United States Patent 9,205,144 (IDENTIFICATION OF CONSERVED PEPTIDE BLOCKS IN HOMOLOGOUS POLYPEPTIDES) - sequence listing, part 4

SEQ ID NO: 102842 - protein, 8 aa, Dengue virus
DCVVKPID

SEQ ID NO: 102843 - protein, 8 aa, Dengue virus
CVVKPIDD

SEQ ID NO: 102844 - protein, 8 aa, Dengue virus
VVKPIDDR

SEQ ID NO: 102845 - protein, 8 aa, Dengue virus
VKPIDDRF

SEQ ID NO: 102846 - protein, 8 aa, Dengue virus
ALTALNDM

SEQ ID NO: 102847 - protein, 8 aa, Dengue virus
LTALNDMG

SEQ ID NO: 102848 - protein, 8 aa, Dengue virus
TALNDMGK

SEQ ID NO: 102849 - protein, 8 aa, Dengue virus
ALNDMGKV

SEQ ID NO: 102850 - protein, 8 aa, Dengue virus
LNDMGKVR

SEQ ID NO: 102851 - protein, 8 aa, Dengue virus
NDMGKVRK

SEQ ID NO: 102852 - protein, 8 aa, Dengue virus
DMGKVRKD

SEQ ID NO: 102853 - protein, 8 aa, Dengue virus
MGKVRKDI

SEQ ID NO: 102854 - protein, 8 aa, Dengue virus
GKVRKDIP

SEQ ID NO: 102855 - protein, 8 aa, Dengue virus
KVRKDIPQ

SEQ ID NO: 102856 - protein, 8 aa, Dengue virus
VRKDIPQW

SEQ ID NO: 102857 - protein, 8 aa, Dengue virus
RKDIPQWE

SEQ ID NO: 102858 - protein, 8 aa, Dengue virus
KDIPQWEP

SEQ ID NO: 102859 - protein, 8 aa, Dengue virus
DIPQWEPS

SEQ ID NO: 102860 - protein, 8 aa, Dengue virus
IPQWEPSK

SEQ ID NO: 102861 - protein, 8 aa, Dengue virus
PQWEPSKG

SEQ ID NO: 102862 - protein, 8 aa, Dengue virus
QWEPSKGW

SEQ ID NO: 102863 - protein, 8 aa, Dengue virus
WEPSKGWN

SEQ ID NO: 102864 - protein, 8 aa, Dengue virus
EPSKGWND

SEQ ID NO: 102865 - protein, 8 aa, Dengue virus
PSKGWNDW

SEQ ID NO: 102866 - protein, 8 aa, Dengue virus
GWNDWQQV

SEQ ID NO: 102867 - protein, 8 aa, Dengue virus
WNDWQQVP

SEQ ID NO: 102868 - protein, 8 aa, Dengue virus
NDWQQVPF

SEQ ID NO: 102869 - protein, 8 aa, Dengue virus
DWQQVPFC

SEQ ID NO: 102870 - protein, 8 aa, Dengue virus
WQQVPFCS

SEQ ID NO: 102871 - protein, 8 aa, Dengue virus
QQVPFCSH

SEQ ID NO: 102872 - protein, 8 aa, Dengue virus
QVPFCSHH

SEQ ID NO: 102873 - protein, 8 aa, Dengue virus
VPFCSHHF

SEQ ID NO: 102874 - protein, 8 aa, Dengue virus
PFCSHHFH

SEQ ID NO: 102875 - protein, 8 aa, Dengue virus
FCSHHFHE

SEQ ID NO: 102876 - protein, 8 aa, Dengue virus
CSHHFHEL

SEQ ID NO: 102877 - protein, 8 aa, Dengue virus
SHHFHQLI

SEQ ID NO: 102878 - protein, 8 aa, Dengue virus
HHFHQLIM

SEQ ID NO: 102879 - protein, 8 aa, Dengue virus
HFHQLIMK

SEQ ID NO: 102880 - protein, 8 aa, Dengue virus
FHQLIMKD

SEQ ID NO: 102881 - protein, 8 aa, Dengue virus
HQLIMKDG

SEQ ID NO: 102882 - protein, 8 aa, Dengue virus
QLIMKDGR

SEQ ID NO: 102883 - protein, 8 aa, Dengue virus
IVVPCRNQ

SEQ ID NO: 102884 - protein, 8 aa, Dengue virus
VVPCRNQD

SEQ ID NO: 102885 - protein, 8 aa, Dengue virus
VPCRNQDE

SEQ ID NO: 102886 - protein, 8 aa, Dengue virus
PCRNQDEL

SEQ ID NO: 102887 - protein, 8 aa, Dengue virus
CRNQDELV

SEQ ID NO: 102888 - protein, 8 aa, Dengue virus
RNQDELVG

SEQ ID NO: 102889 - protein, 8 aa, Dengue virus
NQDELVGR

SEQ ID NO: 102890 - protein, 8 aa, Dengue virus
QDELIGRA

SEQ ID NO: 102891 - protein, 8 aa, Dengue virus
DELIGRAR

SEQ ID NO: 102892 - protein, 8 aa, Dengue virus
ELIGRARI

SEQ ID NO: 102893 - protein, 8 aa, Dengue virus
LIGRARIS

SEQ ID NO: 102894 - protein, 8 aa, Dengue virus
IGRARISQ

SEQ ID NO: 102895 - protein, 8 aa, Dengue virus
GRARISQG

SEQ ID NO: 102896 - protein, 8 aa, Dengue virus
RARISQGA

SEQ ID NO: 102897 - protein, 8 aa, Dengue virus
ARISQGAG

SEQ ID NO: 102898 - protein, 8 aa, Dengue virus
RISQGAGW

SEQ ID NO: 102899 - protein, 8 aa, Dengue virus
ISQGAGWS

SEQ ID NO: 102900 - protein, 8 aa, Dengue virus
SQGAGWSL

SEQ ID NO: 102901 - protein, 8 aa, Dengue virus
QGAGWSLR

SEQ ID NO: 102902 - protein, 8 aa, Dengue virus
GAGWSLRE

SEQ ID NO: 102903 - protein, 8 aa, Dengue virus
AGWSLRET

SEQ ID NO: 102904 - protein, 8 aa, Dengue virus
GWSLRETA

SEQ ID NO: 102905 - protein, 8 aa, Dengue virus
WSLRETAC

SEQ ID NO: 102906 - protein, 8 aa, Dengue virus
SLRETACL

SEQ ID NO: 102907 - protein, 8 aa, Dengue virus
LRETACLG

SEQ ID NO: 102908 - protein, 8 aa, Dengue virus
RETACLGK

SEQ ID NO: 102909 - protein, 8 aa, Dengue virus
ETACLGKS

SEQ ID NO: 102910 - protein, 8 aa, Dengue virus
TACLGKSY

SEQ ID NO: 102911 - protein, 8 aa, Dengue virus
ACLGKSYA

SEQ ID NO: 102912 - protein, 8 aa, Dengue virus
CLGKSYAQ

SEQ ID NO: 102913 - protein, 8 aa, Dengue virus
LGKSYAQM

SEQ ID NO: 102914 - protein, 8 aa, Dengue virus
GKSYAQMW

SEQ ID NO: 102915 - protein, 8 aa, Dengue virus
KSYAQMWQ

SEQ ID NO: 102916 - protein, 8 aa, Dengue virus
SYAQMWQL

SEQ ID NO: 102917 - protein, 8 aa, Dengue virus
YAQMWQLM

SEQ ID NO: 102918 - protein, 8 aa, Dengue virus
AQMWQLMY

SEQ ID NO: 102919 - protein, 8 aa, Dengue virus
QMWQLMYF

SEQ ID NO: 102920 - protein, 8 aa, Dengue virus
MWQLMYFH

SEQ ID NO: 102921 - protein, 8 aa, Dengue virus
WQLMYFHR

SEQ ID NO: 102922 - protein, 8 aa, Dengue virus
QLMYFHRR

SEQ ID NO: 102923 - protein, 8 aa, Dengue virus
LMYFHRRD

SEQ ID NO: 102924 - protein, 8 aa, Dengue virus
MYFHRRDL

SEQ ID NO: 102925 - protein, 8 aa, Dengue virus
YFHRRDLR

SEQ ID NO: 102926 - protein, 8 aa, Dengue virus
FHRRDLRL

SEQ ID NO: 102927 - protein, 8 aa, Dengue virus
HRRDLRLA

SEQ ID NO: 102928 - protein, 8 aa, Dengue virus
RRDLRLAA

SEQ ID NO: 102929 - protein, 8 aa, Dengue virus
RDLRLAAN

SEQ ID NO: 102930 - protein, 8 aa, Dengue virus
DLRLAANA

SEQ ID NO: 102931 - protein, 8 aa, Dengue virus
LRLAANAI

SEQ ID NO: 102932 - protein, 8 aa, Dengue virus
RLAANAIC

SEQ ID NO: 102933 - protein, 8 aa, Dengue virus
LAANAICS

SEQ ID NO: 102934 - protein, 8 aa, Dengue virus
AANAICSA

SEQ ID NO: 102935 - protein, 8 aa, Dengue virus
ANAICSAV

SEQ ID NO: 102936 - protein, 8 aa, Dengue virus
NAICSAVP

SEQ ID NO: 102937 - protein, 8 aa, Dengue virus
AICSAVPV

SEQ ID NO: 102938 - protein, 8 aa, Dengue virus
HWVPTSRT

SEQ ID NO: 102939 - protein, 8 aa, Dengue virus
WVPTSRTT

SEQ ID NO: 102940 - protein, 8 aa, Dengue virus
VPTSRTTW

SEQ ID NO: 102941 - protein, 8 aa, Dengue virus
PTSRTTWS

SEQ ID NO: 102942 - protein, 8 aa, Dengue virus
TSRTTWSI

SEQ ID NO: 102943 - protein, 8 aa, Dengue virus
SRTTWSIH

SEQ ID NO: 102944 - protein, 8 aa, Dengue virus
RTTWSIHA

SEQ ID NO: 102945 - protein, 8 aa, Dengue virus
TTWSIHAH

SEQ ID NO: 102946 - protein, 8 aa, Dengue virus
TWSIHAHH

SEQ ID NO: 102947 - protein, 8 aa, Dengue virus
WSIHAHHQ

SEQ ID NO: 102948 - protein, 8 aa, Dengue virus
SIHAHHQW

SEQ ID NO: 102949 - protein, 8 aa, Dengue virus
IHAHHQWM

SEQ ID NO: 102950 - protein, 8 aa, Dengue virus
HAHHQWMT

SEQ ID NO: 102951 - protein, 8 aa, Dengue virus
AHHQWMTT

SEQ ID NO: 102952 - protein, 8 aa, Dengue virus
HHQWMTTE

SEQ ID NO: 102953 - protein, 8 aa, Dengue virus
HQWMTTED

SEQ ID NO: 102954 - protein, 8 aa, Dengue virus
QWMTTEDM

SEQ ID NO: 102955 - protein, 8 aa, Dengue virus
WMTTEDML

SEQ ID NO: 102956 - protein, 8 aa, Dengue virus
MTTEDMLS

SEQ ID NO: 102957 - protein, 8 aa, Dengue virus
TTEDMLSV

SEQ ID NO: 102958 - protein, 8 aa, Dengue virus
TEDMLSVW

SEQ ID NO: 102959 - protein, 8 aa, Dengue virus
EDMLSVWN

SEQ ID NO: 102960 - protein, 8 aa, Dengue virus
DMLSVWNR

SEQ ID NO: 102961 - protein, 8 aa, Dengue virus
MLSVWNRV

SEQ ID NO: 102962 - protein, 8 aa, Dengue virus
LSVWNRVW

SEQ ID NO: 102963 - protein, 8 aa, Dengue virus
SVWNRVWI

SEQ ID NO: 102964 - protein, 8 aa, Dengue virus
VWNRVWIE

SEQ ID NO: 102965 - protein, 8 aa, Dengue virus
ENPWMEDK

SEQ ID NO: 102966 - protein, 8 aa, Dengue virus
NPWMEDKT

SEQ ID NO: 102967 - protein, 8 aa, Dengue virus
DVPYLGKR

SEQ ID NO: 102968 - protein, 8 aa, Dengue virus
VPYLGKRE

SEQ ID NO: 102969 - protein, 8 aa, Dengue virus
PYLGKRED

SEQ ID NO: 102970 - protein, 8 aa, Dengue virus
YLGKREDQ

SEQ ID NO: 102971 - protein, 8 aa, Dengue virus
LGKREDQW

SEQ ID NO: 102972 - protein, 8 aa, Dengue virus
GKREDQWC

SEQ ID NO: 102973 - protein, 8 aa, Dengue virus
KREDQWCG

SEQ ID NO: 102974 - protein, 8 aa, Dengue virus
REDQWCGS

SEQ ID NO: 102975 - protein, 8 aa, Dengue virus
EDQWCGSL

SEQ ID NO: 102976 - protein, 8 aa, Dengue virus
DQWCGSLI

SEQ ID NO: 102977 - protein, 8 aa, Dengue virus
QWCGSLIG

SEQ ID NO: 102978 - protein, 8 aa, Dengue virus
WCGSLIGL

SEQ ID NO: 102979 - protein, 8 aa, Dengue virus
CGSLIGLT

SEQ ID NO: 102980 - protein, 8 aa, Dengue virus
GSLIGLTS

SEQ ID NO: 102981 - protein, 8 aa, Dengue virus
SLIGLTSR

SEQ ID NO: 102982 - protein, 8 aa, Dengue virus
LIGLTSRA

SEQ ID NO: 102983 - protein, 8 aa, Dengue virus
IGLTSRAT

SEQ ID NO: 102984 - protein, 8 aa, Dengue virus
GLTSRATW

SEQ ID NO: 102985 - protein, 8 aa, Dengue virus
LTSRATWA

SEQ ID NO: 102986 - protein, 8 aa, Dengue virus
TARATWAT

SEQ ID NO: 102987 - protein, 8 aa, Dengue virus
ARATWATN

SEQ ID NO: 102988 - protein, 8 aa, Dengue virus
RATWATNI

SEQ ID NO: 102989 - protein, 8 aa, Dengue virus
AINQVRRL

SEQ ID NO: 102990 - protein, 8 aa, Dengue virus
DYMPSMKR

SEQ ID NO: 102991 - protein, 8 aa, Dengue virus
YMPSMKRF

SEQ ID NO: 102992 - protein, 8 aa, Dengue virus
MPSMKRFR

SEQ ID NO: 102993 - protein, 8 aa, Dengue virus
MNNQRKKA

SEQ ID NO: 102994 - protein, 8 aa, Dengue virus
TPFNMLKR

SEQ ID NO: 102995 - protein, 8 aa, Dengue virus
PFNMLKRE

SEQ ID NO: 102996 - protein, 8 aa, Dengue virus
FNMLKRER

SEQ ID NO: 102997 - protein, 8 aa, Dengue virus
NMLKRERN

SEQ ID NO: 102998 - protein, 8 aa, Dengue virus
MLKRERNR

SEQ ID NO: 102999 - protein, 8 aa, Dengue virus
LKRERNRV

SEQ ID NO: 103000 - protein, 8 aa, Dengue virus
KRERNRVS

SEQ ID NO: 103001 - protein, 8 aa, Dengue virus
RERNRVST

SEQ ID NO: 103002 - protein, 8 aa, Dengue virus
RNRVSTVQ

SEQ ID NO: 103003 - protein, 8 aa, Dengue virus
NRVSTVQQ

SEQ ID NO: 103004 - protein, 8 aa, Dengue virus
RVSTVQQL

SEQ ID NO: 103005 - protein, 8 aa, Dengue virus
VSTVQQLT

SEQ ID NO: 103006 - protein, 8 aa, Dengue virus
STVQQLTK

SEQ ID NO: 103007 - protein, 8 aa, Dengue virus
TVQQLTKR

SEQ ID NO: 103008 - protein, 8 aa, Dengue virus
VQQLTKRF

SEQ ID NO: 103009 - protein, 8 aa, Dengue virus
QQLTKRFS

SEQ ID NO: 103010 - protein, 8 aa, Dengue virus
QLTKRFSL

SEQ ID NO: 103011 - protein, 8 aa, Dengue virus
LTKRFSLG

SEQ ID NO: 103012 - protein, 8 aa, Dengue virus
TKRFSLGM

SEQ ID NO: 103013 - protein, 8 aa, Dengue virus
KRFSLGML

SEQ ID NO: 103014 - protein, 8 aa, Dengue virus
RFSLGMLQ

SEQ ID NO: 103015 - protein, 8 aa, Dengue virus
FSLGMLQG

SEQ ID NO: 103016 - protein, 8 aa, Dengue virus
SLGMLQGR

SEQ ID NO: 103017 - protein, 8 aa, Dengue virus
LGMLQGRG

SEQ ID NO: 103018 - protein, 8 aa, Dengue virus
GMLQGRGP

SEQ ID NO: 103019 - protein, 8 aa, Dengue virus
MLQGRGPL

SEQ ID NO: 103020 - protein, 8 aa, Dengue virus
LQGRGPLK

SEQ ID NO: 103021 - protein, 8 aa, Dengue virus
GRGPLKLF

SEQ ID NO: 103022 - protein, 8 aa, Dengue virus
RGPLKLFM

SEQ ID NO: 103023 - protein, 8 aa, Dengue virus
GPLKLFMA

SEQ ID NO: 103024 - protein, 8 aa, Dengue virus
PLKLFMAL

SEQ ID NO: 103025 - protein, 8 aa, Dengue virus
KLFMALVA

SEQ ID NO: 103026 - protein, 8 aa, Dengue virus
LFMALVAF

SEQ ID NO: 103027 - protein, 8 aa, Dengue virus
FMALVAFL

SEQ ID NO: 103028 - protein, 8 aa, Dengue virus
MALVAFLR

SEQ ID NO: 103029 - protein, 8 aa, Dengue virus
ALVAFLRF

SEQ ID NO: 103030 - protein, 8 aa, Dengue virus
LVAFLRFL

SEQ ID NO: 103031 - protein, 8 aa, Dengue virus
VAFLRFLT

SEQ ID NO: 103032 - protein, 8 aa, Dengue virus
AFLRFLTI

SEQ ID NO: 103033 - protein, 8 aa, Dengue virus
FLRFLTIP

SEQ ID NO: 103034 - protein, 8 aa, Dengue virus
LRFLTIPP

SEQ ID NO: 103035 - protein, 8 aa, Dengue virus
RFLTIPPT

SEQ ID NO: 103036 - protein, 8 aa, Dengue virus
FLTIPPTA

SEQ ID NO: 103037 - protein, 8 aa, Dengue virus
LTIPPTAG

SEQ ID NO: 103038 - protein, 8 aa, Dengue virus
TIPPTAGI

SEQ ID NO: 103039 - protein, 8 aa, Dengue virus
IPPTAGVL

SEQ ID NO: 103040 - protein, 8 aa, Dengue virus
PPTAGILK

SEQ ID NO: 103041 - protein, 8 aa, Dengue virus
PTAGILKR

SEQ ID NO: 103042 - protein, 8 aa, Dengue virus
TAGILKRW

SEQ ID NO: 103043 - protein, 8 aa, Dengue virus
AGILKRWG

SEQ ID NO: 103044 - protein, 8 aa, Dengue virus
GFRKEIGR

SEQ ID NO: 103045 - protein, 8 aa, Dengue virus
FRKEIGRM

SEQ ID NO: 103046 - protein, 8 aa, Dengue virus
RKEIGRML

SEQ ID NO: 103047 - protein, 8 aa, Dengue virus
AFHLTTRN

SEQ ID NO: 103048 - protein, 8 aa, Dengue virus
FHLTTRNG

SEQ ID NO: 103049 - protein, 8 aa, Dengue virus
HLTTRNGE

SEQ ID NO: 103050 - protein, 8 aa, Dengue virus
LTTRNGEP

SEQ ID NO: 103051 - protein, 8 aa, Dengue virus
TTRNGEPH

SEQ ID NO: 103052 - protein, 8 aa, Dengue virus
TRNGEPHM

SEQ ID NO: 103053 - protein, 8 aa, Dengue virus
RNGEPHMI

SEQ ID NO: 103054 - protein, 8 aa, Dengue virus
NGEPHMIV

SEQ ID NO: 103055 - protein, 8 aa, Dengue virus
QEKGKSLL

SEQ ID NO: 103056 - protein, 8 aa, Dengue virus
EKGKSLLF

SEQ ID NO: 103057 - protein, 8 aa, Dengue virus
KGKSLLFK

SEQ ID NO: 103058 - protein, 8 aa, Dengue virus
GRPLLFKT

SEQ ID NO: 103059 - protein, 8 aa, Dengue virus
KSLLFKTE

SEQ ID NO: 103060 - protein, 8 aa, Dengue virus
NMCTLMAI

SEQ ID NO: 103061 - protein, 8 aa, Dengue virus
MCTLMAID

SEQ ID NO: 103062 - protein, 8 aa, Dengue virus
CTLMAIDL

SEQ ID NO: 103063 - protein, 8 aa, Dengue virus
TLMAIDLG

SEQ ID NO: 103064 - protein, 8 aa, Dengue virus
LMAIDLGE

SEQ ID NO: 103065 - protein, 8 aa, Dengue virus
IAMDLGEM

SEQ ID NO: 103066 - protein, 8 aa, Dengue virus
AMDLGEMC

SEQ ID NO: 103067 - protein, 8 aa, Dengue virus
MDLGEMCD

SEQ ID NO: 103068 - protein, 8 aa, Dengue virus
DLGEMCDD

SEQ ID NO: 103069 - protein, 8 aa, Dengue virus
LGEMCDDT

SEQ ID NO: 103070 - protein, 8 aa, Dengue virus
DTITYKCP

SEQ ID NO: 103071 - protein, 8 aa, Dengue virus
EPDDVDCW

SEQ ID NO: 103072 - protein, 8 aa, Dengue virus
PDDVDCWC

SEQ ID NO: 103073 - protein, 8 aa, Dengue virus
DDVDCWCN

SEQ ID NO: 103074 - protein, 8 aa, Dengue virus
DIDCWCNS

SEQ ID NO: 103075 - protein, 8 aa, Dengue virus
IDCWCNST

SEQ ID NO: 103076 - protein, 8 aa, Dengue virus
DCWCNSTS

SEQ ID NO: 103077 - protein, 8 aa, Dengue virus
CWCNSTST

SEQ ID NO: 103078 - protein, 8 aa, Dengue virus
WCNSTSTW

SEQ ID NO: 103079 - protein, 8 aa, Dengue virus
TDTWVTYG

SEQ ID NO: 103080 - protein, 8 aa, Dengue virus
DTWVTYGT

SEQ ID NO: 103081 - protein, 8 aa, Dengue virus
TWVMYGTC

SEQ ID NO: 103082 - protein, 8 aa, Dengue virus
WVTYGTCT

SEQ ID NO: 103083 - protein, 8 aa, Dengue virus
GEHRREKR

SEQ ID NO: 103084 - protein, 8 aa, Dengue virus
EHRREKRS

SEQ ID NO: 103085 - protein, 8 aa, Dengue virus
HRREKRSV

SEQ ID NO: 103086 - protein, 8 aa, Dengue virus
RREKRSVA

SEQ ID NO: 103087 - protein, 8 aa, Dengue virus
REKRSVAL

SEQ ID NO: 103088 - protein, 8 aa, Dengue virus
EKRSVALV

SEQ ID NO: 103089 - protein, 8 aa, Dengue virus
KRSVALVP

SEQ ID NO: 103090 - protein, 8 aa, Dengue virus
RSVALVPH

SEQ ID NO: 103091 - protein, 8 aa, Dengue virus
SVALVPHV

SEQ ID NO: 103092 - protein, 8 aa, Dengue virus
VALVPHVG

SEQ ID NO: 103093 - protein, 8 aa, Dengue virus
ALVPHVGM

SEQ ID NO: 103094 - protein, 8 aa, Dengue virus
LVPHVGMG

SEQ ID NO: 103095 - protein, 8 aa, Dengue virus
VPHVGMGL

SEQ ID NO: 103096 - protein, 8 aa, Dengue virus
PHVGMGLE

SEQ ID NO: 103097 - protein, 8 aa, Dengue virus
HVGMGLET

SEQ ID NO: 103098 - protein, 8 aa, Dengue virus
VGMGLETR

SEQ ID NO: 103099 - protein, 8 aa, Dengue virus
GLDTRTQT

SEQ ID NO: 103100 - protein, 8 aa, Dengue virus
LDTRTQTW

SEQ ID NO: 103101 - protein, 8 aa, Dengue virus
DTRTQTWM

SEQ ID NO: 103102 - protein, 8 aa, Dengue virus
TRTQTWMS

SEQ ID NO: 103103 - protein, 8 aa, Dengue virus
RTQTWMSA

SEQ ID NO: 103104 - protein, 8 aa, Dengue virus
TQTWMSAE

SEQ ID NO: 103105 - protein, 8 aa, Dengue virus
QTWMSAEG

SEQ ID NO: 103106 - protein, 8 aa, Dengue virus
TWMSAEGA

SEQ ID NO: 103107 - protein, 8 aa, Dengue virus
WMSAEGAW

SEQ ID NO: 103108 - protein, 8 aa, Dengue virus
MSAEGAWR

SEQ ID NO: 103109 - protein, 8 aa, Dengue virus
SSEGAWKH

SEQ ID NO: 103110 - protein, 8 aa, Dengue virus
AEGAWRQV

SEQ ID NO: 103111 - protein, 8 aa, Dengue virus
EGAWRQVE

SEQ ID NO: 103112 - protein, 8 aa, Dengue virus
IETWILRH

SEQ ID NO: 103113 - protein, 8 aa, Dengue virus
ETWILRHP

SEQ ID NO: 103114 - protein, 8 aa, Dengue virus
TWILRHPG

SEQ ID NO: 103115 - protein, 8 aa, Dengue virus
WILRHPGF

SEQ ID NO: 103116 - protein, 8 aa, Dengue virus
ILRHPGFT

SEQ ID NO: 103117 - protein, 8 aa, Dengue virus
VAPSMTMR

SEQ ID NO: 103118 - protein, 8 aa, Dengue virus
APSMTMRC

SEQ ID NO: 103119 - protein, 8 aa, Dengue virus
PSMTMRCI

SEQ ID NO: 103120 - protein, 8 aa, Dengue virus
SMTMRCIG

SEQ ID NO: 103121 - protein, 8 aa, Dengue virus
MRCIGISN

SEQ ID NO: 103122 - protein, 8 aa, Dengue virus
RCIGISNR

SEQ ID NO: 103123 - protein, 8 aa, Dengue virus
CIGISNRD

SEQ ID NO: 103124 - protein, 8 aa, Dengue virus
IGISNRDF

SEQ ID NO: 103125 - protein, 8 aa, Dengue virus
GISNRDFV

SEQ ID NO: 103126 - protein, 8 aa, Dengue virus
ISNRDFVE

SEQ ID NO: 103127 - protein, 8 aa, Dengue virus
GSRDFVEG

SEQ ID NO: 103128 - protein, 8 aa, Dengue virus
SRDFVEGL

SEQ ID NO: 103129 - protein, 8 aa, Dengue virus
RDFVEGVS

SEQ ID NO: 103130 - protein, 8 aa, Dengue virus
DFVEGVSG

SEQ ID NO: 103131 - protein, 8 aa, Dengue virus
FVEGVSGG

SEQ ID NO: 103132 - protein, 8 aa, Dengue virus
VEGVSGGS

SEQ ID NO: 103133 - protein, 8 aa, Dengue virus
EGVSGGSW

SEQ ID NO: 103134 - protein, 8 aa, Dengue virus
GVSGGSWV

SEQ ID NO: 103135 - protein, 8 aa, Dengue virus
VSGGSWVD

SEQ ID NO: 103136 - protein, 8 aa, Dengue virus
SGGSWVDI

SEQ ID NO: 103137 - protein, 8 aa, Dengue virus
GGSWVDIV

SEQ ID NO: 103138 - protein, 8 aa, Dengue virus
GSWVDIVL

SEQ ID NO: 103139 - protein, 8 aa, Dengue virus
SWVDIVLE

SEQ ID NO: 103140 - protein, 8 aa, Dengue virus
WVDIVLEH

SEQ ID NO: 103141 - protein, 8 aa, Dengue virus
VDIVLEHG

SEQ ID NO: 103142 - protein, 8 aa, Dengue virus
DIVLEHGS

SEQ ID NO: 103143 - protein, 8 aa, Dengue virus
IVLEHGSC

SEQ ID NO: 103144 - protein, 8 aa, Dengue virus
VLEHGGCV

SEQ ID NO: 103145 - protein, 8 aa, Dengue virus
LEHGGCVT

SEQ ID NO: 103146 - protein, 8 aa, Dengue virus
EHGGCVTT

SEQ ID NO: 103147 - protein, 8 aa, Dengue virus
HGGCVTTM

SEQ ID NO: 103148 - protein, 8 aa, Dengue virus
GGCVTTMA

SEQ ID NO: 103149 - protein, 8 aa, Dengue virus
GCVTTMAK

SEQ ID NO: 103150 - protein, 8 aa, Dengue virus
CVTTMAKD

SEQ ID NO: 103151 - protein, 8 aa, Dengue virus
VTTMAKDK

SEQ ID NO: 103152 - protein, 8 aa, Dengue virus
TTMAKDKP

SEQ ID NO: 103153 - protein, 8 aa, Dengue virus
TMAKDKPT

SEQ ID NO: 103154 - protein, 8 aa, Dengue virus
MAKDKPTL

SEQ ID NO: 103155 - protein, 8 aa, Dengue virus
AKDKPTLD

SEQ ID NO: 103156 - protein, 8 aa, Dengue virus
KNKPTLDF

SEQ ID NO: 103157 - protein, 8 aa, Dengue virus
NKPTLDFE

SEQ ID NO: 103158 - protein, 8 aa, Dengue virus
KPTLDFEL

SEQ ID NO: 103159 - protein, 8 aa, Dengue virus
PTLDFELI

SEQ ID NO: 103160 - protein, 8 aa, Dengue virus
TLDFELIK

SEQ ID NO: 103161 - protein, 8 aa, Dengue virus
LDFELIKT

SEQ ID NO: 103162 - protein, 8 aa, Dengue virus
DFELIKTE

SEQ ID NO: 103163 - protein, 8 aa, Dengue virus
FELIKTEA

SEQ ID NO: 103164 - protein, 8 aa, Dengue virus
ELIKTEAK

SEQ ID NO: 103165 - protein, 8 aa, Dengue virus
LRKYCIEA

SEQ ID NO: 103166 - protein, 8 aa, Dengue virus
CIEAKLTN

SEQ ID NO: 103167 - protein, 8 aa, Dengue virus
TTESRCPT

SEQ ID NO: 103168 - protein, 8 aa, Dengue virus
TESRCPTQ

SEQ ID NO: 103169 - protein, 8 aa, Dengue virus
ESRCPTQG

SEQ ID NO: 103170 - protein, 8 aa, Dengue virus
TRCPTQGE

SEQ ID NO: 103171 - protein, 8 aa, Dengue virus
RCPTQGEP

SEQ ID NO: 103172 - protein, 8 aa, Dengue virus
CKHSMVDR

SEQ ID NO: 103173 - protein, 8 aa, Dengue virus
KHSMVDRG

SEQ ID NO: 103174 - protein, 8 aa, Dengue virus
HSMVDRGW

SEQ ID NO: 103175 - protein, 8 aa, Dengue virus
SMVDRGWG

SEQ ID NO: 103176 - protein, 8 aa, Dengue virus
MVDRGWGN

SEQ ID NO: 103177 - protein, 8 aa, Dengue virus
CGLFGKGG

SEQ ID NO: 103178 - protein, 8 aa, Dengue virus
GLFGKGGI

SEQ ID NO: 103179 - protein, 8 aa, Dengue virus
LFGKGGIV

SEQ ID NO: 103180 - protein, 8 aa, Dengue virus
FGKGGIVT

SEQ ID NO: 103181 - protein, 8 aa, Dengue virus
GKGGIVTC

SEQ ID NO: 103182 - protein, 8 aa, Dengue virus
KGGIVTCA

SEQ ID NO: 103183 - protein, 8 aa, Dengue virus
GGIVTCAM

SEQ ID NO: 103184 - protein, 8 aa, Dengue virus
GIVTCAMF

SEQ ID NO: 103185 - protein, 8 aa, Dengue virus
VQPENLEY

SEQ ID NO: 103186 - protein, 8 aa, Dengue virus
ENLEYTIV

SEQ ID NO: 103187 - protein, 8 aa, Dengue virus
VITPHSGE

SEQ ID NO: 103188 - protein, 8 aa, Dengue virus
ITPHSGEE

SEQ ID NO: 103189 - protein, 8 aa, Dengue virus
TPHSGEEH

SEQ ID NO: 103190 - protein, 8 aa, Dengue virus
PHSGEEHA

SEQ ID NO: 103191 - protein, 8 aa, Dengue virus
HSGEEHAV

SEQ ID NO: 103192 - protein, 8 aa, Dengue virus
SGEEHAVG

SEQ ID NO: 103193 - protein, 8 aa, Dengue virus
GEEHAVGN

SEQ ID NO: 103194 - protein, 8 aa, Dengue virus
EEHAVGND

SEQ ID NO: 103195 - protein, 8 aa, Dengue virus
VTMECSPR

SEQ ID NO: 103196 - protein, 8 aa, Dengue virus
TMECSPRT

SEQ ID NO: 103197 - protein, 8 aa, Dengue virus
MECSPRTG

SEQ ID NO: 103198 - protein, 8 aa, Dengue virus
DCSPRTGL

SEQ ID NO: 103199 - protein, 8 aa, Dengue virus
CEPRSGID

SEQ ID NO: 103200 - protein, 8 aa, Dengue virus
EPRSGIDF

SEQ ID NO: 103201 - protein, 8 aa, Dengue virus
PRSGIDFN

SEQ ID NO: 103202 - protein, 8 aa, Dengue virus
RSGIDFNE

SEQ ID NO: 103203 - protein, 8 aa, Dengue virus
SGIDFNEM

SEQ ID NO: 103204 - protein, 8 aa, Dengue virus
GLDFNEMI

SEQ ID NO: 103205 - protein, 8 aa, Dengue virus
LDFNEMIL

SEQ ID NO: 103206 - protein, 8 aa, Dengue virus
DFNEMILL

SEQ ID NO: 103207 - protein, 8 aa, Dengue virus
FNEMVLLQ

SEQ ID NO: 103208 - protein, 8 aa, Dengue virus
NEMVLLQM

SEQ ID NO: 103209 - protein, 8 aa, Dengue virus
EMVLLQME

SEQ ID NO: 103210 - protein, 8 aa, Dengue virus
KAWLVHRQ

SEQ ID NO: 103211 - protein, 8 aa, Dengue virus
AWLVHRQW

SEQ ID NO: 103212 - protein, 8 aa, Dengue virus
WLVHRQWF

SEQ ID NO: 103213 - protein, 8 aa, Dengue virus
LVHRQWFL

SEQ ID NO: 103214 - protein, 8 aa, Dengue virus
VHRQWFLD

SEQ ID NO: 103215 - protein, 8 aa, Dengue virus
HRQWFLDL

SEQ ID NO: 103216 - protein, 8 aa, Dengue virus
RQWFLDLP

SEQ ID NO: 103217 - protein, 8 aa, Dengue virus
QWFFDLPL

SEQ ID NO: 103218 - protein, 8 aa, Dengue virus
WFFDLPLP

SEQ ID NO: 103219 - protein, 8 aa, Dengue virus
FFDLPLPW

SEQ ID NO: 103220 - protein, 8 aa, Dengue virus
LDLPLPWL

SEQ ID NO: 103221 - protein, 8 aa, Dengue virus
DLPLPWLP

SEQ ID NO: 103222 - protein, 8 aa, Dengue virus
LPLPWLPG

SEQ ID NO: 103223 - protein, 8 aa, Dengue virus
PLPWLPGA

SEQ ID NO: 103224 - protein, 8 aa, Dengue virus
KETLVTFK

SEQ ID NO: 103225 - protein, 8 aa, Dengue virus
ETLVTFKN

SEQ ID NO: 103226 - protein, 8 aa, Dengue virus
TLVTFKNP

SEQ ID NO: 103227 - protein, 8 aa, Dengue virus
LVTFKNPH

SEQ ID NO: 103228 - protein, 8 aa, Dengue virus
VTFKNPHA

SEQ ID NO: 103229 - protein, 8 aa, Dengue virus
TFKNPHAK

SEQ ID NO: 103230 - protein, 8 aa, Dengue virus
FKNPHAKK

SEQ ID NO: 103231 - protein, 8 aa, Dengue virus
KNPHAKKQ

SEQ ID NO: 103232 - protein, 8 aa, Dengue virus
NPHAKKQD

SEQ ID NO: 103233 - protein, 8 aa, Dengue virus
PHAKKQDV

SEQ ID NO: 103234 - protein, 8 aa, Dengue virus
HAKKQDVV

SEQ ID NO: 103235 - protein, 8 aa, Dengue virus
AKKQDVVV

SEQ ID NO: 103236 - protein, 8 aa, Dengue virus
KKQDVVVL

SEQ ID NO: 103237 - protein, 8 aa, Dengue virus
KQDVVVLG

SEQ ID NO: 103238 - protein, 8 aa, Dengue virus
QDVVVLGS

SEQ ID NO: 103239 - protein, 8 aa, Dengue virus
DVVVLGSQ

SEQ ID NO: 103240 - protein, 8 aa, Dengue virus
VTVLGSQE

SEQ ID NO: 103241 - protein, 8 aa, Dengue virus
TVLGSQEG

SEQ ID NO: 103242 - protein, 8 aa, Dengue virus
SQEGAMHS

SEQ ID NO: 103243 - protein, 8 aa, Dengue virus
QEGAMHSA

SEQ ID NO: 103244 - protein, 8 aa, Dengue virus
EGAMHSAL

SEQ ID NO: 103245 - protein, 8 aa, Dengue virus
GAMHSALA

SEQ ID NO: 103246 - protein, 8 aa, Dengue virus
AMHSALAG

SEQ ID NO: 103247 - protein, 8 aa, Dengue virus
MHSALAGA

SEQ ID NO: 103248 - protein, 8 aa, Dengue virus
HSALAGAT

SEQ ID NO: 103249 - protein, 8 aa, Dengue virus
SALAGATE

SEQ ID NO: 103250 - protein, 8 aa, Dengue virus
ALAGATEV

SEQ ID NO: 103251 - protein, 8 aa, Dengue virus
LAGATEVD

SEQ ID NO: 103252 - protein, 8 aa, Dengue virus
TGATEIQM

SEQ ID NO: 103253 - protein, 8 aa, Dengue virus
GATEIQMS

SEQ ID NO: 103254 - protein, 8 aa, Dengue virus
ATEIQMSS

SEQ ID NO: 103255 - protein, 8 aa, Dengue virus
EIQMSSGN

SEQ ID NO: 103256 - protein, 8 aa, Dengue virus
SGNLLFTG

SEQ ID NO: 103257 - protein, 8 aa, Dengue virus
GNLLFTGH

SEQ ID NO: 103258 - protein, 8 aa, Dengue virus
NLLFTGHL

SEQ ID NO: 103259 - protein, 8 aa, Dengue virus
LLFTGHLK

SEQ ID NO: 103260 - protein, 8 aa, Dengue virus
LFTGHLKC

SEQ ID NO: 103261 - protein, 8 aa, Dengue virus
FTGHLKCR

SEQ ID NO: 103262 - protein, 8 aa, Dengue virus
TGHLKCRL

SEQ ID NO: 103263 - protein, 8 aa, Dengue virus
GHLKCRLR

SEQ ID NO: 103264 - protein, 8 aa, Dengue virus
HLKCRLRM

SEQ ID NO: 103265 - protein, 8 aa, Dengue virus
LKCRLRMD

SEQ ID NO: 103266 - protein, 8 aa, Dengue virus
KCRLRMDK

SEQ ID NO: 103267 - protein, 8 aa, Dengue virus
CRLRMDKL

SEQ ID NO: 103268 - protein, 8 aa, Dengue virus
RLRMDKLQ

SEQ ID NO: 103269 - protein, 8 aa, Dengue virus
LRMDKLQL

SEQ ID NO: 103270 - protein, 8 aa, Dengue virus
RMDKLQLK

SEQ ID NO: 103271 - protein, 8 aa, Dengue virus
MDKLQLKG

SEQ ID NO: 103272 - protein, 8 aa, Dengue virus
VKEIAETQ

SEQ ID NO: 103273 - protein, 8 aa, Dengue virus
KEIAETQH

SEQ ID NO: 103274 - protein, 8 aa, Dengue virus
EIAETQHG

SEQ ID NO: 103275 - protein, 8 aa, Dengue virus
IAETQHGT

SEQ ID NO: 103276 - protein, 8 aa, Dengue virus
AETQHGTI

SEQ ID NO: 103277 - protein, 8 aa, Dengue virus
ETQHGTIV

SEQ ID NO: 103278 - protein, 8 aa, Dengue virus
TQHGTIVI

SEQ ID NO: 103279 - protein, 8 aa, Dengue virus
QHGTIVIR

SEQ ID NO: 103280 - protein, 8 aa, Dengue virus
PVNIETEP

SEQ ID NO: 103281 - protein, 8 aa, Dengue virus
VNIETEPP

SEQ ID NO: 103282 - protein, 8 aa, Dengue virus
NIETEPPF

SEQ ID NO: 103283 - protein, 8 aa, Dengue virus
IETEPPFG

SEQ ID NO: 103284 - protein, 8 aa, Dengue virus
EAEPPFGD

SEQ ID NO: 103285 - protein, 8 aa, Dengue virus
AEPPFGDS

SEQ ID NO: 103286 - protein, 8 aa, Dengue virus
EPPFGDSY

SEQ ID NO: 103287 - protein, 8 aa, Dengue virus
PPFGDSYI

SEQ ID NO: 103288 - protein, 8 aa, Dengue virus
WYKKGSSI

SEQ ID NO: 103289 - protein, 8 aa, Dengue virus
YKKGSSIG

SEQ ID NO: 103290 - protein, 8 aa, Dengue virus
KKGSSIGQ

SEQ ID NO: 103291 - protein, 8 aa, Dengue virus
KGSSIGQM

SEQ ID NO: 103292 - protein, 8 aa, Dengue virus
GSSIGQMF

SEQ ID NO: 103293 - protein, 8 aa, Dengue virus
SSIGQMFE

SEQ ID NO: 103294 - protein, 8 aa, Dengue virus
SIGQMFET

SEQ ID NO: 103295 - protein, 8 aa, Dengue virus
IGQMFETT

SEQ ID NO: 103296 - protein, 8 aa, Dengue virus
GQMFETTM

SEQ ID NO: 103297 - protein, 8 aa, Dengue virus
QMFETTMR

SEQ ID NO: 103298 - protein, 8 aa, Dengue virus
MFETTMRG

SEQ ID NO: 103299 - protein, 8 aa, Dengue virus
FETTMRGA

SEQ ID NO: 103300 - protein, 8 aa, Dengue virus
ETTMRGAK

SEQ ID NO: 103301 - protein, 8 aa, Dengue virus
TTMRGAKR

SEQ ID NO: 103302 - protein, 8 aa, Dengue virus
TMRGAKRM

SEQ ID NO: 103303 - protein, 8 aa, Dengue virus
MRGAKRMA

SEQ ID NO: 103304 - protein, 8 aa, Dengue virus
RGAKRMAI

SEQ ID NO: 103305 - protein, 8 aa, Dengue virus
GAKRMAIL

SEQ ID NO: 103306 - protein, 8 aa, Dengue virus
AKRMAILG

SEQ ID NO: 103307 - protein, 8 aa, Dengue virus
KRMAILGD

SEQ ID NO: 103308 - protein, 8 aa, Dengue virus
RMAILGET

SEQ ID NO: 103309 - protein, 8 aa, Dengue virus
MAILGETA

SEQ ID NO: 103310 - protein, 8 aa, Dengue virus
AILGETAW

SEQ ID NO: 103311 - protein, 8 aa, Dengue virus
ILGETAWD

SEQ ID NO: 103312 - protein, 8 aa, Dengue virus
LGETAWDF

SEQ ID NO: 103313 - protein, 8 aa, Dengue virus
GETAWDFG

SEQ ID NO: 103314 - protein, 8 aa, Dengue virus
ETAWDFGS

SEQ ID NO: 103315 - protein, 8 aa, Dengue virus
TAWDFGSL

SEQ ID NO: 103316 - protein, 8 aa, Dengue virus
AWDFGSLG

SEQ ID NO: 103317 - protein, 8 aa, Dengue virus
WDFGSLGG

SEQ ID NO: 103318 - protein, 8 aa, Dengue virus
DFGSLGGV

SEQ ID NO: 103319 - protein, 8 aa, Dengue virus
FGAIYGAA

SEQ ID NO: 103320 - protein, 8 aa, Dengue virus
GAIYGAAF

SEQ ID NO: 103321 - protein, 8 aa, Dengue virus
IYGAAFSG

SEQ ID NO: 103322 - protein, 8 aa, Dengue virus
YGAAFSGV

SEQ ID NO: 103323 - protein, 8 aa, Dengue virus
GAAFSGVS

SEQ ID NO: 103324 - protein, 8 aa, Dengue virus
AAFSGVSW

SEQ ID NO: 103325 - protein, 8 aa, Dengue virus
FSGVSWVM

SEQ ID NO: 103326 - protein, 8 aa, Dengue virus
SGVSWVMK

SEQ ID NO: 103327 - protein, 8 aa, Dengue virus
GVSWVMKI

SEQ ID NO: 103328 - protein, 8 aa, Dengue virus
IITWIGMN

SEQ ID NO: 103329 - protein, 8 aa, Dengue virus
ITWIGMNS

SEQ ID NO: 103330 - protein, 8 aa, Dengue virus
TWIGMNSR

SEQ ID NO: 103331 - protein, 8 aa, Dengue virus
WIGMNSRS

SEQ ID NO: 103332 - protein, 8 aa, Dengue virus
IGMNSRST

SEQ ID NO: 103333 - protein, 8 aa, Dengue virus
GMNSRSTS

SEQ ID NO: 103334 - protein, 8 aa, Dengue virus
NSKNTSMS

SEQ ID NO: 103335 - protein, 8 aa, Dengue virus
TLYLGAVV

SEQ ID NO: 103336 - protein, 8 aa, Dengue virus
LYLGAVVQ

SEQ ID NO: 103337 - protein, 8 aa, Dengue virus
YLGAVVQA

SEQ ID NO: 103338 - protein, 8 aa, Dengue virus
LGAVVQAD

SEQ ID NO: 103339 - protein, 8 aa, Dengue virus
VQADMGCV

SEQ ID NO: 103340 - protein, 8 aa, Dengue virus
NKELKCGS

SEQ ID NO: 103341 - protein, 8 aa, Dengue virus
RELKCGSG

SEQ ID NO: 103342 - protein, 8 aa, Dengue virus
KCGSGIFI

SEQ ID NO: 103343 - protein, 8 aa, Dengue virus
CGSGIFIT

SEQ ID NO: 103344 - protein, 8 aa, Dengue virus
GSGIFITD

SEQ ID NO: 103345 - protein, 8 aa, Dengue virus
SGIFITDN

SEQ ID NO: 103346 - protein, 8 aa, Dengue virus
GIFITDNV

SEQ ID NO: 103347 - protein, 8 aa, Dengue virus
IFITDNVH

SEQ ID NO: 103348 - protein, 8 aa, Dengue virus
FITDNVHT

SEQ ID NO: 103349 - protein, 8 aa, Dengue virus
ITDNVHTW

SEQ ID NO: 103350 - protein, 8 aa, Dengue virus
TDNVHTWT

SEQ ID NO: 103351 - protein, 8 aa, Dengue virus
DNVHTWTE

SEQ ID NO: 103352 - protein, 8 aa, Dengue virus
NVHTWTEQ

SEQ ID NO: 103353 - protein, 8 aa, Dengue virus
TEQYKFQP

SEQ ID NO: 103354 - protein, 8 aa, Dengue virus
EQYKFQPE

SEQ ID NO: 103355 - protein, 8 aa, Dengue virus
QYKFQPES

SEQ ID NO: 103356 - protein, 8 aa, Dengue virus
YKFQPESP

SEQ ID NO: 103357 - protein, 8 aa, Dengue virus
KFQPESPS

SEQ ID NO: 103358 - protein, 8 aa, Dengue virus
FQPESPSK

SEQ ID NO: 103359 - protein, 8 aa, Dengue virus
QPESPSKL

SEQ ID NO: 103360 - protein, 8 aa, Dengue virus
PESPSKLA

SEQ ID NO: 103361 - protein, 8 aa, Dengue virus
ESPSKLAS

SEQ ID NO: 103362 - protein, 8 aa, Dengue virus
SPSKLASA

SEQ ID NO: 103363 - protein, 8 aa, Dengue virus
PSKLASAI

SEQ ID NO: 103364 - protein, 8 aa, Dengue virus
SKLASAIQ

SEQ ID NO: 103365 - protein, 8 aa, Dengue virus
KLASAIQK

SEQ ID NO: 103366 - protein, 8 aa, Dengue virus
LASAIQKA

SEQ ID NO: 103367 - protein, 8 aa, Dengue virus
ASAIQKAH

SEQ ID NO: 103368 - protein, 8 aa, Dengue virus
EEGICGIR

SEQ ID NO: 103369 - protein, 8 aa, Dengue virus
EGICGIRS

SEQ ID NO: 103370 - protein, 8 aa, Dengue virus
GICGIRSV

SEQ ID NO: 103371 - protein, 8 aa, Dengue virus
ICGIRSVT

SEQ ID NO: 103372 - protein, 8 aa, Dengue virus
CGIRSVTR

SEQ ID NO: 103373 - protein, 8 aa, Dengue virus
GIRSVTRL

SEQ ID NO: 103374 - protein, 8 aa, Dengue virus
IRSVTRLE

SEQ ID NO: 103375 - protein, 8 aa, Dengue virus
RSVTRLEN

SEQ ID NO: 103376 - protein, 8 aa, Dengue virus
SVTRLENL

SEQ ID NO: 103377 - protein, 8 aa, Dengue virus
VTRLENLM

SEQ ID NO: 103378 - protein, 8 aa, Dengue virus
TRLENLMW

SEQ ID NO: 103379 - protein, 8 aa, Dengue virus
RLENLMWK

SEQ ID NO: 103380 - protein, 8 aa, Dengue virus
LENLMWKQ

SEQ ID NO: 103381 - protein, 8 aa, Dengue virus
ENLMWKQI

SEQ ID NO: 103382 - protein, 8 aa, Dengue virus
TPELNHIL

SEQ ID NO: 103383 - protein, 8 aa, Dengue virus
ELNHILSE

SEQ ID NO: 103384 - protein, 8 aa, Dengue virus
LNHILSEN

SEQ ID NO: 103385 - protein, 8 aa, Dengue virus
KYSWKSWG

SEQ ID NO: 103386 - protein, 8 aa, Dengue virus
YSWKSWGK

SEQ ID NO: 103387 - protein, 8 aa, Dengue virus
SWKSWGKA

SEQ ID NO: 103388 - protein, 8 aa, Dengue virus
WKSWGKAK

SEQ ID NO: 103389 - protein, 8 aa, Dengue virus
TFLIDGPE

SEQ ID NO: 103390 - protein, 8 aa, Dengue virus
FLIDGPET

SEQ ID NO: 103391 - protein, 8 aa, Dengue virus
RAWNSLEV

SEQ ID NO: 103392 - protein, 8 aa, Dengue virus
AWNSLEVE

SEQ ID NO: 103393 - protein, 8 aa, Dengue virus
WNSLEVED

SEQ ID NO: 103394 - protein, 8 aa, Dengue virus
NSLEVEDY

SEQ ID NO: 103395 - protein, 8 aa, Dengue virus
SLEVEDYG

SEQ ID NO: 103396 - protein, 8 aa, Dengue virus
LEVEDYGF

SEQ ID NO: 103397 - protein, 8 aa, Dengue virus
VEDYGFGI

SEQ ID NO: 103398 - protein, 8 aa, Dengue virus
EDYGFGIF

SEQ ID NO: 103399 - protein, 8 aa, Dengue virus
DYGFGIFT

SEQ ID NO: 103400 - protein, 8 aa, Dengue virus
YGFGIFTT

SEQ ID NO: 103401 - protein, 8 aa, Dengue virus
GFGIFTTN

SEQ ID NO: 103402 - protein, 8 aa, Dengue virus
FGIFTTNI

SEQ ID NO: 103403 - protein, 8 aa, Dengue virus
GIFTTNIW

SEQ ID NO: 103404 - protein, 8 aa, Dengue virus
IFTTNIWL

SEQ ID NO: 103405 - protein, 8 aa, Dengue virus
FTTNIWMK

SEQ ID NO: 103406 - protein, 8 aa, Dengue virus
TTNIWMKF

SEQ ID NO: 103407 - protein, 8 aa, Dengue virus
TNIWLKLK

SEQ ID NO: 103408 - protein, 8 aa, Dengue virus
CDSKLMSA

SEQ ID NO: 103409 - protein, 8 aa, Dengue virus
DSKLMSAA

SEQ ID NO: 103410 - protein, 8 aa, Dengue virus
SKLMSAAI

SEQ ID NO: 103411 - protein, 8 aa, Dengue virus
KLMSAAIK

SEQ ID NO: 103412 - protein, 8 aa, Dengue virus
LMSAAVKD

SEQ ID NO: 103413 - protein, 8 aa, Dengue virus
KDNRAVHA

SEQ ID NO: 103414 - protein, 8 aa, Dengue virus
DNRAVHAD

SEQ ID NO: 103415 - protein, 8 aa, Dengue virus
NRAVHADM

SEQ ID NO: 103416 - protein, 8 aa, Dengue virus
KAVHADMG

SEQ ID NO: 103417 - protein, 8 aa, Dengue virus
MGYWIESA

SEQ ID NO: 103418 - protein, 8 aa, Dengue virus
GYWIESAL

SEQ ID NO: 103419 - protein, 8 aa, Dengue virus
YWIESALN

SEQ ID NO: 103420 - protein, 8 aa, Dengue virus
ESALNDTW

SEQ ID NO: 103421 - protein, 8 aa, Dengue virus
SALNDTWK

SEQ ID NO: 103422 - protein, 8 aa, Dengue virus
KNGSWKLE

SEQ ID NO: 103423 - protein, 8 aa, Dengue virus
KASFIEVK

SEQ ID NO: 103424 - protein, 8 aa, Dengue virus
ASLIEVKT

SEQ ID NO: 103425 - protein, 8 aa, Dengue virus
SLIEVKTC

SEQ ID NO: 103426 - protein, 8 aa, Dengue virus
WPKTHTLW

SEQ ID NO: 103427 - protein, 8 aa, Dengue virus
PKTHTLWS

SEQ ID NO: 103428 - protein, 8 aa, Dengue virus
KTHTLWSN

SEQ ID NO: 103429 - protein, 8 aa, Dengue virus
THTLWSNG

SEQ ID NO: 103430 - protein, 8 aa, Dengue virus
SNGVLESD

SEQ ID NO: 103431 - protein, 8 aa, Dengue virus
NGVLESDM

SEQ ID NO: 103432 - protein, 8 aa, Dengue virus
GVLESDMI

SEQ ID NO: 103433 - protein, 8 aa, Dengue virus
VLESDMII

SEQ ID NO: 103434 - protein, 8 aa, Dengue virus
LESDMIIP

SEQ ID NO: 103435 - protein, 8 aa, Dengue virus
ESDMIIPK

SEQ ID NO: 103436 - protein, 8 aa, Dengue virus
AGPVSQHN

SEQ ID NO: 103437 - protein, 8 aa, Dengue virus
SQHNHRPG

SEQ ID NO: 103438 - protein, 8 aa, Dengue virus
QHNHRPGY

SEQ ID NO: 103439 - protein, 8 aa, Dengue virus
TQIAGPWH

SEQ ID NO: 103440 - protein, 8 aa, Dengue virus
QIAGPWHL

SEQ ID NO: 103441 - protein, 8 aa, Dengue virus
IAGPWHLG

SEQ ID NO: 103442 - protein, 8 aa, Dengue virus
VGPWHLGK

SEQ ID NO: 103443 - protein, 8 aa, Dengue virus
PWHLGRLE

SEQ ID NO: 103444 - protein, 8 aa, Dengue virus
WHLGKLEM

SEQ ID NO: 103445 - protein, 8 aa, Dengue virus
HLGKLEMD

SEQ ID NO: 103446 - protein, 8 aa, Dengue virus
LGKLEMDF

SEQ ID NO: 103447 - protein, 8 aa, Dengue virus
CEGTTVVI

SEQ ID NO: 103448 - protein, 8 aa, Dengue virus
CGTRGPSL

SEQ ID NO: 103449 - protein, 8 aa, Dengue virus
GTRGPSLR

SEQ ID NO: 103450 - protein, 8 aa, Dengue virus
TRGPSLRT

SEQ ID NO: 103451 - protein, 8 aa, Dengue virus
PSLRTTTA

SEQ ID NO: 103452 - protein, 8 aa, Dengue virus
SLRTTTAS

SEQ ID NO: 103453 - protein, 8 aa, Dengue virus
LRTTTASG

SEQ ID NO: 103454 - protein, 8 aa, Dengue virus
RTTTASGK

SEQ ID NO: 103455 - protein, 8 aa, Dengue virus
TTTASGKL

SEQ ID NO: 103456 - protein, 8 aa, Dengue virus
TTASGKLI

SEQ ID NO: 103457 - protein, 8 aa, Dengue virus
TASGKLIT

SEQ ID NO: 103458 - protein, 8 aa, Dengue virus
ASGKLITE

SEQ ID NO: 103459 - protein, 8 aa, Dengue virus
SGKLITEW

SEQ ID NO: 103460 - protein, 8 aa, Dengue virus
GKLITEWC

SEQ ID NO: 103461 - protein, 8 aa, Dengue virus
KLITEWCC

SEQ ID NO: 103462 - protein, 8 aa, Dengue virus
LITEWCCR

SEQ ID NO: 103463 - protein, 8 aa, Dengue virus
ITEWCCRS

SEQ ID NO: 103464 - protein, 8 aa, Dengue virus
TEWCCRSC

SEQ ID NO: 103465 - protein, 8 aa, Dengue virus
QWCCRSCT

SEQ ID NO: 103466 - protein, 8 aa, Dengue virus
WCCRSCTM

SEQ ID NO: 103467 - protein, 8 aa, Dengue virus
CCRSCTMP

SEQ ID NO: 103468 - protein, 8 aa, Dengue virus
CRSCTMPP

SEQ ID NO: 103469 - protein, 8 aa, Dengue virus
RSCTMPPL

SEQ ID NO: 103470 - protein, 8 aa, Dengue virus
SCTMPPLR

SEQ ID NO: 103471 - protein, 8 aa, Dengue virus
CTLPPLRF

SEQ ID NO: 103472 - protein, 8 aa, Dengue virus
TLPPLRFR

SEQ ID NO: 103473 - protein, 8 aa, Dengue virus
LPPLRFRG

SEQ ID NO: 103474 - protein, 8 aa, Dengue virus
PPLRFRGE

SEQ ID NO: 103475 - protein, 8 aa, Dengue virus
PLRFRGED

SEQ ID NO: 103476 - protein, 8 aa, Dengue virus
LRFRGEDG

SEQ ID NO: 103477 - protein, 8 aa, Dengue virus
RFRGEDGC

SEQ ID NO: 103478 - protein, 8 aa, Dengue virus
FRGEDGCW

SEQ ID NO: 103479 - protein, 8 aa, Dengue virus
MGEDGCWY

SEQ ID NO: 103480 - protein, 8 aa, Dengue virus
YGMEIRPL

SEQ ID NO: 103481 - protein, 8 aa, Dengue virus
SEKEENMV

SEQ ID NO: 103482 - protein, 8 aa, Dengue virus
KEENLVNS

SEQ ID NO: 103483 - protein, 8 aa, Dengue virus
LEEMLRTR

SEQ ID NO: 103484 - protein, 8 aa, Dengue virus
EEMLRTRV

SEQ ID NO: 103485 - protein, 8 aa, Dengue virus
EMLRTRVG

SEQ ID NO: 103486 - protein, 8 aa, Dengue virus
IGMGVTYL

SEQ ID NO: 103487 - protein, 8 aa, Dengue virus
GMGTTYLA

SEQ ID NO: 103488 - protein, 8 aa, Dengue virus
MGTTYLAL

SEQ ID NO: 103489 - protein, 8 aa, Dengue virus
TYLALLAA

SEQ ID NO: 103490 - protein, 8 aa, Dengue virus
YLALLAAF

SEQ ID NO: 103491 - protein, 8 aa, Dengue virus
LLRKLTSK

SEQ ID NO: 103492 - protein, 8 aa, Dengue virus
LRKLTSKE

SEQ ID NO: 103493 - protein, 8 aa, Dengue virus
RKLTSKEL

SEQ ID NO: 103494 - protein, 8 aa, Dengue virus
KLTSKELM

SEQ ID NO: 103495 - protein, 8 aa, Dengue virus
LTSKELMM

SEQ ID NO: 103496 - protein, 8 aa, Dengue virus
TSRENLLL

SEQ ID NO: 103497 - protein, 8 aa, Dengue virus
SRENLLLG

SEQ ID NO: 103498 - protein, 8 aa, Dengue virus
LELTDALA

SEQ ID NO: 103499 - protein, 8 aa, Dengue virus
ELTDALAL

SEQ ID NO: 103500 - protein, 8 aa, Dengue virus
LTDALALG

SEQ ID NO: 103501 - protein, 8 aa, Dengue virus
TDALALGM

SEQ ID NO: 103502 - protein, 8 aa, Dengue virus
DALALGMM

SEQ ID NO: 103503 - protein, 8 aa, Dengue virus
RKSWPLNE

SEQ ID NO: 103504 - protein, 8 aa, Dengue virus
KSWPLNEG

SEQ ID NO: 103505 - protein, 8 aa, Dengue virus
SWPLNEAI

SEQ ID NO: 103506 - protein, 8 aa, Dengue virus
WPLNEAIM

SEQ ID NO: 103507 - protein, 8 aa, Dengue virus
PLNEAIMA

SEQ ID NO: 103508 - protein, 8 aa, Dengue virus
LNEAIMAV

SEQ ID NO: 103509 - protein, 8 aa, Dengue virus
NEAIMAVG

SEQ ID NO: 103510 - protein, 8 aa, Dengue virus
GMVSILAS

SEQ ID NO: 103511 - protein, 8 aa, Dengue virus
MVSILASS

SEQ ID NO: 103512 - protein, 8 aa, Dengue virus
VSILLSSL

SEQ ID NO: 103513 - protein, 8 aa, Dengue virus
SILLSSLL

SEQ ID NO: 103514 - protein, 8 aa, Dengue virus
ILASSLLK

SEQ ID NO: 103515 - protein, 8 aa, Dengue virus
LASSLLKN

SEQ ID NO: 103516 - protein, 8 aa, Dengue virus
ASSLLKND

SEQ ID NO: 103517 - protein, 8 aa, Dengue virus
SSLLKNDI

SEQ ID NO: 103518 - protein, 8 aa, Dengue virus
SLLKNDIP

SEQ ID NO: 103519 - protein, 8 aa, Dengue virus
LLKNDIPM

SEQ ID NO: 103520 - protein, 8 aa, Dengue virus
LKNDIPMT

SEQ ID NO: 103521 - protein, 8 aa, Dengue virus
KNDIPMTG

SEQ ID NO: 103522 - protein, 8 aa, Dengue virus
NDIPMTGP

SEQ ID NO: 103523 - protein, 8 aa, Dengue virus
DIPMTGPL

SEQ ID NO: 103524 - protein, 8 aa, Dengue virus
IPMTGPLV

SEQ ID NO: 103525 - protein, 8 aa, Dengue virus
PMTGPLVA

SEQ ID NO: 103526 - protein, 8 aa, Dengue virus
MTGPLVAG

SEQ ID NO: 103527 - protein, 8 aa, Dengue virus
TGPLVAGG

SEQ ID NO: 103528 - protein, 8 aa, Dengue virus
GPLIAGGM

SEQ ID NO: 103529 - protein, 8 aa, Dengue virus
PLIAGGML

SEQ ID NO: 103530 - protein, 8 aa, Dengue virus
LVAGGLLT

SEQ ID NO: 103531 - protein, 8 aa, Dengue virus
VAGGLLTV

SEQ ID NO: 103532 - protein, 8 aa, Dengue virus
AGGLLTVC

SEQ ID NO: 103533 - protein, 8 aa, Dengue virus
GGLLTVCY

SEQ ID NO: 103534 - protein, 8 aa, Dengue virus
GLLTVCYV

SEQ ID NO: 103535 - protein, 8 aa, Dengue virus
LLTVCYVL

SEQ ID NO: 103536 - protein, 8 aa, Dengue virus
LTVCYVLT

SEQ ID NO: 103537 - protein, 8 aa, Dengue virus
TVCYVLTG

SEQ ID NO: 103538 - protein, 8 aa, Dengue virus
VCYVLTGR

SEQ ID NO: 103539 - protein, 8 aa, Dengue virus
CYVLTGRS

SEQ ID NO: 103540 - protein, 8 aa, Dengue virus
YVLTGRSA

SEQ ID NO: 103541 - protein, 8 aa, Dengue virus
VLTGRSAD

SEQ ID NO: 103542 - protein, 8 aa, Dengue virus
LTGRSADL

SEQ ID NO: 103543 - protein, 8 aa, Dengue virus
TGRSADLE

SEQ ID NO: 103544 - protein, 8 aa, Dengue virus
GRSADLEL

SEQ ID NO: 103545 - protein, 8 aa, Dengue virus
RSADLELE

SEQ ID NO: 103546 - protein, 8 aa, Dengue virus
SADLELER

SEQ ID NO: 103547 - protein, 8 aa, Dengue virus
ADLELERA

SEQ ID NO: 103548 - protein, 8 aa, Dengue virus
QAEISGSS

SEQ ID NO: 103549 - protein, 8 aa, Dengue virus
AEISGSSP

SEQ ID NO: 103550 - protein, 8 aa, Dengue virus
EISGSSPI

SEQ ID NO: 103551 - protein, 8 aa, Dengue virus
ISGSSPIL

SEQ ID NO: 103552 - protein, 8 aa, Dengue virus
SGSSPILS

SEQ ID NO: 103553 - protein, 8 aa, Dengue virus
SEDGSMSI

SEQ ID NO: 103554 - protein, 8 aa, Dengue virus
EDGSMSIK

SEQ ID NO: 103555 - protein, 8 aa, Dengue virus
DGSMSIKN

SEQ ID NO: 103556 - protein, 8 aa, Dengue virus
GSMSIKNE

SEQ ID NO: 103557 - protein, 8 aa, Dengue virus
SMSIKNEE

SEQ ID NO: 103558 - protein, 8 aa, Dengue virus
MSIKNEEE

SEQ ID NO: 103559 - protein, 8 aa, Dengue virus
SIKNEEEE

SEQ ID NO: 103560 - protein, 8 aa, Dengue virus
IKNEEEEQ

SEQ ID NO: 103561 - protein, 8 aa, Dengue virus
TLTILIRT

SEQ ID NO: 103562 - protein, 8 aa, Dengue virus
LTILIRTG

SEQ ID NO: 103563 - protein, 8 aa, Dengue virus
TILIRTGL

SEQ ID NO: 103564 - protein, 8 aa, Dengue virus
ILIRTGLL

SEQ ID NO: 103565 - protein, 8 aa, Dengue virus
LIRTGLLV

SEQ ID NO: 103566 - protein, 8 aa, Dengue virus
IRTGLLVI

SEQ ID NO: 103567 - protein, 8 aa, Dengue virus
RTGLLVIS

SEQ ID NO: 103568 - protein, 8 aa, Dengue virus
TGLLVISG

SEQ ID NO: 103569 - protein, 8 aa, Dengue virus
KKQRAGVL

SEQ ID NO: 103570 - protein, 8 aa, Dengue virus
KQRAGVLW

SEQ ID NO: 103571 - protein, 8 aa, Dengue virus
QRAGVLWD

SEQ ID NO: 103572 - protein, 8 aa, Dengue virus
RAGVLWDV

SEQ ID NO: 103573 - protein, 8 aa, Dengue virus
AGVLWDVP

SEQ ID NO: 103574 - protein, 8 aa, Dengue virus
GVLWDTPS

SEQ ID NO: 103575 - protein, 8 aa, Dengue virus
VLWDTPSP

SEQ ID NO: 103576 - protein, 8 aa, Dengue virus
LWDTPSPP

SEQ ID NO: 103577 - protein, 8 aa, Dengue virus
WDVPSPPP

SEQ ID NO: 103578 - protein, 8 aa, Dengue virus
AELEDGAY

SEQ ID NO: 103579 - protein, 8 aa, Dengue virus
ELEDGAYR

SEQ ID NO: 103580 - protein, 8 aa, Dengue virus
LEDGAYRI

SEQ ID NO: 103581 - protein, 8 aa, Dengue virus
EDGAYRIK

SEQ ID NO: 103582 - protein, 8 aa, Dengue virus
DGAYRIKQ

SEQ ID NO: 103583 - protein, 8 aa, Dengue virus
YRIKQQGI

SEQ ID NO: 103584 - protein, 8 aa, Dengue virus
LGYSQIGA

SEQ ID NO: 103585 - protein, 8 aa, Dengue virus
GYSQIGAG

SEQ ID NO: 103586 - protein, 8 aa, Dengue virus
YSQIGAGV

SEQ ID NO: 103587 - protein, 8 aa, Dengue virus
SQIGAGVY

SEQ ID NO: 103588 - protein, 8 aa, Dengue virus
QIGAGVYK

SEQ ID NO: 103589 - protein, 8 aa, Dengue virus
IGAGVYKE

SEQ ID NO: 103590 - protein, 8 aa, Dengue virus
EGTFHTMW

SEQ ID NO: 103591 - protein, 8 aa, Dengue virus
NVFHTMWH

SEQ ID NO: 103592 - protein, 8 aa, Dengue virus
TFHTMWHV

SEQ ID NO: 103593 - protein, 8 aa, Dengue virus
MWHVTRGS

SEQ ID NO: 103594 - protein, 8 aa, Dengue virus
WHVTRGSV

SEQ ID NO: 103595 - protein, 8 aa, Dengue virus
HVTRGSVI

SEQ ID NO: 103596 - protein, 8 aa, Dengue virus
VTRGAVLT

SEQ ID NO: 103597 - protein, 8 aa, Dengue virus
TRGAVLMH

SEQ ID NO: 103598 - protein, 8 aa, Dengue virus
NGKRLEPN

SEQ ID NO: 103599 - protein, 8 aa, Dengue virus
GKRIEPSW

SEQ ID NO: 103600 - protein, 8 aa, Dengue virus
KRIEPSWA

SEQ ID NO: 103601 - protein, 8 aa, Dengue virus
RIEPSWAD

SEQ ID NO: 103602 - protein, 8 aa, Dengue virus
IEPSWADV

SEQ ID NO: 103603 - protein, 8 aa, Dengue virus
EPSWADVK

SEQ ID NO: 103604 - protein, 8 aa, Dengue virus
PSWADVKK

SEQ ID NO: 103605 - protein, 8 aa, Dengue virus
SWADVKKD

SEQ ID NO: 103606 - protein, 8 aa, Dengue virus
WADVKKDL

SEQ ID NO: 103607 - protein, 8 aa, Dengue virus
ADVKKDLI

SEQ ID NO: 103608 - protein, 8 aa, Dengue virus
DVKKDLIS

SEQ ID NO: 103609 - protein, 8 aa, Dengue virus
VRNDMISY

SEQ ID NO: 103610 - protein, 8 aa, Dengue virus
RNDMISYG

SEQ ID NO: 103611 - protein, 8 aa, Dengue virus
NDMISYGG

SEQ ID NO: 103612 - protein, 8 aa, Dengue virus
DMISYGGG

SEQ ID NO: 103613 - protein, 8 aa, Dengue virus
MISYGGGW

SEQ ID NO: 103614 - protein, 8 aa, Dengue virus
ISYGGGWK

SEQ ID NO: 103615 - protein, 8 aa, Dengue virus
SYGGGWKL

SEQ ID NO: 103616 - protein, 8 aa, Dengue virus
WKEGEEVQ

SEQ ID NO: 103617 - protein, 8 aa, Dengue virus
KEGEEVQV

SEQ ID NO: 103618 - protein, 8 aa, Dengue virus
EGEEVQVL

SEQ ID NO: 103619 - protein, 8 aa, Dengue virus
GEEVQVLA

SEQ ID NO: 103620 - protein, 8 aa, Dengue virus
EEVQVLAL

SEQ ID NO: 103621 - protein, 8 aa, Dengue virus
EVQVLALE

SEQ ID NO: 103622 - protein, 8 aa, Dengue virus
VQVLALEP

SEQ ID NO: 103623 - protein, 8 aa, Dengue virus
QVLALEPG

SEQ ID NO: 103624 - protein, 8 aa, Dengue virus
VLALEPGK

SEQ ID NO: 103625 - protein, 8 aa, Dengue virus
LALEPGKN

SEQ ID NO: 103626 - protein, 8 aa, Dengue virus
ALEPGKNP

SEQ ID NO: 103627 - protein, 8 aa, Dengue virus
LEPGKNPR

SEQ ID NO: 103628 - protein, 8 aa, Dengue virus
EPGKNPRA

SEQ ID NO: 103629 - protein, 8 aa, Dengue virus
PGKNPRAV

SEQ ID NO: 103630 - protein, 8 aa, Dengue virus
GKNPRAVQ

SEQ ID NO: 103631 - protein, 8 aa, Dengue virus
KNPRAVQT

SEQ ID NO: 103632 - protein, 8 aa, Dengue virus
TGTIGAVS

SEQ ID NO: 103633 - protein, 8 aa, Dengue virus
GTIGAVSL

SEQ ID NO: 103634 - protein, 8 aa, Dengue virus
TIGAVSLD

SEQ ID NO: 103635 - protein, 8 aa, Dengue virus
IGAVSLDF

SEQ ID NO: 103636 - protein, 8 aa, Dengue virus
GAVSLDFS

SEQ ID NO: 103637 - protein, 8 aa, Dengue virus
AVSLDFSP

SEQ ID NO: 103638 - protein, 8 aa, Dengue virus
VSLDFSPG

SEQ ID NO: 103639 - protein, 8 aa, Dengue virus
SLDFSPGT

SEQ ID NO: 103640 - protein, 8 aa, Dengue virus
LDFSPGTS

SEQ ID NO: 103641 - protein, 8 aa, Dengue virus
DFSPGTSG

SEQ ID NO: 103642 - protein, 8 aa, Dengue virus
FSPGTSGS

SEQ ID NO: 103643 - protein, 8 aa, Dengue virus
SPGTSGSP

SEQ ID NO: 103644 - protein, 8 aa, Dengue virus
GTSGSPII

SEQ ID NO: 103645 - protein, 8 aa, Dengue virus
TSGSPIIN

SEQ ID NO: 103646 - protein, 8 aa, Dengue virus
SGSPIINR

SEQ ID NO: 103647 - protein, 8 aa, Dengue virus
KGKVVGLY

SEQ ID NO: 103648 - protein, 8 aa, Dengue virus
GKIVGLYG

SEQ ID NO: 103649 - protein, 8 aa, Dengue virus
KIVGLYGN

SEQ ID NO: 103650 - protein, 8 aa, Dengue virus
IVGLYGNG

SEQ ID NO: 103651 - protein, 8 aa, Dengue virus
IGLYGNGV

SEQ ID NO: 103652 - protein, 8 aa, Dengue virus
YGNGVVTR

SEQ ID NO: 103653 - protein, 8 aa, Dengue virus
GNGVVTRS

SEQ ID NO: 103654 - protein, 8 aa, Dengue virus
NGVVTRSG

SEQ ID NO: 103655 - protein, 8 aa, Dengue virus
GVVTRSGA

SEQ ID NO: 103656 - protein, 8 aa, Dengue virus
VVTRSGAY

SEQ ID NO: 103657 - protein, 8 aa, Dengue virus
VTRSGAYV

SEQ ID NO: 103658 - protein, 8 aa, Dengue virus
TRSGAYVS

SEQ ID NO: 103659 - protein, 8 aa, Dengue virus
SGAYVSAI

SEQ ID NO: 103660 - protein, 8 aa, Dengue virus
GAYVSAIA

SEQ ID NO: 103661 - protein, 8 aa, Dengue virus
AYVSAIAQ

SEQ ID NO: 103662 - protein, 8 aa, Dengue virus
YVSAIAQT

SEQ ID NO: 103663 - protein, 8 aa, Dengue virus
IFRKKRLT

SEQ ID NO: 103664 - protein, 8 aa, Dengue virus
FKKRNLTI

SEQ ID NO: 103665 - protein, 8 aa, Dengue virus
KKRNLTIM

SEQ ID NO: 103666 - protein, 8 aa, Dengue virus
KKRLTIMD

SEQ ID NO: 103667 - protein, 8 aa, Dengue virus
KRLTIMDL

SEQ ID NO: 103668 - protein, 8 aa, Dengue virus
RLTIMDLH

SEQ ID NO: 103669 - protein, 8 aa, Dengue virus
IMDLHPGA

SEQ ID NO: 103670 - protein, 8 aa, Dengue virus
MDLHPGAG

SEQ ID NO: 103671 - protein, 8 aa, Dengue virus
DLHPGAGK

SEQ ID NO: 103672 - protein, 8 aa, Dengue virus
LHPGAGKT

SEQ ID NO: 103673 - protein, 8 aa, Dengue virus
HPGAGKTK

SEQ ID NO: 103674 - protein, 8 aa, Dengue virus
PGAGKTKR

SEQ ID NO: 103675 - protein, 8 aa, Dengue virus
GAGKTKRY

SEQ ID NO: 103676 - protein, 8 aa, Dengue virus
AGKTKRYL

SEQ ID NO: 103677 - protein, 8 aa, Dengue virus
GKTKRYLP

SEQ ID NO: 103678 - protein, 8 aa, Dengue virus
KTKRYLPA

SEQ ID NO: 103679 - protein, 8 aa, Dengue virus
TKRYLPAI

SEQ ID NO: 103680 - protein, 8 aa, Dengue virus
KYLPAIVR

SEQ ID NO: 103681 - protein, 8 aa, Dengue virus
ILPSIVRE

SEQ ID NO: 103682 - protein, 8 aa, Dengue virus
LPSIVREA

SEQ ID NO: 103683 - protein, 8 aa, Dengue virus
PSIVREAL

SEQ ID NO: 103684 - protein, 8 aa, Dengue virus
SIVREALK

SEQ ID NO: 103685 - protein, 8 aa, Dengue virus
IVREALKR

SEQ ID NO: 103686 - protein, 8 aa, Dengue virus
REAIKRGL

SEQ ID NO: 103687 - protein, 8 aa, Dengue virus
EAIKRGLR

SEQ ID NO: 103688 - protein, 8 aa, Dengue virus
AIKRGLRT

SEQ ID NO: 103689 - protein, 8 aa, Dengue virus
IKRGLRTL

SEQ ID NO: 103690 - protein, 8 aa, Dengue virus
KRGLRTLI

SEQ ID NO: 103691 - protein, 8 aa, Dengue virus
RGLRTLIL

SEQ ID NO: 103692 - protein, 8 aa, Dengue virus
GLRTLILA

SEQ ID NO: 103693 - protein, 8 aa, Dengue virus
LRTLVLAP

SEQ ID NO: 103694 - protein, 8 aa, Dengue virus
RTLVLAPT

SEQ ID NO: 103695 - protein, 8 aa, Dengue virus
TLVLAPTR

SEQ ID NO: 103696 - protein, 8 aa, Dengue virus
LVLAPTRV

SEQ ID NO: 103697 - protein, 8 aa, Dengue virus
VLAPTRVV

SEQ ID NO: 103698 - protein, 8 aa, Dengue virus
APTRVVAS

SEQ ID NO: 103699 - protein, 8 aa, Dengue virus
PTRVVASE

SEQ ID NO: 103700 - protein, 8 aa, Dengue virus
TRVVASEM

SEQ ID NO: 103701 - protein, 8 aa, Dengue virus
RVVASEMA

SEQ ID NO: 103702 - protein, 8 aa, Dengue virus
VVASEMAE

SEQ ID NO: 103703 - protein, 8 aa, Dengue virus
VASEMAEA

SEQ ID NO: 103704 - protein, 8 aa, Dengue virus
ASEMAEAL

SEQ ID NO: 103705 - protein, 8 aa, Dengue virus
AEMEEALR

SEQ ID NO: 103706 - protein, 8 aa, Dengue virus
EMEEALRG

SEQ ID NO: 103707 - protein, 8 aa, Dengue virus
MEEALRGL

SEQ ID NO: 103708 - protein, 8 aa, Dengue virus
EEALRGLP

SEQ ID NO: 103709 - protein, 8 aa, Dengue virus
EALRGLPI

SEQ ID NO: 103710 - protein, 8 aa, Dengue virus
ALRGLPIR

SEQ ID NO: 103711 - protein, 8 aa, Dengue virus
LRGLPIRY

SEQ ID NO: 103712 - protein, 8 aa, Dengue virus
RGLPIRYQ

SEQ ID NO: 103713 - protein, 8 aa, Dengue virus
GMPIRYQT

SEQ ID NO: 103714 - protein, 8 aa, Dengue virus
LPIRYQTP

SEQ ID NO: 103715 - protein, 8 aa, Dengue virus
PIRYQTPA

SEQ ID NO: 103716 - protein, 8 aa, Dengue virus
IRYQTPAI

SEQ ID NO: 103717 - protein, 8 aa, Dengue virus
KSEHTGRE

SEQ ID NO: 103718 - protein, 8 aa, Dengue virus
SEHTGREI

SEQ ID NO: 103719 - protein, 8 aa, Dengue virus
EHTGKEIV

SEQ ID NO: 103720 - protein, 8 aa, Dengue virus
HTGKEIVD

SEQ ID NO: 103721 - protein, 8 aa, Dengue virus
TGKEIVDL

SEQ ID NO: 103722 - protein, 8 aa, Dengue virus
GKEIVDLM

SEQ ID NO: 103723 - protein, 8 aa, Dengue virus
KEIVDLMC

SEQ ID NO: 103724 - protein, 8 aa, Dengue virus
MCHATFTT

SEQ ID NO: 103725 - protein, 8 aa, Dengue virus
CHATFTTR

SEQ ID NO: 103726 - protein, 8 aa, Dengue virus
HATFTTRL

SEQ ID NO: 103727 - protein, 8 aa, Dengue virus
ATFTTRLL

SEQ ID NO: 103728 - protein, 8 aa, Dengue virus
TFTTRLLS

SEQ ID NO: 103729 - protein, 8 aa, Dengue virus
FTTRLLSS

SEQ ID NO: 103730 - protein, 8 aa, Dengue virus
TTRLLSST

SEQ ID NO: 103731 - protein, 8 aa, Dengue virus
TRLLSSTR

SEQ ID NO: 103732 - protein, 8 aa, Dengue virus
RLLSSTRV

SEQ ID NO: 103733 - protein, 8 aa, Dengue virus
LLSSTRVP

SEQ ID NO: 103734 - protein, 8 aa, Dengue virus
LSSTRVPN

SEQ ID NO: 103735 - protein, 8 aa, Dengue virus
SSTRVPNY

SEQ ID NO: 103736 - protein, 8 aa, Dengue virus
STRVPNYN

SEQ ID NO: 103737 - protein, 8 aa, Dengue virus
VRVPNYNM

SEQ ID NO: 103738 - protein, 8 aa, Dengue virus
RVPNYNMI

SEQ ID NO: 103739 - protein, 8 aa, Dengue virus
VPNYNMII

SEQ ID NO: 103740 - protein, 8 aa, Dengue virus
PNYNMIIM

SEQ ID NO: 103741 - protein, 8 aa, Dengue virus
NYNMIIMD

SEQ ID NO: 103742 - protein, 8 aa, Dengue virus
YNMIIMDE

SEQ ID NO: 103743 - protein, 8 aa, Dengue virus
NMIIMDEA

SEQ ID NO: 103744 - protein, 8 aa, Dengue virus
MIIMDEAH

SEQ ID NO: 103745 - protein, 8 aa, Dengue virus
IVMDEAHF

SEQ ID NO: 103746 - protein, 8 aa, Dengue virus
VMDEAHFT

SEQ ID NO: 103747 - protein, 8 aa, Dengue virus
EAHFTDPS

SEQ ID NO: 103748 - protein, 8 aa, Dengue virus
AHFTDPSS

SEQ ID NO: 103749 - protein, 8 aa, Dengue virus
HFTDPSSI

SEQ ID NO: 103750 - protein, 8 aa, Dengue virus
FTDPSSIA

SEQ ID NO: 103751 - protein, 8 aa, Dengue virus
TDPSSIAA

SEQ ID NO: 103752 - protein, 8 aa, Dengue virus
DPSSIAAR

SEQ ID NO: 103753 - protein, 8 aa, Dengue virus
PSSIAARG

SEQ ID NO: 103754 - protein, 8 aa, Dengue virus
SSIAARGY

SEQ ID NO: 103755 - protein, 8 aa, Dengue virus
SVAARGYI

SEQ ID NO: 103756 - protein, 8 aa, Dengue virus
VAARGYIS

SEQ ID NO: 103757 - protein, 8 aa, Dengue virus
GYISTRVE

SEQ ID NO: 103758 - protein, 8 aa, Dengue virus
YISTRVEM

SEQ ID NO: 103759 - protein, 8 aa, Dengue virus
ISTRVEMG

SEQ ID NO: 103760 - protein, 8 aa, Dengue virus
STRVEMGE

SEQ ID NO: 103761 - protein, 8 aa, Dengue virus
TRVEMGEA

SEQ ID NO: 103762 - protein, 8 aa, Dengue virus
RVEMGEAA

SEQ ID NO: 103763 - protein, 8 aa, Dengue virus
VEMGEAAG

SEQ ID NO: 103764 - protein, 8 aa, Dengue virus
EMGEAAGI

SEQ ID NO: 103765 - protein, 8 aa, Dengue virus
MGEAAGIF

SEQ ID NO: 103766 - protein, 8 aa, Dengue virus
GEAAGIFM

SEQ ID NO: 103767 - protein, 8 aa, Dengue virus
EAAGIFMT

SEQ ID NO: 103768 - protein, 8 aa, Dengue virus
AAGIFMTA

SEQ ID NO: 103769 - protein, 8 aa, Dengue virus
AGIFMTAT

SEQ ID NO: 103770 - protein, 8 aa, Dengue virus
GIFMTATP

SEQ ID NO: 103771 - protein, 8 aa, Dengue virus
MTATPPGT

SEQ ID NO: 103772 - protein, 8 aa, Dengue virus
DPFPQSNA

SEQ ID NO: 103773 - protein, 8 aa, Dengue virus
PFPQSNAP

SEQ ID NO: 103774 - protein, 8 aa, Dengue virus
FPQSNAVI

SEQ ID NO: 103775 - protein, 8 aa, Dengue virus
IMDEEREI

SEQ ID NO: 103776 - protein, 8 aa, Dengue virus
MDEEREIP

SEQ ID NO: 103777 - protein, 8 aa, Dengue virus
DEEREIPE

SEQ ID NO: 103778 - protein, 8 aa, Dengue virus
EEREIPER

SEQ ID NO: 103779 - protein, 8 aa, Dengue virus
EREIPERS

SEQ ID NO: 103780 - protein, 8 aa, Dengue virus
REIPERSW

SEQ ID NO: 103781 - protein, 8 aa, Dengue virus
EIPERSWN

SEQ ID NO: 103782 - protein, 8 aa, Dengue virus
IPERSWNT

SEQ ID NO: 103783 - protein, 8 aa, Dengue virus
PERSWNTG

SEQ ID NO: 103784 - protein, 8 aa, Dengue virus
ERSWNSGH

SEQ ID NO: 103785 - protein, 8 aa, Dengue virus
FKGKTVWF

SEQ ID NO: 103786 - protein, 8 aa, Dengue virus
KGKTVWFV

SEQ ID NO: 103787 - protein, 8 aa, Dengue virus
WFVPSIKS

SEQ ID NO: 103788 - protein, 8 aa, Dengue virus
FVPSIKSG

SEQ ID NO: 103789 - protein, 8 aa, Dengue virus
VPSIKSGN

SEQ ID NO: 103790 - protein, 8 aa, Dengue virus
PSIKSGND

SEQ ID NO: 103791 - protein, 8 aa, Dengue virus
SIKSGNDI

SEQ ID NO: 103792 - protein, 8 aa, Dengue virus
IKSGNDIA

SEQ ID NO: 103793 - protein, 8 aa, Dengue virus
KAGNDIAA

SEQ ID NO: 103794 - protein, 8 aa, Dengue virus
AGNDIAAC

SEQ ID NO: 103795 - protein, 8 aa, Dengue virus
GNDIAACL

SEQ ID NO: 103796 - protein, 8 aa, Dengue virus
NDIAACLR

SEQ ID NO: 103797 - protein, 8 aa, Dengue virus
DIAACLRK

SEQ ID NO: 103798 - protein, 8 aa, Dengue virus
IAACLRKN

SEQ ID NO: 103799 - protein, 8 aa, Dengue virus
AACLRKNG

SEQ ID NO: 103800 - protein, 8 aa, Dengue virus
ACLRKNGK

SEQ ID NO: 103801 - protein, 8 aa, Dengue virus
CLRKNGKR

SEQ ID NO: 103802 - protein, 8 aa, Dengue virus
LRKNGKRV

SEQ ID NO: 103803 - protein, 8 aa, Dengue virus
RKNGKRVI

SEQ ID NO: 103804 - protein, 8 aa, Dengue virus
KNGKRVIQ

SEQ ID NO: 103805 - protein, 8 aa, Dengue virus
NGKRVIQL

SEQ ID NO: 103806 - protein, 8 aa, Dengue virus
GKRVIQLS

SEQ ID NO: 103807 - protein, 8 aa, Dengue virus
KRVIQLSR

SEQ ID NO: 103808 - protein, 8 aa, Dengue virus
RVIQLSRK

SEQ ID NO: 103809 - protein, 8 aa, Dengue virus
LSRKTFDS

SEQ ID NO: 103810 - protein, 8 aa, Dengue virus
SRKTFDSE

SEQ ID NO: 103811 - protein, 8 aa, Dengue virus
RKTFDSEY

SEQ ID NO: 103812 - protein, 8 aa, Dengue virus
KTFDSEYV

SEQ ID NO: 103813 - protein, 8 aa, Dengue virus
TFDSEYVK

SEQ ID NO: 103814 - protein, 8 aa, Dengue virus
FDSEYVKT

SEQ ID NO: 103815 - protein, 8 aa, Dengue virus
LNDWDFVV

SEQ ID NO: 103816 - protein, 8 aa, Dengue virus
NDWDYVVT

SEQ ID NO: 103817 - protein, 8 aa, Dengue virus
DWDYVVTT

SEQ ID NO: 103818 - protein, 8 aa, Dengue virus
WDYVVTTD

SEQ ID NO: 103819 - protein, 8 aa, Dengue virus
DYVVTTDI

SEQ ID NO: 103820 - protein, 8 aa, Dengue virus
YVVTTDIS

SEQ ID NO: 103821 - protein, 8 aa, Dengue virus
SEMGANFK

SEQ ID NO: 103822 - protein, 8 aa, Dengue virus
EMGANFKA

SEQ ID NO: 103823 - protein, 8 aa, Dengue virus
MGANFKAE

SEQ ID NO: 103824 - protein, 8 aa, Dengue virus
GANFKAER

SEQ ID NO: 103825 - protein, 8 aa, Dengue virus
ANFKAERV

SEQ ID NO: 103826 - protein, 8 aa, Dengue virus
NFKAERVI

SEQ ID NO: 103827 - protein, 8 aa, Dengue virus
FKAERVID

SEQ ID NO: 103828 - protein, 8 aa, Dengue virus
KAERVIDP

SEQ ID NO: 103829 - protein, 8 aa, Dengue virus
AERVIDPR

SEQ ID NO: 103830 - protein, 8 aa, Dengue virus
ERVIDPRR

SEQ ID NO: 103831 - protein, 8 aa, Dengue virus
VIDPRRCM

SEQ ID NO: 103832 - protein, 8 aa, Dengue virus
IDPRRCMK

SEQ ID NO: 103833 - protein, 8 aa, Dengue virus
DPRRCMKP

SEQ ID NO: 103834 - protein, 8 aa, Dengue virus
PRRCMKPV

SEQ ID NO: 103835 - protein, 8 aa, Dengue virus
RRCMKPVI

SEQ ID NO: 103836 - protein, 8 aa, Dengue virus
RCMKPVIL

SEQ ID NO: 103837 - protein, 8 aa, Dengue virus
CMKPVILT

SEQ ID NO: 103838 - protein, 8 aa, Dengue virus
MKPVILTD

SEQ ID NO: 103839 - protein, 8 aa, Dengue virus
KPVILKDG

SEQ ID NO: 103840 - protein, 8 aa, Dengue virus
PVILTDGE

SEQ ID NO: 103841 - protein, 8 aa, Dengue virus
VILTDGEE

SEQ ID NO: 103842 - protein, 8 aa, Dengue virus
ILTDGEER

SEQ ID NO: 103843 - protein, 8 aa, Dengue virus
LTDGEERV

SEQ ID NO: 103844 - protein, 8 aa, Dengue virus
TDGEERVI

SEQ ID NO: 103845 - protein, 8 aa, Dengue virus
DGEERVIL

SEQ ID NO: 103846 - protein, 8 aa, Dengue virus
GEERVILA

SEQ ID NO: 103847 - protein, 8 aa, Dengue virus
EERVILAG

SEQ ID NO: 103848 - protein, 8 aa, Dengue virus
RVILAGPI

SEQ ID NO: 103849 - protein, 8 aa, Dengue virus
VILAGPIP

SEQ ID NO: 103850 - protein, 8 aa, Dengue virus
ILAGPIPV

SEQ ID NO: 103851 - protein, 8 aa, Dengue virus
LAGPIPVT

SEQ ID NO: 103852 - protein, 8 aa, Dengue virus
AGPMPVTH

SEQ ID NO: 103853 - protein, 8 aa, Dengue virus
GPMPVTHS

SEQ ID NO: 103854 - protein, 8 aa, Dengue virus
PMPVTHSS

SEQ ID NO: 103855 - protein, 8 aa, Dengue virus
MPVTHSSA

SEQ ID NO: 103856 - protein, 8 aa, Dengue virus
PVTHSSAA

SEQ ID NO: 103857 - protein, 8 aa, Dengue virus
VTHSSAAQ

SEQ ID NO: 103858 - protein, 8 aa, Dengue virus
THSSAAQR

SEQ ID NO: 103859 - protein, 8 aa, Dengue virus
HSSAAQRR

SEQ ID NO: 103860 - protein, 8 aa, Dengue virus
SSAAQRRG

SEQ ID NO: 103861 - protein, 8 aa, Dengue virus
AAQRRGRV

SEQ ID NO: 103862 - protein, 8 aa, Dengue virus
AQRRGRVG

SEQ ID NO: 103863 - protein, 8 aa, Dengue virus
QRRGRVGR

SEQ ID NO: 103864 - protein, 8 aa, Dengue virus
RRGRVGRN

SEQ ID NO: 103865 - protein, 8 aa, Dengue virus
RGRIGRNH

SEQ ID NO: 103866 - protein, 8 aa, Dengue virus
NENDQYIY

SEQ ID NO: 103867 - protein, 8 aa, Dengue virus
ENDQYIYM

SEQ ID NO: 103868 - protein, 8 aa, Dengue virus
NDQYIYMG

SEQ ID NO: 103869 - protein, 8 aa, Dengue virus
DQYIYMGE

SEQ ID NO: 103870 - protein, 8 aa, Dengue virus
QYIYMGEP

SEQ ID NO: 103871 - protein, 8 aa, Dengue virus
YIYMGEPL

SEQ ID NO: 103872 - protein, 8 aa, Dengue virus
YMGEPLEN

SEQ ID NO: 103873 - protein, 8 aa, Dengue virus
MGEPLEND

SEQ ID NO: 103874 - protein, 8 aa, Dengue virus
GEPLENDE

SEQ ID NO: 103875 - protein, 8 aa, Dengue virus
EPLENDED

SEQ ID NO: 103876 - protein, 8 aa, Dengue virus
PLENDEDC

SEQ ID NO: 103877 - protein, 8 aa, Dengue virus
LENDEDCA

SEQ ID NO: 103878 - protein, 8 aa, Dengue virus
ENDEDCAH

SEQ ID NO: 103879 - protein, 8 aa, Dengue virus
NDEDCAHW

SEQ ID NO: 103880 - protein, 8 aa, Dengue virus
DEDCAHWK

SEQ ID NO: 103881 - protein, 8 aa, Dengue virus
EDCAHWKE

SEQ ID NO: 103882 - protein, 8 aa, Dengue virus
DCAHWKEA

SEQ ID NO: 103883 - protein, 8 aa, Dengue virus
CAHWKEAK

SEQ ID NO: 103884 - protein, 8 aa, Dengue virus
AHWKEAKM

SEQ ID NO: 103885 - protein, 8 aa, Dengue virus
HWKEAKML

SEQ ID NO: 103886 - protein, 8 aa, Dengue virus
WKEAKMLL

SEQ ID NO: 103887 - protein, 8 aa, Dengue virus
KEAKMLLD

SEQ ID NO: 103888 - protein, 8 aa, Dengue virus
KMLLDNIY

SEQ ID NO: 103889 - protein, 8 aa, Dengue virus
MLLDNIYT

SEQ ID NO: 103890 - protein, 8 aa, Dengue virus
LLDNIYTP

SEQ ID NO: 103891 - protein, 8 aa, Dengue virus
LDNIYTPE

SEQ ID NO: 103892 - protein, 8 aa, Dengue virus
DNIYTPEG

SEQ ID NO: 103893 - protein, 8 aa, Dengue virus
NIYTPEGI

SEQ ID NO: 103894 - protein, 8 aa, Dengue virus
IYTPEGII

SEQ ID NO: 103895 - protein, 8 aa, Dengue virus
YTPEGIIP

SEQ ID NO: 103896 - protein, 8 aa, Dengue virus
TPEGIIPS

SEQ ID NO: 103897 - protein, 8 aa, Dengue virus
PEGIIPSM

SEQ ID NO: 103898 - protein, 8 aa, Dengue virus
EGIIPSMF

SEQ ID NO: 103899 - protein, 8 aa, Dengue virus
GIIPSMFE

SEQ ID NO: 103900 - protein, 8 aa, Dengue virus
IIPSMFEP

SEQ ID NO: 103901 - protein, 8 aa, Dengue virus
IPSMFEPE

SEQ ID NO: 103902 - protein, 8 aa, Dengue virus
PSMFEPER

SEQ ID NO: 103903 - protein, 8 aa, Dengue virus
SMFEPERE

SEQ ID NO: 103904 - protein, 8 aa, Dengue virus
MFEPEREK

SEQ ID NO: 103905 - protein, 8 aa, Dengue virus
FEPEREKV

SEQ ID NO: 103906 - protein, 8 aa, Dengue virus
EPEREKVD

SEQ ID NO: 103907 - protein, 8 aa, Dengue virus
PEREKVDA

SEQ ID NO: 103908 - protein, 8 aa, Dengue virus
EREKVDAI

SEQ ID NO: 103909 - protein, 8 aa, Dengue virus
REKVDAID

SEQ ID NO: 103910 - protein, 8 aa, Dengue virus
EKVDAIDG

SEQ ID NO: 103911 - protein, 8 aa, Dengue virus
KVDAIDGE

SEQ ID NO: 103912 - protein, 8 aa, Dengue virus
VDAIDGEY

SEQ ID NO: 103913 - protein, 8 aa, Dengue virus
DAIDGEYR

SEQ ID NO: 103914 - protein, 8 aa, Dengue virus
AIDGEFRL

SEQ ID NO: 103915 - protein, 8 aa, Dengue virus
IDGEYRLK

SEQ ID NO: 103916 - protein, 8 aa, Dengue virus
DGEYRLKG

SEQ ID NO: 103917 - protein, 8 aa, Dengue virus
GEYRLKGE

SEQ ID NO: 103918 - protein, 8 aa, Dengue virus
EYRLKGES

SEQ ID NO: 103919 - protein, 8 aa, Dengue virus
YRLKGESR

SEQ ID NO: 103920 - protein, 8 aa, Dengue virus
RLKGESRK

SEQ ID NO: 103921 - protein, 8 aa, Dengue virus
LKGESRKT

SEQ ID NO: 103922 - protein, 8 aa, Dengue virus
KGESRKTF

SEQ ID NO: 103923 - protein, 8 aa, Dengue virus
GESRKTFV

SEQ ID NO: 103924 - protein, 8 aa, Dengue virus
EARKTFVD

SEQ ID NO: 103925 - protein, 8 aa, Dengue virus
ARKTFVDL

SEQ ID NO: 103926 - protein, 8 aa, Dengue virus
RKTFVDLM

SEQ ID NO: 103927 - protein, 8 aa, Dengue virus
KTFVDLMR

SEQ ID NO: 103928 - protein, 8 aa, Dengue virus
TFVDLMRR

SEQ ID NO: 103929 - protein, 8 aa, Dengue virus
FVDLMRRG

SEQ ID NO: 103930 - protein, 8 aa, Dengue virus
VDLMRRGD

SEQ ID NO: 103931 - protein, 8 aa, Dengue virus
DLMRRGDL

SEQ ID NO: 103932 - protein, 8 aa, Dengue virus
GDLPVWLS

SEQ ID NO: 103933 - protein, 8 aa, Dengue virus
DLPVWLAY

SEQ ID NO: 103934 - protein, 8 aa, Dengue virus
LPVWLAYK

SEQ ID NO: 103935 - protein, 8 aa, Dengue virus
PVWLAYKV

SEQ ID NO: 103936 - protein, 8 aa, Dengue virus
VWLAYKVA

SEQ ID NO: 103937 - protein, 8 aa, Dengue virus
WLAHKVAS

SEQ ID NO: 103938 - protein, 8 aa, Dengue virus
VAAEGINY

SEQ ID NO: 103939 - protein, 8 aa, Dengue virus
EGINYADR

SEQ ID NO: 103940 - protein, 8 aa, Dengue virus
YADRRWCF

SEQ ID NO: 103941 - protein, 8 aa, Dengue virus
TDRKWCFD

SEQ ID NO: 103942 - protein, 8 aa, Dengue virus
DRKWCFDG

SEQ ID NO: 103943 - protein, 8 aa, Dengue virus
KNNQILEE

SEQ ID NO: 103944 - protein, 8 aa, Dengue virus
NNQVLEEN

SEQ ID NO: 103945 - protein, 8 aa, Dengue virus
NQILEENM

SEQ ID NO: 103946 - protein, 8 aa, Dengue virus
QILEENVE

SEQ ID NO: 103947 - protein, 8 aa, Dengue virus
ILEENVEV

SEQ ID NO: 103948 - protein, 8 aa, Dengue virus
LEENVEVE

SEQ ID NO: 103949 - protein, 8 aa, Dengue virus
EENVEVEI

SEQ ID NO: 103950 - protein, 8 aa, Dengue virus
ENVEVEIW

SEQ ID NO: 103951 - protein, 8 aa, Dengue virus
NVEVEIWT

SEQ ID NO: 103952 - protein, 8 aa, Dengue virus
VEVEIWTK

SEQ ID NO: 103953 - protein, 8 aa, Dengue virus
EVEIWTKE

SEQ ID NO: 103954 - protein, 8 aa, Dengue virus
VEIWTREG

SEQ ID NO: 103955 - protein, 8 aa, Dengue virus
ERKKLKPR

SEQ ID NO: 103956 - protein, 8 aa, Dengue virus
RKKLKPRW

SEQ ID NO: 103957 - protein, 8 aa, Dengue virus
KKLKPRWL

SEQ ID NO: 103958 - protein, 8 aa, Dengue virus
KLKPRWLD

SEQ ID NO: 103959 - protein, 8 aa, Dengue virus
LKPRWLDA

SEQ ID NO: 103960 - protein, 8 aa, Dengue virus
KPRWLDAR

SEQ ID NO: 103961 - protein, 8 aa, Dengue virus
PRWLDARI

SEQ ID NO: 103962 - protein, 8 aa, Dengue virus
RWLDARIY

SEQ ID NO: 103963 - protein, 8 aa, Dengue virus
WLDARIYS

SEQ ID NO: 103964 - protein, 8 aa, Dengue virus
LDARIYSD

SEQ ID NO: 103965 - protein, 8 aa, Dengue virus
DARIYSDP

SEQ ID NO: 103966 - protein, 8 aa, Dengue virus
ARIYSDPL

SEQ ID NO: 103967 - protein, 8 aa, Dengue virus
RIYSDPLA

SEQ ID NO: 103968 - protein, 8 aa, Dengue virus
IYSDPLAL

SEQ ID NO: 103969 - protein, 8 aa, Dengue virus
YSDPLALR

SEQ ID NO: 103970 - protein, 8 aa, Dengue virus
SDPLALRE

SEQ ID NO: 103971 - protein, 8 aa, Dengue virus
DPLALREF

SEQ ID NO: 103972 - protein, 8 aa, Dengue virus
PLALREFK

SEQ ID NO: 103973 - protein, 8 aa, Dengue virus
LALKEFKE

SEQ ID NO: 103974 - protein, 8 aa, Dengue virus
ALKEFKEF

SEQ ID NO: 103975 - protein, 8 aa, Dengue virus
LKEFKEFA

SEQ ID NO: 103976 - protein, 8 aa, Dengue virus
KEFKEFAA

SEQ ID NO: 103977 - protein, 8 aa, Dengue virus
EFKDFAAG

SEQ ID NO: 103978 - protein, 8 aa, Dengue virus
FKDFAAGR

SEQ ID NO: 103979 - protein, 8 aa, Dengue virus
KEFAAGRK

SEQ ID NO: 103980 - protein, 8 aa, Dengue virus
EFAAGRKS

SEQ ID NO: 103981 - protein, 8 aa, Dengue virus
FAAGRKSL

SEQ ID NO: 103982 - protein, 8 aa, Dengue virus
AAGRKSLT

SEQ ID NO: 103983 - protein, 8 aa, Dengue virus
AGRKSLTL

SEQ ID NO: 103984 - protein, 8 aa, Dengue virus
LNLITEMG

SEQ ID NO: 103985 - protein, 8 aa, Dengue virus
NLITEMGR

SEQ ID NO: 103986 - protein, 8 aa, Dengue virus
LITEMGRL

SEQ ID NO: 103987 - protein, 8 aa, Dengue virus
ITEMGRLP

SEQ ID NO: 103988 - protein, 8 aa, Dengue virus
TEMGRLPT

SEQ ID NO: 103989 - protein, 8 aa, Dengue virus
EMGRLPTF

SEQ ID NO: 103990 - protein, 8 aa, Dengue virus
MGRLPTFM

SEQ ID NO: 103991 - protein, 8 aa, Dengue virus
GRLPTFMT

SEQ ID NO: 103992 - protein, 8 aa, Dengue virus
RNALDNLV

SEQ ID NO: 103993 - protein, 8 aa, Dengue virus
DALDNLAV

SEQ ID NO: 103994 - protein, 8 aa, Dengue virus
ALDNLAVL

SEQ ID NO: 103995 - protein, 8 aa, Dengue virus
LDNLAVLH

SEQ ID NO: 103996 - protein, 8 aa, Dengue virus
DNLAVLHT

SEQ ID NO: 103997 - protein, 8 aa, Dengue virus
NLAVLHTA

SEQ ID NO: 103998 - protein, 8 aa, Dengue virus
LAVLHTAE

SEQ ID NO: 103999 - protein, 8 aa, Dengue virus
AYNHALSE

SEQ ID NO: 104000 - protein, 8 aa, Dengue virus
YNHALSEL

SEQ ID NO: 104001 - protein, 8 aa, Dengue virus
NHALSELP

SEQ ID NO: 104002 - protein, 8 aa, Dengue virus
HALSELPE

SEQ ID NO: 104003 - protein, 8 aa, Dengue virus
ALSELPET

SEQ ID NO: 104004 - protein, 8 aa, Dengue virus
LSELPETL

SEQ ID NO: 104005 - protein, 8 aa, Dengue virus
SELPETLE

SEQ ID NO: 104006 - protein, 8 aa, Dengue virus
ELPETLET

SEQ ID NO: 104007 - protein, 8 aa, Dengue virus
LPETLETL

SEQ ID NO: 104008 - protein, 8 aa, Dengue virus
PETLETLL

SEQ ID NO: 104009 - protein, 8 aa, Dengue virus
ETLETLLL

SEQ ID NO: 104010 - protein, 8 aa, Dengue virus
TLETLLLL

SEQ ID NO: 104011 - protein, 8 aa, Dengue virus
LETLLLLT

SEQ ID NO: 104012 - protein, 8 aa, Dengue virus
ETLLLLTL

SEQ ID NO: 104013 - protein, 8 aa, Dengue virus
TLLLLTLL

SEQ ID NO: 104014 - protein, 8 aa, Dengue virus
LLLLTLLA

SEQ ID NO: 104015 - protein, 8 aa, Dengue virus
LLATVTGG

SEQ ID NO: 104016 - protein, 8 aa, Dengue virus
VTGGIFLF

SEQ ID NO: 104017 - protein, 8 aa, Dengue virus
TGGIFLFL

SEQ ID NO: 104018 - protein, 8 aa, Dengue virus
GIFLFLMS

SEQ ID NO: 104019 - protein, 8 aa, Dengue virus
GKMTLGMC

SEQ ID NO: 104020 - protein, 8 aa, Dengue virus
KMTLGMCC

SEQ ID NO: 104021 - protein, 8 aa, Dengue virus
MTLGMCCI

SEQ ID NO: 104022 - protein, 8 aa, Dengue virus
IQPHWIAA

SEQ ID NO: 104023 - protein, 8 aa, Dengue virus
QPHWIAAS

SEQ ID NO: 104024 - protein, 8 aa, Dengue virus
LQWIASAI

SEQ ID NO: 104025 - protein, 8 aa, Dengue virus
QWIASAIV

SEQ ID NO: 104026 - protein, 8 aa, Dengue virus
WIASAIVL

SEQ ID NO: 104027 - protein, 8 aa, Dengue virus
IASAIVLE

SEQ ID NO: 104028 - protein, 8 aa, Dengue virus
ASAIVLEF

SEQ ID NO: 104029 - protein, 8 aa, Dengue virus
SAIVLEFF

SEQ ID NO: 104030 - protein, 8 aa, Dengue virus
AIVLEFFM

SEQ ID NO: 104031 - protein, 8 aa, Dengue virus
IILEFFLI

SEQ ID NO: 104032 - protein, 8 aa, Dengue virus
ILEFFLIV

SEQ ID NO: 104033 - protein, 8 aa, Dengue virus
LEFFLIVL

SEQ ID NO: 104034 - protein, 8 aa, Dengue virus
EFFLIVLL

SEQ ID NO: 104035 - protein, 8 aa, Dengue virus
FFLIVLLI

SEQ ID NO: 104036 - protein, 8 aa, Dengue virus
FLIVLLIP

SEQ ID NO: 104037 - protein, 8 aa, Dengue virus
LIVLLIPE

SEQ ID NO: 104038 - protein, 8 aa, Dengue virus
IVLLIPEP

SEQ ID NO: 104039 - protein, 8 aa, Dengue virus
VLLIPEPD

SEQ ID NO: 104040 - protein, 8 aa, Dengue virus
LLIPEPDR

SEQ ID NO: 104041 - protein, 8 aa, Dengue virus
LIPEPDRQ

SEQ ID NO: 104042 - protein, 8 aa, Dengue virus
IPEPDRQR

SEQ ID NO: 104043 - protein, 8 aa, Dengue virus
PEPDRQRT

SEQ ID NO: 104044 - protein, 8 aa, Dengue virus
EPDRQRTP

SEQ ID NO: 104045 - protein, 8 aa, Dengue virus
PDRQRTPQ

SEQ ID NO: 104046 - protein, 8 aa, Dengue virus
DRQRTPQD

SEQ ID NO: 104047 - protein, 8 aa, Dengue virus
RQRTPQDN

SEQ ID NO: 104048 - protein, 8 aa, Dengue virus
TPQDNQLT

SEQ ID NO: 104049 - protein, 8 aa, Dengue virus
PQDNQLTY

SEQ ID NO: 104050 - protein, 8 aa, Dengue virus
QDNQLTYV

SEQ ID NO: 104051 - protein, 8 aa, Dengue virus
DNQLTYVV

SEQ ID NO: 104052 - protein, 8 aa, Dengue virus
NQLTYVVI

SEQ ID NO: 104053 - protein, 8 aa, Dengue virus
QLTYVVIA

SEQ ID NO: 104054 - protein, 8 aa, Dengue virus
LTYVVIAI

SEQ ID NO: 104055 - protein, 8 aa, Dengue virus
TYVVIAIL

SEQ ID NO: 104056 - protein, 8 aa, Dengue virus
YVVIAILT

SEQ ID NO: 104057 - protein, 8 aa, Dengue virus
TMANEMGF

SEQ ID NO: 104058 - protein, 8 aa, Dengue virus
MANEMGFL

SEQ ID NO: 104059 - protein, 8 aa, Dengue virus
ANEMGFLE

SEQ ID NO: 104060 - protein, 8 aa, Dengue virus
NEMGFLEK

SEQ ID NO: 104061 - protein, 8 aa, Dengue virus
EMGFLEKT

SEQ ID NO: 104062 - protein, 8 aa, Dengue virus
MGFLEKTK

SEQ ID NO: 104063 - protein, 8 aa, Dengue virus
GFLEKTKK

SEQ ID NO: 104064 - protein, 8 aa, Dengue virus
FLEKTKKD

SEQ ID NO: 104065 - protein, 8 aa, Dengue virus
LEKTKKDL

SEQ ID NO: 104066 - protein, 8 aa, Dengue virus
EKTKKDLG

SEQ ID NO: 104067 - protein, 8 aa, Dengue virus
LDIDLRPA

SEQ ID NO: 104068 - protein, 8 aa, Dengue virus
DIDLRPAS

SEQ ID NO: 104069 - protein, 8 aa, Dengue virus
IDLRPASA

SEQ ID NO: 104070 - protein, 8 aa, Dengue virus
DLRPASAW

SEQ ID NO: 104071 - protein, 8 aa, Dengue virus
LRPASAWT

SEQ ID NO: 104072 - protein, 8 aa, Dengue virus
RPASAWTL

SEQ ID NO: 104073 - protein, 8 aa, Dengue virus
LYAVATTF

SEQ ID NO: 104074 - protein, 8 aa, Dengue virus
YAVATTVI

SEQ ID NO: 104075 - protein, 8 aa, Dengue virus
AVATTVIT

SEQ ID NO: 104076 - protein, 8 aa, Dengue virus
VATTVITP

SEQ ID NO: 104077 - protein, 8 aa, Dengue virus
ATTVITPM

SEQ ID NO: 104078 - protein, 8 aa, Dengue virus
VTPMLRHS

SEQ ID NO: 104079 - protein, 8 aa, Dengue virus
TPMLRHSI

SEQ ID NO: 104080 - protein, 8 aa, Dengue virus
PMLRHSIE

SEQ ID NO: 104081 - protein, 8 aa, Dengue virus
MLRHSIEN

SEQ ID NO: 104082 - protein, 8 aa, Dengue virus
LRHSIENS

SEQ ID NO: 104083 - protein, 8 aa, Dengue virus
RHSIENSS

SEQ ID NO: 104084 - protein, 8 aa, Dengue virus
HSIENSSV

SEQ ID NO: 104085 - protein, 8 aa, Dengue virus
SIENSSVN

SEQ ID NO: 104086 - protein, 8 aa, Dengue virus
IENSSVNV

SEQ ID NO: 104087 - protein, 8 aa, Dengue virus
ENSSVNVS

SEQ ID NO: 104088 - protein, 8 aa, Dengue virus
NSSVNVSL

SEQ ID NO: 104089 - protein, 8 aa, Dengue virus
SSVNVSLT

SEQ ID NO: 104090 - protein, 8 aa, Dengue virus
SVNVSLTA

SEQ ID NO: 104091 - protein, 8 aa, Dengue virus
VNVSLTAI

SEQ ID NO: 104092 - protein, 8 aa, Dengue virus
NVSLTAIA

SEQ ID NO: 104093 - protein, 8 aa, Dengue virus
VSLTAIAN

SEQ ID NO: 104094 - protein, 8 aa, Dengue virus
SLAAIANQ

SEQ ID NO: 104095 - protein, 8 aa, Dengue virus
LAAIANQA

SEQ ID NO: 104096 - protein, 8 aa, Dengue virus
TAIANQAT

SEQ ID NO: 104097 - protein, 8 aa, Dengue virus
AIANQATV

SEQ ID NO: 104098 - protein, 8 aa, Dengue virus
IANQATVL

SEQ ID NO: 104099 - protein, 8 aa, Dengue virus
ANQATVLM

SEQ ID NO: 104100 - protein, 8 aa, Dengue virus
NQATVLMG

SEQ ID NO: 104101 - protein, 8 aa, Dengue virus
QATVLMGL

SEQ ID NO: 104102 - protein, 8 aa, Dengue virus
ATVLMGLG

SEQ ID NO: 104103 - protein, 8 aa, Dengue virus
TVLMGLGK

SEQ ID NO: 104104 - protein, 8 aa, Dengue virus
VLMGLGKG

SEQ ID NO: 104105 - protein, 8 aa, Dengue virus
LMGLGKGW

SEQ ID NO: 104106 - protein, 8 aa, Dengue virus
MGLGKGWP

SEQ ID NO: 104107 - protein, 8 aa, Dengue virus
GLGKGWPL

SEQ ID NO: 104108 - protein, 8 aa, Dengue virus
LGKGWPLS

SEQ ID NO: 104109 - protein, 8 aa, Dengue virus
GKGWPLSK

SEQ ID NO: 104110 - protein, 8 aa, Dengue virus
KGWPLSKM

SEQ ID NO: 104111 - protein, 8 aa, Dengue virus
GWPLSKMD

SEQ ID NO: 104112 - protein, 8 aa, Dengue virus
WPLSKMDI

SEQ ID NO: 104113 - protein, 8 aa, Dengue virus
PLSKMDIG

SEQ ID NO: 104114 - protein, 8 aa, Dengue virus
LSKMDIGV

SEQ ID NO: 104115 - protein, 8 aa, Dengue virus
SKMDLGVP

SEQ ID NO: 104116 - protein, 8 aa, Dengue virus
KMDLGVPL

SEQ ID NO: 104117 - protein, 8 aa, Dengue virus
MDLGVPLL

SEQ ID NO: 104118 - protein, 8 aa, Dengue virus
DLGVPLLA

SEQ ID NO: 104119 - protein, 8 aa, Dengue virus
IGVPLLAI

SEQ ID NO: 104120 - protein, 8 aa, Dengue virus
GVPLLAIG

SEQ ID NO: 104121 - protein, 8 aa, Dengue virus
VPLLAIGC

SEQ ID NO: 104122 - protein, 8 aa, Dengue virus
PLLAIGCY

SEQ ID NO: 104123 - protein, 8 aa, Dengue virus
LLAIGCYS

SEQ ID NO: 104124 - protein, 8 aa, Dengue virus
LAIGCYSQ

SEQ ID NO: 104125 - protein, 8 aa, Dengue virus
AIGCYSQV

SEQ ID NO: 104126 - protein, 8 aa, Dengue virus
IGCYSQVN

SEQ ID NO: 104127 - protein, 8 aa, Dengue virus
CYSQVNPI

SEQ ID NO: 104128 - protein, 8 aa, Dengue virus
YSQVNPIT

SEQ ID NO: 104129 - protein, 8 aa, Dengue virus
SQVNPITL

SEQ ID NO: 104130 - protein, 8 aa, Dengue virus
QVNPITLT

SEQ ID NO: 104131 - protein, 8 aa, Dengue virus
VNPITLTA

SEQ ID NO: 104132 - protein, 8 aa, Dengue virus
NPITLTAA

SEQ ID NO: 104133 - protein, 8 aa, Dengue virus
PITLTAAL

SEQ ID NO: 104134 - protein, 8 aa, Dengue virus
LITHYAII

SEQ ID NO: 104135 - protein, 8 aa, Dengue virus
ITHYAIIG

SEQ ID NO: 104136 - protein, 8 aa, Dengue virus
THYAIIGP

SEQ ID NO: 104137 - protein, 8 aa, Dengue virus
TREAQKRA

SEQ ID NO: 104138 - protein, 8 aa, Dengue virus
REAQKRAA

SEQ ID NO: 104139 - protein, 8 aa, Dengue virus
EAQKRAAA

SEQ ID NO: 104140 - protein, 8 aa, Dengue virus
AQKRAAAG

SEQ ID NO: 104141 - protein, 8 aa, Dengue virus
QKRAAAGI

SEQ ID NO: 104142 - protein, 8 aa, Dengue virus
KRAAAGIM

SEQ ID NO: 104143 - protein, 8 aa, Dengue virus
RAAAGIMK

SEQ ID NO: 104144 - protein, 8 aa, Dengue virus
AAAGIMKN

SEQ ID NO: 104145 - protein, 8 aa, Dengue virus
GIMKNPTI

SEQ ID NO: 104146 - protein, 8 aa, Dengue virus
IMKNPTID

SEQ ID NO: 104147 - protein, 8 aa, Dengue virus
MKNPTIDG

SEQ ID NO: 104148 - protein, 8 aa, Dengue virus
KNPTIDGI

SEQ ID NO: 104149 - protein, 8 aa, Dengue virus
NPTVDGIT

SEQ ID NO: 104150 - protein, 8 aa, Dengue virus
PTVDGITV

SEQ ID NO: 104151 - protein, 8 aa, Dengue virus
TVDGITVI

SEQ ID NO: 104152 - protein, 8 aa, Dengue virus
DGITVIDL

SEQ ID NO: 104153 - protein, 8 aa, Dengue virus
MTIDLDPV

SEQ ID NO: 104154 - protein, 8 aa, Dengue virus
TIDLDPVI

SEQ ID NO: 104155 - protein, 8 aa, Dengue virus
IDLDPVIY

SEQ ID NO: 104156 - protein, 8 aa, Dengue virus
DLDPVIYD

SEQ ID NO: 104157 - protein, 8 aa, Dengue virus
PIPYDPKF

SEQ ID NO: 104158 - protein, 8 aa, Dengue virus
IPYDPKFE

SEQ ID NO: 104159 - protein, 8 aa, Dengue virus
PYDPKFEK

SEQ ID NO: 104160 - protein, 8 aa, Dengue virus
YDPKFEKQ

SEQ ID NO: 104161 - protein, 8 aa, Dengue virus
DPKFEKQL

SEQ ID NO: 104162 - protein, 8 aa, Dengue virus
PKFEKQLG

SEQ ID NO: 104163 - protein, 8 aa, Dengue virus
FEKQLGQI

SEQ ID NO: 104164 - protein, 8 aa, Dengue virus
EKQLGQIM

SEQ ID NO: 104165 - protein, 8 aa, Dengue virus
KQLGQIML

SEQ ID NO: 104166 - protein, 8 aa, Dengue virus
QLGQIMLL

SEQ ID NO: 104167 - protein, 8 aa, Dengue virus
LGQVMLLV

SEQ ID NO: 104168 - protein, 8 aa, Dengue virus
GQVMLLVL

SEQ ID NO: 104169 - protein, 8 aa, Dengue virus
QVMLLVLC

SEQ ID NO: 104170 - protein, 8 aa, Dengue virus
VMLLVLCA

SEQ ID NO: 104171 - protein, 8 aa, Dengue virus
LCVTQVLM

SEQ ID NO: 104172 - protein, 8 aa, Dengue virus
CVTQVLMM

SEQ ID NO: 104173 - protein, 8 aa, Dengue virus
VTQVLMMR

SEQ ID NO: 104174 - protein, 8 aa, Dengue virus
TQVLMMRT

SEQ ID NO: 104175 - protein, 8 aa, Dengue virus
QVLMMRTT

SEQ ID NO: 104176 - protein, 8 aa, Dengue virus
VLMMRTTW

SEQ ID NO: 104177 - protein, 8 aa, Dengue virus
LMMRTTWA

SEQ ID NO: 104178 - protein, 8 aa, Dengue virus
MMRTTWAL

SEQ ID NO: 104179 - protein, 8 aa, Dengue virus
MRTSWALC

SEQ ID NO: 104180 - protein, 8 aa, Dengue virus
RTSWALCE

SEQ ID NO: 104181 - protein, 8 aa, Dengue virus
TTWALCEA

SEQ ID NO: 104182 - protein, 8 aa, Dengue virus
TWALCEAL

SEQ ID NO: 104183 - protein, 8 aa, Dengue virus
WALCESIT

SEQ ID NO: 104184 - protein, 8 aa, Dengue virus
ALCESITL

SEQ ID NO: 104185 - protein, 8 aa, Dengue virus
LCESITLA

SEQ ID NO: 104186 - protein, 8 aa, Dengue virus
CESITLAT

SEQ ID NO: 104187 - protein, 8 aa, Dengue virus
ESITLATG

SEQ ID NO: 104188 - protein, 8 aa, Dengue virus
SITLATGP

SEQ ID NO: 104189 - protein, 8 aa, Dengue virus
ITLATGPL

SEQ ID NO: 104190 - protein, 8 aa, Dengue virus
TLATGPIS

SEQ ID NO: 104191 - protein, 8 aa, Dengue virus
LATGPIST

SEQ ID NO: 104192 - protein, 8 aa, Dengue virus
ATGPISTL

SEQ ID NO: 104193 - protein, 8 aa, Dengue virus
TGPISTLW

SEQ ID NO: 104194 - protein, 8 aa, Dengue virus
GPISTLWE

SEQ ID NO: 104195 - protein, 8 aa, Dengue virus
PISTLWEG

SEQ ID NO: 104196 - protein, 8 aa, Dengue virus
ISTLWEGN

SEQ ID NO: 104197 - protein, 8 aa, Dengue virus
STLWEGNP

SEQ ID NO: 104198 - protein, 8 aa, Dengue virus
TLWEGNPG

SEQ ID NO: 104199 - protein, 8 aa, Dengue virus
LWEGNPGR

SEQ ID NO: 104200 - protein, 8 aa, Dengue virus
WEGNPGRF

SEQ ID NO: 104201 - protein, 8 aa, Dengue virus
EGNPGRFW

SEQ ID NO: 104202 - protein, 8 aa, Dengue virus
GNPGRFWN

SEQ ID NO: 104203 - protein, 8 aa, Dengue virus
NPGRFWNT

SEQ ID NO: 104204 - protein, 8 aa, Dengue virus
PGRFWNTT

SEQ ID NO: 104205 - protein, 8 aa, Dengue virus
GRFWNTTI

SEQ ID NO: 104206 - protein, 8 aa, Dengue virus
RFWNTTIA

SEQ ID NO: 104207 - protein, 8 aa, Dengue virus
NTTIAVST

SEQ ID NO: 104208 - protein, 8 aa, Dengue virus
TTIAVSTA

SEQ ID NO: 104209 - protein, 8 aa, Dengue virus
TIAVSTAN

SEQ ID NO: 104210 - protein, 8 aa, Dengue virus
IAVSTANI

SEQ ID NO: 104211 - protein, 8 aa, Dengue virus
AVSTANIF

SEQ ID NO: 104212 - protein, 8 aa, Dengue virus
VSTANIFR

SEQ ID NO: 104213 - protein, 8 aa, Dengue virus
STANIFRG

SEQ ID NO: 104214 - protein, 8 aa, Dengue virus
TANIFRGS

SEQ ID NO: 104215 - protein, 8 aa, Dengue virus
YLAGAGLL

SEQ ID NO: 104216 - protein, 8 aa, Dengue virus
LAGAGLLF

SEQ ID NO: 104217 - protein, 8 aa, Dengue virus
AGAGLLFS

SEQ ID NO: 104218 - protein, 8 aa, Dengue virus
GAGLLFSI

SEQ ID NO: 104219 - protein, 8 aa, Dengue virus
AGLLFSIM

SEQ ID NO: 104220 - protein, 8 aa, Dengue virus
GLLFSIMK

SEQ ID NO: 104221 - protein, 8 aa, Dengue virus
LLFSIMKN

SEQ ID NO: 104222 - protein, 8 aa, Dengue virus
LFSIMKNT

SEQ ID NO: 104223 - protein, 8 aa, Dengue virus
IGETLGEK

SEQ ID NO: 104224 - protein, 8 aa, Dengue virus
TLGEKWKS

SEQ ID NO: 104225 - protein, 8 aa, Dengue virus
LGEKWKSR

SEQ ID NO: 104226 - protein, 8 aa, Dengue virus
GEKWKSRL

SEQ ID NO: 104227 - protein, 8 aa, Dengue virus
EKWKSRLN

SEQ ID NO: 104228 - protein, 8 aa, Dengue virus
SGIQEVDR

SEQ ID NO: 104229 - protein, 8 aa, Dengue virus
EVDRTLAK

SEQ ID NO: 104230 - protein, 8 aa, Dengue virus
VDRTLAKE

SEQ ID NO: 104231 - protein, 8 aa, Dengue virus
DRTLAKEG

SEQ ID NO: 104232 - protein, 8 aa, Dengue virus
RTLAKEGI

SEQ ID NO: 104233 - protein, 8 aa, Dengue virus
LAKEGIKR

SEQ ID NO: 104234 - protein, 8 aa, Dengue virus
AKEGIKRG

SEQ ID NO: 104235 - protein, 8 aa, Dengue virus
KEGIKRGE

SEQ ID NO: 104236 - protein, 8 aa, Dengue virus
EGIKRGET

SEQ ID NO: 104237 - protein, 8 aa, Dengue virus
DHHAVSRG

SEQ ID NO: 104238 - protein, 8 aa, Dengue virus
KHAVSRGT

SEQ ID NO: 104239 - protein, 8 aa, Dengue virus
HAVSRGTA

SEQ ID NO: 104240 - protein, 8 aa, Dengue virus
AVSRGTAK

SEQ ID NO: 104241 - protein, 8 aa, Dengue virus
VSRGTAKL

SEQ ID NO: 104242 - protein, 8 aa, Dengue virus
SRGSAKLR

SEQ ID NO: 104243 - protein, 8 aa, Dengue virus
RGSAKLRW

SEQ ID NO: 104244 - protein, 8 aa, Dengue virus
GSAKLRWF

SEQ ID NO: 104245 - protein, 8 aa, Dengue virus
SAKLRWFV

SEQ ID NO: 104246 - protein, 8 aa, Dengue virus
AKLQWFVE

SEQ ID NO: 104247 - protein, 8 aa, Dengue virus
KLQWFVER

SEQ ID NO: 104248 - protein, 8 aa, Dengue virus
LQWFVERN

SEQ ID NO: 104249 - protein, 8 aa, Dengue virus
RWFVERNM

SEQ ID NO: 104250 - protein, 8 aa, Dengue virus
WFVERNLV

SEQ ID NO: 104251 - protein, 8 aa, Dengue virus
PEGKVVDL

SEQ ID NO: 104252 - protein, 8 aa, Dengue virus
EGKVVDLG

SEQ ID NO: 104253 - protein, 8 aa, Dengue virus
GKVVDLGC

SEQ ID NO: 104254 - protein, 8 aa, Dengue virus
KVVDLGCG

SEQ ID NO: 104255 - protein, 8 aa, Dengue virus
VVDLGCGR

SEQ ID NO: 104256 - protein, 8 aa, Dengue virus
VDLGCGRG

SEQ ID NO: 104257 - protein, 8 aa, Dengue virus
RGGWSYYM

SEQ ID NO: 104258 - protein, 8 aa, Dengue virus
GGWSYYCG

SEQ ID NO: 104259 - protein, 8 aa, Dengue virus
GWSYYCGG

SEQ ID NO: 104260 - protein, 8 aa, Dengue virus
WSYYCGGL

SEQ ID NO: 104261 - protein, 8 aa, Dengue virus
SYYCGGLK

SEQ ID NO: 104262 - protein, 8 aa, Dengue virus
YYCGGLKN

SEQ ID NO: 104263 - protein, 8 aa, Dengue virus
YCGGLKNV

SEQ ID NO: 104264 - protein, 8 aa, Dengue virus
CGGLKNVR

SEQ ID NO: 104265 - protein, 8 aa, Dengue virus
GGLKNVRE

SEQ ID NO: 104266 - protein, 8 aa, Dengue virus
GLKNVREV

SEQ ID NO: 104267 - protein, 8 aa, Dengue virus
VREVKGLT

SEQ ID NO: 104268 - protein, 8 aa, Dengue virus
REVKGLTK

SEQ ID NO: 104269 - protein, 8 aa, Dengue virus
EVKGLTKG

SEQ ID NO: 104270 - protein, 8 aa, Dengue virus
VKGLTKGG

SEQ ID NO: 104271 - protein, 8 aa, Dengue virus
KGLTKGGP

SEQ ID NO: 104272 - protein, 8 aa, Dengue virus
GLTKGGPG

SEQ ID NO: 104273 - protein, 8 aa, Dengue virus
LTKGGPGH

SEQ ID NO: 104274 - protein, 8 aa, Dengue virus
GPGHEEPV

SEQ ID NO: 104275 - protein, 8 aa, Dengue virus
PGHEEPVP

SEQ ID NO: 104276 - protein, 8 aa, Dengue virus
GHEEPVPM

SEQ ID NO: 104277 - protein, 8 aa, Dengue virus
HEEPIPMS

SEQ ID NO: 104278 - protein, 8 aa, Dengue virus
EEPIPMST

SEQ ID NO: 104279 - protein, 8 aa, Dengue virus
EPIPMSTY

SEQ ID NO: 104280 - protein, 8 aa, Dengue virus
PIPMSTYG

SEQ ID NO: 104281 - protein, 8 aa, Dengue virus
IPMSTYGW

SEQ ID NO: 104282 - protein, 8 aa, Dengue virus
PMATYGWN

SEQ ID NO: 104283 - protein, 8 aa, Dengue virus
MSTYGWNL

SEQ ID NO: 104284 - protein, 8 aa, Dengue virus
STYGWNLV

SEQ ID NO: 104285 - protein, 8 aa, Dengue virus
TYGWNLVR

SEQ ID NO: 104286 - protein, 8 aa, Dengue virus
YGWNLVRL

SEQ ID NO: 104287 - protein, 8 aa, Dengue virus
GWNLVRLQ

SEQ ID NO: 104288 - protein, 8 aa, Dengue virus
WNLVRLQS

SEQ ID NO: 104289 - protein, 8 aa, Dengue virus
NLVRLQSG

SEQ ID NO: 104290 - protein, 8 aa, Dengue virus
LQSGVDVF

SEQ ID NO: 104291 - protein, 8 aa, Dengue virus
QSGVDVFF

SEQ ID NO: 104292 - protein, 8 aa, Dengue virus
PTEQVDTL

SEQ ID NO: 104293 - protein, 8 aa, Dengue virus
TEQVDTLL

SEQ ID NO: 104294 - protein, 8 aa, Dengue virus
EQVDTLLC

SEQ ID NO: 104295 - protein, 8 aa, Dengue virus
QVDTLLCD

SEQ ID NO: 104296 - protein, 8 aa, Dengue virus
VDTLLCDI

SEQ ID NO: 104297 - protein, 8 aa, Dengue virus
CDIGESSS

SEQ ID NO: 104298 - protein, 8 aa, Dengue virus
DIGESSPS

SEQ ID NO: 104299 - protein, 8 aa, Dengue virus
IGESSPSP

SEQ ID NO: 104300 - protein, 8 aa, Dengue virus
GESSPSPT

SEQ ID NO: 104301 - protein, 8 aa, Dengue virus
ESSPSPTV

SEQ ID NO: 104302 - protein, 8 aa, Dengue virus
SSPSPTVE

SEQ ID NO: 104303 - protein, 8 aa, Dengue virus
SPSPTVEE

SEQ ID NO: 104304 - protein, 8 aa, Dengue virus
PSPTVEES

SEQ ID NO: 104305 - protein, 8 aa, Dengue virus
SPTVEESR

SEQ ID NO: 104306 - protein, 8 aa, Dengue virus
PTVEESRT

SEQ ID NO: 104307 - protein, 8 aa, Dengue virus
TVEESRTI

SEQ ID NO: 104308 - protein, 8 aa, Dengue virus
VEESRTIR

SEQ ID NO: 104309 - protein, 8 aa, Dengue virus
EAGRTLRV

SEQ ID NO: 104310 - protein, 8 aa, Dengue virus
AGRTLRVL

SEQ ID NO: 104311 - protein, 8 aa, Dengue virus
GRTLRVLN

SEQ ID NO: 104312 - protein, 8 aa, Dengue virus
RTLRVLNL

SEQ ID NO: 104313 - protein, 8 aa, Dengue virus
TLRVLNLV

SEQ ID NO: 104314 - protein, 8 aa, Dengue virus
LRVLNLVE

SEQ ID NO: 104315 - protein, 8 aa, Dengue virus
RVLNLVEN

SEQ ID NO: 104316 - protein, 8 aa, Dengue virus
VLNLVENW

SEQ ID NO: 104317 - protein, 8 aa, Dengue virus
LNLVENWL

SEQ ID NO: 104318 - protein, 8 aa, Dengue virus
NLVENWLN

SEQ ID NO: 104319 - protein, 8 aa, Dengue virus
QFCIKILN

SEQ ID NO: 104320 - protein, 8 aa, Dengue virus
FCIKILNP

SEQ ID NO: 104321 - protein, 8 aa, Dengue virus
CIKILNPY

SEQ ID NO: 104322 - protein, 8 aa, Dengue virus
IKILNPYM

SEQ ID NO: 104323 - protein, 8 aa, Dengue virus
KILNPYMP

SEQ ID NO: 104324 - protein, 8 aa, Dengue virus
VLNPYMPS

SEQ ID NO: 104325 - protein, 8 aa, Dengue virus
LNPYMPTV

SEQ ID NO: 104326 - protein, 8 aa, Dengue virus
NPYMPSVI

SEQ ID NO: 104327 - protein, 8 aa, Dengue virus
PYMPSVIE

SEQ ID NO: 104328 - protein, 8 aa, Dengue virus
YGGALVRN

SEQ ID NO: 104329 - protein, 8 aa, Dengue virus
GGALVRNP

SEQ ID NO: 104330 - protein, 8 aa, Dengue virus
GALVRNPL

SEQ ID NO: 104331 - protein, 8 aa, Dengue virus
ALVRNPLS

SEQ ID NO: 104332 - protein, 8 aa, Dengue virus
LVRCPLSR

SEQ ID NO: 104333 - protein, 8 aa, Dengue virus
VRCPLSRN

SEQ ID NO: 104334 - protein, 8 aa, Dengue virus
RCPLSRNS

SEQ ID NO: 104335 - protein, 8 aa, Dengue virus
CPLSRNST

SEQ ID NO: 104336 - protein, 8 aa, Dengue virus
STHEMYWI

SEQ ID NO: 104337 - protein, 8 aa, Dengue virus
THEMYWIS

SEQ ID NO: 104338 - protein, 8 aa, Dengue virus
HEMYWVSN

SEQ ID NO: 104339 - protein, 8 aa, Dengue virus
EMYWVSNA

SEQ ID NO: 104340 - protein, 8 aa, Dengue virus
MYWISNGT

SEQ ID NO: 104341 - protein, 8 aa, Dengue virus
YWISNGTG

SEQ ID NO: 104342 - protein, 8 aa, Dengue virus
WISNGTGN

SEQ ID NO: 104343 - protein, 8 aa, Dengue virus
ISNGTGNI

SEQ ID NO: 104344 - protein, 8 aa, Dengue virus
SNGTGNIV

SEQ ID NO: 104345 - protein, 8 aa, Dengue virus
ASGNIVSS

SEQ ID NO: 104346 - protein, 8 aa, Dengue virus
TGNIVSSV

SEQ ID NO: 104347 - protein, 8 aa, Dengue virus
GNIVSAVN

SEQ ID NO: 104348 - protein, 8 aa, Dengue virus
NIVSSVNM

SEQ ID NO: 104349 - protein, 8 aa, Dengue virus
IVSSVNMI

SEQ ID NO: 104350 - protein, 8 aa, Dengue virus
VSSVNMIS

SEQ ID NO: 104351 - protein, 8 aa, Dengue virus
SSVNMISR

SEQ ID NO: 104352 - protein, 8 aa, Dengue virus
SVNMISRM

SEQ ID NO: 104353 - protein, 8 aa, Dengue virus
VNMISRML

SEQ ID NO: 104354 - protein, 8 aa, Dengue virus
NMISRMLI

SEQ ID NO: 104355 - protein, 8 aa, Dengue virus
MISRMLIN

SEQ ID NO: 104356 - protein, 8 aa, Dengue virus
ISRMLINR

SEQ ID NO: 104357 - protein, 8 aa, Dengue virus
SRMLINRF

SEQ ID NO: 104358 - protein, 8 aa, Dengue virus
RMLINRFT

SEQ ID NO: 104359 - protein, 8 aa, Dengue virus
MLINRFTM

SEQ ID NO: 104360 - protein, 8 aa, Dengue virus
LLNRFTMT

SEQ ID NO: 104361 - protein, 8 aa, Dengue virus
ATYEPDVD

SEQ ID NO: 104362 - protein, 8 aa, Dengue virus
TYEPDVDL

SEQ ID NO: 104363 - protein, 8 aa, Dengue virus
YEPDVDLG

SEQ ID NO: 104364 - protein, 8 aa, Dengue virus
EPDVDLGS

SEQ ID NO: 104365 - protein, 8 aa, Dengue virus
PDVDLGSG

SEQ ID NO: 104366 - protein, 8 aa, Dengue virus
DVDLGSGT

SEQ ID NO: 104367 - protein, 8 aa, Dengue virus
VDLGSGTR

SEQ ID NO: 104368 - protein, 8 aa, Dengue virus
DLGSGTRN

SEQ ID NO: 104369 - protein, 8 aa, Dengue virus
LGSGTRNI

SEQ ID NO: 104370 - protein, 8 aa, Dengue virus
GSGTRNIG

SEQ ID NO: 104371 - protein, 8 aa, Dengue virus
SGTRNIGI

SEQ ID NO: 104372 - protein, 8 aa, Dengue virus
GTRNIGIE

SEQ ID NO: 104373 - protein, 8 aa, Dengue virus
PNLDIIGK

SEQ ID NO: 104374 - protein, 8 aa, Dengue virus
NLDIIGKR

SEQ ID NO: 104375 - protein, 8 aa, Dengue virus
LDIIGKRI

SEQ ID NO: 104376 - protein, 8 aa, Dengue virus
DIIGKRIE

SEQ ID NO: 104377 - protein, 8 aa, Dengue virus
IIGKRIEK

SEQ ID NO: 104378 - protein, 8 aa, Dengue virus
IGKRIEKI

SEQ ID NO: 104379 - protein, 8 aa, Dengue virus
GKRIEKIK

SEQ ID NO: 104380 - protein, 8 aa, Dengue virus
TSWHYDQD

SEQ ID NO: 104381 - protein, 8 aa, Dengue virus
SWHYDQDH

SEQ ID NO: 104382 - protein, 8 aa, Dengue virus
WHYDQDHP

SEQ ID NO: 104383 - protein, 8 aa, Dengue virus
HYDQDHPY

SEQ ID NO: 104384 - protein, 8 aa, Dengue virus
YDQDHPYK

SEQ ID NO: 104385 - protein, 8 aa, Dengue virus
DQDHPYKT

SEQ ID NO: 104386 - protein, 8 aa, Dengue virus
QDHPYKTW

SEQ ID NO: 104387 - protein, 8 aa, Dengue virus
DHPYKTWA

SEQ ID NO: 104388 - protein, 8 aa, Dengue virus
HPYKTWAY

SEQ ID NO: 104389 - protein, 8 aa, Dengue virus
PYRTWAYH

SEQ ID NO: 104390 - protein, 8 aa, Dengue virus
YRTWAYHG

SEQ ID NO: 104391 - protein, 8 aa, Dengue virus
RTWAYHGS

SEQ ID NO: 104392 - protein, 8 aa, Dengue virus
AYHGSYET

SEQ ID NO: 104393 - protein, 8 aa, Dengue virus
YHGSYETK

SEQ ID NO: 104394 - protein, 8 aa, Dengue virus
HGSYETKQ

SEQ ID NO: 104395 - protein, 8 aa, Dengue virus
GSYETKQT

SEQ ID NO: 104396 - protein, 8 aa, Dengue virus
SYETKQTG

SEQ ID NO: 104397 - protein, 8 aa, Dengue virus
YETKQTGS

SEQ ID NO: 104398 - protein, 8 aa, Dengue virus
ETKQTGSA

SEQ ID NO: 104399 - protein, 8 aa, Dengue virus
TKQTGSAS

SEQ ID NO: 104400 - protein, 8 aa, Dengue virus
KQTGSASS

SEQ ID NO: 104401 - protein, 8 aa, Dengue virus
QTGSASSM

SEQ ID NO: 104402 - protein, 8 aa, Dengue virus
TGSASSMV

SEQ ID NO: 104403 - protein, 8 aa, Dengue virus
GSASSMIN

SEQ ID NO: 104404 - protein, 8 aa, Dengue virus
SASSMING

SEQ ID NO: 104405 - protein, 8 aa, Dengue virus
ASSMINGV

SEQ ID NO: 104406 - protein, 8 aa, Dengue virus
SSMINGVV

SEQ ID NO: 104407 - protein, 8 aa, Dengue virus
SMVNGVVK

SEQ ID NO: 104408 - protein, 8 aa, Dengue virus
MVNGVVKL

SEQ ID NO: 104409 - protein, 8 aa, Dengue virus
VNGVVKLL

SEQ ID NO: 104410 - protein, 8 aa, Dengue virus
NGVVRLLT

SEQ ID NO: 104411 - protein, 8 aa, Dengue virus
GVVRLLTK

SEQ ID NO: 104412 - protein, 8 aa, Dengue virus
VVRLLTKP

SEQ ID NO: 104413 - protein, 8 aa, Dengue virus
VRLLTKPW

SEQ ID NO: 104414 - protein, 8 aa, Dengue virus
RLLTKPWD

SEQ ID NO: 104415 - protein, 8 aa, Dengue virus
LTKPWDVV

SEQ ID NO: 104416 - protein, 8 aa, Dengue virus
TKPWDVVP

SEQ ID NO: 104417 - protein, 8 aa, Dengue virus
KPWDVVPM

SEQ ID NO: 104418 - protein, 8 aa, Dengue virus
PWDVVPMV

SEQ ID NO: 104419 - protein, 8 aa, Dengue virus
WDVVPMVT

SEQ ID NO: 104420 - protein, 8 aa, Dengue virus
DVVPMVTQ

SEQ ID NO: 104421 - protein, 8 aa, Dengue virus
PMVTQMAM

SEQ ID NO: 104422 - protein, 8 aa, Dengue virus
MVTQMAMT

SEQ ID NO: 104423 - protein, 8 aa, Dengue virus
VTQIAMTD

SEQ ID NO: 104424 - protein, 8 aa, Dengue virus
TQIAMTDT

SEQ ID NO: 104425 - protein, 8 aa, Dengue virus
QIAMTDTT

SEQ ID NO: 104426 - protein, 8 aa, Dengue virus
IAMTDTTP

SEQ ID NO: 104427 - protein, 8 aa, Dengue virus
EKVDTRTQ

SEQ ID NO: 104428 - protein, 8 aa, Dengue virus
KVDTRTQE

SEQ ID NO: 104429 - protein, 8 aa, Dengue virus
PRMCTREE

SEQ ID NO: 104430 - protein, 8 aa, Dengue virus
RMCTREEF

SEQ ID NO: 104431 - protein, 8 aa, Dengue virus
CTREEFTK

SEQ ID NO: 104432 - protein, 8 aa, Dengue virus
TREEFTKK

SEQ ID NO: 104433 - protein, 8 aa, Dengue virus
REEFTKKV

SEQ ID NO: 104434 - protein, 8 aa, Dengue virus
EEFTKKVR

SEQ ID NO: 104435 - protein, 8 aa, Dengue virus
KKVRTNAA

SEQ ID NO: 104436 - protein, 8 aa, Dengue virus
KVRSNAAL

SEQ ID NO: 104437 - protein, 8 aa, Dengue virus
VRSNAALG

SEQ ID NO: 104438 - protein, 8 aa, Dengue virus
RSNAALGA

SEQ ID NO: 104439 - protein, 8 aa, Dengue virus
SNAALGAI

SEQ ID NO: 104440 - protein, 8 aa, Dengue virus
NAALGAIF

SEQ ID NO: 104441 - protein, 8 aa, Dengue virus
AALGAIFT

SEQ ID NO: 104442 - protein, 8 aa, Dengue virus
ALGAIFTD

SEQ ID NO: 104443 - protein, 8 aa, Dengue virus
LGAIFTDE

SEQ ID NO: 104444 - protein, 8 aa, Dengue virus
GAIFTDEN

SEQ ID NO: 104445 - protein, 8 aa, Dengue virus
AIFTDENK

SEQ ID NO: 104446 - protein, 8 aa, Dengue virus
IFTDENKW

SEQ ID NO: 104447 - protein, 8 aa, Dengue virus
FTDENKWK

SEQ ID NO: 104448 - protein, 8 aa, Dengue virus
TDENKWKS

SEQ ID NO: 104449 - protein, 8 aa, Dengue virus
DENKWKSA

SEQ ID NO: 104450 - protein, 8 aa, Dengue virus
ENKWKSAR

SEQ ID NO: 104451 - protein, 8 aa, Dengue virus
NKWKSARE

SEQ ID NO: 104452 - protein, 8 aa, Dengue virus
KWKSAREA

SEQ ID NO: 104453 - protein, 8 aa, Dengue virus
WKSAREAV

SEQ ID NO: 104454 - protein, 8 aa, Dengue virus
KSAREAVE

SEQ ID NO: 104455 - protein, 8 aa, Dengue virus
SAREAVED

SEQ ID NO: 104456 - protein, 8 aa, Dengue virus
ERNLHLEG

SEQ ID NO: 104457 - protein, 8 aa, Dengue virus
RNLHLEGK

SEQ ID NO: 104458 - protein, 8 aa, Dengue virus
NLHLEGKC

SEQ ID NO: 104459 - protein, 8 aa, Dengue virus
LHLEGKCE

SEQ ID NO: 104460 - protein, 8 aa, Dengue virus
HLEGKCET

SEQ ID NO: 104461 - protein, 8 aa, Dengue virus
LEGKCETC

SEQ ID NO: 104462 - protein, 8 aa, Dengue virus
EGKCETCV

SEQ ID NO: 104463 - protein, 8 aa, Dengue virus
GKCETCVY

SEQ ID NO: 104464 - protein, 8 aa, Dengue virus
KCETCVYN

SEQ ID NO: 104465 - protein, 8 aa, Dengue virus
CETCVYNM

SEQ ID NO: 104466 - protein, 8 aa, Dengue virus
ETCVYNMM

SEQ ID NO: 104467 - protein, 8 aa, Dengue virus
SCVYNMMG

SEQ ID NO: 104468 - protein, 8 aa, Dengue virus
KKLGEFGR

SEQ ID NO: 104469 - protein, 8 aa, Dengue virus
KLGEFGRA

SEQ ID NO: 104470 - protein, 8 aa, Dengue virus
LGEFGRAK

SEQ ID NO: 104471 - protein, 8 aa, Dengue virus
GEFGRAKG

SEQ ID NO: 104472 - protein, 8 aa, Dengue virus
EFGRAKGS

SEQ ID NO: 104473 - protein, 8 aa, Dengue virus
FGRAKGSR

SEQ ID NO: 104474 - protein, 8 aa, Dengue virus
GRAKGSRA

SEQ ID NO: 104475 - protein, 8 aa, Dengue virus
RAKGSRAI

SEQ ID NO: 104476 - protein, 8 aa, Dengue virus
YMWLGARY

SEQ ID NO: 104477 - protein, 8 aa, Dengue virus
MWLGARYL

SEQ ID NO: 104478 - protein, 8 aa, Dengue virus
WLGARYLE

SEQ ID NO: 104479 - protein, 8 aa, Dengue virus
LGARYLEF

SEQ ID NO: 104480 - protein, 8 aa, Dengue virus
GARYLEFE

SEQ ID NO: 104481 - protein, 8 aa, Dengue virus
ARYLEFEA

SEQ ID NO: 104482 - protein, 8 aa, Dengue virus
RYLEFEAL

SEQ ID NO: 104483 - protein, 8 aa, Dengue virus
YLEFEALG

SEQ ID NO: 104484 - protein, 8 aa, Dengue virus
EFEALGFM

SEQ ID NO: 104485 - protein, 8 aa, Dengue virus
FEALGFMN

SEQ ID NO: 104486 - protein, 8 aa, Dengue virus
EALGFMNE

SEQ ID NO: 104487 - protein, 8 aa, Dengue virus
ALGFMNED

SEQ ID NO: 104488 - protein, 8 aa, Dengue virus
LGFMNEDH

SEQ ID NO: 104489 - protein, 8 aa, Dengue virus
GFMNEDHW

SEQ ID NO: 104490 - protein, 8 aa, Dengue virus
FMNEDHWF

SEQ ID NO: 104491 - protein, 8 aa, Dengue virus
MNEDHWFS

SEQ ID NO: 104492 - protein, 8 aa, Dengue virus
NEDHWFGR

SEQ ID NO: 104493 - protein, 8 aa, Dengue virus
EDHWFSRG

SEQ ID NO: 104494 - protein, 8 aa, Dengue virus
DHWFSRGN

SEQ ID NO: 104495 - protein, 8 aa, Dengue virus
HWFSRGNS

SEQ ID NO: 104496 - protein, 8 aa, Dengue virus
WFSRENSY

SEQ ID NO: 104497 - protein, 8 aa, Dengue virus
FSRENSYS

SEQ ID NO: 104498 - protein, 8 aa, Dengue virus
SRENSYSG

SEQ ID NO: 104499 - protein, 8 aa, Dengue virus
RENSYSGV

SEQ ID NO: 104500 - protein, 8 aa, Dengue virus
ENSYSGVE

SEQ ID NO: 104501 - protein, 8 aa, Dengue virus
NSYSGVEG

SEQ ID NO: 104502 - protein, 8 aa, Dengue virus
SYSGVEGE

SEQ ID NO: 104503 - protein, 8 aa, Dengue virus
YSGVEGEG

SEQ ID NO: 104504 - protein, 8 aa, Dengue virus
VEGEGLHR

SEQ ID NO: 104505 - protein, 8 aa, Dengue virus
EGEGLHRL

SEQ ID NO: 104506 - protein, 8 aa, Dengue virus
GEGLHRLG

SEQ ID NO: 104507 - protein, 8 aa, Dengue virus
EGLHRLGY

SEQ ID NO: 104508 - protein, 8 aa, Dengue virus
GLHRLGYI

SEQ ID NO: 104509 - protein, 8 aa, Dengue virus
LHRLGYIL

SEQ ID NO: 104510 - protein, 8 aa, Dengue virus
HRLGYILR

SEQ ID NO: 104511 - protein, 8 aa, Dengue virus
RLGYILRD

SEQ ID NO: 104512 - protein, 8 aa, Dengue virus
LGYILRDV

SEQ ID NO: 104513 - protein, 8 aa, Dengue virus
GGNMYADD

SEQ ID NO: 104514 - protein, 8 aa, Dengue virus
GNMYADDT

SEQ ID NO: 104515 - protein, 8 aa, Dengue virus
NMYADDTA

SEQ ID NO: 104516 - protein, 8 aa, Dengue virus
GWDTRITL

SEQ ID NO: 104517 - protein, 8 aa, Dengue virus
WDTRITLE

SEQ ID NO: 104518 - protein, 8 aa, Dengue virus
DTRITLED

SEQ ID NO: 104519 - protein, 8 aa, Dengue virus
TRITLEDL

SEQ ID NO: 104520 - protein, 8 aa, Dengue virus
SIFKLTYQ

SEQ ID NO: 104521 - protein, 8 aa, Dengue virus
TYQNKVVK

SEQ ID NO: 104522 - protein, 8 aa, Dengue virus
YQNKVVKV

SEQ ID NO: 104523 - protein, 8 aa, Dengue virus
QNKVVKVQ

SEQ ID NO: 104524 - protein, 8 aa, Dengue virus
NKVVKVQR

SEQ ID NO: 104525 - protein, 8 aa, Dengue virus
KVVKVQRP

SEQ ID NO: 104526 - protein, 8 aa, Dengue virus
VVRVQRPT

SEQ ID NO: 104527 - protein, 8 aa, Dengue virus
VRVQRPTP

SEQ ID NO: 104528 - protein, 8 aa, Dengue virus
GTVMDVIS

SEQ ID NO: 104529 - protein, 8 aa, Dengue virus
TVMDVISR

SEQ ID NO: 104530 - protein, 8 aa, Dengue virus
VMDIISRK

SEQ ID NO: 104531 - protein, 8 aa, Dengue virus
MDIISRKD

SEQ ID NO: 104532 - protein, 8 aa, Dengue virus
DIISRKDQ

SEQ ID NO: 104533 - protein, 8 aa, Dengue virus
IISRKDQR

SEQ ID NO: 104534 - protein, 8 aa, Dengue virus
ISRKDQRG

SEQ ID NO: 104535 - protein, 8 aa, Dengue virus
SRKDQRGS

SEQ ID NO: 104536 - protein, 8 aa, Dengue virus
RKDQRGSG

SEQ ID NO: 104537 - protein, 8 aa, Dengue virus
KDQRGSGQ

SEQ ID NO: 104538 - protein, 8 aa, Dengue virus
QRGSGQVV

SEQ ID NO: 104539 - protein, 8 aa, Dengue virus
RGSGQVVT

SEQ ID NO: 104540 - protein, 8 aa, Dengue virus
GSGQVVTY

SEQ ID NO: 104541 - protein, 8 aa, Dengue virus
SGQVVTYG

SEQ ID NO: 104542 - protein, 8 aa, Dengue virus
GQVVTYGL

SEQ ID NO: 104543 - protein, 8 aa, Dengue virus
QVVTYGLN

SEQ ID NO: 104544 - protein, 8 aa, Dengue virus
VVTYGLNT

SEQ ID NO: 104545 - protein, 8 aa, Dengue virus
FTNMEVQL

SEQ ID NO: 104546 - protein, 8 aa, Dengue virus
TNMEVQLI

SEQ ID NO: 104547 - protein, 8 aa, Dengue virus
NMEVQLIR

SEQ ID NO: 104548 - protein, 8 aa, Dengue virus
MEVQLIRQ

SEQ ID NO: 104549 - protein, 8 aa, Dengue virus
EVQLIRQM

SEQ ID NO: 104550 - protein, 8 aa, Dengue virus
VQLIRQME

SEQ ID NO: 104551 - protein, 8 aa, Dengue virus
QLIRQMEG

SEQ ID NO: 104552 - protein, 8 aa, Dengue virus
LIRQMEGE

SEQ ID NO: 104553 - protein, 8 aa, Dengue virus
IRQMEGEG

SEQ ID NO: 104554 - protein, 8 aa, Dengue virus
RQMEGEGV

SEQ ID NO: 104555 - protein, 8 aa, Dengue virus
ERLSRMAI

SEQ ID NO: 104556 - protein, 8 aa, Dengue virus
RLSRMAIS

SEQ ID NO: 104557 - protein, 8 aa, Dengue virus
LSRMAISG

SEQ ID NO: 104558 - protein, 8 aa, Dengue virus
SRMAISGD

SEQ ID NO: 104559 - protein, 8 aa, Dengue virus
DDCVVKPL

SEQ ID NO: 104560 - protein, 8 aa, Dengue virus
DCVVKPLD

SEQ ID NO: 104561 - protein, 8 aa, Dengue virus
CVVKPLDD

SEQ ID NO: 104562 - protein, 8 aa, Dengue virus
VVKPLDDR

SEQ ID NO: 104563 - protein, 8 aa, Dengue virus
VKPLDDRF

SEQ ID NO: 104564 - protein, 8 aa, Dengue virus
ALLALNDM

SEQ ID NO: 104565 - protein, 8 aa, Dengue virus
LLALNDMG

SEQ ID NO: 104566 - protein, 8 aa, Dengue virus
LALNDMGK

SEQ ID NO: 104567 - protein, 8 aa, Dengue virus
ALNDMGKI

SEQ ID NO: 104568 - protein, 8 aa, Dengue virus
LNDMGKIR

SEQ ID NO: 104569 - protein, 8 aa, Dengue virus
NDMGKIRK

SEQ ID NO: 104570 - protein, 8 aa, Dengue virus
DMGKIRKD

SEQ ID NO: 104571 - protein, 8 aa, Dengue virus
MGKIRKDI

SEQ ID NO: 104572 - protein, 8 aa, Dengue virus
GKVRKDIQ

SEQ ID NO: 104573 - protein, 8 aa, Dengue virus
KVRKDIQQ

SEQ ID NO: 104574 - protein, 8 aa, Dengue virus
VRKDIQQW

SEQ ID NO: 104575 - protein, 8 aa, Dengue virus
RKDIQQWE

SEQ ID NO: 104576 - protein, 8 aa, Dengue virus
KDIQQWEP

SEQ ID NO: 104577 - protein, 8 aa, Dengue virus
DIQQWEPS

SEQ ID NO: 104578 - protein, 8 aa, Dengue virus
IQQWEPSR

SEQ ID NO: 104579 - protein, 8 aa, Dengue virus
QQWEPSRG

SEQ ID NO: 104580 - protein, 8 aa, Dengue virus
QWEPSRGW

SEQ ID NO: 104581 - protein, 8 aa, Dengue virus
WEPSRGWN

SEQ ID NO: 104582 - protein, 8 aa, Dengue virus
EPSRGWND

SEQ ID NO: 104583 - protein, 8 aa, Dengue virus
PSRGWNDW

SEQ ID NO: 104584 - protein, 8 aa, Dengue virus
GWNDWTQV

SEQ ID NO: 104585 - protein, 8 aa, Dengue virus
WNDWTQVP

SEQ ID NO: 104586 - protein, 8 aa, Dengue virus
NDWTQVPF

SEQ ID NO: 104587 - protein, 8 aa, Dengue virus
DWTQVPFC

SEQ ID NO: 104588 - protein, 8 aa, Dengue virus
WTQVPFCS

SEQ ID NO: 104589 - protein, 8 aa, Dengue virus
TQVPFCSH

SEQ ID NO: 104590 - protein, 8 aa, Dengue virus
EVPFCSHH

SEQ ID NO: 104591 - protein, 8 aa, Dengue virus
FCSHHFHQ

SEQ ID NO: 104592 - protein, 8 aa, Dengue virus
CSHHFHQL

SEQ ID NO: 104593 - protein, 8 aa, Dengue virus
SHHFHELI

SEQ ID NO: 104594 - protein, 8 aa, Dengue virus
HHFHELIM

SEQ ID NO: 104595 - protein, 8 aa, Dengue virus
HFHELIMK

SEQ ID NO: 104596 - protein, 8 aa, Dengue virus
FHELIMKD

SEQ ID NO: 104597 - protein, 8 aa, Dengue virus
HELIMKDG

SEQ ID NO: 104598 - protein, 8 aa, Dengue virus
ELIMKDGR

SEQ ID NO: 104599 - protein, 8 aa, Dengue virus
LVVPCRNQ

SEQ ID NO: 104600 - protein, 8 aa, Dengue virus
VVPCRPQD

SEQ ID NO: 104601 - protein, 8 aa, Dengue virus
VPCRPQDE

SEQ ID NO: 104602 - protein, 8 aa, Dengue virus
PCRPQDEL

SEQ ID NO: 104603 - protein, 8 aa, Dengue virus
CRNQDELI

SEQ ID NO: 104604 - protein, 8 aa, Dengue virus
RNQDELIG

SEQ ID NO: 104605 - protein, 8 aa, Dengue virus
NQDELIGR

SEQ ID NO: 104606 - protein, 8 aa, Dengue virus
QDELVGRA

SEQ ID NO: 104607 - protein, 8 aa, Dengue virus
DELVGRAR

SEQ ID NO: 104608 - protein, 8 aa, Dengue virus
ELVGRARV

SEQ ID NO: 104609 - protein, 8 aa, Dengue virus
LVGRARVS

SEQ ID NO: 104610 - protein, 8 aa, Dengue virus
VGRARVSQ

SEQ ID NO: 104611 - protein, 8 aa, Dengue virus
GRARVSQG

SEQ ID NO: 104612 - protein, 8 aa, Dengue virus
RARVSQGA

SEQ ID NO: 104613 - protein, 8 aa, Dengue virus
ARVSQGAG

SEQ ID NO: 104614 - protein, 8 aa, Dengue virus
RVSQGAGW

SEQ ID NO: 104615 - protein, 8 aa, Dengue virus
VSQGAGWS

SEQ ID NO: 104616 - protein, 8 aa, Dengue virus
QGAGWSLK

SEQ ID NO: 104617 - protein, 8 aa, Dengue virus
GAGWSLKE

SEQ ID NO: 104618 - protein, 8 aa, Dengue virus
AGWSLKET

SEQ ID NO: 104619 - protein, 8 aa, Dengue virus
GWSLKETA

SEQ ID NO: 104620 - protein, 8 aa, Dengue virus
WSLKETAC

SEQ ID NO: 104621 - protein, 8 aa, Dengue virus
SLKETACL

SEQ ID NO: 104622 - protein, 8 aa, Dengue virus
LKETACLG

SEQ ID NO: 104623 - protein, 8 aa, Dengue virus
KETACLGK

SEQ ID NO: 104624 - protein, 8 aa, Dengue virus
ETACLGKA

SEQ ID NO: 104625 - protein, 8 aa, Dengue virus
TACLGKAY

SEQ ID NO: 104626 - protein, 8 aa, Dengue virus
ACLGKAYA

SEQ ID NO: 104627 - protein, 8 aa, Dengue virus
CLGKAYAQ

SEQ ID NO: 104628 - protein, 8 aa, Dengue virus
LGKAYAQM

SEQ ID NO: 104629 - protein, 8 aa, Dengue virus
GKAYAQMW

SEQ ID NO: 104630 - protein, 8 aa, Dengue virus
KAYAQMWS

SEQ ID NO: 104631 - protein, 8 aa, Dengue virus
AYAQMWSL

SEQ ID NO: 104632 - protein, 8 aa, Dengue virus
YAQMWSLM

SEQ ID NO: 104633 - protein, 8 aa, Dengue virus
AQMWSLMY

SEQ ID NO: 104634 - protein, 8 aa, Dengue virus
QMWSLMYF

SEQ ID NO: 104635 - protein, 8 aa, Dengue virus
MWSLMYFH

SEQ ID NO: 104636 - protein, 8 aa, Dengue virus
WSLMYFHR

SEQ ID NO: 104637 - protein, 8 aa, Dengue virus
SLMYFHRR

SEQ ID NO: 104638 - protein, 8 aa, Dengue virus
RRDLRLAS

SEQ ID NO: 104639 - protein, 8 aa, Dengue virus
RDLRLASN

SEQ ID NO: 104640 - protein, 8 aa, Dengue virus
DLRLASNA

SEQ ID NO: 104641 - protein, 8 aa, Dengue virus
LRLASNAI

SEQ ID NO: 104642 - protein, 8 aa, Dengue virus
RLASNAIC

SEQ ID NO: 104643 - protein, 8 aa, Dengue virus
LASNAICS

SEQ ID NO: 104644 - protein, 8 aa, Dengue virus
ASNAICSA

SEQ ID NO: 104645 - protein, 8 aa, Dengue virus
SNAICSAV

SEQ ID NO: 104646 - protein, 8 aa, Dengue virus
MAICSAVP

SEQ ID NO: 104647 - protein, 8 aa, Dengue virus
AICSAVPS

SEQ ID NO: 104648 - protein, 8 aa, Dengue virus
DWVPTSRT

SEQ ID NO: 104649 - protein, 8 aa, Dengue virus
WIPTSRTT

SEQ ID NO: 104650 - protein, 8 aa, Dengue virus
IPTSRTTW

SEQ ID NO: 104651 - protein, 8 aa, Dengue virus
TTWSIHAK

SEQ ID NO: 104652 - protein, 8 aa, Dengue virus
TWSIHAKH

SEQ ID NO: 104653 - protein, 8 aa, Dengue virus
WSIHAKHE

SEQ ID NO: 104654 - protein, 8 aa, Dengue virus
SIHAKHEW

SEQ ID NO: 104655 - protein, 8 aa, Dengue virus
IHAKHEWM

SEQ ID NO: 104656 - protein, 8 aa, Dengue virus
HAKHEWMT

SEQ ID NO: 104657 - protein, 8 aa, Dengue virus
AKHEWMTT

SEQ ID NO: 104658 - protein, 8 aa, Dengue virus
KHEWMTTE

SEQ ID NO: 104659 - protein, 8 aa, Dengue virus
HEWMTTED

SEQ ID NO: 104660 - protein, 8 aa, Dengue virus
EWMTTEDM

SEQ ID NO: 104661 - protein, 8 aa, Dengue virus
MTTEDMLT

SEQ ID NO: 104662 - protein, 8 aa, Dengue virus
TTEDMLTV

SEQ ID NO: 104663 - protein, 8 aa, Dengue virus
TEDMLTVW

SEQ ID NO: 104664 - protein, 8 aa, Dengue virus
EDMLTVWN

SEQ ID NO: 104665 - protein, 8 aa, Dengue virus
DMLTVWNR

SEQ ID NO: 104666 - protein, 8 aa, Dengue virus
MLTVWNRV

SEQ ID NO: 104667 - protein, 8 aa, Dengue virus
LTVWNRVW

SEQ ID NO: 104668 - protein, 8 aa, Dengue virus
TVWNRVWI

SEQ ID NO: 104669 - protein, 8 aa, Dengue virus
VWNRVWIQ

SEQ ID NO: 104670 - protein, 8 aa, Dengue virus
DNPWMEDK

SEQ ID NO: 104671 - protein, 8 aa, Dengue virus
NPNMIDKT

SEQ ID NO: 104672 - protein, 8 aa, Dengue virus
EVPYLGKR

SEQ ID NO: 104673 - protein, 8 aa, Dengue virus
IPYLGKRE

SEQ ID NO: 104674 - protein, 8 aa, Dengue virus
YLGKREDL

SEQ ID NO: 104675 - protein, 8 aa, Dengue virus
LGKREDLW

SEQ ID NO: 104676 - protein, 8 aa, Dengue virus
GKREDLWC

SEQ ID NO: 104677 - protein, 8 aa, Dengue virus
KREDLWCG

SEQ ID NO: 104678 - protein, 8 aa, Dengue virus
REDLWCGS

SEQ ID NO: 104679 - protein, 8 aa, Dengue virus
EDLWCGSL

SEQ ID NO: 104680 - protein, 8 aa, Dengue virus
DLWCGSLI

SEQ ID NO: 104681 - protein, 8 aa, Dengue virus
LWCGSLIG

SEQ ID NO: 104682 - protein, 8 aa, Dengue virus
CGSLIGLS

SEQ ID NO: 104683 - protein, 8 aa, Dengue virus
GSLIGLTA

SEQ ID NO: 104684 - protein, 8 aa, Dengue virus
SLIGLTAR

SEQ ID NO: 104685 - protein, 8 aa, Dengue virus
LIGLTARA

SEQ ID NO: 104686 - protein, 8 aa, Dengue virus
IGLTARAT

SEQ ID NO: 104687 - protein, 8 aa, Dengue virus
GLTARATW

SEQ ID NO: 104688 - protein, 8 aa, Dengue virus
LTARATWA

SEQ ID NO: 104689 - protein, 8 aa, Dengue virus
TSRATWAK

SEQ ID NO: 104690 - protein, 8 aa, Dengue virus
SRATWAKN

SEQ ID NO: 104691 - protein, 8 aa, Dengue virus
RATWAKNI

SEQ ID NO: 104692 - protein, 8 aa, Dengue virus
AINQVRSL

SEQ ID NO: 104693 - protein, 8 aa, Dengue virus
DYMTSMKR

SEQ ID NO: 104694 - protein, 8 aa, Dengue virus
YMTSMKRF

SEQ ID NO: 104695 - protein, 8 aa, Dengue virus
MTSMKRFK

SEQ ID NO: 104696 - protein, 8 aa, Dengue virus
MINQRKKT

SEQ ID NO: 104697 - protein, 8 aa, Dengue virus
PSINMLKR

SEQ ID NO: 104698 - protein, 8 aa, Dengue virus
SINMLKRV

SEQ ID NO: 104699 - protein, 8 aa, Dengue virus
INMLKRVR

SEQ ID NO: 104700 - protein, 8 aa, Dengue virus
NMLKRVRN

SEQ ID NO: 104701 - protein, 8 aa, Dengue virus
MLKRVRNR

SEQ ID NO: 104702 - protein, 8 aa, Dengue virus
LKRVRNRV

SEQ ID NO: 104703 - protein, 8 aa, Dengue virus
KRVRNRVS

SEQ ID NO: 104704 - protein, 8 aa, Dengue virus
RVRNRVST

SEQ ID NO: 104705 - protein, 8 aa, Dengue virus
RNRVSTGS

SEQ ID NO: 104706 - protein, 8 aa, Dengue virus
NRVSTGSQ

SEQ ID NO: 104707 - protein, 8 aa, Dengue virus
RVSTGSQL

SEQ ID NO: 104708 - protein, 8 aa, Dengue virus
VSTGSQLA

SEQ ID NO: 104709 - protein, 8 aa, Dengue virus
STGSQLAK

SEQ ID NO: 104710 - protein, 8 aa, Dengue virus
TGSQLAKR

SEQ ID NO: 104711 - protein, 8 aa, Dengue virus
GSQLAKRF

SEQ ID NO: 104712 - protein, 8 aa, Dengue virus
QGLVKRFS

SEQ ID NO: 104713 - protein, 8 aa, Dengue virus
QLAKRFSR

SEQ ID NO: 104714 - protein, 8 aa, Dengue virus
LAKRFSRG

SEQ ID NO: 104715 - protein, 8 aa, Dengue virus
AKRFSRGL

SEQ ID NO: 104716 - protein, 8 aa, Dengue virus
KRFSRGLL

SEQ ID NO: 104717 - protein, 8 aa, Dengue virus
RFSKGLLN

SEQ ID NO: 104718 - protein, 8 aa, Dengue virus
FSKGLLNG

SEQ ID NO: 104719 - protein, 8 aa, Dengue virus
SKGLLNGQ

SEQ ID NO: 104720 - protein, 8 aa, Dengue virus
KGLLNGQG

SEQ ID NO: 104721 - protein, 8 aa, Dengue virus
GLLNGQGP

SEQ ID NO: 104722 - protein, 8 aa, Dengue virus
LLNGQGPM

SEQ ID NO: 104723 - protein, 8 aa, Dengue virus
LNGQGPMK

SEQ ID NO: 104724 - protein, 8 aa, Dengue virus
GKGPLRMV

SEQ ID NO: 104725 - protein, 8 aa, Dengue virus
KGPLRMVL

SEQ ID NO: 104726 - protein, 8 aa, Dengue virus
GPLRMVLA

SEQ ID NO: 104727 - protein, 8 aa, Dengue virus
PLRMVLAF

SEQ ID NO: 104728 - protein, 8 aa, Dengue virus
RMVLAFIT

SEQ ID NO: 104729 - protein, 8 aa, Dengue virus
MVLAFITF

SEQ ID NO: 104730 - protein, 8 aa, Dengue virus
VLAFITFL

SEQ ID NO: 104731 - protein, 8 aa, Dengue virus
LAFITFLR

SEQ ID NO: 104732 - protein, 8 aa, Dengue virus
AFITFLRV

SEQ ID NO: 104733 - protein, 8 aa, Dengue virus
FITFLRVL

SEQ ID NO: 104734 - protein, 8 aa, Dengue virus
ITFLRVLS

SEQ ID NO: 104735 - protein, 8 aa, Dengue virus
TFLRVLSI

SEQ ID NO: 104736 - protein, 8 aa, Dengue virus
FLRVLSIP

SEQ ID NO: 104737 - protein, 8 aa, Dengue virus
LRVLSIPP

SEQ ID NO: 104738 - protein, 8 aa, Dengue virus
RVLSIPPT

SEQ ID NO: 104739 - protein, 8 aa, Dengue virus
VLSIPPTA

SEQ ID NO: 104740 - protein, 8 aa, Dengue virus
LSIPPTAG

SEQ ID NO: 104741 - protein, 8 aa, Dengue virus
AIPPTAGV

SEQ ID NO: 104742 - protein, 8 aa, Dengue virus
PPTAGVLA

SEQ ID NO: 104743 - protein, 8 aa, Dengue virus
PTAGVLAR

SEQ ID NO: 104744 - protein, 8 aa, Dengue virus
TAGVLARW

SEQ ID NO: 104745 - protein, 8 aa, Dengue virus
AGVLARWG

SEQ ID NO: 104746 - protein, 8 aa, Dengue virus
GFKKEISS

SEQ ID NO: 104747 - protein, 8 aa, Dengue virus
FKKEISSM

SEQ ID NO: 104748 - protein, 8 aa, Dengue virus
KKEISSML

SEQ ID NO: 104749 - protein, 8 aa, Dengue virus
AFHLTSRD

SEQ ID NO: 104750 - protein, 8 aa, Dengue virus
FHLTSRDG

SEQ ID NO: 104751 - protein, 8 aa, Dengue virus
HLTSRDGE

SEQ ID NO: 104752 - protein, 8 aa, Dengue virus
LTSRDGEP

SEQ ID NO: 104753 - protein, 8 aa, Dengue virus
TSRDGEPR

SEQ ID NO: 104754 - protein, 8 aa, Dengue virus
SRDGEPRM

SEQ ID NO: 104755 - protein, 8 aa, Dengue virus
RDGEPRMI

SEQ ID NO: 104756 - protein, 8 aa, Dengue virus
DGEPRMIV

SEQ ID NO: 104757 - protein, 8 aa, Dengue virus
NERGKSLL

SEQ ID NO: 104758 - protein, 8 aa, Dengue virus
ERGRPLLF

SEQ ID NO: 104759 - protein, 8 aa, Dengue virus
RGRPLLFK

SEQ ID NO: 104760 - protein, 8 aa, Dengue virus
KSLLFKTA

SEQ ID NO: 104761 - protein, 8 aa, Dengue virus
NMCTLMAM

SEQ ID NO: 104762 - protein, 8 aa, Dengue virus
MCTLMAMD

SEQ ID NO: 104763 - protein, 8 aa, Dengue virus
CTLMAMDL

SEQ ID NO: 104764 - protein, 8 aa, Dengue virus
TLMAMDLG

SEQ ID NO: 104765 - protein, 8 aa, Dengue virus
LMAMDLGE

SEQ ID NO: 104766 - protein, 8 aa, Dengue virus
MAIDLGEL

SEQ ID NO: 104767 - protein, 8 aa, Dengue virus
AIDLGELC

SEQ ID NO: 104768 - protein, 8 aa, Dengue virus
IDLGELCE

SEQ ID NO: 104769 - protein, 8 aa, Dengue virus
DLGEFCED

SEQ ID NO: 104770 - protein, 8 aa, Dengue virus
LGEFCEDT

SEQ ID NO: 104771 - protein, 8 aa, Dengue virus
DTVTYKCP

SEQ ID NO: 104772 - protein, 8 aa, Dengue virus
DIDCWCNL

SEQ ID NO: 104773 - protein, 8 aa, Dengue virus
IDCWCNLT

SEQ ID NO: 104774 - protein, 8 aa, Dengue virus
DCWCNLTS

SEQ ID NO: 104775 - protein, 8 aa, Dengue virus
CWCNLTST

SEQ ID NO: 104776 - protein, 8 aa, Dengue virus
WCNLTSTW

SEQ ID NO: 104777 - protein, 8 aa, Dengue virus
TSTWVMYG

SEQ ID NO: 104778 - protein, 8 aa, Dengue virus
STWVMYGT

SEQ ID NO: 104779 - protein, 8 aa, Dengue virus
WVTYGTCN

SEQ ID NO: 104780 - protein, 8 aa, Dengue virus
GERRREKR

SEQ ID NO: 104781 - protein, 8 aa, Dengue virus
ERRREKRS

SEQ ID NO: 104782 - protein, 8 aa, Dengue virus
RRREKRSV

SEQ ID NO: 104783 - protein, 8 aa, Dengue virus
EKRSVALT

SEQ ID NO: 104784 - protein, 8 aa, Dengue virus
KRSVALTP

SEQ ID NO: 104785 - protein, 8 aa, Dengue virus
RSVALTPH

SEQ ID NO: 104786 - protein, 8 aa, Dengue virus
SVALTPHS

SEQ ID NO: 104787 - protein, 8 aa, Dengue virus
VALTPHSG

SEQ ID NO: 104788 - protein, 8 aa, Dengue virus
ALAPHVGM

SEQ ID NO: 104789 - protein, 8 aa, Dengue virus
LAPHVGMG

SEQ ID NO: 104790 - protein, 8 aa, Dengue virus
APHVGMGL

SEQ ID NO: 104791 - protein, 8 aa, Dengue virus
PHVGMGLD

SEQ ID NO: 104792 - protein, 8 aa, Dengue virus
HVGMGLDT

SEQ ID NO: 104793 - protein, 8 aa, Dengue virus
VGMGLDTR

SEQ ID NO: 104794 - protein, 8 aa, Dengue virus
GLETRAET

SEQ ID NO: 104795 - protein, 8 aa, Dengue virus
LETRAETW

SEQ ID NO: 104796 - protein, 8 aa, Dengue virus
ETRAETWM

SEQ ID NO: 104797 - protein, 8 aa, Dengue virus
TRAETWMS

SEQ ID NO: 104798 - protein, 8 aa, Dengue virus
RAETWMSS

SEQ ID NO: 104799 - protein, 8 aa, Dengue virus
AETWMSSE

SEQ ID NO: 104800 - protein, 8 aa, Dengue virus
MSSEGAWR

SEQ ID NO: 104801 - protein, 8 aa, Dengue virus
SAEGAWRQ

SEQ ID NO: 104802 - protein, 8 aa, Dengue virus
SEGAWKHA

SEQ ID NO: 104803 - protein, 8 aa, Dengue virus
EGAWKHAQ

SEQ ID NO: 104804 - protein, 8 aa, Dengue virus
VESWILRN

SEQ ID NO: 104805 - protein, 8 aa, Dengue virus
ESWILRNP

SEQ ID NO: 104806 - protein, 8 aa, Dengue virus
SWILRNPG

SEQ ID NO: 104807 - protein, 8 aa, Dengue virus
WILRNPGF

SEQ ID NO: 104808 - protein, 8 aa, Dengue virus
ILRNPGFA

SEQ ID NO: 104809 - protein, 8 aa, Dengue virus
VTPSMTMR

SEQ ID NO: 104810 - protein, 8 aa, Dengue virus
TPSMTMRC

SEQ ID NO: 104811 - protein, 8 aa, Dengue virus
PSMTMRCV

SEQ ID NO: 104812 - protein, 8 aa, Dengue virus
SMTMRCVG

SEQ ID NO: 104813 - protein, 8 aa, Dengue virus
MRCVGVGN

SEQ ID NO: 104814 - protein, 8 aa, Dengue virus
RCVGVGNR

SEQ ID NO: 104815 - protein, 8 aa, Dengue virus
CVGVGNRD

SEQ ID NO: 104816 - protein, 8 aa, Dengue virus
VGVGNRDF

SEQ ID NO: 104817 - protein, 8 aa, Dengue virus
GVGNRDFV

SEQ ID NO: 104818 - protein, 8 aa, Dengue virus
VGNRDFVE

SEQ ID NO: 104819 - protein, 8 aa, Dengue virus
SNRDFVEG

SEQ ID NO: 104820 - protein, 8 aa, Dengue virus
NRDFVEGL

SEQ ID NO: 104821 - protein, 8 aa, Dengue virus
VEGVSGGA

SEQ ID NO: 104822 - protein, 8 aa, Dengue virus
EGVSGGAW

SEQ ID NO: 104823 - protein, 8 aa, Dengue virus
GVSGGAWV

SEQ ID NO: 104824 - protein, 8 aa, Dengue virus
VSGGAWVD

SEQ ID NO: 104825 - protein, 8 aa, Dengue virus
SGGAWVDL

SEQ ID NO: 104826 - protein, 8 aa, Dengue virus
GGAWVDLV

SEQ ID NO: 104827 - protein, 8 aa, Dengue virus
GAWVDLVL

SEQ ID NO: 104828 - protein, 8 aa, Dengue virus
AWVDLVLE

SEQ ID NO: 104829 - protein, 8 aa, Dengue virus
WVDLVLEH

SEQ ID NO: 104830 - protein, 8 aa, Dengue virus
VDLVLEHG

SEQ ID NO: 104831 - protein, 8 aa, Dengue virus
DVVLEHGG

SEQ ID NO: 104832 - protein, 8 aa, Dengue virus
VVLEHGGC

SEQ ID NO: 104833 - protein, 8 aa, Dengue virus
GCVTTMAQ

SEQ ID NO: 104834 - protein, 8 aa, Dengue virus
CVTTMAQG

SEQ ID NO: 104835 - protein, 8 aa, Dengue virus
VTTMAQGK

SEQ ID NO: 104836 - protein, 8 aa, Dengue virus
TTMAQGKP

SEQ ID NO: 104837 - protein, 8 aa, Dengue virus
TMAQGKPT

SEQ ID NO: 104838 - protein, 8 aa, Dengue virus
MAQGKPTL

SEQ ID NO: 104839 - protein, 8 aa, Dengue virus
AQGKPTLD

SEQ ID NO: 104840 - protein, 8 aa, Dengue virus
KNKPTLDI

SEQ ID NO: 104841 - protein, 8 aa, Dengue virus
NKPTLDIE

SEQ ID NO: 104842 - protein, 8 aa, Dengue virus
PTLDIELQ

SEQ ID NO: 104843 - protein, 8 aa, Dengue virus
TLDIELQK

SEQ ID NO: 104844 - protein, 8 aa, Dengue virus
LDIELQKT

SEQ ID NO: 104845 - protein, 8 aa, Dengue virus
DIELQKTE

SEQ ID NO: 104846 - protein, 8 aa, Dengue virus
IELQKTEA

SEQ ID NO: 104847 - protein, 8 aa, Dengue virus
ELQKTEAT

SEQ ID NO: 104848 - protein, 8 aa, Dengue virus
LRKLCIEG

SEQ ID NO: 104849 - protein, 8 aa, Dengue virus
CIEGKITN

SEQ ID NO: 104850 - protein, 8 aa, Dengue virus
TTATRCPT

SEQ ID NO: 104851 - protein, 8 aa, Dengue virus
TATRCPTQ

SEQ ID NO: 104852 - protein, 8 aa, Dengue virus
ATRCPTQG

SEQ ID NO: 104853 - protein, 8 aa, Dengue virus
CKHTYVDR

SEQ ID NO: 104854 - protein, 8 aa, Dengue virus
KHTYVDRG

SEQ ID NO: 104855 - protein, 8 aa, Dengue virus
HTYVDRGW

SEQ ID NO: 104856 - protein, 8 aa, Dengue virus
TYVDRGWG

SEQ ID NO: 104857 - protein, 8 aa, Dengue virus
YVDRGWGN

SEQ ID NO: 104858 - protein, 8 aa, Dengue virus
GLFGKGGV

SEQ ID NO: 104859 - protein, 8 aa, Dengue virus
LFGKGSLV

SEQ ID NO: 104860 - protein, 8 aa, Dengue virus
FGKGSLVT

SEQ ID NO: 104861 - protein, 8 aa, Dengue virus
GKGSLVTC

SEQ ID NO: 104862 - protein, 8 aa, Dengue virus
KGSLVTCA

SEQ ID NO: 104863 - protein, 8 aa, Dengue virus
GSLVTCAK

SEQ ID NO: 104864 - protein, 8 aa, Dengue virus
SLVTCAKF

SEQ ID NO: 104865 - protein, 8 aa, Dengue virus
VLPENLEY

SEQ ID NO: 104866 - protein, 8 aa, Dengue virus
ENLKYTVI

SEQ ID NO: 104867 - protein, 8 aa, Dengue virus
IITVHTGD

SEQ ID NO: 104868 - protein, 8 aa, Dengue virus
ITVHTGDQ

SEQ ID NO: 104869 - protein, 8 aa, Dengue virus
TVHNGDTH

SEQ ID NO: 104870 - protein, 8 aa, Dengue virus
VHNGDTHA

SEQ ID NO: 104871 - protein, 8 aa, Dengue virus
HNGDTHAV

SEQ ID NO: 104872 - protein, 8 aa, Dengue virus
NGDTHAVG

SEQ ID NO: 104873 - protein, 8 aa, Dengue virus
GDTHAVGN

SEQ ID NO: 104874 - protein, 8 aa, Dengue virus
DQHQVGND

SEQ ID NO: 104875 - protein, 8 aa, Dengue virus
LGLECSPR

SEQ ID NO: 104876 - protein, 8 aa, Dengue virus
GLECSPRT

SEQ ID NO: 104877 - protein, 8 aa, Dengue virus
LECSPRTG

SEQ ID NO: 104878 - protein, 8 aa, Dengue virus
DCEPRSGI

SEQ ID NO: 104879 - protein, 8 aa, Dengue virus
GIDFNEMI

SEQ ID NO: 104880 - protein, 8 aa, Dengue virus
IDFNEMIL

SEQ ID NO: 104881 - protein, 8 aa, Dengue virus
DFNEMILM

SEQ ID NO: 104882 - protein, 8 aa, Dengue virus
FNEMILLT

SEQ ID NO: 104883 - protein, 8 aa, Dengue virus
NEMILLTM

SEQ ID NO: 104884 - protein, 8 aa, Dengue virus
EMILLTMK

SEQ ID NO: 104885 - protein, 8 aa, Dengue virus
KAWMVHRQ

SEQ ID NO: 104886 - protein, 8 aa, Dengue virus
AWMVHRQW

SEQ ID NO: 104887 - protein, 8 aa, Dengue virus
WMVHRQWF

SEQ ID NO: 104888 - protein, 8 aa, Dengue virus
MVHRQWFF

SEQ ID NO: 104889 - protein, 8 aa, Dengue virus
VHRQWFFD

SEQ ID NO: 104890 - protein, 8 aa, Dengue virus
HRQWFFDL

SEQ ID NO: 104891 - protein, 8 aa, Dengue virus
RQWFFDLP

SEQ ID NO: 104892 - protein, 8 aa, Dengue virus
FDLPLPWT

SEQ ID NO: 104893 - protein, 8 aa, Dengue virus
DLPLPWTA

SEQ ID NO: 104894 - protein, 8 aa, Dengue virus
LPLPWTAG

SEQ ID NO: 104895 - protein, 8 aa, Dengue virus
PLPWTAGA

SEQ ID NO: 104896 - protein, 8 aa, Dengue virus
KELLVTFK

SEQ ID NO: 104897 - protein, 8 aa, Dengue virus
ELLVTFKN

SEQ ID NO: 104898 - protein, 8 aa, Dengue virus
LLVTFKNA

SEQ ID NO: 104899 - protein, 8 aa, Dengue virus
LVTFKNAH

SEQ ID NO: 104900 - protein, 8 aa, Dengue virus
VTFKNAHA

SEQ ID NO: 104901 - protein, 8 aa, Dengue virus
TFKNAHAK

SEQ ID NO: 104902 - protein, 8 aa, Dengue virus
FKNAHAKK

SEQ ID NO: 104903 - protein, 8 aa, Dengue virus
KNAHAKKQ

SEQ ID NO: 104904 - protein, 8 aa, Dengue virus
NAHAKKQE

SEQ ID NO: 104905 - protein, 8 aa, Dengue virus
PHAKRQDV

SEQ ID NO: 104906 - protein, 8 aa, Dengue virus
HAKRQDVT

SEQ ID NO: 104907 - protein, 8 aa, Dengue virus
AKRQDVTV

SEQ ID NO: 104908 - protein, 8 aa, Dengue virus
KRQDVTVL

SEQ ID NO: 104909 - protein, 8 aa, Dengue virus
RQDVTVLG

SEQ ID NO: 104910 - protein, 8 aa, Dengue virus
QDVTVLGS

SEQ ID NO: 104911 - protein, 8 aa, Dengue virus
DVTVLGSQ

SEQ ID NO: 104912 - protein, 8 aa, Dengue virus
TGATEIQN

SEQ ID NO: 104913 - protein, 8 aa, Dengue virus
GATEIQNS

SEQ ID NO: 104914 - protein, 8 aa, Dengue virus
ATEIQNSG

SEQ ID NO: 104915 - protein, 8 aa, Dengue virus
EIQNSGGT

SEQ ID NO: 104916 - protein, 8 aa, Dengue virus
GGTSIFAG

SEQ ID NO: 104917 - protein, 8 aa, Dengue virus
GTSIFAGH

SEQ ID NO: 104918 - protein, 8 aa, Dengue virus
TSIFAGHL

SEQ ID NO: 104919 - protein, 8 aa, Dengue virus
SIFAGHLK

SEQ ID NO: 104920 - protein, 8 aa, Dengue virus
MFAGHLKC

SEQ ID NO: 104921 - protein, 8 aa, Dengue virus
FAGHLKCK

SEQ ID NO: 104922 - protein, 8 aa, Dengue virus
AGHLKCKV

SEQ ID NO: 104923 - protein, 8 aa, Dengue virus
GHLKCKVR

SEQ ID NO: 104924 - protein, 8 aa, Dengue virus
HLKCKVRM

SEQ ID NO: 104925 - protein, 8 aa, Dengue virus
LKCKVRME

SEQ ID NO: 104926 - protein, 8 aa, Dengue virus
KCKVRMEK

SEQ ID NO: 104927 - protein, 8 aa, Dengue virus
CKVRMEKL

SEQ ID NO: 104928 - protein, 8 aa, Dengue virus
RLKMDKLE

SEQ ID NO: 104929 - protein, 8 aa, Dengue virus
LKMDKLEL

SEQ ID NO: 104930 - protein, 8 aa, Dengue virus
KMDKLELK

SEQ ID NO: 104931 - protein, 8 aa, Dengue virus
MDKLELKG

SEQ ID NO: 104932 - protein, 8 aa, Dengue virus
KKEVSETQ

SEQ ID NO: 104933 - protein, 8 aa, Dengue virus
KEVSETQH

SEQ ID NO: 104934 - protein, 8 aa, Dengue virus
EVSETQHG

SEQ ID NO: 104935 - protein, 8 aa, Dengue virus
VSETQHGT

SEQ ID NO: 104936 - protein, 8 aa, Dengue virus
SETQHGTI

SEQ ID NO: 104937 - protein, 8 aa, Dengue virus
ETQHGTIL

SEQ ID NO: 104938 - protein, 8 aa, Dengue virus
TQHGTILI

SEQ ID NO: 104939 - protein, 8 aa, Dengue virus
QHGTILIK

SEQ ID NO: 104940 - protein, 8 aa, Dengue virus
VTNIELEP

SEQ ID NO: 104941 - protein, 8 aa, Dengue virus
TNIELEPP

SEQ ID NO: 104942 - protein, 8 aa, Dengue virus
NIELEPPF

SEQ ID NO: 104943 - protein, 8 aa, Dengue virus
IELEPPFG

SEQ ID NO: 104944 - protein, 8 aa, Dengue virus
ETEPPFGE

SEQ ID NO: 104945 - protein, 8 aa, Dengue virus
TEPPFGES

SEQ ID NO: 104946 - protein, 8 aa, Dengue virus
EPPFGESN

SEQ ID NO: 104947 - protein, 8 aa, Dengue virus
PPFGESNI

SEQ ID NO: 104948 - protein, 8 aa, Dengue virus
WFRKGSSI

SEQ ID NO: 104949 - protein, 8 aa, Dengue virus
FRKGSSIG

SEQ ID NO: 104950 - protein, 8 aa, Dengue virus
RKGSSIGK

SEQ ID NO: 104951 - protein, 8 aa, Dengue virus
RGSSIGKM

SEQ ID NO: 104952 - protein, 8 aa, Dengue virus
GSSIGQMI

SEQ ID NO: 104953 - protein, 8 aa, Dengue virus
STIGKMFE

SEQ ID NO: 104954 - protein, 8 aa, Dengue virus
SIGKMFES

SEQ ID NO: 104955 - protein, 8 aa, Dengue virus
IGKMFEST

SEQ ID NO: 104956 - protein, 8 aa, Dengue virus
GKMFESTY

SEQ ID NO: 104957 - protein, 8 aa, Dengue virus
KMFESTYR

SEQ ID NO: 104958 - protein, 8 aa, Dengue virus
MFESTYRG

SEQ ID NO: 104959 - protein, 8 aa, Dengue virus
FESTYRGA

SEQ ID NO: 104960 - protein, 8 aa, Dengue virus
ESTYRGAK

SEQ ID NO: 104961 - protein, 8 aa, Dengue virus
STYRGAKR

SEQ ID NO: 104962 - protein, 8 aa, Dengue virus
TYRGAKRM

SEQ ID NO: 104963 - protein, 8 aa, Dengue virus
YRGAKRMA

SEQ ID NO: 104964 - protein, 8 aa, Dengue virus
KRMAILGE

SEQ ID NO: 104965 - protein, 8 aa, Dengue virus
TAWDFGSV

SEQ ID NO: 104966 - protein, 8 aa, Dengue virus
AWDFGSVG

SEQ ID NO: 104967 - protein, 8 aa, Dengue virus
WDFGSVGG

SEQ ID NO: 104968 - protein, 8 aa, Dengue virus
DFGSVGGV

SEQ ID NO: 104969 - protein, 8 aa, Dengue virus
FGSAYTAL

SEQ ID NO: 104970 - protein, 8 aa, Dengue virus
GSAYTALF

SEQ ID NO: 104971 - protein, 8 aa, Dengue virus
AYTALFSG

SEQ ID NO: 104972 - protein, 8 aa, Dengue virus
YTALFSGV

SEQ ID NO: 104973 - protein, 8 aa, Dengue virus
TALFSGVS

SEQ ID NO: 104974 - protein, 8 aa, Dengue virus
ALFSGVSW

SEQ ID NO: 104975 - protein, 8 aa, Dengue virus
FSGVSWIM

SEQ ID NO: 104976 - protein, 8 aa, Dengue virus
SGVSWIMK

SEQ ID NO: 104977 - protein, 8 aa, Dengue virus
GVSWIMKI

SEQ ID NO: 104978 - protein, 8 aa, Dengue virus
LLTWIGLN

SEQ ID NO: 104979 - protein, 8 aa, Dengue virus
LTWIGLNS

SEQ ID NO: 104980 - protein, 8 aa, Dengue virus
TWIGLNSK

SEQ ID NO: 104981 - protein, 8 aa, Dengue virus
WIGLNSKN

SEQ ID NO: 104982 - protein, 8 aa, Dengue virus
IGLNSKNT

SEQ ID NO: 104983 - protein, 8 aa, Dengue virus
GLNSKNTS

SEQ ID NO: 104984 - protein, 8 aa, Dengue virus
NSRNTSMA

SEQ ID NO: 104985 - protein, 8 aa, Dengue virus
TLYLGAMV

SEQ ID NO: 104986 - protein, 8 aa, Dengue virus
LYLGAMVQ

SEQ ID NO: 104987 - protein, 8 aa, Dengue virus
YLGAMVQA

SEQ ID NO: 104988 - protein, 8 aa, Dengue virus
LGAMVQAD

SEQ ID NO: 104989 - protein, 8 aa, Dengue virus
VQADTGCV

SEQ ID NO: 104990 - protein, 8 aa, Dengue virus
GKELKCGS

SEQ ID NO: 104991 - protein, 8 aa, Dengue virus
CGSGIFVV

SEQ ID NO: 104992 - protein, 8 aa, Dengue virus
GSGIFVVD

SEQ ID NO: 104993 - protein, 8 aa, Dengue virus
SGIFVVDN

SEQ ID NO: 104994 - protein, 8 aa, Dengue virus
GIFVVDNV

SEQ ID NO: 104995 - protein, 8 aa, Dengue virus
IFVVDNVH

SEQ ID NO: 104996 - protein, 8 aa, Dengue virus
FVVDNVHT

SEQ ID NO: 104997 - protein, 8 aa, Dengue virus
VVDNVHTW

SEQ ID NO: 104998 - protein, 8 aa, Dengue virus
VDNVHTWT

SEQ ID NO: 104999 - protein, 8 aa, Dengue virus
KFQPESPA

SEQ ID NO: 105000 - protein, 8 aa, Dengue virus
FQPESPAR

SEQ ID NO: 105001 - protein, 8 aa, Dengue virus
QPESPARL

SEQ ID NO: 105002 - protein, 8 aa, Dengue virus
ADSPKRLA

SEQ ID NO: 105003 - protein, 8 aa, Dengue virus
DSPKRLAT

SEQ ID NO: 105004 - protein, 8 aa, Dengue virus
SPKRLATA

SEQ ID NO: 105005 - protein, 8 aa, Dengue virus
PKRLATAI

SEQ ID NO: 105006 - protein, 8 aa, Dengue virus
KRLATAIA

SEQ ID NO: 105007 - protein, 8 aa, Dengue virus
RLATAIAG

SEQ ID NO: 105008 - protein, 8 aa, Dengue virus
LATAIAGA

SEQ ID NO: 105009 - protein, 8 aa, Dengue virus
ATAIAGAW

SEQ ID NO: 105010 - protein, 8 aa, Dengue virus
ENGVCGIR

SEQ ID NO: 105011 - protein, 8 aa, Dengue virus
NGVCGIRS

SEQ ID NO: 105012 - protein, 8 aa, Dengue virus
GVCGIRST

SEQ ID NO: 105013 - protein, 8 aa, Dengue virus
VCGIRSTT

SEQ ID NO: 105014 - protein, 8 aa, Dengue virus
CGIRSTTR

SEQ ID NO: 105015 - protein, 8 aa, Dengue virus
GIRSTTRM

SEQ ID NO: 105016 - protein, 8 aa, Dengue virus
IRSTTRME

SEQ ID NO: 105017 - protein, 8 aa, Dengue virus
RSTTRMEN

SEQ ID NO: 105018 - protein, 8 aa, Dengue virus
STTRMENL

SEQ ID NO: 105019 - protein, 8 aa, Dengue virus
TTRMENLL

SEQ ID NO: 105020 - protein, 8 aa, Dengue virus
TRMENLLW

SEQ ID NO: 105021 - protein, 8 aa, Dengue virus
RMENLLWK

SEQ ID NO: 105022 - protein, 8 aa, Dengue virus
MENLLWKQ

SEQ ID NO: 105023 - protein, 8 aa, Dengue virus
ENLLWKQI

SEQ ID NO: 105024 - protein, 8 aa, Dengue virus
ANELNYIL

SEQ ID NO: 105025 - protein, 8 aa, Dengue virus
ELNYILWE

SEQ ID NO: 105026 - protein, 8 aa, Dengue virus
LNYILWEN

SEQ ID NO: 105027 - protein, 8 aa, Dengue virus
KYSWKAWG

SEQ ID NO: 105028 - protein, 8 aa, Dengue virus
YSWKAWGK

SEQ ID NO: 105029 - protein, 8 aa, Dengue virus
SWKAWGKA

SEQ ID NO: 105030 - protein, 8 aa, Dengue virus
WKAWGKAK

SEQ ID NO: 105031 - protein, 8 aa, Dengue virus
SFIIDGPN

SEQ ID NO: 105032 - protein, 8 aa, Dengue virus
FIIDGPDT

SEQ ID NO: 105033 - protein, 8 aa, Dengue virus
RAWNVWEV

SEQ ID NO: 105034 - protein, 8 aa, Dengue virus
AWNVWEVE

SEQ ID NO: 105035 - protein, 8 aa, Dengue virus
WNVWEVED

SEQ ID NO: 105036 - protein, 8 aa, Dengue virus
NVWEVEDY

SEQ ID NO: 105037 - protein, 8 aa, Dengue virus
VWEVEDYG

SEQ ID NO: 105038 - protein, 8 aa, Dengue virus
FEVEDYGF

SEQ ID NO: 105039 - protein, 8 aa, Dengue virus
VEDYGFGM

SEQ ID NO: 105040 - protein, 8 aa, Dengue virus
EDYGFGMF

SEQ ID NO: 105041 - protein, 8 aa, Dengue virus
DYGFGMFT

SEQ ID NO: 105042 - protein, 8 aa, Dengue virus
YGFGMFTT

SEQ ID NO: 105043 - protein, 8 aa, Dengue virus
GFGMFTTN

SEQ ID NO: 105044 - protein, 8 aa, Dengue virus
FGMFTTNI

SEQ ID NO: 105045 - protein, 8 aa, Dengue virus
GMFTTNIW

SEQ ID NO: 105046 - protein, 8 aa, Dengue virus
MFTTNIWM

SEQ ID NO: 105047 - protein, 8 aa, Dengue virus
FSTNIWLK

SEQ ID NO: 105048 - protein, 8 aa, Dengue virus
STNIWLKL

SEQ ID NO: 105049 - protein, 8 aa, Dengue virus
TNIWMKFR

SEQ ID NO: 105050 - protein, 8 aa, Dengue virus
HRLMSAAV

SEQ ID NO: 105051 - protein, 8 aa, Dengue virus
RLMSAAVK

SEQ ID NO: 105052 - protein, 8 aa, Dengue virus
KDERAVHA

SEQ ID NO: 105053 - protein, 8 aa, Dengue virus
DERAVHAD

SEQ ID NO: 105054 - protein, 8 aa, Dengue virus
ERAVHADM

SEQ ID NO: 105055 - protein, 8 aa, Dengue virus
MGYWIESQ

SEQ ID NO: 105056 - protein, 8 aa, Dengue virus
GYWIESQK

SEQ ID NO: 105057 - protein, 8 aa, Dengue virus
YWIESQKN

SEQ ID NO: 105058 - protein, 8 aa, Dengue virus
ESQKNGSW

SEQ ID NO: 105059 - protein, 8 aa, Dengue virus
SQKNGSWK

SEQ ID NO: 105060 - protein, 8 aa, Dengue virus
LNDTWKME

SEQ ID NO: 105061 - protein, 8 aa, Dengue virus
KASLIEVK

SEQ ID NO: 105062 - protein, 8 aa, Dengue virus
ASFIEVKS

SEQ ID NO: 105063 - protein, 8 aa, Dengue virus
SFIEVKSC

SEQ ID NO: 105064 - protein, 8 aa, Dengue virus
WPRSHTLW

SEQ ID NO: 105065 - protein, 8 aa, Dengue virus
PRSHTLWS

SEQ ID NO: 105066 - protein, 8 aa, Dengue virus
RSHTLWSN

SEQ ID NO: 105067 - protein, 8 aa, Dengue virus
SNGVLESQ

SEQ ID NO: 105068 - protein, 8 aa, Dengue virus
NGVLESQM

SEQ ID NO: 105069 - protein, 8 aa, Dengue virus
GVLESQML

SEQ ID NO: 105070 - protein, 8 aa, Dengue virus
VLESQMLI

SEQ ID NO: 105071 - protein, 8 aa, Dengue virus
LESQMLIP

SEQ ID NO: 105072 - protein, 8 aa, Dengue virus
ESQMLIPK

SEQ ID NO: 105073 - protein, 8 aa, Dengue virus
AGPISQHN

SEQ ID NO: 105074 - protein, 8 aa, Dengue virus
SQHNYRQG

SEQ ID NO: 105075 - protein, 8 aa, Dengue virus
QHNYRQGY

SEQ ID NO: 105076 - protein, 8 aa, Dengue virus
TQTVGPWH

SEQ ID NO: 105077 - protein, 8 aa, Dengue virus
QTVGPWHL

SEQ ID NO: 105078 - protein, 8 aa, Dengue virus
TVGPWHLG

SEQ ID NO: 105079 - protein, 8 aa, Dengue virus
AGPWHLGR

SEQ ID NO: 105080 - protein, 8 aa, Dengue virus
WHLGKLEI

SEQ ID NO: 105081 - protein, 8 aa, Dengue virus
HLGKLEID

SEQ ID NO: 105082 - protein, 8 aa, Dengue virus
LGKLEIDF

SEQ ID NO: 105083 - protein, 8 aa, Dengue virus
CDGTTVIV

SEQ ID NO: 105084 - protein, 8 aa, Dengue virus
CDHRGPSL

SEQ ID NO: 105085 - protein, 8 aa, Dengue virus
DHRGPSLR

SEQ ID NO: 105086 - protein, 8 aa, Dengue virus
HRGPSLRT

SEQ ID NO: 105087 - protein, 8 aa, Dengue virus
SLRTTTVS

SEQ ID NO: 105088 - protein, 8 aa, Dengue virus
LRTTTVSG

SEQ ID NO: 105089 - protein, 8 aa, Dengue virus
RTTTVSGK

SEQ ID NO: 105090 - protein, 8 aa, Dengue virus
TTTVSGKL

SEQ ID NO: 105091 - protein, 8 aa, Dengue virus
TTVSGKLI

SEQ ID NO: 105092 - protein, 8 aa, Dengue virus
TVSGKLIH

SEQ ID NO: 105093 - protein, 8 aa, Dengue virus
VSGKLIHE

SEQ ID NO: 105094 - protein, 8 aa, Dengue virus
SGKLIHEW

SEQ ID NO: 105095 - protein, 8 aa, Dengue virus
GKLIHEWC

SEQ ID NO: 105096 - protein, 8 aa, Dengue virus
KLIHEWCC

SEQ ID NO: 105097 - protein, 8 aa, Dengue virus
LIHEWCCR

SEQ ID NO: 105098 - protein, 8 aa, Dengue virus
VTQWCCRS

SEQ ID NO: 105099 - protein, 8 aa, Dengue virus
TQWCCRSC

SEQ ID NO: 105100 - protein, 8 aa, Dengue virus
CTMPPLRF

SEQ ID NO: 105101 - protein, 8 aa, Dengue virus
TLPPLRYM

SEQ ID NO: 105102 - protein, 8 aa, Dengue virus
LPPLRYMG

SEQ ID NO: 105103 - protein, 8 aa, Dengue virus
PPLRYMGE

SEQ ID NO: 105104 - protein, 8 aa, Dengue virus
PLRYMGED

SEQ ID NO: 105105 - protein, 8 aa, Dengue virus
LRYMGEDG

SEQ ID NO: 105106 - protein, 8 aa, Dengue virus
RYMGEDGC

SEQ ID NO: 105107 - protein, 8 aa, Dengue virus
YMGEDGCW

SEQ ID NO: 105108 - protein, 8 aa, Dengue virus
KGEDGCWY

SEQ ID NO: 105109 - protein, 8 aa, Dengue virus
YGMEIRPI

SEQ ID NO: 105110 - protein, 8 aa, Dengue virus
NEKEENMV

SEQ ID NO: 105111 - protein, 8 aa, Dengue virus
KEENMVKS

SEQ ID NO: 105112 - protein, 8 aa, Dengue virus
FEEVMRGK

SEQ ID NO: 105113 - protein, 8 aa, Dengue virus
EEVMRGKF

SEQ ID NO: 105114 - protein, 8 aa, Dengue virus
EVMRGKFG

SEQ ID NO: 105115 - protein, 8 aa, Dengue virus
MGMGVTYL

SEQ ID NO: 105116 - protein, 8 aa, Dengue virus
GMGMTYLA

SEQ ID NO: 105117 - protein, 8 aa, Dengue virus
MGMTYLAL

SEQ ID NO: 105118 - protein, 8 aa, Dengue virus
TYLALIAT

SEQ ID NO: 105119 - protein, 8 aa, Dengue virus
YLALIATF

SEQ ID NO: 105120 - protein, 8 aa, Dengue virus
FLRKLTSR

SEQ ID NO: 105121 - protein, 8 aa, Dengue virus
LRKLTSRE

SEQ ID NO: 105122 - protein, 8 aa, Dengue virus
RKLTSREN

SEQ ID NO: 105123 - protein, 8 aa, Dengue virus
KLTSRENL

SEQ ID NO: 105124 - protein, 8 aa, Dengue virus
LTSRENLL

SEQ ID NO: 105125 - protein, 8 aa, Dengue virus
TSKELMMA

SEQ ID NO: 105126 - protein, 8 aa, Dengue virus
SKELMMAT

SEQ ID NO: 105127 - protein, 8 aa, Dengue virus
EQMANGIA

SEQ ID NO: 105128 - protein, 8 aa, Dengue virus
QMANGIAL

SEQ ID NO: 105129 - protein, 8 aa, Dengue virus
MANGIALG

SEQ ID NO: 105130 - protein, 8 aa, Dengue virus
ANGIALGL

SEQ ID NO: 105131 - protein, 8 aa, Dengue virus
NGIALGLM

SEQ ID NO: 105132 - protein, 8 aa, Dengue virus
KRSWPLNE

SEQ ID NO: 105133 - protein, 8 aa, Dengue virus
RSWPLNEA

SEQ ID NO: 105134 - protein, 8 aa, Dengue virus
SWPLNEGV

SEQ ID NO: 105135 - protein, 8 aa, Dengue virus
WPLNEGVM

SEQ ID NO: 105136 - protein, 8 aa, Dengue virus
PLNEGVMA

SEQ ID NO: 105137 - protein, 8 aa, Dengue virus
LNEGVMAV

SEQ ID NO: 105138 - protein, 8 aa, Dengue virus
NEGVMAVG

SEQ ID NO: 105139 - protein, 8 aa, Dengue virus
GLVSILAS

SEQ ID NO: 105140 - protein, 8 aa, Dengue virus
LVSILASS

SEQ ID NO: 105141 - protein, 8 aa, Dengue virus
VSLLGSAL

SEQ ID NO: 105142 - protein, 8 aa, Dengue virus
SLLGSALL

SEQ ID NO: 105143 - protein, 8 aa, Dengue virus
ILASSLLR

SEQ ID NO: 105144 - protein, 8 aa, Dengue virus
LASSLLRN

SEQ ID NO: 105145 - protein, 8 aa, Dengue virus
ASSLLRND

SEQ ID NO: 105146 - protein, 8 aa, Dengue virus
SSLLRNDV

SEQ ID NO: 105147 - protein, 8 aa, Dengue virus
SLLRNDVP

SEQ ID NO: 105148 - protein, 8 aa, Dengue virus
LLRNDVPM

SEQ ID NO: 105149 - protein, 8 aa, Dengue virus
LRNDVPMA

SEQ ID NO: 105150 - protein, 8 aa, Dengue virus
RNDVPMAG

SEQ ID NO: 105151 - protein, 8 aa, Dengue virus
NDVPMAGP

SEQ ID NO: 105152 - protein, 8 aa, Dengue virus
DVPMAGPL

SEQ ID NO: 105153 - protein, 8 aa, Dengue virus
VPMAGPLV

SEQ ID NO: 105154 - protein, 8 aa, Dengue virus
PMAGPLVA

SEQ ID NO: 105155 - protein, 8 aa, Dengue virus
MAGPLVAG

SEQ ID NO: 105156 - protein, 8 aa, Dengue virus
AGPLVAGG

SEQ ID NO: 105157 - protein, 8 aa, Dengue virus
GPMVAGGL

SEQ ID NO: 105158 - protein, 8 aa, Dengue virus
PMVAGGLL

SEQ ID NO: 105159 - protein, 8 aa, Dengue virus
LVAGGLLI

SEQ ID NO: 105160 - protein, 8 aa, Dengue virus
VAGGLLIA

SEQ ID NO: 105161 - protein, 8 aa, Dengue virus
AGGLLIAC

SEQ ID NO: 105162 - protein, 8 aa, Dengue virus
GGLLIACY

SEQ ID NO: 105163 - protein, 8 aa, Dengue virus
GLLIACYV

SEQ ID NO: 105164 - protein, 8 aa, Dengue virus
LLIACYVI

SEQ ID NO: 105165 - protein, 8 aa, Dengue virus
LIACYVIT

SEQ ID NO: 105166 - protein, 8 aa, Dengue virus
IACYVITG

SEQ ID NO: 105167 - protein, 8 aa, Dengue virus
ACYVITGT

SEQ ID NO: 105168 - protein, 8 aa, Dengue virus
CYVITGTS

SEQ ID NO: 105169 - protein, 8 aa, Dengue virus
YVITGTSA

SEQ ID NO: 105170 - protein, 8 aa, Dengue virus
VITGTSAD

SEQ ID NO: 105171 - protein, 8 aa, Dengue virus
ITGTSADL

SEQ ID NO: 105172 - protein, 8 aa, Dengue virus
TGTSADLT

SEQ ID NO: 105173 - protein, 8 aa, Dengue virus
GTSADLTV

SEQ ID NO: 105174 - protein, 8 aa, Dengue virus
TSADLTVE

SEQ ID NO: 105175 - protein, 8 aa, Dengue virus
SADLTVEK

SEQ ID NO: 105176 - protein, 8 aa, Dengue virus
ADLTVEKA

SEQ ID NO: 105177 - protein, 8 aa, Dengue virus
EAEQTGVS

SEQ ID NO: 105178 - protein, 8 aa, Dengue virus
AEQTGVSH

SEQ ID NO: 105179 - protein, 8 aa, Dengue virus
EQTGVSHN

SEQ ID NO: 105180 - protein, 8 aa, Dengue virus
QTGVSHNL

SEQ ID NO: 105181 - protein, 8 aa, Dengue virus
TGVSHNLM

SEQ ID NO: 105182 - protein, 8 aa, Dengue virus
DDDGTMRI

SEQ ID NO: 105183 - protein, 8 aa, Dengue virus
DDGTMRIK

SEQ ID NO: 105184 - protein, 8 aa, Dengue virus
DGTMRIKD

SEQ ID NO: 105185 - protein, 8 aa, Dengue virus
GTMRIKDD

SEQ ID NO: 105186 - protein, 8 aa, Dengue virus
TMRIKDDE

SEQ ID NO: 105187 - protein, 8 aa, Dengue virus
MRIKDDET

SEQ ID NO: 105188 - protein, 8 aa, Dengue virus
RIKDDETE

SEQ ID NO: 105189 - protein, 8 aa, Dengue virus
IKDDETEN

SEQ ID NO: 105190 - protein, 8 aa, Dengue virus
ILTVLLKT

SEQ ID NO: 105191 - protein, 8 aa, Dengue virus
LTVLLKTA

SEQ ID NO: 105192 - protein, 8 aa, Dengue virus
TVLLKTAL

SEQ ID NO: 105193 - protein, 8 aa, Dengue virus
VLLKTALL

SEQ ID NO: 105194 - protein, 8 aa, Dengue virus
LLKTALLI

SEQ ID NO: 105195 - protein, 8 aa, Dengue virus
LKTALLIV

SEQ ID NO: 105196 - protein, 8 aa, Dengue virus
KTALLIVS

SEQ ID NO: 105197 - protein, 8 aa, Dengue virus
TALLIVSG

SEQ ID NO: 105198 - protein, 8 aa, Dengue virus
QTQRSGVL

SEQ ID NO: 105199 - protein, 8 aa, Dengue virus
TQRSGVLW

SEQ ID NO: 105200 - protein, 8 aa, Dengue virus
QRSGALWD

SEQ ID NO: 105201 - protein, 8 aa, Dengue virus
RSGVLWDV

SEQ ID NO: 105202 - protein, 8 aa, Dengue virus
SGVLWDVP

SEQ ID NO: 105203 - protein, 8 aa, Dengue virus
GALWDVPS

SEQ ID NO: 105204 - protein, 8 aa, Dengue virus
ALWDVPSP

SEQ ID NO: 105205 - protein, 8 aa, Dengue virus
LWDVPSPA

SEQ ID NO: 105206 - protein, 8 aa, Dengue virus
WDVPSPPE

SEQ ID NO: 105207 - protein, 8 aa, Dengue virus
AELEEGVY

SEQ ID NO: 105208 - protein, 8 aa, Dengue virus
ELEEGVYR

SEQ ID NO: 105209 - protein, 8 aa, Dengue virus
LEEGVYRI

SEQ ID NO: 105210 - protein, 8 aa, Dengue virus
EEGVYRIK

SEQ ID NO: 105211 - protein, 8 aa, Dengue virus
EGVYRIKQ

SEQ ID NO: 105212 - protein, 8 aa, Dengue virus
YRIKQRGI

SEQ ID NO: 105213 - protein, 8 aa, Dengue virus
FGKTQVGV

SEQ ID NO: 105214 - protein, 8 aa, Dengue virus
GKTQVGVG

SEQ ID NO: 105215 - protein, 8 aa, Dengue virus
KTQVGVGV

SEQ ID NO: 105216 - protein, 8 aa, Dengue virus
TQVGVGVQ

SEQ ID NO: 105217 - protein, 8 aa, Dengue virus
QVGVGVQK

SEQ ID NO: 105218 - protein, 8 aa, Dengue virus
VGVGVQKE

SEQ ID NO: 105219 - protein, 8 aa, Dengue virus
EGVFHTMW

SEQ ID NO: 105220 - protein, 8 aa, Dengue virus
GTFHTMWH

SEQ ID NO: 105221 - protein, 8 aa, Dengue virus
VTRGSVIC

SEQ ID NO: 105222 - protein, 8 aa, Dengue virus
TRGAVLTY

SEQ ID NO: 105223 - protein, 8 aa, Dengue virus
RGKRIEPS

SEQ ID NO: 105224 - protein, 8 aa, Dengue virus
GKRLEPNW

SEQ ID NO: 105225 - protein, 8 aa, Dengue virus
KRLEPNWA

SEQ ID NO: 105226 - protein, 8 aa, Dengue virus
RLEPNWAS

SEQ ID NO: 105227 - protein, 8 aa, Dengue virus
LEPNWASV

SEQ ID NO: 105228 - protein, 8 aa, Dengue virus
EPNWASVK

SEQ ID NO: 105229 - protein, 8 aa, Dengue virus
PNWASVKK

SEQ ID NO: 105230 - protein, 8 aa, Dengue virus
NWASVKKD

SEQ ID NO: 105231 - protein, 8 aa, Dengue virus
WADVRNDM

SEQ ID NO: 105232 - protein, 8 aa, Dengue virus
ADVRNDMI

SEQ ID NO: 105233 - protein, 8 aa, Dengue virus
DVRNDMIS

SEQ ID NO: 105234 - protein, 8 aa, Dengue virus
SYGGGWRF

SEQ ID NO: 105235 - protein, 8 aa, Dengue virus
WQKGEEVQ

SEQ ID NO: 105236 - protein, 8 aa, Dengue virus
QKGEEVQV

SEQ ID NO: 105237 - protein, 8 aa, Dengue virus
KGEEVQVI

SEQ ID NO: 105238 - protein, 8 aa, Dengue virus
EEDVQVLA

SEQ ID NO: 105239 - protein, 8 aa, Dengue virus
EDVQVLAI

SEQ ID NO: 105240 - protein, 8 aa, Dengue virus
DVQVLAIE

SEQ ID NO: 105241 - protein, 8 aa, Dengue virus
VQVLAIEP

SEQ ID NO: 105242 - protein, 8 aa, Dengue virus
QVLAIEPG

SEQ ID NO: 105243 - protein, 8 aa, Dengue virus
VLAIEPGK

SEQ ID NO: 105244 - protein, 8 aa, Dengue virus
LAIEPGKN

SEQ ID NO: 105245 - protein, 8 aa, Dengue virus
AIEPGKNP

SEQ ID NO: 105246 - protein, 8 aa, Dengue virus
IEPGKNPK

SEQ ID NO: 105247 - protein, 8 aa, Dengue virus
EPGKNPKH

SEQ ID NO: 105248 - protein, 8 aa, Dengue virus
PGKNPKNF

SEQ ID NO: 105249 - protein, 8 aa, Dengue virus
GKNPKNFQ

SEQ ID NO: 105250 - protein, 8 aa, Dengue virus
KNPKNFQT

SEQ ID NO: 105251 - protein, 8 aa, Dengue virus
TGEIGAIA

SEQ ID NO: 105252 - protein, 8 aa, Dengue virus
GEIGAIAL

SEQ ID NO: 105253 - protein, 8 aa, Dengue virus
EIGAIALD

SEQ ID NO: 105254 - protein, 8 aa, Dengue virus
IGAIALDF

SEQ ID NO: 105255 - protein, 8 aa, Dengue virus
GAVTLDFK

SEQ ID NO: 105256 - protein, 8 aa, Dengue virus
AVTLDFKP

SEQ ID NO: 105257 - protein, 8 aa, Dengue virus
VTLDFKPG

SEQ ID NO: 105258 - protein, 8 aa, Dengue virus
TLDFKPGT

SEQ ID NO: 105259 - protein, 8 aa, Dengue virus
TSGSPIVD

SEQ ID NO: 105260 - protein, 8 aa, Dengue virus
SGSPIVDR

SEQ ID NO: 105261 - protein, 8 aa, Dengue virus
EGKVVGLY

SEQ ID NO: 105262 - protein, 8 aa, Dengue virus
GKVIGLYG

SEQ ID NO: 105263 - protein, 8 aa, Dengue virus
KVIGLYGN

SEQ ID NO: 105264 - protein, 8 aa, Dengue virus
VIGLYGNG

SEQ ID NO: 105265 - protein, 8 aa, Dengue virus
YGNGVVTK

SEQ ID NO: 105266 - protein, 8 aa, Dengue virus
GNGVVTKN

SEQ ID NO: 105267 - protein, 8 aa, Dengue virus
NGVVTKNG

SEQ ID NO: 105268 - protein, 8 aa, Dengue virus
GVVTKNGG

SEQ ID NO: 105269 - protein, 8 aa, Dengue virus
VVTKNGGY

SEQ ID NO: 105270 - protein, 8 aa, Dengue virus
VTKNGGYV

SEQ ID NO: 105271 - protein, 8 aa, Dengue virus
TKNGGYVS

SEQ ID NO: 105272 - protein, 8 aa, Dengue virus
NGGYVSGI

SEQ ID NO: 105273 - protein, 8 aa, Dengue virus
GGYVSGIA

SEQ ID NO: 105274 - protein, 8 aa, Dengue virus
GYVSGIAQ

SEQ ID NO: 105275 - protein, 8 aa, Dengue virus
YVSGIAQT

SEQ ID NO: 105276 - protein, 8 aa, Dengue virus
MFKKRNLT

SEQ ID NO: 105277 - protein, 8 aa, Dengue virus
FRKKRLTI

SEQ ID NO: 105278 - protein, 8 aa, Dengue virus
RKKRLTIM

SEQ ID NO: 105279 - protein, 8 aa, Dengue virus
KRRLTIMD

SEQ ID NO: 105280 - protein, 8 aa, Dengue virus
RRLTIMDL

SEQ ID NO: 105281 - protein, 8 aa, Dengue virus
PGSGKTRK

SEQ ID NO: 105282 - protein, 8 aa, Dengue virus
GSGKTRKY

SEQ ID NO: 105283 - protein, 8 aa, Dengue virus
SGKTRKYL

SEQ ID NO: 105284 - protein, 8 aa, Dengue virus
GKTRKYLP

SEQ ID NO: 105285 - protein, 8 aa, Dengue virus
KTRKYLPA

SEQ ID NO: 105286 - protein, 8 aa, Dengue virus
TRKYLPAI

SEQ ID NO: 105287 - protein, 8 aa, Dengue virus
RILPSIVR

SEQ ID NO: 105288 - protein, 8 aa, Dengue virus
YLPAIIRE

SEQ ID NO: 105289 - protein, 8 aa, Dengue virus
LPAIIREA

SEQ ID NO: 105290 - protein, 8 aa, Dengue virus
PAIIREAI

SEQ ID NO: 105291 - protein, 8 aa, Dengue virus
AIIREAIK

SEQ ID NO: 105292 - protein, 8 aa, Dengue virus
IIREAIKR

SEQ ID NO: 105293 - protein, 8 aa, Dengue virus
REAIKRRL

SEQ ID NO: 105294 - protein, 8 aa, Dengue virus
EAIKRRLR

SEQ ID NO: 105295 - protein, 8 aa, Dengue virus
AIKRRLRT

SEQ ID NO: 105296 - protein, 8 aa, Dengue virus
IKRRLRTL

SEQ ID NO: 105297 - protein, 8 aa, Dengue virus
KRRLRTLI

SEQ ID NO: 105298 - protein, 8 aa, Dengue virus
RRLRTLIL

SEQ ID NO: 105299 - protein, 8 aa, Dengue virus
RLRTLILA

SEQ ID NO: 105300 - protein, 8 aa, Dengue virus
AEMEEALK

SEQ ID NO: 105301 - protein, 8 aa, Dengue virus
EMEEALKG

SEQ ID NO: 105302 - protein, 8 aa, Dengue virus
MEEALKGL

SEQ ID NO: 105303 - protein, 8 aa, Dengue virus
EEALKGLP

SEQ ID NO: 105304 - protein, 8 aa, Dengue virus
EALKGLPI

SEQ ID NO: 105305 - protein, 8 aa, Dengue virus
ALKGLPIR

SEQ ID NO: 105306 - protein, 8 aa, Dengue virus
LKGLPIRY

SEQ ID NO: 105307 - protein, 8 aa, Dengue virus
KGLPIRYQ

SEQ ID NO: 105308 - protein, 8 aa, Dengue virus
LPIRYQTT

SEQ ID NO: 105309 - protein, 8 aa, Dengue virus
IRYQTTAT

SEQ ID NO: 105310 - protein, 8 aa, Dengue virus
RAEHTGRE

SEQ ID NO: 105311 - protein, 8 aa, Dengue virus
AEHTGREI

SEQ ID NO: 105312 - protein, 8 aa, Dengue virus
TMRLLSPI

SEQ ID NO: 105313 - protein, 8 aa, Dengue virus
MRLLSPIR

SEQ ID NO: 105314 - protein, 8 aa, Dengue virus
RLLSPIRV

SEQ ID NO: 105315 - protein, 8 aa, Dengue virus
LLSPIRVP

SEQ ID NO: 105316 - protein, 8 aa, Dengue virus
LSPIRVPN

SEQ ID NO: 105317 - protein, 8 aa, Dengue virus
SPIRVPNY

SEQ ID NO: 105318 - protein, 8 aa, Dengue virus
PIRVPNYN

SEQ ID NO: 105319 - protein, 8 aa, Dengue virus
TRVPNYNL

SEQ ID NO: 105320 - protein, 8 aa, Dengue virus
RVPNYNLV

SEQ ID NO: 105321 - protein, 8 aa, Dengue virus
VPNYNLIV

SEQ ID NO: 105322 - protein, 8 aa, Dengue virus
PNYNLIVM

SEQ ID NO: 105323 - protein, 8 aa, Dengue virus
NYNLIVMD

SEQ ID NO: 105324 - protein, 8 aa, Dengue virus
YNLIVMDE

SEQ ID NO: 105325 - protein, 8 aa, Dengue virus
NLIVMDEA

SEQ ID NO: 105326 - protein, 8 aa, Dengue virus
LIVMDEAH

SEQ ID NO: 105327 - protein, 8 aa, Dengue virus
VIMDEAHF

SEQ ID NO: 105328 - protein, 8 aa, Dengue virus
HFTDPSSV

SEQ ID NO: 105329 - protein, 8 aa, Dengue virus
FTDPSSVA

SEQ ID NO: 105330 - protein, 8 aa, Dengue virus
TDPSSVAA

SEQ ID NO: 105331 - protein, 8 aa, Dengue virus
DPSSVAAR

SEQ ID NO: 105332 - protein, 8 aa, Dengue virus
PSSVAARG

SEQ ID NO: 105333 - protein, 8 aa, Dengue virus
SSVAARGY

SEQ ID NO: 105334 - protein, 8 aa, Dengue virus
VEMGEAAA

SEQ ID NO: 105335 - protein, 8 aa, Dengue virus
EMGEAAAI

SEQ ID NO: 105336 - protein, 8 aa, Dengue virus
MTATPPGA

SEQ ID NO: 105337 - protein, 8 aa, Dengue virus
DAFPQSNA

SEQ ID NO: 105338 - protein, 8 aa, Dengue virus
AFPQSNAP

SEQ ID NO: 105339 - protein, 8 aa, Dengue virus
FPQSNSPI

SEQ ID NO: 105340 - protein, 8 aa, Dengue virus
IIDEEREI

SEQ ID NO: 105341 - protein, 8 aa, Dengue virus
IDEEREIP

SEQ ID NO: 105342 - protein, 8 aa, Dengue virus
DIEREIPE

SEQ ID NO: 105343 - protein, 8 aa, Dengue virus
IEREIPER

SEQ ID NO: 105344 - protein, 8 aa, Dengue virus
EKDIPERS

SEQ ID NO: 105345 - protein, 8 aa, Dengue virus
KDIPERSW

SEQ ID NO: 105346 - protein, 8 aa, Dengue virus
ERSWNSGN

SEQ ID NO: 105347 - protein, 8 aa, Dengue virus
FAGKTVWF

SEQ ID NO: 105348 - protein, 8 aa, Dengue virus
AGKTVWFV

SEQ ID NO: 105349 - protein, 8 aa, Dengue virus
WFVPSIKT

SEQ ID NO: 105350 - protein, 8 aa, Dengue virus
FVPSIKTG

SEQ ID NO: 105351 - protein, 8 aa, Dengue virus
VPSIKTGN

SEQ ID NO: 105352 - protein, 8 aa, Dengue virus
PSIKTGND

SEQ ID NO: 105353 - protein, 8 aa, Dengue virus
SIKTGNDI

SEQ ID NO: 105354 - protein, 8 aa, Dengue virus
IKTGNDIA

SEQ ID NO: 105355 - protein, 8 aa, Dengue virus
KAGNDIAN

SEQ ID NO: 105356 - protein, 8 aa, Dengue virus
AGNDIANC

SEQ ID NO: 105357 - protein, 8 aa, Dengue virus
IANCLRKS

SEQ ID NO: 105358 - protein, 8 aa, Dengue virus
ANCLRKSG

SEQ ID NO: 105359 - protein, 8 aa, Dengue virus
NCLRKSGK

SEQ ID NO: 105360 - protein, 8 aa, Dengue virus
CLRKSGKK

SEQ ID NO: 105361 - protein, 8 aa, Dengue virus
LRKSGKKV

SEQ ID NO: 105362 - protein, 8 aa, Dengue virus
RKSGKKVI

SEQ ID NO: 105363 - protein, 8 aa, Dengue virus
KSGKKVIQ

SEQ ID NO: 105364 - protein, 8 aa, Dengue virus
SGKKVIQL

SEQ ID NO: 105365 - protein, 8 aa, Dengue virus
KTFDTEYP

SEQ ID NO: 105366 - protein, 8 aa, Dengue virus
TFDTEYPK

SEQ ID NO: 105367 - protein, 8 aa, Dengue virus
FDTEYPKT

SEQ ID NO: 105368 - protein, 8 aa, Dengue virus
TNDWDFVV

SEQ ID NO: 105369 - protein, 8 aa, Dengue virus
TDWDFVVT

SEQ ID NO: 105370 - protein, 8 aa, Dengue virus
MGANFKAD

SEQ ID NO: 105371 - protein, 8 aa, Dengue virus
GANFKADR

SEQ ID NO: 105372 - protein, 8 aa, Dengue virus
ANFKADRV

SEQ ID NO: 105373 - protein, 8 aa, Dengue virus
NFKADRVI

SEQ ID NO: 105374 - protein, 8 aa, Dengue virus
FKADRVID

SEQ ID NO: 105375 - protein, 8 aa, Dengue virus
KADRVIDP

SEQ ID NO: 105376 - protein, 8 aa, Dengue virus
AGRVIDPR

SEQ ID NO: 105377 - protein, 8 aa, Dengue virus
GRVIDPRR

SEQ ID NO: 105378 - protein, 8 aa, Dengue virus
CLKPVILT

SEQ ID NO: 105379 - protein, 8 aa, Dengue virus
LKPVILTD

SEQ ID NO: 105380 - protein, 8 aa, Dengue virus
KPVILPDG

SEQ ID NO: 105381 - protein, 8 aa, Dengue virus
PVILTDGP

SEQ ID NO: 105382 - protein, 8 aa, Dengue virus
VILTDGPE

SEQ ID NO: 105383 - protein, 8 aa, Dengue virus
ILTDGPER

SEQ ID NO: 105384 - protein, 8 aa, Dengue virus
LTDGPERV

SEQ ID NO: 105385 - protein, 8 aa, Dengue virus
TDGPERVI

SEQ ID NO: 105386 - protein, 8 aa, Dengue virus
DGEERVVL

SEQ ID NO: 105387 - protein, 8 aa, Dengue virus
AGPMPVTA

SEQ ID NO: 105388 - protein, 8 aa, Dengue virus
GPMPVTAA

SEQ ID NO: 105389 - protein, 8 aa, Dengue virus
PMPVTAAS

SEQ ID NO: 105390 - protein, 8 aa, Dengue virus
MPVTAASA

SEQ ID NO: 105391 - protein, 8 aa, Dengue virus
PVTAASAA

SEQ ID NO: 105392 - protein, 8 aa, Dengue virus
VTAASAAQ

SEQ ID NO: 105393 - protein, 8 aa, Dengue virus
TAASAAQR

SEQ ID NO: 105394 - protein, 8 aa, Dengue virus
AASAAQRR

SEQ ID NO: 105395 - protein, 8 aa, Dengue virus
RGRVGRNP

SEQ ID NO: 105396 - protein, 8 aa, Dengue virus
KENDQYIF

SEQ ID NO: 105397 - protein, 8 aa, Dengue virus
ENDQYIFT

SEQ ID NO: 105398 - protein, 8 aa, Dengue virus
NDQYIFTG

SEQ ID NO: 105399 - protein, 8 aa, Dengue virus
DQYIFTGQ

SEQ ID NO: 105400 - protein, 8 aa, Dengue virus
QYIFTGQP

SEQ ID NO: 105401 - protein, 8 aa, Dengue virus
YIFTGQPL

SEQ ID NO: 105402 - protein, 8 aa, Dengue virus
FTGQPLNN

SEQ ID NO: 105403 - protein, 8 aa, Dengue virus
TGQPLNND

SEQ ID NO: 105404 - protein, 8 aa, Dengue virus
GDPLKNDE

SEQ ID NO: 105405 - protein, 8 aa, Dengue virus
DPLKNDED

SEQ ID NO: 105406 - protein, 8 aa, Dengue virus
PLKNDEDH

SEQ ID NO: 105407 - protein, 8 aa, Dengue virus
LKNDEDHA

SEQ ID NO: 105408 - protein, 8 aa, Dengue virus
KNDEDHAH

SEQ ID NO: 105409 - protein, 8 aa, Dengue virus
TPEGIIPT

SEQ ID NO: 105410 - protein, 8 aa, Dengue virus
PEGIIPTL

SEQ ID NO: 105411 - protein, 8 aa, Dengue virus
EGIIPTLF

SEQ ID NO: 105412 - protein, 8 aa, Dengue virus
GIIPTLFG

SEQ ID NO: 105413 - protein, 8 aa, Dengue virus
IIPTLFGP

SEQ ID NO: 105414 - protein, 8 aa, Dengue virus
IPTLFGPE

SEQ ID NO: 105415 - protein, 8 aa, Dengue virus
PTLFGPER

SEQ ID NO: 105416 - protein, 8 aa, Dengue virus
TLFGPERE

SEQ ID NO: 105417 - protein, 8 aa, Dengue virus
LFGPEREK

SEQ ID NO: 105418 - protein, 8 aa, Dengue virus
FGPEREKT

SEQ ID NO: 105419 - protein, 8 aa, Dengue virus
GPEREKTQ

SEQ ID NO: 105420 - protein, 8 aa, Dengue virus
PEREKTQA

SEQ ID NO: 105421 - protein, 8 aa, Dengue virus
EREKTQAI

SEQ ID NO: 105422 - protein, 8 aa, Dengue virus
REKTQAID

SEQ ID NO: 105423 - protein, 8 aa, Dengue virus
EKTQAIDG

SEQ ID NO: 105424 - protein, 8 aa, Dengue virus
KTQAIDGE

SEQ ID NO: 105425 - protein, 8 aa, Dengue virus
TQAIDGEF

SEQ ID NO: 105426 - protein, 8 aa, Dengue virus
QAIDGEFR

SEQ ID NO: 105427 - protein, 8 aa, Dengue virus
AVDGEYRL

SEQ ID NO: 105428 - protein, 8 aa, Dengue virus
IDGEFRLR

SEQ ID NO: 105429 - protein, 8 aa, Dengue virus
DGEFRLRG

SEQ ID NO: 105430 - protein, 8 aa, Dengue virus
GEFRLRGE

SEQ ID NO: 105431 - protein, 8 aa, Dengue virus
EFRLRGEQ

SEQ ID NO: 105432 - protein, 8 aa, Dengue virus
FRLRGEQR

SEQ ID NO: 105433 - protein, 8 aa, Dengue virus
RLRGEQRK

SEQ ID NO: 105434 - protein, 8 aa, Dengue virus
LRGEQRKT

SEQ ID NO: 105435 - protein, 8 aa, Dengue virus
RGEQRKTF

SEQ ID NO: 105436 - protein, 8 aa, Dengue virus
GEQRKTFV

SEQ ID NO: 105437 - protein, 8 aa, Dengue virus
ESRKTFVE

SEQ ID NO: 105438 - protein, 8 aa, Dengue virus
SRKTFVEL

SEQ ID NO: 105439 - protein, 8 aa, Dengue virus
DLPVWLAH

SEQ ID NO: 105440 - protein, 8 aa, Dengue virus
LPVWLAHK

SEQ ID NO: 105441 - protein, 8 aa, Dengue virus
PVWLAHKV

SEQ ID NO: 105442 - protein, 8 aa, Dengue virus
VWLAHKVA

SEQ ID NO: 105443 - protein, 8 aa, Dengue virus
WLAYKVAA

SEQ ID NO: 105444 - protein, 8 aa, Dengue virus
VASEGIKY

SEQ ID NO: 105445 - protein, 8 aa, Dengue virus
EGIKYTDR

SEQ ID NO: 105446 - protein, 8 aa, Dengue virus
YTDRKWCF

SEQ ID NO: 105447 - protein, 8 aa, Dengue virus
ADRRWCFD

SEQ ID NO: 105448 - protein, 8 aa, Dengue virus
DREWCFTG

SEQ ID NO: 105449 - protein, 8 aa, Dengue virus
RNNQILEE

SEQ ID NO: 105450 - protein, 8 aa, Dengue virus
NQILEENV

SEQ ID NO: 105451 - protein, 8 aa, Dengue virus
QILEENMD

SEQ ID NO: 105452 - protein, 8 aa, Dengue virus
ILEENMDV

SEQ ID NO: 105453 - protein, 8 aa, Dengue virus
LEENMEVE

SEQ ID NO: 105454 - protein, 8 aa, Dengue virus
EENMEVEI

SEQ ID NO: 105455 - protein, 8 aa, Dengue virus
ENMEVEIW

SEQ ID NO: 105456 - protein, 8 aa, Dengue virus
NMEVEIWT

SEQ ID NO: 105457 - protein, 8 aa, Dengue virus
MEVEIWTK

SEQ ID NO: 105458 - protein, 8 aa, Dengue virus
EVEIWTRE

SEQ ID NO: 105459 - protein, 8 aa, Dengue virus
EKKKLRPR

SEQ ID NO: 105460 - protein, 8 aa, Dengue virus
KKKLRPRW

SEQ ID NO: 105461 - protein, 8 aa, Dengue virus
KKLRPKWL

SEQ ID NO: 105462 - protein, 8 aa, Dengue virus
KLRPKWLD

SEQ ID NO: 105463 - protein, 8 aa, Dengue virus
LRPKWLDA

SEQ ID NO: 105464 - protein, 8 aa, Dengue virus
RPKWLDAR

SEQ ID NO: 105465 - protein, 8 aa, Dengue virus
PRWLDARV

SEQ ID NO: 105466 - protein, 8 aa, Dengue virus
RWLDARVY

SEQ ID NO: 105467 - protein, 8 aa, Dengue virus
WLDARVYA

SEQ ID NO: 105468 - protein, 8 aa, Dengue virus
LDARVYAD

SEQ ID NO: 105469 - protein, 8 aa, Dengue virus
DARVYADP

SEQ ID NO: 105470 - protein, 8 aa, Dengue virus
ARVYADPM

SEQ ID NO: 105471 - protein, 8 aa, Dengue virus
RVYADPMA

SEQ ID NO: 105472 - protein, 8 aa, Dengue virus
VYADPMAL

SEQ ID NO: 105473 - protein, 8 aa, Dengue virus
YADPMALK

SEQ ID NO: 105474 - protein, 8 aa, Dengue virus
ADPMALKD

SEQ ID NO: 105475 - protein, 8 aa, Dengue virus
DPMALKDF

SEQ ID NO: 105476 - protein, 8 aa, Dengue virus
PMALKDFK

SEQ ID NO: 105477 - protein, 8 aa, Dengue virus
LALKEFKD

SEQ ID NO: 105478 - protein, 8 aa, Dengue virus
ALKEFKDF

SEQ ID NO: 105479 - protein, 8 aa, Dengue virus
LKEFKDFA

SEQ ID NO: 105480 - protein, 8 aa, Dengue virus
KEFKDFAA

SEQ ID NO: 105481 - protein, 8 aa, Dengue virus
DFKEFASG

SEQ ID NO: 105482 - protein, 8 aa, Dengue virus
FKEFASGR

SEQ ID NO: 105483 - protein, 8 aa, Dengue virus
KDFAAGRK

SEQ ID NO: 105484 - protein, 8 aa, Dengue virus
DFAAGRKS

SEQ ID NO: 105485 - protein, 8 aa, Dengue virus
FAAGRKSI

SEQ ID NO: 105486 - protein, 8 aa, Dengue virus
AAGRKSIA

SEQ ID NO: 105487 - protein, 8 aa, Dengue virus
AGRKSIAL

SEQ ID NO: 105488 - protein, 8 aa, Dengue virus
LDLVTEIG

SEQ ID NO: 105489 - protein, 8 aa, Dengue virus
DLVTEIGR

SEQ ID NO: 105490 - protein, 8 aa, Dengue virus
LVTEIGRV

SEQ ID NO: 105491 - protein, 8 aa, Dengue virus
VTEIGRVP

SEQ ID NO: 105492 - protein, 8 aa, Dengue virus
TEIGRVPS

SEQ ID NO: 105493 - protein, 8 aa, Dengue virus
EIGRVPSH

SEQ ID NO: 105494 - protein, 8 aa, Dengue virus
IGRVPSHL

SEQ ID NO: 105495 - protein, 8 aa, Dengue virus
GRVPSHLA

SEQ ID NO: 105496 - protein, 8 aa, Dengue virus
RDALDNLA

SEQ ID NO: 105497 - protein, 8 aa, Dengue virus
NALDNLAV

SEQ ID NO: 105498 - protein, 8 aa, Dengue virus
ALDNIVML

SEQ ID NO: 105499 - protein, 8 aa, Dengue virus
LDNIVMLH

SEQ ID NO: 105500 - protein, 8 aa, Dengue virus
DNLVMLHT

SEQ ID NO: 105501 - protein, 8 aa, Dengue virus
NLVMLHTS

SEQ ID NO: 105502 - protein, 8 aa, Dengue virus
LVMLHTSE

SEQ ID NO: 105503 - protein, 8 aa, Dengue virus
AYRHAVEE

SEQ ID NO: 105504 - protein, 8 aa, Dengue virus
YRHAVEEL

SEQ ID NO: 105505 - protein, 8 aa, Dengue virus
RHAVEELP

SEQ ID NO: 105506 - protein, 8 aa, Dengue virus
HAVEELPE

SEQ ID NO: 105507 - protein, 8 aa, Dengue virus
AVEELPET

SEQ ID NO: 105508 - protein, 8 aa, Dengue virus
VEELPETM

SEQ ID NO: 105509 - protein, 8 aa, Dengue virus
EELPETME

SEQ ID NO: 105510 - protein, 8 aa, Dengue virus
ELPETMET

SEQ ID NO: 105511 - protein, 8 aa, Dengue virus
LPETMETL

SEQ ID NO: 105512 - protein, 8 aa, Dengue virus
PETMETLL

SEQ ID NO: 105513 - protein, 8 aa, Dengue virus
ETMETLLL

SEQ ID NO: 105514 - protein, 8 aa, Dengue virus
TMETLLLL

SEQ ID NO: 105515 - protein, 8 aa, Dengue virus
METLLLLG

SEQ ID NO: 105516 - protein, 8 aa, Dengue virus
ETLLLLGL

SEQ ID NO: 105517 - protein, 8 aa, Dengue virus
TLLLLGLM

SEQ ID NO: 105518 - protein, 8 aa, Dengue virus
LLLLGLMI

SEQ ID NO: 105519 - protein, 8 aa, Dengue virus
LMILLTGG

SEQ ID NO: 105520 - protein, 8 aa, Dengue virus
LTGGAMLF

SEQ ID NO: 105521 - protein, 8 aa, Dengue virus
TGGAMLFL

SEQ ID NO: 105522 - protein, 8 aa, Dengue virus
GAMLFLIS

SEQ ID NO: 105523 - protein, 8 aa, Dengue virus
GKTSIGLI

SEQ ID NO: 105524 - protein, 8 aa, Dengue virus
KTSIGLIC

SEQ ID NO: 105525 - protein, 8 aa, Dengue virus
TSIGLICV

SEQ ID NO: 105526 - protein, 8 aa, Dengue virus
IPLQWIAS

SEQ ID NO: 105527 - protein, 8 aa, Dengue virus
PLQWIASA

SEQ ID NO: 105528 - protein, 8 aa, Dengue virus
PQWIAASI

SEQ ID NO: 105529 - protein, 8 aa, Dengue virus
QWIAASII

SEQ ID NO: 105530 - protein, 8 aa, Dengue virus
IVLEFFMM

SEQ ID NO: 105531 - protein, 8 aa, Dengue virus
VLEFFMMV

SEQ ID NO: 105532 - protein, 8 aa, Dengue virus
LEFFMMVL

SEQ ID NO: 105533 - protein, 8 aa, Dengue virus
EFFMMVLL

SEQ ID NO: 105534 - protein, 8 aa, Dengue virus
FFMMVLLI

SEQ ID NO: 105535 - protein, 8 aa, Dengue virus
FMMVLLIP

SEQ ID NO: 105536 - protein, 8 aa, Dengue virus
MMVLLIPE

SEQ ID NO: 105537 - protein, 8 aa, Dengue virus
TPQDNQLI

SEQ ID NO: 105538 - protein, 8 aa, Dengue virus
PQDNQLIY

SEQ ID NO: 105539 - protein, 8 aa, Dengue virus
QDNQLIYV

SEQ ID NO: 105540 - protein, 8 aa, Dengue virus
DNQLIYVI

SEQ ID NO: 105541 - protein, 8 aa, Dengue virus
NQLIYVIL

SEQ ID NO: 105542 - protein, 8 aa, Dengue virus
QLIYVILT

SEQ ID NO: 105543 - protein, 8 aa, Dengue virus
LAYVVIGI

SEQ ID NO: 105544 - protein, 8 aa, Dengue virus
AYVVIGIL

SEQ ID NO: 105545 - protein, 8 aa, Dengue virus
YVVIGILT

SEQ ID NO: 105546 - protein, 8 aa, Dengue virus
IAANEMGL

SEQ ID NO: 105547 - protein, 8 aa, Dengue virus
AANEMGLI

SEQ ID NO: 105548 - protein, 8 aa, Dengue virus
ANEMGLIE

SEQ ID NO: 105549 - protein, 8 aa, Dengue virus
NEMGLIEK

SEQ ID NO: 105550 - protein, 8 aa, Dengue virus
EMGLIEKT

SEQ ID NO: 105551 - protein, 8 aa, Dengue virus
MGLIEKTK

SEQ ID NO: 105552 - protein, 8 aa, Dengue virus
GLLETTKR

SEQ ID NO: 105553 - protein, 8 aa, Dengue virus
LLETTKRD

SEQ ID NO: 105554 - protein, 8 aa, Dengue virus
LETTKRDL

SEQ ID NO: 105555 - protein, 8 aa, Dengue virus
ETTKRDLG

SEQ ID NO: 105556 - protein, 8 aa, Dengue virus
LDVDLRPA

SEQ ID NO: 105557 - protein, 8 aa, Dengue virus
DVDLRPAS

SEQ ID NO: 105558 - protein, 8 aa, Dengue virus
VDLRPASA

SEQ ID NO: 105559 - protein, 8 aa, Dengue virus
LYAVATTV

SEQ ID NO: 105560 - protein, 8 aa, Dengue virus
YAVATTFV

SEQ ID NO: 105561 - protein, 8 aa, Dengue virus
AVATTFVT

SEQ ID NO: 105562 - protein, 8 aa, Dengue virus
VATTFVTP

SEQ ID NO: 105563 - protein, 8 aa, Dengue virus
ATTFVTPM

SEQ ID NO: 105564 - protein, 8 aa, Dengue virus
ITPMLRHT

SEQ ID NO: 105565 - protein, 8 aa, Dengue virus
TPMLRHTI

SEQ ID NO: 105566 - protein, 8 aa, Dengue virus
PMLRHTIE

SEQ ID NO: 105567 - protein, 8 aa, Dengue virus
MLRHTIEN

SEQ ID NO: 105568 - protein, 8 aa, Dengue virus
LRHTIENS

SEQ ID NO: 105569 - protein, 8 aa, Dengue virus
RHTIENST

SEQ ID NO: 105570 - protein, 8 aa, Dengue virus
HTIENSTA

SEQ ID NO: 105571 - protein, 8 aa, Dengue virus
TIENSTAN

SEQ ID NO: 105572 - protein, 8 aa, Dengue virus
IENSTANV

SEQ ID NO: 105573 - protein, 8 aa, Dengue virus
ENSTANVS

SEQ ID NO: 105574 - protein, 8 aa, Dengue virus
NSTANVSL

SEQ ID NO: 105575 - protein, 8 aa, Dengue virus
STANVSLA

SEQ ID NO: 105576 - protein, 8 aa, Dengue virus
TANVSLAA

SEQ ID NO: 105577 - protein, 8 aa, Dengue virus
ANVSLAAI

SEQ ID NO: 105578 - protein, 8 aa, Dengue virus
NVSLAAIA

SEQ ID NO: 105579 - protein, 8 aa, Dengue virus
VSLAAIAN

SEQ ID NO: 105580 - protein, 8 aa, Dengue virus
AAIANQAV

SEQ ID NO: 105581 - protein, 8 aa, Dengue virus
AIANQAVV

SEQ ID NO: 105582 - protein, 8 aa, Dengue virus
IANQAVVL

SEQ ID NO: 105583 - protein, 8 aa, Dengue virus
ANQAVVLM

SEQ ID NO: 105584 - protein, 8 aa, Dengue virus
NQAVVLMG

SEQ ID NO: 105585 - protein, 8 aa, Dengue virus
QAVVLMGL

SEQ ID NO: 105586 - protein, 8 aa, Dengue virus
AVVLMGLD

SEQ ID NO: 105587 - protein, 8 aa, Dengue virus
VVLMGLDK

SEQ ID NO: 105588 - protein, 8 aa, Dengue virus
VLMGLDKG

SEQ ID NO: 105589 - protein, 8 aa, Dengue virus
LMGLGRGW

SEQ ID NO: 105590 - protein, 8 aa, Dengue virus
MGLGRGWP

SEQ ID NO: 105591 - protein, 8 aa, Dengue virus
GLGRGWPL

SEQ ID NO: 105592 - protein, 8 aa, Dengue virus
LGKGWPLH

SEQ ID NO: 105593 - protein, 8 aa, Dengue virus
GKGWPLHR

SEQ ID NO: 105594 - protein, 8 aa, Dengue virus
KGWPLHRM

SEQ ID NO: 105595 - protein, 8 aa, Dengue virus
GWPLHRMD

SEQ ID NO: 105596 - protein, 8 aa, Dengue virus
WPISKMDL

SEQ ID NO: 105597 - protein, 8 aa, Dengue virus
PISKMDLG

SEQ ID NO: 105598 - protein, 8 aa, Dengue virus
ISKMDLGV

SEQ ID NO: 105599 - protein, 8 aa, Dengue virus
HRMDLGVP

SEQ ID NO: 105600 - protein, 8 aa, Dengue virus
RMDLGVPL

SEQ ID NO: 105601 - protein, 8 aa, Dengue virus
LGVPLLAL

SEQ ID NO: 105602 - protein, 8 aa, Dengue virus
GVPLLAMG

SEQ ID NO: 105603 - protein, 8 aa, Dengue virus
VPLLAMGC

SEQ ID NO: 105604 - protein, 8 aa, Dengue virus
PLLAMGCY

SEQ ID NO: 105605 - protein, 8 aa, Dengue virus
LLAMGCYS

SEQ ID NO: 105606 - protein, 8 aa, Dengue virus
LAMGCYSQ

SEQ ID NO: 105607 - protein, 8 aa, Dengue virus
AMGCYSQV

SEQ ID NO: 105608 - protein, 8 aa, Dengue virus
MGCYSQVN

SEQ ID NO: 105609 - protein, 8 aa, Dengue virus
CYSQVNPT

SEQ ID NO: 105610 - protein, 8 aa, Dengue virus
YSQVNPTT

SEQ ID NO: 105611 - protein, 8 aa, Dengue virus
SQVNPTTL

SEQ ID NO: 105612 - protein, 8 aa, Dengue virus
QVNPTTLT

SEQ ID NO: 105613 - protein, 8 aa, Dengue virus
VNPTTLTA

SEQ ID NO: 105614 - protein, 8 aa, Dengue virus
NPTTLTAS

SEQ ID NO: 105615 - protein, 8 aa, Dengue virus
PTTLTASL

SEQ ID NO: 105616 - protein, 8 aa, Dengue virus
LVTHYAII

SEQ ID NO: 105617 - protein, 8 aa, Dengue virus
VTHYAIIG

SEQ ID NO: 105618 - protein, 8 aa, Dengue virus
VHYAIIGP

SEQ ID NO: 105619 - protein, 8 aa, Dengue virus
NPTVDGIM

SEQ ID NO: 105620 - protein, 8 aa, Dengue virus
PTVDGIMT

SEQ ID NO: 105621 - protein, 8 aa, Dengue virus
TVDGIMTI

SEQ ID NO: 105622 - protein, 8 aa, Dengue virus
DGIMTIDL

SEQ ID NO: 105623 - protein, 8 aa, Dengue virus
TVIDLEPI

SEQ ID NO: 105624 - protein, 8 aa, Dengue virus
VIDLDPIP

SEQ ID NO: 105625 - protein, 8 aa, Dengue virus
IDLDPIPY

SEQ ID NO: 105626 - protein, 8 aa, Dengue virus
DLDPIPYD

SEQ ID NO: 105627 - protein, 8 aa, Dengue virus
PVIYDSKF

SEQ ID NO: 105628 - protein, 8 aa, Dengue virus
VIYDSKFE

SEQ ID NO: 105629 - protein, 8 aa, Dengue virus
IYDSKFEK

SEQ ID NO: 105630 - protein, 8 aa, Dengue virus
YDSKFEKQ

SEQ ID NO: 105631 - protein, 8 aa, Dengue virus
DSKFEKQL

SEQ ID NO: 105632 - protein, 8 aa, Dengue virus
SKFEKQLG

SEQ ID NO: 105633 - protein, 8 aa, Dengue virus
LGQVMLLI

SEQ ID NO: 105634 - protein, 8 aa, Dengue virus
GQVMLLIL

SEQ ID NO: 105635 - protein, 8 aa, Dengue virus
QVMLLILC

SEQ ID NO: 105636 - protein, 8 aa, Dengue virus
VMLLILCV

SEQ ID NO: 105637 - protein, 8 aa, Dengue virus
LCAVQLLL

SEQ ID NO: 105638 - protein, 8 aa, Dengue virus
CAVQLLLM

SEQ ID NO: 105639 - protein, 8 aa, Dengue virus
AVQLLLMR

SEQ ID NO: 105640 - protein, 8 aa, Dengue virus
VQLLLMRT

SEQ ID NO: 105641 - protein, 8 aa, Dengue virus
QLLLMRTS

SEQ ID NO: 105642 - protein, 8 aa, Dengue virus
LLLMRTSW

SEQ ID NO: 105643 - protein, 8 aa, Dengue virus
LLMRTSWA

SEQ ID NO: 105644 - protein, 8 aa, Dengue virus
LMRTSWAL

SEQ ID NO: 105645 - protein, 8 aa, Dengue virus
MRTTWAFC

SEQ ID NO: 105646 - protein, 8 aa, Dengue virus
RTTWAFCE

SEQ ID NO: 105647 - protein, 8 aa, Dengue virus
TSWALCEA

SEQ ID NO: 105648 - protein, 8 aa, Dengue virus
SWALCEAL

SEQ ID NO: 105649 - protein, 8 aa, Dengue virus
WAFCEVLT

SEQ ID NO: 105650 - protein, 8 aa, Dengue virus
AFCEVLTL

SEQ ID NO: 105651 - protein, 8 aa, Dengue virus
FCEVLTLA

SEQ ID NO: 105652 - protein, 8 aa, Dengue virus
CEVLTLAT

SEQ ID NO: 105653 - protein, 8 aa, Dengue virus
EVLTLATG

SEQ ID NO: 105654 - protein, 8 aa, Dengue virus
VLTLATGP

SEQ ID NO: 105655 - protein, 8 aa, Dengue virus
LTLATGPV

SEQ ID NO: 105656 - protein, 8 aa, Dengue virus
TLATGPIT

SEQ ID NO: 105657 - protein, 8 aa, Dengue virus
LATGPITT

SEQ ID NO: 105658 - protein, 8 aa, Dengue virus
ATGPITTL

SEQ ID NO: 105659 - protein, 8 aa, Dengue virus
TGPITTLW

SEQ ID NO: 105660 - protein, 8 aa, Dengue virus
GPITTLWE

SEQ ID NO: 105661 - protein, 8 aa, Dengue virus
PITTLWEG

SEQ ID NO: 105662 - protein, 8 aa, Dengue virus
ITTLWEGS

SEQ ID NO: 105663 - protein, 8 aa, Dengue virus
LTLWEGNP

SEQ ID NO: 105664 - protein, 8 aa, Dengue virus
GAGLAFSI

SEQ ID NO: 105665 - protein, 8 aa, Dengue virus
AGLAFSIM

SEQ ID NO: 105666 - protein, 8 aa, Dengue virus
GLAFSIMK

SEQ ID NO: 105667 - protein, 8 aa, Dengue virus
LAFSIMKS

SEQ ID NO: 105668 - protein, 8 aa, Dengue virus
AFSIMKSV

SEQ ID NO: 105669 - protein, 8 aa, Dengue virus
TGETLGEK

SEQ ID NO: 105670 - protein, 8 aa, Dengue virus
TLGEKWKK

SEQ ID NO: 105671 - protein, 8 aa, Dengue virus
LGEKWKKK

SEQ ID NO: 105672 - protein, 8 aa, Dengue virus
GEKWKKKL

SEQ ID NO: 105673 - protein, 8 aa, Dengue virus
EKWKKKLN

SEQ ID NO: 105674 - protein, 8 aa, Dengue virus
SGITEVDR

SEQ ID NO: 105675 - protein, 8 aa, Dengue virus
EVDRTEAK

SEQ ID NO: 105676 - protein, 8 aa, Dengue virus
VDRTEAKE

SEQ ID NO: 105677 - protein, 8 aa, Dengue virus
DRTEAKEG

SEQ ID NO: 105678 - protein, 8 aa, Dengue virus
RTEAKEGL

SEQ ID NO: 105679 - protein, 8 aa, Dengue virus
EAKSALKD

SEQ ID NO: 105680 - protein, 8 aa, Dengue virus
AKSALKDG

SEQ ID NO: 105681 - protein, 8 aa, Dengue virus
KSALKDGS

SEQ ID NO: 105682 - protein, 8 aa, Dengue virus
EGLKRGEI

SEQ ID NO: 105683 - protein, 8 aa, Dengue virus
THHAVSRG

SEQ ID NO: 105684 - protein, 8 aa, Dengue virus
RHAVSRGT

SEQ ID NO: 105685 - protein, 8 aa, Dengue virus
HAVSRGSS

SEQ ID NO: 105686 - protein, 8 aa, Dengue virus
AVSRGSSK

SEQ ID NO: 105687 - protein, 8 aa, Dengue virus
VSRGSSKI

SEQ ID NO: 105688 - protein, 8 aa, Dengue virus
SRGSAKLQ

SEQ ID NO: 105689 - protein, 8 aa, Dengue virus
RGSAKLQW

SEQ ID NO: 105690 - protein, 8 aa, Dengue virus
GSAKLQWF

SEQ ID NO: 105691 - protein, 8 aa, Dengue virus
SAKLQWFV

SEQ ID NO: 105692 - protein, 8 aa, Dengue virus
SKIRWIVE

SEQ ID NO: 105693 - protein, 8 aa, Dengue virus
KIRWIVER

SEQ ID NO: 105694 - protein, 8 aa, Dengue virus
IRWIVERG

SEQ ID NO: 105695 - protein, 8 aa, Dengue virus
QWFVERNM

SEQ ID NO: 105696 - protein, 8 aa, Dengue virus
WIVERGMV

SEQ ID NO: 105697 - protein, 8 aa, Dengue virus
PEGRVIDL

SEQ ID NO: 105698 - protein, 8 aa, Dengue virus
EGRVIDLG

SEQ ID NO: 105699 - protein, 8 aa, Dengue virus
GRVIDLGC

SEQ ID NO: 105700 - protein, 8 aa, Dengue virus
RVIDLGCG

SEQ ID NO: 105701 - protein, 8 aa, Dengue virus
GGWSYYMA

SEQ ID NO: 105702 - protein, 8 aa, Dengue virus
GWSYYMAT

SEQ ID NO: 105703 - protein, 8 aa, Dengue virus
WSYYMATL

SEQ ID NO: 105704 - protein, 8 aa, Dengue virus
SYYMATLK

SEQ ID NO: 105705 - protein, 8 aa, Dengue virus
YYMATLKN

SEQ ID NO: 105706 - protein, 8 aa, Dengue virus
YMATLKNV

SEQ ID NO: 105707 - protein, 8 aa, Dengue virus
MATLKNVT

SEQ ID NO: 105708 - protein, 8 aa, Dengue virus
ATLKNVTE

SEQ ID NO: 105709 - protein, 8 aa, Dengue virus
TLKNVTEV

SEQ ID NO: 105710 - protein, 8 aa, Dengue virus
VTEVRGYT

SEQ ID NO: 105711 - protein, 8 aa, Dengue virus
TEVRGYTK

SEQ ID NO: 105712 - protein, 8 aa, Dengue virus
EVRGYTKG

SEQ ID NO: 105713 - protein, 8 aa, Dengue virus
VRGYTKGG

SEQ ID NO: 105714 - protein, 8 aa, Dengue virus
RGYTKGGP

SEQ ID NO: 105715 - protein, 8 aa, Dengue virus
HEEPVPMS

SEQ ID NO: 105716 - protein, 8 aa, Dengue virus
EEPVPMST

SEQ ID NO: 105717 - protein, 8 aa, Dengue virus
EPVPMSTY

SEQ ID NO: 105718 - protein, 8 aa, Dengue virus
PVPMSTYG

SEQ ID NO: 105719 - protein, 8 aa, Dengue virus
VPMSTYGW

SEQ ID NO: 105720 - protein, 8 aa, Dengue virus
MSTYGWNI

SEQ ID NO: 105721 - protein, 8 aa, Dengue virus
STYGWNIV

SEQ ID NO: 105722 - protein, 8 aa, Dengue virus
TYGWNIVK

SEQ ID NO: 105723 - protein, 8 aa, Dengue virus
YGWNIVKL

SEQ ID NO: 105724 - protein, 8 aa, Dengue virus
GWNIVKLM

SEQ ID NO: 105725 - protein, 8 aa, Dengue virus
WNIVKLMS

SEQ ID NO: 105726 - protein, 8 aa, Dengue virus
NIVKLMSG

SEQ ID NO: 105727 - protein, 8 aa, Dengue virus
LMSGKDVF

SEQ ID NO: 105728 - protein, 8 aa, Dengue virus
MSGKDVFY

SEQ ID NO: 105729 - protein, 8 aa, Dengue virus
PPERCDTL

SEQ ID NO: 105730 - protein, 8 aa, Dengue virus
PERCDTLL

SEQ ID NO: 105731 - protein, 8 aa, Dengue virus
ERCDTLLC

SEQ ID NO: 105732 - protein, 8 aa, Dengue virus
RCDTLLCD

SEQ ID NO: 105733 - protein, 8 aa, Dengue virus
DIGESSSN

SEQ ID NO: 105734 - protein, 8 aa, Dengue virus
IGESSSNP

SEQ ID NO: 105735 - protein, 8 aa, Dengue virus
GESSSNPT

SEQ ID NO: 105736 - protein, 8 aa, Dengue virus
ESSPNPTV

SEQ ID NO: 105737 - protein, 8 aa, Dengue virus
SSPNPTVE

SEQ ID NO: 105738 - protein, 8 aa, Dengue virus
SPNPTIEA

SEQ ID NO: 105739 - protein, 8 aa, Dengue virus
PNPTIEAG

SEQ ID NO: 105740 - protein, 8 aa, Dengue virus
NPTIEAGR

SEQ ID NO: 105741 - protein, 8 aa, Dengue virus
PTIEAGRT

SEQ ID NO: 105742 - protein, 8 aa, Dengue virus
TIEAGRTL

SEQ ID NO: 105743 - protein, 8 aa, Dengue virus
IEAGRTLR

SEQ ID NO: 105744 - protein, 8 aa, Dengue virus
EESRTIRV

SEQ ID NO: 105745 - protein, 8 aa, Dengue virus
ESRTIRVL

SEQ ID NO: 105746 - protein, 8 aa, Dengue virus
SRTIRVLK

SEQ ID NO: 105747 - protein, 8 aa, Dengue virus
RTIRVLKM

SEQ ID NO: 105748 - protein, 8 aa, Dengue virus
TIRVLKMV

SEQ ID NO: 105749 - protein, 8 aa, Dengue virus
IRVLKMVE

SEQ ID NO: 105750 - protein, 8 aa, Dengue virus
RVLSLVEN

SEQ ID NO: 105751 - protein, 8 aa, Dengue virus
VLSLVENW

SEQ ID NO: 105752 - protein, 8 aa, Dengue virus
LSLVENWL

SEQ ID NO: 105753 - protein, 8 aa, Dengue virus
KMVEPWLK

SEQ ID NO: 105754 - protein, 8 aa, Dengue virus
EFCIKVLN

SEQ ID NO: 105755 - protein, 8 aa, Dengue virus
FCVKVLNP

SEQ ID NO: 105756 - protein, 8 aa, Dengue virus
CVKVLNPY

SEQ ID NO: 105757 - protein, 8 aa, Dengue virus
VKVLNPYM

SEQ ID NO: 105758 - protein, 8 aa, Dengue virus
VLNPYMPT

SEQ ID NO: 105759 - protein, 8 aa, Dengue virus
LNPYMPAV

SEQ ID NO: 105760 - protein, 8 aa, Dengue virus
NPYMPTVI

SEQ ID NO: 105761 - protein, 8 aa, Dengue virus
PYMPTVIE

SEQ ID NO: 105762 - protein, 8 aa, Dengue virus
YGGMLVRN

SEQ ID NO: 105763 - protein, 8 aa, Dengue virus
GGNLVRCP

SEQ ID NO: 105764 - protein, 8 aa, Dengue virus
GNLVRCPL

SEQ ID NO: 105765 - protein, 8 aa, Dengue virus
NLVRCPLS

SEQ ID NO: 105766 - protein, 8 aa, Dengue virus
HEMYWISN

SEQ ID NO: 105767 - protein, 8 aa, Dengue virus
EMYWISNG

SEQ ID NO: 105768 - protein, 8 aa, Dengue virus
MYWVSNAT

SEQ ID NO: 105769 - protein, 8 aa, Dengue virus
YWVSNATG

SEQ ID NO: 105770 - protein, 8 aa, Dengue virus
WVSNATGN

SEQ ID NO: 105771 - protein, 8 aa, Dengue virus
VSNATGNI

SEQ ID NO: 105772 - protein, 8 aa, Dengue virus
SNATGNIV

SEQ ID NO: 105773 - protein, 8 aa, Dengue virus
ATGNIVSS

SEQ ID NO: 105774 - protein, 8 aa, Dengue virus
SGNIVSSV

SEQ ID NO: 105775 - protein, 8 aa, Dengue virus
GNIVASVN

SEQ ID NO: 105776 - protein, 8 aa, Dengue virus
NIVASVNM

SEQ ID NO: 105777 - protein, 8 aa, Dengue virus
IVASVNMV

SEQ ID NO: 105778 - protein, 8 aa, Dengue virus
VASVNMVS

SEQ ID NO: 105779 - protein, 8 aa, Dengue virus
ASVNMVSR

SEQ ID NO: 105780 - protein, 8 aa, Dengue virus
SVNMVSRL

SEQ ID NO: 105781 - protein, 8 aa, Dengue virus
VNMVSRLL

SEQ ID NO: 105782 - protein, 8 aa, Dengue virus
NMVSRLLL

SEQ ID NO: 105783 - protein, 8 aa, Dengue virus
MVSRLLLN

SEQ ID NO: 105784 - protein, 8 aa, Dengue virus
VSRLLLNR

SEQ ID NO: 105785 - protein, 8 aa, Dengue virus
SRLLLNRF

SEQ ID NO: 105786 - protein, 8 aa, Dengue virus
RLLLNRFT

SEQ ID NO: 105787 - protein, 8 aa, Dengue virus
LLLNRFTM

SEQ ID NO: 105788 - protein, 8 aa, Dengue virus
LINRFTMK

SEQ ID NO: 105789 - protein, 8 aa, Dengue virus
PTIEKDVD

SEQ ID NO: 105790 - protein, 8 aa, Dengue virus
TIEKDVDL

SEQ ID NO: 105791 - protein, 8 aa, Dengue virus
IEKDVDLG

SEQ ID NO: 105792 - protein, 8 aa, Dengue virus
EKDVDLGA

SEQ ID NO: 105793 - protein, 8 aa, Dengue virus
KDVDLGAG

SEQ ID NO: 105794 - protein, 8 aa, Dengue virus
DVDLGTGT

SEQ ID NO: 105795 - protein, 8 aa, Dengue virus
VDLGTGTR

SEQ ID NO: 105796 - protein, 8 aa, Dengue virus
DLGAGTRS

SEQ ID NO: 105797 - protein, 8 aa, Dengue virus
LGAGTRSV

SEQ ID NO: 105798 - protein, 8 aa, Dengue virus
GAGTRHVN

SEQ ID NO: 105799 - protein, 8 aa, Dengue virus
AGTRHVNA

SEQ ID NO: 105800 - protein, 8 aa, Dengue virus
GTRHVNAE

SEQ ID NO: 105801 - protein, 8 aa, Dengue virus
PNMDVIGE

SEQ ID NO: 105802 - protein, 8 aa, Dengue virus
NMDVIGER

SEQ ID NO: 105803 - protein, 8 aa, Dengue virus
MDVIGERI

SEQ ID NO: 105804 - protein, 8 aa, Dengue virus
DVIGERIK

SEQ ID NO: 105805 - protein, 8 aa, Dengue virus
VIGERIKR

SEQ ID NO: 105806 - protein, 8 aa, Dengue virus
IGERIKRI

SEQ ID NO: 105807 - protein, 8 aa, Dengue virus
GERIKRIK

SEQ ID NO: 105808 - protein, 8 aa, Dengue virus
STWHYDDE

SEQ ID NO: 105809 - protein, 8 aa, Dengue virus
TWHYDDEN

SEQ ID NO: 105810 - protein, 8 aa, Dengue virus
WHYDDENP

SEQ ID NO: 105811 - protein, 8 aa, Dengue virus
HYDDENPY

SEQ ID NO: 105812 - protein, 8 aa, Dengue virus
YDDENPYK

SEQ ID NO: 105813 - protein, 8 aa, Dengue virus
DDENPYKT

SEQ ID NO: 105814 - protein, 8 aa, Dengue virus
DENPYKTW

SEQ ID NO: 105815 - protein, 8 aa, Dengue virus
ENPYKTWA

SEQ ID NO: 105816 - protein, 8 aa, Dengue virus
NPYRTWAY

SEQ ID NO: 105817 - protein, 8 aa, Dengue virus
AYHGSYEA

SEQ ID NO: 105818 - protein, 8 aa, Dengue virus
YHGSYEAP

SEQ ID NO: 105819 - protein, 8 aa, Dengue virus
HGSYEVKA

SEQ ID NO: 105820 - protein, 8 aa, Dengue virus
GSYEVKAT

SEQ ID NO: 105821 - protein, 8 aa, Dengue virus
SYEVKATG

SEQ ID NO: 105822 - protein, 8 aa, Dengue virus
YEVKATGS

SEQ ID NO: 105823 - protein, 8 aa, Dengue virus
EVKATGSA

SEQ ID NO: 105824 - protein, 8 aa, Dengue virus
VKATGSAS

SEQ ID NO: 105825 - protein, 8 aa, Dengue virus
KATGSASS

SEQ ID NO: 105826 - protein, 8 aa, Dengue virus
ATGSASSM

SEQ ID NO: 105827 - protein, 8 aa, Dengue virus
TGSASSMI

SEQ ID NO: 105828 - protein, 8 aa, Dengue virus
SMINGVVK

SEQ ID NO: 105829 - protein, 8 aa, Dengue virus
MINGVVKL

SEQ ID NO: 105830 - protein, 8 aa, Dengue virus
INGVVKLL

SEQ ID NO: 105831 - protein, 8 aa, Dengue virus
LTKPWDVL

SEQ ID NO: 105832 - protein, 8 aa, Dengue virus
TKPWDVLP

SEQ ID NO: 105833 - protein, 8 aa, Dengue virus
KPWDVLPT

SEQ ID NO: 105834 - protein, 8 aa, Dengue virus
PWDVLPTV

SEQ ID NO: 105835 - protein, 8 aa, Dengue virus
WDVLPTVT

SEQ ID NO: 105836 - protein, 8 aa, Dengue virus
DVLPTVTQ

SEQ ID NO: 105837 - protein, 8 aa, Dengue virus
PTVTQMAM

SEQ ID NO: 105838 - protein, 8 aa, Dengue virus
TVTQMAMT

SEQ ID NO: 105839 - protein, 8 aa, Dengue virus
VTQLAMTD

SEQ ID NO: 105840 - protein, 8 aa, Dengue virus
TQLAMTDT

SEQ ID NO: 105841 - protein, 8 aa, Dengue virus
QLAMTDTT

SEQ ID NO: 105842 - protein, 8 aa, Dengue virus
LAMTDTTP

SEQ ID NO: 105843 - protein, 8 aa, Dengue virus
KVDTRTPR

SEQ ID NO: 105844 - protein, 8 aa, Dengue virus
PRLCTREE

SEQ ID NO: 105845 - protein, 8 aa, Dengue virus
RLCTREEF

SEQ ID NO: 105846 - protein, 8 aa, Dengue virus
CTREEFIS

SEQ ID NO: 105847 - protein, 8 aa, Dengue virus
TREEFISK

SEQ ID NO: 105848 - protein, 8 aa, Dengue virus
REEFISKV

SEQ ID NO: 105849 - protein, 8 aa, Dengue virus
EEFISKVR

SEQ ID NO: 105850 - protein, 8 aa, Dengue virus
SKVRSNAA

SEQ ID NO: 105851 - protein, 8 aa, Dengue virus
KVRTNAAM

SEQ ID NO: 105852 - protein, 8 aa, Dengue virus
VRTNAAMG

SEQ ID NO: 105853 - protein, 8 aa, Dengue virus
RTNAAMGA

SEQ ID NO: 105854 - protein, 8 aa, Dengue virus
TNAAMGAV

SEQ ID NO: 105855 - protein, 8 aa, Dengue virus
NAAMGAVF

SEQ ID NO: 105856 - protein, 8 aa, Dengue virus
AAMGAVFT

SEQ ID NO: 105857 - protein, 8 aa, Dengue virus
AMGAVFTE

SEQ ID NO: 105858 - protein, 8 aa, Dengue virus
MGAVFTEE

SEQ ID NO: 105859 - protein, 8 aa, Dengue virus
GAVFTEEN

SEQ ID NO: 105860 - protein, 8 aa, Dengue virus
AVFTEENQ

SEQ ID NO: 105861 - protein, 8 aa, Dengue virus
VFTEENQW

SEQ ID NO: 105862 - protein, 8 aa, Dengue virus
FTEENQWD

SEQ ID NO: 105863 - protein, 8 aa, Dengue virus
TEENQWDS

SEQ ID NO: 105864 - protein, 8 aa, Dengue virus
EENQWDSA

SEQ ID NO: 105865 - protein, 8 aa, Dengue virus
ENQWDSAK

SEQ ID NO: 105866 - protein, 8 aa, Dengue virus
NQWDSAKA

SEQ ID NO: 105867 - protein, 8 aa, Dengue virus
QWDSAKAA

SEQ ID NO: 105868 - protein, 8 aa, Dengue virus
WDSAKAAV

SEQ ID NO: 105869 - protein, 8 aa, Dengue virus
DSAKAAVE

SEQ ID NO: 105870 - protein, 8 aa, Dengue virus
SAKAAVED

SEQ ID NO: 105871 - protein, 8 aa, Dengue virus
ERELHKLG

SEQ ID NO: 105872 - protein, 8 aa, Dengue virus
RELHKLGK

SEQ ID NO: 105873 - protein, 8 aa, Dengue virus
ELHKLGKC

SEQ ID NO: 105874 - protein, 8 aa, Dengue virus
LHKLGKCG

SEQ ID NO: 105875 - protein, 8 aa, Dengue virus
HKLGKCGS

SEQ ID NO: 105876 - protein, 8 aa, Dengue virus
KLGKCGSC

SEQ ID NO: 105877 - protein, 8 aa, Dengue virus
LGKCGSCV

SEQ ID NO: 105878 - protein, 8 aa, Dengue virus
GKCGSCVY

SEQ ID NO: 105879 - protein, 8 aa, Dengue virus
KCGSCVYN

SEQ ID NO: 105880 - protein, 8 aa, Dengue virus
CGSCVYNM

SEQ ID NO: 105881 - protein, 8 aa, Dengue virus
GSCVYNMM

SEQ ID NO: 105882 - protein, 8 aa, Dengue virus
LNEDHWFG

SEQ ID NO: 105883 - protein, 8 aa, Dengue virus
EDHWFGRE

SEQ ID NO: 105884 - protein, 8 aa, Dengue virus
DHWFGREN

SEQ ID NO: 105885 - protein, 8 aa, Dengue virus
HWFGRENS

SEQ ID NO: 105886 - protein, 8 aa, Dengue virus
WFSRGNSL

SEQ ID NO: 105887 - protein, 8 aa, Dengue virus
FSRGNSLS

SEQ ID NO: 105888 - protein, 8 aa, Dengue virus
SRGNSLSG

SEQ ID NO: 105889 - protein, 8 aa, Dengue virus
RGNSLSGV

SEQ ID NO: 105890 - protein, 8 aa, Dengue virus
GNSLSGVE

SEQ ID NO: 105891 - protein, 8 aa, Dengue virus
NSWSGVEG

SEQ ID NO: 105892 - protein, 8 aa, Dengue virus
SWSGVEGE

SEQ ID NO: 105893 - protein, 8 aa, Dengue virus
WSGVEGEG

SEQ ID NO: 105894 - protein, 8 aa, Dengue virus
HRLGYILE

SEQ ID NO: 105895 - protein, 8 aa, Dengue virus
RLGYILEE

SEQ ID NO: 105896 - protein, 8 aa, Dengue virus
LGYILEEI

SEQ ID NO: 105897 - protein, 8 aa, Dengue virus
GDLMYADD

SEQ ID NO: 105898 - protein, 8 aa, Dengue virus
DLMYADDT

SEQ ID NO: 105899 - protein, 8 aa, Dengue virus
LMYADDTA

SEQ ID NO: 105900 - protein, 8 aa, Dengue virus
GWDTRITI

SEQ ID NO: 105901 - protein, 8 aa, Dengue virus
WDTRITIE

SEQ ID NO: 105902 - protein, 8 aa, Dengue virus
DTRITIED

SEQ ID NO: 105903 - protein, 8 aa, Dengue virus
TRITIEDL

SEQ ID NO: 105904 - protein, 8 aa, Dengue virus
QNKVVKVL

SEQ ID NO: 105905 - protein, 8 aa, Dengue virus
NKVVKVLR

SEQ ID NO: 105906 - protein, 8 aa, Dengue virus
KVVKVLRP

SEQ ID NO: 105907 - protein, 8 aa, Dengue virus
VVKVQRPT

SEQ ID NO: 105908 - protein, 8 aa, Dengue virus
VKVQRPTP

SEQ ID NO: 105909 - protein, 8 aa, Dengue virus
GAVMDIIS

SEQ ID NO: 105910 - protein, 8 aa, Dengue virus
AVMDIISR

SEQ ID NO: 105911 - protein, 8 aa, Dengue virus
VMDIISRR

SEQ ID NO: 105912 - protein, 8 aa, Dengue virus
MDIISRRD

SEQ ID NO: 105913 - protein, 8 aa, Dengue virus
DIISRRDQ

SEQ ID NO: 105914 - protein, 8 aa, Dengue virus
IISRRDQR

SEQ ID NO: 105915 - protein, 8 aa, Dengue virus
TNMEAQLV

SEQ ID NO: 105916 - protein, 8 aa, Dengue virus
NMEAQLVR

SEQ ID NO: 105917 - protein, 8 aa, Dengue virus
MEAQLVRQ

SEQ ID NO: 105918 - protein, 8 aa, Dengue virus
EAQLVRQM

SEQ ID NO: 105919 - protein, 8 aa, Dengue virus
AQLVRQME

SEQ ID NO: 105920 - protein, 8 aa, Dengue virus
QLVRQMEG

SEQ ID NO: 105921 - protein, 8 aa, Dengue virus
LVRQMEGE

SEQ ID NO: 105922 - protein, 8 aa, Dengue virus
VRQMEGEG

SEQ ID NO: 105923 - protein, 8 aa, Dengue virus
RQMEGEGI

SEQ ID NO: 105924 - protein, 8 aa, Dengue virus
DRLKRMAI

SEQ ID NO: 105925 - protein, 8 aa, Dengue virus
RLRRMAIS

SEQ ID NO: 105926 - protein, 8 aa, Dengue virus
LRRMAISG

SEQ ID NO: 105927 - protein, 8 aa, Dengue virus
RRMAISGD

SEQ ID NO: 105928 - protein, 8 aa, Dengue virus
DDCVVKPT

SEQ ID NO: 105929 - protein, 8 aa, Dengue virus
DCVVKPTD

SEQ ID NO: 105930 - protein, 8 aa, Dengue virus
CVVKPLDE

SEQ ID NO: 105931 - protein, 8 aa, Dengue virus
VVKPLDER

SEQ ID NO: 105932 - protein, 8 aa, Dengue virus
VKPLDERF

SEQ ID NO: 105933 - protein, 8 aa, Dengue virus
SLLFLNDM

SEQ ID NO: 105934 - protein, 8 aa, Dengue virus
LLFLNDMG

SEQ ID NO: 105935 - protein, 8 aa, Dengue virus
LFLNDMGK

SEQ ID NO: 105936 - protein, 8 aa, Dengue virus
FLNDMGKV

SEQ ID NO: 105937 - protein, 8 aa, Dengue virus
GKIRKDIQ

SEQ ID NO: 105938 - protein, 8 aa, Dengue virus
KIRKDIQQ

SEQ ID NO: 105939 - protein, 8 aa, Dengue virus
IRKDIQQW

SEQ ID NO: 105940 - protein, 8 aa, Dengue virus
RKDIPQWQ

SEQ ID NO: 105941 - protein, 8 aa, Dengue virus
KDIPQWQP

SEQ ID NO: 105942 - protein, 8 aa, Dengue virus
DIPQWQPS

SEQ ID NO: 105943 - protein, 8 aa, Dengue virus
IPQWQPSK

SEQ ID NO: 105944 - protein, 8 aa, Dengue virus
PQWQPSKG

SEQ ID NO: 105945 - protein, 8 aa, Dengue virus
QWQPSKGW

SEQ ID NO: 105946 - protein, 8 aa, Dengue virus
WQPSKGWH

SEQ ID NO: 105947 - protein, 8 aa, Dengue virus
QPSKGWHD

SEQ ID NO: 105948 - protein, 8 aa, Dengue virus
PSKGWHDW

SEQ ID NO: 105949 - protein, 8 aa, Dengue virus
GWHDWQQV

SEQ ID NO: 105950 - protein, 8 aa, Dengue virus
WHDWQQVP

SEQ ID NO: 105951 - protein, 8 aa, Dengue virus
HDWQQVPF

SEQ ID NO: 105952 - protein, 8 aa, Dengue virus
NWQEVPFC

SEQ ID NO: 105953 - protein, 8 aa, Dengue virus
WQEVPFCS

SEQ ID NO: 105954 - protein, 8 aa, Dengue virus
QEVPFCSH

SEQ ID NO: 105955 - protein, 8 aa, Dengue virus
FCSHHFHK

SEQ ID NO: 105956 - protein, 8 aa, Dengue virus
CSHHFHKI

SEQ ID NO: 105957 - protein, 8 aa, Dengue virus
SHHFHELV

SEQ ID NO: 105958 - protein, 8 aa, Dengue virus
HHFHELVM

SEQ ID NO: 105959 - protein, 8 aa, Dengue virus
HFHELVMK

SEQ ID NO: 105960 - protein, 8 aa, Dengue virus
FHELVMKD

SEQ ID NO: 105961 - protein, 8 aa, Dengue virus
HELVMKDG

SEQ ID NO: 105962 - protein, 8 aa, Dengue virus
ELVMKDGR

SEQ ID NO: 105963 - protein, 8 aa, Dengue virus
LVVPCRPQ

SEQ ID NO: 105964 - protein, 8 aa, Dengue virus
CRPQDELI

SEQ ID NO: 105965 - protein, 8 aa, Dengue virus
RPQDELIG

SEQ ID NO: 105966 - protein, 8 aa, Dengue virus
PQDELIGR

SEQ ID NO: 105967 - protein, 8 aa, Dengue virus
KSYAQMWS

SEQ ID NO: 105968 - protein, 8 aa, Dengue virus
SYAQMWSL

SEQ ID NO: 105969 - protein, 8 aa, Dengue virus
YAQMWTLM

SEQ ID NO: 105970 - protein, 8 aa, Dengue virus
AQMWTLMY

SEQ ID NO: 105971 - protein, 8 aa, Dengue virus
QMWTLMYF

SEQ ID NO: 105972 - protein, 8 aa, Dengue virus
MWTLMYFH

SEQ ID NO: 105973 - protein, 8 aa, Dengue virus
WTLMYFHR

SEQ ID NO: 105974 - protein, 8 aa, Dengue virus
TLMYFHRR

SEQ ID NO: 105975 - protein, 8 aa, Dengue virus
RDLRLASM

SEQ ID NO: 105976 - protein, 8 aa, Dengue virus
DLRLASMA

SEQ ID NO: 105977 - protein, 8 aa, Dengue virus
LRLASMAI

SEQ ID NO: 105978 - protein, 8 aa, Dengue virus
RLASMAIC

SEQ ID NO: 105979 - protein, 8 aa, Dengue virus
LASMAICS

SEQ ID NO: 105980 - protein, 8 aa, Dengue virus
ASMAICSA

SEQ ID NO: 105981 - protein, 8 aa, Dengue virus
SMAICSAV

SEQ ID NO: 105982 - protein, 8 aa, Dengue virus
AICSAVPT

SEQ ID NO: 105983 - protein, 8 aa, Dengue virus
DWIPTSRT

SEQ ID NO: 105984 - protein, 8 aa, Dengue virus
WFPTSRTT

SEQ ID NO: 105985 - protein, 8 aa, Dengue virus
FPTSRTTW

SEQ ID NO: 105986 - protein, 8 aa, Dengue virus
TTWSIHAT

SEQ ID NO: 105987 - protein, 8 aa, Dengue virus
TWSIHATH

SEQ ID NO: 105988 - protein, 8 aa, Dengue virus
WSIHATHE

SEQ ID NO: 105989 - protein, 8 aa, Dengue virus
SIHATHEW

SEQ ID NO: 105990 - protein, 8 aa, Dengue virus
IHATHEWM

SEQ ID NO: 105991 - protein, 8 aa, Dengue virus
HATHEWMT

SEQ ID NO: 105992 - protein, 8 aa, Dengue virus
ATHEWMTT

SEQ ID NO: 105993 - protein, 8 aa, Dengue virus
THEWMTTE

SEQ ID NO: 105994 - protein, 8 aa, Dengue virus
MTTEDMLA

SEQ ID NO: 105995 - protein, 8 aa, Dengue virus
TTEDMLAV

SEQ ID NO: 105996 - protein, 8 aa, Dengue virus
TEDMLAVW

SEQ ID NO: 105997 - protein, 8 aa, Dengue virus
EDMLAVWN

SEQ ID NO: 105998 - protein, 8 aa, Dengue virus
DMLAVWNR

SEQ ID NO: 105999 - protein, 8 aa, Dengue virus
MLAVWNRV

SEQ ID NO: 106000 - protein, 8 aa, Dengue virus
LAVWNRVW

SEQ ID NO: 106001 - protein, 8 aa, Dengue virus
AVWNRVWI

SEQ ID NO: 106002 - protein, 8 aa, Dengue virus
VWNRVWIR

SEQ ID NO: 106003 - protein, 8 aa, Dengue virus
DNPNMIDK

SEQ ID NO: 106004 - protein, 8 aa, Dengue virus
NPNMTDKT

SEQ ID NO: 106005 - protein, 8 aa, Dengue virus
EIPYLGKR

SEQ ID NO: 106006 - protein, 8 aa, Dengue virus
GSLIGLSS

SEQ ID NO: 106007 - protein, 8 aa, Dengue virus
SLIGLSSR

SEQ ID NO: 106008 - protein, 8 aa, Dengue virus
LIGLSSRA

SEQ ID NO: 106009 - protein, 8 aa, Dengue virus
IGLSSRAT

SEQ ID NO: 106010 - protein, 8 aa, Dengue virus
GLSSRATW

SEQ ID NO: 106011 - protein, 8 aa, Dengue virus
LSSRATWA

SEQ ID NO: 106012 - protein, 8 aa, Dengue virus
TSRATWAQ

SEQ ID NO: 106013 - protein, 8 aa, Dengue virus
SRATWAQN

SEQ ID NO: 106014 - protein, 8 aa, Dengue virus
RATWAQNI

SEQ ID NO: 106015 - protein, 8 aa, Dengue virus
AIQQVRSL

SEQ ID NO: 106016 - protein, 8 aa, Dengue virus
DYMPVMKR

SEQ ID NO: 106017 - protein, 8 aa, Dengue virus
YMPVMKRY

SEQ ID NO: 106018 - protein, 8 aa, Dengue virus
MPVMKRYS

SEQ ID NO: 106019 - protein, 8 aa, Dengue virus
PPFNMLKR

SEQ ID NO: 106020 - protein, 8 aa, Dengue virus
RNRVSTPQ

SEQ ID NO: 106021 - protein, 8 aa, Dengue virus
NRVSTPQG

SEQ ID NO: 106022 - protein, 8 aa, Dengue virus
RVSTPQGL

SEQ ID NO: 106023 - protein, 8 aa, Dengue virus
VSTPQGLV

SEQ ID NO: 106024 - protein, 8 aa, Dengue virus
STPQGLVK

SEQ ID NO: 106025 - protein, 8 aa, Dengue virus
TPQGLVKR

SEQ ID NO: 106026 - protein, 8 aa, Dengue virus
PQGLVKRF

SEQ ID NO: 106027 - protein, 8 aa, Dengue virus
GLVKRFST

SEQ ID NO: 106028 - protein, 8 aa, Dengue virus
LVKRFSTG

SEQ ID NO: 106029 - protein, 8 aa, Dengue virus
VKRFSTGL

SEQ ID NO: 106030 - protein, 8 aa, Dengue virus
KRFSTGLF

SEQ ID NO: 106031 - protein, 8 aa, Dengue virus
RFSRGLLN

SEQ ID NO: 106032 - protein, 8 aa, Dengue virus
FSRGLLNG

SEQ ID NO: 106033 - protein, 8 aa, Dengue virus
SRGLLNGQ

SEQ ID NO: 106034 - protein, 8 aa, Dengue virus
RGLLNGQG

SEQ ID NO: 106035 - protein, 8 aa, Dengue virus
GLFSGKGP

SEQ ID NO: 106036 - protein, 8 aa, Dengue virus
LFSGKGPL

SEQ ID NO: 106037 - protein, 8 aa, Dengue virus
FSGKGPLR

SEQ ID NO: 106038 - protein, 8 aa, Dengue virus
GQGPMKMV

SEQ ID NO: 106039 - protein, 8 aa, Dengue virus
QGPMKMVM

SEQ ID NO: 106040 - protein, 8 aa, Dengue virus
GPMKMVMA

SEQ ID NO: 106041 - protein, 8 aa, Dengue virus
PMKMVMAF

SEQ ID NO: 106042 - protein, 8 aa, Dengue virus
KMVMAFIA

SEQ ID NO: 106043 - protein, 8 aa, Dengue virus
MVMAFIAF

SEQ ID NO: 106044 - protein, 8 aa, Dengue virus
SIPPTAGI

SEQ ID NO: 106045 - protein, 8 aa, Dengue virus
AGILARWS

SEQ ID NO: 106046 - protein, 8 aa, Dengue virus
GFKKEVSN

SEQ ID NO: 106047 - protein, 8 aa, Dengue virus
FKKEVSNM

SEQ ID NO: 106048 - protein, 8 aa, Dengue virus
KKEVSNML

SEQ ID NO: 106049 - protein, 8 aa, Dengue virus
AFHLSTRD

SEQ ID NO: 106050 - protein, 8 aa, Dengue virus
FHLSTRDG

SEQ ID NO: 106051 - protein, 8 aa, Dengue virus
HLSTRDGE

SEQ ID NO: 106052 - protein, 8 aa, Dengue virus
LSTRDGEP

SEQ ID NO: 106053 - protein, 8 aa, Dengue virus
STRDGEPL

SEQ ID NO: 106054 - protein, 8 aa, Dengue virus
TRDGEPLM

SEQ ID NO: 106055 - protein, 8 aa, Dengue virus
RDGEPLMI

SEQ ID NO: 106056 - protein, 8 aa, Dengue virus
DGEPLMIV

SEQ ID NO: 106057 - protein, 8 aa, Dengue virus
HERGRPLL

SEQ ID NO: 106058 - protein, 8 aa, Dengue virus
RPLLFKTT

SEQ ID NO: 106059 - protein, 8 aa, Dengue virus
NKCTLIAM

SEQ ID NO: 106060 - protein, 8 aa, Dengue virus
KCTLIAMD

SEQ ID NO: 106061 - protein, 8 aa, Dengue virus
MAMDLGEL

SEQ ID NO: 106062 - protein, 8 aa, Dengue virus
AMDLGEFC

SEQ ID NO: 106063 - protein, 8 aa, Dengue virus
MDLGEFCE

SEQ ID NO: 106064 - protein, 8 aa, Dengue virus
DLGEMCED

SEQ ID NO: 106065 - protein, 8 aa, Dengue virus
LGEMCEDT

SEQ ID NO: 106066 - protein, 8 aa, Dengue virus
DTITYNCP

SEQ ID NO: 106067 - protein, 8 aa, Dengue virus
DVDCWCNT

SEQ ID NO: 106068 - protein, 8 aa, Dengue virus
VDCWCNTT

SEQ ID NO: 106069 - protein, 8 aa, Dengue virus
DCWCNATE

SEQ ID NO: 106070 - protein, 8 aa, Dengue virus
CWCNATET

SEQ ID NO: 106071 - protein, 8 aa, Dengue virus
WCNATETW

SEQ ID NO: 106072 - protein, 8 aa, Dengue virus
TETWVTYG

SEQ ID NO: 106073 - protein, 8 aa, Dengue virus
ETWVTYGT

SEQ ID NO: 106074 - protein, 8 aa, Dengue virus
WVMYGTCT

SEQ ID NO: 106075 - protein, 8 aa, Dengue virus
GERRRDKR

SEQ ID NO: 106076 - protein, 8 aa, Dengue virus
ERRRDKRS

SEQ ID NO: 106077 - protein, 8 aa, Dengue virus
RRRDKRSV

SEQ ID NO: 106078 - protein, 8 aa, Dengue virus
EKRSVALA

SEQ ID NO: 106079 - protein, 8 aa, Dengue virus
ALTPHSGM

SEQ ID NO: 106080 - protein, 8 aa, Dengue virus
LTPHSGMG

SEQ ID NO: 106081 - protein, 8 aa, Dengue virus
TPHSGMGL

SEQ ID NO: 106082 - protein, 8 aa, Dengue virus
PHSGMGLE

SEQ ID NO: 106083 - protein, 8 aa, Dengue virus
HSGMGLET

SEQ ID NO: 106084 - protein, 8 aa, Dengue virus
SGMGLETR

SEQ ID NO: 106085 - protein, 8 aa, Dengue virus
GLDTRAQT

SEQ ID NO: 106086 - protein, 8 aa, Dengue virus
LDTRAQTW

SEQ ID NO: 106087 - protein, 8 aa, Dengue virus
DTRAQTWM

SEQ ID NO: 106088 - protein, 8 aa, Dengue virus
TRAQTWMS

SEQ ID NO: 106089 - protein, 8 aa, Dengue virus
RAQTWMSA

SEQ ID NO: 106090 - protein, 8 aa, Dengue virus
AQTWMSAE

SEQ ID NO: 106091 - protein, 8 aa, Dengue virus
SSEGAWRQ

SEQ ID NO: 106092 - protein, 8 aa, Dengue virus
SEGAWKHV

SEQ ID NO: 106093 - protein, 8 aa, Dengue virus
EGAWKHVQ

SEQ ID NO: 106094 - protein, 8 aa, Dengue virus
VETWAFRH

SEQ ID NO: 106095 - protein, 8 aa, Dengue virus
ETWAFRHP

SEQ ID NO: 106096 - protein, 8 aa, Dengue virus
TWAFRHPG

SEQ ID NO: 106097 - protein, 8 aa, Dengue virus
WAFRHPGF

SEQ ID NO: 106098 - protein, 8 aa, Dengue virus
AFRHPGFT

SEQ ID NO: 106099 - protein, 8 aa, Dengue virus
VAPSYGMR

SEQ ID NO: 106100 - protein, 8 aa, Dengue virus
APSYGMRC

SEQ ID NO: 106101 - protein, 8 aa, Dengue virus
PSYGMRCV

SEQ ID NO: 106102 - protein, 8 aa, Dengue virus
SYGMRCVG

SEQ ID NO: 106103 - protein, 8 aa, Dengue virus
MRCVGIGN

SEQ ID NO: 106104 - protein, 8 aa, Dengue virus
RCVGIGNR

SEQ ID NO: 106105 - protein, 8 aa, Dengue virus
CVGIGNRD

SEQ ID NO: 106106 - protein, 8 aa, Dengue virus
VGIGNRDF

SEQ ID NO: 106107 - protein, 8 aa, Dengue virus
GIGNRDFV

SEQ ID NO: 106108 - protein, 8 aa, Dengue virus
IGNRDFVE

SEQ ID NO: 106109 - protein, 8 aa, Dengue virus
DLVLEHGG

SEQ ID NO: 106110 - protein, 8 aa, Dengue virus
LVLEHGGC

SEQ ID NO: 106111 - protein, 8 aa, Dengue virus
CVTTMAKS

SEQ ID NO: 106112 - protein, 8 aa, Dengue virus
VTTMAKSK

SEQ ID NO: 106113 - protein, 8 aa, Dengue virus
TTMAKSKP

SEQ ID NO: 106114 - protein, 8 aa, Dengue virus
TMAKSKPT

SEQ ID NO: 106115 - protein, 8 aa, Dengue virus
MAKSKPTL

SEQ ID NO: 106116 - protein, 8 aa, Dengue virus
AKSKPTLD

SEQ ID NO: 106117 - protein, 8 aa, Dengue virus
QGKPTLDF

SEQ ID NO: 106118 - protein, 8 aa, Dengue virus
GKPTLDFE

SEQ ID NO: 106119 - protein, 8 aa, Dengue virus
PTLDFELT

SEQ ID NO: 106120 - protein, 8 aa, Dengue virus
TLDFELTK

SEQ ID NO: 106121 - protein, 8 aa, Dengue virus
LDFELTKT

SEQ ID NO: 106122 - protein, 8 aa, Dengue virus
DFELTKTT

SEQ ID NO: 106123 - protein, 8 aa, Dengue virus
FELTKTTA

SEQ ID NO: 106124 - protein, 8 aa, Dengue virus
ELTKTTAK

SEQ ID NO: 106125 - protein, 8 aa, Dengue virus
LRTYCIEA

SEQ ID NO: 106126 - protein, 8 aa, Dengue virus
CIEASISN

SEQ ID NO: 106127 - protein, 8 aa, Dengue virus
TTASRCPT

SEQ ID NO: 106128 - protein, 8 aa, Dengue virus
TASRCPTQ

SEQ ID NO: 106129 - protein, 8 aa, Dengue virus
ASRCPTQG

SEQ ID NO: 106130 - protein, 8 aa, Dengue virus
CRRDVVDR

SEQ ID NO: 106131 - protein, 8 aa, Dengue virus
RRDVVDRG

SEQ ID NO: 106132 - protein, 8 aa, Dengue virus
RDVVDRGW

SEQ ID NO: 106133 - protein, 8 aa, Dengue virus
DVVDRGWG

SEQ ID NO: 106134 - protein, 8 aa, Dengue virus
VVDRGWGN

SEQ ID NO: 106135 - protein, 8 aa, Dengue virus
LFGKGSLL

SEQ ID NO: 106136 - protein, 8 aa, Dengue virus
FGKGSLLT

SEQ ID NO: 106137 - protein, 8 aa, Dengue virus
GKGSLLTC

SEQ ID NO: 106138 - protein, 8 aa, Dengue virus
KGSLLTCA

SEQ ID NO: 106139 - protein, 8 aa, Dengue virus
GSLLTCAK

SEQ ID NO: 106140 - protein, 8 aa, Dengue virus
SLLTCAKF

SEQ ID NO: 106141 - protein, 8 aa, Dengue virus
VQHENLKY

SEQ ID NO: 106142 - protein, 8 aa, Dengue virus
ENLEYTVV

SEQ ID NO: 106143 - protein, 8 aa, Dengue virus
VVTPHSGE

SEQ ID NO: 106144 - protein, 8 aa, Dengue virus
VTPHSGEE

SEQ ID NO: 106145 - protein, 8 aa, Dengue virus
TPHSGEEN

SEQ ID NO: 106146 - protein, 8 aa, Dengue virus
PHSGEENA

SEQ ID NO: 106147 - protein, 8 aa, Dengue virus
HSGEENAV

SEQ ID NO: 106148 - protein, 8 aa, Dengue virus
SGEENAVG

SEQ ID NO: 106149 - protein, 8 aa, Dengue virus
GEENAVGN

SEQ ID NO: 106150 - protein, 8 aa, Dengue virus
DTHAVGND

SEQ ID NO: 106151 - protein, 8 aa, Dengue virus
LTLDCEPR

SEQ ID NO: 106152 - protein, 8 aa, Dengue virus
TLDCEPRS

SEQ ID NO: 106153 - protein, 8 aa, Dengue virus
LDCEPRSG

SEQ ID NO: 106154 - protein, 8 aa, Dengue virus
FNEMILMK

SEQ ID NO: 106155 - protein, 8 aa, Dengue virus
NEMILMKM

SEQ ID NO: 106156 - protein, 8 aa, Dengue virus
EMILMKMK

SEQ ID NO: 106157 - protein, 8 aa, Dengue virus
KTWLVHKQ

SEQ ID NO: 106158 - protein, 8 aa, Dengue virus
TWLVHKQW

SEQ ID NO: 106159 - protein, 8 aa, Dengue virus
FDLPLPWA

SEQ ID NO: 106160 - protein, 8 aa, Dengue virus
DLPLPWAS

SEQ ID NO: 106161 - protein, 8 aa, Dengue virus
LPLPWASG

SEQ ID NO: 106162 - protein, 8 aa, Dengue virus
PLPWASGA

SEQ ID NO: 106163 - protein, 8 aa, Dengue virus
KDLLVTFK

SEQ ID NO: 106164 - protein, 8 aa, Dengue virus
ERMVTFKV

SEQ ID NO: 106165 - protein, 8 aa, Dengue virus
RMVTFKVP

SEQ ID NO: 106166 - protein, 8 aa, Dengue virus
MVTFKVPH

SEQ ID NO: 106167 - protein, 8 aa, Dengue virus
VTFKVPHA

SEQ ID NO: 106168 - protein, 8 aa, Dengue virus
TFKVPHAK

SEQ ID NO: 106169 - protein, 8 aa, Dengue virus
FKVPHAKR

SEQ ID NO: 106170 - protein, 8 aa, Dengue virus
KVPHAKRQ

SEQ ID NO: 106171 - protein, 8 aa, Dengue virus
VPHAKRQD

SEQ ID NO: 106172 - protein, 8 aa, Dengue virus
AGATEVDS

SEQ ID NO: 106173 - protein, 8 aa, Dengue virus
GATEVDSG

SEQ ID NO: 106174 - protein, 8 aa, Dengue virus
ATEVDSGD

SEQ ID NO: 106175 - protein, 8 aa, Dengue virus
EVDSGDGN

SEQ ID NO: 106176 - protein, 8 aa, Dengue virus
DGNHMFAG

SEQ ID NO: 106177 - protein, 8 aa, Dengue virus
GNHMFAGH

SEQ ID NO: 106178 - protein, 8 aa, Dengue virus
NHMFAGHL

SEQ ID NO: 106179 - protein, 8 aa, Dengue virus
HMFAGHLK

SEQ ID NO: 106180 - protein, 8 aa, Dengue virus
KVRMEKLR

SEQ ID NO: 106181 - protein, 8 aa, Dengue virus
VRMEKLRI

SEQ ID NO: 106182 - protein, 8 aa, Dengue virus
RMEKLRIK

SEQ ID NO: 106183 - protein, 8 aa, Dengue virus
MEKLRIKG

SEQ ID NO: 106184 - protein, 8 aa, Dengue virus
DKEMAETQ

SEQ ID NO: 106185 - protein, 8 aa, Dengue virus
KEMAETQH

SEQ ID NO: 106186 - protein, 8 aa, Dengue virus
EMAETQHG

SEQ ID NO: 106187 - protein, 8 aa, Dengue virus
MAETQHGT

SEQ ID NO: 106188 - protein, 8 aa, Dengue virus
AETQHGTT

SEQ ID NO: 106189 - protein, 8 aa, Dengue virus
ETQHGTTV

SEQ ID NO: 106190 - protein, 8 aa, Dengue virus
TQHGTTVV

SEQ ID NO: 106191 - protein, 8 aa, Dengue virus
QHGTTVVK

SEQ ID NO: 106192 - protein, 8 aa, Dengue virus
PINIEAEP

SEQ ID NO: 106193 - protein, 8 aa, Dengue virus
INIEAEPP

SEQ ID NO: 106194 - protein, 8 aa, Dengue virus
ELEPPFGD

SEQ ID NO: 106195 - protein, 8 aa, Dengue virus
LEPPFGDS

SEQ ID NO: 106196 - protein, 8 aa, Dengue virus
WFKRGSSI

SEQ ID NO: 106197 - protein, 8 aa, Dengue virus
FKRGSSIG

SEQ ID NO: 106198 - protein, 8 aa, Dengue virus
KRGSSIGK

SEQ ID NO: 106199 - protein, 8 aa, Dengue virus
SSIGQMIE

SEQ ID NO: 106200 - protein, 8 aa, Dengue virus
SIGQMIET

SEQ ID NO: 106201 - protein, 8 aa, Dengue virus
IGQMIETT

SEQ ID NO: 106202 - protein, 8 aa, Dengue virus
GQMIETTM

SEQ ID NO: 106203 - protein, 8 aa, Dengue virus
QMIETTMR

SEQ ID NO: 106204 - protein, 8 aa, Dengue virus
MIETTMRG

SEQ ID NO: 106205 - protein, 8 aa, Dengue virus
IETTMRGA

SEQ ID NO: 106206 - protein, 8 aa, Dengue virus
DFGSVGGL

SEQ ID NO: 106207 - protein, 8 aa, Dengue virus
FGSVYTTM

SEQ ID NO: 106208 - protein, 8 aa, Dengue virus
GSVYTTMF

SEQ ID NO: 106209 - protein, 8 aa, Dengue virus
VYTTMFGG

SEQ ID NO: 106210 - protein, 8 aa, Dengue virus
YTTMFGGV

SEQ ID NO: 106211 - protein, 8 aa, Dengue virus
TTMFGGVS

SEQ ID NO: 106212 - protein, 8 aa, Dengue virus
TMFGGVSW

SEQ ID NO: 106213 - protein, 8 aa, Dengue virus
FGGVSWMI

SEQ ID NO: 106214 - protein, 8 aa, Dengue virus
GGVSWMIR

SEQ ID NO: 106215 - protein, 8 aa, Dengue virus
GVSWMIRI

SEQ ID NO: 106216 - protein, 8 aa, Dengue virus
LVLWIGTN

SEQ ID NO: 106217 - protein, 8 aa, Dengue virus
VLWIGTNS

SEQ ID NO: 106218 - protein, 8 aa, Dengue virus
LWIGTNSR

SEQ ID NO: 106219 - protein, 8 aa, Dengue virus
WIGTNSRN

SEQ ID NO: 106220 - protein, 8 aa, Dengue virus
IGTNSRNT

SEQ ID NO: 106221 - protein, 8 aa, Dengue virus
GTNSRNTS

SEQ ID NO: 106222 - protein, 8 aa, Dengue virus
NSRSTSFS

SEQ ID NO: 106223 - protein, 8 aa, Dengue virus
TLFLGFTV

SEQ ID NO: 106224 - protein, 8 aa, Dengue virus
LFLGFTVQ

SEQ ID NO: 106225 - protein, 8 aa, Dengue virus
FLGFTVQA

SEQ ID NO: 106226 - protein, 8 aa, Dengue virus
LGFTVQAD

SEQ ID NO: 106227 - protein, 8 aa, Dengue virus
VQADMGCA

SEQ ID NO: 106228 - protein, 8 aa, Dengue virus
SKELKCGS

SEQ ID NO: 106229 - protein, 8 aa, Dengue virus
CGNGIFVT

SEQ ID NO: 106230 - protein, 8 aa, Dengue virus
GSGIFVTD

SEQ ID NO: 106231 - protein, 8 aa, Dengue virus
SGIFVTDN

SEQ ID NO: 106232 - protein, 8 aa, Dengue virus
GIFVTDNV

SEQ ID NO: 106233 - protein, 8 aa, Dengue virus
IFVTDNVH

SEQ ID NO: 106234 - protein, 8 aa, Dengue virus
FVTDNVHT

SEQ ID NO: 106235 - protein, 8 aa, Dengue virus
VTDNVHTW

SEQ ID NO: 106236 - protein, 8 aa, Dengue virus
PESPARLA

SEQ ID NO: 106237 - protein, 8 aa, Dengue virus
ESPARLAS

SEQ ID NO: 106238 - protein, 8 aa, Dengue virus
SPARLASA

SEQ ID NO: 106239 - protein, 8 aa, Dengue virus
PARLASAI

SEQ ID NO: 106240 - protein, 8 aa, Dengue virus
ARLASAIL

SEQ ID NO: 106241 - protein, 8 aa, Dengue virus
RLASAILN

SEQ ID NO: 106242 - protein, 8 aa, Dengue virus
LASAILNA

SEQ ID NO: 106243 - protein, 8 aa, Dengue virus
ASAIQKAQ

SEQ ID NO: 106244 - protein, 8 aa, Dengue virus
KDGVCGIR

SEQ ID NO: 106245 - protein, 8 aa, Dengue virus
DGVCGIRS

SEQ ID NO: 106246 - protein, 8 aa, Dengue virus
DICGIRSV

SEQ ID NO: 106247 - protein, 8 aa, Dengue virus
GIRSTTRL

SEQ ID NO: 106248 - protein, 8 aa, Dengue virus
IRSTTRLE

SEQ ID NO: 106249 - protein, 8 aa, Dengue virus
RSTTRLEN

SEQ ID NO: 106250 - protein, 8 aa, Dengue virus
STTRLENV

SEQ ID NO: 106251 - protein, 8 aa, Dengue virus
TTRLENVM

SEQ ID NO: 106252 - protein, 8 aa, Dengue virus
TRLENVMW

SEQ ID NO: 106253 - protein, 8 aa, Dengue virus
RLENVMWK

SEQ ID NO: 106254 - protein, 8 aa, Dengue virus
LENVMWKQ

SEQ ID NO: 106255 - protein, 8 aa, Dengue virus
ENVMWKQI

SEQ ID NO: 106256 - protein, 8 aa, Dengue virus
TNELNYVL

SEQ ID NO: 106257 - protein, 8 aa, Dengue virus
ELNHILAE

SEQ ID NO: 106258 - protein, 8 aa, Dengue virus
LNHILAEN

SEQ ID NO: 106259 - protein, 8 aa, Dengue virus
RYSWKTWG

SEQ ID NO: 106260 - protein, 8 aa, Dengue virus
YSWKIWGK

SEQ ID NO: 106261 - protein, 8 aa, Dengue virus
SWRSWGKA

SEQ ID NO: 106262 - protein, 8 aa, Dengue virus
WKTWGKAR

SEQ ID NO: 106263 - protein, 8 aa, Dengue virus
TFIIDGPD

SEQ ID NO: 106264 - protein, 8 aa, Dengue virus
FLIDGPDT

SEQ ID NO: 106265 - protein, 8 aa, Dengue virus
RAWNSFEV

SEQ ID NO: 106266 - protein, 8 aa, Dengue virus
AWNSFEVE

SEQ ID NO: 106267 - protein, 8 aa, Dengue virus
WNSFEVED

SEQ ID NO: 106268 - protein, 8 aa, Dengue virus
NSFEVEDY

SEQ ID NO: 106269 - protein, 8 aa, Dengue virus
SFEVEDYG

SEQ ID NO: 106270 - protein, 8 aa, Dengue virus
DYGFGVFS

SEQ ID NO: 106271 - protein, 8 aa, Dengue virus
YGFGVFST

SEQ ID NO: 106272 - protein, 8 aa, Dengue virus
GFGVFSTN

SEQ ID NO: 106273 - protein, 8 aa, Dengue virus
FGVFSTNI

SEQ ID NO: 106274 - protein, 8 aa, Dengue virus
GVFSTNIW

SEQ ID NO: 106275 - protein, 8 aa, Dengue virus
VFSTNIWL

SEQ ID NO: 106276 - protein, 8 aa, Dengue virus
FTTNIWLR

SEQ ID NO: 106277 - protein, 8 aa, Dengue virus
TTNIWLRL

SEQ ID NO: 106278 - protein, 8 aa, Dengue virus
TNIWLRLR

SEQ ID NO: 106279 - protein, 8 aa, Dengue virus
SKLMSAAV

SEQ ID NO: 106280 - protein, 8 aa, Dengue virus
KLMSAAVK

SEQ ID NO: 106281 - protein, 8 aa, Dengue virus
KDQKAVHA

SEQ ID NO: 106282 - protein, 8 aa, Dengue virus
DQKAVHAD

SEQ ID NO: 106283 - protein, 8 aa, Dengue virus
QKAVHADM

SEQ ID NO: 106284 - protein, 8 aa, Dengue virus
MGYWIESS

SEQ ID NO: 106285 - protein, 8 aa, Dengue virus
GYWIESSK

SEQ ID NO: 106286 - protein, 8 aa, Dengue virus
YWIESSKN

SEQ ID NO: 106287 - protein, 8 aa, Dengue virus
ESSKNQTW

SEQ ID NO: 106288 - protein, 8 aa, Dengue virus
SSKNQTWQ

SEQ ID NO: 106289 - protein, 8 aa, Dengue virus
LNDTWKIE

SEQ ID NO: 106290 - protein, 8 aa, Dengue virus
KASFIEIK

SEQ ID NO: 106291 - protein, 8 aa, Dengue virus
ASFIEVKN

SEQ ID NO: 106292 - protein, 8 aa, Dengue virus
SFIEVKNC

SEQ ID NO: 106293 - protein, 8 aa, Dengue virus
GVLESEMV

SEQ ID NO: 106294 - protein, 8 aa, Dengue virus
VLESEMVI

SEQ ID NO: 106295 - protein, 8 aa, Dengue virus
LESEMVIP

SEQ ID NO: 106296 - protein, 8 aa, Dengue virus
ESEMVIPK

SEQ ID NO: 106297 - protein, 8 aa, Dengue virus
AGPFSQHN

SEQ ID NO: 106298 - protein, 8 aa, Dengue virus
SQHNNRPG

SEQ ID NO: 106299 - protein, 8 aa, Dengue virus
QHNNRPGY

SEQ ID NO: 106300 - protein, 8 aa, Dengue virus
TQAAGPWH

SEQ ID NO: 106301 - protein, 8 aa, Dengue virus
QAAGPWHL

SEQ ID NO: 106302 - protein, 8 aa, Dengue virus
AAGPWHLG

SEQ ID NO: 106303 - protein, 8 aa, Dengue virus
WHLGRLEM

SEQ ID NO: 106304 - protein, 8 aa, Dengue virus
HLGRLEMD

SEQ ID NO: 106305 - protein, 8 aa, Dengue virus
LGRLEMDF

SEQ ID NO: 106306 - protein, 8 aa, Dengue virus
CPGTTVTI

SEQ ID NO: 106307 - protein, 8 aa, Dengue virus
CGSRGPSL

SEQ ID NO: 106308 - protein, 8 aa, Dengue virus
GSRGPSLR

SEQ ID NO: 106309 - protein, 8 aa, Dengue virus
SRGPSLRT

SEQ ID NO: 106310 - protein, 8 aa, Dengue virus
TTASGKLV

SEQ ID NO: 106311 - protein, 8 aa, Dengue virus
TASGKLVT

SEQ ID NO: 106312 - protein, 8 aa, Dengue virus
ASGKLVTQ

SEQ ID NO: 106313 - protein, 8 aa, Dengue virus
SGKLVTQW

SEQ ID NO: 106314 - protein, 8 aa, Dengue virus
GKLVTQWC

SEQ ID NO: 106315 - protein, 8 aa, Dengue virus
KLVTQWCC

SEQ ID NO: 106316 - protein, 8 aa, Dengue virus
LVTQWCCR

SEQ ID NO: 106317 - protein, 8 aa, Dengue virus
TLPPLRFK

SEQ ID NO: 106318 - protein, 8 aa, Dengue virus
LPPLRFKG

SEQ ID NO: 106319 - protein, 8 aa, Dengue virus
PPLRFKGE

SEQ ID NO: 106320 - protein, 8 aa, Dengue virus
PLRFKGED

SEQ ID NO: 106321 - protein, 8 aa, Dengue virus
LRFKGEDG

SEQ ID NO: 106322 - protein, 8 aa, Dengue virus
RFKGEDGC

SEQ ID NO: 106323 - protein, 8 aa, Dengue virus
FKGEDGCW

SEQ ID NO: 106324 - protein, 8 aa, Dengue virus
LGEDGCWY

SEQ ID NO: 106325 - protein, 8 aa, Dengue virus
KEREENLV

SEQ ID NO: 106326 - protein, 8 aa, Dengue virus
KEENLVRS

SEQ ID NO: 106327 - protein, 8 aa, Dengue virus
VEECLRRR

SEQ ID NO: 106328 - protein, 8 aa, Dengue virus
EEMLRTRI

SEQ ID NO: 106329 - protein, 8 aa, Dengue virus
EMLRTRIG

SEQ ID NO: 106330 - protein, 8 aa, Dengue virus
MGMGMTYL

SEQ ID NO: 106331 - protein, 8 aa, Dengue virus
GMGITYLA

SEQ ID NO: 106332 - protein, 8 aa, Dengue virus
MGITYLAL

SEQ ID NO: 106333 - protein, 8 aa, Dengue virus
THLAIMAV

SEQ ID NO: 106334 - protein, 8 aa, Dengue virus
HLAIMAVF

SEQ ID NO: 106335 - protein, 8 aa, Dengue virus
FLRKLTSK

SEQ ID NO: 106336 - protein, 8 aa, Dengue virus
IRRLTSRE

SEQ ID NO: 106337 - protein, 8 aa, Dengue virus
RKLTSRET

SEQ ID NO: 106338 - protein, 8 aa, Dengue virus
KLTSRETA

SEQ ID NO: 106339 - protein, 8 aa, Dengue virus
LTSRETAL

SEQ ID NO: 106340 - protein, 8 aa, Dengue virus
TSKELMMT

SEQ ID NO: 106341 - protein, 8 aa, Dengue virus
SKELMMTT

SEQ ID NO: 106342 - protein, 8 aa, Dengue virus
MELIDGIS

SEQ ID NO: 106343 - protein, 8 aa, Dengue virus
ELIDGISL

SEQ ID NO: 106344 - protein, 8 aa, Dengue virus
LIDGISLG

SEQ ID NO: 106345 - protein, 8 aa, Dengue virus
IDGISLGL

SEQ ID NO: 106346 - protein, 8 aa, Dengue virus
DGISLGLI

SEQ ID NO: 106347 - protein, 8 aa, Dengue virus
RKSWPINE

SEQ ID NO: 106348 - protein, 8 aa, Dengue virus
SWPLNEAV

SEQ ID NO: 106349 - protein, 8 aa, Dengue virus
WPLNEAVM

SEQ ID NO: 106350 - protein, 8 aa, Dengue virus
PLNEAVMA

SEQ ID NO: 106351 - protein, 8 aa, Dengue virus
LNEGIMAI

SEQ ID NO: 106352 - protein, 8 aa, Dengue virus
NEGIMAIG

SEQ ID NO: 106353 - protein, 8 aa, Dengue virus
GVVSILLS

SEQ ID NO: 106354 - protein, 8 aa, Dengue virus
VVSILLSS

SEQ ID NO: 106355 - protein, 8 aa, Dengue virus
VSILLSAL

SEQ ID NO: 106356 - protein, 8 aa, Dengue virus
SILLSALL

SEQ ID NO: 106357 - protein, 8 aa, Dengue virus
LLGSALLK

SEQ ID NO: 106358 - protein, 8 aa, Dengue virus
LGSALLKN

SEQ ID NO: 106359 - protein, 8 aa, Dengue virus
GSALLKND

SEQ ID NO: 106360 - protein, 8 aa, Dengue virus
SALLKNDV

SEQ ID NO: 106361 - protein, 8 aa, Dengue virus
ALLKNDVP

SEQ ID NO: 106362 - protein, 8 aa, Dengue virus
DVPLAGPM

SEQ ID NO: 106363 - protein, 8 aa, Dengue virus
VPLAGPMV

SEQ ID NO: 106364 - protein, 8 aa, Dengue virus
PLAGPMVA

SEQ ID NO: 106365 - protein, 8 aa, Dengue virus
LAGPMVAG

SEQ ID NO: 106366 - protein, 8 aa, Dengue virus
AGPMVAGG

SEQ ID NO: 106367 - protein, 8 aa, Dengue virus
MVAGGLLL

SEQ ID NO: 106368 - protein, 8 aa, Dengue virus
VAGGLLLA

SEQ ID NO: 106369 - protein, 8 aa, Dengue virus
AGGLLLAA

SEQ ID NO: 106370 - protein, 8 aa, Dengue virus
GGLLLAAY

SEQ ID NO: 106371 - protein, 8 aa, Dengue virus
GLLLAAYV

SEQ ID NO: 106372 - protein, 8 aa, Dengue virus
LLLAAYVM

SEQ ID NO: 106373 - protein, 8 aa, Dengue virus
LLAAYVMS

SEQ ID NO: 106374 - protein, 8 aa, Dengue virus
LAAYVMSG

SEQ ID NO: 106375 - protein, 8 aa, Dengue virus
AAYVMSGS

SEQ ID NO: 106376 - protein, 8 aa, Dengue virus
AYVMSGSS

SEQ ID NO: 106377 - protein, 8 aa, Dengue virus
YVMSGSSA

SEQ ID NO: 106378 - protein, 8 aa, Dengue virus
VMSGSSAD

SEQ ID NO: 106379 - protein, 8 aa, Dengue virus
MSGSSADL

SEQ ID NO: 106380 - protein, 8 aa, Dengue virus
SADLELEK

SEQ ID NO: 106381 - protein, 8 aa, Dengue virus
ADLELEKA

SEQ ID NO: 106382 - protein, 8 aa, Dengue virus
EAEHSGTS

SEQ ID NO: 106383 - protein, 8 aa, Dengue virus
AEHSGTSH

SEQ ID NO: 106384 - protein, 8 aa, Dengue virus
EHSGTSHN

SEQ ID NO: 106385 - protein, 8 aa, Dengue virus
HSGTSHNI

SEQ ID NO: 106386 - protein, 8 aa, Dengue virus
SGTSHNIL

SEQ ID NO: 106387 - protein, 8 aa, Dengue virus
DEDGSFSI

SEQ ID NO: 106388 - protein, 8 aa, Dengue virus
EDGSFSIR

SEQ ID NO: 106389 - protein, 8 aa, Dengue virus
DGSFSIRD

SEQ ID NO: 106390 - protein, 8 aa, Dengue virus
GSFSIRDV

SEQ ID NO: 106391 - protein, 8 aa, Dengue virus
SFSIRDVE

SEQ ID NO: 106392 - protein, 8 aa, Dengue virus
FSIRDVEE

SEQ ID NO: 106393 - protein, 8 aa, Dengue virus
SIRDVEET

SEQ ID NO: 106394 - protein, 8 aa, Dengue virus
IRDVEETN

SEQ ID NO: 106395 - protein, 8 aa, Dengue virus
MITLLVKL

SEQ ID NO: 106396 - protein, 8 aa, Dengue virus
ITLLVKLA

SEQ ID NO: 106397 - protein, 8 aa, Dengue virus
TLLVKLAL

SEQ ID NO: 106398 - protein, 8 aa, Dengue virus
LLVKLALI

SEQ ID NO: 106399 - protein, 8 aa, Dengue virus
LVKLALIT

SEQ ID NO: 106400 - protein, 8 aa, Dengue virus
VKLALITV

SEQ ID NO: 106401 - protein, 8 aa, Dengue virus
KLALITVS

SEQ ID NO: 106402 - protein, 8 aa, Dengue virus
LALITVSG

SEQ ID NO: 106403 - protein, 8 aa, Dengue virus
KTQRSGAL

SEQ ID NO: 106404 - protein, 8 aa, Dengue virus
TQRSGALW

SEQ ID NO: 106405 - protein, 8 aa, Dengue virus
RSGALWDV

SEQ ID NO: 106406 - protein, 8 aa, Dengue virus
SGALWDVP

SEQ ID NO: 106407 - protein, 8 aa, Dengue virus
WDVPSPAA

SEQ ID NO: 106408 - protein, 8 aa, Dengue virus
AALSEGVY

SEQ ID NO: 106409 - protein, 8 aa, Dengue virus
ALSEGVYR

SEQ ID NO: 106410 - protein, 8 aa, Dengue virus
LSEGVYRI

SEQ ID NO: 106411 - protein, 8 aa, Dengue virus
DDGIYRIL

SEQ ID NO: 106412 - protein, 8 aa, Dengue virus
DGIYRILQ

SEQ ID NO: 106413 - protein, 8 aa, Dengue virus
YRIKQKGI

SEQ ID NO: 106414 - protein, 8 aa, Dengue virus
FGYSQIGA

SEQ ID NO: 106415 - protein, 8 aa, Dengue virus
KTQVGVGI

SEQ ID NO: 106416 - protein, 8 aa, Dengue virus
TQVGVGIH

SEQ ID NO: 106417 - protein, 8 aa, Dengue virus
QVGVGIHM

SEQ ID NO: 106418 - protein, 8 aa, Dengue virus
VGVGVFQD

SEQ ID NO: 106419 - protein, 8 aa, Dengue virus
DGVFHTMW

SEQ ID NO: 106420 - protein, 8 aa, Dengue virus
TRGAVLTH

SEQ ID NO: 106421 - protein, 8 aa, Dengue virus
KGKRIEPS

SEQ ID NO: 106422 - protein, 8 aa, Dengue virus
TGRLEPSW

SEQ ID NO: 106423 - protein, 8 aa, Dengue virus
GRLEPSWA

SEQ ID NO: 106424 - protein, 8 aa, Dengue virus
RLEPSWAD

SEQ ID NO: 106425 - protein, 8 aa, Dengue virus
LEPSWADV

SEQ ID NO: 106426 - protein, 8 aa, Dengue virus
EPSWADVR

SEQ ID NO: 106427 - protein, 8 aa, Dengue virus
PSWADVRN

SEQ ID NO: 106428 - protein, 8 aa, Dengue virus
SWADVRND

SEQ ID NO: 106429 - protein, 8 aa, Dengue virus
WANVKKDL

SEQ ID NO: 106430 - protein, 8 aa, Dengue virus
ANVKKDLI

SEQ ID NO: 106431 - protein, 8 aa, Dengue virus
NVKKDLIS

SEQ ID NO: 106432 - protein, 8 aa, Dengue virus
WDKEEDVQ

SEQ ID NO: 106433 - protein, 8 aa, Dengue virus
DKEEDVQV

SEQ ID NO: 106434 - protein, 8 aa, Dengue virus
KEEDVQVL

SEQ ID NO: 106435 - protein, 8 aa, Dengue virus
PGKNPKHV

SEQ ID NO: 106436 - protein, 8 aa, Dengue virus
GKNPKHVQ

SEQ ID NO: 106437 - protein, 8 aa, Dengue virus
KNPKHVQT

SEQ ID NO: 106438 - protein, 8 aa, Dengue virus
TGEIGAVT

SEQ ID NO: 106439 - protein, 8 aa, Dengue virus
GEIGAVTL

SEQ ID NO: 106440 - protein, 8 aa, Dengue virus
EIGAVTLD

SEQ ID NO: 106441 - protein, 8 aa, Dengue virus
IGAVTLDF

SEQ ID NO: 106442 - protein, 8 aa, Dengue virus
TSGSPIID

SEQ ID NO: 106443 - protein, 8 aa, Dengue virus
SGSPIIDK

SEQ ID NO: 106444 - protein, 8 aa, Dengue virus
KGKVIGLY

SEQ ID NO: 106445 - protein, 8 aa, Dengue virus
GNGVVTKS

SEQ ID NO: 106446 - protein, 8 aa, Dengue virus
NGVVTKSG

SEQ ID NO: 106447 - protein, 8 aa, Dengue virus
GVVTKSGD

SEQ ID NO: 106448 - protein, 8 aa, Dengue virus
VVTKSGDY

SEQ ID NO: 106449 - protein, 8 aa, Dengue virus
VTKSGDYV

SEQ ID NO: 106450 - protein, 8 aa, Dengue virus
TKSGDYVS

SEQ ID NO: 106451 - protein, 8 aa, Dengue virus
SGDYVSAI

SEQ ID NO: 106452 - protein, 8 aa, Dengue virus
GDYVSAIT

SEQ ID NO: 106453 - protein, 8 aa, Dengue virus
DYVSAITQ

SEQ ID NO: 106454 - protein, 8 aa, Dengue virus
YVSAITQA

SEQ ID NO: 106455 - protein, 8 aa, Dengue virus
IFRKRRLT

SEQ ID NO: 106456 - protein, 8 aa, Dengue virus
FRKRRLTI

SEQ ID NO: 106457 - protein, 8 aa, Dengue virus
RKRRLTIM

SEQ ID NO: 106458 - protein, 8 aa, Dengue virus
GAGKTKRI

SEQ ID NO: 106459 - protein, 8 aa, Dengue virus
AGKTKRIL

SEQ ID NO: 106460 - protein, 8 aa, Dengue virus
GKTKRILP

SEQ ID NO: 106461 - protein, 8 aa, Dengue virus
KTKRILPS

SEQ ID NO: 106462 - protein, 8 aa, Dengue virus
TKRILPSI

SEQ ID NO: 106463 - protein, 8 aa, Dengue virus
KYLPAIIR

SEQ ID NO: 106464 - protein, 8 aa, Dengue virus
YLPAMVRE

SEQ ID NO: 106465 - protein, 8 aa, Dengue virus
LPAMVREA

SEQ ID NO: 106466 - protein, 8 aa, Dengue virus
PAMVREAI

SEQ ID NO: 106467 - protein, 8 aa, Dengue virus
AMVREAIK

SEQ ID NO: 106468 - protein, 8 aa, Dengue virus
IVREAIRR

SEQ ID NO: 106469 - protein, 8 aa, Dengue virus
REALKRRL

SEQ ID NO: 106470 - protein, 8 aa, Dengue virus
EALKRRLR

SEQ ID NO: 106471 - protein, 8 aa, Dengue virus
ALKRRLRT

SEQ ID NO: 106472 - protein, 8 aa, Dengue virus
LKRRLRTL

SEQ ID NO: 106473 - protein, 8 aa, Dengue virus
KRKLRTLV

SEQ ID NO: 106474 - protein, 8 aa, Dengue virus
RKLRTLVL

SEQ ID NO: 106475 - protein, 8 aa, Dengue virus
KLRTLVLA

SEQ ID NO: 106476 - protein, 8 aa, Dengue virus
IRYQTPAV

SEQ ID NO: 106477 - protein, 8 aa, Dengue virus
KTEHTGRE

SEQ ID NO: 106478 - protein, 8 aa, Dengue virus
TEHTGREI

SEQ ID NO: 106479 - protein, 8 aa, Dengue virus
IRVPNYNL

SEQ ID NO: 106480 - protein, 8 aa, Dengue virus
VPNYNLVI

SEQ ID NO: 106481 - protein, 8 aa, Dengue virus
PNYNLVIM

SEQ ID NO: 106482 - protein, 8 aa, Dengue virus
NYNLVIMD

SEQ ID NO: 106483 - protein, 8 aa, Dengue virus
YNLVIMDE

SEQ ID NO: 106484 - protein, 8 aa, Dengue virus
NLVIMDEA

SEQ ID NO: 106485 - protein, 8 aa, Dengue virus
LVIMDEAH

SEQ ID NO: 106486 - protein, 8 aa, Dengue virus
DPFPQSNS

SEQ ID NO: 106487 - protein, 8 aa, Dengue virus
PFPQSNSP

SEQ ID NO: 106488 - protein, 8 aa, Dengue virus
IEDIEREI

SEQ ID NO: 106489 - protein, 8 aa, Dengue virus
EDIEREIP

SEQ ID NO: 106490 - protein, 8 aa, Dengue virus
DEEKDIPE

SEQ ID NO: 106491 - protein, 8 aa, Dengue virus
EEKDIPER

SEQ ID NO: 106492 - protein, 8 aa, Dengue virus
ERSWNTGF

SEQ ID NO: 106493 - protein, 8 aa, Dengue virus
FVGKTVWF

SEQ ID NO: 106494 - protein, 8 aa, Dengue virus
VGKTVWFV

SEQ ID NO: 106495 - protein, 8 aa, Dengue virus
KTGNDIAA

SEQ ID NO: 106496 - protein, 8 aa, Dengue virus
RKNGKRVV

SEQ ID NO: 106497 - protein, 8 aa, Dengue virus
KNGKRVVQ

SEQ ID NO: 106498 - protein, 8 aa, Dengue virus
NGKRVVQL

SEQ ID NO: 106499 - protein, 8 aa, Dengue virus
KTFDSEYI

SEQ ID NO: 106500 - protein, 8 aa, Dengue virus
TFDSEYIK

SEQ ID NO: 106501 - protein, 8 aa, Dengue virus
FDSEYIKT

SEQ ID NO: 106502 - protein, 8 aa, Dengue virus
ANDWDFVV

SEQ ID NO: 106503 - protein, 8 aa, Dengue virus
MGANFRAG

SEQ ID NO: 106504 - protein, 8 aa, Dengue virus
GANFRAGR

SEQ ID NO: 106505 - protein, 8 aa, Dengue virus
ANFRAGRV

SEQ ID NO: 106506 - protein, 8 aa, Dengue virus
NFRAGRVI

SEQ ID NO: 106507 - protein, 8 aa, Dengue virus
FRAGRVID

SEQ ID NO: 106508 - protein, 8 aa, Dengue virus
RAGRVIDP

SEQ ID NO: 106509 - protein, 8 aa, Dengue virus
PVILPDGP

SEQ ID NO: 106510 - protein, 8 aa, Dengue virus
VILPDGPE

SEQ ID NO: 106511 - protein, 8 aa, Dengue virus
ILPDGPER

SEQ ID NO: 106512 - protein, 8 aa, Dengue virus
LPDGPERV

SEQ ID NO: 106513 - protein, 8 aa, Dengue virus
TDGEERVV

SEQ ID NO: 106514 - protein, 8 aa, Dengue virus
AGPIPVTP

SEQ ID NO: 106515 - protein, 8 aa, Dengue virus
GPIPVTPA

SEQ ID NO: 106516 - protein, 8 aa, Dengue virus
PIPVTPAS

SEQ ID NO: 106517 - protein, 8 aa, Dengue virus
IPVTPASA

SEQ ID NO: 106518 - protein, 8 aa, Dengue virus
PVTPASAA

SEQ ID NO: 106519 - protein, 8 aa, Dengue virus
VTPASAAQ

SEQ ID NO: 106520 - protein, 8 aa, Dengue virus
TPASAAQR

SEQ ID NO: 106521 - protein, 8 aa, Dengue virus
PASAAQRR

SEQ ID NO: 106522 - protein, 8 aa, Dengue virus
RGRIGRNQ

SEQ ID NO: 106523 - protein, 8 aa, Dengue virus
KEGDQYVY

SEQ ID NO: 106524 - protein, 8 aa, Dengue virus
EGDQYVYM

SEQ ID NO: 106525 - protein, 8 aa, Dengue virus
GDQYVYMG

SEQ ID NO: 106526 - protein, 8 aa, Dengue virus
DQYVYMGQ

SEQ ID NO: 106527 - protein, 8 aa, Dengue virus
QYVYMGQP

SEQ ID NO: 106528 - protein, 8 aa, Dengue virus
YVYMGQPL

SEQ ID NO: 106529 - protein, 8 aa, Dengue virus
FSGDPLKN

SEQ ID NO: 106530 - protein, 8 aa, Dengue virus
SGDPLKND

SEQ ID NO: 106531 - protein, 8 aa, Dengue virus
EREKSAAV

SEQ ID NO: 106532 - protein, 8 aa, Dengue virus
REKSAAVD

SEQ ID NO: 106533 - protein, 8 aa, Dengue virus
EKSAAVDG

SEQ ID NO: 106534 - protein, 8 aa, Dengue virus
KSAAVDGE

SEQ ID NO: 106535 - protein, 8 aa, Dengue virus
SAAVDGEY

SEQ ID NO: 106536 - protein, 8 aa, Dengue virus
AAVDGEYR

SEQ ID NO: 106537 - protein, 8 aa, Dengue virus
VDGEYRLR

SEQ ID NO: 106538 - protein, 8 aa, Dengue virus
EQRKTFVE

SEQ ID NO: 106539 - protein, 8 aa, Dengue virus
QRKTFVEL

SEQ ID NO: 106540 - protein, 8 aa, Dengue virus
DLPVWLSH

SEQ ID NO: 106541 - protein, 8 aa, Dengue virus
LPVWLAYR

SEQ ID NO: 106542 - protein, 8 aa, Dengue virus
PVWLAYRV

SEQ ID NO: 106543 - protein, 8 aa, Dengue virus
VWLAYRVA

SEQ ID NO: 106544 - protein, 8 aa, Dengue virus
WLAYRVAA

SEQ ID NO: 106545 - protein, 8 aa, Dengue virus
VASAGISY

SEQ ID NO: 106546 - protein, 8 aa, Dengue virus
AGISYKDR

SEQ ID NO: 106547 - protein, 8 aa, Dengue virus
YADRKWCF

SEQ ID NO: 106548 - protein, 8 aa, Dengue virus
ADRKWCFD

SEQ ID NO: 106549 - protein, 8 aa, Dengue virus
QILEENME

SEQ ID NO: 106550 - protein, 8 aa, Dengue virus
ILEENMEV

SEQ ID NO: 106551 - protein, 8 aa, Dengue virus
EENMEVEV

SEQ ID NO: 106552 - protein, 8 aa, Dengue virus
ENMEVEVW

SEQ ID NO: 106553 - protein, 8 aa, Dengue virus
NMEVEVWT

SEQ ID NO: 106554 - protein, 8 aa, Dengue virus
MEVEIWTR

SEQ ID NO: 106555 - protein, 8 aa, Dengue virus
EKKKLRPK

SEQ ID NO: 106556 - protein, 8 aa, Dengue virus
KKKLRPKW

SEQ ID NO: 106557 - protein, 8 aa, Dengue virus
PKWLDARV

SEQ ID NO: 106558 - protein, 8 aa, Dengue virus
KWLDARVY

SEQ ID NO: 106559 - protein, 8 aa, Dengue virus
MALKDFKE

SEQ ID NO: 106560 - protein, 8 aa, Dengue virus
ALKDFKEF

SEQ ID NO: 106561 - protein, 8 aa, Dengue virus
LKDFKEFA

SEQ ID NO: 106562 - protein, 8 aa, Dengue virus
KDFKEFAS

SEQ ID NO: 106563 - protein, 8 aa, Dengue virus
KEFASGRK

SEQ ID NO: 106564 - protein, 8 aa, Dengue virus
EFASGRKS

SEQ ID NO: 106565 - protein, 8 aa, Dengue virus
FASGRKSI

SEQ ID NO: 106566 - protein, 8 aa, Dengue virus
ASGRKSIT

SEQ ID NO: 106567 - protein, 8 aa, Dengue virus
SGRKSITL

SEQ ID NO: 106568 - protein, 8 aa, Dengue virus
LDILTEIA

SEQ ID NO: 106569 - protein, 8 aa, Dengue virus
DILTEIAS

SEQ ID NO: 106570 - protein, 8 aa, Dengue virus
ILTEIASL

SEQ ID NO: 106571 - protein, 8 aa, Dengue virus
LTEIASLP

SEQ ID NO: 106572 - protein, 8 aa, Dengue virus
TEIASLPT

SEQ ID NO: 106573 - protein, 8 aa, Dengue virus
EIASLPTY

SEQ ID NO: 106574 - protein, 8 aa, Dengue virus
IASLPTYL

SEQ ID NO: 106575 - protein, 8 aa, Dengue virus
ASLPTYLS

SEQ ID NO: 106576 - protein, 8 aa, Dengue virus
RNALDNLA

SEQ ID NO: 106577 - protein, 8 aa, Dengue virus
LALDNIVM

SEQ ID NO: 106578 - protein, 8 aa, Dengue virus
DNIVMLHT

SEQ ID NO: 106579 - protein, 8 aa, Dengue virus
NIVMLHTT

SEQ ID NO: 106580 - protein, 8 aa, Dengue virus
IVMLHTTE

SEQ ID NO: 106581 - protein, 8 aa, Dengue virus
AYQHALNE

SEQ ID NO: 106582 - protein, 8 aa, Dengue virus
YQHALNEL

SEQ ID NO: 106583 - protein, 8 aa, Dengue virus
QHALNELP

SEQ ID NO: 106584 - protein, 8 aa, Dengue virus
HALNELPE

SEQ ID NO: 106585 - protein, 8 aa, Dengue virus
ALNELPES

SEQ ID NO: 106586 - protein, 8 aa, Dengue virus
LNELPESL

SEQ ID NO: 106587 - protein, 8 aa, Dengue virus
NELPESLE

SEQ ID NO: 106588 - protein, 8 aa, Dengue virus
ELPESLET

SEQ ID NO: 106589 - protein, 8 aa, Dengue virus
LPESLETL

SEQ ID NO: 106590 - protein, 8 aa, Dengue virus
PESLETLM

SEQ ID NO: 106591 - protein, 8 aa, Dengue virus
ESLETLML

SEQ ID NO: 106592 - protein, 8 aa, Dengue virus
SLETLMLV

SEQ ID NO: 106593 - protein, 8 aa, Dengue virus
LETLMLVA

SEQ ID NO: 106594 - protein, 8 aa, Dengue virus
ETLMLVAL

SEQ ID NO: 106595 - protein, 8 aa, Dengue virus
TLMLVALL

SEQ ID NO: 106596 - protein, 8 aa, Dengue virus
LMLVALLG

SEQ ID NO: 106597 - protein, 8 aa, Dengue virus
LLGAMTAG

SEQ ID NO: 106598 - protein, 8 aa, Dengue virus
MTAGIFLF

SEQ ID NO: 106599 - protein, 8 aa, Dengue virus
TAGIFLFF

SEQ ID NO: 106600 - protein, 8 aa, Dengue virus
GIFLFFMQ

SEQ ID NO: 106601 - protein, 8 aa, Dengue virus
GKLSMGLI

SEQ ID NO: 106602 - protein, 8 aa, Dengue virus
KLSMGLIT

SEQ ID NO: 106603 - protein, 8 aa, Dengue virus
LSMGLITI

SEQ ID NO: 106604 - protein, 8 aa, Dengue virus
VPLQWIAS

SEQ ID NO: 106605 - protein, 8 aa, Dengue virus
QPQWIAAS

SEQ ID NO: 106606 - protein, 8 aa, Dengue virus
QLTYVIIA

SEQ ID NO: 106607 - protein, 8 aa, Dengue virus
LIYVILTI

SEQ ID NO: 106608 - protein, 8 aa, Dengue virus
IYVILTIL

SEQ ID NO: 106609 - protein, 8 aa, Dengue virus
YVILTILT

SEQ ID NO: 106610 - protein, 8 aa, Dengue virus
GLIEKTKT

SEQ ID NO: 106611 - protein, 8 aa, Dengue virus
LIEKTKTD

SEQ ID NO: 106612 - protein, 8 aa, Dengue virus
IEKTKTDF

SEQ ID NO: 106613 - protein, 8 aa, Dengue virus
EKTKTDFG

SEQ ID NO: 106614 - protein, 8 aa, Dengue virus
YAVATTIL

SEQ ID NO: 106615 - protein, 8 aa, Dengue virus
AVATTILT

SEQ ID NO: 106616 - protein, 8 aa, Dengue virus
VATTILTP

SEQ ID NO: 106617 - protein, 8 aa, Dengue virus
ATTILTPM

SEQ ID NO: 106618 - protein, 8 aa, Dengue virus
LTPMLRHT

SEQ ID NO: 106619 - protein, 8 aa, Dengue virus
LRHTIENT

SEQ ID NO: 106620 - protein, 8 aa, Dengue virus
RHTIENTS

SEQ ID NO: 106621 - protein, 8 aa, Dengue virus
HTIENTSA

SEQ ID NO: 106622 - protein, 8 aa, Dengue virus
TIENTSAN

SEQ ID NO: 106623 - protein, 8 aa, Dengue virus
IENTSANL

SEQ ID NO: 106624 - protein, 8 aa, Dengue virus
ENTSANLS

SEQ ID NO: 106625 - protein, 8 aa, Dengue virus
NTSANLSL

SEQ ID NO: 106626 - protein, 8 aa, Dengue virus
TSANLSLA

SEQ ID NO: 106627 - protein, 8 aa, Dengue virus
SANLSLAA

SEQ ID NO: 106628 - protein, 8 aa, Dengue virus
ANLSLAAI

SEQ ID NO: 106629 - protein, 8 aa, Dengue virus
NLSLAAIA

SEQ ID NO: 106630 - protein, 8 aa, Dengue virus
LSLAAIAN

SEQ ID NO: 106631 - protein, 8 aa, Dengue virus
AAIANQAA

SEQ ID NO: 106632 - protein, 8 aa, Dengue virus
AIANQAAV

SEQ ID NO: 106633 - protein, 8 aa, Dengue virus
IANQAAVL

SEQ ID NO: 106634 - protein, 8 aa, Dengue virus
ANQAAVLM

SEQ ID NO: 106635 - protein, 8 aa, Dengue virus
NQAAVLMG

SEQ ID NO: 106636 - protein, 8 aa, Dengue virus
QAAVLMGL

SEQ ID NO: 106637 - protein, 8 aa, Dengue virus
AAVLMGLG

SEQ ID NO: 106638 - protein, 8 aa, Dengue virus
AVLMGLGK

SEQ ID NO: 106639 - protein, 8 aa, Dengue virus
VLMGLGRG

SEQ ID NO: 106640 - protein, 8 aa, Dengue virus
LGRGWPLS

SEQ ID NO: 106641 - protein, 8 aa, Dengue virus
GRGWPLSK

SEQ ID NO: 106642 - protein, 8 aa, Dengue virus
RGWPLSKM

SEQ ID NO: 106643 - protein, 8 aa, Dengue virus
WPLHRMDL

SEQ ID NO: 106644 - protein, 8 aa, Dengue virus
PLHRMDLG

SEQ ID NO: 106645 - protein, 8 aa, Dengue virus
LHRMDLGV

SEQ ID NO: 106646 - protein, 8 aa, Dengue virus
LGVPLLAM

SEQ ID NO: 106647 - protein, 8 aa, Dengue virus
QVNPLTLI

SEQ ID NO: 106648 - protein, 8 aa, Dengue virus
VNPLTLIA

SEQ ID NO: 106649 - protein, 8 aa, Dengue virus
NPLTLIAA

SEQ ID NO: 106650 - protein, 8 aa, Dengue virus
PLTLIAAV

SEQ ID NO: 106651 - protein, 8 aa, Dengue virus
LLVHYAII

SEQ ID NO: 106652 - protein, 8 aa, Dengue virus
LVHYAIIG

SEQ ID NO: 106653 - protein, 8 aa, Dengue virus
NPTIDGIV

SEQ ID NO: 106654 - protein, 8 aa, Dengue virus
PTIDGIVA

SEQ ID NO: 106655 - protein, 8 aa, Dengue virus
TIDGIVAI

SEQ ID NO: 106656 - protein, 8 aa, Dengue virus
DGVTVIDL

SEQ ID NO: 106657 - protein, 8 aa, Dengue virus
TVIDLDPI

SEQ ID NO: 106658 - protein, 8 aa, Dengue virus
VIDLEPIP

SEQ ID NO: 106659 - protein, 8 aa, Dengue virus
IDLEPIPY

SEQ ID NO: 106660 - protein, 8 aa, Dengue virus
DLEPIPYD

SEQ ID NO: 106661 - protein, 8 aa, Dengue virus
PISYDPKF

SEQ ID NO: 106662 - protein, 8 aa, Dengue virus
ISYDPKFE

SEQ ID NO: 106663 - protein, 8 aa, Dengue virus
SYDPKFEK

SEQ ID NO: 106664 - protein, 8 aa, Dengue virus
VMLLVLCV

SEQ ID NO: 106665 - protein, 8 aa, Dengue virus
LCAGQLLL

SEQ ID NO: 106666 - protein, 8 aa, Dengue virus
CAGQLLLM

SEQ ID NO: 106667 - protein, 8 aa, Dengue virus
AGQLLLMR

SEQ ID NO: 106668 - protein, 8 aa, Dengue virus
GQLLLMRT

SEQ ID NO: 106669 - protein, 8 aa, Dengue virus
QLLLMRTT

SEQ ID NO: 106670 - protein, 8 aa, Dengue virus
LLLMRTTW

SEQ ID NO: 106671 - protein, 8 aa, Dengue virus
LMRTTWAF

SEQ ID NO: 106672 - protein, 8 aa, Dengue virus
MRTSWAFC

SEQ ID NO: 106673 - protein, 8 aa, Dengue virus
RTSWAFCE

SEQ ID NO: 106674 - protein, 8 aa, Dengue virus
TTWAFCEV

SEQ ID NO: 106675 - protein, 8 aa, Dengue virus
TWAFCEVL

SEQ ID NO: 106676 - protein, 8 aa, Dengue virus
WAFCEALT

SEQ ID NO: 106677 - protein, 8 aa, Dengue virus
AFCEALTL

SEQ ID NO: 106678 - protein, 8 aa, Dengue virus
FCEALTLA

SEQ ID NO: 106679 - protein, 8 aa, Dengue virus
TLATGPIL

SEQ ID NO: 106680 - protein, 8 aa, Dengue virus
LATGPILT

SEQ ID NO: 106681 - protein, 8 aa, Dengue virus
ATGPILTL

SEQ ID NO: 106682 - protein, 8 aa, Dengue virus
TGPILTLW

SEQ ID NO: 106683 - protein, 8 aa, Dengue virus
GPILTLWE

SEQ ID NO: 106684 - protein, 8 aa, Dengue virus
PILTLWEG

SEQ ID NO: 106685 - protein, 8 aa, Dengue virus
ILTLWEGN

SEQ ID NO: 106686 - protein, 8 aa, Dengue virus
AGLAFSLI

SEQ ID NO: 106687 - protein, 8 aa, Dengue virus
GLAFSLIK

SEQ ID NO: 106688 - protein, 8 aa, Dengue virus
LAFSLIKN

SEQ ID NO: 106689 - protein, 8 aa, Dengue virus
AFSLIKNA

SEQ ID NO: 106690 - protein, 8 aa, Dengue virus
MGETLGEK

SEQ ID NO: 106691 - protein, 8 aa, Dengue virus
TLGEKWKN

SEQ ID NO: 106692 - protein, 8 aa, Dengue virus
LGEKWKNR

SEQ ID NO: 106693 - protein, 8 aa, Dengue virus
GEKWKNRL

SEQ ID NO: 106694 - protein, 8 aa, Dengue virus
EKWKNRLN

SEQ ID NO: 106695 - protein, 8 aa, Dengue virus
SGILEVDR

SEQ ID NO: 106696 - protein, 8 aa, Dengue virus
VDRTEAKS

SEQ ID NO: 106697 - protein, 8 aa, Dengue virus
DRTEAKSA

SEQ ID NO: 106698 - protein, 8 aa, Dengue virus
RTEAKSAL

SEQ ID NO: 106699 - protein, 8 aa, Dengue virus
EAKEGLRR

SEQ ID NO: 106700 - protein, 8 aa, Dengue virus
AKEGLRRG

SEQ ID NO: 106701 - protein, 8 aa, Dengue virus
KEGLRRGE

SEQ ID NO: 106702 - protein, 8 aa, Dengue virus
SALKDGSK

SEQ ID NO: 106703 - protein, 8 aa, Dengue virus
TRHAVSRG

SEQ ID NO: 106704 - protein, 8 aa, Dengue virus
KHAVSRGS

SEQ ID NO: 106705 - protein, 8 aa, Dengue virus
SRGSSKIR

SEQ ID NO: 106706 - protein, 8 aa, Dengue virus
RGSSKIRW

SEQ ID NO: 106707 - protein, 8 aa, Dengue virus
GSSKIRWI

SEQ ID NO: 106708 - protein, 8 aa, Dengue virus
SSKIRWIV

SEQ ID NO: 106709 - protein, 8 aa, Dengue virus
RWIVERGM

SEQ ID NO: 106710 - protein, 8 aa, Dengue virus
PKGKVVDL

SEQ ID NO: 106711 - protein, 8 aa, Dengue virus
KGKVVDLG

SEQ ID NO: 106712 - protein, 8 aa, Dengue virus
YYCGGLKD

SEQ ID NO: 106713 - protein, 8 aa, Dengue virus
YCGGLKDV

SEQ ID NO: 106714 - protein, 8 aa, Dengue virus
CGGLKNVK

SEQ ID NO: 106715 - protein, 8 aa, Dengue virus
GGLKNVKE

SEQ ID NO: 106716 - protein, 8 aa, Dengue virus
GLKNVKEV

SEQ ID NO: 106717 - protein, 8 aa, Dengue virus
VKEVKGLT

SEQ ID NO: 106718 - protein, 8 aa, Dengue virus
KEVKGLTK

SEQ ID NO: 106719 - protein, 8 aa, Dengue virus
GWNLVKLY

SEQ ID NO: 106720 - protein, 8 aa, Dengue virus
WNLVKLYS

SEQ ID NO: 106721 - protein, 8 aa, Dengue virus
NLVKLYSG

SEQ ID NO: 106722 - protein, 8 aa, Dengue virus
LHSGVDVF

SEQ ID NO: 106723 - protein, 8 aa, Dengue virus
HSGVDVFY

SEQ ID NO: 106724 - protein, 8 aa, Dengue virus
ESSSNPTI

SEQ ID NO: 106725 - protein, 8 aa, Dengue virus
SSSNPTIE

SEQ ID NO: 106726 - protein, 8 aa, Dengue virus
SPNPTVEA

SEQ ID NO: 106727 - protein, 8 aa, Dengue virus
PNPTVEAG

SEQ ID NO: 106728 - protein, 8 aa, Dengue virus
NPTVEAGR

SEQ ID NO: 106729 - protein, 8 aa, Dengue virus
PTVEAGRT

SEQ ID NO: 106730 - protein, 8 aa, Dengue virus
TVEAGRTL

SEQ ID NO: 106731 - protein, 8 aa, Dengue virus
VEAGRTLR

SEQ ID NO: 106732 - protein, 8 aa, Dengue virus
GRTLRVLS

SEQ ID NO: 106733 - protein, 8 aa, Dengue virus
RTLRVLSL

SEQ ID NO: 106734 - protein, 8 aa, Dengue virus
TLRVLSLV

SEQ ID NO: 106735 - protein, 8 aa, Dengue virus
LRVLSLVE

SEQ ID NO: 106736 - protein, 8 aa, Dengue virus
KMVEPWLS

SEQ ID NO: 106737 - protein, 8 aa, Dengue virus
QFCVKVLN

SEQ ID NO: 106738 - protein, 8 aa, Dengue virus
VLNPYMPA

SEQ ID NO: 106739 - protein, 8 aa, Dengue virus
NPYMPAVI

SEQ ID NO: 106740 - protein, 8 aa, Dengue virus
PYMPAVIE

SEQ ID NO: 106741 - protein, 8 aa, Dengue virus
HGGNLVRC

SEQ ID NO: 106742 - protein, 8 aa, Dengue virus
HEMYWVSG

SEQ ID NO: 106743 - protein, 8 aa, Dengue virus
EMYWVSGA

SEQ ID NO: 106744 - protein, 8 aa, Dengue virus
MYWVSNAS

SEQ ID NO: 106745 - protein, 8 aa, Dengue virus
YWVSNASG

SEQ ID NO: 106746 - protein, 8 aa, Dengue virus
WVSNASGN

SEQ ID NO: 106747 - protein, 8 aa, Dengue virus
VSNASGNI

SEQ ID NO: 106748 - protein, 8 aa, Dengue virus
SNASGNIV

SEQ ID NO: 106749 - protein, 8 aa, Dengue virus
GTGNIVAS

SEQ ID NO: 106750 - protein, 8 aa, Dengue virus
TGNIVASV

SEQ ID NO: 106751 - protein, 8 aa, Dengue virus
NIVSSVNT

SEQ ID NO: 106752 - protein, 8 aa, Dengue virus
IVSSVNMV

SEQ ID NO: 106753 - protein, 8 aa, Dengue virus
VSSVNMVS

SEQ ID NO: 106754 - protein, 8 aa, Dengue virus
SSVNMVSR

SEQ ID NO: 106755 - protein, 8 aa, Dengue virus
SVNTTSKM

SEQ ID NO: 106756 - protein, 8 aa, Dengue virus
VNTTSKML

SEQ ID NO: 106757 - protein, 8 aa, Dengue virus
NTTSKMLL

SEQ ID NO: 106758 - protein, 8 aa, Dengue virus
TTSKMLLN

SEQ ID NO: 106759 - protein, 8 aa, Dengue virus
TSKMLLNR

SEQ ID NO: 106760 - protein, 8 aa, Dengue virus
SKMLLNRF

SEQ ID NO: 106761 - protein, 8 aa, Dengue virus
KMLLNRFT

SEQ ID NO: 106762 - protein, 8 aa, Dengue virus
MLLNRFTT

SEQ ID NO: 106763 - protein, 8 aa, Dengue virus
LINRFTMR

SEQ ID NO: 106764 - protein, 8 aa, Dengue virus
PTYEKDVD

SEQ ID NO: 106765 - protein, 8 aa, Dengue virus
TYEKDVDL

SEQ ID NO: 106766 - protein, 8 aa, Dengue virus
YEKDVDLG

SEQ ID NO: 106767 - protein, 8 aa, Dengue virus
ERDVDLGT

SEQ ID NO: 106768 - protein, 8 aa, Dengue virus
RDVDLGTG

SEQ ID NO: 106769 - protein, 8 aa, Dengue virus
DLGTGTRH

SEQ ID NO: 106770 - protein, 8 aa, Dengue virus
LGTGTRHV

SEQ ID NO: 106771 - protein, 8 aa, Dengue virus
GAGTRSVS

SEQ ID NO: 106772 - protein, 8 aa, Dengue virus
AGTRSVST

SEQ ID NO: 106773 - protein, 8 aa, Dengue virus
GTRSVSTE

SEQ ID NO: 106774 - protein, 8 aa, Dengue virus
PDMTIIGR

SEQ ID NO: 106775 - protein, 8 aa, Dengue virus
DMTIIGRR

SEQ ID NO: 106776 - protein, 8 aa, Dengue virus
MTIIGRRL

SEQ ID NO: 106777 - protein, 8 aa, Dengue virus
TIIGRRLQ

SEQ ID NO: 106778 - protein, 8 aa, Dengue virus
IIGRRLQR

SEQ ID NO: 106779 - protein, 8 aa, Dengue virus
IGRRLQRL

SEQ ID NO: 106780 - protein, 8 aa, Dengue virus
GRRLQRLQ

SEQ ID NO: 106781 - protein, 8 aa, Dengue virus
ETWHYDQE

SEQ ID NO: 106782 - protein, 8 aa, Dengue virus
TWHYDQEN

SEQ ID NO: 106783 - protein, 8 aa, Dengue virus
WHYDQENP

SEQ ID NO: 106784 - protein, 8 aa, Dengue virus
HYDQENPY

SEQ ID NO: 106785 - protein, 8 aa, Dengue virus
YDQENPYR

SEQ ID NO: 106786 - protein, 8 aa, Dengue virus
DQENPYRT

SEQ ID NO: 106787 - protein, 8 aa, Dengue virus
QENPYRTW

SEQ ID NO: 106788 - protein, 8 aa, Dengue virus
ENPYRTWA

SEQ ID NO: 106789 - protein, 8 aa, Dengue virus
HGSYEAPS

SEQ ID NO: 106790 - protein, 8 aa, Dengue virus
GSYEAPST

SEQ ID NO: 106791 - protein, 8 aa, Dengue virus
SYEAPSTG

SEQ ID NO: 106792 - protein, 8 aa, Dengue virus
YEAPSTGS

SEQ ID NO: 106793 - protein, 8 aa, Dengue virus
EAPSTGSA

SEQ ID NO: 106794 - protein, 8 aa, Dengue virus
APSTGSAS

SEQ ID NO: 106795 - protein, 8 aa, Dengue virus
PSTGSASS

SEQ ID NO: 106796 - protein, 8 aa, Dengue virus
STGSASSM

SEQ ID NO: 106797 - protein, 8 aa, Dengue virus
KPWDVVPT

SEQ ID NO: 106798 - protein, 8 aa, Dengue virus
PWDVVPTV

SEQ ID NO: 106799 - protein, 8 aa, Dengue virus
WDVVPTVT

SEQ ID NO: 106800 - protein, 8 aa, Dengue virus
DVVPTVTQ

SEQ ID NO: 106801 - protein, 8 aa, Dengue virus
PMVTQLAM

SEQ ID NO: 106802 - protein, 8 aa, Dengue virus
MVTQLAMT

SEQ ID NO: 106803 - protein, 8 aa, Dengue virus
KVDTRTPQ

SEQ ID NO: 106804 - protein, 8 aa, Dengue virus
PRICTRAE

SEQ ID NO: 106805 - protein, 8 aa, Dengue virus
RICTRAEF

SEQ ID NO: 106806 - protein, 8 aa, Dengue virus
CTRAEFCN

SEQ ID NO: 106807 - protein, 8 aa, Dengue virus
TRAEFCNK

SEQ ID NO: 106808 - protein, 8 aa, Dengue virus
RAEFCNKV

SEQ ID NO: 106809 - protein, 8 aa, Dengue virus
AEFCNKVR

SEQ ID NO: 106810 - protein, 8 aa, Dengue virus
KKVRSNAA

SEQ ID NO: 106811 - protein, 8 aa, Dengue virus
SNAALGAV

SEQ ID NO: 106812 - protein, 8 aa, Dengue virus
NAALGAVF

SEQ ID NO: 106813 - protein, 8 aa, Dengue virus
AAIGAVFQ

SEQ ID NO: 106814 - protein, 8 aa, Dengue virus
AIGAVFQE

SEQ ID NO: 106815 - protein, 8 aa, Dengue virus
IGAVFQEE

SEQ ID NO: 106816 - protein, 8 aa, Dengue virus
GAVFQEEQ

SEQ ID NO: 106817 - protein, 8 aa, Dengue virus
AVFQEEQG

SEQ ID NO: 106818 - protein, 8 aa, Dengue virus
VFQEEQGW

SEQ ID NO: 106819 - protein, 8 aa, Dengue virus
FQEEQGWT

SEQ ID NO: 106820 - protein, 8 aa, Dengue virus
QEEQGWTS

SEQ ID NO: 106821 - protein, 8 aa, Dengue virus
EEQGWTSA

SEQ ID NO: 106822 - protein, 8 aa, Dengue virus
ENQWDSAR

SEQ ID NO: 106823 - protein, 8 aa, Dengue virus
NQWDSARA

SEQ ID NO: 106824 - protein, 8 aa, Dengue virus
QWDSARAA

SEQ ID NO: 106825 - protein, 8 aa, Dengue virus
WDSARAAV

SEQ ID NO: 106826 - protein, 8 aa, Dengue virus
DSARAAVE

SEQ ID NO: 106827 - protein, 8 aa, Dengue virus
SARAAVED

SEQ ID NO: 106828 - protein, 8 aa, Dengue virus
ERALHQEG

SEQ ID NO: 106829 - protein, 8 aa, Dengue virus
RALHQEGK

SEQ ID NO: 106830 - protein, 8 aa, Dengue virus
ALHQEGKC

SEQ ID NO: 106831 - protein, 8 aa, Dengue virus
LHQEGKCE

SEQ ID NO: 106832 - protein, 8 aa, Dengue virus
HQEGKCES

SEQ ID NO: 106833 - protein, 8 aa, Dengue virus
QEGKCESC

SEQ ID NO: 106834 - protein, 8 aa, Dengue virus
EGKCESCV

SEQ ID NO: 106835 - protein, 8 aa, Dengue virus
GKCESCVY

SEQ ID NO: 106836 - protein, 8 aa, Dengue virus
KCESCVYN

SEQ ID NO: 106837 - protein, 8 aa, Dengue virus
CESCVYNM

SEQ ID NO: 106838 - protein, 8 aa, Dengue virus
ESCVYNMM

SEQ ID NO: 106839 - protein, 8 aa, Dengue virus
WFGRENSW

SEQ ID NO: 106840 - protein, 8 aa, Dengue virus
FGRENSWS

SEQ ID NO: 106841 - protein, 8 aa, Dengue virus
GRENSWSG

SEQ ID NO: 106842 - protein, 8 aa, Dengue virus
RENSWSGV

SEQ ID NO: 106843 - protein, 8 aa, Dengue virus
ENSWSGVE

SEQ ID NO: 106844 - protein, 8 aa, Dengue virus
NSFSGVEG

SEQ ID NO: 106845 - protein, 8 aa, Dengue virus
SFSGVEGE

SEQ ID NO: 106846 - protein, 8 aa, Dengue virus
FSGVEGEG

SEQ ID NO: 106847 - protein, 8 aa, Dengue virus
RLGYILRE

SEQ ID NO: 106848 - protein, 8 aa, Dengue virus
LGYILREV

SEQ ID NO: 106849 - protein, 8 aa, Dengue virus
GDLIYADD

SEQ ID NO: 106850 - protein, 8 aa, Dengue virus
DLIYADDT

SEQ ID NO: 106851 - protein, 8 aa, Dengue virus
LIYADDTA

SEQ ID NO: 106852 - protein, 8 aa, Dengue virus
GWDTRITS

SEQ ID NO: 106853 - protein, 8 aa, Dengue virus
WDTRITSE

SEQ ID NO: 106854 - protein, 8 aa, Dengue virus
DTRITSED

SEQ ID NO: 106855 - protein, 8 aa, Dengue virus
TRITSEDL

SEQ ID NO: 106856 - protein, 8 aa, Dengue virus
VVKVLRPT

SEQ ID NO: 106857 - protein, 8 aa, Dengue virus
VKVLRPTP

SEQ ID NO: 106858 - protein, 8 aa, Dengue virus
TNMGAQLI

SEQ ID NO: 106859 - protein, 8 aa, Dengue virus
NMGAQLIR

SEQ ID NO: 106860 - protein, 8 aa, Dengue virus
MGAQLIRQ

SEQ ID NO: 106861 - protein, 8 aa, Dengue virus
QLIRQMEA

SEQ ID NO: 106862 - protein, 8 aa, Dengue virus
LIRQMEAE

SEQ ID NO: 106863 - protein, 8 aa, Dengue virus
IRQMEAEG

SEQ ID NO: 106864 - protein, 8 aa, Dengue virus
RQMEAEGV

SEQ ID NO: 106865 - protein, 8 aa, Dengue virus
ERLRRMAI

SEQ ID NO: 106866 - protein, 8 aa, Dengue virus
DDCVVKPV

SEQ ID NO: 106867 - protein, 8 aa, Dengue virus
DCVVKPVD

SEQ ID NO: 106868 - protein, 8 aa, Dengue virus
CVVKPTDD

SEQ ID NO: 106869 - protein, 8 aa, Dengue virus
VVKPTDDR

SEQ ID NO: 106870 - protein, 8 aa, Dengue virus
VKPTDDRF

SEQ ID NO: 106871 - protein, 8 aa, Dengue virus
ALIALNDM

SEQ ID NO: 106872 - protein, 8 aa, Dengue virus
LIALNDMG

SEQ ID NO: 106873 - protein, 8 aa, Dengue virus
IALNDMGK

SEQ ID NO: 106874 - protein, 8 aa, Dengue virus
IQQWEPSK

SEQ ID NO: 106875 - protein, 8 aa, Dengue virus
QQWEPSKG

SEQ ID NO: 106876 - protein, 8 aa, Dengue virus
WEPSKGWK

SEQ ID NO: 106877 - protein, 8 aa, Dengue virus
EPSKGWKN

SEQ ID NO: 106878 - protein, 8 aa, Dengue virus
PSKGWKNW

SEQ ID NO: 106879 - protein, 8 aa, Dengue virus
GWKNWQEV

SEQ ID NO: 106880 - protein, 8 aa, Dengue virus
WKNWQEVP

SEQ ID NO: 106881 - protein, 8 aa, Dengue virus
KNWQEVPF

SEQ ID NO: 106882 - protein, 8 aa, Dengue virus
SHHFHKIF

SEQ ID NO: 106883 - protein, 8 aa, Dengue virus
HHFHKIFM

SEQ ID NO: 106884 - protein, 8 aa, Dengue virus
HFHKIFMK

SEQ ID NO: 106885 - protein, 8 aa, Dengue virus
FHKIFMKD

SEQ ID NO: 106886 - protein, 8 aa, Dengue virus
HKIFMKDG

SEQ ID NO: 106887 - protein, 8 aa, Dengue virus
KIFMKDGR

SEQ ID NO: 106888 - protein, 8 aa, Dengue virus
KSYAQMWT

SEQ ID NO: 106889 - protein, 8 aa, Dengue virus
SYAQMWTL

SEQ ID NO: 106890 - protein, 8 aa, Dengue virus
YAQMWALM

SEQ ID NO: 106891 - protein, 8 aa, Dengue virus
AQMWALMY

SEQ ID NO: 106892 - protein, 8 aa, Dengue virus
QMWALMYF

SEQ ID NO: 106893 - protein, 8 aa, Dengue virus
MWALMYFH

SEQ ID NO: 106894 - protein, 8 aa, Dengue virus
WALMYFHR

SEQ ID NO: 106895 - protein, 8 aa, Dengue virus
ALMYFHRR

SEQ ID NO: 106896 - protein, 8 aa, Dengue virus
AICSAVPP

SEQ ID NO: 106897 - protein, 8 aa, Dengue virus
EWFPTSRT

SEQ ID NO: 106898 - protein, 8 aa, Dengue virus
TTWSIHAS

SEQ ID NO: 106899 - protein, 8 aa, Dengue virus
TWSIHASH

SEQ ID NO: 106900 - protein, 8 aa, Dengue virus
WSIHASHE

SEQ ID NO: 106901 - protein, 8 aa, Dengue virus
SIHASHEW

SEQ ID NO: 106902 - protein, 8 aa, Dengue virus
IHASHEWM

SEQ ID NO: 106903 - protein, 8 aa, Dengue virus
HASHEWMT

SEQ ID NO: 106904 - protein, 8 aa, Dengue virus
ASHEWMTT

SEQ ID NO: 106905 - protein, 8 aa, Dengue virus
SHEWMTTE

SEQ ID NO: 106906 - protein, 8 aa, Dengue virus
MTTEDMLK

SEQ ID NO: 106907 - protein, 8 aa, Dengue virus
TTEDMLKV

SEQ ID NO: 106908 - protein, 8 aa, Dengue virus
TEDMLKVW

SEQ ID NO: 106909 - protein, 8 aa, Dengue virus
EDMLKVWN

SEQ ID NO: 106910 - protein, 8 aa, Dengue virus
DMLKVWNR

SEQ ID NO: 106911 - protein, 8 aa, Dengue virus
MLKVWNRV

SEQ ID NO: 106912 - protein, 8 aa, Dengue virus
LKVWNRVW

SEQ ID NO: 106913 - protein, 8 aa, Dengue virus
KVWNRVWI

SEQ ID NO: 106914 - protein, 8 aa, Dengue virus
VWNRVWIL

SEQ ID NO: 106915 - protein, 8 aa, Dengue virus
DNPNMTDK

SEQ ID NO: 106916 - protein, 8 aa, Dengue virus
NVPYLGKR

SEQ ID NO: 106917 - protein, 8 aa, Dengue virus
TARATWAS

SEQ ID NO: 106918 - protein, 8 aa, Dengue virus
ARATWASN

SEQ ID NO: 106919 - protein, 8 aa, Dengue virus
RATWASNI

SEQ ID NO: 106920 - protein, 8 aa, Dengue virus
AITQVRNL

SEQ ID NO: 106921 - protein, 8 aa, Dengue virus
DYMPAMKR

SEQ ID NO: 106922 - protein, 8 aa, Dengue virus
YMISMKRF

SEQ ID NO: 106923 - protein, 8 aa, Dengue virus
RNRVSTIQ

SEQ ID NO: 106924 - protein, 8 aa, Dengue virus
NRVSTIQQ

SEQ ID NO: 106925 - protein, 8 aa, Dengue virus
RVSTIQQL

SEQ ID NO: 106926 - protein, 8 aa, Dengue virus
VSTIQQLT

SEQ ID NO: 106927 - protein, 8 aa, Dengue virus
STIQQLTK

SEQ ID NO: 106928 - protein, 8 aa, Dengue virus
TIQQLTKR

SEQ ID NO: 106929 - protein, 8 aa, Dengue virus
IQQLTKRF

SEQ ID NO: 106930 - protein, 8 aa, Dengue virus
RFSTGLFS

SEQ ID NO: 106931 - protein, 8 aa, Dengue virus
FSTGLFSG

SEQ ID NO: 106932 - protein, 8 aa, Dengue virus
STGLFSGK

SEQ ID NO: 106933 - protein, 8 aa, Dengue virus
TGLFSGKG

SEQ ID NO: 106934 - protein, 8 aa, Dengue virus
GQGPMKFV

SEQ ID NO: 106935 - protein, 8 aa, Dengue virus
QGPMKFVM

SEQ ID NO: 106936 - protein, 8 aa, Dengue virus
PLKLFMAF

SEQ ID NO: 106937 - protein, 8 aa, Dengue virus
KFVMAFIA

SEQ ID NO: 106938 - protein, 8 aa, Dengue virus
LFMAFVAF

SEQ ID NO: 106939 - protein, 8 aa, Dengue virus
GFKREISN

SEQ ID NO: 106940 - protein, 8 aa, Dengue virus
FKREISNM

SEQ ID NO: 106941 - protein, 8 aa, Dengue virus
KREISNML

SEQ ID NO: 106942 - protein, 8 aa, Dengue virus
TFHLTTRG

SEQ ID NO: 106943 - protein, 8 aa, Dengue virus
KSLLFKTK

SEQ ID NO: 106944 - protein, 8 aa, Dengue virus
IAMDLGEF

SEQ ID NO: 106945 - protein, 8 aa, Dengue virus
MDLGEMCE

SEQ ID NO: 106946 - protein, 8 aa, Dengue virus
DCWCNTTD

SEQ ID NO: 106947 - protein, 8 aa, Dengue virus
CWCNTTDT

SEQ ID NO: 106948 - protein, 8 aa, Dengue virus
WCNTTDTW

SEQ ID NO: 106949 - protein, 8 aa, Dengue virus
SEGAWRQI

SEQ ID NO: 106950 - protein, 8 aa, Dengue virus
EGAWRQIQ

SEQ ID NO: 106951 - protein, 8 aa, Dengue virus
IETWVLRH

SEQ ID NO: 106952 - protein, 8 aa, Dengue virus
ETWVLRHP

SEQ ID NO: 106953 - protein, 8 aa, Dengue virus
TWVLRHPG

SEQ ID NO: 106954 - protein, 8 aa, Dengue virus
WVLRHPGF

SEQ ID NO: 106955 - protein, 8 aa, Dengue virus
VLRHPGFT

SEQ ID NO: 106956 - protein, 8 aa, Dengue virus
IAPSMTMR

SEQ ID NO: 106957 - protein, 8 aa, Dengue virus
MRCIGMSN

SEQ ID NO: 106958 - protein, 8 aa, Dengue virus
RCIGMSNR

SEQ ID NO: 106959 - protein, 8 aa, Dengue virus
CIGMSNRD

SEQ ID NO: 106960 - protein, 8 aa, Dengue virus
IGMSNRDF

SEQ ID NO: 106961 - protein, 8 aa, Dengue virus
KSKPTLDI

SEQ ID NO: 106962 - protein, 8 aa, Dengue virus
SKPTLDIE

SEQ ID NO: 106963 - protein, 8 aa, Dengue virus
ELIKTTAK

SEQ ID NO: 106964 - protein, 8 aa, Dengue virus
LRKFCIEA

SEQ ID NO: 106965 - protein, 8 aa, Dengue virus
CIEALISN

SEQ ID NO: 106966 - protein, 8 aa, Dengue virus
CRHSMVDR

SEQ ID NO: 106967 - protein, 8 aa, Dengue virus
RHSMVDRG

SEQ ID NO: 106968 - protein, 8 aa, Dengue virus
LFGKGGVV

SEQ ID NO: 106969 - protein, 8 aa, Dengue virus
FGKGGVVT

SEQ ID NO: 106970 - protein, 8 aa, Dengue virus
GKGGVVTC

SEQ ID NO: 106971 - protein, 8 aa, Dengue virus
KGGVVTCA

SEQ ID NO: 106972 - protein, 8 aa, Dengue virus
GGVVTCAK

SEQ ID NO: 106973 - protein, 8 aa, Dengue virus
GVVTCAKF

SEQ ID NO: 106974 - protein, 8 aa, Dengue virus
VQIENLEY

SEQ ID NO: 106975 - protein, 8 aa, Dengue virus
VVTVHNGD

SEQ ID NO: 106976 - protein, 8 aa, Dengue virus
VTVHNGDT

SEQ ID NO: 106977 - protein, 8 aa, Dengue virus
EENAVGND

SEQ ID NO: 106978 - protein, 8 aa, Dengue virus
EMVLLQMK

SEQ ID NO: 106979 - protein, 8 aa, Dengue virus
DLPLPWTT

SEQ ID NO: 106980 - protein, 8 aa, Dengue virus
LPLPWTTG

SEQ ID NO: 106981 - protein, 8 aa, Dengue virus
PLPWTTGA

SEQ ID NO: 106982 - protein, 8 aa, Dengue virus
KERMVTFK

SEQ ID NO: 106983 - protein, 8 aa, Dengue virus
EIQTSGGT

SEQ ID NO: 106984 - protein, 8 aa, Dengue virus
LGNILFMG

SEQ ID NO: 106985 - protein, 8 aa, Dengue virus
GNILFMGH

SEQ ID NO: 106986 - protein, 8 aa, Dengue virus
NILFMGHL

SEQ ID NO: 106987 - protein, 8 aa, Dengue virus
ILFMGHLK

SEQ ID NO: 106988 - protein, 8 aa, Dengue virus
KMDKLTLR

SEQ ID NO: 106989 - protein, 8 aa, Dengue virus
MDKLTLRG

SEQ ID NO: 106990 - protein, 8 aa, Dengue virus
EKELAETQ

SEQ ID NO: 106991 - protein, 8 aa, Dengue virus
KELAETQH

SEQ ID NO: 106992 - protein, 8 aa, Dengue virus
ELAETQHG

SEQ ID NO: 106993 - protein, 8 aa, Dengue virus
LAETQHGT

SEQ ID NO: 106994 - protein, 8 aa, Dengue virus
TIGKMFEA

SEQ ID NO: 106995 - protein, 8 aa, Dengue virus
DFGSIGGL

SEQ ID NO: 106996 - protein, 8 aa, Dengue virus
FGAAYGVL

SEQ ID NO: 106997 - protein, 8 aa, Dengue virus
GAAYGVLF

SEQ ID NO: 106998 - protein, 8 aa, Dengue virus
AYTALFGG

SEQ ID NO: 106999 - protein, 8 aa, Dengue virus
YTALFGGV

SEQ ID NO: 107000 - protein, 8 aa, Dengue virus
TALFGGVS

SEQ ID NO: 107001 - protein, 8 aa, Dengue virus
FGGVSWMV

SEQ ID NO: 107002 - protein, 8 aa, Dengue virus
GGVSWMVR

SEQ ID NO: 107003 - protein, 8 aa, Dengue virus
VITWIGMN

SEQ ID NO: 107004 - protein, 8 aa, Dengue virus
LGLNSRSA

SEQ ID NO: 107005 - protein, 8 aa, Dengue virus
GLNSRNTS

SEQ ID NO: 107006 - protein, 8 aa, Dengue virus
NSRSASLS

SEQ ID NO: 107007 - protein, 8 aa, Dengue virus
TLYLGTVV

SEQ ID NO: 107008 - protein, 8 aa, Dengue virus
LYLGTVVQ

SEQ ID NO: 107009 - protein, 8 aa, Dengue virus
YLGTVVQA

SEQ ID NO: 107010 - protein, 8 aa, Dengue virus
LGTVVQAD

SEQ ID NO: 107011 - protein, 8 aa, Dengue virus
VQADSGCI

SEQ ID NO: 107012 - protein, 8 aa, Dengue virus
GNGIFVTN

SEQ ID NO: 107013 - protein, 8 aa, Dengue virus
NGIFVTNE

SEQ ID NO: 107014 - protein, 8 aa, Dengue virus
RLSAAIGR

SEQ ID NO: 107015 - protein, 8 aa, Dengue virus
ASAILNAH

SEQ ID NO: 107016 - protein, 8 aa, Dengue virus
EEDICGIR

SEQ ID NO: 107017 - protein, 8 aa, Dengue virus
STTRLENI

SEQ ID NO: 107018 - protein, 8 aa, Dengue virus
TTRLENIM

SEQ ID NO: 107019 - protein, 8 aa, Dengue virus
RLENIMWR

SEQ ID NO: 107020 - protein, 8 aa, Dengue virus
LENIMWRQ

SEQ ID NO: 107021 - protein, 8 aa, Dengue virus
ENIMWRQI

SEQ ID NO: 107022 - protein, 8 aa, Dengue virus
TSELNHIL

SEQ ID NO: 107023 - protein, 8 aa, Dengue virus
ELNYVLWE

SEQ ID NO: 107024 - protein, 8 aa, Dengue virus
LNYVLWEG

SEQ ID NO: 107025 - protein, 8 aa, Dengue virus
RYSWKSWG

SEQ ID NO: 107026 - protein, 8 aa, Dengue virus
WRSWGKAK

SEQ ID NO: 107027 - protein, 8 aa, Dengue virus
TFLIDGPD

SEQ ID NO: 107028 - protein, 8 aa, Dengue virus
TNIWLKMR

SEQ ID NO: 107029 - protein, 8 aa, Dengue virus
KDDRAVHA

SEQ ID NO: 107030 - protein, 8 aa, Dengue virus
DDRAVHAD

SEQ ID NO: 107031 - protein, 8 aa, Dengue virus
DRAVHADM

SEQ ID NO: 107032 - protein, 8 aa, Dengue virus
MGYWIESR

SEQ ID NO: 107033 - protein, 8 aa, Dengue virus
GYWIESRL

SEQ ID NO: 107034 - protein, 8 aa, Dengue virus
YWIESRLN

SEQ ID NO: 107035 - protein, 8 aa, Dengue virus
ESRLNDTW

SEQ ID NO: 107036 - protein, 8 aa, Dengue virus
SRLNDTWK

SEQ ID NO: 107037 - protein, 8 aa, Dengue virus
KNQTWQIE

SEQ ID NO: 107038 - protein, 8 aa, Dengue virus
RASLIEVK

SEQ ID NO: 107039 - protein, 8 aa, Dengue virus
ASFIEIKS

SEQ ID NO: 107040 - protein, 8 aa, Dengue virus
SFIEIKSC

SEQ ID NO: 107041 - protein, 8 aa, Dengue virus
GGPTSQHN

SEQ ID NO: 107042 - protein, 8 aa, Dengue virus
CDGTTVVV

SEQ ID NO: 107043 - protein, 8 aa, Dengue virus
TMPPLRFL

SEQ ID NO: 107044 - protein, 8 aa, Dengue virus
MPPLRFLG

SEQ ID NO: 107045 - protein, 8 aa, Dengue virus
PPLRFLGE

SEQ ID NO: 107046 - protein, 8 aa, Dengue virus
PLRFLGED

SEQ ID NO: 107047 - protein, 8 aa, Dengue virus
LRFLGEDG

SEQ ID NO: 107048 - protein, 8 aa, Dengue virus
RFLGEDGC

SEQ ID NO: 107049 - protein, 8 aa, Dengue virus
FLGEDGCW

SEQ ID NO: 107050 - protein, 8 aa, Dengue virus
KEENLVSS

SEQ ID NO: 107051 - protein, 8 aa, Dengue virus
TEEVMRSR

SEQ ID NO: 107052 - protein, 8 aa, Dengue virus
EECLRRRV

SEQ ID NO: 107053 - protein, 8 aa, Dengue virus
ECLRRRVT

SEQ ID NO: 107054 - protein, 8 aa, Dengue virus
IGMGITYL

SEQ ID NO: 107055 - protein, 8 aa, Dengue virus
IHLAIMAV

SEQ ID NO: 107056 - protein, 8 aa, Dengue virus
LIRRLTSR

SEQ ID NO: 107057 - protein, 8 aa, Dengue virus
KLTSKELL

SEQ ID NO: 107058 - protein, 8 aa, Dengue virus
TSRETALM

SEQ ID NO: 107059 - protein, 8 aa, Dengue virus
SRETALMV

SEQ ID NO: 107060 - protein, 8 aa, Dengue virus
LELTDAIA

SEQ ID NO: 107061 - protein, 8 aa, Dengue virus
ELTDAIAL

SEQ ID NO: 107062 - protein, 8 aa, Dengue virus
LTDAIALG

SEQ ID NO: 107063 - protein, 8 aa, Dengue virus
TDAIALGI

SEQ ID NO: 107064 - protein, 8 aa, Dengue virus
DAIALGIM

SEQ ID NO: 107065 - protein, 8 aa, Dengue virus
LNEAVMAV

SEQ ID NO: 107066 - protein, 8 aa, Dengue virus
NEAVMAVG

SEQ ID NO: 107067 - protein, 8 aa, Dengue virus
GLVSLLGS

SEQ ID NO: 107068 - protein, 8 aa, Dengue virus
LVSLLGSA

SEQ ID NO: 107069 - protein, 8 aa, Dengue virus
ILLSALLK

SEQ ID NO: 107070 - protein, 8 aa, Dengue virus
LLSALLKN

SEQ ID NO: 107071 - protein, 8 aa, Dengue virus
LSALLKND

SEQ ID NO: 107072 - protein, 8 aa, Dengue virus
ADLIVEKA

SEQ ID NO: 107073 - protein, 8 aa, Dengue virus
MADITGSS

SEQ ID NO: 107074 - protein, 8 aa, Dengue virus
ADITGSSP

SEQ ID NO: 107075 - protein, 8 aa, Dengue virus
DITGSSPI

SEQ ID NO: 107076 - protein, 8 aa, Dengue virus
ITGSSPII

SEQ ID NO: 107077 - protein, 8 aa, Dengue virus
TGSSPIIE

SEQ ID NO: 107078 - protein, 8 aa, Dengue virus
AEDGSMSI

SEQ ID NO: 107079 - protein, 8 aa, Dengue virus
IKNEEEEH

SEQ ID NO: 107080 - protein, 8 aa, Dengue virus
TITILLKA

SEQ ID NO: 107081 - protein, 8 aa, Dengue virus
LKATLLAI

SEQ ID NO: 107082 - protein, 8 aa, Dengue virus
KATLLAIS

SEQ ID NO: 107083 - protein, 8 aa, Dengue virus
ATLLAISG

SEQ ID NO: 107084 - protein, 8 aa, Dengue virus
QTRRSGVL

SEQ ID NO: 107085 - protein, 8 aa, Dengue virus
WDTPSPPK

SEQ ID NO: 107086 - protein, 8 aa, Dengue virus
ATLSEGVY

SEQ ID NO: 107087 - protein, 8 aa, Dengue virus
TLSEGVYR

SEQ ID NO: 107088 - protein, 8 aa, Dengue virus
SEGVYRIM

SEQ ID NO: 107089 - protein, 8 aa, Dengue virus
EGVYRIMQ

SEQ ID NO: 107090 - protein, 8 aa, Dengue virus
YRILQRGL

SEQ ID NO: 107091 - protein, 8 aa, Dengue virus
LGKTQVGV

SEQ ID NO: 107092 - protein, 8 aa, Dengue virus
VGVGIHME

SEQ ID NO: 107093 - protein, 8 aa, Dengue virus
TRGSVICH

SEQ ID NO: 107094 - protein, 8 aa, Dengue virus
ETGRLEPS

SEQ ID NO: 107095 - protein, 8 aa, Dengue virus
PNWANVKK

SEQ ID NO: 107096 - protein, 8 aa, Dengue virus
NWANVKKD

SEQ ID NO: 107097 - protein, 8 aa, Dengue virus
ADVKKDLV

SEQ ID NO: 107098 - protein, 8 aa, Dengue virus
DVRKDLIS

SEQ ID NO: 107099 - protein, 8 aa, Dengue virus
WNAGEEVQ

SEQ ID NO: 107100 - protein, 8 aa, Dengue virus
NAGEEVQV

SEQ ID NO: 107101 - protein, 8 aa, Dengue virus
AGTIGAVS

SEQ ID NO: 107102 - protein, 8 aa, Dengue virus
SGSPIVDK

SEQ ID NO: 107103 - protein, 8 aa, Dengue virus
GVVTRSGT

SEQ ID NO: 107104 - protein, 8 aa, Dengue virus
VVTRSGTY

SEQ ID NO: 107105 - protein, 8 aa, Dengue virus
VTRSGTYV

SEQ ID NO: 107106 - protein, 8 aa, Dengue virus
TRSGTYVS

SEQ ID NO: 107107 - protein, 8 aa, Dengue virus
SGTYVSSI

SEQ ID NO: 107108 - protein, 8 aa, Dengue virus
VFKKRNLT

SEQ ID NO: 107109 - protein, 8 aa, Dengue virus
TRRYLPAM

SEQ ID NO: 107110 - protein, 8 aa, Dengue virus
RYLPAMVR

SEQ ID NO: 107111 - protein, 8 aa, Dengue virus
AIVREAIR

SEQ ID NO: 107112 - protein, 8 aa, Dengue virus
MVREAIKR

SEQ ID NO: 107113 - protein, 8 aa, Dengue virus
REAIRRGL

SEQ ID NO: 107114 - protein, 8 aa, Dengue virus
EAIRRGLR

SEQ ID NO: 107115 - protein, 8 aa, Dengue virus
AIRRGLRT

SEQ ID NO: 107116 - protein, 8 aa, Dengue virus
IRRGLRTL

SEQ ID NO: 107117 - protein, 8 aa, Dengue virus
RRGLRTLI

SEQ ID NO: 107118 - protein, 8 aa, Dengue virus
IRYQTTAI

SEQ ID NO: 107119 - protein, 8 aa, Dengue virus
KAEHTGRE

SEQ ID NO: 107120 - protein, 8 aa, Dengue virus
IQDEEKDI

SEQ ID NO: 107121 - protein, 8 aa, Dengue virus
QDEEKDIP

SEQ ID NO: 107122 - protein, 8 aa, Dengue virus
ERSWSSGH

SEQ ID NO: 107123 - protein, 8 aa, Dengue virus
YQGKTVWF

SEQ ID NO: 107124 - protein, 8 aa, Dengue virus
QGKTVWFV

SEQ ID NO: 107125 - protein, 8 aa, Dengue virus
KTFDSEYA

SEQ ID NO: 107126 - protein, 8 aa, Dengue virus
TFDSEYAK

SEQ ID NO: 107127 - protein, 8 aa, Dengue virus
FDTEYTKT

SEQ ID NO: 107128 - protein, 8 aa, Dengue virus
LTDWDFVV

SEQ ID NO: 107129 - protein, 8 aa, Dengue virus
MGANFRAE

SEQ ID NO: 107130 - protein, 8 aa, Dengue virus
GANFRAER

SEQ ID NO: 107131 - protein, 8 aa, Dengue virus
ANFRAERV

SEQ ID NO: 107132 - protein, 8 aa, Dengue virus
NFRAERVI

SEQ ID NO: 107133 - protein, 8 aa, Dengue virus
FRAERVID

SEQ ID NO: 107134 - protein, 8 aa, Dengue virus
RAERVIDP

SEQ ID NO: 107135 - protein, 8 aa, Dengue virus
PDGPERVI

SEQ ID NO: 107136 - protein, 8 aa, Dengue virus
QEDDQYVF

SEQ ID NO: 107137 - protein, 8 aa, Dengue virus
EDDQYVFS

SEQ ID NO: 107138 - protein, 8 aa, Dengue virus
DDQYVFSG

SEQ ID NO: 107139 - protein, 8 aa, Dengue virus
DQYVFSGD

SEQ ID NO: 107140 - protein, 8 aa, Dengue virus
QYVFSGDP

SEQ ID NO: 107141 - protein, 8 aa, Dengue virus
YVFSGDPL

SEQ ID NO: 107142 - protein, 8 aa, Dengue virus
FMGQPLNN

SEQ ID NO: 107143 - protein, 8 aa, Dengue virus
WLAYKVAS

SEQ ID NO: 107144 - protein, 8 aa, Dengue virus
VASEGINY

SEQ ID NO: 107145 - protein, 8 aa, Dengue virus
EGINYTDR

SEQ ID NO: 107146 - protein, 8 aa, Dengue virus
YKDREWCF

SEQ ID NO: 107147 - protein, 8 aa, Dengue virus
KDREWCFT

SEQ ID NO: 107148 - protein, 8 aa, Dengue virus
MEVEVWTK

SEQ ID NO: 107149 - protein, 8 aa, Dengue virus
AAGRKSLA

SEQ ID NO: 107150 - protein, 8 aa, Dengue virus
AGRKSLAL

SEQ ID NO: 107151 - protein, 8 aa, Dengue virus
LSLITEMG

SEQ ID NO: 107152 - protein, 8 aa, Dengue virus
SLITEMGR

SEQ ID NO: 107153 - protein, 8 aa, Dengue virus
TEIGRVPT

SEQ ID NO: 107154 - protein, 8 aa, Dengue virus
EIGRVPTH

SEQ ID NO: 107155 - protein, 8 aa, Dengue virus
IGRVPTHL

SEQ ID NO: 107156 - protein, 8 aa, Dengue virus
GRVPTHLA

SEQ ID NO: 107157 - protein, 8 aa, Dengue virus
KLALDNIV

SEQ ID NO: 107158 - protein, 8 aa, Dengue virus
AYTHALSE

SEQ ID NO: 107159 - protein, 8 aa, Dengue virus
YTHALSEL

SEQ ID NO: 107160 - protein, 8 aa, Dengue virus
THALSELP

SEQ ID NO: 107161 - protein, 8 aa, Dengue virus
LETLLLLG

SEQ ID NO: 107162 - protein, 8 aa, Dengue virus
TLLLLGLL

SEQ ID NO: 107163 - protein, 8 aa, Dengue virus
LLLLGLLA

SEQ ID NO: 107164 - protein, 8 aa, Dengue virus
LTGGVMLF

SEQ ID NO: 107165 - protein, 8 aa, Dengue virus
TGGVMLFL

SEQ ID NO: 107166 - protein, 8 aa, Dengue virus
GVMLFLIS

SEQ ID NO: 107167 - protein, 8 aa, Dengue virus
KLSMGLIA

SEQ ID NO: 107168 - protein, 8 aa, Dengue virus
LSMGLIAI

SEQ ID NO: 107169 - protein, 8 aa, Dengue virus
IQPQWIAA

SEQ ID NO: 107170 - protein, 8 aa, Dengue virus
LTYVIIAI

SEQ ID NO: 107171 - protein, 8 aa, Dengue virus
TYVIIAIL

SEQ ID NO: 107172 - protein, 8 aa, Dengue virus
YVIIAILT

SEQ ID NO: 107173 - protein, 8 aa, Dengue virus
LEKTKKDF

SEQ ID NO: 107174 - protein, 8 aa, Dengue virus
EKTKKDFG

SEQ ID NO: 107175 - protein, 8 aa, Dengue virus
YAVATTFI

SEQ ID NO: 107176 - protein, 8 aa, Dengue virus
AVATTFIT

SEQ ID NO: 107177 - protein, 8 aa, Dengue virus
VATTFITP

SEQ ID NO: 107178 - protein, 8 aa, Dengue virus
ATTFITPM

SEQ ID NO: 107179 - protein, 8 aa, Dengue virus
ITPMLRHS

SEQ ID NO: 107180 - protein, 8 aa, Dengue virus
TVLMGLGR

SEQ ID NO: 107181 - protein, 8 aa, Dengue virus
NPLTLTAV

SEQ ID NO: 107182 - protein, 8 aa, Dengue virus
PLTLTAVV

SEQ ID NO: 107183 - protein, 8 aa, Dengue virus
LIAHYAII

SEQ ID NO: 107184 - protein, 8 aa, Dengue virus
IAHYAIIG

SEQ ID NO: 107185 - protein, 8 aa, Dengue virus
NPTVDGVT

SEQ ID NO: 107186 - protein, 8 aa, Dengue virus
PTVDGVTV

SEQ ID NO: 107187 - protein, 8 aa, Dengue virus
TVDGVTVI

SEQ ID NO: 107188 - protein, 8 aa, Dengue virus
DGIVTIDL

SEQ ID NO: 107189 - protein, 8 aa, Dengue virus
VTIDLDPV

SEQ ID NO: 107190 - protein, 8 aa, Dengue virus
VIDLEPIS

SEQ ID NO: 107191 - protein, 8 aa, Dengue virus
IDLEPISY

SEQ ID NO: 107192 - protein, 8 aa, Dengue virus
DLEPISYD

SEQ ID NO: 107193 - protein, 8 aa, Dengue virus
LMRTSWAF

SEQ ID NO: 107194 - protein, 8 aa, Dengue virus
TSWAFCEA

SEQ ID NO: 107195 - protein, 8 aa, Dengue virus
SWAFCEAL

SEQ ID NO: 107196 - protein, 8 aa, Dengue virus
TLATGPVS

SEQ ID NO: 107197 - protein, 8 aa, Dengue virus
LATGPVST

SEQ ID NO: 107198 - protein, 8 aa, Dengue virus
ATGPVSTL

SEQ ID NO: 107199 - protein, 8 aa, Dengue virus
TGPVSTLW

SEQ ID NO: 107200 - protein, 8 aa, Dengue virus
GPVSTLWE

SEQ ID NO: 107201 - protein, 8 aa, Dengue virus
PVSTLWEG

SEQ ID NO: 107202 - protein, 8 aa, Dengue virus
VSTLWEGN

SEQ ID NO: 107203 - protein, 8 aa, Dengue virus
GLLFSIMR

SEQ ID NO: 107204 - protein, 8 aa, Dengue virus
LFSIMRNT

SEQ ID NO: 107205 - protein, 8 aa, Dengue virus
VGETLGEK

SEQ ID NO: 107206 - protein, 8 aa, Dengue virus
SGIIEVDR

SEQ ID NO: 107207 - protein, 8 aa, Dengue virus
EGLRRGET

SEQ ID NO: 107208 - protein, 8 aa, Dengue virus
IKHAVSRG

SEQ ID NO: 107209 - protein, 8 aa, Dengue virus
HHAVSRGT

SEQ ID NO: 107210 - protein, 8 aa, Dengue virus
CGGLKDVR

SEQ ID NO: 107211 - protein, 8 aa, Dengue virus
GGLKDVRE

SEQ ID NO: 107212 - protein, 8 aa, Dengue virus
GLKDVREV

SEQ ID NO: 107213 - protein, 8 aa, Dengue virus
GWNLVKLM

SEQ ID NO: 107214 - protein, 8 aa, Dengue virus
WNLVKLMS

SEQ ID NO: 107215 - protein, 8 aa, Dengue virus
NLVKLMSG

SEQ ID NO: 107216 - protein, 8 aa, Dengue virus
LYSGKDVF

SEQ ID NO: 107217 - protein, 8 aa, Dengue virus
YSGKDVFF

SEQ ID NO: 107218 - protein, 8 aa, Dengue virus
SSNPTIEE

SEQ ID NO: 107219 - protein, 8 aa, Dengue virus
SNPTIEEG

SEQ ID NO: 107220 - protein, 8 aa, Dengue virus
SLVENWLN

SEQ ID NO: 107221 - protein, 8 aa, Dengue virus
FGGALVRN

SEQ ID NO: 107222 - protein, 8 aa, Dengue virus
MYWVSGAS

SEQ ID NO: 107223 - protein, 8 aa, Dengue virus
YWVSGASG

SEQ ID NO: 107224 - protein, 8 aa, Dengue virus
WVSGASGN

SEQ ID NO: 107225 - protein, 8 aa, Dengue virus
VSGASGNI

SEQ ID NO: 107226 - protein, 8 aa, Dengue virus
SGASGNIV

SEQ ID NO: 107227 - protein, 8 aa, Dengue virus
GTGNIVSS

SEQ ID NO: 107228 - protein, 8 aa, Dengue virus
IVSSVNTT

SEQ ID NO: 107229 - protein, 8 aa, Dengue virus
VSSVNTTS

SEQ ID NO: 107230 - protein, 8 aa, Dengue virus
SSVNTTSK

SEQ ID NO: 107231 - protein, 8 aa, Dengue virus
LLNRFTTR

SEQ ID NO: 107232 - protein, 8 aa, Dengue virus
PTFERDVD

SEQ ID NO: 107233 - protein, 8 aa, Dengue virus
TFERDVDL

SEQ ID NO: 107234 - protein, 8 aa, Dengue virus
FERDVDLG

SEQ ID NO: 107235 - protein, 8 aa, Dengue virus
GTGTRHVA

SEQ ID NO: 107236 - protein, 8 aa, Dengue virus
TGTRHVAV

SEQ ID NO: 107237 - protein, 8 aa, Dengue virus
PNMDIIGK

SEQ ID NO: 107238 - protein, 8 aa, Dengue virus
NMDIIGKR

SEQ ID NO: 107239 - protein, 8 aa, Dengue virus
MDIIGKRI

SEQ ID NO: 107240 - protein, 8 aa, Dengue virus
DVIGERIR

SEQ ID NO: 107241 - protein, 8 aa, Dengue virus
VIGERIRR

SEQ ID NO: 107242 - protein, 8 aa, Dengue virus
IGERIRRI

SEQ ID NO: 107243 - protein, 8 aa, Dengue virus
GERIRRIK

SEQ ID NO: 107244 - protein, 8 aa, Dengue virus
ISWHYDQD

SEQ ID NO: 107245 - protein, 8 aa, Dengue virus
WDVVPMVI

SEQ ID NO: 107246 - protein, 8 aa, Dengue virus
DVVPMVIQ

SEQ ID NO: 107247 - protein, 8 aa, Dengue virus
CTREEFIR

SEQ ID NO: 107248 - protein, 8 aa, Dengue virus
TREEFIRK

SEQ ID NO: 107249 - protein, 8 aa, Dengue virus
REEFIRKV

SEQ ID NO: 107250 - protein, 8 aa, Dengue virus
EEFIRKVR

SEQ ID NO: 107251 - protein, 8 aa, Dengue virus
AALGAVFT

SEQ ID NO: 107252 - protein, 8 aa, Dengue virus
ALGAVFTD

SEQ ID NO: 107253 - protein, 8 aa, Dengue virus
LGAVFTDE

SEQ ID NO: 107254 - protein, 8 aa, Dengue virus
GAVFTDEN

SEQ ID NO: 107255 - protein, 8 aa, Dengue virus
AVFTDENK

SEQ ID NO: 107256 - protein, 8 aa, Dengue virus
VFTDENKW

SEQ ID NO: 107257 - protein, 8 aa, Dengue virus
EQGWTSAS

SEQ ID NO: 107258 - protein, 8 aa, Dengue virus
QGWTSASE

SEQ ID NO: 107259 - protein, 8 aa, Dengue virus
GWTSASEA

SEQ ID NO: 107260 - protein, 8 aa, Dengue virus
WTSASEAV

SEQ ID NO: 107261 - protein, 8 aa, Dengue virus
TSASEAVN

SEQ ID NO: 107262 - protein, 8 aa, Dengue virus
SASEAVND

SEQ ID NO: 107263 - protein, 8 aa, Dengue virus
NLHLDGKC

SEQ ID NO: 107264 - protein, 8 aa, Dengue virus
DGKCETCV

SEQ ID NO: 107265 - protein, 8 aa, Dengue virus
WFSRENSF

SEQ ID NO: 107266 - protein, 8 aa, Dengue virus
FSRENSFS

SEQ ID NO: 107267 - protein, 8 aa, Dengue virus
SRENSFSG

SEQ ID NO: 107268 - protein, 8 aa, Dengue virus
RENSFSGV

SEQ ID NO: 107269 - protein, 8 aa, Dengue virus
ENSFSGVE

SEQ ID NO: 107270 - protein, 8 aa, Dengue virus
KLGYILRE

SEQ ID NO: 107271 - protein, 8 aa, Dengue virus
VRVQRPAR

SEQ ID NO: 107272 - protein, 8 aa, Dengue virus
RQMEGEGL

SEQ ID NO: 107273 - protein, 8 aa, Dengue virus
ERLARMAI

SEQ ID NO: 107274 - protein, 8 aa, Dengue virus
CVVKPVDD

SEQ ID NO: 107275 - protein, 8 aa, Dengue virus
VVKPVDDR

SEQ ID NO: 107276 - protein, 8 aa, Dengue virus
VKPVDDRF

SEQ ID NO: 107277 - protein, 8 aa, Dengue virus
ALSALNDM

SEQ ID NO: 107278 - protein, 8 aa, Dengue virus
LSALNDMG

SEQ ID NO: 107279 - protein, 8 aa, Dengue virus
SALNDMGK

SEQ ID NO: 107280 - protein, 8 aa, Dengue virus
WEPSKGWS

SEQ ID NO: 107281 - protein, 8 aa, Dengue virus
EPSKGWSD

SEQ ID NO: 107282 - protein, 8 aa, Dengue virus
PSKGWSDW

SEQ ID NO: 107283 - protein, 8 aa, Dengue virus
GWSDWTQV

SEQ ID NO: 107284 - protein, 8 aa, Dengue virus
WSDWTQVP

SEQ ID NO: 107285 - protein, 8 aa, Dengue virus
SDWTQVPF

SEQ ID NO: 107286 - protein, 8 aa, Dengue virus
KAYAQMWA

SEQ ID NO: 107287 - protein, 8 aa, Dengue virus
AYAQMWAL

SEQ ID NO: 107288 - protein, 8 aa, Dengue virus
AICSAVPA

SEQ ID NO: 107289 - protein, 8 aa, Dengue virus
HWIPTSRT

SEQ ID NO: 107290 - protein, 8 aa, Dengue virus
DIPYLGKR

SEQ ID NO: 107291 - protein, 8 aa, Dengue virus
SSRATWAK

SEQ ID NO: 107292 - protein, 8 aa, Dengue virus
AINQVRAL

SEQ ID NO: 107293 - protein, 9 aa, Dengue virus
PSFNMLKRA

SEQ ID NO: 107294 - protein, 9 aa, Dengue virus
SFNMLKRAR

SEQ ID NO: 107295 - protein, 9 aa, Dengue virus
FNMLKRARN

SEQ ID NO: 107296 - protein, 9 aa, Dengue virus
NMLKRARNR

SEQ ID NO: 107297 - protein, 9 aa, Dengue virus
MLKRARNRV

SEQ ID NO: 107298 - protein, 9 aa, Dengue virus
LKRARNRVS

SEQ ID NO: 107299 - protein, 9 aa, Dengue virus
KRARNRVST

SEQ ID NO: 107300 - protein, 9 aa, Dengue virus
RNRVSTVSQ

SEQ ID NO: 107301 - protein, 9 aa, Dengue virus
NRVSTVSQL

SEQ ID NO: 107302 - protein, 9 aa, Dengue virus
RVSTVSQLA

SEQ ID NO: 107303 - protein, 9 aa, Dengue virus
VSTVSQLAK

SEQ ID NO: 107304 - protein, 9 aa, Dengue virus
STVSQLAKR

SEQ ID NO: 107305 - protein, 9 aa, Dengue virus
TVSQLAKRF

SEQ ID NO: 107306 - protein, 9 aa, Dengue virus
VSQLAKRFS

SEQ ID NO: 107307 - protein, 9 aa, Dengue virus
SQLAKRFSK

SEQ ID NO: 107308 - protein, 9 aa, Dengue virus
QLAKRFSKG

SEQ ID NO: 107309 - protein, 9 aa, Dengue virus
LAKRFSKGL

SEQ ID NO: 107310 - protein, 9 aa, Dengue virus
AKRFSKGLL

SEQ ID NO: 107311 - protein, 9 aa, Dengue virus
KRFSKGLLS

SEQ ID NO: 107312 - protein, 9 aa, Dengue virus
RFSKGLLSG

SEQ ID NO: 107313 - protein, 9 aa, Dengue virus
FSKGLLSGQ

SEQ ID NO: 107314 - protein, 9 aa, Dengue virus
SKGLLSGQG

SEQ ID NO: 107315 - protein, 9 aa, Dengue virus
KGLLSGQGP

SEQ ID NO: 107316 - protein, 9 aa, Dengue virus
GLLSGQGPM

SEQ ID NO: 107317 - protein, 9 aa, Dengue virus
LLSGQGPMK

SEQ ID NO: 107318 - protein, 9 aa, Dengue virus
GQGPMKLVM

SEQ ID NO: 107319 - protein, 9 aa, Dengue virus
QGPMKLVMA

SEQ ID NO: 107320 - protein, 9 aa, Dengue virus
GPMKLVMAF

SEQ ID NO: 107321 - protein, 9 aa, Dengue virus
LVMAFIAFL

SEQ ID NO: 107322 - protein, 9 aa, Dengue virus
VMAFIAFLR

SEQ ID NO: 107323 - protein, 9 aa, Dengue virus
MAFIAFLRF

SEQ ID NO: 107324 - protein, 9 aa, Dengue virus
AFIAFLRFL

SEQ ID NO: 107325 - protein, 9 aa, Dengue virus
FIAFLRFLA

SEQ ID NO: 107326 - protein, 9 aa, Dengue virus
IAFLRFLAI

SEQ ID NO: 107327 - protein, 9 aa, Dengue virus
AFLRFLAIP

SEQ ID NO: 107328 - protein, 9 aa, Dengue virus
FLRFLAIPP

SEQ ID NO: 107329 - protein, 9 aa, Dengue virus
LRFLAIPPT

SEQ ID NO: 107330 - protein, 9 aa, Dengue virus
RFLAIPPTA

SEQ ID NO: 107331 - protein, 9 aa, Dengue virus
FLAIPPTAG

SEQ ID NO: 107332 - protein, 9 aa, Dengue virus
LAIPPTAGI

SEQ ID NO: 107333 - protein, 9 aa, Dengue virus
AIPPTAGIL

SEQ ID NO: 107334 - protein, 9 aa, Dengue virus
IPPTAGILA

SEQ ID NO: 107335 - protein, 9 aa, Dengue virus
PPTAGILAR

SEQ ID NO: 107336 - protein, 9 aa, Dengue virus
PTAGILARW

SEQ ID NO: 107337 - protein, 9 aa, Dengue virus
TAGILARWG

SEQ ID NO: 107338 - protein, 9 aa, Dengue virus
GFKKEISNM

SEQ ID NO: 107339 - protein, 9 aa, Dengue virus
FKKEISNML

SEQ ID NO: 107340 - protein, 9 aa, Dengue virus
AFHLTTRGG

SEQ ID NO: 107341 - protein, 9 aa, Dengue virus
FHLTTRGGE

SEQ ID NO: 107342 - protein, 9 aa, Dengue virus
HLTTRGGEP

SEQ ID NO: 107343 - protein, 9 aa, Dengue virus
LTTRGGEPH

SEQ ID NO: 107344 - protein, 9 aa, Dengue virus
TTRGGEPHM

SEQ ID NO: 107345 - protein, 9 aa, Dengue virus
TRGGEPHMI

SEQ ID NO: 107346 - protein, 9 aa, Dengue virus
RGGEPHMIV

SEQ ID NO: 107347 - protein, 9 aa, Dengue virus
QERGKSLLF

SEQ ID NO: 107348 - protein, 9 aa, Dengue virus
ERGKSLLFK

SEQ ID NO: 107349 - protein, 9 aa, Dengue virus
RGKSLLFKT

SEQ ID NO: 107350 - protein, 9 aa, Dengue virus
GKSLLFKTS

SEQ ID NO: 107351 - protein, 9 aa, Dengue virus
NMCTLIAMD

SEQ ID NO: 107352 - protein, 9 aa, Dengue virus
MCTLIAMDL

SEQ ID NO: 107353 - protein, 9 aa, Dengue virus
CTLIAMDLG

SEQ ID NO: 107354 - protein, 9 aa, Dengue virus
TLIAMDLGE

SEQ ID NO: 107355 - protein, 9 aa, Dengue virus
LIAMDLGEL

SEQ ID NO: 107356 - protein, 9 aa, Dengue virus
IAMDLGELC

SEQ ID NO: 107357 - protein, 9 aa, Dengue virus
AMDLGELCE

SEQ ID NO: 107358 - protein, 9 aa, Dengue virus
MDLGELCED

SEQ ID NO: 107359 - protein, 9 aa, Dengue virus
DLGELCEDT

SEQ ID NO: 107360 - protein, 9 aa, Dengue virus
EPEDIDCWC

SEQ ID NO: 107361 - protein, 9 aa, Dengue virus
PEDIDCWCN

SEQ ID NO: 107362 - protein, 9 aa, Dengue virus
DDVDCWCNA

SEQ ID NO: 107363 - protein, 9 aa, Dengue virus
DVDCWCNAT

SEQ ID NO: 107364 - protein, 9 aa, Dengue virus
VDCWCNATD

SEQ ID NO: 107365 - protein, 9 aa, Dengue virus
DCWCNATDT

SEQ ID NO: 107366 - protein, 9 aa, Dengue virus
CWCNATDTW

SEQ ID NO: 107367 - protein, 9 aa, Dengue virus
TSTWVTYGT

SEQ ID NO: 107368 - protein, 9 aa, Dengue virus
STWVTYGTC

SEQ ID NO: 107369 - protein, 9 aa, Dengue virus
TWVTYGTCS

SEQ ID NO: 107370 - protein, 9 aa, Dengue virus
GEHRRDKRS

SEQ ID NO: 107371 - protein, 9 aa, Dengue virus
EHRRDKRSV

SEQ ID NO: 107372 - protein, 9 aa, Dengue virus
HRRDKRSVA

SEQ ID NO: 107373 - protein, 9 aa, Dengue virus
RRDKRSVAL

SEQ ID NO: 107374 - protein, 9 aa, Dengue virus
RDKRSVALA

SEQ ID NO: 107375 - protein, 9 aa, Dengue virus
DKRSVALAP

SEQ ID NO: 107376 - protein, 9 aa, Dengue virus
KRSVALAPH

SEQ ID NO: 107377 - protein, 9 aa, Dengue virus
RSVALAPHV

SEQ ID NO: 107378 - protein, 9 aa, Dengue virus
SVALAPHVG

SEQ ID NO: 107379 - protein, 9 aa, Dengue virus
VALAPHVGL

SEQ ID NO: 107380 - protein, 9 aa, Dengue virus
ALAPHVGLG

SEQ ID NO: 107381 - protein, 9 aa, Dengue virus
LAPHVGLGL

SEQ ID NO: 107382 - protein, 9 aa, Dengue virus
APHVGLGLE

SEQ ID NO: 107383 - protein, 9 aa, Dengue virus
PHVGLGLET

SEQ ID NO: 107384 - protein, 9 aa, Dengue virus
HVGLGLETR

SEQ ID NO: 107385 - protein, 9 aa, Dengue virus
GLETRTETW

SEQ ID NO: 107386 - protein, 9 aa, Dengue virus
LETRTETWM

SEQ ID NO: 107387 - protein, 9 aa, Dengue virus
ETRTETWMS

SEQ ID NO: 107388 - protein, 9 aa, Dengue virus
TRTETWMSS

SEQ ID NO: 107389 - protein, 9 aa, Dengue virus
RTETWMSSE

SEQ ID NO: 107390 - protein, 9 aa, Dengue virus
TETWMSSEG

SEQ ID NO: 107391 - protein, 9 aa, Dengue virus
ETWMSSEGA

SEQ ID NO: 107392 - protein, 9 aa, Dengue virus
TWMSSEGAW

SEQ ID NO: 107393 - protein, 9 aa, Dengue virus
WMSSEGAWK

SEQ ID NO: 107394 - protein, 9 aa, Dengue virus
MSSEGAWKQ

SEQ ID NO: 107395 - protein, 9 aa, Dengue virus
SSEGAWKQI

SEQ ID NO: 107396 - protein, 9 aa, Dengue virus
SEGAWKQIQ

SEQ ID NO: 107397 - protein, 9 aa, Dengue virus
VETWALRHP

SEQ ID NO: 107398 - protein, 9 aa, Dengue virus
ETWALRHPG

SEQ ID NO: 107399 - protein, 9 aa, Dengue virus
TWALRHPGF

SEQ ID NO: 107400 - protein, 9 aa, Dengue virus
WALRHPGFT

SEQ ID NO: 107401 - protein, 9 aa, Dengue virus
VTPSMAMRC

SEQ ID NO: 107402 - protein, 9 aa, Dengue virus
TPSMAMRCV

SEQ ID NO: 107403 - protein, 9 aa, Dengue virus
PSMAMRCVG

SEQ ID NO: 107404 - protein, 9 aa, Dengue virus
MRCVGIGSR

SEQ ID NO: 107405 - protein, 9 aa, Dengue virus
RCVGIGSRD

SEQ ID NO: 107406 - protein, 9 aa, Dengue virus
CVGIGSRDF

SEQ ID NO: 107407 - protein, 9 aa, Dengue virus
VGIGSRDFV

SEQ ID NO: 107408 - protein, 9 aa, Dengue virus
GIGSRDFVE

SEQ ID NO: 107409 - protein, 9 aa, Dengue virus
IGSRDFVEG

SEQ ID NO: 107410 - protein, 9 aa, Dengue virus
GSRDFVEGL

SEQ ID NO: 107411 - protein, 9 aa, Dengue virus
NRDFVEGVS

SEQ ID NO: 107412 - protein, 9 aa, Dengue virus
RDFVEGLSG

SEQ ID NO: 107413 - protein, 9 aa, Dengue virus
DFVEGLSGA

SEQ ID NO: 107414 - protein, 9 aa, Dengue virus
FVEGLSGAT

SEQ ID NO: 107415 - protein, 9 aa, Dengue virus
VEGLSGATW

SEQ ID NO: 107416 - protein, 9 aa, Dengue virus
EGLSGATWV

SEQ ID NO: 107417 - protein, 9 aa, Dengue virus
GLSGATWVD

SEQ ID NO: 107418 - protein, 9 aa, Dengue virus
LSGATWVDV

SEQ ID NO: 107419 - protein, 9 aa, Dengue virus
SGATWVDVV

SEQ ID NO: 107420 - protein, 9 aa, Dengue virus
GATWVDVVL

SEQ ID NO: 107421 - protein, 9 aa, Dengue virus
ATWVDVVLE

SEQ ID NO: 107422 - protein, 9 aa, Dengue virus
TWVDVVLEH

SEQ ID NO: 107423 - protein, 9 aa, Dengue virus
WVDVVLEHG

SEQ ID NO: 107424 - protein, 9 aa, Dengue virus
VDVVLEHGS

SEQ ID NO: 107425 - protein, 9 aa, Dengue virus
DVVLEHGSC

SEQ ID NO: 107426 - protein, 9 aa, Dengue virus
VVLEHGSCV

SEQ ID NO: 107427 - protein, 9 aa, Dengue virus
VLEHGSCVT

SEQ ID NO: 107428 - protein, 9 aa, Dengue virus
LEHGSCVTT

SEQ ID NO: 107429 - protein, 9 aa, Dengue virus
EHGSCVTTM

SEQ ID NO: 107430 - protein, 9 aa, Dengue virus
HGSCVTTMA

SEQ ID NO: 107431 - protein, 9 aa, Dengue virus
GSCVTTMAK

SEQ ID NO: 107432 - protein, 9 aa, Dengue virus
SCVTTMAKN

SEQ ID NO: 107433 - protein, 9 aa, Dengue virus
CVTTMAKNK

SEQ ID NO: 107434 - protein, 9 aa, Dengue virus
VTTMAKNKP

SEQ ID NO: 107435 - protein, 9 aa, Dengue virus
TTMAKNKPT

SEQ ID NO: 107436 - protein, 9 aa, Dengue virus
TMAKNKPTL

SEQ ID NO: 107437 - protein, 9 aa, Dengue virus
MAKNKPTLD

SEQ ID NO: 107438 - protein, 9 aa, Dengue virus
AKDKPTLDI

SEQ ID NO: 107439 - protein, 9 aa, Dengue virus
KDKPTLDIE

SEQ ID NO: 107440 - protein, 9 aa, Dengue virus
DKPTLDIEL

SEQ ID NO: 107441 - protein, 9 aa, Dengue virus
KPTLDIELL

SEQ ID NO: 107442 - protein, 9 aa, Dengue virus
PTLDIELLK

SEQ ID NO: 107443 - protein, 9 aa, Dengue virus
TLDIELLKT

SEQ ID NO: 107444 - protein, 9 aa, Dengue virus
LDIELLKTE

SEQ ID NO: 107445 - protein, 9 aa, Dengue virus
DIELLKTEV

SEQ ID NO: 107446 - protein, 9 aa, Dengue virus
IELLKTEVT

SEQ ID NO: 107447 - protein, 9 aa, Dengue virus
TTDSRCPTQ

SEQ ID NO: 107448 - protein, 9 aa, Dengue virus
TDSRCPTQG

SEQ ID NO: 107449 - protein, 9 aa, Dengue virus
DSRCPTQGE

SEQ ID NO: 107450 - protein, 9 aa, Dengue virus
SRCPTQGEA

SEQ ID NO: 107451 - protein, 9 aa, Dengue virus
CRRTFVDRG

SEQ ID NO: 107452 - protein, 9 aa, Dengue virus
RRTFVDRGW

SEQ ID NO: 107453 - protein, 9 aa, Dengue virus
RTFVDRGWG

SEQ ID NO: 107454 - protein, 9 aa, Dengue virus
TFVDRGWGN

SEQ ID NO: 107455 - protein, 9 aa, Dengue virus
FVDRGWGNG

SEQ ID NO: 107456 - protein, 9 aa, Dengue virus
VDRGWGNGC

SEQ ID NO: 107457 - protein, 9 aa, Dengue virus
DRGWGNGCG

SEQ ID NO: 107458 - protein, 9 aa, Dengue virus
RGWGNGCGL

SEQ ID NO: 107459 - protein, 9 aa, Dengue virus
GWGNGCGLF

SEQ ID NO: 107460 - protein, 9 aa, Dengue virus
WGNGCGLFG

SEQ ID NO: 107461 - protein, 9 aa, Dengue virus
GNGCGLFGK

SEQ ID NO: 107462 - protein, 9 aa, Dengue virus
NGCGLFGKG

SEQ ID NO: 107463 - protein, 9 aa, Dengue virus
GCGLFGKGS

SEQ ID NO: 107464 - protein, 9 aa, Dengue virus
CGLFGKGSL

SEQ ID NO: 107465 - protein, 9 aa, Dengue virus
GLFGKGSLI

SEQ ID NO: 107466 - protein, 9 aa, Dengue virus
LFGKGSLIT

SEQ ID NO: 107467 - protein, 9 aa, Dengue virus
FGKGSLITC

SEQ ID NO: 107468 - protein, 9 aa, Dengue virus
GKGSLITCA

SEQ ID NO: 107469 - protein, 9 aa, Dengue virus
KGSLITCAK

SEQ ID NO: 107470 - protein, 9 aa, Dengue virus
GSLITCAKF

SEQ ID NO: 107471 - protein, 9 aa, Dengue virus
IVTVHTGDQ

SEQ ID NO: 107472 - protein, 9 aa, Dengue virus
TVHTGDQHQ

SEQ ID NO: 107473 - protein, 9 aa, Dengue virus
VHTGDQHQV

SEQ ID NO: 107474 - protein, 9 aa, Dengue virus
HTGDQHQVG

SEQ ID NO: 107475 - protein, 9 aa, Dengue virus
TGDQHQVGN

SEQ ID NO: 107476 - protein, 9 aa, Dengue virus
GDQHQVGNE

SEQ ID NO: 107477 - protein, 9 aa, Dengue virus
LTLDCSPRT

SEQ ID NO: 107478 - protein, 9 aa, Dengue virus
TLDCSPRTG

SEQ ID NO: 107479 - protein, 9 aa, Dengue virus
LDCSPRTGL

SEQ ID NO: 107480 - protein, 9 aa, Dengue virus
ECSPRTGLD

SEQ ID NO: 107481 - protein, 9 aa, Dengue virus
CSPRTGLDF

SEQ ID NO: 107482 - protein, 9 aa, Dengue virus
SPRTGLDFN

SEQ ID NO: 107483 - protein, 9 aa, Dengue virus
PRTGLDFNE

SEQ ID NO: 107484 - protein, 9 aa, Dengue virus
RTGLDFNEM

SEQ ID NO: 107485 - protein, 9 aa, Dengue virus
TGLDFNEMV

SEQ ID NO: 107486 - protein, 9 aa, Dengue virus
GLDFNEMVL

SEQ ID NO: 107487 - protein, 9 aa, Dengue virus
LDFNEMVLL

SEQ ID NO: 107488 - protein, 9 aa, Dengue virus
DFNEMVLLT

SEQ ID NO: 107489 - protein, 9 aa, Dengue virus
FNEMVLLTM

SEQ ID NO: 107490 - protein, 9 aa, Dengue virus
NEMVLLTMK

SEQ ID NO: 107491 - protein, 9 aa, Dengue virus
KSWLVHKQW

SEQ ID NO: 107492 - protein, 9 aa, Dengue virus
SWLVHKQWF

SEQ ID NO: 107493 - protein, 9 aa, Dengue virus
WLVHKQWFL

SEQ ID NO: 107494 - protein, 9 aa, Dengue virus
LVHKQWFLD

SEQ ID NO: 107495 - protein, 9 aa, Dengue virus
VHKQWFLDL

SEQ ID NO: 107496 - protein, 9 aa, Dengue virus
HKQWFLDLP

SEQ ID NO: 107497 - protein, 9 aa, Dengue virus
KQWFLDLPL

SEQ ID NO: 107498 - protein, 9 aa, Dengue virus
QWFLDLPLP

SEQ ID NO: 107499 - protein, 9 aa, Dengue virus
WFLDLPLPW

SEQ ID NO: 107500 - protein, 9 aa, Dengue virus
FLDLPLPWT

SEQ ID NO: 107501 - protein, 9 aa, Dengue virus
DLPLPWTSG

SEQ ID NO: 107502 - protein, 9 aa, Dengue virus
LPLPWTSGA

SEQ ID NO: 107503 - protein, 9 aa, Dengue virus
QDLLVTFKT

SEQ ID NO: 107504 - protein, 9 aa, Dengue virus
DLLVTFKTA

SEQ ID NO: 107505 - protein, 9 aa, Dengue virus
LLVTFKTAH

SEQ ID NO: 107506 - protein, 9 aa, Dengue virus
LVTFKTAHA

SEQ ID NO: 107507 - protein, 9 aa, Dengue virus
VTFKTAHAK

SEQ ID NO: 107508 - protein, 9 aa, Dengue virus
TFKTAHAKK

SEQ ID NO: 107509 - protein, 9 aa, Dengue virus
FKTAHAKKQ

SEQ ID NO: 107510 - protein, 9 aa, Dengue virus
KTAHAKKQE

SEQ ID NO: 107511 - protein, 9 aa, Dengue virus
TAHAKKQEV

SEQ ID NO: 107512 - protein, 9 aa, Dengue virus
AHAKKQEVV

SEQ ID NO: 107513 - protein, 9 aa, Dengue virus
HAKKQEVVV

SEQ ID NO: 107514 - protein, 9 aa, Dengue virus
AKKQEVVVL

SEQ ID NO: 107515 - protein, 9 aa, Dengue virus
KKQEVVVLG

SEQ ID NO: 107516 - protein, 9 aa, Dengue virus
KQEVVVLGS

SEQ ID NO: 107517 - protein, 9 aa, Dengue virus
QEVVVLGSQ

SEQ ID NO: 107518 - protein, 9 aa, Dengue virus
EVVVLGSQE

SEQ ID NO: 107519 - protein, 9 aa, Dengue virus
VVVLGSQEG

SEQ ID NO: 107520 - protein, 9 aa, Dengue virus
VVLGSQEGA

SEQ ID NO: 107521 - protein, 9 aa, Dengue virus
VLGSQEGAM

SEQ ID NO: 107522 - protein, 9 aa, Dengue virus
LGSQEGAMH

SEQ ID NO: 107523 - protein, 9 aa, Dengue virus
GSQEGAMHT

SEQ ID NO: 107524 - protein, 9 aa, Dengue virus
SQEGAMHTA

SEQ ID NO: 107525 - protein, 9 aa, Dengue virus
QEGAMHTAL

SEQ ID NO: 107526 - protein, 9 aa, Dengue virus
EGAMHTALT

SEQ ID NO: 107527 - protein, 9 aa, Dengue virus
GAMHTALTG

SEQ ID NO: 107528 - protein, 9 aa, Dengue virus
AMHTALTGA

SEQ ID NO: 107529 - protein, 9 aa, Dengue virus
MHTALTGAT

SEQ ID NO: 107530 - protein, 9 aa, Dengue virus
HTALTGATE

SEQ ID NO: 107531 - protein, 9 aa, Dengue virus
TALTGATEI

SEQ ID NO: 107532 - protein, 9 aa, Dengue virus
ALTGATEIQ

SEQ ID NO: 107533 - protein, 9 aa, Dengue virus
LTGATEIQT

SEQ ID NO: 107534 - protein, 9 aa, Dengue virus
TGATEIQTS

SEQ ID NO: 107535 - protein, 9 aa, Dengue virus
GATEIQTSG

SEQ ID NO: 107536 - protein, 9 aa, Dengue virus
GTTTIFAGH

SEQ ID NO: 107537 - protein, 9 aa, Dengue virus
TTTIFAGHL

SEQ ID NO: 107538 - protein, 9 aa, Dengue virus
TTIFAGHLK

SEQ ID NO: 107539 - protein, 9 aa, Dengue virus
TIFAGHLKC

SEQ ID NO: 107540 - protein, 9 aa, Dengue virus
IFAGHLKCR

SEQ ID NO: 107541 - protein, 9 aa, Dengue virus
FAGHLKCRL

SEQ ID NO: 107542 - protein, 9 aa, Dengue virus
AGHLKCRLK

SEQ ID NO: 107543 - protein, 9 aa, Dengue virus
GHLKCRLKM

SEQ ID NO: 107544 - protein, 9 aa, Dengue virus
HLKCRLKMD

SEQ ID NO: 107545 - protein, 9 aa, Dengue virus
LKCRLKMDK

SEQ ID NO: 107546 - protein, 9 aa, Dengue virus
KCRLKMDKL

SEQ ID NO: 107547 - protein, 9 aa, Dengue virus
CRLKMDKLT

SEQ ID NO: 107548 - protein, 9 aa, Dengue virus
RLKMDKLTL

SEQ ID NO: 107549 - protein, 9 aa, Dengue virus
LKMDKLTLK

SEQ ID NO: 107550 - protein, 9 aa, Dengue virus
KMDKLTLKG

SEQ ID NO: 107551 - protein, 9 aa, Dengue virus
EKEVAETQH

SEQ ID NO: 107552 - protein, 9 aa, Dengue virus
KEVAETQHG

SEQ ID NO: 107553 - protein, 9 aa, Dengue virus
EVAETQHGT

SEQ ID NO: 107554 - protein, 9 aa, Dengue virus
VAETQHGTV

SEQ ID NO: 107555 - protein, 9 aa, Dengue virus
AETQHGTVL

SEQ ID NO: 107556 - protein, 9 aa, Dengue virus
ETQHGTVLV

SEQ ID NO: 107557 - protein, 9 aa, Dengue virus
TQHGTVLVQ

SEQ ID NO: 107558 - protein, 9 aa, Dengue virus
PVNIEAEPP

SEQ ID NO: 107559 - protein, 9 aa, Dengue virus
VNIEAEPPF

SEQ ID NO: 107560 - protein, 9 aa, Dengue virus
NIEAEPPFG

SEQ ID NO: 107561 - protein, 9 aa, Dengue virus
IEAEPPFGE

SEQ ID NO: 107562 - protein, 9 aa, Dengue virus
EAEPPFGES

SEQ ID NO: 107563 - protein, 9 aa, Dengue virus
AEPPFGESY

SEQ ID NO: 107564 - protein, 9 aa, Dengue virus
EPPFGESYI

SEQ ID NO: 107565 - protein, 9 aa, Dengue virus
WFKKGSSIG

SEQ ID NO: 107566 - protein, 9 aa, Dengue virus
KKGSSIGKM

SEQ ID NO: 107567 - protein, 9 aa, Dengue virus
KGSSIGKMF

SEQ ID NO: 107568 - protein, 9 aa, Dengue virus
GSSIGKMFE

SEQ ID NO: 107569 - protein, 9 aa, Dengue virus
SSIGKMFEA

SEQ ID NO: 107570 - protein, 9 aa, Dengue virus
SIGKMFEAT

SEQ ID NO: 107571 - protein, 9 aa, Dengue virus
IGKMFEATA

SEQ ID NO: 107572 - protein, 9 aa, Dengue virus
GKMFEATAR

SEQ ID NO: 107573 - protein, 9 aa, Dengue virus
KMFEATARG

SEQ ID NO: 107574 - protein, 9 aa, Dengue virus
MFEATARGA

SEQ ID NO: 107575 - protein, 9 aa, Dengue virus
FEATARGAR

SEQ ID NO: 107576 - protein, 9 aa, Dengue virus
EATARGARR

SEQ ID NO: 107577 - protein, 9 aa, Dengue virus
ATARGARRM

SEQ ID NO: 107578 - protein, 9 aa, Dengue virus
TARGARRMA

SEQ ID NO: 107579 - protein, 9 aa, Dengue virus
ARGARRMAI

SEQ ID NO: 107580 - protein, 9 aa, Dengue virus
RGARRMAIL

SEQ ID NO: 107581 - protein, 9 aa, Dengue virus
GARRMAILG

SEQ ID NO: 107582 - protein, 9 aa, Dengue virus
ARRMAILGD

SEQ ID NO: 107583 - protein, 9 aa, Dengue virus
RRMAILGDT

SEQ ID NO: 107584 - protein, 9 aa, Dengue virus
RMAILGDTA

SEQ ID NO: 107585 - protein, 9 aa, Dengue virus
MAILGDTAW

SEQ ID NO: 107586 - protein, 9 aa, Dengue virus
AILGDTAWD

SEQ ID NO: 107587 - protein, 9 aa, Dengue virus
ILGDTAWDF

SEQ ID NO: 107588 - protein, 9 aa, Dengue virus
LGDTAWDFG

SEQ ID NO: 107589 - protein, 9 aa, Dengue virus
GDTAWDFGS

SEQ ID NO: 107590 - protein, 9 aa, Dengue virus
DTAWDFGSI

SEQ ID NO: 107591 - protein, 9 aa, Dengue virus
TAWDFGSIG

SEQ ID NO: 107592 - protein, 9 aa, Dengue virus
AWDFGSIGG

SEQ ID NO: 107593 - protein, 9 aa, Dengue virus
WDFGSIGGV

SEQ ID NO: 107594 - protein, 9 aa, Dengue virus
FGTAYGVLF

SEQ ID NO: 107595 - protein, 9 aa, Dengue virus
AYGVLFSGV

SEQ ID NO: 107596 - protein, 9 aa, Dengue virus
YGVLFSGVS

SEQ ID NO: 107597 - protein, 9 aa, Dengue virus
GVLFSGVSW

SEQ ID NO: 107598 - protein, 9 aa, Dengue virus
FSGVSWTMK

SEQ ID NO: 107599 - protein, 9 aa, Dengue virus
SGVSWTMKI

SEQ ID NO: 107600 - protein, 9 aa, Dengue virus
LLTWLGLNS

SEQ ID NO: 107601 - protein, 9 aa, Dengue virus
LTWLGLNSR

SEQ ID NO: 107602 - protein, 9 aa, Dengue virus
TWLGLNSRS

SEQ ID NO: 107603 - protein, 9 aa, Dengue virus
WLGLNSRST

SEQ ID NO: 107604 - protein, 9 aa, Dengue virus
LYLGVMVQA

SEQ ID NO: 107605 - protein, 9 aa, Dengue virus
YLGVMVQAD

SEQ ID NO: 107606 - protein, 9 aa, Dengue virus
GRELKCGSG

SEQ ID NO: 107607 - protein, 9 aa, Dengue virus
KELKCGSGI

SEQ ID NO: 107608 - protein, 9 aa, Dengue virus
ELKCGSGIF

SEQ ID NO: 107609 - protein, 9 aa, Dengue virus
LKCGSGIFV

SEQ ID NO: 107610 - protein, 9 aa, Dengue virus
KCGSGIFVT

SEQ ID NO: 107611 - protein, 9 aa, Dengue virus
CGSGIFVTN

SEQ ID NO: 107612 - protein, 9 aa, Dengue virus
GSGIFVTNE

SEQ ID NO: 107613 - protein, 9 aa, Dengue virus
SGIFVTNEV

SEQ ID NO: 107614 - protein, 9 aa, Dengue virus
GIFVTNEVH

SEQ ID NO: 107615 - protein, 9 aa, Dengue virus
IFVTNEVHT

SEQ ID NO: 107616 - protein, 9 aa, Dengue virus
FVTNEVHTW

SEQ ID NO: 107617 - protein, 9 aa, Dengue virus
VTNEVHTWT

SEQ ID NO: 107618 - protein, 9 aa, Dengue virus
TNEVHTWTE

SEQ ID NO: 107619 - protein, 9 aa, Dengue virus
NEVHTWTEQ

SEQ ID NO: 107620 - protein, 9 aa, Dengue virus
EVHTWTEQY

SEQ ID NO: 107621 - protein, 9 aa, Dengue virus
VHTWTEQYK

SEQ ID NO: 107622 - protein, 9 aa, Dengue virus
HTWTEQYKF

SEQ ID NO: 107623 - protein, 9 aa, Dengue virus
TWTEQYKFQ

SEQ ID NO: 107624 - protein, 9 aa, Dengue virus
WTEQYKFQA

SEQ ID NO: 107625 - protein, 9 aa, Dengue virus
TEQYKFQAD

SEQ ID NO: 107626 - protein, 9 aa, Dengue virus
EQYKFQADS

SEQ ID NO: 107627 - protein, 9 aa, Dengue virus
QYKFQADSP

SEQ ID NO: 107628 - protein, 9 aa, Dengue virus
YKFQADSPK

SEQ ID NO: 107629 - protein, 9 aa, Dengue virus
KFQADSPKR

SEQ ID NO: 107630 - protein, 9 aa, Dengue virus
FQADSPKRL

SEQ ID NO: 107631 - protein, 9 aa, Dengue virus
QADSPKRLS

SEQ ID NO: 107632 - protein, 9 aa, Dengue virus
ADSPKRLSA

SEQ ID NO: 107633 - protein, 9 aa, Dengue virus
DSPKRLSAA

SEQ ID NO: 107634 - protein, 9 aa, Dengue virus
SPKRLSAAI

SEQ ID NO: 107635 - protein, 9 aa, Dengue virus
PKRLSAAIG

SEQ ID NO: 107636 - protein, 9 aa, Dengue virus
KRLSAAIGK

SEQ ID NO: 107637 - protein, 9 aa, Dengue virus
RLSAAIGKA

SEQ ID NO: 107638 - protein, 9 aa, Dengue virus
EEGVCGIRS

SEQ ID NO: 107639 - protein, 9 aa, Dengue virus
GVCGIRSAT

SEQ ID NO: 107640 - protein, 9 aa, Dengue virus
VCGIRSATR

SEQ ID NO: 107641 - protein, 9 aa, Dengue virus
CGIRSATRL

SEQ ID NO: 107642 - protein, 9 aa, Dengue virus
GIRSATRLE

SEQ ID NO: 107643 - protein, 9 aa, Dengue virus
IRSATRLEN

SEQ ID NO: 107644 - protein, 9 aa, Dengue virus
RSATRLENI

SEQ ID NO: 107645 - protein, 9 aa, Dengue virus
SATRLENIM

SEQ ID NO: 107646 - protein, 9 aa, Dengue virus
ATRLENIMW

SEQ ID NO: 107647 - protein, 9 aa, Dengue virus
TRLENIMWK

SEQ ID NO: 107648 - protein, 9 aa, Dengue virus
RLENIMWKQ

SEQ ID NO: 107649 - protein, 9 aa, Dengue virus
LENIMWKQI

SEQ ID NO: 107650 - protein, 9 aa, Dengue virus
ELNHILLEN

SEQ ID NO: 107651 - protein, 9 aa, Dengue virus
YSWKTWGKA

SEQ ID NO: 107652 - protein, 9 aa, Dengue virus
SWKTWGKAK

SEQ ID NO: 107653 - protein, 9 aa, Dengue virus
TFIIDGPNT

SEQ ID NO: 107654 - protein, 9 aa, Dengue virus
RAWNIWEVE

SEQ ID NO: 107655 - protein, 9 aa, Dengue virus
AWNIWEVED

SEQ ID NO: 107656 - protein, 9 aa, Dengue virus
WNIWEVEDY

SEQ ID NO: 107657 - protein, 9 aa, Dengue virus
NIWEVEDYG

SEQ ID NO: 107658 - protein, 9 aa, Dengue virus
IWEVEDYGF

SEQ ID NO: 107659 - protein, 9 aa, Dengue virus
WEVEDYGFG

SEQ ID NO: 107660 - protein, 9 aa, Dengue virus
EVEDYGFGV

SEQ ID NO: 107661 - protein, 9 aa, Dengue virus
VEDYGFGVF

SEQ ID NO: 107662 - protein, 9 aa, Dengue virus
EDYGFGVFT

SEQ ID NO: 107663 - protein, 9 aa, Dengue virus
DYGFGVFTT

SEQ ID NO: 107664 - protein, 9 aa, Dengue virus
YGFGVFTTN

SEQ ID NO: 107665 - protein, 9 aa, Dengue virus
GFGVFTTNI

SEQ ID NO: 107666 - protein, 9 aa, Dengue virus
FGVFTTNIW

SEQ ID NO: 107667 - protein, 9 aa, Dengue virus
GVFTTNIWL

SEQ ID NO: 107668 - protein, 9 aa, Dengue virus
VFTTNIWLK

SEQ ID NO: 107669 - protein, 9 aa, Dengue virus
FTTNIWLKL

SEQ ID NO: 107670 - protein, 9 aa, Dengue virus
CDHRLMSAA

SEQ ID NO: 107671 - protein, 9 aa, Dengue virus
DHRLMSAAI

SEQ ID NO: 107672 - protein, 9 aa, Dengue virus
HRLMSAAIK

SEQ ID NO: 107673 - protein, 9 aa, Dengue virus
RLMSAAIKD

SEQ ID NO: 107674 - protein, 9 aa, Dengue virus
KDSKAVHAD

SEQ ID NO: 107675 - protein, 9 aa, Dengue virus
DSKAVHADM

SEQ ID NO: 107676 - protein, 9 aa, Dengue virus
SKAVHADMG

SEQ ID NO: 107677 - protein, 9 aa, Dengue virus
RAVHADMGY

SEQ ID NO: 107678 - protein, 9 aa, Dengue virus
AVHADMGYW

SEQ ID NO: 107679 - protein, 9 aa, Dengue virus
VHADMGYWI

SEQ ID NO: 107680 - protein, 9 aa, Dengue virus
HADMGYWIE

SEQ ID NO: 107681 - protein, 9 aa, Dengue virus
ADMGYWIES

SEQ ID NO: 107682 - protein, 9 aa, Dengue virus
DMGYWIESE

SEQ ID NO: 107683 - protein, 9 aa, Dengue virus
MGYWIESEK

SEQ ID NO: 107684 - protein, 9 aa, Dengue virus
GYWIESEKN

SEQ ID NO: 107685 - protein, 9 aa, Dengue virus
ESEKNETWK

SEQ ID NO: 107686 - protein, 9 aa, Dengue virus
ASFIEVKTC

SEQ ID NO: 107687 - protein, 9 aa, Dengue virus
WPKSHTLWS

SEQ ID NO: 107688 - protein, 9 aa, Dengue virus
PKSHTLWSN

SEQ ID NO: 107689 - protein, 9 aa, Dengue virus
KSHTLWSNG

SEQ ID NO: 107690 - protein, 9 aa, Dengue virus
SHTLWSNGV

SEQ ID NO: 107691 - protein, 9 aa, Dengue virus
HTLWSNGVL

SEQ ID NO: 107692 - protein, 9 aa, Dengue virus
TLWSNGVLE

SEQ ID NO: 107693 - protein, 9 aa, Dengue virus
LWSNGVLES

SEQ ID NO: 107694 - protein, 9 aa, Dengue virus
WSNGVLESE

SEQ ID NO: 107695 - protein, 9 aa, Dengue virus
SNGVLESEM

SEQ ID NO: 107696 - protein, 9 aa, Dengue virus
NGVLESEMI

SEQ ID NO: 107697 - protein, 9 aa, Dengue virus
GVLESEMII

SEQ ID NO: 107698 - protein, 9 aa, Dengue virus
VLESEMIIP

SEQ ID NO: 107699 - protein, 9 aa, Dengue virus
LESEMIIPK

SEQ ID NO: 107700 - protein, 9 aa, Dengue virus
SQHNYRPGY

SEQ ID NO: 107701 - protein, 9 aa, Dengue virus
TQTAGPWHL

SEQ ID NO: 107702 - protein, 9 aa, Dengue virus
QTAGPWHLG

SEQ ID NO: 107703 - protein, 9 aa, Dengue virus
TAGPWHLGK

SEQ ID NO: 107704 - protein, 9 aa, Dengue virus
AGPWHLGKL

SEQ ID NO: 107705 - protein, 9 aa, Dengue virus
GPWHLGKLE

SEQ ID NO: 107706 - protein, 9 aa, Dengue virus
PWHLGKLEL

SEQ ID NO: 107707 - protein, 9 aa, Dengue virus
WHLGKLELD

SEQ ID NO: 107708 - protein, 9 aa, Dengue virus
HLGKLELDF

SEQ ID NO: 107709 - protein, 9 aa, Dengue virus
CGNRGPSLR

SEQ ID NO: 107710 - protein, 9 aa, Dengue virus
GNRGPSLRT

SEQ ID NO: 107711 - protein, 9 aa, Dengue virus
NRGPSLRTT

SEQ ID NO: 107712 - protein, 9 aa, Dengue virus
RGPSLRTTT

SEQ ID NO: 107713 - protein, 9 aa, Dengue virus
GPSLRTTTV

SEQ ID NO: 107714 - protein, 9 aa, Dengue virus
PSLRTTTVT

SEQ ID NO: 107715 - protein, 9 aa, Dengue virus
SLRTTTVTG

SEQ ID NO: 107716 - protein, 9 aa, Dengue virus
LRTTTVTGK

SEQ ID NO: 107717 - protein, 9 aa, Dengue virus
RTTTVTGKI

SEQ ID NO: 107718 - protein, 9 aa, Dengue virus
TTTVTGKII

SEQ ID NO: 107719 - protein, 9 aa, Dengue virus
TTVTGKIIH

SEQ ID NO: 107720 - protein, 9 aa, Dengue virus
TVTGKIIHE

SEQ ID NO: 107721 - protein, 9 aa, Dengue virus
VTGKIIHEW

SEQ ID NO: 107722 - protein, 9 aa, Dengue virus
TGKIIHEWC

SEQ ID NO: 107723 - protein, 9 aa, Dengue virus
GKIIHEWCC

SEQ ID NO: 107724 - protein, 9 aa, Dengue virus
KIIHEWCCR

SEQ ID NO: 107725 - protein, 9 aa, Dengue virus
IIHEWCCRS

SEQ ID NO: 107726 - protein, 9 aa, Dengue virus
IHEWCCRSC

SEQ ID NO: 107727 - protein, 9 aa, Dengue virus
HEWCCRSCT

SEQ ID NO: 107728 - protein, 9 aa, Dengue virus
EWCCRSCTL

SEQ ID NO: 107729 - protein, 9 aa, Dengue virus
WCCRSCTLP

SEQ ID NO: 107730 - protein, 9 aa, Dengue virus
CCRSCTLPP

SEQ ID NO: 107731 - protein, 9 aa, Dengue virus
CRSCTLPPL

SEQ ID NO: 107732 - protein, 9 aa, Dengue virus
RSCTLPPLR

SEQ ID NO: 107733 - protein, 9 aa, Dengue virus
SCTLPPLRY

SEQ ID NO: 107734 - protein, 9 aa, Dengue virus
CTLPPLRYR

SEQ ID NO: 107735 - protein, 9 aa, Dengue virus
TLPPLRYRG

SEQ ID NO: 107736 - protein, 9 aa, Dengue virus
LPPLRYRGE

SEQ ID NO: 107737 - protein, 9 aa, Dengue virus
PPLRYRGED

SEQ ID NO: 107738 - protein, 9 aa, Dengue virus
PLRYRGEDG

SEQ ID NO: 107739 - protein, 9 aa, Dengue virus
LRYRGEDGC

SEQ ID NO: 107740 - protein, 9 aa, Dengue virus
RYRGEDGCW

SEQ ID NO: 107741 - protein, 9 aa, Dengue virus
YRGEDGCWY

SEQ ID NO: 107742 - protein, 9 aa, Dengue virus
RGEDGCWYG

SEQ ID NO: 107743 - protein, 9 aa, Dengue virus
GEDGCWYGM

SEQ ID NO: 107744 - protein, 9 aa, Dengue virus
EDGCWYGME

SEQ ID NO: 107745 - protein, 9 aa, Dengue virus
DGCWYGMEI

SEQ ID NO: 107746 - protein, 9 aa, Dengue virus
GCWYGMEIR

SEQ ID NO: 107747 - protein, 9 aa, Dengue virus
CWYGMEIRP

SEQ ID NO: 107748 - protein, 9 aa, Dengue virus
WYGMEIRPV

SEQ ID NO: 107749 - protein, 9 aa, Dengue virus
EEVMRSRWS

SEQ ID NO: 107750 - protein, 9 aa, Dengue virus
MGMGTTYLA

SEQ ID NO: 107751 - protein, 9 aa, Dengue virus
GMGVTYLAL

SEQ ID NO: 107752 - protein, 9 aa, Dengue virus
TYLALMATF

SEQ ID NO: 107753 - protein, 9 aa, Dengue virus
LFRRLTSRE

SEQ ID NO: 107754 - protein, 9 aa, Dengue virus
RRLTSREVL

SEQ ID NO: 107755 - protein, 9 aa, Dengue virus
RLTSREVLL

SEQ ID NO: 107756 - protein, 9 aa, Dengue virus
LTSREVLLL

SEQ ID NO: 107757 - protein, 9 aa, Dengue virus
TSREVLLLT

SEQ ID NO: 107758 - protein, 9 aa, Dengue virus
ELGDGLAMG

SEQ ID NO: 107759 - protein, 9 aa, Dengue virus
LGDGLAMGI

SEQ ID NO: 107760 - protein, 9 aa, Dengue virus
GDGLAMGIM

SEQ ID NO: 107761 - protein, 9 aa, Dengue virus
RRSWPLNEG

SEQ ID NO: 107762 - protein, 9 aa, Dengue virus
KSWPLNEGI

SEQ ID NO: 107763 - protein, 9 aa, Dengue virus
SWPLNEGIM

SEQ ID NO: 107764 - protein, 9 aa, Dengue virus
WPLNEGIMA

SEQ ID NO: 107765 - protein, 9 aa, Dengue virus
PLNEGIMAV

SEQ ID NO: 107766 - protein, 9 aa, Dengue virus
LNEGIMAVG

SEQ ID NO: 107767 - protein, 9 aa, Dengue virus
GIVSILLSS

SEQ ID NO: 107768 - protein, 9 aa, Dengue virus
VSILASSLL

SEQ ID NO: 107769 - protein, 9 aa, Dengue virus
SILLSSLLK

SEQ ID NO: 107770 - protein, 9 aa, Dengue virus
ILLSSLLKN

SEQ ID NO: 107771 - protein, 9 aa, Dengue virus
LLSSLLKND

SEQ ID NO: 107772 - protein, 9 aa, Dengue virus
LSSLLKNDV

SEQ ID NO: 107773 - protein, 9 aa, Dengue virus
SSLLKNDVP

SEQ ID NO: 107774 - protein, 9 aa, Dengue virus
SLLKNDVPL

SEQ ID NO: 107775 - protein, 9 aa, Dengue virus
LLKNDVPLA

SEQ ID NO: 107776 - protein, 9 aa, Dengue virus
LKNDVPLAG

SEQ ID NO: 107777 - protein, 9 aa, Dengue virus
KNDVPLAGP

SEQ ID NO: 107778 - protein, 9 aa, Dengue virus
NDVPLAGPL

SEQ ID NO: 107779 - protein, 9 aa, Dengue virus
DVPLAGPLI

SEQ ID NO: 107780 - protein, 9 aa, Dengue virus
VPLAGPLIA

SEQ ID NO: 107781 - protein, 9 aa, Dengue virus
PLAGPLIAG

SEQ ID NO: 107782 - protein, 9 aa, Dengue virus
LAGPLIAGG

SEQ ID NO: 107783 - protein, 9 aa, Dengue virus
AGPLIAGGM

SEQ ID NO: 107784 - protein, 9 aa, Dengue virus
GPLVAGGLL

SEQ ID NO: 107785 - protein, 9 aa, Dengue virus
PLIAGGMLI

SEQ ID NO: 107786 - protein, 9 aa, Dengue virus
LIAGGMLIA

SEQ ID NO: 107787 - protein, 9 aa, Dengue virus
IAGGMLIAC

SEQ ID NO: 107788 - protein, 9 aa, Dengue virus
AGGMLIACY

SEQ ID NO: 107789 - protein, 9 aa, Dengue virus
GGMLIACYV

SEQ ID NO: 107790 - protein, 9 aa, Dengue virus
GMLIACYVI

SEQ ID NO: 107791 - protein, 9 aa, Dengue virus
MLIACYVIS

SEQ ID NO: 107792 - protein, 9 aa, Dengue virus
LIACYVISG

SEQ ID NO: 107793 - protein, 9 aa, Dengue virus
IACYVISGS

SEQ ID NO: 107794 - protein, 9 aa, Dengue virus
ACYVISGSS

SEQ ID NO: 107795 - protein, 9 aa, Dengue virus
CYVISGSSA

SEQ ID NO: 107796 - protein, 9 aa, Dengue virus
YVISGSSAD

SEQ ID NO: 107797 - protein, 9 aa, Dengue virus
VISGSSADL

SEQ ID NO: 107798 - protein, 9 aa, Dengue virus
ISGSSADLS

SEQ ID NO: 107799 - protein, 9 aa, Dengue virus
SGSSADLSL

SEQ ID NO: 107800 - protein, 9 aa, Dengue virus
GSSADLSLE

SEQ ID NO: 107801 - protein, 9 aa, Dengue virus
SSADLSLEK

SEQ ID NO: 107802 - protein, 9 aa, Dengue virus
EAEHSGASH

SEQ ID NO: 107803 - protein, 9 aa, Dengue virus
AEHSGASHN

SEQ ID NO: 107804 - protein, 9 aa, Dengue virus
EHSGASHNI

SEQ ID NO: 107805 - protein, 9 aa, Dengue virus
HSGASHNIL

SEQ ID NO: 107806 - protein, 9 aa, Dengue virus
QDDGTMKIK

SEQ ID NO: 107807 - protein, 9 aa, Dengue virus
DDGTMKIKD

SEQ ID NO: 107808 - protein, 9 aa, Dengue virus
DGTMKIKDE

SEQ ID NO: 107809 - protein, 9 aa, Dengue virus
GTMKIKDEE

SEQ ID NO: 107810 - protein, 9 aa, Dengue virus
TMKIKDEER

SEQ ID NO: 107811 - protein, 9 aa, Dengue virus
MKIKDEERD

SEQ ID NO: 107812 - protein, 9 aa, Dengue virus
LTILLKATL

SEQ ID NO: 107813 - protein, 9 aa, Dengue virus
TILLKATLL

SEQ ID NO: 107814 - protein, 9 aa, Dengue virus
ILLKATLLA

SEQ ID NO: 107815 - protein, 9 aa, Dengue virus
LLKATLLAV

SEQ ID NO: 107816 - protein, 9 aa, Dengue virus
LKATLLAVS

SEQ ID NO: 107817 - protein, 9 aa, Dengue virus
KATLLAVSG

SEQ ID NO: 107818 - protein, 9 aa, Dengue virus
KKQRSGVLW

SEQ ID NO: 107819 - protein, 9 aa, Dengue virus
KQRSGVLWD

SEQ ID NO: 107820 - protein, 9 aa, Dengue virus
QRSGVLWDT

SEQ ID NO: 107821 - protein, 9 aa, Dengue virus
RSGVLWDTP

SEQ ID NO: 107822 - protein, 9 aa, Dengue virus
SGVLWDTPS

SEQ ID NO: 107823 - protein, 9 aa, Dengue virus
GVLWDVPSP

SEQ ID NO: 107824 - protein, 9 aa, Dengue virus
VLWDVPSPP

SEQ ID NO: 107825 - protein, 9 aa, Dengue virus
LWDTPSPPE

SEQ ID NO: 107826 - protein, 9 aa, Dengue virus
AVLDDGIYR

SEQ ID NO: 107827 - protein, 9 aa, Dengue virus
VLDDGIYRI

SEQ ID NO: 107828 - protein, 9 aa, Dengue virus
LDDGIYRIM

SEQ ID NO: 107829 - protein, 9 aa, Dengue virus
DDGIYRIMQ

SEQ ID NO: 107830 - protein, 9 aa, Dengue virus
LGRSQVGVG

SEQ ID NO: 107831 - protein, 9 aa, Dengue virus
GRSQVGVGV

SEQ ID NO: 107832 - protein, 9 aa, Dengue virus
RSQVGVGVF

SEQ ID NO: 107833 - protein, 9 aa, Dengue virus
SQVGVGVFQ

SEQ ID NO: 107834 - protein, 9 aa, Dengue virus
QVGVGVFQE

SEQ ID NO: 107835 - protein, 9 aa, Dengue virus
ENVFHTMWH

SEQ ID NO: 107836 - protein, 9 aa, Dengue virus
GVFHTMWHV

SEQ ID NO: 107837 - protein, 9 aa, Dengue virus
VFHTMWHVT

SEQ ID NO: 107838 - protein, 9 aa, Dengue virus
FHTMWHVTR

SEQ ID NO: 107839 - protein, 9 aa, Dengue virus
HTMWHVTRG

SEQ ID NO: 107840 - protein, 9 aa, Dengue virus
TMWHVTRGA

SEQ ID NO: 107841 - protein, 9 aa, Dengue virus
MWHVTRGAV

SEQ ID NO: 107842 - protein, 9 aa, Dengue virus
WHVTRGAVL

SEQ ID NO: 107843 - protein, 9 aa, Dengue virus
HVTRGAVLM

SEQ ID NO: 107844 - protein, 9 aa, Dengue virus
VTRGAVLMY

SEQ ID NO: 107845 - protein, 9 aa, Dengue virus
QGKRLEPSW

SEQ ID NO: 107846 - protein, 9 aa, Dengue virus
GKRLEPSWA

SEQ ID NO: 107847 - protein, 9 aa, Dengue virus
KRLEPSWAS

SEQ ID NO: 107848 - protein, 9 aa, Dengue virus
RLEPSWASV

SEQ ID NO: 107849 - protein, 9 aa, Dengue virus
LEPSWASVK

SEQ ID NO: 107850 - protein, 9 aa, Dengue virus
EPSWASVKK

SEQ ID NO: 107851 - protein, 9 aa, Dengue virus
PSWASVKKD

SEQ ID NO: 107852 - protein, 9 aa, Dengue virus
SWASVKKDL

SEQ ID NO: 107853 - protein, 9 aa, Dengue virus
WASVKKDLI

SEQ ID NO: 107854 - protein, 9 aa, Dengue virus
ASVKKDLIS

SEQ ID NO: 107855 - protein, 9 aa, Dengue virus
SVKKDLISY

SEQ ID NO: 107856 - protein, 9 aa, Dengue virus
VKKDLISYG

SEQ ID NO: 107857 - protein, 9 aa, Dengue virus
KKDLISYGG

SEQ ID NO: 107858 - protein, 9 aa, Dengue virus
KDLISYGGG

SEQ ID NO: 107859 - protein, 9 aa, Dengue virus
DLISYGGGW

SEQ ID NO: 107860 - protein, 9 aa, Dengue virus
LISYGGGWR

SEQ ID NO: 107861 - protein, 9 aa, Dengue virus
ISYGGGWRL

SEQ ID NO: 107862 - protein, 9 aa, Dengue virus
WNTGEEVQV

SEQ ID NO: 107863 - protein, 9 aa, Dengue virus
NTGEEVQVI

SEQ ID NO: 107864 - protein, 9 aa, Dengue virus
TGEEVQVIA

SEQ ID NO: 107865 - protein, 9 aa, Dengue virus
GEEVQVIAV

SEQ ID NO: 107866 - protein, 9 aa, Dengue virus
EEVQVIAVE

SEQ ID NO: 107867 - protein, 9 aa, Dengue virus
EVQVIAVEP

SEQ ID NO: 107868 - protein, 9 aa, Dengue virus
VQVIAVEPG

SEQ ID NO: 107869 - protein, 9 aa, Dengue virus
QVIAVEPGK

SEQ ID NO: 107870 - protein, 9 aa, Dengue virus
VIAVEPGKN

SEQ ID NO: 107871 - protein, 9 aa, Dengue virus
IAVEPGKNP

SEQ ID NO: 107872 - protein, 9 aa, Dengue virus
AVEPGKNPK

SEQ ID NO: 107873 - protein, 9 aa, Dengue virus
VEPGKNPKN

SEQ ID NO: 107874 - protein, 9 aa, Dengue virus
EPGKNPKNV

SEQ ID NO: 107875 - protein, 9 aa, Dengue virus
PGKNPKNVQ

SEQ ID NO: 107876 - protein, 9 aa, Dengue virus
GKNPKNVQT

SEQ ID NO: 107877 - protein, 9 aa, Dengue virus
EGEVGAIAL

SEQ ID NO: 107878 - protein, 9 aa, Dengue virus
GEVGAIALD

SEQ ID NO: 107879 - protein, 9 aa, Dengue virus
EVGAIALDF

SEQ ID NO: 107880 - protein, 9 aa, Dengue virus
VGAIALDFK

SEQ ID NO: 107881 - protein, 9 aa, Dengue virus
GAIALDFKP

SEQ ID NO: 107882 - protein, 9 aa, Dengue virus
AIALDFKPG

SEQ ID NO: 107883 - protein, 9 aa, Dengue virus
IALDFKPGT

SEQ ID NO: 107884 - protein, 9 aa, Dengue virus
ALDFKPGTS

SEQ ID NO: 107885 - protein, 9 aa, Dengue virus
LDFKPGTSG

SEQ ID NO: 107886 - protein, 9 aa, Dengue virus
DFKPGTSGS

SEQ ID NO: 107887 - protein, 9 aa, Dengue virus
FKPGTSGSP

SEQ ID NO: 107888 - protein, 9 aa, Dengue virus
KPGTSGSPI

SEQ ID NO: 107889 - protein, 9 aa, Dengue virus
PGTSGSPIV

SEQ ID NO: 107890 - protein, 9 aa, Dengue virus
GTSGSPIVN

SEQ ID NO: 107891 - protein, 9 aa, Dengue virus
TSGSPIVNR

SEQ ID NO: 107892 - protein, 9 aa, Dengue virus
EGKIVGLYG

SEQ ID NO: 107893 - protein, 9 aa, Dengue virus
GKVVGLYGN

SEQ ID NO: 107894 - protein, 9 aa, Dengue virus
KVVGLYGNG

SEQ ID NO: 107895 - protein, 9 aa, Dengue virus
VVGLYGNGV

SEQ ID NO: 107896 - protein, 9 aa, Dengue virus
VGLYGNGVV

SEQ ID NO: 107897 - protein, 9 aa, Dengue virus
GLYGNGVVT

SEQ ID NO: 107898 - protein, 9 aa, Dengue virus
LYGNGVVTT

SEQ ID NO: 107899 - protein, 9 aa, Dengue virus
YGNGVVTTS

SEQ ID NO: 107900 - protein, 9 aa, Dengue virus
GNGVVTTSG

SEQ ID NO: 107901 - protein, 9 aa, Dengue virus
NGVVTTSGT

SEQ ID NO: 107902 - protein, 9 aa, Dengue virus
GVVTTSGTY

SEQ ID NO: 107903 - protein, 9 aa, Dengue virus
VVTTSGTYV

SEQ ID NO: 107904 - protein, 9 aa, Dengue virus
VTTSGTYVS

SEQ ID NO: 107905 - protein, 9 aa, Dengue virus
SGTYVSAIA

SEQ ID NO: 107906 - protein, 9 aa, Dengue virus
GTYVSAIAQ

SEQ ID NO: 107907 - protein, 9 aa, Dengue virus
TYVSAIAQA

SEQ ID NO: 107908 - protein, 9 aa, Dengue virus
VFRKRNLTI

SEQ ID NO: 107909 - protein, 9 aa, Dengue virus
FRKRNLTIM

SEQ ID NO: 107910 - protein, 9 aa, Dengue virus
RKRNLTIMD

SEQ ID NO: 107911 - protein, 9 aa, Dengue virus
KRNLTIMDL

SEQ ID NO: 107912 - protein, 9 aa, Dengue virus
RNLTIMDLH

SEQ ID NO: 107913 - protein, 9 aa, Dengue virus
NLTIMDLHP

SEQ ID NO: 107914 - protein, 9 aa, Dengue virus
LTIMDLHPG

SEQ ID NO: 107915 - protein, 9 aa, Dengue virus
TIMDLHPGS

SEQ ID NO: 107916 - protein, 9 aa, Dengue virus
IMDLHPGSG

SEQ ID NO: 107917 - protein, 9 aa, Dengue virus
MDLHPGSGK

SEQ ID NO: 107918 - protein, 9 aa, Dengue virus
DLHPGSGKT

SEQ ID NO: 107919 - protein, 9 aa, Dengue virus
LHPGSGKTR

SEQ ID NO: 107920 - protein, 9 aa, Dengue virus
HPGSGKTRR

SEQ ID NO: 107921 - protein, 9 aa, Dengue virus
PGSGKTRRY

SEQ ID NO: 107922 - protein, 9 aa, Dengue virus
GSGKTRRYL

SEQ ID NO: 107923 - protein, 9 aa, Dengue virus
SGKTRRYLP

SEQ ID NO: 107924 - protein, 9 aa, Dengue virus
GKTRRYLPA

SEQ ID NO: 107925 - protein, 9 aa, Dengue virus
KTRRYLPAI

SEQ ID NO: 107926 - protein, 9 aa, Dengue virus
RYLPAIVRE

SEQ ID NO: 107927 - protein, 9 aa, Dengue virus
YLPAIVREA

SEQ ID NO: 107928 - protein, 9 aa, Dengue virus
LPAIVREAI

SEQ ID NO: 107929 - protein, 9 aa, Dengue virus
PAIVREAIK

SEQ ID NO: 107930 - protein, 9 aa, Dengue virus
AIVREAIKR

SEQ ID NO: 107931 - protein, 9 aa, Dengue virus
REAIKRKLR

SEQ ID NO: 107932 - protein, 9 aa, Dengue virus
EAIKRKLRT

SEQ ID NO: 107933 - protein, 9 aa, Dengue virus
AIKRKLRTL

SEQ ID NO: 107934 - protein, 9 aa, Dengue virus
KRKLRTLIL

SEQ ID NO: 107935 - protein, 9 aa, Dengue virus
RKLRTLILA

SEQ ID NO: 107936 - protein, 9 aa, Dengue virus
KLRTLILAP

SEQ ID NO: 107937 - protein, 9 aa, Dengue virus
LRTLILAPT

SEQ ID NO: 107938 - protein, 9 aa, Dengue virus
RTLILAPTR

SEQ ID NO: 107939 - protein, 9 aa, Dengue virus
TLILAPTRV

SEQ ID NO: 107940 - protein, 9 aa, Dengue virus
LILAPTRVV

SEQ ID NO: 107941 - protein, 9 aa, Dengue virus
ILAPTRVVA

SEQ ID NO: 107942 - protein, 9 aa, Dengue virus
LAPTRVVAA

SEQ ID NO: 107943 - protein, 9 aa, Dengue virus
APTRVVAAE

SEQ ID NO: 107944 - protein, 9 aa, Dengue virus
PTRVVAAEM

SEQ ID NO: 107945 - protein, 9 aa, Dengue virus
TRVVAAEME

SEQ ID NO: 107946 - protein, 9 aa, Dengue virus
RVVAAEMEE

SEQ ID NO: 107947 - protein, 9 aa, Dengue virus
VVAAEMEEA

SEQ ID NO: 107948 - protein, 9 aa, Dengue virus
VAAEMEEAL

SEQ ID NO: 107949 - protein, 9 aa, Dengue virus
ASEMAEALK

SEQ ID NO: 107950 - protein, 9 aa, Dengue virus
SEMAEALKG

SEQ ID NO: 107951 - protein, 9 aa, Dengue virus
EMAEALKGM

SEQ ID NO: 107952 - protein, 9 aa, Dengue virus
MAEALKGMP

SEQ ID NO: 107953 - protein, 9 aa, Dengue virus
AEALKGMPI

SEQ ID NO: 107954 - protein, 9 aa, Dengue virus
EALKGMPIR

SEQ ID NO: 107955 - protein, 9 aa, Dengue virus
ALKGMPIRY

SEQ ID NO: 107956 - protein, 9 aa, Dengue virus
LKGMPIRYQ

SEQ ID NO: 107957 - protein, 9 aa, Dengue virus
KGMPIRYQT

SEQ ID NO: 107958 - protein, 9 aa, Dengue virus
GMPIRYQTT

SEQ ID NO: 107959 - protein, 9 aa, Dengue virus
MPIRYQTTA

SEQ ID NO: 107960 - protein, 9 aa, Dengue virus
PIRYQTTAV

SEQ ID NO: 107961 - protein, 9 aa, Dengue virus
KSEHTGKEI

SEQ ID NO: 107962 - protein, 9 aa, Dengue virus
SEHTGKEIV

SEQ ID NO: 107963 - protein, 9 aa, Dengue virus
EHTGREIVD

SEQ ID NO: 107964 - protein, 9 aa, Dengue virus
HTGREIVDL

SEQ ID NO: 107965 - protein, 9 aa, Dengue virus
TGREIVDLM

SEQ ID NO: 107966 - protein, 9 aa, Dengue virus
GREIVDLMC

SEQ ID NO: 107967 - protein, 9 aa, Dengue virus
REIVDLMCH

SEQ ID NO: 107968 - protein, 9 aa, Dengue virus
EIVDLMCHA

SEQ ID NO: 107969 - protein, 9 aa, Dengue virus
IVDLMCHAT

SEQ ID NO: 107970 - protein, 9 aa, Dengue virus
VDLMCHATF

SEQ ID NO: 107971 - protein, 9 aa, Dengue virus
DLMCHATFT

SEQ ID NO: 107972 - protein, 9 aa, Dengue virus
LMCHATFTM

SEQ ID NO: 107973 - protein, 9 aa, Dengue virus
MCHATFTMR

SEQ ID NO: 107974 - protein, 9 aa, Dengue virus
CHATFTMRL

SEQ ID NO: 107975 - protein, 9 aa, Dengue virus
HATFTMRLL

SEQ ID NO: 107976 - protein, 9 aa, Dengue virus
ATFTMRLLS

SEQ ID NO: 107977 - protein, 9 aa, Dengue virus
TFTMRLLSP

SEQ ID NO: 107978 - protein, 9 aa, Dengue virus
FTMRLLSPV

SEQ ID NO: 107979 - protein, 9 aa, Dengue virus
TMRLLSPVR

SEQ ID NO: 107980 - protein, 9 aa, Dengue virus
MRLLSPVRV

SEQ ID NO: 107981 - protein, 9 aa, Dengue virus
RLLSPVRVP

SEQ ID NO: 107982 - protein, 9 aa, Dengue virus
LLSPVRVPN

SEQ ID NO: 107983 - protein, 9 aa, Dengue virus
LSPVRVPNY

SEQ ID NO: 107984 - protein, 9 aa, Dengue virus
SPVRVPNYN

SEQ ID NO: 107985 - protein, 9 aa, Dengue virus
PVRVPNYNL

SEQ ID NO: 107986 - protein, 9 aa, Dengue virus
VRVPNYNLI

SEQ ID NO: 107987 - protein, 9 aa, Dengue virus
RVPNYNLII

SEQ ID NO: 107988 - protein, 9 aa, Dengue virus
VPNYNLIIM

SEQ ID NO: 107989 - protein, 9 aa, Dengue virus
PNYNLIIMD

SEQ ID NO: 107990 - protein, 9 aa, Dengue virus
NYNLIIMDE

SEQ ID NO: 107991 - protein, 9 aa, Dengue virus
YNLIIMDEA

SEQ ID NO: 107992 - protein, 9 aa, Dengue virus
NLIIMDEAH

SEQ ID NO: 107993 - protein, 9 aa, Dengue virus
LIIMDEAHF

SEQ ID NO: 107994 - protein, 9 aa, Dengue virus
IIMDEAHFT

SEQ ID NO: 107995 - protein, 9 aa, Dengue virus
IMDEAHFTD

SEQ ID NO: 107996 - protein, 9 aa, Dengue virus
MDEAHFTDP

SEQ ID NO: 107997 - protein, 9 aa, Dengue virus
DEAHFTDPA

SEQ ID NO: 107998 - protein, 9 aa, Dengue virus
EAHFTDPAS

SEQ ID NO: 107999 - protein, 9 aa, Dengue virus
AHFTDPASI

SEQ ID NO: 108000 - protein, 9 aa, Dengue virus
HFTDPASIA

SEQ ID NO: 108001 - protein, 9 aa, Dengue virus
FTDPASIAA

SEQ ID NO: 108002 - protein, 9 aa, Dengue virus
TDPASIAAR

SEQ ID NO: 108003 - protein, 9 aa, Dengue virus
DPASIAARG

SEQ ID NO: 108004 - protein, 9 aa, Dengue virus
PASIAARGY

SEQ ID NO: 108005 - protein, 9 aa, Dengue virus
ASIAARGYI

SEQ ID NO: 108006 - protein, 9 aa, Dengue virus
SIAARGYIS

SEQ ID NO: 108007 - protein, 9 aa, Dengue virus
IAARGYIST

SEQ ID NO: 108008 - protein, 9 aa, Dengue virus
AARGYISTR

SEQ ID NO: 108009 - protein, 9 aa, Dengue virus
ARGYISTRV

SEQ ID NO: 108010 - protein, 9 aa, Dengue virus
RGYISTRVG

SEQ ID NO: 108011 - protein, 9 aa, Dengue virus
GYISTRVGM

SEQ ID NO: 108012 - protein, 9 aa, Dengue virus
YISTRVGMG

SEQ ID NO: 108013 - protein, 9 aa, Dengue virus
ISTRVGMGE

SEQ ID NO: 108014 - protein, 9 aa, Dengue virus
STRVGMGEA

SEQ ID NO: 108015 - protein, 9 aa, Dengue virus
TRVGMGEAA

SEQ ID NO: 108016 - protein, 9 aa, Dengue virus
RVGMGEAAA

SEQ ID NO: 108017 - protein, 9 aa, Dengue virus
VGMGEAAAI

SEQ ID NO: 108018 - protein, 9 aa, Dengue virus
GMGEAAAIF

SEQ ID NO: 108019 - protein, 9 aa, Dengue virus
MGEAAAIFM

SEQ ID NO: 108020 - protein, 9 aa, Dengue virus
GEAAAIFMT

SEQ ID NO: 108021 - protein, 9 aa, Dengue virus
EAAAIFMTA

SEQ ID NO: 108022 - protein, 9 aa, Dengue virus
AAAIFMTAT

SEQ ID NO: 108023 - protein, 9 aa, Dengue virus
AAIFMTATP

SEQ ID NO: 108024 - protein, 9 aa, Dengue virus
AIFMTATPP

SEQ ID NO: 108025 - protein, 9 aa, Dengue virus
IFMTATPPG

SEQ ID NO: 108026 - protein, 9 aa, Dengue virus
FMTATPPGS

SEQ ID NO: 108027 - protein, 9 aa, Dengue virus
EAFPQSNAV

SEQ ID NO: 108028 - protein, 9 aa, Dengue virus
AFPQSNAVI

SEQ ID NO: 108029 - protein, 9 aa, Dengue virus
IQDEERDIP

SEQ ID NO: 108030 - protein, 9 aa, Dengue virus
QDEERDIPE

SEQ ID NO: 108031 - protein, 9 aa, Dengue virus
DEERDIPER

SEQ ID NO: 108032 - protein, 9 aa, Dengue virus
EERDIPERS

SEQ ID NO: 108033 - protein, 9 aa, Dengue virus
ERDIPERSW

SEQ ID NO: 108034 - protein, 9 aa, Dengue virus
RDIPERSWN

SEQ ID NO: 108035 - protein, 9 aa, Dengue virus
DIPERSWNS

SEQ ID NO: 108036 - protein, 9 aa, Dengue virus
IPERSWNSG

SEQ ID NO: 108037 - protein, 9 aa, Dengue virus
PERSWNSGY

SEQ ID NO: 108038 - protein, 9 aa, Dengue virus
FPGKTVWFV

SEQ ID NO: 108039 - protein, 9 aa, Dengue virus
PGKTVWFVP

SEQ ID NO: 108040 - protein, 9 aa, Dengue virus
GKTVWFVPS

SEQ ID NO: 108041 - protein, 9 aa, Dengue virus
KTVWFVPSI

SEQ ID NO: 108042 - protein, 9 aa, Dengue virus
TVWFVPSIK

SEQ ID NO: 108043 - protein, 9 aa, Dengue virus
VWFVPSIKA

SEQ ID NO: 108044 - protein, 9 aa, Dengue virus
WFVPSIKAG

SEQ ID NO: 108045 - protein, 9 aa, Dengue virus
FVPSIKAGN

SEQ ID NO: 108046 - protein, 9 aa, Dengue virus
VPSIKAGND

SEQ ID NO: 108047 - protein, 9 aa, Dengue virus
PSIKAGNDI

SEQ ID NO: 108048 - protein, 9 aa, Dengue virus
SIKAGNDIA

SEQ ID NO: 108049 - protein, 9 aa, Dengue virus
IKSGNDIAN

SEQ ID NO: 108050 - protein, 9 aa, Dengue virus
KSGNDIANC

SEQ ID NO: 108051 - protein, 9 aa, Dengue virus
SGNDIANCL

SEQ ID NO: 108052 - protein, 9 aa, Dengue virus
GNDIANCLR

SEQ ID NO: 108053 - protein, 9 aa, Dengue virus
NDIANCLRK

SEQ ID NO: 108054 - protein, 9 aa, Dengue virus
DIANCLRKN

SEQ ID NO: 108055 - protein, 9 aa, Dengue virus
IANCLRKNG

SEQ ID NO: 108056 - protein, 9 aa, Dengue virus
ANCLRKNGK

SEQ ID NO: 108057 - protein, 9 aa, Dengue virus
NCLRKNGKR

SEQ ID NO: 108058 - protein, 9 aa, Dengue virus
CLRKNGKKV

SEQ ID NO: 108059 - protein, 9 aa, Dengue virus
LRKNGKKVI

SEQ ID NO: 108060 - protein, 9 aa, Dengue virus
RKNGKKVIQ

SEQ ID NO: 108061 - protein, 9 aa, Dengue virus
KNGKKVIQL

SEQ ID NO: 108062 - protein, 9 aa, Dengue virus
NGKKVIQLS

SEQ ID NO: 108063 - protein, 9 aa, Dengue virus
GKKVIQLSR

SEQ ID NO: 108064 - protein, 9 aa, Dengue virus
KKVIQLSRK

SEQ ID NO: 108065 - protein, 9 aa, Dengue virus
KVIQLSRKT

SEQ ID NO: 108066 - protein, 9 aa, Dengue virus
VIQLSRKTF

SEQ ID NO: 108067 - protein, 9 aa, Dengue virus
IQLSRKTFD

SEQ ID NO: 108068 - protein, 9 aa, Dengue virus
QLSRKTFDT

SEQ ID NO: 108069 - protein, 9 aa, Dengue virus
LSRKTFDTE

SEQ ID NO: 108070 - protein, 9 aa, Dengue virus
SRKTFDTEY

SEQ ID NO: 108071 - protein, 9 aa, Dengue virus
RKTFDTEYQ

SEQ ID NO: 108072 - protein, 9 aa, Dengue virus
KTFDTEYQK

SEQ ID NO: 108073 - protein, 9 aa, Dengue virus
TFDTEYQKT

SEQ ID NO: 108074 - protein, 9 aa, Dengue virus
NNDWDYVVT

SEQ ID NO: 108075 - protein, 9 aa, Dengue virus
NDWDFVVTT

SEQ ID NO: 108076 - protein, 9 aa, Dengue virus
DWDFVVTTD

SEQ ID NO: 108077 - protein, 9 aa, Dengue virus
WDFVVTTDI

SEQ ID NO: 108078 - protein, 9 aa, Dengue virus
DFVVTTDIS

SEQ ID NO: 108079 - protein, 9 aa, Dengue virus
FVVTTDISE

SEQ ID NO: 108080 - protein, 9 aa, Dengue virus
VVTTDISEM

SEQ ID NO: 108081 - protein, 9 aa, Dengue virus
VTTDISEMG

SEQ ID NO: 108082 - protein, 9 aa, Dengue virus
TTDISEMGA

SEQ ID NO: 108083 - protein, 9 aa, Dengue virus
TDISEMGAN

SEQ ID NO: 108084 - protein, 9 aa, Dengue virus
DISEMGANF

SEQ ID NO: 108085 - protein, 9 aa, Dengue virus
ISEMGANFR

SEQ ID NO: 108086 - protein, 9 aa, Dengue virus
SEMGANFRA

SEQ ID NO: 108087 - protein, 9 aa, Dengue virus
EMGANFRAD

SEQ ID NO: 108088 - protein, 9 aa, Dengue virus
MGANFRADR

SEQ ID NO: 108089 - protein, 9 aa, Dengue virus
GANFRADRV

SEQ ID NO: 108090 - protein, 9 aa, Dengue virus
ANFRADRVI

SEQ ID NO: 108091 - protein, 9 aa, Dengue virus
NFRADRVID

SEQ ID NO: 108092 - protein, 9 aa, Dengue virus
FRADRVIDP

SEQ ID NO: 108093 - protein, 9 aa, Dengue virus
RADRVIDPR

SEQ ID NO: 108094 - protein, 9 aa, Dengue virus
ADRVIDPRR

SEQ ID NO: 108095 - protein, 9 aa, Dengue virus
DRVIDPRRC

SEQ ID NO: 108096 - protein, 9 aa, Dengue virus
RVIDPRRCL

SEQ ID NO: 108097 - protein, 9 aa, Dengue virus
VIDPRRCLK

SEQ ID NO: 108098 - protein, 9 aa, Dengue virus
IDPRRCLKP

SEQ ID NO: 108099 - protein, 9 aa, Dengue virus
DPRRCLKPV

SEQ ID NO: 108100 - protein, 9 aa, Dengue virus
PRRCLKPVI

SEQ ID NO: 108101 - protein, 9 aa, Dengue virus
RRCLKPVIL

SEQ ID NO: 108102 - protein, 9 aa, Dengue virus
RCLKPVILK

SEQ ID NO: 108103 - protein, 9 aa, Dengue virus
CLKPVILKD

SEQ ID NO: 108104 - protein, 9 aa, Dengue virus
LKPVILKDG

SEQ ID NO: 108105 - protein, 9 aa, Dengue virus
KPVILKDGP

SEQ ID NO: 108106 - protein, 9 aa, Dengue virus
PVILKDGPE

SEQ ID NO: 108107 - protein, 9 aa, Dengue virus
VILKDGPER

SEQ ID NO: 108108 - protein, 9 aa, Dengue virus
ILKDGPERV

SEQ ID NO: 108109 - protein, 9 aa, Dengue virus
LKDGPERVI

SEQ ID NO: 108110 - protein, 9 aa, Dengue virus
KDGPERVIL

SEQ ID NO: 108111 - protein, 9 aa, Dengue virus
DGPERVILA

SEQ ID NO: 108112 - protein, 9 aa, Dengue virus
GPERVILAG

SEQ ID NO: 108113 - protein, 9 aa, Dengue virus
PERVILAGP

SEQ ID NO: 108114 - protein, 9 aa, Dengue virus
ERVILAGPM

SEQ ID NO: 108115 - protein, 9 aa, Dengue virus
RVILAGPMP

SEQ ID NO: 108116 - protein, 9 aa, Dengue virus
VILAGPMPV

SEQ ID NO: 108117 - protein, 9 aa, Dengue virus
ILAGPMPVT

SEQ ID NO: 108118 - protein, 9 aa, Dengue virus
LAGPMPVTV

SEQ ID NO: 108119 - protein, 9 aa, Dengue virus
AGPMPVTVA

SEQ ID NO: 108120 - protein, 9 aa, Dengue virus
GPMPVTVAS

SEQ ID NO: 108121 - protein, 9 aa, Dengue virus
PMPVTVASA

SEQ ID NO: 108122 - protein, 9 aa, Dengue virus
MPVTVASAA

SEQ ID NO: 108123 - protein, 9 aa, Dengue virus
PVTVASAAQ

SEQ ID NO: 108124 - protein, 9 aa, Dengue virus
VTVASAAQR

SEQ ID NO: 108125 - protein, 9 aa, Dengue virus
TVASAAQRR

SEQ ID NO: 108126 - protein, 9 aa, Dengue virus
VASAAQRRG

SEQ ID NO: 108127 - protein, 9 aa, Dengue virus
ASAAQRRGR

SEQ ID NO: 108128 - protein, 9 aa, Dengue virus
SAAQRRGRI

SEQ ID NO: 108129 - protein, 9 aa, Dengue virus
AAQRRGRIG

SEQ ID NO: 108130 - protein, 9 aa, Dengue virus
AQRRGRIGR

SEQ ID NO: 108131 - protein, 9 aa, Dengue virus
QRRGRIGRN

SEQ ID NO: 108132 - protein, 9 aa, Dengue virus
RRGRIGRNP

SEQ ID NO: 108133 - protein, 9 aa, Dengue virus
KEGDQYIYM

SEQ ID NO: 108134 - protein, 9 aa, Dengue virus
EGDQYIYMG

SEQ ID NO: 108135 - protein, 9 aa, Dengue virus
GDQYIYMGQ

SEQ ID NO: 108136 - protein, 9 aa, Dengue virus
DQYIYMGQP

SEQ ID NO: 108137 - protein, 9 aa, Dengue virus
QYIYMGQPL

SEQ ID NO: 108138 - protein, 9 aa, Dengue virus
YMGQPLNND

SEQ ID NO: 108139 - protein, 9 aa, Dengue virus
MGQPLNNDE

SEQ ID NO: 108140 - protein, 9 aa, Dengue virus
GQPLNNDED

SEQ ID NO: 108141 - protein, 9 aa, Dengue virus
QPLNNDEDH

SEQ ID NO: 108142 - protein, 9 aa, Dengue virus
PLNNDEDHA

SEQ ID NO: 108143 - protein, 9 aa, Dengue virus
LNNDEDHAH

SEQ ID NO: 108144 - protein, 9 aa, Dengue virus
NNDEDHAHW

SEQ ID NO: 108145 - protein, 9 aa, Dengue virus
NDEDHAHWT

SEQ ID NO: 108146 - protein, 9 aa, Dengue virus
DEDHAHWTE

SEQ ID NO: 108147 - protein, 9 aa, Dengue virus
EDHAHWTEA

SEQ ID NO: 108148 - protein, 9 aa, Dengue virus
DHAHWTEAK

SEQ ID NO: 108149 - protein, 9 aa, Dengue virus
HAHWTEAKM

SEQ ID NO: 108150 - protein, 9 aa, Dengue virus
AHWTEAKML

SEQ ID NO: 108151 - protein, 9 aa, Dengue virus
HWTEAKMLL

SEQ ID NO: 108152 - protein, 9 aa, Dengue virus
WTEAKMLLD

SEQ ID NO: 108153 - protein, 9 aa, Dengue virus
TEAKMLLDN

SEQ ID NO: 108154 - protein, 9 aa, Dengue virus
EAKMLLDNI

SEQ ID NO: 108155 - protein, 9 aa, Dengue virus
AKMLLDNIN

SEQ ID NO: 108156 - protein, 9 aa, Dengue virus
KMLLDNINT

SEQ ID NO: 108157 - protein, 9 aa, Dengue virus
MLLDNINTP

SEQ ID NO: 108158 - protein, 9 aa, Dengue virus
LLDNINTPE

SEQ ID NO: 108159 - protein, 9 aa, Dengue virus
LDNINTPEG

SEQ ID NO: 108160 - protein, 9 aa, Dengue virus
DNINTPEGI

SEQ ID NO: 108161 - protein, 9 aa, Dengue virus
NINTPEGII

SEQ ID NO: 108162 - protein, 9 aa, Dengue virus
INTPEGIIP

SEQ ID NO: 108163 - protein, 9 aa, Dengue virus
NTPEGIIPA

SEQ ID NO: 108164 - protein, 9 aa, Dengue virus
TPEGIIPAL

SEQ ID NO: 108165 - protein, 9 aa, Dengue virus
PEGIIPALF

SEQ ID NO: 108166 - protein, 9 aa, Dengue virus
EGIIPALFE

SEQ ID NO: 108167 - protein, 9 aa, Dengue virus
GIIPALFEP

SEQ ID NO: 108168 - protein, 9 aa, Dengue virus
IIPALFEPE

SEQ ID NO: 108169 - protein, 9 aa, Dengue virus
IPALFEPER

SEQ ID NO: 108170 - protein, 9 aa, Dengue virus
PALFEPERE

SEQ ID NO: 108171 - protein, 9 aa, Dengue virus
ALFEPEREK

SEQ ID NO: 108172 - protein, 9 aa, Dengue virus
LFEPEREKS

SEQ ID NO: 108173 - protein, 9 aa, Dengue virus
FEPEREKSA

SEQ ID NO: 108174 - protein, 9 aa, Dengue virus
EPEREKSAA

SEQ ID NO: 108175 - protein, 9 aa, Dengue virus
PEREKSAAI

SEQ ID NO: 108176 - protein, 9 aa, Dengue virus
EREKSAAID

SEQ ID NO: 108177 - protein, 9 aa, Dengue virus
REKSAAIDG

SEQ ID NO: 108178 - protein, 9 aa, Dengue virus
EKSAAIDGE

SEQ ID NO: 108179 - protein, 9 aa, Dengue virus
KSAAIDGEY

SEQ ID NO: 108180 - protein, 9 aa, Dengue virus
SAAIDGEYR

SEQ ID NO: 108181 - protein, 9 aa, Dengue virus
AAIDGEYRL

SEQ ID NO: 108182 - protein, 9 aa, Dengue virus
AIDGEYRLR

SEQ ID NO: 108183 - protein, 9 aa, Dengue virus
IDGEYRLRG

SEQ ID NO: 108184 - protein, 9 aa, Dengue virus
DGEYRLRGE

SEQ ID NO: 108185 - protein, 9 aa, Dengue virus
GEYRLRGEA

SEQ ID NO: 108186 - protein, 9 aa, Dengue virus
EYRLRGEAR

SEQ ID NO: 108187 - protein, 9 aa, Dengue virus
YRLRGEARK

SEQ ID NO: 108188 - protein, 9 aa, Dengue virus
RLRGEARKT

SEQ ID NO: 108189 - protein, 9 aa, Dengue virus
LRGEARKTF

SEQ ID NO: 108190 - protein, 9 aa, Dengue virus
RGEARKTFV

SEQ ID NO: 108191 - protein, 9 aa, Dengue virus
GEARKTFVE

SEQ ID NO: 108192 - protein, 9 aa, Dengue virus
EARKTFVEL

SEQ ID NO: 108193 - protein, 9 aa, Dengue virus
ARKTFVELM

SEQ ID NO: 108194 - protein, 9 aa, Dengue virus
RKTFVELMR

SEQ ID NO: 108195 - protein, 9 aa, Dengue virus
KTFVELMRR

SEQ ID NO: 108196 - protein, 9 aa, Dengue virus
TFVELMRRG

SEQ ID NO: 108197 - protein, 9 aa, Dengue virus
FVELMRRGD

SEQ ID NO: 108198 - protein, 9 aa, Dengue virus
VELMRRGDL

SEQ ID NO: 108199 - protein, 9 aa, Dengue virus
ELMRRGDLP

SEQ ID NO: 108200 - protein, 9 aa, Dengue virus
LMRRGDLPV

SEQ ID NO: 108201 - protein, 9 aa, Dengue virus
MRRGDLPVW

SEQ ID NO: 108202 - protein, 9 aa, Dengue virus
RRGDLPVWL

SEQ ID NO: 108203 - protein, 9 aa, Dengue virus
RGDLPVWLA

SEQ ID NO: 108204 - protein, 9 aa, Dengue virus
GDLPVWLSY

SEQ ID NO: 108205 - protein, 9 aa, Dengue virus
DLPVWLSYK

SEQ ID NO: 108206 - protein, 9 aa, Dengue virus
LPVWLSYKV

SEQ ID NO: 108207 - protein, 9 aa, Dengue virus
PVWLSYKVA

SEQ ID NO: 108208 - protein, 9 aa, Dengue virus
VWLSYKVAS

SEQ ID NO: 108209 - protein, 9 aa, Dengue virus
YSDRRWCFD

SEQ ID NO: 108210 - protein, 9 aa, Dengue virus
SDRRWCFDG

SEQ ID NO: 108211 - protein, 9 aa, Dengue virus
RNNQVLEEN

SEQ ID NO: 108212 - protein, 9 aa, Dengue virus
NNQVLEENM

SEQ ID NO: 108213 - protein, 9 aa, Dengue virus
NQVLEENMD

SEQ ID NO: 108214 - protein, 9 aa, Dengue virus
QVLEENMDV

SEQ ID NO: 108215 - protein, 9 aa, Dengue virus
VLEENMDVE

SEQ ID NO: 108216 - protein, 9 aa, Dengue virus
LEENMDVEI

SEQ ID NO: 108217 - protein, 9 aa, Dengue virus
EENMDVEIW

SEQ ID NO: 108218 - protein, 9 aa, Dengue virus
ENMDVEIWT

SEQ ID NO: 108219 - protein, 9 aa, Dengue virus
NMDVEIWTK

SEQ ID NO: 108220 - protein, 9 aa, Dengue virus
MDVEIWTKE

SEQ ID NO: 108221 - protein, 9 aa, Dengue virus
DVEIWTKEG

SEQ ID NO: 108222 - protein, 9 aa, Dengue virus
ERKKLRPRW

SEQ ID NO: 108223 - protein, 9 aa, Dengue virus
RKKLRPRWL

SEQ ID NO: 108224 - protein, 9 aa, Dengue virus
KKLRPRWLD

SEQ ID NO: 108225 - protein, 9 aa, Dengue virus
KLRPRWLDA

SEQ ID NO: 108226 - protein, 9 aa, Dengue virus
LRPRWLDAR

SEQ ID NO: 108227 - protein, 9 aa, Dengue virus
RPRWLDART

SEQ ID NO: 108228 - protein, 9 aa, Dengue virus
PRWLDARTY

SEQ ID NO: 108229 - protein, 9 aa, Dengue virus
RWLDARTYS

SEQ ID NO: 108230 - protein, 9 aa, Dengue virus
WLDARTYSD

SEQ ID NO: 108231 - protein, 9 aa, Dengue virus
LDARTYSDP

SEQ ID NO: 108232 - protein, 9 aa, Dengue virus
DARTYSDPL

SEQ ID NO: 108233 - protein, 9 aa, Dengue virus
ARTYSDPLA

SEQ ID NO: 108234 - protein, 9 aa, Dengue virus
RTYSDPLAL

SEQ ID NO: 108235 - protein, 9 aa, Dengue virus
TYSDPLALR

SEQ ID NO: 108236 - protein, 9 aa, Dengue virus
YSDPLALKE

SEQ ID NO: 108237 - protein, 9 aa, Dengue virus
SDPLALKEF

SEQ ID NO: 108238 - protein, 9 aa, Dengue virus
DPLALKEFK

SEQ ID NO: 108239 - protein, 9 aa, Dengue virus
PLALREFKE

SEQ ID NO: 108240 - protein, 9 aa, Dengue virus
LALREFKEF

SEQ ID NO: 108241 - protein, 9 aa, Dengue virus
ALREFKEFA

SEQ ID NO: 108242 - protein, 9 aa, Dengue virus
LREFKEFAA

SEQ ID NO: 108243 - protein, 9 aa, Dengue virus
REFKEFAAG

SEQ ID NO: 108244 - protein, 9 aa, Dengue virus
EFKEFAAGR

SEQ ID NO: 108245 - protein, 9 aa, Dengue virus
FKEFAAGRR

SEQ ID NO: 108246 - protein, 9 aa, Dengue virus
KEFAAGRRS

SEQ ID NO: 108247 - protein, 9 aa, Dengue virus
EFAAGRRSV

SEQ ID NO: 108248 - protein, 9 aa, Dengue virus
FAAGRRSVS

SEQ ID NO: 108249 - protein, 9 aa, Dengue virus
AAGRRSVSG

SEQ ID NO: 108250 - protein, 9 aa, Dengue virus
DLILEIGKL

SEQ ID NO: 108251 - protein, 9 aa, Dengue virus
LILEIGKLP

SEQ ID NO: 108252 - protein, 9 aa, Dengue virus
ILEIGKLPQ

SEQ ID NO: 108253 - protein, 9 aa, Dengue virus
LEIGKLPQH

SEQ ID NO: 108254 - protein, 9 aa, Dengue virus
EIGKLPQHL

SEQ ID NO: 108255 - protein, 9 aa, Dengue virus
IGKLPQHLT

SEQ ID NO: 108256 - protein, 9 aa, Dengue virus
QNALDNLVM

SEQ ID NO: 108257 - protein, 9 aa, Dengue virus
NALDNLVML

SEQ ID NO: 108258 - protein, 9 aa, Dengue virus
ALDNLVMLH

SEQ ID NO: 108259 - protein, 9 aa, Dengue virus
LDNLVMLHN

SEQ ID NO: 108260 - protein, 9 aa, Dengue virus
DNLVMLHNS

SEQ ID NO: 108261 - protein, 9 aa, Dengue virus
NLVMLHNSE

SEQ ID NO: 108262 - protein, 9 aa, Dengue virus
AYRHAMEEL

SEQ ID NO: 108263 - protein, 9 aa, Dengue virus
YRHAMEELP

SEQ ID NO: 108264 - protein, 9 aa, Dengue virus
RHAMEELPD

SEQ ID NO: 108265 - protein, 9 aa, Dengue virus
HAMEELPDT

SEQ ID NO: 108266 - protein, 9 aa, Dengue virus
AMEELPDTI

SEQ ID NO: 108267 - protein, 9 aa, Dengue virus
MEELPDTIE

SEQ ID NO: 108268 - protein, 9 aa, Dengue virus
EELPDTIET

SEQ ID NO: 108269 - protein, 9 aa, Dengue virus
ELPDTIETL

SEQ ID NO: 108270 - protein, 9 aa, Dengue virus
LPDTIETLM

SEQ ID NO: 108271 - protein, 9 aa, Dengue virus
PDTIETLML

SEQ ID NO: 108272 - protein, 9 aa, Dengue virus
DTIETLMLL

SEQ ID NO: 108273 - protein, 9 aa, Dengue virus
TIETLMLLA

SEQ ID NO: 108274 - protein, 9 aa, Dengue virus
IETLMLLAL

SEQ ID NO: 108275 - protein, 9 aa, Dengue virus
ETLMLLALI

SEQ ID NO: 108276 - protein, 9 aa, Dengue virus
TLMLLALIA

SEQ ID NO: 108277 - protein, 9 aa, Dengue virus
LTGGVTLFF

SEQ ID NO: 108278 - protein, 9 aa, Dengue virus
GKTSIGLLC

SEQ ID NO: 108279 - protein, 9 aa, Dengue virus
KTSIGLLCV

SEQ ID NO: 108280 - protein, 9 aa, Dengue virus
VEPHWIAAS

SEQ ID NO: 108281 - protein, 9 aa, Dengue virus
EPHWIAASI

SEQ ID NO: 108282 - protein, 9 aa, Dengue virus
PHWIAASII

SEQ ID NO: 108283 - protein, 9 aa, Dengue virus
HWIAASIIL

SEQ ID NO: 108284 - protein, 9 aa, Dengue virus
WIAASIILE

SEQ ID NO: 108285 - protein, 9 aa, Dengue virus
IAASIILEF

SEQ ID NO: 108286 - protein, 9 aa, Dengue virus
AASIILEFF

SEQ ID NO: 108287 - protein, 9 aa, Dengue virus
ASIILEFFL

SEQ ID NO: 108288 - protein, 9 aa, Dengue virus
SIILEFFLM

SEQ ID NO: 108289 - protein, 9 aa, Dengue virus
IILEFFLMV

SEQ ID NO: 108290 - protein, 9 aa, Dengue virus
ILEFFLMVL

SEQ ID NO: 108291 - protein, 9 aa, Dengue virus
LEFFLMVLL

SEQ ID NO: 108292 - protein, 9 aa, Dengue virus
EFFLMVLLI

SEQ ID NO: 108293 - protein, 9 aa, Dengue virus
FFLMVLLIP

SEQ ID NO: 108294 - protein, 9 aa, Dengue virus
FLMVLLIPE

SEQ ID NO: 108295 - protein, 9 aa, Dengue virus
LMVLLIPEP

SEQ ID NO: 108296 - protein, 9 aa, Dengue virus
MVLLIPEPD

SEQ ID NO: 108297 - protein, 9 aa, Dengue virus
VLLIPEPEK

SEQ ID NO: 108298 - protein, 9 aa, Dengue virus
LLIPEPEKQ

SEQ ID NO: 108299 - protein, 9 aa, Dengue virus
LIPEPEKQR

SEQ ID NO: 108300 - protein, 9 aa, Dengue virus
IPEPEKQRT

SEQ ID NO: 108301 - protein, 9 aa, Dengue virus
PEPEKQRTP

SEQ ID NO: 108302 - protein, 9 aa, Dengue virus
EPEKQRTPQ

SEQ ID NO: 108303 - protein, 9 aa, Dengue virus
PEKQRTPQD

SEQ ID NO: 108304 - protein, 9 aa, Dengue virus
EKQRTPQDN

SEQ ID NO: 108305 - protein, 9 aa, Dengue virus
KQRTPQDNQ

SEQ ID NO: 108306 - protein, 9 aa, Dengue virus
QRTPQDNQL

SEQ ID NO: 108307 - protein, 9 aa, Dengue virus
RTPQDNQLA

SEQ ID NO: 108308 - protein, 9 aa, Dengue virus
TPQDNQLAY

SEQ ID NO: 108309 - protein, 9 aa, Dengue virus
PQDNQLAYV

SEQ ID NO: 108310 - protein, 9 aa, Dengue virus
QDNQLAYVV

SEQ ID NO: 108311 - protein, 9 aa, Dengue virus
DNQLAYVVI

SEQ ID NO: 108312 - protein, 9 aa, Dengue virus
NQLAYVVIG

SEQ ID NO: 108313 - protein, 9 aa, Dengue virus
QLAYVVIGL

SEQ ID NO: 108314 - protein, 9 aa, Dengue virus
LAYVVIGLL

SEQ ID NO: 108315 - protein, 9 aa, Dengue virus
AYVVIGLLF

SEQ ID NO: 108316 - protein, 9 aa, Dengue virus
VAANEMGLL

SEQ ID NO: 108317 - protein, 9 aa, Dengue virus
AANEMGLLE

SEQ ID NO: 108318 - protein, 9 aa, Dengue virus
ANEMGLLET

SEQ ID NO: 108319 - protein, 9 aa, Dengue virus
NEMGLLETT

SEQ ID NO: 108320 - protein, 9 aa, Dengue virus
EMGLLETTK

SEQ ID NO: 108321 - protein, 9 aa, Dengue virus
MGLLETTKK

SEQ ID NO: 108322 - protein, 9 aa, Dengue virus
GLLETTKKD

SEQ ID NO: 108323 - protein, 9 aa, Dengue virus
LLETTKKDL

SEQ ID NO: 108324 - protein, 9 aa, Dengue virus
LETTKKDLG

SEQ ID NO: 108325 - protein, 9 aa, Dengue virus
LDVDLHPAS

SEQ ID NO: 108326 - protein, 9 aa, Dengue virus
DVDLHPASA

SEQ ID NO: 108327 - protein, 9 aa, Dengue virus
VDLHPASAW

SEQ ID NO: 108328 - protein, 9 aa, Dengue virus
DLHPASAWT

SEQ ID NO: 108329 - protein, 9 aa, Dengue virus
LHPASAWTL

SEQ ID NO: 108330 - protein, 9 aa, Dengue virus
HPASAWTLY

SEQ ID NO: 108331 - protein, 9 aa, Dengue virus
PASAWTLYA

SEQ ID NO: 108332 - protein, 9 aa, Dengue virus
ASAWTLYAV

SEQ ID NO: 108333 - protein, 9 aa, Dengue virus
SAWTLYAVA

SEQ ID NO: 108334 - protein, 9 aa, Dengue virus
AWTLYAVAT

SEQ ID NO: 108335 - protein, 9 aa, Dengue virus
WTLYAVATT

SEQ ID NO: 108336 - protein, 9 aa, Dengue virus
TLYAVATTI

SEQ ID NO: 108337 - protein, 9 aa, Dengue virus
LYAVATTII

SEQ ID NO: 108338 - protein, 9 aa, Dengue virus
YAVATTIIT

SEQ ID NO: 108339 - protein, 9 aa, Dengue virus
AVATTIITP

SEQ ID NO: 108340 - protein, 9 aa, Dengue virus
VATTIITPM

SEQ ID NO: 108341 - protein, 9 aa, Dengue virus
ITPMMRHTI

SEQ ID NO: 108342 - protein, 9 aa, Dengue virus
TPMMRHTIE

SEQ ID NO: 108343 - protein, 9 aa, Dengue virus
PMMRHTIEN

SEQ ID NO: 108344 - protein, 9 aa, Dengue virus
MMRHTIENT

SEQ ID NO: 108345 - protein, 9 aa, Dengue virus
MRHTIENTT

SEQ ID NO: 108346 - protein, 9 aa, Dengue virus
RHTIENTTA

SEQ ID NO: 108347 - protein, 9 aa, Dengue virus
HTIENTTAN

SEQ ID NO: 108348 - protein, 9 aa, Dengue virus
TIENTTANI

SEQ ID NO: 108349 - protein, 9 aa, Dengue virus
IENTTANIS

SEQ ID NO: 108350 - protein, 9 aa, Dengue virus
ENTTANISL

SEQ ID NO: 108351 - protein, 9 aa, Dengue virus
NTTANISLT

SEQ ID NO: 108352 - protein, 9 aa, Dengue virus
TTANISLTA

SEQ ID NO: 108353 - protein, 9 aa, Dengue virus
TANISLTAI

SEQ ID NO: 108354 - protein, 9 aa, Dengue virus
ANISLTAIA

SEQ ID NO: 108355 - protein, 9 aa, Dengue virus
NISLTAIAN

SEQ ID NO: 108356 - protein, 9 aa, Dengue virus
ISLTAIANQ

SEQ ID NO: 108357 - protein, 9 aa, Dengue virus
SLTAIANQA

SEQ ID NO: 108358 - protein, 9 aa, Dengue virus
LTAIANQAA

SEQ ID NO: 108359 - protein, 9 aa, Dengue virus
TAIANQAAI

SEQ ID NO: 108360 - protein, 9 aa, Dengue virus
AIANQAAIL

SEQ ID NO: 108361 - protein, 9 aa, Dengue virus
IANQAAILM

SEQ ID NO: 108362 - protein, 9 aa, Dengue virus
ANQAAILMG

SEQ ID NO: 108363 - protein, 9 aa, Dengue virus
NQAAILMGL

SEQ ID NO: 108364 - protein, 9 aa, Dengue virus
QAAILMGLD

SEQ ID NO: 108365 - protein, 9 aa, Dengue virus
AAILMGLDK

SEQ ID NO: 108366 - protein, 9 aa, Dengue virus
AILMGLDKG

SEQ ID NO: 108367 - protein, 9 aa, Dengue virus
ILMGLDKGW

SEQ ID NO: 108368 - protein, 9 aa, Dengue virus
LMGLDKGWP

SEQ ID NO: 108369 - protein, 9 aa, Dengue virus
MGLDKGWPI

SEQ ID NO: 108370 - protein, 9 aa, Dengue virus
GLDKGWPIS

SEQ ID NO: 108371 - protein, 9 aa, Dengue virus
LDKGWPISK

SEQ ID NO: 108372 - protein, 9 aa, Dengue virus
DKGWPISKM

SEQ ID NO: 108373 - protein, 9 aa, Dengue virus
KGWPISKMD

SEQ ID NO: 108374 - protein, 9 aa, Dengue virus
GWPISKMDI

SEQ ID NO: 108375 - protein, 9 aa, Dengue virus
WPISKMDIG

SEQ ID NO: 108376 - protein, 9 aa, Dengue virus
PISKMDIGV

SEQ ID NO: 108377 - protein, 9 aa, Dengue virus
ISKMDIGVP

SEQ ID NO: 108378 - protein, 9 aa, Dengue virus
SKMDIGVPL

SEQ ID NO: 108379 - protein, 9 aa, Dengue virus
KMDIGVPLL

SEQ ID NO: 108380 - protein, 9 aa, Dengue virus
MDIGVPLLA

SEQ ID NO: 108381 - protein, 9 aa, Dengue virus
DIGVPLLAL

SEQ ID NO: 108382 - protein, 9 aa, Dengue virus
IGVPLLALG

SEQ ID NO: 108383 - protein, 9 aa, Dengue virus
GVPLLALGC

SEQ ID NO: 108384 - protein, 9 aa, Dengue virus
VPLLALGCY

SEQ ID NO: 108385 - protein, 9 aa, Dengue virus
PLLALGCYS

SEQ ID NO: 108386 - protein, 9 aa, Dengue virus
LLALGCYSQ

SEQ ID NO: 108387 - protein, 9 aa, Dengue virus
LALGCYSQV

SEQ ID NO: 108388 - protein, 9 aa, Dengue virus
ALGCYSQVN

SEQ ID NO: 108389 - protein, 9 aa, Dengue virus
LGCYSQVNP

SEQ ID NO: 108390 - protein, 9 aa, Dengue virus
GCYSQVNPL

SEQ ID NO: 108391 - protein, 9 aa, Dengue virus
CYSQVNPLT

SEQ ID NO: 108392 - protein, 9 aa, Dengue virus
YSQVNPLTL

SEQ ID NO: 108393 - protein, 9 aa, Dengue virus
SQVNPLTLT

SEQ ID NO: 108394 - protein, 9 aa, Dengue virus
QVNPLTLTA

SEQ ID NO: 108395 - protein, 9 aa, Dengue virus
VNPLTLTAA

SEQ ID NO: 108396 - protein, 9 aa, Dengue virus
NPLTLTAAV

SEQ ID NO: 108397 - protein, 9 aa, Dengue virus
LVAHYAIIG

SEQ ID NO: 108398 - protein, 9 aa, Dengue virus
VAHYAIIGP

SEQ ID NO: 108399 - protein, 9 aa, Dengue virus
AHYAIIGPG

SEQ ID NO: 108400 - protein, 9 aa, Dengue virus
HYAIIGPGL

SEQ ID NO: 108401 - protein, 9 aa, Dengue virus
YAIIGPGLQ

SEQ ID NO: 108402 - protein, 9 aa, Dengue virus
AIIGPGLQA

SEQ ID NO: 108403 - protein, 9 aa, Dengue virus
IIGPGLQAK

SEQ ID NO: 108404 - protein, 9 aa, Dengue virus
IGPGLQAKA

SEQ ID NO: 108405 - protein, 9 aa, Dengue virus
GPGLQAKAT

SEQ ID NO: 108406 - protein, 9 aa, Dengue virus
PGLQAKATR

SEQ ID NO: 108407 - protein, 9 aa, Dengue virus
GLQAKATRE

SEQ ID NO: 108408 - protein, 9 aa, Dengue virus
LQAKATREA

SEQ ID NO: 108409 - protein, 9 aa, Dengue virus
QAKATREAQ

SEQ ID NO: 108410 - protein, 9 aa, Dengue virus
AKATREAQK

SEQ ID NO: 108411 - protein, 9 aa, Dengue virus
KATREAQKR

SEQ ID NO: 108412 - protein, 9 aa, Dengue virus
ATREAQKRT

SEQ ID NO: 108413 - protein, 9 aa, Dengue virus
TREAQKRTA

SEQ ID NO: 108414 - protein, 9 aa, Dengue virus
REAQKRTAA

SEQ ID NO: 108415 - protein, 9 aa, Dengue virus
EAQKRTAAG

SEQ ID NO: 108416 - protein, 9 aa, Dengue virus
AQKRTAAGI

SEQ ID NO: 108417 - protein, 9 aa, Dengue virus
QKRTAAGIM

SEQ ID NO: 108418 - protein, 9 aa, Dengue virus
KRTAAGIMK

SEQ ID NO: 108419 - protein, 9 aa, Dengue virus
RTAAGIMKN

SEQ ID NO: 108420 - protein, 9 aa, Dengue virus
TAAGIMKNP

SEQ ID NO: 108421 - protein, 9 aa, Dengue virus
AAGIMKNPT

SEQ ID NO: 108422 - protein, 9 aa, Dengue virus
AGIMKNPTV

SEQ ID NO: 108423 - protein, 9 aa, Dengue virus
GIMKNPTVD

SEQ ID NO: 108424 - protein, 9 aa, Dengue virus
IMKNPTVDG

SEQ ID NO: 108425 - protein, 9 aa, Dengue virus
MKNPTVDGI

SEQ ID NO: 108426 - protein, 9 aa, Dengue virus
KNPTVDGIV

SEQ ID NO: 108427 - protein, 9 aa, Dengue virus
NPTVDGIVA

SEQ ID NO: 108428 - protein, 9 aa, Dengue virus
PTVDGIVAI

SEQ ID NO: 108429 - protein, 9 aa, Dengue virus
AIDLDPVVY

SEQ ID NO: 108430 - protein, 9 aa, Dengue virus
IDLDPVVYD

SEQ ID NO: 108431 - protein, 9 aa, Dengue virus
PVVYDAKFE

SEQ ID NO: 108432 - protein, 9 aa, Dengue virus
VVYDAKFEK

SEQ ID NO: 108433 - protein, 9 aa, Dengue virus
VYDAKFEKQ

SEQ ID NO: 108434 - protein, 9 aa, Dengue virus
YDAKFEKQL

SEQ ID NO: 108435 - protein, 9 aa, Dengue virus
DAKFEKQLG

SEQ ID NO: 108436 - protein, 9 aa, Dengue virus
AKFEKQLGQ

SEQ ID NO: 108437 - protein, 9 aa, Dengue virus
KFEKQLGQV

SEQ ID NO: 108438 - protein, 9 aa, Dengue virus
FEKQLGQVM

SEQ ID NO: 108439 - protein, 9 aa, Dengue virus
EKQLGQVML

SEQ ID NO: 108440 - protein, 9 aa, Dengue virus
KQLGQVMLL

SEQ ID NO: 108441 - protein, 9 aa, Dengue virus
QLGQIMLLI

SEQ ID NO: 108442 - protein, 9 aa, Dengue virus
LGQIMLLIL

SEQ ID NO: 108443 - protein, 9 aa, Dengue virus
GQIMLLILC

SEQ ID NO: 108444 - protein, 9 aa, Dengue virus
QIMLLILCT

SEQ ID NO: 108445 - protein, 9 aa, Dengue virus
LCTSQILLM

SEQ ID NO: 108446 - protein, 9 aa, Dengue virus
CTSQILLMR

SEQ ID NO: 108447 - protein, 9 aa, Dengue virus
TSQILLMRT

SEQ ID NO: 108448 - protein, 9 aa, Dengue virus
SQILLMRTT

SEQ ID NO: 108449 - protein, 9 aa, Dengue virus
QILLMRTTW

SEQ ID NO: 108450 - protein, 9 aa, Dengue virus
ILLMRTTWA

SEQ ID NO: 108451 - protein, 9 aa, Dengue virus
LLMRTTWAL

SEQ ID NO: 108452 - protein, 9 aa, Dengue virus
LMRTTWALC

SEQ ID NO: 108453 - protein, 9 aa, Dengue virus
MRTTWALCE

SEQ ID NO: 108454 - protein, 9 aa, Dengue virus
RTTWALCES

SEQ ID NO: 108455 - protein, 9 aa, Dengue virus
TTWALCESI

SEQ ID NO: 108456 - protein, 9 aa, Dengue virus
TWALCESIT

SEQ ID NO: 108457 - protein, 9 aa, Dengue virus
WALCEALTL

SEQ ID NO: 108458 - protein, 9 aa, Dengue virus
ALCEALTLA

SEQ ID NO: 108459 - protein, 9 aa, Dengue virus
LCEALTLAT

SEQ ID NO: 108460 - protein, 9 aa, Dengue virus
CEALTLATG

SEQ ID NO: 108461 - protein, 9 aa, Dengue virus
EALTLATGP

SEQ ID NO: 108462 - protein, 9 aa, Dengue virus
ALTLATGPI

SEQ ID NO: 108463 - protein, 9 aa, Dengue virus
ITLATGPLT

SEQ ID NO: 108464 - protein, 9 aa, Dengue virus
TLATGPLTT

SEQ ID NO: 108465 - protein, 9 aa, Dengue virus
LATGPLTTL

SEQ ID NO: 108466 - protein, 9 aa, Dengue virus
ATGPLTTLW

SEQ ID NO: 108467 - protein, 9 aa, Dengue virus
TGPLTTLWE

SEQ ID NO: 108468 - protein, 9 aa, Dengue virus
GPLTTLWEG

SEQ ID NO: 108469 - protein, 9 aa, Dengue virus
PLTTLWEGS

SEQ ID NO: 108470 - protein, 9 aa, Dengue virus
LTTLWEGSP

SEQ ID NO: 108471 - protein, 9 aa, Dengue virus
TTLWEGSPG

SEQ ID NO: 108472 - protein, 9 aa, Dengue virus
TLWEGSPGK

SEQ ID NO: 108473 - protein, 9 aa, Dengue virus
LWEGSPGKF

SEQ ID NO: 108474 - protein, 9 aa, Dengue virus
WEGSPGKFW

SEQ ID NO: 108475 - protein, 9 aa, Dengue virus
EGSPGKFWN

SEQ ID NO: 108476 - protein, 9 aa, Dengue virus
GSPGKFWNT

SEQ ID NO: 108477 - protein, 9 aa, Dengue virus
SPGKFWNTT

SEQ ID NO: 108478 - protein, 9 aa, Dengue virus
PGKFWNTTI

SEQ ID NO: 108479 - protein, 9 aa, Dengue virus
GKFWNTTIA

SEQ ID NO: 108480 - protein, 9 aa, Dengue virus
KFWNTTIAV

SEQ ID NO: 108481 - protein, 9 aa, Dengue virus
FWNTTIAVS

SEQ ID NO: 108482 - protein, 9 aa, Dengue virus
WNTTIAVSM

SEQ ID NO: 108483 - protein, 9 aa, Dengue virus
NTTIAVSMA

SEQ ID NO: 108484 - protein, 9 aa, Dengue virus
TTIAVSMAN

SEQ ID NO: 108485 - protein, 9 aa, Dengue virus
TIAVSMANI

SEQ ID NO: 108486 - protein, 9 aa, Dengue virus
IAVSMANIF

SEQ ID NO: 108487 - protein, 9 aa, Dengue virus
AVSMANIFR

SEQ ID NO: 108488 - protein, 9 aa, Dengue virus
VSMANIFRG

SEQ ID NO: 108489 - protein, 9 aa, Dengue virus
SMANIFRGS

SEQ ID NO: 108490 - protein, 9 aa, Dengue virus
MANIFRGSY

SEQ ID NO: 108491 - protein, 9 aa, Dengue virus
ANIFRGSYL

SEQ ID NO: 108492 - protein, 9 aa, Dengue virus
NIFRGSYLA

SEQ ID NO: 108493 - protein, 9 aa, Dengue virus
IFRGSYLAG

SEQ ID NO: 108494 - protein, 9 aa, Dengue virus
FRGSYLAGA

SEQ ID NO: 108495 - protein, 9 aa, Dengue virus
RGSYLAGAG

SEQ ID NO: 108496 - protein, 9 aa, Dengue virus
GSYLAGAGL

SEQ ID NO: 108497 - protein, 9 aa, Dengue virus
SYLAGAGLA

SEQ ID NO: 108498 - protein, 9 aa, Dengue virus
YLAGAGLAF

SEQ ID NO: 108499 - protein, 9 aa, Dengue virus
LAGAGLAFS

SEQ ID NO: 108500 - protein, 9 aa, Dengue virus
AGAGLAFSL

SEQ ID NO: 108501 - protein, 9 aa, Dengue virus
GAGLAFSLM

SEQ ID NO: 108502 - protein, 9 aa, Dengue virus
AGLAFSLMK

SEQ ID NO: 108503 - protein, 9 aa, Dengue virus
GLAFSLMKS

SEQ ID NO: 108504 - protein, 9 aa, Dengue virus
LAFSLMKSL

SEQ ID NO: 108505 - protein, 9 aa, Dengue virus
QGETLGEKW

SEQ ID NO: 108506 - protein, 9 aa, Dengue virus
GETLGEKWK

SEQ ID NO: 108507 - protein, 9 aa, Dengue virus
ETLGEKWKR

SEQ ID NO: 108508 - protein, 9 aa, Dengue virus
TLGEKWKRQ

SEQ ID NO: 108509 - protein, 9 aa, Dengue virus
LGEKWKRQL

SEQ ID NO: 108510 - protein, 9 aa, Dengue virus
GEKWKRQLN

SEQ ID NO: 108511 - protein, 9 aa, Dengue virus
EVDRSEAKE

SEQ ID NO: 108512 - protein, 9 aa, Dengue virus
VDRSEAKEG

SEQ ID NO: 108513 - protein, 9 aa, Dengue virus
DRSEAKEGL

SEQ ID NO: 108514 - protein, 9 aa, Dengue virus
EAKEGLKRG

SEQ ID NO: 108515 - protein, 9 aa, Dengue virus
AKEGLKRGE

SEQ ID NO: 108516 - protein, 9 aa, Dengue virus
KEGLKRGET

SEQ ID NO: 108517 - protein, 9 aa, Dengue virus
HHAVSRGSA

SEQ ID NO: 108518 - protein, 9 aa, Dengue virus
HAVSRGSAK

SEQ ID NO: 108519 - protein, 9 aa, Dengue virus
AVSRGSAKL

SEQ ID NO: 108520 - protein, 9 aa, Dengue virus
VSRGTAKLR

SEQ ID NO: 108521 - protein, 9 aa, Dengue virus
SRGTAKLRW

SEQ ID NO: 108522 - protein, 9 aa, Dengue virus
RGTAKLRWF

SEQ ID NO: 108523 - protein, 9 aa, Dengue virus
GTAKLRWFV

SEQ ID NO: 108524 - protein, 9 aa, Dengue virus
TAKLRWFVE

SEQ ID NO: 108525 - protein, 9 aa, Dengue virus
AKLRWFVER

SEQ ID NO: 108526 - protein, 9 aa, Dengue virus
KLRWFVERN

SEQ ID NO: 108527 - protein, 9 aa, Dengue virus
LRWFVERNL

SEQ ID NO: 108528 - protein, 9 aa, Dengue virus
RWFVERNLV

SEQ ID NO: 108529 - protein, 9 aa, Dengue virus
PEGKVIDLG

SEQ ID NO: 108530 - protein, 9 aa, Dengue virus
EGKVIDLGC

SEQ ID NO: 108531 - protein, 9 aa, Dengue virus
GKVIDLGCG

SEQ ID NO: 108532 - protein, 9 aa, Dengue virus
KVIDLGCGR

SEQ ID NO: 108533 - protein, 9 aa, Dengue virus
VIDLGCGRG

SEQ ID NO: 108534 - protein, 9 aa, Dengue virus
IDLGCGRGG

SEQ ID NO: 108535 - protein, 9 aa, Dengue virus
DLGCGRGGW

SEQ ID NO: 108536 - protein, 9 aa, Dengue virus
LGCGRGGWS

SEQ ID NO: 108537 - protein, 9 aa, Dengue virus
GCGRGGWSY

SEQ ID NO: 108538 - protein, 9 aa, Dengue virus
CGRGGWSYY

SEQ ID NO: 108539 - protein, 9 aa, Dengue virus
GRGGWSYYC

SEQ ID NO: 108540 - protein, 9 aa, Dengue virus
RGGWSYYCA

SEQ ID NO: 108541 - protein, 9 aa, Dengue virus
GGWSYYCAG

SEQ ID NO: 108542 - protein, 9 aa, Dengue virus
GWSYYCAGL

SEQ ID NO: 108543 - protein, 9 aa, Dengue virus
WSYYCAGLK

SEQ ID NO: 108544 - protein, 9 aa, Dengue virus
SYYCAGLKK

SEQ ID NO: 108545 - protein, 9 aa, Dengue virus
YYCAGLKKV

SEQ ID NO: 108546 - protein, 9 aa, Dengue virus
YCAGLKKVT

SEQ ID NO: 108547 - protein, 9 aa, Dengue virus
CAGLKKVTE

SEQ ID NO: 108548 - protein, 9 aa, Dengue virus
AGLKKVTEV

SEQ ID NO: 108549 - protein, 9 aa, Dengue virus
VTEVKGYTK

SEQ ID NO: 108550 - protein, 9 aa, Dengue virus
TEVKGYTKG

SEQ ID NO: 108551 - protein, 9 aa, Dengue virus
EVKGYTKGG

SEQ ID NO: 108552 - protein, 9 aa, Dengue virus
VKGYTKGGP

SEQ ID NO: 108553 - protein, 9 aa, Dengue virus
KGYTKGGPG

SEQ ID NO: 108554 - protein, 9 aa, Dengue virus
GYTKGGPGH

SEQ ID NO: 108555 - protein, 9 aa, Dengue virus
YTKGGPGHE

SEQ ID NO: 108556 - protein, 9 aa, Dengue virus
TKGGPGHEE

SEQ ID NO: 108557 - protein, 9 aa, Dengue virus
KGGPGHEEP

SEQ ID NO: 108558 - protein, 9 aa, Dengue virus
GGPGHEEPI

SEQ ID NO: 108559 - protein, 9 aa, Dengue virus
GPGHEEPIP

SEQ ID NO: 108560 - protein, 9 aa, Dengue virus
PGHEEPIPM

SEQ ID NO: 108561 - protein, 9 aa, Dengue virus
GHEEPIPMA

SEQ ID NO: 108562 - protein, 9 aa, Dengue virus
HEEPIPMAT

SEQ ID NO: 108563 - protein, 9 aa, Dengue virus
EEPIPMATY

SEQ ID NO: 108564 - protein, 9 aa, Dengue virus
EPIPMATYG

SEQ ID NO: 108565 - protein, 9 aa, Dengue virus
PIPMATYGW

SEQ ID NO: 108566 - protein, 9 aa, Dengue virus
IPMATYGWN

SEQ ID NO: 108567 - protein, 9 aa, Dengue virus
PMATYGWNL

SEQ ID NO: 108568 - protein, 9 aa, Dengue virus
MATYGWNLV

SEQ ID NO: 108569 - protein, 9 aa, Dengue virus
ATYGWNLVK

SEQ ID NO: 108570 - protein, 9 aa, Dengue virus
TYGWNLVKL

SEQ ID NO: 108571 - protein, 9 aa, Dengue virus
YGWNLVKLH

SEQ ID NO: 108572 - protein, 9 aa, Dengue virus
GWNLVKLHS

SEQ ID NO: 108573 - protein, 9 aa, Dengue virus
WNLVKLHSG

SEQ ID NO: 108574 - protein, 9 aa, Dengue virus
LHSGKDVFF

SEQ ID NO: 108575 - protein, 9 aa, Dengue virus
PPEKCDTLL

SEQ ID NO: 108576 - protein, 9 aa, Dengue virus
PEKCDTLLC

SEQ ID NO: 108577 - protein, 9 aa, Dengue virus
EKCDTLLCD

SEQ ID NO: 108578 - protein, 9 aa, Dengue virus
KCDTLLCDI

SEQ ID NO: 108579 - protein, 9 aa, Dengue virus
CDTLLCDIG

SEQ ID NO: 108580 - protein, 9 aa, Dengue virus
DTLLCDIGE

SEQ ID NO: 108581 - protein, 9 aa, Dengue virus
TLLCDIGES

SEQ ID NO: 108582 - protein, 9 aa, Dengue virus
LLCDIGESS

SEQ ID NO: 108583 - protein, 9 aa, Dengue virus
LCDIGESSP

SEQ ID NO: 108584 - protein, 9 aa, Dengue virus
CDIGESSPN

SEQ ID NO: 108585 - protein, 9 aa, Dengue virus
DIGESSPNP

SEQ ID NO: 108586 - protein, 9 aa, Dengue virus
IGESSPNPT

SEQ ID NO: 108587 - protein, 9 aa, Dengue virus
GESSPNPTI

SEQ ID NO: 108588 - protein, 9 aa, Dengue virus
ESSPNPTIE

SEQ ID NO: 108589 - protein, 9 aa, Dengue virus
SSPNPTIEE

SEQ ID NO: 108590 - protein, 9 aa, Dengue virus
SPNPTIEEG

SEQ ID NO: 108591 - protein, 9 aa, Dengue virus
PNPTIEEGR

SEQ ID NO: 108592 - protein, 9 aa, Dengue virus
NPTIEEGRT

SEQ ID NO: 108593 - protein, 9 aa, Dengue virus
PTIEEGRTL

SEQ ID NO: 108594 - protein, 9 aa, Dengue virus
TIEEGRTLR

SEQ ID NO: 108595 - protein, 9 aa, Dengue virus
IEEGRTLRV

SEQ ID NO: 108596 - protein, 9 aa, Dengue virus
EEGRTLRVL

SEQ ID NO: 108597 - protein, 9 aa, Dengue virus
EGRTLRVLK

SEQ ID NO: 108598 - protein, 9 aa, Dengue virus
GRTLRVLKM

SEQ ID NO: 108599 - protein, 9 aa, Dengue virus
RTLRVLKMV

SEQ ID NO: 108600 - protein, 9 aa, Dengue virus
TLRVLKMVE

SEQ ID NO: 108601 - protein, 9 aa, Dengue virus
LRVLKMVEP

SEQ ID NO: 108602 - protein, 9 aa, Dengue virus
RVLKMVEPW

SEQ ID NO: 108603 - protein, 9 aa, Dengue virus
VLKMVEPWL

SEQ ID NO: 108604 - protein, 9 aa, Dengue virus
LKMVEPWLR

SEQ ID NO: 108605 - protein, 9 aa, Dengue virus
QFCIKVLNP

SEQ ID NO: 108606 - protein, 9 aa, Dengue virus
FCIKVLNPY

SEQ ID NO: 108607 - protein, 9 aa, Dengue virus
CIKVLNPYM

SEQ ID NO: 108608 - protein, 9 aa, Dengue virus
IKVLNPYMP

SEQ ID NO: 108609 - protein, 9 aa, Dengue virus
KILNPYMPS

SEQ ID NO: 108610 - protein, 9 aa, Dengue virus
ILNPYMPSV

SEQ ID NO: 108611 - protein, 9 aa, Dengue virus
LNPYMPSVV

SEQ ID NO: 108612 - protein, 9 aa, Dengue virus
NPYMPSVVE

SEQ ID NO: 108613 - protein, 9 aa, Dengue virus
HGGMLVRNP

SEQ ID NO: 108614 - protein, 9 aa, Dengue virus
GGMLVRNPL

SEQ ID NO: 108615 - protein, 9 aa, Dengue virus
GMLVRNPLS

SEQ ID NO: 108616 - protein, 9 aa, Dengue virus
MLVRNPLSR

SEQ ID NO: 108617 - protein, 9 aa, Dengue virus
LVRNPLSRN

SEQ ID NO: 108618 - protein, 9 aa, Dengue virus
VRNPLSRNS

SEQ ID NO: 108619 - protein, 9 aa, Dengue virus
RNPLSRNST

SEQ ID NO: 108620 - protein, 9 aa, Dengue virus
NPLSRNSTH

SEQ ID NO: 108621 - protein, 9 aa, Dengue virus
PLSRNSTHE

SEQ ID NO: 108622 - protein, 9 aa, Dengue virus
LSRNSTHEM

SEQ ID NO: 108623 - protein, 9 aa, Dengue virus
SRNSTHEMY

SEQ ID NO: 108624 - protein, 9 aa, Dengue virus
RNSTHEMYW

SEQ ID NO: 108625 - protein, 9 aa, Dengue virus
NSTHEMYWV

SEQ ID NO: 108626 - protein, 9 aa, Dengue virus
STHEMYWVS

SEQ ID NO: 108627 - protein, 9 aa, Dengue virus
THEMYWVSC

SEQ ID NO: 108628 - protein, 9 aa, Dengue virus
HEMYWVSCG

SEQ ID NO: 108629 - protein, 9 aa, Dengue virus
EMYWVSCGT

SEQ ID NO: 108630 - protein, 9 aa, Dengue virus
MYWVSCGTG

SEQ ID NO: 108631 - protein, 9 aa, Dengue virus
YWVSCGTGN

SEQ ID NO: 108632 - protein, 9 aa, Dengue virus
WVSCGTGNI

SEQ ID NO: 108633 - protein, 9 aa, Dengue virus
VSCGTGNIV

SEQ ID NO: 108634 - protein, 9 aa, Dengue virus
GTGNIVSAV

SEQ ID NO: 108635 - protein, 9 aa, Dengue virus
TGNIVSAVN

SEQ ID NO: 108636 - protein, 9 aa, Dengue virus
GNIVSAVNM

SEQ ID NO: 108637 - protein, 9 aa, Dengue virus
NIVSAVNMT

SEQ ID NO: 108638 - protein, 9 aa, Dengue virus
IVSAVNMTS

SEQ ID NO: 108639 - protein, 9 aa, Dengue virus
VSAVNMTSR

SEQ ID NO: 108640 - protein, 9 aa, Dengue virus
SAVNMTSRM

SEQ ID NO: 108641 - protein, 9 aa, Dengue virus
AVNMTSRML

SEQ ID NO: 108642 - protein, 9 aa, Dengue virus
VNMTSRMLL

SEQ ID NO: 108643 - protein, 9 aa, Dengue virus
NMTSRMLLN

SEQ ID NO: 108644 - protein, 9 aa, Dengue virus
MTSRMLLNR

SEQ ID NO: 108645 - protein, 9 aa, Dengue virus
TSRMLLNRF

SEQ ID NO: 108646 - protein, 9 aa, Dengue virus
SRMLLNRFT

SEQ ID NO: 108647 - protein, 9 aa, Dengue virus
RMLLNRFTM

SEQ ID NO: 108648 - protein, 9 aa, Dengue virus
PTYERDVDL

SEQ ID NO: 108649 - protein, 9 aa, Dengue virus
TYERDVDLG

SEQ ID NO: 108650 - protein, 9 aa, Dengue virus
ERDVDLGAG

SEQ ID NO: 108651 - protein, 9 aa, Dengue virus
RDVDLGAGT

SEQ ID NO: 108652 - protein, 9 aa, Dengue virus
DVDLGAGTR

SEQ ID NO: 108653 - protein, 9 aa, Dengue virus
VDLGAGTRH

SEQ ID NO: 108654 - protein, 9 aa, Dengue virus
DLGAGTRHV

SEQ ID NO: 108655 - protein, 9 aa, Dengue virus
LGAGTRHVA

SEQ ID NO: 108656 - protein, 9 aa, Dengue virus
GAGTRHVAV

SEQ ID NO: 108657 - protein, 9 aa, Dengue virus
AGTRHVAVE

SEQ ID NO: 108658 - protein, 9 aa, Dengue virus
ANLDIIGQR

SEQ ID NO: 108659 - protein, 9 aa, Dengue virus
NLDIIGQRI

SEQ ID NO: 108660 - protein, 9 aa, Dengue virus
DIIGQRIEN

SEQ ID NO: 108661 - protein, 9 aa, Dengue virus
IIGQRIENI

SEQ ID NO: 108662 - protein, 9 aa, Dengue virus
IGQRIENIK

SEQ ID NO: 108663 - protein, 9 aa, Dengue virus
TWHYDEDNP

SEQ ID NO: 108664 - protein, 9 aa, Dengue virus
WHYDEDNPY

SEQ ID NO: 108665 - protein, 9 aa, Dengue virus
HYDEDNPYK

SEQ ID NO: 108666 - protein, 9 aa, Dengue virus
YDEDNPYKT

SEQ ID NO: 108667 - protein, 9 aa, Dengue virus
DEDNPYKTW

SEQ ID NO: 108668 - protein, 9 aa, Dengue virus
EDNPYKTWA

SEQ ID NO: 108669 - protein, 9 aa, Dengue virus
DNPYKTWAY

SEQ ID NO: 108670 - protein, 9 aa, Dengue virus
NPYKTWAYH

SEQ ID NO: 108671 - protein, 9 aa, Dengue virus
PYKTWAYHG

SEQ ID NO: 108672 - protein, 9 aa, Dengue virus
YKTWAYHGS

SEQ ID NO: 108673 - protein, 9 aa, Dengue virus
KTWAYHGSY

SEQ ID NO: 108674 - protein, 9 aa, Dengue virus
TWAYHGSYE

SEQ ID NO: 108675 - protein, 9 aa, Dengue virus
WAYHGSYEV

SEQ ID NO: 108676 - protein, 9 aa, Dengue virus
AYHGSYEVK

SEQ ID NO: 108677 - protein, 9 aa, Dengue virus
YHGSYEVKP

SEQ ID NO: 108678 - protein, 9 aa, Dengue virus
HGSYEVKPS

SEQ ID NO: 108679 - protein, 9 aa, Dengue virus
GSYEVKPSG

SEQ ID NO: 108680 - protein, 9 aa, Dengue virus
SYEVKPSGS

SEQ ID NO: 108681 - protein, 9 aa, Dengue virus
YEVKPSGSA

SEQ ID NO: 108682 - protein, 9 aa, Dengue virus
EVKPSGSAS

SEQ ID NO: 108683 - protein, 9 aa, Dengue virus
VKPSGSASS

SEQ ID NO: 108684 - protein, 9 aa, Dengue virus
KPSGSASSM

SEQ ID NO: 108685 - protein, 9 aa, Dengue virus
PSGSASSMV

SEQ ID NO: 108686 - protein, 9 aa, Dengue virus
SGSASSMVN

SEQ ID NO: 108687 - protein, 9 aa, Dengue virus
GSASSMVNG

SEQ ID NO: 108688 - protein, 9 aa, Dengue virus
SASSMVNGV

SEQ ID NO: 108689 - protein, 9 aa, Dengue virus
ASSMVNGVV

SEQ ID NO: 108690 - protein, 9 aa, Dengue virus
SSMVNGVVR

SEQ ID NO: 108691 - protein, 9 aa, Dengue virus
SMVNGVVRL

SEQ ID NO: 108692 - protein, 9 aa, Dengue virus
MVNGVVRLL

SEQ ID NO: 108693 - protein, 9 aa, Dengue virus
VNGVVRLLT

SEQ ID NO: 108694 - protein, 9 aa, Dengue virus
NGVVKLLTK

SEQ ID NO: 108695 - protein, 9 aa, Dengue virus
GVVKLLTKP

SEQ ID NO: 108696 - protein, 9 aa, Dengue virus
VVKLLTKPW

SEQ ID NO: 108697 - protein, 9 aa, Dengue virus
VKLLTKPWD

SEQ ID NO: 108698 - protein, 9 aa, Dengue virus
KLLTKPWDV

SEQ ID NO: 108699 - protein, 9 aa, Dengue virus
LLTKPWDVI

SEQ ID NO: 108700 - protein, 9 aa, Dengue virus
LTKPWDVIP

SEQ ID NO: 108701 - protein, 9 aa, Dengue virus
TKPWDVIPM

SEQ ID NO: 108702 - protein, 9 aa, Dengue virus
KPWDVIPMV

SEQ ID NO: 108703 - protein, 9 aa, Dengue virus
PWDVIPMVT

SEQ ID NO: 108704 - protein, 9 aa, Dengue virus
WDVIPMVTQ

SEQ ID NO: 108705 - protein, 9 aa, Dengue virus
PMVTQIAMT

SEQ ID NO: 108706 - protein, 9 aa, Dengue virus
MVTQIAMTD

SEQ ID NO: 108707 - protein, 9 aa, Dengue virus
VTQMAMTDT

SEQ ID NO: 108708 - protein, 9 aa, Dengue virus
TQMAMTDTT

SEQ ID NO: 108709 - protein, 9 aa, Dengue virus
QMAMTDTTP

SEQ ID NO: 108710 - protein, 9 aa, Dengue virus
MAMTDTTPF

SEQ ID NO: 108711 - protein, 9 aa, Dengue virus
AMTDTTPFG

SEQ ID NO: 108712 - protein, 9 aa, Dengue virus
MTDTTPFGQ

SEQ ID NO: 108713 - protein, 9 aa, Dengue virus
TDTTPFGQQ

SEQ ID NO: 108714 - protein, 9 aa, Dengue virus
DTTPFGQQR

SEQ ID NO: 108715 - protein, 9 aa, Dengue virus
TTPFGQQRV

SEQ ID NO: 108716 - protein, 9 aa, Dengue virus
TPFGQQRVF

SEQ ID NO: 108717 - protein, 9 aa, Dengue virus
PFGQQRVFK

SEQ ID NO: 108718 - protein, 9 aa, Dengue virus
FGQQRVFKE

SEQ ID NO: 108719 - protein, 9 aa, Dengue virus
GQQRVFKEK

SEQ ID NO: 108720 - protein, 9 aa, Dengue virus
QQRVFKEKV

SEQ ID NO: 108721 - protein, 9 aa, Dengue virus
QRVFKEKVD

SEQ ID NO: 108722 - protein, 9 aa, Dengue virus
RVFKEKVDT

SEQ ID NO: 108723 - protein, 9 aa, Dengue virus
VFKEKVDTR

SEQ ID NO: 108724 - protein, 9 aa, Dengue virus
FKEKVDTRT

SEQ ID NO: 108725 - protein, 9 aa, Dengue virus
KEKVDTRTP

SEQ ID NO: 108726 - protein, 9 aa, Dengue virus
EKVDTRTPK

SEQ ID NO: 108727 - protein, 9 aa, Dengue virus
PRICTREEF

SEQ ID NO: 108728 - protein, 9 aa, Dengue virus
CTREEFTRK

SEQ ID NO: 108729 - protein, 9 aa, Dengue virus
TREEFTRKV

SEQ ID NO: 108730 - protein, 9 aa, Dengue virus
REEFTRKVR

SEQ ID NO: 108731 - protein, 9 aa, Dengue virus
RKVRSNAAI

SEQ ID NO: 108732 - protein, 9 aa, Dengue virus
KVRSNAAIG

SEQ ID NO: 108733 - protein, 9 aa, Dengue virus
VRSNAAIGA

SEQ ID NO: 108734 - protein, 9 aa, Dengue virus
RSNAAIGAV

SEQ ID NO: 108735 - protein, 9 aa, Dengue virus
SNAAIGAVF

SEQ ID NO: 108736 - protein, 9 aa, Dengue virus
NAAIGAVFV

SEQ ID NO: 108737 - protein, 9 aa, Dengue virus
AAIGAVFVD

SEQ ID NO: 108738 - protein, 9 aa, Dengue virus
AIGAVFVDE

SEQ ID NO: 108739 - protein, 9 aa, Dengue virus
IGAVFVDEN

SEQ ID NO: 108740 - protein, 9 aa, Dengue virus
GAVFVDENQ

SEQ ID NO: 108741 - protein, 9 aa, Dengue virus
AVFVDENQW

SEQ ID NO: 108742 - protein, 9 aa, Dengue virus
VFVDENQWN

SEQ ID NO: 108743 - protein, 9 aa, Dengue virus
FVDENQWNS

SEQ ID NO: 108744 - protein, 9 aa, Dengue virus
VDENQWNSA

SEQ ID NO: 108745 - protein, 9 aa, Dengue virus
DENQWNSAK

SEQ ID NO: 108746 - protein, 9 aa, Dengue virus
ENQWNSAKE

SEQ ID NO: 108747 - protein, 9 aa, Dengue virus
NQWNSAKEA

SEQ ID NO: 108748 - protein, 9 aa, Dengue virus
QWNSAKEAV

SEQ ID NO: 108749 - protein, 9 aa, Dengue virus
WNSAKEAVE

SEQ ID NO: 108750 - protein, 9 aa, Dengue virus
NSAKEAVED

SEQ ID NO: 108751 - protein, 9 aa, Dengue virus
ERELHKQGK

SEQ ID NO: 108752 - protein, 9 aa, Dengue virus
RELHKQGKC

SEQ ID NO: 108753 - protein, 9 aa, Dengue virus
ELHKQGKCA

SEQ ID NO: 108754 - protein, 9 aa, Dengue virus
LHKQGKCAT

SEQ ID NO: 108755 - protein, 9 aa, Dengue virus
HKQGKCATC

SEQ ID NO: 108756 - protein, 9 aa, Dengue virus
KQGKCATCV

SEQ ID NO: 108757 - protein, 9 aa, Dengue virus
QGKCATCVY

SEQ ID NO: 108758 - protein, 9 aa, Dengue virus
GKCATCVYN

SEQ ID NO: 108759 - protein, 9 aa, Dengue virus
KCATCVYNM

SEQ ID NO: 108760 - protein, 9 aa, Dengue virus
CATCVYNMM

SEQ ID NO: 108761 - protein, 9 aa, Dengue virus
ATCVYNMMG

SEQ ID NO: 108762 - protein, 9 aa, Dengue virus
TCVYNMMGK

SEQ ID NO: 108763 - protein, 9 aa, Dengue virus
CVYNMMGKR

SEQ ID NO: 108764 - protein, 9 aa, Dengue virus
VYNMMGKRE

SEQ ID NO: 108765 - protein, 9 aa, Dengue virus
YNMMGKREK

SEQ ID NO: 108766 - protein, 9 aa, Dengue virus
NMMGKREKK

SEQ ID NO: 108767 - protein, 9 aa, Dengue virus
MMGKREKKL

SEQ ID NO: 108768 - protein, 9 aa, Dengue virus
MGKREKKLG

SEQ ID NO: 108769 - protein, 9 aa, Dengue virus
GKREKKLGE

SEQ ID NO: 108770 - protein, 9 aa, Dengue virus
KREKKLGEF

SEQ ID NO: 108771 - protein, 9 aa, Dengue virus
REKKLGEFG

SEQ ID NO: 108772 - protein, 9 aa, Dengue virus
EKKLGEFGK

SEQ ID NO: 108773 - protein, 9 aa, Dengue virus
KKLGEFGKA

SEQ ID NO: 108774 - protein, 9 aa, Dengue virus
KLGEFGKAK

SEQ ID NO: 108775 - protein, 9 aa, Dengue virus
LGEFGKAKG

SEQ ID NO: 108776 - protein, 9 aa, Dengue virus
GEFGKAKGS

SEQ ID NO: 108777 - protein, 9 aa, Dengue virus
EFGKAKGSR

SEQ ID NO: 108778 - protein, 9 aa, Dengue virus
FGKAKGSRA

SEQ ID NO: 108779 - protein, 9 aa, Dengue virus
GKAKGSRAI

SEQ ID NO: 108780 - protein, 9 aa, Dengue virus
KAKGSRAIW

SEQ ID NO: 108781 - protein, 9 aa, Dengue virus
AKGSRAIWY

SEQ ID NO: 108782 - protein, 9 aa, Dengue virus
KGSRAIWYM

SEQ ID NO: 108783 - protein, 9 aa, Dengue virus
GSRAIWYMW

SEQ ID NO: 108784 - protein, 9 aa, Dengue virus
SRAIWYMWL

SEQ ID NO: 108785 - protein, 9 aa, Dengue virus
RAIWYMWLG

SEQ ID NO: 108786 - protein, 9 aa, Dengue virus
AIWYMWLGA

SEQ ID NO: 108787 - protein, 9 aa, Dengue virus
IWYMWLGAR

SEQ ID NO: 108788 - protein, 9 aa, Dengue virus
WYMWLGARF

SEQ ID NO: 108789 - protein, 9 aa, Dengue virus
YMWLGARFL

SEQ ID NO: 108790 - protein, 9 aa, Dengue virus
MWLGARFLE

SEQ ID NO: 108791 - protein, 9 aa, Dengue virus
WLGARFLEF

SEQ ID NO: 108792 - protein, 9 aa, Dengue virus
LGARFLEFE

SEQ ID NO: 108793 - protein, 9 aa, Dengue virus
GARFLEFEA

SEQ ID NO: 108794 - protein, 9 aa, Dengue virus
ARFLEFEAL

SEQ ID NO: 108795 - protein, 9 aa, Dengue virus
RFLEFEALG

SEQ ID NO: 108796 - protein, 9 aa, Dengue virus
FLEFEALGF

SEQ ID NO: 108797 - protein, 9 aa, Dengue virus
LEFEALGFL

SEQ ID NO: 108798 - protein, 9 aa, Dengue virus
EFEALGFLN

SEQ ID NO: 108799 - protein, 9 aa, Dengue virus
FEALGFLNE

SEQ ID NO: 108800 - protein, 9 aa, Dengue virus
EALGFLNED

SEQ ID NO: 108801 - protein, 9 aa, Dengue virus
ALGFLNEDH

SEQ ID NO: 108802 - protein, 9 aa, Dengue virus
LGFLNEDHW

SEQ ID NO: 108803 - protein, 9 aa, Dengue virus
GFLNEDHWF

SEQ ID NO: 108804 - protein, 9 aa, Dengue virus
FLNEDHWFS

SEQ ID NO: 108805 - protein, 9 aa, Dengue virus
LNEDHWFSR

SEQ ID NO: 108806 - protein, 9 aa, Dengue virus
NEDHWFSRE

SEQ ID NO: 108807 - protein, 9 aa, Dengue virus
EDHWFSREN

SEQ ID NO: 108808 - protein, 9 aa, Dengue virus
DHWFSRENS

SEQ ID NO: 108809 - protein, 9 aa, Dengue virus
HWFSRENSL

SEQ ID NO: 108810 - protein, 9 aa, Dengue virus
WFSRENSLS

SEQ ID NO: 108811 - protein, 9 aa, Dengue virus
FSRENSLSG

SEQ ID NO: 108812 - protein, 9 aa, Dengue virus
SRENSLSGV

SEQ ID NO: 108813 - protein, 9 aa, Dengue virus
RENSLSGVE

SEQ ID NO: 108814 - protein, 9 aa, Dengue virus
ENSLSGVEG

SEQ ID NO: 108815 - protein, 9 aa, Dengue virus
NSLSGVEGE

SEQ ID NO: 108816 - protein, 9 aa, Dengue virus
SLSGVEGEG

SEQ ID NO: 108817 - protein, 9 aa, Dengue virus
LSGVEGEGL

SEQ ID NO: 108818 - protein, 9 aa, Dengue virus
SGVEGEGLH

SEQ ID NO: 108819 - protein, 9 aa, Dengue virus
GVEGEGLHK

SEQ ID NO: 108820 - protein, 9 aa, Dengue virus
VEGEGLHKL

SEQ ID NO: 108821 - protein, 9 aa, Dengue virus
EGEGLHKLG

SEQ ID NO: 108822 - protein, 9 aa, Dengue virus
GEGLHKLGY

SEQ ID NO: 108823 - protein, 9 aa, Dengue virus
EGLHKLGYI

SEQ ID NO: 108824 - protein, 9 aa, Dengue virus
GLHKLGYIL

SEQ ID NO: 108825 - protein, 9 aa, Dengue virus
LHKLGYILR

SEQ ID NO: 108826 - protein, 9 aa, Dengue virus
GGAMYADDT

SEQ ID NO: 108827 - protein, 9 aa, Dengue virus
GAMYADDTA

SEQ ID NO: 108828 - protein, 9 aa, Dengue virus
AMYADDTAG

SEQ ID NO: 108829 - protein, 9 aa, Dengue virus
MYADDTAGW

SEQ ID NO: 108830 - protein, 9 aa, Dengue virus
YADDTAGWD

SEQ ID NO: 108831 - protein, 9 aa, Dengue virus
ADDTAGWDT

SEQ ID NO: 108832 - protein, 9 aa, Dengue virus
DDTAGWDTR

SEQ ID NO: 108833 - protein, 9 aa, Dengue virus
DTAGWDTRI

SEQ ID NO: 108834 - protein, 9 aa, Dengue virus
TAGWDTRIT

SEQ ID NO: 108835 - protein, 9 aa, Dengue virus
AGWDTRITE

SEQ ID NO: 108836 - protein, 9 aa, Dengue virus
GWDTRITED

SEQ ID NO: 108837 - protein, 9 aa, Dengue virus
WDTRITEDD

SEQ ID NO: 108838 - protein, 9 aa, Dengue virus
DTRITEDDL

SEQ ID NO: 108839 - protein, 9 aa, Dengue virus
AIFKLTYQN

SEQ ID NO: 108840 - protein, 9 aa, Dengue virus
IFKLTYQNK

SEQ ID NO: 108841 - protein, 9 aa, Dengue virus
FKLTYQNKV

SEQ ID NO: 108842 - protein, 9 aa, Dengue virus
KLTYQNKVV

SEQ ID NO: 108843 - protein, 9 aa, Dengue virus
LTYQNKVVR

SEQ ID NO: 108844 - protein, 9 aa, Dengue virus
TYQNKVVRV

SEQ ID NO: 108845 - protein, 9 aa, Dengue virus
YQNKVVRVQ

SEQ ID NO: 108846 - protein, 9 aa, Dengue virus
QNKVVRVQR

SEQ ID NO: 108847 - protein, 9 aa, Dengue virus
NKVVRVQRP

SEQ ID NO: 108848 - protein, 9 aa, Dengue virus
KVVRVQRPA

SEQ ID NO: 108849 - protein, 9 aa, Dengue virus
VVRVQRPAK

SEQ ID NO: 108850 - protein, 9 aa, Dengue virus
GTVMDIISR

SEQ ID NO: 108851 - protein, 9 aa, Dengue virus
TVMDVISRR

SEQ ID NO: 108852 - protein, 9 aa, Dengue virus
VMDVISRRD

SEQ ID NO: 108853 - protein, 9 aa, Dengue virus
MDVISRRDQ

SEQ ID NO: 108854 - protein, 9 aa, Dengue virus
DVISRRDQR

SEQ ID NO: 108855 - protein, 9 aa, Dengue virus
VISRRDQRG

SEQ ID NO: 108856 - protein, 9 aa, Dengue virus
ISRRDQRGS

SEQ ID NO: 108857 - protein, 9 aa, Dengue virus
SRRDQRGSG

SEQ ID NO: 108858 - protein, 9 aa, Dengue virus
RRDQRGSGQ

SEQ ID NO: 108859 - protein, 9 aa, Dengue virus
RDQRGSGQV

SEQ ID NO: 108860 - protein, 9 aa, Dengue virus
DQRGSGQVG

SEQ ID NO: 108861 - protein, 9 aa, Dengue virus
QRGSGQVGT

SEQ ID NO: 108862 - protein, 9 aa, Dengue virus
RGSGQVGTY

SEQ ID NO: 108863 - protein, 9 aa, Dengue virus
GSGQVGTYG

SEQ ID NO: 108864 - protein, 9 aa, Dengue virus
SGQVGTYGL

SEQ ID NO: 108865 - protein, 9 aa, Dengue virus
GQVGTYGLN

SEQ ID NO: 108866 - protein, 9 aa, Dengue virus
QVGTYGLNT

SEQ ID NO: 108867 - protein, 9 aa, Dengue virus
FTNMEAQLI

SEQ ID NO: 108868 - protein, 9 aa, Dengue virus
TNMEAQLIR

SEQ ID NO: 108869 - protein, 9 aa, Dengue virus
NMEAQLIRQ

SEQ ID NO: 108870 - protein, 9 aa, Dengue virus
MEAQLIRQM

SEQ ID NO: 108871 - protein, 9 aa, Dengue virus
EAQLIRQME

SEQ ID NO: 108872 - protein, 9 aa, Dengue virus
AQLIRQMEG

SEQ ID NO: 108873 - protein, 9 aa, Dengue virus
QLIRQMESE

SEQ ID NO: 108874 - protein, 9 aa, Dengue virus
LIRQMESEG

SEQ ID NO: 108875 - protein, 9 aa, Dengue virus
ERLKRMAIS

SEQ ID NO: 108876 - protein, 9 aa, Dengue virus
RLKRMAISG

SEQ ID NO: 108877 - protein, 9 aa, Dengue virus
LKRMAISGD

SEQ ID NO: 108878 - protein, 9 aa, Dengue virus
KRMAISGDD

SEQ ID NO: 108879 - protein, 9 aa, Dengue virus
RMAISGDDC

SEQ ID NO: 108880 - protein, 9 aa, Dengue virus
MAISGDDCV

SEQ ID NO: 108881 - protein, 9 aa, Dengue virus
AISGDDCVV

SEQ ID NO: 108882 - protein, 9 aa, Dengue virus
ISGDDCVVK

SEQ ID NO: 108883 - protein, 9 aa, Dengue virus
SGDDCVVKP

SEQ ID NO: 108884 - protein, 9 aa, Dengue virus
GDDCVVKPI

SEQ ID NO: 108885 - protein, 9 aa, Dengue virus
DDCVVKPID

SEQ ID NO: 108886 - protein, 9 aa, Dengue virus
DCVVKPIDD

SEQ ID NO: 108887 - protein, 9 aa, Dengue virus
CVVKPIDDR

SEQ ID NO: 108888 - protein, 9 aa, Dengue virus
VVKPIDDRF

SEQ ID NO: 108889 - protein, 9 aa, Dengue virus
ALTALNDMG

SEQ ID NO: 108890 - protein, 9 aa, Dengue virus
LTALNDMGK

SEQ ID NO: 108891 - protein, 9 aa, Dengue virus
ALNDMGKVR

SEQ ID NO: 108892 - protein, 9 aa, Dengue virus
LNDMGKVRK

SEQ ID NO: 108893 - protein, 9 aa, Dengue virus
NDMGKVRKD

SEQ ID NO: 108894 - protein, 9 aa, Dengue virus
DMGKVRKDI

SEQ ID NO: 108895 - protein, 9 aa, Dengue virus
MGKVRKDIP

SEQ ID NO: 108896 - protein, 9 aa, Dengue virus
GKVRKDIPQ

SEQ ID NO: 108897 - protein, 9 aa, Dengue virus
KVRKDIPQW

SEQ ID NO: 108898 - protein, 9 aa, Dengue virus
VRKDIPQWE

SEQ ID NO: 108899 - protein, 9 aa, Dengue virus
RKDIPQWEP

SEQ ID NO: 108900 - protein, 9 aa, Dengue virus
KDIPQWEPS

SEQ ID NO: 108901 - protein, 9 aa, Dengue virus
DIPQWEPSK

SEQ ID NO: 108902 - protein, 9 aa, Dengue virus
IPQWEPSKG

SEQ ID NO: 108903 - protein, 9 aa, Dengue virus
PQWEPSKGW

SEQ ID NO: 108904 - protein, 9 aa, Dengue virus
QWEPSKGWN

SEQ ID NO: 108905 - protein, 9 aa, Dengue virus
WEPSKGWND

SEQ ID NO: 108906 - protein, 9 aa, Dengue virus
EPSKGWNDW

SEQ ID NO: 108907 - protein, 9 aa, Dengue virus
GWNDWQQVP

SEQ ID NO: 108908 - protein, 9 aa, Dengue virus
WNDWQQVPF

SEQ ID NO: 108909 - protein, 9 aa, Dengue virus
NDWQQVPFC

SEQ ID NO: 108910 - protein, 9 aa, Dengue virus
DWQQVPFCS

SEQ ID NO: 108911 - protein, 9 aa, Dengue virus
WQQVPFCSH

SEQ ID NO: 108912 - protein, 9 aa, Dengue virus
QQVPFCSHH

SEQ ID NO: 108913 - protein, 9 aa, Dengue virus
QVPFCSHHF

SEQ ID NO: 108914 - protein, 9 aa, Dengue virus
VPFCSHHFH

SEQ ID NO: 108915 - protein, 9 aa, Dengue virus
PFCSHHFHE

SEQ ID NO: 108916 - protein, 9 aa, Dengue virus
FCSHHFHEL

SEQ ID NO: 108917 - protein, 9 aa, Dengue virus
CSHHFHQLI

SEQ ID NO: 108918 - protein, 9 aa, Dengue virus
SHHFHQLIM

SEQ ID NO: 108919 - protein, 9 aa, Dengue virus
HHFHQLIMK

SEQ ID NO: 108920 - protein, 9 aa, Dengue virus
HFHQLIMKD

SEQ ID NO: 108921 - protein, 9 aa, Dengue virus
FHQLIMKDG

SEQ ID NO: 108922 - protein, 9 aa, Dengue virus
HQLIMKDGR

SEQ ID NO: 108923 - protein, 9 aa, Dengue virus
IVVPCRNQD

SEQ ID NO: 108924 - protein, 9 aa, Dengue virus
VVPCRNQDE

SEQ ID NO: 108925 - protein, 9 aa, Dengue virus
VPCRNQDEL

SEQ ID NO: 108926 - protein, 9 aa, Dengue virus
PCRNQDELV

SEQ ID NO: 108927 - protein, 9 aa, Dengue virus
CRNQDELVG

SEQ ID NO: 108928 - protein, 9 aa, Dengue virus
RNQDELVGR

SEQ ID NO: 108929 - protein, 9 aa, Dengue virus
NQDELVGRA

SEQ ID NO: 108930 - protein, 9 aa, Dengue virus
QDELIGRAR

SEQ ID NO: 108931 - protein, 9 aa, Dengue virus
DELIGRARI

SEQ ID NO: 108932 - protein, 9 aa, Dengue virus
ELIGRARIS

SEQ ID NO: 108933 - protein, 9 aa, Dengue virus
LIGRARISQ

SEQ ID NO: 108934 - protein, 9 aa, Dengue virus
IGRARISQG

SEQ ID NO: 108935 - protein, 9 aa, Dengue virus
GRARISQGA

SEQ ID NO: 108936 - protein, 9 aa, Dengue virus
RARISQGAG

SEQ ID NO: 108937 - protein, 9 aa, Dengue virus
ARISQGAGW

SEQ ID NO: 108938 - protein, 9 aa, Dengue virus
RISQGAGWS

SEQ ID NO: 108939 - protein, 9 aa, Dengue virus
ISQGAGWSL

SEQ ID NO: 108940 - protein, 9 aa, Dengue virus
SQGAGWSLR

SEQ ID NO: 108941 - protein, 9 aa, Dengue virus
QGAGWSLRE

SEQ ID NO: 108942 - protein, 9 aa, Dengue virus
GAGWSLRET

SEQ ID NO: 108943 - protein, 9 aa, Dengue virus
AGWSLRETA

SEQ ID NO: 108944 - protein, 9 aa, Dengue virus
GWSLRETAC

SEQ ID NO: 108945 - protein, 9 aa, Dengue virus
WSLRETACL

SEQ ID NO: 108946 - protein, 9 aa, Dengue virus
SLRETACLG

SEQ ID NO: 108947 - protein, 9 aa, Dengue virus
LRETACLGK

SEQ ID NO: 108948 - protein, 9 aa, Dengue virus
RETACLGKS

SEQ ID NO: 108949 - protein, 9 aa, Dengue virus
ETACLGKSY

SEQ ID NO: 108950 - protein, 9 aa, Dengue virus
TACLGKSYA

SEQ ID NO: 108951 - protein, 9 aa, Dengue virus
ACLGKSYAQ

SEQ ID NO: 108952 - protein, 9 aa, Dengue virus
CLGKSYAQM

SEQ ID NO: 108953 - protein, 9 aa, Dengue virus
LGKSYAQMW

SEQ ID NO: 108954 - protein, 9 aa, Dengue virus
GKSYAQMWQ

SEQ ID NO: 108955 - protein, 9 aa, Dengue virus
KSYAQMWQL

SEQ ID NO: 108956 - protein, 9 aa, Dengue virus
SYAQMWQLM

SEQ ID NO: 108957 - protein, 9 aa, Dengue virus
YAQMWQLMY

SEQ ID NO: 108958 - protein, 9 aa, Dengue virus
AQMWQLMYF

SEQ ID NO: 108959 - protein, 9 aa, Dengue virus
QMWQLMYFH

SEQ ID NO: 108960 - protein, 9 aa, Dengue virus
MWQLMYFHR

SEQ ID NO: 108961 - protein, 9 aa, Dengue virus
WQLMYFHRR

SEQ ID NO: 108962 - protein, 9 aa, Dengue virus
QLMYFHRRD

SEQ ID NO: 108963 - protein, 9 aa, Dengue virus
LMYFHRRDL

SEQ ID NO: 108964 - protein, 9 aa, Dengue virus
MYFHRRDLR

SEQ ID NO: 108965 - protein, 9 aa, Dengue virus
YFHRRDLRL

SEQ ID NO: 108966 - protein, 9 aa, Dengue virus
FHRRDLRLA

SEQ ID NO: 108967 - protein, 9 aa, Dengue virus
HRRDLRLAA

SEQ ID NO: 108968 - protein, 9 aa, Dengue virus
RRDLRLAAN

SEQ ID NO: 108969 - protein, 9 aa, Dengue virus
RDLRLAANA

SEQ ID NO: 108970 - protein, 9 aa, Dengue virus
DLRLAANAI

SEQ ID NO: 108971 - protein, 9 aa, Dengue virus
LRLAANAIC

SEQ ID NO: 108972 - protein, 9 aa, Dengue virus
RLAANAICS

SEQ ID NO: 108973 - protein, 9 aa, Dengue virus
LAANAICSA

SEQ ID NO: 108974 - protein, 9 aa, Dengue virus
AANAICSAV

SEQ ID NO: 108975 - protein, 9 aa, Dengue virus
ANAICSAVP

SEQ ID NO: 108976 - protein, 9 aa, Dengue virus
NAICSAVPV

SEQ ID NO: 108977 - protein, 9 aa, Dengue virus
HWVPTSRTT

SEQ ID NO: 108978 - protein, 9 aa, Dengue virus
WVPTSRTTW

SEQ ID NO: 108979 - protein, 9 aa, Dengue virus
VPTSRTTWS

SEQ ID NO: 108980 - protein, 9 aa, Dengue virus
PTSRTTWSI

SEQ ID NO: 108981 - protein, 9 aa, Dengue virus
TSRTTWSIH

SEQ ID NO: 108982 - protein, 9 aa, Dengue virus
SRTTWSIHA

SEQ ID NO: 108983 - protein, 9 aa, Dengue virus
RTTWSIHAH

SEQ ID NO: 108984 - protein, 9 aa, Dengue virus
TTWSIHAHH

SEQ ID NO: 108985 - protein, 9 aa, Dengue virus
TWSIHAHHQ

SEQ ID NO: 108986 - protein, 9 aa, Dengue virus
WSIHAHHQW

SEQ ID NO: 108987 - protein, 9 aa, Dengue virus
SIHAHHQWM

SEQ ID NO: 108988 - protein, 9 aa, Dengue virus
IHAHHQWMT

SEQ ID NO: 108989 - protein, 9 aa, Dengue virus
HAHHQWMTT

SEQ ID NO: 108990 - protein, 9 aa, Dengue virus
AHHQWMTTE

SEQ ID NO: 108991 - protein, 9 aa, Dengue virus
HHQWMTTED

SEQ ID NO: 108992 - protein, 9 aa, Dengue virus
HQWMTTEDM

SEQ ID NO: 108993 - protein, 9 aa, Dengue virus
QWMTTEDML

SEQ ID NO: 108994 - protein, 9 aa, Dengue virus
WMTTEDMLS

SEQ ID NO: 108995 - protein, 9 aa, Dengue virus
MTTEDMLSV

SEQ ID NO: 108996 - protein, 9 aa, Dengue virus
TTEDMLSVW

SEQ ID NO: 108997 - protein, 9 aa, Dengue virus
TEDMLSVWN

SEQ ID NO: 108998 - protein, 9 aa, Dengue virus
EDMLSVWNR

SEQ ID NO: 108999 - protein, 9 aa, Dengue virus
DMLSVWNRV

SEQ ID NO: 109000 - protein, 9 aa, Dengue virus
MLSVWNRVW

SEQ ID NO: 109001 - protein, 9 aa, Dengue virus
LSVWNRVWI

SEQ ID NO: 109002 - protein, 9 aa, Dengue virus
ENPWMEDKT

SEQ ID NO: 109003 - protein, 9 aa, Dengue virus
DVPYLGKRE

SEQ ID NO: 109004 - protein, 9 aa, Dengue virus
VPYLGKRED

SEQ ID NO: 109005 - protein, 9 aa, Dengue virus
PYLGKREDQ

SEQ ID NO: 109006 - protein, 9 aa, Dengue virus
YLGKREDQW

SEQ ID NO: 109007 - protein, 9 aa, Dengue virus
LGKREDQWC

SEQ ID NO: 109008 - protein, 9 aa, Dengue virus
GKREDQWCG

SEQ ID NO: 109009 - protein, 9 aa, Dengue virus
KREDQWCGS

SEQ ID NO: 109010 - protein, 9 aa, Dengue virus
REDQWCGSL

SEQ ID NO: 109011 - protein, 9 aa, Dengue virus
EDQWCGSLI

SEQ ID NO: 109012 - protein, 9 aa, Dengue virus
DQWCGSLIG

SEQ ID NO: 109013 - protein, 9 aa, Dengue virus
QWCGSLIGL

SEQ ID NO: 109014 - protein, 9 aa, Dengue virus
WCGSLIGLT

SEQ ID NO: 109015 - protein, 9 aa, Dengue virus
CGSLIGLTS

SEQ ID NO: 109016 - protein, 9 aa, Dengue virus
GSLIGLTSR

SEQ ID NO: 109017 - protein, 9 aa, Dengue virus
SLIGLTSRA

SEQ ID NO: 109018 - protein, 9 aa, Dengue virus
LIGLTSRAT

SEQ ID NO: 109019 - protein, 9 aa, Dengue virus
IGLTSRATW

SEQ ID NO: 109020 - protein, 9 aa, Dengue virus
GLTSRATWA

SEQ ID NO: 109021 - protein, 9 aa, Dengue virus
LTARATWAT

SEQ ID NO: 109022 - protein, 9 aa, Dengue virus
TARATWATN

SEQ ID NO: 109023 - protein, 9 aa, Dengue virus
ARATWATNI

SEQ ID NO: 109024 - protein, 9 aa, Dengue virus
DYMPSMKRF

SEQ ID NO: 109025 - protein, 9 aa, Dengue virus
YMPSMKRFR

SEQ ID NO: 109026 - protein, 9 aa, Dengue virus
TPFNMLKRE

SEQ ID NO: 109027 - protein, 9 aa, Dengue virus
PFNMLKRER

SEQ ID NO: 109028 - protein, 9 aa, Dengue virus
FNMLKRERN

SEQ ID NO: 109029 - protein, 9 aa, Dengue virus
NMLKRERNR

SEQ ID NO: 109030 - protein, 9 aa, Dengue virus
MLKRERNRV

SEQ ID NO: 109031 - protein, 9 aa, Dengue virus
LKRERNRVS

SEQ ID NO: 109032 - protein, 9 aa, Dengue virus
KRERNRVST

SEQ ID NO: 109033 - protein, 9 aa, Dengue virus
RNRVSTVQQ

SEQ ID NO: 109034 - protein, 9 aa, Dengue virus
NRVSTVQQL

SEQ ID NO: 109035 - protein, 9 aa, Dengue virus
RVSTVQQLT

SEQ ID NO: 109036 - protein, 9 aa, Dengue virus
VSTVQQLTK

SEQ ID NO: 109037 - protein, 9 aa, Dengue virus
STVQQLTKR

SEQ ID NO: 109038 - protein, 9 aa, Dengue virus
TVQQLTKRF

SEQ ID NO: 109039 - protein, 9 aa, Dengue virus
VQQLTKRFS

SEQ ID NO: 109040 - protein, 9 aa, Dengue virus
QQLTKRFSL

SEQ ID NO: 109041 - protein, 9 aa, Dengue virus
QLTKRFSLG

SEQ ID NO: 109042 - protein, 9 aa, Dengue virus
LTKRFSLGM

SEQ ID NO: 109043 - protein, 9 aa, Dengue virus
TKRFSLGML

SEQ ID NO: 109044 - protein, 9 aa, Dengue virus
KRFSLGMLQ

SEQ ID NO: 109045 - protein, 9 aa, Dengue virus
RFSLGMLQG

SEQ ID NO: 109046 - protein, 9 aa, Dengue virus
FSLGMLQGR

SEQ ID NO: 109047 - protein, 9 aa, Dengue virus
SLGMLQGRG

SEQ ID NO: 109048 - protein, 9 aa, Dengue virus
LGMLQGRGP

SEQ ID NO: 109049 - protein, 9 aa, Dengue virus
GMLQGRGPL

SEQ ID NO: 109050 - protein, 9 aa, Dengue virus
MLQGRGPLK

SEQ ID NO: 109051 - protein, 9 aa, Dengue virus
GRGPLKLFM

SEQ ID NO: 109052 - protein, 9 aa, Dengue virus
RGPLKLFMA

SEQ ID NO: 109053 - protein, 9 aa, Dengue virus
GPLKLFMAL

SEQ ID NO: 109054 - protein, 9 aa, Dengue virus
LFMALVAFL

SEQ ID NO: 109055 - protein, 9 aa, Dengue virus
FMALVAFLR

SEQ ID NO: 109056 - protein, 9 aa, Dengue virus
MALVAFLRF

SEQ ID NO: 109057 - protein, 9 aa, Dengue virus
ALVAFLRFL

SEQ ID NO: 109058 - protein, 9 aa, Dengue virus
LVAFLRFLT

SEQ ID NO: 109059 - protein, 9 aa, Dengue virus
VAFLRFLTI

SEQ ID NO: 109060 - protein, 9 aa, Dengue virus
AFLRFLTIP

SEQ ID NO: 109061 - protein, 9 aa, Dengue virus
FLRFLTIPP

SEQ ID NO: 109062 - protein, 9 aa, Dengue virus
LRFLTIPPT

SEQ ID NO: 109063 - protein, 9 aa, Dengue virus
RFLTIPPTA

SEQ ID NO: 109064 - protein, 9 aa, Dengue virus
FLTIPPTAG

SEQ ID NO: 109065 - protein, 9 aa, Dengue virus
LTIPPTAGI

SEQ ID NO: 109066 - protein, 9 aa, Dengue virus
TIPPTAGIL

SEQ ID NO: 109067 - protein, 9 aa, Dengue virus
IPPTAGILK

SEQ ID NO: 109068 - protein, 9 aa, Dengue virus
PPTAGILKR

SEQ ID NO: 109069 - protein, 9 aa, Dengue virus
PTAGILKRW

SEQ ID NO: 109070 - protein, 9 aa, Dengue virus
TAGILKRWG

SEQ ID NO: 109071 - protein, 9 aa, Dengue virus
GFRKEIGRM

SEQ ID NO: 109072 - protein, 9 aa, Dengue virus
FRKEIGRML

SEQ ID NO: 109073 - protein, 9 aa, Dengue virus
AFHLTTRNG

SEQ ID NO: 109074 - protein, 9 aa, Dengue virus
FHLTTRNGE

SEQ ID NO: 109075 - protein, 9 aa, Dengue virus
HLTTRNGEP

SEQ ID NO: 109076 - protein, 9 aa, Dengue virus
LTTRNGEPH

SEQ ID NO: 109077 - protein, 9 aa, Dengue virus
TTRNGEPHM

SEQ ID NO: 109078 - protein, 9 aa, Dengue virus
TRNGEPHMI

SEQ ID NO: 109079 - protein, 9 aa, Dengue virus
RNGEPHMIV

SEQ ID NO: 109080 - protein, 9 aa, Dengue virus
QEKGKSLLF

SEQ ID NO: 109081 - protein, 9 aa, Dengue virus
EKGKSLLFK

SEQ ID NO: 109082 - protein, 9 aa, Dengue virus
KGKSLLFKT

SEQ ID NO: 109083 - protein, 9 aa, Dengue virus
GKSLLFKTE

SEQ ID NO: 109084 - protein, 9 aa, Dengue virus
NMCTLMAID

SEQ ID NO: 109085 - protein, 9 aa, Dengue virus
MCTLMAIDL

SEQ ID NO: 109086 - protein, 9 aa, Dengue virus
CTLMAIDLG

SEQ ID NO: 109087 - protein, 9 aa, Dengue virus
TLMAIDLGE

SEQ ID NO: 109088 - protein, 9 aa, Dengue virus
LIAMDLGEM

SEQ ID NO: 109089 - protein, 9 aa, Dengue virus
IAMDLGEMC

SEQ ID NO: 109090 - protein, 9 aa, Dengue virus
AMDLGEMCD

SEQ ID NO: 109091 - protein, 9 aa, Dengue virus
MDLGEMCDD

SEQ ID NO: 109092 - protein, 9 aa, Dengue virus
DLGEMCDDT

SEQ ID NO: 109093 - protein, 9 aa, Dengue virus
EPDDVDCWC

SEQ ID NO: 109094 - protein, 9 aa, Dengue virus
PDDVDCWCN

SEQ ID NO: 109095 - protein, 9 aa, Dengue virus
EDIDCWCNS

SEQ ID NO: 109096 - protein, 9 aa, Dengue virus
DIDCWCNST

SEQ ID NO: 109097 - protein, 9 aa, Dengue virus
IDCWCNSTS

SEQ ID NO: 109098 - protein, 9 aa, Dengue virus
DCWCNSTST

SEQ ID NO: 109099 - protein, 9 aa, Dengue virus
CWCNSTSTW

SEQ ID NO: 109100 - protein, 9 aa, Dengue virus
TDTWVTYGT

SEQ ID NO: 109101 - protein, 9 aa, Dengue virus
DTWVTYGTC

SEQ ID NO: 109102 - protein, 9 aa, Dengue virus
TWVTYGTCT

SEQ ID NO: 109103 - protein, 9 aa, Dengue virus
GEHRREKRS

SEQ ID NO: 109104 - protein, 9 aa, Dengue virus
EHRREKRSV

SEQ ID NO: 109105 - protein, 9 aa, Dengue virus
HRREKRSVA

SEQ ID NO: 109106 - protein, 9 aa, Dengue virus
RREKRSVAL

SEQ ID NO: 109107 - protein, 9 aa, Dengue virus
REKRSVALV

SEQ ID NO: 109108 - protein, 9 aa, Dengue virus
EKRSVALVP

SEQ ID NO: 109109 - protein, 9 aa, Dengue virus
KRSVALVPH

SEQ ID NO: 109110 - protein, 9 aa, Dengue virus
RSVALVPHV

SEQ ID NO: 109111 - protein, 9 aa, Dengue virus
SVALVPHVG

SEQ ID NO: 109112 - protein, 9 aa, Dengue virus
VALVPHVGM

SEQ ID NO: 109113 - protein, 9 aa, Dengue virus
ALVPHVGMG

SEQ ID NO: 109114 - protein, 9 aa, Dengue virus
LVPHVGMGL

SEQ ID NO: 109115 - protein, 9 aa, Dengue virus
VPHVGMGLE

SEQ ID NO: 109116 - protein, 9 aa, Dengue virus
PHVGMGLET

SEQ ID NO: 109117 - protein, 9 aa, Dengue virus
HVGMGLETR

SEQ ID NO: 109118 - protein, 9 aa, Dengue virus
GLDTRTQTW

SEQ ID NO: 109119 - protein, 9 aa, Dengue virus
LDTRTQTWM

SEQ ID NO: 109120 - protein, 9 aa, Dengue virus
DTRTQTWMS

SEQ ID NO: 109121 - protein, 9 aa, Dengue virus
TRTQTWMSA

SEQ ID NO: 109122 - protein, 9 aa, Dengue virus
RTQTWMSAE

SEQ ID NO: 109123 - protein, 9 aa, Dengue virus
TQTWMSAEG

SEQ ID NO: 109124 - protein, 9 aa, Dengue virus
QTWMSAEGA

SEQ ID NO: 109125 - protein, 9 aa, Dengue virus
TWMSAEGAW

SEQ ID NO: 109126 - protein, 9 aa, Dengue virus
WMSAEGAWR

SEQ ID NO: 109127 - protein, 9 aa, Dengue virus
MSSEGAWKH

SEQ ID NO: 109128 - protein, 9 aa, Dengue virus
SAEGAWRQV

SEQ ID NO: 109129 - protein, 9 aa, Dengue virus
AEGAWRQVE

SEQ ID NO: 109130 - protein, 9 aa, Dengue virus
IETWILRHP

SEQ ID NO: 109131 - protein, 9 aa, Dengue virus
ETWILRHPG

SEQ ID NO: 109132 - protein, 9 aa, Dengue virus
TWILRHPGF

SEQ ID NO: 109133 - protein, 9 aa, Dengue virus
WILRHPGFT

SEQ ID NO: 109134 - protein, 9 aa, Dengue virus
VAPSMTMRC

SEQ ID NO: 109135 - protein, 9 aa, Dengue virus
APSMTMRCI

SEQ ID NO: 109136 - protein, 9 aa, Dengue virus
PSMTMRCIG

SEQ ID NO: 109137 - protein, 9 aa, Dengue virus
MRCIGISNR

SEQ ID NO: 109138 - protein, 9 aa, Dengue virus
RCIGISNRD

SEQ ID NO: 109139 - protein, 9 aa, Dengue virus
CIGISNRDF

SEQ ID NO: 109140 - protein, 9 aa, Dengue virus
IGISNRDFV

SEQ ID NO: 109141 - protein, 9 aa, Dengue virus
GISNRDFVE

SEQ ID NO: 109142 - protein, 9 aa, Dengue virus
ISNRDFVEG

SEQ ID NO: 109143 - protein, 9 aa, Dengue virus
GNRDFVEGL

SEQ ID NO: 109144 - protein, 9 aa, Dengue virus
SRDFVEGLS

SEQ ID NO: 109145 - protein, 9 aa, Dengue virus
RDFVEGVSG

SEQ ID NO: 109146 - protein, 9 aa, Dengue virus
DFVEGVSGG

SEQ ID NO: 109147 - protein, 9 aa, Dengue virus
FVEGVSGGS

SEQ ID NO: 109148 - protein, 9 aa, Dengue virus
VEGVSGGSW

SEQ ID NO: 109149 - protein, 9 aa, Dengue virus
EGVSGGSWV

SEQ ID NO: 109150 - protein, 9 aa, Dengue virus
GVSGGSWVD

SEQ ID NO: 109151 - protein, 9 aa, Dengue virus
VSGGSWVDI

SEQ ID NO: 109152 - protein, 9 aa, Dengue virus
SGGSWVDIV

SEQ ID NO: 109153 - protein, 9 aa, Dengue virus
GGSWVDIVL

SEQ ID NO: 109154 - protein, 9 aa, Dengue virus
GSWVDIVLE

SEQ ID NO: 109155 - protein, 9 aa, Dengue virus
SWVDIVLEH

SEQ ID NO: 109156 - protein, 9 aa, Dengue virus
WVDIVLEHG

SEQ ID NO: 109157 - protein, 9 aa, Dengue virus
VDIVLEHGS

SEQ ID NO: 109158 - protein, 9 aa, Dengue virus
DIVLEHGSC

SEQ ID NO: 109159 - protein, 9 aa, Dengue virus
IVLEHGSCV

SEQ ID NO: 109160 - protein, 9 aa, Dengue virus
VLEHGGCVT

SEQ ID NO: 109161 - protein, 9 aa, Dengue virus
LEHGGCVTT

SEQ ID NO: 109162 - protein, 9 aa, Dengue virus
EHGGCVTTM

SEQ ID NO: 109163 - protein, 9 aa, Dengue virus
HGGCVTTMA

SEQ ID NO: 109164 - protein, 9 aa, Dengue virus
GGCVTTMAK

SEQ ID NO: 109165 - protein, 9 aa, Dengue virus
SCVTTMAKD

SEQ ID NO: 109166 - protein, 9 aa, Dengue virus
CVTTMAKDK

SEQ ID NO: 109167 - protein, 9 aa, Dengue virus
VTTMAKDKP

SEQ ID NO: 109168 - protein, 9 aa, Dengue virus
TTMAKDKPT

SEQ ID NO: 109169 - protein, 9 aa, Dengue virus
TMAKDKPTL

SEQ ID NO: 109170 - protein, 9 aa, Dengue virus
MAKDKPTLD

SEQ ID NO: 109171 - protein, 9 aa, Dengue virus
AKNKPTLDF

SEQ ID NO: 109172 - protein, 9 aa, Dengue virus
KNKPTLDFE

SEQ ID NO: 109173 - protein, 9 aa, Dengue virus
NKPTLDFEL

SEQ ID NO: 109174 - protein, 9 aa, Dengue virus
KPTLDFELI

SEQ ID NO: 109175 - protein, 9 aa, Dengue virus
PTLDFELIK

SEQ ID NO: 109176 - protein, 9 aa, Dengue virus
TLDFELIKT

SEQ ID NO: 109177 - protein, 9 aa, Dengue virus
LDFELIKTE

SEQ ID NO: 109178 - protein, 9 aa, Dengue virus
DFELIKTEA

SEQ ID NO: 109179 - protein, 9 aa, Dengue virus
FELIKTEAK

SEQ ID NO: 109180 - protein, 9 aa, Dengue virus
TTESRCPTQ

SEQ ID NO: 109181 - protein, 9 aa, Dengue virus
TESRCPTQG

SEQ ID NO: 109182 - protein, 9 aa, Dengue virus
ESRCPTQGE

SEQ ID NO: 109183 - protein, 9 aa, Dengue virus
SRCPTQGEP

SEQ ID NO: 109184 - protein, 9 aa, Dengue virus
CKHSMVDRG

SEQ ID NO: 109185 - protein, 9 aa, Dengue virus
KHSMVDRGW

SEQ ID NO: 109186 - protein, 9 aa, Dengue virus
HSMVDRGWG

SEQ ID NO: 109187 - protein, 9 aa, Dengue virus
SMVDRGWGN

SEQ ID NO: 109188 - protein, 9 aa, Dengue virus
MVDRGWGNG

SEQ ID NO: 109189 - protein, 9 aa, Dengue virus
GCGLFGKGG

SEQ ID NO: 109190 - protein, 9 aa, Dengue virus
CGLFGKGGI

SEQ ID NO: 109191 - protein, 9 aa, Dengue virus
GLFGKGGIV

SEQ ID NO: 109192 - protein, 9 aa, Dengue virus
LFGKGGIVT

SEQ ID NO: 109193 - protein, 9 aa, Dengue virus
FGKGGIVTC

SEQ ID NO: 109194 - protein, 9 aa, Dengue virus
GKGGIVTCA

SEQ ID NO: 109195 - protein, 9 aa, Dengue virus
KGGIVTCAM

SEQ ID NO: 109196 - protein, 9 aa, Dengue virus
GGIVTCAMF

SEQ ID NO: 109197 - protein, 9 aa, Dengue virus
VITPHSGEE

SEQ ID NO: 109198 - protein, 9 aa, Dengue virus
TPHSGEEHA

SEQ ID NO: 109199 - protein, 9 aa, Dengue virus
PHSGEEHAV

SEQ ID NO: 109200 - protein, 9 aa, Dengue virus
HSGEEHAVG

SEQ ID NO: 109201 - protein, 9 aa, Dengue virus
SGEEHAVGN

SEQ ID NO: 109202 - protein, 9 aa, Dengue virus
GEEHAVGND

SEQ ID NO: 109203 - protein, 9 aa, Dengue virus
VTMECSPRT

SEQ ID NO: 109204 - protein, 9 aa, Dengue virus
TMECSPRTG

SEQ ID NO: 109205 - protein, 9 aa, Dengue virus
MECSPRTGL

SEQ ID NO: 109206 - protein, 9 aa, Dengue virus
DCSPRTGLD

SEQ ID NO: 109207 - protein, 9 aa, Dengue virus
CEPRSGIDF

SEQ ID NO: 109208 - protein, 9 aa, Dengue virus
EPRSGIDFN

SEQ ID NO: 109209 - protein, 9 aa, Dengue virus
PRSGIDFNE

SEQ ID NO: 109210 - protein, 9 aa, Dengue virus
RSGIDFNEM

SEQ ID NO: 109211 - protein, 9 aa, Dengue virus
TGLDFNEMI

SEQ ID NO: 109212 - protein, 9 aa, Dengue virus
GLDFNEMIL

SEQ ID NO: 109213 - protein, 9 aa, Dengue virus
LDFNEMILL

SEQ ID NO: 109214 - protein, 9 aa, Dengue virus
DFNEMVLLQ

SEQ ID NO: 109215 - protein, 9 aa, Dengue virus
FNEMVLLQM

SEQ ID NO: 109216 - protein, 9 aa, Dengue virus
NEMVLLQME

SEQ ID NO: 109217 - protein, 9 aa, Dengue virus
KAWLVHRQW

SEQ ID NO: 109218 - protein, 9 aa, Dengue virus
AWLVHRQWF

SEQ ID NO: 109219 - protein, 9 aa, Dengue virus
WLVHRQWFL

SEQ ID NO: 109220 - protein, 9 aa, Dengue virus
LVHRQWFLD

SEQ ID NO: 109221 - protein, 9 aa, Dengue virus
VHRQWFLDL

SEQ ID NO: 109222 - protein, 9 aa, Dengue virus
HRQWFLDLP

SEQ ID NO: 109223 - protein, 9 aa, Dengue virus
RQWFLDLPL

SEQ ID NO: 109224 - protein, 9 aa, Dengue virus
QWFFDLPLP

SEQ ID NO: 109225 - protein, 9 aa, Dengue virus
WFFDLPLPW

SEQ ID NO: 109226 - protein, 9 aa, Dengue virus
FLDLPLPWL

SEQ ID NO: 109227 - protein, 9 aa, Dengue virus
DLPLPWLPG

SEQ ID NO: 109228 - protein, 9 aa, Dengue virus
LPLPWLPGA

SEQ ID NO: 109229 - protein, 9 aa, Dengue virus
KETLVTFKN

SEQ ID NO: 109230 - protein, 9 aa, Dengue virus
ETLVTFKNP

SEQ ID NO: 109231 - protein, 9 aa, Dengue virus
TLVTFKNPH

SEQ ID NO: 109232 - protein, 9 aa, Dengue virus
LVTFKNPHA

SEQ ID NO: 109233 - protein, 9 aa, Dengue virus
VTFKNPHAK

SEQ ID NO: 109234 - protein, 9 aa, Dengue virus
TFKNPHAKK

SEQ ID NO: 109235 - protein, 9 aa, Dengue virus
FKNPHAKKQ

SEQ ID NO: 109236 - protein, 9 aa, Dengue virus
KNPHAKKQD

SEQ ID NO: 109237 - protein, 9 aa, Dengue virus
NPHAKKQDV

SEQ ID NO: 109238 - protein, 9 aa, Dengue virus
PHAKKQDVV

SEQ ID NO: 109239 - protein, 9 aa, Dengue virus
HAKKQDVVV

SEQ ID NO: 109240 - protein, 9 aa, Dengue virus
AKKQDVVVL

SEQ ID NO: 109241 - protein, 9 aa, Dengue virus
KKQDVVVLG

SEQ ID NO: 109242 - protein, 9 aa, Dengue virus
KQDVVVLGS

SEQ ID NO: 109243 - protein, 9 aa, Dengue virus
QDVVVLGSQ

SEQ ID NO: 109244 - protein, 9 aa, Dengue virus
DVVVLGSQE

SEQ ID NO: 109245 - protein, 9 aa, Dengue virus
VTVLGSQEG

SEQ ID NO: 109246 - protein, 9 aa, Dengue virus
TVLGSQEGA

SEQ ID NO: 109247 - protein, 9 aa, Dengue virus
GSQEGAMHS

SEQ ID NO: 109248 - protein, 9 aa, Dengue virus
SQEGAMHSA

SEQ ID NO: 109249 - protein, 9 aa, Dengue virus
QEGAMHSAL

SEQ ID NO: 109250 - protein, 9 aa, Dengue virus
EGAMHSALA

SEQ ID NO: 109251 - protein, 9 aa, Dengue virus
GAMHSALAG

SEQ ID NO: 109252 - protein, 9 aa, Dengue virus
AMHSALAGA

SEQ ID NO: 109253 - protein, 9 aa, Dengue virus
MHSALAGAT

SEQ ID NO: 109254 - protein, 9 aa, Dengue virus
HSALAGATE

SEQ ID NO: 109255 - protein, 9 aa, Dengue virus
SALAGATEV

SEQ ID NO: 109256 - protein, 9 aa, Dengue virus
ALAGATEVD

SEQ ID NO: 109257 - protein, 9 aa, Dengue virus
LTGATEIQM

SEQ ID NO: 109258 - protein, 9 aa, Dengue virus
TGATEIQMS

SEQ ID NO: 109259 - protein, 9 aa, Dengue virus
GATEIQMSS

SEQ ID NO: 109260 - protein, 9 aa, Dengue virus
SGNLLFTGH

SEQ ID NO: 109261 - protein, 9 aa, Dengue virus
GNLLFTGHL

SEQ ID NO: 109262 - protein, 9 aa, Dengue virus
NLLFTGHLK

SEQ ID NO: 109263 - protein, 9 aa, Dengue virus
LLFTGHLKC

SEQ ID NO: 109264 - protein, 9 aa, Dengue virus
LFTGHLKCR

SEQ ID NO: 109265 - protein, 9 aa, Dengue virus
FTGHLKCRL

SEQ ID NO: 109266 - protein, 9 aa, Dengue virus
TGHLKCRLR

SEQ ID NO: 109267 - protein, 9 aa, Dengue virus
GHLKCRLRM

SEQ ID NO: 109268 - protein, 9 aa, Dengue virus
HLKCRLRMD

SEQ ID NO: 109269 - protein, 9 aa, Dengue virus
LKCRLRMDK

SEQ ID NO: 109270 - protein, 9 aa, Dengue virus
KCRLRMDKL

SEQ ID NO: 109271 - protein, 9 aa, Dengue virus
CRLRMDKLQ

SEQ ID NO: 109272 - protein, 9 aa, Dengue virus
RLRMDKLQL

SEQ ID NO: 109273 - protein, 9 aa, Dengue virus
LRMDKLQLK

SEQ ID NO: 109274 - protein, 9 aa, Dengue virus
RMDKLQLKG

SEQ ID NO: 109275 - protein, 9 aa, Dengue virus
VKEIAETQH

SEQ ID NO: 109276 - protein, 9 aa, Dengue virus
KEIAETQHG

SEQ ID NO: 109277 - protein, 9 aa, Dengue virus
EIAETQHGT

SEQ ID NO: 109278 - protein, 9 aa, Dengue virus
IAETQHGTI

SEQ ID NO: 109279 - protein, 9 aa, Dengue virus
AETQHGTIV

SEQ ID NO: 109280 - protein, 9 aa, Dengue virus
ETQHGTIVI

SEQ ID NO: 109281 - protein, 9 aa, Dengue virus
TQHGTIVIR

SEQ ID NO: 109282 - protein, 9 aa, Dengue virus
PVNIETEPP

SEQ ID NO: 109283 - protein, 9 aa, Dengue virus
VNIETEPPF

SEQ ID NO: 109284 - protein, 9 aa, Dengue virus
NIETEPPFG

SEQ ID NO: 109285 - protein, 9 aa, Dengue virus
IEAEPPFGD

SEQ ID NO: 109286 - protein, 9 aa, Dengue virus
EAEPPFGDS

SEQ ID NO: 109287 - protein, 9 aa, Dengue virus
AEPPFGDSY

SEQ ID NO: 109288 - protein, 9 aa, Dengue virus
EPPFGDSYI

SEQ ID NO: 109289 - protein, 9 aa, Dengue virus
WYKKGSSIG

SEQ ID NO: 109290 - protein, 9 aa, Dengue virus
KKGSSIGQM

SEQ ID NO: 109291 - protein, 9 aa, Dengue virus
KGSSIGQMF

SEQ ID NO: 109292 - protein, 9 aa, Dengue virus
GSSIGQMFE

SEQ ID NO: 109293 - protein, 9 aa, Dengue virus
SSIGQMFET

SEQ ID NO: 109294 - protein, 9 aa, Dengue virus
SIGQMFETT

SEQ ID NO: 109295 - protein, 9 aa, Dengue virus
IGQMFETTM

SEQ ID NO: 109296 - protein, 9 aa, Dengue virus
GQMFETTMR

SEQ ID NO: 109297 - protein, 9 aa, Dengue virus
QMFETTMRG

SEQ ID NO: 109298 - protein, 9 aa, Dengue virus
MFETTMRGA

SEQ ID NO: 109299 - protein, 9 aa, Dengue virus
FETTMRGAK

SEQ ID NO: 109300 - protein, 9 aa, Dengue virus
ETTMRGAKR

SEQ ID NO: 109301 - protein, 9 aa, Dengue virus
TTMRGAKRM

SEQ ID NO: 109302 - protein, 9 aa, Dengue virus
TMRGAKRMA

SEQ ID NO: 109303 - protein, 9 aa, Dengue virus
MRGAKRMAI

SEQ ID NO: 109304 - protein, 9 aa, Dengue virus
RGAKRMAIL

SEQ ID NO: 109305 - protein, 9 aa, Dengue virus
GAKRMAILG

SEQ ID NO: 109306 - protein, 9 aa, Dengue virus
AKRMAILGD

SEQ ID NO: 109307 - protein, 9 aa, Dengue virus
KRMAILGDT

SEQ ID NO: 109308 - protein, 9 aa, Dengue virus
RMAILGETA

SEQ ID NO: 109309 - protein, 9 aa, Dengue virus
MAILGETAW

SEQ ID NO: 109310 - protein, 9 aa, Dengue virus
AILGETAWD

SEQ ID NO: 109311 - protein, 9 aa, Dengue virus
ILGETAWDF

SEQ ID NO: 109312 - protein, 9 aa, Dengue virus
LGETAWDFG

SEQ ID NO: 109313 - protein, 9 aa, Dengue virus
GETAWDFGS

SEQ ID NO: 109314 - protein, 9 aa, Dengue virus
DTAWDFGSL

SEQ ID NO: 109315 - protein, 9 aa, Dengue virus
TAWDFGSLG

SEQ ID NO: 109316 - protein, 9 aa, Dengue virus
AWDFGSLGG

SEQ ID NO: 109317 - protein, 9 aa, Dengue virus
WDFGSLGGV

SEQ ID NO: 109318 - protein, 9 aa, Dengue virus
FGAIYGAAF

SEQ ID NO: 109319 - protein, 9 aa, Dengue virus
IYGAAFSGV

SEQ ID NO: 109320 - protein, 9 aa, Dengue virus
YGAAFSGVS

SEQ ID NO: 109321 - protein, 9 aa, Dengue virus
GAAFSGVSW

SEQ ID NO: 109322 - protein, 9 aa, Dengue virus
FSGVSWVMK

SEQ ID NO: 109323 - protein, 9 aa, Dengue virus
SGVSWVMKI

SEQ ID NO: 109324 - protein, 9 aa, Dengue virus
IITWIGMNS

SEQ ID NO: 109325 - protein, 9 aa, Dengue virus
ITWIGMNSR

SEQ ID NO: 109326 - protein, 9 aa, Dengue virus
TWIGMNSRS

SEQ ID NO: 109327 - protein, 9 aa, Dengue virus
WIGMNSRST

SEQ ID NO: 109328 - protein, 9 aa, Dengue virus
LYLGAVVQA

SEQ ID NO: 109329 - protein, 9 aa, Dengue virus
YLGAVVQAD

SEQ ID NO: 109330 - protein, 9 aa, Dengue virus
NKELKCGSG

SEQ ID NO: 109331 - protein, 9 aa, Dengue virus
RELKCGSGI

SEQ ID NO: 109332 - protein, 9 aa, Dengue virus
LKCGSGIFI

SEQ ID NO: 109333 - protein, 9 aa, Dengue virus
KCGSGIFIT

SEQ ID NO: 109334 - protein, 9 aa, Dengue virus
CGSGIFITD

SEQ ID NO: 109335 - protein, 9 aa, Dengue virus
GSGIFITDN

SEQ ID NO: 109336 - protein, 9 aa, Dengue virus
SGIFITDNV

SEQ ID NO: 109337 - protein, 9 aa, Dengue virus
GIFITDNVH

SEQ ID NO: 109338 - protein, 9 aa, Dengue virus
IFITDNVHT

SEQ ID NO: 109339 - protein, 9 aa, Dengue virus
FITDNVHTW

SEQ ID NO: 109340 - protein, 9 aa, Dengue virus
ITDNVHTWT

SEQ ID NO: 109341 - protein, 9 aa, Dengue virus
TDNVHTWTE

SEQ ID NO: 109342 - protein, 9 aa, Dengue virus
DNVHTWTEQ

SEQ ID NO: 109343 - protein, 9 aa, Dengue virus
NVHTWTEQY

SEQ ID NO: 109344 - protein, 9 aa, Dengue virus
WTEQYKFQP

SEQ ID NO: 109345 - protein, 9 aa, Dengue virus
TEQYKFQPE

SEQ ID NO: 109346 - protein, 9 aa, Dengue virus
EQYKFQPES

SEQ ID NO: 109347 - protein, 9 aa, Dengue virus
QYKFQPESP

SEQ ID NO: 109348 - protein, 9 aa, Dengue virus
YKFQPESPS

SEQ ID NO: 109349 - protein, 9 aa, Dengue virus
KFQPESPSK

SEQ ID NO: 109350 - protein, 9 aa, Dengue virus
FQPESPSKL

SEQ ID NO: 109351 - protein, 9 aa, Dengue virus
QPESPSKLA

SEQ ID NO: 109352 - protein, 9 aa, Dengue virus
PESPSKLAS

SEQ ID NO: 109353 - protein, 9 aa, Dengue virus
ESPSKLASA

SEQ ID NO: 109354 - protein, 9 aa, Dengue virus
SPSKLASAI

SEQ ID NO: 109355 - protein, 9 aa, Dengue virus
PSKLASAIQ

SEQ ID NO: 109356 - protein, 9 aa, Dengue virus
SKLASAIQK

SEQ ID NO: 109357 - protein, 9 aa, Dengue virus
KLASAIQKA

SEQ ID NO: 109358 - protein, 9 aa, Dengue virus
EEGICGIRS

SEQ ID NO: 109359 - protein, 9 aa, Dengue virus
GICGIRSVT

SEQ ID NO: 109360 - protein, 9 aa, Dengue virus
ICGIRSVTR

SEQ ID NO: 109361 - protein, 9 aa, Dengue virus
CGIRSVTRL

SEQ ID NO: 109362 - protein, 9 aa, Dengue virus
GIRSVTRLE

SEQ ID NO: 109363 - protein, 9 aa, Dengue virus
IRSVTRLEN

SEQ ID NO: 109364 - protein, 9 aa, Dengue virus
RSVTRLENL

SEQ ID NO: 109365 - protein, 9 aa, Dengue virus
SVTRLENLM

SEQ ID NO: 109366 - protein, 9 aa, Dengue virus
VTRLENLMW

SEQ ID NO: 109367 - protein, 9 aa, Dengue virus
TRLENLMWK

SEQ ID NO: 109368 - protein, 9 aa, Dengue virus
RLENLMWKQ

SEQ ID NO: 109369 - protein, 9 aa, Dengue virus
LENLMWKQI

SEQ ID NO: 109370 - protein, 9 aa, Dengue virus
ELNHILSEN

SEQ ID NO: 109371 - protein, 9 aa, Dengue virus
YSWKSWGKA

SEQ ID NO: 109372 - protein, 9 aa, Dengue virus
SWKSWGKAK

SEQ ID NO: 109373 - protein, 9 aa, Dengue virus
TFLIDGPET

SEQ ID NO: 109374 - protein, 9 aa, Dengue virus
RAWNSLEVE

SEQ ID NO: 109375 - protein, 9 aa, Dengue virus
AWNSLEVED

SEQ ID NO: 109376 - protein, 9 aa, Dengue virus
WNSLEVEDY

SEQ ID NO: 109377 - protein, 9 aa, Dengue virus
NSLEVEDYG

SEQ ID NO: 109378 - protein, 9 aa, Dengue virus
SLEVEDYGF

SEQ ID NO: 109379 - protein, 9 aa, Dengue virus
LEVEDYGFG

SEQ ID NO: 109380 - protein, 9 aa, Dengue virus
EVEDYGFGI

SEQ ID NO: 109381 - protein, 9 aa, Dengue virus
VEDYGFGIF

SEQ ID NO: 109382 - protein, 9 aa, Dengue virus
EDYGFGIFT

SEQ ID NO: 109383 - protein, 9 aa, Dengue virus
DYGFGIFTT

SEQ ID NO: 109384 - protein, 9 aa, Dengue virus
YGFGIFTTN

SEQ ID NO: 109385 - protein, 9 aa, Dengue virus
GFGIFTTNI

SEQ ID NO: 109386 - protein, 9 aa, Dengue virus
FGIFTTNIW

SEQ ID NO: 109387 - protein, 9 aa, Dengue virus
GIFTTNIWL

SEQ ID NO: 109388 - protein, 9 aa, Dengue virus
IFTTNIWLK

SEQ ID NO: 109389 - protein, 9 aa, Dengue virus
FTTNIWMKF

SEQ ID NO: 109390 - protein, 9 aa, Dengue virus
CDSKLMSAA

SEQ ID NO: 109391 - protein, 9 aa, Dengue virus
DSKLMSAAI

SEQ ID NO: 109392 - protein, 9 aa, Dengue virus
SKLMSAAIK

SEQ ID NO: 109393 - protein, 9 aa, Dengue virus
KLMSAAIKD

SEQ ID NO: 109394 - protein, 9 aa, Dengue virus
KDNRAVHAD

SEQ ID NO: 109395 - protein, 9 aa, Dengue virus
DNRAVHADM

SEQ ID NO: 109396 - protein, 9 aa, Dengue virus
NRAVHADMG

SEQ ID NO: 109397 - protein, 9 aa, Dengue virus
KAVHADMGY

SEQ ID NO: 109398 - protein, 9 aa, Dengue virus
DMGYWIESA

SEQ ID NO: 109399 - protein, 9 aa, Dengue virus
MGYWIESAL

SEQ ID NO: 109400 - protein, 9 aa, Dengue virus
GYWIESALN

SEQ ID NO: 109401 - protein, 9 aa, Dengue virus
ESALNDTWK

SEQ ID NO: 109402 - protein, 9 aa, Dengue virus
ASFIEVKSC

SEQ ID NO: 109403 - protein, 9 aa, Dengue virus
WPKTHTLWS

SEQ ID NO: 109404 - protein, 9 aa, Dengue virus
PKTHTLWSN

SEQ ID NO: 109405 - protein, 9 aa, Dengue virus
KTHTLWSNG

SEQ ID NO: 109406 - protein, 9 aa, Dengue virus
THTLWSNGV

SEQ ID NO: 109407 - protein, 9 aa, Dengue virus
WSNGVLESD

SEQ ID NO: 109408 - protein, 9 aa, Dengue virus
SNGVLESDM

SEQ ID NO: 109409 - protein, 9 aa, Dengue virus
NGVLESDMI

SEQ ID NO: 109410 - protein, 9 aa, Dengue virus
GVLESDMII

SEQ ID NO: 109411 - protein, 9 aa, Dengue virus
VLESDMIIP

SEQ ID NO: 109412 - protein, 9 aa, Dengue virus
LESDMIIPK

SEQ ID NO: 109413 - protein, 9 aa, Dengue virus
SQHNHRPGY

SEQ ID NO: 109414 - protein, 9 aa, Dengue virus
TQIAGPWHL

SEQ ID NO: 109415 - protein, 9 aa, Dengue virus
QIAGPWHLG

SEQ ID NO: 109416 - protein, 9 aa, Dengue virus
IAGPWHLGK

SEQ ID NO: 109417 - protein, 9 aa, Dengue virus
VGPWHLGKL

SEQ ID NO: 109418 - protein, 9 aa, Dengue virus
GPWHLGRLE

SEQ ID NO: 109419 - protein, 9 aa, Dengue virus
PWHLGKLEM

SEQ ID NO: 109420 - protein, 9 aa, Dengue virus
WHLGKLEMD

SEQ ID NO: 109421 - protein, 9 aa, Dengue virus
HLGKLEMDF

SEQ ID NO: 109422 - protein, 9 aa, Dengue virus
CGTRGPSLR

SEQ ID NO: 109423 - protein, 9 aa, Dengue virus
GTRGPSLRT

SEQ ID NO: 109424 - protein, 9 aa, Dengue virus
TRGPSLRTT

SEQ ID NO: 109425 - protein, 9 aa, Dengue virus
GPSLRTTTA

SEQ ID NO: 109426 - protein, 9 aa, Dengue virus
PSLRTTTAS

SEQ ID NO: 109427 - protein, 9 aa, Dengue virus
SLRTTTASG

SEQ ID NO: 109428 - protein, 9 aa, Dengue virus
LRTTTASGK

SEQ ID NO: 109429 - protein, 9 aa, Dengue virus
RTTTASGKL

SEQ ID NO: 109430 - protein, 9 aa, Dengue virus
TTTASGKLI

SEQ ID NO: 109431 - protein, 9 aa, Dengue virus
TTASGKLIT

SEQ ID NO: 109432 - protein, 9 aa, Dengue virus
TASGKLITE

SEQ ID NO: 109433 - protein, 9 aa, Dengue virus
ASGKLITEW

SEQ ID NO: 109434 - protein, 9 aa, Dengue virus
SGKLITEWC

SEQ ID NO: 109435 - protein, 9 aa, Dengue virus
GKLITEWCC

SEQ ID NO: 109436 - protein, 9 aa, Dengue virus
KLITEWCCR

SEQ ID NO: 109437 - protein, 9 aa, Dengue virus
LITEWCCRS

SEQ ID NO: 109438 - protein, 9 aa, Dengue virus
ITEWCCRSC

SEQ ID NO: 109439 - protein, 9 aa, Dengue virus
TEWCCRSCT

SEQ ID NO: 109440 - protein, 9 aa, Dengue virus
QWCCRSCTM

SEQ ID NO: 109441 - protein, 9 aa, Dengue virus
WCCRSCTMP

SEQ ID NO: 109442 - protein, 9 aa, Dengue virus
CCRSCTMPP

SEQ ID NO: 109443 - protein, 9 aa, Dengue virus
CRSCTMPPL

SEQ ID NO: 109444 - protein, 9 aa, Dengue virus
RSCTMPPLR

SEQ ID NO: 109445 - protein, 9 aa, Dengue virus
SCTLPPLRF

SEQ ID NO: 109446 - protein, 9 aa, Dengue virus
CTLPPLRFR

SEQ ID NO: 109447 - protein, 9 aa, Dengue virus
TLPPLRFRG

SEQ ID NO: 109448 - protein, 9 aa, Dengue virus
LPPLRFRGE

SEQ ID NO: 109449 - protein, 9 aa, Dengue virus
PPLRFRGED

SEQ ID NO: 109450 - protein, 9 aa, Dengue virus
PLRFRGEDG

SEQ ID NO: 109451 - protein, 9 aa, Dengue virus
LRFRGEDGC

SEQ ID NO: 109452 - protein, 9 aa, Dengue virus
RFRGEDGCW

SEQ ID NO: 109453 - protein, 9 aa, Dengue virus
FRGEDGCWY

SEQ ID NO: 109454 - protein, 9 aa, Dengue virus
MGEDGCWYG

SEQ ID NO: 109455 - protein, 9 aa, Dengue virus
WYGMEIRPL

SEQ ID NO: 109456 - protein, 9 aa, Dengue virus
EEMLRTRVG

SEQ ID NO: 109457 - protein, 9 aa, Dengue virus
IGMGVTYLA

SEQ ID NO: 109458 - protein, 9 aa, Dengue virus
GMGTTYLAL

SEQ ID NO: 109459 - protein, 9 aa, Dengue virus
TYLALLAAF

SEQ ID NO: 109460 - protein, 9 aa, Dengue virus
LLRKLTSKE

SEQ ID NO: 109461 - protein, 9 aa, Dengue virus
RKLTSKELM

SEQ ID NO: 109462 - protein, 9 aa, Dengue virus
KLTSKELMM

SEQ ID NO: 109463 - protein, 9 aa, Dengue virus
LTSRENLLL

SEQ ID NO: 109464 - protein, 9 aa, Dengue virus
TSRENLLLG

SEQ ID NO: 109465 - protein, 9 aa, Dengue virus
ELTDALALG

SEQ ID NO: 109466 - protein, 9 aa, Dengue virus
LTDALALGM

SEQ ID NO: 109467 - protein, 9 aa, Dengue virus
TDALALGMM

SEQ ID NO: 109468 - protein, 9 aa, Dengue virus
RKSWPLNEG

SEQ ID NO: 109469 - protein, 9 aa, Dengue virus
RSWPLNEAI

SEQ ID NO: 109470 - protein, 9 aa, Dengue virus
SWPLNEAIM

SEQ ID NO: 109471 - protein, 9 aa, Dengue virus
WPLNEAIMA

SEQ ID NO: 109472 - protein, 9 aa, Dengue virus
PLNEAIMAV

SEQ ID NO: 109473 - protein, 9 aa, Dengue virus
LNEAIMAVG

SEQ ID NO: 109474 - protein, 9 aa, Dengue virus
GMVSILASS

SEQ ID NO: 109475 - protein, 9 aa, Dengue virus
VSILLSSLL

SEQ ID NO: 109476 - protein, 9 aa, Dengue virus
SILASSLLK

SEQ ID NO: 109477 - protein, 9 aa, Dengue virus
ILASSLLKN

SEQ ID NO: 109478 - protein, 9 aa, Dengue virus
LASSLLKND

SEQ ID NO: 109479 - protein, 9 aa, Dengue virus
ASSLLKNDI

SEQ ID NO: 109480 - protein, 9 aa, Dengue virus
SSLLKNDIP

SEQ ID NO: 109481 - protein, 9 aa, Dengue virus
SLLKNDIPM

SEQ ID NO: 109482 - protein, 9 aa, Dengue virus
LLKNDIPMT

SEQ ID NO: 109483 - protein, 9 aa, Dengue virus
LKNDIPMTG

SEQ ID NO: 109484 - protein, 9 aa, Dengue virus
KNDIPMTGP

SEQ ID NO: 109485 - protein, 9 aa, Dengue virus
NDIPMTGPL

SEQ ID NO: 109486 - protein, 9 aa, Dengue virus
DIPMTGPLV

SEQ ID NO: 109487 - protein, 9 aa, Dengue virus
IPMTGPLVA

SEQ ID NO: 109488 - protein, 9 aa, Dengue virus
PMTGPLVAG

SEQ ID NO: 109489 - protein, 9 aa, Dengue virus
MTGPLVAGG

SEQ ID NO: 109490 - protein, 9 aa, Dengue virus
TGPLVAGGL

SEQ ID NO: 109491 - protein, 9 aa, Dengue virus
GPLIAGGML

SEQ ID NO: 109492 - protein, 9 aa, Dengue virus
PLVAGGLLT

SEQ ID NO: 109493 - protein, 9 aa, Dengue virus
LVAGGLLTV

SEQ ID NO: 109494 - protein, 9 aa, Dengue virus
VAGGLLTVC

SEQ ID NO: 109495 - protein, 9 aa, Dengue virus
AGGLLTVCY

SEQ ID NO: 109496 - protein, 9 aa, Dengue virus
GGLLTVCYV

SEQ ID NO: 109497 - protein, 9 aa, Dengue virus
GLLTVCYVL

SEQ ID NO: 109498 - protein, 9 aa, Dengue virus
LLTVCYVLT

SEQ ID NO: 109499 - protein, 9 aa, Dengue virus
LTVCYVLTG

SEQ ID NO: 109500 - protein, 9 aa, Dengue virus
TVCYVLTGR

SEQ ID NO: 109501 - protein, 9 aa, Dengue virus
VCYVLTGRS

SEQ ID NO: 109502 - protein, 9 aa, Dengue virus
CYVLTGRSA

SEQ ID NO: 109503 - protein, 9 aa, Dengue virus
YVLTGRSAD

SEQ ID NO: 109504 - protein, 9 aa, Dengue virus
VLTGRSADL

SEQ ID NO: 109505 - protein, 9 aa, Dengue virus
LTGRSADLE

SEQ ID NO: 109506 - protein, 9 aa, Dengue virus
TGRSADLEL

SEQ ID NO: 109507 - protein, 9 aa, Dengue virus
GRSADLELE

SEQ ID NO: 109508 - protein, 9 aa, Dengue virus
RSADLELER

SEQ ID NO: 109509 - protein, 9 aa, Dengue virus
QAEISGSSP

SEQ ID NO: 109510 - protein, 9 aa, Dengue virus
AEISGSSPI

SEQ ID NO: 109511 - protein, 9 aa, Dengue virus
EISGSSPIL

SEQ ID NO: 109512 - protein, 9 aa, Dengue virus
ISGSSPILS

SEQ ID NO: 109513 - protein, 9 aa, Dengue virus
SEDGSMSIK

SEQ ID NO: 109514 - protein, 9 aa, Dengue virus
EDGSMSIKN

SEQ ID NO: 109515 - protein, 9 aa, Dengue virus
DGSMSIKNE

SEQ ID NO: 109516 - protein, 9 aa, Dengue virus
GSMSIKNEE

SEQ ID NO: 109517 - protein, 9 aa, Dengue virus
SMSIKNEEE

SEQ ID NO: 109518 - protein, 9 aa, Dengue virus
MSIKNEEEE

SEQ ID NO: 109519 - protein, 9 aa, Dengue virus
LTILIRTGL

SEQ ID NO: 109520 - protein, 9 aa, Dengue virus
TILIRTGLL

SEQ ID NO: 109521 - protein, 9 aa, Dengue virus
ILIRTGLLV

SEQ ID NO: 109522 - protein, 9 aa, Dengue virus
LIRTGLLVI

SEQ ID NO: 109523 - protein, 9 aa, Dengue virus
IRTGLLVIS

SEQ ID NO: 109524 - protein, 9 aa, Dengue virus
RTGLLVISG

SEQ ID NO: 109525 - protein, 9 aa, Dengue virus
KKQRAGVLW

SEQ ID NO: 109526 - protein, 9 aa, Dengue virus
KQRAGVLWD

SEQ ID NO: 109527 - protein, 9 aa, Dengue virus
QRAGVLWDV

SEQ ID NO: 109528 - protein, 9 aa, Dengue virus
RAGVLWDVP

SEQ ID NO: 109529 - protein, 9 aa, Dengue virus
AGVLWDVPS

SEQ ID NO: 109530 - protein, 9 aa, Dengue virus
GVLWDTPSP

SEQ ID NO: 109531 - protein, 9 aa, Dengue virus
VLWDTPSPP

SEQ ID NO: 109532 - protein, 9 aa, Dengue virus
LWDVPSPPP

SEQ ID NO: 109533 - protein, 9 aa, Dengue virus
AELEDGAYR

SEQ ID NO: 109534 - protein, 9 aa, Dengue virus
ELEDGAYRI

SEQ ID NO: 109535 - protein, 9 aa, Dengue virus
LEDGAYRIK

SEQ ID NO: 109536 - protein, 9 aa, Dengue virus
EDGAYRIKQ

SEQ ID NO: 109537 - protein, 9 aa, Dengue virus
LGYSQIGAG

SEQ ID NO: 109538 - protein, 9 aa, Dengue virus
GYSQIGAGV

SEQ ID NO: 109539 - protein, 9 aa, Dengue virus
YSQIGAGVY

SEQ ID NO: 109540 - protein, 9 aa, Dengue virus
SQIGAGVYK

SEQ ID NO: 109541 - protein, 9 aa, Dengue virus
QIGAGVYKE

SEQ ID NO: 109542 - protein, 9 aa, Dengue virus
EGTFHTMWH

SEQ ID NO: 109543 - protein, 9 aa, Dengue virus
NVFHTMWHV

SEQ ID NO: 109544 - protein, 9 aa, Dengue virus
TFHTMWHVT

SEQ ID NO: 109545 - protein, 9 aa, Dengue virus
TMWHVTRGS

SEQ ID NO: 109546 - protein, 9 aa, Dengue virus
MWHVTRGSV

SEQ ID NO: 109547 - protein, 9 aa, Dengue virus
WHVTRGSVI

SEQ ID NO: 109548 - protein, 9 aa, Dengue virus
HVTRGAVLT

SEQ ID NO: 109549 - protein, 9 aa, Dengue virus
VTRGAVLMH

SEQ ID NO: 109550 - protein, 9 aa, Dengue virus
NGKRLEPNW

SEQ ID NO: 109551 - protein, 9 aa, Dengue virus
GKRIEPSWA

SEQ ID NO: 109552 - protein, 9 aa, Dengue virus
KRIEPSWAD

SEQ ID NO: 109553 - protein, 9 aa, Dengue virus
RIEPSWADV

SEQ ID NO: 109554 - protein, 9 aa, Dengue virus
IEPSWADVK

SEQ ID NO: 109555 - protein, 9 aa, Dengue virus
EPSWADVKK

SEQ ID NO: 109556 - protein, 9 aa, Dengue virus
PSWADVKKD

SEQ ID NO: 109557 - protein, 9 aa, Dengue virus
SWADVKKDL

SEQ ID NO: 109558 - protein, 9 aa, Dengue virus
WADVKKDLI

SEQ ID NO: 109559 - protein, 9 aa, Dengue virus
ADVKKDLIS

SEQ ID NO: 109560 - protein, 9 aa, Dengue virus
DVKKDLISY

SEQ ID NO: 109561 - protein, 9 aa, Dengue virus
VRNDMISYG

SEQ ID NO: 109562 - protein, 9 aa, Dengue virus
RNDMISYGG

SEQ ID NO: 109563 - protein, 9 aa, Dengue virus
NDMISYGGG

SEQ ID NO: 109564 - protein, 9 aa, Dengue virus
DMISYGGGW

SEQ ID NO: 109565 - protein, 9 aa, Dengue virus
LISYGGGWK

SEQ ID NO: 109566 - protein, 9 aa, Dengue virus
ISYGGGWKL

SEQ ID NO: 109567 - protein, 9 aa, Dengue virus
WKEGEEVQV

SEQ ID NO: 109568 - protein, 9 aa, Dengue virus
KEGEEVQVL

SEQ ID NO: 109569 - protein, 9 aa, Dengue virus
EGEEVQVLA

SEQ ID NO: 109570 - protein, 9 aa, Dengue virus
GEEVQVLAL

SEQ ID NO: 109571 - protein, 9 aa, Dengue virus
EEVQVLALE

SEQ ID NO: 109572 - protein, 9 aa, Dengue virus
EVQVLALEP

SEQ ID NO: 109573 - protein, 9 aa, Dengue virus
VQVLALEPG

SEQ ID NO: 109574 - protein, 9 aa, Dengue virus
QVLALEPGK

SEQ ID NO: 109575 - protein, 9 aa, Dengue virus
VLALEPGKN

SEQ ID NO: 109576 - protein, 9 aa, Dengue virus
LALEPGKNP

SEQ ID NO: 109577 - protein, 9 aa, Dengue virus
ALEPGKNPR

SEQ ID NO: 109578 - protein, 9 aa, Dengue virus
LEPGKNPRA

SEQ ID NO: 109579 - protein, 9 aa, Dengue virus
EPGKNPRAV

SEQ ID NO: 109580 - protein, 9 aa, Dengue virus
PGKNPRAVQ

SEQ ID NO: 109581 - protein, 9 aa, Dengue virus
GKNPRAVQT

SEQ ID NO: 109582 - protein, 9 aa, Dengue virus
TGTIGAVSL

SEQ ID NO: 109583 - protein, 9 aa, Dengue virus
GTIGAVSLD

SEQ ID NO: 109584 - protein, 9 aa, Dengue virus
TIGAVSLDF

SEQ ID NO: 109585 - protein, 9 aa, Dengue virus
IGAVSLDFS

SEQ ID NO: 109586 - protein, 9 aa, Dengue virus
GAVSLDFSP

SEQ ID NO: 109587 - protein, 9 aa, Dengue virus
AVSLDFSPG

SEQ ID NO: 109588 - protein, 9 aa, Dengue virus
VSLDFSPGT

SEQ ID NO: 109589 - protein, 9 aa, Dengue virus
SLDFSPGTS

SEQ ID NO: 109590 - protein, 9 aa, Dengue virus
LDFSPGTSG

SEQ ID NO: 109591 - protein, 9 aa, Dengue virus
DFSPGTSGS

SEQ ID NO: 109592 - protein, 9 aa, Dengue virus
FSPGTSGSP

SEQ ID NO: 109593 - protein, 9 aa, Dengue virus
SPGTSGSPI

SEQ ID NO: 109594 - protein, 9 aa, Dengue virus
PGTSGSPII

SEQ ID NO: 109595 - protein, 9 aa, Dengue virus
GTSGSPIIN

SEQ ID NO: 109596 - protein, 9 aa, Dengue virus
TSGSPIINR

SEQ ID NO: 109597 - protein, 9 aa, Dengue virus
KGKVVGLYG

SEQ ID NO: 109598 - protein, 9 aa, Dengue virus
GKIVGLYGN

SEQ ID NO: 109599 - protein, 9 aa, Dengue virus
KIVGLYGNG

SEQ ID NO: 109600 - protein, 9 aa, Dengue virus
IVGLYGNGV

SEQ ID NO: 109601 - protein, 9 aa, Dengue virus
IGLYGNGVV

SEQ ID NO: 109602 - protein, 9 aa, Dengue virus
LYGNGVVTR

SEQ ID NO: 109603 - protein, 9 aa, Dengue virus
YGNGVVTRS

SEQ ID NO: 109604 - protein, 9 aa, Dengue virus
GNGVVTRSG

SEQ ID NO: 109605 - protein, 9 aa, Dengue virus
NGVVTRSGA

SEQ ID NO: 109606 - protein, 9 aa, Dengue virus
GVVTRSGAY

SEQ ID NO: 109607 - protein, 9 aa, Dengue virus
VVTRSGAYV

SEQ ID NO: 109608 - protein, 9 aa, Dengue virus
VTRSGAYVS

SEQ ID NO: 109609 - protein, 9 aa, Dengue virus
SGAYVSAIA

SEQ ID NO: 109610 - protein, 9 aa, Dengue virus
GAYVSAIAQ

SEQ ID NO: 109611 - protein, 9 aa, Dengue virus
AYVSAIAQT

SEQ ID NO: 109612 - protein, 9 aa, Dengue virus
IFRKKRLTI

SEQ ID NO: 109613 - protein, 9 aa, Dengue virus
FKKRNLTIM

SEQ ID NO: 109614 - protein, 9 aa, Dengue virus
KKRNLTIMD

SEQ ID NO: 109615 - protein, 9 aa, Dengue virus
KKRLTIMDL

SEQ ID NO: 109616 - protein, 9 aa, Dengue virus
KRLTIMDLH

SEQ ID NO: 109617 - protein, 9 aa, Dengue virus
RLTIMDLHP

SEQ ID NO: 109618 - protein, 9 aa, Dengue virus
TIMDLHPGA

SEQ ID NO: 109619 - protein, 9 aa, Dengue virus
IMDLHPGAG

SEQ ID NO: 109620 - protein, 9 aa, Dengue virus
MDLHPGAGK

SEQ ID NO: 109621 - protein, 9 aa, Dengue virus
DLHPGAGKT

SEQ ID NO: 109622 - protein, 9 aa, Dengue virus
LHPGAGKTK

SEQ ID NO: 109623 - protein, 9 aa, Dengue virus
HPGAGKTKR

SEQ ID NO: 109624 - protein, 9 aa, Dengue virus
PGAGKTKRY

SEQ ID NO: 109625 - protein, 9 aa, Dengue virus
GAGKTKRYL

SEQ ID NO: 109626 - protein, 9 aa, Dengue virus
AGKTKRYLP

SEQ ID NO: 109627 - protein, 9 aa, Dengue virus
GKTKRYLPA

SEQ ID NO: 109628 - protein, 9 aa, Dengue virus
KTKRYLPAI

SEQ ID NO: 109629 - protein, 9 aa, Dengue virus
KYLPAIVRE

SEQ ID NO: 109630 - protein, 9 aa, Dengue virus
ILPSIVREA

SEQ ID NO: 109631 - protein, 9 aa, Dengue virus
LPSIVREAL

SEQ ID NO: 109632 - protein, 9 aa, Dengue virus
PSIVREALK

SEQ ID NO: 109633 - protein, 9 aa, Dengue virus
SIVREALKR

SEQ ID NO: 109634 - protein, 9 aa, Dengue virus
REAIKRGLR

SEQ ID NO: 109635 - protein, 9 aa, Dengue virus
EAIKRGLRT

SEQ ID NO: 109636 - protein, 9 aa, Dengue virus
AIKRGLRTL

SEQ ID NO: 109637 - protein, 9 aa, Dengue virus
KRGLRTLIL

SEQ ID NO: 109638 - protein, 9 aa, Dengue virus
RGLRTLILA

SEQ ID NO: 109639 - protein, 9 aa, Dengue virus
GLRTLILAP

SEQ ID NO: 109640 - protein, 9 aa, Dengue virus
LRTLVLAPT

SEQ ID NO: 109641 - protein, 9 aa, Dengue virus
RTLVLAPTR

SEQ ID NO: 109642 - protein, 9 aa, Dengue virus
TLVLAPTRV

SEQ ID NO: 109643 - protein, 9 aa, Dengue virus
LVLAPTRVV

SEQ ID NO: 109644 - protein, 9 aa, Dengue virus
VLAPTRVVA

SEQ ID NO: 109645 - protein, 9 aa, Dengue virus
LAPTRVVAS

SEQ ID NO: 109646 - protein, 9 aa, Dengue virus
APTRVVASE

SEQ ID NO: 109647 - protein, 9 aa, Dengue virus
PTRVVASEM

SEQ ID NO: 109648 - protein, 9 aa, Dengue virus
TRVVASEMA

SEQ ID NO: 109649 - protein, 9 aa, Dengue virus
RVVASEMAE

SEQ ID NO: 109650 - protein, 9 aa, Dengue virus
VVASEMAEA

SEQ ID NO: 109651 - protein, 9 aa, Dengue virus
VASEMAEAL

SEQ ID NO: 109652 - protein, 9 aa, Dengue virus
AAEMEEALR

SEQ ID NO: 109653 - protein, 9 aa, Dengue virus
AEMEEALRG

SEQ ID NO: 109654 - protein, 9 aa, Dengue virus
EMEEALRGL

SEQ ID NO: 109655 - protein, 9 aa, Dengue virus
MEEALRGLP

SEQ ID NO: 109656 - protein, 9 aa, Dengue virus
EEALRGLPI

SEQ ID NO: 109657 - protein, 9 aa, Dengue virus
EALRGLPIR

SEQ ID NO: 109658 - protein, 9 aa, Dengue virus
ALRGLPIRY

SEQ ID NO: 109659 - protein, 9 aa, Dengue virus
LRGLPIRYQ

SEQ ID NO: 109660 - protein, 9 aa, Dengue virus
RGLPIRYQT

SEQ ID NO: 109661 - protein, 9 aa, Dengue virus
GLPIRYQTP

SEQ ID NO: 109662 - protein, 9 aa, Dengue virus
LPIRYQTPA

SEQ ID NO: 109663 - protein, 9 aa, Dengue virus
PIRYQTPAI

SEQ ID NO: 109664 - protein, 9 aa, Dengue virus
KSEHTGREI

SEQ ID NO: 109665 - protein, 9 aa, Dengue virus
SEHTGREIV

SEQ ID NO: 109666 - protein, 9 aa, Dengue virus
EHTGKEIVD

SEQ ID NO: 109667 - protein, 9 aa, Dengue virus
HTGKEIVDL

SEQ ID NO: 109668 - protein, 9 aa, Dengue virus
TGKEIVDLM

SEQ ID NO: 109669 - protein, 9 aa, Dengue virus
GKEIVDLMC

SEQ ID NO: 109670 - protein, 9 aa, Dengue virus
KEIVDLMCH

SEQ ID NO: 109671 - protein, 9 aa, Dengue virus
LMCHATFTT

SEQ ID NO: 109672 - protein, 9 aa, Dengue virus
MCHATFTTR

SEQ ID NO: 109673 - protein, 9 aa, Dengue virus
CHATFTTRL

SEQ ID NO: 109674 - protein, 9 aa, Dengue virus
HATFTTRLL

SEQ ID NO: 109675 - protein, 9 aa, Dengue virus
ATFTTRLLS

SEQ ID NO: 109676 - protein, 9 aa, Dengue virus
TFTTRLLSS

SEQ ID NO: 109677 - protein, 9 aa, Dengue virus
FTTRLLSST

SEQ ID NO: 109678 - protein, 9 aa, Dengue virus
TTRLLSSTR

SEQ ID NO: 109679 - protein, 9 aa, Dengue virus
TRLLSSTRV

SEQ ID NO: 109680 - protein, 9 aa, Dengue virus
RLLSSTRVP

SEQ ID NO: 109681 - protein, 9 aa, Dengue virus
LLSSTRVPN

SEQ ID NO: 109682 - protein, 9 aa, Dengue virus
LSSTRVPNY

SEQ ID NO: 109683 - protein, 9 aa, Dengue virus
SSTRVPNYN

SEQ ID NO: 109684 - protein, 9 aa, Dengue virus
PVRVPNYNM

SEQ ID NO: 109685 - protein, 9 aa, Dengue virus
VRVPNYNMI

SEQ ID NO: 109686 - protein, 9 aa, Dengue virus
RVPNYNMII

SEQ ID NO: 109687 - protein, 9 aa, Dengue virus
VPNYNMIIM

SEQ ID NO: 109688 - protein, 9 aa, Dengue virus
PNYNMIIMD

SEQ ID NO: 109689 - protein, 9 aa, Dengue virus
NYNMIIMDE

SEQ ID NO: 109690 - protein, 9 aa, Dengue virus
YNMIIMDEA

SEQ ID NO: 109691 - protein, 9 aa, Dengue virus
NMIIMDEAH

SEQ ID NO: 109692 - protein, 9 aa, Dengue virus
MIIMDEAHF

SEQ ID NO: 109693 - protein, 9 aa, Dengue virus
IVMDEAHFT

SEQ ID NO: 109694 - protein, 9 aa, Dengue virus
VMDEAHFTD

SEQ ID NO: 109695 - protein, 9 aa, Dengue virus
DEAHFTDPS

SEQ ID NO: 109696 - protein, 9 aa, Dengue virus
EAHFTDPSS

SEQ ID NO: 109697 - protein, 9 aa, Dengue virus
AHFTDPSSI

SEQ ID NO: 109698 - protein, 9 aa, Dengue virus
HFTDPSSIA

SEQ ID NO: 109699 - protein, 9 aa, Dengue virus
FTDPSSIAA

SEQ ID NO: 109700 - protein, 9 aa, Dengue virus
TDPSSIAAR

SEQ ID NO: 109701 - protein, 9 aa, Dengue virus
DPSSIAARG

SEQ ID NO: 109702 - protein, 9 aa, Dengue virus
PSSIAARGY

SEQ ID NO: 109703 - protein, 9 aa, Dengue virus
SSIAARGYI

SEQ ID NO: 109704 - protein, 9 aa, Dengue virus
SVAARGYIS

SEQ ID NO: 109705 - protein, 9 aa, Dengue virus
VAARGYIST

SEQ ID NO: 109706 - protein, 9 aa, Dengue virus
RGYISTRVE

SEQ ID NO: 109707 - protein, 9 aa, Dengue virus
GYISTRVEM

SEQ ID NO: 109708 - protein, 9 aa, Dengue virus
YISTRVEMG

SEQ ID NO: 109709 - protein, 9 aa, Dengue virus
ISTRVEMGE

SEQ ID NO: 109710 - protein, 9 aa, Dengue virus
STRVEMGEA

SEQ ID NO: 109711 - protein, 9 aa, Dengue virus
TRVEMGEAA

SEQ ID NO: 109712 - protein, 9 aa, Dengue virus
RVEMGEAAG

SEQ ID NO: 109713 - protein, 9 aa, Dengue virus
VEMGEAAGI

SEQ ID NO: 109714 - protein, 9 aa, Dengue virus
EMGEAAGIF

SEQ ID NO: 109715 - protein, 9 aa, Dengue virus
MGEAAGIFM

SEQ ID NO: 109716 - protein, 9 aa, Dengue virus
GEAAGIFMT

SEQ ID NO: 109717 - protein, 9 aa, Dengue virus
EAAGIFMTA

SEQ ID NO: 109718 - protein, 9 aa, Dengue virus
AAGIFMTAT

SEQ ID NO: 109719 - protein, 9 aa, Dengue virus
AGIFMTATP

SEQ ID NO: 109720 - protein, 9 aa, Dengue virus
GIFMTATPP

SEQ ID NO: 109721 - protein, 9 aa, Dengue virus
FMTATPPGT

SEQ ID NO: 109722 - protein, 9 aa, Dengue virus
DPFPQSNAP

SEQ ID NO: 109723 - protein, 9 aa, Dengue virus
PFPQSNAPI

SEQ ID NO: 109724 - protein, 9 aa, Dengue virus
IMDEEREIP

SEQ ID NO: 109725 - protein, 9 aa, Dengue virus
MDEEREIPE

SEQ ID NO: 109726 - protein, 9 aa, Dengue virus
DEEREIPER

SEQ ID NO: 109727 - protein, 9 aa, Dengue virus
EEREIPERS

SEQ ID NO: 109728 - protein, 9 aa, Dengue virus
EREIPERSW

SEQ ID NO: 109729 - protein, 9 aa, Dengue virus
REIPERSWN

SEQ ID NO: 109730 - protein, 9 aa, Dengue virus
EIPERSWNS

SEQ ID NO: 109731 - protein, 9 aa, Dengue virus
IPERSWNTG

SEQ ID NO: 109732 - protein, 9 aa, Dengue virus
PERSWNSGH

SEQ ID NO: 109733 - protein, 9 aa, Dengue virus
FKGKTVWFV

SEQ ID NO: 109734 - protein, 9 aa, Dengue virus
KGKTVWFVP

SEQ ID NO: 109735 - protein, 9 aa, Dengue virus
VWFVPSIKS

SEQ ID NO: 109736 - protein, 9 aa, Dengue virus
WFVPSIKSG

SEQ ID NO: 109737 - protein, 9 aa, Dengue virus
FVPSIKSGN

SEQ ID NO: 109738 - protein, 9 aa, Dengue virus
VPSIKSGND

SEQ ID NO: 109739 - protein, 9 aa, Dengue virus
PSIKSGNDI

SEQ ID NO: 109740 - protein, 9 aa, Dengue virus
SIKSGNDIA

SEQ ID NO: 109741 - protein, 9 aa, Dengue virus
IKAGNDIAA

SEQ ID NO: 109742 - protein, 9 aa, Dengue virus
KAGNDIAAC

SEQ ID NO: 109743 - protein, 9 aa, Dengue virus
AGNDIAACL

SEQ ID NO: 109744 - protein, 9 aa, Dengue virus
GNDIAACLR

SEQ ID NO: 109745 - protein, 9 aa, Dengue virus
NDIAACLRK

SEQ ID NO: 109746 - protein, 9 aa, Dengue virus
DIAACLRKN

SEQ ID NO: 109747 - protein, 9 aa, Dengue virus
IAACLRKNG

SEQ ID NO: 109748 - protein, 9 aa, Dengue virus
AACLRKNGK

SEQ ID NO: 109749 - protein, 9 aa, Dengue virus
ACLRKNGKK

SEQ ID NO: 109750 - protein, 9 aa, Dengue virus
CLRKNGKRV

SEQ ID NO: 109751 - protein, 9 aa, Dengue virus
LRKNGKRVI

SEQ ID NO: 109752 - protein, 9 aa, Dengue virus
RKNGKRVIQ

SEQ ID NO: 109753 - protein, 9 aa, Dengue virus
KNGKRVIQL

SEQ ID NO: 109754 - protein, 9 aa, Dengue virus
NGKRVIQLS

SEQ ID NO: 109755 - protein, 9 aa, Dengue virus
GKRVIQLSR

SEQ ID NO: 109756 - protein, 9 aa, Dengue virus
KRVIQLSRK

SEQ ID NO: 109757 - protein, 9 aa, Dengue virus
RVIQLSRKT

SEQ ID NO: 109758 - protein, 9 aa, Dengue virus
VQLSRKTFD

SEQ ID NO: 109759 - protein, 9 aa, Dengue virus
QLSRKTFDS

SEQ ID NO: 109760 - protein, 9 aa, Dengue virus
LSRKTFDSE

SEQ ID NO: 109761 - protein, 9 aa, Dengue virus
SRKTFDSEY

SEQ ID NO: 109762 - protein, 9 aa, Dengue virus
RKTFDSEYV

SEQ ID NO: 109763 - protein, 9 aa, Dengue virus
KTFDSEYVK

SEQ ID NO: 109764 - protein, 9 aa, Dengue virus
TFDSEYVKT

SEQ ID NO: 109765 - protein, 9 aa, Dengue virus
LNDWDFVVT

SEQ ID NO: 109766 - protein, 9 aa, Dengue virus
NDWDYVVTT

SEQ ID NO: 109767 - protein, 9 aa, Dengue virus
DWDYVVTTD

SEQ ID NO: 109768 - protein, 9 aa, Dengue virus
WDYVVTTDI

SEQ ID NO: 109769 - protein, 9 aa, Dengue virus
DYVVTTDIS

SEQ ID NO: 109770 - protein, 9 aa, Dengue virus
YVVTTDISE

SEQ ID NO: 109771 - protein, 9 aa, Dengue virus
ISEMGANFK

SEQ ID NO: 109772 - protein, 9 aa, Dengue virus
SEMGANFKA

SEQ ID NO: 109773 - protein, 9 aa, Dengue virus
EMGANFKAE

SEQ ID NO: 109774 - protein, 9 aa, Dengue virus
MGANFKAER

SEQ ID NO: 109775 - protein, 9 aa, Dengue virus
GANFKAERV

SEQ ID NO: 109776 - protein, 9 aa, Dengue virus
ANFKAERVI

SEQ ID NO: 109777 - protein, 9 aa, Dengue virus
NFKAERVID

SEQ ID NO: 109778 - protein, 9 aa, Dengue virus
FKAERVIDP

SEQ ID NO: 109779 - protein, 9 aa, Dengue virus
KAERVIDPR

SEQ ID NO: 109780 - protein, 9 aa, Dengue virus
AERVIDPRR

SEQ ID NO: 109781 - protein, 9 aa, Dengue virus
ERVIDPRRC

SEQ ID NO: 109782 - protein, 9 aa, Dengue virus
RVIDPRRCM

SEQ ID NO: 109783 - protein, 9 aa, Dengue virus
VIDPRRCMK

SEQ ID NO: 109784 - protein, 9 aa, Dengue virus
IDPRRCMKP

SEQ ID NO: 109785 - protein, 9 aa, Dengue virus
DPRRCMKPV

SEQ ID NO: 109786 - protein, 9 aa, Dengue virus
PRRCMKPVI

SEQ ID NO: 109787 - protein, 9 aa, Dengue virus
RRCMKPVIL

SEQ ID NO: 109788 - protein, 9 aa, Dengue virus
RCMKPVILT

SEQ ID NO: 109789 - protein, 9 aa, Dengue virus
CMKPVILTD

SEQ ID NO: 109790 - protein, 9 aa, Dengue virus
MKPVILTDG

SEQ ID NO: 109791 - protein, 9 aa, Dengue virus
KPVILTDGE

SEQ ID NO: 109792 - protein, 9 aa, Dengue virus
PVILTDGEE

SEQ ID NO: 109793 - protein, 9 aa, Dengue virus
VILTDGEER

SEQ ID NO: 109794 - protein, 9 aa, Dengue virus
ILTDGEERV

SEQ ID NO: 109795 - protein, 9 aa, Dengue virus
LTDGEERVI

SEQ ID NO: 109796 - protein, 9 aa, Dengue virus
TDGEERVIL

SEQ ID NO: 109797 - protein, 9 aa, Dengue virus
DGEERVILA

SEQ ID NO: 109798 - protein, 9 aa, Dengue virus
GEERVILAG

SEQ ID NO: 109799 - protein, 9 aa, Dengue virus
EERVILAGP

SEQ ID NO: 109800 - protein, 9 aa, Dengue virus
ERVILAGPI

SEQ ID NO: 109801 - protein, 9 aa, Dengue virus
RVILAGPIP

SEQ ID NO: 109802 - protein, 9 aa, Dengue virus
VILAGPIPV

SEQ ID NO: 109803 - protein, 9 aa, Dengue virus
ILAGPIPVT

SEQ ID NO: 109804 - protein, 9 aa, Dengue virus
LAGPMPVTH

SEQ ID NO: 109805 - protein, 9 aa, Dengue virus
AGPMPVTHS

SEQ ID NO: 109806 - protein, 9 aa, Dengue virus
GPMPVTHSS

SEQ ID NO: 109807 - protein, 9 aa, Dengue virus
PMPVTHSSA

SEQ ID NO: 109808 - protein, 9 aa, Dengue virus
MPVTHSSAA

SEQ ID NO: 109809 - protein, 9 aa, Dengue virus
PVTHSSAAQ

SEQ ID NO: 109810 - protein, 9 aa, Dengue virus
VTHSSAAQR

SEQ ID NO: 109811 - protein, 9 aa, Dengue virus
THSSAAQRR

SEQ ID NO: 109812 - protein, 9 aa, Dengue virus
HSSAAQRRG

SEQ ID NO: 109813 - protein, 9 aa, Dengue virus
SSAAQRRGR

SEQ ID NO: 109814 - protein, 9 aa, Dengue virus
SAAQRRGRV

SEQ ID NO: 109815 - protein, 9 aa, Dengue virus
AAQRRGRVG

SEQ ID NO: 109816 - protein, 9 aa, Dengue virus
AQRRGRVGR

SEQ ID NO: 109817 - protein, 9 aa, Dengue virus
QRRGRVGRN

SEQ ID NO: 109818 - protein, 9 aa, Dengue virus
RRGRIGRNH

SEQ ID NO: 109819 - protein, 9 aa, Dengue virus
NENDQYIYM

SEQ ID NO: 109820 - protein, 9 aa, Dengue virus
ENDQYIYMG

SEQ ID NO: 109821 - protein, 9 aa, Dengue virus
NDQYIYMGE

SEQ ID NO: 109822 - protein, 9 aa, Dengue virus
DQYIYMGEP

SEQ ID NO: 109823 - protein, 9 aa, Dengue virus
QYIYMGEPL

SEQ ID NO: 109824 - protein, 9 aa, Dengue virus
YMGEPLEND

SEQ ID NO: 109825 - protein, 9 aa, Dengue virus
MGEPLENDE

SEQ ID NO: 109826 - protein, 9 aa, Dengue virus
GEPLENDED

SEQ ID NO: 109827 - protein, 9 aa, Dengue virus
EPLENDEDC

SEQ ID NO: 109828 - protein, 9 aa, Dengue virus
PLENDEDCA

SEQ ID NO: 109829 - protein, 9 aa, Dengue virus
LENDEDCAH

SEQ ID NO: 109830 - protein, 9 aa, Dengue virus
ENDEDCAHW

SEQ ID NO: 109831 - protein, 9 aa, Dengue virus
NDEDCAHWK

SEQ ID NO: 109832 - protein, 9 aa, Dengue virus
DEDCAHWKE

SEQ ID NO: 109833 - protein, 9 aa, Dengue virus
EDCAHWKEA

SEQ ID NO: 109834 - protein, 9 aa, Dengue virus
DCAHWKEAK

SEQ ID NO: 109835 - protein, 9 aa, Dengue virus
CAHWKEAKM

SEQ ID NO: 109836 - protein, 9 aa, Dengue virus
AHWKEAKML

SEQ ID NO: 109837 - protein, 9 aa, Dengue virus
HWKEAKMLL

SEQ ID NO: 109838 - protein, 9 aa, Dengue virus
WKEAKMLLD

SEQ ID NO: 109839 - protein, 9 aa, Dengue virus
KEAKMLLDN

SEQ ID NO: 109840 - protein, 9 aa, Dengue virus
AKMLLDNIY

SEQ ID NO: 109841 - protein, 9 aa, Dengue virus
KMLLDNIYT

SEQ ID NO: 109842 - protein, 9 aa, Dengue virus
MLLDNIYTP

SEQ ID NO: 109843 - protein, 9 aa, Dengue virus
LLDNIYTPE

SEQ ID NO: 109844 - protein, 9 aa, Dengue virus
LDNIYTPEG

SEQ ID NO: 109845 - protein, 9 aa, Dengue virus
DNIYTPEGI

SEQ ID NO: 109846 - protein, 9 aa, Dengue virus
NIYTPEGII

SEQ ID NO: 109847 - protein, 9 aa, Dengue virus
IYTPEGIIP

SEQ ID NO: 109848 - protein, 9 aa, Dengue virus
NTPEGIIPS

SEQ ID NO: 109849 - protein, 9 aa, Dengue virus
TPEGIIPSM

SEQ ID NO: 109850 - protein, 9 aa, Dengue virus
PEGIIPSMF

SEQ ID NO: 109851 - protein, 9 aa, Dengue virus
EGIIPSMFE

SEQ ID NO: 109852 - protein, 9 aa, Dengue virus
GIIPSMFEP

SEQ ID NO: 109853 - protein, 9 aa, Dengue virus
IIPSMFEPE

SEQ ID NO: 109854 - protein, 9 aa, Dengue virus
IPSMFEPER

SEQ ID NO: 109855 - protein, 9 aa, Dengue virus
PSMFEPERE

SEQ ID NO: 109856 - protein, 9 aa, Dengue virus
SMFEPEREK

SEQ ID NO: 109857 - protein, 9 aa, Dengue virus
MFEPEREKV

SEQ ID NO: 109858 - protein, 9 aa, Dengue virus
FEPEREKVD

SEQ ID NO: 109859 - protein, 9 aa, Dengue virus
EPEREKVDA

SEQ ID NO: 109860 - protein, 9 aa, Dengue virus
PEREKVDAI

SEQ ID NO: 109861 - protein, 9 aa, Dengue virus
EREKVDAID

SEQ ID NO: 109862 - protein, 9 aa, Dengue virus
REKVDAIDG

SEQ ID NO: 109863 - protein, 9 aa, Dengue virus
EKVDAIDGE

SEQ ID NO: 109864 - protein, 9 aa, Dengue virus
KVDAIDGEY

SEQ ID NO: 109865 - protein, 9 aa, Dengue virus
VDAIDGEYR

SEQ ID NO: 109866 - protein, 9 aa, Dengue virus
DAIDGEYRL

SEQ ID NO: 109867 - protein, 9 aa, Dengue virus
AIDGEYRLK

SEQ ID NO: 109868 - protein, 9 aa, Dengue virus
IDGEYRLKG

SEQ ID NO: 109869 - protein, 9 aa, Dengue virus
DGEYRLKGE

SEQ ID NO: 109870 - protein, 9 aa, Dengue virus
GEYRLKGES

SEQ ID NO: 109871 - protein, 9 aa, Dengue virus
EYRLKGESR

SEQ ID NO: 109872 - protein, 9 aa, Dengue virus
YRLKGESRK

SEQ ID NO: 109873 - protein, 9 aa, Dengue virus
RLKGESRKT

SEQ ID NO: 109874 - protein, 9 aa, Dengue virus
LKGESRKTF

SEQ ID NO: 109875 - protein, 9 aa, Dengue virus
KGESRKTFV

SEQ ID NO: 109876 - protein, 9 aa, Dengue virus
GEARKTFVD

SEQ ID NO: 109877 - protein, 9 aa, Dengue virus
EARKTFVDL

SEQ ID NO: 109878 - protein, 9 aa, Dengue virus
ARKTFVDLM

SEQ ID NO: 109879 - protein, 9 aa, Dengue virus
RKTFVDLMR

SEQ ID NO: 109880 - protein, 9 aa, Dengue virus
KTFVDLMRR

SEQ ID NO: 109881 - protein, 9 aa, Dengue virus
TFVDLMRRG

SEQ ID NO: 109882 - protein, 9 aa, Dengue virus
FVDLMRRGD

SEQ ID NO: 109883 - protein, 9 aa, Dengue virus
VDLMRRGDL

SEQ ID NO: 109884 - protein, 9 aa, Dengue virus
DLMRRGDLP

SEQ ID NO: 109885 - protein, 9 aa, Dengue virus
RGDLPVWLS

SEQ ID NO: 109886 - protein, 9 aa, Dengue virus
GDLPVWLAY

SEQ ID NO: 109887 - protein, 9 aa, Dengue virus
DLPVWLAYK

SEQ ID NO: 109888 - protein, 9 aa, Dengue virus
LPVWLAYKV

SEQ ID NO: 109889 - protein, 9 aa, Dengue virus
PVWLAYKVA

SEQ ID NO: 109890 - protein, 9 aa, Dengue virus
VWLAHKVAS

SEQ ID NO: 109891 - protein, 9 aa, Dengue virus
YTDRKWCFD

SEQ ID NO: 109892 - protein, 9 aa, Dengue virus
ADRRWCFDG

SEQ ID NO: 109893 - protein, 9 aa, Dengue virus
KNNQILEEN

SEQ ID NO: 109894 - protein, 9 aa, Dengue virus
NNQILEENM

SEQ ID NO: 109895 - protein, 9 aa, Dengue virus
NQILEENVE

SEQ ID NO: 109896 - protein, 9 aa, Dengue virus
QILEENVEV

SEQ ID NO: 109897 - protein, 9 aa, Dengue virus
ILEENVEVE

SEQ ID NO: 109898 - protein, 9 aa, Dengue virus
LEENVEVEI

SEQ ID NO: 109899 - protein, 9 aa, Dengue virus
EENVEVEIW

SEQ ID NO: 109900 - protein, 9 aa, Dengue virus
ENVEVEIWT

SEQ ID NO: 109901 - protein, 9 aa, Dengue virus
NVEVEIWTK

SEQ ID NO: 109902 - protein, 9 aa, Dengue virus
VEVEIWTKE

SEQ ID NO: 109903 - protein, 9 aa, Dengue virus
EVEIWTKEG

SEQ ID NO: 109904 - protein, 9 aa, Dengue virus
ERKKLKPRW

SEQ ID NO: 109905 - protein, 9 aa, Dengue virus
RKKLKPRWL

SEQ ID NO: 109906 - protein, 9 aa, Dengue virus
KKLKPRWLD

SEQ ID NO: 109907 - protein, 9 aa, Dengue virus
KLKPRWLDA

SEQ ID NO: 109908 - protein, 9 aa, Dengue virus
LKPRWLDAR

SEQ ID NO: 109909 - protein, 9 aa, Dengue virus
KPRWLDARI

SEQ ID NO: 109910 - protein, 9 aa, Dengue virus
PRWLDARIY

SEQ ID NO: 109911 - protein, 9 aa, Dengue virus
RWLDARIYS

SEQ ID NO: 109912 - protein, 9 aa, Dengue virus
WLDARIYSD

SEQ ID NO: 109913 - protein, 9 aa, Dengue virus
LDARIYSDP

SEQ ID NO: 109914 - protein, 9 aa, Dengue virus
DARIYSDPL

SEQ ID NO: 109915 - protein, 9 aa, Dengue virus
ARIYSDPLA

SEQ ID NO: 109916 - protein, 9 aa, Dengue virus
RIYSDPLAL

SEQ ID NO: 109917 - protein, 9 aa, Dengue virus
IYSDPLALK

SEQ ID NO: 109918 - protein, 9 aa, Dengue virus
YSDPLALRE

SEQ ID NO: 109919 - protein, 9 aa, Dengue virus
SDPLALREF

SEQ ID NO: 109920 - protein, 9 aa, Dengue virus
DPLALREFK

SEQ ID NO: 109921 - protein, 9 aa, Dengue virus
PLALKEFKE

SEQ ID NO: 109922 - protein, 9 aa, Dengue virus
LALKEFKEF

SEQ ID NO: 109923 - protein, 9 aa, Dengue virus
ALKEFKEFA

SEQ ID NO: 109924 - protein, 9 aa, Dengue virus
LKEFKEFAA

SEQ ID NO: 109925 - protein, 9 aa, Dengue virus
KEFKEFAAG

SEQ ID NO: 109926 - protein, 9 aa, Dengue virus
EFKDFAAGR

SEQ ID NO: 109927 - protein, 9 aa, Dengue virus
FKEFAAGRK

SEQ ID NO: 109928 - protein, 9 aa, Dengue virus
KEFAAGRKS

SEQ ID NO: 109929 - protein, 9 aa, Dengue virus
EFAAGRKSL

SEQ ID NO: 109930 - protein, 9 aa, Dengue virus
FAAGRKSLT

SEQ ID NO: 109931 - protein, 9 aa, Dengue virus
AAGRKSLTL

SEQ ID NO: 109932 - protein, 9 aa, Dengue virus
NLITEMGRL

SEQ ID NO: 109933 - protein, 9 aa, Dengue virus
LITEMGRLP

SEQ ID NO: 109934 - protein, 9 aa, Dengue virus
ITEMGRLPT

SEQ ID NO: 109935 - protein, 9 aa, Dengue virus
TEMGRLPTF

SEQ ID NO: 109936 - protein, 9 aa, Dengue virus
EMGRLPTFM

SEQ ID NO: 109937 - protein, 9 aa, Dengue virus
MGRLPTFMT

SEQ ID NO: 109938 - protein, 9 aa, Dengue virus
RNALDNLVM

SEQ ID NO: 109939 - protein, 9 aa, Dengue virus
DALDNLAVL

SEQ ID NO: 109940 - protein, 9 aa, Dengue virus
ALDNLAVLH

SEQ ID NO: 109941 - protein, 9 aa, Dengue virus
LDNLAVLHT

SEQ ID NO: 109942 - protein, 9 aa, Dengue virus
DNLAVLHTA

SEQ ID NO: 109943 - protein, 9 aa, Dengue virus
NLAVLHTAE

SEQ ID NO: 109944 - protein, 9 aa, Dengue virus
AYNHALSEL

SEQ ID NO: 109945 - protein, 9 aa, Dengue virus
YNHALSELP

SEQ ID NO: 109946 - protein, 9 aa, Dengue virus
NHALSELPE

SEQ ID NO: 109947 - protein, 9 aa, Dengue virus
HALSELPET

SEQ ID NO: 109948 - protein, 9 aa, Dengue virus
ALSELPETL

SEQ ID NO: 109949 - protein, 9 aa, Dengue virus
LSELPETLE

SEQ ID NO: 109950 - protein, 9 aa, Dengue virus
SELPETLET

SEQ ID NO: 109951 - protein, 9 aa, Dengue virus
ELPETLETL

SEQ ID NO: 109952 - protein, 9 aa, Dengue virus
LPETLETLL

SEQ ID NO: 109953 - protein, 9 aa, Dengue virus
PETLETLLL

SEQ ID NO: 109954 - protein, 9 aa, Dengue virus
ETLETLLLL

SEQ ID NO: 109955 - protein, 9 aa, Dengue virus
TLETLLLLT

SEQ ID NO: 109956 - protein, 9 aa, Dengue virus
LETLLLLTL

SEQ ID NO: 109957 - protein, 9 aa, Dengue virus
ETLLLLTLL

SEQ ID NO: 109958 - protein, 9 aa, Dengue virus
TLLLLTLLA

SEQ ID NO: 109959 - protein, 9 aa, Dengue virus
VTGGIFLFL

SEQ ID NO: 109960 - protein, 9 aa, Dengue virus
GKMTLGMCC

SEQ ID NO: 109961 - protein, 9 aa, Dengue virus
KMTLGMCCI

SEQ ID NO: 109962 - protein, 9 aa, Dengue virus
IQPHWIAAS

SEQ ID NO: 109963 - protein, 9 aa, Dengue virus
QPHWIAASI

SEQ ID NO: 109964 - protein, 9 aa, Dengue virus
LQWIASAIV

SEQ ID NO: 109965 - protein, 9 aa, Dengue virus
QWIASAIVL

SEQ ID NO: 109966 - protein, 9 aa, Dengue virus
WIASAIVLE

SEQ ID NO: 109967 - protein, 9 aa, Dengue virus
IASAIVLEF

SEQ ID NO: 109968 - protein, 9 aa, Dengue virus
ASAIVLEFF

SEQ ID NO: 109969 - protein, 9 aa, Dengue virus
SAIVLEFFM

SEQ ID NO: 109970 - protein, 9 aa, Dengue virus
SIILEFFLI

SEQ ID NO: 109971 - protein, 9 aa, Dengue virus
IILEFFLIV

SEQ ID NO: 109972 - protein, 9 aa, Dengue virus
ILEFFLIVL

SEQ ID NO: 109973 - protein, 9 aa, Dengue virus
LEFFLIVLL

SEQ ID NO: 109974 - protein, 9 aa, Dengue virus
EFFLIVLLI

SEQ ID NO: 109975 - protein, 9 aa, Dengue virus
FFLIVLLIP

SEQ ID NO: 109976 - protein, 9 aa, Dengue virus
FLIVLLIPE

SEQ ID NO: 109977 - protein, 9 aa, Dengue virus
LIVLLIPEP

SEQ ID NO: 109978 - protein, 9 aa, Dengue virus
IVLLIPEPE

SEQ ID NO: 109979 - protein, 9 aa, Dengue virus
VLLIPEPDR

SEQ ID NO: 109980 - protein, 9 aa, Dengue virus
LLIPEPDRQ

SEQ ID NO: 109981 - protein, 9 aa, Dengue virus
LIPEPDRQR

SEQ ID NO: 109982 - protein, 9 aa, Dengue virus
IPEPDRQRT

SEQ ID NO: 109983 - protein, 9 aa, Dengue virus
PEPDRQRTP

SEQ ID NO: 109984 - protein, 9 aa, Dengue virus
EPDRQRTPQ

SEQ ID NO: 109985 - protein, 9 aa, Dengue virus
PDRQRTPQD

SEQ ID NO: 109986 - protein, 9 aa, Dengue virus
DRQRTPQDN

SEQ ID NO: 109987 - protein, 9 aa, Dengue virus
RQRTPQDNQ

SEQ ID NO: 109988 - protein, 9 aa, Dengue virus
RTPQDNQLT

SEQ ID NO: 109989 - protein, 9 aa, Dengue virus
TPQDNQLTY

SEQ ID NO: 109990 - protein, 9 aa, Dengue virus
PQDNQLTYV

SEQ ID NO: 109991 - protein, 9 aa, Dengue virus
QDNQLTYVV

SEQ ID NO: 109992 - protein, 9 aa, Dengue virus
DNQLTYVVI

SEQ ID NO: 109993 - protein, 9 aa, Dengue virus
NQLTYVVIA

SEQ ID NO: 109994 - protein, 9 aa, Dengue virus
QLTYVVIAI

SEQ ID NO: 109995 - protein, 9 aa, Dengue virus
LTYVVIAIL

SEQ ID NO: 109996 - protein, 9 aa, Dengue virus
TYVVIAILT

SEQ ID NO: 109997 - protein, 9 aa, Dengue virus
TMANEMGFL

SEQ ID NO: 109998 - protein, 9 aa, Dengue virus
MANEMGFLE

SEQ ID NO: 109999 - protein, 9 aa, Dengue virus
ANEMGFLEK

SEQ ID NO: 110000 - protein, 9 aa, Dengue virus
NEMGFLEKT

SEQ ID NO: 110001 - protein, 9 aa, Dengue virus
EMGFLEKTK

SEQ ID NO: 110002 - protein, 9 aa, Dengue virus
MGFLEKTKK

SEQ ID NO: 110003 - protein, 9 aa, Dengue virus
GFLEKTKKD

SEQ ID NO: 110004 - protein, 9 aa, Dengue virus
FLEKTKKDL

SEQ ID NO: 110005 - protein, 9 aa, Dengue virus
LEKTKKDLG

SEQ ID NO: 110006 - protein, 9 aa, Dengue virus
LDIDLRPAS

SEQ ID NO: 110007 - protein, 9 aa, Dengue virus
DIDLRPASA

SEQ ID NO: 110008 - protein, 9 aa, Dengue virus
IDLRPASAW

SEQ ID NO: 110009 - protein, 9 aa, Dengue virus
DLRPASAWT

SEQ ID NO: 110010 - protein, 9 aa, Dengue virus
LRPASAWTL

SEQ ID NO: 110011 - protein, 9 aa, Dengue virus
RPASAWTLY

SEQ ID NO: 110012 - protein, 9 aa, Dengue virus
TLYAVATTF

SEQ ID NO: 110013 - protein, 9 aa, Dengue virus
LYAVATTVI

SEQ ID NO: 110014 - protein, 9 aa, Dengue virus
YAVATTVIT

SEQ ID NO: 110015 - protein, 9 aa, Dengue virus
AVATTVITP

SEQ ID NO: 110016 - protein, 9 aa, Dengue virus
VATTVITPM

SEQ ID NO: 110017 - protein, 9 aa, Dengue virus
VTPMLRHSI

SEQ ID NO: 110018 - protein, 9 aa, Dengue virus
TPMLRHSIE

SEQ ID NO: 110019 - protein, 9 aa, Dengue virus
PMLRHSIEN

SEQ ID NO: 110020 - protein, 9 aa, Dengue virus
MLRHSIENS

SEQ ID NO: 110021 - protein, 9 aa, Dengue virus
LRHSIENSS

SEQ ID NO: 110022 - protein, 9 aa, Dengue virus
RHSIENSSV

SEQ ID NO: 110023 - protein, 9 aa, Dengue virus
HSIENSSVN

SEQ ID NO: 110024 - protein, 9 aa, Dengue virus
SIENSSVNV

SEQ ID NO: 110025 - protein, 9 aa, Dengue virus
IENSSVNVS

SEQ ID NO: 110026 - protein, 9 aa, Dengue virus
ENSSVNVSL

SEQ ID NO: 110027 - protein, 9 aa, Dengue virus
NSSVNVSLT

SEQ ID NO: 110028 - protein, 9 aa, Dengue virus
SSVNVSLTA

SEQ ID NO: 110029 - protein, 9 aa, Dengue virus
SVNVSLTAI

SEQ ID NO: 110030 - protein, 9 aa, Dengue virus
VNVSLTAIA

SEQ ID NO: 110031 - protein, 9 aa, Dengue virus
NVSLTAIAN

SEQ ID NO: 110032 - protein, 9 aa, Dengue virus
VSLTAIANQ

SEQ ID NO: 110033 - protein, 9 aa, Dengue virus
SLAAIANQA

SEQ ID NO: 110034 - protein, 9 aa, Dengue virus
LTAIANQAT

SEQ ID NO: 110035 - protein, 9 aa, Dengue virus
TAIANQATV

SEQ ID NO: 110036 - protein, 9 aa, Dengue virus
AIANQATVL

SEQ ID NO: 110037 - protein, 9 aa, Dengue virus
IANQATVLM

SEQ ID NO: 110038 - protein, 9 aa, Dengue virus
ANQATVLMG

SEQ ID NO: 110039 - protein, 9 aa, Dengue virus
NQATVLMGL

SEQ ID NO: 110040 - protein, 9 aa, Dengue virus
QATVLMGLG

SEQ ID NO: 110041 - protein, 9 aa, Dengue virus
ATVLMGLGK

SEQ ID NO: 110042 - protein, 9 aa, Dengue virus
TVLMGLGKG

SEQ ID NO: 110043 - protein, 9 aa, Dengue virus
VLMGLGKGW

SEQ ID NO: 110044 - protein, 9 aa, Dengue virus
LMGLGKGWP

SEQ ID NO: 110045 - protein, 9 aa, Dengue virus
MGLGKGWPL

SEQ ID NO: 110046 - protein, 9 aa, Dengue virus
GLGKGWPLS

SEQ ID NO: 110047 - protein, 9 aa, Dengue virus
LGKGWPLSK

SEQ ID NO: 110048 - protein, 9 aa, Dengue virus
GKGWPLSKM

SEQ ID NO: 110049 - protein, 9 aa, Dengue virus
KGWPLSKMD

SEQ ID NO: 110050 - protein, 9 aa, Dengue virus
GWPLSKMDI

SEQ ID NO: 110051 - protein, 9 aa, Dengue virus
WPLSKMDIG

SEQ ID NO: 110052 - protein, 9 aa, Dengue virus
PLSKMDIGV

SEQ ID NO: 110053 - protein, 9 aa, Dengue virus
LSKMDIGVP

SEQ ID NO: 110054 - protein, 9 aa, Dengue virus
SKMDLGVPL

SEQ ID NO: 110055 - protein, 9 aa, Dengue virus
KMDLGVPLL

SEQ ID NO: 110056 - protein, 9 aa, Dengue virus
MDLGVPLLA

SEQ ID NO: 110057 - protein, 9 aa, Dengue virus
DIGVPLLAI

SEQ ID NO: 110058 - protein, 9 aa, Dengue virus
IGVPLLAIG

SEQ ID NO: 110059 - protein, 9 aa, Dengue virus
GVPLLAIGC

SEQ ID NO: 110060 - protein, 9 aa, Dengue virus
VPLLAIGCY

SEQ ID NO: 110061 - protein, 9 aa, Dengue virus
PLLAIGCYS

SEQ ID NO: 110062 - protein, 9 aa, Dengue virus
LLAIGCYSQ

SEQ ID NO: 110063 - protein, 9 aa, Dengue virus
LAIGCYSQV

SEQ ID NO: 110064 - protein, 9 aa, Dengue virus
AIGCYSQVN

SEQ ID NO: 110065 - protein, 9 aa, Dengue virus
IGCYSQVNP

SEQ ID NO: 110066 - protein, 9 aa, Dengue virus
GCYSQVNPI

SEQ ID NO: 110067 - protein, 9 aa, Dengue virus
CYSQVNPIT

SEQ ID NO: 110068 - protein, 9 aa, Dengue virus
YSQVNPITL

SEQ ID NO: 110069 - protein, 9 aa, Dengue virus
SQVNPITLT

SEQ ID NO: 110070 - protein, 9 aa, Dengue virus
QVNPITLTA

SEQ ID NO: 110071 - protein, 9 aa, Dengue virus
VNPITLTAA

SEQ ID NO: 110072 - protein, 9 aa, Dengue virus
NPITLTAAL

SEQ ID NO: 110073 - protein, 9 aa, Dengue virus
LITHYAIIG

SEQ ID NO: 110074 - protein, 9 aa, Dengue virus
ITHYAIIGP

SEQ ID NO: 110075 - protein, 9 aa, Dengue virus
THYAIIGPG

SEQ ID NO: 110076 - protein, 9 aa, Dengue virus
ATREAQKRA

SEQ ID NO: 110077 - protein, 9 aa, Dengue virus
TREAQKRAA

SEQ ID NO: 110078 - protein, 9 aa, Dengue virus
REAQKRAAA

SEQ ID NO: 110079 - protein, 9 aa, Dengue virus
EAQKRAAAG

SEQ ID NO: 110080 - protein, 9 aa, Dengue virus
AQKRAAAGI

SEQ ID NO: 110081 - protein, 9 aa, Dengue virus
QKRAAAGIM

SEQ ID NO: 110082 - protein, 9 aa, Dengue virus
KRAAAGIMK

SEQ ID NO: 110083 - protein, 9 aa, Dengue virus
RAAAGIMKN

SEQ ID NO: 110084 - protein, 9 aa, Dengue virus
AAAGIMKNP

SEQ ID NO: 110085 - protein, 9 aa, Dengue virus
AGIMKNPTI

SEQ ID NO: 110086 - protein, 9 aa, Dengue virus
GIMKNPTID

SEQ ID NO: 110087 - protein, 9 aa, Dengue virus
IMKNPTIDG

SEQ ID NO: 110088 - protein, 9 aa, Dengue virus
MKNPTIDGI

SEQ ID NO: 110089 - protein, 9 aa, Dengue virus
KNPTVDGIT

SEQ ID NO: 110090 - protein, 9 aa, Dengue virus
NPTVDGITV

SEQ ID NO: 110091 - protein, 9 aa, Dengue virus
PTVDGITVI

SEQ ID NO: 110092 - protein, 9 aa, Dengue virus
TIDLDPVIY

SEQ ID NO: 110093 - protein, 9 aa, Dengue virus
IDLDPVIYD

SEQ ID NO: 110094 - protein, 9 aa, Dengue virus
PIPYDPKFE

SEQ ID NO: 110095 - protein, 9 aa, Dengue virus
IPYDPKFEK

SEQ ID NO: 110096 - protein, 9 aa, Dengue virus
PYDPKFEKQ

SEQ ID NO: 110097 - protein, 9 aa, Dengue virus
YDPKFEKQL

SEQ ID NO: 110098 - protein, 9 aa, Dengue virus
DPKFEKQLG

SEQ ID NO: 110099 - protein, 9 aa, Dengue virus
PKFEKQLGQ

SEQ ID NO: 110100 - protein, 9 aa, Dengue virus
KFEKQLGQI

SEQ ID NO: 110101 - protein, 9 aa, Dengue virus
FEKQLGQIM

SEQ ID NO: 110102 - protein, 9 aa, Dengue virus
EKQLGQIML

SEQ ID NO: 110103 - protein, 9 aa, Dengue virus
KQLGQIMLL

SEQ ID NO: 110104 - protein, 9 aa, Dengue virus
QLGQVMLLV

SEQ ID NO: 110105 - protein, 9 aa, Dengue virus
LGQVMLLVL

SEQ ID NO: 110106 - protein, 9 aa, Dengue virus
GQVMLLVLC

SEQ ID NO: 110107 - protein, 9 aa, Dengue virus
QVMLLVLCA

SEQ ID NO: 110108 - protein, 9 aa, Dengue virus
LCVTQVLMM

SEQ ID NO: 110109 - protein, 9 aa, Dengue virus
CVTQVLMMR

SEQ ID NO: 110110 - protein, 9 aa, Dengue virus
VTQVLMMRT

SEQ ID NO: 110111 - protein, 9 aa, Dengue virus
TQVLMMRTT

SEQ ID NO: 110112 - protein, 9 aa, Dengue virus
QVLMMRTTW

SEQ ID NO: 110113 - protein, 9 aa, Dengue virus
VLMMRTTWA

SEQ ID NO: 110114 - protein, 9 aa, Dengue virus
LMMRTTWAL

SEQ ID NO: 110115 - protein, 9 aa, Dengue virus
MMRTTWALC

SEQ ID NO: 110116 - protein, 9 aa, Dengue virus
MRTSWALCE

SEQ ID NO: 110117 - protein, 9 aa, Dengue virus
RTTWALCEA

SEQ ID NO: 110118 - protein, 9 aa, Dengue virus
TTWALCEAL

SEQ ID NO: 110119 - protein, 9 aa, Dengue virus
TWALCEALT

SEQ ID NO: 110120 - protein, 9 aa, Dengue virus
WALCESITL

SEQ ID NO: 110121 - protein, 9 aa, Dengue virus
ALCESITLA

SEQ ID NO: 110122 - protein, 9 aa, Dengue virus
LCESITLAT

SEQ ID NO: 110123 - protein, 9 aa, Dengue virus
CESITLATG

SEQ ID NO: 110124 - protein, 9 aa, Dengue virus
ESITLATGP

SEQ ID NO: 110125 - protein, 9 aa, Dengue virus
SITLATGPL

SEQ ID NO: 110126 - protein, 9 aa, Dengue virus
LTLATGPIS

SEQ ID NO: 110127 - protein, 9 aa, Dengue virus
TLATGPIST

SEQ ID NO: 110128 - protein, 9 aa, Dengue virus
LATGPISTL

SEQ ID NO: 110129 - protein, 9 aa, Dengue virus
ATGPISTLW

SEQ ID NO: 110130 - protein, 9 aa, Dengue virus
TGPISTLWE

SEQ ID NO: 110131 - protein, 9 aa, Dengue virus
GPISTLWEG

SEQ ID NO: 110132 - protein, 9 aa, Dengue virus
PISTLWEGN

SEQ ID NO: 110133 - protein, 9 aa, Dengue virus
ISTLWEGNP

SEQ ID NO: 110134 - protein, 9 aa, Dengue virus
STLWEGNPG

SEQ ID NO: 110135 - protein, 9 aa, Dengue virus
TLWEGNPGR

SEQ ID NO: 110136 - protein, 9 aa, Dengue virus
LWEGNPGRF

SEQ ID NO: 110137 - protein, 9 aa, Dengue virus
WEGNPGRFW

SEQ ID NO: 110138 - protein, 9 aa, Dengue virus
EGNPGRFWN

SEQ ID NO: 110139 - protein, 9 aa, Dengue virus
GNPGRFWNT

SEQ ID NO: 110140 - protein, 9 aa, Dengue virus
NPGRFWNTT

SEQ ID NO: 110141 - protein, 9 aa, Dengue virus
PGRFWNTTI

SEQ ID NO: 110142 - protein, 9 aa, Dengue virus
GRFWNTTIA

SEQ ID NO: 110143 - protein, 9 aa, Dengue virus
RFWNTTIAV

SEQ ID NO: 110144 - protein, 9 aa, Dengue virus
WNTTIAVST

SEQ ID NO: 110145 - protein, 9 aa, Dengue virus
NTTIAVSTA

SEQ ID NO: 110146 - protein, 9 aa, Dengue virus
TTIAVSTAN

SEQ ID NO: 110147 - protein, 9 aa, Dengue virus
TIAVSTANI

SEQ ID NO: 110148 - protein, 9 aa, Dengue virus
IAVSTANIF

SEQ ID NO: 110149 - protein, 9 aa, Dengue virus
AVSTANIFR

SEQ ID NO: 110150 - protein, 9 aa, Dengue virus
VSTANIFRG

SEQ ID NO: 110151 - protein, 9 aa, Dengue virus
STANIFRGS

SEQ ID NO: 110152 - protein, 9 aa, Dengue virus
TANIFRGSY

SEQ ID NO: 110153 - protein, 9 aa, Dengue virus
SYLAGAGLL

SEQ ID NO: 110154 - protein, 9 aa, Dengue virus
YLAGAGLLF

SEQ ID NO: 110155 - protein, 9 aa, Dengue virus
LAGAGLLFS

SEQ ID NO: 110156 - protein, 9 aa, Dengue virus
AGAGLLFSI

SEQ ID NO: 110157 - protein, 9 aa, Dengue virus
GAGLLFSIM

SEQ ID NO: 110158 - protein, 9 aa, Dengue virus
AGLLFSIMK

SEQ ID NO: 110159 - protein, 9 aa, Dengue virus
GLLFSIMKN

SEQ ID NO: 110160 - protein, 9 aa, Dengue virus
LLFSIMKNT

SEQ ID NO: 110161 - protein, 9 aa, Dengue virus
IGETLGEKW

SEQ ID NO: 110162 - protein, 9 aa, Dengue virus
ETLGEKWKS

SEQ ID NO: 110163 - protein, 9 aa, Dengue virus
TLGEKWKSR

SEQ ID NO: 110164 - protein, 9 aa, Dengue virus
LGEKWKSRL

SEQ ID NO: 110165 - protein, 9 aa, Dengue virus
GEKWKSRLN

SEQ ID NO: 110166 - protein, 9 aa, Dengue virus
EVDRTLAKE

SEQ ID NO: 110167 - protein, 9 aa, Dengue virus
VDRTLAKEG

SEQ ID NO: 110168 - protein, 9 aa, Dengue virus
DRTLAKEGI

SEQ ID NO: 110169 - protein, 9 aa, Dengue virus
LAKEGIKRG

SEQ ID NO: 110170 - protein, 9 aa, Dengue virus
AKEGIKRGE

SEQ ID NO: 110171 - protein, 9 aa, Dengue virus
KEGIKRGET

SEQ ID NO: 110172 - protein, 9 aa, Dengue virus
KHAVSRGTA

SEQ ID NO: 110173 - protein, 9 aa, Dengue virus
HAVSRGTAK

SEQ ID NO: 110174 - protein, 9 aa, Dengue virus
AVSRGTAKL

SEQ ID NO: 110175 - protein, 9 aa, Dengue virus
VSRGSAKLR

SEQ ID NO: 110176 - protein, 9 aa, Dengue virus
SRGSAKLRW

SEQ ID NO: 110177 - protein, 9 aa, Dengue virus
RGSAKLRWF

SEQ ID NO: 110178 - protein, 9 aa, Dengue virus
GSAKLRWFV

SEQ ID NO: 110179 - protein, 9 aa, Dengue virus
SAKLRWFVE

SEQ ID NO: 110180 - protein, 9 aa, Dengue virus
AKLQWFVER

SEQ ID NO: 110181 - protein, 9 aa, Dengue virus
KLQWFVERN

SEQ ID NO: 110182 - protein, 9 aa, Dengue virus
LRWFVERNM

SEQ ID NO: 110183 - protein, 9 aa, Dengue virus
RWFVERNMV

SEQ ID NO: 110184 - protein, 9 aa, Dengue virus
PEGKVVDLG

SEQ ID NO: 110185 - protein, 9 aa, Dengue virus
EGKVVDLGC

SEQ ID NO: 110186 - protein, 9 aa, Dengue virus
GKVVDLGCG

SEQ ID NO: 110187 - protein, 9 aa, Dengue virus
KVVDLGCGR

SEQ ID NO: 110188 - protein, 9 aa, Dengue virus
VVDLGCGRG

SEQ ID NO: 110189 - protein, 9 aa, Dengue virus
VDLGCGRGG

SEQ ID NO: 110190 - protein, 9 aa, Dengue virus
GRGGWSYYM

SEQ ID NO: 110191 - protein, 9 aa, Dengue virus
RGGWSYYCG

SEQ ID NO: 110192 - protein, 9 aa, Dengue virus
GGWSYYCGG

SEQ ID NO: 110193 - protein, 9 aa, Dengue virus
GWSYYCGGL

SEQ ID NO: 110194 - protein, 9 aa, Dengue virus
WSYYCGGLK

SEQ ID NO: 110195 - protein, 9 aa, Dengue virus
SYYCGGLKN

SEQ ID NO: 110196 - protein, 9 aa, Dengue virus
YYCGGLKNV

SEQ ID NO: 110197 - protein, 9 aa, Dengue virus
YCGGLKNVR

SEQ ID NO: 110198 - protein, 9 aa, Dengue virus
CGGLKNVRE

SEQ ID NO: 110199 - protein, 9 aa, Dengue virus
GGLKNVREV

SEQ ID NO: 110200 - protein, 9 aa, Dengue virus
VREVKGLTK

SEQ ID NO: 110201 - protein, 9 aa, Dengue virus
REVKGLTKG

SEQ ID NO: 110202 - protein, 9 aa, Dengue virus
EVKGLTKGG

SEQ ID NO: 110203 - protein, 9 aa, Dengue virus
VKGLTKGGP

SEQ ID NO: 110204 - protein, 9 aa, Dengue virus
KGLTKGGPG

SEQ ID NO: 110205 - protein, 9 aa, Dengue virus
GLTKGGPGH

SEQ ID NO: 110206 - protein, 9 aa, Dengue virus
LTKGGPGHE

SEQ ID NO: 110207 - protein, 9 aa, Dengue virus
GGPGHEEPV

SEQ ID NO: 110208 - protein, 9 aa, Dengue virus
GPGHEEPVP

SEQ ID NO: 110209 - protein, 9 aa, Dengue virus
PGHEEPVPM

SEQ ID NO: 110210 - protein, 9 aa, Dengue virus
GHEEPIPMS

SEQ ID NO: 110211 - protein, 9 aa, Dengue virus
HEEPIPMST

SEQ ID NO: 110212 - protein, 9 aa, Dengue virus
EEPIPMSTY

SEQ ID NO: 110213 - protein, 9 aa, Dengue virus
EPIPMSTYG

SEQ ID NO: 110214 - protein, 9 aa, Dengue virus
PIPMSTYGW

SEQ ID NO: 110215 - protein, 9 aa, Dengue virus
IPMSTYGWN

SEQ ID NO: 110216 - protein, 9 aa, Dengue virus
PMSTYGWNL

SEQ ID NO: 110217 - protein, 9 aa, Dengue virus
MSTYGWNLV

SEQ ID NO: 110218 - protein, 9 aa, Dengue virus
STYGWNLVR

SEQ ID NO: 110219 - protein, 9 aa, Dengue virus
TYGWNLVRL

SEQ ID NO: 110220 - protein, 9 aa, Dengue virus
YGWNLVRLQ

SEQ ID NO: 110221 - protein, 9 aa, Dengue virus
GWNLVRLQS

SEQ ID NO: 110222 - protein, 9 aa, Dengue virus
WNLVRLQSG

SEQ ID NO: 110223 - protein, 9 aa, Dengue virus
LQSGVDVFF

SEQ ID NO: 110224 - protein, 9 aa, Dengue virus
PTEQVDTLL

SEQ ID NO: 110225 - protein, 9 aa, Dengue virus
TEQVDTLLC

SEQ ID NO: 110226 - protein, 9 aa, Dengue virus
EQVDTLLCD

SEQ ID NO: 110227 - protein, 9 aa, Dengue virus
QVDTLLCDI

SEQ ID NO: 110228 - protein, 9 aa, Dengue virus
VDTLLCDIG

SEQ ID NO: 110229 - protein, 9 aa, Dengue virus
LCDIGESSS

SEQ ID NO: 110230 - protein, 9 aa, Dengue virus
CDIGESSPS

SEQ ID NO: 110231 - protein, 9 aa, Dengue virus
DIGESSPSP

SEQ ID NO: 110232 - protein, 9 aa, Dengue virus
IGESSPSPT

SEQ ID NO: 110233 - protein, 9 aa, Dengue virus
GESSPSPTV

SEQ ID NO: 110234 - protein, 9 aa, Dengue virus
ESSPSPTVE

SEQ ID NO: 110235 - protein, 9 aa, Dengue virus
SSPSPTVEE

SEQ ID NO: 110236 - protein, 9 aa, Dengue virus
SPSPTVEES

SEQ ID NO: 110237 - protein, 9 aa, Dengue virus
PSPTVEESR

SEQ ID NO: 110238 - protein, 9 aa, Dengue virus
SPTVEESRT

SEQ ID NO: 110239 - protein, 9 aa, Dengue virus
PTVEESRTI

SEQ ID NO: 110240 - protein, 9 aa, Dengue virus
TVEESRTIR

SEQ ID NO: 110241 - protein, 9 aa, Dengue virus
VEESRTIRV

SEQ ID NO: 110242 - protein, 9 aa, Dengue virus
EAGRTLRVL

SEQ ID NO: 110243 - protein, 9 aa, Dengue virus
AGRTLRVLN

SEQ ID NO: 110244 - protein, 9 aa, Dengue virus
GRTLRVLNL

SEQ ID NO: 110245 - protein, 9 aa, Dengue virus
RTLRVLNLV

SEQ ID NO: 110246 - protein, 9 aa, Dengue virus
TLRVLNLVE

SEQ ID NO: 110247 - protein, 9 aa, Dengue virus
LRVLNLVEN

SEQ ID NO: 110248 - protein, 9 aa, Dengue virus
RVLNLVENW

SEQ ID NO: 110249 - protein, 9 aa, Dengue virus
VLNLVENWL

SEQ ID NO: 110250 - protein, 9 aa, Dengue virus
LNLVENWLN

SEQ ID NO: 110251 - protein, 9 aa, Dengue virus
QFCIKILNP

SEQ ID NO: 110252 - protein, 9 aa, Dengue virus
FCIKILNPY

SEQ ID NO: 110253 - protein, 9 aa, Dengue virus
CIKILNPYM

SEQ ID NO: 110254 - protein, 9 aa, Dengue virus
IKILNPYMP

SEQ ID NO: 110255 - protein, 9 aa, Dengue virus
KVLNPYMPS

SEQ ID NO: 110256 - protein, 9 aa, Dengue virus
VLNPYMPSV

SEQ ID NO: 110257 - protein, 9 aa, Dengue virus
LNPYMPSVI

SEQ ID NO: 110258 - protein, 9 aa, Dengue virus
NPYMPSVIE

SEQ ID NO: 110259 - protein, 9 aa, Dengue virus
YGGALVRNP

SEQ ID NO: 110260 - protein, 9 aa, Dengue virus
GGALVRNPL

SEQ ID NO: 110261 - protein, 9 aa, Dengue virus
GALVRNPLS

SEQ ID NO: 110262 - protein, 9 aa, Dengue virus
ALVRNPLSR

SEQ ID NO: 110263 - protein, 9 aa, Dengue virus
LVRCPLSRN

SEQ ID NO: 110264 - protein, 9 aa, Dengue virus
VRCPLSRNS

SEQ ID NO: 110265 - protein, 9 aa, Dengue virus
RCPLSRNST

SEQ ID NO: 110266 - protein, 9 aa, Dengue virus
CPLSRNSTH

SEQ ID NO: 110267 - protein, 9 aa, Dengue virus
NSTHEMYWI

SEQ ID NO: 110268 - protein, 9 aa, Dengue virus
STHEMYWIS

SEQ ID NO: 110269 - protein, 9 aa, Dengue virus
THEMYWVSN

SEQ ID NO: 110270 - protein, 9 aa, Dengue virus
HEMYWVSNA

SEQ ID NO: 110271 - protein, 9 aa, Dengue virus
EMYWISNGT

SEQ ID NO: 110272 - protein, 9 aa, Dengue virus
MYWISNGTG

SEQ ID NO: 110273 - protein, 9 aa, Dengue virus
YWISNGTGN

SEQ ID NO: 110274 - protein, 9 aa, Dengue virus
WISNGTGNI

SEQ ID NO: 110275 - protein, 9 aa, Dengue virus
ISNGTGNIV

SEQ ID NO: 110276 - protein, 9 aa, Dengue virus
ASGNIVSSV

SEQ ID NO: 110277 - protein, 9 aa, Dengue virus
TGNIVSSVN

SEQ ID NO: 110278 - protein, 9 aa, Dengue virus
GNIVSSVNM

SEQ ID NO: 110279 - protein, 9 aa, Dengue virus
NIVSSVNMI

SEQ ID NO: 110280 - protein, 9 aa, Dengue virus
IVSSVNMIS

SEQ ID NO: 110281 - protein, 9 aa, Dengue virus
VSSVNMISR

SEQ ID NO: 110282 - protein, 9 aa, Dengue virus
SSVNMISRM

SEQ ID NO: 110283 - protein, 9 aa, Dengue virus
SVNMISRML

SEQ ID NO: 110284 - protein, 9 aa, Dengue virus
VNMISRMLI

SEQ ID NO: 110285 - protein, 9 aa, Dengue virus
NMISRMLIN

SEQ ID NO: 110286 - protein, 9 aa, Dengue virus
MISRMLINR

SEQ ID NO: 110287 - protein, 9 aa, Dengue virus
ISRMLINRF

SEQ ID NO: 110288 - protein, 9 aa, Dengue virus
SRMLINRFT

SEQ ID NO: 110289 - protein, 9 aa, Dengue virus
RMLINRFTM

SEQ ID NO: 110290 - protein, 9 aa, Dengue virus
ATYEPDVDL

SEQ ID NO: 110291 - protein, 9 aa, Dengue virus
TYEPDVDLG

SEQ ID NO: 110292 - protein, 9 aa, Dengue virus
EPDVDLGSG

SEQ ID NO: 110293 - protein, 9 aa, Dengue virus
PDVDLGSGT

SEQ ID NO: 110294 - protein, 9 aa, Dengue virus
DVDLGSGTR

SEQ ID NO: 110295 - protein, 9 aa, Dengue virus
VDLGSGTRN

SEQ ID NO: 110296 - protein, 9 aa, Dengue virus
DLGSGTRNI

SEQ ID NO: 110297 - protein, 9 aa, Dengue virus
LGSGTRNIG

SEQ ID NO: 110298 - protein, 9 aa, Dengue virus
GSGTRNIGI

SEQ ID NO: 110299 - protein, 9 aa, Dengue virus
SGTRNIGIE

SEQ ID NO: 110300 - protein, 9 aa, Dengue virus
PNLDIIGKR

SEQ ID NO: 110301 - protein, 9 aa, Dengue virus
NLDIIGKRI

SEQ ID NO: 110302 - protein, 9 aa, Dengue virus
DIIGKRIEK

SEQ ID NO: 110303 - protein, 9 aa, Dengue virus
IIGKRIEKI

SEQ ID NO: 110304 - protein, 9 aa, Dengue virus
IGKRIEKIK

SEQ ID NO: 110305 - protein, 9 aa, Dengue virus
SWHYDQDHP

SEQ ID NO: 110306 - protein, 9 aa, Dengue virus
WHYDQDHPY

SEQ ID NO: 110307 - protein, 9 aa, Dengue virus
HYDQDHPYK

SEQ ID NO: 110308 - protein, 9 aa, Dengue virus
YDQDHPYKT

SEQ ID NO: 110309 - protein, 9 aa, Dengue virus
DQDHPYKTW

SEQ ID NO: 110310 - protein, 9 aa, Dengue virus
QDHPYKTWA

SEQ ID NO: 110311 - protein, 9 aa, Dengue virus
DHPYKTWAY

SEQ ID NO: 110312 - protein, 9 aa, Dengue virus
HPYKTWAYH

SEQ ID NO: 110313 - protein, 9 aa, Dengue virus
PYRTWAYHG

SEQ ID NO: 110314 - protein, 9 aa, Dengue virus
YRTWAYHGS

SEQ ID NO: 110315 - protein, 9 aa, Dengue virus
RTWAYHGSY

SEQ ID NO: 110316 - protein, 9 aa, Dengue virus
WAYHGSYET

SEQ ID NO: 110317 - protein, 9 aa, Dengue virus
AYHGSYETK

SEQ ID NO: 110318 - protein, 9 aa, Dengue virus
YHGSYETKQ

SEQ ID NO: 110319 - protein, 9 aa, Dengue virus
HGSYETKQT

SEQ ID NO: 110320 - protein, 9 aa, Dengue virus
GSYETKQTG

SEQ ID NO: 110321 - protein, 9 aa, Dengue virus
SYETKQTGS

SEQ ID NO: 110322 - protein, 9 aa, Dengue virus
YETKQTGSA

SEQ ID NO: 110323 - protein, 9 aa, Dengue virus
ETKQTGSAS

SEQ ID NO: 110324 - protein, 9 aa, Dengue virus
TKQTGSASS

SEQ ID NO: 110325 - protein, 9 aa, Dengue virus
KQTGSASSM

SEQ ID NO: 110326 - protein, 9 aa, Dengue virus
QTGSASSMV

SEQ ID NO: 110327 - protein, 9 aa, Dengue virus
TGSASSMVN

SEQ ID NO: 110328 - protein, 9 aa, Dengue virus
GSASSMING

SEQ ID NO: 110329 - protein, 9 aa, Dengue virus
SASSMINGV

SEQ ID NO: 110330 - protein, 9 aa, Dengue virus
ASSMINGVV

SEQ ID NO: 110331 - protein, 9 aa, Dengue virus
SSMVNGVVK

SEQ ID NO: 110332 - protein, 9 aa, Dengue virus
SMVNGVVKL

SEQ ID NO: 110333 - protein, 9 aa, Dengue virus
MVNGVVKLL

SEQ ID NO: 110334 - protein, 9 aa, Dengue virus
VNGVVKLLT

SEQ ID NO: 110335 - protein, 9 aa, Dengue virus
NGVVRLLTK

SEQ ID NO: 110336 - protein, 9 aa, Dengue virus
GVVRLLTKP

SEQ ID NO: 110337 - protein, 9 aa, Dengue virus
VVRLLTKPW

SEQ ID NO: 110338 - protein, 9 aa, Dengue virus
VRLLTKPWD

SEQ ID NO: 110339 - protein, 9 aa, Dengue virus
RLLTKPWDV

SEQ ID NO: 110340 - protein, 9 aa, Dengue virus
LLTKPWDVV

SEQ ID NO: 110341 - protein, 9 aa, Dengue virus
LTKPWDVVP

SEQ ID NO: 110342 - protein, 9 aa, Dengue virus
TKPWDVVPM

SEQ ID NO: 110343 - protein, 9 aa, Dengue virus
KPWDVVPMV

SEQ ID NO: 110344 - protein, 9 aa, Dengue virus
PWDVVPMVT

SEQ ID NO: 110345 - protein, 9 aa, Dengue virus
WDVVPMVTQ

SEQ ID NO: 110346 - protein, 9 aa, Dengue virus
PMVTQMAMT

SEQ ID NO: 110347 - protein, 9 aa, Dengue virus
MVTQMAMTD

SEQ ID NO: 110348 - protein, 9 aa, Dengue virus
VTQIAMTDT

SEQ ID NO: 110349 - protein, 9 aa, Dengue virus
TQIAMTDTT

SEQ ID NO: 110350 - protein, 9 aa, Dengue virus
QIAMTDTTP

SEQ ID NO: 110351 - protein, 9 aa, Dengue virus
IAMTDTTPF

SEQ ID NO: 110352 - protein, 9 aa, Dengue virus
KEKVDTRTQ

SEQ ID NO: 110353 - protein, 9 aa, Dengue virus
EKVDTRTQE

SEQ ID NO: 110354 - protein, 9 aa, Dengue virus
PRMCTREEF

SEQ ID NO: 110355 - protein, 9 aa, Dengue virus
CTREEFTKK

SEQ ID NO: 110356 - protein, 9 aa, Dengue virus
TREEFTKKV

SEQ ID NO: 110357 - protein, 9 aa, Dengue virus
REEFTKKVR

SEQ ID NO: 110358 - protein, 9 aa, Dengue virus
RKVRSNAAL

SEQ ID NO: 110359 - protein, 9 aa, Dengue virus
KVRSNAALG

SEQ ID NO: 110360 - protein, 9 aa, Dengue virus
VRSNAALGA

SEQ ID NO: 110361 - protein, 9 aa, Dengue virus
RSNAALGAI

SEQ ID NO: 110362 - protein, 9 aa, Dengue virus
SNAALGAIF

SEQ ID NO: 110363 - protein, 9 aa, Dengue virus
NAALGAIFT

SEQ ID NO: 110364 - protein, 9 aa, Dengue virus
AALGAIFTD

SEQ ID NO: 110365 - protein, 9 aa, Dengue virus
ALGAIFTDE

SEQ ID NO: 110366 - protein, 9 aa, Dengue virus
LGAIFTDEN

SEQ ID NO: 110367 - protein, 9 aa, Dengue virus
GAIFTDENK

SEQ ID NO: 110368 - protein, 9 aa, Dengue virus
AIFTDENKW

SEQ ID NO: 110369 - protein, 9 aa, Dengue virus
IFTDENKWK

SEQ ID NO: 110370 - protein, 9 aa, Dengue virus
FTDENKWKS

SEQ ID NO: 110371 - protein, 9 aa, Dengue virus
TDENKWKSA

SEQ ID NO: 110372 - protein, 9 aa, Dengue virus
DENKWKSAR

SEQ ID NO: 110373 - protein, 9 aa, Dengue virus
ENKWKSARE

SEQ ID NO: 110374 - protein, 9 aa, Dengue virus
NKWKSAREA

SEQ ID NO: 110375 - protein, 9 aa, Dengue virus
KWKSAREAV

SEQ ID NO: 110376 - protein, 9 aa, Dengue virus
WKSAREAVE

SEQ ID NO: 110377 - protein, 9 aa, Dengue virus
KSAREAVED

SEQ ID NO: 110378 - protein, 9 aa, Dengue virus
ERNLHLEGK

SEQ ID NO: 110379 - protein, 9 aa, Dengue virus
RNLHLEGKC

SEQ ID NO: 110380 - protein, 9 aa, Dengue virus
NLHLEGKCE

SEQ ID NO: 110381 - protein, 9 aa, Dengue virus
LHLEGKCET

SEQ ID NO: 110382 - protein, 9 aa, Dengue virus
HLEGKCETC

SEQ ID NO: 110383 - protein, 9 aa, Dengue virus
LEGKCETCV

SEQ ID NO: 110384 - protein, 9 aa, Dengue virus
EGKCETCVY

SEQ ID NO: 110385 - protein, 9 aa, Dengue virus
GKCETCVYN

SEQ ID NO: 110386 - protein, 9 aa, Dengue virus
KCETCVYNM

SEQ ID NO: 110387 - protein, 9 aa, Dengue virus
CETCVYNMM

SEQ ID NO: 110388 - protein, 9 aa, Dengue virus
ETCVYNMMG

SEQ ID NO: 110389 - protein, 9 aa, Dengue virus
SCVYNMMGK

SEQ ID NO: 110390 - protein, 9 aa, Dengue virus
EKKLGEFGR

SEQ ID NO: 110391 - protein, 9 aa, Dengue virus
KKLGEFGRA

SEQ ID NO: 110392 - protein, 9 aa, Dengue virus
KLGEFGRAK

SEQ ID NO: 110393 - protein, 9 aa, Dengue virus
LGEFGRAKG

SEQ ID NO: 110394 - protein, 9 aa, Dengue virus
GEFGRAKGS

SEQ ID NO: 110395 - protein, 9 aa, Dengue virus
EFGRAKGSR

SEQ ID NO: 110396 - protein, 9 aa, Dengue virus
FGRAKGSRA

SEQ ID NO: 110397 - protein, 9 aa, Dengue virus
GRAKGSRAI

SEQ ID NO: 110398 - protein, 9 aa, Dengue virus
RAKGSRAIW

SEQ ID NO: 110399 - protein, 9 aa, Dengue virus
WYMWLGARY

SEQ ID NO: 110400 - protein, 9 aa, Dengue virus
YMWLGARYL

SEQ ID NO: 110401 - protein, 9 aa, Dengue virus
MWLGARYLE

SEQ ID NO: 110402 - protein, 9 aa, Dengue virus
WLGARYLEF

SEQ ID NO: 110403 - protein, 9 aa, Dengue virus
LGARYLEFE

SEQ ID NO: 110404 - protein, 9 aa, Dengue virus
GARYLEFEA

SEQ ID NO: 110405 - protein, 9 aa, Dengue virus
ARYLEFEAL

SEQ ID NO: 110406 - protein, 9 aa, Dengue virus
RYLEFEALG

SEQ ID NO: 110407 - protein, 9 aa, Dengue virus
YLEFEALGF

SEQ ID NO: 110408 - protein, 9 aa, Dengue virus
LEFEALGFM

SEQ ID NO: 110409 - protein, 9 aa, Dengue virus
EFEALGFMN

SEQ ID NO: 110410 - protein, 9 aa, Dengue virus
FEALGFMNE

SEQ ID NO: 110411 - protein, 9 aa, Dengue virus
EALGFMNED

SEQ ID NO: 110412 - protein, 9 aa, Dengue virus
ALGFMNEDH

SEQ ID NO: 110413 - protein, 9 aa, Dengue virus
LGFMNEDHW

SEQ ID NO: 110414 - protein, 9 aa, Dengue virus
GFMNEDHWF

SEQ ID NO: 110415 - protein, 9 aa, Dengue virus
FMNEDHWFS

SEQ ID NO: 110416 - protein, 9 aa, Dengue virus
MNEDHWFSR

SEQ ID NO: 110417 - protein, 9 aa, Dengue virus
NEDHWFSRG

SEQ ID NO: 110418 - protein, 9 aa, Dengue virus
EDHWFSRGN

SEQ ID NO: 110419 - protein, 9 aa, Dengue virus
DHWFSRGNS

SEQ ID NO: 110420 - protein, 9 aa, Dengue virus
HWFSRENSY

SEQ ID NO: 110421 - protein, 9 aa, Dengue virus
WFSRENSYS

SEQ ID NO: 110422 - protein, 9 aa, Dengue virus
FSRENSYSG

SEQ ID NO: 110423 - protein, 9 aa, Dengue virus
SRENSYSGV

SEQ ID NO: 110424 - protein, 9 aa, Dengue virus
RENSYSGVE

SEQ ID NO: 110425 - protein, 9 aa, Dengue virus
ENSYSGVEG

SEQ ID NO: 110426 - protein, 9 aa, Dengue virus
NSYSGVEGE

SEQ ID NO: 110427 - protein, 9 aa, Dengue virus
SYSGVEGEG

SEQ ID NO: 110428 - protein, 9 aa, Dengue virus
YSGVEGEGL

SEQ ID NO: 110429 - protein, 9 aa, Dengue virus
GVEGEGLHR

SEQ ID NO: 110430 - protein, 9 aa, Dengue virus
VEGEGLHRL

SEQ ID NO: 110431 - protein, 9 aa, Dengue virus
EGEGLHRLG

SEQ ID NO: 110432 - protein, 9 aa, Dengue virus
GEGLHRLGY

SEQ ID NO: 110433 - protein, 9 aa, Dengue virus
EGLHRLGYI

SEQ ID NO: 110434 - protein, 9 aa, Dengue virus
GLHRLGYIL

SEQ ID NO: 110435 - protein, 9 aa, Dengue virus
LHRLGYILR

SEQ ID NO: 110436 - protein, 9 aa, Dengue virus
GGNMYADDT

SEQ ID NO: 110437 - protein, 9 aa, Dengue virus
GNMYADDTA

SEQ ID NO: 110438 - protein, 9 aa, Dengue virus
NMYADDTAG

SEQ ID NO: 110439 - protein, 9 aa, Dengue virus
AGWDTRITL

SEQ ID NO: 110440 - protein, 9 aa, Dengue virus
GWDTRITLE

SEQ ID NO: 110441 - protein, 9 aa, Dengue virus
WDTRITLED

SEQ ID NO: 110442 - protein, 9 aa, Dengue virus
DTRITLEDL

SEQ ID NO: 110443 - protein, 9 aa, Dengue virus
SIFKLTYQN

SEQ ID NO: 110444 - protein, 9 aa, Dengue virus
LTYQNKVVK

SEQ ID NO: 110445 - protein, 9 aa, Dengue virus
TYQNKVVKV

SEQ ID NO: 110446 - protein, 9 aa, Dengue virus
YQNKVVKVQ

SEQ ID NO: 110447 - protein, 9 aa, Dengue virus
QNKVVKVQR

SEQ ID NO: 110448 - protein, 9 aa, Dengue virus
NKVVKVQRP

SEQ ID NO: 110449 - protein, 9 aa, Dengue virus
KVVRVQRPT

SEQ ID NO: 110450 - protein, 9 aa, Dengue virus
VVRVQRPTP

SEQ ID NO: 110451 - protein, 9 aa, Dengue virus
GTVMDVISR

SEQ ID NO: 110452 - protein, 9 aa, Dengue virus
TVMDIISRR

SEQ ID NO: 110453 - protein, 9 aa, Dengue virus
VMDIISRKD

SEQ ID NO: 110454 - protein, 9 aa, Dengue virus
MDIISRKDQ

SEQ ID NO: 110455 - protein, 9 aa, Dengue virus
DIISRKDQR

SEQ ID NO: 110456 - protein, 9 aa, Dengue virus
IISRKDQRG

SEQ ID NO: 110457 - protein, 9 aa, Dengue virus
ISRKDQRGS

SEQ ID NO: 110458 - protein, 9 aa, Dengue virus
SRKDQRGSG

SEQ ID NO: 110459 - protein, 9 aa, Dengue virus
RKDQRGSGQ

SEQ ID NO: 110460 - protein, 9 aa, Dengue virus
KDQRGSGQV

SEQ ID NO: 110461 - protein, 9 aa, Dengue virus
DQRGSGQVV

SEQ ID NO: 110462 - protein, 9 aa, Dengue virus
QRGSGQVVT

SEQ ID NO: 110463 - protein, 9 aa, Dengue virus
RGSGQVVTY

SEQ ID NO: 110464 - protein, 9 aa, Dengue virus
GSGQVVTYG

SEQ ID NO: 110465 - protein, 9 aa, Dengue virus
SGQVVTYGL

SEQ ID NO: 110466 - protein, 9 aa, Dengue virus
GQVVTYGLN

SEQ ID NO: 110467 - protein, 9 aa, Dengue virus
QVVTYGLNT

SEQ ID NO: 110468 - protein, 9 aa, Dengue virus
FTNMEVQLI

SEQ ID NO: 110469 - protein, 9 aa, Dengue virus
TNMEVQLIR

SEQ ID NO: 110470 - protein, 9 aa, Dengue virus
NMEVQLIRQ

SEQ ID NO: 110471 - protein, 9 aa, Dengue virus
MEVQLIRQM

SEQ ID NO: 110472 - protein, 9 aa, Dengue virus
EVQLIRQME

SEQ ID NO: 110473 - protein, 9 aa, Dengue virus
AQLIRQMES

SEQ ID NO: 110474 - protein, 9 aa, Dengue virus
QLIRQMEGE

SEQ ID NO: 110475 - protein, 9 aa, Dengue virus
LIRQMEGEG

SEQ ID NO: 110476 - protein, 9 aa, Dengue virus
ERLSRMAIS

SEQ ID NO: 110477 - protein, 9 aa, Dengue virus
RLSRMAISG

SEQ ID NO: 110478 - protein, 9 aa, Dengue virus
LSRMAISGD

SEQ ID NO: 110479 - protein, 9 aa, Dengue virus
SRMAISGDD

SEQ ID NO: 110480 - protein, 9 aa, Dengue virus
GDDCVVKPL

SEQ ID NO: 110481 - protein, 9 aa, Dengue virus
DDCVVKPLD

SEQ ID NO: 110482 - protein, 9 aa, Dengue virus
DCVVKPLDD

SEQ ID NO: 110483 - protein, 9 aa, Dengue virus
CVVKPLDDR

SEQ ID NO: 110484 - protein, 9 aa, Dengue virus
VVKPLDDRF

SEQ ID NO: 110485 - protein, 9 aa, Dengue virus
ALLALNDMG

SEQ ID NO: 110486 - protein, 9 aa, Dengue virus
LLALNDMGK

SEQ ID NO: 110487 - protein, 9 aa, Dengue virus
ALNDMGKIR

SEQ ID NO: 110488 - protein, 9 aa, Dengue virus
LNDMGKIRK

SEQ ID NO: 110489 - protein, 9 aa, Dengue virus
NDMGKIRKD

SEQ ID NO: 110490 - protein, 9 aa, Dengue virus
DMGKIRKDI

SEQ ID NO: 110491 - protein, 9 aa, Dengue virus
MGKVRKDIQ

SEQ ID NO: 110492 - protein, 9 aa, Dengue virus
GKVRKDIQQ

SEQ ID NO: 110493 - protein, 9 aa, Dengue virus
KVRKDIQQW

SEQ ID NO: 110494 - protein, 9 aa, Dengue virus
VRKDIPQWQ

SEQ ID NO: 110495 - protein, 9 aa, Dengue virus
RKDIQQWEP

SEQ ID NO: 110496 - protein, 9 aa, Dengue virus
KDIQQWEPS

SEQ ID NO: 110497 - protein, 9 aa, Dengue virus
DIQQWEPSR

SEQ ID NO: 110498 - protein, 9 aa, Dengue virus
IQQWEPSRG

SEQ ID NO: 110499 - protein, 9 aa, Dengue virus
QQWEPSRGW

SEQ ID NO: 110500 - protein, 9 aa, Dengue virus
QWEPSRGWN

SEQ ID NO: 110501 - protein, 9 aa, Dengue virus
WEPSRGWND

SEQ ID NO: 110502 - protein, 9 aa, Dengue virus
EPSRGWNDW

SEQ ID NO: 110503 - protein, 9 aa, Dengue virus
GWNDWTQVP

SEQ ID NO: 110504 - protein, 9 aa, Dengue virus
WNDWTQVPF

SEQ ID NO: 110505 - protein, 9 aa, Dengue virus
NDWTQVPFC

SEQ ID NO: 110506 - protein, 9 aa, Dengue virus
DWTQVPFCS

SEQ ID NO: 110507 - protein, 9 aa, Dengue virus
WTQVPFCSH

SEQ ID NO: 110508 - protein, 9 aa, Dengue virus
TQVPFCSHH

SEQ ID NO: 110509 - protein, 9 aa, Dengue virus
EVPFCSHHF

SEQ ID NO: 110510 - protein, 9 aa, Dengue virus
PFCSHHFHQ

SEQ ID NO: 110511 - protein, 9 aa, Dengue virus
FCSHHFHQL

SEQ ID NO: 110512 - protein, 9 aa, Dengue virus
CSHHFHELI

SEQ ID NO: 110513 - protein, 9 aa, Dengue virus
SHHFHELIM

SEQ ID NO: 110514 - protein, 9 aa, Dengue virus
HHFHELIMK

SEQ ID NO: 110515 - protein, 9 aa, Dengue virus
HFHELIMKD

SEQ ID NO: 110516 - protein, 9 aa, Dengue virus
FHELIMKDG

SEQ ID NO: 110517 - protein, 9 aa, Dengue virus
HELIMKDGR

SEQ ID NO: 110518 - protein, 9 aa, Dengue virus
LVVPCRNQD

SEQ ID NO: 110519 - protein, 9 aa, Dengue virus
VVPCRPQDE

SEQ ID NO: 110520 - protein, 9 aa, Dengue virus
VPCRPQDEL

SEQ ID NO: 110521 - protein, 9 aa, Dengue virus
PCRNQDELI

SEQ ID NO: 110522 - protein, 9 aa, Dengue virus
CRNQDELIG

SEQ ID NO: 110523 - protein, 9 aa, Dengue virus
RNQDELIGR

SEQ ID NO: 110524 - protein, 9 aa, Dengue virus
NQDELIGRA

SEQ ID NO: 110525 - protein, 9 aa, Dengue virus
QDELVGRAR

SEQ ID NO: 110526 - protein, 9 aa, Dengue virus
DELVGRARV

SEQ ID NO: 110527 - protein, 9 aa, Dengue virus
ELVGRARVS

SEQ ID NO: 110528 - protein, 9 aa, Dengue virus
LVGRARVSQ

SEQ ID NO: 110529 - protein, 9 aa, Dengue virus
VGRARVSQG

SEQ ID NO: 110530 - protein, 9 aa, Dengue virus
GRARVSQGA

SEQ ID NO: 110531 - protein, 9 aa, Dengue virus
RARVSQGAG

SEQ ID NO: 110532 - protein, 9 aa, Dengue virus
ARVSQGAGW

SEQ ID NO: 110533 - protein, 9 aa, Dengue virus
RVSQGAGWS

SEQ ID NO: 110534 - protein, 9 aa, Dengue virus
VSQGAGWSL

SEQ ID NO: 110535 - protein, 9 aa, Dengue virus
SQGAGWSLK

SEQ ID NO: 110536 - protein, 9 aa, Dengue virus
QGAGWSLKE

SEQ ID NO: 110537 - protein, 9 aa, Dengue virus
GAGWSLKET

SEQ ID NO: 110538 - protein, 9 aa, Dengue virus
AGWSLKETA

SEQ ID NO: 110539 - protein, 9 aa, Dengue virus
GWSLKETAC

SEQ ID NO: 110540 - protein, 9 aa, Dengue virus
WSLKETACL

SEQ ID NO: 110541 - protein, 9 aa, Dengue virus
SLKETACLG

SEQ ID NO: 110542 - protein, 9 aa, Dengue virus
LKETACLGK

SEQ ID NO: 110543 - protein, 9 aa, Dengue virus
KETACLGKS

SEQ ID NO: 110544 - protein, 9 aa, Dengue virus
ETACLGKAY

SEQ ID NO: 110545 - protein, 9 aa, Dengue virus
TACLGKAYA

SEQ ID NO: 110546 - protein, 9 aa, Dengue virus
ACLGKAYAQ

SEQ ID NO: 110547 - protein, 9 aa, Dengue virus
CLGKAYAQM

SEQ ID NO: 110548 - protein, 9 aa, Dengue virus
LGKAYAQMW

SEQ ID NO: 110549 - protein, 9 aa, Dengue virus
GKAYAQMWS

SEQ ID NO: 110550 - protein, 9 aa, Dengue virus
KAYAQMWSL

SEQ ID NO: 110551 - protein, 9 aa, Dengue virus
AYAQMWSLM

SEQ ID NO: 110552 - protein, 9 aa, Dengue virus
YAQMWSLMY

SEQ ID NO: 110553 - protein, 9 aa, Dengue virus
AQMWSLMYF

SEQ ID NO: 110554 - protein, 9 aa, Dengue virus
QMWSLMYFH

SEQ ID NO: 110555 - protein, 9 aa, Dengue virus
MWSLMYFHR

SEQ ID NO: 110556 - protein, 9 aa, Dengue virus
WSLMYFHRR

SEQ ID NO: 110557 - protein, 9 aa, Dengue virus
SLMYFHRRD

SEQ ID NO: 110558 - protein, 9 aa, Dengue virus
HRRDLRLAS

SEQ ID NO: 110559 - protein, 9 aa, Dengue virus
RRDLRLASN

SEQ ID NO: 110560 - protein, 9 aa, Dengue virus
RDLRLASNA

SEQ ID NO: 110561 - protein, 9 aa, Dengue virus
DLRLASNAI

SEQ ID NO: 110562 - protein, 9 aa, Dengue virus
LRLASNAIC

SEQ ID NO: 110563 - protein, 9 aa, Dengue virus
RLASNAICS

SEQ ID NO: 110564 - protein, 9 aa, Dengue virus
LASNAICSA

SEQ ID NO: 110565 - protein, 9 aa, Dengue virus
ASNAICSAV

SEQ ID NO: 110566 - protein, 9 aa, Dengue virus
SNAICSAVP

SEQ ID NO: 110567 - protein, 9 aa, Dengue virus
NAICSAVPS

SEQ ID NO: 110568 - protein, 9 aa, Dengue virus
DWVPTSRTT

SEQ ID NO: 110569 - protein, 9 aa, Dengue virus
WIPTSRTTW

SEQ ID NO: 110570 - protein, 9 aa, Dengue virus
IPTSRTTWS

SEQ ID NO: 110571 - protein, 9 aa, Dengue virus
RTTWSIHAK

SEQ ID NO: 110572 - protein, 9 aa, Dengue virus
TTWSIHAKH

SEQ ID NO: 110573 - protein, 9 aa, Dengue virus
TWSIHAKHE

SEQ ID NO: 110574 - protein, 9 aa, Dengue virus
WSIHAKHEW

SEQ ID NO: 110575 - protein, 9 aa, Dengue virus
SIHAKHEWM

SEQ ID NO: 110576 - protein, 9 aa, Dengue virus
IHAKHEWMT

SEQ ID NO: 110577 - protein, 9 aa, Dengue virus
HAKHEWMTT

SEQ ID NO: 110578 - protein, 9 aa, Dengue virus
AKHEWMTTE

SEQ ID NO: 110579 - protein, 9 aa, Dengue virus
KHEWMTTED

SEQ ID NO: 110580 - protein, 9 aa, Dengue virus
HEWMTTEDM

SEQ ID NO: 110581 - protein, 9 aa, Dengue virus
EWMTTEDML

SEQ ID NO: 110582 - protein, 9 aa, Dengue virus
WMTTEDMLT

SEQ ID NO: 110583 - protein, 9 aa, Dengue virus
MTTEDMLTV

SEQ ID NO: 110584 - protein, 9 aa, Dengue virus
TTEDMLTVW

SEQ ID NO: 110585 - protein, 9 aa, Dengue virus
TEDMLTVWN

SEQ ID NO: 110586 - protein, 9 aa, Dengue virus
EDMLTVWNR

SEQ ID NO: 110587 - protein, 9 aa, Dengue virus
DMLTVWNRV

SEQ ID NO: 110588 - protein, 9 aa, Dengue virus
MLTVWNRVW

SEQ ID NO: 110589 - protein, 9 aa, Dengue virus
LTVWNRVWI

SEQ ID NO: 110590 - protein, 9 aa, Dengue virus
DNPWMEDKT

SEQ ID NO: 110591 - protein, 9 aa, Dengue virus
EVPYLGKRE

SEQ ID NO: 110592 - protein, 9 aa, Dengue virus
IPYLGKRED

SEQ ID NO: 110593 - protein, 9 aa, Dengue virus
PYLGKREDL

SEQ ID NO: 110594 - protein, 9 aa, Dengue virus
YLGKREDLW

SEQ ID NO: 110595 - protein, 9 aa, Dengue virus
LGKREDLWC

SEQ ID NO: 110596 - protein, 9 aa, Dengue virus
GKREDLWCG

SEQ ID NO: 110597 - protein, 9 aa, Dengue virus
KREDLWCGS

SEQ ID NO: 110598 - protein, 9 aa, Dengue virus
REDLWCGSL

SEQ ID NO: 110599 - protein, 9 aa, Dengue virus
EDLWCGSLI

SEQ ID NO: 110600 - protein, 9 aa, Dengue virus
DLWCGSLIG

SEQ ID NO: 110601 - protein, 9 aa, Dengue virus
LWCGSLIGL

SEQ ID NO: 110602 - protein, 9 aa, Dengue virus
WCGSLIGLS

SEQ ID NO: 110603 - protein, 9 aa, Dengue virus
CGSLIGLTA

SEQ ID NO: 110604 - protein, 9 aa, Dengue virus
GSLIGLTAR

SEQ ID NO: 110605 - protein, 9 aa, Dengue virus
SLIGLTARA

SEQ ID NO: 110606 - protein, 9 aa, Dengue virus
LIGLTARAT

SEQ ID NO: 110607 - protein, 9 aa, Dengue virus
IGLTARATW

SEQ ID NO: 110608 - protein, 9 aa, Dengue virus
GLTARATWA

SEQ ID NO: 110609 - protein, 9 aa, Dengue virus
LTSRATWAK

SEQ ID NO: 110610 - protein, 9 aa, Dengue virus
TSRATWAKN

SEQ ID NO: 110611 - protein, 9 aa, Dengue virus
SRATWAKNI

SEQ ID NO: 110612 - protein, 9 aa, Dengue virus
DYMTSMKRF

SEQ ID NO: 110613 - protein, 9 aa, Dengue virus
YMTSMKRFK

SEQ ID NO: 110614 - protein, 9 aa, Dengue virus
PSINMLKRV

SEQ ID NO: 110615 - protein, 9 aa, Dengue virus
SINMLKRVR

SEQ ID NO: 110616 - protein, 9 aa, Dengue virus
INMLKRVRN

SEQ ID NO: 110617 - protein, 9 aa, Dengue virus
NMLKRVRNR

SEQ ID NO: 110618 - protein, 9 aa, Dengue virus
MLKRVRNRV

SEQ ID NO: 110619 - protein, 9 aa, Dengue virus
LKRVRNRVS

SEQ ID NO: 110620 - protein, 9 aa, Dengue virus
KRVRNRVST

SEQ ID NO: 110621 - protein, 9 aa, Dengue virus
RNRVSTGSQ

SEQ ID NO: 110622 - protein, 9 aa, Dengue virus
NRVSTGSQL

SEQ ID NO: 110623 - protein, 9 aa, Dengue virus
RVSTGSQLA

SEQ ID NO: 110624 - protein, 9 aa, Dengue virus
VSTGSQLAK

SEQ ID NO: 110625 - protein, 9 aa, Dengue virus
STGSQLAKR

SEQ ID NO: 110626 - protein, 9 aa, Dengue virus
TGSQLAKRF

SEQ ID NO: 110627 - protein, 9 aa, Dengue virus
GSQLAKRFS

SEQ ID NO: 110628 - protein, 9 aa, Dengue virus
SQLAKRFSR

SEQ ID NO: 110629 - protein, 9 aa, Dengue virus
QLAKRFSRG

SEQ ID NO: 110630 - protein, 9 aa, Dengue virus
LAKRFSRGL

SEQ ID NO: 110631 - protein, 9 aa, Dengue virus
AKRFSRGLL

SEQ ID NO: 110632 - protein, 9 aa, Dengue virus
KRFSKGLLN

SEQ ID NO: 110633 - protein, 9 aa, Dengue virus
RFSKGLLNG

SEQ ID NO: 110634 - protein, 9 aa, Dengue virus
FSKGLLNGQ

SEQ ID NO: 110635 - protein, 9 aa, Dengue virus
SKGLLNGQG

SEQ ID NO: 110636 - protein, 9 aa, Dengue virus
KGLLNGQGP

SEQ ID NO: 110637 - protein, 9 aa, Dengue virus
GLLNGQGPM

SEQ ID NO: 110638 - protein, 9 aa, Dengue virus
LLNGQGPMK

SEQ ID NO: 110639 - protein, 9 aa, Dengue virus
GKGPLRMVL

SEQ ID NO: 110640 - protein, 9 aa, Dengue virus
KGPLRMVLA

SEQ ID NO: 110641 - protein, 9 aa, Dengue virus
GPLRMVLAF

SEQ ID NO: 110642 - protein, 9 aa, Dengue virus
MVLAFITFL

SEQ ID NO: 110643 - protein, 9 aa, Dengue virus
VLAFITFLR

SEQ ID NO: 110644 - protein, 9 aa, Dengue virus
LAFITFLRV

SEQ ID NO: 110645 - protein, 9 aa, Dengue virus
AFITFLRVL

SEQ ID NO: 110646 - protein, 9 aa, Dengue virus
FITFLRVLS

SEQ ID NO: 110647 - protein, 9 aa, Dengue virus
ITFLRVLSI

SEQ ID NO: 110648 - protein, 9 aa, Dengue virus
TFLRVLSIP

SEQ ID NO: 110649 - protein, 9 aa, Dengue virus
FLRVLSIPP

SEQ ID NO: 110650 - protein, 9 aa, Dengue virus
LRVLSIPPT

SEQ ID NO: 110651 - protein, 9 aa, Dengue virus
RVLSIPPTA

SEQ ID NO: 110652 - protein, 9 aa, Dengue virus
VLSIPPTAG

SEQ ID NO: 110653 - protein, 9 aa, Dengue virus
LAIPPTAGV

SEQ ID NO: 110654 - protein, 9 aa, Dengue virus
AIPPTAGVL

SEQ ID NO: 110655 - protein, 9 aa, Dengue virus
IPPTAGVLA

SEQ ID NO: 110656 - protein, 9 aa, Dengue virus
PPTAGVLAR

SEQ ID NO: 110657 - protein, 9 aa, Dengue virus
PTAGVLARW

SEQ ID NO: 110658 - protein, 9 aa, Dengue virus
TAGVLARWG

SEQ ID NO: 110659 - protein, 9 aa, Dengue virus
GFKKEISSM

SEQ ID NO: 110660 - protein, 9 aa, Dengue virus
FKKEISSML

SEQ ID NO: 110661 - protein, 9 aa, Dengue virus
AFHLTSRDG

SEQ ID NO: 110662 - protein, 9 aa, Dengue virus
FHLTSRDGE

SEQ ID NO: 110663 - protein, 9 aa, Dengue virus
HLTSRDGEP

SEQ ID NO: 110664 - protein, 9 aa, Dengue virus
LTSRDGEPR

SEQ ID NO: 110665 - protein, 9 aa, Dengue virus
TSRDGEPRM

SEQ ID NO: 110666 - protein, 9 aa, Dengue virus
SRDGEPRMI

SEQ ID NO: 110667 - protein, 9 aa, Dengue virus
RDGEPRMIV

SEQ ID NO: 110668 - protein, 9 aa, Dengue virus
NERGKSLLF

SEQ ID NO: 110669 - protein, 9 aa, Dengue virus
ERGRPLLFK

SEQ ID NO: 110670 - protein, 9 aa, Dengue virus
RGRPLLFKT

SEQ ID NO: 110671 - protein, 9 aa, Dengue virus
GKSLLFKTA

SEQ ID NO: 110672 - protein, 9 aa, Dengue virus
NMCTLMAMD

SEQ ID NO: 110673 - protein, 9 aa, Dengue virus
MCTLMAMDL

SEQ ID NO: 110674 - protein, 9 aa, Dengue virus
CTLMAMDLG

SEQ ID NO: 110675 - protein, 9 aa, Dengue virus
TLMAMDLGE

SEQ ID NO: 110676 - protein, 9 aa, Dengue virus
LMAIDLGEL

SEQ ID NO: 110677 - protein, 9 aa, Dengue virus
MAIDLGELC

SEQ ID NO: 110678 - protein, 9 aa, Dengue virus
AIDLGELCE

SEQ ID NO: 110679 - protein, 9 aa, Dengue virus
IDLGELCED

SEQ ID NO: 110680 - protein, 9 aa, Dengue virus
DLGEFCEDT

SEQ ID NO: 110681 - protein, 9 aa, Dengue virus
EDIDCWCNL

SEQ ID NO: 110682 - protein, 9 aa, Dengue virus
DIDCWCNLT

SEQ ID NO: 110683 - protein, 9 aa, Dengue virus
IDCWCNLTS

SEQ ID NO: 110684 - protein, 9 aa, Dengue virus
DCWCNLTST

SEQ ID NO: 110685 - protein, 9 aa, Dengue virus
CWCNLTSTW

SEQ ID NO: 110686 - protein, 9 aa, Dengue virus
TSTWVMYGT

SEQ ID NO: 110687 - protein, 9 aa, Dengue virus
STWVMYGTC

SEQ ID NO: 110688 - protein, 9 aa, Dengue virus
TWVTYGTCN

SEQ ID NO: 110689 - protein, 9 aa, Dengue virus
GERRREKRS

SEQ ID NO: 110690 - protein, 9 aa, Dengue virus
ERRREKRSV

SEQ ID NO: 110691 - protein, 9 aa, Dengue virus
RRREKRSVA

SEQ ID NO: 110692 - protein, 9 aa, Dengue virus
REKRSVALT

SEQ ID NO: 110693 - protein, 9 aa, Dengue virus
EKRSVALTP

SEQ ID NO: 110694 - protein, 9 aa, Dengue virus
KRSVALTPH

SEQ ID NO: 110695 - protein, 9 aa, Dengue virus
RSVALTPHS

SEQ ID NO: 110696 - protein, 9 aa, Dengue virus
SVALTPHSG

SEQ ID NO: 110697 - protein, 9 aa, Dengue virus
VALAPHVGM

SEQ ID NO: 110698 - protein, 9 aa, Dengue virus
ALAPHVGMG

SEQ ID NO: 110699 - protein, 9 aa, Dengue virus
LAPHVGMGL

SEQ ID NO: 110700 - protein, 9 aa, Dengue virus
APHVGMGLD

SEQ ID NO: 110701 - protein, 9 aa, Dengue virus
PHVGMGLDT

SEQ ID NO: 110702 - protein, 9 aa, Dengue virus
HVGMGLDTR

SEQ ID NO: 110703 - protein, 9 aa, Dengue virus
GLETRAETW

SEQ ID NO: 110704 - protein, 9 aa, Dengue virus
LETRAETWM

SEQ ID NO: 110705 - protein, 9 aa, Dengue virus
ETRAETWMS

SEQ ID NO: 110706 - protein, 9 aa, Dengue virus
TRAETWMSS

SEQ ID NO: 110707 - protein, 9 aa, Dengue virus
RAETWMSSE

SEQ ID NO: 110708 - protein, 9 aa, Dengue virus
AETWMSSEG

SEQ ID NO: 110709 - protein, 9 aa, Dengue virus
WMSSEGAWR

SEQ ID NO: 110710 - protein, 9 aa, Dengue virus
MSAEGAWRQ

SEQ ID NO: 110711 - protein, 9 aa, Dengue virus
SSEGAWKHA

SEQ ID NO: 110712 - protein, 9 aa, Dengue virus
SEGAWKHAQ

SEQ ID NO: 110713 - protein, 9 aa, Dengue virus
VESWILRNP

SEQ ID NO: 110714 - protein, 9 aa, Dengue virus
ESWILRNPG

SEQ ID NO: 110715 - protein, 9 aa, Dengue virus
SWILRNPGF

SEQ ID NO: 110716 - protein, 9 aa, Dengue virus
WILRNPGFA

SEQ ID NO: 110717 - protein, 9 aa, Dengue virus
VTPSMTMRC

SEQ ID NO: 110718 - protein, 9 aa, Dengue virus
TPSMTMRCV

SEQ ID NO: 110719 - protein, 9 aa, Dengue virus
PSMTMRCVG

SEQ ID NO: 110720 - protein, 9 aa, Dengue virus
MRCVGVGNR

SEQ ID NO: 110721 - protein, 9 aa, Dengue virus
RCVGVGNRD

SEQ ID NO: 110722 - protein, 9 aa, Dengue virus
CVGVGNRDF

SEQ ID NO: 110723 - protein, 9 aa, Dengue virus
VGVGNRDFV

SEQ ID NO: 110724 - protein, 9 aa, Dengue virus
GVGNRDFVE

SEQ ID NO: 110725 - protein, 9 aa, Dengue virus
VGNRDFVEG

SEQ ID NO: 110726 - protein, 9 aa, Dengue virus
SNRDFVEGV

SEQ ID NO: 110727 - protein, 9 aa, Dengue virus
NRDFVEGLS

SEQ ID NO: 110728 - protein, 9 aa, Dengue virus
FVEGVSGGA

SEQ ID NO: 110729 - protein, 9 aa, Dengue virus
VEGVSGGAW

SEQ ID NO: 110730 - protein, 9 aa, Dengue virus
EGVSGGAWV

SEQ ID NO: 110731 - protein, 9 aa, Dengue virus
GVSGGAWVD

SEQ ID NO: 110732 - protein, 9 aa, Dengue virus
VSGGAWVDL

SEQ ID NO: 110733 - protein, 9 aa, Dengue virus
SGGAWVDLV

SEQ ID NO: 110734 - protein, 9 aa, Dengue virus
GGAWVDLVL

SEQ ID NO: 110735 - protein, 9 aa, Dengue virus
GAWVDLVLE

SEQ ID NO: 110736 - protein, 9 aa, Dengue virus
AWVDLVLEH

SEQ ID NO: 110737 - protein, 9 aa, Dengue virus
WVDLVLEHG

SEQ ID NO: 110738 - protein, 9 aa, Dengue virus
VDVVLEHGG

SEQ ID NO: 110739 - protein, 9 aa, Dengue virus
DVVLEHGGC

SEQ ID NO: 110740 - protein, 9 aa, Dengue virus
VVLEHGGCV

SEQ ID NO: 110741 - protein, 9 aa, Dengue virus
GGCVTTMAQ

SEQ ID NO: 110742 - protein, 9 aa, Dengue virus
GCVTTMAKN

SEQ ID NO: 110743 - protein, 9 aa, Dengue virus
CVTTMAQGK

SEQ ID NO: 110744 - protein, 9 aa, Dengue virus
VTTMAQGKP

SEQ ID NO: 110745 - protein, 9 aa, Dengue virus
TTMAQGKPT

SEQ ID NO: 110746 - protein, 9 aa, Dengue virus
TMAQGKPTL

SEQ ID NO: 110747 - protein, 9 aa, Dengue virus
MAQGKPTLD

SEQ ID NO: 110748 - protein, 9 aa, Dengue virus
AKNKPTLDI

SEQ ID NO: 110749 - protein, 9 aa, Dengue virus
KNKPTLDIE

SEQ ID NO: 110750 - protein, 9 aa, Dengue virus
NKPTLDIEL

SEQ ID NO: 110751 - protein, 9 aa, Dengue virus
KPTLDIELQ

SEQ ID NO: 110752 - protein, 9 aa, Dengue virus
PTLDIELQK

SEQ ID NO: 110753 - protein, 9 aa, Dengue virus
TLDIELQKT

SEQ ID NO: 110754 - protein, 9 aa, Dengue virus
LDIELQKTE

SEQ ID NO: 110755 - protein, 9 aa, Dengue virus
DIELQKTEA

SEQ ID NO: 110756 - protein, 9 aa, Dengue virus
IELQKTEAT

SEQ ID NO: 110757 - protein, 9 aa, Dengue virus
TTATRCPTQ

SEQ ID NO: 110758 - protein, 9 aa, Dengue virus
TATRCPTQG

SEQ ID NO: 110759 - protein, 9 aa, Dengue virus
ATRCPTQGE

SEQ ID NO: 110760 - protein, 9 aa, Dengue virus
TRCPTQGEP

SEQ ID NO: 110761 - protein, 9 aa, Dengue virus
CKHTYVDRG

SEQ ID NO: 110762 - protein, 9 aa, Dengue virus
KHTYVDRGW

SEQ ID NO: 110763 - protein, 9 aa, Dengue virus
HTYVDRGWG

SEQ ID NO: 110764 - protein, 9 aa, Dengue virus
TYVDRGWGN

SEQ ID NO: 110765 - protein, 9 aa, Dengue virus
YVDRGWGNG

SEQ ID NO: 110766 - protein, 9 aa, Dengue virus
CGLFGKGGV

SEQ ID NO: 110767 - protein, 9 aa, Dengue virus
GLFGKGSLV

SEQ ID NO: 110768 - protein, 9 aa, Dengue virus
LFGKGSLVT

SEQ ID NO: 110769 - protein, 9 aa, Dengue virus
FGKGSLVTC

SEQ ID NO: 110770 - protein, 9 aa, Dengue virus
GKGSLVTCA

SEQ ID NO: 110771 - protein, 9 aa, Dengue virus
KGSLVTCAK

SEQ ID NO: 110772 - protein, 9 aa, Dengue virus
GSLVTCAKF

SEQ ID NO: 110773 - protein, 9 aa, Dengue virus
IITVHTGDQ

SEQ ID NO: 110774 - protein, 9 aa, Dengue virus
TVHNGDTHA

SEQ ID NO: 110775 - protein, 9 aa, Dengue virus
VHNGDTHAV

SEQ ID NO: 110776 - protein, 9 aa, Dengue virus
HNGDTHAVG

SEQ ID NO: 110777 - protein, 9 aa, Dengue virus
NGDTHAVGN

SEQ ID NO: 110778 - protein, 9 aa, Dengue virus
GDQHQVGND

SEQ ID NO: 110779 - protein, 9 aa, Dengue virus
LGLECSPRT

SEQ ID NO: 110780 - protein, 9 aa, Dengue virus
GLECSPRTG

SEQ ID NO: 110781 - protein, 9 aa, Dengue virus
LECSPRTGL

SEQ ID NO: 110782 - protein, 9 aa, Dengue virus
DCEPRSGID

SEQ ID NO: 110783 - protein, 9 aa, Dengue virus
SGIDFNEMI

SEQ ID NO: 110784 - protein, 9 aa, Dengue virus
GIDFNEMIL

SEQ ID NO: 110785 - protein, 9 aa, Dengue virus
IDFNEMILM

SEQ ID NO: 110786 - protein, 9 aa, Dengue virus
DFNEMILLT

SEQ ID NO: 110787 - protein, 9 aa, Dengue virus
FNEMILLTM

SEQ ID NO: 110788 - protein, 9 aa, Dengue virus
NEMILLTMK

SEQ ID NO: 110789 - protein, 9 aa, Dengue virus
KAWMVHRQW

SEQ ID NO: 110790 - protein, 9 aa, Dengue virus
AWMVHRQWF

SEQ ID NO: 110791 - protein, 9 aa, Dengue virus
WMVHRQWFF

SEQ ID NO: 110792 - protein, 9 aa, Dengue virus
MVHRQWFFD

SEQ ID NO: 110793 - protein, 9 aa, Dengue virus
VHRQWFFDL

SEQ ID NO: 110794 - protein, 9 aa, Dengue virus
HRQWFFDLP

SEQ ID NO: 110795 - protein, 9 aa, Dengue virus
RQWFFDLPL

SEQ ID NO: 110796 - protein, 9 aa, Dengue virus
FFDLPLPWT

SEQ ID NO: 110797 - protein, 9 aa, Dengue virus
DLPLPWTAG

SEQ ID NO: 110798 - protein, 9 aa, Dengue virus
LPLPWTAGA

SEQ ID NO: 110799 - protein, 9 aa, Dengue virus
KELLVTFKN

SEQ ID NO: 110800 - protein, 9 aa, Dengue virus
ELLVTFKNA

SEQ ID NO: 110801 - protein, 9 aa, Dengue virus
LLVTFKNAH

SEQ ID NO: 110802 - protein, 9 aa, Dengue virus
LVTFKNAHA

SEQ ID NO: 110803 - protein, 9 aa, Dengue virus
VTFKNAHAK

SEQ ID NO: 110804 - protein, 9 aa, Dengue virus
TFKNAHAKK

SEQ ID NO: 110805 - protein, 9 aa, Dengue virus
FKNAHAKKQ

SEQ ID NO: 110806 - protein, 9 aa, Dengue virus
KNAHAKKQE

SEQ ID NO: 110807 - protein, 9 aa, Dengue virus
NAHAKKQEV

SEQ ID NO: 110808 - protein, 9 aa, Dengue virus
PHAKRQDVT

SEQ ID NO: 110809 - protein, 9 aa, Dengue virus
HAKRQDVTV

SEQ ID NO: 110810 - protein, 9 aa, Dengue virus
AKRQDVTVL

SEQ ID NO: 110811 - protein, 9 aa, Dengue virus
KRQDVTVLG

SEQ ID NO: 110812 - protein, 9 aa, Dengue virus
RQDVTVLGS

SEQ ID NO: 110813 - protein, 9 aa, Dengue virus
QDVTVLGSQ

SEQ ID NO: 110814 - protein, 9 aa, Dengue virus
DVTVLGSQE

SEQ ID NO: 110815 - protein, 9 aa, Dengue virus
LTGATEIQN

SEQ ID NO: 110816 - protein, 9 aa, Dengue virus
TGATEIQNS

SEQ ID NO: 110817 - protein, 9 aa, Dengue virus
GATEIQNSG

SEQ ID NO: 110818 - protein, 9 aa, Dengue virus
GGTSIFAGH

SEQ ID NO: 110819 - protein, 9 aa, Dengue virus
GTSIFAGHL

SEQ ID NO: 110820 - protein, 9 aa, Dengue virus
TSIFAGHLK

SEQ ID NO: 110821 - protein, 9 aa, Dengue virus
SIFAGHLKC

SEQ ID NO: 110822 - protein, 9 aa, Dengue virus
MFAGHLKCK

SEQ ID NO: 110823 - protein, 9 aa, Dengue virus
FAGHLKCKV

SEQ ID NO: 110824 - protein, 9 aa, Dengue virus
AGHLKCKVR

SEQ ID NO: 110825 - protein, 9 aa, Dengue virus
GHLKCKVRM

SEQ ID NO: 110826 - protein, 9 aa, Dengue virus
HLKCKVRME

SEQ ID NO: 110827 - protein, 9 aa, Dengue virus
LKCKVRMEK

SEQ ID NO: 110828 - protein, 9 aa, Dengue virus
KCKVRMEKL

SEQ ID NO: 110829 - protein, 9 aa, Dengue virus
CRLKMDKLE

SEQ ID NO: 110830 - protein, 9 aa, Dengue virus
RLKMDKLEL

SEQ ID NO: 110831 - protein, 9 aa, Dengue virus
LKMDKLELK

SEQ ID NO: 110832 - protein, 9 aa, Dengue virus
KMDKLELKG

SEQ ID NO: 110833 - protein, 9 aa, Dengue virus
KKEVSETQH

SEQ ID NO: 110834 - protein, 9 aa, Dengue virus
KEVSETQHG

SEQ ID NO: 110835 - protein, 9 aa, Dengue virus
EVSETQHGT

SEQ ID NO: 110836 - protein, 9 aa, Dengue virus
VSETQHGTI

SEQ ID NO: 110837 - protein, 9 aa, Dengue virus
SETQHGTIL

SEQ ID NO: 110838 - protein, 9 aa, Dengue virus
ETQHGTILI

SEQ ID NO: 110839 - protein, 9 aa, Dengue virus
TQHGTILIK

SEQ ID NO: 110840 - protein, 9 aa, Dengue virus
VTNIELEPP

SEQ ID NO: 110841 - protein, 9 aa, Dengue virus
TNIELEPPF

SEQ ID NO: 110842 - protein, 9 aa, Dengue virus
NIELEPPFG

SEQ ID NO: 110843 - protein, 9 aa, Dengue virus
IETEPPFGE

SEQ ID NO: 110844 - protein, 9 aa, Dengue virus
ETEPPFGES

SEQ ID NO: 110845 - protein, 9 aa, Dengue virus
AEPPFGESN

SEQ ID NO: 110846 - protein, 9 aa, Dengue virus
EPPFGESNI

SEQ ID NO: 110847 - protein, 9 aa, Dengue virus
WFRKGSSIG

SEQ ID NO: 110848 - protein, 9 aa, Dengue virus
RKGSSIGKM

SEQ ID NO: 110849 - protein, 9 aa, Dengue virus
RGSSIGKMF

SEQ ID NO: 110850 - protein, 9 aa, Dengue virus
GSSIGQMIE

SEQ ID NO: 110851 - protein, 9 aa, Dengue virus
SSIGKMFES

SEQ ID NO: 110852 - protein, 9 aa, Dengue virus
SIGKMFEST

SEQ ID NO: 110853 - protein, 9 aa, Dengue virus
IGKMFESTY

SEQ ID NO: 110854 - protein, 9 aa, Dengue virus
GKMFESTYR

SEQ ID NO: 110855 - protein, 9 aa, Dengue virus
KMFESTYRG

SEQ ID NO: 110856 - protein, 9 aa, Dengue virus
MFESTYRGA

SEQ ID NO: 110857 - protein, 9 aa, Dengue virus
FESTYRGAK

SEQ ID NO: 110858 - protein, 9 aa, Dengue virus
ESTYRGAKR

SEQ ID NO: 110859 - protein, 9 aa, Dengue virus
STYRGAKRM

SEQ ID NO: 110860 - protein, 9 aa, Dengue virus
TYRGAKRMA

SEQ ID NO: 110861 - protein, 9 aa, Dengue virus
YRGAKRMAI

SEQ ID NO: 110862 - protein, 9 aa, Dengue virus
AKRMAILGE

SEQ ID NO: 110863 - protein, 9 aa, Dengue virus
KRMAILGET

SEQ ID NO: 110864 - protein, 9 aa, Dengue virus
DTAWDFGSV

SEQ ID NO: 110865 - protein, 9 aa, Dengue virus
TAWDFGSVG

SEQ ID NO: 110866 - protein, 9 aa, Dengue virus
AWDFGSVGG

SEQ ID NO: 110867 - protein, 9 aa, Dengue virus
WDFGSVGGV

SEQ ID NO: 110868 - protein, 9 aa, Dengue virus
FGSAYTALF

SEQ ID NO: 110869 - protein, 9 aa, Dengue virus
AYTALFSGV

SEQ ID NO: 110870 - protein, 9 aa, Dengue virus
YTALFSGVS

SEQ ID NO: 110871 - protein, 9 aa, Dengue virus
TALFSGVSW

SEQ ID NO: 110872 - protein, 9 aa, Dengue virus
FSGVSWIMK

SEQ ID NO: 110873 - protein, 9 aa, Dengue virus
SGVSWIMKI

SEQ ID NO: 110874 - protein, 9 aa, Dengue virus
LLTWIGLNS

SEQ ID NO: 110875 - protein, 9 aa, Dengue virus
LTWIGLNSK

SEQ ID NO: 110876 - protein, 9 aa, Dengue virus
TWIGLNSKN

SEQ ID NO: 110877 - protein, 9 aa, Dengue virus
WIGLNSKNT

SEQ ID NO: 110878 - protein, 9 aa, Dengue virus
LYLGAMVQA

SEQ ID NO: 110879 - protein, 9 aa, Dengue virus
YLGAMVQAD

SEQ ID NO: 110880 - protein, 9 aa, Dengue virus
GKELKCGSG

SEQ ID NO: 110881 - protein, 9 aa, Dengue virus
KCGSGIFVV

SEQ ID NO: 110882 - protein, 9 aa, Dengue virus
CGSGIFVVD

SEQ ID NO: 110883 - protein, 9 aa, Dengue virus
GSGIFVVDN

SEQ ID NO: 110884 - protein, 9 aa, Dengue virus
SGIFVVDNV

SEQ ID NO: 110885 - protein, 9 aa, Dengue virus
GIFVVDNVH

SEQ ID NO: 110886 - protein, 9 aa, Dengue virus
IFVVDNVHT

SEQ ID NO: 110887 - protein, 9 aa, Dengue virus
FVVDNVHTW

SEQ ID NO: 110888 - protein, 9 aa, Dengue virus
VVDNVHTWT

SEQ ID NO: 110889 - protein, 9 aa, Dengue virus
VDNVHTWTE

SEQ ID NO: 110890 - protein, 9 aa, Dengue virus
YKFQPESPA

SEQ ID NO: 110891 - protein, 9 aa, Dengue virus
KFQPESPAR

SEQ ID NO: 110892 - protein, 9 aa, Dengue virus
FQPESPARL

SEQ ID NO: 110893 - protein, 9 aa, Dengue virus
QADSPKRLA

SEQ ID NO: 110894 - protein, 9 aa, Dengue virus
ADSPKRLAT

SEQ ID NO: 110895 - protein, 9 aa, Dengue virus
DSPKRLATA

SEQ ID NO: 110896 - protein, 9 aa, Dengue virus
SPKRLATAI

SEQ ID NO: 110897 - protein, 9 aa, Dengue virus
PKRLATAIA

SEQ ID NO: 110898 - protein, 9 aa, Dengue virus
KRLATAIAG

SEQ ID NO: 110899 - protein, 9 aa, Dengue virus
RLATAIAGA

SEQ ID NO: 110900 - protein, 9 aa, Dengue virus
ENGVCGIRS

SEQ ID NO: 110901 - protein, 9 aa, Dengue virus
GVCGIRSTT

SEQ ID NO: 110902 - protein, 9 aa, Dengue virus
VCGIRSTTR

SEQ ID NO: 110903 - protein, 9 aa, Dengue virus
CGIRSTTRM

SEQ ID NO: 110904 - protein, 9 aa, Dengue virus
GIRSTTRME

SEQ ID NO: 110905 - protein, 9 aa, Dengue virus
IRSTTRMEN

SEQ ID NO: 110906 - protein, 9 aa, Dengue virus
RSTTRMENL

SEQ ID NO: 110907 - protein, 9 aa, Dengue virus
STTRMENLL

SEQ ID NO: 110908 - protein, 9 aa, Dengue virus
TTRMENLLW

SEQ ID NO: 110909 - protein, 9 aa, Dengue virus
TRMENLLWK

SEQ ID NO: 110910 - protein, 9 aa, Dengue virus
RMENLLWKQ

SEQ ID NO: 110911 - protein, 9 aa, Dengue virus
MENLLWKQI

SEQ ID NO: 110912 - protein, 9 aa, Dengue virus
ELNYILWEN

SEQ ID NO: 110913 - protein, 9 aa, Dengue virus
YSWKAWGKA

SEQ ID NO: 110914 - protein, 9 aa, Dengue virus
SWKAWGKAK

SEQ ID NO: 110915 - protein, 9 aa, Dengue virus
SFIIDGPNT

SEQ ID NO: 110916 - protein, 9 aa, Dengue virus
RAWNVWEVE

SEQ ID NO: 110917 - protein, 9 aa, Dengue virus
AWNVWEVED

SEQ ID NO: 110918 - protein, 9 aa, Dengue virus
WNVWEVEDY

SEQ ID NO: 110919 - protein, 9 aa, Dengue virus
NVWEVEDYG

SEQ ID NO: 110920 - protein, 9 aa, Dengue virus
VWEVEDYGF

SEQ ID NO: 110921 - protein, 9 aa, Dengue virus
FEVEDYGFG

SEQ ID NO: 110922 - protein, 9 aa, Dengue virus
EVEDYGFGM

SEQ ID NO: 110923 - protein, 9 aa, Dengue virus
VEDYGFGMF

SEQ ID NO: 110924 - protein, 9 aa, Dengue virus
EDYGFGMFT

SEQ ID NO: 110925 - protein, 9 aa, Dengue virus
DYGFGMFTT

SEQ ID NO: 110926 - protein, 9 aa, Dengue virus
YGFGMFTTN

SEQ ID NO: 110927 - protein, 9 aa, Dengue virus
GFGMFTTNI

SEQ ID NO: 110928 - protein, 9 aa, Dengue virus
FGMFTTNIW

SEQ ID NO: 110929 - protein, 9 aa, Dengue virus
GMFTTNIWM

SEQ ID NO: 110930 - protein, 9 aa, Dengue virus
MFTTNIWMK

SEQ ID NO: 110931 - protein, 9 aa, Dengue virus
FSTNIWLKL

SEQ ID NO: 110932 - protein, 9 aa, Dengue virus
DHRLMSAAV

SEQ ID NO: 110933 - protein, 9 aa, Dengue virus
HRLMSAAVK

SEQ ID NO: 110934 - protein, 9 aa, Dengue virus
RLMSAAVKD

SEQ ID NO: 110935 - protein, 9 aa, Dengue virus
KDERAVHAD

SEQ ID NO: 110936 - protein, 9 aa, Dengue virus
DERAVHADM

SEQ ID NO: 110937 - protein, 9 aa, Dengue virus
ERAVHADMG

SEQ ID NO: 110938 - protein, 9 aa, Dengue virus
DMGYWIESQ

SEQ ID NO: 110939 - protein, 9 aa, Dengue virus
MGYWIESQK

SEQ ID NO: 110940 - protein, 9 aa, Dengue virus
GYWIESQKN

SEQ ID NO: 110941 - protein, 9 aa, Dengue virus
ESQKNGSWK

SEQ ID NO: 110942 - protein, 9 aa, Dengue virus
ASLIEVKTC

SEQ ID NO: 110943 - protein, 9 aa, Dengue virus
WPRSHTLWS

SEQ ID NO: 110944 - protein, 9 aa, Dengue virus
PRSHTLWSN

SEQ ID NO: 110945 - protein, 9 aa, Dengue virus
RSHTLWSNG

SEQ ID NO: 110946 - protein, 9 aa, Dengue virus
WSNGVLESQ

SEQ ID NO: 110947 - protein, 9 aa, Dengue virus
SNGVLESQM

SEQ ID NO: 110948 - protein, 9 aa, Dengue virus
NGVLESQML

SEQ ID NO: 110949 - protein, 9 aa, Dengue virus
GVLESQMLI

SEQ ID NO: 110950 - protein, 9 aa, Dengue virus
VLESQMLIP

SEQ ID NO: 110951 - protein, 9 aa, Dengue virus
LESQMLIPK

SEQ ID NO: 110952 - protein, 9 aa, Dengue virus
SQHNYRQGY

SEQ ID NO: 110953 - protein, 9 aa, Dengue virus
TQTVGPWHL

SEQ ID NO: 110954 - protein, 9 aa, Dengue virus
QTVGPWHLG

SEQ ID NO: 110955 - protein, 9 aa, Dengue virus
TVGPWHLGK

SEQ ID NO: 110956 - protein, 9 aa, Dengue virus
AGPWHLGRL

SEQ ID NO: 110957 - protein, 9 aa, Dengue virus
PWHLGKLEI

SEQ ID NO: 110958 - protein, 9 aa, Dengue virus
WHLGKLEID

SEQ ID NO: 110959 - protein, 9 aa, Dengue virus
HLGKLEIDF

SEQ ID NO: 110960 - protein, 9 aa, Dengue virus
CDHRGPSLR

SEQ ID NO: 110961 - protein, 9 aa, Dengue virus
DHRGPSLRT

SEQ ID NO: 110962 - protein, 9 aa, Dengue virus
HRGPSLRTT

SEQ ID NO: 110963 - protein, 9 aa, Dengue virus
PSLRTTTVS

SEQ ID NO: 110964 - protein, 9 aa, Dengue virus
SLRTTTVSG

SEQ ID NO: 110965 - protein, 9 aa, Dengue virus
LRTTTVSGK

SEQ ID NO: 110966 - protein, 9 aa, Dengue virus
RTTTVSGKL

SEQ ID NO: 110967 - protein, 9 aa, Dengue virus
TTTVSGKLI

SEQ ID NO: 110968 - protein, 9 aa, Dengue virus
TTVSGKLIH

SEQ ID NO: 110969 - protein, 9 aa, Dengue virus
TVSGKLIHE

SEQ ID NO: 110970 - protein, 9 aa, Dengue virus
VSGKLIHEW

SEQ ID NO: 110971 - protein, 9 aa, Dengue virus
SGKLIHEWC

SEQ ID NO: 110972 - protein, 9 aa, Dengue virus
GKLIHEWCC

SEQ ID NO: 110973 - protein, 9 aa, Dengue virus
KLIHEWCCR

SEQ ID NO: 110974 - protein, 9 aa, Dengue virus
LIHEWCCRS

SEQ ID NO: 110975 - protein, 9 aa, Dengue virus
VTQWCCRSC

SEQ ID NO: 110976 - protein, 9 aa, Dengue virus
TQWCCRSCT

SEQ ID NO: 110977 - protein, 9 aa, Dengue virus
SCTMPPLRF

SEQ ID NO: 110978 - protein, 9 aa, Dengue virus
CTLPPLRYM

SEQ ID NO: 110979 - protein, 9 aa, Dengue virus
TLPPLRYMG

SEQ ID NO: 110980 - protein, 9 aa, Dengue virus
LPPLRYMGE

SEQ ID NO: 110981 - protein, 9 aa, Dengue virus
PPLRYMGED

SEQ ID NO: 110982 - protein, 9 aa, Dengue virus
PLRYMGEDG

SEQ ID NO: 110983 - protein, 9 aa, Dengue virus
LRYMGEDGC

SEQ ID NO: 110984 - protein, 9 aa, Dengue virus
RYMGEDGCW

SEQ ID NO: 110985 - protein, 9 aa, Dengue virus
YMGEDGCWY

SEQ ID NO: 110986 - protein, 9 aa, Dengue virus
KGEDGCWYG

SEQ ID NO: 110987 - protein, 9 aa, Dengue virus
WYGMEIRPI

SEQ ID NO: 110988 - protein, 9 aa, Dengue virus
EEVMRGKFG

SEQ ID NO: 110989 - protein, 9 aa, Dengue virus
MGMGVTYLA

SEQ ID NO: 110990 - protein, 9 aa, Dengue virus
GMGMTYLAL

SEQ ID NO: 110991 - protein, 9 aa, Dengue virus
TYLALIATF

SEQ ID NO: 110992 - protein, 9 aa, Dengue virus
FLRKLTSRE

SEQ ID NO: 110993 - protein, 9 aa, Dengue virus
RKLTSRENL

SEQ ID NO: 110994 - protein, 9 aa, Dengue virus
KLTSRENLL

SEQ ID NO: 110995 - protein, 9 aa, Dengue virus
LTSKELMMA

SEQ ID NO: 110996 - protein, 9 aa, Dengue virus
TSKELMMAT

SEQ ID NO: 110997 - protein, 9 aa, Dengue virus
QMANGIALG

SEQ ID NO: 110998 - protein, 9 aa, Dengue virus
MANGIALGL

SEQ ID NO: 110999 - protein, 9 aa, Dengue virus
ANGIALGLM

SEQ ID NO: 111000 - protein, 9 aa, Dengue virus
KRSWPLNEA

SEQ ID NO: 111001 - protein, 9 aa, Dengue virus
RSWPLNEGV

SEQ ID NO: 111002 - protein, 9 aa, Dengue virus
SWPLNEGVM

SEQ ID NO: 111003 - protein, 9 aa, Dengue virus
WPLNEGVMA

SEQ ID NO: 111004 - protein, 9 aa, Dengue virus
PLNEGVMAV

SEQ ID NO: 111005 - protein, 9 aa, Dengue virus
LNEGVMAVG

SEQ ID NO: 111006 - protein, 9 aa, Dengue virus
GLVSILASS

SEQ ID NO: 111007 - protein, 9 aa, Dengue virus
VSLLGSALL

SEQ ID NO: 111008 - protein, 9 aa, Dengue virus
SILASSLLR

SEQ ID NO: 111009 - protein, 9 aa, Dengue virus
ILASSLLRN

SEQ ID NO: 111010 - protein, 9 aa, Dengue virus
LASSLLRND

SEQ ID NO: 111011 - protein, 9 aa, Dengue virus
ASSLLRNDV

SEQ ID NO: 111012 - protein, 9 aa, Dengue virus
SSLLRNDVP

SEQ ID NO: 111013 - protein, 9 aa, Dengue virus
SLLRNDVPM

SEQ ID NO: 111014 - protein, 9 aa, Dengue virus
LLRNDVPMA

SEQ ID NO: 111015 - protein, 9 aa, Dengue virus
LRNDVPMAG

SEQ ID NO: 111016 - protein, 9 aa, Dengue virus
RNDVPMAGP

SEQ ID NO: 111017 - protein, 9 aa, Dengue virus
NDVPMAGPL

SEQ ID NO: 111018 - protein, 9 aa, Dengue virus
DVPMAGPLV

SEQ ID NO: 111019 - protein, 9 aa, Dengue virus
VPMAGPLVA

SEQ ID NO: 111020 - protein, 9 aa, Dengue virus
PMAGPLVAG

SEQ ID NO: 111021 - protein, 9 aa, Dengue virus
MAGPLVAGG

SEQ ID NO: 111022 - protein, 9 aa, Dengue virus
AGPLVAGGL

SEQ ID NO: 111023 - protein, 9 aa, Dengue virus
GPMVAGGLL

SEQ ID NO: 111024 - protein, 9 aa, Dengue virus
PLVAGGLLI

SEQ ID NO: 111025 - protein, 9 aa, Dengue virus
LVAGGLLIA

SEQ ID NO: 111026 - protein, 9 aa, Dengue virus
VAGGLLIAC

SEQ ID NO: 111027 - protein, 9 aa, Dengue virus
AGGLLIACY

SEQ ID NO: 111028 - protein, 9 aa, Dengue virus
GGLLIACYV

SEQ ID NO: 111029 - protein, 9 aa, Dengue virus
GLLIACYVI

SEQ ID NO: 111030 - protein, 9 aa, Dengue virus
LLIACYVIT

SEQ ID NO: 111031 - protein, 9 aa, Dengue virus
LIACYVITG

SEQ ID NO: 111032 - protein, 9 aa, Dengue virus
IACYVITGT

SEQ ID NO: 111033 - protein, 9 aa, Dengue virus
ACYVITGTS

SEQ ID NO: 111034 - protein, 9 aa, Dengue virus
CYVITGTSA

SEQ ID NO: 111035 - protein, 9 aa, Dengue virus
YVITGTSAD

SEQ ID NO: 111036 - protein, 9 aa, Dengue virus
VITGTSADL

SEQ ID NO: 111037 - protein, 9 aa, Dengue virus
ITGTSADLT

SEQ ID NO: 111038 - protein, 9 aa, Dengue virus
TGTSADLTV

SEQ ID NO: 111039 - protein, 9 aa, Dengue virus
GTSADLTVE

SEQ ID NO: 111040 - protein, 9 aa, Dengue virus
TSADLTVEK

SEQ ID NO: 111041 - protein, 9 aa, Dengue virus
EAEQTGVSH

SEQ ID NO: 111042 - protein, 9 aa, Dengue virus
AEQTGVSHN

SEQ ID NO: 111043 - protein, 9 aa, Dengue virus
EQTGVSHNL

SEQ ID NO: 111044 - protein, 9 aa, Dengue virus
QTGVSHNLM

SEQ ID NO: 111045 - protein, 9 aa, Dengue virus
DDDGTMRIK

SEQ ID NO: 111046 - protein, 9 aa, Dengue virus
DDGTMRIKD

SEQ ID NO: 111047 - protein, 9 aa, Dengue virus
DGTMRIKDD

SEQ ID NO: 111048 - protein, 9 aa, Dengue virus
GTMRIKDDE

SEQ ID NO: 111049 - protein, 9 aa, Dengue virus
TMRIKDDET

SEQ ID NO: 111050 - protein, 9 aa, Dengue virus
MRIKDDETE

SEQ ID NO: 111051 - protein, 9 aa, Dengue virus
LTVLLKTAL

SEQ ID NO: 111052 - protein, 9 aa, Dengue virus
TVLLKTALL

SEQ ID NO: 111053 - protein, 9 aa, Dengue virus
VLLKTALLI

SEQ ID NO: 111054 - protein, 9 aa, Dengue virus
LLKTALLIV

SEQ ID NO: 111055 - protein, 9 aa, Dengue virus
LKTALLIVS

SEQ ID NO: 111056 - protein, 9 aa, Dengue virus
KTALLIVSG

SEQ ID NO: 111057 - protein, 9 aa, Dengue virus
QTQRSGVLW

SEQ ID NO: 111058 - protein, 9 aa, Dengue virus
TQRSGVLWD

SEQ ID NO: 111059 - protein, 9 aa, Dengue virus
QRSGVLWDV

SEQ ID NO: 111060 - protein, 9 aa, Dengue virus
RSGVLWDVP

SEQ ID NO: 111061 - protein, 9 aa, Dengue virus
SGVLWDVPS

SEQ ID NO: 111062 - protein, 9 aa, Dengue virus
GALWDVPSP

SEQ ID NO: 111063 - protein, 9 aa, Dengue virus
ALWDVPSPA

SEQ ID NO: 111064 - protein, 9 aa, Dengue virus
LWDVPSPPE

SEQ ID NO: 111065 - protein, 9 aa, Dengue virus
AELEEGVYR

SEQ ID NO: 111066 - protein, 9 aa, Dengue virus
ELEEGVYRI

SEQ ID NO: 111067 - protein, 9 aa, Dengue virus
LEEGVYRIK

SEQ ID NO: 111068 - protein, 9 aa, Dengue virus
EEGVYRIKQ

SEQ ID NO: 111069 - protein, 9 aa, Dengue virus
FGKTQVGVG

SEQ ID NO: 111070 - protein, 9 aa, Dengue virus
GKTQVGVGV

SEQ ID NO: 111071 - protein, 9 aa, Dengue virus
KTQVGVGVQ

SEQ ID NO: 111072 - protein, 9 aa, Dengue virus
TQVGVGVQK

SEQ ID NO: 111073 - protein, 9 aa, Dengue virus
QVGVGVQKE

SEQ ID NO: 111074 - protein, 9 aa, Dengue virus
EGVFHTMWH

SEQ ID NO: 111075 - protein, 9 aa, Dengue virus
GTFHTMWHV

SEQ ID NO: 111076 - protein, 9 aa, Dengue virus
HVTRGSVIC

SEQ ID NO: 111077 - protein, 9 aa, Dengue virus
VTRGAVLTY

SEQ ID NO: 111078 - protein, 9 aa, Dengue virus
RGKRIEPSW

SEQ ID NO: 111079 - protein, 9 aa, Dengue virus
GKRLEPNWA

SEQ ID NO: 111080 - protein, 9 aa, Dengue virus
KRLEPNWAS

SEQ ID NO: 111081 - protein, 9 aa, Dengue virus
RLEPNWASV

SEQ ID NO: 111082 - protein, 9 aa, Dengue virus
LEPNWASVK

SEQ ID NO: 111083 - protein, 9 aa, Dengue virus
EPNWASVKK

SEQ ID NO: 111084 - protein, 9 aa, Dengue virus
PNWASVKKD

SEQ ID NO: 111085 - protein, 9 aa, Dengue virus
NWASVKKDL

SEQ ID NO: 111086 - protein, 9 aa, Dengue virus
WADVRNDMI

SEQ ID NO: 111087 - protein, 9 aa, Dengue virus
ADVRNDMIS

SEQ ID NO: 111088 - protein, 9 aa, Dengue virus
DVRNDMISY

SEQ ID NO: 111089 - protein, 9 aa, Dengue virus
MISYGGGWR

SEQ ID NO: 111090 - protein, 9 aa, Dengue virus
ISYGGGWRF

SEQ ID NO: 111091 - protein, 9 aa, Dengue virus
WQKGEEVQV

SEQ ID NO: 111092 - protein, 9 aa, Dengue virus
QKGEEVQVI

SEQ ID NO: 111093 - protein, 9 aa, Dengue virus
KGEEVQVIA

SEQ ID NO: 111094 - protein, 9 aa, Dengue virus
EEDVQVLAI

SEQ ID NO: 111095 - protein, 9 aa, Dengue virus
EDVQVLAIE

SEQ ID NO: 111096 - protein, 9 aa, Dengue virus
DVQVLAIEP

SEQ ID NO: 111097 - protein, 9 aa, Dengue virus
VQVLAIEPG

SEQ ID NO: 111098 - protein, 9 aa, Dengue virus
QVLAIEPGK

SEQ ID NO: 111099 - protein, 9 aa, Dengue virus
VLAIEPGKN

SEQ ID NO: 111100 - protein, 9 aa, Dengue virus
LAIEPGKNP

SEQ ID NO: 111101 - protein, 9 aa, Dengue virus
AIEPGKNPK

SEQ ID NO: 111102 - protein, 9 aa, Dengue virus
IEPGKNPKH

SEQ ID NO: 111103 - protein, 9 aa, Dengue virus
EPGKNPKNF

SEQ ID NO: 111104 - protein, 9 aa, Dengue virus
PGKNPKNFQ

SEQ ID NO: 111105 - protein, 9 aa, Dengue virus
GKNPKNFQT

SEQ ID NO: 111106 - protein, 9 aa, Dengue virus
TGEIGAIAL

SEQ ID NO: 111107 - protein, 9 aa, Dengue virus
GEIGAIALD

SEQ ID NO: 111108 - protein, 9 aa, Dengue virus
EIGAIALDF

SEQ ID NO: 111109 - protein, 9 aa, Dengue virus
IGAIALDFK

SEQ ID NO: 111110 - protein, 9 aa, Dengue virus
GAVTLDFKP

SEQ ID NO: 111111 - protein, 9 aa, Dengue virus
AVTLDFKPG

SEQ ID NO: 111112 - protein, 9 aa, Dengue virus
VTLDFKPGT

SEQ ID NO: 111113 - protein, 9 aa, Dengue virus
TLDFKPGTS

SEQ ID NO: 111114 - protein, 9 aa, Dengue virus
GTSGSPIVD

SEQ ID NO: 111115 - protein, 9 aa, Dengue virus
TSGSPIVDR

SEQ ID NO: 111116 - protein, 9 aa, Dengue virus
EGKVVGLYG

SEQ ID NO: 111117 - protein, 9 aa, Dengue virus
GKVIGLYGN

SEQ ID NO: 111118 - protein, 9 aa, Dengue virus
KVIGLYGNG

SEQ ID NO: 111119 - protein, 9 aa, Dengue virus
VIGLYGNGV

SEQ ID NO: 111120 - protein, 9 aa, Dengue virus
LYGNGVVTK

SEQ ID NO: 111121 - protein, 9 aa, Dengue virus
YGNGVVTKN

SEQ ID NO: 111122 - protein, 9 aa, Dengue virus
GNGVVTKNG

SEQ ID NO: 111123 - protein, 9 aa, Dengue virus
NGVVTKNGG

SEQ ID NO: 111124 - protein, 9 aa, Dengue virus
GVVTKNGGY

SEQ ID NO: 111125 - protein, 9 aa, Dengue virus
VVTKNGGYV

SEQ ID NO: 111126 - protein, 9 aa, Dengue virus
VTKNGGYVS

SEQ ID NO: 111127 - protein, 9 aa, Dengue virus
NGGYVSGIA

SEQ ID NO: 111128 - protein, 9 aa, Dengue virus
GGYVSGIAQ

SEQ ID NO: 111129 - protein, 9 aa, Dengue virus
GYVSGIAQT

SEQ ID NO: 111130 - protein, 9 aa, Dengue virus
MFKKRNLTI

SEQ ID NO: 111131 - protein, 9 aa, Dengue virus
FRKKRLTIM

SEQ ID NO: 111132 - protein, 9 aa, Dengue virus
RKKRLTIMD

SEQ ID NO: 111133 - protein, 9 aa, Dengue virus
KRRLTIMDL

SEQ ID NO: 111134 - protein, 9 aa, Dengue virus
RRLTIMDLH

SEQ ID NO: 111135 - protein, 9 aa, Dengue virus
HPGSGKTRK

SEQ ID NO: 111136 - protein, 9 aa, Dengue virus
PGSGKTRKY

SEQ ID NO: 111137 - protein, 9 aa, Dengue virus
GSGKTRKYL

SEQ ID NO: 111138 - protein, 9 aa, Dengue virus
SGKTRKYLP

SEQ ID NO: 111139 - protein, 9 aa, Dengue virus
GKTRKYLPA

SEQ ID NO: 111140 - protein, 9 aa, Dengue virus
KTRKYLPAI

SEQ ID NO: 111141 - protein, 9 aa, Dengue virus
RILPSIVRE

SEQ ID NO: 111142 - protein, 9 aa, Dengue virus
YLPAIIREA

SEQ ID NO: 111143 - protein, 9 aa, Dengue virus
LPAIIREAI

SEQ ID NO: 111144 - protein, 9 aa, Dengue virus
PAIIREAIK

SEQ ID NO: 111145 - protein, 9 aa, Dengue virus
AIIREAIKR

SEQ ID NO: 111146 - protein, 9 aa, Dengue virus
REAIKRRLR

SEQ ID NO: 111147 - protein, 9 aa, Dengue virus
EAIKRRLRT

SEQ ID NO: 111148 - protein, 9 aa, Dengue virus
AIKRRLRTL

SEQ ID NO: 111149 - protein, 9 aa, Dengue virus
KRRLRTLIL

SEQ ID NO: 111150 - protein, 9 aa, Dengue virus
RRLRTLILA

SEQ ID NO: 111151 - protein, 9 aa, Dengue virus
RLRTLILAP

SEQ ID NO: 111152 - protein, 9 aa, Dengue virus
AAEMEEALK

SEQ ID NO: 111153 - protein, 9 aa, Dengue virus
AEMEEALKG

SEQ ID NO: 111154 - protein, 9 aa, Dengue virus
EMEEALKGL

SEQ ID NO: 111155 - protein, 9 aa, Dengue virus
MEEALKGLP

SEQ ID NO: 111156 - protein, 9 aa, Dengue virus
EEALKGLPI

SEQ ID NO: 111157 - protein, 9 aa, Dengue virus
EALKGLPIR

SEQ ID NO: 111158 - protein, 9 aa, Dengue virus
ALKGLPIRY

SEQ ID NO: 111159 - protein, 9 aa, Dengue virus
LKGLPIRYQ

SEQ ID NO: 111160 - protein, 9 aa, Dengue virus
KGLPIRYQT

SEQ ID NO: 111161 - protein, 9 aa, Dengue virus
GLPIRYQTT

SEQ ID NO: 111162 - protein, 9 aa, Dengue virus
LPIRYQTTA

SEQ ID NO: 111163 - protein, 9 aa, Dengue virus
PIRYQTTAT

SEQ ID NO: 111164 - protein, 9 aa, Dengue virus
RAEHTGREI

SEQ ID NO: 111165 - protein, 9 aa, Dengue virus
AEHTGREIV

SEQ ID NO: 111166 - protein, 9 aa, Dengue virus
FTMRLLSPI

SEQ ID NO: 111167 - protein, 9 aa, Dengue virus
TMRLLSPIR

SEQ ID NO: 111168 - protein, 9 aa, Dengue virus
MRLLSPIRV

SEQ ID NO: 111169 - protein, 9 aa, Dengue virus
RLLSPIRVP

SEQ ID NO: 111170 - protein, 9 aa, Dengue virus
LLSPIRVPN

SEQ ID NO: 111171 - protein, 9 aa, Dengue virus
LSPIRVPNY

SEQ ID NO: 111172 - protein, 9 aa, Dengue virus
SPIRVPNYN

SEQ ID NO: 111173 - protein, 9 aa, Dengue virus
STRVPNYNL

SEQ ID NO: 111174 - protein, 9 aa, Dengue virus
TRVPNYNLI

SEQ ID NO: 111175 - protein, 9 aa, Dengue virus
RVPNYNLIV

SEQ ID NO: 111176 - protein, 9 aa, Dengue virus
VPNYNLIVM

SEQ ID NO: 111177 - protein, 9 aa, Dengue virus
PNYNLIVMD

SEQ ID NO: 111178 - protein, 9 aa, Dengue virus
NYNLIVMDE

SEQ ID NO: 111179 - protein, 9 aa, Dengue virus
YNLIVMDEA

SEQ ID NO: 111180 - protein, 9 aa, Dengue virus
NLIVMDEAH

SEQ ID NO: 111181 - protein, 9 aa, Dengue virus
LIVMDEAHF

SEQ ID NO: 111182 - protein, 9 aa, Dengue virus
VIMDEAHFT

SEQ ID NO: 111183 - protein, 9 aa, Dengue virus
AHFTDPSSV

SEQ ID NO: 111184 - protein, 9 aa, Dengue virus
HFTDPSSVA

SEQ ID NO: 111185 - protein, 9 aa, Dengue virus
FTDPSSVAA

SEQ ID NO: 111186 - protein, 9 aa, Dengue virus
TDPSSVAAR

SEQ ID NO: 111187 - protein, 9 aa, Dengue virus
DPSSVAARG

SEQ ID NO: 111188 - protein, 9 aa, Dengue virus
PSSVAARGY

SEQ ID NO: 111189 - protein, 9 aa, Dengue virus
SSVAARGYI

SEQ ID NO: 111190 - protein, 9 aa, Dengue virus
RVEMGEAAA

SEQ ID NO: 111191 - protein, 9 aa, Dengue virus
VEMGEAAAI

SEQ ID NO: 111192 - protein, 9 aa, Dengue virus
EMGEAAAIF

SEQ ID NO: 111193 - protein, 9 aa, Dengue virus
FMTATPPGA

SEQ ID NO: 111194 - protein, 9 aa, Dengue virus
DAFPQSNAP

SEQ ID NO: 111195 - protein, 9 aa, Dengue virus
AFPQSNAPI

SEQ ID NO: 111196 - protein, 9 aa, Dengue virus
IIDEEREIP

SEQ ID NO: 111197 - protein, 9 aa, Dengue virus
IDEEREIPE

SEQ ID NO: 111198 - protein, 9 aa, Dengue virus
DIEREIPER

SEQ ID NO: 111199 - protein, 9 aa, Dengue virus
IEREIPERS

SEQ ID NO: 111200 - protein, 9 aa, Dengue virus
EKDIPERSW

SEQ ID NO: 111201 - protein, 9 aa, Dengue virus
KDIPERSWN

SEQ ID NO: 111202 - protein, 9 aa, Dengue virus
EIPERSWNT

SEQ ID NO: 111203 - protein, 9 aa, Dengue virus
PERSWNSGN

SEQ ID NO: 111204 - protein, 9 aa, Dengue virus
FAGKTVWFV

SEQ ID NO: 111205 - protein, 9 aa, Dengue virus
AGKTVWFVP

SEQ ID NO: 111206 - protein, 9 aa, Dengue virus
VWFVPSIKT

SEQ ID NO: 111207 - protein, 9 aa, Dengue virus
WFVPSIKTG

SEQ ID NO: 111208 - protein, 9 aa, Dengue virus
FVPSIKTGN

SEQ ID NO: 111209 - protein, 9 aa, Dengue virus
VPSIKTGND

SEQ ID NO: 111210 - protein, 9 aa, Dengue virus
PSIKTGNDI

SEQ ID NO: 111211 - protein, 9 aa, Dengue virus
SIKTGNDIA

SEQ ID NO: 111212 - protein, 9 aa, Dengue virus
IKAGNDIAN

SEQ ID NO: 111213 - protein, 9 aa, Dengue virus
KAGNDIANC

SEQ ID NO: 111214 - protein, 9 aa, Dengue virus
AGNDIANCL

SEQ ID NO: 111215 - protein, 9 aa, Dengue virus
DIANCLRKS

SEQ ID NO: 111216 - protein, 9 aa, Dengue virus
IANCLRKSG

SEQ ID NO: 111217 - protein, 9 aa, Dengue virus
ANCLRKSGK

SEQ ID NO: 111218 - protein, 9 aa, Dengue virus
NCLRKNGKK

SEQ ID NO: 111219 - protein, 9 aa, Dengue virus
CLRKSGKKV

SEQ ID NO: 111220 - protein, 9 aa, Dengue virus
LRKSGKKVI

SEQ ID NO: 111221 - protein, 9 aa, Dengue virus
RKSGKKVIQ

SEQ ID NO: 111222 - protein, 9 aa, Dengue virus
KSGKKVIQL

SEQ ID NO: 111223 - protein, 9 aa, Dengue virus
SGKKVIQLS

SEQ ID NO: 111224 - protein, 9 aa, Dengue virus
RKTFDTEYP

SEQ ID NO: 111225 - protein, 9 aa, Dengue virus
KTFDTEYPK

SEQ ID NO: 111226 - protein, 9 aa, Dengue virus
TFDTEYPKT

SEQ ID NO: 111227 - protein, 9 aa, Dengue virus
TNDWDFVVT

SEQ ID NO: 111228 - protein, 9 aa, Dengue virus
TDWDFVVTT

SEQ ID NO: 111229 - protein, 9 aa, Dengue virus
EMGANFKAD

SEQ ID NO: 111230 - protein, 9 aa, Dengue virus
MGANFKADR

SEQ ID NO: 111231 - protein, 9 aa, Dengue virus
GANFKADRV

SEQ ID NO: 111232 - protein, 9 aa, Dengue virus
ANFKADRVI

SEQ ID NO: 111233 - protein, 9 aa, Dengue virus
NFKADRVID

SEQ ID NO: 111234 - protein, 9 aa, Dengue virus
FKADRVIDP

SEQ ID NO: 111235 - protein, 9 aa, Dengue virus
KADRVIDPR

SEQ ID NO: 111236 - protein, 9 aa, Dengue virus
AGRVIDPRR

SEQ ID NO: 111237 - protein, 9 aa, Dengue virus
GRVIDPRRC

SEQ ID NO: 111238 - protein, 9 aa, Dengue virus
RCLKPVILT

SEQ ID NO: 111239 - protein, 9 aa, Dengue virus
CLKPVILTD

SEQ ID NO: 111240 - protein, 9 aa, Dengue virus
LKPVILTDG

SEQ ID NO: 111241 - protein, 9 aa, Dengue virus
KPVILTDGP

SEQ ID NO: 111242 - protein, 9 aa, Dengue virus
PVILTDGPE

SEQ ID NO: 111243 - protein, 9 aa, Dengue virus
VILTDGPER

SEQ ID NO: 111244 - protein, 9 aa, Dengue virus
ILTDGPERV

SEQ ID NO: 111245 - protein, 9 aa, Dengue virus
LTDGPERVI

SEQ ID NO: 111246 - protein, 9 aa, Dengue virus
TDGPERVIL

SEQ ID NO: 111247 - protein, 9 aa, Dengue virus
DGEERVVLA

SEQ ID NO: 111248 - protein, 9 aa, Dengue virus
LAGPMPVTA

SEQ ID NO: 111249 - protein, 9 aa, Dengue virus
AGPMPVTAA

SEQ ID NO: 111250 - protein, 9 aa, Dengue virus
GPMPVTAAS

SEQ ID NO: 111251 - protein, 9 aa, Dengue virus
PMPVTAASA

SEQ ID NO: 111252 - protein, 9 aa, Dengue virus
MPVTAASAA

SEQ ID NO: 111253 - protein, 9 aa, Dengue virus
PVTAASAAQ

SEQ ID NO: 111254 - protein, 9 aa, Dengue virus
VTAASAAQR

SEQ ID NO: 111255 - protein, 9 aa, Dengue virus
TAASAAQRR

SEQ ID NO: 111256 - protein, 9 aa, Dengue virus
AASAAQRRG

SEQ ID NO: 111257 - protein, 9 aa, Dengue virus
RRGRVGRNP

SEQ ID NO: 111258 - protein, 9 aa, Dengue virus
KENDQYIFT

SEQ ID NO: 111259 - protein, 9 aa, Dengue virus
ENDQYIFTG

SEQ ID NO: 111260 - protein, 9 aa, Dengue virus
NDQYIFTGQ

SEQ ID NO: 111261 - protein, 9 aa, Dengue virus
DQYIFTGQP

SEQ ID NO: 111262 - protein, 9 aa, Dengue virus
QYIFTGQPL

SEQ ID NO: 111263 - protein, 9 aa, Dengue virus
FTGQPLNND

SEQ ID NO: 111264 - protein, 9 aa, Dengue virus
TGQPLNNDE

SEQ ID NO: 111265 - protein, 9 aa, Dengue virus
GDPLKNDED

SEQ ID NO: 111266 - protein, 9 aa, Dengue virus
DPLKNDEDH

SEQ ID NO: 111267 - protein, 9 aa, Dengue virus
PLKNDEDHA

SEQ ID NO: 111268 - protein, 9 aa, Dengue virus
LKNDEDHAH

SEQ ID NO: 111269 - protein, 9 aa, Dengue virus
KNDEDHAHW

SEQ ID NO: 111270 - protein, 9 aa, Dengue virus
YTPEGIIPT

SEQ ID NO: 111271 - protein, 9 aa, Dengue virus
TPEGIIPTL

SEQ ID NO: 111272 - protein, 9 aa, Dengue virus
PEGIIPTLF

SEQ ID NO: 111273 - protein, 9 aa, Dengue virus
EGIIPTLFG

SEQ ID NO: 111274 - protein, 9 aa, Dengue virus
GIIPTLFGP

SEQ ID NO: 111275 - protein, 9 aa, Dengue virus
IIPTLFGPE

SEQ ID NO: 111276 - protein, 9 aa, Dengue virus
IPTLFGPER

SEQ ID NO: 111277 - protein, 9 aa, Dengue virus
PTLFGPERE

SEQ ID NO: 111278 - protein, 9 aa, Dengue virus
TLFGPEREK

SEQ ID NO: 111279 - protein, 9 aa, Dengue virus
LFGPEREKT

SEQ ID NO: 111280 - protein, 9 aa, Dengue virus
FGPEREKTQ

SEQ ID NO: 111281 - protein, 9 aa, Dengue virus
GPEREKTQA

SEQ ID NO: 111282 - protein, 9 aa, Dengue virus
PEREKTQAI

SEQ ID NO: 111283 - protein, 9 aa, Dengue virus
EREKTQAID

SEQ ID NO: 111284 - protein, 9 aa, Dengue virus
REKTQAIDG

SEQ ID NO: 111285 - protein, 9 aa, Dengue virus
EKTQAIDGE

SEQ ID NO: 111286 - protein, 9 aa, Dengue virus
KTQAIDGEF

SEQ ID NO: 111287 - protein, 9 aa, Dengue virus
TQAIDGEFR

SEQ ID NO: 111288 - protein, 9 aa, Dengue virus
QAIDGEFRL

SEQ ID NO: 111289 - protein, 9 aa, Dengue virus
AIDGEFRLR

SEQ ID NO: 111290 - protein, 9 aa, Dengue virus
IDGEFRLRG

SEQ ID NO: 111291 - protein, 9 aa, Dengue virus
DGEFRLRGE

SEQ ID NO: 111292 - protein, 9 aa, Dengue virus
GEFRLRGEQ

SEQ ID NO: 111293 - protein, 9 aa, Dengue virus
EFRLRGEQR

SEQ ID NO: 111294 - protein, 9 aa, Dengue virus
FRLRGEQRK

SEQ ID NO: 111295 - protein, 9 aa, Dengue virus
RLRGEQRKT

SEQ ID NO: 111296 - protein, 9 aa, Dengue virus
LRGEQRKTF

SEQ ID NO: 111297 - protein, 9 aa, Dengue virus
RGEQRKTFV

SEQ ID NO: 111298 - protein, 9 aa, Dengue virus
GESRKTFVE

SEQ ID NO: 111299 - protein, 9 aa, Dengue virus
ESRKTFVEL

SEQ ID NO: 111300 - protein, 9 aa, Dengue virus
SRKTFVELM

SEQ ID NO: 111301 - protein, 9 aa, Dengue virus
GDLPVWLAH

SEQ ID NO: 111302 - protein, 9 aa, Dengue virus
DLPVWLAHK

SEQ ID NO: 111303 - protein, 9 aa, Dengue virus
LPVWLAHKV

SEQ ID NO: 111304 - protein, 9 aa, Dengue virus
PVWLAHKVA

SEQ ID NO: 111305 - protein, 9 aa, Dengue virus
VWLAYKVAA

SEQ ID NO: 111306 - protein, 9 aa, Dengue virus
YADRRWCFD

SEQ ID NO: 111307 - protein, 9 aa, Dengue virus
TDRKWCFDG

SEQ ID NO: 111308 - protein, 9 aa, Dengue virus
RNNQILEEN

SEQ ID NO: 111309 - protein, 9 aa, Dengue virus
NNQILEENV

SEQ ID NO: 111310 - protein, 9 aa, Dengue virus
NQILEENMD

SEQ ID NO: 111311 - protein, 9 aa, Dengue virus
QILEENMDV

SEQ ID NO: 111312 - protein, 9 aa, Dengue virus
ILEENMDVE

SEQ ID NO: 111313 - protein, 9 aa, Dengue virus
LEENMEVEI

SEQ ID NO: 111314 - protein, 9 aa, Dengue virus
EENMEVEIW

SEQ ID NO: 111315 - protein, 9 aa, Dengue virus
ENMEVEIWT

SEQ ID NO: 111316 - protein, 9 aa, Dengue virus
NMEVEIWTK

SEQ ID NO: 111317 - protein, 9 aa, Dengue virus
MEVEIWTKE

SEQ ID NO: 111318 - protein, 9 aa, Dengue virus
EVEIWTREG

SEQ ID NO: 111319 - protein, 9 aa, Dengue virus
EKKKLRPRW

SEQ ID NO: 111320 - protein, 9 aa, Dengue virus
KKKLRPRWL

SEQ ID NO: 111321 - protein, 9 aa, Dengue virus
KKLRPKWLD

SEQ ID NO: 111322 - protein, 9 aa, Dengue virus
KLRPKWLDA

SEQ ID NO: 111323 - protein, 9 aa, Dengue virus
LRPKWLDAR

SEQ ID NO: 111324 - protein, 9 aa, Dengue virus
RPRWLDARV

SEQ ID NO: 111325 - protein, 9 aa, Dengue virus
PRWLDARVY

SEQ ID NO: 111326 - protein, 9 aa, Dengue virus
RWLDARVYA

SEQ ID NO: 111327 - protein, 9 aa, Dengue virus
WLDARVYAD

SEQ ID NO: 111328 - protein, 9 aa, Dengue virus
LDARVYADP

SEQ ID NO: 111329 - protein, 9 aa, Dengue virus
DARVYADPM

SEQ ID NO: 111330 - protein, 9 aa, Dengue virus
ARVYADPMA

SEQ ID NO: 111331 - protein, 9 aa, Dengue virus
RVYADPMAL

SEQ ID NO: 111332 - protein, 9 aa, Dengue virus
TYSDPLALK

SEQ ID NO: 111333 - protein, 9 aa, Dengue virus
YADPMALKD

SEQ ID NO: 111334 - protein, 9 aa, Dengue virus
ADPMALKDF

SEQ ID NO: 111335 - protein, 9 aa, Dengue virus
DPMALKDFK

SEQ ID NO: 111336 - protein, 9 aa, Dengue virus
PLALKEFKD

SEQ ID NO: 111337 - protein, 9 aa, Dengue virus
LALKEFKDF

SEQ ID NO: 111338 - protein, 9 aa, Dengue virus
ALKEFKDFA

SEQ ID NO: 111339 - protein, 9 aa, Dengue virus
LKEFKDFAA

SEQ ID NO: 111340 - protein, 9 aa, Dengue virus
KEFKDFAAG

SEQ ID NO: 111341 - protein, 9 aa, Dengue virus
DFKEFASGR

SEQ ID NO: 111342 - protein, 9 aa, Dengue virus
FKDFAAGRK

SEQ ID NO: 111343 - protein, 9 aa, Dengue virus
KDFAAGRKS

SEQ ID NO: 111344 - protein, 9 aa, Dengue virus
DFAAGRKSI

SEQ ID NO: 111345 - protein, 9 aa, Dengue virus
FAAGRKSIA

SEQ ID NO: 111346 - protein, 9 aa, Dengue virus
AAGRKSIAL

SEQ ID NO: 111347 - protein, 9 aa, Dengue virus
DLVTEIGRV

SEQ ID NO: 111348 - protein, 9 aa, Dengue virus
LVTEIGRVP

SEQ ID NO: 111349 - protein, 9 aa, Dengue virus
VTEIGRVPS

SEQ ID NO: 111350 - protein, 9 aa, Dengue virus
TEIGRVPSH

SEQ ID NO: 111351 - protein, 9 aa, Dengue virus
EIGRVPSHL

SEQ ID NO: 111352 - protein, 9 aa, Dengue virus
IGRVPSHLA

SEQ ID NO: 111353 - protein, 9 aa, Dengue virus
RDALDNLAV

SEQ ID NO: 111354 - protein, 9 aa, Dengue virus
NALDNLAVL

SEQ ID NO: 111355 - protein, 9 aa, Dengue virus
ALDNIVMLH

SEQ ID NO: 111356 - protein, 9 aa, Dengue virus
LDNLVMLHT

SEQ ID NO: 111357 - protein, 9 aa, Dengue virus
DNLVMLHTS

SEQ ID NO: 111358 - protein, 9 aa, Dengue virus
NLVMLHTSE

SEQ ID NO: 111359 - protein, 9 aa, Dengue virus
AYRHAVEEL

SEQ ID NO: 111360 - protein, 9 aa, Dengue virus
YRHAVEELP

SEQ ID NO: 111361 - protein, 9 aa, Dengue virus
RHAVEELPE

SEQ ID NO: 111362 - protein, 9 aa, Dengue virus
HAVEELPET

SEQ ID NO: 111363 - protein, 9 aa, Dengue virus
AVEELPETM

SEQ ID NO: 111364 - protein, 9 aa, Dengue virus
VEELPETME

SEQ ID NO: 111365 - protein, 9 aa, Dengue virus
EELPETMET

SEQ ID NO: 111366 - protein, 9 aa, Dengue virus
ELPETMETL

SEQ ID NO: 111367 - protein, 9 aa, Dengue virus
LPETMETLL

SEQ ID NO: 111368 - protein, 9 aa, Dengue virus
PETMETLLL

SEQ ID NO: 111369 - protein, 9 aa, Dengue virus
ETMETLLLL

SEQ ID NO: 111370 - protein, 9 aa, Dengue virus
TMETLLLLG

SEQ ID NO: 111371 - protein, 9 aa, Dengue virus
METLLLLGL

SEQ ID NO: 111372 - protein, 9 aa, Dengue virus
ETLLLLGLM

SEQ ID NO: 111373 - protein, 9 aa, Dengue virus
TLLLLGLMI

SEQ ID NO: 111374 - protein, 9 aa, Dengue virus
LTGGAMLFL

SEQ ID NO: 111375 - protein, 9 aa, Dengue virus
GKTSIGLIC

SEQ ID NO: 111376 - protein, 9 aa, Dengue virus
KTSIGLICV

SEQ ID NO: 111377 - protein, 9 aa, Dengue virus
IPLQWIASA

SEQ ID NO: 111378 - protein, 9 aa, Dengue virus
PLQWIASAI

SEQ ID NO: 111379 - protein, 9 aa, Dengue virus
PQWIAASII

SEQ ID NO: 111380 - protein, 9 aa, Dengue virus
QWIAASIIL

SEQ ID NO: 111381 - protein, 9 aa, Dengue virus
AIVLEFFMM

SEQ ID NO: 111382 - protein, 9 aa, Dengue virus
IVLEFFMMV

SEQ ID NO: 111383 - protein, 9 aa, Dengue virus
VLEFFMMVL

SEQ ID NO: 111384 - protein, 9 aa, Dengue virus
LEFFMMVLL

SEQ ID NO: 111385 - protein, 9 aa, Dengue virus
EFFMMVLLI

SEQ ID NO: 111386 - protein, 9 aa, Dengue virus
FFMMVLLIP

SEQ ID NO: 111387 - protein, 9 aa, Dengue virus
FMMVLLIPE

SEQ ID NO: 111388 - protein, 9 aa, Dengue virus
MMVLLIPEP

SEQ ID NO: 111389 - protein, 9 aa, Dengue virus
MVLLIPEPE

SEQ ID NO: 111390 - protein, 9 aa, Dengue virus
RTPQDNQLI

SEQ ID NO: 111391 - protein, 9 aa, Dengue virus
TPQDNQLIY

SEQ ID NO: 111392 - protein, 9 aa, Dengue virus
PQDNQLIYV

SEQ ID NO: 111393 - protein, 9 aa, Dengue virus
QDNQLIYVI

SEQ ID NO: 111394 - protein, 9 aa, Dengue virus
DNQLIYVIL

SEQ ID NO: 111395 - protein, 9 aa, Dengue virus
NQLIYVILT

SEQ ID NO: 111396 - protein, 9 aa, Dengue virus
QLAYVVIGI

SEQ ID NO: 111397 - protein, 9 aa, Dengue virus
LAYVVIGIL

SEQ ID NO: 111398 - protein, 9 aa, Dengue virus
AYVVIGILT

SEQ ID NO: 111399 - protein, 9 aa, Dengue virus
IAANEMGLL

SEQ ID NO: 111400 - protein, 9 aa, Dengue virus
AANEMGLIE

SEQ ID NO: 111401 - protein, 9 aa, Dengue virus
ANEMGLIEK

SEQ ID NO: 111402 - protein, 9 aa, Dengue virus
NEMGLIEKT

SEQ ID NO: 111403 - protein, 9 aa, Dengue virus
EMGLIEKTK

SEQ ID NO: 111404 - protein, 9 aa, Dengue virus
MGLLETTKR

SEQ ID NO: 111405 - protein, 9 aa, Dengue virus
GLLETTKRD

SEQ ID NO: 111406 - protein, 9 aa, Dengue virus
LLETTKRDL

SEQ ID NO: 111407 - protein, 9 aa, Dengue virus
LETTKRDLG

SEQ ID NO: 111408 - protein, 9 aa, Dengue virus
LDVDLRPAS

SEQ ID NO: 111409 - protein, 9 aa, Dengue virus
DVDLRPASA

SEQ ID NO: 111410 - protein, 9 aa, Dengue virus
VDLRPASAW

SEQ ID NO: 111411 - protein, 9 aa, Dengue virus
TLYAVATTV

SEQ ID NO: 111412 - protein, 9 aa, Dengue virus
LYAVATTFV

SEQ ID NO: 111413 - protein, 9 aa, Dengue virus
YAVATTFVT

SEQ ID NO: 111414 - protein, 9 aa, Dengue virus
AVATTFVTP

SEQ ID NO: 111415 - protein, 9 aa, Dengue virus
VATTFVTPM

SEQ ID NO: 111416 - protein, 9 aa, Dengue virus
ITPMLRHTI

SEQ ID NO: 111417 - protein, 9 aa, Dengue virus
TPMLRHTIE

SEQ ID NO: 111418 - protein, 9 aa, Dengue virus
PMLRHTIEN

SEQ ID NO: 111419 - protein, 9 aa, Dengue virus
MLRHTIENS

SEQ ID NO: 111420 - protein, 9 aa, Dengue virus
LRHTIENST

SEQ ID NO: 111421 - protein, 9 aa, Dengue virus
RHTIENSTA

SEQ ID NO: 111422 - protein, 9 aa, Dengue virus
HTIENSTAN

SEQ ID NO: 111423 - protein, 9 aa, Dengue virus
TIENSTANV

SEQ ID NO: 111424 - protein, 9 aa, Dengue virus
IENSTANVS

SEQ ID NO: 111425 - protein, 9 aa, Dengue virus
ENSTANVSL

SEQ ID NO: 111426 - protein, 9 aa, Dengue virus
NSTANVSLA

SEQ ID NO: 111427 - protein, 9 aa, Dengue virus
STANVSLAA

SEQ ID NO: 111428 - protein, 9 aa, Dengue virus
TANVSLAAI

SEQ ID NO: 111429 - protein, 9 aa, Dengue virus
ANVSLAAIA

SEQ ID NO: 111430 - protein, 9 aa, Dengue virus
NVSLAAIAN

SEQ ID NO: 111431 - protein, 9 aa, Dengue virus
VSLAAIANQ

SEQ ID NO: 111432 - protein, 9 aa, Dengue virus
LAAIANQAV

SEQ ID NO: 111433 - protein, 9 aa, Dengue virus
AAIANQAVV

SEQ ID NO: 111434 - protein, 9 aa, Dengue virus
AIANQAVVL

SEQ ID NO: 111435 - protein, 9 aa, Dengue virus
IANQAVVLM

SEQ ID NO: 111436 - protein, 9 aa, Dengue virus
ANQAVVLMG

SEQ ID NO: 111437 - protein, 9 aa, Dengue virus
NQAVVLMGL

SEQ ID NO: 111438 - protein, 9 aa, Dengue virus
QAVVLMGLD

SEQ ID NO: 111439 - protein, 9 aa, Dengue virus
AVVLMGLDK

SEQ ID NO: 111440 - protein, 9 aa, Dengue virus
VVLMGLDKG

SEQ ID NO: 111441 - protein, 9 aa, Dengue virus
VLMGLDKGW

SEQ ID NO: 111442 - protein, 9 aa, Dengue virus
LMGLGRGWP

SEQ ID NO: 111443 - protein, 9 aa, Dengue virus
MGLGRGWPL

SEQ ID NO: 111444 - protein, 9 aa, Dengue virus
GLGKGWPLH

SEQ ID NO: 111445 - protein, 9 aa, Dengue virus
LGKGWPLHR

SEQ ID NO: 111446 - protein, 9 aa, Dengue virus
GKGWPLHRM

SEQ ID NO: 111447 - protein, 9 aa, Dengue virus
KGWPLHRMD

SEQ ID NO: 111448 - protein, 9 aa, Dengue virus
GWPISKMDL

SEQ ID NO: 111449 - protein, 9 aa, Dengue virus
WPISKMDLG

SEQ ID NO: 111450 - protein, 9 aa, Dengue virus
PISKMDLGV

SEQ ID NO: 111451 - protein, 9 aa, Dengue virus
ISKMDLGVP

SEQ ID NO: 111452 - protein, 9 aa, Dengue virus
HRMDLGVPL

SEQ ID NO: 111453 - protein, 9 aa, Dengue virus
RMDLGVPLL

SEQ ID NO: 111454 - protein, 9 aa, Dengue virus
DLGVPLLAL

SEQ ID NO: 111455 - protein, 9 aa, Dengue virus
LGVPLLALG

SEQ ID NO: 111456 - protein, 9 aa, Dengue virus
GVPLLAMGC

SEQ ID NO: 111457 - protein, 9 aa, Dengue virus
VPLLAMGCY

SEQ ID NO: 111458 - protein, 9 aa, Dengue virus
PLLAMGCYS

SEQ ID NO: 111459 - protein, 9 aa, Dengue virus
LLAMGCYSQ

SEQ ID NO: 111460 - protein, 9 aa, Dengue virus
LAMGCYSQV

SEQ ID NO: 111461 - protein, 9 aa, Dengue virus
AMGCYSQVN

SEQ ID NO: 111462 - protein, 9 aa, Dengue virus
MGCYSQVNP

SEQ ID NO: 111463 - protein, 9 aa, Dengue virus
GCYSQVNPT

SEQ ID NO: 111464 - protein, 9 aa, Dengue virus
CYSQVNPTT

SEQ ID NO: 111465 - protein, 9 aa, Dengue virus
YSQVNPTTL

SEQ ID NO: 111466 - protein, 9 aa, Dengue virus
SQVNPTTLT

SEQ ID NO: 111467 - protein, 9 aa, Dengue virus
QVNPTTLTA

SEQ ID NO: 111468 - protein, 9 aa, Dengue virus
VNPTTLTAS

SEQ ID NO: 111469 - protein, 9 aa, Dengue virus
NPTTLTASL

SEQ ID NO: 111470 - protein, 9 aa, Dengue virus
LVTHYAIIG

SEQ ID NO: 111471 - protein, 9 aa, Dengue virus
VTHYAIIGP

SEQ ID NO: 111472 - protein, 9 aa, Dengue virus
VHYAIIGPG

SEQ ID NO: 111473 - protein, 9 aa, Dengue virus
KNPTVDGIM

SEQ ID NO: 111474 - protein, 9 aa, Dengue virus
NPTVDGIMT

SEQ ID NO: 111475 - protein, 9 aa, Dengue virus
PTVDGIMTI

SEQ ID NO: 111476 - protein, 9 aa, Dengue virus
VIDLDPIPY

SEQ ID NO: 111477 - protein, 9 aa, Dengue virus
IDLDPIPYD

SEQ ID NO: 111478 - protein, 9 aa, Dengue virus
PVIYDSKFE

SEQ ID NO: 111479 - protein, 9 aa, Dengue virus
VIYDSKFEK

SEQ ID NO: 111480 - protein, 9 aa, Dengue virus
IYDSKFEKQ

SEQ ID NO: 111481 - protein, 9 aa, Dengue virus
YDSKFEKQL

SEQ ID NO: 111482 - protein, 9 aa, Dengue virus
DSKFEKQLG

SEQ ID NO: 111483 - protein, 9 aa, Dengue virus
SKFEKQLGQ

SEQ ID NO: 111484 - protein, 9 aa, Dengue virus
QLGQVMLLI

SEQ ID NO: 111485 - protein, 9 aa, Dengue virus
LGQVMLLIL

SEQ ID NO: 111486 - protein, 9 aa, Dengue virus
GQVMLLILC

SEQ ID NO: 111487 - protein, 9 aa, Dengue virus
QVMLLILCV

SEQ ID NO: 111488 - protein, 9 aa, Dengue virus
LCAVQLLLM

SEQ ID NO: 111489 - protein, 9 aa, Dengue virus
CAVQLLLMR

SEQ ID NO: 111490 - protein, 9 aa, Dengue virus
AVQLLLMRT

SEQ ID NO: 111491 - protein, 9 aa, Dengue virus
VQLLLMRTS

SEQ ID NO: 111492 - protein, 9 aa, Dengue virus
QLLLMRTSW

SEQ ID NO: 111493 - protein, 9 aa, Dengue virus
LLLMRTSWA

SEQ ID NO: 111494 - protein, 9 aa, Dengue virus
LLMRTSWAL

SEQ ID NO: 111495 - protein, 9 aa, Dengue virus
LMRTSWALC

SEQ ID NO: 111496 - protein, 9 aa, Dengue virus
MRTTWAFCE

SEQ ID NO: 111497 - protein, 9 aa, Dengue virus
RTSWALCEA

SEQ ID NO: 111498 - protein, 9 aa, Dengue virus
TSWALCEAL

SEQ ID NO: 111499 - protein, 9 aa, Dengue virus
SWALCEALT

SEQ ID NO: 111500 - protein, 9 aa, Dengue virus
WAFCEVLTL

SEQ ID NO: 111501 - protein, 9 aa, Dengue virus
AFCEVLTLA

SEQ ID NO: 111502 - protein, 9 aa, Dengue virus
FCEVLTLAT

SEQ ID NO: 111503 - protein, 9 aa, Dengue virus
CEVLTLATG

SEQ ID NO: 111504 - protein, 9 aa, Dengue virus
EVLTLATGP

SEQ ID NO: 111505 - protein, 9 aa, Dengue virus
VLTLATGPI

SEQ ID NO: 111506 - protein, 9 aa, Dengue virus
LTLATGPIT

SEQ ID NO: 111507 - protein, 9 aa, Dengue virus
TLATGPITT

SEQ ID NO: 111508 - protein, 9 aa, Dengue virus
LATGPITTL

SEQ ID NO: 111509 - protein, 9 aa, Dengue virus
ATGPITTLW

SEQ ID NO: 111510 - protein, 9 aa, Dengue virus
TGPITTLWE

SEQ ID NO: 111511 - protein, 9 aa, Dengue virus
GPITTLWEG

SEQ ID NO: 111512 - protein, 9 aa, Dengue virus
PITTLWEGS

SEQ ID NO: 111513 - protein, 9 aa, Dengue virus
ITTLWEGSP

SEQ ID NO: 111514 - protein, 9 aa, Dengue virus
LTLWEGNPG

SEQ ID NO: 111515 - protein, 9 aa, Dengue virus
AGAGLAFSI

SEQ ID NO: 111516 - protein, 9 aa, Dengue virus
GAGLAFSIM

SEQ ID NO: 111517 - protein, 9 aa, Dengue virus
AGLAFSIMK

SEQ ID NO: 111518 - protein, 9 aa, Dengue virus
GLAFSIMKS

SEQ ID NO: 111519 - protein, 9 aa, Dengue virus
LAFSIMKSV

SEQ ID NO: 111520 - protein, 9 aa, Dengue virus
TGETLGEKW

SEQ ID NO: 111521 - protein, 9 aa, Dengue virus
ETLGEKWKK

SEQ ID NO: 111522 - protein, 9 aa, Dengue virus
TLGEKWKKK

SEQ ID NO: 111523 - protein, 9 aa, Dengue virus
LGEKWKKKL

SEQ ID NO: 111524 - protein, 9 aa, Dengue virus
GEKWKKKLN

SEQ ID NO: 111525 - protein, 9 aa, Dengue virus
EVDRTEAKE

SEQ ID NO: 111526 - protein, 9 aa, Dengue virus
VDRTEAKEG

SEQ ID NO: 111527 - protein, 9 aa, Dengue virus
DRTEAKEGL

SEQ ID NO: 111528 - protein, 9 aa, Dengue virus
EAKSALKDG

SEQ ID NO: 111529 - protein, 9 aa, Dengue virus
AKSALKDGS

SEQ ID NO: 111530 - protein, 9 aa, Dengue virus
KEGLKRGEI

SEQ ID NO: 111531 - protein, 9 aa, Dengue virus
RHAVSRGTA

SEQ ID NO: 111532 - protein, 9 aa, Dengue virus
HAVSRGSSK

SEQ ID NO: 111533 - protein, 9 aa, Dengue virus
AVSRGSSKI

SEQ ID NO: 111534 - protein, 9 aa, Dengue virus
VSRGSAKLQ

SEQ ID NO: 111535 - protein, 9 aa, Dengue virus
SRGSAKLQW

SEQ ID NO: 111536 - protein, 9 aa, Dengue virus
RGSAKLQWF

SEQ ID NO: 111537 - protein, 9 aa, Dengue virus
GSAKLQWFV

SEQ ID NO: 111538 - protein, 9 aa, Dengue virus
SAKLQWFVE

SEQ ID NO: 111539 - protein, 9 aa, Dengue virus
SKIRWIVER

SEQ ID NO: 111540 - protein, 9 aa, Dengue virus
KIRWIVERG

SEQ ID NO: 111541 - protein, 9 aa, Dengue virus
LQWFVERNM

SEQ ID NO: 111542 - protein, 9 aa, Dengue virus
QWFVERNMV

SEQ ID NO: 111543 - protein, 9 aa, Dengue virus
PEGRVIDLG

SEQ ID NO: 111544 - protein, 9 aa, Dengue virus
EGRVIDLGC

SEQ ID NO: 111545 - protein, 9 aa, Dengue virus
GRVIDLGCG

SEQ ID NO: 111546 - protein, 9 aa, Dengue virus
RVIDLGCGR

SEQ ID NO: 111547 - protein, 9 aa, Dengue virus
RGGWSYYMA

SEQ ID NO: 111548 - protein, 9 aa, Dengue virus
GGWSYYMAT

SEQ ID NO: 111549 - protein, 9 aa, Dengue virus
GWSYYMATL

SEQ ID NO: 111550 - protein, 9 aa, Dengue virus
WSYYMATLK

SEQ ID NO: 111551 - protein, 9 aa, Dengue virus
SYYMATLKN

SEQ ID NO: 111552 - protein, 9 aa, Dengue virus
YYMATLKNV

SEQ ID NO: 111553 - protein, 9 aa, Dengue virus
YMATLKNVT

SEQ ID NO: 111554 - protein, 9 aa, Dengue virus
MATLKNVTE

SEQ ID NO: 111555 - protein, 9 aa, Dengue virus
ATLKNVTEV

SEQ ID NO: 111556 - protein, 9 aa, Dengue virus
VTEVRGYTK

SEQ ID NO: 111557 - protein, 9 aa, Dengue virus
TEVRGYTKG

SEQ ID NO: 111558 - protein, 9 aa, Dengue virus
EVRGYTKGG

SEQ ID NO: 111559 - protein, 9 aa, Dengue virus
VRGYTKGGP

SEQ ID NO: 111560 - protein, 9 aa, Dengue virus
RGYTKGGPG

SEQ ID NO: 111561 - protein, 9 aa, Dengue virus
GHEEPVPMS

SEQ ID NO: 111562 - protein, 9 aa, Dengue virus
HEEPVPMST

SEQ ID NO: 111563 - protein, 9 aa, Dengue virus
EEPVPMSTY

SEQ ID NO: 111564 - protein, 9 aa, Dengue virus
EPVPMSTYG

SEQ ID NO: 111565 - protein, 9 aa, Dengue virus
PVPMSTYGW

SEQ ID NO: 111566 - protein, 9 aa, Dengue virus
VPMSTYGWN

SEQ ID NO: 111567 - protein, 9 aa, Dengue virus
PMSTYGWNI

SEQ ID NO: 111568 - protein, 9 aa, Dengue virus
MSTYGWNIV

SEQ ID NO: 111569 - protein, 9 aa, Dengue virus
STYGWNIVK

SEQ ID NO: 111570 - protein, 9 aa, Dengue virus
TYGWNIVKL

SEQ ID NO: 111571 - protein, 9 aa, Dengue virus
YGWNIVKLM

SEQ ID NO: 111572 - protein, 9 aa, Dengue virus
GWNIVKLMS

SEQ ID NO: 111573 - protein, 9 aa, Dengue virus
WNIVKLMSG

SEQ ID NO: 111574 - protein, 9 aa, Dengue virus
LMSGKDVFY

SEQ ID NO: 111575 - protein, 9 aa, Dengue virus
PPERCDTLL

SEQ ID NO: 111576 - protein, 9 aa, Dengue virus
PERCDTLLC

SEQ ID NO: 111577 - protein, 9 aa, Dengue virus
ERCDTLLCD

SEQ ID NO: 111578 - protein, 9 aa, Dengue virus
RCDTLLCDI

SEQ ID NO: 111579 - protein, 9 aa, Dengue virus
CDIGESSSN

SEQ ID NO: 111580 - protein, 9 aa, Dengue virus
DIGESSSNP

SEQ ID NO: 111581 - protein, 9 aa, Dengue virus
IGESSSNPT

SEQ ID NO: 111582 - protein, 9 aa, Dengue virus
GESSPNPTV

SEQ ID NO: 111583 - protein, 9 aa, Dengue virus
ESSPNPTVE

SEQ ID NO: 111584 - protein, 9 aa, Dengue virus
SSPNPTIEA

SEQ ID NO: 111585 - protein, 9 aa, Dengue virus
SPNPTIEAG

SEQ ID NO: 111586 - protein, 9 aa, Dengue virus
PNPTIEAGR

SEQ ID NO: 111587 - protein, 9 aa, Dengue virus
NPTIEAGRT

SEQ ID NO: 111588 - protein, 9 aa, Dengue virus
PTIEAGRTL

SEQ ID NO: 111589 - protein, 9 aa, Dengue virus
TIEAGRTLR

SEQ ID NO: 111590 - protein, 9 aa, Dengue virus
IEAGRTLRV

SEQ ID NO: 111591 - protein, 9 aa, Dengue virus
EESRTIRVL

SEQ ID NO: 111592 - protein, 9 aa, Dengue virus
ESRTIRVLK

SEQ ID NO: 111593 - protein, 9 aa, Dengue virus
SRTIRVLKM

SEQ ID NO: 111594 - protein, 9 aa, Dengue virus
RTIRVLKMV

SEQ ID NO: 111595 - protein, 9 aa, Dengue virus
TIRVLKMVE

SEQ ID NO: 111596 - protein, 9 aa, Dengue virus
IRVLKMVEP

SEQ ID NO: 111597 - protein, 9 aa, Dengue virus
RVLSLVENW

SEQ ID NO: 111598 - protein, 9 aa, Dengue virus
VLSLVENWL

SEQ ID NO: 111599 - protein, 9 aa, Dengue virus
LKMVEPWLK

SEQ ID NO: 111600 - protein, 9 aa, Dengue virus
EFCIKVLNP

SEQ ID NO: 111601 - protein, 9 aa, Dengue virus
FCVKVLNPY

SEQ ID NO: 111602 - protein, 9 aa, Dengue virus
CVKVLNPYM

SEQ ID NO: 111603 - protein, 9 aa, Dengue virus
VKVLNPYMP

SEQ ID NO: 111604 - protein, 9 aa, Dengue virus
KVLNPYMPT

SEQ ID NO: 111605 - protein, 9 aa, Dengue virus
VLNPYMPTV

SEQ ID NO: 111606 - protein, 9 aa, Dengue virus
LNPYMPTVI

SEQ ID NO: 111607 - protein, 9 aa, Dengue virus
NPYMPTVIE

SEQ ID NO: 111608 - protein, 9 aa, Dengue virus
YGGMLVRNP

SEQ ID NO: 111609 - protein, 9 aa, Dengue virus
GGNLVRCPL

SEQ ID NO: 111610 - protein, 9 aa, Dengue virus
GNLVRCPLS

SEQ ID NO: 111611 - protein, 9 aa, Dengue virus
NLVRCPLSR

SEQ ID NO: 111612 - protein, 9 aa, Dengue virus
THEMYWISN

SEQ ID NO: 111613 - protein, 9 aa, Dengue virus
HEMYWISNG

SEQ ID NO: 111614 - protein, 9 aa, Dengue virus
EMYWVSNAT

SEQ ID NO: 111615 - protein, 9 aa, Dengue virus
MYWVSNATG

SEQ ID NO: 111616 - protein, 9 aa, Dengue virus
YWVSNATGN

SEQ ID NO: 111617 - protein, 9 aa, Dengue virus
WVSNATGNI

SEQ ID NO: 111618 - protein, 9 aa, Dengue virus
VSNATGNIV

SEQ ID NO: 111619 - protein, 9 aa, Dengue virus
ATGNIVSSV

SEQ ID NO: 111620 - protein, 9 aa, Dengue virus
SGNIVSSVN

SEQ ID NO: 111621 - protein, 9 aa, Dengue virus
GNIVASVNM

SEQ ID NO: 111622 - protein, 9 aa, Dengue virus
NIVASVNMV

SEQ ID NO: 111623 - protein, 9 aa, Dengue virus
IVASVNMVS

SEQ ID NO: 111624 - protein, 9 aa, Dengue virus
VASVNMVSR

SEQ ID NO: 111625 - protein, 9 aa, Dengue virus
ASVNMVSRL

SEQ ID NO: 111626 - protein, 9 aa, Dengue virus
SVNMVSRLL

SEQ ID NO: 111627 - protein, 9 aa, Dengue virus
VNMVSRLLL

SEQ ID NO: 111628 - protein, 9 aa, Dengue virus
NMVSRLLLN

SEQ ID NO: 111629 - protein, 9 aa, Dengue virus
MVSRLLLNR

SEQ ID NO: 111630 - protein, 9 aa, Dengue virus
VSRLLLNRF

SEQ ID NO: 111631 - protein, 9 aa, Dengue virus
SRLLLNRFT

SEQ ID NO: 111632 - protein, 9 aa, Dengue virus
RLLLNRFTM

SEQ ID NO: 111633 - protein, 9 aa, Dengue virus
PTIEKDVDL

SEQ ID NO: 111634 - protein, 9 aa, Dengue virus
TIEKDVDLG

SEQ ID NO: 111635 - protein, 9 aa, Dengue virus
EKDVDLGAG

SEQ ID NO: 111636 - protein, 9 aa, Dengue virus
KDVDLGAGT

SEQ ID NO: 111637 - protein, 9 aa, Dengue virus
DVDLGTGTR

SEQ ID NO: 111638 - protein, 9 aa, Dengue virus
VDLGAGTRS

SEQ ID NO: 111639 - protein, 9 aa, Dengue virus
DLGAGTRSV

SEQ ID NO: 111640 - protein, 9 aa, Dengue virus
LGAGTRHVN

SEQ ID NO: 111641 - protein, 9 aa, Dengue virus
GAGTRHVNA

SEQ ID NO: 111642 - protein, 9 aa, Dengue virus
AGTRHVNAE

SEQ ID NO: 111643 - protein, 9 aa, Dengue virus
PNMDVIGER

SEQ ID NO: 111644 - protein, 9 aa, Dengue virus
NMDVIGERI

SEQ ID NO: 111645 - protein, 9 aa, Dengue virus
DVIGERIKR

SEQ ID NO: 111646 - protein, 9 aa, Dengue virus
VIGERIKRI

SEQ ID NO: 111647 - protein, 9 aa, Dengue virus
IGERIKRIK

SEQ ID NO: 111648 - protein, 9 aa, Dengue virus
TWHYDDENP

SEQ ID NO: 111649 - protein, 9 aa, Dengue virus
WHYDDENPY

SEQ ID NO: 111650 - protein, 9 aa, Dengue virus
HYDDENPYK

SEQ ID NO: 111651 - protein, 9 aa, Dengue virus
YDDENPYKT

SEQ ID NO: 111652 - protein, 9 aa, Dengue virus
DDENPYKTW

SEQ ID NO: 111653 - protein, 9 aa, Dengue virus
DENPYKTWA

SEQ ID NO: 111654 - protein, 9 aa, Dengue virus
ENPYKTWAY

SEQ ID NO: 111655 - protein, 9 aa, Dengue virus
NPYRTWAYH

SEQ ID NO: 111656 - protein, 9 aa, Dengue virus
WAYHGSYEA

SEQ ID NO: 111657 - protein, 9 aa, Dengue virus
AYHGSYEAP

SEQ ID NO: 111658 - protein, 9 aa, Dengue virus
YHGSYEVKA

SEQ ID NO: 111659 - protein, 9 aa, Dengue virus
HGSYEVKAT

SEQ ID NO: 111660 - protein, 9 aa, Dengue virus
GSYEVKATG

SEQ ID NO: 111661 - protein, 9 aa, Dengue virus
SYEVKATGS

SEQ ID NO: 111662 - protein, 9 aa, Dengue virus
YEVKATGSA

SEQ ID NO: 111663 - protein, 9 aa, Dengue virus
EVKATGSAS

SEQ ID NO: 111664 - protein, 9 aa, Dengue virus
VKATGSASS

SEQ ID NO: 111665 - protein, 9 aa, Dengue virus
KATGSASSM

SEQ ID NO: 111666 - protein, 9 aa, Dengue virus
ATGSASSMI

SEQ ID NO: 111667 - protein, 9 aa, Dengue virus
TGSASSMIN

SEQ ID NO: 111668 - protein, 9 aa, Dengue virus
SSMINGVVK

SEQ ID NO: 111669 - protein, 9 aa, Dengue virus
SMINGVVKL

SEQ ID NO: 111670 - protein, 9 aa, Dengue virus
MINGVVKLL

SEQ ID NO: 111671 - protein, 9 aa, Dengue virus
INGVVKLLT

SEQ ID NO: 111672 - protein, 9 aa, Dengue virus
LLTKPWDVL

SEQ ID NO: 111673 - protein, 9 aa, Dengue virus
LTKPWDVLP

SEQ ID NO: 111674 - protein, 9 aa, Dengue virus
TKPWDVLPT

SEQ ID NO: 111675 - protein, 9 aa, Dengue virus
KPWDVLPTV

SEQ ID NO: 111676 - protein, 9 aa, Dengue virus
PWDVLPTVT

SEQ ID NO: 111677 - protein, 9 aa, Dengue virus
WDVLPTVTQ

SEQ ID NO: 111678 - protein, 9 aa, Dengue virus
PTVTQMAMT

SEQ ID NO: 111679 - protein, 9 aa, Dengue virus
TVTQMAMTD

SEQ ID NO: 111680 - protein, 9 aa, Dengue virus
VTQLAMTDT

SEQ ID NO: 111681 - protein, 9 aa, Dengue virus
TQLAMTDTT

SEQ ID NO: 111682 - protein, 9 aa, Dengue virus
QLAMTDTTP

SEQ ID NO: 111683 - protein, 9 aa, Dengue virus
LAMTDTTPF

SEQ ID NO: 111684 - protein, 9 aa, Dengue virus
EKVDTRTPR

SEQ ID NO: 111685 - protein, 9 aa, Dengue virus
PRLCTREEF

SEQ ID NO: 111686 - protein, 9 aa, Dengue virus
CTREEFISK

SEQ ID NO: 111687 - protein, 9 aa, Dengue virus
TREEFISKV

SEQ ID NO: 111688 - protein, 9 aa, Dengue virus
REEFISKVR

SEQ ID NO: 111689 - protein, 9 aa, Dengue virus
KKVRTNAAM

SEQ ID NO: 111690 - protein, 9 aa, Dengue virus
KVRTNAAMG

SEQ ID NO: 111691 - protein, 9 aa, Dengue virus
VRTNAAMGA

SEQ ID NO: 111692 - protein, 9 aa, Dengue virus
RTNAAMGAV

SEQ ID NO: 111693 - protein, 9 aa, Dengue virus
TNAAMGAVF

SEQ ID NO: 111694 - protein, 9 aa, Dengue virus
NAAMGAVFT

SEQ ID NO: 111695 - protein, 9 aa, Dengue virus
AAMGAVFTE

SEQ ID NO: 111696 - protein, 9 aa, Dengue virus
AMGAVFTEE

SEQ ID NO: 111697 - protein, 9 aa, Dengue virus
MGAVFTEEN

SEQ ID NO: 111698 - protein, 9 aa, Dengue virus
GAVFTEENQ

SEQ ID NO: 111699 - protein, 9 aa, Dengue virus
AVFTEENQW

SEQ ID NO: 111700 - protein, 9 aa, Dengue virus
VFTEENQWD

SEQ ID NO: 111701 - protein, 9 aa, Dengue virus
FTEENQWDS

SEQ ID NO: 111702 - protein, 9 aa, Dengue virus
TEENQWDSA

SEQ ID NO: 111703 - protein, 9 aa, Dengue virus
EENQWDSAK

SEQ ID NO: 111704 - protein, 9 aa, Dengue virus
ENQWDSAKA

SEQ ID NO: 111705 - protein, 9 aa, Dengue virus
NQWDSAKAA

SEQ ID NO: 111706 - protein, 9 aa, Dengue virus
QWDSAKAAV

SEQ ID NO: 111707 - protein, 9 aa, Dengue virus
WDSAKAAVE

SEQ ID NO: 111708 - protein, 9 aa, Dengue virus
DSAKAAVED

SEQ ID NO: 111709 - protein, 9 aa, Dengue virus
ERELHKLGK

SEQ ID NO: 111710 - protein, 9 aa, Dengue virus
RELHKLGKC

SEQ ID NO: 111711 - protein, 9 aa, Dengue virus
ELHKLGKCG

SEQ ID NO: 111712 - protein, 9 aa, Dengue virus
LHKLGKCGS

SEQ ID NO: 111713 - protein, 9 aa, Dengue virus
HKLGKCGSC

SEQ ID NO: 111714 - protein, 9 aa, Dengue virus
KLGKCGSCV

SEQ ID NO: 111715 - protein, 9 aa, Dengue virus
LGKCGSCVY

SEQ ID NO: 111716 - protein, 9 aa, Dengue virus
GKCGSCVYN

SEQ ID NO: 111717 - protein, 9 aa, Dengue virus
KCGSCVYNM

SEQ ID NO: 111718 - protein, 9 aa, Dengue virus
CGSCVYNMM

SEQ ID NO: 111719 - protein, 9 aa, Dengue virus
GSCVYNMMG

SEQ ID NO: 111720 - protein, 9 aa, Dengue virus
FLNEDHWFG

SEQ ID NO: 111721 - protein, 9 aa, Dengue virus
LNEDHWFGR

SEQ ID NO: 111722 - protein, 9 aa, Dengue virus
NEDHWFGRE

SEQ ID NO: 111723 - protein, 9 aa, Dengue virus
EDHWFGREN

SEQ ID NO: 111724 - protein, 9 aa, Dengue virus
DHWFGRENS

SEQ ID NO: 111725 - protein, 9 aa, Dengue virus
HWFSRGNSL

SEQ ID NO: 111726 - protein, 9 aa, Dengue virus
WFSRGNSLS

SEQ ID NO: 111727 - protein, 9 aa, Dengue virus
FSRGNSLSG

SEQ ID NO: 111728 - protein, 9 aa, Dengue virus
SRGNSLSGV

SEQ ID NO: 111729 - protein, 9 aa, Dengue virus
RGNSLSGVE

SEQ ID NO: 111730 - protein, 9 aa, Dengue virus
GNSLSGVEG

SEQ ID NO: 111731 - protein, 9 aa, Dengue virus
NSWSGVEGE

SEQ ID NO: 111732 - protein, 9 aa, Dengue virus
SWSGVEGEG

SEQ ID NO: 111733 - protein, 9 aa, Dengue virus
WSGVEGEGL

SEQ ID NO: 111734 - protein, 9 aa, Dengue virus
LHRLGYILE

SEQ ID NO: 111735 - protein, 9 aa, Dengue virus
GDLMYADDT

SEQ ID NO: 111736 - protein, 9 aa, Dengue virus
DLMYADDTA

SEQ ID NO: 111737 - protein, 9 aa, Dengue virus
LMYADDTAG

SEQ ID NO: 111738 - protein, 9 aa, Dengue virus
AGWDTRITI

SEQ ID NO: 111739 - protein, 9 aa, Dengue virus
GWDTRITIE

SEQ ID NO: 111740 - protein, 9 aa, Dengue virus
WDTRITIED

SEQ ID NO: 111741 - protein, 9 aa, Dengue virus
DTRITIEDL

SEQ ID NO: 111742 - protein, 9 aa, Dengue virus
YQNKVVKVL

SEQ ID NO: 111743 - protein, 9 aa, Dengue virus
QNKVVKVLR

SEQ ID NO: 111744 - protein, 9 aa, Dengue virus
NKVVKVLRP

SEQ ID NO: 111745 - protein, 9 aa, Dengue virus
KVVKVQRPT

SEQ ID NO: 111746 - protein, 9 aa, Dengue virus
VVKVQRPTP

SEQ ID NO: 111747 - protein, 9 aa, Dengue virus
GAVMDIISR

SEQ ID NO: 111748 - protein, 9 aa, Dengue virus
TVMDIISRK

SEQ ID NO: 111749 - protein, 9 aa, Dengue virus
VMDIISRRD

SEQ ID NO: 111750 - protein, 9 aa, Dengue virus
MDIISRRDQ

SEQ ID NO: 111751 - protein, 9 aa, Dengue virus
DIISRRDQR

SEQ ID NO: 111752 - protein, 9 aa, Dengue virus
IISRRDQRG

SEQ ID NO: 111753 - protein, 9 aa, Dengue virus
FTNMEAQLV

SEQ ID NO: 111754 - protein, 9 aa, Dengue virus
TNMEAQLVR

SEQ ID NO: 111755 - protein, 9 aa, Dengue virus
NMEAQLVRQ

SEQ ID NO: 111756 - protein, 9 aa, Dengue virus
MEAQLVRQM

SEQ ID NO: 111757 - protein, 9 aa, Dengue virus
EAQLVRQME

SEQ ID NO: 111758 - protein, 9 aa, Dengue virus
VQLIRQMES

SEQ ID NO: 111759 - protein, 9 aa, Dengue virus
QLVRQMEGE

SEQ ID NO: 111760 - protein, 9 aa, Dengue virus
LVRQMEGEG

SEQ ID NO: 111761 - protein, 9 aa, Dengue virus
DRLKRMAIS

SEQ ID NO: 111762 - protein, 9 aa, Dengue virus
RLRRMAISG

SEQ ID NO: 111763 - protein, 9 aa, Dengue virus
LRRMAISGD

SEQ ID NO: 111764 - protein, 9 aa, Dengue virus
RRMAISGDD

SEQ ID NO: 111765 - protein, 9 aa, Dengue virus
GDDCVVKPT

SEQ ID NO: 111766 - protein, 9 aa, Dengue virus
DDCVVKPTD

SEQ ID NO: 111767 - protein, 9 aa, Dengue virus
DCVVKPLDE

SEQ ID NO: 111768 - protein, 9 aa, Dengue virus
CVVKPLDER

SEQ ID NO: 111769 - protein, 9 aa, Dengue virus
VVKPLDERF

SEQ ID NO: 111770 - protein, 9 aa, Dengue virus
SLLFLNDMG

SEQ ID NO: 111771 - protein, 9 aa, Dengue virus
LLFLNDMGK

SEQ ID NO: 111772 - protein, 9 aa, Dengue virus
FLNDMGKVR

SEQ ID NO: 111773 - protein, 9 aa, Dengue virus
DMGKVRKDV

SEQ ID NO: 111774 - protein, 9 aa, Dengue virus
MGKIRKDIQ

SEQ ID NO: 111775 - protein, 9 aa, Dengue virus
GKIRKDIQQ

SEQ ID NO: 111776 - protein, 9 aa, Dengue virus
KIRKDIQQW

SEQ ID NO: 111777 - protein, 9 aa, Dengue virus
VRKDIQQWE

SEQ ID NO: 111778 - protein, 9 aa, Dengue virus
RKDIPQWQP

SEQ ID NO: 111779 - protein, 9 aa, Dengue virus
KDIPQWQPS

SEQ ID NO: 111780 - protein, 9 aa, Dengue virus
DIPQWQPSK

SEQ ID NO: 111781 - protein, 9 aa, Dengue virus
IPQWQPSKG

SEQ ID NO: 111782 - protein, 9 aa, Dengue virus
PQWQPSKGW

SEQ ID NO: 111783 - protein, 9 aa, Dengue virus
QWQPSKGWH

SEQ ID NO: 111784 - protein, 9 aa, Dengue virus
WQPSKGWHD

SEQ ID NO: 111785 - protein, 9 aa, Dengue virus
QPSKGWHDW

SEQ ID NO: 111786 - protein, 9 aa, Dengue virus
GWHDWQQVP

SEQ ID NO: 111787 - protein, 9 aa, Dengue virus
WHDWQQVPF

SEQ ID NO: 111788 - protein, 9 aa, Dengue virus
HDWQQVPFC

SEQ ID NO: 111789 - protein, 9 aa, Dengue virus
NWQEVPFCS

SEQ ID NO: 111790 - protein, 9 aa, Dengue virus
WQEVPFCSH

SEQ ID NO: 111791 - protein, 9 aa, Dengue virus
QEVPFCSHH

SEQ ID NO: 111792 - protein, 9 aa, Dengue virus
PFCSHHFHK

SEQ ID NO: 111793 - protein, 9 aa, Dengue virus
FCSHHFHKI

SEQ ID NO: 111794 - protein, 9 aa, Dengue virus
CSHHFHELV

SEQ ID NO: 111795 - protein, 9 aa, Dengue virus
SHHFHELVM

SEQ ID NO: 111796 - protein, 9 aa, Dengue virus
HHFHELVMK

SEQ ID NO: 111797 - protein, 9 aa, Dengue virus
HFHELVMKD

SEQ ID NO: 111798 - protein, 9 aa, Dengue virus
FHELVMKDG

SEQ ID NO: 111799 - protein, 9 aa, Dengue virus
HELVMKDGR

SEQ ID NO: 111800 - protein, 9 aa, Dengue virus
LVVPCRPQD

SEQ ID NO: 111801 - protein, 9 aa, Dengue virus
PCRPQDELI

SEQ ID NO: 111802 - protein, 9 aa, Dengue virus
CRPQDELIG

SEQ ID NO: 111803 - protein, 9 aa, Dengue virus
RPQDELIGR

SEQ ID NO: 111804 - protein, 9 aa, Dengue virus
PQDELIGRA

SEQ ID NO: 111805 - protein, 9 aa, Dengue virus
RETACLGKA

SEQ ID NO: 111806 - protein, 9 aa, Dengue virus
GKSYAQMWS

SEQ ID NO: 111807 - protein, 9 aa, Dengue virus
KSYAQMWSL

SEQ ID NO: 111808 - protein, 9 aa, Dengue virus
SYAQMWSLM

SEQ ID NO: 111809 - protein, 9 aa, Dengue virus
YAQMWTLMY

SEQ ID NO: 111810 - protein, 9 aa, Dengue virus
AQMWTLMYF

SEQ ID NO: 111811 - protein, 9 aa, Dengue virus
QMWTLMYFH

SEQ ID NO: 111812 - protein, 9 aa, Dengue virus
MWTLMYFHR

SEQ ID NO: 111813 - protein, 9 aa, Dengue virus
WTLMYFHRR

SEQ ID NO: 111814 - protein, 9 aa, Dengue virus
TLMYFHRRD

SEQ ID NO: 111815 - protein, 9 aa, Dengue virus
RRDLRLASM

SEQ ID NO: 111816 - protein, 9 aa, Dengue virus
RDLRLASMA

SEQ ID NO: 111817 - protein, 9 aa, Dengue virus
DLRLASMAI

SEQ ID NO: 111818 - protein, 9 aa, Dengue virus
LRLASMAIC

SEQ ID NO: 111819 - protein, 9 aa, Dengue virus
RLASMAICS

SEQ ID NO: 111820 - protein, 9 aa, Dengue virus
LASMAICSA

SEQ ID NO: 111821 - protein, 9 aa, Dengue virus
ASMAICSAV

SEQ ID NO: 111822 - protein, 9 aa, Dengue virus
SMAICSAVP

SEQ ID NO: 111823 - protein, 9 aa, Dengue virus
MAICSAVPT

SEQ ID NO: 111824 - protein, 9 aa, Dengue virus
DWIPTSRTT

SEQ ID NO: 111825 - protein, 9 aa, Dengue virus
WFPTSRTTW

SEQ ID NO: 111826 - protein, 9 aa, Dengue virus
FPTSRTTWS

SEQ ID NO: 111827 - protein, 9 aa, Dengue virus
RTTWSIHAT

SEQ ID NO: 111828 - protein, 9 aa, Dengue virus
TTWSIHATH

SEQ ID NO: 111829 - protein, 9 aa, Dengue virus
TWSIHATHE

SEQ ID NO: 111830 - protein, 9 aa, Dengue virus
WSIHATHEW

SEQ ID NO: 111831 - protein, 9 aa, Dengue virus
SIHATHEWM

SEQ ID NO: 111832 - protein, 9 aa, Dengue virus
IHATHEWMT

SEQ ID NO: 111833 - protein, 9 aa, Dengue virus
HATHEWMTT

SEQ ID NO: 111834 - protein, 9 aa, Dengue virus
ATHEWMTTE

SEQ ID NO: 111835 - protein, 9 aa, Dengue virus
THEWMTTED

SEQ ID NO: 111836 - protein, 9 aa, Dengue virus
WMTTEDMLA

SEQ ID NO: 111837 - protein, 9 aa, Dengue virus
MTTEDMLAV

SEQ ID NO: 111838 - protein, 9 aa, Dengue virus
TTEDMLAVW

SEQ ID NO: 111839 - protein, 9 aa, Dengue virus
TEDMLAVWN

SEQ ID NO: 111840 - protein, 9 aa, Dengue virus
EDMLAVWNR

SEQ ID NO: 111841 - protein, 9 aa, Dengue virus
DMLAVWNRV

SEQ ID NO: 111842 - protein, 9 aa, Dengue virus
MLAVWNRVW

SEQ ID NO: 111843 - protein, 9 aa, Dengue virus
LAVWNRVWI

SEQ ID NO: 111844 - protein, 9 aa, Dengue virus
DNPNMIDKT

SEQ ID NO: 111845 - protein, 9 aa, Dengue virus
EIPYLGKRE

SEQ ID NO: 111846 - protein, 9 aa, Dengue virus
CGSLIGLSS

SEQ ID NO: 111847 - protein, 9 aa, Dengue virus
GSLIGLSSR

SEQ ID NO: 111848 - protein, 9 aa, Dengue virus
SLIGLSSRA

SEQ ID NO: 111849 - protein, 9 aa, Dengue virus
LIGLSSRAT

SEQ ID NO: 111850 - protein, 9 aa, Dengue virus
IGLSSRATW

SEQ ID NO: 111851 - protein, 9 aa, Dengue virus
GLSSRATWA

SEQ ID NO: 111852 - protein, 9 aa, Dengue virus
LTSRATWAQ

SEQ ID NO: 111853 - protein, 9 aa, Dengue virus
TSRATWAQN

SEQ ID NO: 111854 - protein, 9 aa, Dengue virus
SRATWAQNI

SEQ ID NO: 111855 - protein, 9 aa, Dengue virus
DYMPVMKRY

SEQ ID NO: 111856 - protein, 9 aa, Dengue virus
YMPVMKRYS

SEQ ID NO: 111857 - protein, 9 aa, Dengue virus
PPFNMLKRE

SEQ ID NO: 111858 - protein, 9 aa, Dengue virus
RNRVSTPQG

SEQ ID NO: 111859 - protein, 9 aa, Dengue virus
NRVSTPQGL

SEQ ID NO: 111860 - protein, 9 aa, Dengue virus
RVSTPQGLV

SEQ ID NO: 111861 - protein, 9 aa, Dengue virus
VSTPQGLVK

SEQ ID NO: 111862 - protein, 9 aa, Dengue virus
STPQGLVKR

SEQ ID NO: 111863 - protein, 9 aa, Dengue virus
TPQGLVKRF

SEQ ID NO: 111864 - protein, 9 aa, Dengue virus
PQGLVKRFS

SEQ ID NO: 111865 - protein, 9 aa, Dengue virus
QGLVKRFST

SEQ ID NO: 111866 - protein, 9 aa, Dengue virus
GLVKRFSTG

SEQ ID NO: 111867 - protein, 9 aa, Dengue virus
LVKRFSTGL

SEQ ID NO: 111868 - protein, 9 aa, Dengue virus
VKRFSTGLF

SEQ ID NO: 111869 - protein, 9 aa, Dengue virus
KRFSRGLLN

SEQ ID NO: 111870 - protein, 9 aa, Dengue virus
RFSRGLLNG

SEQ ID NO: 111871 - protein, 9 aa, Dengue virus
FSRGLLNGQ

SEQ ID NO: 111872 - protein, 9 aa, Dengue virus
SRGLLNGQG

SEQ ID NO: 111873 - protein, 9 aa, Dengue virus
RGLLNGQGP

SEQ ID NO: 111874 - protein, 9 aa, Dengue virus
GLFSGKGPL

SEQ ID NO: 111875 - protein, 9 aa, Dengue virus
LFSGKGPLR

SEQ ID NO: 111876 - protein, 9 aa, Dengue virus
GQGPMKMVM

SEQ ID NO: 111877 - protein, 9 aa, Dengue virus
QGPMKMVMA

SEQ ID NO: 111878 - protein, 9 aa, Dengue virus
GPMKMVMAF

SEQ ID NO: 111879 - protein, 9 aa, Dengue virus
MVMAFIAFL

SEQ ID NO: 111880 - protein, 9 aa, Dengue virus
LSIPPTAGI

SEQ ID NO: 111881 - protein, 9 aa, Dengue virus
SIPPTAGIL

SEQ ID NO: 111882 - protein, 9 aa, Dengue virus
TAGILARWS

SEQ ID NO: 111883 - protein, 9 aa, Dengue virus
GFKKEVSNM

SEQ ID NO: 111884 - protein, 9 aa, Dengue virus
FKKEVSNML

SEQ ID NO: 111885 - protein, 9 aa, Dengue virus
AFHLSTRDG

SEQ ID NO: 111886 - protein, 9 aa, Dengue virus
FHLSTRDGE

SEQ ID NO: 111887 - protein, 9 aa, Dengue virus
HLSTRDGEP

SEQ ID NO: 111888 - protein, 9 aa, Dengue virus
LSTRDGEPL

SEQ ID NO: 111889 - protein, 9 aa, Dengue virus
STRDGEPLM

SEQ ID NO: 111890 - protein, 9 aa, Dengue virus
TRDGEPLMI

SEQ ID NO: 111891 - protein, 9 aa, Dengue virus
RDGEPLMIV

SEQ ID NO: 111892 - protein, 9 aa, Dengue virus
HERGRPLLF

SEQ ID NO: 111893 - protein, 9 aa, Dengue virus
GRPLLFKTT

SEQ ID NO: 111894 - protein, 9 aa, Dengue virus
NKCTLIAMD

SEQ ID NO: 111895 - protein, 9 aa, Dengue virus
KCTLIAMDL

SEQ ID NO: 111896 - protein, 9 aa, Dengue virus
LMAMDLGEL

SEQ ID NO: 111897 - protein, 9 aa, Dengue virus
MAMDLGELC

SEQ ID NO: 111898 - protein, 9 aa, Dengue virus
AMDLGEFCE

SEQ ID NO: 111899 - protein, 9 aa, Dengue virus
MDLGEFCED

SEQ ID NO: 111900 - protein, 9 aa, Dengue virus
DLGEMCEDT

SEQ ID NO: 111901 - protein, 9 aa, Dengue virus
DDVDCWCNT

SEQ ID NO: 111902 - protein, 9 aa, Dengue virus
DVDCWCNTT

SEQ ID NO: 111903 - protein, 9 aa, Dengue virus
VDCWCNATE

SEQ ID NO: 111904 - protein, 9 aa, Dengue virus
DCWCNATET

SEQ ID NO: 111905 - protein, 9 aa, Dengue virus
CWCNATETW

SEQ ID NO: 111906 - protein, 9 aa, Dengue virus
TETWVTYGT

SEQ ID NO: 111907 - protein, 9 aa, Dengue virus
ETWVTYGTC

SEQ ID NO: 111908 - protein, 9 aa, Dengue virus
TWVMYGTCT

SEQ ID NO: 111909 - protein, 9 aa, Dengue virus
GERRRDKRS

SEQ ID NO: 111910 - protein, 9 aa, Dengue virus
ERRRDKRSV

SEQ ID NO: 111911 - protein, 9 aa, Dengue virus
RRRDKRSVA

SEQ ID NO: 111912 - protein, 9 aa, Dengue virus
REKRSVALA

SEQ ID NO: 111913 - protein, 9 aa, Dengue virus
EKRSVALAP

SEQ ID NO: 111914 - protein, 9 aa, Dengue virus
VALTPHSGM

SEQ ID NO: 111915 - protein, 9 aa, Dengue virus
ALTPHSGMG

SEQ ID NO: 111916 - protein, 9 aa, Dengue virus
LTPHSGMGL

SEQ ID NO: 111917 - protein, 9 aa, Dengue virus
TPHSGMGLE

SEQ ID NO: 111918 - protein, 9 aa, Dengue virus
PHSGMGLET

SEQ ID NO: 111919 - protein, 9 aa, Dengue virus
HSGMGLETR

SEQ ID NO: 111920 - protein, 9 aa, Dengue virus
GLDTRAQTW

SEQ ID NO: 111921 - protein, 9 aa, Dengue virus
LDTRAQTWM

SEQ ID NO: 111922 - protein, 9 aa, Dengue virus
DTRAQTWMS

SEQ ID NO: 111923 - protein, 9 aa, Dengue virus
TRAQTWMSA

SEQ ID NO: 111924 - protein, 9 aa, Dengue virus
RAQTWMSAE

SEQ ID NO: 111925 - protein, 9 aa, Dengue virus
AQTWMSAEG

SEQ ID NO: 111926 - protein, 9 aa, Dengue virus
MSSEGAWRQ

SEQ ID NO: 111927 - protein, 9 aa, Dengue virus
SSEGAWKHV

SEQ ID NO: 111928 - protein, 9 aa, Dengue virus
SEGAWKHVQ

SEQ ID NO: 111929 - protein, 9 aa, Dengue virus
VETWAFRHP

SEQ ID NO: 111930 - protein, 9 aa, Dengue virus
ETWAFRHPG

SEQ ID NO: 111931 - protein, 9 aa, Dengue virus
TWAFRHPGF

SEQ ID NO: 111932 - protein, 9 aa, Dengue virus
WAFRHPGFT

SEQ ID NO: 111933 - protein, 9 aa, Dengue virus
VAPSYGMRC

SEQ ID NO: 111934 - protein, 9 aa, Dengue virus
APSYGMRCV

SEQ ID NO: 111935 - protein, 9 aa, Dengue virus
PSYGMRCVG

SEQ ID NO: 111936 - protein, 9 aa, Dengue virus
MRCVGIGNR

SEQ ID NO: 111937 - protein, 9 aa, Dengue virus
RCVGIGNRD

SEQ ID NO: 111938 - protein, 9 aa, Dengue virus
CVGIGNRDF

SEQ ID NO: 111939 - protein, 9 aa, Dengue virus
VGIGNRDFV

SEQ ID NO: 111940 - protein, 9 aa, Dengue virus
GIGNRDFVE

SEQ ID NO: 111941 - protein, 9 aa, Dengue virus
IGNRDFVEG

SEQ ID NO: 111942 - protein, 9 aa, Dengue virus
GNRDFVEGV

SEQ ID NO: 111943 - protein, 9 aa, Dengue virus
VDLVLEHGG

SEQ ID NO: 111944 - protein, 9 aa, Dengue virus
DLVLEHGGC

SEQ ID NO: 111945 - protein, 9 aa, Dengue virus
LVLEHGGCV

SEQ ID NO: 111946 - protein, 9 aa, Dengue virus
GCVTTMAQG

SEQ ID NO: 111947 - protein, 9 aa, Dengue virus
CVTTMAKSK

SEQ ID NO: 111948 - protein, 9 aa, Dengue virus
VTTMAKSKP

SEQ ID NO: 111949 - protein, 9 aa, Dengue virus
TTMAKSKPT

SEQ ID NO: 111950 - protein, 9 aa, Dengue virus
TMAKSKPTL

SEQ ID NO: 111951 - protein, 9 aa, Dengue virus
MAKSKPTLD

SEQ ID NO: 111952 - protein, 9 aa, Dengue virus
AQGKPTLDF

SEQ ID NO: 111953 - protein, 9 aa, Dengue virus
QGKPTLDFE

SEQ ID NO: 111954 - protein, 9 aa, Dengue virus
GKPTLDFEL

SEQ ID NO: 111955 - protein, 9 aa, Dengue virus
KPTLDFELT

SEQ ID NO: 111956 - protein, 9 aa, Dengue virus
PTLDFELTK

SEQ ID NO: 111957 - protein, 9 aa, Dengue virus
TLDFELTKT

SEQ ID NO: 111958 - protein, 9 aa, Dengue virus
LDFELTKTT

SEQ ID NO: 111959 - protein, 9 aa, Dengue virus
DFELTKTTA

SEQ ID NO: 111960 - protein, 9 aa, Dengue virus
FELTKTTAK

SEQ ID NO: 111961 - protein, 9 aa, Dengue virus
TTASRCPTQ

SEQ ID NO: 111962 - protein, 9 aa, Dengue virus
TASRCPTQG

SEQ ID NO: 111963 - protein, 9 aa, Dengue virus
ASRCPTQGE

SEQ ID NO: 111964 - protein, 9 aa, Dengue virus
CRRDVVDRG

SEQ ID NO: 111965 - protein, 9 aa, Dengue virus
RRDVVDRGW

SEQ ID NO: 111966 - protein, 9 aa, Dengue virus
RDVVDRGWG

SEQ ID NO: 111967 - protein, 9 aa, Dengue virus
DVVDRGWGN

SEQ ID NO: 111968 - protein, 9 aa, Dengue virus
VVDRGWGNG

SEQ ID NO: 111969 - protein, 9 aa, Dengue virus
GLFGKGSLL

SEQ ID NO: 111970 - protein, 9 aa, Dengue virus
LFGKGSLLT

SEQ ID NO: 111971 - protein, 9 aa, Dengue virus
FGKGSLLTC

SEQ ID NO: 111972 - protein, 9 aa, Dengue virus
GKGSLLTCA

SEQ ID NO: 111973 - protein, 9 aa, Dengue virus
KGSLLTCAK

SEQ ID NO: 111974 - protein, 9 aa, Dengue virus
GSLLTCAKF

SEQ ID NO: 111975 - protein, 9 aa, Dengue virus
VVTPHSGEE

SEQ ID NO: 111976 - protein, 9 aa, Dengue virus
TPHSGEENA

SEQ ID NO: 111977 - protein, 9 aa, Dengue virus
PHSGEENAV

SEQ ID NO: 111978 - protein, 9 aa, Dengue virus
HSGEENAVG

SEQ ID NO: 111979 - protein, 9 aa, Dengue virus
SGEENAVGN

SEQ ID NO: 111980 - protein, 9 aa, Dengue virus
GDTHAVGND

SEQ ID NO: 111981 - protein, 9 aa, Dengue virus
LTLDCEPRS

SEQ ID NO: 111982 - protein, 9 aa, Dengue virus
TLDCEPRSG

SEQ ID NO: 111983 - protein, 9 aa, Dengue virus
LDCEPRSGI

SEQ ID NO: 111984 - protein, 9 aa, Dengue virus
TSLDFNEMV

SEQ ID NO: 111985 - protein, 9 aa, Dengue virus
DFNEMILMK

SEQ ID NO: 111986 - protein, 9 aa, Dengue virus
FNEMILMKM

SEQ ID NO: 111987 - protein, 9 aa, Dengue virus
NEMILMKMK

SEQ ID NO: 111988 - protein, 9 aa, Dengue virus
KTWLVHKQW

SEQ ID NO: 111989 - protein, 9 aa, Dengue virus
TWLVHKQWF

SEQ ID NO: 111990 - protein, 9 aa, Dengue virus
FFDLPLPWA

SEQ ID NO: 111991 - protein, 9 aa, Dengue virus
DLPLPWASG

SEQ ID NO: 111992 - protein, 9 aa, Dengue virus
LPLPWASGA

SEQ ID NO: 111993 - protein, 9 aa, Dengue virus
KDLLVTFKT

SEQ ID NO: 111994 - protein, 9 aa, Dengue virus
ERMVTFKVP

SEQ ID NO: 111995 - protein, 9 aa, Dengue virus
RMVTFKVPH

SEQ ID NO: 111996 - protein, 9 aa, Dengue virus
MVTFKVPHA

SEQ ID NO: 111997 - protein, 9 aa, Dengue virus
VTFKVPHAK

SEQ ID NO: 111998 - protein, 9 aa, Dengue virus
TFKVPHAKR

SEQ ID NO: 111999 - protein, 9 aa, Dengue virus
FKVPHAKRQ

SEQ ID NO: 112000 - protein, 9 aa, Dengue virus
KVPHAKRQD

SEQ ID NO: 112001 - protein, 9 aa, Dengue virus
VPHAKRQDV

SEQ ID NO: 112002 - protein, 9 aa, Dengue virus
LAGATEVDS

SEQ ID NO: 112003 - protein, 9 aa, Dengue virus
AGATEVDSG

SEQ ID NO: 112004 - protein, 9 aa, Dengue virus
GATEVDSGD

SEQ ID NO: 112005 - protein, 9 aa, Dengue virus
DGNHMFAGH

SEQ ID NO: 112006 - protein, 9 aa, Dengue virus
GNHMFAGHL

SEQ ID NO: 112007 - protein, 9 aa, Dengue virus
NHMFAGHLK

SEQ ID NO: 112008 - protein, 9 aa, Dengue virus
HMFAGHLKC

SEQ ID NO: 112009 - protein, 9 aa, Dengue virus
CKVRMEKLR

SEQ ID NO: 112010 - protein, 9 aa, Dengue virus
KVRMEKLRI

SEQ ID NO: 112011 - protein, 9 aa, Dengue virus
VRMEKLRIK

SEQ ID NO: 112012 - protein, 9 aa, Dengue virus
RMEKLRIKG

SEQ ID NO: 112013 - protein, 9 aa, Dengue virus
DKEMAETQH

SEQ ID NO: 112014 - protein, 9 aa, Dengue virus
KEMAETQHG

SEQ ID NO: 112015 - protein, 9 aa, Dengue virus
EMAETQHGT

SEQ ID NO: 112016 - protein, 9 aa, Dengue virus
MAETQHGTT

SEQ ID NO: 112017 - protein, 9 aa, Dengue virus
AETQHGTTV

SEQ ID NO: 112018 - protein, 9 aa, Dengue virus
ETQHGTTVV

SEQ ID NO: 112019 - protein, 9 aa, Dengue virus
TQHGTTVVK

SEQ ID NO: 112020 - protein, 9 aa, Dengue virus
PINIEAEPP

SEQ ID NO: 112021 - protein, 9 aa, Dengue virus
INIEAEPPF

SEQ ID NO: 112022 - protein, 9 aa, Dengue virus
IELEPPFGD

SEQ ID NO: 112023 - protein, 9 aa, Dengue virus
ELEPPFGDS

SEQ ID NO: 112024 - protein, 9 aa, Dengue virus
TEPPFGESY

SEQ ID NO: 112025 - protein, 9 aa, Dengue virus
WFKRGSSIG

SEQ ID NO: 112026 - protein, 9 aa, Dengue virus
KRGSSIGKM

SEQ ID NO: 112027 - protein, 9 aa, Dengue virus
KGSTIGKMF

SEQ ID NO: 112028 - protein, 9 aa, Dengue virus
GSTIGKMFE

SEQ ID NO: 112029 - protein, 9 aa, Dengue virus
STIGKMFEA

SEQ ID NO: 112030 - protein, 9 aa, Dengue virus
TIGKMFEAT

SEQ ID NO: 112031 - protein, 9 aa, Dengue virus
IGQMIETTM

SEQ ID NO: 112032 - protein, 9 aa, Dengue virus
GQMIETTMR

SEQ ID NO: 112033 - protein, 9 aa, Dengue virus
QMIETTMRG

SEQ ID NO: 112034 - protein, 9 aa, Dengue virus
MIETTMRGA

SEQ ID NO: 112035 - protein, 9 aa, Dengue virus
IETTMRGAK

SEQ ID NO: 112036 - protein, 9 aa, Dengue virus
ETAWDFGSV

SEQ ID NO: 112037 - protein, 9 aa, Dengue virus
WDFGSVGGL

SEQ ID NO: 112038 - protein, 9 aa, Dengue virus
FGSVYTTMF

SEQ ID NO: 112039 - protein, 9 aa, Dengue virus
VYTTMFGGV

SEQ ID NO: 112040 - protein, 9 aa, Dengue virus
YTTMFGGVS

SEQ ID NO: 112041 - protein, 9 aa, Dengue virus
TTMFGGVSW

SEQ ID NO: 112042 - protein, 9 aa, Dengue virus
FGGVSWMIR

SEQ ID NO: 112043 - protein, 9 aa, Dengue virus
GGVSWMIRI

SEQ ID NO: 112044 - protein, 9 aa, Dengue virus
LVLWIGTNS

SEQ ID NO: 112045 - protein, 9 aa, Dengue virus
VLWIGTNSR

SEQ ID NO: 112046 - protein, 9 aa, Dengue virus
LWIGTNSRN

SEQ ID NO: 112047 - protein, 9 aa, Dengue virus
WIGTNSRNT

SEQ ID NO: 112048 - protein, 9 aa, Dengue virus
LFLGFTVQA

SEQ ID NO: 112049 - protein, 9 aa, Dengue virus
FLGFTVQAD

SEQ ID NO: 112050 - protein, 9 aa, Dengue virus
SKELKCGSG

SEQ ID NO: 112051 - protein, 9 aa, Dengue virus
KCGNGIFVT

SEQ ID NO: 112052 - protein, 9 aa, Dengue virus
CGSGIFVTD

SEQ ID NO: 112053 - protein, 9 aa, Dengue virus
GSGIFVTDN

SEQ ID NO: 112054 - protein, 9 aa, Dengue virus
SGIFVTDNV

SEQ ID NO: 112055 - protein, 9 aa, Dengue virus
GIFVTDNVH

SEQ ID NO: 112056 - protein, 9 aa, Dengue virus
IFVTDNVHT

SEQ ID NO: 112057 - protein, 9 aa, Dengue virus
FVTDNVHTW

SEQ ID NO: 112058 - protein, 9 aa, Dengue virus
VTDNVHTWT

SEQ ID NO: 112059 - protein, 9 aa, Dengue virus
QPESPARLA

SEQ ID NO: 112060 - protein, 9 aa, Dengue virus
PESPARLAS

SEQ ID NO: 112061 - protein, 9 aa, Dengue virus
ESPARLASA

SEQ ID NO: 112062 - protein, 9 aa, Dengue virus
SPARLASAI

SEQ ID NO: 112063 - protein, 9 aa, Dengue virus
PARLASAIL

SEQ ID NO: 112064 - protein, 9 aa, Dengue virus
ARLASAILN

SEQ ID NO: 112065 - protein, 9 aa, Dengue virus
RLASAILNA

SEQ ID NO: 112066 - protein, 9 aa, Dengue virus
KDGVCGIRS

SEQ ID NO: 112067 - protein, 9 aa, Dengue virus
DICGIRSVT

SEQ ID NO: 112068 - protein, 9 aa, Dengue virus
CGIRSTTRL

SEQ ID NO: 112069 - protein, 9 aa, Dengue virus
GIRSTTRLE

SEQ ID NO: 112070 - protein, 9 aa, Dengue virus
IRSTTRLEN

SEQ ID NO: 112071 - protein, 9 aa, Dengue virus
RSTTRLENV

SEQ ID NO: 112072 - protein, 9 aa, Dengue virus
STTRLENVM

SEQ ID NO: 112073 - protein, 9 aa, Dengue virus
TTRLENVMW

SEQ ID NO: 112074 - protein, 9 aa, Dengue virus
TRLENVMWK

SEQ ID NO: 112075 - protein, 9 aa, Dengue virus
RLENVMWKQ

SEQ ID NO: 112076 - protein, 9 aa, Dengue virus
LENVMWKQI

SEQ ID NO: 112077 - protein, 9 aa, Dengue virus
ELNHILAEN

SEQ ID NO: 112078 - protein, 9 aa, Dengue virus
YSWKIWGKA

SEQ ID NO: 112079 - protein, 9 aa, Dengue virus
SWKTWGKAR

SEQ ID NO: 112080 - protein, 9 aa, Dengue virus
TFIIDGPDT

SEQ ID NO: 112081 - protein, 9 aa, Dengue virus
RAWNSFEVE

SEQ ID NO: 112082 - protein, 9 aa, Dengue virus
AWNSFEVED

SEQ ID NO: 112083 - protein, 9 aa, Dengue virus
WNSFEVEDY

SEQ ID NO: 112084 - protein, 9 aa, Dengue virus
NSFEVEDYG

SEQ ID NO: 112085 - protein, 9 aa, Dengue virus
SFEVEDYGF

SEQ ID NO: 112086 - protein, 9 aa, Dengue virus
EDYGFGVFS

SEQ ID NO: 112087 - protein, 9 aa, Dengue virus
DYGFGVFST

SEQ ID NO: 112088 - protein, 9 aa, Dengue virus
YGFGVFSTN

SEQ ID NO: 112089 - protein, 9 aa, Dengue virus
GFGVFSTNI

SEQ ID NO: 112090 - protein, 9 aa, Dengue virus
FGVFSTNIW

SEQ ID NO: 112091 - protein, 9 aa, Dengue virus
GVFSTNIWL

SEQ ID NO: 112092 - protein, 9 aa, Dengue virus
VFSTNIWLK

SEQ ID NO: 112093 - protein, 9 aa, Dengue virus
FTTNIWLRL

SEQ ID NO: 112094 - protein, 9 aa, Dengue virus
DSKLMSAAV

SEQ ID NO: 112095 - protein, 9 aa, Dengue virus
SKLMSAAVK

SEQ ID NO: 112096 - protein, 9 aa, Dengue virus
KLMSAAVKD

SEQ ID NO: 112097 - protein, 9 aa, Dengue virus
KDQKAVHAD

SEQ ID NO: 112098 - protein, 9 aa, Dengue virus
DQKAVHADM

SEQ ID NO: 112099 - protein, 9 aa, Dengue virus
QKAVHADMG

SEQ ID NO: 112100 - protein, 9 aa, Dengue virus
DMGYWIESS

SEQ ID NO: 112101 - protein, 9 aa, Dengue virus
MGYWIESSK

SEQ ID NO: 112102 - protein, 9 aa, Dengue virus
GYWIESSKN

SEQ ID NO: 112103 - protein, 9 aa, Dengue virus
ESSKNQTWQ

SEQ ID NO: 112104 - protein, 9 aa, Dengue virus
ASFIEVKNC

SEQ ID NO: 112105 - protein, 9 aa, Dengue virus
NGVLESEMV

SEQ ID NO: 112106 - protein, 9 aa, Dengue virus
GVLESEMVI

SEQ ID NO: 112107 - protein, 9 aa, Dengue virus
VLESEMVIP

SEQ ID NO: 112108 - protein, 9 aa, Dengue virus
LESEMVIPK

SEQ ID NO: 112109 - protein, 9 aa, Dengue virus
SQHNNRPGY

SEQ ID NO: 112110 - protein, 9 aa, Dengue virus
TQAAGPWHL

SEQ ID NO: 112111 - protein, 9 aa, Dengue virus
QAAGPWHLG

SEQ ID NO: 112112 - protein, 9 aa, Dengue virus
AAGPWHLGK

SEQ ID NO: 112113 - protein, 9 aa, Dengue virus
PWHLGRLEM

SEQ ID NO: 112114 - protein, 9 aa, Dengue virus
WHLGRLEMD

SEQ ID NO: 112115 - protein, 9 aa, Dengue virus
HLGRLEMDF

SEQ ID NO: 112116 - protein, 9 aa, Dengue virus
CGSRGPSLR

SEQ ID NO: 112117 - protein, 9 aa, Dengue virus
GSRGPSLRT

SEQ ID NO: 112118 - protein, 9 aa, Dengue virus
SRGPSLRTT

SEQ ID NO: 112119 - protein, 9 aa, Dengue virus
TTTASGKLV

SEQ ID NO: 112120 - protein, 9 aa, Dengue virus
TTASGKLVT

SEQ ID NO: 112121 - protein, 9 aa, Dengue virus
TASGKLVTQ

SEQ ID NO: 112122 - protein, 9 aa, Dengue virus
ASGKLVTQW

SEQ ID NO: 112123 - protein, 9 aa, Dengue virus
SGKLVTQWC

SEQ ID NO: 112124 - protein, 9 aa, Dengue virus
GKLVTQWCC

SEQ ID NO: 112125 - protein, 9 aa, Dengue virus
KLVTQWCCR

SEQ ID NO: 112126 - protein, 9 aa, Dengue virus
LVTQWCCRS

SEQ ID NO: 112127 - protein, 9 aa, Dengue virus
CTLPPLRFK

SEQ ID NO: 112128 - protein, 9 aa, Dengue virus
TLPPLRFKG

SEQ ID NO: 112129 - protein, 9 aa, Dengue virus
LPPLRFKGE

SEQ ID NO: 112130 - protein, 9 aa, Dengue virus
PPLRFKGED

SEQ ID NO: 112131 - protein, 9 aa, Dengue virus
PLRFKGEDG

SEQ ID NO: 112132 - protein, 9 aa, Dengue virus
LRFKGEDGC

SEQ ID NO: 112133 - protein, 9 aa, Dengue virus
RFKGEDGCW

SEQ ID NO: 112134 - protein, 9 aa, Dengue virus
FKGEDGCWY

SEQ ID NO: 112135 - protein, 9 aa, Dengue virus
LGEDGCWYG

SEQ ID NO: 112136 - protein, 9 aa, Dengue virus
EEMLRTRIG

SEQ ID NO: 112137 - protein, 9 aa, Dengue virus
MGMGMTYLA

SEQ ID NO: 112138 - protein, 9 aa, Dengue virus
GMGITYLAL

SEQ ID NO: 112139 - protein, 9 aa, Dengue virus
THLAIMAVF

SEQ ID NO: 112140 - protein, 9 aa, Dengue virus
FLRKLTSKE

SEQ ID NO: 112141 - protein, 9 aa, Dengue virus
RKLTSRETA

SEQ ID NO: 112142 - protein, 9 aa, Dengue virus
KLTSRETAL

SEQ ID NO: 112143 - protein, 9 aa, Dengue virus
LTSKELMMT

SEQ ID NO: 112144 - protein, 9 aa, Dengue virus
TSKELMMTT

SEQ ID NO: 112145 - protein, 9 aa, Dengue virus
ELIDGISLG

SEQ ID NO: 112146 - protein, 9 aa, Dengue virus
LIDGISLGL

SEQ ID NO: 112147 - protein, 9 aa, Dengue virus
IDGISLGLI

SEQ ID NO: 112148 - protein, 9 aa, Dengue virus
RKSWPINEG

SEQ ID NO: 112149 - protein, 9 aa, Dengue virus
RSWPLNEGI

SEQ ID NO: 112150 - protein, 9 aa, Dengue virus
SWPLNEAVM

SEQ ID NO: 112151 - protein, 9 aa, Dengue virus
WPLNEAVMA

SEQ ID NO: 112152 - protein, 9 aa, Dengue virus
PLNEGIMAI

SEQ ID NO: 112153 - protein, 9 aa, Dengue virus
LNEGIMAIG

SEQ ID NO: 112154 - protein, 9 aa, Dengue virus
GVVSILLSS

SEQ ID NO: 112155 - protein, 9 aa, Dengue virus
VSILLSALL

SEQ ID NO: 112156 - protein, 9 aa, Dengue virus
SLLGSALLK

SEQ ID NO: 112157 - protein, 9 aa, Dengue virus
LLGSALLKN

SEQ ID NO: 112158 - protein, 9 aa, Dengue virus
LGSALLKND

SEQ ID NO: 112159 - protein, 9 aa, Dengue virus
GSALLKNDV

SEQ ID NO: 112160 - protein, 9 aa, Dengue virus
SALLKNDVP

SEQ ID NO: 112161 - protein, 9 aa, Dengue virus
ALLKNDVPL

SEQ ID NO: 112162 - protein, 9 aa, Dengue virus
NDVPLAGPM

SEQ ID NO: 112163 - protein, 9 aa, Dengue virus
DVPLAGPMV

SEQ ID NO: 112164 - protein, 9 aa, Dengue virus
VPLAGPMVA

SEQ ID NO: 112165 - protein, 9 aa, Dengue virus
PLAGPMVAG

SEQ ID NO: 112166 - protein, 9 aa, Dengue virus
LAGPMVAGG

SEQ ID NO: 112167 - protein, 9 aa, Dengue virus
AGPMVAGGL

SEQ ID NO: 112168 - protein, 9 aa, Dengue virus
PMVAGGLLL

SEQ ID NO: 112169 - protein, 9 aa, Dengue virus
MVAGGLLLA

SEQ ID NO: 112170 - protein, 9 aa, Dengue virus
VAGGLLLAA

SEQ ID NO: 112171 - protein, 9 aa, Dengue virus
AGGLLLAAY

SEQ ID NO: 112172 - protein, 9 aa, Dengue virus
GGLLLAAYV

SEQ ID NO: 112173 - protein, 9 aa, Dengue virus
GLLLAAYVM

SEQ ID NO: 112174 - protein, 9 aa, Dengue virus
LLLAAYVMS

SEQ ID NO: 112175 - protein, 9 aa, Dengue virus
LLAAYVMSG

SEQ ID NO: 112176 - protein, 9 aa, Dengue virus
LAAYVMSGS

SEQ ID NO: 112177 - protein, 9 aa, Dengue virus
AAYVMSGSS

SEQ ID NO: 112178 - protein, 9 aa, Dengue virus
AYVMSGSSA

SEQ ID NO: 112179 - protein, 9 aa, Dengue virus
YVMSGSSAD

SEQ ID NO: 112180 - protein, 9 aa, Dengue virus
VMSGSSADL

SEQ ID NO: 112181 - protein, 9 aa, Dengue virus
MSGSSADLS

SEQ ID NO: 112182 - protein, 9 aa, Dengue virus
RSADLELEK

SEQ ID NO: 112183 - protein, 9 aa, Dengue virus
EAEHSGTSH

SEQ ID NO: 112184 - protein, 9 aa, Dengue virus
AEHSGTSHN

SEQ ID NO: 112185 - protein, 9 aa, Dengue virus
EHSGTSHNI

SEQ ID NO: 112186 - protein, 9 aa, Dengue virus
HSGTSHNIL

SEQ ID NO: 112187 - protein, 9 aa, Dengue virus
DEDGSFSIR

SEQ ID NO: 112188 - protein, 9 aa, Dengue virus
EDGSFSIRD

SEQ ID NO: 112189 - protein, 9 aa, Dengue virus
DGSFSIRDV

SEQ ID NO: 112190 - protein, 9 aa, Dengue virus
GSFSIRDVE

SEQ ID NO: 112191 - protein, 9 aa, Dengue virus
SFSIRDVEE

SEQ ID NO: 112192 - protein, 9 aa, Dengue virus
FSIRDVEET

SEQ ID NO: 112193 - protein, 9 aa, Dengue virus
ITLLVKLAL

SEQ ID NO: 112194 - protein, 9 aa, Dengue virus
TLLVKLALI

SEQ ID NO: 112195 - protein, 9 aa, Dengue virus
LLVKLALIT

SEQ ID NO: 112196 - protein, 9 aa, Dengue virus
LVKLALITV

SEQ ID NO: 112197 - protein, 9 aa, Dengue virus
VKLALITVS

SEQ ID NO: 112198 - protein, 9 aa, Dengue virus
KLALITVSG

SEQ ID NO: 112199 - protein, 9 aa, Dengue virus
KTQRSGALW

SEQ ID NO: 112200 - protein, 9 aa, Dengue virus
TQRSGALWD

SEQ ID NO: 112201 - protein, 9 aa, Dengue virus
QRSGALWDV

SEQ ID NO: 112202 - protein, 9 aa, Dengue virus
RSGALWDVP

SEQ ID NO: 112203 - protein, 9 aa, Dengue virus
SGALWDVPS

SEQ ID NO: 112204 - protein, 9 aa, Dengue virus
LWDVPSPAA

SEQ ID NO: 112205 - protein, 9 aa, Dengue virus
AALSEGVYR

SEQ ID NO: 112206 - protein, 9 aa, Dengue virus
ALSEGVYRI

SEQ ID NO: 112207 - protein, 9 aa, Dengue virus
LDDGIYRIL

SEQ ID NO: 112208 - protein, 9 aa, Dengue virus
DDGIYRILQ

SEQ ID NO: 112209 - protein, 9 aa, Dengue virus
FGYSQIGAG

SEQ ID NO: 112210 - protein, 9 aa, Dengue virus
GKTQVGVGI

SEQ ID NO: 112211 - protein, 9 aa, Dengue virus
KTQVGVGIH

SEQ ID NO: 112212 - protein, 9 aa, Dengue virus
TQVGVGIHM

SEQ ID NO: 112213 - protein, 9 aa, Dengue virus
QVGVGVFQD

SEQ ID NO: 112214 - protein, 9 aa, Dengue virus
DGVFHTMWH

SEQ ID NO: 112215 - protein, 9 aa, Dengue virus
VTRGAVLTH

SEQ ID NO: 112216 - protein, 9 aa, Dengue virus
KGKRIEPSW

SEQ ID NO: 112217 - protein, 9 aa, Dengue virus
TGRLEPSWA

SEQ ID NO: 112218 - protein, 9 aa, Dengue virus
GRLEPSWAD

SEQ ID NO: 112219 - protein, 9 aa, Dengue virus
RLEPSWADV

SEQ ID NO: 112220 - protein, 9 aa, Dengue virus
LEPSWADVR

SEQ ID NO: 112221 - protein, 9 aa, Dengue virus
EPSWADVRN

SEQ ID NO: 112222 - protein, 9 aa, Dengue virus
PSWADVRND

SEQ ID NO: 112223 - protein, 9 aa, Dengue virus
SWADVRNDM

SEQ ID NO: 112224 - protein, 9 aa, Dengue virus
WANVKKDLI

SEQ ID NO: 112225 - protein, 9 aa, Dengue virus
ANVKKDLIS

SEQ ID NO: 112226 - protein, 9 aa, Dengue virus
NVKKDLISY

SEQ ID NO: 112227 - protein, 9 aa, Dengue virus
WDKEEDVQV

SEQ ID NO: 112228 - protein, 9 aa, Dengue virus
DKEEDVQVL

SEQ ID NO: 112229 - protein, 9 aa, Dengue virus
KEEDVQVLA

SEQ ID NO: 112230 - protein, 9 aa, Dengue virus
EPGKNPKHV

SEQ ID NO: 112231 - protein, 9 aa, Dengue virus
PGKNPKHVQ

SEQ ID NO: 112232 - protein, 9 aa, Dengue virus
GKNPKHVQT

SEQ ID NO: 112233 - protein, 9 aa, Dengue virus
TGEIGAVTL

SEQ ID NO: 112234 - protein, 9 aa, Dengue virus
GEIGAVTLD

SEQ ID NO: 112235 - protein, 9 aa, Dengue virus
EIGAVTLDF

SEQ ID NO: 112236 - protein, 9 aa, Dengue virus
IGAVTLDFK

SEQ ID NO: 112237 - protein, 9 aa, Dengue virus
GTSGSPIID

SEQ ID NO: 112238 - protein, 9 aa, Dengue virus
TSGSPIIDK

SEQ ID NO: 112239 - protein, 9 aa, Dengue virus
KGKVIGLYG

SEQ ID NO: 112240 - protein, 9 aa, Dengue virus
YGNGVVTKS

SEQ ID NO: 112241 - protein, 9 aa, Dengue virus
GNGVVTKSG

SEQ ID NO: 112242 - protein, 9 aa, Dengue virus
NGVVTKSGD

SEQ ID NO: 112243 - protein, 9 aa, Dengue virus
GVVTKSGDY

SEQ ID NO: 112244 - protein, 9 aa, Dengue virus
VVTKSGDYV

SEQ ID NO: 112245 - protein, 9 aa, Dengue virus
VTKSGDYVS

SEQ ID NO: 112246 - protein, 9 aa, Dengue virus
SGDYVSAIT

SEQ ID NO: 112247 - protein, 9 aa, Dengue virus
GDYVSAITQ

SEQ ID NO: 112248 - protein, 9 aa, Dengue virus
DYVSAITQA

SEQ ID NO: 112249 - protein, 9 aa, Dengue virus
IFRKRRLTI

SEQ ID NO: 112250 - protein, 9 aa, Dengue virus
FRKRRLTIM

SEQ ID NO: 112251 - protein, 9 aa, Dengue virus
RKRRLTIMD

SEQ ID NO: 112252 - protein, 9 aa, Dengue virus
PGAGKTKRI

SEQ ID NO: 112253 - protein, 9 aa, Dengue virus
GAGKTKRIL

SEQ ID NO: 112254 - protein, 9 aa, Dengue virus
AGKTKRILP

SEQ ID NO: 112255 - protein, 9 aa, Dengue virus
GKTKRILPS

SEQ ID NO: 112256 - protein, 9 aa, Dengue virus
KTKRILPSI

SEQ ID NO: 112257 - protein, 9 aa, Dengue virus
KYLPAIIRE

SEQ ID NO: 112258 - protein, 9 aa, Dengue virus
YLPAMVREA

SEQ ID NO: 112259 - protein, 9 aa, Dengue virus
LPAMVREAI

SEQ ID NO: 112260 - protein, 9 aa, Dengue virus
PAMVREAIK

SEQ ID NO: 112261 - protein, 9 aa, Dengue virus
AMVREAIKR

SEQ ID NO: 112262 - protein, 9 aa, Dengue virus
REALKRRLR

SEQ ID NO: 112263 - protein, 9 aa, Dengue virus
EALKRRLRT

SEQ ID NO: 112264 - protein, 9 aa, Dengue virus
ALKRRLRTL

SEQ ID NO: 112265 - protein, 9 aa, Dengue virus
KRKLRTLVL

SEQ ID NO: 112266 - protein, 9 aa, Dengue virus
RKLRTLVLA

SEQ ID NO: 112267 - protein, 9 aa, Dengue virus
KLRTLVLAP

SEQ ID NO: 112268 - protein, 9 aa, Dengue virus
PIRYQTPAV

SEQ ID NO: 112269 - protein, 9 aa, Dengue virus
KTEHTGREI

SEQ ID NO: 112270 - protein, 9 aa, Dengue virus
TEHTGREIV

SEQ ID NO: 112271 - protein, 9 aa, Dengue virus
PIRVPNYNL

SEQ ID NO: 112272 - protein, 9 aa, Dengue virus
IRVPNYNLI

SEQ ID NO: 112273 - protein, 9 aa, Dengue virus
RVPNYNLVI

SEQ ID NO: 112274 - protein, 9 aa, Dengue virus
VPNYNLVIM

SEQ ID NO: 112275 - protein, 9 aa, Dengue virus
PNYNLVIMD

SEQ ID NO: 112276 - protein, 9 aa, Dengue virus
NYNLVIMDE

SEQ ID NO: 112277 - protein, 9 aa, Dengue virus
YNLVIMDEA

SEQ ID NO: 112278 - protein, 9 aa, Dengue virus
NLVIMDEAH

SEQ ID NO: 112279 - protein, 9 aa, Dengue virus
LVIMDEAHF

SEQ ID NO: 112280 - protein, 9 aa, Dengue virus
EAFPQSNAP

SEQ ID NO: 112281 - protein, 9 aa, Dengue virus
PFPQSNSPI

SEQ ID NO: 112282 - protein, 9 aa, Dengue virus
IEDIEREIP

SEQ ID NO: 112283 - protein, 9 aa, Dengue virus
EDIEREIPE

SEQ ID NO: 112284 - protein, 9 aa, Dengue virus
DEEKDIPER

SEQ ID NO: 112285 - protein, 9 aa, Dengue virus
EEKDIPERS

SEQ ID NO: 112286 - protein, 9 aa, Dengue virus
PERSWNTGF

SEQ ID NO: 112287 - protein, 9 aa, Dengue virus
FVGKTVWFV

SEQ ID NO: 112288 - protein, 9 aa, Dengue virus
VGKTVWFVP

SEQ ID NO: 112289 - protein, 9 aa, Dengue virus
IKTGNDIAA

SEQ ID NO: 112290 - protein, 9 aa, Dengue virus
KTGNDIAAC

SEQ ID NO: 112291 - protein, 9 aa, Dengue virus
NCLRKSGKK

SEQ ID NO: 112292 - protein, 9 aa, Dengue virus
LRKNGKRVV

SEQ ID NO: 112293 - protein, 9 aa, Dengue virus
RKNGKRVVQ

SEQ ID NO: 112294 - protein, 9 aa, Dengue virus
KNGKRVVQL

SEQ ID NO: 112295 - protein, 9 aa, Dengue virus
NGKRVVQLS

SEQ ID NO: 112296 - protein, 9 aa, Dengue virus
RKTFDSEYI

SEQ ID NO: 112297 - protein, 9 aa, Dengue virus
KTFDSEYIK

SEQ ID NO: 112298 - protein, 9 aa, Dengue virus
TFDSEYIKT

SEQ ID NO: 112299 - protein, 9 aa, Dengue virus
ANDWDFVVT

SEQ ID NO: 112300 - protein, 9 aa, Dengue virus
EMGANFRAG

SEQ ID NO: 112301 - protein, 9 aa, Dengue virus
MGANFRAGR

SEQ ID NO: 112302 - protein, 9 aa, Dengue virus
GANFRAGRV

SEQ ID NO: 112303 - protein, 9 aa, Dengue virus
ANFRAGRVI

SEQ ID NO: 112304 - protein, 9 aa, Dengue virus
NFRAGRVID

SEQ ID NO: 112305 - protein, 9 aa, Dengue virus
FRAGRVIDP

SEQ ID NO: 112306 - protein, 9 aa, Dengue virus
RAGRVIDPR

SEQ ID NO: 112307 - protein, 9 aa, Dengue virus
LKPVILPDG

SEQ ID NO: 112308 - protein, 9 aa, Dengue virus
KPVILPDGP

SEQ ID NO: 112309 - protein, 9 aa, Dengue virus
PVILPDGPE

SEQ ID NO: 112310 - protein, 9 aa, Dengue virus
VILPDGPER

SEQ ID NO: 112311 - protein, 9 aa, Dengue virus
ILPDGPERV

SEQ ID NO: 112312 - protein, 9 aa, Dengue virus
LTDGEERVV

SEQ ID NO: 112313 - protein, 9 aa, Dengue virus
TDGEERVVL

SEQ ID NO: 112314 - protein, 9 aa, Dengue virus
LAGPIPVTP

SEQ ID NO: 112315 - protein, 9 aa, Dengue virus
AGPIPVTPA

SEQ ID NO: 112316 - protein, 9 aa, Dengue virus
GPIPVTPAS

SEQ ID NO: 112317 - protein, 9 aa, Dengue virus
PIPVTPASA

SEQ ID NO: 112318 - protein, 9 aa, Dengue virus
IPVTPASAA

SEQ ID NO: 112319 - protein, 9 aa, Dengue virus
PVTPASAAQ

SEQ ID NO: 112320 - protein, 9 aa, Dengue virus
VTPASAAQR

SEQ ID NO: 112321 - protein, 9 aa, Dengue virus
TPASAAQRR

SEQ ID NO: 112322 - protein, 9 aa, Dengue virus
PASAAQRRG

SEQ ID NO: 112323 - protein, 9 aa, Dengue virus
RRGRIGRNQ

SEQ ID NO: 112324 - protein, 9 aa, Dengue virus
KEGDQYVYM

SEQ ID NO: 112325 - protein, 9 aa, Dengue virus
EGDQYVYMG

SEQ ID NO: 112326 - protein, 9 aa, Dengue virus
GDQYVYMGQ

SEQ ID NO: 112327 - protein, 9 aa, Dengue virus
DQYVYMGQP

SEQ ID NO: 112328 - protein, 9 aa, Dengue virus
QYVYMGQPL

SEQ ID NO: 112329 - protein, 9 aa, Dengue virus
FSGDPLKND

SEQ ID NO: 112330 - protein, 9 aa, Dengue virus
SGDPLKNDE

SEQ ID NO: 112331 - protein, 9 aa, Dengue virus
PEREKSAAV

SEQ ID NO: 112332 - protein, 9 aa, Dengue virus
EREKSAAVD

SEQ ID NO: 112333 - protein, 9 aa, Dengue virus
REKSAAVDG

SEQ ID NO: 112334 - protein, 9 aa, Dengue virus
EKSAAVDGE

SEQ ID NO: 112335 - protein, 9 aa, Dengue virus
KSAAVDGEY

SEQ ID NO: 112336 - protein, 9 aa, Dengue virus
SAAVDGEYR

SEQ ID NO: 112337 - protein, 9 aa, Dengue virus
AAVDGEYRL

SEQ ID NO: 112338 - protein, 9 aa, Dengue virus
AVDGEYRLR

SEQ ID NO: 112339 - protein, 9 aa, Dengue virus
VDGEYRLRG

SEQ ID NO: 112340 - protein, 9 aa, Dengue virus
GEQRKTFVE

SEQ ID NO: 112341 - protein, 9 aa, Dengue virus
EQRKTFVEL

SEQ ID NO: 112342 - protein, 9 aa, Dengue virus
QRKTFVELM

SEQ ID NO: 112343 - protein, 9 aa, Dengue virus
GDLPVWLSH

SEQ ID NO: 112344 - protein, 9 aa, Dengue virus
DLPVWLAYR

SEQ ID NO: 112345 - protein, 9 aa, Dengue virus
LPVWLAYRV

SEQ ID NO: 112346 - protein, 9 aa, Dengue virus
PVWLAYRVA

SEQ ID NO: 112347 - protein, 9 aa, Dengue virus
VWLAYRVAA

SEQ ID NO: 112348 - protein, 9 aa, Dengue virus
YADRKWCFD

SEQ ID NO: 112349 - protein, 9 aa, Dengue virus
ADRKWCFDG

SEQ ID NO: 112350 - protein, 9 aa, Dengue virus
NQILEENME

SEQ ID NO: 112351 - protein, 9 aa, Dengue virus
QILEENMEV

SEQ ID NO: 112352 - protein, 9 aa, Dengue virus
ILEENMEVE

SEQ ID NO: 112353 - protein, 9 aa, Dengue virus
LEENMEVEV

SEQ ID NO: 112354 - protein, 9 aa, Dengue virus
EENMEVEVW

SEQ ID NO: 112355 - protein, 9 aa, Dengue virus
ENMEVEVWT

SEQ ID NO: 112356 - protein, 9 aa, Dengue virus
NMEVEIWTR

SEQ ID NO: 112357 - protein, 9 aa, Dengue virus
MEVEIWTRE

SEQ ID NO: 112358 - protein, 9 aa, Dengue virus
EKKKLRPKW

SEQ ID NO: 112359 - protein, 9 aa, Dengue virus
KKKLRPKWL

SEQ ID NO: 112360 - protein, 9 aa, Dengue virus
RPKWLDARV

SEQ ID NO: 112361 - protein, 9 aa, Dengue virus
PKWLDARVY

SEQ ID NO: 112362 - protein, 9 aa, Dengue virus
KWLDARVYA

SEQ ID NO: 112363 - protein, 9 aa, Dengue virus
VYADPMALK

SEQ ID NO: 112364 - protein, 9 aa, Dengue virus
PMALKDFKE

SEQ ID NO: 112365 - protein, 9 aa, Dengue virus
MALKDFKEF

SEQ ID NO: 112366 - protein, 9 aa, Dengue virus
ALKDFKEFA

SEQ ID NO: 112367 - protein, 9 aa, Dengue virus
LKDFKEFAS

SEQ ID NO: 112368 - protein, 9 aa, Dengue virus
KDFKEFASG

SEQ ID NO: 112369 - protein, 9 aa, Dengue virus
FKEFASGRK

SEQ ID NO: 112370 - protein, 9 aa, Dengue virus
KEFASGRKS

SEQ ID NO: 112371 - protein, 9 aa, Dengue virus
EFASGRKSI

SEQ ID NO: 112372 - protein, 9 aa, Dengue virus
FASGRKSIT

SEQ ID NO: 112373 - protein, 9 aa, Dengue virus
ASGRKSITL

SEQ ID NO: 112374 - protein, 9 aa, Dengue virus
DILTEIASL

SEQ ID NO: 112375 - protein, 9 aa, Dengue virus
ILTEIASLP

SEQ ID NO: 112376 - protein, 9 aa, Dengue virus
LTEIASLPT

SEQ ID NO: 112377 - protein, 9 aa, Dengue virus
TEIASLPTY

SEQ ID NO: 112378 - protein, 9 aa, Dengue virus
EIASLPTYL

SEQ ID NO: 112379 - protein, 9 aa, Dengue virus
IASLPTYLS

SEQ ID NO: 112380 - protein, 9 aa, Dengue virus
RNALDNLAV

SEQ ID NO: 112381 - protein, 9 aa, Dengue virus
LALDNIVML

SEQ ID NO: 112382 - protein, 9 aa, Dengue virus
LDNIVMLHT

SEQ ID NO: 112383 - protein, 9 aa, Dengue virus
DNIVMLHTT

SEQ ID NO: 112384 - protein, 9 aa, Dengue virus
NIVMLHTTE

SEQ ID NO: 112385 - protein, 9 aa, Dengue virus
AYQHALNEL

SEQ ID NO: 112386 - protein, 9 aa, Dengue virus
YQHALNELP

SEQ ID NO: 112387 - protein, 9 aa, Dengue virus
QHALNELPE

SEQ ID NO: 112388 - protein, 9 aa, Dengue virus
HALNELPES

SEQ ID NO: 112389 - protein, 9 aa, Dengue virus
ALNELPESL

SEQ ID NO: 112390 - protein, 9 aa, Dengue virus
LNELPESLE

SEQ ID NO: 112391 - protein, 9 aa, Dengue virus
NELPESLET

SEQ ID NO: 112392 - protein, 9 aa, Dengue virus
ELPESLETL

SEQ ID NO: 112393 - protein, 9 aa, Dengue virus
LPESLETLM

SEQ ID NO: 112394 - protein, 9 aa, Dengue virus
PESLETLML

SEQ ID NO: 112395 - protein, 9 aa, Dengue virus
ESLETLMLV

SEQ ID NO: 112396 - protein, 9 aa, Dengue virus
SLETLMLVA

SEQ ID NO: 112397 - protein, 9 aa, Dengue virus
LETLMLVAL

SEQ ID NO: 112398 - protein, 9 aa, Dengue virus
ETLMLVALL

SEQ ID NO: 112399 - protein, 9 aa, Dengue virus
TLMLVALLG

SEQ ID NO: 112400 - protein, 9 aa, Dengue virus
MTAGIFLFF

SEQ ID NO: 112401 - protein, 9 aa, Dengue virus
GKLSMGLIT

SEQ ID NO: 112402 - protein, 9 aa, Dengue virus
KLSMGLITI

SEQ ID NO: 112403 - protein, 9 aa, Dengue virus
VPLQWIASA

SEQ ID NO: 112404 - protein, 9 aa, Dengue virus
QPQWIAASI

SEQ ID NO: 112405 - protein, 9 aa, Dengue virus
NQLTYVIIA

SEQ ID NO: 112406 - protein, 9 aa, Dengue virus
QLIYVILTI

SEQ ID NO: 112407 - protein, 9 aa, Dengue virus
LIYVILTIL

SEQ ID NO: 112408 - protein, 9 aa, Dengue virus
IYVILTILT

SEQ ID NO: 112409 - protein, 9 aa, Dengue virus
IAANEMGLI

SEQ ID NO: 112410 - protein, 9 aa, Dengue virus
MGLIEKTKT

SEQ ID NO: 112411 - protein, 9 aa, Dengue virus
GLIEKTKTD

SEQ ID NO: 112412 - protein, 9 aa, Dengue virus
LIEKTKTDF

SEQ ID NO: 112413 - protein, 9 aa, Dengue virus
IEKTKTDFG

SEQ ID NO: 112414 - protein, 9 aa, Dengue virus
LYAVATTIL

SEQ ID NO: 112415 - protein, 9 aa, Dengue virus
YAVATTILT

SEQ ID NO: 112416 - protein, 9 aa, Dengue virus
AVATTILTP

SEQ ID NO: 112417 - protein, 9 aa, Dengue virus
VATTILTPM

SEQ ID NO: 112418 - protein, 9 aa, Dengue virus
LTPMLRHTI

SEQ ID NO: 112419 - protein, 9 aa, Dengue virus
MLRHTIENT

SEQ ID NO: 112420 - protein, 9 aa, Dengue virus
LRHTIENTS

SEQ ID NO: 112421 - protein, 9 aa, Dengue virus
RHTIENTSA

SEQ ID NO: 112422 - protein, 9 aa, Dengue virus
HTIENTSAN

SEQ ID NO: 112423 - protein, 9 aa, Dengue virus
TIENTSANL

SEQ ID NO: 112424 - protein, 9 aa, Dengue virus
IENTSANLS

SEQ ID NO: 112425 - protein, 9 aa, Dengue virus
ENTSANLSL

SEQ ID NO: 112426 - protein, 9 aa, Dengue virus
NTSANLSLA

SEQ ID NO: 112427 - protein, 9 aa, Dengue virus
TSANLSLAA

SEQ ID NO: 112428 - protein, 9 aa, Dengue virus
SANLSLAAI

SEQ ID NO: 112429 - protein, 9 aa, Dengue virus
ANLSLAAIA

SEQ ID NO: 112430 - protein, 9 aa, Dengue virus
NLSLAAIAN

SEQ ID NO: 112431 - protein, 9 aa, Dengue virus
LSLAAIANQ

SEQ ID NO: 112432 - protein, 9 aa, Dengue virus
LAAIANQAA

SEQ ID NO: 112433 - protein, 9 aa, Dengue virus
AAIANQAAV

SEQ ID NO: 112434 - protein, 9 aa, Dengue virus
AIANQAAVL

SEQ ID NO: 112435 - protein, 9 aa, Dengue virus
IANQAAVLM

SEQ ID NO: 112436 - protein, 9 aa, Dengue virus
ANQAAVLMG

SEQ ID NO: 112437 - protein, 9 aa, Dengue virus
NQAAVLMGL

SEQ ID NO: 112438 - protein, 9 aa, Dengue virus
QAAVLMGLG

SEQ ID NO: 112439 - protein, 9 aa, Dengue virus
AAVLMGLGK

SEQ ID NO: 112440 - protein, 9 aa, Dengue virus
AVLMGLGKG

SEQ ID NO: 112441 - protein, 9 aa, Dengue virus
VLMGLGRGW

SEQ ID NO: 112442 - protein, 9 aa, Dengue virus
GLGRGWPLS

SEQ ID NO: 112443 - protein, 9 aa, Dengue virus
LGRGWPLSK

SEQ ID NO: 112444 - protein, 9 aa, Dengue virus
GRGWPLSKM

SEQ ID NO: 112445 - protein, 9 aa, Dengue virus
RGWPLSKMD

SEQ ID NO: 112446 - protein, 9 aa, Dengue virus
GWPLHRMDL

SEQ ID NO: 112447 - protein, 9 aa, Dengue virus
WPLHRMDLG

SEQ ID NO: 112448 - protein, 9 aa, Dengue virus
PLHRMDLGV

SEQ ID NO: 112449 - protein, 9 aa, Dengue virus
LHRMDLGVP

SEQ ID NO: 112450 - protein, 9 aa, Dengue virus
DLGVPLLAM

SEQ ID NO: 112451 - protein, 9 aa, Dengue virus
LGVPLLAMG

SEQ ID NO: 112452 - protein, 9 aa, Dengue virus
SQVNPLTLI

SEQ ID NO: 112453 - protein, 9 aa, Dengue virus
QVNPLTLIA

SEQ ID NO: 112454 - protein, 9 aa, Dengue virus
VNPLTLIAA

SEQ ID NO: 112455 - protein, 9 aa, Dengue virus
NPLTLIAAV

SEQ ID NO: 112456 - protein, 9 aa, Dengue virus
LLVHYAIIG

SEQ ID NO: 112457 - protein, 9 aa, Dengue virus
LVHYAIIGP

SEQ ID NO: 112458 - protein, 9 aa, Dengue virus
KNPTIDGIV

SEQ ID NO: 112459 - protein, 9 aa, Dengue virus
NPTIDGIVA

SEQ ID NO: 112460 - protein, 9 aa, Dengue virus
PTIDGIVAI

SEQ ID NO: 112461 - protein, 9 aa, Dengue virus
VIDLEPIPY

SEQ ID NO: 112462 - protein, 9 aa, Dengue virus
IDLEPIPYD

SEQ ID NO: 112463 - protein, 9 aa, Dengue virus
PISYDPKFE

SEQ ID NO: 112464 - protein, 9 aa, Dengue virus
ISYDPKFEK

SEQ ID NO: 112465 - protein, 9 aa, Dengue virus
SYDPKFEKQ

SEQ ID NO: 112466 - protein, 9 aa, Dengue virus
QVMLLVLCV

SEQ ID NO: 112467 - protein, 9 aa, Dengue virus
LCAGQLLLM

SEQ ID NO: 112468 - protein, 9 aa, Dengue virus
CAGQLLLMR

SEQ ID NO: 112469 - protein, 9 aa, Dengue virus
AGQLLLMRT

SEQ ID NO: 112470 - protein, 9 aa, Dengue virus
GQLLLMRTT

SEQ ID NO: 112471 - protein, 9 aa, Dengue virus
QLLLMRTTW

SEQ ID NO: 112472 - protein, 9 aa, Dengue virus
LLLMRTTWA

SEQ ID NO: 112473 - protein, 9 aa, Dengue virus
LLMRTTWAF

SEQ ID NO: 112474 - protein, 9 aa, Dengue virus
LMRTTWAFC

SEQ ID NO: 112475 - protein, 9 aa, Dengue virus
MRTSWAFCE

SEQ ID NO: 112476 - protein, 9 aa, Dengue virus
RTTWAFCEV

SEQ ID NO: 112477 - protein, 9 aa, Dengue virus
TTWAFCEVL

SEQ ID NO: 112478 - protein, 9 aa, Dengue virus
TWAFCEVLT

SEQ ID NO: 112479 - protein, 9 aa, Dengue virus
WAFCEALTL

SEQ ID NO: 112480 - protein, 9 aa, Dengue virus
AFCEALTLA

SEQ ID NO: 112481 - protein, 9 aa, Dengue virus
FCEALTLAT

SEQ ID NO: 112482 - protein, 9 aa, Dengue virus
ALTLATGPV

SEQ ID NO: 112483 - protein, 9 aa, Dengue virus
LTLATGPIL

SEQ ID NO: 112484 - protein, 9 aa, Dengue virus
TLATGPILT

SEQ ID NO: 112485 - protein, 9 aa, Dengue virus
LATGPILTL

SEQ ID NO: 112486 - protein, 9 aa, Dengue virus
ATGPILTLW

SEQ ID NO: 112487 - protein, 9 aa, Dengue virus
TGPILTLWE

SEQ ID NO: 112488 - protein, 9 aa, Dengue virus
GPILTLWEG

SEQ ID NO: 112489 - protein, 9 aa, Dengue virus
PILTLWEGN

SEQ ID NO: 112490 - protein, 9 aa, Dengue virus
ILTLWEGNP

SEQ ID NO: 112491 - protein, 9 aa, Dengue virus
GAGLAFSLI

SEQ ID NO: 112492 - protein, 9 aa, Dengue virus
AGLAFSLIK

SEQ ID NO: 112493 - protein, 9 aa, Dengue virus
GLAFSLIKN

SEQ ID NO: 112494 - protein, 9 aa, Dengue virus
LAFSLIKNA

SEQ ID NO: 112495 - protein, 9 aa, Dengue virus
MGETLGEKW

SEQ ID NO: 112496 - protein, 9 aa, Dengue virus
ETLGEKWKN

SEQ ID NO: 112497 - protein, 9 aa, Dengue virus
TLGEKWKNR

SEQ ID NO: 112498 - protein, 9 aa, Dengue virus
LGEKWKNRL

SEQ ID NO: 112499 - protein, 9 aa, Dengue virus
GEKWKNRLN

SEQ ID NO: 112500 - protein, 9 aa, Dengue virus
EVDRTEAKS

SEQ ID NO: 112501 - protein, 9 aa, Dengue virus
VDRTEAKSA

SEQ ID NO: 112502 - protein, 9 aa, Dengue virus
DRTEAKSAL

SEQ ID NO: 112503 - protein, 9 aa, Dengue virus
EAKEGLRRG

SEQ ID NO: 112504 - protein, 9 aa, Dengue virus
AKEGLRRGE

SEQ ID NO: 112505 - protein, 9 aa, Dengue virus
KSALKDGSK

SEQ ID NO: 112506 - protein, 9 aa, Dengue virus
KHAVSRGSS

SEQ ID NO: 112507 - protein, 9 aa, Dengue virus
VSRGSSKIR

SEQ ID NO: 112508 - protein, 9 aa, Dengue virus
SRGSSKIRW

SEQ ID NO: 112509 - protein, 9 aa, Dengue virus
RGSSKIRWI

SEQ ID NO: 112510 - protein, 9 aa, Dengue virus
GSSKIRWIV

SEQ ID NO: 112511 - protein, 9 aa, Dengue virus
SSKIRWIVE

SEQ ID NO: 112512 - protein, 9 aa, Dengue virus
IRWIVERGM

SEQ ID NO: 112513 - protein, 9 aa, Dengue virus
RWIVERGMV

SEQ ID NO: 112514 - protein, 9 aa, Dengue virus
PKGKVVDLG

SEQ ID NO: 112515 - protein, 9 aa, Dengue virus
KGKVVDLGC

SEQ ID NO: 112516 - protein, 9 aa, Dengue virus
SYYCGGLKD

SEQ ID NO: 112517 - protein, 9 aa, Dengue virus
YYCGGLKDV

SEQ ID NO: 112518 - protein, 9 aa, Dengue virus
YCGGLKNVK

SEQ ID NO: 112519 - protein, 9 aa, Dengue virus
CGGLKNVKE

SEQ ID NO: 112520 - protein, 9 aa, Dengue virus
GGLKNVKEV

SEQ ID NO: 112521 - protein, 9 aa, Dengue virus
VKEVKGLTK

SEQ ID NO: 112522 - protein, 9 aa, Dengue virus
KEVKGLTKG

SEQ ID NO: 112523 - protein, 9 aa, Dengue virus
STYGWNLVK

SEQ ID NO: 112524 - protein, 9 aa, Dengue virus
YGWNLVKLY

SEQ ID NO: 112525 - protein, 9 aa, Dengue virus
GWNLVKLYS

SEQ ID NO: 112526 - protein, 9 aa, Dengue virus
WNLVKLYSG

SEQ ID NO: 112527 - protein, 9 aa, Dengue virus
LHSGVDVFY

SEQ ID NO: 112528 - protein, 9 aa, Dengue virus
GESSSNPTI

SEQ ID NO: 112529 - protein, 9 aa, Dengue virus
ESSSNPTIE

SEQ ID NO: 112530 - protein, 9 aa, Dengue virus
SSPNPTVEA

SEQ ID NO: 112531 - protein, 9 aa, Dengue virus
SPNPTVEAG

SEQ ID NO: 112532 - protein, 9 aa, Dengue virus
PNPTVEAGR

SEQ ID NO: 112533 - protein, 9 aa, Dengue virus
NPTVEAGRT

SEQ ID NO: 112534 - protein, 9 aa, Dengue virus
PTVEAGRTL

SEQ ID NO: 112535 - protein, 9 aa, Dengue virus
TVEAGRTLR

SEQ ID NO: 112536 - protein, 9 aa, Dengue virus
VEAGRTLRV

SEQ ID NO: 112537 - protein, 9 aa, Dengue virus
AGRTLRVLS

SEQ ID NO: 112538 - protein, 9 aa, Dengue virus
GRTLRVLSL

SEQ ID NO: 112539 - protein, 9 aa, Dengue virus
RTLRVLSLV

SEQ ID NO: 112540 - protein, 9 aa, Dengue virus
TLRVLSLVE

SEQ ID NO: 112541 - protein, 9 aa, Dengue virus
LRVLSLVEN

SEQ ID NO: 112542 - protein, 9 aa, Dengue virus
LKMVEPWLS

SEQ ID NO: 112543 - protein, 9 aa, Dengue virus
QFCVKVLNP

SEQ ID NO: 112544 - protein, 9 aa, Dengue virus
KVLNPYMPA

SEQ ID NO: 112545 - protein, 9 aa, Dengue virus
VLNPYMPAV

SEQ ID NO: 112546 - protein, 9 aa, Dengue virus
LNPYMPAVI

SEQ ID NO: 112547 - protein, 9 aa, Dengue virus
NPYMPAVIE

SEQ ID NO: 112548 - protein, 9 aa, Dengue virus
HGGNLVRCP

SEQ ID NO: 112549 - protein, 9 aa, Dengue virus
THEMYWVSG

SEQ ID NO: 112550 - protein, 9 aa, Dengue virus
HEMYWVSGA

SEQ ID NO: 112551 - protein, 9 aa, Dengue virus
EMYWVSNAS

SEQ ID NO: 112552 - protein, 9 aa, Dengue virus
MYWVSNASG

SEQ ID NO: 112553 - protein, 9 aa, Dengue virus
YWVSNASGN

SEQ ID NO: 112554 - protein, 9 aa, Dengue virus
WVSNASGNI

SEQ ID NO: 112555 - protein, 9 aa, Dengue virus
VSNASGNIV

SEQ ID NO: 112556 - protein, 9 aa, Dengue virus
GTGNIVASV

SEQ ID NO: 112557 - protein, 9 aa, Dengue virus
TGNIVASVN

SEQ ID NO: 112558 - protein, 9 aa, Dengue virus
GNIVSSVNT

SEQ ID NO: 112559 - protein, 9 aa, Dengue virus
NIVSSVNMV

SEQ ID NO: 112560 - protein, 9 aa, Dengue virus
IVSSVNMVS

SEQ ID NO: 112561 - protein, 9 aa, Dengue virus
VSSVNMVSR

SEQ ID NO: 112562 - protein, 9 aa, Dengue virus
SSVNMVSRL

SEQ ID NO: 112563 - protein, 9 aa, Dengue virus
SVNTTSKML

SEQ ID NO: 112564 - protein, 9 aa, Dengue virus
VNTTSKMLL

SEQ ID NO: 112565 - protein, 9 aa, Dengue virus
NTTSKMLLN

SEQ ID NO: 112566 - protein, 9 aa, Dengue virus
TTSKMLLNR

SEQ ID NO: 112567 - protein, 9 aa, Dengue virus
TSKMLLNRF

SEQ ID NO: 112568 - protein, 9 aa, Dengue virus
SKMLLNRFT

SEQ ID NO: 112569 - protein, 9 aa, Dengue virus
KMLLNRFTT

SEQ ID NO: 112570 - protein, 9 aa, Dengue virus
PTYEKDVDL

SEQ ID NO: 112571 - protein, 9 aa, Dengue virus
TYEKDVDLG

SEQ ID NO: 112572 - protein, 9 aa, Dengue virus
ERDVDLGTG

SEQ ID NO: 112573 - protein, 9 aa, Dengue virus
RDVDLGTGT

SEQ ID NO: 112574 - protein, 9 aa, Dengue virus
VDLGTGTRH

SEQ ID NO: 112575 - protein, 9 aa, Dengue virus
DLGTGTRHV

SEQ ID NO: 112576 - protein, 9 aa, Dengue virus
LGAGTRSVS

SEQ ID NO: 112577 - protein, 9 aa, Dengue virus
GAGTRSVST

SEQ ID NO: 112578 - protein, 9 aa, Dengue virus
AGTRSVSTE

SEQ ID NO: 112579 - protein, 9 aa, Dengue virus
PDMTIIGRR

SEQ ID NO: 112580 - protein, 9 aa, Dengue virus
DMTIIGRRL

SEQ ID NO: 112581 - protein, 9 aa, Dengue virus
TIIGRRLQR

SEQ ID NO: 112582 - protein, 9 aa, Dengue virus
IIGRRLQRL

SEQ ID NO: 112583 - protein, 9 aa, Dengue virus
IGRRLQRLQ

SEQ ID NO: 112584 - protein, 9 aa, Dengue virus
TWHYDQENP

SEQ ID NO: 112585 - protein, 9 aa, Dengue virus
WHYDQENPY

SEQ ID NO: 112586 - protein, 9 aa, Dengue virus
HYDQENPYR

SEQ ID NO: 112587 - protein, 9 aa, Dengue virus
YDQENPYRT

SEQ ID NO: 112588 - protein, 9 aa, Dengue virus
DQENPYRTW

SEQ ID NO: 112589 - protein, 9 aa, Dengue virus
QENPYRTWA

SEQ ID NO: 112590 - protein, 9 aa, Dengue virus
ENPYRTWAY

SEQ ID NO: 112591 - protein, 9 aa, Dengue virus
YHGSYEAPS

SEQ ID NO: 112592 - protein, 9 aa, Dengue virus
HGSYEAPST

SEQ ID NO: 112593 - protein, 9 aa, Dengue virus
GSYEAPSTG

SEQ ID NO: 112594 - protein, 9 aa, Dengue virus
SYEAPSTGS

SEQ ID NO: 112595 - protein, 9 aa, Dengue virus
YEAPSTGSA

SEQ ID NO: 112596 - protein, 9 aa, Dengue virus
EAPSTGSAS

SEQ ID NO: 112597 - protein, 9 aa, Dengue virus
APSTGSASS

SEQ ID NO: 112598 - protein, 9 aa, Dengue virus
PSTGSASSM

SEQ ID NO: 112599 - protein, 9 aa, Dengue virus
STGSASSMV

SEQ ID NO: 112600 - protein, 9 aa, Dengue virus
TKPWDVVPT

SEQ ID NO: 112601 - protein, 9 aa, Dengue virus
KPWDVVPTV

SEQ ID NO: 112602 - protein, 9 aa, Dengue virus
PWDVVPTVT

SEQ ID NO: 112603 - protein, 9 aa, Dengue virus
WDVVPTVTQ

SEQ ID NO: 112604 - protein, 9 aa, Dengue virus
PMVTQLAMT

SEQ ID NO: 112605 - protein, 9 aa, Dengue virus
MVTQLAMTD

SEQ ID NO: 112606 - protein, 9 aa, Dengue virus
EKVDTRTPQ

SEQ ID NO: 112607 - protein, 9 aa, Dengue virus
PRICTRAEF

SEQ ID NO: 112608 - protein, 9 aa, Dengue virus
CTRAEFCNK

SEQ ID NO: 112609 - protein, 9 aa, Dengue virus
TRAEFCNKV

SEQ ID NO: 112610 - protein, 9 aa, Dengue virus
RAEFCNKVR

SEQ ID NO: 112611 - protein, 9 aa, Dengue virus
SKVRSNAAI

SEQ ID NO: 112612 - protein, 9 aa, Dengue virus
RSNAALGAV

SEQ ID NO: 112613 - protein, 9 aa, Dengue virus
SNAALGAVF

SEQ ID NO: 112614 - protein, 9 aa, Dengue virus
NAAIGAVFQ

SEQ ID NO: 112615 - protein, 9 aa, Dengue virus
AAIGAVFQE

SEQ ID NO: 112616 - protein, 9 aa, Dengue virus
AIGAVFQEE

SEQ ID NO: 112617 - protein, 9 aa, Dengue virus
IGAVFQEEQ

SEQ ID NO: 112618 - protein, 9 aa, Dengue virus
GAVFQEEQG

SEQ ID NO: 112619 - protein, 9 aa, Dengue virus
AVFQEEQGW

SEQ ID NO: 112620 - protein, 9 aa, Dengue virus
VFQEEQGWT

SEQ ID NO: 112621 - protein, 9 aa, Dengue virus
FQEEQGWTS

SEQ ID NO: 112622 - protein, 9 aa, Dengue virus
QEEQGWTSA

SEQ ID NO: 112623 - protein, 9 aa, Dengue virus
EENQWDSAR

SEQ ID NO: 112624 - protein, 9 aa, Dengue virus
ENQWDSARA

SEQ ID NO: 112625 - protein, 9 aa, Dengue virus
NQWDSARAA

SEQ ID NO: 112626 - protein, 9 aa, Dengue virus
QWDSARAAV

SEQ ID NO: 112627 - protein, 9 aa, Dengue virus
WDSARAAVE

SEQ ID NO: 112628 - protein, 9 aa, Dengue virus
DSARAAVED

SEQ ID NO: 112629 - protein, 9 aa, Dengue virus
ERALHQEGK

SEQ ID NO: 112630 - protein, 9 aa, Dengue virus
RALHQEGKC

SEQ ID NO: 112631 - protein, 9 aa, Dengue virus
ALHQEGKCE

SEQ ID NO: 112632 - protein, 9 aa, Dengue virus
LHQEGKCES

SEQ ID NO: 112633 - protein, 9 aa, Dengue virus
HQEGKCESC

SEQ ID NO: 112634 - protein, 9 aa, Dengue virus
QEGKCESCV

SEQ ID NO: 112635 - protein, 9 aa, Dengue virus
EGKCESCVY

SEQ ID NO: 112636 - protein, 9 aa, Dengue virus
GKCESCVYN

SEQ ID NO: 112637 - protein, 9 aa, Dengue virus
KCESCVYNM

SEQ ID NO: 112638 - protein, 9 aa, Dengue virus
CESCVYNMM

SEQ ID NO: 112639 - protein, 9 aa, Dengue virus
ESCVYNMMG

SEQ ID NO: 112640 - protein, 9 aa, Dengue virus
HWFGRENSW

SEQ ID NO: 112641 - protein, 9 aa, Dengue virus
WFGRENSWS

SEQ ID NO: 112642 - protein, 9 aa, Dengue virus
FGRENSWSG

SEQ ID NO: 112643 - protein, 9 aa, Dengue virus
GRENSWSGV

SEQ ID NO: 112644 - protein, 9 aa, Dengue virus
RENSWSGVE

SEQ ID NO: 112645 - protein, 9 aa, Dengue virus
ENSWSGVEG

SEQ ID NO: 112646 - protein, 9 aa, Dengue virus
NSFSGVEGE

SEQ ID NO: 112647 - protein, 9 aa, Dengue virus
SFSGVEGEG

SEQ ID NO: 112648 - protein, 9 aa, Dengue virus
FSGVEGEGL

SEQ ID NO: 112649 - protein, 9 aa, Dengue virus
GDLIYADDT

SEQ ID NO: 112650 - protein, 9 aa, Dengue virus
DLIYADDTA

SEQ ID NO: 112651 - protein, 9 aa, Dengue virus
LIYADDTAG

SEQ ID NO: 112652 - protein, 9 aa, Dengue virus
AGWDTRITS

SEQ ID NO: 112653 - protein, 9 aa, Dengue virus
GWDTRITSE

SEQ ID NO: 112654 - protein, 9 aa, Dengue virus
WDTRITSED

SEQ ID NO: 112655 - protein, 9 aa, Dengue virus
DTRITSEDL

SEQ ID NO: 112656 - protein, 9 aa, Dengue virus
KVVKVLRPT

SEQ ID NO: 112657 - protein, 9 aa, Dengue virus
VVKVLRPTP

SEQ ID NO: 112658 - protein, 9 aa, Dengue virus
AVMDIISRK

SEQ ID NO: 112659 - protein, 9 aa, Dengue virus
FTNMGAQLI

SEQ ID NO: 112660 - protein, 9 aa, Dengue virus
TNMGAQLIR

SEQ ID NO: 112661 - protein, 9 aa, Dengue virus
NMGAQLIRQ

SEQ ID NO: 112662 - protein, 9 aa, Dengue virus
MGAQLIRQM

SEQ ID NO: 112663 - protein, 9 aa, Dengue virus
AQLVRQMEG

SEQ ID NO: 112664 - protein, 9 aa, Dengue virus
QLIRQMEAE

SEQ ID NO: 112665 - protein, 9 aa, Dengue virus
LIRQMEAEG

SEQ ID NO: 112666 - protein, 9 aa, Dengue virus
ERLRRMAIS

SEQ ID NO: 112667 - protein, 9 aa, Dengue virus
GDDCVVKPV

SEQ ID NO: 112668 - protein, 9 aa, Dengue virus
DDCVVKPVD

SEQ ID NO: 112669 - protein, 9 aa, Dengue virus
DCVVKPTDD

SEQ ID NO: 112670 - protein, 9 aa, Dengue virus
CVVKPTDDR

SEQ ID NO: 112671 - protein, 9 aa, Dengue virus
VVKPTDDRF

SEQ ID NO: 112672 - protein, 9 aa, Dengue virus
ALIALNDMG

SEQ ID NO: 112673 - protein, 9 aa, Dengue virus
LIALNDMGK

SEQ ID NO: 112674 - protein, 9 aa, Dengue virus
MGKVRKDVP

SEQ ID NO: 112675 - protein, 9 aa, Dengue virus
IRKDIQQWE

SEQ ID NO: 112676 - protein, 9 aa, Dengue virus
DIQQWEPSK

SEQ ID NO: 112677 - protein, 9 aa, Dengue virus
IQQWEPSKG

SEQ ID NO: 112678 - protein, 9 aa, Dengue virus
QQWEPSKGW

SEQ ID NO: 112679 - protein, 9 aa, Dengue virus
QWEPSKGWK

SEQ ID NO: 112680 - protein, 9 aa, Dengue virus
WEPSKGWKN

SEQ ID NO: 112681 - protein, 9 aa, Dengue virus
EPSKGWKNW

SEQ ID NO: 112682 - protein, 9 aa, Dengue virus
GWKNWQEVP

SEQ ID NO: 112683 - protein, 9 aa, Dengue virus
WKNWQEVPF

SEQ ID NO: 112684 - protein, 9 aa, Dengue virus
KNWQEVPFC

SEQ ID NO: 112685 - protein, 9 aa, Dengue virus
CSHHFHKIF

SEQ ID NO: 112686 - protein, 9 aa, Dengue virus
SHHFHKIFM

SEQ ID NO: 112687 - protein, 9 aa, Dengue virus
HHFHKIFMK

SEQ ID NO: 112688 - protein, 9 aa, Dengue virus
HFHKIFMKD

SEQ ID NO: 112689 - protein, 9 aa, Dengue virus
FHKIFMKDG

SEQ ID NO: 112690 - protein, 9 aa, Dengue virus
HKIFMKDGR

SEQ ID NO: 112691 - protein, 9 aa, Dengue virus
KETACLGKA

SEQ ID NO: 112692 - protein, 9 aa, Dengue virus
GKSYAQMWT

SEQ ID NO: 112693 - protein, 9 aa, Dengue virus
KSYAQMWTL

SEQ ID NO: 112694 - protein, 9 aa, Dengue virus
SYAQMWTLM

SEQ ID NO: 112695 - protein, 9 aa, Dengue virus
YAQMWALMY

SEQ ID NO: 112696 - protein, 9 aa, Dengue virus
AQMWALMYF

SEQ ID NO: 112697 - protein, 9 aa, Dengue virus
QMWALMYFH

SEQ ID NO: 112698 - protein, 9 aa, Dengue virus
MWALMYFHR

SEQ ID NO: 112699 - protein, 9 aa, Dengue virus
WALMYFHRR

SEQ ID NO: 112700 - protein, 9 aa, Dengue virus
ALMYFHRRD

SEQ ID NO: 112701 - protein, 9 aa, Dengue virus
NAICSAVPP

SEQ ID NO: 112702 - protein, 9 aa, Dengue virus
EWFPTSRTT

SEQ ID NO: 112703 - protein, 9 aa, Dengue virus
RTTWSIHAS

SEQ ID NO: 112704 - protein, 9 aa, Dengue virus
TTWSIHASH

SEQ ID NO: 112705 - protein, 9 aa, Dengue virus
TWSIHASHE

SEQ ID NO: 112706 - protein, 9 aa, Dengue virus
WSIHASHEW

SEQ ID NO: 112707 - protein, 9 aa, Dengue virus
SIHASHEWM

SEQ ID NO: 112708 - protein, 9 aa, Dengue virus
IHASHEWMT

SEQ ID NO: 112709 - protein, 9 aa, Dengue virus
HASHEWMTT

SEQ ID NO: 112710 - protein, 9 aa, Dengue virus
ASHEWMTTE

SEQ ID NO: 112711 - protein, 9 aa, Dengue virus
SHEWMTTED

SEQ ID NO: 112712 - protein, 9 aa, Dengue virus
WMTTEDMLK

SEQ ID NO: 112713 - protein, 9 aa, Dengue virus
MTTEDMLKV

SEQ ID NO: 112714 - protein, 9 aa, Dengue virus
TTEDMLKVW

SEQ ID NO: 112715 - protein, 9 aa, Dengue virus
TEDMLKVWN

SEQ ID NO: 112716 - protein, 9 aa, Dengue virus
EDMLKVWNR

SEQ ID NO: 112717 - protein, 9 aa, Dengue virus
DMLKVWNRV

SEQ ID NO: 112718 - protein, 9 aa, Dengue virus
MLKVWNRVW

SEQ ID NO: 112719 - protein, 9 aa, Dengue virus
LKVWNRVWI

SEQ ID NO: 112720 - protein, 9 aa, Dengue virus
DNPNMTDKT

SEQ ID NO: 112721 - protein, 9 aa, Dengue virus
NVPYLGKRE

SEQ ID NO: 112722 - protein, 9 aa, Dengue virus
LTARATWAS

SEQ ID NO: 112723 - protein, 9 aa, Dengue virus
TARATWASN

SEQ ID NO: 112724 - protein, 9 aa, Dengue virus
ARATWASNI

SEQ ID NO: 112725 - protein, 9 aa, Dengue virus
DYMISMKRF

SEQ ID NO: 112726 - protein, 9 aa, Dengue virus
YMISMKRFK

SEQ ID NO: 112727 - protein, 9 aa, Dengue virus
RNRVSTIQQ

SEQ ID NO: 112728 - protein, 9 aa, Dengue virus
NRVSTIQQL

SEQ ID NO: 112729 - protein, 9 aa, Dengue virus
RVSTIQQLT

SEQ ID NO: 112730 - protein, 9 aa, Dengue virus
VSTIQQLTK

SEQ ID NO: 112731 - protein, 9 aa, Dengue virus
STIQQLTKR

SEQ ID NO: 112732 - protein, 9 aa, Dengue virus
TIQQLTKRF

SEQ ID NO: 112733 - protein, 9 aa, Dengue virus
IQQLTKRFS

SEQ ID NO: 112734 - protein, 9 aa, Dengue virus
KRFSTGLFS

SEQ ID NO: 112735 - protein, 9 aa, Dengue virus
RFSTGLFSG

SEQ ID NO: 112736 - protein, 9 aa, Dengue virus
FSTGLFSGK

SEQ ID NO: 112737 - protein, 9 aa, Dengue virus
STGLFSGKG

SEQ ID NO: 112738 - protein, 9 aa, Dengue virus
TGLFSGKGP

SEQ ID NO: 112739 - protein, 9 aa, Dengue virus
GQGPMKFVM

SEQ ID NO: 112740 - protein, 9 aa, Dengue virus
QGPMKFVMA

SEQ ID NO: 112741 - protein, 9 aa, Dengue virus
GPLKLFMAF

SEQ ID NO: 112742 - protein, 9 aa, Dengue virus
LFMAFVAFL

SEQ ID NO: 112743 - protein, 9 aa, Dengue virus
GFKREISNM

SEQ ID NO: 112744 - protein, 9 aa, Dengue virus
FKREISNML

SEQ ID NO: 112745 - protein, 9 aa, Dengue virus
TFHLTTRGG

SEQ ID NO: 112746 - protein, 9 aa, Dengue virus
GKSLLFKTK

SEQ ID NO: 112747 - protein, 9 aa, Dengue virus
LIAMDLGEF

SEQ ID NO: 112748 - protein, 9 aa, Dengue virus
IAMDLGEFC

SEQ ID NO: 112749 - protein, 9 aa, Dengue virus
AMDLGEMCE

SEQ ID NO: 112750 - protein, 9 aa, Dengue virus
MDLGEMCED

SEQ ID NO: 112751 - protein, 9 aa, Dengue virus
VDCWCNTTD

SEQ ID NO: 112752 - protein, 9 aa, Dengue virus
DCWCNTTDT

SEQ ID NO: 112753 - protein, 9 aa, Dengue virus
CWCNTTDTW

SEQ ID NO: 112754 - protein, 9 aa, Dengue virus
AWVMYGTCT

SEQ ID NO: 112755 - protein, 9 aa, Dengue virus
SSEGAWRQI

SEQ ID NO: 112756 - protein, 9 aa, Dengue virus
SEGAWRQIQ

SEQ ID NO: 112757 - protein, 9 aa, Dengue virus
IETWVLRHP

SEQ ID NO: 112758 - protein, 9 aa, Dengue virus
ETWVLRHPG

SEQ ID NO: 112759 - protein, 9 aa, Dengue virus
TWVLRHPGF

SEQ ID NO: 112760 - protein, 9 aa, Dengue virus
WVLRHPGFT

SEQ ID NO: 112761 - protein, 9 aa, Dengue virus
IAPSMTMRC

SEQ ID NO: 112762 - protein, 9 aa, Dengue virus
TPSMTMRCI

SEQ ID NO: 112763 - protein, 9 aa, Dengue virus
MRCIGMSNR

SEQ ID NO: 112764 - protein, 9 aa, Dengue virus
RCIGMSNRD

SEQ ID NO: 112765 - protein, 9 aa, Dengue virus
CIGMSNRDF

SEQ ID NO: 112766 - protein, 9 aa, Dengue virus
IGMSNRDFV

SEQ ID NO: 112767 - protein, 9 aa, Dengue virus
GCVTTMAKS

SEQ ID NO: 112768 - protein, 9 aa, Dengue virus
AKSKPTLDI

SEQ ID NO: 112769 - protein, 9 aa, Dengue virus
KSKPTLDIE

SEQ ID NO: 112770 - protein, 9 aa, Dengue virus
SKPTLDIEL

SEQ ID NO: 112771 - protein, 9 aa, Dengue virus
FELIKTTAK

SEQ ID NO: 112772 - protein, 9 aa, Dengue virus
CRHSMVDRG

SEQ ID NO: 112773 - protein, 9 aa, Dengue virus
RHSMVDRGW

SEQ ID NO: 112774 - protein, 9 aa, Dengue virus
GLFGKGGVV

SEQ ID NO: 112775 - protein, 9 aa, Dengue virus
LFGKGGVVT

SEQ ID NO: 112776 - protein, 9 aa, Dengue virus
FGKGGVVTC

SEQ ID NO: 112777 - protein, 9 aa, Dengue virus
GKGGVVTCA

SEQ ID NO: 112778 - protein, 9 aa, Dengue virus
KGGVVTCAK

SEQ ID NO: 112779 - protein, 9 aa, Dengue virus
GGVVTCAKF

SEQ ID NO: 112780 - protein, 9 aa, Dengue virus
VVTVHNGDT

SEQ ID NO: 112781 - protein, 9 aa, Dengue virus
GEENAVGND

SEQ ID NO: 112782 - protein, 9 aa, Dengue virus
ITMECSPRT

SEQ ID NO: 112783 - protein, 9 aa, Dengue virus
NEMVLLQMK

SEQ ID NO: 112784 - protein, 9 aa, Dengue virus
DLPLPWTTG

SEQ ID NO: 112785 - protein, 9 aa, Dengue virus
LPLPWTTGA

SEQ ID NO: 112786 - protein, 9 aa, Dengue virus
KERMVTFKV

SEQ ID NO: 112787 - protein, 9 aa, Dengue virus
LGNILFMGH

SEQ ID NO: 112788 - protein, 9 aa, Dengue virus
GNILFMGHL

SEQ ID NO: 112789 - protein, 9 aa, Dengue virus
NILFMGHLK

SEQ ID NO: 112790 - protein, 9 aa, Dengue virus
ILFMGHLKC

SEQ ID NO: 112791 - protein, 9 aa, Dengue virus
LKMDKLTLR

SEQ ID NO: 112792 - protein, 9 aa, Dengue virus
KMDKLTLRG

SEQ ID NO: 112793 - protein, 9 aa, Dengue virus
EKELAETQH

SEQ ID NO: 112794 - protein, 9 aa, Dengue virus
KELAETQHG

SEQ ID NO: 112795 - protein, 9 aa, Dengue virus
ELAETQHGT

SEQ ID NO: 112796 - protein, 9 aa, Dengue virus
LAETQHGTV

SEQ ID NO: 112797 - protein, 9 aa, Dengue virus
LEPPFGDSY

SEQ ID NO: 112798 - protein, 9 aa, Dengue virus
SSIGQMIET

SEQ ID NO: 112799 - protein, 9 aa, Dengue virus
SIGQMIETT

SEQ ID NO: 112800 - protein, 9 aa, Dengue virus
WDFGSIGGL

SEQ ID NO: 112801 - protein, 9 aa, Dengue virus
FGAAYGVLF

SEQ ID NO: 112802 - protein, 9 aa, Dengue virus
AYTALFGGV

SEQ ID NO: 112803 - protein, 9 aa, Dengue virus
YTALFGGVS

SEQ ID NO: 112804 - protein, 9 aa, Dengue virus
TALFGGVSW

SEQ ID NO: 112805 - protein, 9 aa, Dengue virus
FGGVSWMVR

SEQ ID NO: 112806 - protein, 9 aa, Dengue virus
GGVSWMVRI

SEQ ID NO: 112807 - protein, 9 aa, Dengue virus
VITWIGMNS

SEQ ID NO: 112808 - protein, 9 aa, Dengue virus
WLGLNSRSA

SEQ ID NO: 112809 - protein, 9 aa, Dengue virus
LYLGTVVQA

SEQ ID NO: 112810 - protein, 9 aa, Dengue virus
YLGTVVQAD

SEQ ID NO: 112811 - protein, 9 aa, Dengue virus
CGNGIFVTN

SEQ ID NO: 112812 - protein, 9 aa, Dengue virus
GNGIFVTNE

SEQ ID NO: 112813 - protein, 9 aa, Dengue virus
NGIFVTNEV

SEQ ID NO: 112814 - protein, 9 aa, Dengue virus
KRLSAAIGR

SEQ ID NO: 112815 - protein, 9 aa, Dengue virus
RLSAAIGRA

SEQ ID NO: 112816 - protein, 9 aa, Dengue virus
EEDICGIRS

SEQ ID NO: 112817 - protein, 9 aa, Dengue virus
RSTTRLENI

SEQ ID NO: 112818 - protein, 9 aa, Dengue virus
STTRLENIM

SEQ ID NO: 112819 - protein, 9 aa, Dengue virus
TTRLENIMW

SEQ ID NO: 112820 - protein, 9 aa, Dengue virus
TRLENIMWR

SEQ ID NO: 112821 - protein, 9 aa, Dengue virus
RLENIMWRQ

SEQ ID NO: 112822 - protein, 9 aa, Dengue virus
LENIMWRQI

SEQ ID NO: 112823 - protein, 9 aa, Dengue virus
ELNYVLWEG

SEQ ID NO: 112824 - protein, 9 aa, Dengue virus
SWKIWGKAK

SEQ ID NO: 112825 - protein, 9 aa, Dengue virus
TFLIDGPDT

SEQ ID NO: 112826 - protein, 9 aa, Dengue virus
VFTTNIWLR

SEQ ID NO: 112827 - protein, 9 aa, Dengue virus
KDDRAVHAD

SEQ ID NO: 112828 - protein, 9 aa, Dengue virus
DDRAVHADM

SEQ ID NO: 112829 - protein, 9 aa, Dengue virus
DRAVHADMG

SEQ ID NO: 112830 - protein, 9 aa, Dengue virus
DMGYWIESR

SEQ ID NO: 112831 - protein, 9 aa, Dengue virus
MGYWIESRL

SEQ ID NO: 112832 - protein, 9 aa, Dengue virus
GYWIESRLN

SEQ ID NO: 112833 - protein, 9 aa, Dengue virus
ESRLNDTWK

SEQ ID NO: 112834 - protein, 9 aa, Dengue virus
ASFIEIKSC

SEQ ID NO: 112835 - protein, 9 aa, Dengue virus
TAGPWHLGR

SEQ ID NO: 112836 - protein, 9 aa, Dengue virus
CTMPPLRFL

SEQ ID NO: 112837 - protein, 9 aa, Dengue virus
TMPPLRFLG

SEQ ID NO: 112838 - protein, 9 aa, Dengue virus
MPPLRFLGE

SEQ ID NO: 112839 - protein, 9 aa, Dengue virus
PPLRFLGED

SEQ ID NO: 112840 - protein, 9 aa, Dengue virus
PLRFLGEDG

SEQ ID NO: 112841 - protein, 9 aa, Dengue virus
LRFLGEDGC

SEQ ID NO: 112842 - protein, 9 aa, Dengue virus
RFLGEDGCW

SEQ ID NO: 112843 - protein, 9 aa, Dengue virus
FLGEDGCWY

SEQ ID NO: 112844 - protein, 9 aa, Dengue virus
EECLRRRVT

SEQ ID NO: 112845 - protein, 9 aa, Dengue virus
IGMGITYLA

SEQ ID NO: 112846 - protein, 9 aa, Dengue virus
IHLAIMAVF

SEQ ID NO: 112847 - protein, 9 aa, Dengue virus
LIRRLTSRE

SEQ ID NO: 112848 - protein, 9 aa, Dengue virus
RKLTSKELL

SEQ ID NO: 112849 - protein, 9 aa, Dengue virus
KLTSKELLM

SEQ ID NO: 112850 - protein, 9 aa, Dengue virus
LTSRETALM

SEQ ID NO: 112851 - protein, 9 aa, Dengue virus
TSRETALMV

SEQ ID NO: 112852 - protein, 9 aa, Dengue virus
ELTDAIALG

SEQ ID NO: 112853 - protein, 9 aa, Dengue virus
LTDAIALGI

SEQ ID NO: 112854 - protein, 9 aa, Dengue virus
TDAIALGIM

SEQ ID NO: 112855 - protein, 9 aa, Dengue virus
KRSWPLNEG

SEQ ID NO: 112856 - protein, 9 aa, Dengue virus
RSWPLNEAV

SEQ ID NO: 112857 - protein, 9 aa, Dengue virus
PLNEAVMAV

SEQ ID NO: 112858 - protein, 9 aa, Dengue virus
LNEAVMAVG

SEQ ID NO: 112859 - protein, 9 aa, Dengue virus
GLVSLLGSA

SEQ ID NO: 112860 - protein, 9 aa, Dengue virus
SILLSALLK

SEQ ID NO: 112861 - protein, 9 aa, Dengue virus
ILLSALLKN

SEQ ID NO: 112862 - protein, 9 aa, Dengue virus
LLSALLKND

SEQ ID NO: 112863 - protein, 9 aa, Dengue virus
LSALLKNDV

SEQ ID NO: 112864 - protein, 9 aa, Dengue virus
MADITGSSP

SEQ ID NO: 112865 - protein, 9 aa, Dengue virus
ADITGSSPI

SEQ ID NO: 112866 - protein, 9 aa, Dengue virus
DITGSSPII

SEQ ID NO: 112867 - protein, 9 aa, Dengue virus
ITGSSPIIE

SEQ ID NO: 112868 - protein, 9 aa, Dengue virus
AEDGSMSIK

SEQ ID NO: 112869 - protein, 9 aa, Dengue virus
TMKIKDEEK

SEQ ID NO: 112870 - protein, 9 aa, Dengue virus
LLKATLLAI

SEQ ID NO: 112871 - protein, 9 aa, Dengue virus
LKATLLAIS

SEQ ID NO: 112872 - protein, 9 aa, Dengue virus
KATLLAISG

SEQ ID NO: 112873 - protein, 9 aa, Dengue virus
QTRRSGVLW

SEQ ID NO: 112874 - protein, 9 aa, Dengue virus
RRSGVLWDV

SEQ ID NO: 112875 - protein, 9 aa, Dengue virus
LWDTPSPPK

SEQ ID NO: 112876 - protein, 9 aa, Dengue virus
ATLSEGVYR

SEQ ID NO: 112877 - protein, 9 aa, Dengue virus
TLSEGVYRI

SEQ ID NO: 112878 - protein, 9 aa, Dengue virus
LSEGVYRIM

SEQ ID NO: 112879 - protein, 9 aa, Dengue virus
SEGVYRIMQ

SEQ ID NO: 112880 - protein, 9 aa, Dengue virus
LGKTQVGVG

SEQ ID NO: 112881 - protein, 9 aa, Dengue virus
QVGVGIHME

SEQ ID NO: 112882 - protein, 9 aa, Dengue virus
VTRGSVICH

SEQ ID NO: 112883 - protein, 9 aa, Dengue virus
ETGRLEPSW

SEQ ID NO: 112884 - protein, 9 aa, Dengue virus
LEPNWANVK

SEQ ID NO: 112885 - protein, 9 aa, Dengue virus
EPNWANVKK

SEQ ID NO: 112886 - protein, 9 aa, Dengue virus
PNWANVKKD

SEQ ID NO: 112887 - protein, 9 aa, Dengue virus
NWANVKKDL

SEQ ID NO: 112888 - protein, 9 aa, Dengue virus
WADVRKDLI

SEQ ID NO: 112889 - protein, 9 aa, Dengue virus
ADVRKDLIS

SEQ ID NO: 112890 - protein, 9 aa, Dengue virus
DVKKDLVSY

SEQ ID NO: 112891 - protein, 9 aa, Dengue virus
WNAGEEVQV

SEQ ID NO: 112892 - protein, 9 aa, Dengue virus
NAGEEVQVI

SEQ ID NO: 112893 - protein, 9 aa, Dengue virus
AGTIGAVSL

SEQ ID NO: 112894 - protein, 9 aa, Dengue virus
TSGSPIVDK

SEQ ID NO: 112895 - protein, 9 aa, Dengue virus
NGVVTRSGT

SEQ ID NO: 112896 - protein, 9 aa, Dengue virus
GVVTRSGTY

SEQ ID NO: 112897 - protein, 9 aa, Dengue virus
VVTRSGTYV

SEQ ID NO: 112898 - protein, 9 aa, Dengue virus
VTRSGTYVS

SEQ ID NO: 112899 - protein, 9 aa, Dengue virus
SGTYVSSIA

SEQ ID NO: 112900 - protein, 9 aa, Dengue virus
TYVSAIAQT

SEQ ID NO: 112901 - protein, 9 aa, Dengue virus
VFKKRNLTI

SEQ ID NO: 112902 - protein, 9 aa, Dengue virus
KTRRYLPAM

SEQ ID NO: 112903 - protein, 9 aa, Dengue virus
RYLPAMVRE

SEQ ID NO: 112904 - protein, 9 aa, Dengue virus
PAIVREAIR

SEQ ID NO: 112905 - protein, 9 aa, Dengue virus
AIVREAIRR

SEQ ID NO: 112906 - protein, 9 aa, Dengue virus
REAIRRGLR

SEQ ID NO: 112907 - protein, 9 aa, Dengue virus
EAIRRGLRT

SEQ ID NO: 112908 - protein, 9 aa, Dengue virus
AIRRGLRTL

SEQ ID NO: 112909 - protein, 9 aa, Dengue virus
RRGLRTLIL

SEQ ID NO: 112910 - protein, 9 aa, Dengue virus
PIRYQTTAI

SEQ ID NO: 112911 - protein, 9 aa, Dengue virus
KAEHTGREI

SEQ ID NO: 112912 - protein, 9 aa, Dengue virus
VRVPNYNLV

SEQ ID NO: 112913 - protein, 9 aa, Dengue virus
DPFPQSNSP

SEQ ID NO: 112914 - protein, 9 aa, Dengue virus
IQDEEKDIP

SEQ ID NO: 112915 - protein, 9 aa, Dengue virus
QDEEKDIPE

SEQ ID NO: 112916 - protein, 9 aa, Dengue virus
PERSWSSGH

SEQ ID NO: 112917 - protein, 9 aa, Dengue virus
YQGKTVWFV

SEQ ID NO: 112918 - protein, 9 aa, Dengue virus
QGKTVWFVP

SEQ ID NO: 112919 - protein, 9 aa, Dengue virus
ACLRKNGKR

SEQ ID NO: 112920 - protein, 9 aa, Dengue virus
RKTFDTEYT

SEQ ID NO: 112921 - protein, 9 aa, Dengue virus
KTFDTEYTK

SEQ ID NO: 112922 - protein, 9 aa, Dengue virus
TFDSEYAKT

SEQ ID NO: 112923 - protein, 9 aa, Dengue virus
LTDWDFVVT

SEQ ID NO: 112924 - protein, 9 aa, Dengue virus
EMGANFRAE

SEQ ID NO: 112925 - protein, 9 aa, Dengue virus
MGANFRAER

SEQ ID NO: 112926 - protein, 9 aa, Dengue virus
GANFRAERV

SEQ ID NO: 112927 - protein, 9 aa, Dengue virus
ANFRAERVI

SEQ ID NO: 112928 - protein, 9 aa, Dengue virus
NFRAERVID

SEQ ID NO: 112929 - protein, 9 aa, Dengue virus
FRAERVIDP

SEQ ID NO: 112930 - protein, 9 aa, Dengue virus
RAERVIDPR

SEQ ID NO: 112931 - protein, 9 aa, Dengue virus
LPDGPERVI

SEQ ID NO: 112932 - protein, 9 aa, Dengue virus
PDGPERVIL

SEQ ID NO: 112933 - protein, 9 aa, Dengue virus
QEDDQYVFS

SEQ ID NO: 112934 - protein, 9 aa, Dengue virus
EDDQYVFSG

SEQ ID NO: 112935 - protein, 9 aa, Dengue virus
DDQYVFSGD

SEQ ID NO: 112936 - protein, 9 aa, Dengue virus
DQYVFSGDP

SEQ ID NO: 112937 - protein, 9 aa, Dengue virus
QYVFSGDPL

SEQ ID NO: 112938 - protein, 9 aa, Dengue virus
FMGQPLNND

SEQ ID NO: 112939 - protein, 9 aa, Dengue virus
DLPVWLSHK

SEQ ID NO: 112940 - protein, 9 aa, Dengue virus
VWLAYKVAS

SEQ ID NO: 112941 - protein, 9 aa, Dengue virus
YKDREWCFT

SEQ ID NO: 112942 - protein, 9 aa, Dengue virus
KDREWCFTG

SEQ ID NO: 112943 - protein, 9 aa, Dengue virus
NMEVEVWTK

SEQ ID NO: 112944 - protein, 9 aa, Dengue virus
MEVEVWTKE

SEQ ID NO: 112945 - protein, 9 aa, Dengue virus
EFAAGRKSI

SEQ ID NO: 112946 - protein, 9 aa, Dengue virus
FAAGRKSLA

SEQ ID NO: 112947 - protein, 9 aa, Dengue virus
AAGRKSLAL

SEQ ID NO: 112948 - protein, 9 aa, Dengue virus
SLITEMGRL

SEQ ID NO: 112949 - protein, 9 aa, Dengue virus
VTEIGRVPT

SEQ ID NO: 112950 - protein, 9 aa, Dengue virus
TEIGRVPTH

SEQ ID NO: 112951 - protein, 9 aa, Dengue virus
EIGRVPTHL

SEQ ID NO: 112952 - protein, 9 aa, Dengue virus
IGRVPTHLA

SEQ ID NO: 112953 - protein, 9 aa, Dengue virus
KLALDNIVM

SEQ ID NO: 112954 - protein, 9 aa, Dengue virus
AYTHALSEL

SEQ ID NO: 112955 - protein, 9 aa, Dengue virus
YTHALSELP

SEQ ID NO: 112956 - protein, 9 aa, Dengue virus
THALSELPE

SEQ ID NO: 112957 - protein, 9 aa, Dengue virus
TLETLLLLG

SEQ ID NO: 112958 - protein, 9 aa, Dengue virus
LETLLLLGL

SEQ ID NO: 112959 - protein, 9 aa, Dengue virus
ETLLLLGLL

SEQ ID NO: 112960 - protein, 9 aa, Dengue virus
TLLLLGLLA

SEQ ID NO: 112961 - protein, 9 aa, Dengue virus
LTGGVMLFL

SEQ ID NO: 112962 - protein, 9 aa, Dengue virus
GKLSMGLIA

SEQ ID NO: 112963 - protein, 9 aa, Dengue virus
KLSMGLIAI

SEQ ID NO: 112964 - protein, 9 aa, Dengue virus
IQPQWIAAS

SEQ ID NO: 112965 - protein, 9 aa, Dengue virus
QLTYVIIAI

SEQ ID NO: 112966 - protein, 9 aa, Dengue virus
LTYVIIAIL

SEQ ID NO: 112967 - protein, 9 aa, Dengue virus
TYVIIAILT

SEQ ID NO: 112968 - protein, 9 aa, Dengue virus
VTANEMGLL

SEQ ID NO: 112969 - protein, 9 aa, Dengue virus
FLEKTKKDF

SEQ ID NO: 112970 - protein, 9 aa, Dengue virus
LEKTKKDFG

SEQ ID NO: 112971 - protein, 9 aa, Dengue virus
LYAVATTFI

SEQ ID NO: 112972 - protein, 9 aa, Dengue virus
YAVATTFIT

SEQ ID NO: 112973 - protein, 9 aa, Dengue virus
AVATTFITP

SEQ ID NO: 112974 - protein, 9 aa, Dengue virus
VATTFITPM

SEQ ID NO: 112975 - protein, 9 aa, Dengue virus
ITPMLRHSI

SEQ ID NO: 112976 - protein, 9 aa, Dengue virus
ATVLMGLGR

SEQ ID NO: 112977 - protein, 9 aa, Dengue virus
TVLMGLGRG

SEQ ID NO: 112978 - protein, 9 aa, Dengue virus
VNPLTLTAV

SEQ ID NO: 112979 - protein, 9 aa, Dengue virus
NPLTLTAVV

SEQ ID NO: 112980 - protein, 9 aa, Dengue virus
LIAHYAIIG

SEQ ID NO: 112981 - protein, 9 aa, Dengue virus
IAHYAIIGP

SEQ ID NO: 112982 - protein, 9 aa, Dengue virus
KNPTVDGVT

SEQ ID NO: 112983 - protein, 9 aa, Dengue virus
NPTVDGVTV

SEQ ID NO: 112984 - protein, 9 aa, Dengue virus
PTVDGVTVI

SEQ ID NO: 112985 - protein, 9 aa, Dengue virus
VIDLEPISY

SEQ ID NO: 112986 - protein, 9 aa, Dengue virus
IDLEPISYD

SEQ ID NO: 112987 - protein, 9 aa, Dengue virus
LLMRTSWAF

SEQ ID NO: 112988 - protein, 9 aa, Dengue virus
LMRTSWAFC

SEQ ID NO: 112989 - protein, 9 aa, Dengue virus
RTSWAFCEA

SEQ ID NO: 112990 - protein, 9 aa, Dengue virus
TSWAFCEAL

SEQ ID NO: 112991 - protein, 9 aa, Dengue virus
SWAFCEALT

SEQ ID NO: 112992 - protein, 9 aa, Dengue virus
LTLATGPVS

SEQ ID NO: 112993 - protein, 9 aa, Dengue virus
TLATGPVST

SEQ ID NO: 112994 - protein, 9 aa, Dengue virus
LATGPVSTL

SEQ ID NO: 112995 - protein, 9 aa, Dengue virus
ATGPVSTLW

SEQ ID NO: 112996 - protein, 9 aa, Dengue virus
TGPVSTLWE

SEQ ID NO: 112997 - protein, 9 aa, Dengue virus
GPVSTLWEG

SEQ ID NO: 112998 - protein, 9 aa, Dengue virus
PVSTLWEGN

SEQ ID NO: 112999 - protein, 9 aa, Dengue virus
VSTLWEGNP

SEQ ID NO: 113000 - protein, 9 aa, Dengue virus
AGLLFSIMR

SEQ ID NO: 113001 - protein, 9 aa, Dengue virus
GLLFSIMRN

SEQ ID NO: 113002 - protein, 9 aa, Dengue virus
LLFSIMRNT

SEQ ID NO: 113003 - protein, 9 aa, Dengue virus
VGETLGEKW

SEQ ID NO: 113004 - protein, 9 aa, Dengue virus
KEGLRRGET

SEQ ID NO: 113005 - protein, 9 aa, Dengue virus
HHAVSRGTA

SEQ ID NO: 113006 - protein, 9 aa, Dengue virus
YCGGLKDVR

SEQ ID NO: 113007 - protein, 9 aa, Dengue virus
CGGLKDVRE

SEQ ID NO: 113008 - protein, 9 aa, Dengue virus
GGLKDVREV

SEQ ID NO: 113009 - protein, 9 aa, Dengue virus
YGWNLVKLM

SEQ ID NO: 113010 - protein, 9 aa, Dengue virus
GWNLVKLMS

SEQ ID NO: 113011 - protein, 9 aa, Dengue virus
WNLVKLMSG

SEQ ID NO: 113012 - protein, 9 aa, Dengue virus
LYSGKDVFF

SEQ ID NO: 113013 - protein, 9 aa, Dengue virus
SSSNPTIEE

SEQ ID NO: 113014 - protein, 9 aa, Dengue virus
SSNPTIEEG

SEQ ID NO: 113015 - protein, 9 aa, Dengue virus
SNPTIEEGR

SEQ ID NO: 113016 - protein, 9 aa, Dengue virus
LSLVENWLN

SEQ ID NO: 113017 - protein, 9 aa, Dengue virus
FGGALVRNP

SEQ ID NO: 113018 - protein, 9 aa, Dengue virus
EMYWVSGAS

SEQ ID NO: 113019 - protein, 9 aa, Dengue virus
MYWVSGASG

SEQ ID NO: 113020 - protein, 9 aa, Dengue virus
YWVSGASGN

SEQ ID NO: 113021 - protein, 9 aa, Dengue virus
WVSGASGNI

SEQ ID NO: 113022 - protein, 9 aa, Dengue virus
VSGASGNIV

SEQ ID NO: 113023 - protein, 9 aa, Dengue virus
GTGNIVSSV

SEQ ID NO: 113024 - protein, 9 aa, Dengue virus
NIVSSVNTT

SEQ ID NO: 113025 - protein, 9 aa, Dengue virus
IVSSVNTTS

SEQ ID NO: 113026 - protein, 9 aa, Dengue virus
VSSVNTTSK

SEQ ID NO: 113027 - protein, 9 aa, Dengue virus
SSVNTTSKM

SEQ ID NO: 113028 - protein, 9 aa, Dengue virus
PTFERDVDL

SEQ ID NO: 113029 - protein, 9 aa, Dengue virus
TFERDVDLG

SEQ ID NO: 113030 - protein, 9 aa, Dengue virus
LGTGTRHVA

SEQ ID NO: 113031 - protein, 9 aa, Dengue virus
GTGTRHVAV

SEQ ID NO: 113032 - protein, 9 aa, Dengue virus
TGTRHVAVE

SEQ ID NO: 113033 - protein, 9 aa, Dengue virus
PNMDIIGKR

SEQ ID NO: 113034 - protein, 9 aa, Dengue virus
NMDIIGKRI

SEQ ID NO: 113035 - protein, 9 aa, Dengue virus
DVIGERIRR

SEQ ID NO: 113036 - protein, 9 aa, Dengue virus
VIGERIRRI

SEQ ID NO: 113037 - protein, 9 aa, Dengue virus
IGERIRRIK

SEQ ID NO: 113038 - protein, 9 aa, Dengue virus
PWDVVPMVI

SEQ ID NO: 113039 - protein, 9 aa, Dengue virus
WDVVPMVIQ

SEQ ID NO: 113040 - protein, 9 aa, Dengue virus
CTREEFIRK

SEQ ID NO: 113041 - protein, 9 aa, Dengue virus
TREEFIRKV

SEQ ID NO: 113042 - protein, 9 aa, Dengue virus
REEFIRKVR

SEQ ID NO: 113043 - protein, 9 aa, Dengue virus
KKVRSNAAL

SEQ ID NO: 113044 - protein, 9 aa, Dengue virus
NAALGAVFT

SEQ ID NO: 113045 - protein, 9 aa, Dengue virus
AALGAVFTD

SEQ ID NO: 113046 - protein, 9 aa, Dengue virus
ALGAVFTDE

SEQ ID NO: 113047 - protein, 9 aa, Dengue virus
LGAVFTDEN

SEQ ID NO: 113048 - protein, 9 aa, Dengue virus
GAVFTDENK

SEQ ID NO: 113049 - protein, 9 aa, Dengue virus
AVFTDENKW

SEQ ID NO: 113050 - protein, 9 aa, Dengue virus
VFTDENKWK

SEQ ID NO: 113051 - protein, 9 aa, Dengue virus
EEQGWTSAS

SEQ ID NO: 113052 - protein, 9 aa, Dengue virus
EQGWTSASE

SEQ ID NO: 113053 - protein, 9 aa, Dengue virus
QGWTSASEA

SEQ ID NO: 113054 - protein, 9 aa, Dengue virus
GWTSASEAV

SEQ ID NO: 113055 - protein, 9 aa, Dengue virus
WTSASEAVN

SEQ ID NO: 113056 - protein, 9 aa, Dengue virus
TSASEAVND

SEQ ID NO: 113057 - protein, 9 aa, Dengue virus
RNLHLDGKC

SEQ ID NO: 113058 - protein, 9 aa, Dengue virus
NLHLDGKCE

SEQ ID NO: 113059 - protein, 9 aa, Dengue virus
LHLDGKCET

SEQ ID NO: 113060 - protein, 9 aa, Dengue virus
LDGKCETCV

SEQ ID NO: 113061 - protein, 9 aa, Dengue virus
DGKCETCVY

SEQ ID NO: 113062 - protein, 9 aa, Dengue virus
HWFSRENSF

SEQ ID NO: 113063 - protein, 9 aa, Dengue virus
WFSRENSFS

SEQ ID NO: 113064 - protein, 9 aa, Dengue virus
FSRENSFSG

SEQ ID NO: 113065 - protein, 9 aa, Dengue virus
SRENSFSGV

SEQ ID NO: 113066 - protein, 9 aa, Dengue virus
RENSFSGVE

SEQ ID NO: 113067 - protein, 9 aa, Dengue virus
ENSFSGVEG

SEQ ID NO: 113068 - protein, 9 aa, Dengue virus
VVRVQRPAR

SEQ ID NO: 113069 - protein, 9 aa, Dengue virus
VQLIRQMEA

SEQ ID NO: 113070 - protein, 9 aa, Dengue virus
ERLARMAIS

SEQ ID NO: 113071 - protein, 9 aa, Dengue virus
DCVVKPVDD

SEQ ID NO: 113072 - protein, 9 aa, Dengue virus
CVVKPVDDR

SEQ ID NO: 113073 - protein, 9 aa, Dengue virus
VVKPVDDRF

SEQ ID NO: 113074 - protein, 9 aa, Dengue virus
ALSALNDMG

SEQ ID NO: 113075 - protein, 9 aa, Dengue virus
LSALNDMGK

SEQ ID NO: 113076 - protein, 9 aa, Dengue virus
QWEPSKGWS

SEQ ID NO: 113077 - protein, 9 aa, Dengue virus
WEPSKGWSD

SEQ ID NO: 113078 - protein, 9 aa, Dengue virus
EPSKGWSDW

SEQ ID NO: 113079 - protein, 9 aa, Dengue virus
GWSDWTQVP

SEQ ID NO: 113080 - protein, 9 aa, Dengue virus
WSDWTQVPF

SEQ ID NO: 113081 - protein, 9 aa, Dengue virus
SDWTQVPFC

SEQ ID NO: 113082 - protein, 9 aa, Dengue virus
GKAYAQMWA

SEQ ID NO: 113083 - protein, 9 aa, Dengue virus
KAYAQMWAL

SEQ ID NO: 113084 - protein, 9 aa, Dengue virus
AYAQMWALM

SEQ ID NO: 113085 - protein, 9 aa, Dengue virus
NAICSAVPA

SEQ ID NO: 113086 - protein, 9 aa, Dengue virus
HWIPTSRTT

SEQ ID NO: 113087 - protein, 9 aa, Dengue virus
DIPYLGKRE

SEQ ID NO: 113088 - protein, 9 aa, Dengue virus
LSSRATWAK

SEQ ID NO: 113089 - protein, 9 aa, Dengue virus
SSRATWAKN

SEQ ID NO: 113090 - protein, 10 aa, Dengue virus
PSFNMLKRAR

SEQ ID NO: 113091 - protein, 10 aa, Dengue virus
SFNMLKRARN

SEQ ID NO: 113092 - protein, 10 aa, Dengue virus
FNMLKRARNR

SEQ ID NO: 113093 - protein, 10 aa, Dengue virus
NMLKRARNRV

SEQ ID NO: 113094 - protein, 10 aa, Dengue virus
MLKRARNRVS

SEQ ID NO: 113095 - protein, 10 aa, Dengue virus
LKRARNRVST

SEQ ID NO: 113096 - protein, 10 aa, Dengue virus
RNRVSTVSQL

SEQ ID NO: 113097 - protein, 10 aa, Dengue virus
NRVSTVSQLA

SEQ ID NO: 113098 - protein, 10 aa, Dengue virus
RVSTVSQLAK

SEQ ID NO: 113099 - protein, 10 aa, Dengue virus
VSTVSQLAKR

SEQ ID NO: 113100 - protein, 10 aa, Dengue virus
STVSQLAKRF

SEQ ID NO: 113101 - protein, 10 aa, Dengue virus
TVSQLAKRFS

SEQ ID NO: 113102 - protein, 10 aa, Dengue virus
SQLAKRFSKG

SEQ ID NO: 113103 - protein, 10 aa, Dengue virus
QLAKRFSKGL

SEQ ID NO: 113104 - protein, 10 aa, Dengue virus
LAKRFSKGLL

SEQ ID NO: 113105 - protein, 10 aa, Dengue virus
AKRFSKGLLS

SEQ ID NO: 113106 - protein, 10 aa, Dengue virus
KRFSKGLLSG

SEQ ID NO: 113107 - protein, 10 aa, Dengue virus
RFSKGLLSGQ

SEQ ID NO: 113108 - protein, 10 aa, Dengue virus
FSKGLLSGQG

SEQ ID NO: 113109 - protein, 10 aa, Dengue virus
SKGLLSGQGP

SEQ ID NO: 113110 - protein, 10 aa, Dengue virus
GLLSGQGPMK

SEQ ID NO: 113111 - protein, 10 aa, Dengue virus
GQGPMKLVMA

SEQ ID NO: 113112 - protein, 10 aa, Dengue virus
LVMAFIAFLR

SEQ ID NO: 113113 - protein, 10 aa, Dengue virus
VMAFIAFLRF

SEQ ID NO: 113114 - protein, 10 aa, Dengue virus
MAFIAFLRFL

SEQ ID NO: 113115 - protein, 10 aa, Dengue virus
AFIAFLRFLA

SEQ ID NO: 113116 - protein, 10 aa, Dengue virus
FIAFLRFLAI

SEQ ID NO: 113117 - protein, 10 aa, Dengue virus
IAFLRFLAIP

SEQ ID NO: 113118 - protein, 10 aa, Dengue virus
AFLRFLAIPP

SEQ ID NO: 113119 - protein, 10 aa, Dengue virus
FLRFLAIPPT

SEQ ID NO: 113120 - protein, 10 aa, Dengue virus
LRFLAIPPTA

SEQ ID NO: 113121 - protein, 10 aa, Dengue virus
RFLAIPPTAG

SEQ ID NO: 113122 - protein, 10 aa, Dengue virus
FLAIPPTAGI

SEQ ID NO: 113123 - protein, 10 aa, Dengue virus
LAIPPTAGIL

SEQ ID NO: 113124 - protein, 10 aa, Dengue virus
AIPPTAGILA

SEQ ID NO: 113125 - protein, 10 aa, Dengue virus
IPPTAGILAR

SEQ ID NO: 113126 - protein, 10 aa, Dengue virus
PPTAGILARW

SEQ ID NO: 113127 - protein, 10 aa, Dengue virus
PTAGILARWG

SEQ ID NO: 113128 - protein, 10 aa, Dengue virus
GFKKEISNML

SEQ ID NO: 113129 - protein, 10 aa, Dengue virus
AFHLTTRGGE

SEQ ID NO: 113130 - protein, 10 aa, Dengue virus
FHLTTRGGEP

SEQ ID NO: 113131 - protein, 10 aa, Dengue virus
HLTTRGGEPH

SEQ ID NO: 113132 - protein, 10 aa, Dengue virus
LTTRGGEPHM

SEQ ID NO: 113133 - protein, 10 aa, Dengue virus
TTRGGEPHMI

SEQ ID NO: 113134 - protein, 10 aa, Dengue virus
TRGGEPHMIV

SEQ ID NO: 113135 - protein, 10 aa, Dengue virus
QERGKSLLFK

SEQ ID NO: 113136 - protein, 10 aa, Dengue virus
ERGKSLLFKT

SEQ ID NO: 113137 - protein, 10 aa, Dengue virus
RGKSLLFKTS

SEQ ID NO: 113138 - protein, 10 aa, Dengue virus
NMCTLIAMDL

SEQ ID NO: 113139 - protein, 10 aa, Dengue virus
MCTLIAMDLG

SEQ ID NO: 113140 - protein, 10 aa, Dengue virus
CTLIAMDLGE

SEQ ID NO: 113141 - protein, 10 aa, Dengue virus
TLIAMDLGEL

SEQ ID NO: 113142 - protein, 10 aa, Dengue virus
LIAMDLGELC

SEQ ID NO: 113143 - protein, 10 aa, Dengue virus
AMDLGELCED

SEQ ID NO: 113144 - protein, 10 aa, Dengue virus
MDLGELCEDT

SEQ ID NO: 113145 - protein, 10 aa, Dengue virus
EPEDIDCWCN

SEQ ID NO: 113146 - protein, 10 aa, Dengue virus
PDDVDCWCNA

SEQ ID NO: 113147 - protein, 10 aa, Dengue virus
DDVDCWCNAT

SEQ ID NO: 113148 - protein, 10 aa, Dengue virus
DVDCWCNATD

SEQ ID NO: 113149 - protein, 10 aa, Dengue virus
VDCWCNATDT

SEQ ID NO: 113150 - protein, 10 aa, Dengue virus
DCWCNATDTW

SEQ ID NO: 113151 - protein, 10 aa, Dengue virus
TSTWVTYGTC

SEQ ID NO: 113152 - protein, 10 aa, Dengue virus
GEHRRDKRSV

SEQ ID NO: 113153 - protein, 10 aa, Dengue virus
EHRRDKRSVA

SEQ ID NO: 113154 - protein, 10 aa, Dengue virus
HRRDKRSVAL

SEQ ID NO: 113155 - protein, 10 aa, Dengue virus
RRDKRSVALA

SEQ ID NO: 113156 - protein, 10 aa, Dengue virus
RDKRSVALAP

SEQ ID NO: 113157 - protein, 10 aa, Dengue virus
DKRSVALAPH

SEQ ID NO: 113158 - protein, 10 aa, Dengue virus
KRSVALAPHV

SEQ ID NO: 113159 - protein, 10 aa, Dengue virus
RSVALAPHVG

SEQ ID NO: 113160 - protein, 10 aa, Dengue virus
SVALAPHVGL

SEQ ID NO: 113161 - protein, 10 aa, Dengue virus
VALAPHVGLG

SEQ ID NO: 113162 - protein, 10 aa, Dengue virus
ALAPHVGLGL

SEQ ID NO: 113163 - protein, 10 aa, Dengue virus
LAPHVGLGLE

SEQ ID NO: 113164 - protein, 10 aa, Dengue virus
APHVGLGLET

SEQ ID NO: 113165 - protein, 10 aa, Dengue virus
PHVGLGLETR

SEQ ID NO: 113166 - protein, 10 aa, Dengue virus
GLETRTETWM

SEQ ID NO: 113167 - protein, 10 aa, Dengue virus
LETRTETWMS

SEQ ID NO: 113168 - protein, 10 aa, Dengue virus
ETRTETWMSS

SEQ ID NO: 113169 - protein, 10 aa, Dengue virus
TRTETWMSSE

SEQ ID NO: 113170 - protein, 10 aa, Dengue virus
RTETWMSSEG

SEQ ID NO: 113171 - protein, 10 aa, Dengue virus
TETWMSSEGA

SEQ ID NO: 113172 - protein, 10 aa, Dengue virus
ETWMSSEGAW

SEQ ID NO: 113173 - protein, 10 aa, Dengue virus
TWMSSEGAWK

SEQ ID NO: 113174 - protein, 10 aa, Dengue virus
WMSSEGAWKQ

SEQ ID NO: 113175 - protein, 10 aa, Dengue virus
SSEGAWKQIQ

SEQ ID NO: 113176 - protein, 10 aa, Dengue virus
VETWALRHPG

SEQ ID NO: 113177 - protein, 10 aa, Dengue virus
ETWALRHPGF

SEQ ID NO: 113178 - protein, 10 aa, Dengue virus
TWALRHPGFT

SEQ ID NO: 113179 - protein, 10 aa, Dengue virus
TPSMAMRCVG

SEQ ID NO: 113180 - protein, 10 aa, Dengue virus
MRCVGIGSRD

SEQ ID NO: 113181 - protein, 10 aa, Dengue virus
RCVGIGSRDF

SEQ ID NO: 113182 - protein, 10 aa, Dengue virus
CVGIGSRDFV

SEQ ID NO: 113183 - protein, 10 aa, Dengue virus
VGIGSRDFVE

SEQ ID NO: 113184 - protein, 10 aa, Dengue virus
GIGSRDFVEG

SEQ ID NO: 113185 - protein, 10 aa, Dengue virus
GSRDFVEGLS

SEQ ID NO: 113186 - protein, 10 aa, Dengue virus
NRDFVEGVSG

SEQ ID NO: 113187 - protein, 10 aa, Dengue virus
RDFVEGLSGA

SEQ ID NO: 113188 - protein, 10 aa, Dengue virus
DFVEGLSGAT

SEQ ID NO: 113189 - protein, 10 aa, Dengue virus
FVEGLSGATW

SEQ ID NO: 113190 - protein, 10 aa, Dengue virus
VEGLSGATWV

SEQ ID NO: 113191 - protein, 10 aa, Dengue virus
EGLSGATWVD

SEQ ID NO: 113192 - protein, 10 aa, Dengue virus
GLSGATWVDV

SEQ ID NO: 113193 - protein, 10 aa, Dengue virus
LSGATWVDVV

SEQ ID NO: 113194 - protein, 10 aa, Dengue virus
SGATWVDVVL

SEQ ID NO: 113195 - protein, 10 aa, Dengue virus
GATWVDVVLE

SEQ ID NO: 113196 - protein, 10 aa, Dengue virus
ATWVDVVLEH

SEQ ID NO: 113197 - protein, 10 aa, Dengue virus
TWVDVVLEHG

SEQ ID NO: 113198 - protein, 10 aa, Dengue virus
WVDVVLEHGS

SEQ ID NO: 113199 - protein, 10 aa, Dengue virus
VDVVLEHGSC

SEQ ID NO: 113200 - protein, 10 aa, Dengue virus
DVVLEHGSCV

SEQ ID NO: 113201 - protein, 10 aa, Dengue virus
VVLEHGSCVT

SEQ ID NO: 113202 - protein, 10 aa, Dengue virus
VLEHGSCVTT

SEQ ID NO: 113203 - protein, 10 aa, Dengue virus
LEHGSCVTTM

SEQ ID NO: 113204 - protein, 10 aa, Dengue virus
EHGSCVTTMA

SEQ ID NO: 113205 - protein, 10 aa, Dengue virus
HGSCVTTMAK

SEQ ID NO: 113206 - protein, 10 aa, Dengue virus
GSCVTTMAKN

SEQ ID NO: 113207 - protein, 10 aa, Dengue virus
SCVTTMAKNK

SEQ ID NO: 113208 - protein, 10 aa, Dengue virus
CVTTMAKNKP

SEQ ID NO: 113209 - protein, 10 aa, Dengue virus
VTTMAKNKPT

SEQ ID NO: 113210 - protein, 10 aa, Dengue virus
TTMAKNKPTL

SEQ ID NO: 113211 - protein, 10 aa, Dengue virus
TMAKNKPTLD

SEQ ID NO: 113212 - protein, 10 aa, Dengue virus
MAKDKPTLDI

SEQ ID NO: 113213 - protein, 10 aa, Dengue virus
AKDKPTLDIE

SEQ ID NO: 113214 - protein, 10 aa, Dengue virus
KDKPTLDIEL

SEQ ID NO: 113215 - protein, 10 aa, Dengue virus
KPTLDIELLK

SEQ ID NO: 113216 - protein, 10 aa, Dengue virus
PTLDIELLKT

SEQ ID NO: 113217 - protein, 10 aa, Dengue virus
TLDIELLKTE

SEQ ID NO: 113218 - protein, 10 aa, Dengue virus
LDIELLKTEV

SEQ ID NO: 113219 - protein, 10 aa, Dengue virus
DIELLKTEVT

SEQ ID NO: 113220 - protein, 10 aa, Dengue virus
TTDSRCPTQG

SEQ ID NO: 113221 - protein, 10 aa, Dengue virus
TDSRCPTQGE

SEQ ID NO: 113222 - protein, 10 aa, Dengue virus
DSRCPTQGEA

SEQ ID NO: 113223 - protein, 10 aa, Dengue virus
CRRTFVDRGW

SEQ ID NO: 113224 - protein, 10 aa, Dengue virus
RRTFVDRGWG

SEQ ID NO: 113225 - protein, 10 aa, Dengue virus
RTFVDRGWGN

SEQ ID NO: 113226 - protein, 10 aa, Dengue virus
TFVDRGWGNG

SEQ ID NO: 113227 - protein, 10 aa, Dengue virus
FVDRGWGNGC

SEQ ID NO: 113228 - protein, 10 aa, Dengue virus
VDRGWGNGCG

SEQ ID NO: 113229 - protein, 10 aa, Dengue virus
DRGWGNGCGL

SEQ ID NO: 113230 - protein, 10 aa, Dengue virus
RGWGNGCGLF

SEQ ID NO: 113231 - protein, 10 aa, Dengue virus
GWGNGCGLFG

SEQ ID NO: 113232 - protein, 10 aa, Dengue virus
WGNGCGLFGK

SEQ ID NO: 113233 - protein, 10 aa, Dengue virus
GNGCGLFGKG

SEQ ID NO: 113234 - protein, 10 aa, Dengue virus
NGCGLFGKGS

SEQ ID NO: 113235 - protein, 10 aa, Dengue virus
GCGLFGKGSL

SEQ ID NO: 113236 - protein, 10 aa, Dengue virus
CGLFGKGSLI

SEQ ID NO: 113237 - protein, 10 aa, Dengue virus
GLFGKGSLIT

SEQ ID NO: 113238 - protein, 10 aa, Dengue virus
LFGKGSLITC

SEQ ID NO: 113239 - protein, 10 aa, Dengue virus
FGKGSLITCA

SEQ ID NO: 113240 - protein, 10 aa, Dengue virus
GKGSLITCAK

SEQ ID NO: 113241 - protein, 10 aa, Dengue virus
KGSLITCAKF

SEQ ID NO: 113242 - protein, 10 aa, Dengue virus
TVHTGDQHQV

SEQ ID NO: 113243 - protein, 10 aa, Dengue virus
VHTGDQHQVG

SEQ ID NO: 113244 - protein, 10 aa, Dengue virus
HTGDQHQVGN

SEQ ID NO: 113245 - protein, 10 aa, Dengue virus
TGDQHQVGNE

SEQ ID NO: 113246 - protein, 10 aa, Dengue virus
LTLDCSPRTG

SEQ ID NO: 113247 - protein, 10 aa, Dengue virus
TLDCSPRTGL

SEQ ID NO: 113248 - protein, 10 aa, Dengue virus
LDCSPRTGLD

SEQ ID NO: 113249 - protein, 10 aa, Dengue virus
ECSPRTGLDF

SEQ ID NO: 113250 - protein, 10 aa, Dengue virus
CSPRTGLDFN

SEQ ID NO: 113251 - protein, 10 aa, Dengue virus
SPRTGLDFNE

SEQ ID NO: 113252 - protein, 10 aa, Dengue virus
PRTGLDFNEM

SEQ ID NO: 113253 - protein, 10 aa, Dengue virus
RTGLDFNEMV

SEQ ID NO: 113254 - protein, 10 aa, Dengue virus
TGLDFNEMVL

SEQ ID NO: 113255 - protein, 10 aa, Dengue virus
GLDFNEMVLL

SEQ ID NO: 113256 - protein, 10 aa, Dengue virus
LDFNEMVLLT

SEQ ID NO: 113257 - protein, 10 aa, Dengue virus
DFNEMVLLTM

SEQ ID NO: 113258 - protein, 10 aa, Dengue virus
KSWLVHKQWF

SEQ ID NO: 113259 - protein, 10 aa, Dengue virus
SWLVHKQWFL

SEQ ID NO: 113260 - protein, 10 aa, Dengue virus
WLVHKQWFLD

SEQ ID NO: 113261 - protein, 10 aa, Dengue virus
LVHKQWFLDL

SEQ ID NO: 113262 - protein, 10 aa, Dengue virus
VHKQWFLDLP

SEQ ID NO: 113263 - protein, 10 aa, Dengue virus
HKQWFLDLPL

SEQ ID NO: 113264 - protein, 10 aa, Dengue virus
KQWFLDLPLP

SEQ ID NO: 113265 - protein, 10 aa, Dengue virus
QWFLDLPLPW

SEQ ID NO: 113266 - protein, 10 aa, Dengue virus
WFLDLPLPWT

SEQ ID NO: 113267 - protein, 10 aa, Dengue virus
DLPLPWTSGA

SEQ ID NO: 113268 - protein, 10 aa, Dengue virus
QDLLVTFKTA

SEQ ID NO: 113269 - protein, 10 aa, Dengue virus
DLLVTFKTAH

SEQ ID NO: 113270 - protein, 10 aa, Dengue virus
LLVTFKTAHA

SEQ ID NO: 113271 - protein, 10 aa, Dengue virus
LVTFKTAHAK

SEQ ID NO: 113272 - protein, 10 aa, Dengue virus
VTFKTAHAKK

SEQ ID NO: 113273 - protein, 10 aa, Dengue virus
TFKTAHAKKQ

SEQ ID NO: 113274 - protein, 10 aa, Dengue virus
FKTAHAKKQE

SEQ ID NO: 113275 - protein, 10 aa, Dengue virus
KTAHAKKQEV

SEQ ID NO: 113276 - protein, 10 aa, Dengue virus
TAHAKKQEVV

SEQ ID NO: 113277 - protein, 10 aa, Dengue virus
AHAKKQEVVV

SEQ ID NO: 113278 - protein, 10 aa, Dengue virus
HAKKQEVVVL

SEQ ID NO: 113279 - protein, 10 aa, Dengue virus
AKKQEVVVLG

SEQ ID NO: 113280 - protein, 10 aa, Dengue virus
KKQEVVVLGS

SEQ ID NO: 113281 - protein, 10 aa, Dengue virus
KQEVVVLGSQ

SEQ ID NO: 113282 - protein, 10 aa, Dengue virus
QEVVVLGSQE

SEQ ID NO: 113283 - protein, 10 aa, Dengue virus
EVVVLGSQEG

SEQ ID NO: 113284 - protein, 10 aa, Dengue virus
VVVLGSQEGA

SEQ ID NO: 113285 - protein, 10 aa, Dengue virus
VVLGSQEGAM

SEQ ID NO: 113286 - protein, 10 aa, Dengue virus
VLGSQEGAMH

SEQ ID NO: 113287 - protein, 10 aa, Dengue virus
LGSQEGAMHT

SEQ ID NO: 113288 - protein, 10 aa, Dengue virus
GSQEGAMHTA

SEQ ID NO: 113289 - protein, 10 aa, Dengue virus
SQEGAMHTAL

SEQ ID NO: 113290 - protein, 10 aa, Dengue virus
QEGAMHTALT

SEQ ID NO: 113291 - protein, 10 aa, Dengue virus
EGAMHTALTG

SEQ ID NO: 113292 - protein, 10 aa, Dengue virus
GAMHTALTGA

SEQ ID NO: 113293 - protein, 10 aa, Dengue virus
AMHTALTGAT

SEQ ID NO: 113294 - protein, 10 aa, Dengue virus
MHTALTGATE

SEQ ID NO: 113295 - protein, 10 aa, Dengue virus
HTALTGATEI

SEQ ID NO: 113296 - protein, 10 aa, Dengue virus
TALTGATEIQ

SEQ ID NO: 113297 - protein, 10 aa, Dengue virus
ALTGATEIQT

SEQ ID NO: 113298 - protein, 10 aa, Dengue virus
LTGATEIQTS

SEQ ID NO: 113299 - protein, 10 aa, Dengue virus
GTTTIFAGHL

SEQ ID NO: 113300 - protein, 10 aa, Dengue virus
TTTIFAGHLK

SEQ ID NO: 113301 - protein, 10 aa, Dengue virus
TTIFAGHLKC

SEQ ID NO: 113302 - protein, 10 aa, Dengue virus
TIFAGHLKCR

SEQ ID NO: 113303 - protein, 10 aa, Dengue virus
IFAGHLKCRL

SEQ ID NO: 113304 - protein, 10 aa, Dengue virus
FAGHLKCRLK

SEQ ID NO: 113305 - protein, 10 aa, Dengue virus
AGHLKCRLKM

SEQ ID NO: 113306 - protein, 10 aa, Dengue virus
GHLKCRLKMD

SEQ ID NO: 113307 - protein, 10 aa, Dengue virus
HLKCRLKMDK

SEQ ID NO: 113308 - protein, 10 aa, Dengue virus
LKCRLKMDKL

SEQ ID NO: 113309 - protein, 10 aa, Dengue virus
KCRLKMDKLT

SEQ ID NO: 113310 - protein, 10 aa, Dengue virus
CRLKMDKLTL

SEQ ID NO: 113311 - protein, 10 aa, Dengue virus
RLKMDKLTLK

SEQ ID NO: 113312 - protein, 10 aa, Dengue virus
LKMDKLTLKG

SEQ ID NO: 113313 - protein, 10 aa, Dengue virus
EKEVAETQHG

SEQ ID NO: 113314 - protein, 10 aa, Dengue virus
KEVAETQHGT

SEQ ID NO: 113315 - protein, 10 aa, Dengue virus
EVAETQHGTV

SEQ ID NO: 113316 - protein, 10 aa, Dengue virus
VAETQHGTVL

SEQ ID NO: 113317 - protein, 10 aa, Dengue virus
AETQHGTVLV

SEQ ID NO: 113318 - protein, 10 aa, Dengue virus
ETQHGTVLVQ

SEQ ID NO: 113319 - protein, 10 aa, Dengue virus
PVNIEAEPPF

SEQ ID NO: 113320 - protein, 10 aa, Dengue virus
VNIEAEPPFG

SEQ ID NO: 113321 - protein, 10 aa, Dengue virus
NIEAEPPFGE

SEQ ID NO: 113322 - protein, 10 aa, Dengue virus
IEAEPPFGES

SEQ ID NO: 113323 - protein, 10 aa, Dengue virus
EAEPPFGESY

SEQ ID NO: 113324 - protein, 10 aa, Dengue virus
AEPPFGESYI

SEQ ID NO: 113325 - protein, 10 aa, Dengue virus
KKGSSIGKMF

SEQ ID NO: 113326 - protein, 10 aa, Dengue virus
KGSSIGKMFE

SEQ ID NO: 113327 - protein, 10 aa, Dengue virus
GSSIGKMFEA

SEQ ID NO: 113328 - protein, 10 aa, Dengue virus
SSIGKMFEAT

SEQ ID NO: 113329 - protein, 10 aa, Dengue virus
IGKMFEATAR

SEQ ID NO: 113330 - protein, 10 aa, Dengue virus
GKMFEATARG

SEQ ID NO: 113331 - protein, 10 aa, Dengue virus
KMFEATARGA

SEQ ID NO: 113332 - protein, 10 aa, Dengue virus
MFEATARGAR

SEQ ID NO: 113333 - protein, 10 aa, Dengue virus
FEATARGARR

SEQ ID NO: 113334 - protein, 10 aa, Dengue virus
EATARGARRM

SEQ ID NO: 113335 - protein, 10 aa, Dengue virus
ATARGARRMA

SEQ ID NO: 113336 - protein, 10 aa, Dengue virus
TARGARRMAI

SEQ ID NO: 113337 - protein, 10 aa, Dengue virus
ARGARRMAIL

SEQ ID NO: 113338 - protein, 10 aa, Dengue virus
RGARRMAILG

SEQ ID NO: 113339 - protein, 10 aa, Dengue virus
GARRMAILGD

SEQ ID NO: 113340 - protein, 10 aa, Dengue virus
ARRMAILGDT

SEQ ID NO: 113341 - protein, 10 aa, Dengue virus
RRMAILGDTA

SEQ ID NO: 113342 - protein, 10 aa, Dengue virus
RMAILGDTAW

SEQ ID NO: 113343 - protein, 10 aa, Dengue virus
MAILGDTAWD

SEQ ID NO: 113344 - protein, 10 aa, Dengue virus
AILGDTAWDF

SEQ ID NO: 113345 - protein, 10 aa, Dengue virus
ILGDTAWDFG

SEQ ID NO: 113346 - protein, 10 aa, Dengue virus
LGDTAWDFGS

SEQ ID NO: 113347 - protein, 10 aa, Dengue virus
GDTAWDFGSI

SEQ ID NO: 113348 - protein, 10 aa, Dengue virus
DTAWDFGSIG

SEQ ID NO: 113349 - protein, 10 aa, Dengue virus
TAWDFGSIGG

SEQ ID NO: 113350 - protein, 10 aa, Dengue virus
AWDFGSIGGV

SEQ ID NO: 113351 - protein, 10 aa, Dengue virus
AYGVLFSGVS

SEQ ID NO: 113352 - protein, 10 aa, Dengue virus
YGVLFSGVSW

SEQ ID NO: 113353 - protein, 10 aa, Dengue virus
FSGVSWTMKI

SEQ ID NO: 113354 - protein, 10 aa, Dengue virus
LLTWLGLNSR

SEQ ID NO: 113355 - protein, 10 aa, Dengue virus
LTWLGLNSRS

SEQ ID NO: 113356 - protein, 10 aa, Dengue virus
TWLGLNSRST

SEQ ID NO: 113357 - protein, 10 aa, Dengue virus
LYLGVMVQAD

SEQ ID NO: 113358 - protein, 10 aa, Dengue virus
GRELKCGSGI

SEQ ID NO: 113359 - protein, 10 aa, Dengue virus
KELKCGSGIF

SEQ ID NO: 113360 - protein, 10 aa, Dengue virus
ELKCGSGIFV

SEQ ID NO: 113361 - protein, 10 aa, Dengue virus
LKCGSGIFVT

SEQ ID NO: 113362 - protein, 10 aa, Dengue virus
KCGSGIFVTN

SEQ ID NO: 113363 - protein, 10 aa, Dengue virus
CGSGIFVTNE

SEQ ID NO: 113364 - protein, 10 aa, Dengue virus
GSGIFVTNEV

SEQ ID NO: 113365 - protein, 10 aa, Dengue virus
SGIFVTNEVH

SEQ ID NO: 113366 - protein, 10 aa, Dengue virus
GIFVTNEVHT

SEQ ID NO: 113367 - protein, 10 aa, Dengue virus
IFVTNEVHTW

SEQ ID NO: 113368 - protein, 10 aa, Dengue virus
FVTNEVHTWT

SEQ ID NO: 113369 - protein, 10 aa, Dengue virus
VTNEVHTWTE

SEQ ID NO: 113370 - protein, 10 aa, Dengue virus
TNEVHTWTEQ

SEQ ID NO: 113371 - protein, 10 aa, Dengue virus
NEVHTWTEQY

SEQ ID NO: 113372 - protein, 10 aa, Dengue virus
EVHTWTEQYK

SEQ ID NO: 113373 - protein, 10 aa, Dengue virus
VHTWTEQYKF

SEQ ID NO: 113374 - protein, 10 aa, Dengue virus
HTWTEQYKFQ

SEQ ID NO: 113375 - protein, 10 aa, Dengue virus
TWTEQYKFQA

SEQ ID NO: 113376 - protein, 10 aa, Dengue virus
WTEQYKFQAD

SEQ ID NO: 113377 - protein, 10 aa, Dengue virus
TEQYKFQADS

SEQ ID NO: 113378 - protein, 10 aa, Dengue virus
EQYKFQADSP

SEQ ID NO: 113379 - protein, 10 aa, Dengue virus
QYKFQADSPK

SEQ ID NO: 113380 - protein, 10 aa, Dengue virus
YKFQADSPKR

SEQ ID NO: 113381 - protein, 10 aa, Dengue virus
KFQADSPKRL

SEQ ID NO: 113382 - protein, 10 aa, Dengue virus
FQADSPKRLS

SEQ ID NO: 113383 - protein, 10 aa, Dengue virus
QADSPKRLSA

SEQ ID NO: 113384 - protein, 10 aa, Dengue virus
ADSPKRLSAA

SEQ ID NO: 113385 - protein, 10 aa, Dengue virus
DSPKRLSAAI

SEQ ID NO: 113386 - protein, 10 aa, Dengue virus
SPKRLSAAIG

SEQ ID NO: 113387 - protein, 10 aa, Dengue virus
PKRLSAAIGK

SEQ ID NO: 113388 - protein, 10 aa, Dengue virus
KRLSAAIGKA

SEQ ID NO: 113389 - protein, 10 aa, Dengue virus
GVCGIRSATR

SEQ ID NO: 113390 - protein, 10 aa, Dengue virus
VCGIRSATRL

SEQ ID NO: 113391 - protein, 10 aa, Dengue virus
CGIRSATRLE

SEQ ID NO: 113392 - protein, 10 aa, Dengue virus
GIRSATRLEN

SEQ ID NO: 113393 - protein, 10 aa, Dengue virus
IRSATRLENI

SEQ ID NO: 113394 - protein, 10 aa, Dengue virus
RSATRLENIM

SEQ ID NO: 113395 - protein, 10 aa, Dengue virus
SATRLENIMW

SEQ ID NO: 113396 - protein, 10 aa, Dengue virus
TRLENIMWKQ

SEQ ID NO: 113397 - protein, 10 aa, Dengue virus
RLENIMWKQI

SEQ ID NO: 113398 - protein, 10 aa, Dengue virus
YSWKTWGKAK

SEQ ID NO: 113399 - protein, 10 aa, Dengue virus
RAWNIWEVED

SEQ ID NO: 113400 - protein, 10 aa, Dengue virus
AWNIWEVEDY

SEQ ID NO: 113401 - protein, 10 aa, Dengue virus
WNIWEVEDYG

SEQ ID NO: 113402 - protein, 10 aa, Dengue virus
NIWEVEDYGF

SEQ ID NO: 113403 - protein, 10 aa, Dengue virus
IWEVEDYGFG

SEQ ID NO: 113404 - protein, 10 aa, Dengue virus
WEVEDYGFGI

SEQ ID NO: 113405 - protein, 10 aa, Dengue virus
EVEDYGFGVF

SEQ ID NO: 113406 - protein, 10 aa, Dengue virus
VEDYGFGVFT

SEQ ID NO: 113407 - protein, 10 aa, Dengue virus
EDYGFGVFTT

SEQ ID NO: 113408 - protein, 10 aa, Dengue virus
DYGFGVFTTN

SEQ ID NO: 113409 - protein, 10 aa, Dengue virus
YGFGVFTTNI

SEQ ID NO: 113410 - protein, 10 aa, Dengue virus
GFGVFTTNIW

SEQ ID NO: 113411 - protein, 10 aa, Dengue virus
FGVFTTNIWL

SEQ ID NO: 113412 - protein, 10 aa, Dengue virus
GVFTTNIWLK

SEQ ID NO: 113413 - protein, 10 aa, Dengue virus
CDHRLMSAAI

SEQ ID NO: 113414 - protein, 10 aa, Dengue virus
DHRLMSAAIK

SEQ ID NO: 113415 - protein, 10 aa, Dengue virus
HRLMSAAIKD

SEQ ID NO: 113416 - protein, 10 aa, Dengue virus
KDSKAVHADM

SEQ ID NO: 113417 - protein, 10 aa, Dengue virus
DSKAVHADMG

SEQ ID NO: 113418 - protein, 10 aa, Dengue virus
SKAVHADMGY

SEQ ID NO: 113419 - protein, 10 aa, Dengue virus
RAVHADMGYW

SEQ ID NO: 113420 - protein, 10 aa, Dengue virus
AVHADMGYWI

SEQ ID NO: 113421 - protein, 10 aa, Dengue virus
VHADMGYWIE

SEQ ID NO: 113422 - protein, 10 aa, Dengue virus
HADMGYWIES

SEQ ID NO: 113423 - protein, 10 aa, Dengue virus
ADMGYWIESE

SEQ ID NO: 113424 - protein, 10 aa, Dengue virus
DMGYWIESEK

SEQ ID NO: 113425 - protein, 10 aa, Dengue virus
MGYWIESEKN

SEQ ID NO: 113426 - protein, 10 aa, Dengue virus
WPKSHTLWSN

SEQ ID NO: 113427 - protein, 10 aa, Dengue virus
PKSHTLWSNG

SEQ ID NO: 113428 - protein, 10 aa, Dengue virus
KSHTLWSNGV

SEQ ID NO: 113429 - protein, 10 aa, Dengue virus
SHTLWSNGVL

SEQ ID NO: 113430 - protein, 10 aa, Dengue virus
HTLWSNGVLE

SEQ ID NO: 113431 - protein, 10 aa, Dengue virus
TLWSNGVLES

SEQ ID NO: 113432 - protein, 10 aa, Dengue virus
LWSNGVLESE

SEQ ID NO: 113433 - protein, 10 aa, Dengue virus
WSNGVLESEM

SEQ ID NO: 113434 - protein, 10 aa, Dengue virus
SNGVLESEMI

SEQ ID NO: 113435 - protein, 10 aa, Dengue virus
NGVLESEMII

SEQ ID NO: 113436 - protein, 10 aa, Dengue virus
GVLESEMIIP

SEQ ID NO: 113437 - protein, 10 aa, Dengue virus
VLESEMIIPK

SEQ ID NO: 113438 - protein, 10 aa, Dengue virus
TQTAGPWHLG

SEQ ID NO: 113439 - protein, 10 aa, Dengue virus
QTAGPWHLGK

SEQ ID NO: 113440 - protein, 10 aa, Dengue virus
TAGPWHLGKL

SEQ ID NO: 113441 - protein, 10 aa, Dengue virus
AGPWHLGKLE

SEQ ID NO: 113442 - protein, 10 aa, Dengue virus
GPWHLGKLEL

SEQ ID NO: 113443 - protein, 10 aa, Dengue virus
PWHLGKLELD

SEQ ID NO: 113444 - protein, 10 aa, Dengue virus
WHLGKLELDF

SEQ ID NO: 113445 - protein, 10 aa, Dengue virus
CGNRGPSLRT

SEQ ID NO: 113446 - protein, 10 aa, Dengue virus
GNRGPSLRTT

SEQ ID NO: 113447 - protein, 10 aa, Dengue virus
NRGPSLRTTT

SEQ ID NO: 113448 - protein, 10 aa, Dengue virus
RGPSLRTTTV

SEQ ID NO: 113449 - protein, 10 aa, Dengue virus
GPSLRTTTVT

SEQ ID NO: 113450 - protein, 10 aa, Dengue virus
PSLRTTTVTG

SEQ ID NO: 113451 - protein, 10 aa, Dengue virus
SLRTTTVTGK

SEQ ID NO: 113452 - protein, 10 aa, Dengue virus
LRTTTVTGKI

SEQ ID NO: 113453 - protein, 10 aa, Dengue virus
RTTTVTGKII

SEQ ID NO: 113454 - protein, 10 aa, Dengue virus
TTTVTGKIIH

SEQ ID NO: 113455 - protein, 10 aa, Dengue virus
TTVTGKIIHE

SEQ ID NO: 113456 - protein, 10 aa, Dengue virus
TVTGKIIHEW

SEQ ID NO: 113457 - protein, 10 aa, Dengue virus
VTGKIIHEWC

SEQ ID NO: 113458 - protein, 10 aa, Dengue virus
TGKIIHEWCC

SEQ ID NO: 113459 - protein, 10 aa, Dengue virus
GKIIHEWCCR

SEQ ID NO: 113460 - protein, 10 aa, Dengue virus
KIIHEWCCRS

SEQ ID NO: 113461 - protein, 10 aa, Dengue virus
IIHEWCCRSC

SEQ ID NO: 113462 - protein, 10 aa, Dengue virus
IHEWCCRSCT

SEQ ID NO: 113463 - protein, 10 aa, Dengue virus
HEWCCRSCTL

SEQ ID NO: 113464 - protein, 10 aa, Dengue virus
EWCCRSCTLP

SEQ ID NO: 113465 - protein, 10 aa, Dengue virus
WCCRSCTLPP

SEQ ID NO: 113466 - protein, 10 aa, Dengue virus
CCRSCTLPPL

SEQ ID NO: 113467 - protein, 10 aa, Dengue virus
CRSCTLPPLR

SEQ ID NO: 113468 - protein, 10 aa, Dengue virus
RSCTLPPLRY

SEQ ID NO: 113469 - protein, 10 aa, Dengue virus
SCTLPPLRYR

SEQ ID NO: 113470 - protein, 10 aa, Dengue virus
CTLPPLRYRG

SEQ ID NO: 113471 - protein, 10 aa, Dengue virus
TLPPLRYRGE

SEQ ID NO: 113472 - protein, 10 aa, Dengue virus
LPPLRYRGED

SEQ ID NO: 113473 - protein, 10 aa, Dengue virus
PPLRYRGEDG

SEQ ID NO: 113474 - protein, 10 aa, Dengue virus
PLRYRGEDGC

SEQ ID NO: 113475 - protein, 10 aa, Dengue virus
LRYRGEDGCW

SEQ ID NO: 113476 - protein, 10 aa, Dengue virus
RYRGEDGCWY

SEQ ID NO: 113477 - protein, 10 aa, Dengue virus
YRGEDGCWYG

SEQ ID NO: 113478 - protein, 10 aa, Dengue virus
RGEDGCWYGM

SEQ ID NO: 113479 - protein, 10 aa, Dengue virus
GEDGCWYGME

SEQ ID NO: 113480 - protein, 10 aa, Dengue virus
EDGCWYGMEI

SEQ ID NO: 113481 - protein, 10 aa, Dengue virus
DGCWYGMEIR

SEQ ID NO: 113482 - protein, 10 aa, Dengue virus
GCWYGMEIRP

SEQ ID NO: 113483 - protein, 10 aa, Dengue virus
CWYGMEIRPV

SEQ ID NO: 113484 - protein, 10 aa, Dengue virus
MGMGTTYLAL

SEQ ID NO: 113485 - protein, 10 aa, Dengue virus
RRLTSREVLL

SEQ ID NO: 113486 - protein, 10 aa, Dengue virus
LTSREVLLLT

SEQ ID NO: 113487 - protein, 10 aa, Dengue virus
ELGDGLAMGI

SEQ ID NO: 113488 - protein, 10 aa, Dengue virus
LGDGLAMGIM

SEQ ID NO: 113489 - protein, 10 aa, Dengue virus
KSWPLNEGIM

SEQ ID NO: 113490 - protein, 10 aa, Dengue virus
SWPLNEGIMA

SEQ ID NO: 113491 - protein, 10 aa, Dengue virus
WPLNEGIMAV

SEQ ID NO: 113492 - protein, 10 aa, Dengue virus
PLNEGIMAVG

SEQ ID NO: 113493 - protein, 10 aa, Dengue virus
VSILLSSLLK

SEQ ID NO: 113494 - protein, 10 aa, Dengue virus
SILLSSLLKN

SEQ ID NO: 113495 - protein, 10 aa, Dengue virus
ILLSSLLKND

SEQ ID NO: 113496 - protein, 10 aa, Dengue virus
LLSSLLKNDV

SEQ ID NO: 113497 - protein, 10 aa, Dengue virus
LSSLLKNDVP

SEQ ID NO: 113498 - protein, 10 aa, Dengue virus
SSLLKNDVPL

SEQ ID NO: 113499 - protein, 10 aa, Dengue virus
SLLKNDVPLA

SEQ ID NO: 113500 - protein, 10 aa, Dengue virus
LLKNDVPLAG

SEQ ID NO: 113501 - protein, 10 aa, Dengue virus
LKNDVPLAGP

SEQ ID NO: 113502 - protein, 10 aa, Dengue virus
KNDVPLAGPL

SEQ ID NO: 113503 - protein, 10 aa, Dengue virus
NDVPLAGPLI

SEQ ID NO: 113504 - protein, 10 aa, Dengue virus
DVPLAGPLIA

SEQ ID NO: 113505 - protein, 10 aa, Dengue virus
VPLAGPLIAG

SEQ ID NO: 113506 - protein, 10 aa, Dengue virus
PLAGPLIAGG

SEQ ID NO: 113507 - protein, 10 aa, Dengue virus
LAGPLIAGGM

SEQ ID NO: 113508 - protein, 10 aa, Dengue virus
AGPLIAGGML

SEQ ID NO: 113509 - protein, 10 aa, Dengue virus
GPLIAGGMLI

SEQ ID NO: 113510 - protein, 10 aa, Dengue virus
PLIAGGMLIA

SEQ ID NO: 113511 - protein, 10 aa, Dengue virus
LIAGGMLIAC

SEQ ID NO: 113512 - protein, 10 aa, Dengue virus
IAGGMLIACY

SEQ ID NO: 113513 - protein, 10 aa, Dengue virus
AGGMLIACYV

SEQ ID NO: 113514 - protein, 10 aa, Dengue virus
GGMLIACYVI

SEQ ID NO: 113515 - protein, 10 aa, Dengue virus
GMLIACYVIS

SEQ ID NO: 113516 - protein, 10 aa, Dengue virus
MLIACYVISG

SEQ ID NO: 113517 - protein, 10 aa, Dengue virus
LIACYVISGS

SEQ ID NO: 113518 - protein, 10 aa, Dengue virus
IACYVISGSS

SEQ ID NO: 113519 - protein, 10 aa, Dengue virus
ACYVISGSSA

SEQ ID NO: 113520 - protein, 10 aa, Dengue virus
CYVISGSSAD

SEQ ID NO: 113521 - protein, 10 aa, Dengue virus
YVISGSSADL

SEQ ID NO: 113522 - protein, 10 aa, Dengue virus
VISGSSADLS

SEQ ID NO: 113523 - protein, 10 aa, Dengue virus
ISGSSADLSL

SEQ ID NO: 113524 - protein, 10 aa, Dengue virus
SGSSADLSLE

SEQ ID NO: 113525 - protein, 10 aa, Dengue virus
GSSADLSLEK

SEQ ID NO: 113526 - protein, 10 aa, Dengue virus
EAEHSGASHN

SEQ ID NO: 113527 - protein, 10 aa, Dengue virus
AEHSGASHNI

SEQ ID NO: 113528 - protein, 10 aa, Dengue virus
EHSGASHNIL

SEQ ID NO: 113529 - protein, 10 aa, Dengue virus
QDDGTMKIKD

SEQ ID NO: 113530 - protein, 10 aa, Dengue virus
DDGTMKIKDE

SEQ ID NO: 113531 - protein, 10 aa, Dengue virus
DGTMKIKDEE

SEQ ID NO: 113532 - protein, 10 aa, Dengue virus
GTMKIKDEER

SEQ ID NO: 113533 - protein, 10 aa, Dengue virus
TMKIKDEERD

SEQ ID NO: 113534 - protein, 10 aa, Dengue virus
LTILLKATLL

SEQ ID NO: 113535 - protein, 10 aa, Dengue virus
TILLKATLLA

SEQ ID NO: 113536 - protein, 10 aa, Dengue virus
ILLKATLLAV

SEQ ID NO: 113537 - protein, 10 aa, Dengue virus
LLKATLLAVS

SEQ ID NO: 113538 - protein, 10 aa, Dengue virus
LKATLLAVSG

SEQ ID NO: 113539 - protein, 10 aa, Dengue virus
KKQRSGVLWD

SEQ ID NO: 113540 - protein, 10 aa, Dengue virus
KQRSGVLWDT

SEQ ID NO: 113541 - protein, 10 aa, Dengue virus
QRSGVLWDTP

SEQ ID NO: 113542 - protein, 10 aa, Dengue virus
RSGVLWDTPS

SEQ ID NO: 113543 - protein, 10 aa, Dengue virus
SGVLWDTPSP

SEQ ID NO: 113544 - protein, 10 aa, Dengue virus
GVLWDVPSPP

SEQ ID NO: 113545 - protein, 10 aa, Dengue virus
VLWDTPSPPE

SEQ ID NO: 113546 - protein, 10 aa, Dengue virus
AVLDDGIYRI

SEQ ID NO: 113547 - protein, 10 aa, Dengue virus
LDDGIYRIMQ

SEQ ID NO: 113548 - protein, 10 aa, Dengue virus
GRSQVGVGVF

SEQ ID NO: 113549 - protein, 10 aa, Dengue virus
RSQVGVGVFQ

SEQ ID NO: 113550 - protein, 10 aa, Dengue virus
SQVGVGVFQE

SEQ ID NO: 113551 - protein, 10 aa, Dengue virus
ENVFHTMWHV

SEQ ID NO: 113552 - protein, 10 aa, Dengue virus
GVFHTMWHVT

SEQ ID NO: 113553 - protein, 10 aa, Dengue virus
VFHTMWHVTR

SEQ ID NO: 113554 - protein, 10 aa, Dengue virus
FHTMWHVTRG

SEQ ID NO: 113555 - protein, 10 aa, Dengue virus
HTMWHVTRGA

SEQ ID NO: 113556 - protein, 10 aa, Dengue virus
TMWHVTRGAV

SEQ ID NO: 113557 - protein, 10 aa, Dengue virus
MWHVTRGAVL

SEQ ID NO: 113558 - protein, 10 aa, Dengue virus
WHVTRGAVLM

SEQ ID NO: 113559 - protein, 10 aa, Dengue virus
HVTRGAVLMY

SEQ ID NO: 113560 - protein, 10 aa, Dengue virus
QGKRLEPSWA

SEQ ID NO: 113561 - protein, 10 aa, Dengue virus
GKRLEPSWAS

SEQ ID NO: 113562 - protein, 10 aa, Dengue virus
KRLEPSWASV

SEQ ID NO: 113563 - protein, 10 aa, Dengue virus
RLEPSWASVK

SEQ ID NO: 113564 - protein, 10 aa, Dengue virus
LEPSWASVKK

SEQ ID NO: 113565 - protein, 10 aa, Dengue virus
EPSWASVKKD

SEQ ID NO: 113566 - protein, 10 aa, Dengue virus
PSWASVKKDL

SEQ ID NO: 113567 - protein, 10 aa, Dengue virus
WASVKKDLIS

SEQ ID NO: 113568 - protein, 10 aa, Dengue virus
ASVKKDLISY

SEQ ID NO: 113569 - protein, 10 aa, Dengue virus
SVKKDLISYG

SEQ ID NO: 113570 - protein, 10 aa, Dengue virus
VKKDLISYGG

SEQ ID NO: 113571 - protein, 10 aa, Dengue virus
KKDLISYGGG

SEQ ID NO: 113572 - protein, 10 aa, Dengue virus
KDLISYGGGW

SEQ ID NO: 113573 - protein, 10 aa, Dengue virus
DLISYGGGWR

SEQ ID NO: 113574 - protein, 10 aa, Dengue virus
LISYGGGWRL

SEQ ID NO: 113575 - protein, 10 aa, Dengue virus
WNTGEEVQVI

SEQ ID NO: 113576 - protein, 10 aa, Dengue virus
NTGEEVQVIA

SEQ ID NO: 113577 - protein, 10 aa, Dengue virus
TGEEVQVIAV

SEQ ID NO: 113578 - protein, 10 aa, Dengue virus
GEEVQVIAVE

SEQ ID NO: 113579 - protein, 10 aa, Dengue virus
EEVQVIAVEP

SEQ ID NO: 113580 - protein, 10 aa, Dengue virus
EVQVIAVEPG

SEQ ID NO: 113581 - protein, 10 aa, Dengue virus
VQVIAVEPGK

SEQ ID NO: 113582 - protein, 10 aa, Dengue virus
QVIAVEPGKN

SEQ ID NO: 113583 - protein, 10 aa, Dengue virus
VIAVEPGKNP

SEQ ID NO: 113584 - protein, 10 aa, Dengue virus
IAVEPGKNPK

SEQ ID NO: 113585 - protein, 10 aa, Dengue virus
AVEPGKNPKN

SEQ ID NO: 113586 - protein, 10 aa, Dengue virus
VEPGKNPKNV

SEQ ID NO: 113587 - protein, 10 aa, Dengue virus
EPGKNPKNVQ

SEQ ID NO: 113588 - protein, 10 aa, Dengue virus
PGKNPKNVQT

SEQ ID NO: 113589 - protein, 10 aa, Dengue virus
EGEVGAIALD

SEQ ID NO: 113590 - protein, 10 aa, Dengue virus
GEVGAIALDF

SEQ ID NO: 113591 - protein, 10 aa, Dengue virus
EVGAIALDFK

SEQ ID NO: 113592 - protein, 10 aa, Dengue virus
VGAIALDFKP

SEQ ID NO: 113593 - protein, 10 aa, Dengue virus
GAIALDFKPG

SEQ ID NO: 113594 - protein, 10 aa, Dengue virus
AIALDFKPGT

SEQ ID NO: 113595 - protein, 10 aa, Dengue virus
IALDFKPGTS

SEQ ID NO: 113596 - protein, 10 aa, Dengue virus
ALDFKPGTSG

SEQ ID NO: 113597 - protein, 10 aa, Dengue virus
LDFKPGTSGS

SEQ ID NO: 113598 - protein, 10 aa, Dengue virus
DFKPGTSGSP

SEQ ID NO: 113599 - protein, 10 aa, Dengue virus
FKPGTSGSPI

SEQ ID NO: 113600 - protein, 10 aa, Dengue virus
KPGTSGSPIV

SEQ ID NO: 113601 - protein, 10 aa, Dengue virus
PGTSGSPIVN

SEQ ID NO: 113602 - protein, 10 aa, Dengue virus
GTSGSPIVNR

SEQ ID NO: 113603 - protein, 10 aa, Dengue virus
EGKIVGLYGN

SEQ ID NO: 113604 - protein, 10 aa, Dengue virus
GKVVGLYGNG

SEQ ID NO: 113605 - protein, 10 aa, Dengue virus
KVVGLYGNGV

SEQ ID NO: 113606 - protein, 10 aa, Dengue virus
VVGLYGNGVV

SEQ ID NO: 113607 - protein, 10 aa, Dengue virus
VGLYGNGVVT

SEQ ID NO: 113608 - protein, 10 aa, Dengue virus
GLYGNGVVTT

SEQ ID NO: 113609 - protein, 10 aa, Dengue virus
LYGNGVVTTS

SEQ ID NO: 113610 - protein, 10 aa, Dengue virus
YGNGVVTTSG

SEQ ID NO: 113611 - protein, 10 aa, Dengue virus
GNGVVTTSGT

SEQ ID NO: 113612 - protein, 10 aa, Dengue virus
NGVVTTSGTY

SEQ ID NO: 113613 - protein, 10 aa, Dengue virus
GVVTTSGTYV

SEQ ID NO: 113614 - protein, 10 aa, Dengue virus
VVTTSGTYVS

SEQ ID NO: 113615 - protein, 10 aa, Dengue virus
SGTYVSAIAQ

SEQ ID NO: 113616 - protein, 10 aa, Dengue virus
GTYVSAIAQA

SEQ ID NO: 113617 - protein, 10 aa, Dengue virus
VFRKRNLTIM

SEQ ID NO: 113618 - protein, 10 aa, Dengue virus
FRKRNLTIMD

SEQ ID NO: 113619 - protein, 10 aa, Dengue virus
RKRNLTIMDL

SEQ ID NO: 113620 - protein, 10 aa, Dengue virus
KRNLTIMDLH

SEQ ID NO: 113621 - protein, 10 aa, Dengue virus
RNLTIMDLHP

SEQ ID NO: 113622 - protein, 10 aa, Dengue virus
NLTIMDLHPG

SEQ ID NO: 113623 - protein, 10 aa, Dengue virus
LTIMDLHPGS

SEQ ID NO: 113624 - protein, 10 aa, Dengue virus
TIMDLHPGSG

SEQ ID NO: 113625 - protein, 10 aa, Dengue virus
IMDLHPGSGK

SEQ ID NO: 113626 - protein, 10 aa, Dengue virus
MDLHPGSGKT

SEQ ID NO: 113627 - protein, 10 aa, Dengue virus
DLHPGSGKTR

SEQ ID NO: 113628 - protein, 10 aa, Dengue virus
LHPGSGKTRR

SEQ ID NO: 113629 - protein, 10 aa, Dengue virus
HPGSGKTRRY

SEQ ID NO: 113630 - protein, 10 aa, Dengue virus
PGSGKTRRYL

SEQ ID NO: 113631 - protein, 10 aa, Dengue virus
GSGKTRRYLP

SEQ ID NO: 113632 - protein, 10 aa, Dengue virus
SGKTRRYLPA

SEQ ID NO: 113633 - protein, 10 aa, Dengue virus
GKTRRYLPAI

SEQ ID NO: 113634 - protein, 10 aa, Dengue virus
RYLPAIVREA

SEQ ID NO: 113635 - protein, 10 aa, Dengue virus
YLPAIVREAI

SEQ ID NO: 113636 - protein, 10 aa, Dengue virus
LPAIVREAIK

SEQ ID NO: 113637 - protein, 10 aa, Dengue virus
PAIVREAIKR

SEQ ID NO: 113638 - protein, 10 aa, Dengue virus
REAIKRKLRT

SEQ ID NO: 113639 - protein, 10 aa, Dengue virus
EAIKRKLRTL

SEQ ID NO: 113640 - protein, 10 aa, Dengue virus
KRKLRTLILA

SEQ ID NO: 113641 - protein, 10 aa, Dengue virus
RKLRTLILAP

SEQ ID NO: 113642 - protein, 10 aa, Dengue virus
KLRTLILAPT

SEQ ID NO: 113643 - protein, 10 aa, Dengue virus
LRTLILAPTR

SEQ ID NO: 113644 - protein, 10 aa, Dengue virus
RTLILAPTRV

SEQ ID NO: 113645 - protein, 10 aa, Dengue virus
TLILAPTRVV

SEQ ID NO: 113646 - protein, 10 aa, Dengue virus
LILAPTRVVA

SEQ ID NO: 113647 - protein, 10 aa, Dengue virus
ILAPTRVVAA

SEQ ID NO: 113648 - protein, 10 aa, Dengue virus
LAPTRVVAAE

SEQ ID NO: 113649 - protein, 10 aa, Dengue virus
APTRVVAAEM

SEQ ID NO: 113650 - protein, 10 aa, Dengue virus
PTRVVAAEME

SEQ ID NO: 113651 - protein, 10 aa, Dengue virus
TRVVAAEMEE

SEQ ID NO: 113652 - protein, 10 aa, Dengue virus
RVVAAEMEEA

SEQ ID NO: 113653 - protein, 10 aa, Dengue virus
VVAAEMEEAL

SEQ ID NO: 113654 - protein, 10 aa, Dengue virus
VASEMAEALK

SEQ ID NO: 113655 - protein, 10 aa, Dengue virus
ASEMAEALKG

SEQ ID NO: 113656 - protein, 10 aa, Dengue virus
SEMAEALKGM

SEQ ID NO: 113657 - protein, 10 aa, Dengue virus
EMAEALKGMP

SEQ ID NO: 113658 - protein, 10 aa, Dengue virus
MAEALKGMPI

SEQ ID NO: 113659 - protein, 10 aa, Dengue virus
AEALKGMPIR

SEQ ID NO: 113660 - protein, 10 aa, Dengue virus
EALKGMPIRY

SEQ ID NO: 113661 - protein, 10 aa, Dengue virus
ALKGMPIRYQ

SEQ ID NO: 113662 - protein, 10 aa, Dengue virus
LKGMPIRYQT

SEQ ID NO: 113663 - protein, 10 aa, Dengue virus
KGMPIRYQTT

SEQ ID NO: 113664 - protein, 10 aa, Dengue virus
GMPIRYQTTA

SEQ ID NO: 113665 - protein, 10 aa, Dengue virus
MPIRYQTTAV

SEQ ID NO: 113666 - protein, 10 aa, Dengue virus
KSEHTGKEIV

SEQ ID NO: 113667 - protein, 10 aa, Dengue virus
SEHTGKEIVD

SEQ ID NO: 113668 - protein, 10 aa, Dengue virus
EHTGREIVDL

SEQ ID NO: 113669 - protein, 10 aa, Dengue virus
HTGREIVDLM

SEQ ID NO: 113670 - protein, 10 aa, Dengue virus
TGREIVDLMC

SEQ ID NO: 113671 - protein, 10 aa, Dengue virus
GREIVDLMCH

SEQ ID NO: 113672 - protein, 10 aa, Dengue virus
REIVDLMCHA

SEQ ID NO: 113673 - protein, 10 aa, Dengue virus
EIVDLMCHAT

SEQ ID NO: 113674 - protein, 10 aa, Dengue virus
IVDLMCHATF

SEQ ID NO: 113675 - protein, 10 aa, Dengue virus
VDLMCHATFT

SEQ ID NO: 113676 - protein, 10 aa, Dengue virus
DLMCHATFTM

SEQ ID NO: 113677 - protein, 10 aa, Dengue virus
LMCHATFTMR

SEQ ID NO: 113678 - protein, 10 aa, Dengue virus
MCHATFTMRL

SEQ ID NO: 113679 - protein, 10 aa, Dengue virus
CHATFTMRLL

SEQ ID NO: 113680 - protein, 10 aa, Dengue virus
HATFTMRLLS

SEQ ID NO: 113681 - protein, 10 aa, Dengue virus
ATFTMRLLSP

SEQ ID NO: 113682 - protein, 10 aa, Dengue virus
TFTMRLLSPV

SEQ ID NO: 113683 - protein, 10 aa, Dengue virus
FTMRLLSPVR

SEQ ID NO: 113684 - protein, 10 aa, Dengue virus
TMRLLSPVRV

SEQ ID NO: 113685 - protein, 10 aa, Dengue virus
MRLLSPVRVP

SEQ ID NO: 113686 - protein, 10 aa, Dengue virus
RLLSPVRVPN

SEQ ID NO: 113687 - protein, 10 aa, Dengue virus
LLSPVRVPNY

SEQ ID NO: 113688 - protein, 10 aa, Dengue virus
LSPVRVPNYN

SEQ ID NO: 113689 - protein, 10 aa, Dengue virus
SPVRVPNYNL

SEQ ID NO: 113690 - protein, 10 aa, Dengue virus
PVRVPNYNLI

SEQ ID NO: 113691 - protein, 10 aa, Dengue virus
VRVPNYNLII

SEQ ID NO: 113692 - protein, 10 aa, Dengue virus
RVPNYNLIIM

SEQ ID NO: 113693 - protein, 10 aa, Dengue virus
VPNYNLIIMD

SEQ ID NO: 113694 - protein, 10 aa, Dengue virus
PNYNLIIMDE

SEQ ID NO: 113695 - protein, 10 aa, Dengue virus
NYNLIIMDEA

SEQ ID NO: 113696 - protein, 10 aa, Dengue virus
YNLIIMDEAH

SEQ ID NO: 113697 - protein, 10 aa, Dengue virus
NLIIMDEAHF

SEQ ID NO: 113698 - protein, 10 aa, Dengue virus
LIIMDEAHFT

SEQ ID NO: 113699 - protein, 10 aa, Dengue virus
IIMDEAHFTD

SEQ ID NO: 113700 - protein, 10 aa, Dengue virus
IMDEAHFTDP

SEQ ID NO: 113701 - protein, 10 aa, Dengue virus
MDEAHFTDPA

SEQ ID NO: 113702 - protein, 10 aa, Dengue virus
DEAHFTDPAS

SEQ ID NO: 113703 - protein, 10 aa, Dengue virus
EAHFTDPASI

SEQ ID NO: 113704 - protein, 10 aa, Dengue virus
AHFTDPASIA

SEQ ID NO: 113705 - protein, 10 aa, Dengue virus
HFTDPASIAA

SEQ ID NO: 113706 - protein, 10 aa, Dengue virus
FTDPASIAAR

SEQ ID NO: 113707 - protein, 10 aa, Dengue virus
TDPASIAARG

SEQ ID NO: 113708 - protein, 10 aa, Dengue virus
DPASIAARGY

SEQ ID NO: 113709 - protein, 10 aa, Dengue virus
PASIAARGYI

SEQ ID NO: 113710 - protein, 10 aa, Dengue virus
ASIAARGYIS

SEQ ID NO: 113711 - protein, 10 aa, Dengue virus
SIAARGYIST

SEQ ID NO: 113712 - protein, 10 aa, Dengue virus
IAARGYISTR

SEQ ID NO: 113713 - protein, 10 aa, Dengue virus
AARGYISTRV

SEQ ID NO: 113714 - protein, 10 aa, Dengue virus
ARGYISTRVG

SEQ ID NO: 113715 - protein, 10 aa, Dengue virus
RGYISTRVGM

SEQ ID NO: 113716 - protein, 10 aa, Dengue virus
GYISTRVGMG

SEQ ID NO: 113717 - protein, 10 aa, Dengue virus
YISTRVGMGE

SEQ ID NO: 113718 - protein, 10 aa, Dengue virus
ISTRVGMGEA

SEQ ID NO: 113719 - protein, 10 aa, Dengue virus
STRVGMGEAA

SEQ ID NO: 113720 - protein, 10 aa, Dengue virus
TRVGMGEAAA

SEQ ID NO: 113721 - protein, 10 aa, Dengue virus
RVGMGEAAAI

SEQ ID NO: 113722 - protein, 10 aa, Dengue virus
VGMGEAAAIF

SEQ ID NO: 113723 - protein, 10 aa, Dengue virus
GMGEAAAIFM

SEQ ID NO: 113724 - protein, 10 aa, Dengue virus
MGEAAAIFMT

SEQ ID NO: 113725 - protein, 10 aa, Dengue virus
GEAAAIFMTA

SEQ ID NO: 113726 - protein, 10 aa, Dengue virus
EAAAIFMTAT

SEQ ID NO: 113727 - protein, 10 aa, Dengue virus
AAAIFMTATP

SEQ ID NO: 113728 - protein, 10 aa, Dengue virus
AAIFMTATPP

SEQ ID NO: 113729 - protein, 10 aa, Dengue virus
AIFMTATPPG

SEQ ID NO: 113730 - protein, 10 aa, Dengue virus
IFMTATPPGS

SEQ ID NO: 113731 - protein, 10 aa, Dengue virus
EAFPQSNAVI

SEQ ID NO: 113732 - protein, 10 aa, Dengue virus
IQDEERDIPE

SEQ ID NO: 113733 - protein, 10 aa, Dengue virus
QDEERDIPER

SEQ ID NO: 113734 - protein, 10 aa, Dengue virus
DEERDIPERS

SEQ ID NO: 113735 - protein, 10 aa, Dengue virus
EERDIPERSW

SEQ ID NO: 113736 - protein, 10 aa, Dengue virus
ERDIPERSWN

SEQ ID NO: 113737 - protein, 10 aa, Dengue virus
RDIPERSWNS

SEQ ID NO: 113738 - protein, 10 aa, Dengue virus
DIPERSWNSG

SEQ ID NO: 113739 - protein, 10 aa, Dengue virus
IPERSWNSGY

SEQ ID NO: 113740 - protein, 10 aa, Dengue virus
FPGKTVWFVP

SEQ ID NO: 113741 - protein, 10 aa, Dengue virus
PGKTVWFVPS

SEQ ID NO: 113742 - protein, 10 aa, Dengue virus
GKTVWFVPSI

SEQ ID NO: 113743 - protein, 10 aa, Dengue virus
KTVWFVPSIK

SEQ ID NO: 113744 - protein, 10 aa, Dengue virus
TVWFVPSIKA

SEQ ID NO: 113745 - protein, 10 aa, Dengue virus
VWFVPSIKAG

SEQ ID NO: 113746 - protein, 10 aa, Dengue virus
WFVPSIKAGN

SEQ ID NO: 113747 - protein, 10 aa, Dengue virus
FVPSIKAGND

SEQ ID NO: 113748 - protein, 10 aa, Dengue virus
VPSIKAGNDI

SEQ ID NO: 113749 - protein, 10 aa, Dengue virus
PSIKAGNDIA

SEQ ID NO: 113750 - protein, 10 aa, Dengue virus
SIKSGNDIAN

SEQ ID NO: 113751 - protein, 10 aa, Dengue virus
IKSGNDIANC

SEQ ID NO: 113752 - protein, 10 aa, Dengue virus
KSGNDIANCL

SEQ ID NO: 113753 - protein, 10 aa, Dengue virus
SGNDIANCLR

SEQ ID NO: 113754 - protein, 10 aa, Dengue virus
GNDIANCLRK

SEQ ID NO: 113755 - protein, 10 aa, Dengue virus
NDIANCLRKN

SEQ ID NO: 113756 - protein, 10 aa, Dengue virus
DIANCLRKNG

SEQ ID NO: 113757 - protein, 10 aa, Dengue virus
IANCLRKNGK

SEQ ID NO: 113758 - protein, 10 aa, Dengue virus
ANCLRKNGKR

SEQ ID NO: 113759 - protein, 10 aa, Dengue virus
NCLRKNGKRV

SEQ ID NO: 113760 - protein, 10 aa, Dengue virus
CLRKNGKKVI

SEQ ID NO: 113761 - protein, 10 aa, Dengue virus
LRKNGKKVIQ

SEQ ID NO: 113762 - protein, 10 aa, Dengue virus
RKNGKKVIQL

SEQ ID NO: 113763 - protein, 10 aa, Dengue virus
KNGKKVIQLS

SEQ ID NO: 113764 - protein, 10 aa, Dengue virus
NGKKVIQLSR

SEQ ID NO: 113765 - protein, 10 aa, Dengue virus
GKKVIQLSRK

SEQ ID NO: 113766 - protein, 10 aa, Dengue virus
KKVIQLSRKT

SEQ ID NO: 113767 - protein, 10 aa, Dengue virus
KVIQLSRKTF

SEQ ID NO: 113768 - protein, 10 aa, Dengue virus
VIQLSRKTFD

SEQ ID NO: 113769 - protein, 10 aa, Dengue virus
IQLSRKTFDT

SEQ ID NO: 113770 - protein, 10 aa, Dengue virus
QLSRKTFDTE

SEQ ID NO: 113771 - protein, 10 aa, Dengue virus
LSRKTFDTEY

SEQ ID NO: 113772 - protein, 10 aa, Dengue virus
SRKTFDTEYQ

SEQ ID NO: 113773 - protein, 10 aa, Dengue virus
RKTFDTEYQK

SEQ ID NO: 113774 - protein, 10 aa, Dengue virus
NNDWDYVVTT

SEQ ID NO: 113775 - protein, 10 aa, Dengue virus
NDWDFVVTTD

SEQ ID NO: 113776 - protein, 10 aa, Dengue virus
DWDFVVTTDI

SEQ ID NO: 113777 - protein, 10 aa, Dengue virus
WDFVVTTDIS

SEQ ID NO: 113778 - protein, 10 aa, Dengue virus
DFVVTTDISE

SEQ ID NO: 113779 - protein, 10 aa, Dengue virus
FVVTTDISEM

SEQ ID NO: 113780 - protein, 10 aa, Dengue virus
VVTTDISEMG

SEQ ID NO: 113781 - protein, 10 aa, Dengue virus
VTTDISEMGA

SEQ ID NO: 113782 - protein, 10 aa, Dengue virus
TTDISEMGAN

SEQ ID NO: 113783 - protein, 10 aa, Dengue virus
TDISEMGANF

SEQ ID NO: 113784 - protein, 10 aa, Dengue virus
DISEMGANFR

SEQ ID NO: 113785 - protein, 10 aa, Dengue virus
ISEMGANFRA

SEQ ID NO: 113786 - protein, 10 aa, Dengue virus
SEMGANFRAD

SEQ ID NO: 113787 - protein, 10 aa, Dengue virus
EMGANFRADR

SEQ ID NO: 113788 - protein, 10 aa, Dengue virus
MGANFRADRV

SEQ ID NO: 113789 - protein, 10 aa, Dengue virus
GANFRADRVI

SEQ ID NO: 113790 - protein, 10 aa, Dengue virus
ANFRADRVID

SEQ ID NO: 113791 - protein, 10 aa, Dengue virus
NFRADRVIDP

SEQ ID NO: 113792 - protein, 10 aa, Dengue virus
FRADRVIDPR

SEQ ID NO: 113793 - protein, 10 aa, Dengue virus
RADRVIDPRR

SEQ ID NO: 113794 - protein, 10 aa, Dengue virus
ADRVIDPRRC

SEQ ID NO: 113795 - protein, 10 aa, Dengue virus
DRVIDPRRCL

SEQ ID NO: 113796 - protein, 10 aa, Dengue virus
RVIDPRRCLK

SEQ ID NO: 113797 - protein, 10 aa, Dengue virus
VIDPRRCLKP

SEQ ID NO: 113798 - protein, 10 aa, Dengue virus
IDPRRCLKPV

SEQ ID NO: 113799 - protein, 10 aa, Dengue virus
DPRRCLKPVI

SEQ ID NO: 113800 - protein, 10 aa, Dengue virus
PRRCLKPVIL

SEQ ID NO: 113801 - protein, 10 aa, Dengue virus
RRCLKPVILK

SEQ ID NO: 113802 - protein, 10 aa, Dengue virus
RCLKPVILKD

SEQ ID NO: 113803 - protein, 10 aa, Dengue virus
CLKPVILKDG

SEQ ID NO: 113804 - protein, 10 aa, Dengue virus
LKPVILKDGP

SEQ ID NO: 113805 - protein, 10 aa, Dengue virus
KPVILKDGPE

SEQ ID NO: 113806 - protein, 10 aa, Dengue virus
PVILKDGPER

SEQ ID NO: 113807 - protein, 10 aa, Dengue virus
VILKDGPERV

SEQ ID NO: 113808 - protein, 10 aa, Dengue virus
ILKDGPERVI

SEQ ID NO: 113809 - protein, 10 aa, Dengue virus
LKDGPERVIL

SEQ ID NO: 113810 - protein, 10 aa, Dengue virus
KDGPERVILA

SEQ ID NO: 113811 - protein, 10 aa, Dengue virus
DGPERVILAG

SEQ ID NO: 113812 - protein, 10 aa, Dengue virus
GPERVILAGP

SEQ ID NO: 113813 - protein, 10 aa, Dengue virus
PERVILAGPM

SEQ ID NO: 113814 - protein, 10 aa, Dengue virus
ERVILAGPMP

SEQ ID NO: 113815 - protein, 10 aa, Dengue virus
RVILAGPMPV

SEQ ID NO: 113816 - protein, 10 aa, Dengue virus
VILAGPMPVT

SEQ ID NO: 113817 - protein, 10 aa, Dengue virus
ILAGPMPVTV

SEQ ID NO: 113818 - protein, 10 aa, Dengue virus
LAGPMPVTVA

SEQ ID NO: 113819 - protein, 10 aa, Dengue virus
AGPMPVTVAS

SEQ ID NO: 113820 - protein, 10 aa, Dengue virus
GPMPVTVASA

SEQ ID NO: 113821 - protein, 10 aa, Dengue virus
PMPVTVASAA

SEQ ID NO: 113822 - protein, 10 aa, Dengue virus
MPVTVASAAQ

SEQ ID NO: 113823 - protein, 10 aa, Dengue virus
PVTVASAAQR

SEQ ID NO: 113824 - protein, 10 aa, Dengue virus
VTVASAAQRR

SEQ ID NO: 113825 - protein, 10 aa, Dengue virus
TVASAAQRRG

SEQ ID NO: 113826 - protein, 10 aa, Dengue virus
VASAAQRRGR

SEQ ID NO: 113827 - protein, 10 aa, Dengue virus
ASAAQRRGRI

SEQ ID NO: 113828 - protein, 10 aa, Dengue virus
SAAQRRGRIG

SEQ ID NO: 113829 - protein, 10 aa, Dengue virus
AAQRRGRIGR

SEQ ID NO: 113830 - protein, 10 aa, Dengue virus
AQRRGRIGRN

SEQ ID NO: 113831 - protein, 10 aa, Dengue virus
QRRGRIGRNP

SEQ ID NO: 113832 - protein, 10 aa, Dengue virus
KEGDQYIYMG

SEQ ID NO: 113833 - protein, 10 aa, Dengue virus
EGDQYIYMGQ

SEQ ID NO: 113834 - protein, 10 aa, Dengue virus
GDQYIYMGQP

SEQ ID NO: 113835 - protein, 10 aa, Dengue virus
DQYIYMGQPL

SEQ ID NO: 113836 - protein, 10 aa, Dengue virus
YMGQPLNNDE

SEQ ID NO: 113837 - protein, 10 aa, Dengue virus
MGQPLNNDED

SEQ ID NO: 113838 - protein, 10 aa, Dengue virus
GQPLNNDEDH

SEQ ID NO: 113839 - protein, 10 aa, Dengue virus
QPLNNDEDHA

SEQ ID NO: 113840 - protein, 10 aa, Dengue virus
PLNNDEDHAH

SEQ ID NO: 113841 - protein, 10 aa, Dengue virus
LNNDEDHAHW

SEQ ID NO: 113842 - protein, 10 aa, Dengue virus
NNDEDHAHWT

SEQ ID NO: 113843 - protein, 10 aa, Dengue virus
NDEDHAHWTE

SEQ ID NO: 113844 - protein, 10 aa, Dengue virus
DEDHAHWTEA

SEQ ID NO: 113845 - protein, 10 aa, Dengue virus
EDHAHWTEAK

SEQ ID NO: 113846 - protein, 10 aa, Dengue virus
DHAHWTEAKM

SEQ ID NO: 113847 - protein, 10 aa, Dengue virus
HAHWTEAKML

SEQ ID NO: 113848 - protein, 10 aa, Dengue virus
AHWTEAKMLL

SEQ ID NO: 113849 - protein, 10 aa, Dengue virus
HWTEAKMLLD

SEQ ID NO: 113850 - protein, 10 aa, Dengue virus
WTEAKMLLDN

SEQ ID NO: 113851 - protein, 10 aa, Dengue virus
TEAKMLLDNI

SEQ ID NO: 113852 - protein, 10 aa, Dengue virus
EAKMLLDNIN

SEQ ID NO: 113853 - protein, 10 aa, Dengue virus
AKMLLDNINT

SEQ ID NO: 113854 - protein, 10 aa, Dengue virus
KMLLDNINTP

SEQ ID NO: 113855 - protein, 10 aa, Dengue virus
MLLDNINTPE

SEQ ID NO: 113856 - protein, 10 aa, Dengue virus
LLDNINTPEG

SEQ ID NO: 113857 - protein, 10 aa, Dengue virus
LDNINTPEGI

SEQ ID NO: 113858 - protein, 10 aa, Dengue virus
DNINTPEGII

SEQ ID NO: 113859 - protein, 10 aa, Dengue virus
NINTPEGIIP

SEQ ID NO: 113860 - protein, 10 aa, Dengue virus
INTPEGIIPA

SEQ ID NO: 113861 - protein, 10 aa, Dengue virus
NTPEGIIPAL

SEQ ID NO: 113862 - protein, 10 aa, Dengue virus
TPEGIIPALF

SEQ ID NO: 113863 - protein, 10 aa, Dengue virus
PEGIIPALFE

SEQ ID NO: 113864 - protein, 10 aa, Dengue virus
EGIIPALFEP

SEQ ID NO: 113865 - protein, 10 aa, Dengue virus
GIIPALFEPE

SEQ ID NO: 113866 - protein, 10 aa, Dengue virus
IIPALFEPER

SEQ ID NO: 113867 - protein, 10 aa, Dengue virus
IPALFEPERE

SEQ ID NO: 113868 - protein, 10 aa, Dengue virus
PALFEPEREK

SEQ ID NO: 113869 - protein, 10 aa, Dengue virus
ALFEPEREKS

SEQ ID NO: 113870 - protein, 10 aa, Dengue virus
LFEPEREKSA

SEQ ID NO: 113871 - protein, 10 aa, Dengue virus
FEPEREKSAA

SEQ ID NO: 113872 - protein, 10 aa, Dengue virus
EPEREKSAAI

SEQ ID NO: 113873 - protein, 10 aa, Dengue virus
PEREKSAAID

SEQ ID NO: 113874 - protein, 10 aa, Dengue virus
EREKSAAIDG

SEQ ID NO: 113875 - protein, 10 aa, Dengue virus
REKSAAIDGE

SEQ ID NO: 113876 - protein, 10 aa, Dengue virus
EKSAAIDGEY

SEQ ID NO: 113877 - protein, 10 aa, Dengue virus
KSAAIDGEYR

SEQ ID NO: 113878 - protein, 10 aa, Dengue virus
SAAIDGEYRL

SEQ ID NO: 113879 - protein, 10 aa, Dengue virus
AAIDGEYRLR

SEQ ID NO: 113880 - protein, 10 aa, Dengue virus
AIDGEYRLRG

SEQ ID NO: 113881 - protein, 10 aa, Dengue virus
IDGEYRLRGE

SEQ ID NO: 113882 - protein, 10 aa, Dengue virus
DGEYRLRGEA

SEQ ID NO: 113883 - protein, 10 aa, Dengue virus
GEYRLRGEAR

SEQ ID NO: 113884 - protein, 10 aa, Dengue virus
EYRLRGEARK

SEQ ID NO: 113885 - protein, 10 aa, Dengue virus
YRLRGEARKT

SEQ ID NO: 113886 - protein, 10 aa, Dengue virus
RLRGEARKTF

SEQ ID NO: 113887 - protein, 10 aa, Dengue virus
LRGEARKTFV

SEQ ID NO: 113888 - protein, 10 aa, Dengue virus
RGEARKTFVE

SEQ ID NO: 113889 - protein, 10 aa, Dengue virus
GEARKTFVEL

SEQ ID NO: 113890 - protein, 10 aa, Dengue virus
EARKTFVELM

SEQ ID NO: 113891 - protein, 10 aa, Dengue virus
ARKTFVELMR

SEQ ID NO: 113892 - protein, 10 aa, Dengue virus
RKTFVELMRR

SEQ ID NO: 113893 - protein, 10 aa, Dengue virus
KTFVELMRRG

SEQ ID NO: 113894 - protein, 10 aa, Dengue virus
TFVELMRRGD

SEQ ID NO: 113895 - protein, 10 aa, Dengue virus
FVELMRRGDL

SEQ ID NO: 113896 - protein, 10 aa, Dengue virus
VELMRRGDLP

SEQ ID NO: 113897 - protein, 10 aa, Dengue virus
ELMRRGDLPV

SEQ ID NO: 113898 - protein, 10 aa, Dengue virus
LMRRGDLPVW

SEQ ID NO: 113899 - protein, 10 aa, Dengue virus
MRRGDLPVWL

SEQ ID NO: 113900 - protein, 10 aa, Dengue virus
RRGDLPVWLA

SEQ ID NO: 113901 - protein, 10 aa, Dengue virus
RGDLPVWLSY

SEQ ID NO: 113902 - protein, 10 aa, Dengue virus
GDLPVWLSYK

SEQ ID NO: 113903 - protein, 10 aa, Dengue virus
DLPVWLSYKV

SEQ ID NO: 113904 - protein, 10 aa, Dengue virus
LPVWLSYKVA

SEQ ID NO: 113905 - protein, 10 aa, Dengue virus
PVWLSYKVAS

SEQ ID NO: 113906 - protein, 10 aa, Dengue virus
YSDRRWCFDG

SEQ ID NO: 113907 - protein, 10 aa, Dengue virus
RNNQVLEENM

SEQ ID NO: 113908 - protein, 10 aa, Dengue virus
NNQVLEENMD

SEQ ID NO: 113909 - protein, 10 aa, Dengue virus
NQVLEENMDV

SEQ ID NO: 113910 - protein, 10 aa, Dengue virus
QVLEENMDVE

SEQ ID NO: 113911 - protein, 10 aa, Dengue virus
VLEENMDVEI

SEQ ID NO: 113912 - protein, 10 aa, Dengue virus
LEENMDVEIW

SEQ ID NO: 113913 - protein, 10 aa, Dengue virus
EENMDVEIWT

SEQ ID NO: 113914 - protein, 10 aa, Dengue virus
ENMDVEIWTK

SEQ ID NO: 113915 - protein, 10 aa, Dengue virus
NMDVEIWTKE

SEQ ID NO: 113916 - protein, 10 aa, Dengue virus
MDVEIWTKEG

SEQ ID NO: 113917 - protein, 10 aa, Dengue virus
ERKKLRPRWL

SEQ ID NO: 113918 - protein, 10 aa, Dengue virus
RKKLRPRWLD

SEQ ID NO: 113919 - protein, 10 aa, Dengue virus
KKLRPRWLDA

SEQ ID NO: 113920 - protein, 10 aa, Dengue virus
KLRPRWLDAR

SEQ ID NO: 113921 - protein, 10 aa, Dengue virus
LRPRWLDART

SEQ ID NO: 113922 - protein, 10 aa, Dengue virus
RPRWLDARTY

SEQ ID NO: 113923 - protein, 10 aa, Dengue virus
PRWLDARTYS

SEQ ID NO: 113924 - protein, 10 aa, Dengue virus
RWLDARTYSD

SEQ ID NO: 113925 - protein, 10 aa, Dengue virus
WLDARTYSDP

SEQ ID NO: 113926 - protein, 10 aa, Dengue virus
LDARTYSDPL

SEQ ID NO: 113927 - protein, 10 aa, Dengue virus
DARTYSDPLA

SEQ ID NO: 113928 - protein, 10 aa, Dengue virus
ARTYSDPLAL

SEQ ID NO: 113929 - protein, 10 aa, Dengue virus
RTYSDPLALR

SEQ ID NO: 113930 - protein, 10 aa, Dengue virus
TYSDPLALRE

SEQ ID NO: 113931 - protein, 10 aa, Dengue virus
YSDPLALKEF

SEQ ID NO: 113932 - protein, 10 aa, Dengue virus
SDPLALKEFK

SEQ ID NO: 113933 - protein, 10 aa, Dengue virus
DPLALREFKE

SEQ ID NO: 113934 - protein, 10 aa, Dengue virus
PLALREFKEF

SEQ ID NO: 113935 - protein, 10 aa, Dengue virus
LALREFKEFA

SEQ ID NO: 113936 - protein, 10 aa, Dengue virus
ALREFKEFAA

SEQ ID NO: 113937 - protein, 10 aa, Dengue virus
LREFKEFAAG

SEQ ID NO: 113938 - protein, 10 aa, Dengue virus
REFKEFAAGR

SEQ ID NO: 113939 - protein, 10 aa, Dengue virus
EFKEFAAGRR

SEQ ID NO: 113940 - protein, 10 aa, Dengue virus
FKEFAAGRRS

SEQ ID NO: 113941 - protein, 10 aa, Dengue virus
KEFAAGRRSV

SEQ ID NO: 113942 - protein, 10 aa, Dengue virus
FAAGRRSVSG

SEQ ID NO: 113943 - protein, 10 aa, Dengue virus
DLILEIGKLP

SEQ ID NO: 113944 - protein, 10 aa, Dengue virus
LEIGKLPQHL

SEQ ID NO: 113945 - protein, 10 aa, Dengue virus
EIGKLPQHLT

SEQ ID NO: 113946 - protein, 10 aa, Dengue virus
QNALDNLVML

SEQ ID NO: 113947 - protein, 10 aa, Dengue virus
NALDNLVMLH

SEQ ID NO: 113948 - protein, 10 aa, Dengue virus
ALDNLVMLHN

SEQ ID NO: 113949 - protein, 10 aa, Dengue virus
LDNLVMLHNS

SEQ ID NO: 113950 - protein, 10 aa, Dengue virus
DNLVMLHNSE

SEQ ID NO: 113951 - protein, 10 aa, Dengue virus
AYRHAMEELP

SEQ ID NO: 113952 - protein, 10 aa, Dengue virus
YRHAMEELPD

SEQ ID NO: 113953 - protein, 10 aa, Dengue virus
RHAMEELPDT

SEQ ID NO: 113954 - protein, 10 aa, Dengue virus
HAMEELPDTI

SEQ ID NO: 113955 - protein, 10 aa, Dengue virus
AMEELPDTIE

SEQ ID NO: 113956 - protein, 10 aa, Dengue virus
MEELPDTIET

SEQ ID NO: 113957 - protein, 10 aa, Dengue virus
EELPDTIETL

SEQ ID NO: 113958 - protein, 10 aa, Dengue virus
ELPDTIETLM

SEQ ID NO: 113959 - protein, 10 aa, Dengue virus
LPDTIETLML

SEQ ID NO: 113960 - protein, 10 aa, Dengue virus
PDTIETLMLL

SEQ ID NO: 113961 - protein, 10 aa, Dengue virus
DTIETLMLLA

SEQ ID NO: 113962 - protein, 10 aa, Dengue virus
TIETLMLLAL

SEQ ID NO: 113963 - protein, 10 aa, Dengue virus
IETLMLLALI

SEQ ID NO: 113964 - protein, 10 aa, Dengue virus
ETLMLLALIA

SEQ ID NO: 113965 - protein, 10 aa, Dengue virus
GKTSIGLLCV

SEQ ID NO: 113966 - protein, 10 aa, Dengue virus
VEPHWIAASI

SEQ ID NO: 113967 - protein, 10 aa, Dengue virus
EPHWIAASII

SEQ ID NO: 113968 - protein, 10 aa, Dengue virus
PHWIAASIIL

SEQ ID NO: 113969 - protein, 10 aa, Dengue virus
HWIAASIILE

SEQ ID NO: 113970 - protein, 10 aa, Dengue virus
WIAASIILEF

SEQ ID NO: 113971 - protein, 10 aa, Dengue virus
IAASIILEFF

SEQ ID NO: 113972 - protein, 10 aa, Dengue virus
AASIILEFFL

SEQ ID NO: 113973 - protein, 10 aa, Dengue virus
ASIILEFFLM

SEQ ID NO: 113974 - protein, 10 aa, Dengue virus
SIILEFFLMV

SEQ ID NO: 113975 - protein, 10 aa, Dengue virus
IILEFFLMVL

SEQ ID NO: 113976 - protein, 10 aa, Dengue virus
ILEFFLMVLL

SEQ ID NO: 113977 - protein, 10 aa, Dengue virus
LEFFLMVLLI

SEQ ID NO: 113978 - protein, 10 aa, Dengue virus
EFFLMVLLIP

SEQ ID NO: 113979 - protein, 10 aa, Dengue virus
FFLMVLLIPE

SEQ ID NO: 113980 - protein, 10 aa, Dengue virus
FLMVLLIPEP

SEQ ID NO: 113981 - protein, 10 aa, Dengue virus
LMVLLIPEPD

SEQ ID NO: 113982 - protein, 10 aa, Dengue virus
MVLLIPEPDR

SEQ ID NO: 113983 - protein, 10 aa, Dengue virus
VLLIPEPEKQ

SEQ ID NO: 113984 - protein, 10 aa, Dengue virus
LLIPEPEKQR

SEQ ID NO: 113985 - protein, 10 aa, Dengue virus
LIPEPEKQRT

SEQ ID NO: 113986 - protein, 10 aa, Dengue virus
IPEPEKQRTP

SEQ ID NO: 113987 - protein, 10 aa, Dengue virus
PEPEKQRTPQ

SEQ ID NO: 113988 - protein, 10 aa, Dengue virus
EPEKQRTPQD

SEQ ID NO: 113989 - protein, 10 aa, Dengue virus
PEKQRTPQDN

SEQ ID NO: 113990 - protein, 10 aa, Dengue virus
EKQRTPQDNQ

SEQ ID NO: 113991 - protein, 10 aa, Dengue virus
KQRTPQDNQL

SEQ ID NO: 113992 - protein, 10 aa, Dengue virus
QRTPQDNQLA

SEQ ID NO: 113993 - protein, 10 aa, Dengue virus
RTPQDNQLAY

SEQ ID NO: 113994 - protein, 10 aa, Dengue virus
TPQDNQLAYV

SEQ ID NO: 113995 - protein, 10 aa, Dengue virus
PQDNQLAYVV

SEQ ID NO: 113996 - protein, 10 aa, Dengue virus
QDNQLAYVVI

SEQ ID NO: 113997 - protein, 10 aa, Dengue virus
DNQLAYVVIG

SEQ ID NO: 113998 - protein, 10 aa, Dengue virus
NQLAYVVIGL

SEQ ID NO: 113999 - protein, 10 aa, Dengue virus
QLAYVVIGLL

SEQ ID NO: 114000 - protein, 10 aa, Dengue virus
LAYVVIGLLF

SEQ ID NO: 114001 - protein, 10 aa, Dengue virus
VAANEMGLLE

SEQ ID NO: 114002 - protein, 10 aa, Dengue virus
AANEMGLLET

SEQ ID NO: 114003 - protein, 10 aa, Dengue virus
ANEMGLLETT

SEQ ID NO: 114004 - protein, 10 aa, Dengue virus
NEMGLLETTK

SEQ ID NO: 114005 - protein, 10 aa, Dengue virus
EMGLLETTKK

SEQ ID NO: 114006 - protein, 10 aa, Dengue virus
MGLLETTKKD

SEQ ID NO: 114007 - protein, 10 aa, Dengue virus
GLLETTKKDL

SEQ ID NO: 114008 - protein, 10 aa, Dengue virus
LLETTKKDLG

SEQ ID NO: 114009 - protein, 10 aa, Dengue virus
LDVDLHPASA

SEQ ID NO: 114010 - protein, 10 aa, Dengue virus
DVDLHPASAW

SEQ ID NO: 114011 - protein, 10 aa, Dengue virus
VDLHPASAWT

SEQ ID NO: 114012 - protein, 10 aa, Dengue virus
DLHPASAWTL

SEQ ID NO: 114013 - protein, 10 aa, Dengue virus
LHPASAWTLY

SEQ ID NO: 114014 - protein, 10 aa, Dengue virus
HPASAWTLYA

SEQ ID NO: 114015 - protein, 10 aa, Dengue virus
PASAWTLYAV

SEQ ID NO: 114016 - protein, 10 aa, Dengue virus
ASAWTLYAVA

SEQ ID NO: 114017 - protein, 10 aa, Dengue virus
SAWTLYAVAT

SEQ ID NO: 114018 - protein, 10 aa, Dengue virus
AWTLYAVATT

SEQ ID NO: 114019 - protein, 10 aa, Dengue virus
WTLYAVATTI

SEQ ID NO: 114020 - protein, 10 aa, Dengue virus
TLYAVATTII

SEQ ID NO: 114021 - protein, 10 aa, Dengue virus
LYAVATTIIT

SEQ ID NO: 114022 - protein, 10 aa, Dengue virus
YAVATTIITP

SEQ ID NO: 114023 - protein, 10 aa, Dengue virus
AVATTIITPM

SEQ ID NO: 114024 - protein, 10 aa, Dengue virus
ITPMMRHTIE

SEQ ID NO: 114025 - protein, 10 aa, Dengue virus
TPMMRHTIEN

SEQ ID NO: 114026 - protein, 10 aa, Dengue virus
PMMRHTIENT

SEQ ID NO: 114027 - protein, 10 aa, Dengue virus
MMRHTIENTT

SEQ ID NO: 114028 - protein, 10 aa, Dengue virus
MRHTIENTTA

SEQ ID NO: 114029 - protein, 10 aa, Dengue virus
RHTIENTTAN

SEQ ID NO: 114030 - protein, 10 aa, Dengue virus
HTIENTTANI

SEQ ID NO: 114031 - protein, 10 aa, Dengue virus
TIENTTANIS

SEQ ID NO: 114032 - protein, 10 aa, Dengue virus
IENTTANISL

SEQ ID NO: 114033 - protein, 10 aa, Dengue virus
ENTTANISLT

SEQ ID NO: 114034 - protein, 10 aa, Dengue virus
NTTANISLTA

SEQ ID NO: 114035 - protein, 10 aa, Dengue virus
TTANISLTAI

SEQ ID NO: 114036 - protein, 10 aa, Dengue virus
TANISLTAIA

SEQ ID NO: 114037 - protein, 10 aa, Dengue virus
ANISLTAIAN

SEQ ID NO: 114038 - protein, 10 aa, Dengue virus
NISLTAIANQ

SEQ ID NO: 114039 - protein, 10 aa, Dengue virus
ISLTAIANQA

SEQ ID NO: 114040 - protein, 10 aa, Dengue virus
SLTAIANQAA

SEQ ID NO: 114041 - protein, 10 aa, Dengue virus
LTAIANQAAI

SEQ ID NO: 114042 - protein, 10 aa, Dengue virus
TAIANQAAIL

SEQ ID NO: 114043 - protein, 10 aa, Dengue virus
AIANQAAILM

SEQ ID NO: 114044 - protein, 10 aa, Dengue virus
IANQAAILMG

SEQ ID NO: 114045 - protein, 10 aa, Dengue virus
ANQAAILMGL

SEQ ID NO: 114046 - protein, 10 aa, Dengue virus
NQAAILMGLD

SEQ ID NO: 114047 - protein, 10 aa, Dengue virus
QAAILMGLDK

SEQ ID NO: 114048 - protein, 10 aa, Dengue virus
AAILMGLDKG

SEQ ID NO: 114049 - protein, 10 aa, Dengue virus
AILMGLDKGW

SEQ ID NO: 114050 - protein, 10 aa, Dengue virus
ILMGLDKGWP

SEQ ID NO: 114051 - protein, 10 aa, Dengue virus
LMGLDKGWPI

SEQ ID NO: 114052 - protein, 10 aa, Dengue virus
MGLDKGWPIS

SEQ ID NO: 114053 - protein, 10 aa, Dengue virus
GLDKGWPISK

SEQ ID NO: 114054 - protein, 10 aa, Dengue virus
LDKGWPISKM

SEQ ID NO: 114055 - protein, 10 aa, Dengue virus
DKGWPISKMD

SEQ ID NO: 114056 - protein, 10 aa, Dengue virus
KGWPISKMDI

SEQ ID NO: 114057 - protein, 10 aa, Dengue virus
GWPISKMDIG

SEQ ID NO: 114058 - protein, 10 aa, Dengue virus
WPISKMDIGV

SEQ ID NO: 114059 - protein, 10 aa, Dengue virus
PISKMDIGVP

SEQ ID NO: 114060 - protein, 10 aa, Dengue virus
ISKMDIGVPL

SEQ ID NO: 114061 - protein, 10 aa, Dengue virus
SKMDIGVPLL

SEQ ID NO: 114062 - protein, 10 aa, Dengue virus
KMDIGVPLLA

SEQ ID NO: 114063 - protein, 10 aa, Dengue virus
MDIGVPLLAL

SEQ ID NO: 114064 - protein, 10 aa, Dengue virus
DIGVPLLALG

SEQ ID NO: 114065 - protein, 10 aa, Dengue virus
IGVPLLALGC

SEQ ID NO: 114066 - protein, 10 aa, Dengue virus
GVPLLALGCY

SEQ ID NO: 114067 - protein, 10 aa, Dengue virus
VPLLALGCYS

SEQ ID NO: 114068 - protein, 10 aa, Dengue virus
PLLALGCYSQ

SEQ ID NO: 114069 - protein, 10 aa, Dengue virus
LLALGCYSQV

SEQ ID NO: 114070 - protein, 10 aa, Dengue virus
LALGCYSQVN

SEQ ID NO: 114071 - protein, 10 aa, Dengue virus
ALGCYSQVNP

SEQ ID NO: 114072 - protein, 10 aa, Dengue virus
LGCYSQVNPL

SEQ ID NO: 114073 - protein, 10 aa, Dengue virus
GCYSQVNPLT

SEQ ID NO: 114074 - protein, 10 aa, Dengue virus
CYSQVNPLTL

SEQ ID NO: 114075 - protein, 10 aa, Dengue virus
YSQVNPLTLT

SEQ ID NO: 114076 - protein, 10 aa, Dengue virus
SQVNPLTLTA

SEQ ID NO: 114077 - protein, 10 aa, Dengue virus
QVNPLTLTAA

SEQ ID NO: 114078 - protein, 10 aa, Dengue virus
VNPLTLTAAV

SEQ ID NO: 114079 - protein, 10 aa, Dengue virus
LVAHYAIIGP

SEQ ID NO: 114080 - protein, 10 aa, Dengue virus
AHYAIIGPGL

SEQ ID NO: 114081 - protein, 10 aa, Dengue virus
HYAIIGPGLQ

SEQ ID NO: 114082 - protein, 10 aa, Dengue virus
YAIIGPGLQA

SEQ ID NO: 114083 - protein, 10 aa, Dengue virus
AIIGPGLQAK

SEQ ID NO: 114084 - protein, 10 aa, Dengue virus
IIGPGLQAKA

SEQ ID NO: 114085 - protein, 10 aa, Dengue virus
IGPGLQAKAT

SEQ ID NO: 114086 - protein, 10 aa, Dengue virus
GPGLQAKATR

SEQ ID NO: 114087 - protein, 10 aa, Dengue virus
PGLQAKATRE

SEQ ID NO: 114088 - protein, 10 aa, Dengue virus
GLQAKATREA

SEQ ID NO: 114089 - protein, 10 aa, Dengue virus
LQAKATREAQ

SEQ ID NO: 114090 - protein, 10 aa, Dengue virus
QAKATREAQK

SEQ ID NO: 114091 - protein, 10 aa, Dengue virus
AKATREAQKR

SEQ ID NO: 114092 - protein, 10 aa, Dengue virus
KATREAQKRT

SEQ ID NO: 114093 - protein, 10 aa, Dengue virus
ATREAQKRTA

SEQ ID NO: 114094 - protein, 10 aa, Dengue virus
TREAQKRTAA

SEQ ID NO: 114095 - protein, 10 aa, Dengue virus
REAQKRTAAG

SEQ ID NO: 114096 - protein, 10 aa, Dengue virus
EAQKRTAAGI

SEQ ID NO: 114097 - protein, 10 aa, Dengue virus
AQKRTAAGIM

SEQ ID NO: 114098 - protein, 10 aa, Dengue virus
QKRTAAGIMK

SEQ ID NO: 114099 - protein, 10 aa, Dengue virus
KRTAAGIMKN

SEQ ID NO: 114100 - protein, 10 aa, Dengue virus
RTAAGIMKNP

SEQ ID NO: 114101 - protein, 10 aa, Dengue virus
TAAGIMKNPT

SEQ ID NO: 114102 - protein, 10 aa, Dengue virus
AAGIMKNPTV

SEQ ID NO: 114103 - protein, 10 aa, Dengue virus
AGIMKNPTVD

SEQ ID NO: 114104 - protein, 10 aa, Dengue virus
GIMKNPTVDG

SEQ ID NO: 114105 - protein, 10 aa, Dengue virus
IMKNPTVDGI

SEQ ID NO: 114106 - protein, 10 aa, Dengue virus
MKNPTVDGIV

SEQ ID NO: 114107 - protein, 10 aa, Dengue virus
KNPTVDGIVA

SEQ ID NO: 114108 - protein, 10 aa, Dengue virus
NPTVDGIVAI

SEQ ID NO: 114109 - protein, 10 aa, Dengue virus
AIDLDPVVYD

SEQ ID NO: 114110 - protein, 10 aa, Dengue virus
PVVYDAKFEK

SEQ ID NO: 114111 - protein, 10 aa, Dengue virus
VVYDAKFEKQ

SEQ ID NO: 114112 - protein, 10 aa, Dengue virus
VYDAKFEKQL

SEQ ID NO: 114113 - protein, 10 aa, Dengue virus
YDAKFEKQLG

SEQ ID NO: 114114 - protein, 10 aa, Dengue virus
DAKFEKQLGQ

SEQ ID NO: 114115 - protein, 10 aa, Dengue virus
AKFEKQLGQI

SEQ ID NO: 114116 - protein, 10 aa, Dengue virus
KFEKQLGQVM

SEQ ID NO: 114117 - protein, 10 aa, Dengue virus
FEKQLGQVML

SEQ ID NO: 114118 - protein, 10 aa, Dengue virus
EKQLGQVMLL

SEQ ID NO: 114119 - protein, 10 aa, Dengue virus
KQLGQIMLLI

SEQ ID NO: 114120 - protein, 10 aa, Dengue virus
QLGQIMLLIL

SEQ ID NO: 114121 - protein, 10 aa, Dengue virus
LGQIMLLILC

SEQ ID NO: 114122 - protein, 10 aa, Dengue virus
GQIMLLILCT

SEQ ID NO: 114123 - protein, 10 aa, Dengue virus
LCTSQILLMR

SEQ ID NO: 114124 - protein, 10 aa, Dengue virus
CTSQILLMRT

SEQ ID NO: 114125 - protein, 10 aa, Dengue virus
TSQILLMRTT

SEQ ID NO: 114126 - protein, 10 aa, Dengue virus
SQILLMRTTW

SEQ ID NO: 114127 - protein, 10 aa, Dengue virus
QILLMRTTWA

SEQ ID NO: 114128 - protein, 10 aa, Dengue virus
ILLMRTTWAL

SEQ ID NO: 114129 - protein, 10 aa, Dengue virus
LLMRTTWALC

SEQ ID NO: 114130 - protein, 10 aa, Dengue virus
LMRTTWALCE

SEQ ID NO: 114131 - protein, 10 aa, Dengue virus
MRTTWALCES

SEQ ID NO: 114132 - protein, 10 aa, Dengue virus
RTTWALCESI

SEQ ID NO: 114133 - protein, 10 aa, Dengue virus
TTWALCESIT

SEQ ID NO: 114134 - protein, 10 aa, Dengue virus
TWALCESITL

SEQ ID NO: 114135 - protein, 10 aa, Dengue virus
WALCEALTLA

SEQ ID NO: 114136 - protein, 10 aa, Dengue virus
ALCEALTLAT

SEQ ID NO: 114137 - protein, 10 aa, Dengue virus
LCEALTLATG

SEQ ID NO: 114138 - protein, 10 aa, Dengue virus
CEALTLATGP

SEQ ID NO: 114139 - protein, 10 aa, Dengue virus
EALTLATGPI

SEQ ID NO: 114140 - protein, 10 aa, Dengue virus
ITLATGPLTT

SEQ ID NO: 114141 - protein, 10 aa, Dengue virus
TLATGPLTTL

SEQ ID NO: 114142 - protein, 10 aa, Dengue virus
LATGPLTTLW

SEQ ID NO: 114143 - protein, 10 aa, Dengue virus
ATGPLTTLWE

SEQ ID NO: 114144 - protein, 10 aa, Dengue virus
TGPLTTLWEG

SEQ ID NO: 114145 - protein, 10 aa, Dengue virus
GPLTTLWEGS

SEQ ID NO: 114146 - protein, 10 aa, Dengue virus
PLTTLWEGSP

SEQ ID NO: 114147 - protein, 10 aa, Dengue virus
LTTLWEGSPG

SEQ ID NO: 114148 - protein, 10 aa, Dengue virus
TTLWEGSPGK

SEQ ID NO: 114149 - protein, 10 aa, Dengue virus
TLWEGSPGKF

SEQ ID NO: 114150 - protein, 10 aa, Dengue virus
LWEGSPGKFW

SEQ ID NO: 114151 - protein, 10 aa, Dengue virus
WEGSPGKFWN

SEQ ID NO: 114152 - protein, 10 aa, Dengue virus
EGSPGKFWNT

SEQ ID NO: 114153 - protein, 10 aa, Dengue virus
GSPGKFWNTT

SEQ ID NO: 114154 - protein, 10 aa, Dengue virus
SPGKFWNTTI

SEQ ID NO: 114155 - protein, 10 aa, Dengue virus
PGKFWNTTIA

SEQ ID NO: 114156 - protein, 10 aa, Dengue virus
GKFWNTTIAV

SEQ ID NO: 114157 - protein, 10 aa, Dengue virus
KFWNTTIAVS

SEQ ID NO: 114158 - protein, 10 aa, Dengue virus
FWNTTIAVSM

SEQ ID NO: 114159 - protein, 10 aa, Dengue virus
WNTTIAVSMA

SEQ ID NO: 114160 - protein, 10 aa, Dengue virus
NTTIAVSMAN

SEQ ID NO: 114161 - protein, 10 aa, Dengue virus
TTIAVSMANI

SEQ ID NO: 114162 - protein, 10 aa, Dengue virus
TIAVSMANIF

SEQ ID NO: 114163 - protein, 10 aa, Dengue virus
IAVSMANIFR

SEQ ID NO: 114164 - protein, 10 aa, Dengue virus
AVSMANIFRG

SEQ ID NO: 114165 - protein, 10 aa, Dengue virus
VSMANIFRGS

SEQ ID NO: 114166 - protein, 10 aa, Dengue virus
SMANIFRGSY

SEQ ID NO: 114167 - protein, 10 aa, Dengue virus
MANIFRGSYL

SEQ ID NO: 114168 - protein, 10 aa, Dengue virus
ANIFRGSYLA

SEQ ID NO: 114169 - protein, 10 aa, Dengue virus
NIFRGSYLAG

SEQ ID NO: 114170 - protein, 10 aa, Dengue virus
IFRGSYLAGA

SEQ ID NO: 114171 - protein, 10 aa, Dengue virus
FRGSYLAGAG

SEQ ID NO: 114172 - protein, 10 aa, Dengue virus
RGSYLAGAGL

SEQ ID NO: 114173 - protein, 10 aa, Dengue virus
GSYLAGAGLA

SEQ ID NO: 114174 - protein, 10 aa, Dengue virus
SYLAGAGLAF

SEQ ID NO: 114175 - protein, 10 aa, Dengue virus
YLAGAGLAFS

SEQ ID NO: 114176 - protein, 10 aa, Dengue virus
LAGAGLAFSL

SEQ ID NO: 114177 - protein, 10 aa, Dengue virus
AGAGLAFSLM

SEQ ID NO: 114178 - protein, 10 aa, Dengue virus
GAGLAFSLMK

SEQ ID NO: 114179 - protein, 10 aa, Dengue virus
AGLAFSLMKS

SEQ ID NO: 114180 - protein, 10 aa, Dengue virus
GLAFSLMKSL

SEQ ID NO: 114181 - protein, 10 aa, Dengue virus
QGETLGEKWK

SEQ ID NO: 114182 - protein, 10 aa, Dengue virus
GETLGEKWKR

SEQ ID NO: 114183 - protein, 10 aa, Dengue virus
ETLGEKWKRQ

SEQ ID NO: 114184 - protein, 10 aa, Dengue virus
TLGEKWKRQL

SEQ ID NO: 114185 - protein, 10 aa, Dengue virus
LGEKWKRQLN

SEQ ID NO: 114186 - protein, 10 aa, Dengue virus
EVDRSEAKEG

SEQ ID NO: 114187 - protein, 10 aa, Dengue virus
VDRSEAKEGL

SEQ ID NO: 114188 - protein, 10 aa, Dengue virus
EAKEGLKRGE

SEQ ID NO: 114189 - protein, 10 aa, Dengue virus
AKEGLKRGET

SEQ ID NO: 114190 - protein, 10 aa, Dengue virus
HHAVSRGSAK

SEQ ID NO: 114191 - protein, 10 aa, Dengue virus
HAVSRGSAKL

SEQ ID NO: 114192 - protein, 10 aa, Dengue virus
AVSRGTAKLR

SEQ ID NO: 114193 - protein, 10 aa, Dengue virus
VSRGTAKLRW

SEQ ID NO: 114194 - protein, 10 aa, Dengue virus
SRGTAKLRWF

SEQ ID NO: 114195 - protein, 10 aa, Dengue virus
RGTAKLRWFV

SEQ ID NO: 114196 - protein, 10 aa, Dengue virus
GTAKLRWFVE

SEQ ID NO: 114197 - protein, 10 aa, Dengue virus
TAKLRWFVER

SEQ ID NO: 114198 - protein, 10 aa, Dengue virus
AKLRWFVERN

SEQ ID NO: 114199 - protein, 10 aa, Dengue virus
KLRWFVERNL

SEQ ID NO: 114200 - protein, 10 aa, Dengue virus
LRWFVERNLV

SEQ ID NO: 114201 - protein, 10 aa, Dengue virus
PEGKVIDLGC

SEQ ID NO: 114202 - protein, 10 aa, Dengue virus
EGKVIDLGCG

SEQ ID NO: 114203 - protein, 10 aa, Dengue virus
GKVIDLGCGR

SEQ ID NO: 114204 - protein, 10 aa, Dengue virus
KVIDLGCGRG

SEQ ID NO: 114205 - protein, 10 aa, Dengue virus
VIDLGCGRGG

SEQ ID NO: 114206 - protein, 10 aa, Dengue virus
IDLGCGRGGW

SEQ ID NO: 114207 - protein, 10 aa, Dengue virus
DLGCGRGGWS

SEQ ID NO: 114208 - protein, 10 aa, Dengue virus
LGCGRGGWSY

SEQ ID NO: 114209 - protein, 10 aa, Dengue virus
GCGRGGWSYY

SEQ ID NO: 114210 - protein, 10 aa, Dengue virus
CGRGGWSYYC

SEQ ID NO: 114211 - protein, 10 aa, Dengue virus
GRGGWSYYCA

SEQ ID NO: 114212 - protein, 10 aa, Dengue virus
RGGWSYYCAG

SEQ ID NO: 114213 - protein, 10 aa, Dengue virus
GGWSYYCAGL

SEQ ID NO: 114214 - protein, 10 aa, Dengue virus
GWSYYCAGLK

SEQ ID NO: 114215 - protein, 10 aa, Dengue virus
WSYYCAGLKK

SEQ ID NO: 114216 - protein, 10 aa, Dengue virus
SYYCAGLKKV

SEQ ID NO: 114217 - protein, 10 aa, Dengue virus
YYCAGLKKVT

SEQ ID NO: 114218 - protein, 10 aa, Dengue virus
YCAGLKKVTE

SEQ ID NO: 114219 - protein, 10 aa, Dengue virus
CAGLKKVTEV

SEQ ID NO: 114220 - protein, 10 aa, Dengue virus
VTEVKGYTKG

SEQ ID NO: 114221 - protein, 10 aa, Dengue virus
TEVKGYTKGG

SEQ ID NO: 114222 - protein, 10 aa, Dengue virus
EVKGYTKGGP

SEQ ID NO: 114223 - protein, 10 aa, Dengue virus
VKGYTKGGPG

SEQ ID NO: 114224 - protein, 10 aa, Dengue virus
KGYTKGGPGH

SEQ ID NO: 114225 - protein, 10 aa, Dengue virus
GYTKGGPGHE

SEQ ID NO: 114226 - protein, 10 aa, Dengue virus
YTKGGPGHEE

SEQ ID NO: 114227 - protein, 10 aa, Dengue virus
TKGGPGHEEP

SEQ ID NO: 114228 - protein, 10 aa, Dengue virus
KGGPGHEEPI

SEQ ID NO: 114229 - protein, 10 aa, Dengue virus
GGPGHEEPIP

SEQ ID NO: 114230 - protein, 10 aa, Dengue virus
GPGHEEPIPM

SEQ ID NO: 114231 - protein, 10 aa, Dengue virus
PGHEEPIPMA

SEQ ID NO: 114232 - protein, 10 aa, Dengue virus
GHEEPIPMAT

SEQ ID NO: 114233 - protein, 10 aa, Dengue virus
HEEPIPMATY

SEQ ID NO: 114234 - protein, 10 aa, Dengue virus
EEPIPMATYG

SEQ ID NO: 114235 - protein, 10 aa, Dengue virus
EPIPMATYGW

SEQ ID NO: 114236 - protein, 10 aa, Dengue virus
PIPMATYGWN

SEQ ID NO: 114237 - protein, 10 aa, Dengue virus
IPMATYGWNL

SEQ ID NO: 114238 - protein, 10 aa, Dengue virus
PMATYGWNLV

SEQ ID NO: 114239 - protein, 10 aa, Dengue virus
MATYGWNLVK

SEQ ID NO: 114240 - protein, 10 aa, Dengue virus
ATYGWNLVKL

SEQ ID NO: 114241 - protein, 10 aa, Dengue virus
TYGWNLVKLH

SEQ ID NO: 114242 - protein, 10 aa, Dengue virus
GWNLVKLHSG

SEQ ID NO: 114243 - protein, 10 aa, Dengue virus
PPEKCDTLLC

SEQ ID NO: 114244 - protein, 10 aa, Dengue virus
PEKCDTLLCD

SEQ ID NO: 114245 - protein, 10 aa, Dengue virus
EKCDTLLCDI

SEQ ID NO: 114246 - protein, 10 aa, Dengue virus
KCDTLLCDIG

SEQ ID NO: 114247 - protein, 10 aa, Dengue virus
CDTLLCDIGE

SEQ ID NO: 114248 - protein, 10 aa, Dengue virus
DTLLCDIGES

SEQ ID NO: 114249 - protein, 10 aa, Dengue virus
TLLCDIGESS

SEQ ID NO: 114250 - protein, 10 aa, Dengue virus
LLCDIGESSP

SEQ ID NO: 114251 - protein, 10 aa, Dengue virus
LCDIGESSPN

SEQ ID NO: 114252 - protein, 10 aa, Dengue virus
CDIGESSPNP

SEQ ID NO: 114253 - protein, 10 aa, Dengue virus
DIGESSPNPT

SEQ ID NO: 114254 - protein, 10 aa, Dengue virus
IGESSPNPTI

SEQ ID NO: 114255 - protein, 10 aa, Dengue virus
GESSPNPTIE

SEQ ID NO: 114256 - protein, 10 aa, Dengue virus
ESSPNPTIEE

SEQ ID NO: 114257 - protein, 10 aa, Dengue virus
SSPNPTIEEG

SEQ ID NO: 114258 - protein, 10 aa, Dengue virus
SPNPTIEEGR

SEQ ID NO: 114259 - protein, 10 aa, Dengue virus
PNPTIEEGRT

SEQ ID NO: 114260 - protein, 10 aa, Dengue virus
NPTIEEGRTL

SEQ ID NO: 114261 - protein, 10 aa, Dengue virus
PTIEEGRTLR

SEQ ID NO: 114262 - protein, 10 aa, Dengue virus
TIEEGRTLRV

SEQ ID NO: 114263 - protein, 10 aa, Dengue virus
IEEGRTLRVL

SEQ ID NO: 114264 - protein, 10 aa, Dengue virus
EEGRTLRVLK

SEQ ID NO: 114265 - protein, 10 aa, Dengue virus
EGRTLRVLKM

SEQ ID NO: 114266 - protein, 10 aa, Dengue virus
GRTLRVLKMV

SEQ ID NO: 114267 - protein, 10 aa, Dengue virus
RTLRVLKMVE

SEQ ID NO: 114268 - protein, 10 aa, Dengue virus
TLRVLKMVEP

SEQ ID NO: 114269 - protein, 10 aa, Dengue virus
LRVLKMVEPW

SEQ ID NO: 114270 - protein, 10 aa, Dengue virus
RVLKMVEPWL

SEQ ID NO: 114271 - protein, 10 aa, Dengue virus
QFCIKVLNPY

SEQ ID NO: 114272 - protein, 10 aa, Dengue virus
FCIKVLNPYM

SEQ ID NO: 114273 - protein, 10 aa, Dengue virus
CIKVLNPYMP

SEQ ID NO: 114274 - protein, 10 aa, Dengue virus
IKILNPYMPS

SEQ ID NO: 114275 - protein, 10 aa, Dengue virus
KILNPYMPSV

SEQ ID NO: 114276 - protein, 10 aa, Dengue virus
ILNPYMPSVV

SEQ ID NO: 114277 - protein, 10 aa, Dengue virus
LNPYMPSVVE

SEQ ID NO: 114278 - protein, 10 aa, Dengue virus
HGGMLVRNPL

SEQ ID NO: 114279 - protein, 10 aa, Dengue virus
GGMLVRNPLS

SEQ ID NO: 114280 - protein, 10 aa, Dengue virus
GMLVRNPLSR

SEQ ID NO: 114281 - protein, 10 aa, Dengue virus
MLVRNPLSRN

SEQ ID NO: 114282 - protein, 10 aa, Dengue virus
LVRNPLSRNS

SEQ ID NO: 114283 - protein, 10 aa, Dengue virus
VRNPLSRNST

SEQ ID NO: 114284 - protein, 10 aa, Dengue virus
RNPLSRNSTH

SEQ ID NO: 114285 - protein, 10 aa, Dengue virus
NPLSRNSTHE

SEQ ID NO: 114286 - protein, 10 aa, Dengue virus
PLSRNSTHEM

SEQ ID NO: 114287 - protein, 10 aa, Dengue virus
LSRNSTHEMY

SEQ ID NO: 114288 - protein, 10 aa, Dengue virus
SRNSTHEMYW

SEQ ID NO: 114289 - protein, 10 aa, Dengue virus
RNSTHEMYWV

SEQ ID NO: 114290 - protein, 10 aa, Dengue virus
NSTHEMYWVS

SEQ ID NO: 114291 - protein, 10 aa, Dengue virus
STHEMYWVSC

SEQ ID NO: 114292 - protein, 10 aa, Dengue virus
THEMYWVSCG

SEQ ID NO: 114293 - protein, 10 aa, Dengue virus
HEMYWVSCGT

SEQ ID NO: 114294 - protein, 10 aa, Dengue virus
EMYWVSCGTG

SEQ ID NO: 114295 - protein, 10 aa, Dengue virus
MYWVSCGTGN

SEQ ID NO: 114296 - protein, 10 aa, Dengue virus
YWVSCGTGNI

SEQ ID NO: 114297 - protein, 10 aa, Dengue virus
WVSCGTGNIV

SEQ ID NO: 114298 - protein, 10 aa, Dengue virus
GTGNIVSAVN

SEQ ID NO: 114299 - protein, 10 aa, Dengue virus
TGNIVSAVNM

SEQ ID NO: 114300 - protein, 10 aa, Dengue virus
GNIVSAVNMT

SEQ ID NO: 114301 - protein, 10 aa, Dengue virus
NIVSAVNMTS

SEQ ID NO: 114302 - protein, 10 aa, Dengue virus
IVSAVNMTSR

SEQ ID NO: 114303 - protein, 10 aa, Dengue virus
VSAVNMTSRM

SEQ ID NO: 114304 - protein, 10 aa, Dengue virus
SAVNMTSRML

SEQ ID NO: 114305 - protein, 10 aa, Dengue virus
AVNMTSRMLL

SEQ ID NO: 114306 - protein, 10 aa, Dengue virus
VNMTSRMLLN

SEQ ID NO: 114307 - protein, 10 aa, Dengue virus
NMTSRMLLNR

SEQ ID NO: 114308 - protein, 10 aa, Dengue virus
MTSRMLLNRF

SEQ ID NO: 114309 - protein, 10 aa, Dengue virus
TSRMLLNRFT

SEQ ID NO: 114310 - protein, 10 aa, Dengue virus
SRMLLNRFTM

SEQ ID NO: 114311 - protein, 10 aa, Dengue virus
PTYERDVDLG

SEQ ID NO: 114312 - protein, 10 aa, Dengue virus
ERDVDLGAGT

SEQ ID NO: 114313 - protein, 10 aa, Dengue virus
RDVDLGAGTR

SEQ ID NO: 114314 - protein, 10 aa, Dengue virus
DVDLGAGTRH

SEQ ID NO: 114315 - protein, 10 aa, Dengue virus
VDLGAGTRHV

SEQ ID NO: 114316 - protein, 10 aa, Dengue virus
DLGAGTRHVA

SEQ ID NO: 114317 - protein, 10 aa, Dengue virus
LGAGTRHVAV

SEQ ID NO: 114318 - protein, 10 aa, Dengue virus
GAGTRHVAVE

SEQ ID NO: 114319 - protein, 10 aa, Dengue virus
ANLDIIGQRI

SEQ ID NO: 114320 - protein, 10 aa, Dengue virus
DIIGQRIENI

SEQ ID NO: 114321 - protein, 10 aa, Dengue virus
TWHYDEDNPY

SEQ ID NO: 114322 - protein, 10 aa, Dengue virus
WHYDEDNPYK

SEQ ID NO: 114323 - protein, 10 aa, Dengue virus
HYDEDNPYKT

SEQ ID NO: 114324 - protein, 10 aa, Dengue virus
YDEDNPYKTW

SEQ ID NO: 114325 - protein, 10 aa, Dengue virus
DEDNPYKTWA

SEQ ID NO: 114326 - protein, 10 aa, Dengue virus
EDNPYKTWAY

SEQ ID NO: 114327 - protein, 10 aa, Dengue virus
DNPYKTWAYH

SEQ ID NO: 114328 - protein, 10 aa, Dengue virus
NPYKTWAYHG

SEQ ID NO: 114329 - protein, 10 aa, Dengue virus
PYKTWAYHGS

SEQ ID NO: 114330 - protein, 10 aa, Dengue virus
YKTWAYHGSY

SEQ ID NO: 114331 - protein, 10 aa, Dengue virus
KTWAYHGSYE

SEQ ID NO: 114332 - protein, 10 aa, Dengue virus
TWAYHGSYEV

SEQ ID NO: 114333 - protein, 10 aa, Dengue virus
WAYHGSYEVK

SEQ ID NO: 114334 - protein, 10 aa, Dengue virus
AYHGSYEVKP

SEQ ID NO: 114335 - protein, 10 aa, Dengue virus
YHGSYEVKPS

SEQ ID NO: 114336 - protein, 10 aa, Dengue virus
HGSYEVKPSG

SEQ ID NO: 114337 - protein, 10 aa, Dengue virus
GSYEVKPSGS

SEQ ID NO: 114338 - protein, 10 aa, Dengue virus
SYEVKPSGSA

SEQ ID NO: 114339 - protein, 10 aa, Dengue virus
YEVKPSGSAS

SEQ ID NO: 114340 - protein, 10 aa, Dengue virus
EVKPSGSASS

SEQ ID NO: 114341 - protein, 10 aa, Dengue virus
VKPSGSASSM

SEQ ID NO: 114342 - protein, 10 aa, Dengue virus
KPSGSASSMV

SEQ ID NO: 114343 - protein, 10 aa, Dengue virus
PSGSASSMVN

SEQ ID NO: 114344 - protein, 10 aa, Dengue virus
SGSASSMVNG

SEQ ID NO: 114345 - protein, 10 aa, Dengue virus
GSASSMVNGV

SEQ ID NO: 114346 - protein, 10 aa, Dengue virus
SASSMVNGVV

SEQ ID NO: 114347 - protein, 10 aa, Dengue virus
ASSMVNGVVR

SEQ ID NO: 114348 - protein, 10 aa, Dengue virus
SSMVNGVVRL

SEQ ID NO: 114349 - protein, 10 aa, Dengue virus
SMVNGVVRLL

SEQ ID NO: 114350 - protein, 10 aa, Dengue virus
MVNGVVRLLT

SEQ ID NO: 114351 - protein, 10 aa, Dengue virus
VNGVVRLLTK

SEQ ID NO: 114352 - protein, 10 aa, Dengue virus
NGVVKLLTKP

SEQ ID NO: 114353 - protein, 10 aa, Dengue virus
GVVKLLTKPW

SEQ ID NO: 114354 - protein, 10 aa, Dengue virus
VVKLLTKPWD

SEQ ID NO: 114355 - protein, 10 aa, Dengue virus
VKLLTKPWDV

SEQ ID NO: 114356 - protein, 10 aa, Dengue virus
KLLTKPWDVI

SEQ ID NO: 114357 - protein, 10 aa, Dengue virus
LLTKPWDVIP

SEQ ID NO: 114358 - protein, 10 aa, Dengue virus
LTKPWDVIPM

SEQ ID NO: 114359 - protein, 10 aa, Dengue virus
TKPWDVIPMV

SEQ ID NO: 114360 - protein, 10 aa, Dengue virus
KPWDVIPMVT

SEQ ID NO: 114361 - protein, 10 aa, Dengue virus
PWDVIPMVTQ

SEQ ID NO: 114362 - protein, 10 aa, Dengue virus
PMVTQIAMTD

SEQ ID NO: 114363 - protein, 10 aa, Dengue virus
MVTQIAMTDT

SEQ ID NO: 114364 - protein, 10 aa, Dengue virus
VTQMAMTDTT

SEQ ID NO: 114365 - protein, 10 aa, Dengue virus
TQMAMTDTTP

SEQ ID NO: 114366 - protein, 10 aa, Dengue virus
QMAMTDTTPF

SEQ ID NO: 114367 - protein, 10 aa, Dengue virus
MAMTDTTPFG

SEQ ID NO: 114368 - protein, 10 aa, Dengue virus
AMTDTTPFGQ

SEQ ID NO: 114369 - protein, 10 aa, Dengue virus
MTDTTPFGQQ

SEQ ID NO: 114370 - protein, 10 aa, Dengue virus
TDTTPFGQQR

SEQ ID NO: 114371 - protein, 10 aa, Dengue virus
DTTPFGQQRV

SEQ ID NO: 114372 - protein, 10 aa, Dengue virus
TTPFGQQRVF

SEQ ID NO: 114373 - protein, 10 aa, Dengue virus
TPFGQQRVFK

SEQ ID NO: 114374 - protein, 10 aa, Dengue virus
PFGQQRVFKE

SEQ ID NO: 114375 - protein, 10 aa, Dengue virus
FGQQRVFKEK

SEQ ID NO: 114376 - protein, 10 aa, Dengue virus
GQQRVFKEKV

SEQ ID NO: 114377 - protein, 10 aa, Dengue virus
QQRVFKEKVD

SEQ ID NO: 114378 - protein, 10 aa, Dengue virus
QRVFKEKVDT

SEQ ID NO: 114379 - protein, 10 aa, Dengue virus
RVFKEKVDTR

SEQ ID NO: 114380 - protein, 10 aa, Dengue virus
VFKEKVDTRT

SEQ ID NO: 114381 - protein, 10 aa, Dengue virus
FKEKVDTRTP

SEQ ID NO: 114382 - protein, 10 aa, Dengue virus
KEKVDTRTPK

SEQ ID NO: 114383 - protein, 10 aa, Dengue virus
CTREEFTRKV

SEQ ID NO: 114384 - protein, 10 aa, Dengue virus
TREEFTRKVR

SEQ ID NO: 114385 - protein, 10 aa, Dengue virus
RKVRSNAAIG

SEQ ID NO: 114386 - protein, 10 aa, Dengue virus
KVRSNAAIGA

SEQ ID NO: 114387 - protein, 10 aa, Dengue virus
VRSNAAIGAV

SEQ ID NO: 114388 - protein, 10 aa, Dengue virus
RSNAAIGAVF

SEQ ID NO: 114389 - protein, 10 aa, Dengue virus
SNAAIGAVFV

SEQ ID NO: 114390 - protein, 10 aa, Dengue virus
NAAIGAVFVD

SEQ ID NO: 114391 - protein, 10 aa, Dengue virus
AAIGAVFVDE

SEQ ID NO: 114392 - protein, 10 aa, Dengue virus
AIGAVFVDEN

SEQ ID NO: 114393 - protein, 10 aa, Dengue virus
IGAVFVDENQ

SEQ ID NO: 114394 - protein, 10 aa, Dengue virus
GAVFVDENQW

SEQ ID NO: 114395 - protein, 10 aa, Dengue virus
AVFVDENQWN

SEQ ID NO: 114396 - protein, 10 aa, Dengue virus
VFVDENQWNS

SEQ ID NO: 114397 - protein, 10 aa, Dengue virus
FVDENQWNSA

SEQ ID NO: 114398 - protein, 10 aa, Dengue virus
VDENQWNSAK

SEQ ID NO: 114399 - protein, 10 aa, Dengue virus
DENQWNSAKE

SEQ ID NO: 114400 - protein, 10 aa, Dengue virus
ENQWNSAKEA

SEQ ID NO: 114401 - protein, 10 aa, Dengue virus
NQWNSAKEAV

SEQ ID NO: 114402 - protein, 10 aa, Dengue virus
QWNSAKEAVE

SEQ ID NO: 114403 - protein, 10 aa, Dengue virus
WNSAKEAVED

SEQ ID NO: 114404 - protein, 10 aa, Dengue virus
ERELHKQGKC

SEQ ID NO: 114405 - protein, 10 aa, Dengue virus
RELHKQGKCA

SEQ ID NO: 114406 - protein, 10 aa, Dengue virus
ELHKQGKCAT

SEQ ID NO: 114407 - protein, 10 aa, Dengue virus
LHKQGKCATC

SEQ ID NO: 114408 - protein, 10 aa, Dengue virus
HKQGKCATCV

SEQ ID NO: 114409 - protein, 10 aa, Dengue virus
KQGKCATCVY

SEQ ID NO: 114410 - protein, 10 aa, Dengue virus
QGKCATCVYN

SEQ ID NO: 114411 - protein, 10 aa, Dengue virus
GKCATCVYNM

SEQ ID NO: 114412 - protein, 10 aa, Dengue virus
KCATCVYNMM

SEQ ID NO: 114413 - protein, 10 aa, Dengue virus
CATCVYNMMG

SEQ ID NO: 114414 - protein, 10 aa, Dengue virus
ATCVYNMMGK

SEQ ID NO: 114415 - protein, 10 aa, Dengue virus
TCVYNMMGKR

SEQ ID NO: 114416 - protein, 10 aa, Dengue virus
CVYNMMGKRE

SEQ ID NO: 114417 - protein, 10 aa, Dengue virus
VYNMMGKREK

SEQ ID NO: 114418 - protein, 10 aa, Dengue virus
YNMMGKREKK

SEQ ID NO: 114419 - protein, 10 aa, Dengue virus
NMMGKREKKL

SEQ ID NO: 114420 - protein, 10 aa, Dengue virus
MMGKREKKLG

SEQ ID NO: 114421 - protein, 10 aa, Dengue virus
MGKREKKLGE

SEQ ID NO: 114422 - protein, 10 aa, Dengue virus
GKREKKLGEF

SEQ ID NO: 114423 - protein, 10 aa, Dengue virus
KREKKLGEFG

SEQ ID NO: 114424 - protein, 10 aa, Dengue virus
REKKLGEFGK

SEQ ID NO: 114425 - protein, 10 aa, Dengue virus
EKKLGEFGKA

SEQ ID NO: 114426 - protein, 10 aa, Dengue virus
KKLGEFGKAK

SEQ ID NO: 114427 - protein, 10 aa, Dengue virus
KLGEFGKAKG

SEQ ID NO: 114428 - protein, 10 aa, Dengue virus
LGEFGKAKGS

SEQ ID NO: 114429 - protein, 10 aa, Dengue virus
GEFGKAKGSR

SEQ ID NO: 114430 - protein, 10 aa, Dengue virus
EFGKAKGSRA

SEQ ID NO: 114431 - protein, 10 aa, Dengue virus
FGKAKGSRAI

SEQ ID NO: 114432 - protein, 10 aa, Dengue virus
GKAKGSRAIW

SEQ ID NO: 114433 - protein, 10 aa, Dengue virus
KAKGSRAIWY

SEQ ID NO: 114434 - protein, 10 aa, Dengue virus
AKGSRAIWYM

SEQ ID NO: 114435 - protein, 10 aa, Dengue virus
KGSRAIWYMW

SEQ ID NO: 114436 - protein, 10 aa, Dengue virus
GSRAIWYMWL

SEQ ID NO: 114437 - protein, 10 aa, Dengue virus
SRAIWYMWLG

SEQ ID NO: 114438 - protein, 10 aa, Dengue virus
RAIWYMWLGA

SEQ ID NO: 114439 - protein, 10 aa, Dengue virus
AIWYMWLGAR

SEQ ID NO: 114440 - protein, 10 aa, Dengue virus
IWYMWLGARF

SEQ ID NO: 114441 - protein, 10 aa, Dengue virus
WYMWLGARFL

SEQ ID NO: 114442 - protein, 10 aa, Dengue virus
YMWLGARFLE

SEQ ID NO: 114443 - protein, 10 aa, Dengue virus
MWLGARFLEF

SEQ ID NO: 114444 - protein, 10 aa, Dengue virus
WLGARFLEFE

SEQ ID NO: 114445 - protein, 10 aa, Dengue virus
LGARFLEFEA

SEQ ID NO: 114446 - protein, 10 aa, Dengue virus
GARFLEFEAL

SEQ ID NO: 114447 - protein, 10 aa, Dengue virus
ARFLEFEALG

SEQ ID NO: 114448 - protein, 10 aa, Dengue virus
RFLEFEALGF

SEQ ID NO: 114449 - protein, 10 aa, Dengue virus
FLEFEALGFM

SEQ ID NO: 114450 - protein, 10 aa, Dengue virus
LEFEALGFLN

SEQ ID NO: 114451 - protein, 10 aa, Dengue virus
EFEALGFLNE

SEQ ID NO: 114452 - protein, 10 aa, Dengue virus
FEALGFLNED

SEQ ID NO: 114453 - protein, 10 aa, Dengue virus
EALGFLNEDH

SEQ ID NO: 114454 - protein, 10 aa, Dengue virus
ALGFLNEDHW

SEQ ID NO: 114455 - protein, 10 aa, Dengue virus
LGFLNEDHWF

SEQ ID NO: 114456 - protein, 10 aa, Dengue virus
GFLNEDHWFS

SEQ ID NO: 114457 - protein, 10 aa, Dengue virus
FLNEDHWFSR

SEQ ID NO: 114458 - protein, 10 aa, Dengue virus
MNEDHWFSRE

SEQ ID NO: 114459 - protein, 10 aa, Dengue virus
NEDHWFSREN

SEQ ID NO: 114460 - protein, 10 aa, Dengue virus
EDHWFSRENS

SEQ ID NO: 114461 - protein, 10 aa, Dengue virus
DHWFSRENSL

SEQ ID NO: 114462 - protein, 10 aa, Dengue virus
HWFSRENSLS

SEQ ID NO: 114463 - protein, 10 aa, Dengue virus
WFSRENSLSG

SEQ ID NO: 114464 - protein, 10 aa, Dengue virus
FSRENSLSGV

SEQ ID NO: 114465 - protein, 10 aa, Dengue virus
SRENSLSGVE

SEQ ID NO: 114466 - protein, 10 aa, Dengue virus
RENSLSGVEG

SEQ ID NO: 114467 - protein, 10 aa, Dengue virus
ENSLSGVEGE

SEQ ID NO: 114468 - protein, 10 aa, Dengue virus
NSLSGVEGEG

SEQ ID NO: 114469 - protein, 10 aa, Dengue virus
SLSGVEGEGL

SEQ ID NO: 114470 - protein, 10 aa, Dengue virus
LSGVEGEGLH

SEQ ID NO: 114471 - protein, 10 aa, Dengue virus
SGVEGEGLHK

SEQ ID NO: 114472 - protein, 10 aa, Dengue virus
GVEGEGLHKL

SEQ ID NO: 114473 - protein, 10 aa, Dengue virus
VEGEGLHKLG

SEQ ID NO: 114474 - protein, 10 aa, Dengue virus
EGEGLHKLGY

SEQ ID NO: 114475 - protein, 10 aa, Dengue virus
GEGLHKLGYI

SEQ ID NO: 114476 - protein, 10 aa, Dengue virus
EGLHKLGYIL

SEQ ID NO: 114477 - protein, 10 aa, Dengue virus
GLHKLGYILR

SEQ ID NO: 114478 - protein, 10 aa, Dengue virus
GGAMYADDTA

SEQ ID NO: 114479 - protein, 10 aa, Dengue virus
GAMYADDTAG

SEQ ID NO: 114480 - protein, 10 aa, Dengue virus
AMYADDTAGW

SEQ ID NO: 114481 - protein, 10 aa, Dengue virus
MYADDTAGWD

SEQ ID NO: 114482 - protein, 10 aa, Dengue virus
YADDTAGWDT

SEQ ID NO: 114483 - protein, 10 aa, Dengue virus
ADDTAGWDTR

SEQ ID NO: 114484 - protein, 10 aa, Dengue virus
DDTAGWDTRI

SEQ ID NO: 114485 - protein, 10 aa, Dengue virus
DTAGWDTRIT

SEQ ID NO: 114486 - protein, 10 aa, Dengue virus
TAGWDTRITE

SEQ ID NO: 114487 - protein, 10 aa, Dengue virus
AGWDTRITED

SEQ ID NO: 114488 - protein, 10 aa, Dengue virus
GWDTRITEDD

SEQ ID NO: 114489 - protein, 10 aa, Dengue virus
WDTRITEDDL

SEQ ID NO: 114490 - protein, 10 aa, Dengue virus
AIFKLTYQNK

SEQ ID NO: 114491 - protein, 10 aa, Dengue virus
IFKLTYQNKV

SEQ ID NO: 114492 - protein, 10 aa, Dengue virus
FKLTYQNKVV

SEQ ID NO: 114493 - protein, 10 aa, Dengue virus
KLTYQNKVVR

SEQ ID NO: 114494 - protein, 10 aa, Dengue virus
LTYQNKVVRV

SEQ ID NO: 114495 - protein, 10 aa, Dengue virus
TYQNKVVRVQ

SEQ ID NO: 114496 - protein, 10 aa, Dengue virus
YQNKVVRVQR

SEQ ID NO: 114497 - protein, 10 aa, Dengue virus
QNKVVRVQRP

SEQ ID NO: 114498 - protein, 10 aa, Dengue virus
NKVVRVQRPA

SEQ ID NO: 114499 - protein, 10 aa, Dengue virus
KVVRVQRPAK

SEQ ID NO: 114500 - protein, 10 aa, Dengue virus
GTVMDVISRR

SEQ ID NO: 114501 - protein, 10 aa, Dengue virus
TVMDVISRRD

SEQ ID NO: 114502 - protein, 10 aa, Dengue virus
VMDVISRRDQ

SEQ ID NO: 114503 - protein, 10 aa, Dengue virus
MDVISRRDQR

SEQ ID NO: 114504 - protein, 10 aa, Dengue virus
DVISRRDQRG

SEQ ID NO: 114505 - protein, 10 aa, Dengue virus
VISRRDQRGS

SEQ ID NO: 114506 - protein, 10 aa, Dengue virus
ISRRDQRGSG

SEQ ID NO: 114507 - protein, 10 aa, Dengue virus
SRRDQRGSGQ

SEQ ID NO: 114508 - protein, 10 aa, Dengue virus
RRDQRGSGQV

SEQ ID NO: 114509 - protein, 10 aa, Dengue virus
RDQRGSGQVG

SEQ ID NO: 114510 - protein, 10 aa, Dengue virus
DQRGSGQVGT

SEQ ID NO: 114511 - protein, 10 aa, Dengue virus
QRGSGQVGTY

SEQ ID NO: 114512 - protein, 10 aa, Dengue virus
RGSGQVGTYG

SEQ ID NO: 114513 - protein, 10 aa, Dengue virus
GSGQVGTYGL

SEQ ID NO: 114514 - protein, 10 aa, Dengue virus
SGQVGTYGLN

SEQ ID NO: 114515 - protein, 10 aa, Dengue virus
GQVGTYGLNT

SEQ ID NO: 114516 - protein, 10 aa, Dengue virus
FTNMEAQLIR

SEQ ID NO: 114517 - protein, 10 aa, Dengue virus
TNMEAQLIRQ

SEQ ID NO: 114518 - protein, 10 aa, Dengue virus
NMEAQLIRQM

SEQ ID NO: 114519 - protein, 10 aa, Dengue virus
MEAQLIRQME

SEQ ID NO: 114520 - protein, 10 aa, Dengue virus
AQLIRQMEGE

SEQ ID NO: 114521 - protein, 10 aa, Dengue virus
QLIRQMESEG

SEQ ID NO: 114522 - protein, 10 aa, Dengue virus
ERLKRMAISG

SEQ ID NO: 114523 - protein, 10 aa, Dengue virus
RLKRMAISGD

SEQ ID NO: 114524 - protein, 10 aa, Dengue virus
LKRMAISGDD

SEQ ID NO: 114525 - protein, 10 aa, Dengue virus
KRMAISGDDC

SEQ ID NO: 114526 - protein, 10 aa, Dengue virus
RMAISGDDCV

SEQ ID NO: 114527 - protein, 10 aa, Dengue virus
MAISGDDCVV

SEQ ID NO: 114528 - protein, 10 aa, Dengue virus
AISGDDCVVK

SEQ ID NO: 114529 - protein, 10 aa, Dengue virus
ISGDDCVVKP

SEQ ID NO: 114530 - protein, 10 aa, Dengue virus
SGDDCVVKPI

SEQ ID NO: 114531 - protein, 10 aa, Dengue virus
GDDCVVKPID

SEQ ID NO: 114532 - protein, 10 aa, Dengue virus
DDCVVKPIDD

SEQ ID NO: 114533 - protein, 10 aa, Dengue virus
DCVVKPIDDR

SEQ ID NO: 114534 - protein, 10 aa, Dengue virus
CVVKPIDDRF

SEQ ID NO: 114535 - protein, 10 aa, Dengue virus
ALTALNDMGK

SEQ ID NO: 114536 - protein, 10 aa, Dengue virus
ALNDMGKVRK

SEQ ID NO: 114537 - protein, 10 aa, Dengue virus
LNDMGKVRKD

SEQ ID NO: 114538 - protein, 10 aa, Dengue virus
NDMGKVRKDI

SEQ ID NO: 114539 - protein, 10 aa, Dengue virus
DMGKVRKDIP

SEQ ID NO: 114540 - protein, 10 aa, Dengue virus
MGKVRKDIPQ

SEQ ID NO: 114541 - protein, 10 aa, Dengue virus
GKVRKDIPQW

SEQ ID NO: 114542 - protein, 10 aa, Dengue virus
KVRKDIPQWE

SEQ ID NO: 114543 - protein, 10 aa, Dengue virus
VRKDIPQWEP

SEQ ID NO: 114544 - protein, 10 aa, Dengue virus
RKDIPQWEPS

SEQ ID NO: 114545 - protein, 10 aa, Dengue virus
KDIPQWEPSK

SEQ ID NO: 114546 - protein, 10 aa, Dengue virus
DIPQWEPSKG

SEQ ID NO: 114547 - protein, 10 aa, Dengue virus
IPQWEPSKGW

SEQ ID NO: 114548 - protein, 10 aa, Dengue virus
QWEPSKGWND

SEQ ID NO: 114549 - protein, 10 aa, Dengue virus
WEPSKGWNDW

SEQ ID NO: 114550 - protein, 10 aa, Dengue virus
GWNDWQQVPF

SEQ ID NO: 114551 - protein, 10 aa, Dengue virus
WNDWQQVPFC

SEQ ID NO: 114552 - protein, 10 aa, Dengue virus
NDWQQVPFCS

SEQ ID NO: 114553 - protein, 10 aa, Dengue virus
DWQQVPFCSH

SEQ ID NO: 114554 - protein, 10 aa, Dengue virus
WQQVPFCSHH

SEQ ID NO: 114555 - protein, 10 aa, Dengue virus
QQVPFCSHHF

SEQ ID NO: 114556 - protein, 10 aa, Dengue virus
QVPFCSHHFH

SEQ ID NO: 114557 - protein, 10 aa, Dengue virus
VPFCSHHFHE

SEQ ID NO: 114558 - protein, 10 aa, Dengue virus
PFCSHHFHEL

SEQ ID NO: 114559 - protein, 10 aa, Dengue virus
FCSHHFHQLI

SEQ ID NO: 114560 - protein, 10 aa, Dengue virus
CSHHFHQLIM

SEQ ID NO: 114561 - protein, 10 aa, Dengue virus
SHHFHQLIMK

SEQ ID NO: 114562 - protein, 10 aa, Dengue virus
HHFHQLIMKD

SEQ ID NO: 114563 - protein, 10 aa, Dengue virus
HFHQLIMKDG

SEQ ID NO: 114564 - protein, 10 aa, Dengue virus
FHQLIMKDGR

SEQ ID NO: 114565 - protein, 10 aa, Dengue virus
IVVPCRNQDE

SEQ ID NO: 114566 - protein, 10 aa, Dengue virus
VVPCRNQDEL

SEQ ID NO: 114567 - protein, 10 aa, Dengue virus
VPCRNQDELV

SEQ ID NO: 114568 - protein, 10 aa, Dengue virus
PCRNQDELVG

SEQ ID NO: 114569 - protein, 10 aa, Dengue virus
CRNQDELVGR

SEQ ID NO: 114570 - protein, 10 aa, Dengue virus
RNQDELVGRA

SEQ ID NO: 114571 - protein, 10 aa, Dengue virus
NQDELVGRAR

SEQ ID NO: 114572 - protein, 10 aa, Dengue virus
QDELIGRARI

SEQ ID NO: 114573 - protein, 10 aa, Dengue virus
DELIGRARIS

SEQ ID NO: 114574 - protein, 10 aa, Dengue virus
ELIGRARISQ

SEQ ID NO: 114575 - protein, 10 aa, Dengue virus
LIGRARISQG

SEQ ID NO: 114576 - protein, 10 aa, Dengue virus
IGRARISQGA

SEQ ID NO: 114577 - protein, 10 aa, Dengue virus
GRARISQGAG

SEQ ID NO: 114578 - protein, 10 aa, Dengue virus
RARISQGAGW

SEQ ID NO: 114579 - protein, 10 aa, Dengue virus
ARISQGAGWS

SEQ ID NO: 114580 - protein, 10 aa, Dengue virus
RISQGAGWSL

SEQ ID NO: 114581 - protein, 10 aa, Dengue virus
VSQGAGWSLR

SEQ ID NO: 114582 - protein, 10 aa, Dengue virus
SQGAGWSLRE

SEQ ID NO: 114583 - protein, 10 aa, Dengue virus
QGAGWSLRET

SEQ ID NO: 114584 - protein, 10 aa, Dengue virus
GAGWSLRETA

SEQ ID NO: 114585 - protein, 10 aa, Dengue virus
AGWSLRETAC

SEQ ID NO: 114586 - protein, 10 aa, Dengue virus
GWSLRETACL

SEQ ID NO: 114587 - protein, 10 aa, Dengue virus
WSLRETACLG

SEQ ID NO: 114588 - protein, 10 aa, Dengue virus
SLRETACLGK

SEQ ID NO: 114589 - protein, 10 aa, Dengue virus
LRETACLGKS

SEQ ID NO: 114590 - protein, 10 aa, Dengue virus
RETACLGKSY

SEQ ID NO: 114591 - protein, 10 aa, Dengue virus
ETACLGKSYA

SEQ ID NO: 114592 - protein, 10 aa, Dengue virus
TACLGKSYAQ

SEQ ID NO: 114593 - protein, 10 aa, Dengue virus
ACLGKSYAQM

SEQ ID NO: 114594 - protein, 10 aa, Dengue virus
CLGKSYAQMW

SEQ ID NO: 114595 - protein, 10 aa, Dengue virus
LGKSYAQMWQ

SEQ ID NO: 114596 - protein, 10 aa, Dengue virus
GKSYAQMWQL

SEQ ID NO: 114597 - protein, 10 aa, Dengue virus
KSYAQMWQLM

SEQ ID NO: 114598 - protein, 10 aa, Dengue virus
SYAQMWQLMY

SEQ ID NO: 114599 - protein, 10 aa, Dengue virus
YAQMWQLMYF

SEQ ID NO: 114600 - protein, 10 aa, Dengue virus
AQMWQLMYFH

SEQ ID NO: 114601 - protein, 10 aa, Dengue virus
QMWQLMYFHR

SEQ ID NO: 114602 - protein, 10 aa, Dengue virus
MWQLMYFHRR

SEQ ID NO: 114603 - protein, 10 aa, Dengue virus
WQLMYFHRRD

SEQ ID NO: 114604 - protein, 10 aa, Dengue virus
QLMYFHRRDL

SEQ ID NO: 114605 - protein, 10 aa, Dengue virus
LMYFHRRDLR

SEQ ID NO: 114606 - protein, 10 aa, Dengue virus
MYFHRRDLRL

SEQ ID NO: 114607 - protein, 10 aa, Dengue virus
YFHRRDLRLA

SEQ ID NO: 114608 - protein, 10 aa, Dengue virus
FHRRDLRLAA

SEQ ID NO: 114609 - protein, 10 aa, Dengue virus
HRRDLRLAAN

SEQ ID NO: 114610 - protein, 10 aa, Dengue virus
RRDLRLAANA

SEQ ID NO: 114611 - protein, 10 aa, Dengue virus
RDLRLAANAI

SEQ ID NO: 114612 - protein, 10 aa, Dengue virus
DLRLAANAIC

SEQ ID NO: 114613 - protein, 10 aa, Dengue virus
LRLAANAICS

SEQ ID NO: 114614 - protein, 10 aa, Dengue virus
RLAANAICSA

SEQ ID NO: 114615 - protein, 10 aa, Dengue virus
LAANAICSAV

SEQ ID NO: 114616 - protein, 10 aa, Dengue virus
AANAICSAVP

SEQ ID NO: 114617 - protein, 10 aa, Dengue virus
HWVPTSRTTW

SEQ ID NO: 114618 - protein, 10 aa, Dengue virus
WVPTSRTTWS

SEQ ID NO: 114619 - protein, 10 aa, Dengue virus
VPTSRTTWSI

SEQ ID NO: 114620 - protein, 10 aa, Dengue virus
PTSRTTWSIH

SEQ ID NO: 114621 - protein, 10 aa, Dengue virus
TSRTTWSIHA

SEQ ID NO: 114622 - protein, 10 aa, Dengue virus
SRTTWSIHAH

SEQ ID NO: 114623 - protein, 10 aa, Dengue virus
RTTWSIHAHH

SEQ ID NO: 114624 - protein, 10 aa, Dengue virus
TTWSIHAHHQ

SEQ ID NO: 114625 - protein, 10 aa, Dengue virus
TWSIHAHHQW

SEQ ID NO: 114626 - protein, 10 aa, Dengue virus
WSIHAHHQWM

SEQ ID NO: 114627 - protein, 10 aa, Dengue virus
SIHAHHQWMT

SEQ ID NO: 114628 - protein, 10 aa, Dengue virus
IHAHHQWMTT

SEQ ID NO: 114629 - protein, 10 aa, Dengue virus
HAHHQWMTTE

SEQ ID NO: 114630 - protein, 10 aa, Dengue virus
AHHQWMTTED

SEQ ID NO: 114631 - protein, 10 aa, Dengue virus
HHQWMTTEDM

SEQ ID NO: 114632 - protein, 10 aa, Dengue virus
HQWMTTEDML

SEQ ID NO: 114633 - protein, 10 aa, Dengue virus
QWMTTEDMLS

SEQ ID NO: 114634 - protein, 10 aa, Dengue virus
WMTTEDMLSV

SEQ ID NO: 114635 - protein, 10 aa, Dengue virus
MTTEDMLSVW

SEQ ID NO: 114636 - protein, 10 aa, Dengue virus
TTEDMLSVWN

SEQ ID NO: 114637 - protein, 10 aa, Dengue virus
TEDMLSVWNR

SEQ ID NO: 114638 - protein, 10 aa, Dengue virus
EDMLSVWNRV

SEQ ID NO: 114639 - protein, 10 aa, Dengue virus
DMLSVWNRVW

SEQ ID NO: 114640 - protein, 10 aa, Dengue virus
MLSVWNRVWI

SEQ ID NO: 114641 - protein, 10 aa, Dengue virus
DVPYLGKRED

SEQ ID NO: 114642 - protein, 10 aa, Dengue virus
VPYLGKREDQ

SEQ ID NO: 114643 - protein, 10 aa, Dengue virus
PYLGKREDQW

SEQ ID NO: 114644 - protein, 10 aa, Dengue virus
YLGKREDQWC

SEQ ID NO: 114645 - protein, 10 aa, Dengue virus
LGKREDQWCG

SEQ ID NO: 114646 - protein, 10 aa, Dengue virus
GKREDQWCGS

SEQ ID NO: 114647 - protein, 10 aa, Dengue virus
KREDQWCGSL

SEQ ID NO: 114648 - protein, 10 aa, Dengue virus
REDQWCGSLI

SEQ ID NO: 114649 - protein, 10 aa, Dengue virus
EDQWCGSLIG

SEQ ID NO: 114650 - protein, 10 aa, Dengue virus
DQWCGSLIGL

SEQ ID NO: 114651 - protein, 10 aa, Dengue virus
QWCGSLIGLT

SEQ ID NO: 114652 - protein, 10 aa, Dengue virus
WCGSLIGLTS

SEQ ID NO: 114653 - protein, 10 aa, Dengue virus
CGSLIGLTSR

SEQ ID NO: 114654 - protein, 10 aa, Dengue virus
GSLIGLTSRA

SEQ ID NO: 114655 - protein, 10 aa, Dengue virus
SLIGLTSRAT

SEQ ID NO: 114656 - protein, 10 aa, Dengue virus
LIGLTSRATW

SEQ ID NO: 114657 - protein, 10 aa, Dengue virus
IGLTSRATWA

SEQ ID NO: 114658 - protein, 10 aa, Dengue virus
GLTARATWAT

SEQ ID NO: 114659 - protein, 10 aa, Dengue virus
LTARATWATN

SEQ ID NO: 114660 - protein, 10 aa, Dengue virus
TARATWATNI

SEQ ID NO: 114661 - protein, 10 aa, Dengue virus
DYMPSMKRFR

SEQ ID NO: 114662 - protein, 10 aa, Dengue virus
TPFNMLKRER

SEQ ID NO: 114663 - protein, 10 aa, Dengue virus
PFNMLKRERN

SEQ ID NO: 114664 - protein, 10 aa, Dengue virus
FNMLKRERNR

SEQ ID NO: 114665 - protein, 10 aa, Dengue virus
NMLKRERNRV

SEQ ID NO: 114666 - protein, 10 aa, Dengue virus
MLKRERNRVS

SEQ ID NO: 114667 - protein, 10 aa, Dengue virus
LKRERNRVST

SEQ ID NO: 114668 - protein, 10 aa, Dengue virus
RNRVSTVQQL

SEQ ID NO: 114669 - protein, 10 aa, Dengue virus
NRVSTVQQLT

SEQ ID NO: 114670 - protein, 10 aa, Dengue virus
RVSTVQQLTK

SEQ ID NO: 114671 - protein, 10 aa, Dengue virus
VSTVQQLTKR

SEQ ID NO: 114672 - protein, 10 aa, Dengue virus
STVQQLTKRF

SEQ ID NO: 114673 - protein, 10 aa, Dengue virus
TVQQLTKRFS

SEQ ID NO: 114674 - protein, 10 aa, Dengue virus
QQLTKRFSLG

SEQ ID NO: 114675 - protein, 10 aa, Dengue virus
QLTKRFSLGM

SEQ ID NO: 114676 - protein, 10 aa, Dengue virus
LTKRFSLGML

SEQ ID NO: 114677 - protein, 10 aa, Dengue virus
TKRFSLGMLQ

SEQ ID NO: 114678 - protein, 10 aa, Dengue virus
KRFSLGMLQG

SEQ ID NO: 114679 - protein, 10 aa, Dengue virus
RFSLGMLQGR

SEQ ID NO: 114680 - protein, 10 aa, Dengue virus
FSLGMLQGRG

SEQ ID NO: 114681 - protein, 10 aa, Dengue virus
SLGMLQGRGP

SEQ ID NO: 114682 - protein, 10 aa, Dengue virus
GMLQGRGPLK

SEQ ID NO: 114683 - protein, 10 aa, Dengue virus
GRGPLKLFMA

SEQ ID NO: 114684 - protein, 10 aa, Dengue virus
LFMALVAFLR

SEQ ID NO: 114685 - protein, 10 aa, Dengue virus
FMALVAFLRF

SEQ ID NO: 114686 - protein, 10 aa, Dengue virus
MALVAFLRFL

SEQ ID NO: 114687 - protein, 10 aa, Dengue virus
ALVAFLRFLT

SEQ ID NO: 114688 - protein, 10 aa, Dengue virus
LVAFLRFLTI

SEQ ID NO: 114689 - protein, 10 aa, Dengue virus
VAFLRFLTIP

SEQ ID NO: 114690 - protein, 10 aa, Dengue virus
AFLRFLTIPP

SEQ ID NO: 114691 - protein, 10 aa, Dengue virus
FLRFLTIPPT

SEQ ID NO: 114692 - protein, 10 aa, Dengue virus
LRFLTIPPTA

SEQ ID NO: 114693 - protein, 10 aa, Dengue virus
RFLTIPPTAG

SEQ ID NO: 114694 - protein, 10 aa, Dengue virus
FLTIPPTAGI

SEQ ID NO: 114695 - protein, 10 aa, Dengue virus
LTIPPTAGIL

SEQ ID NO: 114696 - protein, 10 aa, Dengue virus
TIPPTAGILK

SEQ ID NO: 114697 - protein, 10 aa, Dengue virus
IPPTAGILKR

SEQ ID NO: 114698 - protein, 10 aa, Dengue virus
PPTAGILKRW

SEQ ID NO: 114699 - protein, 10 aa, Dengue virus
PTAGILKRWG

SEQ ID NO: 114700 - protein, 10 aa, Dengue virus
GFRKEIGRML

SEQ ID NO: 114701 - protein, 10 aa, Dengue virus
AFHLTTRNGE

SEQ ID NO: 114702 - protein, 10 aa, Dengue virus
FHLTTRNGEP

SEQ ID NO: 114703 - protein, 10 aa, Dengue virus
HLTTRNGEPH

SEQ ID NO: 114704 - protein, 10 aa, Dengue virus
LTTRNGEPHM

SEQ ID NO: 114705 - protein, 10 aa, Dengue virus
TTRNGEPHMI

SEQ ID NO: 114706 - protein, 10 aa, Dengue virus
TRNGEPHMIV

SEQ ID NO: 114707 - protein, 10 aa, Dengue virus
QEKGKSLLFK

SEQ ID NO: 114708 - protein, 10 aa, Dengue virus
EKGKSLLFKT

SEQ ID NO: 114709 - protein, 10 aa, Dengue virus
KGKSLLFKTE

SEQ ID NO: 114710 - protein, 10 aa, Dengue virus
NMCTLMAIDL

SEQ ID NO: 114711 - protein, 10 aa, Dengue virus
MCTLMAIDLG

SEQ ID NO: 114712 - protein, 10 aa, Dengue virus
CTLMAIDLGE

SEQ ID NO: 114713 - protein, 10 aa, Dengue virus
TLIAMDLGEM

SEQ ID NO: 114714 - protein, 10 aa, Dengue virus
LIAMDLGEMC

SEQ ID NO: 114715 - protein, 10 aa, Dengue virus
AMDLGEMCDD

SEQ ID NO: 114716 - protein, 10 aa, Dengue virus
MDLGEMCDDT

SEQ ID NO: 114717 - protein, 10 aa, Dengue virus
EPDDVDCWCN

SEQ ID NO: 114718 - protein, 10 aa, Dengue virus
PEDIDCWCNS

SEQ ID NO: 114719 - protein, 10 aa, Dengue virus
EDIDCWCNST

SEQ ID NO: 114720 - protein, 10 aa, Dengue virus
DIDCWCNSTS

SEQ ID NO: 114721 - protein, 10 aa, Dengue virus
IDCWCNSTST

SEQ ID NO: 114722 - protein, 10 aa, Dengue virus
DCWCNSTSTW

SEQ ID NO: 114723 - protein, 10 aa, Dengue virus
TDTWVTYGTC

SEQ ID NO: 114724 - protein, 10 aa, Dengue virus
GEHRREKRSV

SEQ ID NO: 114725 - protein, 10 aa, Dengue virus
EHRREKRSVA

SEQ ID NO: 114726 - protein, 10 aa, Dengue virus
HRREKRSVAL

SEQ ID NO: 114727 - protein, 10 aa, Dengue virus
RREKRSVALV

SEQ ID NO: 114728 - protein, 10 aa, Dengue virus
REKRSVALVP

SEQ ID NO: 114729 - protein, 10 aa, Dengue virus
EKRSVALVPH

SEQ ID NO: 114730 - protein, 10 aa, Dengue virus
KRSVALVPHV

SEQ ID NO: 114731 - protein, 10 aa, Dengue virus
RSVALVPHVG

SEQ ID NO: 114732 - protein, 10 aa, Dengue virus
SVALVPHVGM

SEQ ID NO: 114733 - protein, 10 aa, Dengue virus
VALVPHVGMG

SEQ ID NO: 114734 - protein, 10 aa, Dengue virus
ALVPHVGMGL

SEQ ID NO: 114735 - protein, 10 aa, Dengue virus
LVPHVGMGLE

SEQ ID NO: 114736 - protein, 10 aa, Dengue virus
VPHVGMGLET

SEQ ID NO: 114737 - protein, 10 aa, Dengue virus
PHVGMGLETR

SEQ ID NO: 114738 - protein, 10 aa, Dengue virus
GLDTRTQTWM

SEQ ID NO: 114739 - protein, 10 aa, Dengue virus
LDTRTQTWMS

SEQ ID NO: 114740 - protein, 10 aa, Dengue virus
DTRTQTWMSA

SEQ ID NO: 114741 - protein, 10 aa, Dengue virus
TRTQTWMSAE

SEQ ID NO: 114742 - protein, 10 aa, Dengue virus
RTQTWMSAEG

SEQ ID NO: 114743 - protein, 10 aa, Dengue virus
TQTWMSAEGA

SEQ ID NO: 114744 - protein, 10 aa, Dengue virus
QTWMSAEGAW

SEQ ID NO: 114745 - protein, 10 aa, Dengue virus
TWMSAEGAWR

SEQ ID NO: 114746 - protein, 10 aa, Dengue virus
WMSSEGAWKH

SEQ ID NO: 114747 - protein, 10 aa, Dengue virus
SAEGAWRQVE

SEQ ID NO: 114748 - protein, 10 aa, Dengue virus
IETWILRHPG

SEQ ID NO: 114749 - protein, 10 aa, Dengue virus
ETWILRHPGF

SEQ ID NO: 114750 - protein, 10 aa, Dengue virus
TWILRHPGFT

SEQ ID NO: 114751 - protein, 10 aa, Dengue virus
APSMTMRCIG

SEQ ID NO: 114752 - protein, 10 aa, Dengue virus
MRCIGISNRD

SEQ ID NO: 114753 - protein, 10 aa, Dengue virus
RCIGISNRDF

SEQ ID NO: 114754 - protein, 10 aa, Dengue virus
CIGISNRDFV

SEQ ID NO: 114755 - protein, 10 aa, Dengue virus
IGISNRDFVE

SEQ ID NO: 114756 - protein, 10 aa, Dengue virus
GISNRDFVEG

SEQ ID NO: 114757 - protein, 10 aa, Dengue virus
GNRDFVEGLS

SEQ ID NO: 114758 - protein, 10 aa, Dengue virus
SRDFVEGLSG

SEQ ID NO: 114759 - protein, 10 aa, Dengue virus
RDFVEGVSGG

SEQ ID NO: 114760 - protein, 10 aa, Dengue virus
DFVEGVSGGS

SEQ ID NO: 114761 - protein, 10 aa, Dengue virus
FVEGVSGGSW

SEQ ID NO: 114762 - protein, 10 aa, Dengue virus
VEGVSGGSWV

SEQ ID NO: 114763 - protein, 10 aa, Dengue virus
EGVSGGSWVD

SEQ ID NO: 114764 - protein, 10 aa, Dengue virus
GVSGGSWVDI

SEQ ID NO: 114765 - protein, 10 aa, Dengue virus
VSGGSWVDIV

SEQ ID NO: 114766 - protein, 10 aa, Dengue virus
SGGSWVDIVL

SEQ ID NO: 114767 - protein, 10 aa, Dengue virus
GGSWVDIVLE

SEQ ID NO: 114768 - protein, 10 aa, Dengue virus
GSWVDIVLEH

SEQ ID NO: 114769 - protein, 10 aa, Dengue virus
SWVDIVLEHG

SEQ ID NO: 114770 - protein, 10 aa, Dengue virus
WVDIVLEHGS

SEQ ID NO: 114771 - protein, 10 aa, Dengue virus
VDIVLEHGSC

SEQ ID NO: 114772 - protein, 10 aa, Dengue virus
DIVLEHGSCV

SEQ ID NO: 114773 - protein, 10 aa, Dengue virus
IVLEHGSCVT

SEQ ID NO: 114774 - protein, 10 aa, Dengue virus
VLEHGGCVTT

SEQ ID NO: 114775 - protein, 10 aa, Dengue virus
LEHGGCVTTM

SEQ ID NO: 114776 - protein, 10 aa, Dengue virus
EHGGCVTTMA

SEQ ID NO: 114777 - protein, 10 aa, Dengue virus
HGGCVTTMAK

SEQ ID NO: 114778 - protein, 10 aa, Dengue virus
GSCVTTMAKD

SEQ ID NO: 114779 - protein, 10 aa, Dengue virus
SCVTTMAKDK

SEQ ID NO: 114780 - protein, 10 aa, Dengue virus
CVTTMAKDKP

SEQ ID NO: 114781 - protein, 10 aa, Dengue virus
VTTMAKDKPT

SEQ ID NO: 114782 - protein, 10 aa, Dengue virus
TTMAKDKPTL

SEQ ID NO: 114783 - protein, 10 aa, Dengue virus
TMAKDKPTLD

SEQ ID NO: 114784 - protein, 10 aa, Dengue virus
MAKNKPTLDF

SEQ ID NO: 114785 - protein, 10 aa, Dengue virus
AKNKPTLDFE

SEQ ID NO: 114786 - protein, 10 aa, Dengue virus
KNKPTLDFEL

SEQ ID NO: 114787 - protein, 10 aa, Dengue virus
KPTLDFELIK

SEQ ID NO: 114788 - protein, 10 aa, Dengue virus
PTLDFELIKT

SEQ ID NO: 114789 - protein, 10 aa, Dengue virus
TLDFELIKTE

SEQ ID NO: 114790 - protein, 10 aa, Dengue virus
LDFELIKTEA

SEQ ID NO: 114791 - protein, 10 aa, Dengue virus
DFELIKTEAK

SEQ ID NO: 114792 - protein, 10 aa, Dengue virus
TTESRCPTQG

SEQ ID NO: 114793 - protein, 10 aa, Dengue virus
TESRCPTQGE

SEQ ID NO: 114794 - protein, 10 aa, Dengue virus
ESRCPTQGEP

SEQ ID NO: 114795 - protein, 10 aa, Dengue virus
CKHSMVDRGW

SEQ ID NO: 114796 - protein, 10 aa, Dengue virus
KHSMVDRGWG

SEQ ID NO: 114797 - protein, 10 aa, Dengue virus
HSMVDRGWGN

SEQ ID NO: 114798 - protein, 10 aa, Dengue virus
SMVDRGWGNG

SEQ ID NO: 114799 - protein, 10 aa, Dengue virus
MVDRGWGNGC

SEQ ID NO: 114800 - protein, 10 aa, Dengue virus
NGCGLFGKGG

SEQ ID NO: 114801 - protein, 10 aa, Dengue virus
GCGLFGKGGI

SEQ ID NO: 114802 - protein, 10 aa, Dengue virus
CGLFGKGGIV

SEQ ID NO: 114803 - protein, 10 aa, Dengue virus
GLFGKGGIVT

SEQ ID NO: 114804 - protein, 10 aa, Dengue virus
LFGKGGIVTC

SEQ ID NO: 114805 - protein, 10 aa, Dengue virus
FGKGGIVTCA

SEQ ID NO: 114806 - protein, 10 aa, Dengue virus
GKGGIVTCAM

SEQ ID NO: 114807 - protein, 10 aa, Dengue virus
KGGIVTCAMF

SEQ ID NO: 114808 - protein, 10 aa, Dengue virus
TPHSGEEHAV

SEQ ID NO: 114809 - protein, 10 aa, Dengue virus
PHSGEEHAVG

SEQ ID NO: 114810 - protein, 10 aa, Dengue virus
HSGEEHAVGN

SEQ ID NO: 114811 - protein, 10 aa, Dengue virus
SGEEHAVGND

SEQ ID NO: 114812 - protein, 10 aa, Dengue virus
VTMECSPRTG

SEQ ID NO: 114813 - protein, 10 aa, Dengue virus
TMECSPRTGL

SEQ ID NO: 114814 - protein, 10 aa, Dengue virus
MECSPRTGLD

SEQ ID NO: 114815 - protein, 10 aa, Dengue virus
DCSPRTGLDF

SEQ ID NO: 114816 - protein, 10 aa, Dengue virus
CEPRSGIDFN

SEQ ID NO: 114817 - protein, 10 aa, Dengue virus
EPRSGIDFNE

SEQ ID NO: 114818 - protein, 10 aa, Dengue virus
PRSGIDFNEM

SEQ ID NO: 114819 - protein, 10 aa, Dengue virus
RTGLDFNEMI

SEQ ID NO: 114820 - protein, 10 aa, Dengue virus
TGLDFNEMIL

SEQ ID NO: 114821 - protein, 10 aa, Dengue virus
GLDFNEMILL

SEQ ID NO: 114822 - protein, 10 aa, Dengue virus
LDFNEMVLLQ

SEQ ID NO: 114823 - protein, 10 aa, Dengue virus
DFNEMVLLQM

SEQ ID NO: 114824 - protein, 10 aa, Dengue virus
KAWLVHRQWF

SEQ ID NO: 114825 - protein, 10 aa, Dengue virus
AWLVHRQWFL

SEQ ID NO: 114826 - protein, 10 aa, Dengue virus
WLVHRQWFLD

SEQ ID NO: 114827 - protein, 10 aa, Dengue virus
LVHRQWFLDL

SEQ ID NO: 114828 - protein, 10 aa, Dengue virus
VHRQWFLDLP

SEQ ID NO: 114829 - protein, 10 aa, Dengue virus
HRQWFLDLPL

SEQ ID NO: 114830 - protein, 10 aa, Dengue virus
RQWFLDLPLP

SEQ ID NO: 114831 - protein, 10 aa, Dengue virus
QWFFDLPLPW

SEQ ID NO: 114832 - protein, 10 aa, Dengue virus
WFLDLPLPWL

SEQ ID NO: 114833 - protein, 10 aa, Dengue virus
DLPLPWLPGA

SEQ ID NO: 114834 - protein, 10 aa, Dengue virus
KETLVTFKNP

SEQ ID NO: 114835 - protein, 10 aa, Dengue virus
ETLVTFKNPH

SEQ ID NO: 114836 - protein, 10 aa, Dengue virus
TLVTFKNPHA

SEQ ID NO: 114837 - protein, 10 aa, Dengue virus
LVTFKNPHAK

SEQ ID NO: 114838 - protein, 10 aa, Dengue virus
VTFKNPHAKK

SEQ ID NO: 114839 - protein, 10 aa, Dengue virus
TFKNPHAKKQ

SEQ ID NO: 114840 - protein, 10 aa, Dengue virus
FKNPHAKKQD

SEQ ID NO: 114841 - protein, 10 aa, Dengue virus
KNPHAKKQDV

SEQ ID NO: 114842 - protein, 10 aa, Dengue virus
NPHAKKQDVV

SEQ ID NO: 114843 - protein, 10 aa, Dengue virus
PHAKKQDVVV

SEQ ID NO: 114844 - protein, 10 aa, Dengue virus
HAKKQDVVVL

SEQ ID NO: 114845 - protein, 10 aa, Dengue virus
AKKQDVVVLG

SEQ ID NO: 114846 - protein, 10 aa, Dengue virus
KKQDVVVLGS

SEQ ID NO: 114847 - protein, 10 aa, Dengue virus
KQDVVVLGSQ

SEQ ID NO: 114848 - protein, 10 aa, Dengue virus
QDVVVLGSQE

SEQ ID NO: 114849 - protein, 10 aa, Dengue virus
DVVVLGSQEG

SEQ ID NO: 114850 - protein, 10 aa, Dengue virus
VTVLGSQEGA

SEQ ID NO: 114851 - protein, 10 aa, Dengue virus
TVLGSQEGAM

SEQ ID NO: 114852 - protein, 10 aa, Dengue virus
LGSQEGAMHS

SEQ ID NO: 114853 - protein, 10 aa, Dengue virus
GSQEGAMHSA

SEQ ID NO: 114854 - protein, 10 aa, Dengue virus
SQEGAMHSAL

SEQ ID NO: 114855 - protein, 10 aa, Dengue virus
QEGAMHSALA

SEQ ID NO: 114856 - protein, 10 aa, Dengue virus
EGAMHSALAG

SEQ ID NO: 114857 - protein, 10 aa, Dengue virus
GAMHSALAGA

SEQ ID NO: 114858 - protein, 10 aa, Dengue virus
AMHSALAGAT

SEQ ID NO: 114859 - protein, 10 aa, Dengue virus
MHSALAGATE

SEQ ID NO: 114860 - protein, 10 aa, Dengue virus
HSALAGATEV

SEQ ID NO: 114861 - protein, 10 aa, Dengue virus
SALAGATEVD

SEQ ID NO: 114862 - protein, 10 aa, Dengue virus
ALTGATEIQM

SEQ ID NO: 114863 - protein, 10 aa, Dengue virus
LTGATEIQMS

SEQ ID NO: 114864 - protein, 10 aa, Dengue virus
SGNLLFTGHL

SEQ ID NO: 114865 - protein, 10 aa, Dengue virus
GNLLFTGHLK

SEQ ID NO: 114866 - protein, 10 aa, Dengue virus
NLLFTGHLKC

SEQ ID NO: 114867 - protein, 10 aa, Dengue virus
LLFTGHLKCR

SEQ ID NO: 114868 - protein, 10 aa, Dengue virus
LFTGHLKCRL

SEQ ID NO: 114869 - protein, 10 aa, Dengue virus
FTGHLKCRLR

SEQ ID NO: 114870 - protein, 10 aa, Dengue virus
TGHLKCRLRM

SEQ ID NO: 114871 - protein, 10 aa, Dengue virus
GHLKCRLRMD

SEQ ID NO: 114872 - protein, 10 aa, Dengue virus
HLKCRLRMDK

SEQ ID NO: 114873 - protein, 10 aa, Dengue virus
LKCRLRMDKL

SEQ ID NO: 114874 - protein, 10 aa, Dengue virus
KCRLRMDKLQ

SEQ ID NO: 114875 - protein, 10 aa, Dengue virus
CRLRMDKLQL

SEQ ID NO: 114876 - protein, 10 aa, Dengue virus
RLRMDKLQLK

SEQ ID NO: 114877 - protein, 10 aa, Dengue virus
LRMDKLQLKG

SEQ ID NO: 114878 - protein, 10 aa, Dengue virus
VKEIAETQHG

SEQ ID NO: 114879 - protein, 10 aa, Dengue virus
KEIAETQHGT

SEQ ID NO: 114880 - protein, 10 aa, Dengue virus
EIAETQHGTI

SEQ ID NO: 114881 - protein, 10 aa, Dengue virus
IAETQHGTIV

SEQ ID NO: 114882 - protein, 10 aa, Dengue virus
AETQHGTIVI

SEQ ID NO: 114883 - protein, 10 aa, Dengue virus
ETQHGTIVIR

SEQ ID NO: 114884 - protein, 10 aa, Dengue virus
PVNIETEPPF

SEQ ID NO: 114885 - protein, 10 aa, Dengue virus
VNIETEPPFG

SEQ ID NO: 114886 - protein, 10 aa, Dengue virus
NIEAEPPFGD

SEQ ID NO: 114887 - protein, 10 aa, Dengue virus
IEAEPPFGDS

SEQ ID NO: 114888 - protein, 10 aa, Dengue virus
EAEPPFGDSY

SEQ ID NO: 114889 - protein, 10 aa, Dengue virus
AEPPFGDSYI

SEQ ID NO: 114890 - protein, 10 aa, Dengue virus
KKGSSIGQMF

SEQ ID NO: 114891 - protein, 10 aa, Dengue virus
KGSSIGQMFE

SEQ ID NO: 114892 - protein, 10 aa, Dengue virus
GSSIGQMFET

SEQ ID NO: 114893 - protein, 10 aa, Dengue virus
SSIGQMFETT

SEQ ID NO: 114894 - protein, 10 aa, Dengue virus
IGQMFETTMR

SEQ ID NO: 114895 - protein, 10 aa, Dengue virus
GQMFETTMRG

SEQ ID NO: 114896 - protein, 10 aa, Dengue virus
QMFETTMRGA

SEQ ID NO: 114897 - protein, 10 aa, Dengue virus
MFETTMRGAK

SEQ ID NO: 114898 - protein, 10 aa, Dengue virus
FETTMRGAKR

SEQ ID NO: 114899 - protein, 10 aa, Dengue virus
ETTMRGAKRM

SEQ ID NO: 114900 - protein, 10 aa, Dengue virus
TTMRGAKRMA

SEQ ID NO: 114901 - protein, 10 aa, Dengue virus
TMRGAKRMAI

SEQ ID NO: 114902 - protein, 10 aa, Dengue virus
MRGAKRMAIL

SEQ ID NO: 114903 - protein, 10 aa, Dengue virus
RGAKRMAILG

SEQ ID NO: 114904 - protein, 10 aa, Dengue virus
GAKRMAILGD

SEQ ID NO: 114905 - protein, 10 aa, Dengue virus
AKRMAILGDT

SEQ ID NO: 114906 - protein, 10 aa, Dengue virus
KRMAILGDTA

SEQ ID NO: 114907 - protein, 10 aa, Dengue virus
RMAILGETAW

SEQ ID NO: 114908 - protein, 10 aa, Dengue virus
MAILGETAWD

SEQ ID NO: 114909 - protein, 10 aa, Dengue virus
AILGETAWDF

SEQ ID NO: 114910 - protein, 10 aa, Dengue virus
ILGETAWDFG

SEQ ID NO: 114911 - protein, 10 aa, Dengue virus
LGETAWDFGS

SEQ ID NO: 114912 - protein, 10 aa, Dengue virus
GDTAWDFGSL

SEQ ID NO: 114913 - protein, 10 aa, Dengue virus
DTAWDFGSLG

SEQ ID NO: 114914 - protein, 10 aa, Dengue virus
TAWDFGSLGG

SEQ ID NO: 114915 - protein, 10 aa, Dengue virus
AWDFGSLGGV

SEQ ID NO: 114916 - protein, 10 aa, Dengue virus
IYGAAFSGVS

SEQ ID NO: 114917 - protein, 10 aa, Dengue virus
YGAAFSGVSW

SEQ ID NO: 114918 - protein, 10 aa, Dengue virus
FSGVSWVMKI

SEQ ID NO: 114919 - protein, 10 aa, Dengue virus
IITWIGMNSR

SEQ ID NO: 114920 - protein, 10 aa, Dengue virus
ITWIGMNSRS

SEQ ID NO: 114921 - protein, 10 aa, Dengue virus
TWIGMNSRST

SEQ ID NO: 114922 - protein, 10 aa, Dengue virus
LYLGAVVQAD

SEQ ID NO: 114923 - protein, 10 aa, Dengue virus
NKELKCGSGI

SEQ ID NO: 114924 - protein, 10 aa, Dengue virus
RELKCGSGIF

SEQ ID NO: 114925 - protein, 10 aa, Dengue virus
ELKCGSGIFI

SEQ ID NO: 114926 - protein, 10 aa, Dengue virus
LKCGSGIFIT

SEQ ID NO: 114927 - protein, 10 aa, Dengue virus
KCGSGIFITD

SEQ ID NO: 114928 - protein, 10 aa, Dengue virus
CGSGIFITDN

SEQ ID NO: 114929 - protein, 10 aa, Dengue virus
GSGIFITDNV

SEQ ID NO: 114930 - protein, 10 aa, Dengue virus
SGIFITDNVH

SEQ ID NO: 114931 - protein, 10 aa, Dengue virus
GIFITDNVHT

SEQ ID NO: 114932 - protein, 10 aa, Dengue virus
IFITDNVHTW

SEQ ID NO: 114933 - protein, 10 aa, Dengue virus
FITDNVHTWT

SEQ ID NO: 114934 - protein, 10 aa, Dengue virus
ITDNVHTWTE

SEQ ID NO: 114935 - protein, 10 aa, Dengue virus
TDNVHTWTEQ

SEQ ID NO: 114936 - protein, 10 aa, Dengue virus
DNVHTWTEQY

SEQ ID NO: 114937 - protein, 10 aa, Dengue virus
NVHTWTEQYK

SEQ ID NO: 114938 - protein, 10 aa, Dengue virus
TWTEQYKFQP

SEQ ID NO: 114939 - protein, 10 aa, Dengue virus
WTEQYKFQPE

SEQ ID NO: 114940 - protein, 10 aa, Dengue virus
TEQYKFQPES

SEQ ID NO: 114941 - protein, 10 aa, Dengue virus
EQYKFQPESP

SEQ ID NO: 114942 - protein, 10 aa, Dengue virus
QYKFQPESPS

SEQ ID NO: 114943 - protein, 10 aa, Dengue virus
YKFQPESPSK

SEQ ID NO: 114944 - protein, 10 aa, Dengue virus
KFQPESPSKL

SEQ ID NO: 114945 - protein, 10 aa, Dengue virus
FQPESPSKLA

SEQ ID NO: 114946 - protein, 10 aa, Dengue virus
QPESPSKLAS

SEQ ID NO: 114947 - protein, 10 aa, Dengue virus
PESPSKLASA

SEQ ID NO: 114948 - protein, 10 aa, Dengue virus
ESPSKLASAI

SEQ ID NO: 114949 - protein, 10 aa, Dengue virus
SPSKLASAIQ

SEQ ID NO: 114950 - protein, 10 aa, Dengue virus
PSKLASAIQK

SEQ ID NO: 114951 - protein, 10 aa, Dengue virus
SKLASAIQKA

SEQ ID NO: 114952 - protein, 10 aa, Dengue virus
GICGIRSVTR

SEQ ID NO: 114953 - protein, 10 aa, Dengue virus
ICGIRSVTRL

SEQ ID NO: 114954 - protein, 10 aa, Dengue virus
CGIRSVTRLE

SEQ ID NO: 114955 - protein, 10 aa, Dengue virus
GIRSVTRLEN

SEQ ID NO: 114956 - protein, 10 aa, Dengue virus
IRSVTRLENL

SEQ ID NO: 114957 - protein, 10 aa, Dengue virus
RSVTRLENLM

SEQ ID NO: 114958 - protein, 10 aa, Dengue virus
SVTRLENLMW

SEQ ID NO: 114959 - protein, 10 aa, Dengue virus
TRLENLMWKQ

SEQ ID NO: 114960 - protein, 10 aa, Dengue virus
RLENLMWKQI

SEQ ID NO: 114961 - protein, 10 aa, Dengue virus
YSWKSWGKAK

SEQ ID NO: 114962 - protein, 10 aa, Dengue virus
RAWNSLEVED

SEQ ID NO: 114963 - protein, 10 aa, Dengue virus
AWNSLEVEDY

SEQ ID NO: 114964 - protein, 10 aa, Dengue virus
WNSLEVEDYG

SEQ ID NO: 114965 - protein, 10 aa, Dengue virus
NSLEVEDYGF

SEQ ID NO: 114966 - protein, 10 aa, Dengue virus
SLEVEDYGFG

SEQ ID NO: 114967 - protein, 10 aa, Dengue virus
LEVEDYGFGV

SEQ ID NO: 114968 - protein, 10 aa, Dengue virus
EVEDYGFGIF

SEQ ID NO: 114969 - protein, 10 aa, Dengue virus
VEDYGFGIFT

SEQ ID NO: 114970 - protein, 10 aa, Dengue virus
EDYGFGIFTT

SEQ ID NO: 114971 - protein, 10 aa, Dengue virus
DYGFGIFTTN

SEQ ID NO: 114972 - protein, 10 aa, Dengue virus
YGFGIFTTNI

SEQ ID NO: 114973 - protein, 10 aa, Dengue virus
GFGIFTTNIW

SEQ ID NO: 114974 - protein, 10 aa, Dengue virus
FGIFTTNIWL

SEQ ID NO: 114975 - protein, 10 aa, Dengue virus
GIFTTNIWLK

SEQ ID NO: 114976 - protein, 10 aa, Dengue virus
CDSKLMSAAI

SEQ ID NO: 114977 - protein, 10 aa, Dengue virus
DSKLMSAAIK

SEQ ID NO: 114978 - protein, 10 aa, Dengue virus
SKLMSAAIKD

SEQ ID NO: 114979 - protein, 10 aa, Dengue virus
KDNRAVHADM

SEQ ID NO: 114980 - protein, 10 aa, Dengue virus
DNRAVHADMG

SEQ ID NO: 114981 - protein, 10 aa, Dengue virus
NRAVHADMGY

SEQ ID NO: 114982 - protein, 10 aa, Dengue virus
KAVHADMGYW

SEQ ID NO: 114983 - protein, 10 aa, Dengue virus
ADMGYWIESA

SEQ ID NO: 114984 - protein, 10 aa, Dengue virus
DMGYWIESAL

SEQ ID NO: 114985 - protein, 10 aa, Dengue virus
MGYWIESALN

SEQ ID NO: 114986 - protein, 10 aa, Dengue virus
WPKTHTLWSN

SEQ ID NO: 114987 - protein, 10 aa, Dengue virus
PKTHTLWSNG

SEQ ID NO: 114988 - protein, 10 aa, Dengue virus
KTHTLWSNGV

SEQ ID NO: 114989 - protein, 10 aa, Dengue virus
THTLWSNGVL

SEQ ID NO: 114990 - protein, 10 aa, Dengue virus
LWSNGVLESD

SEQ ID NO: 114991 - protein, 10 aa, Dengue virus
WSNGVLESDM

SEQ ID NO: 114992 - protein, 10 aa, Dengue virus
SNGVLESDMI

SEQ ID NO: 114993 - protein, 10 aa, Dengue virus
NGVLESDMII

SEQ ID NO: 114994 - protein, 10 aa, Dengue virus
GVLESDMIIP

SEQ ID NO: 114995 - protein, 10 aa, Dengue virus
VLESDMIIPK

SEQ ID NO: 114996 - protein, 10 aa, Dengue virus
TQIAGPWHLG

SEQ ID NO: 114997 - protein, 10 aa, Dengue virus
QIAGPWHLGK

SEQ ID NO: 114998 - protein, 10 aa, Dengue virus
IAGPWHLGKL

SEQ ID NO: 114999 - protein, 10 aa, Dengue virus
VGPWHLGKLE

SEQ ID NO: 115000 - protein, 10 aa, Dengue virus
GPWHLGKLEM

SEQ ID NO: 115001 - protein, 10 aa, Dengue virus
PWHLGKLEMD

SEQ ID NO: 115002 - protein, 10 aa, Dengue virus
WHLGKLEMDF

SEQ ID NO: 115003 - protein, 10 aa, Dengue virus
CGTRGPSLRT

SEQ ID NO: 115004 - protein, 10 aa, Dengue virus
GTRGPSLRTT

SEQ ID NO: 115005 - protein, 10 aa, Dengue virus
TRGPSLRTTT

SEQ ID NO: 115006 - protein, 10 aa, Dengue virus
RGPSLRTTTA

SEQ ID NO: 115007 - protein, 10 aa, Dengue virus
GPSLRTTTAS

SEQ ID NO: 115008 - protein, 10 aa, Dengue virus
PSLRTTTASG

SEQ ID NO: 115009 - protein, 10 aa, Dengue virus
SLRTTTASGK

SEQ ID NO: 115010 - protein, 10 aa, Dengue virus
LRTTTASGKL

SEQ ID NO: 115011 - protein, 10 aa, Dengue virus
RTTTASGKLI

SEQ ID NO: 115012 - protein, 10 aa, Dengue virus
TTTASGKLIT

SEQ ID NO: 115013 - protein, 10 aa, Dengue virus
TTASGKLITE

SEQ ID NO: 115014 - protein, 10 aa, Dengue virus
TASGKLITEW

SEQ ID NO: 115015 - protein, 10 aa, Dengue virus
ASGKLITEWC

SEQ ID NO: 115016 - protein, 10 aa, Dengue virus
SGKLITEWCC

SEQ ID NO: 115017 - protein, 10 aa, Dengue virus
GKLITEWCCR

SEQ ID NO: 115018 - protein, 10 aa, Dengue virus
KLITEWCCRS

SEQ ID NO: 115019 - protein, 10 aa, Dengue virus
LITEWCCRSC

SEQ ID NO: 115020 - protein, 10 aa, Dengue virus
ITEWCCRSCT

SEQ ID NO: 115021 - protein, 10 aa, Dengue virus
TEWCCRSCTL

SEQ ID NO: 115022 - protein, 10 aa, Dengue virus
QWCCRSCTMP

SEQ ID NO: 115023 - protein, 10 aa, Dengue virus
WCCRSCTMPP

SEQ ID NO: 115024 - protein, 10 aa, Dengue virus
CCRSCTMPPL

SEQ ID NO: 115025 - protein, 10 aa, Dengue virus
CRSCTMPPLR

SEQ ID NO: 115026 - protein, 10 aa, Dengue virus
RSCTLPPLRF

SEQ ID NO: 115027 - protein, 10 aa, Dengue virus
SCTLPPLRFR

SEQ ID NO: 115028 - protein, 10 aa, Dengue virus
CTLPPLRFRG

SEQ ID NO: 115029 - protein, 10 aa, Dengue virus
TLPPLRFRGE

SEQ ID NO: 115030 - protein, 10 aa, Dengue virus
LPPLRFRGED

SEQ ID NO: 115031 - protein, 10 aa, Dengue virus
PPLRFRGEDG

SEQ ID NO: 115032 - protein, 10 aa, Dengue virus
PLRFRGEDGC

SEQ ID NO: 115033 - protein, 10 aa, Dengue virus
LRFRGEDGCW

SEQ ID NO: 115034 - protein, 10 aa, Dengue virus
RFRGEDGCWY

SEQ ID NO: 115035 - protein, 10 aa, Dengue virus
FRGEDGCWYG

SEQ ID NO: 115036 - protein, 10 aa, Dengue virus
MGEDGCWYGM

SEQ ID NO: 115037 - protein, 10 aa, Dengue virus
CWYGMEIRPL

SEQ ID NO: 115038 - protein, 10 aa, Dengue virus
IGMGVTYLAL

SEQ ID NO: 115039 - protein, 10 aa, Dengue virus
RKLTSKELMM

SEQ ID NO: 115040 - protein, 10 aa, Dengue virus
LTSRENLLLG

SEQ ID NO: 115041 - protein, 10 aa, Dengue virus
ELTDALALGM

SEQ ID NO: 115042 - protein, 10 aa, Dengue virus
LTDALALGMM

SEQ ID NO: 115043 - protein, 10 aa, Dengue virus
RSWPLNEAIM

SEQ ID NO: 115044 - protein, 10 aa, Dengue virus
SWPLNEAIMA

SEQ ID NO: 115045 - protein, 10 aa, Dengue virus
WPLNEAIMAV

SEQ ID NO: 115046 - protein, 10 aa, Dengue virus
PLNEAIMAVG

SEQ ID NO: 115047 - protein, 10 aa, Dengue virus
VSILASSLLK

SEQ ID NO: 115048 - protein, 10 aa, Dengue virus
SILASSLLKN

SEQ ID NO: 115049 - protein, 10 aa, Dengue virus
ILASSLLKND

SEQ ID NO: 115050 - protein, 10 aa, Dengue virus
LASSLLKNDI

SEQ ID NO: 115051 - protein, 10 aa, Dengue virus
ASSLLKNDIP

SEQ ID NO: 115052 - protein, 10 aa, Dengue virus
SSLLKNDIPM

SEQ ID NO: 115053 - protein, 10 aa, Dengue virus
SLLKNDIPMT

SEQ ID NO: 115054 - protein, 10 aa, Dengue virus
LLKNDIPMTG

SEQ ID NO: 115055 - protein, 10 aa, Dengue virus
LKNDIPMTGP

SEQ ID NO: 115056 - protein, 10 aa, Dengue virus
KNDIPMTGPL

SEQ ID NO: 115057 - protein, 10 aa, Dengue virus
NDIPMTGPLV

SEQ ID NO: 115058 - protein, 10 aa, Dengue virus
DIPMTGPLVA

SEQ ID NO: 115059 - protein, 10 aa, Dengue virus
IPMTGPLVAG

SEQ ID NO: 115060 - protein, 10 aa, Dengue virus
PMTGPLVAGG

SEQ ID NO: 115061 - protein, 10 aa, Dengue virus
MTGPLVAGGL

SEQ ID NO: 115062 - protein, 10 aa, Dengue virus
TGPLVAGGLL

SEQ ID NO: 115063 - protein, 10 aa, Dengue virus
GPLVAGGLLT

SEQ ID NO: 115064 - protein, 10 aa, Dengue virus
PLVAGGLLTV

SEQ ID NO: 115065 - protein, 10 aa, Dengue virus
LVAGGLLTVC

SEQ ID NO: 115066 - protein, 10 aa, Dengue virus
VAGGLLTVCY

SEQ ID NO: 115067 - protein, 10 aa, Dengue virus
AGGLLTVCYV

SEQ ID NO: 115068 - protein, 10 aa, Dengue virus
GGLLTVCYVL

SEQ ID NO: 115069 - protein, 10 aa, Dengue virus
GLLTVCYVLT

SEQ ID NO: 115070 - protein, 10 aa, Dengue virus
LLTVCYVLTG

SEQ ID NO: 115071 - protein, 10 aa, Dengue virus
LTVCYVLTGR

SEQ ID NO: 115072 - protein, 10 aa, Dengue virus
TVCYVLTGRS

SEQ ID NO: 115073 - protein, 10 aa, Dengue virus
VCYVLTGRSA

SEQ ID NO: 115074 - protein, 10 aa, Dengue virus
CYVLTGRSAD

SEQ ID NO: 115075 - protein, 10 aa, Dengue virus
YVLTGRSADL

SEQ ID NO: 115076 - protein, 10 aa, Dengue virus
VLTGRSADLE

SEQ ID NO: 115077 - protein, 10 aa, Dengue virus
LTGRSADLEL

SEQ ID NO: 115078 - protein, 10 aa, Dengue virus
TGRSADLELE

SEQ ID NO: 115079 - protein, 10 aa, Dengue virus
GRSADLELER

SEQ ID NO: 115080 - protein, 10 aa, Dengue virus
QAEISGSSPI

SEQ ID NO: 115081 - protein, 10 aa, Dengue virus
AEISGSSPIL

SEQ ID NO: 115082 - protein, 10 aa, Dengue virus
EISGSSPILS

SEQ ID NO: 115083 - protein, 10 aa, Dengue virus
SEDGSMSIKN

SEQ ID NO: 115084 - protein, 10 aa, Dengue virus
EDGSMSIKNE

SEQ ID NO: 115085 - protein, 10 aa, Dengue virus
DGSMSIKNEE

SEQ ID NO: 115086 - protein, 10 aa, Dengue virus
GSMSIKNEEE

SEQ ID NO: 115087 - protein, 10 aa, Dengue virus
SMSIKNEEEE

SEQ ID NO: 115088 - protein, 10 aa, Dengue virus
LTILIRTGLL

SEQ ID NO: 115089 - protein, 10 aa, Dengue virus
TILIRTGLLV

SEQ ID NO: 115090 - protein, 10 aa, Dengue virus
ILIRTGLLVI

SEQ ID NO: 115091 - protein, 10 aa, Dengue virus
LIRTGLLVIS

SEQ ID NO: 115092 - protein, 10 aa, Dengue virus
IRTGLLVISG

SEQ ID NO: 115093 - protein, 10 aa, Dengue virus
KKQRAGVLWD

SEQ ID NO: 115094 - protein, 10 aa, Dengue virus
KQRAGVLWDV

SEQ ID NO: 115095 - protein, 10 aa, Dengue virus
QRAGVLWDVP

SEQ ID NO: 115096 - protein, 10 aa, Dengue virus
RAGVLWDVPS

SEQ ID NO: 115097 - protein, 10 aa, Dengue virus
AGVLWDVPSP

SEQ ID NO: 115098 - protein, 10 aa, Dengue virus
GVLWDTPSPP

SEQ ID NO: 115099 - protein, 10 aa, Dengue virus
VLWDVPSPPP

SEQ ID NO: 115100 - protein, 10 aa, Dengue virus
AELEDGAYRI

SEQ ID NO: 115101 - protein, 10 aa, Dengue virus
LEDGAYRIKQ

SEQ ID NO: 115102 - protein, 10 aa, Dengue virus
GYSQIGAGVY

SEQ ID NO: 115103 - protein, 10 aa, Dengue virus
YSQIGAGVYK

SEQ ID NO: 115104 - protein, 10 aa, Dengue virus
SQIGAGVYKE

SEQ ID NO: 115105 - protein, 10 aa, Dengue virus
EGTFHTMWHV

SEQ ID NO: 115106 - protein, 10 aa, Dengue virus
NVFHTMWHVT

SEQ ID NO: 115107 - protein, 10 aa, Dengue virus
TFHTMWHVTR

SEQ ID NO: 115108 - protein, 10 aa, Dengue virus
HTMWHVTRGS

SEQ ID NO: 115109 - protein, 10 aa, Dengue virus
TMWHVTRGSV

SEQ ID NO: 115110 - protein, 10 aa, Dengue virus
MWHVTRGSVI

SEQ ID NO: 115111 - protein, 10 aa, Dengue virus
WHVTRGAVLT

SEQ ID NO: 115112 - protein, 10 aa, Dengue virus
HVTRGAVLMH

SEQ ID NO: 115113 - protein, 10 aa, Dengue virus
NGKRLEPNWA

SEQ ID NO: 115114 - protein, 10 aa, Dengue virus
GKRIEPSWAD

SEQ ID NO: 115115 - protein, 10 aa, Dengue virus
KRIEPSWADV

SEQ ID NO: 115116 - protein, 10 aa, Dengue virus
RIEPSWADVK

SEQ ID NO: 115117 - protein, 10 aa, Dengue virus
IEPSWADVKK

SEQ ID NO: 115118 - protein, 10 aa, Dengue virus
EPSWADVKKD

SEQ ID NO: 115119 - protein, 10 aa, Dengue virus
PSWADVKKDL

SEQ ID NO: 115120 - protein, 10 aa, Dengue virus
WADVKKDLIS

SEQ ID NO: 115121 - protein, 10 aa, Dengue virus
ADVKKDLISY

SEQ ID NO: 115122 - protein, 10 aa, Dengue virus
DVKKDLISYG

SEQ ID NO: 115123 - protein, 10 aa, Dengue virus
VRNDMISYGG

SEQ ID NO: 115124 - protein, 10 aa, Dengue virus
RNDMISYGGG

SEQ ID NO: 115125 - protein, 10 aa, Dengue virus
NDMISYGGGW

SEQ ID NO: 115126 - protein, 10 aa, Dengue virus
DLISYGGGWK

SEQ ID NO: 115127 - protein, 10 aa, Dengue virus
LISYGGGWKL

SEQ ID NO: 115128 - protein, 10 aa, Dengue virus
WKEGEEVQVL

SEQ ID NO: 115129 - protein, 10 aa, Dengue virus
KEGEEVQVLA

SEQ ID NO: 115130 - protein, 10 aa, Dengue virus
EGEEVQVLAL

SEQ ID NO: 115131 - protein, 10 aa, Dengue virus
GEEVQVLALE

SEQ ID NO: 115132 - protein, 10 aa, Dengue virus
EEVQVLALEP

SEQ ID NO: 115133 - protein, 10 aa, Dengue virus
EVQVLALEPG

SEQ ID NO: 115134 - protein, 10 aa, Dengue virus
VQVLALEPGK

SEQ ID NO: 115135 - protein, 10 aa, Dengue virus
QVLALEPGKN

SEQ ID NO: 115136 - protein, 10 aa, Dengue virus
VLALEPGKNP

SEQ ID NO: 115137 - protein, 10 aa, Dengue virus
LALEPGKNPR

SEQ ID NO: 115138 - protein, 10 aa, Dengue virus
ALEPGKNPRA

SEQ ID NO: 115139 - protein, 10 aa, Dengue virus
LEPGKNPRAV

SEQ ID NO: 115140 - protein, 10 aa, Dengue virus
EPGKNPRAVQ

SEQ ID NO: 115141 - protein, 10 aa, Dengue virus
PGKNPRAVQT

SEQ ID NO: 115142 - protein, 10 aa, Dengue virus
TGTIGAVSLD

SEQ ID NO: 115143 - protein, 10 aa, Dengue virus
GTIGAVSLDF

SEQ ID NO: 115144 - protein, 10 aa, Dengue virus
TIGAVSLDFS

SEQ ID NO: 115145 - protein, 10 aa, Dengue virus
IGAVSLDFSP

SEQ ID NO: 115146 - protein, 10 aa, Dengue virus
GAVSLDFSPG

SEQ ID NO: 115147 - protein, 10 aa, Dengue virus
AVSLDFSPGT

SEQ ID NO: 115148 - protein, 10 aa, Dengue virus
VSLDFSPGTS

SEQ ID NO: 115149 - protein, 10 aa, Dengue virus
SLDFSPGTSG

SEQ ID NO: 115150 - protein, 10 aa, Dengue virus
LDFSPGTSGS

SEQ ID NO: 115151 - protein, 10 aa, Dengue virus
DFSPGTSGSP

SEQ ID NO: 115152 - protein, 10 aa, Dengue virus
FSPGTSGSPI

SEQ ID NO: 115153 - protein, 10 aa, Dengue virus
KPGTSGSPII

SEQ ID NO: 115154 - protein, 10 aa, Dengue virus
PGTSGSPIIN

SEQ ID NO: 115155 - protein, 10 aa, Dengue virus
GTSGSPIINR

SEQ ID NO: 115156 - protein, 10 aa, Dengue virus
KGKVVGLYGN

SEQ ID NO: 115157 - protein, 10 aa, Dengue virus
GKIVGLYGNG

SEQ ID NO: 115158 - protein, 10 aa, Dengue virus
KIVGLYGNGV

SEQ ID NO: 115159 - protein, 10 aa, Dengue virus
IVGLYGNGVV

SEQ ID NO: 115160 - protein, 10 aa, Dengue virus
IGLYGNGVVT

SEQ ID NO: 115161 - protein, 10 aa, Dengue virus
GLYGNGVVTR

SEQ ID NO: 115162 - protein, 10 aa, Dengue virus
LYGNGVVTRS

SEQ ID NO: 115163 - protein, 10 aa, Dengue virus
YGNGVVTRSG

SEQ ID NO: 115164 - protein, 10 aa, Dengue virus
GNGVVTRSGA

SEQ ID NO: 115165 - protein, 10 aa, Dengue virus
NGVVTRSGAY

SEQ ID NO: 115166 - protein, 10 aa, Dengue virus
GVVTRSGAYV

SEQ ID NO: 115167 - protein, 10 aa, Dengue virus
VVTRSGAYVS

SEQ ID NO: 115168 - protein, 10 aa, Dengue virus
SGAYVSAIAQ

SEQ ID NO: 115169 - protein, 10 aa, Dengue virus
GAYVSAIAQT

SEQ ID NO: 115170 - protein, 10 aa, Dengue virus
IFRKKRLTIM

SEQ ID NO: 115171 - protein, 10 aa, Dengue virus
FKKRNLTIMD

SEQ ID NO: 115172 - protein, 10 aa, Dengue virus
KKRNLTIMDL

SEQ ID NO: 115173 - protein, 10 aa, Dengue virus
KKRLTIMDLH

SEQ ID NO: 115174 - protein, 10 aa, Dengue virus
KRLTIMDLHP

SEQ ID NO: 115175 - protein, 10 aa, Dengue virus
RLTIMDLHPG

SEQ ID NO: 115176 - protein, 10 aa, Dengue virus
LTIMDLHPGA

SEQ ID NO: 115177 - protein, 10 aa, Dengue virus
TIMDLHPGAG

SEQ ID NO: 115178 - protein, 10 aa, Dengue virus
IMDLHPGAGK

SEQ ID NO: 115179 - protein, 10 aa, Dengue virus
MDLHPGAGKT

SEQ ID NO: 115180 - protein, 10 aa, Dengue virus
DLHPGAGKTK

SEQ ID NO: 115181 - protein, 10 aa, Dengue virus
LHPGAGKTKR

SEQ ID NO: 115182 - protein, 10 aa, Dengue virus
HPGAGKTKRY

SEQ ID NO: 115183 - protein, 10 aa, Dengue virus
PGAGKTKRYL

SEQ ID NO: 115184 - protein, 10 aa, Dengue virus
GAGKTKRYLP

SEQ ID NO: 115185 - protein, 10 aa, Dengue virus
AGKTKRYLPA

SEQ ID NO: 115186 - protein, 10 aa, Dengue virus
GKTKRYLPAI

SEQ ID NO: 115187 - protein, 10 aa, Dengue virus
KYLPAIVREA

SEQ ID NO: 115188 - protein, 10 aa, Dengue virus
ILPSIVREAL

SEQ ID NO: 115189 - protein, 10 aa, Dengue virus
LPSIVREALK

SEQ ID NO: 115190 - protein, 10 aa, Dengue virus
PSIVREALKR

SEQ ID NO: 115191 - protein, 10 aa, Dengue virus
REAIKRGLRT

SEQ ID NO: 115192 - protein, 10 aa, Dengue virus
EAIKRGLRTL

SEQ ID NO: 115193 - protein, 10 aa, Dengue virus
KRGLRTLILA

SEQ ID NO: 115194 - protein, 10 aa, Dengue virus
RGLRTLILAP

SEQ ID NO: 115195 - protein, 10 aa, Dengue virus
GLRTLILAPT

SEQ ID NO: 115196 - protein, 10 aa, Dengue virus
LRTLVLAPTR

SEQ ID NO: 115197 - protein, 10 aa, Dengue virus
RTLVLAPTRV

SEQ ID NO: 115198 - protein, 10 aa, Dengue virus
TLVLAPTRVV

SEQ ID NO: 115199 - protein, 10 aa, Dengue virus
LVLAPTRVVA

SEQ ID NO: 115200 - protein, 10 aa, Dengue virus
ILAPTRVVAS

SEQ ID NO: 115201 - protein, 10 aa, Dengue virus
LAPTRVVASE

SEQ ID NO: 115202 - protein, 10 aa, Dengue virus
APTRVVASEM

SEQ ID NO: 115203 - protein, 10 aa, Dengue virus
PTRVVASEMA

SEQ ID NO: 115204 - protein, 10 aa, Dengue virus
TRVVASEMAE

SEQ ID NO: 115205 - protein, 10 aa, Dengue virus
RVVASEMAEA

SEQ ID NO: 115206 - protein, 10 aa, Dengue virus
VVASEMAEAL

SEQ ID NO: 115207 - protein, 10 aa, Dengue virus
VAAEMEEALR

SEQ ID NO: 115208 - protein, 10 aa, Dengue virus
AAEMEEALRG

SEQ ID NO: 115209 - protein, 10 aa, Dengue virus
AEMEEALRGL

SEQ ID NO: 115210 - protein, 10 aa, Dengue virus
EMEEALRGLP

SEQ ID NO: 115211 - protein, 10 aa, Dengue virus
MEEALRGLPI

SEQ ID NO: 115212 - protein, 10 aa, Dengue virus
EEALRGLPIR

SEQ ID NO: 115213 - protein, 10 aa, Dengue virus
EALRGLPIRY

SEQ ID NO: 115214 - protein, 10 aa, Dengue virus
ALRGLPIRYQ

SEQ ID NO: 115215 - protein, 10 aa, Dengue virus
LRGLPIRYQT

SEQ ID NO: 115216 - protein, 10 aa, Dengue virus
RGLPIRYQTP

SEQ ID NO: 115217 - protein, 10 aa, Dengue virus
GLPIRYQTPA

SEQ ID NO: 115218 - protein, 10 aa, Dengue virus
LPIRYQTPAI

SEQ ID NO: 115219 - protein, 10 aa, Dengue virus
KSEHTGREIV

SEQ ID NO: 115220 - protein, 10 aa, Dengue virus
SEHTGREIVD

SEQ ID NO: 115221 - protein, 10 aa, Dengue virus
EHTGKEIVDL

SEQ ID NO: 115222 - protein, 10 aa, Dengue virus
HTGKEIVDLM

SEQ ID NO: 115223 - protein, 10 aa, Dengue virus
TGKEIVDLMC

SEQ ID NO: 115224 - protein, 10 aa, Dengue virus
GKEIVDLMCH

SEQ ID NO: 115225 - protein, 10 aa, Dengue virus
KEIVDLMCHA

SEQ ID NO: 115226 - protein, 10 aa, Dengue virus
DLMCHATFTT

SEQ ID NO: 115227 - protein, 10 aa, Dengue virus
LMCHATFTTR

SEQ ID NO: 115228 - protein, 10 aa, Dengue virus
MCHATFTTRL

SEQ ID NO: 115229 - protein, 10 aa, Dengue virus
CHATFTTRLL

SEQ ID NO: 115230 - protein, 10 aa, Dengue virus
HATFTTRLLS

SEQ ID NO: 115231 - protein, 10 aa, Dengue virus
ATFTTRLLSS

SEQ ID NO: 115232 - protein, 10 aa, Dengue virus
TFTTRLLSST

SEQ ID NO: 115233 - protein, 10 aa, Dengue virus
FTTRLLSSTR

SEQ ID NO: 115234 - protein, 10 aa, Dengue virus
TTRLLSSTRV

SEQ ID NO: 115235 - protein, 10 aa, Dengue virus
TRLLSSTRVP

SEQ ID NO: 115236 - protein, 10 aa, Dengue virus
RLLSSTRVPN

SEQ ID NO: 115237 - protein, 10 aa, Dengue virus
LLSSTRVPNY

SEQ ID NO: 115238 - protein, 10 aa, Dengue virus
LSSTRVPNYN

SEQ ID NO: 115239 - protein, 10 aa, Dengue virus
SPVRVPNYNM

SEQ ID NO: 115240 - protein, 10 aa, Dengue virus
PVRVPNYNMI

SEQ ID NO: 115241 - protein, 10 aa, Dengue virus
VRVPNYNMII

SEQ ID NO: 115242 - protein, 10 aa, Dengue virus
RVPNYNMIIM

SEQ ID NO: 115243 - protein, 10 aa, Dengue virus
VPNYNMIIMD

SEQ ID NO: 115244 - protein, 10 aa, Dengue virus
PNYNMIIMDE

SEQ ID NO: 115245 - protein, 10 aa, Dengue virus
NYNMIIMDEA

SEQ ID NO: 115246 - protein, 10 aa, Dengue virus
YNMIIMDEAH

SEQ ID NO: 115247 - protein, 10 aa, Dengue virus
NMIIMDEAHF

SEQ ID NO: 115248 - protein, 10 aa, Dengue virus
MIIMDEAHFT

SEQ ID NO: 115249 - protein, 10 aa, Dengue virus
IVMDEAHFTD

SEQ ID NO: 115250 - protein, 10 aa, Dengue virus
VMDEAHFTDP

SEQ ID NO: 115251 - protein, 10 aa, Dengue virus
MDEAHFTDPS

SEQ ID NO: 115252 - protein, 10 aa, Dengue virus
DEAHFTDPSS

SEQ ID NO: 115253 - protein, 10 aa, Dengue virus
EAHFTDPSSI

SEQ ID NO: 115254 - protein, 10 aa, Dengue virus
AHFTDPSSIA

SEQ ID NO: 115255 - protein, 10 aa, Dengue virus
HFTDPSSIAA

SEQ ID NO: 115256 - protein, 10 aa, Dengue virus
FTDPSSIAAR

SEQ ID NO: 115257 - protein, 10 aa, Dengue virus
TDPSSIAARG

SEQ ID NO: 115258 - protein, 10 aa, Dengue virus
DPSSIAARGY

SEQ ID NO: 115259 - protein, 10 aa, Dengue virus
PSSIAARGYI

SEQ ID NO: 115260 - protein, 10 aa, Dengue virus
SSIAARGYIS

SEQ ID NO: 115261 - protein, 10 aa, Dengue virus
SVAARGYIST

SEQ ID NO: 115262 - protein, 10 aa, Dengue virus
VAARGYISTR

SEQ ID NO: 115263 - protein, 10 aa, Dengue virus
ARGYISTRVE

SEQ ID NO: 115264 - protein, 10 aa, Dengue virus
RGYISTRVEM

SEQ ID NO: 115265 - protein, 10 aa, Dengue virus
GYISTRVEMG

SEQ ID NO: 115266 - protein, 10 aa, Dengue virus
YISTRVEMGE

SEQ ID NO: 115267 - protein, 10 aa, Dengue virus
ISTRVEMGEA

SEQ ID NO: 115268 - protein, 10 aa, Dengue virus
STRVEMGEAA

SEQ ID NO: 115269 - protein, 10 aa, Dengue virus
TRVEMGEAAG

SEQ ID NO: 115270 - protein, 10 aa, Dengue virus
RVEMGEAAGI

SEQ ID NO: 115271 - protein, 10 aa, Dengue virus
VEMGEAAGIF

SEQ ID NO: 115272 - protein, 10 aa, Dengue virus
EMGEAAGIFM

SEQ ID NO: 115273 - protein, 10 aa, Dengue virus
MGEAAGIFMT

SEQ ID NO: 115274 - protein, 10 aa, Dengue virus
GEAAGIFMTA

SEQ ID NO: 115275 - protein, 10 aa, Dengue virus
EAAGIFMTAT

SEQ ID NO: 115276 - protein, 10 aa, Dengue virus
AAGIFMTATP

SEQ ID NO: 115277 - protein, 10 aa, Dengue virus
AGIFMTATPP

SEQ ID NO: 115278 - protein, 10 aa, Dengue virus
GIFMTATPPG

SEQ ID NO: 115279 - protein, 10 aa, Dengue virus
IFMTATPPGT

SEQ ID NO: 115280 - protein, 10 aa, Dengue virus
DPFPQSNAPI

SEQ ID NO: 115281 - protein, 10 aa, Dengue virus
IMDEEREIPE

SEQ ID NO: 115282 - protein, 10 aa, Dengue virus
MDEEREIPER

SEQ ID NO: 115283 - protein, 10 aa, Dengue virus
DEEREIPERS

SEQ ID NO: 115284 - protein, 10 aa, Dengue virus
EEREIPERSW

SEQ ID NO: 115285 - protein, 10 aa, Dengue virus
EREIPERSWN

SEQ ID NO: 115286 - protein, 10 aa, Dengue virus
REIPERSWNS

SEQ ID NO: 115287 - protein, 10 aa, Dengue virus
EIPERSWNSG

SEQ ID NO: 115288 - protein, 10 aa, Dengue virus
IPERSWNSGH

SEQ ID NO: 115289 - protein, 10 aa, Dengue virus
FKGKTVWFVP

SEQ ID NO: 115290 - protein, 10 aa, Dengue virus
KGKTVWFVPS

SEQ ID NO: 115291 - protein, 10 aa, Dengue virus
TVWFVPSIKS

SEQ ID NO: 115292 - protein, 10 aa, Dengue virus
VWFVPSIKSG

SEQ ID NO: 115293 - protein, 10 aa, Dengue virus
WFVPSIKSGN

SEQ ID NO: 115294 - protein, 10 aa, Dengue virus
FVPSIKSGND

SEQ ID NO: 115295 - protein, 10 aa, Dengue virus
VPSIKSGNDI

SEQ ID NO: 115296 - protein, 10 aa, Dengue virus
PSIKSGNDIA

SEQ ID NO: 115297 - protein, 10 aa, Dengue virus
SIKAGNDIAA

SEQ ID NO: 115298 - protein, 10 aa, Dengue virus
IKAGNDIAAC

SEQ ID NO: 115299 - protein, 10 aa, Dengue virus
KAGNDIAACL

SEQ ID NO: 115300 - protein, 10 aa, Dengue virus
AGNDIAACLR

SEQ ID NO: 115301 - protein, 10 aa, Dengue virus
GNDIAACLRK

SEQ ID NO: 115302 - protein, 10 aa, Dengue virus
NDIAACLRKN

SEQ ID NO: 115303 - protein, 10 aa, Dengue virus
DIAACLRKNG

SEQ ID NO: 115304 - protein, 10 aa, Dengue virus
IAACLRKNGK

SEQ ID NO: 115305 - protein, 10 aa, Dengue virus
AACLRKNGKK

SEQ ID NO: 115306 - protein, 10 aa, Dengue virus
ACLRKNGKKV

SEQ ID NO: 115307 - protein, 10 aa, Dengue virus
CLRKNGKRVI

SEQ ID NO: 115308 - protein, 10 aa, Dengue virus
LRKNGKRVIQ

SEQ ID NO: 115309 - protein, 10 aa, Dengue virus
RKNGKRVIQL

SEQ ID NO: 115310 - protein, 10 aa, Dengue virus
KNGKRVIQLS

SEQ ID NO: 115311 - protein, 10 aa, Dengue virus
NGKRVIQLSR

SEQ ID NO: 115312 - protein, 10 aa, Dengue virus
GKRVIQLSRK

SEQ ID NO: 115313 - protein, 10 aa, Dengue virus
KRVIQLSRKT

SEQ ID NO: 115314 - protein, 10 aa, Dengue virus
RVIQLSRKTF

SEQ ID NO: 115315 - protein, 10 aa, Dengue virus
VVQLSRKTFD

SEQ ID NO: 115316 - protein, 10 aa, Dengue virus
IQLSRKTFDS

SEQ ID NO: 115317 - protein, 10 aa, Dengue virus
QLSRKTFDSE

SEQ ID NO: 115318 - protein, 10 aa, Dengue virus
LSRKTFDSEY

SEQ ID NO: 115319 - protein, 10 aa, Dengue virus
SRKTFDSEYV

SEQ ID NO: 115320 - protein, 10 aa, Dengue virus
RKTFDSEYVK

SEQ ID NO: 115321 - protein, 10 aa, Dengue virus
LNDWDFVVTT

SEQ ID NO: 115322 - protein, 10 aa, Dengue virus
NDWDYVVTTD

SEQ ID NO: 115323 - protein, 10 aa, Dengue virus
DWDYVVTTDI

SEQ ID NO: 115324 - protein, 10 aa, Dengue virus
WDYVVTTDIS

SEQ ID NO: 115325 - protein, 10 aa, Dengue virus
DYVVTTDISE

SEQ ID NO: 115326 - protein, 10 aa, Dengue virus
YVVTTDISEM

SEQ ID NO: 115327 - protein, 10 aa, Dengue virus
DISEMGANFK

SEQ ID NO: 115328 - protein, 10 aa, Dengue virus
ISEMGANFKA

SEQ ID NO: 115329 - protein, 10 aa, Dengue virus
SEMGANFKAE

SEQ ID NO: 115330 - protein, 10 aa, Dengue virus
EMGANFKAER

SEQ ID NO: 115331 - protein, 10 aa, Dengue virus
MGANFKAERV

SEQ ID NO: 115332 - protein, 10 aa, Dengue virus
GANFKAERVI

SEQ ID NO: 115333 - protein, 10 aa, Dengue virus
ANFKAERVID

SEQ ID NO: 115334 - protein, 10 aa, Dengue virus
NFKAERVIDP

SEQ ID NO: 115335 - protein, 10 aa, Dengue virus
FKAERVIDPR

SEQ ID NO: 115336 - protein, 10 aa, Dengue virus
KAERVIDPRR

SEQ ID NO: 115337 - protein, 10 aa, Dengue virus
AERVIDPRRC

SEQ ID NO: 115338 - protein, 10 aa, Dengue virus
ERVIDPRRCM

SEQ ID NO: 115339 - protein, 10 aa, Dengue virus
RVIDPRRCMK

SEQ ID NO: 115340 - protein, 10 aa, Dengue virus
VIDPRRCMKP

SEQ ID NO: 115341 - protein, 10 aa, Dengue virus
IDPRRCMKPV

SEQ ID NO: 115342 - protein, 10 aa, Dengue virus
DPRRCMKPVI

SEQ ID NO: 115343 - protein, 10 aa, Dengue virus
PRRCMKPVIL

SEQ ID NO: 115344 - protein, 10 aa, Dengue virus
RRCMKPVILT

SEQ ID NO: 115345 - protein, 10 aa, Dengue virus
RCMKPVILTD

SEQ ID NO: 115346 - protein, 10 aa, Dengue virus
CMKPVILTDG

SEQ ID NO: 115347 - protein, 10 aa, Dengue virus
MKPVILTDGE

SEQ ID NO: 115348 - protein, 10 aa, Dengue virus
KPVILTDGEE

SEQ ID NO: 115349 - protein, 10 aa, Dengue virus
PVILTDGEER

SEQ ID NO: 115350 - protein, 10 aa, Dengue virus
VILTDGEERV

SEQ ID NO: 115351 - protein, 10 aa, Dengue virus
ILTDGEERVI

SEQ ID NO: 115352 - protein, 10 aa, Dengue virus
LTDGEERVIL

SEQ ID NO: 115353 - protein, 10 aa, Dengue virus
TDGEERVILA

SEQ ID NO: 115354 - protein, 10 aa, Dengue virus
DGEERVILAG

SEQ ID NO: 115355 - protein, 10 aa, Dengue virus
GEERVILAGP

SEQ ID NO: 115356 - protein, 10 aa, Dengue virus
EERVILAGPM

SEQ ID NO: 115357 - protein, 10 aa, Dengue virus
ERVILAGPIP

SEQ ID NO: 115358 - protein, 10 aa, Dengue virus
RVILAGPIPV

SEQ ID NO: 115359 - protein, 10 aa, Dengue virus
VILAGPIPVT

SEQ ID NO: 115360 - protein, 10 aa, Dengue virus
ILAGPMPVTH

SEQ ID NO: 115361 - protein, 10 aa, Dengue virus
LAGPMPVTHS

SEQ ID NO: 115362 - protein, 10 aa, Dengue virus
AGPMPVTHSS

SEQ ID NO: 115363 - protein, 10 aa, Dengue virus
GPMPVTHSSA

SEQ ID NO: 115364 - protein, 10 aa, Dengue virus
PMPVTHSSAA

SEQ ID NO: 115365 - protein, 10 aa, Dengue virus
MPVTHSSAAQ

SEQ ID NO: 115366 - protein, 10 aa, Dengue virus
PVTHSSAAQR

SEQ ID NO: 115367 - protein, 10 aa, Dengue virus
VTHSSAAQRR

SEQ ID NO: 115368 - protein, 10 aa, Dengue virus
THSSAAQRRG

SEQ ID NO: 115369 - protein, 10 aa, Dengue virus
HSSAAQRRGR

SEQ ID NO: 115370 - protein, 10 aa, Dengue virus
SSAAQRRGRI

SEQ ID NO: 115371 - protein, 10 aa, Dengue virus
SAAQRRGRVG

SEQ ID NO: 115372 - protein, 10 aa, Dengue virus
AAQRRGRVGR

SEQ ID NO: 115373 - protein, 10 aa, Dengue virus
AQRRGRVGRN

SEQ ID NO: 115374 - protein, 10 aa, Dengue virus
QRRGRIGRNH

SEQ ID NO: 115375 - protein, 10 aa, Dengue virus
NENDQYIYMG

SEQ ID NO: 115376 - protein, 10 aa, Dengue virus
ENDQYIYMGE

SEQ ID NO: 115377 - protein, 10 aa, Dengue virus
NDQYIYMGEP

SEQ ID NO: 115378 - protein, 10 aa, Dengue virus
DQYIYMGEPL

SEQ ID NO: 115379 - protein, 10 aa, Dengue virus
YMGEPLENDE

SEQ ID NO: 115380 - protein, 10 aa, Dengue virus
MGEPLENDED

SEQ ID NO: 115381 - protein, 10 aa, Dengue virus
GEPLENDEDC

SEQ ID NO: 115382 - protein, 10 aa, Dengue virus
EPLENDEDCA

SEQ ID NO: 115383 - protein, 10 aa, Dengue virus
PLENDEDCAH

SEQ ID NO: 115384 - protein, 10 aa, Dengue virus
LENDEDCAHW

SEQ ID NO: 115385 - protein, 10 aa, Dengue virus
ENDEDCAHWK

SEQ ID NO: 115386 - protein, 10 aa, Dengue virus
NDEDCAHWKE

SEQ ID NO: 115387 - protein, 10 aa, Dengue virus
DEDCAHWKEA

SEQ ID NO: 115388 - protein, 10 aa, Dengue virus
EDCAHWKEAK

SEQ ID NO: 115389 - protein, 10 aa, Dengue virus
DCAHWKEAKM

SEQ ID NO: 115390 - protein, 10 aa, Dengue virus
CAHWKEAKML

SEQ ID NO: 115391 - protein, 10 aa, Dengue virus
AHWKEAKMLL

SEQ ID NO: 115392 - protein, 10 aa, Dengue virus
HWKEAKMLLD

SEQ ID NO: 115393 - protein, 10 aa, Dengue virus
WKEAKMLLDN

SEQ ID NO: 115394 - protein, 10 aa, Dengue virus
KEAKMLLDNI

SEQ ID NO: 115395 - protein, 10 aa, Dengue virus
EAKMLLDNIY

SEQ ID NO: 115396 - protein, 10 aa, Dengue virus
AKMLLDNIYT

SEQ ID NO: 115397 - protein, 10 aa, Dengue virus
KMLLDNIYTP

SEQ ID NO: 115398 - protein, 10 aa, Dengue virus
MLLDNIYTPE

SEQ ID NO: 115399 - protein, 10 aa, Dengue virus
LLDNIYTPEG

SEQ ID NO: 115400 - protein, 10 aa, Dengue virus
LDNIYTPEGI

SEQ ID NO: 115401 - protein, 10 aa, Dengue virus
DNIYTPEGII

SEQ ID NO: 115402 - protein, 10 aa, Dengue virus
NIYTPEGIIP

SEQ ID NO: 115403 - protein, 10 aa, Dengue virus
INTPEGIIPS

SEQ ID NO: 115404 - protein, 10 aa, Dengue virus
NTPEGIIPSM

SEQ ID NO: 115405 - protein, 10 aa, Dengue virus
TPEGIIPSMF

SEQ ID NO: 115406 - protein, 10 aa, Dengue virus
PEGIIPSMFE

SEQ ID NO: 115407 - protein, 10 aa, Dengue virus
EGIIPSMFEP

SEQ ID NO: 115408 - protein, 10 aa, Dengue virus
GIIPSMFEPE

SEQ ID NO: 115409 - protein, 10 aa, Dengue virus
IIPSMFEPER

SEQ ID NO: 115410 - protein, 10 aa, Dengue virus
IPSMFEPERE

SEQ ID NO: 115411 - protein, 10 aa, Dengue virus
PSMFEPEREK

SEQ ID NO: 115412 - protein, 10 aa, Dengue virus
SMFEPEREKV

SEQ ID NO: 115413 - protein, 10 aa, Dengue virus
MFEPEREKVD

SEQ ID NO: 115414 - protein, 10 aa, Dengue virus
FEPEREKVDA

SEQ ID NO: 115415 - protein, 10 aa, Dengue virus
EPEREKVDAI

SEQ ID NO: 115416 - protein, 10 aa, Dengue virus
PEREKVDAID

SEQ ID NO: 115417 - protein, 10 aa, Dengue virus
EREKVDAIDG

SEQ ID NO: 115418 - protein, 10 aa, Dengue virus
REKVDAIDGE

SEQ ID NO: 115419 - protein, 10 aa, Dengue virus
EKVDAIDGEY

SEQ ID NO: 115420 - protein, 10 aa, Dengue virus
KVDAIDGEYR

SEQ ID NO: 115421 - protein, 10 aa, Dengue virus
VDAIDGEYRL

SEQ ID NO: 115422 - protein, 10 aa, Dengue virus
DAIDGEYRLR

SEQ ID NO: 115423 - protein, 10 aa, Dengue virus
AIDGEYRLKG

SEQ ID NO: 115424 - protein, 10 aa, Dengue virus
IDGEYRLKGE

SEQ ID NO: 115425 - protein, 10 aa, Dengue virus
DGEYRLKGES

SEQ ID NO: 115426 - protein, 10 aa, Dengue virus
GEYRLKGESR

SEQ ID NO: 115427 - protein, 10 aa, Dengue virus
EYRLKGESRK

SEQ ID NO: 115428 - protein, 10 aa, Dengue virus
YRLKGESRKT

SEQ ID NO: 115429 - protein, 10 aa, Dengue virus
RLKGESRKTF

SEQ ID NO: 115430 - protein, 10 aa, Dengue virus
LKGESRKTFV

SEQ ID NO: 115431 - protein, 10 aa, Dengue virus
RGEARKTFVD

SEQ ID NO: 115432 - protein, 10 aa, Dengue virus
GEARKTFVDL

SEQ ID NO: 115433 - protein, 10 aa, Dengue virus
EARKTFVDLM

SEQ ID NO: 115434 - protein, 10 aa, Dengue virus
ARKTFVDLMR

SEQ ID NO: 115435 - protein, 10 aa, Dengue virus
RKTFVDLMRR

SEQ ID NO: 115436 - protein, 10 aa, Dengue virus
KTFVDLMRRG

SEQ ID NO: 115437 - protein, 10 aa, Dengue virus
TFVDLMRRGD

SEQ ID NO: 115438 - protein, 10 aa, Dengue virus
FVDLMRRGDL

SEQ ID NO: 115439 - protein, 10 aa, Dengue virus
VDLMRRGDLP

SEQ ID NO: 115440 - protein, 10 aa, Dengue virus
DLMRRGDLPV

SEQ ID NO: 115441 - protein, 10 aa, Dengue virus
RRGDLPVWLS

SEQ ID NO: 115442 - protein, 10 aa, Dengue virus
RGDLPVWLAY

SEQ ID NO: 115443 - protein, 10 aa, Dengue virus
GDLPVWLAYK

SEQ ID NO: 115444 - protein, 10 aa, Dengue virus
DLPVWLAYKV

SEQ ID NO: 115445 - protein, 10 aa, Dengue virus
LPVWLAYKVA

SEQ ID NO: 115446 - protein, 10 aa, Dengue virus
PVWLAHKVAS

SEQ ID NO: 115447 - protein, 10 aa, Dengue virus
YTDRKWCFDG

SEQ ID NO: 115448 - protein, 10 aa, Dengue virus
RNNQILEENM

SEQ ID NO: 115449 - protein, 10 aa, Dengue virus
NNQILEENVE

SEQ ID NO: 115450 - protein, 10 aa, Dengue virus
NQILEENVEV

SEQ ID NO: 115451 - protein, 10 aa, Dengue virus
QILEENVEVE

SEQ ID NO: 115452 - protein, 10 aa, Dengue virus
ILEENVEVEI

SEQ ID NO: 115453 - protein, 10 aa, Dengue virus
LEENVEVEIW

SEQ ID NO: 115454 - protein, 10 aa, Dengue virus
EENVEVEIWT

SEQ ID NO: 115455 - protein, 10 aa, Dengue virus
ENVEVEIWTK

SEQ ID NO: 115456 - protein, 10 aa, Dengue virus
NVEVEIWTKE

SEQ ID NO: 115457 - protein, 10 aa, Dengue virus
VEVEIWTKEG

SEQ ID NO: 115458 - protein, 10 aa, Dengue virus
ERKKLKPRWL

SEQ ID NO: 115459 - protein, 10 aa, Dengue virus
RKKLKPRWLD

SEQ ID NO: 115460 - protein, 10 aa, Dengue virus
KKLKPRWLDA

SEQ ID NO: 115461 - protein, 10 aa, Dengue virus
KLKPRWLDAR

SEQ ID NO: 115462 - protein, 10 aa, Dengue virus
LKPRWLDARI

SEQ ID NO: 115463 - protein, 10 aa, Dengue virus
KPRWLDARIY

SEQ ID NO: 115464 - protein, 10 aa, Dengue virus
PRWLDARIYS

SEQ ID NO: 115465 - protein, 10 aa, Dengue virus
RWLDARIYSD

SEQ ID NO: 115466 - protein, 10 aa, Dengue virus
WLDARIYSDP

SEQ ID NO: 115467 - protein, 10 aa, Dengue virus
LDARIYSDPL

SEQ ID NO: 115468 - protein, 10 aa, Dengue virus
DARIYSDPLA

SEQ ID NO: 115469 - protein, 10 aa, Dengue virus
ARIYSDPLAL

SEQ ID NO: 115470 - protein, 10 aa, Dengue virus
RIYSDPLALK

SEQ ID NO: 115471 - protein, 10 aa, Dengue virus
IYSDPLALKE

SEQ ID NO: 115472 - protein, 10 aa, Dengue virus
YSDPLALREF

SEQ ID NO: 115473 - protein, 10 aa, Dengue virus
SDPLALREFK

SEQ ID NO: 115474 - protein, 10 aa, Dengue virus
DPLALKEFKE

SEQ ID NO: 115475 - protein, 10 aa, Dengue virus
PLALKEFKEF

SEQ ID NO: 115476 - protein, 10 aa, Dengue virus
LALKEFKEFA

SEQ ID NO: 115477 - protein, 10 aa, Dengue virus
ALKEFKEFAA

SEQ ID NO: 115478 - protein, 10 aa, Dengue virus
LKEFKEFAAG

SEQ ID NO: 115479 - protein, 10 aa, Dengue virus
KEFKEFAAGR

SEQ ID NO: 115480 - protein, 10 aa, Dengue virus
EFKEFAAGRK

SEQ ID NO: 115481 - protein, 10 aa, Dengue virus
FKEFAAGRKS

SEQ ID NO: 115482 - protein, 10 aa, Dengue virus
KEFAAGRKSL

SEQ ID NO: 115483 - protein, 10 aa, Dengue virus
FAAGRKSLTL

SEQ ID NO: 115484 - protein, 10 aa, Dengue virus
NLITEMGRLP

SEQ ID NO: 115485 - protein, 10 aa, Dengue virus
TEMGRLPTFM

SEQ ID NO: 115486 - protein, 10 aa, Dengue virus
EMGRLPTFMT

SEQ ID NO: 115487 - protein, 10 aa, Dengue virus
RNALDNLVML

SEQ ID NO: 115488 - protein, 10 aa, Dengue virus
DALDNLAVLH

SEQ ID NO: 115489 - protein, 10 aa, Dengue virus
ALDNLAVLHT

SEQ ID NO: 115490 - protein, 10 aa, Dengue virus
LDNLAVLHTA

SEQ ID NO: 115491 - protein, 10 aa, Dengue virus
DNLAVLHTAE

SEQ ID NO: 115492 - protein, 10 aa, Dengue virus
AYNHALSELP

SEQ ID NO: 115493 - protein, 10 aa, Dengue virus
YNHALSELPE

SEQ ID NO: 115494 - protein, 10 aa, Dengue virus
NHALSELPET

SEQ ID NO: 115495 - protein, 10 aa, Dengue virus
HALSELPETL

SEQ ID NO: 115496 - protein, 10 aa, Dengue virus
ALSELPETLE

SEQ ID NO: 115497 - protein, 10 aa, Dengue virus
LSELPETLET

SEQ ID NO: 115498 - protein, 10 aa, Dengue virus
SELPETLETL

SEQ ID NO: 115499 - protein, 10 aa, Dengue virus
ELPETLETLL

SEQ ID NO: 115500 - protein, 10 aa, Dengue virus
LPETLETLLL

SEQ ID NO: 115501 - protein, 10 aa, Dengue virus
PETLETLLLL

SEQ ID NO: 115502 - protein, 10 aa, Dengue virus
ETLETLLLLT

SEQ ID NO: 115503 - protein, 10 aa, Dengue virus
TLETLLLLTL

SEQ ID NO: 115504 - protein, 10 aa, Dengue virus
LETLLLLTLL

SEQ ID NO: 115505 - protein, 10 aa, Dengue virus
ETLLLLTLLA

SEQ ID NO: 115506 - protein, 10 aa, Dengue virus
GKMTLGMCCI

SEQ ID NO: 115507 - protein, 10 aa, Dengue virus
IQPHWIAASI

SEQ ID NO: 115508 - protein, 10 aa, Dengue virus
QPHWIAASII

SEQ ID NO: 115509 - protein, 10 aa, Dengue virus
LQWIASAIVL

SEQ ID NO: 115510 - protein, 10 aa, Dengue virus
QWIASAIVLE

SEQ ID NO: 115511 - protein, 10 aa, Dengue virus
WIASAIVLEF

SEQ ID NO: 115512 - protein, 10 aa, Dengue virus
IASAIVLEFF

SEQ ID NO: 115513 - protein, 10 aa, Dengue virus
ASAIVLEFFM

SEQ ID NO: 115514 - protein, 10 aa, Dengue virus
ASIILEFFLI

SEQ ID NO: 115515 - protein, 10 aa, Dengue virus
SIILEFFLIV

SEQ ID NO: 115516 - protein, 10 aa, Dengue virus
IILEFFLIVL

SEQ ID NO: 115517 - protein, 10 aa, Dengue virus
ILEFFLIVLL

SEQ ID NO: 115518 - protein, 10 aa, Dengue virus
LEFFLIVLLI

SEQ ID NO: 115519 - protein, 10 aa, Dengue virus
EFFLIVLLIP

SEQ ID NO: 115520 - protein, 10 aa, Dengue virus
FFLIVLLIPE

SEQ ID NO: 115521 - protein, 10 aa, Dengue virus
FLIVLLIPEP

SEQ ID NO: 115522 - protein, 10 aa, Dengue virus
LIVLLIPEPE

SEQ ID NO: 115523 - protein, 10 aa, Dengue virus
IVLLIPEPEK

SEQ ID NO: 115524 - protein, 10 aa, Dengue virus
VLLIPEPDRQ

SEQ ID NO: 115525 - protein, 10 aa, Dengue virus
LLIPEPDRQR

SEQ ID NO: 115526 - protein, 10 aa, Dengue virus
LIPEPDRQRT

SEQ ID NO: 115527 - protein, 10 aa, Dengue virus
IPEPDRQRTP

SEQ ID NO: 115528 - protein, 10 aa, Dengue virus
PEPDRQRTPQ

SEQ ID NO: 115529 - protein, 10 aa, Dengue virus
EPDRQRTPQD

SEQ ID NO: 115530 - protein, 10 aa, Dengue virus
PDRQRTPQDN

SEQ ID NO: 115531 - protein, 10 aa, Dengue virus
DRQRTPQDNQ

SEQ ID NO: 115532 - protein, 10 aa, Dengue virus
RQRTPQDNQL

SEQ ID NO: 115533 - protein, 10 aa, Dengue virus
QRTPQDNQLT

SEQ ID NO: 115534 - protein, 10 aa, Dengue virus
RTPQDNQLTY

SEQ ID NO: 115535 - protein, 10 aa, Dengue virus
TPQDNQLTYV

SEQ ID NO: 115536 - protein, 10 aa, Dengue virus
PQDNQLTYVV

SEQ ID NO: 115537 - protein, 10 aa, Dengue virus
QDNQLTYVVI

SEQ ID NO: 115538 - protein, 10 aa, Dengue virus
DNQLTYVVIA

SEQ ID NO: 115539 - protein, 10 aa, Dengue virus
NQLTYVVIAI

SEQ ID NO: 115540 - protein, 10 aa, Dengue virus
QLTYVVIAIL

SEQ ID NO: 115541 - protein, 10 aa, Dengue virus
LTYVVIAILT

SEQ ID NO: 115542 - protein, 10 aa, Dengue virus
TMANEMGFLE

SEQ ID NO: 115543 - protein, 10 aa, Dengue virus
MANEMGFLEK

SEQ ID NO: 115544 - protein, 10 aa, Dengue virus
ANEMGFLEKT

SEQ ID NO: 115545 - protein, 10 aa, Dengue virus
NEMGFLEKTK

SEQ ID NO: 115546 - protein, 10 aa, Dengue virus
EMGFLEKTKK

SEQ ID NO: 115547 - protein, 10 aa, Dengue virus
MGFLEKTKKD

SEQ ID NO: 115548 - protein, 10 aa, Dengue virus
GFLEKTKKDL

SEQ ID NO: 115549 - protein, 10 aa, Dengue virus
FLEKTKKDLG

SEQ ID NO: 115550 - protein, 10 aa, Dengue virus
LDIDLRPASA

SEQ ID NO: 115551 - protein, 10 aa, Dengue virus
DIDLRPASAW

SEQ ID NO: 115552 - protein, 10 aa, Dengue virus
IDLRPASAWT

SEQ ID NO: 115553 - protein, 10 aa, Dengue virus
DLRPASAWTL

SEQ ID NO: 115554 - protein, 10 aa, Dengue virus
LRPASAWTLY

SEQ ID NO: 115555 - protein, 10 aa, Dengue virus
RPASAWTLYA

SEQ ID NO: 115556 - protein, 10 aa, Dengue virus
WTLYAVATTF

SEQ ID NO: 115557 - protein, 10 aa, Dengue virus
TLYAVATTVI

SEQ ID NO: 115558 - protein, 10 aa, Dengue virus
LYAVATTVIT

SEQ ID NO: 115559 - protein, 10 aa, Dengue virus
YAVATTVITP

SEQ ID NO: 115560 - protein, 10 aa, Dengue virus
AVATTVITPM

SEQ ID NO: 115561 - protein, 10 aa, Dengue virus
VTPMLRHSIE

SEQ ID NO: 115562 - protein, 10 aa, Dengue virus
TPMLRHSIEN

SEQ ID NO: 115563 - protein, 10 aa, Dengue virus
PMLRHSIENS

SEQ ID NO: 115564 - protein, 10 aa, Dengue virus
MLRHSIENSS

SEQ ID NO: 115565 - protein, 10 aa, Dengue virus
LRHSIENSSV

SEQ ID NO: 115566 - protein, 10 aa, Dengue virus
RHSIENSSVN

SEQ ID NO: 115567 - protein, 10 aa, Dengue virus
HSIENSSVNV

SEQ ID NO: 115568 - protein, 10 aa, Dengue virus
SIENSSVNVS

SEQ ID NO: 115569 - protein, 10 aa, Dengue virus
IENSSVNVSL

SEQ ID NO: 115570 - protein, 10 aa, Dengue virus
ENSSVNVSLT

SEQ ID NO: 115571 - protein, 10 aa, Dengue virus
NSSVNVSLTA

SEQ ID NO: 115572 - protein, 10 aa, Dengue virus
SSVNVSLTAI

SEQ ID NO: 115573 - protein, 10 aa, Dengue virus
SVNVSLTAIA

SEQ ID NO: 115574 - protein, 10 aa, Dengue virus
VNVSLTAIAN

SEQ ID NO: 115575 - protein, 10 aa, Dengue virus
NVSLTAIANQ

SEQ ID NO: 115576 - protein, 10 aa, Dengue virus
VSLTAIANQA

SEQ ID NO: 115577 - protein, 10 aa, Dengue virus
SLTAIANQAT

SEQ ID NO: 115578 - protein, 10 aa, Dengue virus
LTAIANQATV

SEQ ID NO: 115579 - protein, 10 aa, Dengue virus
TAIANQATVL

SEQ ID NO: 115580 - protein, 10 aa, Dengue virus
AIANQATVLM

SEQ ID NO: 115581 - protein, 10 aa, Dengue virus
IANQATVLMG

SEQ ID NO: 115582 - protein, 10 aa, Dengue virus
ANQATVLMGL

SEQ ID NO: 115583 - protein, 10 aa, Dengue virus
NQATVLMGLG

SEQ ID NO: 115584 - protein, 10 aa, Dengue virus
QATVLMGLGK

SEQ ID NO: 115585 - protein, 10 aa, Dengue virus
ATVLMGLGKG

SEQ ID NO: 115586 - protein, 10 aa, Dengue virus
TVLMGLGKGW

SEQ ID NO: 115587 - protein, 10 aa, Dengue virus
VLMGLGKGWP

SEQ ID NO: 115588 - protein, 10 aa, Dengue virus
LMGLGKGWPL

SEQ ID NO: 115589 - protein, 10 aa, Dengue virus
MGLGKGWPLS

SEQ ID NO: 115590 - protein, 10 aa, Dengue virus
GLGKGWPLSK

SEQ ID NO: 115591 - protein, 10 aa, Dengue virus
LGKGWPLSKM

SEQ ID NO: 115592 - protein, 10 aa, Dengue virus
GKGWPLSKMD

SEQ ID NO: 115593 - protein, 10 aa, Dengue virus
KGWPLSKMDI

SEQ ID NO: 115594 - protein, 10 aa, Dengue virus
GWPLSKMDIG

SEQ ID NO: 115595 - protein, 10 aa, Dengue virus
WPLSKMDIGV

SEQ ID NO: 115596 - protein, 10 aa, Dengue virus
PLSKMDIGVP

SEQ ID NO: 115597 - protein, 10 aa, Dengue virus
LSKMDIGVPL

SEQ ID NO: 115598 - protein, 10 aa, Dengue virus
SKMDLGVPLL

SEQ ID NO: 115599 - protein, 10 aa, Dengue virus
KMDLGVPLLA

SEQ ID NO: 115600 - protein, 10 aa, Dengue virus
MDIGVPLLAI

SEQ ID NO: 115601 - protein, 10 aa, Dengue virus
DIGVPLLAIG

SEQ ID NO: 115602 - protein, 10 aa, Dengue virus
IGVPLLAIGC

SEQ ID NO: 115603 - protein, 10 aa, Dengue virus
GVPLLAIGCY

SEQ ID NO: 115604 - protein, 10 aa, Dengue virus
VPLLAIGCYS

SEQ ID NO: 115605 - protein, 10 aa, Dengue virus
PLLAIGCYSQ

SEQ ID NO: 115606 - protein, 10 aa, Dengue virus
LLAIGCYSQV

SEQ ID NO: 115607 - protein, 10 aa, Dengue virus
LAIGCYSQVN

SEQ ID NO: 115608 - protein, 10 aa, Dengue virus
AIGCYSQVNP

SEQ ID NO: 115609 - protein, 10 aa, Dengue virus
IGCYSQVNPI

SEQ ID NO: 115610 - protein, 10 aa, Dengue virus
GCYSQVNPIT

SEQ ID NO: 115611 - protein, 10 aa, Dengue virus
CYSQVNPITL

SEQ ID NO: 115612 - protein, 10 aa, Dengue virus
YSQVNPITLT

SEQ ID NO: 115613 - protein, 10 aa, Dengue virus
SQVNPITLTA

SEQ ID NO: 115614 - protein, 10 aa, Dengue virus
QVNPITLTAA

SEQ ID NO: 115615 - protein, 10 aa, Dengue virus
VNPITLTAAL

SEQ ID NO: 115616 - protein, 10 aa, Dengue virus
LITHYAIIGP

SEQ ID NO: 115617 - protein, 10 aa, Dengue virus
THYAIIGPGL

SEQ ID NO: 115618 - protein, 10 aa, Dengue virus
KATREAQKRA

SEQ ID NO: 115619 - protein, 10 aa, Dengue virus
ATREAQKRAA

SEQ ID NO: 115620 - protein, 10 aa, Dengue virus
TREAQKRAAA

SEQ ID NO: 115621 - protein, 10 aa, Dengue virus
REAQKRAAAG

SEQ ID NO: 115622 - protein, 10 aa, Dengue virus
EAQKRAAAGI

SEQ ID NO: 115623 - protein, 10 aa, Dengue virus
AQKRAAAGIM

SEQ ID NO: 115624 - protein, 10 aa, Dengue virus
QKRAAAGIMK

SEQ ID NO: 115625 - protein, 10 aa, Dengue virus
KRAAAGIMKN

SEQ ID NO: 115626 - protein, 10 aa, Dengue virus
RAAAGIMKNP

SEQ ID NO: 115627 - protein, 10 aa, Dengue virus
AAAGIMKNPT

SEQ ID NO: 115628 - protein, 10 aa, Dengue virus
AAGIMKNPTI

SEQ ID NO: 115629 - protein, 10 aa, Dengue virus
AGIMKNPTID

SEQ ID NO: 115630 - protein, 10 aa, Dengue virus
GIMKNPTIDG

SEQ ID NO: 115631 - protein, 10 aa, Dengue virus
IMKNPTIDGI

SEQ ID NO: 115632 - protein, 10 aa, Dengue virus
MKNPTVDGIT

SEQ ID NO: 115633 - protein, 10 aa, Dengue virus
KNPTVDGITV

SEQ ID NO: 115634 - protein, 10 aa, Dengue virus
NPTVDGITVI

SEQ ID NO: 115635 - protein, 10 aa, Dengue virus
TIDLDPVIYD

SEQ ID NO: 115636 - protein, 10 aa, Dengue virus
PIPYDPKFEK

SEQ ID NO: 115637 - protein, 10 aa, Dengue virus
IPYDPKFEKQ

SEQ ID NO: 115638 - protein, 10 aa, Dengue virus
PYDPKFEKQL

SEQ ID NO: 115639 - protein, 10 aa, Dengue virus
YDPKFEKQLG

SEQ ID NO: 115640 - protein, 10 aa, Dengue virus
DPKFEKQLGQ

SEQ ID NO: 115641 - protein, 10 aa, Dengue virus
PKFEKQLGQV

SEQ ID NO: 115642 - protein, 10 aa, Dengue virus
KFEKQLGQIM

SEQ ID NO: 115643 - protein, 10 aa, Dengue virus
FEKQLGQIML

SEQ ID NO: 115644 - protein, 10 aa, Dengue virus
EKQLGQIMLL

SEQ ID NO: 115645 - protein, 10 aa, Dengue virus
KQLGQVMLLV

SEQ ID NO: 115646 - protein, 10 aa, Dengue virus
QLGQVMLLVL

SEQ ID NO: 115647 - protein, 10 aa, Dengue virus
LGQVMLLVLC

SEQ ID NO: 115648 - protein, 10 aa, Dengue virus
GQVMLLVLCA

SEQ ID NO: 115649 - protein, 10 aa, Dengue virus
LCVTQVLMMR

SEQ ID NO: 115650 - protein, 10 aa, Dengue virus
CVTQVLMMRT

SEQ ID NO: 115651 - protein, 10 aa, Dengue virus
VTQVLMMRTT

SEQ ID NO: 115652 - protein, 10 aa, Dengue virus
TQVLMMRTTW

SEQ ID NO: 115653 - protein, 10 aa, Dengue virus
QVLMMRTTWA

SEQ ID NO: 115654 - protein, 10 aa, Dengue virus
VLMMRTTWAL

SEQ ID NO: 115655 - protein, 10 aa, Dengue virus
LMMRTTWALC

SEQ ID NO: 115656 - protein, 10 aa, Dengue virus
MMRTTWALCE

SEQ ID NO: 115657 - protein, 10 aa, Dengue virus
MRTTWALCEA

SEQ ID NO: 115658 - protein, 10 aa, Dengue virus
RTTWALCEAL

SEQ ID NO: 115659 - protein, 10 aa, Dengue virus
TTWALCEALT

SEQ ID NO: 115660 - protein, 10 aa, Dengue virus
TWALCEALTL

SEQ ID NO: 115661 - protein, 10 aa, Dengue virus
WALCESITLA

SEQ ID NO: 115662 - protein, 10 aa, Dengue virus
ALCESITLAT

SEQ ID NO: 115663 - protein, 10 aa, Dengue virus
LCESITLATG

SEQ ID NO: 115664 - protein, 10 aa, Dengue virus
CESITLATGP

SEQ ID NO: 115665 - protein, 10 aa, Dengue virus
ESITLATGPL

SEQ ID NO: 115666 - protein, 10 aa, Dengue virus
LTLATGPIST

SEQ ID NO: 115667 - protein, 10 aa, Dengue virus
TLATGPISTL

SEQ ID NO: 115668 - protein, 10 aa, Dengue virus
LATGPISTLW

SEQ ID NO: 115669 - protein, 10 aa, Dengue virus
ATGPISTLWE

SEQ ID NO: 115670 - protein, 10 aa, Dengue virus
TGPISTLWEG

SEQ ID NO: 115671 - protein, 10 aa, Dengue virus
GPISTLWEGN

SEQ ID NO: 115672 - protein, 10 aa, Dengue virus
PISTLWEGNP

SEQ ID NO: 115673 - protein, 10 aa, Dengue virus
ISTLWEGNPG

SEQ ID NO: 115674 - protein, 10 aa, Dengue virus
STLWEGNPGR

SEQ ID NO: 115675 - protein, 10 aa, Dengue virus
TLWEGNPGRF

SEQ ID NO: 115676 - protein, 10 aa, Dengue virus
LWEGNPGRFW

SEQ ID NO: 115677 - protein, 10 aa, Dengue virus
WEGNPGRFWN

SEQ ID NO: 115678 - protein, 10 aa, Dengue virus
EGNPGRFWNT

SEQ ID NO: 115679 - protein, 10 aa, Dengue virus
GNPGRFWNTT

SEQ ID NO: 115680 - protein, 10 aa, Dengue virus
NPGRFWNTTI

SEQ ID NO: 115681 - protein, 10 aa, Dengue virus
PGRFWNTTIA

SEQ ID NO: 115682 - protein, 10 aa, Dengue virus
GRFWNTTIAV

SEQ ID NO: 115683 - protein, 10 aa, Dengue virus
RFWNTTIAVS

SEQ ID NO: 115684 - protein, 10 aa, Dengue virus
FWNTTIAVST

SEQ ID NO: 115685 - protein, 10 aa, Dengue virus
WNTTIAVSTA

SEQ ID NO: 115686 - protein, 10 aa, Dengue virus
NTTIAVSTAN

SEQ ID NO: 115687 - protein, 10 aa, Dengue virus
TTIAVSTANI

SEQ ID NO: 115688 - protein, 10 aa, Dengue virus
TIAVSTANIF

SEQ ID NO: 115689 - protein, 10 aa, Dengue virus
IAVSTANIFR

SEQ ID NO: 115690 - protein, 10 aa, Dengue virus
AVSTANIFRG

SEQ ID NO: 115691 - protein, 10 aa, Dengue virus
VSTANIFRGS

SEQ ID NO: 115692 - protein, 10 aa, Dengue virus
STANIFRGSY

SEQ ID NO: 115693 - protein, 10 aa, Dengue virus
TANIFRGSYL

SEQ ID NO: 115694 - protein, 10 aa, Dengue virus
GSYLAGAGLL

SEQ ID NO: 115695 - protein, 10 aa, Dengue virus
SYLAGAGLLF

SEQ ID NO: 115696 - protein, 10 aa, Dengue virus
YLAGAGLLFS

SEQ ID NO: 115697 - protein, 10 aa, Dengue virus
LAGAGLLFSI

SEQ ID NO: 115698 - protein, 10 aa, Dengue virus
AGAGLLFSIM

SEQ ID NO: 115699 - protein, 10 aa, Dengue virus
GAGLLFSIMK

SEQ ID NO: 115700 - protein, 10 aa, Dengue virus
AGLLFSIMKN

SEQ ID NO: 115701 - protein, 10 aa, Dengue virus
GLLFSIMKNT

SEQ ID NO: 115702 - protein, 10 aa, Dengue virus
IGETLGEKWK

SEQ ID NO: 115703 - protein, 10 aa, Dengue virus
GETLGEKWKS

SEQ ID NO: 115704 - protein, 10 aa, Dengue virus
ETLGEKWKSR

SEQ ID NO: 115705 - protein, 10 aa, Dengue virus
TLGEKWKSRL

SEQ ID NO: 115706 - protein, 10 aa, Dengue virus
LGEKWKSRLN

SEQ ID NO: 115707 - protein, 10 aa, Dengue virus
EVDRTLAKEG

SEQ ID NO: 115708 - protein, 10 aa, Dengue virus
VDRTLAKEGI

SEQ ID NO: 115709 - protein, 10 aa, Dengue virus
LAKEGIKRGE

SEQ ID NO: 115710 - protein, 10 aa, Dengue virus
AKEGIKRGET

SEQ ID NO: 115711 - protein, 10 aa, Dengue virus
KHAVSRGTAK

SEQ ID NO: 115712 - protein, 10 aa, Dengue virus
HAVSRGTAKL

SEQ ID NO: 115713 - protein, 10 aa, Dengue virus
AVSRGSAKLR

SEQ ID NO: 115714 - protein, 10 aa, Dengue virus
VSRGSAKLRW

SEQ ID NO: 115715 - protein, 10 aa, Dengue virus
SRGSAKLRWF

SEQ ID NO: 115716 - protein, 10 aa, Dengue virus
RGSAKLRWFV

SEQ ID NO: 115717 - protein, 10 aa, Dengue virus
GSAKLRWFVE

SEQ ID NO: 115718 - protein, 10 aa, Dengue virus
SAKLRWFVER

SEQ ID NO: 115719 - protein, 10 aa, Dengue virus
AKLQWFVERN

SEQ ID NO: 115720 - protein, 10 aa, Dengue virus
KLRWFVERNM

SEQ ID NO: 115721 - protein, 10 aa, Dengue virus
LRWFVERNMV

SEQ ID NO: 115722 - protein, 10 aa, Dengue virus
PEGKVVDLGC

SEQ ID NO: 115723 - protein, 10 aa, Dengue virus
EGKVVDLGCG

SEQ ID NO: 115724 - protein, 10 aa, Dengue virus
GKVVDLGCGR

SEQ ID NO: 115725 - protein, 10 aa, Dengue virus
KVVDLGCGRG

SEQ ID NO: 115726 - protein, 10 aa, Dengue virus
VVDLGCGRGG

SEQ ID NO: 115727 - protein, 10 aa, Dengue virus
VDLGCGRGGW

SEQ ID NO: 115728 - protein, 10 aa, Dengue virus
CGRGGWSYYM

SEQ ID NO: 115729 - protein, 10 aa, Dengue virus
GRGGWSYYCG

SEQ ID NO: 115730 - protein, 10 aa, Dengue virus
RGGWSYYCGG

SEQ ID NO: 115731 - protein, 10 aa, Dengue virus
GGWSYYCGGL

SEQ ID NO: 115732 - protein, 10 aa, Dengue virus
GWSYYCGGLK

SEQ ID NO: 115733 - protein, 10 aa, Dengue virus
WSYYCGGLKN

SEQ ID NO: 115734 - protein, 10 aa, Dengue virus
SYYCGGLKNV

SEQ ID NO: 115735 - protein, 10 aa, Dengue virus
YYCGGLKNVR

SEQ ID NO: 115736 - protein, 10 aa, Dengue virus
YCGGLKNVRE

SEQ ID NO: 115737 - protein, 10 aa, Dengue virus
CGGLKNVREV

SEQ ID NO: 115738 - protein, 10 aa, Dengue virus
VREVKGLTKG

SEQ ID NO: 115739 - protein, 10 aa, Dengue virus
REVKGLTKGG

SEQ ID NO: 115740 - protein, 10 aa, Dengue virus
EVKGLTKGGP

SEQ ID NO: 115741 - protein, 10 aa, Dengue virus
VKGLTKGGPG

SEQ ID NO: 115742 - protein, 10 aa, Dengue virus
KGLTKGGPGH

SEQ ID NO: 115743 - protein, 10 aa, Dengue virus
GLTKGGPGHE

SEQ ID NO: 115744 - protein, 10 aa, Dengue virus
LTKGGPGHEE

SEQ ID NO: 115745 - protein, 10 aa, Dengue virus
KGGPGHEEPV

SEQ ID NO: 115746 - protein, 10 aa, Dengue virus
GGPGHEEPVP

SEQ ID NO: 115747 - protein, 10 aa, Dengue virus
GPGHEEPVPM

SEQ ID NO: 115748 - protein, 10 aa, Dengue virus
PGHEEPIPMS

SEQ ID NO: 115749 - protein, 10 aa, Dengue virus
GHEEPIPMST

SEQ ID NO: 115750 - protein, 10 aa, Dengue virus
HEEPIPMSTY

SEQ ID NO: 115751 - protein, 10 aa, Dengue virus
EEPIPMSTYG

SEQ ID NO: 115752 - protein, 10 aa, Dengue virus
EPIPMSTYGW

SEQ ID NO: 115753 - protein, 10 aa, Dengue virus
PIPMSTYGWN

SEQ ID NO: 115754 - protein, 10 aa, Dengue virus
IPMSTYGWNL

SEQ ID NO: 115755 - protein, 10 aa, Dengue virus
PMSTYGWNLV

SEQ ID NO: 115756 - protein, 10 aa, Dengue virus
MSTYGWNLVR

SEQ ID NO: 115757 - protein, 10 aa, Dengue virus
STYGWNLVRL

SEQ ID NO: 115758 - protein, 10 aa, Dengue virus
TYGWNLVRLQ

SEQ ID NO: 115759 - protein, 10 aa, Dengue virus
GWNLVRLQSG

SEQ ID NO: 115760 - protein, 10 aa, Dengue virus
PTEQVDTLLC

SEQ ID NO: 115761 - protein, 10 aa, Dengue virus
TEQVDTLLCD

SEQ ID NO: 115762 - protein, 10 aa, Dengue virus
EQVDTLLCDI

SEQ ID NO: 115763 - protein, 10 aa, Dengue virus
QVDTLLCDIG

SEQ ID NO: 115764 - protein, 10 aa, Dengue virus
VDTLLCDIGE

SEQ ID NO: 115765 - protein, 10 aa, Dengue virus
LLCDIGESSS

SEQ ID NO: 115766 - protein, 10 aa, Dengue virus
LCDIGESSPS

SEQ ID NO: 115767 - protein, 10 aa, Dengue virus
CDIGESSPSP

SEQ ID NO: 115768 - protein, 10 aa, Dengue virus
DIGESSPSPT

SEQ ID NO: 115769 - protein, 10 aa, Dengue virus
IGESSPSPTV

SEQ ID NO: 115770 - protein, 10 aa, Dengue virus
GESSPSPTVE

SEQ ID NO: 115771 - protein, 10 aa, Dengue virus
ESSPSPTVEE

SEQ ID NO: 115772 - protein, 10 aa, Dengue virus
SSPSPTVEES

SEQ ID NO: 115773 - protein, 10 aa, Dengue virus
SPSPTVEESR

SEQ ID NO: 115774 - protein, 10 aa, Dengue virus
PSPTVEESRT

SEQ ID NO: 115775 - protein, 10 aa, Dengue virus
SPTVEESRTI

SEQ ID NO: 115776 - protein, 10 aa, Dengue virus
PTVEESRTIR

SEQ ID NO: 115777 - protein, 10 aa, Dengue virus
TVEESRTIRV

SEQ ID NO: 115778 - protein, 10 aa, Dengue virus
VEESRTIRVL

SEQ ID NO: 115779 - protein, 10 aa, Dengue virus
EAGRTLRVLN

SEQ ID NO: 115780 - protein, 10 aa, Dengue virus
AGRTLRVLNL

SEQ ID NO: 115781 - protein, 10 aa, Dengue virus
GRTLRVLNLV

SEQ ID NO: 115782 - protein, 10 aa, Dengue virus
RTLRVLNLVE

SEQ ID NO: 115783 - protein, 10 aa, Dengue virus
TLRVLNLVEN

SEQ ID NO: 115784 - protein, 10 aa, Dengue virus
LRVLNLVENW

SEQ ID NO: 115785 - protein, 10 aa, Dengue virus
RVLNLVENWL

SEQ ID NO: 115786 - protein, 10 aa, Dengue virus
QFCIKILNPY

SEQ ID NO: 115787 - protein, 10 aa, Dengue virus
FCIKILNPYM

SEQ ID NO: 115788 - protein, 10 aa, Dengue virus
CIKILNPYMP

SEQ ID NO: 115789 - protein, 10 aa, Dengue virus
IKVLNPYMPS

SEQ ID NO: 115790 - protein, 10 aa, Dengue virus
KVLNPYMPSV

SEQ ID NO: 115791 - protein, 10 aa, Dengue virus
VLNPYMPSVI

SEQ ID NO: 115792 - protein, 10 aa, Dengue virus
LNPYMPSVIE

SEQ ID NO: 115793 - protein, 10 aa, Dengue virus
YGGALVRNPL

SEQ ID NO: 115794 - protein, 10 aa, Dengue virus
GGALVRNPLS

SEQ ID NO: 115795 - protein, 10 aa, Dengue virus
GALVRNPLSR

SEQ ID NO: 115796 - protein, 10 aa, Dengue virus
ALVRNPLSRN

SEQ ID NO: 115797 - protein, 10 aa, Dengue virus
LVRCPLSRNS

SEQ ID NO: 115798 - protein, 10 aa, Dengue virus
VRCPLSRNST

SEQ ID NO: 115799 - protein, 10 aa, Dengue virus
RCPLSRNSTH

SEQ ID NO: 115800 - protein, 10 aa, Dengue virus
CPLSRNSTHE

SEQ ID NO: 115801 - protein, 10 aa, Dengue virus
RNSTHEMYWI

SEQ ID NO: 115802 - protein, 10 aa, Dengue virus
NSTHEMYWIS

SEQ ID NO: 115803 - protein, 10 aa, Dengue virus
STHEMYWVSN

SEQ ID NO: 115804 - protein, 10 aa, Dengue virus
THEMYWVSNA

SEQ ID NO: 115805 - protein, 10 aa, Dengue virus
HEMYWISNGT

SEQ ID NO: 115806 - protein, 10 aa, Dengue virus
EMYWISNGTG

SEQ ID NO: 115807 - protein, 10 aa, Dengue virus
MYWISNGTGN

SEQ ID NO: 115808 - protein, 10 aa, Dengue virus
YWISNGTGNI

SEQ ID NO: 115809 - protein, 10 aa, Dengue virus
WISNGTGNIV

SEQ ID NO: 115810 - protein, 10 aa, Dengue virus
ASGNIVSSVN

SEQ ID NO: 115811 - protein, 10 aa, Dengue virus
TGNIVSSVNM

SEQ ID NO: 115812 - protein, 10 aa, Dengue virus
GNIVSSVNMI

SEQ ID NO: 115813 - protein, 10 aa, Dengue virus
NIVSSVNMIS

SEQ ID NO: 115814 - protein, 10 aa, Dengue virus
IVSSVNMISR

SEQ ID NO: 115815 - protein, 10 aa, Dengue virus
VSSVNMISRM

SEQ ID NO: 115816 - protein, 10 aa, Dengue virus
SSVNMISRML

SEQ ID NO: 115817 - protein, 10 aa, Dengue virus
SVNMISRMLI

SEQ ID NO: 115818 - protein, 10 aa, Dengue virus
VNMISRMLIN

SEQ ID NO: 115819 - protein, 10 aa, Dengue virus
NMISRMLINR

SEQ ID NO: 115820 - protein, 10 aa, Dengue virus
MISRMLINRF

SEQ ID NO: 115821 - protein, 10 aa, Dengue virus
ISRMLINRFT

SEQ ID NO: 115822 - protein, 10 aa, Dengue virus
SRMLINRFTM

SEQ ID NO: 115823 - protein, 10 aa, Dengue virus
ATYEPDVDLG

SEQ ID NO: 115824 - protein, 10 aa, Dengue virus
EPDVDLGSGT

SEQ ID NO: 115825 - protein, 10 aa, Dengue virus
PDVDLGSGTR

SEQ ID NO: 115826 - protein, 10 aa, Dengue virus
DVDLGSGTRN

SEQ ID NO: 115827 - protein, 10 aa, Dengue virus
VDLGSGTRNI

SEQ ID NO: 115828 - protein, 10 aa, Dengue virus
DLGSGTRNIG

SEQ ID NO: 115829 - protein, 10 aa, Dengue virus
LGSGTRNIGI

SEQ ID NO: 115830 - protein, 10 aa, Dengue virus
GSGTRNIGIE

SEQ ID NO: 115831 - protein, 10 aa, Dengue virus
PNLDIIGKRI

SEQ ID NO: 115832 - protein, 10 aa, Dengue virus
DIIGKRIEKI

SEQ ID NO: 115833 - protein, 10 aa, Dengue virus
SWHYDQDHPY

SEQ ID NO: 115834 - protein, 10 aa, Dengue virus
WHYDQDHPYK

SEQ ID NO: 115835 - protein, 10 aa, Dengue virus
HYDQDHPYKT

SEQ ID NO: 115836 - protein, 10 aa, Dengue virus
YDQDHPYKTW

SEQ ID NO: 115837 - protein, 10 aa, Dengue virus
DQDHPYKTWA

SEQ ID NO: 115838 - protein, 10 aa, Dengue virus
QDHPYKTWAY

SEQ ID NO: 115839 - protein, 10 aa, Dengue virus
DHPYKTWAYH

SEQ ID NO: 115840 - protein, 10 aa, Dengue virus
HPYKTWAYHG

SEQ ID NO: 115841 - protein, 10 aa, Dengue virus
PYRTWAYHGS

SEQ ID NO: 115842 - protein, 10 aa, Dengue virus
YRTWAYHGSY

SEQ ID NO: 115843 - protein, 10 aa, Dengue virus
RTWAYHGSYE

SEQ ID NO: 115844 - protein, 10 aa, Dengue virus
TWAYHGSYET

SEQ ID NO: 115845 - protein, 10 aa, Dengue virus
WAYHGSYETK

SEQ ID NO: 115846 - protein, 10 aa, Dengue virus
AYHGSYETKQ

SEQ ID NO: 115847 - protein, 10 aa, Dengue virus
YHGSYETKQT

SEQ ID NO: 115848 - protein, 10 aa, Dengue virus
HGSYETKQTG

SEQ ID NO: 115849 - protein, 10 aa, Dengue virus
GSYETKQTGS

SEQ ID NO: 115850 - protein, 10 aa, Dengue virus
SYETKQTGSA

SEQ ID NO: 115851 - protein, 10 aa, Dengue virus
YETKQTGSAS

SEQ ID NO: 115852 - protein, 10 aa, Dengue virus
ETKQTGSASS

SEQ ID NO: 115853 - protein, 10 aa, Dengue virus
TKQTGSASSM

SEQ ID NO: 115854 - protein, 10 aa, Dengue virus
KQTGSASSMV

SEQ ID NO: 115855 - protein, 10 aa, Dengue virus
QTGSASSMVN

SEQ ID NO: 115856 - protein, 10 aa, Dengue virus
TGSASSMVNG

SEQ ID NO: 115857 - protein, 10 aa, Dengue virus
GSASSMINGV

SEQ ID NO: 115858 - protein, 10 aa, Dengue virus
SASSMINGVV

SEQ ID NO: 115859 - protein, 10 aa, Dengue virus
ASSMVNGVVK

SEQ ID NO: 115860 - protein, 10 aa, Dengue virus
SSMVNGVVKL

SEQ ID NO: 115861 - protein, 10 aa, Dengue virus
SMVNGVVKLL

SEQ ID NO: 115862 - protein, 10 aa, Dengue virus
MVNGVVKLLT

SEQ ID NO: 115863 - protein, 10 aa, Dengue virus
VNGVVKLLTK

SEQ ID NO: 115864 - protein, 10 aa, Dengue virus
NGVVRLLTKP

SEQ ID NO: 115865 - protein, 10 aa, Dengue virus
GVVRLLTKPW

SEQ ID NO: 115866 - protein, 10 aa, Dengue virus
VVRLLTKPWD

SEQ ID NO: 115867 - protein, 10 aa, Dengue virus
VRLLTKPWDV

SEQ ID NO: 115868 - protein, 10 aa, Dengue virus
KLLTKPWDVV

SEQ ID NO: 115869 - protein, 10 aa, Dengue virus
LLTKPWDVVP

SEQ ID NO: 115870 - protein, 10 aa, Dengue virus
LTKPWDVVPM

SEQ ID NO: 115871 - protein, 10 aa, Dengue virus
TKPWDVVPMV

SEQ ID NO: 115872 - protein, 10 aa, Dengue virus
KPWDVVPMVT

SEQ ID NO: 115873 - protein, 10 aa, Dengue virus
PWDVVPMVTQ

SEQ ID NO: 115874 - protein, 10 aa, Dengue virus
PMVTQMAMTD

SEQ ID NO: 115875 - protein, 10 aa, Dengue virus
MVTQMAMTDT

SEQ ID NO: 115876 - protein, 10 aa, Dengue virus
VTQIAMTDTT

SEQ ID NO: 115877 - protein, 10 aa, Dengue virus
TQIAMTDTTP

SEQ ID NO: 115878 - protein, 10 aa, Dengue virus
QIAMTDTTPF

SEQ ID NO: 115879 - protein, 10 aa, Dengue virus
IAMTDTTPFG

SEQ ID NO: 115880 - protein, 10 aa, Dengue virus
FKEKVDTRTQ

SEQ ID NO: 115881 - protein, 10 aa, Dengue virus
KEKVDTRTQE

SEQ ID NO: 115882 - protein, 10 aa, Dengue virus
CTREEFTKKV

SEQ ID NO: 115883 - protein, 10 aa, Dengue virus
TREEFTKKVR

SEQ ID NO: 115884 - protein, 10 aa, Dengue virus
RKVRSNAALG

SEQ ID NO: 115885 - protein, 10 aa, Dengue virus
KVRSNAALGA

SEQ ID NO: 115886 - protein, 10 aa, Dengue virus
VRSNAALGAI

SEQ ID NO: 115887 - protein, 10 aa, Dengue virus
RSNAALGAIF

SEQ ID NO: 115888 - protein, 10 aa, Dengue virus
SNAALGAIFT

SEQ ID NO: 115889 - protein, 10 aa, Dengue virus
NAALGAIFTD

SEQ ID NO: 115890 - protein, 10 aa, Dengue virus
AALGAIFTDE

SEQ ID NO: 115891 - protein, 10 aa, Dengue virus
ALGAIFTDEN

SEQ ID NO: 115892 - protein, 10 aa, Dengue virus
LGAIFTDENK

SEQ ID NO: 115893 - protein, 10 aa, Dengue virus
GAIFTDENKW

SEQ ID NO: 115894 - protein, 10 aa, Dengue virus
AIFTDENKWK

SEQ ID NO: 115895 - protein, 10 aa, Dengue virus
IFTDENKWKS

SEQ ID NO: 115896 - protein, 10 aa, Dengue virus
FTDENKWKSA

SEQ ID NO: 115897 - protein, 10 aa, Dengue virus
TDENKWKSAR

SEQ ID NO: 115898 - protein, 10 aa, Dengue virus
DENKWKSARE

SEQ ID NO: 115899 - protein, 10 aa, Dengue virus
ENKWKSAREA

SEQ ID NO: 115900 - protein, 10 aa, Dengue virus
NKWKSAREAV

SEQ ID NO: 115901 - protein, 10 aa, Dengue virus
KWKSAREAVE

SEQ ID NO: 115902 - protein, 10 aa, Dengue virus
WKSAREAVED

SEQ ID NO: 115903 - protein, 10 aa, Dengue virus
ERNLHLEGKC

SEQ ID NO: 115904 - protein, 10 aa, Dengue virus
RNLHLEGKCE

SEQ ID NO: 115905 - protein, 10 aa, Dengue virus
NLHLEGKCET

SEQ ID NO: 115906 - protein, 10 aa, Dengue virus
LHLEGKCETC

SEQ ID NO: 115907 - protein, 10 aa, Dengue virus
HLEGKCETCV

SEQ ID NO: 115908 - protein, 10 aa, Dengue virus
LEGKCETCVY

SEQ ID NO: 115909 - protein, 10 aa, Dengue virus
EGKCETCVYN

SEQ ID NO: 115910 - protein, 10 aa, Dengue virus
GKCETCVYNM

SEQ ID NO: 115911 - protein, 10 aa, Dengue virus
KCETCVYNMM

SEQ ID NO: 115912 - protein, 10 aa, Dengue virus
CETCVYNMMG

SEQ ID NO: 115913 - protein, 10 aa, Dengue virus
ETCVYNMMGK

SEQ ID NO: 115914 - protein, 10 aa, Dengue virus
SCVYNMMGKR

SEQ ID NO: 115915 - protein, 10 aa, Dengue virus
REKKLGEFGR

SEQ ID NO: 115916 - protein, 10 aa, Dengue virus
EKKLGEFGRA

SEQ ID NO: 115917 - protein, 10 aa, Dengue virus
KKLGEFGRAK

SEQ ID NO: 115918 - protein, 10 aa, Dengue virus
KLGEFGRAKG

SEQ ID NO: 115919 - protein, 10 aa, Dengue virus
LGEFGRAKGS

SEQ ID NO: 115920 - protein, 10 aa, Dengue virus
GEFGRAKGSR

SEQ ID NO: 115921 - protein, 10 aa, Dengue virus
EFGRAKGSRA

SEQ ID NO: 115922 - protein, 10 aa, Dengue virus
FGRAKGSRAI

SEQ ID NO: 115923 - protein, 10 aa, Dengue virus
GRAKGSRAIW

SEQ ID NO: 115924 - protein, 10 aa, Dengue virus
RAKGSRAIWY

SEQ ID NO: 115925 - protein, 10 aa, Dengue virus
IWYMWLGARY

SEQ ID NO: 115926 - protein, 10 aa, Dengue virus
WYMWLGARYL

SEQ ID NO: 115927 - protein, 10 aa, Dengue virus
YMWLGARYLE

SEQ ID NO: 115928 - protein, 10 aa, Dengue virus
MWLGARYLEF

SEQ ID NO: 115929 - protein, 10 aa, Dengue virus
WLGARYLEFE

SEQ ID NO: 115930 - protein, 10 aa, Dengue virus
LGARYLEFEA

SEQ ID NO: 115931 - protein, 10 aa, Dengue virus
GARYLEFEAL

SEQ ID NO: 115932 - protein, 10 aa, Dengue virus
ARYLEFEALG

SEQ ID NO: 115933 - protein, 10 aa, Dengue virus
RYLEFEALGF

SEQ ID NO: 115934 - protein, 10 aa, Dengue virus
FLEFEALGFL

SEQ ID NO: 115935 - protein, 10 aa, Dengue virus
LEFEALGFMN

SEQ ID NO: 115936 - protein, 10 aa, Dengue virus
EFEALGFMNE

SEQ ID NO: 115937 - protein, 10 aa, Dengue virus
FEALGFMNED

SEQ ID NO: 115938 - protein, 10 aa, Dengue virus
EALGFMNEDH

SEQ ID NO: 115939 - protein, 10 aa, Dengue virus
ALGFMNEDHW

SEQ ID NO: 115940 - protein, 10 aa, Dengue virus
LGFMNEDHWF

SEQ ID NO: 115941 - protein, 10 aa, Dengue virus
GFMNEDHWFS

SEQ ID NO: 115942 - protein, 10 aa, Dengue virus
FMNEDHWFSR

SEQ ID NO: 115943 - protein, 10 aa, Dengue virus
LNEDHWFSRE

SEQ ID NO: 115944 - protein, 10 aa, Dengue virus
NEDHWFSRGN

SEQ ID NO: 115945 - protein, 10 aa, Dengue virus
EDHWFSRGNS

SEQ ID NO: 115946 - protein, 10 aa, Dengue virus
DHWFSRENSY

SEQ ID NO: 115947 - protein, 10 aa, Dengue virus
HWFSRENSYS

SEQ ID NO: 115948 - protein, 10 aa, Dengue virus
WFSRENSYSG

SEQ ID NO: 115949 - protein, 10 aa, Dengue virus
FSRENSYSGV

SEQ ID NO: 115950 - protein, 10 aa, Dengue virus
SRENSYSGVE

SEQ ID NO: 115951 - protein, 10 aa, Dengue virus
RENSYSGVEG

SEQ ID NO: 115952 - protein, 10 aa, Dengue virus
ENSYSGVEGE

SEQ ID NO: 115953 - protein, 10 aa, Dengue virus
NSYSGVEGEG

SEQ ID NO: 115954 - protein, 10 aa, Dengue virus
SYSGVEGEGL

SEQ ID NO: 115955 - protein, 10 aa, Dengue virus
YSGVEGEGLH

SEQ ID NO: 115956 - protein, 10 aa, Dengue virus
SGVEGEGLHR

SEQ ID NO: 115957 - protein, 10 aa, Dengue virus
GVEGEGLHRL

SEQ ID NO: 115958 - protein, 10 aa, Dengue virus
VEGEGLHRLG

SEQ ID NO: 115959 - protein, 10 aa, Dengue virus
EGEGLHRLGY

SEQ ID NO: 115960 - protein, 10 aa, Dengue virus
GEGLHRLGYI

SEQ ID NO: 115961 - protein, 10 aa, Dengue virus
EGLHRLGYIL

SEQ ID NO: 115962 - protein, 10 aa, Dengue virus
GLHRLGYILR

SEQ ID NO: 115963 - protein, 10 aa, Dengue virus
GGNMYADDTA

SEQ ID NO: 115964 - protein, 10 aa, Dengue virus
GNMYADDTAG

SEQ ID NO: 115965 - protein, 10 aa, Dengue virus
NMYADDTAGW

SEQ ID NO: 115966 - protein, 10 aa, Dengue virus
TAGWDTRITL

SEQ ID NO: 115967 - protein, 10 aa, Dengue virus
AGWDTRITLE

SEQ ID NO: 115968 - protein, 10 aa, Dengue virus
GWDTRITLED

SEQ ID NO: 115969 - protein, 10 aa, Dengue virus
WDTRITLEDL

SEQ ID NO: 115970 - protein, 10 aa, Dengue virus
SIFKLTYQNK

SEQ ID NO: 115971 - protein, 10 aa, Dengue virus
KLTYQNKVVK

SEQ ID NO: 115972 - protein, 10 aa, Dengue virus
LTYQNKVVKV

SEQ ID NO: 115973 - protein, 10 aa, Dengue virus
TYQNKVVKVQ

SEQ ID NO: 115974 - protein, 10 aa, Dengue virus
YQNKVVKVQR

SEQ ID NO: 115975 - protein, 10 aa, Dengue virus
QNKVVKVQRP

SEQ ID NO: 115976 - protein, 10 aa, Dengue virus
NKVVRVQRPT

SEQ ID NO: 115977 - protein, 10 aa, Dengue virus
KVVRVQRPTP

SEQ ID NO: 115978 - protein, 10 aa, Dengue virus
GTVMDIISRR

SEQ ID NO: 115979 - protein, 10 aa, Dengue virus
TVMDIISRRD

SEQ ID NO: 115980 - protein, 10 aa, Dengue virus
VMDIISRKDQ

SEQ ID NO: 115981 - protein, 10 aa, Dengue virus
MDIISRKDQR

SEQ ID NO: 115982 - protein, 10 aa, Dengue virus
DIISRKDQRG

SEQ ID NO: 115983 - protein, 10 aa, Dengue virus
IISRKDQRGS

SEQ ID NO: 115984 - protein, 10 aa, Dengue virus
ISRKDQRGSG

SEQ ID NO: 115985 - protein, 10 aa, Dengue virus
SRKDQRGSGQ

SEQ ID NO: 115986 - protein, 10 aa, Dengue virus
RKDQRGSGQV

SEQ ID NO: 115987 - protein, 10 aa, Dengue virus
KDQRGSGQVG

SEQ ID NO: 115988 - protein, 10 aa, Dengue virus
DQRGSGQVVT

SEQ ID NO: 115989 - protein, 10 aa, Dengue virus
QRGSGQVVTY

SEQ ID NO: 115990 - protein, 10 aa, Dengue virus
RGSGQVVTYG

SEQ ID NO: 115991 - protein, 10 aa, Dengue virus
GSGQVVTYGL

SEQ ID NO: 115992 - protein, 10 aa, Dengue virus
SGQVVTYGLN

SEQ ID NO: 115993 - protein, 10 aa, Dengue virus
GQVVTYGLNT

SEQ ID NO: 115994 - protein, 10 aa, Dengue virus
FTNMEVQLIR

SEQ ID NO: 115995 - protein, 10 aa, Dengue virus
TNMEVQLIRQ

SEQ ID NO: 115996 - protein, 10 aa, Dengue virus
NMEVQLIRQM

SEQ ID NO: 115997 - protein, 10 aa, Dengue virus
MEVQLIRQME

SEQ ID NO: 115998 - protein, 10 aa, Dengue virus
AQLIRQMESE

SEQ ID NO: 115999 - protein, 10 aa, Dengue virus
QLIRQMEGEG

SEQ ID NO: 116000 - protein, 10 aa, Dengue virus
ERLSRMAISG

SEQ ID NO: 116001 - protein, 10 aa, Dengue virus
RLSRMAISGD

SEQ ID NO: 116002 - protein, 10 aa, Dengue virus
LSRMAISGDD

SEQ ID NO: 116003 - protein, 10 aa, Dengue virus
SRMAISGDDC

SEQ ID NO: 116004 - protein, 10 aa, Dengue virus
SGDDCVVKPL

SEQ ID NO: 116005 - protein, 10 aa, Dengue virus
GDDCVVKPLD

SEQ ID NO: 116006 - protein, 10 aa, Dengue virus
DDCVVKPLDD

SEQ ID NO: 116007 - protein, 10 aa, Dengue virus
DCVVKPLDDR

SEQ ID NO: 116008 - protein, 10 aa, Dengue virus
CVVKPLDDRF

SEQ ID NO: 116009 - protein, 10 aa, Dengue virus
ALLALNDMGK

SEQ ID NO: 116010 - protein, 10 aa, Dengue virus
ALNDMGKIRK

SEQ ID NO: 116011 - protein, 10 aa, Dengue virus
LNDMGKIRKD

SEQ ID NO: 116012 - protein, 10 aa, Dengue virus
NDMGKIRKDI

SEQ ID NO: 116013 - protein, 10 aa, Dengue virus
DMGKVRKDIQ

SEQ ID NO: 116014 - protein, 10 aa, Dengue virus
MGKVRKDIQQ

SEQ ID NO: 116015 - protein, 10 aa, Dengue virus
GKVRKDIQQW

SEQ ID NO: 116016 - protein, 10 aa, Dengue virus
KVRKDIPQWQ

SEQ ID NO: 116017 - protein, 10 aa, Dengue virus
VRKDIPQWQP

SEQ ID NO: 116018 - protein, 10 aa, Dengue virus
RKDIQQWEPS

SEQ ID NO: 116019 - protein, 10 aa, Dengue virus
KDIQQWEPSR

SEQ ID NO: 116020 - protein, 10 aa, Dengue virus
DIQQWEPSRG

SEQ ID NO: 116021 - protein, 10 aa, Dengue virus
IQQWEPSRGW

SEQ ID NO: 116022 - protein, 10 aa, Dengue virus
QWEPSRGWND

SEQ ID NO: 116023 - protein, 10 aa, Dengue virus
WEPSRGWNDW

SEQ ID NO: 116024 - protein, 10 aa, Dengue virus
GWNDWTQVPF

SEQ ID NO: 116025 - protein, 10 aa, Dengue virus
WNDWTQVPFC

SEQ ID NO: 116026 - protein, 10 aa, Dengue virus
NDWTQVPFCS

SEQ ID NO: 116027 - protein, 10 aa, Dengue virus
DWTQVPFCSH

SEQ ID NO: 116028 - protein, 10 aa, Dengue virus
WTQVPFCSHH

SEQ ID NO: 116029 - protein, 10 aa, Dengue virus
TQVPFCSHHF

SEQ ID NO: 116030 - protein, 10 aa, Dengue virus
EVPFCSHHFH

SEQ ID NO: 116031 - protein, 10 aa, Dengue virus
VPFCSHHFHQ

SEQ ID NO: 116032 - protein, 10 aa, Dengue virus
PFCSHHFHQL

SEQ ID NO: 116033 - protein, 10 aa, Dengue virus
FCSHHFHELI

SEQ ID NO: 116034 - protein, 10 aa, Dengue virus
CSHHFHELIM

SEQ ID NO: 116035 - protein, 10 aa, Dengue virus
SHHFHELIMK

SEQ ID NO: 116036 - protein, 10 aa, Dengue virus
HHFHELIMKD

SEQ ID NO: 116037 - protein, 10 aa, Dengue virus
HFHELIMKDG

SEQ ID NO: 116038 - protein, 10 aa, Dengue virus
FHELIMKDGR

SEQ ID NO: 116039 - protein, 10 aa, Dengue virus
LVVPCRNQDE

SEQ ID NO: 116040 - protein, 10 aa, Dengue virus
VVPCRPQDEL

SEQ ID NO: 116041 - protein, 10 aa, Dengue virus
VPCRNQDELI

SEQ ID NO: 116042 - protein, 10 aa, Dengue virus
PCRNQDELIG

SEQ ID NO: 116043 - protein, 10 aa, Dengue virus
CRNQDELIGR

SEQ ID NO: 116044 - protein, 10 aa, Dengue virus
RNQDELIGRA

SEQ ID NO: 116045 - protein, 10 aa, Dengue virus
NQDELIGRAR

SEQ ID NO: 116046 - protein, 10 aa, Dengue virus
QDELVGRARV

SEQ ID NO: 116047 - protein, 10 aa, Dengue virus
DELVGRARVS

SEQ ID NO: 116048 - protein, 10 aa, Dengue virus
ELVGRARVSQ

SEQ ID NO: 116049 - protein, 10 aa, Dengue virus
LVGRARVSQG

SEQ ID NO: 116050 - protein, 10 aa, Dengue virus
VGRARVSQGA

SEQ ID NO: 116051 - protein, 10 aa, Dengue virus
GRARVSQGAG

SEQ ID NO: 116052 - protein, 10 aa, Dengue virus
RARVSQGAGW

SEQ ID NO: 116053 - protein, 10 aa, Dengue virus
ARVSQGAGWS

SEQ ID NO: 116054 - protein, 10 aa, Dengue virus
RVSQGAGWSL

SEQ ID NO: 116055 - protein, 10 aa, Dengue virus
ISQGAGWSLR

SEQ ID NO: 116056 - protein, 10 aa, Dengue virus
SQGAGWSLKE

SEQ ID NO: 116057 - protein, 10 aa, Dengue virus
QGAGWSLKET

SEQ ID NO: 116058 - protein, 10 aa, Dengue virus
GAGWSLKETA

SEQ ID NO: 116059 - protein, 10 aa, Dengue virus
AGWSLKETAC

SEQ ID NO: 116060 - protein, 10 aa, Dengue virus
GWSLKETACL

SEQ ID NO: 116061 - protein, 10 aa, Dengue virus
WSLKETACLG

SEQ ID NO: 116062 - protein, 10 aa, Dengue virus
SLKETACLGK

SEQ ID NO: 116063 - protein, 10 aa, Dengue virus
LKETACLGKS

SEQ ID NO: 116064 - protein, 10 aa, Dengue virus
KETACLGKSY

SEQ ID NO: 116065 - protein, 10 aa, Dengue virus
ETACLGKAYA

SEQ ID NO: 116066 - protein, 10 aa, Dengue virus
TACLGKAYAQ

SEQ ID NO: 116067 - protein, 10 aa, Dengue virus
ACLGKAYAQM

SEQ ID NO: 116068 - protein, 10 aa, Dengue virus
CLGKAYAQMW

SEQ ID NO: 116069 - protein, 10 aa, Dengue virus
LGKAYAQMWS

SEQ ID NO: 116070 - protein, 10 aa, Dengue virus
GKAYAQMWSL

SEQ ID NO: 116071 - protein, 10 aa, Dengue virus
KAYAQMWSLM

SEQ ID NO: 116072 - protein, 10 aa, Dengue virus
AYAQMWSLMY

SEQ ID NO: 116073 - protein, 10 aa, Dengue virus
YAQMWSLMYF

SEQ ID NO: 116074 - protein, 10 aa, Dengue virus
AQMWSLMYFH

SEQ ID NO: 116075 - protein, 10 aa, Dengue virus
QMWSLMYFHR

SEQ ID NO: 116076 - protein, 10 aa, Dengue virus
MWSLMYFHRR

SEQ ID NO: 116077 - protein, 10 aa, Dengue virus
WSLMYFHRRD

SEQ ID NO: 116078 - protein, 10 aa, Dengue virus
SLMYFHRRDL

SEQ ID NO: 116079 - protein, 10 aa, Dengue virus
FHRRDLRLAS

SEQ ID NO: 116080 - protein, 10 aa, Dengue virus
HRRDLRLASN

SEQ ID NO: 116081 - protein, 10 aa, Dengue virus
RRDLRLASNA

SEQ ID NO: 116082 - protein, 10 aa, Dengue virus
RDLRLASNAI

SEQ ID NO: 116083 - protein, 10 aa, Dengue virus
DLRLASNAIC

SEQ ID NO: 116084 - protein, 10 aa, Dengue virus
LRLASNAICS

SEQ ID NO: 116085 - protein, 10 aa, Dengue virus
RLASNAICSA

SEQ ID NO: 116086 - protein, 10 aa, Dengue virus
LASNAICSAV

SEQ ID NO: 116087 - protein, 10 aa, Dengue virus
ASNAICSAVP

SEQ ID NO: 116088 - protein, 10 aa, Dengue virus
DWVPTSRTTW

SEQ ID NO: 116089 - protein, 10 aa, Dengue virus
WIPTSRTTWS

SEQ ID NO: 116090 - protein, 10 aa, Dengue virus
IPTSRTTWSI

SEQ ID NO: 116091 - protein, 10 aa, Dengue virus
SRTTWSIHAK

SEQ ID NO: 116092 - protein, 10 aa, Dengue virus
RTTWSIHAKH

SEQ ID NO: 116093 - protein, 10 aa, Dengue virus
TTWSIHAKHE

SEQ ID NO: 116094 - protein, 10 aa, Dengue virus
TWSIHAKHEW

SEQ ID NO: 116095 - protein, 10 aa, Dengue virus
WSIHAKHEWM

SEQ ID NO: 116096 - protein, 10 aa, Dengue virus
SIHAKHEWMT

SEQ ID NO: 116097 - protein, 10 aa, Dengue virus
IHAKHEWMTT

SEQ ID NO: 116098 - protein, 10 aa, Dengue virus
HAKHEWMTTE

SEQ ID NO: 116099 - protein, 10 aa, Dengue virus
AKHEWMTTED

SEQ ID NO: 116100 - protein, 10 aa, Dengue virus
KHEWMTTEDM

SEQ ID NO: 116101 - protein, 10 aa, Dengue virus
HEWMTTEDML

SEQ ID NO: 116102 - protein, 10 aa, Dengue virus
QWMTTEDMLT

SEQ ID NO: 116103 - protein, 10 aa, Dengue virus
WMTTEDMLTV

SEQ ID NO: 116104 - protein, 10 aa, Dengue virus
MTTEDMLTVW

SEQ ID NO: 116105 - protein, 10 aa, Dengue virus
TTEDMLTVWN

SEQ ID NO: 116106 - protein, 10 aa, Dengue virus
TEDMLTVWNR

SEQ ID NO: 116107 - protein, 10 aa, Dengue virus
EDMLTVWNRV

SEQ ID NO: 116108 - protein, 10 aa, Dengue virus
DMLTVWNRVW

SEQ ID NO: 116109 - protein, 10 aa, Dengue virus
MLTVWNRVWI

SEQ ID NO: 116110 - protein, 10 aa, Dengue virus
EVPYLGKRED

SEQ ID NO: 116111 - protein, 10 aa, Dengue virus
IPYLGKREDQ

SEQ ID NO: 116112 - protein, 10 aa, Dengue virus
PYLGKREDLW

SEQ ID NO: 116113 - protein, 10 aa, Dengue virus
YLGKREDLWC

SEQ ID NO: 116114 - protein, 10 aa, Dengue virus
LGKREDLWCG

SEQ ID NO: 116115 - protein, 10 aa, Dengue virus
GKREDLWCGS

SEQ ID NO: 116116 - protein, 10 aa, Dengue virus
KREDLWCGSL

SEQ ID NO: 116117 - protein, 10 aa, Dengue virus
REDLWCGSLI

SEQ ID NO: 116118 - protein, 10 aa, Dengue virus
EDLWCGSLIG

SEQ ID NO: 116119 - protein, 10 aa, Dengue virus
DLWCGSLIGL

SEQ ID NO: 116120 - protein, 10 aa, Dengue virus
LWCGSLIGLS

SEQ ID NO: 116121 - protein, 10 aa, Dengue virus
WCGSLIGLTA

SEQ ID NO: 116122 - protein, 10 aa, Dengue virus
CGSLIGLTAR

SEQ ID NO: 116123 - protein, 10 aa, Dengue virus
GSLIGLTARA

SEQ ID NO: 116124 - protein, 10 aa, Dengue virus
SLIGLTARAT

SEQ ID NO: 116125 - protein, 10 aa, Dengue virus
LIGLTARATW

SEQ ID NO: 116126 - protein, 10 aa, Dengue virus
IGLTARATWA

SEQ ID NO: 116127 - protein, 10 aa, Dengue virus
GLTSRATWAK

SEQ ID NO: 116128 - protein, 10 aa, Dengue virus
LTSRATWAKN

SEQ ID NO: 116129 - protein, 10 aa, Dengue virus
TSRATWAKNI

SEQ ID NO: 116130 - protein, 10 aa, Dengue virus
DYMTSMKRFK

SEQ ID NO: 116131 - protein, 10 aa, Dengue virus
PSINMLKRVR

SEQ ID NO: 116132 - protein, 10 aa, Dengue virus
SINMLKRVRN

SEQ ID NO: 116133 - protein, 10 aa, Dengue virus
INMLKRVRNR

SEQ ID NO: 116134 - protein, 10 aa, Dengue virus
NMLKRVRNRV

SEQ ID NO: 116135 - protein, 10 aa, Dengue virus
MLKRVRNRVS

SEQ ID NO: 116136 - protein, 10 aa, Dengue virus
LKRVRNRVST

SEQ ID NO: 116137 - protein, 10 aa, Dengue virus
RNRVSTGSQL

SEQ ID NO: 116138 - protein, 10 aa, Dengue virus
NRVSTGSQLA

SEQ ID NO: 116139 - protein, 10 aa, Dengue virus
RVSTGSQLAK

SEQ ID NO: 116140 - protein, 10 aa, Dengue virus
VSTGSQLAKR

SEQ ID NO: 116141 - protein, 10 aa, Dengue virus
STGSQLAKRF

SEQ ID NO: 116142 - protein, 10 aa, Dengue virus
TGSQLAKRFS

SEQ ID NO: 116143 - protein, 10 aa, Dengue virus
SQLAKRFSRG

SEQ ID NO: 116144 - protein, 10 aa, Dengue virus
QLAKRFSRGL

SEQ ID NO: 116145 - protein, 10 aa, Dengue virus
LAKRFSRGLL

SEQ ID NO: 116146 - protein, 10 aa, Dengue virus
AKRFSKGLLN

SEQ ID NO: 116147 - protein, 10 aa, Dengue virus
KRFSKGLLNG

SEQ ID NO: 116148 - protein, 10 aa, Dengue virus
RFSKGLLNGQ

SEQ ID NO: 116149 - protein, 10 aa, Dengue virus
FSKGLLNGQG

SEQ ID NO: 116150 - protein, 10 aa, Dengue virus
SKGLLNGQGP

SEQ ID NO: 116151 - protein, 10 aa, Dengue virus
GLLNGQGPMK

SEQ ID NO: 116152 - protein, 10 aa, Dengue virus
GKGPLRMVLA

SEQ ID NO: 116153 - protein, 10 aa, Dengue virus
MVLAFITFLR

SEQ ID NO: 116154 - protein, 10 aa, Dengue virus
VLAFITFLRV

SEQ ID NO: 116155 - protein, 10 aa, Dengue virus
LAFITFLRVL

SEQ ID NO: 116156 - protein, 10 aa, Dengue virus
AFITFLRVLS

SEQ ID NO: 116157 - protein, 10 aa, Dengue virus
FITFLRVLSI

SEQ ID NO: 116158 - protein, 10 aa, Dengue virus
ITFLRVLSIP

SEQ ID NO: 116159 - protein, 10 aa, Dengue virus
TFLRVLSIPP

SEQ ID NO: 116160 - protein, 10 aa, Dengue virus
FLRVLSIPPT

SEQ ID NO: 116161 - protein, 10 aa, Dengue virus
LRVLSIPPTA

SEQ ID NO: 116162 - protein, 10 aa, Dengue virus
RVLSIPPTAG

SEQ ID NO: 116163 - protein, 10 aa, Dengue virus
FLAIPPTAGV

SEQ ID NO: 116164 - protein, 10 aa, Dengue virus
LAIPPTAGVL

SEQ ID NO: 116165 - protein, 10 aa, Dengue virus
AIPPTAGVLA

SEQ ID NO: 116166 - protein, 10 aa, Dengue virus
IPPTAGVLAR

SEQ ID NO: 116167 - protein, 10 aa, Dengue virus
PPTAGVLARW

SEQ ID NO: 116168 - protein, 10 aa, Dengue virus
PTAGVLARWG

SEQ ID NO: 116169 - protein, 10 aa, Dengue virus
GFKKEISSML

SEQ ID NO: 116170 - protein, 10 aa, Dengue virus
AFHLTSRDGE

SEQ ID NO: 116171 - protein, 10 aa, Dengue virus
FHLTSRDGEP

SEQ ID NO: 116172 - protein, 10 aa, Dengue virus
HLTSRDGEPR

SEQ ID NO: 116173 - protein, 10 aa, Dengue virus
LTSRDGEPRM

SEQ ID NO: 116174 - protein, 10 aa, Dengue virus
TSRDGEPRMI

SEQ ID NO: 116175 - protein, 10 aa, Dengue virus
SRDGEPRMIV

SEQ ID NO: 116176 - protein, 10 aa, Dengue virus
NERGKSLLFK

SEQ ID NO: 116177 - protein, 10 aa, Dengue virus
ERGRPLLFKT

SEQ ID NO: 116178 - protein, 10 aa, Dengue virus
RGKSLLFKTA

SEQ ID NO: 116179 - protein, 10 aa, Dengue virus
NMCTLMAMDL

SEQ ID NO: 116180 - protein, 10 aa, Dengue virus
MCTLMAMDLG

SEQ ID NO: 116181 - protein, 10 aa, Dengue virus
CTLMAMDLGE

SEQ ID NO: 116182 - protein, 10 aa, Dengue virus
TLMAIDLGEL

SEQ ID NO: 116183 - protein, 10 aa, Dengue virus
LMAIDLGELC

SEQ ID NO: 116184 - protein, 10 aa, Dengue virus
AIDLGELCED

SEQ ID NO: 116185 - protein, 10 aa, Dengue virus
IDLGELCEDT

SEQ ID NO: 116186 - protein, 10 aa, Dengue virus
PEDIDCWCNL

SEQ ID NO: 116187 - protein, 10 aa, Dengue virus
EDIDCWCNLT

SEQ ID NO: 116188 - protein, 10 aa, Dengue virus
DIDCWCNLTS

SEQ ID NO: 116189 - protein, 10 aa, Dengue virus
IDCWCNLTST

SEQ ID NO: 116190 - protein, 10 aa, Dengue virus
DCWCNLTSTW

SEQ ID NO: 116191 - protein, 10 aa, Dengue virus
TSTWVMYGTC

SEQ ID NO: 116192 - protein, 10 aa, Dengue virus
GERRREKRSV

SEQ ID NO: 116193 - protein, 10 aa, Dengue virus
ERRREKRSVA

SEQ ID NO: 116194 - protein, 10 aa, Dengue virus
RRREKRSVAL

SEQ ID NO: 116195 - protein, 10 aa, Dengue virus
RREKRSVALT

SEQ ID NO: 116196 - protein, 10 aa, Dengue virus
REKRSVALTP

SEQ ID NO: 116197 - protein, 10 aa, Dengue virus
EKRSVALTPH

SEQ ID NO: 116198 - protein, 10 aa, Dengue virus
KRSVALTPHS

SEQ ID NO: 116199 - protein, 10 aa, Dengue virus
RSVALTPHSG

SEQ ID NO: 116200 - protein, 10 aa, Dengue virus
SVALAPHVGM

SEQ ID NO: 116201 - protein, 10 aa, Dengue virus
VALAPHVGMG

SEQ ID NO: 116202 - protein, 10 aa, Dengue virus
ALAPHVGMGL

SEQ ID NO: 116203 - protein, 10 aa, Dengue virus
LAPHVGMGLD

SEQ ID NO: 116204 - protein, 10 aa, Dengue virus
APHVGMGLDT

SEQ ID NO: 116205 - protein, 10 aa, Dengue virus
PHVGMGLDTR

SEQ ID NO: 116206 - protein, 10 aa, Dengue virus
GLETRAETWM

SEQ ID NO: 116207 - protein, 10 aa, Dengue virus
LETRAETWMS

SEQ ID NO: 116208 - protein, 10 aa, Dengue virus
ETRAETWMSS

SEQ ID NO: 116209 - protein, 10 aa, Dengue virus
TRAETWMSSE

SEQ ID NO: 116210 - protein, 10 aa, Dengue virus
RAETWMSSEG

SEQ ID NO: 116211 - protein, 10 aa, Dengue virus
AETWMSSEGA

SEQ ID NO: 116212 - protein, 10 aa, Dengue virus
TWMSSEGAWR

SEQ ID NO: 116213 - protein, 10 aa, Dengue virus
WMSAEGAWRQ

SEQ ID NO: 116214 - protein, 10 aa, Dengue virus
SSEGAWKHAQ

SEQ ID NO: 116215 - protein, 10 aa, Dengue virus
VESWILRNPG

SEQ ID NO: 116216 - protein, 10 aa, Dengue virus
ESWILRNPGF

SEQ ID NO: 116217 - protein, 10 aa, Dengue virus
SWILRNPGFA

SEQ ID NO: 116218 - protein, 10 aa, Dengue virus
TPSMTMRCVG

SEQ ID NO: 116219 - protein, 10 aa, Dengue virus
MRCVGVGNRD

SEQ ID NO: 116220 - protein, 10 aa, Dengue virus
RCVGVGNRDF

SEQ ID NO: 116221 - protein, 10 aa, Dengue virus
CVGVGNRDFV

SEQ ID NO: 116222 - protein, 10 aa, Dengue virus
VGVGNRDFVE

SEQ ID NO: 116223 - protein, 10 aa, Dengue virus
GVGNRDFVEG

SEQ ID NO: 116224 - protein, 10 aa, Dengue virus
SNRDFVEGVS

SEQ ID NO: 116225 - protein, 10 aa, Dengue virus
NRDFVEGLSG

SEQ ID NO: 116226 - protein, 10 aa, Dengue virus
DFVEGVSGGA

SEQ ID NO: 116227 - protein, 10 aa, Dengue virus
FVEGVSGGAW

SEQ ID NO: 116228 - protein, 10 aa, Dengue virus
VEGVSGGAWV

SEQ ID NO: 116229 - protein, 10 aa, Dengue virus
EGVSGGAWVD

SEQ ID NO: 116230 - protein, 10 aa, Dengue virus
GVSGGAWVDL

SEQ ID NO: 116231 - protein, 10 aa, Dengue virus
VSGGAWVDLV

SEQ ID NO: 116232 - protein, 10 aa, Dengue virus
SGGAWVDLVL

SEQ ID NO: 116233 - protein, 10 aa, Dengue virus
GGAWVDLVLE

SEQ ID NO: 116234 - protein, 10 aa, Dengue virus
GAWVDLVLEH

SEQ ID NO: 116235 - protein, 10 aa, Dengue virus
AWVDLVLEHG

SEQ ID NO: 116236 - protein, 10 aa, Dengue virus
WVDVVLEHGG

SEQ ID NO: 116237 - protein, 10 aa, Dengue virus
VDVVLEHGGC

SEQ ID NO: 116238 - protein, 10 aa, Dengue virus
DVVLEHGGCV

SEQ ID NO: 116239 - protein, 10 aa, Dengue virus
VVLEHGGCVT

SEQ ID NO: 116240 - protein, 10 aa, Dengue virus
HGGCVTTMAQ

SEQ ID NO: 116241 - protein, 10 aa, Dengue virus
GGCVTTMAKN

SEQ ID NO: 116242 - protein, 10 aa, Dengue virus
GCVTTMAKNK

SEQ ID NO: 116243 - protein, 10 aa, Dengue virus
CVTTMAQGKP

SEQ ID NO: 116244 - protein, 10 aa, Dengue virus
VTTMAQGKPT

SEQ ID NO: 116245 - protein, 10 aa, Dengue virus
TTMAQGKPTL

SEQ ID NO: 116246 - protein, 10 aa, Dengue virus
TMAQGKPTLD

SEQ ID NO: 116247 - protein, 10 aa, Dengue virus
MAKNKPTLDI

SEQ ID NO: 116248 - protein, 10 aa, Dengue virus
AKNKPTLDIE

SEQ ID NO: 116249 - protein, 10 aa, Dengue virus
KNKPTLDIEL

SEQ ID NO: 116250 - protein, 10 aa, Dengue virus
KPTLDIELQK

SEQ ID NO: 116251 - protein, 10 aa, Dengue virus
PTLDIELQKT

SEQ ID NO: 116252 - protein, 10 aa, Dengue virus
TLDIELQKTE

SEQ ID NO: 116253 - protein, 10 aa, Dengue virus
LDIELQKTEA

SEQ ID NO: 116254 - protein, 10 aa, Dengue virus
DIELQKTEAT

SEQ ID NO: 116255 - protein, 10 aa, Dengue virus
TTATRCPTQG

SEQ ID NO: 116256 - protein, 10 aa, Dengue virus
TATRCPTQGE

SEQ ID NO: 116257 - protein, 10 aa, Dengue virus
ATRCPTQGEP

SEQ ID NO: 116258 - protein, 10 aa, Dengue virus
CKHTYVDRGW

SEQ ID NO: 116259 - protein, 10 aa, Dengue virus
KHTYVDRGWG

SEQ ID NO: 116260 - protein, 10 aa, Dengue virus
HTYVDRGWGN

SEQ ID NO: 116261 - protein, 10 aa, Dengue virus
TYVDRGWGNG

SEQ ID NO: 116262 - protein, 10 aa, Dengue virus
YVDRGWGNGC

SEQ ID NO: 116263 - protein, 10 aa, Dengue virus
GCGLFGKGGV

SEQ ID NO: 116264 - protein, 10 aa, Dengue virus
CGLFGKGSLV

SEQ ID NO: 116265 - protein, 10 aa, Dengue virus
GLFGKGSLVT

SEQ ID NO: 116266 - protein, 10 aa, Dengue virus
LFGKGSLVTC

SEQ ID NO: 116267 - protein, 10 aa, Dengue virus
FGKGSLVTCA

SEQ ID NO: 116268 - protein, 10 aa, Dengue virus
GKGSLVTCAK

SEQ ID NO: 116269 - protein, 10 aa, Dengue virus
KGSLVTCAKF

SEQ ID NO: 116270 - protein, 10 aa, Dengue virus
TVHNGDTHAV

SEQ ID NO: 116271 - protein, 10 aa, Dengue virus
VHNGDTHAVG

SEQ ID NO: 116272 - protein, 10 aa, Dengue virus
HNGDTHAVGN

SEQ ID NO: 116273 - protein, 10 aa, Dengue virus
TGDQHQVGND

SEQ ID NO: 116274 - protein, 10 aa, Dengue virus
LGLECSPRTG

SEQ ID NO: 116275 - protein, 10 aa, Dengue virus
GLECSPRTGL

SEQ ID NO: 116276 - protein, 10 aa, Dengue virus
LECSPRTGLD

SEQ ID NO: 116277 - protein, 10 aa, Dengue virus
DCEPRSGIDF

SEQ ID NO: 116278 - protein, 10 aa, Dengue virus
PRTSLDFNEM

SEQ ID NO: 116279 - protein, 10 aa, Dengue virus
RSGIDFNEMI

SEQ ID NO: 116280 - protein, 10 aa, Dengue virus
SGIDFNEMIL

SEQ ID NO: 116281 - protein, 10 aa, Dengue virus
GIDFNEMILM

SEQ ID NO: 116282 - protein, 10 aa, Dengue virus
LDFNEMILLT

SEQ ID NO: 116283 - protein, 10 aa, Dengue virus
DFNEMILLTM

SEQ ID NO: 116284 - protein, 10 aa, Dengue virus
KAWMVHRQWF

SEQ ID NO: 116285 - protein, 10 aa, Dengue virus
AWMVHRQWFF

SEQ ID NO: 116286 - protein, 10 aa, Dengue virus
WMVHRQWFFD

SEQ ID NO: 116287 - protein, 10 aa, Dengue virus
MVHRQWFFDL

SEQ ID NO: 116288 - protein, 10 aa, Dengue virus
VHRQWFFDLP

SEQ ID NO: 116289 - protein, 10 aa, Dengue virus
HRQWFFDLPL

SEQ ID NO: 116290 - protein, 10 aa, Dengue virus
RQWFFDLPLP

SEQ ID NO: 116291 - protein, 10 aa, Dengue virus
WFFDLPLPWT

SEQ ID NO: 116292 - protein, 10 aa, Dengue virus
DLPLPWTAGA

SEQ ID NO: 116293 - protein, 10 aa, Dengue virus
KELLVTFKNA

SEQ ID NO: 116294 - protein, 10 aa, Dengue virus
ELLVTFKNAH

SEQ ID NO: 116295 - protein, 10 aa, Dengue virus
LLVTFKNAHA

SEQ ID NO: 116296 - protein, 10 aa, Dengue virus
LVTFKNAHAK

SEQ ID NO: 116297 - protein, 10 aa, Dengue virus
VTFKNAHAKK

SEQ ID NO: 116298 - protein, 10 aa, Dengue virus
TFKNAHAKKQ

SEQ ID NO: 116299 - protein, 10 aa, Dengue virus
FKNAHAKKQE

SEQ ID NO: 116300 - protein, 10 aa, Dengue virus
KNAHAKKQEV

SEQ ID NO: 116301 - protein, 10 aa, Dengue virus
NAHAKKQEVV

SEQ ID NO: 116302 - protein, 10 aa, Dengue virus
PHAKRQDVTV

SEQ ID NO: 116303 - protein, 10 aa, Dengue virus
HAKRQDVTVL

SEQ ID NO: 116304 - protein, 10 aa, Dengue virus
AKRQDVTVLG

SEQ ID NO: 116305 - protein, 10 aa, Dengue virus
KRQDVTVLGS

SEQ ID NO: 116306 - protein, 10 aa, Dengue virus
RQDVTVLGSQ

SEQ ID NO: 116307 - protein, 10 aa, Dengue virus
QDVTVLGSQE

SEQ ID NO: 116308 - protein, 10 aa, Dengue virus
DVTVLGSQEG

SEQ ID NO: 116309 - protein, 10 aa, Dengue virus
ALTGATEIQN

SEQ ID NO: 116310 - protein, 10 aa, Dengue virus
LTGATEIQNS

SEQ ID NO: 116311 - protein, 10 aa, Dengue virus
GGTSIFAGHL

SEQ ID NO: 116312 - protein, 10 aa, Dengue virus
GTSIFAGHLK

SEQ ID NO: 116313 - protein, 10 aa, Dengue virus
TSIFAGHLKC

SEQ ID NO: 116314 - protein, 10 aa, Dengue virus
SIFAGHLKCR

SEQ ID NO: 116315 - protein, 10 aa, Dengue virus
MFAGHLKCKV

SEQ ID NO: 116316 - protein, 10 aa, Dengue virus
FAGHLKCKVR

SEQ ID NO: 116317 - protein, 10 aa, Dengue virus
AGHLKCKVRM

SEQ ID NO: 116318 - protein, 10 aa, Dengue virus
GHLKCKVRME

SEQ ID NO: 116319 - protein, 10 aa, Dengue virus
HLKCKVRMEK

SEQ ID NO: 116320 - protein, 10 aa, Dengue virus
LKCKVRMEKL

SEQ ID NO: 116321 - protein, 10 aa, Dengue virus
KCRLKMDKLE

SEQ ID NO: 116322 - protein, 10 aa, Dengue virus
CRLKMDKLEL

SEQ ID NO: 116323 - protein, 10 aa, Dengue virus
RLKMDKLELK

SEQ ID NO: 116324 - protein, 10 aa, Dengue virus
LKMDKLELKG

SEQ ID NO: 116325 - protein, 10 aa, Dengue virus
KKEVSETQHG

SEQ ID NO: 116326 - protein, 10 aa, Dengue virus
KEVSETQHGT

SEQ ID NO: 116327 - protein, 10 aa, Dengue virus
EVSETQHGTI

SEQ ID NO: 116328 - protein, 10 aa, Dengue virus
VSETQHGTIL

SEQ ID NO: 116329 - protein, 10 aa, Dengue virus
SETQHGTILI

SEQ ID NO: 116330 - protein, 10 aa, Dengue virus
ETQHGTILIK

SEQ ID NO: 116331 - protein, 10 aa, Dengue virus
VTNIELEPPF

SEQ ID NO: 116332 - protein, 10 aa, Dengue virus
TNIELEPPFG

SEQ ID NO: 116333 - protein, 10 aa, Dengue virus
NIETEPPFGE

SEQ ID NO: 116334 - protein, 10 aa, Dengue virus
IETEPPFGES

SEQ ID NO: 116335 - protein, 10 aa, Dengue virus
EAEPPFGESN

SEQ ID NO: 116336 - protein, 10 aa, Dengue virus
AEPPFGESNI

SEQ ID NO: 116337 - protein, 10 aa, Dengue virus
RKGSSIGKMF

SEQ ID NO: 116338 - protein, 10 aa, Dengue virus
RGSSIGKMFE

SEQ ID NO: 116339 - protein, 10 aa, Dengue virus
GSSIGKMFES

SEQ ID NO: 116340 - protein, 10 aa, Dengue virus
SSIGKMFEST

SEQ ID NO: 116341 - protein, 10 aa, Dengue virus
IGKMFESTYR

SEQ ID NO: 116342 - protein, 10 aa, Dengue virus
GKMFESTYRG

SEQ ID NO: 116343 - protein, 10 aa, Dengue virus
KMFESTYRGA

SEQ ID NO: 116344 - protein, 10 aa, Dengue virus
MFESTYRGAK

SEQ ID NO: 116345 - protein, 10 aa, Dengue virus
FESTYRGAKR

SEQ ID NO: 116346 - protein, 10 aa, Dengue virus
ESTYRGAKRM

SEQ ID NO: 116347 - protein, 10 aa, Dengue virus
STYRGAKRMA

SEQ ID NO: 116348 - protein, 10 aa, Dengue virus
TYRGAKRMAI

SEQ ID NO: 116349 - protein, 10 aa, Dengue virus
YRGAKRMAIL

SEQ ID NO: 116350 - protein, 10 aa, Dengue virus
GAKRMAILGE

SEQ ID NO: 116351 - protein, 10 aa, Dengue virus
AKRMAILGET

SEQ ID NO: 116352 - protein, 10 aa, Dengue virus
KRMAILGETA

SEQ ID NO: 116353 - protein, 10 aa, Dengue virus
GDTAWDFGSV

SEQ ID NO: 116354 - protein, 10 aa, Dengue virus
DTAWDFGSVG

SEQ ID NO: 116355 - protein, 10 aa, Dengue virus
TAWDFGSVGG

SEQ ID NO: 116356 - protein, 10 aa, Dengue virus
AWDFGSVGGV

SEQ ID NO: 116357 - protein, 10 aa, Dengue virus
AYTALFSGVS

SEQ ID NO: 116358 - protein, 10 aa, Dengue virus
YTALFSGVSW

SEQ ID NO: 116359 - protein, 10 aa, Dengue virus
FSGVSWIMKI

SEQ ID NO: 116360 - protein, 10 aa, Dengue virus
LLTWIGLNSK

SEQ ID NO: 116361 - protein, 10 aa, Dengue virus
LTWIGLNSKN

SEQ ID NO: 116362 - protein, 10 aa, Dengue virus
TWIGLNSKNT

SEQ ID NO: 116363 - protein, 10 aa, Dengue virus
LYLGAMVQAD

SEQ ID NO: 116364 - protein, 10 aa, Dengue virus
GKELKCGSGI

SEQ ID NO: 116365 - protein, 10 aa, Dengue virus
LKCGSGIFVV

SEQ ID NO: 116366 - protein, 10 aa, Dengue virus
KCGSGIFVVD

SEQ ID NO: 116367 - protein, 10 aa, Dengue virus
CGSGIFVVDN

SEQ ID NO: 116368 - protein, 10 aa, Dengue virus
GSGIFVVDNV

SEQ ID NO: 116369 - protein, 10 aa, Dengue virus
SGIFVVDNVH

SEQ ID NO: 116370 - protein, 10 aa, Dengue virus
GIFVVDNVHT

SEQ ID NO: 116371 - protein, 10 aa, Dengue virus
IFVVDNVHTW

SEQ ID NO: 116372 - protein, 10 aa, Dengue virus
FVVDNVHTWT

SEQ ID NO: 116373 - protein, 10 aa, Dengue virus
VVDNVHTWTE

SEQ ID NO: 116374 - protein, 10 aa, Dengue virus
VDNVHTWTEQ

SEQ ID NO: 116375 - protein, 10 aa, Dengue virus
QYKFQPESPA

SEQ ID NO: 116376 - protein, 10 aa, Dengue virus
YKFQPESPAR

SEQ ID NO: 116377 - protein, 10 aa, Dengue virus
KFQPESPARL

SEQ ID NO: 116378 - protein, 10 aa, Dengue virus
FQADSPKRLA

SEQ ID NO: 116379 - protein, 10 aa, Dengue virus
QADSPKRLAT

SEQ ID NO: 116380 - protein, 10 aa, Dengue virus
ADSPKRLATA

SEQ ID NO: 116381 - protein, 10 aa, Dengue virus
DSPKRLATAI

SEQ ID NO: 116382 - protein, 10 aa, Dengue virus
SPKRLATAIA

SEQ ID NO: 116383 - protein, 10 aa, Dengue virus
PKRLATAIAG

SEQ ID NO: 116384 - protein, 10 aa, Dengue virus
KRLATAIAGA

SEQ ID NO: 116385 - protein, 10 aa, Dengue virus
GVCGIRSTTR

SEQ ID NO: 116386 - protein, 10 aa, Dengue virus
VCGIRSTTRM

SEQ ID NO: 116387 - protein, 10 aa, Dengue virus
CGIRSTTRME

SEQ ID NO: 116388 - protein, 10 aa, Dengue virus
GIRSTTRMEN

SEQ ID NO: 116389 - protein, 10 aa, Dengue virus
IRSTTRMENL

SEQ ID NO: 116390 - protein, 10 aa, Dengue virus
RSTTRMENLL

SEQ ID NO: 116391 - protein, 10 aa, Dengue virus
STTRMENLLW

SEQ ID NO: 116392 - protein, 10 aa, Dengue virus
TRMENLLWKQ

SEQ ID NO: 116393 - protein, 10 aa, Dengue virus
RMENLLWKQI

SEQ ID NO: 116394 - protein, 10 aa, Dengue virus
YSWKAWGKAK

SEQ ID NO: 116395 - protein, 10 aa, Dengue virus
RAWNVWEVED

SEQ ID NO: 116396 - protein, 10 aa, Dengue virus
AWNVWEVEDY

SEQ ID NO: 116397 - protein, 10 aa, Dengue virus
WNVWEVEDYG

SEQ ID NO: 116398 - protein, 10 aa, Dengue virus
NVWEVEDYGF

SEQ ID NO: 116399 - protein, 10 aa, Dengue virus
VWEVEDYGFG

SEQ ID NO: 116400 - protein, 10 aa, Dengue virus
WEVEDYGFGV

SEQ ID NO: 116401 - protein, 10 aa, Dengue virus
EVEDYGFGMF

SEQ ID NO: 116402 - protein, 10 aa, Dengue virus
VEDYGFGMFT

SEQ ID NO: 116403 - protein, 10 aa, Dengue virus
EDYGFGMFTT

SEQ ID NO: 116404 - protein, 10 aa, Dengue virus
DYGFGMFTTN

SEQ ID NO: 116405 - protein, 10 aa, Dengue virus
YGFGMFTTNI

SEQ ID NO: 116406 - protein, 10 aa, Dengue virus
GFGMFTTNIW

SEQ ID NO: 116407 - protein, 10 aa, Dengue virus
FGMFTTNIWM

SEQ ID NO: 116408 - protein, 10 aa, Dengue virus
GMFTTNIWMK

SEQ ID NO: 116409 - protein, 10 aa, Dengue virus
CDHRLMSAAV

SEQ ID NO: 116410 - protein, 10 aa, Dengue virus
DHRLMSAAVK

SEQ ID NO: 116411 - protein, 10 aa, Dengue virus
HRLMSAAVKD

SEQ ID NO: 116412 - protein, 10 aa, Dengue virus
KDERAVHADM

SEQ ID NO: 116413 - protein, 10 aa, Dengue virus
DERAVHADMG

SEQ ID NO: 116414 - protein, 10 aa, Dengue virus
ERAVHADMGY

SEQ ID NO: 116415 - protein, 10 aa, Dengue virus
ADMGYWIESQ

SEQ ID NO: 116416 - protein, 10 aa, Dengue virus
DMGYWIESQK

SEQ ID NO: 116417 - protein, 10 aa, Dengue virus
MGYWIESQKN

SEQ ID NO: 116418 - protein, 10 aa, Dengue virus
WPRSHTLWSN

SEQ ID NO: 116419 - protein, 10 aa, Dengue virus
PRSHTLWSNG

SEQ ID NO: 116420 - protein, 10 aa, Dengue virus
RSHTLWSNGV

SEQ ID NO: 116421 - protein, 10 aa, Dengue virus
LWSNGVLESQ

SEQ ID NO: 116422 - protein, 10 aa, Dengue virus
WSNGVLESQM

SEQ ID NO: 116423 - protein, 10 aa, Dengue virus
SNGVLESQML

SEQ ID NO: 116424 - protein, 10 aa, Dengue virus
NGVLESQMLI

SEQ ID NO: 116425 - protein, 10 aa, Dengue virus
GVLESQMLIP

SEQ ID NO: 116426 - protein, 10 aa, Dengue virus
VLESQMLIPK

SEQ ID NO: 116427 - protein, 10 aa, Dengue virus
TQTVGPWHLG

SEQ ID NO: 116428 - protein, 10 aa, Dengue virus
QTVGPWHLGK

SEQ ID NO: 116429 - protein, 10 aa, Dengue virus
TVGPWHLGKL

SEQ ID NO: 116430 - protein, 10 aa, Dengue virus
AGPWHLGRLE

SEQ ID NO: 116431 - protein, 10 aa, Dengue virus
GPWHLGKLEI

SEQ ID NO: 116432 - protein, 10 aa, Dengue virus
PWHLGKLEID

SEQ ID NO: 116433 - protein, 10 aa, Dengue virus
WHLGKLEIDF

SEQ ID NO: 116434 - protein, 10 aa, Dengue virus
CDHRGPSLRT

SEQ ID NO: 116435 - protein, 10 aa, Dengue virus
DHRGPSLRTT

SEQ ID NO: 116436 - protein, 10 aa, Dengue virus
HRGPSLRTTT

SEQ ID NO: 116437 - protein, 10 aa, Dengue virus
GPSLRTTTVS

SEQ ID NO: 116438 - protein, 10 aa, Dengue virus
PSLRTTTVSG

SEQ ID NO: 116439 - protein, 10 aa, Dengue virus
SLRTTTVSGK

SEQ ID NO: 116440 - protein, 10 aa, Dengue virus
LRTTTVSGKL

SEQ ID NO: 116441 - protein, 10 aa, Dengue virus
RTTTVSGKLI

SEQ ID NO: 116442 - protein, 10 aa, Dengue virus
TTTVSGKLIH

SEQ ID NO: 116443 - protein, 10 aa, Dengue virus
TTVSGKLIHE

SEQ ID NO: 116444 - protein, 10 aa, Dengue virus
TVSGKLIHEW

SEQ ID NO: 116445 - protein, 10 aa, Dengue virus
VSGKLIHEWC

SEQ ID NO: 116446 - protein, 10 aa, Dengue virus
SGKLIHEWCC

SEQ ID NO: 116447 - protein, 10 aa, Dengue virus
GKLIHEWCCR

SEQ ID NO: 116448 - protein, 10 aa, Dengue virus
KLIHEWCCRS

SEQ ID NO: 116449 - protein, 10 aa, Dengue virus
LIHEWCCRSC

SEQ ID NO: 116450 - protein, 10 aa, Dengue virus
VTQWCCRSCT

SEQ ID NO: 116451 - protein, 10 aa, Dengue virus
TQWCCRSCTM

SEQ ID NO: 116452 - protein, 10 aa, Dengue virus
RSCTMPPLRF

SEQ ID NO: 116453 - protein, 10 aa, Dengue virus
SCTLPPLRYM

SEQ ID NO: 116454 - protein, 10 aa, Dengue virus
CTLPPLRYMG

SEQ ID NO: 116455 - protein, 10 aa, Dengue virus
TLPPLRYMGE

SEQ ID NO: 116456 - protein, 10 aa, Dengue virus
LPPLRYMGED

SEQ ID NO: 116457 - protein, 10 aa, Dengue virus
PPLRYMGEDG

SEQ ID NO: 116458 - protein, 10 aa, Dengue virus
PLRYMGEDGC

SEQ ID NO: 116459 - protein, 10 aa, Dengue virus
LRYMGEDGCW

SEQ ID NO: 116460 - protein, 10 aa, Dengue virus
RYMGEDGCWY

SEQ ID NO: 116461 - protein, 10 aa, Dengue virus
YMGEDGCWYG

SEQ ID NO: 116462 - protein, 10 aa, Dengue virus
KGEDGCWYGM

SEQ ID NO: 116463 - protein, 10 aa, Dengue virus
CWYGMEIRPI

SEQ ID NO: 116464 - protein, 10 aa, Dengue virus
MGMGVTYLAL

SEQ ID NO: 116465 - protein, 10 aa, Dengue virus
RKLTSRENLL

SEQ ID NO: 116466 - protein, 10 aa, Dengue virus
LTSKELMMAT

SEQ ID NO: 116467 - protein, 10 aa, Dengue virus
QMANGIALGL

SEQ ID NO: 116468 - protein, 10 aa, Dengue virus
MANGIALGLM

SEQ ID NO: 116469 - protein, 10 aa, Dengue virus
RSWPLNEGVM

SEQ ID NO: 116470 - protein, 10 aa, Dengue virus
SWPLNEGVMA

SEQ ID NO: 116471 - protein, 10 aa, Dengue virus
WPLNEGVMAV

SEQ ID NO: 116472 - protein, 10 aa, Dengue virus
PLNEGVMAVG

SEQ ID NO: 116473 - protein, 10 aa, Dengue virus
VSILASSLLR

SEQ ID NO: 116474 - protein, 10 aa, Dengue virus
SILASSLLRN

SEQ ID NO: 116475 - protein, 10 aa, Dengue virus
ILASSLLRND

SEQ ID NO: 116476 - protein, 10 aa, Dengue virus
LASSLLRNDV

SEQ ID NO: 116477 - protein, 10 aa, Dengue virus
ASSLLRNDVP

SEQ ID NO: 116478 - protein, 10 aa, Dengue virus
SSLLRNDVPM

SEQ ID NO: 116479 - protein, 10 aa, Dengue virus
SLLRNDVPMA

SEQ ID NO: 116480 - protein, 10 aa, Dengue virus
LLRNDVPMAG

SEQ ID NO: 116481 - protein, 10 aa, Dengue virus
LRNDVPMAGP

SEQ ID NO: 116482 - protein, 10 aa, Dengue virus
RNDVPMAGPL

SEQ ID NO: 116483 - protein, 10 aa, Dengue virus
NDVPMAGPLV

SEQ ID NO: 116484 - protein, 10 aa, Dengue virus
DVPMAGPLVA

SEQ ID NO: 116485 - protein, 10 aa, Dengue virus
VPMAGPLVAG

SEQ ID NO: 116486 - protein, 10 aa, Dengue virus
PMAGPLVAGG

SEQ ID NO: 116487 - protein, 10 aa, Dengue virus
MAGPLVAGGL

SEQ ID NO: 116488 - protein, 10 aa, Dengue virus
AGPLVAGGLL

SEQ ID NO: 116489 - protein, 10 aa, Dengue virus
GPLVAGGLLI

SEQ ID NO: 116490 - protein, 10 aa, Dengue virus
PLVAGGLLIA

SEQ ID NO: 116491 - protein, 10 aa, Dengue virus
LVAGGLLIAC

SEQ ID NO: 116492 - protein, 10 aa, Dengue virus
VAGGLLIACY

SEQ ID NO: 116493 - protein, 10 aa, Dengue virus
AGGLLIACYV

SEQ ID NO: 116494 - protein, 10 aa, Dengue virus
GGLLIACYVI

SEQ ID NO: 116495 - protein, 10 aa, Dengue virus
GLLIACYVIT

SEQ ID NO: 116496 - protein, 10 aa, Dengue virus
LLIACYVITG

SEQ ID NO: 116497 - protein, 10 aa, Dengue virus
LIACYVITGT

SEQ ID NO: 116498 - protein, 10 aa, Dengue virus
IACYVITGTS

SEQ ID NO: 116499 - protein, 10 aa, Dengue virus
ACYVITGTSA

SEQ ID NO: 116500 - protein, 10 aa, Dengue virus
CYVITGTSAD

SEQ ID NO: 116501 - protein, 10 aa, Dengue virus
YVITGTSADL

SEQ ID NO: 116502 - protein, 10 aa, Dengue virus
VITGTSADLT

SEQ ID NO: 116503 - protein, 10 aa, Dengue virus
ITGTSADLTV

SEQ ID NO: 116504 - protein, 10 aa, Dengue virus
TGTSADLTVE

SEQ ID NO: 116505 - protein, 10 aa, Dengue virus
GTSADLTVEK

SEQ ID NO: 116506 - protein, 10 aa, Dengue virus
EAEQTGVSHN

SEQ ID NO: 116507 - protein, 10 aa, Dengue virus
AEQTGVSHNL

SEQ ID NO: 116508 - protein, 10 aa, Dengue virus
EQTGVSHNLM

SEQ ID NO: 116509 - protein, 10 aa, Dengue virus
DDDGTMRIKD

SEQ ID NO: 116510 - protein, 10 aa, Dengue virus
DDGTMRIKDD

SEQ ID NO: 116511 - protein, 10 aa, Dengue virus
DGTMRIKDDE

SEQ ID NO: 116512 - protein, 10 aa, Dengue virus
GTMRIKDDET

SEQ ID NO: 116513 - protein, 10 aa, Dengue virus
TMRIKDDETE

SEQ ID NO: 116514 - protein, 10 aa, Dengue virus
LTVLLKTALL

SEQ ID NO: 116515 - protein, 10 aa, Dengue virus
TVLLKTALLI

SEQ ID NO: 116516 - protein, 10 aa, Dengue virus
VLLKTALLIV

SEQ ID NO: 116517 - protein, 10 aa, Dengue virus
LLKTALLIVS

SEQ ID NO: 116518 - protein, 10 aa, Dengue virus
LKTALLIVSG

SEQ ID NO: 116519 - protein, 10 aa, Dengue virus
QTQRSGVLWD

SEQ ID NO: 116520 - protein, 10 aa, Dengue virus
TQRSGVLWDV

SEQ ID NO: 116521 - protein, 10 aa, Dengue virus
QRSGVLWDVP

SEQ ID NO: 116522 - protein, 10 aa, Dengue virus
RSGVLWDVPS

SEQ ID NO: 116523 - protein, 10 aa, Dengue virus
SGVLWDVPSP

SEQ ID NO: 116524 - protein, 10 aa, Dengue virus
GALWDVPSPA

SEQ ID NO: 116525 - protein, 10 aa, Dengue virus
VLWDVPSPPE

SEQ ID NO: 116526 - protein, 10 aa, Dengue virus
AELEEGVYRI

SEQ ID NO: 116527 - protein, 10 aa, Dengue virus
LEEGVYRIKQ

SEQ ID NO: 116528 - protein, 10 aa, Dengue virus
GKTQVGVGVQ

SEQ ID NO: 116529 - protein, 10 aa, Dengue virus
KTQVGVGVQK

SEQ ID NO: 116530 - protein, 10 aa, Dengue virus
TQVGVGVQKE

SEQ ID NO: 116531 - protein, 10 aa, Dengue virus
EGVFHTMWHV

SEQ ID NO: 116532 - protein, 10 aa, Dengue virus
GTFHTMWHVT

SEQ ID NO: 116533 - protein, 10 aa, Dengue virus
WHVTRGSVIC

SEQ ID NO: 116534 - protein, 10 aa, Dengue virus
HVTRGAVLTY

SEQ ID NO: 116535 - protein, 10 aa, Dengue virus
RGKRIEPSWA

SEQ ID NO: 116536 - protein, 10 aa, Dengue virus
GKRLEPNWAS

SEQ ID NO: 116537 - protein, 10 aa, Dengue virus
KRLEPNWASV

SEQ ID NO: 116538 - protein, 10 aa, Dengue virus
RLEPNWASVK

SEQ ID NO: 116539 - protein, 10 aa, Dengue virus
LEPNWASVKK

SEQ ID NO: 116540 - protein, 10 aa, Dengue virus
EPNWASVKKD

SEQ ID NO: 116541 - protein, 10 aa, Dengue virus
PNWASVKKDL

SEQ ID NO: 116542 - protein, 10 aa, Dengue virus
WADVRNDMIS

SEQ ID NO: 116543 - protein, 10 aa, Dengue virus
ADVRNDMISY

SEQ ID NO: 116544 - protein, 10 aa, Dengue virus
DVRNDMISYG

SEQ ID NO: 116545 - protein, 10 aa, Dengue virus
DMISYGGGWR

SEQ ID NO: 116546 - protein, 10 aa, Dengue virus
LISYGGGWRF

SEQ ID NO: 116547 - protein, 10 aa, Dengue virus
WQKGEEVQVI

SEQ ID NO: 116548 - protein, 10 aa, Dengue virus
QKGEEVQVIA

SEQ ID NO: 116549 - protein, 10 aa, Dengue virus
KGEEVQVIAV

SEQ ID NO: 116550 - protein, 10 aa, Dengue virus
EEDVQVLAIE

SEQ ID NO: 116551 - protein, 10 aa, Dengue virus
EDVQVLAIEP

SEQ ID NO: 116552 - protein, 10 aa, Dengue virus
DVQVLAIEPG

SEQ ID NO: 116553 - protein, 10 aa, Dengue virus
VQVLAIEPGK

SEQ ID NO: 116554 - protein, 10 aa, Dengue virus
QVLAIEPGKN

SEQ ID NO: 116555 - protein, 10 aa, Dengue virus
VLAIEPGKNP

SEQ ID NO: 116556 - protein, 10 aa, Dengue virus
LAIEPGKNPK

SEQ ID NO: 116557 - protein, 10 aa, Dengue virus
AIEPGKNPKH

SEQ ID NO: 116558 - protein, 10 aa, Dengue virus
VEPGKNPKNF

SEQ ID NO: 116559 - protein, 10 aa, Dengue virus
EPGKNPKNFQ

SEQ ID NO: 116560 - protein, 10 aa, Dengue virus
PGKNPKNFQT

SEQ ID NO: 116561 - protein, 10 aa, Dengue virus
TGEIGAIALD

SEQ ID NO: 116562 - protein, 10 aa, Dengue virus
GEIGAIALDF

SEQ ID NO: 116563 - protein, 10 aa, Dengue virus
EIGAIALDFK

SEQ ID NO: 116564 - protein, 10 aa, Dengue virus
IGAIALDFKP

SEQ ID NO: 116565 - protein, 10 aa, Dengue virus
GAVTLDFKPG

SEQ ID NO: 116566 - protein, 10 aa, Dengue virus
AVTLDFKPGT

SEQ ID NO: 116567 - protein, 10 aa, Dengue virus
VTLDFKPGTS

SEQ ID NO: 116568 - protein, 10 aa, Dengue virus
TLDFKPGTSG

SEQ ID NO: 116569 - protein, 10 aa, Dengue virus
SPGTSGSPIV

SEQ ID NO: 116570 - protein, 10 aa, Dengue virus
PGTSGSPIVD

SEQ ID NO: 116571 - protein, 10 aa, Dengue virus
GTSGSPIVDR

SEQ ID NO: 116572 - protein, 10 aa, Dengue virus
EGKVVGLYGN

SEQ ID NO: 116573 - protein, 10 aa, Dengue virus
GKVIGLYGNG

SEQ ID NO: 116574 - protein, 10 aa, Dengue virus
KVIGLYGNGV

SEQ ID NO: 116575 - protein, 10 aa, Dengue virus
VIGLYGNGVV

SEQ ID NO: 116576 - protein, 10 aa, Dengue virus
GLYGNGVVTK

SEQ ID NO: 116577 - protein, 10 aa, Dengue virus
LYGNGVVTKN

SEQ ID NO: 116578 - protein, 10 aa, Dengue virus
YGNGVVTKNG

SEQ ID NO: 116579 - protein, 10 aa, Dengue virus
GNGVVTKNGG

SEQ ID NO: 116580 - protein, 10 aa, Dengue virus
NGVVTKNGGY

SEQ ID NO: 116581 - protein, 10 aa, Dengue virus
GVVTKNGGYV

SEQ ID NO: 116582 - protein, 10 aa, Dengue virus
VVTKNGGYVS

SEQ ID NO: 116583 - protein, 10 aa, Dengue virus
NGGYVSGIAQ

SEQ ID NO: 116584 - protein, 10 aa, Dengue virus
GGYVSGIAQT

SEQ ID NO: 116585 - protein, 10 aa, Dengue virus
MFKKRNLTIM

SEQ ID NO: 116586 - protein, 10 aa, Dengue virus
FRKKRLTIMD

SEQ ID NO: 116587 - protein, 10 aa, Dengue virus
RKKRLTIMDL

SEQ ID NO: 116588 - protein, 10 aa, Dengue virus
KRRLTIMDLH

SEQ ID NO: 116589 - protein, 10 aa, Dengue virus
RRLTIMDLHP

SEQ ID NO: 116590 - protein, 10 aa, Dengue virus
LHPGSGKTRK

SEQ ID NO: 116591 - protein, 10 aa, Dengue virus
HPGSGKTRKY

SEQ ID NO: 116592 - protein, 10 aa, Dengue virus
PGSGKTRKYL

SEQ ID NO: 116593 - protein, 10 aa, Dengue virus
GSGKTRKYLP

SEQ ID NO: 116594 - protein, 10 aa, Dengue virus
SGKTRKYLPA

SEQ ID NO: 116595 - protein, 10 aa, Dengue virus
GKTRKYLPAI

SEQ ID NO: 116596 - protein, 10 aa, Dengue virus
RILPSIVREA

SEQ ID NO: 116597 - protein, 10 aa, Dengue virus
YLPAIIREAI

SEQ ID NO: 116598 - protein, 10 aa, Dengue virus
LPAIIREAIK

SEQ ID NO: 116599 - protein, 10 aa, Dengue virus
PAIIREAIKR

SEQ ID NO: 116600 - protein, 10 aa, Dengue virus
REAIKRRLRT

SEQ ID NO: 116601 - protein, 10 aa, Dengue virus
EAIKRRLRTL

SEQ ID NO: 116602 - protein, 10 aa, Dengue virus
KRRLRTLILA

SEQ ID NO: 116603 - protein, 10 aa, Dengue virus
RRLRTLILAP

SEQ ID NO: 116604 - protein, 10 aa, Dengue virus
RLRTLILAPT

SEQ ID NO: 116605 - protein, 10 aa, Dengue virus
VLAPTRVVAS

SEQ ID NO: 116606 - protein, 10 aa, Dengue virus
VAAEMEEALK

SEQ ID NO: 116607 - protein, 10 aa, Dengue virus
AAEMEEALKG

SEQ ID NO: 116608 - protein, 10 aa, Dengue virus
AEMEEALKGL

SEQ ID NO: 116609 - protein, 10 aa, Dengue virus
EMEEALKGLP

SEQ ID NO: 116610 - protein, 10 aa, Dengue virus
MEEALKGLPI

SEQ ID NO: 116611 - protein, 10 aa, Dengue virus
EEALKGLPIR

SEQ ID NO: 116612 - protein, 10 aa, Dengue virus
EALKGLPIRY

SEQ ID NO: 116613 - protein, 10 aa, Dengue virus
ALKGLPIRYQ

SEQ ID NO: 116614 - protein, 10 aa, Dengue virus
LKGLPIRYQT

SEQ ID NO: 116615 - protein, 10 aa, Dengue virus
KGLPIRYQTT

SEQ ID NO: 116616 - protein, 10 aa, Dengue virus
GLPIRYQTTA

SEQ ID NO: 116617 - protein, 10 aa, Dengue virus
LPIRYQTTAT

SEQ ID NO: 116618 - protein, 10 aa, Dengue virus
RAEHTGREIV

SEQ ID NO: 116619 - protein, 10 aa, Dengue virus
AEHTGREIVD

SEQ ID NO: 116620 - protein, 10 aa, Dengue virus
TFTMRLLSPI

SEQ ID NO: 116621 - protein, 10 aa, Dengue virus
FTMRLLSPIR

SEQ ID NO: 116622 - protein, 10 aa, Dengue virus
TMRLLSPIRV

SEQ ID NO: 116623 - protein, 10 aa, Dengue virus
MRLLSPIRVP

SEQ ID NO: 116624 - protein, 10 aa, Dengue virus
RLLSPIRVPN

SEQ ID NO: 116625 - protein, 10 aa, Dengue virus
LLSPIRVPNY

SEQ ID NO: 116626 - protein, 10 aa, Dengue virus
LSPIRVPNYN

SEQ ID NO: 116627 - protein, 10 aa, Dengue virus
SSTRVPNYNL

SEQ ID NO: 116628 - protein, 10 aa, Dengue virus
STRVPNYNLI

SEQ ID NO: 116629 - protein, 10 aa, Dengue virus
TRVPNYNLIV

SEQ ID NO: 116630 - protein, 10 aa, Dengue virus
RVPNYNLIVM

SEQ ID NO: 116631 - protein, 10 aa, Dengue virus
VPNYNLIVMD

SEQ ID NO: 116632 - protein, 10 aa, Dengue virus
PNYNLIVMDE

SEQ ID NO: 116633 - protein, 10 aa, Dengue virus
NYNLIVMDEA

SEQ ID NO: 116634 - protein, 10 aa, Dengue virus
YNLIVMDEAH

SEQ ID NO: 116635 - protein, 10 aa, Dengue virus
NLIVMDEAHF

SEQ ID NO: 116636 - protein, 10 aa, Dengue virus
LIVMDEAHFT

SEQ ID NO: 116637 - protein, 10 aa, Dengue virus
VIMDEAHFTD

SEQ ID NO: 116638 - protein, 10 aa, Dengue virus
EAHFTDPSSV

SEQ ID NO: 116639 - protein, 10 aa, Dengue virus
AHFTDPSSVA

SEQ ID NO: 116640 - protein, 10 aa, Dengue virus
HFTDPSSVAA

SEQ ID NO: 116641 - protein, 10 aa, Dengue virus
FTDPSSVAAR

SEQ ID NO: 116642 - protein, 10 aa, Dengue virus
TDPSSVAARG

SEQ ID NO: 116643 - protein, 10 aa, Dengue virus
DPSSVAARGY

SEQ ID NO: 116644 - protein, 10 aa, Dengue virus
PSSVAARGYI

SEQ ID NO: 116645 - protein, 10 aa, Dengue virus
SSVAARGYIS

SEQ ID NO: 116646 - protein, 10 aa, Dengue virus
TRVEMGEAAA

SEQ ID NO: 116647 - protein, 10 aa, Dengue virus
RVEMGEAAAI

SEQ ID NO: 116648 - protein, 10 aa, Dengue virus
VEMGEAAAIF

SEQ ID NO: 116649 - protein, 10 aa, Dengue virus
EMGEAAAIFM

SEQ ID NO: 116650 - protein, 10 aa, Dengue virus
IFMTATPPGA

SEQ ID NO: 116651 - protein, 10 aa, Dengue virus
DAFPQSNAPI

SEQ ID NO: 116652 - protein, 10 aa, Dengue virus
IIDEEREIPE

SEQ ID NO: 116653 - protein, 10 aa, Dengue virus
IDEEREIPER

SEQ ID NO: 116654 - protein, 10 aa, Dengue virus
DIEREIPERS

SEQ ID NO: 116655 - protein, 10 aa, Dengue virus
IEREIPERSW

SEQ ID NO: 116656 - protein, 10 aa, Dengue virus
EKDIPERSWN

SEQ ID NO: 116657 - protein, 10 aa, Dengue virus
REIPERSWNT

SEQ ID NO: 116658 - protein, 10 aa, Dengue virus
EIPERSWNTG

SEQ ID NO: 116659 - protein, 10 aa, Dengue virus
IPERSWNSGN

SEQ ID NO: 116660 - protein, 10 aa, Dengue virus
FAGKTVWFVP

SEQ ID NO: 116661 - protein, 10 aa, Dengue virus
AGKTVWFVPS

SEQ ID NO: 116662 - protein, 10 aa, Dengue virus
TVWFVPSIKT

SEQ ID NO: 116663 - protein, 10 aa, Dengue virus
VWFVPSIKTG

SEQ ID NO: 116664 - protein, 10 aa, Dengue virus
WFVPSIKTGN

SEQ ID NO: 116665 - protein, 10 aa, Dengue virus
FVPSIKTGND

SEQ ID NO: 116666 - protein, 10 aa, Dengue virus
VPSIKTGNDI

SEQ ID NO: 116667 - protein, 10 aa, Dengue virus
PSIKTGNDIA

SEQ ID NO: 116668 - protein, 10 aa, Dengue virus
SIKAGNDIAN

SEQ ID NO: 116669 - protein, 10 aa, Dengue virus
IKAGNDIANC

SEQ ID NO: 116670 - protein, 10 aa, Dengue virus
KAGNDIANCL

SEQ ID NO: 116671 - protein, 10 aa, Dengue virus
AGNDIANCLR

SEQ ID NO: 116672 - protein, 10 aa, Dengue virus
NDIANCLRKS

SEQ ID NO: 116673 - protein, 10 aa, Dengue virus
DIANCLRKSG

SEQ ID NO: 116674 - protein, 10 aa, Dengue virus
IANCLRKSGK

SEQ ID NO: 116675 - protein, 10 aa, Dengue virus
ANCLRKNGKK

SEQ ID NO: 116676 - protein, 10 aa, Dengue virus
NCLRKNGKKV

SEQ ID NO: 116677 - protein, 10 aa, Dengue virus
CLRKSGKKVI

SEQ ID NO: 116678 - protein, 10 aa, Dengue virus
LRKSGKKVIQ

SEQ ID NO: 116679 - protein, 10 aa, Dengue virus
RKSGKKVIQL

SEQ ID NO: 116680 - protein, 10 aa, Dengue virus
KSGKKVIQLS

SEQ ID NO: 116681 - protein, 10 aa, Dengue virus
SGKKVIQLSR

SEQ ID NO: 116682 - protein, 10 aa, Dengue virus
VQLSRKTFDT

SEQ ID NO: 116683 - protein, 10 aa, Dengue virus
SRKTFDTEYP

SEQ ID NO: 116684 - protein, 10 aa, Dengue virus
RKTFDTEYPK

SEQ ID NO: 116685 - protein, 10 aa, Dengue virus
TNDWDFVVTT

SEQ ID NO: 116686 - protein, 10 aa, Dengue virus
TDWDFVVTTD

SEQ ID NO: 116687 - protein, 10 aa, Dengue virus
SEMGANFKAD

SEQ ID NO: 116688 - protein, 10 aa, Dengue virus
EMGANFKADR

SEQ ID NO: 116689 - protein, 10 aa, Dengue virus
MGANFKADRV

SEQ ID NO: 116690 - protein, 10 aa, Dengue virus
GANFKADRVI

SEQ ID NO: 116691 - protein, 10 aa, Dengue virus
ANFKADRVID

SEQ ID NO: 116692 - protein, 10 aa, Dengue virus
NFKADRVIDP

SEQ ID NO: 116693 - protein, 10 aa, Dengue virus
FKADRVIDPR

SEQ ID NO: 116694 - protein, 10 aa, Dengue virus
KADRVIDPRR

SEQ ID NO: 116695 - protein, 10 aa, Dengue virus
AGRVIDPRRC

SEQ ID NO: 116696 - protein, 10 aa, Dengue virus
GRVIDPRRCL

SEQ ID NO: 116697 - protein, 10 aa, Dengue virus
RRCLKPVILT

SEQ ID NO: 116698 - protein, 10 aa, Dengue virus
RCLKPVILTD

SEQ ID NO: 116699 - protein, 10 aa, Dengue virus
CLKPVILTDG

SEQ ID NO: 116700 - protein, 10 aa, Dengue virus
LKPVILTDGP

SEQ ID NO: 116701 - protein, 10 aa, Dengue virus
KPVILTDGPE

SEQ ID NO: 116702 - protein, 10 aa, Dengue virus
PVILTDGPER

SEQ ID NO: 116703 - protein, 10 aa, Dengue virus
VILTDGPERV

SEQ ID NO: 116704 - protein, 10 aa, Dengue virus
ILTDGPERVI

SEQ ID NO: 116705 - protein, 10 aa, Dengue virus
LTDGPERVIL

SEQ ID NO: 116706 - protein, 10 aa, Dengue virus
TDGPERVILA

SEQ ID NO: 116707 - protein, 10 aa, Dengue virus
DGEERVVLAG

SEQ ID NO: 116708 - protein, 10 aa, Dengue virus
PERVILAGPI

SEQ ID NO: 116709 - protein, 10 aa, Dengue virus
ILAGPMPVTA

SEQ ID NO: 116710 - protein, 10 aa, Dengue virus
LAGPMPVTAA

SEQ ID NO: 116711 - protein, 10 aa, Dengue virus
AGPMPVTAAS

SEQ ID NO: 116712 - protein, 10 aa, Dengue virus
GPMPVTAASA

SEQ ID NO: 116713 - protein, 10 aa, Dengue virus
PMPVTAASAA

SEQ ID NO: 116714 - protein, 10 aa, Dengue virus
MPVTAASAAQ

SEQ ID NO: 116715 - protein, 10 aa, Dengue virus
PVTAASAAQR

SEQ ID NO: 116716 - protein, 10 aa, Dengue virus
VTAASAAQRR

SEQ ID NO: 116717 - protein, 10 aa, Dengue virus
TAASAAQRRG

SEQ ID NO: 116718 - protein, 10 aa, Dengue virus
AASAAQRRGR

SEQ ID NO: 116719 - protein, 10 aa, Dengue virus
ASAAQRRGRV

SEQ ID NO: 116720 - protein, 10 aa, Dengue virus
QRRGRVGRNP

SEQ ID NO: 116721 - protein, 10 aa, Dengue virus
KENDQYIFTG

SEQ ID NO: 116722 - protein, 10 aa, Dengue virus
ENDQYIFTGQ

SEQ ID NO: 116723 - protein, 10 aa, Dengue virus
NDQYIFTGQP

SEQ ID NO: 116724 - protein, 10 aa, Dengue virus
DQYIFTGQPL

SEQ ID NO: 116725 - protein, 10 aa, Dengue virus
FTGQPLNNDE

SEQ ID NO: 116726 - protein, 10 aa, Dengue virus
TGQPLNNDED

SEQ ID NO: 116727 - protein, 10 aa, Dengue virus
GDPLKNDEDH

SEQ ID NO: 116728 - protein, 10 aa, Dengue virus
DPLKNDEDHA

SEQ ID NO: 116729 - protein, 10 aa, Dengue virus
PLKNDEDHAH

SEQ ID NO: 116730 - protein, 10 aa, Dengue virus
LKNDEDHAHW

SEQ ID NO: 116731 - protein, 10 aa, Dengue virus
KNDEDHAHWT

SEQ ID NO: 116732 - protein, 10 aa, Dengue virus
IYTPEGIIPT

SEQ ID NO: 116733 - protein, 10 aa, Dengue virus
YTPEGIIPTL

SEQ ID NO: 116734 - protein, 10 aa, Dengue virus
TPEGIIPTLF

SEQ ID NO: 116735 - protein, 10 aa, Dengue virus
PEGIIPTLFG

SEQ ID NO: 116736 - protein, 10 aa, Dengue virus
EGIIPTLFGP

SEQ ID NO: 116737 - protein, 10 aa, Dengue virus
GIIPTLFGPE

SEQ ID NO: 116738 - protein, 10 aa, Dengue virus
IIPTLFGPER

SEQ ID NO: 116739 - protein, 10 aa, Dengue virus
IPTLFGPERE

SEQ ID NO: 116740 - protein, 10 aa, Dengue virus
PTLFGPEREK

SEQ ID NO: 116741 - protein, 10 aa, Dengue virus
TLFGPEREKT

SEQ ID NO: 116742 - protein, 10 aa, Dengue virus
LFGPEREKTQ

SEQ ID NO: 116743 - protein, 10 aa, Dengue virus
FGPEREKTQA

SEQ ID NO: 116744 - protein, 10 aa, Dengue virus
GPEREKTQAI

SEQ ID NO: 116745 - protein, 10 aa, Dengue virus
PEREKTQAID

SEQ ID NO: 116746 - protein, 10 aa, Dengue virus
EREKTQAIDG

SEQ ID NO: 116747 - protein, 10 aa, Dengue virus
REKTQAIDGE

SEQ ID NO: 116748 - protein, 10 aa, Dengue virus
EKTQAIDGEF

SEQ ID NO: 116749 - protein, 10 aa, Dengue virus
KTQAIDGEFR

SEQ ID NO: 116750 - protein, 10 aa, Dengue virus
TQAIDGEFRL

SEQ ID NO: 116751 - protein, 10 aa, Dengue virus
AAIDGEYRLK

SEQ ID NO: 116752 - protein, 10 aa, Dengue virus
AIDGEFRLRG

SEQ ID NO: 116753 - protein, 10 aa, Dengue virus
IDGEFRLRGE

SEQ ID NO: 116754 - protein, 10 aa, Dengue virus
DGEFRLRGEQ

SEQ ID NO: 116755 - protein, 10 aa, Dengue virus
GEFRLRGEQR

SEQ ID NO: 116756 - protein, 10 aa, Dengue virus
EFRLRGEQRK

SEQ ID NO: 116757 - protein, 10 aa, Dengue virus
FRLRGEQRKT

SEQ ID NO: 116758 - protein, 10 aa, Dengue virus
RLRGEQRKTF

SEQ ID NO: 116759 - protein, 10 aa, Dengue virus
LRGEQRKTFV

SEQ ID NO: 116760 - protein, 10 aa, Dengue virus
KGESRKTFVE

SEQ ID NO: 116761 - protein, 10 aa, Dengue virus
GESRKTFVEL

SEQ ID NO: 116762 - protein, 10 aa, Dengue virus
ESRKTFVELM

SEQ ID NO: 116763 - protein, 10 aa, Dengue virus
SRKTFVELMR

SEQ ID NO: 116764 - protein, 10 aa, Dengue virus
RGDLPVWLAH

SEQ ID NO: 116765 - protein, 10 aa, Dengue virus
GDLPVWLAHK

SEQ ID NO: 116766 - protein, 10 aa, Dengue virus
DLPVWLAHKV

SEQ ID NO: 116767 - protein, 10 aa, Dengue virus
LPVWLAHKVA

SEQ ID NO: 116768 - protein, 10 aa, Dengue virus
PVWLAYKVAA

SEQ ID NO: 116769 - protein, 10 aa, Dengue virus
YADRRWCFDG

SEQ ID NO: 116770 - protein, 10 aa, Dengue virus
KNNQILEENV

SEQ ID NO: 116771 - protein, 10 aa, Dengue virus
NNQILEENMD

SEQ ID NO: 116772 - protein, 10 aa, Dengue virus
NQILEENMDV

SEQ ID NO: 116773 - protein, 10 aa, Dengue virus
QILEENMDVE

SEQ ID NO: 116774 - protein, 10 aa, Dengue virus
ILEENMDVEI

SEQ ID NO: 116775 - protein, 10 aa, Dengue virus
LEENMEVEIW

SEQ ID NO: 116776 - protein, 10 aa, Dengue virus
EENMEVEIWT

SEQ ID NO: 116777 - protein, 10 aa, Dengue virus
ENMEVEIWTK

SEQ ID NO: 116778 - protein, 10 aa, Dengue virus
NMEVEIWTKE

SEQ ID NO: 116779 - protein, 10 aa, Dengue virus
MEVEIWTKEG

SEQ ID NO: 116780 - protein, 10 aa, Dengue virus
EKKKLRPRWL

SEQ ID NO: 116781 - protein, 10 aa, Dengue virus
KKKLRPRWLD

SEQ ID NO: 116782 - protein, 10 aa, Dengue virus
KKLRPKWLDA

SEQ ID NO: 116783 - protein, 10 aa, Dengue virus
KLRPKWLDAR

SEQ ID NO: 116784 - protein, 10 aa, Dengue virus
LRPRWLDARV

SEQ ID NO: 116785 - protein, 10 aa, Dengue virus
RPRWLDARVY

SEQ ID NO: 116786 - protein, 10 aa, Dengue virus
PRWLDARVYA

SEQ ID NO: 116787 - protein, 10 aa, Dengue virus
RWLDARVYAD

SEQ ID NO: 116788 - protein, 10 aa, Dengue virus
WLDARVYADP

SEQ ID NO: 116789 - protein, 10 aa, Dengue virus
LDARVYADPM

SEQ ID NO: 116790 - protein, 10 aa, Dengue virus
DARVYADPMA

SEQ ID NO: 116791 - protein, 10 aa, Dengue virus
ARVYADPMAL

SEQ ID NO: 116792 - protein, 10 aa, Dengue virus
RTYSDPLALK

SEQ ID NO: 116793 - protein, 10 aa, Dengue virus
TYSDPLALKE

SEQ ID NO: 116794 - protein, 10 aa, Dengue virus
YADPMALKDF

SEQ ID NO: 116795 - protein, 10 aa, Dengue virus
ADPMALKDFK

SEQ ID NO: 116796 - protein, 10 aa, Dengue virus
DPLALKEFKD

SEQ ID NO: 116797 - protein, 10 aa, Dengue virus
PLALKEFKDF

SEQ ID NO: 116798 - protein, 10 aa, Dengue virus
LALKEFKDFA

SEQ ID NO: 116799 - protein, 10 aa, Dengue virus
ALKEFKDFAA

SEQ ID NO: 116800 - protein, 10 aa, Dengue virus
LKEFKDFAAG

SEQ ID NO: 116801 - protein, 10 aa, Dengue virus
KEFKDFAAGR

SEQ ID NO: 116802 - protein, 10 aa, Dengue virus
EFKDFAAGRK

SEQ ID NO: 116803 - protein, 10 aa, Dengue virus
FKDFAAGRKS

SEQ ID NO: 116804 - protein, 10 aa, Dengue virus
KDFAAGRKSI

SEQ ID NO: 116805 - protein, 10 aa, Dengue virus
FAAGRKSIAL

SEQ ID NO: 116806 - protein, 10 aa, Dengue virus
DLVTEIGRVP

SEQ ID NO: 116807 - protein, 10 aa, Dengue virus
TEIGRVPSHL

SEQ ID NO: 116808 - protein, 10 aa, Dengue virus
EIGRVPSHLA

SEQ ID NO: 116809 - protein, 10 aa, Dengue virus
RDALDNLAVL

SEQ ID NO: 116810 - protein, 10 aa, Dengue virus
NALDNLAVLH

SEQ ID NO: 116811 - protein, 10 aa, Dengue virus
ALDNLVMLHT

SEQ ID NO: 116812 - protein, 10 aa, Dengue virus
LDNLVMLHTS

SEQ ID NO: 116813 - protein, 10 aa, Dengue virus
DNLVMLHTSE

SEQ ID NO: 116814 - protein, 10 aa, Dengue virus
AYRHAVEELP

SEQ ID NO: 116815 - protein, 10 aa, Dengue virus
YRHAVEELPE

SEQ ID NO: 116816 - protein, 10 aa, Dengue virus
RHAVEELPET

SEQ ID NO: 116817 - protein, 10 aa, Dengue virus
HAVEELPETM

SEQ ID NO: 116818 - protein, 10 aa, Dengue virus
AVEELPETME

SEQ ID NO: 116819 - protein, 10 aa, Dengue virus
VEELPETMET

SEQ ID NO: 116820 - protein, 10 aa, Dengue virus
EELPETMETL

SEQ ID NO: 116821 - protein, 10 aa, Dengue virus
ELPETMETLL

SEQ ID NO: 116822 - protein, 10 aa, Dengue virus
LPETMETLLL

SEQ ID NO: 116823 - protein, 10 aa, Dengue virus
PETMETLLLL

SEQ ID NO: 116824 - protein, 10 aa, Dengue virus
ETMETLLLLG

SEQ ID NO: 116825 - protein, 10 aa, Dengue virus
TMETLLLLGL

SEQ ID NO: 116826 - protein, 10 aa, Dengue virus
METLLLLGLM

SEQ ID NO: 116827 - protein, 10 aa, Dengue virus
ETLLLLGLMI

SEQ ID NO: 116828 - protein, 10 aa, Dengue virus
GKTSIGLICV

SEQ ID NO: 116829 - protein, 10 aa, Dengue virus
IPLQWIASAI

SEQ ID NO: 116830 - protein, 10 aa, Dengue virus
PLQWIASAIV

SEQ ID NO: 116831 - protein, 10 aa, Dengue virus
PQWIAASIIL

SEQ ID NO: 116832 - protein, 10 aa, Dengue virus
QWIAASIILE

SEQ ID NO: 116833 - protein, 10 aa, Dengue virus
SAIVLEFFMM

SEQ ID NO: 116834 - protein, 10 aa, Dengue virus
AIVLEFFMMV

SEQ ID NO: 116835 - protein, 10 aa, Dengue virus
IVLEFFMMVL

SEQ ID NO: 116836 - protein, 10 aa, Dengue virus
VLEFFMMVLL

SEQ ID NO: 116837 - protein, 10 aa, Dengue virus
LEFFMMVLLI

SEQ ID NO: 116838 - protein, 10 aa, Dengue virus
EFFMMVLLIP

SEQ ID NO: 116839 - protein, 10 aa, Dengue virus
FFMMVLLIPE

SEQ ID NO: 116840 - protein, 10 aa, Dengue virus
FMMVLLIPEP

SEQ ID NO: 116841 - protein, 10 aa, Dengue virus
MMVLLIPEPE

SEQ ID NO: 116842 - protein, 10 aa, Dengue virus
MVLLIPEPEK

SEQ ID NO: 116843 - protein, 10 aa, Dengue virus
QRTPQDNQLI

SEQ ID NO: 116844 - protein, 10 aa, Dengue virus
RTPQDNQLIY

SEQ ID NO: 116845 - protein, 10 aa, Dengue virus
TPQDNQLIYV

SEQ ID NO: 116846 - protein, 10 aa, Dengue virus
PQDNQLIYVI

SEQ ID NO: 116847 - protein, 10 aa, Dengue virus
QDNQLIYVIL

SEQ ID NO: 116848 - protein, 10 aa, Dengue virus
DNQLIYVILT

SEQ ID NO: 116849 - protein, 10 aa, Dengue virus
NQLAYVVIGI

SEQ ID NO: 116850 - protein, 10 aa, Dengue virus
QLAYVVIGIL

SEQ ID NO: 116851 - protein, 10 aa, Dengue virus
LAYVVIGILT

SEQ ID NO: 116852 - protein, 10 aa, Dengue virus
IAANEMGLLE

SEQ ID NO: 116853 - protein, 10 aa, Dengue virus
AANEMGLIEK

SEQ ID NO: 116854 - protein, 10 aa, Dengue virus
ANEMGLIEKT

SEQ ID NO: 116855 - protein, 10 aa, Dengue virus
NEMGLIEKTK

SEQ ID NO: 116856 - protein, 10 aa, Dengue virus
EMGLLETTKR

SEQ ID NO: 116857 - protein, 10 aa, Dengue virus
MGLLETTKRD

SEQ ID NO: 116858 - protein, 10 aa, Dengue virus
GLLETTKRDL

SEQ ID NO: 116859 - protein, 10 aa, Dengue virus
LLETTKRDLG

SEQ ID NO: 116860 - protein, 10 aa, Dengue virus
LDVDLRPASA

SEQ ID NO: 116861 - protein, 10 aa, Dengue virus
DVDLRPASAW

SEQ ID NO: 116862 - protein, 10 aa, Dengue virus
VDLRPASAWT

SEQ ID NO: 116863 - protein, 10 aa, Dengue virus
WTLYAVATTV

SEQ ID NO: 116864 - protein, 10 aa, Dengue virus
TLYAVATTFV

SEQ ID NO: 116865 - protein, 10 aa, Dengue virus
LYAVATTFVT

SEQ ID NO: 116866 - protein, 10 aa, Dengue virus
YAVATTFVTP

SEQ ID NO: 116867 - protein, 10 aa, Dengue virus
AVATTFVTPM

SEQ ID NO: 116868 - protein, 10 aa, Dengue virus
ITPMLRHTIE

SEQ ID NO: 116869 - protein, 10 aa, Dengue virus
TPMLRHTIEN

SEQ ID NO: 116870 - protein, 10 aa, Dengue virus
PMLRHTIENS

SEQ ID NO: 116871 - protein, 10 aa, Dengue virus
MLRHTIENST

SEQ ID NO: 116872 - protein, 10 aa, Dengue virus
LRHTIENSTA

SEQ ID NO: 116873 - protein, 10 aa, Dengue virus
RHTIENSTAN

SEQ ID NO: 116874 - protein, 10 aa, Dengue virus
HTIENSTANV

SEQ ID NO: 116875 - protein, 10 aa, Dengue virus
TIENSTANVS

SEQ ID NO: 116876 - protein, 10 aa, Dengue virus
IENSTANVSL

SEQ ID NO: 116877 - protein, 10 aa, Dengue virus
ENSTANVSLA

SEQ ID NO: 116878 - protein, 10 aa, Dengue virus
NSTANVSLAA

SEQ ID NO: 116879 - protein, 10 aa, Dengue virus
STANVSLAAI

SEQ ID NO: 116880 - protein, 10 aa, Dengue virus
TANVSLAAIA

SEQ ID NO: 116881 - protein, 10 aa, Dengue virus
ANVSLAAIAN

SEQ ID NO: 116882 - protein, 10 aa, Dengue virus
NVSLAAIANQ

SEQ ID NO: 116883 - protein, 10 aa, Dengue virus
VSLAAIANQA

SEQ ID NO: 116884 - protein, 10 aa, Dengue virus
SLAAIANQAV

SEQ ID NO: 116885 - protein, 10 aa, Dengue virus
LAAIANQAVV

SEQ ID NO: 116886 - protein, 10 aa, Dengue virus
AAIANQAVVL

SEQ ID NO: 116887 - protein, 10 aa, Dengue virus
AIANQAVVLM

SEQ ID NO: 116888 - protein, 10 aa, Dengue virus
IANQAVVLMG

SEQ ID NO: 116889 - protein, 10 aa, Dengue virus
ANQAVVLMGL

SEQ ID NO: 116890 - protein, 10 aa, Dengue virus
NQAVVLMGLD

SEQ ID NO: 116891 - protein, 10 aa, Dengue virus
QAVVLMGLDK

SEQ ID NO: 116892 - protein, 10 aa, Dengue virus
AVVLMGLDKG

SEQ ID NO: 116893 - protein, 10 aa, Dengue virus
VVLMGLDKGW

SEQ ID NO: 116894 - protein, 10 aa, Dengue virus
VLMGLDKGWP

SEQ ID NO: 116895 - protein, 10 aa, Dengue virus
LMGLGRGWPL

SEQ ID NO: 116896 - protein, 10 aa, Dengue virus
MGLGKGWPLH

SEQ ID NO: 116897 - protein, 10 aa, Dengue virus
GLGKGWPLHR

SEQ ID NO: 116898 - protein, 10 aa, Dengue virus
LGKGWPLHRM

SEQ ID NO: 116899 - protein, 10 aa, Dengue virus
GKGWPLHRMD

SEQ ID NO: 116900 - protein, 10 aa, Dengue virus
KGWPISKMDL

SEQ ID NO: 116901 - protein, 10 aa, Dengue virus
GWPISKMDLG

SEQ ID NO: 116902 - protein, 10 aa, Dengue virus
WPISKMDLGV

SEQ ID NO: 116903 - protein, 10 aa, Dengue virus
PISKMDLGVP

SEQ ID NO: 116904 - protein, 10 aa, Dengue virus
ISKMDLGVPL

SEQ ID NO: 116905 - protein, 10 aa, Dengue virus
HRMDLGVPLL

SEQ ID NO: 116906 - protein, 10 aa, Dengue virus
RMDLGVPLLA

SEQ ID NO: 116907 - protein, 10 aa, Dengue virus
MDLGVPLLAL

SEQ ID NO: 116908 - protein, 10 aa, Dengue virus
DLGVPLLALG

SEQ ID NO: 116909 - protein, 10 aa, Dengue virus
LGVPLLALGC

SEQ ID NO: 116910 - protein, 10 aa, Dengue virus
GVPLLAMGCY

SEQ ID NO: 116911 - protein, 10 aa, Dengue virus
VPLLAMGCYS

SEQ ID NO: 116912 - protein, 10 aa, Dengue virus
PLLAMGCYSQ

SEQ ID NO: 116913 - protein, 10 aa, Dengue virus
LLAMGCYSQV

SEQ ID NO: 116914 - protein, 10 aa, Dengue virus
LAMGCYSQVN

SEQ ID NO: 116915 - protein, 10 aa, Dengue virus
AMGCYSQVNP

SEQ ID NO: 116916 - protein, 10 aa, Dengue virus
MGCYSQVNPT

SEQ ID NO: 116917 - protein, 10 aa, Dengue virus
GCYSQVNPTT

SEQ ID NO: 116918 - protein, 10 aa, Dengue virus
CYSQVNPTTL

SEQ ID NO: 116919 - protein, 10 aa, Dengue virus
YSQVNPTTLT

SEQ ID NO: 116920 - protein, 10 aa, Dengue virus
SQVNPTTLTA

SEQ ID NO: 116921 - protein, 10 aa, Dengue virus
QVNPTTLTAS

SEQ ID NO: 116922 - protein, 10 aa, Dengue virus
VNPTTLTASL

SEQ ID NO: 116923 - protein, 10 aa, Dengue virus
LVTHYAIIGP

SEQ ID NO: 116924 - protein, 10 aa, Dengue virus
VHYAIIGPGL

SEQ ID NO: 116925 - protein, 10 aa, Dengue virus
MKNPTVDGIM

SEQ ID NO: 116926 - protein, 10 aa, Dengue virus
KNPTVDGIMT

SEQ ID NO: 116927 - protein, 10 aa, Dengue virus
NPTVDGIMTI

SEQ ID NO: 116928 - protein, 10 aa, Dengue virus
VIDLDPIPYD

SEQ ID NO: 116929 - protein, 10 aa, Dengue virus
PVIYDSKFEK

SEQ ID NO: 116930 - protein, 10 aa, Dengue virus
VIYDSKFEKQ

SEQ ID NO: 116931 - protein, 10 aa, Dengue virus
IYDSKFEKQL

SEQ ID NO: 116932 - protein, 10 aa, Dengue virus
YDSKFEKQLG

SEQ ID NO: 116933 - protein, 10 aa, Dengue virus
DSKFEKQLGQ

SEQ ID NO: 116934 - protein, 10 aa, Dengue virus
SKFEKQLGQV

SEQ ID NO: 116935 - protein, 10 aa, Dengue virus
KQLGQVMLLI

SEQ ID NO: 116936 - protein, 10 aa, Dengue virus
QLGQVMLLIL

SEQ ID NO: 116937 - protein, 10 aa, Dengue virus
LGQVMLLILC

SEQ ID NO: 116938 - protein, 10 aa, Dengue virus
GQVMLLILCV

SEQ ID NO: 116939 - protein, 10 aa, Dengue virus
LCAVQLLLMR

SEQ ID NO: 116940 - protein, 10 aa, Dengue virus
CAVQLLLMRT

SEQ ID NO: 116941 - protein, 10 aa, Dengue virus
AVQLLLMRTS

SEQ ID NO: 116942 - protein, 10 aa, Dengue virus
VQLLLMRTSW

SEQ ID NO: 116943 - protein, 10 aa, Dengue virus
QLLLMRTSWA

SEQ ID NO: 116944 - protein, 10 aa, Dengue virus
LLLMRTSWAL

SEQ ID NO: 116945 - protein, 10 aa, Dengue virus
LLMRTSWALC

SEQ ID NO: 116946 - protein, 10 aa, Dengue virus
LMRTSWALCE

SEQ ID NO: 116947 - protein, 10 aa, Dengue virus
MRTSWALCEA

SEQ ID NO: 116948 - protein, 10 aa, Dengue virus
RTSWALCEAL

SEQ ID NO: 116949 - protein, 10 aa, Dengue virus
TSWALCEALT

SEQ ID NO: 116950 - protein, 10 aa, Dengue virus
SWALCEALTL

SEQ ID NO: 116951 - protein, 10 aa, Dengue virus
WAFCEVLTLA

SEQ ID NO: 116952 - protein, 10 aa, Dengue virus
AFCEVLTLAT

SEQ ID NO: 116953 - protein, 10 aa, Dengue virus
FCEVLTLATG

SEQ ID NO: 116954 - protein, 10 aa, Dengue virus
CEVLTLATGP

SEQ ID NO: 116955 - protein, 10 aa, Dengue virus
EVLTLATGPI

SEQ ID NO: 116956 - protein, 10 aa, Dengue virus
LTLATGPITT

SEQ ID NO: 116957 - protein, 10 aa, Dengue virus
TLATGPITTL

SEQ ID NO: 116958 - protein, 10 aa, Dengue virus
LATGPITTLW

SEQ ID NO: 116959 - protein, 10 aa, Dengue virus
ATGPITTLWE

SEQ ID NO: 116960 - protein, 10 aa, Dengue virus
TGPITTLWEG

SEQ ID NO: 116961 - protein, 10 aa, Dengue virus
GPITTLWEGS

SEQ ID NO: 116962 - protein, 10 aa, Dengue virus
PITTLWEGSP

SEQ ID NO: 116963 - protein, 10 aa, Dengue virus
ITTLWEGSPG

SEQ ID NO: 116964 - protein, 10 aa, Dengue virus
LTLWEGNPGR

SEQ ID NO: 116965 - protein, 10 aa, Dengue virus
LAGAGLAFSI

SEQ ID NO: 116966 - protein, 10 aa, Dengue virus
AGAGLAFSIM

SEQ ID NO: 116967 - protein, 10 aa, Dengue virus
GAGLAFSIMK

SEQ ID NO: 116968 - protein, 10 aa, Dengue virus
AGLAFSIMKS

SEQ ID NO: 116969 - protein, 10 aa, Dengue virus
GLAFSIMKSV

SEQ ID NO: 116970 - protein, 10 aa, Dengue virus
TGETLGEKWK

SEQ ID NO: 116971 - protein, 10 aa, Dengue virus
GETLGEKWKK

SEQ ID NO: 116972 - protein, 10 aa, Dengue virus
ETLGEKWKKK

SEQ ID NO: 116973 - protein, 10 aa, Dengue virus
TLGEKWKKKL

SEQ ID NO: 116974 - protein, 10 aa, Dengue virus
LGEKWKKKLN

SEQ ID NO: 116975 - protein, 10 aa, Dengue virus
EVDRTEAKEG

SEQ ID NO: 116976 - protein, 10 aa, Dengue virus
VDRTEAKEGL

SEQ ID NO: 116977 - protein, 10 aa, Dengue virus
EAKSALKDGS

SEQ ID NO: 116978 - protein, 10 aa, Dengue virus
AKEGLKRGEI

SEQ ID NO: 116979 - protein, 10 aa, Dengue virus
RHAVSRGTAK

SEQ ID NO: 116980 - protein, 10 aa, Dengue virus
HAVSRGSSKI

SEQ ID NO: 116981 - protein, 10 aa, Dengue virus
AVSRGSAKLQ

SEQ ID NO: 116982 - protein, 10 aa, Dengue virus
VSRGSAKLQW

SEQ ID NO: 116983 - protein, 10 aa, Dengue virus
SRGSAKLQWF

SEQ ID NO: 116984 - protein, 10 aa, Dengue virus
RGSAKLQWFV

SEQ ID NO: 116985 - protein, 10 aa, Dengue virus
GSAKLQWFVE

SEQ ID NO: 116986 - protein, 10 aa, Dengue virus
SAKLQWFVER

SEQ ID NO: 116987 - protein, 10 aa, Dengue virus
SKIRWIVERG

SEQ ID NO: 116988 - protein, 10 aa, Dengue virus
KLQWFVERNM

SEQ ID NO: 116989 - protein, 10 aa, Dengue virus
LQWFVERNMV

SEQ ID NO: 116990 - protein, 10 aa, Dengue virus
PEGRVIDLGC

SEQ ID NO: 116991 - protein, 10 aa, Dengue virus
EGRVIDLGCG

SEQ ID NO: 116992 - protein, 10 aa, Dengue virus
GRVIDLGCGR

SEQ ID NO: 116993 - protein, 10 aa, Dengue virus
RVIDLGCGRG

SEQ ID NO: 116994 - protein, 10 aa, Dengue virus
GRGGWSYYMA

SEQ ID NO: 116995 - protein, 10 aa, Dengue virus
RGGWSYYMAT

SEQ ID NO: 116996 - protein, 10 aa, Dengue virus
GGWSYYMATL

SEQ ID NO: 116997 - protein, 10 aa, Dengue virus
GWSYYMATLK

SEQ ID NO: 116998 - protein, 10 aa, Dengue virus
WSYYMATLKN

SEQ ID NO: 116999 - protein, 10 aa, Dengue virus
SYYMATLKNV

SEQ ID NO: 117000 - protein, 10 aa, Dengue virus
YYMATLKNVT

SEQ ID NO: 117001 - protein, 10 aa, Dengue virus
YMATLKNVTE

SEQ ID NO: 117002 - protein, 10 aa, Dengue virus
MATLKNVTEV

SEQ ID NO: 117003 - protein, 10 aa, Dengue virus
VTEVRGYTKG

SEQ ID NO: 117004 - protein, 10 aa, Dengue virus
TEVRGYTKGG

SEQ ID NO: 117005 - protein, 10 aa, Dengue virus
EVRGYTKGGP

SEQ ID NO: 117006 - protein, 10 aa, Dengue virus
VRGYTKGGPG

SEQ ID NO: 117007 - protein, 10 aa, Dengue virus
RGYTKGGPGH

SEQ ID NO: 117008 - protein, 10 aa, Dengue virus
PGHEEPVPMS

SEQ ID NO: 117009 - protein, 10 aa, Dengue virus
GHEEPVPMST

SEQ ID NO: 117010 - protein, 10 aa, Dengue virus
HEEPVPMSTY

SEQ ID NO: 117011 - protein, 10 aa, Dengue virus
EEPVPMSTYG

SEQ ID NO: 117012 - protein, 10 aa, Dengue virus
EPVPMSTYGW

SEQ ID NO: 117013 - protein, 10 aa, Dengue virus
PVPMSTYGWN

SEQ ID NO: 117014 - protein, 10 aa, Dengue virus
VPMSTYGWNI

SEQ ID NO: 117015 - protein, 10 aa, Dengue virus
PMSTYGWNIV

SEQ ID NO: 117016 - protein, 10 aa, Dengue virus
MSTYGWNIVK

SEQ ID NO: 117017 - protein, 10 aa, Dengue virus
STYGWNIVKL

SEQ ID NO: 117018 - protein, 10 aa, Dengue virus
TYGWNIVKLM

SEQ ID NO: 117019 - protein, 10 aa, Dengue virus
GWNIVKLMSG

SEQ ID NO: 117020 - protein, 10 aa, Dengue virus
PPERCDTLLC

SEQ ID NO: 117021 - protein, 10 aa, Dengue virus
PERCDTLLCD

SEQ ID NO: 117022 - protein, 10 aa, Dengue virus
ERCDTLLCDI

SEQ ID NO: 117023 - protein, 10 aa, Dengue virus
RCDTLLCDIG

SEQ ID NO: 117024 - protein, 10 aa, Dengue virus
LCDIGESSSN

SEQ ID NO: 117025 - protein, 10 aa, Dengue virus
CDIGESSSNP

SEQ ID NO: 117026 - protein, 10 aa, Dengue virus
DIGESSSNPT

SEQ ID NO: 117027 - protein, 10 aa, Dengue virus
IGESSPNPTV

SEQ ID NO: 117028 - protein, 10 aa, Dengue virus
GESSPNPTVE

SEQ ID NO: 117029 - protein, 10 aa, Dengue virus
ESSPNPTIEA

SEQ ID NO: 117030 - protein, 10 aa, Dengue virus
SSPNPTIEAG

SEQ ID NO: 117031 - protein, 10 aa, Dengue virus
SPNPTIEAGR

SEQ ID NO: 117032 - protein, 10 aa, Dengue virus
PNPTIEAGRT

SEQ ID NO: 117033 - protein, 10 aa, Dengue virus
NPTIEAGRTL

SEQ ID NO: 117034 - protein, 10 aa, Dengue virus
PTIEAGRTLR

SEQ ID NO: 117035 - protein, 10 aa, Dengue virus
TIEAGRTLRV

SEQ ID NO: 117036 - protein, 10 aa, Dengue virus
IEAGRTLRVL

SEQ ID NO: 117037 - protein, 10 aa, Dengue virus
EESRTIRVLK

SEQ ID NO: 117038 - protein, 10 aa, Dengue virus
ESRTIRVLKM

SEQ ID NO: 117039 - protein, 10 aa, Dengue virus
SRTIRVLKMV

SEQ ID NO: 117040 - protein, 10 aa, Dengue virus
RTIRVLKMVE

SEQ ID NO: 117041 - protein, 10 aa, Dengue virus
TIRVLKMVEP

SEQ ID NO: 117042 - protein, 10 aa, Dengue virus
IRVLKMVEPW

SEQ ID NO: 117043 - protein, 10 aa, Dengue virus
RVLSLVENWL

SEQ ID NO: 117044 - protein, 10 aa, Dengue virus
EFCIKVLNPY

SEQ ID NO: 117045 - protein, 10 aa, Dengue virus
FCVKVLNPYM

SEQ ID NO: 117046 - protein, 10 aa, Dengue virus
CVKVLNPYMP

SEQ ID NO: 117047 - protein, 10 aa, Dengue virus
IKVLNPYMPT

SEQ ID NO: 117048 - protein, 10 aa, Dengue virus
KVLNPYMPTV

SEQ ID NO: 117049 - protein, 10 aa, Dengue virus
VLNPYMPTVI

SEQ ID NO: 117050 - protein, 10 aa, Dengue virus
LNPYMPTVIE

SEQ ID NO: 117051 - protein, 10 aa, Dengue virus
YGGMLVRNPL

SEQ ID NO: 117052 - protein, 10 aa, Dengue virus
GGNLVRCPLS

SEQ ID NO: 117053 - protein, 10 aa, Dengue virus
GNLVRCPLSR

SEQ ID NO: 117054 - protein, 10 aa, Dengue virus
NLVRCPLSRN

SEQ ID NO: 117055 - protein, 10 aa, Dengue virus
STHEMYWISN

SEQ ID NO: 117056 - protein, 10 aa, Dengue virus
THEMYWISNG

SEQ ID NO: 117057 - protein, 10 aa, Dengue virus
HEMYWVSNAT

SEQ ID NO: 117058 - protein, 10 aa, Dengue virus
EMYWVSNATG

SEQ ID NO: 117059 - protein, 10 aa, Dengue virus
MYWVSNATGN

SEQ ID NO: 117060 - protein, 10 aa, Dengue virus
YWVSNATGNI

SEQ ID NO: 117061 - protein, 10 aa, Dengue virus
WVSNATGNIV

SEQ ID NO: 117062 - protein, 10 aa, Dengue virus
ATGNIVSSVN

SEQ ID NO: 117063 - protein, 10 aa, Dengue virus
SGNIVSSVNM

SEQ ID NO: 117064 - protein, 10 aa, Dengue virus
GNIVASVNMV

SEQ ID NO: 117065 - protein, 10 aa, Dengue virus
NIVASVNMVS

SEQ ID NO: 117066 - protein, 10 aa, Dengue virus
IVASVNMVSR

SEQ ID NO: 117067 - protein, 10 aa, Dengue virus
VASVNMVSRL

SEQ ID NO: 117068 - protein, 10 aa, Dengue virus
ASVNMVSRLL

SEQ ID NO: 117069 - protein, 10 aa, Dengue virus
SVNMVSRLLL

SEQ ID NO: 117070 - protein, 10 aa, Dengue virus
VNMVSRLLLN

SEQ ID NO: 117071 - protein, 10 aa, Dengue virus
NMVSRLLLNR

SEQ ID NO: 117072 - protein, 10 aa, Dengue virus
MVSRLLLNRF

SEQ ID NO: 117073 - protein, 10 aa, Dengue virus
VSRLLLNRFT

SEQ ID NO: 117074 - protein, 10 aa, Dengue virus
SRLLLNRFTM

SEQ ID NO: 117075 - protein, 10 aa, Dengue virus
PTIEKDVDLG

SEQ ID NO: 117076 - protein, 10 aa, Dengue virus
EKDVDLGAGT

SEQ ID NO: 117077 - protein, 10 aa, Dengue virus
KDVDLGAGTR

SEQ ID NO: 117078 - protein, 10 aa, Dengue virus
DVDLGAGTRS

SEQ ID NO: 117079 - protein, 10 aa, Dengue virus
VDLGAGTRSV

SEQ ID NO: 117080 - protein, 10 aa, Dengue virus
DLGAGTRHVN

SEQ ID NO: 117081 - protein, 10 aa, Dengue virus
LGAGTRHVNA

SEQ ID NO: 117082 - protein, 10 aa, Dengue virus
GAGTRHVNAE

SEQ ID NO: 117083 - protein, 10 aa, Dengue virus
PNMDVIGERI

SEQ ID NO: 117084 - protein, 10 aa, Dengue virus
DVIGERIKRI

SEQ ID NO: 117085 - protein, 10 aa, Dengue virus
TWHYDDENPY

SEQ ID NO: 117086 - protein, 10 aa, Dengue virus
WHYDDENPYK

SEQ ID NO: 117087 - protein, 10 aa, Dengue virus
HYDDENPYKT

SEQ ID NO: 117088 - protein, 10 aa, Dengue virus
YDDENPYKTW

SEQ ID NO: 117089 - protein, 10 aa, Dengue virus
DDENPYKTWA

SEQ ID NO: 117090 - protein, 10 aa, Dengue virus
DENPYKTWAY

SEQ ID NO: 117091 - protein, 10 aa, Dengue virus
ENPYKTWAYH

SEQ ID NO: 117092 - protein, 10 aa, Dengue virus
NPYRTWAYHG

SEQ ID NO: 117093 - protein, 10 aa, Dengue virus
TWAYHGSYEA

SEQ ID NO: 117094 - protein, 10 aa, Dengue virus
WAYHGSYEAP

SEQ ID NO: 117095 - protein, 10 aa, Dengue virus
AYHGSYEVKA

SEQ ID NO: 117096 - protein, 10 aa, Dengue virus
YHGSYEVKAT

SEQ ID NO: 117097 - protein, 10 aa, Dengue virus
HGSYEVKATG

SEQ ID NO: 117098 - protein, 10 aa, Dengue virus
GSYEVKATGS

SEQ ID NO: 117099 - protein, 10 aa, Dengue virus
SYEVKATGSA

SEQ ID NO: 117100 - protein, 10 aa, Dengue virus
YEVKATGSAS

SEQ ID NO: 117101 - protein, 10 aa, Dengue virus
EVKATGSASS

SEQ ID NO: 117102 - protein, 10 aa, Dengue virus
VKATGSASSM

SEQ ID NO: 117103 - protein, 10 aa, Dengue virus
KATGSASSMI

SEQ ID NO: 117104 - protein, 10 aa, Dengue virus
ATGSASSMIN

SEQ ID NO: 117105 - protein, 10 aa, Dengue virus
TGSASSMING

SEQ ID NO: 117106 - protein, 10 aa, Dengue virus
ASSMINGVVK

SEQ ID NO: 117107 - protein, 10 aa, Dengue virus
SSMINGVVKL

SEQ ID NO: 117108 - protein, 10 aa, Dengue virus
SMINGVVKLL

SEQ ID NO: 117109 - protein, 10 aa, Dengue virus
MINGVVKLLT

SEQ ID NO: 117110 - protein, 10 aa, Dengue virus
INGVVKLLTK

SEQ ID NO: 117111 - protein, 10 aa, Dengue virus
RLLTKPWDVV

SEQ ID NO: 117112 - protein, 10 aa, Dengue virus
LLTKPWDVLP

SEQ ID NO: 117113 - protein, 10 aa, Dengue virus
LTKPWDVLPT

SEQ ID NO: 117114 - protein, 10 aa, Dengue virus
TKPWDVLPTV

SEQ ID NO: 117115 - protein, 10 aa, Dengue virus
KPWDVLPTVT

SEQ ID NO: 117116 - protein, 10 aa, Dengue virus
PWDVLPTVTQ

SEQ ID NO: 117117 - protein, 10 aa, Dengue virus
PTVTQMAMTD

SEQ ID NO: 117118 - protein, 10 aa, Dengue virus
TVTQMAMTDT

SEQ ID NO: 117119 - protein, 10 aa, Dengue virus
VTQLAMTDTT

SEQ ID NO: 117120 - protein, 10 aa, Dengue virus
TQLAMTDTTP

SEQ ID NO: 117121 - protein, 10 aa, Dengue virus
QLAMTDTTPF

SEQ ID NO: 117122 - protein, 10 aa, Dengue virus
LAMTDTTPFG

SEQ ID NO: 117123 - protein, 10 aa, Dengue virus
KEKVDTRTPR

SEQ ID NO: 117124 - protein, 10 aa, Dengue virus
CTREEFISKV

SEQ ID NO: 117125 - protein, 10 aa, Dengue virus
TREEFISKVR

SEQ ID NO: 117126 - protein, 10 aa, Dengue virus
KKVRTNAAMG

SEQ ID NO: 117127 - protein, 10 aa, Dengue virus
KVRTNAAMGA

SEQ ID NO: 117128 - protein, 10 aa, Dengue virus
VRTNAAMGAV

SEQ ID NO: 117129 - protein, 10 aa, Dengue virus
RTNAAMGAVF

SEQ ID NO: 117130 - protein, 10 aa, Dengue virus
TNAAMGAVFT

SEQ ID NO: 117131 - protein, 10 aa, Dengue virus
NAAMGAVFTE

SEQ ID NO: 117132 - protein, 10 aa, Dengue virus
AAMGAVFTEE

SEQ ID NO: 117133 - protein, 10 aa, Dengue virus
AMGAVFTEEN

SEQ ID NO: 117134 - protein, 10 aa, Dengue virus
MGAVFTEENQ

SEQ ID NO: 117135 - protein, 10 aa, Dengue virus
GAVFTEENQW

SEQ ID NO: 117136 - protein, 10 aa, Dengue virus
AVFTEENQWD

SEQ ID NO: 117137 - protein, 10 aa, Dengue virus
VFTEENQWDS

SEQ ID NO: 117138 - protein, 10 aa, Dengue virus
FTEENQWDSA

SEQ ID NO: 117139 - protein, 10 aa, Dengue virus
TEENQWDSAK

SEQ ID NO: 117140 - protein, 10 aa, Dengue virus
EENQWDSAKA

SEQ ID NO: 117141 - protein, 10 aa, Dengue virus
ENQWDSAKAA

SEQ ID NO: 117142 - protein, 10 aa, Dengue virus
NQWDSAKAAV

SEQ ID NO: 117143 - protein, 10 aa, Dengue virus
QWDSAKAAVE

SEQ ID NO: 117144 - protein, 10 aa, Dengue virus
WDSAKAAVED

SEQ ID NO: 117145 - protein, 10 aa, Dengue virus
ERELHKLGKC

SEQ ID NO: 117146 - protein, 10 aa, Dengue virus
RELHKLGKCG

SEQ ID NO: 117147 - protein, 10 aa, Dengue virus
ELHKLGKCGS

SEQ ID NO: 117148 - protein, 10 aa, Dengue virus
LHKLGKCGSC

SEQ ID NO: 117149 - protein, 10 aa, Dengue virus
HKLGKCGSCV

SEQ ID NO: 117150 - protein, 10 aa, Dengue virus
KLGKCGSCVY

SEQ ID NO: 117151 - protein, 10 aa, Dengue virus
LGKCGSCVYN

SEQ ID NO: 117152 - protein, 10 aa, Dengue virus
GKCGSCVYNM

SEQ ID NO: 117153 - protein, 10 aa, Dengue virus
KCGSCVYNMM

SEQ ID NO: 117154 - protein, 10 aa, Dengue virus
CGSCVYNMMG

SEQ ID NO: 117155 - protein, 10 aa, Dengue virus
GSCVYNMMGK

SEQ ID NO: 117156 - protein, 10 aa, Dengue virus
YLEFEALGFL

SEQ ID NO: 117157 - protein, 10 aa, Dengue virus
GFLNEDHWFG

SEQ ID NO: 117158 - protein, 10 aa, Dengue virus
FLNEDHWFGR

SEQ ID NO: 117159 - protein, 10 aa, Dengue virus
LNEDHWFSRG

SEQ ID NO: 117160 - protein, 10 aa, Dengue virus
NEDHWFGREN

SEQ ID NO: 117161 - protein, 10 aa, Dengue virus
EDHWFGRENS

SEQ ID NO: 117162 - protein, 10 aa, Dengue virus
DHWFSRGNSL

SEQ ID NO: 117163 - protein, 10 aa, Dengue virus
HWFSRGNSLS

SEQ ID NO: 117164 - protein, 10 aa, Dengue virus
WFSRGNSLSG

SEQ ID NO: 117165 - protein, 10 aa, Dengue virus
FSRGNSLSGV

SEQ ID NO: 117166 - protein, 10 aa, Dengue virus
SRGNSLSGVE

SEQ ID NO: 117167 - protein, 10 aa, Dengue virus
RGNSLSGVEG

SEQ ID NO: 117168 - protein, 10 aa, Dengue virus
GNSLSGVEGE

SEQ ID NO: 117169 - protein, 10 aa, Dengue virus
NSWSGVEGEG

SEQ ID NO: 117170 - protein, 10 aa, Dengue virus
SWSGVEGEGL

SEQ ID NO: 117171 - protein, 10 aa, Dengue virus
WSGVEGEGLH

SEQ ID NO: 117172 - protein, 10 aa, Dengue virus
GLHRLGYILE

SEQ ID NO: 117173 - protein, 10 aa, Dengue virus
GDLMYADDTA

SEQ ID NO: 117174 - protein, 10 aa, Dengue virus
DLMYADDTAG

SEQ ID NO: 117175 - protein, 10 aa, Dengue virus
LMYADDTAGW

SEQ ID NO: 117176 - protein, 10 aa, Dengue virus
TAGWDTRITI

SEQ ID NO: 117177 - protein, 10 aa, Dengue virus
AGWDTRITIE

SEQ ID NO: 117178 - protein, 10 aa, Dengue virus
GWDTRITIED

SEQ ID NO: 117179 - protein, 10 aa, Dengue virus
WDTRITIEDL

SEQ ID NO: 117180 - protein, 10 aa, Dengue virus
TYQNKVVKVL

SEQ ID NO: 117181 - protein, 10 aa, Dengue virus
YQNKVVKVLR

SEQ ID NO: 117182 - protein, 10 aa, Dengue virus
QNKVVKVLRP

SEQ ID NO: 117183 - protein, 10 aa, Dengue virus
NKVVKVQRPT

SEQ ID NO: 117184 - protein, 10 aa, Dengue virus
KVVKVQRPTP

SEQ ID NO: 117185 - protein, 10 aa, Dengue virus
GTVMDIISRK

SEQ ID NO: 117186 - protein, 10 aa, Dengue virus
TVMDIISRKD

SEQ ID NO: 117187 - protein, 10 aa, Dengue virus
VMDIISRRDQ

SEQ ID NO: 117188 - protein, 10 aa, Dengue virus
MDIISRRDQR

SEQ ID NO: 117189 - protein, 10 aa, Dengue virus
DIISRRDQRG

SEQ ID NO: 117190 - protein, 10 aa, Dengue virus
IISRRDQRGS

SEQ ID NO: 117191 - protein, 10 aa, Dengue virus
RDQRGSGQVV

SEQ ID NO: 117192 - protein, 10 aa, Dengue virus
FTNMEAQLVR

SEQ ID NO: 117193 - protein, 10 aa, Dengue virus
TNMEAQLVRQ

SEQ ID NO: 117194 - protein, 10 aa, Dengue virus
NMEAQLVRQM

SEQ ID NO: 117195 - protein, 10 aa, Dengue virus
MEAQLVRQME

SEQ ID NO: 117196 - protein, 10 aa, Dengue virus
VQLIRQMESE

SEQ ID NO: 117197 - protein, 10 aa, Dengue virus
QLVRQMEGEG

SEQ ID NO: 117198 - protein, 10 aa, Dengue virus
DRLKRMAISG

SEQ ID NO: 117199 - protein, 10 aa, Dengue virus
RLRRMAISGD

SEQ ID NO: 117200 - protein, 10 aa, Dengue virus
LRRMAISGDD

SEQ ID NO: 117201 - protein, 10 aa, Dengue virus
RRMAISGDDC

SEQ ID NO: 117202 - protein, 10 aa, Dengue virus
SGDDCVVKPT

SEQ ID NO: 117203 - protein, 10 aa, Dengue virus
GDDCVVKPTD

SEQ ID NO: 117204 - protein, 10 aa, Dengue virus
DDCVVKPLDE

SEQ ID NO: 117205 - protein, 10 aa, Dengue virus
DCVVKPLDER

SEQ ID NO: 117206 - protein, 10 aa, Dengue virus
CVVKPLDERF

SEQ ID NO: 117207 - protein, 10 aa, Dengue virus
SLLFLNDMGK

SEQ ID NO: 117208 - protein, 10 aa, Dengue virus
FLNDMGKVRK

SEQ ID NO: 117209 - protein, 10 aa, Dengue virus
NDMGKVRKDV

SEQ ID NO: 117210 - protein, 10 aa, Dengue virus
DMGKIRKDIQ

SEQ ID NO: 117211 - protein, 10 aa, Dengue virus
MGKIRKDIQQ

SEQ ID NO: 117212 - protein, 10 aa, Dengue virus
GKIRKDIQQW

SEQ ID NO: 117213 - protein, 10 aa, Dengue virus
KVRKDIQQWE

SEQ ID NO: 117214 - protein, 10 aa, Dengue virus
VRKDIQQWEP

SEQ ID NO: 117215 - protein, 10 aa, Dengue virus
RKDIPQWQPS

SEQ ID NO: 117216 - protein, 10 aa, Dengue virus
KDIPQWQPSK

SEQ ID NO: 117217 - protein, 10 aa, Dengue virus
DIPQWQPSKG

SEQ ID NO: 117218 - protein, 10 aa, Dengue virus
IPQWQPSKGW

SEQ ID NO: 117219 - protein, 10 aa, Dengue virus
QWQPSKGWHD

SEQ ID NO: 117220 - protein, 10 aa, Dengue virus
WQPSKGWHDW

SEQ ID NO: 117221 - protein, 10 aa, Dengue virus
GWHDWQQVPF

SEQ ID NO: 117222 - protein, 10 aa, Dengue virus
WHDWQQVPFC

SEQ ID NO: 117223 - protein, 10 aa, Dengue virus
HDWQQVPFCS

SEQ ID NO: 117224 - protein, 10 aa, Dengue virus
NWQEVPFCSH

SEQ ID NO: 117225 - protein, 10 aa, Dengue virus
WQEVPFCSHH

SEQ ID NO: 117226 - protein, 10 aa, Dengue virus
QEVPFCSHHF

SEQ ID NO: 117227 - protein, 10 aa, Dengue virus
VPFCSHHFHK

SEQ ID NO: 117228 - protein, 10 aa, Dengue virus
PFCSHHFHKI

SEQ ID NO: 117229 - protein, 10 aa, Dengue virus
FCSHHFHELV

SEQ ID NO: 117230 - protein, 10 aa, Dengue virus
CSHHFHELVM

SEQ ID NO: 117231 - protein, 10 aa, Dengue virus
SHHFHELVMK

SEQ ID NO: 117232 - protein, 10 aa, Dengue virus
HHFHELVMKD

SEQ ID NO: 117233 - protein, 10 aa, Dengue virus
HFHELVMKDG

SEQ ID NO: 117234 - protein, 10 aa, Dengue virus
FHELVMKDGR

SEQ ID NO: 117235 - protein, 10 aa, Dengue virus
LVVPCRPQDE

SEQ ID NO: 117236 - protein, 10 aa, Dengue virus
VPCRPQDELI

SEQ ID NO: 117237 - protein, 10 aa, Dengue virus
PCRPQDELIG

SEQ ID NO: 117238 - protein, 10 aa, Dengue virus
CRPQDELIGR

SEQ ID NO: 117239 - protein, 10 aa, Dengue virus
RPQDELIGRA

SEQ ID NO: 117240 - protein, 10 aa, Dengue virus
PQDELIGRAR

SEQ ID NO: 117241 - protein, 10 aa, Dengue virus
ISQGAGWSLK

SEQ ID NO: 117242 - protein, 10 aa, Dengue virus
LRETACLGKA

SEQ ID NO: 117243 - protein, 10 aa, Dengue virus
RETACLGKAY

SEQ ID NO: 117244 - protein, 10 aa, Dengue virus
LGKSYAQMWS

SEQ ID NO: 117245 - protein, 10 aa, Dengue virus
GKSYAQMWSL

SEQ ID NO: 117246 - protein, 10 aa, Dengue virus
KSYAQMWSLM

SEQ ID NO: 117247 - protein, 10 aa, Dengue virus
SYAQMWSLMY

SEQ ID NO: 117248 - protein, 10 aa, Dengue virus
YAQMWTLMYF

SEQ ID NO: 117249 - protein, 10 aa, Dengue virus
AQMWTLMYFH

SEQ ID NO: 117250 - protein, 10 aa, Dengue virus
QMWTLMYFHR

SEQ ID NO: 117251 - protein, 10 aa, Dengue virus
MWTLMYFHRR

SEQ ID NO: 117252 - protein, 10 aa, Dengue virus
WTLMYFHRRD

SEQ ID NO: 117253 - protein, 10 aa, Dengue virus
TLMYFHRRDL

SEQ ID NO: 117254 - protein, 10 aa, Dengue virus
HRRDLRLASM

SEQ ID NO: 117255 - protein, 10 aa, Dengue virus
RRDLRLASMA

SEQ ID NO: 117256 - protein, 10 aa, Dengue virus
RDLRLASMAI

SEQ ID NO: 117257 - protein, 10 aa, Dengue virus
DLRLASMAIC

SEQ ID NO: 117258 - protein, 10 aa, Dengue virus
LRLASMAICS

SEQ ID NO: 117259 - protein, 10 aa, Dengue virus
RLASMAICSA

SEQ ID NO: 117260 - protein, 10 aa, Dengue virus
LASMAICSAV

SEQ ID NO: 117261 - protein, 10 aa, Dengue virus
ASMAICSAVP

SEQ ID NO: 117262 - protein, 10 aa, Dengue virus
DWIPTSRTTW

SEQ ID NO: 117263 - protein, 10 aa, Dengue virus
WFPTSRTTWS

SEQ ID NO: 117264 - protein, 10 aa, Dengue virus
FPTSRTTWSI

SEQ ID NO: 117265 - protein, 10 aa, Dengue virus
SRTTWSIHAT

SEQ ID NO: 117266 - protein, 10 aa, Dengue virus
RTTWSIHATH

SEQ ID NO: 117267 - protein, 10 aa, Dengue virus
TTWSIHATHE

SEQ ID NO: 117268 - protein, 10 aa, Dengue virus
TWSIHATHEW

SEQ ID NO: 117269 - protein, 10 aa, Dengue virus
WSIHATHEWM

SEQ ID NO: 117270 - protein, 10 aa, Dengue virus
SIHATHEWMT

SEQ ID NO: 117271 - protein, 10 aa, Dengue virus
IHATHEWMTT

SEQ ID NO: 117272 - protein, 10 aa, Dengue virus
HATHEWMTTE

SEQ ID NO: 117273 - protein, 10 aa, Dengue virus
ATHEWMTTED

SEQ ID NO: 117274 - protein, 10 aa, Dengue virus
THEWMTTEDM

SEQ ID NO: 117275 - protein, 10 aa, Dengue virus
EWMTTEDMLA

SEQ ID NO: 117276 - protein, 10 aa, Dengue virus
WMTTEDMLAV

SEQ ID NO: 117277 - protein, 10 aa, Dengue virus
MTTEDMLAVW

SEQ ID NO: 117278 - protein, 10 aa, Dengue virus
TTEDMLAVWN

SEQ ID NO: 117279 - protein, 10 aa, Dengue virus
TEDMLAVWNR

SEQ ID NO: 117280 - protein, 10 aa, Dengue virus
EDMLAVWNRV

SEQ ID NO: 117281 - protein, 10 aa, Dengue virus
DMLAVWNRVW

SEQ ID NO: 117282 - protein, 10 aa, Dengue virus
MLAVWNRVWI

SEQ ID NO: 117283 - protein, 10 aa, Dengue virus
EIPYLGKRED

SEQ ID NO: 117284 - protein, 10 aa, Dengue virus
IPYLGKREDL

SEQ ID NO: 117285 - protein, 10 aa, Dengue virus
WCGSLIGLSS

SEQ ID NO: 117286 - protein, 10 aa, Dengue virus
CGSLIGLSSR

SEQ ID NO: 117287 - protein, 10 aa, Dengue virus
GSLIGLSSRA

SEQ ID NO: 117288 - protein, 10 aa, Dengue virus
SLIGLSSRAT

SEQ ID NO: 117289 - protein, 10 aa, Dengue virus
LIGLSSRATW

SEQ ID NO: 117290 - protein, 10 aa, Dengue virus
IGLSSRATWA

SEQ ID NO: 117291 - protein, 10 aa, Dengue virus
GLTSRATWAQ

SEQ ID NO: 117292 - protein, 10 aa, Dengue virus
LTSRATWAQN

SEQ ID NO: 117293 - protein, 10 aa, Dengue virus
TSRATWAQNI

SEQ ID NO: 117294 - protein, 10 aa, Dengue virus
DYMPVMKRYS

SEQ ID NO: 117295 - protein, 10 aa, Dengue virus
PPFNMLKRER

SEQ ID NO: 117296 - protein, 10 aa, Dengue virus
RNRVSTPQGL

SEQ ID NO: 117297 - protein, 10 aa, Dengue virus
NRVSTPQGLV

SEQ ID NO: 117298 - protein, 10 aa, Dengue virus
RVSTPQGLVK

SEQ ID NO: 117299 - protein, 10 aa, Dengue virus
VSTPQGLVKR

SEQ ID NO: 117300 - protein, 10 aa, Dengue virus
STPQGLVKRF

SEQ ID NO: 117301 - protein, 10 aa, Dengue virus
TPQGLVKRFS

SEQ ID NO: 117302 - protein, 10 aa, Dengue virus
QGLVKRFSTG

SEQ ID NO: 117303 - protein, 10 aa, Dengue virus
GLVKRFSTGL

SEQ ID NO: 117304 - protein, 10 aa, Dengue virus
LVKRFSTGLF

SEQ ID NO: 117305 - protein, 10 aa, Dengue virus
AKRFSRGLLN

SEQ ID NO: 117306 - protein, 10 aa, Dengue virus
KRFSRGLLNG

SEQ ID NO: 117307 - protein, 10 aa, Dengue virus
RFSRGLLNGQ

SEQ ID NO: 117308 - protein, 10 aa, Dengue virus
FSRGLLNGQG

SEQ ID NO: 117309 - protein, 10 aa, Dengue virus
SRGLLNGQGP

SEQ ID NO: 117310 - protein, 10 aa, Dengue virus
GLFSGKGPLR

SEQ ID NO: 117311 - protein, 10 aa, Dengue virus
GQGPMKMVMA

SEQ ID NO: 117312 - protein, 10 aa, Dengue virus
MVMAFIAFLR

SEQ ID NO: 117313 - protein, 10 aa, Dengue virus
VLSIPPTAGI

SEQ ID NO: 117314 - protein, 10 aa, Dengue virus
LSIPPTAGIL

SEQ ID NO: 117315 - protein, 10 aa, Dengue virus
SIPPTAGILK

SEQ ID NO: 117316 - protein, 10 aa, Dengue virus
PTAGILARWS

SEQ ID NO: 117317 - protein, 10 aa, Dengue virus
GFKKEVSNML

SEQ ID NO: 117318 - protein, 10 aa, Dengue virus
AFHLSTRDGE

SEQ ID NO: 117319 - protein, 10 aa, Dengue virus
FHLSTRDGEP

SEQ ID NO: 117320 - protein, 10 aa, Dengue virus
HLSTRDGEPL

SEQ ID NO: 117321 - protein, 10 aa, Dengue virus
LSTRDGEPLM

SEQ ID NO: 117322 - protein, 10 aa, Dengue virus
STRDGEPLMI

SEQ ID NO: 117323 - protein, 10 aa, Dengue virus
TRDGEPLMIV

SEQ ID NO: 117324 - protein, 10 aa, Dengue virus
HERGRPLLFK

SEQ ID NO: 117325 - protein, 10 aa, Dengue virus
RGRPLLFKTT

SEQ ID NO: 117326 - protein, 10 aa, Dengue virus
NKCTLIAMDL

SEQ ID NO: 117327 - protein, 10 aa, Dengue virus
KCTLIAMDLG

SEQ ID NO: 117328 - protein, 10 aa, Dengue virus
TLMAMDLGEL

SEQ ID NO: 117329 - protein, 10 aa, Dengue virus
LMAMDLGELC

SEQ ID NO: 117330 - protein, 10 aa, Dengue virus
AMDLGEFCED

SEQ ID NO: 117331 - protein, 10 aa, Dengue virus
MDLGEFCEDT

SEQ ID NO: 117332 - protein, 10 aa, Dengue virus
PDDVDCWCNT

SEQ ID NO: 117333 - protein, 10 aa, Dengue virus
DDVDCWCNTT

SEQ ID NO: 117334 - protein, 10 aa, Dengue virus
DVDCWCNATE

SEQ ID NO: 117335 - protein, 10 aa, Dengue virus
VDCWCNATET

SEQ ID NO: 117336 - protein, 10 aa, Dengue virus
DCWCNATETW

SEQ ID NO: 117337 - protein, 10 aa, Dengue virus
TETWVTYGTC

SEQ ID NO: 117338 - protein, 10 aa, Dengue virus
GERRRDKRSV

SEQ ID NO: 117339 - protein, 10 aa, Dengue virus
ERRRDKRSVA

SEQ ID NO: 117340 - protein, 10 aa, Dengue virus
RRRDKRSVAL

SEQ ID NO: 117341 - protein, 10 aa, Dengue virus
RREKRSVALA

SEQ ID NO: 117342 - protein, 10 aa, Dengue virus
REKRSVALAP

SEQ ID NO: 117343 - protein, 10 aa, Dengue virus
EKRSVALAPH

SEQ ID NO: 117344 - protein, 10 aa, Dengue virus
SVALTPHSGM

SEQ ID NO: 117345 - protein, 10 aa, Dengue virus
VALTPHSGMG

SEQ ID NO: 117346 - protein, 10 aa, Dengue virus
ALTPHSGMGL

SEQ ID NO: 117347 - protein, 10 aa, Dengue virus
LTPHSGMGLE

SEQ ID NO: 117348 - protein, 10 aa, Dengue virus
TPHSGMGLET

SEQ ID NO: 117349 - protein, 10 aa, Dengue virus
PHSGMGLETR

SEQ ID NO: 117350 - protein, 10 aa, Dengue virus
GLDTRAQTWM

SEQ ID NO: 117351 - protein, 10 aa, Dengue virus
LDTRAQTWMS

SEQ ID NO: 117352 - protein, 10 aa, Dengue virus
DTRAQTWMSA

SEQ ID NO: 117353 - protein, 10 aa, Dengue virus
TRAQTWMSAE

SEQ ID NO: 117354 - protein, 10 aa, Dengue virus
RAQTWMSAEG

SEQ ID NO: 117355 - protein, 10 aa, Dengue virus
AQTWMSAEGA

SEQ ID NO: 117356 - protein, 10 aa, Dengue virus
WMSSEGAWRQ

SEQ ID NO: 117357 - protein, 10 aa, Dengue virus
SSEGAWKHVQ

SEQ ID NO: 117358 - protein, 10 aa, Dengue virus
VETWAFRHPG

SEQ ID NO: 117359 - protein, 10 aa, Dengue virus
ETWAFRHPGF

SEQ ID NO: 117360 - protein, 10 aa, Dengue virus
TWAFRHPGFT

SEQ ID NO: 117361 - protein, 10 aa, Dengue virus
APSYGMRCVG

SEQ ID NO: 117362 - protein, 10 aa, Dengue virus
MRCVGIGNRD

SEQ ID NO: 117363 - protein, 10 aa, Dengue virus
RCVGIGNRDF

SEQ ID NO: 117364 - protein, 10 aa, Dengue virus
CVGIGNRDFV

SEQ ID NO: 117365 - protein, 10 aa, Dengue virus
VGIGNRDFVE

SEQ ID NO: 117366 - protein, 10 aa, Dengue virus
GIGNRDFVEG

SEQ ID NO: 117367 - protein, 10 aa, Dengue virus
GNRDFVEGVS

SEQ ID NO: 117368 - protein, 10 aa, Dengue virus
WVDLVLEHGG

SEQ ID NO: 117369 - protein, 10 aa, Dengue virus
VDLVLEHGGC

SEQ ID NO: 117370 - protein, 10 aa, Dengue virus
DLVLEHGGCV

SEQ ID NO: 117371 - protein, 10 aa, Dengue virus
LVLEHGGCVT

SEQ ID NO: 117372 - protein, 10 aa, Dengue virus
GGCVTTMAQG

SEQ ID NO: 117373 - protein, 10 aa, Dengue virus
GCVTTMAQGK

SEQ ID NO: 117374 - protein, 10 aa, Dengue virus
CVTTMAKSKP

SEQ ID NO: 117375 - protein, 10 aa, Dengue virus
VTTMAKSKPT

SEQ ID NO: 117376 - protein, 10 aa, Dengue virus
TTMAKSKPTL

SEQ ID NO: 117377 - protein, 10 aa, Dengue virus
TMAKSKPTLD

SEQ ID NO: 117378 - protein, 10 aa, Dengue virus
MAQGKPTLDF

SEQ ID NO: 117379 - protein, 10 aa, Dengue virus
AQGKPTLDFE

SEQ ID NO: 117380 - protein, 10 aa, Dengue virus
QGKPTLDFEL

SEQ ID NO: 117381 - protein, 10 aa, Dengue virus
KPTLDFELTK

SEQ ID NO: 117382 - protein, 10 aa, Dengue virus
PTLDFELTKT

SEQ ID NO: 117383 - protein, 10 aa, Dengue virus
TLDFELTKTT

SEQ ID NO: 117384 - protein, 10 aa, Dengue virus
LDFELTKTTA

SEQ ID NO: 117385 - protein, 10 aa, Dengue virus
DFELTKTTAK

SEQ ID NO: 117386 - protein, 10 aa, Dengue virus
TTASRCPTQG

SEQ ID NO: 117387 - protein, 10 aa, Dengue virus
TASRCPTQGE

SEQ ID NO: 117388 - protein, 10 aa, Dengue virus
ASRCPTQGEP

SEQ ID NO: 117389 - protein, 10 aa, Dengue virus
CRRDVVDRGW

SEQ ID NO: 117390 - protein, 10 aa, Dengue virus
RRDVVDRGWG

SEQ ID NO: 117391 - protein, 10 aa, Dengue virus
RDVVDRGWGN

SEQ ID NO: 117392 - protein, 10 aa, Dengue virus
DVVDRGWGNG

SEQ ID NO: 117393 - protein, 10 aa, Dengue virus
VVDRGWGNGC

SEQ ID NO: 117394 - protein, 10 aa, Dengue virus
CGLFGKGSLL

SEQ ID NO: 117395 - protein, 10 aa, Dengue virus
GLFGKGSLLT

SEQ ID NO: 117396 - protein, 10 aa, Dengue virus
LFGKGSLLTC

SEQ ID NO: 117397 - protein, 10 aa, Dengue virus
FGKGSLLTCA

SEQ ID NO: 117398 - protein, 10 aa, Dengue virus
GKGSLLTCAK

SEQ ID NO: 117399 - protein, 10 aa, Dengue virus
KGSLLTCAKF

SEQ ID NO: 117400 - protein, 10 aa, Dengue virus
TPHSGEENAV

SEQ ID NO: 117401 - protein, 10 aa, Dengue virus
PHSGEENAVG

SEQ ID NO: 117402 - protein, 10 aa, Dengue virus
HSGEENAVGN

SEQ ID NO: 117403 - protein, 10 aa, Dengue virus
NGDTHAVGND

SEQ ID NO: 117404 - protein, 10 aa, Dengue virus
LTLDCEPRSG

SEQ ID NO: 117405 - protein, 10 aa, Dengue virus
TLDCEPRSGI

SEQ ID NO: 117406 - protein, 10 aa, Dengue virus
LDCEPRSGID

SEQ ID NO: 117407 - protein, 10 aa, Dengue virus
RTSLDFNEMV

SEQ ID NO: 117408 - protein, 10 aa, Dengue virus
TSLDFNEMVL

SEQ ID NO: 117409 - protein, 10 aa, Dengue virus
IDFNEMILMK

SEQ ID NO: 117410 - protein, 10 aa, Dengue virus
DFNEMILMKM

SEQ ID NO: 117411 - protein, 10 aa, Dengue virus
KTWLVHKQWF

SEQ ID NO: 117412 - protein, 10 aa, Dengue virus
TWLVHKQWFL

SEQ ID NO: 117413 - protein, 10 aa, Dengue virus
WFFDLPLPWA

SEQ ID NO: 117414 - protein, 10 aa, Dengue virus
DLPLPWASGA

SEQ ID NO: 117415 - protein, 10 aa, Dengue virus
KDLLVTFKTA

SEQ ID NO: 117416 - protein, 10 aa, Dengue virus
ERMVTFKVPH

SEQ ID NO: 117417 - protein, 10 aa, Dengue virus
RMVTFKVPHA

SEQ ID NO: 117418 - protein, 10 aa, Dengue virus
MVTFKVPHAK

SEQ ID NO: 117419 - protein, 10 aa, Dengue virus
VTFKVPHAKR

SEQ ID NO: 117420 - protein, 10 aa, Dengue virus
TFKVPHAKRQ

SEQ ID NO: 117421 - protein, 10 aa, Dengue virus
FKVPHAKRQD

SEQ ID NO: 117422 - protein, 10 aa, Dengue virus
KVPHAKRQDV

SEQ ID NO: 117423 - protein, 10 aa, Dengue virus
VPHAKRQDVT

SEQ ID NO: 117424 - protein, 10 aa, Dengue virus
ALAGATEVDS

SEQ ID NO: 117425 - protein, 10 aa, Dengue virus
LAGATEVDSG

SEQ ID NO: 117426 - protein, 10 aa, Dengue virus
DGNHMFAGHL

SEQ ID NO: 117427 - protein, 10 aa, Dengue virus
GNHMFAGHLK

SEQ ID NO: 117428 - protein, 10 aa, Dengue virus
NHMFAGHLKC

SEQ ID NO: 117429 - protein, 10 aa, Dengue virus
HMFAGHLKCK

SEQ ID NO: 117430 - protein, 10 aa, Dengue virus
KCKVRMEKLR

SEQ ID NO: 117431 - protein, 10 aa, Dengue virus
CKVRMEKLRI

SEQ ID NO: 117432 - protein, 10 aa, Dengue virus
KVRMEKLRIK

SEQ ID NO: 117433 - protein, 10 aa, Dengue virus
VRMEKLRIKG

SEQ ID NO: 117434 - protein, 10 aa, Dengue virus
DKEMAETQHG

SEQ ID NO: 117435 - protein, 10 aa, Dengue virus
KEMAETQHGT

SEQ ID NO: 117436 - protein, 10 aa, Dengue virus
EMAETQHGTT

SEQ ID NO: 117437 - protein, 10 aa, Dengue virus
MAETQHGTTV

SEQ ID NO: 117438 - protein, 10 aa, Dengue virus
AETQHGTTVV

SEQ ID NO: 117439 - protein, 10 aa, Dengue virus
ETQHGTTVVK

SEQ ID NO: 117440 - protein, 10 aa, Dengue virus
PINIEAEPPF

SEQ ID NO: 117441 - protein, 10 aa, Dengue virus
INIEAEPPFG

SEQ ID NO: 117442 - protein, 10 aa, Dengue virus
NIELEPPFGD

SEQ ID NO: 117443 - protein, 10 aa, Dengue virus
IELEPPFGDS

SEQ ID NO: 117444 - protein, 10 aa, Dengue virus
ETEPPFGESY

SEQ ID NO: 117445 - protein, 10 aa, Dengue virus
TEPPFGESYI

SEQ ID NO: 117446 - protein, 10 aa, Dengue virus
KRGSSIGKMF

SEQ ID NO: 117447 - protein, 10 aa, Dengue virus
KGSTIGKMFE

SEQ ID NO: 117448 - protein, 10 aa, Dengue virus
GSSIGQMIET

SEQ ID NO: 117449 - protein, 10 aa, Dengue virus
SSIGQMIETT

SEQ ID NO: 117450 - protein, 10 aa, Dengue virus
IGQMIETTMR

SEQ ID NO: 117451 - protein, 10 aa, Dengue virus
GQMIETTMRG

SEQ ID NO: 117452 - protein, 10 aa, Dengue virus
QMIETTMRGA

SEQ ID NO: 117453 - protein, 10 aa, Dengue virus
MIETTMRGAK

SEQ ID NO: 117454 - protein, 10 aa, Dengue virus
IETTMRGAKR

SEQ ID NO: 117455 - protein, 10 aa, Dengue virus
GETAWDFGSV

SEQ ID NO: 117456 - protein, 10 aa, Dengue virus
ETAWDFGSVG

SEQ ID NO: 117457 - protein, 10 aa, Dengue virus
AWDFGSVGGL

SEQ ID NO: 117458 - protein, 10 aa, Dengue virus
VYTTMFGGVS

SEQ ID NO: 117459 - protein, 10 aa, Dengue virus
YTTMFGGVSW

SEQ ID NO: 117460 - protein, 10 aa, Dengue virus
FGGVSWMIRI

SEQ ID NO: 117461 - protein, 10 aa, Dengue virus
LVLWIGTNSR

SEQ ID NO: 117462 - protein, 10 aa, Dengue virus
VLWIGTNSRN

SEQ ID NO: 117463 - protein, 10 aa, Dengue virus
LWIGTNSRNT

SEQ ID NO: 117464 - protein, 10 aa, Dengue virus
LFLGFTVQAD

SEQ ID NO: 117465 - protein, 10 aa, Dengue virus
SKELKCGSGI

SEQ ID NO: 117466 - protein, 10 aa, Dengue virus
LKCGNGIFVT

SEQ ID NO: 117467 - protein, 10 aa, Dengue virus
KCGSGIFVTD

SEQ ID NO: 117468 - protein, 10 aa, Dengue virus
CGSGIFVTDN

SEQ ID NO: 117469 - protein, 10 aa, Dengue virus
GSGIFVTDNV

SEQ ID NO: 117470 - protein, 10 aa, Dengue virus
SGIFVTDNVH

SEQ ID NO: 117471 - protein, 10 aa, Dengue virus
GIFVTDNVHT

SEQ ID NO: 117472 - protein, 10 aa, Dengue virus
IFVTDNVHTW

SEQ ID NO: 117473 - protein, 10 aa, Dengue virus
FVTDNVHTWT

SEQ ID NO: 117474 - protein, 10 aa, Dengue virus
VTDNVHTWTE

SEQ ID NO: 117475 - protein, 10 aa, Dengue virus
YKFQPDSPSK

SEQ ID NO: 117476 - protein, 10 aa, Dengue virus
KFQPDSPSKL

SEQ ID NO: 117477 - protein, 10 aa, Dengue virus
FQPESPARLA

SEQ ID NO: 117478 - protein, 10 aa, Dengue virus
QPESPARLAS

SEQ ID NO: 117479 - protein, 10 aa, Dengue virus
PESPARLASA

SEQ ID NO: 117480 - protein, 10 aa, Dengue virus
ESPARLASAI

SEQ ID NO: 117481 - protein, 10 aa, Dengue virus
SPARLASAIL

SEQ ID NO: 117482 - protein, 10 aa, Dengue virus
PARLASAILN

SEQ ID NO: 117483 - protein, 10 aa, Dengue virus
ARLASAILNA

SEQ ID NO: 117484 - protein, 10 aa, Dengue virus
DICGIRSVTR

SEQ ID NO: 117485 - protein, 10 aa, Dengue virus
VCGIRSTTRL

SEQ ID NO: 117486 - protein, 10 aa, Dengue virus
CGIRSTTRLE

SEQ ID NO: 117487 - protein, 10 aa, Dengue virus
GIRSTTRLEN

SEQ ID NO: 117488 - protein, 10 aa, Dengue virus
IRSTTRLENV

SEQ ID NO: 117489 - protein, 10 aa, Dengue virus
RSTTRLENVM

SEQ ID NO: 117490 - protein, 10 aa, Dengue virus
STTRLENVMW

SEQ ID NO: 117491 - protein, 10 aa, Dengue virus
TRLENVMWKQ

SEQ ID NO: 117492 - protein, 10 aa, Dengue virus
RLENVMWKQI

SEQ ID NO: 117493 - protein, 10 aa, Dengue virus
YSWKTWGKAR

SEQ ID NO: 117494 - protein, 10 aa, Dengue virus
RAWNSFEVED

SEQ ID NO: 117495 - protein, 10 aa, Dengue virus
AWNSFEVEDY

SEQ ID NO: 117496 - protein, 10 aa, Dengue virus
WNSFEVEDYG

SEQ ID NO: 117497 - protein, 10 aa, Dengue virus
NSFEVEDYGF

SEQ ID NO: 117498 - protein, 10 aa, Dengue virus
SFEVEDYGFG

SEQ ID NO: 117499 - protein, 10 aa, Dengue virus
LEVEDYGFGM

SEQ ID NO: 117500 - protein, 10 aa, Dengue virus
VEDYGFGVFS

SEQ ID NO: 117501 - protein, 10 aa, Dengue virus
EDYGFGVFST

SEQ ID NO: 117502 - protein, 10 aa, Dengue virus
DYGFGVFSTN

SEQ ID NO: 117503 - protein, 10 aa, Dengue virus
YGFGVFSTNI

SEQ ID NO: 117504 - protein, 10 aa, Dengue virus
GFGVFSTNIW

SEQ ID NO: 117505 - protein, 10 aa, Dengue virus
FGVFSTNIWL

SEQ ID NO: 117506 - protein, 10 aa, Dengue virus
GVFSTNIWLK

SEQ ID NO: 117507 - protein, 10 aa, Dengue virus
CDSKLMSAAV

SEQ ID NO: 117508 - protein, 10 aa, Dengue virus
DSKLMSAAVK

SEQ ID NO: 117509 - protein, 10 aa, Dengue virus
SKLMSAAVKD

SEQ ID NO: 117510 - protein, 10 aa, Dengue virus
KDQKAVHADM

SEQ ID NO: 117511 - protein, 10 aa, Dengue virus
DQKAVHADMG

SEQ ID NO: 117512 - protein, 10 aa, Dengue virus
QKAVHADMGY

SEQ ID NO: 117513 - protein, 10 aa, Dengue virus
ADMGYWIESS

SEQ ID NO: 117514 - protein, 10 aa, Dengue virus
DMGYWIESSK

SEQ ID NO: 117515 - protein, 10 aa, Dengue virus
MGYWIESSKN

SEQ ID NO: 117516 - protein, 10 aa, Dengue virus
SNGVLESEMV

SEQ ID NO: 117517 - protein, 10 aa, Dengue virus
NGVLESEMVI

SEQ ID NO: 117518 - protein, 10 aa, Dengue virus
GVLESEMVIP

SEQ ID NO: 117519 - protein, 10 aa, Dengue virus
VLESEMVIPK

SEQ ID NO: 117520 - protein, 10 aa, Dengue virus
TQAAGPWHLG

SEQ ID NO: 117521 - protein, 10 aa, Dengue virus
QAAGPWHLGK

SEQ ID NO: 117522 - protein, 10 aa, Dengue virus
AAGPWHLGKL

SEQ ID NO: 117523 - protein, 10 aa, Dengue virus
TGPWHLGKLE

SEQ ID NO: 117524 - protein, 10 aa, Dengue virus
GPWHLGRLEM

SEQ ID NO: 117525 - protein, 10 aa, Dengue virus
PWHLGRLEMD

SEQ ID NO: 117526 - protein, 10 aa, Dengue virus
WHLGRLEMDF

SEQ ID NO: 117527 - protein, 10 aa, Dengue virus
CGSRGPSLRT

SEQ ID NO: 117528 - protein, 10 aa, Dengue virus
GSRGPSLRTT

SEQ ID NO: 117529 - protein, 10 aa, Dengue virus
SRGPSLRTTT

SEQ ID NO: 117530 - protein, 10 aa, Dengue virus
RTTTASGKLV

SEQ ID NO: 117531 - protein, 10 aa, Dengue virus
TTTASGKLVT

SEQ ID NO: 117532 - protein, 10 aa, Dengue virus
TTASGKLVTQ

SEQ ID NO: 117533 - protein, 10 aa, Dengue virus
TASGKLVTQW

SEQ ID NO: 117534 - protein, 10 aa, Dengue virus
ASGKLVTQWC

SEQ ID NO: 117535 - protein, 10 aa, Dengue virus
SGKLVTQWCC

SEQ ID NO: 117536 - protein, 10 aa, Dengue virus
GKLVTQWCCR

SEQ ID NO: 117537 - protein, 10 aa, Dengue virus
KLVTQWCCRS

SEQ ID NO: 117538 - protein, 10 aa, Dengue virus
LVTQWCCRSC

SEQ ID NO: 117539 - protein, 10 aa, Dengue virus
SCTLPPLRFK

SEQ ID NO: 117540 - protein, 10 aa, Dengue virus
CTLPPLRFKG

SEQ ID NO: 117541 - protein, 10 aa, Dengue virus
TLPPLRFKGE

SEQ ID NO: 117542 - protein, 10 aa, Dengue virus
LPPLRFKGED

SEQ ID NO: 117543 - protein, 10 aa, Dengue virus
PPLRFKGEDG

SEQ ID NO: 117544 - protein, 10 aa, Dengue virus
PLRFKGEDGC

SEQ ID NO: 117545 - protein, 10 aa, Dengue virus
LRFKGEDGCW

SEQ ID NO: 117546 - protein, 10 aa, Dengue virus
RFKGEDGCWY

SEQ ID NO: 117547 - protein, 10 aa, Dengue virus
FKGEDGCWYG

SEQ ID NO: 117548 - protein, 10 aa, Dengue virus
LGEDGCWYGM

SEQ ID NO: 117549 - protein, 10 aa, Dengue virus
MGMGMTYLAL

SEQ ID NO: 117550 - protein, 10 aa, Dengue virus
RKLTSRETAL

SEQ ID NO: 117551 - protein, 10 aa, Dengue virus
LTSKELMMTT

SEQ ID NO: 117552 - protein, 10 aa, Dengue virus
ELIDGISLGL

SEQ ID NO: 117553 - protein, 10 aa, Dengue virus
LIDGISLGLI

SEQ ID NO: 117554 - protein, 10 aa, Dengue virus
RSWPLNEGIM

SEQ ID NO: 117555 - protein, 10 aa, Dengue virus
SWPLNEAVMA

SEQ ID NO: 117556 - protein, 10 aa, Dengue virus
WPLNEGIMAI

SEQ ID NO: 117557 - protein, 10 aa, Dengue virus
PLNEGIMAIG

SEQ ID NO: 117558 - protein, 10 aa, Dengue virus
VSLLGSALLK

SEQ ID NO: 117559 - protein, 10 aa, Dengue virus
SLLGSALLKN

SEQ ID NO: 117560 - protein, 10 aa, Dengue virus
LLGSALLKND

SEQ ID NO: 117561 - protein, 10 aa, Dengue virus
LGSALLKNDV

SEQ ID NO: 117562 - protein, 10 aa, Dengue virus
GSALLKNDVP

SEQ ID NO: 117563 - protein, 10 aa, Dengue virus
SALLKNDVPL

SEQ ID NO: 117564 - protein, 10 aa, Dengue virus
ALLKNDVPLA

SEQ ID NO: 117565 - protein, 10 aa, Dengue virus
KNDVPLAGPM

SEQ ID NO: 117566 - protein, 10 aa, Dengue virus
NDVPLAGPMV

SEQ ID NO: 117567 - protein, 10 aa, Dengue virus
DVPLAGPMVA

SEQ ID NO: 117568 - protein, 10 aa, Dengue virus
VPLAGPMVAG

SEQ ID NO: 117569 - protein, 10 aa, Dengue virus
PLAGPMVAGG

SEQ ID NO: 117570 - protein, 10 aa, Dengue virus
LAGPMVAGGL

SEQ ID NO: 117571 - protein, 10 aa, Dengue virus
AGPMVAGGLL

SEQ ID NO: 117572 - protein, 10 aa, Dengue virus
GPMVAGGLLL

SEQ ID NO: 117573 - protein, 10 aa, Dengue virus
PMVAGGLLLA

SEQ ID NO: 117574 - protein, 10 aa, Dengue virus
MVAGGLLLAA

SEQ ID NO: 117575 - protein, 10 aa, Dengue virus
VAGGLLLAAY

SEQ ID NO: 117576 - protein, 10 aa, Dengue virus
AGGLLLAAYV

SEQ ID NO: 117577 - protein, 10 aa, Dengue virus
GGLLLAAYVM

SEQ ID NO: 117578 - protein, 10 aa, Dengue virus
GLLLAAYVMS

SEQ ID NO: 117579 - protein, 10 aa, Dengue virus
LLLAAYVMSG

SEQ ID NO: 117580 - protein, 10 aa, Dengue virus
LLAAYVMSGS

SEQ ID NO: 117581 - protein, 10 aa, Dengue virus
LAAYVMSGSS

SEQ ID NO: 117582 - protein, 10 aa, Dengue virus
AAYVMSGSSA

SEQ ID NO: 117583 - protein, 10 aa, Dengue virus
AYVMSGSSAD

SEQ ID NO: 117584 - protein, 10 aa, Dengue virus
YVMSGSSADL

SEQ ID NO: 117585 - protein, 10 aa, Dengue virus
VMSGSSADLS

SEQ ID NO: 117586 - protein, 10 aa, Dengue virus
MSGSSADLSL

SEQ ID NO: 117587 - protein, 10 aa, Dengue virus
GRSADLELEK

SEQ ID NO: 117588 - protein, 10 aa, Dengue virus
EAEHSGTSHN

SEQ ID NO: 117589 - protein, 10 aa, Dengue virus
AEHSGTSHNI

SEQ ID NO: 117590 - protein, 10 aa, Dengue virus
EHSGTSHNIL

SEQ ID NO: 117591 - protein, 10 aa, Dengue virus
DEDGSFSIRD

SEQ ID NO: 117592 - protein, 10 aa, Dengue virus
EDGSFSIRDV

SEQ ID NO: 117593 - protein, 10 aa, Dengue virus
DGSFSIRDVE

SEQ ID NO: 117594 - protein, 10 aa, Dengue virus
GSFSIRDVEE

SEQ ID NO: 117595 - protein, 10 aa, Dengue virus
SFSIRDVEET

SEQ ID NO: 117596 - protein, 10 aa, Dengue virus
ITLLVKLALI

SEQ ID NO: 117597 - protein, 10 aa, Dengue virus
TLLVKLALIT

SEQ ID NO: 117598 - protein, 10 aa, Dengue virus
LLVKLALITV

SEQ ID NO: 117599 - protein, 10 aa, Dengue virus
LVKLALITVS

SEQ ID NO: 117600 - protein, 10 aa, Dengue virus
VKLALITVSG

SEQ ID NO: 117601 - protein, 10 aa, Dengue virus
KTQRSGALWD

SEQ ID NO: 117602 - protein, 10 aa, Dengue virus
TQRSGALWDV

SEQ ID NO: 117603 - protein, 10 aa, Dengue virus
QRSGALWDVP

SEQ ID NO: 117604 - protein, 10 aa, Dengue virus
RSGALWDVPS

SEQ ID NO: 117605 - protein, 10 aa, Dengue virus
SGALWDVPSP

SEQ ID NO: 117606 - protein, 10 aa, Dengue virus
ALWDVPSPAA

SEQ ID NO: 117607 - protein, 10 aa, Dengue virus
AALSEGVYRI

SEQ ID NO: 117608 - protein, 10 aa, Dengue virus
LDDGIYRILQ

SEQ ID NO: 117609 - protein, 10 aa, Dengue virus
GKTQVGVGIH

SEQ ID NO: 117610 - protein, 10 aa, Dengue virus
KTQVGVGIHM

SEQ ID NO: 117611 - protein, 10 aa, Dengue virus
SQVGVGVFQD

SEQ ID NO: 117612 - protein, 10 aa, Dengue virus
DGVFHTMWHV

SEQ ID NO: 117613 - protein, 10 aa, Dengue virus
HVTRGAVLTH

SEQ ID NO: 117614 - protein, 10 aa, Dengue virus
KGKRIEPSWA

SEQ ID NO: 117615 - protein, 10 aa, Dengue virus
TGRLEPSWAD

SEQ ID NO: 117616 - protein, 10 aa, Dengue virus
GRLEPSWADV

SEQ ID NO: 117617 - protein, 10 aa, Dengue virus
RLEPSWADVR

SEQ ID NO: 117618 - protein, 10 aa, Dengue virus
LEPSWADVRN

SEQ ID NO: 117619 - protein, 10 aa, Dengue virus
EPSWADVRND

SEQ ID NO: 117620 - protein, 10 aa, Dengue virus
PSWADVRNDM

SEQ ID NO: 117621 - protein, 10 aa, Dengue virus
WANVKKDLIS

SEQ ID NO: 117622 - protein, 10 aa, Dengue virus
ANVKKDLISY

SEQ ID NO: 117623 - protein, 10 aa, Dengue virus
NVKKDLISYG

SEQ ID NO: 117624 - protein, 10 aa, Dengue virus
MISYGGGWRL

SEQ ID NO: 117625 - protein, 10 aa, Dengue virus
WDKEEDVQVL

SEQ ID NO: 117626 - protein, 10 aa, Dengue virus
DKEEDVQVLA

SEQ ID NO: 117627 - protein, 10 aa, Dengue virus
KEEDVQVLAI

SEQ ID NO: 117628 - protein, 10 aa, Dengue virus
IEPGKNPKHV

SEQ ID NO: 117629 - protein, 10 aa, Dengue virus
EPGKNPKHVQ

SEQ ID NO: 117630 - protein, 10 aa, Dengue virus
PGKNPKHVQT

SEQ ID NO: 117631 - protein, 10 aa, Dengue virus
TGEIGAVTLD

SEQ ID NO: 117632 - protein, 10 aa, Dengue virus
GEIGAVTLDF

SEQ ID NO: 117633 - protein, 10 aa, Dengue virus
EIGAVTLDFK

SEQ ID NO: 117634 - protein, 10 aa, Dengue virus
IGAVTLDFKP

SEQ ID NO: 117635 - protein, 10 aa, Dengue virus
SPGTSGSPII

SEQ ID NO: 117636 - protein, 10 aa, Dengue virus
PGTSGSPIID

SEQ ID NO: 117637 - protein, 10 aa, Dengue virus
GTSGSPIIDK

SEQ ID NO: 117638 - protein, 10 aa, Dengue virus
KGKVIGLYGN

SEQ ID NO: 117639 - protein, 10 aa, Dengue virus
LYGNGVVTKS

SEQ ID NO: 117640 - protein, 10 aa, Dengue virus
YGNGVVTKSG

SEQ ID NO: 117641 - protein, 10 aa, Dengue virus
GNGVVTKSGD

SEQ ID NO: 117642 - protein, 10 aa, Dengue virus
NGVVTKSGDY

SEQ ID NO: 117643 - protein, 10 aa, Dengue virus
GVVTKSGDYV

SEQ ID NO: 117644 - protein, 10 aa, Dengue virus
VVTKSGDYVS

SEQ ID NO: 117645 - protein, 10 aa, Dengue virus
SGDYVSAITQ

SEQ ID NO: 117646 - protein, 10 aa, Dengue virus
GDYVSAITQA

SEQ ID NO: 117647 - protein, 10 aa, Dengue virus
IFRKRRLTIM

SEQ ID NO: 117648 - protein, 10 aa, Dengue virus
FRKRRLTIMD

SEQ ID NO: 117649 - protein, 10 aa, Dengue virus
RKRRLTIMDL

SEQ ID NO: 117650 - protein, 10 aa, Dengue virus
HPGAGKTKRI

SEQ ID NO: 117651 - protein, 10 aa, Dengue virus
PGAGKTKRIL

SEQ ID NO: 117652 - protein, 10 aa, Dengue virus
GAGKTKRILP

SEQ ID NO: 117653 - protein, 10 aa, Dengue virus
AGKTKRILPS

SEQ ID NO: 117654 - protein, 10 aa, Dengue virus
GKTKRILPSI

SEQ ID NO: 117655 - protein, 10 aa, Dengue virus
KYLPAIIREA

SEQ ID NO: 117656 - protein, 10 aa, Dengue virus
YLPAMVREAI

SEQ ID NO: 117657 - protein, 10 aa, Dengue virus
LPAIVREAIR

SEQ ID NO: 117658 - protein, 10 aa, Dengue virus
PAIVREAIRR

SEQ ID NO: 117659 - protein, 10 aa, Dengue virus
REALKRRLRT

SEQ ID NO: 117660 - protein, 10 aa, Dengue virus
EALKRRLRTL

SEQ ID NO: 117661 - protein, 10 aa, Dengue virus
KRKLRTLVLA

SEQ ID NO: 117662 - protein, 10 aa, Dengue virus
RKLRTLVLAP

SEQ ID NO: 117663 - protein, 10 aa, Dengue virus
KLRTLVLAPT

SEQ ID NO: 117664 - protein, 10 aa, Dengue virus
RGLPIRYQTT

SEQ ID NO: 117665 - protein, 10 aa, Dengue virus
LPIRYQTPAV

SEQ ID NO: 117666 - protein, 10 aa, Dengue virus
KTEHTGREIV

SEQ ID NO: 117667 - protein, 10 aa, Dengue virus
TEHTGREIVD

SEQ ID NO: 117668 - protein, 10 aa, Dengue virus
SPIRVPNYNL

SEQ ID NO: 117669 - protein, 10 aa, Dengue virus
PIRVPNYNLI

SEQ ID NO: 117670 - protein, 10 aa, Dengue virus
IRVPNYNLII

SEQ ID NO: 117671 - protein, 10 aa, Dengue virus
RVPNYNLVIM

SEQ ID NO: 117672 - protein, 10 aa, Dengue virus
VPNYNLVIMD

SEQ ID NO: 117673 - protein, 10 aa, Dengue virus
PNYNLVIMDE

SEQ ID NO: 117674 - protein, 10 aa, Dengue virus
NYNLVIMDEA

SEQ ID NO: 117675 - protein, 10 aa, Dengue virus
YNLVIMDEAH

SEQ ID NO: 117676 - protein, 10 aa, Dengue virus
NLVIMDEAHF

SEQ ID NO: 117677 - protein, 10 aa, Dengue virus
LVIMDEAHFT

SEQ ID NO: 117678 - protein, 10 aa, Dengue virus
EAFPQSNAPI

SEQ ID NO: 117679 - protein, 10 aa, Dengue virus
IEDIEREIPE

SEQ ID NO: 117680 - protein, 10 aa, Dengue virus
EDIEREIPER

SEQ ID NO: 117681 - protein, 10 aa, Dengue virus
DEEKDIPERS

SEQ ID NO: 117682 - protein, 10 aa, Dengue virus
EEKDIPERSW

SEQ ID NO: 117683 - protein, 10 aa, Dengue virus
KDIPERSWNS

SEQ ID NO: 117684 - protein, 10 aa, Dengue virus
IPERSWNTGF

SEQ ID NO: 117685 - protein, 10 aa, Dengue virus
FVGKTVWFVP

SEQ ID NO: 117686 - protein, 10 aa, Dengue virus
VGKTVWFVPS

SEQ ID NO: 117687 - protein, 10 aa, Dengue virus
SIKTGNDIAA

SEQ ID NO: 117688 - protein, 10 aa, Dengue virus
IKTGNDIAAC

SEQ ID NO: 117689 - protein, 10 aa, Dengue virus
KTGNDIAACL

SEQ ID NO: 117690 - protein, 10 aa, Dengue virus
ANCLRKSGKK

SEQ ID NO: 117691 - protein, 10 aa, Dengue virus
NCLRKSGKKV

SEQ ID NO: 117692 - protein, 10 aa, Dengue virus
CLRKNGKRVV

SEQ ID NO: 117693 - protein, 10 aa, Dengue virus
LRKNGKRVVQ

SEQ ID NO: 117694 - protein, 10 aa, Dengue virus
RKNGKRVVQL

SEQ ID NO: 117695 - protein, 10 aa, Dengue virus
KNGKRVVQLS

SEQ ID NO: 117696 - protein, 10 aa, Dengue virus
NGKRVVQLSR

SEQ ID NO: 117697 - protein, 10 aa, Dengue virus
SRKTFDSEYI

SEQ ID NO: 117698 - protein, 10 aa, Dengue virus
RKTFDSEYIK

SEQ ID NO: 117699 - protein, 10 aa, Dengue virus
ANDWDFVVTT

SEQ ID NO: 117700 - protein, 10 aa, Dengue virus
SEMGANFRAG

SEQ ID NO: 117701 - protein, 10 aa, Dengue virus
EMGANFRAGR

SEQ ID NO: 117702 - protein, 10 aa, Dengue virus
MGANFRAGRV

SEQ ID NO: 117703 - protein, 10 aa, Dengue virus
GANFRAGRVI

SEQ ID NO: 117704 - protein, 10 aa, Dengue virus
ANFRAGRVID

SEQ ID NO: 117705 - protein, 10 aa, Dengue virus
NFRAGRVIDP

SEQ ID NO: 117706 - protein, 10 aa, Dengue virus
FRAGRVIDPR

SEQ ID NO: 117707 - protein, 10 aa, Dengue virus
RAGRVIDPRR

SEQ ID NO: 117708 - protein, 10 aa, Dengue virus
CLKPVILPDG

SEQ ID NO: 117709 - protein, 10 aa, Dengue virus
LKPVILPDGP

SEQ ID NO: 117710 - protein, 10 aa, Dengue virus
KPVILPDGPE

SEQ ID NO: 117711 - protein, 10 aa, Dengue virus
PVILPDGPER

SEQ ID NO: 117712 - protein, 10 aa, Dengue virus
VILPDGPERV

SEQ ID NO: 117713 - protein, 10 aa, Dengue virus
ILTDGEERVV

SEQ ID NO: 117714 - protein, 10 aa, Dengue virus
LTDGEERVVL

SEQ ID NO: 117715 - protein, 10 aa, Dengue virus
TDGEERVVLA

SEQ ID NO: 117716 - protein, 10 aa, Dengue virus
ILAGPIPVTP

SEQ ID NO: 117717 - protein, 10 aa, Dengue virus
LAGPIPVTPA

SEQ ID NO: 117718 - protein, 10 aa, Dengue virus
AGPIPVTPAS

SEQ ID NO: 117719 - protein, 10 aa, Dengue virus
GPIPVTPASA

SEQ ID NO: 117720 - protein, 10 aa, Dengue virus
PIPVTPASAA

SEQ ID NO: 117721 - protein, 10 aa, Dengue virus
IPVTPASAAQ

SEQ ID NO: 117722 - protein, 10 aa, Dengue virus
PVTPASAAQR

SEQ ID NO: 117723 - protein, 10 aa, Dengue virus
VTPASAAQRR

SEQ ID NO: 117724 - protein, 10 aa, Dengue virus
TPASAAQRRG

SEQ ID NO: 117725 - protein, 10 aa, Dengue virus
PASAAQRRGR

SEQ ID NO: 117726 - protein, 10 aa, Dengue virus
SSAAQRRGRV

SEQ ID NO: 117727 - protein, 10 aa, Dengue virus
QRRGRIGRNQ

SEQ ID NO: 117728 - protein, 10 aa, Dengue virus
KEGDQYVYMG

SEQ ID NO: 117729 - protein, 10 aa, Dengue virus
EGDQYVYMGQ

SEQ ID NO: 117730 - protein, 10 aa, Dengue virus
GDQYVYMGQP

SEQ ID NO: 117731 - protein, 10 aa, Dengue virus
DQYVYMGQPL

SEQ ID NO: 117732 - protein, 10 aa, Dengue virus
FSGDPLKNDE

SEQ ID NO: 117733 - protein, 10 aa, Dengue virus
SGDPLKNDED

SEQ ID NO: 117734 - protein, 10 aa, Dengue virus
EPEREKSAAV

SEQ ID NO: 117735 - protein, 10 aa, Dengue virus
PEREKSAAVD

SEQ ID NO: 117736 - protein, 10 aa, Dengue virus
EREKSAAVDG

SEQ ID NO: 117737 - protein, 10 aa, Dengue virus
REKSAAVDGE

SEQ ID NO: 117738 - protein, 10 aa, Dengue virus
EKSAAVDGEY

SEQ ID NO: 117739 - protein, 10 aa, Dengue virus
KSAAVDGEYR

SEQ ID NO: 117740 - protein, 10 aa, Dengue virus
SAAVDGEYRL

SEQ ID NO: 117741 - protein, 10 aa, Dengue virus
QAIDGEFRLR

SEQ ID NO: 117742 - protein, 10 aa, Dengue virus
AVDGEYRLRG

SEQ ID NO: 117743 - protein, 10 aa, Dengue virus
VDGEYRLRGE

SEQ ID NO: 117744 - protein, 10 aa, Dengue virus
RGEQRKTFVE

SEQ ID NO: 117745 - protein, 10 aa, Dengue virus
GEQRKTFVEL

SEQ ID NO: 117746 - protein, 10 aa, Dengue virus
EQRKTFVELM

SEQ ID NO: 117747 - protein, 10 aa, Dengue virus
QRKTFVELMR

SEQ ID NO: 117748 - protein, 10 aa, Dengue virus
RGDLPVWLSH

SEQ ID NO: 117749 - protein, 10 aa, Dengue virus
GDLPVWLAYR

SEQ ID NO: 117750 - protein, 10 aa, Dengue virus
DLPVWLAYRV

SEQ ID NO: 117751 - protein, 10 aa, Dengue virus
LPVWLAYRVA

SEQ ID NO: 117752 - protein, 10 aa, Dengue virus
PVWLAYRVAA

SEQ ID NO: 117753 - protein, 10 aa, Dengue virus
YADRKWCFDG

SEQ ID NO: 117754 - protein, 10 aa, Dengue virus
KNNQILEENM

SEQ ID NO: 117755 - protein, 10 aa, Dengue virus
NNQILEENME

SEQ ID NO: 117756 - protein, 10 aa, Dengue virus
NQILEENMEV

SEQ ID NO: 117757 - protein, 10 aa, Dengue virus
QILEENMEVE

SEQ ID NO: 117758 - protein, 10 aa, Dengue virus
ILEENMEVEI

SEQ ID NO: 117759 - protein, 10 aa, Dengue virus
LEENMEVEVW

SEQ ID NO: 117760 - protein, 10 aa, Dengue virus
EENMEVEVWT

SEQ ID NO: 117761 - protein, 10 aa, Dengue virus
ENMEVEIWTR

SEQ ID NO: 117762 - protein, 10 aa, Dengue virus
NMEVEIWTRE

SEQ ID NO: 117763 - protein, 10 aa, Dengue virus
MEVEIWTREG

SEQ ID NO: 117764 - protein, 10 aa, Dengue virus
EKKKLRPKWL

SEQ ID NO: 117765 - protein, 10 aa, Dengue virus
KKKLRPKWLD

SEQ ID NO: 117766 - protein, 10 aa, Dengue virus
LRPKWLDARV

SEQ ID NO: 117767 - protein, 10 aa, Dengue virus
RPKWLDARVY

SEQ ID NO: 117768 - protein, 10 aa, Dengue virus
PKWLDARVYA

SEQ ID NO: 117769 - protein, 10 aa, Dengue virus
KWLDARVYAD

SEQ ID NO: 117770 - protein, 10 aa, Dengue virus
RVYADPMALK

SEQ ID NO: 117771 - protein, 10 aa, Dengue virus
VYADPMALKD

SEQ ID NO: 117772 - protein, 10 aa, Dengue virus
DPMALKDFKE

SEQ ID NO: 117773 - protein, 10 aa, Dengue virus
PMALKDFKEF

SEQ ID NO: 117774 - protein, 10 aa, Dengue virus
MALKDFKEFA

SEQ ID NO: 117775 - protein, 10 aa, Dengue virus
ALKDFKEFAS

SEQ ID NO: 117776 - protein, 10 aa, Dengue virus
LKDFKEFASG

SEQ ID NO: 117777 - protein, 10 aa, Dengue virus
KDFKEFASGR

SEQ ID NO: 117778 - protein, 10 aa, Dengue virus
DFKEFASGRK

SEQ ID NO: 117779 - protein, 10 aa, Dengue virus
FKEFASGRKS

SEQ ID NO: 117780 - protein, 10 aa, Dengue virus
KEFASGRKSI

SEQ ID NO: 117781 - protein, 10 aa, Dengue virus
FASGRKSITL

SEQ ID NO: 117782 - protein, 10 aa, Dengue virus
DILTEIASLP

SEQ ID NO: 117783 - protein, 10 aa, Dengue virus
TEIASLPTYL

SEQ ID NO: 117784 - protein, 10 aa, Dengue virus
EIASLPTYLS

SEQ ID NO: 117785 - protein, 10 aa, Dengue virus
RNALDNLAVL

SEQ ID NO: 117786 - protein, 10 aa, Dengue virus
LALDNIVMLH

SEQ ID NO: 117787 - protein, 10 aa, Dengue virus
ALDNIVMLHT

SEQ ID NO: 117788 - protein, 10 aa, Dengue virus
LDNIVMLHTT

SEQ ID NO: 117789 - protein, 10 aa, Dengue virus
DNIVMLHTTE

SEQ ID NO: 117790 - protein, 10 aa, Dengue virus
AYQHALNELP

SEQ ID NO: 117791 - protein, 10 aa, Dengue virus
YQHALNELPE

SEQ ID NO: 117792 - protein, 10 aa, Dengue virus
QHALNELPES

SEQ ID NO: 117793 - protein, 10 aa, Dengue virus
HALNELPESL

SEQ ID NO: 117794 - protein, 10 aa, Dengue virus
ALNELPESLE

SEQ ID NO: 117795 - protein, 10 aa, Dengue virus
LNELPESLET

SEQ ID NO: 117796 - protein, 10 aa, Dengue virus
NELPESLETL

SEQ ID NO: 117797 - protein, 10 aa, Dengue virus
ELPESLETLM

SEQ ID NO: 117798 - protein, 10 aa, Dengue virus
LPESLETLML

SEQ ID NO: 117799 - protein, 10 aa, Dengue virus
PESLETLMLV

SEQ ID NO: 117800 - protein, 10 aa, Dengue virus
ESLETLMLVA

SEQ ID NO: 117801 - protein, 10 aa, Dengue virus
SLETLMLVAL

SEQ ID NO: 117802 - protein, 10 aa, Dengue virus
LETLMLVALL

SEQ ID NO: 117803 - protein, 10 aa, Dengue virus
ETLMLVALLG

SEQ ID NO: 117804 - protein, 10 aa, Dengue virus
GKLSMGLITI

SEQ ID NO: 117805 - protein, 10 aa, Dengue virus
VPLQWIASAI

SEQ ID NO: 117806 - protein, 10 aa, Dengue virus
QPQWIAASII

SEQ ID NO: 117807 - protein, 10 aa, Dengue virus
LMVLLIPEPE

SEQ ID NO: 117808 - protein, 10 aa, Dengue virus
DNQLTYVIIA

SEQ ID NO: 117809 - protein, 10 aa, Dengue virus
NQLIYVILTI

SEQ ID NO: 117810 - protein, 10 aa, Dengue virus
QLIYVILTIL

SEQ ID NO: 117811 - protein, 10 aa, Dengue virus
LIYVILTILT

SEQ ID NO: 117812 - protein, 10 aa, Dengue virus
IAANEMGLIE

SEQ ID NO: 117813 - protein, 10 aa, Dengue virus
EMGLIEKTKT

SEQ ID NO: 117814 - protein, 10 aa, Dengue virus
MGLIEKTKTD

SEQ ID NO: 117815 - protein, 10 aa, Dengue virus
GLIEKTKTDF

SEQ ID NO: 117816 - protein, 10 aa, Dengue virus
LIEKTKTDFG

SEQ ID NO: 117817 - protein, 10 aa, Dengue virus
TLYAVATTIL

SEQ ID NO: 117818 - protein, 10 aa, Dengue virus
LYAVATTILT

SEQ ID NO: 117819 - protein, 10 aa, Dengue virus
YAVATTILTP

SEQ ID NO: 117820 - protein, 10 aa, Dengue virus
AVATTILTPM

SEQ ID NO: 117821 - protein, 10 aa, Dengue virus
LTPMLRHTIE

SEQ ID NO: 117822 - protein, 10 aa, Dengue virus
PMLRHTIENT

SEQ ID NO: 117823 - protein, 10 aa, Dengue virus
MLRHTIENTS

SEQ ID NO: 117824 - protein, 10 aa, Dengue virus
LRHTIENTSA

SEQ ID NO: 117825 - protein, 10 aa, Dengue virus
RHTIENTSAN

SEQ ID NO: 117826 - protein, 10 aa, Dengue virus
HTIENTSANL

SEQ ID NO: 117827 - protein, 10 aa, Dengue virus
TIENTSANLS

SEQ ID NO: 117828 - protein, 10 aa, Dengue virus
IENTSANLSL

SEQ ID NO: 117829 - protein, 10 aa, Dengue virus
ENTSANLSLA

SEQ ID NO: 117830 - protein, 10 aa, Dengue virus
NTSANLSLAA

SEQ ID NO: 117831 - protein, 10 aa, Dengue virus
TSANLSLAAI

SEQ ID NO: 117832 - protein, 10 aa, Dengue virus
SANLSLAAIA

SEQ ID NO: 117833 - protein, 10 aa, Dengue virus
ANLSLAAIAN

SEQ ID NO: 117834 - protein, 10 aa, Dengue virus
NLSLAAIANQ

SEQ ID NO: 117835 - protein, 10 aa, Dengue virus
LSLAAIANQA

SEQ ID NO: 117836 - protein, 10 aa, Dengue virus
SLAAIANQAA

SEQ ID NO: 117837 - protein, 10 aa, Dengue virus
LAAIANQAAV

SEQ ID NO: 117838 - protein, 10 aa, Dengue virus
AAIANQAAVL

SEQ ID NO: 117839 - protein, 10 aa, Dengue virus
AIANQAAVLM

SEQ ID NO: 117840 - protein, 10 aa, Dengue virus
IANQAAVLMG

SEQ ID NO: 117841 - protein, 10 aa, Dengue virus
ANQAAVLMGL

SEQ ID NO: 117842 - protein, 10 aa, Dengue virus
NQAAVLMGLG

SEQ ID NO: 117843 - protein, 10 aa, Dengue virus
QAAVLMGLGK

SEQ ID NO: 117844 - protein, 10 aa, Dengue virus
AAVLMGLGKG

SEQ ID NO: 117845 - protein, 10 aa, Dengue virus
AVLMGLGKGW

SEQ ID NO: 117846 - protein, 10 aa, Dengue virus
VLMGLGRGWP

SEQ ID NO: 117847 - protein, 10 aa, Dengue virus
MGLGRGWPLS

SEQ ID NO: 117848 - protein, 10 aa, Dengue virus
GLGRGWPLSK

SEQ ID NO: 117849 - protein, 10 aa, Dengue virus
LGRGWPLSKM

SEQ ID NO: 117850 - protein, 10 aa, Dengue virus
GRGWPLSKMD

SEQ ID NO: 117851 - protein, 10 aa, Dengue virus
KGWPLHRMDL

SEQ ID NO: 117852 - protein, 10 aa, Dengue virus
GWPLHRMDLG

SEQ ID NO: 117853 - protein, 10 aa, Dengue virus
WPLHRMDLGV

SEQ ID NO: 117854 - protein, 10 aa, Dengue virus
PLHRMDLGVP

SEQ ID NO: 117855 - protein, 10 aa, Dengue virus
LHRMDLGVPL

SEQ ID NO: 117856 - protein, 10 aa, Dengue virus
MDLGVPLLAM

SEQ ID NO: 117857 - protein, 10 aa, Dengue virus
DLGVPLLAMG

SEQ ID NO: 117858 - protein, 10 aa, Dengue virus
LGVPLLAMGC

SEQ ID NO: 117859 - protein, 10 aa, Dengue virus
YSQVNPLTLI

SEQ ID NO: 117860 - protein, 10 aa, Dengue virus
SQVNPLTLIA

SEQ ID NO: 117861 - protein, 10 aa, Dengue virus
QVNPLTLIAA

SEQ ID NO: 117862 - protein, 10 aa, Dengue virus
VNPLTLIAAV

SEQ ID NO: 117863 - protein, 10 aa, Dengue virus
LLVHYAIIGP

SEQ ID NO: 117864 - protein, 10 aa, Dengue virus
MKNPTIDGIV

SEQ ID NO: 117865 - protein, 10 aa, Dengue virus
KNPTIDGIVA

SEQ ID NO: 117866 - protein, 10 aa, Dengue virus
NPTIDGIVAI

SEQ ID NO: 117867 - protein, 10 aa, Dengue virus
VIDLEPIPYD

SEQ ID NO: 117868 - protein, 10 aa, Dengue virus
PISYDPKFEK

SEQ ID NO: 117869 - protein, 10 aa, Dengue virus
ISYDPKFEKQ

SEQ ID NO: 117870 - protein, 10 aa, Dengue virus
SYDPKFEKQL

SEQ ID NO: 117871 - protein, 10 aa, Dengue virus
TKFEKQLGQI

SEQ ID NO: 117872 - protein, 10 aa, Dengue virus
GQVMLLVLCV

SEQ ID NO: 117873 - protein, 10 aa, Dengue virus
LCAGQLLLMR

SEQ ID NO: 117874 - protein, 10 aa, Dengue virus
CAGQLLLMRT

SEQ ID NO: 117875 - protein, 10 aa, Dengue virus
AGQLLLMRTT

SEQ ID NO: 117876 - protein, 10 aa, Dengue virus
GQLLLMRTTW

SEQ ID NO: 117877 - protein, 10 aa, Dengue virus
QLLLMRTTWA

SEQ ID NO: 117878 - protein, 10 aa, Dengue virus
LLLMRTTWAF

SEQ ID NO: 117879 - protein, 10 aa, Dengue virus
LLMRTTWAFC

SEQ ID NO: 117880 - protein, 10 aa, Dengue virus
LMRTTWAFCE

SEQ ID NO: 117881 - protein, 10 aa, Dengue virus
MRTTWAFCEV

SEQ ID NO: 117882 - protein, 10 aa, Dengue virus
RTTWAFCEVL

SEQ ID NO: 117883 - protein, 10 aa, Dengue virus
TTWAFCEVLT

SEQ ID NO: 117884 - protein, 10 aa, Dengue virus
TWAFCEVLTL

SEQ ID NO: 117885 - protein, 10 aa, Dengue virus
WAFCEALTLA

SEQ ID NO: 117886 - protein, 10 aa, Dengue virus
AFCEALTLAT

SEQ ID NO: 117887 - protein, 10 aa, Dengue virus
FCEALTLATG

SEQ ID NO: 117888 - protein, 10 aa, Dengue virus
EALTLATGPV

SEQ ID NO: 117889 - protein, 10 aa, Dengue virus
LTLATGPILT

SEQ ID NO: 117890 - protein, 10 aa, Dengue virus
TLATGPILTL

SEQ ID NO: 117891 - protein, 10 aa, Dengue virus
LATGPILTLW

SEQ ID NO: 117892 - protein, 10 aa, Dengue virus
ATGPILTLWE

SEQ ID NO: 117893 - protein, 10 aa, Dengue virus
TGPILTLWEG

SEQ ID NO: 117894 - protein, 10 aa, Dengue virus
GPILTLWEGN

SEQ ID NO: 117895 - protein, 10 aa, Dengue virus
PILTLWEGNP

SEQ ID NO: 117896 - protein, 10 aa, Dengue virus
ILTLWEGNPG

SEQ ID NO: 117897 - protein, 10 aa, Dengue virus
STLWEGNPGK

SEQ ID NO: 117898 - protein, 10 aa, Dengue virus
AGAGLAFSLI

SEQ ID NO: 117899 - protein, 10 aa, Dengue virus
GAGLAFSLIK

SEQ ID NO: 117900 - protein, 10 aa, Dengue virus
AGLAFSLIKN

SEQ ID NO: 117901 - protein, 10 aa, Dengue virus
GLAFSLIKNA

SEQ ID NO: 117902 - protein, 10 aa, Dengue virus
MGETLGEKWK

SEQ ID NO: 117903 - protein, 10 aa, Dengue virus
GETLGEKWKN

SEQ ID NO: 117904 - protein, 10 aa, Dengue virus
ETLGEKWKNR

SEQ ID NO: 117905 - protein, 10 aa, Dengue virus
TLGEKWKNRL

SEQ ID NO: 117906 - protein, 10 aa, Dengue virus
LGEKWKNRLN

SEQ ID NO: 117907 - protein, 10 aa, Dengue virus
EVDRTEAKSA

SEQ ID NO: 117908 - protein, 10 aa, Dengue virus
VDRTEAKSAL

SEQ ID NO: 117909 - protein, 10 aa, Dengue virus
EAKEGLRRGE

SEQ ID NO: 117910 - protein, 10 aa, Dengue virus
AKSALKDGSK

SEQ ID NO: 117911 - protein, 10 aa, Dengue virus
KHAVSRGSSK

SEQ ID NO: 117912 - protein, 10 aa, Dengue virus
AVSRGSSKIR

SEQ ID NO: 117913 - protein, 10 aa, Dengue virus
VSRGSSKIRW

SEQ ID NO: 117914 - protein, 10 aa, Dengue virus
SRGSSKIRWI

SEQ ID NO: 117915 - protein, 10 aa, Dengue virus
RGSSKIRWIV

SEQ ID NO: 117916 - protein, 10 aa, Dengue virus
GSSKIRWIVE

SEQ ID NO: 117917 - protein, 10 aa, Dengue virus
SSKIRWIVER

SEQ ID NO: 117918 - protein, 10 aa, Dengue virus
KIRWIVERGM

SEQ ID NO: 117919 - protein, 10 aa, Dengue virus
IRWIVERGMV

SEQ ID NO: 117920 - protein, 10 aa, Dengue virus
PKGKVVDLGC

SEQ ID NO: 117921 - protein, 10 aa, Dengue virus
KGKVVDLGCG

SEQ ID NO: 117922 - protein, 10 aa, Dengue virus
WSYYCGGLKD

SEQ ID NO: 117923 - protein, 10 aa, Dengue virus
SYYCGGLKDV

SEQ ID NO: 117924 - protein, 10 aa, Dengue virus
YYCGGLKNVK

SEQ ID NO: 117925 - protein, 10 aa, Dengue virus
YCGGLKNVKE

SEQ ID NO: 117926 - protein, 10 aa, Dengue virus
CGGLKNVKEV

SEQ ID NO: 117927 - protein, 10 aa, Dengue virus
VKEVKGLTKG

SEQ ID NO: 117928 - protein, 10 aa, Dengue virus
KEVKGLTKGG

SEQ ID NO: 117929 - protein, 10 aa, Dengue virus
PGHEEPVPMA

SEQ ID NO: 117930 - protein, 10 aa, Dengue virus
VPMSTYGWNL

SEQ ID NO: 117931 - protein, 10 aa, Dengue virus
MSTYGWNLVK

SEQ ID NO: 117932 - protein, 10 aa, Dengue virus
STYGWNLVKL

SEQ ID NO: 117933 - protein, 10 aa, Dengue virus
TYGWNLVKLY

SEQ ID NO: 117934 - protein, 10 aa, Dengue virus
GWNLVKLYSG

SEQ ID NO: 117935 - protein, 10 aa, Dengue virus
IGESSSNPTI

SEQ ID NO: 117936 - protein, 10 aa, Dengue virus
GESSSNPTIE

SEQ ID NO: 117937 - protein, 10 aa, Dengue virus
ESSPNPTVEA

SEQ ID NO: 117938 - protein, 10 aa, Dengue virus
SSPNPTVEAG

SEQ ID NO: 117939 - protein, 10 aa, Dengue virus
SPNPTVEAGR

SEQ ID NO: 117940 - protein, 10 aa, Dengue virus
PNPTVEAGRT

SEQ ID NO: 117941 - protein, 10 aa, Dengue virus
NPTVEAGRTL

SEQ ID NO: 117942 - protein, 10 aa, Dengue virus
PTVEAGRTLR

SEQ ID NO: 117943 - protein, 10 aa, Dengue virus
TVEAGRTLRV

SEQ ID NO: 117944 - protein, 10 aa, Dengue virus
VEAGRTLRVL

SEQ ID NO: 117945 - protein, 10 aa, Dengue virus
EAGRTLRVLS

SEQ ID NO: 117946 - protein, 10 aa, Dengue virus
AGRTLRVLSL

SEQ ID NO: 117947 - protein, 10 aa, Dengue virus
GRTLRVLSLV

SEQ ID NO: 117948 - protein, 10 aa, Dengue virus
RTLRVLSLVE

SEQ ID NO: 117949 - protein, 10 aa, Dengue virus
TLRVLSLVEN

SEQ ID NO: 117950 - protein, 10 aa, Dengue virus
LRVLSLVENW

SEQ ID NO: 117951 - protein, 10 aa, Dengue virus
QFCVKVLNPY

SEQ ID NO: 117952 - protein, 10 aa, Dengue virus
VKVLNPYMPS

SEQ ID NO: 117953 - protein, 10 aa, Dengue virus
KVLNPYMPAV

SEQ ID NO: 117954 - protein, 10 aa, Dengue virus
VLNPYMPAVI

SEQ ID NO: 117955 - protein, 10 aa, Dengue virus
LNPYMPAVIE

SEQ ID NO: 117956 - protein, 10 aa, Dengue virus
HGGNLVRCPL

SEQ ID NO: 117957 - protein, 10 aa, Dengue virus
STHEMYWVSG

SEQ ID NO: 117958 - protein, 10 aa, Dengue virus
THEMYWVSGA

SEQ ID NO: 117959 - protein, 10 aa, Dengue virus
HEMYWVSNAS

SEQ ID NO: 117960 - protein, 10 aa, Dengue virus
EMYWVSNASG

SEQ ID NO: 117961 - protein, 10 aa, Dengue virus
MYWVSNASGN

SEQ ID NO: 117962 - protein, 10 aa, Dengue virus
YWVSNASGNI

SEQ ID NO: 117963 - protein, 10 aa, Dengue virus
WVSNASGNIV

SEQ ID NO: 117964 - protein, 10 aa, Dengue virus
GTGNIVASVN

SEQ ID NO: 117965 - protein, 10 aa, Dengue virus
TGNIVASVNM

SEQ ID NO: 117966 - protein, 10 aa, Dengue virus
GNIVSSVNMV

SEQ ID NO: 117967 - protein, 10 aa, Dengue virus
NIVSSVNMVS

SEQ ID NO: 117968 - protein, 10 aa, Dengue virus
IVSSVNMVSR

SEQ ID NO: 117969 - protein, 10 aa, Dengue virus
VSSVNMVSRL

SEQ ID NO: 117970 - protein, 10 aa, Dengue virus
SSVNMVSRLL

SEQ ID NO: 117971 - protein, 10 aa, Dengue virus
SVNTTSKMLL

SEQ ID NO: 117972 - protein, 10 aa, Dengue virus
VNTTSKMLLN

SEQ ID NO: 117973 - protein, 10 aa, Dengue virus
NTTSKMLLNR

SEQ ID NO: 117974 - protein, 10 aa, Dengue virus
TTSKMLLNRF

SEQ ID NO: 117975 - protein, 10 aa, Dengue virus
TSKMLLNRFT

SEQ ID NO: 117976 - protein, 10 aa, Dengue virus
SKMLLNRFTT

SEQ ID NO: 117977 - protein, 10 aa, Dengue virus
PTYEKDVDLG

SEQ ID NO: 117978 - protein, 10 aa, Dengue virus
ERDVDLGTGT

SEQ ID NO: 117979 - protein, 10 aa, Dengue virus
RDVDLGTGTR

SEQ ID NO: 117980 - protein, 10 aa, Dengue virus
DVDLGTGTRH

SEQ ID NO: 117981 - protein, 10 aa, Dengue virus
VDLGTGTRHV

SEQ ID NO: 117982 - protein, 10 aa, Dengue virus
DLGAGTRSVS

SEQ ID NO: 117983 - protein, 10 aa, Dengue virus
LGAGTRSVST

SEQ ID NO: 117984 - protein, 10 aa, Dengue virus
GAGTRSVSTE

SEQ ID NO: 117985 - protein, 10 aa, Dengue virus
PDMTIIGRRL

SEQ ID NO: 117986 - protein, 10 aa, Dengue virus
TIIGRRLQRL

SEQ ID NO: 117987 - protein, 10 aa, Dengue virus
TWHYDQENPY

SEQ ID NO: 117988 - protein, 10 aa, Dengue virus
WHYDQENPYR

SEQ ID NO: 117989 - protein, 10 aa, Dengue virus
HYDQENPYRT

SEQ ID NO: 117990 - protein, 10 aa, Dengue virus
YDQENPYRTW

SEQ ID NO: 117991 - protein, 10 aa, Dengue virus
DQENPYRTWA

SEQ ID NO: 117992 - protein, 10 aa, Dengue virus
QENPYRTWAY

SEQ ID NO: 117993 - protein, 10 aa, Dengue virus
ENPYRTWAYH

SEQ ID NO: 117994 - protein, 10 aa, Dengue virus
AYHGSYEAPS

SEQ ID NO: 117995 - protein, 10 aa, Dengue virus
YHGSYEAPST

SEQ ID NO: 117996 - protein, 10 aa, Dengue virus
HGSYEAPSTG

SEQ ID NO: 117997 - protein, 10 aa, Dengue virus
GSYEAPSTGS

SEQ ID NO: 117998 - protein, 10 aa, Dengue virus
SYEAPSTGSA

SEQ ID NO: 117999 - protein, 10 aa, Dengue virus
YEAPSTGSAS

SEQ ID NO: 118000 - protein, 10 aa, Dengue virus
EAPSTGSASS

SEQ ID NO: 118001 - protein, 10 aa, Dengue virus
APSTGSASSM

SEQ ID NO: 118002 - protein, 10 aa, Dengue virus
PSTGSASSMV

SEQ ID NO: 118003 - protein, 10 aa, Dengue virus
STGSASSMVN

SEQ ID NO: 118004 - protein, 10 aa, Dengue virus
RLLTKPWDVI

SEQ ID NO: 118005 - protein, 10 aa, Dengue virus
LTKPWDVVPT

SEQ ID NO: 118006 - protein, 10 aa, Dengue virus
TKPWDVVPTV

SEQ ID NO: 118007 - protein, 10 aa, Dengue virus
KPWDVVPTVT

SEQ ID NO: 118008 - protein, 10 aa, Dengue virus
PWDVVPTVTQ

SEQ ID NO: 118009 - protein, 10 aa, Dengue virus
PMVTQLAMTD

SEQ ID NO: 118010 - protein, 10 aa, Dengue virus
MVTQLAMTDT

SEQ ID NO: 118011 - protein, 10 aa, Dengue virus
KEKVDTRTPQ

SEQ ID NO: 118012 - protein, 10 aa, Dengue virus
CTRAEFCNKV

SEQ ID NO: 118013 - protein, 10 aa, Dengue virus
TRAEFCNKVR

SEQ ID NO: 118014 - protein, 10 aa, Dengue virus
SKVRSNAAIG

SEQ ID NO: 118015 - protein, 10 aa, Dengue virus
VRSNAALGAV

SEQ ID NO: 118016 - protein, 10 aa, Dengue virus
RSNAALGAVF

SEQ ID NO: 118017 - protein, 10 aa, Dengue virus
SNAAIGAVFQ

SEQ ID NO: 118018 - protein, 10 aa, Dengue virus
NAAIGAVFQE

SEQ ID NO: 118019 - protein, 10 aa, Dengue virus
AAIGAVFQEE

SEQ ID NO: 118020 - protein, 10 aa, Dengue virus
AIGAVFQEEQ

SEQ ID NO: 118021 - protein, 10 aa, Dengue virus
IGAVFQEEQG

SEQ ID NO: 118022 - protein, 10 aa, Dengue virus
GAVFQEEQGW

SEQ ID NO: 118023 - protein, 10 aa, Dengue virus
AVFQEEQGWT

SEQ ID NO: 118024 - protein, 10 aa, Dengue virus
VFQEEQGWTS

SEQ ID NO: 118025 - protein, 10 aa, Dengue virus
FQEEQGWTSA

SEQ ID NO: 118026 - protein, 10 aa, Dengue virus
TEENQWDSAR

SEQ ID NO: 118027 - protein, 10 aa, Dengue virus
EENQWDSARA

SEQ ID NO: 118028 - protein, 10 aa, Dengue virus
ENQWDSARAA

SEQ ID NO: 118029 - protein, 10 aa, Dengue virus
NQWDSARAAV

SEQ ID NO: 118030 - protein, 10 aa, Dengue virus
QWDSARAAVE

SEQ ID NO: 118031 - protein, 10 aa, Dengue virus
WDSARAAVED

SEQ ID NO: 118032 - protein, 10 aa, Dengue virus
ERALHQEGKC

SEQ ID NO: 118033 - protein, 10 aa, Dengue virus
RALHQEGKCE

SEQ ID NO: 118034 - protein, 10 aa, Dengue virus
ALHQEGKCES

SEQ ID NO: 118035 - protein, 10 aa, Dengue virus
LHQEGKCESC

SEQ ID NO: 118036 - protein, 10 aa, Dengue virus
HQEGKCESCV

SEQ ID NO: 118037 - protein, 10 aa, Dengue virus
QEGKCESCVY

SEQ ID NO: 118038 - protein, 10 aa, Dengue virus
EGKCESCVYN

SEQ ID NO: 118039 - protein, 10 aa, Dengue virus
GKCESCVYNM

SEQ ID NO: 118040 - protein, 10 aa, Dengue virus
KCESCVYNMM

SEQ ID NO: 118041 - protein, 10 aa, Dengue virus
CESCVYNMMG

SEQ ID NO: 118042 - protein, 10 aa, Dengue virus
ESCVYNMMGK

SEQ ID NO: 118043 - protein, 10 aa, Dengue virus
LNEDHWFGRE

SEQ ID NO: 118044 - protein, 10 aa, Dengue virus
DHWFGRENSW

SEQ ID NO: 118045 - protein, 10 aa, Dengue virus
HWFGRENSWS

SEQ ID NO: 118046 - protein, 10 aa, Dengue virus
WFGRENSWSG

SEQ ID NO: 118047 - protein, 10 aa, Dengue virus
FGRENSWSGV

SEQ ID NO: 118048 - protein, 10 aa, Dengue virus
GRENSWSGVE

SEQ ID NO: 118049 - protein, 10 aa, Dengue virus
RENSWSGVEG

SEQ ID NO: 118050 - protein, 10 aa, Dengue virus
ENSWSGVEGE

SEQ ID NO: 118051 - protein, 10 aa, Dengue virus
NSFSGVEGEG

SEQ ID NO: 118052 - protein, 10 aa, Dengue virus
SFSGVEGEGL

SEQ ID NO: 118053 - protein, 10 aa, Dengue virus
FSGVEGEGLH

SEQ ID NO: 118054 - protein, 10 aa, Dengue virus
GDLIYADDTA

SEQ ID NO: 118055 - protein, 10 aa, Dengue virus
DLIYADDTAG

SEQ ID NO: 118056 - protein, 10 aa, Dengue virus
LIYADDTAGW

SEQ ID NO: 118057 - protein, 10 aa, Dengue virus
TAGWDTRITS

SEQ ID NO: 118058 - protein, 10 aa, Dengue virus
AGWDTRITSE

SEQ ID NO: 118059 - protein, 10 aa, Dengue virus
GWDTRITSED

SEQ ID NO: 118060 - protein, 10 aa, Dengue virus
WDTRITSEDL

SEQ ID NO: 118061 - protein, 10 aa, Dengue virus
NKVVKVLRPT

SEQ ID NO: 118062 - protein, 10 aa, Dengue virus
KVVKVLRPTP

SEQ ID NO: 118063 - protein, 10 aa, Dengue virus
GAVMDIISRK

SEQ ID NO: 118064 - protein, 10 aa, Dengue virus
AVMDIISRKD

SEQ ID NO: 118065 - protein, 10 aa, Dengue virus
FTNMGAQLIR

SEQ ID NO: 118066 - protein, 10 aa, Dengue virus
TNMGAQLIRQ

SEQ ID NO: 118067 - protein, 10 aa, Dengue virus
NMGAQLIRQM

SEQ ID NO: 118068 - protein, 10 aa, Dengue virus
MGAQLIRQME

SEQ ID NO: 118069 - protein, 10 aa, Dengue virus
AQLVRQMEGE

SEQ ID NO: 118070 - protein, 10 aa, Dengue virus
QLIRQMEAEG

SEQ ID NO: 118071 - protein, 10 aa, Dengue virus
ERLRRMAISG

SEQ ID NO: 118072 - protein, 10 aa, Dengue virus
SGDDCVVKPV

SEQ ID NO: 118073 - protein, 10 aa, Dengue virus
GDDCVVKPVD

SEQ ID NO: 118074 - protein, 10 aa, Dengue virus
DDCVVKPTDD

SEQ ID NO: 118075 - protein, 10 aa, Dengue virus
DCVVKPTDDR

SEQ ID NO: 118076 - protein, 10 aa, Dengue virus
CVVKPTDDRF

SEQ ID NO: 118077 - protein, 10 aa, Dengue virus
ALIALNDMGK

SEQ ID NO: 118078 - protein, 10 aa, Dengue virus
DMGKVRKDVP

SEQ ID NO: 118079 - protein, 10 aa, Dengue virus
MGKVRKDVPQ

SEQ ID NO: 118080 - protein, 10 aa, Dengue virus
KIRKDIQQWE

SEQ ID NO: 118081 - protein, 10 aa, Dengue virus
IRKDIQQWEP

SEQ ID NO: 118082 - protein, 10 aa, Dengue virus
KDIQQWEPSK

SEQ ID NO: 118083 - protein, 10 aa, Dengue virus
DIQQWEPSKG

SEQ ID NO: 118084 - protein, 10 aa, Dengue virus
IQQWEPSKGW

SEQ ID NO: 118085 - protein, 10 aa, Dengue virus
QWEPSKGWKN

SEQ ID NO: 118086 - protein, 10 aa, Dengue virus
WEPSKGWKNW

SEQ ID NO: 118087 - protein, 10 aa, Dengue virus
GWKNWQEVPF

SEQ ID NO: 118088 - protein, 10 aa, Dengue virus
WKNWQEVPFC

SEQ ID NO: 118089 - protein, 10 aa, Dengue virus
KNWQEVPFCS

SEQ ID NO: 118090 - protein, 10 aa, Dengue virus
FCSHHFHKIF

SEQ ID NO: 118091 - protein, 10 aa, Dengue virus
CSHHFHKIFM

SEQ ID NO: 118092 - protein, 10 aa, Dengue virus
SHHFHKIFMK

SEQ ID NO: 118093 - protein, 10 aa, Dengue virus
HHFHKIFMKD

SEQ ID NO: 118094 - protein, 10 aa, Dengue virus
HFHKIFMKDG

SEQ ID NO: 118095 - protein, 10 aa, Dengue virus
FHKIFMKDGR

SEQ ID NO: 118096 - protein, 10 aa, Dengue virus
LKETACLGKA

SEQ ID NO: 118097 - protein, 10 aa, Dengue virus
KETACLGKAY

SEQ ID NO: 118098 - protein, 10 aa, Dengue virus
LGKSYAQMWT

SEQ ID NO: 118099 - protein, 10 aa, Dengue virus
GKSYAQMWTL

SEQ ID NO: 118100 - protein, 10 aa, Dengue virus
KSYAQMWTLM

SEQ ID NO: 118101 - protein, 10 aa, Dengue virus
SYAQMWTLMY

SEQ ID NO: 118102 - protein, 10 aa, Dengue virus
YAQMWALMYF

SEQ ID NO: 118103 - protein, 10 aa, Dengue virus
AQMWALMYFH

SEQ ID NO: 118104 - protein, 10 aa, Dengue virus
QMWALMYFHR

SEQ ID NO: 118105 - protein, 10 aa, Dengue virus
MWALMYFHRR

SEQ ID NO: 118106 - protein, 10 aa, Dengue virus
WALMYFHRRD

SEQ ID NO: 118107 - protein, 10 aa, Dengue virus
ALMYFHRRDL

SEQ ID NO: 118108 - protein, 10 aa, Dengue virus
EWFPTSRTTW

SEQ ID NO: 118109 - protein, 10 aa, Dengue virus
SRTTWSIHAS

SEQ ID NO: 118110 - protein, 10 aa, Dengue virus
RTTWSIHASH

SEQ ID NO: 118111 - protein, 10 aa, Dengue virus
TTWSIHASHE

SEQ ID NO: 118112 - protein, 10 aa, Dengue virus
TWSIHASHEW

SEQ ID NO: 118113 - protein, 10 aa, Dengue virus
WSIHASHEWM

SEQ ID NO: 118114 - protein, 10 aa, Dengue virus
SIHASHEWMT

SEQ ID NO: 118115 - protein, 10 aa, Dengue virus
IHASHEWMTT

SEQ ID NO: 118116 - protein, 10 aa, Dengue virus
HASHEWMTTE

SEQ ID NO: 118117 - protein, 10 aa, Dengue virus
ASHEWMTTED

SEQ ID NO: 118118 - protein, 10 aa, Dengue virus
SHEWMTTEDM

SEQ ID NO: 118119 - protein, 10 aa, Dengue virus
EWMTTEDMLT

SEQ ID NO: 118120 - protein, 10 aa, Dengue virus
WMTTEDMLKV

SEQ ID NO: 118121 - protein, 10 aa, Dengue virus
MTTEDMLKVW

SEQ ID NO: 118122 - protein, 10 aa, Dengue virus
TTEDMLKVWN

SEQ ID NO: 118123 - protein, 10 aa, Dengue virus
TEDMLKVWNR

SEQ ID NO: 118124 - protein, 10 aa, Dengue virus
EDMLKVWNRV

SEQ ID NO: 118125 - protein, 10 aa, Dengue virus
DMLKVWNRVW

SEQ ID NO: 118126 - protein, 10 aa, Dengue virus
MLKVWNRVWI

SEQ ID NO: 118127 - protein, 10 aa, Dengue virus
NVPYLGKRED

SEQ ID NO: 118128 - protein, 10 aa, Dengue virus
GLTARATWAS

SEQ ID NO: 118129 - protein, 10 aa, Dengue virus
LTARATWASN

SEQ ID NO: 118130 - protein, 10 aa, Dengue virus
TARATWASNI

SEQ ID NO: 118131 - protein, 10 aa, Dengue virus
DYMISMKRFK

SEQ ID NO: 118132 - protein, 10 aa, Dengue virus
RNRVSTIQQL

SEQ ID NO: 118133 - protein, 10 aa, Dengue virus
NRVSTIQQLT

SEQ ID NO: 118134 - protein, 10 aa, Dengue virus
RVSTIQQLTK

SEQ ID NO: 118135 - protein, 10 aa, Dengue virus
VSTIQQLTKR

SEQ ID NO: 118136 - protein, 10 aa, Dengue virus
STIQQLTKRF

SEQ ID NO: 118137 - protein, 10 aa, Dengue virus
TIQQLTKRFS

SEQ ID NO: 118138 - protein, 10 aa, Dengue virus
VKRFSTGLFS

SEQ ID NO: 118139 - protein, 10 aa, Dengue virus
KRFSTGLFSG

SEQ ID NO: 118140 - protein, 10 aa, Dengue virus
RFSTGLFSGK

SEQ ID NO: 118141 - protein, 10 aa, Dengue virus
FSTGLFSGKG

SEQ ID NO: 118142 - protein, 10 aa, Dengue virus
STGLFSGKGP

SEQ ID NO: 118143 - protein, 10 aa, Dengue virus
ELLNGQGPMK

SEQ ID NO: 118144 - protein, 10 aa, Dengue virus
GQGPMKFVMA

SEQ ID NO: 118145 - protein, 10 aa, Dengue virus
FVMAFIAFLR

SEQ ID NO: 118146 - protein, 10 aa, Dengue virus
GFKREISNML

SEQ ID NO: 118147 - protein, 10 aa, Dengue virus
TFHLTTRGGE

SEQ ID NO: 118148 - protein, 10 aa, Dengue virus
KGKSLLFKTK

SEQ ID NO: 118149 - protein, 10 aa, Dengue virus
TLIAMDLGEF

SEQ ID NO: 118150 - protein, 10 aa, Dengue virus
LIAMDLGEFC

SEQ ID NO: 118151 - protein, 10 aa, Dengue virus
AMDLGEMCED

SEQ ID NO: 118152 - protein, 10 aa, Dengue virus
MDLGEMCEDT

SEQ ID NO: 118153 - protein, 10 aa, Dengue virus
DVDCWCNTTD

SEQ ID NO: 118154 - protein, 10 aa, Dengue virus
VDCWCNTTDT

SEQ ID NO: 118155 - protein, 10 aa, Dengue virus
DCWCNTTDTW

SEQ ID NO: 118156 - protein, 10 aa, Dengue virus
SSEGAWRQIQ

SEQ ID NO: 118157 - protein, 10 aa, Dengue virus
IETWVLRHPG

SEQ ID NO: 118158 - protein, 10 aa, Dengue virus
ETWVLRHPGF

SEQ ID NO: 118159 - protein, 10 aa, Dengue virus
TWVLRHPGFT

SEQ ID NO: 118160 - protein, 10 aa, Dengue virus
TPSMTMRCIG

SEQ ID NO: 118161 - protein, 10 aa, Dengue virus
MRCIGMSNRD

SEQ ID NO: 118162 - protein, 10 aa, Dengue virus
RCIGMSNRDF

SEQ ID NO: 118163 - protein, 10 aa, Dengue virus
CIGMSNRDFV

SEQ ID NO: 118164 - protein, 10 aa, Dengue virus
IGMSNRDFVE

SEQ ID NO: 118165 - protein, 10 aa, Dengue virus
GGCVTTMAKS

SEQ ID NO: 118166 - protein, 10 aa, Dengue virus
GCVTTMAKSK

SEQ ID NO: 118167 - protein, 10 aa, Dengue virus
MAKSKPTLDI

SEQ ID NO: 118168 - protein, 10 aa, Dengue virus
AKSKPTLDIE

SEQ ID NO: 118169 - protein, 10 aa, Dengue virus
KSKPTLDIEL

SEQ ID NO: 118170 - protein, 10 aa, Dengue virus
DFELIKTTAK

SEQ ID NO: 118171 - protein, 10 aa, Dengue virus
DSRCPTQGEP

SEQ ID NO: 118172 - protein, 10 aa, Dengue virus
CRHSMVDRGW

SEQ ID NO: 118173 - protein, 10 aa, Dengue virus
RHSMVDRGWG

SEQ ID NO: 118174 - protein, 10 aa, Dengue virus
CGLFGKGGVV

SEQ ID NO: 118175 - protein, 10 aa, Dengue virus
GLFGKGGVVT

SEQ ID NO: 118176 - protein, 10 aa, Dengue virus
LFGKGGVVTC

SEQ ID NO: 118177 - protein, 10 aa, Dengue virus
FGKGGVVTCA

SEQ ID NO: 118178 - protein, 10 aa, Dengue virus
GKGGVVTCAK

SEQ ID NO: 118179 - protein, 10 aa, Dengue virus
KGGVVTCAKF

SEQ ID NO: 118180 - protein, 10 aa, Dengue virus
SGEENAVGND

SEQ ID NO: 118181 - protein, 10 aa, Dengue virus
ITMECSPRTG

SEQ ID NO: 118182 - protein, 10 aa, Dengue virus
DLPLPWTTGA

SEQ ID NO: 118183 - protein, 10 aa, Dengue virus
KERMVTFKVP

SEQ ID NO: 118184 - protein, 10 aa, Dengue virus
LGNILFMGHL

SEQ ID NO: 118185 - protein, 10 aa, Dengue virus
GNILFMGHLK

SEQ ID NO: 118186 - protein, 10 aa, Dengue virus
NILFMGHLKC

SEQ ID NO: 118187 - protein, 10 aa, Dengue virus
ILFMGHLKCR

SEQ ID NO: 118188 - protein, 10 aa, Dengue virus
RLKMDKLTLR

SEQ ID NO: 118189 - protein, 10 aa, Dengue virus
LKMDKLTLRG

SEQ ID NO: 118190 - protein, 10 aa, Dengue virus
EKELAETQHG

SEQ ID NO: 118191 - protein, 10 aa, Dengue virus
KELAETQHGT

SEQ ID NO: 118192 - protein, 10 aa, Dengue virus
ELAETQHGTV

SEQ ID NO: 118193 - protein, 10 aa, Dengue virus
LAETQHGTVL

SEQ ID NO: 118194 - protein, 10 aa, Dengue virus
ELEPPFGDSY

SEQ ID NO: 118195 - protein, 10 aa, Dengue virus
LEPPFGDSYI

SEQ ID NO: 118196 - protein, 10 aa, Dengue virus
KKGSSIGQMI

SEQ ID NO: 118197 - protein, 10 aa, Dengue virus
KGSSIGQMIE

SEQ ID NO: 118198 - protein, 10 aa, Dengue virus
GSTIGKMFEA

SEQ ID NO: 118199 - protein, 10 aa, Dengue virus
STIGKMFEAT

SEQ ID NO: 118200 - protein, 10 aa, Dengue virus
QMFATTMRGA

SEQ ID NO: 118201 - protein, 10 aa, Dengue virus
AWDFGSIGGL

SEQ ID NO: 118202 - protein, 10 aa, Dengue virus
AYTALFGGVS

SEQ ID NO: 118203 - protein, 10 aa, Dengue virus
YTALFGGVSW

SEQ ID NO: 118204 - protein, 10 aa, Dengue virus
FGGVSWMVRI

SEQ ID NO: 118205 - protein, 10 aa, Dengue virus
VITWIGMNSR

SEQ ID NO: 118206 - protein, 10 aa, Dengue virus
TWLGLNSRSA

SEQ ID NO: 118207 - protein, 10 aa, Dengue virus
LYLGTVVQAD

SEQ ID NO: 118208 - protein, 10 aa, Dengue virus
KCGNGIFVTN

SEQ ID NO: 118209 - protein, 10 aa, Dengue virus
CGNGIFVTNE

SEQ ID NO: 118210 - protein, 10 aa, Dengue virus
GNGIFVTNEV

SEQ ID NO: 118211 - protein, 10 aa, Dengue virus
NGIFVTNEVH

SEQ ID NO: 118212 - protein, 10 aa, Dengue virus
DSPSKLASAI

SEQ ID NO: 118213 - protein, 10 aa, Dengue virus
PKRLSAAIGR

SEQ ID NO: 118214 - protein, 10 aa, Dengue virus
KRLSAAIGRA

SEQ ID NO: 118215 - protein, 10 aa, Dengue virus
IRSTTRLENI

SEQ ID NO: 118216 - protein, 10 aa, Dengue virus
RSTTRLENIM

SEQ ID NO: 118217 - protein, 10 aa, Dengue virus
STTRLENIMW

SEQ ID NO: 118218 - protein, 10 aa, Dengue virus
TRLENIMWRQ

SEQ ID NO: 118219 - protein, 10 aa, Dengue virus
RLENIMWRQI

SEQ ID NO: 118220 - protein, 10 aa, Dengue virus
YSWRSWGKAK

SEQ ID NO: 118221 - protein, 10 aa, Dengue virus
FEVEDYGFGM

SEQ ID NO: 118222 - protein, 10 aa, Dengue virus
GVFTTNIWLR

SEQ ID NO: 118223 - protein, 10 aa, Dengue virus
KDDRAVHADM

SEQ ID NO: 118224 - protein, 10 aa, Dengue virus
DDRAVHADMG

SEQ ID NO: 118225 - protein, 10 aa, Dengue virus
DRAVHADMGY

SEQ ID NO: 118226 - protein, 10 aa, Dengue virus
ADMGYWIESR

SEQ ID NO: 118227 - protein, 10 aa, Dengue virus
DMGYWIESRL

SEQ ID NO: 118228 - protein, 10 aa, Dengue virus
MGYWIESRLN

SEQ ID NO: 118229 - protein, 10 aa, Dengue virus
QTAGPWHLGR

SEQ ID NO: 118230 - protein, 10 aa, Dengue virus
TAGPWHLGRL

SEQ ID NO: 118231 - protein, 10 aa, Dengue virus
SCTMPPLRFL

SEQ ID NO: 118232 - protein, 10 aa, Dengue virus
CTMPPLRFLG

SEQ ID NO: 118233 - protein, 10 aa, Dengue virus
TMPPLRFLGE

SEQ ID NO: 118234 - protein, 10 aa, Dengue virus
MPPLRFLGED

SEQ ID NO: 118235 - protein, 10 aa, Dengue virus
PPLRFLGEDG

SEQ ID NO: 118236 - protein, 10 aa, Dengue virus
PLRFLGEDGC

SEQ ID NO: 118237 - protein, 10 aa, Dengue virus
LRFLGEDGCW

SEQ ID NO: 118238 - protein, 10 aa, Dengue virus
RFLGEDGCWY

SEQ ID NO: 118239 - protein, 10 aa, Dengue virus
FLGEDGCWYG

SEQ ID NO: 118240 - protein, 10 aa, Dengue virus
IGMGITYLAL

SEQ ID NO: 118241 - protein, 10 aa, Dengue virus
RKLTSKELLM

SEQ ID NO: 118242 - protein, 10 aa, Dengue virus
LTSRETALMV

SEQ ID NO: 118243 - protein, 10 aa, Dengue virus
ELTDAIALGI

SEQ ID NO: 118244 - protein, 10 aa, Dengue virus
LTDAIALGIM

SEQ ID NO: 118245 - protein, 10 aa, Dengue virus
RSWPLNEAVM

SEQ ID NO: 118246 - protein, 10 aa, Dengue virus
WPLNEAVMAV

SEQ ID NO: 118247 - protein, 10 aa, Dengue virus
PLNEAVMAVG

SEQ ID NO: 118248 - protein, 10 aa, Dengue virus
VSILLSALLK

SEQ ID NO: 118249 - protein, 10 aa, Dengue virus
SILLSALLKN

SEQ ID NO: 118250 - protein, 10 aa, Dengue virus
ILLSALLKND

SEQ ID NO: 118251 - protein, 10 aa, Dengue virus
LLSALLKNDV

SEQ ID NO: 118252 - protein, 10 aa, Dengue virus
LSALLKNDVP

SEQ ID NO: 118253 - protein, 10 aa, Dengue virus
MADITGSSPI

SEQ ID NO: 118254 - protein, 10 aa, Dengue virus
ADITGSSPII

SEQ ID NO: 118255 - protein, 10 aa, Dengue virus
DITGSSPIIE

SEQ ID NO: 118256 - protein, 10 aa, Dengue virus
AEDGSMSIKN

SEQ ID NO: 118257 - protein, 10 aa, Dengue virus
GTMKIKDEEK

SEQ ID NO: 118258 - protein, 10 aa, Dengue virus
TMKIKDEEKD

SEQ ID NO: 118259 - protein, 10 aa, Dengue virus
ILLKATLLAI

SEQ ID NO: 118260 - protein, 10 aa, Dengue virus
LLKATLLAIS

SEQ ID NO: 118261 - protein, 10 aa, Dengue virus
LKATLLAISG

SEQ ID NO: 118262 - protein, 10 aa, Dengue virus
QTRRSGVLWD

SEQ ID NO: 118263 - protein, 10 aa, Dengue virus
TRRSGVLWDV

SEQ ID NO: 118264 - protein, 10 aa, Dengue virus
RRSGVLWDVP

SEQ ID NO: 118265 - protein, 10 aa, Dengue virus
VLWDTPSPPK

SEQ ID NO: 118266 - protein, 10 aa, Dengue virus
ATLSEGVYRI

SEQ ID NO: 118267 - protein, 10 aa, Dengue virus
LSEGVYRIMQ

SEQ ID NO: 118268 - protein, 10 aa, Dengue virus
KSQVGVGVFQ

SEQ ID NO: 118269 - protein, 10 aa, Dengue virus
TQVGVGIHME

SEQ ID NO: 118270 - protein, 10 aa, Dengue virus
HVTRGSVICH

SEQ ID NO: 118271 - protein, 10 aa, Dengue virus
ETGRLEPSWA

SEQ ID NO: 118272 - protein, 10 aa, Dengue virus
RLEPNWANVK

SEQ ID NO: 118273 - protein, 10 aa, Dengue virus
LEPNWANVKK

SEQ ID NO: 118274 - protein, 10 aa, Dengue virus
EPNWANVKKD

SEQ ID NO: 118275 - protein, 10 aa, Dengue virus
PNWANVKKDL

SEQ ID NO: 118276 - protein, 10 aa, Dengue virus
WADVKKDLVS

SEQ ID NO: 118277 - protein, 10 aa, Dengue virus
ADVKKDLVSY

SEQ ID NO: 118278 - protein, 10 aa, Dengue virus
DVRKDLISYG

SEQ ID NO: 118279 - protein, 10 aa, Dengue virus
WNAGEEVQVI

SEQ ID NO: 118280 - protein, 10 aa, Dengue virus
NAGEEVQVIA

SEQ ID NO: 118281 - protein, 10 aa, Dengue virus
AGEEVQVIAV

SEQ ID NO: 118282 - protein, 10 aa, Dengue virus
AGTIGAVSLD

SEQ ID NO: 118283 - protein, 10 aa, Dengue virus
GTSGSPIVDK

SEQ ID NO: 118284 - protein, 10 aa, Dengue virus
GNGVVTRSGT

SEQ ID NO: 118285 - protein, 10 aa, Dengue virus
NGVVTRSGTY

SEQ ID NO: 118286 - protein, 10 aa, Dengue virus
GVVTRSGTYV

SEQ ID NO: 118287 - protein, 10 aa, Dengue virus
VVTRSGTYVS

SEQ ID NO: 118288 - protein, 10 aa, Dengue virus
SGTYVSSIAQ

SEQ ID NO: 118289 - protein, 10 aa, Dengue virus
GTYVSAIAQT

SEQ ID NO: 118290 - protein, 10 aa, Dengue virus
VFKKRNLTIM

SEQ ID NO: 118291 - protein, 10 aa, Dengue virus
GKTRRYLPAM

SEQ ID NO: 118292 - protein, 10 aa, Dengue virus
RYLPAMVREA

SEQ ID NO: 118293 - protein, 10 aa, Dengue virus
LPAMVREAIK

SEQ ID NO: 118294 - protein, 10 aa, Dengue virus
PAMVREAIKR

SEQ ID NO: 118295 - protein, 10 aa, Dengue virus
REAIRRGLRT

SEQ ID NO: 118296 - protein, 10 aa, Dengue virus
EAIRRGLRTL

SEQ ID NO: 118297 - protein, 10 aa, Dengue virus
RRGLRTLILA

SEQ ID NO: 118298 - protein, 10 aa, Dengue virus
LPIRYQTTAI

SEQ ID NO: 118299 - protein, 10 aa, Dengue virus
KAEHTGREIV

SEQ ID NO: 118300 - protein, 10 aa, Dengue virus
PVRVPNYNLV

SEQ ID NO: 118301 - protein, 10 aa, Dengue virus
VRVPNYNLVI

SEQ ID NO: 118302 - protein, 10 aa, Dengue virus
DPFPQSNSPI

SEQ ID NO: 118303 - protein, 10 aa, Dengue virus
IQDEEKDIPE

SEQ ID NO: 118304 - protein, 10 aa, Dengue virus
QDEEKDIPER

SEQ ID NO: 118305 - protein, 10 aa, Dengue virus
IPERSWSSGH

SEQ ID NO: 118306 - protein, 10 aa, Dengue virus
YQGKTVWFVP

SEQ ID NO: 118307 - protein, 10 aa, Dengue virus
QGKTVWFVPS

SEQ ID NO: 118308 - protein, 10 aa, Dengue virus
AACLRKNGKR

SEQ ID NO: 118309 - protein, 10 aa, Dengue virus
ACLRKNGKRV

SEQ ID NO: 118310 - protein, 10 aa, Dengue virus
SRKTFDTEYT

SEQ ID NO: 118311 - protein, 10 aa, Dengue virus
RKTFDSEYAK

SEQ ID NO: 118312 - protein, 10 aa, Dengue virus
LTDWDFVVTT

SEQ ID NO: 118313 - protein, 10 aa, Dengue virus
SEMGANFRAE

SEQ ID NO: 118314 - protein, 10 aa, Dengue virus
EMGANFRAER

SEQ ID NO: 118315 - protein, 10 aa, Dengue virus
MGANFRAERV

SEQ ID NO: 118316 - protein, 10 aa, Dengue virus
GANFRAERVI

SEQ ID NO: 118317 - protein, 10 aa, Dengue virus
ANFRAERVID

SEQ ID NO: 118318 - protein, 10 aa, Dengue virus
NFRAERVIDP

SEQ ID NO: 118319 - protein, 10 aa, Dengue virus
FRAERVIDPR

SEQ ID NO: 118320 - protein, 10 aa, Dengue virus
RAERVIDPRR

SEQ ID NO: 118321 - protein, 10 aa, Dengue virus
ILPDGPERVI

SEQ ID NO: 118322 - protein, 10 aa, Dengue virus
LPDGPERVIL

SEQ ID NO: 118323 - protein, 10 aa, Dengue virus
PDGPERVILA

SEQ ID NO: 118324 - protein, 10 aa, Dengue virus
QEDDQYVFSG

SEQ ID NO: 118325 - protein, 10 aa, Dengue virus
EDDQYVFSGD

SEQ ID NO: 118326 - protein, 10 aa, Dengue virus
DDQYVFSGDP

SEQ ID NO: 118327 - protein, 10 aa, Dengue virus
DQYVFSGDPL

SEQ ID NO: 118328 - protein, 10 aa, Dengue virus
FMGQPLNNDE

SEQ ID NO: 118329 - protein, 10 aa, Dengue virus
AAVDGEYRLR

SEQ ID NO: 118330 - protein, 10 aa, Dengue virus
GDLPVWLSHK

SEQ ID NO: 118331 - protein, 10 aa, Dengue virus
DLPVWLSHKV

SEQ ID NO: 118332 - protein, 10 aa, Dengue virus
PVWLAYKVAS

SEQ ID NO: 118333 - protein, 10 aa, Dengue virus
YKDREWCFTG

SEQ ID NO: 118334 - protein, 10 aa, Dengue virus
RNNQILEENV

SEQ ID NO: 118335 - protein, 10 aa, Dengue virus
ILEENMEVEV

SEQ ID NO: 118336 - protein, 10 aa, Dengue virus
ENMEVEVWTK

SEQ ID NO: 118337 - protein, 10 aa, Dengue virus
NMEVEVWTKE

SEQ ID NO: 118338 - protein, 10 aa, Dengue virus
MEVEVWTKEG

SEQ ID NO: 118339 - protein, 10 aa, Dengue virus
KEFAAGRKSI

SEQ ID NO: 118340 - protein, 10 aa, Dengue virus
FAAGRKSLAL

SEQ ID NO: 118341 - protein, 10 aa, Dengue virus
SLITEMGRLP

SEQ ID NO: 118342 - protein, 10 aa, Dengue virus
TEIGRVPTHL

SEQ ID NO: 118343 - protein, 10 aa, Dengue virus
EIGRVPTHLA

SEQ ID NO: 118344 - protein, 10 aa, Dengue virus
KLALDNIVML

SEQ ID NO: 118345 - protein, 10 aa, Dengue virus
AYTHALSELP

SEQ ID NO: 118346 - protein, 10 aa, Dengue virus
YTHALSELPE

SEQ ID NO: 118347 - protein, 10 aa, Dengue virus
THALSELPET

SEQ ID NO: 118348 - protein, 10 aa, Dengue virus
ETLETLLLLG

SEQ ID NO: 118349 - protein, 10 aa, Dengue virus
TLETLLLLGL

SEQ ID NO: 118350 - protein, 10 aa, Dengue virus
LETLLLLGLL

SEQ ID NO: 118351 - protein, 10 aa, Dengue virus
ETLLLLGLLA

SEQ ID NO: 118352 - protein, 10 aa, Dengue virus
GKLSMGLIAI

SEQ ID NO: 118353 - protein, 10 aa, Dengue virus
IQPQWIAASI

SEQ ID NO: 118354 - protein, 10 aa, Dengue virus
NQLTYVIIAI

SEQ ID NO: 118355 - protein, 10 aa, Dengue virus
QLTYVIIAIL

SEQ ID NO: 118356 - protein, 10 aa, Dengue virus
LTYVIIAILT

SEQ ID NO: 118357 - protein, 10 aa, Dengue virus
VTANEMGLLE

SEQ ID NO: 118358 - protein, 10 aa, Dengue virus
GFLEKTKKDF

SEQ ID NO: 118359 - protein, 10 aa, Dengue virus
FLEKTKKDFG

SEQ ID NO: 118360 - protein, 10 aa, Dengue virus
TLYAVATTFI

SEQ ID NO: 118361 - protein, 10 aa, Dengue virus
LYAVATTFIT

SEQ ID NO: 118362 - protein, 10 aa, Dengue virus
YAVATTFITP

SEQ ID NO: 118363 - protein, 10 aa, Dengue virus
AVATTFITPM

SEQ ID NO: 118364 - protein, 10 aa, Dengue virus
ITPMLRHSIE

SEQ ID NO: 118365 - protein, 10 aa, Dengue virus
QATVLMGLGR

SEQ ID NO: 118366 - protein, 10 aa, Dengue virus
ATVLMGLGRG

SEQ ID NO: 118367 - protein, 10 aa, Dengue virus
TVLMGLGRGW

SEQ ID NO: 118368 - protein, 10 aa, Dengue virus
RGWPLSKMDI

SEQ ID NO: 118369 - protein, 10 aa, Dengue virus
QVNPLTLTAV

SEQ ID NO: 118370 - protein, 10 aa, Dengue virus
VNPLTLTAVV

SEQ ID NO: 118371 - protein, 10 aa, Dengue virus
LIAHYAIIGP

SEQ ID NO: 118372 - protein, 10 aa, Dengue virus
MKNPTVDGVT

SEQ ID NO: 118373 - protein, 10 aa, Dengue virus
KNPTVDGVTV

SEQ ID NO: 118374 - protein, 10 aa, Dengue virus
NPTVDGVTVI

SEQ ID NO: 118375 - protein, 10 aa, Dengue virus
VIDLEPISYD

SEQ ID NO: 118376 - protein, 10 aa, Dengue virus
LLLMRTSWAF

SEQ ID NO: 118377 - protein, 10 aa, Dengue virus
LLMRTSWAFC

SEQ ID NO: 118378 - protein, 10 aa, Dengue virus
LMRTSWAFCE

SEQ ID NO: 118379 - protein, 10 aa, Dengue virus
MRTSWAFCEA

SEQ ID NO: 118380 - protein, 10 aa, Dengue virus
RTSWAFCEAL

SEQ ID NO: 118381 - protein, 10 aa, Dengue virus
TSWAFCEALT

SEQ ID NO: 118382 - protein, 10 aa, Dengue virus
SWAFCEALTL

SEQ ID NO: 118383 - protein, 10 aa, Dengue virus
LTLATGPVST

SEQ ID NO: 118384 - protein, 10 aa, Dengue virus
TLATGPVSTL

SEQ ID NO: 118385 - protein, 10 aa, Dengue virus
LATGPVSTLW

SEQ ID NO: 118386 - protein, 10 aa, Dengue virus
ATGPVSTLWE

SEQ ID NO: 118387 - protein, 10 aa, Dengue virus
TGPVSTLWEG

SEQ ID NO: 118388 - protein, 10 aa, Dengue virus
GPVSTLWEGN

SEQ ID NO: 118389 - protein, 10 aa, Dengue virus
PVSTLWEGNP

SEQ ID NO: 118390 - protein, 10 aa, Dengue virus
VSTLWEGNPG

SEQ ID NO: 118391 - protein, 10 aa, Dengue virus
GAGLLFSIMR

SEQ ID NO: 118392 - protein, 10 aa, Dengue virus
AGLLFSIMRN

SEQ ID NO: 118393 - protein, 10 aa, Dengue virus
GLLFSIMRNT

SEQ ID NO: 118394 - protein, 10 aa, Dengue virus
VGETLGEKWK

SEQ ID NO: 118395 - protein, 10 aa, Dengue virus
AKEGLRRGET

SEQ ID NO: 118396 - protein, 10 aa, Dengue virus
HHAVSRGTAK

SEQ ID NO: 118397 - protein, 10 aa, Dengue virus
YYCGGLKDVR

SEQ ID NO: 118398 - protein, 10 aa, Dengue virus
YCGGLKDVRE

SEQ ID NO: 118399 - protein, 10 aa, Dengue virus
CGGLKDVREV

SEQ ID NO: 118400 - protein, 10 aa, Dengue virus
TYGWNLVKLM

SEQ ID NO: 118401 - protein, 10 aa, Dengue virus
GWNLVKLMSG

SEQ ID NO: 118402 - protein, 10 aa, Dengue virus
ESSSNPTIEE

SEQ ID NO: 118403 - protein, 10 aa, Dengue virus
SSSNPTIEEG

SEQ ID NO: 118404 - protein, 10 aa, Dengue virus
SSNPTIEEGR

SEQ ID NO: 118405 - protein, 10 aa, Dengue virus
SNPTIEEGRT

SEQ ID NO: 118406 - protein, 10 aa, Dengue virus
IKVLNPYMPA

SEQ ID NO: 118407 - protein, 10 aa, Dengue virus
VLNPYMPTVV

SEQ ID NO: 118408 - protein, 10 aa, Dengue virus
FGGALVRNPL

SEQ ID NO: 118409 - protein, 10 aa, Dengue virus
HEMYWVSGAS

SEQ ID NO: 118410 - protein, 10 aa, Dengue virus
EMYWVSGASG

SEQ ID NO: 118411 - protein, 10 aa, Dengue virus
MYWVSGASGN

SEQ ID NO: 118412 - protein, 10 aa, Dengue virus
YWVSGASGNI

SEQ ID NO: 118413 - protein, 10 aa, Dengue virus
WVSGASGNIV

SEQ ID NO: 118414 - protein, 10 aa, Dengue virus
GTGNIVSSVN

SEQ ID NO: 118415 - protein, 10 aa, Dengue virus
SGNIVSSVNT

SEQ ID NO: 118416 - protein, 10 aa, Dengue virus
GNIVSSVNTT

SEQ ID NO: 118417 - protein, 10 aa, Dengue virus
NIVSSVNTTS

SEQ ID NO: 118418 - protein, 10 aa, Dengue virus
IVSSVNTTSK

SEQ ID NO: 118419 - protein, 10 aa, Dengue virus
VSSVNTTSKM

SEQ ID NO: 118420 - protein, 10 aa, Dengue virus
SSVNTTSKML

SEQ ID NO: 118421 - protein, 10 aa, Dengue virus
PTFERDVDLG

SEQ ID NO: 118422 - protein, 10 aa, Dengue virus
DLGTGTRHVA

SEQ ID NO: 118423 - protein, 10 aa, Dengue virus
LGTGTRHVAV

SEQ ID NO: 118424 - protein, 10 aa, Dengue virus
GTGTRHVAVE

SEQ ID NO: 118425 - protein, 10 aa, Dengue virus
PNMDIIGKRI

SEQ ID NO: 118426 - protein, 10 aa, Dengue virus
DVIGERIRRI

SEQ ID NO: 118427 - protein, 10 aa, Dengue virus
RLLTKPWDVL

SEQ ID NO: 118428 - protein, 10 aa, Dengue virus
KPWDVVPMVI

SEQ ID NO: 118429 - protein, 10 aa, Dengue virus
PWDVVPMVIQ

SEQ ID NO: 118430 - protein, 10 aa, Dengue virus
CTREEFIRKV

SEQ ID NO: 118431 - protein, 10 aa, Dengue virus
TREEFIRKVR

SEQ ID NO: 118432 - protein, 10 aa, Dengue virus
KKVRSNAALG

SEQ ID NO: 118433 - protein, 10 aa, Dengue virus
SNAALGAVFT

SEQ ID NO: 118434 - protein, 10 aa, Dengue virus
NAALGAVFTD

SEQ ID NO: 118435 - protein, 10 aa, Dengue virus
AALGAVFTDE

SEQ ID NO: 118436 - protein, 10 aa, Dengue virus
ALGAVFTDEN

SEQ ID NO: 118437 - protein, 10 aa, Dengue virus
LGAVFTDENK

SEQ ID NO: 118438 - protein, 10 aa, Dengue virus
GAVFTDENKW

SEQ ID NO: 118439 - protein, 10 aa, Dengue virus
AVFTDENKWK

SEQ ID NO: 118440 - protein, 10 aa, Dengue virus
VFTDENKWKS

SEQ ID NO: 118441 - protein, 10 aa, Dengue virus
QEEQGWTSAS

SEQ ID NO: 118442 - protein, 10 aa, Dengue virus
EEQGWTSASE

SEQ ID NO: 118443 - protein, 10 aa, Dengue virus
EQGWTSASEA

SEQ ID NO: 118444 - protein, 10 aa, Dengue virus
QGWTSASEAV

SEQ ID NO: 118445 - protein, 10 aa, Dengue virus
GWTSASEAVN

SEQ ID NO: 118446 - protein, 10 aa, Dengue virus
WTSASEAVND

SEQ ID NO: 118447 - protein, 10 aa, Dengue virus
ERNLHLDGKC

SEQ ID NO: 118448 - protein, 10 aa, Dengue virus
RNLHLDGKCE

SEQ ID NO: 118449 - protein, 10 aa, Dengue virus
NLHLDGKCET

SEQ ID NO: 118450 - protein, 10 aa, Dengue virus
LHLDGKCETC

SEQ ID NO: 118451 - protein, 10 aa, Dengue virus
HLDGKCETCV

SEQ ID NO: 118452 - protein, 10 aa, Dengue virus
LDGKCETCVY

SEQ ID NO: 118453 - protein, 10 aa, Dengue virus
DGKCETCVYN

SEQ ID NO: 118454 - protein, 10 aa, Dengue virus
DHWFSRENSF

SEQ ID NO: 118455 - protein, 10 aa, Dengue virus
HWFSRENSFS

SEQ ID NO: 118456 - protein, 10 aa, Dengue virus
WFSRENSFSG

SEQ ID NO: 118457 - protein, 10 aa, Dengue virus
FSRENSFSGV

SEQ ID NO: 118458 - protein, 10 aa, Dengue virus
SRENSFSGVE

SEQ ID NO: 118459 - protein, 10 aa, Dengue virus
RENSFSGVEG

SEQ ID NO: 118460 - protein, 10 aa, Dengue virus
ENSFSGVEGE

SEQ ID NO: 118461 - protein, 10 aa, Dengue virus
KVVRVQRPAR

SEQ ID NO: 118462 - protein, 10 aa, Dengue virus
VQLIRQMEAE

SEQ ID NO: 118463 - protein, 10 aa, Dengue virus
ERLARMAISG

SEQ ID NO: 118464 - protein, 10 aa, Dengue virus
DDCVVKPVDD

SEQ ID NO: 118465 - protein, 10 aa, Dengue virus
DCVVKPVDDR

SEQ ID NO: 118466 - protein, 10 aa, Dengue virus
CVVKPVDDRF

SEQ ID NO: 118467 - protein, 10 aa, Dengue virus
ALSALNDMGK

SEQ ID NO: 118468 - protein, 10 aa, Dengue virus
QWEPSKGWSD

SEQ ID NO: 118469 - protein, 10 aa, Dengue virus
WEPSKGWSDW

SEQ ID NO: 118470 - protein, 10 aa, Dengue virus
GWSDWTQVPF

SEQ ID NO: 118471 - protein, 10 aa, Dengue virus
WSDWTQVPFC

SEQ ID NO: 118472 - protein, 10 aa, Dengue virus
SDWTQVPFCS

SEQ ID NO: 118473 - protein, 10 aa, Dengue virus
LGKAYAQMWA

SEQ ID NO: 118474 - protein, 10 aa, Dengue virus
GKAYAQMWAL

SEQ ID NO: 118475 - protein, 10 aa, Dengue virus
KAYAQMWALM

SEQ ID NO: 118476 - protein, 10 aa, Dengue virus
AYAQMWALMY

SEQ ID NO: 118477 - protein, 10 aa, Dengue virus
HWIPTSRTTW

SEQ ID NO: 118478 - protein, 10 aa, Dengue virus
QWMTTEDMLK

SEQ ID NO: 118479 - protein, 10 aa, Dengue virus
DIPYLGKRED

SEQ ID NO: 118480 - protein, 10 aa, Dengue virus
GLSSRATWAK

SEQ ID NO: 118481 - protein, 10 aa, Dengue virus
LSSRATWAKN

SEQ ID NO: 118482 - protein, 10 aa, Dengue virus
SSRATWAKNI

SEQ ID NO: 118483 - protein, 10 aa, Dengue virus
DYMPAMKRYS

SEQ ID NO: 118484 - protein, 11 aa, Dengue virus
PSFNMLKRARN

SEQ ID NO: 118485 - protein, 11 aa, Dengue virus
SFNMLKRARNR

SEQ ID NO: 118486 - protein, 11 aa, Dengue virus
FNMLKRARNRV

SEQ ID NO: 118487 - protein, 11 aa, Dengue virus
NMLKRARNRVS

SEQ ID NO: 118488 - protein, 11 aa, Dengue virus
MLKRARNRVST

SEQ ID NO: 118489 - protein, 11 aa, Dengue virus
RNRVSTVSQLA

SEQ ID NO: 118490 - protein, 11 aa, Dengue virus
NRVSTVSQLAK

SEQ ID NO: 118491 - protein, 11 aa, Dengue virus
RVSTVSQLAKR

SEQ ID NO: 118492 - protein, 11 aa, Dengue virus
VSTVSQLAKRF

SEQ ID NO: 118493 - protein, 11 aa, Dengue virus
STVSQLAKRFS

SEQ ID NO: 118494 - protein, 11 aa, Dengue virus
SQLAKRFSKGL

SEQ ID NO: 118495 - protein, 11 aa, Dengue virus
QLAKRFSKGLL

SEQ ID NO: 118496 - protein, 11 aa, Dengue virus
LAKRFSKGLLS

SEQ ID NO: 118497 - protein, 11 aa, Dengue virus
AKRFSKGLLSG

SEQ ID NO: 118498 - protein, 11 aa, Dengue virus
KRFSKGLLSGQ

SEQ ID NO: 118499 - protein, 11 aa, Dengue virus
RFSKGLLSGQG

SEQ ID NO: 118500 - protein, 11 aa, Dengue virus
FSKGLLSGQGP

SEQ ID NO: 118501 - protein, 11 aa, Dengue virus
LVMAFIAFLRF

SEQ ID NO: 118502 - protein, 11 aa, Dengue virus
VMAFIAFLRFL

SEQ ID NO: 118503 - protein, 11 aa, Dengue virus
MAFIAFLRFLA

SEQ ID NO: 118504 - protein, 11 aa, Dengue virus
AFIAFLRFLAI

SEQ ID NO: 118505 - protein, 11 aa, Dengue virus
FIAFLRFLAIP

SEQ ID NO: 118506 - protein, 11 aa, Dengue virus
IAFLRFLAIPP

SEQ ID NO: 118507 - protein, 11 aa, Dengue virus
AFLRFLAIPPT

SEQ ID NO: 118508 - protein, 11 aa, Dengue virus
FLRFLAIPPTA

SEQ ID NO: 118509 - protein, 11 aa, Dengue virus
LRFLAIPPTAG

SEQ ID NO: 118510 - protein, 11 aa, Dengue virus
RFLAIPPTAGI

SEQ ID NO: 118511 - protein, 11 aa, Dengue virus
FLAIPPTAGIL

SEQ ID NO: 118512 - protein, 11 aa, Dengue virus
LAIPPTAGILA

SEQ ID NO: 118513 - protein, 11 aa, Dengue virus
AIPPTAGILAR

SEQ ID NO: 118514 - protein, 11 aa, Dengue virus
IPPTAGILARW

SEQ ID NO: 118515 - protein, 11 aa, Dengue virus
PPTAGILARWG

SEQ ID NO: 118516 - protein, 11 aa, Dengue virus
AFHLTTRGGEP

SEQ ID NO: 118517 - protein, 11 aa, Dengue virus
FHLTTRGGEPH

SEQ ID NO: 118518 - protein, 11 aa, Dengue virus
HLTTRGGEPHM

SEQ ID NO: 118519 - protein, 11 aa, Dengue virus
LTTRGGEPHMI

SEQ ID NO: 118520 - protein, 11 aa, Dengue virus
TTRGGEPHMIV

SEQ ID NO: 118521 - protein, 11 aa, Dengue virus
QERGKSLLFKT

SEQ ID NO: 118522 - protein, 11 aa, Dengue virus
ERGKSLLFKTS

SEQ ID NO: 118523 - protein, 11 aa, Dengue virus
NMCTLIAMDLG

SEQ ID NO: 118524 - protein, 11 aa, Dengue virus
MCTLIAMDLGE

SEQ ID NO: 118525 - protein, 11 aa, Dengue virus
CTLIAMDLGEL

SEQ ID NO: 118526 - protein, 11 aa, Dengue virus
TLIAMDLGELC

SEQ ID NO: 118527 - protein, 11 aa, Dengue virus
AMDLGELCEDT

SEQ ID NO: 118528 - protein, 11 aa, Dengue virus
EPDDVDCWCNA

SEQ ID NO: 118529 - protein, 11 aa, Dengue virus
PDDVDCWCNAT

SEQ ID NO: 118530 - protein, 11 aa, Dengue virus
DDVDCWCNATD

SEQ ID NO: 118531 - protein, 11 aa, Dengue virus
DVDCWCNATDT

SEQ ID NO: 118532 - protein, 11 aa, Dengue virus
VDCWCNATDTW

SEQ ID NO: 118533 - protein, 11 aa, Dengue virus
GEHRRDKRSVA

SEQ ID NO: 118534 - protein, 11 aa, Dengue virus
EHRRDKRSVAL

SEQ ID NO: 118535 - protein, 11 aa, Dengue virus
HRRDKRSVALA

SEQ ID NO: 118536 - protein, 11 aa, Dengue virus
RRDKRSVALAP

SEQ ID NO: 118537 - protein, 11 aa, Dengue virus
RDKRSVALAPH

SEQ ID NO: 118538 - protein, 11 aa, Dengue virus
DKRSVALAPHV

SEQ ID NO: 118539 - protein, 11 aa, Dengue virus
KRSVALAPHVG

SEQ ID NO: 118540 - protein, 11 aa, Dengue virus
RSVALAPHVGL

SEQ ID NO: 118541 - protein, 11 aa, Dengue virus
SVALAPHVGLG

SEQ ID NO: 118542 - protein, 11 aa, Dengue virus
VALAPHVGLGL

SEQ ID NO: 118543 - protein, 11 aa, Dengue virus
ALAPHVGLGLE

SEQ ID NO: 118544 - protein, 11 aa, Dengue virus
LAPHVGLGLET

SEQ ID NO: 118545 - protein, 11 aa, Dengue virus
APHVGLGLETR

SEQ ID NO: 118546 - protein, 11 aa, Dengue virus
GLETRTETWMS

SEQ ID NO: 118547 - protein, 11 aa, Dengue virus
LETRTETWMSS

SEQ ID NO: 118548 - protein, 11 aa, Dengue virus
ETRTETWMSSE

SEQ ID NO: 118549 - protein, 11 aa, Dengue virus
TRTETWMSSEG

SEQ ID NO: 118550 - protein, 11 aa, Dengue virus
RTETWMSSEGA

SEQ ID NO: 118551 - protein, 11 aa, Dengue virus
TETWMSSEGAW

SEQ ID NO: 118552 - protein, 11 aa, Dengue virus
ETWMSSEGAWK

SEQ ID NO: 118553 - protein, 11 aa, Dengue virus
TWMSSEGAWKQ

SEQ ID NO: 118554 - protein, 11 aa, Dengue virus
VETWALRHPGF

SEQ ID NO: 118555 - protein, 11 aa, Dengue virus
ETWALRHPGFT

SEQ ID NO: 118556 - protein, 11 aa, Dengue virus
MRCVGIGSRDF

SEQ ID NO: 118557 - protein, 11 aa, Dengue virus
RCVGIGSRDFV

SEQ ID NO: 118558 - protein, 11 aa, Dengue virus
CVGIGSRDFVE

SEQ ID NO: 118559 - protein, 11 aa, Dengue virus
VGIGSRDFVEG

SEQ ID NO: 118560 - protein, 11 aa, Dengue virus
GSRDFVEGLSG

SEQ ID NO: 118561 - protein, 11 aa, Dengue virus
NRDFVEGVSGG

SEQ ID NO: 118562 - protein, 11 aa, Dengue virus
RDFVEGLSGAT

SEQ ID NO: 118563 - protein, 11 aa, Dengue virus
DFVEGLSGATW

SEQ ID NO: 118564 - protein, 11 aa, Dengue virus
FVEGLSGATWV

SEQ ID NO: 118565 - protein, 11 aa, Dengue virus
VEGLSGATWVD

SEQ ID NO: 118566 - protein, 11 aa, Dengue virus
EGLSGATWVDV

SEQ ID NO: 118567 - protein, 11 aa, Dengue virus
GLSGATWVDVV

SEQ ID NO: 118568 - protein, 11 aa, Dengue virus
LSGATWVDVVL

SEQ ID NO: 118569 - protein, 11 aa, Dengue virus
SGATWVDVVLE

SEQ ID NO: 118570 - protein, 11 aa, Dengue virus
GATWVDVVLEH

SEQ ID NO: 118571 - protein, 11 aa, Dengue virus
ATWVDVVLEHG

SEQ ID NO: 118572 - protein, 11 aa, Dengue virus
TWVDVVLEHGS

SEQ ID NO: 118573 - protein, 11 aa, Dengue virus
WVDVVLEHGSC

SEQ ID NO: 118574 - protein, 11 aa, Dengue virus
VDVVLEHGSCV

SEQ ID NO: 118575 - protein, 11 aa, Dengue virus
DVVLEHGSCVT

SEQ ID NO: 118576 - protein, 11 aa, Dengue virus
VVLEHGSCVTT

SEQ ID NO: 118577 - protein, 11 aa, Dengue virus
VLEHGSCVTTM

SEQ ID NO: 118578 - protein, 11 aa, Dengue virus
LEHGSCVTTMA

SEQ ID NO: 118579 - protein, 11 aa, Dengue virus
EHGSCVTTMAK

SEQ ID NO: 118580 - protein, 11 aa, Dengue virus
HGSCVTTMAKN

SEQ ID NO: 118581 - protein, 11 aa, Dengue virus
GSCVTTMAKNK

SEQ ID NO: 118582 - protein, 11 aa, Dengue virus
SCVTTMAKNKP

SEQ ID NO: 118583 - protein, 11 aa, Dengue virus
CVTTMAKNKPT

SEQ ID NO: 118584 - protein, 11 aa, Dengue virus
VTTMAKNKPTL

SEQ ID NO: 118585 - protein, 11 aa, Dengue virus
TTMAKNKPTLD

SEQ ID NO: 118586 - protein, 11 aa, Dengue virus
TMAKDKPTLDI

SEQ ID NO: 118587 - protein, 11 aa, Dengue virus
MAKDKPTLDIE

SEQ ID NO: 118588 - protein, 11 aa, Dengue virus
AKDKPTLDIEL

SEQ ID NO: 118589 - protein, 11 aa, Dengue virus
KPTLDIELLKT

SEQ ID NO: 118590 - protein, 11 aa, Dengue virus
PTLDIELLKTE

SEQ ID NO: 118591 - protein, 11 aa, Dengue virus
TLDIELLKTEV

SEQ ID NO: 118592 - protein, 11 aa, Dengue virus
LDIELLKTEVT

SEQ ID NO: 118593 - protein, 11 aa, Dengue virus
TTDSRCPTQGE

SEQ ID NO: 118594 - protein, 11 aa, Dengue virus
TDSRCPTQGEA

SEQ ID NO: 118595 - protein, 11 aa, Dengue virus
CRRTFVDRGWG

SEQ ID NO: 118596 - protein, 11 aa, Dengue virus
RRTFVDRGWGN

SEQ ID NO: 118597 - protein, 11 aa, Dengue virus
RTFVDRGWGNG

SEQ ID NO: 118598 - protein, 11 aa, Dengue virus
TFVDRGWGNGC

SEQ ID NO: 118599 - protein, 11 aa, Dengue virus
FVDRGWGNGCG

SEQ ID NO: 118600 - protein, 11 aa, Dengue virus
VDRGWGNGCGL

SEQ ID NO: 118601 - protein, 11 aa, Dengue virus
DRGWGNGCGLF

SEQ ID NO: 118602 - protein, 11 aa, Dengue virus
RGWGNGCGLFG

SEQ ID NO: 118603 - protein, 11 aa, Dengue virus
GWGNGCGLFGK

SEQ ID NO: 118604 - protein, 11 aa, Dengue virus
WGNGCGLFGKG

SEQ ID NO: 118605 - protein, 11 aa, Dengue virus
GNGCGLFGKGS

SEQ ID NO: 118606 - protein, 11 aa, Dengue virus
NGCGLFGKGSL

SEQ ID NO: 118607 - protein, 11 aa, Dengue virus
GCGLFGKGSLI

SEQ ID NO: 118608 - protein, 11 aa, Dengue virus
CGLFGKGSLIT

SEQ ID NO: 118609 - protein, 11 aa, Dengue virus
GLFGKGSLITC

SEQ ID NO: 118610 - protein, 11 aa, Dengue virus
LFGKGSLITCA

SEQ ID NO: 118611 - protein, 11 aa, Dengue virus
FGKGSLITCAK

SEQ ID NO: 118612 - protein, 11 aa, Dengue virus
GKGSLITCAKF

SEQ ID NO: 118613 - protein, 11 aa, Dengue virus
TVHTGDQHQVG

SEQ ID NO: 118614 - protein, 11 aa, Dengue virus
VHTGDQHQVGN

SEQ ID NO: 118615 - protein, 11 aa, Dengue virus
HTGDQHQVGNE

SEQ ID NO: 118616 - protein, 11 aa, Dengue virus
LTLDCSPRTGL

SEQ ID NO: 118617 - protein, 11 aa, Dengue virus
TLDCSPRTGLD

SEQ ID NO: 118618 - protein, 11 aa, Dengue virus
LDCSPRTGLDF

SEQ ID NO: 118619 - protein, 11 aa, Dengue virus
ECSPRTGLDFN

SEQ ID NO: 118620 - protein, 11 aa, Dengue virus
CSPRTGLDFNE

SEQ ID NO: 118621 - protein, 11 aa, Dengue virus
SPRTGLDFNEM

SEQ ID NO: 118622 - protein, 11 aa, Dengue virus
PRTGLDFNEMV

SEQ ID NO: 118623 - protein, 11 aa, Dengue virus
RTGLDFNEMVL

SEQ ID NO: 118624 - protein, 11 aa, Dengue virus
TGLDFNEMVLL

SEQ ID NO: 118625 - protein, 11 aa, Dengue virus
GLDFNEMVLLT

SEQ ID NO: 118626 - protein, 11 aa, Dengue virus
LDFNEMVLLTM

SEQ ID NO: 118627 - protein, 11 aa, Dengue virus
KSWLVHKQWFL

SEQ ID NO: 118628 - protein, 11 aa, Dengue virus
SWLVHKQWFLD

SEQ ID NO: 118629 - protein, 11 aa, Dengue virus
WLVHKQWFLDL

SEQ ID NO: 118630 - protein, 11 aa, Dengue virus
LVHKQWFLDLP

SEQ ID NO: 118631 - protein, 11 aa, Dengue virus
VHKQWFLDLPL

SEQ ID NO: 118632 - protein, 11 aa, Dengue virus
HKQWFLDLPLP

SEQ ID NO: 118633 - protein, 11 aa, Dengue virus
KQWFLDLPLPW

SEQ ID NO: 118634 - protein, 11 aa, Dengue virus
QWFLDLPLPWT

SEQ ID NO: 118635 - protein, 11 aa, Dengue virus
QDLLVTFKTAH

SEQ ID NO: 118636 - protein, 11 aa, Dengue virus
DLLVTFKTAHA

SEQ ID NO: 118637 - protein, 11 aa, Dengue virus
LLVTFKTAHAK

SEQ ID NO: 118638 - protein, 11 aa, Dengue virus
LVTFKTAHAKK

SEQ ID NO: 118639 - protein, 11 aa, Dengue virus
VTFKTAHAKKQ

SEQ ID NO: 118640 - protein, 11 aa, Dengue virus
TFKTAHAKKQE

SEQ ID NO: 118641 - protein, 11 aa, Dengue virus
FKTAHAKKQEV

SEQ ID NO: 118642 - protein, 11 aa, Dengue virus
KTAHAKKQEVV

SEQ ID NO: 118643 - protein, 11 aa, Dengue virus
TAHAKKQEVVV

SEQ ID NO: 118644 - protein, 11 aa, Dengue virus
AHAKKQEVVVL

SEQ ID NO: 118645 - protein, 11 aa, Dengue virus
HAKKQEVVVLG

SEQ ID NO: 118646 - protein, 11 aa, Dengue virus
AKKQEVVVLGS

SEQ ID NO: 118647 - protein, 11 aa, Dengue virus
KKQEVVVLGSQ

SEQ ID NO: 118648 - protein, 11 aa, Dengue virus
KQEVVVLGSQE

SEQ ID NO: 118649 - protein, 11 aa, Dengue virus
QEVVVLGSQEG

SEQ ID NO: 118650 - protein, 11 aa, Dengue virus
EVVVLGSQEGA

SEQ ID NO: 118651 - protein, 11 aa, Dengue virus
VVVLGSQEGAM

SEQ ID NO: 118652 - protein, 11 aa, Dengue virus
VVLGSQEGAMH

SEQ ID NO: 118653 - protein, 11 aa, Dengue virus
VLGSQEGAMHT

SEQ ID NO: 118654 - protein, 11 aa, Dengue virus
LGSQEGAMHTA

SEQ ID NO: 118655 - protein, 11 aa, Dengue virus
GSQEGAMHTAL

SEQ ID NO: 118656 - protein, 11 aa, Dengue virus
SQEGAMHTALT

SEQ ID NO: 118657 - protein, 11 aa, Dengue virus
QEGAMHTALTG

SEQ ID NO: 118658 - protein, 11 aa, Dengue virus
EGAMHTALTGA

SEQ ID NO: 118659 - protein, 11 aa, Dengue virus
GAMHTALTGAT

SEQ ID NO: 118660 - protein, 11 aa, Dengue virus
AMHTALTGATE

SEQ ID NO: 118661 - protein, 11 aa, Dengue virus
MHTALTGATEI

SEQ ID NO: 118662 - protein, 11 aa, Dengue virus
HTALTGATEIQ

SEQ ID NO: 118663 - protein, 11 aa, Dengue virus
TALTGATEIQT

SEQ ID NO: 118664 - protein, 11 aa, Dengue virus
ALTGATEIQTS

SEQ ID NO: 118665 - protein, 11 aa, Dengue virus
GTTTIFAGHLK

SEQ ID NO: 118666 - protein, 11 aa, Dengue virus
TTTIFAGHLKC

SEQ ID NO: 118667 - protein, 11 aa, Dengue virus
TTIFAGHLKCR

SEQ ID NO: 118668 - protein, 11 aa, Dengue virus
TIFAGHLKCRL

SEQ ID NO: 118669 - protein, 11 aa, Dengue virus
IFAGHLKCRLK

SEQ ID NO: 118670 - protein, 11 aa, Dengue virus
FAGHLKCRLKM

SEQ ID NO: 118671 - protein, 11 aa, Dengue virus
AGHLKCRLKMD

SEQ ID NO: 118672 - protein, 11 aa, Dengue virus
GHLKCRLKMDK

SEQ ID NO: 118673 - protein, 11 aa, Dengue virus
HLKCRLKMDKL

SEQ ID NO: 118674 - protein, 11 aa, Dengue virus
LKCRLKMDKLT

SEQ ID NO: 118675 - protein, 11 aa, Dengue virus
KCRLKMDKLTL

SEQ ID NO: 118676 - protein, 11 aa, Dengue virus
CRLKMDKLTLK

SEQ ID NO: 118677 - protein, 11 aa, Dengue virus
RLKMDKLTLKG

SEQ ID NO: 118678 - protein, 11 aa, Dengue virus
EKEVAETQHGT

SEQ ID NO: 118679 - protein, 11 aa, Dengue virus
KEVAETQHGTV

SEQ ID NO: 118680 - protein, 11 aa, Dengue virus
EVAETQHGTVL

SEQ ID NO: 118681 - protein, 11 aa, Dengue virus
VAETQHGTVLV

SEQ ID NO: 118682 - protein, 11 aa, Dengue virus
AETQHGTVLVQ

SEQ ID NO: 118683 - protein, 11 aa, Dengue virus
PVNIEAEPPFG

SEQ ID NO: 118684 - protein, 11 aa, Dengue virus
VNIEAEPPFGE

SEQ ID NO: 118685 - protein, 11 aa, Dengue virus
NIEAEPPFGES

SEQ ID NO: 118686 - protein, 11 aa, Dengue virus
IEAEPPFGESY

SEQ ID NO: 118687 - protein, 11 aa, Dengue virus
EAEPPFGESYI

SEQ ID NO: 118688 - protein, 11 aa, Dengue virus
GSSIGKMFEAT

SEQ ID NO: 118689 - protein, 11 aa, Dengue virus
IGKMFEATARG

SEQ ID NO: 118690 - protein, 11 aa, Dengue virus
GKMFEATARGA

SEQ ID NO: 118691 - protein, 11 aa, Dengue virus
KMFEATARGAR

SEQ ID NO: 118692 - protein, 11 aa, Dengue virus
MFEATARGARR

SEQ ID NO: 118693 - protein, 11 aa, Dengue virus
FEATARGARRM

SEQ ID NO: 118694 - protein, 11 aa, Dengue virus
EATARGARRMA

SEQ ID NO: 118695 - protein, 11 aa, Dengue virus
ATARGARRMAI

SEQ ID NO: 118696 - protein, 11 aa, Dengue virus
TARGARRMAIL

SEQ ID NO: 118697 - protein, 11 aa, Dengue virus
ARGARRMAILG

SEQ ID NO: 118698 - protein, 11 aa, Dengue virus
RGARRMAILGD

SEQ ID NO: 118699 - protein, 11 aa, Dengue virus
GARRMAILGDT

SEQ ID NO: 118700 - protein, 11 aa, Dengue virus
ARRMAILGDTA

SEQ ID NO: 118701 - protein, 11 aa, Dengue virus
RRMAILGDTAW

SEQ ID NO: 118702 - protein, 11 aa, Dengue virus
RMAILGDTAWD

SEQ ID NO: 118703 - protein, 11 aa, Dengue virus
MAILGDTAWDF

SEQ ID NO: 118704 - protein, 11 aa, Dengue virus
AILGDTAWDFG

SEQ ID NO: 118705 - protein, 11 aa, Dengue virus
ILGDTAWDFGS

SEQ ID NO: 118706 - protein, 11 aa, Dengue virus
LGDTAWDFGSI

SEQ ID NO: 118707 - protein, 11 aa, Dengue virus
GDTAWDFGSIG

SEQ ID NO: 118708 - protein, 11 aa, Dengue virus
DTAWDFGSIGG

SEQ ID NO: 118709 - protein, 11 aa, Dengue virus
TAWDFGSIGGV

SEQ ID NO: 118710 - protein, 11 aa, Dengue virus
AYGVLFSGVSW

SEQ ID NO: 118711 - protein, 11 aa, Dengue virus
GRELKCGSGIF

SEQ ID NO: 118712 - protein, 11 aa, Dengue virus
RELKCGSGIFV

SEQ ID NO: 118713 - protein, 11 aa, Dengue virus
ELKCGSGIFVT

SEQ ID NO: 118714 - protein, 11 aa, Dengue virus
LKCGSGIFVTN

SEQ ID NO: 118715 - protein, 11 aa, Dengue virus
KCGSGIFVTNE

SEQ ID NO: 118716 - protein, 11 aa, Dengue virus
CGSGIFVTNEV

SEQ ID NO: 118717 - protein, 11 aa, Dengue virus
GSGIFVTNEVH

SEQ ID NO: 118718 - protein, 11 aa, Dengue virus
SGIFVTNEVHT

SEQ ID NO: 118719 - protein, 11 aa, Dengue virus
GIFVTNEVHTW

SEQ ID NO: 118720 - protein, 11 aa, Dengue virus
IFVTNEVHTWT

SEQ ID NO: 118721 - protein, 11 aa, Dengue virus
FVTNEVHTWTE

SEQ ID NO: 118722 - protein, 11 aa, Dengue virus
VTNEVHTWTEQ

SEQ ID NO: 118723 - protein, 11 aa, Dengue virus
TNEVHTWTEQY

SEQ ID NO: 118724 - protein, 11 aa, Dengue virus
NEVHTWTEQYK

SEQ ID NO: 118725 - protein, 11 aa, Dengue virus
EVHTWTEQYKF

SEQ ID NO: 118726 - protein, 11 aa, Dengue virus
VHTWTEQYKFQ

SEQ ID NO: 118727 - protein, 11 aa, Dengue virus
HTWTEQYKFQA

SEQ ID NO: 118728 - protein, 11 aa, Dengue virus
TWTEQYKFQAD

SEQ ID NO: 118729 - protein, 11 aa, Dengue virus
WTEQYKFQADS

SEQ ID NO: 118730 - protein, 11 aa, Dengue virus
TEQYKFQADSP

SEQ ID NO: 118731 - protein, 11 aa, Dengue virus
EQYKFQADSPK

SEQ ID NO: 118732 - protein, 11 aa, Dengue virus
QYKFQADSPKR

SEQ ID NO: 118733 - protein, 11 aa, Dengue virus
YKFQADSPKRL

SEQ ID NO: 118734 - protein, 11 aa, Dengue virus
KFQADSPKRLS

SEQ ID NO: 118735 - protein, 11 aa, Dengue virus
FQADSPKRLSA

SEQ ID NO: 118736 - protein, 11 aa, Dengue virus
QADSPKRLSAA

SEQ ID NO: 118737 - protein, 11 aa, Dengue virus
ADSPKRLSAAI

SEQ ID NO: 118738 - protein, 11 aa, Dengue virus
DSPKRLSAAIG

SEQ ID NO: 118739 - protein, 11 aa, Dengue virus
SPKRLSAAIGK

SEQ ID NO: 118740 - protein, 11 aa, Dengue virus
PKRLSAAIGKA

SEQ ID NO: 118741 - protein, 11 aa, Dengue virus
GVCGIRSATRL

SEQ ID NO: 118742 - protein, 11 aa, Dengue virus
VCGIRSATRLE

SEQ ID NO: 118743 - protein, 11 aa, Dengue virus
CGIRSATRLEN

SEQ ID NO: 118744 - protein, 11 aa, Dengue virus
GIRSATRLENI

SEQ ID NO: 118745 - protein, 11 aa, Dengue virus
IRSATRLENIM

SEQ ID NO: 118746 - protein, 11 aa, Dengue virus
RSATRLENIMW

SEQ ID NO: 118747 - protein, 11 aa, Dengue virus
TRLENIMWKQI

SEQ ID NO: 118748 - protein, 11 aa, Dengue virus
RAWNIWEVEDY

SEQ ID NO: 118749 - protein, 11 aa, Dengue virus
AWNIWEVEDYG

SEQ ID NO: 118750 - protein, 11 aa, Dengue virus
WNIWEVEDYGF

SEQ ID NO: 118751 - protein, 11 aa, Dengue virus
NIWEVEDYGFG

SEQ ID NO: 118752 - protein, 11 aa, Dengue virus
WEVEDYGFGIF

SEQ ID NO: 118753 - protein, 11 aa, Dengue virus
EVEDYGFGVFT

SEQ ID NO: 118754 - protein, 11 aa, Dengue virus
VEDYGFGVFTT

SEQ ID NO: 118755 - protein, 11 aa, Dengue virus
EDYGFGVFTTN

SEQ ID NO: 118756 - protein, 11 aa, Dengue virus
DYGFGVFTTNI

SEQ ID NO: 118757 - protein, 11 aa, Dengue virus
YGFGVFTTNIW

SEQ ID NO: 118758 - protein, 11 aa, Dengue virus
GFGVFTTNIWL

SEQ ID NO: 118759 - protein, 11 aa, Dengue virus
FGVFTTNIWLK

SEQ ID NO: 118760 - protein, 11 aa, Dengue virus
CDHRLMSAAIK

SEQ ID NO: 118761 - protein, 11 aa, Dengue virus
DHRLMSAAIKD

SEQ ID NO: 118762 - protein, 11 aa, Dengue virus
KDSKAVHADMG

SEQ ID NO: 118763 - protein, 11 aa, Dengue virus
DSKAVHADMGY

SEQ ID NO: 118764 - protein, 11 aa, Dengue virus
SKAVHADMGYW

SEQ ID NO: 118765 - protein, 11 aa, Dengue virus
RAVHADMGYWI

SEQ ID NO: 118766 - protein, 11 aa, Dengue virus
AVHADMGYWIE

SEQ ID NO: 118767 - protein, 11 aa, Dengue virus
VHADMGYWIES

SEQ ID NO: 118768 - protein, 11 aa, Dengue virus
HADMGYWIESE

SEQ ID NO: 118769 - protein, 11 aa, Dengue virus
ADMGYWIESEK

SEQ ID NO: 118770 - protein, 11 aa, Dengue virus
DMGYWIESEKN

SEQ ID NO: 118771 - protein, 11 aa, Dengue virus
WPKSHTLWSNG

SEQ ID NO: 118772 - protein, 11 aa, Dengue virus
PKSHTLWSNGV

SEQ ID NO: 118773 - protein, 11 aa, Dengue virus
KSHTLWSNGVL

SEQ ID NO: 118774 - protein, 11 aa, Dengue virus
SHTLWSNGVLE

SEQ ID NO: 118775 - protein, 11 aa, Dengue virus
HTLWSNGVLES

SEQ ID NO: 118776 - protein, 11 aa, Dengue virus
TLWSNGVLESE

SEQ ID NO: 118777 - protein, 11 aa, Dengue virus
LWSNGVLESEM

SEQ ID NO: 118778 - protein, 11 aa, Dengue virus
WSNGVLESEMI

SEQ ID NO: 118779 - protein, 11 aa, Dengue virus
SNGVLESEMII

SEQ ID NO: 118780 - protein, 11 aa, Dengue virus
NGVLESEMIIP

SEQ ID NO: 118781 - protein, 11 aa, Dengue virus
GVLESEMIIPK

SEQ ID NO: 118782 - protein, 11 aa, Dengue virus
TQTAGPWHLGK

SEQ ID NO: 118783 - protein, 11 aa, Dengue virus
QTAGPWHLGKL

SEQ ID NO: 118784 - protein, 11 aa, Dengue virus
AGPWHLGKLEL

SEQ ID NO: 118785 - protein, 11 aa, Dengue virus
GPWHLGKLELD

SEQ ID NO: 118786 - protein, 11 aa, Dengue virus
PWHLGKLELDF

SEQ ID NO: 118787 - protein, 11 aa, Dengue virus
CGNRGPSLRTT

SEQ ID NO: 118788 - protein, 11 aa, Dengue virus
GNRGPSLRTTT

SEQ ID NO: 118789 - protein, 11 aa, Dengue virus
RGPSLRTTTVT

SEQ ID NO: 118790 - protein, 11 aa, Dengue virus
GPSLRTTTVTG

SEQ ID NO: 118791 - protein, 11 aa, Dengue virus
PSLRTTTVTGK

SEQ ID NO: 118792 - protein, 11 aa, Dengue virus
SLRTTTVTGKI

SEQ ID NO: 118793 - protein, 11 aa, Dengue virus
LRTTTVTGKII

SEQ ID NO: 118794 - protein, 11 aa, Dengue virus
RTTTVTGKIIH

SEQ ID NO: 118795 - protein, 11 aa, Dengue virus
TTTVTGKIIHE

SEQ ID NO: 118796 - protein, 11 aa, Dengue virus
TTVTGKIIHEW

SEQ ID NO: 118797 - protein, 11 aa, Dengue virus
TVTGKIIHEWC

SEQ ID NO: 118798 - protein, 11 aa, Dengue virus
VTGKIIHEWCC

SEQ ID NO: 118799 - protein, 11 aa, Dengue virus
TGKIIHEWCCR

SEQ ID NO: 118800 - protein, 11 aa, Dengue virus
GKIIHEWCCRS

SEQ ID NO: 118801 - protein, 11 aa, Dengue virus
KIIHEWCCRSC

SEQ ID NO: 118802 - protein, 11 aa, Dengue virus
IIHEWCCRSCT

SEQ ID NO: 118803 - protein, 11 aa, Dengue virus
IHEWCCRSCTL

SEQ ID NO: 118804 - protein, 11 aa, Dengue virus
HEWCCRSCTLP

SEQ ID NO: 118805 - protein, 11 aa, Dengue virus
EWCCRSCTLPP

SEQ ID NO: 118806 - protein, 11 aa, Dengue virus
WCCRSCTLPPL

SEQ ID NO: 118807 - protein, 11 aa, Dengue virus
CCRSCTLPPLR

SEQ ID NO: 118808 - protein, 11 aa, Dengue virus
CRSCTLPPLRY

SEQ ID NO: 118809 - protein, 11 aa, Dengue virus
RSCTLPPLRYR

SEQ ID NO: 118810 - protein, 11 aa, Dengue virus
SCTLPPLRYRG

SEQ ID NO: 118811 - protein, 11 aa, Dengue virus
CTLPPLRYRGE

SEQ ID NO: 118812 - protein, 11 aa, Dengue virus
TLPPLRYRGED

SEQ ID NO: 118813 - protein, 11 aa, Dengue virus
LPPLRYRGEDG

SEQ ID NO: 118814 - protein, 11 aa, Dengue virus
PPLRYRGEDGC

SEQ ID NO: 118815 - protein, 11 aa, Dengue virus
PLRYRGEDGCW

SEQ ID NO: 118816 - protein, 11 aa, Dengue virus
LRYRGEDGCWY

SEQ ID NO: 118817 - protein, 11 aa, Dengue virus
RYRGEDGCWYG

SEQ ID NO: 118818 - protein, 11 aa, Dengue virus
YRGEDGCWYGM

SEQ ID NO: 118819 - protein, 11 aa, Dengue virus
RGEDGCWYGME

SEQ ID NO: 118820 - protein, 11 aa, Dengue virus
GEDGCWYGMEI

SEQ ID NO: 118821 - protein, 11 aa, Dengue virus
EDGCWYGMEIR

SEQ ID NO: 118822 - protein, 11 aa, Dengue virus
DGCWYGMEIRP

SEQ ID NO: 118823 - protein, 11 aa, Dengue virus
GCWYGMEIRPV

SEQ ID NO: 118824 - protein, 11 aa, Dengue virus
ELGDGLAMGIM

SEQ ID NO: 118825 - protein, 11 aa, Dengue virus
KSWPLNEGIMA

SEQ ID NO: 118826 - protein, 11 aa, Dengue virus
SWPLNEGIMAV

SEQ ID NO: 118827 - protein, 11 aa, Dengue virus
WPLNEGIMAVG

SEQ ID NO: 118828 - protein, 11 aa, Dengue virus
VSILLSSLLKN

SEQ ID NO: 118829 - protein, 11 aa, Dengue virus
SILLSSLLKND

SEQ ID NO: 118830 - protein, 11 aa, Dengue virus
ILLSSLLKNDV

SEQ ID NO: 118831 - protein, 11 aa, Dengue virus
LLSSLLKNDVP

SEQ ID NO: 118832 - protein, 11 aa, Dengue virus
LSSLLKNDVPL

SEQ ID NO: 118833 - protein, 11 aa, Dengue virus
SSLLKNDVPLA

SEQ ID NO: 118834 - protein, 11 aa, Dengue virus
SLLKNDVPLAG

SEQ ID NO: 118835 - protein, 11 aa, Dengue virus
LLKNDVPLAGP

SEQ ID NO: 118836 - protein, 11 aa, Dengue virus
LKNDVPLAGPL

SEQ ID NO: 118837 - protein, 11 aa, Dengue virus
KNDVPLAGPLI

SEQ ID NO: 118838 - protein, 11 aa, Dengue virus
NDVPLAGPLIA

SEQ ID NO: 118839 - protein, 11 aa, Dengue virus
DVPLAGPLIAG

SEQ ID NO: 118840 - protein, 11 aa, Dengue virus
VPLAGPLIAGG

SEQ ID NO: 118841 - protein, 11 aa, Dengue virus
PLAGPLIAGGM

SEQ ID NO: 118842 - protein, 11 aa, Dengue virus
LAGPLIAGGML

SEQ ID NO: 118843 - protein, 11 aa, Dengue virus
AGPLIAGGMLI

SEQ ID NO: 118844 - protein, 11 aa, Dengue virus
GPLIAGGMLIA

SEQ ID NO: 118845 - protein, 11 aa, Dengue virus
PLIAGGMLIAC

SEQ ID NO: 118846 - protein, 11 aa, Dengue virus
LIAGGMLIACY

SEQ ID NO: 118847 - protein, 11 aa, Dengue virus
IAGGMLIACYV

SEQ ID NO: 118848 - protein, 11 aa, Dengue virus
AGGMLIACYVI

SEQ ID NO: 118849 - protein, 11 aa, Dengue virus
GGMLIACYVIS

SEQ ID NO: 118850 - protein, 11 aa, Dengue virus
GMLIACYVISG

SEQ ID NO: 118851 - protein, 11 aa, Dengue virus
MLIACYVISGS

SEQ ID NO: 118852 - protein, 11 aa, Dengue virus
LIACYVISGSS

SEQ ID NO: 118853 - protein, 11 aa, Dengue virus
IACYVISGSSA

SEQ ID NO: 118854 - protein, 11 aa, Dengue virus
ACYVISGSSAD

SEQ ID NO: 118855 - protein, 11 aa, Dengue virus
CYVISGSSADL

SEQ ID NO: 118856 - protein, 11 aa, Dengue virus
YVISGSSADLS

SEQ ID NO: 118857 - protein, 11 aa, Dengue virus
VISGSSADLSL

SEQ ID NO: 118858 - protein, 11 aa, Dengue virus
ISGSSADLSLE

SEQ ID NO: 118859 - protein, 11 aa, Dengue virus
SGSSADLSLEK

SEQ ID NO: 118860 - protein, 11 aa, Dengue virus
EAEHSGASHNI

SEQ ID NO: 118861 - protein, 11 aa, Dengue virus
AEHSGASHNIL

SEQ ID NO: 118862 - protein, 11 aa, Dengue virus
QDDGTMKIKDE

SEQ ID NO: 118863 - protein, 11 aa, Dengue virus
DDGTMKIKDEE

SEQ ID NO: 118864 - protein, 11 aa, Dengue virus
DGTMKIKDEER

SEQ ID NO: 118865 - protein, 11 aa, Dengue virus
GTMKIKDEERD

SEQ ID NO: 118866 - protein, 11 aa, Dengue virus
LTILLKATLLA

SEQ ID NO: 118867 - protein, 11 aa, Dengue virus
TILLKATLLAV

SEQ ID NO: 118868 - protein, 11 aa, Dengue virus
ILLKATLLAVS

SEQ ID NO: 118869 - protein, 11 aa, Dengue virus
LLKATLLAVSG

SEQ ID NO: 118870 - protein, 11 aa, Dengue virus
KKQRSGVLWDT

SEQ ID NO: 118871 - protein, 11 aa, Dengue virus
KQRSGVLWDTP

SEQ ID NO: 118872 - protein, 11 aa, Dengue virus
QRSGVLWDTPS

SEQ ID NO: 118873 - protein, 11 aa, Dengue virus
RSGVLWDTPSP

SEQ ID NO: 118874 - protein, 11 aa, Dengue virus
SGVLWDTPSPP

SEQ ID NO: 118875 - protein, 11 aa, Dengue virus
GVLWDTPSPPE

SEQ ID NO: 118876 - protein, 11 aa, Dengue virus
GRSQVGVGVFQ

SEQ ID NO: 118877 - protein, 11 aa, Dengue virus
ENVFHTMWHVT

SEQ ID NO: 118878 - protein, 11 aa, Dengue virus
GVFHTMWHVTR

SEQ ID NO: 118879 - protein, 11 aa, Dengue virus
VFHTMWHVTRG

SEQ ID NO: 118880 - protein, 11 aa, Dengue virus
FHTMWHVTRGA

SEQ ID NO: 118881 - protein, 11 aa, Dengue virus
HTMWHVTRGAV

SEQ ID NO: 118882 - protein, 11 aa, Dengue virus
TMWHVTRGAVL

SEQ ID NO: 118883 - protein, 11 aa, Dengue virus
MWHVTRGAVLM

SEQ ID NO: 118884 - protein, 11 aa, Dengue virus
WHVTRGAVLMY

SEQ ID NO: 118885 - protein, 11 aa, Dengue virus
GKRLEPSWASV

SEQ ID NO: 118886 - protein, 11 aa, Dengue virus
KRLEPSWASVK

SEQ ID NO: 118887 - protein, 11 aa, Dengue virus
RLEPSWASVKK

SEQ ID NO: 118888 - protein, 11 aa, Dengue virus
LEPSWASVKKD

SEQ ID NO: 118889 - protein, 11 aa, Dengue virus
EPSWASVKKDL

SEQ ID NO: 118890 - protein, 11 aa, Dengue virus
WASVKKDLISY

SEQ ID NO: 118891 - protein, 11 aa, Dengue virus
ASVKKDLISYG

SEQ ID NO: 118892 - protein, 11 aa, Dengue virus
SVKKDLISYGG

SEQ ID NO: 118893 - protein, 11 aa, Dengue virus
VKKDLISYGGG

SEQ ID NO: 118894 - protein, 11 aa, Dengue virus
KKDLISYGGGW

SEQ ID NO: 118895 - protein, 11 aa, Dengue virus
KDLISYGGGWR

SEQ ID NO: 118896 - protein, 11 aa, Dengue virus
DLISYGGGWRL

SEQ ID NO: 118897 - protein, 11 aa, Dengue virus
WNTGEEVQVIA

SEQ ID NO: 118898 - protein, 11 aa, Dengue virus
TGEEVQVIAVE

SEQ ID NO: 118899 - protein, 11 aa, Dengue virus
GEEVQVIAVEP

SEQ ID NO: 118900 - protein, 11 aa, Dengue virus
EEVQVIAVEPG

SEQ ID NO: 118901 - protein, 11 aa, Dengue virus
EVQVIAVEPGK

SEQ ID NO: 118902 - protein, 11 aa, Dengue virus
VQVIAVEPGKN

SEQ ID NO: 118903 - protein, 11 aa, Dengue virus
QVIAVEPGKNP

SEQ ID NO: 118904 - protein, 11 aa, Dengue virus
VIAVEPGKNPK

SEQ ID NO: 118905 - protein, 11 aa, Dengue virus
IAVEPGKNPKN

SEQ ID NO: 118906 - protein, 11 aa, Dengue virus
AVEPGKNPKNV

SEQ ID NO: 118907 - protein, 11 aa, Dengue virus
VEPGKNPKNVQ

SEQ ID NO: 118908 - protein, 11 aa, Dengue virus
EPGKNPKNVQT

SEQ ID NO: 118909 - protein, 11 aa, Dengue virus
EGEVGAIALDF

SEQ ID NO: 118910 - protein, 11 aa, Dengue virus
GEVGAIALDFK

SEQ ID NO: 118911 - protein, 11 aa, Dengue virus
EVGAIALDFKP

SEQ ID NO: 118912 - protein, 11 aa, Dengue virus
VGAIALDFKPG

SEQ ID NO: 118913 - protein, 11 aa, Dengue virus
GAIALDFKPGT

SEQ ID NO: 118914 - protein, 11 aa, Dengue virus
AIALDFKPGTS

SEQ ID NO: 118915 - protein, 11 aa, Dengue virus
IALDFKPGTSG

SEQ ID NO: 118916 - protein, 11 aa, Dengue virus
ALDFKPGTSGS

SEQ ID NO: 118917 - protein, 11 aa, Dengue virus
LDFKPGTSGSP

SEQ ID NO: 118918 - protein, 11 aa, Dengue virus
DFKPGTSGSPI

SEQ ID NO: 118919 - protein, 11 aa, Dengue virus
FKPGTSGSPIV

SEQ ID NO: 118920 - protein, 11 aa, Dengue virus
KPGTSGSPIVN

SEQ ID NO: 118921 - protein, 11 aa, Dengue virus
PGTSGSPIVNR

SEQ ID NO: 118922 - protein, 11 aa, Dengue virus
EGKIVGLYGNG

SEQ ID NO: 118923 - protein, 11 aa, Dengue virus
GKVVGLYGNGV

SEQ ID NO: 118924 - protein, 11 aa, Dengue virus
KVVGLYGNGVV

SEQ ID NO: 118925 - protein, 11 aa, Dengue virus
VVGLYGNGVVT

SEQ ID NO: 118926 - protein, 11 aa, Dengue virus
VGLYGNGVVTT

SEQ ID NO: 118927 - protein, 11 aa, Dengue virus
GLYGNGVVTTS

SEQ ID NO: 118928 - protein, 11 aa, Dengue virus
LYGNGVVTTSG

SEQ ID NO: 118929 - protein, 11 aa, Dengue virus
YGNGVVTTSGT

SEQ ID NO: 118930 - protein, 11 aa, Dengue virus
GNGVVTTSGTY

SEQ ID NO: 118931 - protein, 11 aa, Dengue virus
NGVVTTSGTYV

SEQ ID NO: 118932 - protein, 11 aa, Dengue virus
GVVTTSGTYVS

SEQ ID NO: 118933 - protein, 11 aa, Dengue virus
VFRKRNLTIMD

SEQ ID NO: 118934 - protein, 11 aa, Dengue virus
FRKRNLTIMDL

SEQ ID NO: 118935 - protein, 11 aa, Dengue virus
RKRNLTIMDLH

SEQ ID NO: 118936 - protein, 11 aa, Dengue virus
KRNLTIMDLHP

SEQ ID NO: 118937 - protein, 11 aa, Dengue virus
RNLTIMDLHPG

SEQ ID NO: 118938 - protein, 11 aa, Dengue virus
NLTIMDLHPGS

SEQ ID NO: 118939 - protein, 11 aa, Dengue virus
LTIMDLHPGSG

SEQ ID NO: 118940 - protein, 11 aa, Dengue virus
TIMDLHPGSGK

SEQ ID NO: 118941 - protein, 11 aa, Dengue virus
IMDLHPGSGKT

SEQ ID NO: 118942 - protein, 11 aa, Dengue virus
MDLHPGSGKTR

SEQ ID NO: 118943 - protein, 11 aa, Dengue virus
DLHPGSGKTRR

SEQ ID NO: 118944 - protein, 11 aa, Dengue virus
LHPGSGKTRRY

SEQ ID NO: 118945 - protein, 11 aa, Dengue virus
HPGSGKTRRYL

SEQ ID NO: 118946 - protein, 11 aa, Dengue virus
PGSGKTRRYLP

SEQ ID NO: 118947 - protein, 11 aa, Dengue virus
GSGKTRRYLPA

SEQ ID NO: 118948 - protein, 11 aa, Dengue virus
SGKTRRYLPAI

SEQ ID NO: 118949 - protein, 11 aa, Dengue virus
RYLPAIVREAI

SEQ ID NO: 118950 - protein, 11 aa, Dengue virus
YLPAIVREAIK

SEQ ID NO: 118951 - protein, 11 aa, Dengue virus
LPAIVREAIKR

SEQ ID NO: 118952 - protein, 11 aa, Dengue virus
REAIKRKLRTL

SEQ ID NO: 118953 - protein, 11 aa, Dengue virus
KRKLRTLILAP

SEQ ID NO: 118954 - protein, 11 aa, Dengue virus
RKLRTLILAPT

SEQ ID NO: 118955 - protein, 11 aa, Dengue virus
KLRTLILAPTR

SEQ ID NO: 118956 - protein, 11 aa, Dengue virus
LRTLILAPTRV

SEQ ID NO: 118957 - protein, 11 aa, Dengue virus
RTLILAPTRVV

SEQ ID NO: 118958 - protein, 11 aa, Dengue virus
TLILAPTRVVA

SEQ ID NO: 118959 - protein, 11 aa, Dengue virus
LILAPTRVVAA

SEQ ID NO: 118960 - protein, 11 aa, Dengue virus
ILAPTRVVAAE

SEQ ID NO: 118961 - protein, 11 aa, Dengue virus
LAPTRVVAAEM

SEQ ID NO: 118962 - protein, 11 aa, Dengue virus
APTRVVAAEME

SEQ ID NO: 118963 - protein, 11 aa, Dengue virus
PTRVVAAEMEE

SEQ ID NO: 118964 - protein, 11 aa, Dengue virus
TRVVAAEMEEA

SEQ ID NO: 118965 - protein, 11 aa, Dengue virus
RVVAAEMEEAL

SEQ ID NO: 118966 - protein, 11 aa, Dengue virus
VVASEMAEALK

SEQ ID NO: 118967 - protein, 11 aa, Dengue virus
VASEMAEALKG

SEQ ID NO: 118968 - protein, 11 aa, Dengue virus
ASEMAEALKGM

SEQ ID NO: 118969 - protein, 11 aa, Dengue virus
SEMAEALKGMP

SEQ ID NO: 118970 - protein, 11 aa, Dengue virus
EMAEALKGMPI

SEQ ID NO: 118971 - protein, 11 aa, Dengue virus
MAEALKGMPIR

SEQ ID NO: 118972 - protein, 11 aa, Dengue virus
AEALKGMPIRY

SEQ ID NO: 118973 - protein, 11 aa, Dengue virus
EALKGMPIRYQ

SEQ ID NO: 118974 - protein, 11 aa, Dengue virus
ALKGMPIRYQT

SEQ ID NO: 118975 - protein, 11 aa, Dengue virus
LKGMPIRYQTT

SEQ ID NO: 118976 - protein, 11 aa, Dengue virus
KGMPIRYQTTA

SEQ ID NO: 118977 - protein, 11 aa, Dengue virus
GMPIRYQTTAV

SEQ ID NO: 118978 - protein, 11 aa, Dengue virus
KSEHTGKEIVD

SEQ ID NO: 118979 - protein, 11 aa, Dengue virus
SEHTGKEIVDL

SEQ ID NO: 118980 - protein, 11 aa, Dengue virus
EHTGREIVDLM

SEQ ID NO: 118981 - protein, 11 aa, Dengue virus
HTGREIVDLMC

SEQ ID NO: 118982 - protein, 11 aa, Dengue virus
TGREIVDLMCH

SEQ ID NO: 118983 - protein, 11 aa, Dengue virus
GREIVDLMCHA

SEQ ID NO: 118984 - protein, 11 aa, Dengue virus
REIVDLMCHAT

SEQ ID NO: 118985 - protein, 11 aa, Dengue virus
EIVDLMCHATF

SEQ ID NO: 118986 - protein, 11 aa, Dengue virus
IVDLMCHATFT

SEQ ID NO: 118987 - protein, 11 aa, Dengue virus
VDLMCHATFTM

SEQ ID NO: 118988 - protein, 11 aa, Dengue virus
DLMCHATFTMR

SEQ ID NO: 118989 - protein, 11 aa, Dengue virus
LMCHATFTMRL

SEQ ID NO: 118990 - protein, 11 aa, Dengue virus
MCHATFTMRLL

SEQ ID NO: 118991 - protein, 11 aa, Dengue virus
CHATFTMRLLS

SEQ ID NO: 118992 - protein, 11 aa, Dengue virus
HATFTMRLLSP

SEQ ID NO: 118993 - protein, 11 aa, Dengue virus
ATFTMRLLSPV

SEQ ID NO: 118994 - protein, 11 aa, Dengue virus
TFTMRLLSPVR

SEQ ID NO: 118995 - protein, 11 aa, Dengue virus
FTMRLLSPVRV

SEQ ID NO: 118996 - protein, 11 aa, Dengue virus
TMRLLSPVRVP

SEQ ID NO: 118997 - protein, 11 aa, Dengue virus
MRLLSPVRVPN

SEQ ID NO: 118998 - protein, 11 aa, Dengue virus
RLLSPVRVPNY

SEQ ID NO: 118999 - protein, 11 aa, Dengue virus
LLSPVRVPNYN

SEQ ID NO: 119000 - protein, 11 aa, Dengue virus
LSPVRVPNYNL

SEQ ID NO: 119001 - protein, 11 aa, Dengue virus
SPVRVPNYNLI

SEQ ID NO: 119002 - protein, 11 aa, Dengue virus
PVRVPNYNLII

SEQ ID NO: 119003 - protein, 11 aa, Dengue virus
VRVPNYNLIIM

SEQ ID NO: 119004 - protein, 11 aa, Dengue virus
RVPNYNLIIMD

SEQ ID NO: 119005 - protein, 11 aa, Dengue virus
VPNYNLIIMDE

SEQ ID NO: 119006 - protein, 11 aa, Dengue virus
PNYNLIIMDEA

SEQ ID NO: 119007 - protein, 11 aa, Dengue virus
NYNLIIMDEAH

SEQ ID NO: 119008 - protein, 11 aa, Dengue virus
YNLIIMDEAHF

SEQ ID NO: 119009 - protein, 11 aa, Dengue virus
NLIIMDEAHFT

SEQ ID NO: 119010 - protein, 11 aa, Dengue virus
LIIMDEAHFTD

SEQ ID NO: 119011 - protein, 11 aa, Dengue virus
IIMDEAHFTDP

SEQ ID NO: 119012 - protein, 11 aa, Dengue virus
IMDEAHFTDPA

SEQ ID NO: 119013 - protein, 11 aa, Dengue virus
MDEAHFTDPAS

SEQ ID NO: 119014 - protein, 11 aa, Dengue virus
DEAHFTDPASI

SEQ ID NO: 119015 - protein, 11 aa, Dengue virus
EAHFTDPASIA

SEQ ID NO: 119016 - protein, 11 aa, Dengue virus
AHFTDPASIAA

SEQ ID NO: 119017 - protein, 11 aa, Dengue virus
HFTDPASIAAR

SEQ ID NO: 119018 - protein, 11 aa, Dengue virus
FTDPASIAARG

SEQ ID NO: 119019 - protein, 11 aa, Dengue virus
TDPASIAARGY

SEQ ID NO: 119020 - protein, 11 aa, Dengue virus
DPASIAARGYI

SEQ ID NO: 119021 - protein, 11 aa, Dengue virus
PASIAARGYIS

SEQ ID NO: 119022 - protein, 11 aa, Dengue virus
ASIAARGYIST

SEQ ID NO: 119023 - protein, 11 aa, Dengue virus
SIAARGYISTR

SEQ ID NO: 119024 - protein, 11 aa, Dengue virus
IAARGYISTRV

SEQ ID NO: 119025 - protein, 11 aa, Dengue virus
AARGYISTRVG

SEQ ID NO: 119026 - protein, 11 aa, Dengue virus
ARGYISTRVGM

SEQ ID NO: 119027 - protein, 11 aa, Dengue virus
RGYISTRVGMG

SEQ ID NO: 119028 - protein, 11 aa, Dengue virus
GYISTRVGMGE

SEQ ID NO: 119029 - protein, 11 aa, Dengue virus
YISTRVGMGEA

SEQ ID NO: 119030 - protein, 11 aa, Dengue virus
ISTRVGMGEAA

SEQ ID NO: 119031 - protein, 11 aa, Dengue virus
STRVGMGEAAA

SEQ ID NO: 119032 - protein, 11 aa, Dengue virus
TRVGMGEAAAI

SEQ ID NO: 119033 - protein, 11 aa, Dengue virus
RVGMGEAAAIF

SEQ ID NO: 119034 - protein, 11 aa, Dengue virus
VGMGEAAAIFM

SEQ ID NO: 119035 - protein, 11 aa, Dengue virus
GMGEAAAIFMT

SEQ ID NO: 119036 - protein, 11 aa, Dengue virus
MGEAAAIFMTA

SEQ ID NO: 119037 - protein, 11 aa, Dengue virus
GEAAAIFMTAT

SEQ ID NO: 119038 - protein, 11 aa, Dengue virus
EAAAIFMTATP

SEQ ID NO: 119039 - protein, 11 aa, Dengue virus
AAAIFMTATPP

SEQ ID NO: 119040 - protein, 11 aa, Dengue virus
AAIFMTATPPG

SEQ ID NO: 119041 - protein, 11 aa, Dengue virus
AIFMTATPPGS

SEQ ID NO: 119042 - protein, 11 aa, Dengue virus
IQDEERDIPER

SEQ ID NO: 119043 - protein, 11 aa, Dengue virus
QDEERDIPERS

SEQ ID NO: 119044 - protein, 11 aa, Dengue virus
DEERDIPERSW

SEQ ID NO: 119045 - protein, 11 aa, Dengue virus
EERDIPERSWN

SEQ ID NO: 119046 - protein, 11 aa, Dengue virus
ERDIPERSWNS

SEQ ID NO: 119047 - protein, 11 aa, Dengue virus
RDIPERSWNSG

SEQ ID NO: 119048 - protein, 11 aa, Dengue virus
FPGKTVWFVPS

SEQ ID NO: 119049 - protein, 11 aa, Dengue virus
PGKTVWFVPSI

SEQ ID NO: 119050 - protein, 11 aa, Dengue virus
GKTVWFVPSIK

SEQ ID NO: 119051 - protein, 11 aa, Dengue virus
KTVWFVPSIKA

SEQ ID NO: 119052 - protein, 11 aa, Dengue virus
TVWFVPSIKAG

SEQ ID NO: 119053 - protein, 11 aa, Dengue virus
VWFVPSIKAGN

SEQ ID NO: 119054 - protein, 11 aa, Dengue virus
WFVPSIKAGND

SEQ ID NO: 119055 - protein, 11 aa, Dengue virus
FVPSIKAGNDI

SEQ ID NO: 119056 - protein, 11 aa, Dengue virus
VPSIKAGNDIA

SEQ ID NO: 119057 - protein, 11 aa, Dengue virus
PSIKSGNDIAN

SEQ ID NO: 119058 - protein, 11 aa, Dengue virus
SIKSGNDIANC

SEQ ID NO: 119059 - protein, 11 aa, Dengue virus
IKSGNDIANCL

SEQ ID NO: 119060 - protein, 11 aa, Dengue virus
KSGNDIANCLR

SEQ ID NO: 119061 - protein, 11 aa, Dengue virus
SGNDIANCLRK

SEQ ID NO: 119062 - protein, 11 aa, Dengue virus
GNDIANCLRKN

SEQ ID NO: 119063 - protein, 11 aa, Dengue virus
NDIANCLRKNG

SEQ ID NO: 119064 - protein, 11 aa, Dengue virus
DIANCLRKNGK

SEQ ID NO: 119065 - protein, 11 aa, Dengue virus
IANCLRKNGKR

SEQ ID NO: 119066 - protein, 11 aa, Dengue virus
ANCLRKNGKRV

SEQ ID NO: 119067 - protein, 11 aa, Dengue virus
CLRKNGKKVIQ

SEQ ID NO: 119068 - protein, 11 aa, Dengue virus
LRKNGKKVIQL

SEQ ID NO: 119069 - protein, 11 aa, Dengue virus
RKNGKKVIQLS

SEQ ID NO: 119070 - protein, 11 aa, Dengue virus
KNGKKVIQLSR

SEQ ID NO: 119071 - protein, 11 aa, Dengue virus
NGKKVIQLSRK

SEQ ID NO: 119072 - protein, 11 aa, Dengue virus
GKKVIQLSRKT

SEQ ID NO: 119073 - protein, 11 aa, Dengue virus
KKVIQLSRKTF

SEQ ID NO: 119074 - protein, 11 aa, Dengue virus
KVIQLSRKTFD

SEQ ID NO: 119075 - protein, 11 aa, Dengue virus
VIQLSRKTFDT

SEQ ID NO: 119076 - protein, 11 aa, Dengue virus
IQLSRKTFDTE

SEQ ID NO: 119077 - protein, 11 aa, Dengue virus
QLSRKTFDTEY

SEQ ID NO: 119078 - protein, 11 aa, Dengue virus
LSRKTFDTEYQ

SEQ ID NO: 119079 - protein, 11 aa, Dengue virus
SRKTFDTEYQK

SEQ ID NO: 119080 - protein, 11 aa, Dengue virus
NNDWDYVVTTD

SEQ ID NO: 119081 - protein, 11 aa, Dengue virus
NDWDFVVTTDI

SEQ ID NO: 119082 - protein, 11 aa, Dengue virus
DWDFVVTTDIS

SEQ ID NO: 119083 - protein, 11 aa, Dengue virus
WDFVVTTDISE

SEQ ID NO: 119084 - protein, 11 aa, Dengue virus
DFVVTTDISEM

SEQ ID NO: 119085 - protein, 11 aa, Dengue virus
FVVTTDISEMG

SEQ ID NO: 119086 - protein, 11 aa, Dengue virus
VVTTDISEMGA

SEQ ID NO: 119087 - protein, 11 aa, Dengue virus
VTTDISEMGAN

SEQ ID NO: 119088 - protein, 11 aa, Dengue virus
TTDISEMGANF

SEQ ID NO: 119089 - protein, 11 aa, Dengue virus
TDISEMGANFR

SEQ ID NO: 119090 - protein, 11 aa, Dengue virus
DISEMGANFRA

SEQ ID NO: 119091 - protein, 11 aa, Dengue virus
ISEMGANFRAD

SEQ ID NO: 119092 - protein, 11 aa, Dengue virus
SEMGANFRADR

SEQ ID NO: 119093 - protein, 11 aa, Dengue virus
EMGANFRADRV

SEQ ID NO: 119094 - protein, 11 aa, Dengue virus
MGANFRADRVI

SEQ ID NO: 119095 - protein, 11 aa, Dengue virus
GANFRADRVID

SEQ ID NO: 119096 - protein, 11 aa, Dengue virus
ANFRADRVIDP

SEQ ID NO: 119097 - protein, 11 aa, Dengue virus
NFRADRVIDPR

SEQ ID NO: 119098 - protein, 11 aa, Dengue virus
FRADRVIDPRR

SEQ ID NO: 119099 - protein, 11 aa, Dengue virus
RADRVIDPRRC

SEQ ID NO: 119100 - protein, 11 aa, Dengue virus
ADRVIDPRRCL

SEQ ID NO: 119101 - protein, 11 aa, Dengue virus
DRVIDPRRCLK

SEQ ID NO: 119102 - protein, 11 aa, Dengue virus
RVIDPRRCLKP

SEQ ID NO: 119103 - protein, 11 aa, Dengue virus
VIDPRRCLKPV

SEQ ID NO: 119104 - protein, 11 aa, Dengue virus
IDPRRCLKPVI

SEQ ID NO: 119105 - protein, 11 aa, Dengue virus
DPRRCLKPVIL

SEQ ID NO: 119106 - protein, 11 aa, Dengue virus
PRRCLKPVILK

SEQ ID NO: 119107 - protein, 11 aa, Dengue virus
RRCLKPVILKD

SEQ ID NO: 119108 - protein, 11 aa, Dengue virus
RCLKPVILKDG

SEQ ID NO: 119109 - protein, 11 aa, Dengue virus
CLKPVILKDGP

SEQ ID NO: 119110 - protein, 11 aa, Dengue virus
LKPVILKDGPE

SEQ ID NO: 119111 - protein, 11 aa, Dengue virus
KPVILKDGPER

SEQ ID NO: 119112 - protein, 11 aa, Dengue virus
PVILKDGPERV

SEQ ID NO: 119113 - protein, 11 aa, Dengue virus
VILKDGPERVI

SEQ ID NO: 119114 - protein, 11 aa, Dengue virus
ILKDGPERVIL

SEQ ID NO: 119115 - protein, 11 aa, Dengue virus
LKDGPERVILA

SEQ ID NO: 119116 - protein, 11 aa, Dengue virus
KDGPERVILAG

SEQ ID NO: 119117 - protein, 11 aa, Dengue virus
DGPERVILAGP

SEQ ID NO: 119118 - protein, 11 aa, Dengue virus
GPERVILAGPM

SEQ ID NO: 119119 - protein, 11 aa, Dengue virus
PERVILAGPMP

SEQ ID NO: 119120 - protein, 11 aa, Dengue virus
ERVILAGPMPV

SEQ ID NO: 119121 - protein, 11 aa, Dengue virus
RVILAGPMPVT

SEQ ID NO: 119122 - protein, 11 aa, Dengue virus
VILAGPMPVTV

SEQ ID NO: 119123 - protein, 11 aa, Dengue virus
ILAGPMPVTVA

SEQ ID NO: 119124 - protein, 11 aa, Dengue virus
LAGPMPVTVAS

SEQ ID NO: 119125 - protein, 11 aa, Dengue virus
AGPMPVTVASA

SEQ ID NO: 119126 - protein, 11 aa, Dengue virus
GPMPVTVASAA

SEQ ID NO: 119127 - protein, 11 aa, Dengue virus
PMPVTVASAAQ

SEQ ID NO: 119128 - protein, 11 aa, Dengue virus
MPVTVASAAQR

SEQ ID NO: 119129 - protein, 11 aa, Dengue virus
PVTVASAAQRR

SEQ ID NO: 119130 - protein, 11 aa, Dengue virus
VTVASAAQRRG

SEQ ID NO: 119131 - protein, 11 aa, Dengue virus
TVASAAQRRGR

SEQ ID NO: 119132 - protein, 11 aa, Dengue virus
ASAAQRRGRIG

SEQ ID NO: 119133 - protein, 11 aa, Dengue virus
SAAQRRGRIGR

SEQ ID NO: 119134 - protein, 11 aa, Dengue virus
AAQRRGRIGRN

SEQ ID NO: 119135 - protein, 11 aa, Dengue virus
AQRRGRIGRNP

SEQ ID NO: 119136 - protein, 11 aa, Dengue virus
KEGDQYIYMGQ

SEQ ID NO: 119137 - protein, 11 aa, Dengue virus
EGDQYIYMGQP

SEQ ID NO: 119138 - protein, 11 aa, Dengue virus
GDQYIYMGQPL

SEQ ID NO: 119139 - protein, 11 aa, Dengue virus
YMGQPLNNDED

SEQ ID NO: 119140 - protein, 11 aa, Dengue virus
MGQPLNNDEDH

SEQ ID NO: 119141 - protein, 11 aa, Dengue virus
GQPLNNDEDHA

SEQ ID NO: 119142 - protein, 11 aa, Dengue virus
QPLNNDEDHAH

SEQ ID NO: 119143 - protein, 11 aa, Dengue virus
PLNNDEDHAHW

SEQ ID NO: 119144 - protein, 11 aa, Dengue virus
LNNDEDHAHWT

SEQ ID NO: 119145 - protein, 11 aa, Dengue virus
NNDEDHAHWTE

SEQ ID NO: 119146 - protein, 11 aa, Dengue virus
NDEDHAHWTEA

SEQ ID NO: 119147 - protein, 11 aa, Dengue virus
DEDHAHWTEAK

SEQ ID NO: 119148 - protein, 11 aa, Dengue virus
EDHAHWTEAKM

SEQ ID NO: 119149 - protein, 11 aa, Dengue virus
DHAHWTEAKML

SEQ ID NO: 119150 - protein, 11 aa, Dengue virus
HAHWTEAKMLL

SEQ ID NO: 119151 - protein, 11 aa, Dengue virus
AHWTEAKMLLD

SEQ ID NO: 119152 - protein, 11 aa, Dengue virus
HWTEAKMLLDN

SEQ ID NO: 119153 - protein, 11 aa, Dengue virus
WTEAKMLLDNI

SEQ ID NO: 119154 - protein, 11 aa, Dengue virus
TEAKMLLDNIN

SEQ ID NO: 119155 - protein, 11 aa, Dengue virus
EAKMLLDNINT

SEQ ID NO: 119156 - protein, 11 aa, Dengue virus
AKMLLDNINTP

SEQ ID NO: 119157 - protein, 11 aa, Dengue virus
KMLLDNINTPE

SEQ ID NO: 119158 - protein, 11 aa, Dengue virus
MLLDNINTPEG

SEQ ID NO: 119159 - protein, 11 aa, Dengue virus
LLDNINTPEGI

SEQ ID NO: 119160 - protein, 11 aa, Dengue virus
LDNINTPEGII

SEQ ID NO: 119161 - protein, 11 aa, Dengue virus
DNINTPEGIIP

SEQ ID NO: 119162 - protein, 11 aa, Dengue virus
NINTPEGIIPA

SEQ ID NO: 119163 - protein, 11 aa, Dengue virus
INTPEGIIPAL

SEQ ID NO: 119164 - protein, 11 aa, Dengue virus
NTPEGIIPALF

SEQ ID NO: 119165 - protein, 11 aa, Dengue virus
TPEGIIPALFE

SEQ ID NO: 119166 - protein, 11 aa, Dengue virus
PEGIIPALFEP

SEQ ID NO: 119167 - protein, 11 aa, Dengue virus
EGIIPALFEPE

SEQ ID NO: 119168 - protein, 11 aa, Dengue virus
GIIPALFEPER

SEQ ID NO: 119169 - protein, 11 aa, Dengue virus
IIPALFEPERE

SEQ ID NO: 119170 - protein, 11 aa, Dengue virus
IPALFEPEREK

SEQ ID NO: 119171 - protein, 11 aa, Dengue virus
PALFEPEREKS

SEQ ID NO: 119172 - protein, 11 aa, Dengue virus
ALFEPEREKSA

SEQ ID NO: 119173 - protein, 11 aa, Dengue virus
LFEPEREKSAA

SEQ ID NO: 119174 - protein, 11 aa, Dengue virus
FEPEREKSAAI

SEQ ID NO: 119175 - protein, 11 aa, Dengue virus
EPEREKSAAID

SEQ ID NO: 119176 - protein, 11 aa, Dengue virus
PEREKSAAIDG

SEQ ID NO: 119177 - protein, 11 aa, Dengue virus
EREKSAAIDGE

SEQ ID NO: 119178 - protein, 11 aa, Dengue virus
REKSAAIDGEY

SEQ ID NO: 119179 - protein, 11 aa, Dengue virus
EKSAAIDGEYR

SEQ ID NO: 119180 - protein, 11 aa, Dengue virus
KSAAIDGEYRL

SEQ ID NO: 119181 - protein, 11 aa, Dengue virus
SAAIDGEYRLR

SEQ ID NO: 119182 - protein, 11 aa, Dengue virus
AAIDGEYRLRG

SEQ ID NO: 119183 - protein, 11 aa, Dengue virus
AIDGEYRLRGE

SEQ ID NO: 119184 - protein, 11 aa, Dengue virus
IDGEYRLRGEA

SEQ ID NO: 119185 - protein, 11 aa, Dengue virus
DGEYRLRGEAR

SEQ ID NO: 119186 - protein, 11 aa, Dengue virus
GEYRLRGEARK

SEQ ID NO: 119187 - protein, 11 aa, Dengue virus
EYRLRGEARKT

SEQ ID NO: 119188 - protein, 11 aa, Dengue virus
YRLRGEARKTF

SEQ ID NO: 119189 - protein, 11 aa, Dengue virus
RLRGEARKTFV

SEQ ID NO: 119190 - protein, 11 aa, Dengue virus
LRGEARKTFVE

SEQ ID NO: 119191 - protein, 11 aa, Dengue virus
RGEARKTFVEL

SEQ ID NO: 119192 - protein, 11 aa, Dengue virus
GEARKTFVELM

SEQ ID NO: 119193 - protein, 11 aa, Dengue virus
EARKTFVELMR

SEQ ID NO: 119194 - protein, 11 aa, Dengue virus
ARKTFVELMRR

SEQ ID NO: 119195 - protein, 11 aa, Dengue virus
RKTFVELMRRG

SEQ ID NO: 119196 - protein, 11 aa, Dengue virus
KTFVELMRRGD

SEQ ID NO: 119197 - protein, 11 aa, Dengue virus
TFVELMRRGDL

SEQ ID NO: 119198 - protein, 11 aa, Dengue virus
FVELMRRGDLP

SEQ ID NO: 119199 - protein, 11 aa, Dengue virus
VELMRRGDLPV

SEQ ID NO: 119200 - protein, 11 aa, Dengue virus
ELMRRGDLPVW

SEQ ID NO: 119201 - protein, 11 aa, Dengue virus
LMRRGDLPVWL

SEQ ID NO: 119202 - protein, 11 aa, Dengue virus
MRRGDLPVWLA

SEQ ID NO: 119203 - protein, 11 aa, Dengue virus
RRGDLPVWLSY

SEQ ID NO: 119204 - protein, 11 aa, Dengue virus
RGDLPVWLSYK

SEQ ID NO: 119205 - protein, 11 aa, Dengue virus
GDLPVWLSYKV

SEQ ID NO: 119206 - protein, 11 aa, Dengue virus
DLPVWLSYKVA

SEQ ID NO: 119207 - protein, 11 aa, Dengue virus
LPVWLSYKVAS

SEQ ID NO: 119208 - protein, 11 aa, Dengue virus
NNQVLEENMDV

SEQ ID NO: 119209 - protein, 11 aa, Dengue virus
NQVLEENMDVE

SEQ ID NO: 119210 - protein, 11 aa, Dengue virus
QVLEENMDVEI

SEQ ID NO: 119211 - protein, 11 aa, Dengue virus
VLEENMDVEIW

SEQ ID NO: 119212 - protein, 11 aa, Dengue virus
LEENMDVEIWT

SEQ ID NO: 119213 - protein, 11 aa, Dengue virus
EENMDVEIWTK

SEQ ID NO: 119214 - protein, 11 aa, Dengue virus
ENMDVEIWTKE

SEQ ID NO: 119215 - protein, 11 aa, Dengue virus
NMDVEIWTKEG

SEQ ID NO: 119216 - protein, 11 aa, Dengue virus
ERKKLRPRWLD

SEQ ID NO: 119217 - protein, 11 aa, Dengue virus
RKKLRPRWLDA

SEQ ID NO: 119218 - protein, 11 aa, Dengue virus
KKLRPRWLDAR

SEQ ID NO: 119219 - protein, 11 aa, Dengue virus
KLRPRWLDART

SEQ ID NO: 119220 - protein, 11 aa, Dengue virus
LRPRWLDARTY

SEQ ID NO: 119221 - protein, 11 aa, Dengue virus
RPRWLDARTYS

SEQ ID NO: 119222 - protein, 11 aa, Dengue virus
PRWLDARTYSD

SEQ ID NO: 119223 - protein, 11 aa, Dengue virus
RWLDARTYSDP

SEQ ID NO: 119224 - protein, 11 aa, Dengue virus
WLDARTYSDPL

SEQ ID NO: 119225 - protein, 11 aa, Dengue virus
LDARTYSDPLA

SEQ ID NO: 119226 - protein, 11 aa, Dengue virus
DARTYSDPLAL

SEQ ID NO: 119227 - protein, 11 aa, Dengue virus
ARTYSDPLALR

SEQ ID NO: 119228 - protein, 11 aa, Dengue virus
RTYSDPLALRE

SEQ ID NO: 119229 - protein, 11 aa, Dengue virus
TYSDPLALREF

SEQ ID NO: 119230 - protein, 11 aa, Dengue virus
YSDPLALKEFK

SEQ ID NO: 119231 - protein, 11 aa, Dengue virus
SDPLALREFKE

SEQ ID NO: 119232 - protein, 11 aa, Dengue virus
DPLALREFKEF

SEQ ID NO: 119233 - protein, 11 aa, Dengue virus
PLALREFKEFA

SEQ ID NO: 119234 - protein, 11 aa, Dengue virus
LALREFKEFAA

SEQ ID NO: 119235 - protein, 11 aa, Dengue virus
ALREFKEFAAG

SEQ ID NO: 119236 - protein, 11 aa, Dengue virus
LREFKEFAAGR

SEQ ID NO: 119237 - protein, 11 aa, Dengue virus
REFKEFAAGRR

SEQ ID NO: 119238 - protein, 11 aa, Dengue virus
EFKEFAAGRRS

SEQ ID NO: 119239 - protein, 11 aa, Dengue virus
FKEFAAGRRSV

SEQ ID NO: 119240 - protein, 11 aa, Dengue virus
QNALDNLVMLH

SEQ ID NO: 119241 - protein, 11 aa, Dengue virus
ALDNLVMLHNS

SEQ ID NO: 119242 - protein, 11 aa, Dengue virus
LDNLVMLHNSE

SEQ ID NO: 119243 - protein, 11 aa, Dengue virus
AYRHAMEELPD

SEQ ID NO: 119244 - protein, 11 aa, Dengue virus
YRHAMEELPDT

SEQ ID NO: 119245 - protein, 11 aa, Dengue virus
RHAMEELPDTI

SEQ ID NO: 119246 - protein, 11 aa, Dengue virus
HAMEELPDTIE

SEQ ID NO: 119247 - protein, 11 aa, Dengue virus
AMEELPDTIET

SEQ ID NO: 119248 - protein, 11 aa, Dengue virus
MEELPDTIETL

SEQ ID NO: 119249 - protein, 11 aa, Dengue virus
EELPDTIETLM

SEQ ID NO: 119250 - protein, 11 aa, Dengue virus
ELPDTIETLML

SEQ ID NO: 119251 - protein, 11 aa, Dengue virus
LPDTIETLMLL

SEQ ID NO: 119252 - protein, 11 aa, Dengue virus
PDTIETLMLLA

SEQ ID NO: 119253 - protein, 11 aa, Dengue virus
DTIETLMLLAL

SEQ ID NO: 119254 - protein, 11 aa, Dengue virus
TIETLMLLALI

SEQ ID NO: 119255 - protein, 11 aa, Dengue virus
IETLMLLALIA

SEQ ID NO: 119256 - protein, 11 aa, Dengue virus
VEPHWIAASII

SEQ ID NO: 119257 - protein, 11 aa, Dengue virus
EPHWIAASIIL

SEQ ID NO: 119258 - protein, 11 aa, Dengue virus
PHWIAASIILE

SEQ ID NO: 119259 - protein, 11 aa, Dengue virus
HWIAASIILEF

SEQ ID NO: 119260 - protein, 11 aa, Dengue virus
WIAASIILEFF

SEQ ID NO: 119261 - protein, 11 aa, Dengue virus
IAASIILEFFL

SEQ ID NO: 119262 - protein, 11 aa, Dengue virus
AASIILEFFLM

SEQ ID NO: 119263 - protein, 11 aa, Dengue virus
ASIILEFFLMV

SEQ ID NO: 119264 - protein, 11 aa, Dengue virus
SIILEFFLMVL

SEQ ID NO: 119265 - protein, 11 aa, Dengue virus
IILEFFLMVLL

SEQ ID NO: 119266 - protein, 11 aa, Dengue virus
ILEFFLMVLLI

SEQ ID NO: 119267 - protein, 11 aa, Dengue virus
LEFFLMVLLIP

SEQ ID NO: 119268 - protein, 11 aa, Dengue virus
EFFLMVLLIPE

SEQ ID NO: 119269 - protein, 11 aa, Dengue virus
FFLMVLLIPEP

SEQ ID NO: 119270 - protein, 11 aa, Dengue virus
FLMVLLIPEPD

SEQ ID NO: 119271 - protein, 11 aa, Dengue virus
LMVLLIPEPDR

SEQ ID NO: 119272 - protein, 11 aa, Dengue virus
MVLLIPEPDRQ

SEQ ID NO: 119273 - protein, 11 aa, Dengue virus
VLLIPEPEKQR

SEQ ID NO: 119274 - protein, 11 aa, Dengue virus
LLIPEPEKQRT

SEQ ID NO: 119275 - protein, 11 aa, Dengue virus
LIPEPEKQRTP

SEQ ID NO: 119276 - protein, 11 aa, Dengue virus
IPEPEKQRTPQ

SEQ ID NO: 119277 - protein, 11 aa, Dengue virus
PEPEKQRTPQD

SEQ ID NO: 119278 - protein, 11 aa, Dengue virus
EPEKQRTPQDN

SEQ ID NO: 119279 - protein, 11 aa, Dengue virus
PEKQRTPQDNQ

SEQ ID NO: 119280 - protein, 11 aa, Dengue virus
EKQRTPQDNQL

SEQ ID NO: 119281 - protein, 11 aa, Dengue virus
RQRTPQDNQLA

SEQ ID NO: 119282 - protein, 11 aa, Dengue virus
QRTPQDNQLAY

SEQ ID NO: 119283 - protein, 11 aa, Dengue virus
RTPQDNQLAYV

SEQ ID NO: 119284 - protein, 11 aa, Dengue virus
TPQDNQLAYVV

SEQ ID NO: 119285 - protein, 11 aa, Dengue virus
PQDNQLAYVVI

SEQ ID NO: 119286 - protein, 11 aa, Dengue virus
QDNQLAYVVIG

SEQ ID NO: 119287 - protein, 11 aa, Dengue virus
DNQLAYVVIGL

SEQ ID NO: 119288 - protein, 11 aa, Dengue virus
NQLAYVVIGLL

SEQ ID NO: 119289 - protein, 11 aa, Dengue virus
QLAYVVIGLLF

SEQ ID NO: 119290 - protein, 11 aa, Dengue virus
VAANEMGLLET

SEQ ID NO: 119291 - protein, 11 aa, Dengue virus
AANEMGLLETT

SEQ ID NO: 119292 - protein, 11 aa, Dengue virus
ANEMGLLETTK

SEQ ID NO: 119293 - protein, 11 aa, Dengue virus
NEMGLLETTKK

SEQ ID NO: 119294 - protein, 11 aa, Dengue virus
EMGLLETTKKD

SEQ ID NO: 119295 - protein, 11 aa, Dengue virus
MGLLETTKKDL

SEQ ID NO: 119296 - protein, 11 aa, Dengue virus
GLLETTKKDLG

SEQ ID NO: 119297 - protein, 11 aa, Dengue virus
LDVDLHPASAW

SEQ ID NO: 119298 - protein, 11 aa, Dengue virus
DVDLHPASAWT

SEQ ID NO: 119299 - protein, 11 aa, Dengue virus
VDLHPASAWTL

SEQ ID NO: 119300 - protein, 11 aa, Dengue virus
DLHPASAWTLY

SEQ ID NO: 119301 - protein, 11 aa, Dengue virus
LHPASAWTLYA

SEQ ID NO: 119302 - protein, 11 aa, Dengue virus
HPASAWTLYAV

SEQ ID NO: 119303 - protein, 11 aa, Dengue virus
PASAWTLYAVA

SEQ ID NO: 119304 - protein, 11 aa, Dengue virus
ASAWTLYAVAT

SEQ ID NO: 119305 - protein, 11 aa, Dengue virus
SAWTLYAVATT

SEQ ID NO: 119306 - protein, 11 aa, Dengue virus
AWTLYAVATTI

SEQ ID NO: 119307 - protein, 11 aa, Dengue virus
WTLYAVATTII

SEQ ID NO: 119308 - protein, 11 aa, Dengue virus
TLYAVATTIIT

SEQ ID NO: 119309 - protein, 11 aa, Dengue virus
LYAVATTIITP

SEQ ID NO: 119310 - protein, 11 aa, Dengue virus
YAVATTIITPM

SEQ ID NO: 119311 - protein, 11 aa, Dengue virus
ITPMMRHTIEN

SEQ ID NO: 119312 - protein, 11 aa, Dengue virus
TPMMRHTIENT

SEQ ID NO: 119313 - protein, 11 aa, Dengue virus
PMMRHTIENTT

SEQ ID NO: 119314 - protein, 11 aa, Dengue virus
MMRHTIENTTA

SEQ ID NO: 119315 - protein, 11 aa, Dengue virus
MRHTIENTTAN

SEQ ID NO: 119316 - protein, 11 aa, Dengue virus
RHTIENTTANI

SEQ ID NO: 119317 - protein, 11 aa, Dengue virus
HTIENTTANIS

SEQ ID NO: 119318 - protein, 11 aa, Dengue virus
TIENTTANISL

SEQ ID NO: 119319 - protein, 11 aa, Dengue virus
IENTTANISLT

SEQ ID NO: 119320 - protein, 11 aa, Dengue virus
ENTTANISLTA

SEQ ID NO: 119321 - protein, 11 aa, Dengue virus
NTTANISLTAI

SEQ ID NO: 119322 - protein, 11 aa, Dengue virus
TTANISLTAIA

SEQ ID NO: 119323 - protein, 11 aa, Dengue virus
TANISLTAIAN

SEQ ID NO: 119324 - protein, 11 aa, Dengue virus
ANISLTAIANQ

SEQ ID NO: 119325 - protein, 11 aa, Dengue virus
NISLTAIANQA

SEQ ID NO: 119326 - protein, 11 aa, Dengue virus
ISLTAIANQAA

SEQ ID NO: 119327 - protein, 11 aa, Dengue virus
SLTAIANQAAI

SEQ ID NO: 119328 - protein, 11 aa, Dengue virus
LTAIANQAAIL

SEQ ID NO: 119329 - protein, 11 aa, Dengue virus
TAIANQAAILM

SEQ ID NO: 119330 - protein, 11 aa, Dengue virus
AIANQAAILMG

SEQ ID NO: 119331 - protein, 11 aa, Dengue virus
IANQAAILMGL

SEQ ID NO: 119332 - protein, 11 aa, Dengue virus
ANQAAILMGLD

SEQ ID NO: 119333 - protein, 11 aa, Dengue virus
NQAAILMGLDK

SEQ ID NO: 119334 - protein, 11 aa, Dengue virus
QAAILMGLDKG

SEQ ID NO: 119335 - protein, 11 aa, Dengue virus
AAILMGLDKGW

SEQ ID NO: 119336 - protein, 11 aa, Dengue virus
AILMGLDKGWP

SEQ ID NO: 119337 - protein, 11 aa, Dengue virus
ILMGLDKGWPI

SEQ ID NO: 119338 - protein, 11 aa, Dengue virus
LMGLDKGWPIS

SEQ ID NO: 119339 - protein, 11 aa, Dengue virus
MGLDKGWPISK

SEQ ID NO: 119340 - protein, 11 aa, Dengue virus
GLDKGWPISKM

SEQ ID NO: 119341 - protein, 11 aa, Dengue virus
LDKGWPISKMD

SEQ ID NO: 119342 - protein, 11 aa, Dengue virus
DKGWPISKMDI

SEQ ID NO: 119343 - protein, 11 aa, Dengue virus
KGWPISKMDIG

SEQ ID NO: 119344 - protein, 11 aa, Dengue virus
GWPISKMDIGV

SEQ ID NO: 119345 - protein, 11 aa, Dengue virus
WPISKMDIGVP

SEQ ID NO: 119346 - protein, 11 aa, Dengue virus
PISKMDIGVPL

SEQ ID NO: 119347 - protein, 11 aa, Dengue virus
ISKMDIGVPLL

SEQ ID NO: 119348 - protein, 11 aa, Dengue virus
SKMDIGVPLLA

SEQ ID NO: 119349 - protein, 11 aa, Dengue virus
KMDIGVPLLAL

SEQ ID NO: 119350 - protein, 11 aa, Dengue virus
MDIGVPLLALG

SEQ ID NO: 119351 - protein, 11 aa, Dengue virus
DIGVPLLALGC

SEQ ID NO: 119352 - protein, 11 aa, Dengue virus
IGVPLLALGCY

SEQ ID NO: 119353 - protein, 11 aa, Dengue virus
GVPLLALGCYS

SEQ ID NO: 119354 - protein, 11 aa, Dengue virus
VPLLALGCYSQ

SEQ ID NO: 119355 - protein, 11 aa, Dengue virus
PLLALGCYSQV

SEQ ID NO: 119356 - protein, 11 aa, Dengue virus
LLALGCYSQVN

SEQ ID NO: 119357 - protein, 11 aa, Dengue virus
LALGCYSQVNP

SEQ ID NO: 119358 - protein, 11 aa, Dengue virus
ALGCYSQVNPL

SEQ ID NO: 119359 - protein, 11 aa, Dengue virus
LGCYSQVNPLT

SEQ ID NO: 119360 - protein, 11 aa, Dengue virus
GCYSQVNPLTL

SEQ ID NO: 119361 - protein, 11 aa, Dengue virus
CYSQVNPLTLT

SEQ ID NO: 119362 - protein, 11 aa, Dengue virus
YSQVNPLTLTA

SEQ ID NO: 119363 - protein, 11 aa, Dengue virus
SQVNPLTLTAA

SEQ ID NO: 119364 - protein, 11 aa, Dengue virus
QVNPLTLTAAV

SEQ ID NO: 119365 - protein, 11 aa, Dengue virus
AHYAIIGPGLQ

SEQ ID NO: 119366 - protein, 11 aa, Dengue virus
HYAIIGPGLQA

SEQ ID NO: 119367 - protein, 11 aa, Dengue virus
YAIIGPGLQAK

SEQ ID NO: 119368 - protein, 11 aa, Dengue virus
AIIGPGLQAKA

SEQ ID NO: 119369 - protein, 11 aa, Dengue virus
IIGPGLQAKAT

SEQ ID NO: 119370 - protein, 11 aa, Dengue virus
IGPGLQAKATR

SEQ ID NO: 119371 - protein, 11 aa, Dengue virus
GPGLQAKATRE

SEQ ID NO: 119372 - protein, 11 aa, Dengue virus
PGLQAKATREA

SEQ ID NO: 119373 - protein, 11 aa, Dengue virus
GLQAKATREAQ

SEQ ID NO: 119374 - protein, 11 aa, Dengue virus
LQAKATREAQK

SEQ ID NO: 119375 - protein, 11 aa, Dengue virus
QAKATREAQKR

SEQ ID NO: 119376 - protein, 11 aa, Dengue virus
AKATREAQKRT

SEQ ID NO: 119377 - protein, 11 aa, Dengue virus
KATREAQKRTA

SEQ ID NO: 119378 - protein, 11 aa, Dengue virus
ATREAQKRTAA

SEQ ID NO: 119379 - protein, 11 aa, Dengue virus
TREAQKRTAAG

SEQ ID NO: 119380 - protein, 11 aa, Dengue virus
REAQKRTAAGI

SEQ ID NO: 119381 - protein, 11 aa, Dengue virus
EAQKRTAAGIM

SEQ ID NO: 119382 - protein, 11 aa, Dengue virus
AQKRTAAGIMK

SEQ ID NO: 119383 - protein, 11 aa, Dengue virus
QKRTAAGIMKN

SEQ ID NO: 119384 - protein, 11 aa, Dengue virus
KRTAAGIMKNP

SEQ ID NO: 119385 - protein, 11 aa, Dengue virus
RTAAGIMKNPT

SEQ ID NO: 119386 - protein, 11 aa, Dengue virus
TAAGIMKNPTV

SEQ ID NO: 119387 - protein, 11 aa, Dengue virus
AAGIMKNPTVD

SEQ ID NO: 119388 - protein, 11 aa, Dengue virus
AGIMKNPTVDG

SEQ ID NO: 119389 - protein, 11 aa, Dengue virus
GIMKNPTVDGI

SEQ ID NO: 119390 - protein, 11 aa, Dengue virus
IMKNPTVDGIV

SEQ ID NO: 119391 - protein, 11 aa, Dengue virus
KNPTVDGIVAI

SEQ ID NO: 119392 - protein, 11 aa, Dengue virus
PVVYDAKFEKQ

SEQ ID NO: 119393 - protein, 11 aa, Dengue virus
VVYDAKFEKQL

SEQ ID NO: 119394 - protein, 11 aa, Dengue virus
VYDAKFEKQLG

SEQ ID NO: 119395 - protein, 11 aa, Dengue virus
YDAKFEKQLGQ

SEQ ID NO: 119396 - protein, 11 aa, Dengue virus
DAKFEKQLGQI

SEQ ID NO: 119397 - protein, 11 aa, Dengue virus
AKFEKQLGQIM

SEQ ID NO: 119398 - protein, 11 aa, Dengue virus
KFEKQLGQVML

SEQ ID NO: 119399 - protein, 11 aa, Dengue virus
FEKQLGQVMLL

SEQ ID NO: 119400 - protein, 11 aa, Dengue virus
EKQLGQIMLLI

SEQ ID NO: 119401 - protein, 11 aa, Dengue virus
KQLGQIMLLIL

SEQ ID NO: 119402 - protein, 11 aa, Dengue virus
QLGQIMLLILC

SEQ ID NO: 119403 - protein, 11 aa, Dengue virus
LGQIMLLILCT

SEQ ID NO: 119404 - protein, 11 aa, Dengue virus
LCTSQILLMRT

SEQ ID NO: 119405 - protein, 11 aa, Dengue virus
CTSQILLMRTT

SEQ ID NO: 119406 - protein, 11 aa, Dengue virus
TSQILLMRTTW

SEQ ID NO: 119407 - protein, 11 aa, Dengue virus
SQILLMRTTWA

SEQ ID NO: 119408 - protein, 11 aa, Dengue virus
QILLMRTTWAL

SEQ ID NO: 119409 - protein, 11 aa, Dengue virus
ILLMRTTWALC

SEQ ID NO: 119410 - protein, 11 aa, Dengue virus
LLMRTTWALCE

SEQ ID NO: 119411 - protein, 11 aa, Dengue virus
LMRTTWALCES

SEQ ID NO: 119412 - protein, 11 aa, Dengue virus
MRTTWALCESI

SEQ ID NO: 119413 - protein, 11 aa, Dengue virus
RTTWALCESIT

SEQ ID NO: 119414 - protein, 11 aa, Dengue virus
TTWALCESITL

SEQ ID NO: 119415 - protein, 11 aa, Dengue virus
TWALCESITLA

SEQ ID NO: 119416 - protein, 11 aa, Dengue virus
WALCEALTLAT

SEQ ID NO: 119417 - protein, 11 aa, Dengue virus
ALCEALTLATG

SEQ ID NO: 119418 - protein, 11 aa, Dengue virus
LCEALTLATGP

SEQ ID NO: 119419 - protein, 11 aa, Dengue virus
CEALTLATGPI

SEQ ID NO: 119420 - protein, 11 aa, Dengue virus
ITLATGPLTTL

SEQ ID NO: 119421 - protein, 11 aa, Dengue virus
TLATGPLTTLW

SEQ ID NO: 119422 - protein, 11 aa, Dengue virus
LATGPLTTLWE

SEQ ID NO: 119423 - protein, 11 aa, Dengue virus
ATGPLTTLWEG

SEQ ID NO: 119424 - protein, 11 aa, Dengue virus
TGPLTTLWEGS

SEQ ID NO: 119425 - protein, 11 aa, Dengue virus
GPLTTLWEGSP

SEQ ID NO: 119426 - protein, 11 aa, Dengue virus
PLTTLWEGSPG

SEQ ID NO: 119427 - protein, 11 aa, Dengue virus
TTLWEGSPGKF

SEQ ID NO: 119428 - protein, 11 aa, Dengue virus
TLWEGSPGKFW

SEQ ID NO: 119429 - protein, 11 aa, Dengue virus
LWEGSPGKFWN

SEQ ID NO: 119430 - protein, 11 aa, Dengue virus
WEGSPGKFWNT

SEQ ID NO: 119431 - protein, 11 aa, Dengue virus
EGSPGKFWNTT

SEQ ID NO: 119432 - protein, 11 aa, Dengue virus
GSPGKFWNTTI

SEQ ID NO: 119433 - protein, 11 aa, Dengue virus
SPGKFWNTTIA

SEQ ID NO: 119434 - protein, 11 aa, Dengue virus
PGKFWNTTIAV

SEQ ID NO: 119435 - protein, 11 aa, Dengue virus
GKFWNTTIAVS

SEQ ID NO: 119436 - protein, 11 aa, Dengue virus
KFWNTTIAVSM

SEQ ID NO: 119437 - protein, 11 aa, Dengue virus
FWNTTIAVSMA

SEQ ID NO: 119438 - protein, 11 aa, Dengue virus
WNTTIAVSMAN

SEQ ID NO: 119439 - protein, 11 aa, Dengue virus
NTTIAVSMANI

SEQ ID NO: 119440 - protein, 11 aa, Dengue virus
TTIAVSMANIF

SEQ ID NO: 119441 - protein, 11 aa, Dengue virus
TIAVSMANIFR

SEQ ID NO: 119442 - protein, 11 aa, Dengue virus
IAVSMANIFRG

SEQ ID NO: 119443 - protein, 11 aa, Dengue virus
AVSMANIFRGS

SEQ ID NO: 119444 - protein, 11 aa, Dengue virus
VSMANIFRGSY

SEQ ID NO: 119445 - protein, 11 aa, Dengue virus
SMANIFRGSYL

SEQ ID NO: 119446 - protein, 11 aa, Dengue virus
MANIFRGSYLA

SEQ ID NO: 119447 - protein, 11 aa, Dengue virus
ANIFRGSYLAG

SEQ ID NO: 119448 - protein, 11 aa, Dengue virus
NIFRGSYLAGA

SEQ ID NO: 119449 - protein, 11 aa, Dengue virus
IFRGSYLAGAG

SEQ ID NO: 119450 - protein, 11 aa, Dengue virus
FRGSYLAGAGL

SEQ ID NO: 119451 - protein, 11 aa, Dengue virus
RGSYLAGAGLA

SEQ ID NO: 119452 - protein, 11 aa, Dengue virus
GSYLAGAGLAF

SEQ ID NO: 119453 - protein, 11 aa, Dengue virus
SYLAGAGLAFS

SEQ ID NO: 119454 - protein, 11 aa, Dengue virus
YLAGAGLAFSL

SEQ ID NO: 119455 - protein, 11 aa, Dengue virus
LAGAGLAFSLM

SEQ ID NO: 119456 - protein, 11 aa, Dengue virus
AGAGLAFSLMK

SEQ ID NO: 119457 - protein, 11 aa, Dengue virus
GAGLAFSLMKS

SEQ ID NO: 119458 - protein, 11 aa, Dengue virus
AGLAFSLMKSL

SEQ ID NO: 119459 - protein, 11 aa, Dengue virus
GETLGEKWKRQ

SEQ ID NO: 119460 - protein, 11 aa, Dengue virus
ETLGEKWKRQL

SEQ ID NO: 119461 - protein, 11 aa, Dengue virus
TLGEKWKRQLN

SEQ ID NO: 119462 - protein, 11 aa, Dengue virus
EVDRSEAKEGL

SEQ ID NO: 119463 - protein, 11 aa, Dengue virus
HHAVSRGSAKL

SEQ ID NO: 119464 - protein, 11 aa, Dengue virus
HAVSRGTAKLR

SEQ ID NO: 119465 - protein, 11 aa, Dengue virus
AVSRGTAKLRW

SEQ ID NO: 119466 - protein, 11 aa, Dengue virus
VSRGTAKLRWF

SEQ ID NO: 119467 - protein, 11 aa, Dengue virus
SRGTAKLRWFV

SEQ ID NO: 119468 - protein, 11 aa, Dengue virus
RGTAKLRWFVE

SEQ ID NO: 119469 - protein, 11 aa, Dengue virus
GTAKLRWFVER

SEQ ID NO: 119470 - protein, 11 aa, Dengue virus
TAKLRWFVERN

SEQ ID NO: 119471 - protein, 11 aa, Dengue virus
AKLRWFVERNL

SEQ ID NO: 119472 - protein, 11 aa, Dengue virus
KLRWFVERNLV

SEQ ID NO: 119473 - protein, 11 aa, Dengue virus
PEGKVIDLGCG

SEQ ID NO: 119474 - protein, 11 aa, Dengue virus
EGKVIDLGCGR

SEQ ID NO: 119475 - protein, 11 aa, Dengue virus
GKVIDLGCGRG

SEQ ID NO: 119476 - protein, 11 aa, Dengue virus
KVIDLGCGRGG

SEQ ID NO: 119477 - protein, 11 aa, Dengue virus
VIDLGCGRGGW

SEQ ID NO: 119478 - protein, 11 aa, Dengue virus
IDLGCGRGGWS

SEQ ID NO: 119479 - protein, 11 aa, Dengue virus
DLGCGRGGWSY

SEQ ID NO: 119480 - protein, 11 aa, Dengue virus
LGCGRGGWSYY

SEQ ID NO: 119481 - protein, 11 aa, Dengue virus
GCGRGGWSYYC

SEQ ID NO: 119482 - protein, 11 aa, Dengue virus
CGRGGWSYYCA

SEQ ID NO: 119483 - protein, 11 aa, Dengue virus
GRGGWSYYCAG

SEQ ID NO: 119484 - protein, 11 aa, Dengue virus
RGGWSYYCAGL

SEQ ID NO: 119485 - protein, 11 aa, Dengue virus
GGWSYYCAGLK

SEQ ID NO: 119486 - protein, 11 aa, Dengue virus
GWSYYCAGLKK

SEQ ID NO: 119487 - protein, 11 aa, Dengue virus
WSYYCAGLKKV

SEQ ID NO: 119488 - protein, 11 aa, Dengue virus
SYYCAGLKKVT

SEQ ID NO: 119489 - protein, 11 aa, Dengue virus
YYCAGLKKVTE

SEQ ID NO: 119490 - protein, 11 aa, Dengue virus
YCAGLKKVTEV

SEQ ID NO: 119491 - protein, 11 aa, Dengue virus
VTEVKGYTKGG

SEQ ID NO: 119492 - protein, 11 aa, Dengue virus
TEVKGYTKGGP

SEQ ID NO: 119493 - protein, 11 aa, Dengue virus
EVKGYTKGGPG

SEQ ID NO: 119494 - protein, 11 aa, Dengue virus
VKGYTKGGPGH

SEQ ID NO: 119495 - protein, 11 aa, Dengue virus
KGYTKGGPGHE

SEQ ID NO: 119496 - protein, 11 aa, Dengue virus
GYTKGGPGHEE

SEQ ID NO: 119497 - protein, 11 aa, Dengue virus
YTKGGPGHEEP

SEQ ID NO: 119498 - protein, 11 aa, Dengue virus
TKGGPGHEEPI

SEQ ID NO: 119499 - protein, 11 aa, Dengue virus
KGGPGHEEPIP

SEQ ID NO: 119500 - protein, 11 aa, Dengue virus
GGPGHEEPIPM

SEQ ID NO: 119501 - protein, 11 aa, Dengue virus
GPGHEEPIPMA

SEQ ID NO: 119502 - protein, 11 aa, Dengue virus
PGHEEPIPMAT

SEQ ID NO: 119503 - protein, 11 aa, Dengue virus
GHEEPIPMATY

SEQ ID NO: 119504 - protein, 11 aa, Dengue virus
HEEPIPMATYG

SEQ ID NO: 119505 - protein, 11 aa, Dengue virus
EEPIPMATYGW

SEQ ID NO: 119506 - protein, 11 aa, Dengue virus
EPIPMATYGWN

SEQ ID NO: 119507 - protein, 11 aa, Dengue virus
PIPMATYGWNL

SEQ ID NO: 119508 - protein, 11 aa, Dengue virus
IPMATYGWNLV

SEQ ID NO: 119509 - protein, 11 aa, Dengue virus
PMATYGWNLVK

SEQ ID NO: 119510 - protein, 11 aa, Dengue virus
MATYGWNLVKL

SEQ ID NO: 119511 - protein, 11 aa, Dengue virus
ATYGWNLVKLH

SEQ ID NO: 119512 - protein, 11 aa, Dengue virus
PPEKCDTLLCD

SEQ ID NO: 119513 - protein, 11 aa, Dengue virus
PEKCDTLLCDI

SEQ ID NO: 119514 - protein, 11 aa, Dengue virus
EKCDTLLCDIG

SEQ ID NO: 119515 - protein, 11 aa, Dengue virus
KCDTLLCDIGE

SEQ ID NO: 119516 - protein, 11 aa, Dengue virus
CDTLLCDIGES

SEQ ID NO: 119517 - protein, 11 aa, Dengue virus
DTLLCDIGESS

SEQ ID NO: 119518 - protein, 11 aa, Dengue virus
TLLCDIGESSP

SEQ ID NO: 119519 - protein, 11 aa, Dengue virus
LLCDIGESSPN

SEQ ID NO: 119520 - protein, 11 aa, Dengue virus
LCDIGESSPNP

SEQ ID NO: 119521 - protein, 11 aa, Dengue virus
CDIGESSPNPT

SEQ ID NO: 119522 - protein, 11 aa, Dengue virus
DIGESSPNPTI

SEQ ID NO: 119523 - protein, 11 aa, Dengue virus
IGESSPNPTIE

SEQ ID NO: 119524 - protein, 11 aa, Dengue virus
GESSPNPTIEE

SEQ ID NO: 119525 - protein, 11 aa, Dengue virus
ESSPNPTIEEG

SEQ ID NO: 119526 - protein, 11 aa, Dengue virus
SSPNPTIEEGR

SEQ ID NO: 119527 - protein, 11 aa, Dengue virus
SPNPTIEEGRT

SEQ ID NO: 119528 - protein, 11 aa, Dengue virus
PNPTIEEGRTL

SEQ ID NO: 119529 - protein, 11 aa, Dengue virus
NPTIEEGRTLR

SEQ ID NO: 119530 - protein, 11 aa, Dengue virus
PTIEEGRTLRV

SEQ ID NO: 119531 - protein, 11 aa, Dengue virus
TIEEGRTLRVL

SEQ ID NO: 119532 - protein, 11 aa, Dengue virus
IEEGRTLRVLK

SEQ ID NO: 119533 - protein, 11 aa, Dengue virus
EEGRTLRVLKM

SEQ ID NO: 119534 - protein, 11 aa, Dengue virus
EGRTLRVLKMV

SEQ ID NO: 119535 - protein, 11 aa, Dengue virus
GRTLRVLKMVE

SEQ ID NO: 119536 - protein, 11 aa, Dengue virus
RTLRVLKMVEP

SEQ ID NO: 119537 - protein, 11 aa, Dengue virus
TLRVLKMVEPW

SEQ ID NO: 119538 - protein, 11 aa, Dengue virus
LRVLKMVEPWL

SEQ ID NO: 119539 - protein, 11 aa, Dengue virus
QFCIKVLNPYM

SEQ ID NO: 119540 - protein, 11 aa, Dengue virus
FCIKVLNPYMP

SEQ ID NO: 119541 - protein, 11 aa, Dengue virus
CIKILNPYMPS

SEQ ID NO: 119542 - protein, 11 aa, Dengue virus
IKILNPYMPSV

SEQ ID NO: 119543 - protein, 11 aa, Dengue virus
KILNPYMPSVV

SEQ ID NO: 119544 - protein, 11 aa, Dengue virus
ILNPYMPSVVE

SEQ ID NO: 119545 - protein, 11 aa, Dengue virus
HGGMLVRNPLS

SEQ ID NO: 119546 - protein, 11 aa, Dengue virus
GGMLVRNPLSR

SEQ ID NO: 119547 - protein, 11 aa, Dengue virus
GMLVRNPLSRN

SEQ ID NO: 119548 - protein, 11 aa, Dengue virus
MLVRNPLSRNS

SEQ ID NO: 119549 - protein, 11 aa, Dengue virus
LVRNPLSRNST

SEQ ID NO: 119550 - protein, 11 aa, Dengue virus
VRNPLSRNSTH

SEQ ID NO: 119551 - protein, 11 aa, Dengue virus
RNPLSRNSTHE

SEQ ID NO: 119552 - protein, 11 aa, Dengue virus
NPLSRNSTHEM

SEQ ID NO: 119553 - protein, 11 aa, Dengue virus
PLSRNSTHEMY

SEQ ID NO: 119554 - protein, 11 aa, Dengue virus
LSRNSTHEMYW

SEQ ID NO: 119555 - protein, 11 aa, Dengue virus
SRNSTHEMYWV

SEQ ID NO: 119556 - protein, 11 aa, Dengue virus
RNSTHEMYWVS

SEQ ID NO: 119557 - protein, 11 aa, Dengue virus
NSTHEMYWVSC

SEQ ID NO: 119558 - protein, 11 aa, Dengue virus
STHEMYWVSCG

SEQ ID NO: 119559 - protein, 11 aa, Dengue virus
THEMYWVSCGT

SEQ ID NO: 119560 - protein, 11 aa, Dengue virus
HEMYWVSCGTG

SEQ ID NO: 119561 - protein, 11 aa, Dengue virus
EMYWVSCGTGN

SEQ ID NO: 119562 - protein, 11 aa, Dengue virus
MYWVSCGTGNI

SEQ ID NO: 119563 - protein, 11 aa, Dengue virus
YWVSCGTGNIV

SEQ ID NO: 119564 - protein, 11 aa, Dengue virus
GNIVSAVNMTS

SEQ ID NO: 119565 - protein, 11 aa, Dengue virus
NIVSAVNMTSR

SEQ ID NO: 119566 - protein, 11 aa, Dengue virus
IVSAVNMTSRM

SEQ ID NO: 119567 - protein, 11 aa, Dengue virus
VSAVNMTSRML

SEQ ID NO: 119568 - protein, 11 aa, Dengue virus
SAVNMTSRMLL

SEQ ID NO: 119569 - protein, 11 aa, Dengue virus
AVNMTSRMLLN

SEQ ID NO: 119570 - protein, 11 aa, Dengue virus
VNMTSRMLLNR

SEQ ID NO: 119571 - protein, 11 aa, Dengue virus
NMTSRMLLNRF

SEQ ID NO: 119572 - protein, 11 aa, Dengue virus
MTSRMLLNRFT

SEQ ID NO: 119573 - protein, 11 aa, Dengue virus
TSRMLLNRFTM

SEQ ID NO: 119574 - protein, 11 aa, Dengue virus
ERDVDLGAGTR

SEQ ID NO: 119575 - protein, 11 aa, Dengue virus
RDVDLGAGTRH

SEQ ID NO: 119576 - protein, 11 aa, Dengue virus
DVDLGAGTRHV

SEQ ID NO: 119577 - protein, 11 aa, Dengue virus
VDLGAGTRHVA

SEQ ID NO: 119578 - protein, 11 aa, Dengue virus
DLGAGTRHVAV

SEQ ID NO: 119579 - protein, 11 aa, Dengue virus
LGAGTRHVAVE

SEQ ID NO: 119580 - protein, 11 aa, Dengue virus
TWHYDEDNPYK

SEQ ID NO: 119581 - protein, 11 aa, Dengue virus
WHYDEDNPYKT

SEQ ID NO: 119582 - protein, 11 aa, Dengue virus
HYDEDNPYKTW

SEQ ID NO: 119583 - protein, 11 aa, Dengue virus
YDEDNPYKTWA

SEQ ID NO: 119584 - protein, 11 aa, Dengue virus
DEDNPYKTWAY

SEQ ID NO: 119585 - protein, 11 aa, Dengue virus
EDNPYKTWAYH

SEQ ID NO: 119586 - protein, 11 aa, Dengue virus
DNPYKTWAYHG

SEQ ID NO: 119587 - protein, 11 aa, Dengue virus
NPYKTWAYHGS

SEQ ID NO: 119588 - protein, 11 aa, Dengue virus
PYKTWAYHGSY

SEQ ID NO: 119589 - protein, 11 aa, Dengue virus
YKTWAYHGSYE

SEQ ID NO: 119590 - protein, 11 aa, Dengue virus
KTWAYHGSYEV

SEQ ID NO: 119591 - protein, 11 aa, Dengue virus
TWAYHGSYEVK

SEQ ID NO: 119592 - protein, 11 aa, Dengue virus
WAYHGSYEVKP

SEQ ID NO: 119593 - protein, 11 aa, Dengue virus
AYHGSYEVKPS

SEQ ID NO: 119594 - protein, 11 aa, Dengue virus
YHGSYEVKPSG

SEQ ID NO: 119595 - protein, 11 aa, Dengue virus
HGSYEVKPSGS

SEQ ID NO: 119596 - protein, 11 aa, Dengue virus
GSYEVKPSGSA

SEQ ID NO: 119597 - protein, 11 aa, Dengue virus
SYEVKPSGSAS

SEQ ID NO: 119598 - protein, 11 aa, Dengue virus
YEVKPSGSASS

SEQ ID NO: 119599 - protein, 11 aa, Dengue virus
EVKPSGSASSM

SEQ ID NO: 119600 - protein, 11 aa, Dengue virus
VKPSGSASSMV

SEQ ID NO: 119601 - protein, 11 aa, Dengue virus
KPSGSASSMVN

SEQ ID NO: 119602 - protein, 11 aa, Dengue virus
PSGSASSMVNG

SEQ ID NO: 119603 - protein, 11 aa, Dengue virus
SGSASSMVNGV

SEQ ID NO: 119604 - protein, 11 aa, Dengue virus
GSASSMVNGVV

SEQ ID NO: 119605 - protein, 11 aa, Dengue virus
SASSMVNGVVR

SEQ ID NO: 119606 - protein, 11 aa, Dengue virus
ASSMVNGVVRL

SEQ ID NO: 119607 - protein, 11 aa, Dengue virus
SSMVNGVVRLL

SEQ ID NO: 119608 - protein, 11 aa, Dengue virus
SMVNGVVRLLT

SEQ ID NO: 119609 - protein, 11 aa, Dengue virus
MVNGVVRLLTK

SEQ ID NO: 119610 - protein, 11 aa, Dengue virus
VNGVVRLLTKP

SEQ ID NO: 119611 - protein, 11 aa, Dengue virus
NGVVKLLTKPW

SEQ ID NO: 119612 - protein, 11 aa, Dengue virus
GVVKLLTKPWD

SEQ ID NO: 119613 - protein, 11 aa, Dengue virus
VVKLLTKPWDV

SEQ ID NO: 119614 - protein, 11 aa, Dengue virus
VKLLTKPWDVI

SEQ ID NO: 119615 - protein, 11 aa, Dengue virus
KLLTKPWDVIP

SEQ ID NO: 119616 - protein, 11 aa, Dengue virus
LLTKPWDVIPM

SEQ ID NO: 119617 - protein, 11 aa, Dengue virus
LTKPWDVIPMV

SEQ ID NO: 119618 - protein, 11 aa, Dengue virus
TKPWDVIPMVT

SEQ ID NO: 119619 - protein, 11 aa, Dengue virus
KPWDVIPMVTQ

SEQ ID NO: 119620 - protein, 11 aa, Dengue virus
PMVTQIAMTDT

SEQ ID NO: 119621 - protein, 11 aa, Dengue virus
MVTQIAMTDTT

SEQ ID NO: 119622 - protein, 11 aa, Dengue virus
VTQMAMTDTTP

SEQ ID NO: 119623 - protein, 11 aa, Dengue virus
TQMAMTDTTPF

SEQ ID NO: 119624 - protein, 11 aa, Dengue virus
QMAMTDTTPFG

SEQ ID NO: 119625 - protein, 11 aa, Dengue virus
MAMTDTTPFGQ

SEQ ID NO: 119626 - protein, 11 aa, Dengue virus
AMTDTTPFGQQ

SEQ ID NO: 119627 - protein, 11 aa, Dengue virus
MTDTTPFGQQR

SEQ ID NO: 119628 - protein, 11 aa, Dengue virus
TDTTPFGQQRV

SEQ ID NO: 119629 - protein, 11 aa, Dengue virus
DTTPFGQQRVF

SEQ ID NO: 119630 - protein, 11 aa, Dengue virus
TTPFGQQRVFK

SEQ ID NO: 119631 - protein, 11 aa, Dengue virus
TPFGQQRVFKE

SEQ ID NO: 119632 - protein, 11 aa, Dengue virus
PFGQQRVFKEK

SEQ ID NO: 119633 - protein, 11 aa, Dengue virus
FGQQRVFKEKV

SEQ ID NO: 119634 - protein, 11 aa, Dengue virus
GQQRVFKEKVD

SEQ ID NO: 119635 - protein, 11 aa, Dengue virus
QQRVFKEKVDT

SEQ ID NO: 119636 - protein, 11 aa, Dengue virus
QRVFKEKVDTR

SEQ ID NO: 119637 - protein, 11 aa, Dengue virus
RVFKEKVDTRT

SEQ ID NO: 119638 - protein, 11 aa, Dengue virus
VFKEKVDTRTP

SEQ ID NO: 119639 - protein, 11 aa, Dengue virus
FKEKVDTRTPK

SEQ ID NO: 119640 - protein, 11 aa, Dengue virus
CTREEFTRKVR

SEQ ID NO: 119641 - protein, 11 aa, Dengue virus
RKVRSNAAIGA

SEQ ID NO: 119642 - protein, 11 aa, Dengue virus
KVRSNAAIGAV

SEQ ID NO: 119643 - protein, 11 aa, Dengue virus
VRSNAAIGAVF

SEQ ID NO: 119644 - protein, 11 aa, Dengue virus
RSNAAIGAVFV

SEQ ID NO: 119645 - protein, 11 aa, Dengue virus
SNAAIGAVFVD

SEQ ID NO: 119646 - protein, 11 aa, Dengue virus
NAAIGAVFVDE

SEQ ID NO: 119647 - protein, 11 aa, Dengue virus
AAIGAVFVDEN

SEQ ID NO: 119648 - protein, 11 aa, Dengue virus
AIGAVFVDENQ

SEQ ID NO: 119649 - protein, 11 aa, Dengue virus
IGAVFVDENQW

SEQ ID NO: 119650 - protein, 11 aa, Dengue virus
GAVFVDENQWN

SEQ ID NO: 119651 - protein, 11 aa, Dengue virus
AVFVDENQWNS

SEQ ID NO: 119652 - protein, 11 aa, Dengue virus
VFVDENQWNSA

SEQ ID NO: 119653 - protein, 11 aa, Dengue virus
FVDENQWNSAK

SEQ ID NO: 119654 - protein, 11 aa, Dengue virus
VDENQWNSAKE

SEQ ID NO: 119655 - protein, 11 aa, Dengue virus
DENQWNSAKEA

SEQ ID NO: 119656 - protein, 11 aa, Dengue virus
ENQWNSAKEAV

SEQ ID NO: 119657 - protein, 11 aa, Dengue virus
NQWNSAKEAVE

SEQ ID NO: 119658 - protein, 11 aa, Dengue virus
QWNSAKEAVED

SEQ ID NO: 119659 - protein, 11 aa, Dengue virus
ERELHKQGKCA

SEQ ID NO: 119660 - protein, 11 aa, Dengue virus
RELHKQGKCAT

SEQ ID NO: 119661 - protein, 11 aa, Dengue virus
ELHKQGKCATC

SEQ ID NO: 119662 - protein, 11 aa, Dengue virus
LHKQGKCATCV

SEQ ID NO: 119663 - protein, 11 aa, Dengue virus
HKQGKCATCVY

SEQ ID NO: 119664 - protein, 11 aa, Dengue virus
KQGKCATCVYN

SEQ ID NO: 119665 - protein, 11 aa, Dengue virus
QGKCATCVYNM

SEQ ID NO: 119666 - protein, 11 aa, Dengue virus
GKCATCVYNMM

SEQ ID NO: 119667 - protein, 11 aa, Dengue virus
KCATCVYNMMG

SEQ ID NO: 119668 - protein, 11 aa, Dengue virus
CATCVYNMMGK

SEQ ID NO: 119669 - protein, 11 aa, Dengue virus
ATCVYNMMGKR

SEQ ID NO: 119670 - protein, 11 aa, Dengue virus
TCVYNMMGKRE

SEQ ID NO: 119671 - protein, 11 aa, Dengue virus
CVYNMMGKREK

SEQ ID NO: 119672 - protein, 11 aa, Dengue virus
VYNMMGKREKK

SEQ ID NO: 119673 - protein, 11 aa, Dengue virus
YNMMGKREKKL

SEQ ID NO: 119674 - protein, 11 aa, Dengue virus
NMMGKREKKLG

SEQ ID NO: 119675 - protein, 11 aa, Dengue virus
MMGKREKKLGE

SEQ ID NO: 119676 - protein, 11 aa, Dengue virus
MGKREKKLGEF

SEQ ID NO: 119677 - protein, 11 aa, Dengue virus
GKREKKLGEFG

SEQ ID NO: 119678 - protein, 11 aa, Dengue virus
KREKKLGEFGK

SEQ ID NO: 119679 - protein, 11 aa, Dengue virus
REKKLGEFGKA

SEQ ID NO: 119680 - protein, 11 aa, Dengue virus
EKKLGEFGKAK

SEQ ID NO: 119681 - protein, 11 aa, Dengue virus
KKLGEFGKAKG

SEQ ID NO: 119682 - protein, 11 aa, Dengue virus
KLGEFGKAKGS

SEQ ID NO: 119683 - protein, 11 aa, Dengue virus
LGEFGKAKGSR

SEQ ID NO: 119684 - protein, 11 aa, Dengue virus
GEFGKAKGSRA

SEQ ID NO: 119685 - protein, 11 aa, Dengue virus
EFGKAKGSRAI

SEQ ID NO: 119686 - protein, 11 aa, Dengue virus
FGKAKGSRAIW

SEQ ID NO: 119687 - protein, 11 aa, Dengue virus
GKAKGSRAIWY

SEQ ID NO: 119688 - protein, 11 aa, Dengue virus
KAKGSRAIWYM

SEQ ID NO: 119689 - protein, 11 aa, Dengue virus
AKGSRAIWYMW

SEQ ID NO: 119690 - protein, 11 aa, Dengue virus
KGSRAIWYMWL

SEQ ID NO: 119691 - protein, 11 aa, Dengue virus
GSRAIWYMWLG

SEQ ID NO: 119692 - protein, 11 aa, Dengue virus
SRAIWYMWLGA

SEQ ID NO: 119693 - protein, 11 aa, Dengue virus
RAIWYMWLGAR

SEQ ID NO: 119694 - protein, 11 aa, Dengue virus
AIWYMWLGARF

SEQ ID NO: 119695 - protein, 11 aa, Dengue virus
IWYMWLGARFL

SEQ ID NO: 119696 - protein, 11 aa, Dengue virus
WYMWLGARFLE

SEQ ID NO: 119697 - protein, 11 aa, Dengue virus
YMWLGARFLEF

SEQ ID NO: 119698 - protein, 11 aa, Dengue virus
MWLGARFLEFE

SEQ ID NO: 119699 - protein, 11 aa, Dengue virus
WLGARFLEFEA

SEQ ID NO: 119700 - protein, 11 aa, Dengue virus
LGARFLEFEAL

SEQ ID NO: 119701 - protein, 11 aa, Dengue virus
GARFLEFEALG

SEQ ID NO: 119702 - protein, 11 aa, Dengue virus
ARFLEFEALGF

SEQ ID NO: 119703 - protein, 11 aa, Dengue virus
RFLEFEALGFM

SEQ ID NO: 119704 - protein, 11 aa, Dengue virus
FLEFEALGFMN

SEQ ID NO: 119705 - protein, 11 aa, Dengue virus
LEFEALGFLNE

SEQ ID NO: 119706 - protein, 11 aa, Dengue virus
EFEALGFLNED

SEQ ID NO: 119707 - protein, 11 aa, Dengue virus
FEALGFLNEDH

SEQ ID NO: 119708 - protein, 11 aa, Dengue virus
EALGFLNEDHW

SEQ ID NO: 119709 - protein, 11 aa, Dengue virus
ALGFLNEDHWF

SEQ ID NO: 119710 - protein, 11 aa, Dengue virus
LGFLNEDHWFS

SEQ ID NO: 119711 - protein, 11 aa, Dengue virus
GFLNEDHWFSR

SEQ ID NO: 119712 - protein, 11 aa, Dengue virus
FMNEDHWFSRE

SEQ ID NO: 119713 - protein, 11 aa, Dengue virus
MNEDHWFSREN

SEQ ID NO: 119714 - protein, 11 aa, Dengue virus
NEDHWFSRENS

SEQ ID NO: 119715 - protein, 11 aa, Dengue virus
EDHWFSRENSL

SEQ ID NO: 119716 - protein, 11 aa, Dengue virus
DHWFSRENSLS

SEQ ID NO: 119717 - protein, 11 aa, Dengue virus
HWFSRENSLSG

SEQ ID NO: 119718 - protein, 11 aa, Dengue virus
WFSRENSLSGV

SEQ ID NO: 119719 - protein, 11 aa, Dengue virus
FSRENSLSGVE

SEQ ID NO: 119720 - protein, 11 aa, Dengue virus
SRENSLSGVEG

SEQ ID NO: 119721 - protein, 11 aa, Dengue virus
RENSLSGVEGE

SEQ ID NO: 119722 - protein, 11 aa, Dengue virus
ENSLSGVEGEG

SEQ ID NO: 119723 - protein, 11 aa, Dengue virus
NSLSGVEGEGL

SEQ ID NO: 119724 - protein, 11 aa, Dengue virus
SLSGVEGEGLH

SEQ ID NO: 119725 - protein, 11 aa, Dengue virus
LSGVEGEGLHK

SEQ ID NO: 119726 - protein, 11 aa, Dengue virus
SGVEGEGLHKL

SEQ ID NO: 119727 - protein, 11 aa, Dengue virus
GVEGEGLHKLG

SEQ ID NO: 119728 - protein, 11 aa, Dengue virus
VEGEGLHKLGY

SEQ ID NO: 119729 - protein, 11 aa, Dengue virus
EGEGLHKLGYI

SEQ ID NO: 119730 - protein, 11 aa, Dengue virus
GEGLHKLGYIL

SEQ ID NO: 119731 - protein, 11 aa, Dengue virus
EGLHKLGYILR

SEQ ID NO: 119732 - protein, 11 aa, Dengue virus
GGAMYADDTAG

SEQ ID NO: 119733 - protein, 11 aa, Dengue virus
GAMYADDTAGW

SEQ ID NO: 119734 - protein, 11 aa, Dengue virus
AMYADDTAGWD

SEQ ID NO: 119735 - protein, 11 aa, Dengue virus
MYADDTAGWDT

SEQ ID NO: 119736 - protein, 11 aa, Dengue virus
YADDTAGWDTR

SEQ ID NO: 119737 - protein, 11 aa, Dengue virus
ADDTAGWDTRI

SEQ ID NO: 119738 - protein, 11 aa, Dengue virus
DDTAGWDTRIT

SEQ ID NO: 119739 - protein, 11 aa, Dengue virus
DTAGWDTRITE

SEQ ID NO: 119740 - protein, 11 aa, Dengue virus
TAGWDTRITED

SEQ ID NO: 119741 - protein, 11 aa, Dengue virus
AGWDTRITEDD

SEQ ID NO: 119742 - protein, 11 aa, Dengue virus
GWDTRITEDDL

SEQ ID NO: 119743 - protein, 11 aa, Dengue virus
AIFKLTYQNKV

SEQ ID NO: 119744 - protein, 11 aa, Dengue virus
IFKLTYQNKVV

SEQ ID NO: 119745 - protein, 11 aa, Dengue virus
FKLTYQNKVVR

SEQ ID NO: 119746 - protein, 11 aa, Dengue virus
KLTYQNKVVRV

SEQ ID NO: 119747 - protein, 11 aa, Dengue virus
LTYQNKVVRVQ

SEQ ID NO: 119748 - protein, 11 aa, Dengue virus
TYQNKVVRVQR

SEQ ID NO: 119749 - protein, 11 aa, Dengue virus
YQNKVVRVQRP

SEQ ID NO: 119750 - protein, 11 aa, Dengue virus
QNKVVRVQRPA

SEQ ID NO: 119751 - protein, 11 aa, Dengue virus
NKVVRVQRPAK

SEQ ID NO: 119752 - protein, 11 aa, Dengue virus
GTVMDVISRRD

SEQ ID NO: 119753 - protein, 11 aa, Dengue virus
TVMDVISRRDQ

SEQ ID NO: 119754 - protein, 11 aa, Dengue virus
VMDVISRRDQR

SEQ ID NO: 119755 - protein, 11 aa, Dengue virus
MDVISRRDQRG

SEQ ID NO: 119756 - protein, 11 aa, Dengue virus
DVISRRDQRGS

SEQ ID NO: 119757 - protein, 11 aa, Dengue virus
VISRRDQRGSG

SEQ ID NO: 119758 - protein, 11 aa, Dengue virus
ISRRDQRGSGQ

SEQ ID NO: 119759 - protein, 11 aa, Dengue virus
SRRDQRGSGQV

SEQ ID NO: 119760 - protein, 11 aa, Dengue virus
RRDQRGSGQVG

SEQ ID NO: 119761 - protein, 11 aa, Dengue virus
RDQRGSGQVGT

SEQ ID NO: 119762 - protein, 11 aa, Dengue virus
DQRGSGQVGTY

SEQ ID NO: 119763 - protein, 11 aa, Dengue virus
QRGSGQVGTYG

SEQ ID NO: 119764 - protein, 11 aa, Dengue virus
RGSGQVGTYGL

SEQ ID NO: 119765 - protein, 11 aa, Dengue virus
GSGQVGTYGLN

SEQ ID NO: 119766 - protein, 11 aa, Dengue virus
SGQVGTYGLNT

SEQ ID NO: 119767 - protein, 11 aa, Dengue virus
FTNMEAQLIRQ

SEQ ID NO: 119768 - protein, 11 aa, Dengue virus
TNMEAQLIRQM

SEQ ID NO: 119769 - protein, 11 aa, Dengue virus
NMEAQLIRQME

SEQ ID NO: 119770 - protein, 11 aa, Dengue virus
AQLIRQMEGEG

SEQ ID NO: 119771 - protein, 11 aa, Dengue virus
ERLKRMAISGD

SEQ ID NO: 119772 - protein, 11 aa, Dengue virus
RLKRMAISGDD

SEQ ID NO: 119773 - protein, 11 aa, Dengue virus
LKRMAISGDDC

SEQ ID NO: 119774 - protein, 11 aa, Dengue virus
KRMAISGDDCV

SEQ ID NO: 119775 - protein, 11 aa, Dengue virus
RMAISGDDCVV

SEQ ID NO: 119776 - protein, 11 aa, Dengue virus
MAISGDDCVVK

SEQ ID NO: 119777 - protein, 11 aa, Dengue virus
AISGDDCVVKP

SEQ ID NO: 119778 - protein, 11 aa, Dengue virus
ISGDDCVVKPI

SEQ ID NO: 119779 - protein, 11 aa, Dengue virus
SGDDCVVKPID

SEQ ID NO: 119780 - protein, 11 aa, Dengue virus
GDDCVVKPIDD

SEQ ID NO: 119781 - protein, 11 aa, Dengue virus
DDCVVKPIDDR

SEQ ID NO: 119782 - protein, 11 aa, Dengue virus
DCVVKPIDDRF

SEQ ID NO: 119783 - protein, 11 aa, Dengue virus
ALNDMGKVRKD

SEQ ID NO: 119784 - protein, 11 aa, Dengue virus
LNDMGKVRKDI

SEQ ID NO: 119785 - protein, 11 aa, Dengue virus
NDMGKVRKDIP

SEQ ID NO: 119786 - protein, 11 aa, Dengue virus
DMGKVRKDIPQ

SEQ ID NO: 119787 - protein, 11 aa, Dengue virus
MGKVRKDIPQW

SEQ ID NO: 119788 - protein, 11 aa, Dengue virus
GKVRKDIPQWE

SEQ ID NO: 119789 - protein, 11 aa, Dengue virus
KVRKDIPQWEP

SEQ ID NO: 119790 - protein, 11 aa, Dengue virus
VRKDIPQWEPS

SEQ ID NO: 119791 - protein, 11 aa, Dengue virus
RKDIPQWEPSK

SEQ ID NO: 119792 - protein, 11 aa, Dengue virus
KDIPQWEPSKG

SEQ ID NO: 119793 - protein, 11 aa, Dengue virus
DIPQWEPSKGW

SEQ ID NO: 119794 - protein, 11 aa, Dengue virus
QWEPSKGWNDW

SEQ ID NO: 119795 - protein, 11 aa, Dengue virus
GWNDWQQVPFC

SEQ ID NO: 119796 - protein, 11 aa, Dengue virus
WNDWQQVPFCS

SEQ ID NO: 119797 - protein, 11 aa, Dengue virus
NDWQQVPFCSH

SEQ ID NO: 119798 - protein, 11 aa, Dengue virus
DWQQVPFCSHH

SEQ ID NO: 119799 - protein, 11 aa, Dengue virus
WQQVPFCSHHF

SEQ ID NO: 119800 - protein, 11 aa, Dengue virus
QQVPFCSHHFH

SEQ ID NO: 119801 - protein, 11 aa, Dengue virus
QVPFCSHHFHE

SEQ ID NO: 119802 - protein, 11 aa, Dengue virus
VPFCSHHFHEL

SEQ ID NO: 119803 - protein, 11 aa, Dengue virus
PFCSHHFHQLI

SEQ ID NO: 119804 - protein, 11 aa, Dengue virus
FCSHHFHQLIM

SEQ ID NO: 119805 - protein, 11 aa, Dengue virus
CSHHFHQLIMK

SEQ ID NO: 119806 - protein, 11 aa, Dengue virus
SHHFHQLIMKD

SEQ ID NO: 119807 - protein, 11 aa, Dengue virus
HHFHQLIMKDG

SEQ ID NO: 119808 - protein, 11 aa, Dengue virus
HFHQLIMKDGR

SEQ ID NO: 119809 - protein, 11 aa, Dengue virus
IVVPCRNQDEL

SEQ ID NO: 119810 - protein, 11 aa, Dengue virus
VVPCRNQDELV

SEQ ID NO: 119811 - protein, 11 aa, Dengue virus
VPCRNQDELVG

SEQ ID NO: 119812 - protein, 11 aa, Dengue virus
PCRNQDELVGR

SEQ ID NO: 119813 - protein, 11 aa, Dengue virus
CRNQDELVGRA

SEQ ID NO: 119814 - protein, 11 aa, Dengue virus
RNQDELVGRAR

SEQ ID NO: 119815 - protein, 11 aa, Dengue virus
NQDELVGRARV

SEQ ID NO: 119816 - protein, 11 aa, Dengue virus
QDELIGRARIS

SEQ ID NO: 119817 - protein, 11 aa, Dengue virus
DELIGRARISQ

SEQ ID NO: 119818 - protein, 11 aa, Dengue virus
ELIGRARISQG

SEQ ID NO: 119819 - protein, 11 aa, Dengue virus
LIGRARISQGA

SEQ ID NO: 119820 - protein, 11 aa, Dengue virus
IGRARISQGAG

SEQ ID NO: 119821 - protein, 11 aa, Dengue virus
GRARISQGAGW

SEQ ID NO: 119822 - protein, 11 aa, Dengue virus
RARISQGAGWS

SEQ ID NO: 119823 - protein, 11 aa, Dengue virus
ARISQGAGWSL

SEQ ID NO: 119824 - protein, 11 aa, Dengue virus
RVSQGAGWSLR

SEQ ID NO: 119825 - protein, 11 aa, Dengue virus
VSQGAGWSLRE

SEQ ID NO: 119826 - protein, 11 aa, Dengue virus
SQGAGWSLRET

SEQ ID NO: 119827 - protein, 11 aa, Dengue virus
QGAGWSLRETA

SEQ ID NO: 119828 - protein, 11 aa, Dengue virus
GAGWSLRETAC

SEQ ID NO: 119829 - protein, 11 aa, Dengue virus
AGWSLRETACL

SEQ ID NO: 119830 - protein, 11 aa, Dengue virus
GWSLRETACLG

SEQ ID NO: 119831 - protein, 11 aa, Dengue virus
WSLRETACLGK

SEQ ID NO: 119832 - protein, 11 aa, Dengue virus
SLRETACLGKS

SEQ ID NO: 119833 - protein, 11 aa, Dengue virus
LRETACLGKSY

SEQ ID NO: 119834 - protein, 11 aa, Dengue virus
RETACLGKSYA

SEQ ID NO: 119835 - protein, 11 aa, Dengue virus
ETACLGKSYAQ

SEQ ID NO: 119836 - protein, 11 aa, Dengue virus
TACLGKSYAQM

SEQ ID NO: 119837 - protein, 11 aa, Dengue virus
ACLGKSYAQMW

SEQ ID NO: 119838 - protein, 11 aa, Dengue virus
CLGKSYAQMWQ

SEQ ID NO: 119839 - protein, 11 aa, Dengue virus
LGKSYAQMWQL

SEQ ID NO: 119840 - protein, 11 aa, Dengue virus
GKSYAQMWQLM

SEQ ID NO: 119841 - protein, 11 aa, Dengue virus
KSYAQMWQLMY

SEQ ID NO: 119842 - protein, 11 aa, Dengue virus
SYAQMWQLMYF

SEQ ID NO: 119843 - protein, 11 aa, Dengue virus
YAQMWQLMYFH

SEQ ID NO: 119844 - protein, 11 aa, Dengue virus
AQMWQLMYFHR

SEQ ID NO: 119845 - protein, 11 aa, Dengue virus
QMWQLMYFHRR

SEQ ID NO: 119846 - protein, 11 aa, Dengue virus
MWQLMYFHRRD

SEQ ID NO: 119847 - protein, 11 aa, Dengue virus
WQLMYFHRRDL

SEQ ID NO: 119848 - protein, 11 aa, Dengue virus
QLMYFHRRDLR

SEQ ID NO: 119849 - protein, 11 aa, Dengue virus
LMYFHRRDLRL

SEQ ID NO: 119850 - protein, 11 aa, Dengue virus
MYFHRRDLRLA

SEQ ID NO: 119851 - protein, 11 aa, Dengue virus
YFHRRDLRLAA

SEQ ID NO: 119852 - protein, 11 aa, Dengue virus
FHRRDLRLAAN

SEQ ID NO: 119853 - protein, 11 aa, Dengue virus
HRRDLRLAANA

SEQ ID NO: 119854 - protein, 11 aa, Dengue virus
RRDLRLAANAI

SEQ ID NO: 119855 - protein, 11 aa, Dengue virus
RDLRLAANAIC

SEQ ID NO: 119856 - protein, 11 aa, Dengue virus
DLRLAANAICS

SEQ ID NO: 119857 - protein, 11 aa, Dengue virus
LRLAANAICSA

SEQ ID NO: 119858 - protein, 11 aa, Dengue virus
RLAANAICSAV

SEQ ID NO: 119859 - protein, 11 aa, Dengue virus
LAANAICSAVP

SEQ ID NO: 119860 - protein, 11 aa, Dengue virus
HWVPTSRTTWS

SEQ ID NO: 119861 - protein, 11 aa, Dengue virus
WVPTSRTTWSI

SEQ ID NO: 119862 - protein, 11 aa, Dengue virus
VPTSRTTWSIH

SEQ ID NO: 119863 - protein, 11 aa, Dengue virus
PTSRTTWSIHA

SEQ ID NO: 119864 - protein, 11 aa, Dengue virus
TSRTTWSIHAH

SEQ ID NO: 119865 - protein, 11 aa, Dengue virus
SRTTWSIHAHH

SEQ ID NO: 119866 - protein, 11 aa, Dengue virus
RTTWSIHAHHQ

SEQ ID NO: 119867 - protein, 11 aa, Dengue virus
TTWSIHAHHQW

SEQ ID NO: 119868 - protein, 11 aa, Dengue virus
TWSIHAHHQWM

SEQ ID NO: 119869 - protein, 11 aa, Dengue virus
WSIHAHHQWMT

SEQ ID NO: 119870 - protein, 11 aa, Dengue virus
SIHAHHQWMTT

SEQ ID NO: 119871 - protein, 11 aa, Dengue virus
IHAHHQWMTTE

SEQ ID NO: 119872 - protein, 11 aa, Dengue virus
HAHHQWMTTED

SEQ ID NO: 119873 - protein, 11 aa, Dengue virus
AHHQWMTTEDM

SEQ ID NO: 119874 - protein, 11 aa, Dengue virus
HHQWMTTEDML

SEQ ID NO: 119875 - protein, 11 aa, Dengue virus
HQWMTTEDMLS

SEQ ID NO: 119876 - protein, 11 aa, Dengue virus
QWMTTEDMLSV

SEQ ID NO: 119877 - protein, 11 aa, Dengue virus
WMTTEDMLSVW

SEQ ID NO: 119878 - protein, 11 aa, Dengue virus
MTTEDMLSVWN

SEQ ID NO: 119879 - protein, 11 aa, Dengue virus
TTEDMLSVWNR

SEQ ID NO: 119880 - protein, 11 aa, Dengue virus
TEDMLSVWNRV

SEQ ID NO: 119881 - protein, 11 aa, Dengue virus
EDMLSVWNRVW

SEQ ID NO: 119882 - protein, 11 aa, Dengue virus
DMLSVWNRVWI

SEQ ID NO: 119883 - protein, 11 aa, Dengue virus
DVPYLGKREDQ

SEQ ID NO: 119884 - protein, 11 aa, Dengue virus
VPYLGKREDQW

SEQ ID NO: 119885 - protein, 11 aa, Dengue virus
PYLGKREDQWC

SEQ ID NO: 119886 - protein, 11 aa, Dengue virus
YLGKREDQWCG

SEQ ID NO: 119887 - protein, 11 aa, Dengue virus
LGKREDQWCGS

SEQ ID NO: 119888 - protein, 11 aa, Dengue virus
GKREDQWCGSL

SEQ ID NO: 119889 - protein, 11 aa, Dengue virus
KREDQWCGSLI

SEQ ID NO: 119890 - protein, 11 aa, Dengue virus
REDQWCGSLIG

SEQ ID NO: 119891 - protein, 11 aa, Dengue virus
EDQWCGSLIGL

SEQ ID NO: 119892 - protein, 11 aa, Dengue virus
DQWCGSLIGLT

SEQ ID NO: 119893 - protein, 11 aa, Dengue virus
QWCGSLIGLTS

SEQ ID NO: 119894 - protein, 11 aa, Dengue virus
WCGSLIGLTSR

SEQ ID NO: 119895 - protein, 11 aa, Dengue virus
CGSLIGLTSRA

SEQ ID NO: 119896 - protein, 11 aa, Dengue virus
GSLIGLTSRAT

SEQ ID NO: 119897 - protein, 11 aa, Dengue virus
SLIGLTSRATW

SEQ ID NO: 119898 - protein, 11 aa, Dengue virus
LIGLTSRATWA

SEQ ID NO: 119899 - protein, 11 aa, Dengue virus
IGLTARATWAT

SEQ ID NO: 119900 - protein, 11 aa, Dengue virus
GLTARATWATN

SEQ ID NO: 119901 - protein, 11 aa, Dengue virus
LTARATWATNI

SEQ ID NO: 119902 - protein, 11 aa, Dengue virus
TPFNMLKRERN

SEQ ID NO: 119903 - protein, 11 aa, Dengue virus
PFNMLKRERNR

SEQ ID NO: 119904 - protein, 11 aa, Dengue virus
FNMLKRERNRV

SEQ ID NO: 119905 - protein, 11 aa, Dengue virus
NMLKRERNRVS

SEQ ID NO: 119906 - protein, 11 aa, Dengue virus
MLKRERNRVST

SEQ ID NO: 119907 - protein, 11 aa, Dengue virus
RNRVSTVQQLT

SEQ ID NO: 119908 - protein, 11 aa, Dengue virus
NRVSTVQQLTK

SEQ ID NO: 119909 - protein, 11 aa, Dengue virus
RVSTVQQLTKR

SEQ ID NO: 119910 - protein, 11 aa, Dengue virus
VSTVQQLTKRF

SEQ ID NO: 119911 - protein, 11 aa, Dengue virus
STVQQLTKRFS

SEQ ID NO: 119912 - protein, 11 aa, Dengue virus
QQLTKRFSLGM

SEQ ID NO: 119913 - protein, 11 aa, Dengue virus
QLTKRFSLGML

SEQ ID NO: 119914 - protein, 11 aa, Dengue virus
LTKRFSLGMLQ

SEQ ID NO: 119915 - protein, 11 aa, Dengue virus
TKRFSLGMLQG

SEQ ID NO: 119916 - protein, 11 aa, Dengue virus
KRFSLGMLQGR

SEQ ID NO: 119917 - protein, 11 aa, Dengue virus
RFSLGMLQGRG

SEQ ID NO: 119918 - protein, 11 aa, Dengue virus
FSLGMLQGRGP

SEQ ID NO: 119919 - protein, 11 aa, Dengue virus
LFMALVAFLRF

SEQ ID NO: 119920 - protein, 11 aa, Dengue virus
FMALVAFLRFL

SEQ ID NO: 119921 - protein, 11 aa, Dengue virus
MALVAFLRFLT

SEQ ID NO: 119922 - protein, 11 aa, Dengue virus
ALVAFLRFLTI

SEQ ID NO: 119923 - protein, 11 aa, Dengue virus
LVAFLRFLTIP

SEQ ID NO: 119924 - protein, 11 aa, Dengue virus
VAFLRFLTIPP

SEQ ID NO: 119925 - protein, 11 aa, Dengue virus
AFLRFLTIPPT

SEQ ID NO: 119926 - protein, 11 aa, Dengue virus
FLRFLTIPPTA

SEQ ID NO: 119927 - protein, 11 aa, Dengue virus
LRFLTIPPTAG

SEQ ID NO: 119928 - protein, 11 aa, Dengue virus
RFLTIPPTAGI

SEQ ID NO: 119929 - protein, 11 aa, Dengue virus
FLTIPPTAGIL

SEQ ID NO: 119930 - protein, 11 aa, Dengue virus
LTIPPTAGILK

SEQ ID NO: 119931 - protein, 11 aa, Dengue virus
TIPPTAGILKR

SEQ ID NO: 119932 - protein, 11 aa, Dengue virus
IPPTAGILKRW

SEQ ID NO: 119933 - protein, 11 aa, Dengue virus
PPTAGILKRWG

SEQ ID NO: 119934 - protein, 11 aa, Dengue virus
AFHLTTRNGEP

SEQ ID NO: 119935 - protein, 11 aa, Dengue virus
FHLTTRNGEPH

SEQ ID NO: 119936 - protein, 11 aa, Dengue virus
HLTTRNGEPHM

SEQ ID NO: 119937 - protein, 11 aa, Dengue virus
LTTRNGEPHMI

SEQ ID NO: 119938 - protein, 11 aa, Dengue virus
TTRNGEPHMIV

SEQ ID NO: 119939 - protein, 11 aa, Dengue virus
QEKGKSLLFKT

SEQ ID NO: 119940 - protein, 11 aa, Dengue virus
EKGKSLLFKTE

SEQ ID NO: 119941 - protein, 11 aa, Dengue virus
NMCTLMAIDLG

SEQ ID NO: 119942 - protein, 11 aa, Dengue virus
MCTLMAIDLGE

SEQ ID NO: 119943 - protein, 11 aa, Dengue virus
CTLIAMDLGEM

SEQ ID NO: 119944 - protein, 11 aa, Dengue virus
TLIAMDLGEMC

SEQ ID NO: 119945 - protein, 11 aa, Dengue virus
AMDLGEMCDDT

SEQ ID NO: 119946 - protein, 11 aa, Dengue virus
EPEDIDCWCNS

SEQ ID NO: 119947 - protein, 11 aa, Dengue virus
PEDIDCWCNST

SEQ ID NO: 119948 - protein, 11 aa, Dengue virus
EDIDCWCNSTS

SEQ ID NO: 119949 - protein, 11 aa, Dengue virus
DIDCWCNSTST

SEQ ID NO: 119950 - protein, 11 aa, Dengue virus
IDCWCNSTSTW

SEQ ID NO: 119951 - protein, 11 aa, Dengue virus
GEHRREKRSVA

SEQ ID NO: 119952 - protein, 11 aa, Dengue virus
EHRREKRSVAL

SEQ ID NO: 119953 - protein, 11 aa, Dengue virus
HRREKRSVALV

SEQ ID NO: 119954 - protein, 11 aa, Dengue virus
RREKRSVALVP

SEQ ID NO: 119955 - protein, 11 aa, Dengue virus
REKRSVALVPH

SEQ ID NO: 119956 - protein, 11 aa, Dengue virus
EKRSVALVPHV

SEQ ID NO: 119957 - protein, 11 aa, Dengue virus
KRSVALVPHVG

SEQ ID NO: 119958 - protein, 11 aa, Dengue virus
RSVALVPHVGM

SEQ ID NO: 119959 - protein, 11 aa, Dengue virus
SVALVPHVGMG

SEQ ID NO: 119960 - protein, 11 aa, Dengue virus
VALVPHVGMGL

SEQ ID NO: 119961 - protein, 11 aa, Dengue virus
ALVPHVGMGLE

SEQ ID NO: 119962 - protein, 11 aa, Dengue virus
LVPHVGMGLET

SEQ ID NO: 119963 - protein, 11 aa, Dengue virus
VPHVGMGLETR

SEQ ID NO: 119964 - protein, 11 aa, Dengue virus
GLDTRTQTWMS

SEQ ID NO: 119965 - protein, 11 aa, Dengue virus
LDTRTQTWMSA

SEQ ID NO: 119966 - protein, 11 aa, Dengue virus
DTRTQTWMSAE

SEQ ID NO: 119967 - protein, 11 aa, Dengue virus
TRTQTWMSAEG

SEQ ID NO: 119968 - protein, 11 aa, Dengue virus
RTQTWMSAEGA

SEQ ID NO: 119969 - protein, 11 aa, Dengue virus
TQTWMSAEGAW

SEQ ID NO: 119970 - protein, 11 aa, Dengue virus
QTWMSAEGAWR

SEQ ID NO: 119971 - protein, 11 aa, Dengue virus
TWMSSEGAWKH

SEQ ID NO: 119972 - protein, 11 aa, Dengue virus
IETWILRHPGF

SEQ ID NO: 119973 - protein, 11 aa, Dengue virus
ETWILRHPGFT

SEQ ID NO: 119974 - protein, 11 aa, Dengue virus
MRCIGISNRDF

SEQ ID NO: 119975 - protein, 11 aa, Dengue virus
RCIGISNRDFV

SEQ ID NO: 119976 - protein, 11 aa, Dengue virus
CIGISNRDFVE

SEQ ID NO: 119977 - protein, 11 aa, Dengue virus
IGISNRDFVEG

SEQ ID NO: 119978 - protein, 11 aa, Dengue virus
GNRDFVEGLSG

SEQ ID NO: 119979 - protein, 11 aa, Dengue virus
SRDFVEGLSGA

SEQ ID NO: 119980 - protein, 11 aa, Dengue virus
RDFVEGVSGGS

SEQ ID NO: 119981 - protein, 11 aa, Dengue virus
DFVEGVSGGSW

SEQ ID NO: 119982 - protein, 11 aa, Dengue virus
FVEGVSGGSWV

SEQ ID NO: 119983 - protein, 11 aa, Dengue virus
VEGVSGGSWVD

SEQ ID NO: 119984 - protein, 11 aa, Dengue virus
EGVSGGSWVDI

SEQ ID NO: 119985 - protein, 11 aa, Dengue virus
GVSGGSWVDIV

SEQ ID NO: 119986 - protein, 11 aa, Dengue virus
VSGGSWVDIVL

SEQ ID NO: 119987 - protein, 11 aa, Dengue virus
SGGSWVDIVLE

SEQ ID NO: 119988 - protein, 11 aa, Dengue virus
GGSWVDIVLEH

SEQ ID NO: 119989 - protein, 11 aa, Dengue virus
GSWVDIVLEHG

SEQ ID NO: 119990 - protein, 11 aa, Dengue virus
SWVDIVLEHGS

SEQ ID NO: 119991 - protein, 11 aa, Dengue virus
WVDIVLEHGSC

SEQ ID NO: 119992 - protein, 11 aa, Dengue virus
VDIVLEHGSCV

SEQ ID NO: 119993 - protein, 11 aa, Dengue virus
DIVLEHGSCVT

SEQ ID NO: 119994 - protein, 11 aa, Dengue virus
IVLEHGSCVTT

SEQ ID NO: 119995 - protein, 11 aa, Dengue virus
VLEHGGCVTTM

SEQ ID NO: 119996 - protein, 11 aa, Dengue virus
LEHGGCVTTMA

SEQ ID NO: 119997 - protein, 11 aa, Dengue virus
EHGGCVTTMAK

SEQ ID NO: 119998 - protein, 11 aa, Dengue virus
HGSCVTTMAKD

SEQ ID NO: 119999 - protein, 11 aa, Dengue virus
GSCVTTMAKDK

SEQ ID NO: 120000 - protein, 11 aa, Dengue virus
SCVTTMAKDKP

SEQ ID NO: 120001 - protein, 11 aa, Dengue virus
CVTTMAKDKPT

SEQ ID NO: 120002 - protein, 11 aa, Dengue virus
VTTMAKDKPTL

SEQ ID NO: 120003 - protein, 11 aa, Dengue virus
TTMAKDKPTLD

SEQ ID NO: 120004 - protein, 11 aa, Dengue virus
TMAKNKPTLDF

SEQ ID NO: 120005 - protein, 11 aa, Dengue virus
MAKNKPTLDFE

SEQ ID NO: 120006 - protein, 11 aa, Dengue virus
AKNKPTLDFEL

SEQ ID NO: 120007 - protein, 11 aa, Dengue virus
KPTLDFELIKT

SEQ ID NO: 120008 - protein, 11 aa, Dengue virus
PTLDFELIKTE

SEQ ID NO: 120009 - protein, 11 aa, Dengue virus
TLDFELIKTEA

SEQ ID NO: 120010 - protein, 11 aa, Dengue virus
LDFELIKTEAK

SEQ ID NO: 120011 - protein, 11 aa, Dengue virus
TTESRCPTQGE

SEQ ID NO: 120012 - protein, 11 aa, Dengue virus
TESRCPTQGEP

SEQ ID NO: 120013 - protein, 11 aa, Dengue virus
CKHSMVDRGWG

SEQ ID NO: 120014 - protein, 11 aa, Dengue virus
KHSMVDRGWGN

SEQ ID NO: 120015 - protein, 11 aa, Dengue virus
HSMVDRGWGNG

SEQ ID NO: 120016 - protein, 11 aa, Dengue virus
SMVDRGWGNGC

SEQ ID NO: 120017 - protein, 11 aa, Dengue virus
MVDRGWGNGCG

SEQ ID NO: 120018 - protein, 11 aa, Dengue virus
GNGCGLFGKGG

SEQ ID NO: 120019 - protein, 11 aa, Dengue virus
NGCGLFGKGGI

SEQ ID NO: 120020 - protein, 11 aa, Dengue virus
GCGLFGKGGIV

SEQ ID NO: 120021 - protein, 11 aa, Dengue virus
CGLFGKGGIVT

SEQ ID NO: 120022 - protein, 11 aa, Dengue virus
GLFGKGGIVTC

SEQ ID NO: 120023 - protein, 11 aa, Dengue virus
LFGKGGIVTCA

SEQ ID NO: 120024 - protein, 11 aa, Dengue virus
FGKGGIVTCAM

SEQ ID NO: 120025 - protein, 11 aa, Dengue virus
GKGGIVTCAMF

SEQ ID NO: 120026 - protein, 11 aa, Dengue virus
TPHSGEEHAVG

SEQ ID NO: 120027 - protein, 11 aa, Dengue virus
PHSGEEHAVGN

SEQ ID NO: 120028 - protein, 11 aa, Dengue virus
HSGEEHAVGND

SEQ ID NO: 120029 - protein, 11 aa, Dengue virus
VTMECSPRTGL

SEQ ID NO: 120030 - protein, 11 aa, Dengue virus
TMECSPRTGLD

SEQ ID NO: 120031 - protein, 11 aa, Dengue virus
MECSPRTGLDF

SEQ ID NO: 120032 - protein, 11 aa, Dengue virus
DCSPRTGLDFN

SEQ ID NO: 120033 - protein, 11 aa, Dengue virus
CEPRSGIDFNE

SEQ ID NO: 120034 - protein, 11 aa, Dengue virus
EPRSGIDFNEM

SEQ ID NO: 120035 - protein, 11 aa, Dengue virus
PRTGLDFNEMI

SEQ ID NO: 120036 - protein, 11 aa, Dengue virus
RTGLDFNEMIL

SEQ ID NO: 120037 - protein, 11 aa, Dengue virus
TGLDFNEMILL

SEQ ID NO: 120038 - protein, 11 aa, Dengue virus
GLDFNEMVLLQ

SEQ ID NO: 120039 - protein, 11 aa, Dengue virus
LDFNEMVLLQM

SEQ ID NO: 120040 - protein, 11 aa, Dengue virus
KAWLVHRQWFL

SEQ ID NO: 120041 - protein, 11 aa, Dengue virus
AWLVHRQWFLD

SEQ ID NO: 120042 - protein, 11 aa, Dengue virus
WLVHRQWFLDL

SEQ ID NO: 120043 - protein, 11 aa, Dengue virus
LVHRQWFLDLP

SEQ ID NO: 120044 - protein, 11 aa, Dengue virus
VHRQWFLDLPL

SEQ ID NO: 120045 - protein, 11 aa, Dengue virus
HRQWFLDLPLP

SEQ ID NO: 120046 - protein, 11 aa, Dengue virus
RQWFLDLPLPW

SEQ ID NO: 120047 - protein, 11 aa, Dengue virus
QWFLDLPLPWL

SEQ ID NO: 120048 - protein, 11 aa, Dengue virus
KETLVTFKNPH

SEQ ID NO: 120049 - protein, 11 aa, Dengue virus
ETLVTFKNPHA

SEQ ID NO: 120050 - protein, 11 aa, Dengue virus
TLVTFKNPHAK

SEQ ID NO: 120051 - protein, 11 aa, Dengue virus
LVTFKNPHAKK

SEQ ID NO: 120052 - protein, 11 aa, Dengue virus
VTFKNPHAKKQ

SEQ ID NO: 120053 - protein, 11 aa, Dengue virus
TFKNPHAKKQD

SEQ ID NO: 120054 - protein, 11 aa, Dengue virus
FKNPHAKKQDV

SEQ ID NO: 120055 - protein, 11 aa, Dengue virus
KNPHAKKQDVV

SEQ ID NO: 120056 - protein, 11 aa, Dengue virus
NPHAKKQDVVV

SEQ ID NO: 120057 - protein, 11 aa, Dengue virus
PHAKKQDVVVL

SEQ ID NO: 120058 - protein, 11 aa, Dengue virus
HAKKQDVVVLG

SEQ ID NO: 120059 - protein, 11 aa, Dengue virus
AKKQDVVVLGS

SEQ ID NO: 120060 - protein, 11 aa, Dengue virus
KKQDVVVLGSQ

SEQ ID NO: 120061 - protein, 11 aa, Dengue virus
KQDVVVLGSQE

SEQ ID NO: 120062 - protein, 11 aa, Dengue virus
QDVVVLGSQEG

SEQ ID NO: 120063 - protein, 11 aa, Dengue virus
DVVVLGSQEGA

SEQ ID NO: 120064 - protein, 11 aa, Dengue virus
VTVLGSQEGAM

SEQ ID NO: 120065 - protein, 11 aa, Dengue virus
TVLGSQEGAMH

SEQ ID NO: 120066 - protein, 11 aa, Dengue virus
VLGSQEGAMHS

SEQ ID NO: 120067 - protein, 11 aa, Dengue virus
LGSQEGAMHSA

SEQ ID NO: 120068 - protein, 11 aa, Dengue virus
GSQEGAMHSAL

SEQ ID NO: 120069 - protein, 11 aa, Dengue virus
SQEGAMHSALA

SEQ ID NO: 120070 - protein, 11 aa, Dengue virus
QEGAMHSALAG

SEQ ID NO: 120071 - protein, 11 aa, Dengue virus
EGAMHSALAGA

SEQ ID NO: 120072 - protein, 11 aa, Dengue virus
GAMHSALAGAT

SEQ ID NO: 120073 - protein, 11 aa, Dengue virus
AMHSALAGATE

SEQ ID NO: 120074 - protein, 11 aa, Dengue virus
MHSALAGATEV

SEQ ID NO: 120075 - protein, 11 aa, Dengue virus
HSALAGATEVD

SEQ ID NO: 120076 - protein, 11 aa, Dengue virus
TALTGATEIQM

SEQ ID NO: 120077 - protein, 11 aa, Dengue virus
ALTGATEIQMS

SEQ ID NO: 120078 - protein, 11 aa, Dengue virus
SGNLLFTGHLK

SEQ ID NO: 120079 - protein, 11 aa, Dengue virus
GNLLFTGHLKC

SEQ ID NO: 120080 - protein, 11 aa, Dengue virus
NLLFTGHLKCR

SEQ ID NO: 120081 - protein, 11 aa, Dengue virus
LLFTGHLKCRL

SEQ ID NO: 120082 - protein, 11 aa, Dengue virus
LFTGHLKCRLR

SEQ ID NO: 120083 - protein, 11 aa, Dengue virus
FTGHLKCRLRM

SEQ ID NO: 120084 - protein, 11 aa, Dengue virus
TGHLKCRLRMD

SEQ ID NO: 120085 - protein, 11 aa, Dengue virus
GHLKCRLRMDK

SEQ ID NO: 120086 - protein, 11 aa, Dengue virus
HLKCRLRMDKL

SEQ ID NO: 120087 - protein, 11 aa, Dengue virus
LKCRLRMDKLQ

SEQ ID NO: 120088 - protein, 11 aa, Dengue virus
KCRLRMDKLQL

SEQ ID NO: 120089 - protein, 11 aa, Dengue virus
CRLRMDKLQLK

SEQ ID NO: 120090 - protein, 11 aa, Dengue virus
RLRMDKLQLKG

SEQ ID NO: 120091 - protein, 11 aa, Dengue virus
VKEIAETQHGT

SEQ ID NO: 120092 - protein, 11 aa, Dengue virus
KEIAETQHGTI

SEQ ID NO: 120093 - protein, 11 aa, Dengue virus
EIAETQHGTIV

SEQ ID NO: 120094 - protein, 11 aa, Dengue virus
IAETQHGTIVI

SEQ ID NO: 120095 - protein, 11 aa, Dengue virus
AETQHGTIVIR

SEQ ID NO: 120096 - protein, 11 aa, Dengue virus
PVNIETEPPFG

SEQ ID NO: 120097 - protein, 11 aa, Dengue virus
VNIEAEPPFGD

SEQ ID NO: 120098 - protein, 11 aa, Dengue virus
NIEAEPPFGDS

SEQ ID NO: 120099 - protein, 11 aa, Dengue virus
IEAEPPFGDSY

SEQ ID NO: 120100 - protein, 11 aa, Dengue virus
EAEPPFGDSYI

SEQ ID NO: 120101 - protein, 11 aa, Dengue virus
GSSIGQMFETT

SEQ ID NO: 120102 - protein, 11 aa, Dengue virus
IGQMFETTMRG

SEQ ID NO: 120103 - protein, 11 aa, Dengue virus
GQMFETTMRGA

SEQ ID NO: 120104 - protein, 11 aa, Dengue virus
QMFETTMRGAK

SEQ ID NO: 120105 - protein, 11 aa, Dengue virus
MFETTMRGAKR

SEQ ID NO: 120106 - protein, 11 aa, Dengue virus
FETTMRGAKRM

SEQ ID NO: 120107 - protein, 11 aa, Dengue virus
ETTMRGAKRMA

SEQ ID NO: 120108 - protein, 11 aa, Dengue virus
TTMRGAKRMAI

SEQ ID NO: 120109 - protein, 11 aa, Dengue virus
TMRGAKRMAIL

SEQ ID NO: 120110 - protein, 11 aa, Dengue virus
MRGAKRMAILG

SEQ ID NO: 120111 - protein, 11 aa, Dengue virus
RGAKRMAILGD

SEQ ID NO: 120112 - protein, 11 aa, Dengue virus
GAKRMAILGDT

SEQ ID NO: 120113 - protein, 11 aa, Dengue virus
AKRMAILGDTA

SEQ ID NO: 120114 - protein, 11 aa, Dengue virus
KRMAILGDTAW

SEQ ID NO: 120115 - protein, 11 aa, Dengue virus
RMAILGETAWD

SEQ ID NO: 120116 - protein, 11 aa, Dengue virus
MAILGETAWDF

SEQ ID NO: 120117 - protein, 11 aa, Dengue virus
AILGETAWDFG

SEQ ID NO: 120118 - protein, 11 aa, Dengue virus
ILGETAWDFGS

SEQ ID NO: 120119 - protein, 11 aa, Dengue virus
LGDTAWDFGSL

SEQ ID NO: 120120 - protein, 11 aa, Dengue virus
GDTAWDFGSLG

SEQ ID NO: 120121 - protein, 11 aa, Dengue virus
DTAWDFGSLGG

SEQ ID NO: 120122 - protein, 11 aa, Dengue virus
TAWDFGSLGGV

SEQ ID NO: 120123 - protein, 11 aa, Dengue virus
IYGAAFSGVSW

SEQ ID NO: 120124 - protein, 11 aa, Dengue virus
NKELKCGSGIF

SEQ ID NO: 120125 - protein, 11 aa, Dengue virus
KELKCGSGIFI

SEQ ID NO: 120126 - protein, 11 aa, Dengue virus
ELKCGSGIFIT

SEQ ID NO: 120127 - protein, 11 aa, Dengue virus
LKCGSGIFITD

SEQ ID NO: 120128 - protein, 11 aa, Dengue virus
KCGSGIFITDN

SEQ ID NO: 120129 - protein, 11 aa, Dengue virus
CGSGIFITDNV

SEQ ID NO: 120130 - protein, 11 aa, Dengue virus
GSGIFITDNVH

SEQ ID NO: 120131 - protein, 11 aa, Dengue virus
SGIFITDNVHT

SEQ ID NO: 120132 - protein, 11 aa, Dengue virus
GIFITDNVHTW

SEQ ID NO: 120133 - protein, 11 aa, Dengue virus
IFITDNVHTWT

SEQ ID NO: 120134 - protein, 11 aa, Dengue virus
FITDNVHTWTE

SEQ ID NO: 120135 - protein, 11 aa, Dengue virus
ITDNVHTWTEQ

SEQ ID NO: 120136 - protein, 11 aa, Dengue virus
TDNVHTWTEQY

SEQ ID NO: 120137 - protein, 11 aa, Dengue virus
DNVHTWTEQYK

SEQ ID NO: 120138 - protein, 11 aa, Dengue virus
NVHTWTEQYKF

SEQ ID NO: 120139 - protein, 11 aa, Dengue virus
HTWTEQYKFQP

SEQ ID NO: 120140 - protein, 11 aa, Dengue virus
TWTEQYKFQPE

SEQ ID NO: 120141 - protein, 11 aa, Dengue virus
WTEQYKFQPES

SEQ ID NO: 120142 - protein, 11 aa, Dengue virus
TEQYKFQPESP

SEQ ID NO: 120143 - protein, 11 aa, Dengue virus
EQYKFQPESPS

SEQ ID NO: 120144 - protein, 11 aa, Dengue virus
QYKFQPESPSK

SEQ ID NO: 120145 - protein, 11 aa, Dengue virus
YKFQPESPSKL

SEQ ID NO: 120146 - protein, 11 aa, Dengue virus
KFQPESPSKLA

SEQ ID NO: 120147 - protein, 11 aa, Dengue virus
FQPESPSKLAS

SEQ ID NO: 120148 - protein, 11 aa, Dengue virus
QPESPSKLASA

SEQ ID NO: 120149 - protein, 11 aa, Dengue virus
PESPSKLASAI

SEQ ID NO: 120150 - protein, 11 aa, Dengue virus
ESPSKLASAIQ

SEQ ID NO: 120151 - protein, 11 aa, Dengue virus
SPSKLASAIQK

SEQ ID NO: 120152 - protein, 11 aa, Dengue virus
PSKLASAIQKA

SEQ ID NO: 120153 - protein, 11 aa, Dengue virus
GICGIRSVTRL

SEQ ID NO: 120154 - protein, 11 aa, Dengue virus
ICGIRSVTRLE

SEQ ID NO: 120155 - protein, 11 aa, Dengue virus
CGIRSVTRLEN

SEQ ID NO: 120156 - protein, 11 aa, Dengue virus
GIRSVTRLENL

SEQ ID NO: 120157 - protein, 11 aa, Dengue virus
IRSVTRLENLM

SEQ ID NO: 120158 - protein, 11 aa, Dengue virus
RSVTRLENLMW

SEQ ID NO: 120159 - protein, 11 aa, Dengue virus
TRLENLMWKQI

SEQ ID NO: 120160 - protein, 11 aa, Dengue virus
RAWNSLEVEDY

SEQ ID NO: 120161 - protein, 11 aa, Dengue virus
AWNSLEVEDYG

SEQ ID NO: 120162 - protein, 11 aa, Dengue virus
WNSLEVEDYGF

SEQ ID NO: 120163 - protein, 11 aa, Dengue virus
NSLEVEDYGFG

SEQ ID NO: 120164 - protein, 11 aa, Dengue virus
LEVEDYGFGVF

SEQ ID NO: 120165 - protein, 11 aa, Dengue virus
EVEDYGFGIFT

SEQ ID NO: 120166 - protein, 11 aa, Dengue virus
VEDYGFGIFTT

SEQ ID NO: 120167 - protein, 11 aa, Dengue virus
EDYGFGIFTTN

SEQ ID NO: 120168 - protein, 11 aa, Dengue virus
DYGFGIFTTNI

SEQ ID NO: 120169 - protein, 11 aa, Dengue virus
YGFGIFTTNIW

SEQ ID NO: 120170 - protein, 11 aa, Dengue virus
GFGIFTTNIWL

SEQ ID NO: 120171 - protein, 11 aa, Dengue virus
FGIFTTNIWLK

SEQ ID NO: 120172 - protein, 11 aa, Dengue virus
CDSKLMSAAIK

SEQ ID NO: 120173 - protein, 11 aa, Dengue virus
DSKLMSAAIKD

SEQ ID NO: 120174 - protein, 11 aa, Dengue virus
KDNRAVHADMG

SEQ ID NO: 120175 - protein, 11 aa, Dengue virus
DNRAVHADMGY

SEQ ID NO: 120176 - protein, 11 aa, Dengue virus
NRAVHADMGYW

SEQ ID NO: 120177 - protein, 11 aa, Dengue virus
KAVHADMGYWI

SEQ ID NO: 120178 - protein, 11 aa, Dengue virus
HADMGYWIESA

SEQ ID NO: 120179 - protein, 11 aa, Dengue virus
ADMGYWIESAL

SEQ ID NO: 120180 - protein, 11 aa, Dengue virus
DMGYWIESALN

SEQ ID NO: 120181 - protein, 11 aa, Dengue virus
WPKTHTLWSNG

SEQ ID NO: 120182 - protein, 11 aa, Dengue virus
PKTHTLWSNGV

SEQ ID NO: 120183 - protein, 11 aa, Dengue virus
KTHTLWSNGVL

SEQ ID NO: 120184 - protein, 11 aa, Dengue virus
THTLWSNGVLE

SEQ ID NO: 120185 - protein, 11 aa, Dengue virus
TLWSNGVLESD

SEQ ID NO: 120186 - protein, 11 aa, Dengue virus
LWSNGVLESDM

SEQ ID NO: 120187 - protein, 11 aa, Dengue virus
WSNGVLESDMI

SEQ ID NO: 120188 - protein, 11 aa, Dengue virus
SNGVLESDMII

SEQ ID NO: 120189 - protein, 11 aa, Dengue virus
NGVLESDMIIP

SEQ ID NO: 120190 - protein, 11 aa, Dengue virus
GVLESDMIIPK

SEQ ID NO: 120191 - protein, 11 aa, Dengue virus
TQIAGPWHLGK

SEQ ID NO: 120192 - protein, 11 aa, Dengue virus
QIAGPWHLGKL

SEQ ID NO: 120193 - protein, 11 aa, Dengue virus
AGPWHLGKLEM

SEQ ID NO: 120194 - protein, 11 aa, Dengue virus
GPWHLGKLEMD

SEQ ID NO: 120195 - protein, 11 aa, Dengue virus
PWHLGKLEMDF

SEQ ID NO: 120196 - protein, 11 aa, Dengue virus
CGTRGPSLRTT

SEQ ID NO: 120197 - protein, 11 aa, Dengue virus
GTRGPSLRTTT

SEQ ID NO: 120198 - protein, 11 aa, Dengue virus
RGPSLRTTTAS

SEQ ID NO: 120199 - protein, 11 aa, Dengue virus
GPSLRTTTASG

SEQ ID NO: 120200 - protein, 11 aa, Dengue virus
PSLRTTTASGK

SEQ ID NO: 120201 - protein, 11 aa, Dengue virus
SLRTTTASGKL

SEQ ID NO: 120202 - protein, 11 aa, Dengue virus
LRTTTASGKLI

SEQ ID NO: 120203 - protein, 11 aa, Dengue virus
RTTTASGKLIT

SEQ ID NO: 120204 - protein, 11 aa, Dengue virus
TTTASGKLITE

SEQ ID NO: 120205 - protein, 11 aa, Dengue virus
TTASGKLITEW

SEQ ID NO: 120206 - protein, 11 aa, Dengue virus
TASGKLITEWC

SEQ ID NO: 120207 - protein, 11 aa, Dengue virus
ASGKLITEWCC

SEQ ID NO: 120208 - protein, 11 aa, Dengue virus
SGKLITEWCCR

SEQ ID NO: 120209 - protein, 11 aa, Dengue virus
GKLITEWCCRS

SEQ ID NO: 120210 - protein, 11 aa, Dengue virus
KLITEWCCRSC

SEQ ID NO: 120211 - protein, 11 aa, Dengue virus
LITEWCCRSCT

SEQ ID NO: 120212 - protein, 11 aa, Dengue virus
ITEWCCRSCTL

SEQ ID NO: 120213 - protein, 11 aa, Dengue virus
TEWCCRSCTLP

SEQ ID NO: 120214 - protein, 11 aa, Dengue virus
QWCCRSCTMPP

SEQ ID NO: 120215 - protein, 11 aa, Dengue virus
WCCRSCTMPPL

SEQ ID NO: 120216 - protein, 11 aa, Dengue virus
CCRSCTMPPLR

SEQ ID NO: 120217 - protein, 11 aa, Dengue virus
CRSCTLPPLRF

SEQ ID NO: 120218 - protein, 11 aa, Dengue virus
RSCTLPPLRFR

SEQ ID NO: 120219 - protein, 11 aa, Dengue virus
SCTLPPLRFRG

SEQ ID NO: 120220 - protein, 11 aa, Dengue virus
CTLPPLRFRGE

SEQ ID NO: 120221 - protein, 11 aa, Dengue virus
TLPPLRFRGED

SEQ ID NO: 120222 - protein, 11 aa, Dengue virus
LPPLRFRGEDG

SEQ ID NO: 120223 - protein, 11 aa, Dengue virus
PPLRFRGEDGC

SEQ ID NO: 120224 - protein, 11 aa, Dengue virus
PLRFRGEDGCW

SEQ ID NO: 120225 - protein, 11 aa, Dengue virus
LRFRGEDGCWY

SEQ ID NO: 120226 - protein, 11 aa, Dengue virus
RFRGEDGCWYG

SEQ ID NO: 120227 - protein, 11 aa, Dengue virus
FRGEDGCWYGM

SEQ ID NO: 120228 - protein, 11 aa, Dengue virus
MGEDGCWYGME

SEQ ID NO: 120229 - protein, 11 aa, Dengue virus
GCWYGMEIRPL

SEQ ID NO: 120230 - protein, 11 aa, Dengue virus
ELTDALALGMM

SEQ ID NO: 120231 - protein, 11 aa, Dengue virus
RSWPLNEAIMA

SEQ ID NO: 120232 - protein, 11 aa, Dengue virus
SWPLNEAIMAV

SEQ ID NO: 120233 - protein, 11 aa, Dengue virus
WPLNEAIMAVG

SEQ ID NO: 120234 - protein, 11 aa, Dengue virus
VSILASSLLKN

SEQ ID NO: 120235 - protein, 11 aa, Dengue virus
SILASSLLKND

SEQ ID NO: 120236 - protein, 11 aa, Dengue virus
ILASSLLKNDI

SEQ ID NO: 120237 - protein, 11 aa, Dengue virus
LASSLLKNDIP

SEQ ID NO: 120238 - protein, 11 aa, Dengue virus
ASSLLKNDIPM

SEQ ID NO: 120239 - protein, 11 aa, Dengue virus
SSLLKNDIPMT

SEQ ID NO: 120240 - protein, 11 aa, Dengue virus
SLLKNDIPMTG

SEQ ID NO: 120241 - protein, 11 aa, Dengue virus
LLKNDIPMTGP

SEQ ID NO: 120242 - protein, 11 aa, Dengue virus
LKNDIPMTGPL

SEQ ID NO: 120243 - protein, 11 aa, Dengue virus
KNDIPMTGPLV

SEQ ID NO: 120244 - protein, 11 aa, Dengue virus
NDIPMTGPLVA

SEQ ID NO: 120245 - protein, 11 aa, Dengue virus
DIPMTGPLVAG

SEQ ID NO: 120246 - protein, 11 aa, Dengue virus
IPMTGPLVAGG

SEQ ID NO: 120247 - protein, 11 aa, Dengue virus
PMTGPLVAGGL

SEQ ID NO: 120248 - protein, 11 aa, Dengue virus
MTGPLVAGGLL

SEQ ID NO: 120249 - protein, 11 aa, Dengue virus
TGPLVAGGLLT

SEQ ID NO: 120250 - protein, 11 aa, Dengue virus
GPLVAGGLLTV

SEQ ID NO: 120251 - protein, 11 aa, Dengue virus
PLVAGGLLTVC

SEQ ID NO: 120252 - protein, 11 aa, Dengue virus
LVAGGLLTVCY

SEQ ID NO: 120253 - protein, 11 aa, Dengue virus
VAGGLLTVCYV

SEQ ID NO: 120254 - protein, 11 aa, Dengue virus
AGGLLTVCYVL

SEQ ID NO: 120255 - protein, 11 aa, Dengue virus
GGLLTVCYVLT

SEQ ID NO: 120256 - protein, 11 aa, Dengue virus
GLLTVCYVLTG

SEQ ID NO: 120257 - protein, 11 aa, Dengue virus
LLTVCYVLTGR

SEQ ID NO: 120258 - protein, 11 aa, Dengue virus
LTVCYVLTGRS

SEQ ID NO: 120259 - protein, 11 aa, Dengue virus
TVCYVLTGRSA

SEQ ID NO: 120260 - protein, 11 aa, Dengue virus
VCYVLTGRSAD

SEQ ID NO: 120261 - protein, 11 aa, Dengue virus
CYVLTGRSADL

SEQ ID NO: 120262 - protein, 11 aa, Dengue virus
YVLTGRSADLE

SEQ ID NO: 120263 - protein, 11 aa, Dengue virus
VLTGRSADLEL

SEQ ID NO: 120264 - protein, 11 aa, Dengue virus
LTGRSADLELE

SEQ ID NO: 120265 - protein, 11 aa, Dengue virus
TGRSADLELER

SEQ ID NO: 120266 - protein, 11 aa, Dengue virus
QAEISGSSPIL

SEQ ID NO: 120267 - protein, 11 aa, Dengue virus
AEISGSSPILS

SEQ ID NO: 120268 - protein, 11 aa, Dengue virus
SEDGSMSIKNE

SEQ ID NO: 120269 - protein, 11 aa, Dengue virus
EDGSMSIKNEE

SEQ ID NO: 120270 - protein, 11 aa, Dengue virus
DGSMSIKNEEE

SEQ ID NO: 120271 - protein, 11 aa, Dengue virus
GSMSIKNEEEE

SEQ ID NO: 120272 - protein, 11 aa, Dengue virus
LTILIRTGLLV

SEQ ID NO: 120273 - protein, 11 aa, Dengue virus
TILIRTGLLVI

SEQ ID NO: 120274 - protein, 11 aa, Dengue virus
ILIRTGLLVIS

SEQ ID NO: 120275 - protein, 11 aa, Dengue virus
LIRTGLLVISG

SEQ ID NO: 120276 - protein, 11 aa, Dengue virus
KKQRAGVLWDV

SEQ ID NO: 120277 - protein, 11 aa, Dengue virus
KQRAGVLWDVP

SEQ ID NO: 120278 - protein, 11 aa, Dengue virus
QRAGVLWDVPS

SEQ ID NO: 120279 - protein, 11 aa, Dengue virus
RAGVLWDVPSP

SEQ ID NO: 120280 - protein, 11 aa, Dengue virus
AGVLWDVPSPP

SEQ ID NO: 120281 - protein, 11 aa, Dengue virus
GVLWDVPSPPP

SEQ ID NO: 120282 - protein, 11 aa, Dengue virus
GYSQIGAGVYK

SEQ ID NO: 120283 - protein, 11 aa, Dengue virus
EGTFHTMWHVT

SEQ ID NO: 120284 - protein, 11 aa, Dengue virus
NVFHTMWHVTR

SEQ ID NO: 120285 - protein, 11 aa, Dengue virus
TFHTMWHVTRG

SEQ ID NO: 120286 - protein, 11 aa, Dengue virus
FHTMWHVTRGS

SEQ ID NO: 120287 - protein, 11 aa, Dengue virus
HTMWHVTRGSV

SEQ ID NO: 120288 - protein, 11 aa, Dengue virus
TMWHVTRGSVI

SEQ ID NO: 120289 - protein, 11 aa, Dengue virus
MWHVTRGAVLT

SEQ ID NO: 120290 - protein, 11 aa, Dengue virus
WHVTRGAVLMH

SEQ ID NO: 120291 - protein, 11 aa, Dengue virus
GKRIEPSWADV

SEQ ID NO: 120292 - protein, 11 aa, Dengue virus
KRIEPSWADVK

SEQ ID NO: 120293 - protein, 11 aa, Dengue virus
RIEPSWADVKK

SEQ ID NO: 120294 - protein, 11 aa, Dengue virus
IEPSWADVKKD

SEQ ID NO: 120295 - protein, 11 aa, Dengue virus
EPSWADVKKDL

SEQ ID NO: 120296 - protein, 11 aa, Dengue virus
WADVKKDLISY

SEQ ID NO: 120297 - protein, 11 aa, Dengue virus
ADVKKDLISYG

SEQ ID NO: 120298 - protein, 11 aa, Dengue virus
DVKKDLISYGG

SEQ ID NO: 120299 - protein, 11 aa, Dengue virus
VRNDMISYGGG

SEQ ID NO: 120300 - protein, 11 aa, Dengue virus
RNDMISYGGGW

SEQ ID NO: 120301 - protein, 11 aa, Dengue virus
KDLISYGGGWK

SEQ ID NO: 120302 - protein, 11 aa, Dengue virus
DLISYGGGWKL

SEQ ID NO: 120303 - protein, 11 aa, Dengue virus
WKEGEEVQVLA

SEQ ID NO: 120304 - protein, 11 aa, Dengue virus
EGEEVQVLALE

SEQ ID NO: 120305 - protein, 11 aa, Dengue virus
GEEVQVLALEP

SEQ ID NO: 120306 - protein, 11 aa, Dengue virus
EEVQVLALEPG

SEQ ID NO: 120307 - protein, 11 aa, Dengue virus
EVQVLALEPGK

SEQ ID NO: 120308 - protein, 11 aa, Dengue virus
VQVLALEPGKN

SEQ ID NO: 120309 - protein, 11 aa, Dengue virus
QVLALEPGKNP

SEQ ID NO: 120310 - protein, 11 aa, Dengue virus
VLALEPGKNPR

SEQ ID NO: 120311 - protein, 11 aa, Dengue virus
LALEPGKNPRA

SEQ ID NO: 120312 - protein, 11 aa, Dengue virus
ALEPGKNPRAV

SEQ ID NO: 120313 - protein, 11 aa, Dengue virus
LEPGKNPRAVQ

SEQ ID NO: 120314 - protein, 11 aa, Dengue virus
EPGKNPRAVQT

SEQ ID NO: 120315 - protein, 11 aa, Dengue virus
TGTIGAVSLDF

SEQ ID NO: 120316 - protein, 11 aa, Dengue virus
GTIGAVSLDFS

SEQ ID NO: 120317 - protein, 11 aa, Dengue virus
TIGAVSLDFSP

SEQ ID NO: 120318 - protein, 11 aa, Dengue virus
IGAVSLDFSPG

SEQ ID NO: 120319 - protein, 11 aa, Dengue virus
GAVSLDFSPGT

SEQ ID NO: 120320 - protein, 11 aa, Dengue virus
AVSLDFSPGTS

SEQ ID NO: 120321 - protein, 11 aa, Dengue virus
VSLDFSPGTSG

SEQ ID NO: 120322 - protein, 11 aa, Dengue virus
SLDFSPGTSGS

SEQ ID NO: 120323 - protein, 11 aa, Dengue virus
LDFSPGTSGSP

SEQ ID NO: 120324 - protein, 11 aa, Dengue virus
DFSPGTSGSPI

SEQ ID NO: 120325 - protein, 11 aa, Dengue virus
FKPGTSGSPII

SEQ ID NO: 120326 - protein, 11 aa, Dengue virus
KPGTSGSPIIN

SEQ ID NO: 120327 - protein, 11 aa, Dengue virus
PGTSGSPIINR

SEQ ID NO: 120328 - protein, 11 aa, Dengue virus
KGKVVGLYGNG

SEQ ID NO: 120329 - protein, 11 aa, Dengue virus
GKIVGLYGNGV

SEQ ID NO: 120330 - protein, 11 aa, Dengue virus
KIVGLYGNGVV

SEQ ID NO: 120331 - protein, 11 aa, Dengue virus
IVGLYGNGVVT

SEQ ID NO: 120332 - protein, 11 aa, Dengue virus
VGLYGNGVVTR

SEQ ID NO: 120333 - protein, 11 aa, Dengue virus
GLYGNGVVTRS

SEQ ID NO: 120334 - protein, 11 aa, Dengue virus
LYGNGVVTRSG

SEQ ID NO: 120335 - protein, 11 aa, Dengue virus
YGNGVVTRSGA

SEQ ID NO: 120336 - protein, 11 aa, Dengue virus
GNGVVTRSGAY

SEQ ID NO: 120337 - protein, 11 aa, Dengue virus
NGVVTRSGAYV

SEQ ID NO: 120338 - protein, 11 aa, Dengue virus
GVVTRSGAYVS

SEQ ID NO: 120339 - protein, 11 aa, Dengue virus
IFRKKRLTIMD

SEQ ID NO: 120340 - protein, 11 aa, Dengue virus
FKKRNLTIMDL

SEQ ID NO: 120341 - protein, 11 aa, Dengue virus
KKRNLTIMDLH

SEQ ID NO: 120342 - protein, 11 aa, Dengue virus
KKRLTIMDLHP

SEQ ID NO: 120343 - protein, 11 aa, Dengue virus
KRLTIMDLHPG

SEQ ID NO: 120344 - protein, 11 aa, Dengue virus
RLTIMDLHPGA

SEQ ID NO: 120345 - protein, 11 aa, Dengue virus
LTIMDLHPGAG

SEQ ID NO: 120346 - protein, 11 aa, Dengue virus
TIMDLHPGAGK

SEQ ID NO: 120347 - protein, 11 aa, Dengue virus
IMDLHPGAGKT

SEQ ID NO: 120348 - protein, 11 aa, Dengue virus
MDLHPGAGKTK

SEQ ID NO: 120349 - protein, 11 aa, Dengue virus
DLHPGAGKTKR

SEQ ID NO: 120350 - protein, 11 aa, Dengue virus
LHPGAGKTKRY

SEQ ID NO: 120351 - protein, 11 aa, Dengue virus
HPGAGKTKRYL

SEQ ID NO: 120352 - protein, 11 aa, Dengue virus
PGAGKTKRYLP

SEQ ID NO: 120353 - protein, 11 aa, Dengue virus
GAGKTKRYLPA

SEQ ID NO: 120354 - protein, 11 aa, Dengue virus
AGKTKRYLPAI

SEQ ID NO: 120355 - protein, 11 aa, Dengue virus
KYLPAIVREAI

SEQ ID NO: 120356 - protein, 11 aa, Dengue virus
ILPSIVREALK

SEQ ID NO: 120357 - protein, 11 aa, Dengue virus
LPSIVREALKR

SEQ ID NO: 120358 - protein, 11 aa, Dengue virus
REAIKRGLRTL

SEQ ID NO: 120359 - protein, 11 aa, Dengue virus
KRGLRTLILAP

SEQ ID NO: 120360 - protein, 11 aa, Dengue virus
RGLRTLILAPT

SEQ ID NO: 120361 - protein, 11 aa, Dengue virus
GLRTLILAPTR

SEQ ID NO: 120362 - protein, 11 aa, Dengue virus
LRTLVLAPTRV

SEQ ID NO: 120363 - protein, 11 aa, Dengue virus
RTLVLAPTRVV

SEQ ID NO: 120364 - protein, 11 aa, Dengue virus
TLVLAPTRVVA

SEQ ID NO: 120365 - protein, 11 aa, Dengue virus
LILAPTRVVAS

SEQ ID NO: 120366 - protein, 11 aa, Dengue virus
ILAPTRVVASE

SEQ ID NO: 120367 - protein, 11 aa, Dengue virus
LAPTRVVASEM

SEQ ID NO: 120368 - protein, 11 aa, Dengue virus
APTRVVASEMA

SEQ ID NO: 120369 - protein, 11 aa, Dengue virus
PTRVVASEMAE

SEQ ID NO: 120370 - protein, 11 aa, Dengue virus
TRVVASEMAEA

SEQ ID NO: 120371 - protein, 11 aa, Dengue virus
RVVASEMAEAL

SEQ ID NO: 120372 - protein, 11 aa, Dengue virus
VVAAEMEEALR

SEQ ID NO: 120373 - protein, 11 aa, Dengue virus
VAAEMEEALRG

SEQ ID NO: 120374 - protein, 11 aa, Dengue virus
AAEMEEALRGL

SEQ ID NO: 120375 - protein, 11 aa, Dengue virus
AEMEEALRGLP

SEQ ID NO: 120376 - protein, 11 aa, Dengue virus
EMEEALRGLPI

SEQ ID NO: 120377 - protein, 11 aa, Dengue virus
MEEALRGLPIR

SEQ ID NO: 120378 - protein, 11 aa, Dengue virus
EEALRGLPIRY

SEQ ID NO: 120379 - protein, 11 aa, Dengue virus
EALRGLPIRYQ

SEQ ID NO: 120380 - protein, 11 aa, Dengue virus
ALRGLPIRYQT

SEQ ID NO: 120381 - protein, 11 aa, Dengue virus
LRGLPIRYQTP

SEQ ID NO: 120382 - protein, 11 aa, Dengue virus
RGLPIRYQTPA

SEQ ID NO: 120383 - protein, 11 aa, Dengue virus
GLPIRYQTPAI

SEQ ID NO: 120384 - protein, 11 aa, Dengue virus
KSEHTGREIVD

SEQ ID NO: 120385 - protein, 11 aa, Dengue virus
SEHTGREIVDL

SEQ ID NO: 120386 - protein, 11 aa, Dengue virus
EHTGKEIVDLM

SEQ ID NO: 120387 - protein, 11 aa, Dengue virus
HTGKEIVDLMC

SEQ ID NO: 120388 - protein, 11 aa, Dengue virus
TGKEIVDLMCH

SEQ ID NO: 120389 - protein, 11 aa, Dengue virus
GKEIVDLMCHA

SEQ ID NO: 120390 - protein, 11 aa, Dengue virus
KEIVDLMCHAT

SEQ ID NO: 120391 - protein, 11 aa, Dengue virus
VDLMCHATFTT

SEQ ID NO: 120392 - protein, 11 aa, Dengue virus
DLMCHATFTTR

SEQ ID NO: 120393 - protein, 11 aa, Dengue virus
LMCHATFTTRL

SEQ ID NO: 120394 - protein, 11 aa, Dengue virus
MCHATFTTRLL

SEQ ID NO: 120395 - protein, 11 aa, Dengue virus
CHATFTTRLLS

SEQ ID NO: 120396 - protein, 11 aa, Dengue virus
HATFTTRLLSS

SEQ ID NO: 120397 - protein, 11 aa, Dengue virus
ATFTTRLLSST

SEQ ID NO: 120398 - protein, 11 aa, Dengue virus
TFTTRLLSSTR

SEQ ID NO: 120399 - protein, 11 aa, Dengue virus
FTTRLLSSTRV

SEQ ID NO: 120400 - protein, 11 aa, Dengue virus
TTRLLSSTRVP

SEQ ID NO: 120401 - protein, 11 aa, Dengue virus
TRLLSSTRVPN

SEQ ID NO: 120402 - protein, 11 aa, Dengue virus
RLLSSTRVPNY

SEQ ID NO: 120403 - protein, 11 aa, Dengue virus
LLSSTRVPNYN

SEQ ID NO: 120404 - protein, 11 aa, Dengue virus
LSPVRVPNYNM

SEQ ID NO: 120405 - protein, 11 aa, Dengue virus
SPVRVPNYNMI

SEQ ID NO: 120406 - protein, 11 aa, Dengue virus
PVRVPNYNMII

SEQ ID NO: 120407 - protein, 11 aa, Dengue virus
VRVPNYNMIIM

SEQ ID NO: 120408 - protein, 11 aa, Dengue virus
RVPNYNMIIMD

SEQ ID NO: 120409 - protein, 11 aa, Dengue virus
VPNYNMIIMDE

SEQ ID NO: 120410 - protein, 11 aa, Dengue virus
PNYNMIIMDEA

SEQ ID NO: 120411 - protein, 11 aa, Dengue virus
NYNMIIMDEAH

SEQ ID NO: 120412 - protein, 11 aa, Dengue virus
YNMIIMDEAHF

SEQ ID NO: 120413 - protein, 11 aa, Dengue virus
NMIIMDEAHFT

SEQ ID NO: 120414 - protein, 11 aa, Dengue virus
MIIMDEAHFTD

SEQ ID NO: 120415 - protein, 11 aa, Dengue virus
IVMDEAHFTDP

SEQ ID NO: 120416 - protein, 11 aa, Dengue virus
IMDEAHFTDPS

SEQ ID NO: 120417 - protein, 11 aa, Dengue virus
MDEAHFTDPSS

SEQ ID NO: 120418 - protein, 11 aa, Dengue virus
DEAHFTDPSSI

SEQ ID NO: 120419 - protein, 11 aa, Dengue virus
EAHFTDPSSIA

SEQ ID NO: 120420 - protein, 11 aa, Dengue virus
AHFTDPSSIAA

SEQ ID NO: 120421 - protein, 11 aa, Dengue virus
HFTDPSSIAAR

SEQ ID NO: 120422 - protein, 11 aa, Dengue virus
FTDPSSIAARG

SEQ ID NO: 120423 - protein, 11 aa, Dengue virus
TDPSSIAARGY

SEQ ID NO: 120424 - protein, 11 aa, Dengue virus
DPSSIAARGYI

SEQ ID NO: 120425 - protein, 11 aa, Dengue virus
PSSIAARGYIS

SEQ ID NO: 120426 - protein, 11 aa, Dengue virus
SSIAARGYIST

SEQ ID NO: 120427 - protein, 11 aa, Dengue virus
SVAARGYISTR

SEQ ID NO: 120428 - protein, 11 aa, Dengue virus
VAARGYISTRV

SEQ ID NO: 120429 - protein, 11 aa, Dengue virus
AARGYISTRVE

SEQ ID NO: 120430 - protein, 11 aa, Dengue virus
ARGYISTRVEM

SEQ ID NO: 120431 - protein, 11 aa, Dengue virus
RGYISTRVEMG

SEQ ID NO: 120432 - protein, 11 aa, Dengue virus
GYISTRVEMGE

SEQ ID NO: 120433 - protein, 11 aa, Dengue virus
YISTRVEMGEA

SEQ ID NO: 120434 - protein, 11 aa, Dengue virus
ISTRVEMGEAA

SEQ ID NO: 120435 - protein, 11 aa, Dengue virus
STRVEMGEAAG

SEQ ID NO: 120436 - protein, 11 aa, Dengue virus
TRVEMGEAAGI

SEQ ID NO: 120437 - protein, 11 aa, Dengue virus
RVEMGEAAGIF

SEQ ID NO: 120438 - protein, 11 aa, Dengue virus
VEMGEAAGIFM

SEQ ID NO: 120439 - protein, 11 aa, Dengue virus
EMGEAAGIFMT

SEQ ID NO: 120440 - protein, 11 aa, Dengue virus
MGEAAGIFMTA

SEQ ID NO: 120441 - protein, 11 aa, Dengue virus
GEAAGIFMTAT

SEQ ID NO: 120442 - protein, 11 aa, Dengue virus
EAAGIFMTATP

SEQ ID NO: 120443 - protein, 11 aa, Dengue virus
AAGIFMTATPP

SEQ ID NO: 120444 - protein, 11 aa, Dengue virus
AGIFMTATPPG

SEQ ID NO: 120445 - protein, 11 aa, Dengue virus
GIFMTATPPGS

SEQ ID NO: 120446 - protein, 11 aa, Dengue virus
IMDEEREIPER

SEQ ID NO: 120447 - protein, 11 aa, Dengue virus
MDEEREIPERS

SEQ ID NO: 120448 - protein, 11 aa, Dengue virus
DEEREIPERSW

SEQ ID NO: 120449 - protein, 11 aa, Dengue virus
EEREIPERSWN

SEQ ID NO: 120450 - protein, 11 aa, Dengue virus
EREIPERSWNS

SEQ ID NO: 120451 - protein, 11 aa, Dengue virus
REIPERSWNSG

SEQ ID NO: 120452 - protein, 11 aa, Dengue virus
FKGKTVWFVPS

SEQ ID NO: 120453 - protein, 11 aa, Dengue virus
KGKTVWFVPSI

SEQ ID NO: 120454 - protein, 11 aa, Dengue virus
KTVWFVPSIKS

SEQ ID NO: 120455 - protein, 11 aa, Dengue virus
TVWFVPSIKSG

SEQ ID NO: 120456 - protein, 11 aa, Dengue virus
VWFVPSIKSGN

SEQ ID NO: 120457 - protein, 11 aa, Dengue virus
WFVPSIKSGND

SEQ ID NO: 120458 - protein, 11 aa, Dengue virus
FVPSIKSGNDI

SEQ ID NO: 120459 - protein, 11 aa, Dengue virus
VPSIKSGNDIA

SEQ ID NO: 120460 - protein, 11 aa, Dengue virus
PSIKAGNDIAA

SEQ ID NO: 120461 - protein, 11 aa, Dengue virus
SIKAGNDIAAC

SEQ ID NO: 120462 - protein, 11 aa, Dengue virus
IKAGNDIAACL

SEQ ID NO: 120463 - protein, 11 aa, Dengue virus
KAGNDIAACLR

SEQ ID NO: 120464 - protein, 11 aa, Dengue virus
AGNDIAACLRK

SEQ ID NO: 120465 - protein, 11 aa, Dengue virus
GNDIAACLRKN

SEQ ID NO: 120466 - protein, 11 aa, Dengue virus
NDIAACLRKNG

SEQ ID NO: 120467 - protein, 11 aa, Dengue virus
DIAACLRKNGK

SEQ ID NO: 120468 - protein, 11 aa, Dengue virus
IAACLRKNGKK

SEQ ID NO: 120469 - protein, 11 aa, Dengue virus
AACLRKNGKKV

SEQ ID NO: 120470 - protein, 11 aa, Dengue virus
CLRKNGKRVIQ

SEQ ID NO: 120471 - protein, 11 aa, Dengue virus
LRKNGKRVIQL

SEQ ID NO: 120472 - protein, 11 aa, Dengue virus
RKNGKRVIQLS

SEQ ID NO: 120473 - protein, 11 aa, Dengue virus
KNGKRVIQLSR

SEQ ID NO: 120474 - protein, 11 aa, Dengue virus
NGKRVIQLSRK

SEQ ID NO: 120475 - protein, 11 aa, Dengue virus
GKRVIQLSRKT

SEQ ID NO: 120476 - protein, 11 aa, Dengue virus
KRVIQLSRKTF

SEQ ID NO: 120477 - protein, 11 aa, Dengue virus
RVIQLSRKTFD

SEQ ID NO: 120478 - protein, 11 aa, Dengue virus
VIQLSRKTFDS

SEQ ID NO: 120479 - protein, 11 aa, Dengue virus
IQLSRKTFDSE

SEQ ID NO: 120480 - protein, 11 aa, Dengue virus
QLSRKTFDSEY

SEQ ID NO: 120481 - protein, 11 aa, Dengue virus
LSRKTFDSEYV

SEQ ID NO: 120482 - protein, 11 aa, Dengue virus
SRKTFDSEYVK

SEQ ID NO: 120483 - protein, 11 aa, Dengue virus
LNDWDFVVTTD

SEQ ID NO: 120484 - protein, 11 aa, Dengue virus
NDWDYVVTTDI

SEQ ID NO: 120485 - protein, 11 aa, Dengue virus
DWDYVVTTDIS

SEQ ID NO: 120486 - protein, 11 aa, Dengue virus
WDYVVTTDISE

SEQ ID NO: 120487 - protein, 11 aa, Dengue virus
DYVVTTDISEM

SEQ ID NO: 120488 - protein, 11 aa, Dengue virus
YVVTTDISEMG

SEQ ID NO: 120489 - protein, 11 aa, Dengue virus
TDISEMGANFK

SEQ ID NO: 120490 - protein, 11 aa, Dengue virus
DISEMGANFKA

SEQ ID NO: 120491 - protein, 11 aa, Dengue virus
ISEMGANFKAE

SEQ ID NO: 120492 - protein, 11 aa, Dengue virus
SEMGANFKAER

SEQ ID NO: 120493 - protein, 11 aa, Dengue virus
EMGANFKAERV

SEQ ID NO: 120494 - protein, 11 aa, Dengue virus
MGANFKAERVI

SEQ ID NO: 120495 - protein, 11 aa, Dengue virus
GANFKAERVID

SEQ ID NO: 120496 - protein, 11 aa, Dengue virus
ANFKAERVIDP

SEQ ID NO: 120497 - protein, 11 aa, Dengue virus
NFKAERVIDPR

SEQ ID NO: 120498 - protein, 11 aa, Dengue virus
FKAERVIDPRR

SEQ ID NO: 120499 - protein, 11 aa, Dengue virus
KAERVIDPRRC

SEQ ID NO: 120500 - protein, 11 aa, Dengue virus
AERVIDPRRCM

SEQ ID NO: 120501 - protein, 11 aa, Dengue virus
ERVIDPRRCMK

SEQ ID NO: 120502 - protein, 11 aa, Dengue virus
RVIDPRRCMKP

SEQ ID NO: 120503 - protein, 11 aa, Dengue virus
VIDPRRCMKPV

SEQ ID NO: 120504 - protein, 11 aa, Dengue virus
IDPRRCMKPVI

SEQ ID NO: 120505 - protein, 11 aa, Dengue virus
DPRRCMKPVIL

SEQ ID NO: 120506 - protein, 11 aa, Dengue virus
PRRCMKPVILT

SEQ ID NO: 120507 - protein, 11 aa, Dengue virus
RRCMKPVILTD

SEQ ID NO: 120508 - protein, 11 aa, Dengue virus
RCMKPVILTDG

SEQ ID NO: 120509 - protein, 11 aa, Dengue virus
CMKPVILTDGE

SEQ ID NO: 120510 - protein, 11 aa, Dengue virus
MKPVILTDGEE

SEQ ID NO: 120511 - protein, 11 aa, Dengue virus
KPVILTDGEER

SEQ ID NO: 120512 - protein, 11 aa, Dengue virus
PVILTDGEERV

SEQ ID NO: 120513 - protein, 11 aa, Dengue virus
VILTDGEERVI

SEQ ID NO: 120514 - protein, 11 aa, Dengue virus
ILTDGEERVIL

SEQ ID NO: 120515 - protein, 11 aa, Dengue virus
LTDGEERVILA

SEQ ID NO: 120516 - protein, 11 aa, Dengue virus
TDGEERVILAG

SEQ ID NO: 120517 - protein, 11 aa, Dengue virus
DGEERVILAGP

SEQ ID NO: 120518 - protein, 11 aa, Dengue virus
GEERVILAGPM

SEQ ID NO: 120519 - protein, 11 aa, Dengue virus
EERVILAGPMP

SEQ ID NO: 120520 - protein, 11 aa, Dengue virus
ERVILAGPIPV

SEQ ID NO: 120521 - protein, 11 aa, Dengue virus
RVILAGPIPVT

SEQ ID NO: 120522 - protein, 11 aa, Dengue virus
VILAGPMPVTH

SEQ ID NO: 120523 - protein, 11 aa, Dengue virus
ILAGPMPVTHS

SEQ ID NO: 120524 - protein, 11 aa, Dengue virus
LAGPMPVTHSS

SEQ ID NO: 120525 - protein, 11 aa, Dengue virus
AGPMPVTHSSA

SEQ ID NO: 120526 - protein, 11 aa, Dengue virus
GPMPVTHSSAA

SEQ ID NO: 120527 - protein, 11 aa, Dengue virus
PMPVTHSSAAQ

SEQ ID NO: 120528 - protein, 11 aa, Dengue virus
MPVTHSSAAQR

SEQ ID NO: 120529 - protein, 11 aa, Dengue virus
PVTHSSAAQRR

SEQ ID NO: 120530 - protein, 11 aa, Dengue virus
VTHSSAAQRRG

SEQ ID NO: 120531 - protein, 11 aa, Dengue virus
THSSAAQRRGR

SEQ ID NO: 120532 - protein, 11 aa, Dengue virus
SSAAQRRGRIG

SEQ ID NO: 120533 - protein, 11 aa, Dengue virus
SAAQRRGRVGR

SEQ ID NO: 120534 - protein, 11 aa, Dengue virus
AAQRRGRVGRN

SEQ ID NO: 120535 - protein, 11 aa, Dengue virus
AQRRGRIGRNH

SEQ ID NO: 120536 - protein, 11 aa, Dengue virus
NENDQYIYMGE

SEQ ID NO: 120537 - protein, 11 aa, Dengue virus
ENDQYIYMGEP

SEQ ID NO: 120538 - protein, 11 aa, Dengue virus
NDQYIYMGEPL

SEQ ID NO: 120539 - protein, 11 aa, Dengue virus
YMGEPLENDED

SEQ ID NO: 120540 - protein, 11 aa, Dengue virus
MGEPLENDEDC

SEQ ID NO: 120541 - protein, 11 aa, Dengue virus
GEPLENDEDCA

SEQ ID NO: 120542 - protein, 11 aa, Dengue virus
EPLENDEDCAH

SEQ ID NO: 120543 - protein, 11 aa, Dengue virus
PLENDEDCAHW

SEQ ID NO: 120544 - protein, 11 aa, Dengue virus
LENDEDCAHWK

SEQ ID NO: 120545 - protein, 11 aa, Dengue virus
ENDEDCAHWKE

SEQ ID NO: 120546 - protein, 11 aa, Dengue virus
NDEDCAHWKEA

SEQ ID NO: 120547 - protein, 11 aa, Dengue virus
DEDCAHWKEAK

SEQ ID NO: 120548 - protein, 11 aa, Dengue virus
EDCAHWKEAKM

SEQ ID NO: 120549 - protein, 11 aa, Dengue virus
DCAHWKEAKML

SEQ ID NO: 120550 - protein, 11 aa, Dengue virus
CAHWKEAKMLL

SEQ ID NO: 120551 - protein, 11 aa, Dengue virus
AHWKEAKMLLD

SEQ ID NO: 120552 - protein, 11 aa, Dengue virus
HWKEAKMLLDN

SEQ ID NO: 120553 - protein, 11 aa, Dengue virus
WKEAKMLLDNI

SEQ ID NO: 120554 - protein, 11 aa, Dengue virus
KEAKMLLDNIN

SEQ ID NO: 120555 - protein, 11 aa, Dengue virus
EAKMLLDNIYT

SEQ ID NO: 120556 - protein, 11 aa, Dengue virus
AKMLLDNIYTP

SEQ ID NO: 120557 - protein, 11 aa, Dengue virus
KMLLDNIYTPE

SEQ ID NO: 120558 - protein, 11 aa, Dengue virus
MLLDNIYTPEG

SEQ ID NO: 120559 - protein, 11 aa, Dengue virus
LLDNIYTPEGI

SEQ ID NO: 120560 - protein, 11 aa, Dengue virus
LDNIYTPEGII

SEQ ID NO: 120561 - protein, 11 aa, Dengue virus
DNIYTPEGIIP

SEQ ID NO: 120562 - protein, 11 aa, Dengue virus
NINTPEGIIPS

SEQ ID NO: 120563 - protein, 11 aa, Dengue virus
INTPEGIIPSM

SEQ ID NO: 120564 - protein, 11 aa, Dengue virus
NTPEGIIPSMF

SEQ ID NO: 120565 - protein, 11 aa, Dengue virus
TPEGIIPSMFE

SEQ ID NO: 120566 - protein, 11 aa, Dengue virus
PEGIIPSMFEP

SEQ ID NO: 120567 - protein, 11 aa, Dengue virus
EGIIPSMFEPE

SEQ ID NO: 120568 - protein, 11 aa, Dengue virus
GIIPSMFEPER

SEQ ID NO: 120569 - protein, 11 aa, Dengue virus
IIPSMFEPERE

SEQ ID NO: 120570 - protein, 11 aa, Dengue virus
IPSMFEPEREK

SEQ ID NO: 120571 - protein, 11 aa, Dengue virus
PSMFEPEREKV

SEQ ID NO: 120572 - protein, 11 aa, Dengue virus
SMFEPEREKVD

SEQ ID NO: 120573 - protein, 11 aa, Dengue virus
MFEPEREKVDA

SEQ ID NO: 120574 - protein, 11 aa, Dengue virus
FEPEREKVDAI

SEQ ID NO: 120575 - protein, 11 aa, Dengue virus
EPEREKVDAID

SEQ ID NO: 120576 - protein, 11 aa, Dengue virus
PEREKVDAIDG

SEQ ID NO: 120577 - protein, 11 aa, Dengue virus
EREKVDAIDGE

SEQ ID NO: 120578 - protein, 11 aa, Dengue virus
REKVDAIDGEY

SEQ ID NO: 120579 - protein, 11 aa, Dengue virus
EKVDAIDGEYR

SEQ ID NO: 120580 - protein, 11 aa, Dengue virus
KVDAIDGEYRL

SEQ ID NO: 120581 - protein, 11 aa, Dengue virus
VDAIDGEYRLR

SEQ ID NO: 120582 - protein, 11 aa, Dengue virus
DAIDGEYRLRG

SEQ ID NO: 120583 - protein, 11 aa, Dengue virus
AIDGEYRLKGE

SEQ ID NO: 120584 - protein, 11 aa, Dengue virus
IDGEYRLKGES

SEQ ID NO: 120585 - protein, 11 aa, Dengue virus
DGEYRLKGESR

SEQ ID NO: 120586 - protein, 11 aa, Dengue virus
GEYRLKGESRK

SEQ ID NO: 120587 - protein, 11 aa, Dengue virus
EYRLKGESRKT

SEQ ID NO: 120588 - protein, 11 aa, Dengue virus
YRLKGESRKTF

SEQ ID NO: 120589 - protein, 11 aa, Dengue virus
RLKGESRKTFV

SEQ ID NO: 120590 - protein, 11 aa, Dengue virus
LRGEARKTFVD

SEQ ID NO: 120591 - protein, 11 aa, Dengue virus
RGEARKTFVDL

SEQ ID NO: 120592 - protein, 11 aa, Dengue virus
GEARKTFVDLM

SEQ ID NO: 120593 - protein, 11 aa, Dengue virus
EARKTFVDLMR

SEQ ID NO: 120594 - protein, 11 aa, Dengue virus
ARKTFVDLMRR

SEQ ID NO: 120595 - protein, 11 aa, Dengue virus
RKTFVDLMRRG

SEQ ID NO: 120596 - protein, 11 aa, Dengue virus
KTFVDLMRRGD

SEQ ID NO: 120597 - protein, 11 aa, Dengue virus
TFVDLMRRGDL

SEQ ID NO: 120598 - protein, 11 aa, Dengue virus
FVDLMRRGDLP

SEQ ID NO: 120599 - protein, 11 aa, Dengue virus
VDLMRRGDLPV

SEQ ID NO: 120600 - protein, 11 aa, Dengue virus
DLMRRGDLPVW

SEQ ID NO: 120601 - protein, 11 aa, Dengue virus
MRRGDLPVWLS

SEQ ID NO: 120602 - protein, 11 aa, Dengue virus
RRGDLPVWLAY

SEQ ID NO: 120603 - protein, 11 aa, Dengue virus
RGDLPVWLAYK

SEQ ID NO: 120604 - protein, 11 aa, Dengue virus
GDLPVWLAYKV

SEQ ID NO: 120605 - protein, 11 aa, Dengue virus
DLPVWLAYKVA

SEQ ID NO: 120606 - protein, 11 aa, Dengue virus
LPVWLAHKVAS

SEQ ID NO: 120607 - protein, 11 aa, Dengue virus
NNQILEENVEV

SEQ ID NO: 120608 - protein, 11 aa, Dengue virus
NQILEENVEVE

SEQ ID NO: 120609 - protein, 11 aa, Dengue virus
QILEENVEVEI

SEQ ID NO: 120610 - protein, 11 aa, Dengue virus
ILEENVEVEIW

SEQ ID NO: 120611 - protein, 11 aa, Dengue virus
LEENVEVEIWT

SEQ ID NO: 120612 - protein, 11 aa, Dengue virus
EENVEVEIWTK

SEQ ID NO: 120613 - protein, 11 aa, Dengue virus
ENVEVEIWTKE

SEQ ID NO: 120614 - protein, 11 aa, Dengue virus
NVEVEIWTKEG

SEQ ID NO: 120615 - protein, 11 aa, Dengue virus
ERKKLKPRWLD

SEQ ID NO: 120616 - protein, 11 aa, Dengue virus
RKKLKPRWLDA

SEQ ID NO: 120617 - protein, 11 aa, Dengue virus
KKLKPRWLDAR

SEQ ID NO: 120618 - protein, 11 aa, Dengue virus
KLKPRWLDARI

SEQ ID NO: 120619 - protein, 11 aa, Dengue virus
LKPRWLDARIY

SEQ ID NO: 120620 - protein, 11 aa, Dengue virus
KPRWLDARIYS

SEQ ID NO: 120621 - protein, 11 aa, Dengue virus
PRWLDARIYSD

SEQ ID NO: 120622 - protein, 11 aa, Dengue virus
RWLDARIYSDP

SEQ ID NO: 120623 - protein, 11 aa, Dengue virus
WLDARIYSDPL

SEQ ID NO: 120624 - protein, 11 aa, Dengue virus
LDARIYSDPLA

SEQ ID NO: 120625 - protein, 11 aa, Dengue virus
DARIYSDPLAL

SEQ ID NO: 120626 - protein, 11 aa, Dengue virus
ARIYSDPLALK

SEQ ID NO: 120627 - protein, 11 aa, Dengue virus
RIYSDPLALKE

SEQ ID NO: 120628 - protein, 11 aa, Dengue virus
IYSDPLALKEF

SEQ ID NO: 120629 - protein, 11 aa, Dengue virus
YSDPLALREFK

SEQ ID NO: 120630 - protein, 11 aa, Dengue virus
SDPLALKEFKE

SEQ ID NO: 120631 - protein, 11 aa, Dengue virus
DPLALKEFKEF

SEQ ID NO: 120632 - protein, 11 aa, Dengue virus
PLALKEFKEFA

SEQ ID NO: 120633 - protein, 11 aa, Dengue virus
LALKEFKEFAA

SEQ ID NO: 120634 - protein, 11 aa, Dengue virus
ALKEFKEFAAG

SEQ ID NO: 120635 - protein, 11 aa, Dengue virus
LKEFKEFAAGR

SEQ ID NO: 120636 - protein, 11 aa, Dengue virus
KEFKEFAAGRK

SEQ ID NO: 120637 - protein, 11 aa, Dengue virus
EFKEFAAGRKS

SEQ ID NO: 120638 - protein, 11 aa, Dengue virus
FKEFAAGRKSL

SEQ ID NO: 120639 - protein, 11 aa, Dengue virus
RNALDNLVMLH

SEQ ID NO: 120640 - protein, 11 aa, Dengue virus
ALDNLAVLHTA

SEQ ID NO: 120641 - protein, 11 aa, Dengue virus
LDNLAVLHTAE

SEQ ID NO: 120642 - protein, 11 aa, Dengue virus
AYNHALSELPE

SEQ ID NO: 120643 - protein, 11 aa, Dengue virus
YNHALSELPET

SEQ ID NO: 120644 - protein, 11 aa, Dengue virus
NHALSELPETL

SEQ ID NO: 120645 - protein, 11 aa, Dengue virus
HALSELPETLE

SEQ ID NO: 120646 - protein, 11 aa, Dengue virus
ALSELPETLET

SEQ ID NO: 120647 - protein, 11 aa, Dengue virus
LSELPETLETL

SEQ ID NO: 120648 - protein, 11 aa, Dengue virus
SELPETLETLL

SEQ ID NO: 120649 - protein, 11 aa, Dengue virus
ELPETLETLLL

SEQ ID NO: 120650 - protein, 11 aa, Dengue virus
LPETLETLLLL

SEQ ID NO: 120651 - protein, 11 aa, Dengue virus
PETLETLLLLT

SEQ ID NO: 120652 - protein, 11 aa, Dengue virus
ETLETLLLLTL

SEQ ID NO: 120653 - protein, 11 aa, Dengue virus
TLETLLLLTLL

SEQ ID NO: 120654 - protein, 11 aa, Dengue virus
LETLLLLTLLA

SEQ ID NO: 120655 - protein, 11 aa, Dengue virus
IQPHWIAASII

SEQ ID NO: 120656 - protein, 11 aa, Dengue virus
QPHWIAASIIL

SEQ ID NO: 120657 - protein, 11 aa, Dengue virus
LQWIASAIVLE

SEQ ID NO: 120658 - protein, 11 aa, Dengue virus
QWIASAIVLEF

SEQ ID NO: 120659 - protein, 11 aa, Dengue virus
WIASAIVLEFF

SEQ ID NO: 120660 - protein, 11 aa, Dengue virus
IASAIVLEFFM

SEQ ID NO: 120661 - protein, 11 aa, Dengue virus
AASIILEFFLI

SEQ ID NO: 120662 - protein, 11 aa, Dengue virus
ASIILEFFLIV

SEQ ID NO: 120663 - protein, 11 aa, Dengue virus
SIILEFFLIVL

SEQ ID NO: 120664 - protein, 11 aa, Dengue virus
IILEFFLIVLL

SEQ ID NO: 120665 - protein, 11 aa, Dengue virus
ILEFFLIVLLI

SEQ ID NO: 120666 - protein, 11 aa, Dengue virus
LEFFLIVLLIP

SEQ ID NO: 120667 - protein, 11 aa, Dengue virus
EFFLIVLLIPE

SEQ ID NO: 120668 - protein, 11 aa, Dengue virus
FFLIVLLIPEP

SEQ ID NO: 120669 - protein, 11 aa, Dengue virus
FLIVLLIPEPE

SEQ ID NO: 120670 - protein, 11 aa, Dengue virus
LIVLLIPEPEK

SEQ ID NO: 120671 - protein, 11 aa, Dengue virus
IVLLIPEPEKQ

SEQ ID NO: 120672 - protein, 11 aa, Dengue virus
VLLIPEPDRQR

SEQ ID NO: 120673 - protein, 11 aa, Dengue virus
LLIPEPDRQRT

SEQ ID NO: 120674 - protein, 11 aa, Dengue virus
LIPEPDRQRTP

SEQ ID NO: 120675 - protein, 11 aa, Dengue virus
IPEPDRQRTPQ

SEQ ID NO: 120676 - protein, 11 aa, Dengue virus
PEPDRQRTPQD

SEQ ID NO: 120677 - protein, 11 aa, Dengue virus
EPDRQRTPQDN

SEQ ID NO: 120678 - protein, 11 aa, Dengue virus
PDRQRTPQDNQ

SEQ ID NO: 120679 - protein, 11 aa, Dengue virus
DRQRTPQDNQL

SEQ ID NO: 120680 - protein, 11 aa, Dengue virus
KQRTPQDNQLT

SEQ ID NO: 120681 - protein, 11 aa, Dengue virus
QRTPQDNQLTY

SEQ ID NO: 120682 - protein, 11 aa, Dengue virus
RTPQDNQLTYV

SEQ ID NO: 120683 - protein, 11 aa, Dengue virus
TPQDNQLTYVV

SEQ ID NO: 120684 - protein, 11 aa, Dengue virus
PQDNQLTYVVI

SEQ ID NO: 120685 - protein, 11 aa, Dengue virus
QDNQLTYVVIA

SEQ ID NO: 120686 - protein, 11 aa, Dengue virus
DNQLTYVVIAI

SEQ ID NO: 120687 - protein, 11 aa, Dengue virus
NQLTYVVIAIL

SEQ ID NO: 120688 - protein, 11 aa, Dengue virus
QLTYVVIAILT

SEQ ID NO: 120689 - protein, 11 aa, Dengue virus
TMANEMGFLEK

SEQ ID NO: 120690 - protein, 11 aa, Dengue virus
MANEMGFLEKT

SEQ ID NO: 120691 - protein, 11 aa, Dengue virus
ANEMGFLEKTK

SEQ ID NO: 120692 - protein, 11 aa, Dengue virus
NEMGFLEKTKK

SEQ ID NO: 120693 - protein, 11 aa, Dengue virus
EMGFLEKTKKD

SEQ ID NO: 120694 - protein, 11 aa, Dengue virus
MGFLEKTKKDL

SEQ ID NO: 120695 - protein, 11 aa, Dengue virus
GFLEKTKKDLG

SEQ ID NO: 120696 - protein, 11 aa, Dengue virus
LDIDLRPASAW

SEQ ID NO: 120697 - protein, 11 aa, Dengue virus
DIDLRPASAWT

SEQ ID NO: 120698 - protein, 11 aa, Dengue virus
IDLRPASAWTL

SEQ ID NO: 120699 - protein, 11 aa, Dengue virus
DLRPASAWTLY

SEQ ID NO: 120700 - protein, 11 aa, Dengue virus
LRPASAWTLYA

SEQ ID NO: 120701 - protein, 11 aa, Dengue virus
RPASAWTLYAV

SEQ ID NO: 120702 - protein, 11 aa, Dengue virus
AWTLYAVATTF

SEQ ID NO: 120703 - protein, 11 aa, Dengue virus
WTLYAVATTVI

SEQ ID NO: 120704 - protein, 11 aa, Dengue virus
TLYAVATTVIT

SEQ ID NO: 120705 - protein, 11 aa, Dengue virus
LYAVATTVITP

SEQ ID NO: 120706 - protein, 11 aa, Dengue virus
YAVATTVITPM

SEQ ID NO: 120707 - protein, 11 aa, Dengue virus
VTPMLRHSIEN

SEQ ID NO: 120708 - protein, 11 aa, Dengue virus
TPMLRHSIENS

SEQ ID NO: 120709 - protein, 11 aa, Dengue virus
PMLRHSIENSS

SEQ ID NO: 120710 - protein, 11 aa, Dengue virus
MLRHSIENSSV

SEQ ID NO: 120711 - protein, 11 aa, Dengue virus
LRHSIENSSVN

SEQ ID NO: 120712 - protein, 11 aa, Dengue virus
RHSIENSSVNV

SEQ ID NO: 120713 - protein, 11 aa, Dengue virus
HSIENSSVNVS

SEQ ID NO: 120714 - protein, 11 aa, Dengue virus
SIENSSVNVSL

SEQ ID NO: 120715 - protein, 11 aa, Dengue virus
IENSSVNVSLT

SEQ ID NO: 120716 - protein, 11 aa, Dengue virus
ENSSVNVSLTA

SEQ ID NO: 120717 - protein, 11 aa, Dengue virus
NSSVNVSLTAI

SEQ ID NO: 120718 - protein, 11 aa, Dengue virus
SSVNVSLTAIA

SEQ ID NO: 120719 - protein, 11 aa, Dengue virus
SVNVSLTAIAN

SEQ ID NO: 120720 - protein, 11 aa, Dengue virus
VNVSLTAIANQ

SEQ ID NO: 120721 - protein, 11 aa, Dengue virus
NVSLTAIANQA

SEQ ID NO: 120722 - protein, 11 aa, Dengue virus
VSLTAIANQAT

SEQ ID NO: 120723 - protein, 11 aa, Dengue virus
SLTAIANQATV

SEQ ID NO: 120724 - protein, 11 aa, Dengue virus
LTAIANQATVL

SEQ ID NO: 120725 - protein, 11 aa, Dengue virus
TAIANQATVLM

SEQ ID NO: 120726 - protein, 11 aa, Dengue virus
AIANQATVLMG

SEQ ID NO: 120727 - protein, 11 aa, Dengue virus
IANQATVLMGL

SEQ ID NO: 120728 - protein, 11 aa, Dengue virus
ANQATVLMGLG

SEQ ID NO: 120729 - protein, 11 aa, Dengue virus
NQATVLMGLGK

SEQ ID NO: 120730 - protein, 11 aa, Dengue virus
QATVLMGLGKG

SEQ ID NO: 120731 - protein, 11 aa, Dengue virus
ATVLMGLGKGW

SEQ ID NO: 120732 - protein, 11 aa, Dengue virus
TVLMGLGKGWP

SEQ ID NO: 120733 - protein, 11 aa, Dengue virus
VLMGLGKGWPL

SEQ ID NO: 120734 - protein, 11 aa, Dengue virus
LMGLGKGWPLS

SEQ ID NO: 120735 - protein, 11 aa, Dengue virus
MGLGKGWPLSK

SEQ ID NO: 120736 - protein, 11 aa, Dengue virus
GLGKGWPLSKM

SEQ ID NO: 120737 - protein, 11 aa, Dengue virus
LGKGWPLSKMD

SEQ ID NO: 120738 - protein, 11 aa, Dengue virus
GKGWPLSKMDI

SEQ ID NO: 120739 - protein, 11 aa, Dengue virus
KGWPLSKMDIG

SEQ ID NO: 120740 - protein, 11 aa, Dengue virus
GWPLSKMDIGV

SEQ ID NO: 120741 - protein, 11 aa, Dengue virus
WPLSKMDIGVP

SEQ ID NO: 120742 - protein, 11 aa, Dengue virus
PLSKMDIGVPL

SEQ ID NO: 120743 - protein, 11 aa, Dengue virus
LSKMDIGVPLL

SEQ ID NO: 120744 - protein, 11 aa, Dengue virus
SKMDLGVPLLA

SEQ ID NO: 120745 - protein, 11 aa, Dengue virus
KMDIGVPLLAI

SEQ ID NO: 120746 - protein, 11 aa, Dengue virus
MDIGVPLLAIG

SEQ ID NO: 120747 - protein, 11 aa, Dengue virus
DIGVPLLAIGC

SEQ ID NO: 120748 - protein, 11 aa, Dengue virus
IGVPLLAIGCY

SEQ ID NO: 120749 - protein, 11 aa, Dengue virus
GVPLLAIGCYS

SEQ ID NO: 120750 - protein, 11 aa, Dengue virus
VPLLAIGCYSQ

SEQ ID NO: 120751 - protein, 11 aa, Dengue virus
PLLAIGCYSQV

SEQ ID NO: 120752 - protein, 11 aa, Dengue virus
LLAIGCYSQVN

SEQ ID NO: 120753 - protein, 11 aa, Dengue virus
LAIGCYSQVNP

SEQ ID NO: 120754 - protein, 11 aa, Dengue virus
AIGCYSQVNPI

SEQ ID NO: 120755 - protein, 11 aa, Dengue virus
IGCYSQVNPIT

SEQ ID NO: 120756 - protein, 11 aa, Dengue virus
GCYSQVNPITL

SEQ ID NO: 120757 - protein, 11 aa, Dengue virus
CYSQVNPITLT

SEQ ID NO: 120758 - protein, 11 aa, Dengue virus
YSQVNPITLTA

SEQ ID NO: 120759 - protein, 11 aa, Dengue virus
SQVNPITLTAA

SEQ ID NO: 120760 - protein, 11 aa, Dengue virus
QVNPITLTAAL

SEQ ID NO: 120761 - protein, 11 aa, Dengue virus
THYAIIGPGLQ

SEQ ID NO: 120762 - protein, 11 aa, Dengue virus
AKATREAQKRA

SEQ ID NO: 120763 - protein, 11 aa, Dengue virus
KATREAQKRAA

SEQ ID NO: 120764 - protein, 11 aa, Dengue virus
ATREAQKRAAA

SEQ ID NO: 120765 - protein, 11 aa, Dengue virus
TREAQKRAAAG

SEQ ID NO: 120766 - protein, 11 aa, Dengue virus
REAQKRAAAGI

SEQ ID NO: 120767 - protein, 11 aa, Dengue virus
EAQKRAAAGIM

SEQ ID NO: 120768 - protein, 11 aa, Dengue virus
AQKRAAAGIMK

SEQ ID NO: 120769 - protein, 11 aa, Dengue virus
QKRAAAGIMKN

SEQ ID NO: 120770 - protein, 11 aa, Dengue virus
KRAAAGIMKNP

SEQ ID NO: 120771 - protein, 11 aa, Dengue virus
RAAAGIMKNPT

SEQ ID NO: 120772 - protein, 11 aa, Dengue virus
AAAGIMKNPTV

SEQ ID NO: 120773 - protein, 11 aa, Dengue virus
AAGIMKNPTID

SEQ ID NO: 120774 - protein, 11 aa, Dengue virus
AGIMKNPTIDG

SEQ ID NO: 120775 - protein, 11 aa, Dengue virus
GIMKNPTIDGI

SEQ ID NO: 120776 - protein, 11 aa, Dengue virus
IMKNPTVDGIT

SEQ ID NO: 120777 - protein, 11 aa, Dengue virus
KNPTVDGITVI

SEQ ID NO: 120778 - protein, 11 aa, Dengue virus
PIPYDPKFEKQ

SEQ ID NO: 120779 - protein, 11 aa, Dengue virus
IPYDPKFEKQL

SEQ ID NO: 120780 - protein, 11 aa, Dengue virus
PYDPKFEKQLG

SEQ ID NO: 120781 - protein, 11 aa, Dengue virus
YDPKFEKQLGQ

SEQ ID NO: 120782 - protein, 11 aa, Dengue virus
DPKFEKQLGQV

SEQ ID NO: 120783 - protein, 11 aa, Dengue virus
PKFEKQLGQVM

SEQ ID NO: 120784 - protein, 11 aa, Dengue virus
KFEKQLGQIML

SEQ ID NO: 120785 - protein, 11 aa, Dengue virus
FEKQLGQIMLL

SEQ ID NO: 120786 - protein, 11 aa, Dengue virus
EKQLGQVMLLV

SEQ ID NO: 120787 - protein, 11 aa, Dengue virus
KQLGQVMLLVL

SEQ ID NO: 120788 - protein, 11 aa, Dengue virus
QLGQVMLLVLC

SEQ ID NO: 120789 - protein, 11 aa, Dengue virus
LGQVMLLVLCA

SEQ ID NO: 120790 - protein, 11 aa, Dengue virus
LCVTQVLMMRT

SEQ ID NO: 120791 - protein, 11 aa, Dengue virus
CVTQVLMMRTT

SEQ ID NO: 120792 - protein, 11 aa, Dengue virus
VTQVLMMRTTW

SEQ ID NO: 120793 - protein, 11 aa, Dengue virus
TQVLMMRTTWA

SEQ ID NO: 120794 - protein, 11 aa, Dengue virus
QVLMMRTTWAL

SEQ ID NO: 120795 - protein, 11 aa, Dengue virus
VLMMRTTWALC

SEQ ID NO: 120796 - protein, 11 aa, Dengue virus
LMMRTTWALCE

SEQ ID NO: 120797 - protein, 11 aa, Dengue virus
MMRTTWALCEA

SEQ ID NO: 120798 - protein, 11 aa, Dengue virus
MRTTWALCEAL

SEQ ID NO: 120799 - protein, 11 aa, Dengue virus
RTTWALCEALT

SEQ ID NO: 120800 - protein, 11 aa, Dengue virus
TTWALCEALTL

SEQ ID NO: 120801 - protein, 11 aa, Dengue virus
TWALCEALTLA

SEQ ID NO: 120802 - protein, 11 aa, Dengue virus
WALCESITLAT

SEQ ID NO: 120803 - protein, 11 aa, Dengue virus
ALCESITLATG

SEQ ID NO: 120804 - protein, 11 aa, Dengue virus
LCESITLATGP

SEQ ID NO: 120805 - protein, 11 aa, Dengue virus
CESITLATGPL

SEQ ID NO: 120806 - protein, 11 aa, Dengue virus
LTLATGPISTL

SEQ ID NO: 120807 - protein, 11 aa, Dengue virus
TLATGPISTLW

SEQ ID NO: 120808 - protein, 11 aa, Dengue virus
LATGPISTLWE

SEQ ID NO: 120809 - protein, 11 aa, Dengue virus
ATGPISTLWEG

SEQ ID NO: 120810 - protein, 11 aa, Dengue virus
TGPISTLWEGN

SEQ ID NO: 120811 - protein, 11 aa, Dengue virus
GPISTLWEGNP

SEQ ID NO: 120812 - protein, 11 aa, Dengue virus
PISTLWEGNPG

SEQ ID NO: 120813 - protein, 11 aa, Dengue virus
STLWEGNPGRF

SEQ ID NO: 120814 - protein, 11 aa, Dengue virus
TLWEGNPGRFW

SEQ ID NO: 120815 - protein, 11 aa, Dengue virus
LWEGNPGRFWN

SEQ ID NO: 120816 - protein, 11 aa, Dengue virus
WEGNPGRFWNT

SEQ ID NO: 120817 - protein, 11 aa, Dengue virus
EGNPGRFWNTT

SEQ ID NO: 120818 - protein, 11 aa, Dengue virus
GNPGRFWNTTI

SEQ ID NO: 120819 - protein, 11 aa, Dengue virus
NPGRFWNTTIA

SEQ ID NO: 120820 - protein, 11 aa, Dengue virus
PGRFWNTTIAV

SEQ ID NO: 120821 - protein, 11 aa, Dengue virus
GRFWNTTIAVS

SEQ ID NO: 120822 - protein, 11 aa, Dengue virus
RFWNTTIAVSM

SEQ ID NO: 120823 - protein, 11 aa, Dengue virus
FWNTTIAVSTA

SEQ ID NO: 120824 - protein, 11 aa, Dengue virus
WNTTIAVSTAN

SEQ ID NO: 120825 - protein, 11 aa, Dengue virus
NTTIAVSTANI

SEQ ID NO: 120826 - protein, 11 aa, Dengue virus
TTIAVSTANIF

SEQ ID NO: 120827 - protein, 11 aa, Dengue virus
TIAVSTANIFR

SEQ ID NO: 120828 - protein, 11 aa, Dengue virus
IAVSTANIFRG

SEQ ID NO: 120829 - protein, 11 aa, Dengue virus
AVSTANIFRGS

SEQ ID NO: 120830 - protein, 11 aa, Dengue virus
VSTANIFRGSY

SEQ ID NO: 120831 - protein, 11 aa, Dengue virus
STANIFRGSYL

SEQ ID NO: 120832 - protein, 11 aa, Dengue virus
TANIFRGSYLA

SEQ ID NO: 120833 - protein, 11 aa, Dengue virus
RGSYLAGAGLL

SEQ ID NO: 120834 - protein, 11 aa, Dengue virus
GSYLAGAGLLF

SEQ ID NO: 120835 - protein, 11 aa, Dengue virus
SYLAGAGLLFS

SEQ ID NO: 120836 - protein, 11 aa, Dengue virus
YLAGAGLLFSI

SEQ ID NO: 120837 - protein, 11 aa, Dengue virus
LAGAGLLFSIM

SEQ ID NO: 120838 - protein, 11 aa, Dengue virus
AGAGLLFSIMK

SEQ ID NO: 120839 - protein, 11 aa, Dengue virus
GAGLLFSIMKN

SEQ ID NO: 120840 - protein, 11 aa, Dengue virus
AGLLFSIMKNT

SEQ ID NO: 120841 - protein, 11 aa, Dengue virus
GETLGEKWKSR

SEQ ID NO: 120842 - protein, 11 aa, Dengue virus
ETLGEKWKSRL

SEQ ID NO: 120843 - protein, 11 aa, Dengue virus
TLGEKWKSRLN

SEQ ID NO: 120844 - protein, 11 aa, Dengue virus
EVDRTLAKEGI

SEQ ID NO: 120845 - protein, 11 aa, Dengue virus
KHAVSRGTAKL

SEQ ID NO: 120846 - protein, 11 aa, Dengue virus
HAVSRGSAKLR

SEQ ID NO: 120847 - protein, 11 aa, Dengue virus
AVSRGSAKLRW

SEQ ID NO: 120848 - protein, 11 aa, Dengue virus
VSRGSAKLRWF

SEQ ID NO: 120849 - protein, 11 aa, Dengue virus
SRGSAKLRWFV

SEQ ID NO: 120850 - protein, 11 aa, Dengue virus
RGSAKLRWFVE

SEQ ID NO: 120851 - protein, 11 aa, Dengue virus
GSAKLRWFVER

SEQ ID NO: 120852 - protein, 11 aa, Dengue virus
SAKLRWFVERN

SEQ ID NO: 120853 - protein, 11 aa, Dengue virus
AKLRWFVERNM

SEQ ID NO: 120854 - protein, 11 aa, Dengue virus
KLRWFVERNMV

SEQ ID NO: 120855 - protein, 11 aa, Dengue virus
PEGKVVDLGCG

SEQ ID NO: 120856 - protein, 11 aa, Dengue virus
EGKVVDLGCGR

SEQ ID NO: 120857 - protein, 11 aa, Dengue virus
GKVVDLGCGRG

SEQ ID NO: 120858 - protein, 11 aa, Dengue virus
KVVDLGCGRGG

SEQ ID NO: 120859 - protein, 11 aa, Dengue virus
VVDLGCGRGGW

SEQ ID NO: 120860 - protein, 11 aa, Dengue virus
VDLGCGRGGWS

SEQ ID NO: 120861 - protein, 11 aa, Dengue virus
GCGRGGWSYYM

SEQ ID NO: 120862 - protein, 11 aa, Dengue virus
CGRGGWSYYCG

SEQ ID NO: 120863 - protein, 11 aa, Dengue virus
GRGGWSYYCGG

SEQ ID NO: 120864 - protein, 11 aa, Dengue virus
RGGWSYYCGGL

SEQ ID NO: 120865 - protein, 11 aa, Dengue virus
GGWSYYCGGLK

SEQ ID NO: 120866 - protein, 11 aa, Dengue virus
GWSYYCGGLKN

SEQ ID NO: 120867 - protein, 11 aa, Dengue virus
WSYYCGGLKNV

SEQ ID NO: 120868 - protein, 11 aa, Dengue virus
SYYCGGLKNVR

SEQ ID NO: 120869 - protein, 11 aa, Dengue virus
YYCGGLKNVRE

SEQ ID NO: 120870 - protein, 11 aa, Dengue virus
YCGGLKNVREV

SEQ ID NO: 120871 - protein, 11 aa, Dengue virus
VREVKGLTKGG

SEQ ID NO: 120872 - protein, 11 aa, Dengue virus
REVKGLTKGGP

SEQ ID NO: 120873 - protein, 11 aa, Dengue virus
EVKGLTKGGPG

SEQ ID NO: 120874 - protein, 11 aa, Dengue virus
VKGLTKGGPGH

SEQ ID NO: 120875 - protein, 11 aa, Dengue virus
KGLTKGGPGHE

SEQ ID NO: 120876 - protein, 11 aa, Dengue virus
GLTKGGPGHEE

SEQ ID NO: 120877 - protein, 11 aa, Dengue virus
LTKGGPGHEEP

SEQ ID NO: 120878 - protein, 11 aa, Dengue virus
TKGGPGHEEPV

SEQ ID NO: 120879 - protein, 11 aa, Dengue virus
KGGPGHEEPVP

SEQ ID NO: 120880 - protein, 11 aa, Dengue virus
GGPGHEEPVPM

SEQ ID NO: 120881 - protein, 11 aa, Dengue virus
GPGHEEPIPMS

SEQ ID NO: 120882 - protein, 11 aa, Dengue virus
PGHEEPIPMST

SEQ ID NO: 120883 - protein, 11 aa, Dengue virus
GHEEPIPMSTY

SEQ ID NO: 120884 - protein, 11 aa, Dengue virus
HEEPIPMSTYG

SEQ ID NO: 120885 - protein, 11 aa, Dengue virus
EEPIPMSTYGW

SEQ ID NO: 120886 - protein, 11 aa, Dengue virus
EPIPMSTYGWN

SEQ ID NO: 120887 - protein, 11 aa, Dengue virus
PIPMSTYGWNL

SEQ ID NO: 120888 - protein, 11 aa, Dengue virus
IPMSTYGWNLV

SEQ ID NO: 120889 - protein, 11 aa, Dengue virus
PMSTYGWNLVR

SEQ ID NO: 120890 - protein, 11 aa, Dengue virus
MSTYGWNLVRL

SEQ ID NO: 120891 - protein, 11 aa, Dengue virus
STYGWNLVRLQ

SEQ ID NO: 120892 - protein, 11 aa, Dengue virus
PTEQVDTLLCD

SEQ ID NO: 120893 - protein, 11 aa, Dengue virus
TEQVDTLLCDI

SEQ ID NO: 120894 - protein, 11 aa, Dengue virus
EQVDTLLCDIG

SEQ ID NO: 120895 - protein, 11 aa, Dengue virus
QVDTLLCDIGE

SEQ ID NO: 120896 - protein, 11 aa, Dengue virus
VDTLLCDIGES

SEQ ID NO: 120897 - protein, 11 aa, Dengue virus
TLLCDIGESSS

SEQ ID NO: 120898 - protein, 11 aa, Dengue virus
LLCDIGESSPS

SEQ ID NO: 120899 - protein, 11 aa, Dengue virus
LCDIGESSPSP

SEQ ID NO: 120900 - protein, 11 aa, Dengue virus
CDIGESSPSPT

SEQ ID NO: 120901 - protein, 11 aa, Dengue virus
DIGESSPSPTV

SEQ ID NO: 120902 - protein, 11 aa, Dengue virus
IGESSPSPTVE

SEQ ID NO: 120903 - protein, 11 aa, Dengue virus
GESSPSPTVEE

SEQ ID NO: 120904 - protein, 11 aa, Dengue virus
ESSPSPTVEES

SEQ ID NO: 120905 - protein, 11 aa, Dengue virus
SSPSPTVEESR

SEQ ID NO: 120906 - protein, 11 aa, Dengue virus
SPSPTVEESRT

SEQ ID NO: 120907 - protein, 11 aa, Dengue virus
PSPTVEESRTI

SEQ ID NO: 120908 - protein, 11 aa, Dengue virus
SPTVEESRTIR

SEQ ID NO: 120909 - protein, 11 aa, Dengue virus
PTVEESRTIRV

SEQ ID NO: 120910 - protein, 11 aa, Dengue virus
TVEESRTIRVL

SEQ ID NO: 120911 - protein, 11 aa, Dengue virus
VEESRTIRVLK

SEQ ID NO: 120912 - protein, 11 aa, Dengue virus
EAGRTLRVLNL

SEQ ID NO: 120913 - protein, 11 aa, Dengue virus
AGRTLRVLNLV

SEQ ID NO: 120914 - protein, 11 aa, Dengue virus
GRTLRVLNLVE

SEQ ID NO: 120915 - protein, 11 aa, Dengue virus
RTLRVLNLVEN

SEQ ID NO: 120916 - protein, 11 aa, Dengue virus
TLRVLNLVENW

SEQ ID NO: 120917 - protein, 11 aa, Dengue virus
LRVLNLVENWL

SEQ ID NO: 120918 - protein, 11 aa, Dengue virus
QFCIKILNPYM

SEQ ID NO: 120919 - protein, 11 aa, Dengue virus
FCIKILNPYMP

SEQ ID NO: 120920 - protein, 11 aa, Dengue virus
CIKVLNPYMPS

SEQ ID NO: 120921 - protein, 11 aa, Dengue virus
IKVLNPYMPSV

SEQ ID NO: 120922 - protein, 11 aa, Dengue virus
KVLNPYMPSVI

SEQ ID NO: 120923 - protein, 11 aa, Dengue virus
VLNPYMPSVIE

SEQ ID NO: 120924 - protein, 11 aa, Dengue virus
YGGALVRNPLS

SEQ ID NO: 120925 - protein, 11 aa, Dengue virus
GGALVRNPLSR

SEQ ID NO: 120926 - protein, 11 aa, Dengue virus
GALVRNPLSRN

SEQ ID NO: 120927 - protein, 11 aa, Dengue virus
ALVRNPLSRNS

SEQ ID NO: 120928 - protein, 11 aa, Dengue virus
LVRCPLSRNST

SEQ ID NO: 120929 - protein, 11 aa, Dengue virus
VRCPLSRNSTH

SEQ ID NO: 120930 - protein, 11 aa, Dengue virus
RCPLSRNSTHE

SEQ ID NO: 120931 - protein, 11 aa, Dengue virus
CPLSRNSTHEM

SEQ ID NO: 120932 - protein, 11 aa, Dengue virus
SRNSTHEMYWI

SEQ ID NO: 120933 - protein, 11 aa, Dengue virus
RNSTHEMYWIS

SEQ ID NO: 120934 - protein, 11 aa, Dengue virus
NSTHEMYWVSN

SEQ ID NO: 120935 - protein, 11 aa, Dengue virus
STHEMYWVSNA

SEQ ID NO: 120936 - protein, 11 aa, Dengue virus
THEMYWISNGT

SEQ ID NO: 120937 - protein, 11 aa, Dengue virus
HEMYWISNGTG

SEQ ID NO: 120938 - protein, 11 aa, Dengue virus
EMYWISNGTGN

SEQ ID NO: 120939 - protein, 11 aa, Dengue virus
MYWISNGTGNI

SEQ ID NO: 120940 - protein, 11 aa, Dengue virus
YWISNGTGNIV

SEQ ID NO: 120941 - protein, 11 aa, Dengue virus
GNIVSSVNMIS

SEQ ID NO: 120942 - protein, 11 aa, Dengue virus
NIVSSVNMISR

SEQ ID NO: 120943 - protein, 11 aa, Dengue virus
IVSSVNMISRM

SEQ ID NO: 120944 - protein, 11 aa, Dengue virus
VSSVNMISRML

SEQ ID NO: 120945 - protein, 11 aa, Dengue virus
SSVNMISRMLI

SEQ ID NO: 120946 - protein, 11 aa, Dengue virus
SVNMISRMLIN

SEQ ID NO: 120947 - protein, 11 aa, Dengue virus
VNMISRMLINR

SEQ ID NO: 120948 - protein, 11 aa, Dengue virus
NMISRMLINRF

SEQ ID NO: 120949 - protein, 11 aa, Dengue virus
MISRMLINRFT

SEQ ID NO: 120950 - protein, 11 aa, Dengue virus
ISRMLINRFTM

SEQ ID NO: 120951 - protein, 11 aa, Dengue virus
EPDVDLGSGTR

SEQ ID NO: 120952 - protein, 11 aa, Dengue virus
PDVDLGSGTRN

SEQ ID NO: 120953 - protein, 11 aa, Dengue virus
DVDLGSGTRNI

SEQ ID NO: 120954 - protein, 11 aa, Dengue virus
VDLGSGTRNIG

SEQ ID NO: 120955 - protein, 11 aa, Dengue virus
DLGSGTRNIGI

SEQ ID NO: 120956 - protein, 11 aa, Dengue virus
LGSGTRNIGIE

SEQ ID NO: 120957 - protein, 11 aa, Dengue virus
SWHYDQDHPYK

SEQ ID NO: 120958 - protein, 11 aa, Dengue virus
WHYDQDHPYKT

SEQ ID NO: 120959 - protein, 11 aa, Dengue virus
HYDQDHPYKTW

SEQ ID NO: 120960 - protein, 11 aa, Dengue virus
YDQDHPYKTWA

SEQ ID NO: 120961 - protein, 11 aa, Dengue virus
DQDHPYKTWAY

SEQ ID NO: 120962 - protein, 11 aa, Dengue virus
QDHPYKTWAYH

SEQ ID NO: 120963 - protein, 11 aa, Dengue virus
DHPYKTWAYHG

SEQ ID NO: 120964 - protein, 11 aa, Dengue virus
HPYKTWAYHGS

SEQ ID NO: 120965 - protein, 11 aa, Dengue virus
PYRTWAYHGSY

SEQ ID NO: 120966 - protein, 11 aa, Dengue virus
YRTWAYHGSYE

SEQ ID NO: 120967 - protein, 11 aa, Dengue virus
KTWAYHGSYET

SEQ ID NO: 120968 - protein, 11 aa, Dengue virus
TWAYHGSYETK

SEQ ID NO: 120969 - protein, 11 aa, Dengue virus
WAYHGSYETKQ

SEQ ID NO: 120970 - protein, 11 aa, Dengue virus
AYHGSYETKQT

SEQ ID NO: 120971 - protein, 11 aa, Dengue virus
YHGSYETKQTG

SEQ ID NO: 120972 - protein, 11 aa, Dengue virus
HGSYETKQTGS

SEQ ID NO: 120973 - protein, 11 aa, Dengue virus
GSYETKQTGSA

SEQ ID NO: 120974 - protein, 11 aa, Dengue virus
SYETKQTGSAS

SEQ ID NO: 120975 - protein, 11 aa, Dengue virus
YETKQTGSASS

SEQ ID NO: 120976 - protein, 11 aa, Dengue virus
ETKQTGSASSM

SEQ ID NO: 120977 - protein, 11 aa, Dengue virus
TKQTGSASSMV

SEQ ID NO: 120978 - protein, 11 aa, Dengue virus
KQTGSASSMVN

SEQ ID NO: 120979 - protein, 11 aa, Dengue virus
QTGSASSMVNG

SEQ ID NO: 120980 - protein, 11 aa, Dengue virus
TGSASSMVNGV

SEQ ID NO: 120981 - protein, 11 aa, Dengue virus
GSASSMINGVV

SEQ ID NO: 120982 - protein, 11 aa, Dengue virus
SASSMVNGVVK

SEQ ID NO: 120983 - protein, 11 aa, Dengue virus
ASSMVNGVVKL

SEQ ID NO: 120984 - protein, 11 aa, Dengue virus
SSMVNGVVKLL

SEQ ID NO: 120985 - protein, 11 aa, Dengue virus
SMVNGVVKLLT

SEQ ID NO: 120986 - protein, 11 aa, Dengue virus
MVNGVVKLLTK

SEQ ID NO: 120987 - protein, 11 aa, Dengue virus
VNGVVKLLTKP

SEQ ID NO: 120988 - protein, 11 aa, Dengue virus
NGVVRLLTKPW

SEQ ID NO: 120989 - protein, 11 aa, Dengue virus
GVVRLLTKPWD

SEQ ID NO: 120990 - protein, 11 aa, Dengue virus
VVRLLTKPWDV

SEQ ID NO: 120991 - protein, 11 aa, Dengue virus
VKLLTKPWDVV

SEQ ID NO: 120992 - protein, 11 aa, Dengue virus
KLLTKPWDVVP

SEQ ID NO: 120993 - protein, 11 aa, Dengue virus
LLTKPWDVVPM

SEQ ID NO: 120994 - protein, 11 aa, Dengue virus
LTKPWDVVPMV

SEQ ID NO: 120995 - protein, 11 aa, Dengue virus
TKPWDVVPMVT

SEQ ID NO: 120996 - protein, 11 aa, Dengue virus
KPWDVVPMVTQ

SEQ ID NO: 120997 - protein, 11 aa, Dengue virus
PMVTQMAMTDT

SEQ ID NO: 120998 - protein, 11 aa, Dengue virus
MVTQMAMTDTT

SEQ ID NO: 120999 - protein, 11 aa, Dengue virus
VTQIAMTDTTP

SEQ ID NO: 121000 - protein, 11 aa, Dengue virus
TQIAMTDTTPF

SEQ ID NO: 121001 - protein, 11 aa, Dengue virus
QIAMTDTTPFG

SEQ ID NO: 121002 - protein, 11 aa, Dengue virus
IAMTDTTPFGQ

SEQ ID NO: 121003 - protein, 11 aa, Dengue virus
VFKEKVDTRTQ

SEQ ID NO: 121004 - protein, 11 aa, Dengue virus
FKEKVDTRTQE

SEQ ID NO: 121005 - protein, 11 aa, Dengue virus
CTREEFTKKVR

SEQ ID NO: 121006 - protein, 11 aa, Dengue virus
RKVRSNAALGA

SEQ ID NO: 121007 - protein, 11 aa, Dengue virus
KVRSNAALGAI

SEQ ID NO: 121008 - protein, 11 aa, Dengue virus
VRSNAALGAIF

SEQ ID NO: 121009 - protein, 11 aa, Dengue virus
RSNAALGAIFT

SEQ ID NO: 121010 - protein, 11 aa, Dengue virus
SNAALGAIFTD

SEQ ID NO: 121011 - protein, 11 aa, Dengue virus
NAALGAIFTDE

SEQ ID NO: 121012 - protein, 11 aa, Dengue virus
AALGAIFTDEN

SEQ ID NO: 121013 - protein, 11 aa, Dengue virus
ALGAIFTDENK

SEQ ID NO: 121014 - protein, 11 aa, Dengue virus
LGAIFTDENKW

SEQ ID NO: 121015 - protein, 11 aa, Dengue virus
GAIFTDENKWK

SEQ ID NO: 121016 - protein, 11 aa, Dengue virus
AIFTDENKWKS

SEQ ID NO: 121017 - protein, 11 aa, Dengue virus
IFTDENKWKSA

SEQ ID NO: 121018 - protein, 11 aa, Dengue virus
FTDENKWKSAR

SEQ ID NO: 121019 - protein, 11 aa, Dengue virus
TDENKWKSARE

SEQ ID NO: 121020 - protein, 11 aa, Dengue virus
DENKWKSAREA

SEQ ID NO: 121021 - protein, 11 aa, Dengue virus
ENKWKSAREAV

SEQ ID NO: 121022 - protein, 11 aa, Dengue virus
NKWKSAREAVE

SEQ ID NO: 121023 - protein, 11 aa, Dengue virus
KWKSAREAVED

SEQ ID NO: 121024 - protein, 11 aa, Dengue virus
ERNLHLEGKCE

SEQ ID NO: 121025 - protein, 11 aa, Dengue virus
RNLHLEGKCET

SEQ ID NO: 121026 - protein, 11 aa, Dengue virus
NLHLEGKCETC

SEQ ID NO: 121027 - protein, 11 aa, Dengue virus
LHLEGKCETCV

SEQ ID NO: 121028 - protein, 11 aa, Dengue virus
HLEGKCETCVY

SEQ ID NO: 121029 - protein, 11 aa, Dengue virus
LEGKCETCVYN

SEQ ID NO: 121030 - protein, 11 aa, Dengue virus
EGKCETCVYNM

SEQ ID NO: 121031 - protein, 11 aa, Dengue virus
GKCETCVYNMM

SEQ ID NO: 121032 - protein, 11 aa, Dengue virus
KCETCVYNMMG

SEQ ID NO: 121033 - protein, 11 aa, Dengue virus
CETCVYNMMGK

SEQ ID NO: 121034 - protein, 11 aa, Dengue virus
ETCVYNMMGKR

SEQ ID NO: 121035 - protein, 11 aa, Dengue virus
SCVYNMMGKRE

SEQ ID NO: 121036 - protein, 11 aa, Dengue virus
KREKKLGEFGR

SEQ ID NO: 121037 - protein, 11 aa, Dengue virus
REKKLGEFGRA

SEQ ID NO: 121038 - protein, 11 aa, Dengue virus
EKKLGEFGRAK

SEQ ID NO: 121039 - protein, 11 aa, Dengue virus
KKLGEFGRAKG

SEQ ID NO: 121040 - protein, 11 aa, Dengue virus
KLGEFGRAKGS

SEQ ID NO: 121041 - protein, 11 aa, Dengue virus
LGEFGRAKGSR

SEQ ID NO: 121042 - protein, 11 aa, Dengue virus
GEFGRAKGSRA

SEQ ID NO: 121043 - protein, 11 aa, Dengue virus
EFGRAKGSRAI

SEQ ID NO: 121044 - protein, 11 aa, Dengue virus
FGRAKGSRAIW

SEQ ID NO: 121045 - protein, 11 aa, Dengue virus
GRAKGSRAIWY

SEQ ID NO: 121046 - protein, 11 aa, Dengue virus
RAKGSRAIWYM

SEQ ID NO: 121047 - protein, 11 aa, Dengue virus
AIWYMWLGARY

SEQ ID NO: 121048 - protein, 11 aa, Dengue virus
IWYMWLGARYL

SEQ ID NO: 121049 - protein, 11 aa, Dengue virus
WYMWLGARYLE

SEQ ID NO: 121050 - protein, 11 aa, Dengue virus
YMWLGARYLEF

SEQ ID NO: 121051 - protein, 11 aa, Dengue virus
MWLGARYLEFE

SEQ ID NO: 121052 - protein, 11 aa, Dengue virus
WLGARYLEFEA

SEQ ID NO: 121053 - protein, 11 aa, Dengue virus
LGARYLEFEAL

SEQ ID NO: 121054 - protein, 11 aa, Dengue virus
GARYLEFEALG

SEQ ID NO: 121055 - protein, 11 aa, Dengue virus
ARYLEFEALGF

SEQ ID NO: 121056 - protein, 11 aa, Dengue virus
RFLEFEALGFL

SEQ ID NO: 121057 - protein, 11 aa, Dengue virus
FLEFEALGFLN

SEQ ID NO: 121058 - protein, 11 aa, Dengue virus
LEFEALGFMNE

SEQ ID NO: 121059 - protein, 11 aa, Dengue virus
EFEALGFMNED

SEQ ID NO: 121060 - protein, 11 aa, Dengue virus
FEALGFMNEDH

SEQ ID NO: 121061 - protein, 11 aa, Dengue virus
EALGFMNEDHW

SEQ ID NO: 121062 - protein, 11 aa, Dengue virus
ALGFMNEDHWF

SEQ ID NO: 121063 - protein, 11 aa, Dengue virus
LGFMNEDHWFS

SEQ ID NO: 121064 - protein, 11 aa, Dengue virus
GFMNEDHWFSR

SEQ ID NO: 121065 - protein, 11 aa, Dengue virus
FLNEDHWFSRE

SEQ ID NO: 121066 - protein, 11 aa, Dengue virus
LNEDHWFSREN

SEQ ID NO: 121067 - protein, 11 aa, Dengue virus
NEDHWFSRGNS

SEQ ID NO: 121068 - protein, 11 aa, Dengue virus
EDHWFSRENSY

SEQ ID NO: 121069 - protein, 11 aa, Dengue virus
DHWFSRENSYS

SEQ ID NO: 121070 - protein, 11 aa, Dengue virus
HWFSRENSYSG

SEQ ID NO: 121071 - protein, 11 aa, Dengue virus
WFSRENSYSGV

SEQ ID NO: 121072 - protein, 11 aa, Dengue virus
FSRENSYSGVE

SEQ ID NO: 121073 - protein, 11 aa, Dengue virus
SRENSYSGVEG

SEQ ID NO: 121074 - protein, 11 aa, Dengue virus
RENSYSGVEGE

SEQ ID NO: 121075 - protein, 11 aa, Dengue virus
ENSYSGVEGEG

SEQ ID NO: 121076 - protein, 11 aa, Dengue virus
NSYSGVEGEGL

SEQ ID NO: 121077 - protein, 11 aa, Dengue virus
SYSGVEGEGLH

SEQ ID NO: 121078 - protein, 11 aa, Dengue virus
YSGVEGEGLHK

SEQ ID NO: 121079 - protein, 11 aa, Dengue virus
SGVEGEGLHRL

SEQ ID NO: 121080 - protein, 11 aa, Dengue virus
GVEGEGLHRLG

SEQ ID NO: 121081 - protein, 11 aa, Dengue virus
VEGEGLHRLGY

SEQ ID NO: 121082 - protein, 11 aa, Dengue virus
EGEGLHRLGYI

SEQ ID NO: 121083 - protein, 11 aa, Dengue virus
GEGLHRLGYIL

SEQ ID NO: 121084 - protein, 11 aa, Dengue virus
EGLHRLGYILR

SEQ ID NO: 121085 - protein, 11 aa, Dengue virus
GGNMYADDTAG

SEQ ID NO: 121086 - protein, 11 aa, Dengue virus
GNMYADDTAGW

SEQ ID NO: 121087 - protein, 11 aa, Dengue virus
NMYADDTAGWD

SEQ ID NO: 121088 - protein, 11 aa, Dengue virus
DTAGWDTRITL

SEQ ID NO: 121089 - protein, 11 aa, Dengue virus
TAGWDTRITLE

SEQ ID NO: 121090 - protein, 11 aa, Dengue virus
AGWDTRITLED

SEQ ID NO: 121091 - protein, 11 aa, Dengue virus
GWDTRITLEDL

SEQ ID NO: 121092 - protein, 11 aa, Dengue virus
SIFKLTYQNKV

SEQ ID NO: 121093 - protein, 11 aa, Dengue virus
FKLTYQNKVVK

SEQ ID NO: 121094 - protein, 11 aa, Dengue virus
KLTYQNKVVKV

SEQ ID NO: 121095 - protein, 11 aa, Dengue virus
LTYQNKVVKVQ

SEQ ID NO: 121096 - protein, 11 aa, Dengue virus
TYQNKVVKVQR

SEQ ID NO: 121097 - protein, 11 aa, Dengue virus
YQNKVVKVQRP

SEQ ID NO: 121098 - protein, 11 aa, Dengue virus
QNKVVRVQRPT

SEQ ID NO: 121099 - protein, 11 aa, Dengue virus
NKVVRVQRPTP

SEQ ID NO: 121100 - protein, 11 aa, Dengue virus
GTVMDIISRRD

SEQ ID NO: 121101 - protein, 11 aa, Dengue virus
TVMDIISRRDQ

SEQ ID NO: 121102 - protein, 11 aa, Dengue virus
VMDIISRKDQR

SEQ ID NO: 121103 - protein, 11 aa, Dengue virus
MDIISRKDQRG

SEQ ID NO: 121104 - protein, 11 aa, Dengue virus
DIISRKDQRGS

SEQ ID NO: 121105 - protein, 11 aa, Dengue virus
IISRKDQRGSG

SEQ ID NO: 121106 - protein, 11 aa, Dengue virus
ISRKDQRGSGQ

SEQ ID NO: 121107 - protein, 11 aa, Dengue virus
SRKDQRGSGQV

SEQ ID NO: 121108 - protein, 11 aa, Dengue virus
RKDQRGSGQVG

SEQ ID NO: 121109 - protein, 11 aa, Dengue virus
KDQRGSGQVGT

SEQ ID NO: 121110 - protein, 11 aa, Dengue virus
DQRGSGQVVTY

SEQ ID NO: 121111 - protein, 11 aa, Dengue virus
QRGSGQVVTYG

SEQ ID NO: 121112 - protein, 11 aa, Dengue virus
RGSGQVVTYGL

SEQ ID NO: 121113 - protein, 11 aa, Dengue virus
GSGQVVTYGLN

SEQ ID NO: 121114 - protein, 11 aa, Dengue virus
SGQVVTYGLNT

SEQ ID NO: 121115 - protein, 11 aa, Dengue virus
FTNMEVQLIRQ

SEQ ID NO: 121116 - protein, 11 aa, Dengue virus
TNMEVQLIRQM

SEQ ID NO: 121117 - protein, 11 aa, Dengue virus
NMEVQLIRQME

SEQ ID NO: 121118 - protein, 11 aa, Dengue virus
AQLIRQMESEG

SEQ ID NO: 121119 - protein, 11 aa, Dengue virus
ERLSRMAISGD

SEQ ID NO: 121120 - protein, 11 aa, Dengue virus
RLSRMAISGDD

SEQ ID NO: 121121 - protein, 11 aa, Dengue virus
LSRMAISGDDC

SEQ ID NO: 121122 - protein, 11 aa, Dengue virus
SRMAISGDDCV

SEQ ID NO: 121123 - protein, 11 aa, Dengue virus
ISGDDCVVKPL

SEQ ID NO: 121124 - protein, 11 aa, Dengue virus
SGDDCVVKPLD

SEQ ID NO: 121125 - protein, 11 aa, Dengue virus
GDDCVVKPLDD

SEQ ID NO: 121126 - protein, 11 aa, Dengue virus
DDCVVKPLDDR

SEQ ID NO: 121127 - protein, 11 aa, Dengue virus
DCVVKPLDDRF

SEQ ID NO: 121128 - protein, 11 aa, Dengue virus
ALNDMGKIRKD

SEQ ID NO: 121129 - protein, 11 aa, Dengue virus
LNDMGKIRKDI

SEQ ID NO: 121130 - protein, 11 aa, Dengue virus
NDMGKVRKDIQ

SEQ ID NO: 121131 - protein, 11 aa, Dengue virus
DMGKVRKDIQQ

SEQ ID NO: 121132 - protein, 11 aa, Dengue virus
MGKVRKDIQQW

SEQ ID NO: 121133 - protein, 11 aa, Dengue virus
GKVRKDIPQWQ

SEQ ID NO: 121134 - protein, 11 aa, Dengue virus
KVRKDIPQWQP

SEQ ID NO: 121135 - protein, 11 aa, Dengue virus
VRKDIPQWQPS

SEQ ID NO: 121136 - protein, 11 aa, Dengue virus
RKDIQQWEPSR

SEQ ID NO: 121137 - protein, 11 aa, Dengue virus
KDIQQWEPSRG

SEQ ID NO: 121138 - protein, 11 aa, Dengue virus
DIQQWEPSRGW

SEQ ID NO: 121139 - protein, 11 aa, Dengue virus
QWEPSRGWNDW

SEQ ID NO: 121140 - protein, 11 aa, Dengue virus
GWNDWTQVPFC

SEQ ID NO: 121141 - protein, 11 aa, Dengue virus
WNDWTQVPFCS

SEQ ID NO: 121142 - protein, 11 aa, Dengue virus
NDWTQVPFCSH

SEQ ID NO: 121143 - protein, 11 aa, Dengue virus
DWTQVPFCSHH

SEQ ID NO: 121144 - protein, 11 aa, Dengue virus
WTQVPFCSHHF

SEQ ID NO: 121145 - protein, 11 aa, Dengue virus
TQVPFCSHHFH

SEQ ID NO: 121146 - protein, 11 aa, Dengue virus
QVPFCSHHFHQ

SEQ ID NO: 121147 - protein, 11 aa, Dengue virus
VPFCSHHFHQL

SEQ ID NO: 121148 - protein, 11 aa, Dengue virus
PFCSHHFHELI

SEQ ID NO: 121149 - protein, 11 aa, Dengue virus
FCSHHFHELIM

SEQ ID NO: 121150 - protein, 11 aa, Dengue virus
CSHHFHELIMK

SEQ ID NO: 121151 - protein, 11 aa, Dengue virus
SHHFHELIMKD

SEQ ID NO: 121152 - protein, 11 aa, Dengue virus
HHFHELIMKDG

SEQ ID NO: 121153 - protein, 11 aa, Dengue virus
HFHELIMKDGR

SEQ ID NO: 121154 - protein, 11 aa, Dengue virus
LVVPCRNQDEL

SEQ ID NO: 121155 - protein, 11 aa, Dengue virus
VVPCRNQDELI

SEQ ID NO: 121156 - protein, 11 aa, Dengue virus
VPCRNQDELIG

SEQ ID NO: 121157 - protein, 11 aa, Dengue virus
PCRNQDELIGR

SEQ ID NO: 121158 - protein, 11 aa, Dengue virus
CRNQDELIGRA

SEQ ID NO: 121159 - protein, 11 aa, Dengue virus
RNQDELIGRAR

SEQ ID NO: 121160 - protein, 11 aa, Dengue virus
NQDELIGRARI

SEQ ID NO: 121161 - protein, 11 aa, Dengue virus
QDELVGRARVS

SEQ ID NO: 121162 - protein, 11 aa, Dengue virus
DELVGRARVSQ

SEQ ID NO: 121163 - protein, 11 aa, Dengue virus
ELVGRARVSQG

SEQ ID NO: 121164 - protein, 11 aa, Dengue virus
LVGRARVSQGA

SEQ ID NO: 121165 - protein, 11 aa, Dengue virus
VGRARVSQGAG

SEQ ID NO: 121166 - protein, 11 aa, Dengue virus
GRARVSQGAGW

SEQ ID NO: 121167 - protein, 11 aa, Dengue virus
RARVSQGAGWS

SEQ ID NO: 121168 - protein, 11 aa, Dengue virus
ARVSQGAGWSL

SEQ ID NO: 121169 - protein, 11 aa, Dengue virus
RISQGAGWSLR

SEQ ID NO: 121170 - protein, 11 aa, Dengue virus
ISQGAGWSLRE

SEQ ID NO: 121171 - protein, 11 aa, Dengue virus
SQGAGWSLKET

SEQ ID NO: 121172 - protein, 11 aa, Dengue virus
QGAGWSLKETA

SEQ ID NO: 121173 - protein, 11 aa, Dengue virus
GAGWSLKETAC

SEQ ID NO: 121174 - protein, 11 aa, Dengue virus
AGWSLKETACL

SEQ ID NO: 121175 - protein, 11 aa, Dengue virus
GWSLKETACLG

SEQ ID NO: 121176 - protein, 11 aa, Dengue virus
WSLKETACLGK

SEQ ID NO: 121177 - protein, 11 aa, Dengue virus
SLKETACLGKS

SEQ ID NO: 121178 - protein, 11 aa, Dengue virus
LKETACLGKSY

SEQ ID NO: 121179 - protein, 11 aa, Dengue virus
KETACLGKSYA

SEQ ID NO: 121180 - protein, 11 aa, Dengue virus
ETACLGKAYAQ

SEQ ID NO: 121181 - protein, 11 aa, Dengue virus
TACLGKAYAQM

SEQ ID NO: 121182 - protein, 11 aa, Dengue virus
ACLGKAYAQMW

SEQ ID NO: 121183 - protein, 11 aa, Dengue virus
CLGKAYAQMWS

SEQ ID NO: 121184 - protein, 11 aa, Dengue virus
LGKAYAQMWSL

SEQ ID NO: 121185 - protein, 11 aa, Dengue virus
GKAYAQMWSLM

SEQ ID NO: 121186 - protein, 11 aa, Dengue virus
KAYAQMWSLMY

SEQ ID NO: 121187 - protein, 11 aa, Dengue virus
AYAQMWSLMYF

SEQ ID NO: 121188 - protein, 11 aa, Dengue virus
YAQMWSLMYFH

SEQ ID NO: 121189 - protein, 11 aa, Dengue virus
AQMWSLMYFHR

SEQ ID NO: 121190 - protein, 11 aa, Dengue virus
QMWSLMYFHRR

SEQ ID NO: 121191 - protein, 11 aa, Dengue virus
MWSLMYFHRRD

SEQ ID NO: 121192 - protein, 11 aa, Dengue virus
WSLMYFHRRDL

SEQ ID NO: 121193 - protein, 11 aa, Dengue virus
SLMYFHRRDLR

SEQ ID NO: 121194 - protein, 11 aa, Dengue virus
YFHRRDLRLAS

SEQ ID NO: 121195 - protein, 11 aa, Dengue virus
FHRRDLRLASN

SEQ ID NO: 121196 - protein, 11 aa, Dengue virus
HRRDLRLASNA

SEQ ID NO: 121197 - protein, 11 aa, Dengue virus
RRDLRLASNAI

SEQ ID NO: 121198 - protein, 11 aa, Dengue virus
RDLRLASNAIC

SEQ ID NO: 121199 - protein, 11 aa, Dengue virus
DLRLASNAICS

SEQ ID NO: 121200 - protein, 11 aa, Dengue virus
LRLASNAICSA

SEQ ID NO: 121201 - protein, 11 aa, Dengue virus
RLASNAICSAV

SEQ ID NO: 121202 - protein, 11 aa, Dengue virus
LASNAICSAVP

SEQ ID NO: 121203 - protein, 11 aa, Dengue virus
DWVPTSRTTWS

SEQ ID NO: 121204 - protein, 11 aa, Dengue virus
WIPTSRTTWSI

SEQ ID NO: 121205 - protein, 11 aa, Dengue virus
IPTSRTTWSIH

SEQ ID NO: 121206 - protein, 11 aa, Dengue virus
TSRTTWSIHAK

SEQ ID NO: 121207 - protein, 11 aa, Dengue virus
SRTTWSIHAKH

SEQ ID NO: 121208 - protein, 11 aa, Dengue virus
RTTWSIHAKHE

SEQ ID NO: 121209 - protein, 11 aa, Dengue virus
TTWSIHAKHEW

SEQ ID NO: 121210 - protein, 11 aa, Dengue virus
TWSIHAKHEWM

SEQ ID NO: 121211 - protein, 11 aa, Dengue virus
WSIHAKHEWMT

SEQ ID NO: 121212 - protein, 11 aa, Dengue virus
SIHAKHEWMTT

SEQ ID NO: 121213 - protein, 11 aa, Dengue virus
IHAKHEWMTTE

SEQ ID NO: 121214 - protein, 11 aa, Dengue virus
HAKHEWMTTED

SEQ ID NO: 121215 - protein, 11 aa, Dengue virus
AKHEWMTTEDM

SEQ ID NO: 121216 - protein, 11 aa, Dengue virus
KHEWMTTEDML

SEQ ID NO: 121217 - protein, 11 aa, Dengue virus
HQWMTTEDMLT

SEQ ID NO: 121218 - protein, 11 aa, Dengue virus
QWMTTEDMLTV

SEQ ID NO: 121219 - protein, 11 aa, Dengue virus
WMTTEDMLTVW

SEQ ID NO: 121220 - protein, 11 aa, Dengue virus
MTTEDMLTVWN

SEQ ID NO: 121221 - protein, 11 aa, Dengue virus
TTEDMLTVWNR

SEQ ID NO: 121222 - protein, 11 aa, Dengue virus
TEDMLTVWNRV

SEQ ID NO: 121223 - protein, 11 aa, Dengue virus
EDMLTVWNRVW

SEQ ID NO: 121224 - protein, 11 aa, Dengue virus
DMLTVWNRVWI

SEQ ID NO: 121225 - protein, 11 aa, Dengue virus
EVPYLGKREDQ

SEQ ID NO: 121226 - protein, 11 aa, Dengue virus
IPYLGKREDQW

SEQ ID NO: 121227 - protein, 11 aa, Dengue virus
PYLGKREDLWC

SEQ ID NO: 121228 - protein, 11 aa, Dengue virus
YLGKREDLWCG

SEQ ID NO: 121229 - protein, 11 aa, Dengue virus
LGKREDLWCGS

SEQ ID NO: 121230 - protein, 11 aa, Dengue virus
GKREDLWCGSL

SEQ ID NO: 121231 - protein, 11 aa, Dengue virus
KREDLWCGSLI

SEQ ID NO: 121232 - protein, 11 aa, Dengue virus
REDLWCGSLIG

SEQ ID NO: 121233 - protein, 11 aa, Dengue virus
EDLWCGSLIGL

SEQ ID NO: 121234 - protein, 11 aa, Dengue virus
DLWCGSLIGLS

SEQ ID NO: 121235 - protein, 11 aa, Dengue virus
QWCGSLIGLTA

SEQ ID NO: 121236 - protein, 11 aa, Dengue virus
WCGSLIGLTAR

SEQ ID NO: 121237 - protein, 11 aa, Dengue virus
CGSLIGLTARA

SEQ ID NO: 121238 - protein, 11 aa, Dengue virus
GSLIGLTARAT

SEQ ID NO: 121239 - protein, 11 aa, Dengue virus
SLIGLTARATW

SEQ ID NO: 121240 - protein, 11 aa, Dengue virus
LIGLTARATWA

SEQ ID NO: 121241 - protein, 11 aa, Dengue virus
IGLTSRATWAK

SEQ ID NO: 121242 - protein, 11 aa, Dengue virus
GLTSRATWAKN

SEQ ID NO: 121243 - protein, 11 aa, Dengue virus
LTSRATWAKNI

SEQ ID NO: 121244 - protein, 11 aa, Dengue virus
PSINMLKRVRN

SEQ ID NO: 121245 - protein, 11 aa, Dengue virus
SINMLKRVRNR

SEQ ID NO: 121246 - protein, 11 aa, Dengue virus
INMLKRVRNRV

SEQ ID NO: 121247 - protein, 11 aa, Dengue virus
NMLKRVRNRVS

SEQ ID NO: 121248 - protein, 11 aa, Dengue virus
MLKRVRNRVST

SEQ ID NO: 121249 - protein, 11 aa, Dengue virus
RNRVSTGSQLA

SEQ ID NO: 121250 - protein, 11 aa, Dengue virus
NRVSTGSQLAK

SEQ ID NO: 121251 - protein, 11 aa, Dengue virus
RVSTGSQLAKR

SEQ ID NO: 121252 - protein, 11 aa, Dengue virus
VSTGSQLAKRF

SEQ ID NO: 121253 - protein, 11 aa, Dengue virus
STGSQLAKRFS

SEQ ID NO: 121254 - protein, 11 aa, Dengue virus
SQLAKRFSRGL

SEQ ID NO: 121255 - protein, 11 aa, Dengue virus
QLAKRFSRGLL

SEQ ID NO: 121256 - protein, 11 aa, Dengue virus
LAKRFSKGLLN

SEQ ID NO: 121257 - protein, 11 aa, Dengue virus
AKRFSKGLLNG

SEQ ID NO: 121258 - protein, 11 aa, Dengue virus
KRFSKGLLNGQ

SEQ ID NO: 121259 - protein, 11 aa, Dengue virus
RFSKGLLNGQG

SEQ ID NO: 121260 - protein, 11 aa, Dengue virus
FSKGLLNGQGP

SEQ ID NO: 121261 - protein, 11 aa, Dengue virus
MVLAFITFLRV

SEQ ID NO: 121262 - protein, 11 aa, Dengue virus
VLAFITFLRVL

SEQ ID NO: 121263 - protein, 11 aa, Dengue virus
LAFITFLRVLS

SEQ ID NO: 121264 - protein, 11 aa, Dengue virus
AFITFLRVLSI

SEQ ID NO: 121265 - protein, 11 aa, Dengue virus
FITFLRVLSIP

SEQ ID NO: 121266 - protein, 11 aa, Dengue virus
ITFLRVLSIPP

SEQ ID NO: 121267 - protein, 11 aa, Dengue virus
TFLRVLSIPPT

SEQ ID NO: 121268 - protein, 11 aa, Dengue virus
FLRVLSIPPTA

SEQ ID NO: 121269 - protein, 11 aa, Dengue virus
LRVLSIPPTAG

SEQ ID NO: 121270 - protein, 11 aa, Dengue virus
RFLAIPPTAGV

SEQ ID NO: 121271 - protein, 11 aa, Dengue virus
FLAIPPTAGVL

SEQ ID NO: 121272 - protein, 11 aa, Dengue virus
LAIPPTAGVLA

SEQ ID NO: 121273 - protein, 11 aa, Dengue virus
AIPPTAGVLAR

SEQ ID NO: 121274 - protein, 11 aa, Dengue virus
IPPTAGVLARW

SEQ ID NO: 121275 - protein, 11 aa, Dengue virus
PPTAGVLARWG

SEQ ID NO: 121276 - protein, 11 aa, Dengue virus
AFHLTSRDGEP

SEQ ID NO: 121277 - protein, 11 aa, Dengue virus
FHLTSRDGEPR

SEQ ID NO: 121278 - protein, 11 aa, Dengue virus
HLTSRDGEPRM

SEQ ID NO: 121279 - protein, 11 aa, Dengue virus
LTSRDGEPRMI

SEQ ID NO: 121280 - protein, 11 aa, Dengue virus
TSRDGEPRMIV

SEQ ID NO: 121281 - protein, 11 aa, Dengue virus
NERGKSLLFKT

SEQ ID NO: 121282 - protein, 11 aa, Dengue virus
ERGKSLLFKTA

SEQ ID NO: 121283 - protein, 11 aa, Dengue virus
NMCTLMAMDLG

SEQ ID NO: 121284 - protein, 11 aa, Dengue virus
MCTLMAMDLGE

SEQ ID NO: 121285 - protein, 11 aa, Dengue virus
CTLMAIDLGEL

SEQ ID NO: 121286 - protein, 11 aa, Dengue virus
TLMAIDLGELC

SEQ ID NO: 121287 - protein, 11 aa, Dengue virus
AIDLGELCEDT

SEQ ID NO: 121288 - protein, 11 aa, Dengue virus
EPEDIDCWCNL

SEQ ID NO: 121289 - protein, 11 aa, Dengue virus
PEDIDCWCNLT

SEQ ID NO: 121290 - protein, 11 aa, Dengue virus
EDIDCWCNLTS

SEQ ID NO: 121291 - protein, 11 aa, Dengue virus
DIDCWCNLTST

SEQ ID NO: 121292 - protein, 11 aa, Dengue virus
IDCWCNLTSTW

SEQ ID NO: 121293 - protein, 11 aa, Dengue virus
GERRREKRSVA

SEQ ID NO: 121294 - protein, 11 aa, Dengue virus
ERRREKRSVAL

SEQ ID NO: 121295 - protein, 11 aa, Dengue virus
RRREKRSVALT

SEQ ID NO: 121296 - protein, 11 aa, Dengue virus
RREKRSVALTP

SEQ ID NO: 121297 - protein, 11 aa, Dengue virus
REKRSVALTPH

SEQ ID NO: 121298 - protein, 11 aa, Dengue virus
EKRSVALTPHS

SEQ ID NO: 121299 - protein, 11 aa, Dengue virus
KRSVALTPHSG

SEQ ID NO: 121300 - protein, 11 aa, Dengue virus
RSVALAPHVGM

SEQ ID NO: 121301 - protein, 11 aa, Dengue virus
SVALAPHVGMG

SEQ ID NO: 121302 - protein, 11 aa, Dengue virus
VALAPHVGMGL

SEQ ID NO: 121303 - protein, 11 aa, Dengue virus
ALAPHVGMGLD

SEQ ID NO: 121304 - protein, 11 aa, Dengue virus
LAPHVGMGLDT

SEQ ID NO: 121305 - protein, 11 aa, Dengue virus
APHVGMGLDTR

SEQ ID NO: 121306 - protein, 11 aa, Dengue virus
GLETRAETWMS

SEQ ID NO: 121307 - protein, 11 aa, Dengue virus
LETRAETWMSS

SEQ ID NO: 121308 - protein, 11 aa, Dengue virus
ETRAETWMSSE

SEQ ID NO: 121309 - protein, 11 aa, Dengue virus
TRAETWMSSEG

SEQ ID NO: 121310 - protein, 11 aa, Dengue virus
RAETWMSSEGA

SEQ ID NO: 121311 - protein, 11 aa, Dengue virus
AETWMSSEGAW

SEQ ID NO: 121312 - protein, 11 aa, Dengue virus
ETWMSSEGAWR

SEQ ID NO: 121313 - protein, 11 aa, Dengue virus
TWMSAEGAWRQ

SEQ ID NO: 121314 - protein, 11 aa, Dengue virus
VESWILRNPGF

SEQ ID NO: 121315 - protein, 11 aa, Dengue virus
ESWILRNPGFA

SEQ ID NO: 121316 - protein, 11 aa, Dengue virus
MRCVGVGNRDF

SEQ ID NO: 121317 - protein, 11 aa, Dengue virus
RCVGVGNRDFV

SEQ ID NO: 121318 - protein, 11 aa, Dengue virus
CVGVGNRDFVE

SEQ ID NO: 121319 - protein, 11 aa, Dengue virus
VGVGNRDFVEG

SEQ ID NO: 121320 - protein, 11 aa, Dengue virus
SNRDFVEGVSG

SEQ ID NO: 121321 - protein, 11 aa, Dengue virus
NRDFVEGLSGA

SEQ ID NO: 121322 - protein, 11 aa, Dengue virus
RDFVEGVSGGA

SEQ ID NO: 121323 - protein, 11 aa, Dengue virus
DFVEGVSGGAW

SEQ ID NO: 121324 - protein, 11 aa, Dengue virus
FVEGVSGGAWV

SEQ ID NO: 121325 - protein, 11 aa, Dengue virus
VEGVSGGAWVD

SEQ ID NO: 121326 - protein, 11 aa, Dengue virus
EGVSGGAWVDL

SEQ ID NO: 121327 - protein, 11 aa, Dengue virus
GVSGGAWVDLV

SEQ ID NO: 121328 - protein, 11 aa, Dengue virus
VSGGAWVDLVL

SEQ ID NO: 121329 - protein, 11 aa, Dengue virus
SGGAWVDLVLE

SEQ ID NO: 121330 - protein, 11 aa, Dengue virus
GGAWVDLVLEH

SEQ ID NO: 121331 - protein, 11 aa, Dengue virus
GAWVDLVLEHG

SEQ ID NO: 121332 - protein, 11 aa, Dengue virus
TWVDVVLEHGG

SEQ ID NO: 121333 - protein, 11 aa, Dengue virus
WVDVVLEHGGC

SEQ ID NO: 121334 - protein, 11 aa, Dengue virus
VDVVLEHGGCV

SEQ ID NO: 121335 - protein, 11 aa, Dengue virus
DVVLEHGGCVT

SEQ ID NO: 121336 - protein, 11 aa, Dengue virus
VVLEHGGCVTT

SEQ ID NO: 121337 - protein, 11 aa, Dengue virus
EHGGCVTTMAQ

SEQ ID NO: 121338 - protein, 11 aa, Dengue virus
HGGCVTTMAKN

SEQ ID NO: 121339 - protein, 11 aa, Dengue virus
GGCVTTMAKNK

SEQ ID NO: 121340 - protein, 11 aa, Dengue virus
GCVTTMAKNKP

SEQ ID NO: 121341 - protein, 11 aa, Dengue virus
CVTTMAQGKPT

SEQ ID NO: 121342 - protein, 11 aa, Dengue virus
VTTMAQGKPTL

SEQ ID NO: 121343 - protein, 11 aa, Dengue virus
TTMAQGKPTLD

SEQ ID NO: 121344 - protein, 11 aa, Dengue virus
TMAKNKPTLDI

SEQ ID NO: 121345 - protein, 11 aa, Dengue virus
MAKNKPTLDIE

SEQ ID NO: 121346 - protein, 11 aa, Dengue virus
AKNKPTLDIEL

SEQ ID NO: 121347 - protein, 11 aa, Dengue virus
KPTLDIELQKT

SEQ ID NO: 121348 - protein, 11 aa, Dengue virus
PTLDIELQKTE

SEQ ID NO: 121349 - protein, 11 aa, Dengue virus
TLDIELQKTEA

SEQ ID NO: 121350 - protein, 11 aa, Dengue virus
LDIELQKTEAT

SEQ ID NO: 121351 - protein, 11 aa, Dengue virus
TTATRCPTQGE

SEQ ID NO: 121352 - protein, 11 aa, Dengue virus
TATRCPTQGEP

SEQ ID NO: 121353 - protein, 11 aa, Dengue virus
CKHTYVDRGWG

SEQ ID NO: 121354 - protein, 11 aa, Dengue virus
KHTYVDRGWGN

SEQ ID NO: 121355 - protein, 11 aa, Dengue virus
HTYVDRGWGNG

SEQ ID NO: 121356 - protein, 11 aa, Dengue virus
TYVDRGWGNGC

SEQ ID NO: 121357 - protein, 11 aa, Dengue virus
YVDRGWGNGCG

SEQ ID NO: 121358 - protein, 11 aa, Dengue virus
NGCGLFGKGGV

SEQ ID NO: 121359 - protein, 11 aa, Dengue virus
GCGLFGKGSLV

SEQ ID NO: 121360 - protein, 11 aa, Dengue virus
CGLFGKGSLVT

SEQ ID NO: 121361 - protein, 11 aa, Dengue virus
GLFGKGSLVTC

SEQ ID NO: 121362 - protein, 11 aa, Dengue virus
LFGKGSLVTCA

SEQ ID NO: 121363 - protein, 11 aa, Dengue virus
FGKGSLVTCAK

SEQ ID NO: 121364 - protein, 11 aa, Dengue virus
GKGSLVTCAKF

SEQ ID NO: 121365 - protein, 11 aa, Dengue virus
TVHNGDTHAVG

SEQ ID NO: 121366 - protein, 11 aa, Dengue virus
VHNGDTHAVGN

SEQ ID NO: 121367 - protein, 11 aa, Dengue virus
HTGDQHQVGND

SEQ ID NO: 121368 - protein, 11 aa, Dengue virus
LGLECSPRTGL

SEQ ID NO: 121369 - protein, 11 aa, Dengue virus
GLECSPRTGLD

SEQ ID NO: 121370 - protein, 11 aa, Dengue virus
LECSPRTGLDF

SEQ ID NO: 121371 - protein, 11 aa, Dengue virus
DCEPRSGIDFN

SEQ ID NO: 121372 - protein, 11 aa, Dengue virus
SPRTSLDFNEM

SEQ ID NO: 121373 - protein, 11 aa, Dengue virus
PRSGIDFNEMI

SEQ ID NO: 121374 - protein, 11 aa, Dengue virus
RSGIDFNEMIL

SEQ ID NO: 121375 - protein, 11 aa, Dengue virus
SGIDFNEMILM

SEQ ID NO: 121376 - protein, 11 aa, Dengue virus
GLDFNEMILLT

SEQ ID NO: 121377 - protein, 11 aa, Dengue virus
LDFNEMILLTM

SEQ ID NO: 121378 - protein, 11 aa, Dengue virus
KAWMVHRQWFF

SEQ ID NO: 121379 - protein, 11 aa, Dengue virus
AWMVHRQWFFD

SEQ ID NO: 121380 - protein, 11 aa, Dengue virus
WMVHRQWFFDL

SEQ ID NO: 121381 - protein, 11 aa, Dengue virus
MVHRQWFFDLP

SEQ ID NO: 121382 - protein, 11 aa, Dengue virus
VHRQWFFDLPL

SEQ ID NO: 121383 - protein, 11 aa, Dengue virus
HRQWFFDLPLP

SEQ ID NO: 121384 - protein, 11 aa, Dengue virus
RQWFFDLPLPW

SEQ ID NO: 121385 - protein, 11 aa, Dengue virus
QWFFDLPLPWT

SEQ ID NO: 121386 - protein, 11 aa, Dengue virus
KELLVTFKNAH

SEQ ID NO: 121387 - protein, 11 aa, Dengue virus
ELLVTFKNAHA

SEQ ID NO: 121388 - protein, 11 aa, Dengue virus
LLVTFKNAHAK

SEQ ID NO: 121389 - protein, 11 aa, Dengue virus
LVTFKNAHAKK

SEQ ID NO: 121390 - protein, 11 aa, Dengue virus
VTFKNAHAKKQ

SEQ ID NO: 121391 - protein, 11 aa, Dengue virus
TFKNAHAKKQE

SEQ ID NO: 121392 - protein, 11 aa, Dengue virus
FKNAHAKKQEV

SEQ ID NO: 121393 - protein, 11 aa, Dengue virus
KNAHAKKQEVV

SEQ ID NO: 121394 - protein, 11 aa, Dengue virus
NAHAKKQEVVV

SEQ ID NO: 121395 - protein, 11 aa, Dengue virus
PHAKRQDVTVL

SEQ ID NO: 121396 - protein, 11 aa, Dengue virus
HAKRQDVTVLG

SEQ ID NO: 121397 - protein, 11 aa, Dengue virus
AKRQDVTVLGS

SEQ ID NO: 121398 - protein, 11 aa, Dengue virus
KRQDVTVLGSQ

SEQ ID NO: 121399 - protein, 11 aa, Dengue virus
RQDVTVLGSQE

SEQ ID NO: 121400 - protein, 11 aa, Dengue virus
QDVTVLGSQEG

SEQ ID NO: 121401 - protein, 11 aa, Dengue virus
DVTVLGSQEGA

SEQ ID NO: 121402 - protein, 11 aa, Dengue virus
TALTGATEIQN

SEQ ID NO: 121403 - protein, 11 aa, Dengue virus
ALTGATEIQNS

SEQ ID NO: 121404 - protein, 11 aa, Dengue virus
GGTSIFAGHLK

SEQ ID NO: 121405 - protein, 11 aa, Dengue virus
GTSIFAGHLKC

SEQ ID NO: 121406 - protein, 11 aa, Dengue virus
TSIFAGHLKCR

SEQ ID NO: 121407 - protein, 11 aa, Dengue virus
SIFAGHLKCRL

SEQ ID NO: 121408 - protein, 11 aa, Dengue virus
MFAGHLKCKVR

SEQ ID NO: 121409 - protein, 11 aa, Dengue virus
FAGHLKCKVRM

SEQ ID NO: 121410 - protein, 11 aa, Dengue virus
AGHLKCKVRME

SEQ ID NO: 121411 - protein, 11 aa, Dengue virus
GHLKCKVRMEK

SEQ ID NO: 121412 - protein, 11 aa, Dengue virus
HLKCKVRMEKL

SEQ ID NO: 121413 - protein, 11 aa, Dengue virus
LKCRLKMDKLE

SEQ ID NO: 121414 - protein, 11 aa, Dengue virus
KCRLKMDKLEL

SEQ ID NO: 121415 - protein, 11 aa, Dengue virus
CRLKMDKLELK

SEQ ID NO: 121416 - protein, 11 aa, Dengue virus
RLKMDKLELKG

SEQ ID NO: 121417 - protein, 11 aa, Dengue virus
KKEVSETQHGT

SEQ ID NO: 121418 - protein, 11 aa, Dengue virus
KEVSETQHGTI

SEQ ID NO: 121419 - protein, 11 aa, Dengue virus
EVSETQHGTIL

SEQ ID NO: 121420 - protein, 11 aa, Dengue virus
VSETQHGTILI

SEQ ID NO: 121421 - protein, 11 aa, Dengue virus
SETQHGTILIK

SEQ ID NO: 121422 - protein, 11 aa, Dengue virus
VTNIELEPPFG

SEQ ID NO: 121423 - protein, 11 aa, Dengue virus
VNIETEPPFGE

SEQ ID NO: 121424 - protein, 11 aa, Dengue virus
NIETEPPFGES

SEQ ID NO: 121425 - protein, 11 aa, Dengue virus
IEAEPPFGESN

SEQ ID NO: 121426 - protein, 11 aa, Dengue virus
EAEPPFGESNI

SEQ ID NO: 121427 - protein, 11 aa, Dengue virus
GSSIGKMFEST

SEQ ID NO: 121428 - protein, 11 aa, Dengue virus
IGKMFESTYRG

SEQ ID NO: 121429 - protein, 11 aa, Dengue virus
GKMFESTYRGA

SEQ ID NO: 121430 - protein, 11 aa, Dengue virus
KMFESTYRGAK

SEQ ID NO: 121431 - protein, 11 aa, Dengue virus
MFESTYRGAKR

SEQ ID NO: 121432 - protein, 11 aa, Dengue virus
FESTYRGAKRM

SEQ ID NO: 121433 - protein, 11 aa, Dengue virus
ESTYRGAKRMA

SEQ ID NO: 121434 - protein, 11 aa, Dengue virus
STYRGAKRMAI

SEQ ID NO: 121435 - protein, 11 aa, Dengue virus
TYRGAKRMAIL

SEQ ID NO: 121436 - protein, 11 aa, Dengue virus
YRGAKRMAILG

SEQ ID NO: 121437 - protein, 11 aa, Dengue virus
RGAKRMAILGE

SEQ ID NO: 121438 - protein, 11 aa, Dengue virus
GAKRMAILGET

SEQ ID NO: 121439 - protein, 11 aa, Dengue virus
AKRMAILGETA

SEQ ID NO: 121440 - protein, 11 aa, Dengue virus
KRMAILGETAW

SEQ ID NO: 121441 - protein, 11 aa, Dengue virus
LGDTAWDFGSV

SEQ ID NO: 121442 - protein, 11 aa, Dengue virus
GDTAWDFGSVG

SEQ ID NO: 121443 - protein, 11 aa, Dengue virus
DTAWDFGSVGG

SEQ ID NO: 121444 - protein, 11 aa, Dengue virus
TAWDFGSVGGV

SEQ ID NO: 121445 - protein, 11 aa, Dengue virus
AYTALFSGVSW

SEQ ID NO: 121446 - protein, 11 aa, Dengue virus
GKELKCGSGIF

SEQ ID NO: 121447 - protein, 11 aa, Dengue virus
KELKCGSGIFV

SEQ ID NO: 121448 - protein, 11 aa, Dengue virus
ELKCGSGIFVV

SEQ ID NO: 121449 - protein, 11 aa, Dengue virus
LKCGSGIFVVD

SEQ ID NO: 121450 - protein, 11 aa, Dengue virus
KCGSGIFVVDN

SEQ ID NO: 121451 - protein, 11 aa, Dengue virus
CGSGIFVVDNV

SEQ ID NO: 121452 - protein, 11 aa, Dengue virus
GSGIFVVDNVH

SEQ ID NO: 121453 - protein, 11 aa, Dengue virus
SGIFVVDNVHT

SEQ ID NO: 121454 - protein, 11 aa, Dengue virus
GIFVVDNVHTW

SEQ ID NO: 121455 - protein, 11 aa, Dengue virus
IFVVDNVHTWT

SEQ ID NO: 121456 - protein, 11 aa, Dengue virus
FVVDNVHTWTE

SEQ ID NO: 121457 - protein, 11 aa, Dengue virus
VVDNVHTWTEQ

SEQ ID NO: 121458 - protein, 11 aa, Dengue virus
VDNVHTWTEQY

SEQ ID NO: 121459 - protein, 11 aa, Dengue virus
EQYKFQPESPA

SEQ ID NO: 121460 - protein, 11 aa, Dengue virus
QYKFQPESPAR

SEQ ID NO: 121461 - protein, 11 aa, Dengue virus
YKFQPESPARL

SEQ ID NO: 121462 - protein, 11 aa, Dengue virus
KFQADSPKRLA

SEQ ID NO: 121463 - protein, 11 aa, Dengue virus
FQADSPKRLAT

SEQ ID NO: 121464 - protein, 11 aa, Dengue virus
QADSPKRLATA

SEQ ID NO: 121465 - protein, 11 aa, Dengue virus
ADSPKRLATAI

SEQ ID NO: 121466 - protein, 11 aa, Dengue virus
DSPKRLATAIA

SEQ ID NO: 121467 - protein, 11 aa, Dengue virus
SPKRLATAIAG

SEQ ID NO: 121468 - protein, 11 aa, Dengue virus
PKRLATAIAGA

SEQ ID NO: 121469 - protein, 11 aa, Dengue virus
GVCGIRSTTRM

SEQ ID NO: 121470 - protein, 11 aa, Dengue virus
VCGIRSTTRME

SEQ ID NO: 121471 - protein, 11 aa, Dengue virus
CGIRSTTRMEN

SEQ ID NO: 121472 - protein, 11 aa, Dengue virus
GIRSTTRMENL

SEQ ID NO: 121473 - protein, 11 aa, Dengue virus
IRSTTRMENLL

SEQ ID NO: 121474 - protein, 11 aa, Dengue virus
RSTTRMENLLW

SEQ ID NO: 121475 - protein, 11 aa, Dengue virus
TRMENLLWKQI

SEQ ID NO: 121476 - protein, 11 aa, Dengue virus
RAWNVWEVEDY

SEQ ID NO: 121477 - protein, 11 aa, Dengue virus
AWNVWEVEDYG

SEQ ID NO: 121478 - protein, 11 aa, Dengue virus
WNVWEVEDYGF

SEQ ID NO: 121479 - protein, 11 aa, Dengue virus
NVWEVEDYGFG

SEQ ID NO: 121480 - protein, 11 aa, Dengue virus
WEVEDYGFGVF

SEQ ID NO: 121481 - protein, 11 aa, Dengue virus
EVEDYGFGMFT

SEQ ID NO: 121482 - protein, 11 aa, Dengue virus
VEDYGFGMFTT

SEQ ID NO: 121483 - protein, 11 aa, Dengue virus
EDYGFGMFTTN

SEQ ID NO: 121484 - protein, 11 aa, Dengue virus
DYGFGMFTTNI

SEQ ID NO: 121485 - protein, 11 aa, Dengue virus
YGFGMFTTNIW

SEQ ID NO: 121486 - protein, 11 aa, Dengue virus
GFGMFTTNIWM

SEQ ID NO: 121487 - protein, 11 aa, Dengue virus
FGMFTTNIWMK

SEQ ID NO: 121488 - protein, 11 aa, Dengue virus
CDHRLMSAAVK

SEQ ID NO: 121489 - protein, 11 aa, Dengue virus
DHRLMSAAVKD

SEQ ID NO: 121490 - protein, 11 aa, Dengue virus
KDERAVHADMG

SEQ ID NO: 121491 - protein, 11 aa, Dengue virus
DERAVHADMGY

SEQ ID NO: 121492 - protein, 11 aa, Dengue virus
ERAVHADMGYW

SEQ ID NO: 121493 - protein, 11 aa, Dengue virus
HADMGYWIESQ

SEQ ID NO: 121494 - protein, 11 aa, Dengue virus
ADMGYWIESQK

SEQ ID NO: 121495 - protein, 11 aa, Dengue virus
DMGYWIESQKN

SEQ ID NO: 121496 - protein, 11 aa, Dengue virus
WPRSHTLWSNG

SEQ ID NO: 121497 - protein, 11 aa, Dengue virus
PRSHTLWSNGV

SEQ ID NO: 121498 - protein, 11 aa, Dengue virus
RSHTLWSNGVL

SEQ ID NO: 121499 - protein, 11 aa, Dengue virus
TLWSNGVLESQ

SEQ ID NO: 121500 - protein, 11 aa, Dengue virus
LWSNGVLESQM

SEQ ID NO: 121501 - protein, 11 aa, Dengue virus
WSNGVLESQML

SEQ ID NO: 121502 - protein, 11 aa, Dengue virus
SNGVLESQMLI

SEQ ID NO: 121503 - protein, 11 aa, Dengue virus
NGVLESQMLIP

SEQ ID NO: 121504 - protein, 11 aa, Dengue virus
GVLESQMLIPK

SEQ ID NO: 121505 - protein, 11 aa, Dengue virus
TQTVGPWHLGK

SEQ ID NO: 121506 - protein, 11 aa, Dengue virus
QTVGPWHLGKL

SEQ ID NO: 121507 - protein, 11 aa, Dengue virus
VGPWHLGKLEI

SEQ ID NO: 121508 - protein, 11 aa, Dengue virus
GPWHLGKLEID

SEQ ID NO: 121509 - protein, 11 aa, Dengue virus
PWHLGKLEIDF

SEQ ID NO: 121510 - protein, 11 aa, Dengue virus
CDHRGPSLRTT

SEQ ID NO: 121511 - protein, 11 aa, Dengue virus
DHRGPSLRTTT

SEQ ID NO: 121512 - protein, 11 aa, Dengue virus
RGPSLRTTTVS

SEQ ID NO: 121513 - protein, 11 aa, Dengue virus
GPSLRTTTVSG

SEQ ID NO: 121514 - protein, 11 aa, Dengue virus
PSLRTTTVSGK

SEQ ID NO: 121515 - protein, 11 aa, Dengue virus
SLRTTTVSGKL

SEQ ID NO: 121516 - protein, 11 aa, Dengue virus
LRTTTVSGKLI

SEQ ID NO: 121517 - protein, 11 aa, Dengue virus
RTTTVSGKLIH

SEQ ID NO: 121518 - protein, 11 aa, Dengue virus
TTTVSGKLIHE

SEQ ID NO: 121519 - protein, 11 aa, Dengue virus
TTVSGKLIHEW

SEQ ID NO: 121520 - protein, 11 aa, Dengue virus
TVSGKLIHEWC

SEQ ID NO: 121521 - protein, 11 aa, Dengue virus
VSGKLIHEWCC

SEQ ID NO: 121522 - protein, 11 aa, Dengue virus
SGKLIHEWCCR

SEQ ID NO: 121523 - protein, 11 aa, Dengue virus
GKLIHEWCCRS

SEQ ID NO: 121524 - protein, 11 aa, Dengue virus
KLIHEWCCRSC

SEQ ID NO: 121525 - protein, 11 aa, Dengue virus
LIHEWCCRSCT

SEQ ID NO: 121526 - protein, 11 aa, Dengue virus
VTQWCCRSCTM

SEQ ID NO: 121527 - protein, 11 aa, Dengue virus
TQWCCRSCTMP

SEQ ID NO: 121528 - protein, 11 aa, Dengue virus
CRSCTMPPLRF

SEQ ID NO: 121529 - protein, 11 aa, Dengue virus
RSCTLPPLRYM

SEQ ID NO: 121530 - protein, 11 aa, Dengue virus
SCTLPPLRYMG

SEQ ID NO: 121531 - protein, 11 aa, Dengue virus
CTLPPLRYMGE

SEQ ID NO: 121532 - protein, 11 aa, Dengue virus
TLPPLRYMGED

SEQ ID NO: 121533 - protein, 11 aa, Dengue virus
LPPLRYMGEDG

SEQ ID NO: 121534 - protein, 11 aa, Dengue virus
PPLRYMGEDGC

SEQ ID NO: 121535 - protein, 11 aa, Dengue virus
PLRYMGEDGCW

SEQ ID NO: 121536 - protein, 11 aa, Dengue virus
LRYMGEDGCWY

SEQ ID NO: 121537 - protein, 11 aa, Dengue virus
RYMGEDGCWYG

SEQ ID NO: 121538 - protein, 11 aa, Dengue virus
YMGEDGCWYGM

SEQ ID NO: 121539 - protein, 11 aa, Dengue virus
KGEDGCWYGME

SEQ ID NO: 121540 - protein, 11 aa, Dengue virus
GCWYGMEIRPI

SEQ ID NO: 121541 - protein, 11 aa, Dengue virus
QMANGIALGLM

SEQ ID NO: 121542 - protein, 11 aa, Dengue virus
RSWPLNEGVMA

SEQ ID NO: 121543 - protein, 11 aa, Dengue virus
SWPLNEGVMAV

SEQ ID NO: 121544 - protein, 11 aa, Dengue virus
WPLNEGVMAVG

SEQ ID NO: 121545 - protein, 11 aa, Dengue virus
VSILASSLLRN

SEQ ID NO: 121546 - protein, 11 aa, Dengue virus
SILASSLLRND

SEQ ID NO: 121547 - protein, 11 aa, Dengue virus
ILASSLLRNDV

SEQ ID NO: 121548 - protein, 11 aa, Dengue virus
LASSLLRNDVP

SEQ ID NO: 121549 - protein, 11 aa, Dengue virus
ASSLLRNDVPM

SEQ ID NO: 121550 - protein, 11 aa, Dengue virus
SSLLRNDVPMA

SEQ ID NO: 121551 - protein, 11 aa, Dengue virus
SLLRNDVPMAG

SEQ ID NO: 121552 - protein, 11 aa, Dengue virus
LLRNDVPMAGP

SEQ ID NO: 121553 - protein, 11 aa, Dengue virus
LRNDVPMAGPL

SEQ ID NO: 121554 - protein, 11 aa, Dengue virus
RNDVPMAGPLV

SEQ ID NO: 121555 - protein, 11 aa, Dengue virus
NDVPMAGPLVA

SEQ ID NO: 121556 - protein, 11 aa, Dengue virus
DVPMAGPLVAG

SEQ ID NO: 121557 - protein, 11 aa, Dengue virus
VPMAGPLVAGG

SEQ ID NO: 121558 - protein, 11 aa, Dengue virus
PMAGPLVAGGL

SEQ ID NO: 121559 - protein, 11 aa, Dengue virus
MAGPLVAGGLL

SEQ ID NO: 121560 - protein, 11 aa, Dengue virus
AGPLVAGGLLI

SEQ ID NO: 121561 - protein, 11 aa, Dengue virus
GPLVAGGLLIA

SEQ ID NO: 121562 - protein, 11 aa, Dengue virus
PLVAGGLLIAC

SEQ ID NO: 121563 - protein, 11 aa, Dengue virus
LVAGGLLIACY

SEQ ID NO: 121564 - protein, 11 aa, Dengue virus
VAGGLLIACYV

SEQ ID NO: 121565 - protein, 11 aa, Dengue virus
AGGLLIACYVI

SEQ ID NO: 121566 - protein, 11 aa, Dengue virus
GGLLIACYVIT

SEQ ID NO: 121567 - protein, 11 aa, Dengue virus
GLLIACYVITG

SEQ ID NO: 121568 - protein, 11 aa, Dengue virus
LLIACYVITGT

SEQ ID NO: 121569 - protein, 11 aa, Dengue virus
LIACYVITGTS

SEQ ID NO: 121570 - protein, 11 aa, Dengue virus
IACYVITGTSA

SEQ ID NO: 121571 - protein, 11 aa, Dengue virus
ACYVITGTSAD

SEQ ID NO: 121572 - protein, 11 aa, Dengue virus
CYVITGTSADL

SEQ ID NO: 121573 - protein, 11 aa, Dengue virus
YVITGTSADLT

SEQ ID NO: 121574 - protein, 11 aa, Dengue virus
VITGTSADLTV

SEQ ID NO: 121575 - protein, 11 aa, Dengue virus
ITGTSADLTVE

SEQ ID NO: 121576 - protein, 11 aa, Dengue virus
TGTSADLTVEK

SEQ ID NO: 121577 - protein, 11 aa, Dengue virus
EAEQTGVSHNL

SEQ ID NO: 121578 - protein, 11 aa, Dengue virus
AEQTGVSHNLM

SEQ ID NO: 121579 - protein, 11 aa, Dengue virus
DDDGTMRIKDD

SEQ ID NO: 121580 - protein, 11 aa, Dengue virus
DDGTMRIKDDE

SEQ ID NO: 121581 - protein, 11 aa, Dengue virus
DGTMRIKDDET

SEQ ID NO: 121582 - protein, 11 aa, Dengue virus
GTMRIKDDETE

SEQ ID NO: 121583 - protein, 11 aa, Dengue virus
LTVLLKTALLI

SEQ ID NO: 121584 - protein, 11 aa, Dengue virus
TVLLKTALLIV

SEQ ID NO: 121585 - protein, 11 aa, Dengue virus
VLLKTALLIVS

SEQ ID NO: 121586 - protein, 11 aa, Dengue virus
LLKTALLIVSG

SEQ ID NO: 121587 - protein, 11 aa, Dengue virus
QTQRSGVLWDV

SEQ ID NO: 121588 - protein, 11 aa, Dengue virus
TQRSGVLWDVP

SEQ ID NO: 121589 - protein, 11 aa, Dengue virus
QRSGVLWDVPS

SEQ ID NO: 121590 - protein, 11 aa, Dengue virus
RSGVLWDVPSP

SEQ ID NO: 121591 - protein, 11 aa, Dengue virus
SGVLWDVPSPP

SEQ ID NO: 121592 - protein, 11 aa, Dengue virus
GVLWDVPSPPE

SEQ ID NO: 121593 - protein, 11 aa, Dengue virus
GKTQVGVGVQK

SEQ ID NO: 121594 - protein, 11 aa, Dengue virus
EGVFHTMWHVT

SEQ ID NO: 121595 - protein, 11 aa, Dengue virus
GTFHTMWHVTR

SEQ ID NO: 121596 - protein, 11 aa, Dengue virus
MWHVTRGSVIC

SEQ ID NO: 121597 - protein, 11 aa, Dengue virus
WHVTRGAVLTY

SEQ ID NO: 121598 - protein, 11 aa, Dengue virus
GKRLEPNWASV

SEQ ID NO: 121599 - protein, 11 aa, Dengue virus
KRLEPNWASVK

SEQ ID NO: 121600 - protein, 11 aa, Dengue virus
RLEPNWASVKK

SEQ ID NO: 121601 - protein, 11 aa, Dengue virus
LEPNWASVKKD

SEQ ID NO: 121602 - protein, 11 aa, Dengue virus
EPNWASVKKDL

SEQ ID NO: 121603 - protein, 11 aa, Dengue virus
WADVRNDMISY

SEQ ID NO: 121604 - protein, 11 aa, Dengue virus
ADVRNDMISYG

SEQ ID NO: 121605 - protein, 11 aa, Dengue virus
DVRNDMISYGG

SEQ ID NO: 121606 - protein, 11 aa, Dengue virus
NDMISYGGGWR

SEQ ID NO: 121607 - protein, 11 aa, Dengue virus
DLISYGGGWRF

SEQ ID NO: 121608 - protein, 11 aa, Dengue virus
WQKGEEVQVIA

SEQ ID NO: 121609 - protein, 11 aa, Dengue virus
KGEEVQVIAVE

SEQ ID NO: 121610 - protein, 11 aa, Dengue virus
EEDVQVLAIEP

SEQ ID NO: 121611 - protein, 11 aa, Dengue virus
EDVQVLAIEPG

SEQ ID NO: 121612 - protein, 11 aa, Dengue virus
DVQVLAIEPGK

SEQ ID NO: 121613 - protein, 11 aa, Dengue virus
VQVLAIEPGKN

SEQ ID NO: 121614 - protein, 11 aa, Dengue virus
QVLAIEPGKNP

SEQ ID NO: 121615 - protein, 11 aa, Dengue virus
VLAIEPGKNPK

SEQ ID NO: 121616 - protein, 11 aa, Dengue virus
LAIEPGKNPKH

SEQ ID NO: 121617 - protein, 11 aa, Dengue virus
AVEPGKNPKNF

SEQ ID NO: 121618 - protein, 11 aa, Dengue virus
VEPGKNPKNFQ

SEQ ID NO: 121619 - protein, 11 aa, Dengue virus
EPGKNPKNFQT

SEQ ID NO: 121620 - protein, 11 aa, Dengue virus
TGEIGAIALDF

SEQ ID NO: 121621 - protein, 11 aa, Dengue virus
GEIGAIALDFK

SEQ ID NO: 121622 - protein, 11 aa, Dengue virus
EIGAIALDFKP

SEQ ID NO: 121623 - protein, 11 aa, Dengue virus
IGAIALDFKPG

SEQ ID NO: 121624 - protein, 11 aa, Dengue virus
GAVTLDFKPGT

SEQ ID NO: 121625 - protein, 11 aa, Dengue virus
AVTLDFKPGTS

SEQ ID NO: 121626 - protein, 11 aa, Dengue virus
VTLDFKPGTSG

SEQ ID NO: 121627 - protein, 11 aa, Dengue virus
TLDFKPGTSGS

SEQ ID NO: 121628 - protein, 11 aa, Dengue virus
FSPGTSGSPIV

SEQ ID NO: 121629 - protein, 11 aa, Dengue virus
SPGTSGSPIVD

SEQ ID NO: 121630 - protein, 11 aa, Dengue virus
PGTSGSPIVDR

SEQ ID NO: 121631 - protein, 11 aa, Dengue virus
EGKVVGLYGNG

SEQ ID NO: 121632 - protein, 11 aa, Dengue virus
GKVIGLYGNGV

SEQ ID NO: 121633 - protein, 11 aa, Dengue virus
KVIGLYGNGVV

SEQ ID NO: 121634 - protein, 11 aa, Dengue virus
VIGLYGNGVVT

SEQ ID NO: 121635 - protein, 11 aa, Dengue virus
VGLYGNGVVTK

SEQ ID NO: 121636 - protein, 11 aa, Dengue virus
GLYGNGVVTKN

SEQ ID NO: 121637 - protein, 11 aa, Dengue virus
LYGNGVVTKNG

SEQ ID NO: 121638 - protein, 11 aa, Dengue virus
YGNGVVTKNGG

SEQ ID NO: 121639 - protein, 11 aa, Dengue virus
GNGVVTKNGGY

SEQ ID NO: 121640 - protein, 11 aa, Dengue virus
NGVVTKNGGYV

SEQ ID NO: 121641 - protein, 11 aa, Dengue virus
GVVTKNGGYVS

SEQ ID NO: 121642 - protein, 11 aa, Dengue virus
MFKKRNLTIMD

SEQ ID NO: 121643 - protein, 11 aa, Dengue virus
FRKKRLTIMDL

SEQ ID NO: 121644 - protein, 11 aa, Dengue virus
RKKRLTIMDLH

SEQ ID NO: 121645 - protein, 11 aa, Dengue virus
KRRLTIMDLHP

SEQ ID NO: 121646 - protein, 11 aa, Dengue virus
RRLTIMDLHPG

SEQ ID NO: 121647 - protein, 11 aa, Dengue virus
DLHPGSGKTRK

SEQ ID NO: 121648 - protein, 11 aa, Dengue virus
LHPGSGKTRKY

SEQ ID NO: 121649 - protein, 11 aa, Dengue virus
HPGSGKTRKYL

SEQ ID NO: 121650 - protein, 11 aa, Dengue virus
PGSGKTRKYLP

SEQ ID NO: 121651 - protein, 11 aa, Dengue virus
GSGKTRKYLPA

SEQ ID NO: 121652 - protein, 11 aa, Dengue virus
SGKTRKYLPAI

SEQ ID NO: 121653 - protein, 11 aa, Dengue virus
RILPSIVREAL

SEQ ID NO: 121654 - protein, 11 aa, Dengue virus
YLPAIIREAIK

SEQ ID NO: 121655 - protein, 11 aa, Dengue virus
LPAIIREAIKR

SEQ ID NO: 121656 - protein, 11 aa, Dengue virus
REAIKRRLRTL

SEQ ID NO: 121657 - protein, 11 aa, Dengue virus
KRRLRTLILAP

SEQ ID NO: 121658 - protein, 11 aa, Dengue virus
RRLRTLILAPT

SEQ ID NO: 121659 - protein, 11 aa, Dengue virus
RLRTLILAPTR

SEQ ID NO: 121660 - protein, 11 aa, Dengue virus
LVLAPTRVVAS

SEQ ID NO: 121661 - protein, 11 aa, Dengue virus
VLAPTRVVASE

SEQ ID NO: 121662 - protein, 11 aa, Dengue virus
VVAAEMEEALK

SEQ ID NO: 121663 - protein, 11 aa, Dengue virus
VAAEMEEALKG

SEQ ID NO: 121664 - protein, 11 aa, Dengue virus
AAEMEEALKGL

SEQ ID NO: 121665 - protein, 11 aa, Dengue virus
AEMEEALKGLP

SEQ ID NO: 121666 - protein, 11 aa, Dengue virus
EMEEALKGLPI

SEQ ID NO: 121667 - protein, 11 aa, Dengue virus
MEEALKGLPIR

SEQ ID NO: 121668 - protein, 11 aa, Dengue virus
EEALKGLPIRY

SEQ ID NO: 121669 - protein, 11 aa, Dengue virus
EALKGLPIRYQ

SEQ ID NO: 121670 - protein, 11 aa, Dengue virus
ALKGLPIRYQT

SEQ ID NO: 121671 - protein, 11 aa, Dengue virus
LKGLPIRYQTT

SEQ ID NO: 121672 - protein, 11 aa, Dengue virus
KGLPIRYQTTA

SEQ ID NO: 121673 - protein, 11 aa, Dengue virus
GLPIRYQTTAT

SEQ ID NO: 121674 - protein, 11 aa, Dengue virus
RAEHTGREIVD

SEQ ID NO: 121675 - protein, 11 aa, Dengue virus
AEHTGREIVDL

SEQ ID NO: 121676 - protein, 11 aa, Dengue virus
ATFTMRLLSPI

SEQ ID NO: 121677 - protein, 11 aa, Dengue virus
TFTMRLLSPIR

SEQ ID NO: 121678 - protein, 11 aa, Dengue virus
FTMRLLSPIRV

SEQ ID NO: 121679 - protein, 11 aa, Dengue virus
TMRLLSPIRVP

SEQ ID NO: 121680 - protein, 11 aa, Dengue virus
MRLLSPIRVPN

SEQ ID NO: 121681 - protein, 11 aa, Dengue virus
RLLSPIRVPNY

SEQ ID NO: 121682 - protein, 11 aa, Dengue virus
LLSPIRVPNYN

SEQ ID NO: 121683 - protein, 11 aa, Dengue virus
LSSTRVPNYNL

SEQ ID NO: 121684 - protein, 11 aa, Dengue virus
SSTRVPNYNLI

SEQ ID NO: 121685 - protein, 11 aa, Dengue virus
STRVPNYNLIV

SEQ ID NO: 121686 - protein, 11 aa, Dengue virus
TRVPNYNLIVM

SEQ ID NO: 121687 - protein, 11 aa, Dengue virus
RVPNYNLIVMD

SEQ ID NO: 121688 - protein, 11 aa, Dengue virus
VPNYNLIVMDE

SEQ ID NO: 121689 - protein, 11 aa, Dengue virus
PNYNLIVMDEA

SEQ ID NO: 121690 - protein, 11 aa, Dengue virus
NYNLIVMDEAH

SEQ ID NO: 121691 - protein, 11 aa, Dengue virus
YNLIVMDEAHF

SEQ ID NO: 121692 - protein, 11 aa, Dengue virus
NLIVMDEAHFT

SEQ ID NO: 121693 - protein, 11 aa, Dengue virus
LIVMDEAHFTD

SEQ ID NO: 121694 - protein, 11 aa, Dengue virus
VIMDEAHFTDP

SEQ ID NO: 121695 - protein, 11 aa, Dengue virus
VMDEAHFTDPS

SEQ ID NO: 121696 - protein, 11 aa, Dengue virus
DEAHFTDPSSV

SEQ ID NO: 121697 - protein, 11 aa, Dengue virus
EAHFTDPSSVA

SEQ ID NO: 121698 - protein, 11 aa, Dengue virus
AHFTDPSSVAA

SEQ ID NO: 121699 - protein, 11 aa, Dengue virus
HFTDPSSVAAR

SEQ ID NO: 121700 - protein, 11 aa, Dengue virus
FTDPSSVAARG

SEQ ID NO: 121701 - protein, 11 aa, Dengue virus
TDPSSVAARGY

SEQ ID NO: 121702 - protein, 11 aa, Dengue virus
DPSSVAARGYI

SEQ ID NO: 121703 - protein, 11 aa, Dengue virus
PSSVAARGYIS

SEQ ID NO: 121704 - protein, 11 aa, Dengue virus
SSVAARGYIST

SEQ ID NO: 121705 - protein, 11 aa, Dengue virus
STRVEMGEAAA

SEQ ID NO: 121706 - protein, 11 aa, Dengue virus
TRVEMGEAAAI

SEQ ID NO: 121707 - protein, 11 aa, Dengue virus
RVEMGEAAAIF

SEQ ID NO: 121708 - protein, 11 aa, Dengue virus
VEMGEAAAIFM

SEQ ID NO: 121709 - protein, 11 aa, Dengue virus
EMGEAAAIFMT

SEQ ID NO: 121710 - protein, 11 aa, Dengue virus
AIFMTATPPGT

SEQ ID NO: 121711 - protein, 11 aa, Dengue virus
IIDEEREIPER

SEQ ID NO: 121712 - protein, 11 aa, Dengue virus
IDEEREIPERS

SEQ ID NO: 121713 - protein, 11 aa, Dengue virus
DIEREIPERSW

SEQ ID NO: 121714 - protein, 11 aa, Dengue virus
IEREIPERSWN

SEQ ID NO: 121715 - protein, 11 aa, Dengue virus
EREIPERSWNT

SEQ ID NO: 121716 - protein, 11 aa, Dengue virus
REIPERSWNTG

SEQ ID NO: 121717 - protein, 11 aa, Dengue virus
FAGKTVWFVPS

SEQ ID NO: 121718 - protein, 11 aa, Dengue virus
AGKTVWFVPSI

SEQ ID NO: 121719 - protein, 11 aa, Dengue virus
KTVWFVPSIKT

SEQ ID NO: 121720 - protein, 11 aa, Dengue virus
TVWFVPSIKTG

SEQ ID NO: 121721 - protein, 11 aa, Dengue virus
VWFVPSIKTGN

SEQ ID NO: 121722 - protein, 11 aa, Dengue virus
WFVPSIKTGND

SEQ ID NO: 121723 - protein, 11 aa, Dengue virus
FVPSIKTGNDI

SEQ ID NO: 121724 - protein, 11 aa, Dengue virus
VPSIKTGNDIA

SEQ ID NO: 121725 - protein, 11 aa, Dengue virus
PSIKAGNDIAN

SEQ ID NO: 121726 - protein, 11 aa, Dengue virus
SIKAGNDIANC

SEQ ID NO: 121727 - protein, 11 aa, Dengue virus
IKAGNDIANCL

SEQ ID NO: 121728 - protein, 11 aa, Dengue virus
KAGNDIANCLR

SEQ ID NO: 121729 - protein, 11 aa, Dengue virus
AGNDIANCLRK

SEQ ID NO: 121730 - protein, 11 aa, Dengue virus
GNDIANCLRKS

SEQ ID NO: 121731 - protein, 11 aa, Dengue virus
NDIANCLRKSG

SEQ ID NO: 121732 - protein, 11 aa, Dengue virus
DIANCLRKSGK

SEQ ID NO: 121733 - protein, 11 aa, Dengue virus
IANCLRKNGKK

SEQ ID NO: 121734 - protein, 11 aa, Dengue virus
ANCLRKNGKKV

SEQ ID NO: 121735 - protein, 11 aa, Dengue virus
CLRKSGKKVIQ

SEQ ID NO: 121736 - protein, 11 aa, Dengue virus
LRKSGKKVIQL

SEQ ID NO: 121737 - protein, 11 aa, Dengue virus
RKSGKKVIQLS

SEQ ID NO: 121738 - protein, 11 aa, Dengue virus
KSGKKVIQLSR

SEQ ID NO: 121739 - protein, 11 aa, Dengue virus
SGKKVIQLSRK

SEQ ID NO: 121740 - protein, 11 aa, Dengue virus
RVVQLSRKTFD

SEQ ID NO: 121741 - protein, 11 aa, Dengue virus
VVQLSRKTFDT

SEQ ID NO: 121742 - protein, 11 aa, Dengue virus
VQLSRKTFDTE

SEQ ID NO: 121743 - protein, 11 aa, Dengue virus
LSRKTFDTEYP

SEQ ID NO: 121744 - protein, 11 aa, Dengue virus
SRKTFDTEYPK

SEQ ID NO: 121745 - protein, 11 aa, Dengue virus
TNDWDFVVTTD

SEQ ID NO: 121746 - protein, 11 aa, Dengue virus
TDWDFVVTTDI

SEQ ID NO: 121747 - protein, 11 aa, Dengue virus
ISEMGANFKAD

SEQ ID NO: 121748 - protein, 11 aa, Dengue virus
SEMGANFKADR

SEQ ID NO: 121749 - protein, 11 aa, Dengue virus
EMGANFKADRV

SEQ ID NO: 121750 - protein, 11 aa, Dengue virus
MGANFKADRVI

SEQ ID NO: 121751 - protein, 11 aa, Dengue virus
GANFKADRVID

SEQ ID NO: 121752 - protein, 11 aa, Dengue virus
ANFKADRVIDP

SEQ ID NO: 121753 - protein, 11 aa, Dengue virus
NFKADRVIDPR

SEQ ID NO: 121754 - protein, 11 aa, Dengue virus
FKADRVIDPRR

SEQ ID NO: 121755 - protein, 11 aa, Dengue virus
KADRVIDPRRC

SEQ ID NO: 121756 - protein, 11 aa, Dengue virus
AGRVIDPRRCL

SEQ ID NO: 121757 - protein, 11 aa, Dengue virus
GRVIDPRRCLK

SEQ ID NO: 121758 - protein, 11 aa, Dengue virus
PRRCLKPVILT

SEQ ID NO: 121759 - protein, 11 aa, Dengue virus
RRCLKPVILTD

SEQ ID NO: 121760 - protein, 11 aa, Dengue virus
RCLKPVILTDG

SEQ ID NO: 121761 - protein, 11 aa, Dengue virus
CLKPVILTDGP

SEQ ID NO: 121762 - protein, 11 aa, Dengue virus
LKPVILTDGPE

SEQ ID NO: 121763 - protein, 11 aa, Dengue virus
KPVILTDGPER

SEQ ID NO: 121764 - protein, 11 aa, Dengue virus
PVILTDGPERV

SEQ ID NO: 121765 - protein, 11 aa, Dengue virus
VILTDGPERVI

SEQ ID NO: 121766 - protein, 11 aa, Dengue virus
ILTDGPERVIL

SEQ ID NO: 121767 - protein, 11 aa, Dengue virus
LTDGPERVILA

SEQ ID NO: 121768 - protein, 11 aa, Dengue virus
TDGPERVILAG

SEQ ID NO: 121769 - protein, 11 aa, Dengue virus
DGEERVVLAGP

SEQ ID NO: 121770 - protein, 11 aa, Dengue virus
GPERVILAGPI

SEQ ID NO: 121771 - protein, 11 aa, Dengue virus
PERVILAGPIP

SEQ ID NO: 121772 - protein, 11 aa, Dengue virus
VILAGPMPVTA

SEQ ID NO: 121773 - protein, 11 aa, Dengue virus
ILAGPMPVTAA

SEQ ID NO: 121774 - protein, 11 aa, Dengue virus
LAGPMPVTAAS

SEQ ID NO: 121775 - protein, 11 aa, Dengue virus
AGPMPVTAASA

SEQ ID NO: 121776 - protein, 11 aa, Dengue virus
GPMPVTAASAA

SEQ ID NO: 121777 - protein, 11 aa, Dengue virus
PMPVTAASAAQ

SEQ ID NO: 121778 - protein, 11 aa, Dengue virus
MPVTAASAAQR

SEQ ID NO: 121779 - protein, 11 aa, Dengue virus
PVTAASAAQRR

SEQ ID NO: 121780 - protein, 11 aa, Dengue virus
VTAASAAQRRG

SEQ ID NO: 121781 - protein, 11 aa, Dengue virus
TAASAAQRRGR

SEQ ID NO: 121782 - protein, 11 aa, Dengue virus
ASAAQRRGRVG

SEQ ID NO: 121783 - protein, 11 aa, Dengue virus
AQRRGRVGRNP

SEQ ID NO: 121784 - protein, 11 aa, Dengue virus
KENDQYIFTGQ

SEQ ID NO: 121785 - protein, 11 aa, Dengue virus
ENDQYIFTGQP

SEQ ID NO: 121786 - protein, 11 aa, Dengue virus
NDQYIFTGQPL

SEQ ID NO: 121787 - protein, 11 aa, Dengue virus
FTGQPLNNDED

SEQ ID NO: 121788 - protein, 11 aa, Dengue virus
TGQPLNNDEDH

SEQ ID NO: 121789 - protein, 11 aa, Dengue virus
GDPLKNDEDHA

SEQ ID NO: 121790 - protein, 11 aa, Dengue virus
DPLKNDEDHAH

SEQ ID NO: 121791 - protein, 11 aa, Dengue virus
PLKNDEDHAHW

SEQ ID NO: 121792 - protein, 11 aa, Dengue virus
LKNDEDHAHWT

SEQ ID NO: 121793 - protein, 11 aa, Dengue virus
KNDEDHAHWTE

SEQ ID NO: 121794 - protein, 11 aa, Dengue virus
TEAKMLLDNIY

SEQ ID NO: 121795 - protein, 11 aa, Dengue virus
NIYTPEGIIPT

SEQ ID NO: 121796 - protein, 11 aa, Dengue virus
IYTPEGIIPTL

SEQ ID NO: 121797 - protein, 11 aa, Dengue virus
YTPEGIIPTLF

SEQ ID NO: 121798 - protein, 11 aa, Dengue virus
TPEGIIPTLFG

SEQ ID NO: 121799 - protein, 11 aa, Dengue virus
PEGIIPTLFGP

SEQ ID NO: 121800 - protein, 11 aa, Dengue virus
EGIIPTLFGPE

SEQ ID NO: 121801 - protein, 11 aa, Dengue virus
GIIPTLFGPER

SEQ ID NO: 121802 - protein, 11 aa, Dengue virus
IIPTLFGPERE

SEQ ID NO: 121803 - protein, 11 aa, Dengue virus
IPTLFGPEREK

SEQ ID NO: 121804 - protein, 11 aa, Dengue virus
PTLFGPEREKT

SEQ ID NO: 121805 - protein, 11 aa, Dengue virus
TLFGPEREKTQ

SEQ ID NO: 121806 - protein, 11 aa, Dengue virus
LFGPEREKTQA

SEQ ID NO: 121807 - protein, 11 aa, Dengue virus
FGPEREKTQAI

SEQ ID NO: 121808 - protein, 11 aa, Dengue virus
GPEREKTQAID

SEQ ID NO: 121809 - protein, 11 aa, Dengue virus
PEREKTQAIDG

SEQ ID NO: 121810 - protein, 11 aa, Dengue virus
EREKTQAIDGE

SEQ ID NO: 121811 - protein, 11 aa, Dengue virus
REKTQAIDGEF

SEQ ID NO: 121812 - protein, 11 aa, Dengue virus
EKTQAIDGEFR

SEQ ID NO: 121813 - protein, 11 aa, Dengue virus
KTQAIDGEFRL

SEQ ID NO: 121814 - protein, 11 aa, Dengue virus
SAAIDGEYRLK

SEQ ID NO: 121815 - protein, 11 aa, Dengue virus
AAIDGEYRLKG

SEQ ID NO: 121816 - protein, 11 aa, Dengue virus
AIDGEFRLRGE

SEQ ID NO: 121817 - protein, 11 aa, Dengue virus
IDGEFRLRGEQ

SEQ ID NO: 121818 - protein, 11 aa, Dengue virus
DGEFRLRGEQR

SEQ ID NO: 121819 - protein, 11 aa, Dengue virus
GEFRLRGEQRK

SEQ ID NO: 121820 - protein, 11 aa, Dengue virus
EFRLRGEQRKT

SEQ ID NO: 121821 - protein, 11 aa, Dengue virus
FRLRGEQRKTF

SEQ ID NO: 121822 - protein, 11 aa, Dengue virus
RLRGEQRKTFV

SEQ ID NO: 121823 - protein, 11 aa, Dengue virus
LKGESRKTFVE

SEQ ID NO: 121824 - protein, 11 aa, Dengue virus
KGESRKTFVEL

SEQ ID NO: 121825 - protein, 11 aa, Dengue virus
GESRKTFVELM

SEQ ID NO: 121826 - protein, 11 aa, Dengue virus
ESRKTFVELMR

SEQ ID NO: 121827 - protein, 11 aa, Dengue virus
SRKTFVELMRR

SEQ ID NO: 121828 - protein, 11 aa, Dengue virus
RRGDLPVWLAH

SEQ ID NO: 121829 - protein, 11 aa, Dengue virus
RGDLPVWLAHK

SEQ ID NO: 121830 - protein, 11 aa, Dengue virus
GDLPVWLAHKV

SEQ ID NO: 121831 - protein, 11 aa, Dengue virus
DLPVWLAHKVA

SEQ ID NO: 121832 - protein, 11 aa, Dengue virus
LPVWLAYKVAA

SEQ ID NO: 121833 - protein, 11 aa, Dengue virus
NNQILEENMDV

SEQ ID NO: 121834 - protein, 11 aa, Dengue virus
NQILEENMDVE

SEQ ID NO: 121835 - protein, 11 aa, Dengue virus
QILEENMDVEI

SEQ ID NO: 121836 - protein, 11 aa, Dengue virus
ILEENMDVEIW

SEQ ID NO: 121837 - protein, 11 aa, Dengue virus
LEENMEVEIWT

SEQ ID NO: 121838 - protein, 11 aa, Dengue virus
EENMEVEIWTK

SEQ ID NO: 121839 - protein, 11 aa, Dengue virus
ENMEVEIWTKE

SEQ ID NO: 121840 - protein, 11 aa, Dengue virus
NMEVEIWTKEG

SEQ ID NO: 121841 - protein, 11 aa, Dengue virus
EKKKLRPRWLD

SEQ ID NO: 121842 - protein, 11 aa, Dengue virus
KKKLRPRWLDA

SEQ ID NO: 121843 - protein, 11 aa, Dengue virus
KKLRPKWLDAR

SEQ ID NO: 121844 - protein, 11 aa, Dengue virus
KLRPRWLDARV

SEQ ID NO: 121845 - protein, 11 aa, Dengue virus
LRPRWLDARVY

SEQ ID NO: 121846 - protein, 11 aa, Dengue virus
RPRWLDARVYA

SEQ ID NO: 121847 - protein, 11 aa, Dengue virus
PRWLDARVYAD

SEQ ID NO: 121848 - protein, 11 aa, Dengue virus
RWLDARVYADP

SEQ ID NO: 121849 - protein, 11 aa, Dengue virus
WLDARVYADPM

SEQ ID NO: 121850 - protein, 11 aa, Dengue virus
LDARVYADPMA

SEQ ID NO: 121851 - protein, 11 aa, Dengue virus
DARVYADPMAL

SEQ ID NO: 121852 - protein, 11 aa, Dengue virus
ARTYSDPLALK

SEQ ID NO: 121853 - protein, 11 aa, Dengue virus
RTYSDPLALKE

SEQ ID NO: 121854 - protein, 11 aa, Dengue virus
TYSDPLALKEF

SEQ ID NO: 121855 - protein, 11 aa, Dengue virus
YADPMALKDFK

SEQ ID NO: 121856 - protein, 11 aa, Dengue virus
SDPLALKEFKD

SEQ ID NO: 121857 - protein, 11 aa, Dengue virus
DPLALKEFKDF

SEQ ID NO: 121858 - protein, 11 aa, Dengue virus
PLALKEFKDFA

SEQ ID NO: 121859 - protein, 11 aa, Dengue virus
LALKEFKDFAA

SEQ ID NO: 121860 - protein, 11 aa, Dengue virus
ALKEFKDFAAG

SEQ ID NO: 121861 - protein, 11 aa, Dengue virus
LKEFKDFAAGR

SEQ ID NO: 121862 - protein, 11 aa, Dengue virus
KEFKDFAAGRK

SEQ ID NO: 121863 - protein, 11 aa, Dengue virus
EFKDFAAGRKS

SEQ ID NO: 121864 - protein, 11 aa, Dengue virus
FKDFAAGRKSI

SEQ ID NO: 121865 - protein, 11 aa, Dengue virus
RDALDNLAVLH

SEQ ID NO: 121866 - protein, 11 aa, Dengue virus
ALDNLVMLHTS

SEQ ID NO: 121867 - protein, 11 aa, Dengue virus
LDNLVMLHTSE

SEQ ID NO: 121868 - protein, 11 aa, Dengue virus
AYRHAVEELPE

SEQ ID NO: 121869 - protein, 11 aa, Dengue virus
YRHAVEELPET

SEQ ID NO: 121870 - protein, 11 aa, Dengue virus
RHAVEELPETM

SEQ ID NO: 121871 - protein, 11 aa, Dengue virus
HAVEELPETME

SEQ ID NO: 121872 - protein, 11 aa, Dengue virus
AVEELPETMET

SEQ ID NO: 121873 - protein, 11 aa, Dengue virus
VEELPETMETL

SEQ ID NO: 121874 - protein, 11 aa, Dengue virus
EELPETMETLL

SEQ ID NO: 121875 - protein, 11 aa, Dengue virus
ELPETMETLLL

SEQ ID NO: 121876 - protein, 11 aa, Dengue virus
LPETMETLLLL

SEQ ID NO: 121877 - protein, 11 aa, Dengue virus
PETMETLLLLG

SEQ ID NO: 121878 - protein, 11 aa, Dengue virus
ETMETLLLLGL

SEQ ID NO: 121879 - protein, 11 aa, Dengue virus
TMETLLLLGLM

SEQ ID NO: 121880 - protein, 11 aa, Dengue virus
METLLLLGLMI

SEQ ID NO: 121881 - protein, 11 aa, Dengue virus
IPLQWIASAIV

SEQ ID NO: 121882 - protein, 11 aa, Dengue virus
PLQWIASAIVL

SEQ ID NO: 121883 - protein, 11 aa, Dengue virus
PQWIAASIILE

SEQ ID NO: 121884 - protein, 11 aa, Dengue virus
QWIAASIILEF

SEQ ID NO: 121885 - protein, 11 aa, Dengue virus
ASAIVLEFFMM

SEQ ID NO: 121886 - protein, 11 aa, Dengue virus
SAIVLEFFMMV

SEQ ID NO: 121887 - protein, 11 aa, Dengue virus
AIVLEFFMMVL

SEQ ID NO: 121888 - protein, 11 aa, Dengue virus
IVLEFFMMVLL

SEQ ID NO: 121889 - protein, 11 aa, Dengue virus
VLEFFMMVLLI

SEQ ID NO: 121890 - protein, 11 aa, Dengue virus
LEFFMMVLLIP

SEQ ID NO: 121891 - protein, 11 aa, Dengue virus
EFFMMVLLIPE

SEQ ID NO: 121892 - protein, 11 aa, Dengue virus
FFMMVLLIPEP

SEQ ID NO: 121893 - protein, 11 aa, Dengue virus
FMMVLLIPEPE

SEQ ID NO: 121894 - protein, 11 aa, Dengue virus
MMVLLIPEPEK

SEQ ID NO: 121895 - protein, 11 aa, Dengue virus
MVLLIPEPEKQ

SEQ ID NO: 121896 - protein, 11 aa, Dengue virus
KQRTPQDNQLA

SEQ ID NO: 121897 - protein, 11 aa, Dengue virus
QRTPQDNQLIY

SEQ ID NO: 121898 - protein, 11 aa, Dengue virus
RTPQDNQLIYV

SEQ ID NO: 121899 - protein, 11 aa, Dengue virus
TPQDNQLIYVI

SEQ ID NO: 121900 - protein, 11 aa, Dengue virus
PQDNQLIYVIL

SEQ ID NO: 121901 - protein, 11 aa, Dengue virus
QDNQLIYVILT

SEQ ID NO: 121902 - protein, 11 aa, Dengue virus
DNQLAYVVIGI

SEQ ID NO: 121903 - protein, 11 aa, Dengue virus
NQLAYVVIGIL

SEQ ID NO: 121904 - protein, 11 aa, Dengue virus
QLAYVVIGILT

SEQ ID NO: 121905 - protein, 11 aa, Dengue virus
IAANEMGLLET

SEQ ID NO: 121906 - protein, 11 aa, Dengue virus
AANEMGLIEKT

SEQ ID NO: 121907 - protein, 11 aa, Dengue virus
ANEMGLIEKTK

SEQ ID NO: 121908 - protein, 11 aa, Dengue virus
NEMGLLETTKR

SEQ ID NO: 121909 - protein, 11 aa, Dengue virus
EMGLLETTKRD

SEQ ID NO: 121910 - protein, 11 aa, Dengue virus
MGLLETTKRDL

SEQ ID NO: 121911 - protein, 11 aa, Dengue virus
GLLETTKRDLG

SEQ ID NO: 121912 - protein, 11 aa, Dengue virus
LDVDLRPASAW

SEQ ID NO: 121913 - protein, 11 aa, Dengue virus
DVDLRPASAWT

SEQ ID NO: 121914 - protein, 11 aa, Dengue virus
VDLRPASAWTL

SEQ ID NO: 121915 - protein, 11 aa, Dengue virus
AWTLYAVATTV

SEQ ID NO: 121916 - protein, 11 aa, Dengue virus
WTLYAVATTFV

SEQ ID NO: 121917 - protein, 11 aa, Dengue virus
TLYAVATTFVT

SEQ ID NO: 121918 - protein, 11 aa, Dengue virus
LYAVATTFVTP

SEQ ID NO: 121919 - protein, 11 aa, Dengue virus
YAVATTFVTPM

SEQ ID NO: 121920 - protein, 11 aa, Dengue virus
ITPMLRHTIEN

SEQ ID NO: 121921 - protein, 11 aa, Dengue virus
TPMLRHTIENS

SEQ ID NO: 121922 - protein, 11 aa, Dengue virus
PMLRHTIENST

SEQ ID NO: 121923 - protein, 11 aa, Dengue virus
MLRHTIENSTA

SEQ ID NO: 121924 - protein, 11 aa, Dengue virus
LRHTIENSTAN

SEQ ID NO: 121925 - protein, 11 aa, Dengue virus
RHTIENSTANV

SEQ ID NO: 121926 - protein, 11 aa, Dengue virus
HTIENSTANVS

SEQ ID NO: 121927 - protein, 11 aa, Dengue virus
TIENSTANVSL

SEQ ID NO: 121928 - protein, 11 aa, Dengue virus
IENSTANVSLA

SEQ ID NO: 121929 - protein, 11 aa, Dengue virus
ENSTANVSLAA

SEQ ID NO: 121930 - protein, 11 aa, Dengue virus
NSTANVSLAAI

SEQ ID NO: 121931 - protein, 11 aa, Dengue virus
STANVSLAAIA

SEQ ID NO: 121932 - protein, 11 aa, Dengue virus
TANVSLAAIAN

SEQ ID NO: 121933 - protein, 11 aa, Dengue virus
ANVSLAAIANQ

SEQ ID NO: 121934 - protein, 11 aa, Dengue virus
NVSLAAIANQA

SEQ ID NO: 121935 - protein, 11 aa, Dengue virus
VSLAAIANQAV

SEQ ID NO: 121936 - protein, 11 aa, Dengue virus
SLAAIANQAVV

SEQ ID NO: 121937 - protein, 11 aa, Dengue virus
LAAIANQAVVL

SEQ ID NO: 121938 - protein, 11 aa, Dengue virus
AAIANQAVVLM

SEQ ID NO: 121939 - protein, 11 aa, Dengue virus
AIANQAVVLMG

SEQ ID NO: 121940 - protein, 11 aa, Dengue virus
IANQAVVLMGL

SEQ ID NO: 121941 - protein, 11 aa, Dengue virus
ANQAVVLMGLD

SEQ ID NO: 121942 - protein, 11 aa, Dengue virus
NQAVVLMGLDK

SEQ ID NO: 121943 - protein, 11 aa, Dengue virus
QAVVLMGLDKG

SEQ ID NO: 121944 - protein, 11 aa, Dengue virus
AVVLMGLDKGW

SEQ ID NO: 121945 - protein, 11 aa, Dengue virus
VVLMGLDKGWP

SEQ ID NO: 121946 - protein, 11 aa, Dengue virus
VLMGLDKGWPI

SEQ ID NO: 121947 - protein, 11 aa, Dengue virus
LMGLGKGWPLH

SEQ ID NO: 121948 - protein, 11 aa, Dengue virus
MGLGKGWPLHR

SEQ ID NO: 121949 - protein, 11 aa, Dengue virus
GLGKGWPLHRM

SEQ ID NO: 121950 - protein, 11 aa, Dengue virus
LGKGWPLHRMD

SEQ ID NO: 121951 - protein, 11 aa, Dengue virus
DKGWPISKMDL

SEQ ID NO: 121952 - protein, 11 aa, Dengue virus
KGWPISKMDLG

SEQ ID NO: 121953 - protein, 11 aa, Dengue virus
GWPISKMDLGV

SEQ ID NO: 121954 - protein, 11 aa, Dengue virus
WPISKMDLGVP

SEQ ID NO: 121955 - protein, 11 aa, Dengue virus
PISKMDLGVPL

SEQ ID NO: 121956 - protein, 11 aa, Dengue virus
ISKMDLGVPLL

SEQ ID NO: 121957 - protein, 11 aa, Dengue virus
HRMDLGVPLLA

SEQ ID NO: 121958 - protein, 11 aa, Dengue virus
KMDLGVPLLAL

SEQ ID NO: 121959 - protein, 11 aa, Dengue virus
MDLGVPLLALG

SEQ ID NO: 121960 - protein, 11 aa, Dengue virus
DLGVPLLALGC

SEQ ID NO: 121961 - protein, 11 aa, Dengue virus
LGVPLLALGCY

SEQ ID NO: 121962 - protein, 11 aa, Dengue virus
GVPLLAMGCYS

SEQ ID NO: 121963 - protein, 11 aa, Dengue virus
VPLLAMGCYSQ

SEQ ID NO: 121964 - protein, 11 aa, Dengue virus
PLLAMGCYSQV

SEQ ID NO: 121965 - protein, 11 aa, Dengue virus
LLAMGCYSQVN

SEQ ID NO: 121966 - protein, 11 aa, Dengue virus
LAMGCYSQVNP

SEQ ID NO: 121967 - protein, 11 aa, Dengue virus
AMGCYSQVNPT

SEQ ID NO: 121968 - protein, 11 aa, Dengue virus
MGCYSQVNPTT

SEQ ID NO: 121969 - protein, 11 aa, Dengue virus
GCYSQVNPTTL

SEQ ID NO: 121970 - protein, 11 aa, Dengue virus
CYSQVNPTTLT

SEQ ID NO: 121971 - protein, 11 aa, Dengue virus
YSQVNPTTLTA

SEQ ID NO: 121972 - protein, 11 aa, Dengue virus
SQVNPTTLTAS

SEQ ID NO: 121973 - protein, 11 aa, Dengue virus
QVNPTTLTASL

SEQ ID NO: 121974 - protein, 11 aa, Dengue virus
VHYAIIGPGLQ

SEQ ID NO: 121975 - protein, 11 aa, Dengue virus
TAAGIMKNPTI

SEQ ID NO: 121976 - protein, 11 aa, Dengue virus
IMKNPTVDGIM

SEQ ID NO: 121977 - protein, 11 aa, Dengue virus
KNPTVDGIMTI

SEQ ID NO: 121978 - protein, 11 aa, Dengue virus
PVIYDSKFEKQ

SEQ ID NO: 121979 - protein, 11 aa, Dengue virus
VIYDSKFEKQL

SEQ ID NO: 121980 - protein, 11 aa, Dengue virus
IYDSKFEKQLG

SEQ ID NO: 121981 - protein, 11 aa, Dengue virus
YDSKFEKQLGQ

SEQ ID NO: 121982 - protein, 11 aa, Dengue virus
DSKFEKQLGQV

SEQ ID NO: 121983 - protein, 11 aa, Dengue virus
SKFEKQLGQVM

SEQ ID NO: 121984 - protein, 11 aa, Dengue virus
EKQLGQVMLLI

SEQ ID NO: 121985 - protein, 11 aa, Dengue virus
KQLGQVMLLIL

SEQ ID NO: 121986 - protein, 11 aa, Dengue virus
QLGQVMLLILC

SEQ ID NO: 121987 - protein, 11 aa, Dengue virus
LGQVMLLILCV

SEQ ID NO: 121988 - protein, 11 aa, Dengue virus
LCAVQLLLMRT

SEQ ID NO: 121989 - protein, 11 aa, Dengue virus
CAVQLLLMRTS

SEQ ID NO: 121990 - protein, 11 aa, Dengue virus
AVQLLLMRTSW

SEQ ID NO: 121991 - protein, 11 aa, Dengue virus
VQLLLMRTSWA

SEQ ID NO: 121992 - protein, 11 aa, Dengue virus
QLLLMRTSWAL

SEQ ID NO: 121993 - protein, 11 aa, Dengue virus
LLLMRTSWALC

SEQ ID NO: 121994 - protein, 11 aa, Dengue virus
LLMRTSWALCE

SEQ ID NO: 121995 - protein, 11 aa, Dengue virus
LMRTSWALCEA

SEQ ID NO: 121996 - protein, 11 aa, Dengue virus
MRTSWALCEAL

SEQ ID NO: 121997 - protein, 11 aa, Dengue virus
RTSWALCEALT

SEQ ID NO: 121998 - protein, 11 aa, Dengue virus
TSWALCEALTL

SEQ ID NO: 121999 - protein, 11 aa, Dengue virus
SWALCEALTLA

SEQ ID NO: 122000 - protein, 11 aa, Dengue virus
WAFCEVLTLAT

SEQ ID NO: 122001 - protein, 11 aa, Dengue virus
AFCEVLTLATG

SEQ ID NO: 122002 - protein, 11 aa, Dengue virus
FCEVLTLATGP

SEQ ID NO: 122003 - protein, 11 aa, Dengue virus
CEVLTLATGPI

SEQ ID NO: 122004 - protein, 11 aa, Dengue virus
LTLATGPITTL

SEQ ID NO: 122005 - protein, 11 aa, Dengue virus
TLATGPITTLW

SEQ ID NO: 122006 - protein, 11 aa, Dengue virus
LATGPITTLWE

SEQ ID NO: 122007 - protein, 11 aa, Dengue virus
ATGPITTLWEG

SEQ ID NO: 122008 - protein, 11 aa, Dengue virus
TGPITTLWEGS

SEQ ID NO: 122009 - protein, 11 aa, Dengue virus
GPITTLWEGSP

SEQ ID NO: 122010 - protein, 11 aa, Dengue virus
PITTLWEGSPG

SEQ ID NO: 122011 - protein, 11 aa, Dengue virus
LTLWEGNPGRF

SEQ ID NO: 122012 - protein, 11 aa, Dengue virus
RFWNTTIAVST

SEQ ID NO: 122013 - protein, 11 aa, Dengue virus
YLAGAGLAFSI

SEQ ID NO: 122014 - protein, 11 aa, Dengue virus
LAGAGLAFSIM

SEQ ID NO: 122015 - protein, 11 aa, Dengue virus
AGAGLAFSIMK

SEQ ID NO: 122016 - protein, 11 aa, Dengue virus
GAGLAFSIMKS

SEQ ID NO: 122017 - protein, 11 aa, Dengue virus
AGLAFSIMKSV

SEQ ID NO: 122018 - protein, 11 aa, Dengue virus
GETLGEKWKKK

SEQ ID NO: 122019 - protein, 11 aa, Dengue virus
ETLGEKWKKKL

SEQ ID NO: 122020 - protein, 11 aa, Dengue virus
TLGEKWKKKLN

SEQ ID NO: 122021 - protein, 11 aa, Dengue virus
EVDRTEAKEGL

SEQ ID NO: 122022 - protein, 11 aa, Dengue virus
RHAVSRGTAKL

SEQ ID NO: 122023 - protein, 11 aa, Dengue virus
HAVSRGSAKLQ

SEQ ID NO: 122024 - protein, 11 aa, Dengue virus
AVSRGSAKLQW

SEQ ID NO: 122025 - protein, 11 aa, Dengue virus
VSRGSAKLQWF

SEQ ID NO: 122026 - protein, 11 aa, Dengue virus
SRGSAKLQWFV

SEQ ID NO: 122027 - protein, 11 aa, Dengue virus
RGSAKLQWFVE

SEQ ID NO: 122028 - protein, 11 aa, Dengue virus
GSAKLQWFVER

SEQ ID NO: 122029 - protein, 11 aa, Dengue virus
SAKLQWFVERN

SEQ ID NO: 122030 - protein, 11 aa, Dengue virus
AKLQWFVERNM

SEQ ID NO: 122031 - protein, 11 aa, Dengue virus
KLQWFVERNMV

SEQ ID NO: 122032 - protein, 11 aa, Dengue virus
PEGRVIDLGCG

SEQ ID NO: 122033 - protein, 11 aa, Dengue virus
EGRVIDLGCGR

SEQ ID NO: 122034 - protein, 11 aa, Dengue virus
GRVIDLGCGRG

SEQ ID NO: 122035 - protein, 11 aa, Dengue virus
RVIDLGCGRGG

SEQ ID NO: 122036 - protein, 11 aa, Dengue virus
CGRGGWSYYMA

SEQ ID NO: 122037 - protein, 11 aa, Dengue virus
GRGGWSYYMAT

SEQ ID NO: 122038 - protein, 11 aa, Dengue virus
RGGWSYYMATL

SEQ ID NO: 122039 - protein, 11 aa, Dengue virus
GGWSYYMATLK

SEQ ID NO: 122040 - protein, 11 aa, Dengue virus
GWSYYMATLKN

SEQ ID NO: 122041 - protein, 11 aa, Dengue virus
WSYYMATLKNV

SEQ ID NO: 122042 - protein, 11 aa, Dengue virus
SYYMATLKNVT

SEQ ID NO: 122043 - protein, 11 aa, Dengue virus
YYMATLKNVTE

SEQ ID NO: 122044 - protein, 11 aa, Dengue virus
YMATLKNVTEV

SEQ ID NO: 122045 - protein, 11 aa, Dengue virus
VTEVRGYTKGG

SEQ ID NO: 122046 - protein, 11 aa, Dengue virus
TEVRGYTKGGP

SEQ ID NO: 122047 - protein, 11 aa, Dengue virus
EVRGYTKGGPG

SEQ ID NO: 122048 - protein, 11 aa, Dengue virus
VRGYTKGGPGH

SEQ ID NO: 122049 - protein, 11 aa, Dengue virus
RGYTKGGPGHE

SEQ ID NO: 122050 - protein, 11 aa, Dengue virus
YTKGGAGHEEP

SEQ ID NO: 122051 - protein, 11 aa, Dengue virus
GPGHEEPVPMS

SEQ ID NO: 122052 - protein, 11 aa, Dengue virus
PGHEEPVPMST

SEQ ID NO: 122053 - protein, 11 aa, Dengue virus
GHEEPVPMSTY

SEQ ID NO: 122054 - protein, 11 aa, Dengue virus
HEEPVPMSTYG

SEQ ID NO: 122055 - protein, 11 aa, Dengue virus
EEPVPMSTYGW

SEQ ID NO: 122056 - protein, 11 aa, Dengue virus
EPVPMSTYGWN

SEQ ID NO: 122057 - protein, 11 aa, Dengue virus
PVPMSTYGWNI

SEQ ID NO: 122058 - protein, 11 aa, Dengue virus
VPMSTYGWNIV

SEQ ID NO: 122059 - protein, 11 aa, Dengue virus
PMSTYGWNIVK

SEQ ID NO: 122060 - protein, 11 aa, Dengue virus
MSTYGWNIVKL

SEQ ID NO: 122061 - protein, 11 aa, Dengue virus
STYGWNIVKLM

SEQ ID NO: 122062 - protein, 11 aa, Dengue virus
PPERCDTLLCD

SEQ ID NO: 122063 - protein, 11 aa, Dengue virus
PERCDTLLCDI

SEQ ID NO: 122064 - protein, 11 aa, Dengue virus
ERCDTLLCDIG

SEQ ID NO: 122065 - protein, 11 aa, Dengue virus
RCDTLLCDIGE

SEQ ID NO: 122066 - protein, 11 aa, Dengue virus
LLCDIGESSSN

SEQ ID NO: 122067 - protein, 11 aa, Dengue virus
LCDIGESSSNP

SEQ ID NO: 122068 - protein, 11 aa, Dengue virus
CDIGESSSNPT

SEQ ID NO: 122069 - protein, 11 aa, Dengue virus
DIGESSPNPTV

SEQ ID NO: 122070 - protein, 11 aa, Dengue virus
IGESSPNPTVE

SEQ ID NO: 122071 - protein, 11 aa, Dengue virus
GESSPNPTIEA

SEQ ID NO: 122072 - protein, 11 aa, Dengue virus
ESSPNPTIEAG

SEQ ID NO: 122073 - protein, 11 aa, Dengue virus
SSPNPTIEAGR

SEQ ID NO: 122074 - protein, 11 aa, Dengue virus
SPNPTIEAGRT

SEQ ID NO: 122075 - protein, 11 aa, Dengue virus
PNPTIEAGRTL

SEQ ID NO: 122076 - protein, 11 aa, Dengue virus
NPTIEAGRTLR

SEQ ID NO: 122077 - protein, 11 aa, Dengue virus
PTIEAGRTLRV

SEQ ID NO: 122078 - protein, 11 aa, Dengue virus
TIEAGRTLRVL

SEQ ID NO: 122079 - protein, 11 aa, Dengue virus
IEAGRTLRVLN

SEQ ID NO: 122080 - protein, 11 aa, Dengue virus
EESRTIRVLKM

SEQ ID NO: 122081 - protein, 11 aa, Dengue virus
ESRTIRVLKMV

SEQ ID NO: 122082 - protein, 11 aa, Dengue virus
SRTIRVLKMVE

SEQ ID NO: 122083 - protein, 11 aa, Dengue virus
RTIRVLKMVEP

SEQ ID NO: 122084 - protein, 11 aa, Dengue virus
TIRVLKMVEPW

SEQ ID NO: 122085 - protein, 11 aa, Dengue virus
IRVLKMVEPWL

SEQ ID NO: 122086 - protein, 11 aa, Dengue virus
EFCIKVLNPYM

SEQ ID NO: 122087 - protein, 11 aa, Dengue virus
FCVKVLNPYMP

SEQ ID NO: 122088 - protein, 11 aa, Dengue virus
CIKVLNPYMPT

SEQ ID NO: 122089 - protein, 11 aa, Dengue virus
IKVLNPYMPTV

SEQ ID NO: 122090 - protein, 11 aa, Dengue virus
KVLNPYMPTVI

SEQ ID NO: 122091 - protein, 11 aa, Dengue virus
VLNPYMPTVIE

SEQ ID NO: 122092 - protein, 11 aa, Dengue virus
YGGMLVRNPLS

SEQ ID NO: 122093 - protein, 11 aa, Dengue virus
GGNLVRCPLSR

SEQ ID NO: 122094 - protein, 11 aa, Dengue virus
GNLVRCPLSRN

SEQ ID NO: 122095 - protein, 11 aa, Dengue virus
NLVRCPLSRNS

SEQ ID NO: 122096 - protein, 11 aa, Dengue virus
NSTHEMYWISN

SEQ ID NO: 122097 - protein, 11 aa, Dengue virus
STHEMYWISNG

SEQ ID NO: 122098 - protein, 11 aa, Dengue virus
THEMYWVSNAT

SEQ ID NO: 122099 - protein, 11 aa, Dengue virus
HEMYWVSNATG

SEQ ID NO: 122100 - protein, 11 aa, Dengue virus
EMYWVSNATGN

SEQ ID NO: 122101 - protein, 11 aa, Dengue virus
MYWVSNATGNI

SEQ ID NO: 122102 - protein, 11 aa, Dengue virus
YWVSNATGNIV

SEQ ID NO: 122103 - protein, 11 aa, Dengue virus
GNIVASVNMVS

SEQ ID NO: 122104 - protein, 11 aa, Dengue virus
NIVASVNMVSR

SEQ ID NO: 122105 - protein, 11 aa, Dengue virus
IVASVNMVSRL

SEQ ID NO: 122106 - protein, 11 aa, Dengue virus
VASVNMVSRLL

SEQ ID NO: 122107 - protein, 11 aa, Dengue virus
ASVNMVSRLLL

SEQ ID NO: 122108 - protein, 11 aa, Dengue virus
SVNMVSRLLLN

SEQ ID NO: 122109 - protein, 11 aa, Dengue virus
VNMVSRLLLNR

SEQ ID NO: 122110 - protein, 11 aa, Dengue virus
NMVSRLLLNRF

SEQ ID NO: 122111 - protein, 11 aa, Dengue virus
MVSRLLLNRFT

SEQ ID NO: 122112 - protein, 11 aa, Dengue virus
VSRLLLNRFTM

SEQ ID NO: 122113 - protein, 11 aa, Dengue virus
EKDVDLGAGTR

SEQ ID NO: 122114 - protein, 11 aa, Dengue virus
KDVDLGAGTRH

SEQ ID NO: 122115 - protein, 11 aa, Dengue virus
DVDLGAGTRSV

SEQ ID NO: 122116 - protein, 11 aa, Dengue virus
VDLGAGTRHVN

SEQ ID NO: 122117 - protein, 11 aa, Dengue virus
DLGAGTRHVNA

SEQ ID NO: 122118 - protein, 11 aa, Dengue virus
LGAGTRHVNAE

SEQ ID NO: 122119 - protein, 11 aa, Dengue virus
TWHYDDENPYK

SEQ ID NO: 122120 - protein, 11 aa, Dengue virus
WHYDDENPYKT

SEQ ID NO: 122121 - protein, 11 aa, Dengue virus
HYDDENPYKTW

SEQ ID NO: 122122 - protein, 11 aa, Dengue virus
YDDENPYKTWA

SEQ ID NO: 122123 - protein, 11 aa, Dengue virus
DDENPYKTWAY

SEQ ID NO: 122124 - protein, 11 aa, Dengue virus
DENPYKTWAYH

SEQ ID NO: 122125 - protein, 11 aa, Dengue virus
ENPYKTWAYHG

SEQ ID NO: 122126 - protein, 11 aa, Dengue virus
NPYRTWAYHGS

SEQ ID NO: 122127 - protein, 11 aa, Dengue virus
RTWAYHGSYEA

SEQ ID NO: 122128 - protein, 11 aa, Dengue virus
TWAYHGSYEAP

SEQ ID NO: 122129 - protein, 11 aa, Dengue virus
WAYHGSYEVKA

SEQ ID NO: 122130 - protein, 11 aa, Dengue virus
AYHGSYEVKAT

SEQ ID NO: 122131 - protein, 11 aa, Dengue virus
YHGSYEVKATG

SEQ ID NO: 122132 - protein, 11 aa, Dengue virus
HGSYEVKATGS

SEQ ID NO: 122133 - protein, 11 aa, Dengue virus
GSYEVKATGSA

SEQ ID NO: 122134 - protein, 11 aa, Dengue virus
SYEVKATGSAS

SEQ ID NO: 122135 - protein, 11 aa, Dengue virus
YEVKATGSASS

SEQ ID NO: 122136 - protein, 11 aa, Dengue virus
EVKATGSASSM

SEQ ID NO: 122137 - protein, 11 aa, Dengue virus
VKATGSASSMI

SEQ ID NO: 122138 - protein, 11 aa, Dengue virus
KATGSASSMIN

SEQ ID NO: 122139 - protein, 11 aa, Dengue virus
ATGSASSMING

SEQ ID NO: 122140 - protein, 11 aa, Dengue virus
TGSASSMINGV

SEQ ID NO: 122141 - protein, 11 aa, Dengue virus
SASSMINGVVK

SEQ ID NO: 122142 - protein, 11 aa, Dengue virus
ASSMINGVVKL

SEQ ID NO: 122143 - protein, 11 aa, Dengue virus
SSMINGVVKLL

SEQ ID NO: 122144 - protein, 11 aa, Dengue virus
SMINGVVKLLT

SEQ ID NO: 122145 - protein, 11 aa, Dengue virus
MINGVVKLLTK

SEQ ID NO: 122146 - protein, 11 aa, Dengue virus
INGVVKLLTKP

SEQ ID NO: 122147 - protein, 11 aa, Dengue virus
VRLLTKPWDVV

SEQ ID NO: 122148 - protein, 11 aa, Dengue virus
RLLTKPWDVVP

SEQ ID NO: 122149 - protein, 11 aa, Dengue virus
LLTKPWDVLPT

SEQ ID NO: 122150 - protein, 11 aa, Dengue virus
LTKPWDVLPTV

SEQ ID NO: 122151 - protein, 11 aa, Dengue virus
TKPWDVLPTVT

SEQ ID NO: 122152 - protein, 11 aa, Dengue virus
KPWDVLPTVTQ

SEQ ID NO: 122153 - protein, 11 aa, Dengue virus
PTVTQMAMTDT

SEQ ID NO: 122154 - protein, 11 aa, Dengue virus
TVTQMAMTDTT

SEQ ID NO: 122155 - protein, 11 aa, Dengue virus
VTQLAMTDTTP

SEQ ID NO: 122156 - protein, 11 aa, Dengue virus
TQLAMTDTTPF

SEQ ID NO: 122157 - protein, 11 aa, Dengue virus
QLAMTDTTPFG

SEQ ID NO: 122158 - protein, 11 aa, Dengue virus
LAMTDTTPFGQ

SEQ ID NO: 122159 - protein, 11 aa, Dengue virus
FKEKVDTRTPR

SEQ ID NO: 122160 - protein, 11 aa, Dengue virus
CTREEFISKVR

SEQ ID NO: 122161 - protein, 11 aa, Dengue virus
KKVRTNAAMGA

SEQ ID NO: 122162 - protein, 11 aa, Dengue virus
KVRTNAAMGAV

SEQ ID NO: 122163 - protein, 11 aa, Dengue virus
VRTNAAMGAVF

SEQ ID NO: 122164 - protein, 11 aa, Dengue virus
RTNAAMGAVFT

SEQ ID NO: 122165 - protein, 11 aa, Dengue virus
TNAAMGAVFTE

SEQ ID NO: 122166 - protein, 11 aa, Dengue virus
NAAMGAVFTEE

SEQ ID NO: 122167 - protein, 11 aa, Dengue virus
AAMGAVFTEEN

SEQ ID NO: 122168 - protein, 11 aa, Dengue virus
AMGAVFTEENQ

SEQ ID NO: 122169 - protein, 11 aa, Dengue virus
MGAVFTEENQW

SEQ ID NO: 122170 - protein, 11 aa, Dengue virus
GAVFTEENQWD

SEQ ID NO: 122171 - protein, 11 aa, Dengue virus
AVFTEENQWDS

SEQ ID NO: 122172 - protein, 11 aa, Dengue virus
VFTEENQWDSA

SEQ ID NO: 122173 - protein, 11 aa, Dengue virus
FTEENQWDSAK

SEQ ID NO: 122174 - protein, 11 aa, Dengue virus
TEENQWDSAKA

SEQ ID NO: 122175 - protein, 11 aa, Dengue virus
EENQWDSAKAA

SEQ ID NO: 122176 - protein, 11 aa, Dengue virus
ENQWDSAKAAV

SEQ ID NO: 122177 - protein, 11 aa, Dengue virus
NQWDSAKAAVE

SEQ ID NO: 122178 - protein, 11 aa, Dengue virus
QWDSAKAAVED

SEQ ID NO: 122179 - protein, 11 aa, Dengue virus
ERELHKLGKCG

SEQ ID NO: 122180 - protein, 11 aa, Dengue virus
RELHKLGKCGS

SEQ ID NO: 122181 - protein, 11 aa, Dengue virus
ELHKLGKCGSC

SEQ ID NO: 122182 - protein, 11 aa, Dengue virus
LHKLGKCGSCV

SEQ ID NO: 122183 - protein, 11 aa, Dengue virus
HKLGKCGSCVY

SEQ ID NO: 122184 - protein, 11 aa, Dengue virus
KLGKCGSCVYN

SEQ ID NO: 122185 - protein, 11 aa, Dengue virus
LGKCGSCVYNM

SEQ ID NO: 122186 - protein, 11 aa, Dengue virus
GKCGSCVYNMM

SEQ ID NO: 122187 - protein, 11 aa, Dengue virus
KCGSCVYNMMG

SEQ ID NO: 122188 - protein, 11 aa, Dengue virus
CGSCVYNMMGK

SEQ ID NO: 122189 - protein, 11 aa, Dengue virus
GSCVYNMMGKR

SEQ ID NO: 122190 - protein, 11 aa, Dengue virus
RYLEFEALGFL

SEQ ID NO: 122191 - protein, 11 aa, Dengue virus
YLEFEALGFLN

SEQ ID NO: 122192 - protein, 11 aa, Dengue virus
LGFLNEDHWFG

SEQ ID NO: 122193 - protein, 11 aa, Dengue virus
GFLNEDHWFGR

SEQ ID NO: 122194 - protein, 11 aa, Dengue virus
FLNEDHWFSRG

SEQ ID NO: 122195 - protein, 11 aa, Dengue virus
LNEDHWFSRGN

SEQ ID NO: 122196 - protein, 11 aa, Dengue virus
NEDHWFGRENS

SEQ ID NO: 122197 - protein, 11 aa, Dengue virus
EDHWFSRGNSL

SEQ ID NO: 122198 - protein, 11 aa, Dengue virus
DHWFSRGNSLS

SEQ ID NO: 122199 - protein, 11 aa, Dengue virus
HWFSRGNSLSG

SEQ ID NO: 122200 - protein, 11 aa, Dengue virus
WFSRGNSLSGV

SEQ ID NO: 122201 - protein, 11 aa, Dengue virus
FSRGNSLSGVE

SEQ ID NO: 122202 - protein, 11 aa, Dengue virus
SRGNSLSGVEG

SEQ ID NO: 122203 - protein, 11 aa, Dengue virus
RGNSLSGVEGE

SEQ ID NO: 122204 - protein, 11 aa, Dengue virus
GNSLSGVEGEG

SEQ ID NO: 122205 - protein, 11 aa, Dengue virus
NSWSGVEGEGL

SEQ ID NO: 122206 - protein, 11 aa, Dengue virus
SWSGVEGEGLH

SEQ ID NO: 122207 - protein, 11 aa, Dengue virus
LSGVEGEGLHR

SEQ ID NO: 122208 - protein, 11 aa, Dengue virus
EGLHRLGYILE

SEQ ID NO: 122209 - protein, 11 aa, Dengue virus
GDLMYADDTAG

SEQ ID NO: 122210 - protein, 11 aa, Dengue virus
DLMYADDTAGW

SEQ ID NO: 122211 - protein, 11 aa, Dengue virus
LMYADDTAGWD

SEQ ID NO: 122212 - protein, 11 aa, Dengue virus
DTAGWDTRITI

SEQ ID NO: 122213 - protein, 11 aa, Dengue virus
TAGWDTRITIE

SEQ ID NO: 122214 - protein, 11 aa, Dengue virus
AGWDTRITIED

SEQ ID NO: 122215 - protein, 11 aa, Dengue virus
GWDTRITIEDL

SEQ ID NO: 122216 - protein, 11 aa, Dengue virus
LTYQNKVVKVL

SEQ ID NO: 122217 - protein, 11 aa, Dengue virus
TYQNKVVKVLR

SEQ ID NO: 122218 - protein, 11 aa, Dengue virus
YQNKVVKVLRP

SEQ ID NO: 122219 - protein, 11 aa, Dengue virus
QNKVVKVQRPT

SEQ ID NO: 122220 - protein, 11 aa, Dengue virus
NKVVKVQRPTP

SEQ ID NO: 122221 - protein, 11 aa, Dengue virus
GTVMDIISRKD

SEQ ID NO: 122222 - protein, 11 aa, Dengue virus
TVMDIISRKDQ

SEQ ID NO: 122223 - protein, 11 aa, Dengue virus
VMDIISRRDQR

SEQ ID NO: 122224 - protein, 11 aa, Dengue virus
MDIISRRDQRG

SEQ ID NO: 122225 - protein, 11 aa, Dengue virus
DIISRRDQRGS

SEQ ID NO: 122226 - protein, 11 aa, Dengue virus
IISRRDQRGSG

SEQ ID NO: 122227 - protein, 11 aa, Dengue virus
RRDQRGSGQVV

SEQ ID NO: 122228 - protein, 11 aa, Dengue virus
RDQRGSGQVVT

SEQ ID NO: 122229 - protein, 11 aa, Dengue virus
FTNMEAQLVRQ

SEQ ID NO: 122230 - protein, 11 aa, Dengue virus
TNMEAQLVRQM

SEQ ID NO: 122231 - protein, 11 aa, Dengue virus
NMEAQLVRQME

SEQ ID NO: 122232 - protein, 11 aa, Dengue virus
VQLIRQMESEG

SEQ ID NO: 122233 - protein, 11 aa, Dengue virus
DRLKRMAISGD

SEQ ID NO: 122234 - protein, 11 aa, Dengue virus
RLRRMAISGDD

SEQ ID NO: 122235 - protein, 11 aa, Dengue virus
LRRMAISGDDC

SEQ ID NO: 122236 - protein, 11 aa, Dengue virus
RRMAISGDDCV

SEQ ID NO: 122237 - protein, 11 aa, Dengue virus
ISGDDCVVKPT

SEQ ID NO: 122238 - protein, 11 aa, Dengue virus
SGDDCVVKPTD

SEQ ID NO: 122239 - protein, 11 aa, Dengue virus
GDDCVVKPLDE

SEQ ID NO: 122240 - protein, 11 aa, Dengue virus
DDCVVKPLDER

SEQ ID NO: 122241 - protein, 11 aa, Dengue virus
DCVVKPLDERF

SEQ ID NO: 122242 - protein, 11 aa, Dengue virus
FLNDMGKVRKD

SEQ ID NO: 122243 - protein, 11 aa, Dengue virus
LNDMGKVRKDV

SEQ ID NO: 122244 - protein, 11 aa, Dengue virus
NDMGKIRKDIQ

SEQ ID NO: 122245 - protein, 11 aa, Dengue virus
DMGKIRKDIQQ

SEQ ID NO: 122246 - protein, 11 aa, Dengue virus
MGKIRKDIQQW

SEQ ID NO: 122247 - protein, 11 aa, Dengue virus
GKVRKDIQQWE

SEQ ID NO: 122248 - protein, 11 aa, Dengue virus
KVRKDIQQWEP

SEQ ID NO: 122249 - protein, 11 aa, Dengue virus
VRKDIQQWEPS

SEQ ID NO: 122250 - protein, 11 aa, Dengue virus
RKDIPQWQPSK

SEQ ID NO: 122251 - protein, 11 aa, Dengue virus
KDIPQWQPSKG

SEQ ID NO: 122252 - protein, 11 aa, Dengue virus
DIPQWQPSKGW

SEQ ID NO: 122253 - protein, 11 aa, Dengue virus
QWQPSKGWHDW

SEQ ID NO: 122254 - protein, 11 aa, Dengue virus
GWHDWQQVPFC

SEQ ID NO: 122255 - protein, 11 aa, Dengue virus
WHDWQQVPFCS

SEQ ID NO: 122256 - protein, 11 aa, Dengue virus
HDWQQVPFCSH

SEQ ID NO: 122257 - protein, 11 aa, Dengue virus
NWQEVPFCSHH

SEQ ID NO: 122258 - protein, 11 aa, Dengue virus
WQEVPFCSHHF

SEQ ID NO: 122259 - protein, 11 aa, Dengue virus
QEVPFCSHHFH

SEQ ID NO: 122260 - protein, 11 aa, Dengue virus
EVPFCSHHFHK

SEQ ID NO: 122261 - protein, 11 aa, Dengue virus
VPFCSHHFHKI

SEQ ID NO: 122262 - protein, 11 aa, Dengue virus
PFCSHHFHELV

SEQ ID NO: 122263 - protein, 11 aa, Dengue virus
FCSHHFHELVM

SEQ ID NO: 122264 - protein, 11 aa, Dengue virus
CSHHFHELVMK

SEQ ID NO: 122265 - protein, 11 aa, Dengue virus
SHHFHELVMKD

SEQ ID NO: 122266 - protein, 11 aa, Dengue virus
HHFHELVMKDG

SEQ ID NO: 122267 - protein, 11 aa, Dengue virus
HFHELVMKDGR

SEQ ID NO: 122268 - protein, 11 aa, Dengue virus
LVVPCRPQDEL

SEQ ID NO: 122269 - protein, 11 aa, Dengue virus
VVPCRPQDELI

SEQ ID NO: 122270 - protein, 11 aa, Dengue virus
VPCRPQDELIG

SEQ ID NO: 122271 - protein, 11 aa, Dengue virus
PCRPQDELIGR

SEQ ID NO: 122272 - protein, 11 aa, Dengue virus
CRPQDELIGRA

SEQ ID NO: 122273 - protein, 11 aa, Dengue virus
RPQDELIGRAR

SEQ ID NO: 122274 - protein, 11 aa, Dengue virus
PQDELIGRARI

SEQ ID NO: 122275 - protein, 11 aa, Dengue virus
RISQGAGWSLK

SEQ ID NO: 122276 - protein, 11 aa, Dengue virus
ISQGAGWSLKE

SEQ ID NO: 122277 - protein, 11 aa, Dengue virus
SLRETACLGKA

SEQ ID NO: 122278 - protein, 11 aa, Dengue virus
LRETACLGKAY

SEQ ID NO: 122279 - protein, 11 aa, Dengue virus
RETACLGKAYA

SEQ ID NO: 122280 - protein, 11 aa, Dengue virus
CLGKSYAQMWS

SEQ ID NO: 122281 - protein, 11 aa, Dengue virus
LGKSYAQMWSL

SEQ ID NO: 122282 - protein, 11 aa, Dengue virus
GKSYAQMWSLM

SEQ ID NO: 122283 - protein, 11 aa, Dengue virus
KSYAQMWSLMY

SEQ ID NO: 122284 - protein, 11 aa, Dengue virus
SYAQMWSLMYF

SEQ ID NO: 122285 - protein, 11 aa, Dengue virus
YAQMWTLMYFH

SEQ ID NO: 122286 - protein, 11 aa, Dengue virus
AQMWTLMYFHR

SEQ ID NO: 122287 - protein, 11 aa, Dengue virus
QMWTLMYFHRR

SEQ ID NO: 122288 - protein, 11 aa, Dengue virus
MWTLMYFHRRD

SEQ ID NO: 122289 - protein, 11 aa, Dengue virus
WTLMYFHRRDL

SEQ ID NO: 122290 - protein, 11 aa, Dengue virus
TLMYFHRRDLR

SEQ ID NO: 122291 - protein, 11 aa, Dengue virus
FHRRDLRLASM

SEQ ID NO: 122292 - protein, 11 aa, Dengue virus
HRRDLRLASMA

SEQ ID NO: 122293 - protein, 11 aa, Dengue virus
RRDLRLASMAI

SEQ ID NO: 122294 - protein, 11 aa, Dengue virus
RDLRLASMAIC

SEQ ID NO: 122295 - protein, 11 aa, Dengue virus
DLRLASMAICS

SEQ ID NO: 122296 - protein, 11 aa, Dengue virus
LRLASMAICSA

SEQ ID NO: 122297 - protein, 11 aa, Dengue virus
RLASMAICSAV

SEQ ID NO: 122298 - protein, 11 aa, Dengue virus
LASMAICSAVP

SEQ ID NO: 122299 - protein, 11 aa, Dengue virus
DWIPTSRTTWS

SEQ ID NO: 122300 - protein, 11 aa, Dengue virus
WFPTSRTTWSI

SEQ ID NO: 122301 - protein, 11 aa, Dengue virus
FPTSRTTWSIH

SEQ ID NO: 122302 - protein, 11 aa, Dengue virus
TSRTTWSIHAT

SEQ ID NO: 122303 - protein, 11 aa, Dengue virus
SRTTWSIHATH

SEQ ID NO: 122304 - protein, 11 aa, Dengue virus
RTTWSIHATHE

SEQ ID NO: 122305 - protein, 11 aa, Dengue virus
TTWSIHATHEW

SEQ ID NO: 122306 - protein, 11 aa, Dengue virus
TWSIHATHEWM

SEQ ID NO: 122307 - protein, 11 aa, Dengue virus
WSIHATHEWMT

SEQ ID NO: 122308 - protein, 11 aa, Dengue virus
SIHATHEWMTT

SEQ ID NO: 122309 - protein, 11 aa, Dengue virus
IHATHEWMTTE

SEQ ID NO: 122310 - protein, 11 aa, Dengue virus
HATHEWMTTED

SEQ ID NO: 122311 - protein, 11 aa, Dengue virus
ATHEWMTTEDM

SEQ ID NO: 122312 - protein, 11 aa, Dengue virus
THEWMTTEDML

SEQ ID NO: 122313 - protein, 11 aa, Dengue virus
HEWMTTEDMLA

SEQ ID NO: 122314 - protein, 11 aa, Dengue virus
EWMTTEDMLAV

SEQ ID NO: 122315 - protein, 11 aa, Dengue virus
WMTTEDMLAVW

SEQ ID NO: 122316 - protein, 11 aa, Dengue virus
MTTEDMLAVWN

SEQ ID NO: 122317 - protein, 11 aa, Dengue virus
TTEDMLAVWNR

SEQ ID NO: 122318 - protein, 11 aa, Dengue virus
TEDMLAVWNRV

SEQ ID NO: 122319 - protein, 11 aa, Dengue virus
EDMLAVWNRVW

SEQ ID NO: 122320 - protein, 11 aa, Dengue virus
DMLAVWNRVWI

SEQ ID NO: 122321 - protein, 11 aa, Dengue virus
EIPYLGKREDQ

SEQ ID NO: 122322 - protein, 11 aa, Dengue virus
IPYLGKREDLW

SEQ ID NO: 122323 - protein, 11 aa, Dengue virus
LWCGSLIGLSS

SEQ ID NO: 122324 - protein, 11 aa, Dengue virus
WCGSLIGLSSR

SEQ ID NO: 122325 - protein, 11 aa, Dengue virus
CGSLIGLSSRA

SEQ ID NO: 122326 - protein, 11 aa, Dengue virus
GSLIGLSSRAT

SEQ ID NO: 122327 - protein, 11 aa, Dengue virus
SLIGLSSRATW

SEQ ID NO: 122328 - protein, 11 aa, Dengue virus
LIGLSSRATWA

SEQ ID NO: 122329 - protein, 11 aa, Dengue virus
IGLTSRATWAQ

SEQ ID NO: 122330 - protein, 11 aa, Dengue virus
GLTSRATWAQN

SEQ ID NO: 122331 - protein, 11 aa, Dengue virus
LTSRATWAQNI

SEQ ID NO: 122332 - protein, 11 aa, Dengue virus
PPFNMLKRERN

SEQ ID NO: 122333 - protein, 11 aa, Dengue virus
RNRVSTPQGLV

SEQ ID NO: 122334 - protein, 11 aa, Dengue virus
NRVSTPQGLVK

SEQ ID NO: 122335 - protein, 11 aa, Dengue virus
RVSTPQGLVKR

SEQ ID NO: 122336 - protein, 11 aa, Dengue virus
VSTPQGLVKRF

SEQ ID NO: 122337 - protein, 11 aa, Dengue virus
STPQGLVKRFS

SEQ ID NO: 122338 - protein, 11 aa, Dengue virus
QGLVKRFSTGL

SEQ ID NO: 122339 - protein, 11 aa, Dengue virus
GLVKRFSTGLF

SEQ ID NO: 122340 - protein, 11 aa, Dengue virus
LAKRFSRGLLN

SEQ ID NO: 122341 - protein, 11 aa, Dengue virus
AKRFSRGLLNG

SEQ ID NO: 122342 - protein, 11 aa, Dengue virus
KRFSRGLLNGQ

SEQ ID NO: 122343 - protein, 11 aa, Dengue virus
RFSRGLLNGQG

SEQ ID NO: 122344 - protein, 11 aa, Dengue virus
FSRGLLNGQGP

SEQ ID NO: 122345 - protein, 11 aa, Dengue virus
MVMAFIAFLRF

SEQ ID NO: 122346 - protein, 11 aa, Dengue virus
RVLSIPPTAGI

SEQ ID NO: 122347 - protein, 11 aa, Dengue virus
VLSIPPTAGIL

SEQ ID NO: 122348 - protein, 11 aa, Dengue virus
LSIPPTAGILK

SEQ ID NO: 122349 - protein, 11 aa, Dengue virus
SIPPTAGILKR

SEQ ID NO: 122350 - protein, 11 aa, Dengue virus
PPTAGILARWS

SEQ ID NO: 122351 - protein, 11 aa, Dengue virus
AFHLSTRDGEP

SEQ ID NO: 122352 - protein, 11 aa, Dengue virus
FHLSTRDGEPL

SEQ ID NO: 122353 - protein, 11 aa, Dengue virus
HLSTRDGEPLM

SEQ ID NO: 122354 - protein, 11 aa, Dengue virus
LSTRDGEPLMI

SEQ ID NO: 122355 - protein, 11 aa, Dengue virus
STRDGEPLMIV

SEQ ID NO: 122356 - protein, 11 aa, Dengue virus
HERGRPLLFKT

SEQ ID NO: 122357 - protein, 11 aa, Dengue virus
ERGRPLLFKTT

SEQ ID NO: 122358 - protein, 11 aa, Dengue virus
NKCTLIAMDLG

SEQ ID NO: 122359 - protein, 11 aa, Dengue virus
KCTLIAMDLGE

SEQ ID NO: 122360 - protein, 11 aa, Dengue virus
CTLMAMDLGEL

SEQ ID NO: 122361 - protein, 11 aa, Dengue virus
TLMAMDLGELC

SEQ ID NO: 122362 - protein, 11 aa, Dengue virus
AMDLGEFCEDT

SEQ ID NO: 122363 - protein, 11 aa, Dengue virus
EPDDVDCWCNT

SEQ ID NO: 122364 - protein, 11 aa, Dengue virus
PDDVDCWCNTT

SEQ ID NO: 122365 - protein, 11 aa, Dengue virus
DDVDCWCNATE

SEQ ID NO: 122366 - protein, 11 aa, Dengue virus
DVDCWCNATET

SEQ ID NO: 122367 - protein, 11 aa, Dengue virus
VDCWCNATETW

SEQ ID NO: 122368 - protein, 11 aa, Dengue virus
GERRRDKRSVA

SEQ ID NO: 122369 - protein, 11 aa, Dengue virus
ERRRDKRSVAL

SEQ ID NO: 122370 - protein, 11 aa, Dengue virus
HRREKRSVALA

SEQ ID NO: 122371 - protein, 11 aa, Dengue virus
RREKRSVALAP

SEQ ID NO: 122372 - protein, 11 aa, Dengue virus
REKRSVALAPH

SEQ ID NO: 122373 - protein, 11 aa, Dengue virus
EKRSVALAPHV

SEQ ID NO: 122374 - protein, 11 aa, Dengue virus
RSVALTPHSGM

SEQ ID NO: 122375 - protein, 11 aa, Dengue virus
SVALTPHSGMG

SEQ ID NO: 122376 - protein, 11 aa, Dengue virus
VALTPHSGMGL

SEQ ID NO: 122377 - protein, 11 aa, Dengue virus
ALTPHSGMGLE

SEQ ID NO: 122378 - protein, 11 aa, Dengue virus
LTPHSGMGLET

SEQ ID NO: 122379 - protein, 11 aa, Dengue virus
TPHSGMGLETR

SEQ ID NO: 122380 - protein, 11 aa, Dengue virus
GLDTRAQTWMS

SEQ ID NO: 122381 - protein, 11 aa, Dengue virus
LDTRAQTWMSA

SEQ ID NO: 122382 - protein, 11 aa, Dengue virus
DTRAQTWMSAE

SEQ ID NO: 122383 - protein, 11 aa, Dengue virus
TRAQTWMSAEG

SEQ ID NO: 122384 - protein, 11 aa, Dengue virus
RAQTWMSAEGA

SEQ ID NO: 122385 - protein, 11 aa, Dengue virus
AQTWMSAEGAW

SEQ ID NO: 122386 - protein, 11 aa, Dengue virus
TWMSSEGAWRQ

SEQ ID NO: 122387 - protein, 11 aa, Dengue virus
VETWAFRHPGF

SEQ ID NO: 122388 - protein, 11 aa, Dengue virus
ETWAFRHPGFT

SEQ ID NO: 122389 - protein, 11 aa, Dengue virus
MRCVGIGNRDF

SEQ ID NO: 122390 - protein, 11 aa, Dengue virus
RCVGIGNRDFV

SEQ ID NO: 122391 - protein, 11 aa, Dengue virus
CVGIGNRDFVE

SEQ ID NO: 122392 - protein, 11 aa, Dengue virus
VGIGNRDFVEG

SEQ ID NO: 122393 - protein, 11 aa, Dengue virus
GNRDFVEGVSG

SEQ ID NO: 122394 - protein, 11 aa, Dengue virus
AWVDLVLEHGG

SEQ ID NO: 122395 - protein, 11 aa, Dengue virus
WVDLVLEHGGC

SEQ ID NO: 122396 - protein, 11 aa, Dengue virus
VDLVLEHGGCV

SEQ ID NO: 122397 - protein, 11 aa, Dengue virus
DLVLEHGGCVT

SEQ ID NO: 122398 - protein, 11 aa, Dengue virus
LVLEHGGCVTT

SEQ ID NO: 122399 - protein, 11 aa, Dengue virus
HGGCVTTMAQG

SEQ ID NO: 122400 - protein, 11 aa, Dengue virus
GGCVTTMAQGK

SEQ ID NO: 122401 - protein, 11 aa, Dengue virus
GCVTTMAQGKP

SEQ ID NO: 122402 - protein, 11 aa, Dengue virus
CVTTMAKSKPT

SEQ ID NO: 122403 - protein, 11 aa, Dengue virus
VTTMAKSKPTL

SEQ ID NO: 122404 - protein, 11 aa, Dengue virus
TTMAKSKPTLD

SEQ ID NO: 122405 - protein, 11 aa, Dengue virus
TMAQGKPTLDF

SEQ ID NO: 122406 - protein, 11 aa, Dengue virus
MAQGKPTLDFE

SEQ ID NO: 122407 - protein, 11 aa, Dengue virus
AQGKPTLDFEL

SEQ ID NO: 122408 - protein, 11 aa, Dengue virus
KPTLDFELTKT

SEQ ID NO: 122409 - protein, 11 aa, Dengue virus
PTLDFELTKTT

SEQ ID NO: 122410 - protein, 11 aa, Dengue virus
TLDFELTKTTA

SEQ ID NO: 122411 - protein, 11 aa, Dengue virus
LDFELTKTTAK

SEQ ID NO: 122412 - protein, 11 aa, Dengue virus
TTASRCPTQGE

SEQ ID NO: 122413 - protein, 11 aa, Dengue virus
TASRCPTQGEP

SEQ ID NO: 122414 - protein, 11 aa, Dengue virus
CRRDVVDRGWG

SEQ ID NO: 122415 - protein, 11 aa, Dengue virus
RRDVVDRGWGN

SEQ ID NO: 122416 - protein, 11 aa, Dengue virus
RDVVDRGWGNG

SEQ ID NO: 122417 - protein, 11 aa, Dengue virus
DVVDRGWGNGC

SEQ ID NO: 122418 - protein, 11 aa, Dengue virus
VVDRGWGNGCG

SEQ ID NO: 122419 - protein, 11 aa, Dengue virus
GCGLFGKGSLL

SEQ ID NO: 122420 - protein, 11 aa, Dengue virus
CGLFGKGSLLT

SEQ ID NO: 122421 - protein, 11 aa, Dengue virus
GLFGKGSLLTC

SEQ ID NO: 122422 - protein, 11 aa, Dengue virus
LFGKGSLLTCA

SEQ ID NO: 122423 - protein, 11 aa, Dengue virus
FGKGSLLTCAK

SEQ ID NO: 122424 - protein, 11 aa, Dengue virus
GKGSLLTCAKF

SEQ ID NO: 122425 - protein, 11 aa, Dengue virus
TPHSGEENAVG

SEQ ID NO: 122426 - protein, 11 aa, Dengue virus
PHSGEENAVGN

SEQ ID NO: 122427 - protein, 11 aa, Dengue virus
HNGDTHAVGND

SEQ ID NO: 122428 - protein, 11 aa, Dengue virus
LTLDCEPRSGI

SEQ ID NO: 122429 - protein, 11 aa, Dengue virus
TLDCEPRSGID

SEQ ID NO: 122430 - protein, 11 aa, Dengue virus
LDCEPRSGIDF

SEQ ID NO: 122431 - protein, 11 aa, Dengue virus
PRTSLDFNEMV

SEQ ID NO: 122432 - protein, 11 aa, Dengue virus
RTSLDFNEMVL

SEQ ID NO: 122433 - protein, 11 aa, Dengue virus
TSLDFNEMVLL

SEQ ID NO: 122434 - protein, 11 aa, Dengue virus
GIDFNEMILMK

SEQ ID NO: 122435 - protein, 11 aa, Dengue virus
IDFNEMILMKM

SEQ ID NO: 122436 - protein, 11 aa, Dengue virus
KTWLVHKQWFL

SEQ ID NO: 122437 - protein, 11 aa, Dengue virus
TWLVHKQWFLD

SEQ ID NO: 122438 - protein, 11 aa, Dengue virus
QWFFDLPLPWA

SEQ ID NO: 122439 - protein, 11 aa, Dengue virus
KDLLVTFKTAH

SEQ ID NO: 122440 - protein, 11 aa, Dengue virus
ERMVTFKVPHA

SEQ ID NO: 122441 - protein, 11 aa, Dengue virus
RMVTFKVPHAK

SEQ ID NO: 122442 - protein, 11 aa, Dengue virus
MVTFKVPHAKR

SEQ ID NO: 122443 - protein, 11 aa, Dengue virus
VTFKVPHAKRQ

SEQ ID NO: 122444 - protein, 11 aa, Dengue virus
TFKVPHAKRQD

SEQ ID NO: 122445 - protein, 11 aa, Dengue virus
FKVPHAKRQDV

SEQ ID NO: 122446 - protein, 11 aa, Dengue virus
KVPHAKRQDVT

SEQ ID NO: 122447 - protein, 11 aa, Dengue virus
VPHAKRQDVTV

SEQ ID NO: 122448 - protein, 11 aa, Dengue virus
SALAGATEVDS

SEQ ID NO: 122449 - protein, 11 aa, Dengue virus
ALAGATEVDSG

SEQ ID NO: 122450 - protein, 11 aa, Dengue virus
DGNHMFAGHLK

SEQ ID NO: 122451 - protein, 11 aa, Dengue virus
GNHMFAGHLKC

SEQ ID NO: 122452 - protein, 11 aa, Dengue virus
NHMFAGHLKCK

SEQ ID NO: 122453 - protein, 11 aa, Dengue virus
HMFAGHLKCKV

SEQ ID NO: 122454 - protein, 11 aa, Dengue virus
MGHLKCRLRMD

SEQ ID NO: 122455 - protein, 11 aa, Dengue virus
LKCKVRMEKLR

SEQ ID NO: 122456 - protein, 11 aa, Dengue virus
KCKVRMEKLRI

SEQ ID NO: 122457 - protein, 11 aa, Dengue virus
CKVRMEKLRIK

SEQ ID NO: 122458 - protein, 11 aa, Dengue virus
KVRMEKLRIKG

SEQ ID NO: 122459 - protein, 11 aa, Dengue virus
DKEMAETQHGT

SEQ ID NO: 122460 - protein, 11 aa, Dengue virus
KEMAETQHGTT

SEQ ID NO: 122461 - protein, 11 aa, Dengue virus
EMAETQHGTTV

SEQ ID NO: 122462 - protein, 11 aa, Dengue virus
MAETQHGTTVV

SEQ ID NO: 122463 - protein, 11 aa, Dengue virus
AETQHGTTVVK

SEQ ID NO: 122464 - protein, 11 aa, Dengue virus
PINIEAEPPFG

SEQ ID NO: 122465 - protein, 11 aa, Dengue virus
TNIELEPPFGD

SEQ ID NO: 122466 - protein, 11 aa, Dengue virus
NIELEPPFGDS

SEQ ID NO: 122467 - protein, 11 aa, Dengue virus
IETEPPFGESY

SEQ ID NO: 122468 - protein, 11 aa, Dengue virus
ETEPPFGESYI

SEQ ID NO: 122469 - protein, 11 aa, Dengue virus
GSSIGQMIETT

SEQ ID NO: 122470 - protein, 11 aa, Dengue virus
IGQMIETTMRG

SEQ ID NO: 122471 - protein, 11 aa, Dengue virus
GQMIETTMRGA

SEQ ID NO: 122472 - protein, 11 aa, Dengue virus
QMIETTMRGAK

SEQ ID NO: 122473 - protein, 11 aa, Dengue virus
MIETTMRGAKR

SEQ ID NO: 122474 - protein, 11 aa, Dengue virus
IETTMRGAKRM

SEQ ID NO: 122475 - protein, 11 aa, Dengue virus
LGETAWDFGSV

SEQ ID NO: 122476 - protein, 11 aa, Dengue virus
GETAWDFGSVG

SEQ ID NO: 122477 - protein, 11 aa, Dengue virus
ETAWDFGSVGG

SEQ ID NO: 122478 - protein, 11 aa, Dengue virus
TAWDFGSVGGL

SEQ ID NO: 122479 - protein, 11 aa, Dengue virus
VYTTMFGGVSW

SEQ ID NO: 122480 - protein, 11 aa, Dengue virus
SKELKCGSGIF

SEQ ID NO: 122481 - protein, 11 aa, Dengue virus
KELKCGNGIFV

SEQ ID NO: 122482 - protein, 11 aa, Dengue virus
ELKCGNGIFVT

SEQ ID NO: 122483 - protein, 11 aa, Dengue virus
LKCGSGIFVTD

SEQ ID NO: 122484 - protein, 11 aa, Dengue virus
KCGSGIFVTDN

SEQ ID NO: 122485 - protein, 11 aa, Dengue virus
CGSGIFVTDNV

SEQ ID NO: 122486 - protein, 11 aa, Dengue virus
GSGIFVTDNVH

SEQ ID NO: 122487 - protein, 11 aa, Dengue virus
SGIFVTDNVHT

SEQ ID NO: 122488 - protein, 11 aa, Dengue virus
GIFVTDNVHTW

SEQ ID NO: 122489 - protein, 11 aa, Dengue virus
IFVTDNVHTWT

SEQ ID NO: 122490 - protein, 11 aa, Dengue virus
FVTDNVHTWTE

SEQ ID NO: 122491 - protein, 11 aa, Dengue virus
VTDNVHTWTEQ

SEQ ID NO: 122492 - protein, 11 aa, Dengue virus
QYKFQPDSPSK

SEQ ID NO: 122493 - protein, 11 aa, Dengue virus
YKFQPDSPSKL

SEQ ID NO: 122494 - protein, 11 aa, Dengue virus
KFQPESPARLA

SEQ ID NO: 122495 - protein, 11 aa, Dengue virus
FQPESPARLAS

SEQ ID NO: 122496 - protein, 11 aa, Dengue virus
QPESPARLASA

SEQ ID NO: 122497 - protein, 11 aa, Dengue virus
PESPARLASAI

SEQ ID NO: 122498 - protein, 11 aa, Dengue virus
ESPARLASAIL

SEQ ID NO: 122499 - protein, 11 aa, Dengue virus
SPARLASAILN

SEQ ID NO: 122500 - protein, 11 aa, Dengue virus
PARLASAILNA

SEQ ID NO: 122501 - protein, 11 aa, Dengue virus
GVCGIRSTTRL

SEQ ID NO: 122502 - protein, 11 aa, Dengue virus
VCGIRSTTRLE

SEQ ID NO: 122503 - protein, 11 aa, Dengue virus
CGIRSTTRLEN

SEQ ID NO: 122504 - protein, 11 aa, Dengue virus
GIRSTTRLENV

SEQ ID NO: 122505 - protein, 11 aa, Dengue virus
IRSTTRLENVM

SEQ ID NO: 122506 - protein, 11 aa, Dengue virus
RSTTRLENVMW

SEQ ID NO: 122507 - protein, 11 aa, Dengue virus
TRLENVMWKQI

SEQ ID NO: 122508 - protein, 11 aa, Dengue virus
RAWNSFEVEDY

SEQ ID NO: 122509 - protein, 11 aa, Dengue virus
AWNSFEVEDYG

SEQ ID NO: 122510 - protein, 11 aa, Dengue virus
WNSFEVEDYGF

SEQ ID NO: 122511 - protein, 11 aa, Dengue virus
NSFEVEDYGFG

SEQ ID NO: 122512 - protein, 11 aa, Dengue virus
LEVEDYGFGMF

SEQ ID NO: 122513 - protein, 11 aa, Dengue virus
EVEDYGFGVFS

SEQ ID NO: 122514 - protein, 11 aa, Dengue virus
VEDYGFGVFST

SEQ ID NO: 122515 - protein, 11 aa, Dengue virus
EDYGFGVFSTN

SEQ ID NO: 122516 - protein, 11 aa, Dengue virus
DYGFGVFSTNI

SEQ ID NO: 122517 - protein, 11 aa, Dengue virus
YGFGVFSTNIW

SEQ ID NO: 122518 - protein, 11 aa, Dengue virus
GFGVFSTNIWL

SEQ ID NO: 122519 - protein, 11 aa, Dengue virus
FGVFSTNIWLK

SEQ ID NO: 122520 - protein, 11 aa, Dengue virus
CDSKLMSAAVK

SEQ ID NO: 122521 - protein, 11 aa, Dengue virus
DSKLMSAAVKD

SEQ ID NO: 122522 - protein, 11 aa, Dengue virus
KDQKAVHADMG

SEQ ID NO: 122523 - protein, 11 aa, Dengue virus
DQKAVHADMGY

SEQ ID NO: 122524 - protein, 11 aa, Dengue virus
QKAVHADMGYW

SEQ ID NO: 122525 - protein, 11 aa, Dengue virus
HADMGYWIESS

SEQ ID NO: 122526 - protein, 11 aa, Dengue virus
ADMGYWIESSK

SEQ ID NO: 122527 - protein, 11 aa, Dengue virus
DMGYWIESSKN

SEQ ID NO: 122528 - protein, 11 aa, Dengue virus
WSNGVLESEMV

SEQ ID NO: 122529 - protein, 11 aa, Dengue virus
SNGVLESEMVI

SEQ ID NO: 122530 - protein, 11 aa, Dengue virus
NGVLESEMVIP

SEQ ID NO: 122531 - protein, 11 aa, Dengue virus
GVLESEMVIPK

SEQ ID NO: 122532 - protein, 11 aa, Dengue virus
TQAAGPWHLGK

SEQ ID NO: 122533 - protein, 11 aa, Dengue virus
QAAGPWHLGKL

SEQ ID NO: 122534 - protein, 11 aa, Dengue virus
AGPWHLGRLEM

SEQ ID NO: 122535 - protein, 11 aa, Dengue virus
GPWHLGRLEMD

SEQ ID NO: 122536 - protein, 11 aa, Dengue virus
PWHLGRLEMDF

SEQ ID NO: 122537 - protein, 11 aa, Dengue virus
CGSRGPSLRTT

SEQ ID NO: 122538 - protein, 11 aa, Dengue virus
GSRGPSLRTTT

SEQ ID NO: 122539 - protein, 11 aa, Dengue virus
LRTTTASGKLV

SEQ ID NO: 122540 - protein, 11 aa, Dengue virus
RTTTASGKLVT

SEQ ID NO: 122541 - protein, 11 aa, Dengue virus
TTTASGKLVTQ

SEQ ID NO: 122542 - protein, 11 aa, Dengue virus
TTASGKLVTQW

SEQ ID NO: 122543 - protein, 11 aa, Dengue virus
TASGKLVTQWC

SEQ ID NO: 122544 - protein, 11 aa, Dengue virus
ASGKLVTQWCC

SEQ ID NO: 122545 - protein, 11 aa, Dengue virus
SGKLVTQWCCR

SEQ ID NO: 122546 - protein, 11 aa, Dengue virus
GKLVTQWCCRS

SEQ ID NO: 122547 - protein, 11 aa, Dengue virus
KLVTQWCCRSC

SEQ ID NO: 122548 - protein, 11 aa, Dengue virus
LVTQWCCRSCT

SEQ ID NO: 122549 - protein, 11 aa, Dengue virus
RSCTLPPLRFK

SEQ ID NO: 122550 - protein, 11 aa, Dengue virus
SCTLPPLRFKG

SEQ ID NO: 122551 - protein, 11 aa, Dengue virus
CTLPPLRFKGE

SEQ ID NO: 122552 - protein, 11 aa, Dengue virus
TLPPLRFKGED

SEQ ID NO: 122553 - protein, 11 aa, Dengue virus
LPPLRFKGEDG

SEQ ID NO: 122554 - protein, 11 aa, Dengue virus
PPLRFKGEDGC

SEQ ID NO: 122555 - protein, 11 aa, Dengue virus
PLRFKGEDGCW

SEQ ID NO: 122556 - protein, 11 aa, Dengue virus
LRFKGEDGCWY

SEQ ID NO: 122557 - protein, 11 aa, Dengue virus
RFKGEDGCWYG

SEQ ID NO: 122558 - protein, 11 aa, Dengue virus
FKGEDGCWYGM

SEQ ID NO: 122559 - protein, 11 aa, Dengue virus
LGEDGCWYGME

SEQ ID NO: 122560 - protein, 11 aa, Dengue virus
ELIDGISLGLI

SEQ ID NO: 122561 - protein, 11 aa, Dengue virus
RSWPLNEGIMA

SEQ ID NO: 122562 - protein, 11 aa, Dengue virus
SWPLNEGIMAI

SEQ ID NO: 122563 - protein, 11 aa, Dengue virus
WPLNEGIMAIG

SEQ ID NO: 122564 - protein, 11 aa, Dengue virus
VSLLGSALLKN

SEQ ID NO: 122565 - protein, 11 aa, Dengue virus
SLLGSALLKND

SEQ ID NO: 122566 - protein, 11 aa, Dengue virus
LLGSALLKNDV

SEQ ID NO: 122567 - protein, 11 aa, Dengue virus
LGSALLKNDVP

SEQ ID NO: 122568 - protein, 11 aa, Dengue virus
GSALLKNDVPL

SEQ ID NO: 122569 - protein, 11 aa, Dengue virus
SALLKNDVPLA

SEQ ID NO: 122570 - protein, 11 aa, Dengue virus
ALLKNDVPLAG

SEQ ID NO: 122571 - protein, 11 aa, Dengue virus
LKNDVPLAGPM

SEQ ID NO: 122572 - protein, 11 aa, Dengue virus
KNDVPLAGPMV

SEQ ID NO: 122573 - protein, 11 aa, Dengue virus
NDVPLAGPMVA

SEQ ID NO: 122574 - protein, 11 aa, Dengue virus
DVPLAGPMVAG

SEQ ID NO: 122575 - protein, 11 aa, Dengue virus
VPLAGPMVAGG

SEQ ID NO: 122576 - protein, 11 aa, Dengue virus
PLAGPMVAGGL

SEQ ID NO: 122577 - protein, 11 aa, Dengue virus
LAGPMVAGGLL

SEQ ID NO: 122578 - protein, 11 aa, Dengue virus
AGPMVAGGLLL

SEQ ID NO: 122579 - protein, 11 aa, Dengue virus
GPMVAGGLLLA

SEQ ID NO: 122580 - protein, 11 aa, Dengue virus
PMVAGGLLLAA

SEQ ID NO: 122581 - protein, 11 aa, Dengue virus
MVAGGLLLAAY

SEQ ID NO: 122582 - protein, 11 aa, Dengue virus
VAGGLLLAAYV

SEQ ID NO: 122583 - protein, 11 aa, Dengue virus
AGGLLLAAYVM

SEQ ID NO: 122584 - protein, 11 aa, Dengue virus
GGLLLAAYVMS

SEQ ID NO: 122585 - protein, 11 aa, Dengue virus
GLLLAAYVMSG

SEQ ID NO: 122586 - protein, 11 aa, Dengue virus
LLLAAYVMSGS

SEQ ID NO: 122587 - protein, 11 aa, Dengue virus
LLAAYVMSGSS

SEQ ID NO: 122588 - protein, 11 aa, Dengue virus
LAAYVMSGSSA

SEQ ID NO: 122589 - protein, 11 aa, Dengue virus
AAYVMSGSSAD

SEQ ID NO: 122590 - protein, 11 aa, Dengue virus
AYVMSGSSADL

SEQ ID NO: 122591 - protein, 11 aa, Dengue virus
YVMSGSSADLS

SEQ ID NO: 122592 - protein, 11 aa, Dengue virus
VMSGSSADLSL

SEQ ID NO: 122593 - protein, 11 aa, Dengue virus
MSGSSADLSLE

SEQ ID NO: 122594 - protein, 11 aa, Dengue virus
TGRSADLELEK

SEQ ID NO: 122595 - protein, 11 aa, Dengue virus
EAEHSGTSHNI

SEQ ID NO: 122596 - protein, 11 aa, Dengue virus
AEHSGTSHNIL

SEQ ID NO: 122597 - protein, 11 aa, Dengue virus
DEDGSFSIRDV

SEQ ID NO: 122598 - protein, 11 aa, Dengue virus
EDGSFSIRDVE

SEQ ID NO: 122599 - protein, 11 aa, Dengue virus
DGSFSIRDVEE

SEQ ID NO: 122600 - protein, 11 aa, Dengue virus
GSFSIRDVEET

SEQ ID NO: 122601 - protein, 11 aa, Dengue virus
ITLLVKLALIT

SEQ ID NO: 122602 - protein, 11 aa, Dengue virus
TLLVKLALITV

SEQ ID NO: 122603 - protein, 11 aa, Dengue virus
LLVKLALITVS

SEQ ID NO: 122604 - protein, 11 aa, Dengue virus
LVKLALITVSG

SEQ ID NO: 122605 - protein, 11 aa, Dengue virus
KTQRSGALWDV

SEQ ID NO: 122606 - protein, 11 aa, Dengue virus
TQRSGALWDVP

SEQ ID NO: 122607 - protein, 11 aa, Dengue virus
QRSGALWDVPS

SEQ ID NO: 122608 - protein, 11 aa, Dengue virus
RSGALWDVPSP

SEQ ID NO: 122609 - protein, 11 aa, Dengue virus
SGALWDVPSPA

SEQ ID NO: 122610 - protein, 11 aa, Dengue virus
GALWDVPSPAA

SEQ ID NO: 122611 - protein, 11 aa, Dengue virus
GKTQVGVGIHM

SEQ ID NO: 122612 - protein, 11 aa, Dengue virus
DGVFHTMWHVT

SEQ ID NO: 122613 - protein, 11 aa, Dengue virus
WHVTRGAVLTH

SEQ ID NO: 122614 - protein, 11 aa, Dengue virus
TGRLEPSWADV

SEQ ID NO: 122615 - protein, 11 aa, Dengue virus
GRLEPSWADVR

SEQ ID NO: 122616 - protein, 11 aa, Dengue virus
RLEPSWADVRN

SEQ ID NO: 122617 - protein, 11 aa, Dengue virus
LEPSWADVRND

SEQ ID NO: 122618 - protein, 11 aa, Dengue virus
EPSWADVRNDM

SEQ ID NO: 122619 - protein, 11 aa, Dengue virus
WANVKKDLISY

SEQ ID NO: 122620 - protein, 11 aa, Dengue virus
ANVKKDLISYG

SEQ ID NO: 122621 - protein, 11 aa, Dengue virus
NVKKDLISYGG

SEQ ID NO: 122622 - protein, 11 aa, Dengue virus
DMISYGGGWRL

SEQ ID NO: 122623 - protein, 11 aa, Dengue virus
WDKEEDVQVLA

SEQ ID NO: 122624 - protein, 11 aa, Dengue virus
KEEDVQVLAIE

SEQ ID NO: 122625 - protein, 11 aa, Dengue virus
AIEPGKNPKHV

SEQ ID NO: 122626 - protein, 11 aa, Dengue virus
IEPGKNPKHVQ

SEQ ID NO: 122627 - protein, 11 aa, Dengue virus
EPGKNPKHVQT

SEQ ID NO: 122628 - protein, 11 aa, Dengue virus
TGEIGAVTLDF

SEQ ID NO: 122629 - protein, 11 aa, Dengue virus
GEIGAVTLDFK

SEQ ID NO: 122630 - protein, 11 aa, Dengue virus
EIGAVTLDFKP

SEQ ID NO: 122631 - protein, 11 aa, Dengue virus
IGAVTLDFKPG

SEQ ID NO: 122632 - protein, 11 aa, Dengue virus
FSPGTSGSPII

SEQ ID NO: 122633 - protein, 11 aa, Dengue virus
SPGTSGSPIID

SEQ ID NO: 122634 - protein, 11 aa, Dengue virus
PGTSGSPIIDK

SEQ ID NO: 122635 - protein, 11 aa, Dengue virus
KGKVIGLYGNG

SEQ ID NO: 122636 - protein, 11 aa, Dengue virus
IGLYGNGVVTK

SEQ ID NO: 122637 - protein, 11 aa, Dengue virus
GLYGNGVVTKS

SEQ ID NO: 122638 - protein, 11 aa, Dengue virus
LYGNGVVTKSG

SEQ ID NO: 122639 - protein, 11 aa, Dengue virus
YGNGVVTKSGD

SEQ ID NO: 122640 - protein, 11 aa, Dengue virus
GNGVVTKSGDY

SEQ ID NO: 122641 - protein, 11 aa, Dengue virus
NGVVTKSGDYV

SEQ ID NO: 122642 - protein, 11 aa, Dengue virus
GVVTKSGDYVS

SEQ ID NO: 122643 - protein, 11 aa, Dengue virus
IFRKRRLTIMD

SEQ ID NO: 122644 - protein, 11 aa, Dengue virus
FRKRRLTIMDL

SEQ ID NO: 122645 - protein, 11 aa, Dengue virus
RKRRLTIMDLH

SEQ ID NO: 122646 - protein, 11 aa, Dengue virus
LHPGAGKTKRI

SEQ ID NO: 122647 - protein, 11 aa, Dengue virus
HPGAGKTKRIL

SEQ ID NO: 122648 - protein, 11 aa, Dengue virus
PGAGKTKRILP

SEQ ID NO: 122649 - protein, 11 aa, Dengue virus
GAGKTKRILPS

SEQ ID NO: 122650 - protein, 11 aa, Dengue virus
AGKTKRILPSI

SEQ ID NO: 122651 - protein, 11 aa, Dengue virus
KYLPAIIREAI

SEQ ID NO: 122652 - protein, 11 aa, Dengue virus
YLPAIVREAIR

SEQ ID NO: 122653 - protein, 11 aa, Dengue virus
LPAMVREAIKR

SEQ ID NO: 122654 - protein, 11 aa, Dengue virus
REALKRRLRTL

SEQ ID NO: 122655 - protein, 11 aa, Dengue virus
KRKLRTLVLAP

SEQ ID NO: 122656 - protein, 11 aa, Dengue virus
RKLRTLVLAPT

SEQ ID NO: 122657 - protein, 11 aa, Dengue virus
KLRTLVLAPTR

SEQ ID NO: 122658 - protein, 11 aa, Dengue virus
LRGLPIRYQTT

SEQ ID NO: 122659 - protein, 11 aa, Dengue virus
RGLPIRYQTTA

SEQ ID NO: 122660 - protein, 11 aa, Dengue virus
GLPIRYQTPAV

SEQ ID NO: 122661 - protein, 11 aa, Dengue virus
KTEHTGREIVD

SEQ ID NO: 122662 - protein, 11 aa, Dengue virus
TEHTGREIVDL

SEQ ID NO: 122663 - protein, 11 aa, Dengue virus
LSPIRVPNYNL

SEQ ID NO: 122664 - protein, 11 aa, Dengue virus
SPIRVPNYNLI

SEQ ID NO: 122665 - protein, 11 aa, Dengue virus
PIRVPNYNLII

SEQ ID NO: 122666 - protein, 11 aa, Dengue virus
IRVPNYNLIIM

SEQ ID NO: 122667 - protein, 11 aa, Dengue virus
RVPNYNLVIMD

SEQ ID NO: 122668 - protein, 11 aa, Dengue virus
VPNYNLVIMDE

SEQ ID NO: 122669 - protein, 11 aa, Dengue virus
PNYNLVIMDEA

SEQ ID NO: 122670 - protein, 11 aa, Dengue virus
NYNLVIMDEAH

SEQ ID NO: 122671 - protein, 11 aa, Dengue virus
YNLVIMDEAHF

SEQ ID NO: 122672 - protein, 11 aa, Dengue virus
NLVIMDEAHFT

SEQ ID NO: 122673 - protein, 11 aa, Dengue virus
LVIMDEAHFTD

SEQ ID NO: 122674 - protein, 11 aa, Dengue virus
VMDEAHFTDPA

SEQ ID NO: 122675 - protein, 11 aa, Dengue virus
AIFMTATPPGA

SEQ ID NO: 122676 - protein, 11 aa, Dengue virus
IEDIEREIPER

SEQ ID NO: 122677 - protein, 11 aa, Dengue virus
EDIEREIPERS

SEQ ID NO: 122678 - protein, 11 aa, Dengue virus
DEEKDIPERSW

SEQ ID NO: 122679 - protein, 11 aa, Dengue virus
EEKDIPERSWN

SEQ ID NO: 122680 - protein, 11 aa, Dengue virus
EKDIPERSWNS

SEQ ID NO: 122681 - protein, 11 aa, Dengue virus
KDIPERSWNSG

SEQ ID NO: 122682 - protein, 11 aa, Dengue virus
FVGKTVWFVPS

SEQ ID NO: 122683 - protein, 11 aa, Dengue virus
VGKTVWFVPSI

SEQ ID NO: 122684 - protein, 11 aa, Dengue virus
PSIKTGNDIAA

SEQ ID NO: 122685 - protein, 11 aa, Dengue virus
SIKTGNDIAAC

SEQ ID NO: 122686 - protein, 11 aa, Dengue virus
IKTGNDIAACL

SEQ ID NO: 122687 - protein, 11 aa, Dengue virus
KTGNDIAACLR

SEQ ID NO: 122688 - protein, 11 aa, Dengue virus
IANCLRKSGKK

SEQ ID NO: 122689 - protein, 11 aa, Dengue virus
ANCLRKSGKKV

SEQ ID NO: 122690 - protein, 11 aa, Dengue virus
CLRKNGKRVVQ

SEQ ID NO: 122691 - protein, 11 aa, Dengue virus
LRKNGKRVVQL

SEQ ID NO: 122692 - protein, 11 aa, Dengue virus
RKNGKRVVQLS

SEQ ID NO: 122693 - protein, 11 aa, Dengue virus
KNGKRVVQLSR

SEQ ID NO: 122694 - protein, 11 aa, Dengue virus
NGKRVVQLSRK

SEQ ID NO: 122695 - protein, 11 aa, Dengue virus
LSRKTFDSEYI

SEQ ID NO: 122696 - protein, 11 aa, Dengue virus
SRKTFDSEYIK

SEQ ID NO: 122697 - protein, 11 aa, Dengue virus
ANDWDFVVTTD

SEQ ID NO: 122698 - protein, 11 aa, Dengue virus
ISEMGANFRAG

SEQ ID NO: 122699 - protein, 11 aa, Dengue virus
SEMGANFRAGR

SEQ ID NO: 122700 - protein, 11 aa, Dengue virus
EMGANFRAGRV

SEQ ID NO: 122701 - protein, 11 aa, Dengue virus
MGANFRAGRVI

SEQ ID NO: 122702 - protein, 11 aa, Dengue virus
GANFRAGRVID

SEQ ID NO: 122703 - protein, 11 aa, Dengue virus
ANFRAGRVIDP

SEQ ID NO: 122704 - protein, 11 aa, Dengue virus
NFRAGRVIDPR

SEQ ID NO: 122705 - protein, 11 aa, Dengue virus
FRAGRVIDPRR

SEQ ID NO: 122706 - protein, 11 aa, Dengue virus
RAGRVIDPRRC

SEQ ID NO: 122707 - protein, 11 aa, Dengue virus
RCLKPVILPDG

SEQ ID NO: 122708 - protein, 11 aa, Dengue virus
CLKPVILPDGP

SEQ ID NO: 122709 - protein, 11 aa, Dengue virus
LKPVILPDGPE

SEQ ID NO: 122710 - protein, 11 aa, Dengue virus
KPVILPDGPER

SEQ ID NO: 122711 - protein, 11 aa, Dengue virus
PVILPDGPERV

SEQ ID NO: 122712 - protein, 11 aa, Dengue virus
VILTDGEERVV

SEQ ID NO: 122713 - protein, 11 aa, Dengue virus
ILTDGEERVVL

SEQ ID NO: 122714 - protein, 11 aa, Dengue virus
LTDGEERVVLA

SEQ ID NO: 122715 - protein, 11 aa, Dengue virus
TDGEERVVLAG

SEQ ID NO: 122716 - protein, 11 aa, Dengue virus
VILAGPIPVTP

SEQ ID NO: 122717 - protein, 11 aa, Dengue virus
ILAGPIPVTPA

SEQ ID NO: 122718 - protein, 11 aa, Dengue virus
LAGPIPVTPAS

SEQ ID NO: 122719 - protein, 11 aa, Dengue virus
AGPIPVTPASA

SEQ ID NO: 122720 - protein, 11 aa, Dengue virus
GPIPVTPASAA

SEQ ID NO: 122721 - protein, 11 aa, Dengue virus
PIPVTPASAAQ

SEQ ID NO: 122722 - protein, 11 aa, Dengue virus
IPVTPASAAQR

SEQ ID NO: 122723 - protein, 11 aa, Dengue virus
PVTPASAAQRR

SEQ ID NO: 122724 - protein, 11 aa, Dengue virus
VTPASAAQRRG

SEQ ID NO: 122725 - protein, 11 aa, Dengue virus
TPASAAQRRGR

SEQ ID NO: 122726 - protein, 11 aa, Dengue virus
SSAAQRRGRVG

SEQ ID NO: 122727 - protein, 11 aa, Dengue virus
AQRRGRIGRNQ

SEQ ID NO: 122728 - protein, 11 aa, Dengue virus
KEGDQYVYMGQ

SEQ ID NO: 122729 - protein, 11 aa, Dengue virus
EGDQYVYMGQP

SEQ ID NO: 122730 - protein, 11 aa, Dengue virus
GDQYVYMGQPL

SEQ ID NO: 122731 - protein, 11 aa, Dengue virus
FSGDPLKNDED

SEQ ID NO: 122732 - protein, 11 aa, Dengue virus
SGDPLKNDEDH

SEQ ID NO: 122733 - protein, 11 aa, Dengue virus
FEPEREKSAAV

SEQ ID NO: 122734 - protein, 11 aa, Dengue virus
EPEREKSAAVD

SEQ ID NO: 122735 - protein, 11 aa, Dengue virus
PEREKSAAVDG

SEQ ID NO: 122736 - protein, 11 aa, Dengue virus
EREKSAAVDGE

SEQ ID NO: 122737 - protein, 11 aa, Dengue virus
REKSAAVDGEY

SEQ ID NO: 122738 - protein, 11 aa, Dengue virus
EKSAAVDGEYR

SEQ ID NO: 122739 - protein, 11 aa, Dengue virus
KSAAVDGEYRL

SEQ ID NO: 122740 - protein, 11 aa, Dengue virus
TQAIDGEFRLR

SEQ ID NO: 122741 - protein, 11 aa, Dengue virus
QAIDGEFRLRG

SEQ ID NO: 122742 - protein, 11 aa, Dengue virus
AVDGEYRLRGE

SEQ ID NO: 122743 - protein, 11 aa, Dengue virus
VDGEYRLRGEA

SEQ ID NO: 122744 - protein, 11 aa, Dengue virus
LRGEQRKTFVE

SEQ ID NO: 122745 - protein, 11 aa, Dengue virus
RGEQRKTFVEL

SEQ ID NO: 122746 - protein, 11 aa, Dengue virus
GEQRKTFVELM

SEQ ID NO: 122747 - protein, 11 aa, Dengue virus
EQRKTFVELMR

SEQ ID NO: 122748 - protein, 11 aa, Dengue virus
QRKTFVELMRR

SEQ ID NO: 122749 - protein, 11 aa, Dengue virus
RRGDLPVWLSH

SEQ ID NO: 122750 - protein, 11 aa, Dengue virus
RGDLPVWLAYR

SEQ ID NO: 122751 - protein, 11 aa, Dengue virus
GDLPVWLAYRV

SEQ ID NO: 122752 - protein, 11 aa, Dengue virus
DLPVWLAYRVA

SEQ ID NO: 122753 - protein, 11 aa, Dengue virus
LPVWLAYRVAA

SEQ ID NO: 122754 - protein, 11 aa, Dengue virus
NNQILEENMEV

SEQ ID NO: 122755 - protein, 11 aa, Dengue virus
NQILEENMEVE

SEQ ID NO: 122756 - protein, 11 aa, Dengue virus
QILEENMEVEI

SEQ ID NO: 122757 - protein, 11 aa, Dengue virus
ILEENMEVEIW

SEQ ID NO: 122758 - protein, 11 aa, Dengue virus
LEENMEVEVWT

SEQ ID NO: 122759 - protein, 11 aa, Dengue virus
EENMEVEIWTR

SEQ ID NO: 122760 - protein, 11 aa, Dengue virus
ENMEVEIWTRE

SEQ ID NO: 122761 - protein, 11 aa, Dengue virus
NMEVEIWTREG

SEQ ID NO: 122762 - protein, 11 aa, Dengue virus
EKKKLRPKWLD

SEQ ID NO: 122763 - protein, 11 aa, Dengue virus
KKKLRPKWLDA

SEQ ID NO: 122764 - protein, 11 aa, Dengue virus
KLRPKWLDARV

SEQ ID NO: 122765 - protein, 11 aa, Dengue virus
LRPKWLDARVY

SEQ ID NO: 122766 - protein, 11 aa, Dengue virus
RPKWLDARVYA

SEQ ID NO: 122767 - protein, 11 aa, Dengue virus
PKWLDARVYAD

SEQ ID NO: 122768 - protein, 11 aa, Dengue virus
KWLDARVYADP

SEQ ID NO: 122769 - protein, 11 aa, Dengue virus
ARVYADPMALK

SEQ ID NO: 122770 - protein, 11 aa, Dengue virus
RVYADPMALKD

SEQ ID NO: 122771 - protein, 11 aa, Dengue virus
VYADPMALKDF

SEQ ID NO: 122772 - protein, 11 aa, Dengue virus
ADPMALKDFKE

SEQ ID NO: 122773 - protein, 11 aa, Dengue virus
DPMALKDFKEF

SEQ ID NO: 122774 - protein, 11 aa, Dengue virus
PMALKDFKEFA

SEQ ID NO: 122775 - protein, 11 aa, Dengue virus
MALKDFKEFAS

SEQ ID NO: 122776 - protein, 11 aa, Dengue virus
ALKDFKEFASG

SEQ ID NO: 122777 - protein, 11 aa, Dengue virus
LKDFKEFASGR

SEQ ID NO: 122778 - protein, 11 aa, Dengue virus
KDFKEFASGRK

SEQ ID NO: 122779 - protein, 11 aa, Dengue virus
DFKEFASGRKS

SEQ ID NO: 122780 - protein, 11 aa, Dengue virus
FKEFASGRKSI

SEQ ID NO: 122781 - protein, 11 aa, Dengue virus
RNALDNLAVLH

SEQ ID NO: 122782 - protein, 11 aa, Dengue virus
ALDNIVMLHTT

SEQ ID NO: 122783 - protein, 11 aa, Dengue virus
LDNIVMLHTTE

SEQ ID NO: 122784 - protein, 11 aa, Dengue virus
AYQHALNELPE

SEQ ID NO: 122785 - protein, 11 aa, Dengue virus
YQHALNELPES

SEQ ID NO: 122786 - protein, 11 aa, Dengue virus
QHALNELPESL

SEQ ID NO: 122787 - protein, 11 aa, Dengue virus
HALNELPESLE

SEQ ID NO: 122788 - protein, 11 aa, Dengue virus
ALNELPESLET

SEQ ID NO: 122789 - protein, 11 aa, Dengue virus
LNELPESLETL

SEQ ID NO: 122790 - protein, 11 aa, Dengue virus
NELPESLETLM

SEQ ID NO: 122791 - protein, 11 aa, Dengue virus
ELPESLETLML

SEQ ID NO: 122792 - protein, 11 aa, Dengue virus
LPESLETLMLV

SEQ ID NO: 122793 - protein, 11 aa, Dengue virus
PESLETLMLVA

SEQ ID NO: 122794 - protein, 11 aa, Dengue virus
ESLETLMLVAL

SEQ ID NO: 122795 - protein, 11 aa, Dengue virus
SLETLMLVALL

SEQ ID NO: 122796 - protein, 11 aa, Dengue virus
LETLMLVALLG

SEQ ID NO: 122797 - protein, 11 aa, Dengue virus
VPLQWIASAIV

SEQ ID NO: 122798 - protein, 11 aa, Dengue virus
QPQWIAASIIL

SEQ ID NO: 122799 - protein, 11 aa, Dengue virus
FLMVLLIPEPE

SEQ ID NO: 122800 - protein, 11 aa, Dengue virus
LMVLLIPEPEK

SEQ ID NO: 122801 - protein, 11 aa, Dengue virus
KQRTPQDNQLI

SEQ ID NO: 122802 - protein, 11 aa, Dengue virus
QDNQLTYVIIA

SEQ ID NO: 122803 - protein, 11 aa, Dengue virus
DNQLIYVILTI

SEQ ID NO: 122804 - protein, 11 aa, Dengue virus
NQLIYVILTIL

SEQ ID NO: 122805 - protein, 11 aa, Dengue virus
QLIYVILTILT

SEQ ID NO: 122806 - protein, 11 aa, Dengue virus
IAANEMGLIEK

SEQ ID NO: 122807 - protein, 11 aa, Dengue virus
NEMGLIEKTKT

SEQ ID NO: 122808 - protein, 11 aa, Dengue virus
EMGLIEKTKTD

SEQ ID NO: 122809 - protein, 11 aa, Dengue virus
MGLIEKTKTDF

SEQ ID NO: 122810 - protein, 11 aa, Dengue virus
GLIEKTKTDFG

SEQ ID NO: 122811 - protein, 11 aa, Dengue virus
WTLYAVATTIL

SEQ ID NO: 122812 - protein, 11 aa, Dengue virus
TLYAVATTILT

SEQ ID NO: 122813 - protein, 11 aa, Dengue virus
LYAVATTILTP

SEQ ID NO: 122814 - protein, 11 aa, Dengue virus
YAVATTILTPM

SEQ ID NO: 122815 - protein, 11 aa, Dengue virus
LTPMLRHTIEN

SEQ ID NO: 122816 - protein, 11 aa, Dengue virus
TPMLRHTIENT

SEQ ID NO: 122817 - protein, 11 aa, Dengue virus
PMLRHTIENTS

SEQ ID NO: 122818 - protein, 11 aa, Dengue virus
MLRHTIENTSA

SEQ ID NO: 122819 - protein, 11 aa, Dengue virus
LRHTIENTSAN

SEQ ID NO: 122820 - protein, 11 aa, Dengue virus
RHTIENTSANL

SEQ ID NO: 122821 - protein, 11 aa, Dengue virus
HTIENTSANLS

SEQ ID NO: 122822 - protein, 11 aa, Dengue virus
TIENTSANLSL

SEQ ID NO: 122823 - protein, 11 aa, Dengue virus
IENTSANLSLA

SEQ ID NO: 122824 - protein, 11 aa, Dengue virus
ENTSANLSLAA

SEQ ID NO: 122825 - protein, 11 aa, Dengue virus
NTSANLSLAAI

SEQ ID NO: 122826 - protein, 11 aa, Dengue virus
TSANLSLAAIA

SEQ ID NO: 122827 - protein, 11 aa, Dengue virus
SANLSLAAIAN

SEQ ID NO: 122828 - protein, 11 aa, Dengue virus
ANLSLAAIANQ

SEQ ID NO: 122829 - protein, 11 aa, Dengue virus
NLSLAAIANQA

SEQ ID NO: 122830 - protein, 11 aa, Dengue virus
LSLAAIANQAA

SEQ ID NO: 122831 - protein, 11 aa, Dengue virus
SLAAIANQAAV

SEQ ID NO: 122832 - protein, 11 aa, Dengue virus
LAAIANQAAVL

SEQ ID NO: 122833 - protein, 11 aa, Dengue virus
AAIANQAAVLM

SEQ ID NO: 122834 - protein, 11 aa, Dengue virus
AIANQAAVLMG

SEQ ID NO: 122835 - protein, 11 aa, Dengue virus
IANQAAVLMGL

SEQ ID NO: 122836 - protein, 11 aa, Dengue virus
ANQAAVLMGLG

SEQ ID NO: 122837 - protein, 11 aa, Dengue virus
NQAAVLMGLGK

SEQ ID NO: 122838 - protein, 11 aa, Dengue virus
QAAVLMGLGKG

SEQ ID NO: 122839 - protein, 11 aa, Dengue virus
AAVLMGLGKGW

SEQ ID NO: 122840 - protein, 11 aa, Dengue virus
AVLMGLGKGWP

SEQ ID NO: 122841 - protein, 11 aa, Dengue virus
VLMGLGRGWPL

SEQ ID NO: 122842 - protein, 11 aa, Dengue virus
LMGLGRGWPLS

SEQ ID NO: 122843 - protein, 11 aa, Dengue virus
MGLGRGWPLSK

SEQ ID NO: 122844 - protein, 11 aa, Dengue virus
GLGRGWPLSKM

SEQ ID NO: 122845 - protein, 11 aa, Dengue virus
LGRGWPLSKMD

SEQ ID NO: 122846 - protein, 11 aa, Dengue virus
GKGWPLHRMDL

SEQ ID NO: 122847 - protein, 11 aa, Dengue virus
KGWPLHRMDLG

SEQ ID NO: 122848 - protein, 11 aa, Dengue virus
GWPLHRMDLGV

SEQ ID NO: 122849 - protein, 11 aa, Dengue virus
WPLHRMDLGVP

SEQ ID NO: 122850 - protein, 11 aa, Dengue virus
PLHRMDLGVPL

SEQ ID NO: 122851 - protein, 11 aa, Dengue virus
LHRMDLGVPLL

SEQ ID NO: 122852 - protein, 11 aa, Dengue virus
RMDLGVPLLAM

SEQ ID NO: 122853 - protein, 11 aa, Dengue virus
MDLGVPLLAMG

SEQ ID NO: 122854 - protein, 11 aa, Dengue virus
DLGVPLLAMGC

SEQ ID NO: 122855 - protein, 11 aa, Dengue virus
LGVPLLAMGCY

SEQ ID NO: 122856 - protein, 11 aa, Dengue virus
CYSQVNPLTLI

SEQ ID NO: 122857 - protein, 11 aa, Dengue virus
YSQVNPLTLIA

SEQ ID NO: 122858 - protein, 11 aa, Dengue virus
SQVNPLTLIAA

SEQ ID NO: 122859 - protein, 11 aa, Dengue virus
QVNPLTLIAAV

SEQ ID NO: 122860 - protein, 11 aa, Dengue virus
IMKNPTIDGIV

SEQ ID NO: 122861 - protein, 11 aa, Dengue virus
KNPTIDGIVAI

SEQ ID NO: 122862 - protein, 11 aa, Dengue virus
PISYDPKFEKQ

SEQ ID NO: 122863 - protein, 11 aa, Dengue virus
ISYDPKFEKQL

SEQ ID NO: 122864 - protein, 11 aa, Dengue virus
SYDPKFEKQLG

SEQ ID NO: 122865 - protein, 11 aa, Dengue virus
DTKFEKQLGQI

SEQ ID NO: 122866 - protein, 11 aa, Dengue virus
TKFEKQLGQIM

SEQ ID NO: 122867 - protein, 11 aa, Dengue virus
LGQVMLLVLCV

SEQ ID NO: 122868 - protein, 11 aa, Dengue virus
LCAGQLLLMRT

SEQ ID NO: 122869 - protein, 11 aa, Dengue virus
CAGQLLLMRTT

SEQ ID NO: 122870 - protein, 11 aa, Dengue virus
AGQLLLMRTTW

SEQ ID NO: 122871 - protein, 11 aa, Dengue virus
GQLLLMRTTWA

SEQ ID NO: 122872 - protein, 11 aa, Dengue virus
QLLLMRTTWAF

SEQ ID NO: 122873 - protein, 11 aa, Dengue virus
LLLMRTTWAFC

SEQ ID NO: 122874 - protein, 11 aa, Dengue virus
LLMRTTWAFCE

SEQ ID NO: 122875 - protein, 11 aa, Dengue virus
LMRTTWAFCEV

SEQ ID NO: 122876 - protein, 11 aa, Dengue virus
MRTTWAFCEVL

SEQ ID NO: 122877 - protein, 11 aa, Dengue virus
RTTWAFCEVLT

SEQ ID NO: 122878 - protein, 11 aa, Dengue virus
TTWAFCEVLTL

SEQ ID NO: 122879 - protein, 11 aa, Dengue virus
TWAFCEVLTLA

SEQ ID NO: 122880 - protein, 11 aa, Dengue virus
WAFCEALTLAT

SEQ ID NO: 122881 - protein, 11 aa, Dengue virus
AFCEALTLATG

SEQ ID NO: 122882 - protein, 11 aa, Dengue virus
FCEALTLATGP

SEQ ID NO: 122883 - protein, 11 aa, Dengue virus
CEALTLATGPV

SEQ ID NO: 122884 - protein, 11 aa, Dengue virus
LTLATGPILTL

SEQ ID NO: 122885 - protein, 11 aa, Dengue virus
TLATGPILTLW

SEQ ID NO: 122886 - protein, 11 aa, Dengue virus
LATGPILTLWE

SEQ ID NO: 122887 - protein, 11 aa, Dengue virus
ATGPILTLWEG

SEQ ID NO: 122888 - protein, 11 aa, Dengue virus
TGPILTLWEGN

SEQ ID NO: 122889 - protein, 11 aa, Dengue virus
GPILTLWEGNP

SEQ ID NO: 122890 - protein, 11 aa, Dengue virus
PILTLWEGNPG

SEQ ID NO: 122891 - protein, 11 aa, Dengue virus
STLWEGNPGKF

SEQ ID NO: 122892 - protein, 11 aa, Dengue virus
LAGAGLAFSLI

SEQ ID NO: 122893 - protein, 11 aa, Dengue virus
AGAGLAFSLIK

SEQ ID NO: 122894 - protein, 11 aa, Dengue virus
GAGLAFSLIKN

SEQ ID NO: 122895 - protein, 11 aa, Dengue virus
AGLAFSLIKNA

SEQ ID NO: 122896 - protein, 11 aa, Dengue virus
GETLGEKWKNR

SEQ ID NO: 122897 - protein, 11 aa, Dengue virus
ETLGEKWKNRL

SEQ ID NO: 122898 - protein, 11 aa, Dengue virus
TLGEKWKNRLN

SEQ ID NO: 122899 - protein, 11 aa, Dengue virus
EVDRTEAKSAL

SEQ ID NO: 122900 - protein, 11 aa, Dengue virus
KHAVSRGSSKI

SEQ ID NO: 122901 - protein, 11 aa, Dengue virus
HAVSRGSSKIR

SEQ ID NO: 122902 - protein, 11 aa, Dengue virus
AVSRGSSKIRW

SEQ ID NO: 122903 - protein, 11 aa, Dengue virus
VSRGSSKIRWI

SEQ ID NO: 122904 - protein, 11 aa, Dengue virus
SRGSSKIRWIV

SEQ ID NO: 122905 - protein, 11 aa, Dengue virus
RGSSKIRWIVE

SEQ ID NO: 122906 - protein, 11 aa, Dengue virus
GSSKIRWIVER

SEQ ID NO: 122907 - protein, 11 aa, Dengue virus
SSKIRWIVERG

SEQ ID NO: 122908 - protein, 11 aa, Dengue virus
SKIRWIVERGM

SEQ ID NO: 122909 - protein, 11 aa, Dengue virus
KIRWIVERGMV

SEQ ID NO: 122910 - protein, 11 aa, Dengue virus
PKGKVVDLGCG

SEQ ID NO: 122911 - protein, 11 aa, Dengue virus
KGKVVDLGCGR

SEQ ID NO: 122912 - protein, 11 aa, Dengue virus
GWSYYCGGLKD

SEQ ID NO: 122913 - protein, 11 aa, Dengue virus
WSYYCGGLKDV

SEQ ID NO: 122914 - protein, 11 aa, Dengue virus
SYYCGGLKNVK

SEQ ID NO: 122915 - protein, 11 aa, Dengue virus
YYCGGLKNVKE

SEQ ID NO: 122916 - protein, 11 aa, Dengue virus
YCGGLKNVKEV

SEQ ID NO: 122917 - protein, 11 aa, Dengue virus
VKEVKGLTKGG

SEQ ID NO: 122918 - protein, 11 aa, Dengue virus
KEVKGLTKGGP

SEQ ID NO: 122919 - protein, 11 aa, Dengue virus
GPGHEEPVPMA

SEQ ID NO: 122920 - protein, 11 aa, Dengue virus
PGHEEPVPMAT

SEQ ID NO: 122921 - protein, 11 aa, Dengue virus
PVPMSTYGWNL

SEQ ID NO: 122922 - protein, 11 aa, Dengue virus
VPMSTYGWNLV

SEQ ID NO: 122923 - protein, 11 aa, Dengue virus
PMSTYGWNLVK

SEQ ID NO: 122924 - protein, 11 aa, Dengue virus
MSTYGWNLVKL

SEQ ID NO: 122925 - protein, 11 aa, Dengue virus
ATYGWNLVKLY

SEQ ID NO: 122926 - protein, 11 aa, Dengue virus
DIGESSSNPTI

SEQ ID NO: 122927 - protein, 11 aa, Dengue virus
IGESSSNPTIE

SEQ ID NO: 122928 - protein, 11 aa, Dengue virus
GESSPNPTVEA

SEQ ID NO: 122929 - protein, 11 aa, Dengue virus
ESSPNPTVEAG

SEQ ID NO: 122930 - protein, 11 aa, Dengue virus
SSPNPTVEAGR

SEQ ID NO: 122931 - protein, 11 aa, Dengue virus
SPNPTVEAGRT

SEQ ID NO: 122932 - protein, 11 aa, Dengue virus
PNPTVEAGRTL

SEQ ID NO: 122933 - protein, 11 aa, Dengue virus
NPTVEAGRTLR

SEQ ID NO: 122934 - protein, 11 aa, Dengue virus
PTVEAGRTLRV

SEQ ID NO: 122935 - protein, 11 aa, Dengue virus
TVEAGRTLRVL

SEQ ID NO: 122936 - protein, 11 aa, Dengue virus
VEAGRTLRVLN

SEQ ID NO: 122937 - protein, 11 aa, Dengue virus
EAGRTLRVLSL

SEQ ID NO: 122938 - protein, 11 aa, Dengue virus
AGRTLRVLSLV

SEQ ID NO: 122939 - protein, 11 aa, Dengue virus
GRTLRVLSLVE

SEQ ID NO: 122940 - protein, 11 aa, Dengue virus
RTLRVLSLVEN

SEQ ID NO: 122941 - protein, 11 aa, Dengue virus
TLRVLSLVENW

SEQ ID NO: 122942 - protein, 11 aa, Dengue virus
LRVLSLVENWL

SEQ ID NO: 122943 - protein, 11 aa, Dengue virus
QFCVKVLNPYM

SEQ ID NO: 122944 - protein, 11 aa, Dengue virus
CVKVLNPYMPS

SEQ ID NO: 122945 - protein, 11 aa, Dengue virus
VKVLNPYMPSV

SEQ ID NO: 122946 - protein, 11 aa, Dengue virus
KVLNPYMPAVI

SEQ ID NO: 122947 - protein, 11 aa, Dengue virus
VLNPYMPAVIE

SEQ ID NO: 122948 - protein, 11 aa, Dengue virus
HGGNLVRCPLS

SEQ ID NO: 122949 - protein, 11 aa, Dengue virus
NSTHEMYWVSG

SEQ ID NO: 122950 - protein, 11 aa, Dengue virus
STHEMYWVSGA

SEQ ID NO: 122951 - protein, 11 aa, Dengue virus
THEMYWVSNAS

SEQ ID NO: 122952 - protein, 11 aa, Dengue virus
HEMYWVSNASG

SEQ ID NO: 122953 - protein, 11 aa, Dengue virus
EMYWVSNASGN

SEQ ID NO: 122954 - protein, 11 aa, Dengue virus
MYWVSNASGNI

SEQ ID NO: 122955 - protein, 11 aa, Dengue virus
YWVSNASGNIV

SEQ ID NO: 122956 - protein, 11 aa, Dengue virus
GNIVSSVNMVS

SEQ ID NO: 122957 - protein, 11 aa, Dengue virus
NIVSSVNMVSR

SEQ ID NO: 122958 - protein, 11 aa, Dengue virus
IVSSVNMVSRL

SEQ ID NO: 122959 - protein, 11 aa, Dengue virus
VSSVNMVSRLL

SEQ ID NO: 122960 - protein, 11 aa, Dengue virus
SSVNMVSRLLL

SEQ ID NO: 122961 - protein, 11 aa, Dengue virus
SVNTTSKMLLN

SEQ ID NO: 122962 - protein, 11 aa, Dengue virus
VNTTSKMLLNR

SEQ ID NO: 122963 - protein, 11 aa, Dengue virus
NTTSKMLLNRF

SEQ ID NO: 122964 - protein, 11 aa, Dengue virus
TTSKMLLNRFT

SEQ ID NO: 122965 - protein, 11 aa, Dengue virus
TSKMLLNRFTT

SEQ ID NO: 122966 - protein, 11 aa, Dengue virus
ERDVDLGTGTR

SEQ ID NO: 122967 - protein, 11 aa, Dengue virus
KDVDLGAGTRS

SEQ ID NO: 122968 - protein, 11 aa, Dengue virus
DVDLGTGTRHV

SEQ ID NO: 122969 - protein, 11 aa, Dengue virus
VDLGAGTRSVS

SEQ ID NO: 122970 - protein, 11 aa, Dengue virus
DLGAGTRSVST

SEQ ID NO: 122971 - protein, 11 aa, Dengue virus
LGAGTRSVSTE

SEQ ID NO: 122972 - protein, 11 aa, Dengue virus
TWHYDQENPYR

SEQ ID NO: 122973 - protein, 11 aa, Dengue virus
WHYDQENPYRT

SEQ ID NO: 122974 - protein, 11 aa, Dengue virus
HYDQENPYRTW

SEQ ID NO: 122975 - protein, 11 aa, Dengue virus
YDQENPYRTWA

SEQ ID NO: 122976 - protein, 11 aa, Dengue virus
DQENPYRTWAY

SEQ ID NO: 122977 - protein, 11 aa, Dengue virus
QENPYRTWAYH

SEQ ID NO: 122978 - protein, 11 aa, Dengue virus
ENPYRTWAYHG

SEQ ID NO: 122979 - protein, 11 aa, Dengue virus
WAYHGSYEAPS

SEQ ID NO: 122980 - protein, 11 aa, Dengue virus
AYHGSYEAPST

SEQ ID NO: 122981 - protein, 11 aa, Dengue virus
YHGSYEAPSTG

SEQ ID NO: 122982 - protein, 11 aa, Dengue virus
HGSYEAPSTGS

SEQ ID NO: 122983 - protein, 11 aa, Dengue virus
GSYEAPSTGSA

SEQ ID NO: 122984 - protein, 11 aa, Dengue virus
SYEAPSTGSAS

SEQ ID NO: 122985 - protein, 11 aa, Dengue virus
YEAPSTGSASS

SEQ ID NO: 122986 - protein, 11 aa, Dengue virus
EAPSTGSASSM

SEQ ID NO: 122987 - protein, 11 aa, Dengue virus
APSTGSASSMV

SEQ ID NO: 122988 - protein, 11 aa, Dengue virus
PSTGSASSMVN

SEQ ID NO: 122989 - protein, 11 aa, Dengue virus
STGSASSMVNG

SEQ ID NO: 122990 - protein, 11 aa, Dengue virus
VRLLTKPWDVI

SEQ ID NO: 122991 - protein, 11 aa, Dengue virus
RLLTKPWDVIP

SEQ ID NO: 122992 - protein, 11 aa, Dengue virus
LLTKPWDVVPT

SEQ ID NO: 122993 - protein, 11 aa, Dengue virus
LTKPWDVVPTV

SEQ ID NO: 122994 - protein, 11 aa, Dengue virus
TKPWDVVPTVT

SEQ ID NO: 122995 - protein, 11 aa, Dengue virus
KPWDVVPTVTQ

SEQ ID NO: 122996 - protein, 11 aa, Dengue virus
PMVTQLAMTDT

SEQ ID NO: 122997 - protein, 11 aa, Dengue virus
MVTQLAMTDTT

SEQ ID NO: 122998 - protein, 11 aa, Dengue virus
FKEKVDTRTPQ

SEQ ID NO: 122999 - protein, 11 aa, Dengue virus
CTRAEFCNKVR

SEQ ID NO: 123000 - protein, 11 aa, Dengue virus
SKVRSNAAIGA

SEQ ID NO: 123001 - protein, 11 aa, Dengue virus
KVRSNAALGAV

SEQ ID NO: 123002 - protein, 11 aa, Dengue virus
VRSNAALGAVF

SEQ ID NO: 123003 - protein, 11 aa, Dengue virus
RSNAAIGAVFQ

SEQ ID NO: 123004 - protein, 11 aa, Dengue virus
SNAAIGAVFQE

SEQ ID NO: 123005 - protein, 11 aa, Dengue virus
NAAIGAVFQEE

SEQ ID NO: 123006 - protein, 11 aa, Dengue virus
AAIGAVFQEEQ

SEQ ID NO: 123007 - protein, 11 aa, Dengue virus
AIGAVFQEEQG

SEQ ID NO: 123008 - protein, 11 aa, Dengue virus
IGAVFQEEQGW

SEQ ID NO: 123009 - protein, 11 aa, Dengue virus
GAVFQEEQGWT

SEQ ID NO: 123010 - protein, 11 aa, Dengue virus
AVFQEEQGWTS

SEQ ID NO: 123011 - protein, 11 aa, Dengue virus
VFQEEQGWTSA

SEQ ID NO: 123012 - protein, 11 aa, Dengue virus
FTEENQWDSAR

SEQ ID NO: 123013 - protein, 11 aa, Dengue virus
TEENQWDSARA

SEQ ID NO: 123014 - protein, 11 aa, Dengue virus
EENQWDSARAA

SEQ ID NO: 123015 - protein, 11 aa, Dengue virus
ENQWDSARAAV

SEQ ID NO: 123016 - protein, 11 aa, Dengue virus
NQWDSARAAVE

SEQ ID NO: 123017 - protein, 11 aa, Dengue virus
QWDSARAAVED

SEQ ID NO: 123018 - protein, 11 aa, Dengue virus
ERALHQEGKCE

SEQ ID NO: 123019 - protein, 11 aa, Dengue virus
RALHQEGKCES

SEQ ID NO: 123020 - protein, 11 aa, Dengue virus
ALHQEGKCESC

SEQ ID NO: 123021 - protein, 11 aa, Dengue virus
LHQEGKCESCV

SEQ ID NO: 123022 - protein, 11 aa, Dengue virus
HQEGKCESCVY

SEQ ID NO: 123023 - protein, 11 aa, Dengue virus
QEGKCESCVYN

SEQ ID NO: 123024 - protein, 11 aa, Dengue virus
EGKCESCVYNM

SEQ ID NO: 123025 - protein, 11 aa, Dengue virus
GKCESCVYNMM

SEQ ID NO: 123026 - protein, 11 aa, Dengue virus
KCESCVYNMMG

SEQ ID NO: 123027 - protein, 11 aa, Dengue virus
CESCVYNMMGK

SEQ ID NO: 123028 - protein, 11 aa, Dengue virus
ESCVYNMMGKR

SEQ ID NO: 123029 - protein, 11 aa, Dengue virus
FLNEDHWFGRE

SEQ ID NO: 123030 - protein, 11 aa, Dengue virus
LNEDHWFGREN

SEQ ID NO: 123031 - protein, 11 aa, Dengue virus
EDHWFGRENSW

SEQ ID NO: 123032 - protein, 11 aa, Dengue virus
DHWFGRENSWS

SEQ ID NO: 123033 - protein, 11 aa, Dengue virus
HWFGRENSWSG

SEQ ID NO: 123034 - protein, 11 aa, Dengue virus
WFGRENSWSGV

SEQ ID NO: 123035 - protein, 11 aa, Dengue virus
FGRENSWSGVE

SEQ ID NO: 123036 - protein, 11 aa, Dengue virus
GRENSWSGVEG

SEQ ID NO: 123037 - protein, 11 aa, Dengue virus
RENSWSGVEGE

SEQ ID NO: 123038 - protein, 11 aa, Dengue virus
ENSWSGVEGEG

SEQ ID NO: 123039 - protein, 11 aa, Dengue virus
NSFSGVEGEGL

SEQ ID NO: 123040 - protein, 11 aa, Dengue virus
SFSGVEGEGLH

SEQ ID NO: 123041 - protein, 11 aa, Dengue virus
WSGVEGEGLHR

SEQ ID NO: 123042 - protein, 11 aa, Dengue virus
GDLIYADDTAG

SEQ ID NO: 123043 - protein, 11 aa, Dengue virus
DLIYADDTAGW

SEQ ID NO: 123044 - protein, 11 aa, Dengue virus
LIYADDTAGWD

SEQ ID NO: 123045 - protein, 11 aa, Dengue virus
DTAGWDTRITS

SEQ ID NO: 123046 - protein, 11 aa, Dengue virus
TAGWDTRITSE

SEQ ID NO: 123047 - protein, 11 aa, Dengue virus
AGWDTRITSED

SEQ ID NO: 123048 - protein, 11 aa, Dengue virus
GWDTRITSEDL

SEQ ID NO: 123049 - protein, 11 aa, Dengue virus
QNKVVKVLRPT

SEQ ID NO: 123050 - protein, 11 aa, Dengue virus
NKVVKVLRPTP

SEQ ID NO: 123051 - protein, 11 aa, Dengue virus
GAVMDIISRKD

SEQ ID NO: 123052 - protein, 11 aa, Dengue virus
AVMDIISRKDQ

SEQ ID NO: 123053 - protein, 11 aa, Dengue virus
FTNMGAQLIRQ

SEQ ID NO: 123054 - protein, 11 aa, Dengue virus
TNMGAQLIRQM

SEQ ID NO: 123055 - protein, 11 aa, Dengue virus
NMGAQLIRQME

SEQ ID NO: 123056 - protein, 11 aa, Dengue virus
AQLVRQMEGEG

SEQ ID NO: 123057 - protein, 11 aa, Dengue virus
ERLRRMAISGD

SEQ ID NO: 123058 - protein, 11 aa, Dengue virus
ISGDDCVVKPV

SEQ ID NO: 123059 - protein, 11 aa, Dengue virus
SGDDCVVKPVD

SEQ ID NO: 123060 - protein, 11 aa, Dengue virus
GDDCVVKPTDD

SEQ ID NO: 123061 - protein, 11 aa, Dengue virus
DDCVVKPTDDR

SEQ ID NO: 123062 - protein, 11 aa, Dengue virus
DCVVKPTDDRF

SEQ ID NO: 123063 - protein, 11 aa, Dengue virus
NDMGKVRKDVP

SEQ ID NO: 123064 - protein, 11 aa, Dengue virus
DMGKVRKDVPQ

SEQ ID NO: 123065 - protein, 11 aa, Dengue virus
MGKVRKDVPQW

SEQ ID NO: 123066 - protein, 11 aa, Dengue virus
GKIRKDIQQWE

SEQ ID NO: 123067 - protein, 11 aa, Dengue virus
KIRKDIQQWEP

SEQ ID NO: 123068 - protein, 11 aa, Dengue virus
IRKDIQQWEPS

SEQ ID NO: 123069 - protein, 11 aa, Dengue virus
RKDIQQWEPSK

SEQ ID NO: 123070 - protein, 11 aa, Dengue virus
KDIQQWEPSKG

SEQ ID NO: 123071 - protein, 11 aa, Dengue virus
DIQQWEPSKGW

SEQ ID NO: 123072 - protein, 11 aa, Dengue virus
QWEPSKGWKNW

SEQ ID NO: 123073 - protein, 11 aa, Dengue virus
GWKNWQEVPFC

SEQ ID NO: 123074 - protein, 11 aa, Dengue virus
WKNWQEVPFCS

SEQ ID NO: 123075 - protein, 11 aa, Dengue virus
KNWQEVPFCSH

SEQ ID NO: 123076 - protein, 11 aa, Dengue virus
PFCSHHFHKIF

SEQ ID NO: 123077 - protein, 11 aa, Dengue virus
FCSHHFHKIFM

SEQ ID NO: 123078 - protein, 11 aa, Dengue virus
CSHHFHKIFMK

SEQ ID NO: 123079 - protein, 11 aa, Dengue virus
SHHFHKIFMKD

SEQ ID NO: 123080 - protein, 11 aa, Dengue virus
HHFHKIFMKDG

SEQ ID NO: 123081 - protein, 11 aa, Dengue virus
HFHKIFMKDGR

SEQ ID NO: 123082 - protein, 11 aa, Dengue virus
SLKETACLGKA

SEQ ID NO: 123083 - protein, 11 aa, Dengue virus
LKETACLGKAY

SEQ ID NO: 123084 - protein, 11 aa, Dengue virus
KETACLGKAYA

SEQ ID NO: 123085 - protein, 11 aa, Dengue virus
CLGKSYAQMWT

SEQ ID NO: 123086 - protein, 11 aa, Dengue virus
LGKSYAQMWTL

SEQ ID NO: 123087 - protein, 11 aa, Dengue virus
GKSYAQMWTLM

SEQ ID NO: 123088 - protein, 11 aa, Dengue virus
KSYAQMWTLMY

SEQ ID NO: 123089 - protein, 11 aa, Dengue virus
SYAQMWTLMYF

SEQ ID NO: 123090 - protein, 11 aa, Dengue virus
YAQMWALMYFH

SEQ ID NO: 123091 - protein, 11 aa, Dengue virus
AQMWALMYFHR

SEQ ID NO: 123092 - protein, 11 aa, Dengue virus
QMWALMYFHRR

SEQ ID NO: 123093 - protein, 11 aa, Dengue virus
MWALMYFHRRD

SEQ ID NO: 123094 - protein, 11 aa, Dengue virus
WALMYFHRRDL

SEQ ID NO: 123095 - protein, 11 aa, Dengue virus
ALMYFHRRDLR

SEQ ID NO: 123096 - protein, 11 aa, Dengue virus
EWFPTSRTTWS

SEQ ID NO: 123097 - protein, 11 aa, Dengue virus
TSRTTWSIHAS

SEQ ID NO: 123098 - protein, 11 aa, Dengue virus
SRTTWSIHASH

SEQ ID NO: 123099 - protein, 11 aa, Dengue virus
RTTWSIHASHE

SEQ ID NO: 123100 - protein, 11 aa, Dengue virus
TTWSIHASHEW

SEQ ID NO: 123101 - protein, 11 aa, Dengue virus
TWSIHASHEWM

SEQ ID NO: 123102 - protein, 11 aa, Dengue virus
WSIHASHEWMT

SEQ ID NO: 123103 - protein, 11 aa, Dengue virus
SIHASHEWMTT

SEQ ID NO: 123104 - protein, 11 aa, Dengue virus
IHASHEWMTTE

SEQ ID NO: 123105 - protein, 11 aa, Dengue virus
HASHEWMTTED

SEQ ID NO: 123106 - protein, 11 aa, Dengue virus
ASHEWMTTEDM

SEQ ID NO: 123107 - protein, 11 aa, Dengue virus
SHEWMTTEDML

SEQ ID NO: 123108 - protein, 11 aa, Dengue virus
HEWMTTEDMLT

SEQ ID NO: 123109 - protein, 11 aa, Dengue virus
EWMTTEDMLTV

SEQ ID NO: 123110 - protein, 11 aa, Dengue virus
WMTTEDMLKVW

SEQ ID NO: 123111 - protein, 11 aa, Dengue virus
MTTEDMLKVWN

SEQ ID NO: 123112 - protein, 11 aa, Dengue virus
TTEDMLKVWNR

SEQ ID NO: 123113 - protein, 11 aa, Dengue virus
TEDMLKVWNRV

SEQ ID NO: 123114 - protein, 11 aa, Dengue virus
EDMLKVWNRVW

SEQ ID NO: 123115 - protein, 11 aa, Dengue virus
DMLKVWNRVWI

SEQ ID NO: 123116 - protein, 11 aa, Dengue virus
NVPYLGKREDQ

SEQ ID NO: 123117 - protein, 11 aa, Dengue virus
IGLTARATWAS

SEQ ID NO: 123118 - protein, 11 aa, Dengue virus
GLTARATWASN

SEQ ID NO: 123119 - protein, 11 aa, Dengue virus
LTARATWASNI

SEQ ID NO: 123120 - protein, 11 aa, Dengue virus
RNRVSTIQQLT

SEQ ID NO: 123121 - protein, 11 aa, Dengue virus
NRVSTIQQLTK

SEQ ID NO: 123122 - protein, 11 aa, Dengue virus
RVSTIQQLTKR

SEQ ID NO: 123123 - protein, 11 aa, Dengue virus
VSTIQQLTKRF

SEQ ID NO: 123124 - protein, 11 aa, Dengue virus
STIQQLTKRFS

SEQ ID NO: 123125 - protein, 11 aa, Dengue virus
SQLAKRFSKEL

SEQ ID NO: 123126 - protein, 11 aa, Dengue virus
LVKRFSTGLFS

SEQ ID NO: 123127 - protein, 11 aa, Dengue virus
VKRFSTGLFSG

SEQ ID NO: 123128 - protein, 11 aa, Dengue virus
KRFSTGLFSGK

SEQ ID NO: 123129 - protein, 11 aa, Dengue virus
RFSTGLFSGKG

SEQ ID NO: 123130 - protein, 11 aa, Dengue virus
FSTGLFSGKGP

SEQ ID NO: 123131 - protein, 11 aa, Dengue virus
FVMAFIAFLRF

SEQ ID NO: 123132 - protein, 11 aa, Dengue virus
TFHLTTRGGEP

SEQ ID NO: 123133 - protein, 11 aa, Dengue virus
EKGKSLLFKTK

SEQ ID NO: 123134 - protein, 11 aa, Dengue virus
CTLIAMDLGEF

SEQ ID NO: 123135 - protein, 11 aa, Dengue virus
TLIAMDLGEFC

SEQ ID NO: 123136 - protein, 11 aa, Dengue virus
AMDLGEMCEDT

SEQ ID NO: 123137 - protein, 11 aa, Dengue virus
DDVDCWCNTTD

SEQ ID NO: 123138 - protein, 11 aa, Dengue virus
DVDCWCNTTDT

SEQ ID NO: 123139 - protein, 11 aa, Dengue virus
VDCWCNTTDTW

SEQ ID NO: 123140 - protein, 11 aa, Dengue virus
RRRDKRSVALA

SEQ ID NO: 123141 - protein, 11 aa, Dengue virus
IETWVLRHPGF

SEQ ID NO: 123142 - protein, 11 aa, Dengue virus
ETWVLRHPGFT

SEQ ID NO: 123143 - protein, 11 aa, Dengue virus
MRCIGMSNRDF

SEQ ID NO: 123144 - protein, 11 aa, Dengue virus
RCIGMSNRDFV

SEQ ID NO: 123145 - protein, 11 aa, Dengue virus
CIGMSNRDFVE

SEQ ID NO: 123146 - protein, 11 aa, Dengue virus
IGMSNRDFVEG

SEQ ID NO: 123147 - protein, 11 aa, Dengue virus
HGGCVTTMAKS

SEQ ID NO: 123148 - protein, 11 aa, Dengue virus
GGCVTTMAKSK

SEQ ID NO: 123149 - protein, 11 aa, Dengue virus
GCVTTMAKSKP

SEQ ID NO: 123150 - protein, 11 aa, Dengue virus
TMAKSKPTLDI

SEQ ID NO: 123151 - protein, 11 aa, Dengue virus
MAKSKPTLDIE

SEQ ID NO: 123152 - protein, 11 aa, Dengue virus
AKSKPTLDIEL

SEQ ID NO: 123153 - protein, 11 aa, Dengue virus
LDFELIKTTAK

SEQ ID NO: 123154 - protein, 11 aa, Dengue virus
TDSRCPTQGEP

SEQ ID NO: 123155 - protein, 11 aa, Dengue virus
CRHSMVDRGWG

SEQ ID NO: 123156 - protein, 11 aa, Dengue virus
RHSMVDRGWGN

SEQ ID NO: 123157 - protein, 11 aa, Dengue virus
GCGLFGKGGVV

SEQ ID NO: 123158 - protein, 11 aa, Dengue virus
CGLFGKGGVVT

SEQ ID NO: 123159 - protein, 11 aa, Dengue virus
GLFGKGGVVTC

SEQ ID NO: 123160 - protein, 11 aa, Dengue virus
LFGKGGVVTCA

SEQ ID NO: 123161 - protein, 11 aa, Dengue virus
FGKGGVVTCAK

SEQ ID NO: 123162 - protein, 11 aa, Dengue virus
GKGGVVTCAKF

SEQ ID NO: 123163 - protein, 11 aa, Dengue virus
HSGEENAVGND

SEQ ID NO: 123164 - protein, 11 aa, Dengue virus
ITMECSPRTGL

SEQ ID NO: 123165 - protein, 11 aa, Dengue virus
SLDFNEMVLLQ

SEQ ID NO: 123166 - protein, 11 aa, Dengue virus
KERMVTFKVPH

SEQ ID NO: 123167 - protein, 11 aa, Dengue virus
LGNILFMGHLK

SEQ ID NO: 123168 - protein, 11 aa, Dengue virus
GNILFMGHLKC

SEQ ID NO: 123169 - protein, 11 aa, Dengue virus
NILFMGHLKCR

SEQ ID NO: 123170 - protein, 11 aa, Dengue virus
ILFMGHLKCRL

SEQ ID NO: 123171 - protein, 11 aa, Dengue virus
CRLKMDKLTLR

SEQ ID NO: 123172 - protein, 11 aa, Dengue virus
RLKMDKLTLRG

SEQ ID NO: 123173 - protein, 11 aa, Dengue virus
EKELAETQHGT

SEQ ID NO: 123174 - protein, 11 aa, Dengue virus
KELAETQHGTV

SEQ ID NO: 123175 - protein, 11 aa, Dengue virus
ELAETQHGTVL

SEQ ID NO: 123176 - protein, 11 aa, Dengue virus
LAETQHGTVLV

SEQ ID NO: 123177 - protein, 11 aa, Dengue virus
INIEAEPPFGD

SEQ ID NO: 123178 - protein, 11 aa, Dengue virus
IELEPPFGDSY

SEQ ID NO: 123179 - protein, 11 aa, Dengue virus
ELEPPFGDSYI

SEQ ID NO: 123180 - protein, 11 aa, Dengue virus
GSTIGKMFEAT

SEQ ID NO: 123181 - protein, 11 aa, Dengue virus
GKMFVATARGA

SEQ ID NO: 123182 - protein, 11 aa, Dengue virus
QMFATTMRGAK

SEQ ID NO: 123183 - protein, 11 aa, Dengue virus
TAWDFGSIGGL

SEQ ID NO: 123184 - protein, 11 aa, Dengue virus
AYTALFGGVSW

SEQ ID NO: 123185 - protein, 11 aa, Dengue virus
LKCGNGIFVTN

SEQ ID NO: 123186 - protein, 11 aa, Dengue virus
KCGNGIFVTNE

SEQ ID NO: 123187 - protein, 11 aa, Dengue virus
CGNGIFVTNEV

SEQ ID NO: 123188 - protein, 11 aa, Dengue virus
GNGIFVTNEVH

SEQ ID NO: 123189 - protein, 11 aa, Dengue virus
NGIFVTNEVHT

SEQ ID NO: 123190 - protein, 11 aa, Dengue virus
KFQPDSPSKLA

SEQ ID NO: 123191 - protein, 11 aa, Dengue virus
PDSPSKLASAI

SEQ ID NO: 123192 - protein, 11 aa, Dengue virus
DSPSKLASAIQ

SEQ ID NO: 123193 - protein, 11 aa, Dengue virus
SPKRLSAAIGR

SEQ ID NO: 123194 - protein, 11 aa, Dengue virus
PKRLSAAIGRA

SEQ ID NO: 123195 - protein, 11 aa, Dengue virus
DICGIRSVTRL

SEQ ID NO: 123196 - protein, 11 aa, Dengue virus
GIRSTTRLENI

SEQ ID NO: 123197 - protein, 11 aa, Dengue virus
IRSTTRLENIM

SEQ ID NO: 123198 - protein, 11 aa, Dengue virus
RSTTRLENIMW

SEQ ID NO: 123199 - protein, 11 aa, Dengue virus
TRLENIMWRQI

SEQ ID NO: 123200 - protein, 11 aa, Dengue virus
FEVEDYGFGMF

SEQ ID NO: 123201 - protein, 11 aa, Dengue virus
FGVFTTNIWLR

SEQ ID NO: 123202 - protein, 11 aa, Dengue virus
KDDRAVHADMG

SEQ ID NO: 123203 - protein, 11 aa, Dengue virus
DDRAVHADMGY

SEQ ID NO: 123204 - protein, 11 aa, Dengue virus
DRAVHADMGYW

SEQ ID NO: 123205 - protein, 11 aa, Dengue virus
HADMGYWIESR

SEQ ID NO: 123206 - protein, 11 aa, Dengue virus
ADMGYWIESRL

SEQ ID NO: 123207 - protein, 11 aa, Dengue virus
DMGYWIESRLN

SEQ ID NO: 123208 - protein, 11 aa, Dengue virus
TQTAGPWHLGR

SEQ ID NO: 123209 - protein, 11 aa, Dengue virus
QTAGPWHLGRL

SEQ ID NO: 123210 - protein, 11 aa, Dengue virus
TGPWHLGKLEM

SEQ ID NO: 123211 - protein, 11 aa, Dengue virus
RSCTMPPLRFL

SEQ ID NO: 123212 - protein, 11 aa, Dengue virus
SCTMPPLRFLG

SEQ ID NO: 123213 - protein, 11 aa, Dengue virus
CTMPPLRFLGE

SEQ ID NO: 123214 - protein, 11 aa, Dengue virus
TMPPLRFLGED

SEQ ID NO: 123215 - protein, 11 aa, Dengue virus
MPPLRFLGEDG

SEQ ID NO: 123216 - protein, 11 aa, Dengue virus
PPLRFLGEDGC

SEQ ID NO: 123217 - protein, 11 aa, Dengue virus
PLRFLGEDGCW

SEQ ID NO: 123218 - protein, 11 aa, Dengue virus
LRFLGEDGCWY

SEQ ID NO: 123219 - protein, 11 aa, Dengue virus
RFLGEDGCWYG

SEQ ID NO: 123220 - protein, 11 aa, Dengue virus
FLGEDGCWYGM

SEQ ID NO: 123221 - protein, 11 aa, Dengue virus
ELTDAIALGIM

SEQ ID NO: 123222 - protein, 11 aa, Dengue virus
RSWPLNEAVMA

SEQ ID NO: 123223 - protein, 11 aa, Dengue virus
SWPLNEAVMAV

SEQ ID NO: 123224 - protein, 11 aa, Dengue virus
WPLNEAVMAVG

SEQ ID NO: 123225 - protein, 11 aa, Dengue virus
VSILLSALLKN

SEQ ID NO: 123226 - protein, 11 aa, Dengue virus
SILLSALLKND

SEQ ID NO: 123227 - protein, 11 aa, Dengue virus
ILLSALLKNDV

SEQ ID NO: 123228 - protein, 11 aa, Dengue virus
LLSALLKNDVP

SEQ ID NO: 123229 - protein, 11 aa, Dengue virus
LSALLKNDVPL

SEQ ID NO: 123230 - protein, 11 aa, Dengue virus
MADITGSSPII

SEQ ID NO: 123231 - protein, 11 aa, Dengue virus
ADITGSSPIIE

SEQ ID NO: 123232 - protein, 11 aa, Dengue virus
AEDGSMSIKNE

SEQ ID NO: 123233 - protein, 11 aa, Dengue virus
DGTMKIKDEEK

SEQ ID NO: 123234 - protein, 11 aa, Dengue virus
GTMKIKDEEKD

SEQ ID NO: 123235 - protein, 11 aa, Dengue virus
ITILLKATLLA

SEQ ID NO: 123236 - protein, 11 aa, Dengue virus
TILLKATLLAI

SEQ ID NO: 123237 - protein, 11 aa, Dengue virus
ILLKATLLAIS

SEQ ID NO: 123238 - protein, 11 aa, Dengue virus
LLKATLLAISG

SEQ ID NO: 123239 - protein, 11 aa, Dengue virus
QTRRSGVLWDV

SEQ ID NO: 123240 - protein, 11 aa, Dengue virus
TRRSGVLWDVP

SEQ ID NO: 123241 - protein, 11 aa, Dengue virus
RRSGVLWDVPS

SEQ ID NO: 123242 - protein, 11 aa, Dengue virus
GVLWDTPSPPK

SEQ ID NO: 123243 - protein, 11 aa, Dengue virus
GKSQVGVGVFQ

SEQ ID NO: 123244 - protein, 11 aa, Dengue virus
WHVTRGSVICH

SEQ ID NO: 123245 - protein, 11 aa, Dengue virus
GKRLEPNWANV

SEQ ID NO: 123246 - protein, 11 aa, Dengue virus
KRLEPNWANVK

SEQ ID NO: 123247 - protein, 11 aa, Dengue virus
RLEPNWANVKK

SEQ ID NO: 123248 - protein, 11 aa, Dengue virus
LEPNWANVKKD

SEQ ID NO: 123249 - protein, 11 aa, Dengue virus
EPNWANVKKDL

SEQ ID NO: 123250 - protein, 11 aa, Dengue virus
WADVRKDLISY

SEQ ID NO: 123251 - protein, 11 aa, Dengue virus
ADVKKDLVSYG

SEQ ID NO: 123252 - protein, 11 aa, Dengue virus
DVRKDLISYGG

SEQ ID NO: 123253 - protein, 11 aa, Dengue virus
WNAGEEVQVIA

SEQ ID NO: 123254 - protein, 11 aa, Dengue virus
AGEEVQVIAVE

SEQ ID NO: 123255 - protein, 11 aa, Dengue virus
AGTIGAVSLDF

SEQ ID NO: 123256 - protein, 11 aa, Dengue virus
PGTSGSPIVDK

SEQ ID NO: 123257 - protein, 11 aa, Dengue virus
YGNGVVTRSGT

SEQ ID NO: 123258 - protein, 11 aa, Dengue virus
GNGVVTRSGTY

SEQ ID NO: 123259 - protein, 11 aa, Dengue virus
NGVVTRSGTYV

SEQ ID NO: 123260 - protein, 11 aa, Dengue virus
GVVTRSGTYVS

SEQ ID NO: 123261 - protein, 11 aa, Dengue virus
VFKKRNLTIMD

SEQ ID NO: 123262 - protein, 11 aa, Dengue virus
SGKTRRYLPAM

SEQ ID NO: 123263 - protein, 11 aa, Dengue virus
RYLPAMVREAI

SEQ ID NO: 123264 - protein, 11 aa, Dengue virus
YLPAMVREAIK

SEQ ID NO: 123265 - protein, 11 aa, Dengue virus
LPAIVREAIRR

SEQ ID NO: 123266 - protein, 11 aa, Dengue virus
REAIRRGLRTL

SEQ ID NO: 123267 - protein, 11 aa, Dengue virus
RRGLRTLILAP

SEQ ID NO: 123268 - protein, 11 aa, Dengue virus
GLPIRYQTTAI

SEQ ID NO: 123269 - protein, 11 aa, Dengue virus
KAEHTGREIVD

SEQ ID NO: 123270 - protein, 11 aa, Dengue virus
SPVRVPNYNLV

SEQ ID NO: 123271 - protein, 11 aa, Dengue virus
PVRVPNYNLVI

SEQ ID NO: 123272 - protein, 11 aa, Dengue virus
VRVPNYNLVIM

SEQ ID NO: 123273 - protein, 11 aa, Dengue virus
IQDEEKDIPER

SEQ ID NO: 123274 - protein, 11 aa, Dengue virus
QDEEKDIPERS

SEQ ID NO: 123275 - protein, 11 aa, Dengue virus
YQGKTVWFVPS

SEQ ID NO: 123276 - protein, 11 aa, Dengue virus
QGKTVWFVPSI

SEQ ID NO: 123277 - protein, 11 aa, Dengue virus
IAACLRKNGKR

SEQ ID NO: 123278 - protein, 11 aa, Dengue virus
AACLRKNGKRV

SEQ ID NO: 123279 - protein, 11 aa, Dengue virus
LSRKTFDSEYA

SEQ ID NO: 123280 - protein, 11 aa, Dengue virus
SRKTFDSEYAK

SEQ ID NO: 123281 - protein, 11 aa, Dengue virus
LTDWDFVVTTD

SEQ ID NO: 123282 - protein, 11 aa, Dengue virus
ISEMGANFRAE

SEQ ID NO: 123283 - protein, 11 aa, Dengue virus
SEMGANFRAER

SEQ ID NO: 123284 - protein, 11 aa, Dengue virus
EMGANFRAERV

SEQ ID NO: 123285 - protein, 11 aa, Dengue virus
MGANFRAERVI

SEQ ID NO: 123286 - protein, 11 aa, Dengue virus
GANFRAERVID

SEQ ID NO: 123287 - protein, 11 aa, Dengue virus
ANFRAERVIDP

SEQ ID NO: 123288 - protein, 11 aa, Dengue virus
NFRAERVIDPR

SEQ ID NO: 123289 - protein, 11 aa, Dengue virus
FRAERVIDPRR

SEQ ID NO: 123290 - protein, 11 aa, Dengue virus
RAERVIDPRRC

SEQ ID NO: 123291 - protein, 11 aa, Dengue virus
VILPDGPERVI

SEQ ID NO: 123292 - protein, 11 aa, Dengue virus
ILPDGPERVIL

SEQ ID NO: 123293 - protein, 11 aa, Dengue virus
LPDGPERVILA

SEQ ID NO: 123294 - protein, 11 aa, Dengue virus
PDGPERVILAG

SEQ ID NO: 123295 - protein, 11 aa, Dengue virus
QEDDQYVFSGD

SEQ ID NO: 123296 - protein, 11 aa, Dengue virus
EDDQYVFSGDP

SEQ ID NO: 123297 - protein, 11 aa, Dengue virus
DDQYVFSGDPL

SEQ ID NO: 123298 - protein, 11 aa, Dengue virus
FMGQPLNNDED

SEQ ID NO: 123299 - protein, 11 aa, Dengue virus
SAAVDGEYRLR

SEQ ID NO: 123300 - protein, 11 aa, Dengue virus
AAVDGEYRLRG

SEQ ID NO: 123301 - protein, 11 aa, Dengue virus
KRGDLPVWLAY

SEQ ID NO: 123302 - protein, 11 aa, Dengue virus
RGDLPVWLSHK

SEQ ID NO: 123303 - protein, 11 aa, Dengue virus
GDLPVWLSHKV

SEQ ID NO: 123304 - protein, 11 aa, Dengue virus
DLPVWLSHKVA

SEQ ID NO: 123305 - protein, 11 aa, Dengue virus
LPVWLAYKVAS

SEQ ID NO: 123306 - protein, 11 aa, Dengue virus
QILEENMEVEV

SEQ ID NO: 123307 - protein, 11 aa, Dengue virus
ILEENMEVEVW

SEQ ID NO: 123308 - protein, 11 aa, Dengue virus
EENMEVEVWTK

SEQ ID NO: 123309 - protein, 11 aa, Dengue virus
ENMEVEVWTKE

SEQ ID NO: 123310 - protein, 11 aa, Dengue virus
NMEVEVWTKEG

SEQ ID NO: 123311 - protein, 11 aa, Dengue virus
KLKPRWLDART

SEQ ID NO: 123312 - protein, 11 aa, Dengue virus
KPRWLDARTYS

SEQ ID NO: 123313 - protein, 11 aa, Dengue virus
FKEFAAGRKSI

SEQ ID NO: 123314 - protein, 11 aa, Dengue virus
KLALDNIVMLH

SEQ ID NO: 123315 - protein, 11 aa, Dengue virus
AYTHALSELPE

SEQ ID NO: 123316 - protein, 11 aa, Dengue virus
YTHALSELPET

SEQ ID NO: 123317 - protein, 11 aa, Dengue virus
THALSELPETL

SEQ ID NO: 123318 - protein, 11 aa, Dengue virus
MEELPDTIETI

SEQ ID NO: 123319 - protein, 11 aa, Dengue virus
PETLETLLLLG

SEQ ID NO: 123320 - protein, 11 aa, Dengue virus
ETLETLLLLGL

SEQ ID NO: 123321 - protein, 11 aa, Dengue virus
TLETLLLLGLL

SEQ ID NO: 123322 - protein, 11 aa, Dengue virus
LETLLLLGLLA

SEQ ID NO: 123323 - protein, 11 aa, Dengue virus
IQPQWIAASII

SEQ ID NO: 123324 - protein, 11 aa, Dengue virus
DNQLTYVIIAI

SEQ ID NO: 123325 - protein, 11 aa, Dengue virus
NQLTYVIIAIL

SEQ ID NO: 123326 - protein, 11 aa, Dengue virus
QLTYVIIAILT

SEQ ID NO: 123327 - protein, 11 aa, Dengue virus
VTANEMGLLET

SEQ ID NO: 123328 - protein, 11 aa, Dengue virus
MGFLEKTKKDF

SEQ ID NO: 123329 - protein, 11 aa, Dengue virus
GFLEKTKKDFG

SEQ ID NO: 123330 - protein, 11 aa, Dengue virus
WTLYAVATTFI

SEQ ID NO: 123331 - protein, 11 aa, Dengue virus
TLYAVATTFIT

SEQ ID NO: 123332 - protein, 11 aa, Dengue virus
LYAVATTFITP

SEQ ID NO: 123333 - protein, 11 aa, Dengue virus
YAVATTFITPM

SEQ ID NO: 123334 - protein, 11 aa, Dengue virus
ITPMLRHSIEN

SEQ ID NO: 123335 - protein, 11 aa, Dengue virus
NQATVLMGLGR

SEQ ID NO: 123336 - protein, 11 aa, Dengue virus
QATVLMGLGRG

SEQ ID NO: 123337 - protein, 11 aa, Dengue virus
ATVLMGLGRGW

SEQ ID NO: 123338 - protein, 11 aa, Dengue virus
TVLMGLGRGWP

SEQ ID NO: 123339 - protein, 11 aa, Dengue virus
GRGWPLSKMDI

SEQ ID NO: 123340 - protein, 11 aa, Dengue virus
RGWPLSKMDIG

SEQ ID NO: 123341 - protein, 11 aa, Dengue virus
SQVNPLTLTAV

SEQ ID NO: 123342 - protein, 11 aa, Dengue virus
QVNPLTLTAVV

SEQ ID NO: 123343 - protein, 11 aa, Dengue virus
IMKNPTVDGVT

SEQ ID NO: 123344 - protein, 11 aa, Dengue virus
KNPTVDGVTVI

SEQ ID NO: 123345 - protein, 11 aa, Dengue virus
QLLLMRTSWAF

SEQ ID NO: 123346 - protein, 11 aa, Dengue virus
LLLMRTSWAFC

SEQ ID NO: 123347 - protein, 11 aa, Dengue virus
LLMRTSWAFCE

SEQ ID NO: 123348 - protein, 11 aa, Dengue virus
LMRTSWAFCEA

SEQ ID NO: 123349 - protein, 11 aa, Dengue virus
MRTSWAFCEAL

SEQ ID NO: 123350 - protein, 11 aa, Dengue virus
RTSWAFCEALT

SEQ ID NO: 123351 - protein, 11 aa, Dengue virus
TSWAFCEALTL

SEQ ID NO: 123352 - protein, 11 aa, Dengue virus
SWAFCEALTLA

SEQ ID NO: 123353 - protein, 11 aa, Dengue virus
LTLATGPVSTL

SEQ ID NO: 123354 - protein, 11 aa, Dengue virus
TLATGPVSTLW

SEQ ID NO: 123355 - protein, 11 aa, Dengue virus
LATGPVSTLWE

SEQ ID NO: 123356 - protein, 11 aa, Dengue virus
ATGPVSTLWEG

SEQ ID NO: 123357 - protein, 11 aa, Dengue virus
TGPVSTLWEGN

SEQ ID NO: 123358 - protein, 11 aa, Dengue virus
GPVSTLWEGNP

SEQ ID NO: 123359 - protein, 11 aa, Dengue virus
PVSTLWEGNPG

SEQ ID NO: 123360 - protein, 11 aa, Dengue virus
AGAGLLFSIMR

SEQ ID NO: 123361 - protein, 11 aa, Dengue virus
GAGLLFSIMRN

SEQ ID NO: 123362 - protein, 11 aa, Dengue virus
AGLLFSIMRNT

SEQ ID NO: 123363 - protein, 11 aa, Dengue virus
HHAVSRGTAKL

SEQ ID NO: 123364 - protein, 11 aa, Dengue virus
SYYCGGLKDVR

SEQ ID NO: 123365 - protein, 11 aa, Dengue virus
YYCGGLKDVRE

SEQ ID NO: 123366 - protein, 11 aa, Dengue virus
YCGGLKDVREV

SEQ ID NO: 123367 - protein, 11 aa, Dengue virus
STYGWNLVKLM

SEQ ID NO: 123368 - protein, 11 aa, Dengue virus
GESSSNPTIEE

SEQ ID NO: 123369 - protein, 11 aa, Dengue virus
ESSSNPTIEEG

SEQ ID NO: 123370 - protein, 11 aa, Dengue virus
SSSNPTIEEGR

SEQ ID NO: 123371 - protein, 11 aa, Dengue virus
SSNPTIEEGRT

SEQ ID NO: 123372 - protein, 11 aa, Dengue virus
SNPTIEEGRTL

SEQ ID NO: 123373 - protein, 11 aa, Dengue virus
IEAGRTLRVLS

SEQ ID NO: 123374 - protein, 11 aa, Dengue virus
CIKVLNPYMPA

SEQ ID NO: 123375 - protein, 11 aa, Dengue virus
IKVLNPYMPAV

SEQ ID NO: 123376 - protein, 11 aa, Dengue virus
KVLNPYMPTVV

SEQ ID NO: 123377 - protein, 11 aa, Dengue virus
VLNPYMPTVVE

SEQ ID NO: 123378 - protein, 11 aa, Dengue virus
FGGALVRNPLS

SEQ ID NO: 123379 - protein, 11 aa, Dengue virus
THEMYWVSGAS

SEQ ID NO: 123380 - protein, 11 aa, Dengue virus
HEMYWVSGASG

SEQ ID NO: 123381 - protein, 11 aa, Dengue virus
EMYWVSGASGN

SEQ ID NO: 123382 - protein, 11 aa, Dengue virus
MYWVSGASGNI

SEQ ID NO: 123383 - protein, 11 aa, Dengue virus
YWVSGASGNIV

SEQ ID NO: 123384 - protein, 11 aa, Dengue virus
GNIVSSVNTTS

SEQ ID NO: 123385 - protein, 11 aa, Dengue virus
NIVSSVNTTSK

SEQ ID NO: 123386 - protein, 11 aa, Dengue virus
IVSSVNTTSKM

SEQ ID NO: 123387 - protein, 11 aa, Dengue virus
VSSVNTTSKML

SEQ ID NO: 123388 - protein, 11 aa, Dengue virus
SSVNTTSKMLL

SEQ ID NO: 123389 - protein, 11 aa, Dengue virus
RDVDLGTGTRH

SEQ ID NO: 123390 - protein, 11 aa, Dengue virus
VDLGTGTRHVA

SEQ ID NO: 123391 - protein, 11 aa, Dengue virus
DLGTGTRHVAV

SEQ ID NO: 123392 - protein, 11 aa, Dengue virus
LGTGTRHVAVE

SEQ ID NO: 123393 - protein, 11 aa, Dengue virus
VRLLTKPWDVL

SEQ ID NO: 123394 - protein, 11 aa, Dengue virus
RLLTKPWDVLP

SEQ ID NO: 123395 - protein, 11 aa, Dengue virus
TKPWDVVPMVI

SEQ ID NO: 123396 - protein, 11 aa, Dengue virus
KPWDVVPMVIQ

SEQ ID NO: 123397 - protein, 11 aa, Dengue virus
CTREEFIRKVR

SEQ ID NO: 123398 - protein, 11 aa, Dengue virus
KKVRSNAALGA

SEQ ID NO: 123399 - protein, 11 aa, Dengue virus
RSNAALGAVFT

SEQ ID NO: 123400 - protein, 11 aa, Dengue virus
SNAALGAVFTD

SEQ ID NO: 123401 - protein, 11 aa, Dengue virus
NAALGAVFTDE

SEQ ID NO: 123402 - protein, 11 aa, Dengue virus
AALGAVFTDEN

SEQ ID NO: 123403 - protein, 11 aa, Dengue virus
ALGAVFTDENK

SEQ ID NO: 123404 - protein, 11 aa, Dengue virus
LGAVFTDENKW

SEQ ID NO: 123405 - protein, 11 aa, Dengue virus
GAVFTDENKWK

SEQ ID NO: 123406 - protein, 11 aa, Dengue virus
AVFTDENKWKS

SEQ ID NO: 123407 - protein, 11 aa, Dengue virus
VFTDENKWKSA

SEQ ID NO: 123408 - protein, 11 aa, Dengue virus
FQEEQGWTSAS

SEQ ID NO: 123409 - protein, 11 aa, Dengue virus
QEEQGWTSASE

SEQ ID NO: 123410 - protein, 11 aa, Dengue virus
EEQGWTSASEA

SEQ ID NO: 123411 - protein, 11 aa, Dengue virus
EQGWTSASEAV

SEQ ID NO: 123412 - protein, 11 aa, Dengue virus
QGWTSASEAVN

SEQ ID NO: 123413 - protein, 11 aa, Dengue virus
GWTSASEAVND

SEQ ID NO: 123414 - protein, 11 aa, Dengue virus
ERNLHLDGKCE

SEQ ID NO: 123415 - protein, 11 aa, Dengue virus
RNLHLDGKCET

SEQ ID NO: 123416 - protein, 11 aa, Dengue virus
NLHLDGKCETC

SEQ ID NO: 123417 - protein, 11 aa, Dengue virus
LHLDGKCETCV

SEQ ID NO: 123418 - protein, 11 aa, Dengue virus
HLDGKCETCVY

SEQ ID NO: 123419 - protein, 11 aa, Dengue virus
LDGKCETCVYN

SEQ ID NO: 123420 - protein, 11 aa, Dengue virus
DGKCETCVYNM

SEQ ID NO: 123421 - protein, 11 aa, Dengue virus
EDHWFSRENSF

SEQ ID NO: 123422 - protein, 11 aa, Dengue virus
DHWFSRENSFS

SEQ ID NO: 123423 - protein, 11 aa, Dengue virus
HWFSRENSFSG

SEQ ID NO: 123424 - protein, 11 aa, Dengue virus
WFSRENSFSGV

SEQ ID NO: 123425 - protein, 11 aa, Dengue virus
FSRENSFSGVE

SEQ ID NO: 123426 - protein, 11 aa, Dengue virus
SRENSFSGVEG

SEQ ID NO: 123427 - protein, 11 aa, Dengue virus
RENSFSGVEGE

SEQ ID NO: 123428 - protein, 11 aa, Dengue virus
ENSFSGVEGEG

SEQ ID NO: 123429 - protein, 11 aa, Dengue virus
FSGVEGEGLHK

SEQ ID NO: 123430 - protein, 11 aa, Dengue virus
NKVVRVQRPAR

SEQ ID NO: 123431 - protein, 11 aa, Dengue virus
VQLIRQMEAEG

SEQ ID NO: 123432 - protein, 11 aa, Dengue virus
ERLARMAISGD

SEQ ID NO: 123433 - protein, 11 aa, Dengue virus
GDDCVVKPVDD

SEQ ID NO: 123434 - protein, 11 aa, Dengue virus
DDCVVKPVDDR

SEQ ID NO: 123435 - protein, 11 aa, Dengue virus
DCVVKPVDDRF

SEQ ID NO: 123436 - protein, 11 aa, Dengue virus
QWEPSKGWSDW

SEQ ID NO: 123437 - protein, 11 aa, Dengue virus
GWSDWTQVPFC

SEQ ID NO: 123438 - protein, 11 aa, Dengue virus
WSDWTQVPFCS

SEQ ID NO: 123439 - protein, 11 aa, Dengue virus
SDWTQVPFCSH

SEQ ID NO: 123440 - protein, 11 aa, Dengue virus
CLGKAYAQMWA

SEQ ID NO: 123441 - protein, 11 aa, Dengue virus
LGKAYAQMWAL

SEQ ID NO: 123442 - protein, 11 aa, Dengue virus
GKAYAQMWALM

SEQ ID NO: 123443 - protein, 11 aa, Dengue virus
KAYAQMWALMY

SEQ ID NO: 123444 - protein, 11 aa, Dengue virus
AYAQMWALMYF

SEQ ID NO: 123445 - protein, 11 aa, Dengue virus
HWIPTSRTTWS

SEQ ID NO: 123446 - protein, 11 aa, Dengue virus
HQWMTTEDMLK

SEQ ID NO: 123447 - protein, 11 aa, Dengue virus
QWMTTEDMLKV

SEQ ID NO: 123448 - protein, 11 aa, Dengue virus
DIPYLGKREDL

SEQ ID NO: 123449 - protein, 11 aa, Dengue virus
IGLSSRATWAK

SEQ ID NO: 123450 - protein, 11 aa, Dengue virus
GLSSRATWAKN

SEQ ID NO: 123451 - protein, 11 aa, Dengue virus
LSSRATWAKNI

SEQ ID NO: 123452 - protein, 8 aa, West Nile virus
MSKKPGGP

SEQ ID NO: 123453 - protein, 8 aa, West Nile virus
SKKPGGPG

SEQ ID NO: 123454 - protein, 8 aa, West Nile virus
KKPGGPGK

SEQ ID NO: 123455 - protein, 8 aa, West Nile virus
KPGGPGKS

SEQ ID NO: 123456 - protein, 8 aa, West Nile virus
PGGPGKSR

SEQ ID NO: 123457 - protein, 8 aa, West Nile virus
GGPGKSRA

SEQ ID NO: 123458 - protein, 8 aa, West Nile virus
GPGKSRAV

SEQ ID NO: 123459 - protein, 8 aa, West Nile virus
PGKSRAVN

SEQ ID NO: 123460 - protein, 8 aa, West Nile virus
GKSRAVNM

SEQ ID NO: 123461 - protein, 8 aa, West Nile virus
KSRAVNML

SEQ ID NO: 123462 - protein, 8 aa, West Nile virus
SRAVNMLK

SEQ ID NO: 123463 - protein, 8 aa, West Nile virus
RAVNMLKR

SEQ ID NO: 123464 - protein, 8 aa, West Nile virus
AVNMLKRG

SEQ ID NO: 123465 - protein, 8 aa, West Nile virus
VNMLKRGM

SEQ ID NO: 123466 - protein, 8 aa, West Nile virus
NMLKRGMP

SEQ ID NO: 123467 - protein, 8 aa, West Nile virus
MLKRGMPR

SEQ ID NO: 123468 - protein, 8 aa, West Nile virus
KRGMPRVL

SEQ ID NO: 123469 - protein, 8 aa, West Nile virus
RGMPRVLS

SEQ ID NO: 123470 - protein, 8 aa, West Nile virus
GMPRVLSL

SEQ ID NO: 123471 - protein, 8 aa, West Nile virus
PRVLSLIG

SEQ ID NO: 123472 - protein, 8 aa, West Nile virus
RVLSLIGL

SEQ ID NO: 123473 - protein, 8 aa, West Nile virus
VLSLIGLK

SEQ ID NO: 123474 - protein, 8 aa, West Nile virus
LSLIGLKR

SEQ ID NO: 123475 - protein, 8 aa, West Nile virus
SLIGLKRA

SEQ ID NO: 123476 - protein, 8 aa, West Nile virus
LIGLKRAM

SEQ ID NO: 123477 - protein, 8 aa, West Nile virus
IGLKRAML

SEQ ID NO: 123478 - protein, 8 aa, West Nile virus
GLKRAMLS

SEQ ID NO: 123479 - protein, 8 aa, West Nile virus
LKRAMLSL

SEQ ID NO: 123480 - protein, 8 aa, West Nile virus
KRAMLSLI

SEQ ID NO: 123481 - protein, 8 aa, West Nile virus
RAMLSLID

SEQ ID NO: 123482 - protein, 8 aa, West Nile virus
AMLSLIDG

SEQ ID NO: 123483 - protein, 8 aa, West Nile virus
MLSLIDGK

SEQ ID NO: 123484 - protein, 8 aa, West Nile virus
LSLIDGKG

SEQ ID NO: 123485 - protein, 8 aa, West Nile virus
SLIDGKGP

SEQ ID NO: 123486 - protein, 8 aa, West Nile virus
LIDGKGPI

SEQ ID NO: 123487 - protein, 8 aa, West Nile virus
IDGKGPIR

SEQ ID NO: 123488 - protein, 8 aa, West Nile virus
DGKGPIRF

SEQ ID NO: 123489 - protein, 8 aa, West Nile virus
GKGPIRFV

SEQ ID NO: 123490 - protein, 8 aa, West Nile virus
KGPIRFVL

SEQ ID NO: 123491 - protein, 8 aa, West Nile virus
GPIRFVLA

SEQ ID NO: 123492 - protein, 8 aa, West Nile virus
PIRFVLAL

SEQ ID NO: 123493 - protein, 8 aa, West Nile virus
IRFVLALL

SEQ ID NO: 123494 - protein, 8 aa, West Nile virus
RFVLALLA

SEQ ID NO: 123495 - protein, 8 aa, West Nile virus
FVLALLAF

SEQ ID NO: 123496 - protein, 8 aa, West Nile virus
VLALLAFF

SEQ ID NO: 123497 - protein, 8 aa, West Nile virus
LALLAFFR

SEQ ID NO: 123498 - protein, 8 aa, West Nile virus
ALLAFFRF

SEQ ID NO: 123499 - protein, 8 aa, West Nile virus
LLAFFRFT

SEQ ID NO: 123500 - protein, 8 aa, West Nile virus
LAFFRFTA

SEQ ID NO: 123501 - protein, 8 aa, West Nile virus
AFFRFTAI

SEQ ID NO: 123502 - protein, 8 aa, West Nile virus
FFRFTAIA

SEQ ID NO: 123503 - protein, 8 aa, West Nile virus
FRFTAIAP

SEQ ID NO: 123504 - protein, 8 aa, West Nile virus
RFTAIAPT

SEQ ID NO: 123505 - protein, 8 aa, West Nile virus
FTAIAPTR

SEQ ID NO: 123506 - protein, 8 aa, West Nile virus
TAIAPTRA

SEQ ID NO: 123507 - protein, 8 aa, West Nile virus
AIAPTRAV

SEQ ID NO: 123508 - protein, 8 aa, West Nile virus
IAPTRAVL

SEQ ID NO: 123509 - protein, 8 aa, West Nile virus
APTRAVLD

SEQ ID NO: 123510 - protein, 8 aa, West Nile virus
PTRAVLDR

SEQ ID NO: 123511 - protein, 8 aa, West Nile virus
TRAVLDRW

SEQ ID NO: 123512 - protein, 8 aa, West Nile virus
RAVLDRWR

SEQ ID NO: 123513 - protein, 8 aa, West Nile virus
AVLDRWRG

SEQ ID NO: 123514 - protein, 8 aa, West Nile virus
VLDRWRGV

SEQ ID NO: 123515 - protein, 8 aa, West Nile virus
LDRWRGVN

SEQ ID NO: 123516 - protein, 8 aa, West Nile virus
DRWRGVNK

SEQ ID NO: 123517 - protein, 8 aa, West Nile virus
RWRGVNKQ

SEQ ID NO: 123518 - protein, 8 aa, West Nile virus
WRGVNKQT

SEQ ID NO: 123519 - protein, 8 aa, West Nile virus
RGVNKQTA

SEQ ID NO: 123520 - protein, 8 aa, West Nile virus
GVNKQTAM

SEQ ID NO: 123521 - protein, 8 aa, West Nile virus
VNKQTAMK

SEQ ID NO: 123522 - protein, 8 aa, West Nile virus
NKQTAMKH

SEQ ID NO: 123523 - protein, 8 aa, West Nile virus
KQTAMKHL

SEQ ID NO: 123524 - protein, 8 aa, West Nile virus
QTAMKHLL

SEQ ID NO: 123525 - protein, 8 aa, West Nile virus
TAMKHLLS

SEQ ID NO: 123526 - protein, 8 aa, West Nile virus
AMKHLLSF

SEQ ID NO: 123527 - protein, 8 aa, West Nile virus
MKHLLSFK

SEQ ID NO: 123528 - protein, 8 aa, West Nile virus
KHLLSFKK

SEQ ID NO: 123529 - protein, 8 aa, West Nile virus
HLLSFKKE

SEQ ID NO: 123530 - protein, 8 aa, West Nile virus
LLSFKKEL

SEQ ID NO: 123531 - protein, 8 aa, West Nile virus
LSFKKELG

SEQ ID NO: 123532 - protein, 8 aa, West Nile virus
SFKKELGT

SEQ ID NO: 123533 - protein, 8 aa, West Nile virus
FKKELGTL

SEQ ID NO: 123534 - protein, 8 aa, West Nile virus
KKELGTLT

SEQ ID NO: 123535 - protein, 8 aa, West Nile virus
KELGTLTS

SEQ ID NO: 123536 - protein, 8 aa, West Nile virus
ELGTLTSA

SEQ ID NO: 123537 - protein, 8 aa, West Nile virus
LGTLTSAI

SEQ ID NO: 123538 - protein, 8 aa, West Nile virus
GTLTSAIN

SEQ ID NO: 123539 - protein, 8 aa, West Nile virus
TLTSAINR

SEQ ID NO: 123540 - protein, 8 aa, West Nile virus
LTSAINRR

SEQ ID NO: 123541 - protein, 8 aa, West Nile virus
TSAINRRS

SEQ ID NO: 123542 - protein, 8 aa, West Nile virus
NRRSSKQK

SEQ ID NO: 123543 - protein, 8 aa, West Nile virus
RRSSKQKK

SEQ ID NO: 123544 - protein, 8 aa, West Nile virus
RSSKQKKR

SEQ ID NO: 123545 - protein, 8 aa, West Nile virus
SSKQKKRG

SEQ ID NO: 123546 - protein, 8 aa, West Nile virus
SKQKKRGG

SEQ ID NO: 123547 - protein, 8 aa, West Nile virus
KQKKRGGK

SEQ ID NO: 123548 - protein, 8 aa, West Nile virus
QKKRGGKT

SEQ ID NO: 123549 - protein, 8 aa, West Nile virus
KKRGGKTG

SEQ ID NO: 123550 - protein, 8 aa, West Nile virus
GAVTLSNF

SEQ ID NO: 123551 - protein, 8 aa, West Nile virus
AVTLSNFQ

SEQ ID NO: 123552 - protein, 8 aa, West Nile virus
VTLSNFQG

SEQ ID NO: 123553 - protein, 8 aa, West Nile virus
TLSNFQGK

SEQ ID NO: 123554 - protein, 8 aa, West Nile virus
LSNFQGKV

SEQ ID NO: 123555 - protein, 8 aa, West Nile virus
SNFQGKVM

SEQ ID NO: 123556 - protein, 8 aa, West Nile virus
NFQGKVMM

SEQ ID NO: 123557 - protein, 8 aa, West Nile virus
FQGKVMMT

SEQ ID NO: 123558 - protein, 8 aa, West Nile virus
QGKVMMTV

SEQ ID NO: 123559 - protein, 8 aa, West Nile virus
GKVMMTVN

SEQ ID NO: 123560 - protein, 8 aa, West Nile virus
KVMMTVNA

SEQ ID NO: 123561 - protein, 8 aa, West Nile virus
VMMTVNAT

SEQ ID NO: 123562 - protein, 8 aa, West Nile virus
MMTVNATD

SEQ ID NO: 123563 - protein, 8 aa, West Nile virus
MTVNATDV

SEQ ID NO: 123564 - protein, 8 aa, West Nile virus
TVNATDVT

SEQ ID NO: 123565 - protein, 8 aa, West Nile virus
VITIPTAA

SEQ ID NO: 123566 - protein, 8 aa, West Nile virus
ITIPTAAG

SEQ ID NO: 123567 - protein, 8 aa, West Nile virus
TIPTAAGK

SEQ ID NO: 123568 - protein, 8 aa, West Nile virus
IPTAAGKN

SEQ ID NO: 123569 - protein, 8 aa, West Nile virus
PTAAGKNL

SEQ ID NO: 123570 - protein, 8 aa, West Nile virus
TAAGKNLC

SEQ ID NO: 123571 - protein, 8 aa, West Nile virus
AAGKNLCI

SEQ ID NO: 123572 - protein, 8 aa, West Nile virus
AGKNLCIV

SEQ ID NO: 123573 - protein, 8 aa, West Nile virus
GKNLCIVR

SEQ ID NO: 123574 - protein, 8 aa, West Nile virus
KNLCIVRA

SEQ ID NO: 123575 - protein, 8 aa, West Nile virus
NLCIVRAM

SEQ ID NO: 123576 - protein, 8 aa, West Nile virus
LCIVRAMD

SEQ ID NO: 123577 - protein, 8 aa, West Nile virus
CIVRAMDV

SEQ ID NO: 123578 - protein, 8 aa, West Nile virus
IVRAMDVG

SEQ ID NO: 123579 - protein, 8 aa, West Nile virus
VRAMDVGY

SEQ ID NO: 123580 - protein, 8 aa, West Nile virus
RAMDVGYM

SEQ ID NO: 123581 - protein, 8 aa, West Nile virus
AMDVGYMC

SEQ ID NO: 123582 - protein, 8 aa, West Nile virus
MDVGYMCD

SEQ ID NO: 123583 - protein, 8 aa, West Nile virus
DVGYMCDD

SEQ ID NO: 123584 - protein, 8 aa, West Nile virus
VGYMCDDT

SEQ ID NO: 123585 - protein, 8 aa, West Nile virus
GYMCDDTI

SEQ ID NO: 123586 - protein, 8 aa, West Nile virus
YMCDDTIT

SEQ ID NO: 123587 - protein, 8 aa, West Nile virus
MCDDTITY

SEQ ID NO: 123588 - protein, 8 aa, West Nile virus
CDDTITYE

SEQ ID NO: 123589 - protein, 8 aa, West Nile virus
DDTITYEC

SEQ ID NO: 123590 - protein, 8 aa, West Nile virus
DTITYECP

SEQ ID NO: 123591 - protein, 8 aa, West Nile virus
TITYECPV

SEQ ID NO: 123592 - protein, 8 aa, West Nile virus
ITYECPVL

SEQ ID NO: 123593 - protein, 8 aa, West Nile virus
TYECPVLS

SEQ ID NO: 123594 - protein, 8 aa, West Nile virus
YECPVLSA

SEQ ID NO: 123595 - protein, 8 aa, West Nile virus
ECPVLSAG

SEQ ID NO: 123596 - protein, 8 aa, West Nile virus
CPVLSAGN

SEQ ID NO: 123597 - protein, 8 aa, West Nile virus
PVLSAGND

SEQ ID NO: 123598 - protein, 8 aa, West Nile virus
VLSAGNDP

SEQ ID NO: 123599 - protein, 8 aa, West Nile virus
LSAGNDPE

SEQ ID NO: 123600 - protein, 8 aa, West Nile virus
SAGNDPED

SEQ ID NO: 123601 - protein, 8 aa, West Nile virus
AGNDPEDI

SEQ ID NO: 123602 - protein, 8 aa, West Nile virus
GNDPEDID

SEQ ID NO: 123603 - protein, 8 aa, West Nile virus
NDPEDIDC

SEQ ID NO: 123604 - protein, 8 aa, West Nile virus
DPEDIDCW

SEQ ID NO: 123605 - protein, 8 aa, West Nile virus
PEDIDCWC

SEQ ID NO: 123606 - protein, 8 aa, West Nile virus
EDIDCWCT

SEQ ID NO: 123607 - protein, 8 aa, West Nile virus
DIDCWCTK

SEQ ID NO: 123608 - protein, 8 aa, West Nile virus
IDCWCTKS

SEQ ID NO: 123609 - protein, 8 aa, West Nile virus
DCWCTKSA

SEQ ID NO: 123610 - protein, 8 aa, West Nile virus
CWCTKSAV

SEQ ID NO: 123611 - protein, 8 aa, West Nile virus
AVYVRYGR

SEQ ID NO: 123612 - protein, 8 aa, West Nile virus
VYVRYGRC

SEQ ID NO: 123613 - protein, 8 aa, West Nile virus
YVRYGRCT

SEQ ID NO: 123614 - protein, 8 aa, West Nile virus
VRYGRCTK

SEQ ID NO: 123615 - protein, 8 aa, West Nile virus
RYGRCTKT

SEQ ID NO: 123616 - protein, 8 aa, West Nile virus
YGRCTKTR

SEQ ID NO: 123617 - protein, 8 aa, West Nile virus
GRCTKTRH

SEQ ID NO: 123618 - protein, 8 aa, West Nile virus
RCTKTRHS

SEQ ID NO: 123619 - protein, 8 aa, West Nile virus
CTKTRHSR

SEQ ID NO: 123620 - protein, 8 aa, West Nile virus
TKTRHSRR

SEQ ID NO: 123621 - protein, 8 aa, West Nile virus
KTRHSRRS

SEQ ID NO: 123622 - protein, 8 aa, West Nile virus
TRHSRRSR

SEQ ID NO: 123623 - protein, 8 aa, West Nile virus
RHSRRSRR

SEQ ID NO: 123624 - protein, 8 aa, West Nile virus
HSRRSRRS

SEQ ID NO: 123625 - protein, 8 aa, West Nile virus
SRRSRRSL

SEQ ID NO: 123626 - protein, 8 aa, West Nile virus
RRSRRSLT

SEQ ID NO: 123627 - protein, 8 aa, West Nile virus
RSRRSLTV

SEQ ID NO: 123628 - protein, 8 aa, West Nile virus
SRRSLTVQ

SEQ ID NO: 123629 - protein, 8 aa, West Nile virus
RRSLTVQT

SEQ ID NO: 123630 - protein, 8 aa, West Nile virus
RSLTVQTH

SEQ ID NO: 123631 - protein, 8 aa, West Nile virus
SLTVQTHG

SEQ ID NO: 123632 - protein, 8 aa, West Nile virus
LTVQTHGE

SEQ ID NO: 123633 - protein, 8 aa, West Nile virus
TVQTHGES

SEQ ID NO: 123634 - protein, 8 aa, West Nile virus
VQTHGEST

SEQ ID NO: 123635 - protein, 8 aa, West Nile virus
QTHGESTL

SEQ ID NO: 123636 - protein, 8 aa, West Nile virus
THGESTLA

SEQ ID NO: 123637 - protein, 8 aa, West Nile virus
HGESTLAN

SEQ ID NO: 123638 - protein, 8 aa, West Nile virus
GESTLANK

SEQ ID NO: 123639 - protein, 8 aa, West Nile virus
ESTLANKK

SEQ ID NO: 123640 - protein, 8 aa, West Nile virus
STLANKKG

SEQ ID NO: 123641 - protein, 8 aa, West Nile virus
TLANKKGA

SEQ ID NO: 123642 - protein, 8 aa, West Nile virus
LANKKGAW

SEQ ID NO: 123643 - protein, 8 aa, West Nile virus
ANKKGAWM

SEQ ID NO: 123644 - protein, 8 aa, West Nile virus
NKKGAWMD

SEQ ID NO: 123645 - protein, 8 aa, West Nile virus
KKGAWMDS

SEQ ID NO: 123646 - protein, 8 aa, West Nile virus
KGAWMDST

SEQ ID NO: 123647 - protein, 8 aa, West Nile virus
GAWMDSTK

SEQ ID NO: 123648 - protein, 8 aa, West Nile virus
AWMDSTKA

SEQ ID NO: 123649 - protein, 8 aa, West Nile virus
WMDSTKAT

SEQ ID NO: 123650 - protein, 8 aa, West Nile virus
MDSTKATR

SEQ ID NO: 123651 - protein, 8 aa, West Nile virus
DSTKATRY

SEQ ID NO: 123652 - protein, 8 aa, West Nile virus
STKATRYL

SEQ ID NO: 123653 - protein, 8 aa, West Nile virus
TKATRYLV

SEQ ID NO: 123654 - protein, 8 aa, West Nile virus
KATRYLVK

SEQ ID NO: 123655 - protein, 8 aa, West Nile virus
ATRYLVKT

SEQ ID NO: 123656 - protein, 8 aa, West Nile virus
TRYLVKTE

SEQ ID NO: 123657 - protein, 8 aa, West Nile virus
RYLVKTES

SEQ ID NO: 123658 - protein, 8 aa, West Nile virus
YLVKTESW

SEQ ID NO: 123659 - protein, 8 aa, West Nile virus
LVKTESWI

SEQ ID NO: 123660 - protein, 8 aa, West Nile virus
VKTESWIL

SEQ ID NO: 123661 - protein, 8 aa, West Nile virus
KTESWILR

SEQ ID NO: 123662 - protein, 8 aa, West Nile virus
TESWILRN

SEQ ID NO: 123663 - protein, 8 aa, West Nile virus
ESWILRNP

SEQ ID NO: 123664 - protein, 8 aa, West Nile virus
SWILRNPG

SEQ ID NO: 123665 - protein, 8 aa, West Nile virus
WILRNPGY

SEQ ID NO: 123666 - protein, 8 aa, West Nile virus
ILRNPGYA

SEQ ID NO: 123667 - protein, 8 aa, West Nile virus
LRNPGYAL

SEQ ID NO: 123668 - protein, 8 aa, West Nile virus
RNPGYALV

SEQ ID NO: 123669 - protein, 8 aa, West Nile virus
NPGYALVA

SEQ ID NO: 123670 - protein, 8 aa, West Nile virus
PGYALVAA

SEQ ID NO: 123671 - protein, 8 aa, West Nile virus
GYALVAAV

SEQ ID NO: 123672 - protein, 8 aa, West Nile virus
YALVAAVI

SEQ ID NO: 123673 - protein, 8 aa, West Nile virus
ALVAAVIG

SEQ ID NO: 123674 - protein, 8 aa, West Nile virus
LVAAVIGW

SEQ ID NO: 123675 - protein, 8 aa, West Nile virus
VAAVIGWM

SEQ ID NO: 123676 - protein, 8 aa, West Nile virus
AAVIGWML

SEQ ID NO: 123677 - protein, 8 aa, West Nile virus
AVIGWMLG

SEQ ID NO: 123678 - protein, 8 aa, West Nile virus
VIGWMLGS

SEQ ID NO: 123679 - protein, 8 aa, West Nile virus
IGWMLGSN

SEQ ID NO: 123680 - protein, 8 aa, West Nile virus
GWMLGSNT

SEQ ID NO: 123681 - protein, 8 aa, West Nile virus
WMLGSNTM

SEQ ID NO: 123682 - protein, 8 aa, West Nile virus
MLGSNTMQ

SEQ ID NO: 123683 - protein, 8 aa, West Nile virus
LGSNTMQR

SEQ ID NO: 123684 - protein, 8 aa, West Nile virus
GSNTMQRV

SEQ ID NO: 123685 - protein, 8 aa, West Nile virus
SNTMQRVV

SEQ ID NO: 123686 - protein, 8 aa, West Nile virus
NTMQRVVF

SEQ ID NO: 123687 - protein, 8 aa, West Nile virus
TMQRVVFV

SEQ ID NO: 123688 - protein, 8 aa, West Nile virus
MQRVVFVV

SEQ ID NO: 123689 - protein, 8 aa, West Nile virus
QRVVFVVL

SEQ ID NO: 123690 - protein, 8 aa, West Nile virus
RVVFVVLL

SEQ ID NO: 123691 - protein, 8 aa, West Nile virus
VVFVVLLL

SEQ ID NO: 123692 - protein, 8 aa, West Nile virus
VFVVLLLL

SEQ ID NO: 123693 - protein, 8 aa, West Nile virus
FVVLLLLV

SEQ ID NO: 123694 - protein, 8 aa, West Nile virus
VVLLLLVA

SEQ ID NO: 123695 - protein, 8 aa, West Nile virus
VLLLLVAP

SEQ ID NO: 123696 - protein, 8 aa, West Nile virus
LLLLVAPA

SEQ ID NO: 123697 - protein, 8 aa, West Nile virus
LLLVAPAY

SEQ ID NO: 123698 - protein, 8 aa, West Nile virus
LLVAPAYS

SEQ ID NO: 123699 - protein, 8 aa, West Nile virus
LVAPAYSF

SEQ ID NO: 123700 - protein, 8 aa, West Nile virus
VAPAYSFN

SEQ ID NO: 123701 - protein, 8 aa, West Nile virus
APAYSFNC

SEQ ID NO: 123702 - protein, 8 aa, West Nile virus
PAYSFNCL

SEQ ID NO: 123703 - protein, 8 aa, West Nile virus
AYSFNCLG

SEQ ID NO: 123704 - protein, 8 aa, West Nile virus
YSFNCLGM

SEQ ID NO: 123705 - protein, 8 aa, West Nile virus
SFNCLGMS

SEQ ID NO: 123706 - protein, 8 aa, West Nile virus
FNCLGMSN

SEQ ID NO: 123707 - protein, 8 aa, West Nile virus
NCLGMSNR

SEQ ID NO: 123708 - protein, 8 aa, West Nile virus
CLGMSNRD

SEQ ID NO: 123709 - protein, 8 aa, West Nile virus
LGMSNRDF

SEQ ID NO: 123710 - protein, 8 aa, West Nile virus
GMSNRDFL

SEQ ID NO: 123711 - protein, 8 aa, West Nile virus
MSNRDFLE

SEQ ID NO: 123712 - protein, 8 aa, West Nile virus
SNRDFLEG

SEQ ID NO: 123713 - protein, 8 aa, West Nile virus
NRDFLEGV

SEQ ID NO: 123714 - protein, 8 aa, West Nile virus
RDFLEGVS

SEQ ID NO: 123715 - protein, 8 aa, West Nile virus
DFLEGVSG

SEQ ID NO: 123716 - protein, 8 aa, West Nile virus
FLEGVSGA

SEQ ID NO: 123717 - protein, 8 aa, West Nile virus
LEGVSGAT

SEQ ID NO: 123718 - protein, 8 aa, West Nile virus
EGVSGATW

SEQ ID NO: 123719 - protein, 8 aa, West Nile virus
GVSGATWV

SEQ ID NO: 123720 - protein, 8 aa, West Nile virus
VSGATWVD

SEQ ID NO: 123721 - protein, 8 aa, West Nile virus
SGATWVDL

SEQ ID NO: 123722 - protein, 8 aa, West Nile virus
GATWVDLV

SEQ ID NO: 123723 - protein, 8 aa, West Nile virus
ATWVDLVL

SEQ ID NO: 123724 - protein, 8 aa, West Nile virus
TWVDLVLE

SEQ ID NO: 123725 - protein, 8 aa, West Nile virus
WVDLVLEG

SEQ ID NO: 123726 - protein, 8 aa, West Nile virus
VDLVLEGD

SEQ ID NO: 123727 - protein, 8 aa, West Nile virus
DLVLEGDS

SEQ ID NO: 123728 - protein, 8 aa, West Nile virus
LVLEGDSC

SEQ ID NO: 123729 - protein, 8 aa, West Nile virus
VLEGDSCV

SEQ ID NO: 123730 - protein, 8 aa, West Nile virus
LEGDSCVT

SEQ ID NO: 123731 - protein, 8 aa, West Nile virus
EGDSCVTI

SEQ ID NO: 123732 - protein, 8 aa, West Nile virus
GDSCVTIM

SEQ ID NO: 123733 - protein, 8 aa, West Nile virus
DSCVTIMS

SEQ ID NO: 123734 - protein, 8 aa, West Nile virus
SCVTIMSK

SEQ ID NO: 123735 - protein, 8 aa, West Nile virus
CVTIMSKD

SEQ ID NO: 123736 - protein, 8 aa, West Nile virus
VTIMSKDK

SEQ ID NO: 123737 - protein, 8 aa, West Nile virus
TIMSKDKP

SEQ ID NO: 123738 - protein, 8 aa, West Nile virus
IMSKDKPT

SEQ ID NO: 123739 - protein, 8 aa, West Nile virus
MSKDKPTI

SEQ ID NO: 123740 - protein, 8 aa, West Nile virus
SKDKPTID

SEQ ID NO: 123741 - protein, 8 aa, West Nile virus
KDKPTIDV

SEQ ID NO: 123742 - protein, 8 aa, West Nile virus
DKPTIDVK

SEQ ID NO: 123743 - protein, 8 aa, West Nile virus
KPTIDVKM

SEQ ID NO: 123744 - protein, 8 aa, West Nile virus
PTIDVKMM

SEQ ID NO: 123745 - protein, 8 aa, West Nile virus
TIDVKMMN

SEQ ID NO: 123746 - protein, 8 aa, West Nile virus
IDVKMMNM

SEQ ID NO: 123747 - protein, 8 aa, West Nile virus
DVKMMNME

SEQ ID NO: 123748 - protein, 8 aa, West Nile virus
VKMMNMEA

SEQ ID NO: 123749 - protein, 8 aa, West Nile virus
LAEVRSYC

SEQ ID NO: 123750 - protein, 8 aa, West Nile virus
AEVRSYCY

SEQ ID NO: 123751 - protein, 8 aa, West Nile virus
EVRSYCYL

SEQ ID NO: 123752 - protein, 8 aa, West Nile virus
VRSYCYLA

SEQ ID NO: 123753 - protein, 8 aa, West Nile virus
VSDLSTKA

SEQ ID NO: 123754 - protein, 8 aa, West Nile virus
SDLSTKAA

SEQ ID NO: 123755 - protein, 8 aa, West Nile virus
DLSTKAAC

SEQ ID NO: 123756 - protein, 8 aa, West Nile virus
LSTKAACP

SEQ ID NO: 123757 - protein, 8 aa, West Nile virus
STKAACPT

SEQ ID NO: 123758 - protein, 8 aa, West Nile virus
TKAACPTM

SEQ ID NO: 123759 - protein, 8 aa, West Nile virus
KAACPTMG

SEQ ID NO: 123760 - protein, 8 aa, West Nile virus
AACPTMGE

SEQ ID NO: 123761 - protein, 8 aa, West Nile virus
ACPTMGEA

SEQ ID NO: 123762 - protein, 8 aa, West Nile virus
CPTMGEAH

SEQ ID NO: 123763 - protein, 8 aa, West Nile virus
PTMGEAHN

SEQ ID NO: 123764 - protein, 8 aa, West Nile virus
TMGEAHND

SEQ ID NO: 123765 - protein, 8 aa, West Nile virus
MGEAHNDK

SEQ ID NO: 123766 - protein, 8 aa, West Nile virus
GEAHNDKR

SEQ ID NO: 123767 - protein, 8 aa, West Nile virus
EAHNDKRA

SEQ ID NO: 123768 - protein, 8 aa, West Nile virus
AHNDKRAD

SEQ ID NO: 123769 - protein, 8 aa, West Nile virus
HNDKRADP

SEQ ID NO: 123770 - protein, 8 aa, West Nile virus
FVCRQGVV

SEQ ID NO: 123771 - protein, 8 aa, West Nile virus
VCRQGVVD

SEQ ID NO: 123772 - protein, 8 aa, West Nile virus
CRQGVVDR

SEQ ID NO: 123773 - protein, 8 aa, West Nile virus
RQGVVDRG

SEQ ID NO: 123774 - protein, 8 aa, West Nile virus
QGVVDRGW

SEQ ID NO: 123775 - protein, 8 aa, West Nile virus
GVVDRGWG

SEQ ID NO: 123776 - protein, 8 aa, West Nile virus
VVDRGWGN

SEQ ID NO: 123777 - protein, 8 aa, West Nile virus
VDRGWGNG

SEQ ID NO: 123778 - protein, 8 aa, West Nile virus
DRGWGNGC

SEQ ID NO: 123779 - protein, 8 aa, West Nile virus
RGWGNGCG

SEQ ID NO: 123780 - protein, 8 aa, West Nile virus
GWGNGCGL

SEQ ID NO: 123781 - protein, 8 aa, West Nile virus
WGNGCGLF

SEQ ID NO: 123782 - protein, 8 aa, West Nile virus
GNGCGLFG

SEQ ID NO: 123783 - protein, 8 aa, West Nile virus
NGCGLFGK

SEQ ID NO: 123784 - protein, 8 aa, West Nile virus
GCGLFGKG

SEQ ID NO: 123785 - protein, 8 aa, West Nile virus
CGLFGKGS

SEQ ID NO: 123786 - protein, 8 aa, West Nile virus
GLFGKGSI

SEQ ID NO: 123787 - protein, 8 aa, West Nile virus
LFGKGSID

SEQ ID NO: 123788 - protein, 8 aa, West Nile virus
FGKGSIDT

SEQ ID NO: 123789 - protein, 8 aa, West Nile virus
GKGSIDTC

SEQ ID NO: 123790 - protein, 8 aa, West Nile virus
KGSIDTCA

SEQ ID NO: 123791 - protein, 8 aa, West Nile virus
GSIDTCAK

SEQ ID NO: 123792 - protein, 8 aa, West Nile virus
SIDTCAKF

SEQ ID NO: 123793 - protein, 8 aa, West Nile virus
IDTCAKFA

SEQ ID NO: 123794 - protein, 8 aa, West Nile virus
DTCAKFAC

SEQ ID NO: 123795 - protein, 8 aa, West Nile virus
TCAKFACS

SEQ ID NO: 123796 - protein, 8 aa, West Nile virus
CAKFACST

SEQ ID NO: 123797 - protein, 8 aa, West Nile virus
AKFACSTK

SEQ ID NO: 123798 - protein, 8 aa, West Nile virus
KFACSTKA

SEQ ID NO: 123799 - protein, 8 aa, West Nile virus
FACSTKAI

SEQ ID NO: 123800 - protein, 8 aa, West Nile virus
ACSTKAIG

SEQ ID NO: 123801 - protein, 8 aa, West Nile virus
CSTKAIGR

SEQ ID NO: 123802 - protein, 8 aa, West Nile virus
STKAIGRT

SEQ ID NO: 123803 - protein, 8 aa, West Nile virus
TKAIGRTI

SEQ ID NO: 123804 - protein, 8 aa, West Nile virus
KAIGRTIL

SEQ ID NO: 123805 - protein, 8 aa, West Nile virus
AIGRTILK

SEQ ID NO: 123806 - protein, 8 aa, West Nile virus
IGRTILKE

SEQ ID NO: 123807 - protein, 8 aa, West Nile virus
GRTILKEN

SEQ ID NO: 123808 - protein, 8 aa, West Nile virus
RTILKENI

SEQ ID NO: 123809 - protein, 8 aa, West Nile virus
TILKENIK

SEQ ID NO: 123810 - protein, 8 aa, West Nile virus
ILKENIKY

SEQ ID NO: 123811 - protein, 8 aa, West Nile virus
LKENIKYE

SEQ ID NO: 123812 - protein, 8 aa, West Nile virus
KENIKYEV

SEQ ID NO: 123813 - protein, 8 aa, West Nile virus
ENIKYEVA

SEQ ID NO: 123814 - protein, 8 aa, West Nile virus
NIKYEVAI

SEQ ID NO: 123815 - protein, 8 aa, West Nile virus
IKYEVAIF

SEQ ID NO: 123816 - protein, 8 aa, West Nile virus
KYEVAIFV

SEQ ID NO: 123817 - protein, 8 aa, West Nile virus
YEVAIFVH

SEQ ID NO: 123818 - protein, 8 aa, West Nile virus
EVAIFVHG

SEQ ID NO: 123819 - protein, 8 aa, West Nile virus
VAIFVHGP

SEQ ID NO: 123820 - protein, 8 aa, West Nile virus
AIFVHGPT

SEQ ID NO: 123821 - protein, 8 aa, West Nile virus
IFVHGPTT

SEQ ID NO: 123822 - protein, 8 aa, West Nile virus
FVHGPTTV

SEQ ID NO: 123823 - protein, 8 aa, West Nile virus
VHGPTTVE

SEQ ID NO: 123824 - protein, 8 aa, West Nile virus
HGPTTVES

SEQ ID NO: 123825 - protein, 8 aa, West Nile virus
GPTTVESH

SEQ ID NO: 123826 - protein, 8 aa, West Nile virus
PTTVESHG

SEQ ID NO: 123827 - protein, 8 aa, West Nile virus
GATQAGRF

SEQ ID NO: 123828 - protein, 8 aa, West Nile virus
ATQAGRFS

SEQ ID NO: 123829 - protein, 8 aa, West Nile virus
TQAGRFSI

SEQ ID NO: 123830 - protein, 8 aa, West Nile virus
QAGRFSIT

SEQ ID NO: 123831 - protein, 8 aa, West Nile virus
AGRFSITP

SEQ ID NO: 123832 - protein, 8 aa, West Nile virus
GRFSITPA

SEQ ID NO: 123833 - protein, 8 aa, West Nile virus
RFSITPAA

SEQ ID NO: 123834 - protein, 8 aa, West Nile virus
FSITPAAP

SEQ ID NO: 123835 - protein, 8 aa, West Nile virus
SITPAAPS

SEQ ID NO: 123836 - protein, 8 aa, West Nile virus
ITPAAPSY

SEQ ID NO: 123837 - protein, 8 aa, West Nile virus
TPAAPSYT

SEQ ID NO: 123838 - protein, 8 aa, West Nile virus
KLGEYGEV

SEQ ID NO: 123839 - protein, 8 aa, West Nile virus
LGEYGEVT

SEQ ID NO: 123840 - protein, 8 aa, West Nile virus
GEYGEVTV

SEQ ID NO: 123841 - protein, 8 aa, West Nile virus
EYGEVTVD

SEQ ID NO: 123842 - protein, 8 aa, West Nile virus
YGEVTVDC

SEQ ID NO: 123843 - protein, 8 aa, West Nile virus
GEVTVDCE

SEQ ID NO: 123844 - protein, 8 aa, West Nile virus
EVTVDCEP

SEQ ID NO: 123845 - protein, 8 aa, West Nile virus
VTVDCEPR

SEQ ID NO: 123846 - protein, 8 aa, West Nile virus
TVDCEPRS

SEQ ID NO: 123847 - protein, 8 aa, West Nile virus
VDCEPRSG

SEQ ID NO: 123848 - protein, 8 aa, West Nile virus
DCEPRSGI

SEQ ID NO: 123849 - protein, 8 aa, West Nile virus
CEPRSGID

SEQ ID NO: 123850 - protein, 8 aa, West Nile virus
EPRSGIDT

SEQ ID NO: 123851 - protein, 8 aa, West Nile virus
PRSGIDTN

SEQ ID NO: 123852 - protein, 8 aa, West Nile virus
RSGIDTNA

SEQ ID NO: 123853 - protein, 8 aa, West Nile virus
SGIDTNAY

SEQ ID NO: 123854 - protein, 8 aa, West Nile virus
GIDTNAYY

SEQ ID NO: 123855 - protein, 8 aa, West Nile virus
IDTNAYYV

SEQ ID NO: 123856 - protein, 8 aa, West Nile virus
DTNAYYVM

SEQ ID NO: 123857 - protein, 8 aa, West Nile virus
TNAYYVMT

SEQ ID NO: 123858 - protein, 8 aa, West Nile virus
NAYYVMTV

SEQ ID NO: 123859 - protein, 8 aa, West Nile virus
AYYVMTVG

SEQ ID NO: 123860 - protein, 8 aa, West Nile virus
YVMTVGTK

SEQ ID NO: 123861 - protein, 8 aa, West Nile virus
KTFLVHRE

SEQ ID NO: 123862 - protein, 8 aa, West Nile virus
TFLVHREW

SEQ ID NO: 123863 - protein, 8 aa, West Nile virus
FLVHREWF

SEQ ID NO: 123864 - protein, 8 aa, West Nile virus
LVHREWFM

SEQ ID NO: 123865 - protein, 8 aa, West Nile virus
VHREWFMD

SEQ ID NO: 123866 - protein, 8 aa, West Nile virus
HREWFMDL

SEQ ID NO: 123867 - protein, 8 aa, West Nile virus
REWFMDLN

SEQ ID NO: 123868 - protein, 8 aa, West Nile virus
EWFMDLNL

SEQ ID NO: 123869 - protein, 8 aa, West Nile virus
WFMDLNLP

SEQ ID NO: 123870 - protein, 8 aa, West Nile virus
FMDLNLPW

SEQ ID NO: 123871 - protein, 8 aa, West Nile virus
MDLNLPWS

SEQ ID NO: 123872 - protein, 8 aa, West Nile virus
DLNLPWSS

SEQ ID NO: 123873 - protein, 8 aa, West Nile virus
LNLPWSSA

SEQ ID NO: 123874 - protein, 8 aa, West Nile virus
NLPWSSAG

SEQ ID NO: 123875 - protein, 8 aa, West Nile virus
LPWSSAGS

SEQ ID NO: 123876 - protein, 8 aa, West Nile virus
PWSSAGST

SEQ ID NO: 123877 - protein, 8 aa, West Nile virus
TVWRNRET

SEQ ID NO: 123878 - protein, 8 aa, West Nile virus
VWRNRETL

SEQ ID NO: 123879 - protein, 8 aa, West Nile virus
WRNRETLM

SEQ ID NO: 123880 - protein, 8 aa, West Nile virus
RNRETLME

SEQ ID NO: 123881 - protein, 8 aa, West Nile virus
NRETLMEF

SEQ ID NO: 123882 - protein, 8 aa, West Nile virus
RETLMEFE

SEQ ID NO: 123883 - protein, 8 aa, West Nile virus
ETLMEFEE

SEQ ID NO: 123884 - protein, 8 aa, West Nile virus
TLMEFEEP

SEQ ID NO: 123885 - protein, 8 aa, West Nile virus
LMEFEEPH

SEQ ID NO: 123886 - protein, 8 aa, West Nile virus
MEFEEPHA

SEQ ID NO: 123887 - protein, 8 aa, West Nile virus
EFEEPHAT

SEQ ID NO: 123888 - protein, 8 aa, West Nile virus
FEEPHATK

SEQ ID NO: 123889 - protein, 8 aa, West Nile virus
EEPHATKQ

SEQ ID NO: 123890 - protein, 8 aa, West Nile virus
EPHATKQS

SEQ ID NO: 123891 - protein, 8 aa, West Nile virus
PHATKQSV

SEQ ID NO: 123892 - protein, 8 aa, West Nile virus
HATKQSVI

SEQ ID NO: 123893 - protein, 8 aa, West Nile virus
ATKQSVIA

SEQ ID NO: 123894 - protein, 8 aa, West Nile virus
TKQSVIAL

SEQ ID NO: 123895 - protein, 8 aa, West Nile virus
KQSVIALG

SEQ ID NO: 123896 - protein, 8 aa, West Nile virus
QSVIALGS

SEQ ID NO: 123897 - protein, 8 aa, West Nile virus
SVIALGSQ

SEQ ID NO: 123898 - protein, 8 aa, West Nile virus
VIALGSQE

SEQ ID NO: 123899 - protein, 8 aa, West Nile virus
IALGSQEG

SEQ ID NO: 123900 - protein, 8 aa, West Nile virus
ALGSQEGA

SEQ ID NO: 123901 - protein, 8 aa, West Nile virus
LGSQEGAL

SEQ ID NO: 123902 - protein, 8 aa, West Nile virus
GSQEGALH

SEQ ID NO: 123903 - protein, 8 aa, West Nile virus
SQEGALHQ

SEQ ID NO: 123904 - protein, 8 aa, West Nile virus
QEGALHQA

SEQ ID NO: 123905 - protein, 8 aa, West Nile virus
EGALHQAL

SEQ ID NO: 123906 - protein, 8 aa, West Nile virus
GALHQALA

SEQ ID NO: 123907 - protein, 8 aa, West Nile virus
ALHQALAG

SEQ ID NO: 123908 - protein, 8 aa, West Nile virus
LHQALAGA

SEQ ID NO: 123909 - protein, 8 aa, West Nile virus
HQALAGAI

SEQ ID NO: 123910 - protein, 8 aa, West Nile virus
QALAGAIP

SEQ ID NO: 123911 - protein, 8 aa, West Nile virus
ALAGAIPV

SEQ ID NO: 123912 - protein, 8 aa, West Nile virus
LAGAIPVE

SEQ ID NO: 123913 - protein, 8 aa, West Nile virus
AGAIPVEF

SEQ ID NO: 123914 - protein, 8 aa, West Nile virus
GAIPVEFS

SEQ ID NO: 123915 - protein, 8 aa, West Nile virus
AIPVEFSS

SEQ ID NO: 123916 - protein, 8 aa, West Nile virus
IPVEFSSN

SEQ ID NO: 123917 - protein, 8 aa, West Nile virus
PVEFSSNT

SEQ ID NO: 123918 - protein, 8 aa, West Nile virus
VEFSSNTV

SEQ ID NO: 123919 - protein, 8 aa, West Nile virus
EFSSNTVK

SEQ ID NO: 123920 - protein, 8 aa, West Nile virus
FSSNTVKL

SEQ ID NO: 123921 - protein, 8 aa, West Nile virus
SSNTVKLT

SEQ ID NO: 123922 - protein, 8 aa, West Nile virus
SNTVKLTS

SEQ ID NO: 123923 - protein, 8 aa, West Nile virus
NTVKLTSG

SEQ ID NO: 123924 - protein, 8 aa, West Nile virus
TVKLTSGH

SEQ ID NO: 123925 - protein, 8 aa, West Nile virus
VKLTSGHL

SEQ ID NO: 123926 - protein, 8 aa, West Nile virus
KLTSGHLK

SEQ ID NO: 123927 - protein, 8 aa, West Nile virus
LTSGHLKC

SEQ ID NO: 123928 - protein, 8 aa, West Nile virus
TSGHLKCR

SEQ ID NO: 123929 - protein, 8 aa, West Nile virus
SGHLKCRV

SEQ ID NO: 123930 - protein, 8 aa, West Nile virus
GHLKCRVK

SEQ ID NO: 123931 - protein, 8 aa, West Nile virus
HLKCRVKM

SEQ ID NO: 123932 - protein, 8 aa, West Nile virus
LKCRVKME

SEQ ID NO: 123933 - protein, 8 aa, West Nile virus
KCRVKMEK

SEQ ID NO: 123934 - protein, 8 aa, West Nile virus
CRVKMEKL

SEQ ID NO: 123935 - protein, 8 aa, West Nile virus
RVKMEKLQ

SEQ ID NO: 123936 - protein, 8 aa, West Nile virus
VKMEKLQL

SEQ ID NO: 123937 - protein, 8 aa, West Nile virus
KMEKLQLK

SEQ ID NO: 123938 - protein, 8 aa, West Nile virus
MEKLQLKG

SEQ ID NO: 123939 - protein, 8 aa, West Nile virus
EKLQLKGT

SEQ ID NO: 123940 - protein, 8 aa, West Nile virus
KLQLKGTT

SEQ ID NO: 123941 - protein, 8 aa, West Nile virus
LQLKGTTY

SEQ ID NO: 123942 - protein, 8 aa, West Nile virus
QLKGTTYG

SEQ ID NO: 123943 - protein, 8 aa, West Nile virus
LKGTTYGV

SEQ ID NO: 123944 - protein, 8 aa, West Nile virus
KGTTYGVC

SEQ ID NO: 123945 - protein, 8 aa, West Nile virus
GTTYGVCS

SEQ ID NO: 123946 - protein, 8 aa, West Nile virus
TTYGVCSK

SEQ ID NO: 123947 - protein, 8 aa, West Nile virus
TYGVCSKA

SEQ ID NO: 123948 - protein, 8 aa, West Nile virus
YGVCSKAF

SEQ ID NO: 123949 - protein, 8 aa, West Nile virus
GVCSKAFK

SEQ ID NO: 123950 - protein, 8 aa, West Nile virus
VCSKAFKF

SEQ ID NO: 123951 - protein, 8 aa, West Nile virus
GTPADTGH

SEQ ID NO: 123952 - protein, 8 aa, West Nile virus
TPADTGHG

SEQ ID NO: 123953 - protein, 8 aa, West Nile virus
PADTGHGT

SEQ ID NO: 123954 - protein, 8 aa, West Nile virus
ADTGHGTV

SEQ ID NO: 123955 - protein, 8 aa, West Nile virus
DTGHGTVV

SEQ ID NO: 123956 - protein, 8 aa, West Nile virus
TGHGTVVL

SEQ ID NO: 123957 - protein, 8 aa, West Nile virus
GHGTVVLE

SEQ ID NO: 123958 - protein, 8 aa, West Nile virus
HGTVVLEL

SEQ ID NO: 123959 - protein, 8 aa, West Nile virus
GTVVLELQ

SEQ ID NO: 123960 - protein, 8 aa, West Nile virus
TVVLELQY

SEQ ID NO: 123961 - protein, 8 aa, West Nile virus
VVLELQYT

SEQ ID NO: 123962 - protein, 8 aa, West Nile virus
VLELQYTG

SEQ ID NO: 123963 - protein, 8 aa, West Nile virus
LELQYTGT

SEQ ID NO: 123964 - protein, 8 aa, West Nile virus
ELQYTGTD

SEQ ID NO: 123965 - protein, 8 aa, West Nile virus
LQYTGTDG

SEQ ID NO: 123966 - protein, 8 aa, West Nile virus
QYTGTDGP

SEQ ID NO: 123967 - protein, 8 aa, West Nile virus
YTGTDGPC

SEQ ID NO: 123968 - protein, 8 aa, West Nile virus
TGTDGPCK

SEQ ID NO: 123969 - protein, 8 aa, West Nile virus
GTDGPCKV

SEQ ID NO: 123970 - protein, 8 aa, West Nile virus
TDGPCKVP

SEQ ID NO: 123971 - protein, 8 aa, West Nile virus
DGPCKVPI

SEQ ID NO: 123972 - protein, 8 aa, West Nile virus
GPCKVPIS

SEQ ID NO: 123973 - protein, 8 aa, West Nile virus
PCKVPISS

SEQ ID NO: 123974 - protein, 8 aa, West Nile virus
CKVPISSV

SEQ ID NO: 123975 - protein, 8 aa, West Nile virus
KVPISSVA

SEQ ID NO: 123976 - protein, 8 aa, West Nile virus
VPISSVAS

SEQ ID NO: 123977 - protein, 8 aa, West Nile virus
PISSVASL

SEQ ID NO: 123978 - protein, 8 aa, West Nile virus
ISSVASLN

SEQ ID NO: 123979 - protein, 8 aa, West Nile virus
SSVASLND

SEQ ID NO: 123980 - protein, 8 aa, West Nile virus
SVASLNDL

SEQ ID NO: 123981 - protein, 8 aa, West Nile virus
VASLNDLT

SEQ ID NO: 123982 - protein, 8 aa, West Nile virus
ASLNDLTP

SEQ ID NO: 123983 - protein, 8 aa, West Nile virus
SLNDLTPV

SEQ ID NO: 123984 - protein, 8 aa, West Nile virus
LNDLTPVG

SEQ ID NO: 123985 - protein, 8 aa, West Nile virus
NDLTPVGR

SEQ ID NO: 123986 - protein, 8 aa, West Nile virus
DLTPVGRL

SEQ ID NO: 123987 - protein, 8 aa, West Nile virus
LTPVGRLV

SEQ ID NO: 123988 - protein, 8 aa, West Nile virus
TPVGRLVT

SEQ ID NO: 123989 - protein, 8 aa, West Nile virus
PVGRLVTV

SEQ ID NO: 123990 - protein, 8 aa, West Nile virus
VGRLVTVN

SEQ ID NO: 123991 - protein, 8 aa, West Nile virus
GRLVTVNP

SEQ ID NO: 123992 - protein, 8 aa, West Nile virus
RLVTVNPF

SEQ ID NO: 123993 - protein, 8 aa, West Nile virus
LVTVNPFV

SEQ ID NO: 123994 - protein, 8 aa, West Nile virus
VTVNPFVS

SEQ ID NO: 123995 - protein, 8 aa, West Nile virus
TVNPFVSV

SEQ ID NO: 123996 - protein, 8 aa, West Nile virus
VNPFVSVA

SEQ ID NO: 123997 - protein, 8 aa, West Nile virus
NPFVSVAT

SEQ ID NO: 123998 - protein, 8 aa, West Nile virus
PFVSVATA

SEQ ID NO: 123999 - protein, 8 aa, West Nile virus
ATANAKVL

SEQ ID NO: 124000 - protein, 8 aa, West Nile virus
TANAKVLI

SEQ ID NO: 124001 - protein, 8 aa, West Nile virus
ANAKVLIE

SEQ ID NO: 124002 - protein, 8 aa, West Nile virus
NAKVLIEL

SEQ ID NO: 124003 - protein, 8 aa, West Nile virus
AKVLIELE

SEQ ID NO: 124004 - protein, 8 aa, West Nile virus
KVLIELEP

SEQ ID NO: 124005 - protein, 8 aa, West Nile virus
VLIELEPP

SEQ ID NO: 124006 - protein, 8 aa, West Nile virus
LIELEPPF

SEQ ID NO: 124007 - protein, 8 aa, West Nile virus
IELEPPFG

SEQ ID NO: 124008 - protein, 8 aa, West Nile virus
ELEPPFGD

SEQ ID NO: 124009 - protein, 8 aa, West Nile virus
LEPPFGDS

SEQ ID NO: 124010 - protein, 8 aa, West Nile virus
EPPFGDSY

SEQ ID NO: 124011 - protein, 8 aa, West Nile virus
PPFGDSYI

SEQ ID NO: 124012 - protein, 8 aa, West Nile virus
PFGDSYIV

SEQ ID NO: 124013 - protein, 8 aa, West Nile virus
FGDSYIVV

SEQ ID NO: 124014 - protein, 8 aa, West Nile virus
GDSYIVVG

SEQ ID NO: 124015 - protein, 8 aa, West Nile virus
DSYIVVGR

SEQ ID NO: 124016 - protein, 8 aa, West Nile virus
SYIVVGRG

SEQ ID NO: 124017 - protein, 8 aa, West Nile virus
YIVVGRGE

SEQ ID NO: 124018 - protein, 8 aa, West Nile virus
IVVGRGEQ

SEQ ID NO: 124019 - protein, 8 aa, West Nile virus
VVGRGEQQ

SEQ ID NO: 124020 - protein, 8 aa, West Nile virus
VGRGEQQI

SEQ ID NO: 124021 - protein, 8 aa, West Nile virus
GRGEQQIN

SEQ ID NO: 124022 - protein, 8 aa, West Nile virus
RGEQQINH

SEQ ID NO: 124023 - protein, 8 aa, West Nile virus
GEQQINHH

SEQ ID NO: 124024 - protein, 8 aa, West Nile virus
EQQINHHW

SEQ ID NO: 124025 - protein, 8 aa, West Nile virus
QQINHHWH

SEQ ID NO: 124026 - protein, 8 aa, West Nile virus
QINHHWHK

SEQ ID NO: 124027 - protein, 8 aa, West Nile virus
INHHWHKS

SEQ ID NO: 124028 - protein, 8 aa, West Nile virus
NHHWHKSG

SEQ ID NO: 124029 - protein, 8 aa, West Nile virus
HHWHKSGS

SEQ ID NO: 124030 - protein, 8 aa, West Nile virus
HWHKSGSS

SEQ ID NO: 124031 - protein, 8 aa, West Nile virus
WHKSGSSI

SEQ ID NO: 124032 - protein, 8 aa, West Nile virus
HKSGSSIG

SEQ ID NO: 124033 - protein, 8 aa, West Nile virus
KSGSSIGK

SEQ ID NO: 124034 - protein, 8 aa, West Nile virus
SGSSIGKA

SEQ ID NO: 124035 - protein, 8 aa, West Nile virus
GSSIGKAF

SEQ ID NO: 124036 - protein, 8 aa, West Nile virus
SSIGKAFT

SEQ ID NO: 124037 - protein, 8 aa, West Nile virus
SIGKAFTT

SEQ ID NO: 124038 - protein, 8 aa, West Nile virus
IGKAFTTT

SEQ ID NO: 124039 - protein, 8 aa, West Nile virus
GKAFTTTL

SEQ ID NO: 124040 - protein, 8 aa, West Nile virus
KAFTTTLK

SEQ ID NO: 124041 - protein, 8 aa, West Nile virus
AFTTTLKG

SEQ ID NO: 124042 - protein, 8 aa, West Nile virus
FTTTLKGA

SEQ ID NO: 124043 - protein, 8 aa, West Nile virus
TTTLKGAQ

SEQ ID NO: 124044 - protein, 8 aa, West Nile virus
TTLKGAQR

SEQ ID NO: 124045 - protein, 8 aa, West Nile virus
TLKGAQRL

SEQ ID NO: 124046 - protein, 8 aa, West Nile virus
LKGAQRLA

SEQ ID NO: 124047 - protein, 8 aa, West Nile virus
KGAQRLAA

SEQ ID NO: 124048 - protein, 8 aa, West Nile virus
GAQRLAAL

SEQ ID NO: 124049 - protein, 8 aa, West Nile virus
AQRLAALG

SEQ ID NO: 124050 - protein, 8 aa, West Nile virus
QRLAALGD

SEQ ID NO: 124051 - protein, 8 aa, West Nile virus
RLAALGDT

SEQ ID NO: 124052 - protein, 8 aa, West Nile virus
LAALGDTA

SEQ ID NO: 124053 - protein, 8 aa, West Nile virus
AALGDTAW

SEQ ID NO: 124054 - protein, 8 aa, West Nile virus
ALGDTAWD

SEQ ID NO: 124055 - protein, 8 aa, West Nile virus
LGDTAWDF

SEQ ID NO: 124056 - protein, 8 aa, West Nile virus
GDTAWDFG

SEQ ID NO: 124057 - protein, 8 aa, West Nile virus
DTAWDFGS

SEQ ID NO: 124058 - protein, 8 aa, West Nile virus
TAWDFGSV

SEQ ID NO: 124059 - protein, 8 aa, West Nile virus
AWDFGSVG

SEQ ID NO: 124060 - protein, 8 aa, West Nile virus
WDFGSVGG

SEQ ID NO: 124061 - protein, 8 aa, West Nile virus
DFGSVGGV

SEQ ID NO: 124062 - protein, 8 aa, West Nile virus
FGSVGGVF

SEQ ID NO: 124063 - protein, 8 aa, West Nile virus
GSVGGVFT

SEQ ID NO: 124064 - protein, 8 aa, West Nile virus
SVGGVFTS

SEQ ID NO: 124065 - protein, 8 aa, West Nile virus
VGGVFTSV

SEQ ID NO: 124066 - protein, 8 aa, West Nile virus
GGVFTSVG

SEQ ID NO: 124067 - protein, 8 aa, West Nile virus
GVFTSVGK

SEQ ID NO: 124068 - protein, 8 aa, West Nile virus
VFTSVGKA

SEQ ID NO: 124069 - protein, 8 aa, West Nile virus
FTSVGKAV

SEQ ID NO: 124070 - protein, 8 aa, West Nile virus
TSVGKAVH

SEQ ID NO: 124071 - protein, 8 aa, West Nile virus
SVGKAVHQ

SEQ ID NO: 124072 - protein, 8 aa, West Nile virus
VGKAVHQV

SEQ ID NO: 124073 - protein, 8 aa, West Nile virus
GKAVHQVF

SEQ ID NO: 124074 - protein, 8 aa, West Nile virus
KAVHQVFG

SEQ ID NO: 124075 - protein, 8 aa, West Nile virus
AVHQVFGG

SEQ ID NO: 124076 - protein, 8 aa, West Nile virus
VHQVFGGA

SEQ ID NO: 124077 - protein, 8 aa, West Nile virus
HQVFGGAF

SEQ ID NO: 124078 - protein, 8 aa, West Nile virus
QVFGGAFR

SEQ ID NO: 124079 - protein, 8 aa, West Nile virus
VFGGAFRS

SEQ ID NO: 124080 - protein, 8 aa, West Nile virus
FGGAFRSL

SEQ ID NO: 124081 - protein, 8 aa, West Nile virus
GGAFRSLF

SEQ ID NO: 124082 - protein, 8 aa, West Nile virus
GAFRSLFG

SEQ ID NO: 124083 - protein, 8 aa, West Nile virus
AFRSLFGG

SEQ ID NO: 124084 - protein, 8 aa, West Nile virus
FRSLFGGM

SEQ ID NO: 124085 - protein, 8 aa, West Nile virus
RSLFGGMS

SEQ ID NO: 124086 - protein, 8 aa, West Nile virus
SLFGGMSW

SEQ ID NO: 124087 - protein, 8 aa, West Nile virus
LFGGMSWI

SEQ ID NO: 124088 - protein, 8 aa, West Nile virus
FGGMSWIT

SEQ ID NO: 124089 - protein, 8 aa, West Nile virus
GGMSWITQ

SEQ ID NO: 124090 - protein, 8 aa, West Nile virus
GMSWITQG

SEQ ID NO: 124091 - protein, 8 aa, West Nile virus
MSWITQGL

SEQ ID NO: 124092 - protein, 8 aa, West Nile virus
SWITQGLL

SEQ ID NO: 124093 - protein, 8 aa, West Nile virus
WITQGLLG

SEQ ID NO: 124094 - protein, 8 aa, West Nile virus
ITQGLLGA

SEQ ID NO: 124095 - protein, 8 aa, West Nile virus
TQGLLGAL

SEQ ID NO: 124096 - protein, 8 aa, West Nile virus
QGLLGALL

SEQ ID NO: 124097 - protein, 8 aa, West Nile virus
GLLGALLL

SEQ ID NO: 124098 - protein, 8 aa, West Nile virus
LLGALLLW

SEQ ID NO: 124099 - protein, 8 aa, West Nile virus
LGALLLWM

SEQ ID NO: 124100 - protein, 8 aa, West Nile virus
GALLLWMG

SEQ ID NO: 124101 - protein, 8 aa, West Nile virus
ALLLWMGI

SEQ ID NO: 124102 - protein, 8 aa, West Nile virus
LLLWMGIN

SEQ ID NO: 124103 - protein, 8 aa, West Nile virus
LLWMGINA

SEQ ID NO: 124104 - protein, 8 aa, West Nile virus
LWMGINAR

SEQ ID NO: 124105 - protein, 8 aa, West Nile virus
WMGINARD

SEQ ID NO: 124106 - protein, 8 aa, West Nile virus
MGINARDR

SEQ ID NO: 124107 - protein, 8 aa, West Nile virus
GINARDRS

SEQ ID NO: 124108 - protein, 8 aa, West Nile virus
INARDRSI

SEQ ID NO: 124109 - protein, 8 aa, West Nile virus
NARDRSIA

SEQ ID NO: 124110 - protein, 8 aa, West Nile virus
ARDRSIAL

SEQ ID NO: 124111 - protein, 8 aa, West Nile virus
RDRSIALT

SEQ ID NO: 124112 - protein, 8 aa, West Nile virus
DRSIALTF

SEQ ID NO: 124113 - protein, 8 aa, West Nile virus
RSIALTFL

SEQ ID NO: 124114 - protein, 8 aa, West Nile virus
SIALTFLA

SEQ ID NO: 124115 - protein, 8 aa, West Nile virus
IALTFLAV

SEQ ID NO: 124116 - protein, 8 aa, West Nile virus
ALTFLAVG

SEQ ID NO: 124117 - protein, 8 aa, West Nile virus
LTFLAVGG

SEQ ID NO: 124118 - protein, 8 aa, West Nile virus
TFLAVGGV

SEQ ID NO: 124119 - protein, 8 aa, West Nile virus
FLAVGGVL

SEQ ID NO: 124120 - protein, 8 aa, West Nile virus
LAVGGVLL

SEQ ID NO: 124121 - protein, 8 aa, West Nile virus
AVGGVLLF

SEQ ID NO: 124122 - protein, 8 aa, West Nile virus
VGGVLLFL

SEQ ID NO: 124123 - protein, 8 aa, West Nile virus
GGVLLFLS

SEQ ID NO: 124124 - protein, 8 aa, West Nile virus
GVLLFLSV

SEQ ID NO: 124125 - protein, 8 aa, West Nile virus
VLLFLSVN

SEQ ID NO: 124126 - protein, 8 aa, West Nile virus
LLFLSVNV

SEQ ID NO: 124127 - protein, 8 aa, West Nile virus
LFLSVNVH

SEQ ID NO: 124128 - protein, 8 aa, West Nile virus
FLSVNVHA

SEQ ID NO: 124129 - protein, 8 aa, West Nile virus
LSVNVHAD

SEQ ID NO: 124130 - protein, 8 aa, West Nile virus
SVNVHADT

SEQ ID NO: 124131 - protein, 8 aa, West Nile virus
VNVHADTG

SEQ ID NO: 124132 - protein, 8 aa, West Nile virus
NVHADTGC

SEQ ID NO: 124133 - protein, 8 aa, West Nile virus
VHADTGCA

SEQ ID NO: 124134 - protein, 8 aa, West Nile virus
HADTGCAI

SEQ ID NO: 124135 - protein, 8 aa, West Nile virus
ADTGCAID

SEQ ID NO: 124136 - protein, 8 aa, West Nile virus
DTGCAIDI

SEQ ID NO: 124137 - protein, 8 aa, West Nile virus
TGCAIDIS

SEQ ID NO: 124138 - protein, 8 aa, West Nile virus
GCAIDISR

SEQ ID NO: 124139 - protein, 8 aa, West Nile virus
CAIDISRQ

SEQ ID NO: 124140 - protein, 8 aa, West Nile virus
AIDISRQE

SEQ ID NO: 124141 - protein, 8 aa, West Nile virus
IDISRQEL

SEQ ID NO: 124142 - protein, 8 aa, West Nile virus
DISRQELR

SEQ ID NO: 124143 - protein, 8 aa, West Nile virus
ISRQELRC

SEQ ID NO: 124144 - protein, 8 aa, West Nile virus
SRQELRCG

SEQ ID NO: 124145 - protein, 8 aa, West Nile virus
RQELRCGS

SEQ ID NO: 124146 - protein, 8 aa, West Nile virus
QELRCGSG

SEQ ID NO: 124147 - protein, 8 aa, West Nile virus
ELRCGSGV

SEQ ID NO: 124148 - protein, 8 aa, West Nile virus
LRCGSGVF

SEQ ID NO: 124149 - protein, 8 aa, West Nile virus
RCGSGVFI

SEQ ID NO: 124150 - protein, 8 aa, West Nile virus
CGSGVFIH

SEQ ID NO: 124151 - protein, 8 aa, West Nile virus
GSGVFIHN

SEQ ID NO: 124152 - protein, 8 aa, West Nile virus
SGVFIHND

SEQ ID NO: 124153 - protein, 8 aa, West Nile virus
GVFIHNDV

SEQ ID NO: 124154 - protein, 8 aa, West Nile virus
VFIHNDVE

SEQ ID NO: 124155 - protein, 8 aa, West Nile virus
FIHNDVEA

SEQ ID NO: 124156 - protein, 8 aa, West Nile virus
IHNDVEAW

SEQ ID NO: 124157 - protein, 8 aa, West Nile virus
NDVEAWMD

SEQ ID NO: 124158 - protein, 8 aa, West Nile virus
DVEAWMDR

SEQ ID NO: 124159 - protein, 8 aa, West Nile virus
VEAWMDRY

SEQ ID NO: 124160 - protein, 8 aa, West Nile virus
EAWMDRYK

SEQ ID NO: 124161 - protein, 8 aa, West Nile virus
DRYKYYPE

SEQ ID NO: 124162 - protein, 8 aa, West Nile virus
RYKYYPET

SEQ ID NO: 124163 - protein, 8 aa, West Nile virus
YKYYPETP

SEQ ID NO: 124164 - protein, 8 aa, West Nile virus
KYYPETPQ

SEQ ID NO: 124165 - protein, 8 aa, West Nile virus
YYPETPQG

SEQ ID NO: 124166 - protein, 8 aa, West Nile virus
YPETPQGL

SEQ ID NO: 124167 - protein, 8 aa, West Nile virus
PETPQGLA

SEQ ID NO: 124168 - protein, 8 aa, West Nile virus
ETPQGLAK

SEQ ID NO: 124169 - protein, 8 aa, West Nile virus
TPQGLAKI

SEQ ID NO: 124170 - protein, 8 aa, West Nile virus
PQGLAKII

SEQ ID NO: 124171 - protein, 8 aa, West Nile virus
QGLAKIIQ

SEQ ID NO: 124172 - protein, 8 aa, West Nile virus
GLAKIIQK

SEQ ID NO: 124173 - protein, 8 aa, West Nile virus
LAKIIQKA

SEQ ID NO: 124174 - protein, 8 aa, West Nile virus
AKIIQKAH

SEQ ID NO: 124175 - protein, 8 aa, West Nile virus
IQKAHKEG

SEQ ID NO: 124176 - protein, 8 aa, West Nile virus
AHKEGVCG

SEQ ID NO: 124177 - protein, 8 aa, West Nile virus
EGVCGLRS

SEQ ID NO: 124178 - protein, 8 aa, West Nile virus
GVCGLRSV

SEQ ID NO: 124179 - protein, 8 aa, West Nile virus
VCGLRSVS

SEQ ID NO: 124180 - protein, 8 aa, West Nile virus
CGLRSVSR

SEQ ID NO: 124181 - protein, 8 aa, West Nile virus
GLRSVSRL

SEQ ID NO: 124182 - protein, 8 aa, West Nile virus
LRSVSRLE

SEQ ID NO: 124183 - protein, 8 aa, West Nile virus
RSVSRLEH

SEQ ID NO: 124184 - protein, 8 aa, West Nile virus
SVSRLEHQ

SEQ ID NO: 124185 - protein, 8 aa, West Nile virus
VSRLEHQM

SEQ ID NO: 124186 - protein, 8 aa, West Nile virus
SRLEHQMW

SEQ ID NO: 124187 - protein, 8 aa, West Nile virus
RLEHQMWE

SEQ ID NO: 124188 - protein, 8 aa, West Nile virus
LEHQMWEA

SEQ ID NO: 124189 - protein, 8 aa, West Nile virus
EHQMWEAV

SEQ ID NO: 124190 - protein, 8 aa, West Nile virus
HQMWEAVK

SEQ ID NO: 124191 - protein, 8 aa, West Nile virus
QMWEAVKD

SEQ ID NO: 124192 - protein, 8 aa, West Nile virus
MWEAVKDE

SEQ ID NO: 124193 - protein, 8 aa, West Nile virus
WEAVKDEL

SEQ ID NO: 124194 - protein, 8 aa, West Nile virus
EAVKDELN

SEQ ID NO: 124195 - protein, 8 aa, West Nile virus
AVKDELNT

SEQ ID NO: 124196 - protein, 8 aa, West Nile virus
VKDELNTL

SEQ ID NO: 124197 - protein, 8 aa, West Nile virus
KDELNTLL

SEQ ID NO: 124198 - protein, 8 aa, West Nile virus
DELNTLLK

SEQ ID NO: 124199 - protein, 8 aa, West Nile virus
ELNTLLKE

SEQ ID NO: 124200 - protein, 8 aa, West Nile virus
LNTLLKEN

SEQ ID NO: 124201 - protein, 8 aa, West Nile virus
NTLLKENG

SEQ ID NO: 124202 - protein, 8 aa, West Nile virus
TLLKENGV

SEQ ID NO: 124203 - protein, 8 aa, West Nile virus
LLKENGVD

SEQ ID NO: 124204 - protein, 8 aa, West Nile virus
LKENGVDL

SEQ ID NO: 124205 - protein, 8 aa, West Nile virus
KENGVDLS

SEQ ID NO: 124206 - protein, 8 aa, West Nile virus
ENGVDLSV

SEQ ID NO: 124207 - protein, 8 aa, West Nile virus
NGVDLSVV

SEQ ID NO: 124208 - protein, 8 aa, West Nile virus
GVDLSVVV

SEQ ID NO: 124209 - protein, 8 aa, West Nile virus
VDLSVVVE

SEQ ID NO: 124210 - protein, 8 aa, West Nile virus
DLSVVVEK

SEQ ID NO: 124211 - protein, 8 aa, West Nile virus
LSVVVEKQ

SEQ ID NO: 124212 - protein, 8 aa, West Nile virus
VVEKQEGM

SEQ ID NO: 124213 - protein, 8 aa, West Nile virus
APKRLTAT

SEQ ID NO: 124214 - protein, 8 aa, West Nile virus
ATTEKLEI

SEQ ID NO: 124215 - protein, 8 aa, West Nile virus
TTEKLEIG

SEQ ID NO: 124216 - protein, 8 aa, West Nile virus
TEKLEIGW

SEQ ID NO: 124217 - protein, 8 aa, West Nile virus
EKLEIGWK

SEQ ID NO: 124218 - protein, 8 aa, West Nile virus
KLEIGWKA

SEQ ID NO: 124219 - protein, 8 aa, West Nile virus
LEIGWKAW

SEQ ID NO: 124220 - protein, 8 aa, West Nile virus
EIGWKAWG

SEQ ID NO: 124221 - protein, 8 aa, West Nile virus
IGWKAWGK

SEQ ID NO: 124222 - protein, 8 aa, West Nile virus
GWKAWGKS

SEQ ID NO: 124223 - protein, 8 aa, West Nile virus
WKAWGKSI

SEQ ID NO: 124224 - protein, 8 aa, West Nile virus
KAWGKSIL

SEQ ID NO: 124225 - protein, 8 aa, West Nile virus
AWGKSILF

SEQ ID NO: 124226 - protein, 8 aa, West Nile virus
WGKSILFA

SEQ ID NO: 124227 - protein, 8 aa, West Nile virus
GKSILFAP

SEQ ID NO: 124228 - protein, 8 aa, West Nile virus
KSILFAPE

SEQ ID NO: 124229 - protein, 8 aa, West Nile virus
SILFAPEL

SEQ ID NO: 124230 - protein, 8 aa, West Nile virus
ILFAPELA

SEQ ID NO: 124231 - protein, 8 aa, West Nile virus
LFAPELAN

SEQ ID NO: 124232 - protein, 8 aa, West Nile virus
FAPELANN

SEQ ID NO: 124233 - protein, 8 aa, West Nile virus
APELANNT

SEQ ID NO: 124234 - protein, 8 aa, West Nile virus
PELANNTF

SEQ ID NO: 124235 - protein, 8 aa, West Nile virus
ELANNTFV

SEQ ID NO: 124236 - protein, 8 aa, West Nile virus
LANNTFVV

SEQ ID NO: 124237 - protein, 8 aa, West Nile virus
ANNTFVVD

SEQ ID NO: 124238 - protein, 8 aa, West Nile virus
NNTFVVDG

SEQ ID NO: 124239 - protein, 8 aa, West Nile virus
NTFVVDGP

SEQ ID NO: 124240 - protein, 8 aa, West Nile virus
TFVVDGPE

SEQ ID NO: 124241 - protein, 8 aa, West Nile virus
FVVDGPET

SEQ ID NO: 124242 - protein, 8 aa, West Nile virus
VVDGPETK

SEQ ID NO: 124243 - protein, 8 aa, West Nile virus
VDGPETKE

SEQ ID NO: 124244 - protein, 8 aa, West Nile virus
DGPETKEC

SEQ ID NO: 124245 - protein, 8 aa, West Nile virus
GPETKECP

SEQ ID NO: 124246 - protein, 8 aa, West Nile virus
PETKECPT

SEQ ID NO: 124247 - protein, 8 aa, West Nile virus
NRAWNSLE

SEQ ID NO: 124248 - protein, 8 aa, West Nile virus
RAWNSLEV

SEQ ID NO: 124249 - protein, 8 aa, West Nile virus
AWNSLEVE

SEQ ID NO: 124250 - protein, 8 aa, West Nile virus
WNSLEVED

SEQ ID NO: 124251 - protein, 8 aa, West Nile virus
NSLEVEDF

SEQ ID NO: 124252 - protein, 8 aa, West Nile virus
SLEVEDFG

SEQ ID NO: 124253 - protein, 8 aa, West Nile virus
LEVEDFGF

SEQ ID NO: 124254 - protein, 8 aa, West Nile virus
EVEDFGFG

SEQ ID NO: 124255 - protein, 8 aa, West Nile virus
VEDFGFGL

SEQ ID NO: 124256 - protein, 8 aa, West Nile virus
EDFGFGLT

SEQ ID NO: 124257 - protein, 8 aa, West Nile virus
DFGFGLTS

SEQ ID NO: 124258 - protein, 8 aa, West Nile virus
FGFGLTST

SEQ ID NO: 124259 - protein, 8 aa, West Nile virus
GFGLTSTR

SEQ ID NO: 124260 - protein, 8 aa, West Nile virus
FGLTSTRM

SEQ ID NO: 124261 - protein, 8 aa, West Nile virus
GLTSTRMF

SEQ ID NO: 124262 - protein, 8 aa, West Nile virus
LTSTRMFL

SEQ ID NO: 124263 - protein, 8 aa, West Nile virus
TSTRMFLK

SEQ ID NO: 124264 - protein, 8 aa, West Nile virus
VRESNTTE

SEQ ID NO: 124265 - protein, 8 aa, West Nile virus
RESNTTEC

SEQ ID NO: 124266 - protein, 8 aa, West Nile virus
ESNTTECD

SEQ ID NO: 124267 - protein, 8 aa, West Nile virus
SNTTECDS

SEQ ID NO: 124268 - protein, 8 aa, West Nile virus
NTTECDSK

SEQ ID NO: 124269 - protein, 8 aa, West Nile virus
TTECDSKI

SEQ ID NO: 124270 - protein, 8 aa, West Nile virus
TECDSKII

SEQ ID NO: 124271 - protein, 8 aa, West Nile virus
ECDSKIIG

SEQ ID NO: 124272 - protein, 8 aa, West Nile virus
CDSKIIGT

SEQ ID NO: 124273 - protein, 8 aa, West Nile virus
DSKIIGTA

SEQ ID NO: 124274 - protein, 8 aa, West Nile virus
SKIIGTAV

SEQ ID NO: 124275 - protein, 8 aa, West Nile virus
KIIGTAVK

SEQ ID NO: 124276 - protein, 8 aa, West Nile virus
IIGTAVKN

SEQ ID NO: 124277 - protein, 8 aa, West Nile virus
IGTAVKNN

SEQ ID NO: 124278 - protein, 8 aa, West Nile virus
GTAVKNNL

SEQ ID NO: 124279 - protein, 8 aa, West Nile virus
TAVKNNLA

SEQ ID NO: 124280 - protein, 8 aa, West Nile virus
AVKNNLAI

SEQ ID NO: 124281 - protein, 8 aa, West Nile virus
VKNNLAIH

SEQ ID NO: 124282 - protein, 8 aa, West Nile virus
KNNLAIHS

SEQ ID NO: 124283 - protein, 8 aa, West Nile virus
NNLAIHSD

SEQ ID NO: 124284 - protein, 8 aa, West Nile virus
NLAIHSDL

SEQ ID NO: 124285 - protein, 8 aa, West Nile virus
LAIHSDLS

SEQ ID NO: 124286 - protein, 8 aa, West Nile virus
AIHSDLSY

SEQ ID NO: 124287 - protein, 8 aa, West Nile virus
IHSDLSYW

SEQ ID NO: 124288 - protein, 8 aa, West Nile virus
HSDLSYWI

SEQ ID NO: 124289 - protein, 8 aa, West Nile virus
SDLSYWIE

SEQ ID NO: 124290 - protein, 8 aa, West Nile virus
DLSYWIES

SEQ ID NO: 124291 - protein, 8 aa, West Nile virus
LSYWIESR

SEQ ID NO: 124292 - protein, 8 aa, West Nile virus
SYWIESRL

SEQ ID NO: 124293 - protein, 8 aa, West Nile virus
YWIESRLN

SEQ ID NO: 124294 - protein, 8 aa, West Nile virus
LNDTWKLE

SEQ ID NO: 124295 - protein, 8 aa, West Nile virus
NDTWKLER

SEQ ID NO: 124296 - protein, 8 aa, West Nile virus
DTWKLERA

SEQ ID NO: 124297 - protein, 8 aa, West Nile virus
TWKLERAV

SEQ ID NO: 124298 - protein, 8 aa, West Nile virus
WKLERAVL

SEQ ID NO: 124299 - protein, 8 aa, West Nile virus
KLERAVLG

SEQ ID NO: 124300 - protein, 8 aa, West Nile virus
LERAVLGE

SEQ ID NO: 124301 - protein, 8 aa, West Nile virus
ERAVLGEV

SEQ ID NO: 124302 - protein, 8 aa, West Nile virus
RAVLGEVK

SEQ ID NO: 124303 - protein, 8 aa, West Nile virus
AVLGEVKS

SEQ ID NO: 124304 - protein, 8 aa, West Nile virus
VLGEVKSC

SEQ ID NO: 124305 - protein, 8 aa, West Nile virus
LGEVKSCT

SEQ ID NO: 124306 - protein, 8 aa, West Nile virus
GEVKSCTW

SEQ ID NO: 124307 - protein, 8 aa, West Nile virus
EVKSCTWP

SEQ ID NO: 124308 - protein, 8 aa, West Nile virus
VKSCTWPE

SEQ ID NO: 124309 - protein, 8 aa, West Nile virus
KSCTWPET

SEQ ID NO: 124310 - protein, 8 aa, West Nile virus
SCTWPETH

SEQ ID NO: 124311 - protein, 8 aa, West Nile virus
CTWPETHT

SEQ ID NO: 124312 - protein, 8 aa, West Nile virus
TWPETHTL

SEQ ID NO: 124313 - protein, 8 aa, West Nile virus
WPETHTLW

SEQ ID NO: 124314 - protein, 8 aa, West Nile virus
PETHTLWG

SEQ ID NO: 124315 - protein, 8 aa, West Nile virus
ETHTLWGD

SEQ ID NO: 124316 - protein, 8 aa, West Nile virus
THTLWGDG

SEQ ID NO: 124317 - protein, 8 aa, West Nile virus
HTLWGDGI

SEQ ID NO: 124318 - protein, 8 aa, West Nile virus
TLWGDGIL

SEQ ID NO: 124319 - protein, 8 aa, West Nile virus
LWGDGILE

SEQ ID NO: 124320 - protein, 8 aa, West Nile virus
WGDGILES

SEQ ID NO: 124321 - protein, 8 aa, West Nile virus
GILESDLI

SEQ ID NO: 124322 - protein, 8 aa, West Nile virus
ILESDLII

SEQ ID NO: 124323 - protein, 8 aa, West Nile virus
LESDLIIP

SEQ ID NO: 124324 - protein, 8 aa, West Nile virus
ESDLIIPV

SEQ ID NO: 124325 - protein, 8 aa, West Nile virus
SDLIIPVT

SEQ ID NO: 124326 - protein, 8 aa, West Nile virus
DLIIPVTL

SEQ ID NO: 124327 - protein, 8 aa, West Nile virus
LIIPVTLA

SEQ ID NO: 124328 - protein, 8 aa, West Nile virus
IIPVTLAG

SEQ ID NO: 124329 - protein, 8 aa, West Nile virus
IPVTLAGP

SEQ ID NO: 124330 - protein, 8 aa, West Nile virus
PVTLAGPR

SEQ ID NO: 124331 - protein, 8 aa, West Nile virus
VTLAGPRS

SEQ ID NO: 124332 - protein, 8 aa, West Nile virus
TLAGPRSN

SEQ ID NO: 124333 - protein, 8 aa, West Nile virus
LAGPRSNH

SEQ ID NO: 124334 - protein, 8 aa, West Nile virus
AGPRSNHN

SEQ ID NO: 124335 - protein, 8 aa, West Nile virus
GPRSNHNR

SEQ ID NO: 124336 - protein, 8 aa, West Nile virus
PRSNHNRR

SEQ ID NO: 124337 - protein, 8 aa, West Nile virus
RSNHNRRP

SEQ ID NO: 124338 - protein, 8 aa, West Nile virus
SNHNRRPG

SEQ ID NO: 124339 - protein, 8 aa, West Nile virus
NHNRRPGY

SEQ ID NO: 124340 - protein, 8 aa, West Nile virus
HNRRPGYK

SEQ ID NO: 124341 - protein, 8 aa, West Nile virus
NRRPGYKT

SEQ ID NO: 124342 - protein, 8 aa, West Nile virus
RRPGYKTQ

SEQ ID NO: 124343 - protein, 8 aa, West Nile virus
RPGYKTQN

SEQ ID NO: 124344 - protein, 8 aa, West Nile virus
PGYKTQNQ

SEQ ID NO: 124345 - protein, 8 aa, West Nile virus
GYKTQNQG

SEQ ID NO: 124346 - protein, 8 aa, West Nile virus
YKTQNQGP

SEQ ID NO: 124347 - protein, 8 aa, West Nile virus
KTQNQGPW

SEQ ID NO: 124348 - protein, 8 aa, West Nile virus
TQNQGPWD

SEQ ID NO: 124349 - protein, 8 aa, West Nile virus
QNQGPWDE

SEQ ID NO: 124350 - protein, 8 aa, West Nile virus
NQGPWDEG

SEQ ID NO: 124351 - protein, 8 aa, West Nile virus
QGPWDEGR

SEQ ID NO: 124352 - protein, 8 aa, West Nile virus
GPWDEGRV

SEQ ID NO: 124353 - protein, 8 aa, West Nile virus
PWDEGRVE

SEQ ID NO: 124354 - protein, 8 aa, West Nile virus
WDEGRVEI

SEQ ID NO: 124355 - protein, 8 aa, West Nile virus
DEGRVEID

SEQ ID NO: 124356 - protein, 8 aa, West Nile virus
EGRVEIDF

SEQ ID NO: 124357 - protein, 8 aa, West Nile virus
GRVEIDFD

SEQ ID NO: 124358 - protein, 8 aa, West Nile virus
RVEIDFDY

SEQ ID NO: 124359 - protein, 8 aa, West Nile virus
VEIDFDYC

SEQ ID NO: 124360 - protein, 8 aa, West Nile virus
EIDFDYCP

SEQ ID NO: 124361 - protein, 8 aa, West Nile virus
IDFDYCPG

SEQ ID NO: 124362 - protein, 8 aa, West Nile virus
DFDYCPGT

SEQ ID NO: 124363 - protein, 8 aa, West Nile virus
FDYCPGTT

SEQ ID NO: 124364 - protein, 8 aa, West Nile virus
DYCPGTTV

SEQ ID NO: 124365 - protein, 8 aa, West Nile virus
YCPGTTVT

SEQ ID NO: 124366 - protein, 8 aa, West Nile virus
CPGTTVTL

SEQ ID NO: 124367 - protein, 8 aa, West Nile virus
PGTTVTLS

SEQ ID NO: 124368 - protein, 8 aa, West Nile virus
SCGHRGPA

SEQ ID NO: 124369 - protein, 8 aa, West Nile virus
CGHRGPAT

SEQ ID NO: 124370 - protein, 8 aa, West Nile virus
GHRGPATR

SEQ ID NO: 124371 - protein, 8 aa, West Nile virus
HRGPATRT

SEQ ID NO: 124372 - protein, 8 aa, West Nile virus
RGPATRTT

SEQ ID NO: 124373 - protein, 8 aa, West Nile virus
GPATRTTT

SEQ ID NO: 124374 - protein, 8 aa, West Nile virus
PATRTTTE

SEQ ID NO: 124375 - protein, 8 aa, West Nile virus
ATRTTTES

SEQ ID NO: 124376 - protein, 8 aa, West Nile virus
TRTTTESG

SEQ ID NO: 124377 - protein, 8 aa, West Nile virus
RTTTESGK

SEQ ID NO: 124378 - protein, 8 aa, West Nile virus
TTTESGKL

SEQ ID NO: 124379 - protein, 8 aa, West Nile virus
TTESGKLI

SEQ ID NO: 124380 - protein, 8 aa, West Nile virus
TESGKLIT

SEQ ID NO: 124381 - protein, 8 aa, West Nile virus
ESGKLITD

SEQ ID NO: 124382 - protein, 8 aa, West Nile virus
SGKLITDW

SEQ ID NO: 124383 - protein, 8 aa, West Nile virus
GKLITDWC

SEQ ID NO: 124384 - protein, 8 aa, West Nile virus
KLITDWCC

SEQ ID NO: 124385 - protein, 8 aa, West Nile virus
LITDWCCR

SEQ ID NO: 124386 - protein, 8 aa, West Nile virus
ITDWCCRS

SEQ ID NO: 124387 - protein, 8 aa, West Nile virus
TDWCCRSC

SEQ ID NO: 124388 - protein, 8 aa, West Nile virus
DWCCRSCT

SEQ ID NO: 124389 - protein, 8 aa, West Nile virus
WCCRSCTL

SEQ ID NO: 124390 - protein, 8 aa, West Nile virus
CCRSCTLP

SEQ ID NO: 124391 - protein, 8 aa, West Nile virus
CRSCTLPP

SEQ ID NO: 124392 - protein, 8 aa, West Nile virus
RSCTLPPL

SEQ ID NO: 124393 - protein, 8 aa, West Nile virus
SCTLPPLR

SEQ ID NO: 124394 - protein, 8 aa, West Nile virus
CTLPPLRY

SEQ ID NO: 124395 - protein, 8 aa, West Nile virus
TLPPLRYQ

SEQ ID NO: 124396 - protein, 8 aa, West Nile virus
LPPLRYQT

SEQ ID NO: 124397 - protein, 8 aa, West Nile virus
PPLRYQTD

SEQ ID NO: 124398 - protein, 8 aa, West Nile virus
TDSGCWYG

SEQ ID NO: 124399 - protein, 8 aa, West Nile virus
DSGCWYGM

SEQ ID NO: 124400 - protein, 8 aa, West Nile virus
SGCWYGME

SEQ ID NO: 124401 - protein, 8 aa, West Nile virus
GCWYGMEI

SEQ ID NO: 124402 - protein, 8 aa, West Nile virus
CWYGMEIR

SEQ ID NO: 124403 - protein, 8 aa, West Nile virus
WYGMEIRP

SEQ ID NO: 124404 - protein, 8 aa, West Nile virus
YGMEIRPQ

SEQ ID NO: 124405 - protein, 8 aa, West Nile virus
GMEIRPQR

SEQ ID NO: 124406 - protein, 8 aa, West Nile virus
MEIRPQRH

SEQ ID NO: 124407 - protein, 8 aa, West Nile virus
EIRPQRHD

SEQ ID NO: 124408 - protein, 8 aa, West Nile virus
IRPQRHDE

SEQ ID NO: 124409 - protein, 8 aa, West Nile virus
RPQRHDEK

SEQ ID NO: 124410 - protein, 8 aa, West Nile virus
PQRHDEKT

SEQ ID NO: 124411 - protein, 8 aa, West Nile virus
QRHDEKTL

SEQ ID NO: 124412 - protein, 8 aa, West Nile virus
RHDEKTLV

SEQ ID NO: 124413 - protein, 8 aa, West Nile virus
HDEKTLVQ

SEQ ID NO: 124414 - protein, 8 aa, West Nile virus
DEKTLVQS

SEQ ID NO: 124415 - protein, 8 aa, West Nile virus
EKTLVQSQ

SEQ ID NO: 124416 - protein, 8 aa, West Nile virus
KTLVQSQV

SEQ ID NO: 124417 - protein, 8 aa, West Nile virus
TLVQSQVN

SEQ ID NO: 124418 - protein, 8 aa, West Nile virus
LVQSQVNA

SEQ ID NO: 124419 - protein, 8 aa, West Nile virus
VQSQVNAY

SEQ ID NO: 124420 - protein, 8 aa, West Nile virus
QSQVNAYN

SEQ ID NO: 124421 - protein, 8 aa, West Nile virus
SQVNAYNA

SEQ ID NO: 124422 - protein, 8 aa, West Nile virus
QVNAYNAD

SEQ ID NO: 124423 - protein, 8 aa, West Nile virus
VNAYNADM

SEQ ID NO: 124424 - protein, 8 aa, West Nile virus
NAYNADMI

SEQ ID NO: 124425 - protein, 8 aa, West Nile virus
AYNADMID

SEQ ID NO: 124426 - protein, 8 aa, West Nile virus
YNADMIDP

SEQ ID NO: 124427 - protein, 8 aa, West Nile virus
NADMIDPF

SEQ ID NO: 124428 - protein, 8 aa, West Nile virus
ADMIDPFQ

SEQ ID NO: 124429 - protein, 8 aa, West Nile virus
DMIDPFQL

SEQ ID NO: 124430 - protein, 8 aa, West Nile virus
MIDPFQLG

SEQ ID NO: 124431 - protein, 8 aa, West Nile virus
IDPFQLGL

SEQ ID NO: 124432 - protein, 8 aa, West Nile virus
DPFQLGLL

SEQ ID NO: 124433 - protein, 8 aa, West Nile virus
PFQLGLLV

SEQ ID NO: 124434 - protein, 8 aa, West Nile virus
FQLGLLVV

SEQ ID NO: 124435 - protein, 8 aa, West Nile virus
QLGLLVVF

SEQ ID NO: 124436 - protein, 8 aa, West Nile virus
LGLLVVFL

SEQ ID NO: 124437 - protein, 8 aa, West Nile virus
GLLVVFLA

SEQ ID NO: 124438 - protein, 8 aa, West Nile virus
LLVVFLAT

SEQ ID NO: 124439 - protein, 8 aa, West Nile virus
LVVFLATQ

SEQ ID NO: 124440 - protein, 8 aa, West Nile virus
VVFLATQE

SEQ ID NO: 124441 - protein, 8 aa, West Nile virus
VFLATQEV

SEQ ID NO: 124442 - protein, 8 aa, West Nile virus
FLATQEVL

SEQ ID NO: 124443 - protein, 8 aa, West Nile virus
LATQEVLR

SEQ ID NO: 124444 - protein, 8 aa, West Nile virus
ATQEVLRK

SEQ ID NO: 124445 - protein, 8 aa, West Nile virus
TQEVLRKR

SEQ ID NO: 124446 - protein, 8 aa, West Nile virus
QEVLRKRW

SEQ ID NO: 124447 - protein, 8 aa, West Nile virus
EVLRKRWT

SEQ ID NO: 124448 - protein, 8 aa, West Nile virus
VLRKRWTA

SEQ ID NO: 124449 - protein, 8 aa, West Nile virus
LRKRWTAK

SEQ ID NO: 124450 - protein, 8 aa, West Nile virus
RKRWTAKI

SEQ ID NO: 124451 - protein, 8 aa, West Nile virus
KRWTAKIS

SEQ ID NO: 124452 - protein, 8 aa, West Nile virus
RWTAKISM

SEQ ID NO: 124453 - protein, 8 aa, West Nile virus
WTAKISMP

SEQ ID NO: 124454 - protein, 8 aa, West Nile virus
TAKISMPA

SEQ ID NO: 124455 - protein, 8 aa, West Nile virus
AKISMPAI

SEQ ID NO: 124456 - protein, 8 aa, West Nile virus
PAILIALL

SEQ ID NO: 124457 - protein, 8 aa, West Nile virus
AILIALLV

SEQ ID NO: 124458 - protein, 8 aa, West Nile virus
ILIALLVL

SEQ ID NO: 124459 - protein, 8 aa, West Nile virus
LIALLVLV

SEQ ID NO: 124460 - protein, 8 aa, West Nile virus
IALLVLVF

SEQ ID NO: 124461 - protein, 8 aa, West Nile virus
ALLVLVFG

SEQ ID NO: 124462 - protein, 8 aa, West Nile virus
LLVLVFGG

SEQ ID NO: 124463 - protein, 8 aa, West Nile virus
LVLVFGGI

SEQ ID NO: 124464 - protein, 8 aa, West Nile virus
VLVFGGIT

SEQ ID NO: 124465 - protein, 8 aa, West Nile virus
LVFGGITY

SEQ ID NO: 124466 - protein, 8 aa, West Nile virus
VFGGITYT

SEQ ID NO: 124467 - protein, 8 aa, West Nile virus
FGGITYTD

SEQ ID NO: 124468 - protein, 8 aa, West Nile virus
GGITYTDV

SEQ ID NO: 124469 - protein, 8 aa, West Nile virus
GITYTDVL

SEQ ID NO: 124470 - protein, 8 aa, West Nile virus
ITYTDVLR

SEQ ID NO: 124471 - protein, 8 aa, West Nile virus
TYTDVLRY

SEQ ID NO: 124472 - protein, 8 aa, West Nile virus
YTDVLRYV

SEQ ID NO: 124473 - protein, 8 aa, West Nile virus
TDVLRYVI

SEQ ID NO: 124474 - protein, 8 aa, West Nile virus
DVLRYVIL

SEQ ID NO: 124475 - protein, 8 aa, West Nile virus
VLRYVILV

SEQ ID NO: 124476 - protein, 8 aa, West Nile virus
LRYVILVG

SEQ ID NO: 124477 - protein, 8 aa, West Nile virus
RYVILVGA

SEQ ID NO: 124478 - protein, 8 aa, West Nile virus
YVILVGAA

SEQ ID NO: 124479 - protein, 8 aa, West Nile virus
VILVGAAF

SEQ ID NO: 124480 - protein, 8 aa, West Nile virus
ILVGAAFA

SEQ ID NO: 124481 - protein, 8 aa, West Nile virus
LVGAAFAE

SEQ ID NO: 124482 - protein, 8 aa, West Nile virus
VGAAFAES

SEQ ID NO: 124483 - protein, 8 aa, West Nile virus
GAAFAESN

SEQ ID NO: 124484 - protein, 8 aa, West Nile virus
AAFAESNS

SEQ ID NO: 124485 - protein, 8 aa, West Nile virus
AFAESNSG

SEQ ID NO: 124486 - protein, 8 aa, West Nile virus
FAESNSGG

SEQ ID NO: 124487 - protein, 8 aa, West Nile virus
AESNSGGD

SEQ ID NO: 124488 - protein, 8 aa, West Nile virus
ESNSGGDV

SEQ ID NO: 124489 - protein, 8 aa, West Nile virus
SNSGGDVV

SEQ ID NO: 124490 - protein, 8 aa, West Nile virus
NSGGDVVH

SEQ ID NO: 124491 - protein, 8 aa, West Nile virus
SGGDVVHL

SEQ ID NO: 124492 - protein, 8 aa, West Nile virus
GGDVVHLA

SEQ ID NO: 124493 - protein, 8 aa, West Nile virus
GDVVHLAL

SEQ ID NO: 124494 - protein, 8 aa, West Nile virus
DVVHLALM

SEQ ID NO: 124495 - protein, 8 aa, West Nile virus
VVHLALMA

SEQ ID NO: 124496 - protein, 8 aa, West Nile virus
VHLALMAT

SEQ ID NO: 124497 - protein, 8 aa, West Nile virus
HLALMATF

SEQ ID NO: 124498 - protein, 8 aa, West Nile virus
LALMATFK

SEQ ID NO: 124499 - protein, 8 aa, West Nile virus
ALMATFKI

SEQ ID NO: 124500 - protein, 8 aa, West Nile virus
LMATFKIQ

SEQ ID NO: 124501 - protein, 8 aa, West Nile virus
MATFKIQP

SEQ ID NO: 124502 - protein, 8 aa, West Nile virus
ATFKIQPV

SEQ ID NO: 124503 - protein, 8 aa, West Nile virus
TFKIQPVF

SEQ ID NO: 124504 - protein, 8 aa, West Nile virus
IQPVFMVA

SEQ ID NO: 124505 - protein, 8 aa, West Nile virus
QPVFMVAS

SEQ ID NO: 124506 - protein, 8 aa, West Nile virus
PVFMVASF

SEQ ID NO: 124507 - protein, 8 aa, West Nile virus
VFMVASFL

SEQ ID NO: 124508 - protein, 8 aa, West Nile virus
FMVASFLK

SEQ ID NO: 124509 - protein, 8 aa, West Nile virus
MVASFLKA

SEQ ID NO: 124510 - protein, 8 aa, West Nile virus
VASFLKAR

SEQ ID NO: 124511 - protein, 8 aa, West Nile virus
ASFLKARW

SEQ ID NO: 124512 - protein, 8 aa, West Nile virus
SFLKARWT

SEQ ID NO: 124513 - protein, 8 aa, West Nile virus
FLKARWTN

SEQ ID NO: 124514 - protein, 8 aa, West Nile virus
KARWTNQE

SEQ ID NO: 124515 - protein, 8 aa, West Nile virus
ARWTNQEN

SEQ ID NO: 124516 - protein, 8 aa, West Nile virus
RWTNQENI

SEQ ID NO: 124517 - protein, 8 aa, West Nile virus
WTNQENIL

SEQ ID NO: 124518 - protein, 8 aa, West Nile virus
TNQENILL

SEQ ID NO: 124519 - protein, 8 aa, West Nile virus
NQENILLM

SEQ ID NO: 124520 - protein, 8 aa, West Nile virus
QENILLML

SEQ ID NO: 124521 - protein, 8 aa, West Nile virus
ENILLMLA

SEQ ID NO: 124522 - protein, 8 aa, West Nile virus
NILLMLAA

SEQ ID NO: 124523 - protein, 8 aa, West Nile virus
ILLMLAAV

SEQ ID NO: 124524 - protein, 8 aa, West Nile virus
LLMLAAVF

SEQ ID NO: 124525 - protein, 8 aa, West Nile virus
LMLAAVFF

SEQ ID NO: 124526 - protein, 8 aa, West Nile virus
MLAAVFFQ

SEQ ID NO: 124527 - protein, 8 aa, West Nile virus
LAAVFFQM

SEQ ID NO: 124528 - protein, 8 aa, West Nile virus
AAVFFQMA

SEQ ID NO: 124529 - protein, 8 aa, West Nile virus
AVFFQMAY

SEQ ID NO: 124530 - protein, 8 aa, West Nile virus
VFFQMAYH

SEQ ID NO: 124531 - protein, 8 aa, West Nile virus
FFQMAYHD

SEQ ID NO: 124532 - protein, 8 aa, West Nile virus
FQMAYHDA

SEQ ID NO: 124533 - protein, 8 aa, West Nile virus
QMAYHDAR

SEQ ID NO: 124534 - protein, 8 aa, West Nile virus
WEIPDVLN

SEQ ID NO: 124535 - protein, 8 aa, West Nile virus
EIPDVLNS

SEQ ID NO: 124536 - protein, 8 aa, West Nile virus
IPDVLNSL

SEQ ID NO: 124537 - protein, 8 aa, West Nile virus
PDVLNSLA

SEQ ID NO: 124538 - protein, 8 aa, West Nile virus
DVLNSLAV

SEQ ID NO: 124539 - protein, 8 aa, West Nile virus
VLNSLAVA

SEQ ID NO: 124540 - protein, 8 aa, West Nile virus
LNSLAVAW

SEQ ID NO: 124541 - protein, 8 aa, West Nile virus
NSLAVAWM

SEQ ID NO: 124542 - protein, 8 aa, West Nile virus
SLAVAWMI

SEQ ID NO: 124543 - protein, 8 aa, West Nile virus
LAVAWMIL

SEQ ID NO: 124544 - protein, 8 aa, West Nile virus
AVAWMILR

SEQ ID NO: 124545 - protein, 8 aa, West Nile virus
VAWMILRA

SEQ ID NO: 124546 - protein, 8 aa, West Nile virus
AWMILRAI

SEQ ID NO: 124547 - protein, 8 aa, West Nile virus
WMILRAIT

SEQ ID NO: 124548 - protein, 8 aa, West Nile virus
MILRAITF

SEQ ID NO: 124549 - protein, 8 aa, West Nile virus
ILRAITFT

SEQ ID NO: 124550 - protein, 8 aa, West Nile virus
FTTTSNVV

SEQ ID NO: 124551 - protein, 8 aa, West Nile virus
TTTSNVVV

SEQ ID NO: 124552 - protein, 8 aa, West Nile virus
TTSNVVVP

SEQ ID NO: 124553 - protein, 8 aa, West Nile virus
TSNVVVPL

SEQ ID NO: 124554 - protein, 8 aa, West Nile virus
SNVVVPLL

SEQ ID NO: 124555 - protein, 8 aa, West Nile virus
NVVVPLLA

SEQ ID NO: 124556 - protein, 8 aa, West Nile virus
VVVPLLAL

SEQ ID NO: 124557 - protein, 8 aa, West Nile virus
VVPLLALL

SEQ ID NO: 124558 - protein, 8 aa, West Nile virus
VPLLALLT

SEQ ID NO: 124559 - protein, 8 aa, West Nile virus
PLLALLTP

SEQ ID NO: 124560 - protein, 8 aa, West Nile virus
LLALLTPG

SEQ ID NO: 124561 - protein, 8 aa, West Nile virus
LALLTPGL

SEQ ID NO: 124562 - protein, 8 aa, West Nile virus
ALLTPGLR

SEQ ID NO: 124563 - protein, 8 aa, West Nile virus
LLTPGLRC

SEQ ID NO: 124564 - protein, 8 aa, West Nile virus
LTPGLRCL

SEQ ID NO: 124565 - protein, 8 aa, West Nile virus
TPGLRCLN

SEQ ID NO: 124566 - protein, 8 aa, West Nile virus
PGLRCLNL

SEQ ID NO: 124567 - protein, 8 aa, West Nile virus
GLRCLNLD

SEQ ID NO: 124568 - protein, 8 aa, West Nile virus
LRCLNLDV

SEQ ID NO: 124569 - protein, 8 aa, West Nile virus
RCLNLDVY

SEQ ID NO: 124570 - protein, 8 aa, West Nile virus
CLNLDVYR

SEQ ID NO: 124571 - protein, 8 aa, West Nile virus
LNLDVYRI

SEQ ID NO: 124572 - protein, 8 aa, West Nile virus
NLDVYRIL

SEQ ID NO: 124573 - protein, 8 aa, West Nile virus
LDVYRILL

SEQ ID NO: 124574 - protein, 8 aa, West Nile virus
DVYRILLL

SEQ ID NO: 124575 - protein, 8 aa, West Nile virus
VYRILLLM

SEQ ID NO: 124576 - protein, 8 aa, West Nile virus
YRILLLMV

SEQ ID NO: 124577 - protein, 8 aa, West Nile virus
RILLLMVG

SEQ ID NO: 124578 - protein, 8 aa, West Nile virus
ILLLMVGI

SEQ ID NO: 124579 - protein, 8 aa, West Nile virus
LLLMVGIG

SEQ ID NO: 124580 - protein, 8 aa, West Nile virus
LLMVGIGS

SEQ ID NO: 124581 - protein, 8 aa, West Nile virus
LMVGIGSL

SEQ ID NO: 124582 - protein, 8 aa, West Nile virus
MVGIGSLI

SEQ ID NO: 124583 - protein, 8 aa, West Nile virus
VGIGSLIR

SEQ ID NO: 124584 - protein, 8 aa, West Nile virus
GIGSLIRE

SEQ ID NO: 124585 - protein, 8 aa, West Nile virus
IGSLIREK

SEQ ID NO: 124586 - protein, 8 aa, West Nile virus
GSLIREKR

SEQ ID NO: 124587 - protein, 8 aa, West Nile virus
SLIREKRS

SEQ ID NO: 124588 - protein, 8 aa, West Nile virus
EKRSAAAK

SEQ ID NO: 124589 - protein, 8 aa, West Nile virus
KRSAAAKK

SEQ ID NO: 124590 - protein, 8 aa, West Nile virus
RSAAAKKK

SEQ ID NO: 124591 - protein, 8 aa, West Nile virus
SAAAKKKG

SEQ ID NO: 124592 - protein, 8 aa, West Nile virus
AAAKKKGA

SEQ ID NO: 124593 - protein, 8 aa, West Nile virus
AAKKKGAS

SEQ ID NO: 124594 - protein, 8 aa, West Nile virus
AKKKGASL

SEQ ID NO: 124595 - protein, 8 aa, West Nile virus
KKKGASLL

SEQ ID NO: 124596 - protein, 8 aa, West Nile virus
KKGASLLC

SEQ ID NO: 124597 - protein, 8 aa, West Nile virus
KGASLLCL

SEQ ID NO: 124598 - protein, 8 aa, West Nile virus
GASLLCLA

SEQ ID NO: 124599 - protein, 8 aa, West Nile virus
ASLLCLAL

SEQ ID NO: 124600 - protein, 8 aa, West Nile virus
SLLCLALA

SEQ ID NO: 124601 - protein, 8 aa, West Nile virus
LLCLALAS

SEQ ID NO: 124602 - protein, 8 aa, West Nile virus
LCLALAST

SEQ ID NO: 124603 - protein, 8 aa, West Nile virus
CLALASTG

SEQ ID NO: 124604 - protein, 8 aa, West Nile virus
FNPMILAA

SEQ ID NO: 124605 - protein, 8 aa, West Nile virus
NPMILAAG

SEQ ID NO: 124606 - protein, 8 aa, West Nile virus
PMILAAGL

SEQ ID NO: 124607 - protein, 8 aa, West Nile virus
MILAAGLI

SEQ ID NO: 124608 - protein, 8 aa, West Nile virus
LAAGLIAC

SEQ ID NO: 124609 - protein, 8 aa, West Nile virus
AAGLIACD

SEQ ID NO: 124610 - protein, 8 aa, West Nile virus
AGLIACDP

SEQ ID NO: 124611 - protein, 8 aa, West Nile virus
GLIACDPN

SEQ ID NO: 124612 - protein, 8 aa, West Nile virus
LIACDPNR

SEQ ID NO: 124613 - protein, 8 aa, West Nile virus
IACDPNRK

SEQ ID NO: 124614 - protein, 8 aa, West Nile virus
ACDPNRKR

SEQ ID NO: 124615 - protein, 8 aa, West Nile virus
CDPNRKRG

SEQ ID NO: 124616 - protein, 8 aa, West Nile virus
DPNRKRGW

SEQ ID NO: 124617 - protein, 8 aa, West Nile virus
PNRKRGWP

SEQ ID NO: 124618 - protein, 8 aa, West Nile virus
NRKRGWPA

SEQ ID NO: 124619 - protein, 8 aa, West Nile virus
RKRGWPAT

SEQ ID NO: 124620 - protein, 8 aa, West Nile virus
KRGWPATE

SEQ ID NO: 124621 - protein, 8 aa, West Nile virus
RGWPATEV

SEQ ID NO: 124622 - protein, 8 aa, West Nile virus
GWPATEVM

SEQ ID NO: 124623 - protein, 8 aa, West Nile virus
WPATEVMT

SEQ ID NO: 124624 - protein, 8 aa, West Nile virus
PATEVMTA

SEQ ID NO: 124625 - protein, 8 aa, West Nile virus
ATEVMTAV

SEQ ID NO: 124626 - protein, 8 aa, West Nile virus
TEVMTAVG

SEQ ID NO: 124627 - protein, 8 aa, West Nile virus
EVMTAVGL

SEQ ID NO: 124628 - protein, 8 aa, West Nile virus
VMTAVGLM

SEQ ID NO: 124629 - protein, 8 aa, West Nile virus
MTAVGLMF

SEQ ID NO: 124630 - protein, 8 aa, West Nile virus
TAVGLMFA

SEQ ID NO: 124631 - protein, 8 aa, West Nile virus
AVGLMFAI

SEQ ID NO: 124632 - protein, 8 aa, West Nile virus
VGLMFAIV

SEQ ID NO: 124633 - protein, 8 aa, West Nile virus
GLMFAIVG

SEQ ID NO: 124634 - protein, 8 aa, West Nile virus
LMFAIVGG

SEQ ID NO: 124635 - protein, 8 aa, West Nile virus
MFAIVGGL

SEQ ID NO: 124636 - protein, 8 aa, West Nile virus
FAIVGGLA

SEQ ID NO: 124637 - protein, 8 aa, West Nile virus
AIVGGLAE

SEQ ID NO: 124638 - protein, 8 aa, West Nile virus
IVGGLAEL

SEQ ID NO: 124639 - protein, 8 aa, West Nile virus
VGGLAELD

SEQ ID NO: 124640 - protein, 8 aa, West Nile virus
GGLAELDI

SEQ ID NO: 124641 - protein, 8 aa, West Nile virus
GLAELDID

SEQ ID NO: 124642 - protein, 8 aa, West Nile virus
LAELDIDS

SEQ ID NO: 124643 - protein, 8 aa, West Nile virus
AELDIDSM

SEQ ID NO: 124644 - protein, 8 aa, West Nile virus
ELDIDSMA

SEQ ID NO: 124645 - protein, 8 aa, West Nile virus
LDIDSMAI

SEQ ID NO: 124646 - protein, 8 aa, West Nile virus
DIDSMAIP

SEQ ID NO: 124647 - protein, 8 aa, West Nile virus
IDSMAIPM

SEQ ID NO: 124648 - protein, 8 aa, West Nile virus
DSMAIPMT

SEQ ID NO: 124649 - protein, 8 aa, West Nile virus
SMAIPMTI

SEQ ID NO: 124650 - protein, 8 aa, West Nile virus
MAIPMTIA

SEQ ID NO: 124651 - protein, 8 aa, West Nile virus
AIPMTIAG

SEQ ID NO: 124652 - protein, 8 aa, West Nile virus
IPMTIAGL

SEQ ID NO: 124653 - protein, 8 aa, West Nile virus
PMTIAGLM

SEQ ID NO: 124654 - protein, 8 aa, West Nile virus
MTIAGLMF

SEQ ID NO: 124655 - protein, 8 aa, West Nile virus
TIAGLMFA

SEQ ID NO: 124656 - protein, 8 aa, West Nile virus
IAGLMFAA

SEQ ID NO: 124657 - protein, 8 aa, West Nile virus
AGLMFAAF

SEQ ID NO: 124658 - protein, 8 aa, West Nile virus
GLMFAAFV

SEQ ID NO: 124659 - protein, 8 aa, West Nile virus
LMFAAFVI

SEQ ID NO: 124660 - protein, 8 aa, West Nile virus
MFAAFVIS

SEQ ID NO: 124661 - protein, 8 aa, West Nile virus
FAAFVISG

SEQ ID NO: 124662 - protein, 8 aa, West Nile virus
AAFVISGK

SEQ ID NO: 124663 - protein, 8 aa, West Nile virus
AFVISGKS

SEQ ID NO: 124664 - protein, 8 aa, West Nile virus
FVISGKST

SEQ ID NO: 124665 - protein, 8 aa, West Nile virus
VISGKSTD

SEQ ID NO: 124666 - protein, 8 aa, West Nile virus
ISGKSTDM

SEQ ID NO: 124667 - protein, 8 aa, West Nile virus
SGKSTDMW

SEQ ID NO: 124668 - protein, 8 aa, West Nile virus
GKSTDMWI

SEQ ID NO: 124669 - protein, 8 aa, West Nile virus
KSTDMWIE

SEQ ID NO: 124670 - protein, 8 aa, West Nile virus
STDMWIER

SEQ ID NO: 124671 - protein, 8 aa, West Nile virus
TDMWIERT

SEQ ID NO: 124672 - protein, 8 aa, West Nile virus
DMWIERTA

SEQ ID NO: 124673 - protein, 8 aa, West Nile virus
MWIERTAD

SEQ ID NO: 124674 - protein, 8 aa, West Nile virus
WIERTADI

SEQ ID NO: 124675 - protein, 8 aa, West Nile virus
IERTADIS

SEQ ID NO: 124676 - protein, 8 aa, West Nile virus
ERTADISW

SEQ ID NO: 124677 - protein, 8 aa, West Nile virus
RTADISWE

SEQ ID NO: 124678 - protein, 8 aa, West Nile virus
TADISWES

SEQ ID NO: 124679 - protein, 8 aa, West Nile virus
ADISWESD

SEQ ID NO: 124680 - protein, 8 aa, West Nile virus
DISWESDA

SEQ ID NO: 124681 - protein, 8 aa, West Nile virus
ISWESDAE

SEQ ID NO: 124682 - protein, 8 aa, West Nile virus
SWESDAEI

SEQ ID NO: 124683 - protein, 8 aa, West Nile virus
WESDAEIT

SEQ ID NO: 124684 - protein, 8 aa, West Nile virus
ESDAEITG

SEQ ID NO: 124685 - protein, 8 aa, West Nile virus
SDAEITGS

SEQ ID NO: 124686 - protein, 8 aa, West Nile virus
DAEITGSS

SEQ ID NO: 124687 - protein, 8 aa, West Nile virus
AEITGSSE

SEQ ID NO: 124688 - protein, 8 aa, West Nile virus
EITGSSER

SEQ ID NO: 124689 - protein, 8 aa, West Nile virus
ITGSSERV

SEQ ID NO: 124690 - protein, 8 aa, West Nile virus
TGSSERVD

SEQ ID NO: 124691 - protein, 8 aa, West Nile virus
GSSERVDV

SEQ ID NO: 124692 - protein, 8 aa, West Nile virus
SSERVDVR

SEQ ID NO: 124693 - protein, 8 aa, West Nile virus
SERVDVRL

SEQ ID NO: 124694 - protein, 8 aa, West Nile virus
ERVDVRLD

SEQ ID NO: 124695 - protein, 8 aa, West Nile virus
RVDVRLDD

SEQ ID NO: 124696 - protein, 8 aa, West Nile virus
VDVRLDDD

SEQ ID NO: 124697 - protein, 8 aa, West Nile virus
DVRLDDDG

SEQ ID NO: 124698 - protein, 8 aa, West Nile virus
VRLDDDGN

SEQ ID NO: 124699 - protein, 8 aa, West Nile virus
RLDDDGNF

SEQ ID NO: 124700 - protein, 8 aa, West Nile virus
LDDDGNFQ

SEQ ID NO: 124701 - protein, 8 aa, West Nile virus
DDDGNFQL

SEQ ID NO: 124702 - protein, 8 aa, West Nile virus
DDGNFQLM

SEQ ID NO: 124703 - protein, 8 aa, West Nile virus
DGNFQLMN

SEQ ID NO: 124704 - protein, 8 aa, West Nile virus
GNFQLMND

SEQ ID NO: 124705 - protein, 8 aa, West Nile virus
NFQLMNDP

SEQ ID NO: 124706 - protein, 8 aa, West Nile virus
FQLMNDPG

SEQ ID NO: 124707 - protein, 8 aa, West Nile virus
QLMNDPGA

SEQ ID NO: 124708 - protein, 8 aa, West Nile virus
LMNDPGAP

SEQ ID NO: 124709 - protein, 8 aa, West Nile virus
MNDPGAPW

SEQ ID NO: 124710 - protein, 8 aa, West Nile virus
NDPGAPWK

SEQ ID NO: 124711 - protein, 8 aa, West Nile virus
DPGAPWKI

SEQ ID NO: 124712 - protein, 8 aa, West Nile virus
PGAPWKIW

SEQ ID NO: 124713 - protein, 8 aa, West Nile virus
GAPWKIWM

SEQ ID NO: 124714 - protein, 8 aa, West Nile virus
APWKIWML

SEQ ID NO: 124715 - protein, 8 aa, West Nile virus
PWKIWMLR

SEQ ID NO: 124716 - protein, 8 aa, West Nile virus
WKIWMLRM

SEQ ID NO: 124717 - protein, 8 aa, West Nile virus
WMLRMVCL

SEQ ID NO: 124718 - protein, 8 aa, West Nile virus
MLRMVCLA

SEQ ID NO: 124719 - protein, 8 aa, West Nile virus
MVCLAISA

SEQ ID NO: 124720 - protein, 8 aa, West Nile virus
VCLAISAY

SEQ ID NO: 124721 - protein, 8 aa, West Nile virus
CLAISAYT

SEQ ID NO: 124722 - protein, 8 aa, West Nile virus
LAISAYTP

SEQ ID NO: 124723 - protein, 8 aa, West Nile virus
AISAYTPW

SEQ ID NO: 124724 - protein, 8 aa, West Nile virus
ISAYTPWA

SEQ ID NO: 124725 - protein, 8 aa, West Nile virus
SAYTPWAI

SEQ ID NO: 124726 - protein, 8 aa, West Nile virus
AYTPWAIL

SEQ ID NO: 124727 - protein, 8 aa, West Nile virus
YTPWAILP

SEQ ID NO: 124728 - protein, 8 aa, West Nile virus
TPWAILPS

SEQ ID NO: 124729 - protein, 8 aa, West Nile virus
PWAILPSV

SEQ ID NO: 124730 - protein, 8 aa, West Nile virus
WAILPSVV

SEQ ID NO: 124731 - protein, 8 aa, West Nile virus
AILPSVVG

SEQ ID NO: 124732 - protein, 8 aa, West Nile virus
ILPSVVGF

SEQ ID NO: 124733 - protein, 8 aa, West Nile virus
LPSVVGFW

SEQ ID NO: 124734 - protein, 8 aa, West Nile virus
PSVVGFWI

SEQ ID NO: 124735 - protein, 8 aa, West Nile virus
SVVGFWIT

SEQ ID NO: 124736 - protein, 8 aa, West Nile virus
VVGFWITL

SEQ ID NO: 124737 - protein, 8 aa, West Nile virus
VGFWITLQ

SEQ ID NO: 124738 - protein, 8 aa, West Nile virus
GFWITLQY

SEQ ID NO: 124739 - protein, 8 aa, West Nile virus
FWITLQYT

SEQ ID NO: 124740 - protein, 8 aa, West Nile virus
WITLQYTK

SEQ ID NO: 124741 - protein, 8 aa, West Nile virus
ITLQYTKR

SEQ ID NO: 124742 - protein, 8 aa, West Nile virus
TLQYTKRG

SEQ ID NO: 124743 - protein, 8 aa, West Nile virus
LQYTKRGG

SEQ ID NO: 124744 - protein, 8 aa, West Nile virus
QYTKRGGV

SEQ ID NO: 124745 - protein, 8 aa, West Nile virus
YTKRGGVL

SEQ ID NO: 124746 - protein, 8 aa, West Nile virus
TKRGGVLW

SEQ ID NO: 124747 - protein, 8 aa, West Nile virus
KRGGVLWD

SEQ ID NO: 124748 - protein, 8 aa, West Nile virus
RGGVLWDT

SEQ ID NO: 124749 - protein, 8 aa, West Nile virus
GGVLWDTP

SEQ ID NO: 124750 - protein, 8 aa, West Nile virus
GVLWDTPS

SEQ ID NO: 124751 - protein, 8 aa, West Nile virus
VLWDTPSP

SEQ ID NO: 124752 - protein, 8 aa, West Nile virus
LWDTPSPK

SEQ ID NO: 124753 - protein, 8 aa, West Nile virus
WDTPSPKE

SEQ ID NO: 124754 - protein, 8 aa, West Nile virus
DTPSPKEY

SEQ ID NO: 124755 - protein, 8 aa, West Nile virus
TPSPKEYK

SEQ ID NO: 124756 - protein, 8 aa, West Nile virus
EYKKGDTT

SEQ ID NO: 124757 - protein, 8 aa, West Nile virus
YKKGDTTT

SEQ ID NO: 124758 - protein, 8 aa, West Nile virus
KKGDTTTG

SEQ ID NO: 124759 - protein, 8 aa, West Nile virus
KGDTTTGV

SEQ ID NO: 124760 - protein, 8 aa, West Nile virus
GDTTTGVY

SEQ ID NO: 124761 - protein, 8 aa, West Nile virus
DTTTGVYR

SEQ ID NO: 124762 - protein, 8 aa, West Nile virus
TTTGVYRI

SEQ ID NO: 124763 - protein, 8 aa, West Nile virus
TTGVYRIM

SEQ ID NO: 124764 - protein, 8 aa, West Nile virus
TGVYRIMT

SEQ ID NO: 124765 - protein, 8 aa, West Nile virus
GVYRIMTR

SEQ ID NO: 124766 - protein, 8 aa, West Nile virus
VYRIMTRG

SEQ ID NO: 124767 - protein, 8 aa, West Nile virus
YRIMTRGL

SEQ ID NO: 124768 - protein, 8 aa, West Nile virus
RIMTRGLL

SEQ ID NO: 124769 - protein, 8 aa, West Nile virus
IMTRGLLG

SEQ ID NO: 124770 - protein, 8 aa, West Nile virus
MTRGLLGS

SEQ ID NO: 124771 - protein, 8 aa, West Nile virus
TRGLLGSY

SEQ ID NO: 124772 - protein, 8 aa, West Nile virus
RGLLGSYQ

SEQ ID NO: 124773 - protein, 8 aa, West Nile virus
GLLGSYQA

SEQ ID NO: 124774 - protein, 8 aa, West Nile virus
LLGSYQAG

SEQ ID NO: 124775 - protein, 8 aa, West Nile virus
LGSYQAGA

SEQ ID NO: 124776 - protein, 8 aa, West Nile virus
GSYQAGAG

SEQ ID NO: 124777 - protein, 8 aa, West Nile virus
SYQAGAGV

SEQ ID NO: 124778 - protein, 8 aa, West Nile virus
YQAGAGVM

SEQ ID NO: 124779 - protein, 8 aa, West Nile virus
QAGAGVMV

SEQ ID NO: 124780 - protein, 8 aa, West Nile virus
AGAGVMVE

SEQ ID NO: 124781 - protein, 8 aa, West Nile virus
GAGVMVEG

SEQ ID NO: 124782 - protein, 8 aa, West Nile virus
AGVMVEGV

SEQ ID NO: 124783 - protein, 8 aa, West Nile virus
GVMVEGVF

SEQ ID NO: 124784 - protein, 8 aa, West Nile virus
VMVEGVFH

SEQ ID NO: 124785 - protein, 8 aa, West Nile virus
MVEGVFHT

SEQ ID NO: 124786 - protein, 8 aa, West Nile virus
VEGVFHTL

SEQ ID NO: 124787 - protein, 8 aa, West Nile virus
EGVFHTLW

SEQ ID NO: 124788 - protein, 8 aa, West Nile virus
GVFHTLWH

SEQ ID NO: 124789 - protein, 8 aa, West Nile virus
VFHTLWHT

SEQ ID NO: 124790 - protein, 8 aa, West Nile virus
FHTLWHTT

SEQ ID NO: 124791 - protein, 8 aa, West Nile virus
HTLWHTTK

SEQ ID NO: 124792 - protein, 8 aa, West Nile virus
TLWHTTKG

SEQ ID NO: 124793 - protein, 8 aa, West Nile virus
LWHTTKGA

SEQ ID NO: 124794 - protein, 8 aa, West Nile virus
WHTTKGAA

SEQ ID NO: 124795 - protein, 8 aa, West Nile virus
HTTKGAAL

SEQ ID NO: 124796 - protein, 8 aa, West Nile virus
TTKGAALM

SEQ ID NO: 124797 - protein, 8 aa, West Nile virus
TKGAALMS

SEQ ID NO: 124798 - protein, 8 aa, West Nile virus
KGAALMSG

SEQ ID NO: 124799 - protein, 8 aa, West Nile virus
GAALMSGE

SEQ ID NO: 124800 - protein, 8 aa, West Nile virus
AALMSGEG

SEQ ID NO: 124801 - protein, 8 aa, West Nile virus
ALMSGEGR

SEQ ID NO: 124802 - protein, 8 aa, West Nile virus
LMSGEGRL

SEQ ID NO: 124803 - protein, 8 aa, West Nile virus
MSGEGRLD

SEQ ID NO: 124804 - protein, 8 aa, West Nile virus
SGEGRLDP

SEQ ID NO: 124805 - protein, 8 aa, West Nile virus
GEGRLDPY

SEQ ID NO: 124806 - protein, 8 aa, West Nile virus
EGRLDPYW

SEQ ID NO: 124807 - protein, 8 aa, West Nile virus
GRLDPYWG

SEQ ID NO: 124808 - protein, 8 aa, West Nile virus
RLDPYWGS

SEQ ID NO: 124809 - protein, 8 aa, West Nile virus
LDPYWGSV

SEQ ID NO: 124810 - protein, 8 aa, West Nile virus
DPYWGSVK

SEQ ID NO: 124811 - protein, 8 aa, West Nile virus
PYWGSVKE

SEQ ID NO: 124812 - protein, 8 aa, West Nile virus
YWGSVKED

SEQ ID NO: 124813 - protein, 8 aa, West Nile virus
WGSVKEDR

SEQ ID NO: 124814 - protein, 8 aa, West Nile virus
GSVKEDRL

SEQ ID NO: 124815 - protein, 8 aa, West Nile virus
SVKEDRLC

SEQ ID NO: 124816 - protein, 8 aa, West Nile virus
VKEDRLCY

SEQ ID NO: 124817 - protein, 8 aa, West Nile virus
KEDRLCYG

SEQ ID NO: 124818 - protein, 8 aa, West Nile virus
EDRLCYGG

SEQ ID NO: 124819 - protein, 8 aa, West Nile virus
DRLCYGGP

SEQ ID NO: 124820 - protein, 8 aa, West Nile virus
RLCYGGPW

SEQ ID NO: 124821 - protein, 8 aa, West Nile virus
LCYGGPWK

SEQ ID NO: 124822 - protein, 8 aa, West Nile virus
CYGGPWKL

SEQ ID NO: 124823 - protein, 8 aa, West Nile virus
YGGPWKLQ

SEQ ID NO: 124824 - protein, 8 aa, West Nile virus
GGPWKLQH

SEQ ID NO: 124825 - protein, 8 aa, West Nile virus
GPWKLQHK

SEQ ID NO: 124826 - protein, 8 aa, West Nile virus
PWKLQHKW

SEQ ID NO: 124827 - protein, 8 aa, West Nile virus
WKLQHKWN

SEQ ID NO: 124828 - protein, 8 aa, West Nile virus
KLQHKWNG

SEQ ID NO: 124829 - protein, 8 aa, West Nile virus
LQHKWNGQ

SEQ ID NO: 124830 - protein, 8 aa, West Nile virus
QHKWNGQD

SEQ ID NO: 124831 - protein, 8 aa, West Nile virus
HKWNGQDE

SEQ ID NO: 124832 - protein, 8 aa, West Nile virus
KWNGQDEV

SEQ ID NO: 124833 - protein, 8 aa, West Nile virus
WNGQDEVQ

SEQ ID NO: 124834 - protein, 8 aa, West Nile virus
NGQDEVQM

SEQ ID NO: 124835 - protein, 8 aa, West Nile virus
GQDEVQMI

SEQ ID NO: 124836 - protein, 8 aa, West Nile virus
QDEVQMIV

SEQ ID NO: 124837 - protein, 8 aa, West Nile virus
DEVQMIVV

SEQ ID NO: 124838 - protein, 8 aa, West Nile virus
EVQMIVVE

SEQ ID NO: 124839 - protein, 8 aa, West Nile virus
VQMIVVEP

SEQ ID NO: 124840 - protein, 8 aa, West Nile virus
QMIVVEPG

SEQ ID NO: 124841 - protein, 8 aa, West Nile virus
MIVVEPGK

SEQ ID NO: 124842 - protein, 8 aa, West Nile virus
IVVEPGKN

SEQ ID NO: 124843 - protein, 8 aa, West Nile virus
VVEPGKNV

SEQ ID NO: 124844 - protein, 8 aa, West Nile virus
VEPGKNVK

SEQ ID NO: 124845 - protein, 8 aa, West Nile virus
EPGKNVKN

SEQ ID NO: 124846 - protein, 8 aa, West Nile virus
PGKNVKNV

SEQ ID NO: 124847 - protein, 8 aa, West Nile virus
GKNVKNVQ

SEQ ID NO: 124848 - protein, 8 aa, West Nile virus
KNVKNVQT

SEQ ID NO: 124849 - protein, 8 aa, West Nile virus
NVKNVQTK

SEQ ID NO: 124850 - protein, 8 aa, West Nile virus
VKNVQTKP

SEQ ID NO: 124851 - protein, 8 aa, West Nile virus
KNVQTKPG

SEQ ID NO: 124852 - protein, 8 aa, West Nile virus
NVQTKPGV

SEQ ID NO: 124853 - protein, 8 aa, West Nile virus
VQTKPGVF

SEQ ID NO: 124854 - protein, 8 aa, West Nile virus
QTKPGVFK

SEQ ID NO: 124855 - protein, 8 aa, West Nile virus
TKPGVFKT

SEQ ID NO: 124856 - protein, 8 aa, West Nile virus
KPGVFKTP

SEQ ID NO: 124857 - protein, 8 aa, West Nile virus
PGVFKTPE

SEQ ID NO: 124858 - protein, 8 aa, West Nile virus
GVFKTPEG

SEQ ID NO: 124859 - protein, 8 aa, West Nile virus
VFKTPEGE

SEQ ID NO: 124860 - protein, 8 aa, West Nile virus
FKTPEGEI

SEQ ID NO: 124861 - protein, 8 aa, West Nile virus
KTPEGEIG

SEQ ID NO: 124862 - protein, 8 aa, West Nile virus
TPEGEIGA

SEQ ID NO: 124863 - protein, 8 aa, West Nile virus
PEGEIGAV

SEQ ID NO: 124864 - protein, 8 aa, West Nile virus
EGEIGAVT

SEQ ID NO: 124865 - protein, 8 aa, West Nile virus
GEIGAVTL

SEQ ID NO: 124866 - protein, 8 aa, West Nile virus
EIGAVTLD

SEQ ID NO: 124867 - protein, 8 aa, West Nile virus
IGAVTLDF

SEQ ID NO: 124868 - protein, 8 aa, West Nile virus
GAVTLDFP

SEQ ID NO: 124869 - protein, 8 aa, West Nile virus
AVTLDFPT

SEQ ID NO: 124870 - protein, 8 aa, West Nile virus
VTLDFPTG

SEQ ID NO: 124871 - protein, 8 aa, West Nile virus
TLDFPTGT

SEQ ID NO: 124872 - protein, 8 aa, West Nile virus
LDFPTGTS

SEQ ID NO: 124873 - protein, 8 aa, West Nile virus
DFPTGTSG

SEQ ID NO: 124874 - protein, 8 aa, West Nile virus
FPTGTSGS

SEQ ID NO: 124875 - protein, 8 aa, West Nile virus
PTGTSGSP

SEQ ID NO: 124876 - protein, 8 aa, West Nile virus
TGTSGSPI

SEQ ID NO: 124877 - protein, 8 aa, West Nile virus
GTSGSPIV

SEQ ID NO: 124878 - protein, 8 aa, West Nile virus
TSGSPIVD

SEQ ID NO: 124879 - protein, 8 aa, West Nile virus
SGSPIVDK

SEQ ID NO: 124880 - protein, 8 aa, West Nile virus
GSPIVDKN

SEQ ID NO: 124881 - protein, 8 aa, West Nile virus
SPIVDKNG

SEQ ID NO: 124882 - protein, 8 aa, West Nile virus
PIVDKNGD

SEQ ID NO: 124883 - protein, 8 aa, West Nile virus
IVDKNGDV

SEQ ID NO: 124884 - protein, 8 aa, West Nile virus
VDKNGDVI

SEQ ID NO: 124885 - protein, 8 aa, West Nile virus
DKNGDVIG

SEQ ID NO: 124886 - protein, 8 aa, West Nile virus
KNGDVIGL

SEQ ID NO: 124887 - protein, 8 aa, West Nile virus
NGDVIGLY

SEQ ID NO: 124888 - protein, 8 aa, West Nile virus
GDVIGLYG

SEQ ID NO: 124889 - protein, 8 aa, West Nile virus
DVIGLYGN

SEQ ID NO: 124890 - protein, 8 aa, West Nile virus
VIGLYGNG

SEQ ID NO: 124891 - protein, 8 aa, West Nile virus
IGLYGNGV

SEQ ID NO: 124892 - protein, 8 aa, West Nile virus
GLYGNGVI

SEQ ID NO: 124893 - protein, 8 aa, West Nile virus
LYGNGVIM

SEQ ID NO: 124894 - protein, 8 aa, West Nile virus
YGNGVIMP

SEQ ID NO: 124895 - protein, 8 aa, West Nile virus
GNGVIMPN

SEQ ID NO: 124896 - protein, 8 aa, West Nile virus
NGVIMPNG

SEQ ID NO: 124897 - protein, 8 aa, West Nile virus
GVIMPNGS

SEQ ID NO: 124898 - protein, 8 aa, West Nile virus
VIMPNGSY

SEQ ID NO: 124899 - protein, 8 aa, West Nile virus
IMPNGSYI

SEQ ID NO: 124900 - protein, 8 aa, West Nile virus
MPNGSYIS

SEQ ID NO: 124901 - protein, 8 aa, West Nile virus
PNGSYISA

SEQ ID NO: 124902 - protein, 8 aa, West Nile virus
NGSYISAI

SEQ ID NO: 124903 - protein, 8 aa, West Nile virus
GSYISAIV

SEQ ID NO: 124904 - protein, 8 aa, West Nile virus
SYISAIVQ

SEQ ID NO: 124905 - protein, 8 aa, West Nile virus
YISAIVQG

SEQ ID NO: 124906 - protein, 8 aa, West Nile virus
ISAIVQGE

SEQ ID NO: 124907 - protein, 8 aa, West Nile virus
SAIVQGER

SEQ ID NO: 124908 - protein, 8 aa, West Nile virus
AIVQGERM

SEQ ID NO: 124909 - protein, 8 aa, West Nile virus
IVQGERMD

SEQ ID NO: 124910 - protein, 8 aa, West Nile virus
VQGERMDE

SEQ ID NO: 124911 - protein, 8 aa, West Nile virus
QGERMDEP

SEQ ID NO: 124912 - protein, 8 aa, West Nile virus
GERMDEPI

SEQ ID NO: 124913 - protein, 8 aa, West Nile virus
ERMDEPIP

SEQ ID NO: 124914 - protein, 8 aa, West Nile virus
RMDEPIPA

SEQ ID NO: 124915 - protein, 8 aa, West Nile virus
MDEPIPAG

SEQ ID NO: 124916 - protein, 8 aa, West Nile virus
DEPIPAGF

SEQ ID NO: 124917 - protein, 8 aa, West Nile virus
GFEPEMLR

SEQ ID NO: 124918 - protein, 8 aa, West Nile virus
FEPEMLRK

SEQ ID NO: 124919 - protein, 8 aa, West Nile virus
EPEMLRKK

SEQ ID NO: 124920 - protein, 8 aa, West Nile virus
PEMLRKKQ

SEQ ID NO: 124921 - protein, 8 aa, West Nile virus
EMLRKKQI

SEQ ID NO: 124922 - protein, 8 aa, West Nile virus
MLRKKQIT

SEQ ID NO: 124923 - protein, 8 aa, West Nile virus
LRKKQITV

SEQ ID NO: 124924 - protein, 8 aa, West Nile virus
RKKQITVL

SEQ ID NO: 124925 - protein, 8 aa, West Nile virus
KKQITVLD

SEQ ID NO: 124926 - protein, 8 aa, West Nile virus
KQITVLDL

SEQ ID NO: 124927 - protein, 8 aa, West Nile virus
QITVLDLH

SEQ ID NO: 124928 - protein, 8 aa, West Nile virus
ITVLDLHP

SEQ ID NO: 124929 - protein, 8 aa, West Nile virus
TVLDLHPG

SEQ ID NO: 124930 - protein, 8 aa, West Nile virus
VLDLHPGA

SEQ ID NO: 124931 - protein, 8 aa, West Nile virus
LDLHPGAG

SEQ ID NO: 124932 - protein, 8 aa, West Nile virus
DLHPGAGK

SEQ ID NO: 124933 - protein, 8 aa, West Nile virus
LHPGAGKT

SEQ ID NO: 124934 - protein, 8 aa, West Nile virus
HPGAGKTR

SEQ ID NO: 124935 - protein, 8 aa, West Nile virus
PGAGKTRR

SEQ ID NO: 124936 - protein, 8 aa, West Nile virus
GAGKTRRI

SEQ ID NO: 124937 - protein, 8 aa, West Nile virus
AGKTRRIL

SEQ ID NO: 124938 - protein, 8 aa, West Nile virus
GKTRRILP

SEQ ID NO: 124939 - protein, 8 aa, West Nile virus
KTRRILPQ

SEQ ID NO: 124940 - protein, 8 aa, West Nile virus
TRRILPQI

SEQ ID NO: 124941 - protein, 8 aa, West Nile virus
RRILPQII

SEQ ID NO: 124942 - protein, 8 aa, West Nile virus
RILPQIIK

SEQ ID NO: 124943 - protein, 8 aa, West Nile virus
ILPQIIKE

SEQ ID NO: 124944 - protein, 8 aa, West Nile virus
LPQIIKEA

SEQ ID NO: 124945 - protein, 8 aa, West Nile virus
PQIIKEAI

SEQ ID NO: 124946 - protein, 8 aa, West Nile virus
QIIKEAIN

SEQ ID NO: 124947 - protein, 8 aa, West Nile virus
IIKEAINR

SEQ ID NO: 124948 - protein, 8 aa, West Nile virus
IKEAINRR

SEQ ID NO: 124949 - protein, 8 aa, West Nile virus
KEAINRRL

SEQ ID NO: 124950 - protein, 8 aa, West Nile virus
EAINRRLR

SEQ ID NO: 124951 - protein, 8 aa, West Nile virus
AINRRLRT

SEQ ID NO: 124952 - protein, 8 aa, West Nile virus
INRRLRTA

SEQ ID NO: 124953 - protein, 8 aa, West Nile virus
NRRLRTAV

SEQ ID NO: 124954 - protein, 8 aa, West Nile virus
RRLRTAVL

SEQ ID NO: 124955 - protein, 8 aa, West Nile virus
RLRTAVLA

SEQ ID NO: 124956 - protein, 8 aa, West Nile virus
LRTAVLAP

SEQ ID NO: 124957 - protein, 8 aa, West Nile virus
RTAVLAPT

SEQ ID NO: 124958 - protein, 8 aa, West Nile virus
TAVLAPTR

SEQ ID NO: 124959 - protein, 8 aa, West Nile virus
AVLAPTRV

SEQ ID NO: 124960 - protein, 8 aa, West Nile virus
VLAPTRVV

SEQ ID NO: 124961 - protein, 8 aa, West Nile virus
LAPTRVVA

SEQ ID NO: 124962 - protein, 8 aa, West Nile virus
APTRVVAA

SEQ ID NO: 124963 - protein, 8 aa, West Nile virus
PTRVVAAE

SEQ ID NO: 124964 - protein, 8 aa, West Nile virus
TRVVAAEM

SEQ ID NO: 124965 - protein, 8 aa, West Nile virus
RVVAAEMA

SEQ ID NO: 124966 - protein, 8 aa, West Nile virus
VVAAEMAE

SEQ ID NO: 124967 - protein, 8 aa, West Nile virus
VAAEMAEA

SEQ ID NO: 124968 - protein, 8 aa, West Nile virus
AAEMAEAL

SEQ ID NO: 124969 - protein, 8 aa, West Nile virus
AEMAEALR

SEQ ID NO: 124970 - protein, 8 aa, West Nile virus
EMAEALRG

SEQ ID NO: 124971 - protein, 8 aa, West Nile virus
MAEALRGL

SEQ ID NO: 124972 - protein, 8 aa, West Nile virus
AEALRGLP

SEQ ID NO: 124973 - protein, 8 aa, West Nile virus
EALRGLPI

SEQ ID NO: 124974 - protein, 8 aa, West Nile virus
ALRGLPIR

SEQ ID NO: 124975 - protein, 8 aa, West Nile virus
LRGLPIRY

SEQ ID NO: 124976 - protein, 8 aa, West Nile virus
RGLPIRYQ

SEQ ID NO: 124977 - protein, 8 aa, West Nile virus
GLPIRYQT

SEQ ID NO: 124978 - protein, 8 aa, West Nile virus
LPIRYQTS

SEQ ID NO: 124979 - protein, 8 aa, West Nile virus
PIRYQTSA

SEQ ID NO: 124980 - protein, 8 aa, West Nile virus
IRYQTSAV

SEQ ID NO: 124981 - protein, 8 aa, West Nile virus
RYQTSAVP

SEQ ID NO: 124982 - protein, 8 aa, West Nile virus
YQTSAVPR

SEQ ID NO: 124983 - protein, 8 aa, West Nile virus
QTSAVPRE

SEQ ID NO: 124984 - protein, 8 aa, West Nile virus
TSAVPREH

SEQ ID NO: 124985 - protein, 8 aa, West Nile virus
REHNGNEI

SEQ ID NO: 124986 - protein, 8 aa, West Nile virus
EHNGNEIV

SEQ ID NO: 124987 - protein, 8 aa, West Nile virus
HNGNEIVD

SEQ ID NO: 124988 - protein, 8 aa, West Nile virus
NGNEIVDV

SEQ ID NO: 124989 - protein, 8 aa, West Nile virus
GNEIVDVM

SEQ ID NO: 124990 - protein, 8 aa, West Nile virus
NEIVDVMC

SEQ ID NO: 124991 - protein, 8 aa, West Nile virus
EIVDVMCH

SEQ ID NO: 124992 - protein, 8 aa, West Nile virus
IVDVMCHA

SEQ ID NO: 124993 - protein, 8 aa, West Nile virus
VDVMCHAT

SEQ ID NO: 124994 - protein, 8 aa, West Nile virus
DVMCHATL

SEQ ID NO: 124995 - protein, 8 aa, West Nile virus
VMCHATLT

SEQ ID NO: 124996 - protein, 8 aa, West Nile virus
MCHATLTH

SEQ ID NO: 124997 - protein, 8 aa, West Nile virus
CHATLTHR

SEQ ID NO: 124998 - protein, 8 aa, West Nile virus
HATLTHRL

SEQ ID NO: 124999 - protein, 8 aa, West Nile virus
ATLTHRLM

SEQ ID NO: 125000 - protein, 8 aa, West Nile virus
TLTHRLMS

SEQ ID NO: 125001 - protein, 8 aa, West Nile virus
LTHRLMSP

SEQ ID NO: 125002 - protein, 8 aa, West Nile virus
THRLMSPH

SEQ ID NO: 125003 - protein, 8 aa, West Nile virus
HRLMSPHR

SEQ ID NO: 125004 - protein, 8 aa, West Nile virus
RLMSPHRV

SEQ ID NO: 125005 - protein, 8 aa, West Nile virus
LMSPHRVP

SEQ ID NO: 125006 - protein, 8 aa, West Nile virus
MSPHRVPN

SEQ ID NO: 125007 - protein, 8 aa, West Nile virus
SPHRVPNY

SEQ ID NO: 125008 - protein, 8 aa, West Nile virus
PHRVPNYN

SEQ ID NO: 125009 - protein, 8 aa, West Nile virus
HRVPNYNL

SEQ ID NO: 125010 - protein, 8 aa, West Nile virus
RVPNYNLF

SEQ ID NO: 125011 - protein, 8 aa, West Nile virus
VPNYNLFV

SEQ ID NO: 125012 - protein, 8 aa, West Nile virus
PNYNLFVM

SEQ ID NO: 125013 - protein, 8 aa, West Nile virus
NYNLFVMD

SEQ ID NO: 125014 - protein, 8 aa, West Nile virus
YNLFVMDE

SEQ ID NO: 125015 - protein, 8 aa, West Nile virus
NLFVMDEA

SEQ ID NO: 125016 - protein, 8 aa, West Nile virus
LFVMDEAH

SEQ ID NO: 125017 - protein, 8 aa, West Nile virus
FVMDEAHF

SEQ ID NO: 125018 - protein, 8 aa, West Nile virus
VMDEAHFT

SEQ ID NO: 125019 - protein, 8 aa, West Nile virus
MDEAHFTD

SEQ ID NO: 125020 - protein, 8 aa, West Nile virus
DEAHFTDP

SEQ ID NO: 125021 - protein, 8 aa, West Nile virus
EAHFTDPA

SEQ ID NO: 125022 - protein, 8 aa, West Nile virus
AHFTDPAS

SEQ ID NO: 125023 - protein, 8 aa, West Nile virus
HFTDPASI

SEQ ID NO: 125024 - protein, 8 aa, West Nile virus
FTDPASIA

SEQ ID NO: 125025 - protein, 8 aa, West Nile virus
TDPASIAA

SEQ ID NO: 125026 - protein, 8 aa, West Nile virus
DPASIAAR

SEQ ID NO: 125027 - protein, 8 aa, West Nile virus
PASIAARG

SEQ ID NO: 125028 - protein, 8 aa, West Nile virus
ASIAARGY

SEQ ID NO: 125029 - protein, 8 aa, West Nile virus
SIAARGYI

SEQ ID NO: 125030 - protein, 8 aa, West Nile virus
IAARGYIS

SEQ ID NO: 125031 - protein, 8 aa, West Nile virus
AARGYIST

SEQ ID NO: 125032 - protein, 8 aa, West Nile virus
ARGYISTK

SEQ ID NO: 125033 - protein, 8 aa, West Nile virus
RGYISTKV

SEQ ID NO: 125034 - protein, 8 aa, West Nile virus
GYISTKVE

SEQ ID NO: 125035 - protein, 8 aa, West Nile virus
YISTKVEL

SEQ ID NO: 125036 - protein, 8 aa, West Nile virus
ISTKVELG

SEQ ID NO: 125037 - protein, 8 aa, West Nile virus
STKVELGE

SEQ ID NO: 125038 - protein, 8 aa, West Nile virus
TKVELGEA

SEQ ID NO: 125039 - protein, 8 aa, West Nile virus
KVELGEAA

SEQ ID NO: 125040 - protein, 8 aa, West Nile virus
VELGEAAA

SEQ ID NO: 125041 - protein, 8 aa, West Nile virus
ELGEAAAI

SEQ ID NO: 125042 - protein, 8 aa, West Nile virus
LGEAAAIF

SEQ ID NO: 125043 - protein, 8 aa, West Nile virus
GEAAAIFM

SEQ ID NO: 125044 - protein, 8 aa, West Nile virus
EAAAIFMT

SEQ ID NO: 125045 - protein, 8 aa, West Nile virus
AAAIFMTA

SEQ ID NO: 125046 - protein, 8 aa, West Nile virus
AAIFMTAT

SEQ ID NO: 125047 - protein, 8 aa, West Nile virus
AIFMTATP

SEQ ID NO: 125048 - protein, 8 aa, West Nile virus
IFMTATPP

SEQ ID NO: 125049 - protein, 8 aa, West Nile virus
FMTATPPG

SEQ ID NO: 125050 - protein, 8 aa, West Nile virus
MTATPPGT

SEQ ID NO: 125051 - protein, 8 aa, West Nile virus
TATPPGTS

SEQ ID NO: 125052 - protein, 8 aa, West Nile virus
ATPPGTSD

SEQ ID NO: 125053 - protein, 8 aa, West Nile virus
TPPGTSDP

SEQ ID NO: 125054 - protein, 8 aa, West Nile virus
PPGTSDPF

SEQ ID NO: 125055 - protein, 8 aa, West Nile virus
PGTSDPFP

SEQ ID NO: 125056 - protein, 8 aa, West Nile virus
GTSDPFPE

SEQ ID NO: 125057 - protein, 8 aa, West Nile virus
TSDPFPES

SEQ ID NO: 125058 - protein, 8 aa, West Nile virus
SDPFPESN

SEQ ID NO: 125059 - protein, 8 aa, West Nile virus
DPFPESNS

SEQ ID NO: 125060 - protein, 8 aa, West Nile virus
PFPESNSP

SEQ ID NO: 125061 - protein, 8 aa, West Nile virus
FPESNSPI

SEQ ID NO: 125062 - protein, 8 aa, West Nile virus
DLQTEIPD

SEQ ID NO: 125063 - protein, 8 aa, West Nile virus
LQTEIPDR

SEQ ID NO: 125064 - protein, 8 aa, West Nile virus
QTEIPDRA

SEQ ID NO: 125065 - protein, 8 aa, West Nile virus
TEIPDRAW

SEQ ID NO: 125066 - protein, 8 aa, West Nile virus
EIPDRAWN

SEQ ID NO: 125067 - protein, 8 aa, West Nile virus
IPDRAWNS

SEQ ID NO: 125068 - protein, 8 aa, West Nile virus
PDRAWNSG

SEQ ID NO: 125069 - protein, 8 aa, West Nile virus
DRAWNSGY

SEQ ID NO: 125070 - protein, 8 aa, West Nile virus
RAWNSGYE

SEQ ID NO: 125071 - protein, 8 aa, West Nile virus
AWNSGYEW

SEQ ID NO: 125072 - protein, 8 aa, West Nile virus
WNSGYEWI

SEQ ID NO: 125073 - protein, 8 aa, West Nile virus
NSGYEWIT

SEQ ID NO: 125074 - protein, 8 aa, West Nile virus
SGYEWITE

SEQ ID NO: 125075 - protein, 8 aa, West Nile virus
GYEWITEY

SEQ ID NO: 125076 - protein, 8 aa, West Nile virus
YEWITEYT

SEQ ID NO: 125077 - protein, 8 aa, West Nile virus
EWITEYTG

SEQ ID NO: 125078 - protein, 8 aa, West Nile virus
WITEYTGK

SEQ ID NO: 125079 - protein, 8 aa, West Nile virus
ITEYTGKT

SEQ ID NO: 125080 - protein, 8 aa, West Nile virus
TEYTGKTV

SEQ ID NO: 125081 - protein, 8 aa, West Nile virus
EYTGKTVW

SEQ ID NO: 125082 - protein, 8 aa, West Nile virus
YTGKTVWF

SEQ ID NO: 125083 - protein, 8 aa, West Nile virus
TGKTVWFV

SEQ ID NO: 125084 - protein, 8 aa, West Nile virus
GKTVWFVP

SEQ ID NO: 125085 - protein, 8 aa, West Nile virus
KTVWFVPS

SEQ ID NO: 125086 - protein, 8 aa, West Nile virus
TVWFVPSV

SEQ ID NO: 125087 - protein, 8 aa, West Nile virus
VWFVPSVK

SEQ ID NO: 125088 - protein, 8 aa, West Nile virus
WFVPSVKM

SEQ ID NO: 125089 - protein, 8 aa, West Nile virus
FVPSVKMG

SEQ ID NO: 125090 - protein, 8 aa, West Nile virus
VPSVKMGN

SEQ ID NO: 125091 - protein, 8 aa, West Nile virus
PSVKMGNE

SEQ ID NO: 125092 - protein, 8 aa, West Nile virus
SVKMGNEI

SEQ ID NO: 125093 - protein, 8 aa, West Nile virus
VKMGNEIA

SEQ ID NO: 125094 - protein, 8 aa, West Nile virus
KMGNEIAL

SEQ ID NO: 125095 - protein, 8 aa, West Nile virus
MGNEIALC

SEQ ID NO: 125096 - protein, 8 aa, West Nile virus
GNEIALCL

SEQ ID NO: 125097 - protein, 8 aa, West Nile virus
NEIALCLQ

SEQ ID NO: 125098 - protein, 8 aa, West Nile virus
EIALCLQR

SEQ ID NO: 125099 - protein, 8 aa, West Nile virus
IALCLQRA

SEQ ID NO: 125100 - protein, 8 aa, West Nile virus
ALCLQRAG

SEQ ID NO: 125101 - protein, 8 aa, West Nile virus
LCLQRAGK

SEQ ID NO: 125102 - protein, 8 aa, West Nile virus
CLQRAGKK

SEQ ID NO: 125103 - protein, 8 aa, West Nile virus
LQRAGKKV

SEQ ID NO: 125104 - protein, 8 aa, West Nile virus
QRAGKKVV

SEQ ID NO: 125105 - protein, 8 aa, West Nile virus
RAGKKVVQ

SEQ ID NO: 125106 - protein, 8 aa, West Nile virus
AGKKVVQL

SEQ ID NO: 125107 - protein, 8 aa, West Nile virus
GKKVVQLN

SEQ ID NO: 125108 - protein, 8 aa, West Nile virus
KKVVQLNR

SEQ ID NO: 125109 - protein, 8 aa, West Nile virus
KVVQLNRK

SEQ ID NO: 125110 - protein, 8 aa, West Nile virus
VVQLNRKS

SEQ ID NO: 125111 - protein, 8 aa, West Nile virus
VQLNRKSY

SEQ ID NO: 125112 - protein, 8 aa, West Nile virus
QLNRKSYE

SEQ ID NO: 125113 - protein, 8 aa, West Nile virus
LNRKSYET

SEQ ID NO: 125114 - protein, 8 aa, West Nile virus
NRKSYETE

SEQ ID NO: 125115 - protein, 8 aa, West Nile virus
RKSYETEY

SEQ ID NO: 125116 - protein, 8 aa, West Nile virus
KSYETEYP

SEQ ID NO: 125117 - protein, 8 aa, West Nile virus
SYETEYPK

SEQ ID NO: 125118 - protein, 8 aa, West Nile virus
YETEYPKC

SEQ ID NO: 125119 - protein, 8 aa, West Nile virus
ETEYPKCK

SEQ ID NO: 125120 - protein, 8 aa, West Nile virus
TEYPKCKN

SEQ ID NO: 125121 - protein, 8 aa, West Nile virus
EYPKCKND

SEQ ID NO: 125122 - protein, 8 aa, West Nile virus
YPKCKNDD

SEQ ID NO: 125123 - protein, 8 aa, West Nile virus
PKCKNDDW

SEQ ID NO: 125124 - protein, 8 aa, West Nile virus
KCKNDDWD

SEQ ID NO: 125125 - protein, 8 aa, West Nile virus
CKNDDWDF

SEQ ID NO: 125126 - protein, 8 aa, West Nile virus
KNDDWDFV

SEQ ID NO: 125127 - protein, 8 aa, West Nile virus
NDDWDFVI

SEQ ID NO: 125128 - protein, 8 aa, West Nile virus
DDWDFVIT

SEQ ID NO: 125129 - protein, 8 aa, West Nile virus
DWDFVITT

SEQ ID NO: 125130 - protein, 8 aa, West Nile virus
WDFVITTD

SEQ ID NO: 125131 - protein, 8 aa, West Nile virus
DFVITTDI

SEQ ID NO: 125132 - protein, 8 aa, West Nile virus
FVITTDIS

SEQ ID NO: 125133 - protein, 8 aa, West Nile virus
VITTDISE

SEQ ID NO: 125134 - protein, 8 aa, West Nile virus
ITTDISEM

SEQ ID NO: 125135 - protein, 8 aa, West Nile virus
TTDISEMG

SEQ ID NO: 125136 - protein, 8 aa, West Nile virus
TDISEMGA

SEQ ID NO: 125137 - protein, 8 aa, West Nile virus
DISEMGAN

SEQ ID NO: 125138 - protein, 8 aa, West Nile virus
ISEMGANF

SEQ ID NO: 125139 - protein, 8 aa, West Nile virus
SEMGANFK

SEQ ID NO: 125140 - protein, 8 aa, West Nile virus
EMGANFKA

SEQ ID NO: 125141 - protein, 8 aa, West Nile virus
MGANFKAS

SEQ ID NO: 125142 - protein, 8 aa, West Nile virus
GANFKASR

SEQ ID NO: 125143 - protein, 8 aa, West Nile virus
ANFKASRV

SEQ ID NO: 125144 - protein, 8 aa, West Nile virus
NFKASRVI

SEQ ID NO: 125145 - protein, 8 aa, West Nile virus
FKASRVID

SEQ ID NO: 125146 - protein, 8 aa, West Nile virus
KASRVIDS

SEQ ID NO: 125147 - protein, 8 aa, West Nile virus
ASRVIDSR

SEQ ID NO: 125148 - protein, 8 aa, West Nile virus
SRVIDSRK

SEQ ID NO: 125149 - protein, 8 aa, West Nile virus
RVIDSRKS

SEQ ID NO: 125150 - protein, 8 aa, West Nile virus
VIDSRKSV

SEQ ID NO: 125151 - protein, 8 aa, West Nile virus
IDSRKSVK

SEQ ID NO: 125152 - protein, 8 aa, West Nile virus
DSRKSVKP

SEQ ID NO: 125153 - protein, 8 aa, West Nile virus
SRKSVKPT

SEQ ID NO: 125154 - protein, 8 aa, West Nile virus
RKSVKPTI

SEQ ID NO: 125155 - protein, 8 aa, West Nile virus
KSVKPTII

SEQ ID NO: 125156 - protein, 8 aa, West Nile virus
SVKPTIIT

SEQ ID NO: 125157 - protein, 8 aa, West Nile virus
VKPTIITE

SEQ ID NO: 125158 - protein, 8 aa, West Nile virus
KPTIITEG

SEQ ID NO: 125159 - protein, 8 aa, West Nile virus
PTIITEGE

SEQ ID NO: 125160 - protein, 8 aa, West Nile virus
ITEGEGRV

SEQ ID NO: 125161 - protein, 8 aa, West Nile virus
TEGEGRVI

SEQ ID NO: 125162 - protein, 8 aa, West Nile virus
EGEGRVIL

SEQ ID NO: 125163 - protein, 8 aa, West Nile virus
GEGRVILG

SEQ ID NO: 125164 - protein, 8 aa, West Nile virus
EGRVILGE

SEQ ID NO: 125165 - protein, 8 aa, West Nile virus
GRVILGEP

SEQ ID NO: 125166 - protein, 8 aa, West Nile virus
RVILGEPS

SEQ ID NO: 125167 - protein, 8 aa, West Nile virus
VILGEPSA

SEQ ID NO: 125168 - protein, 8 aa, West Nile virus
ILGEPSAV

SEQ ID NO: 125169 - protein, 8 aa, West Nile virus
LGEPSAVT

SEQ ID NO: 125170 - protein, 8 aa, West Nile virus
GEPSAVTA

SEQ ID NO: 125171 - protein, 8 aa, West Nile virus
EPSAVTAA

SEQ ID NO: 125172 - protein, 8 aa, West Nile virus
PSAVTAAS

SEQ ID NO: 125173 - protein, 8 aa, West Nile virus
SAVTAASA

SEQ ID NO: 125174 - protein, 8 aa, West Nile virus
AVTAASAA

SEQ ID NO: 125175 - protein, 8 aa, West Nile virus
VTAASAAQ

SEQ ID NO: 125176 - protein, 8 aa, West Nile virus
TAASAAQR

SEQ ID NO: 125177 - protein, 8 aa, West Nile virus
AASAAQRR

SEQ ID NO: 125178 - protein, 8 aa, West Nile virus
ASAAQRRG

SEQ ID NO: 125179 - protein, 8 aa, West Nile virus
SAAQRRGR

SEQ ID NO: 125180 - protein, 8 aa, West Nile virus
AAQRRGRI

SEQ ID NO: 125181 - protein, 8 aa, West Nile virus
AQRRGRIG

SEQ ID NO: 125182 - protein, 8 aa, West Nile virus
QRRGRIGR

SEQ ID NO: 125183 - protein, 8 aa, West Nile virus
RRGRIGRN

SEQ ID NO: 125184 - protein, 8 aa, West Nile virus
RGRIGRNP

SEQ ID NO: 125185 - protein, 8 aa, West Nile virus
GRIGRNPS

SEQ ID NO: 125186 - protein, 8 aa, West Nile virus
RIGRNPSQ

SEQ ID NO: 125187 - protein, 8 aa, West Nile virus
IGRNPSQV

SEQ ID NO: 125188 - protein, 8 aa, West Nile virus
GRNPSQVG

SEQ ID NO: 125189 - protein, 8 aa, West Nile virus
RNPSQVGD

SEQ ID NO: 125190 - protein, 8 aa, West Nile virus
NPSQVGDE

SEQ ID NO: 125191 - protein, 8 aa, West Nile virus
PSQVGDEY

SEQ ID NO: 125192 - protein, 8 aa, West Nile virus
SQVGDEYC

SEQ ID NO: 125193 - protein, 8 aa, West Nile virus
QVGDEYCY

SEQ ID NO: 125194 - protein, 8 aa, West Nile virus
VGDEYCYG

SEQ ID NO: 125195 - protein, 8 aa, West Nile virus
GDEYCYGG

SEQ ID NO: 125196 - protein, 8 aa, West Nile virus
DEYCYGGH

SEQ ID NO: 125197 - protein, 8 aa, West Nile virus
EYCYGGHT

SEQ ID NO: 125198 - protein, 8 aa, West Nile virus
YCYGGHTN

SEQ ID NO: 125199 - protein, 8 aa, West Nile virus
CYGGHTNE

SEQ ID NO: 125200 - protein, 8 aa, West Nile virus
YGGHTNED

SEQ ID NO: 125201 - protein, 8 aa, West Nile virus
GGHTNEDD

SEQ ID NO: 125202 - protein, 8 aa, West Nile virus
GHTNEDDS

SEQ ID NO: 125203 - protein, 8 aa, West Nile virus
HTNEDDSN

SEQ ID NO: 125204 - protein, 8 aa, West Nile virus
TNEDDSNF

SEQ ID NO: 125205 - protein, 8 aa, West Nile virus
NEDDSNFA

SEQ ID NO: 125206 - protein, 8 aa, West Nile virus
EDDSNFAH

SEQ ID NO: 125207 - protein, 8 aa, West Nile virus
DDSNFAHW

SEQ ID NO: 125208 - protein, 8 aa, West Nile virus
DSNFAHWT

SEQ ID NO: 125209 - protein, 8 aa, West Nile virus
SNFAHWTE

SEQ ID NO: 125210 - protein, 8 aa, West Nile virus
NFAHWTEA

SEQ ID NO: 125211 - protein, 8 aa, West Nile virus
FAHWTEAR

SEQ ID NO: 125212 - protein, 8 aa, West Nile virus
AHWTEARI

SEQ ID NO: 125213 - protein, 8 aa, West Nile virus
HWTEARIM

SEQ ID NO: 125214 - protein, 8 aa, West Nile virus
WTEARIML

SEQ ID NO: 125215 - protein, 8 aa, West Nile virus
TEARIMLD

SEQ ID NO: 125216 - protein, 8 aa, West Nile virus
EARIMLDN

SEQ ID NO: 125217 - protein, 8 aa, West Nile virus
ARIMLDNI

SEQ ID NO: 125218 - protein, 8 aa, West Nile virus
RIMLDNIN

SEQ ID NO: 125219 - protein, 8 aa, West Nile virus
IMLDNINM

SEQ ID NO: 125220 - protein, 8 aa, West Nile virus
MLDNINMP

SEQ ID NO: 125221 - protein, 8 aa, West Nile virus
LDNINMPN

SEQ ID NO: 125222 - protein, 8 aa, West Nile virus
DNINMPNG

SEQ ID NO: 125223 - protein, 8 aa, West Nile virus
NINMPNGL

SEQ ID NO: 125224 - protein, 8 aa, West Nile virus
INMPNGLI

SEQ ID NO: 125225 - protein, 8 aa, West Nile virus
NMPNGLIA

SEQ ID NO: 125226 - protein, 8 aa, West Nile virus
MPNGLIAQ

SEQ ID NO: 125227 - protein, 8 aa, West Nile virus
PNGLIAQF

SEQ ID NO: 125228 - protein, 8 aa, West Nile virus
NGLIAQFY

SEQ ID NO: 125229 - protein, 8 aa, West Nile virus
GLIAQFYQ

SEQ ID NO: 125230 - protein, 8 aa, West Nile virus
LIAQFYQP

SEQ ID NO: 125231 - protein, 8 aa, West Nile virus
IAQFYQPE

SEQ ID NO: 125232 - protein, 8 aa, West Nile virus
AQFYQPER

SEQ ID NO: 125233 - protein, 8 aa, West Nile virus
QFYQPERE

SEQ ID NO: 125234 - protein, 8 aa, West Nile virus
FYQPEREK

SEQ ID NO: 125235 - protein, 8 aa, West Nile virus
YQPEREKV

SEQ ID NO: 125236 - protein, 8 aa, West Nile virus
QPEREKVY

SEQ ID NO: 125237 - protein, 8 aa, West Nile virus
PEREKVYT

SEQ ID NO: 125238 - protein, 8 aa, West Nile virus
EREKVYTM

SEQ ID NO: 125239 - protein, 8 aa, West Nile virus
REKVYTMD

SEQ ID NO: 125240 - protein, 8 aa, West Nile virus
EKVYTMDG

SEQ ID NO: 125241 - protein, 8 aa, West Nile virus
KVYTMDGE

SEQ ID NO: 125242 - protein, 8 aa, West Nile virus
VYTMDGEY

SEQ ID NO: 125243 - protein, 8 aa, West Nile virus
YTMDGEYR

SEQ ID NO: 125244 - protein, 8 aa, West Nile virus
TMDGEYRL

SEQ ID NO: 125245 - protein, 8 aa, West Nile virus
MDGEYRLR

SEQ ID NO: 125246 - protein, 8 aa, West Nile virus
DGEYRLRG

SEQ ID NO: 125247 - protein, 8 aa, West Nile virus
GEYRLRGE

SEQ ID NO: 125248 - protein, 8 aa, West Nile virus
EYRLRGEE

SEQ ID NO: 125249 - protein, 8 aa, West Nile virus
YRLRGEER

SEQ ID NO: 125250 - protein, 8 aa, West Nile virus
RLRGEERK

SEQ ID NO: 125251 - protein, 8 aa, West Nile virus
LRGEERKN

SEQ ID NO: 125252 - protein, 8 aa, West Nile virus
RGEERKNF

SEQ ID NO: 125253 - protein, 8 aa, West Nile virus
GEERKNFL

SEQ ID NO: 125254 - protein, 8 aa, West Nile virus
EERKNFLE

SEQ ID NO: 125255 - protein, 8 aa, West Nile virus
ERKNFLEL

SEQ ID NO: 125256 - protein, 8 aa, West Nile virus
RKNFLELL

SEQ ID NO: 125257 - protein, 8 aa, West Nile virus
KNFLELLR

SEQ ID NO: 125258 - protein, 8 aa, West Nile virus
NFLELLRT

SEQ ID NO: 125259 - protein, 8 aa, West Nile virus
FLELLRTA

SEQ ID NO: 125260 - protein, 8 aa, West Nile virus
LELLRTAD

SEQ ID NO: 125261 - protein, 8 aa, West Nile virus
ELLRTADL

SEQ ID NO: 125262 - protein, 8 aa, West Nile virus
LLRTADLP

SEQ ID NO: 125263 - protein, 8 aa, West Nile virus
LRTADLPV

SEQ ID NO: 125264 - protein, 8 aa, West Nile virus
RTADLPVW

SEQ ID NO: 125265 - protein, 8 aa, West Nile virus
TADLPVWL

SEQ ID NO: 125266 - protein, 8 aa, West Nile virus
ADLPVWLA

SEQ ID NO: 125267 - protein, 8 aa, West Nile virus
DLPVWLAY

SEQ ID NO: 125268 - protein, 8 aa, West Nile virus
LPVWLAYK

SEQ ID NO: 125269 - protein, 8 aa, West Nile virus
PVWLAYKV

SEQ ID NO: 125270 - protein, 8 aa, West Nile virus
VWLAYKVA

SEQ ID NO: 125271 - protein, 8 aa, West Nile virus
WLAYKVAA

SEQ ID NO: 125272 - protein, 8 aa, West Nile virus
LAYKVAAA

SEQ ID NO: 125273 - protein, 8 aa, West Nile virus
AYKVAAAG

SEQ ID NO: 125274 - protein, 8 aa, West Nile virus
YKVAAAGV

SEQ ID NO: 125275 - protein, 8 aa, West Nile virus
KVAAAGVS

SEQ ID NO: 125276 - protein, 8 aa, West Nile virus
VAAAGVSY

SEQ ID NO: 125277 - protein, 8 aa, West Nile virus
AAAGVSYH

SEQ ID NO: 125278 - protein, 8 aa, West Nile virus
AAGVSYHD

SEQ ID NO: 125279 - protein, 8 aa, West Nile virus
AGVSYHDR

SEQ ID NO: 125280 - protein, 8 aa, West Nile virus
GVSYHDRR

SEQ ID NO: 125281 - protein, 8 aa, West Nile virus
VSYHDRRW

SEQ ID NO: 125282 - protein, 8 aa, West Nile virus
SYHDRRWC

SEQ ID NO: 125283 - protein, 8 aa, West Nile virus
YHDRRWCF

SEQ ID NO: 125284 - protein, 8 aa, West Nile virus
HDRRWCFD

SEQ ID NO: 125285 - protein, 8 aa, West Nile virus
DRRWCFDG

SEQ ID NO: 125286 - protein, 8 aa, West Nile virus
RRWCFDGP

SEQ ID NO: 125287 - protein, 8 aa, West Nile virus
RWCFDGPR

SEQ ID NO: 125288 - protein, 8 aa, West Nile virus
WCFDGPRT

SEQ ID NO: 125289 - protein, 8 aa, West Nile virus
CFDGPRTN

SEQ ID NO: 125290 - protein, 8 aa, West Nile virus
FDGPRTNT

SEQ ID NO: 125291 - protein, 8 aa, West Nile virus
DGPRTNTI

SEQ ID NO: 125292 - protein, 8 aa, West Nile virus
GPRTNTIL

SEQ ID NO: 125293 - protein, 8 aa, West Nile virus
PRTNTILE

SEQ ID NO: 125294 - protein, 8 aa, West Nile virus
RTNTILED

SEQ ID NO: 125295 - protein, 8 aa, West Nile virus
TNTILEDN

SEQ ID NO: 125296 - protein, 8 aa, West Nile virus
NTILEDNN

SEQ ID NO: 125297 - protein, 8 aa, West Nile virus
TILEDNNE

SEQ ID NO: 125298 - protein, 8 aa, West Nile virus
ILEDNNEV

SEQ ID NO: 125299 - protein, 8 aa, West Nile virus
LEDNNEVE

SEQ ID NO: 125300 - protein, 8 aa, West Nile virus
EDNNEVEV

SEQ ID NO: 125301 - protein, 8 aa, West Nile virus
DNNEVEVI

SEQ ID NO: 125302 - protein, 8 aa, West Nile virus
NNEVEVIT

SEQ ID NO: 125303 - protein, 8 aa, West Nile virus
NEVEVITK

SEQ ID NO: 125304 - protein, 8 aa, West Nile virus
EVEVITKL

SEQ ID NO: 125305 - protein, 8 aa, West Nile virus
VEVITKLG

SEQ ID NO: 125306 - protein, 8 aa, West Nile virus
EVITKLGE

SEQ ID NO: 125307 - protein, 8 aa, West Nile virus
VITKLGER

SEQ ID NO: 125308 - protein, 8 aa, West Nile virus
ITKLGERK

SEQ ID NO: 125309 - protein, 8 aa, West Nile virus
TKLGERKI

SEQ ID NO: 125310 - protein, 8 aa, West Nile virus
KLGERKIL

SEQ ID NO: 125311 - protein, 8 aa, West Nile virus
LGERKILR

SEQ ID NO: 125312 - protein, 8 aa, West Nile virus
GERKILRP

SEQ ID NO: 125313 - protein, 8 aa, West Nile virus
ERKILRPR

SEQ ID NO: 125314 - protein, 8 aa, West Nile virus
RKILRPRW

SEQ ID NO: 125315 - protein, 8 aa, West Nile virus
KILRPRWI

SEQ ID NO: 125316 - protein, 8 aa, West Nile virus
ILRPRWID

SEQ ID NO: 125317 - protein, 8 aa, West Nile virus
LRPRWIDA

SEQ ID NO: 125318 - protein, 8 aa, West Nile virus
RPRWIDAR

SEQ ID NO: 125319 - protein, 8 aa, West Nile virus
PRWIDARV

SEQ ID NO: 125320 - protein, 8 aa, West Nile virus
RWIDARVY

SEQ ID NO: 125321 - protein, 8 aa, West Nile virus
WIDARVYS

SEQ ID NO: 125322 - protein, 8 aa, West Nile virus
IDARVYSD

SEQ ID NO: 125323 - protein, 8 aa, West Nile virus
DARVYSDH

SEQ ID NO: 125324 - protein, 8 aa, West Nile virus
ARVYSDHQ

SEQ ID NO: 125325 - protein, 8 aa, West Nile virus
RVYSDHQA

SEQ ID NO: 125326 - protein, 8 aa, West Nile virus
VYSDHQAL

SEQ ID NO: 125327 - protein, 8 aa, West Nile virus
YSDHQALK

SEQ ID NO: 125328 - protein, 8 aa, West Nile virus
SDHQALKA

SEQ ID NO: 125329 - protein, 8 aa, West Nile virus
DHQALKAF

SEQ ID NO: 125330 - protein, 8 aa, West Nile virus
HQALKAFK

SEQ ID NO: 125331 - protein, 8 aa, West Nile virus
QALKAFKD

SEQ ID NO: 125332 - protein, 8 aa, West Nile virus
ALKAFKDF

SEQ ID NO: 125333 - protein, 8 aa, West Nile virus
LKAFKDFA

SEQ ID NO: 125334 - protein, 8 aa, West Nile virus
KAFKDFAS

SEQ ID NO: 125335 - protein, 8 aa, West Nile virus
AFKDFASG

SEQ ID NO: 125336 - protein, 8 aa, West Nile virus
FKDFASGK

SEQ ID NO: 125337 - protein, 8 aa, West Nile virus
KDFASGKR

SEQ ID NO: 125338 - protein, 8 aa, West Nile virus
DFASGKRS

SEQ ID NO: 125339 - protein, 8 aa, West Nile virus
FASGKRSQ

SEQ ID NO: 125340 - protein, 8 aa, West Nile virus
ASGKRSQI

SEQ ID NO: 125341 - protein, 8 aa, West Nile virus
SGKRSQIG

SEQ ID NO: 125342 - protein, 8 aa, West Nile virus
GKRSQIGL

SEQ ID NO: 125343 - protein, 8 aa, West Nile virus
KRSQIGLI

SEQ ID NO: 125344 - protein, 8 aa, West Nile virus
RSQIGLIE

SEQ ID NO: 125345 - protein, 8 aa, West Nile virus
SQIGLIEV

SEQ ID NO: 125346 - protein, 8 aa, West Nile virus
QIGLIEVL

SEQ ID NO: 125347 - protein, 8 aa, West Nile virus
IGLIEVLG

SEQ ID NO: 125348 - protein, 8 aa, West Nile virus
GLIEVLGK

SEQ ID NO: 125349 - protein, 8 aa, West Nile virus
LIEVLGKM

SEQ ID NO: 125350 - protein, 8 aa, West Nile virus
IEVLGKMP

SEQ ID NO: 125351 - protein, 8 aa, West Nile virus
EVLGKMPE

SEQ ID NO: 125352 - protein, 8 aa, West Nile virus
VLGKMPEH

SEQ ID NO: 125353 - protein, 8 aa, West Nile virus
LGKMPEHF

SEQ ID NO: 125354 - protein, 8 aa, West Nile virus
GKMPEHFM

SEQ ID NO: 125355 - protein, 8 aa, West Nile virus
KMPEHFMG

SEQ ID NO: 125356 - protein, 8 aa, West Nile virus
MPEHFMGK

SEQ ID NO: 125357 - protein, 8 aa, West Nile virus
PEHFMGKT

SEQ ID NO: 125358 - protein, 8 aa, West Nile virus
EHFMGKTW

SEQ ID NO: 125359 - protein, 8 aa, West Nile virus
HFMGKTWE

SEQ ID NO: 125360 - protein, 8 aa, West Nile virus
FMGKTWEA

SEQ ID NO: 125361 - protein, 8 aa, West Nile virus
MGKTWEAL

SEQ ID NO: 125362 - protein, 8 aa, West Nile virus
GKTWEALD

SEQ ID NO: 125363 - protein, 8 aa, West Nile virus
KTWEALDT

SEQ ID NO: 125364 - protein, 8 aa, West Nile virus
TWEALDTM

SEQ ID NO: 125365 - protein, 8 aa, West Nile virus
WEALDTMY

SEQ ID NO: 125366 - protein, 8 aa, West Nile virus
EALDTMYV

SEQ ID NO: 125367 - protein, 8 aa, West Nile virus
ALDTMYVV

SEQ ID NO: 125368 - protein, 8 aa, West Nile virus
LDTMYVVA

SEQ ID NO: 125369 - protein, 8 aa, West Nile virus
DTMYVVAT

SEQ ID NO: 125370 - protein, 8 aa, West Nile virus
TMYVVATA

SEQ ID NO: 125371 - protein, 8 aa, West Nile virus
MYVVATAE

SEQ ID NO: 125372 - protein, 8 aa, West Nile virus
YVVATAEK

SEQ ID NO: 125373 - protein, 8 aa, West Nile virus
VVATAEKG

SEQ ID NO: 125374 - protein, 8 aa, West Nile virus
VATAEKGG

SEQ ID NO: 125375 - protein, 8 aa, West Nile virus
ATAEKGGR

SEQ ID NO: 125376 - protein, 8 aa, West Nile virus
TAEKGGRA

SEQ ID NO: 125377 - protein, 8 aa, West Nile virus
AEKGGRAH

SEQ ID NO: 125378 - protein, 8 aa, West Nile virus
EKGGRAHR

SEQ ID NO: 125379 - protein, 8 aa, West Nile virus
KGGRAHRM

SEQ ID NO: 125380 - protein, 8 aa, West Nile virus
GGRAHRMA

SEQ ID NO: 125381 - protein, 8 aa, West Nile virus
GRAHRMAL

SEQ ID NO: 125382 - protein, 8 aa, West Nile virus
RAHRMALE

SEQ ID NO: 125383 - protein, 8 aa, West Nile virus
AHRMALEE

SEQ ID NO: 125384 - protein, 8 aa, West Nile virus
HRMALEEL

SEQ ID NO: 125385 - protein, 8 aa, West Nile virus
RMALEELP

SEQ ID NO: 125386 - protein, 8 aa, West Nile virus
MALEELPD

SEQ ID NO: 125387 - protein, 8 aa, West Nile virus
ALEELPDA

SEQ ID NO: 125388 - protein, 8 aa, West Nile virus
LEELPDAL

SEQ ID NO: 125389 - protein, 8 aa, West Nile virus
EELPDALQ

SEQ ID NO: 125390 - protein, 8 aa, West Nile virus
ELPDALQT

SEQ ID NO: 125391 - protein, 8 aa, West Nile virus
LPDALQTI

SEQ ID NO: 125392 - protein, 8 aa, West Nile virus
PDALQTIA

SEQ ID NO: 125393 - protein, 8 aa, West Nile virus
DALQTIAL

SEQ ID NO: 125394 - protein, 8 aa, West Nile virus
ALQTIALI

SEQ ID NO: 125395 - protein, 8 aa, West Nile virus
LQTIALIA

SEQ ID NO: 125396 - protein, 8 aa, West Nile virus
QTIALIAL

SEQ ID NO: 125397 - protein, 8 aa, West Nile virus
TIALIALL

SEQ ID NO: 125398 - protein, 8 aa, West Nile virus
IALIALLS

SEQ ID NO: 125399 - protein, 8 aa, West Nile virus
ALIALLSV

SEQ ID NO: 125400 - protein, 8 aa, West Nile virus
LIALLSVM

SEQ ID NO: 125401 - protein, 8 aa, West Nile virus
IALLSVMT

SEQ ID NO: 125402 - protein, 8 aa, West Nile virus
LLSVMTMG

SEQ ID NO: 125403 - protein, 8 aa, West Nile virus
LSVMTMGV

SEQ ID NO: 125404 - protein, 8 aa, West Nile virus
SVMTMGVF

SEQ ID NO: 125405 - protein, 8 aa, West Nile virus
VMTMGVFF

SEQ ID NO: 125406 - protein, 8 aa, West Nile virus
MTMGVFFL

SEQ ID NO: 125407 - protein, 8 aa, West Nile virus
TMGVFFLL

SEQ ID NO: 125408 - protein, 8 aa, West Nile virus
MGVFFLLM

SEQ ID NO: 125409 - protein, 8 aa, West Nile virus
GVFFLLMQ

SEQ ID NO: 125410 - protein, 8 aa, West Nile virus
VFFLLMQR

SEQ ID NO: 125411 - protein, 8 aa, West Nile virus
FFLLMQRK

SEQ ID NO: 125412 - protein, 8 aa, West Nile virus
FLLMQRKG

SEQ ID NO: 125413 - protein, 8 aa, West Nile virus
LLMQRKGI

SEQ ID NO: 125414 - protein, 8 aa, West Nile virus
LMQRKGIG

SEQ ID NO: 125415 - protein, 8 aa, West Nile virus
MQRKGIGK

SEQ ID NO: 125416 - protein, 8 aa, West Nile virus
QRKGIGKI

SEQ ID NO: 125417 - protein, 8 aa, West Nile virus
RKGIGKIG

SEQ ID NO: 125418 - protein, 8 aa, West Nile virus
KGIGKIGL

SEQ ID NO: 125419 - protein, 8 aa, West Nile virus
GIGKIGLG

SEQ ID NO: 125420 - protein, 8 aa, West Nile virus
IGKIGLGG

SEQ ID NO: 125421 - protein, 8 aa, West Nile virus
GKIGLGGA

SEQ ID NO: 125422 - protein, 8 aa, West Nile virus
LGVATFFC

SEQ ID NO: 125423 - protein, 8 aa, West Nile virus
GVATFFCW

SEQ ID NO: 125424 - protein, 8 aa, West Nile virus
VATFFCWM

SEQ ID NO: 125425 - protein, 8 aa, West Nile virus
ATFFCWMA

SEQ ID NO: 125426 - protein, 8 aa, West Nile virus
TFFCWMAE

SEQ ID NO: 125427 - protein, 8 aa, West Nile virus
FFCWMAEV

SEQ ID NO: 125428 - protein, 8 aa, West Nile virus
FCWMAEVP

SEQ ID NO: 125429 - protein, 8 aa, West Nile virus
CWMAEVPG

SEQ ID NO: 125430 - protein, 8 aa, West Nile virus
WMAEVPGT

SEQ ID NO: 125431 - protein, 8 aa, West Nile virus
MAEVPGTK

SEQ ID NO: 125432 - protein, 8 aa, West Nile virus
AEVPGTKI

SEQ ID NO: 125433 - protein, 8 aa, West Nile virus
EVPGTKIA

SEQ ID NO: 125434 - protein, 8 aa, West Nile virus
VPGTKIAG

SEQ ID NO: 125435 - protein, 8 aa, West Nile virus
PGTKIAGM

SEQ ID NO: 125436 - protein, 8 aa, West Nile virus
GTKIAGML

SEQ ID NO: 125437 - protein, 8 aa, West Nile virus
TKIAGMLL

SEQ ID NO: 125438 - protein, 8 aa, West Nile virus
KIAGMLLL

SEQ ID NO: 125439 - protein, 8 aa, West Nile virus
IAGMLLLS

SEQ ID NO: 125440 - protein, 8 aa, West Nile virus
AGMLLLSL

SEQ ID NO: 125441 - protein, 8 aa, West Nile virus
GMLLLSLL

SEQ ID NO: 125442 - protein, 8 aa, West Nile virus
MLLLSLLL

SEQ ID NO: 125443 - protein, 8 aa, West Nile virus
LLLSLLLM

SEQ ID NO: 125444 - protein, 8 aa, West Nile virus
LLSLLLMI

SEQ ID NO: 125445 - protein, 8 aa, West Nile virus
LSLLLMIV

SEQ ID NO: 125446 - protein, 8 aa, West Nile virus
SLLLMIVL

SEQ ID NO: 125447 - protein, 8 aa, West Nile virus
LLLMIVLI

SEQ ID NO: 125448 - protein, 8 aa, West Nile virus
LLMIVLIP

SEQ ID NO: 125449 - protein, 8 aa, West Nile virus
LMIVLIPE

SEQ ID NO: 125450 - protein, 8 aa, West Nile virus
MIVLIPEP

SEQ ID NO: 125451 - protein, 8 aa, West Nile virus
IVLIPEPE

SEQ ID NO: 125452 - protein, 8 aa, West Nile virus
VLIPEPEK

SEQ ID NO: 125453 - protein, 8 aa, West Nile virus
LIPEPEKQ

SEQ ID NO: 125454 - protein, 8 aa, West Nile virus
IPEPEKQR

SEQ ID NO: 125455 - protein, 8 aa, West Nile virus
PEPEKQRS

SEQ ID NO: 125456 - protein, 8 aa, West Nile virus
EPEKQRSQ

SEQ ID NO: 125457 - protein, 8 aa, West Nile virus
PEKQRSQT

SEQ ID NO: 125458 - protein, 8 aa, West Nile virus
EKQRSQTD

SEQ ID NO: 125459 - protein, 8 aa, West Nile virus
KQRSQTDN

SEQ ID NO: 125460 - protein, 8 aa, West Nile virus
QRSQTDNQ

SEQ ID NO: 125461 - protein, 8 aa, West Nile virus
RSQTDNQL

SEQ ID NO: 125462 - protein, 8 aa, West Nile virus
SQTDNQLA

SEQ ID NO: 125463 - protein, 8 aa, West Nile virus
QTDNQLAV

SEQ ID NO: 125464 - protein, 8 aa, West Nile virus
TDNQLAVF

SEQ ID NO: 125465 - protein, 8 aa, West Nile virus
DNQLAVFL

SEQ ID NO: 125466 - protein, 8 aa, West Nile virus
NQLAVFLI

SEQ ID NO: 125467 - protein, 8 aa, West Nile virus
QLAVFLIC

SEQ ID NO: 125468 - protein, 8 aa, West Nile virus
LAVFLICV

SEQ ID NO: 125469 - protein, 8 aa, West Nile virus
AVFLICVM

SEQ ID NO: 125470 - protein, 8 aa, West Nile virus
VFLICVMT

SEQ ID NO: 125471 - protein, 8 aa, West Nile virus
FLICVMTL

SEQ ID NO: 125472 - protein, 8 aa, West Nile virus
LICVMTLV

SEQ ID NO: 125473 - protein, 8 aa, West Nile virus
ICVMTLVS

SEQ ID NO: 125474 - protein, 8 aa, West Nile virus
TLVSAVAA

SEQ ID NO: 125475 - protein, 8 aa, West Nile virus
LVSAVAAN

SEQ ID NO: 125476 - protein, 8 aa, West Nile virus
VSAVAANE

SEQ ID NO: 125477 - protein, 8 aa, West Nile virus
SAVAANEM

SEQ ID NO: 125478 - protein, 8 aa, West Nile virus
AVAANEMG

SEQ ID NO: 125479 - protein, 8 aa, West Nile virus
VAANEMGW

SEQ ID NO: 125480 - protein, 8 aa, West Nile virus
AANEMGWL

SEQ ID NO: 125481 - protein, 8 aa, West Nile virus
ANEMGWLD

SEQ ID NO: 125482 - protein, 8 aa, West Nile virus
NEMGWLDK

SEQ ID NO: 125483 - protein, 8 aa, West Nile virus
EMGWLDKT

SEQ ID NO: 125484 - protein, 8 aa, West Nile virus
MGWLDKTK

SEQ ID NO: 125485 - protein, 8 aa, West Nile virus
GWLDKTKS

SEQ ID NO: 125486 - protein, 8 aa, West Nile virus
WLDKTKSD

SEQ ID NO: 125487 - protein, 8 aa, West Nile virus
LDKTKSDI

SEQ ID NO: 125488 - protein, 8 aa, West Nile virus
GEFLLDLR

SEQ ID NO: 125489 - protein, 8 aa, West Nile virus
EFLLDLRP

SEQ ID NO: 125490 - protein, 8 aa, West Nile virus
FLLDLRPA

SEQ ID NO: 125491 - protein, 8 aa, West Nile virus
LLDLRPAT

SEQ ID NO: 125492 - protein, 8 aa, West Nile virus
LDLRPATA

SEQ ID NO: 125493 - protein, 8 aa, West Nile virus
DLRPATAW

SEQ ID NO: 125494 - protein, 8 aa, West Nile virus
LRPATAWS

SEQ ID NO: 125495 - protein, 8 aa, West Nile virus
RPATAWSL

SEQ ID NO: 125496 - protein, 8 aa, West Nile virus
PATAWSLY

SEQ ID NO: 125497 - protein, 8 aa, West Nile virus
ATAWSLYA

SEQ ID NO: 125498 - protein, 8 aa, West Nile virus
TAWSLYAV

SEQ ID NO: 125499 - protein, 8 aa, West Nile virus
AWSLYAVT

SEQ ID NO: 125500 - protein, 8 aa, West Nile virus
WSLYAVTT

SEQ ID NO: 125501 - protein, 8 aa, West Nile virus
SLYAVTTA

SEQ ID NO: 125502 - protein, 8 aa, West Nile virus
LYAVTTAV

SEQ ID NO: 125503 - protein, 8 aa, West Nile virus
YAVTTAVL

SEQ ID NO: 125504 - protein, 8 aa, West Nile virus
AVTTAVLT

SEQ ID NO: 125505 - protein, 8 aa, West Nile virus
VTTAVLTP

SEQ ID NO: 125506 - protein, 8 aa, West Nile virus
TTAVLTPL

SEQ ID NO: 125507 - protein, 8 aa, West Nile virus
TAVLTPLL

SEQ ID NO: 125508 - protein, 8 aa, West Nile virus
AVLTPLLK

SEQ ID NO: 125509 - protein, 8 aa, West Nile virus
VLTPLLKH

SEQ ID NO: 125510 - protein, 8 aa, West Nile virus
LTPLLKHL

SEQ ID NO: 125511 - protein, 8 aa, West Nile virus
TPLLKHLI

SEQ ID NO: 125512 - protein, 8 aa, West Nile virus
PLLKHLIT

SEQ ID NO: 125513 - protein, 8 aa, West Nile virus
LLKHLITS

SEQ ID NO: 125514 - protein, 8 aa, West Nile virus
LKHLITSD

SEQ ID NO: 125515 - protein, 8 aa, West Nile virus
KHLITSDY

SEQ ID NO: 125516 - protein, 8 aa, West Nile virus
HLITSDYI

SEQ ID NO: 125517 - protein, 8 aa, West Nile virus
LITSDYIN

SEQ ID NO: 125518 - protein, 8 aa, West Nile virus
ITSDYINT

SEQ ID NO: 125519 - protein, 8 aa, West Nile virus
TSDYINTS

SEQ ID NO: 125520 - protein, 8 aa, West Nile virus
SDYINTSL

SEQ ID NO: 125521 - protein, 8 aa, West Nile virus
DYINTSLT

SEQ ID NO: 125522 - protein, 8 aa, West Nile virus
YINTSLTS

SEQ ID NO: 125523 - protein, 8 aa, West Nile virus
INTSLTSI

SEQ ID NO: 125524 - protein, 8 aa, West Nile virus
NTSLTSIN

SEQ ID NO: 125525 - protein, 8 aa, West Nile virus
TSLTSINV

SEQ ID NO: 125526 - protein, 8 aa, West Nile virus
SLTSINVQ

SEQ ID NO: 125527 - protein, 8 aa, West Nile virus
LTSINVQA

SEQ ID NO: 125528 - protein, 8 aa, West Nile virus
TSINVQAS

SEQ ID NO: 125529 - protein, 8 aa, West Nile virus
SINVQASA

SEQ ID NO: 125530 - protein, 8 aa, West Nile virus
INVQASAL

SEQ ID NO: 125531 - protein, 8 aa, West Nile virus
NVQASALF

SEQ ID NO: 125532 - protein, 8 aa, West Nile virus
VQASALFT

SEQ ID NO: 125533 - protein, 8 aa, West Nile virus
QASALFTL

SEQ ID NO: 125534 - protein, 8 aa, West Nile virus
ASALFTLA

SEQ ID NO: 125535 - protein, 8 aa, West Nile virus
SALFTLAR

SEQ ID NO: 125536 - protein, 8 aa, West Nile virus
ALFTLARG

SEQ ID NO: 125537 - protein, 8 aa, West Nile virus
LFTLARGF

SEQ ID NO: 125538 - protein, 8 aa, West Nile virus
FTLARGFP

SEQ ID NO: 125539 - protein, 8 aa, West Nile virus
TLARGFPF

SEQ ID NO: 125540 - protein, 8 aa, West Nile virus
LARGFPFV

SEQ ID NO: 125541 - protein, 8 aa, West Nile virus
ARGFPFVD

SEQ ID NO: 125542 - protein, 8 aa, West Nile virus
RGFPFVDV

SEQ ID NO: 125543 - protein, 8 aa, West Nile virus
GFPFVDVG

SEQ ID NO: 125544 - protein, 8 aa, West Nile virus
FPFVDVGV

SEQ ID NO: 125545 - protein, 8 aa, West Nile virus
PFVDVGVS

SEQ ID NO: 125546 - protein, 8 aa, West Nile virus
FVDVGVSA

SEQ ID NO: 125547 - protein, 8 aa, West Nile virus
VDVGVSAL

SEQ ID NO: 125548 - protein, 8 aa, West Nile virus
DVGVSALL

SEQ ID NO: 125549 - protein, 8 aa, West Nile virus
VGVSALLL

SEQ ID NO: 125550 - protein, 8 aa, West Nile virus
GVSALLLA

SEQ ID NO: 125551 - protein, 8 aa, West Nile virus
VSALLLAA

SEQ ID NO: 125552 - protein, 8 aa, West Nile virus
SALLLAAG

SEQ ID NO: 125553 - protein, 8 aa, West Nile virus
ALLLAAGC

SEQ ID NO: 125554 - protein, 8 aa, West Nile virus
LLLAAGCW

SEQ ID NO: 125555 - protein, 8 aa, West Nile virus
LLAAGCWG

SEQ ID NO: 125556 - protein, 8 aa, West Nile virus
LAAGCWGQ

SEQ ID NO: 125557 - protein, 8 aa, West Nile virus
AAGCWGQV

SEQ ID NO: 125558 - protein, 8 aa, West Nile virus
AGCWGQVT

SEQ ID NO: 125559 - protein, 8 aa, West Nile virus
GCWGQVTL

SEQ ID NO: 125560 - protein, 8 aa, West Nile virus
CWGQVTLT

SEQ ID NO: 125561 - protein, 8 aa, West Nile virus
WGQVTLTV

SEQ ID NO: 125562 - protein, 8 aa, West Nile virus
GQVTLTVT

SEQ ID NO: 125563 - protein, 8 aa, West Nile virus
QVTLTVTV

SEQ ID NO: 125564 - protein, 8 aa, West Nile virus
VTLTVTVT

SEQ ID NO: 125565 - protein, 8 aa, West Nile virus
TLTVTVTA

SEQ ID NO: 125566 - protein, 8 aa, West Nile virus
LTVTVTAA

SEQ ID NO: 125567 - protein, 8 aa, West Nile virus
TLLFCHYA

SEQ ID NO: 125568 - protein, 8 aa, West Nile virus
LLFCHYAY

SEQ ID NO: 125569 - protein, 8 aa, West Nile virus
LFCHYAYM

SEQ ID NO: 125570 - protein, 8 aa, West Nile virus
FCHYAYMV

SEQ ID NO: 125571 - protein, 8 aa, West Nile virus
CHYAYMVP

SEQ ID NO: 125572 - protein, 8 aa, West Nile virus
HYAYMVPG

SEQ ID NO: 125573 - protein, 8 aa, West Nile virus
YAYMVPGW

SEQ ID NO: 125574 - protein, 8 aa, West Nile virus
AYMVPGWQ

SEQ ID NO: 125575 - protein, 8 aa, West Nile virus
YMVPGWQA

SEQ ID NO: 125576 - protein, 8 aa, West Nile virus
MVPGWQAE

SEQ ID NO: 125577 - protein, 8 aa, West Nile virus
VPGWQAEA

SEQ ID NO: 125578 - protein, 8 aa, West Nile virus
PGWQAEAM

SEQ ID NO: 125579 - protein, 8 aa, West Nile virus
GWQAEAMR

SEQ ID NO: 125580 - protein, 8 aa, West Nile virus
WQAEAMRS

SEQ ID NO: 125581 - protein, 8 aa, West Nile virus
QAEAMRSA

SEQ ID NO: 125582 - protein, 8 aa, West Nile virus
AEAMRSAQ

SEQ ID NO: 125583 - protein, 8 aa, West Nile virus
EAMRSAQR

SEQ ID NO: 125584 - protein, 8 aa, West Nile virus
AMRSAQRR

SEQ ID NO: 125585 - protein, 8 aa, West Nile virus
MRSAQRRT

SEQ ID NO: 125586 - protein, 8 aa, West Nile virus
RSAQRRTA

SEQ ID NO: 125587 - protein, 8 aa, West Nile virus
SAQRRTAA

SEQ ID NO: 125588 - protein, 8 aa, West Nile virus
AQRRTAAG

SEQ ID NO: 125589 - protein, 8 aa, West Nile virus
QRRTAAGI

SEQ ID NO: 125590 - protein, 8 aa, West Nile virus
RRTAAGIM

SEQ ID NO: 125591 - protein, 8 aa, West Nile virus
RTAAGIMK

SEQ ID NO: 125592 - protein, 8 aa, West Nile virus
TAAGIMKN

SEQ ID NO: 125593 - protein, 8 aa, West Nile virus
AAGIMKNA

SEQ ID NO: 125594 - protein, 8 aa, West Nile virus
AGIMKNAV

SEQ ID NO: 125595 - protein, 8 aa, West Nile virus
GIMKNAVV

SEQ ID NO: 125596 - protein, 8 aa, West Nile virus
IMKNAVVD

SEQ ID NO: 125597 - protein, 8 aa, West Nile virus
MKNAVVDG

SEQ ID NO: 125598 - protein, 8 aa, West Nile virus
KNAVVDGI

SEQ ID NO: 125599 - protein, 8 aa, West Nile virus
NAVVDGIV

SEQ ID NO: 125600 - protein, 8 aa, West Nile virus
AVVDGIVA

SEQ ID NO: 125601 - protein, 8 aa, West Nile virus
VVDGIVAT

SEQ ID NO: 125602 - protein, 8 aa, West Nile virus
VDGIVATD

SEQ ID NO: 125603 - protein, 8 aa, West Nile virus
DGIVATDV

SEQ ID NO: 125604 - protein, 8 aa, West Nile virus
GIVATDVP

SEQ ID NO: 125605 - protein, 8 aa, West Nile virus
IVATDVPE

SEQ ID NO: 125606 - protein, 8 aa, West Nile virus
VATDVPEL

SEQ ID NO: 125607 - protein, 8 aa, West Nile virus
ATDVPELE

SEQ ID NO: 125608 - protein, 8 aa, West Nile virus
TDVPELER

SEQ ID NO: 125609 - protein, 8 aa, West Nile virus
DVPELERT

SEQ ID NO: 125610 - protein, 8 aa, West Nile virus
VPELERTT

SEQ ID NO: 125611 - protein, 8 aa, West Nile virus
PELERTTP

SEQ ID NO: 125612 - protein, 8 aa, West Nile virus
ELERTTPI

SEQ ID NO: 125613 - protein, 8 aa, West Nile virus
LERTTPIM

SEQ ID NO: 125614 - protein, 8 aa, West Nile virus
ERTTPIMQ

SEQ ID NO: 125615 - protein, 8 aa, West Nile virus
RTTPIMQK

SEQ ID NO: 125616 - protein, 8 aa, West Nile virus
TTPIMQKK

SEQ ID NO: 125617 - protein, 8 aa, West Nile virus
TPIMQKKV

SEQ ID NO: 125618 - protein, 8 aa, West Nile virus
PIMQKKVG

SEQ ID NO: 125619 - protein, 8 aa, West Nile virus
IMQKKVGQ

SEQ ID NO: 125620 - protein, 8 aa, West Nile virus
MQKKVGQI

SEQ ID NO: 125621 - protein, 8 aa, West Nile virus
QKKVGQIM

SEQ ID NO: 125622 - protein, 8 aa, West Nile virus
KKVGQIML

SEQ ID NO: 125623 - protein, 8 aa, West Nile virus
KVGQIMLI

SEQ ID NO: 125624 - protein, 8 aa, West Nile virus
VGQIMLIL

SEQ ID NO: 125625 - protein, 8 aa, West Nile virus
GQIMLILV

SEQ ID NO: 125626 - protein, 8 aa, West Nile virus
QIMLILVS

SEQ ID NO: 125627 - protein, 8 aa, West Nile virus
MLILVSLA

SEQ ID NO: 125628 - protein, 8 aa, West Nile virus
LILVSLAA

SEQ ID NO: 125629 - protein, 8 aa, West Nile virus
ILVSLAAV

SEQ ID NO: 125630 - protein, 8 aa, West Nile virus
LVSLAAVV

SEQ ID NO: 125631 - protein, 8 aa, West Nile virus
VSLAAVVV

SEQ ID NO: 125632 - protein, 8 aa, West Nile virus
SLAAVVVN

SEQ ID NO: 125633 - protein, 8 aa, West Nile virus
LAAVVVNP

SEQ ID NO: 125634 - protein, 8 aa, West Nile virus
AAVVVNPS

SEQ ID NO: 125635 - protein, 8 aa, West Nile virus
AVVVNPSV

SEQ ID NO: 125636 - protein, 8 aa, West Nile virus
VVVNPSVK

SEQ ID NO: 125637 - protein, 8 aa, West Nile virus
VVNPSVKT

SEQ ID NO: 125638 - protein, 8 aa, West Nile virus
VNPSVKTV

SEQ ID NO: 125639 - protein, 8 aa, West Nile virus
NPSVKTVR

SEQ ID NO: 125640 - protein, 8 aa, West Nile virus
PSVKTVRE

SEQ ID NO: 125641 - protein, 8 aa, West Nile virus
SVKTVREA

SEQ ID NO: 125642 - protein, 8 aa, West Nile virus
VKTVREAG

SEQ ID NO: 125643 - protein, 8 aa, West Nile virus
KTVREAGI

SEQ ID NO: 125644 - protein, 8 aa, West Nile virus
TVREAGIL

SEQ ID NO: 125645 - protein, 8 aa, West Nile virus
VREAGILI

SEQ ID NO: 125646 - protein, 8 aa, West Nile virus
REAGILIT

SEQ ID NO: 125647 - protein, 8 aa, West Nile virus
EAGILITA

SEQ ID NO: 125648 - protein, 8 aa, West Nile virus
AGILITAA

SEQ ID NO: 125649 - protein, 8 aa, West Nile virus
GILITAAA

SEQ ID NO: 125650 - protein, 8 aa, West Nile virus
ILITAAAV

SEQ ID NO: 125651 - protein, 8 aa, West Nile virus
LITAAAVT

SEQ ID NO: 125652 - protein, 8 aa, West Nile virus
ITAAAVTL

SEQ ID NO: 125653 - protein, 8 aa, West Nile virus
TAAAVTLW

SEQ ID NO: 125654 - protein, 8 aa, West Nile virus
AAAVTLWE

SEQ ID NO: 125655 - protein, 8 aa, West Nile virus
AAVTLWEN

SEQ ID NO: 125656 - protein, 8 aa, West Nile virus
AVTLWENG

SEQ ID NO: 125657 - protein, 8 aa, West Nile virus
VTLWENGA

SEQ ID NO: 125658 - protein, 8 aa, West Nile virus
TLWENGAS

SEQ ID NO: 125659 - protein, 8 aa, West Nile virus
LWENGASS

SEQ ID NO: 125660 - protein, 8 aa, West Nile virus
WENGASSV

SEQ ID NO: 125661 - protein, 8 aa, West Nile virus
ENGASSVW

SEQ ID NO: 125662 - protein, 8 aa, West Nile virus
NGASSVWN

SEQ ID NO: 125663 - protein, 8 aa, West Nile virus
GASSVWNA

SEQ ID NO: 125664 - protein, 8 aa, West Nile virus
ASSVWNAT

SEQ ID NO: 125665 - protein, 8 aa, West Nile virus
SSVWNATT

SEQ ID NO: 125666 - protein, 8 aa, West Nile virus
SVWNATTA

SEQ ID NO: 125667 - protein, 8 aa, West Nile virus
VWNATTAI

SEQ ID NO: 125668 - protein, 8 aa, West Nile virus
WNATTAIG

SEQ ID NO: 125669 - protein, 8 aa, West Nile virus
NATTAIGL

SEQ ID NO: 125670 - protein, 8 aa, West Nile virus
ATTAIGLC

SEQ ID NO: 125671 - protein, 8 aa, West Nile virus
TTAIGLCH

SEQ ID NO: 125672 - protein, 8 aa, West Nile virus
TAIGLCHI

SEQ ID NO: 125673 - protein, 8 aa, West Nile virus
AIGLCHIM

SEQ ID NO: 125674 - protein, 8 aa, West Nile virus
IGLCHIMR

SEQ ID NO: 125675 - protein, 8 aa, West Nile virus
GLCHIMRG

SEQ ID NO: 125676 - protein, 8 aa, West Nile virus
LCHIMRGG

SEQ ID NO: 125677 - protein, 8 aa, West Nile virus
CHIMRGGW

SEQ ID NO: 125678 - protein, 8 aa, West Nile virus
HIMRGGWL

SEQ ID NO: 125679 - protein, 8 aa, West Nile virus
IMRGGWLS

SEQ ID NO: 125680 - protein, 8 aa, West Nile virus
MRGGWLSC

SEQ ID NO: 125681 - protein, 8 aa, West Nile virus
RGGWLSCL

SEQ ID NO: 125682 - protein, 8 aa, West Nile virus
GGWLSCLS

SEQ ID NO: 125683 - protein, 8 aa, West Nile virus
GWLSCLSI

SEQ ID NO: 125684 - protein, 8 aa, West Nile virus
WLSCLSIT

SEQ ID NO: 125685 - protein, 8 aa, West Nile virus
LSCLSITW

SEQ ID NO: 125686 - protein, 8 aa, West Nile virus
SCLSITWT

SEQ ID NO: 125687 - protein, 8 aa, West Nile virus
CLSITWTL

SEQ ID NO: 125688 - protein, 8 aa, West Nile virus
SITWTLIK

SEQ ID NO: 125689 - protein, 8 aa, West Nile virus
KNMEKPGL

SEQ ID NO: 125690 - protein, 8 aa, West Nile virus
NMEKPGLK

SEQ ID NO: 125691 - protein, 8 aa, West Nile virus
MEKPGLKR

SEQ ID NO: 125692 - protein, 8 aa, West Nile virus
EKPGLKRG

SEQ ID NO: 125693 - protein, 8 aa, West Nile virus
KPGLKRGG

SEQ ID NO: 125694 - protein, 8 aa, West Nile virus
PGLKRGGA

SEQ ID NO: 125695 - protein, 8 aa, West Nile virus
GLKRGGAK

SEQ ID NO: 125696 - protein, 8 aa, West Nile virus
LKRGGAKG

SEQ ID NO: 125697 - protein, 8 aa, West Nile virus
KRGGAKGR

SEQ ID NO: 125698 - protein, 8 aa, West Nile virus
RGGAKGRT

SEQ ID NO: 125699 - protein, 8 aa, West Nile virus
GGAKGRTL

SEQ ID NO: 125700 - protein, 8 aa, West Nile virus
GAKGRTLG

SEQ ID NO: 125701 - protein, 8 aa, West Nile virus
AKGRTLGE

SEQ ID NO: 125702 - protein, 8 aa, West Nile virus
KGRTLGEV

SEQ ID NO: 125703 - protein, 8 aa, West Nile virus
GRTLGEVW

SEQ ID NO: 125704 - protein, 8 aa, West Nile virus
RTLGEVWK

SEQ ID NO: 125705 - protein, 8 aa, West Nile virus
TLGEVWKE

SEQ ID NO: 125706 - protein, 8 aa, West Nile virus
LGEVWKER

SEQ ID NO: 125707 - protein, 8 aa, West Nile virus
GEVWKERL

SEQ ID NO: 125708 - protein, 8 aa, West Nile virus
EVWKERLN

SEQ ID NO: 125709 - protein, 8 aa, West Nile virus
VWKERLNQ

SEQ ID NO: 125710 - protein, 8 aa, West Nile virus
WKERLNQM

SEQ ID NO: 125711 - protein, 8 aa, West Nile virus
KERLNQMT

SEQ ID NO: 125712 - protein, 8 aa, West Nile virus
MTKEEFTR

SEQ ID NO: 125713 - protein, 8 aa, West Nile virus
TKEEFTRY

SEQ ID NO: 125714 - protein, 8 aa, West Nile virus
KEEFTRYR

SEQ ID NO: 125715 - protein, 8 aa, West Nile virus
EEFTRYRK

SEQ ID NO: 125716 - protein, 8 aa, West Nile virus
EFTRYRKE

SEQ ID NO: 125717 - protein, 8 aa, West Nile virus
FTRYRKEA

SEQ ID NO: 125718 - protein, 8 aa, West Nile virus
TRYRKEAI

SEQ ID NO: 125719 - protein, 8 aa, West Nile virus
RYRKEAII

SEQ ID NO: 125720 - protein, 8 aa, West Nile virus
YRKEAIIE

SEQ ID NO: 125721 - protein, 8 aa, West Nile virus
RKEAIIEV

SEQ ID NO: 125722 - protein, 8 aa, West Nile virus
KEAIIEVD

SEQ ID NO: 125723 - protein, 8 aa, West Nile virus
EAIIEVDR

SEQ ID NO: 125724 - protein, 8 aa, West Nile virus
AIIEVDRS

SEQ ID NO: 125725 - protein, 8 aa, West Nile virus
IIEVDRSA

SEQ ID NO: 125726 - protein, 8 aa, West Nile virus
IEVDRSAA

SEQ ID NO: 125727 - protein, 8 aa, West Nile virus
EVDRSAAK

SEQ ID NO: 125728 - protein, 8 aa, West Nile virus
ARKEGNVT

SEQ ID NO: 125729 - protein, 8 aa, West Nile virus
RKEGNVTG

SEQ ID NO: 125730 - protein, 8 aa, West Nile virus
KEGNVTGG

SEQ ID NO: 125731 - protein, 8 aa, West Nile virus
EGNVTGGH

SEQ ID NO: 125732 - protein, 8 aa, West Nile virus
GNVTGGHP

SEQ ID NO: 125733 - protein, 8 aa, West Nile virus
NVTGGHPV

SEQ ID NO: 125734 - protein, 8 aa, West Nile virus
VTGGHPVS

SEQ ID NO: 125735 - protein, 8 aa, West Nile virus
TGGHPVSR

SEQ ID NO: 125736 - protein, 8 aa, West Nile virus
GGHPVSRG

SEQ ID NO: 125737 - protein, 8 aa, West Nile virus
GHPVSRGT

SEQ ID NO: 125738 - protein, 8 aa, West Nile virus
HPVSRGTA

SEQ ID NO: 125739 - protein, 8 aa, West Nile virus
PVSRGTAK

SEQ ID NO: 125740 - protein, 8 aa, West Nile virus
VSRGTAKL

SEQ ID NO: 125741 - protein, 8 aa, West Nile virus
SRGTAKLR

SEQ ID NO: 125742 - protein, 8 aa, West Nile virus
RGTAKLRW

SEQ ID NO: 125743 - protein, 8 aa, West Nile virus
GTAKLRWL

SEQ ID NO: 125744 - protein, 8 aa, West Nile virus
TAKLRWLV

SEQ ID NO: 125745 - protein, 8 aa, West Nile virus
AKLRWLVE

SEQ ID NO: 125746 - protein, 8 aa, West Nile virus
KLRWLVER

SEQ ID NO: 125747 - protein, 8 aa, West Nile virus
LRWLVERR

SEQ ID NO: 125748 - protein, 8 aa, West Nile virus
RWLVERRF

SEQ ID NO: 125749 - protein, 8 aa, West Nile virus
WLVERRFL

SEQ ID NO: 125750 - protein, 8 aa, West Nile virus
LVERRFLE

SEQ ID NO: 125751 - protein, 8 aa, West Nile virus
VERRFLEP

SEQ ID NO: 125752 - protein, 8 aa, West Nile virus
ERRFLEPV

SEQ ID NO: 125753 - protein, 8 aa, West Nile virus
RRFLEPVG

SEQ ID NO: 125754 - protein, 8 aa, West Nile virus
RFLEPVGK

SEQ ID NO: 125755 - protein, 8 aa, West Nile virus
FLEPVGKV

SEQ ID NO: 125756 - protein, 8 aa, West Nile virus
LEPVGKVI

SEQ ID NO: 125757 - protein, 8 aa, West Nile virus
EPVGKVID

SEQ ID NO: 125758 - protein, 8 aa, West Nile virus
PVGKVIDL

SEQ ID NO: 125759 - protein, 8 aa, West Nile virus
VGKVIDLG

SEQ ID NO: 125760 - protein, 8 aa, West Nile virus
GKVIDLGC

SEQ ID NO: 125761 - protein, 8 aa, West Nile virus
KVIDLGCG

SEQ ID NO: 125762 - protein, 8 aa, West Nile virus
VIDLGCGR

SEQ ID NO: 125763 - protein, 8 aa, West Nile virus
IDLGCGRG

SEQ ID NO: 125764 - protein, 8 aa, West Nile virus
DLGCGRGG

SEQ ID NO: 125765 - protein, 8 aa, West Nile virus
LGCGRGGW

SEQ ID NO: 125766 - protein, 8 aa, West Nile virus
GCGRGGWC

SEQ ID NO: 125767 - protein, 8 aa, West Nile virus
CGRGGWCY

SEQ ID NO: 125768 - protein, 8 aa, West Nile virus
GRGGWCYY

SEQ ID NO: 125769 - protein, 8 aa, West Nile virus
RGGWCYYM

SEQ ID NO: 125770 - protein, 8 aa, West Nile virus
GGWCYYMA

SEQ ID NO: 125771 - protein, 8 aa, West Nile virus
GWCYYMAT

SEQ ID NO: 125772 - protein, 8 aa, West Nile virus
WCYYMATQ

SEQ ID NO: 125773 - protein, 8 aa, West Nile virus
CYYMATQK

SEQ ID NO: 125774 - protein, 8 aa, West Nile virus
YYMATQKR

SEQ ID NO: 125775 - protein, 8 aa, West Nile virus
YMATQKRV

SEQ ID NO: 125776 - protein, 8 aa, West Nile virus
MATQKRVQ

SEQ ID NO: 125777 - protein, 8 aa, West Nile virus
ATQKRVQE

SEQ ID NO: 125778 - protein, 8 aa, West Nile virus
TQKRVQEV

SEQ ID NO: 125779 - protein, 8 aa, West Nile virus
QKRVQEVR

SEQ ID NO: 125780 - protein, 8 aa, West Nile virus
KRVQEVRG

SEQ ID NO: 125781 - protein, 8 aa, West Nile virus
RVQEVRGY

SEQ ID NO: 125782 - protein, 8 aa, West Nile virus
VQEVRGYT

SEQ ID NO: 125783 - protein, 8 aa, West Nile virus
QEVRGYTK

SEQ ID NO: 125784 - protein, 8 aa, West Nile virus
EVRGYTKG

SEQ ID NO: 125785 - protein, 8 aa, West Nile virus
VRGYTKGG

SEQ ID NO: 125786 - protein, 8 aa, West Nile virus
RGYTKGGP

SEQ ID NO: 125787 - protein, 8 aa, West Nile virus
GYTKGGPG

SEQ ID NO: 125788 - protein, 8 aa, West Nile virus
YTKGGPGH

SEQ ID NO: 125789 - protein, 8 aa, West Nile virus
TKGGPGHE

SEQ ID NO: 125790 - protein, 8 aa, West Nile virus
KGGPGHEE

SEQ ID NO: 125791 - protein, 8 aa, West Nile virus
GGPGHEEP

SEQ ID NO: 125792 - protein, 8 aa, West Nile virus
GPGHEEPQ

SEQ ID NO: 125793 - protein, 8 aa, West Nile virus
PGHEEPQL

SEQ ID NO: 125794 - protein, 8 aa, West Nile virus
GHEEPQLV

SEQ ID NO: 125795 - protein, 8 aa, West Nile virus
HEEPQLVQ

SEQ ID NO: 125796 - protein, 8 aa, West Nile virus
EEPQLVQS

SEQ ID NO: 125797 - protein, 8 aa, West Nile virus
EPQLVQSY

SEQ ID NO: 125798 - protein, 8 aa, West Nile virus
PQLVQSYG

SEQ ID NO: 125799 - protein, 8 aa, West Nile virus
QLVQSYGW

SEQ ID NO: 125800 - protein, 8 aa, West Nile virus
LVQSYGWN

SEQ ID NO: 125801 - protein, 8 aa, West Nile virus
VQSYGWNI

SEQ ID NO: 125802 - protein, 8 aa, West Nile virus
QSYGWNIV

SEQ ID NO: 125803 - protein, 8 aa, West Nile virus
SYGWNIVT

SEQ ID NO: 125804 - protein, 8 aa, West Nile virus
YGWNIVTM

SEQ ID NO: 125805 - protein, 8 aa, West Nile virus
GWNIVTMK

SEQ ID NO: 125806 - protein, 8 aa, West Nile virus
WNIVTMKS

SEQ ID NO: 125807 - protein, 8 aa, West Nile virus
NIVTMKSG

SEQ ID NO: 125808 - protein, 8 aa, West Nile virus
IVTMKSGV

SEQ ID NO: 125809 - protein, 8 aa, West Nile virus
VTMKSGVD

SEQ ID NO: 125810 - protein, 8 aa, West Nile virus
TMKSGVDV

SEQ ID NO: 125811 - protein, 8 aa, West Nile virus
MKSGVDVF

SEQ ID NO: 125812 - protein, 8 aa, West Nile virus
KSGVDVFY

SEQ ID NO: 125813 - protein, 8 aa, West Nile virus
SGVDVFYR

SEQ ID NO: 125814 - protein, 8 aa, West Nile virus
GVDVFYRP

SEQ ID NO: 125815 - protein, 8 aa, West Nile virus
VDVFYRPS

SEQ ID NO: 125816 - protein, 8 aa, West Nile virus
DVFYRPSE

SEQ ID NO: 125817 - protein, 8 aa, West Nile virus
VFYRPSEC

SEQ ID NO: 125818 - protein, 8 aa, West Nile virus
FYRPSECC

SEQ ID NO: 125819 - protein, 8 aa, West Nile virus
YRPSECCD

SEQ ID NO: 125820 - protein, 8 aa, West Nile virus
RPSECCDT

SEQ ID NO: 125821 - protein, 8 aa, West Nile virus
PSECCDTL

SEQ ID NO: 125822 - protein, 8 aa, West Nile virus
SECCDTLL

SEQ ID NO: 125823 - protein, 8 aa, West Nile virus
ECCDTLLC

SEQ ID NO: 125824 - protein, 8 aa, West Nile virus
CCDTLLCD

SEQ ID NO: 125825 - protein, 8 aa, West Nile virus
CDTLLCDI

SEQ ID NO: 125826 - protein, 8 aa, West Nile virus
DTLLCDIG

SEQ ID NO: 125827 - protein, 8 aa, West Nile virus
TLLCDIGE

SEQ ID NO: 125828 - protein, 8 aa, West Nile virus
LLCDIGES

SEQ ID NO: 125829 - protein, 8 aa, West Nile virus
LCDIGESS

SEQ ID NO: 125830 - protein, 8 aa, West Nile virus
CDIGESSS

SEQ ID NO: 125831 - protein, 8 aa, West Nile virus
DIGESSSS

SEQ ID NO: 125832 - protein, 8 aa, West Nile virus
IGESSSSA

SEQ ID NO: 125833 - protein, 8 aa, West Nile virus
GESSSSAE

SEQ ID NO: 125834 - protein, 8 aa, West Nile virus
ESSSSAEV

SEQ ID NO: 125835 - protein, 8 aa, West Nile virus
SSSSAEVE

SEQ ID NO: 125836 - protein, 8 aa, West Nile virus
SSSAEVEE

SEQ ID NO: 125837 - protein, 8 aa, West Nile virus
SSAEVEEH

SEQ ID NO: 125838 - protein, 8 aa, West Nile virus
SAEVEEHR

SEQ ID NO: 125839 - protein, 8 aa, West Nile virus
AEVEEHRT

SEQ ID NO: 125840 - protein, 8 aa, West Nile virus
EVEEHRTI

SEQ ID NO: 125841 - protein, 8 aa, West Nile virus
VEEHRTIR

SEQ ID NO: 125842 - protein, 8 aa, West Nile virus
EEHRTIRV

SEQ ID NO: 125843 - protein, 8 aa, West Nile virus
EHRTIRVL

SEQ ID NO: 125844 - protein, 8 aa, West Nile virus
HRTIRVLE

SEQ ID NO: 125845 - protein, 8 aa, West Nile virus
RTIRVLEM

SEQ ID NO: 125846 - protein, 8 aa, West Nile virus
TIRVLEMV

SEQ ID NO: 125847 - protein, 8 aa, West Nile virus
IRVLEMVE

SEQ ID NO: 125848 - protein, 8 aa, West Nile virus
RVLEMVED

SEQ ID NO: 125849 - protein, 8 aa, West Nile virus
VLEMVEDW

SEQ ID NO: 125850 - protein, 8 aa, West Nile virus
LEMVEDWL

SEQ ID NO: 125851 - protein, 8 aa, West Nile virus
EMVEDWLH

SEQ ID NO: 125852 - protein, 8 aa, West Nile virus
MVEDWLHR

SEQ ID NO: 125853 - protein, 8 aa, West Nile virus
VEDWLHRG

SEQ ID NO: 125854 - protein, 8 aa, West Nile virus
EDWLHRGP

SEQ ID NO: 125855 - protein, 8 aa, West Nile virus
DWLHRGPR

SEQ ID NO: 125856 - protein, 8 aa, West Nile virus
WLHRGPRE

SEQ ID NO: 125857 - protein, 8 aa, West Nile virus
LHRGPREF

SEQ ID NO: 125858 - protein, 8 aa, West Nile virus
HRGPREFC

SEQ ID NO: 125859 - protein, 8 aa, West Nile virus
RGPREFCV

SEQ ID NO: 125860 - protein, 8 aa, West Nile virus
GPREFCVK

SEQ ID NO: 125861 - protein, 8 aa, West Nile virus
PREFCVKV

SEQ ID NO: 125862 - protein, 8 aa, West Nile virus
REFCVKVL

SEQ ID NO: 125863 - protein, 8 aa, West Nile virus
EFCVKVLC

SEQ ID NO: 125864 - protein, 8 aa, West Nile virus
FCVKVLCP

SEQ ID NO: 125865 - protein, 8 aa, West Nile virus
CVKVLCPY

SEQ ID NO: 125866 - protein, 8 aa, West Nile virus
VKVLCPYM

SEQ ID NO: 125867 - protein, 8 aa, West Nile virus
KVLCPYMP

SEQ ID NO: 125868 - protein, 8 aa, West Nile virus
VLCPYMPK

SEQ ID NO: 125869 - protein, 8 aa, West Nile virus
LCPYMPKV

SEQ ID NO: 125870 - protein, 8 aa, West Nile virus
CPYMPKVI

SEQ ID NO: 125871 - protein, 8 aa, West Nile virus
PYMPKVIE

SEQ ID NO: 125872 - protein, 8 aa, West Nile virus
YMPKVIEK

SEQ ID NO: 125873 - protein, 8 aa, West Nile virus
MPKVIEKM

SEQ ID NO: 125874 - protein, 8 aa, West Nile virus
PKVIEKME

SEQ ID NO: 125875 - protein, 8 aa, West Nile virus
KVIEKMEL

SEQ ID NO: 125876 - protein, 8 aa, West Nile virus
VIEKMELL

SEQ ID NO: 125877 - protein, 8 aa, West Nile virus
IEKMELLQ

SEQ ID NO: 125878 - protein, 8 aa, West Nile virus
EKMELLQR

SEQ ID NO: 125879 - protein, 8 aa, West Nile virus
KMELLQRR

SEQ ID NO: 125880 - protein, 8 aa, West Nile virus
MELLQRRY

SEQ ID NO: 125881 - protein, 8 aa, West Nile virus
ELLQRRYG

SEQ ID NO: 125882 - protein, 8 aa, West Nile virus
LLQRRYGG

SEQ ID NO: 125883 - protein, 8 aa, West Nile virus
LQRRYGGG

SEQ ID NO: 125884 - protein, 8 aa, West Nile virus
QRRYGGGL

SEQ ID NO: 125885 - protein, 8 aa, West Nile virus
RRYGGGLV

SEQ ID NO: 125886 - protein, 8 aa, West Nile virus
RYGGGLVR

SEQ ID NO: 125887 - protein, 8 aa, West Nile virus
YGGGLVRN

SEQ ID NO: 125888 - protein, 8 aa, West Nile virus
GGGLVRNP

SEQ ID NO: 125889 - protein, 8 aa, West Nile virus
GGLVRNPL

SEQ ID NO: 125890 - protein, 8 aa, West Nile virus
GLVRNPLS

SEQ ID NO: 125891 - protein, 8 aa, West Nile virus
LVRNPLSR

SEQ ID NO: 125892 - protein, 8 aa, West Nile virus
VRNPLSRN

SEQ ID NO: 125893 - protein, 8 aa, West Nile virus
RNPLSRNS

SEQ ID NO: 125894 - protein, 8 aa, West Nile virus
NPLSRNST

SEQ ID NO: 125895 - protein, 8 aa, West Nile virus
PLSRNSTH

SEQ ID NO: 125896 - protein, 8 aa, West Nile virus
LSRNSTHE

SEQ ID NO: 125897 - protein, 8 aa, West Nile virus
SRNSTHEM

SEQ ID NO: 125898 - protein, 8 aa, West Nile virus
RNSTHEMY

SEQ ID NO: 125899 - protein, 8 aa, West Nile virus
NSTHEMYW

SEQ ID NO: 125900 - protein, 8 aa, West Nile virus
STHEMYWV

SEQ ID NO: 125901 - protein, 8 aa, West Nile virus
THEMYWVS

SEQ ID NO: 125902 - protein, 8 aa, West Nile virus
HEMYWVSR

SEQ ID NO: 125903 - protein, 8 aa, West Nile virus
EMYWVSRA

SEQ ID NO: 125904 - protein, 8 aa, West Nile virus
MYWVSRAS

SEQ ID NO: 125905 - protein, 8 aa, West Nile virus
YWVSRASG

SEQ ID NO: 125906 - protein, 8 aa, West Nile virus
WVSRASGN

SEQ ID NO: 125907 - protein, 8 aa, West Nile virus
VSRASGNV

SEQ ID NO: 125908 - protein, 8 aa, West Nile virus
SRASGNVV

SEQ ID NO: 125909 - protein, 8 aa, West Nile virus
RASGNVVH

SEQ ID NO: 125910 - protein, 8 aa, West Nile virus
ASGNVVHS

SEQ ID NO: 125911 - protein, 8 aa, West Nile virus
NVVHSVNM

SEQ ID NO: 125912 - protein, 8 aa, West Nile virus
VVHSVNMT

SEQ ID NO: 125913 - protein, 8 aa, West Nile virus
VHSVNMTS

SEQ ID NO: 125914 - protein, 8 aa, West Nile virus
HSVNMTSQ

SEQ ID NO: 125915 - protein, 8 aa, West Nile virus
SVNMTSQV

SEQ ID NO: 125916 - protein, 8 aa, West Nile virus
VNMTSQVL

SEQ ID NO: 125917 - protein, 8 aa, West Nile virus
NMTSQVLL

SEQ ID NO: 125918 - protein, 8 aa, West Nile virus
MTSQVLLG

SEQ ID NO: 125919 - protein, 8 aa, West Nile virus
TSQVLLGR

SEQ ID NO: 125920 - protein, 8 aa, West Nile virus
SQVLLGRM

SEQ ID NO: 125921 - protein, 8 aa, West Nile virus
QVLLGRME

SEQ ID NO: 125922 - protein, 8 aa, West Nile virus
VLLGRMEK

SEQ ID NO: 125923 - protein, 8 aa, West Nile virus
LLGRMEKR

SEQ ID NO: 125924 - protein, 8 aa, West Nile virus
LGRMEKRT

SEQ ID NO: 125925 - protein, 8 aa, West Nile virus
GRMEKRTW

SEQ ID NO: 125926 - protein, 8 aa, West Nile virus
RMEKRTWK

SEQ ID NO: 125927 - protein, 8 aa, West Nile virus
MEKRTWKG

SEQ ID NO: 125928 - protein, 8 aa, West Nile virus
EKRTWKGP

SEQ ID NO: 125929 - protein, 8 aa, West Nile virus
KRTWKGPQ

SEQ ID NO: 125930 - protein, 8 aa, West Nile virus
RTWKGPQY

SEQ ID NO: 125931 - protein, 8 aa, West Nile virus
TWKGPQYE

SEQ ID NO: 125932 - protein, 8 aa, West Nile virus
WKGPQYEE

SEQ ID NO: 125933 - protein, 8 aa, West Nile virus
KGPQYEED

SEQ ID NO: 125934 - protein, 8 aa, West Nile virus
GPQYEEDV

SEQ ID NO: 125935 - protein, 8 aa, West Nile virus
PQYEEDVN

SEQ ID NO: 125936 - protein, 8 aa, West Nile virus
QYEEDVNL

SEQ ID NO: 125937 - protein, 8 aa, West Nile virus
YEEDVNLG

SEQ ID NO: 125938 - protein, 8 aa, West Nile virus
EEDVNLGS

SEQ ID NO: 125939 - protein, 8 aa, West Nile virus
EDVNLGSG

SEQ ID NO: 125940 - protein, 8 aa, West Nile virus
DVNLGSGT

SEQ ID NO: 125941 - protein, 8 aa, West Nile virus
VNLGSGTR

SEQ ID NO: 125942 - protein, 8 aa, West Nile virus
NLGSGTRA

SEQ ID NO: 125943 - protein, 8 aa, West Nile virus
LGSGTRAV

SEQ ID NO: 125944 - protein, 8 aa, West Nile virus
GSGTRAVG

SEQ ID NO: 125945 - protein, 8 aa, West Nile virus
SGTRAVGK

SEQ ID NO: 125946 - protein, 8 aa, West Nile virus
GTRAVGKP

SEQ ID NO: 125947 - protein, 8 aa, West Nile virus
TRAVGKPL

SEQ ID NO: 125948 - protein, 8 aa, West Nile virus
RAVGKPLL

SEQ ID NO: 125949 - protein, 8 aa, West Nile virus
AVGKPLLN

SEQ ID NO: 125950 - protein, 8 aa, West Nile virus
VGKPLLNS

SEQ ID NO: 125951 - protein, 8 aa, West Nile virus
GKPLLNSD

SEQ ID NO: 125952 - protein, 8 aa, West Nile virus
KPLLNSDT

SEQ ID NO: 125953 - protein, 8 aa, West Nile virus
PLLNSDTS

SEQ ID NO: 125954 - protein, 8 aa, West Nile virus
LLNSDTSK

SEQ ID NO: 125955 - protein, 8 aa, West Nile virus
LNSDTSKI

SEQ ID NO: 125956 - protein, 8 aa, West Nile virus
NSDTSKIK

SEQ ID NO: 125957 - protein, 8 aa, West Nile virus
SDTSKIKN

SEQ ID NO: 125958 - protein, 8 aa, West Nile virus
DTSKIKNR

SEQ ID NO: 125959 - protein, 8 aa, West Nile virus
IKNRIERL

SEQ ID NO: 125960 - protein, 8 aa, West Nile virus
NRIERLRR

SEQ ID NO: 125961 - protein, 8 aa, West Nile virus
RIERLRRE

SEQ ID NO: 125962 - protein, 8 aa, West Nile virus
IERLRREY

SEQ ID NO: 125963 - protein, 8 aa, West Nile virus
ERLRREYS

SEQ ID NO: 125964 - protein, 8 aa, West Nile virus
REYSSTWH

SEQ ID NO: 125965 - protein, 8 aa, West Nile virus
DENHPYRT

SEQ ID NO: 125966 - protein, 8 aa, West Nile virus
ENHPYRTW

SEQ ID NO: 125967 - protein, 8 aa, West Nile virus
NHPYRTWN

SEQ ID NO: 125968 - protein, 8 aa, West Nile virus
HPYRTWNY

SEQ ID NO: 125969 - protein, 8 aa, West Nile virus
PYRTWNYH

SEQ ID NO: 125970 - protein, 8 aa, West Nile virus
YRTWNYHG

SEQ ID NO: 125971 - protein, 8 aa, West Nile virus
RTWNYHGS

SEQ ID NO: 125972 - protein, 8 aa, West Nile virus
TWNYHGSY

SEQ ID NO: 125973 - protein, 8 aa, West Nile virus
WNYHGSYD

SEQ ID NO: 125974 - protein, 8 aa, West Nile virus
NYHGSYDV

SEQ ID NO: 125975 - protein, 8 aa, West Nile virus
YHGSYDVK

SEQ ID NO: 125976 - protein, 8 aa, West Nile virus
HGSYDVKP

SEQ ID NO: 125977 - protein, 8 aa, West Nile virus
GSYDVKPT

SEQ ID NO: 125978 - protein, 8 aa, West Nile virus
SYDVKPTG

SEQ ID NO: 125979 - protein, 8 aa, West Nile virus
YDVKPTGS

SEQ ID NO: 125980 - protein, 8 aa, West Nile virus
DVKPTGSA

SEQ ID NO: 125981 - protein, 8 aa, West Nile virus
VKPTGSAS

SEQ ID NO: 125982 - protein, 8 aa, West Nile virus
KPTGSASS

SEQ ID NO: 125983 - protein, 8 aa, West Nile virus
PTGSASSL

SEQ ID NO: 125984 - protein, 8 aa, West Nile virus
TGSASSLV

SEQ ID NO: 125985 - protein, 8 aa, West Nile virus
GSASSLVN

SEQ ID NO: 125986 - protein, 8 aa, West Nile virus
SASSLVNG

SEQ ID NO: 125987 - protein, 8 aa, West Nile virus
ASSLVNGV

SEQ ID NO: 125988 - protein, 8 aa, West Nile virus
SSLVNGVV

SEQ ID NO: 125989 - protein, 8 aa, West Nile virus
SLVNGVVR

SEQ ID NO: 125990 - protein, 8 aa, West Nile virus
LVNGVVRL

SEQ ID NO: 125991 - protein, 8 aa, West Nile virus
VNGVVRLL

SEQ ID NO: 125992 - protein, 8 aa, West Nile virus
NGVVRLLS

SEQ ID NO: 125993 - protein, 8 aa, West Nile virus
GVVRLLSK

SEQ ID NO: 125994 - protein, 8 aa, West Nile virus
VVRLLSKP

SEQ ID NO: 125995 - protein, 8 aa, West Nile virus
VRLLSKPW

SEQ ID NO: 125996 - protein, 8 aa, West Nile virus
RLLSKPWD

SEQ ID NO: 125997 - protein, 8 aa, West Nile virus
LLSKPWDT

SEQ ID NO: 125998 - protein, 8 aa, West Nile virus
LSKPWDTI

SEQ ID NO: 125999 - protein, 8 aa, West Nile virus
SKPWDTIT

SEQ ID NO: 126000 - protein, 8 aa, West Nile virus
KPWDTITN

SEQ ID NO: 126001 - protein, 8 aa, West Nile virus
PWDTITNV

SEQ ID NO: 126002 - protein, 8 aa, West Nile virus
WDTITNVT

SEQ ID NO: 126003 - protein, 8 aa, West Nile virus
DTITNVTT

SEQ ID NO: 126004 - protein, 8 aa, West Nile virus
TITNVTTM

SEQ ID NO: 126005 - protein, 8 aa, West Nile virus
ITNVTTMA

SEQ ID NO: 126006 - protein, 8 aa, West Nile virus
TNVTTMAM

SEQ ID NO: 126007 - protein, 8 aa, West Nile virus
NVTTMAMT

SEQ ID NO: 126008 - protein, 8 aa, West Nile virus
VTTMAMTD

SEQ ID NO: 126009 - protein, 8 aa, West Nile virus
TTMAMTDT

SEQ ID NO: 126010 - protein, 8 aa, West Nile virus
TMAMTDTT

SEQ ID NO: 126011 - protein, 8 aa, West Nile virus
MAMTDTTP

SEQ ID NO: 126012 - protein, 8 aa, West Nile virus
AMTDTTPF

SEQ ID NO: 126013 - protein, 8 aa, West Nile virus
MTDTTPFG

SEQ ID NO: 126014 - protein, 8 aa, West Nile virus
TDTTPFGQ

SEQ ID NO: 126015 - protein, 8 aa, West Nile virus
DTTPFGQQ

SEQ ID NO: 126016 - protein, 8 aa, West Nile virus
TTPFGQQR

SEQ ID NO: 126017 - protein, 8 aa, West Nile virus
TPFGQQRV

SEQ ID NO: 126018 - protein, 8 aa, West Nile virus
PFGQQRVF

SEQ ID NO: 126019 - protein, 8 aa, West Nile virus
FGQQRVFK

SEQ ID NO: 126020 - protein, 8 aa, West Nile virus
GQQRVFKE

SEQ ID NO: 126021 - protein, 8 aa, West Nile virus
QQRVFKEK

SEQ ID NO: 126022 - protein, 8 aa, West Nile virus
QRVFKEKV

SEQ ID NO: 126023 - protein, 8 aa, West Nile virus
RVFKEKVD

SEQ ID NO: 126024 - protein, 8 aa, West Nile virus
VFKEKVDT

SEQ ID NO: 126025 - protein, 8 aa, West Nile virus
FKEKVDTK

SEQ ID NO: 126026 - protein, 8 aa, West Nile virus
KEKVDTKA

SEQ ID NO: 126027 - protein, 8 aa, West Nile virus
EKVDTKAP

SEQ ID NO: 126028 - protein, 8 aa, West Nile virus
KVDTKAPE

SEQ ID NO: 126029 - protein, 8 aa, West Nile virus
VDTKAPEP

SEQ ID NO: 126030 - protein, 8 aa, West Nile virus
DTKAPEPP

SEQ ID NO: 126031 - protein, 8 aa, West Nile virus
TKAPEPPE

SEQ ID NO: 126032 - protein, 8 aa, West Nile virus
KAPEPPEG

SEQ ID NO: 126033 - protein, 8 aa, West Nile virus
APEPPEGV

SEQ ID NO: 126034 - protein, 8 aa, West Nile virus
PEPPEGVK

SEQ ID NO: 126035 - protein, 8 aa, West Nile virus
VLNETTNW

SEQ ID NO: 126036 - protein, 8 aa, West Nile virus
LNETTNWL

SEQ ID NO: 126037 - protein, 8 aa, West Nile virus
NETTNWLW

SEQ ID NO: 126038 - protein, 8 aa, West Nile virus
ETTNWLWA

SEQ ID NO: 126039 - protein, 8 aa, West Nile virus
TTNWLWAF

SEQ ID NO: 126040 - protein, 8 aa, West Nile virus
TNWLWAFL

SEQ ID NO: 126041 - protein, 8 aa, West Nile virus
NWLWAFLA

SEQ ID NO: 126042 - protein, 8 aa, West Nile virus
WLWAFLAR

SEQ ID NO: 126043 - protein, 8 aa, West Nile virus
REKRPRMC

SEQ ID NO: 126044 - protein, 8 aa, West Nile virus
EKRPRMCS

SEQ ID NO: 126045 - protein, 8 aa, West Nile virus
KRPRMCSR

SEQ ID NO: 126046 - protein, 8 aa, West Nile virus
RPRMCSRE

SEQ ID NO: 126047 - protein, 8 aa, West Nile virus
PRMCSREE

SEQ ID NO: 126048 - protein, 8 aa, West Nile virus
RMCSREEF

SEQ ID NO: 126049 - protein, 8 aa, West Nile virus
MCSREEFI

SEQ ID NO: 126050 - protein, 8 aa, West Nile virus
CSREEFIR

SEQ ID NO: 126051 - protein, 8 aa, West Nile virus
SREEFIRK

SEQ ID NO: 126052 - protein, 8 aa, West Nile virus
REEFIRKV

SEQ ID NO: 126053 - protein, 8 aa, West Nile virus
EEFIRKVN

SEQ ID NO: 126054 - protein, 8 aa, West Nile virus
EFIRKVNS

SEQ ID NO: 126055 - protein, 8 aa, West Nile virus
FIRKVNSN

SEQ ID NO: 126056 - protein, 8 aa, West Nile virus
IRKVNSNA

SEQ ID NO: 126057 - protein, 8 aa, West Nile virus
RKVNSNAA

SEQ ID NO: 126058 - protein, 8 aa, West Nile virus
KVNSNAAL

SEQ ID NO: 126059 - protein, 8 aa, West Nile virus
VNSNAALG

SEQ ID NO: 126060 - protein, 8 aa, West Nile virus
NSNAALGA

SEQ ID NO: 126061 - protein, 8 aa, West Nile virus
SNAALGAM

SEQ ID NO: 126062 - protein, 8 aa, West Nile virus
NAALGAMF

SEQ ID NO: 126063 - protein, 8 aa, West Nile virus
AALGAMFE

SEQ ID NO: 126064 - protein, 8 aa, West Nile virus
ALGAMFEE

SEQ ID NO: 126065 - protein, 8 aa, West Nile virus
LGAMFEEQ

SEQ ID NO: 126066 - protein, 8 aa, West Nile virus
GAMFEEQN

SEQ ID NO: 126067 - protein, 8 aa, West Nile virus
AMFEEQNQ

SEQ ID NO: 126068 - protein, 8 aa, West Nile virus
MFEEQNQW

SEQ ID NO: 126069 - protein, 8 aa, West Nile virus
FEEQNQWR

SEQ ID NO: 126070 - protein, 8 aa, West Nile virus
EEQNQWRS

SEQ ID NO: 126071 - protein, 8 aa, West Nile virus
EQNQWRSA

SEQ ID NO: 126072 - protein, 8 aa, West Nile virus
QNQWRSAR

SEQ ID NO: 126073 - protein, 8 aa, West Nile virus
NQWRSARE

SEQ ID NO: 126074 - protein, 8 aa, West Nile virus
QWRSAREA

SEQ ID NO: 126075 - protein, 8 aa, West Nile virus
WRSAREAV

SEQ ID NO: 126076 - protein, 8 aa, West Nile virus
RSAREAVE

SEQ ID NO: 126077 - protein, 8 aa, West Nile virus
SAREAVED

SEQ ID NO: 126078 - protein, 8 aa, West Nile virus
AREAVEDP

SEQ ID NO: 126079 - protein, 8 aa, West Nile virus
REAVEDPK

SEQ ID NO: 126080 - protein, 8 aa, West Nile virus
EAVEDPKF

SEQ ID NO: 126081 - protein, 8 aa, West Nile virus
AVEDPKFW

SEQ ID NO: 126082 - protein, 8 aa, West Nile virus
VEDPKFWE

SEQ ID NO: 126083 - protein, 8 aa, West Nile virus
EDPKFWEM

SEQ ID NO: 126084 - protein, 8 aa, West Nile virus
DPKFWEMV

SEQ ID NO: 126085 - protein, 8 aa, West Nile virus
PKFWEMVD

SEQ ID NO: 126086 - protein, 8 aa, West Nile virus
KFWEMVDE

SEQ ID NO: 126087 - protein, 8 aa, West Nile virus
FWEMVDEE

SEQ ID NO: 126088 - protein, 8 aa, West Nile virus
WEMVDEER

SEQ ID NO: 126089 - protein, 8 aa, West Nile virus
EMVDEERE

SEQ ID NO: 126090 - protein, 8 aa, West Nile virus
MVDEEREA

SEQ ID NO: 126091 - protein, 8 aa, West Nile virus
VDEEREAH

SEQ ID NO: 126092 - protein, 8 aa, West Nile virus
DEEREAHL

SEQ ID NO: 126093 - protein, 8 aa, West Nile virus
EEREAHLR

SEQ ID NO: 126094 - protein, 8 aa, West Nile virus
EREAHLRG

SEQ ID NO: 126095 - protein, 8 aa, West Nile virus
REAHLRGE

SEQ ID NO: 126096 - protein, 8 aa, West Nile virus
EAHLRGEC

SEQ ID NO: 126097 - protein, 8 aa, West Nile virus
AHLRGECH

SEQ ID NO: 126098 - protein, 8 aa, West Nile virus
HLRGECHT

SEQ ID NO: 126099 - protein, 8 aa, West Nile virus
LRGECHTC

SEQ ID NO: 126100 - protein, 8 aa, West Nile virus
RGECHTCI

SEQ ID NO: 126101 - protein, 8 aa, West Nile virus
GECHTCIY

SEQ ID NO: 126102 - protein, 8 aa, West Nile virus
ECHTCIYN

SEQ ID NO: 126103 - protein, 8 aa, West Nile virus
CHTCIYNM

SEQ ID NO: 126104 - protein, 8 aa, West Nile virus
HTCIYNMM

SEQ ID NO: 126105 - protein, 8 aa, West Nile virus
TCIYNMMG

SEQ ID NO: 126106 - protein, 8 aa, West Nile virus
CIYNMMGK

SEQ ID NO: 126107 - protein, 8 aa, West Nile virus
IYNMMGKR

SEQ ID NO: 126108 - protein, 8 aa, West Nile virus
YNMMGKRE

SEQ ID NO: 126109 - protein, 8 aa, West Nile virus
NMMGKREK

SEQ ID NO: 126110 - protein, 8 aa, West Nile virus
MMGKREKK

SEQ ID NO: 126111 - protein, 8 aa, West Nile virus
MGKREKKP

SEQ ID NO: 126112 - protein, 8 aa, West Nile virus
GKREKKPG

SEQ ID NO: 126113 - protein, 8 aa, West Nile virus
KREKKPGE

SEQ ID NO: 126114 - protein, 8 aa, West Nile virus
REKKPGEF

SEQ ID NO: 126115 - protein, 8 aa, West Nile virus
EKKPGEFG

SEQ ID NO: 126116 - protein, 8 aa, West Nile virus
KKPGEFGK

SEQ ID NO: 126117 - protein, 8 aa, West Nile virus
KPGEFGKA

SEQ ID NO: 126118 - protein, 8 aa, West Nile virus
PGEFGKAK

SEQ ID NO: 126119 - protein, 8 aa, West Nile virus
GEFGKAKG

SEQ ID NO: 126120 - protein, 8 aa, West Nile virus
EFGKAKGS

SEQ ID NO: 126121 - protein, 8 aa, West Nile virus
FGKAKGSR

SEQ ID NO: 126122 - protein, 8 aa, West Nile virus
GKAKGSRA

SEQ ID NO: 126123 - protein, 8 aa, West Nile virus
KAKGSRAI

SEQ ID NO: 126124 - protein, 8 aa, West Nile virus
AKGSRAIW

SEQ ID NO: 126125 - protein, 8 aa, West Nile virus
KGSRAIWF

SEQ ID NO: 126126 - protein, 8 aa, West Nile virus
GSRAIWFM

SEQ ID NO: 126127 - protein, 8 aa, West Nile virus
SRAIWFMW

SEQ ID NO: 126128 - protein, 8 aa, West Nile virus
RAIWFMWL

SEQ ID NO: 126129 - protein, 8 aa, West Nile virus
AIWFMWLG

SEQ ID NO: 126130 - protein, 8 aa, West Nile virus
IWFMWLGA

SEQ ID NO: 126131 - protein, 8 aa, West Nile virus
WFMWLGAR

SEQ ID NO: 126132 - protein, 8 aa, West Nile virus
FMWLGARF

SEQ ID NO: 126133 - protein, 8 aa, West Nile virus
MWLGARFL

SEQ ID NO: 126134 - protein, 8 aa, West Nile virus
WLGARFLE

SEQ ID NO: 126135 - protein, 8 aa, West Nile virus
LGARFLEF

SEQ ID NO: 126136 - protein, 8 aa, West Nile virus
GARFLEFE

SEQ ID NO: 126137 - protein, 8 aa, West Nile virus
ARFLEFEA

SEQ ID NO: 126138 - protein, 8 aa, West Nile virus
RFLEFEAL

SEQ ID NO: 126139 - protein, 8 aa, West Nile virus
FLEFEALG

SEQ ID NO: 126140 - protein, 8 aa, West Nile virus
LEFEALGF

SEQ ID NO: 126141 - protein, 8 aa, West Nile virus
EFEALGFL

SEQ ID NO: 126142 - protein, 8 aa, West Nile virus
FEALGFLN

SEQ ID NO: 126143 - protein, 8 aa, West Nile virus
EALGFLNE

SEQ ID NO: 126144 - protein, 8 aa, West Nile virus
ALGFLNED

SEQ ID NO: 126145 - protein, 8 aa, West Nile virus
LGFLNEDH

SEQ ID NO: 126146 - protein, 8 aa, West Nile virus
GFLNEDHW

SEQ ID NO: 126147 - protein, 8 aa, West Nile virus
FLNEDHWL

SEQ ID NO: 126148 - protein, 8 aa, West Nile virus
LNEDHWLG

SEQ ID NO: 126149 - protein, 8 aa, West Nile virus
NEDHWLGR

SEQ ID NO: 126150 - protein, 8 aa, West Nile virus
EDHWLGRK

SEQ ID NO: 126151 - protein, 8 aa, West Nile virus
DHWLGRKN

SEQ ID NO: 126152 - protein, 8 aa, West Nile virus
HWLGRKNS

SEQ ID NO: 126153 - protein, 8 aa, West Nile virus
WLGRKNSG

SEQ ID NO: 126154 - protein, 8 aa, West Nile virus
LGRKNSGG

SEQ ID NO: 126155 - protein, 8 aa, West Nile virus
GRKNSGGG

SEQ ID NO: 126156 - protein, 8 aa, West Nile virus
RKNSGGGV

SEQ ID NO: 126157 - protein, 8 aa, West Nile virus
KNSGGGVE

SEQ ID NO: 126158 - protein, 8 aa, West Nile virus
NSGGGVEG

SEQ ID NO: 126159 - protein, 8 aa, West Nile virus
SGGGVEGL

SEQ ID NO: 126160 - protein, 8 aa, West Nile virus
GGGVEGLG

SEQ ID NO: 126161 - protein, 8 aa, West Nile virus
GGVEGLGL

SEQ ID NO: 126162 - protein, 8 aa, West Nile virus
GVEGLGLQ

SEQ ID NO: 126163 - protein, 8 aa, West Nile virus
VEGLGLQK

SEQ ID NO: 126164 - protein, 8 aa, West Nile virus
EGLGLQKL

SEQ ID NO: 126165 - protein, 8 aa, West Nile virus
GLGLQKLG

SEQ ID NO: 126166 - protein, 8 aa, West Nile virus
LGLQKLGY

SEQ ID NO: 126167 - protein, 8 aa, West Nile virus
GLQKLGYI

SEQ ID NO: 126168 - protein, 8 aa, West Nile virus
LQKLGYIL

SEQ ID NO: 126169 - protein, 8 aa, West Nile virus
QKLGYILR

SEQ ID NO: 126170 - protein, 8 aa, West Nile virus
KLGYILRE

SEQ ID NO: 126171 - protein, 8 aa, West Nile virus
LGYILREV

SEQ ID NO: 126172 - protein, 8 aa, West Nile virus
GYILREVG

SEQ ID NO: 126173 - protein, 8 aa, West Nile virus
GGKIYADD

SEQ ID NO: 126174 - protein, 8 aa, West Nile virus
GKIYADDT

SEQ ID NO: 126175 - protein, 8 aa, West Nile virus
KIYADDTA

SEQ ID NO: 126176 - protein, 8 aa, West Nile virus
IYADDTAG

SEQ ID NO: 126177 - protein, 8 aa, West Nile virus
YADDTAGW

SEQ ID NO: 126178 - protein, 8 aa, West Nile virus
ADDTAGWD

SEQ ID NO: 126179 - protein, 8 aa, West Nile virus
DDTAGWDT

SEQ ID NO: 126180 - protein, 8 aa, West Nile virus
DTAGWDTR

SEQ ID NO: 126181 - protein, 8 aa, West Nile virus
TAGWDTRI

SEQ ID NO: 126182 - protein, 8 aa, West Nile virus
AGWDTRIT

SEQ ID NO: 126183 - protein, 8 aa, West Nile virus
GWDTRITR

SEQ ID NO: 126184 - protein, 8 aa, West Nile virus
WDTRITRA

SEQ ID NO: 126185 - protein, 8 aa, West Nile virus
DTRITRAD

SEQ ID NO: 126186 - protein, 8 aa, West Nile virus
TRITRADL

SEQ ID NO: 126187 - protein, 8 aa, West Nile virus
RITRADLE

SEQ ID NO: 126188 - protein, 8 aa, West Nile virus
ITRADLEN

SEQ ID NO: 126189 - protein, 8 aa, West Nile virus
TRADLENE

SEQ ID NO: 126190 - protein, 8 aa, West Nile virus
RADLENEA

SEQ ID NO: 126191 - protein, 8 aa, West Nile virus
ADLENEAK

SEQ ID NO: 126192 - protein, 8 aa, West Nile virus
DLENEAKV

SEQ ID NO: 126193 - protein, 8 aa, West Nile virus
LENEAKVL

SEQ ID NO: 126194 - protein, 8 aa, West Nile virus
ENEAKVLE

SEQ ID NO: 126195 - protein, 8 aa, West Nile virus
NEAKVLEL

SEQ ID NO: 126196 - protein, 8 aa, West Nile virus
EAKVLELL

SEQ ID NO: 126197 - protein, 8 aa, West Nile virus
AKVLELLD

SEQ ID NO: 126198 - protein, 8 aa, West Nile virus
KVLELLDG

SEQ ID NO: 126199 - protein, 8 aa, West Nile virus
VLELLDGE

SEQ ID NO: 126200 - protein, 8 aa, West Nile virus
LELLDGEH

SEQ ID NO: 126201 - protein, 8 aa, West Nile virus
ELLDGEHR

SEQ ID NO: 126202 - protein, 8 aa, West Nile virus
LLDGEHRR

SEQ ID NO: 126203 - protein, 8 aa, West Nile virus
LDGEHRRL

SEQ ID NO: 126204 - protein, 8 aa, West Nile virus
DGEHRRLA

SEQ ID NO: 126205 - protein, 8 aa, West Nile virus
GEHRRLAR

SEQ ID NO: 126206 - protein, 8 aa, West Nile virus
EHRRLARA

SEQ ID NO: 126207 - protein, 8 aa, West Nile virus
HRRLARAI

SEQ ID NO: 126208 - protein, 8 aa, West Nile virus
RRLARAII

SEQ ID NO: 126209 - protein, 8 aa, West Nile virus
RLARAIIE

SEQ ID NO: 126210 - protein, 8 aa, West Nile virus
LARAIIEL

SEQ ID NO: 126211 - protein, 8 aa, West Nile virus
ARAIIELT

SEQ ID NO: 126212 - protein, 8 aa, West Nile virus
RAIIELTY

SEQ ID NO: 126213 - protein, 8 aa, West Nile virus
AIIELTYR

SEQ ID NO: 126214 - protein, 8 aa, West Nile virus
IIELTYRH

SEQ ID NO: 126215 - protein, 8 aa, West Nile virus
IELTYRHK

SEQ ID NO: 126216 - protein, 8 aa, West Nile virus
ELTYRHKV

SEQ ID NO: 126217 - protein, 8 aa, West Nile virus
LTYRHKVV

SEQ ID NO: 126218 - protein, 8 aa, West Nile virus
TYRHKVVK

SEQ ID NO: 126219 - protein, 8 aa, West Nile virus
YRHKVVKV

SEQ ID NO: 126220 - protein, 8 aa, West Nile virus
RHKVVKVM

SEQ ID NO: 126221 - protein, 8 aa, West Nile virus
HKVVKVMR

SEQ ID NO: 126222 - protein, 8 aa, West Nile virus
KVVKVMRP

SEQ ID NO: 126223 - protein, 8 aa, West Nile virus
VVKVMRPA

SEQ ID NO: 126224 - protein, 8 aa, West Nile virus
VKVMRPAA

SEQ ID NO: 126225 - protein, 8 aa, West Nile virus
KVMRPAAD

SEQ ID NO: 126226 - protein, 8 aa, West Nile virus
VMRPAADG

SEQ ID NO: 126227 - protein, 8 aa, West Nile virus
MRPAADGR

SEQ ID NO: 126228 - protein, 8 aa, West Nile virus
RPAADGRT

SEQ ID NO: 126229 - protein, 8 aa, West Nile virus
PAADGRTV

SEQ ID NO: 126230 - protein, 8 aa, West Nile virus
AADGRTVM

SEQ ID NO: 126231 - protein, 8 aa, West Nile virus
ADGRTVMD

SEQ ID NO: 126232 - protein, 8 aa, West Nile virus
DGRTVMDV

SEQ ID NO: 126233 - protein, 8 aa, West Nile virus
GRTVMDVI

SEQ ID NO: 126234 - protein, 8 aa, West Nile virus
RTVMDVIS

SEQ ID NO: 126235 - protein, 8 aa, West Nile virus
TVMDVISR

SEQ ID NO: 126236 - protein, 8 aa, West Nile virus
VMDVISRE

SEQ ID NO: 126237 - protein, 8 aa, West Nile virus
MDVISRED

SEQ ID NO: 126238 - protein, 8 aa, West Nile virus
DVISREDQ

SEQ ID NO: 126239 - protein, 8 aa, West Nile virus
VISREDQR

SEQ ID NO: 126240 - protein, 8 aa, West Nile virus
ISREDQRG

SEQ ID NO: 126241 - protein, 8 aa, West Nile virus
SREDQRGS

SEQ ID NO: 126242 - protein, 8 aa, West Nile virus
REDQRGSG

SEQ ID NO: 126243 - protein, 8 aa, West Nile virus
EDQRGSGQ

SEQ ID NO: 126244 - protein, 8 aa, West Nile virus
DQRGSGQV

SEQ ID NO: 126245 - protein, 8 aa, West Nile virus
QRGSGQVV

SEQ ID NO: 126246 - protein, 8 aa, West Nile virus
RGSGQVVT

SEQ ID NO: 126247 - protein, 8 aa, West Nile virus
GSGQVVTY

SEQ ID NO: 126248 - protein, 8 aa, West Nile virus
SGQVVTYA

SEQ ID NO: 126249 - protein, 8 aa, West Nile virus
GQVVTYAL

SEQ ID NO: 126250 - protein, 8 aa, West Nile virus
QVVTYALN

SEQ ID NO: 126251 - protein, 8 aa, West Nile virus
VVTYALNT

SEQ ID NO: 126252 - protein, 8 aa, West Nile virus
VTYALNTF

SEQ ID NO: 126253 - protein, 8 aa, West Nile virus
TYALNTFT

SEQ ID NO: 126254 - protein, 8 aa, West Nile virus
YALNTFTN

SEQ ID NO: 126255 - protein, 8 aa, West Nile virus
ALNTFTNL

SEQ ID NO: 126256 - protein, 8 aa, West Nile virus
LNTFTNLA

SEQ ID NO: 126257 - protein, 8 aa, West Nile virus
NTFTNLAV

SEQ ID NO: 126258 - protein, 8 aa, West Nile virus
TFTNLAVQ

SEQ ID NO: 126259 - protein, 8 aa, West Nile virus
FTNLAVQL

SEQ ID NO: 126260 - protein, 8 aa, West Nile virus
TNLAVQLV

SEQ ID NO: 126261 - protein, 8 aa, West Nile virus
NLAVQLVR

SEQ ID NO: 126262 - protein, 8 aa, West Nile virus
LAVQLVRM

SEQ ID NO: 126263 - protein, 8 aa, West Nile virus
AVQLVRMM

SEQ ID NO: 126264 - protein, 8 aa, West Nile virus
VQLVRMME

SEQ ID NO: 126265 - protein, 8 aa, West Nile virus
QLVRMMEG

SEQ ID NO: 126266 - protein, 8 aa, West Nile virus
LVRMMEGE

SEQ ID NO: 126267 - protein, 8 aa, West Nile virus
VRMMEGEG

SEQ ID NO: 126268 - protein, 8 aa, West Nile virus
RMMEGEGV

SEQ ID NO: 126269 - protein, 8 aa, West Nile virus
MMEGEGVI

SEQ ID NO: 126270 - protein, 8 aa, West Nile virus
MEGEGVIG

SEQ ID NO: 126271 - protein, 8 aa, West Nile virus
EGEGVIGP

SEQ ID NO: 126272 - protein, 8 aa, West Nile virus
GEGVIGPD

SEQ ID NO: 126273 - protein, 8 aa, West Nile virus
EGVIGPDD

SEQ ID NO: 126274 - protein, 8 aa, West Nile virus
GVIGPDDV

SEQ ID NO: 126275 - protein, 8 aa, West Nile virus
VIGPDDVE

SEQ ID NO: 126276 - protein, 8 aa, West Nile virus
GPDDVEKL

SEQ ID NO: 126277 - protein, 8 aa, West Nile virus
PDDVEKLT

SEQ ID NO: 126278 - protein, 8 aa, West Nile virus
KGKGPKVR

SEQ ID NO: 126279 - protein, 8 aa, West Nile virus
GKGPKVRT

SEQ ID NO: 126280 - protein, 8 aa, West Nile virus
KGPKVRTW

SEQ ID NO: 126281 - protein, 8 aa, West Nile virus
GPKVRTWL

SEQ ID NO: 126282 - protein, 8 aa, West Nile virus
PKVRTWLF

SEQ ID NO: 126283 - protein, 8 aa, West Nile virus
KVRTWLFE

SEQ ID NO: 126284 - protein, 8 aa, West Nile virus
VRTWLFEN

SEQ ID NO: 126285 - protein, 8 aa, West Nile virus
RTWLFENG

SEQ ID NO: 126286 - protein, 8 aa, West Nile virus
TWLFENGE

SEQ ID NO: 126287 - protein, 8 aa, West Nile virus
WLFENGEE

SEQ ID NO: 126288 - protein, 8 aa, West Nile virus
LFENGEER

SEQ ID NO: 126289 - protein, 8 aa, West Nile virus
FENGEERL

SEQ ID NO: 126290 - protein, 8 aa, West Nile virus
ENGEERLS

SEQ ID NO: 126291 - protein, 8 aa, West Nile virus
NGEERLSR

SEQ ID NO: 126292 - protein, 8 aa, West Nile virus
GEERLSRM

SEQ ID NO: 126293 - protein, 8 aa, West Nile virus
EERLSRMA

SEQ ID NO: 126294 - protein, 8 aa, West Nile virus
ERLSRMAV

SEQ ID NO: 126295 - protein, 8 aa, West Nile virus
RLSRMAVS

SEQ ID NO: 126296 - protein, 8 aa, West Nile virus
LSRMAVSG

SEQ ID NO: 126297 - protein, 8 aa, West Nile virus
SRMAVSGD

SEQ ID NO: 126298 - protein, 8 aa, West Nile virus
RMAVSGDD

SEQ ID NO: 126299 - protein, 8 aa, West Nile virus
MAVSGDDC

SEQ ID NO: 126300 - protein, 8 aa, West Nile virus
AVSGDDCV

SEQ ID NO: 126301 - protein, 8 aa, West Nile virus
VSGDDCVV

SEQ ID NO: 126302 - protein, 8 aa, West Nile virus
SGDDCVVK

SEQ ID NO: 126303 - protein, 8 aa, West Nile virus
GDDCVVKP

SEQ ID NO: 126304 - protein, 8 aa, West Nile virus
DDCVVKPL

SEQ ID NO: 126305 - protein, 8 aa, West Nile virus
DCVVKPLD

SEQ ID NO: 126306 - protein, 8 aa, West Nile virus
CVVKPLDD

SEQ ID NO: 126307 - protein, 8 aa, West Nile virus
VVKPLDDR

SEQ ID NO: 126308 - protein, 8 aa, West Nile virus
VKPLDDRF

SEQ ID NO: 126309 - protein, 8 aa, West Nile virus
KPLDDRFA

SEQ ID NO: 126310 - protein, 8 aa, West Nile virus
PLDDRFAT

SEQ ID NO: 126311 - protein, 8 aa, West Nile virus
LDDRFATS

SEQ ID NO: 126312 - protein, 8 aa, West Nile virus
DDRFATSL

SEQ ID NO: 126313 - protein, 8 aa, West Nile virus
DRFATSLH

SEQ ID NO: 126314 - protein, 8 aa, West Nile virus
RFATSLHF

SEQ ID NO: 126315 - protein, 8 aa, West Nile virus
FATSLHFL

SEQ ID NO: 126316 - protein, 8 aa, West Nile virus
ATSLHFLN

SEQ ID NO: 126317 - protein, 8 aa, West Nile virus
TSLHFLNA

SEQ ID NO: 126318 - protein, 8 aa, West Nile virus
SLHFLNAM

SEQ ID NO: 126319 - protein, 8 aa, West Nile virus
LHFLNAMS

SEQ ID NO: 126320 - protein, 8 aa, West Nile virus
HFLNAMSK

SEQ ID NO: 126321 - protein, 8 aa, West Nile virus
FLNAMSKV

SEQ ID NO: 126322 - protein, 8 aa, West Nile virus
LNAMSKVR

SEQ ID NO: 126323 - protein, 8 aa, West Nile virus
NAMSKVRK

SEQ ID NO: 126324 - protein, 8 aa, West Nile virus
AMSKVRKD

SEQ ID NO: 126325 - protein, 8 aa, West Nile virus
MSKVRKDI

SEQ ID NO: 126326 - protein, 8 aa, West Nile virus
SKVRKDIQ

SEQ ID NO: 126327 - protein, 8 aa, West Nile virus
KVRKDIQE

SEQ ID NO: 126328 - protein, 8 aa, West Nile virus
VRKDIQEW

SEQ ID NO: 126329 - protein, 8 aa, West Nile virus
RKDIQEWK

SEQ ID NO: 126330 - protein, 8 aa, West Nile virus
KDIQEWKP

SEQ ID NO: 126331 - protein, 8 aa, West Nile virus
DIQEWKPS

SEQ ID NO: 126332 - protein, 8 aa, West Nile virus
IQEWKPST

SEQ ID NO: 126333 - protein, 8 aa, West Nile virus
QEWKPSTG

SEQ ID NO: 126334 - protein, 8 aa, West Nile virus
EWKPSTGW

SEQ ID NO: 126335 - protein, 8 aa, West Nile virus
WKPSTGWY

SEQ ID NO: 126336 - protein, 8 aa, West Nile virus
KPSTGWYD

SEQ ID NO: 126337 - protein, 8 aa, West Nile virus
PSTGWYDW

SEQ ID NO: 126338 - protein, 8 aa, West Nile virus
STGWYDWQ

SEQ ID NO: 126339 - protein, 8 aa, West Nile virus
TGWYDWQQ

SEQ ID NO: 126340 - protein, 8 aa, West Nile virus
GWYDWQQV

SEQ ID NO: 126341 - protein, 8 aa, West Nile virus
WYDWQQVP

SEQ ID NO: 126342 - protein, 8 aa, West Nile virus
YDWQQVPF

SEQ ID NO: 126343 - protein, 8 aa, West Nile virus
DWQQVPFC

SEQ ID NO: 126344 - protein, 8 aa, West Nile virus
WQQVPFCS

SEQ ID NO: 126345 - protein, 8 aa, West Nile virus
QQVPFCSN

SEQ ID NO: 126346 - protein, 8 aa, West Nile virus
QVPFCSNH

SEQ ID NO: 126347 - protein, 8 aa, West Nile virus
VPFCSNHF

SEQ ID NO: 126348 - protein, 8 aa, West Nile virus
PFCSNHFT

SEQ ID NO: 126349 - protein, 8 aa, West Nile virus
FCSNHFTE

SEQ ID NO: 126350 - protein, 8 aa, West Nile virus
CSNHFTEL

SEQ ID NO: 126351 - protein, 8 aa, West Nile virus
SNHFTELI

SEQ ID NO: 126352 - protein, 8 aa, West Nile virus
NHFTELIM

SEQ ID NO: 126353 - protein, 8 aa, West Nile virus
HFTELIMK

SEQ ID NO: 126354 - protein, 8 aa, West Nile virus
FTELIMKD

SEQ ID NO: 126355 - protein, 8 aa, West Nile virus
TELIMKDG

SEQ ID NO: 126356 - protein, 8 aa, West Nile virus
ELIMKDGR

SEQ ID NO: 126357 - protein, 8 aa, West Nile virus
LIMKDGRT

SEQ ID NO: 126358 - protein, 8 aa, West Nile virus
IMKDGRTL

SEQ ID NO: 126359 - protein, 8 aa, West Nile virus
MKDGRTLV

SEQ ID NO: 126360 - protein, 8 aa, West Nile virus
KDGRTLVV

SEQ ID NO: 126361 - protein, 8 aa, West Nile virus
DGRTLVVP

SEQ ID NO: 126362 - protein, 8 aa, West Nile virus
GRTLVVPC

SEQ ID NO: 126363 - protein, 8 aa, West Nile virus
RTLVVPCR

SEQ ID NO: 126364 - protein, 8 aa, West Nile virus
TLVVPCRG

SEQ ID NO: 126365 - protein, 8 aa, West Nile virus
LVVPCRGQ

SEQ ID NO: 126366 - protein, 8 aa, West Nile virus
VVPCRGQD

SEQ ID NO: 126367 - protein, 8 aa, West Nile virus
VPCRGQDE

SEQ ID NO: 126368 - protein, 8 aa, West Nile virus
PCRGQDEL

SEQ ID NO: 126369 - protein, 8 aa, West Nile virus
CRGQDELV

SEQ ID NO: 126370 - protein, 8 aa, West Nile virus
RGQDELVG

SEQ ID NO: 126371 - protein, 8 aa, West Nile virus
GQDELVGR

SEQ ID NO: 126372 - protein, 8 aa, West Nile virus
QDELVGRA

SEQ ID NO: 126373 - protein, 8 aa, West Nile virus
DELVGRAR

SEQ ID NO: 126374 - protein, 8 aa, West Nile virus
ELVGRARI

SEQ ID NO: 126375 - protein, 8 aa, West Nile virus
LVGRARIS

SEQ ID NO: 126376 - protein, 8 aa, West Nile virus
VGRARISP

SEQ ID NO: 126377 - protein, 8 aa, West Nile virus
GRARISPG

SEQ ID NO: 126378 - protein, 8 aa, West Nile virus
RARISPGA

SEQ ID NO: 126379 - protein, 8 aa, West Nile virus
ARISPGAG

SEQ ID NO: 126380 - protein, 8 aa, West Nile virus
RISPGAGW

SEQ ID NO: 126381 - protein, 8 aa, West Nile virus
ISPGAGWN

SEQ ID NO: 126382 - protein, 8 aa, West Nile virus
SPGAGWNV

SEQ ID NO: 126383 - protein, 8 aa, West Nile virus
PGAGWNVR

SEQ ID NO: 126384 - protein, 8 aa, West Nile virus
GAGWNVRD

SEQ ID NO: 126385 - protein, 8 aa, West Nile virus
AGWNVRDT

SEQ ID NO: 126386 - protein, 8 aa, West Nile virus
GWNVRDTA

SEQ ID NO: 126387 - protein, 8 aa, West Nile virus
WNVRDTAC

SEQ ID NO: 126388 - protein, 8 aa, West Nile virus
NVRDTACL

SEQ ID NO: 126389 - protein, 8 aa, West Nile virus
VRDTACLA

SEQ ID NO: 126390 - protein, 8 aa, West Nile virus
RDTACLAK

SEQ ID NO: 126391 - protein, 8 aa, West Nile virus
DTACLAKS

SEQ ID NO: 126392 - protein, 8 aa, West Nile virus
TACLAKSY

SEQ ID NO: 126393 - protein, 8 aa, West Nile virus
ACLAKSYA

SEQ ID NO: 126394 - protein, 8 aa, West Nile virus
CLAKSYAQ

SEQ ID NO: 126395 - protein, 8 aa, West Nile virus
LAKSYAQM

SEQ ID NO: 126396 - protein, 8 aa, West Nile virus
AKSYAQMW

SEQ ID NO: 126397 - protein, 8 aa, West Nile virus
KSYAQMWL

SEQ ID NO: 126398 - protein, 8 aa, West Nile virus
SYAQMWLL

SEQ ID NO: 126399 - protein, 8 aa, West Nile virus
YAQMWLLL

SEQ ID NO: 126400 - protein, 8 aa, West Nile virus
AQMWLLLY

SEQ ID NO: 126401 - protein, 8 aa, West Nile virus
QMWLLLYF

SEQ ID NO: 126402 - protein, 8 aa, West Nile virus
MWLLLYFH

SEQ ID NO: 126403 - protein, 8 aa, West Nile virus
WLLLYFHR

SEQ ID NO: 126404 - protein, 8 aa, West Nile virus
LLLYFHRR

SEQ ID NO: 126405 - protein, 8 aa, West Nile virus
LLYFHRRD

SEQ ID NO: 126406 - protein, 8 aa, West Nile virus
LYFHRRDL

SEQ ID NO: 126407 - protein, 8 aa, West Nile virus
YFHRRDLR

SEQ ID NO: 126408 - protein, 8 aa, West Nile virus
FHRRDLRL

SEQ ID NO: 126409 - protein, 8 aa, West Nile virus
HRRDLRLM

SEQ ID NO: 126410 - protein, 8 aa, West Nile virus
RRDLRLMA

SEQ ID NO: 126411 - protein, 8 aa, West Nile virus
RDLRLMAN

SEQ ID NO: 126412 - protein, 8 aa, West Nile virus
DLRLMANA

SEQ ID NO: 126413 - protein, 8 aa, West Nile virus
LRLMANAI

SEQ ID NO: 126414 - protein, 8 aa, West Nile virus
RLMANAIC

SEQ ID NO: 126415 - protein, 8 aa, West Nile virus
LMANAICS

SEQ ID NO: 126416 - protein, 8 aa, West Nile virus
MANAICSA

SEQ ID NO: 126417 - protein, 8 aa, West Nile virus
ANAICSAV

SEQ ID NO: 126418 - protein, 8 aa, West Nile virus
NAICSAVP

SEQ ID NO: 126419 - protein, 8 aa, West Nile virus
AICSAVPV

SEQ ID NO: 126420 - protein, 8 aa, West Nile virus
ICSAVPVN

SEQ ID NO: 126421 - protein, 8 aa, West Nile virus
CSAVPVNW

SEQ ID NO: 126422 - protein, 8 aa, West Nile virus
SAVPVNWV

SEQ ID NO: 126423 - protein, 8 aa, West Nile virus
AVPVNWVP

SEQ ID NO: 126424 - protein, 8 aa, West Nile virus
VPVNWVPT

SEQ ID NO: 126425 - protein, 8 aa, West Nile virus
PVNWVPTG

SEQ ID NO: 126426 - protein, 8 aa, West Nile virus
VNWVPTGR

SEQ ID NO: 126427 - protein, 8 aa, West Nile virus
NWVPTGRT

SEQ ID NO: 126428 - protein, 8 aa, West Nile virus
WVPTGRTT

SEQ ID NO: 126429 - protein, 8 aa, West Nile virus
VPTGRTTW

SEQ ID NO: 126430 - protein, 8 aa, West Nile virus
PTGRTTWS

SEQ ID NO: 126431 - protein, 8 aa, West Nile virus
TGRTTWSI

SEQ ID NO: 126432 - protein, 8 aa, West Nile virus
GRTTWSIH

SEQ ID NO: 126433 - protein, 8 aa, West Nile virus
RTTWSIHA

SEQ ID NO: 126434 - protein, 8 aa, West Nile virus
TTWSIHAG

SEQ ID NO: 126435 - protein, 8 aa, West Nile virus
TWSIHAGG

SEQ ID NO: 126436 - protein, 8 aa, West Nile virus
WSIHAGGE

SEQ ID NO: 126437 - protein, 8 aa, West Nile virus
SIHAGGEW

SEQ ID NO: 126438 - protein, 8 aa, West Nile virus
IHAGGEWM

SEQ ID NO: 126439 - protein, 8 aa, West Nile virus
HAGGEWMT

SEQ ID NO: 126440 - protein, 8 aa, West Nile virus
AGGEWMTT

SEQ ID NO: 126441 - protein, 8 aa, West Nile virus
GGEWMTTE

SEQ ID NO: 126442 - protein, 8 aa, West Nile virus
GEWMTTED

SEQ ID NO: 126443 - protein, 8 aa, West Nile virus
EWMTTEDM

SEQ ID NO: 126444 - protein, 8 aa, West Nile virus
WMTTEDML

SEQ ID NO: 126445 - protein, 8 aa, West Nile virus
MTTEDMLE

SEQ ID NO: 126446 - protein, 8 aa, West Nile virus
TTEDMLEV

SEQ ID NO: 126447 - protein, 8 aa, West Nile virus
TEDMLEVW

SEQ ID NO: 126448 - protein, 8 aa, West Nile virus
EDMLEVWN

SEQ ID NO: 126449 - protein, 8 aa, West Nile virus
DMLEVWNR

SEQ ID NO: 126450 - protein, 8 aa, West Nile virus
MLEVWNRV

SEQ ID NO: 126451 - protein, 8 aa, West Nile virus
LEVWNRVW

SEQ ID NO: 126452 - protein, 8 aa, West Nile virus
EVWNRVWI

SEQ ID NO: 126453 - protein, 8 aa, West Nile virus
VWNRVWIE

SEQ ID NO: 126454 - protein, 8 aa, West Nile virus
WNRVWIEE

SEQ ID NO: 126455 - protein, 8 aa, West Nile virus
NRVWIEEN

SEQ ID NO: 126456 - protein, 8 aa, West Nile virus
RVWIEENE

SEQ ID NO: 126457 - protein, 8 aa, West Nile virus
VWIEENEW

SEQ ID NO: 126458 - protein, 8 aa, West Nile virus
WIEENEWM

SEQ ID NO: 126459 - protein, 8 aa, West Nile virus
IEENEWME

SEQ ID NO: 126460 - protein, 8 aa, West Nile virus
EENEWMED

SEQ ID NO: 126461 - protein, 8 aa, West Nile virus
ENEWMEDK

SEQ ID NO: 126462 - protein, 8 aa, West Nile virus
NEWMEDKT

SEQ ID NO: 126463 - protein, 8 aa, West Nile virus
EWMEDKTP

SEQ ID NO: 126464 - protein, 8 aa, West Nile virus
WMEDKTPV

SEQ ID NO: 126465 - protein, 8 aa, West Nile virus
MEDKTPVE

SEQ ID NO: 126466 - protein, 8 aa, West Nile virus
EDKTPVEK

SEQ ID NO: 126467 - protein, 8 aa, West Nile virus
DKTPVEKW

SEQ ID NO: 126468 - protein, 8 aa, West Nile virus
KTPVEKWS

SEQ ID NO: 126469 - protein, 8 aa, West Nile virus
TPVEKWSD

SEQ ID NO: 126470 - protein, 8 aa, West Nile virus
PVEKWSDV

SEQ ID NO: 126471 - protein, 8 aa, West Nile virus
VEKWSDVP

SEQ ID NO: 126472 - protein, 8 aa, West Nile virus
EKWSDVPY

SEQ ID NO: 126473 - protein, 8 aa, West Nile virus
KWSDVPYS

SEQ ID NO: 126474 - protein, 8 aa, West Nile virus
WSDVPYSG

SEQ ID NO: 126475 - protein, 8 aa, West Nile virus
SDVPYSGK

SEQ ID NO: 126476 - protein, 8 aa, West Nile virus
DVPYSGKR

SEQ ID NO: 126477 - protein, 8 aa, West Nile virus
VPYSGKRE

SEQ ID NO: 126478 - protein, 8 aa, West Nile virus
PYSGKRED

SEQ ID NO: 126479 - protein, 8 aa, West Nile virus
YSGKREDI

SEQ ID NO: 126480 - protein, 8 aa, West Nile virus
SGKREDIW

SEQ ID NO: 126481 - protein, 8 aa, West Nile virus
GKREDIWC

SEQ ID NO: 126482 - protein, 8 aa, West Nile virus
KREDIWCG

SEQ ID NO: 126483 - protein, 8 aa, West Nile virus
REDIWCGS

SEQ ID NO: 126484 - protein, 8 aa, West Nile virus
EDIWCGSL

SEQ ID NO: 126485 - protein, 8 aa, West Nile virus
DIWCGSLI

SEQ ID NO: 126486 - protein, 8 aa, West Nile virus
IWCGSLIG

SEQ ID NO: 126487 - protein, 8 aa, West Nile virus
WCGSLIGT

SEQ ID NO: 126488 - protein, 8 aa, West Nile virus
CGSLIGTR

SEQ ID NO: 126489 - protein, 8 aa, West Nile virus
GSLIGTRA

SEQ ID NO: 126490 - protein, 8 aa, West Nile virus
SLIGTRAR

SEQ ID NO: 126491 - protein, 8 aa, West Nile virus
LIGTRARA

SEQ ID NO: 126492 - protein, 8 aa, West Nile virus
IGTRARAT

SEQ ID NO: 126493 - protein, 8 aa, West Nile virus
GTRARATW

SEQ ID NO: 126494 - protein, 8 aa, West Nile virus
TRARATWA

SEQ ID NO: 126495 - protein, 8 aa, West Nile virus
RARATWAE

SEQ ID NO: 126496 - protein, 8 aa, West Nile virus
ARATWAEN

SEQ ID NO: 126497 - protein, 8 aa, West Nile virus
RATWAENI

SEQ ID NO: 126498 - protein, 8 aa, West Nile virus
ATWAENIQ

SEQ ID NO: 126499 - protein, 8 aa, West Nile virus
TWAENIQV

SEQ ID NO: 126500 - protein, 8 aa, West Nile virus
WAENIQVA

SEQ ID NO: 126501 - protein, 8 aa, West Nile virus
AENIQVAI

SEQ ID NO: 126502 - protein, 8 aa, West Nile virus
ENIQVAIN

SEQ ID NO: 126503 - protein, 8 aa, West Nile virus
NIQVAINQ

SEQ ID NO: 126504 - protein, 8 aa, West Nile virus
IQVAINQV

SEQ ID NO: 126505 - protein, 8 aa, West Nile virus
QVAINQVR

SEQ ID NO: 126506 - protein, 8 aa, West Nile virus
VAINQVRA

SEQ ID NO: 126507 - protein, 8 aa, West Nile virus
IIGDEKYV

SEQ ID NO: 126508 - protein, 8 aa, West Nile virus
IGDEKYVD

SEQ ID NO: 126509 - protein, 8 aa, West Nile virus
GDEKYVDY

SEQ ID NO: 126510 - protein, 8 aa, West Nile virus
DEKYVDYM

SEQ ID NO: 126511 - protein, 8 aa, West Nile virus
EKYVDYMS

SEQ ID NO: 126512 - protein, 8 aa, West Nile virus
KYVDYMSS

SEQ ID NO: 126513 - protein, 8 aa, West Nile virus
YVDYMSSL

SEQ ID NO: 126514 - protein, 8 aa, West Nile virus
VDYMSSLK

SEQ ID NO: 126515 - protein, 8 aa, West Nile virus
DYMSSLKR

SEQ ID NO: 126516 - protein, 8 aa, West Nile virus
YMSSLKRY

SEQ ID NO: 126517 - protein, 8 aa, West Nile virus
MSSLKRYE

SEQ ID NO: 126518 - protein, 8 aa, West Nile virus
SSLKRYED

SEQ ID NO: 126519 - protein, 8 aa, West Nile virus
SLKRYEDT

SEQ ID NO: 126520 - protein, 8 aa, West Nile virus
KPGGPGKN

SEQ ID NO: 126521 - protein, 8 aa, West Nile virus
PGGPGKNR

SEQ ID NO: 126522 - protein, 8 aa, West Nile virus
GGPGKNRA

SEQ ID NO: 126523 - protein, 8 aa, West Nile virus
GPGKNRAV

SEQ ID NO: 126524 - protein, 8 aa, West Nile virus
PGKNRAVN

SEQ ID NO: 126525 - protein, 8 aa, West Nile virus
GKNRAVNM

SEQ ID NO: 126526 - protein, 8 aa, West Nile virus
KNRAVNML

SEQ ID NO: 126527 - protein, 8 aa, West Nile virus
NRAVNMLK

SEQ ID NO: 126528 - protein, 8 aa, West Nile virus
RAVNMQKR

SEQ ID NO: 126529 - protein, 8 aa, West Nile virus
AVNMQKRG

SEQ ID NO: 126530 - protein, 8 aa, West Nile virus
VNMQKRGT

SEQ ID NO: 126531 - protein, 8 aa, West Nile virus
NMQKRGTP

SEQ ID NO: 126532 - protein, 8 aa, West Nile virus
MQKRGMPR

SEQ ID NO: 126533 - protein, 8 aa, West Nile virus
KRGMPRGL

SEQ ID NO: 126534 - protein, 8 aa, West Nile virus
RGMPRGLS

SEQ ID NO: 126535 - protein, 8 aa, West Nile virus
GMPRGLSL

SEQ ID NO: 126536 - protein, 8 aa, West Nile virus
PRGLSLIG

SEQ ID NO: 126537 - protein, 8 aa, West Nile virus
RGLSLIGL

SEQ ID NO: 126538 - protein, 8 aa, West Nile virus
GLSLIGLK

SEQ ID NO: 126539 - protein, 8 aa, West Nile virus
LSLTGLKR

SEQ ID NO: 126540 - protein, 8 aa, West Nile virus
SLTGLKRA

SEQ ID NO: 126541 - protein, 8 aa, West Nile virus
LTGLKRAM

SEQ ID NO: 126542 - protein, 8 aa, West Nile virus
TGLKRAML

SEQ ID NO: 126543 - protein, 8 aa, West Nile virus
GLKRAVLS

SEQ ID NO: 126544 - protein, 8 aa, West Nile virus
LKRAVLSL

SEQ ID NO: 126545 - protein, 8 aa, West Nile virus
KRAVLSLI

SEQ ID NO: 126546 - protein, 8 aa, West Nile virus
RAVLSLID

SEQ ID NO: 126547 - protein, 8 aa, West Nile virus
AVLSLIDG

SEQ ID NO: 126548 - protein, 8 aa, West Nile virus
MLSLIDGR

SEQ ID NO: 126549 - protein, 8 aa, West Nile virus
LSLIDGRG

SEQ ID NO: 126550 - protein, 8 aa, West Nile virus
SLIDGRGP

SEQ ID NO: 126551 - protein, 8 aa, West Nile virus
LIDGRGPI

SEQ ID NO: 126552 - protein, 8 aa, West Nile virus
IDGRGPIR

SEQ ID NO: 126553 - protein, 8 aa, West Nile virus
DGRGPIRF

SEQ ID NO: 126554 - protein, 8 aa, West Nile virus
GRGPIRFV

SEQ ID NO: 126555 - protein, 8 aa, West Nile virus
RGPIRFVL

SEQ ID NO: 126556 - protein, 8 aa, West Nile virus
GPTRFVLA

SEQ ID NO: 126557 - protein, 8 aa, West Nile virus
PTRFVLAL

SEQ ID NO: 126558 - protein, 8 aa, West Nile virus
TRFVLALL

SEQ ID NO: 126559 - protein, 8 aa, West Nile virus
RFVLALLT

SEQ ID NO: 126560 - protein, 8 aa, West Nile virus
FVLALLTF

SEQ ID NO: 126561 - protein, 8 aa, West Nile virus
VLALLTFF

SEQ ID NO: 126562 - protein, 8 aa, West Nile virus
LALLTFFR

SEQ ID NO: 126563 - protein, 8 aa, West Nile virus
ALLTFFRF

SEQ ID NO: 126564 - protein, 8 aa, West Nile virus
LLTFFRFT

SEQ ID NO: 126565 - protein, 8 aa, West Nile virus
LTFFRFTA

SEQ ID NO: 126566 - protein, 8 aa, West Nile virus
TFFRFTAI

SEQ ID NO: 126567 - protein, 8 aa, West Nile virus
FFKFTAIA

SEQ ID NO: 126568 - protein, 8 aa, West Nile virus
FKFTAIAP

SEQ ID NO: 126569 - protein, 8 aa, West Nile virus
KFTAIAPT

SEQ ID NO: 126570 - protein, 8 aa, West Nile virus
AIAPTRAL

SEQ ID NO: 126571 - protein, 8 aa, West Nile virus
IAPTRALL

SEQ ID NO: 126572 - protein, 8 aa, West Nile virus
APTRALLD

SEQ ID NO: 126573 - protein, 8 aa, West Nile virus
PTRALLDR

SEQ ID NO: 126574 - protein, 8 aa, West Nile virus
TRALLDRW

SEQ ID NO: 126575 - protein, 8 aa, West Nile virus
RALLDRWR

SEQ ID NO: 126576 - protein, 8 aa, West Nile virus
ALLDRWRG

SEQ ID NO: 126577 - protein, 8 aa, West Nile virus
LLDRWRGV

SEQ ID NO: 126578 - protein, 8 aa, West Nile virus
LDRWRGVR

SEQ ID NO: 126579 - protein, 8 aa, West Nile virus
DRWRGVRK

SEQ ID NO: 126580 - protein, 8 aa, West Nile virus
RWRGVRKQ

SEQ ID NO: 126581 - protein, 8 aa, West Nile virus
WRGVRKQT

SEQ ID NO: 126582 - protein, 8 aa, West Nile virus
RGVRKQTA

SEQ ID NO: 126583 - protein, 8 aa, West Nile virus
GVRKQTAM

SEQ ID NO: 126584 - protein, 8 aa, West Nile virus
VRKQTAMK

SEQ ID NO: 126585 - protein, 8 aa, West Nile virus
RKQTAMKH

SEQ ID NO: 126586 - protein, 8 aa, West Nile virus
KHLTSFKK

SEQ ID NO: 126587 - protein, 8 aa, West Nile virus
HLTSFKKE

SEQ ID NO: 126588 - protein, 8 aa, West Nile virus
LLSFKREL

SEQ ID NO: 126589 - protein, 8 aa, West Nile virus
TSFKKELG

SEQ ID NO: 126590 - protein, 8 aa, West Nile virus
SFKKELGA

SEQ ID NO: 126591 - protein, 8 aa, West Nile virus
FKKELGAL

SEQ ID NO: 126592 - protein, 8 aa, West Nile virus
KKELGALT

SEQ ID NO: 126593 - protein, 8 aa, West Nile virus
KELGALTN

SEQ ID NO: 126594 - protein, 8 aa, West Nile virus
ELGALTNA

SEQ ID NO: 126595 - protein, 8 aa, West Nile virus
LGALTNAM

SEQ ID NO: 126596 - protein, 8 aa, West Nile virus
GALTNAMN

SEQ ID NO: 126597 - protein, 8 aa, West Nile virus
ALTNAMNK

SEQ ID NO: 126598 - protein, 8 aa, West Nile virus
LTNAMNKR

SEQ ID NO: 126599 - protein, 8 aa, West Nile virus
TNAMNKRS

SEQ ID NO: 126600 - protein, 8 aa, West Nile virus
NRRSTKQK

SEQ ID NO: 126601 - protein, 8 aa, West Nile virus
RRSTKQKK

SEQ ID NO: 126602 - protein, 8 aa, West Nile virus
RSTKQKKR

SEQ ID NO: 126603 - protein, 8 aa, West Nile virus
STKQKKRG

SEQ ID NO: 126604 - protein, 8 aa, West Nile virus
TKQKKRGG

SEQ ID NO: 126605 - protein, 8 aa, West Nile virus
KQKKRGGT

SEQ ID NO: 126606 - protein, 8 aa, West Nile virus
QKKRGGTA

SEQ ID NO: 126607 - protein, 8 aa, West Nile virus
KKRGGTAG

SEQ ID NO: 126608 - protein, 8 aa, West Nile virus
SALTLSNF

SEQ ID NO: 126609 - protein, 8 aa, West Nile virus
ALTLSNFQ

SEQ ID NO: 126610 - protein, 8 aa, West Nile virus
LTLSNFQG

SEQ ID NO: 126611 - protein, 8 aa, West Nile virus
TLSDFQGK

SEQ ID NO: 126612 - protein, 8 aa, West Nile virus
LSNFQGKL

SEQ ID NO: 126613 - protein, 8 aa, West Nile virus
SNFQGKLM

SEQ ID NO: 126614 - protein, 8 aa, West Nile virus
NFQGKLMM

SEQ ID NO: 126615 - protein, 8 aa, West Nile virus
FQGKLMMT

SEQ ID NO: 126616 - protein, 8 aa, West Nile virus
QGKLMMTI

SEQ ID NO: 126617 - protein, 8 aa, West Nile virus
GKLMMTIN

SEQ ID NO: 126618 - protein, 8 aa, West Nile virus
KLMMTINA

SEQ ID NO: 126619 - protein, 8 aa, West Nile virus
LMMTINAT

SEQ ID NO: 126620 - protein, 8 aa, West Nile virus
MMTINATD

SEQ ID NO: 126621 - protein, 8 aa, West Nile virus
MTVNATDI

SEQ ID NO: 126622 - protein, 8 aa, West Nile virus
TVNATDIT

SEQ ID NO: 126623 - protein, 8 aa, West Nile virus
IITIPTAA

SEQ ID NO: 126624 - protein, 8 aa, West Nile virus
ITIPIASG

SEQ ID NO: 126625 - protein, 8 aa, West Nile virus
TIPIASGK

SEQ ID NO: 126626 - protein, 8 aa, West Nile virus
IPPAAGKN

SEQ ID NO: 126627 - protein, 8 aa, West Nile virus
PIASGKNL

SEQ ID NO: 126628 - protein, 8 aa, West Nile virus
PAAGKNLC

SEQ ID NO: 126629 - protein, 8 aa, West Nile virus
AAGKNLCT

SEQ ID NO: 126630 - protein, 8 aa, West Nile virus
AGKNLCTI

SEQ ID NO: 126631 - protein, 8 aa, West Nile virus
GKNLCTIR

SEQ ID NO: 126632 - protein, 8 aa, West Nile virus
KNLCTVRA

SEQ ID NO: 126633 - protein, 8 aa, West Nile virus
NLCTIRAM

SEQ ID NO: 126634 - protein, 8 aa, West Nile virus
LCTIRAMD

SEQ ID NO: 126635 - protein, 8 aa, West Nile virus
CTIRAMDV

SEQ ID NO: 126636 - protein, 8 aa, West Nile virus
TIRAMDVG

SEQ ID NO: 126637 - protein, 8 aa, West Nile virus
IRAMDVGF

SEQ ID NO: 126638 - protein, 8 aa, West Nile virus
RAMDVGYL

SEQ ID NO: 126639 - protein, 8 aa, West Nile virus
AMDVGYLC

SEQ ID NO: 126640 - protein, 8 aa, West Nile virus
MDVGYLCE

SEQ ID NO: 126641 - protein, 8 aa, West Nile virus
DVGYLCED

SEQ ID NO: 126642 - protein, 8 aa, West Nile virus
VGYLCEDT

SEQ ID NO: 126643 - protein, 8 aa, West Nile virus
GYLCEDTI

SEQ ID NO: 126644 - protein, 8 aa, West Nile virus
YLCEDTIT

SEQ ID NO: 126645 - protein, 8 aa, West Nile virus
LCEDTITY

SEQ ID NO: 126646 - protein, 8 aa, West Nile virus
CEDTITYE

SEQ ID NO: 126647 - protein, 8 aa, West Nile virus
EDTITYEC

SEQ ID NO: 126648 - protein, 8 aa, West Nile virus
DTIAYECP

SEQ ID NO: 126649 - protein, 8 aa, West Nile virus
TIAYECPA

SEQ ID NO: 126650 - protein, 8 aa, West Nile virus
IAYECPAL

SEQ ID NO: 126651 - protein, 8 aa, West Nile virus
TYECPVLA

SEQ ID NO: 126652 - protein, 8 aa, West Nile virus
YECPVLAA

SEQ ID NO: 126653 - protein, 8 aa, West Nile virus
ECPVLAAG

SEQ ID NO: 126654 - protein, 8 aa, West Nile virus
CPVLAAGN

SEQ ID NO: 126655 - protein, 8 aa, West Nile virus
PVLAAGND

SEQ ID NO: 126656 - protein, 8 aa, West Nile virus
VLAAGNDP

SEQ ID NO: 126657 - protein, 8 aa, West Nile virus
LAAGNDPE

SEQ ID NO: 126658 - protein, 8 aa, West Nile virus
AAGNDPED

SEQ ID NO: 126659 - protein, 8 aa, West Nile virus
EGNDPEDI

SEQ ID NO: 126660 - protein, 8 aa, West Nile virus
IDCWCTKL

SEQ ID NO: 126661 - protein, 8 aa, West Nile virus
DCWCTKSS

SEQ ID NO: 126662 - protein, 8 aa, West Nile virus
CWCTKSSV

SEQ ID NO: 126663 - protein, 8 aa, West Nile virus
SVYVRYGR

SEQ ID NO: 126664 - protein, 8 aa, West Nile virus
VFVRYGRC

SEQ ID NO: 126665 - protein, 8 aa, West Nile virus
FVRYGRCT

SEQ ID NO: 126666 - protein, 8 aa, West Nile virus
VRYGRCTR

SEQ ID NO: 126667 - protein, 8 aa, West Nile virus
RYGRCTRT

SEQ ID NO: 126668 - protein, 8 aa, West Nile virus
YGRCTRTR

SEQ ID NO: 126669 - protein, 8 aa, West Nile virus
GRCTRTRN

SEQ ID NO: 126670 - protein, 8 aa, West Nile virus
RCTRTRNS

SEQ ID NO: 126671 - protein, 8 aa, West Nile virus
CTRTRNSR

SEQ ID NO: 126672 - protein, 8 aa, West Nile virus
TRTRNSRR

SEQ ID NO: 126673 - protein, 8 aa, West Nile virus
RTRNSRRS

SEQ ID NO: 126674 - protein, 8 aa, West Nile virus
TRNSRRSR

SEQ ID NO: 126675 - protein, 8 aa, West Nile virus
RNSRRSRR

SEQ ID NO: 126676 - protein, 8 aa, West Nile virus
NSRRSRRS

SEQ ID NO: 126677 - protein, 8 aa, West Nile virus
RRSRRSLN

SEQ ID NO: 126678 - protein, 8 aa, West Nile virus
RSRRSLNV

SEQ ID NO: 126679 - protein, 8 aa, West Nile virus
SRRSLNVQ

SEQ ID NO: 126680 - protein, 8 aa, West Nile virus
RRSLNVQV

SEQ ID NO: 126681 - protein, 8 aa, West Nile virus
RSLNVQVH

SEQ ID NO: 126682 - protein, 8 aa, West Nile virus
SLNVQVHG

SEQ ID NO: 126683 - protein, 8 aa, West Nile virus
LNVQVHGE

SEQ ID NO: 126684 - protein, 8 aa, West Nile virus
NVQVHGES

SEQ ID NO: 126685 - protein, 8 aa, West Nile virus
VQVHGESS

SEQ ID NO: 126686 - protein, 8 aa, West Nile virus
QVHGESSL

SEQ ID NO: 126687 - protein, 8 aa, West Nile virus
VHGESSLS

SEQ ID NO: 126688 - protein, 8 aa, West Nile virus
HGESSLSN

SEQ ID NO: 126689 - protein, 8 aa, West Nile virus
GESSLSNR

SEQ ID NO: 126690 - protein, 8 aa, West Nile virus
ESSLSNRK

SEQ ID NO: 126691 - protein, 8 aa, West Nile virus
SSLSNRKG

SEQ ID NO: 126692 - protein, 8 aa, West Nile virus
SLSNRKGA

SEQ ID NO: 126693 - protein, 8 aa, West Nile virus
LSNRKGAW

SEQ ID NO: 126694 - protein, 8 aa, West Nile virus
ANKKGAWL

SEQ ID NO: 126695 - protein, 8 aa, West Nile virus
NKKGAWLD

SEQ ID NO: 126696 - protein, 8 aa, West Nile virus
KKGAWLDS

SEQ ID NO: 126697 - protein, 8 aa, West Nile virus
KGAWLDST

SEQ ID NO: 126698 - protein, 8 aa, West Nile virus
GAWLDSTK

SEQ ID NO: 126699 - protein, 8 aa, West Nile virus
AWLDSTKA

SEQ ID NO: 126700 - protein, 8 aa, West Nile virus
WLDSTKAT

SEQ ID NO: 126701 - protein, 8 aa, West Nile virus
LDSTKATR

SEQ ID NO: 126702 - protein, 8 aa, West Nile virus
DSTKASRY

SEQ ID NO: 126703 - protein, 8 aa, West Nile virus
STKASRYL

SEQ ID NO: 126704 - protein, 8 aa, West Nile virus
TKASRYLM

SEQ ID NO: 126705 - protein, 8 aa, West Nile virus
KASRYLMK

SEQ ID NO: 126706 - protein, 8 aa, West Nile virus
ASRYLMKA

SEQ ID NO: 126707 - protein, 8 aa, West Nile virus
SRYLMKAE

SEQ ID NO: 126708 - protein, 8 aa, West Nile virus
RYLMKAES

SEQ ID NO: 126709 - protein, 8 aa, West Nile virus
YLMKAESW

SEQ ID NO: 126710 - protein, 8 aa, West Nile virus
LMKAESWI

SEQ ID NO: 126711 - protein, 8 aa, West Nile virus
MKAESWIL

SEQ ID NO: 126712 - protein, 8 aa, West Nile virus
KAESWILR

SEQ ID NO: 126713 - protein, 8 aa, West Nile virus
AESWILRN

SEQ ID NO: 126714 - protein, 8 aa, West Nile virus
YALVAAVT

SEQ ID NO: 126715 - protein, 8 aa, West Nile virus
ALVAVVIG

SEQ ID NO: 126716 - protein, 8 aa, West Nile virus
LVAVVIGW

SEQ ID NO: 126717 - protein, 8 aa, West Nile virus
VAVVIGWM

SEQ ID NO: 126718 - protein, 8 aa, West Nile virus
AAVTGWML

SEQ ID NO: 126719 - protein, 8 aa, West Nile virus
AVTGWMLG

SEQ ID NO: 126720 - protein, 8 aa, West Nile virus
WMLGSNTT

SEQ ID NO: 126721 - protein, 8 aa, West Nile virus
MLGSNTTQ

SEQ ID NO: 126722 - protein, 8 aa, West Nile virus
LGSNTTQR

SEQ ID NO: 126723 - protein, 8 aa, West Nile virus
GSNTTQRV

SEQ ID NO: 126724 - protein, 8 aa, West Nile virus
SNTTQRVV

SEQ ID NO: 126725 - protein, 8 aa, West Nile virus
NTTQRVVF

SEQ ID NO: 126726 - protein, 8 aa, West Nile virus
TMQRVVFA

SEQ ID NO: 126727 - protein, 8 aa, West Nile virus
MQRVVFAI

SEQ ID NO: 126728 - protein, 8 aa, West Nile virus
QRVVFAIL

SEQ ID NO: 126729 - protein, 8 aa, West Nile virus
RVVFAILL

SEQ ID NO: 126730 - protein, 8 aa, West Nile virus
VVFAILLL

SEQ ID NO: 126731 - protein, 8 aa, West Nile virus
VFAILLLL

SEQ ID NO: 126732 - protein, 8 aa, West Nile virus
FAILLLLV

SEQ ID NO: 126733 - protein, 8 aa, West Nile virus
AILLLLVA

SEQ ID NO: 126734 - protein, 8 aa, West Nile virus
ILLLLVAP

SEQ ID NO: 126735 - protein, 8 aa, West Nile virus
FNCLGMSS

SEQ ID NO: 126736 - protein, 8 aa, West Nile virus
NCLGMSSR

SEQ ID NO: 126737 - protein, 8 aa, West Nile virus
CLGMSSRD

SEQ ID NO: 126738 - protein, 8 aa, West Nile virus
LGMSSRDF

SEQ ID NO: 126739 - protein, 8 aa, West Nile virus
GMSNRDFI

SEQ ID NO: 126740 - protein, 8 aa, West Nile virus
MSNRDFIE

SEQ ID NO: 126741 - protein, 8 aa, West Nile virus
SNRDFIEG

SEQ ID NO: 126742 - protein, 8 aa, West Nile virus
NRDFIEGA

SEQ ID NO: 126743 - protein, 8 aa, West Nile virus
RDFIEGAS

SEQ ID NO: 126744 - protein, 8 aa, West Nile virus
DFIEGASG

SEQ ID NO: 126745 - protein, 8 aa, West Nile virus
FIEGASGA

SEQ ID NO: 126746 - protein, 8 aa, West Nile virus
IEGASGAT

SEQ ID NO: 126747 - protein, 8 aa, West Nile virus
EGASGATW

SEQ ID NO: 126748 - protein, 8 aa, West Nile virus
GASGATWV

SEQ ID NO: 126749 - protein, 8 aa, West Nile virus
ASGATWVD

SEQ ID NO: 126750 - protein, 8 aa, West Nile virus
SGATWMDL

SEQ ID NO: 126751 - protein, 8 aa, West Nile virus
GATWMDLV

SEQ ID NO: 126752 - protein, 8 aa, West Nile virus
ATWMDLVL

SEQ ID NO: 126753 - protein, 8 aa, West Nile virus
TWMDLVLE

SEQ ID NO: 126754 - protein, 8 aa, West Nile virus
WMDLVLEG

SEQ ID NO: 126755 - protein, 8 aa, West Nile virus
MDLVLEGD

SEQ ID NO: 126756 - protein, 8 aa, West Nile virus
GDSCVTIT

SEQ ID NO: 126757 - protein, 8 aa, West Nile virus
DSCVTIMA

SEQ ID NO: 126758 - protein, 8 aa, West Nile virus
SCVTIMAK

SEQ ID NO: 126759 - protein, 8 aa, West Nile virus
CVTIMAKD

SEQ ID NO: 126760 - protein, 8 aa, West Nile virus
VTIMAKDR

SEQ ID NO: 126761 - protein, 8 aa, West Nile virus
TIMAKDRP

SEQ ID NO: 126762 - protein, 8 aa, West Nile virus
IMAKDRPT

SEQ ID NO: 126763 - protein, 8 aa, West Nile virus
MAKDRPTI

SEQ ID NO: 126764 - protein, 8 aa, West Nile virus
AKDRPTID

SEQ ID NO: 126765 - protein, 8 aa, West Nile virus
KDRPTIDV

SEQ ID NO: 126766 - protein, 8 aa, West Nile virus
DRPTIDVK

SEQ ID NO: 126767 - protein, 8 aa, West Nile virus
RPTIDVKM

SEQ ID NO: 126768 - protein, 8 aa, West Nile virus
PTIDVKMV

SEQ ID NO: 126769 - protein, 8 aa, West Nile virus
TIDVKMVT

SEQ ID NO: 126770 - protein, 8 aa, West Nile virus
IDVKMVTM

SEQ ID NO: 126771 - protein, 8 aa, West Nile virus
DVKMVTMG

SEQ ID NO: 126772 - protein, 8 aa, West Nile virus
VKMVTMGA

SEQ ID NO: 126773 - protein, 8 aa, West Nile virus
LADVRSYC

SEQ ID NO: 126774 - protein, 8 aa, West Nile virus
ADVRSYCY

SEQ ID NO: 126775 - protein, 8 aa, West Nile virus
DVRSYCYL

SEQ ID NO: 126776 - protein, 8 aa, West Nile virus
VRSYCYAA

SEQ ID NO: 126777 - protein, 8 aa, West Nile virus
VSDLSTRA

SEQ ID NO: 126778 - protein, 8 aa, West Nile virus
SDLSTRAA

SEQ ID NO: 126779 - protein, 8 aa, West Nile virus
DLSTRAAC

SEQ ID NO: 126780 - protein, 8 aa, West Nile virus
LSTRAACP

SEQ ID NO: 126781 - protein, 8 aa, West Nile virus
STRAACPT

SEQ ID NO: 126782 - protein, 8 aa, West Nile virus
TRAACPTM

SEQ ID NO: 126783 - protein, 8 aa, West Nile virus
RAACPTMG

SEQ ID NO: 126784 - protein, 8 aa, West Nile virus
AACPAMGE

SEQ ID NO: 126785 - protein, 8 aa, West Nile virus
ACPTMGDA

SEQ ID NO: 126786 - protein, 8 aa, West Nile virus
CPAMGEAH

SEQ ID NO: 126787 - protein, 8 aa, West Nile virus
PAMGEAHN

SEQ ID NO: 126788 - protein, 8 aa, West Nile virus
TMGEAHNE

SEQ ID NO: 126789 - protein, 8 aa, West Nile virus
MGEAHNEK

SEQ ID NO: 126790 - protein, 8 aa, West Nile virus
GEAHNEKR

SEQ ID NO: 126791 - protein, 8 aa, West Nile virus
EAHNEKRA

SEQ ID NO: 126792 - protein, 8 aa, West Nile virus
AHNEKRAD

SEQ ID NO: 126793 - protein, 8 aa, West Nile virus
HNEKRADP

SEQ ID NO: 126794 - protein, 8 aa, West Nile virus
FVCKQGVV

SEQ ID NO: 126795 - protein, 8 aa, West Nile virus
VCKQGVVD

SEQ ID NO: 126796 - protein, 8 aa, West Nile virus
CKQGVVDR

SEQ ID NO: 126797 - protein, 8 aa, West Nile virus
KQGVVDRG

SEQ ID NO: 126798 - protein, 8 aa, West Nile virus
IDTCAKFT

SEQ ID NO: 126799 - protein, 8 aa, West Nile virus
DTCAKFTC

SEQ ID NO: 126800 - protein, 8 aa, West Nile virus
TCAKFACT

SEQ ID NO: 126801 - protein, 8 aa, West Nile virus
CAKFACTT

SEQ ID NO: 126802 - protein, 8 aa, West Nile virus
AKFACTTK

SEQ ID NO: 126803 - protein, 8 aa, West Nile virus
KFACTTKA

SEQ ID NO: 126804 - protein, 8 aa, West Nile virus
FACSTKAT

SEQ ID NO: 126805 - protein, 8 aa, West Nile virus
ACSTKATG

SEQ ID NO: 126806 - protein, 8 aa, West Nile virus
CSTKATGR

SEQ ID NO: 126807 - protein, 8 aa, West Nile virus
STKATGRT

SEQ ID NO: 126808 - protein, 8 aa, West Nile virus
TKATGRTI

SEQ ID NO: 126809 - protein, 8 aa, West Nile virus
KATGRTIL

SEQ ID NO: 126810 - protein, 8 aa, West Nile virus
ATGRTILK

SEQ ID NO: 126811 - protein, 8 aa, West Nile virus
TGRTILKE

SEQ ID NO: 126812 - protein, 8 aa, West Nile virus
GWIIQKEN

SEQ ID NO: 126813 - protein, 8 aa, West Nile virus
WIIQKENI

SEQ ID NO: 126814 - protein, 8 aa, West Nile virus
IIQKENIK

SEQ ID NO: 126815 - protein, 8 aa, West Nile virus
IQKENIKY

SEQ ID NO: 126816 - protein, 8 aa, West Nile virus
QKENIKYE

SEQ ID NO: 126817 - protein, 8 aa, West Nile virus
RENVKYEV

SEQ ID NO: 126818 - protein, 8 aa, West Nile virus
ENVKYEVA

SEQ ID NO: 126819 - protein, 8 aa, West Nile virus
NVKYEVAA

SEQ ID NO: 126820 - protein, 8 aa, West Nile virus
VKYEVAAF

SEQ ID NO: 126821 - protein, 8 aa, West Nile virus
KYEVAAFV

SEQ ID NO: 126822 - protein, 8 aa, West Nile virus
YEVAAFVH

SEQ ID NO: 126823 - protein, 8 aa, West Nile virus
EVAAFVHG

SEQ ID NO: 126824 - protein, 8 aa, West Nile virus
VAAFVHGP

SEQ ID NO: 126825 - protein, 8 aa, West Nile virus
AAFVHGPT

SEQ ID NO: 126826 - protein, 8 aa, West Nile virus
AFVHGPTT

SEQ ID NO: 126827 - protein, 8 aa, West Nile virus
VHGPTTVD

SEQ ID NO: 126828 - protein, 8 aa, West Nile virus
HGPTTVDT

SEQ ID NO: 126829 - protein, 8 aa, West Nile virus
GPTTVDTH

SEQ ID NO: 126830 - protein, 8 aa, West Nile virus
PTTVDTHS

SEQ ID NO: 126831 - protein, 8 aa, West Nile virus
AAVQAGRF

SEQ ID NO: 126832 - protein, 8 aa, West Nile virus
AVQAGRFS

SEQ ID NO: 126833 - protein, 8 aa, West Nile virus
VQAGRFSV

SEQ ID NO: 126834 - protein, 8 aa, West Nile virus
QAGRFSVS

SEQ ID NO: 126835 - protein, 8 aa, West Nile virus
AGRFSVSP

SEQ ID NO: 126836 - protein, 8 aa, West Nile virus
GRFSITPS

SEQ ID NO: 126837 - protein, 8 aa, West Nile virus
RFSITPSA

SEQ ID NO: 126838 - protein, 8 aa, West Nile virus
FSITPSAP

SEQ ID NO: 126839 - protein, 8 aa, West Nile virus
SITPSAPS

SEQ ID NO: 126840 - protein, 8 aa, West Nile virus
ITPSAPSY

SEQ ID NO: 126841 - protein, 8 aa, West Nile virus
TPSAPSYT

SEQ ID NO: 126842 - protein, 8 aa, West Nile virus
TLGDYGEV

SEQ ID NO: 126843 - protein, 8 aa, West Nile virus
LGDYGEVT

SEQ ID NO: 126844 - protein, 8 aa, West Nile virus
GDYGEVTF

SEQ ID NO: 126845 - protein, 8 aa, West Nile virus
DYGEVTFD

SEQ ID NO: 126846 - protein, 8 aa, West Nile virus
YGEVTFDC

SEQ ID NO: 126847 - protein, 8 aa, West Nile virus
GEVTFDCE

SEQ ID NO: 126848 - protein, 8 aa, West Nile virus
EVTFDCEP

SEQ ID NO: 126849 - protein, 8 aa, West Nile virus
VTFDCEPR

SEQ ID NO: 126850 - protein, 8 aa, West Nile virus
TFDCEPRS

SEQ ID NO: 126851 - protein, 8 aa, West Nile virus
FDCEPRSG

SEQ ID NO: 126852 - protein, 8 aa, West Nile virus
DCEPRSGV

SEQ ID NO: 126853 - protein, 8 aa, West Nile virus
CEPRSGVD

SEQ ID NO: 126854 - protein, 8 aa, West Nile virus
EPRSGVDV

SEQ ID NO: 126855 - protein, 8 aa, West Nile virus
PRSGIDTS

SEQ ID NO: 126856 - protein, 8 aa, West Nile virus
RSGIDTSA

SEQ ID NO: 126857 - protein, 8 aa, West Nile virus
SGIDTSAY

SEQ ID NO: 126858 - protein, 8 aa, West Nile virus
GIDTSAYY

SEQ ID NO: 126859 - protein, 8 aa, West Nile virus
IDTSAYYV

SEQ ID NO: 126860 - protein, 8 aa, West Nile virus
DTSAYYVM

SEQ ID NO: 126861 - protein, 8 aa, West Nile virus
TSAYYVMS

SEQ ID NO: 126862 - protein, 8 aa, West Nile virus
SAYYVMSV

SEQ ID NO: 126863 - protein, 8 aa, West Nile virus
AYYVMSVG

SEQ ID NO: 126864 - protein, 8 aa, West Nile virus
YVMSVGAK

SEQ ID NO: 126865 - protein, 8 aa, West Nile virus
KSFLVHRE

SEQ ID NO: 126866 - protein, 8 aa, West Nile virus
SFLVHREW

SEQ ID NO: 126867 - protein, 8 aa, West Nile virus
EWFTDLNL

SEQ ID NO: 126868 - protein, 8 aa, West Nile virus
WFMDLNMP

SEQ ID NO: 126869 - protein, 8 aa, West Nile virus
FMDLNMPW

SEQ ID NO: 126870 - protein, 8 aa, West Nile virus
TDLNLPWS

SEQ ID NO: 126871 - protein, 8 aa, West Nile virus
LNLPWSSP

SEQ ID NO: 126872 - protein, 8 aa, West Nile virus
NLPWSSPG

SEQ ID NO: 126873 - protein, 8 aa, West Nile virus
LPWSSPGN

SEQ ID NO: 126874 - protein, 8 aa, West Nile virus
PWSSPGNT

SEQ ID NO: 126875 - protein, 8 aa, West Nile virus
TTWRNRET

SEQ ID NO: 126876 - protein, 8 aa, West Nile virus
TWRNRETL

SEQ ID NO: 126877 - protein, 8 aa, West Nile virus
WRNREALV

SEQ ID NO: 126878 - protein, 8 aa, West Nile virus
RNREALVE

SEQ ID NO: 126879 - protein, 8 aa, West Nile virus
NREALVEF

SEQ ID NO: 126880 - protein, 8 aa, West Nile virus
REALVEFE

SEQ ID NO: 126881 - protein, 8 aa, West Nile virus
EALVEFEE

SEQ ID NO: 126882 - protein, 8 aa, West Nile virus
ALVEFEEA

SEQ ID NO: 126883 - protein, 8 aa, West Nile virus
LVEFEEAH

SEQ ID NO: 126884 - protein, 8 aa, West Nile virus
VEFEEAHA

SEQ ID NO: 126885 - protein, 8 aa, West Nile virus
EFEEAHAT

SEQ ID NO: 126886 - protein, 8 aa, West Nile virus
FEEAHATK

SEQ ID NO: 126887 - protein, 8 aa, West Nile virus
EEAHATKQ

SEQ ID NO: 126888 - protein, 8 aa, West Nile virus
EAHATKQS

SEQ ID NO: 126889 - protein, 8 aa, West Nile virus
AHATKQSV

SEQ ID NO: 126890 - protein, 8 aa, West Nile virus
HATKQSVV

SEQ ID NO: 126891 - protein, 8 aa, West Nile virus
ATKQSVVA

SEQ ID NO: 126892 - protein, 8 aa, West Nile virus
TKQSVVAL

SEQ ID NO: 126893 - protein, 8 aa, West Nile virus
KQSVVALG

SEQ ID NO: 126894 - protein, 8 aa, West Nile virus
QSVVALGS

SEQ ID NO: 126895 - protein, 8 aa, West Nile virus
SVVALGSQ

SEQ ID NO: 126896 - protein, 8 aa, West Nile virus
VVALGSQE

SEQ ID NO: 126897 - protein, 8 aa, West Nile virus
VALGSQEG

SEQ ID NO: 126898 - protein, 8 aa, West Nile virus
LHQALAGT

SEQ ID NO: 126899 - protein, 8 aa, West Nile virus
QQALAGAI

SEQ ID NO: 126900 - protein, 8 aa, West Nile virus
ALAGAIPL

SEQ ID NO: 126901 - protein, 8 aa, West Nile virus
LAGAIPVD

SEQ ID NO: 126902 - protein, 8 aa, West Nile virus
AGAIPVDY

SEQ ID NO: 126903 - protein, 8 aa, West Nile virus
GAIPVDYK

SEQ ID NO: 126904 - protein, 8 aa, West Nile virus
AIPVDYKN

SEQ ID NO: 126905 - protein, 8 aa, West Nile virus
IPVDYKNS

SEQ ID NO: 126906 - protein, 8 aa, West Nile virus
PVDYKNSV

SEQ ID NO: 126907 - protein, 8 aa, West Nile virus
VDYKNSVV

SEQ ID NO: 126908 - protein, 8 aa, West Nile virus
DYKNSVVK

SEQ ID NO: 126909 - protein, 8 aa, West Nile virus
YKNSVVKL

SEQ ID NO: 126910 - protein, 8 aa, West Nile virus
KNSVVKLS

SEQ ID NO: 126911 - protein, 8 aa, West Nile virus
NSVVKLSS

SEQ ID NO: 126912 - protein, 8 aa, West Nile virus
SVVKLSSG

SEQ ID NO: 126913 - protein, 8 aa, West Nile virus
VVKLSSGH

SEQ ID NO: 126914 - protein, 8 aa, West Nile virus
VKLSSGHL

SEQ ID NO: 126915 - protein, 8 aa, West Nile virus
KLSSGHLK

SEQ ID NO: 126916 - protein, 8 aa, West Nile virus
LSSGHLKC

SEQ ID NO: 126917 - protein, 8 aa, West Nile virus
SSGHLKCR

SEQ ID NO: 126918 - protein, 8 aa, West Nile virus
GHLKCRVR

SEQ ID NO: 126919 - protein, 8 aa, West Nile virus
HLKCRVRM

SEQ ID NO: 126920 - protein, 8 aa, West Nile virus
LKCRVRME

SEQ ID NO: 126921 - protein, 8 aa, West Nile virus
KCRVRMEK

SEQ ID NO: 126922 - protein, 8 aa, West Nile virus
CRVRMEKL

SEQ ID NO: 126923 - protein, 8 aa, West Nile virus
RVRMEKLQ

SEQ ID NO: 126924 - protein, 8 aa, West Nile virus
VRMEKLQL

SEQ ID NO: 126925 - protein, 8 aa, West Nile virus
RMEKLQLK

SEQ ID NO: 126926 - protein, 8 aa, West Nile virus
MEKLKLKG

SEQ ID NO: 126927 - protein, 8 aa, West Nile virus
EKLKLKGT

SEQ ID NO: 126928 - protein, 8 aa, West Nile virus
KLKLKGTT

SEQ ID NO: 126929 - protein, 8 aa, West Nile virus
LKLKGTTY

SEQ ID NO: 126930 - protein, 8 aa, West Nile virus
KLKGTTYG

SEQ ID NO: 126931 - protein, 8 aa, West Nile virus
GTTYGVCA

SEQ ID NO: 126932 - protein, 8 aa, West Nile virus
TTYGVCAK

SEQ ID NO: 126933 - protein, 8 aa, West Nile virus
TYGVCAKA

SEQ ID NO: 126934 - protein, 8 aa, West Nile virus
YGVCAKAF

SEQ ID NO: 126935 - protein, 8 aa, West Nile virus
GVCAKAFR

SEQ ID NO: 126936 - protein, 8 aa, West Nile virus
VCAKAFRF

SEQ ID NO: 126937 - protein, 8 aa, West Nile virus
RTPADTGH

SEQ ID NO: 126938 - protein, 8 aa, West Nile virus
TGHGTVVM

SEQ ID NO: 126939 - protein, 8 aa, West Nile virus
GHGTVVME

SEQ ID NO: 126940 - protein, 8 aa, West Nile virus
HGTVVMEL

SEQ ID NO: 126941 - protein, 8 aa, West Nile virus
GTVVMELQ

SEQ ID NO: 126942 - protein, 8 aa, West Nile virus
TVVMELQY

SEQ ID NO: 126943 - protein, 8 aa, West Nile virus
VVMELQYT

SEQ ID NO: 126944 - protein, 8 aa, West Nile virus
VMELQYTG

SEQ ID NO: 126945 - protein, 8 aa, West Nile virus
MELQYTGT

SEQ ID NO: 126946 - protein, 8 aa, West Nile virus
ELQYTGKD

SEQ ID NO: 126947 - protein, 8 aa, West Nile virus
LQYTGKDG

SEQ ID NO: 126948 - protein, 8 aa, West Nile virus
QYTGKDGP

SEQ ID NO: 126949 - protein, 8 aa, West Nile virus
YTGKDGPC

SEQ ID NO: 126950 - protein, 8 aa, West Nile virus
TGKDGPCK

SEQ ID NO: 126951 - protein, 8 aa, West Nile virus
GTDGPCKI

SEQ ID NO: 126952 - protein, 8 aa, West Nile virus
TDGPCKIP

SEQ ID NO: 126953 - protein, 8 aa, West Nile virus
DGPCKIPI

SEQ ID NO: 126954 - protein, 8 aa, West Nile virus
GPCKIPIT

SEQ ID NO: 126955 - protein, 8 aa, West Nile virus
PCKIPISS

SEQ ID NO: 126956 - protein, 8 aa, West Nile virus
CKIPITSV

SEQ ID NO: 126957 - protein, 8 aa, West Nile virus
KIPITSVA

SEQ ID NO: 126958 - protein, 8 aa, West Nile virus
IPISSVAS

SEQ ID NO: 126959 - protein, 8 aa, West Nile virus
PITSVASL

SEQ ID NO: 126960 - protein, 8 aa, West Nile virus
ITSVASLN

SEQ ID NO: 126961 - protein, 8 aa, West Nile virus
TSVASLND

SEQ ID NO: 126962 - protein, 8 aa, West Nile virus
RLVTVNPY

SEQ ID NO: 126963 - protein, 8 aa, West Nile virus
LVTVNPYV

SEQ ID NO: 126964 - protein, 8 aa, West Nile virus
VTVNPYVS

SEQ ID NO: 126965 - protein, 8 aa, West Nile virus
TVNPYVSV

SEQ ID NO: 126966 - protein, 8 aa, West Nile virus
VNPYVSVA

SEQ ID NO: 126967 - protein, 8 aa, West Nile virus
NPYVSVAT

SEQ ID NO: 126968 - protein, 8 aa, West Nile virus
PYVSVATA

SEQ ID NO: 126969 - protein, 8 aa, West Nile virus
ATANSKVL

SEQ ID NO: 126970 - protein, 8 aa, West Nile virus
TANSKVLI

SEQ ID NO: 126971 - protein, 8 aa, West Nile virus
ANSKVLIE

SEQ ID NO: 126972 - protein, 8 aa, West Nile virus
NSKVLIEL

SEQ ID NO: 126973 - protein, 8 aa, West Nile virus
SKVLIELE

SEQ ID NO: 126974 - protein, 8 aa, West Nile virus
KILVELEP

SEQ ID NO: 126975 - protein, 8 aa, West Nile virus
ILVELEPP

SEQ ID NO: 126976 - protein, 8 aa, West Nile virus
LVELEPPF

SEQ ID NO: 126977 - protein, 8 aa, West Nile virus
VELEPPFG

SEQ ID NO: 126978 - protein, 8 aa, West Nile virus
FGDSYIVI

SEQ ID NO: 126979 - protein, 8 aa, West Nile virus
GDSYIVIG

SEQ ID NO: 126980 - protein, 8 aa, West Nile virus
DSYIVIGK

SEQ ID NO: 126981 - protein, 8 aa, West Nile virus
SYIVIGKG

SEQ ID NO: 126982 - protein, 8 aa, West Nile virus
YIVIGKGD

SEQ ID NO: 126983 - protein, 8 aa, West Nile virus
IVIGKGDQ

SEQ ID NO: 126984 - protein, 8 aa, West Nile virus
VIGKGDQQ

SEQ ID NO: 126985 - protein, 8 aa, West Nile virus
IGKGDQQV

SEQ ID NO: 126986 - protein, 8 aa, West Nile virus
GKGDQQVT

SEQ ID NO: 126987 - protein, 8 aa, West Nile virus
KGDQQVTH

SEQ ID NO: 126988 - protein, 8 aa, West Nile virus
GDQQVTHH

SEQ ID NO: 126989 - protein, 8 aa, West Nile virus
DQQVTHHW

SEQ ID NO: 126990 - protein, 8 aa, West Nile virus
QQVTHHWH

SEQ ID NO: 126991 - protein, 8 aa, West Nile virus
QVTHHWHK

SEQ ID NO: 126992 - protein, 8 aa, West Nile virus
VTHHWHKS

SEQ ID NO: 126993 - protein, 8 aa, West Nile virus
THHWHKSG

SEQ ID NO: 126994 - protein, 8 aa, West Nile virus
HHWYKSGS

SEQ ID NO: 126995 - protein, 8 aa, West Nile virus
HWHKSGIS

SEQ ID NO: 126996 - protein, 8 aa, West Nile virus
WYKSGSSI

SEQ ID NO: 126997 - protein, 8 aa, West Nile virus
YKSGSSIG

SEQ ID NO: 126998 - protein, 8 aa, West Nile virus
SSIGKAFA

SEQ ID NO: 126999 - protein, 8 aa, West Nile virus
SIGKAFAT

SEQ ID NO: 127000 - protein, 8 aa, West Nile virus
IGKAFATT

SEQ ID NO: 127001 - protein, 8 aa, West Nile virus
GKAFATTL

SEQ ID NO: 127002 - protein, 8 aa, West Nile virus
KAFTTTLR

SEQ ID NO: 127003 - protein, 8 aa, West Nile virus
AFTTTLRG

SEQ ID NO: 127004 - protein, 8 aa, West Nile virus
FTTTLRGA

SEQ ID NO: 127005 - protein, 8 aa, West Nile virus
TTTLRGAQ

SEQ ID NO: 127006 - protein, 8 aa, West Nile virus
TTLRGAQR

SEQ ID NO: 127007 - protein, 8 aa, West Nile virus
TLRGAQRL

SEQ ID NO: 127008 - protein, 8 aa, West Nile virus
LRGAQRLA

SEQ ID NO: 127009 - protein, 8 aa, West Nile virus
RGAQRLAA

SEQ ID NO: 127010 - protein, 8 aa, West Nile virus
GAQRLVSL

SEQ ID NO: 127011 - protein, 8 aa, West Nile virus
AQRLVSLG

SEQ ID NO: 127012 - protein, 8 aa, West Nile virus
QRLVSLGD

SEQ ID NO: 127013 - protein, 8 aa, West Nile virus
RLVSLGDT

SEQ ID NO: 127014 - protein, 8 aa, West Nile virus
LVSLGDTA

SEQ ID NO: 127015 - protein, 8 aa, West Nile virus
VSLGDTAW

SEQ ID NO: 127016 - protein, 8 aa, West Nile virus
SLGDTAWD

SEQ ID NO: 127017 - protein, 8 aa, West Nile virus
TAWDFGSI

SEQ ID NO: 127018 - protein, 8 aa, West Nile virus
AWDFGSIG

SEQ ID NO: 127019 - protein, 8 aa, West Nile virus
WDFGSIGG

SEQ ID NO: 127020 - protein, 8 aa, West Nile virus
DFGSIGGV

SEQ ID NO: 127021 - protein, 8 aa, West Nile virus
FGSIGGVF

SEQ ID NO: 127022 - protein, 8 aa, West Nile virus
GSIGGVFT

SEQ ID NO: 127023 - protein, 8 aa, West Nile virus
SIGGVFTS

SEQ ID NO: 127024 - protein, 8 aa, West Nile virus
IGGVFTSV

SEQ ID NO: 127025 - protein, 8 aa, West Nile virus
GGVFNSIG

SEQ ID NO: 127026 - protein, 8 aa, West Nile virus
GVFNSIGK

SEQ ID NO: 127027 - protein, 8 aa, West Nile virus
VFNSIGKA

SEQ ID NO: 127028 - protein, 8 aa, West Nile virus
FTSVGKAI

SEQ ID NO: 127029 - protein, 8 aa, West Nile virus
TSVGKAIH

SEQ ID NO: 127030 - protein, 8 aa, West Nile virus
SVGKAIHQ

SEQ ID NO: 127031 - protein, 8 aa, West Nile virus
VGKAIHQV

SEQ ID NO: 127032 - protein, 8 aa, West Nile virus
GKAIHQVF

SEQ ID NO: 127033 - protein, 8 aa, West Nile virus
KAIHQVFG

SEQ ID NO: 127034 - protein, 8 aa, West Nile virus
AIHQVFGG

SEQ ID NO: 127035 - protein, 8 aa, West Nile virus
IHQVFGGA

SEQ ID NO: 127036 - protein, 8 aa, West Nile virus
HQLFGGAF

SEQ ID NO: 127037 - protein, 8 aa, West Nile virus
QLFGGAFR

SEQ ID NO: 127038 - protein, 8 aa, West Nile virus
LFGGAFRS

SEQ ID NO: 127039 - protein, 8 aa, West Nile virus
FGGAFRLL

SEQ ID NO: 127040 - protein, 8 aa, West Nile virus
GGAFRLLF

SEQ ID NO: 127041 - protein, 8 aa, West Nile virus
GAFRLLFG

SEQ ID NO: 127042 - protein, 8 aa, West Nile virus
AFRLLFGG

SEQ ID NO: 127043 - protein, 8 aa, West Nile virus
FRLLFGGM

SEQ ID NO: 127044 - protein, 8 aa, West Nile virus
RLLFGGMS

SEQ ID NO: 127045 - protein, 8 aa, West Nile virus
LLFGGMSW

SEQ ID NO: 127046 - protein, 8 aa, West Nile virus
ALLLWMGV

SEQ ID NO: 127047 - protein, 8 aa, West Nile virus
LLLWMGIS

SEQ ID NO: 127048 - protein, 8 aa, West Nile virus
LLWMGINS

SEQ ID NO: 127049 - protein, 8 aa, West Nile virus
LWMGINSR

SEQ ID NO: 127050 - protein, 8 aa, West Nile virus
WMGINSRD

SEQ ID NO: 127051 - protein, 8 aa, West Nile virus
MGINSRDR

SEQ ID NO: 127052 - protein, 8 aa, West Nile virus
GINSRDRS

SEQ ID NO: 127053 - protein, 8 aa, West Nile virus
INSRDRSI

SEQ ID NO: 127054 - protein, 8 aa, West Nile virus
NSRDRSIA

SEQ ID NO: 127055 - protein, 8 aa, West Nile virus
ARDRSIAM

SEQ ID NO: 127056 - protein, 8 aa, West Nile virus
RDRSIAMT

SEQ ID NO: 127057 - protein, 8 aa, West Nile virus
DRSIAMTF

SEQ ID NO: 127058 - protein, 8 aa, West Nile virus
RSIAMTFL

SEQ ID NO: 127059 - protein, 8 aa, West Nile virus
SIAMTFLA

SEQ ID NO: 127060 - protein, 8 aa, West Nile virus
IAMTFLAV

SEQ ID NO: 127061 - protein, 8 aa, West Nile virus
AMTFLAVG

SEQ ID NO: 127062 - protein, 8 aa, West Nile virus
MTFLAVGG

SEQ ID NO: 127063 - protein, 8 aa, West Nile virus
TFLAVGGI

SEQ ID NO: 127064 - protein, 8 aa, West Nile virus
FLAVGGIL

SEQ ID NO: 127065 - protein, 8 aa, West Nile virus
LAVGGILL

SEQ ID NO: 127066 - protein, 8 aa, West Nile virus
AIGGVLLF

SEQ ID NO: 127067 - protein, 8 aa, West Nile virus
VGGILLFL

SEQ ID NO: 127068 - protein, 8 aa, West Nile virus
GGILLFLS

SEQ ID NO: 127069 - protein, 8 aa, West Nile virus
GILLFLSA

SEQ ID NO: 127070 - protein, 8 aa, West Nile virus
ILLFLSAN

SEQ ID NO: 127071 - protein, 8 aa, West Nile virus
LLFLSVSV

SEQ ID NO: 127072 - protein, 8 aa, West Nile virus
LFLSANVH

SEQ ID NO: 127073 - protein, 8 aa, West Nile virus
FLSANVHA

SEQ ID NO: 127074 - protein, 8 aa, West Nile virus
LSVSVHAD

SEQ ID NO: 127075 - protein, 8 aa, West Nile virus
SANVHADT

SEQ ID NO: 127076 - protein, 8 aa, West Nile virus
ANVHADTG

SEQ ID NO: 127077 - protein, 8 aa, West Nile virus
DTGCAIDL

SEQ ID NO: 127078 - protein, 8 aa, West Nile virus
TGCAIDIG

SEQ ID NO: 127079 - protein, 8 aa, West Nile virus
GCAIDIGR

SEQ ID NO: 127080 - protein, 8 aa, West Nile virus
CAIDIGRQ

SEQ ID NO: 127081 - protein, 8 aa, West Nile virus
AIDIGRQE

SEQ ID NO: 127082 - protein, 8 aa, West Nile virus
IDIGRQEL

SEQ ID NO: 127083 - protein, 8 aa, West Nile virus
DIGRQELR

SEQ ID NO: 127084 - protein, 8 aa, West Nile virus
IGRQELRC

SEQ ID NO: 127085 - protein, 8 aa, West Nile virus
GRQELRCG

SEQ ID NO: 127086 - protein, 8 aa, West Nile virus
CGSGVFIY

SEQ ID NO: 127087 - protein, 8 aa, West Nile virus
GNGVFIHN

SEQ ID NO: 127088 - protein, 8 aa, West Nile virus
SGVFIYND

SEQ ID NO: 127089 - protein, 8 aa, West Nile virus
VFIHNDVK

SEQ ID NO: 127090 - protein, 8 aa, West Nile virus
FIYNDVEA

SEQ ID NO: 127091 - protein, 8 aa, West Nile virus
IYNDVEAW

SEQ ID NO: 127092 - protein, 8 aa, West Nile virus
NDVEAWVD

SEQ ID NO: 127093 - protein, 8 aa, West Nile virus
DVEAWVDR

SEQ ID NO: 127094 - protein, 8 aa, West Nile virus
VEAWVDRY

SEQ ID NO: 127095 - protein, 8 aa, West Nile virus
EAWVDRYR

SEQ ID NO: 127096 - protein, 8 aa, West Nile virus
DRYKFYPE

SEQ ID NO: 127097 - protein, 8 aa, West Nile virus
RYKFYPET

SEQ ID NO: 127098 - protein, 8 aa, West Nile virus
YKFYPETP

SEQ ID NO: 127099 - protein, 8 aa, West Nile virus
KFYPETPQ

SEQ ID NO: 127100 - protein, 8 aa, West Nile virus
FYPETPQG

SEQ ID NO: 127101 - protein, 8 aa, West Nile virus
HPETPQGL

SEQ ID NO: 127102 - protein, 8 aa, West Nile virus
ETPQGLAR

SEQ ID NO: 127103 - protein, 8 aa, West Nile virus
TPQGLARV

SEQ ID NO: 127104 - protein, 8 aa, West Nile virus
PQGLARVI

SEQ ID NO: 127105 - protein, 8 aa, West Nile virus
QGLAKIIH

SEQ ID NO: 127106 - protein, 8 aa, West Nile virus
GLAKIIHN

SEQ ID NO: 127107 - protein, 8 aa, West Nile virus
LAKIIHNA

SEQ ID NO: 127108 - protein, 8 aa, West Nile virus
AKIIHNAH

SEQ ID NO: 127109 - protein, 8 aa, West Nile virus
IQKAHAEG

SEQ ID NO: 127110 - protein, 8 aa, West Nile virus
AHAEGVCG

SEQ ID NO: 127111 - protein, 8 aa, West Nile virus
EGVCGVRS

SEQ ID NO: 127112 - protein, 8 aa, West Nile virus
GVCGVRSV

SEQ ID NO: 127113 - protein, 8 aa, West Nile virus
VCGVRSVS

SEQ ID NO: 127114 - protein, 8 aa, West Nile virus
CGVRSVSR

SEQ ID NO: 127115 - protein, 8 aa, West Nile virus
GVRSVSRL

SEQ ID NO: 127116 - protein, 8 aa, West Nile virus
VRSVSRLE

SEQ ID NO: 127117 - protein, 8 aa, West Nile virus
RLEHQMWD

SEQ ID NO: 127118 - protein, 8 aa, West Nile virus
LEHQMWES

SEQ ID NO: 127119 - protein, 8 aa, West Nile virus
EHQMWESV

SEQ ID NO: 127120 - protein, 8 aa, West Nile virus
HQMWESVK

SEQ ID NO: 127121 - protein, 8 aa, West Nile virus
QMWESVKD

SEQ ID NO: 127122 - protein, 8 aa, West Nile virus
MWESVKDE

SEQ ID NO: 127123 - protein, 8 aa, West Nile virus
WESVKDEL

SEQ ID NO: 127124 - protein, 8 aa, West Nile virus
ESVKDELN

SEQ ID NO: 127125 - protein, 8 aa, West Nile virus
SVKDELNT

SEQ ID NO: 127126 - protein, 8 aa, West Nile virus
IKDELNTL

SEQ ID NO: 127127 - protein, 8 aa, West Nile virus
KDELNTLF

SEQ ID NO: 127128 - protein, 8 aa, West Nile virus
DELNTPLK

SEQ ID NO: 127129 - protein, 8 aa, West Nile virus
ELNTPLKE

SEQ ID NO: 127130 - protein, 8 aa, West Nile virus
LNTLFREN

SEQ ID NO: 127131 - protein, 8 aa, West Nile virus
NTPLKENG

SEQ ID NO: 127132 - protein, 8 aa, West Nile virus
TLLKENGI

SEQ ID NO: 127133 - protein, 8 aa, West Nile virus
LLKENGID

SEQ ID NO: 127134 - protein, 8 aa, West Nile virus
LKENGIDL

SEQ ID NO: 127135 - protein, 8 aa, West Nile virus
KENGIDLS

SEQ ID NO: 127136 - protein, 8 aa, West Nile virus
ENGVDLSI

SEQ ID NO: 127137 - protein, 8 aa, West Nile virus
NGVDLSIV

SEQ ID NO: 127138 - protein, 8 aa, West Nile virus
GVDLSIVV

SEQ ID NO: 127139 - protein, 8 aa, West Nile virus
VDLSIVVE

SEQ ID NO: 127140 - protein, 8 aa, West Nile virus
DLSIVVEK

SEQ ID NO: 127141 - protein, 8 aa, West Nile virus
LSIVVEKQ

SEQ ID NO: 127142 - protein, 8 aa, West Nile virus
VVEKQNGM

SEQ ID NO: 127143 - protein, 8 aa, West Nile virus
APKRLAAT

SEQ ID NO: 127144 - protein, 8 aa, West Nile virus
ATTEKLEM

SEQ ID NO: 127145 - protein, 8 aa, West Nile virus
TTEKLEMG

SEQ ID NO: 127146 - protein, 8 aa, West Nile virus
TEKLEMGW

SEQ ID NO: 127147 - protein, 8 aa, West Nile virus
EKLEMGWK

SEQ ID NO: 127148 - protein, 8 aa, West Nile virus
KLEMGWKA

SEQ ID NO: 127149 - protein, 8 aa, West Nile virus
LEMGWKAW

SEQ ID NO: 127150 - protein, 8 aa, West Nile virus
EMGWKAWG

SEQ ID NO: 127151 - protein, 8 aa, West Nile virus
MGWKAWGK

SEQ ID NO: 127152 - protein, 8 aa, West Nile virus
KAWGKSII

SEQ ID NO: 127153 - protein, 8 aa, West Nile virus
AWGKSIIF

SEQ ID NO: 127154 - protein, 8 aa, West Nile virus
WGKSIIFA

SEQ ID NO: 127155 - protein, 8 aa, West Nile virus
GKSIIFAP

SEQ ID NO: 127156 - protein, 8 aa, West Nile virus
KSIIFAPE

SEQ ID NO: 127157 - protein, 8 aa, West Nile virus
SIIFAPEL

SEQ ID NO: 127158 - protein, 8 aa, West Nile virus
IIFAPELA

SEQ ID NO: 127159 - protein, 8 aa, West Nile virus
IFAPELAN

SEQ ID NO: 127160 - protein, 8 aa, West Nile virus
FAPELANH

SEQ ID NO: 127161 - protein, 8 aa, West Nile virus
APELANHT

SEQ ID NO: 127162 - protein, 8 aa, West Nile virus
PELANHTF

SEQ ID NO: 127163 - protein, 8 aa, West Nile virus
ELANHTFV

SEQ ID NO: 127164 - protein, 8 aa, West Nile virus
LANNTFVI

SEQ ID NO: 127165 - protein, 8 aa, West Nile virus
ANNTFVID

SEQ ID NO: 127166 - protein, 8 aa, West Nile virus
NNTFVIDG

SEQ ID NO: 127167 - protein, 8 aa, West Nile virus
NTFVIDGP

SEQ ID NO: 127168 - protein, 8 aa, West Nile virus
TFVIDGPE

SEQ ID NO: 127169 - protein, 8 aa, West Nile virus
FVIDGPET

SEQ ID NO: 127170 - protein, 8 aa, West Nile virus
VIDGPETE

SEQ ID NO: 127171 - protein, 8 aa, West Nile virus
IDGPETEE

SEQ ID NO: 127172 - protein, 8 aa, West Nile virus
DGPETEEC

SEQ ID NO: 127173 - protein, 8 aa, West Nile virus
GPETEECP

SEQ ID NO: 127174 - protein, 8 aa, West Nile virus
PETEECPT

SEQ ID NO: 127175 - protein, 8 aa, West Nile virus
NRAWNSME

SEQ ID NO: 127176 - protein, 8 aa, West Nile virus
RAWNSMEV

SEQ ID NO: 127177 - protein, 8 aa, West Nile virus
AWNSMEVE

SEQ ID NO: 127178 - protein, 8 aa, West Nile virus
WNSMEVED

SEQ ID NO: 127179 - protein, 8 aa, West Nile virus
NSMEVEDF

SEQ ID NO: 127180 - protein, 8 aa, West Nile virus
SMEVEDFG

SEQ ID NO: 127181 - protein, 8 aa, West Nile virus
MEVEDFGF

SEQ ID NO: 127182 - protein, 8 aa, West Nile virus
FGLTSTRI

SEQ ID NO: 127183 - protein, 8 aa, West Nile virus
GLMTTRMF

SEQ ID NO: 127184 - protein, 8 aa, West Nile virus
LTSTRMFM

SEQ ID NO: 127185 - protein, 8 aa, West Nile virus
TSTRMFLR

SEQ ID NO: 127186 - protein, 8 aa, West Nile virus
IRETNTTE

SEQ ID NO: 127187 - protein, 8 aa, West Nile virus
RETNTTEC

SEQ ID NO: 127188 - protein, 8 aa, West Nile virus
ETNTTECD

SEQ ID NO: 127189 - protein, 8 aa, West Nile virus
TNTTECDS

SEQ ID NO: 127190 - protein, 8 aa, West Nile virus
NTTECDTK

SEQ ID NO: 127191 - protein, 8 aa, West Nile virus
TTECDTKI

SEQ ID NO: 127192 - protein, 8 aa, West Nile virus
TECDTKII

SEQ ID NO: 127193 - protein, 8 aa, West Nile virus
ECDTKIIG

SEQ ID NO: 127194 - protein, 8 aa, West Nile virus
CDTKIIGT

SEQ ID NO: 127195 - protein, 8 aa, West Nile virus
DTKIIGTA

SEQ ID NO: 127196 - protein, 8 aa, West Nile virus
TKIIGTAV

SEQ ID NO: 127197 - protein, 8 aa, West Nile virus
KTIGTAVK

SEQ ID NO: 127198 - protein, 8 aa, West Nile virus
TIGTAVKN

SEQ ID NO: 127199 - protein, 8 aa, West Nile virus
GTAVKNNM

SEQ ID NO: 127200 - protein, 8 aa, West Nile virus
TAVKNNMA

SEQ ID NO: 127201 - protein, 8 aa, West Nile virus
AVKNNMAV

SEQ ID NO: 127202 - protein, 8 aa, West Nile virus
VKNNMAVH

SEQ ID NO: 127203 - protein, 8 aa, West Nile virus
KNNMAVHS

SEQ ID NO: 127204 - protein, 8 aa, West Nile virus
NNMAVHSD

SEQ ID NO: 127205 - protein, 8 aa, West Nile virus
NMAVHSDL

SEQ ID NO: 127206 - protein, 8 aa, West Nile virus
MAVHSDLS

SEQ ID NO: 127207 - protein, 8 aa, West Nile virus
AVHSDLSY

SEQ ID NO: 127208 - protein, 8 aa, West Nile virus
VHSDLSYW

SEQ ID NO: 127209 - protein, 8 aa, West Nile virus
LSYWIESG

SEQ ID NO: 127210 - protein, 8 aa, West Nile virus
SYWIESGL

SEQ ID NO: 127211 - protein, 8 aa, West Nile virus
YWIESGLN

SEQ ID NO: 127212 - protein, 8 aa, West Nile virus
FNDTWKLE

SEQ ID NO: 127213 - protein, 8 aa, West Nile virus
NETWKLER

SEQ ID NO: 127214 - protein, 8 aa, West Nile virus
ETWKLERA

SEQ ID NO: 127215 - protein, 8 aa, West Nile virus
ETHTLWGE

SEQ ID NO: 127216 - protein, 8 aa, West Nile virus
THTLWGEG

SEQ ID NO: 127217 - protein, 8 aa, West Nile virus
HTLWGDGV

SEQ ID NO: 127218 - protein, 8 aa, West Nile virus
TLWGDGVL

SEQ ID NO: 127219 - protein, 8 aa, West Nile virus
LWGDGVLE

SEQ ID NO: 127220 - protein, 8 aa, West Nile virus
WGDGVLES

SEQ ID NO: 127221 - protein, 8 aa, West Nile virus
GVLESDLI

SEQ ID NO: 127222 - protein, 8 aa, West Nile virus
VLESDLII

SEQ ID NO: 127223 - protein, 8 aa, West Nile virus
QESDLIIP

SEQ ID NO: 127224 - protein, 8 aa, West Nile virus
ESDLIIPI

SEQ ID NO: 127225 - protein, 8 aa, West Nile virus
SDLIIPIT

SEQ ID NO: 127226 - protein, 8 aa, West Nile virus
DLIIPITL

SEQ ID NO: 127227 - protein, 8 aa, West Nile virus
LIIPITLA

SEQ ID NO: 127228 - protein, 8 aa, West Nile virus
IIPITLAG

SEQ ID NO: 127229 - protein, 8 aa, West Nile virus
IPITLAGP

SEQ ID NO: 127230 - protein, 8 aa, West Nile virus
PITLAGPR

SEQ ID NO: 127231 - protein, 8 aa, West Nile virus
ITLAGPRS

SEQ ID NO: 127232 - protein, 8 aa, West Nile virus
TLAGLRSN

SEQ ID NO: 127233 - protein, 8 aa, West Nile virus
LAGLRSNH

SEQ ID NO: 127234 - protein, 8 aa, West Nile virus
AGLRSNHN

SEQ ID NO: 127235 - protein, 8 aa, West Nile virus
GLRSNHNR

SEQ ID NO: 127236 - protein, 8 aa, West Nile virus
LRSNHNRR

SEQ ID NO: 127237 - protein, 8 aa, West Nile virus
RSNYNRRP

SEQ ID NO: 127238 - protein, 8 aa, West Nile virus
SNYNRRPG

SEQ ID NO: 127239 - protein, 8 aa, West Nile virus
NYNRRPGY

SEQ ID NO: 127240 - protein, 8 aa, West Nile virus
YNRRPGYK

SEQ ID NO: 127241 - protein, 8 aa, West Nile virus
NRRPGYKM

SEQ ID NO: 127242 - protein, 8 aa, West Nile virus
KRPGYKTQ

SEQ ID NO: 127243 - protein, 8 aa, West Nile virus
RPGYKTQS

SEQ ID NO: 127244 - protein, 8 aa, West Nile virus
PGYKTQSQ

SEQ ID NO: 127245 - protein, 8 aa, West Nile virus
GYKTQSQG

SEQ ID NO: 127246 - protein, 8 aa, West Nile virus
YKTQSQGP

SEQ ID NO: 127247 - protein, 8 aa, West Nile virus
KTQSQGPW

SEQ ID NO: 127248 - protein, 8 aa, West Nile virus
TQSQGPWD

SEQ ID NO: 127249 - protein, 8 aa, West Nile virus
QSQGPWDE

SEQ ID NO: 127250 - protein, 8 aa, West Nile virus
SQGPWDEG

SEQ ID NO: 127251 - protein, 8 aa, West Nile virus
GPWDEGRI

SEQ ID NO: 127252 - protein, 8 aa, West Nile virus
PWDEGRIE

SEQ ID NO: 127253 - protein, 8 aa, West Nile virus
WDEGRVEL

SEQ ID NO: 127254 - protein, 8 aa, West Nile virus
DEGRVELD

SEQ ID NO: 127255 - protein, 8 aa, West Nile virus
EGRVELDF

SEQ ID NO: 127256 - protein, 8 aa, West Nile virus
GRVELDFD

SEQ ID NO: 127257 - protein, 8 aa, West Nile virus
RVELDFDY

SEQ ID NO: 127258 - protein, 8 aa, West Nile virus
VELDFDYC

SEQ ID NO: 127259 - protein, 8 aa, West Nile virus
ELDFDYCP

SEQ ID NO: 127260 - protein, 8 aa, West Nile virus
LDFDYCPG

SEQ ID NO: 127261 - protein, 8 aa, West Nile virus
CPGTTVTI

SEQ ID NO: 127262 - protein, 8 aa, West Nile virus
PGTTVTIS

SEQ ID NO: 127263 - protein, 8 aa, West Nile virus
SCEHRGPA

SEQ ID NO: 127264 - protein, 8 aa, West Nile virus
CGHRGPAA

SEQ ID NO: 127265 - protein, 8 aa, West Nile virus
GHRGPAAR

SEQ ID NO: 127266 - protein, 8 aa, West Nile virus
HRGPAART

SEQ ID NO: 127267 - protein, 8 aa, West Nile virus
RGPAARTT

SEQ ID NO: 127268 - protein, 8 aa, West Nile virus
GPAARTTT

SEQ ID NO: 127269 - protein, 8 aa, West Nile virus
PAARTTTE

SEQ ID NO: 127270 - protein, 8 aa, West Nile virus
AARTTTES

SEQ ID NO: 127271 - protein, 8 aa, West Nile virus
ARTTTESG

SEQ ID NO: 127272 - protein, 8 aa, West Nile virus
TESGKLIS

SEQ ID NO: 127273 - protein, 8 aa, West Nile virus
ESGKLISD

SEQ ID NO: 127274 - protein, 8 aa, West Nile virus
SGKLISDW

SEQ ID NO: 127275 - protein, 8 aa, West Nile virus
GKLISDWC

SEQ ID NO: 127276 - protein, 8 aa, West Nile virus
KLISDWCC

SEQ ID NO: 127277 - protein, 8 aa, West Nile virus
LISDWCCR

SEQ ID NO: 127278 - protein, 8 aa, West Nile virus
ISDWCCRS

SEQ ID NO: 127279 - protein, 8 aa, West Nile virus
SDWCCRSC

SEQ ID NO: 127280 - protein, 8 aa, West Nile virus
CTLPPLRF

SEQ ID NO: 127281 - protein, 8 aa, West Nile virus
TLPPLRFQ

SEQ ID NO: 127282 - protein, 8 aa, West Nile virus
LPPLRFQT

SEQ ID NO: 127283 - protein, 8 aa, West Nile virus
PPLRFQTE

SEQ ID NO: 127284 - protein, 8 aa, West Nile virus
TENGCWYG

SEQ ID NO: 127285 - protein, 8 aa, West Nile virus
ENGCWYGM

SEQ ID NO: 127286 - protein, 8 aa, West Nile virus
NGCWYGME

SEQ ID NO: 127287 - protein, 8 aa, West Nile virus
YGMEIRPT

SEQ ID NO: 127288 - protein, 8 aa, West Nile virus
GMEIRPTR

SEQ ID NO: 127289 - protein, 8 aa, West Nile virus
MEIRPTRH

SEQ ID NO: 127290 - protein, 8 aa, West Nile virus
EIRPTRHD

SEQ ID NO: 127291 - protein, 8 aa, West Nile virus
IRPTRHDE

SEQ ID NO: 127292 - protein, 8 aa, West Nile virus
RPTRHDEK

SEQ ID NO: 127293 - protein, 8 aa, West Nile virus
PTRHDEKT

SEQ ID NO: 127294 - protein, 8 aa, West Nile virus
TRHDEKTL

SEQ ID NO: 127295 - protein, 8 aa, West Nile virus
RHDGKTLV

SEQ ID NO: 127296 - protein, 8 aa, West Nile virus
HDGKTLVQ

SEQ ID NO: 127297 - protein, 8 aa, West Nile virus
DERTLVQS

SEQ ID NO: 127298 - protein, 8 aa, West Nile virus
EKTLVQSR

SEQ ID NO: 127299 - protein, 8 aa, West Nile virus
KTLVQSRV

SEQ ID NO: 127300 - protein, 8 aa, West Nile virus
TLVQSRVN

SEQ ID NO: 127301 - protein, 8 aa, West Nile virus
LVQSRVNA

SEQ ID NO: 127302 - protein, 8 aa, West Nile virus
VQSRVNAY

SEQ ID NO: 127303 - protein, 8 aa, West Nile virus
QSRVNAYN

SEQ ID NO: 127304 - protein, 8 aa, West Nile virus
SRVNAYNA

SEQ ID NO: 127305 - protein, 8 aa, West Nile virus
RVNAYNAD

SEQ ID NO: 127306 - protein, 8 aa, West Nile virus
VTAYNADM

SEQ ID NO: 127307 - protein, 8 aa, West Nile virus
TAYNADMI

SEQ ID NO: 127308 - protein, 8 aa, West Nile virus
AHNADMID

SEQ ID NO: 127309 - protein, 8 aa, West Nile virus
YNAEMIDP

SEQ ID NO: 127310 - protein, 8 aa, West Nile virus
KSDMIDPF

SEQ ID NO: 127311 - protein, 8 aa, West Nile virus
AEMIDPFQ

SEQ ID NO: 127312 - protein, 8 aa, West Nile virus
DPFQLGLM

SEQ ID NO: 127313 - protein, 8 aa, West Nile virus
PFQLGLMV

SEQ ID NO: 127314 - protein, 8 aa, West Nile virus
FQLGLMVV

SEQ ID NO: 127315 - protein, 8 aa, West Nile virus
QLGLMVVF

SEQ ID NO: 127316 - protein, 8 aa, West Nile virus
LGLMVVFL

SEQ ID NO: 127317 - protein, 8 aa, West Nile virus
GLMVVFLA

SEQ ID NO: 127318 - protein, 8 aa, West Nile virus
LMVVFLAT

SEQ ID NO: 127319 - protein, 8 aa, West Nile virus
MVVFLATQ

SEQ ID NO: 127320 - protein, 8 aa, West Nile virus
VVFLVTQE

SEQ ID NO: 127321 - protein, 8 aa, West Nile virus
VFLVTQEV

SEQ ID NO: 127322 - protein, 8 aa, West Nile virus
FLVTQEVL

SEQ ID NO: 127323 - protein, 8 aa, West Nile virus
LATKEVLR

SEQ ID NO: 127324 - protein, 8 aa, West Nile virus
ATKEVLRK

SEQ ID NO: 127325 - protein, 8 aa, West Nile virus
TKEVLRKR

SEQ ID NO: 127326 - protein, 8 aa, West Nile virus
QEVLRRRW

SEQ ID NO: 127327 - protein, 8 aa, West Nile virus
RWTAKISI

SEQ ID NO: 127328 - protein, 8 aa, West Nile virus
WTAKISIP

SEQ ID NO: 127329 - protein, 8 aa, West Nile virus
TAKISIPA

SEQ ID NO: 127330 - protein, 8 aa, West Nile virus
AKISIPAI

SEQ ID NO: 127331 - protein, 8 aa, West Nile virus
PAIMLALL

SEQ ID NO: 127332 - protein, 8 aa, West Nile virus
AIMLALLV

SEQ ID NO: 127333 - protein, 8 aa, West Nile virus
IMLALLVL

SEQ ID NO: 127334 - protein, 8 aa, West Nile virus
MLALLVLV

SEQ ID NO: 127335 - protein, 8 aa, West Nile virus
LALLVLVF

SEQ ID NO: 127336 - protein, 8 aa, West Nile virus
ALLTLVFG

SEQ ID NO: 127337 - protein, 8 aa, West Nile virus
LLTLVFGG

SEQ ID NO: 127338 - protein, 8 aa, West Nile virus
LTLVFGGV

SEQ ID NO: 127339 - protein, 8 aa, West Nile virus
TLVFGGVT

SEQ ID NO: 127340 - protein, 8 aa, West Nile virus
LVFGGVTY

SEQ ID NO: 127341 - protein, 8 aa, West Nile virus
VFGGVTYT

SEQ ID NO: 127342 - protein, 8 aa, West Nile virus
FGGVTYTD

SEQ ID NO: 127343 - protein, 8 aa, West Nile virus
GGVTYTDL

SEQ ID NO: 127344 - protein, 8 aa, West Nile virus
GVTYTDLI

SEQ ID NO: 127345 - protein, 8 aa, West Nile virus
VTYTDLIR

SEQ ID NO: 127346 - protein, 8 aa, West Nile virus
TYTDLIRY

SEQ ID NO: 127347 - protein, 8 aa, West Nile virus
YTDLIRYV

SEQ ID NO: 127348 - protein, 8 aa, West Nile virus
TDLIRYVI

SEQ ID NO: 127349 - protein, 8 aa, West Nile virus
DLIRYVIL

SEQ ID NO: 127350 - protein, 8 aa, West Nile virus
LIRYVILV

SEQ ID NO: 127351 - protein, 8 aa, West Nile virus
IRYVILVG

SEQ ID NO: 127352 - protein, 8 aa, West Nile virus
RYVILAGA

SEQ ID NO: 127353 - protein, 8 aa, West Nile virus
YVILAGAA

SEQ ID NO: 127354 - protein, 8 aa, West Nile virus
IILVGAAF

SEQ ID NO: 127355 - protein, 8 aa, West Nile virus
NLVGAAFA

SEQ ID NO: 127356 - protein, 8 aa, West Nile virus
LVGAAFME

SEQ ID NO: 127357 - protein, 8 aa, West Nile virus
VGAAFAEA

SEQ ID NO: 127358 - protein, 8 aa, West Nile virus
GAAFAEAN

SEQ ID NO: 127359 - protein, 8 aa, West Nile virus
AAFAEANS

SEQ ID NO: 127360 - protein, 8 aa, West Nile virus
AFAEANSG

SEQ ID NO: 127361 - protein, 8 aa, West Nile virus
FAEANSGG

SEQ ID NO: 127362 - protein, 8 aa, West Nile virus
AEANSGGD

SEQ ID NO: 127363 - protein, 8 aa, West Nile virus
EANSGGDV

SEQ ID NO: 127364 - protein, 8 aa, West Nile virus
ANSGGDVV

SEQ ID NO: 127365 - protein, 8 aa, West Nile virus
LALMATFR

SEQ ID NO: 127366 - protein, 8 aa, West Nile virus
ALMATFKV

SEQ ID NO: 127367 - protein, 8 aa, West Nile virus
LMATFKVQ

SEQ ID NO: 127368 - protein, 8 aa, West Nile virus
MATFKVQP

SEQ ID NO: 127369 - protein, 8 aa, West Nile virus
ATFKIQPA

SEQ ID NO: 127370 - protein, 8 aa, West Nile virus
TFKIQPAF

SEQ ID NO: 127371 - protein, 8 aa, West Nile virus
IQPVFLVA

SEQ ID NO: 127372 - protein, 8 aa, West Nile virus
QPVFLVAS

SEQ ID NO: 127373 - protein, 8 aa, West Nile virus
PVFLVASF

SEQ ID NO: 127374 - protein, 8 aa, West Nile virus
VFLVASFL

SEQ ID NO: 127375 - protein, 8 aa, West Nile virus
FLVASFLK

SEQ ID NO: 127376 - protein, 8 aa, West Nile virus
LVASFLKA

SEQ ID NO: 127377 - protein, 8 aa, West Nile virus
VASFLKTR

SEQ ID NO: 127378 - protein, 8 aa, West Nile virus
ASFLKTRW

SEQ ID NO: 127379 - protein, 8 aa, West Nile virus
SFLKTRWT

SEQ ID NO: 127380 - protein, 8 aa, West Nile virus
FLKTRWTN

SEQ ID NO: 127381 - protein, 8 aa, West Nile virus
KTRWTNQE

SEQ ID NO: 127382 - protein, 8 aa, West Nile virus
ARWTNQES

SEQ ID NO: 127383 - protein, 8 aa, West Nile virus
RWTNQESI

SEQ ID NO: 127384 - protein, 8 aa, West Nile virus
WTNQESIL

SEQ ID NO: 127385 - protein, 8 aa, West Nile virus
TNQESILL

SEQ ID NO: 127386 - protein, 8 aa, West Nile virus
NQESILLM

SEQ ID NO: 127387 - protein, 8 aa, West Nile virus
QESILLML

SEQ ID NO: 127388 - protein, 8 aa, West Nile virus
ESILLMLA

SEQ ID NO: 127389 - protein, 8 aa, West Nile virus
SILLMLAA

SEQ ID NO: 127390 - protein, 8 aa, West Nile virus
ILLMLAAA

SEQ ID NO: 127391 - protein, 8 aa, West Nile virus
LLMLAAAF

SEQ ID NO: 127392 - protein, 8 aa, West Nile virus
LMLAAAFF

SEQ ID NO: 127393 - protein, 8 aa, West Nile virus
MLAAAFFQ

SEQ ID NO: 127394 - protein, 8 aa, West Nile virus
LAAAFFQM

SEQ ID NO: 127395 - protein, 8 aa, West Nile virus
AAAFFQMA

SEQ ID NO: 127396 - protein, 8 aa, West Nile virus
AAFFQMAY

SEQ ID NO: 127397 - protein, 8 aa, West Nile virus
AFFQMAYY

SEQ ID NO: 127398 - protein, 8 aa, West Nile virus
FFQMAYYD

SEQ ID NO: 127399 - protein, 8 aa, West Nile virus
FQMAYYDA

SEQ ID NO: 127400 - protein, 8 aa, West Nile virus
QMAYYDAK

SEQ ID NO: 127401 - protein, 8 aa, West Nile virus
WEVPDVLN

SEQ ID NO: 127402 - protein, 8 aa, West Nile virus
EVPDVLNS

SEQ ID NO: 127403 - protein, 8 aa, West Nile virus
VPDVLNSL

SEQ ID NO: 127404 - protein, 8 aa, West Nile virus
PDVLNSLS

SEQ ID NO: 127405 - protein, 8 aa, West Nile virus
DVLNSLSV

SEQ ID NO: 127406 - protein, 8 aa, West Nile virus
VLNSLSVA

SEQ ID NO: 127407 - protein, 8 aa, West Nile virus
LNSLSVAW

SEQ ID NO: 127408 - protein, 8 aa, West Nile virus
NSLSVAWM

SEQ ID NO: 127409 - protein, 8 aa, West Nile virus
SLSVAWMI

SEQ ID NO: 127410 - protein, 8 aa, West Nile virus
LSVAWMIL

SEQ ID NO: 127411 - protein, 8 aa, West Nile virus
SVAWMILR

SEQ ID NO: 127412 - protein, 8 aa, West Nile virus
IAWMILRA

SEQ ID NO: 127413 - protein, 8 aa, West Nile virus
WMILRAIS

SEQ ID NO: 127414 - protein, 8 aa, West Nile virus
MILRAISF

SEQ ID NO: 127415 - protein, 8 aa, West Nile virus
ILRAISFT

SEQ ID NO: 127416 - protein, 8 aa, West Nile virus
FTNTSNVV

SEQ ID NO: 127417 - protein, 8 aa, West Nile virus
TNTSNVVV

SEQ ID NO: 127418 - protein, 8 aa, West Nile virus
NTSNVVVP

SEQ ID NO: 127419 - protein, 8 aa, West Nile virus
TSNVATPL

SEQ ID NO: 127420 - protein, 8 aa, West Nile virus
SNVATPLL

SEQ ID NO: 127421 - protein, 8 aa, West Nile virus
NVATPLLA

SEQ ID NO: 127422 - protein, 8 aa, West Nile virus
VATPLLAL

SEQ ID NO: 127423 - protein, 8 aa, West Nile virus
ATPLLALL

SEQ ID NO: 127424 - protein, 8 aa, West Nile virus
TPLLALLT

SEQ ID NO: 127425 - protein, 8 aa, West Nile virus
PLMALLTP

SEQ ID NO: 127426 - protein, 8 aa, West Nile virus
LMALLTPG

SEQ ID NO: 127427 - protein, 8 aa, West Nile virus
MALLTPGL

SEQ ID NO: 127428 - protein, 8 aa, West Nile virus
ALLTPGLK

SEQ ID NO: 127429 - protein, 8 aa, West Nile virus
LLTPGLKC

SEQ ID NO: 127430 - protein, 8 aa, West Nile virus
LTPGLKCL

SEQ ID NO: 127431 - protein, 8 aa, West Nile virus
TPGLKCLN

SEQ ID NO: 127432 - protein, 8 aa, West Nile virus
PGLKCLNL

SEQ ID NO: 127433 - protein, 8 aa, West Nile virus
GLKCLNLD

SEQ ID NO: 127434 - protein, 8 aa, West Nile virus
LKCLNLDV

SEQ ID NO: 127435 - protein, 8 aa, West Nile virus
KCLNLDVY

SEQ ID NO: 127436 - protein, 8 aa, West Nile virus
CLHLDIYR

SEQ ID NO: 127437 - protein, 8 aa, West Nile virus
LHLDIYRI

SEQ ID NO: 127438 - protein, 8 aa, West Nile virus
HLDIYRIL

SEQ ID NO: 127439 - protein, 8 aa, West Nile virus
LDIYRILL

SEQ ID NO: 127440 - protein, 8 aa, West Nile virus
DIYRILLL

SEQ ID NO: 127441 - protein, 8 aa, West Nile virus
IYRILLLM

SEQ ID NO: 127442 - protein, 8 aa, West Nile virus
YKILLLMV

SEQ ID NO: 127443 - protein, 8 aa, West Nile virus
RILLLMIG

SEQ ID NO: 127444 - protein, 8 aa, West Nile virus
ILLLMVGV

SEQ ID NO: 127445 - protein, 8 aa, West Nile virus
LLLMVGVG

SEQ ID NO: 127446 - protein, 8 aa, West Nile virus
LLMVGVGS

SEQ ID NO: 127447 - protein, 8 aa, West Nile virus
LMVGVGSL

SEQ ID NO: 127448 - protein, 8 aa, West Nile virus
MVGVGSLI

SEQ ID NO: 127449 - protein, 8 aa, West Nile virus
VGVGSLIK

SEQ ID NO: 127450 - protein, 8 aa, West Nile virus
GVGSLIKE

SEQ ID NO: 127451 - protein, 8 aa, West Nile virus
VGSLIKEK

SEQ ID NO: 127452 - protein, 8 aa, West Nile virus
GSLIKEKR

SEQ ID NO: 127453 - protein, 8 aa, West Nile virus
SLIKEKRS

SEQ ID NO: 127454 - protein, 8 aa, West Nile virus
EKRSSAAK

SEQ ID NO: 127455 - protein, 8 aa, West Nile virus
KRSSAAKK

SEQ ID NO: 127456 - protein, 8 aa, West Nile virus
RSSAAKKK

SEQ ID NO: 127457 - protein, 8 aa, West Nile virus
SSAAKKKG

SEQ ID NO: 127458 - protein, 8 aa, West Nile virus
SAAKKKGA

SEQ ID NO: 127459 - protein, 8 aa, West Nile virus
AAKKKGAC

SEQ ID NO: 127460 - protein, 8 aa, West Nile virus
AKKKGACL

SEQ ID NO: 127461 - protein, 8 aa, West Nile virus
KKKGACLI

SEQ ID NO: 127462 - protein, 8 aa, West Nile virus
KKGACLIC

SEQ ID NO: 127463 - protein, 8 aa, West Nile virus
KGACLICL

SEQ ID NO: 127464 - protein, 8 aa, West Nile virus
GACLICLA

SEQ ID NO: 127465 - protein, 8 aa, West Nile virus
ACLICLAL

SEQ ID NO: 127466 - protein, 8 aa, West Nile virus
CLICLALA

SEQ ID NO: 127467 - protein, 8 aa, West Nile virus
LICLALAS

SEQ ID NO: 127468 - protein, 8 aa, West Nile virus
ICLALAST

SEQ ID NO: 127469 - protein, 8 aa, West Nile virus
FNPLILVA

SEQ ID NO: 127470 - protein, 8 aa, West Nile virus
NPLILVAG

SEQ ID NO: 127471 - protein, 8 aa, West Nile virus
PLILVAGL

SEQ ID NO: 127472 - protein, 8 aa, West Nile virus
MILAAGLM

SEQ ID NO: 127473 - protein, 8 aa, West Nile virus
LAAGLITC

SEQ ID NO: 127474 - protein, 8 aa, West Nile virus
AAGLITCD

SEQ ID NO: 127475 - protein, 8 aa, West Nile virus
AGLITCDP

SEQ ID NO: 127476 - protein, 8 aa, West Nile virus
GLITCDPN

SEQ ID NO: 127477 - protein, 8 aa, West Nile virus
LITCDPNR

SEQ ID NO: 127478 - protein, 8 aa, West Nile virus
ITCDPNRK

SEQ ID NO: 127479 - protein, 8 aa, West Nile virus
TCDPNRKR

SEQ ID NO: 127480 - protein, 8 aa, West Nile virus
GGLAELDV

SEQ ID NO: 127481 - protein, 8 aa, West Nile virus
GLAELDMD

SEQ ID NO: 127482 - protein, 8 aa, West Nile virus
LAELDMDS

SEQ ID NO: 127483 - protein, 8 aa, West Nile virus
AELDVDSM

SEQ ID NO: 127484 - protein, 8 aa, West Nile virus
ELDMDSMA

SEQ ID NO: 127485 - protein, 8 aa, West Nile virus
LDVDSMAI

SEQ ID NO: 127486 - protein, 8 aa, West Nile virus
DVDSMAIP

SEQ ID NO: 127487 - protein, 8 aa, West Nile virus
IDSMAVPM

SEQ ID NO: 127488 - protein, 8 aa, West Nile virus
DTMAIPMT

SEQ ID NO: 127489 - protein, 8 aa, West Nile virus
TMAIPMTI

SEQ ID NO: 127490 - protein, 8 aa, West Nile virus
TIAGLMFV

SEQ ID NO: 127491 - protein, 8 aa, West Nile virus
IAGLMFVA

SEQ ID NO: 127492 - protein, 8 aa, West Nile virus
AGLMFVAF

SEQ ID NO: 127493 - protein, 8 aa, West Nile virus
GLMFVAFV

SEQ ID NO: 127494 - protein, 8 aa, West Nile virus
LMFVAFVI

SEQ ID NO: 127495 - protein, 8 aa, West Nile virus
MFVAFVIS

SEQ ID NO: 127496 - protein, 8 aa, West Nile virus
FVAFVISG

SEQ ID NO: 127497 - protein, 8 aa, West Nile virus
VAFVISGK

SEQ ID NO: 127498 - protein, 8 aa, West Nile virus
AYVITGRS

SEQ ID NO: 127499 - protein, 8 aa, West Nile virus
YVITGRST

SEQ ID NO: 127500 - protein, 8 aa, West Nile virus
VITGRSTD

SEQ ID NO: 127501 - protein, 8 aa, West Nile virus
ITGRSTDM

SEQ ID NO: 127502 - protein, 8 aa, West Nile virus
TGRSTDMW

SEQ ID NO: 127503 - protein, 8 aa, West Nile virus
GRSTDMWI

SEQ ID NO: 127504 - protein, 8 aa, West Nile virus
RSTDMWIE

SEQ ID NO: 127505 - protein, 8 aa, West Nile virus
MWIERTAN

SEQ ID NO: 127506 - protein, 8 aa, West Nile virus
WIERVADI

SEQ ID NO: 127507 - protein, 8 aa, West Nile virus
IERTADIT

SEQ ID NO: 127508 - protein, 8 aa, West Nile virus
ERTADITW

SEQ ID NO: 127509 - protein, 8 aa, West Nile virus
RTADITWE

SEQ ID NO: 127510 - protein, 8 aa, West Nile virus
TADITWES

SEQ ID NO: 127511 - protein, 8 aa, West Nile virus
ADITWESD

SEQ ID NO: 127512 - protein, 8 aa, West Nile virus
DITWESDA

SEQ ID NO: 127513 - protein, 8 aa, West Nile virus
ITWESDAE

SEQ ID NO: 127514 - protein, 8 aa, West Nile virus
TWESDAEI

SEQ ID NO: 127515 - protein, 8 aa, West Nile virus
WEGDAEIT

SEQ ID NO: 127516 - protein, 8 aa, West Nile virus
EGDAEITG

SEQ ID NO: 127517 - protein, 8 aa, West Nile virus
SDAEITGT

SEQ ID NO: 127518 - protein, 8 aa, West Nile virus
DAEITGTS

SEQ ID NO: 127519 - protein, 8 aa, West Nile virus
AEITGTSD

SEQ ID NO: 127520 - protein, 8 aa, West Nile virus
EITGTSDR

SEQ ID NO: 127521 - protein, 8 aa, West Nile virus
ITGTSDRV

SEQ ID NO: 127522 - protein, 8 aa, West Nile virus
TGTSDRVD

SEQ ID NO: 127523 - protein, 8 aa, West Nile virus
GTSDRVDV

SEQ ID NO: 127524 - protein, 8 aa, West Nile virus
TSDRVDVK

SEQ ID NO: 127525 - protein, 8 aa, West Nile virus
SDRVDVKL

SEQ ID NO: 127526 - protein, 8 aa, West Nile virus
DRVDVKLD

SEQ ID NO: 127527 - protein, 8 aa, West Nile virus
RVDVKLDD

SEQ ID NO: 127528 - protein, 8 aa, West Nile virus
VDVKLDDD

SEQ ID NO: 127529 - protein, 8 aa, West Nile virus
DVKLDDDG

SEQ ID NO: 127530 - protein, 8 aa, West Nile virus
VKLDDDGN

SEQ ID NO: 127531 - protein, 8 aa, West Nile virus
KLDDDGNF

SEQ ID NO: 127532 - protein, 8 aa, West Nile virus
LDDDGDFQ

SEQ ID NO: 127533 - protein, 8 aa, West Nile virus
DDDGDFQL

SEQ ID NO: 127534 - protein, 8 aa, West Nile virus
DDGNFQLI

SEQ ID NO: 127535 - protein, 8 aa, West Nile virus
DGNFQLIN

SEQ ID NO: 127536 - protein, 8 aa, West Nile virus
GNFQLIND

SEQ ID NO: 127537 - protein, 8 aa, West Nile virus
NFQLINDP

SEQ ID NO: 127538 - protein, 8 aa, West Nile virus
FQLINDPG

SEQ ID NO: 127539 - protein, 8 aa, West Nile virus
QLINDPGA

SEQ ID NO: 127540 - protein, 8 aa, West Nile virus
LINDPGAP

SEQ ID NO: 127541 - protein, 8 aa, West Nile virus
INDPGAPW

SEQ ID NO: 127542 - protein, 8 aa, West Nile virus
GAPWKIWI

SEQ ID NO: 127543 - protein, 8 aa, West Nile virus
APWKIWIL

SEQ ID NO: 127544 - protein, 8 aa, West Nile virus
PWKIWILR

SEQ ID NO: 127545 - protein, 8 aa, West Nile virus
WKIWILRM

SEQ ID NO: 127546 - protein, 8 aa, West Nile virus
WMLRMACL

SEQ ID NO: 127547 - protein, 8 aa, West Nile virus
MLRMACLA

SEQ ID NO: 127548 - protein, 8 aa, West Nile virus
MACLAISA

SEQ ID NO: 127549 - protein, 8 aa, West Nile virus
ACLAISAY

SEQ ID NO: 127550 - protein, 8 aa, West Nile virus
CLAVSAYT

SEQ ID NO: 127551 - protein, 8 aa, West Nile virus
LAVSAYTP

SEQ ID NO: 127552 - protein, 8 aa, West Nile virus
AVSAYTPW

SEQ ID NO: 127553 - protein, 8 aa, West Nile virus
VSAYTPWA

SEQ ID NO: 127554 - protein, 8 aa, West Nile virus
PWAVLPSV

SEQ ID NO: 127555 - protein, 8 aa, West Nile virus
WAILPSVI

SEQ ID NO: 127556 - protein, 8 aa, West Nile virus
AILPSVIG

SEQ ID NO: 127557 - protein, 8 aa, West Nile virus
ILPSVIGF

SEQ ID NO: 127558 - protein, 8 aa, West Nile virus
LPSVIGFW

SEQ ID NO: 127559 - protein, 8 aa, West Nile virus
PSVIGFWI

SEQ ID NO: 127560 - protein, 8 aa, West Nile virus
SVIGFWIT

SEQ ID NO: 127561 - protein, 8 aa, West Nile virus
VIGFWITL

SEQ ID NO: 127562 - protein, 8 aa, West Nile virus
IGFWITLQ

SEQ ID NO: 127563 - protein, 8 aa, West Nile virus
LWDTPSPR

SEQ ID NO: 127564 - protein, 8 aa, West Nile virus
WDTPSPRE

SEQ ID NO: 127565 - protein, 8 aa, West Nile virus
DTPSPREY

SEQ ID NO: 127566 - protein, 8 aa, West Nile virus
TPSPREYK

SEQ ID NO: 127567 - protein, 8 aa, West Nile virus
EYKRGDTT

SEQ ID NO: 127568 - protein, 8 aa, West Nile virus
YKRGDTTT

SEQ ID NO: 127569 - protein, 8 aa, West Nile virus
KRGDTTTG

SEQ ID NO: 127570 - protein, 8 aa, West Nile virus
RGDTTTGV

SEQ ID NO: 127571 - protein, 8 aa, West Nile virus
YRIMTRGI

SEQ ID NO: 127572 - protein, 8 aa, West Nile virus
RIMTRGIL

SEQ ID NO: 127573 - protein, 8 aa, West Nile virus
IMTRGILG

SEQ ID NO: 127574 - protein, 8 aa, West Nile virus
MTRGILGS

SEQ ID NO: 127575 - protein, 8 aa, West Nile virus
TRGILGSY

SEQ ID NO: 127576 - protein, 8 aa, West Nile virus
RGILGSYQ

SEQ ID NO: 127577 - protein, 8 aa, West Nile virus
GILGSYQA

SEQ ID NO: 127578 - protein, 8 aa, West Nile virus
ILGSYQAG

SEQ ID NO: 127579 - protein, 8 aa, West Nile virus
LGSYQAGV

SEQ ID NO: 127580 - protein, 8 aa, West Nile virus
GSYQAGVG

SEQ ID NO: 127581 - protein, 8 aa, West Nile virus
SYQAGVGV

SEQ ID NO: 127582 - protein, 8 aa, West Nile virus
YQAGVGVM

SEQ ID NO: 127583 - protein, 8 aa, West Nile virus
QAGVGVMV

SEQ ID NO: 127584 - protein, 8 aa, West Nile virus
AGVGVMVE

SEQ ID NO: 127585 - protein, 8 aa, West Nile virus
GVGVMVEG

SEQ ID NO: 127586 - protein, 8 aa, West Nile virus
VGVMVEGV

SEQ ID NO: 127587 - protein, 8 aa, West Nile virus
GAALMSGT

SEQ ID NO: 127588 - protein, 8 aa, West Nile virus
AALMSGTG

SEQ ID NO: 127589 - protein, 8 aa, West Nile virus
ALMSGTGR

SEQ ID NO: 127590 - protein, 8 aa, West Nile virus
LMSGTGRL

SEQ ID NO: 127591 - protein, 8 aa, West Nile virus
MSGTGRLD

SEQ ID NO: 127592 - protein, 8 aa, West Nile virus
SGTGRLDP

SEQ ID NO: 127593 - protein, 8 aa, West Nile virus
GTGRLDPY

SEQ ID NO: 127594 - protein, 8 aa, West Nile virus
TGRLDPYW

SEQ ID NO: 127595 - protein, 8 aa, West Nile virus
DPYWGSVR

SEQ ID NO: 127596 - protein, 8 aa, West Nile virus
PYWGSVRE

SEQ ID NO: 127597 - protein, 8 aa, West Nile virus
YWGSVRED

SEQ ID NO: 127598 - protein, 8 aa, West Nile virus
WGSVREDR

SEQ ID NO: 127599 - protein, 8 aa, West Nile virus
GSVREDRL

SEQ ID NO: 127600 - protein, 8 aa, West Nile virus
SVREDRLC

SEQ ID NO: 127601 - protein, 8 aa, West Nile virus
VREDRLCY

SEQ ID NO: 127602 - protein, 8 aa, West Nile virus
REDRLCYG

SEQ ID NO: 127603 - protein, 8 aa, West Nile virus
GGPWKLQR

SEQ ID NO: 127604 - protein, 8 aa, West Nile virus
GPWKLQRK

SEQ ID NO: 127605 - protein, 8 aa, West Nile virus
PWKLQRKW

SEQ ID NO: 127606 - protein, 8 aa, West Nile virus
WKLQRKWN

SEQ ID NO: 127607 - protein, 8 aa, West Nile virus
KLQRKWNG

SEQ ID NO: 127608 - protein, 8 aa, West Nile virus
LQHKWNGH

SEQ ID NO: 127609 - protein, 8 aa, West Nile virus
QHKWNGHD

SEQ ID NO: 127610 - protein, 8 aa, West Nile virus
HKWNGHDE

SEQ ID NO: 127611 - protein, 8 aa, West Nile virus
KWNGHDEV

SEQ ID NO: 127612 - protein, 8 aa, West Nile virus
WNGHDEVQ

SEQ ID NO: 127613 - protein, 8 aa, West Nile virus
NGHDEVQM

SEQ ID NO: 127614 - protein, 8 aa, West Nile virus
GHDEVQMI

SEQ ID NO: 127615 - protein, 8 aa, West Nile virus
HDEVQMIV

SEQ ID NO: 127616 - protein, 8 aa, West Nile virus
DEVQMIVA

SEQ ID NO: 127617 - protein, 8 aa, West Nile virus
EVQMIVAE

SEQ ID NO: 127618 - protein, 8 aa, West Nile virus
VQMIVAEP

SEQ ID NO: 127619 - protein, 8 aa, West Nile virus
QMIVAEPG

SEQ ID NO: 127620 - protein, 8 aa, West Nile virus
MIVAEPGR

SEQ ID NO: 127621 - protein, 8 aa, West Nile virus
IVAEPGRN

SEQ ID NO: 127622 - protein, 8 aa, West Nile virus
VAEPGRNT

SEQ ID NO: 127623 - protein, 8 aa, West Nile virus
AEPGRNTR

SEQ ID NO: 127624 - protein, 8 aa, West Nile virus
EPGRNTRN

SEQ ID NO: 127625 - protein, 8 aa, West Nile virus
PGRNTRNV

SEQ ID NO: 127626 - protein, 8 aa, West Nile virus
GRNTRNVQ

SEQ ID NO: 127627 - protein, 8 aa, West Nile virus
RNTRNVQT

SEQ ID NO: 127628 - protein, 8 aa, West Nile virus
NTRNVQTK

SEQ ID NO: 127629 - protein, 8 aa, West Nile virus
TRNVQTKP

SEQ ID NO: 127630 - protein, 8 aa, West Nile virus
RNVQTKPG

SEQ ID NO: 127631 - protein, 8 aa, West Nile virus
PGVFKTPD

SEQ ID NO: 127632 - protein, 8 aa, West Nile virus
GVFKTPDG

SEQ ID NO: 127633 - protein, 8 aa, West Nile virus
VFKTPDGE

SEQ ID NO: 127634 - protein, 8 aa, West Nile virus
FKTPDGEI

SEQ ID NO: 127635 - protein, 8 aa, West Nile virus
KTPDGEIG

SEQ ID NO: 127636 - protein, 8 aa, West Nile virus
TPDGEIGA

SEQ ID NO: 127637 - protein, 8 aa, West Nile virus
PDGEIGAV

SEQ ID NO: 127638 - protein, 8 aa, West Nile virus
DGEIGAVT

SEQ ID NO: 127639 - protein, 8 aa, West Nile virus
IGAVTLDY

SEQ ID NO: 127640 - protein, 8 aa, West Nile virus
GAVTLDYP

SEQ ID NO: 127641 - protein, 8 aa, West Nile virus
AVTLDYPT

SEQ ID NO: 127642 - protein, 8 aa, West Nile virus
VTLDYPTG

SEQ ID NO: 127643 - protein, 8 aa, West Nile virus
TLDYPTGT

SEQ ID NO: 127644 - protein, 8 aa, West Nile virus
LDYPTGTS

SEQ ID NO: 127645 - protein, 8 aa, West Nile virus
DYPTGTSG

SEQ ID NO: 127646 - protein, 8 aa, West Nile virus
YPTGTSGS

SEQ ID NO: 127647 - protein, 8 aa, West Nile virus
SGSPIVDR

SEQ ID NO: 127648 - protein, 8 aa, West Nile virus
GSPIVDRN

SEQ ID NO: 127649 - protein, 8 aa, West Nile virus
SPIVDRNG

SEQ ID NO: 127650 - protein, 8 aa, West Nile virus
PIVDRNGD

SEQ ID NO: 127651 - protein, 8 aa, West Nile virus
IVDRNGDV

SEQ ID NO: 127652 - protein, 8 aa, West Nile virus
VDRNGDVI

SEQ ID NO: 127653 - protein, 8 aa, West Nile virus
DRNGDVIG

SEQ ID NO: 127654 - protein, 8 aa, West Nile virus
RNGDVIGL

SEQ ID NO: 127655 - protein, 8 aa, West Nile virus
SGDVIGLY

SEQ ID NO: 127656 - protein, 8 aa, West Nile virus
GNGVIMPS

SEQ ID NO: 127657 - protein, 8 aa, West Nile virus
NGVIMPSG

SEQ ID NO: 127658 - protein, 8 aa, West Nile virus
GVIMPNGA

SEQ ID NO: 127659 - protein, 8 aa, West Nile virus
VIMPNGAY

SEQ ID NO: 127660 - protein, 8 aa, West Nile virus
IMPNGAYI

SEQ ID NO: 127661 - protein, 8 aa, West Nile virus
MPNGAYIS

SEQ ID NO: 127662 - protein, 8 aa, West Nile virus
PNGAYISA

SEQ ID NO: 127663 - protein, 8 aa, West Nile virus
NGAYISAI

SEQ ID NO: 127664 - protein, 8 aa, West Nile virus
GAYISAIV

SEQ ID NO: 127665 - protein, 8 aa, West Nile virus
AYISAIVQ

SEQ ID NO: 127666 - protein, 8 aa, West Nile virus
IVQGERME

SEQ ID NO: 127667 - protein, 8 aa, West Nile virus
VQGERMEE

SEQ ID NO: 127668 - protein, 8 aa, West Nile virus
QGERMEEP

SEQ ID NO: 127669 - protein, 8 aa, West Nile virus
GERMEEPA

SEQ ID NO: 127670 - protein, 8 aa, West Nile virus
ERMEEPAP

SEQ ID NO: 127671 - protein, 8 aa, West Nile virus
RMEEPAPA

SEQ ID NO: 127672 - protein, 8 aa, West Nile virus
MEEPAPAG

SEQ ID NO: 127673 - protein, 8 aa, West Nile virus
EEPAPAGF

SEQ ID NO: 127674 - protein, 8 aa, West Nile virus
GFEPDMLR

SEQ ID NO: 127675 - protein, 8 aa, West Nile virus
FEPDMLRK

SEQ ID NO: 127676 - protein, 8 aa, West Nile virus
EPDMLRKK

SEQ ID NO: 127677 - protein, 8 aa, West Nile virus
PDMLRKKQ

SEQ ID NO: 127678 - protein, 8 aa, West Nile virus
DMLRKKQI

SEQ ID NO: 127679 - protein, 8 aa, West Nile virus
TLKKKQIT

SEQ ID NO: 127680 - protein, 8 aa, West Nile virus
LKKKQITV

SEQ ID NO: 127681 - protein, 8 aa, West Nile virus
RKKQISVL

SEQ ID NO: 127682 - protein, 8 aa, West Nile virus
KKKITVLD

SEQ ID NO: 127683 - protein, 8 aa, West Nile virus
KQISVLDL

SEQ ID NO: 127684 - protein, 8 aa, West Nile virus
QISVLDLH

SEQ ID NO: 127685 - protein, 8 aa, West Nile virus
SVLDLHPG

SEQ ID NO: 127686 - protein, 8 aa, West Nile virus
PGAGKTRK

SEQ ID NO: 127687 - protein, 8 aa, West Nile virus
GAGKTRKI

SEQ ID NO: 127688 - protein, 8 aa, West Nile virus
AGKTRKIL

SEQ ID NO: 127689 - protein, 8 aa, West Nile virus
GKTRKILP

SEQ ID NO: 127690 - protein, 8 aa, West Nile virus
KTRKILPQ

SEQ ID NO: 127691 - protein, 8 aa, West Nile virus
TRKILPQI

SEQ ID NO: 127692 - protein, 8 aa, West Nile virus
RKILPQII

SEQ ID NO: 127693 - protein, 8 aa, West Nile virus
KILPQIIK

SEQ ID NO: 127694 - protein, 8 aa, West Nile virus
ILPQIIRE

SEQ ID NO: 127695 - protein, 8 aa, West Nile virus
LPQIIREA

SEQ ID NO: 127696 - protein, 8 aa, West Nile virus
PQIIREAI

SEQ ID NO: 127697 - protein, 8 aa, West Nile virus
QIIREAIN

SEQ ID NO: 127698 - protein, 8 aa, West Nile virus
IIKEAINK

SEQ ID NO: 127699 - protein, 8 aa, West Nile virus
IKEAINKR

SEQ ID NO: 127700 - protein, 8 aa, West Nile virus
KEAINKRL

SEQ ID NO: 127701 - protein, 8 aa, West Nile virus
EAINKRLR

SEQ ID NO: 127702 - protein, 8 aa, West Nile virus
AINKRLRT

SEQ ID NO: 127703 - protein, 8 aa, West Nile virus
INKRLRTA

SEQ ID NO: 127704 - protein, 8 aa, West Nile virus
NKRLRTAV

SEQ ID NO: 127705 - protein, 8 aa, West Nile virus
KRLRTAVL

SEQ ID NO: 127706 - protein, 8 aa, West Nile virus
RLRTAILA

SEQ ID NO: 127707 - protein, 8 aa, West Nile virus
LRTAILAP

SEQ ID NO: 127708 - protein, 8 aa, West Nile virus
RTAILAPT

SEQ ID NO: 127709 - protein, 8 aa, West Nile virus
TAILAPTR

SEQ ID NO: 127710 - protein, 8 aa, West Nile virus
AILAPTRV

SEQ ID NO: 127711 - protein, 8 aa, West Nile virus
ILAPTRVV

SEQ ID NO: 127712 - protein, 8 aa, West Nile virus
APTRVVAS

SEQ ID NO: 127713 - protein, 8 aa, West Nile virus
PTRVVASE

SEQ ID NO: 127714 - protein, 8 aa, West Nile virus
TRVVASEM

SEQ ID NO: 127715 - protein, 8 aa, West Nile virus
RVVAAEMS

SEQ ID NO: 127716 - protein, 8 aa, West Nile virus
VVAAEMSE

SEQ ID NO: 127717 - protein, 8 aa, West Nile virus
VAAEMSEA

SEQ ID NO: 127718 - protein, 8 aa, West Nile virus
AAEMSEAL

SEQ ID NO: 127719 - protein, 8 aa, West Nile virus
AEMSEALR

SEQ ID NO: 127720 - protein, 8 aa, West Nile virus
EMSEALRG

SEQ ID NO: 127721 - protein, 8 aa, West Nile virus
MSEALRGL

SEQ ID NO: 127722 - protein, 8 aa, West Nile virus
SEALRGLP

SEQ ID NO: 127723 - protein, 8 aa, West Nile virus
RYQTSAVH

SEQ ID NO: 127724 - protein, 8 aa, West Nile virus
YQTSAVHR

SEQ ID NO: 127725 - protein, 8 aa, West Nile virus
QTSAVHRE

SEQ ID NO: 127726 - protein, 8 aa, West Nile virus
TSAVTREH

SEQ ID NO: 127727 - protein, 8 aa, West Nile virus
REHSGNEI

SEQ ID NO: 127728 - protein, 8 aa, West Nile virus
EHSGNEIV

SEQ ID NO: 127729 - protein, 8 aa, West Nile virus
HSGNEIVD

SEQ ID NO: 127730 - protein, 8 aa, West Nile virus
SGNEIVDV

SEQ ID NO: 127731 - protein, 8 aa, West Nile virus
VPNYNLFI

SEQ ID NO: 127732 - protein, 8 aa, West Nile virus
PNYNLFIM

SEQ ID NO: 127733 - protein, 8 aa, West Nile virus
NYNLFIMD

SEQ ID NO: 127734 - protein, 8 aa, West Nile virus
YNLFIMDE

SEQ ID NO: 127735 - protein, 8 aa, West Nile virus
NLFIMDEA

SEQ ID NO: 127736 - protein, 8 aa, West Nile virus
LFIMDEAH

SEQ ID NO: 127737 - protein, 8 aa, West Nile virus
FIMDEAHF

SEQ ID NO: 127738 - protein, 8 aa, West Nile virus
IMDEAHFT

SEQ ID NO: 127739 - protein, 8 aa, West Nile virus
IAARGYIA

SEQ ID NO: 127740 - protein, 8 aa, West Nile virus
AARGYIAT

SEQ ID NO: 127741 - protein, 8 aa, West Nile virus
ARGYIATK

SEQ ID NO: 127742 - protein, 8 aa, West Nile virus
RGYIATKV

SEQ ID NO: 127743 - protein, 8 aa, West Nile virus
GYIATKVE

SEQ ID NO: 127744 - protein, 8 aa, West Nile virus
YIATKVEL

SEQ ID NO: 127745 - protein, 8 aa, West Nile virus
IATKVELG

SEQ ID NO: 127746 - protein, 8 aa, West Nile virus
ATKVELGE

SEQ ID NO: 127747 - protein, 8 aa, West Nile virus
TRVELGEA

SEQ ID NO: 127748 - protein, 8 aa, West Nile virus
RVELGEAA

SEQ ID NO: 127749 - protein, 8 aa, West Nile virus
TATPPGSS

SEQ ID NO: 127750 - protein, 8 aa, West Nile virus
ATPPGTHD

SEQ ID NO: 127751 - protein, 8 aa, West Nile virus
TPPGTHDP

SEQ ID NO: 127752 - protein, 8 aa, West Nile virus
PPGSSDPF

SEQ ID NO: 127753 - protein, 8 aa, West Nile virus
PGTHDPFP

SEQ ID NO: 127754 - protein, 8 aa, West Nile virus
GTSDPFPK

SEQ ID NO: 127755 - protein, 8 aa, West Nile virus
SSDPFPES

SEQ ID NO: 127756 - protein, 8 aa, West Nile virus
SDPFPKSN

SEQ ID NO: 127757 - protein, 8 aa, West Nile virus
DPFPESNA

SEQ ID NO: 127758 - protein, 8 aa, West Nile virus
PFPESNAP

SEQ ID NO: 127759 - protein, 8 aa, West Nile virus
FPESNAPI

SEQ ID NO: 127760 - protein, 8 aa, West Nile virus
DMQTEIPD

SEQ ID NO: 127761 - protein, 8 aa, West Nile virus
MQTEIPDR

SEQ ID NO: 127762 - protein, 8 aa, West Nile virus
IPDRAWNT

SEQ ID NO: 127763 - protein, 8 aa, West Nile virus
PDRAWNTG

SEQ ID NO: 127764 - protein, 8 aa, West Nile virus
DRAWNTGY

SEQ ID NO: 127765 - protein, 8 aa, West Nile virus
RAWNTGYE

SEQ ID NO: 127766 - protein, 8 aa, West Nile virus
AWNTGYEW

SEQ ID NO: 127767 - protein, 8 aa, West Nile virus
WNTGYEWI

SEQ ID NO: 127768 - protein, 8 aa, West Nile virus
NTGYEWIT

SEQ ID NO: 127769 - protein, 8 aa, West Nile virus
TGYEWITE

SEQ ID NO: 127770 - protein, 8 aa, West Nile virus
YEWITEYI

SEQ ID NO: 127771 - protein, 8 aa, West Nile virus
EWITEYIG

SEQ ID NO: 127772 - protein, 8 aa, West Nile virus
WITEYIGK

SEQ ID NO: 127773 - protein, 8 aa, West Nile virus
ITEYIGKT

SEQ ID NO: 127774 - protein, 8 aa, West Nile virus
TEYIGKTV

SEQ ID NO: 127775 - protein, 8 aa, West Nile virus
EYIGKTVW

SEQ ID NO: 127776 - protein, 8 aa, West Nile virus
YIGKTVWF

SEQ ID NO: 127777 - protein, 8 aa, West Nile virus
IGKTVWFV

SEQ ID NO: 127778 - protein, 8 aa, West Nile virus
VWFVPSVR

SEQ ID NO: 127779 - protein, 8 aa, West Nile virus
WFVPSVRM

SEQ ID NO: 127780 - protein, 8 aa, West Nile virus
FVPSVRMG

SEQ ID NO: 127781 - protein, 8 aa, West Nile virus
VPSVRMGN

SEQ ID NO: 127782 - protein, 8 aa, West Nile virus
PSVRMGNE

SEQ ID NO: 127783 - protein, 8 aa, West Nile virus
SVRMGNEM

SEQ ID NO: 127784 - protein, 8 aa, West Nile virus
VRMGNEMA

SEQ ID NO: 127785 - protein, 8 aa, West Nile virus
RMGNEMAQ

SEQ ID NO: 127786 - protein, 8 aa, West Nile virus
MGNEMAQC

SEQ ID NO: 127787 - protein, 8 aa, West Nile virus
GNEMAQCL

SEQ ID NO: 127788 - protein, 8 aa, West Nile virus
NEMAQCLQ

SEQ ID NO: 127789 - protein, 8 aa, West Nile virus
EMAQCLQR

SEQ ID NO: 127790 - protein, 8 aa, West Nile virus
MAQCLQRA

SEQ ID NO: 127791 - protein, 8 aa, West Nile virus
AQCLQRAG

SEQ ID NO: 127792 - protein, 8 aa, West Nile virus
QCLQRAGK

SEQ ID NO: 127793 - protein, 8 aa, West Nile virus
CLQRAGKR

SEQ ID NO: 127794 - protein, 8 aa, West Nile virus
LQRAGKRV

SEQ ID NO: 127795 - protein, 8 aa, West Nile virus
QRAGKKVI

SEQ ID NO: 127796 - protein, 8 aa, West Nile virus
RAGKKVIQ

SEQ ID NO: 127797 - protein, 8 aa, West Nile virus
AGKKVIQL

SEQ ID NO: 127798 - protein, 8 aa, West Nile virus
GKKVIQLN

SEQ ID NO: 127799 - protein, 8 aa, West Nile virus
KKVIQLNR

SEQ ID NO: 127800 - protein, 8 aa, West Nile virus
KVIQLNRK

SEQ ID NO: 127801 - protein, 8 aa, West Nile virus
VIQLNRKS

SEQ ID NO: 127802 - protein, 8 aa, West Nile virus
IQLNRKSY

SEQ ID NO: 127803 - protein, 8 aa, West Nile virus
NDDWDFVV

SEQ ID NO: 127804 - protein, 8 aa, West Nile virus
DDWDFVVT

SEQ ID NO: 127805 - protein, 8 aa, West Nile virus
DWDFVVTT

SEQ ID NO: 127806 - protein, 8 aa, West Nile virus
WDFVVTTD

SEQ ID NO: 127807 - protein, 8 aa, West Nile virus
DFVVTTDI

SEQ ID NO: 127808 - protein, 8 aa, West Nile virus
FVVTTDIS

SEQ ID NO: 127809 - protein, 8 aa, West Nile virus
VVTTDISE

SEQ ID NO: 127810 - protein, 8 aa, West Nile virus
VTTDISEM

SEQ ID NO: 127811 - protein, 8 aa, West Nile virus
SEMGANFR

SEQ ID NO: 127812 - protein, 8 aa, West Nile virus
EMGANFRA

SEQ ID NO: 127813 - protein, 8 aa, West Nile virus
MGANFRAS

SEQ ID NO: 127814 - protein, 8 aa, West Nile virus
GANFKANR

SEQ ID NO: 127815 - protein, 8 aa, West Nile virus
ANFKANRV

SEQ ID NO: 127816 - protein, 8 aa, West Nile virus
NFKANRVI

SEQ ID NO: 127817 - protein, 8 aa, West Nile virus
FRASRVID

SEQ ID NO: 127818 - protein, 8 aa, West Nile virus
KANRVIDS

SEQ ID NO: 127819 - protein, 8 aa, West Nile virus
ANRVIDSR

SEQ ID NO: 127820 - protein, 8 aa, West Nile virus
NRVIDSRK

SEQ ID NO: 127821 - protein, 8 aa, West Nile virus
RKSVKPTS

SEQ ID NO: 127822 - protein, 8 aa, West Nile virus
KSVKPIII

SEQ ID NO: 127823 - protein, 8 aa, West Nile virus
SVKPTIIE

SEQ ID NO: 127824 - protein, 8 aa, West Nile virus
VKPTIIEE

SEQ ID NO: 127825 - protein, 8 aa, West Nile virus
KPTIIEEG

SEQ ID NO: 127826 - protein, 8 aa, West Nile virus
PTIIEEGD

SEQ ID NO: 127827 - protein, 8 aa, West Nile virus
IEEGDGRV

SEQ ID NO: 127828 - protein, 8 aa, West Nile virus
EEGDGRVI

SEQ ID NO: 127829 - protein, 8 aa, West Nile virus
EGDGRVIL

SEQ ID NO: 127830 - protein, 8 aa, West Nile virus
GDGRVILG

SEQ ID NO: 127831 - protein, 8 aa, West Nile virus
DGRVILGE

SEQ ID NO: 127832 - protein, 8 aa, West Nile virus
NRVVLGEP

SEQ ID NO: 127833 - protein, 8 aa, West Nile virus
RVVLGEPS

SEQ ID NO: 127834 - protein, 8 aa, West Nile virus
VVLGEPSA

SEQ ID NO: 127835 - protein, 8 aa, West Nile virus
ILGEPSAI

SEQ ID NO: 127836 - protein, 8 aa, West Nile virus
LGEPSAIT

SEQ ID NO: 127837 - protein, 8 aa, West Nile virus
GEPSAITA

SEQ ID NO: 127838 - protein, 8 aa, West Nile virus
EPSAITAA

SEQ ID NO: 127839 - protein, 8 aa, West Nile virus
PSAITAAS

SEQ ID NO: 127840 - protein, 8 aa, West Nile virus
SAITAASA

SEQ ID NO: 127841 - protein, 8 aa, West Nile virus
AITAASAA

SEQ ID NO: 127842 - protein, 8 aa, West Nile virus
ITAASAAQ

SEQ ID NO: 127843 - protein, 8 aa, West Nile virus
AAQRRGRT

SEQ ID NO: 127844 - protein, 8 aa, West Nile virus
AQRRGRVG

SEQ ID NO: 127845 - protein, 8 aa, West Nile virus
QRRGRTGR

SEQ ID NO: 127846 - protein, 8 aa, West Nile virus
RRGRVGRN

SEQ ID NO: 127847 - protein, 8 aa, West Nile virus
RGRIGRNS

SEQ ID NO: 127848 - protein, 8 aa, West Nile virus
GRIGRNSS

SEQ ID NO: 127849 - protein, 8 aa, West Nile virus
RIGRNSSQ

SEQ ID NO: 127850 - protein, 8 aa, West Nile virus
IGRNSSQV

SEQ ID NO: 127851 - protein, 8 aa, West Nile virus
GRNSSQVG

SEQ ID NO: 127852 - protein, 8 aa, West Nile virus
RNSSQVGD

SEQ ID NO: 127853 - protein, 8 aa, West Nile virus
NSSQVGDE

SEQ ID NO: 127854 - protein, 8 aa, West Nile virus
SSQVGDEY

SEQ ID NO: 127855 - protein, 8 aa, West Nile virus
SQAGDEYC

SEQ ID NO: 127856 - protein, 8 aa, West Nile virus
TNEDDSNY

SEQ ID NO: 127857 - protein, 8 aa, West Nile virus
NEDDSNLA

SEQ ID NO: 127858 - protein, 8 aa, West Nile virus
EDDSNLAH

SEQ ID NO: 127859 - protein, 8 aa, West Nile virus
DDSNCAHW

SEQ ID NO: 127860 - protein, 8 aa, West Nile virus
DSNCAHWT

SEQ ID NO: 127861 - protein, 8 aa, West Nile virus
SNLAHWTE

SEQ ID NO: 127862 - protein, 8 aa, West Nile virus
NCAHWTEA

SEQ ID NO: 127863 - protein, 8 aa, West Nile virus
CAHWTEAR

SEQ ID NO: 127864 - protein, 8 aa, West Nile virus
LDNINMPS

SEQ ID NO: 127865 - protein, 8 aa, West Nile virus
INMPNGLV

SEQ ID NO: 127866 - protein, 8 aa, West Nile virus
NMPNGLVA

SEQ ID NO: 127867 - protein, 8 aa, West Nile virus
MPNGLVAQ

SEQ ID NO: 127868 - protein, 8 aa, West Nile virus
PNGLVAQL

SEQ ID NO: 127869 - protein, 8 aa, West Nile virus
NGLVAQLY

SEQ ID NO: 127870 - protein, 8 aa, West Nile virus
GLVAQLYQ

SEQ ID NO: 127871 - protein, 8 aa, West Nile virus
LVAQLYQP

SEQ ID NO: 127872 - protein, 8 aa, West Nile virus
VAQLYQPE

SEQ ID NO: 127873 - protein, 8 aa, West Nile virus
AQLYQPER

SEQ ID NO: 127874 - protein, 8 aa, West Nile virus
QLYQPERE

SEQ ID NO: 127875 - protein, 8 aa, West Nile virus
LYQPEREK

SEQ ID NO: 127876 - protein, 8 aa, West Nile virus
QPEREKVC

SEQ ID NO: 127877 - protein, 8 aa, West Nile virus
PEREKVCT

SEQ ID NO: 127878 - protein, 8 aa, West Nile virus
EREKVCTM

SEQ ID NO: 127879 - protein, 8 aa, West Nile virus
REKVCTMD

SEQ ID NO: 127880 - protein, 8 aa, West Nile virus
EKVYTMEG

SEQ ID NO: 127881 - protein, 8 aa, West Nile virus
KVHTMDGE

SEQ ID NO: 127882 - protein, 8 aa, West Nile virus
VYTMEGEY

SEQ ID NO: 127883 - protein, 8 aa, West Nile virus
YTMDGEYK

SEQ ID NO: 127884 - protein, 8 aa, West Nile virus
TMDGEYKL

SEQ ID NO: 127885 - protein, 8 aa, West Nile virus
MDGEYKLR

SEQ ID NO: 127886 - protein, 8 aa, West Nile virus
DGEYKLRG

SEQ ID NO: 127887 - protein, 8 aa, West Nile virus
GEYKLRGE

SEQ ID NO: 127888 - protein, 8 aa, West Nile virus
EYKLRGEE

SEQ ID NO: 127889 - protein, 8 aa, West Nile virus
YKLRGEER

SEQ ID NO: 127890 - protein, 8 aa, West Nile virus
KLRGEERK

SEQ ID NO: 127891 - protein, 8 aa, West Nile virus
ERKNFLEF

SEQ ID NO: 127892 - protein, 8 aa, West Nile virus
RKNFLEFL

SEQ ID NO: 127893 - protein, 8 aa, West Nile virus
KNFLEFLR

SEQ ID NO: 127894 - protein, 8 aa, West Nile virus
NFLEFLRT

SEQ ID NO: 127895 - protein, 8 aa, West Nile virus
FLEFLRTA

SEQ ID NO: 127896 - protein, 8 aa, West Nile virus
LEFLRTAD

SEQ ID NO: 127897 - protein, 8 aa, West Nile virus
EFLRTADL

SEQ ID NO: 127898 - protein, 8 aa, West Nile virus
FLRTADLP

SEQ ID NO: 127899 - protein, 8 aa, West Nile virus
LPVWLAYQ

SEQ ID NO: 127900 - protein, 8 aa, West Nile virus
PVWLAYQV

SEQ ID NO: 127901 - protein, 8 aa, West Nile virus
VWLAYQVA

SEQ ID NO: 127902 - protein, 8 aa, West Nile virus
WLAYQVAA

SEQ ID NO: 127903 - protein, 8 aa, West Nile virus
LAYQVAAA

SEQ ID NO: 127904 - protein, 8 aa, West Nile virus
AYQVAAAG

SEQ ID NO: 127905 - protein, 8 aa, West Nile virus
YKVAAAGI

SEQ ID NO: 127906 - protein, 8 aa, West Nile virus
KVAAAGIS

SEQ ID NO: 127907 - protein, 8 aa, West Nile virus
VAAAGISY

SEQ ID NO: 127908 - protein, 8 aa, West Nile virus
AAAGISYH

SEQ ID NO: 127909 - protein, 8 aa, West Nile virus
AAGISYHD

SEQ ID NO: 127910 - protein, 8 aa, West Nile virus
AGISYHDR

SEQ ID NO: 127911 - protein, 8 aa, West Nile virus
GISYHDRK

SEQ ID NO: 127912 - protein, 8 aa, West Nile virus
ISYHDRKW

SEQ ID NO: 127913 - protein, 8 aa, West Nile virus
SYHDRKWC

SEQ ID NO: 127914 - protein, 8 aa, West Nile virus
YHDRKWCF

SEQ ID NO: 127915 - protein, 8 aa, West Nile virus
HDRKWCFD

SEQ ID NO: 127916 - protein, 8 aa, West Nile virus
DRKWCFDG

SEQ ID NO: 127917 - protein, 8 aa, West Nile virus
RKWCFDGP

SEQ ID NO: 127918 - protein, 8 aa, West Nile virus
KWCFDGPR

SEQ ID NO: 127919 - protein, 8 aa, West Nile virus
DGPRTNTV

SEQ ID NO: 127920 - protein, 8 aa, West Nile virus
GPRTNTVL

SEQ ID NO: 127921 - protein, 8 aa, West Nile virus
PRTNTVLE

SEQ ID NO: 127922 - protein, 8 aa, West Nile virus
RTNTVLEE

SEQ ID NO: 127923 - protein, 8 aa, West Nile virus
TNTVLEEN

SEQ ID NO: 127924 - protein, 8 aa, West Nile virus
NTVLEENT

SEQ ID NO: 127925 - protein, 8 aa, West Nile virus
TVLEENTE

SEQ ID NO: 127926 - protein, 8 aa, West Nile virus
VLEENTEV

SEQ ID NO: 127927 - protein, 8 aa, West Nile virus
LEENTEVE

SEQ ID NO: 127928 - protein, 8 aa, West Nile virus
EENTEVEI

SEQ ID NO: 127929 - protein, 8 aa, West Nile virus
ENTEVEIV

SEQ ID NO: 127930 - protein, 8 aa, West Nile virus
NTEVEIVT

SEQ ID NO: 127931 - protein, 8 aa, West Nile virus
TEVEIVTK

SEQ ID NO: 127932 - protein, 8 aa, West Nile virus
EVEIVTKM

SEQ ID NO: 127933 - protein, 8 aa, West Nile virus
VEIVTKMG

SEQ ID NO: 127934 - protein, 8 aa, West Nile virus
EIVTKMGE

SEQ ID NO: 127935 - protein, 8 aa, West Nile virus
IVTKMGER

SEQ ID NO: 127936 - protein, 8 aa, West Nile virus
VTKMGERK

SEQ ID NO: 127937 - protein, 8 aa, West Nile virus
TKMGERKI

SEQ ID NO: 127938 - protein, 8 aa, West Nile virus
KMGERKIL

SEQ ID NO: 127939 - protein, 8 aa, West Nile virus
MGERKILR

SEQ ID NO: 127940 - protein, 8 aa, West Nile virus
KILRPRWA

SEQ ID NO: 127941 - protein, 8 aa, West Nile virus
ILRPRWAD

SEQ ID NO: 127942 - protein, 8 aa, West Nile virus
LRPRWADA

SEQ ID NO: 127943 - protein, 8 aa, West Nile virus
RPRWADAR

SEQ ID NO: 127944 - protein, 8 aa, West Nile virus
PRWADARV

SEQ ID NO: 127945 - protein, 8 aa, West Nile virus
RWADARVY

SEQ ID NO: 127946 - protein, 8 aa, West Nile virus
WADARVYS

SEQ ID NO: 127947 - protein, 8 aa, West Nile virus
ADARVYSD

SEQ ID NO: 127948 - protein, 8 aa, West Nile virus
SDHQALKS

SEQ ID NO: 127949 - protein, 8 aa, West Nile virus
DHQALKSF

SEQ ID NO: 127950 - protein, 8 aa, West Nile virus
HQALKSFK

SEQ ID NO: 127951 - protein, 8 aa, West Nile virus
QALKSFKD

SEQ ID NO: 127952 - protein, 8 aa, West Nile virus
ALKSFKDF

SEQ ID NO: 127953 - protein, 8 aa, West Nile virus
LKSFKDFA

SEQ ID NO: 127954 - protein, 8 aa, West Nile virus
KSFKDFAS

SEQ ID NO: 127955 - protein, 8 aa, West Nile virus
SFKDFASG

SEQ ID NO: 127956 - protein, 8 aa, West Nile virus
FKDFAAGR

SEQ ID NO: 127957 - protein, 8 aa, West Nile virus
KDFAAGRR

SEQ ID NO: 127958 - protein, 8 aa, West Nile virus
DFAAGRRS

SEQ ID NO: 127959 - protein, 8 aa, West Nile virus
FAAGRRSQ

SEQ ID NO: 127960 - protein, 8 aa, West Nile virus
AAGRRSQI

SEQ ID NO: 127961 - protein, 8 aa, West Nile virus
AGRRSQIG

SEQ ID NO: 127962 - protein, 8 aa, West Nile virus
GRRSQIGL

SEQ ID NO: 127963 - protein, 8 aa, West Nile virus
KRSQIGLV

SEQ ID NO: 127964 - protein, 8 aa, West Nile virus
RSQIGLVE

SEQ ID NO: 127965 - protein, 8 aa, West Nile virus
SQIGLVEV

SEQ ID NO: 127966 - protein, 8 aa, West Nile virus
QIGLVEVL

SEQ ID NO: 127967 - protein, 8 aa, West Nile virus
IGLVEVLG

SEQ ID NO: 127968 - protein, 8 aa, West Nile virus
GLVEVLGR

SEQ ID NO: 127969 - protein, 8 aa, West Nile virus
LVEVLGRM

SEQ ID NO: 127970 - protein, 8 aa, West Nile virus
VEVLGRMP

SEQ ID NO: 127971 - protein, 8 aa, West Nile virus
EVLGRMPE

SEQ ID NO: 127972 - protein, 8 aa, West Nile virus
VLGRMPEH

SEQ ID NO: 127973 - protein, 8 aa, West Nile virus
LGRMPEHF

SEQ ID NO: 127974 - protein, 8 aa, West Nile virus
GRMPEHFM

SEQ ID NO: 127975 - protein, 8 aa, West Nile virus
RMPEHFMG

SEQ ID NO: 127976 - protein, 8 aa, West Nile virus
MPEHFVGK

SEQ ID NO: 127977 - protein, 8 aa, West Nile virus
PEHFVGKT

SEQ ID NO: 127978 - protein, 8 aa, West Nile virus
EHFVGKTW

SEQ ID NO: 127979 - protein, 8 aa, West Nile virus
HFVGKTWE

SEQ ID NO: 127980 - protein, 8 aa, West Nile virus
FVGKTWEA

SEQ ID NO: 127981 - protein, 8 aa, West Nile virus
VGKTWEAL

SEQ ID NO: 127982 - protein, 8 aa, West Nile virus
VKTWEALD

SEQ ID NO: 127983 - protein, 8 aa, West Nile virus
YVVATAER

SEQ ID NO: 127984 - protein, 8 aa, West Nile virus
VVATAERG

SEQ ID NO: 127985 - protein, 8 aa, West Nile virus
VATAEKGR

SEQ ID NO: 127986 - protein, 8 aa, West Nile virus
ATAEKGRR

SEQ ID NO: 127987 - protein, 8 aa, West Nile virus
TAEKGRRA

SEQ ID NO: 127988 - protein, 8 aa, West Nile virus
AERGGRAH

SEQ ID NO: 127989 - protein, 8 aa, West Nile virus
EKGRRAHR

SEQ ID NO: 127990 - protein, 8 aa, West Nile virus
KGGRAHRT

SEQ ID NO: 127991 - protein, 8 aa, West Nile virus
GGRAHRTA

SEQ ID NO: 127992 - protein, 8 aa, West Nile virus
GRAHRTAL

SEQ ID NO: 127993 - protein, 8 aa, West Nile virus
RAHRTALE

SEQ ID NO: 127994 - protein, 8 aa, West Nile virus
AHRTALEE

SEQ ID NO: 127995 - protein, 8 aa, West Nile virus
HRTALEEL

SEQ ID NO: 127996 - protein, 8 aa, West Nile virus
RTALEELP

SEQ ID NO: 127997 - protein, 8 aa, West Nile virus
TALEELPD

SEQ ID NO: 127998 - protein, 8 aa, West Nile virus
PDALQTIV

SEQ ID NO: 127999 - protein, 8 aa, West Nile virus
DALQTIVL

SEQ ID NO: 128000 - protein, 8 aa, West Nile virus
ALQTIVLI

SEQ ID NO: 128001 - protein, 8 aa, West Nile virus
LQTIALIT

SEQ ID NO: 128002 - protein, 8 aa, West Nile virus
QTIALITL

SEQ ID NO: 128003 - protein, 8 aa, West Nile virus
TIALITLL

SEQ ID NO: 128004 - protein, 8 aa, West Nile virus
IALITLLS

SEQ ID NO: 128005 - protein, 8 aa, West Nile virus
ALITLLSV

SEQ ID NO: 128006 - protein, 8 aa, West Nile virus
LITLLSVM

SEQ ID NO: 128007 - protein, 8 aa, West Nile virus
ITLLSVMT

SEQ ID NO: 128008 - protein, 8 aa, West Nile virus
LLSVMSLG

SEQ ID NO: 128009 - protein, 8 aa, West Nile virus
LSVMSLGV

SEQ ID NO: 128010 - protein, 8 aa, West Nile virus
SVMSLGVF

SEQ ID NO: 128011 - protein, 8 aa, West Nile virus
VMSLGVFF

SEQ ID NO: 128012 - protein, 8 aa, West Nile virus
MSLGVFFL

SEQ ID NO: 128013 - protein, 8 aa, West Nile virus
SLGVFFLL

SEQ ID NO: 128014 - protein, 8 aa, West Nile virus
LGVFFLLM

SEQ ID NO: 128015 - protein, 8 aa, West Nile virus
GVFCLLMQ

SEQ ID NO: 128016 - protein, 8 aa, West Nile virus
VFCLLMQR

SEQ ID NO: 128017 - protein, 8 aa, West Nile virus
FCLLMQRK

SEQ ID NO: 128018 - protein, 8 aa, West Nile virus
CLLMQRKG

SEQ ID NO: 128019 - protein, 8 aa, West Nile virus
LLMQRKGV

SEQ ID NO: 128020 - protein, 8 aa, West Nile virus
LMQRKGVS

SEQ ID NO: 128021 - protein, 8 aa, West Nile virus
MQRKGVSK

SEQ ID NO: 128022 - protein, 8 aa, West Nile virus
QRKGVSKI

SEQ ID NO: 128023 - protein, 8 aa, West Nile virus
RKGVSKIG

SEQ ID NO: 128024 - protein, 8 aa, West Nile virus
KGVSKIGL

SEQ ID NO: 128025 - protein, 8 aa, West Nile virus
GVSKIGLA

SEQ ID NO: 128026 - protein, 8 aa, West Nile virus
VSKIGLAG

SEQ ID NO: 128027 - protein, 8 aa, West Nile virus
GKIGLGGT

SEQ ID NO: 128028 - protein, 8 aa, West Nile virus
LGAATFFC

SEQ ID NO: 128029 - protein, 8 aa, West Nile virus
GAATFFCW

SEQ ID NO: 128030 - protein, 8 aa, West Nile virus
AATFFCWM

SEQ ID NO: 128031 - protein, 8 aa, West Nile virus
ATLFCWMA

SEQ ID NO: 128032 - protein, 8 aa, West Nile virus
TFFCWMAD

SEQ ID NO: 128033 - protein, 8 aa, West Nile virus
LFCWMAEV

SEQ ID NO: 128034 - protein, 8 aa, West Nile virus
FCWMAEVS

SEQ ID NO: 128035 - protein, 8 aa, West Nile virus
CWMAEVSG

SEQ ID NO: 128036 - protein, 8 aa, West Nile virus
WMAEVSGT

SEQ ID NO: 128037 - protein, 8 aa, West Nile virus
MAEVSGTK

SEQ ID NO: 128038 - protein, 8 aa, West Nile virus
AEVSGTKI

SEQ ID NO: 128039 - protein, 8 aa, West Nile virus
EVSGTKIA

SEQ ID NO: 128040 - protein, 8 aa, West Nile virus
VSGTKIAG

SEQ ID NO: 128041 - protein, 8 aa, West Nile virus
SGTKIAGM

SEQ ID NO: 128042 - protein, 8 aa, West Nile virus
MLLLSLLM

SEQ ID NO: 128043 - protein, 8 aa, West Nile virus
LLLSLLMM

SEQ ID NO: 128044 - protein, 8 aa, West Nile virus
LLSLLMMI

SEQ ID NO: 128045 - protein, 8 aa, West Nile virus
LSLLMMIV

SEQ ID NO: 128046 - protein, 8 aa, West Nile virus
SLLMMIVL

SEQ ID NO: 128047 - protein, 8 aa, West Nile virus
LLMMIVLI

SEQ ID NO: 128048 - protein, 8 aa, West Nile virus
LMMIVLIP

SEQ ID NO: 128049 - protein, 8 aa, West Nile virus
MMIVLIPE

SEQ ID NO: 128050 - protein, 8 aa, West Nile virus
QTDNQLAM

SEQ ID NO: 128051 - protein, 8 aa, West Nile virus
TDNQLAMF

SEQ ID NO: 128052 - protein, 8 aa, West Nile virus
DNQLAMFL

SEQ ID NO: 128053 - protein, 8 aa, West Nile virus
NQLAMFLI

SEQ ID NO: 128054 - protein, 8 aa, West Nile virus
QLAMFLIC

SEQ ID NO: 128055 - protein, 8 aa, West Nile virus
LAMFLICV

SEQ ID NO: 128056 - protein, 8 aa, West Nile virus
AVFLICVL

SEQ ID NO: 128057 - protein, 8 aa, West Nile virus
VFLICVLT

SEQ ID NO: 128058 - protein, 8 aa, West Nile virus
FLICVLTL

SEQ ID NO: 128059 - protein, 8 aa, West Nile virus
LICVLTLV

SEQ ID NO: 128060 - protein, 8 aa, West Nile virus
ICVLTLVS

SEQ ID NO: 128061 - protein, 8 aa, West Nile virus
TLVGAVAA

SEQ ID NO: 128062 - protein, 8 aa, West Nile virus
LVGAVAAN

SEQ ID NO: 128063 - protein, 8 aa, West Nile virus
VGAVAANE

SEQ ID NO: 128064 - protein, 8 aa, West Nile virus
GAVAANEM

SEQ ID NO: 128065 - protein, 8 aa, West Nile virus
TVAANEMG

SEQ ID NO: 128066 - protein, 8 aa, West Nile virus
NEMGWLDR

SEQ ID NO: 128067 - protein, 8 aa, West Nile virus
EMGWLDRT

SEQ ID NO: 128068 - protein, 8 aa, West Nile virus
MGWLDRTK

SEQ ID NO: 128069 - protein, 8 aa, West Nile virus
GWLDKTKN

SEQ ID NO: 128070 - protein, 8 aa, West Nile virus
WLDKTKND

SEQ ID NO: 128071 - protein, 8 aa, West Nile virus
LDKTKNDI

SEQ ID NO: 128072 - protein, 8 aa, West Nile virus
ESFLLDLR

SEQ ID NO: 128073 - protein, 8 aa, West Nile virus
SFLLDLRP

SEQ ID NO: 128074 - protein, 8 aa, West Nile virus
FLLDLKPA

SEQ ID NO: 128075 - protein, 8 aa, West Nile virus
LLDLKPAT

SEQ ID NO: 128076 - protein, 8 aa, West Nile virus
LDLKPATA

SEQ ID NO: 128077 - protein, 8 aa, West Nile virus
DLKPATAW

SEQ ID NO: 128078 - protein, 8 aa, West Nile virus
LKPATAWS

SEQ ID NO: 128079 - protein, 8 aa, West Nile virus
KPATAWSL

SEQ ID NO: 128080 - protein, 8 aa, West Nile virus
AWSLYAVS

SEQ ID NO: 128081 - protein, 8 aa, West Nile virus
WSLYAVST

SEQ ID NO: 128082 - protein, 8 aa, West Nile virus
SLYAVSTA

SEQ ID NO: 128083 - protein, 8 aa, West Nile virus
LYAVSTAV

SEQ ID NO: 128084 - protein, 8 aa, West Nile virus
YAVSTAVM

SEQ ID NO: 128085 - protein, 8 aa, West Nile virus
AVSTAVMT

SEQ ID NO: 128086 - protein, 8 aa, West Nile virus
VSTAVMTP

SEQ ID NO: 128087 - protein, 8 aa, West Nile virus
STAVMTPL

SEQ ID NO: 128088 - protein, 8 aa, West Nile virus
TAVMTPLL

SEQ ID NO: 128089 - protein, 8 aa, West Nile virus
AVMTPLLK

SEQ ID NO: 128090 - protein, 8 aa, West Nile virus
VMTPLLKH

SEQ ID NO: 128091 - protein, 8 aa, West Nile virus
MTPLLKHV

SEQ ID NO: 128092 - protein, 8 aa, West Nile virus
TPLLKHVI

SEQ ID NO: 128093 - protein, 8 aa, West Nile virus
PLLKHVIT

SEQ ID NO: 128094 - protein, 8 aa, West Nile virus
LLKHVITS

SEQ ID NO: 128095 - protein, 8 aa, West Nile virus
LKHVITSD

SEQ ID NO: 128096 - protein, 8 aa, West Nile virus
KHVITSDY

SEQ ID NO: 128097 - protein, 8 aa, West Nile virus
HVITSDYI

SEQ ID NO: 128098 - protein, 8 aa, West Nile virus
VITSDYIN

SEQ ID NO: 128099 - protein, 8 aa, West Nile virus
SINVQAST

SEQ ID NO: 128100 - protein, 8 aa, West Nile virus
INVQASTL

SEQ ID NO: 128101 - protein, 8 aa, West Nile virus
NVQASALY

SEQ ID NO: 128102 - protein, 8 aa, West Nile virus
VQASALYS

SEQ ID NO: 128103 - protein, 8 aa, West Nile virus
QASALYSL

SEQ ID NO: 128104 - protein, 8 aa, West Nile virus
ASALFTLS

SEQ ID NO: 128105 - protein, 8 aa, West Nile virus
SALFTLSR

SEQ ID NO: 128106 - protein, 8 aa, West Nile virus
ALFTLSRG

SEQ ID NO: 128107 - protein, 8 aa, West Nile virus
LFTLSRGF

SEQ ID NO: 128108 - protein, 8 aa, West Nile virus
FTLSRGFP

SEQ ID NO: 128109 - protein, 8 aa, West Nile virus
TLSRGFPF

SEQ ID NO: 128110 - protein, 8 aa, West Nile virus
LSRGFPFV

SEQ ID NO: 128111 - protein, 8 aa, West Nile virus
SRGFPFVD

SEQ ID NO: 128112 - protein, 8 aa, West Nile virus
FPFVDVGI

SEQ ID NO: 128113 - protein, 8 aa, West Nile virus
PFVDVGIS

SEQ ID NO: 128114 - protein, 8 aa, West Nile virus
FVDVGISS

SEQ ID NO: 128115 - protein, 8 aa, West Nile virus
VDVGISSL

SEQ ID NO: 128116 - protein, 8 aa, West Nile virus
DVGISALL

SEQ ID NO: 128117 - protein, 8 aa, West Nile virus
VGISSLLL

SEQ ID NO: 128118 - protein, 8 aa, West Nile virus
GISSLLLA

SEQ ID NO: 128119 - protein, 8 aa, West Nile virus
VSALLLAV

SEQ ID NO: 128120 - protein, 8 aa, West Nile virus
SALLLAVG

SEQ ID NO: 128121 - protein, 8 aa, West Nile virus
ALLLAVGC

SEQ ID NO: 128122 - protein, 8 aa, West Nile virus
LLLAVGCW

SEQ ID NO: 128123 - protein, 8 aa, West Nile virus
LLAVGCWG

SEQ ID NO: 128124 - protein, 8 aa, West Nile virus
LAVGCWGQ

SEQ ID NO: 128125 - protein, 8 aa, West Nile virus
AVGCWGQV

SEQ ID NO: 128126 - protein, 8 aa, West Nile virus
VGCWGQVT

SEQ ID NO: 128127 - protein, 8 aa, West Nile virus
EQVTLTVT

SEQ ID NO: 128128 - protein, 8 aa, West Nile virus
TLTVTVTS

SEQ ID NO: 128129 - protein, 8 aa, West Nile virus
LTVTVTAT

SEQ ID NO: 128130 - protein, 8 aa, West Nile virus
ALLFCHYA

SEQ ID NO: 128131 - protein, 8 aa, West Nile virus
LLLCHYAY

SEQ ID NO: 128132 - protein, 8 aa, West Nile virus
LLCHYAYM

SEQ ID NO: 128133 - protein, 8 aa, West Nile virus
LCHYAYMV

SEQ ID NO: 128134 - protein, 8 aa, West Nile virus
YAYMVPGG

SEQ ID NO: 128135 - protein, 8 aa, West Nile virus
AYMIPGWQ

SEQ ID NO: 128136 - protein, 8 aa, West Nile virus
YMIPGWQA

SEQ ID NO: 128137 - protein, 8 aa, West Nile virus
MVPGGQAE

SEQ ID NO: 128138 - protein, 8 aa, West Nile virus
IPGWQAEA

SEQ ID NO: 128139 - protein, 8 aa, West Nile virus
WQAEAMRA

SEQ ID NO: 128140 - protein, 8 aa, West Nile virus
QAEAMRAA

SEQ ID NO: 128141 - protein, 8 aa, West Nile virus
AEAMRAAQ

SEQ ID NO: 128142 - protein, 8 aa, West Nile virus
EAMRAAQR

SEQ ID NO: 128143 - protein, 8 aa, West Nile virus
AMRAAQRR

SEQ ID NO: 128144 - protein, 8 aa, West Nile virus
MRAAQRRT

SEQ ID NO: 128145 - protein, 8 aa, West Nile virus
RAAQRRTA

SEQ ID NO: 128146 - protein, 8 aa, West Nile virus
AAQRRTAA

SEQ ID NO: 128147 - protein, 8 aa, West Nile virus
AAGIMKNV

SEQ ID NO: 128148 - protein, 8 aa, West Nile virus
AGIMKNVV

SEQ ID NO: 128149 - protein, 8 aa, West Nile virus
GIMKNVVV

SEQ ID NO: 128150 - protein, 8 aa, West Nile virus
IMKNAVID

SEQ ID NO: 128151 - protein, 8 aa, West Nile virus
MKNAVIDG

SEQ ID NO: 128152 - protein, 8 aa, West Nile virus
KNVVVDGI

SEQ ID NO: 128153 - protein, 8 aa, West Nile virus
NVVVDGIV

SEQ ID NO: 128154 - protein, 8 aa, West Nile virus
VVVDGIVA

SEQ ID NO: 128155 - protein, 8 aa, West Nile virus
VIDGMVAT

SEQ ID NO: 128156 - protein, 8 aa, West Nile virus
IDGMVATD

SEQ ID NO: 128157 - protein, 8 aa, West Nile virus
DGMVATDV

SEQ ID NO: 128158 - protein, 8 aa, West Nile virus
GMVATDVP

SEQ ID NO: 128159 - protein, 8 aa, West Nile virus
MVATDVPE

SEQ ID NO: 128160 - protein, 8 aa, West Nile virus
DVPELERA

SEQ ID NO: 128161 - protein, 8 aa, West Nile virus
VPELERAT

SEQ ID NO: 128162 - protein, 8 aa, West Nile virus
PELERATP

SEQ ID NO: 128163 - protein, 8 aa, West Nile virus
ELERTTPV

SEQ ID NO: 128164 - protein, 8 aa, West Nile virus
LERTTPVM

SEQ ID NO: 128165 - protein, 8 aa, West Nile virus
ERTTPVMQ

SEQ ID NO: 128166 - protein, 8 aa, West Nile virus
RTTPVMQK

SEQ ID NO: 128167 - protein, 8 aa, West Nile virus
TTPVMQKK

SEQ ID NO: 128168 - protein, 8 aa, West Nile virus
TPVMQKKV

SEQ ID NO: 128169 - protein, 8 aa, West Nile virus
PVMQKKVG

SEQ ID NO: 128170 - protein, 8 aa, West Nile virus
VMQKKVGQ

SEQ ID NO: 128171 - protein, 8 aa, West Nile virus
MQKKVGQV

SEQ ID NO: 128172 - protein, 8 aa, West Nile virus
QKKVGQVM

SEQ ID NO: 128173 - protein, 8 aa, West Nile virus
KKVGQVML

SEQ ID NO: 128174 - protein, 8 aa, West Nile virus
KVGQVMLI

SEQ ID NO: 128175 - protein, 8 aa, West Nile virus
VGQVMLIL

SEQ ID NO: 128176 - protein, 8 aa, West Nile virus
GQVMLILV

SEQ ID NO: 128177 - protein, 8 aa, West Nile virus
QVMLILVS

SEQ ID NO: 128178 - protein, 8 aa, West Nile virus
MLILVSMA

SEQ ID NO: 128179 - protein, 8 aa, West Nile virus
LILVSMAA

SEQ ID NO: 128180 - protein, 8 aa, West Nile virus
ILVSMAAV

SEQ ID NO: 128181 - protein, 8 aa, West Nile virus
LVSMAAVV

SEQ ID NO: 128182 - protein, 8 aa, West Nile virus
VSMAAVVV

SEQ ID NO: 128183 - protein, 8 aa, West Nile virus
SMAAVVVN

SEQ ID NO: 128184 - protein, 8 aa, West Nile virus
MAAVVVNP

SEQ ID NO: 128185 - protein, 8 aa, West Nile virus
AALVVNPS

SEQ ID NO: 128186 - protein, 8 aa, West Nile virus
ALVVNPSV

SEQ ID NO: 128187 - protein, 8 aa, West Nile virus
VVVNPSVR

SEQ ID NO: 128188 - protein, 8 aa, West Nile virus
VVNPSVRT

SEQ ID NO: 128189 - protein, 8 aa, West Nile virus
VNPSVRTV

SEQ ID NO: 128190 - protein, 8 aa, West Nile virus
NPSVRTVR

SEQ ID NO: 128191 - protein, 8 aa, West Nile virus
PSVRTVRE

SEQ ID NO: 128192 - protein, 8 aa, West Nile virus
SVRTVREA

SEQ ID NO: 128193 - protein, 8 aa, West Nile virus
VRTVREAG

SEQ ID NO: 128194 - protein, 8 aa, West Nile virus
RTVREAGI

SEQ ID NO: 128195 - protein, 8 aa, West Nile virus
VREAGILT

SEQ ID NO: 128196 - protein, 8 aa, West Nile virus
REAGILTT

SEQ ID NO: 128197 - protein, 8 aa, West Nile virus
EAGILTTA

SEQ ID NO: 128198 - protein, 8 aa, West Nile virus
AGILTTAA

SEQ ID NO: 128199 - protein, 8 aa, West Nile virus
GILTTAAA

SEQ ID NO: 128200 - protein, 8 aa, West Nile virus
ILTTAAAV

SEQ ID NO: 128201 - protein, 8 aa, West Nile virus
LTTAAAVT

SEQ ID NO: 128202 - protein, 8 aa, West Nile virus
TTAAAVTL

SEQ ID NO: 128203 - protein, 8 aa, West Nile virus
SAAAVTLW

SEQ ID NO: 128204 - protein, 8 aa, West Nile virus
AAVTLWEK

SEQ ID NO: 128205 - protein, 8 aa, West Nile virus
SVTLWENG

SEQ ID NO: 128206 - protein, 8 aa, West Nile virus
TLWENGAG

SEQ ID NO: 128207 - protein, 8 aa, West Nile virus
LWENGAGS

SEQ ID NO: 128208 - protein, 8 aa, West Nile virus
WENGAGSV

SEQ ID NO: 128209 - protein, 8 aa, West Nile virus
ENGAGSVW

SEQ ID NO: 128210 - protein, 8 aa, West Nile virus
NGAGSVWN

SEQ ID NO: 128211 - protein, 8 aa, West Nile virus
GAGSVWNA

SEQ ID NO: 128212 - protein, 8 aa, West Nile virus
AGSVWNAT

SEQ ID NO: 128213 - protein, 8 aa, West Nile virus
GSVWNATT

SEQ ID NO: 128214 - protein, 8 aa, West Nile virus
TAIGLCHV

SEQ ID NO: 128215 - protein, 8 aa, West Nile virus
AIGLCHVM

SEQ ID NO: 128216 - protein, 8 aa, West Nile virus
IGLCHVMR

SEQ ID NO: 128217 - protein, 8 aa, West Nile virus
GLCHVMRG

SEQ ID NO: 128218 - protein, 8 aa, West Nile virus
LCHVMRGG

SEQ ID NO: 128219 - protein, 8 aa, West Nile virus
CHVMRGGW

SEQ ID NO: 128220 - protein, 8 aa, West Nile virus
HVMRGGWL

SEQ ID NO: 128221 - protein, 8 aa, West Nile virus
VMRGGWLS

SEQ ID NO: 128222 - protein, 8 aa, West Nile virus
REGWLSCL

SEQ ID NO: 128223 - protein, 8 aa, West Nile virus
EGWLSCLS

SEQ ID NO: 128224 - protein, 8 aa, West Nile virus
GWLSCLSM

SEQ ID NO: 128225 - protein, 8 aa, West Nile virus
WLSCLSIM

SEQ ID NO: 128226 - protein, 8 aa, West Nile virus
LSCLSIMW

SEQ ID NO: 128227 - protein, 8 aa, West Nile virus
SCLSIMWT

SEQ ID NO: 128228 - protein, 8 aa, West Nile virus
CLSIMWTL

SEQ ID NO: 128229 - protein, 8 aa, West Nile virus
SITWTLVK

SEQ ID NO: 128230 - protein, 8 aa, West Nile virus
KNMDKPGL

SEQ ID NO: 128231 - protein, 8 aa, West Nile virus
NMDKPGLK

SEQ ID NO: 128232 - protein, 8 aa, West Nile virus
MDKPGLKR

SEQ ID NO: 128233 - protein, 8 aa, West Nile virus
DKPGLKRG

SEQ ID NO: 128234 - protein, 8 aa, West Nile virus
KPGIKRGG

SEQ ID NO: 128235 - protein, 8 aa, West Nile virus
PGIKRGGA

SEQ ID NO: 128236 - protein, 8 aa, West Nile virus
VLKRGGAK

SEQ ID NO: 128237 - protein, 8 aa, West Nile virus
TLGEVWKD

SEQ ID NO: 128238 - protein, 8 aa, West Nile virus
LGEVWKDR

SEQ ID NO: 128239 - protein, 8 aa, West Nile virus
GEVWKDRL

SEQ ID NO: 128240 - protein, 8 aa, West Nile virus
EVWKDRLN

SEQ ID NO: 128241 - protein, 8 aa, West Nile virus
VWKERLNH

SEQ ID NO: 128242 - protein, 8 aa, West Nile virus
WKERLNHM

SEQ ID NO: 128243 - protein, 8 aa, West Nile virus
KERLNHMT

SEQ ID NO: 128244 - protein, 8 aa, West Nile virus
LTKEEFTR

SEQ ID NO: 128245 - protein, 8 aa, West Nile virus
TKEEFIRY

SEQ ID NO: 128246 - protein, 8 aa, West Nile virus
KEEFIRYR

SEQ ID NO: 128247 - protein, 8 aa, West Nile virus
EEFIRYRK

SEQ ID NO: 128248 - protein, 8 aa, West Nile virus
EFIRYRKE

SEQ ID NO: 128249 - protein, 8 aa, West Nile virus
FIRYRKEA

SEQ ID NO: 128250 - protein, 8 aa, West Nile virus
IRYRKEAI

SEQ ID NO: 128251 - protein, 8 aa, West Nile virus
RYRKEAIT

SEQ ID NO: 128252 - protein, 8 aa, West Nile virus
YRKEAITE

SEQ ID NO: 128253 - protein, 8 aa, West Nile virus
RKEAITEV

SEQ ID NO: 128254 - protein, 8 aa, West Nile virus
KEAITEVD

SEQ ID NO: 128255 - protein, 8 aa, West Nile virus
EAITEVDR

SEQ ID NO: 128256 - protein, 8 aa, West Nile virus
AITEVDRS

SEQ ID NO: 128257 - protein, 8 aa, West Nile virus
ITEVDRSA

SEQ ID NO: 128258 - protein, 8 aa, West Nile virus
TEVDRSAA

SEQ ID NO: 128259 - protein, 8 aa, West Nile virus
EVDRSAAR

SEQ ID NO: 128260 - protein, 8 aa, West Nile virus
ARREGNIT

SEQ ID NO: 128261 - protein, 8 aa, West Nile virus
RREGNITG

SEQ ID NO: 128262 - protein, 8 aa, West Nile virus
REGNITGG

SEQ ID NO: 128263 - protein, 8 aa, West Nile virus
EGNITGGH

SEQ ID NO: 128264 - protein, 8 aa, West Nile virus
GNITGGHP

SEQ ID NO: 128265 - protein, 8 aa, West Nile virus
NITGGHPV

SEQ ID NO: 128266 - protein, 8 aa, West Nile virus
ITGGHPVS

SEQ ID NO: 128267 - protein, 8 aa, West Nile virus
TGGHSVSR

SEQ ID NO: 128268 - protein, 8 aa, West Nile virus
GGHSVSRG

SEQ ID NO: 128269 - protein, 8 aa, West Nile virus
GHSVSRGT

SEQ ID NO: 128270 - protein, 8 aa, West Nile virus
HSVSRGTA

SEQ ID NO: 128271 - protein, 8 aa, West Nile virus
SVSRGTAK

SEQ ID NO: 128272 - protein, 8 aa, West Nile virus
LVERRFLD

SEQ ID NO: 128273 - protein, 8 aa, West Nile virus
VERRFLDP

SEQ ID NO: 128274 - protein, 8 aa, West Nile virus
ERRFLDPI

SEQ ID NO: 128275 - protein, 8 aa, West Nile virus
RRFLDPIG

SEQ ID NO: 128276 - protein, 8 aa, West Nile virus
RFLDPIGK

SEQ ID NO: 128277 - protein, 8 aa, West Nile virus
FLDPIGKV

SEQ ID NO: 128278 - protein, 8 aa, West Nile virus
LEPVGKVV

SEQ ID NO: 128279 - protein, 8 aa, West Nile virus
EPVGKVVD

SEQ ID NO: 128280 - protein, 8 aa, West Nile virus
PVGKVVDL

SEQ ID NO: 128281 - protein, 8 aa, West Nile virus
VGKVVDLG

SEQ ID NO: 128282 - protein, 8 aa, West Nile virus
GKVVDLGC

SEQ ID NO: 128283 - protein, 8 aa, West Nile virus
KVVDLGCG

SEQ ID NO: 128284 - protein, 8 aa, West Nile virus
VVDLGCGR

SEQ ID NO: 128285 - protein, 8 aa, West Nile virus
VDLGCGRG

SEQ ID NO: 128286 - protein, 8 aa, West Nile virus
QKRVQEVK

SEQ ID NO: 128287 - protein, 8 aa, West Nile virus
KRVQEVKG

SEQ ID NO: 128288 - protein, 8 aa, West Nile virus
RVQEVKGY

SEQ ID NO: 128289 - protein, 8 aa, West Nile virus
VQEVKGYT

SEQ ID NO: 128290 - protein, 8 aa, West Nile virus
QEVKGYTK

SEQ ID NO: 128291 - protein, 8 aa, West Nile virus
EVKGYTKG

SEQ ID NO: 128292 - protein, 8 aa, West Nile virus
VKGYTKGG

SEQ ID NO: 128293 - protein, 8 aa, West Nile virus
KGYTKGGP

SEQ ID NO: 128294 - protein, 8 aa, West Nile virus
VQSYGWNT

SEQ ID NO: 128295 - protein, 8 aa, West Nile virus
QSYGWNTV

SEQ ID NO: 128296 - protein, 8 aa, West Nile virus
SYGWNTVT

SEQ ID NO: 128297 - protein, 8 aa, West Nile virus
YGWNTVTM

SEQ ID NO: 128298 - protein, 8 aa, West Nile virus
GWNTVTMK

SEQ ID NO: 128299 - protein, 8 aa, West Nile virus
WNTVTMKS

SEQ ID NO: 128300 - protein, 8 aa, West Nile virus
NTVTMKSG

SEQ ID NO: 128301 - protein, 8 aa, West Nile virus
TVTMKSGV

SEQ ID NO: 128302 - protein, 8 aa, West Nile virus
MKSGVDVY

SEQ ID NO: 128303 - protein, 8 aa, West Nile virus
KSGVDVYY

SEQ ID NO: 128304 - protein, 8 aa, West Nile virus
SGVDVYYR

SEQ ID NO: 128305 - protein, 8 aa, West Nile virus
GVDVYYRA

SEQ ID NO: 128306 - protein, 8 aa, West Nile virus
VDVYYRAS

SEQ ID NO: 128307 - protein, 8 aa, West Nile virus
DVYYRASE

SEQ ID NO: 128308 - protein, 8 aa, West Nile virus
VFYRPSEA

SEQ ID NO: 128309 - protein, 8 aa, West Nile virus
FYRPSEAS

SEQ ID NO: 128310 - protein, 8 aa, West Nile virus
YRPSEASD

SEQ ID NO: 128311 - protein, 8 aa, West Nile virus
RPSEASDT

SEQ ID NO: 128312 - protein, 8 aa, West Nile virus
PSEASDTL

SEQ ID NO: 128313 - protein, 8 aa, West Nile virus
SEASDTLL

SEQ ID NO: 128314 - protein, 8 aa, West Nile virus
EASDTLLC

SEQ ID NO: 128315 - protein, 8 aa, West Nile virus
ASDTLLCD

SEQ ID NO: 128316 - protein, 8 aa, West Nile virus
SDTLLCDI

SEQ ID NO: 128317 - protein, 8 aa, West Nile virus
LCDIGESA

SEQ ID NO: 128318 - protein, 8 aa, West Nile virus
CDIGESAS

SEQ ID NO: 128319 - protein, 8 aa, West Nile virus
DIGESASS

SEQ ID NO: 128320 - protein, 8 aa, West Nile virus
IGESASSA

SEQ ID NO: 128321 - protein, 8 aa, West Nile virus
GESASSAE

SEQ ID NO: 128322 - protein, 8 aa, West Nile virus
ESASSAEV

SEQ ID NO: 128323 - protein, 8 aa, West Nile virus
SASSAEVE

SEQ ID NO: 128324 - protein, 8 aa, West Nile virus
ASSAEVEE

SEQ ID NO: 128325 - protein, 8 aa, West Nile virus
EVEEHRTV

SEQ ID NO: 128326 - protein, 8 aa, West Nile virus
VEEHRTVR

SEQ ID NO: 128327 - protein, 8 aa, West Nile virus
EEHRTVRV

SEQ ID NO: 128328 - protein, 8 aa, West Nile virus
EHRTVRVL

SEQ ID NO: 128329 - protein, 8 aa, West Nile virus
HRTVRVLE

SEQ ID NO: 128330 - protein, 8 aa, West Nile virus
RTVRVLEM

SEQ ID NO: 128331 - protein, 8 aa, West Nile virus
TVRVLEMV

SEQ ID NO: 128332 - protein, 8 aa, West Nile virus
VRVLEMVE

SEQ ID NO: 128333 - protein, 8 aa, West Nile virus
DWLHRGPK

SEQ ID NO: 128334 - protein, 8 aa, West Nile virus
WLHRGPKE

SEQ ID NO: 128335 - protein, 8 aa, West Nile virus
LHRGPKEF

SEQ ID NO: 128336 - protein, 8 aa, West Nile virus
HRGPKEFC

SEQ ID NO: 128337 - protein, 8 aa, West Nile virus
RGPKEFCI

SEQ ID NO: 128338 - protein, 8 aa, West Nile virus
GPKEFCIK

SEQ ID NO: 128339 - protein, 8 aa, West Nile virus
PKEFCIKV

SEQ ID NO: 128340 - protein, 8 aa, West Nile virus
KEFCIKVL

SEQ ID NO: 128341 - protein, 8 aa, West Nile virus
EFCIKVLC

SEQ ID NO: 128342 - protein, 8 aa, West Nile virus
FCIKVLCP

SEQ ID NO: 128343 - protein, 8 aa, West Nile virus
CIKVLCPY

SEQ ID NO: 128344 - protein, 8 aa, West Nile virus
IKVLCPYM

SEQ ID NO: 128345 - protein, 8 aa, West Nile virus
CPYMPRVI

SEQ ID NO: 128346 - protein, 8 aa, West Nile virus
PYMPRVIE

SEQ ID NO: 128347 - protein, 8 aa, West Nile virus
YMPKVVEK

SEQ ID NO: 128348 - protein, 8 aa, West Nile virus
MPRVIEKM

SEQ ID NO: 128349 - protein, 8 aa, West Nile virus
PKVVEKME

SEQ ID NO: 128350 - protein, 8 aa, West Nile virus
KVIEKMET

SEQ ID NO: 128351 - protein, 8 aa, West Nile virus
VIEKMETL

SEQ ID NO: 128352 - protein, 8 aa, West Nile virus
IEKMETLQ

SEQ ID NO: 128353 - protein, 8 aa, West Nile virus
EKMETLQR

SEQ ID NO: 128354 - protein, 8 aa, West Nile virus
KMETLQRR

SEQ ID NO: 128355 - protein, 8 aa, West Nile virus
METLQRRY

SEQ ID NO: 128356 - protein, 8 aa, West Nile virus
ETLQRRYG

SEQ ID NO: 128357 - protein, 8 aa, West Nile virus
TLQRRYGG

SEQ ID NO: 128358 - protein, 8 aa, West Nile virus
RRYGGGLI

SEQ ID NO: 128359 - protein, 8 aa, West Nile virus
RYGGGLIR

SEQ ID NO: 128360 - protein, 8 aa, West Nile virus
YGGGLIRN

SEQ ID NO: 128361 - protein, 8 aa, West Nile virus
GGGLIRNP

SEQ ID NO: 128362 - protein, 8 aa, West Nile virus
GGLIRNPL

SEQ ID NO: 128363 - protein, 8 aa, West Nile virus
GLIRNPLS

SEQ ID NO: 128364 - protein, 8 aa, West Nile virus
LIRNPLSR

SEQ ID NO: 128365 - protein, 8 aa, West Nile virus
IRNPLSRN

SEQ ID NO: 128366 - protein, 8 aa, West Nile virus
HEMYWVSH

SEQ ID NO: 128367 - protein, 8 aa, West Nile virus
EMYWVSHA

SEQ ID NO: 128368 - protein, 8 aa, West Nile virus
MYWVSHAS

SEQ ID NO: 128369 - protein, 8 aa, West Nile virus
YWVSHASG

SEQ ID NO: 128370 - protein, 8 aa, West Nile virus
WVSHASGN

SEQ ID NO: 128371 - protein, 8 aa, West Nile virus
VSHASGNI

SEQ ID NO: 128372 - protein, 8 aa, West Nile virus
SHASGNIV

SEQ ID NO: 128373 - protein, 8 aa, West Nile virus
HASGNIVH

SEQ ID NO: 128374 - protein, 8 aa, West Nile virus
ASGNIVHS

SEQ ID NO: 128375 - protein, 8 aa, West Nile virus
NIVHSVNM

SEQ ID NO: 128376 - protein, 8 aa, West Nile virus
IVHSVNMT

SEQ ID NO: 128377 - protein, 8 aa, West Nile virus
VNSVSMTS

SEQ ID NO: 128378 - protein, 8 aa, West Nile virus
NSVSMTSQ

SEQ ID NO: 128379 - protein, 8 aa, West Nile virus
SVSMTSQV

SEQ ID NO: 128380 - protein, 8 aa, West Nile virus
VSMTSQVL

SEQ ID NO: 128381 - protein, 8 aa, West Nile virus
SMTSQVLL

SEQ ID NO: 128382 - protein, 8 aa, West Nile virus
LLGRMEKK

SEQ ID NO: 128383 - protein, 8 aa, West Nile virus
LGRMEKKT

SEQ ID NO: 128384 - protein, 8 aa, West Nile virus
GRMEKKTW

SEQ ID NO: 128385 - protein, 8 aa, West Nile virus
RMEKKTWK

SEQ ID NO: 128386 - protein, 8 aa, West Nile virus
MEKKTWKG

SEQ ID NO: 128387 - protein, 8 aa, West Nile virus
EKKTWKGP

SEQ ID NO: 128388 - protein, 8 aa, West Nile virus
KKTWKGPQ

SEQ ID NO: 128389 - protein, 8 aa, West Nile virus
KTWKGPQF

SEQ ID NO: 128390 - protein, 8 aa, West Nile virus
TWKGPQFE

SEQ ID NO: 128391 - protein, 8 aa, West Nile virus
WKGPQFEE

SEQ ID NO: 128392 - protein, 8 aa, West Nile virus
KGPQFEED

SEQ ID NO: 128393 - protein, 8 aa, West Nile virus
GPQFEEDV

SEQ ID NO: 128394 - protein, 8 aa, West Nile virus
PQFEEDVN

SEQ ID NO: 128395 - protein, 8 aa, West Nile virus
QFEEDVNL

SEQ ID NO: 128396 - protein, 8 aa, West Nile virus
FEEDVNLG

SEQ ID NO: 128397 - protein, 8 aa, West Nile virus
EEDANLGS

SEQ ID NO: 128398 - protein, 8 aa, West Nile virus
EDANLGSG

SEQ ID NO: 128399 - protein, 8 aa, West Nile virus
DANLGSGT

SEQ ID NO: 128400 - protein, 8 aa, West Nile virus
ANLGSGTR

SEQ ID NO: 128401 - protein, 8 aa, West Nile virus
AVGRPLLN

SEQ ID NO: 128402 - protein, 8 aa, West Nile virus
VGKPLLSS

SEQ ID NO: 128403 - protein, 8 aa, West Nile virus
GKPLLSSD

SEQ ID NO: 128404 - protein, 8 aa, West Nile virus
RPLLNSDT

SEQ ID NO: 128405 - protein, 8 aa, West Nile virus
PLLNSDTG

SEQ ID NO: 128406 - protein, 8 aa, West Nile virus
LLNSDTGK

SEQ ID NO: 128407 - protein, 8 aa, West Nile virus
LNSDTGKI

SEQ ID NO: 128408 - protein, 8 aa, West Nile virus
NSDTGKIR

SEQ ID NO: 128409 - protein, 8 aa, West Nile virus
SDTGKIRN

SEQ ID NO: 128410 - protein, 8 aa, West Nile virus
DTGKIRNR

SEQ ID NO: 128411 - protein, 8 aa, West Nile virus
IRNRIERL

SEQ ID NO: 128412 - protein, 8 aa, West Nile virus
NRIERLKK

SEQ ID NO: 128413 - protein, 8 aa, West Nile virus
RIERLKKE

SEQ ID NO: 128414 - protein, 8 aa, West Nile virus
IERLKKEY

SEQ ID NO: 128415 - protein, 8 aa, West Nile virus
ERLKKEYS

SEQ ID NO: 128416 - protein, 8 aa, West Nile virus
KEYSSTWH

SEQ ID NO: 128417 - protein, 8 aa, West Nile virus
DANHPYRT

SEQ ID NO: 128418 - protein, 8 aa, West Nile virus
ANHPYRTW

SEQ ID NO: 128419 - protein, 8 aa, West Nile virus
WNYHGSYE

SEQ ID NO: 128420 - protein, 8 aa, West Nile virus
NYHGSYEV

SEQ ID NO: 128421 - protein, 8 aa, West Nile virus
YHGSYDVR

SEQ ID NO: 128422 - protein, 8 aa, West Nile virus
HGSYDVRP

SEQ ID NO: 128423 - protein, 8 aa, West Nile virus
GSYDVRPT

SEQ ID NO: 128424 - protein, 8 aa, West Nile virus
SYDVRPTG

SEQ ID NO: 128425 - protein, 8 aa, West Nile virus
YDVRPTGS

SEQ ID NO: 128426 - protein, 8 aa, West Nile virus
DVRPTGSA

SEQ ID NO: 128427 - protein, 8 aa, West Nile virus
VRPTGSAS

SEQ ID NO: 128428 - protein, 8 aa, West Nile virus
RPTGSASS

SEQ ID NO: 128429 - protein, 8 aa, West Nile virus
SKPWDVIT

SEQ ID NO: 128430 - protein, 8 aa, West Nile virus
KPWDVITN

SEQ ID NO: 128431 - protein, 8 aa, West Nile virus
PWDVITNV

SEQ ID NO: 128432 - protein, 8 aa, West Nile virus
WDVITNVT

SEQ ID NO: 128433 - protein, 8 aa, West Nile virus
DTIMNVTT

SEQ ID NO: 128434 - protein, 8 aa, West Nile virus
TIMNVTTM

SEQ ID NO: 128435 - protein, 8 aa, West Nile virus
ITSVTTMA

SEQ ID NO: 128436 - protein, 8 aa, West Nile virus
MNVTTMAM

SEQ ID NO: 128437 - protein, 8 aa, West Nile virus
DTKAPEPA

SEQ ID NO: 128438 - protein, 8 aa, West Nile virus
TKAPEPAE

SEQ ID NO: 128439 - protein, 8 aa, West Nile virus
KAPEPAEG

SEQ ID NO: 128440 - protein, 8 aa, West Nile virus
APEPAEGV

SEQ ID NO: 128441 - protein, 8 aa, West Nile virus
PEPAEGVK

SEQ ID NO: 128442 - protein, 8 aa, West Nile virus
ALNETTNW

SEQ ID NO: 128443 - protein, 8 aa, West Nile virus
ETTNWLWT

SEQ ID NO: 128444 - protein, 8 aa, West Nile virus
TTNWLWTF

SEQ ID NO: 128445 - protein, 8 aa, West Nile virus
TNWLWTFL

SEQ ID NO: 128446 - protein, 8 aa, West Nile virus
NWLWTFLA

SEQ ID NO: 128447 - protein, 8 aa, West Nile virus
WLWTFLAR

SEQ ID NO: 128448 - protein, 8 aa, West Nile virus
RDKKPRMC

SEQ ID NO: 128449 - protein, 8 aa, West Nile virus
DKKPRMCS

SEQ ID NO: 128450 - protein, 8 aa, West Nile virus
KKPRMCSR

SEQ ID NO: 128451 - protein, 8 aa, West Nile virus
KPRMCSRE

SEQ ID NO: 128452 - protein, 8 aa, West Nile virus
PRMCTREE

SEQ ID NO: 128453 - protein, 8 aa, West Nile virus
RMCTREEF

SEQ ID NO: 128454 - protein, 8 aa, West Nile virus
MCTREEFI

SEQ ID NO: 128455 - protein, 8 aa, West Nile virus
CSREEFIG

SEQ ID NO: 128456 - protein, 8 aa, West Nile virus
SREEFIGK

SEQ ID NO: 128457 - protein, 8 aa, West Nile virus
REEFIGKV

SEQ ID NO: 128458 - protein, 8 aa, West Nile virus
EEFIGKVN

SEQ ID NO: 128459 - protein, 8 aa, West Nile virus
EFIGKVNS

SEQ ID NO: 128460 - protein, 8 aa, West Nile virus
FIGKVNSN

SEQ ID NO: 128461 - protein, 8 aa, West Nile virus
IGKVNSNA

SEQ ID NO: 128462 - protein, 8 aa, West Nile virus
GKVNSNAA

SEQ ID NO: 128463 - protein, 8 aa, West Nile virus
FEEQNQWK

SEQ ID NO: 128464 - protein, 8 aa, West Nile virus
EEQNQWKN

SEQ ID NO: 128465 - protein, 8 aa, West Nile virus
EQNQWKNA

SEQ ID NO: 128466 - protein, 8 aa, West Nile virus
QNQWKNAR

SEQ ID NO: 128467 - protein, 8 aa, West Nile virus
NQWKNARE

SEQ ID NO: 128468 - protein, 8 aa, West Nile virus
QWKNAREA

SEQ ID NO: 128469 - protein, 8 aa, West Nile virus
WKNAREAV

SEQ ID NO: 128470 - protein, 8 aa, West Nile virus
KNAREAVE

SEQ ID NO: 128471 - protein, 8 aa, West Nile virus
NAREAVED

SEQ ID NO: 128472 - protein, 8 aa, West Nile virus
AREAVEDL

SEQ ID NO: 128473 - protein, 8 aa, West Nile virus
REAVEDLK

SEQ ID NO: 128474 - protein, 8 aa, West Nile virus
AAVEDPKF

SEQ ID NO: 128475 - protein, 8 aa, West Nile virus
AVEDLKFW

SEQ ID NO: 128476 - protein, 8 aa, West Nile virus
VEDLKFWE

SEQ ID NO: 128477 - protein, 8 aa, West Nile virus
EDPKFWEI

SEQ ID NO: 128478 - protein, 8 aa, West Nile virus
DPKFWEIV

SEQ ID NO: 128479 - protein, 8 aa, West Nile virus
LKFWEMVD

SEQ ID NO: 128480 - protein, 8 aa, West Nile virus
KFWEMVDD

SEQ ID NO: 128481 - protein, 8 aa, West Nile virus
FWEMVDDE

SEQ ID NO: 128482 - protein, 8 aa, West Nile virus
WEMVDDER

SEQ ID NO: 128483 - protein, 8 aa, West Nile virus
EMVDDERE

SEQ ID NO: 128484 - protein, 8 aa, West Nile virus
MVDDEREA

SEQ ID NO: 128485 - protein, 8 aa, West Nile virus
VDDEREAH

SEQ ID NO: 128486 - protein, 8 aa, West Nile virus
DDEREAHL

SEQ ID NO: 128487 - protein, 8 aa, West Nile virus
DEREAHLR

SEQ ID NO: 128488 - protein, 8 aa, West Nile virus
AHLRGECN

SEQ ID NO: 128489 - protein, 8 aa, West Nile virus
HLRGECNT

SEQ ID NO: 128490 - protein, 8 aa, West Nile virus
LRGECNTC

SEQ ID NO: 128491 - protein, 8 aa, West Nile virus
RGECNTCI

SEQ ID NO: 128492 - protein, 8 aa, West Nile virus
GECNTCIY

SEQ ID NO: 128493 - protein, 8 aa, West Nile virus
ECNTCIYN

SEQ ID NO: 128494 - protein, 8 aa, West Nile virus
CNTCIYNM

SEQ ID NO: 128495 - protein, 8 aa, West Nile virus
NTCIYNMM

SEQ ID NO: 128496 - protein, 8 aa, West Nile virus
PGDFGKAK

SEQ ID NO: 128497 - protein, 8 aa, West Nile virus
GEFGKARG

SEQ ID NO: 128498 - protein, 8 aa, West Nile virus
EFGKARGS

SEQ ID NO: 128499 - protein, 8 aa, West Nile virus
EDHWLGRE

SEQ ID NO: 128500 - protein, 8 aa, West Nile virus
DHWLGREN

SEQ ID NO: 128501 - protein, 8 aa, West Nile virus
HWLGRENS

SEQ ID NO: 128502 - protein, 8 aa, West Nile virus
WLGRENSG

SEQ ID NO: 128503 - protein, 8 aa, West Nile virus
LGRENSGG

SEQ ID NO: 128504 - protein, 8 aa, West Nile virus
GRENSGGG

SEQ ID NO: 128505 - protein, 8 aa, West Nile virus
RENSGGGV

SEQ ID NO: 128506 - protein, 8 aa, West Nile virus
ENSGGGVE

SEQ ID NO: 128507 - protein, 8 aa, West Nile virus
GLQKLGYV

SEQ ID NO: 128508 - protein, 8 aa, West Nile virus
LQKLGYVL

SEQ ID NO: 128509 - protein, 8 aa, West Nile virus
QKLGYILK

SEQ ID NO: 128510 - protein, 8 aa, West Nile virus
KLGYILKE

SEQ ID NO: 128511 - protein, 8 aa, West Nile virus
LGYILKEV

SEQ ID NO: 128512 - protein, 8 aa, West Nile virus
GYILKEVG

SEQ ID NO: 128513 - protein, 8 aa, West Nile virus
GGKMYADD

SEQ ID NO: 128514 - protein, 8 aa, West Nile virus
GKMYADDT

SEQ ID NO: 128515 - protein, 8 aa, West Nile virus
KMYADDTA

SEQ ID NO: 128516 - protein, 8 aa, West Nile virus
MYADDTAG

SEQ ID NO: 128517 - protein, 8 aa, West Nile virus
GWDTRITK

SEQ ID NO: 128518 - protein, 8 aa, West Nile virus
WDTRITKA

SEQ ID NO: 128519 - protein, 8 aa, West Nile virus
DTRITKAD

SEQ ID NO: 128520 - protein, 8 aa, West Nile virus
TRITKADL

SEQ ID NO: 128521 - protein, 8 aa, West Nile virus
RITKADLE

SEQ ID NO: 128522 - protein, 8 aa, West Nile virus
ITKADLEN

SEQ ID NO: 128523 - protein, 8 aa, West Nile virus
TKADLENE

SEQ ID NO: 128524 - protein, 8 aa, West Nile virus
KADLENEA

SEQ ID NO: 128525 - protein, 8 aa, West Nile virus
NEAKVLEF

SEQ ID NO: 128526 - protein, 8 aa, West Nile virus
EAKVLEFL

SEQ ID NO: 128527 - protein, 8 aa, West Nile virus
AKVLEFLD

SEQ ID NO: 128528 - protein, 8 aa, West Nile virus
KVLEFLDG

SEQ ID NO: 128529 - protein, 8 aa, West Nile virus
VLEFLDGE

SEQ ID NO: 128530 - protein, 8 aa, West Nile virus
LEFLDGEH

SEQ ID NO: 128531 - protein, 8 aa, West Nile virus
EFLDGEHR

SEQ ID NO: 128532 - protein, 8 aa, West Nile virus
FLDGEHRR

SEQ ID NO: 128533 - protein, 8 aa, West Nile virus
LEGEHRRL

SEQ ID NO: 128534 - protein, 8 aa, West Nile virus
EGEHRRLA

SEQ ID NO: 128535 - protein, 8 aa, West Nile virus
EHRRLARS

SEQ ID NO: 128536 - protein, 8 aa, West Nile virus
HRRLARSI

SEQ ID NO: 128537 - protein, 8 aa, West Nile virus
RRLARSII

SEQ ID NO: 128538 - protein, 8 aa, West Nile virus
RLARSIIE

SEQ ID NO: 128539 - protein, 8 aa, West Nile virus
LARSIIEL

SEQ ID NO: 128540 - protein, 8 aa, West Nile virus
ARSIIELT

SEQ ID NO: 128541 - protein, 8 aa, West Nile virus
RSIIELTY

SEQ ID NO: 128542 - protein, 8 aa, West Nile virus
SIIELTYR

SEQ ID NO: 128543 - protein, 8 aa, West Nile virus
VIELTYRH

SEQ ID NO: 128544 - protein, 8 aa, West Nile virus
IELTYCHK

SEQ ID NO: 128545 - protein, 8 aa, West Nile virus
ELTYRYKV

SEQ ID NO: 128546 - protein, 8 aa, West Nile virus
LTYRYKVV

SEQ ID NO: 128547 - protein, 8 aa, West Nile virus
TYRYKVVK

SEQ ID NO: 128548 - protein, 8 aa, West Nile virus
YRYKVVKV

SEQ ID NO: 128549 - protein, 8 aa, West Nile virus
RHKVVKGM

SEQ ID NO: 128550 - protein, 8 aa, West Nile virus
YKVVKVMR

SEQ ID NO: 128551 - protein, 8 aa, West Nile virus
VKVMRPAV

SEQ ID NO: 128552 - protein, 8 aa, West Nile virus
KVMRPAVG

SEQ ID NO: 128553 - protein, 8 aa, West Nile virus
VMRPAVGG

SEQ ID NO: 128554 - protein, 8 aa, West Nile virus
MRPAADGK

SEQ ID NO: 128555 - protein, 8 aa, West Nile virus
RPAADGKT

SEQ ID NO: 128556 - protein, 8 aa, West Nile virus
PAADGKTV

SEQ ID NO: 128557 - protein, 8 aa, West Nile virus
AADGKTVM

SEQ ID NO: 128558 - protein, 8 aa, West Nile virus
ADGKTVMD

SEQ ID NO: 128559 - protein, 8 aa, West Nile virus
DGKTVMDV

SEQ ID NO: 128560 - protein, 8 aa, West Nile virus
GKTVMDVI

SEQ ID NO: 128561 - protein, 8 aa, West Nile virus
KTVMDVIS

SEQ ID NO: 128562 - protein, 8 aa, West Nile virus
TVMDIISR

SEQ ID NO: 128563 - protein, 8 aa, West Nile virus
VMDIISRE

SEQ ID NO: 128564 - protein, 8 aa, West Nile virus
MDIISRED

SEQ ID NO: 128565 - protein, 8 aa, West Nile virus
DIISREDQ

SEQ ID NO: 128566 - protein, 8 aa, West Nile virus
IISREDQR

SEQ ID NO: 128567 - protein, 8 aa, West Nile virus
VVTYALNP

SEQ ID NO: 128568 - protein, 8 aa, West Nile virus
VTYALNPF

SEQ ID NO: 128569 - protein, 8 aa, West Nile virus
TYALNPFT

SEQ ID NO: 128570 - protein, 8 aa, West Nile virus
YALNPFSN

SEQ ID NO: 128571 - protein, 8 aa, West Nile virus
ALNPFSNL

SEQ ID NO: 128572 - protein, 8 aa, West Nile virus
LNTFTNLS

SEQ ID NO: 128573 - protein, 8 aa, West Nile virus
NTFTNLSV

SEQ ID NO: 128574 - protein, 8 aa, West Nile virus
TFTNLSVQ

SEQ ID NO: 128575 - protein, 8 aa, West Nile virus
FTNLSVQL

SEQ ID NO: 128576 - protein, 8 aa, West Nile virus
TNLSVQLV

SEQ ID NO: 128577 - protein, 8 aa, West Nile virus
NLSVQLVR

SEQ ID NO: 128578 - protein, 8 aa, West Nile virus
LSVQLVRM

SEQ ID NO: 128579 - protein, 8 aa, West Nile virus
SVQLVRMM

SEQ ID NO: 128580 - protein, 8 aa, West Nile virus
FQLGRRRE

SEQ ID NO: 128581 - protein, 8 aa, West Nile virus
QLVRRREG

SEQ ID NO: 128582 - protein, 8 aa, West Nile virus
LVRRREGE

SEQ ID NO: 128583 - protein, 8 aa, West Nile virus
VRRREGEG

SEQ ID NO: 128584 - protein, 8 aa, West Nile virus
RRREGEGV

SEQ ID NO: 128585 - protein, 8 aa, West Nile virus
MMEGEGVV

SEQ ID NO: 128586 - protein, 8 aa, West Nile virus
MEGEGVVG

SEQ ID NO: 128587 - protein, 8 aa, West Nile virus
EGEGVVGP

SEQ ID NO: 128588 - protein, 8 aa, West Nile virus
GEGVVGPD

SEQ ID NO: 128589 - protein, 8 aa, West Nile virus
EGVVGPDD

SEQ ID NO: 128590 - protein, 8 aa, West Nile virus
GVVGPDDV

SEQ ID NO: 128591 - protein, 8 aa, West Nile virus
VVGPDDVE

SEQ ID NO: 128592 - protein, 8 aa, West Nile virus
TPDDVEKL

SEQ ID NO: 128593 - protein, 8 aa, West Nile virus
PDDVEKLG

SEQ ID NO: 128594 - protein, 8 aa, West Nile virus
KGKGVKVR

SEQ ID NO: 128595 - protein, 8 aa, West Nile virus
GKGVKVRV

SEQ ID NO: 128596 - protein, 8 aa, West Nile virus
KGVKVRVW

SEQ ID NO: 128597 - protein, 8 aa, West Nile virus
GVKVRVWL

SEQ ID NO: 128598 - protein, 8 aa, West Nile virus
VKVRVWLF

SEQ ID NO: 128599 - protein, 8 aa, West Nile virus
KVRVWLFE

SEQ ID NO: 128600 - protein, 8 aa, West Nile virus
VRVWLFEN

SEQ ID NO: 128601 - protein, 8 aa, West Nile virus
RVWLFENG

SEQ ID NO: 128602 - protein, 8 aa, West Nile virus
VWLFENGE

SEQ ID NO: 128603 - protein, 8 aa, West Nile virus
WLSENGEE

SEQ ID NO: 128604 - protein, 8 aa, West Nile virus
LSENGEER

SEQ ID NO: 128605 - protein, 8 aa, West Nile virus
SENGEERL

SEQ ID NO: 128606 - protein, 8 aa, West Nile virus
ENGEERLG

SEQ ID NO: 128607 - protein, 8 aa, West Nile virus
NGKERLGR

SEQ ID NO: 128608 - protein, 8 aa, West Nile virus
GEERLGRM

SEQ ID NO: 128609 - protein, 8 aa, West Nile virus
KERLGRMA

SEQ ID NO: 128610 - protein, 8 aa, West Nile virus
ERLGRMAV

SEQ ID NO: 128611 - protein, 8 aa, West Nile virus
RLGRMAVS

SEQ ID NO: 128612 - protein, 8 aa, West Nile virus
LGRMAVSG

SEQ ID NO: 128613 - protein, 8 aa, West Nile virus
GRMAVSGD

SEQ ID NO: 128614 - protein, 8 aa, West Nile virus
PLDDRFAI

SEQ ID NO: 128615 - protein, 8 aa, West Nile virus
LDDRFATA

SEQ ID NO: 128616 - protein, 8 aa, West Nile virus
DDRFATAL

SEQ ID NO: 128617 - protein, 8 aa, West Nile virus
DRFATALH

SEQ ID NO: 128618 - protein, 8 aa, West Nile virus
RFATALHF

SEQ ID NO: 128619 - protein, 8 aa, West Nile virus
FATALHFL

SEQ ID NO: 128620 - protein, 8 aa, West Nile virus
ATALHFLN

SEQ ID NO: 128621 - protein, 8 aa, West Nile virus
TALHFLNA

SEQ ID NO: 128622 - protein, 8 aa, West Nile virus
ALHFLNAM

SEQ ID NO: 128623 - protein, 8 aa, West Nile virus
LHFLNAMP

SEQ ID NO: 128624 - protein, 8 aa, West Nile virus
HFLNDMSK

SEQ ID NO: 128625 - protein, 8 aa, West Nile virus
FLNAMSQV

SEQ ID NO: 128626 - protein, 8 aa, West Nile virus
LNAMPKVR

SEQ ID NO: 128627 - protein, 8 aa, West Nile virus
NAMSQVRK

SEQ ID NO: 128628 - protein, 8 aa, West Nile virus
DMSKVRKD

SEQ ID NO: 128629 - protein, 8 aa, West Nile virus
MPKVRKDI

SEQ ID NO: 128630 - protein, 8 aa, West Nile virus
PKVRKDIQ

SEQ ID NO: 128631 - protein, 8 aa, West Nile virus
VGWYDWQQ

SEQ ID NO: 128632 - protein, 8 aa, West Nile virus
WYDWQQVQ

SEQ ID NO: 128633 - protein, 8 aa, West Nile virus
YDWQQVQF

SEQ ID NO: 128634 - protein, 8 aa, West Nile virus
DWQQVQFC

SEQ ID NO: 128635 - protein, 8 aa, West Nile virus
WQQVQFCS

SEQ ID NO: 128636 - protein, 8 aa, West Nile virus
QQVQFCSN

SEQ ID NO: 128637 - protein, 8 aa, West Nile virus
QVQFCSNH

SEQ ID NO: 128638 - protein, 8 aa, West Nile virus
VQFCSNHF

SEQ ID NO: 128639 - protein, 8 aa, West Nile virus
QFCSNHFT

SEQ ID NO: 128640 - protein, 8 aa, West Nile virus
KDGRTLVT

SEQ ID NO: 128641 - protein, 8 aa, West Nile virus
DGRTLVTP

SEQ ID NO: 128642 - protein, 8 aa, West Nile virus
GRTLVTPC

SEQ ID NO: 128643 - protein, 8 aa, West Nile virus
RTLVTPCR

SEQ ID NO: 128644 - protein, 8 aa, West Nile virus
TLVTPCRG

SEQ ID NO: 128645 - protein, 8 aa, West Nile virus
LVTPCRGQ

SEQ ID NO: 128646 - protein, 8 aa, West Nile virus
VTPCRGQD

SEQ ID NO: 128647 - protein, 8 aa, West Nile virus
TPCRGQDE

SEQ ID NO: 128648 - protein, 8 aa, West Nile virus
CRGQDELI

SEQ ID NO: 128649 - protein, 8 aa, West Nile virus
RGQDELIG

SEQ ID NO: 128650 - protein, 8 aa, West Nile virus
GQDELIGR

SEQ ID NO: 128651 - protein, 8 aa, West Nile virus
QDELIGRA

SEQ ID NO: 128652 - protein, 8 aa, West Nile virus
DELIGRAR

SEQ ID NO: 128653 - protein, 8 aa, West Nile virus
ELIGRARI

SEQ ID NO: 128654 - protein, 8 aa, West Nile virus
LIGRARIS

SEQ ID NO: 128655 - protein, 8 aa, West Nile virus
IGRARISP

SEQ ID NO: 128656 - protein, 8 aa, West Nile virus
KSYAQMWQ

SEQ ID NO: 128657 - protein, 8 aa, West Nile virus
SYAQMWQL

SEQ ID NO: 128658 - protein, 8 aa, West Nile virus
YAQMWQLL

SEQ ID NO: 128659 - protein, 8 aa, West Nile virus
AQMWQLLY

SEQ ID NO: 128660 - protein, 8 aa, West Nile virus
QMWQLLYF

SEQ ID NO: 128661 - protein, 8 aa, West Nile virus
MWQLLYFH

SEQ ID NO: 128662 - protein, 8 aa, West Nile virus
WQLLYFHR

SEQ ID NO: 128663 - protein, 8 aa, West Nile virus
QLLYFHRR

SEQ ID NO: 128664 - protein, 8 aa, West Nile virus
AICSAVPA

SEQ ID NO: 128665 - protein, 8 aa, West Nile virus
ICSAVPVS

SEQ ID NO: 128666 - protein, 8 aa, West Nile virus
CSAVPVSW

SEQ ID NO: 128667 - protein, 8 aa, West Nile virus
SAVPVSWV

SEQ ID NO: 128668 - protein, 8 aa, West Nile virus
AVPVSWVP

SEQ ID NO: 128669 - protein, 8 aa, West Nile virus
VPVSWVPT

SEQ ID NO: 128670 - protein, 8 aa, West Nile virus
PVSWVPTG

SEQ ID NO: 128671 - protein, 8 aa, West Nile virus
VSWVPTGR

SEQ ID NO: 128672 - protein, 8 aa, West Nile virus
SWVPTGRT

SEQ ID NO: 128673 - protein, 8 aa, West Nile virus
RTTWSIHV

SEQ ID NO: 128674 - protein, 8 aa, West Nile virus
TTWSIHAK

SEQ ID NO: 128675 - protein, 8 aa, West Nile virus
TWSIHAKG

SEQ ID NO: 128676 - protein, 8 aa, West Nile virus
WSIHAKGE

SEQ ID NO: 128677 - protein, 8 aa, West Nile virus
SIHAKGEW

SEQ ID NO: 128678 - protein, 8 aa, West Nile virus
IHAKGEWM

SEQ ID NO: 128679 - protein, 8 aa, West Nile virus
HAKGEWMT

SEQ ID NO: 128680 - protein, 8 aa, West Nile virus
AKGEWMTT

SEQ ID NO: 128681 - protein, 8 aa, West Nile virus
KGEWMTTE

SEQ ID NO: 128682 - protein, 8 aa, West Nile virus
GEWMTTAD

SEQ ID NO: 128683 - protein, 8 aa, West Nile virus
EWMTTADM

SEQ ID NO: 128684 - protein, 8 aa, West Nile virus
WMTTADML

SEQ ID NO: 128685 - protein, 8 aa, West Nile virus
MTTEDMLA

SEQ ID NO: 128686 - protein, 8 aa, West Nile virus
TTEDMLAV

SEQ ID NO: 128687 - protein, 8 aa, West Nile virus
TEDMLAVW

SEQ ID NO: 128688 - protein, 8 aa, West Nile virus
EDMLAVWN

SEQ ID NO: 128689 - protein, 8 aa, West Nile virus
DMLAVWNR

SEQ ID NO: 128690 - protein, 8 aa, West Nile virus
MLAVWNRV

SEQ ID NO: 128691 - protein, 8 aa, West Nile virus
LAVWNRVW

SEQ ID NO: 128692 - protein, 8 aa, West Nile virus
AVWNRVWI

SEQ ID NO: 128693 - protein, 8 aa, West Nile virus
KVWIEENE

SEQ ID NO: 128694 - protein, 8 aa, West Nile virus
EDKTPVER

SEQ ID NO: 128695 - protein, 8 aa, West Nile virus
DKTPVERW

SEQ ID NO: 128696 - protein, 8 aa, West Nile virus
KTPVERWS

SEQ ID NO: 128697 - protein, 8 aa, West Nile virus
TPVERWSD

SEQ ID NO: 128698 - protein, 8 aa, West Nile virus
PVERWSDV

SEQ ID NO: 128699 - protein, 8 aa, West Nile virus
VERWSDVP

SEQ ID NO: 128700 - protein, 8 aa, West Nile virus
ERWSDVPY

SEQ ID NO: 128701 - protein, 8 aa, West Nile virus
RWSDVPYS

SEQ ID NO: 128702 - protein, 8 aa, West Nile virus
WSDIPYSG

SEQ ID NO: 128703 - protein, 8 aa, West Nile virus
SDIPYSGK

SEQ ID NO: 128704 - protein, 8 aa, West Nile virus
DIPYSGKR

SEQ ID NO: 128705 - protein, 8 aa, West Nile virus
IPYSGKRE

SEQ ID NO: 128706 - protein, 8 aa, West Nile virus
GSLIGTRT

SEQ ID NO: 128707 - protein, 8 aa, West Nile virus
SLIGTRTR

SEQ ID NO: 128708 - protein, 8 aa, West Nile virus
LIGTRTRA

SEQ ID NO: 128709 - protein, 8 aa, West Nile virus
IGTRTRAT

SEQ ID NO: 128710 - protein, 8 aa, West Nile virus
GTRTRATW

SEQ ID NO: 128711 - protein, 8 aa, West Nile virus
TRTRATWA

SEQ ID NO: 128712 - protein, 8 aa, West Nile virus
RTRATWAE

SEQ ID NO: 128713 - protein, 8 aa, West Nile virus
TRATWAEN

SEQ ID NO: 128714 - protein, 8 aa, West Nile virus
ATWAENIH

SEQ ID NO: 128715 - protein, 8 aa, West Nile virus
TWAENIHV

SEQ ID NO: 128716 - protein, 8 aa, West Nile virus
WAENIHVA

SEQ ID NO: 128717 - protein, 8 aa, West Nile virus
AENIHVAI

SEQ ID NO: 128718 - protein, 8 aa, West Nile virus
ENIHVAIN

SEQ ID NO: 128719 - protein, 8 aa, West Nile virus
NIHVAINQ

SEQ ID NO: 128720 - protein, 8 aa, West Nile virus
IHVAINQV

SEQ ID NO: 128721 - protein, 8 aa, West Nile virus
HVAINQVR

SEQ ID NO: 128722 - protein, 8 aa, West Nile virus
VAINQVRS

SEQ ID NO: 128723 - protein, 8 aa, West Nile virus
VIGEEKYV

SEQ ID NO: 128724 - protein, 8 aa, West Nile virus
IGEEKYVD

SEQ ID NO: 128725 - protein, 8 aa, West Nile virus
GEEKYVDY

SEQ ID NO: 128726 - protein, 8 aa, West Nile virus
EEKYVDYM

SEQ ID NO: 128727 - protein, 8 aa, West Nile virus
EKYVDYMG

SEQ ID NO: 128728 - protein, 8 aa, West Nile virus
KYVDYMGS

SEQ ID NO: 128729 - protein, 8 aa, West Nile virus
YVDYMGSL

SEQ ID NO: 128730 - protein, 8 aa, West Nile virus
VDYMSSLR

SEQ ID NO: 128731 - protein, 8 aa, West Nile virus
DYMSSLRR

SEQ ID NO: 128732 - protein, 8 aa, West Nile virus
YMSSLRRY

SEQ ID NO: 128733 - protein, 8 aa, West Nile virus
MSSLRRYE

SEQ ID NO: 128734 - protein, 8 aa, West Nile virus
SSLRRYED

SEQ ID NO: 128735 - protein, 8 aa, West Nile virus
SLRRYEDT

SEQ ID NO: 128736 - protein, 8 aa, West Nile virus
KNRAVNMQ

SEQ ID NO: 128737 - protein, 8 aa, West Nile virus
NRAVNMQK

SEQ ID NO: 128738 - protein, 8 aa, West Nile virus
VNMQKRGM

SEQ ID NO: 128739 - protein, 8 aa, West Nile virus
NMQKRGMP

SEQ ID NO: 128740 - protein, 8 aa, West Nile virus
MQKRGTPR

SEQ ID NO: 128741 - protein, 8 aa, West Nile virus
KRGTPRVL

SEQ ID NO: 128742 - protein, 8 aa, West Nile virus
RGTPRVLS

SEQ ID NO: 128743 - protein, 8 aa, West Nile virus
GTPRVLSL

SEQ ID NO: 128744 - protein, 8 aa, West Nile virus
PRVLSLTG

SEQ ID NO: 128745 - protein, 8 aa, West Nile virus
RVLSLTGL

SEQ ID NO: 128746 - protein, 8 aa, West Nile virus
VLSLTGLK

SEQ ID NO: 128747 - protein, 8 aa, West Nile virus
GSLMGLKR

SEQ ID NO: 128748 - protein, 8 aa, West Nile virus
LIGLKRAV

SEQ ID NO: 128749 - protein, 8 aa, West Nile virus
IGLKRAVL

SEQ ID NO: 128750 - protein, 8 aa, West Nile virus
VLSLIDGK

SEQ ID NO: 128751 - protein, 8 aa, West Nile virus
LIDGRGPT

SEQ ID NO: 128752 - protein, 8 aa, West Nile virus
IDGRGPTR

SEQ ID NO: 128753 - protein, 8 aa, West Nile virus
DGRGPTRF

SEQ ID NO: 128754 - protein, 8 aa, West Nile virus
GRGPTRFV

SEQ ID NO: 128755 - protein, 8 aa, West Nile virus
RGPTRFVL

SEQ ID NO: 128756 - protein, 8 aa, West Nile virus
LALLAFFK

SEQ ID NO: 128757 - protein, 8 aa, West Nile virus
ALLAFFKF

SEQ ID NO: 128758 - protein, 8 aa, West Nile virus
LLAFFKFT

SEQ ID NO: 128759 - protein, 8 aa, West Nile virus
LAFFKFTA

SEQ ID NO: 128760 - protein, 8 aa, West Nile virus
AFFKFTAI

SEQ ID NO: 128761 - protein, 8 aa, West Nile virus
APTRAVLN

SEQ ID NO: 128762 - protein, 8 aa, West Nile virus
PTRAVLNR

SEQ ID NO: 128763 - protein, 8 aa, West Nile virus
TRAVLERW

SEQ ID NO: 128764 - protein, 8 aa, West Nile virus
RAVLERWR

SEQ ID NO: 128765 - protein, 8 aa, West Nile virus
AVLDRWRS

SEQ ID NO: 128766 - protein, 8 aa, West Nile virus
VLDRWRSV

SEQ ID NO: 128767 - protein, 8 aa, West Nile virus
LDRWRSVN

SEQ ID NO: 128768 - protein, 8 aa, West Nile virus
DRWRSVNK

SEQ ID NO: 128769 - protein, 8 aa, West Nile virus
RWRSVNKQ

SEQ ID NO: 128770 - protein, 8 aa, West Nile virus
WRSVNKQT

SEQ ID NO: 128771 - protein, 8 aa, West Nile virus
RSVNKQTA

SEQ ID NO: 128772 - protein, 8 aa, West Nile virus
SVNKQTAM

SEQ ID NO: 128773 - protein, 8 aa, West Nile virus
SFKKELGI

SEQ ID NO: 128774 - protein, 8 aa, West Nile virus
FKKELGIL

SEQ ID NO: 128775 - protein, 8 aa, West Nile virus
KRELGTLT

SEQ ID NO: 128776 - protein, 8 aa, West Nile virus
RELGTLTS

SEQ ID NO: 128777 - protein, 8 aa, West Nile virus
ELGALTSA

SEQ ID NO: 128778 - protein, 8 aa, West Nile virus
LGALTSAI

SEQ ID NO: 128779 - protein, 8 aa, West Nile virus
GALTSAIN

SEQ ID NO: 128780 - protein, 8 aa, West Nile virus
ILTNAISR

SEQ ID NO: 128781 - protein, 8 aa, West Nile virus
LTNAISRR

SEQ ID NO: 128782 - protein, 8 aa, West Nile virus
TNAMNRRS

SEQ ID NO: 128783 - protein, 8 aa, West Nile virus
NRRSLKQK

SEQ ID NO: 128784 - protein, 8 aa, West Nile virus
RRSLKQKK

SEQ ID NO: 128785 - protein, 8 aa, West Nile virus
RSLKQKKR

SEQ ID NO: 128786 - protein, 8 aa, West Nile virus
SLKQKKRG

SEQ ID NO: 128787 - protein, 8 aa, West Nile virus
LKQKKRGG

SEQ ID NO: 128788 - protein, 8 aa, West Nile virus
KQKKRGGN

SEQ ID NO: 128789 - protein, 8 aa, West Nile virus
QKKRGGNT

SEQ ID NO: 128790 - protein, 8 aa, West Nile virus
KKRGGSIG

SEQ ID NO: 128791 - protein, 8 aa, West Nile virus
GAVTLSDF

SEQ ID NO: 128792 - protein, 8 aa, West Nile virus
AVVLSNFQ

SEQ ID NO: 128793 - protein, 8 aa, West Nile virus
VTLSDFQG

SEQ ID NO: 128794 - protein, 8 aa, West Nile virus
SNFQGKVI

SEQ ID NO: 128795 - protein, 8 aa, West Nile virus
NFQGKVIM

SEQ ID NO: 128796 - protein, 8 aa, West Nile virus
FQGKVIMT

SEQ ID NO: 128797 - protein, 8 aa, West Nile virus
QGKVIMTV

SEQ ID NO: 128798 - protein, 8 aa, West Nile virus
GKVIMTVN

SEQ ID NO: 128799 - protein, 8 aa, West Nile virus
KVIMTVNA

SEQ ID NO: 128800 - protein, 8 aa, West Nile virus
VIMTVNAT

SEQ ID NO: 128801 - protein, 8 aa, West Nile virus
MMTINATE

SEQ ID NO: 128802 - protein, 8 aa, West Nile virus
MTINATET

SEQ ID NO: 128803 - protein, 8 aa, West Nile virus
TINATETT

SEQ ID NO: 128804 - protein, 8 aa, West Nile virus
IITIPTAS

SEQ ID NO: 128805 - protein, 8 aa, West Nile virus
ITIPTASG

SEQ ID NO: 128806 - protein, 8 aa, West Nile virus
TIPPAAGK

SEQ ID NO: 128807 - protein, 8 aa, West Nile virus
IPTASGKN

SEQ ID NO: 128808 - protein, 8 aa, West Nile virus
PPAAGKNL

SEQ ID NO: 128809 - protein, 8 aa, West Nile virus
TASGKNLC

SEQ ID NO: 128810 - protein, 8 aa, West Nile virus
ASGKNLCT

SEQ ID NO: 128811 - protein, 8 aa, West Nile virus
SGKNLCTV

SEQ ID NO: 128812 - protein, 8 aa, West Nile virus
GKNLCTVR

SEQ ID NO: 128813 - protein, 8 aa, West Nile virus
KNLCTIRA

SEQ ID NO: 128814 - protein, 8 aa, West Nile virus
NLCTVRAM

SEQ ID NO: 128815 - protein, 8 aa, West Nile virus
LCTVRAMD

SEQ ID NO: 128816 - protein, 8 aa, West Nile virus
CTVRAMDV

SEQ ID NO: 128817 - protein, 8 aa, West Nile virus
TVRAMDVG

SEQ ID NO: 128818 - protein, 8 aa, West Nile virus
VRAMDVGH

SEQ ID NO: 128819 - protein, 8 aa, West Nile virus
RAMDVGFM

SEQ ID NO: 128820 - protein, 8 aa, West Nile virus
AMDVGFMC

SEQ ID NO: 128821 - protein, 8 aa, West Nile virus
MDVGFMCD

SEQ ID NO: 128822 - protein, 8 aa, West Nile virus
DVGFMCDD

SEQ ID NO: 128823 - protein, 8 aa, West Nile virus
VGFMCDDT

SEQ ID NO: 128824 - protein, 8 aa, West Nile virus
GFMCDDTI

SEQ ID NO: 128825 - protein, 8 aa, West Nile virus
FMCDDTIA

SEQ ID NO: 128826 - protein, 8 aa, West Nile virus
MCDDTIAY

SEQ ID NO: 128827 - protein, 8 aa, West Nile virus
CDDTIAYE

SEQ ID NO: 128828 - protein, 8 aa, West Nile virus
DDTIAYEC

SEQ ID NO: 128829 - protein, 8 aa, West Nile virus
TITYECSV

SEQ ID NO: 128830 - protein, 8 aa, West Nile virus
ITYECPAL

SEQ ID NO: 128831 - protein, 8 aa, West Nile virus
AYECPALM

SEQ ID NO: 128832 - protein, 8 aa, West Nile virus
YECPALME

SEQ ID NO: 128833 - protein, 8 aa, West Nile virus
ECPALMEG

SEQ ID NO: 128834 - protein, 8 aa, West Nile virus
CPALMEGN

SEQ ID NO: 128835 - protein, 8 aa, West Nile virus
PALMEGND

SEQ ID NO: 128836 - protein, 8 aa, West Nile virus
ALMEGNDP

SEQ ID NO: 128837 - protein, 8 aa, West Nile virus
LMEGNDPE

SEQ ID NO: 128838 - protein, 8 aa, West Nile virus
MEGNDPED

SEQ ID NO: 128839 - protein, 8 aa, West Nile virus
IDCWCTKA

SEQ ID NO: 128840 - protein, 8 aa, West Nile virus
DCWCTKLA

SEQ ID NO: 128841 - protein, 8 aa, West Nile virus
CWCTKLAV

SEQ ID NO: 128842 - protein, 8 aa, West Nile virus
AVFVRYGR

SEQ ID NO: 128843 - protein, 8 aa, West Nile virus
GRCTRTRH

SEQ ID NO: 128844 - protein, 8 aa, West Nile virus
RCTRTRHS

SEQ ID NO: 128845 - protein, 8 aa, West Nile virus
CTRTRHSR

SEQ ID NO: 128846 - protein, 8 aa, West Nile virus
TRTRHSRR

SEQ ID NO: 128847 - protein, 8 aa, West Nile virus
RTRHSRRS

SEQ ID NO: 128848 - protein, 8 aa, West Nile virus
TRQSRRSR

SEQ ID NO: 128849 - protein, 8 aa, West Nile virus
RHSRRSKR

SEQ ID NO: 128850 - protein, 8 aa, West Nile virus
QSRRSRRS

SEQ ID NO: 128851 - protein, 8 aa, West Nile virus
RRSLTVQA

SEQ ID NO: 128852 - protein, 8 aa, West Nile virus
LTVQTHGK

SEQ ID NO: 128853 - protein, 8 aa, West Nile virus
TVQTHGKS

SEQ ID NO: 128854 - protein, 8 aa, West Nile virus
VQAHGEST

SEQ ID NO: 128855 - protein, 8 aa, West Nile virus
QTHGKSTL

SEQ ID NO: 128856 - protein, 8 aa, West Nile virus
THGESTLS

SEQ ID NO: 128857 - protein, 8 aa, West Nile virus
HGESTLSN

SEQ ID NO: 128858 - protein, 8 aa, West Nile virus
GESTLSNK

SEQ ID NO: 128859 - protein, 8 aa, West Nile virus
ESTLSNKK

SEQ ID NO: 128860 - protein, 8 aa, West Nile virus
STLSNKKG

SEQ ID NO: 128861 - protein, 8 aa, West Nile virus
TLSNKKGA

SEQ ID NO: 128862 - protein, 8 aa, West Nile virus
LSNKKGAW

SEQ ID NO: 128863 - protein, 8 aa, West Nile virus
SNRKGAWL

SEQ ID NO: 128864 - protein, 8 aa, West Nile virus
NRKGAWLD

SEQ ID NO: 128865 - protein, 8 aa, West Nile virus
RKGAWLDS

SEQ ID NO: 128866 - protein, 8 aa, West Nile virus
WLDSTKAS

SEQ ID NO: 128867 - protein, 8 aa, West Nile virus
LDSTKASR

SEQ ID NO: 128868 - protein, 8 aa, West Nile virus
TTQRVVFM

SEQ ID NO: 128869 - protein, 8 aa, West Nile virus
TQRVVFMI

SEQ ID NO: 128870 - protein, 8 aa, West Nile virus
QRVVFMIL

SEQ ID NO: 128871 - protein, 8 aa, West Nile virus
RVVFAVLL

SEQ ID NO: 128872 - protein, 8 aa, West Nile virus
VVFAVLLL

SEQ ID NO: 128873 - protein, 8 aa, West Nile virus
VFAVLLLL

SEQ ID NO: 128874 - protein, 8 aa, West Nile virus
FMILLLLV

SEQ ID NO: 128875 - protein, 8 aa, West Nile virus
MILLLLVA

SEQ ID NO: 128876 - protein, 8 aa, West Nile virus
GMSSRDFL

SEQ ID NO: 128877 - protein, 8 aa, West Nile virus
MSSRDFLE

SEQ ID NO: 128878 - protein, 8 aa, West Nile virus
SSRDFLEG

SEQ ID NO: 128879 - protein, 8 aa, West Nile virus
SRDFLEGV

SEQ ID NO: 128880 - protein, 8 aa, West Nile virus
GVSGATWM

SEQ ID NO: 128881 - protein, 8 aa, West Nile virus
VSGATWMD

SEQ ID NO: 128882 - protein, 8 aa, West Nile virus
DSCVTITA

SEQ ID NO: 128883 - protein, 8 aa, West Nile virus
SCVTLMSK

SEQ ID NO: 128884 - protein, 8 aa, West Nile virus
CVTIMSKN

SEQ ID NO: 128885 - protein, 8 aa, West Nile virus
VTITAKDR

SEQ ID NO: 128886 - protein, 8 aa, West Nile virus
TIMSKNKP

SEQ ID NO: 128887 - protein, 8 aa, West Nile virus
ITAKDRPT

SEQ ID NO: 128888 - protein, 8 aa, West Nile virus
MSKNKPTI

SEQ ID NO: 128889 - protein, 8 aa, West Nile virus
TIDVKMMK

SEQ ID NO: 128890 - protein, 8 aa, West Nile virus
IDVKMMKM

SEQ ID NO: 128891 - protein, 8 aa, West Nile virus
DVKMTNME

SEQ ID NO: 128892 - protein, 8 aa, West Nile virus
VKMTNMEA

SEQ ID NO: 128893 - protein, 8 aa, West Nile virus
MAEVRSYC

SEQ ID NO: 128894 - protein, 8 aa, West Nile virus
GDVRSYCY

SEQ ID NO: 128895 - protein, 8 aa, West Nile virus
EVRSYCYA

SEQ ID NO: 128896 - protein, 8 aa, West Nile virus
VRSYCHLA

SEQ ID NO: 128897 - protein, 8 aa, West Nile virus
ATEISSSA

SEQ ID NO: 128898 - protein, 8 aa, West Nile virus
TEISSSAA

SEQ ID NO: 128899 - protein, 8 aa, West Nile virus
EISSSAAC

SEQ ID NO: 128900 - protein, 8 aa, West Nile virus
ISSSAACP

SEQ ID NO: 128901 - protein, 8 aa, West Nile virus
SSSAACPT

SEQ ID NO: 128902 - protein, 8 aa, West Nile virus
SSAACPTM

SEQ ID NO: 128903 - protein, 8 aa, West Nile virus
SAACPTMG

SEQ ID NO: 128904 - protein, 8 aa, West Nile virus
AMGEAHND

SEQ ID NO: 128905 - protein, 8 aa, West Nile virus
EAHNEKRT

SEQ ID NO: 128906 - protein, 8 aa, West Nile virus
AHNEKRTD

SEQ ID NO: 128907 - protein, 8 aa, West Nile virus
HNEKRTDS

SEQ ID NO: 128908 - protein, 8 aa, West Nile virus
YVCRQGVV

SEQ ID NO: 128909 - protein, 8 aa, West Nile virus
TCAKFTCS

SEQ ID NO: 128910 - protein, 8 aa, West Nile virus
CAKFTCSN

SEQ ID NO: 128911 - protein, 8 aa, West Nile virus
AKFTCSNK

SEQ ID NO: 128912 - protein, 8 aa, West Nile virus
KFTCSNKA

SEQ ID NO: 128913 - protein, 8 aa, West Nile virus
FACTTKAT

SEQ ID NO: 128914 - protein, 8 aa, West Nile virus
ACTTKATG

SEQ ID NO: 128915 - protein, 8 aa, West Nile virus
CTTKATGW

SEQ ID NO: 128916 - protein, 8 aa, West Nile virus
TTKATGWI

SEQ ID NO: 128917 - protein, 8 aa, West Nile virus
TKATGWII

SEQ ID NO: 128918 - protein, 8 aa, West Nile virus
KATGWIIQ

SEQ ID NO: 128919 - protein, 8 aa, West Nile virus
ATGWIIQK

SEQ ID NO: 128920 - protein, 8 aa, West Nile virus
TGWIIQKE

SEQ ID NO: 128921 - protein, 8 aa, West Nile virus
GLTIQREN

SEQ ID NO: 128922 - protein, 8 aa, West Nile virus
LTIQRENV

SEQ ID NO: 128923 - protein, 8 aa, West Nile virus
TIQRENVK

SEQ ID NO: 128924 - protein, 8 aa, West Nile virus
IQRENVKY

SEQ ID NO: 128925 - protein, 8 aa, West Nile virus
QRENVKYE

SEQ ID NO: 128926 - protein, 8 aa, West Nile virus
BIKYEVAI

SEQ ID NO: 128927 - protein, 8 aa, West Nile virus
PTTVESHR

SEQ ID NO: 128928 - protein, 8 aa, West Nile virus
GATQAGRL

SEQ ID NO: 128929 - protein, 8 aa, West Nile virus
AAQAGRFS

SEQ ID NO: 128930 - protein, 8 aa, West Nile virus
TQAGRLSI

SEQ ID NO: 128931 - protein, 8 aa, West Nile virus
QAGRLSIT

SEQ ID NO: 128932 - protein, 8 aa, West Nile virus
AGRLSITP

SEQ ID NO: 128933 - protein, 8 aa, West Nile virus
GRFSVSPA

SEQ ID NO: 128934 - protein, 8 aa, West Nile virus
RFSVSPAA

SEQ ID NO: 128935 - protein, 8 aa, West Nile virus
FSVSPAAP

SEQ ID NO: 128936 - protein, 8 aa, West Nile virus
SVSPAAPT

SEQ ID NO: 128937 - protein, 8 aa, West Nile virus
VSPAAPTH

SEQ ID NO: 128938 - protein, 8 aa, West Nile virus
SPAAPTHT

SEQ ID NO: 128939 - protein, 8 aa, West Nile virus
NLGDYGEV

SEQ ID NO: 128940 - protein, 8 aa, West Nile virus
GEYGEVTM

SEQ ID NO: 128941 - protein, 8 aa, West Nile virus
EYGEVTMD

SEQ ID NO: 128942 - protein, 8 aa, West Nile virus
YGEVTMDC

SEQ ID NO: 128943 - protein, 8 aa, West Nile virus
GEVTIDCE

SEQ ID NO: 128944 - protein, 8 aa, West Nile virus
EVTMDCEP

SEQ ID NO: 128945 - protein, 8 aa, West Nile virus
VTIDCEPR

SEQ ID NO: 128946 - protein, 8 aa, West Nile virus
TIDCEPRS

SEQ ID NO: 128947 - protein, 8 aa, West Nile virus
IDCEPRSG

SEQ ID NO: 128948 - protein, 8 aa, West Nile virus
PRSGVDVD

SEQ ID NO: 128949 - protein, 8 aa, West Nile virus
RSGVDVDA

SEQ ID NO: 128950 - protein, 8 aa, West Nile virus
SGVDVDAF

SEQ ID NO: 128951 - protein, 8 aa, West Nile virus
GVDVDAFY

SEQ ID NO: 128952 - protein, 8 aa, West Nile virus
VDVDAFYV

SEQ ID NO: 128953 - protein, 8 aa, West Nile virus
DVDAFYVM

SEQ ID NO: 128954 - protein, 8 aa, West Nile virus
VDAFYVMT

SEQ ID NO: 128955 - protein, 8 aa, West Nile virus
DAFYVMTV

SEQ ID NO: 128956 - protein, 8 aa, West Nile virus
AFYVMTVG

SEQ ID NO: 128957 - protein, 8 aa, West Nile virus
YVMSVGEK

SEQ ID NO: 128958 - protein, 8 aa, West Nile virus
NLPWSSAE

SEQ ID NO: 128959 - protein, 8 aa, West Nile virus
LPWSSAES

SEQ ID NO: 128960 - protein, 8 aa, West Nile virus
PWSSAESN

SEQ ID NO: 128961 - protein, 8 aa, West Nile virus
NVWRNRET

SEQ ID NO: 128962 - protein, 8 aa, West Nile virus
NWRNREAL

SEQ ID NO: 128963 - protein, 8 aa, West Nile virus
WRNRETLV

SEQ ID NO: 128964 - protein, 8 aa, West Nile virus
RNRETLVE

SEQ ID NO: 128965 - protein, 8 aa, West Nile virus
NRETLVEF

SEQ ID NO: 128966 - protein, 8 aa, West Nile virus
RETLVEFE

SEQ ID NO: 128967 - protein, 8 aa, West Nile virus
ETLVEFEE

SEQ ID NO: 128968 - protein, 8 aa, West Nile virus
TLVEFEEP

SEQ ID NO: 128969 - protein, 8 aa, West Nile virus
LVEFEEPH

SEQ ID NO: 128970 - protein, 8 aa, West Nile virus
VEFEEPHA

SEQ ID NO: 128971 - protein, 8 aa, West Nile virus
LAGTIPVE

SEQ ID NO: 128972 - protein, 8 aa, West Nile virus
AGTIPVEF

SEQ ID NO: 128973 - protein, 8 aa, West Nile virus
GAIPVSFT

SEQ ID NO: 128974 - protein, 8 aa, West Nile virus
AIPVSFTS

SEQ ID NO: 128975 - protein, 8 aa, West Nile virus
IPVSFTSN

SEQ ID NO: 128976 - protein, 8 aa, West Nile virus
PVSFTSNT

SEQ ID NO: 128977 - protein, 8 aa, West Nile virus
LEFSSNTV

SEQ ID NO: 128978 - protein, 8 aa, West Nile virus
SFTSNTVK

SEQ ID NO: 128979 - protein, 8 aa, West Nile virus
FSSNTVTL

SEQ ID NO: 128980 - protein, 8 aa, West Nile virus
TSNTVKLT

SEQ ID NO: 128981 - protein, 8 aa, West Nile virus
RVKMEKLK

SEQ ID NO: 128982 - protein, 8 aa, West Nile virus
VKMEKLKL

SEQ ID NO: 128983 - protein, 8 aa, West Nile virus
KMEKLKLK

SEQ ID NO: 128984 - protein, 8 aa, West Nile virus
GVCSKAFR

SEQ ID NO: 128985 - protein, 8 aa, West Nile virus
VCSKAFRF

SEQ ID NO: 128986 - protein, 8 aa, West Nile virus
NTPADTGH

SEQ ID NO: 128987 - protein, 8 aa, West Nile virus
LELQYTGK

SEQ ID NO: 128988 - protein, 8 aa, West Nile virus
GKDGPCKV

SEQ ID NO: 128989 - protein, 8 aa, West Nile virus
KDGPCKVP

SEQ ID NO: 128990 - protein, 8 aa, West Nile virus
GPCKIPIS

SEQ ID NO: 128991 - protein, 8 aa, West Nile virus
PCKIPITS

SEQ ID NO: 128992 - protein, 8 aa, West Nile virus
CKIPISSV

SEQ ID NO: 128993 - protein, 8 aa, West Nile virus
KIPISSVA

SEQ ID NO: 128994 - protein, 8 aa, West Nile virus
IPITSVAS

SEQ ID NO: 128995 - protein, 8 aa, West Nile virus
TVNPFVSM

SEQ ID NO: 128996 - protein, 8 aa, West Nile virus
VNPFVSVS

SEQ ID NO: 128997 - protein, 8 aa, West Nile virus
NPFVSVST

SEQ ID NO: 128998 - protein, 8 aa, West Nile virus
PFVSVSTA

SEQ ID NO: 128999 - protein, 8 aa, West Nile virus
ATANAKIL

SEQ ID NO: 129000 - protein, 8 aa, West Nile virus
TANAKILV

SEQ ID NO: 129001 - protein, 8 aa, West Nile virus
ANAKILVE

SEQ ID NO: 129002 - protein, 8 aa, West Nile virus
NAKILVEL

SEQ ID NO: 129003 - protein, 8 aa, West Nile virus
AKILVELE

SEQ ID NO: 129004 - protein, 8 aa, West Nile virus
GRGEHQIN

SEQ ID NO: 129005 - protein, 8 aa, West Nile virus
RGEQQISH

SEQ ID NO: 129006 - protein, 8 aa, West Nile virus
GEQQISHH

SEQ ID NO: 129007 - protein, 8 aa, West Nile virus
EHQINHHW

SEQ ID NO: 129008 - protein, 8 aa, West Nile virus
QQINHHWY

SEQ ID NO: 129009 - protein, 8 aa, West Nile virus
QISHHWHK

SEQ ID NO: 129010 - protein, 8 aa, West Nile virus
ISHHWHKS

SEQ ID NO: 129011 - protein, 8 aa, West Nile virus
SHHWHKSG

SEQ ID NO: 129012 - protein, 8 aa, West Nile virus
SIGKAFTA

SEQ ID NO: 129013 - protein, 8 aa, West Nile virus
IGKAFTAT

SEQ ID NO: 129014 - protein, 8 aa, West Nile virus
GKAFTATL

SEQ ID NO: 129015 - protein, 8 aa, West Nile virus
KAFATTLQ

SEQ ID NO: 129016 - protein, 8 aa, West Nile virus
AFATTLQG

SEQ ID NO: 129017 - protein, 8 aa, West Nile virus
FATTLQGA

SEQ ID NO: 129018 - protein, 8 aa, West Nile virus
ATTLQGAQ

SEQ ID NO: 129019 - protein, 8 aa, West Nile virus
TTLQGAQR

SEQ ID NO: 129020 - protein, 8 aa, West Nile virus
TLQGAQRL

SEQ ID NO: 129021 - protein, 8 aa, West Nile virus
LQGAQRLV

SEQ ID NO: 129022 - protein, 8 aa, West Nile virus
QGAQRLVS

SEQ ID NO: 129023 - protein, 8 aa, West Nile virus
FGSVGGVL

SEQ ID NO: 129024 - protein, 8 aa, West Nile virus
GSVGGVFN

SEQ ID NO: 129025 - protein, 8 aa, West Nile virus
SVGGVFNS

SEQ ID NO: 129026 - protein, 8 aa, West Nile virus
VGGVFNSI

SEQ ID NO: 129027 - protein, 8 aa, West Nile virus
GGIFTSFG

SEQ ID NO: 129028 - protein, 8 aa, West Nile virus
GIFTSFGK

SEQ ID NO: 129029 - protein, 8 aa, West Nile virus
IFTSFGKA

SEQ ID NO: 129030 - protein, 8 aa, West Nile virus
FNSIGKAV

SEQ ID NO: 129031 - protein, 8 aa, West Nile virus
NSIGKAVH

SEQ ID NO: 129032 - protein, 8 aa, West Nile virus
SIGKAVHQ

SEQ ID NO: 129033 - protein, 8 aa, West Nile virus
IGKAVHQL

SEQ ID NO: 129034 - protein, 8 aa, West Nile virus
GKAVHQLF

SEQ ID NO: 129035 - protein, 8 aa, West Nile virus
KAVHQLFG

SEQ ID NO: 129036 - protein, 8 aa, West Nile virus
AVHQLFGG

SEQ ID NO: 129037 - protein, 8 aa, West Nile virus
VHQLFGGA

SEQ ID NO: 129038 - protein, 8 aa, West Nile virus
VFGGAFRL

SEQ ID NO: 129039 - protein, 8 aa, West Nile virus
LLLWMGVN

SEQ ID NO: 129040 - protein, 8 aa, West Nile virus
LLWMGISA

SEQ ID NO: 129041 - protein, 8 aa, West Nile virus
VWMGINAR

SEQ ID NO: 129042 - protein, 8 aa, West Nile virus
WMGVNARD

SEQ ID NO: 129043 - protein, 8 aa, West Nile virus
MGISARDR

SEQ ID NO: 129044 - protein, 8 aa, West Nile virus
GISARDRS

SEQ ID NO: 129045 - protein, 8 aa, West Nile virus
INARDKSI

SEQ ID NO: 129046 - protein, 8 aa, West Nile virus
SARDRSIA

SEQ ID NO: 129047 - protein, 8 aa, West Nile virus
SRDRSIAM

SEQ ID NO: 129048 - protein, 8 aa, West Nile virus
RDRSIALM

SEQ ID NO: 129049 - protein, 8 aa, West Nile virus
DKSIALTF

SEQ ID NO: 129050 - protein, 8 aa, West Nile virus
KSIALTFL

SEQ ID NO: 129051 - protein, 8 aa, West Nile virus
IALTFLAI

SEQ ID NO: 129052 - protein, 8 aa, West Nile virus
ALTFLAIG

SEQ ID NO: 129053 - protein, 8 aa, West Nile virus
LTFLAIGG

SEQ ID NO: 129054 - protein, 8 aa, West Nile virus
TFLAIGGV

SEQ ID NO: 129055 - protein, 8 aa, West Nile virus
FLAIGGVL

SEQ ID NO: 129056 - protein, 8 aa, West Nile virus
LAIGGVLL

SEQ ID NO: 129057 - protein, 8 aa, West Nile virus
AVGGILLF

SEQ ID NO: 129058 - protein, 8 aa, West Nile virus
IGGVLLFL

SEQ ID NO: 129059 - protein, 8 aa, West Nile virus
GVLLFLSI

SEQ ID NO: 129060 - protein, 8 aa, West Nile virus
VLLFLSVS

SEQ ID NO: 129061 - protein, 8 aa, West Nile virus
LLFLSANV

SEQ ID NO: 129062 - protein, 8 aa, West Nile virus
LFLSVSVH

SEQ ID NO: 129063 - protein, 8 aa, West Nile virus
FLSINVHA

SEQ ID NO: 129064 - protein, 8 aa, West Nile virus
LSINVHAD

SEQ ID NO: 129065 - protein, 8 aa, West Nile virus
SINVHADT

SEQ ID NO: 129066 - protein, 8 aa, West Nile virus
INVHADTG

SEQ ID NO: 129067 - protein, 8 aa, West Nile virus
DTGCAIDV

SEQ ID NO: 129068 - protein, 8 aa, West Nile virus
TGCAIDLK

SEQ ID NO: 129069 - protein, 8 aa, West Nile virus
GCAIDLKR

SEQ ID NO: 129070 - protein, 8 aa, West Nile virus
CAIDLKRQ

SEQ ID NO: 129071 - protein, 8 aa, West Nile virus
AIDLKRQE

SEQ ID NO: 129072 - protein, 8 aa, West Nile virus
IDLKRQEL

SEQ ID NO: 129073 - protein, 8 aa, West Nile virus
DLKRQELR

SEQ ID NO: 129074 - protein, 8 aa, West Nile virus
LKRQELRC

SEQ ID NO: 129075 - protein, 8 aa, West Nile virus
KRQELRCG

SEQ ID NO: 129076 - protein, 8 aa, West Nile virus
FIHNDVEV

SEQ ID NO: 129077 - protein, 8 aa, West Nile virus
IHNDVEVW

SEQ ID NO: 129078 - protein, 8 aa, West Nile virus
NDVEAWID

SEQ ID NO: 129079 - protein, 8 aa, West Nile virus
DVEAWIDR

SEQ ID NO: 129080 - protein, 8 aa, West Nile virus
VEAWIDRY

SEQ ID NO: 129081 - protein, 8 aa, West Nile virus
EAWIDRYK

SEQ ID NO: 129082 - protein, 8 aa, West Nile virus
DRYRYHPE

SEQ ID NO: 129083 - protein, 8 aa, West Nile virus
RYRYHPET

SEQ ID NO: 129084 - protein, 8 aa, West Nile virus
YRYHPETP

SEQ ID NO: 129085 - protein, 8 aa, West Nile virus
RYHPETPQ

SEQ ID NO: 129086 - protein, 8 aa, West Nile virus
YHPETPQG

SEQ ID NO: 129087 - protein, 8 aa, West Nile virus
TPQGLARI

SEQ ID NO: 129088 - protein, 8 aa, West Nile virus
PQGLARII

SEQ ID NO: 129089 - protein, 8 aa, West Nile virus
QGLARIIQ

SEQ ID NO: 129090 - protein, 8 aa, West Nile virus
GLARVIQK

SEQ ID NO: 129091 - protein, 8 aa, West Nile virus
LAKVIQKA

SEQ ID NO: 129092 - protein, 8 aa, West Nile virus
ARVIQKAH

SEQ ID NO: 129093 - protein, 8 aa, West Nile virus
IHNAHKEG

SEQ ID NO: 129094 - protein, 8 aa, West Nile virus
AHQEGVCG

SEQ ID NO: 129095 - protein, 8 aa, West Nile virus
EGICGLRS

SEQ ID NO: 129096 - protein, 8 aa, West Nile virus
GVCGLRSA

SEQ ID NO: 129097 - protein, 8 aa, West Nile virus
TCGIRSVS

SEQ ID NO: 129098 - protein, 8 aa, West Nile virus
CGIRSVSR

SEQ ID NO: 129099 - protein, 8 aa, West Nile virus
GIRSVSRL

SEQ ID NO: 129100 - protein, 8 aa, West Nile virus
LRSASRLE

SEQ ID NO: 129101 - protein, 8 aa, West Nile virus
LEHQMWDS

SEQ ID NO: 129102 - protein, 8 aa, West Nile virus
EHQMWEAI

SEQ ID NO: 129103 - protein, 8 aa, West Nile virus
HQMWEAIK

SEQ ID NO: 129104 - protein, 8 aa, West Nile virus
QMWEAIKD

SEQ ID NO: 129105 - protein, 8 aa, West Nile virus
MWEAIKDE

SEQ ID NO: 129106 - protein, 8 aa, West Nile virus
WEAIKDEL

SEQ ID NO: 129107 - protein, 8 aa, West Nile virus
EAIKDELN

SEQ ID NO: 129108 - protein, 8 aa, West Nile virus
AIKDELNT

SEQ ID NO: 129109 - protein, 8 aa, West Nile virus
TLFRENGI

SEQ ID NO: 129110 - protein, 8 aa, West Nile virus
PLKENGVD

SEQ ID NO: 129111 - protein, 8 aa, West Nile virus
FRENGIDL

SEQ ID NO: 129112 - protein, 8 aa, West Nile virus
KENGVDLT

SEQ ID NO: 129113 - protein, 8 aa, West Nile virus
ENGIDLSI

SEQ ID NO: 129114 - protein, 8 aa, West Nile virus
NGIDLSIV

SEQ ID NO: 129115 - protein, 8 aa, West Nile virus
GIDLSIVV

SEQ ID NO: 129116 - protein, 8 aa, West Nile virus
IDLSIVVE

SEQ ID NO: 129117 - protein, 8 aa, West Nile virus
DLSMVVEK

SEQ ID NO: 129118 - protein, 8 aa, West Nile virus
LTVVVEKQ

SEQ ID NO: 129119 - protein, 8 aa, West Nile virus
VVEKQSGL

SEQ ID NO: 129120 - protein, 8 aa, West Nile virus
APRRLAAT

SEQ ID NO: 129121 - protein, 8 aa, West Nile virus
ATTENLEI

SEQ ID NO: 129122 - protein, 8 aa, West Nile virus
TTENLEIG

SEQ ID NO: 129123 - protein, 8 aa, West Nile virus
TENLEIGW

SEQ ID NO: 129124 - protein, 8 aa, West Nile virus
ENLEIGWK

SEQ ID NO: 129125 - protein, 8 aa, West Nile virus
NLEIGWKA

SEQ ID NO: 129126 - protein, 8 aa, West Nile virus
SIMFASEL

SEQ ID NO: 129127 - protein, 8 aa, West Nile virus
IMFASELA

SEQ ID NO: 129128 - protein, 8 aa, West Nile virus
IFAPEIAN

SEQ ID NO: 129129 - protein, 8 aa, West Nile virus
FAPEIANN

SEQ ID NO: 129130 - protein, 8 aa, West Nile virus
APEIANNT

SEQ ID NO: 129131 - protein, 8 aa, West Nile virus
PEIANNTF

SEQ ID NO: 129132 - protein, 8 aa, West Nile virus
EIANNTFV

SEQ ID NO: 129133 - protein, 8 aa, West Nile virus
LANHTFVI

SEQ ID NO: 129134 - protein, 8 aa, West Nile virus
ANHTFVID

SEQ ID NO: 129135 - protein, 8 aa, West Nile virus
NHTFVIDG

SEQ ID NO: 129136 - protein, 8 aa, West Nile virus
HTFVIDGP

SEQ ID NO: 129137 - protein, 8 aa, West Nile virus
TFVVDGSE

SEQ ID NO: 129138 - protein, 8 aa, West Nile virus
FVVDGSET

SEQ ID NO: 129139 - protein, 8 aa, West Nile virus
VIDGPETK

SEQ ID NO: 129140 - protein, 8 aa, West Nile virus
IDGPETKE

SEQ ID NO: 129141 - protein, 8 aa, West Nile virus
DGSETREC

SEQ ID NO: 129142 - protein, 8 aa, West Nile virus
GSETRECP

SEQ ID NO: 129143 - protein, 8 aa, West Nile virus
PETKECPS

SEQ ID NO: 129144 - protein, 8 aa, West Nile virus
DRAWNSLE

SEQ ID NO: 129145 - protein, 8 aa, West Nile virus
LMTTRMFL

SEQ ID NO: 129146 - protein, 8 aa, West Nile virus
TSTRMFMK

SEQ ID NO: 129147 - protein, 8 aa, West Nile virus
VREGNTTE

SEQ ID NO: 129148 - protein, 8 aa, West Nile virus
REGNTTEC

SEQ ID NO: 129149 - protein, 8 aa, West Nile virus
EGNTTECD

SEQ ID NO: 129150 - protein, 8 aa, West Nile virus
SNTTECDT

SEQ ID NO: 129151 - protein, 8 aa, West Nile virus
TTECDSKT

SEQ ID NO: 129152 - protein, 8 aa, West Nile virus
TECDSKTI

SEQ ID NO: 129153 - protein, 8 aa, West Nile virus
ECDSKTIG

SEQ ID NO: 129154 - protein, 8 aa, West Nile virus
CDSKTIGT

SEQ ID NO: 129155 - protein, 8 aa, West Nile virus
DSKTIGTA

SEQ ID NO: 129156 - protein, 8 aa, West Nile virus
SKTIGTAV

SEQ ID NO: 129157 - protein, 8 aa, West Nile virus
AVKNNLAV

SEQ ID NO: 129158 - protein, 8 aa, West Nile virus
IKNNLAIH

SEQ ID NO: 129159 - protein, 8 aa, West Nile virus
SYWIESRF

SEQ ID NO: 129160 - protein, 8 aa, West Nile virus
YWIESRFN

SEQ ID NO: 129161 - protein, 8 aa, West Nile virus
LNETWKLE

SEQ ID NO: 129162 - protein, 8 aa, West Nile virus
NHTWKLER

SEQ ID NO: 129163 - protein, 8 aa, West Nile virus
HTWKLERA

SEQ ID NO: 129164 - protein, 8 aa, West Nile virus
HTLWGEGI

SEQ ID NO: 129165 - protein, 8 aa, West Nile virus
TLWGEGIL

SEQ ID NO: 129166 - protein, 8 aa, West Nile virus
LWGEGILE

SEQ ID NO: 129167 - protein, 8 aa, West Nile virus
WGEGILES

SEQ ID NO: 129168 - protein, 8 aa, West Nile virus
GVQESDLI

SEQ ID NO: 129169 - protein, 8 aa, West Nile virus
VQESDLII

SEQ ID NO: 129170 - protein, 8 aa, West Nile virus
LESELIIP

SEQ ID NO: 129171 - protein, 8 aa, West Nile virus
ESELIIPI

SEQ ID NO: 129172 - protein, 8 aa, West Nile virus
SELIIPIT

SEQ ID NO: 129173 - protein, 8 aa, West Nile virus
DLIIPATL

SEQ ID NO: 129174 - protein, 8 aa, West Nile virus
IPITLAGL

SEQ ID NO: 129175 - protein, 8 aa, West Nile virus
PITLAGLR

SEQ ID NO: 129176 - protein, 8 aa, West Nile virus
ITLAGLRS

SEQ ID NO: 129177 - protein, 8 aa, West Nile virus
LAGPRSNY

SEQ ID NO: 129178 - protein, 8 aa, West Nile virus
AGPKSNHN

SEQ ID NO: 129179 - protein, 8 aa, West Nile virus
GPKSNHNK

SEQ ID NO: 129180 - protein, 8 aa, West Nile virus
PKSNHNKR

SEQ ID NO: 129181 - protein, 8 aa, West Nile virus
WDEGRIEI

SEQ ID NO: 129182 - protein, 8 aa, West Nile virus
DEGRIEID

SEQ ID NO: 129183 - protein, 8 aa, West Nile virus
EGRIEIDF

SEQ ID NO: 129184 - protein, 8 aa, West Nile virus
GRIEIDFD

SEQ ID NO: 129185 - protein, 8 aa, West Nile virus
RIEIDFDY

SEQ ID NO: 129186 - protein, 8 aa, West Nile virus
IEIDFDYC

SEQ ID NO: 129187 - protein, 8 aa, West Nile virus
PGTTVTLR

SEQ ID NO: 129188 - protein, 8 aa, West Nile virus
RCGHRGPA

SEQ ID NO: 129189 - protein, 8 aa, West Nile virus
CGHRGPAI

SEQ ID NO: 129190 - protein, 8 aa, West Nile virus
GHRGPAIR

SEQ ID NO: 129191 - protein, 8 aa, West Nile virus
HRGPAIRT

SEQ ID NO: 129192 - protein, 8 aa, West Nile virus
RGPAIRTT

SEQ ID NO: 129193 - protein, 8 aa, West Nile virus
GPAIRTTT

SEQ ID NO: 129194 - protein, 8 aa, West Nile virus
PAIRTTTE

SEQ ID NO: 129195 - protein, 8 aa, West Nile virus
AIRTTTES

SEQ ID NO: 129196 - protein, 8 aa, West Nile virus
IRTTTESG

SEQ ID NO: 129197 - protein, 8 aa, West Nile virus
TLPPLRYR

SEQ ID NO: 129198 - protein, 8 aa, West Nile virus
LPPLRYRT

SEQ ID NO: 129199 - protein, 8 aa, West Nile virus
PPLRYRTE

SEQ ID NO: 129200 - protein, 8 aa, West Nile virus
TESGCWYG

SEQ ID NO: 129201 - protein, 8 aa, West Nile virus
ESGCWYGM

SEQ ID NO: 129202 - protein, 8 aa, West Nile virus
YGMEIRPL

SEQ ID NO: 129203 - protein, 8 aa, West Nile virus
GMEIRPLR

SEQ ID NO: 129204 - protein, 8 aa, West Nile virus
MEIRPLRH

SEQ ID NO: 129205 - protein, 8 aa, West Nile virus
EIRPLRHD

SEQ ID NO: 129206 - protein, 8 aa, West Nile virus
IRPLRHDE

SEQ ID NO: 129207 - protein, 8 aa, West Nile virus
RPLRHDEK

SEQ ID NO: 129208 - protein, 8 aa, West Nile virus
PLRHDEKT

SEQ ID NO: 129209 - protein, 8 aa, West Nile virus
LRHDEKTL

SEQ ID NO: 129210 - protein, 8 aa, West Nile virus
KHDEKTLV

SEQ ID NO: 129211 - protein, 8 aa, West Nile virus
EKTLVQSK

SEQ ID NO: 129212 - protein, 8 aa, West Nile virus
KTLVQSKV

SEQ ID NO: 129213 - protein, 8 aa, West Nile virus
TLVQSKVT

SEQ ID NO: 129214 - protein, 8 aa, West Nile virus
LVQSKVTA

SEQ ID NO: 129215 - protein, 8 aa, West Nile virus
VQSKVTAY

SEQ ID NO: 129216 - protein, 8 aa, West Nile virus
QSKVTAYN

SEQ ID NO: 129217 - protein, 8 aa, West Nile virus
SKVTAYNA

SEQ ID NO: 129218 - protein, 8 aa, West Nile virus
KVTAYNAD

SEQ ID NO: 129219 - protein, 8 aa, West Nile virus
VNAYNAEM

SEQ ID NO: 129220 - protein, 8 aa, West Nile virus
NAHNADMI

SEQ ID NO: 129221 - protein, 8 aa, West Nile virus
AYKSDMID

SEQ ID NO: 129222 - protein, 8 aa, West Nile virus
YKSDMIDP

SEQ ID NO: 129223 - protein, 8 aa, West Nile virus
QLGLLIVF

SEQ ID NO: 129224 - protein, 8 aa, West Nile virus
LGLLVVVL

SEQ ID NO: 129225 - protein, 8 aa, West Nile virus
GLLIVFLA

SEQ ID NO: 129226 - protein, 8 aa, West Nile virus
LLVVFLVT

SEQ ID NO: 129227 - protein, 8 aa, West Nile virus
LVVFLATK

SEQ ID NO: 129228 - protein, 8 aa, West Nile virus
VVFLATKE

SEQ ID NO: 129229 - protein, 8 aa, West Nile virus
VVLATQEV

SEQ ID NO: 129230 - protein, 8 aa, West Nile virus
FLATKEVL

SEQ ID NO: 129231 - protein, 8 aa, West Nile virus
ATQEVLRR

SEQ ID NO: 129232 - protein, 8 aa, West Nile virus
RWTAKISV

SEQ ID NO: 129233 - protein, 8 aa, West Nile virus
WTAKISVP

SEQ ID NO: 129234 - protein, 8 aa, West Nile virus
TAKISVPA

SEQ ID NO: 129235 - protein, 8 aa, West Nile virus
AKISVPAI

SEQ ID NO: 129236 - protein, 8 aa, West Nile virus
PAIIIALL

SEQ ID NO: 129237 - protein, 8 aa, West Nile virus
AIIIALLT

SEQ ID NO: 129238 - protein, 8 aa, West Nile virus
IIIALLTL

SEQ ID NO: 129239 - protein, 8 aa, West Nile virus
IIALLTLV

SEQ ID NO: 129240 - protein, 8 aa, West Nile virus
IALLTLVF

SEQ ID NO: 129241 - protein, 8 aa, West Nile virus
ALLVLVLG

SEQ ID NO: 129242 - protein, 8 aa, West Nile virus
LLVLVLGG

SEQ ID NO: 129243 - protein, 8 aa, West Nile virus
LVLVLGGI

SEQ ID NO: 129244 - protein, 8 aa, West Nile virus
VLVLGGIT

SEQ ID NO: 129245 - protein, 8 aa, West Nile virus
LVLGGITY

SEQ ID NO: 129246 - protein, 8 aa, West Nile virus
VLGGITYT

SEQ ID NO: 129247 - protein, 8 aa, West Nile virus
LGGITYTD

SEQ ID NO: 129248 - protein, 8 aa, West Nile virus
GGITYIDV

SEQ ID NO: 129249 - protein, 8 aa, West Nile virus
GVTYTDVL

SEQ ID NO: 129250 - protein, 8 aa, West Nile virus
ITYIDVLR

SEQ ID NO: 129251 - protein, 8 aa, West Nile virus
TYADVLRY

SEQ ID NO: 129252 - protein, 8 aa, West Nile virus
YIDVLRYV

SEQ ID NO: 129253 - protein, 8 aa, West Nile virus
TDVLRYII

SEQ ID NO: 129254 - protein, 8 aa, West Nile virus
DVLRYVNL

SEQ ID NO: 129255 - protein, 8 aa, West Nile virus
VLRYIILV

SEQ ID NO: 129256 - protein, 8 aa, West Nile virus
LRYVNLVG

SEQ ID NO: 129257 - protein, 8 aa, West Nile virus
RYVNLVGA

SEQ ID NO: 129258 - protein, 8 aa, West Nile virus
YVNLVGAA

SEQ ID NO: 129259 - protein, 8 aa, West Nile virus
VNLVGAAF

SEQ ID NO: 129260 - protein, 8 aa, West Nile virus
ILVGAAFM

SEQ ID NO: 129261 - protein, 8 aa, West Nile virus
VGAAFMEA

SEQ ID NO: 129262 - protein, 8 aa, West Nile virus
ALMATFRI

SEQ ID NO: 129263 - protein, 8 aa, West Nile virus
LMATFRIQ

SEQ ID NO: 129264 - protein, 8 aa, West Nile virus
MATFRIQP

SEQ ID NO: 129265 - protein, 8 aa, West Nile virus
ATFKVQPV

SEQ ID NO: 129266 - protein, 8 aa, West Nile virus
TFKVQPVF

SEQ ID NO: 129267 - protein, 8 aa, West Nile virus
IQPAFMVA

SEQ ID NO: 129268 - protein, 8 aa, West Nile virus
QPAFMVAS

SEQ ID NO: 129269 - protein, 8 aa, West Nile virus
PAFMVASF

SEQ ID NO: 129270 - protein, 8 aa, West Nile virus
AFMVASFL

SEQ ID NO: 129271 - protein, 8 aa, West Nile virus
FVVASFLK

SEQ ID NO: 129272 - protein, 8 aa, West Nile virus
MVASFLKT

SEQ ID NO: 129273 - protein, 8 aa, West Nile virus
VASFLKAK

SEQ ID NO: 129274 - protein, 8 aa, West Nile virus
ASFLKAKW

SEQ ID NO: 129275 - protein, 8 aa, West Nile virus
SFLKAKWT

SEQ ID NO: 129276 - protein, 8 aa, West Nile virus
FLKAKWTN

SEQ ID NO: 129277 - protein, 8 aa, West Nile virus
KAKWTNQE

SEQ ID NO: 129278 - protein, 8 aa, West Nile virus
TRWTNQES

SEQ ID NO: 129279 - protein, 8 aa, West Nile virus
KWTNQESI

SEQ ID NO: 129280 - protein, 8 aa, West Nile virus
WTNHENIL

SEQ ID NO: 129281 - protein, 8 aa, West Nile virus
TNHENILL

SEQ ID NO: 129282 - protein, 8 aa, West Nile virus
NHENILLM

SEQ ID NO: 129283 - protein, 8 aa, West Nile virus
HENILLML

SEQ ID NO: 129284 - protein, 8 aa, West Nile virus
VFFQMAYY

SEQ ID NO: 129285 - protein, 8 aa, West Nile virus
FFQMAYID

SEQ ID NO: 129286 - protein, 8 aa, West Nile virus
FQMAYIDS

SEQ ID NO: 129287 - protein, 8 aa, West Nile virus
QMAYYDAR

SEQ ID NO: 129288 - protein, 8 aa, West Nile virus
WEMPDVLN

SEQ ID NO: 129289 - protein, 8 aa, West Nile virus
NIPDVLNS

SEQ ID NO: 129290 - protein, 8 aa, West Nile virus
MPDVLNSL

SEQ ID NO: 129291 - protein, 8 aa, West Nile virus
DVLNSLAA

SEQ ID NO: 129292 - protein, 8 aa, West Nile virus
VLNSLAIA

SEQ ID NO: 129293 - protein, 8 aa, West Nile virus
LNSLAIAW

SEQ ID NO: 129294 - protein, 8 aa, West Nile virus
NSLAAAWM

SEQ ID NO: 129295 - protein, 8 aa, West Nile virus
SLAAAWMI

SEQ ID NO: 129296 - protein, 8 aa, West Nile virus
LAIAWMIL

SEQ ID NO: 129297 - protein, 8 aa, West Nile virus
AVAWMVLR

SEQ ID NO: 129298 - protein, 8 aa, West Nile virus
VAWMVLRA

SEQ ID NO: 129299 - protein, 8 aa, West Nile virus
WMILRAIG

SEQ ID NO: 129300 - protein, 8 aa, West Nile virus
MILRAIGF

SEQ ID NO: 129301 - protein, 8 aa, West Nile virus
ILRAIGFT

SEQ ID NO: 129302 - protein, 8 aa, West Nile virus
FTTTSNVA

SEQ ID NO: 129303 - protein, 8 aa, West Nile virus
TTTSNVAT

SEQ ID NO: 129304 - protein, 8 aa, West Nile virus
TTSNVATP

SEQ ID NO: 129305 - protein, 8 aa, West Nile virus
SNVVVPLM

SEQ ID NO: 129306 - protein, 8 aa, West Nile virus
NVVVPLMA

SEQ ID NO: 129307 - protein, 8 aa, West Nile virus
VVVPLMAL

SEQ ID NO: 129308 - protein, 8 aa, West Nile virus
VVPLMALL

SEQ ID NO: 129309 - protein, 8 aa, West Nile virus
VPLMALLT

SEQ ID NO: 129310 - protein, 8 aa, West Nile virus
LLALLTPR

SEQ ID NO: 129311 - protein, 8 aa, West Nile virus
LALLTPRL

SEQ ID NO: 129312 - protein, 8 aa, West Nile virus
ALLTPRLR

SEQ ID NO: 129313 - protein, 8 aa, West Nile virus
FLTPGLKC

SEQ ID NO: 129314 - protein, 8 aa, West Nile virus
TPGLKCLH

SEQ ID NO: 129315 - protein, 8 aa, West Nile virus
PGLKCLHL

SEQ ID NO: 129316 - protein, 8 aa, West Nile virus
GLKCLHLD

SEQ ID NO: 129317 - protein, 8 aa, West Nile virus
LKCLHLDI

SEQ ID NO: 129318 - protein, 8 aa, West Nile virus
KCLHLDIY

SEQ ID NO: 129319 - protein, 8 aa, West Nile virus
CLNLDVSR

SEQ ID NO: 129320 - protein, 8 aa, West Nile virus
LNLDVSRI

SEQ ID NO: 129321 - protein, 8 aa, West Nile virus
NLDVSRIL

SEQ ID NO: 129322 - protein, 8 aa, West Nile virus
LDVYKILL

SEQ ID NO: 129323 - protein, 8 aa, West Nile virus
DVSRILLL

SEQ ID NO: 129324 - protein, 8 aa, West Nile virus
VYKILLLM

SEQ ID NO: 129325 - protein, 8 aa, West Nile virus
SRILLLMV

SEQ ID NO: 129326 - protein, 8 aa, West Nile virus
KILLLMVG

SEQ ID NO: 129327 - protein, 8 aa, West Nile virus
IVLLMIGI

SEQ ID NO: 129328 - protein, 8 aa, West Nile virus
LLLMIGIG

SEQ ID NO: 129329 - protein, 8 aa, West Nile virus
LLMIGIGS

SEQ ID NO: 129330 - protein, 8 aa, West Nile virus
LMIGIGSL

SEQ ID NO: 129331 - protein, 8 aa, West Nile virus
MVGVGSLV

SEQ ID NO: 129332 - protein, 8 aa, West Nile virus
VGVGSLVK

SEQ ID NO: 129333 - protein, 8 aa, West Nile virus
GVGSLVKE

SEQ ID NO: 129334 - protein, 8 aa, West Nile virus
VGSLVKER

SEQ ID NO: 129335 - protein, 8 aa, West Nile virus
GSLVKERR

SEQ ID NO: 129336 - protein, 8 aa, West Nile virus
SLVKERRS

SEQ ID NO: 129337 - protein, 8 aa, West Nile virus
ERRSAVAK

SEQ ID NO: 129338 - protein, 8 aa, West Nile virus
RRSAVAKK

SEQ ID NO: 129339 - protein, 8 aa, West Nile virus
RSAVAKKK

SEQ ID NO: 129340 - protein, 8 aa, West Nile virus
SAVAKKKG

SEQ ID NO: 129341 - protein, 8 aa, West Nile virus
AVAKKKGA

SEQ ID NO: 129342 - protein, 8 aa, West Nile virus
VAKKKGAS

SEQ ID NO: 129343 - protein, 8 aa, West Nile virus
KKKGASLI

SEQ ID NO: 129344 - protein, 8 aa, West Nile virus
KKGASLIC

SEQ ID NO: 129345 - protein, 8 aa, West Nile virus
KGASLICL

SEQ ID NO: 129346 - protein, 8 aa, West Nile virus
GASLICLA

SEQ ID NO: 129347 - protein, 8 aa, West Nile virus
ASLICLAL

SEQ ID NO: 129348 - protein, 8 aa, West Nile virus
SLICLALA

SEQ ID NO: 129349 - protein, 8 aa, West Nile virus
FSPITLAA

SEQ ID NO: 129350 - protein, 8 aa, West Nile virus
SPITLAAG

SEQ ID NO: 129351 - protein, 8 aa, West Nile virus
PLVLAAGL

SEQ ID NO: 129352 - protein, 8 aa, West Nile virus
LILVAGLL

SEQ ID NO: 129353 - protein, 8 aa, West Nile virus
LAAGLMAC

SEQ ID NO: 129354 - protein, 8 aa, West Nile virus
AAGLMACD

SEQ ID NO: 129355 - protein, 8 aa, West Nile virus
AGLMACDP

SEQ ID NO: 129356 - protein, 8 aa, West Nile virus
GLMACDPN

SEQ ID NO: 129357 - protein, 8 aa, West Nile virus
LMACDPNR

SEQ ID NO: 129358 - protein, 8 aa, West Nile virus
MACDPNRK

SEQ ID NO: 129359 - protein, 8 aa, West Nile virus
LAELDIDT

SEQ ID NO: 129360 - protein, 8 aa, West Nile virus
AELDIDTM

SEQ ID NO: 129361 - protein, 8 aa, West Nile virus
ELDIDTMA

SEQ ID NO: 129362 - protein, 8 aa, West Nile virus
LDIDTMAI

SEQ ID NO: 129363 - protein, 8 aa, West Nile virus
DIDTMAIP

SEQ ID NO: 129364 - protein, 8 aa, West Nile virus
MDSMAIPM

SEQ ID NO: 129365 - protein, 8 aa, West Nile virus
AGLMFAAY

SEQ ID NO: 129366 - protein, 8 aa, West Nile virus
GLMFAAYV

SEQ ID NO: 129367 - protein, 8 aa, West Nile virus
LMFAAYVI

SEQ ID NO: 129368 - protein, 8 aa, West Nile virus
MFAAYVIT

SEQ ID NO: 129369 - protein, 8 aa, West Nile virus
FAAYVITG

SEQ ID NO: 129370 - protein, 8 aa, West Nile virus
AAYVITGR

SEQ ID NO: 129371 - protein, 8 aa, West Nile virus
IERTANIS

SEQ ID NO: 129372 - protein, 8 aa, West Nile virus
ERVADISW

SEQ ID NO: 129373 - protein, 8 aa, West Nile virus
RTANISWE

SEQ ID NO: 129374 - protein, 8 aa, West Nile virus
TADISWEG

SEQ ID NO: 129375 - protein, 8 aa, West Nile virus
ADISWEGD

SEQ ID NO: 129376 - protein, 8 aa, West Nile virus
DISWEGDA

SEQ ID NO: 129377 - protein, 8 aa, West Nile virus
ISWEGDAE

SEQ ID NO: 129378 - protein, 8 aa, West Nile virus
SWEGDAEI

SEQ ID NO: 129379 - protein, 8 aa, West Nile virus
WESDVEIT

SEQ ID NO: 129380 - protein, 8 aa, West Nile virus
ENDAEITG

SEQ ID NO: 129381 - protein, 8 aa, West Nile virus
GDAEITGS

SEQ ID NO: 129382 - protein, 8 aa, West Nile virus
DVEITGSS

SEQ ID NO: 129383 - protein, 8 aa, West Nile virus
VEITGSSE

SEQ ID NO: 129384 - protein, 8 aa, West Nile virus
SSDRVDVK

SEQ ID NO: 129385 - protein, 8 aa, West Nile virus
VRLDDGEN

SEQ ID NO: 129386 - protein, 8 aa, West Nile virus
RLDDGENF

SEQ ID NO: 129387 - protein, 8 aa, West Nile virus
DGENFQLM

SEQ ID NO: 129388 - protein, 8 aa, West Nile virus
DGNFQLMS

SEQ ID NO: 129389 - protein, 8 aa, West Nile virus
ENFQLMND

SEQ ID NO: 129390 - protein, 8 aa, West Nile virus
DFQLMNDP

SEQ ID NO: 129391 - protein, 8 aa, West Nile virus
PWKLWMLR

SEQ ID NO: 129392 - protein, 8 aa, West Nile virus
WKIWMLKM

SEQ ID NO: 129393 - protein, 8 aa, West Nile virus
WMLRMTCL

SEQ ID NO: 129394 - protein, 8 aa, West Nile virus
MLRMTCLA

SEQ ID NO: 129395 - protein, 8 aa, West Nile virus
MTCLAVSA

SEQ ID NO: 129396 - protein, 8 aa, West Nile virus
TCLAVSAY

SEQ ID NO: 129397 - protein, 8 aa, West Nile virus
WAVLPSVV

SEQ ID NO: 129398 - protein, 8 aa, West Nile virus
AILPSIVG

SEQ ID NO: 129399 - protein, 8 aa, West Nile virus
ILPSIVGF

SEQ ID NO: 129400 - protein, 8 aa, West Nile virus
SIVGFWIT

SEQ ID NO: 129401 - protein, 8 aa, West Nile virus
IVGFWITL

SEQ ID NO: 129402 - protein, 8 aa, West Nile virus
TPSPREYR

SEQ ID NO: 129403 - protein, 8 aa, West Nile virus
EYRKGDTT

SEQ ID NO: 129404 - protein, 8 aa, West Nile virus
YRKGDTTT

SEQ ID NO: 129405 - protein, 8 aa, West Nile virus
RKGDTTTG

SEQ ID NO: 129406 - protein, 8 aa, West Nile virus
GGPWKLGH

SEQ ID NO: 129407 - protein, 8 aa, West Nile virus
GPWKLGHR

SEQ ID NO: 129408 - protein, 8 aa, West Nile virus
PWKLGHRW

SEQ ID NO: 129409 - protein, 8 aa, West Nile virus
WKLQHRWN

SEQ ID NO: 129410 - protein, 8 aa, West Nile virus
KLGHRWNG

SEQ ID NO: 129411 - protein, 8 aa, West Nile virus
LQRKWNGL

SEQ ID NO: 129412 - protein, 8 aa, West Nile virus
QRKWNGLD

SEQ ID NO: 129413 - protein, 8 aa, West Nile virus
RKWNGLDE

SEQ ID NO: 129414 - protein, 8 aa, West Nile virus
KWNGLDEV

SEQ ID NO: 129415 - protein, 8 aa, West Nile virus
WNGLDEVQ

SEQ ID NO: 129416 - protein, 8 aa, West Nile virus
NGLDEVQM

SEQ ID NO: 129417 - protein, 8 aa, West Nile virus
GLDEVQMI

SEQ ID NO: 129418 - protein, 8 aa, West Nile virus
LDEVQMIV

SEQ ID NO: 129419 - protein, 8 aa, West Nile virus
IVVKPGES

SEQ ID NO: 129420 - protein, 8 aa, West Nile virus
VVEPGKNA

SEQ ID NO: 129421 - protein, 8 aa, West Nile virus
VEPGKNAK

SEQ ID NO: 129422 - protein, 8 aa, West Nile virus
EPGKNAKN

SEQ ID NO: 129423 - protein, 8 aa, West Nile virus
PGKNAKNV

SEQ ID NO: 129424 - protein, 8 aa, West Nile virus
GKNAKNVQ

SEQ ID NO: 129425 - protein, 8 aa, West Nile virus
KNAKNVQT

SEQ ID NO: 129426 - protein, 8 aa, West Nile virus
NAKNVQTK

SEQ ID NO: 129427 - protein, 8 aa, West Nile virus
AKNVQTKP

SEQ ID NO: 129428 - protein, 8 aa, West Nile virus
SPIVDKNS

SEQ ID NO: 129429 - protein, 8 aa, West Nile virus
PIVDKSGD

SEQ ID NO: 129430 - protein, 8 aa, West Nile virus
IVDKSGDV

SEQ ID NO: 129431 - protein, 8 aa, West Nile virus
VDKSGDVI

SEQ ID NO: 129432 - protein, 8 aa, West Nile virus
DKNSDVIG

SEQ ID NO: 129433 - protein, 8 aa, West Nile virus
KNSDVIGL

SEQ ID NO: 129434 - protein, 8 aa, West Nile virus
GVIMPSGS

SEQ ID NO: 129435 - protein, 8 aa, West Nile virus
VIMPSGSY

SEQ ID NO: 129436 - protein, 8 aa, West Nile virus
IMPSGSYI

SEQ ID NO: 129437 - protein, 8 aa, West Nile virus
MPSGSYIS

SEQ ID NO: 129438 - protein, 8 aa, West Nile virus
PSGSYISA

SEQ ID NO: 129439 - protein, 8 aa, West Nile virus
SGSYISAI

SEQ ID NO: 129440 - protein, 8 aa, West Nile virus
GERMDEPV

SEQ ID NO: 129441 - protein, 8 aa, West Nile virus
ERMDEPVP

SEQ ID NO: 129442 - protein, 8 aa, West Nile virus
RMDEPVPA

SEQ ID NO: 129443 - protein, 8 aa, West Nile virus
MDEPVPAG

SEQ ID NO: 129444 - protein, 8 aa, West Nile virus
DEPVPAGF

SEQ ID NO: 129445 - protein, 8 aa, West Nile virus
GFESEMLR

SEQ ID NO: 129446 - protein, 8 aa, West Nile virus
FEPETLKK

SEQ ID NO: 129447 - protein, 8 aa, West Nile virus
DPEMLRKK

SEQ ID NO: 129448 - protein, 8 aa, West Nile virus
SEMLRKKQ

SEQ ID NO: 129449 - protein, 8 aa, West Nile virus
ETLKKKQI

SEQ ID NO: 129450 - protein, 8 aa, West Nile virus
MLRKKQIS

SEQ ID NO: 129451 - protein, 8 aa, West Nile virus
LRKKQISV

SEQ ID NO: 129452 - protein, 8 aa, West Nile virus
KKKQITVL

SEQ ID NO: 129453 - protein, 8 aa, West Nile virus
KILPQIIR

SEQ ID NO: 129454 - protein, 8 aa, West Nile virus
QIIKEAID

SEQ ID NO: 129455 - protein, 8 aa, West Nile virus
IIREAINR

SEQ ID NO: 129456 - protein, 8 aa, West Nile virus
IREAINRR

SEQ ID NO: 129457 - protein, 8 aa, West Nile virus
REAINRRL

SEQ ID NO: 129458 - protein, 8 aa, West Nile virus
EAMNRRLR

SEQ ID NO: 129459 - protein, 8 aa, West Nile virus
AMNRRLRT

SEQ ID NO: 129460 - protein, 8 aa, West Nile virus
ISKRLRTA

SEQ ID NO: 129461 - protein, 8 aa, West Nile virus
NKRLRTAI

SEQ ID NO: 129462 - protein, 8 aa, West Nile virus
KRLRTAIL

SEQ ID NO: 129463 - protein, 8 aa, West Nile virus
RVVASEMA

SEQ ID NO: 129464 - protein, 8 aa, West Nile virus
VVASEMAE

SEQ ID NO: 129465 - protein, 8 aa, West Nile virus
VASEMAEA

SEQ ID NO: 129466 - protein, 8 aa, West Nile virus
ASEMAEAL

SEQ ID NO: 129467 - protein, 8 aa, West Nile virus
SEMAEALR

SEQ ID NO: 129468 - protein, 8 aa, West Nile virus
RYQTSAVT

SEQ ID NO: 129469 - protein, 8 aa, West Nile virus
YQTSAVTR

SEQ ID NO: 129470 - protein, 8 aa, West Nile virus
QTSAVTRE

SEQ ID NO: 129471 - protein, 8 aa, West Nile virus
TSAVHREH

SEQ ID NO: 129472 - protein, 8 aa, West Nile virus
REHTGNEI

SEQ ID NO: 129473 - protein, 8 aa, West Nile virus
EHTGNEIV

SEQ ID NO: 129474 - protein, 8 aa, West Nile virus
HTGNEIVD

SEQ ID NO: 129475 - protein, 8 aa, West Nile virus
TGNEIVDV

SEQ ID NO: 129476 - protein, 8 aa, West Nile virus
ARGYISTR

SEQ ID NO: 129477 - protein, 8 aa, West Nile virus
RGYISTRV

SEQ ID NO: 129478 - protein, 8 aa, West Nile virus
GYISTRVE

SEQ ID NO: 129479 - protein, 8 aa, West Nile virus
YISTRVEL

SEQ ID NO: 129480 - protein, 8 aa, West Nile virus
ISTRVELG

SEQ ID NO: 129481 - protein, 8 aa, West Nile virus
STRVELGE

SEQ ID NO: 129482 - protein, 8 aa, West Nile virus
GTHDPFPE

SEQ ID NO: 129483 - protein, 8 aa, West Nile virus
TSDPFPKS

SEQ ID NO: 129484 - protein, 8 aa, West Nile virus
FPESNAPV

SEQ ID NO: 129485 - protein, 8 aa, West Nile virus
DIQTEIPD

SEQ ID NO: 129486 - protein, 8 aa, West Nile virus
IQTEIPDR

SEQ ID NO: 129487 - protein, 8 aa, West Nile virus
YEWITEYV

SEQ ID NO: 129488 - protein, 8 aa, West Nile virus
EWITEYVG

SEQ ID NO: 129489 - protein, 8 aa, West Nile virus
WITEYVGK

SEQ ID NO: 129490 - protein, 8 aa, West Nile virus
ITEYVGKT

SEQ ID NO: 129491 - protein, 8 aa, West Nile virus
TEYVGKTV

SEQ ID NO: 129492 - protein, 8 aa, West Nile virus
EYVGKTVW

SEQ ID NO: 129493 - protein, 8 aa, West Nile virus
YVGKTVWF

SEQ ID NO: 129494 - protein, 8 aa, West Nile virus
VGKTVWFV

SEQ ID NO: 129495 - protein, 8 aa, West Nile virus
QRAGKRVI

SEQ ID NO: 129496 - protein, 8 aa, West Nile virus
RAGKRVIQ

SEQ ID NO: 129497 - protein, 8 aa, West Nile virus
AGKRVIQL

SEQ ID NO: 129498 - protein, 8 aa, West Nile virus
GKRVIQLN

SEQ ID NO: 129499 - protein, 8 aa, West Nile virus
KRVIQLNR

SEQ ID NO: 129500 - protein, 8 aa, West Nile virus
RVIQLNRK

SEQ ID NO: 129501 - protein, 8 aa, West Nile virus
MGANFKAN

SEQ ID NO: 129502 - protein, 8 aa, West Nile virus
GANFRASR

SEQ ID NO: 129503 - protein, 8 aa, West Nile virus
ANFRASRV

SEQ ID NO: 129504 - protein, 8 aa, West Nile virus
NFRASRVI

SEQ ID NO: 129505 - protein, 8 aa, West Nile virus
FKANRVID

SEQ ID NO: 129506 - protein, 8 aa, West Nile virus
RASRVIDS

SEQ ID NO: 129507 - protein, 8 aa, West Nile virus
SVKPIIIT

SEQ ID NO: 129508 - protein, 8 aa, West Nile virus
VKPTIITD

SEQ ID NO: 129509 - protein, 8 aa, West Nile virus
KPTIITDG

SEQ ID NO: 129510 - protein, 8 aa, West Nile virus
PTIITDGE

SEQ ID NO: 129511 - protein, 8 aa, West Nile virus
ITDGENRV

SEQ ID NO: 129512 - protein, 8 aa, West Nile virus
TDGENRVV

SEQ ID NO: 129513 - protein, 8 aa, West Nile virus
DGENRVVL

SEQ ID NO: 129514 - protein, 8 aa, West Nile virus
GENRVVLG

SEQ ID NO: 129515 - protein, 8 aa, West Nile virus
ENRVVLGE

SEQ ID NO: 129516 - protein, 8 aa, West Nile virus
ARVILGEP

SEQ ID NO: 129517 - protein, 8 aa, West Nile virus
VLGEPSAI

SEQ ID NO: 129518 - protein, 8 aa, West Nile virus
RGRTGRNP

SEQ ID NO: 129519 - protein, 8 aa, West Nile virus
GRIGRNPT

SEQ ID NO: 129520 - protein, 8 aa, West Nile virus
RVGRNPSQ

SEQ ID NO: 129521 - protein, 8 aa, West Nile virus
IGRNPTQV

SEQ ID NO: 129522 - protein, 8 aa, West Nile virus
GRNPSQAG

SEQ ID NO: 129523 - protein, 8 aa, West Nile virus
RNPSQAGD

SEQ ID NO: 129524 - protein, 8 aa, West Nile virus
NPTQVGDE

SEQ ID NO: 129525 - protein, 8 aa, West Nile virus
PTQVGDEY

SEQ ID NO: 129526 - protein, 8 aa, West Nile virus
TNEDDSNL

SEQ ID NO: 129527 - protein, 8 aa, West Nile virus
NEDDSNYA

SEQ ID NO: 129528 - protein, 8 aa, West Nile virus
EDDSNCAH

SEQ ID NO: 129529 - protein, 8 aa, West Nile virus
DDSNYAHW

SEQ ID NO: 129530 - protein, 8 aa, West Nile virus
DSNYAHWT

SEQ ID NO: 129531 - protein, 8 aa, West Nile virus
SNCAHWTE

SEQ ID NO: 129532 - protein, 8 aa, West Nile virus
NLAHWTEA

SEQ ID NO: 129533 - protein, 8 aa, West Nile virus
LAHWTEAR

SEQ ID NO: 129534 - protein, 8 aa, West Nile virus
PNGLIAQL

SEQ ID NO: 129535 - protein, 8 aa, West Nile virus
NGLIAQLY

SEQ ID NO: 129536 - protein, 8 aa, West Nile virus
GLIAQLYQ

SEQ ID NO: 129537 - protein, 8 aa, West Nile virus
LIAQLYQP

SEQ ID NO: 129538 - protein, 8 aa, West Nile virus
IAQLYQPE

SEQ ID NO: 129539 - protein, 8 aa, West Nile virus
REKVYTME

SEQ ID NO: 129540 - protein, 8 aa, West Nile virus
EKVHTMDG

SEQ ID NO: 129541 - protein, 8 aa, West Nile virus
KVCTMDGE

SEQ ID NO: 129542 - protein, 8 aa, West Nile virus
VCTMDGEY

SEQ ID NO: 129543 - protein, 8 aa, West Nile virus
YTMEGEYR

SEQ ID NO: 129544 - protein, 8 aa, West Nile virus
PVWLAYKA

SEQ ID NO: 129545 - protein, 8 aa, West Nile virus
VWLAHKVA

SEQ ID NO: 129546 - protein, 8 aa, West Nile virus
WLAYKVAS

SEQ ID NO: 129547 - protein, 8 aa, West Nile virus
LAHKVAAA

SEQ ID NO: 129548 - protein, 8 aa, West Nile virus
AHKVAAAG

SEQ ID NO: 129549 - protein, 8 aa, West Nile virus
YQVAAAGI

SEQ ID NO: 129550 - protein, 8 aa, West Nile virus
QVAAAGIS

SEQ ID NO: 129551 - protein, 8 aa, West Nile virus
VAAAGVPY

SEQ ID NO: 129552 - protein, 8 aa, West Nile virus
AAAGVPYH

SEQ ID NO: 129553 - protein, 8 aa, West Nile virus
AAGVPYHD

SEQ ID NO: 129554 - protein, 8 aa, West Nile virus
AGVPYHDR

SEQ ID NO: 129555 - protein, 8 aa, West Nile virus
GVPYHDRR

SEQ ID NO: 129556 - protein, 8 aa, West Nile virus
VPYHDRRW

SEQ ID NO: 129557 - protein, 8 aa, West Nile virus
PYHDRRWC

SEQ ID NO: 129558 - protein, 8 aa, West Nile virus
RTNMILED

SEQ ID NO: 129559 - protein, 8 aa, West Nile virus
TNMILEDN

SEQ ID NO: 129560 - protein, 8 aa, West Nile virus
NMILEDNN

SEQ ID NO: 129561 - protein, 8 aa, West Nile virus
MILEDNNE

SEQ ID NO: 129562 - protein, 8 aa, West Nile virus
KILRPRWV

SEQ ID NO: 129563 - protein, 8 aa, West Nile virus
ILRPRWVD

SEQ ID NO: 129564 - protein, 8 aa, West Nile virus
LRPRWVDA

SEQ ID NO: 129565 - protein, 8 aa, West Nile virus
RPRWVDAR

SEQ ID NO: 129566 - protein, 8 aa, West Nile virus
PRWVDARV

SEQ ID NO: 129567 - protein, 8 aa, West Nile virus
RWVDARVY

SEQ ID NO: 129568 - protein, 8 aa, West Nile virus
WVDARVYS

SEQ ID NO: 129569 - protein, 8 aa, West Nile virus
VDARVYSD

SEQ ID NO: 129570 - protein, 8 aa, West Nile virus
SDHQALKL

SEQ ID NO: 129571 - protein, 8 aa, West Nile virus
DHQALKLF

SEQ ID NO: 129572 - protein, 8 aa, West Nile virus
HQALKLFK

SEQ ID NO: 129573 - protein, 8 aa, West Nile virus
QALKLFKD

SEQ ID NO: 129574 - protein, 8 aa, West Nile virus
ALKLFKDF

SEQ ID NO: 129575 - protein, 8 aa, West Nile virus
LKLFKDFA

SEQ ID NO: 129576 - protein, 8 aa, West Nile virus
KLFKDFAA

SEQ ID NO: 129577 - protein, 8 aa, West Nile virus
LFKDFAAG

SEQ ID NO: 129578 - protein, 8 aa, West Nile virus
ASGKRSQM

SEQ ID NO: 129579 - protein, 8 aa, West Nile virus
AGKRSQIG

SEQ ID NO: 129580 - protein, 8 aa, West Nile virus
GKRSQIGF

SEQ ID NO: 129581 - protein, 8 aa, West Nile virus
RRSQIGLV

SEQ ID NO: 129582 - protein, 8 aa, West Nile virus
RSQIGFIE

SEQ ID NO: 129583 - protein, 8 aa, West Nile virus
SQIGFIEV

SEQ ID NO: 129584 - protein, 8 aa, West Nile virus
QIGLVEVI

SEQ ID NO: 129585 - protein, 8 aa, West Nile virus
IGLVEVIG

SEQ ID NO: 129586 - protein, 8 aa, West Nile virus
GLVEVIGR

SEQ ID NO: 129587 - protein, 8 aa, West Nile virus
LVEVIGRM

SEQ ID NO: 129588 - protein, 8 aa, West Nile virus
VEVIGRMP

SEQ ID NO: 129589 - protein, 8 aa, West Nile virus
EVIGRMPE

SEQ ID NO: 129590 - protein, 8 aa, West Nile virus
VIGRMPEH

SEQ ID NO: 129591 - protein, 8 aa, West Nile virus
IGRMPEHF

SEQ ID NO: 129592 - protein, 8 aa, West Nile virus
GRMPEHFV

SEQ ID NO: 129593 - protein, 8 aa, West Nile virus
RMPEHFVG

SEQ ID NO: 129594 - protein, 8 aa, West Nile virus
MPEHFMVK

SEQ ID NO: 129595 - protein, 8 aa, West Nile virus
PEHFMVKT

SEQ ID NO: 129596 - protein, 8 aa, West Nile virus
EHFMVKTW

SEQ ID NO: 129597 - protein, 8 aa, West Nile virus
HFMVKTWE

SEQ ID NO: 129598 - protein, 8 aa, West Nile virus
FMVKTWEA

SEQ ID NO: 129599 - protein, 8 aa, West Nile virus
MVKTWEAL

SEQ ID NO: 129600 - protein, 8 aa, West Nile virus
VATAERGG

SEQ ID NO: 129601 - protein, 8 aa, West Nile virus
ATADKGGR

SEQ ID NO: 129602 - protein, 8 aa, West Nile virus
TAERGGRA

SEQ ID NO: 129603 - protein, 8 aa, West Nile virus
AEKGRRAH

SEQ ID NO: 129604 - protein, 8 aa, West Nile virus
DKGGRAHR

SEQ ID NO: 129605 - protein, 8 aa, West Nile virus
RGGRAHRS

SEQ ID NO: 129606 - protein, 8 aa, West Nile virus
GRRAHRMA

SEQ ID NO: 129607 - protein, 8 aa, West Nile virus
GRAHSMAL

SEQ ID NO: 129608 - protein, 8 aa, West Nile virus
RAHRSALE

SEQ ID NO: 129609 - protein, 8 aa, West Nile virus
AHSMALEE

SEQ ID NO: 129610 - protein, 8 aa, West Nile virus
HRSALEEL

SEQ ID NO: 129611 - protein, 8 aa, West Nile virus
RSALEELP

SEQ ID NO: 129612 - protein, 8 aa, West Nile virus
PDALQTII

SEQ ID NO: 129613 - protein, 8 aa, West Nile virus
DALQTVAL

SEQ ID NO: 129614 - protein, 8 aa, West Nile virus
ALQTIILI

SEQ ID NO: 129615 - protein, 8 aa, West Nile virus
LQTIVLIA

SEQ ID NO: 129616 - protein, 8 aa, West Nile virus
QTIVLIAL

SEQ ID NO: 129617 - protein, 8 aa, West Nile virus
TIVLIALL

SEQ ID NO: 129618 - protein, 8 aa, West Nile virus
IVLIALLS

SEQ ID NO: 129619 - protein, 8 aa, West Nile virus
VLIALLSV

SEQ ID NO: 129620 - protein, 8 aa, West Nile virus
IALLSVMS

SEQ ID NO: 129621 - protein, 8 aa, West Nile virus
LLSVMTLG

SEQ ID NO: 129622 - protein, 8 aa, West Nile virus
LSVMTLGV

SEQ ID NO: 129623 - protein, 8 aa, West Nile virus
SVMTLGVF

SEQ ID NO: 129624 - protein, 8 aa, West Nile virus
VMTLGVFC

SEQ ID NO: 129625 - protein, 8 aa, West Nile virus
MTLGVFCL

SEQ ID NO: 129626 - protein, 8 aa, West Nile virus
TLGVFCLL

SEQ ID NO: 129627 - protein, 8 aa, West Nile virus
LGVFCLLM

SEQ ID NO: 129628 - protein, 8 aa, West Nile virus
GVFLLLMQ

SEQ ID NO: 129629 - protein, 8 aa, West Nile virus
IFFLLMQR

SEQ ID NO: 129630 - protein, 8 aa, West Nile virus
GKIGLGGV

SEQ ID NO: 129631 - protein, 8 aa, West Nile virus
LGLATFFC

SEQ ID NO: 129632 - protein, 8 aa, West Nile virus
GLATFFCW

SEQ ID NO: 129633 - protein, 8 aa, West Nile virus
LATFFCWM

SEQ ID NO: 129634 - protein, 8 aa, West Nile virus
TLFCWMAE

SEQ ID NO: 129635 - protein, 8 aa, West Nile virus
FFCWMADV

SEQ ID NO: 129636 - protein, 8 aa, West Nile virus
FCWMADVP

SEQ ID NO: 129637 - protein, 8 aa, West Nile virus
CWMADVPG

SEQ ID NO: 129638 - protein, 8 aa, West Nile virus
WMADVPGT

SEQ ID NO: 129639 - protein, 8 aa, West Nile virus
MADVPGTK

SEQ ID NO: 129640 - protein, 8 aa, West Nile virus
ADVPGTKI

SEQ ID NO: 129641 - protein, 8 aa, West Nile virus
DVPGTKIA

SEQ ID NO: 129642 - protein, 8 aa, West Nile virus
AMFLICVM

SEQ ID NO: 129643 - protein, 8 aa, West Nile virus
MFLICVMT

SEQ ID NO: 129644 - protein, 8 aa, West Nile virus
FMICVMTL

SEQ ID NO: 129645 - protein, 8 aa, West Nile virus
LICVMTPV

SEQ ID NO: 129646 - protein, 8 aa, West Nile virus
ICVLTLVG

SEQ ID NO: 129647 - protein, 8 aa, West Nile virus
TLVGTVAA

SEQ ID NO: 129648 - protein, 8 aa, West Nile virus
LVGTVAAN

SEQ ID NO: 129649 - protein, 8 aa, West Nile virus
VGTVAANE

SEQ ID NO: 129650 - protein, 8 aa, West Nile virus
GTVAANEM

SEQ ID NO: 129651 - protein, 8 aa, West Nile virus
GWLDRTKS

SEQ ID NO: 129652 - protein, 8 aa, West Nile virus
WLDRTKSD

SEQ ID NO: 129653 - protein, 8 aa, West Nile virus
LDRTKSDI

SEQ ID NO: 129654 - protein, 8 aa, West Nile virus
ESFLLDLK

SEQ ID NO: 129655 - protein, 8 aa, West Nile virus
SFLLDLKP

SEQ ID NO: 129656 - protein, 8 aa, West Nile virus
LLLDLKPA

SEQ ID NO: 129657 - protein, 8 aa, West Nile virus
AWSLYAIS

SEQ ID NO: 129658 - protein, 8 aa, West Nile virus
WSLYAIST

SEQ ID NO: 129659 - protein, 8 aa, West Nile virus
SLYAVATA

SEQ ID NO: 129660 - protein, 8 aa, West Nile virus
LYAVATAV

SEQ ID NO: 129661 - protein, 8 aa, West Nile virus
YAISTAFM

SEQ ID NO: 129662 - protein, 8 aa, West Nile virus
AVATAVLT

SEQ ID NO: 129663 - protein, 8 aa, West Nile virus
VTTAFLTP

SEQ ID NO: 129664 - protein, 8 aa, West Nile virus
ATAVLTPL

SEQ ID NO: 129665 - protein, 8 aa, West Nile virus
TAFLTPLL

SEQ ID NO: 129666 - protein, 8 aa, West Nile virus
AFMTPLLK

SEQ ID NO: 129667 - protein, 8 aa, West Nile virus
FMTPLLKH

SEQ ID NO: 129668 - protein, 8 aa, West Nile virus
LTPLLKHV

SEQ ID NO: 129669 - protein, 8 aa, West Nile virus
NVQASTLF

SEQ ID NO: 129670 - protein, 8 aa, West Nile virus
VQASTLFT

SEQ ID NO: 129671 - protein, 8 aa, West Nile virus
QASTLFTL

SEQ ID NO: 129672 - protein, 8 aa, West Nile virus
ASALYSLA

SEQ ID NO: 129673 - protein, 8 aa, West Nile virus
SALYSLAR

SEQ ID NO: 129674 - protein, 8 aa, West Nile virus
ALYSLARG

SEQ ID NO: 129675 - protein, 8 aa, West Nile virus
LYSLARGF

SEQ ID NO: 129676 - protein, 8 aa, West Nile virus
YSLARGFP

SEQ ID NO: 129677 - protein, 8 aa, West Nile virus
SLARGFPF

SEQ ID NO: 129678 - protein, 8 aa, West Nile virus
ISSLLLAV

SEQ ID NO: 129679 - protein, 8 aa, West Nile virus
LTVTVTSA

SEQ ID NO: 129680 - protein, 8 aa, West Nile virus
TLLLCHYA

SEQ ID NO: 129681 - protein, 8 aa, West Nile virus
GIMKNAVI

SEQ ID NO: 129682 - protein, 8 aa, West Nile virus
IMKNVVVD

SEQ ID NO: 129683 - protein, 8 aa, West Nile virus
MKNVVVDG

SEQ ID NO: 129684 - protein, 8 aa, West Nile virus
KNAVIDGM

SEQ ID NO: 129685 - protein, 8 aa, West Nile virus
NAVIDGMV

SEQ ID NO: 129686 - protein, 8 aa, West Nile virus
AVIDGMVA

SEQ ID NO: 129687 - protein, 8 aa, West Nile virus
ELERATPI

SEQ ID NO: 129688 - protein, 8 aa, West Nile virus
LERATPIM

SEQ ID NO: 129689 - protein, 8 aa, West Nile virus
ERATPIMQ

SEQ ID NO: 129690 - protein, 8 aa, West Nile virus
RATPIMQK

SEQ ID NO: 129691 - protein, 8 aa, West Nile virus
ATPIMQKK

SEQ ID NO: 129692 - protein, 8 aa, West Nile virus
TPMMQKKV

SEQ ID NO: 129693 - protein, 8 aa, West Nile virus
PIMQKKIG

SEQ ID NO: 129694 - protein, 8 aa, West Nile virus
MMQKKVGQ

SEQ ID NO: 129695 - protein, 8 aa, West Nile virus
QKKVGQII

SEQ ID NO: 129696 - protein, 8 aa, West Nile virus
KKVGQIIL

SEQ ID NO: 129697 - protein, 8 aa, West Nile virus
KVGQIILI

SEQ ID NO: 129698 - protein, 8 aa, West Nile virus
VGQIILIL

SEQ ID NO: 129699 - protein, 8 aa, West Nile virus
GQIILILV

SEQ ID NO: 129700 - protein, 8 aa, West Nile virus
QIILILVS

SEQ ID NO: 129701 - protein, 8 aa, West Nile virus
MLILVSTA

SEQ ID NO: 129702 - protein, 8 aa, West Nile virus
LILVSTAA

SEQ ID NO: 129703 - protein, 8 aa, West Nile virus
ILVSTAAV

SEQ ID NO: 129704 - protein, 8 aa, West Nile virus
LVSTAAVV

SEQ ID NO: 129705 - protein, 8 aa, West Nile virus
VSTAAVVV

SEQ ID NO: 129706 - protein, 8 aa, West Nile virus
STAAVVVN

SEQ ID NO: 129707 - protein, 8 aa, West Nile virus
TAAVVVNP

SEQ ID NO: 129708 - protein, 8 aa, West Nile virus
LVVNPSVK

SEQ ID NO: 129709 - protein, 8 aa, West Nile virus
VREAGILV

SEQ ID NO: 129710 - protein, 8 aa, West Nile virus
REAGILVT

SEQ ID NO: 129711 - protein, 8 aa, West Nile virus
EAGILVTA

SEQ ID NO: 129712 - protein, 8 aa, West Nile virus
AGILVTAA

SEQ ID NO: 129713 - protein, 8 aa, West Nile virus
GILVTAAA

SEQ ID NO: 129714 - protein, 8 aa, West Nile virus
ILVTAAAV

SEQ ID NO: 129715 - protein, 8 aa, West Nile virus
LVTAAAVT

SEQ ID NO: 129716 - protein, 8 aa, West Nile virus
VTAAAVTL

SEQ ID NO: 129717 - protein, 8 aa, West Nile virus
WLSCLSMT

SEQ ID NO: 129718 - protein, 8 aa, West Nile virus
LSCLSMTW

SEQ ID NO: 129719 - protein, 8 aa, West Nile virus
SCLSMTWT

SEQ ID NO: 129720 - protein, 8 aa, West Nile virus
CLSMTWTL

SEQ ID NO: 129721 - protein, 8 aa, West Nile virus
SMTWTLIK

SEQ ID NO: 129722 - protein, 8 aa, West Nile virus
KNMGKPGL

SEQ ID NO: 129723 - protein, 8 aa, West Nile virus
NMGKPGLK

SEQ ID NO: 129724 - protein, 8 aa, West Nile virus
MGKPGLKR

SEQ ID NO: 129725 - protein, 8 aa, West Nile virus
GKPGLKRG

SEQ ID NO: 129726 - protein, 8 aa, West Nile virus
LGEVWKEK

SEQ ID NO: 129727 - protein, 8 aa, West Nile virus
GEAWKERL

SEQ ID NO: 129728 - protein, 8 aa, West Nile virus
EAWKERLN

SEQ ID NO: 129729 - protein, 8 aa, West Nile virus
VWKDRLNR

SEQ ID NO: 129730 - protein, 8 aa, West Nile virus
WKDRLNRL

SEQ ID NO: 129731 - protein, 8 aa, West Nile virus
KDRLNRLT

SEQ ID NO: 129732 - protein, 8 aa, West Nile virus
MTKEEFIR

SEQ ID NO: 129733 - protein, 8 aa, West Nile virus
TREEFTRY

SEQ ID NO: 129734 - protein, 8 aa, West Nile virus
KEEFARYR

SEQ ID NO: 129735 - protein, 8 aa, West Nile virus
EEFARYRK

SEQ ID NO: 129736 - protein, 8 aa, West Nile virus
EFARYRKE

SEQ ID NO: 129737 - protein, 8 aa, West Nile virus
FSRYRKEA

SEQ ID NO: 129738 - protein, 8 aa, West Nile virus
TRYRREAI

SEQ ID NO: 129739 - protein, 8 aa, West Nile virus
IIEVDRST

SEQ ID NO: 129740 - protein, 8 aa, West Nile virus
TEVDRAPA

SEQ ID NO: 129741 - protein, 8 aa, West Nile virus
EVDRSAAQ

SEQ ID NO: 129742 - protein, 8 aa, West Nile virus
ARKERNIT

SEQ ID NO: 129743 - protein, 8 aa, West Nile virus
RKERNITG

SEQ ID NO: 129744 - protein, 8 aa, West Nile virus
KERNITGG

SEQ ID NO: 129745 - protein, 8 aa, West Nile virus
ERNITGGH

SEQ ID NO: 129746 - protein, 8 aa, West Nile virus
RNITGGHP

SEQ ID NO: 129747 - protein, 8 aa, West Nile virus
NVTGGHSV

SEQ ID NO: 129748 - protein, 8 aa, West Nile virus
VTGGHSVS

SEQ ID NO: 129749 - protein, 8 aa, West Nile virus
GYPVSRGT

SEQ ID NO: 129750 - protein, 8 aa, West Nile virus
YPVSRGTA

SEQ ID NO: 129751 - protein, 8 aa, West Nile virus
ERRFLEPI

SEQ ID NO: 129752 - protein, 8 aa, West Nile virus
RKFVEPVG

SEQ ID NO: 129753 - protein, 8 aa, West Nile virus
RFLEPIGK

SEQ ID NO: 129754 - protein, 8 aa, West Nile virus
FLEPIGKV

SEQ ID NO: 129755 - protein, 8 aa, West Nile virus
LDPIGKVV

SEQ ID NO: 129756 - protein, 8 aa, West Nile virus
DPIGKVVD

SEQ ID NO: 129757 - protein, 8 aa, West Nile virus
PIGKVVDL

SEQ ID NO: 129758 - protein, 8 aa, West Nile virus
IGKVVDLG

SEQ ID NO: 129759 - protein, 8 aa, West Nile virus
VYYRASEA

SEQ ID NO: 129760 - protein, 8 aa, West Nile virus
YYRASEAS

SEQ ID NO: 129761 - protein, 8 aa, West Nile virus
YRASEASD

SEQ ID NO: 129762 - protein, 8 aa, West Nile virus
RASEASDT

SEQ ID NO: 129763 - protein, 8 aa, West Nile virus
ASEASDTL

SEQ ID NO: 129764 - protein, 8 aa, West Nile virus
SEVSDTLL

SEQ ID NO: 129765 - protein, 8 aa, West Nile virus
EVSDTLLC

SEQ ID NO: 129766 - protein, 8 aa, West Nile virus
SCDTLLCD

SEQ ID NO: 129767 - protein, 8 aa, West Nile virus
EVEEHRTL

SEQ ID NO: 129768 - protein, 8 aa, West Nile virus
VEEHRTLR

SEQ ID NO: 129769 - protein, 8 aa, West Nile virus
EEHRTLRV

SEQ ID NO: 129770 - protein, 8 aa, West Nile virus
EHRTLRVL

SEQ ID NO: 129771 - protein, 8 aa, West Nile virus
HRTLRVLE

SEQ ID NO: 129772 - protein, 8 aa, West Nile virus
RTLRVLEM

SEQ ID NO: 129773 - protein, 8 aa, West Nile virus
TLRVLEMV

SEQ ID NO: 129774 - protein, 8 aa, West Nile virus
LRVLEMVE

SEQ ID NO: 129775 - protein, 8 aa, West Nile virus
RGPKEFCV

SEQ ID NO: 129776 - protein, 8 aa, West Nile virus
GPKEFCVK

SEQ ID NO: 129777 - protein, 8 aa, West Nile virus
PKEFCVKV

SEQ ID NO: 129778 - protein, 8 aa, West Nile virus
KEFCVKVL

SEQ ID NO: 129779 - protein, 8 aa, West Nile virus
KVIEKMEV

SEQ ID NO: 129780 - protein, 8 aa, West Nile virus
VIEKMEVL

SEQ ID NO: 129781 - protein, 8 aa, West Nile virus
IEKMEVLQ

SEQ ID NO: 129782 - protein, 8 aa, West Nile virus
EKMEVLQR

SEQ ID NO: 129783 - protein, 8 aa, West Nile virus
KMEVLQRR

SEQ ID NO: 129784 - protein, 8 aa, West Nile virus
MEVLQRRY

SEQ ID NO: 129785 - protein, 8 aa, West Nile virus
EVLQRRYG

SEQ ID NO: 129786 - protein, 8 aa, West Nile virus
VLQRRYGG

SEQ ID NO: 129787 - protein, 8 aa, West Nile virus
YWVSRASS

SEQ ID NO: 129788 - protein, 8 aa, West Nile virus
WVSRASRN

SEQ ID NO: 129789 - protein, 8 aa, West Nile virus
VSRASGNI

SEQ ID NO: 129790 - protein, 8 aa, West Nile virus
SRASGNIV

SEQ ID NO: 129791 - protein, 8 aa, West Nile virus
RASGNIVN

SEQ ID NO: 129792 - protein, 8 aa, West Nile virus
ASGNIVNS

SEQ ID NO: 129793 - protein, 8 aa, West Nile virus
NIVNSVSM

SEQ ID NO: 129794 - protein, 8 aa, West Nile virus
IVNSVSMT

SEQ ID NO: 129795 - protein, 8 aa, West Nile virus
VHAVNMTS

SEQ ID NO: 129796 - protein, 8 aa, West Nile virus
HAVNMTSQ

SEQ ID NO: 129797 - protein, 8 aa, West Nile virus
AVNMTSQV

SEQ ID NO: 129798 - protein, 8 aa, West Nile virus
EKKTWKGA

SEQ ID NO: 129799 - protein, 8 aa, West Nile virus
KKTWKGAH

SEQ ID NO: 129800 - protein, 8 aa, West Nile virus
KTWKGPQY

SEQ ID NO: 129801 - protein, 8 aa, West Nile virus
TWKGAHYE

SEQ ID NO: 129802 - protein, 8 aa, West Nile virus
WKGAHYEE

SEQ ID NO: 129803 - protein, 8 aa, West Nile virus
KGAHYEED

SEQ ID NO: 129804 - protein, 8 aa, West Nile virus
GPQYEEDA

SEQ ID NO: 129805 - protein, 8 aa, West Nile virus
PQYEEDAN

SEQ ID NO: 129806 - protein, 8 aa, West Nile virus
HYEEDVNL

SEQ ID NO: 129807 - protein, 8 aa, West Nile virus
YEEDANLG

SEQ ID NO: 129808 - protein, 8 aa, West Nile virus
PLLNSDTR

SEQ ID NO: 129809 - protein, 8 aa, West Nile virus
LLSSDTSK

SEQ ID NO: 129810 - protein, 8 aa, West Nile virus
LNSDTRKI

SEQ ID NO: 129811 - protein, 8 aa, West Nile virus
NSDTRKIK

SEQ ID NO: 129812 - protein, 8 aa, West Nile virus
SDTSKIKS

SEQ ID NO: 129813 - protein, 8 aa, West Nile virus
DTRKIKNR

SEQ ID NO: 129814 - protein, 8 aa, West Nile virus
IKSRIERL

SEQ ID NO: 129815 - protein, 8 aa, West Nile virus
SRIERLKK

SEQ ID NO: 129816 - protein, 8 aa, West Nile virus
RVERLKRE

SEQ ID NO: 129817 - protein, 8 aa, West Nile virus
VERLKREY

SEQ ID NO: 129818 - protein, 8 aa, West Nile virus
ERLKKEYN

SEQ ID NO: 129819 - protein, 8 aa, West Nile virus
KEYGSTWH

SEQ ID NO: 129820 - protein, 8 aa, West Nile virus
DDNHPYRT

SEQ ID NO: 129821 - protein, 8 aa, West Nile virus
DNHPYRTW

SEQ ID NO: 129822 - protein, 8 aa, West Nile virus
YHGSYEVK

SEQ ID NO: 129823 - protein, 8 aa, West Nile virus
HGSYEVKP

SEQ ID NO: 129824 - protein, 8 aa, West Nile virus
GSYEVKPT

SEQ ID NO: 129825 - protein, 8 aa, West Nile virus
SYEVKPTG

SEQ ID NO: 129826 - protein, 8 aa, West Nile virus
YEVKPTGS

SEQ ID NO: 129827 - protein, 8 aa, West Nile virus
EVKPTGSA

SEQ ID NO: 129828 - protein, 8 aa, West Nile virus
VNPTGSAS

SEQ ID NO: 129829 - protein, 8 aa, West Nile virus
NPLVSASS

SEQ ID NO: 129830 - protein, 8 aa, West Nile virus
KPWDTIMN

SEQ ID NO: 129831 - protein, 8 aa, West Nile virus
PWDTITSV

SEQ ID NO: 129832 - protein, 8 aa, West Nile virus
WDTIMNVT

SEQ ID NO: 129833 - protein, 8 aa, West Nile virus
DTITSVTT

SEQ ID NO: 129834 - protein, 8 aa, West Nile virus
TITSVTTM

SEQ ID NO: 129835 - protein, 8 aa, West Nile virus
APEPPAGV

SEQ ID NO: 129836 - protein, 8 aa, West Nile virus
PEPPEGAK

SEQ ID NO: 129837 - protein, 8 aa, West Nile virus
TTNWLWAY

SEQ ID NO: 129838 - protein, 8 aa, West Nile virus
TNWLWSHL

SEQ ID NO: 129839 - protein, 8 aa, West Nile virus
NWLWAFLS

SEQ ID NO: 129840 - protein, 8 aa, West Nile virus
WLWAFLSR

SEQ ID NO: 129841 - protein, 8 aa, West Nile virus
RNKRPRMC

SEQ ID NO: 129842 - protein, 8 aa, West Nile virus
NKRPRMCT

SEQ ID NO: 129843 - protein, 8 aa, West Nile virus
KRPRMCTR

SEQ ID NO: 129844 - protein, 8 aa, West Nile virus
RPRMCTRE

SEQ ID NO: 129845 - protein, 8 aa, West Nile virus
CSREEFIK

SEQ ID NO: 129846 - protein, 8 aa, West Nile virus
SREEFIKK

SEQ ID NO: 129847 - protein, 8 aa, West Nile virus
REEFIKKV

SEQ ID NO: 129848 - protein, 8 aa, West Nile virus
EEFIKKVN

SEQ ID NO: 129849 - protein, 8 aa, West Nile virus
EFIKKVNS

SEQ ID NO: 129850 - protein, 8 aa, West Nile virus
FIKKVNSN

SEQ ID NO: 129851 - protein, 8 aa, West Nile virus
ISKVNSNA

SEQ ID NO: 129852 - protein, 8 aa, West Nile virus
KKVNSNAA

SEQ ID NO: 129853 - protein, 8 aa, West Nile virus
FEEQNQWS

SEQ ID NO: 129854 - protein, 8 aa, West Nile virus
EEQNQWKS

SEQ ID NO: 129855 - protein, 8 aa, West Nile virus
EQNQWKSA

SEQ ID NO: 129856 - protein, 8 aa, West Nile virus
QNQWKSAR

SEQ ID NO: 129857 - protein, 8 aa, West Nile virus
NQWKSARE

SEQ ID NO: 129858 - protein, 8 aa, West Nile virus
QWKSAREA

SEQ ID NO: 129859 - protein, 8 aa, West Nile virus
WKSAREAV

SEQ ID NO: 129860 - protein, 8 aa, West Nile virus
KSAREAVE

SEQ ID NO: 129861 - protein, 8 aa, West Nile virus
SARAAVED

SEQ ID NO: 129862 - protein, 8 aa, West Nile virus
ARAAVEDP

SEQ ID NO: 129863 - protein, 8 aa, West Nile virus
RAAVEDPK

SEQ ID NO: 129864 - protein, 8 aa, West Nile virus
EAVEDLKF

SEQ ID NO: 129865 - protein, 8 aa, West Nile virus
AVEDSTFW

SEQ ID NO: 129866 - protein, 8 aa, West Nile virus
VEDSTFWE

SEQ ID NO: 129867 - protein, 8 aa, West Nile virus
EDLKFWEM

SEQ ID NO: 129868 - protein, 8 aa, West Nile virus
DLKFWEMV

SEQ ID NO: 129869 - protein, 8 aa, West Nile virus
PKFWEIVD

SEQ ID NO: 129870 - protein, 8 aa, West Nile virus
KFWEIVDE

SEQ ID NO: 129871 - protein, 8 aa, West Nile virus
FWEIVDEE

SEQ ID NO: 129872 - protein, 8 aa, West Nile virus
WEIVDEER

SEQ ID NO: 129873 - protein, 8 aa, West Nile virus
EIVDEERE

SEQ ID NO: 129874 - protein, 8 aa, West Nile virus
IVDEEREA

SEQ ID NO: 129875 - protein, 8 aa, West Nile virus
AHLRGECY

SEQ ID NO: 129876 - protein, 8 aa, West Nile virus
HLRGECYT

SEQ ID NO: 129877 - protein, 8 aa, West Nile virus
LRGECYTC

SEQ ID NO: 129878 - protein, 8 aa, West Nile virus
RGECYTCI

SEQ ID NO: 129879 - protein, 8 aa, West Nile virus
GECYTCIY

SEQ ID NO: 129880 - protein, 8 aa, West Nile virus
ECYTCIYN

SEQ ID NO: 129881 - protein, 8 aa, West Nile virus
CYTCIYNM

SEQ ID NO: 129882 - protein, 8 aa, West Nile virus
YTCIYNMM

SEQ ID NO: 129883 - protein, 8 aa, West Nile virus
QKLGYVLR

SEQ ID NO: 129884 - protein, 8 aa, West Nile virus
KLGYVLRE

SEQ ID NO: 129885 - protein, 8 aa, West Nile virus
LGYVLREV

SEQ ID NO: 129886 - protein, 8 aa, West Nile virus
GYVLREVG

SEQ ID NO: 129887 - protein, 8 aa, West Nile virus
GGRIYADD

SEQ ID NO: 129888 - protein, 8 aa, West Nile virus
GKVYADDT

SEQ ID NO: 129889 - protein, 8 aa, West Nile virus
RIYADDTA

SEQ ID NO: 129890 - protein, 8 aa, West Nile virus
VYADDTAG

SEQ ID NO: 129891 - protein, 8 aa, West Nile virus
GWDTRITM

SEQ ID NO: 129892 - protein, 8 aa, West Nile virus
WDTRITMT

SEQ ID NO: 129893 - protein, 8 aa, West Nile virus
DTRITMTD

SEQ ID NO: 129894 - protein, 8 aa, West Nile virus
TRITMTDL

SEQ ID NO: 129895 - protein, 8 aa, West Nile virus
PITKADLE

SEQ ID NO: 129896 - protein, 8 aa, West Nile virus
KVLELLDR

SEQ ID NO: 129897 - protein, 8 aa, West Nile virus
VLELLEGE

SEQ ID NO: 129898 - protein, 8 aa, West Nile virus
LELLEGEH

SEQ ID NO: 129899 - protein, 8 aa, West Nile virus
ELLEGEHR

SEQ ID NO: 129900 - protein, 8 aa, West Nile virus
LLEGEHRR

SEQ ID NO: 129901 - protein, 8 aa, West Nile virus
HRRLARSV

SEQ ID NO: 129902 - protein, 8 aa, West Nile virus
RRLARSVI

SEQ ID NO: 129903 - protein, 8 aa, West Nile virus
RLARSVIE

SEQ ID NO: 129904 - protein, 8 aa, West Nile virus
LARSVIEL

SEQ ID NO: 129905 - protein, 8 aa, West Nile virus
ARSVIELT

SEQ ID NO: 129906 - protein, 8 aa, West Nile virus
RSVIELTY

SEQ ID NO: 129907 - protein, 8 aa, West Nile virus
SVIELTYR

SEQ ID NO: 129908 - protein, 8 aa, West Nile virus
IIELTYCH

SEQ ID NO: 129909 - protein, 8 aa, West Nile virus
IELTYRYK

SEQ ID NO: 129910 - protein, 8 aa, West Nile virus
ELTYCHKV

SEQ ID NO: 129911 - protein, 8 aa, West Nile virus
YCHKVVKV

SEQ ID NO: 129912 - protein, 8 aa, West Nile virus
CHKVVKVM

SEQ ID NO: 129913 - protein, 8 aa, West Nile virus
MRPAVGGK

SEQ ID NO: 129914 - protein, 8 aa, West Nile virus
RPAVGGKT

SEQ ID NO: 129915 - protein, 8 aa, West Nile virus
PAVGGKTV

SEQ ID NO: 129916 - protein, 8 aa, West Nile virus
AVGGKTVM

SEQ ID NO: 129917 - protein, 8 aa, West Nile virus
VGGKTVMD

SEQ ID NO: 129918 - protein, 8 aa, West Nile virus
GGKTVMDI

SEQ ID NO: 129919 - protein, 8 aa, West Nile virus
GKTVMDII

SEQ ID NO: 129920 - protein, 8 aa, West Nile virus
KTVMDIIS

SEQ ID NO: 129921 - protein, 8 aa, West Nile virus
LNPFSNLA

SEQ ID NO: 129922 - protein, 8 aa, West Nile virus
NPFTNLAF

SEQ ID NO: 129923 - protein, 8 aa, West Nile virus
PFTNLAFQ

SEQ ID NO: 129924 - protein, 8 aa, West Nile virus
FSNLAVQL

SEQ ID NO: 129925 - protein, 8 aa, West Nile virus
SNLAVQLV

SEQ ID NO: 129926 - protein, 8 aa, West Nile virus
LAFQLGRR

SEQ ID NO: 129927 - protein, 8 aa, West Nile virus
AVQLVRRR

SEQ ID NO: 129928 - protein, 8 aa, West Nile virus
RREGEGVI

SEQ ID NO: 129929 - protein, 8 aa, West Nile virus
REGEGVIG

SEQ ID NO: 129930 - protein, 8 aa, West Nile virus
GEGVITPD

SEQ ID NO: 129931 - protein, 8 aa, West Nile virus
EGVIGPYD

SEQ ID NO: 129932 - protein, 8 aa, West Nile virus
GVITPDDV

SEQ ID NO: 129933 - protein, 8 aa, West Nile virus
VIGPEDVE

SEQ ID NO: 129934 - protein, 8 aa, West Nile virus
GPYDVEKL

SEQ ID NO: 129935 - protein, 8 aa, West Nile virus
PYDVEKLE

SEQ ID NO: 129936 - protein, 8 aa, West Nile virus
KRKGPKVR

SEQ ID NO: 129937 - protein, 8 aa, West Nile virus
RKGPKVRT

SEQ ID NO: 129938 - protein, 8 aa, West Nile virus
PKVRTWLS

SEQ ID NO: 129939 - protein, 8 aa, West Nile virus
KVRTWLSE

SEQ ID NO: 129940 - protein, 8 aa, West Nile virus
VRTWLSEN

SEQ ID NO: 129941 - protein, 8 aa, West Nile virus
RTWLSENG

SEQ ID NO: 129942 - protein, 8 aa, West Nile virus
TWLSENGE

SEQ ID NO: 129943 - protein, 8 aa, West Nile virus
GEERLSRT

SEQ ID NO: 129944 - protein, 8 aa, West Nile virus
EERLGRMA

SEQ ID NO: 129945 - protein, 8 aa, West Nile virus
LDDRFASS

SEQ ID NO: 129946 - protein, 8 aa, West Nile virus
DDRFASSL

SEQ ID NO: 129947 - protein, 8 aa, West Nile virus
DRFASSLH

SEQ ID NO: 129948 - protein, 8 aa, West Nile virus
RFAISLHF

SEQ ID NO: 129949 - protein, 8 aa, West Nile virus
FASSLHFL

SEQ ID NO: 129950 - protein, 8 aa, West Nile virus
ASSLHFLN

SEQ ID NO: 129951 - protein, 8 aa, West Nile virus
SSLHFLNA

SEQ ID NO: 129952 - protein, 8 aa, West Nile virus
HFLNAMPK

SEQ ID NO: 129953 - protein, 8 aa, West Nile virus
FLNAMPKV

SEQ ID NO: 129954 - protein, 8 aa, West Nile virus
LNDMSKVR

SEQ ID NO: 129955 - protein, 8 aa, West Nile virus
NAMPKVRK

SEQ ID NO: 129956 - protein, 8 aa, West Nile virus
AMSQVRKD

SEQ ID NO: 129957 - protein, 8 aa, West Nile virus
ICSAVPAN

SEQ ID NO: 129958 - protein, 8 aa, West Nile virus
CSAVPANW

SEQ ID NO: 129959 - protein, 8 aa, West Nile virus
SAVPANWV

SEQ ID NO: 129960 - protein, 8 aa, West Nile virus
AVPANWVP

SEQ ID NO: 129961 - protein, 8 aa, West Nile virus
VPANWVPT

SEQ ID NO: 129962 - protein, 8 aa, West Nile virus
PANWVPTG

SEQ ID NO: 129963 - protein, 8 aa, West Nile virus
ANWVPTGR

SEQ ID NO: 129964 - protein, 8 aa, West Nile virus
DWVPTGRT

SEQ ID NO: 129965 - protein, 8 aa, West Nile virus
TTWSIHAR

SEQ ID NO: 129966 - protein, 8 aa, West Nile virus
TWSIHARG

SEQ ID NO: 129967 - protein, 8 aa, West Nile virus
WSIHARGE

SEQ ID NO: 129968 - protein, 8 aa, West Nile virus
SIHARGEW

SEQ ID NO: 129969 - protein, 8 aa, West Nile virus
IHARGEWM

SEQ ID NO: 129970 - protein, 8 aa, West Nile virus
HARGEWMT

SEQ ID NO: 129971 - protein, 8 aa, West Nile virus
ARGEWMTT

SEQ ID NO: 129972 - protein, 8 aa, West Nile virus
RGEWMTTA

SEQ ID NO: 129973 - protein, 8 aa, West Nile virus
MTTADMLG

SEQ ID NO: 129974 - protein, 8 aa, West Nile virus
TTADMLGV

SEQ ID NO: 129975 - protein, 8 aa, West Nile virus
TADMLGVW

SEQ ID NO: 129976 - protein, 8 aa, West Nile virus
ADMLGVWN

SEQ ID NO: 129977 - protein, 8 aa, West Nile virus
DMLGVWNR

SEQ ID NO: 129978 - protein, 8 aa, West Nile virus
MLGVWNRV

SEQ ID NO: 129979 - protein, 8 aa, West Nile virus
LGVWNRVW

SEQ ID NO: 129980 - protein, 8 aa, West Nile virus
GVWNRVWI

SEQ ID NO: 129981 - protein, 8 aa, West Nile virus
PVERWSDI

SEQ ID NO: 129982 - protein, 8 aa, West Nile virus
VERWSDIP

SEQ ID NO: 129983 - protein, 8 aa, West Nile virus
ERWSDIPY

SEQ ID NO: 129984 - protein, 8 aa, West Nile virus
RWSDIPYS

SEQ ID NO: 129985 - protein, 8 aa, West Nile virus
GSLIGTRS

SEQ ID NO: 129986 - protein, 8 aa, West Nile virus
SLIGTRSR

SEQ ID NO: 129987 - protein, 8 aa, West Nile virus
LIGTRSRA

SEQ ID NO: 129988 - protein, 8 aa, West Nile virus
IGTRSRAT

SEQ ID NO: 129989 - protein, 8 aa, West Nile virus
GTRSRATW

SEQ ID NO: 129990 - protein, 8 aa, West Nile virus
TRSRATWA

SEQ ID NO: 129991 - protein, 8 aa, West Nile virus
RSRATWAE

SEQ ID NO: 129992 - protein, 8 aa, West Nile virus
SRATWAEN

SEQ ID NO: 129993 - protein, 8 aa, West Nile virus
QVAIGQVR

SEQ ID NO: 129994 - protein, 8 aa, West Nile virus
VAIGQVRS

SEQ ID NO: 129995 - protein, 8 aa, West Nile virus
IIGEEKYV

SEQ ID NO: 129996 - protein, 8 aa, West Nile virus
VDYMGSLK

SEQ ID NO: 129997 - protein, 8 aa, West Nile virus
DYMGSLKR

SEQ ID NO: 129998 - protein, 8 aa, West Nile virus
YMGSLKRY

SEQ ID NO: 129999 - protein, 8 aa, West Nile virus
MGSLKRYE

SEQ ID NO: 130000 - protein, 8 aa, West Nile virus
GSLKRYEE

SEQ ID NO: 130001 - protein, 8 aa, West Nile virus
SLKRYEEP

SEQ ID NO: 130002 - protein, 8 aa, West Nile virus
VNMLKRGK

SEQ ID NO: 130003 - protein, 8 aa, West Nile virus
NMLKRGKP

SEQ ID NO: 130004 - protein, 8 aa, West Nile virus
MLKRGTPR

SEQ ID NO: 130005 - protein, 8 aa, West Nile virus
KRGKPRVL

SEQ ID NO: 130006 - protein, 8 aa, West Nile virus
RGKPRVLS

SEQ ID NO: 130007 - protein, 8 aa, West Nile virus
GKPRVLSL

SEQ ID NO: 130008 - protein, 8 aa, West Nile virus
PRGGSLMG

SEQ ID NO: 130009 - protein, 8 aa, West Nile virus
RVMSLIGL

SEQ ID NO: 130010 - protein, 8 aa, West Nile virus
GGSLMGLK

SEQ ID NO: 130011 - protein, 8 aa, West Nile virus
LIDGKGPV

SEQ ID NO: 130012 - protein, 8 aa, West Nile virus
IDGKGPVR

SEQ ID NO: 130013 - protein, 8 aa, West Nile virus
DGKGPTRF

SEQ ID NO: 130014 - protein, 8 aa, West Nile virus
GKGPTRFV

SEQ ID NO: 130015 - protein, 8 aa, West Nile virus
KGPVRFVL

SEQ ID NO: 130016 - protein, 8 aa, West Nile virus
VFFRFTAI

SEQ ID NO: 130017 - protein, 8 aa, West Nile virus
AVLERWRG

SEQ ID NO: 130018 - protein, 8 aa, West Nile virus
VLERWRGV

SEQ ID NO: 130019 - protein, 8 aa, West Nile virus
LERWRGVN

SEQ ID NO: 130020 - protein, 8 aa, West Nile virus
NRWRGVNK

SEQ ID NO: 130021 - protein, 8 aa, West Nile virus
KELGILTN

SEQ ID NO: 130022 - protein, 8 aa, West Nile virus
ELGILTNA

SEQ ID NO: 130023 - protein, 8 aa, West Nile virus
LGILTNAI

SEQ ID NO: 130024 - protein, 8 aa, West Nile virus
GILTNAIS

SEQ ID NO: 130025 - protein, 8 aa, West Nile virus
TLTNAMNR

SEQ ID NO: 130026 - protein, 8 aa, West Nile virus
SRRSEKKK

SEQ ID NO: 130027 - protein, 8 aa, West Nile virus
RRSAKQKK

SEQ ID NO: 130028 - protein, 8 aa, West Nile virus
RSEKKKKR

SEQ ID NO: 130029 - protein, 8 aa, West Nile virus
SAKQKKRG

SEQ ID NO: 130030 - protein, 8 aa, West Nile virus
AKQKKRGG

SEQ ID NO: 130031 - protein, 8 aa, West Nile virus
KKKKRGGS

SEQ ID NO: 130032 - protein, 8 aa, West Nile virus
QKKRGGVV

SEQ ID NO: 130033 - protein, 8 aa, West Nile virus
KKRGGVVG

SEQ ID NO: 130034 - protein, 8 aa, West Nile virus
GSVTLSNF

SEQ ID NO: 130035 - protein, 8 aa, West Nile virus
AVTLSDFQ

SEQ ID NO: 130036 - protein, 8 aa, West Nile virus
QGKVMMTI

SEQ ID NO: 130037 - protein, 8 aa, West Nile virus
GKLMMTVN

SEQ ID NO: 130038 - protein, 8 aa, West Nile virus
KLMMTVNA

SEQ ID NO: 130039 - protein, 8 aa, West Nile virus
VMMTINAT

SEQ ID NO: 130040 - protein, 8 aa, West Nile virus
IMTVNATD

SEQ ID NO: 130041 - protein, 8 aa, West Nile virus
MTINATDT

SEQ ID NO: 130042 - protein, 8 aa, West Nile virus
TINATDTT

SEQ ID NO: 130043 - protein, 8 aa, West Nile virus
AITIPTAA

SEQ ID NO: 130044 - protein, 8 aa, West Nile virus
AGKNLCTV

SEQ ID NO: 130045 - protein, 8 aa, West Nile virus
VRAMDVGF

SEQ ID NO: 130046 - protein, 8 aa, West Nile virus
RAMDVGHM

SEQ ID NO: 130047 - protein, 8 aa, West Nile virus
AMDVGHMC

SEQ ID NO: 130048 - protein, 8 aa, West Nile virus
MDVGHMCD

SEQ ID NO: 130049 - protein, 8 aa, West Nile virus
DVGHMCDD

SEQ ID NO: 130050 - protein, 8 aa, West Nile virus
VGHMCDDT

SEQ ID NO: 130051 - protein, 8 aa, West Nile virus
GHMCDDTI

SEQ ID NO: 130052 - protein, 8 aa, West Nile virus
HMCDDTIT

SEQ ID NO: 130053 - protein, 8 aa, West Nile virus
TYECPALA

SEQ ID NO: 130054 - protein, 8 aa, West Nile virus
YECSVLSA

SEQ ID NO: 130055 - protein, 8 aa, West Nile virus
ECSVLSAG

SEQ ID NO: 130056 - protein, 8 aa, West Nile virus
CSVLSAGN

SEQ ID NO: 130057 - protein, 8 aa, West Nile virus
SVLSAGND

SEQ ID NO: 130058 - protein, 8 aa, West Nile virus
DCWCTKSP

SEQ ID NO: 130059 - protein, 8 aa, West Nile virus
CWCTKLAM

SEQ ID NO: 130060 - protein, 8 aa, West Nile virus
PVYVRYGR

SEQ ID NO: 130061 - protein, 8 aa, West Nile virus
THGESTLV

SEQ ID NO: 130062 - protein, 8 aa, West Nile virus
HGESTLVN

SEQ ID NO: 130063 - protein, 8 aa, West Nile virus
GKSTLANK

SEQ ID NO: 130064 - protein, 8 aa, West Nile virus
KSTLANKK

SEQ ID NO: 130065 - protein, 8 aa, West Nile virus
SNKKGAWM

SEQ ID NO: 130066 - protein, 8 aa, West Nile virus
TMQRVVFI

SEQ ID NO: 130067 - protein, 8 aa, West Nile virus
MQRVVFAV

SEQ ID NO: 130068 - protein, 8 aa, West Nile virus
QRVVFAVL

SEQ ID NO: 130069 - protein, 8 aa, West Nile virus
RVVFMILL

SEQ ID NO: 130070 - protein, 8 aa, West Nile virus
VVFMILLL

SEQ ID NO: 130071 - protein, 8 aa, West Nile virus
VFMILLLL

SEQ ID NO: 130072 - protein, 8 aa, West Nile virus
FAVLLLLV

SEQ ID NO: 130073 - protein, 8 aa, West Nile virus
AVLLLLVA

SEQ ID NO: 130074 - protein, 8 aa, West Nile virus
CVTITAKD

SEQ ID NO: 130075 - protein, 8 aa, West Nile virus
VTIMSKNK

SEQ ID NO: 130076 - protein, 8 aa, West Nile virus
TLMSKDKP

SEQ ID NO: 130077 - protein, 8 aa, West Nile virus
IMSKNKPT

SEQ ID NO: 130078 - protein, 8 aa, West Nile virus
IDVKMMNV

SEQ ID NO: 130079 - protein, 8 aa, West Nile virus
DVKMMKME

SEQ ID NO: 130080 - protein, 8 aa, West Nile virus
VKMMNVEA

SEQ ID NO: 130081 - protein, 8 aa, West Nile virus
LAGVRDYC

SEQ ID NO: 130082 - protein, 8 aa, West Nile virus
AEVRSYCH

SEQ ID NO: 130083 - protein, 8 aa, West Nile virus
GVRDYCYL

SEQ ID NO: 130084 - protein, 8 aa, West Nile virus
VRDYCYLA

SEQ ID NO: 130085 - protein, 8 aa, West Nile virus
VSELSTKA

SEQ ID NO: 130086 - protein, 8 aa, West Nile virus
SELSTKAA

SEQ ID NO: 130087 - protein, 8 aa, West Nile virus
ELSTKAAC

SEQ ID NO: 130088 - protein, 8 aa, West Nile virus
STKAACPA

SEQ ID NO: 130089 - protein, 8 aa, West Nile virus
TKAACPAM

SEQ ID NO: 130090 - protein, 8 aa, West Nile virus
HNDKRADS

SEQ ID NO: 130091 - protein, 8 aa, West Nile virus
YFCKQGVV

SEQ ID NO: 130092 - protein, 8 aa, West Nile virus
CAKFACTS

SEQ ID NO: 130093 - protein, 8 aa, West Nile virus
ARFACSTK

SEQ ID NO: 130094 - protein, 8 aa, West Nile virus
RFACSTKA

SEQ ID NO: 130095 - protein, 8 aa, West Nile virus
FTCSNKAT

SEQ ID NO: 130096 - protein, 8 aa, West Nile virus
TCSNKATG

SEQ ID NO: 130097 - protein, 8 aa, West Nile virus
CSNKATGL

SEQ ID NO: 130098 - protein, 8 aa, West Nile virus
SNKATGLT

SEQ ID NO: 130099 - protein, 8 aa, West Nile virus
NKATGLTI

SEQ ID NO: 130100 - protein, 8 aa, West Nile virus
KATGLTIQ

SEQ ID NO: 130101 - protein, 8 aa, West Nile virus
ATGLTIQR

SEQ ID NO: 130102 - protein, 8 aa, West Nile virus
TGLTIQRE

SEQ ID NO: 130103 - protein, 8 aa, West Nile virus
GAAQAGRF

SEQ ID NO: 130104 - protein, 8 aa, West Nile virus
ATQAGRLS

SEQ ID NO: 130105 - protein, 8 aa, West Nile virus
AQAGRFSI

SEQ ID NO: 130106 - protein, 8 aa, West Nile virus
QAGRFTVS

SEQ ID NO: 130107 - protein, 8 aa, West Nile virus
AGRFSVTP

SEQ ID NO: 130108 - protein, 8 aa, West Nile virus
GRLSITPA

SEQ ID NO: 130109 - protein, 8 aa, West Nile virus
RLSITPAA

SEQ ID NO: 130110 - protein, 8 aa, West Nile virus
LSITPAAP

SEQ ID NO: 130111 - protein, 8 aa, West Nile virus
TVSPSAPT

SEQ ID NO: 130112 - protein, 8 aa, West Nile virus
ITPAAPSH

SEQ ID NO: 130113 - protein, 8 aa, West Nile virus
TPAAPSHT

SEQ ID NO: 130114 - protein, 8 aa, West Nile virus
KLGDYGEV

SEQ ID NO: 130115 - protein, 8 aa, West Nile virus
GDYGEVTI

SEQ ID NO: 130116 - protein, 8 aa, West Nile virus
DYGEVTID

SEQ ID NO: 130117 - protein, 8 aa, West Nile virus
TSAYYVMT

SEQ ID NO: 130118 - protein, 8 aa, West Nile virus
SAYYVMTV

SEQ ID NO: 130119 - protein, 8 aa, West Nile virus
YVMTVGAK

SEQ ID NO: 130120 - protein, 8 aa, West Nile virus
LPWSSAGG

SEQ ID NO: 130121 - protein, 8 aa, West Nile virus
PWSSAAGT

SEQ ID NO: 130122 - protein, 8 aa, West Nile virus
TNWRNREA

SEQ ID NO: 130123 - protein, 8 aa, West Nile virus
VWRNRETF

SEQ ID NO: 130124 - protein, 8 aa, West Nile virus
WRNRETFM

SEQ ID NO: 130125 - protein, 8 aa, West Nile virus
RNRGTLME

SEQ ID NO: 130126 - protein, 8 aa, West Nile virus
NRGTLMEF

SEQ ID NO: 130127 - protein, 8 aa, West Nile virus
RGTLMEFE

SEQ ID NO: 130128 - protein, 8 aa, West Nile virus
ETFMEFEE

SEQ ID NO: 130129 - protein, 8 aa, West Nile virus
LAGAIPLE

SEQ ID NO: 130130 - protein, 8 aa, West Nile virus
AGAIPVSF

SEQ ID NO: 130131 - protein, 8 aa, West Nile virus
GAIPLEFS

SEQ ID NO: 130132 - protein, 8 aa, West Nile virus
TIPVEFSS

SEQ ID NO: 130133 - protein, 8 aa, West Nile virus
VNPFVSMA

SEQ ID NO: 130134 - protein, 8 aa, West Nile virus
NPFVSMAT

SEQ ID NO: 130135 - protein, 8 aa, West Nile virus
PFVSMATA

SEQ ID NO: 130136 - protein, 8 aa, West Nile virus
STANAKVL

SEQ ID NO: 130137 - protein, 8 aa, West Nile virus
TANAKVLV

SEQ ID NO: 130138 - protein, 8 aa, West Nile virus
ANAKVLVE

SEQ ID NO: 130139 - protein, 8 aa, West Nile virus
DAKVLIEL

SEQ ID NO: 130140 - protein, 8 aa, West Nile virus
HQINHHWH

SEQ ID NO: 130141 - protein, 8 aa, West Nile virus
KAFTATLK

SEQ ID NO: 130142 - protein, 8 aa, West Nile virus
AFTATLKG

SEQ ID NO: 130143 - protein, 8 aa, West Nile virus
FTATLKGA

SEQ ID NO: 130144 - protein, 8 aa, West Nile virus
TATLKGAQ

SEQ ID NO: 130145 - protein, 8 aa, West Nile virus
ATLKGAQR

SEQ ID NO: 130146 - protein, 8 aa, West Nile virus
GSVGGIFT

SEQ ID NO: 130147 - protein, 8 aa, West Nile virus
SVGGIFTS

SEQ ID NO: 130148 - protein, 8 aa, West Nile virus
VGGVLTSV

SEQ ID NO: 130149 - protein, 8 aa, West Nile virus
FTSFGKAV

SEQ ID NO: 130150 - protein, 8 aa, West Nile virus
TSVGQAIH

SEQ ID NO: 130151 - protein, 8 aa, West Nile virus
SFGKAVHQ

SEQ ID NO: 130152 - protein, 8 aa, West Nile virus
VGQAIHQV

SEQ ID NO: 130153 - protein, 8 aa, West Nile virus
LVWMGINA

SEQ ID NO: 130154 - protein, 8 aa, West Nile virus
LWMGVNAR

SEQ ID NO: 130155 - protein, 8 aa, West Nile virus
MGVNARDR

SEQ ID NO: 130156 - protein, 8 aa, West Nile virus
GINARDKS

SEQ ID NO: 130157 - protein, 8 aa, West Nile virus
VNARDRSI

SEQ ID NO: 130158 - protein, 8 aa, West Nile virus
SRDRSIAL

SEQ ID NO: 130159 - protein, 8 aa, West Nile virus
VLLFLSIN

SEQ ID NO: 130160 - protein, 8 aa, West Nile virus
TGCAINIT

SEQ ID NO: 130161 - protein, 8 aa, West Nile virus
GCAIDVGR

SEQ ID NO: 130162 - protein, 8 aa, West Nile virus
CAINITRQ

SEQ ID NO: 130163 - protein, 8 aa, West Nile virus
AIDVGRQE

SEQ ID NO: 130164 - protein, 8 aa, West Nile virus
IDVGRQEL

SEQ ID NO: 130165 - protein, 8 aa, West Nile virus
DVSRQELR

SEQ ID NO: 130166 - protein, 8 aa, West Nile virus
VGRQELRC

SEQ ID NO: 130167 - protein, 8 aa, West Nile virus
NDVEAWTD

SEQ ID NO: 130168 - protein, 8 aa, West Nile virus
DVEAWTDR

SEQ ID NO: 130169 - protein, 8 aa, West Nile virus
VEAWTDRY

SEQ ID NO: 130170 - protein, 8 aa, West Nile virus
EAWTDRYK

SEQ ID NO: 130171 - protein, 8 aa, West Nile virus
DRYKFHPE

SEQ ID NO: 130172 - protein, 8 aa, West Nile virus
RYKYHPET

SEQ ID NO: 130173 - protein, 8 aa, West Nile virus
YKYHPETP

SEQ ID NO: 130174 - protein, 8 aa, West Nile virus
KFHPETPQ

SEQ ID NO: 130175 - protein, 8 aa, West Nile virus
FHPETPQG

SEQ ID NO: 130176 - protein, 8 aa, West Nile virus
QGLAKVIQ

SEQ ID NO: 130177 - protein, 8 aa, West Nile virus
GLARIIQK

SEQ ID NO: 130178 - protein, 8 aa, West Nile virus
LARVIQKA

SEQ ID NO: 130179 - protein, 8 aa, West Nile virus
AKVIQKAH

SEQ ID NO: 130180 - protein, 8 aa, West Nile virus
IQKAHESG

SEQ ID NO: 130181 - protein, 8 aa, West Nile virus
AHAEGICG

SEQ ID NO: 130182 - protein, 8 aa, West Nile virus
GICGLRSV

SEQ ID NO: 130183 - protein, 8 aa, West Nile virus
VCGLRSAS

SEQ ID NO: 130184 - protein, 8 aa, West Nile virus
EHQMWESI

SEQ ID NO: 130185 - protein, 8 aa, West Nile virus
HQMWESIK

SEQ ID NO: 130186 - protein, 8 aa, West Nile virus
QMWESIKD

SEQ ID NO: 130187 - protein, 8 aa, West Nile virus
MWESIKDE

SEQ ID NO: 130188 - protein, 8 aa, West Nile virus
WESIKDEL

SEQ ID NO: 130189 - protein, 8 aa, West Nile virus
ESIKDELN

SEQ ID NO: 130190 - protein, 8 aa, West Nile virus
SIKDELNT

SEQ ID NO: 130191 - protein, 8 aa, West Nile virus
KENGVDFS

SEQ ID NO: 130192 - protein, 8 aa, West Nile virus
ENGVDFSV

SEQ ID NO: 130193 - protein, 8 aa, West Nile virus
NGVDLTVV

SEQ ID NO: 130194 - protein, 8 aa, West Nile virus
GVDFSVVV

SEQ ID NO: 130195 - protein, 8 aa, West Nile virus
VDFSVVVE

SEQ ID NO: 130196 - protein, 8 aa, West Nile virus
DFSVVVEK

SEQ ID NO: 130197 - protein, 8 aa, West Nile virus
LSMVVEKQ

SEQ ID NO: 130198 - protein, 8 aa, West Nile virus
VVEKQGGM

SEQ ID NO: 130199 - protein, 8 aa, West Nile virus
APRRLTAT

SEQ ID NO: 130200 - protein, 8 aa, West Nile virus
ATTDKLEI

SEQ ID NO: 130201 - protein, 8 aa, West Nile virus
TTDKLEIG

SEQ ID NO: 130202 - protein, 8 aa, West Nile virus
TEKFEIGW

SEQ ID NO: 130203 - protein, 8 aa, West Nile virus
EKFEIGWK

SEQ ID NO: 130204 - protein, 8 aa, West Nile virus
SIIFAPEI

SEQ ID NO: 130205 - protein, 8 aa, West Nile virus
IIFAPEIA

SEQ ID NO: 130206 - protein, 8 aa, West Nile virus
LFAPEIAN

SEQ ID NO: 130207 - protein, 8 aa, West Nile virus
FAPELANS

SEQ ID NO: 130208 - protein, 8 aa, West Nile virus
ASELANHT

SEQ ID NO: 130209 - protein, 8 aa, West Nile virus
PELANSTF

SEQ ID NO: 130210 - protein, 8 aa, West Nile virus
IANNTFVV

SEQ ID NO: 130211 - protein, 8 aa, West Nile virus
ANHTFVVD

SEQ ID NO: 130212 - protein, 8 aa, West Nile virus
NHTFVVDG

SEQ ID NO: 130213 - protein, 8 aa, West Nile virus
NTFVVDGS

SEQ ID NO: 130214 - protein, 8 aa, West Nile virus
VVDGSETR

SEQ ID NO: 130215 - protein, 8 aa, West Nile virus
VDGSETRE

SEQ ID NO: 130216 - protein, 8 aa, West Nile virus
SETRECPT

SEQ ID NO: 130217 - protein, 8 aa, West Nile virus
SRAWNSME

SEQ ID NO: 130218 - protein, 8 aa, West Nile virus
MTTRMFLK

SEQ ID NO: 130219 - protein, 8 aa, West Nile virus
IREVNTTE

SEQ ID NO: 130220 - protein, 8 aa, West Nile virus
REVNTTEC

SEQ ID NO: 130221 - protein, 8 aa, West Nile virus
EVNTTECD

SEQ ID NO: 130222 - protein, 8 aa, West Nile virus
GNTTECDS

SEQ ID NO: 130223 - protein, 8 aa, West Nile virus
SKIIGTAI

SEQ ID NO: 130224 - protein, 8 aa, West Nile virus
SYWIESGF

SEQ ID NO: 130225 - protein, 8 aa, West Nile virus
YWIESGFN

SEQ ID NO: 130226 - protein, 8 aa, West Nile virus
LNHTWKLE

SEQ ID NO: 130227 - protein, 8 aa, West Nile virus
HTLWGEGV

SEQ ID NO: 130228 - protein, 8 aa, West Nile virus
TLWGEGVQ

SEQ ID NO: 130229 - protein, 8 aa, West Nile virus
LWGEGVQE

SEQ ID NO: 130230 - protein, 8 aa, West Nile virus
WGEGVQES

SEQ ID NO: 130231 - protein, 8 aa, West Nile virus
GVLESELI

SEQ ID NO: 130232 - protein, 8 aa, West Nile virus
VVESDLII

SEQ ID NO: 130233 - protein, 8 aa, West Nile virus
VESDLIIP

SEQ ID NO: 130234 - protein, 8 aa, West Nile virus
ESDLIIPA

SEQ ID NO: 130235 - protein, 8 aa, West Nile virus
SELIIPVT

SEQ ID NO: 130236 - protein, 8 aa, West Nile virus
ELIIPVTL

SEQ ID NO: 130237 - protein, 8 aa, West Nile virus
PATLAGPR

SEQ ID NO: 130238 - protein, 8 aa, West Nile virus
VTLAGPKS

SEQ ID NO: 130239 - protein, 8 aa, West Nile virus
NCGHRGPS

SEQ ID NO: 130240 - protein, 8 aa, West Nile virus
CEHRGPAA

SEQ ID NO: 130241 - protein, 8 aa, West Nile virus
EHRGPAAR

SEQ ID NO: 130242 - protein, 8 aa, West Nile virus
HRGASTRT

SEQ ID NO: 130243 - protein, 8 aa, West Nile virus
RGASTRTT

SEQ ID NO: 130244 - protein, 8 aa, West Nile virus
GPSARTTT

SEQ ID NO: 130245 - protein, 8 aa, West Nile virus
PSARTTTE

SEQ ID NO: 130246 - protein, 8 aa, West Nile virus
SARTTTES

SEQ ID NO: 130247 - protein, 8 aa, West Nile virus
TLPPLRFK

SEQ ID NO: 130248 - protein, 8 aa, West Nile virus
LPPLRYTT

SEQ ID NO: 130249 - protein, 8 aa, West Nile virus
PPLRFQTR

SEQ ID NO: 130250 - protein, 8 aa, West Nile virus
TDNGCWYG

SEQ ID NO: 130251 - protein, 8 aa, West Nile virus
DNGCWYGM

SEQ ID NO: 130252 - protein, 8 aa, West Nile virus
GMEIRPLK

SEQ ID NO: 130253 - protein, 8 aa, West Nile virus
MEIRPQKH

SEQ ID NO: 130254 - protein, 8 aa, West Nile virus
EIRPLKHD

SEQ ID NO: 130255 - protein, 8 aa, West Nile virus
IRPQKHDE

SEQ ID NO: 130256 - protein, 8 aa, West Nile virus
RPLKHDEK

SEQ ID NO: 130257 - protein, 8 aa, West Nile virus
PQRHDGKT

SEQ ID NO: 130258 - protein, 8 aa, West Nile virus
LKHDEKTL

SEQ ID NO: 130259 - protein, 8 aa, West Nile virus
ERTLVQSQ

SEQ ID NO: 130260 - protein, 8 aa, West Nile virus
VQSRVSAY

SEQ ID NO: 130261 - protein, 8 aa, West Nile virus
QSRVNAHN

SEQ ID NO: 130262 - protein, 8 aa, West Nile virus
SRVSAYKS

SEQ ID NO: 130263 - protein, 8 aa, West Nile virus
RVNAHNAD

SEQ ID NO: 130264 - protein, 8 aa, West Nile virus
VSAYKSDM

SEQ ID NO: 130265 - protein, 8 aa, West Nile virus
NAYNAEMI

SEQ ID NO: 130266 - protein, 8 aa, West Nile virus
GLLVVFLV

SEQ ID NO: 130267 - protein, 8 aa, West Nile virus
LLVVVLAT

SEQ ID NO: 130268 - protein, 8 aa, West Nile virus
LIVFLATQ

SEQ ID NO: 130269 - protein, 8 aa, West Nile virus
IVFLATQE

SEQ ID NO: 130270 - protein, 8 aa, West Nile virus
RWTAKISL

SEQ ID NO: 130271 - protein, 8 aa, West Nile virus
WTAKISLP

SEQ ID NO: 130272 - protein, 8 aa, West Nile virus
TAKISLPA

SEQ ID NO: 130273 - protein, 8 aa, West Nile virus
AKISLPAI

SEQ ID NO: 130274 - protein, 8 aa, West Nile virus
PAIMIALL

SEQ ID NO: 130275 - protein, 8 aa, West Nile virus
AIMIALLV

SEQ ID NO: 130276 - protein, 8 aa, West Nile virus
IMIALLVL

SEQ ID NO: 130277 - protein, 8 aa, West Nile virus
LVALAVLV

SEQ ID NO: 130278 - protein, 8 aa, West Nile virus
IALLVLVL

SEQ ID NO: 130279 - protein, 8 aa, West Nile virus
LVLVFGGV

SEQ ID NO: 130280 - protein, 8 aa, West Nile virus
VFGGITYI

SEQ ID NO: 130281 - protein, 8 aa, West Nile virus
FGGITYAD

SEQ ID NO: 130282 - protein, 8 aa, West Nile virus
GGITYADV

SEQ ID NO: 130283 - protein, 8 aa, West Nile virus
GITYADVL

SEQ ID NO: 130284 - protein, 8 aa, West Nile virus
VTYTDVLR

SEQ ID NO: 130285 - protein, 8 aa, West Nile virus
YTDVLRYI

SEQ ID NO: 130286 - protein, 8 aa, West Nile virus
ADVLRYVI

SEQ ID NO: 130287 - protein, 8 aa, West Nile virus
VLRYVILA

SEQ ID NO: 130288 - protein, 8 aa, West Nile virus
LRYIILVG

SEQ ID NO: 130289 - protein, 8 aa, West Nile virus
ATFRIQPV

SEQ ID NO: 130290 - protein, 8 aa, West Nile virus
TFRIQPVF

SEQ ID NO: 130291 - protein, 8 aa, West Nile virus
VQPVFMVA

SEQ ID NO: 130292 - protein, 8 aa, West Nile virus
QPVFVVAS

SEQ ID NO: 130293 - protein, 8 aa, West Nile virus
PVFVVASF

SEQ ID NO: 130294 - protein, 8 aa, West Nile virus
VFVVASFL

SEQ ID NO: 130295 - protein, 8 aa, West Nile virus
FMVATFVK

SEQ ID NO: 130296 - protein, 8 aa, West Nile virus
MVATFVKA

SEQ ID NO: 130297 - protein, 8 aa, West Nile virus
VASFLKAG

SEQ ID NO: 130298 - protein, 8 aa, West Nile virus
ATFVKARW

SEQ ID NO: 130299 - protein, 8 aa, West Nile virus
SFLRARWT

SEQ ID NO: 130300 - protein, 8 aa, West Nile virus
FLRARWTN

SEQ ID NO: 130301 - protein, 8 aa, West Nile virus
KARWTNHE

SEQ ID NO: 130302 - protein, 8 aa, West Nile virus
AKWTNQES

SEQ ID NO: 130303 - protein, 8 aa, West Nile virus
RWTNHENI

SEQ ID NO: 130304 - protein, 8 aa, West Nile virus
AFFQMAYI

SEQ ID NO: 130305 - protein, 8 aa, West Nile virus
QMAYIDSQ

SEQ ID NO: 130306 - protein, 8 aa, West Nile virus
WNIPDVLN

SEQ ID NO: 130307 - protein, 8 aa, West Nile virus
EMPDVLNS

SEQ ID NO: 130308 - protein, 8 aa, West Nile virus
SLAVAWMV

SEQ ID NO: 130309 - protein, 8 aa, West Nile virus
LAAAWMIL

SEQ ID NO: 130310 - protein, 8 aa, West Nile virus
AIAWMILR

SEQ ID NO: 130311 - protein, 8 aa, West Nile virus
ILRAITFP

SEQ ID NO: 130312 - protein, 8 aa, West Nile virus
FTSTSNVV

SEQ ID NO: 130313 - protein, 8 aa, West Nile virus
TSTSNVVV

SEQ ID NO: 130314 - protein, 8 aa, West Nile virus
NLDVYRIV

SEQ ID NO: 130315 - protein, 8 aa, West Nile virus
LDVYRIVL

SEQ ID NO: 130316 - protein, 8 aa, West Nile virus
DVYKILLL

SEQ ID NO: 130317 - protein, 8 aa, West Nile virus
VSRILLLM

SEQ ID NO: 130318 - protein, 8 aa, West Nile virus
YRILLLMI

SEQ ID NO: 130319 - protein, 8 aa, West Nile virus
MIGIGSLI

SEQ ID NO: 130320 - protein, 8 aa, West Nile virus
IGIGSLIR

SEQ ID NO: 130321 - protein, 8 aa, West Nile virus
GIGSLIKE

SEQ ID NO: 130322 - protein, 8 aa, West Nile virus
IGSLIKEK

SEQ ID NO: 130323 - protein, 8 aa, West Nile virus
GSLIKERR

SEQ ID NO: 130324 - protein, 8 aa, West Nile virus
SLIKEKKN

SEQ ID NO: 130325 - protein, 8 aa, West Nile virus
EKKNSAAK

SEQ ID NO: 130326 - protein, 8 aa, West Nile virus
RRSSAAKK

SEQ ID NO: 130327 - protein, 8 aa, West Nile virus
RNAAAKKK

SEQ ID NO: 130328 - protein, 8 aa, West Nile virus
NAAAKKKG

SEQ ID NO: 130329 - protein, 8 aa, West Nile virus
MILAAGLV

SEQ ID NO: 130330 - protein, 8 aa, West Nile virus
LVAGLLAC

SEQ ID NO: 130331 - protein, 8 aa, West Nile virus
VAGLLACD

SEQ ID NO: 130332 - protein, 8 aa, West Nile virus
AGLLACDP

SEQ ID NO: 130333 - protein, 8 aa, West Nile virus
GLLACDPN

SEQ ID NO: 130334 - protein, 8 aa, West Nile virus
LLACDPNR

SEQ ID NO: 130335 - protein, 8 aa, West Nile virus
LACDPNRK

SEQ ID NO: 130336 - protein, 8 aa, West Nile virus
LDIDSMAV

SEQ ID NO: 130337 - protein, 8 aa, West Nile virus
DMDSMAIP

SEQ ID NO: 130338 - protein, 8 aa, West Nile virus
IDTMAIPM

SEQ ID NO: 130339 - protein, 8 aa, West Nile virus
VADISWEN

SEQ ID NO: 130340 - protein, 8 aa, West Nile virus
ADISWEND

SEQ ID NO: 130341 - protein, 8 aa, West Nile virus
DISWESDV

SEQ ID NO: 130342 - protein, 8 aa, West Nile virus
ISWESDVE

SEQ ID NO: 130343 - protein, 8 aa, West Nile virus
SWENDAEI

SEQ ID NO: 130344 - protein, 8 aa, West Nile virus
WENDAEIT

SEQ ID NO: 130345 - protein, 8 aa, West Nile virus
ESDVEITG

SEQ ID NO: 130346 - protein, 8 aa, West Nile virus
NDAEITGS

SEQ ID NO: 130347 - protein, 8 aa, West Nile virus
GENFQLMN

SEQ ID NO: 130348 - protein, 8 aa, West Nile virus
GNFQLMSD

SEQ ID NO: 130349 - protein, 8 aa, West Nile virus
WILRMVCL

SEQ ID NO: 130350 - protein, 8 aa, West Nile virus
ILRMVCLA

SEQ ID NO: 130351 - protein, 8 aa, West Nile virus
MFCLAISA

SEQ ID NO: 130352 - protein, 8 aa, West Nile virus
ACLAVSAY

SEQ ID NO: 130353 - protein, 8 aa, West Nile virus
TPSPKEYE

SEQ ID NO: 130354 - protein, 8 aa, West Nile virus
EYRKGDTA

SEQ ID NO: 130355 - protein, 8 aa, West Nile virus
YEKGDTTT

SEQ ID NO: 130356 - protein, 8 aa, West Nile virus
EKGDTTTG

SEQ ID NO: 130357 - protein, 8 aa, West Nile virus
GPWKLQCK

SEQ ID NO: 130358 - protein, 8 aa, West Nile virus
PWKLQHRW

SEQ ID NO: 130359 - protein, 8 aa, West Nile virus
WKLQCKWN

SEQ ID NO: 130360 - protein, 8 aa, West Nile virus
KLQCKWNG

SEQ ID NO: 130361 - protein, 8 aa, West Nile virus
LQCKWNGQ

SEQ ID NO: 130362 - protein, 8 aa, West Nile virus
QHRWNGQD

SEQ ID NO: 130363 - protein, 8 aa, West Nile virus
HRWNGQDE

SEQ ID NO: 130364 - protein, 8 aa, West Nile virus
RWNGQDEV

SEQ ID NO: 130365 - protein, 8 aa, West Nile virus
VAEPGRKT

SEQ ID NO: 130366 - protein, 8 aa, West Nile virus
AEPGRKTR

SEQ ID NO: 130367 - protein, 8 aa, West Nile virus
KPGESVKN

SEQ ID NO: 130368 - protein, 8 aa, West Nile virus
PGESVKNV

SEQ ID NO: 130369 - protein, 8 aa, West Nile virus
GESVKNVQ

SEQ ID NO: 130370 - protein, 8 aa, West Nile virus
RKTRNVQT

SEQ ID NO: 130371 - protein, 8 aa, West Nile virus
KTRNVQTK

SEQ ID NO: 130372 - protein, 8 aa, West Nile virus
GERMEEPP

SEQ ID NO: 130373 - protein, 8 aa, West Nile virus
ERMEEPVP

SEQ ID NO: 130374 - protein, 8 aa, West Nile virus
RMDEPIPV

SEQ ID NO: 130375 - protein, 8 aa, West Nile virus
MDEPIPVG

SEQ ID NO: 130376 - protein, 8 aa, West Nile virus
DEPIPVGF

SEQ ID NO: 130377 - protein, 8 aa, West Nile virus
GFEPETLK

SEQ ID NO: 130378 - protein, 8 aa, West Nile virus
FDPEMLRK

SEQ ID NO: 130379 - protein, 8 aa, West Nile virus
EPETLKKK

SEQ ID NO: 130380 - protein, 8 aa, West Nile virus
PETLKKKQ

SEQ ID NO: 130381 - protein, 8 aa, West Nile virus
QIIKEAIS

SEQ ID NO: 130382 - protein, 8 aa, West Nile virus
IIKEAMNR

SEQ ID NO: 130383 - protein, 8 aa, West Nile virus
IKEAISKR

SEQ ID NO: 130384 - protein, 8 aa, West Nile virus
KEAISKRL

SEQ ID NO: 130385 - protein, 8 aa, West Nile virus
EAIDRRLR

SEQ ID NO: 130386 - protein, 8 aa, West Nile virus
AIDRRLRT

SEQ ID NO: 130387 - protein, 8 aa, West Nile virus
MNRRLRTA

SEQ ID NO: 130388 - protein, 8 aa, West Nile virus
SKRLRTAI

SEQ ID NO: 130389 - protein, 8 aa, West Nile virus
VVAAEMAD

SEQ ID NO: 130390 - protein, 8 aa, West Nile virus
VAAEMADA

SEQ ID NO: 130391 - protein, 8 aa, West Nile virus
AAEMADAL

SEQ ID NO: 130392 - protein, 8 aa, West Nile virus
RYQTSAVA

SEQ ID NO: 130393 - protein, 8 aa, West Nile virus
YQTSAVAR

SEQ ID NO: 130394 - protein, 8 aa, West Nile virus
QTSAVARE

SEQ ID NO: 130395 - protein, 8 aa, West Nile virus
TSAVAREH

SEQ ID NO: 130396 - protein, 8 aa, West Nile virus
AGGYIATK

SEQ ID NO: 130397 - protein, 8 aa, West Nile virus
GGYIATKV

SEQ ID NO: 130398 - protein, 8 aa, West Nile virus
STRVELGD

SEQ ID NO: 130399 - protein, 8 aa, West Nile virus
YEWITEFV

SEQ ID NO: 130400 - protein, 8 aa, West Nile virus
EWITEYAG

SEQ ID NO: 130401 - protein, 8 aa, West Nile virus
WITEFVGK

SEQ ID NO: 130402 - protein, 8 aa, West Nile virus
ITEFVGKT

SEQ ID NO: 130403 - protein, 8 aa, West Nile virus
TEYAGKTV

SEQ ID NO: 130404 - protein, 8 aa, West Nile virus
EYAGKTVW

SEQ ID NO: 130405 - protein, 8 aa, West Nile virus
FVGKTVWF

SEQ ID NO: 130406 - protein, 8 aa, West Nile virus
VKPIIITE

SEQ ID NO: 130407 - protein, 8 aa, West Nile virus
KPIIITEG

SEQ ID NO: 130408 - protein, 8 aa, West Nile virus
PTSITEGE

SEQ ID NO: 130409 - protein, 8 aa, West Nile virus
ITDGESRV

SEQ ID NO: 130410 - protein, 8 aa, West Nile virus
TEGEARVI

SEQ ID NO: 130411 - protein, 8 aa, West Nile virus
EGEARVIL

SEQ ID NO: 130412 - protein, 8 aa, West Nile virus
GEARVILG

SEQ ID NO: 130413 - protein, 8 aa, West Nile virus
EGKVVLSE

SEQ ID NO: 130414 - protein, 8 aa, West Nile virus
SRVVLGEP

SEQ ID NO: 130415 - protein, 8 aa, West Nile virus
GRTGRNPS

SEQ ID NO: 130416 - protein, 8 aa, West Nile virus
RTGRNPSQ

SEQ ID NO: 130417 - protein, 8 aa, West Nile virus
VGRNPSQV

SEQ ID NO: 130418 - protein, 8 aa, West Nile virus
TNEDDSNC

SEQ ID NO: 130419 - protein, 8 aa, West Nile virus
NEDDSNCA

SEQ ID NO: 130420 - protein, 8 aa, West Nile virus
EDDSNYAH

SEQ ID NO: 130421 - protein, 8 aa, West Nile virus
DDSNLAHW

SEQ ID NO: 130422 - protein, 8 aa, West Nile virus
DSNLAHWT

SEQ ID NO: 130423 - protein, 8 aa, West Nile virus
SNYAHWTE

SEQ ID NO: 130424 - protein, 8 aa, West Nile virus
NYAHWTEA

SEQ ID NO: 130425 - protein, 8 aa, West Nile virus
YAHWTEAR

SEQ ID NO: 130426 - protein, 8 aa, West Nile virus
CTMDGEYR

SEQ ID NO: 130427 - protein, 8 aa, West Nile virus
WLAHKVAA

SEQ ID NO: 130428 - protein, 8 aa, West Nile virus
LAYKAAAA

SEQ ID NO: 130429 - protein, 8 aa, West Nile virus
AYKAAAAG

SEQ ID NO: 130430 - protein, 8 aa, West Nile virus
YKVASAGI

SEQ ID NO: 130431 - protein, 8 aa, West Nile virus
KVAAAGVP

SEQ ID NO: 130432 - protein, 8 aa, West Nile virus
VASAGISY

SEQ ID NO: 130433 - protein, 8 aa, West Nile virus
GISYHDRR

SEQ ID NO: 130434 - protein, 8 aa, West Nile virus
ISYHDRRW

SEQ ID NO: 130435 - protein, 8 aa, West Nile virus
WTDARVYS

SEQ ID NO: 130436 - protein, 8 aa, West Nile virus
IDARVYLD

SEQ ID NO: 130437 - protein, 8 aa, West Nile virus
AAGKRSQI

SEQ ID NO: 130438 - protein, 8 aa, West Nile virus
SGKRSQMG

SEQ ID NO: 130439 - protein, 8 aa, West Nile virus
GKRSQMGL

SEQ ID NO: 130440 - protein, 8 aa, West Nile virus
KRSQIGFI

SEQ ID NO: 130441 - protein, 8 aa, West Nile virus
RSQMGLIE

SEQ ID NO: 130442 - protein, 8 aa, West Nile virus
SQVGLIEV

SEQ ID NO: 130443 - protein, 8 aa, West Nile virus
QIGFIEVL

SEQ ID NO: 130444 - protein, 8 aa, West Nile virus
IGFIEVLG

SEQ ID NO: 130445 - protein, 8 aa, West Nile virus
GFIEVLGK

SEQ ID NO: 130446 - protein, 8 aa, West Nile virus
FIEVLGKM

SEQ ID NO: 130447 - protein, 8 aa, West Nile virus
RMPEHFMV

SEQ ID NO: 130448 - protein, 8 aa, West Nile virus
ERGGRAHR

SEQ ID NO: 130449 - protein, 8 aa, West Nile virus
KGRRAHRM

SEQ ID NO: 130450 - protein, 8 aa, West Nile virus
GGRAHRSA

SEQ ID NO: 130451 - protein, 8 aa, West Nile virus
GRAHRSAL

SEQ ID NO: 130452 - protein, 8 aa, West Nile virus
LQTVALIA

SEQ ID NO: 130453 - protein, 8 aa, West Nile virus
QTVALIAL

SEQ ID NO: 130454 - protein, 8 aa, West Nile virus
TIILITLL

SEQ ID NO: 130455 - protein, 8 aa, West Nile virus
IILITLLS

SEQ ID NO: 130456 - protein, 8 aa, West Nile virus
ALIALLGV

SEQ ID NO: 130457 - protein, 8 aa, West Nile virus
IALLGVMT

SEQ ID NO: 130458 - protein, 8 aa, West Nile virus
LLGVMTMG

SEQ ID NO: 130459 - protein, 8 aa, West Nile virus
LGVMTMGV

SEQ ID NO: 130460 - protein, 8 aa, West Nile virus
SVMTMGIF

SEQ ID NO: 130461 - protein, 8 aa, West Nile virus
VMSMGVFF

SEQ ID NO: 130462 - protein, 8 aa, West Nile virus
MTMGIFFL

SEQ ID NO: 130463 - protein, 8 aa, West Nile virus
SMGVFFLL

SEQ ID NO: 130464 - protein, 8 aa, West Nile virus
MGIFFLLM

SEQ ID NO: 130465 - protein, 8 aa, West Nile virus
GKIGLGGI

SEQ ID NO: 130466 - protein, 8 aa, West Nile virus
LGVATLFC

SEQ ID NO: 130467 - protein, 8 aa, West Nile virus
GVATLFCW

SEQ ID NO: 130468 - protein, 8 aa, West Nile virus
VATLFCWM

SEQ ID NO: 130469 - protein, 8 aa, West Nile virus
FLICVLTF

SEQ ID NO: 130470 - protein, 8 aa, West Nile virus
MICVMTLV

SEQ ID NO: 130471 - protein, 8 aa, West Nile virus
ICVLTFIS

SEQ ID NO: 130472 - protein, 8 aa, West Nile virus
TPVSAVAA

SEQ ID NO: 130473 - protein, 8 aa, West Nile virus
FISAVAAN

SEQ ID NO: 130474 - protein, 8 aa, West Nile virus
LDKTKSDV

SEQ ID NO: 130475 - protein, 8 aa, West Nile virus
ENFLLDLR

SEQ ID NO: 130476 - protein, 8 aa, West Nile virus
DLLLDLKP

SEQ ID NO: 130477 - protein, 8 aa, West Nile virus
LYAVTTAF

SEQ ID NO: 130478 - protein, 8 aa, West Nile virus
YAVATAVL

SEQ ID NO: 130479 - protein, 8 aa, West Nile virus
AISTAFMT

SEQ ID NO: 130480 - protein, 8 aa, West Nile virus
VATAVLTP

SEQ ID NO: 130481 - protein, 8 aa, West Nile virus
STAFMTPL

SEQ ID NO: 130482 - protein, 8 aa, West Nile virus
TAVLTPLI

SEQ ID NO: 130483 - protein, 8 aa, West Nile virus
AFLTPLLK

SEQ ID NO: 130484 - protein, 8 aa, West Nile virus
VLTPLIKH

SEQ ID NO: 130485 - protein, 8 aa, West Nile virus
LTPLIKHL

SEQ ID NO: 130486 - protein, 8 aa, West Nile virus
ASTLFTLA

SEQ ID NO: 130487 - protein, 8 aa, West Nile virus
STLFTLAR

SEQ ID NO: 130488 - protein, 8 aa, West Nile virus
TLFTLARG

SEQ ID NO: 130489 - protein, 8 aa, West Nile virus
VLLFCHYA

SEQ ID NO: 130490 - protein, 8 aa, West Nile virus
IGQIMLIL

SEQ ID NO: 130491 - protein, 8 aa, West Nile virus
ILILVSMA

SEQ ID NO: 130492 - protein, 8 aa, West Nile virus
LIWVSLAA

SEQ ID NO: 130493 - protein, 8 aa, West Nile virus
ILVSLAAL

SEQ ID NO: 130494 - protein, 8 aa, West Nile virus
LVSLAALV

SEQ ID NO: 130495 - protein, 8 aa, West Nile virus
VSLAALVV

SEQ ID NO: 130496 - protein, 8 aa, West Nile virus
SLAALVVN

SEQ ID NO: 130497 - protein, 8 aa, West Nile virus
LAALVVNP

SEQ ID NO: 130498 - protein, 8 aa, West Nile virus
EAGILTSA

SEQ ID NO: 130499 - protein, 8 aa, West Nile virus
AGILTSAA

SEQ ID NO: 130500 - protein, 8 aa, West Nile virus
GILTSAAA

SEQ ID NO: 130501 - protein, 8 aa, West Nile virus
ILTSAAAV

SEQ ID NO: 130502 - protein, 8 aa, West Nile virus
LTSAAAVT

SEQ ID NO: 130503 - protein, 8 aa, West Nile virus
TSAAAVTL

SEQ ID NO: 130504 - protein, 8 aa, West Nile virus
WLSCLSIA

SEQ ID NO: 130505 - protein, 8 aa, West Nile virus
LSCLSIAW

SEQ ID NO: 130506 - protein, 8 aa, West Nile virus
SCLSIAWT

SEQ ID NO: 130507 - protein, 8 aa, West Nile virus
CLSIAWTL

SEQ ID NO: 130508 - protein, 8 aa, West Nile virus
SIMWTLIK

SEQ ID NO: 130509 - protein, 8 aa, West Nile virus
KNMEKPGI

SEQ ID NO: 130510 - protein, 8 aa, West Nile virus
SMEKPVLK

SEQ ID NO: 130511 - protein, 8 aa, West Nile virus
LEKPGLKR

SEQ ID NO: 130512 - protein, 8 aa, West Nile virus
EKPVLKRG

SEQ ID NO: 130513 - protein, 8 aa, West Nile virus
VWKEKLNQ

SEQ ID NO: 130514 - protein, 8 aa, West Nile virus
WKEKLNQM

SEQ ID NO: 130515 - protein, 8 aa, West Nile virus
KERLNYMT

SEQ ID NO: 130516 - protein, 8 aa, West Nile virus
MTREEFTR

SEQ ID NO: 130517 - protein, 8 aa, West Nile virus
SKEEFSRY

SEQ ID NO: 130518 - protein, 8 aa, West Nile virus
KEEFSRYR

SEQ ID NO: 130519 - protein, 8 aa, West Nile virus
EEFTRYRR

SEQ ID NO: 130520 - protein, 8 aa, West Nile virus
EFSRYRKE

SEQ ID NO: 130521 - protein, 8 aa, West Nile virus
FTRYRREA

SEQ ID NO: 130522 - protein, 8 aa, West Nile virus
SRYRKEAI

SEQ ID NO: 130523 - protein, 8 aa, West Nile virus
EVDRSTAK

SEQ ID NO: 130524 - protein, 8 aa, West Nile virus
ARREGNVT

SEQ ID NO: 130525 - protein, 8 aa, West Nile virus
RREGNVTG

SEQ ID NO: 130526 - protein, 8 aa, West Nile virus
REGNVTGG

SEQ ID NO: 130527 - protein, 8 aa, West Nile virus
GNVTGGHS

SEQ ID NO: 130528 - protein, 8 aa, West Nile virus
VEPVGRVI

SEQ ID NO: 130529 - protein, 8 aa, West Nile virus
EPVGRVID

SEQ ID NO: 130530 - protein, 8 aa, West Nile virus
PIGKVIDL

SEQ ID NO: 130531 - protein, 8 aa, West Nile virus
IGKVIDLG

SEQ ID NO: 130532 - protein, 8 aa, West Nile virus
VFYRPSES

SEQ ID NO: 130533 - protein, 8 aa, West Nile virus
FYRPSEVS

SEQ ID NO: 130534 - protein, 8 aa, West Nile virus
YRPSEVSD

SEQ ID NO: 130535 - protein, 8 aa, West Nile virus
RTSEASDT

SEQ ID NO: 130536 - protein, 8 aa, West Nile virus
PSESCDTL

SEQ ID NO: 130537 - protein, 8 aa, West Nile virus
RTIRVLEI

SEQ ID NO: 130538 - protein, 8 aa, West Nile virus
TIRVLEIV

SEQ ID NO: 130539 - protein, 8 aa, West Nile virus
MRVLEMVE

SEQ ID NO: 130540 - protein, 8 aa, West Nile virus
KVIEKMEI

SEQ ID NO: 130541 - protein, 8 aa, West Nile virus
VIEKMEIL

SEQ ID NO: 130542 - protein, 8 aa, West Nile virus
IEKMEILQ

SEQ ID NO: 130543 - protein, 8 aa, West Nile virus
EKMEILQR

SEQ ID NO: 130544 - protein, 8 aa, West Nile virus
KMEILQRR

SEQ ID NO: 130545 - protein, 8 aa, West Nile virus
MEILQRRY

SEQ ID NO: 130546 - protein, 8 aa, West Nile virus
EILQRRYG

SEQ ID NO: 130547 - protein, 8 aa, West Nile virus
ILQRRYGG

SEQ ID NO: 130548 - protein, 8 aa, West Nile virus
YWVSRASR

SEQ ID NO: 130549 - protein, 8 aa, West Nile virus
WVSQASGN

SEQ ID NO: 130550 - protein, 8 aa, West Nile virus
VSQASGNI

SEQ ID NO: 130551 - protein, 8 aa, West Nile virus
SRASSNVV

SEQ ID NO: 130552 - protein, 8 aa, West Nile virus
QASGNIVH

SEQ ID NO: 130553 - protein, 8 aa, West Nile virus
ASGNIVHA

SEQ ID NO: 130554 - protein, 8 aa, West Nile virus
NIVHAVNM

SEQ ID NO: 130555 - protein, 8 aa, West Nile virus
IVHAVNMT

SEQ ID NO: 130556 - protein, 8 aa, West Nile virus
KTWKGAHY

SEQ ID NO: 130557 - protein, 8 aa, West Nile virus
GAHYEEDV

SEQ ID NO: 130558 - protein, 8 aa, West Nile virus
AHYEEDVN

SEQ ID NO: 130559 - protein, 8 aa, West Nile virus
QYEEDANL

SEQ ID NO: 130560 - protein, 8 aa, West Nile virus
LLNSDTRK

SEQ ID NO: 130561 - protein, 8 aa, West Nile virus
LSSDTSKI

SEQ ID NO: 130562 - protein, 8 aa, West Nile virus
NSDTSKIN

SEQ ID NO: 130563 - protein, 8 aa, West Nile virus
SDTSKINN

SEQ ID NO: 130564 - protein, 8 aa, West Nile virus
DTSKINNR

SEQ ID NO: 130565 - protein, 8 aa, West Nile virus
IKNRVERL

SEQ ID NO: 130566 - protein, 8 aa, West Nile virus
NRIEKLKK

SEQ ID NO: 130567 - protein, 8 aa, West Nile virus
RIEKLKKE

SEQ ID NO: 130568 - protein, 8 aa, West Nile virus
IEKLKKEY

SEQ ID NO: 130569 - protein, 8 aa, West Nile virus
EKLKKEYG

SEQ ID NO: 130570 - protein, 8 aa, West Nile virus
REYSLTWH

SEQ ID NO: 130571 - protein, 8 aa, West Nile virus
DGNHPYRT

SEQ ID NO: 130572 - protein, 8 aa, West Nile virus
GNHPYRTW

SEQ ID NO: 130573 - protein, 8 aa, West Nile virus
YHGSYDVN

SEQ ID NO: 130574 - protein, 8 aa, West Nile virus
HGSYDVNP

SEQ ID NO: 130575 - protein, 8 aa, West Nile virus
GSYDVNPT

SEQ ID NO: 130576 - protein, 8 aa, West Nile virus
SYEVNPLV

SEQ ID NO: 130577 - protein, 8 aa, West Nile virus
YDVNPTGS

SEQ ID NO: 130578 - protein, 8 aa, West Nile virus
DVNPTGSA

SEQ ID NO: 130579 - protein, 8 aa, West Nile virus
PEPPEGVR

SEQ ID NO: 130580 - protein, 8 aa, West Nile virus
NWLWSHLE

SEQ ID NO: 130581 - protein, 8 aa, West Nile virus
WLWAYLAR

SEQ ID NO: 130582 - protein, 8 aa, West Nile virus
RGKRPRMC

SEQ ID NO: 130583 - protein, 8 aa, West Nile virus
GKRPRMCS

SEQ ID NO: 130584 - protein, 8 aa, West Nile virus
CTREEFIS

SEQ ID NO: 130585 - protein, 8 aa, West Nile virus
TREEFISK

SEQ ID NO: 130586 - protein, 8 aa, West Nile virus
REEFISKV

SEQ ID NO: 130587 - protein, 8 aa, West Nile virus
EEFISKVN

SEQ ID NO: 130588 - protein, 8 aa, West Nile virus
EFISKVNS

SEQ ID NO: 130589 - protein, 8 aa, West Nile virus
FISKVNSN

SEQ ID NO: 130590 - protein, 8 aa, West Nile virus
IKKVNSNA

SEQ ID NO: 130591 - protein, 8 aa, West Nile virus
SKVNSNAA

SEQ ID NO: 130592 - protein, 8 aa, West Nile virus
EEQNQWSN

SEQ ID NO: 130593 - protein, 8 aa, West Nile virus
EQNQWSNA

SEQ ID NO: 130594 - protein, 8 aa, West Nile virus
QNQWSNAR

SEQ ID NO: 130595 - protein, 8 aa, West Nile virus
NQWSNARE

SEQ ID NO: 130596 - protein, 8 aa, West Nile virus
QWSNAREA

SEQ ID NO: 130597 - protein, 8 aa, West Nile virus
WSNAREAV

SEQ ID NO: 130598 - protein, 8 aa, West Nile virus
SNAREAVE

SEQ ID NO: 130599 - protein, 8 aa, West Nile virus
AREAVEDS

SEQ ID NO: 130600 - protein, 8 aa, West Nile virus
REAVEDQK

SEQ ID NO: 130601 - protein, 8 aa, West Nile virus
EAVEDQKF

SEQ ID NO: 130602 - protein, 8 aa, West Nile virus
EDSTFWEM

SEQ ID NO: 130603 - protein, 8 aa, West Nile virus
DQKFWEMV

SEQ ID NO: 130604 - protein, 8 aa, West Nile virus
STFWEMVD

SEQ ID NO: 130605 - protein, 8 aa, West Nile virus
GGKVYADD

SEQ ID NO: 130606 - protein, 8 aa, West Nile virus
GRIYADDT

SEQ ID NO: 130607 - protein, 8 aa, West Nile virus
KVYADDTA

SEQ ID NO: 130608 - protein, 8 aa, West Nile virus
IFADDTAG

SEQ ID NO: 130609 - protein, 8 aa, West Nile virus
AIIELTYC

SEQ ID NO: 130610 - protein, 8 aa, West Nile virus
IIQLTYRH

SEQ ID NO: 130611 - protein, 8 aa, West Nile virus
ADGKTVMS

SEQ ID NO: 130612 - protein, 8 aa, West Nile virus
DRKTVMDV

SEQ ID NO: 130613 - protein, 8 aa, West Nile virus
RKTVMDVI

SEQ ID NO: 130614 - protein, 8 aa, West Nile virus
GEGVIGPE

SEQ ID NO: 130615 - protein, 8 aa, West Nile virus
EGVIGPED

SEQ ID NO: 130616 - protein, 8 aa, West Nile virus
GVIGPEDV

SEQ ID NO: 130617 - protein, 8 aa, West Nile virus
VITPDDVE

SEQ ID NO: 130618 - protein, 8 aa, West Nile virus
GPEDVEKL

SEQ ID NO: 130619 - protein, 8 aa, West Nile virus
PDDVERLG

SEQ ID NO: 130620 - protein, 8 aa, West Nile virus
RGKGPKVR

SEQ ID NO: 130621 - protein, 8 aa, West Nile virus
TSLHFLND

SEQ ID NO: 130622 - protein, 8 aa, West Nile virus
ICSAVPVD

SEQ ID NO: 130623 - protein, 8 aa, West Nile virus
CSAVPVDW

SEQ ID NO: 130624 - protein, 8 aa, West Nile virus
SAVPVDWV

SEQ ID NO: 130625 - protein, 8 aa, West Nile virus
AVPVDWVP

SEQ ID NO: 130626 - protein, 8 aa, West Nile virus
VPVDWVPT

SEQ ID NO: 130627 - protein, 8 aa, West Nile virus
PVDWVPTG

SEQ ID NO: 130628 - protein, 8 aa, West Nile virus
VDWVPTGR

SEQ ID NO: 130629 - protein, 8 aa, West Nile virus
TTWSIHVG

SEQ ID NO: 130630 - protein, 8 aa, West Nile virus
TWSIHVGG

SEQ ID NO: 130631 - protein, 8 aa, West Nile virus
WSIHVGGE

SEQ ID NO: 130632 - protein, 8 aa, West Nile virus
SIHVGGEW

SEQ ID NO: 130633 - protein, 8 aa, West Nile virus
IHVGGEWM

SEQ ID NO: 130634 - protein, 8 aa, West Nile virus
HVGGEWMT

SEQ ID NO: 130635 - protein, 8 aa, West Nile virus
VGGEWMTT

SEQ ID NO: 130636 - protein, 8 aa, West Nile virus
RGEWMTTE

SEQ ID NO: 130637 - protein, 8 aa, West Nile virus
MTTEDMLS

SEQ ID NO: 130638 - protein, 8 aa, West Nile virus
TTEDMLSV

SEQ ID NO: 130639 - protein, 8 aa, West Nile virus
TEDMLSVW

SEQ ID NO: 130640 - protein, 8 aa, West Nile virus
EDMLSVWN

SEQ ID NO: 130641 - protein, 8 aa, West Nile virus
DMLSVWNR

SEQ ID NO: 130642 - protein, 8 aa, West Nile virus
MLSVWNRV

SEQ ID NO: 130643 - protein, 8 aa, West Nile virus
LSVWNRVW

SEQ ID NO: 130644 - protein, 8 aa, West Nile virus
SVWNRVWI

SEQ ID NO: 130645 - protein, 8 aa, West Nile virus
GSLRRYED

SEQ ID NO: 130646 - protein, 8 aa, West Nile virus
SLRRYEDA

SEQ ID NO: 130647 - protein, 8 aa, West Nile virus
VNMLKRGT

SEQ ID NO: 130648 - protein, 8 aa, West Nile virus
NMLKRGTP

SEQ ID NO: 130649 - protein, 8 aa, West Nile virus
MLKRGKPR

SEQ ID NO: 130650 - protein, 8 aa, West Nile virus
KRGKPRGG

SEQ ID NO: 130651 - protein, 8 aa, West Nile virus
RGKPRGGS

SEQ ID NO: 130652 - protein, 8 aa, West Nile virus
GKPRGGSL

SEQ ID NO: 130653 - protein, 8 aa, West Nile virus
KELGTLTN

SEQ ID NO: 130654 - protein, 8 aa, West Nile virus
NRRSAKQK

SEQ ID NO: 130655 - protein, 8 aa, West Nile virus
RRSSKEKK

SEQ ID NO: 130656 - protein, 8 aa, West Nile virus
RSSKEKKR

SEQ ID NO: 130657 - protein, 8 aa, West Nile virus
SEKKKKRG

SEQ ID NO: 130658 - protein, 8 aa, West Nile virus
EKKKKRGG

SEQ ID NO: 130659 - protein, 8 aa, West Nile virus
KEKKRGGK

SEQ ID NO: 130660 - protein, 8 aa, West Nile virus
KKKRGGSI

SEQ ID NO: 130661 - protein, 8 aa, West Nile virus
RAVTLSNF

SEQ ID NO: 130662 - protein, 8 aa, West Nile virus
TVNATDVA

SEQ ID NO: 130663 - protein, 8 aa, West Nile virus
IITIPPAA

SEQ ID NO: 130664 - protein, 8 aa, West Nile virus
FMCDDTIT

SEQ ID NO: 130665 - protein, 8 aa, West Nile virus
CWCTKAAV

SEQ ID NO: 130666 - protein, 8 aa, West Nile virus
THGKSTLA

SEQ ID NO: 130667 - protein, 8 aa, West Nile virus
MQRVVFIV

SEQ ID NO: 130668 - protein, 8 aa, West Nile virus
QRVVFIVL

SEQ ID NO: 130669 - protein, 8 aa, West Nile virus
RVVFIVLL

SEQ ID NO: 130670 - protein, 8 aa, West Nile virus
VVFIVLLL

SEQ ID NO: 130671 - protein, 8 aa, West Nile virus
VFIVLLLL

SEQ ID NO: 130672 - protein, 8 aa, West Nile virus
FIVLLLLV

SEQ ID NO: 130673 - protein, 8 aa, West Nile virus
IVLLLLVA

SEQ ID NO: 130674 - protein, 8 aa, West Nile virus
LGDVRSYC

SEQ ID NO: 130675 - protein, 8 aa, West Nile virus
ADVRHYCY

SEQ ID NO: 130676 - protein, 8 aa, West Nile virus
EVRSYCHL

SEQ ID NO: 130677 - protein, 8 aa, West Nile virus
VSELSTRA

SEQ ID NO: 130678 - protein, 8 aa, West Nile virus
NDLSPRAA

SEQ ID NO: 130679 - protein, 8 aa, West Nile virus
ELSTRAAC

SEQ ID NO: 130680 - protein, 8 aa, West Nile virus
TQAGRFTV

SEQ ID NO: 130681 - protein, 8 aa, West Nile virus
GRFTVSPS

SEQ ID NO: 130682 - protein, 8 aa, West Nile virus
RFSVTPAA

SEQ ID NO: 130683 - protein, 8 aa, West Nile virus
FSVTPAAP

SEQ ID NO: 130684 - protein, 8 aa, West Nile virus
VTPAAPSY

SEQ ID NO: 130685 - protein, 8 aa, West Nile virus
TGAYYVMS

SEQ ID NO: 130686 - protein, 8 aa, West Nile virus
GAYYVMSV

SEQ ID NO: 130687 - protein, 8 aa, West Nile virus
YVMSVGSK

SEQ ID NO: 130688 - protein, 8 aa, West Nile virus
PWSSAGGT

SEQ ID NO: 130689 - protein, 8 aa, West Nile virus
TAWRNRET

SEQ ID NO: 130690 - protein, 8 aa, West Nile virus
AWRNRETL

SEQ ID NO: 130691 - protein, 8 aa, West Nile virus
NPFVSVAA

SEQ ID NO: 130692 - protein, 8 aa, West Nile virus
PFVAAATA

SEQ ID NO: 130693 - protein, 8 aa, West Nile virus
ATADAKVL

SEQ ID NO: 130694 - protein, 8 aa, West Nile virus
TADAKVLI

SEQ ID NO: 130695 - protein, 8 aa, West Nile virus
TGCAIDVG

SEQ ID NO: 130696 - protein, 8 aa, West Nile virus
GCAINITR

SEQ ID NO: 130697 - protein, 8 aa, West Nile virus
CAIDVGRQ

SEQ ID NO: 130698 - protein, 8 aa, West Nile virus
AIDVSRQE

SEQ ID NO: 130699 - protein, 8 aa, West Nile virus
INITRQEL

SEQ ID NO: 130700 - protein, 8 aa, West Nile virus
DVGRQELR

SEQ ID NO: 130701 - protein, 8 aa, West Nile virus
VSRQELRC

SEQ ID NO: 130702 - protein, 8 aa, West Nile virus
NDVKAWMD

SEQ ID NO: 130703 - protein, 8 aa, West Nile virus
DVEVWMDR

SEQ ID NO: 130704 - protein, 8 aa, West Nile virus
VEVWMDRY

SEQ ID NO: 130705 - protein, 8 aa, West Nile virus
EVWMDRYK

SEQ ID NO: 130706 - protein, 8 aa, West Nile virus
DRYKYHPE

SEQ ID NO: 130707 - protein, 8 aa, West Nile virus
RYKFHPET

SEQ ID NO: 130708 - protein, 8 aa, West Nile virus
YKFHPETP

SEQ ID NO: 130709 - protein, 8 aa, West Nile virus
KYHPETPQ

SEQ ID NO: 130710 - protein, 8 aa, West Nile virus
IQKAHQEG

SEQ ID NO: 130711 - protein, 8 aa, West Nile virus
AHESGTCG

SEQ ID NO: 130712 - protein, 8 aa, West Nile virus
EHQMWDSV

SEQ ID NO: 130713 - protein, 8 aa, West Nile virus
HQMWDSVK

SEQ ID NO: 130714 - protein, 8 aa, West Nile virus
QMWDSVKD

SEQ ID NO: 130715 - protein, 8 aa, West Nile virus
MWDSVKDE

SEQ ID NO: 130716 - protein, 8 aa, West Nile virus
WDSVKDEL

SEQ ID NO: 130717 - protein, 8 aa, West Nile virus
DSVKDELN

SEQ ID NO: 130718 - protein, 8 aa, West Nile virus
ENGIDLSM

SEQ ID NO: 130719 - protein, 8 aa, West Nile virus
NGIDLSMV

SEQ ID NO: 130720 - protein, 8 aa, West Nile virus
GIDLSMVV

SEQ ID NO: 130721 - protein, 8 aa, West Nile virus
VDLTVVVE

SEQ ID NO: 130722 - protein, 8 aa, West Nile virus
VVEKQDGL

SEQ ID NO: 130723 - protein, 8 aa, West Nile virus
APKRLKAT

SEQ ID NO: 130724 - protein, 8 aa, West Nile virus
ATSEKLEI

SEQ ID NO: 130725 - protein, 8 aa, West Nile virus
TTEKFEIG

SEQ ID NO: 130726 - protein, 8 aa, West Nile virus
TDKLEIGW

SEQ ID NO: 130727 - protein, 8 aa, West Nile virus
LANHTFVV

SEQ ID NO: 130728 - protein, 8 aa, West Nile virus
STFVVDGP

SEQ ID NO: 130729 - protein, 8 aa, West Nile virus
PETEECPS

SEQ ID NO: 130730 - protein, 8 aa, West Nile virus
VRKSNTTE

SEQ ID NO: 130731 - protein, 8 aa, West Nile virus
VNTTECDA

SEQ ID NO: 130732 - protein, 8 aa, West Nile virus
FNETWKLE

SEQ ID NO: 130733 - protein, 8 aa, West Nile virus
TLWGDGVI

SEQ ID NO: 130734 - protein, 8 aa, West Nile virus
LWGDGVIE

SEQ ID NO: 130735 - protein, 8 aa, West Nile virus
WGDGVIES

SEQ ID NO: 130736 - protein, 8 aa, West Nile virus
GVIESELI

SEQ ID NO: 130737 - protein, 8 aa, West Nile virus
VIESELII

SEQ ID NO: 130738 - protein, 8 aa, West Nile virus
CGHRGAST

SEQ ID NO: 130739 - protein, 8 aa, West Nile virus
GHRGPSAR

SEQ ID NO: 130740 - protein, 8 aa, West Nile virus
PPLRFKTE

SEQ ID NO: 130741 - protein, 8 aa, West Nile virus
IRPLKHDE

SEQ ID NO: 130742 - protein, 8 aa, West Nile virus
RPQKHDER

SEQ ID NO: 130743 - protein, 8 aa, West Nile virus
PLKHDEKT

SEQ ID NO: 130744 - protein, 8 aa, West Nile virus
QKHDERTL

SEQ ID NO: 130745 - protein, 8 aa, West Nile virus
RVSAYKSD

SEQ ID NO: 130746 - protein, 8 aa, West Nile virus
LVVVLATQ

SEQ ID NO: 130747 - protein, 8 aa, West Nile virus
PAILVALA

SEQ ID NO: 130748 - protein, 8 aa, West Nile virus
AILVALAV

SEQ ID NO: 130749 - protein, 8 aa, West Nile virus
ILVALAVL

SEQ ID NO: 130750 - protein, 8 aa, West Nile virus
LLALLVLV

SEQ ID NO: 130751 - protein, 8 aa, West Nile virus
TDVLRYVN

SEQ ID NO: 130752 - protein, 8 aa, West Nile virus
VVASFLKA

SEQ ID NO: 130753 - protein, 8 aa, West Nile virus
VASFLRAR

SEQ ID NO: 130754 - protein, 8 aa, West Nile virus
ASFLKAGW

SEQ ID NO: 130755 - protein, 8 aa, West Nile virus
TFVKARWT

SEQ ID NO: 130756 - protein, 8 aa, West Nile virus
FVKARWTN

SEQ ID NO: 130757 - protein, 8 aa, West Nile virus
KAGWTNQE

SEQ ID NO: 130758 - protein, 8 aa, West Nile virus
ARWTNHEN

SEQ ID NO: 130759 - protein, 8 aa, West Nile virus
RWTNQENT

SEQ ID NO: 130760 - protein, 8 aa, West Nile virus
AFFQMAYH

SEQ ID NO: 130761 - protein, 8 aa, West Nile virus
WGIPDVLN

SEQ ID NO: 130762 - protein, 8 aa, West Nile virus
GIPDVLNS

SEQ ID NO: 130763 - protein, 8 aa, West Nile virus
VGIGSLIK

SEQ ID NO: 130764 - protein, 8 aa, West Nile virus
SLIKERRS

SEQ ID NO: 130765 - protein, 8 aa, West Nile virus
EKRNAAAK

SEQ ID NO: 130766 - protein, 8 aa, West Nile virus
KKNSAAKK

SEQ ID NO: 130767 - protein, 8 aa, West Nile virus
ITLAAGLM

SEQ ID NO: 130768 - protein, 8 aa, West Nile virus
LAAGLVAC

SEQ ID NO: 130769 - protein, 8 aa, West Nile virus
AAGLVACD

SEQ ID NO: 130770 - protein, 8 aa, West Nile virus
AGLVACDP

SEQ ID NO: 130771 - protein, 8 aa, West Nile virus
GLVACDPN

SEQ ID NO: 130772 - protein, 8 aa, West Nile virus
LVACDPNR

SEQ ID NO: 130773 - protein, 8 aa, West Nile virus
VACDPNRK

SEQ ID NO: 130774 - protein, 8 aa, West Nile virus
TANISWES

SEQ ID NO: 130775 - protein, 8 aa, West Nile virus
DISWENDA

SEQ ID NO: 130776 - protein, 8 aa, West Nile virus
ISWENDAE

SEQ ID NO: 130777 - protein, 8 aa, West Nile virus
SWESDVEI

SEQ ID NO: 130778 - protein, 8 aa, West Nile virus
SDVEITGS

SEQ ID NO: 130779 - protein, 8 aa, West Nile virus
WMLKMACL

SEQ ID NO: 130780 - protein, 8 aa, West Nile virus
MLRMFCLA

SEQ ID NO: 130781 - protein, 8 aa, West Nile virus
MVCLAVSA

SEQ ID NO: 130782 - protein, 8 aa, West Nile virus
FCLAISAY

SEQ ID NO: 130783 - protein, 8 aa, West Nile virus
TPSPKVYK

SEQ ID NO: 130784 - protein, 8 aa, West Nile virus
EYEKGDTT

SEQ ID NO: 130785 - protein, 8 aa, West Nile virus
LQHRWNGQ

SEQ ID NO: 130786 - protein, 8 aa, West Nile virus
GHRWNGMD

SEQ ID NO: 130787 - protein, 8 aa, West Nile virus
CKWNGQDE

SEQ ID NO: 130788 - protein, 8 aa, West Nile virus
RMEEPVPS

SEQ ID NO: 130789 - protein, 8 aa, West Nile virus
MEEPPPVG

SEQ ID NO: 130790 - protein, 8 aa, West Nile virus
EEPVPSGF

SEQ ID NO: 130791 - protein, 8 aa, West Nile virus
IIKEAIDR

SEQ ID NO: 130792 - protein, 8 aa, West Nile virus
IKEAIDRR

SEQ ID NO: 130793 - protein, 8 aa, West Nile virus
KEAIDRRL

SEQ ID NO: 130794 - protein, 8 aa, West Nile virus
DRRLRTAV

SEQ ID NO: 130795 - protein, 8 aa, West Nile virus
RYHTSAVT

SEQ ID NO: 130796 - protein, 8 aa, West Nile virus
YQTSAVNR

SEQ ID NO: 130797 - protein, 8 aa, West Nile virus
QTSAVNRE

SEQ ID NO: 130798 - protein, 8 aa, West Nile virus
ITEGEARV

SEQ ID NO: 130799 - protein, 8 aa, West Nile virus
TDGESRVV

SEQ ID NO: 130800 - protein, 8 aa, West Nile virus
DGESRVVL

SEQ ID NO: 130801 - protein, 8 aa, West Nile virus
GESRVVLG

SEQ ID NO: 130802 - protein, 8 aa, West Nile virus
ESRVVLGE

SEQ ID NO: 130803 - protein, 8 aa, West Nile virus
HKVAAAGV

SEQ ID NO: 130804 - protein, 8 aa, West Nile virus
KVASAGIS

SEQ ID NO: 130805 - protein, 8 aa, West Nile virus
KRSQMGLI

SEQ ID NO: 130806 - protein, 8 aa, West Nile virus
QVGLIEVL

SEQ ID NO: 130807 - protein, 8 aa, West Nile virus
MGLIEVLG

SEQ ID NO: 130808 - protein, 8 aa, West Nile virus
LSVMTMGI

SEQ ID NO: 130809 - protein, 8 aa, West Nile virus
SVMSMGVF

SEQ ID NO: 130810 - protein, 8 aa, West Nile virus
VMTMGIFF

SEQ ID NO: 130811 - protein, 8 aa, West Nile virus
MTMGVFLL

SEQ ID NO: 130812 - protein, 8 aa, West Nile virus
TMGVFLLL

SEQ ID NO: 130813 - protein, 8 aa, West Nile virus
SKIGLAGV

SEQ ID NO: 130814 - protein, 8 aa, West Nile virus
LAVATFFC

SEQ ID NO: 130815 - protein, 8 aa, West Nile virus
ICVMTLVG

SEQ ID NO: 130816 - protein, 8 aa, West Nile virus
ADLLLDLK

SEQ ID NO: 130817 - protein, 8 aa, West Nile virus
NFLLDLRP

SEQ ID NO: 130818 - protein, 8 aa, West Nile virus
MLIWVSLA

SEQ ID NO: 130819 - protein, 8 aa, West Nile virus
IWVSLAAV

SEQ ID NO: 130820 - protein, 8 aa, West Nile virus
WVSLAAVV

SEQ ID NO: 130821 - protein, 8 aa, West Nile virus
SIAWTLIK

SEQ ID NO: 130822 - protein, 8 aa, West Nile virus
KSMEKPVL

SEQ ID NO: 130823 - protein, 8 aa, West Nile virus
NLEKPGLK

SEQ ID NO: 130824 - protein, 8 aa, West Nile virus
MEKPVLKR

SEQ ID NO: 130825 - protein, 8 aa, West Nile virus
AWKERLNQ

SEQ ID NO: 130826 - protein, 8 aa, West Nile virus
WKERLNYM

SEQ ID NO: 130827 - protein, 8 aa, West Nile virus
KEKLNQMS

SEQ ID NO: 130828 - protein, 8 aa, West Nile virus
MTKEEFAR

SEQ ID NO: 130829 - protein, 8 aa, West Nile virus
VFYRTSEA

SEQ ID NO: 130830 - protein, 8 aa, West Nile virus
FYRTSEAS

SEQ ID NO: 130831 - protein, 8 aa, West Nile virus
YRTSEASD

SEQ ID NO: 130832 - protein, 8 aa, West Nile virus
RPSESCDT

SEQ ID NO: 130833 - protein, 8 aa, West Nile virus
TSEASDTL

SEQ ID NO: 130834 - protein, 8 aa, West Nile virus
RVIEKMET

SEQ ID NO: 130835 - protein, 8 aa, West Nile virus
VSRASRNV

SEQ ID NO: 130836 - protein, 8 aa, West Nile virus
SRASRNVV

SEQ ID NO: 130837 - protein, 8 aa, West Nile virus
RASSNVVH

SEQ ID NO: 130838 - protein, 8 aa, West Nile virus
ASSNVVHS

SEQ ID NO: 130839 - protein, 8 aa, West Nile virus
KTWKGPHY

SEQ ID NO: 130840 - protein, 8 aa, West Nile virus
PQYEEDVS

SEQ ID NO: 130841 - protein, 8 aa, West Nile virus
SSDTSKIK

SEQ ID NO: 130842 - protein, 8 aa, West Nile virus
SDTSRIKS

SEQ ID NO: 130843 - protein, 8 aa, West Nile virus
DTSKIKSR

SEQ ID NO: 130844 - protein, 8 aa, West Nile virus
INNRIERL

SEQ ID NO: 130845 - protein, 8 aa, West Nile virus
NRIERLKR

SEQ ID NO: 130846 - protein, 8 aa, West Nile virus
ERLKREYG

SEQ ID NO: 130847 - protein, 8 aa, West Nile virus
REYGSTWH

SEQ ID NO: 130848 - protein, 8 aa, West Nile virus
DSNHPYRT

SEQ ID NO: 130849 - protein, 8 aa, West Nile virus
SNHPYRTW

SEQ ID NO: 130850 - protein, 8 aa, West Nile virus
RDKRPRLC

SEQ ID NO: 130851 - protein, 8 aa, West Nile virus
DKRPRLCS

SEQ ID NO: 130852 - protein, 8 aa, West Nile virus
CSREEFIS

SEQ ID NO: 130853 - protein, 8 aa, West Nile virus
SREEFISK

SEQ ID NO: 130854 - protein, 8 aa, West Nile virus
NQWRSARA

SEQ ID NO: 130855 - protein, 8 aa, West Nile virus
QWRSARAA

SEQ ID NO: 130856 - protein, 8 aa, West Nile virus
WRSARAAV

SEQ ID NO: 130857 - protein, 8 aa, West Nile virus
RSARAAVE

SEQ ID NO: 130858 - protein, 8 aa, West Nile virus
GGKIFADD

SEQ ID NO: 130859 - protein, 8 aa, West Nile virus
GKIFADDT

SEQ ID NO: 130860 - protein, 8 aa, West Nile virus
KIFADDTA

SEQ ID NO: 130861 - protein, 8 aa, West Nile virus
DGKTVMSL

SEQ ID NO: 130862 - protein, 8 aa, West Nile virus
GVIGPDDI

SEQ ID NO: 130863 - protein, 8 aa, West Nile virus
VIGPYDVE

SEQ ID NO: 130864 - protein, 8 aa, West Nile virus
GPDDVERL

SEQ ID NO: 130865 - protein, 8 aa, West Nile virus
PEDVEKLT

SEQ ID NO: 130866 - protein, 8 aa, West Nile virus
DMLGVWNK

SEQ ID NO: 130867 - protein, 8 aa, West Nile virus
SLKRYEDV

SEQ ID NO: 130868 - protein, 9 aa, West Nile virus
MSKKPGGPG

SEQ ID NO: 130869 - protein, 9 aa, West Nile virus
SKKPGGPGK

SEQ ID NO: 130870 - protein, 9 aa, West Nile virus
KKPGGPGKS

SEQ ID NO: 130871 - protein, 9 aa, West Nile virus
KPGGPGKSR

SEQ ID NO: 130872 - protein, 9 aa, West Nile virus
PGGPGKSRA

SEQ ID NO: 130873 - protein, 9 aa, West Nile virus
GGPGKSRAV

SEQ ID NO: 130874 - protein, 9 aa, West Nile virus
GPGKSRAVN

SEQ ID NO: 130875 - protein, 9 aa, West Nile virus
PGKSRAVNM

SEQ ID NO: 130876 - protein, 9 aa, West Nile virus
GKSRAVNML

SEQ ID NO: 130877 - protein, 9 aa, West Nile virus
KSRAVNMLK

SEQ ID NO: 130878 - protein, 9 aa, West Nile virus
SRAVNMLKR

SEQ ID NO: 130879 - protein, 9 aa, West Nile virus
RAVNMLKRG

SEQ ID NO: 130880 - protein, 9 aa, West Nile virus
AVNMLKRGM

SEQ ID NO: 130881 - protein, 9 aa, West Nile virus
VNMLKRGMP

SEQ ID NO: 130882 - protein, 9 aa, West Nile virus
NMLKRGMPR

SEQ ID NO: 130883 - protein, 9 aa, West Nile virus
KRGMPRVLS

SEQ ID NO: 130884 - protein, 9 aa, West Nile virus
RGMPRVLSL

SEQ ID NO: 130885 - protein, 9 aa, West Nile virus
PRVLSLIGL

SEQ ID NO: 130886 - protein, 9 aa, West Nile virus
RVLSLIGLK

SEQ ID NO: 130887 - protein, 9 aa, West Nile virus
VLSLIGLKR

SEQ ID NO: 130888 - protein, 9 aa, West Nile virus
LSLIGLKRA

SEQ ID NO: 130889 - protein, 9 aa, West Nile virus
SLIGLKRAM

SEQ ID NO: 130890 - protein, 9 aa, West Nile virus
LIGLKRAML

SEQ ID NO: 130891 - protein, 9 aa, West Nile virus
IGLKRAMLS

SEQ ID NO: 130892 - protein, 9 aa, West Nile virus
GLKRAMLSL

SEQ ID NO: 130893 - protein, 9 aa, West Nile virus
LKRAMLSLI

SEQ ID NO: 130894 - protein, 9 aa, West Nile virus
KRAMLSLID

SEQ ID NO: 130895 - protein, 9 aa, West Nile virus
RAMLSLIDG

SEQ ID NO: 130896 - protein, 9 aa, West Nile virus
AMLSLIDGK

SEQ ID NO: 130897 - protein, 9 aa, West Nile virus
MLSLIDGKG

SEQ ID NO: 130898 - protein, 9 aa, West Nile virus
LSLIDGKGP

SEQ ID NO: 130899 - protein, 9 aa, West Nile virus
SLIDGKGPI

SEQ ID NO: 130900 - protein, 9 aa, West Nile virus
LIDGKGPIR

SEQ ID NO: 130901 - protein, 9 aa, West Nile virus
IDGKGPIRF

SEQ ID NO: 130902 - protein, 9 aa, West Nile virus
DGKGPIRFV

SEQ ID NO: 130903 - protein, 9 aa, West Nile virus
GKGPIRFVL

SEQ ID NO: 130904 - protein, 9 aa, West Nile virus
KGPIRFVLA

SEQ ID NO: 130905 - protein, 9 aa, West Nile virus
GPIRFVLAL

SEQ ID NO: 130906 - protein, 9 aa, West Nile virus
PIRFVLALL

SEQ ID NO: 130907 - protein, 9 aa, West Nile virus
IRFVLALLA

SEQ ID NO: 130908 - protein, 9 aa, West Nile virus
RFVLALLAF

SEQ ID NO: 130909 - protein, 9 aa, West Nile virus
FVLALLAFF

SEQ ID NO: 130910 - protein, 9 aa, West Nile virus
VLALLAFFR

SEQ ID NO: 130911 - protein, 9 aa, West Nile virus
LALLAFFRF

SEQ ID NO: 130912 - protein, 9 aa, West Nile virus
ALLAFFRFT

SEQ ID NO: 130913 - protein, 9 aa, West Nile virus
LLAFFRFTA

SEQ ID NO: 130914 - protein, 9 aa, West Nile virus
LAFFRFTAI

SEQ ID NO: 130915 - protein, 9 aa, West Nile virus
AFFRFTAIA

SEQ ID NO: 130916 - protein, 9 aa, West Nile virus
FFRFTAIAP

SEQ ID NO: 130917 - protein, 9 aa, West Nile virus
FRFTAIAPT

SEQ ID NO: 130918 - protein, 9 aa, West Nile virus
RFTAIAPTR

SEQ ID NO: 130919 - protein, 9 aa, West Nile virus
FTAIAPTRA

SEQ ID NO: 130920 - protein, 9 aa, West Nile virus
TAIAPTRAV

SEQ ID NO: 130921 - protein, 9 aa, West Nile virus
AIAPTRAVL

SEQ ID NO: 130922 - protein, 9 aa, West Nile virus
IAPTRAVLD

SEQ ID NO: 130923 - protein, 9 aa, West Nile virus
APTRAVLDR

SEQ ID NO: 130924 - protein, 9 aa, West Nile virus
PTRAVLDRW

SEQ ID NO: 130925 - protein, 9 aa, West Nile virus
TRAVLDRWR

SEQ ID NO: 130926 - protein, 9 aa, West Nile virus
RAVLDRWRG

SEQ ID NO: 130927 - protein, 9 aa, West Nile virus
AVLDRWRGV

SEQ ID NO: 130928 - protein, 9 aa, West Nile virus
VLDRWRGVN

SEQ ID NO: 130929 - protein, 9 aa, West Nile virus
LDRWRGVNK

SEQ ID NO: 130930 - protein, 9 aa, West Nile virus
DRWRGVNKQ

SEQ ID NO: 130931 - protein, 9 aa, West Nile virus
RWRGVNKQT

SEQ ID NO: 130932 - protein, 9 aa, West Nile virus
WRGVNKQTA

SEQ ID NO: 130933 - protein, 9 aa, West Nile virus
RGVNKQTAM

SEQ ID NO: 130934 - protein, 9 aa, West Nile virus
GVNKQTAMK

SEQ ID NO: 130935 - protein, 9 aa, West Nile virus
VNKQTAMKH

SEQ ID NO: 130936 - protein, 9 aa, West Nile virus
NKQTAMKHL

SEQ ID NO: 130937 - protein, 9 aa, West Nile virus
KQTAMKHLL

SEQ ID NO: 130938 - protein, 9 aa, West Nile virus
QTAMKHLLS

SEQ ID NO: 130939 - protein, 9 aa, West Nile virus
TAMKHLLSF

SEQ ID NO: 130940 - protein, 9 aa, West Nile virus
AMKHLLSFK

SEQ ID NO: 130941 - protein, 9 aa, West Nile virus
MKHLLSFKK

SEQ ID NO: 130942 - protein, 9 aa, West Nile virus
KHLLSFKKE

SEQ ID NO: 130943 - protein, 9 aa, West Nile virus
HLLSFKKEL

SEQ ID NO: 130944 - protein, 9 aa, West Nile virus
LLSFKKELG

SEQ ID NO: 130945 - protein, 9 aa, West Nile virus
LSFKKELGT

SEQ ID NO: 130946 - protein, 9 aa, West Nile virus
SFKKELGTL

SEQ ID NO: 130947 - protein, 9 aa, West Nile virus
FKKELGTLT

SEQ ID NO: 130948 - protein, 9 aa, West Nile virus
KKELGTLTS

SEQ ID NO: 130949 - protein, 9 aa, West Nile virus
KELGTLTSA

SEQ ID NO: 130950 - protein, 9 aa, West Nile virus
ELGTLTSAI

SEQ ID NO: 130951 - protein, 9 aa, West Nile virus
LGTLTSAIN

SEQ ID NO: 130952 - protein, 9 aa, West Nile virus
GTLTSAINR

SEQ ID NO: 130953 - protein, 9 aa, West Nile virus
TLTSAINRR

SEQ ID NO: 130954 - protein, 9 aa, West Nile virus
LTSAINRRS

SEQ ID NO: 130955 - protein, 9 aa, West Nile virus
NRRSSKQKK

SEQ ID NO: 130956 - protein, 9 aa, West Nile virus
RRSSKQKKR

SEQ ID NO: 130957 - protein, 9 aa, West Nile virus
RSSKQKKRG

SEQ ID NO: 130958 - protein, 9 aa, West Nile virus
SSKQKKRGG

SEQ ID NO: 130959 - protein, 9 aa, West Nile virus
KQKKRGGKT

SEQ ID NO: 130960 - protein, 9 aa, West Nile virus
QKKRGGKTG

SEQ ID NO: 130961 - protein, 9 aa, West Nile virus
KKRGGKTGI

SEQ ID NO: 130962 - protein, 9 aa, West Nile virus
GAVTLSNFQ

SEQ ID NO: 130963 - protein, 9 aa, West Nile virus
AVTLSNFQG

SEQ ID NO: 130964 - protein, 9 aa, West Nile virus
VTLSNFQGK

SEQ ID NO: 130965 - protein, 9 aa, West Nile virus
TLSNFQGKV

SEQ ID NO: 130966 - protein, 9 aa, West Nile virus
LSNFQGKVM

SEQ ID NO: 130967 - protein, 9 aa, West Nile virus
SNFQGKVMM

SEQ ID NO: 130968 - protein, 9 aa, West Nile virus
NFQGKVMMT

SEQ ID NO: 130969 - protein, 9 aa, West Nile virus
FQGKVMMTV

SEQ ID NO: 130970 - protein, 9 aa, West Nile virus
QGKVMMTVN

SEQ ID NO: 130971 - protein, 9 aa, West Nile virus
GKVMMTVNA

SEQ ID NO: 130972 - protein, 9 aa, West Nile virus
KVMMTVNAT

SEQ ID NO: 130973 - protein, 9 aa, West Nile virus
VMMTVNATD

SEQ ID NO: 130974 - protein, 9 aa, West Nile virus
MMTVNATDV

SEQ ID NO: 130975 - protein, 9 aa, West Nile virus
MTVNATDVT

SEQ ID NO: 130976 - protein, 9 aa, West Nile virus
VITIPTAAG

SEQ ID NO: 130977 - protein, 9 aa, West Nile virus
ITIPTAAGK

SEQ ID NO: 130978 - protein, 9 aa, West Nile virus
TIPTAAGKN

SEQ ID NO: 130979 - protein, 9 aa, West Nile virus
IPTAAGKNL

SEQ ID NO: 130980 - protein, 9 aa, West Nile virus
PTAAGKNLC

SEQ ID NO: 130981 - protein, 9 aa, West Nile virus
TAAGKNLCI

SEQ ID NO: 130982 - protein, 9 aa, West Nile virus
AAGKNLCIV

SEQ ID NO: 130983 - protein, 9 aa, West Nile virus
AGKNLCIVR

SEQ ID NO: 130984 - protein, 9 aa, West Nile virus
GKNLCIVRA

SEQ ID NO: 130985 - protein, 9 aa, West Nile virus
KNLCIVRAM

SEQ ID NO: 130986 - protein, 9 aa, West Nile virus
NLCIVRAMD

SEQ ID NO: 130987 - protein, 9 aa, West Nile virus
LCIVRAMDV

SEQ ID NO: 130988 - protein, 9 aa, West Nile virus
CIVRAMDVG

SEQ ID NO: 130989 - protein, 9 aa, West Nile virus
IVRAMDVGY

SEQ ID NO: 130990 - protein, 9 aa, West Nile virus
VRAMDVGYM

SEQ ID NO: 130991 - protein, 9 aa, West Nile virus
RAMDVGYMC

SEQ ID NO: 130992 - protein, 9 aa, West Nile virus
AMDVGYMCD

SEQ ID NO: 130993 - protein, 9 aa, West Nile virus
MDVGYMCDD

SEQ ID NO: 130994 - protein, 9 aa, West Nile virus
DVGYMCDDT

SEQ ID NO: 130995 - protein, 9 aa, West Nile virus
VGYMCDDTI

SEQ ID NO: 130996 - protein, 9 aa, West Nile virus
GYMCDDTIT

SEQ ID NO: 130997 - protein, 9 aa, West Nile virus
YMCDDTITY

SEQ ID NO: 130998 - protein, 9 aa, West Nile virus
MCDDTITYE

SEQ ID NO: 130999 - protein, 9 aa, West Nile virus
CDDTITYEC

SEQ ID NO: 131000 - protein, 9 aa, West Nile virus
DDTITYECP

SEQ ID NO: 131001 - protein, 9 aa, West Nile virus
DTITYECPV

SEQ ID NO: 131002 - protein, 9 aa, West Nile virus
TITYECPVL

SEQ ID NO: 131003 - protein, 9 aa, West Nile virus
ITYECPVLS

SEQ ID NO: 131004 - protein, 9 aa, West Nile virus
TYECPVLSA

SEQ ID NO: 131005 - protein, 9 aa, West Nile virus
YECPVLSAG

SEQ ID NO: 131006 - protein, 9 aa, West Nile virus
ECPVLSAGN

SEQ ID NO: 131007 - protein, 9 aa, West Nile virus
CPVLSAGND

SEQ ID NO: 131008 - protein, 9 aa, West Nile virus
PVLSAGNDP

SEQ ID NO: 131009 - protein, 9 aa, West Nile virus
VLSAGNDPE

SEQ ID NO: 131010 - protein, 9 aa, West Nile virus
LSAGNDPED

SEQ ID NO: 131011 - protein, 9 aa, West Nile virus
SAGNDPEDI

SEQ ID NO: 131012 - protein, 9 aa, West Nile virus
AGNDPEDID

SEQ ID NO: 131013 - protein, 9 aa, West Nile virus
GNDPEDIDC

SEQ ID NO: 131014 - protein, 9 aa, West Nile virus
NDPEDIDCW

SEQ ID NO: 131015 - protein, 9 aa, West Nile virus
DPEDIDCWC

SEQ ID NO: 131016 - protein, 9 aa, West Nile virus
PEDIDCWCT

SEQ ID NO: 131017 - protein, 9 aa, West Nile virus
EDIDCWCTK

SEQ ID NO: 131018 - protein, 9 aa, West Nile virus
DIDCWCTKS

SEQ ID NO: 131019 - protein, 9 aa, West Nile virus
IDCWCTKSA

SEQ ID NO: 131020 - protein, 9 aa, West Nile virus
DCWCTKSAV

SEQ ID NO: 131021 - protein, 9 aa, West Nile virus
AVYVRYGRC

SEQ ID NO: 131022 - protein, 9 aa, West Nile virus
VYVRYGRCT

SEQ ID NO: 131023 - protein, 9 aa, West Nile virus
YVRYGRCTK

SEQ ID NO: 131024 - protein, 9 aa, West Nile virus
VRYGRCTKT

SEQ ID NO: 131025 - protein, 9 aa, West Nile virus
RYGRCTKTR

SEQ ID NO: 131026 - protein, 9 aa, West Nile virus
YGRCTKTRH

SEQ ID NO: 131027 - protein, 9 aa, West Nile virus
GRCTKTRHS

SEQ ID NO: 131028 - protein, 9 aa, West Nile virus
RCTKTRHSR

SEQ ID NO: 131029 - protein, 9 aa, West Nile virus
CTKTRHSRR

SEQ ID NO: 131030 - protein, 9 aa, West Nile virus
TKTRHSRRS

SEQ ID NO: 131031 - protein, 9 aa, West Nile virus
KTRHSRRSR

SEQ ID NO: 131032 - protein, 9 aa, West Nile virus
TRHSRRSRR

SEQ ID NO: 131033 - protein, 9 aa, West Nile virus
RHSRRSRRS

SEQ ID NO: 131034 - protein, 9 aa, West Nile virus
HSRRSRRSL

SEQ ID NO: 131035 - protein, 9 aa, West Nile virus
SRRSRRSLT

SEQ ID NO: 131036 - protein, 9 aa, West Nile virus
RRSRRSLTV

SEQ ID NO: 131037 - protein, 9 aa, West Nile virus
RSRRSLTVQ

SEQ ID NO: 131038 - protein, 9 aa, West Nile virus
SRRSLTVQT

SEQ ID NO: 131039 - protein, 9 aa, West Nile virus
RRSLTVQTH

SEQ ID NO: 131040 - protein, 9 aa, West Nile virus
RSLTVQTHG

SEQ ID NO: 131041 - protein, 9 aa, West Nile virus
SLTVQTHGE

SEQ ID NO: 131042 - protein, 9 aa, West Nile virus
LTVQTHGES

SEQ ID NO: 131043 - protein, 9 aa, West Nile virus
TVQTHGEST

SEQ ID NO: 131044 - protein, 9 aa, West Nile virus
VQTHGESTL

SEQ ID NO: 131045 - protein, 9 aa, West Nile virus
QTHGESTLA

SEQ ID NO: 131046 - protein, 9 aa, West Nile virus
THGESTLAN

SEQ ID NO: 131047 - protein, 9 aa, West Nile virus
HGESTLANK

SEQ ID NO: 131048 - protein, 9 aa, West Nile virus
GESTLANKK

SEQ ID NO: 131049 - protein, 9 aa, West Nile virus
ESTLANKKG

SEQ ID NO: 131050 - protein, 9 aa, West Nile virus
STLANKKGA

SEQ ID NO: 131051 - protein, 9 aa, West Nile virus
TLANKKGAW

SEQ ID NO: 131052 - protein, 9 aa, West Nile virus
LANKKGAWM

SEQ ID NO: 131053 - protein, 9 aa, West Nile virus
ANKKGAWMD

SEQ ID NO: 131054 - protein, 9 aa, West Nile virus
NKKGAWMDS

SEQ ID NO: 131055 - protein, 9 aa, West Nile virus
KKGAWMDST

SEQ ID NO: 131056 - protein, 9 aa, West Nile virus
KGAWMDSTK

SEQ ID NO: 131057 - protein, 9 aa, West Nile virus
GAWMDSTKA

SEQ ID NO: 131058 - protein, 9 aa, West Nile virus
AWMDSTKAT

SEQ ID NO: 131059 - protein, 9 aa, West Nile virus
WMDSTKATR

SEQ ID NO: 131060 - protein, 9 aa, West Nile virus
MDSTKATRY

SEQ ID NO: 131061 - protein, 9 aa, West Nile virus
DSTKATRYL

SEQ ID NO: 131062 - protein, 9 aa, West Nile virus
STKATRYLV

SEQ ID NO: 131063 - protein, 9 aa, West Nile virus
TKATRYLVK

SEQ ID NO: 131064 - protein, 9 aa, West Nile virus
KATRYLVKT

SEQ ID NO: 131065 - protein, 9 aa, West Nile virus
ATRYLVKTE

SEQ ID NO: 131066 - protein, 9 aa, West Nile virus
TRYLVKTES

SEQ ID NO: 131067 - protein, 9 aa, West Nile virus
RYLVKTESW

SEQ ID NO: 131068 - protein, 9 aa, West Nile virus
YLVKTESWI

SEQ ID NO: 131069 - protein, 9 aa, West Nile virus
LVKTESWIL

SEQ ID NO: 131070 - protein, 9 aa, West Nile virus
VKTESWILR

SEQ ID NO: 131071 - protein, 9 aa, West Nile virus
KTESWILRN

SEQ ID NO: 131072 - protein, 9 aa, West Nile virus
TESWILRNP

SEQ ID NO: 131073 - protein, 9 aa, West Nile virus
ESWILRNPG

SEQ ID NO: 131074 - protein, 9 aa, West Nile virus
SWILRNPGY

SEQ ID NO: 131075 - protein, 9 aa, West Nile virus
WILRNPGYA

SEQ ID NO: 131076 - protein, 9 aa, West Nile virus
ILRNPGYAL

SEQ ID NO: 131077 - protein, 9 aa, West Nile virus
LRNPGYALV

SEQ ID NO: 131078 - protein, 9 aa, West Nile virus
RNPGYALVA

SEQ ID NO: 131079 - protein, 9 aa, West Nile virus
NPGYALVAA

SEQ ID NO: 131080 - protein, 9 aa, West Nile virus
PGYALVAAV

SEQ ID NO: 131081 - protein, 9 aa, West Nile virus
GYALVAAVI

SEQ ID NO: 131082 - protein, 9 aa, West Nile virus
YALVAAVIG

SEQ ID NO: 131083 - protein, 9 aa, West Nile virus
ALVAAVIGW

SEQ ID NO: 131084 - protein, 9 aa, West Nile virus
LVAAVIGWM

SEQ ID NO: 131085 - protein, 9 aa, West Nile virus
VAAVIGWML

SEQ ID NO: 131086 - protein, 9 aa, West Nile virus
AAVIGWMLG

SEQ ID NO: 131087 - protein, 9 aa, West Nile virus
AVIGWMLGS

SEQ ID NO: 131088 - protein, 9 aa, West Nile virus
VIGWMLGSN

SEQ ID NO: 131089 - protein, 9 aa, West Nile virus
IGWMLGSNT

SEQ ID NO: 131090 - protein, 9 aa, West Nile virus
GWMLGSNTM

SEQ ID NO: 131091 - protein, 9 aa, West Nile virus
WMLGSNTMQ

SEQ ID NO: 131092 - protein, 9 aa, West Nile virus
MLGSNTMQR

SEQ ID NO: 131093 - protein, 9 aa, West Nile virus
LGSNTMQRV

SEQ ID NO: 131094 - protein, 9 aa, West Nile virus
GSNTMQRVV

SEQ ID NO: 131095 - protein, 9 aa, West Nile virus
SNTMQRVVF

SEQ ID NO: 131096 - protein, 9 aa, West Nile virus
NTMQRVVFV

SEQ ID NO: 131097 - protein, 9 aa, West Nile virus
MQRVVFVVL

SEQ ID NO: 131098 - protein, 9 aa, West Nile virus
QRVVFVVLL

SEQ ID NO: 131099 - protein, 9 aa, West Nile virus
RVVFVVLLL

SEQ ID NO: 131100 - protein, 9 aa, West Nile virus
VVFVVLLLL

SEQ ID NO: 131101 - protein, 9 aa, West Nile virus
VFVVLLLLV

SEQ ID NO: 131102 - protein, 9 aa, West Nile virus
FVVLLLLVA

SEQ ID NO: 131103 - protein, 9 aa, West Nile virus
VVLLLLVAP

SEQ ID NO: 131104 - protein, 9 aa, West Nile virus
VLLLLVAPA

SEQ ID NO: 131105 - protein, 9 aa, West Nile virus
LLLLVAPAY

SEQ ID NO: 131106 - protein, 9 aa, West Nile virus
LLLVAPAYS

SEQ ID NO: 131107 - protein, 9 aa, West Nile virus
LLVAPAYSF

SEQ ID NO: 131108 - protein, 9 aa, West Nile virus
LVAPAYSFN

SEQ ID NO: 131109 - protein, 9 aa, West Nile virus
VAPAYSFNC

SEQ ID NO: 131110 - protein, 9 aa, West Nile virus
APAYSFNCL

SEQ ID NO: 131111 - protein, 9 aa, West Nile virus
PAYSFNCLG

SEQ ID NO: 131112 - protein, 9 aa, West Nile virus
AYSFNCLGM

SEQ ID NO: 131113 - protein, 9 aa, West Nile virus
YSFNCLGMS

SEQ ID NO: 131114 - protein, 9 aa, West Nile virus
SFNCLGMSN

SEQ ID NO: 131115 - protein, 9 aa, West Nile virus
FNCLGMSNR

SEQ ID NO: 131116 - protein, 9 aa, West Nile virus
NCLGMSNRD

SEQ ID NO: 131117 - protein, 9 aa, West Nile virus
CLGMSNRDF

SEQ ID NO: 131118 - protein, 9 aa, West Nile virus
LGMSNRDFL

SEQ ID NO: 131119 - protein, 9 aa, West Nile virus
GMSNRDFLE

SEQ ID NO: 131120 - protein, 9 aa, West Nile virus
MSNRDFLEG

SEQ ID NO: 131121 - protein, 9 aa, West Nile virus
SNRDFLEGV

SEQ ID NO: 131122 - protein, 9 aa, West Nile virus
NRDFLEGVS

SEQ ID NO: 131123 - protein, 9 aa, West Nile virus
RDFLEGVSG

SEQ ID NO: 131124 - protein, 9 aa, West Nile virus
DFLEGVSGA

SEQ ID NO: 131125 - protein, 9 aa, West Nile virus
FLEGVSGAT

SEQ ID NO: 131126 - protein, 9 aa, West Nile virus
LEGVSGATW

SEQ ID NO: 131127 - protein, 9 aa, West Nile virus
EGVSGATWV

SEQ ID NO: 131128 - protein, 9 aa, West Nile virus
GVSGATWVD

SEQ ID NO: 131129 - protein, 9 aa, West Nile virus
VSGATWVDL

SEQ ID NO: 131130 - protein, 9 aa, West Nile virus
SGATWVDLV

SEQ ID NO: 131131 - protein, 9 aa, West Nile virus
GATWVDLVL

SEQ ID NO: 131132 - protein, 9 aa, West Nile virus
ATWVDLVLE

SEQ ID NO: 131133 - protein, 9 aa, West Nile virus
TWVDLVLEG

SEQ ID NO: 131134 - protein, 9 aa, West Nile virus
WVDLVLEGD

SEQ ID NO: 131135 - protein, 9 aa, West Nile virus
VDLVLEGDS

SEQ ID NO: 131136 - protein, 9 aa, West Nile virus
DLVLEGDSC

SEQ ID NO: 131137 - protein, 9 aa, West Nile virus
LVLEGDSCV

SEQ ID NO: 131138 - protein, 9 aa, West Nile virus
VLEGDSCVT

SEQ ID NO: 131139 - protein, 9 aa, West Nile virus
LEGDSCVTI

SEQ ID NO: 131140 - protein, 9 aa, West Nile virus
EGDSCVTIM

SEQ ID NO: 131141 - protein, 9 aa, West Nile virus
GDSCVTIMS

SEQ ID NO: 131142 - protein, 9 aa, West Nile virus
DSCVTIMSK

SEQ ID NO: 131143 - protein, 9 aa, West Nile virus
SCVTIMSKD

SEQ ID NO: 131144 - protein, 9 aa, West Nile virus
CVTIMSKDK

SEQ ID NO: 131145 - protein, 9 aa, West Nile virus
VTIMSKDKP

SEQ ID NO: 131146 - protein, 9 aa, West Nile virus
TIMSKDKPT

SEQ ID NO: 131147 - protein, 9 aa, West Nile virus
IMSKDKPTI

SEQ ID NO: 131148 - protein, 9 aa, West Nile virus
MSKDKPTID

SEQ ID NO: 131149 - protein, 9 aa, West Nile virus
SKDKPTIDV

SEQ ID NO: 131150 - protein, 9 aa, West Nile virus
KDKPTIDVK

SEQ ID NO: 131151 - protein, 9 aa, West Nile virus
DKPTIDVKM

SEQ ID NO: 131152 - protein, 9 aa, West Nile virus
KPTIDVKMM

SEQ ID NO: 131153 - protein, 9 aa, West Nile virus
PTIDVKMMN

SEQ ID NO: 131154 - protein, 9 aa, West Nile virus
TIDVKMMNM

SEQ ID NO: 131155 - protein, 9 aa, West Nile virus
IDVKMMNME

SEQ ID NO: 131156 - protein, 9 aa, West Nile virus
DVKMMNMEA

SEQ ID NO: 131157 - protein, 9 aa, West Nile virus
EVRSYCYLA

SEQ ID NO: 131158 - protein, 9 aa, West Nile virus
VSDLSTKAA

SEQ ID NO: 131159 - protein, 9 aa, West Nile virus
SDLSTKAAC

SEQ ID NO: 131160 - protein, 9 aa, West Nile virus
DLSTKAACP

SEQ ID NO: 131161 - protein, 9 aa, West Nile virus
LSTKAACPT

SEQ ID NO: 131162 - protein, 9 aa, West Nile virus
STKAACPTM

SEQ ID NO: 131163 - protein, 9 aa, West Nile virus
TKAACPTMG

SEQ ID NO: 131164 - protein, 9 aa, West Nile virus
KAACPTMGE

SEQ ID NO: 131165 - protein, 9 aa, West Nile virus
AACPTMGEA

SEQ ID NO: 131166 - protein, 9 aa, West Nile virus
ACPTMGEAH

SEQ ID NO: 131167 - protein, 9 aa, West Nile virus
CPTMGEAHN

SEQ ID NO: 131168 - protein, 9 aa, West Nile virus
PTMGEAHND

SEQ ID NO: 131169 - protein, 9 aa, West Nile virus
TMGEAHNDK

SEQ ID NO: 131170 - protein, 9 aa, West Nile virus
MGEAHNDKR

SEQ ID NO: 131171 - protein, 9 aa, West Nile virus
GEAHNDKRA

SEQ ID NO: 131172 - protein, 9 aa, West Nile virus
EAHNDKRAD

SEQ ID NO: 131173 - protein, 9 aa, West Nile virus
AHNDKRADP

SEQ ID NO: 131174 - protein, 9 aa, West Nile virus
FVCRQGVVD

SEQ ID NO: 131175 - protein, 9 aa, West Nile virus
VCRQGVVDR

SEQ ID NO: 131176 - protein, 9 aa, West Nile virus
CRQGVVDRG

SEQ ID NO: 131177 - protein, 9 aa, West Nile virus
RQGVVDRGW

SEQ ID NO: 131178 - protein, 9 aa, West Nile virus
QGVVDRGWG

SEQ ID NO: 131179 - protein, 9 aa, West Nile virus
GVVDRGWGN

SEQ ID NO: 131180 - protein, 9 aa, West Nile virus
VVDRGWGNG

SEQ ID NO: 131181 - protein, 9 aa, West Nile virus
VDRGWGNGC

SEQ ID NO: 131182 - protein, 9 aa, West Nile virus
DRGWGNGCG

SEQ ID NO: 131183 - protein, 9 aa, West Nile virus
RGWGNGCGL

SEQ ID NO: 131184 - protein, 9 aa, West Nile virus
GWGNGCGLF

SEQ ID NO: 131185 - protein, 9 aa, West Nile virus
WGNGCGLFG

SEQ ID NO: 131186 - protein, 9 aa, West Nile virus
GNGCGLFGK

SEQ ID NO: 131187 - protein, 9 aa, West Nile virus
NGCGLFGKG

SEQ ID NO: 131188 - protein, 9 aa, West Nile virus
GCGLFGKGS

SEQ ID NO: 131189 - protein, 9 aa, West Nile virus
CGLFGKGSI

SEQ ID NO: 131190 - protein, 9 aa, West Nile virus
GLFGKGSID

SEQ ID NO: 131191 - protein, 9 aa, West Nile virus
LFGKGSIDT

SEQ ID NO: 131192 - protein, 9 aa, West Nile virus
FGKGSIDTC

SEQ ID NO: 131193 - protein, 9 aa, West Nile virus
GKGSIDTCA

SEQ ID NO: 131194 - protein, 9 aa, West Nile virus
KGSIDTCAK

SEQ ID NO: 131195 - protein, 9 aa, West Nile virus
GSIDTCAKF

SEQ ID NO: 131196 - protein, 9 aa, West Nile virus
SIDTCAKFA

SEQ ID NO: 131197 - protein, 9 aa, West Nile virus
IDTCAKFAC

SEQ ID NO: 131198 - protein, 9 aa, West Nile virus
DTCAKFACS

SEQ ID NO: 131199 - protein, 9 aa, West Nile virus
TCAKFACST

SEQ ID NO: 131200 - protein, 9 aa, West Nile virus
CAKFACSTK

SEQ ID NO: 131201 - protein, 9 aa, West Nile virus
AKFACSTKA

SEQ ID NO: 131202 - protein, 9 aa, West Nile virus
KFACSTKAI

SEQ ID NO: 131203 - protein, 9 aa, West Nile virus
FACSTKAIG

SEQ ID NO: 131204 - protein, 9 aa, West Nile virus
ACSTKAIGR

SEQ ID NO: 131205 - protein, 9 aa, West Nile virus
CSTKAIGRT

SEQ ID NO: 131206 - protein, 9 aa, West Nile virus
STKAIGRTI

SEQ ID NO: 131207 - protein, 9 aa, West Nile virus
TKAIGRTIL

SEQ ID NO: 131208 - protein, 9 aa, West Nile virus
KAIGRTILK

SEQ ID NO: 131209 - protein, 9 aa, West Nile virus
AIGRTILKE

SEQ ID NO: 131210 - protein, 9 aa, West Nile virus
IGRTILKEN

SEQ ID NO: 131211 - protein, 9 aa, West Nile virus
GRTILKENI

SEQ ID NO: 131212 - protein, 9 aa, West Nile virus
RTILKENIK

SEQ ID NO: 131213 - protein, 9 aa, West Nile virus
TILKENIKY

SEQ ID NO: 131214 - protein, 9 aa, West Nile virus
ILKENIKYE

SEQ ID NO: 131215 - protein, 9 aa, West Nile virus
LKENIKYEV

SEQ ID NO: 131216 - protein, 9 aa, West Nile virus
KENIKYEVA

SEQ ID NO: 131217 - protein, 9 aa, West Nile virus
ENIKYEVAI

SEQ ID NO: 131218 - protein, 9 aa, West Nile virus
NIKYEVAIF

SEQ ID NO: 131219 - protein, 9 aa, West Nile virus
IKYEVAIFV

SEQ ID NO: 131220 - protein, 9 aa, West Nile virus
KYEVAIFVH

SEQ ID NO: 131221 - protein, 9 aa, West Nile virus
YEVAIFVHG

SEQ ID NO: 131222 - protein, 9 aa, West Nile virus
EVAIFVHGP

SEQ ID NO: 131223 - protein, 9 aa, West Nile virus
VAIFVHGPT

SEQ ID NO: 131224 - protein, 9 aa, West Nile virus
AIFVHGPTT

SEQ ID NO: 131225 - protein, 9 aa, West Nile virus
IFVHGPTTV

SEQ ID NO: 131226 - protein, 9 aa, West Nile virus
FVHGPTTVE

SEQ ID NO: 131227 - protein, 9 aa, West Nile virus
VHGPTTVES

SEQ ID NO: 131228 - protein, 9 aa, West Nile virus
HGPTTVESH

SEQ ID NO: 131229 - protein, 9 aa, West Nile virus
GPTTVESHG

SEQ ID NO: 131230 - protein, 9 aa, West Nile virus
GATQAGRFS

SEQ ID NO: 131231 - protein, 9 aa, West Nile virus
ATQAGRFSI

SEQ ID NO: 131232 - protein, 9 aa, West Nile virus
TQAGRFSIT

SEQ ID NO: 131233 - protein, 9 aa, West Nile virus
QAGRFSITP

SEQ ID NO: 131234 - protein, 9 aa, West Nile virus
AGRFSITPA

SEQ ID NO: 131235 - protein, 9 aa, West Nile virus
GRFSITPAA

SEQ ID NO: 131236 - protein, 9 aa, West Nile virus
RFSITPAAP

SEQ ID NO: 131237 - protein, 9 aa, West Nile virus
FSITPAAPS

SEQ ID NO: 131238 - protein, 9 aa, West Nile virus
SITPAAPSY

SEQ ID NO: 131239 - protein, 9 aa, West Nile virus
ITPAAPSYT

SEQ ID NO: 131240 - protein, 9 aa, West Nile virus
KLGEYGEVT

SEQ ID NO: 131241 - protein, 9 aa, West Nile virus
LGEYGEVTV

SEQ ID NO: 131242 - protein, 9 aa, West Nile virus
GEYGEVTVD

SEQ ID NO: 131243 - protein, 9 aa, West Nile virus
EYGEVTVDC

SEQ ID NO: 131244 - protein, 9 aa, West Nile virus
YGEVTVDCE

SEQ ID NO: 131245 - protein, 9 aa, West Nile virus
GEVTVDCEP

SEQ ID NO: 131246 - protein, 9 aa, West Nile virus
EVTVDCEPR

SEQ ID NO: 131247 - protein, 9 aa, West Nile virus
VTVDCEPRS

SEQ ID NO: 131248 - protein, 9 aa, West Nile virus
TVDCEPRSG

SEQ ID NO: 131249 - protein, 9 aa, West Nile virus
VDCEPRSGI

SEQ ID NO: 131250 - protein, 9 aa, West Nile virus
DCEPRSGID

SEQ ID NO: 131251 - protein, 9 aa, West Nile virus
CEPRSGIDT

SEQ ID NO: 131252 - protein, 9 aa, West Nile virus
EPRSGIDTN

SEQ ID NO: 131253 - protein, 9 aa, West Nile virus
PRSGIDTNA

SEQ ID NO: 131254 - protein, 9 aa, West Nile virus
RSGIDTNAY

SEQ ID NO: 131255 - protein, 9 aa, West Nile virus
SGIDTNAYY

SEQ ID NO: 131256 - protein, 9 aa, West Nile virus
GIDTNAYYV

SEQ ID NO: 131257 - protein, 9 aa, West Nile virus
IDTNAYYVM

SEQ ID NO: 131258 - protein, 9 aa, West Nile virus
DTNAYYVMT

SEQ ID NO: 131259 - protein, 9 aa, West Nile virus
TNAYYVMTV

SEQ ID NO: 131260 - protein, 9 aa, West Nile virus
NAYYVMTVG

SEQ ID NO: 131261 - protein, 9 aa, West Nile virus
KTFLVHREW

SEQ ID NO: 131262 - protein, 9 aa, West Nile virus
TFLVHREWF

SEQ ID NO: 131263 - protein, 9 aa, West Nile virus
FLVHREWFM

SEQ ID NO: 131264 - protein, 9 aa, West Nile virus
LVHREWFMD

SEQ ID NO: 131265 - protein, 9 aa, West Nile virus
VHREWFMDL

SEQ ID NO: 131266 - protein, 9 aa, West Nile virus
HREWFMDLN

SEQ ID NO: 131267 - protein, 9 aa, West Nile virus
REWFMDLNL

SEQ ID NO: 131268 - protein, 9 aa, West Nile virus
EWFMDLNLP

SEQ ID NO: 131269 - protein, 9 aa, West Nile virus
WFMDLNLPW

SEQ ID NO: 131270 - protein, 9 aa, West Nile virus
FMDLNLPWS

SEQ ID NO: 131271 - protein, 9 aa, West Nile virus
MDLNLPWSS

SEQ ID NO: 131272 - protein, 9 aa, West Nile virus
DLNLPWSSA

SEQ ID NO: 131273 - protein, 9 aa, West Nile virus
LNLPWSSAG

SEQ ID NO: 131274 - protein, 9 aa, West Nile virus
NLPWSSAGS

SEQ ID NO: 131275 - protein, 9 aa, West Nile virus
LPWSSAGST

SEQ ID NO: 131276 - protein, 9 aa, West Nile virus
WRNRETLME

SEQ ID NO: 131277 - protein, 9 aa, West Nile virus
RNRETLMEF

SEQ ID NO: 131278 - protein, 9 aa, West Nile virus
NRETLMEFE

SEQ ID NO: 131279 - protein, 9 aa, West Nile virus
RETLMEFEE

SEQ ID NO: 131280 - protein, 9 aa, West Nile virus
ETLMEFEEP

SEQ ID NO: 131281 - protein, 9 aa, West Nile virus
TLMEFEEPH

SEQ ID NO: 131282 - protein, 9 aa, West Nile virus
LMEFEEPHA

SEQ ID NO: 131283 - protein, 9 aa, West Nile virus
MEFEEPHAT

SEQ ID NO: 131284 - protein, 9 aa, West Nile virus
EFEEPHATK

SEQ ID NO: 131285 - protein, 9 aa, West Nile virus
FEEPHATKQ

SEQ ID NO: 131286 - protein, 9 aa, West Nile virus
EEPHATKQS

SEQ ID NO: 131287 - protein, 9 aa, West Nile virus
EPHATKQSV

SEQ ID NO: 131288 - protein, 9 aa, West Nile virus
PHATKQSVI

SEQ ID NO: 131289 - protein, 9 aa, West Nile virus
HATKQSVIA

SEQ ID NO: 131290 - protein, 9 aa, West Nile virus
ATKQSVIAL

SEQ ID NO: 131291 - protein, 9 aa, West Nile virus
TKQSVIALG

SEQ ID NO: 131292 - protein, 9 aa, West Nile virus
KQSVIALGS

SEQ ID NO: 131293 - protein, 9 aa, West Nile virus
QSVIALGSQ

SEQ ID NO: 131294 - protein, 9 aa, West Nile virus
SVIALGSQE

SEQ ID NO: 131295 - protein, 9 aa, West Nile virus
VIALGSQEG

SEQ ID NO: 131296 - protein, 9 aa, West Nile virus
IALGSQEGA

SEQ ID NO: 131297 - protein, 9 aa, West Nile virus
ALGSQEGAL

SEQ ID NO: 131298 - protein, 9 aa, West Nile virus
LGSQEGALH

SEQ ID NO: 131299 - protein, 9 aa, West Nile virus
GSQEGALHQ

SEQ ID NO: 131300 - protein, 9 aa, West Nile virus
SQEGALHQA

SEQ ID NO: 131301 - protein, 9 aa, West Nile virus
QEGALHQAL

SEQ ID NO: 131302 - protein, 9 aa, West Nile virus
EGALHQALA

SEQ ID NO: 131303 - protein, 9 aa, West Nile virus
GALHQALAG

SEQ ID NO: 131304 - protein, 9 aa, West Nile virus
ALHQALAGA

SEQ ID NO: 131305 - protein, 9 aa, West Nile virus
LHQALAGAI

SEQ ID NO: 131306 - protein, 9 aa, West Nile virus
HQALAGAIP

SEQ ID NO: 131307 - protein, 9 aa, West Nile virus
QALAGAIPV

SEQ ID NO: 131308 - protein, 9 aa, West Nile virus
ALAGAIPVE

SEQ ID NO: 131309 - protein, 9 aa, West Nile virus
LAGAIPVEF

SEQ ID NO: 131310 - protein, 9 aa, West Nile virus
AGAIPVEFS

SEQ ID NO: 131311 - protein, 9 aa, West Nile virus
GAIPVEFSS

SEQ ID NO: 131312 - protein, 9 aa, West Nile virus
AIPVEFSSN

SEQ ID NO: 131313 - protein, 9 aa, West Nile virus
IPVEFSSNT

SEQ ID NO: 131314 - protein, 9 aa, West Nile virus
PVEFSSNTV

SEQ ID NO: 131315 - protein, 9 aa, West Nile virus
VEFSSNTVK

SEQ ID NO: 131316 - protein, 9 aa, West Nile virus
EFSSNTVKL

SEQ ID NO: 131317 - protein, 9 aa, West Nile virus
FSSNTVKLT

SEQ ID NO: 131318 - protein, 9 aa, West Nile virus
SSNTVKLTS

SEQ ID NO: 131319 - protein, 9 aa, West Nile virus
SNTVKLTSG

SEQ ID NO: 131320 - protein, 9 aa, West Nile virus
NTVKLTSGH

SEQ ID NO: 131321 - protein, 9 aa, West Nile virus
TVKLTSGHL

SEQ ID NO: 131322 - protein, 9 aa, West Nile virus
VKLTSGHLK

SEQ ID NO: 131323 - protein, 9 aa, West Nile virus
KLTSGHLKC

SEQ ID NO: 131324 - protein, 9 aa, West Nile virus
LTSGHLKCR

SEQ ID NO: 131325 - protein, 9 aa, West Nile virus
TSGHLKCRV

SEQ ID NO: 131326 - protein, 9 aa, West Nile virus
SGHLKCRVK

SEQ ID NO: 131327 - protein, 9 aa, West Nile virus
GHLKCRVKM

SEQ ID NO: 131328 - protein, 9 aa, West Nile virus
HLKCRVKME

SEQ ID NO: 131329 - protein, 9 aa, West Nile virus
LKCRVKMEK

SEQ ID NO: 131330 - protein, 9 aa, West Nile virus
KCRVKMEKL

SEQ ID NO: 131331 - protein, 9 aa, West Nile virus
CRVKMEKLQ

SEQ ID NO: 131332 - protein, 9 aa, West Nile virus
RVKMEKLQL

SEQ ID NO: 131333 - protein, 9 aa, West Nile virus
VKMEKLQLK

SEQ ID NO: 131334 - protein, 9 aa, West Nile virus
KMEKLQLKG

SEQ ID NO: 131335 - protein, 9 aa, West Nile virus
MEKLQLKGT

SEQ ID NO: 131336 - protein, 9 aa, West Nile virus
EKLQLKGTT

SEQ ID NO: 131337 - protein, 9 aa, West Nile virus
KLQLKGTTY

SEQ ID NO: 131338 - protein, 9 aa, West Nile virus
LQLKGTTYG

SEQ ID NO: 131339 - protein, 9 aa, West Nile virus
QLKGTTYGV

SEQ ID NO: 131340 - protein, 9 aa, West Nile virus
LKGTTYGVC

SEQ ID NO: 131341 - protein, 9 aa, West Nile virus
KGTTYGVCS

SEQ ID NO: 131342 - protein, 9 aa, West Nile virus
GTTYGVCSK

SEQ ID NO: 131343 - protein, 9 aa, West Nile virus
TTYGVCSKA

SEQ ID NO: 131344 - protein, 9 aa, West Nile virus
TYGVCSKAF

SEQ ID NO: 131345 - protein, 9 aa, West Nile virus
YGVCSKAFK

SEQ ID NO: 131346 - protein, 9 aa, West Nile virus
GVCSKAFKF

SEQ ID NO: 131347 - protein, 9 aa, West Nile virus
GTPADTGHG

SEQ ID NO: 131348 - protein, 9 aa, West Nile virus
TPADTGHGT

SEQ ID NO: 131349 - protein, 9 aa, West Nile virus
PADTGHGTV

SEQ ID NO: 131350 - protein, 9 aa, West Nile virus
ADTGHGTVV

SEQ ID NO: 131351 - protein, 9 aa, West Nile virus
DTGHGTVVL

SEQ ID NO: 131352 - protein, 9 aa, West Nile virus
TGHGTVVLE

SEQ ID NO: 131353 - protein, 9 aa, West Nile virus
GHGTVVLEL

SEQ ID NO: 131354 - protein, 9 aa, West Nile virus
HGTVVLELQ

SEQ ID NO: 131355 - protein, 9 aa, West Nile virus
GTVVLELQY

SEQ ID NO: 131356 - protein, 9 aa, West Nile virus
TVVLELQYT

SEQ ID NO: 131357 - protein, 9 aa, West Nile virus
VVLELQYTG

SEQ ID NO: 131358 - protein, 9 aa, West Nile virus
VLELQYTGT

SEQ ID NO: 131359 - protein, 9 aa, West Nile virus
LELQYTGTD

SEQ ID NO: 131360 - protein, 9 aa, West Nile virus
ELQYTGTDG

SEQ ID NO: 131361 - protein, 9 aa, West Nile virus
LQYTGTDGP

SEQ ID NO: 131362 - protein, 9 aa, West Nile virus
QYTGTDGPC

SEQ ID NO: 131363 - protein, 9 aa, West Nile virus
YTGTDGPCK

SEQ ID NO: 131364 - protein, 9 aa, West Nile virus
TGTDGPCKV

SEQ ID NO: 131365 - protein, 9 aa, West Nile virus
GTDGPCKVP

SEQ ID NO: 131366 - protein, 9 aa, West Nile virus
TDGPCKVPI

SEQ ID NO: 131367 - protein, 9 aa, West Nile virus
DGPCKVPIS

SEQ ID NO: 131368 - protein, 9 aa, West Nile virus
GPCKVPISS

SEQ ID NO: 131369 - protein, 9 aa, West Nile virus
PCKVPISSV

SEQ ID NO: 131370 - protein, 9 aa, West Nile virus
CKVPISSVA

SEQ ID NO: 131371 - protein, 9 aa, West Nile virus
KVPISSVAS

SEQ ID NO: 131372 - protein, 9 aa, West Nile virus
VPISSVASL

SEQ ID NO: 131373 - protein, 9 aa, West Nile virus
PISSVASLN

SEQ ID NO: 131374 - protein, 9 aa, West Nile virus
ISSVASLND

SEQ ID NO: 131375 - protein, 9 aa, West Nile virus
SSVASLNDL

SEQ ID NO: 131376 - protein, 9 aa, West Nile virus
SVASLNDLT

SEQ ID NO: 131377 - protein, 9 aa, West Nile virus
VASLNDLTP

SEQ ID NO: 131378 - protein, 9 aa, West Nile virus
ASLNDLTPV

SEQ ID NO: 131379 - protein, 9 aa, West Nile virus
SLNDLTPVG

SEQ ID NO: 131380 - protein, 9 aa, West Nile virus
LNDLTPVGR

SEQ ID NO: 131381 - protein, 9 aa, West Nile virus
NDLTPVGRL

SEQ ID NO: 131382 - protein, 9 aa, West Nile virus
DLTPVGRLV

SEQ ID NO: 131383 - protein, 9 aa, West Nile virus
LTPVGRLVT

SEQ ID NO: 131384 - protein, 9 aa, West Nile virus
TPVGRLVTV

SEQ ID NO: 131385 - protein, 9 aa, West Nile virus
PVGRLVTVN

SEQ ID NO: 131386 - protein, 9 aa, West Nile virus
VGRLVTVNP

SEQ ID NO: 131387 - protein, 9 aa, West Nile virus
GRLVTVNPF

SEQ ID NO: 131388 - protein, 9 aa, West Nile virus
RLVTVNPFV

SEQ ID NO: 131389 - protein, 9 aa, West Nile virus
LVTVNPFVS

SEQ ID NO: 131390 - protein, 9 aa, West Nile virus
VTVNPFVSV

SEQ ID NO: 131391 - protein, 9 aa, West Nile virus
TVNPFVSVA

SEQ ID NO: 131392 - protein, 9 aa, West Nile virus
VNPFVSVAT

SEQ ID NO: 131393 - protein, 9 aa, West Nile virus
NPFVSVATA

SEQ ID NO: 131394 - protein, 9 aa, West Nile virus
TANAKVLIE

SEQ ID NO: 131395 - protein, 9 aa, West Nile virus
ANAKVLIEL

SEQ ID NO: 131396 - protein, 9 aa, West Nile virus
NAKVLIELE

SEQ ID NO: 131397 - protein, 9 aa, West Nile virus
AKVLIELEP

SEQ ID NO: 131398 - protein, 9 aa, West Nile virus
KVLIELEPP

SEQ ID NO: 131399 - protein, 9 aa, West Nile virus
VLIELEPPF

SEQ ID NO: 131400 - protein, 9 aa, West Nile virus
LIELEPPFG

SEQ ID NO: 131401 - protein, 9 aa, West Nile virus
IELEPPFGD

SEQ ID NO: 131402 - protein, 9 aa, West Nile virus
ELEPPFGDS

SEQ ID NO: 131403 - protein, 9 aa, West Nile virus
LEPPFGDSY

SEQ ID NO: 131404 - protein, 9 aa, West Nile virus
EPPFGDSYI

SEQ ID NO: 131405 - protein, 9 aa, West Nile virus
PPFGDSYIV

SEQ ID NO: 131406 - protein, 9 aa, West Nile virus
PFGDSYIVV

SEQ ID NO: 131407 - protein, 9 aa, West Nile virus
FGDSYIVVG

SEQ ID NO: 131408 - protein, 9 aa, West Nile virus
GDSYIVVGR

SEQ ID NO: 131409 - protein, 9 aa, West Nile virus
DSYIVVGRG

SEQ ID NO: 131410 - protein, 9 aa, West Nile virus
SYIVVGRGE

SEQ ID NO: 131411 - protein, 9 aa, West Nile virus
YIVVGRGEQ

SEQ ID NO: 131412 - protein, 9 aa, West Nile virus
IVVGRGEQQ

SEQ ID NO: 131413 - protein, 9 aa, West Nile virus
VVGRGEQQI

SEQ ID NO: 131414 - protein, 9 aa, West Nile virus
VGRGEQQIN

SEQ ID NO: 131415 - protein, 9 aa, West Nile virus
GRGEQQINH

SEQ ID NO: 131416 - protein, 9 aa, West Nile virus
RGEQQINHH

SEQ ID NO: 131417 - protein, 9 aa, West Nile virus
GEQQINHHW

SEQ ID NO: 131418 - protein, 9 aa, West Nile virus
EQQINHHWH

SEQ ID NO: 131419 - protein, 9 aa, West Nile virus
QQINHHWHK

SEQ ID NO: 131420 - protein, 9 aa, West Nile virus
QINHHWHKS

SEQ ID NO: 131421 - protein, 9 aa, West Nile virus
INHHWHKSG

SEQ ID NO: 131422 - protein, 9 aa, West Nile virus
NHHWHKSGS

SEQ ID NO: 131423 - protein, 9 aa, West Nile virus
HHWHKSGSS

SEQ ID NO: 131424 - protein, 9 aa, West Nile virus
HWHKSGSSI

SEQ ID NO: 131425 - protein, 9 aa, West Nile virus
WHKSGSSIG

SEQ ID NO: 131426 - protein, 9 aa, West Nile virus
HKSGSSIGK

SEQ ID NO: 131427 - protein, 9 aa, West Nile virus
KSGSSIGKA

SEQ ID NO: 131428 - protein, 9 aa, West Nile virus
SGSSIGKAF

SEQ ID NO: 131429 - protein, 9 aa, West Nile virus
GSSIGKAFT

SEQ ID NO: 131430 - protein, 9 aa, West Nile virus
SSIGKAFTT

SEQ ID NO: 131431 - protein, 9 aa, West Nile virus
SIGKAFTTT

SEQ ID NO: 131432 - protein, 9 aa, West Nile virus
IGKAFTTTL

SEQ ID NO: 131433 - protein, 9 aa, West Nile virus
GKAFTTTLK

SEQ ID NO: 131434 - protein, 9 aa, West Nile virus
KAFTTTLKG

SEQ ID NO: 131435 - protein, 9 aa, West Nile virus
AFTTTLKGA

SEQ ID NO: 131436 - protein, 9 aa, West Nile virus
FTTTLKGAQ

SEQ ID NO: 131437 - protein, 9 aa, West Nile virus
TTTLKGAQR

SEQ ID NO: 131438 - protein, 9 aa, West Nile virus
TTLKGAQRL

SEQ ID NO: 131439 - protein, 9 aa, West Nile virus
TLKGAQRLA

SEQ ID NO: 131440 - protein, 9 aa, West Nile virus
LKGAQRLAA

SEQ ID NO: 131441 - protein, 9 aa, West Nile virus
KGAQRLAAL

SEQ ID NO: 131442 - protein, 9 aa, West Nile virus
GAQRLAALG

SEQ ID NO: 131443 - protein, 9 aa, West Nile virus
AQRLAALGD

SEQ ID NO: 131444 - protein, 9 aa, West Nile virus
QRLAALGDT

SEQ ID NO: 131445 - protein, 9 aa, West Nile virus
RLAALGDTA

SEQ ID NO: 131446 - protein, 9 aa, West Nile virus
LAALGDTAW

SEQ ID NO: 131447 - protein, 9 aa, West Nile virus
AALGDTAWD

SEQ ID NO: 131448 - protein, 9 aa, West Nile virus
ALGDTAWDF

SEQ ID NO: 131449 - protein, 9 aa, West Nile virus
LGDTAWDFG

SEQ ID NO: 131450 - protein, 9 aa, West Nile virus
GDTAWDFGS

SEQ ID NO: 131451 - protein, 9 aa, West Nile virus
DTAWDFGSV

SEQ ID NO: 131452 - protein, 9 aa, West Nile virus
TAWDFGSVG

SEQ ID NO: 131453 - protein, 9 aa, West Nile virus
AWDFGSVGG

SEQ ID NO: 131454 - protein, 9 aa, West Nile virus
WDFGSVGGV

SEQ ID NO: 131455 - protein, 9 aa, West Nile virus
DFGSVGGVF

SEQ ID NO: 131456 - protein, 9 aa, West Nile virus
FGSVGGVFT

SEQ ID NO: 131457 - protein, 9 aa, West Nile virus
GSVGGVFTS

SEQ ID NO: 131458 - protein, 9 aa, West Nile virus
SVGGVFTSV

SEQ ID NO: 131459 - protein, 9 aa, West Nile virus
VGGVFTSVG

SEQ ID NO: 131460 - protein, 9 aa, West Nile virus
GGVFTSVGK

SEQ ID NO: 131461 - protein, 9 aa, West Nile virus
GVFTSVGKA

SEQ ID NO: 131462 - protein, 9 aa, West Nile virus
VFTSVGKAV

SEQ ID NO: 131463 - protein, 9 aa, West Nile virus
FTSVGKAVH

SEQ ID NO: 131464 - protein, 9 aa, West Nile virus
TSVGKAVHQ

SEQ ID NO: 131465 - protein, 9 aa, West Nile virus
SVGKAVHQV

SEQ ID NO: 131466 - protein, 9 aa, West Nile virus
VGKAVHQVF

SEQ ID NO: 131467 - protein, 9 aa, West Nile virus
GKAVHQVFG

SEQ ID NO: 131468 - protein, 9 aa, West Nile virus
KAVHQVFGG

SEQ ID NO: 131469 - protein, 9 aa, West Nile virus
AVHQVFGGA

SEQ ID NO: 131470 - protein, 9 aa, West Nile virus
VHQVFGGAF

SEQ ID NO: 131471 - protein, 9 aa, West Nile virus
HQVFGGAFR

SEQ ID NO: 131472 - protein, 9 aa, West Nile virus
QVFGGAFRS

SEQ ID NO: 131473 - protein, 9 aa, West Nile virus
VFGGAFRSL

SEQ ID NO: 131474 - protein, 9 aa, West Nile virus
FGGAFRSLF

SEQ ID NO: 131475 - protein, 9 aa, West Nile virus
GGAFRSLFG

SEQ ID NO: 131476 - protein, 9 aa, West Nile virus
GAFRSLFGG

SEQ ID NO: 131477 - protein, 9 aa, West Nile virus
AFRSLFGGM

SEQ ID NO: 131478 - protein, 9 aa, West Nile virus
FRSLFGGMS

SEQ ID NO: 131479 - protein, 9 aa, West Nile virus
RSLFGGMSW

SEQ ID NO: 131480 - protein, 9 aa, West Nile virus
SLFGGMSWI

SEQ ID NO: 131481 - protein, 9 aa, West Nile virus
LFGGMSWIT

SEQ ID NO: 131482 - protein, 9 aa, West Nile virus
FGGMSWITQ

SEQ ID NO: 131483 - protein, 9 aa, West Nile virus
GGMSWITQG

SEQ ID NO: 131484 - protein, 9 aa, West Nile virus
GMSWITQGL

SEQ ID NO: 131485 - protein, 9 aa, West Nile virus
MSWITQGLL

SEQ ID NO: 131486 - protein, 9 aa, West Nile virus
SWITQGLLG

SEQ ID NO: 131487 - protein, 9 aa, West Nile virus
WITQGLLGA

SEQ ID NO: 131488 - protein, 9 aa, West Nile virus
ITQGLLGAL

SEQ ID NO: 131489 - protein, 9 aa, West Nile virus
TQGLLGALL

SEQ ID NO: 131490 - protein, 9 aa, West Nile virus
QGLLGALLL

SEQ ID NO: 131491 - protein, 9 aa, West Nile virus
GLLGALLLW

SEQ ID NO: 131492 - protein, 9 aa, West Nile virus
LLGALLLWM

SEQ ID NO: 131493 - protein, 9 aa, West Nile virus
LGALLLWMG

SEQ ID NO: 131494 - protein, 9 aa, West Nile virus
GALLLWMGI

SEQ ID NO: 131495 - protein, 9 aa, West Nile virus
ALLLWMGIN

SEQ ID NO: 131496 - protein, 9 aa, West Nile virus
LLLWMGINA

SEQ ID NO: 131497 - protein, 9 aa, West Nile virus
LLWMGINAR

SEQ ID NO: 131498 - protein, 9 aa, West Nile virus
LWMGINARD

SEQ ID NO: 131499 - protein, 9 aa, West Nile virus
WMGINARDR

SEQ ID NO: 131500 - protein, 9 aa, West Nile virus
MGINARDRS

SEQ ID NO: 131501 - protein, 9 aa, West Nile virus
GINARDRSI

SEQ ID NO: 131502 - protein, 9 aa, West Nile virus
INARDRSIA

SEQ ID NO: 131503 - protein, 9 aa, West Nile virus
NARDRSIAL

SEQ ID NO: 131504 - protein, 9 aa, West Nile virus
ARDRSIALT

SEQ ID NO: 131505 - protein, 9 aa, West Nile virus
RDRSIALTF

SEQ ID NO: 131506 - protein, 9 aa, West Nile virus
DRSIALTFL

SEQ ID NO: 131507 - protein, 9 aa, West Nile virus
RSIALTFLA

SEQ ID NO: 131508 - protein, 9 aa, West Nile virus
SIALTFLAV

SEQ ID NO: 131509 - protein, 9 aa, West Nile virus
IALTFLAVG

SEQ ID NO: 131510 - protein, 9 aa, West Nile virus
ALTFLAVGG

SEQ ID NO: 131511 - protein, 9 aa, West Nile virus
LTFLAVGGV

SEQ ID NO: 131512 - protein, 9 aa, West Nile virus
TFLAVGGVL

SEQ ID NO: 131513 - protein, 9 aa, West Nile virus
FLAVGGVLL

SEQ ID NO: 131514 - protein, 9 aa, West Nile virus
LAVGGVLLF

SEQ ID NO: 131515 - protein, 9 aa, West Nile virus
AVGGVLLFL

SEQ ID NO: 131516 - protein, 9 aa, West Nile virus
VGGVLLFLS

SEQ ID NO: 131517 - protein, 9 aa, West Nile virus
GGVLLFLSV

SEQ ID NO: 131518 - protein, 9 aa, West Nile virus
GVLLFLSVN

SEQ ID NO: 131519 - protein, 9 aa, West Nile virus
VLLFLSVNV

SEQ ID NO: 131520 - protein, 9 aa, West Nile virus
LLFLSVNVH

SEQ ID NO: 131521 - protein, 9 aa, West Nile virus
LFLSVNVHA

SEQ ID NO: 131522 - protein, 9 aa, West Nile virus
FLSVNVHAD

SEQ ID NO: 131523 - protein, 9 aa, West Nile virus
LSVNVHADT

SEQ ID NO: 131524 - protein, 9 aa, West Nile virus
SVNVHADTG

SEQ ID NO: 131525 - protein, 9 aa, West Nile virus
VNVHADTGC

SEQ ID NO: 131526 - protein, 9 aa, West Nile virus
NVHADTGCA

SEQ ID NO: 131527 - protein, 9 aa, West Nile virus
VHADTGCAI

SEQ ID NO: 131528 - protein, 9 aa, West Nile virus
HADTGCAID

SEQ ID NO: 131529 - protein, 9 aa, West Nile virus
ADTGCAIDI

SEQ ID NO: 131530 - protein, 9 aa, West Nile virus
DTGCAIDIS

SEQ ID NO: 131531 - protein, 9 aa, West Nile virus
TGCAIDISR

SEQ ID NO: 131532 - protein, 9 aa, West Nile virus
GCAIDISRQ

SEQ ID NO: 131533 - protein, 9 aa, West Nile virus
CAIDISRQE

SEQ ID NO: 131534 - protein, 9 aa, West Nile virus
AIDISRQEL

SEQ ID NO: 131535 - protein, 9 aa, West Nile virus
IDISRQELR

SEQ ID NO: 131536 - protein, 9 aa, West Nile virus
DISRQELRC

SEQ ID NO: 131537 - protein, 9 aa, West Nile virus
ISRQELRCG

SEQ ID NO: 131538 - protein, 9 aa, West Nile virus
SRQELRCGS

SEQ ID NO: 131539 - protein, 9 aa, West Nile virus
RQELRCGSG

SEQ ID NO: 131540 - protein, 9 aa, West Nile virus
QELRCGSGV

SEQ ID NO: 131541 - protein, 9 aa, West Nile virus
ELRCGSGVF

SEQ ID NO: 131542 - protein, 9 aa, West Nile virus
LRCGSGVFI

SEQ ID NO: 131543 - protein, 9 aa, West Nile virus
RCGSGVFIH

SEQ ID NO: 131544 - protein, 9 aa, West Nile virus
CGSGVFIHN

SEQ ID NO: 131545 - protein, 9 aa, West Nile virus
GSGVFIHND

SEQ ID NO: 131546 - protein, 9 aa, West Nile virus
SGVFIHNDV

SEQ ID NO: 131547 - protein, 9 aa, West Nile virus
GVFIHNDVE

SEQ ID NO: 131548 - protein, 9 aa, West Nile virus
VFIHNDVEA

SEQ ID NO: 131549 - protein, 9 aa, West Nile virus
FIHNDVEAW

SEQ ID NO: 131550 - protein, 9 aa, West Nile virus
NDVEAWMDR

SEQ ID NO: 131551 - protein, 9 aa, West Nile virus
DVEAWMDRY

SEQ ID NO: 131552 - protein, 9 aa, West Nile virus
VEAWMDRYK

SEQ ID NO: 131553 - protein, 9 aa, West Nile virus
DRYKYYPET

SEQ ID NO: 131554 - protein, 9 aa, West Nile virus
RYKYYPETP

SEQ ID NO: 131555 - protein, 9 aa, West Nile virus
YKYYPETPQ

SEQ ID NO: 131556 - protein, 9 aa, West Nile virus
KYYPETPQG

SEQ ID NO: 131557 - protein, 9 aa, West Nile virus
YYPETPQGL

SEQ ID NO: 131558 - protein, 9 aa, West Nile virus
YPETPQGLA

SEQ ID NO: 131559 - protein, 9 aa, West Nile virus
PETPQGLAK

SEQ ID NO: 131560 - protein, 9 aa, West Nile virus
ETPQGLAKI

SEQ ID NO: 131561 - protein, 9 aa, West Nile virus
TPQGLAKII

SEQ ID NO: 131562 - protein, 9 aa, West Nile virus
PQGLAKIIQ

SEQ ID NO: 131563 - protein, 9 aa, West Nile virus
QGLAKIIQK

SEQ ID NO: 131564 - protein, 9 aa, West Nile virus
GLAKIIQKA

SEQ ID NO: 131565 - protein, 9 aa, West Nile virus
LAKIIQKAH

SEQ ID NO: 131566 - protein, 9 aa, West Nile virus
EGVCGLRSV

SEQ ID NO: 131567 - protein, 9 aa, West Nile virus
GVCGLRSVS

SEQ ID NO: 131568 - protein, 9 aa, West Nile virus
VCGLRSVSR

SEQ ID NO: 131569 - protein, 9 aa, West Nile virus
CGLRSVSRL

SEQ ID NO: 131570 - protein, 9 aa, West Nile virus
GLRSVSRLE

SEQ ID NO: 131571 - protein, 9 aa, West Nile virus
LRSVSRLEH

SEQ ID NO: 131572 - protein, 9 aa, West Nile virus
RSVSRLEHQ

SEQ ID NO: 131573 - protein, 9 aa, West Nile virus
SVSRLEHQM

SEQ ID NO: 131574 - protein, 9 aa, West Nile virus
VSRLEHQMW

SEQ ID NO: 131575 - protein, 9 aa, West Nile virus
SRLEHQMWE

SEQ ID NO: 131576 - protein, 9 aa, West Nile virus
RLEHQMWEA

SEQ ID NO: 131577 - protein, 9 aa, West Nile virus
LEHQMWEAV

SEQ ID NO: 131578 - protein, 9 aa, West Nile virus
EHQMWEAVK

SEQ ID NO: 131579 - protein, 9 aa, West Nile virus
HQMWEAVKD

SEQ ID NO: 131580 - protein, 9 aa, West Nile virus
QMWEAVKDE

SEQ ID NO: 131581 - protein, 9 aa, West Nile virus
MWEAVKDEL

SEQ ID NO: 131582 - protein, 9 aa, West Nile virus
WEAVKDELN

SEQ ID NO: 131583 - protein, 9 aa, West Nile virus
EAVKDELNT

SEQ ID NO: 131584 - protein, 9 aa, West Nile virus
AVKDELNTL

SEQ ID NO: 131585 - protein, 9 aa, West Nile virus
VKDELNTLL

SEQ ID NO: 131586 - protein, 9 aa, West Nile virus
KDELNTLLK

SEQ ID NO: 131587 - protein, 9 aa, West Nile virus
DELNTLLKE

SEQ ID NO: 131588 - protein, 9 aa, West Nile virus
ELNTLLKEN

SEQ ID NO: 131589 - protein, 9 aa, West Nile virus
LNTLLKENG

SEQ ID NO: 131590 - protein, 9 aa, West Nile virus
NTLLKENGV

SEQ ID NO: 131591 - protein, 9 aa, West Nile virus
TLLKENGVD

SEQ ID NO: 131592 - protein, 9 aa, West Nile virus
LLKENGVDL

SEQ ID NO: 131593 - protein, 9 aa, West Nile virus
LKENGVDLS

SEQ ID NO: 131594 - protein, 9 aa, West Nile virus
KENGVDLSV

SEQ ID NO: 131595 - protein, 9 aa, West Nile virus
ENGVDLSVV

SEQ ID NO: 131596 - protein, 9 aa, West Nile virus
NGVDLSVVV

SEQ ID NO: 131597 - protein, 9 aa, West Nile virus
GVDLSVVVE

SEQ ID NO: 131598 - protein, 9 aa, West Nile virus
VDLSVVVEK

SEQ ID NO: 131599 - protein, 9 aa, West Nile virus
DLSVVVEKQ

SEQ ID NO: 131600 - protein, 9 aa, West Nile virus
ATTEKLEIG

SEQ ID NO: 131601 - protein, 9 aa, West Nile virus
TTEKLEIGW

SEQ ID NO: 131602 - protein, 9 aa, West Nile virus
TEKLEIGWK

SEQ ID NO: 131603 - protein, 9 aa, West Nile virus
EKLEIGWKA

SEQ ID NO: 131604 - protein, 9 aa, West Nile virus
KLEIGWKAW

SEQ ID NO: 131605 - protein, 9 aa, West Nile virus
LEIGWKAWG

SEQ ID NO: 131606 - protein, 9 aa, West Nile virus
EIGWKAWGK

SEQ ID NO: 131607 - protein, 9 aa, West Nile virus
IGWKAWGKS

SEQ ID NO: 131608 - protein, 9 aa, West Nile virus
GWKAWGKSI

SEQ ID NO: 131609 - protein, 9 aa, West Nile virus
WKAWGKSIL

SEQ ID NO: 131610 - protein, 9 aa, West Nile virus
KAWGKSILF

SEQ ID NO: 131611 - protein, 9 aa, West Nile virus
AWGKSILFA

SEQ ID NO: 131612 - protein, 9 aa, West Nile virus
WGKSILFAP

SEQ ID NO: 131613 - protein, 9 aa, West Nile virus
GKSILFAPE

SEQ ID NO: 131614 - protein, 9 aa, West Nile virus
KSILFAPEL

SEQ ID NO: 131615 - protein, 9 aa, West Nile virus
SILFAPELA

SEQ ID NO: 131616 - protein, 9 aa, West Nile virus
ILFAPELAN

SEQ ID NO: 131617 - protein, 9 aa, West Nile virus
FAPELANNT

SEQ ID NO: 131618 - protein, 9 aa, West Nile virus
APELANNTF

SEQ ID NO: 131619 - protein, 9 aa, West Nile virus
PELANNTFV

SEQ ID NO: 131620 - protein, 9 aa, West Nile virus
ELANNTFVV

SEQ ID NO: 131621 - protein, 9 aa, West Nile virus
LANNTFVVD

SEQ ID NO: 131622 - protein, 9 aa, West Nile virus
ANNTFVVDG

SEQ ID NO: 131623 - protein, 9 aa, West Nile virus
NNTFVVDGP

SEQ ID NO: 131624 - protein, 9 aa, West Nile virus
NTFVVDGPE

SEQ ID NO: 131625 - protein, 9 aa, West Nile virus
TFVVDGPET

SEQ ID NO: 131626 - protein, 9 aa, West Nile virus
FVVDGPETK

SEQ ID NO: 131627 - protein, 9 aa, West Nile virus
VVDGPETKE

SEQ ID NO: 131628 - protein, 9 aa, West Nile virus
VDGPETKEC

SEQ ID NO: 131629 - protein, 9 aa, West Nile virus
DGPETKECP

SEQ ID NO: 131630 - protein, 9 aa, West Nile virus
GPETKECPT

SEQ ID NO: 131631 - protein, 9 aa, West Nile virus
NRAWNSLEV

SEQ ID NO: 131632 - protein, 9 aa, West Nile virus
RAWNSLEVE

SEQ ID NO: 131633 - protein, 9 aa, West Nile virus
AWNSLEVED

SEQ ID NO: 131634 - protein, 9 aa, West Nile virus
WNSLEVEDF

SEQ ID NO: 131635 - protein, 9 aa, West Nile virus
NSLEVEDFG

SEQ ID NO: 131636 - protein, 9 aa, West Nile virus
SLEVEDFGF

SEQ ID NO: 131637 - protein, 9 aa, West Nile virus
LEVEDFGFG

SEQ ID NO: 131638 - protein, 9 aa, West Nile virus
EVEDFGFGL

SEQ ID NO: 131639 - protein, 9 aa, West Nile virus
VEDFGFGLT

SEQ ID NO: 131640 - protein, 9 aa, West Nile virus
EDFGFGLTS

SEQ ID NO: 131641 - protein, 9 aa, West Nile virus
DFGFGLTST

SEQ ID NO: 131642 - protein, 9 aa, West Nile virus
FGFGLTSTR

SEQ ID NO: 131643 - protein, 9 aa, West Nile virus
GFGLTSTRM

SEQ ID NO: 131644 - protein, 9 aa, West Nile virus
FGLTSTRMF

SEQ ID NO: 131645 - protein, 9 aa, West Nile virus
GLTSTRMFL

SEQ ID NO: 131646 - protein, 9 aa, West Nile virus
LTSTRMFLK

SEQ ID NO: 131647 - protein, 9 aa, West Nile virus
VRESNTTEC

SEQ ID NO: 131648 - protein, 9 aa, West Nile virus
RESNTTECD

SEQ ID NO: 131649 - protein, 9 aa, West Nile virus
SNTTECDSK

SEQ ID NO: 131650 - protein, 9 aa, West Nile virus
NTTECDSKI

SEQ ID NO: 131651 - protein, 9 aa, West Nile virus
TTECDSKII

SEQ ID NO: 131652 - protein, 9 aa, West Nile virus
TECDSKIIG

SEQ ID NO: 131653 - protein, 9 aa, West Nile virus
ECDSKIIGT

SEQ ID NO: 131654 - protein, 9 aa, West Nile virus
CDSKIIGTA

SEQ ID NO: 131655 - protein, 9 aa, West Nile virus
DSKIIGTAV

SEQ ID NO: 131656 - protein, 9 aa, West Nile virus
SKIIGTAVK

SEQ ID NO: 131657 - protein, 9 aa, West Nile virus
KIIGTAVKN

SEQ ID NO: 131658 - protein, 9 aa, West Nile virus
IIGTAVKNN

SEQ ID NO: 131659 - protein, 9 aa, West Nile virus
IGTAVKNNL

SEQ ID NO: 131660 - protein, 9 aa, West Nile virus
GTAVKNNLA

SEQ ID NO: 131661 - protein, 9 aa, West Nile virus
TAVKNNLAI

SEQ ID NO: 131662 - protein, 9 aa, West Nile virus
AVKNNLAIH

SEQ ID NO: 131663 - protein, 9 aa, West Nile virus
VKNNLAIHS

SEQ ID NO: 131664 - protein, 9 aa, West Nile virus
KNNLAIHSD

SEQ ID NO: 131665 - protein, 9 aa, West Nile virus
NNLAIHSDL

SEQ ID NO: 131666 - protein, 9 aa, West Nile virus
NLAIHSDLS

SEQ ID NO: 131667 - protein, 9 aa, West Nile virus
LAIHSDLSY

SEQ ID NO: 131668 - protein, 9 aa, West Nile virus
AIHSDLSYW

SEQ ID NO: 131669 - protein, 9 aa, West Nile virus
IHSDLSYWI

SEQ ID NO: 131670 - protein, 9 aa, West Nile virus
HSDLSYWIE

SEQ ID NO: 131671 - protein, 9 aa, West Nile virus
SDLSYWIES

SEQ ID NO: 131672 - protein, 9 aa, West Nile virus
DLSYWIESR

SEQ ID NO: 131673 - protein, 9 aa, West Nile virus
LSYWIESRL

SEQ ID NO: 131674 - protein, 9 aa, West Nile virus
SYWIESRLN

SEQ ID NO: 131675 - protein, 9 aa, West Nile virus
LNDTWKLER

SEQ ID NO: 131676 - protein, 9 aa, West Nile virus
NDTWKLERA

SEQ ID NO: 131677 - protein, 9 aa, West Nile virus
DTWKLERAV

SEQ ID NO: 131678 - protein, 9 aa, West Nile virus
TWKLERAVL

SEQ ID NO: 131679 - protein, 9 aa, West Nile virus
WKLERAVLG

SEQ ID NO: 131680 - protein, 9 aa, West Nile virus
KLERAVLGE

SEQ ID NO: 131681 - protein, 9 aa, West Nile virus
LERAVLGEV

SEQ ID NO: 131682 - protein, 9 aa, West Nile virus
ERAVLGEVK

SEQ ID NO: 131683 - protein, 9 aa, West Nile virus
RAVLGEVKS

SEQ ID NO: 131684 - protein, 9 aa, West Nile virus
AVLGEVKSC

SEQ ID NO: 131685 - protein, 9 aa, West Nile virus
VLGEVKSCT

SEQ ID NO: 131686 - protein, 9 aa, West Nile virus
LGEVKSCTW

SEQ ID NO: 131687 - protein, 9 aa, West Nile virus
GEVKSCTWP

SEQ ID NO: 131688 - protein, 9 aa, West Nile virus
EVKSCTWPE

SEQ ID NO: 131689 - protein, 9 aa, West Nile virus
VKSCTWPET

SEQ ID NO: 131690 - protein, 9 aa, West Nile virus
KSCTWPETH

SEQ ID NO: 131691 - protein, 9 aa, West Nile virus
SCTWPETHT

SEQ ID NO: 131692 - protein, 9 aa, West Nile virus
CTWPETHTL

SEQ ID NO: 131693 - protein, 9 aa, West Nile virus
TWPETHTLW

SEQ ID NO: 131694 - protein, 9 aa, West Nile virus
WPETHTLWG

SEQ ID NO: 131695 - protein, 9 aa, West Nile virus
PETHTLWGD

SEQ ID NO: 131696 - protein, 9 aa, West Nile virus
ETHTLWGDG

SEQ ID NO: 131697 - protein, 9 aa, West Nile virus
THTLWGDGI

SEQ ID NO: 131698 - protein, 9 aa, West Nile virus
HTLWGDGIL

SEQ ID NO: 131699 - protein, 9 aa, West Nile virus
TLWGDGILE

SEQ ID NO: 131700 - protein, 9 aa, West Nile virus
LWGDGILES

SEQ ID NO: 131701 - protein, 9 aa, West Nile virus
GILESDLII

SEQ ID NO: 131702 - protein, 9 aa, West Nile virus
ILESDLIIP

SEQ ID NO: 131703 - protein, 9 aa, West Nile virus
ESDLIIPVT

SEQ ID NO: 131704 - protein, 9 aa, West Nile virus
SDLIIPVTL

SEQ ID NO: 131705 - protein, 9 aa, West Nile virus
DLIIPVTLA

SEQ ID NO: 131706 - protein, 9 aa, West Nile virus
LIIPVTLAG

SEQ ID NO: 131707 - protein, 9 aa, West Nile virus
IIPVTLAGP

SEQ ID NO: 131708 - protein, 9 aa, West Nile virus
IPVTLAGPR

SEQ ID NO: 131709 - protein, 9 aa, West Nile virus
PVTLAGPRS

SEQ ID NO: 131710 - protein, 9 aa, West Nile virus
VTLAGPRSN

SEQ ID NO: 131711 - protein, 9 aa, West Nile virus
TLAGPRSNH

SEQ ID NO: 131712 - protein, 9 aa, West Nile virus
LAGPRSNHN

SEQ ID NO: 131713 - protein, 9 aa, West Nile virus
AGPRSNHNR

SEQ ID NO: 131714 - protein, 9 aa, West Nile virus
GPRSNHNRR

SEQ ID NO: 131715 - protein, 9 aa, West Nile virus
PRSNHNRRP

SEQ ID NO: 131716 - protein, 9 aa, West Nile virus
RSNHNRRPG

SEQ ID NO: 131717 - protein, 9 aa, West Nile virus
SNHNRRPGY

SEQ ID NO: 131718 - protein, 9 aa, West Nile virus
NHNRRPGYK

SEQ ID NO: 131719 - protein, 9 aa, West Nile virus
HNRRPGYKT

SEQ ID NO: 131720 - protein, 9 aa, West Nile virus
NRRPGYKTQ

SEQ ID NO: 131721 - protein, 9 aa, West Nile virus
RRPGYKTQN

SEQ ID NO: 131722 - protein, 9 aa, West Nile virus
RPGYKTQNQ

SEQ ID NO: 131723 - protein, 9 aa, West Nile virus
PGYKTQNQG

SEQ ID NO: 131724 - protein, 9 aa, West Nile virus
GYKTQNQGP

SEQ ID NO: 131725 - protein, 9 aa, West Nile virus
YKTQNQGPW

SEQ ID NO: 131726 - protein, 9 aa, West Nile virus
KTQNQGPWD

SEQ ID NO: 131727 - protein, 9 aa, West Nile virus
TQNQGPWDE

SEQ ID NO: 131728 - protein, 9 aa, West Nile virus
QNQGPWDEG

SEQ ID NO: 131729 - protein, 9 aa, West Nile virus
NQGPWDEGR

SEQ ID NO: 131730 - protein, 9 aa, West Nile virus
QGPWDEGRV

SEQ ID NO: 131731 - protein, 9 aa, West Nile virus
GPWDEGRVE

SEQ ID NO: 131732 - protein, 9 aa, West Nile virus
PWDEGRVEI

SEQ ID NO: 131733 - protein, 9 aa, West Nile virus
WDEGRVEID

SEQ ID NO: 131734 - protein, 9 aa, West Nile virus
DEGRVEIDF

SEQ ID NO: 131735 - protein, 9 aa, West Nile virus
EGRVEIDFD

SEQ ID NO: 131736 - protein, 9 aa, West Nile virus
GRVEIDFDY

SEQ ID NO: 131737 - protein, 9 aa, West Nile virus
RVEIDFDYC

SEQ ID NO: 131738 - protein, 9 aa, West Nile virus
VEIDFDYCP

SEQ ID NO: 131739 - protein, 9 aa, West Nile virus
EIDFDYCPG

SEQ ID NO: 131740 - protein, 9 aa, West Nile virus
IDFDYCPGT

SEQ ID NO: 131741 - protein, 9 aa, West Nile virus
DFDYCPGTT

SEQ ID NO: 131742 - protein, 9 aa, West Nile virus
FDYCPGTTV

SEQ ID NO: 131743 - protein, 9 aa, West Nile virus
DYCPGTTVT

SEQ ID NO: 131744 - protein, 9 aa, West Nile virus
YCPGTTVTL

SEQ ID NO: 131745 - protein, 9 aa, West Nile virus
CPGTTVTLS

SEQ ID NO: 131746 - protein, 9 aa, West Nile virus
CGHRGPATR

SEQ ID NO: 131747 - protein, 9 aa, West Nile virus
GHRGPATRT

SEQ ID NO: 131748 - protein, 9 aa, West Nile virus
HRGPATRTT

SEQ ID NO: 131749 - protein, 9 aa, West Nile virus
RGPATRTTT

SEQ ID NO: 131750 - protein, 9 aa, West Nile virus
GPATRTTTE

SEQ ID NO: 131751 - protein, 9 aa, West Nile virus
PATRTTTES

SEQ ID NO: 131752 - protein, 9 aa, West Nile virus
ATRTTTESG

SEQ ID NO: 131753 - protein, 9 aa, West Nile virus
TRTTTESGK

SEQ ID NO: 131754 - protein, 9 aa, West Nile virus
RTTTESGKL

SEQ ID NO: 131755 - protein, 9 aa, West Nile virus
TTTESGKLI

SEQ ID NO: 131756 - protein, 9 aa, West Nile virus
TTESGKLIT

SEQ ID NO: 131757 - protein, 9 aa, West Nile virus
TESGKLITD

SEQ ID NO: 131758 - protein, 9 aa, West Nile virus
ESGKLITDW

SEQ ID NO: 131759 - protein, 9 aa, West Nile virus
SGKLITDWC

SEQ ID NO: 131760 - protein, 9 aa, West Nile virus
GKLITDWCC

SEQ ID NO: 131761 - protein, 9 aa, West Nile virus
KLITDWCCR

SEQ ID NO: 131762 - protein, 9 aa, West Nile virus
LITDWCCRS

SEQ ID NO: 131763 - protein, 9 aa, West Nile virus
ITDWCCRSC

SEQ ID NO: 131764 - protein, 9 aa, West Nile virus
TDWCCRSCT

SEQ ID NO: 131765 - protein, 9 aa, West Nile virus
DWCCRSCTL

SEQ ID NO: 131766 - protein, 9 aa, West Nile virus
WCCRSCTLP

SEQ ID NO: 131767 - protein, 9 aa, West Nile virus
CCRSCTLPP

SEQ ID NO: 131768 - protein, 9 aa, West Nile virus
CRSCTLPPL

SEQ ID NO: 131769 - protein, 9 aa, West Nile virus
RSCTLPPLR

SEQ ID NO: 131770 - protein, 9 aa, West Nile virus
SCTLPPLRY

SEQ ID NO: 131771 - protein, 9 aa, West Nile virus
CTLPPLRYQ

SEQ ID NO: 131772 - protein, 9 aa, West Nile virus
TLPPLRYQT

SEQ ID NO: 131773 - protein, 9 aa, West Nile virus
LPPLRYQTD

SEQ ID NO: 131774 - protein, 9 aa, West Nile virus
TDSGCWYGM

SEQ ID NO: 131775 - protein, 9 aa, West Nile virus
DSGCWYGME

SEQ ID NO: 131776 - protein, 9 aa, West Nile virus
SGCWYGMEI

SEQ ID NO: 131777 - protein, 9 aa, West Nile virus
GCWYGMEIR

SEQ ID NO: 131778 - protein, 9 aa, West Nile virus
CWYGMEIRP

SEQ ID NO: 131779 - protein, 9 aa, West Nile virus
WYGMEIRPQ

SEQ ID NO: 131780 - protein, 9 aa, West Nile virus
YGMEIRPQR

SEQ ID NO: 131781 - protein, 9 aa, West Nile virus
GMEIRPQRH

SEQ ID NO: 131782 - protein, 9 aa, West Nile virus
MEIRPQRHD

SEQ ID NO: 131783 - protein, 9 aa, West Nile virus
EIRPQRHDE

SEQ ID NO: 131784 - protein, 9 aa, West Nile virus
IRPQRHDEK

SEQ ID NO: 131785 - protein, 9 aa, West Nile virus
RPQRHDEKT

SEQ ID NO: 131786 - protein, 9 aa, West Nile virus
PQRHDEKTL

SEQ ID NO: 131787 - protein, 9 aa, West Nile virus
QRHDEKTLV

SEQ ID NO: 131788 - protein, 9 aa, West Nile virus
RHDEKTLVQ

SEQ ID NO: 131789 - protein, 9 aa, West Nile virus
HDEKTLVQS

SEQ ID NO: 131790 - protein, 9 aa, West Nile virus
DEKTLVQSQ

SEQ ID NO: 131791 - protein, 9 aa, West Nile virus
EKTLVQSQV

SEQ ID NO: 131792 - protein, 9 aa, West Nile virus
KTLVQSQVN

SEQ ID NO: 131793 - protein, 9 aa, West Nile virus
TLVQSQVNA

SEQ ID NO: 131794 - protein, 9 aa, West Nile virus
LVQSQVNAY

SEQ ID NO: 131795 - protein, 9 aa, West Nile virus
VQSQVNAYN

SEQ ID NO: 131796 - protein, 9 aa, West Nile virus
QSQVNAYNA

SEQ ID NO: 131797 - protein, 9 aa, West Nile virus
SQVNAYNAD

SEQ ID NO: 131798 - protein, 9 aa, West Nile virus
QVNAYNADM

SEQ ID NO: 131799 - protein, 9 aa, West Nile virus
VNAYNADMI

SEQ ID NO: 131800 - protein, 9 aa, West Nile virus
NAYNADMID

SEQ ID NO: 131801 - protein, 9 aa, West Nile virus
AYNADMIDP

SEQ ID NO: 131802 - protein, 9 aa, West Nile virus
YNADMIDPF

SEQ ID NO: 131803 - protein, 9 aa, West Nile virus
NADMIDPFQ

SEQ ID NO: 131804 - protein, 9 aa, West Nile virus
ADMIDPFQL

SEQ ID NO: 131805 - protein, 9 aa, West Nile virus
DMIDPFQLG

SEQ ID NO: 131806 - protein, 9 aa, West Nile virus
MIDPFQLGL

SEQ ID NO: 131807 - protein, 9 aa, West Nile virus
IDPFQLGLL

SEQ ID NO: 131808 - protein, 9 aa, West Nile virus
DPFQLGLLV

SEQ ID NO: 131809 - protein, 9 aa, West Nile virus
PFQLGLLVV

SEQ ID NO: 131810 - protein, 9 aa, West Nile virus
FQLGLLVVF

SEQ ID NO: 131811 - protein, 9 aa, West Nile virus
QLGLLVVFL

SEQ ID NO: 131812 - protein, 9 aa, West Nile virus
LGLLVVFLA

SEQ ID NO: 131813 - protein, 9 aa, West Nile virus
GLLVVFLAT

SEQ ID NO: 131814 - protein, 9 aa, West Nile virus
LLVVFLATQ

SEQ ID NO: 131815 - protein, 9 aa, West Nile virus
LVVFLATQE

SEQ ID NO: 131816 - protein, 9 aa, West Nile virus
VVFLATQEV

SEQ ID NO: 131817 - protein, 9 aa, West Nile virus
VFLATQEVL

SEQ ID NO: 131818 - protein, 9 aa, West Nile virus
FLATQEVLR

SEQ ID NO: 131819 - protein, 9 aa, West Nile virus
LATQEVLRK

SEQ ID NO: 131820 - protein, 9 aa, West Nile virus
ATQEVLRKR

SEQ ID NO: 131821 - protein, 9 aa, West Nile virus
TQEVLRKRW

SEQ ID NO: 131822 - protein, 9 aa, West Nile virus
QEVLRKRWT

SEQ ID NO: 131823 - protein, 9 aa, West Nile virus
EVLRKRWTA

SEQ ID NO: 131824 - protein, 9 aa, West Nile virus
VLRKRWTAK

SEQ ID NO: 131825 - protein, 9 aa, West Nile virus
LRKRWTAKI

SEQ ID NO: 131826 - protein, 9 aa, West Nile virus
RKRWTAKIS

SEQ ID NO: 131827 - protein, 9 aa, West Nile virus
KRWTAKISM

SEQ ID NO: 131828 - protein, 9 aa, West Nile virus
RWTAKISMP

SEQ ID NO: 131829 - protein, 9 aa, West Nile virus
WTAKISMPA

SEQ ID NO: 131830 - protein, 9 aa, West Nile virus
TAKISMPAI

SEQ ID NO: 131831 - protein, 9 aa, West Nile virus
PAILIALLV

SEQ ID NO: 131832 - protein, 9 aa, West Nile virus
AILIALLVL

SEQ ID NO: 131833 - protein, 9 aa, West Nile virus
ILIALLVLV

SEQ ID NO: 131834 - protein, 9 aa, West Nile virus
LIALLVLVF

SEQ ID NO: 131835 - protein, 9 aa, West Nile virus
IALLVLVFG

SEQ ID NO: 131836 - protein, 9 aa, West Nile virus
ALLVLVFGG

SEQ ID NO: 131837 - protein, 9 aa, West Nile virus
LLVLVFGGI

SEQ ID NO: 131838 - protein, 9 aa, West Nile virus
LVLVFGGIT

SEQ ID NO: 131839 - protein, 9 aa, West Nile virus
VLVFGGITY

SEQ ID NO: 131840 - protein, 9 aa, West Nile virus
LVFGGITYT

SEQ ID NO: 131841 - protein, 9 aa, West Nile virus
VFGGITYTD

SEQ ID NO: 131842 - protein, 9 aa, West Nile virus
FGGITYTDV

SEQ ID NO: 131843 - protein, 9 aa, West Nile virus
GGITYTDVL

SEQ ID NO: 131844 - protein, 9 aa, West Nile virus
GITYTDVLR

SEQ ID NO: 131845 - protein, 9 aa, West Nile virus
ITYTDVLRY

SEQ ID NO: 131846 - protein, 9 aa, West Nile virus
TYTDVLRYV

SEQ ID NO: 131847 - protein, 9 aa, West Nile virus
YTDVLRYVI

SEQ ID NO: 131848 - protein, 9 aa, West Nile virus
TDVLRYVIL

SEQ ID NO: 131849 - protein, 9 aa, West Nile virus
DVLRYVILV

SEQ ID NO: 131850 - protein, 9 aa, West Nile virus
VLRYVILVG

SEQ ID NO: 131851 - protein, 9 aa, West Nile virus
LRYVILVGA

SEQ ID NO: 131852 - protein, 9 aa, West Nile virus
RYVILVGAA

SEQ ID NO: 131853 - protein, 9 aa, West Nile virus
YVILVGAAF

SEQ ID NO: 131854 - protein, 9 aa, West Nile virus
VILVGAAFA

SEQ ID NO: 131855 - protein, 9 aa, West Nile virus
ILVGAAFAE

SEQ ID NO: 131856 - protein, 9 aa, West Nile virus
LVGAAFAES

SEQ ID NO: 131857 - protein, 9 aa, West Nile virus
VGAAFAESN

SEQ ID NO: 131858 - protein, 9 aa, West Nile virus
GAAFAESNS

SEQ ID NO: 131859 - protein, 9 aa, West Nile virus
AAFAESNSG

SEQ ID NO: 131860 - protein, 9 aa, West Nile virus
AFAESNSGG

SEQ ID NO: 131861 - protein, 9 aa, West Nile virus
FAESNSGGD

SEQ ID NO: 131862 - protein, 9 aa, West Nile virus
AESNSGGDV

SEQ ID NO: 131863 - protein, 9 aa, West Nile virus
ESNSGGDVV

SEQ ID NO: 131864 - protein, 9 aa, West Nile virus
SNSGGDVVH

SEQ ID NO: 131865 - protein, 9 aa, West Nile virus
NSGGDVVHL

SEQ ID NO: 131866 - protein, 9 aa, West Nile virus
SGGDVVHLA

SEQ ID NO: 131867 - protein, 9 aa, West Nile virus
GGDVVHLAL

SEQ ID NO: 131868 - protein, 9 aa, West Nile virus
GDVVHLALM

SEQ ID NO: 131869 - protein, 9 aa, West Nile virus
DVVHLALMA

SEQ ID NO: 131870 - protein, 9 aa, West Nile virus
VVHLALMAT

SEQ ID NO: 131871 - protein, 9 aa, West Nile virus
VHLALMATF

SEQ ID NO: 131872 - protein, 9 aa, West Nile virus
HLALMATFK

SEQ ID NO: 131873 - protein, 9 aa, West Nile virus
LALMATFKI

SEQ ID NO: 131874 - protein, 9 aa, West Nile virus
ALMATFKIQ

SEQ ID NO: 131875 - protein, 9 aa, West Nile virus
LMATFKIQP

SEQ ID NO: 131876 - protein, 9 aa, West Nile virus
MATFKIQPV

SEQ ID NO: 131877 - protein, 9 aa, West Nile virus
ATFKIQPVF

SEQ ID NO: 131878 - protein, 9 aa, West Nile virus
IQPVFMVAS

SEQ ID NO: 131879 - protein, 9 aa, West Nile virus
QPVFMVASF

SEQ ID NO: 131880 - protein, 9 aa, West Nile virus
PVFMVASFL

SEQ ID NO: 131881 - protein, 9 aa, West Nile virus
VFMVASFLK

SEQ ID NO: 131882 - protein, 9 aa, West Nile virus
FMVASFLKA

SEQ ID NO: 131883 - protein, 9 aa, West Nile virus
VASFLKARW

SEQ ID NO: 131884 - protein, 9 aa, West Nile virus
ASFLKARWT

SEQ ID NO: 131885 - protein, 9 aa, West Nile virus
SFLKARWTN

SEQ ID NO: 131886 - protein, 9 aa, West Nile virus
RWTNQENIL

SEQ ID NO: 131887 - protein, 9 aa, West Nile virus
WTNQENILL

SEQ ID NO: 131888 - protein, 9 aa, West Nile virus
TNQENILLM

SEQ ID NO: 131889 - protein, 9 aa, West Nile virus
NQENILLML

SEQ ID NO: 131890 - protein, 9 aa, West Nile virus
QENILLMLA

SEQ ID NO: 131891 - protein, 9 aa, West Nile virus
ENILLMLAA

SEQ ID NO: 131892 - protein, 9 aa, West Nile virus
NILLMLAAV

SEQ ID NO: 131893 - protein, 9 aa, West Nile virus
ILLMLAAVF

SEQ ID NO: 131894 - protein, 9 aa, West Nile virus
LLMLAAVFF

SEQ ID NO: 131895 - protein, 9 aa, West Nile virus
LMLAAVFFQ

SEQ ID NO: 131896 - protein, 9 aa, West Nile virus
MLAAVFFQM

SEQ ID NO: 131897 - protein, 9 aa, West Nile virus
LAAVFFQMA

SEQ ID NO: 131898 - protein, 9 aa, West Nile virus
AAVFFQMAY

SEQ ID NO: 131899 - protein, 9 aa, West Nile virus
AVFFQMAYH

SEQ ID NO: 131900 - protein, 9 aa, West Nile virus
VFFQMAYHD

SEQ ID NO: 131901 - protein, 9 aa, West Nile virus
FFQMAYHDA

SEQ ID NO: 131902 - protein, 9 aa, West Nile virus
FQMAYHDAR

SEQ ID NO: 131903 - protein, 9 aa, West Nile virus
WEIPDVLNS

SEQ ID NO: 131904 - protein, 9 aa, West Nile virus
EIPDVLNSL

SEQ ID NO: 131905 - protein, 9 aa, West Nile virus
IPDVLNSLA

SEQ ID NO: 131906 - protein, 9 aa, West Nile virus
PDVLNSLAV

SEQ ID NO: 131907 - protein, 9 aa, West Nile virus
DVLNSLAVA

SEQ ID NO: 131908 - protein, 9 aa, West Nile virus
VLNSLAVAW

SEQ ID NO: 131909 - protein, 9 aa, West Nile virus
LNSLAVAWM

SEQ ID NO: 131910 - protein, 9 aa, West Nile virus
NSLAVAWMI

SEQ ID NO: 131911 - protein, 9 aa, West Nile virus
SLAVAWMIL

SEQ ID NO: 131912 - protein, 9 aa, West Nile virus
LAVAWMILR

SEQ ID NO: 131913 - protein, 9 aa, West Nile virus
AVAWMILRA

SEQ ID NO: 131914 - protein, 9 aa, West Nile virus
VAWMILRAI

SEQ ID NO: 131915 - protein, 9 aa, West Nile virus
AWMILRAIT

SEQ ID NO: 131916 - protein, 9 aa, West Nile virus
WMILRAITF

SEQ ID NO: 131917 - protein, 9 aa, West Nile virus
MILRAITFT

SEQ ID NO: 131918 - protein, 9 aa, West Nile virus
FTTTSNVVV

SEQ ID NO: 131919 - protein, 9 aa, West Nile virus
TTTSNVVVP

SEQ ID NO: 131920 - protein, 9 aa, West Nile virus
TTSNVVVPL

SEQ ID NO: 131921 - protein, 9 aa, West Nile virus
TSNVVVPLL

SEQ ID NO: 131922 - protein, 9 aa, West Nile virus
SNVVVPLLA

SEQ ID NO: 131923 - protein, 9 aa, West Nile virus
NVVVPLLAL

SEQ ID NO: 131924 - protein, 9 aa, West Nile virus
VVVPLLALL

SEQ ID NO: 131925 - protein, 9 aa, West Nile virus
VVPLLALLT

SEQ ID NO: 131926 - protein, 9 aa, West Nile virus
VPLLALLTP

SEQ ID NO: 131927 - protein, 9 aa, West Nile virus
PLLALLTPG

SEQ ID NO: 131928 - protein, 9 aa, West Nile virus
LLALLTPGL

SEQ ID NO: 131929 - protein, 9 aa, West Nile virus
LALLTPGLR

SEQ ID NO: 131930 - protein, 9 aa, West Nile virus
ALLTPGLRC

SEQ ID NO: 131931 - protein, 9 aa, West Nile virus
LLTPGLRCL

SEQ ID NO: 131932 - protein, 9 aa, West Nile virus
LTPGLRCLN

SEQ ID NO: 131933 - protein, 9 aa, West Nile virus
TPGLRCLNL

SEQ ID NO: 131934 - protein, 9 aa, West Nile virus
PGLRCLNLD

SEQ ID NO: 131935 - protein, 9 aa, West Nile virus
GLRCLNLDV

SEQ ID NO: 131936 - protein, 9 aa, West Nile virus
LRCLNLDVY

SEQ ID NO: 131937 - protein, 9 aa, West Nile virus
RCLNLDVYR

SEQ ID NO: 131938 - protein, 9 aa, West Nile virus
CLNLDVYRI

SEQ ID NO: 131939 - protein, 9 aa, West Nile virus
LNLDVYRIL

SEQ ID NO: 131940 - protein, 9 aa, West Nile virus
NLDVYRILL

SEQ ID NO: 131941 - protein, 9 aa, West Nile virus
LDVYRILLL

SEQ ID NO: 131942 - protein, 9 aa, West Nile virus
DVYRILLLM

SEQ ID NO: 131943 - protein, 9 aa, West Nile virus
VYRILLLMV

SEQ ID NO: 131944 - protein, 9 aa, West Nile virus
YRILLLMVG

SEQ ID NO: 131945 - protein, 9 aa, West Nile virus
RILLLMVGI

SEQ ID NO: 131946 - protein, 9 aa, West Nile virus
ILLLMVGIG

SEQ ID NO: 131947 - protein, 9 aa, West Nile virus
LLLMVGIGS

SEQ ID NO: 131948 - protein, 9 aa, West Nile virus
LLMVGIGSL

SEQ ID NO: 131949 - protein, 9 aa, West Nile virus
LMVGIGSLI

SEQ ID NO: 131950 - protein, 9 aa, West Nile virus
MVGIGSLIR

SEQ ID NO: 131951 - protein, 9 aa, West Nile virus
VGIGSLIRE

SEQ ID NO: 131952 - protein, 9 aa, West Nile virus
GIGSLIREK

SEQ ID NO: 131953 - protein, 9 aa, West Nile virus
IGSLIREKR

SEQ ID NO: 131954 - protein, 9 aa, West Nile virus
GSLIREKRS

SEQ ID NO: 131955 - protein, 9 aa, West Nile virus
EKRSAAAKK

SEQ ID NO: 131956 - protein, 9 aa, West Nile virus
KRSAAAKKK

SEQ ID NO: 131957 - protein, 9 aa, West Nile virus
RSAAAKKKG

SEQ ID NO: 131958 - protein, 9 aa, West Nile virus
SAAAKKKGA

SEQ ID NO: 131959 - protein, 9 aa, West Nile virus
AAAKKKGAS

SEQ ID NO: 131960 - protein, 9 aa, West Nile virus
AAKKKGASL

SEQ ID NO: 131961 - protein, 9 aa, West Nile virus
AKKKGASLL

SEQ ID NO: 131962 - protein, 9 aa, West Nile virus
KKKGASLLC

SEQ ID NO: 131963 - protein, 9 aa, West Nile virus
KKGASLLCL

SEQ ID NO: 131964 - protein, 9 aa, West Nile virus
KGASLLCLA

SEQ ID NO: 131965 - protein, 9 aa, West Nile virus
GASLLCLAL

SEQ ID NO: 131966 - protein, 9 aa, West Nile virus
ASLLCLALA

SEQ ID NO: 131967 - protein, 9 aa, West Nile virus
SLLCLALAS

SEQ ID NO: 131968 - protein, 9 aa, West Nile virus
LLCLALAST

SEQ ID NO: 131969 - protein, 9 aa, West Nile virus
LCLALASTG

SEQ ID NO: 131970 - protein, 9 aa, West Nile virus
FNPMILAAG

SEQ ID NO: 131971 - protein, 9 aa, West Nile virus
NPMILAAGL

SEQ ID NO: 131972 - protein, 9 aa, West Nile virus
PMILAAGLI

SEQ ID NO: 131973 - protein, 9 aa, West Nile virus
LAAGLIACD

SEQ ID NO: 131974 - protein, 9 aa, West Nile virus
AAGLIACDP

SEQ ID NO: 131975 - protein, 9 aa, West Nile virus
AGLIACDPN

SEQ ID NO: 131976 - protein, 9 aa, West Nile virus
GLIACDPNR

SEQ ID NO: 131977 - protein, 9 aa, West Nile virus
LIACDPNRK

SEQ ID NO: 131978 - protein, 9 aa, West Nile virus
IACDPNRKR

SEQ ID NO: 131979 - protein, 9 aa, West Nile virus
ACDPNRKRG

SEQ ID NO: 131980 - protein, 9 aa, West Nile virus
CDPNRKRGW

SEQ ID NO: 131981 - protein, 9 aa, West Nile virus
DPNRKRGWP

SEQ ID NO: 131982 - protein, 9 aa, West Nile virus
PNRKRGWPA

SEQ ID NO: 131983 - protein, 9 aa, West Nile virus
NRKRGWPAT

SEQ ID NO: 131984 - protein, 9 aa, West Nile virus
RKRGWPATE

SEQ ID NO: 131985 - protein, 9 aa, West Nile virus
KRGWPATEV

SEQ ID NO: 131986 - protein, 9 aa, West Nile virus
RGWPATEVM

SEQ ID NO: 131987 - protein, 9 aa, West Nile virus
GWPATEVMT

SEQ ID NO: 131988 - protein, 9 aa, West Nile virus
WPATEVMTA

SEQ ID NO: 131989 - protein, 9 aa, West Nile virus
PATEVMTAV

SEQ ID NO: 131990 - protein, 9 aa, West Nile virus
ATEVMTAVG

SEQ ID NO: 131991 - protein, 9 aa, West Nile virus
TEVMTAVGL

SEQ ID NO: 131992 - protein, 9 aa, West Nile virus
EVMTAVGLM

SEQ ID NO: 131993 - protein, 9 aa, West Nile virus
VMTAVGLMF

SEQ ID NO: 131994 - protein, 9 aa, West Nile virus
MTAVGLMFA

SEQ ID NO: 131995 - protein, 9 aa, West Nile virus
TAVGLMFAI

SEQ ID NO: 131996 - protein, 9 aa, West Nile virus
AVGLMFAIV

SEQ ID NO: 131997 - protein, 9 aa, West Nile virus
VGLMFAIVG

SEQ ID NO: 131998 - protein, 9 aa, West Nile virus
GLMFAIVGG

SEQ ID NO: 131999 - protein, 9 aa, West Nile virus
LMFAIVGGL

SEQ ID NO: 132000 - protein, 9 aa, West Nile virus
MFAIVGGLA

SEQ ID NO: 132001 - protein, 9 aa, West Nile virus
FAIVGGLAE

SEQ ID NO: 132002 - protein, 9 aa, West Nile virus
AIVGGLAEL

SEQ ID NO: 132003 - protein, 9 aa, West Nile virus
IVGGLAELD

SEQ ID NO: 132004 - protein, 9 aa, West Nile virus
VGGLAELDI

SEQ ID NO: 132005 - protein, 9 aa, West Nile virus
GGLAELDID

SEQ ID NO: 132006 - protein, 9 aa, West Nile virus
GLAELDIDS

SEQ ID NO: 132007 - protein, 9 aa, West Nile virus
LAELDIDSM

SEQ ID NO: 132008 - protein, 9 aa, West Nile virus
AELDIDSMA

SEQ ID NO: 132009 - protein, 9 aa, West Nile virus
ELDIDSMAI

SEQ ID NO: 132010 - protein, 9 aa, West Nile virus
LDIDSMAIP

SEQ ID NO: 132011 - protein, 9 aa, West Nile virus
DIDSMAIPM

SEQ ID NO: 132012 - protein, 9 aa, West Nile virus
IDSMAIPMT

SEQ ID NO: 132013 - protein, 9 aa, West Nile virus
DSMAIPMTI

SEQ ID NO: 132014 - protein, 9 aa, West Nile virus
SMAIPMTIA

SEQ ID NO: 132015 - protein, 9 aa, West Nile virus
MAIPMTIAG

SEQ ID NO: 132016 - protein, 9 aa, West Nile virus
AIPMTIAGL

SEQ ID NO: 132017 - protein, 9 aa, West Nile virus
IPMTIAGLM

SEQ ID NO: 132018 - protein, 9 aa, West Nile virus
PMTIAGLMF

SEQ ID NO: 132019 - protein, 9 aa, West Nile virus
MTIAGLMFA

SEQ ID NO: 132020 - protein, 9 aa, West Nile virus
TIAGLMFAA

SEQ ID NO: 132021 - protein, 9 aa, West Nile virus
IAGLMFAAF

SEQ ID NO: 132022 - protein, 9 aa, West Nile virus
AGLMFAAFV

SEQ ID NO: 132023 - protein, 9 aa, West Nile virus
GLMFAAFVI

SEQ ID NO: 132024 - protein, 9 aa, West Nile virus
LMFAAFVIS

SEQ ID NO: 132025 - protein, 9 aa, West Nile virus
MFAAFVISG

SEQ ID NO: 132026 - protein, 9 aa, West Nile virus
FAAFVISGK

SEQ ID NO: 132027 - protein, 9 aa, West Nile virus
AAFVISGKS

SEQ ID NO: 132028 - protein, 9 aa, West Nile virus
AFVISGKST

SEQ ID NO: 132029 - protein, 9 aa, West Nile virus
FVISGKSTD

SEQ ID NO: 132030 - protein, 9 aa, West Nile virus
VISGKSTDM

SEQ ID NO: 132031 - protein, 9 aa, West Nile virus
ISGKSTDMW

SEQ ID NO: 132032 - protein, 9 aa, West Nile virus
SGKSTDMWI

SEQ ID NO: 132033 - protein, 9 aa, West Nile virus
GKSTDMWIE

SEQ ID NO: 132034 - protein, 9 aa, West Nile virus
KSTDMWIER

SEQ ID NO: 132035 - protein, 9 aa, West Nile virus
STDMWIERT

SEQ ID NO: 132036 - protein, 9 aa, West Nile virus
TDMWIERTA

SEQ ID NO: 132037 - protein, 9 aa, West Nile virus
DMWIERTAD

SEQ ID NO: 132038 - protein, 9 aa, West Nile virus
MWIERTADI

SEQ ID NO: 132039 - protein, 9 aa, West Nile virus
WIERTADIS

SEQ ID NO: 132040 - protein, 9 aa, West Nile virus
IERTADISW

SEQ ID NO: 132041 - protein, 9 aa, West Nile virus
ERTADISWE

SEQ ID NO: 132042 - protein, 9 aa, West Nile virus
RTADISWES

SEQ ID NO: 132043 - protein, 9 aa, West Nile virus
TADISWESD

SEQ ID NO: 132044 - protein, 9 aa, West Nile virus
ADISWESDA

SEQ ID NO: 132045 - protein, 9 aa, West Nile virus
DISWESDAE

SEQ ID NO: 132046 - protein, 9 aa, West Nile virus
ISWESDAEI

SEQ ID NO: 132047 - protein, 9 aa, West Nile virus
SWESDAEIT

SEQ ID NO: 132048 - protein, 9 aa, West Nile virus
WESDAEITG

SEQ ID NO: 132049 - protein, 9 aa, West Nile virus
ESDAEITGS

SEQ ID NO: 132050 - protein, 9 aa, West Nile virus
SDAEITGSS

SEQ ID NO: 132051 - protein, 9 aa, West Nile virus
DAEITGSSE

SEQ ID NO: 132052 - protein, 9 aa, West Nile virus
AEITGSSER

SEQ ID NO: 132053 - protein, 9 aa, West Nile virus
EITGSSERV

SEQ ID NO: 132054 - protein, 9 aa, West Nile virus
ITGSSERVD

SEQ ID NO: 132055 - protein, 9 aa, West Nile virus
TGSSERVDV

SEQ ID NO: 132056 - protein, 9 aa, West Nile virus
GSSERVDVR

SEQ ID NO: 132057 - protein, 9 aa, West Nile virus
SSERVDVRL

SEQ ID NO: 132058 - protein, 9 aa, West Nile virus
SERVDVRLD

SEQ ID NO: 132059 - protein, 9 aa, West Nile virus
ERVDVRLDD

SEQ ID NO: 132060 - protein, 9 aa, West Nile virus
RVDVRLDDD

SEQ ID NO: 132061 - protein, 9 aa, West Nile virus
VDVRLDDDG

SEQ ID NO: 132062 - protein, 9 aa, West Nile virus
DVRLDDDGN

SEQ ID NO: 132063 - protein, 9 aa, West Nile virus
VRLDDDGNF

SEQ ID NO: 132064 - protein, 9 aa, West Nile virus
RLDDDGNFQ

SEQ ID NO: 132065 - protein, 9 aa, West Nile virus
LDDDGNFQL

SEQ ID NO: 132066 - protein, 9 aa, West Nile virus
DDDGNFQLM

SEQ ID NO: 132067 - protein, 9 aa, West Nile virus
DDGNFQLMN

SEQ ID NO: 132068 - protein, 9 aa, West Nile virus
DGNFQLMND

SEQ ID NO: 132069 - protein, 9 aa, West Nile virus
GNFQLMNDP

SEQ ID NO: 132070 - protein, 9 aa, West Nile virus
NFQLMNDPG

SEQ ID NO: 132071 - protein, 9 aa, West Nile virus
FQLMNDPGA

SEQ ID NO: 132072 - protein, 9 aa, West Nile virus
QLMNDPGAP

SEQ ID NO: 132073 - protein, 9 aa, West Nile virus
LMNDPGAPW

SEQ ID NO: 132074 - protein, 9 aa, West Nile virus
MNDPGAPWK

SEQ ID NO: 132075 - protein, 9 aa, West Nile virus
NDPGAPWKI

SEQ ID NO: 132076 - protein, 9 aa, West Nile virus
DPGAPWKIW

SEQ ID NO: 132077 - protein, 9 aa, West Nile virus
PGAPWKIWM

SEQ ID NO: 132078 - protein, 9 aa, West Nile virus
GAPWKIWML

SEQ ID NO: 132079 - protein, 9 aa, West Nile virus
APWKIWMLR

SEQ ID NO: 132080 - protein, 9 aa, West Nile virus
PWKIWMLRM

SEQ ID NO: 132081 - protein, 9 aa, West Nile virus
WMLRMVCLA

SEQ ID NO: 132082 - protein, 9 aa, West Nile virus
MVCLAISAY

SEQ ID NO: 132083 - protein, 9 aa, West Nile virus
VCLAISAYT

SEQ ID NO: 132084 - protein, 9 aa, West Nile virus
CLAISAYTP

SEQ ID NO: 132085 - protein, 9 aa, West Nile virus
LAISAYTPW

SEQ ID NO: 132086 - protein, 9 aa, West Nile virus
AISAYTPWA

SEQ ID NO: 132087 - protein, 9 aa, West Nile virus
ISAYTPWAI

SEQ ID NO: 132088 - protein, 9 aa, West Nile virus
SAYTPWAIL

SEQ ID NO: 132089 - protein, 9 aa, West Nile virus
AYTPWAILP

SEQ ID NO: 132090 - protein, 9 aa, West Nile virus
YTPWAILPS

SEQ ID NO: 132091 - protein, 9 aa, West Nile virus
TPWAILPSV

SEQ ID NO: 132092 - protein, 9 aa, West Nile virus
PWAILPSVV

SEQ ID NO: 132093 - protein, 9 aa, West Nile virus
WAILPSVVG

SEQ ID NO: 132094 - protein, 9 aa, West Nile virus
AILPSVVGF

SEQ ID NO: 132095 - protein, 9 aa, West Nile virus
ILPSVVGFW

SEQ ID NO: 132096 - protein, 9 aa, West Nile virus
LPSVVGFWI

SEQ ID NO: 132097 - protein, 9 aa, West Nile virus
PSVVGFWIT

SEQ ID NO: 132098 - protein, 9 aa, West Nile virus
SVVGFWITL

SEQ ID NO: 132099 - protein, 9 aa, West Nile virus
VVGFWITLQ

SEQ ID NO: 132100 - protein, 9 aa, West Nile virus
VGFWITLQY

SEQ ID NO: 132101 - protein, 9 aa, West Nile virus
GFWITLQYT

SEQ ID NO: 132102 - protein, 9 aa, West Nile virus
FWITLQYTK

SEQ ID NO: 132103 - protein, 9 aa, West Nile virus
WITLQYTKR

SEQ ID NO: 132104 - protein, 9 aa, West Nile virus
ITLQYTKRG

SEQ ID NO: 132105 - protein, 9 aa, West Nile virus
TLQYTKRGG

SEQ ID NO: 132106 - protein, 9 aa, West Nile virus
LQYTKRGGV

SEQ ID NO: 132107 - protein, 9 aa, West Nile virus
QYTKRGGVL

SEQ ID NO: 132108 - protein, 9 aa, West Nile virus
YTKRGGVLW

SEQ ID NO: 132109 - protein, 9 aa, West Nile virus
TKRGGVLWD

SEQ ID NO: 132110 - protein, 9 aa, West Nile virus
KRGGVLWDT

SEQ ID NO: 132111 - protein, 9 aa, West Nile virus
RGGVLWDTP

SEQ ID NO: 132112 - protein, 9 aa, West Nile virus
GGVLWDTPS

SEQ ID NO: 132113 - protein, 9 aa, West Nile virus
GVLWDTPSP

SEQ ID NO: 132114 - protein, 9 aa, West Nile virus
VLWDTPSPK

SEQ ID NO: 132115 - protein, 9 aa, West Nile virus
LWDTPSPKE

SEQ ID NO: 132116 - protein, 9 aa, West Nile virus
WDTPSPKEY

SEQ ID NO: 132117 - protein, 9 aa, West Nile virus
DTPSPKEYK

SEQ ID NO: 132118 - protein, 9 aa, West Nile virus
EYKKGDTTT

SEQ ID NO: 132119 - protein, 9 aa, West Nile virus
YKKGDTTTG

SEQ ID NO: 132120 - protein, 9 aa, West Nile virus
KKGDTTTGV

SEQ ID NO: 132121 - protein, 9 aa, West Nile virus
KGDTTTGVY

SEQ ID NO: 132122 - protein, 9 aa, West Nile virus
GDTTTGVYR

SEQ ID NO: 132123 - protein, 9 aa, West Nile virus
DTTTGVYRI

SEQ ID NO: 132124 - protein, 9 aa, West Nile virus
TTTGVYRIM

SEQ ID NO: 132125 - protein, 9 aa, West Nile virus
TTGVYRIMT

SEQ ID NO: 132126 - protein, 9 aa, West Nile virus
TGVYRIMTR

SEQ ID NO: 132127 - protein, 9 aa, West Nile virus
GVYRIMTRG

SEQ ID NO: 132128 - protein, 9 aa, West Nile virus
VYRIMTRGL

SEQ ID NO: 132129 - protein, 9 aa, West Nile virus
YRIMTRGLL

SEQ ID NO: 132130 - protein, 9 aa, West Nile virus
RIMTRGLLG

SEQ ID NO: 132131 - protein, 9 aa, West Nile virus
IMTRGLLGS

SEQ ID NO: 132132 - protein, 9 aa, West Nile virus
MTRGLLGSY

SEQ ID NO: 132133 - protein, 9 aa, West Nile virus
TRGLLGSYQ

SEQ ID NO: 132134 - protein, 9 aa, West Nile virus
RGLLGSYQA

SEQ ID NO: 132135 - protein, 9 aa, West Nile virus
GLLGSYQAG

SEQ ID NO: 132136 - protein, 9 aa, West Nile virus
LLGSYQAGA

SEQ ID NO: 132137 - protein, 9 aa, West Nile virus
LGSYQAGAG

SEQ ID NO: 132138 - protein, 9 aa, West Nile virus
GSYQAGAGV

SEQ ID NO: 132139 - protein, 9 aa, West Nile virus
SYQAGAGVM

SEQ ID NO: 132140 - protein, 9 aa, West Nile virus
YQAGAGVMV

SEQ ID NO: 132141 - protein, 9 aa, West Nile virus
QAGAGVMVE

SEQ ID NO: 132142 - protein, 9 aa, West Nile virus
AGAGVMVEG

SEQ ID NO: 132143 - protein, 9 aa, West Nile virus
GAGVMVEGV

SEQ ID NO: 132144 - protein, 9 aa, West Nile virus
AGVMVEGVF

SEQ ID NO: 132145 - protein, 9 aa, West Nile virus
GVMVEGVFH

SEQ ID NO: 132146 - protein, 9 aa, West Nile virus
VMVEGVFHT

SEQ ID NO: 132147 - protein, 9 aa, West Nile virus
MVEGVFHTL

SEQ ID NO: 132148 - protein, 9 aa, West Nile virus
VEGVFHTLW

SEQ ID NO: 132149 - protein, 9 aa, West Nile virus
EGVFHTLWH

SEQ ID NO: 132150 - protein, 9 aa, West Nile virus
GVFHTLWHT

SEQ ID NO: 132151 - protein, 9 aa, West Nile virus
VFHTLWHTT

SEQ ID NO: 132152 - protein, 9 aa, West Nile virus
FHTLWHTTK

SEQ ID NO: 132153 - protein, 9 aa, West Nile virus
HTLWHTTKG

SEQ ID NO: 132154 - protein, 9 aa, West Nile virus
TLWHTTKGA

SEQ ID NO: 132155 - protein, 9 aa, West Nile virus
LWHTTKGAA

SEQ ID NO: 132156 - protein, 9 aa, West Nile virus
WHTTKGAAL

SEQ ID NO: 132157 - protein, 9 aa, West Nile virus
HTTKGAALM

SEQ ID NO: 132158 - protein, 9 aa, West Nile virus
TTKGAALMS

SEQ ID NO: 132159 - protein, 9 aa, West Nile virus
TKGAALMSG

SEQ ID NO: 132160 - protein, 9 aa, West Nile virus
KGAALMSGE

SEQ ID NO: 132161 - protein, 9 aa, West Nile virus
GAALMSGEG

SEQ ID NO: 132162 - protein, 9 aa, West Nile virus
AALMSGEGR

SEQ ID NO: 132163 - protein, 9 aa, West Nile virus
ALMSGEGRL

SEQ ID NO: 132164 - protein, 9 aa, West Nile virus
LMSGEGRLD

SEQ ID NO: 132165 - protein, 9 aa, West Nile virus
MSGEGRLDP

SEQ ID NO: 132166 - protein, 9 aa, West Nile virus
SGEGRLDPY

SEQ ID NO: 132167 - protein, 9 aa, West Nile virus
GEGRLDPYW

SEQ ID NO: 132168 - protein, 9 aa, West Nile virus
EGRLDPYWG

SEQ ID NO: 132169 - protein, 9 aa, West Nile virus
GRLDPYWGS

SEQ ID NO: 132170 - protein, 9 aa, West Nile virus
RLDPYWGSV

SEQ ID NO: 132171 - protein, 9 aa, West Nile virus
LDPYWGSVK

SEQ ID NO: 132172 - protein, 9 aa, West Nile virus
DPYWGSVKE

SEQ ID NO: 132173 - protein, 9 aa, West Nile virus
PYWGSVKED

SEQ ID NO: 132174 - protein, 9 aa, West Nile virus
YWGSVKEDR

SEQ ID NO: 132175 - protein, 9 aa, West Nile virus
WGSVKEDRL

SEQ ID NO: 132176 - protein, 9 aa, West Nile virus
GSVKEDRLC

SEQ ID NO: 132177 - protein, 9 aa, West Nile virus
SVKEDRLCY

SEQ ID NO: 132178 - protein, 9 aa, West Nile virus
VKEDRLCYG

SEQ ID NO: 132179 - protein, 9 aa, West Nile virus
KEDRLCYGG

SEQ ID NO: 132180 - protein, 9 aa, West Nile virus
EDRLCYGGP

SEQ ID NO: 132181 - protein, 9 aa, West Nile virus
DRLCYGGPW

SEQ ID NO: 132182 - protein, 9 aa, West Nile virus
RLCYGGPWK

SEQ ID NO: 132183 - protein, 9 aa, West Nile virus
LCYGGPWKL

SEQ ID NO: 132184 - protein, 9 aa, West Nile virus
CYGGPWKLQ

SEQ ID NO: 132185 - protein, 9 aa, West Nile virus
YGGPWKLQH

SEQ ID NO: 132186 - protein, 9 aa, West Nile virus
GGPWKLQHK

SEQ ID NO: 132187 - protein, 9 aa, West Nile virus
GPWKLQHKW

SEQ ID NO: 132188 - protein, 9 aa, West Nile virus
PWKLQHKWN

SEQ ID NO: 132189 - protein, 9 aa, West Nile virus
WKLQHKWNG

SEQ ID NO: 132190 - protein, 9 aa, West Nile virus
KLQHKWNGQ

SEQ ID NO: 132191 - protein, 9 aa, West Nile virus
LQHKWNGQD

SEQ ID NO: 132192 - protein, 9 aa, West Nile virus
QHKWNGQDE

SEQ ID NO: 132193 - protein, 9 aa, West Nile virus
HKWNGQDEV

SEQ ID NO: 132194 - protein, 9 aa, West Nile virus
KWNGQDEVQ

SEQ ID NO: 132195 - protein, 9 aa, West Nile virus
WNGQDEVQM

SEQ ID NO: 132196 - protein, 9 aa, West Nile virus
NGQDEVQMI

SEQ ID NO: 132197 - protein, 9 aa, West Nile virus
GQDEVQMIV

SEQ ID NO: 132198 - protein, 9 aa, West Nile virus
QDEVQMIVV

SEQ ID NO: 132199 - protein, 9 aa, West Nile virus
DEVQMIVVE

SEQ ID NO: 132200 - protein, 9 aa, West Nile virus
EVQMIVVEP

SEQ ID NO: 132201 - protein, 9 aa, West Nile virus
VQMIVVEPG

SEQ ID NO: 132202 - protein, 9 aa, West Nile virus
QMIVVEPGK

SEQ ID NO: 132203 - protein, 9 aa, West Nile virus
MIVVEPGKN

SEQ ID NO: 132204 - protein, 9 aa, West Nile virus
IVVEPGKNV

SEQ ID NO: 132205 - protein, 9 aa, West Nile virus
VVEPGKNVK

SEQ ID NO: 132206 - protein, 9 aa, West Nile virus
VEPGKNVKN

SEQ ID NO: 132207 - protein, 9 aa, West Nile virus
EPGKNVKNV

SEQ ID NO: 132208 - protein, 9 aa, West Nile virus
PGKNVKNVQ

SEQ ID NO: 132209 - protein, 9 aa, West Nile virus
GKNVKNVQT

SEQ ID NO: 132210 - protein, 9 aa, West Nile virus
KNVKNVQTK

SEQ ID NO: 132211 - protein, 9 aa, West Nile virus
NVKNVQTKP

SEQ ID NO: 132212 - protein, 9 aa, West Nile virus
VKNVQTKPG

SEQ ID NO: 132213 - protein, 9 aa, West Nile virus
KNVQTKPGV

SEQ ID NO: 132214 - protein, 9 aa, West Nile virus
NVQTKPGVF

SEQ ID NO: 132215 - protein, 9 aa, West Nile virus
VQTKPGVFK

SEQ ID NO: 132216 - protein, 9 aa, West Nile virus
QTKPGVFKT

SEQ ID NO: 132217 - protein, 9 aa, West Nile virus
TKPGVFKTP

SEQ ID NO: 132218 - protein, 9 aa, West Nile virus
KPGVFKTPE

SEQ ID NO: 132219 - protein, 9 aa, West Nile virus
PGVFKTPEG

SEQ ID NO: 132220 - protein, 9 aa, West Nile virus
GVFKTPEGE

SEQ ID NO: 132221 - protein, 9 aa, West Nile virus
VFKTPEGEI

SEQ ID NO: 132222 - protein, 9 aa, West Nile virus
FKTPEGEIG

SEQ ID NO: 132223 - protein, 9 aa, West Nile virus
KTPEGEIGA

SEQ ID NO: 132224 - protein, 9 aa, West Nile virus
TPEGEIGAV

SEQ ID NO: 132225 - protein, 9 aa, West Nile virus
PEGEIGAVT

SEQ ID NO: 132226 - protein, 9 aa, West Nile virus
EGEIGAVTL

SEQ ID NO: 132227 - protein, 9 aa, West Nile virus
GEIGAVTLD

SEQ ID NO: 132228 - protein, 9 aa, West Nile virus
EIGAVTLDF

SEQ ID NO: 132229 - protein, 9 aa, West Nile virus
IGAVTLDFP

SEQ ID NO: 132230 - protein, 9 aa, West Nile virus
GAVTLDFPT

SEQ ID NO: 132231 - protein, 9 aa, West Nile virus
AVTLDFPTG

SEQ ID NO: 132232 - protein, 9 aa, West Nile virus
VTLDFPTGT

SEQ ID NO: 132233 - protein, 9 aa, West Nile virus
TLDFPTGTS

SEQ ID NO: 132234 - protein, 9 aa, West Nile virus
LDFPTGTSG

SEQ ID NO: 132235 - protein, 9 aa, West Nile virus
DFPTGTSGS

SEQ ID NO: 132236 - protein, 9 aa, West Nile virus
FPTGTSGSP

SEQ ID NO: 132237 - protein, 9 aa, West Nile virus
PTGTSGSPI

SEQ ID NO: 132238 - protein, 9 aa, West Nile virus
TGTSGSPIV

SEQ ID NO: 132239 - protein, 9 aa, West Nile virus
GTSGSPIVD

SEQ ID NO: 132240 - protein, 9 aa, West Nile virus
TSGSPIVDK

SEQ ID NO: 132241 - protein, 9 aa, West Nile virus
SGSPIVDKN

SEQ ID NO: 132242 - protein, 9 aa, West Nile virus
GSPIVDKNG

SEQ ID NO: 132243 - protein, 9 aa, West Nile virus
SPIVDKNGD

SEQ ID NO: 132244 - protein, 9 aa, West Nile virus
PIVDKNGDV

SEQ ID NO: 132245 - protein, 9 aa, West Nile virus
IVDKNGDVI

SEQ ID NO: 132246 - protein, 9 aa, West Nile virus
VDKNGDVIG

SEQ ID NO: 132247 - protein, 9 aa, West Nile virus
DKNGDVIGL

SEQ ID NO: 132248 - protein, 9 aa, West Nile virus
KNGDVIGLY

SEQ ID NO: 132249 - protein, 9 aa, West Nile virus
NGDVIGLYG

SEQ ID NO: 132250 - protein, 9 aa, West Nile virus
GDVIGLYGN

SEQ ID NO: 132251 - protein, 9 aa, West Nile virus
DVIGLYGNG

SEQ ID NO: 132252 - protein, 9 aa, West Nile virus
VIGLYGNGV

SEQ ID NO: 132253 - protein, 9 aa, West Nile virus
IGLYGNGVI

SEQ ID NO: 132254 - protein, 9 aa, West Nile virus
GLYGNGVIM

SEQ ID NO: 132255 - protein, 9 aa, West Nile virus
LYGNGVIMP

SEQ ID NO: 132256 - protein, 9 aa, West Nile virus
YGNGVIMPN

SEQ ID NO: 132257 - protein, 9 aa, West Nile virus
GNGVIMPNG

SEQ ID NO: 132258 - protein, 9 aa, West Nile virus
NGVIMPNGS

SEQ ID NO: 132259 - protein, 9 aa, West Nile virus
GVIMPNGSY

SEQ ID NO: 132260 - protein, 9 aa, West Nile virus
VIMPNGSYI

SEQ ID NO: 132261 - protein, 9 aa, West Nile virus
IMPNGSYIS

SEQ ID NO: 132262 - protein, 9 aa, West Nile virus
MPNGSYISA

SEQ ID NO: 132263 - protein, 9 aa, West Nile virus
PNGSYISAI

SEQ ID NO: 132264 - protein, 9 aa, West Nile virus
NGSYISAIV

SEQ ID NO: 132265 - protein, 9 aa, West Nile virus
GSYISAIVQ

SEQ ID NO: 132266 - protein, 9 aa, West Nile virus
SYISAIVQG

SEQ ID NO: 132267 - protein, 9 aa, West Nile virus
YISAIVQGE

SEQ ID NO: 132268 - protein, 9 aa, West Nile virus
ISAIVQGER

SEQ ID NO: 132269 - protein, 9 aa, West Nile virus
SAIVQGERM

SEQ ID NO: 132270 - protein, 9 aa, West Nile virus
AIVQGERMD

SEQ ID NO: 132271 - protein, 9 aa, West Nile virus
IVQGERMDE

SEQ ID NO: 132272 - protein, 9 aa, West Nile virus
VQGERMDEP

SEQ ID NO: 132273 - protein, 9 aa, West Nile virus
QGERMDEPI

SEQ ID NO: 132274 - protein, 9 aa, West Nile virus
GERMDEPIP

SEQ ID NO: 132275 - protein, 9 aa, West Nile virus
ERMDEPIPA

SEQ ID NO: 132276 - protein, 9 aa, West Nile virus
RMDEPIPAG

SEQ ID NO: 132277 - protein, 9 aa, West Nile virus
MDEPIPAGF

SEQ ID NO: 132278 - protein, 9 aa, West Nile virus
GFEPEMLRK

SEQ ID NO: 132279 - protein, 9 aa, West Nile virus
FEPEMLRKK

SEQ ID NO: 132280 - protein, 9 aa, West Nile virus
EPEMLRKKQ

SEQ ID NO: 132281 - protein, 9 aa, West Nile virus
PEMLRKKQI

SEQ ID NO: 132282 - protein, 9 aa, West Nile virus
EMLRKKQIT

SEQ ID NO: 132283 - protein, 9 aa, West Nile virus
MLRKKQITV

SEQ ID NO: 132284 - protein, 9 aa, West Nile virus
LRKKQITVL

SEQ ID NO: 132285 - protein, 9 aa, West Nile virus
RKKQITVLD

SEQ ID NO: 132286 - protein, 9 aa, West Nile virus
KKQITVLDL

SEQ ID NO: 132287 - protein, 9 aa, West Nile virus
KQITVLDLH

SEQ ID NO: 132288 - protein, 9 aa, West Nile virus
QITVLDLHP

SEQ ID NO: 132289 - protein, 9 aa, West Nile virus
ITVLDLHPG

SEQ ID NO: 132290 - protein, 9 aa, West Nile virus
TVLDLHPGA

SEQ ID NO: 132291 - protein, 9 aa, West Nile virus
VLDLHPGAG

SEQ ID NO: 132292 - protein, 9 aa, West Nile virus
LDLHPGAGK

SEQ ID NO: 132293 - protein, 9 aa, West Nile virus
DLHPGAGKT

SEQ ID NO: 132294 - protein, 9 aa, West Nile virus
LHPGAGKTR

SEQ ID NO: 132295 - protein, 9 aa, West Nile virus
HPGAGKTRR

SEQ ID NO: 132296 - protein, 9 aa, West Nile virus
PGAGKTRRI

SEQ ID NO: 132297 - protein, 9 aa, West Nile virus
GAGKTRRIL

SEQ ID NO: 132298 - protein, 9 aa, West Nile virus
AGKTRRILP

SEQ ID NO: 132299 - protein, 9 aa, West Nile virus
GKTRRILPQ

SEQ ID NO: 132300 - protein, 9 aa, West Nile virus
KTRRILPQI

SEQ ID NO: 132301 - protein, 9 aa, West Nile virus
TRRILPQII

SEQ ID NO: 132302 - protein, 9 aa, West Nile virus
RRILPQIIK

SEQ ID NO: 132303 - protein, 9 aa, West Nile virus
RILPQIIKE

SEQ ID NO: 132304 - protein, 9 aa, West Nile virus
ILPQIIKEA

SEQ ID NO: 132305 - protein, 9 aa, West Nile virus
LPQIIKEAI

SEQ ID NO: 132306 - protein, 9 aa, West Nile virus
PQIIKEAIN

SEQ ID NO: 132307 - protein, 9 aa, West Nile virus
QIIKEAINR

SEQ ID NO: 132308 - protein, 9 aa, West Nile virus
IIKEAINRR

SEQ ID NO: 132309 - protein, 9 aa, West Nile virus
IKEAINRRL

SEQ ID NO: 132310 - protein, 9 aa, West Nile virus
KEAINRRLR

SEQ ID NO: 132311 - protein, 9 aa, West Nile virus
EAINRRLRT

SEQ ID NO: 132312 - protein, 9 aa, West Nile virus
AINRRLRTA

SEQ ID NO: 132313 - protein, 9 aa, West Nile virus
NRRLRTAVL

SEQ ID NO: 132314 - protein, 9 aa, West Nile virus
RRLRTAVLA

SEQ ID NO: 132315 - protein, 9 aa, West Nile virus
RLRTAVLAP

SEQ ID NO: 132316 - protein, 9 aa, West Nile virus
LRTAVLAPT

SEQ ID NO: 132317 - protein, 9 aa, West Nile virus
RTAVLAPTR

SEQ ID NO: 132318 - protein, 9 aa, West Nile virus
TAVLAPTRV

SEQ ID NO: 132319 - protein, 9 aa, West Nile virus
AVLAPTRVV

SEQ ID NO: 132320 - protein, 9 aa, West Nile virus
VLAPTRVVA

SEQ ID NO: 132321 - protein, 9 aa, West Nile virus
LAPTRVVAA

SEQ ID NO: 132322 - protein, 9 aa, West Nile virus
APTRVVAAE

SEQ ID NO: 132323 - protein, 9 aa, West Nile virus
PTRVVAAEM

SEQ ID NO: 132324 - protein, 9 aa, West Nile virus
TRVVAAEMA

SEQ ID NO: 132325 - protein, 9 aa, West Nile virus
RVVAAEMAE

SEQ ID NO: 132326 - protein, 9 aa, West Nile virus
VVAAEMAEA

SEQ ID NO: 132327 - protein, 9 aa, West Nile virus
VAAEMAEAL

SEQ ID NO: 132328 - protein, 9 aa, West Nile virus
AAEMAEALR

SEQ ID NO: 132329 - protein, 9 aa, West Nile virus
AEMAEALRG

SEQ ID NO: 132330 - protein, 9 aa, West Nile virus
EMAEALRGL

SEQ ID NO: 132331 - protein, 9 aa, West Nile virus
MAEALRGLP

SEQ ID NO: 132332 - protein, 9 aa, West Nile virus
AEALRGLPI

SEQ ID NO: 132333 - protein, 9 aa, West Nile virus
EALRGLPIR

SEQ ID NO: 132334 - protein, 9 aa, West Nile virus
ALRGLPIRY

SEQ ID NO: 132335 - protein, 9 aa, West Nile virus
LRGLPIRYQ

SEQ ID NO: 132336 - protein, 9 aa, West Nile virus
RGLPIRYQT

SEQ ID NO: 132337 - protein, 9 aa, West Nile virus
GLPIRYQTS

SEQ ID NO: 132338 - protein, 9 aa, West Nile virus
LPIRYQTSA

SEQ ID NO: 132339 - protein, 9 aa, West Nile virus
PIRYQTSAV

SEQ ID NO: 132340 - protein, 9 aa, West Nile virus
IRYQTSAVP

SEQ ID NO: 132341 - protein, 9 aa, West Nile virus
RYQTSAVPR

SEQ ID NO: 132342 - protein, 9 aa, West Nile virus
YQTSAVPRE

SEQ ID NO: 132343 - protein, 9 aa, West Nile virus
QTSAVPREH

SEQ ID NO: 132344 - protein, 9 aa, West Nile virus
REHNGNEIV

SEQ ID NO: 132345 - protein, 9 aa, West Nile virus
EHNGNEIVD

SEQ ID NO: 132346 - protein, 9 aa, West Nile virus
HNGNEIVDV

SEQ ID NO: 132347 - protein, 9 aa, West Nile virus
NGNEIVDVM

SEQ ID NO: 132348 - protein, 9 aa, West Nile virus
GNEIVDVMC

SEQ ID NO: 132349 - protein, 9 aa, West Nile virus
NEIVDVMCH

SEQ ID NO: 132350 - protein, 9 aa, West Nile virus
EIVDVMCHA

SEQ ID NO: 132351 - protein, 9 aa, West Nile virus
IVDVMCHAT

SEQ ID NO: 132352 - protein, 9 aa, West Nile virus
VDVMCHATL

SEQ ID NO: 132353 - protein, 9 aa, West Nile virus
DVMCHATLT

SEQ ID NO: 132354 - protein, 9 aa, West Nile virus
VMCHATLTH

SEQ ID NO: 132355 - protein, 9 aa, West Nile virus
MCHATLTHR

SEQ ID NO: 132356 - protein, 9 aa, West Nile virus
CHATLTHRL

SEQ ID NO: 132357 - protein, 9 aa, West Nile virus
HATLTHRLM

SEQ ID NO: 132358 - protein, 9 aa, West Nile virus
ATLTHRLMS

SEQ ID NO: 132359 - protein, 9 aa, West Nile virus
TLTHRLMSP

SEQ ID NO: 132360 - protein, 9 aa, West Nile virus
LTHRLMSPH

SEQ ID NO: 132361 - protein, 9 aa, West Nile virus
THRLMSPHR

SEQ ID NO: 132362 - protein, 9 aa, West Nile virus
HRLMSPHRV

SEQ ID NO: 132363 - protein, 9 aa, West Nile virus
RLMSPHRVP

SEQ ID NO: 132364 - protein, 9 aa, West Nile virus
LMSPHRVPN

SEQ ID NO: 132365 - protein, 9 aa, West Nile virus
MSPHRVPNY

SEQ ID NO: 132366 - protein, 9 aa, West Nile virus
SPHRVPNYN

SEQ ID NO: 132367 - protein, 9 aa, West Nile virus
PHRVPNYNL

SEQ ID NO: 132368 - protein, 9 aa, West Nile virus
HRVPNYNLF

SEQ ID NO: 132369 - protein, 9 aa, West Nile virus
RVPNYNLFV

SEQ ID NO: 132370 - protein, 9 aa, West Nile virus
VPNYNLFVM

SEQ ID NO: 132371 - protein, 9 aa, West Nile virus
PNYNLFVMD

SEQ ID NO: 132372 - protein, 9 aa, West Nile virus
NYNLFVMDE

SEQ ID NO: 132373 - protein, 9 aa, West Nile virus
YNLFVMDEA

SEQ ID NO: 132374 - protein, 9 aa, West Nile virus
NLFVMDEAH

SEQ ID NO: 132375 - protein, 9 aa, West Nile virus
LFVMDEAHF

SEQ ID NO: 132376 - protein, 9 aa, West Nile virus
FVMDEAHFT

SEQ ID NO: 132377 - protein, 9 aa, West Nile virus
VMDEAHFTD

SEQ ID NO: 132378 - protein, 9 aa, West Nile virus
MDEAHFTDP

SEQ ID NO: 132379 - protein, 9 aa, West Nile virus
DEAHFTDPA

SEQ ID NO: 132380 - protein, 9 aa, West Nile virus
EAHFTDPAS

SEQ ID NO: 132381 - protein, 9 aa, West Nile virus
AHFTDPASI

SEQ ID NO: 132382 - protein, 9 aa, West Nile virus
HFTDPASIA

SEQ ID NO: 132383 - protein, 9 aa, West Nile virus
FTDPASIAA

SEQ ID NO: 132384 - protein, 9 aa, West Nile virus
TDPASIAAR

SEQ ID NO: 132385 - protein, 9 aa, West Nile virus
DPASIAARG

SEQ ID NO: 132386 - protein, 9 aa, West Nile virus
PASIAARGY

SEQ ID NO: 132387 - protein, 9 aa, West Nile virus
ASIAARGYI

SEQ ID NO: 132388 - protein, 9 aa, West Nile virus
SIAARGYIS

SEQ ID NO: 132389 - protein, 9 aa, West Nile virus
IAARGYIST

SEQ ID NO: 132390 - protein, 9 aa, West Nile virus
AARGYISTK

SEQ ID NO: 132391 - protein, 9 aa, West Nile virus
ARGYISTKV

SEQ ID NO: 132392 - protein, 9 aa, West Nile virus
RGYISTKVE

SEQ ID NO: 132393 - protein, 9 aa, West Nile virus
GYISTKVEL

SEQ ID NO: 132394 - protein, 9 aa, West Nile virus
YISTKVELG

SEQ ID NO: 132395 - protein, 9 aa, West Nile virus
ISTKVELGE

SEQ ID NO: 132396 - protein, 9 aa, West Nile virus
STKVELGEA

SEQ ID NO: 132397 - protein, 9 aa, West Nile virus
TKVELGEAA

SEQ ID NO: 132398 - protein, 9 aa, West Nile virus
KVELGEAAA

SEQ ID NO: 132399 - protein, 9 aa, West Nile virus
VELGEAAAI

SEQ ID NO: 132400 - protein, 9 aa, West Nile virus
ELGEAAAIF

SEQ ID NO: 132401 - protein, 9 aa, West Nile virus
LGEAAAIFM

SEQ ID NO: 132402 - protein, 9 aa, West Nile virus
GEAAAIFMT

SEQ ID NO: 132403 - protein, 9 aa, West Nile virus
EAAAIFMTA

SEQ ID NO: 132404 - protein, 9 aa, West Nile virus
AAAIFMTAT

SEQ ID NO: 132405 - protein, 9 aa, West Nile virus
AAIFMTATP

SEQ ID NO: 132406 - protein, 9 aa, West Nile virus
AIFMTATPP

SEQ ID NO: 132407 - protein, 9 aa, West Nile virus
IFMTATPPG

SEQ ID NO: 132408 - protein, 9 aa, West Nile virus
FMTATPPGT

SEQ ID NO: 132409 - protein, 9 aa, West Nile virus
MTATPPGTS

SEQ ID NO: 132410 - protein, 9 aa, West Nile virus
TATPPGTSD

SEQ ID NO: 132411 - protein, 9 aa, West Nile virus
ATPPGTSDP

SEQ ID NO: 132412 - protein, 9 aa, West Nile virus
TPPGTSDPF

SEQ ID NO: 132413 - protein, 9 aa, West Nile virus
PPGTSDPFP

SEQ ID NO: 132414 - protein, 9 aa, West Nile virus
PGTSDPFPE

SEQ ID NO: 132415 - protein, 9 aa, West Nile virus
GTSDPFPES

SEQ ID NO: 132416 - protein, 9 aa, West Nile virus
TSDPFPESN

SEQ ID NO: 132417 - protein, 9 aa, West Nile virus
SDPFPESNS

SEQ ID NO: 132418 - protein, 9 aa, West Nile virus
DPFPESNSP

SEQ ID NO: 132419 - protein, 9 aa, West Nile virus
PFPESNSPI

SEQ ID NO: 132420 - protein, 9 aa, West Nile virus
DLQTEIPDR

SEQ ID NO: 132421 - protein, 9 aa, West Nile virus
LQTEIPDRA

SEQ ID NO: 132422 - protein, 9 aa, West Nile virus
QTEIPDRAW

SEQ ID NO: 132423 - protein, 9 aa, West Nile virus
TEIPDRAWN

SEQ ID NO: 132424 - protein, 9 aa, West Nile virus
EIPDRAWNS

SEQ ID NO: 132425 - protein, 9 aa, West Nile virus
IPDRAWNSG

SEQ ID NO: 132426 - protein, 9 aa, West Nile virus
PDRAWNSGY

SEQ ID NO: 132427 - protein, 9 aa, West Nile virus
DRAWNSGYE

SEQ ID NO: 132428 - protein, 9 aa, West Nile virus
RAWNSGYEW

SEQ ID NO: 132429 - protein, 9 aa, West Nile virus
AWNSGYEWI

SEQ ID NO: 132430 - protein, 9 aa, West Nile virus
WNSGYEWIT

SEQ ID NO: 132431 - protein, 9 aa, West Nile virus
NSGYEWITE

SEQ ID NO: 132432 - protein, 9 aa, West Nile virus
SGYEWITEY

SEQ ID NO: 132433 - protein, 9 aa, West Nile virus
GYEWITEYT

SEQ ID NO: 132434 - protein, 9 aa, West Nile virus
YEWITEYTG

SEQ ID NO: 132435 - protein, 9 aa, West Nile virus
EWITEYTGK

SEQ ID NO: 132436 - protein, 9 aa, West Nile virus
WITEYTGKT

SEQ ID NO: 132437 - protein, 9 aa, West Nile virus
ITEYTGKTV

SEQ ID NO: 132438 - protein, 9 aa, West Nile virus
TEYTGKTVW

SEQ ID NO: 132439 - protein, 9 aa, West Nile virus
EYTGKTVWF

SEQ ID NO: 132440 - protein, 9 aa, West Nile virus
YTGKTVWFV

SEQ ID NO: 132441 - protein, 9 aa, West Nile virus
TGKTVWFVP

SEQ ID NO: 132442 - protein, 9 aa, West Nile virus
GKTVWFVPS

SEQ ID NO: 132443 - protein, 9 aa, West Nile virus
KTVWFVPSV

SEQ ID NO: 132444 - protein, 9 aa, West Nile virus
TVWFVPSVK

SEQ ID NO: 132445 - protein, 9 aa, West Nile virus
VWFVPSVKM

SEQ ID NO: 132446 - protein, 9 aa, West Nile virus
WFVPSVKMG

SEQ ID NO: 132447 - protein, 9 aa, West Nile virus
FVPSVKMGN

SEQ ID NO: 132448 - protein, 9 aa, West Nile virus
VPSVKMGNE

SEQ ID NO: 132449 - protein, 9 aa, West Nile virus
PSVKMGNEI

SEQ ID NO: 132450 - protein, 9 aa, West Nile virus
SVKMGNEIA

SEQ ID NO: 132451 - protein, 9 aa, West Nile virus
VKMGNEIAL

SEQ ID NO: 132452 - protein, 9 aa, West Nile virus
KMGNEIALC

SEQ ID NO: 132453 - protein, 9 aa, West Nile virus
MGNEIALCL

SEQ ID NO: 132454 - protein, 9 aa, West Nile virus
GNEIALCLQ

SEQ ID NO: 132455 - protein, 9 aa, West Nile virus
NEIALCLQR

SEQ ID NO: 132456 - protein, 9 aa, West Nile virus
EIALCLQRA

SEQ ID NO: 132457 - protein, 9 aa, West Nile virus
IALCLQRAG

SEQ ID NO: 132458 - protein, 9 aa, West Nile virus
ALCLQRAGK

SEQ ID NO: 132459 - protein, 9 aa, West Nile virus
LCLQRAGKK

SEQ ID NO: 132460 - protein, 9 aa, West Nile virus
CLQRAGKKV

SEQ ID NO: 132461 - protein, 9 aa, West Nile virus
LQRAGKKVV

SEQ ID NO: 132462 - protein, 9 aa, West Nile virus
QRAGKKVVQ

SEQ ID NO: 132463 - protein, 9 aa, West Nile virus
RAGKKVVQL

SEQ ID NO: 132464 - protein, 9 aa, West Nile virus
AGKKVVQLN

SEQ ID NO: 132465 - protein, 9 aa, West Nile virus
GKKVVQLNR

SEQ ID NO: 132466 - protein, 9 aa, West Nile virus
KKVVQLNRK

SEQ ID NO: 132467 - protein, 9 aa, West Nile virus
KVVQLNRKS

SEQ ID NO: 132468 - protein, 9 aa, West Nile virus
VVQLNRKSY

SEQ ID NO: 132469 - protein, 9 aa, West Nile virus
VQLNRKSYE

SEQ ID NO: 132470 - protein, 9 aa, West Nile virus
QLNRKSYET

SEQ ID NO: 132471 - protein, 9 aa, West Nile virus
LNRKSYETE

SEQ ID NO: 132472 - protein, 9 aa, West Nile virus
NRKSYETEY

SEQ ID NO: 132473 - protein, 9 aa, West Nile virus
RKSYETEYP

SEQ ID NO: 132474 - protein, 9 aa, West Nile virus
KSYETEYPK

SEQ ID NO: 132475 - protein, 9 aa, West Nile virus
SYETEYPKC

SEQ ID NO: 132476 - protein, 9 aa, West Nile virus
YETEYPKCK

SEQ ID NO: 132477 - protein, 9 aa, West Nile virus
ETEYPKCKN

SEQ ID NO: 132478 - protein, 9 aa, West Nile virus
TEYPKCKND

SEQ ID NO: 132479 - protein, 9 aa, West Nile virus
EYPKCKNDD

SEQ ID NO: 132480 - protein, 9 aa, West Nile virus
YPKCKNDDW

SEQ ID NO: 132481 - protein, 9 aa, West Nile virus
PKCKNDDWD

SEQ ID NO: 132482 - protein, 9 aa, West Nile virus
KCKNDDWDF

SEQ ID NO: 132483 - protein, 9 aa, West Nile virus
CKNDDWDFV

SEQ ID NO: 132484 - protein, 9 aa, West Nile virus
KNDDWDFVI

SEQ ID NO: 132485 - protein, 9 aa, West Nile virus
NDDWDFVIT

SEQ ID NO: 132486 - protein, 9 aa, West Nile virus
DDWDFVITT

SEQ ID NO: 132487 - protein, 9 aa, West Nile virus
DWDFVITTD

SEQ ID NO: 132488 - protein, 9 aa, West Nile virus
WDFVITTDI

SEQ ID NO: 132489 - protein, 9 aa, West Nile virus
DFVITTDIS

SEQ ID NO: 132490 - protein, 9 aa, West Nile virus
FVITTDISE

SEQ ID NO: 132491 - protein, 9 aa, West Nile virus
VITTDISEM

SEQ ID NO: 132492 - protein, 9 aa, West Nile virus
ITTDISEMG

SEQ ID NO: 132493 - protein, 9 aa, West Nile virus
TTDISEMGA

SEQ ID NO: 132494 - protein, 9 aa, West Nile virus
TDISEMGAN

SEQ ID NO: 132495 - protein, 9 aa, West Nile virus
DISEMGANF

SEQ ID NO: 132496 - protein, 9 aa, West Nile virus
ISEMGANFK

SEQ ID NO: 132497 - protein, 9 aa, West Nile virus
SEMGANFKA

SEQ ID NO: 132498 - protein, 9 aa, West Nile virus
EMGANFKAS

SEQ ID NO: 132499 - protein, 9 aa, West Nile virus
MGANFKASR

SEQ ID NO: 132500 - protein, 9 aa, West Nile virus
GANFKASRV

SEQ ID NO: 132501 - protein, 9 aa, West Nile virus
ANFKASRVI

SEQ ID NO: 132502 - protein, 9 aa, West Nile virus
NFKASRVID

SEQ ID NO: 132503 - protein, 9 aa, West Nile virus
FKASRVIDS

SEQ ID NO: 132504 - protein, 9 aa, West Nile virus
KASRVIDSR

SEQ ID NO: 132505 - protein, 9 aa, West Nile virus
ASRVIDSRK

SEQ ID NO: 132506 - protein, 9 aa, West Nile virus
SRVIDSRKS

SEQ ID NO: 132507 - protein, 9 aa, West Nile virus
RVIDSRKSV

SEQ ID NO: 132508 - protein, 9 aa, West Nile virus
VIDSRKSVK

SEQ ID NO: 132509 - protein, 9 aa, West Nile virus
IDSRKSVKP

SEQ ID NO: 132510 - protein, 9 aa, West Nile virus
DSRKSVKPT

SEQ ID NO: 132511 - protein, 9 aa, West Nile virus
SRKSVKPTI

SEQ ID NO: 132512 - protein, 9 aa, West Nile virus
RKSVKPTII

SEQ ID NO: 132513 - protein, 9 aa, West Nile virus
KSVKPTIIT

SEQ ID NO: 132514 - protein, 9 aa, West Nile virus
SVKPTIITE

SEQ ID NO: 132515 - protein, 9 aa, West Nile virus
VKPTIITEG

SEQ ID NO: 132516 - protein, 9 aa, West Nile virus
KPTIITEGE

SEQ ID NO: 132517 - protein, 9 aa, West Nile virus
ITEGEGRVI

SEQ ID NO: 132518 - protein, 9 aa, West Nile virus
TEGEGRVIL

SEQ ID NO: 132519 - protein, 9 aa, West Nile virus
EGEGRVILG

SEQ ID NO: 132520 - protein, 9 aa, West Nile virus
GEGRVILGE

SEQ ID NO: 132521 - protein, 9 aa, West Nile virus
EGRVILGEP

SEQ ID NO: 132522 - protein, 9 aa, West Nile virus
GRVILGEPS

SEQ ID NO: 132523 - protein, 9 aa, West Nile virus
RVILGEPSA

SEQ ID NO: 132524 - protein, 9 aa, West Nile virus
VILGEPSAV

SEQ ID NO: 132525 - protein, 9 aa, West Nile virus
ILGEPSAVT

SEQ ID NO: 132526 - protein, 9 aa, West Nile virus
LGEPSAVTA

SEQ ID NO: 132527 - protein, 9 aa, West Nile virus
GEPSAVTAA

SEQ ID NO: 132528 - protein, 9 aa, West Nile virus
EPSAVTAAS

SEQ ID NO: 132529 - protein, 9 aa, West Nile virus
PSAVTAASA

SEQ ID NO: 132530 - protein, 9 aa, West Nile virus
SAVTAASAA

SEQ ID NO: 132531 - protein, 9 aa, West Nile virus
AVTAASAAQ

SEQ ID NO: 132532 - protein, 9 aa, West Nile virus
VTAASAAQR

SEQ ID NO: 132533 - protein, 9 aa, West Nile virus
TAASAAQRR

SEQ ID NO: 132534 - protein, 9 aa, West Nile virus
AASAAQRRG

SEQ ID NO: 132535 - protein, 9 aa, West Nile virus
ASAAQRRGR

SEQ ID NO: 132536 - protein, 9 aa, West Nile virus
SAAQRRGRI

SEQ ID NO: 132537 - protein, 9 aa, West Nile virus
AAQRRGRIG

SEQ ID NO: 132538 - protein, 9 aa, West Nile virus
AQRRGRIGR

SEQ ID NO: 132539 - protein, 9 aa, West Nile virus
QRRGRIGRN

SEQ ID NO: 132540 - protein, 9 aa, West Nile virus
RRGRIGRNP

SEQ ID NO: 132541 - protein, 9 aa, West Nile virus
RGRIGRNPS

SEQ ID NO: 132542 - protein, 9 aa, West Nile virus
GRIGRNPSQ

SEQ ID NO: 132543 - protein, 9 aa, West Nile virus
RIGRNPSQV

SEQ ID NO: 132544 - protein, 9 aa, West Nile virus
IGRNPSQVG

SEQ ID NO: 132545 - protein, 9 aa, West Nile virus
GRNPSQVGD

SEQ ID NO: 132546 - protein, 9 aa, West Nile virus
RNPSQVGDE

SEQ ID NO: 132547 - protein, 9 aa, West Nile virus
NPSQVGDEY

SEQ ID NO: 132548 - protein, 9 aa, West Nile virus
PSQVGDEYC

SEQ ID NO: 132549 - protein, 9 aa, West Nile virus
SQVGDEYCY

SEQ ID NO: 132550 - protein, 9 aa, West Nile virus
QVGDEYCYG

SEQ ID NO: 132551 - protein, 9 aa, West Nile virus
VGDEYCYGG

SEQ ID NO: 132552 - protein, 9 aa, West Nile virus
GDEYCYGGH

SEQ ID NO: 132553 - protein, 9 aa, West Nile virus
DEYCYGGHT

SEQ ID NO: 132554 - protein, 9 aa, West Nile virus
EYCYGGHTN

SEQ ID NO: 132555 - protein, 9 aa, West Nile virus
YCYGGHTNE

SEQ ID NO: 132556 - protein, 9 aa, West Nile virus
CYGGHTNED

SEQ ID NO: 132557 - protein, 9 aa, West Nile virus
YGGHTNEDD

SEQ ID NO: 132558 - protein, 9 aa, West Nile virus
GGHTNEDDS

SEQ ID NO: 132559 - protein, 9 aa, West Nile virus
GHTNEDDSN

SEQ ID NO: 132560 - protein, 9 aa, West Nile virus
HTNEDDSNF

SEQ ID NO: 132561 - protein, 9 aa, West Nile virus
TNEDDSNFA

SEQ ID NO: 132562 - protein, 9 aa, West Nile virus
NEDDSNFAH

SEQ ID NO: 132563 - protein, 9 aa, West Nile virus
EDDSNFAHW

SEQ ID NO: 132564 - protein, 9 aa, West Nile virus
DDSNFAHWT

SEQ ID NO: 132565 - protein, 9 aa, West Nile virus
DSNFAHWTE

SEQ ID NO: 132566 - protein, 9 aa, West Nile virus
SNFAHWTEA

SEQ ID NO: 132567 - protein, 9 aa, West Nile virus
NFAHWTEAR

SEQ ID NO: 132568 - protein, 9 aa, West Nile virus
FAHWTEARI

SEQ ID NO: 132569 - protein, 9 aa, West Nile virus
AHWTEARIM

SEQ ID NO: 132570 - protein, 9 aa, West Nile virus
HWTEARIML

SEQ ID NO: 132571 - protein, 9 aa, West Nile virus
WTEARIMLD

SEQ ID NO: 132572 - protein, 9 aa, West Nile virus
TEARIMLDN

SEQ ID NO: 132573 - protein, 9 aa, West Nile virus
EARIMLDNI

SEQ ID NO: 132574 - protein, 9 aa, West Nile virus
ARIMLDNIN

SEQ ID NO: 132575 - protein, 9 aa, West Nile virus
RIMLDNINM

SEQ ID NO: 132576 - protein, 9 aa, West Nile virus
IMLDNINMP

SEQ ID NO: 132577 - protein, 9 aa, West Nile virus
MLDNINMPN

SEQ ID NO: 132578 - protein, 9 aa, West Nile virus
LDNINMPNG

SEQ ID NO: 132579 - protein, 9 aa, West Nile virus
DNINMPNGL

SEQ ID NO: 132580 - protein, 9 aa, West Nile virus
NINMPNGLI

SEQ ID NO: 132581 - protein, 9 aa, West Nile virus
INMPNGLIA

SEQ ID NO: 132582 - protein, 9 aa, West Nile virus
NMPNGLIAQ

SEQ ID NO: 132583 - protein, 9 aa, West Nile virus
MPNGLIAQF

SEQ ID NO: 132584 - protein, 9 aa, West Nile virus
PNGLIAQFY

SEQ ID NO: 132585 - protein, 9 aa, West Nile virus
NGLIAQFYQ

SEQ ID NO: 132586 - protein, 9 aa, West Nile virus
GLIAQFYQP

SEQ ID NO: 132587 - protein, 9 aa, West Nile virus
LIAQFYQPE

SEQ ID NO: 132588 - protein, 9 aa, West Nile virus
IAQFYQPER

SEQ ID NO: 132589 - protein, 9 aa, West Nile virus
AQFYQPERE

SEQ ID NO: 132590 - protein, 9 aa, West Nile virus
QFYQPEREK

SEQ ID NO: 132591 - protein, 9 aa, West Nile virus
FYQPEREKV

SEQ ID NO: 132592 - protein, 9 aa, West Nile virus
YQPEREKVY

SEQ ID NO: 132593 - protein, 9 aa, West Nile virus
QPEREKVYT

SEQ ID NO: 132594 - protein, 9 aa, West Nile virus
PEREKVYTM

SEQ ID NO: 132595 - protein, 9 aa, West Nile virus
EREKVYTMD

SEQ ID NO: 132596 - protein, 9 aa, West Nile virus
REKVYTMDG

SEQ ID NO: 132597 - protein, 9 aa, West Nile virus
EKVYTMDGE

SEQ ID NO: 132598 - protein, 9 aa, West Nile virus
KVYTMDGEY

SEQ ID NO: 132599 - protein, 9 aa, West Nile virus
VYTMDGEYR

SEQ ID NO: 132600 - protein, 9 aa, West Nile virus
YTMDGEYRL

SEQ ID NO: 132601 - protein, 9 aa, West Nile virus
TMDGEYRLR

SEQ ID NO: 132602 - protein, 9 aa, West Nile virus
MDGEYRLRG

SEQ ID NO: 132603 - protein, 9 aa, West Nile virus
DGEYRLRGE

SEQ ID NO: 132604 - protein, 9 aa, West Nile virus
GEYRLRGEE

SEQ ID NO: 132605 - protein, 9 aa, West Nile virus
EYRLRGEER

SEQ ID NO: 132606 - protein, 9 aa, West Nile virus
YRLRGEERK

SEQ ID NO: 132607 - protein, 9 aa, West Nile virus
RLRGEERKN

SEQ ID NO: 132608 - protein, 9 aa, West Nile virus
LRGEERKNF

SEQ ID NO: 132609 - protein, 9 aa, West Nile virus
RGEERKNFL

SEQ ID NO: 132610 - protein, 9 aa, West Nile virus
GEERKNFLE

SEQ ID NO: 132611 - protein, 9 aa, West Nile virus
EERKNFLEL

SEQ ID NO: 132612 - protein, 9 aa, West Nile virus
ERKNFLELL

SEQ ID NO: 132613 - protein, 9 aa, West Nile virus
RKNFLELLR

SEQ ID NO: 132614 - protein, 9 aa, West Nile virus
KNFLELLRT

SEQ ID NO: 132615 - protein, 9 aa, West Nile virus
NFLELLRTA

SEQ ID NO: 132616 - protein, 9 aa, West Nile virus
FLELLRTAD

SEQ ID NO: 132617 - protein, 9 aa, West Nile virus
LELLRTADL

SEQ ID NO: 132618 - protein, 9 aa, West Nile virus
ELLRTADLP

SEQ ID NO: 132619 - protein, 9 aa, West Nile virus
LLRTADLPV

SEQ ID NO: 132620 - protein, 9 aa, West Nile virus
LRTADLPVW

SEQ ID NO: 132621 - protein, 9 aa, West Nile virus
RTADLPVWL

SEQ ID NO: 132622 - protein, 9 aa, West Nile virus
TADLPVWLA

SEQ ID NO: 132623 - protein, 9 aa, West Nile virus
ADLPVWLAY

SEQ ID NO: 132624 - protein, 9 aa, West Nile virus
DLPVWLAYK

SEQ ID NO: 132625 - protein, 9 aa, West Nile virus
LPVWLAYKV

SEQ ID NO: 132626 - protein, 9 aa, West Nile virus
PVWLAYKVA

SEQ ID NO: 132627 - protein, 9 aa, West Nile virus
VWLAYKVAA

SEQ ID NO: 132628 - protein, 9 aa, West Nile virus
WLAYKVAAA

SEQ ID NO: 132629 - protein, 9 aa, West Nile virus
LAYKVAAAG

SEQ ID NO: 132630 - protein, 9 aa, West Nile virus
AYKVAAAGV

SEQ ID NO: 132631 - protein, 9 aa, West Nile virus
KVAAAGVSY

SEQ ID NO: 132632 - protein, 9 aa, West Nile virus
VAAAGVSYH

SEQ ID NO: 132633 - protein, 9 aa, West Nile virus
AAAGVSYHD

SEQ ID NO: 132634 - protein, 9 aa, West Nile virus
AAGVSYHDR

SEQ ID NO: 132635 - protein, 9 aa, West Nile virus
AGVSYHDRR

SEQ ID NO: 132636 - protein, 9 aa, West Nile virus
GVSYHDRRW

SEQ ID NO: 132637 - protein, 9 aa, West Nile virus
VSYHDRRWC

SEQ ID NO: 132638 - protein, 9 aa, West Nile virus
SYHDRRWCF

SEQ ID NO: 132639 - protein, 9 aa, West Nile virus
YHDRRWCFD

SEQ ID NO: 132640 - protein, 9 aa, West Nile virus
HDRRWCFDG

SEQ ID NO: 132641 - protein, 9 aa, West Nile virus
DRRWCFDGP

SEQ ID NO: 132642 - protein, 9 aa, West Nile virus
RRWCFDGPR

SEQ ID NO: 132643 - protein, 9 aa, West Nile virus
RWCFDGPRT

SEQ ID NO: 132644 - protein, 9 aa, West Nile virus
WCFDGPRTN

SEQ ID NO: 132645 - protein, 9 aa, West Nile virus
CFDGPRTNT

SEQ ID NO: 132646 - protein, 9 aa, West Nile virus
FDGPRTNTI

SEQ ID NO: 132647 - protein, 9 aa, West Nile virus
DGPRTNTIL

SEQ ID NO: 132648 - protein, 9 aa, West Nile virus
GPRTNTILE

SEQ ID NO: 132649 - protein, 9 aa, West Nile virus
PRTNTILED

SEQ ID NO: 132650 - protein, 9 aa, West Nile virus
RTNTILEDN

SEQ ID NO: 132651 - protein, 9 aa, West Nile virus
TNTILEDNN

SEQ ID NO: 132652 - protein, 9 aa, West Nile virus
NTILEDNNE

SEQ ID NO: 132653 - protein, 9 aa, West Nile virus
TILEDNNEV

SEQ ID NO: 132654 - protein, 9 aa, West Nile virus
ILEDNNEVE

SEQ ID NO: 132655 - protein, 9 aa, West Nile virus
LEDNNEVEV

SEQ ID NO: 132656 - protein, 9 aa, West Nile virus
EDNNEVEVI

SEQ ID NO: 132657 - protein, 9 aa, West Nile virus
DNNEVEVIT

SEQ ID NO: 132658 - protein, 9 aa, West Nile virus
NNEVEVITK

SEQ ID NO: 132659 - protein, 9 aa, West Nile virus
NEVEVITKL

SEQ ID NO: 132660 - protein, 9 aa, West Nile virus
EVEVITKLG

SEQ ID NO: 132661 - protein, 9 aa, West Nile virus
VEVITKLGE

SEQ ID NO: 132662 - protein, 9 aa, West Nile virus
EVITKLGER

SEQ ID NO: 132663 - protein, 9 aa, West Nile virus
VITKLGERK

SEQ ID NO: 132664 - protein, 9 aa, West Nile virus
ITKLGERKI

SEQ ID NO: 132665 - protein, 9 aa, West Nile virus
TKLGERKIL

SEQ ID NO: 132666 - protein, 9 aa, West Nile virus
KLGERKILR

SEQ ID NO: 132667 - protein, 9 aa, West Nile virus
LGERKILRP

SEQ ID NO: 132668 - protein, 9 aa, West Nile virus
GERKILRPR

SEQ ID NO: 132669 - protein, 9 aa, West Nile virus
ERKILRPRW

SEQ ID NO: 132670 - protein, 9 aa, West Nile virus
RKILRPRWI

SEQ ID NO: 132671 - protein, 9 aa, West Nile virus
KILRPRWID

SEQ ID NO: 132672 - protein, 9 aa, West Nile virus
ILRPRWIDA

SEQ ID NO: 132673 - protein, 9 aa, West Nile virus
LRPRWIDAR

SEQ ID NO: 132674 - protein, 9 aa, West Nile virus
RPRWIDARV

SEQ ID NO: 132675 - protein, 9 aa, West Nile virus
PRWIDARVY

SEQ ID NO: 132676 - protein, 9 aa, West Nile virus
RWIDARVYS

SEQ ID NO: 132677 - protein, 9 aa, West Nile virus
WIDARVYSD

SEQ ID NO: 132678 - protein, 9 aa, West Nile virus
IDARVYSDH

SEQ ID NO: 132679 - protein, 9 aa, West Nile virus
DARVYSDHQ

SEQ ID NO: 132680 - protein, 9 aa, West Nile virus
ARVYSDHQA

SEQ ID NO: 132681 - protein, 9 aa, West Nile virus
RVYSDHQAL

SEQ ID NO: 132682 - protein, 9 aa, West Nile virus
VYSDHQALK

SEQ ID NO: 132683 - protein, 9 aa, West Nile virus
YSDHQALKA

SEQ ID NO: 132684 - protein, 9 aa, West Nile virus
SDHQALKAF

SEQ ID NO: 132685 - protein, 9 aa, West Nile virus
DHQALKAFK

SEQ ID NO: 132686 - protein, 9 aa, West Nile virus
HQALKAFKD

SEQ ID NO: 132687 - protein, 9 aa, West Nile virus
QALKAFKDF

SEQ ID NO: 132688 - protein, 9 aa, West Nile virus
ALKAFKDFA

SEQ ID NO: 132689 - protein, 9 aa, West Nile virus
LKAFKDFAS

SEQ ID NO: 132690 - protein, 9 aa, West Nile virus
KAFKDFASG

SEQ ID NO: 132691 - protein, 9 aa, West Nile virus
AFKDFASGK

SEQ ID NO: 132692 - protein, 9 aa, West Nile virus
FKDFASGKR

SEQ ID NO: 132693 - protein, 9 aa, West Nile virus
KDFASGKRS

SEQ ID NO: 132694 - protein, 9 aa, West Nile virus
DFASGKRSQ

SEQ ID NO: 132695 - protein, 9 aa, West Nile virus
FASGKRSQI

SEQ ID NO: 132696 - protein, 9 aa, West Nile virus
ASGKRSQIG

SEQ ID NO: 132697 - protein, 9 aa, West Nile virus
SGKRSQIGL

SEQ ID NO: 132698 - protein, 9 aa, West Nile virus
GKRSQIGLI

SEQ ID NO: 132699 - protein, 9 aa, West Nile virus
KRSQIGLIE

SEQ ID NO: 132700 - protein, 9 aa, West Nile virus
RSQIGLIEV

SEQ ID NO: 132701 - protein, 9 aa, West Nile virus
SQIGLIEVL

SEQ ID NO: 132702 - protein, 9 aa, West Nile virus
QIGLIEVLG

SEQ ID NO: 132703 - protein, 9 aa, West Nile virus
IGLIEVLGK

SEQ ID NO: 132704 - protein, 9 aa, West Nile virus
GLIEVLGKM

SEQ ID NO: 132705 - protein, 9 aa, West Nile virus
LIEVLGKMP

SEQ ID NO: 132706 - protein, 9 aa, West Nile virus
IEVLGKMPE

SEQ ID NO: 132707 - protein, 9 aa, West Nile virus
EVLGKMPEH

SEQ ID NO: 132708 - protein, 9 aa, West Nile virus
VLGKMPEHF

SEQ ID NO: 132709 - protein, 9 aa, West Nile virus
LGKMPEHFM

SEQ ID NO: 132710 - protein, 9 aa, West Nile virus
GKMPEHFMG

SEQ ID NO: 132711 - protein, 9 aa, West Nile virus
KMPEHFMGK

SEQ ID NO: 132712 - protein, 9 aa, West Nile virus
MPEHFMGKT

SEQ ID NO: 132713 - protein, 9 aa, West Nile virus
PEHFMGKTW

SEQ ID NO: 132714 - protein, 9 aa, West Nile virus
EHFMGKTWE

SEQ ID NO: 132715 - protein, 9 aa, West Nile virus
HFMGKTWEA

SEQ ID NO: 132716 - protein, 9 aa, West Nile virus
FMGKTWEAL

SEQ ID NO: 132717 - protein, 9 aa, West Nile virus
MGKTWEALD

SEQ ID NO: 132718 - protein, 9 aa, West Nile virus
GKTWEALDT

SEQ ID NO: 132719 - protein, 9 aa, West Nile virus
KTWEALDTM

SEQ ID NO: 132720 - protein, 9 aa, West Nile virus
TWEALDTMY

SEQ ID NO: 132721 - protein, 9 aa, West Nile virus
WEALDTMYV

SEQ ID NO: 132722 - protein, 9 aa, West Nile virus
EALDTMYVV

SEQ ID NO: 132723 - protein, 9 aa, West Nile virus
ALDTMYVVA

SEQ ID NO: 132724 - protein, 9 aa, West Nile virus
LDTMYVVAT

SEQ ID NO: 132725 - protein, 9 aa, West Nile virus
DTMYVVATA

SEQ ID NO: 132726 - protein, 9 aa, West Nile virus
TMYVVATAE

SEQ ID NO: 132727 - protein, 9 aa, West Nile virus
MYVVATAEK

SEQ ID NO: 132728 - protein, 9 aa, West Nile virus
YVVATAEKG

SEQ ID NO: 132729 - protein, 9 aa, West Nile virus
VVATAEKGG

SEQ ID NO: 132730 - protein, 9 aa, West Nile virus
VATAEKGGR

SEQ ID NO: 132731 - protein, 9 aa, West Nile virus
ATAEKGGRA

SEQ ID NO: 132732 - protein, 9 aa, West Nile virus
TAEKGGRAH

SEQ ID NO: 132733 - protein, 9 aa, West Nile virus
AEKGGRAHR

SEQ ID NO: 132734 - protein, 9 aa, West Nile virus
EKGGRAHRM

SEQ ID NO: 132735 - protein, 9 aa, West Nile virus
KGGRAHRMA

SEQ ID NO: 132736 - protein, 9 aa, West Nile virus
GGRAHRMAL

SEQ ID NO: 132737 - protein, 9 aa, West Nile virus
GRAHRMALE

SEQ ID NO: 132738 - protein, 9 aa, West Nile virus
RAHRMALEE

SEQ ID NO: 132739 - protein, 9 aa, West Nile virus
AHRMALEEL

SEQ ID NO: 132740 - protein, 9 aa, West Nile virus
HRMALEELP

SEQ ID NO: 132741 - protein, 9 aa, West Nile virus
RMALEELPD

SEQ ID NO: 132742 - protein, 9 aa, West Nile virus
MALEELPDA

SEQ ID NO: 132743 - protein, 9 aa, West Nile virus
ALEELPDAL

SEQ ID NO: 132744 - protein, 9 aa, West Nile virus
LEELPDALQ

SEQ ID NO: 132745 - protein, 9 aa, West Nile virus
EELPDALQT

SEQ ID NO: 132746 - protein, 9 aa, West Nile virus
ELPDALQTI

SEQ ID NO: 132747 - protein, 9 aa, West Nile virus
LPDALQTIA

SEQ ID NO: 132748 - protein, 9 aa, West Nile virus
PDALQTIAL

SEQ ID NO: 132749 - protein, 9 aa, West Nile virus
DALQTIALI

SEQ ID NO: 132750 - protein, 9 aa, West Nile virus
ALQTIALIA

SEQ ID NO: 132751 - protein, 9 aa, West Nile virus
LQTIALIAL

SEQ ID NO: 132752 - protein, 9 aa, West Nile virus
QTIALIALL

SEQ ID NO: 132753 - protein, 9 aa, West Nile virus
TIALIALLS

SEQ ID NO: 132754 - protein, 9 aa, West Nile virus
IALIALLSV

SEQ ID NO: 132755 - protein, 9 aa, West Nile virus
ALIALLSVM

SEQ ID NO: 132756 - protein, 9 aa, West Nile virus
LIALLSVMT

SEQ ID NO: 132757 - protein, 9 aa, West Nile virus
LLSVMTMGV

SEQ ID NO: 132758 - protein, 9 aa, West Nile virus
LSVMTMGVF

SEQ ID NO: 132759 - protein, 9 aa, West Nile virus
VMTMGVFFL

SEQ ID NO: 132760 - protein, 9 aa, West Nile virus
MTMGVFFLL

SEQ ID NO: 132761 - protein, 9 aa, West Nile virus
TMGVFFLLM

SEQ ID NO: 132762 - protein, 9 aa, West Nile virus
MGVFFLLMQ

SEQ ID NO: 132763 - protein, 9 aa, West Nile virus
GVFFLLMQR

SEQ ID NO: 132764 - protein, 9 aa, West Nile virus
VFFLLMQRK

SEQ ID NO: 132765 - protein, 9 aa, West Nile virus
FFLLMQRKG

SEQ ID NO: 132766 - protein, 9 aa, West Nile virus
FLLMQRKGI

SEQ ID NO: 132767 - protein, 9 aa, West Nile virus
LLMQRKGIG

SEQ ID NO: 132768 - protein, 9 aa, West Nile virus
LMQRKGIGK

SEQ ID NO: 132769 - protein, 9 aa, West Nile virus
MQRKGIGKI

SEQ ID NO: 132770 - protein, 9 aa, West Nile virus
QRKGIGKIG

SEQ ID NO: 132771 - protein, 9 aa, West Nile virus
RKGIGKIGL

SEQ ID NO: 132772 - protein, 9 aa, West Nile virus
KGIGKIGLG

SEQ ID NO: 132773 - protein, 9 aa, West Nile virus
GIGKIGLGG

SEQ ID NO: 132774 - protein, 9 aa, West Nile virus
IGKIGLGGA

SEQ ID NO: 132775 - protein, 9 aa, West Nile virus
LGVATFFCW

SEQ ID NO: 132776 - protein, 9 aa, West Nile virus
GVATFFCWM

SEQ ID NO: 132777 - protein, 9 aa, West Nile virus
VATFFCWMA

SEQ ID NO: 132778 - protein, 9 aa, West Nile virus
ATFFCWMAE

SEQ ID NO: 132779 - protein, 9 aa, West Nile virus
TFFCWMAEV

SEQ ID NO: 132780 - protein, 9 aa, West Nile virus
FFCWMAEVP

SEQ ID NO: 132781 - protein, 9 aa, West Nile virus
FCWMAEVPG

SEQ ID NO: 132782 - protein, 9 aa, West Nile virus
CWMAEVPGT

SEQ ID NO: 132783 - protein, 9 aa, West Nile virus
WMAEVPGTK

SEQ ID NO: 132784 - protein, 9 aa, West Nile virus
MAEVPGTKI

SEQ ID NO: 132785 - protein, 9 aa, West Nile virus
AEVPGTKIA

SEQ ID NO: 132786 - protein, 9 aa, West Nile virus
EVPGTKIAG

SEQ ID NO: 132787 - protein, 9 aa, West Nile virus
VPGTKIAGM

SEQ ID NO: 132788 - protein, 9 aa, West Nile virus
PGTKIAGML

SEQ ID NO: 132789 - protein, 9 aa, West Nile virus
GTKIAGMLL

SEQ ID NO: 132790 - protein, 9 aa, West Nile virus
TKIAGMLLL

SEQ ID NO: 132791 - protein, 9 aa, West Nile virus
KIAGMLLLS

SEQ ID NO: 132792 - protein, 9 aa, West Nile virus
IAGMLLLSL

SEQ ID NO: 132793 - protein, 9 aa, West Nile virus
AGMLLLSLL

SEQ ID NO: 132794 - protein, 9 aa, West Nile virus
GMLLLSLLL

SEQ ID NO: 132795 - protein, 9 aa, West Nile virus
MLLLSLLLM

SEQ ID NO: 132796 - protein, 9 aa, West Nile virus
LLLSLLLMI

SEQ ID NO: 132797 - protein, 9 aa, West Nile virus
LLSLLLMIV

SEQ ID NO: 132798 - protein, 9 aa, West Nile virus
LSLLLMIVL

SEQ ID NO: 132799 - protein, 9 aa, West Nile virus
SLLLMIVLI

SEQ ID NO: 132800 - protein, 9 aa, West Nile virus
LLLMIVLIP

SEQ ID NO: 132801 - protein, 9 aa, West Nile virus
LLMIVLIPE

SEQ ID NO: 132802 - protein, 9 aa, West Nile virus
LMIVLIPEP

SEQ ID NO: 132803 - protein, 9 aa, West Nile virus
MIVLIPEPE

SEQ ID NO: 132804 - protein, 9 aa, West Nile virus
IVLIPEPEK

SEQ ID NO: 132805 - protein, 9 aa, West Nile virus
VLIPEPEKQ

SEQ ID NO: 132806 - protein, 9 aa, West Nile virus
LIPEPEKQR

SEQ ID NO: 132807 - protein, 9 aa, West Nile virus
IPEPEKQRS

SEQ ID NO: 132808 - protein, 9 aa, West Nile virus
PEPEKQRSQ

SEQ ID NO: 132809 - protein, 9 aa, West Nile virus
EPEKQRSQT

SEQ ID NO: 132810 - protein, 9 aa, West Nile virus
PEKQRSQTD

SEQ ID NO: 132811 - protein, 9 aa, West Nile virus
EKQRSQTDN

SEQ ID NO: 132812 - protein, 9 aa, West Nile virus
KQRSQTDNQ

SEQ ID NO: 132813 - protein, 9 aa, West Nile virus
QRSQTDNQL

SEQ ID NO: 132814 - protein, 9 aa, West Nile virus
RSQTDNQLA

SEQ ID NO: 132815 - protein, 9 aa, West Nile virus
SQTDNQLAV

SEQ ID NO: 132816 - protein, 9 aa, West Nile virus
QTDNQLAVF

SEQ ID NO: 132817 - protein, 9 aa, West Nile virus
TDNQLAVFL

SEQ ID NO: 132818 - protein, 9 aa, West Nile virus
DNQLAVFLI

SEQ ID NO: 132819 - protein, 9 aa, West Nile virus
NQLAVFLIC

SEQ ID NO: 132820 - protein, 9 aa, West Nile virus
QLAVFLICV

SEQ ID NO: 132821 - protein, 9 aa, West Nile virus
LAVFLICVM

SEQ ID NO: 132822 - protein, 9 aa, West Nile virus
AVFLICVMT

SEQ ID NO: 132823 - protein, 9 aa, West Nile virus
VFLICVMTL

SEQ ID NO: 132824 - protein, 9 aa, West Nile virus
FLICVMTLV

SEQ ID NO: 132825 - protein, 9 aa, West Nile virus
TLVSAVAAN

SEQ ID NO: 132826 - protein, 9 aa, West Nile virus
LVSAVAANE

SEQ ID NO: 132827 - protein, 9 aa, West Nile virus
VSAVAANEM

SEQ ID NO: 132828 - protein, 9 aa, West Nile virus
SAVAANEMG

SEQ ID NO: 132829 - protein, 9 aa, West Nile virus
AVAANEMGW

SEQ ID NO: 132830 - protein, 9 aa, West Nile virus
VAANEMGWL

SEQ ID NO: 132831 - protein, 9 aa, West Nile virus
AANEMGWLD

SEQ ID NO: 132832 - protein, 9 aa, West Nile virus
ANEMGWLDK

SEQ ID NO: 132833 - protein, 9 aa, West Nile virus
NEMGWLDKT

SEQ ID NO: 132834 - protein, 9 aa, West Nile virus
EMGWLDKTK

SEQ ID NO: 132835 - protein, 9 aa, West Nile virus
MGWLDKTKS

SEQ ID NO: 132836 - protein, 9 aa, West Nile virus
GWLDKTKSD

SEQ ID NO: 132837 - protein, 9 aa, West Nile virus
WLDKTKSDI

SEQ ID NO: 132838 - protein, 9 aa, West Nile virus
GEFLLDLRP

SEQ ID NO: 132839 - protein, 9 aa, West Nile virus
EFLLDLRPA

SEQ ID NO: 132840 - protein, 9 aa, West Nile virus
FLLDLRPAT

SEQ ID NO: 132841 - protein, 9 aa, West Nile virus
LLDLRPATA

SEQ ID NO: 132842 - protein, 9 aa, West Nile virus
LDLRPATAW

SEQ ID NO: 132843 - protein, 9 aa, West Nile virus
DLRPATAWS

SEQ ID NO: 132844 - protein, 9 aa, West Nile virus
LRPATAWSL

SEQ ID NO: 132845 - protein, 9 aa, West Nile virus
RPATAWSLY

SEQ ID NO: 132846 - protein, 9 aa, West Nile virus
PATAWSLYA

SEQ ID NO: 132847 - protein, 9 aa, West Nile virus
ATAWSLYAV

SEQ ID NO: 132848 - protein, 9 aa, West Nile virus
TAWSLYAVT

SEQ ID NO: 132849 - protein, 9 aa, West Nile virus
AWSLYAVTT

SEQ ID NO: 132850 - protein, 9 aa, West Nile virus
WSLYAVTTA

SEQ ID NO: 132851 - protein, 9 aa, West Nile virus
SLYAVTTAV

SEQ ID NO: 132852 - protein, 9 aa, West Nile virus
LYAVTTAVL

SEQ ID NO: 132853 - protein, 9 aa, West Nile virus
YAVTTAVLT

SEQ ID NO: 132854 - protein, 9 aa, West Nile virus
AVTTAVLTP

SEQ ID NO: 132855 - protein, 9 aa, West Nile virus
VTTAVLTPL

SEQ ID NO: 132856 - protein, 9 aa, West Nile virus
TTAVLTPLL

SEQ ID NO: 132857 - protein, 9 aa, West Nile virus
TAVLTPLLK

SEQ ID NO: 132858 - protein, 9 aa, West Nile virus
AVLTPLLKH

SEQ ID NO: 132859 - protein, 9 aa, West Nile virus
VLTPLLKHL

SEQ ID NO: 132860 - protein, 9 aa, West Nile virus
LTPLLKHLI

SEQ ID NO: 132861 - protein, 9 aa, West Nile virus
TPLLKHLIT

SEQ ID NO: 132862 - protein, 9 aa, West Nile virus
PLLKHLITS

SEQ ID NO: 132863 - protein, 9 aa, West Nile virus
LLKHLITSD

SEQ ID NO: 132864 - protein, 9 aa, West Nile virus
LKHLITSDY

SEQ ID NO: 132865 - protein, 9 aa, West Nile virus
KHLITSDYI

SEQ ID NO: 132866 - protein, 9 aa, West Nile virus
HLITSDYIN

SEQ ID NO: 132867 - protein, 9 aa, West Nile virus
LITSDYINT

SEQ ID NO: 132868 - protein, 9 aa, West Nile virus
ITSDYINTS

SEQ ID NO: 132869 - protein, 9 aa, West Nile virus
TSDYINTSL

SEQ ID NO: 132870 - protein, 9 aa, West Nile virus
SDYINTSLT

SEQ ID NO: 132871 - protein, 9 aa, West Nile virus
DYINTSLTS

SEQ ID NO: 132872 - protein, 9 aa, West Nile virus
YINTSLTSI

SEQ ID NO: 132873 - protein, 9 aa, West Nile virus
INTSLTSIN

SEQ ID NO: 132874 - protein, 9 aa, West Nile virus
NTSLTSINV

SEQ ID NO: 132875 - protein, 9 aa, West Nile virus
TSLTSINVQ

SEQ ID NO: 132876 - protein, 9 aa, West Nile virus
SLTSINVQA

SEQ ID NO: 132877 - protein, 9 aa, West Nile virus
LTSINVQAS

SEQ ID NO: 132878 - protein, 9 aa, West Nile virus
TSINVQASA

SEQ ID NO: 132879 - protein, 9 aa, West Nile virus
SINVQASAL

SEQ ID NO: 132880 - protein, 9 aa, West Nile virus
INVQASALF

SEQ ID NO: 132881 - protein, 9 aa, West Nile virus
NVQASALFT

SEQ ID NO: 132882 - protein, 9 aa, West Nile virus
VQASALFTL

SEQ ID NO: 132883 - protein, 9 aa, West Nile virus
QASALFTLA

SEQ ID NO: 132884 - protein, 9 aa, West Nile virus
ASALFTLAR

SEQ ID NO: 132885 - protein, 9 aa, West Nile virus
SALFTLARG

SEQ ID NO: 132886 - protein, 9 aa, West Nile virus
ALFTLARGF

SEQ ID NO: 132887 - protein, 9 aa, West Nile virus
LFTLARGFP

SEQ ID NO: 132888 - protein, 9 aa, West Nile virus
FTLARGFPF

SEQ ID NO: 132889 - protein, 9 aa, West Nile virus
TLARGFPFV

SEQ ID NO: 132890 - protein, 9 aa, West Nile virus
LARGFPFVD

SEQ ID NO: 132891 - protein, 9 aa, West Nile virus
ARGFPFVDV

SEQ ID NO: 132892 - protein, 9 aa, West Nile virus
RGFPFVDVG

SEQ ID NO: 132893 - protein, 9 aa, West Nile virus
GFPFVDVGV

SEQ ID NO: 132894 - protein, 9 aa, West Nile virus
FPFVDVGVS

SEQ ID NO: 132895 - protein, 9 aa, West Nile virus
PFVDVGVSA

SEQ ID NO: 132896 - protein, 9 aa, West Nile virus
FVDVGVSAL

SEQ ID NO: 132897 - protein, 9 aa, West Nile virus
VDVGVSALL

SEQ ID NO: 132898 - protein, 9 aa, West Nile virus
DVGVSALLL

SEQ ID NO: 132899 - protein, 9 aa, West Nile virus
VGVSALLLA

SEQ ID NO: 132900 - protein, 9 aa, West Nile virus
GVSALLLAA

SEQ ID NO: 132901 - protein, 9 aa, West Nile virus
VSALLLAAG

SEQ ID NO: 132902 - protein, 9 aa, West Nile virus
SALLLAAGC

SEQ ID NO: 132903 - protein, 9 aa, West Nile virus
ALLLAAGCW

SEQ ID NO: 132904 - protein, 9 aa, West Nile virus
LLLAAGCWG

SEQ ID NO: 132905 - protein, 9 aa, West Nile virus
LLAAGCWGQ

SEQ ID NO: 132906 - protein, 9 aa, West Nile virus
LAAGCWGQV

SEQ ID NO: 132907 - protein, 9 aa, West Nile virus
AAGCWGQVT

SEQ ID NO: 132908 - protein, 9 aa, West Nile virus
AGCWGQVTL

SEQ ID NO: 132909 - protein, 9 aa, West Nile virus
GCWGQVTLT

SEQ ID NO: 132910 - protein, 9 aa, West Nile virus
CWGQVTLTV

SEQ ID NO: 132911 - protein, 9 aa, West Nile virus
WGQVTLTVT

SEQ ID NO: 132912 - protein, 9 aa, West Nile virus
GQVTLTVTV

SEQ ID NO: 132913 - protein, 9 aa, West Nile virus
QVTLTVTVT

SEQ ID NO: 132914 - protein, 9 aa, West Nile virus
VTLTVTVTA

SEQ ID NO: 132915 - protein, 9 aa, West Nile virus
TLTVTVTAA

SEQ ID NO: 132916 - protein, 9 aa, West Nile virus
TLLFCHYAY

SEQ ID NO: 132917 - protein, 9 aa, West Nile virus
LLFCHYAYM

SEQ ID NO: 132918 - protein, 9 aa, West Nile virus
LFCHYAYMV

SEQ ID NO: 132919 - protein, 9 aa, West Nile virus
FCHYAYMVP

SEQ ID NO: 132920 - protein, 9 aa, West Nile virus
CHYAYMVPG

SEQ ID NO: 132921 - protein, 9 aa, West Nile virus
HYAYMVPGW

SEQ ID NO: 132922 - protein, 9 aa, West Nile virus
YAYMVPGWQ

SEQ ID NO: 132923 - protein, 9 aa, West Nile virus
AYMVPGWQA

SEQ ID NO: 132924 - protein, 9 aa, West Nile virus
YMVPGWQAE

SEQ ID NO: 132925 - protein, 9 aa, West Nile virus
MVPGWQAEA

SEQ ID NO: 132926 - protein, 9 aa, West Nile virus
VPGWQAEAM

SEQ ID NO: 132927 - protein, 9 aa, West Nile virus
PGWQAEAMR

SEQ ID NO: 132928 - protein, 9 aa, West Nile virus
GWQAEAMRS

SEQ ID NO: 132929 - protein, 9 aa, West Nile virus
WQAEAMRSA

SEQ ID NO: 132930 - protein, 9 aa, West Nile virus
QAEAMRSAQ

SEQ ID NO: 132931 - protein, 9 aa, West Nile virus
AEAMRSAQR

SEQ ID NO: 132932 - protein, 9 aa, West Nile virus
EAMRSAQRR

SEQ ID NO: 132933 - protein, 9 aa, West Nile virus
AMRSAQRRT

SEQ ID NO: 132934 - protein, 9 aa, West Nile virus
MRSAQRRTA

SEQ ID NO: 132935 - protein, 9 aa, West Nile virus
RSAQRRTAA

SEQ ID NO: 132936 - protein, 9 aa, West Nile virus
SAQRRTAAG

SEQ ID NO: 132937 - protein, 9 aa, West Nile virus
AQRRTAAGI

SEQ ID NO: 132938 - protein, 9 aa, West Nile virus
QRRTAAGIM

SEQ ID NO: 132939 - protein, 9 aa, West Nile virus
RRTAAGIMK

SEQ ID NO: 132940 - protein, 9 aa, West Nile virus
RTAAGIMKN

SEQ ID NO: 132941 - protein, 9 aa, West Nile virus
TAAGIMKNA

SEQ ID NO: 132942 - protein, 9 aa, West Nile virus
AAGIMKNAV

SEQ ID NO: 132943 - protein, 9 aa, West Nile virus
AGIMKNAVV

SEQ ID NO: 132944 - protein, 9 aa, West Nile virus
GIMKNAVVD

SEQ ID NO: 132945 - protein, 9 aa, West Nile virus
IMKNAVVDG

SEQ ID NO: 132946 - protein, 9 aa, West Nile virus
MKNAVVDGI

SEQ ID NO: 132947 - protein, 9 aa, West Nile virus
KNAVVDGIV

SEQ ID NO: 132948 - protein, 9 aa, West Nile virus
NAVVDGIVA

SEQ ID NO: 132949 - protein, 9 aa, West Nile virus
AVVDGIVAT

SEQ ID NO: 132950 - protein, 9 aa, West Nile virus
VVDGIVATD

SEQ ID NO: 132951 - protein, 9 aa, West Nile virus
VDGIVATDV

SEQ ID NO: 132952 - protein, 9 aa, West Nile virus
DGIVATDVP

SEQ ID NO: 132953 - protein, 9 aa, West Nile virus
GIVATDVPE

SEQ ID NO: 132954 - protein, 9 aa, West Nile virus
IVATDVPEL

SEQ ID NO: 132955 - protein, 9 aa, West Nile virus
VATDVPELE

SEQ ID NO: 132956 - protein, 9 aa, West Nile virus
ATDVPELER

SEQ ID NO: 132957 - protein, 9 aa, West Nile virus
TDVPELERT

SEQ ID NO: 132958 - protein, 9 aa, West Nile virus
DVPELERTT

SEQ ID NO: 132959 - protein, 9 aa, West Nile virus
VPELERTTP

SEQ ID NO: 132960 - protein, 9 aa, West Nile virus
PELERTTPI

SEQ ID NO: 132961 - protein, 9 aa, West Nile virus
ELERTTPIM

SEQ ID NO: 132962 - protein, 9 aa, West Nile virus
LERTTPIMQ

SEQ ID NO: 132963 - protein, 9 aa, West Nile virus
ERTTPIMQK

SEQ ID NO: 132964 - protein, 9 aa, West Nile virus
RTTPIMQKK

SEQ ID NO: 132965 - protein, 9 aa, West Nile virus
TTPIMQKKV

SEQ ID NO: 132966 - protein, 9 aa, West Nile virus
TPIMQKKVG

SEQ ID NO: 132967 - protein, 9 aa, West Nile virus
PIMQKKVGQ

SEQ ID NO: 132968 - protein, 9 aa, West Nile virus
IMQKKVGQI

SEQ ID NO: 132969 - protein, 9 aa, West Nile virus
MQKKVGQIM

SEQ ID NO: 132970 - protein, 9 aa, West Nile virus
QKKVGQIML

SEQ ID NO: 132971 - protein, 9 aa, West Nile virus
KKVGQIMLI

SEQ ID NO: 132972 - protein, 9 aa, West Nile virus
KVGQIMLIL

SEQ ID NO: 132973 - protein, 9 aa, West Nile virus
VGQIMLILV

SEQ ID NO: 132974 - protein, 9 aa, West Nile virus
GQIMLILVS

SEQ ID NO: 132975 - protein, 9 aa, West Nile virus
MLILVSLAA

SEQ ID NO: 132976 - protein, 9 aa, West Nile virus
LILVSLAAV

SEQ ID NO: 132977 - protein, 9 aa, West Nile virus
ILVSLAAVV

SEQ ID NO: 132978 - protein, 9 aa, West Nile virus
LVSLAAVVV

SEQ ID NO: 132979 - protein, 9 aa, West Nile virus
VSLAAVVVN

SEQ ID NO: 132980 - protein, 9 aa, West Nile virus
SLAAVVVNP

SEQ ID NO: 132981 - protein, 9 aa, West Nile virus
LAAVVVNPS

SEQ ID NO: 132982 - protein, 9 aa, West Nile virus
AAVVVNPSV

SEQ ID NO: 132983 - protein, 9 aa, West Nile virus
AVVVNPSVK

SEQ ID NO: 132984 - protein, 9 aa, West Nile virus
VVVNPSVKT

SEQ ID NO: 132985 - protein, 9 aa, West Nile virus
VVNPSVKTV

SEQ ID NO: 132986 - protein, 9 aa, West Nile virus
VNPSVKTVR

SEQ ID NO: 132987 - protein, 9 aa, West Nile virus
NPSVKTVRE

SEQ ID NO: 132988 - protein, 9 aa, West Nile virus
PSVKTVREA

SEQ ID NO: 132989 - protein, 9 aa, West Nile virus
SVKTVREAG

SEQ ID NO: 132990 - protein, 9 aa, West Nile virus
VKTVREAGI

SEQ ID NO: 132991 - protein, 9 aa, West Nile virus
KTVREAGIL

SEQ ID NO: 132992 - protein, 9 aa, West Nile virus
TVREAGILI

SEQ ID NO: 132993 - protein, 9 aa, West Nile virus
VREAGILIT

SEQ ID NO: 132994 - protein, 9 aa, West Nile virus
REAGILITA

SEQ ID NO: 132995 - protein, 9 aa, West Nile virus
EAGILITAA

SEQ ID NO: 132996 - protein, 9 aa, West Nile virus
AGILITAAA

SEQ ID NO: 132997 - protein, 9 aa, West Nile virus
GILITAAAV

SEQ ID NO: 132998 - protein, 9 aa, West Nile virus
ILITAAAVT

SEQ ID NO: 132999 - protein, 9 aa, West Nile virus
LITAAAVTL

SEQ ID NO: 133000 - protein, 9 aa, West Nile virus
ITAAAVTLW

SEQ ID NO: 133001 - protein, 9 aa, West Nile virus
TAAAVTLWE

SEQ ID NO: 133002 - protein, 9 aa, West Nile virus
AAAVTLWEN

SEQ ID NO: 133003 - protein, 9 aa, West Nile virus
AAVTLWENG

SEQ ID NO: 133004 - protein, 9 aa, West Nile virus
AVTLWENGA

SEQ ID NO: 133005 - protein, 9 aa, West Nile virus
VTLWENGAS

SEQ ID NO: 133006 - protein, 9 aa, West Nile virus
TLWENGASS

SEQ ID NO: 133007 - protein, 9 aa, West Nile virus
LWENGASSV

SEQ ID NO: 133008 - protein, 9 aa, West Nile virus
WENGASSVW

SEQ ID NO: 133009 - protein, 9 aa, West Nile virus
ENGASSVWN

SEQ ID NO: 133010 - protein, 9 aa, West Nile virus
NGASSVWNA

SEQ ID NO: 133011 - protein, 9 aa, West Nile virus
GASSVWNAT

SEQ ID NO: 133012 - protein, 9 aa, West Nile virus
ASSVWNATT

SEQ ID NO: 133013 - protein, 9 aa, West Nile virus
SSVWNATTA

SEQ ID NO: 133014 - protein, 9 aa, West Nile virus
SVWNATTAI

SEQ ID NO: 133015 - protein, 9 aa, West Nile virus
VWNATTAIG

SEQ ID NO: 133016 - protein, 9 aa, West Nile virus
WNATTAIGL

SEQ ID NO: 133017 - protein, 9 aa, West Nile virus
NATTAIGLC

SEQ ID NO: 133018 - protein, 9 aa, West Nile virus
ATTAIGLCH

SEQ ID NO: 133019 - protein, 9 aa, West Nile virus
TTAIGLCHI

SEQ ID NO: 133020 - protein, 9 aa, West Nile virus
TAIGLCHIM

SEQ ID NO: 133021 - protein, 9 aa, West Nile virus
AIGLCHIMR

SEQ ID NO: 133022 - protein, 9 aa, West Nile virus
IGLCHIMRG

SEQ ID NO: 133023 - protein, 9 aa, West Nile virus
GLCHIMRGG

SEQ ID NO: 133024 - protein, 9 aa, West Nile virus
LCHIMRGGW

SEQ ID NO: 133025 - protein, 9 aa, West Nile virus
CHIMRGGWL

SEQ ID NO: 133026 - protein, 9 aa, West Nile virus
HIMRGGWLS

SEQ ID NO: 133027 - protein, 9 aa, West Nile virus
IMRGGWLSC

SEQ ID NO: 133028 - protein, 9 aa, West Nile virus
MRGGWLSCL

SEQ ID NO: 133029 - protein, 9 aa, West Nile virus
RGGWLSCLS

SEQ ID NO: 133030 - protein, 9 aa, West Nile virus
GGWLSCLSI

SEQ ID NO: 133031 - protein, 9 aa, West Nile virus
GWLSCLSIT

SEQ ID NO: 133032 - protein, 9 aa, West Nile virus
WLSCLSITW

SEQ ID NO: 133033 - protein, 9 aa, West Nile virus
LSCLSITWT

SEQ ID NO: 133034 - protein, 9 aa, West Nile virus
SCLSITWTL

SEQ ID NO: 133035 - protein, 9 aa, West Nile virus
KNMEKPGLK

SEQ ID NO: 133036 - protein, 9 aa, West Nile virus
NMEKPGLKR

SEQ ID NO: 133037 - protein, 9 aa, West Nile virus
MEKPGLKRG

SEQ ID NO: 133038 - protein, 9 aa, West Nile virus
EKPGLKRGG

SEQ ID NO: 133039 - protein, 9 aa, West Nile virus
KPGLKRGGA

SEQ ID NO: 133040 - protein, 9 aa, West Nile virus
PGLKRGGAK

SEQ ID NO: 133041 - protein, 9 aa, West Nile virus
GLKRGGAKG

SEQ ID NO: 133042 - protein, 9 aa, West Nile virus
LKRGGAKGR

SEQ ID NO: 133043 - protein, 9 aa, West Nile virus
KRGGAKGRT

SEQ ID NO: 133044 - protein, 9 aa, West Nile virus
RGGAKGRTL

SEQ ID NO: 133045 - protein, 9 aa, West Nile virus
GGAKGRTLG

SEQ ID NO: 133046 - protein, 9 aa, West Nile virus
GAKGRTLGE

SEQ ID NO: 133047 - protein, 9 aa, West Nile virus
AKGRTLGEV

SEQ ID NO: 133048 - protein, 9 aa, West Nile virus
KGRTLGEVW

SEQ ID NO: 133049 - protein, 9 aa, West Nile virus
GRTLGEVWK

SEQ ID NO: 133050 - protein, 9 aa, West Nile virus
RTLGEVWKE

SEQ ID NO: 133051 - protein, 9 aa, West Nile virus
TLGEVWKER

SEQ ID NO: 133052 - protein, 9 aa, West Nile virus
LGEVWKERL

SEQ ID NO: 133053 - protein, 9 aa, West Nile virus
GEVWKERLN

SEQ ID NO: 133054 - protein, 9 aa, West Nile virus
EVWKERLNQ

SEQ ID NO: 133055 - protein, 9 aa, West Nile virus
VWKERLNQM

SEQ ID NO: 133056 - protein, 9 aa, West Nile virus
WKERLNQMT

SEQ ID NO: 133057 - protein, 9 aa, West Nile virus
MTKEEFTRY

SEQ ID NO: 133058 - protein, 9 aa, West Nile virus
TKEEFTRYR

SEQ ID NO: 133059 - protein, 9 aa, West Nile virus
KEEFTRYRK

SEQ ID NO: 133060 - protein, 9 aa, West Nile virus
EEFTRYRKE

SEQ ID NO: 133061 - protein, 9 aa, West Nile virus
EFTRYRKEA

SEQ ID NO: 133062 - protein, 9 aa, West Nile virus
FTRYRKEAI

SEQ ID NO: 133063 - protein, 9 aa, West Nile virus
TRYRKEAII

SEQ ID NO: 133064 - protein, 9 aa, West Nile virus
RYRKEAIIE

SEQ ID NO: 133065 - protein, 9 aa, West Nile virus
YRKEAIIEV

SEQ ID NO: 133066 - protein, 9 aa, West Nile virus
RKEAIIEVD

SEQ ID NO: 133067 - protein, 9 aa, West Nile virus
KEAIIEVDR

SEQ ID NO: 133068 - protein, 9 aa, West Nile virus
EAIIEVDRS

SEQ ID NO: 133069 - protein, 9 aa, West Nile virus
AIIEVDRSA

SEQ ID NO: 133070 - protein, 9 aa, West Nile virus
IIEVDRSAA

SEQ ID NO: 133071 - protein, 9 aa, West Nile virus
IEVDRSAAK

SEQ ID NO: 133072 - protein, 9 aa, West Nile virus
ARKEGNVTG

SEQ ID NO: 133073 - protein, 9 aa, West Nile virus
RKEGNVTGG

SEQ ID NO: 133074 - protein, 9 aa, West Nile virus
KEGNVTGGH

SEQ ID NO: 133075 - protein, 9 aa, West Nile virus
EGNVTGGHP

SEQ ID NO: 133076 - protein, 9 aa, West Nile virus
GNVTGGHPV

SEQ ID NO: 133077 - protein, 9 aa, West Nile virus
NVTGGHPVS

SEQ ID NO: 133078 - protein, 9 aa, West Nile virus
VTGGHPVSR

SEQ ID NO: 133079 - protein, 9 aa, West Nile virus
TGGHPVSRG

SEQ ID NO: 133080 - protein, 9 aa, West Nile virus
GGHPVSRGT

SEQ ID NO: 133081 - protein, 9 aa, West Nile virus
GHPVSRGTA

SEQ ID NO: 133082 - protein, 9 aa, West Nile virus
HPVSRGTAK

SEQ ID NO: 133083 - protein, 9 aa, West Nile virus
PVSRGTAKL

SEQ ID NO: 133084 - protein, 9 aa, West Nile virus
VSRGTAKLR

SEQ ID NO: 133085 - protein, 9 aa, West Nile virus
SRGTAKLRW

SEQ ID NO: 133086 - protein, 9 aa, West Nile virus
RGTAKLRWL

SEQ ID NO: 133087 - protein, 9 aa, West Nile virus
GTAKLRWLV

SEQ ID NO: 133088 - protein, 9 aa, West Nile virus
TAKLRWLVE

SEQ ID NO: 133089 - protein, 9 aa, West Nile virus
AKLRWLVER

SEQ ID NO: 133090 - protein, 9 aa, West Nile virus
KLRWLVERR

SEQ ID NO: 133091 - protein, 9 aa, West Nile virus
LRWLVERRF

SEQ ID NO: 133092 - protein, 9 aa, West Nile virus
RWLVERRFL

SEQ ID NO: 133093 - protein, 9 aa, West Nile virus
WLVERRFLE

SEQ ID NO: 133094 - protein, 9 aa, West Nile virus
LVERRFLEP

SEQ ID NO: 133095 - protein, 9 aa, West Nile virus
VERRFLEPV

SEQ ID NO: 133096 - protein, 9 aa, West Nile virus
ERRFLEPVG

SEQ ID NO: 133097 - protein, 9 aa, West Nile virus
RRFLEPVGK

SEQ ID NO: 133098 - protein, 9 aa, West Nile virus
RFLEPVGKV

SEQ ID NO: 133099 - protein, 9 aa, West Nile virus
FLEPVGKVI

SEQ ID NO: 133100 - protein, 9 aa, West Nile virus
LEPVGKVID

SEQ ID NO: 133101 - protein, 9 aa, West Nile virus
EPVGKVIDL

SEQ ID NO: 133102 - protein, 9 aa, West Nile virus
PVGKVIDLG

SEQ ID NO: 133103 - protein, 9 aa, West Nile virus
VGKVIDLGC

SEQ ID NO: 133104 - protein, 9 aa, West Nile virus
GKVIDLGCG

SEQ ID NO: 133105 - protein, 9 aa, West Nile virus
KVIDLGCGR

SEQ ID NO: 133106 - protein, 9 aa, West Nile virus
VIDLGCGRG

SEQ ID NO: 133107 - protein, 9 aa, West Nile virus
IDLGCGRGG

SEQ ID NO: 133108 - protein, 9 aa, West Nile virus
DLGCGRGGW

SEQ ID NO: 133109 - protein, 9 aa, West Nile virus
LGCGRGGWC

SEQ ID NO: 133110 - protein, 9 aa, West Nile virus
GCGRGGWCY

SEQ ID NO: 133111 - protein, 9 aa, West Nile virus
CGRGGWCYY

SEQ ID NO: 133112 - protein, 9 aa, West Nile virus
GRGGWCYYM

SEQ ID NO: 133113 - protein, 9 aa, West Nile virus
RGGWCYYMA

SEQ ID NO: 133114 - protein, 9 aa, West Nile virus
GGWCYYMAT

SEQ ID NO: 133115 - protein, 9 aa, West Nile virus
GWCYYMATQ

SEQ ID NO: 133116 - protein, 9 aa, West Nile virus
WCYYMATQK

SEQ ID NO: 133117 - protein, 9 aa, West Nile virus
CYYMATQKR

SEQ ID NO: 133118 - protein, 9 aa, West Nile virus
YYMATQKRV

SEQ ID NO: 133119 - protein, 9 aa, West Nile virus
YMATQKRVQ

SEQ ID NO: 133120 - protein, 9 aa, West Nile virus
MATQKRVQE

SEQ ID NO: 133121 - protein, 9 aa, West Nile virus
ATQKRVQEV

SEQ ID NO: 133122 - protein, 9 aa, West Nile virus
TQKRVQEVR

SEQ ID NO: 133123 - protein, 9 aa, West Nile virus
QKRVQEVRG

SEQ ID NO: 133124 - protein, 9 aa, West Nile virus
KRVQEVRGY

SEQ ID NO: 133125 - protein, 9 aa, West Nile virus
RVQEVRGYT

SEQ ID NO: 133126 - protein, 9 aa, West Nile virus
VQEVRGYTK

SEQ ID NO: 133127 - protein, 9 aa, West Nile virus
QEVRGYTKG

SEQ ID NO: 133128 - protein, 9 aa, West Nile virus
EVRGYTKGG

SEQ ID NO: 133129 - protein, 9 aa, West Nile virus
VRGYTKGGP

SEQ ID NO: 133130 - protein, 9 aa, West Nile virus
RGYTKGGPG

SEQ ID NO: 133131 - protein, 9 aa, West Nile virus
GYTKGGPGH

SEQ ID NO: 133132 - protein, 9 aa, West Nile virus
YTKGGPGHE

SEQ ID NO: 133133 - protein, 9 aa, West Nile virus
TKGGPGHEE

SEQ ID NO: 133134 - protein, 9 aa, West Nile virus
KGGPGHEEP

SEQ ID NO: 133135 - protein, 9 aa, West Nile virus
GGPGHEEPQ

SEQ ID NO: 133136 - protein, 9 aa, West Nile virus
GPGHEEPQL

SEQ ID NO: 133137 - protein, 9 aa, West Nile virus
PGHEEPQLV

SEQ ID NO: 133138 - protein, 9 aa, West Nile virus
GHEEPQLVQ

SEQ ID NO: 133139 - protein, 9 aa, West Nile virus
HEEPQLVQS

SEQ ID NO: 133140 - protein, 9 aa, West Nile virus
EEPQLVQSY

SEQ ID NO: 133141 - protein, 9 aa, West Nile virus
EPQLVQSYG

SEQ ID NO: 133142 - protein, 9 aa, West Nile virus
PQLVQSYGW

SEQ ID NO: 133143 - protein, 9 aa, West Nile virus
QLVQSYGWN

SEQ ID NO: 133144 - protein, 9 aa, West Nile virus
LVQSYGWNI

SEQ ID NO: 133145 - protein, 9 aa, West Nile virus
VQSYGWNIV

SEQ ID NO: 133146 - protein, 9 aa, West Nile virus
QSYGWNIVT

SEQ ID NO: 133147 - protein, 9 aa, West Nile virus
SYGWNIVTM

SEQ ID NO: 133148 - protein, 9 aa, West Nile virus
YGWNIVTMK

SEQ ID NO: 133149 - protein, 9 aa, West Nile virus
GWNIVTMKS

SEQ ID NO: 133150 - protein, 9 aa, West Nile virus
WNIVTMKSG

SEQ ID NO: 133151 - protein, 9 aa, West Nile virus
NIVTMKSGV

SEQ ID NO: 133152 - protein, 9 aa, West Nile virus
IVTMKSGVD

SEQ ID NO: 133153 - protein, 9 aa, West Nile virus
VTMKSGVDV

SEQ ID NO: 133154 - protein, 9 aa, West Nile virus
TMKSGVDVF

SEQ ID NO: 133155 - protein, 9 aa, West Nile virus
MKSGVDVFY

SEQ ID NO: 133156 - protein, 9 aa, West Nile virus
KSGVDVFYR

SEQ ID NO: 133157 - protein, 9 aa, West Nile virus
SGVDVFYRP

SEQ ID NO: 133158 - protein, 9 aa, West Nile virus
GVDVFYRPS

SEQ ID NO: 133159 - protein, 9 aa, West Nile virus
VDVFYRPSE

SEQ ID NO: 133160 - protein, 9 aa, West Nile virus
DVFYRPSEC

SEQ ID NO: 133161 - protein, 9 aa, West Nile virus
VFYRPSECC

SEQ ID NO: 133162 - protein, 9 aa, West Nile virus
FYRPSECCD

SEQ ID NO: 133163 - protein, 9 aa, West Nile virus
YRPSECCDT

SEQ ID NO: 133164 - protein, 9 aa, West Nile virus
RPSECCDTL

SEQ ID NO: 133165 - protein, 9 aa, West Nile virus
PSECCDTLL

SEQ ID NO: 133166 - protein, 9 aa, West Nile virus
SECCDTLLC

SEQ ID NO: 133167 - protein, 9 aa, West Nile virus
ECCDTLLCD

SEQ ID NO: 133168 - protein, 9 aa, West Nile virus
CCDTLLCDI

SEQ ID NO: 133169 - protein, 9 aa, West Nile virus
CDTLLCDIG

SEQ ID NO: 133170 - protein, 9 aa, West Nile virus
DTLLCDIGE

SEQ ID NO: 133171 - protein, 9 aa, West Nile virus
TLLCDIGES

SEQ ID NO: 133172 - protein, 9 aa, West Nile virus
LLCDIGESS

SEQ ID NO: 133173 - protein, 9 aa, West Nile virus
LCDIGESSS

SEQ ID NO: 133174 - protein, 9 aa, West Nile virus
CDIGESSSS

SEQ ID NO: 133175 - protein, 9 aa, West Nile virus
DIGESSSSA

SEQ ID NO: 133176 - protein, 9 aa, West Nile virus
IGESSSSAE

SEQ ID NO: 133177 - protein, 9 aa, West Nile virus
GESSSSAEV

SEQ ID NO: 133178 - protein, 9 aa, West Nile virus
ESSSSAEVE

SEQ ID NO: 133179 - protein, 9 aa, West Nile virus
SSSSAEVEE

SEQ ID NO: 133180 - protein, 9 aa, West Nile virus
SSSAEVEEH

SEQ ID NO: 133181 - protein, 9 aa, West Nile virus
SSAEVEEHR

SEQ ID NO: 133182 - protein, 9 aa, West Nile virus
SAEVEEHRT

SEQ ID NO: 133183 - protein, 9 aa, West Nile virus
AEVEEHRTI

SEQ ID NO: 133184 - protein, 9 aa, West Nile virus
EVEEHRTIR

SEQ ID NO: 133185 - protein, 9 aa, West Nile virus
VEEHRTIRV

SEQ ID NO: 133186 - protein, 9 aa, West Nile virus
EEHRTIRVL

SEQ ID NO: 133187 - protein, 9 aa, West Nile virus
EHRTIRVLE

SEQ ID NO: 133188 - protein, 9 aa, West Nile virus
HRTIRVLEM

SEQ ID NO: 133189 - protein, 9 aa, West Nile virus
RTIRVLEMV

SEQ ID NO: 133190 - protein, 9 aa, West Nile virus
TIRVLEMVE

SEQ ID NO: 133191 - protein, 9 aa, West Nile virus
IRVLEMVED

SEQ ID NO: 133192 - protein, 9 aa, West Nile virus
RVLEMVEDW

SEQ ID NO: 133193 - protein, 9 aa, West Nile virus
VLEMVEDWL

SEQ ID NO: 133194 - protein, 9 aa, West Nile virus
LEMVEDWLH

SEQ ID NO: 133195 - protein, 9 aa, West Nile virus
EMVEDWLHR

SEQ ID NO: 133196 - protein, 9 aa, West Nile virus
MVEDWLHRG

SEQ ID NO: 133197 - protein, 9 aa, West Nile virus
VEDWLHRGP

SEQ ID NO: 133198 - protein, 9 aa, West Nile virus
EDWLHRGPR

SEQ ID NO: 133199 - protein, 9 aa, West Nile virus
DWLHRGPRE

SEQ ID NO: 133200 - protein, 9 aa, West Nile virus
WLHRGPREF

SEQ ID NO: 133201 - protein, 9 aa, West Nile virus
LHRGPREFC

SEQ ID NO: 133202 - protein, 9 aa, West Nile virus
HRGPREFCV

SEQ ID NO: 133203 - protein, 9 aa, West Nile virus
RGPREFCVK

SEQ ID NO: 133204 - protein, 9 aa, West Nile virus
GPREFCVKV

SEQ ID NO: 133205 - protein, 9 aa, West Nile virus
PREFCVKVL

SEQ ID NO: 133206 - protein, 9 aa, West Nile virus
REFCVKVLC

SEQ ID NO: 133207 - protein, 9 aa, West Nile virus
EFCVKVLCP

SEQ ID NO: 133208 - protein, 9 aa, West Nile virus
FCVKVLCPY

SEQ ID NO: 133209 - protein, 9 aa, West Nile virus
CVKVLCPYM

SEQ ID NO: 133210 - protein, 9 aa, West Nile virus
VKVLCPYMP

SEQ ID NO: 133211 - protein, 9 aa, West Nile virus
KVLCPYMPK

SEQ ID NO: 133212 - protein, 9 aa, West Nile virus
VLCPYMPKV

SEQ ID NO: 133213 - protein, 9 aa, West Nile virus
LCPYMPKVI

SEQ ID NO: 133214 - protein, 9 aa, West Nile virus
CPYMPKVIE

SEQ ID NO: 133215 - protein, 9 aa, West Nile virus
PYMPKVIEK

SEQ ID NO: 133216 - protein, 9 aa, West Nile virus
YMPKVIEKM

SEQ ID NO: 133217 - protein, 9 aa, West Nile virus
MPKVIEKME

SEQ ID NO: 133218 - protein, 9 aa, West Nile virus
PKVIEKMEL

SEQ ID NO: 133219 - protein, 9 aa, West Nile virus
KVIEKMELL

SEQ ID NO: 133220 - protein, 9 aa, West Nile virus
VIEKMELLQ

SEQ ID NO: 133221 - protein, 9 aa, West Nile virus
IEKMELLQR

SEQ ID NO: 133222 - protein, 9 aa, West Nile virus
EKMELLQRR

SEQ ID NO: 133223 - protein, 9 aa, West Nile virus
KMELLQRRY

SEQ ID NO: 133224 - protein, 9 aa, West Nile virus
MELLQRRYG

SEQ ID NO: 133225 - protein, 9 aa, West Nile virus
ELLQRRYGG

SEQ ID NO: 133226 - protein, 9 aa, West Nile virus
LLQRRYGGG

SEQ ID NO: 133227 - protein, 9 aa, West Nile virus
LQRRYGGGL

SEQ ID NO: 133228 - protein, 9 aa, West Nile virus
QRRYGGGLV

SEQ ID NO: 133229 - protein, 9 aa, West Nile virus
RRYGGGLVR

SEQ ID NO: 133230 - protein, 9 aa, West Nile virus
RYGGGLVRN

SEQ ID NO: 133231 - protein, 9 aa, West Nile virus
YGGGLVRNP

SEQ ID NO: 133232 - protein, 9 aa, West Nile virus
GGGLVRNPL

SEQ ID NO: 133233 - protein, 9 aa, West Nile virus
GGLVRNPLS

SEQ ID NO: 133234 - protein, 9 aa, West Nile virus
GLVRNPLSR

SEQ ID NO: 133235 - protein, 9 aa, West Nile virus
LVRNPLSRN

SEQ ID NO: 133236 - protein, 9 aa, West Nile virus
VRNPLSRNS

SEQ ID NO: 133237 - protein, 9 aa, West Nile virus
RNPLSRNST

SEQ ID NO: 133238 - protein, 9 aa, West Nile virus
NPLSRNSTH

SEQ ID NO: 133239 - protein, 9 aa, West Nile virus
PLSRNSTHE

SEQ ID NO: 133240 - protein, 9 aa, West Nile virus
LSRNSTHEM

SEQ ID NO: 133241 - protein, 9 aa, West Nile virus
SRNSTHEMY

SEQ ID NO: 133242 - protein, 9 aa, West Nile virus
RNSTHEMYW

SEQ ID NO: 133243 - protein, 9 aa, West Nile virus
NSTHEMYWV

SEQ ID NO: 133244 - protein, 9 aa, West Nile virus
STHEMYWVS

SEQ ID NO: 133245 - protein, 9 aa, West Nile virus
THEMYWVSR

SEQ ID NO: 133246 - protein, 9 aa, West Nile virus
HEMYWVSRA

SEQ ID NO: 133247 - protein, 9 aa, West Nile virus
EMYWVSRAS

SEQ ID NO: 133248 - protein, 9 aa, West Nile virus
MYWVSRASG

SEQ ID NO: 133249 - protein, 9 aa, West Nile virus
YWVSRASGN

SEQ ID NO: 133250 - protein, 9 aa, West Nile virus
WVSRASGNV

SEQ ID NO: 133251 - protein, 9 aa, West Nile virus
VSRASGNVV

SEQ ID NO: 133252 - protein, 9 aa, West Nile virus
SRASGNVVH

SEQ ID NO: 133253 - protein, 9 aa, West Nile virus
NVVHSVNMT

SEQ ID NO: 133254 - protein, 9 aa, West Nile virus
VVHSVNMTS

SEQ ID NO: 133255 - protein, 9 aa, West Nile virus
VHSVNMTSQ

SEQ ID NO: 133256 - protein, 9 aa, West Nile virus
HSVNMTSQV

SEQ ID NO: 133257 - protein, 9 aa, West Nile virus
SVNMTSQVL

SEQ ID NO: 133258 - protein, 9 aa, West Nile virus
VNMTSQVLL

SEQ ID NO: 133259 - protein, 9 aa, West Nile virus
NMTSQVLLG

SEQ ID NO: 133260 - protein, 9 aa, West Nile virus
MTSQVLLGR

SEQ ID NO: 133261 - protein, 9 aa, West Nile virus
TSQVLLGRM

SEQ ID NO: 133262 - protein, 9 aa, West Nile virus
SQVLLGRME

SEQ ID NO: 133263 - protein, 9 aa, West Nile virus
QVLLGRMEK

SEQ ID NO: 133264 - protein, 9 aa, West Nile virus
VLLGRMEKR

SEQ ID NO: 133265 - protein, 9 aa, West Nile virus
LLGRMEKRT

SEQ ID NO: 133266 - protein, 9 aa, West Nile virus
LGRMEKRTW

SEQ ID NO: 133267 - protein, 9 aa, West Nile virus
GRMEKRTWK

SEQ ID NO: 133268 - protein, 9 aa, West Nile virus
RMEKRTWKG

SEQ ID NO: 133269 - protein, 9 aa, West Nile virus
MEKRTWKGP

SEQ ID NO: 133270 - protein, 9 aa, West Nile virus
EKRTWKGPQ

SEQ ID NO: 133271 - protein, 9 aa, West Nile virus
KRTWKGPQY

SEQ ID NO: 133272 - protein, 9 aa, West Nile virus
RTWKGPQYE

SEQ ID NO: 133273 - protein, 9 aa, West Nile virus
TWKGPQYEE

SEQ ID NO: 133274 - protein, 9 aa, West Nile virus
WKGPQYEED

SEQ ID NO: 133275 - protein, 9 aa, West Nile virus
KGPQYEEDV

SEQ ID NO: 133276 - protein, 9 aa, West Nile virus
GPQYEEDVN

SEQ ID NO: 133277 - protein, 9 aa, West Nile virus
PQYEEDVNL

SEQ ID NO: 133278 - protein, 9 aa, West Nile virus
QYEEDVNLG

SEQ ID NO: 133279 - protein, 9 aa, West Nile virus
YEEDVNLGS

SEQ ID NO: 133280 - protein, 9 aa, West Nile virus
EEDVNLGSG

SEQ ID NO: 133281 - protein, 9 aa, West Nile virus
EDVNLGSGT

SEQ ID NO: 133282 - protein, 9 aa, West Nile virus
DVNLGSGTR

SEQ ID NO: 133283 - protein, 9 aa, West Nile virus
VNLGSGTRA

SEQ ID NO: 133284 - protein, 9 aa, West Nile virus
NLGSGTRAV

SEQ ID NO: 133285 - protein, 9 aa, West Nile virus
LGSGTRAVG

SEQ ID NO: 133286 - protein, 9 aa, West Nile virus
GSGTRAVGK

SEQ ID NO: 133287 - protein, 9 aa, West Nile virus
SGTRAVGKP

SEQ ID NO: 133288 - protein, 9 aa, West Nile virus
GTRAVGKPL

SEQ ID NO: 133289 - protein, 9 aa, West Nile virus
TRAVGKPLL

SEQ ID NO: 133290 - protein, 9 aa, West Nile virus
RAVGKPLLN

SEQ ID NO: 133291 - protein, 9 aa, West Nile virus
AVGKPLLNS

SEQ ID NO: 133292 - protein, 9 aa, West Nile virus
VGKPLLNSD

SEQ ID NO: 133293 - protein, 9 aa, West Nile virus
GKPLLNSDT

SEQ ID NO: 133294 - protein, 9 aa, West Nile virus
KPLLNSDTS

SEQ ID NO: 133295 - protein, 9 aa, West Nile virus
PLLNSDTSK

SEQ ID NO: 133296 - protein, 9 aa, West Nile virus
LLNSDTSKI

SEQ ID NO: 133297 - protein, 9 aa, West Nile virus
LNSDTSKIK

SEQ ID NO: 133298 - protein, 9 aa, West Nile virus
SDTSKIKNR

SEQ ID NO: 133299 - protein, 9 aa, West Nile virus
NRIERLRRE

SEQ ID NO: 133300 - protein, 9 aa, West Nile virus
RIERLRREY

SEQ ID NO: 133301 - protein, 9 aa, West Nile virus
IERLRREYS

SEQ ID NO: 133302 - protein, 9 aa, West Nile virus
DENHPYRTW

SEQ ID NO: 133303 - protein, 9 aa, West Nile virus
ENHPYRTWN

SEQ ID NO: 133304 - protein, 9 aa, West Nile virus
NHPYRTWNY

SEQ ID NO: 133305 - protein, 9 aa, West Nile virus
HPYRTWNYH

SEQ ID NO: 133306 - protein, 9 aa, West Nile virus
PYRTWNYHG

SEQ ID NO: 133307 - protein, 9 aa, West Nile virus
YRTWNYHGS

SEQ ID NO: 133308 - protein, 9 aa, West Nile virus
RTWNYHGSY

SEQ ID NO: 133309 - protein, 9 aa, West Nile virus
TWNYHGSYD

SEQ ID NO: 133310 - protein, 9 aa, West Nile virus
WNYHGSYDV

SEQ ID NO: 133311 - protein, 9 aa, West Nile virus
NYHGSYDVK

SEQ ID NO: 133312 - protein, 9 aa, West Nile virus
YHGSYDVKP

SEQ ID NO: 133313 - protein, 9 aa, West Nile virus
HGSYDVKPT

SEQ ID NO: 133314 - protein, 9 aa, West Nile virus
GSYDVKPTG

SEQ ID NO: 133315 - protein, 9 aa, West Nile virus
SYDVKPTGS

SEQ ID NO: 133316 - protein, 9 aa, West Nile virus
YDVKPTGSA

SEQ ID NO: 133317 - protein, 9 aa, West Nile virus
DVKPTGSAS

SEQ ID NO: 133318 - protein, 9 aa, West Nile virus
VKPTGSASS

SEQ ID NO: 133319 - protein, 9 aa, West Nile virus
KPTGSASSL

SEQ ID NO: 133320 - protein, 9 aa, West Nile virus
PTGSASSLV

SEQ ID NO: 133321 - protein, 9 aa, West Nile virus
TGSASSLVN

SEQ ID NO: 133322 - protein, 9 aa, West Nile virus
GSASSLVNG

SEQ ID NO: 133323 - protein, 9 aa, West Nile virus
SASSLVNGV

SEQ ID NO: 133324 - protein, 9 aa, West Nile virus
ASSLVNGVV

SEQ ID NO: 133325 - protein, 9 aa, West Nile virus
SSLVNGVVR

SEQ ID NO: 133326 - protein, 9 aa, West Nile virus
SLVNGVVRL

SEQ ID NO: 133327 - protein, 9 aa, West Nile virus
LVNGVVRLL

SEQ ID NO: 133328 - protein, 9 aa, West Nile virus
VNGVVRLLS

SEQ ID NO: 133329 - protein, 9 aa, West Nile virus
NGVVRLLSK

SEQ ID NO: 133330 - protein, 9 aa, West Nile virus
GVVRLLSKP

SEQ ID NO: 133331 - protein, 9 aa, West Nile virus
VVRLLSKPW

SEQ ID NO: 133332 - protein, 9 aa, West Nile virus
VRLLSKPWD

SEQ ID NO: 133333 - protein, 9 aa, West Nile virus
RLLSKPWDT

SEQ ID NO: 133334 - protein, 9 aa, West Nile virus
LLSKPWDTI

SEQ ID NO: 133335 - protein, 9 aa, West Nile virus
LSKPWDTIT

SEQ ID NO: 133336 - protein, 9 aa, West Nile virus
SKPWDTITN

SEQ ID NO: 133337 - protein, 9 aa, West Nile virus
KPWDTITNV

SEQ ID NO: 133338 - protein, 9 aa, West Nile virus
PWDTITNVT

SEQ ID NO: 133339 - protein, 9 aa, West Nile virus
WDTITNVTT

SEQ ID NO: 133340 - protein, 9 aa, West Nile virus
DTITNVTTM

SEQ ID NO: 133341 - protein, 9 aa, West Nile virus
TITNVTTMA

SEQ ID NO: 133342 - protein, 9 aa, West Nile virus
ITNVTTMAM

SEQ ID NO: 133343 - protein, 9 aa, West Nile virus
TNVTTMAMT

SEQ ID NO: 133344 - protein, 9 aa, West Nile virus
NVTTMAMTD

SEQ ID NO: 133345 - protein, 9 aa, West Nile virus
VTTMAMTDT

SEQ ID NO: 133346 - protein, 9 aa, West Nile virus
TTMAMTDTT

SEQ ID NO: 133347 - protein, 9 aa, West Nile virus
TMAMTDTTP

SEQ ID NO: 133348 - protein, 9 aa, West Nile virus
MAMTDTTPF

SEQ ID NO: 133349 - protein, 9 aa, West Nile virus
AMTDTTPFG

SEQ ID NO: 133350 - protein, 9 aa, West Nile virus
MTDTTPFGQ

SEQ ID NO: 133351 - protein, 9 aa, West Nile virus
TDTTPFGQQ

SEQ ID NO: 133352 - protein, 9 aa, West Nile virus
DTTPFGQQR

SEQ ID NO: 133353 - protein, 9 aa, West Nile virus
TTPFGQQRV

SEQ ID NO: 133354 - protein, 9 aa, West Nile virus
TPFGQQRVF

SEQ ID NO: 133355 - protein, 9 aa, West Nile virus
PFGQQRVFK

SEQ ID NO: 133356 - protein, 9 aa, West Nile virus
FGQQRVFKE

SEQ ID NO: 133357 - protein, 9 aa, West Nile virus
GQQRVFKEK

SEQ ID NO: 133358 - protein, 9 aa, West Nile virus
QQRVFKEKV

SEQ ID NO: 133359 - protein, 9 aa, West Nile virus
QRVFKEKVD

SEQ ID NO: 133360 - protein, 9 aa, West Nile virus
RVFKEKVDT

SEQ ID NO: 133361 - protein, 9 aa, West Nile virus
VFKEKVDTK

SEQ ID NO: 133362 - protein, 9 aa, West Nile virus
FKEKVDTKA

SEQ ID NO: 133363 - protein, 9 aa, West Nile virus
KEKVDTKAP

SEQ ID NO: 133364 - protein, 9 aa, West Nile virus
EKVDTKAPE

SEQ ID NO: 133365 - protein, 9 aa, West Nile virus
KVDTKAPEP

SEQ ID NO: 133366 - protein, 9 aa, West Nile virus
VDTKAPEPP

SEQ ID NO: 133367 - protein, 9 aa, West Nile virus
DTKAPEPPE

SEQ ID NO: 133368 - protein, 9 aa, West Nile virus
TKAPEPPEG

SEQ ID NO: 133369 - protein, 9 aa, West Nile virus
KAPEPPEGV

SEQ ID NO: 133370 - protein, 9 aa, West Nile virus
APEPPEGVK

SEQ ID NO: 133371 - protein, 9 aa, West Nile virus
VLNETTNWL

SEQ ID NO: 133372 - protein, 9 aa, West Nile virus
LNETTNWLW

SEQ ID NO: 133373 - protein, 9 aa, West Nile virus
NETTNWLWA

SEQ ID NO: 133374 - protein, 9 aa, West Nile virus
ETTNWLWAF

SEQ ID NO: 133375 - protein, 9 aa, West Nile virus
TTNWLWAFL

SEQ ID NO: 133376 - protein, 9 aa, West Nile virus
TNWLWAFLA

SEQ ID NO: 133377 - protein, 9 aa, West Nile virus
NWLWAFLAR

SEQ ID NO: 133378 - protein, 9 aa, West Nile virus
REKRPRMCS

SEQ ID NO: 133379 - protein, 9 aa, West Nile virus
EKRPRMCSR

SEQ ID NO: 133380 - protein, 9 aa, West Nile virus
KRPRMCSRE

SEQ ID NO: 133381 - protein, 9 aa, West Nile virus
RPRMCSREE

SEQ ID NO: 133382 - protein, 9 aa, West Nile virus
PRMCSREEF

SEQ ID NO: 133383 - protein, 9 aa, West Nile virus
RMCSREEFI

SEQ ID NO: 133384 - protein, 9 aa, West Nile virus
MCSREEFIR

SEQ ID NO: 133385 - protein, 9 aa, West Nile virus
CSREEFIRK

SEQ ID NO: 133386 - protein, 9 aa, West Nile virus
SREEFIRKV

SEQ ID NO: 133387 - protein, 9 aa, West Nile virus
REEFIRKVN

SEQ ID NO: 133388 - protein, 9 aa, West Nile virus
EEFIRKVNS

SEQ ID NO: 133389 - protein, 9 aa, West Nile virus
EFIRKVNSN

SEQ ID NO: 133390 - protein, 9 aa, West Nile virus
FIRKVNSNA

SEQ ID NO: 133391 - protein, 9 aa, West Nile virus
IRKVNSNAA

SEQ ID NO: 133392 - protein, 9 aa, West Nile virus
RKVNSNAAL

SEQ ID NO: 133393 - protein, 9 aa, West Nile virus
KVNSNAALG

SEQ ID NO: 133394 - protein, 9 aa, West Nile virus
VNSNAALGA

SEQ ID NO: 133395 - protein, 9 aa, West Nile virus
NSNAALGAM

SEQ ID NO: 133396 - protein, 9 aa, West Nile virus
SNAALGAMF

SEQ ID NO: 133397 - protein, 9 aa, West Nile virus
NAALGAMFE

SEQ ID NO: 133398 - protein, 9 aa, West Nile virus
AALGAMFEE

SEQ ID NO: 133399 - protein, 9 aa, West Nile virus
ALGAMFEEQ

SEQ ID NO: 133400 - protein, 9 aa, West Nile virus
LGAMFEEQN

SEQ ID NO: 133401 - protein, 9 aa, West Nile virus
GAMFEEQNQ

SEQ ID NO: 133402 - protein, 9 aa, West Nile virus
AMFEEQNQW

SEQ ID NO: 133403 - protein, 9 aa, West Nile virus
MFEEQNQWR

SEQ ID NO: 133404 - protein, 9 aa, West Nile virus
FEEQNQWRS

SEQ ID NO: 133405 - protein, 9 aa, West Nile virus
EEQNQWRSA

SEQ ID NO: 133406 - protein, 9 aa, West Nile virus
EQNQWRSAR

SEQ ID NO: 133407 - protein, 9 aa, West Nile virus
QNQWRSARE

SEQ ID NO: 133408 - protein, 9 aa, West Nile virus
NQWRSAREA

SEQ ID NO: 133409 - protein, 9 aa, West Nile virus
QWRSAREAV

SEQ ID NO: 133410 - protein, 9 aa, West Nile virus
WRSAREAVE

SEQ ID NO: 133411 - protein, 9 aa, West Nile virus
RSAREAVED

SEQ ID NO: 133412 - protein, 9 aa, West Nile virus
SAREAVEDP

SEQ ID NO: 133413 - protein, 9 aa, West Nile virus
AREAVEDPK

SEQ ID NO: 133414 - protein, 9 aa, West Nile virus
REAVEDPKF

SEQ ID NO: 133415 - protein, 9 aa, West Nile virus
EAVEDPKFW

SEQ ID NO: 133416 - protein, 9 aa, West Nile virus
AVEDPKFWE

SEQ ID NO: 133417 - protein, 9 aa, West Nile virus
VEDPKFWEM

SEQ ID NO: 133418 - protein, 9 aa, West Nile virus
EDPKFWEMV

SEQ ID NO: 133419 - protein, 9 aa, West Nile virus
DPKFWEMVD

SEQ ID NO: 133420 - protein, 9 aa, West Nile virus
PKFWEMVDE

SEQ ID NO: 133421 - protein, 9 aa, West Nile virus
KFWEMVDEE

SEQ ID NO: 133422 - protein, 9 aa, West Nile virus
FWEMVDEER

SEQ ID NO: 133423 - protein, 9 aa, West Nile virus
WEMVDEERE

SEQ ID NO: 133424 - protein, 9 aa, West Nile virus
EMVDEEREA

SEQ ID NO: 133425 - protein, 9 aa, West Nile virus
MVDEEREAH

SEQ ID NO: 133426 - protein, 9 aa, West Nile virus
VDEEREAHL

SEQ ID NO: 133427 - protein, 9 aa, West Nile virus
DEEREAHLR

SEQ ID NO: 133428 - protein, 9 aa, West Nile virus
EEREAHLRG

SEQ ID NO: 133429 - protein, 9 aa, West Nile virus
EREAHLRGE

SEQ ID NO: 133430 - protein, 9 aa, West Nile virus
REAHLRGEC

SEQ ID NO: 133431 - protein, 9 aa, West Nile virus
EAHLRGECH

SEQ ID NO: 133432 - protein, 9 aa, West Nile virus
AHLRGECHT

SEQ ID NO: 133433 - protein, 9 aa, West Nile virus
HLRGECHTC

SEQ ID NO: 133434 - protein, 9 aa, West Nile virus
LRGECHTCI

SEQ ID NO: 133435 - protein, 9 aa, West Nile virus
RGECHTCIY

SEQ ID NO: 133436 - protein, 9 aa, West Nile virus
GECHTCIYN

SEQ ID NO: 133437 - protein, 9 aa, West Nile virus
ECHTCIYNM

SEQ ID NO: 133438 - protein, 9 aa, West Nile virus
CHTCIYNMM

SEQ ID NO: 133439 - protein, 9 aa, West Nile virus
HTCIYNMMG

SEQ ID NO: 133440 - protein, 9 aa, West Nile virus
TCIYNMMGK

SEQ ID NO: 133441 - protein, 9 aa, West Nile virus
CIYNMMGKR

SEQ ID NO: 133442 - protein, 9 aa, West Nile virus
IYNMMGKRE

SEQ ID NO: 133443 - protein, 9 aa, West Nile virus
YNMMGKREK

SEQ ID NO: 133444 - protein, 9 aa, West Nile virus
NMMGKREKK

SEQ ID NO: 133445 - protein, 9 aa, West Nile virus
MMGKREKKP

SEQ ID NO: 133446 - protein, 9 aa, West Nile virus
MGKREKKPG

SEQ ID NO: 133447 - protein, 9 aa, West Nile virus
GKREKKPGE

SEQ ID NO: 133448 - protein, 9 aa, West Nile virus
KREKKPGEF

SEQ ID NO: 133449 - protein, 9 aa, West Nile virus
REKKPGEFG

SEQ ID NO: 133450 - protein, 9 aa, West Nile virus
EKKPGEFGK

SEQ ID NO: 133451 - protein, 9 aa, West Nile virus
KKPGEFGKA

SEQ ID NO: 133452 - protein, 9 aa, West Nile virus
KPGEFGKAK

SEQ ID NO: 133453 - protein, 9 aa, West Nile virus
PGEFGKAKG

SEQ ID NO: 133454 - protein, 9 aa, West Nile virus
GEFGKAKGS

SEQ ID NO: 133455 - protein, 9 aa, West Nile virus
EFGKAKGSR

SEQ ID NO: 133456 - protein, 9 aa, West Nile virus
FGKAKGSRA

SEQ ID NO: 133457 - protein, 9 aa, West Nile virus
GKAKGSRAI

SEQ ID NO: 133458 - protein, 9 aa, West Nile virus
KAKGSRAIW

SEQ ID NO: 133459 - protein, 9 aa, West Nile virus
AKGSRAIWF

SEQ ID NO: 133460 - protein, 9 aa, West Nile virus
KGSRAIWFM

SEQ ID NO: 133461 - protein, 9 aa, West Nile virus
GSRAIWFMW

SEQ ID NO: 133462 - protein, 9 aa, West Nile virus
SRAIWFMWL

SEQ ID NO: 133463 - protein, 9 aa, West Nile virus
RAIWFMWLG

SEQ ID NO: 133464 - protein, 9 aa, West Nile virus
AIWFMWLGA

SEQ ID NO: 133465 - protein, 9 aa, West Nile virus
IWFMWLGAR

SEQ ID NO: 133466 - protein, 9 aa, West Nile virus
WFMWLGARF

SEQ ID NO: 133467 - protein, 9 aa, West Nile virus
FMWLGARFL

SEQ ID NO: 133468 - protein, 9 aa, West Nile virus
MWLGARFLE

SEQ ID NO: 133469 - protein, 9 aa, West Nile virus
WLGARFLEF

SEQ ID NO: 133470 - protein, 9 aa, West Nile virus
LGARFLEFE

SEQ ID NO: 133471 - protein, 9 aa, West Nile virus
GARFLEFEA

SEQ ID NO: 133472 - protein, 9 aa, West Nile virus
ARFLEFEAL

SEQ ID NO: 133473 - protein, 9 aa, West Nile virus
RFLEFEALG

SEQ ID NO: 133474 - protein, 9 aa, West Nile virus
FLEFEALGF

SEQ ID NO: 133475 - protein, 9 aa, West Nile virus
LEFEALGFL

SEQ ID NO: 133476 - protein, 9 aa, West Nile virus
EFEALGFLN

SEQ ID NO: 133477 - protein, 9 aa, West Nile virus
FEALGFLNE

SEQ ID NO: 133478 - protein, 9 aa, West Nile virus
EALGFLNED

SEQ ID NO: 133479 - protein, 9 aa, West Nile virus
ALGFLNEDH

SEQ ID NO: 133480 - protein, 9 aa, West Nile virus
LGFLNEDHW

SEQ ID NO: 133481 - protein, 9 aa, West Nile virus
GFLNEDHWL

SEQ ID NO: 133482 - protein, 9 aa, West Nile virus
FLNEDHWLG

SEQ ID NO: 133483 - protein, 9 aa, West Nile virus
LNEDHWLGR

SEQ ID NO: 133484 - protein, 9 aa, West Nile virus
NEDHWLGRK

SEQ ID NO: 133485 - protein, 9 aa, West Nile virus
EDHWLGRKN

SEQ ID NO: 133486 - protein, 9 aa, West Nile virus
DHWLGRKNS

SEQ ID NO: 133487 - protein, 9 aa, West Nile virus
HWLGRKNSG

SEQ ID NO: 133488 - protein, 9 aa, West Nile virus
WLGRKNSGG

SEQ ID NO: 133489 - protein, 9 aa, West Nile virus
LGRKNSGGG

SEQ ID NO: 133490 - protein, 9 aa, West Nile virus
GRKNSGGGV

SEQ ID NO: 133491 - protein, 9 aa, West Nile virus
RKNSGGGVE

SEQ ID NO: 133492 - protein, 9 aa, West Nile virus
KNSGGGVEG

SEQ ID NO: 133493 - protein, 9 aa, West Nile virus
NSGGGVEGL

SEQ ID NO: 133494 - protein, 9 aa, West Nile virus
SGGGVEGLG

SEQ ID NO: 133495 - protein, 9 aa, West Nile virus
GGGVEGLGL

SEQ ID NO: 133496 - protein, 9 aa, West Nile virus
GGVEGLGLQ

SEQ ID NO: 133497 - protein, 9 aa, West Nile virus
GVEGLGLQK

SEQ ID NO: 133498 - protein, 9 aa, West Nile virus
VEGLGLQKL

SEQ ID NO: 133499 - protein, 9 aa, West Nile virus
EGLGLQKLG

SEQ ID NO: 133500 - protein, 9 aa, West Nile virus
GLGLQKLGY

SEQ ID NO: 133501 - protein, 9 aa, West Nile virus
LGLQKLGYI

SEQ ID NO: 133502 - protein, 9 aa, West Nile virus
GLQKLGYIL

SEQ ID NO: 133503 - protein, 9 aa, West Nile virus
LQKLGYILR

SEQ ID NO: 133504 - protein, 9 aa, West Nile virus
QKLGYILRE

SEQ ID NO: 133505 - protein, 9 aa, West Nile virus
KLGYILREV

SEQ ID NO: 133506 - protein, 9 aa, West Nile virus
LGYILREVG

SEQ ID NO: 133507 - protein, 9 aa, West Nile virus
GGKIYADDT

SEQ ID NO: 133508 - protein, 9 aa, West Nile virus
GKIYADDTA

SEQ ID NO: 133509 - protein, 9 aa, West Nile virus
KIYADDTAG

SEQ ID NO: 133510 - protein, 9 aa, West Nile virus
IYADDTAGW

SEQ ID NO: 133511 - protein, 9 aa, West Nile virus
YADDTAGWD

SEQ ID NO: 133512 - protein, 9 aa, West Nile virus
ADDTAGWDT

SEQ ID NO: 133513 - protein, 9 aa, West Nile virus
DDTAGWDTR

SEQ ID NO: 133514 - protein, 9 aa, West Nile virus
DTAGWDTRI

SEQ ID NO: 133515 - protein, 9 aa, West Nile virus
TAGWDTRIT

SEQ ID NO: 133516 - protein, 9 aa, West Nile virus
AGWDTRITR

SEQ ID NO: 133517 - protein, 9 aa, West Nile virus
GWDTRITRA

SEQ ID NO: 133518 - protein, 9 aa, West Nile virus
WDTRITRAD

SEQ ID NO: 133519 - protein, 9 aa, West Nile virus
DTRITRADL

SEQ ID NO: 133520 - protein, 9 aa, West Nile virus
TRITRADLE

SEQ ID NO: 133521 - protein, 9 aa, West Nile virus
RITRADLEN

SEQ ID NO: 133522 - protein, 9 aa, West Nile virus
ITRADLENE

SEQ ID NO: 133523 - protein, 9 aa, West Nile virus
TRADLENEA

SEQ ID NO: 133524 - protein, 9 aa, West Nile virus
RADLENEAK

SEQ ID NO: 133525 - protein, 9 aa, West Nile virus
ADLENEAKV

SEQ ID NO: 133526 - protein, 9 aa, West Nile virus
DLENEAKVL

SEQ ID NO: 133527 - protein, 9 aa, West Nile virus
LENEAKVLE

SEQ ID NO: 133528 - protein, 9 aa, West Nile virus
ENEAKVLEL

SEQ ID NO: 133529 - protein, 9 aa, West Nile virus
NEAKVLELL

SEQ ID NO: 133530 - protein, 9 aa, West Nile virus
EAKVLELLD

SEQ ID NO: 133531 - protein, 9 aa, West Nile virus
AKVLELLDG

SEQ ID NO: 133532 - protein, 9 aa, West Nile virus
KVLELLDGE

SEQ ID NO: 133533 - protein, 9 aa, West Nile virus
VLELLDGEH

SEQ ID NO: 133534 - protein, 9 aa, West Nile virus
LELLDGEHR

SEQ ID NO: 133535 - protein, 9 aa, West Nile virus
ELLDGEHRR

SEQ ID NO: 133536 - protein, 9 aa, West Nile virus
LLDGEHRRL

SEQ ID NO: 133537 - protein, 9 aa, West Nile virus
LDGEHRRLA

SEQ ID NO: 133538 - protein, 9 aa, West Nile virus
DGEHRRLAR

SEQ ID NO: 133539 - protein, 9 aa, West Nile virus
GEHRRLARA

SEQ ID NO: 133540 - protein, 9 aa, West Nile virus
EHRRLARAI

SEQ ID NO: 133541 - protein, 9 aa, West Nile virus
HRRLARAII

SEQ ID NO: 133542 - protein, 9 aa, West Nile virus
RRLARAIIE

SEQ ID NO: 133543 - protein, 9 aa, West Nile virus
RLARAIIEL

SEQ ID NO: 133544 - protein, 9 aa, West Nile virus
LARAIIELT

SEQ ID NO: 133545 - protein, 9 aa, West Nile virus
ARAIIELTY

SEQ ID NO: 133546 - protein, 9 aa, West Nile virus
RAIIELTYR

SEQ ID NO: 133547 - protein, 9 aa, West Nile virus
AIIELTYRH

SEQ ID NO: 133548 - protein, 9 aa, West Nile virus
IIELTYRHK

SEQ ID NO: 133549 - protein, 9 aa, West Nile virus
IELTYRHKV

SEQ ID NO: 133550 - protein, 9 aa, West Nile virus
ELTYRHKVV

SEQ ID NO: 133551 - protein, 9 aa, West Nile virus
LTYRHKVVK

SEQ ID NO: 133552 - protein, 9 aa, West Nile virus
TYRHKVVKV

SEQ ID NO: 133553 - protein, 9 aa, West Nile virus
YRHKVVKVM

SEQ ID NO: 133554 - protein, 9 aa, West Nile virus
RHKVVKVMR

SEQ ID NO: 133555 - protein, 9 aa, West Nile virus
HKVVKVMRP

SEQ ID NO: 133556 - protein, 9 aa, West Nile virus
KVVKVMRPA

SEQ ID NO: 133557 - protein, 9 aa, West Nile virus
VVKVMRPAA

SEQ ID NO: 133558 - protein, 9 aa, West Nile virus
VKVMRPAAD

SEQ ID NO: 133559 - protein, 9 aa, West Nile virus
KVMRPAADG

SEQ ID NO: 133560 - protein, 9 aa, West Nile virus
VMRPAADGR

SEQ ID NO: 133561 - protein, 9 aa, West Nile virus
MRPAADGRT

SEQ ID NO: 133562 - protein, 9 aa, West Nile virus
RPAADGRTV

SEQ ID NO: 133563 - protein, 9 aa, West Nile virus
PAADGRTVM

SEQ ID NO: 133564 - protein, 9 aa, West Nile virus
AADGRTVMD

SEQ ID NO: 133565 - protein, 9 aa, West Nile virus
ADGRTVMDV

SEQ ID NO: 133566 - protein, 9 aa, West Nile virus
DGRTVMDVI

SEQ ID NO: 133567 - protein, 9 aa, West Nile virus
GRTVMDVIS

SEQ ID NO: 133568 - protein, 9 aa, West Nile virus
RTVMDVISR

SEQ ID NO: 133569 - protein, 9 aa, West Nile virus
TVMDVISRE

SEQ ID NO: 133570 - protein, 9 aa, West Nile virus
VMDVISRED

SEQ ID NO: 133571 - protein, 9 aa, West Nile virus
MDVISREDQ

SEQ ID NO: 133572 - protein, 9 aa, West Nile virus
DVISREDQR

SEQ ID NO: 133573 - protein, 9 aa, West Nile virus
VISREDQRG

SEQ ID NO: 133574 - protein, 9 aa, West Nile virus
ISREDQRGS

SEQ ID NO: 133575 - protein, 9 aa, West Nile virus
SREDQRGSG

SEQ ID NO: 133576 - protein, 9 aa, West Nile virus
REDQRGSGQ

SEQ ID NO: 133577 - protein, 9 aa, West Nile virus
EDQRGSGQV

SEQ ID NO: 133578 - protein, 9 aa, West Nile virus
DQRGSGQVV

SEQ ID NO: 133579 - protein, 9 aa, West Nile virus
QRGSGQVVT

SEQ ID NO: 133580 - protein, 9 aa, West Nile virus
RGSGQVVTY

SEQ ID NO: 133581 - protein, 9 aa, West Nile virus
GSGQVVTYA

SEQ ID NO: 133582 - protein, 9 aa, West Nile virus
SGQVVTYAL

SEQ ID NO: 133583 - protein, 9 aa, West Nile virus
GQVVTYALN

SEQ ID NO: 133584 - protein, 9 aa, West Nile virus
QVVTYALNT

SEQ ID NO: 133585 - protein, 9 aa, West Nile virus
VVTYALNTF

SEQ ID NO: 133586 - protein, 9 aa, West Nile virus
VTYALNTFT

SEQ ID NO: 133587 - protein, 9 aa, West Nile virus
TYALNTFTN

SEQ ID NO: 133588 - protein, 9 aa, West Nile virus
YALNTFTNL

SEQ ID NO: 133589 - protein, 9 aa, West Nile virus
ALNTFTNLA

SEQ ID NO: 133590 - protein, 9 aa, West Nile virus
LNTFTNLAV

SEQ ID NO: 133591 - protein, 9 aa, West Nile virus
NTFTNLAVQ

SEQ ID NO: 133592 - protein, 9 aa, West Nile virus
TFTNLAVQL

SEQ ID NO: 133593 - protein, 9 aa, West Nile virus
FTNLAVQLV

SEQ ID NO: 133594 - protein, 9 aa, West Nile virus
TNLAVQLVR

SEQ ID NO: 133595 - protein, 9 aa, West Nile virus
NLAVQLVRM

SEQ ID NO: 133596 - protein, 9 aa, West Nile virus
LAVQLVRMM

SEQ ID NO: 133597 - protein, 9 aa, West Nile virus
AVQLVRMME

SEQ ID NO: 133598 - protein, 9 aa, West Nile virus
VQLVRMMEG

SEQ ID NO: 133599 - protein, 9 aa, West Nile virus
QLVRMMEGE

SEQ ID NO: 133600 - protein, 9 aa, West Nile virus
LVRMMEGEG

SEQ ID NO: 133601 - protein, 9 aa, West Nile virus
VRMMEGEGV

SEQ ID NO: 133602 - protein, 9 aa, West Nile virus
RMMEGEGVI

SEQ ID NO: 133603 - protein, 9 aa, West Nile virus
MMEGEGVIG

SEQ ID NO: 133604 - protein, 9 aa, West Nile virus
MEGEGVIGP

SEQ ID NO: 133605 - protein, 9 aa, West Nile virus
EGEGVIGPD

SEQ ID NO: 133606 - protein, 9 aa, West Nile virus
GEGVIGPDD

SEQ ID NO: 133607 - protein, 9 aa, West Nile virus
EGVIGPDDV

SEQ ID NO: 133608 - protein, 9 aa, West Nile virus
GVIGPDDVE

SEQ ID NO: 133609 - protein, 9 aa, West Nile virus
KGKGPKVRT

SEQ ID NO: 133610 - protein, 9 aa, West Nile virus
GKGPKVRTW

SEQ ID NO: 133611 - protein, 9 aa, West Nile virus
KGPKVRTWL

SEQ ID NO: 133612 - protein, 9 aa, West Nile virus
GPKVRTWLF

SEQ ID NO: 133613 - protein, 9 aa, West Nile virus
PKVRTWLFE

SEQ ID NO: 133614 - protein, 9 aa, West Nile virus
KVRTWLFEN

SEQ ID NO: 133615 - protein, 9 aa, West Nile virus
VRTWLFENG

SEQ ID NO: 133616 - protein, 9 aa, West Nile virus
RTWLFENGE

SEQ ID NO: 133617 - protein, 9 aa, West Nile virus
TWLFENGEE

SEQ ID NO: 133618 - protein, 9 aa, West Nile virus
WLFENGEER

SEQ ID NO: 133619 - protein, 9 aa, West Nile virus
LFENGEERL

SEQ ID NO: 133620 - protein, 9 aa, West Nile virus
FENGEERLS

SEQ ID NO: 133621 - protein, 9 aa, West Nile virus
ENGEERLSR

SEQ ID NO: 133622 - protein, 9 aa, West Nile virus
NGEERLSRM

SEQ ID NO: 133623 - protein, 9 aa, West Nile virus
GEERLSRMA

SEQ ID NO: 133624 - protein, 9 aa, West Nile virus
EERLSRMAV

SEQ ID NO: 133625 - protein, 9 aa, West Nile virus
ERLSRMAVS

SEQ ID NO: 133626 - protein, 9 aa, West Nile virus
RLSRMAVSG

SEQ ID NO: 133627 - protein, 9 aa, West Nile virus
LSRMAVSGD

SEQ ID NO: 133628 - protein, 9 aa, West Nile virus
SRMAVSGDD

SEQ ID NO: 133629 - protein, 9 aa, West Nile virus
RMAVSGDDC

SEQ ID NO: 133630 - protein, 9 aa, West Nile virus
MAVSGDDCV

SEQ ID NO: 133631 - protein, 9 aa, West Nile virus
AVSGDDCVV

SEQ ID NO: 133632 - protein, 9 aa, West Nile virus
VSGDDCVVK

SEQ ID NO: 133633 - protein, 9 aa, West Nile virus
SGDDCVVKP

SEQ ID NO: 133634 - protein, 9 aa, West Nile virus
GDDCVVKPL

SEQ ID NO: 133635 - protein, 9 aa, West Nile virus
DDCVVKPLD

SEQ ID NO: 133636 - protein, 9 aa, West Nile virus
DCVVKPLDD

SEQ ID NO: 133637 - protein, 9 aa, West Nile virus
CVVKPLDDR

SEQ ID NO: 133638 - protein, 9 aa, West Nile virus
VVKPLDDRF

SEQ ID NO: 133639 - protein, 9 aa, West Nile virus
VKPLDDRFA

SEQ ID NO: 133640 - protein, 9 aa, West Nile virus
KPLDDRFAT

SEQ ID NO: 133641 - protein, 9 aa, West Nile virus
PLDDRFATS

SEQ ID NO: 133642 - protein, 9 aa, West Nile virus
LDDRFATSL

SEQ ID NO: 133643 - protein, 9 aa, West Nile virus
DDRFATSLH

SEQ ID NO: 133644 - protein, 9 aa, West Nile virus
DRFATSLHF

SEQ ID NO: 133645 - protein, 9 aa, West Nile virus
RFATSLHFL

SEQ ID NO: 133646 - protein, 9 aa, West Nile virus
FATSLHFLN

SEQ ID NO: 133647 - protein, 9 aa, West Nile virus
ATSLHFLNA

SEQ ID NO: 133648 - protein, 9 aa, West Nile virus
TSLHFLNAM

SEQ ID NO: 133649 - protein, 9 aa, West Nile virus
SLHFLNAMS

SEQ ID NO: 133650 - protein, 9 aa, West Nile virus
LHFLNAMSK

SEQ ID NO: 133651 - protein, 9 aa, West Nile virus
HFLNAMSKV

SEQ ID NO: 133652 - protein, 9 aa, West Nile virus
FLNAMSKVR

SEQ ID NO: 133653 - protein, 9 aa, West Nile virus
LNAMSKVRK

SEQ ID NO: 133654 - protein, 9 aa, West Nile virus
NAMSKVRKD

SEQ ID NO: 133655 - protein, 9 aa, West Nile virus
AMSKVRKDI

SEQ ID NO: 133656 - protein, 9 aa, West Nile virus
MSKVRKDIQ

SEQ ID NO: 133657 - protein, 9 aa, West Nile virus
SKVRKDIQE

SEQ ID NO: 133658 - protein, 9 aa, West Nile virus
KVRKDIQEW

SEQ ID NO: 133659 - protein, 9 aa, West Nile virus
VRKDIQEWK

SEQ ID NO: 133660 - protein, 9 aa, West Nile virus
RKDIQEWKP

SEQ ID NO: 133661 - protein, 9 aa, West Nile virus
KDIQEWKPS

SEQ ID NO: 133662 - protein, 9 aa, West Nile virus
DIQEWKPST

SEQ ID NO: 133663 - protein, 9 aa, West Nile virus
IQEWKPSTG

SEQ ID NO: 133664 - protein, 9 aa, West Nile virus
QEWKPSTGW

SEQ ID NO: 133665 - protein, 9 aa, West Nile virus
EWKPSTGWY

SEQ ID NO: 133666 - protein, 9 aa, West Nile virus
WKPSTGWYD

SEQ ID NO: 133667 - protein, 9 aa, West Nile virus
KPSTGWYDW

SEQ ID NO: 133668 - protein, 9 aa, West Nile virus
PSTGWYDWQ

SEQ ID NO: 133669 - protein, 9 aa, West Nile virus
STGWYDWQQ

SEQ ID NO: 133670 - protein, 9 aa, West Nile virus
TGWYDWQQV

SEQ ID NO: 133671 - protein, 9 aa, West Nile virus
GWYDWQQVP

SEQ ID NO: 133672 - protein, 9 aa, West Nile virus
WYDWQQVPF

SEQ ID NO: 133673 - protein, 9 aa, West Nile virus
YDWQQVPFC

SEQ ID NO: 133674 - protein, 9 aa, West Nile virus
DWQQVPFCS

SEQ ID NO: 133675 - protein, 9 aa, West Nile virus
WQQVPFCSN

SEQ ID NO: 133676 - protein, 9 aa, West Nile virus
QQVPFCSNH

SEQ ID NO: 133677 - protein, 9 aa, West Nile virus
QVPFCSNHF

SEQ ID NO: 133678 - protein, 9 aa, West Nile virus
VPFCSNHFT

SEQ ID NO: 133679 - protein, 9 aa, West Nile virus
PFCSNHFTE

SEQ ID NO: 133680 - protein, 9 aa, West Nile virus
FCSNHFTEL

SEQ ID NO: 133681 - protein, 9 aa, West Nile virus
CSNHFTELI

SEQ ID NO: 133682 - protein, 9 aa, West Nile virus
SNHFTELIM

SEQ ID NO: 133683 - protein, 9 aa, West Nile virus
NHFTELIMK

SEQ ID NO: 133684 - protein, 9 aa, West Nile virus
HFTELIMKD

SEQ ID NO: 133685 - protein, 9 aa, West Nile virus
FTELIMKDG

SEQ ID NO: 133686 - protein, 9 aa, West Nile virus
TELIMKDGR

SEQ ID NO: 133687 - protein, 9 aa, West Nile virus
ELIMKDGRT

SEQ ID NO: 133688 - protein, 9 aa, West Nile virus
LIMKDGRTL

SEQ ID NO: 133689 - protein, 9 aa, West Nile virus
IMKDGRTLV

SEQ ID NO: 133690 - protein, 9 aa, West Nile virus
MKDGRTLVV

SEQ ID NO: 133691 - protein, 9 aa, West Nile virus
KDGRTLVVP

SEQ ID NO: 133692 - protein, 9 aa, West Nile virus
DGRTLVVPC

SEQ ID NO: 133693 - protein, 9 aa, West Nile virus
GRTLVVPCR

SEQ ID NO: 133694 - protein, 9 aa, West Nile virus
RTLVVPCRG

SEQ ID NO: 133695 - protein, 9 aa, West Nile virus
TLVVPCRGQ

SEQ ID NO: 133696 - protein, 9 aa, West Nile virus
LVVPCRGQD

SEQ ID NO: 133697 - protein, 9 aa, West Nile virus
VVPCRGQDE

SEQ ID NO: 133698 - protein, 9 aa, West Nile virus
VPCRGQDEL

SEQ ID NO: 133699 - protein, 9 aa, West Nile virus
PCRGQDELV

SEQ ID NO: 133700 - protein, 9 aa, West Nile virus
CRGQDELVG

SEQ ID NO: 133701 - protein, 9 aa, West Nile virus
RGQDELVGR

SEQ ID NO: 133702 - protein, 9 aa, West Nile virus
GQDELVGRA

SEQ ID NO: 133703 - protein, 9 aa, West Nile virus
QDELVGRAR

SEQ ID NO: 133704 - protein, 9 aa, West Nile virus
DELVGRARI

SEQ ID NO: 133705 - protein, 9 aa, West Nile virus
ELVGRARIS

SEQ ID NO: 133706 - protein, 9 aa, West Nile virus
LVGRARISP

SEQ ID NO: 133707 - protein, 9 aa, West Nile virus
VGRARISPG

SEQ ID NO: 133708 - protein, 9 aa, West Nile virus
GRARISPGA

SEQ ID NO: 133709 - protein, 9 aa, West Nile virus
RARISPGAG

SEQ ID NO: 133710 - protein, 9 aa, West Nile virus
ARISPGAGW

SEQ ID NO: 133711 - protein, 9 aa, West Nile virus
RISPGAGWN

SEQ ID NO: 133712 - protein, 9 aa, West Nile virus
ISPGAGWNV

SEQ ID NO: 133713 - protein, 9 aa, West Nile virus
SPGAGWNVR

SEQ ID NO: 133714 - protein, 9 aa, West Nile virus
PGAGWNVRD

SEQ ID NO: 133715 - protein, 9 aa, West Nile virus
GAGWNVRDT

SEQ ID NO: 133716 - protein, 9 aa, West Nile virus
AGWNVRDTA

SEQ ID NO: 133717 - protein, 9 aa, West Nile virus
GWNVRDTAC

SEQ ID NO: 133718 - protein, 9 aa, West Nile virus
WNVRDTACL

SEQ ID NO: 133719 - protein, 9 aa, West Nile virus
NVRDTACLA

SEQ ID NO: 133720 - protein, 9 aa, West Nile virus
VRDTACLAK

SEQ ID NO: 133721 - protein, 9 aa, West Nile virus
RDTACLAKS

SEQ ID NO: 133722 - protein, 9 aa, West Nile virus
DTACLAKSY

SEQ ID NO: 133723 - protein, 9 aa, West Nile virus
TACLAKSYA

SEQ ID NO: 133724 - protein, 9 aa, West Nile virus
ACLAKSYAQ

SEQ ID NO: 133725 - protein, 9 aa, West Nile virus
CLAKSYAQM

SEQ ID NO: 133726 - protein, 9 aa, West Nile virus
LAKSYAQMW

SEQ ID NO: 133727 - protein, 9 aa, West Nile virus
AKSYAQMWL

SEQ ID NO: 133728 - protein, 9 aa, West Nile virus
KSYAQMWLL

SEQ ID NO: 133729 - protein, 9 aa, West Nile virus
SYAQMWLLL

SEQ ID NO: 133730 - protein, 9 aa, West Nile virus
YAQMWLLLY

SEQ ID NO: 133731 - protein, 9 aa, West Nile virus
AQMWLLLYF

SEQ ID NO: 133732 - protein, 9 aa, West Nile virus
QMWLLLYFH

SEQ ID NO: 133733 - protein, 9 aa, West Nile virus
MWLLLYFHR

SEQ ID NO: 133734 - protein, 9 aa, West Nile virus
WLLLYFHRR

SEQ ID NO: 133735 - protein, 9 aa, West Nile virus
LLLYFHRRD

SEQ ID NO: 133736 - protein, 9 aa, West Nile virus
LLYFHRRDL

SEQ ID NO: 133737 - protein, 9 aa, West Nile virus
LYFHRRDLR

SEQ ID NO: 133738 - protein, 9 aa, West Nile virus
YFHRRDLRL

SEQ ID NO: 133739 - protein, 9 aa, West Nile virus
FHRRDLRLM

SEQ ID NO: 133740 - protein, 9 aa, West Nile virus
HRRDLRLMA

SEQ ID NO: 133741 - protein, 9 aa, West Nile virus
RRDLRLMAN

SEQ ID NO: 133742 - protein, 9 aa, West Nile virus
RDLRLMANA

SEQ ID NO: 133743 - protein, 9 aa, West Nile virus
DLRLMANAI

SEQ ID NO: 133744 - protein, 9 aa, West Nile virus
LRLMANAIC

SEQ ID NO: 133745 - protein, 9 aa, West Nile virus
RLMANAICS

SEQ ID NO: 133746 - protein, 9 aa, West Nile virus
LMANAICSA

SEQ ID NO: 133747 - protein, 9 aa, West Nile virus
MANAICSAV

SEQ ID NO: 133748 - protein, 9 aa, West Nile virus
ANAICSAVP

SEQ ID NO: 133749 - protein, 9 aa, West Nile virus
NAICSAVPV

SEQ ID NO: 133750 - protein, 9 aa, West Nile virus
AICSAVPVN

SEQ ID NO: 133751 - protein, 9 aa, West Nile virus
ICSAVPVNW

SEQ ID NO: 133752 - protein, 9 aa, West Nile virus
CSAVPVNWV

SEQ ID NO: 133753 - protein, 9 aa, West Nile virus
SAVPVNWVP

SEQ ID NO: 133754 - protein, 9 aa, West Nile virus
AVPVNWVPT

SEQ ID NO: 133755 - protein, 9 aa, West Nile virus
VPVNWVPTG

SEQ ID NO: 133756 - protein, 9 aa, West Nile virus
PVNWVPTGR

SEQ ID NO: 133757 - protein, 9 aa, West Nile virus
VNWVPTGRT

SEQ ID NO: 133758 - protein, 9 aa, West Nile virus
NWVPTGRTT

SEQ ID NO: 133759 - protein, 9 aa, West Nile virus
WVPTGRTTW

SEQ ID NO: 133760 - protein, 9 aa, West Nile virus
VPTGRTTWS

SEQ ID NO: 133761 - protein, 9 aa, West Nile virus
PTGRTTWSI

SEQ ID NO: 133762 - protein, 9 aa, West Nile virus
TGRTTWSIH

SEQ ID NO: 133763 - protein, 9 aa, West Nile virus
GRTTWSIHA

SEQ ID NO: 133764 - protein, 9 aa, West Nile virus
RTTWSIHAG

SEQ ID NO: 133765 - protein, 9 aa, West Nile virus
TTWSIHAGG

SEQ ID NO: 133766 - protein, 9 aa, West Nile virus
TWSIHAGGE

SEQ ID NO: 133767 - protein, 9 aa, West Nile virus
WSIHAGGEW

SEQ ID NO: 133768 - protein, 9 aa, West Nile virus
SIHAGGEWM

SEQ ID NO: 133769 - protein, 9 aa, West Nile virus
IHAGGEWMT

SEQ ID NO: 133770 - protein, 9 aa, West Nile virus
HAGGEWMTT

SEQ ID NO: 133771 - protein, 9 aa, West Nile virus
AGGEWMTTE

SEQ ID NO: 133772 - protein, 9 aa, West Nile virus
GGEWMTTED

SEQ ID NO: 133773 - protein, 9 aa, West Nile virus
GEWMTTEDM

SEQ ID NO: 133774 - protein, 9 aa, West Nile virus
EWMTTEDML

SEQ ID NO: 133775 - protein, 9 aa, West Nile virus
WMTTEDMLE

SEQ ID NO: 133776 - protein, 9 aa, West Nile virus
MTTEDMLEV

SEQ ID NO: 133777 - protein, 9 aa, West Nile virus
TTEDMLEVW

SEQ ID NO: 133778 - protein, 9 aa, West Nile virus
TEDMLEVWN

SEQ ID NO: 133779 - protein, 9 aa, West Nile virus
EDMLEVWNR

SEQ ID NO: 133780 - protein, 9 aa, West Nile virus
DMLEVWNRV

SEQ ID NO: 133781 - protein, 9 aa, West Nile virus
MLEVWNRVW

SEQ ID NO: 133782 - protein, 9 aa, West Nile virus
LEVWNRVWI

SEQ ID NO: 133783 - protein, 9 aa, West Nile virus
EVWNRVWIE

SEQ ID NO: 133784 - protein, 9 aa, West Nile virus
VWNRVWIEE

SEQ ID NO: 133785 - protein, 9 aa, West Nile virus
WNRVWIEEN

SEQ ID NO: 133786 - protein, 9 aa, West Nile virus
NRVWIEENE

SEQ ID NO: 133787 - protein, 9 aa, West Nile virus
RVWIEENEW

SEQ ID NO: 133788 - protein, 9 aa, West Nile virus
VWIEENEWM

SEQ ID NO: 133789 - protein, 9 aa, West Nile virus
WIEENEWME

SEQ ID NO: 133790 - protein, 9 aa, West Nile virus
IEENEWMED

SEQ ID NO: 133791 - protein, 9 aa, West Nile virus
EENEWMEDK

SEQ ID NO: 133792 - protein, 9 aa, West Nile virus
ENEWMEDKT

SEQ ID NO: 133793 - protein, 9 aa, West Nile virus
NEWMEDKTP

SEQ ID NO: 133794 - protein, 9 aa, West Nile virus
EWMEDKTPV

SEQ ID NO: 133795 - protein, 9 aa, West Nile virus
WMEDKTPVE

SEQ ID NO: 133796 - protein, 9 aa, West Nile virus
MEDKTPVEK

SEQ ID NO: 133797 - protein, 9 aa, West Nile virus
EDKTPVEKW

SEQ ID NO: 133798 - protein, 9 aa, West Nile virus
DKTPVEKWS

SEQ ID NO: 133799 - protein, 9 aa, West Nile virus
KTPVEKWSD

SEQ ID NO: 133800 - protein, 9 aa, West Nile virus
TPVEKWSDV

SEQ ID NO: 133801 - protein, 9 aa, West Nile virus
PVEKWSDVP

SEQ ID NO: 133802 - protein, 9 aa, West Nile virus
VEKWSDVPY

SEQ ID NO: 133803 - protein, 9 aa, West Nile virus
EKWSDVPYS

SEQ ID NO: 133804 - protein, 9 aa, West Nile virus
KWSDVPYSG

SEQ ID NO: 133805 - protein, 9 aa, West Nile virus
WSDVPYSGK

SEQ ID NO: 133806 - protein, 9 aa, West Nile virus
SDVPYSGKR

SEQ ID NO: 133807 - protein, 9 aa, West Nile virus
DVPYSGKRE

SEQ ID NO: 133808 - protein, 9 aa, West Nile virus
VPYSGKRED

SEQ ID NO: 133809 - protein, 9 aa, West Nile virus
PYSGKREDI

SEQ ID NO: 133810 - protein, 9 aa, West Nile virus
YSGKREDIW

SEQ ID NO: 133811 - protein, 9 aa, West Nile virus
SGKREDIWC

SEQ ID NO: 133812 - protein, 9 aa, West Nile virus
GKREDIWCG

SEQ ID NO: 133813 - protein, 9 aa, West Nile virus
KREDIWCGS

SEQ ID NO: 133814 - protein, 9 aa, West Nile virus
REDIWCGSL

SEQ ID NO: 133815 - protein, 9 aa, West Nile virus
EDIWCGSLI

SEQ ID NO: 133816 - protein, 9 aa, West Nile virus
DIWCGSLIG

SEQ ID NO: 133817 - protein, 9 aa, West Nile virus
IWCGSLIGT

SEQ ID NO: 133818 - protein, 9 aa, West Nile virus
WCGSLIGTR

SEQ ID NO: 133819 - protein, 9 aa, West Nile virus
CGSLIGTRA

SEQ ID NO: 133820 - protein, 9 aa, West Nile virus
GSLIGTRAR

SEQ ID NO: 133821 - protein, 9 aa, West Nile virus
SLIGTRARA

SEQ ID NO: 133822 - protein, 9 aa, West Nile virus
LIGTRARAT

SEQ ID NO: 133823 - protein, 9 aa, West Nile virus
IGTRARATW

SEQ ID NO: 133824 - protein, 9 aa, West Nile virus
GTRARATWA

SEQ ID NO: 133825 - protein, 9 aa, West Nile virus
TRARATWAE

SEQ ID NO: 133826 - protein, 9 aa, West Nile virus
RARATWAEN

SEQ ID NO: 133827 - protein, 9 aa, West Nile virus
ARATWAENI

SEQ ID NO: 133828 - protein, 9 aa, West Nile virus
RATWAENIQ

SEQ ID NO: 133829 - protein, 9 aa, West Nile virus
ATWAENIQV

SEQ ID NO: 133830 - protein, 9 aa, West Nile virus
TWAENIQVA

SEQ ID NO: 133831 - protein, 9 aa, West Nile virus
WAENIQVAI

SEQ ID NO: 133832 - protein, 9 aa, West Nile virus
AENIQVAIN

SEQ ID NO: 133833 - protein, 9 aa, West Nile virus
ENIQVAINQ

SEQ ID NO: 133834 - protein, 9 aa, West Nile virus
NIQVAINQV

SEQ ID NO: 133835 - protein, 9 aa, West Nile virus
IQVAINQVR

SEQ ID NO: 133836 - protein, 9 aa, West Nile virus
QVAINQVRA

SEQ ID NO: 133837 - protein, 9 aa, West Nile virus
IIGDEKYVD

SEQ ID NO: 133838 - protein, 9 aa, West Nile virus
IGDEKYVDY

SEQ ID NO: 133839 - protein, 9 aa, West Nile virus
GDEKYVDYM

SEQ ID NO: 133840 - protein, 9 aa, West Nile virus
DEKYVDYMS

SEQ ID NO: 133841 - protein, 9 aa, West Nile virus
EKYVDYMSS

SEQ ID NO: 133842 - protein, 9 aa, West Nile virus
KYVDYMSSL

SEQ ID NO: 133843 - protein, 9 aa, West Nile virus
YVDYMSSLK

SEQ ID NO: 133844 - protein, 9 aa, West Nile virus
VDYMSSLKR

SEQ ID NO: 133845 - protein, 9 aa, West Nile virus
DYMSSLKRY

SEQ ID NO: 133846 - protein, 9 aa, West Nile virus
YMSSLKRYE

SEQ ID NO: 133847 - protein, 9 aa, West Nile virus
MSSLKRYED

SEQ ID NO: 133848 - protein, 9 aa, West Nile virus
KKPGGPGKN

SEQ ID NO: 133849 - protein, 9 aa, West Nile virus
KPGGPGKNR

SEQ ID NO: 133850 - protein, 9 aa, West Nile virus
PGGPGKNRA

SEQ ID NO: 133851 - protein, 9 aa, West Nile virus
GGPGKNRAV

SEQ ID NO: 133852 - protein, 9 aa, West Nile virus
GPGKNRAVN

SEQ ID NO: 133853 - protein, 9 aa, West Nile virus
PGKNRAVNM

SEQ ID NO: 133854 - protein, 9 aa, West Nile virus
GKNRAVNML

SEQ ID NO: 133855 - protein, 9 aa, West Nile virus
KNRAVNMLK

SEQ ID NO: 133856 - protein, 9 aa, West Nile virus
NRAVNMLKR

SEQ ID NO: 133857 - protein, 9 aa, West Nile virus
RAVNMQKRG

SEQ ID NO: 133858 - protein, 9 aa, West Nile virus
AVNMQKRGT

SEQ ID NO: 133859 - protein, 9 aa, West Nile virus
VNMQKRGMP

SEQ ID NO: 133860 - protein, 9 aa, West Nile virus
NMQKRGTPR

SEQ ID NO: 133861 - protein, 9 aa, West Nile virus
KRGMPRGLS

SEQ ID NO: 133862 - protein, 9 aa, West Nile virus
RGMPRGLSL

SEQ ID NO: 133863 - protein, 9 aa, West Nile virus
PRGLSLIGL

SEQ ID NO: 133864 - protein, 9 aa, West Nile virus
RGLSLIGLK

SEQ ID NO: 133865 - protein, 9 aa, West Nile virus
GLSLIGLKR

SEQ ID NO: 133866 - protein, 9 aa, West Nile virus
LSLTGLKRA

SEQ ID NO: 133867 - protein, 9 aa, West Nile virus
SLTGLKRAM

SEQ ID NO: 133868 - protein, 9 aa, West Nile virus
LTGLKRAML

SEQ ID NO: 133869 - protein, 9 aa, West Nile virus
TGLKRAMLS

SEQ ID NO: 133870 - protein, 9 aa, West Nile virus
GLKRAVLSL

SEQ ID NO: 133871 - protein, 9 aa, West Nile virus
LKRAVLSLI

SEQ ID NO: 133872 - protein, 9 aa, West Nile virus
KRAVLSLID

SEQ ID NO: 133873 - protein, 9 aa, West Nile virus
RAVLSLIDG

SEQ ID NO: 133874 - protein, 9 aa, West Nile virus
AMLSLIDGR

SEQ ID NO: 133875 - protein, 9 aa, West Nile virus
MLSLIDGRG

SEQ ID NO: 133876 - protein, 9 aa, West Nile virus
LSLIDGRGP

SEQ ID NO: 133877 - protein, 9 aa, West Nile virus
SLIDGRGPI

SEQ ID NO: 133878 - protein, 9 aa, West Nile virus
LIDGRGPIR

SEQ ID NO: 133879 - protein, 9 aa, West Nile virus
IDGRGPIRF

SEQ ID NO: 133880 - protein, 9 aa, West Nile virus
DGRGPIRFV

SEQ ID NO: 133881 - protein, 9 aa, West Nile virus
GRGPIRFVL

SEQ ID NO: 133882 - protein, 9 aa, West Nile virus
RGPIRFVLA

SEQ ID NO: 133883 - protein, 9 aa, West Nile virus
GPTRFVLAL

SEQ ID NO: 133884 - protein, 9 aa, West Nile virus
PTRFVLALL

SEQ ID NO: 133885 - protein, 9 aa, West Nile virus
TRFVLALLA

SEQ ID NO: 133886 - protein, 9 aa, West Nile virus
RFVLALLTF

SEQ ID NO: 133887 - protein, 9 aa, West Nile virus
FVLALLTFF

SEQ ID NO: 133888 - protein, 9 aa, West Nile virus
VLALLTFFR

SEQ ID NO: 133889 - protein, 9 aa, West Nile virus
LALLTFFRF

SEQ ID NO: 133890 - protein, 9 aa, West Nile virus
ALLTFFRFT

SEQ ID NO: 133891 - protein, 9 aa, West Nile virus
LLTFFRFTA

SEQ ID NO: 133892 - protein, 9 aa, West Nile virus
LTFFRFTAI

SEQ ID NO: 133893 - protein, 9 aa, West Nile virus
TFFRFTAIA

SEQ ID NO: 133894 - protein, 9 aa, West Nile virus
FFKFTAIAP

SEQ ID NO: 133895 - protein, 9 aa, West Nile virus
FKFTAIAPT

SEQ ID NO: 133896 - protein, 9 aa, West Nile virus
KFTAIAPTR

SEQ ID NO: 133897 - protein, 9 aa, West Nile virus
TAIAPTRAL

SEQ ID NO: 133898 - protein, 9 aa, West Nile virus
AIAPTRALL

SEQ ID NO: 133899 - protein, 9 aa, West Nile virus
IAPTRALLD

SEQ ID NO: 133900 - protein, 9 aa, West Nile virus
APTRALLDR

SEQ ID NO: 133901 - protein, 9 aa, West Nile virus
PTRALLDRW

SEQ ID NO: 133902 - protein, 9 aa, West Nile virus
TRALLDRWR

SEQ ID NO: 133903 - protein, 9 aa, West Nile virus
RALLDRWRG

SEQ ID NO: 133904 - protein, 9 aa, West Nile virus
ALLDRWRGV

SEQ ID NO: 133905 - protein, 9 aa, West Nile virus
LLDRWRGVR

SEQ ID NO: 133906 - protein, 9 aa, West Nile virus
LDRWRGVRK

SEQ ID NO: 133907 - protein, 9 aa, West Nile virus
DRWRGVRKQ

SEQ ID NO: 133908 - protein, 9 aa, West Nile virus
RWRGVRKQT

SEQ ID NO: 133909 - protein, 9 aa, West Nile virus
WRGVRKQTA

SEQ ID NO: 133910 - protein, 9 aa, West Nile virus
RGVRKQTAM

SEQ ID NO: 133911 - protein, 9 aa, West Nile virus
GVRKQTAMK

SEQ ID NO: 133912 - protein, 9 aa, West Nile virus
VRKQTAMKH

SEQ ID NO: 133913 - protein, 9 aa, West Nile virus
RKQTAMKHL

SEQ ID NO: 133914 - protein, 9 aa, West Nile virus
MKHLTSFKK

SEQ ID NO: 133915 - protein, 9 aa, West Nile virus
KHLLSFKRE

SEQ ID NO: 133916 - protein, 9 aa, West Nile virus
HLLSFKREL

SEQ ID NO: 133917 - protein, 9 aa, West Nile virus
LTSFKKELG

SEQ ID NO: 133918 - protein, 9 aa, West Nile virus
LSFKKELGA

SEQ ID NO: 133919 - protein, 9 aa, West Nile virus
SFKKELGAL

SEQ ID NO: 133920 - protein, 9 aa, West Nile virus
FKKELGALT

SEQ ID NO: 133921 - protein, 9 aa, West Nile virus
KKELGALTN

SEQ ID NO: 133922 - protein, 9 aa, West Nile virus
KELGALTNA

SEQ ID NO: 133923 - protein, 9 aa, West Nile virus
ELGALTNAM

SEQ ID NO: 133924 - protein, 9 aa, West Nile virus
LGALTNAMN

SEQ ID NO: 133925 - protein, 9 aa, West Nile virus
GALTNAMNK

SEQ ID NO: 133926 - protein, 9 aa, West Nile virus
ALTNAMNKR

SEQ ID NO: 133927 - protein, 9 aa, West Nile virus
LTNAMNKRS

SEQ ID NO: 133928 - protein, 9 aa, West Nile virus
NRRSTKQKK

SEQ ID NO: 133929 - protein, 9 aa, West Nile virus
RRSTKQKKR

SEQ ID NO: 133930 - protein, 9 aa, West Nile virus
RSTKQKKRG

SEQ ID NO: 133931 - protein, 9 aa, West Nile virus
STKQKKRGG

SEQ ID NO: 133932 - protein, 9 aa, West Nile virus
KQKKRGGTA

SEQ ID NO: 133933 - protein, 9 aa, West Nile virus
QKKRGGTAG

SEQ ID NO: 133934 - protein, 9 aa, West Nile virus
KKRGGTAGF

SEQ ID NO: 133935 - protein, 9 aa, West Nile virus
SALTLSNFQ

SEQ ID NO: 133936 - protein, 9 aa, West Nile virus
ALTLSNFQG

SEQ ID NO: 133937 - protein, 9 aa, West Nile virus
LTLSNFQGK

SEQ ID NO: 133938 - protein, 9 aa, West Nile virus
TLSNFQGKL

SEQ ID NO: 133939 - protein, 9 aa, West Nile virus
LSNFQGKLM

SEQ ID NO: 133940 - protein, 9 aa, West Nile virus
SNFQGKLMM

SEQ ID NO: 133941 - protein, 9 aa, West Nile virus
NFQGKLMMT

SEQ ID NO: 133942 - protein, 9 aa, West Nile virus
FQGKLMMTI

SEQ ID NO: 133943 - protein, 9 aa, West Nile virus
QGKLMMTIN

SEQ ID NO: 133944 - protein, 9 aa, West Nile virus
GKLMMTINA

SEQ ID NO: 133945 - protein, 9 aa, West Nile virus
KLMMTINAT

SEQ ID NO: 133946 - protein, 9 aa, West Nile virus
VIMTVNATD

SEQ ID NO: 133947 - protein, 9 aa, West Nile virus
MMTVNATDI

SEQ ID NO: 133948 - protein, 9 aa, West Nile virus
MTVNATDIT

SEQ ID NO: 133949 - protein, 9 aa, West Nile virus
IITIPTAAG

SEQ ID NO: 133950 - protein, 9 aa, West Nile virus
ITIPPAAGK

SEQ ID NO: 133951 - protein, 9 aa, West Nile virus
TIPPAAGKN

SEQ ID NO: 133952 - protein, 9 aa, West Nile virus
IPTASGKNL

SEQ ID NO: 133953 - protein, 9 aa, West Nile virus
PTASGKNLC

SEQ ID NO: 133954 - protein, 9 aa, West Nile virus
TAAGKNLCT

SEQ ID NO: 133955 - protein, 9 aa, West Nile virus
AAGKNLCTI

SEQ ID NO: 133956 - protein, 9 aa, West Nile virus
AGKNLCTIR

SEQ ID NO: 133957 - protein, 9 aa, West Nile virus
GKNLCTIRA

SEQ ID NO: 133958 - protein, 9 aa, West Nile virus
KNLCTIRAM

SEQ ID NO: 133959 - protein, 9 aa, West Nile virus
NLCTIRAMD

SEQ ID NO: 133960 - protein, 9 aa, West Nile virus
LCTIRAMDV

SEQ ID NO: 133961 - protein, 9 aa, West Nile virus
CTIRAMDVG

SEQ ID NO: 133962 - protein, 9 aa, West Nile virus
TIRAMDVGF

SEQ ID NO: 133963 - protein, 9 aa, West Nile virus
VRAMDVGYL

SEQ ID NO: 133964 - protein, 9 aa, West Nile virus
RAMDVGYLC

SEQ ID NO: 133965 - protein, 9 aa, West Nile virus
AMDVGYLCE

SEQ ID NO: 133966 - protein, 9 aa, West Nile virus
MDVGYLCED

SEQ ID NO: 133967 - protein, 9 aa, West Nile virus
DVGYLCEDT

SEQ ID NO: 133968 - protein, 9 aa, West Nile virus
VGYLCEDTI

SEQ ID NO: 133969 - protein, 9 aa, West Nile virus
GYLCEDTIT

SEQ ID NO: 133970 - protein, 9 aa, West Nile virus
YLCEDTITY

SEQ ID NO: 133971 - protein, 9 aa, West Nile virus
LCEDTITYE

SEQ ID NO: 133972 - protein, 9 aa, West Nile virus
CEDTITYEC

SEQ ID NO: 133973 - protein, 9 aa, West Nile virus
EDTITYECP

SEQ ID NO: 133974 - protein, 9 aa, West Nile virus
DTIAYECPA

SEQ ID NO: 133975 - protein, 9 aa, West Nile virus
TIAYECPAL

SEQ ID NO: 133976 - protein, 9 aa, West Nile virus
ITYECPVLA

SEQ ID NO: 133977 - protein, 9 aa, West Nile virus
TYECPVLAA

SEQ ID NO: 133978 - protein, 9 aa, West Nile virus
YECPVLAAG

SEQ ID NO: 133979 - protein, 9 aa, West Nile virus
ECPVLAAGN

SEQ ID NO: 133980 - protein, 9 aa, West Nile virus
CPVLAAGND

SEQ ID NO: 133981 - protein, 9 aa, West Nile virus
PVLAAGNDP

SEQ ID NO: 133982 - protein, 9 aa, West Nile virus
VLAAGNDPE

SEQ ID NO: 133983 - protein, 9 aa, West Nile virus
LAAGNDPED

SEQ ID NO: 133984 - protein, 9 aa, West Nile virus
AAGNDPEDI

SEQ ID NO: 133985 - protein, 9 aa, West Nile virus
EGNDPEDID

SEQ ID NO: 133986 - protein, 9 aa, West Nile virus
DIDCWCTKL

SEQ ID NO: 133987 - protein, 9 aa, West Nile virus
IDCWCTKSS

SEQ ID NO: 133988 - protein, 9 aa, West Nile virus
DCWCTKSSV

SEQ ID NO: 133989 - protein, 9 aa, West Nile virus
SVYVRYGRC

SEQ ID NO: 133990 - protein, 9 aa, West Nile virus
VFVRYGRCT

SEQ ID NO: 133991 - protein, 9 aa, West Nile virus
FVRYGRCTR

SEQ ID NO: 133992 - protein, 9 aa, West Nile virus
VRYGRCTRT

SEQ ID NO: 133993 - protein, 9 aa, West Nile virus
RYGRCTRTR

SEQ ID NO: 133994 - protein, 9 aa, West Nile virus
YGRCTRTRN

SEQ ID NO: 133995 - protein, 9 aa, West Nile virus
GRCTRTRNS

SEQ ID NO: 133996 - protein, 9 aa, West Nile virus
RCTRTRNSR

SEQ ID NO: 133997 - protein, 9 aa, West Nile virus
CTRTRNSRR

SEQ ID NO: 133998 - protein, 9 aa, West Nile virus
TRTRNSRRS

SEQ ID NO: 133999 - protein, 9 aa, West Nile virus
RTRNSRRSR

SEQ ID NO: 134000 - protein, 9 aa, West Nile virus
TRNSRRSRR

SEQ ID NO: 134001 - protein, 9 aa, West Nile virus
RNSRRSRRS

SEQ ID NO: 134002 - protein, 9 aa, West Nile virus
NSRRSRRSL

SEQ ID NO: 134003 - protein, 9 aa, West Nile virus
SRRSRRSLN

SEQ ID NO: 134004 - protein, 9 aa, West Nile virus
RRSRRSLNV

SEQ ID NO: 134005 - protein, 9 aa, West Nile virus
RSRRSLNVQ

SEQ ID NO: 134006 - protein, 9 aa, West Nile virus
SRRSLNVQV

SEQ ID NO: 134007 - protein, 9 aa, West Nile virus
RRSLNVQVH

SEQ ID NO: 134008 - protein, 9 aa, West Nile virus
RSLNVQVHG

SEQ ID NO: 134009 - protein, 9 aa, West Nile virus
SLNVQVHGE

SEQ ID NO: 134010 - protein, 9 aa, West Nile virus
LNVQVHGES

SEQ ID NO: 134011 - protein, 9 aa, West Nile virus
NVQVHGESS

SEQ ID NO: 134012 - protein, 9 aa, West Nile virus
VQVHGESSL

SEQ ID NO: 134013 - protein, 9 aa, West Nile virus
QVHGESSLS

SEQ ID NO: 134014 - protein, 9 aa, West Nile virus
VHGESSLSN

SEQ ID NO: 134015 - protein, 9 aa, West Nile virus
HGESSLSNR

SEQ ID NO: 134016 - protein, 9 aa, West Nile virus
GESSLSNRK

SEQ ID NO: 134017 - protein, 9 aa, West Nile virus
ESSLSNRKG

SEQ ID NO: 134018 - protein, 9 aa, West Nile virus
SSLSNRKGA

SEQ ID NO: 134019 - protein, 9 aa, West Nile virus
SLSNRKGAW

SEQ ID NO: 134020 - protein, 9 aa, West Nile virus
LANKKGAWL

SEQ ID NO: 134021 - protein, 9 aa, West Nile virus
ANKKGAWLD

SEQ ID NO: 134022 - protein, 9 aa, West Nile virus
NKKGAWLDS

SEQ ID NO: 134023 - protein, 9 aa, West Nile virus
KKGAWLDST

SEQ ID NO: 134024 - protein, 9 aa, West Nile virus
KGAWLDSTK

SEQ ID NO: 134025 - protein, 9 aa, West Nile virus
GAWLDSTKA

SEQ ID NO: 134026 - protein, 9 aa, West Nile virus
AWLDSTKAT

SEQ ID NO: 134027 - protein, 9 aa, West Nile virus
WLDSTKATR

SEQ ID NO: 134028 - protein, 9 aa, West Nile virus
LDSTKATRY

SEQ ID NO: 134029 - protein, 9 aa, West Nile virus
DSTKASRYL

SEQ ID NO: 134030 - protein, 9 aa, West Nile virus
STKASRYLM

SEQ ID NO: 134031 - protein, 9 aa, West Nile virus
TKASRYLMK

SEQ ID NO: 134032 - protein, 9 aa, West Nile virus
KASRYLMKA

SEQ ID NO: 134033 - protein, 9 aa, West Nile virus
ASRYLMKAE

SEQ ID NO: 134034 - protein, 9 aa, West Nile virus
SRYLMKAES

SEQ ID NO: 134035 - protein, 9 aa, West Nile virus
RYLMKAESW

SEQ ID NO: 134036 - protein, 9 aa, West Nile virus
YLMKAESWI

SEQ ID NO: 134037 - protein, 9 aa, West Nile virus
LMKAESWIL

SEQ ID NO: 134038 - protein, 9 aa, West Nile virus
MKAESWILR

SEQ ID NO: 134039 - protein, 9 aa, West Nile virus
KAESWILRN

SEQ ID NO: 134040 - protein, 9 aa, West Nile virus
AESWILRNP

SEQ ID NO: 134041 - protein, 9 aa, West Nile virus
GYALVAVVI

SEQ ID NO: 134042 - protein, 9 aa, West Nile virus
YALVAAVTG

SEQ ID NO: 134043 - protein, 9 aa, West Nile virus
ALVAAVTGW

SEQ ID NO: 134044 - protein, 9 aa, West Nile virus
LVAAVTGWM

SEQ ID NO: 134045 - protein, 9 aa, West Nile virus
VAAVTGWML

SEQ ID NO: 134046 - protein, 9 aa, West Nile virus
AVVIGWMLG

SEQ ID NO: 134047 - protein, 9 aa, West Nile virus
VVIGWMLGS

SEQ ID NO: 134048 - protein, 9 aa, West Nile virus
TGWMLGSNT

SEQ ID NO: 134049 - protein, 9 aa, West Nile virus
GWMLGSNTT

SEQ ID NO: 134050 - protein, 9 aa, West Nile virus
WMLGSNTTQ

SEQ ID NO: 134051 - protein, 9 aa, West Nile virus
MLGSNTTQR

SEQ ID NO: 134052 - protein, 9 aa, West Nile virus
LGSNTTQRV

SEQ ID NO: 134053 - protein, 9 aa, West Nile virus
GSNTTQRVV

SEQ ID NO: 134054 - protein, 9 aa, West Nile virus
SNTTQRVVF

SEQ ID NO: 134055 - protein, 9 aa, West Nile virus
NTMQRVVFA

SEQ ID NO: 134056 - protein, 9 aa, West Nile virus
MQRVVFAIL

SEQ ID NO: 134057 - protein, 9 aa, West Nile virus
QRVVFAILL

SEQ ID NO: 134058 - protein, 9 aa, West Nile virus
RVVFAILLL

SEQ ID NO: 134059 - protein, 9 aa, West Nile virus
VVFAILLLL

SEQ ID NO: 134060 - protein, 9 aa, West Nile virus
VFAILLLLV

SEQ ID NO: 134061 - protein, 9 aa, West Nile virus
FAILLLLVA

SEQ ID NO: 134062 - protein, 9 aa, West Nile virus
AILLLLVAP

SEQ ID NO: 134063 - protein, 9 aa, West Nile virus
ILLLLVAPA

SEQ ID NO: 134064 - protein, 9 aa, West Nile virus
SFNCLGMSS

SEQ ID NO: 134065 - protein, 9 aa, West Nile virus
FNCLGMSSR

SEQ ID NO: 134066 - protein, 9 aa, West Nile virus
NCLGMSSRD

SEQ ID NO: 134067 - protein, 9 aa, West Nile virus
CLGMSSRDF

SEQ ID NO: 134068 - protein, 9 aa, West Nile virus
LGMSNRDFI

SEQ ID NO: 134069 - protein, 9 aa, West Nile virus
GMSNRDFIE

SEQ ID NO: 134070 - protein, 9 aa, West Nile virus
MSNRDFIEG

SEQ ID NO: 134071 - protein, 9 aa, West Nile virus
SNRDFIEGA

SEQ ID NO: 134072 - protein, 9 aa, West Nile virus
NRDFIEGAS

SEQ ID NO: 134073 - protein, 9 aa, West Nile virus
RDFIEGASG

SEQ ID NO: 134074 - protein, 9 aa, West Nile virus
DFIEGASGA

SEQ ID NO: 134075 - protein, 9 aa, West Nile virus
FIEGASGAT

SEQ ID NO: 134076 - protein, 9 aa, West Nile virus
IEGASGATW

SEQ ID NO: 134077 - protein, 9 aa, West Nile virus
EGASGATWV

SEQ ID NO: 134078 - protein, 9 aa, West Nile virus
GASGATWVD

SEQ ID NO: 134079 - protein, 9 aa, West Nile virus
ASGATWVDL

SEQ ID NO: 134080 - protein, 9 aa, West Nile virus
SGATWMDLV

SEQ ID NO: 134081 - protein, 9 aa, West Nile virus
GATWMDLVL

SEQ ID NO: 134082 - protein, 9 aa, West Nile virus
ATWMDLVLE

SEQ ID NO: 134083 - protein, 9 aa, West Nile virus
TWMDLVLEG

SEQ ID NO: 134084 - protein, 9 aa, West Nile virus
WMDLVLEGD

SEQ ID NO: 134085 - protein, 9 aa, West Nile virus
MDLVLEGDS

SEQ ID NO: 134086 - protein, 9 aa, West Nile virus
EGDSCVTIT

SEQ ID NO: 134087 - protein, 9 aa, West Nile virus
GDSCVTIMA

SEQ ID NO: 134088 - protein, 9 aa, West Nile virus
DSCVTIMAK

SEQ ID NO: 134089 - protein, 9 aa, West Nile virus
SCVTIMAKD

SEQ ID NO: 134090 - protein, 9 aa, West Nile virus
CVTIMAKDR

SEQ ID NO: 134091 - protein, 9 aa, West Nile virus
VTIMAKDRP

SEQ ID NO: 134092 - protein, 9 aa, West Nile virus
TIMAKDRPT

SEQ ID NO: 134093 - protein, 9 aa, West Nile virus
IMAKDRPTI

SEQ ID NO: 134094 - protein, 9 aa, West Nile virus
MAKDRPTID

SEQ ID NO: 134095 - protein, 9 aa, West Nile virus
AKDRPTIDV

SEQ ID NO: 134096 - protein, 9 aa, West Nile virus
KDRPTIDVK

SEQ ID NO: 134097 - protein, 9 aa, West Nile virus
DRPTIDVKM

SEQ ID NO: 134098 - protein, 9 aa, West Nile virus
RPTIDVKMV

SEQ ID NO: 134099 - protein, 9 aa, West Nile virus
PTIDVKMVT

SEQ ID NO: 134100 - protein, 9 aa, West Nile virus
TIDVKMVTM

SEQ ID NO: 134101 - protein, 9 aa, West Nile virus
IDVKMVTMG

SEQ ID NO: 134102 - protein, 9 aa, West Nile virus
DVKMVTMGA

SEQ ID NO: 134103 - protein, 9 aa, West Nile virus
DVRSYCYLA

SEQ ID NO: 134104 - protein, 9 aa, West Nile virus
VSDLSTRAA

SEQ ID NO: 134105 - protein, 9 aa, West Nile virus
SDLSTRAAC

SEQ ID NO: 134106 - protein, 9 aa, West Nile virus
DLSTRAACP

SEQ ID NO: 134107 - protein, 9 aa, West Nile virus
LSTRAACPT

SEQ ID NO: 134108 - protein, 9 aa, West Nile virus
STRAACPTM

SEQ ID NO: 134109 - protein, 9 aa, West Nile virus
TRAACPTMG

SEQ ID NO: 134110 - protein, 9 aa, West Nile virus
RAACPTMGE

SEQ ID NO: 134111 - protein, 9 aa, West Nile virus
AACPTMGDA

SEQ ID NO: 134112 - protein, 9 aa, West Nile virus
ACPAMGEAH

SEQ ID NO: 134113 - protein, 9 aa, West Nile virus
CPTMGDAHN

SEQ ID NO: 134114 - protein, 9 aa, West Nile virus
PTMGEAHNE

SEQ ID NO: 134115 - protein, 9 aa, West Nile virus
TMGEAHNEK

SEQ ID NO: 134116 - protein, 9 aa, West Nile virus
MGEAHNEKR

SEQ ID NO: 134117 - protein, 9 aa, West Nile virus
GEAHNEKRA

SEQ ID NO: 134118 - protein, 9 aa, West Nile virus
EAHNEKRAD

SEQ ID NO: 134119 - protein, 9 aa, West Nile virus
AHNEKRADP

SEQ ID NO: 134120 - protein, 9 aa, West Nile virus
FVCKQGVVD

SEQ ID NO: 134121 - protein, 9 aa, West Nile virus
VCKQGVVDR

SEQ ID NO: 134122 - protein, 9 aa, West Nile virus
CKQGVVDRG

SEQ ID NO: 134123 - protein, 9 aa, West Nile virus
KQGVVDRGW

SEQ ID NO: 134124 - protein, 9 aa, West Nile virus
SIDTCAKFT

SEQ ID NO: 134125 - protein, 9 aa, West Nile virus
IDTCAKFTC

SEQ ID NO: 134126 - protein, 9 aa, West Nile virus
DTCAKFACT

SEQ ID NO: 134127 - protein, 9 aa, West Nile virus
TCAKFACTT

SEQ ID NO: 134128 - protein, 9 aa, West Nile virus
CAKFACTTK

SEQ ID NO: 134129 - protein, 9 aa, West Nile virus
AKFACTTKA

SEQ ID NO: 134130 - protein, 9 aa, West Nile virus
KFACSTKAT

SEQ ID NO: 134131 - protein, 9 aa, West Nile virus
FACSTKATG

SEQ ID NO: 134132 - protein, 9 aa, West Nile virus
ACSTKATGR

SEQ ID NO: 134133 - protein, 9 aa, West Nile virus
CSTKATGRT

SEQ ID NO: 134134 - protein, 9 aa, West Nile virus
STKATGRTI

SEQ ID NO: 134135 - protein, 9 aa, West Nile virus
TKATGRTIL

SEQ ID NO: 134136 - protein, 9 aa, West Nile virus
KATGRTILK

SEQ ID NO: 134137 - protein, 9 aa, West Nile virus
ATGRTILKE

SEQ ID NO: 134138 - protein, 9 aa, West Nile virus
TGRTILKEN

SEQ ID NO: 134139 - protein, 9 aa, West Nile virus
GWIIQKENI

SEQ ID NO: 134140 - protein, 9 aa, West Nile virus
WIIQKENIK

SEQ ID NO: 134141 - protein, 9 aa, West Nile virus
IIQKENIKY

SEQ ID NO: 134142 - protein, 9 aa, West Nile virus
IQKENIKYE

SEQ ID NO: 134143 - protein, 9 aa, West Nile virus
QKENIKYEV

SEQ ID NO: 134144 - protein, 9 aa, West Nile virus
RENVKYEVA

SEQ ID NO: 134145 - protein, 9 aa, West Nile virus
ENVKYEVAA

SEQ ID NO: 134146 - protein, 9 aa, West Nile virus
NVKYEVAAF

SEQ ID NO: 134147 - protein, 9 aa, West Nile virus
VKYEVAAFV

SEQ ID NO: 134148 - protein, 9 aa, West Nile virus
KYEVAAFVH

SEQ ID NO: 134149 - protein, 9 aa, West Nile virus
YEVAAFVHG

SEQ ID NO: 134150 - protein, 9 aa, West Nile virus
EVAAFVHGP

SEQ ID NO: 134151 - protein, 9 aa, West Nile virus
VAAFVHGPT

SEQ ID NO: 134152 - protein, 9 aa, West Nile virus
AAFVHGPTT

SEQ ID NO: 134153 - protein, 9 aa, West Nile virus
AFVHGPTTV

SEQ ID NO: 134154 - protein, 9 aa, West Nile virus
FVHGPTTVD

SEQ ID NO: 134155 - protein, 9 aa, West Nile virus
VHGPTTVDT

SEQ ID NO: 134156 - protein, 9 aa, West Nile virus
HGPTTVDTH

SEQ ID NO: 134157 - protein, 9 aa, West Nile virus
GPTTVDTHS

SEQ ID NO: 134158 - protein, 9 aa, West Nile virus
AAVQAGRFS

SEQ ID NO: 134159 - protein, 9 aa, West Nile virus
AVQAGRFSV

SEQ ID NO: 134160 - protein, 9 aa, West Nile virus
VQAGRFSVS

SEQ ID NO: 134161 - protein, 9 aa, West Nile virus
QAGRFSVSP

SEQ ID NO: 134162 - protein, 9 aa, West Nile virus
AGRFSITPS

SEQ ID NO: 134163 - protein, 9 aa, West Nile virus
GRFSITPSA

SEQ ID NO: 134164 - protein, 9 aa, West Nile virus
RFSITPSAP

SEQ ID NO: 134165 - protein, 9 aa, West Nile virus
FSITPSAPS

SEQ ID NO: 134166 - protein, 9 aa, West Nile virus
SITPSAPSY

SEQ ID NO: 134167 - protein, 9 aa, West Nile virus
ITPSAPSYT

SEQ ID NO: 134168 - protein, 9 aa, West Nile virus
TLGDYGEVT

SEQ ID NO: 134169 - protein, 9 aa, West Nile virus
LGDYGEVTF

SEQ ID NO: 134170 - protein, 9 aa, West Nile virus
GDYGEVTFD

SEQ ID NO: 134171 - protein, 9 aa, West Nile virus
DYGEVTFDC

SEQ ID NO: 134172 - protein, 9 aa, West Nile virus
YGEVTFDCE

SEQ ID NO: 134173 - protein, 9 aa, West Nile virus
GEVTFDCEP

SEQ ID NO: 134174 - protein, 9 aa, West Nile virus
EVTFDCEPR

SEQ ID NO: 134175 - protein, 9 aa, West Nile virus
VTFDCEPRS

SEQ ID NO: 134176 - protein, 9 aa, West Nile virus
TFDCEPRSG

SEQ ID NO: 134177 - protein, 9 aa, West Nile virus
FDCEPRSGV

SEQ ID NO: 134178 - protein, 9 aa, West Nile virus
DCEPRSGVD

SEQ ID NO: 134179 - protein, 9 aa, West Nile virus
CEPRSGVDV

SEQ ID NO: 134180 - protein, 9 aa, West Nile virus
EPRSGIDTS

SEQ ID NO: 134181 - protein, 9 aa, West Nile virus
PRSGIDTSA

SEQ ID NO: 134182 - protein, 9 aa, West Nile virus
RSGIDTSAY

SEQ ID NO: 134183 - protein, 9 aa, West Nile virus
SGIDTSAYY

SEQ ID NO: 134184 - protein, 9 aa, West Nile virus
GIDTSAYYV

SEQ ID NO: 134185 - protein, 9 aa, West Nile virus
IDTSAYYVM

SEQ ID NO: 134186 - protein, 9 aa, West Nile virus
DTSAYYVMS

SEQ ID NO: 134187 - protein, 9 aa, West Nile virus
TSAYYVMSV

SEQ ID NO: 134188 - protein, 9 aa, West Nile virus
SAYYVMSVG

SEQ ID NO: 134189 - protein, 9 aa, West Nile virus
KSFLVHREW

SEQ ID NO: 134190 - protein, 9 aa, West Nile virus
SFLVHREWF

SEQ ID NO: 134191 - protein, 9 aa, West Nile virus
REWFMDLNM

SEQ ID NO: 134192 - protein, 9 aa, West Nile virus
EWFMDLNMP

SEQ ID NO: 134193 - protein, 9 aa, West Nile virus
WFTDLNLPW

SEQ ID NO: 134194 - protein, 9 aa, West Nile virus
FTDLNLPWS

SEQ ID NO: 134195 - protein, 9 aa, West Nile virus
TDLNLPWSS

SEQ ID NO: 134196 - protein, 9 aa, West Nile virus
DLNLPWSSP

SEQ ID NO: 134197 - protein, 9 aa, West Nile virus
LNLPWSSPG

SEQ ID NO: 134198 - protein, 9 aa, West Nile virus
NLPWSSPGN

SEQ ID NO: 134199 - protein, 9 aa, West Nile virus
LPWSSPGNT

SEQ ID NO: 134200 - protein, 9 aa, West Nile virus
WRNREALVE

SEQ ID NO: 134201 - protein, 9 aa, West Nile virus
RNREALVEF

SEQ ID NO: 134202 - protein, 9 aa, West Nile virus
NREALVEFE

SEQ ID NO: 134203 - protein, 9 aa, West Nile virus
REALVEFEE

SEQ ID NO: 134204 - protein, 9 aa, West Nile virus
EALVEFEEA

SEQ ID NO: 134205 - protein, 9 aa, West Nile virus
ALVEFEEAH

SEQ ID NO: 134206 - protein, 9 aa, West Nile virus
LVEFEEAHA

SEQ ID NO: 134207 - protein, 9 aa, West Nile virus
VEFEEAHAT

SEQ ID NO: 134208 - protein, 9 aa, West Nile virus
EFEEAHATK

SEQ ID NO: 134209 - protein, 9 aa, West Nile virus
FEEAHATKQ

SEQ ID NO: 134210 - protein, 9 aa, West Nile virus
EEAHATKQS

SEQ ID NO: 134211 - protein, 9 aa, West Nile virus
EAHATKQSV

SEQ ID NO: 134212 - protein, 9 aa, West Nile virus
PHATKQSVV

SEQ ID NO: 134213 - protein, 9 aa, West Nile virus
HATKQSVVA

SEQ ID NO: 134214 - protein, 9 aa, West Nile virus
ATKQSVVAL

SEQ ID NO: 134215 - protein, 9 aa, West Nile virus
TKQSVVALG

SEQ ID NO: 134216 - protein, 9 aa, West Nile virus
KQSVVALGS

SEQ ID NO: 134217 - protein, 9 aa, West Nile virus
QSVVALGSQ

SEQ ID NO: 134218 - protein, 9 aa, West Nile virus
SVVALGSQE

SEQ ID NO: 134219 - protein, 9 aa, West Nile virus
VVALGSQEG

SEQ ID NO: 134220 - protein, 9 aa, West Nile virus
VALGSQEGA

SEQ ID NO: 134221 - protein, 9 aa, West Nile virus
ALQQALAGA

SEQ ID NO: 134222 - protein, 9 aa, West Nile virus
LHQALAGTI

SEQ ID NO: 134223 - protein, 9 aa, West Nile virus
HQALAGTIP

SEQ ID NO: 134224 - protein, 9 aa, West Nile virus
QALAGTIPV

SEQ ID NO: 134225 - protein, 9 aa, West Nile virus
ALAGAIPVD

SEQ ID NO: 134226 - protein, 9 aa, West Nile virus
LAGAIPVDY

SEQ ID NO: 134227 - protein, 9 aa, West Nile virus
AGAIPVDYK

SEQ ID NO: 134228 - protein, 9 aa, West Nile virus
GAIPVDYKN

SEQ ID NO: 134229 - protein, 9 aa, West Nile virus
AIPVDYKNS

SEQ ID NO: 134230 - protein, 9 aa, West Nile virus
IPVDYKNSV

SEQ ID NO: 134231 - protein, 9 aa, West Nile virus
PVDYKNSVV

SEQ ID NO: 134232 - protein, 9 aa, West Nile virus
VDYKNSVVK

SEQ ID NO: 134233 - protein, 9 aa, West Nile virus
DYKNSVVKL

SEQ ID NO: 134234 - protein, 9 aa, West Nile virus
YKNSVVKLS

SEQ ID NO: 134235 - protein, 9 aa, West Nile virus
KNSVVKLSS

SEQ ID NO: 134236 - protein, 9 aa, West Nile virus
NSVVKLSSG

SEQ ID NO: 134237 - protein, 9 aa, West Nile virus
SVVKLSSGH

SEQ ID NO: 134238 - protein, 9 aa, West Nile virus
VVKLSSGHL

SEQ ID NO: 134239 - protein, 9 aa, West Nile virus
VKLSSGHLK

SEQ ID NO: 134240 - protein, 9 aa, West Nile virus
KLSSGHLKC

SEQ ID NO: 134241 - protein, 9 aa, West Nile virus
LSSGHLKCR

SEQ ID NO: 134242 - protein, 9 aa, West Nile virus
SSGHLKCRV

SEQ ID NO: 134243 - protein, 9 aa, West Nile virus
SGHLKCRVR

SEQ ID NO: 134244 - protein, 9 aa, West Nile virus
GHLKCRVRM

SEQ ID NO: 134245 - protein, 9 aa, West Nile virus
HLKCRVRME

SEQ ID NO: 134246 - protein, 9 aa, West Nile virus
LKCRVRMEK

SEQ ID NO: 134247 - protein, 9 aa, West Nile virus
KCRVRMEKL

SEQ ID NO: 134248 - protein, 9 aa, West Nile virus
CRVRMEKLQ

SEQ ID NO: 134249 - protein, 9 aa, West Nile virus
RVRMEKLQL

SEQ ID NO: 134250 - protein, 9 aa, West Nile virus
VRMEKLQLK

SEQ ID NO: 134251 - protein, 9 aa, West Nile virus
RMEKLQLKG

SEQ ID NO: 134252 - protein, 9 aa, West Nile virus
MEKLKLKGT

SEQ ID NO: 134253 - protein, 9 aa, West Nile virus
EKLKLKGTT

SEQ ID NO: 134254 - protein, 9 aa, West Nile virus
KLKLKGTTY

SEQ ID NO: 134255 - protein, 9 aa, West Nile virus
LKLKGTTYG

SEQ ID NO: 134256 - protein, 9 aa, West Nile virus
KLKGTTYGV

SEQ ID NO: 134257 - protein, 9 aa, West Nile virus
KGTTYGVCA

SEQ ID NO: 134258 - protein, 9 aa, West Nile virus
GTTYGVCAK

SEQ ID NO: 134259 - protein, 9 aa, West Nile virus
TTYGVCAKA

SEQ ID NO: 134260 - protein, 9 aa, West Nile virus
TYGVCAKAF

SEQ ID NO: 134261 - protein, 9 aa, West Nile virus
YGVCAKAFR

SEQ ID NO: 134262 - protein, 9 aa, West Nile virus
GVCAKAFRF

SEQ ID NO: 134263 - protein, 9 aa, West Nile virus
RTPADTGHG

SEQ ID NO: 134264 - protein, 9 aa, West Nile virus
DTGHGTVVM

SEQ ID NO: 134265 - protein, 9 aa, West Nile virus
TGHGTVVME

SEQ ID NO: 134266 - protein, 9 aa, West Nile virus
GHGTVVMEL

SEQ ID NO: 134267 - protein, 9 aa, West Nile virus
HGTVVMELQ

SEQ ID NO: 134268 - protein, 9 aa, West Nile virus
GTVVMELQY

SEQ ID NO: 134269 - protein, 9 aa, West Nile virus
TVVMELQYT

SEQ ID NO: 134270 - protein, 9 aa, West Nile virus
VVMELQYTG

SEQ ID NO: 134271 - protein, 9 aa, West Nile virus
VMELQYTGT

SEQ ID NO: 134272 - protein, 9 aa, West Nile virus
MELQYTGTD

SEQ ID NO: 134273 - protein, 9 aa, West Nile virus
ELQYTGKDG

SEQ ID NO: 134274 - protein, 9 aa, West Nile virus
LQYTGKDGP

SEQ ID NO: 134275 - protein, 9 aa, West Nile virus
QYTGKDGPC

SEQ ID NO: 134276 - protein, 9 aa, West Nile virus
YTGKDGPCK

SEQ ID NO: 134277 - protein, 9 aa, West Nile virus
TGTDGPCKI

SEQ ID NO: 134278 - protein, 9 aa, West Nile virus
GTDGPCKIP

SEQ ID NO: 134279 - protein, 9 aa, West Nile virus
TDGPCKIPI

SEQ ID NO: 134280 - protein, 9 aa, West Nile virus
DGPCKIPIS

SEQ ID NO: 134281 - protein, 9 aa, West Nile virus
GPCKIPITS

SEQ ID NO: 134282 - protein, 9 aa, West Nile virus
PCKIPISSV

SEQ ID NO: 134283 - protein, 9 aa, West Nile virus
CKIPITSVA

SEQ ID NO: 134284 - protein, 9 aa, West Nile virus
KIPISSVAS

SEQ ID NO: 134285 - protein, 9 aa, West Nile virus
IPITSVASL

SEQ ID NO: 134286 - protein, 9 aa, West Nile virus
PITSVASLN

SEQ ID NO: 134287 - protein, 9 aa, West Nile virus
ITSVASLND

SEQ ID NO: 134288 - protein, 9 aa, West Nile virus
TSVASLNDL

SEQ ID NO: 134289 - protein, 9 aa, West Nile virus
GRLVTVNPY

SEQ ID NO: 134290 - protein, 9 aa, West Nile virus
RLVTVNPYV

SEQ ID NO: 134291 - protein, 9 aa, West Nile virus
LVTVNPYVS

SEQ ID NO: 134292 - protein, 9 aa, West Nile virus
VTVNPYVSV

SEQ ID NO: 134293 - protein, 9 aa, West Nile virus
TVNPYVSVA

SEQ ID NO: 134294 - protein, 9 aa, West Nile virus
VNPYVSVAT

SEQ ID NO: 134295 - protein, 9 aa, West Nile virus
NPYVSVATA

SEQ ID NO: 134296 - protein, 9 aa, West Nile virus
TANSKVLIE

SEQ ID NO: 134297 - protein, 9 aa, West Nile virus
ANSKVLIEL

SEQ ID NO: 134298 - protein, 9 aa, West Nile virus
NSKVLIELE

SEQ ID NO: 134299 - protein, 9 aa, West Nile virus
SKVLIELEP

SEQ ID NO: 134300 - protein, 9 aa, West Nile virus
KILVELEPP

SEQ ID NO: 134301 - protein, 9 aa, West Nile virus
ILVELEPPF

SEQ ID NO: 134302 - protein, 9 aa, West Nile virus
LVELEPPFG

SEQ ID NO: 134303 - protein, 9 aa, West Nile virus
VELEPPFGD

SEQ ID NO: 134304 - protein, 9 aa, West Nile virus
PFGDSYIVI

SEQ ID NO: 134305 - protein, 9 aa, West Nile virus
FGDSYIVIG

SEQ ID NO: 134306 - protein, 9 aa, West Nile virus
GDSYIVIGK

SEQ ID NO: 134307 - protein, 9 aa, West Nile virus
DSYIVIGKG

SEQ ID NO: 134308 - protein, 9 aa, West Nile virus
SYIVIGKGD

SEQ ID NO: 134309 - protein, 9 aa, West Nile virus
YIVIGKGDQ

SEQ ID NO: 134310 - protein, 9 aa, West Nile virus
IVIGKGDQQ

SEQ ID NO: 134311 - protein, 9 aa, West Nile virus
VIGKGDQQV

SEQ ID NO: 134312 - protein, 9 aa, West Nile virus
IGKGDQQVT

SEQ ID NO: 134313 - protein, 9 aa, West Nile virus
GKGDQQVTH

SEQ ID NO: 134314 - protein, 9 aa, West Nile virus
KGDQQVTHH

SEQ ID NO: 134315 - protein, 9 aa, West Nile virus
GDQQVTHHW

SEQ ID NO: 134316 - protein, 9 aa, West Nile virus
DQQVTHHWH

SEQ ID NO: 134317 - protein, 9 aa, West Nile virus
QQVTHHWHK

SEQ ID NO: 134318 - protein, 9 aa, West Nile virus
QVTHHWHKS

SEQ ID NO: 134319 - protein, 9 aa, West Nile virus
VTHHWHKSG

SEQ ID NO: 134320 - protein, 9 aa, West Nile virus
THHWHKSGS

SEQ ID NO: 134321 - protein, 9 aa, West Nile virus
HHWYKSGSS

SEQ ID NO: 134322 - protein, 9 aa, West Nile virus
HWYKSGSSI

SEQ ID NO: 134323 - protein, 9 aa, West Nile virus
WHKSGISIG

SEQ ID NO: 134324 - protein, 9 aa, West Nile virus
YKSGSSIGK

SEQ ID NO: 134325 - protein, 9 aa, West Nile virus
GSSIGKAFA

SEQ ID NO: 134326 - protein, 9 aa, West Nile virus
SSIGKAFAT

SEQ ID NO: 134327 - protein, 9 aa, West Nile virus
SIGKAFATT

SEQ ID NO: 134328 - protein, 9 aa, West Nile virus
IGKAFATTL

SEQ ID NO: 134329 - protein, 9 aa, West Nile virus
GKAFTTTLR

SEQ ID NO: 134330 - protein, 9 aa, West Nile virus
KAFTTTLRG

SEQ ID NO: 134331 - protein, 9 aa, West Nile virus
AFTTTLRGA

SEQ ID NO: 134332 - protein, 9 aa, West Nile virus
FTTTLRGAQ

SEQ ID NO: 134333 - protein, 9 aa, West Nile virus
TTTLRGAQR

SEQ ID NO: 134334 - protein, 9 aa, West Nile virus
TTLRGAQRL

SEQ ID NO: 134335 - protein, 9 aa, West Nile virus
TLRGAQRLA

SEQ ID NO: 134336 - protein, 9 aa, West Nile virus
LRGAQRLAA

SEQ ID NO: 134337 - protein, 9 aa, West Nile virus
RGAQRLAAL

SEQ ID NO: 134338 - protein, 9 aa, West Nile virus
GAQRLVSLG

SEQ ID NO: 134339 - protein, 9 aa, West Nile virus
AQRLVSLGD

SEQ ID NO: 134340 - protein, 9 aa, West Nile virus
QRLVSLGDT

SEQ ID NO: 134341 - protein, 9 aa, West Nile virus
RLVSLGDTA

SEQ ID NO: 134342 - protein, 9 aa, West Nile virus
LVSLGDTAW

SEQ ID NO: 134343 - protein, 9 aa, West Nile virus
VSLGDTAWD

SEQ ID NO: 134344 - protein, 9 aa, West Nile virus
SLGDTAWDF

SEQ ID NO: 134345 - protein, 9 aa, West Nile virus
DTAWDFGSI

SEQ ID NO: 134346 - protein, 9 aa, West Nile virus
TAWDFGSIG

SEQ ID NO: 134347 - protein, 9 aa, West Nile virus
AWDFGSIGG

SEQ ID NO: 134348 - protein, 9 aa, West Nile virus
WDFGSIGGV

SEQ ID NO: 134349 - protein, 9 aa, West Nile virus
DFGSIGGVF

SEQ ID NO: 134350 - protein, 9 aa, West Nile virus
FGSIGGVFT

SEQ ID NO: 134351 - protein, 9 aa, West Nile virus
GSIGGVFTS

SEQ ID NO: 134352 - protein, 9 aa, West Nile virus
SIGGVFTSV

SEQ ID NO: 134353 - protein, 9 aa, West Nile virus
IGGVFTSVG

SEQ ID NO: 134354 - protein, 9 aa, West Nile virus
GGVFNSIGK

SEQ ID NO: 134355 - protein, 9 aa, West Nile virus
GVFNSIGKA

SEQ ID NO: 134356 - protein, 9 aa, West Nile virus
VFTSVGKAI

SEQ ID NO: 134357 - protein, 9 aa, West Nile virus
FTSVGKAIH

SEQ ID NO: 134358 - protein, 9 aa, West Nile virus
TSVGKAIHQ

SEQ ID NO: 134359 - protein, 9 aa, West Nile virus
SVGKAIHQV

SEQ ID NO: 134360 - protein, 9 aa, West Nile virus
VGKAIHQVF

SEQ ID NO: 134361 - protein, 9 aa, West Nile virus
GKAIHQVFG

SEQ ID NO: 134362 - protein, 9 aa, West Nile virus
KAIHQVFGG

SEQ ID NO: 134363 - protein, 9 aa, West Nile virus
AIHQVFGGA

SEQ ID NO: 134364 - protein, 9 aa, West Nile virus
IHQVFGGAF

SEQ ID NO: 134365 - protein, 9 aa, West Nile virus
HQLFGGAFR

SEQ ID NO: 134366 - protein, 9 aa, West Nile virus
QLFGGAFRS

SEQ ID NO: 134367 - protein, 9 aa, West Nile virus
LFGGAFRSL

SEQ ID NO: 134368 - protein, 9 aa, West Nile virus
FGGAFRLLF

SEQ ID NO: 134369 - protein, 9 aa, West Nile virus
GGAFRLLFG

SEQ ID NO: 134370 - protein, 9 aa, West Nile virus
GAFRLLFGG

SEQ ID NO: 134371 - protein, 9 aa, West Nile virus
AFRLLFGGM

SEQ ID NO: 134372 - protein, 9 aa, West Nile virus
FRLLFGGMS

SEQ ID NO: 134373 - protein, 9 aa, West Nile virus
RLLFGGMSW

SEQ ID NO: 134374 - protein, 9 aa, West Nile virus
LLFGGMSWI

SEQ ID NO: 134375 - protein, 9 aa, West Nile virus
GALLLWMGV

SEQ ID NO: 134376 - protein, 9 aa, West Nile virus
ALLLWMGIS

SEQ ID NO: 134377 - protein, 9 aa, West Nile virus
LLLWMGINS

SEQ ID NO: 134378 - protein, 9 aa, West Nile virus
LLWMGINSR

SEQ ID NO: 134379 - protein, 9 aa, West Nile virus
LWMGINSRD

SEQ ID NO: 134380 - protein, 9 aa, West Nile virus
WMGINSRDR

SEQ ID NO: 134381 - protein, 9 aa, West Nile virus
MGINSRDRS

SEQ ID NO: 134382 - protein, 9 aa, West Nile virus
GINSRDRSI

SEQ ID NO: 134383 - protein, 9 aa, West Nile virus
INSRDRSIA

SEQ ID NO: 134384 - protein, 9 aa, West Nile virus
NARDRSIAM

SEQ ID NO: 134385 - protein, 9 aa, West Nile virus
ARDRSIAMT

SEQ ID NO: 134386 - protein, 9 aa, West Nile virus
RDRSIAMTF

SEQ ID NO: 134387 - protein, 9 aa, West Nile virus
DRSIAMTFL

SEQ ID NO: 134388 - protein, 9 aa, West Nile virus
RSIAMTFLA

SEQ ID NO: 134389 - protein, 9 aa, West Nile virus
SIAMTFLAV

SEQ ID NO: 134390 - protein, 9 aa, West Nile virus
IAMTFLAVG

SEQ ID NO: 134391 - protein, 9 aa, West Nile virus
AMTFLAVGG

SEQ ID NO: 134392 - protein, 9 aa, West Nile virus
MTFLAVGGV

SEQ ID NO: 134393 - protein, 9 aa, West Nile virus
TFLAIGGVL

SEQ ID NO: 134394 - protein, 9 aa, West Nile virus
FLAVGGILL

SEQ ID NO: 134395 - protein, 9 aa, West Nile virus
LAIGGVLLF

SEQ ID NO: 134396 - protein, 9 aa, West Nile virus
AVGGILLFL

SEQ ID NO: 134397 - protein, 9 aa, West Nile virus
IGGVLLFLS

SEQ ID NO: 134398 - protein, 9 aa, West Nile virus
GGILLFLSV

SEQ ID NO: 134399 - protein, 9 aa, West Nile virus
GVLLFLSIN

SEQ ID NO: 134400 - protein, 9 aa, West Nile virus
ILLFLSVNV

SEQ ID NO: 134401 - protein, 9 aa, West Nile virus
LLFLSANVH

SEQ ID NO: 134402 - protein, 9 aa, West Nile virus
LFLSVSVHA

SEQ ID NO: 134403 - protein, 9 aa, West Nile virus
FLSINVHAD

SEQ ID NO: 134404 - protein, 9 aa, West Nile virus
LSINVHADT

SEQ ID NO: 134405 - protein, 9 aa, West Nile virus
SANVHADTG

SEQ ID NO: 134406 - protein, 9 aa, West Nile virus
ANVHADTGC

SEQ ID NO: 134407 - protein, 9 aa, West Nile virus
ADTGCAIDL

SEQ ID NO: 134408 - protein, 9 aa, West Nile virus
DTGCAIDIG

SEQ ID NO: 134409 - protein, 9 aa, West Nile virus
TGCAIDIGR

SEQ ID NO: 134410 - protein, 9 aa, West Nile virus
GCAIDIGRQ

SEQ ID NO: 134411 - protein, 9 aa, West Nile virus
CAIDIGRQE

SEQ ID NO: 134412 - protein, 9 aa, West Nile virus
AIDIGRQEL

SEQ ID NO: 134413 - protein, 9 aa, West Nile virus
IDIGRQELR

SEQ ID NO: 134414 - protein, 9 aa, West Nile virus
DIGRQELRC

SEQ ID NO: 134415 - protein, 9 aa, West Nile virus
IGRQELRCG

SEQ ID NO: 134416 - protein, 9 aa, West Nile virus
GRQELRCGS

SEQ ID NO: 134417 - protein, 9 aa, West Nile virus
RCGSGVFIY

SEQ ID NO: 134418 - protein, 9 aa, West Nile virus
CGNGVFIHN

SEQ ID NO: 134419 - protein, 9 aa, West Nile virus
GNGVFIHND

SEQ ID NO: 134420 - protein, 9 aa, West Nile virus
NGVFIHNDV

SEQ ID NO: 134421 - protein, 9 aa, West Nile virus
GVFIYNDVE

SEQ ID NO: 134422 - protein, 9 aa, West Nile virus
VFIHNDVKA

SEQ ID NO: 134423 - protein, 9 aa, West Nile virus
FIHNDVKAW

SEQ ID NO: 134424 - protein, 9 aa, West Nile virus
NDVEAWVDR

SEQ ID NO: 134425 - protein, 9 aa, West Nile virus
DVEAWVDRY

SEQ ID NO: 134426 - protein, 9 aa, West Nile virus
VEAWVDRYR

SEQ ID NO: 134427 - protein, 9 aa, West Nile virus
DRYKFYPET

SEQ ID NO: 134428 - protein, 9 aa, West Nile virus
RYKFYPETP

SEQ ID NO: 134429 - protein, 9 aa, West Nile virus
YKFYPETPQ

SEQ ID NO: 134430 - protein, 9 aa, West Nile virus
KFYPETPQG

SEQ ID NO: 134431 - protein, 9 aa, West Nile virus
FYPETPQGL

SEQ ID NO: 134432 - protein, 9 aa, West Nile virus
HPETPQGLA

SEQ ID NO: 134433 - protein, 9 aa, West Nile virus
PETPQGLAR

SEQ ID NO: 134434 - protein, 9 aa, West Nile virus
ETPQGLARI

SEQ ID NO: 134435 - protein, 9 aa, West Nile virus
TPQGLARII

SEQ ID NO: 134436 - protein, 9 aa, West Nile virus
PQGLAKIIH

SEQ ID NO: 134437 - protein, 9 aa, West Nile virus
QGLAKIIHN

SEQ ID NO: 134438 - protein, 9 aa, West Nile virus
GLAKIIHNA

SEQ ID NO: 134439 - protein, 9 aa, West Nile virus
LAKIIHNAH

SEQ ID NO: 134440 - protein, 9 aa, West Nile virus
EGVCGVRSV

SEQ ID NO: 134441 - protein, 9 aa, West Nile virus
GVCGVRSVS

SEQ ID NO: 134442 - protein, 9 aa, West Nile virus
VCGVRSVSR

SEQ ID NO: 134443 - protein, 9 aa, West Nile virus
CGVRSVSRL

SEQ ID NO: 134444 - protein, 9 aa, West Nile virus
GVRSVSRLE

SEQ ID NO: 134445 - protein, 9 aa, West Nile virus
VRSVSRLEH

SEQ ID NO: 134446 - protein, 9 aa, West Nile virus
SRLEHQMWD

SEQ ID NO: 134447 - protein, 9 aa, West Nile virus
RLEHQMWES

SEQ ID NO: 134448 - protein, 9 aa, West Nile virus
LEHQMWESV

SEQ ID NO: 134449 - protein, 9 aa, West Nile virus
EHQMWESVK

SEQ ID NO: 134450 - protein, 9 aa, West Nile virus
HQMWESVKD

SEQ ID NO: 134451 - protein, 9 aa, West Nile virus
QMWESVKDE

SEQ ID NO: 134452 - protein, 9 aa, West Nile virus
MWESVKDEL

SEQ ID NO: 134453 - protein, 9 aa, West Nile virus
WESVKDELN

SEQ ID NO: 134454 - protein, 9 aa, West Nile virus
ESVKDELNT

SEQ ID NO: 134455 - protein, 9 aa, West Nile virus
SVKDELNTL

SEQ ID NO: 134456 - protein, 9 aa, West Nile virus
IKDELNTLL

SEQ ID NO: 134457 - protein, 9 aa, West Nile virus
KDELNTLFR

SEQ ID NO: 134458 - protein, 9 aa, West Nile virus
DELNTLFRE

SEQ ID NO: 134459 - protein, 9 aa, West Nile virus
ELNTPLKEN

SEQ ID NO: 134460 - protein, 9 aa, West Nile virus
LNTLFRENG

SEQ ID NO: 134461 - protein, 9 aa, West Nile virus
NTLLKENGI

SEQ ID NO: 134462 - protein, 9 aa, West Nile virus
TLLKENGID

SEQ ID NO: 134463 - protein, 9 aa, West Nile virus
LLKENGIDL

SEQ ID NO: 134464 - protein, 9 aa, West Nile virus
LKENGIDLS

SEQ ID NO: 134465 - protein, 9 aa, West Nile virus
KENGVDLSI

SEQ ID NO: 134466 - protein, 9 aa, West Nile virus
ENGVDLSIV

SEQ ID NO: 134467 - protein, 9 aa, West Nile virus
NGVDLSIVV

SEQ ID NO: 134468 - protein, 9 aa, West Nile virus
GVDLSIVVE

SEQ ID NO: 134469 - protein, 9 aa, West Nile virus
VDLSIVVEK

SEQ ID NO: 134470 - protein, 9 aa, West Nile virus
DLSIVVEKQ

SEQ ID NO: 134471 - protein, 9 aa, West Nile virus
ATTEKLEMG

SEQ ID NO: 134472 - protein, 9 aa, West Nile virus
TTEKLEMGW

SEQ ID NO: 134473 - protein, 9 aa, West Nile virus
TEKLEMGWK

SEQ ID NO: 134474 - protein, 9 aa, West Nile virus
EKLEMGWKA

SEQ ID NO: 134475 - protein, 9 aa, West Nile virus
KLEMGWKAW

SEQ ID NO: 134476 - protein, 9 aa, West Nile virus
LEMGWKAWG

SEQ ID NO: 134477 - protein, 9 aa, West Nile virus
EMGWKAWGK

SEQ ID NO: 134478 - protein, 9 aa, West Nile virus
MGWKAWGKS

SEQ ID NO: 134479 - protein, 9 aa, West Nile virus
WKAWGKSII

SEQ ID NO: 134480 - protein, 9 aa, West Nile virus
KAWGKSIIF

SEQ ID NO: 134481 - protein, 9 aa, West Nile virus
AWGKSIIFA

SEQ ID NO: 134482 - protein, 9 aa, West Nile virus
WGKSIIFAP

SEQ ID NO: 134483 - protein, 9 aa, West Nile virus
GKSIIFAPE

SEQ ID NO: 134484 - protein, 9 aa, West Nile virus
KSIIFAPEL

SEQ ID NO: 134485 - protein, 9 aa, West Nile virus
SIIFAPELA

SEQ ID NO: 134486 - protein, 9 aa, West Nile virus
IIFAPELAN

SEQ ID NO: 134487 - protein, 9 aa, West Nile virus
FAPELANHT

SEQ ID NO: 134488 - protein, 9 aa, West Nile virus
APELANHTF

SEQ ID NO: 134489 - protein, 9 aa, West Nile virus
PELANHTFV

SEQ ID NO: 134490 - protein, 9 aa, West Nile virus
ELANNTFVI

SEQ ID NO: 134491 - protein, 9 aa, West Nile virus
LANNTFVID

SEQ ID NO: 134492 - protein, 9 aa, West Nile virus
ANNTFVIDG

SEQ ID NO: 134493 - protein, 9 aa, West Nile virus
NNTFVIDGP

SEQ ID NO: 134494 - protein, 9 aa, West Nile virus
NTFVIDGPE

SEQ ID NO: 134495 - protein, 9 aa, West Nile virus
TFVIDGPET

SEQ ID NO: 134496 - protein, 9 aa, West Nile virus
FVIDGPETE

SEQ ID NO: 134497 - protein, 9 aa, West Nile virus
VIDGPETEE

SEQ ID NO: 134498 - protein, 9 aa, West Nile virus
IDGPETEEC

SEQ ID NO: 134499 - protein, 9 aa, West Nile virus
DGPETEECP

SEQ ID NO: 134500 - protein, 9 aa, West Nile virus
GPETEECPT

SEQ ID NO: 134501 - protein, 9 aa, West Nile virus
NRAWNSMEV

SEQ ID NO: 134502 - protein, 9 aa, West Nile virus
RAWNSMEVE

SEQ ID NO: 134503 - protein, 9 aa, West Nile virus
AWNSMEVED

SEQ ID NO: 134504 - protein, 9 aa, West Nile virus
WNSMEVEDF

SEQ ID NO: 134505 - protein, 9 aa, West Nile virus
NSMEVEDFG

SEQ ID NO: 134506 - protein, 9 aa, West Nile virus
SMEVEDFGF

SEQ ID NO: 134507 - protein, 9 aa, West Nile virus
MEVEDFGFG

SEQ ID NO: 134508 - protein, 9 aa, West Nile virus
GFGLMTTRM

SEQ ID NO: 134509 - protein, 9 aa, West Nile virus
FGLMTTRMF

SEQ ID NO: 134510 - protein, 9 aa, West Nile virus
GLTSTRMFM

SEQ ID NO: 134511 - protein, 9 aa, West Nile virus
LTSTRMFLR

SEQ ID NO: 134512 - protein, 9 aa, West Nile virus
IRETNTTEC

SEQ ID NO: 134513 - protein, 9 aa, West Nile virus
RETNTTECD

SEQ ID NO: 134514 - protein, 9 aa, West Nile virus
TNTTECDSK

SEQ ID NO: 134515 - protein, 9 aa, West Nile virus
NTTECDTKI

SEQ ID NO: 134516 - protein, 9 aa, West Nile virus
TTECDTKII

SEQ ID NO: 134517 - protein, 9 aa, West Nile virus
TECDTKIIG

SEQ ID NO: 134518 - protein, 9 aa, West Nile virus
ECDTKIIGT

SEQ ID NO: 134519 - protein, 9 aa, West Nile virus
CDTKIIGTA

SEQ ID NO: 134520 - protein, 9 aa, West Nile virus
DTKIIGTAV

SEQ ID NO: 134521 - protein, 9 aa, West Nile virus
TKIIGTAVK

SEQ ID NO: 134522 - protein, 9 aa, West Nile virus
KTIGTAVKN

SEQ ID NO: 134523 - protein, 9 aa, West Nile virus
TIGTAVKNN

SEQ ID NO: 134524 - protein, 9 aa, West Nile virus
IGTAVKNNM

SEQ ID NO: 134525 - protein, 9 aa, West Nile virus
GTAVKNNMA

SEQ ID NO: 134526 - protein, 9 aa, West Nile virus
TAVKNNMAV

SEQ ID NO: 134527 - protein, 9 aa, West Nile virus
AVKNNMAVH

SEQ ID NO: 134528 - protein, 9 aa, West Nile virus
VKNNMAVHS

SEQ ID NO: 134529 - protein, 9 aa, West Nile virus
KNNMAVHSD

SEQ ID NO: 134530 - protein, 9 aa, West Nile virus
NNMAVHSDL

SEQ ID NO: 134531 - protein, 9 aa, West Nile virus
NMAVHSDLS

SEQ ID NO: 134532 - protein, 9 aa, West Nile virus
MAVHSDLSY

SEQ ID NO: 134533 - protein, 9 aa, West Nile virus
AVHSDLSYW

SEQ ID NO: 134534 - protein, 9 aa, West Nile virus
VHSDLSYWI

SEQ ID NO: 134535 - protein, 9 aa, West Nile virus
DLSYWIESG

SEQ ID NO: 134536 - protein, 9 aa, West Nile virus
LSYWIESGL

SEQ ID NO: 134537 - protein, 9 aa, West Nile virus
SYWIESGLN

SEQ ID NO: 134538 - protein, 9 aa, West Nile virus
FNDTWKLER

SEQ ID NO: 134539 - protein, 9 aa, West Nile virus
NETWKLERA

SEQ ID NO: 134540 - protein, 9 aa, West Nile virus
ETWKLERAV

SEQ ID NO: 134541 - protein, 9 aa, West Nile virus
PETHTLWGE

SEQ ID NO: 134542 - protein, 9 aa, West Nile virus
ETHTLWGEG

SEQ ID NO: 134543 - protein, 9 aa, West Nile virus
THTLWGDGV

SEQ ID NO: 134544 - protein, 9 aa, West Nile virus
HTLWGDGVL

SEQ ID NO: 134545 - protein, 9 aa, West Nile virus
TLWGDGVLE

SEQ ID NO: 134546 - protein, 9 aa, West Nile virus
LWGDGVLES

SEQ ID NO: 134547 - protein, 9 aa, West Nile virus
GVLESDLII

SEQ ID NO: 134548 - protein, 9 aa, West Nile virus
VLESDLIIP

SEQ ID NO: 134549 - protein, 9 aa, West Nile virus
ESDLIIPIT

SEQ ID NO: 134550 - protein, 9 aa, West Nile virus
SDLIIPITL

SEQ ID NO: 134551 - protein, 9 aa, West Nile virus
DLIIPITLA

SEQ ID NO: 134552 - protein, 9 aa, West Nile virus
LIIPITLAG

SEQ ID NO: 134553 - protein, 9 aa, West Nile virus
IIPITLAGP

SEQ ID NO: 134554 - protein, 9 aa, West Nile virus
IPITLAGPR

SEQ ID NO: 134555 - protein, 9 aa, West Nile virus
PITLAGPRS

SEQ ID NO: 134556 - protein, 9 aa, West Nile virus
ITLAGPRSN

SEQ ID NO: 134557 - protein, 9 aa, West Nile virus
TLAGLRSNH

SEQ ID NO: 134558 - protein, 9 aa, West Nile virus
LAGLRSNHN

SEQ ID NO: 134559 - protein, 9 aa, West Nile virus
AGLRSNHNR

SEQ ID NO: 134560 - protein, 9 aa, West Nile virus
GLRSNHNRR

SEQ ID NO: 134561 - protein, 9 aa, West Nile virus
LRSNHNRRP

SEQ ID NO: 134562 - protein, 9 aa, West Nile virus
RSNYNRRPG

SEQ ID NO: 134563 - protein, 9 aa, West Nile virus
SNYNRRPGY

SEQ ID NO: 134564 - protein, 9 aa, West Nile virus
NHNKRPGYK

SEQ ID NO: 134565 - protein, 9 aa, West Nile virus
HNKRPGYKT

SEQ ID NO: 134566 - protein, 9 aa, West Nile virus
NKRPGYKTQ

SEQ ID NO: 134567 - protein, 9 aa, West Nile virus
RRPGYKTQS

SEQ ID NO: 134568 - protein, 9 aa, West Nile virus
RPGYKTQSQ

SEQ ID NO: 134569 - protein, 9 aa, West Nile virus
PGYKTQSQG

SEQ ID NO: 134570 - protein, 9 aa, West Nile virus
GYKTQSQGP

SEQ ID NO: 134571 - protein, 9 aa, West Nile virus
YKTQSQGPW

SEQ ID NO: 134572 - protein, 9 aa, West Nile virus
KTQSQGPWD

SEQ ID NO: 134573 - protein, 9 aa, West Nile virus
TQSQGPWDE

SEQ ID NO: 134574 - protein, 9 aa, West Nile virus
QSQGPWDEG

SEQ ID NO: 134575 - protein, 9 aa, West Nile virus
SQGPWDEGR

SEQ ID NO: 134576 - protein, 9 aa, West Nile virus
QGPWDEGRI

SEQ ID NO: 134577 - protein, 9 aa, West Nile virus
GPWDEGRIE

SEQ ID NO: 134578 - protein, 9 aa, West Nile virus
PWDEGRVEL

SEQ ID NO: 134579 - protein, 9 aa, West Nile virus
WDEGRVELD

SEQ ID NO: 134580 - protein, 9 aa, West Nile virus
DEGRVELDF

SEQ ID NO: 134581 - protein, 9 aa, West Nile virus
EGRVELDFD

SEQ ID NO: 134582 - protein, 9 aa, West Nile virus
GRVELDFDY

SEQ ID NO: 134583 - protein, 9 aa, West Nile virus
RVELDFDYC

SEQ ID NO: 134584 - protein, 9 aa, West Nile virus
VELDFDYCP

SEQ ID NO: 134585 - protein, 9 aa, West Nile virus
ELDFDYCPG

SEQ ID NO: 134586 - protein, 9 aa, West Nile virus
LDFDYCPGT

SEQ ID NO: 134587 - protein, 9 aa, West Nile virus
YCPGTTVTI

SEQ ID NO: 134588 - protein, 9 aa, West Nile virus
CPGTTVTIS

SEQ ID NO: 134589 - protein, 9 aa, West Nile virus
CGHRGPAAR

SEQ ID NO: 134590 - protein, 9 aa, West Nile virus
GHRGPAART

SEQ ID NO: 134591 - protein, 9 aa, West Nile virus
HRGPAARTT

SEQ ID NO: 134592 - protein, 9 aa, West Nile virus
RGPAARTTT

SEQ ID NO: 134593 - protein, 9 aa, West Nile virus
GPAARTTTE

SEQ ID NO: 134594 - protein, 9 aa, West Nile virus
PAARTTTES

SEQ ID NO: 134595 - protein, 9 aa, West Nile virus
AARTTTESG

SEQ ID NO: 134596 - protein, 9 aa, West Nile virus
ARTTTESGK

SEQ ID NO: 134597 - protein, 9 aa, West Nile virus
TTESGKLIS

SEQ ID NO: 134598 - protein, 9 aa, West Nile virus
TESGKLISD

SEQ ID NO: 134599 - protein, 9 aa, West Nile virus
ESGKLISDW

SEQ ID NO: 134600 - protein, 9 aa, West Nile virus
SGKLISDWC

SEQ ID NO: 134601 - protein, 9 aa, West Nile virus
GKLISDWCC

SEQ ID NO: 134602 - protein, 9 aa, West Nile virus
KLISDWCCR

SEQ ID NO: 134603 - protein, 9 aa, West Nile virus
LISDWCCRS

SEQ ID NO: 134604 - protein, 9 aa, West Nile virus
ISDWCCRSC

SEQ ID NO: 134605 - protein, 9 aa, West Nile virus
SDWCCRSCT

SEQ ID NO: 134606 - protein, 9 aa, West Nile virus
SCTLPPLRF

SEQ ID NO: 134607 - protein, 9 aa, West Nile virus
CTLPPLRFQ

SEQ ID NO: 134608 - protein, 9 aa, West Nile virus
TLPPLRFQT

SEQ ID NO: 134609 - protein, 9 aa, West Nile virus
LPPLRFQTE

SEQ ID NO: 134610 - protein, 9 aa, West Nile virus
TENGCWYGM

SEQ ID NO: 134611 - protein, 9 aa, West Nile virus
ENGCWYGME

SEQ ID NO: 134612 - protein, 9 aa, West Nile virus
NGCWYGMEI

SEQ ID NO: 134613 - protein, 9 aa, West Nile virus
WYGMEIRPT

SEQ ID NO: 134614 - protein, 9 aa, West Nile virus
YGMEIRPTR

SEQ ID NO: 134615 - protein, 9 aa, West Nile virus
GMEIRPTRH

SEQ ID NO: 134616 - protein, 9 aa, West Nile virus
MEIRPTRHD

SEQ ID NO: 134617 - protein, 9 aa, West Nile virus
EIRPTRHDE

SEQ ID NO: 134618 - protein, 9 aa, West Nile virus
IRPTRHDEK

SEQ ID NO: 134619 - protein, 9 aa, West Nile virus
RPTRHDEKT

SEQ ID NO: 134620 - protein, 9 aa, West Nile virus
PTRHDEKTL

SEQ ID NO: 134621 - protein, 9 aa, West Nile virus
TRHDEKTLV

SEQ ID NO: 134622 - protein, 9 aa, West Nile virus
KHDERTLVQ

SEQ ID NO: 134623 - protein, 9 aa, West Nile virus
HDGKTLVQS

SEQ ID NO: 134624 - protein, 9 aa, West Nile virus
DEKTLVQSR

SEQ ID NO: 134625 - protein, 9 aa, West Nile virus
EKTLVQSRV

SEQ ID NO: 134626 - protein, 9 aa, West Nile virus
KTLVQSRVN

SEQ ID NO: 134627 - protein, 9 aa, West Nile virus
TLVQSRVNA

SEQ ID NO: 134628 - protein, 9 aa, West Nile virus
LVQSRVNAY

SEQ ID NO: 134629 - protein, 9 aa, West Nile virus
VQSRVNAYN

SEQ ID NO: 134630 - protein, 9 aa, West Nile virus
QSRVNAYNA

SEQ ID NO: 134631 - protein, 9 aa, West Nile virus
SRVNAYNAD

SEQ ID NO: 134632 - protein, 9 aa, West Nile virus
RVNAYNADM

SEQ ID NO: 134633 - protein, 9 aa, West Nile virus
VTAYNADMI

SEQ ID NO: 134634 - protein, 9 aa, West Nile virus
TAYNADMID

SEQ ID NO: 134635 - protein, 9 aa, West Nile virus
AHNADMIDP

SEQ ID NO: 134636 - protein, 9 aa, West Nile virus
YKSDMIDPF

SEQ ID NO: 134637 - protein, 9 aa, West Nile virus
NAEMIDPFQ

SEQ ID NO: 134638 - protein, 9 aa, West Nile virus
AEMIDPFQL

SEQ ID NO: 134639 - protein, 9 aa, West Nile virus
IDPFQLGLM

SEQ ID NO: 134640 - protein, 9 aa, West Nile virus
DPFQLGLMV

SEQ ID NO: 134641 - protein, 9 aa, West Nile virus
PFQLGLMVV

SEQ ID NO: 134642 - protein, 9 aa, West Nile virus
FQLGLMVVF

SEQ ID NO: 134643 - protein, 9 aa, West Nile virus
QLGLMVVFL

SEQ ID NO: 134644 - protein, 9 aa, West Nile virus
LGLMVVFLA

SEQ ID NO: 134645 - protein, 9 aa, West Nile virus
GLMVVFLAT

SEQ ID NO: 134646 - protein, 9 aa, West Nile virus
LMVVFLATQ

SEQ ID NO: 134647 - protein, 9 aa, West Nile virus
MVVFLATQE

SEQ ID NO: 134648 - protein, 9 aa, West Nile virus
VVFLATKEV

SEQ ID NO: 134649 - protein, 9 aa, West Nile virus
VFLVTQEVL

SEQ ID NO: 134650 - protein, 9 aa, West Nile virus
FLATKEVLR

SEQ ID NO: 134651 - protein, 9 aa, West Nile virus
LATKEVLRK

SEQ ID NO: 134652 - protein, 9 aa, West Nile virus
VTQEVLRKR

SEQ ID NO: 134653 - protein, 9 aa, West Nile virus
TKEVLRKRW

SEQ ID NO: 134654 - protein, 9 aa, West Nile virus
KEVLRKRWT

SEQ ID NO: 134655 - protein, 9 aa, West Nile virus
KRWTAKISI

SEQ ID NO: 134656 - protein, 9 aa, West Nile virus
RWTAKISIP

SEQ ID NO: 134657 - protein, 9 aa, West Nile virus
WTAKISIPA

SEQ ID NO: 134658 - protein, 9 aa, West Nile virus
TAKISIPAI

SEQ ID NO: 134659 - protein, 9 aa, West Nile virus
PAIMLALLV

SEQ ID NO: 134660 - protein, 9 aa, West Nile virus
AIMLALLVL

SEQ ID NO: 134661 - protein, 9 aa, West Nile virus
IMLALLVLV

SEQ ID NO: 134662 - protein, 9 aa, West Nile virus
MLALLVLVF

SEQ ID NO: 134663 - protein, 9 aa, West Nile virus
LALLVLVFG

SEQ ID NO: 134664 - protein, 9 aa, West Nile virus
ALLTLVFGG

SEQ ID NO: 134665 - protein, 9 aa, West Nile virus
LLTLVFGGV

SEQ ID NO: 134666 - protein, 9 aa, West Nile virus
LTLVFGGVT

SEQ ID NO: 134667 - protein, 9 aa, West Nile virus
TLVFGGVTY

SEQ ID NO: 134668 - protein, 9 aa, West Nile virus
LVFGGVTYT

SEQ ID NO: 134669 - protein, 9 aa, West Nile virus
VFGGVTYTD

SEQ ID NO: 134670 - protein, 9 aa, West Nile virus
FGGVTYTDL

SEQ ID NO: 134671 - protein, 9 aa, West Nile virus
GGVTYTDLI

SEQ ID NO: 134672 - protein, 9 aa, West Nile virus
GVTYTDLIR

SEQ ID NO: 134673 - protein, 9 aa, West Nile virus
VTYTDLIRY

SEQ ID NO: 134674 - protein, 9 aa, West Nile virus
TYTDLIRYV

SEQ ID NO: 134675 - protein, 9 aa, West Nile virus
YTDLIRYVI

SEQ ID NO: 134676 - protein, 9 aa, West Nile virus
TDLIRYVIL

SEQ ID NO: 134677 - protein, 9 aa, West Nile virus
DLIRYVILV

SEQ ID NO: 134678 - protein, 9 aa, West Nile virus
LIRYVILVG

SEQ ID NO: 134679 - protein, 9 aa, West Nile virus
IRYVILVGA

SEQ ID NO: 134680 - protein, 9 aa, West Nile virus
RYVNLVGAA

SEQ ID NO: 134681 - protein, 9 aa, West Nile virus
YIILVGAAF

SEQ ID NO: 134682 - protein, 9 aa, West Nile virus
IILVGAAFM

SEQ ID NO: 134683 - protein, 9 aa, West Nile virus
ILAGAAFAE

SEQ ID NO: 134684 - protein, 9 aa, West Nile virus
LVGAAFAEA

SEQ ID NO: 134685 - protein, 9 aa, West Nile virus
VGAAFAEAN

SEQ ID NO: 134686 - protein, 9 aa, West Nile virus
GAAFAEANS

SEQ ID NO: 134687 - protein, 9 aa, West Nile virus
AAFAEANSG

SEQ ID NO: 134688 - protein, 9 aa, West Nile virus
AFAEANSGG

SEQ ID NO: 134689 - protein, 9 aa, West Nile virus
FAEANSGGD

SEQ ID NO: 134690 - protein, 9 aa, West Nile virus
AEANSGGDV

SEQ ID NO: 134691 - protein, 9 aa, West Nile virus
EANSGGDVV

SEQ ID NO: 134692 - protein, 9 aa, West Nile virus
ANSGGDVVH

SEQ ID NO: 134693 - protein, 9 aa, West Nile virus
HLALMATFR

SEQ ID NO: 134694 - protein, 9 aa, West Nile virus
LALMATFKV

SEQ ID NO: 134695 - protein, 9 aa, West Nile virus
ALMATFKVQ

SEQ ID NO: 134696 - protein, 9 aa, West Nile virus
LMATFKVQP

SEQ ID NO: 134697 - protein, 9 aa, West Nile virus
MATFKIQPA

SEQ ID NO: 134698 - protein, 9 aa, West Nile virus
ATFKIQPAF

SEQ ID NO: 134699 - protein, 9 aa, West Nile virus
IQPVFLVAS

SEQ ID NO: 134700 - protein, 9 aa, West Nile virus
QPVFLVASF

SEQ ID NO: 134701 - protein, 9 aa, West Nile virus
PVFLVASFL

SEQ ID NO: 134702 - protein, 9 aa, West Nile virus
VFLVASFLK

SEQ ID NO: 134703 - protein, 9 aa, West Nile virus
FLVASFLKA

SEQ ID NO: 134704 - protein, 9 aa, West Nile virus
VASFLKTRW

SEQ ID NO: 134705 - protein, 9 aa, West Nile virus
ASFLKTRWT

SEQ ID NO: 134706 - protein, 9 aa, West Nile virus
SFLKTRWTN

SEQ ID NO: 134707 - protein, 9 aa, West Nile virus
RWTNQESIL

SEQ ID NO: 134708 - protein, 9 aa, West Nile virus
WTNQESILL

SEQ ID NO: 134709 - protein, 9 aa, West Nile virus
TNQESILLM

SEQ ID NO: 134710 - protein, 9 aa, West Nile virus
NQESILLML

SEQ ID NO: 134711 - protein, 9 aa, West Nile virus
QESILLMLA

SEQ ID NO: 134712 - protein, 9 aa, West Nile virus
ESILLMLAA

SEQ ID NO: 134713 - protein, 9 aa, West Nile virus
SILLMLAAA

SEQ ID NO: 134714 - protein, 9 aa, West Nile virus
ILLMLAAAF

SEQ ID NO: 134715 - protein, 9 aa, West Nile virus
LLMLAAAFF

SEQ ID NO: 134716 - protein, 9 aa, West Nile virus
LMLAAAFFQ

SEQ ID NO: 134717 - protein, 9 aa, West Nile virus
MLAAAFFQM

SEQ ID NO: 134718 - protein, 9 aa, West Nile virus
LAAAFFQMA

SEQ ID NO: 134719 - protein, 9 aa, West Nile virus
AAAFFQMAY

SEQ ID NO: 134720 - protein, 9 aa, West Nile virus
AAFFQMAYY

SEQ ID NO: 134721 - protein, 9 aa, West Nile virus
AFFQMAYYD

SEQ ID NO: 134722 - protein, 9 aa, West Nile virus
FFQMAYYDA

SEQ ID NO: 134723 - protein, 9 aa, West Nile virus
FQMAYYDAK

SEQ ID NO: 134724 - protein, 9 aa, West Nile virus
WEVPDVLNS

SEQ ID NO: 134725 - protein, 9 aa, West Nile virus
EVPDVLNSL

SEQ ID NO: 134726 - protein, 9 aa, West Nile virus
VPDVLNSLS

SEQ ID NO: 134727 - protein, 9 aa, West Nile virus
PDVLNSLSV

SEQ ID NO: 134728 - protein, 9 aa, West Nile virus
DVLNSLSVA

SEQ ID NO: 134729 - protein, 9 aa, West Nile virus
VLNSLSVAW

SEQ ID NO: 134730 - protein, 9 aa, West Nile virus
LNSLSVAWM

SEQ ID NO: 134731 - protein, 9 aa, West Nile virus
NSLSVAWMI

SEQ ID NO: 134732 - protein, 9 aa, West Nile virus
SLSVAWMIL

SEQ ID NO: 134733 - protein, 9 aa, West Nile virus
LSVAWMILR

SEQ ID NO: 134734 - protein, 9 aa, West Nile virus
SVAWMILRA

SEQ ID NO: 134735 - protein, 9 aa, West Nile virus
IAWMILRAI

SEQ ID NO: 134736 - protein, 9 aa, West Nile virus
AWMILRAIS

SEQ ID NO: 134737 - protein, 9 aa, West Nile virus
WMILRAISF

SEQ ID NO: 134738 - protein, 9 aa, West Nile virus
MILRAISFT

SEQ ID NO: 134739 - protein, 9 aa, West Nile virus
FTNTSNVVV

SEQ ID NO: 134740 - protein, 9 aa, West Nile virus
TNTSNVVVP

SEQ ID NO: 134741 - protein, 9 aa, West Nile virus
NTSNVVVPL

SEQ ID NO: 134742 - protein, 9 aa, West Nile virus
TSNVATPLL

SEQ ID NO: 134743 - protein, 9 aa, West Nile virus
SNVATPLLA

SEQ ID NO: 134744 - protein, 9 aa, West Nile virus
NVATPLLAL

SEQ ID NO: 134745 - protein, 9 aa, West Nile virus
VATPLLALL

SEQ ID NO: 134746 - protein, 9 aa, West Nile virus
ATPLLALLT

SEQ ID NO: 134747 - protein, 9 aa, West Nile virus
TPLLALLTP

SEQ ID NO: 134748 - protein, 9 aa, West Nile virus
PLMALLTPG

SEQ ID NO: 134749 - protein, 9 aa, West Nile virus
LMALLTPGL

SEQ ID NO: 134750 - protein, 9 aa, West Nile virus
LALLTPGLK

SEQ ID NO: 134751 - protein, 9 aa, West Nile virus
ALLTPGLKC

SEQ ID NO: 134752 - protein, 9 aa, West Nile virus
LLTPGLKCL

SEQ ID NO: 134753 - protein, 9 aa, West Nile virus
LTPGLKCLN

SEQ ID NO: 134754 - protein, 9 aa, West Nile virus
TPGLKCLNL

SEQ ID NO: 134755 - protein, 9 aa, West Nile virus
PGLKCLNLD

SEQ ID NO: 134756 - protein, 9 aa, West Nile virus
GLKCLNLDV

SEQ ID NO: 134757 - protein, 9 aa, West Nile virus
LKCLNLDVY

SEQ ID NO: 134758 - protein, 9 aa, West Nile virus
KCLNLDVYR

SEQ ID NO: 134759 - protein, 9 aa, West Nile virus
CLHLDIYRI

SEQ ID NO: 134760 - protein, 9 aa, West Nile virus
LHLDIYRIL

SEQ ID NO: 134761 - protein, 9 aa, West Nile virus
HLDIYRILL

SEQ ID NO: 134762 - protein, 9 aa, West Nile virus
LDIYRILLL

SEQ ID NO: 134763 - protein, 9 aa, West Nile virus
DIYRILLLM

SEQ ID NO: 134764 - protein, 9 aa, West Nile virus
IYRILLLMV

SEQ ID NO: 134765 - protein, 9 aa, West Nile virus
YRIVLLMIG

SEQ ID NO: 134766 - protein, 9 aa, West Nile virus
RILLLMVGV

SEQ ID NO: 134767 - protein, 9 aa, West Nile virus
ILLLMVGVG

SEQ ID NO: 134768 - protein, 9 aa, West Nile virus
LLLMVGVGS

SEQ ID NO: 134769 - protein, 9 aa, West Nile virus
LLMVGVGSL

SEQ ID NO: 134770 - protein, 9 aa, West Nile virus
LMVGVGSLI

SEQ ID NO: 134771 - protein, 9 aa, West Nile virus
MVGVGSLIK

SEQ ID NO: 134772 - protein, 9 aa, West Nile virus
VGVGSLIKE

SEQ ID NO: 134773 - protein, 9 aa, West Nile virus
GVGSLIKEK

SEQ ID NO: 134774 - protein, 9 aa, West Nile virus
VGSLIKEKR

SEQ ID NO: 134775 - protein, 9 aa, West Nile virus
GSLIKEKRS

SEQ ID NO: 134776 - protein, 9 aa, West Nile virus
EKRSSAAKK

SEQ ID NO: 134777 - protein, 9 aa, West Nile virus
KRSSAAKKK

SEQ ID NO: 134778 - protein, 9 aa, West Nile virus
RSSAAKKKG

SEQ ID NO: 134779 - protein, 9 aa, West Nile virus
SSAAKKKGA

SEQ ID NO: 134780 - protein, 9 aa, West Nile virus
SAAKKKGAC

SEQ ID NO: 134781 - protein, 9 aa, West Nile virus
AAKKKGACL

SEQ ID NO: 134782 - protein, 9 aa, West Nile virus
AKKKGACLI

SEQ ID NO: 134783 - protein, 9 aa, West Nile virus
KKKGACLIC

SEQ ID NO: 134784 - protein, 9 aa, West Nile virus
KKGACLICL

SEQ ID NO: 134785 - protein, 9 aa, West Nile virus
KGACLICLA

SEQ ID NO: 134786 - protein, 9 aa, West Nile virus
GACLICLAL

SEQ ID NO: 134787 - protein, 9 aa, West Nile virus
ACLICLALA

SEQ ID NO: 134788 - protein, 9 aa, West Nile virus
CLICLALAS

SEQ ID NO: 134789 - protein, 9 aa, West Nile virus
LICLALAST

SEQ ID NO: 134790 - protein, 9 aa, West Nile virus
ICLALASTG

SEQ ID NO: 134791 - protein, 9 aa, West Nile virus
FNPLILVAG

SEQ ID NO: 134792 - protein, 9 aa, West Nile virus
NPLILVAGL

SEQ ID NO: 134793 - protein, 9 aa, West Nile virus
PMILAAGLM

SEQ ID NO: 134794 - protein, 9 aa, West Nile virus
LAAGLITCD

SEQ ID NO: 134795 - protein, 9 aa, West Nile virus
AAGLITCDP

SEQ ID NO: 134796 - protein, 9 aa, West Nile virus
AGLITCDPN

SEQ ID NO: 134797 - protein, 9 aa, West Nile virus
GLITCDPNR

SEQ ID NO: 134798 - protein, 9 aa, West Nile virus
LITCDPNRK

SEQ ID NO: 134799 - protein, 9 aa, West Nile virus
ITCDPNRKR

SEQ ID NO: 134800 - protein, 9 aa, West Nile virus
TCDPNRKRG

SEQ ID NO: 134801 - protein, 9 aa, West Nile virus
VGGLAELDM

SEQ ID NO: 134802 - protein, 9 aa, West Nile virus
GGLAELDMD

SEQ ID NO: 134803 - protein, 9 aa, West Nile virus
GLAELDIDT

SEQ ID NO: 134804 - protein, 9 aa, West Nile virus
LAELDVDSM

SEQ ID NO: 134805 - protein, 9 aa, West Nile virus
AELDMDSMA

SEQ ID NO: 134806 - protein, 9 aa, West Nile virus
ELDIDSMAV

SEQ ID NO: 134807 - protein, 9 aa, West Nile virus
LDVDSMAIP

SEQ ID NO: 134808 - protein, 9 aa, West Nile virus
DVDSMAIPM

SEQ ID NO: 134809 - protein, 9 aa, West Nile virus
IDTMAIPMT

SEQ ID NO: 134810 - protein, 9 aa, West Nile virus
DTMAIPMTI

SEQ ID NO: 134811 - protein, 9 aa, West Nile virus
SMAVPMTIA

SEQ ID NO: 134812 - protein, 9 aa, West Nile virus
MTIAGLMFV

SEQ ID NO: 134813 - protein, 9 aa, West Nile virus
TIAGLMFVA

SEQ ID NO: 134814 - protein, 9 aa, West Nile virus
IAGLMFVAF

SEQ ID NO: 134815 - protein, 9 aa, West Nile virus
AGLMFVAFV

SEQ ID NO: 134816 - protein, 9 aa, West Nile virus
GLMFVAFVI

SEQ ID NO: 134817 - protein, 9 aa, West Nile virus
LMFVAFVIS

SEQ ID NO: 134818 - protein, 9 aa, West Nile virus
MFVAFVISG

SEQ ID NO: 134819 - protein, 9 aa, West Nile virus
FVAFVISGK

SEQ ID NO: 134820 - protein, 9 aa, West Nile virus
VAFVISGKS

SEQ ID NO: 134821 - protein, 9 aa, West Nile virus
AYVITGRST

SEQ ID NO: 134822 - protein, 9 aa, West Nile virus
YVITGRSTD

SEQ ID NO: 134823 - protein, 9 aa, West Nile virus
VITGRSTDM

SEQ ID NO: 134824 - protein, 9 aa, West Nile virus
ITGRSTDMW

SEQ ID NO: 134825 - protein, 9 aa, West Nile virus
TGRSTDMWI

SEQ ID NO: 134826 - protein, 9 aa, West Nile virus
GRSTDMWIE

SEQ ID NO: 134827 - protein, 9 aa, West Nile virus
RSTDMWIER

SEQ ID NO: 134828 - protein, 9 aa, West Nile virus
DMWIERVAD

SEQ ID NO: 134829 - protein, 9 aa, West Nile virus
MWIERTANI

SEQ ID NO: 134830 - protein, 9 aa, West Nile virus
WIERTADIT

SEQ ID NO: 134831 - protein, 9 aa, West Nile virus
IERTADITW

SEQ ID NO: 134832 - protein, 9 aa, West Nile virus
ERTADITWE

SEQ ID NO: 134833 - protein, 9 aa, West Nile virus
RTADITWES

SEQ ID NO: 134834 - protein, 9 aa, West Nile virus
TADITWESD

SEQ ID NO: 134835 - protein, 9 aa, West Nile virus
ADITWESDA

SEQ ID NO: 134836 - protein, 9 aa, West Nile virus
DITWESDAE

SEQ ID NO: 134837 - protein, 9 aa, West Nile virus
ITWESDAEI

SEQ ID NO: 134838 - protein, 9 aa, West Nile virus
TWESDAEIT

SEQ ID NO: 134839 - protein, 9 aa, West Nile virus
WEGDAEITG

SEQ ID NO: 134840 - protein, 9 aa, West Nile virus
ESDAEITGT

SEQ ID NO: 134841 - protein, 9 aa, West Nile virus
SDAEITGTS

SEQ ID NO: 134842 - protein, 9 aa, West Nile virus
DAEITGTSD

SEQ ID NO: 134843 - protein, 9 aa, West Nile virus
AEITGTSDR

SEQ ID NO: 134844 - protein, 9 aa, West Nile virus
EITGTSDRV

SEQ ID NO: 134845 - protein, 9 aa, West Nile virus
ITGTSDRVD

SEQ ID NO: 134846 - protein, 9 aa, West Nile virus
TGTSDRVDV

SEQ ID NO: 134847 - protein, 9 aa, West Nile virus
GTSDRVDVK

SEQ ID NO: 134848 - protein, 9 aa, West Nile virus
TSDRVDVKL

SEQ ID NO: 134849 - protein, 9 aa, West Nile virus
SDRVDVKLD

SEQ ID NO: 134850 - protein, 9 aa, West Nile virus
DRVDVKLDD

SEQ ID NO: 134851 - protein, 9 aa, West Nile virus
RVDVKLDDD

SEQ ID NO: 134852 - protein, 9 aa, West Nile virus
VDVKLDDDG

SEQ ID NO: 134853 - protein, 9 aa, West Nile virus
DVKLDDDGN

SEQ ID NO: 134854 - protein, 9 aa, West Nile virus
VKLDDDGNF

SEQ ID NO: 134855 - protein, 9 aa, West Nile virus
KLDDDGNFQ

SEQ ID NO: 134856 - protein, 9 aa, West Nile virus
LDDDGDFQL

SEQ ID NO: 134857 - protein, 9 aa, West Nile virus
DDDGNFQLI

SEQ ID NO: 134858 - protein, 9 aa, West Nile virus
DDGNFQLIN

SEQ ID NO: 134859 - protein, 9 aa, West Nile virus
DGNFQLIND

SEQ ID NO: 134860 - protein, 9 aa, West Nile virus
GNFQLINDP

SEQ ID NO: 134861 - protein, 9 aa, West Nile virus
NFQLINDPG

SEQ ID NO: 134862 - protein, 9 aa, West Nile virus
FQLINDPGA

SEQ ID NO: 134863 - protein, 9 aa, West Nile virus
QLINDPGAP

SEQ ID NO: 134864 - protein, 9 aa, West Nile virus
LINDPGAPW

SEQ ID NO: 134865 - protein, 9 aa, West Nile virus
INDPGAPWK

SEQ ID NO: 134866 - protein, 9 aa, West Nile virus
SDPGAPWKI

SEQ ID NO: 134867 - protein, 9 aa, West Nile virus
PGAPWKIWI

SEQ ID NO: 134868 - protein, 9 aa, West Nile virus
GAPWKIWIL

SEQ ID NO: 134869 - protein, 9 aa, West Nile virus
APWKIWILR

SEQ ID NO: 134870 - protein, 9 aa, West Nile virus
PWKIWILRM

SEQ ID NO: 134871 - protein, 9 aa, West Nile virus
WMLRMACLA

SEQ ID NO: 134872 - protein, 9 aa, West Nile virus
MACLAISAY

SEQ ID NO: 134873 - protein, 9 aa, West Nile virus
ACLAISAYT

SEQ ID NO: 134874 - protein, 9 aa, West Nile virus
CLAVSAYTP

SEQ ID NO: 134875 - protein, 9 aa, West Nile virus
LAVSAYTPW

SEQ ID NO: 134876 - protein, 9 aa, West Nile virus
AVSAYTPWA

SEQ ID NO: 134877 - protein, 9 aa, West Nile virus
VSAYTPWAI

SEQ ID NO: 134878 - protein, 9 aa, West Nile virus
TPWAILPSI

SEQ ID NO: 134879 - protein, 9 aa, West Nile virus
PWAILPSVI

SEQ ID NO: 134880 - protein, 9 aa, West Nile virus
WAILPSVIG

SEQ ID NO: 134881 - protein, 9 aa, West Nile virus
AILPSVIGF

SEQ ID NO: 134882 - protein, 9 aa, West Nile virus
ILPSVIGFW

SEQ ID NO: 134883 - protein, 9 aa, West Nile virus
LPSVIGFWI

SEQ ID NO: 134884 - protein, 9 aa, West Nile virus
PSVIGFWIT

SEQ ID NO: 134885 - protein, 9 aa, West Nile virus
SVIGFWITL

SEQ ID NO: 134886 - protein, 9 aa, West Nile virus
VIGFWITLQ

SEQ ID NO: 134887 - protein, 9 aa, West Nile virus
IGFWITLQY

SEQ ID NO: 134888 - protein, 9 aa, West Nile virus
VLWDTPSPR

SEQ ID NO: 134889 - protein, 9 aa, West Nile virus
LWDTPSPRE

SEQ ID NO: 134890 - protein, 9 aa, West Nile virus
WDTPSPREY

SEQ ID NO: 134891 - protein, 9 aa, West Nile virus
DTPSPREYK

SEQ ID NO: 134892 - protein, 9 aa, West Nile virus
EYKRGDTTT

SEQ ID NO: 134893 - protein, 9 aa, West Nile virus
YKRGDTTTG

SEQ ID NO: 134894 - protein, 9 aa, West Nile virus
KRGDTTTGV

SEQ ID NO: 134895 - protein, 9 aa, West Nile virus
RGDTTTGVY

SEQ ID NO: 134896 - protein, 9 aa, West Nile virus
VYRIMTRGI

SEQ ID NO: 134897 - protein, 9 aa, West Nile virus
YRIMTRGIL

SEQ ID NO: 134898 - protein, 9 aa, West Nile virus
RIMTRGILG

SEQ ID NO: 134899 - protein, 9 aa, West Nile virus
IMTRGILGS

SEQ ID NO: 134900 - protein, 9 aa, West Nile virus
MTRGILGSY

SEQ ID NO: 134901 - protein, 9 aa, West Nile virus
TRGILGSYQ

SEQ ID NO: 134902 - protein, 9 aa, West Nile virus
RGILGSYQA

SEQ ID NO: 134903 - protein, 9 aa, West Nile virus
GILGSYQAG

SEQ ID NO: 134904 - protein, 9 aa, West Nile virus
ILGSYQAGV

SEQ ID NO: 134905 - protein, 9 aa, West Nile virus
LGSYQAGVG

SEQ ID NO: 134906 - protein, 9 aa, West Nile virus
GSYQAGVGV

SEQ ID NO: 134907 - protein, 9 aa, West Nile virus
SYQAGVGVM

SEQ ID NO: 134908 - protein, 9 aa, West Nile virus
YQAGVGVMV

SEQ ID NO: 134909 - protein, 9 aa, West Nile virus
QAGVGVMVE

SEQ ID NO: 134910 - protein, 9 aa, West Nile virus
AGVGVMVEG

SEQ ID NO: 134911 - protein, 9 aa, West Nile virus
GVGVMVEGV

SEQ ID NO: 134912 - protein, 9 aa, West Nile virus
VGVMVEGVF

SEQ ID NO: 134913 - protein, 9 aa, West Nile virus
KGAALMSGT

SEQ ID NO: 134914 - protein, 9 aa, West Nile virus
GAALMSGTG

SEQ ID NO: 134915 - protein, 9 aa, West Nile virus
AALMSGTGR

SEQ ID NO: 134916 - protein, 9 aa, West Nile virus
ALMSGTGRL

SEQ ID NO: 134917 - protein, 9 aa, West Nile virus
LMSGTGRLD

SEQ ID NO: 134918 - protein, 9 aa, West Nile virus
MSGTGRLDP

SEQ ID NO: 134919 - protein, 9 aa, West Nile virus
SGTGRLDPY

SEQ ID NO: 134920 - protein, 9 aa, West Nile virus
GTGRLDPYW

SEQ ID NO: 134921 - protein, 9 aa, West Nile virus
TGRLDPYWG

SEQ ID NO: 134922 - protein, 9 aa, West Nile virus
LDPYWGSVR

SEQ ID NO: 134923 - protein, 9 aa, West Nile virus
DPYWGSVRE

SEQ ID NO: 134924 - protein, 9 aa, West Nile virus
PYWGSVRED

SEQ ID NO: 134925 - protein, 9 aa, West Nile virus
YWGSVREDR

SEQ ID NO: 134926 - protein, 9 aa, West Nile virus
WGSVREDRL

SEQ ID NO: 134927 - protein, 9 aa, West Nile virus
GSVREDRLC

SEQ ID NO: 134928 - protein, 9 aa, West Nile virus
SVREDRLCY

SEQ ID NO: 134929 - protein, 9 aa, West Nile virus
VREDRLCYG

SEQ ID NO: 134930 - protein, 9 aa, West Nile virus
REDRLCYGG

SEQ ID NO: 134931 - protein, 9 aa, West Nile virus
YGGPWKLQR

SEQ ID NO: 134932 - protein, 9 aa, West Nile virus
GGPWKLQRK

SEQ ID NO: 134933 - protein, 9 aa, West Nile virus
GPWKLQRKW

SEQ ID NO: 134934 - protein, 9 aa, West Nile virus
PWKLQRKWN

SEQ ID NO: 134935 - protein, 9 aa, West Nile virus
WKLQRKWNG

SEQ ID NO: 134936 - protein, 9 aa, West Nile virus
KLQHKWNGH

SEQ ID NO: 134937 - protein, 9 aa, West Nile virus
LQHKWNGHD

SEQ ID NO: 134938 - protein, 9 aa, West Nile virus
QHKWNGHDE

SEQ ID NO: 134939 - protein, 9 aa, West Nile virus
HKWNGHDEV

SEQ ID NO: 134940 - protein, 9 aa, West Nile virus
KWNGHDEVQ

SEQ ID NO: 134941 - protein, 9 aa, West Nile virus
WNGHDEVQM

SEQ ID NO: 134942 - protein, 9 aa, West Nile virus
NGHDEVQMI

SEQ ID NO: 134943 - protein, 9 aa, West Nile virus
GHDEVQMIV

SEQ ID NO: 134944 - protein, 9 aa, West Nile virus
HDEVQMIVV

SEQ ID NO: 134945 - protein, 9 aa, West Nile virus
DEVQMIVAE

SEQ ID NO: 134946 - protein, 9 aa, West Nile virus
EVQMIVAEP

SEQ ID NO: 134947 - protein, 9 aa, West Nile virus
VQMIVAEPG

SEQ ID NO: 134948 - protein, 9 aa, West Nile virus
QMIVAEPGR

SEQ ID NO: 134949 - protein, 9 aa, West Nile virus
MIVAEPGRN

SEQ ID NO: 134950 - protein, 9 aa, West Nile virus
IVAEPGRNT

SEQ ID NO: 134951 - protein, 9 aa, West Nile virus
VAEPGRNTR

SEQ ID NO: 134952 - protein, 9 aa, West Nile virus
AEPGRNTRN

SEQ ID NO: 134953 - protein, 9 aa, West Nile virus
EPGRNTRNV

SEQ ID NO: 134954 - protein, 9 aa, West Nile virus
PGRNTRNVQ

SEQ ID NO: 134955 - protein, 9 aa, West Nile virus
GRNTRNVQT

SEQ ID NO: 134956 - protein, 9 aa, West Nile virus
RNTRNVQTK

SEQ ID NO: 134957 - protein, 9 aa, West Nile virus
NTRNVQTKP

SEQ ID NO: 134958 - protein, 9 aa, West Nile virus
TRNVQTKPG

SEQ ID NO: 134959 - protein, 9 aa, West Nile virus
RNVQTKPGV

SEQ ID NO: 134960 - protein, 9 aa, West Nile virus
KPGVFKTPD

SEQ ID NO: 134961 - protein, 9 aa, West Nile virus
PGVFKTPDG

SEQ ID NO: 134962 - protein, 9 aa, West Nile virus
GVFKTPDGE

SEQ ID NO: 134963 - protein, 9 aa, West Nile virus
VFKTPDGEI

SEQ ID NO: 134964 - protein, 9 aa, West Nile virus
FKTPDGEIG

SEQ ID NO: 134965 - protein, 9 aa, West Nile virus
KTPDGEIGA

SEQ ID NO: 134966 - protein, 9 aa, West Nile virus
TPDGEIGAV

SEQ ID NO: 134967 - protein, 9 aa, West Nile virus
PDGEIGAVT

SEQ ID NO: 134968 - protein, 9 aa, West Nile virus
DGEIGAVTL

SEQ ID NO: 134969 - protein, 9 aa, West Nile virus
EIGAVTLDY

SEQ ID NO: 134970 - protein, 9 aa, West Nile virus
IGAVTLDYP

SEQ ID NO: 134971 - protein, 9 aa, West Nile virus
GAVTLDYPT

SEQ ID NO: 134972 - protein, 9 aa, West Nile virus
AVTLDYPTG

SEQ ID NO: 134973 - protein, 9 aa, West Nile virus
VTLDYPTGT

SEQ ID NO: 134974 - protein, 9 aa, West Nile virus
TLDYPTGTS

SEQ ID NO: 134975 - protein, 9 aa, West Nile virus
LDYPTGTSG

SEQ ID NO: 134976 - protein, 9 aa, West Nile virus
DYPTGTSGS

SEQ ID NO: 134977 - protein, 9 aa, West Nile virus
YPTGTSGSP

SEQ ID NO: 134978 - protein, 9 aa, West Nile virus
TSGSPIVDR

SEQ ID NO: 134979 - protein, 9 aa, West Nile virus
SGSPIVDRN

SEQ ID NO: 134980 - protein, 9 aa, West Nile virus
GSPIVDRNG

SEQ ID NO: 134981 - protein, 9 aa, West Nile virus
SPIVDRNGD

SEQ ID NO: 134982 - protein, 9 aa, West Nile virus
PIVDRNGDV

SEQ ID NO: 134983 - protein, 9 aa, West Nile virus
IVDRNGDVI

SEQ ID NO: 134984 - protein, 9 aa, West Nile virus
VDRNGDVIG

SEQ ID NO: 134985 - protein, 9 aa, West Nile virus
DRNGDVIGL

SEQ ID NO: 134986 - protein, 9 aa, West Nile virus
RNGDVIGLY

SEQ ID NO: 134987 - protein, 9 aa, West Nile virus
SGDVIGLYG

SEQ ID NO: 134988 - protein, 9 aa, West Nile virus
YGNGVIMPS

SEQ ID NO: 134989 - protein, 9 aa, West Nile virus
GNGVIMPSG

SEQ ID NO: 134990 - protein, 9 aa, West Nile virus
NGVIMPNGA

SEQ ID NO: 134991 - protein, 9 aa, West Nile virus
GVIMPNGAY

SEQ ID NO: 134992 - protein, 9 aa, West Nile virus
VIMPNGAYI

SEQ ID NO: 134993 - protein, 9 aa, West Nile virus
IMPNGAYIS

SEQ ID NO: 134994 - protein, 9 aa, West Nile virus
MPNGAYISA

SEQ ID NO: 134995 - protein, 9 aa, West Nile virus
PNGAYISAI

SEQ ID NO: 134996 - protein, 9 aa, West Nile virus
NGAYISAIV

SEQ ID NO: 134997 - protein, 9 aa, West Nile virus
GAYISAIVQ

SEQ ID NO: 134998 - protein, 9 aa, West Nile virus
AYISAIVQG

SEQ ID NO: 134999 - protein, 9 aa, West Nile virus
AIVQGERME

SEQ ID NO: 135000 - protein, 9 aa, West Nile virus
IVQGERMEE

SEQ ID NO: 135001 - protein, 9 aa, West Nile virus
VQGERMEEP

SEQ ID NO: 135002 - protein, 9 aa, West Nile virus
QGERMEEPA

SEQ ID NO: 135003 - protein, 9 aa, West Nile virus
GERMEEPAP

SEQ ID NO: 135004 - protein, 9 aa, West Nile virus
ERMEEPAPA

SEQ ID NO: 135005 - protein, 9 aa, West Nile virus
RMEEPAPAG

SEQ ID NO: 135006 - protein, 9 aa, West Nile virus
MEEPAPAGF

SEQ ID NO: 135007 - protein, 9 aa, West Nile virus
GFEPDMLRK

SEQ ID NO: 135008 - protein, 9 aa, West Nile virus
FEPDMLRKK

SEQ ID NO: 135009 - protein, 9 aa, West Nile virus
EPDMLRKKQ

SEQ ID NO: 135010 - protein, 9 aa, West Nile virus
PDMLRKKQI

SEQ ID NO: 135011 - protein, 9 aa, West Nile virus
DMLRKKQIT

SEQ ID NO: 135012 - protein, 9 aa, West Nile virus
TLKKKQITV

SEQ ID NO: 135013 - protein, 9 aa, West Nile virus
LKKKQITVL

SEQ ID NO: 135014 - protein, 9 aa, West Nile virus
KKKQITVLD

SEQ ID NO: 135015 - protein, 9 aa, West Nile virus
KKQISVLDL

SEQ ID NO: 135016 - protein, 9 aa, West Nile virus
KKITVLDLH

SEQ ID NO: 135017 - protein, 9 aa, West Nile virus
KITVLDLHP

SEQ ID NO: 135018 - protein, 9 aa, West Nile virus
ISVLDLHPG

SEQ ID NO: 135019 - protein, 9 aa, West Nile virus
SVLDLHPGA

SEQ ID NO: 135020 - protein, 9 aa, West Nile virus
HPGAGKTRK

SEQ ID NO: 135021 - protein, 9 aa, West Nile virus
PGAGKTRKI

SEQ ID NO: 135022 - protein, 9 aa, West Nile virus
GAGKTRKIL

SEQ ID NO: 135023 - protein, 9 aa, West Nile virus
AGKTRKILP

SEQ ID NO: 135024 - protein, 9 aa, West Nile virus
GKTRKILPQ

SEQ ID NO: 135025 - protein, 9 aa, West Nile virus
KTRKILPQI

SEQ ID NO: 135026 - protein, 9 aa, West Nile virus
TRKILPQII

SEQ ID NO: 135027 - protein, 9 aa, West Nile virus
RKILPQIIK

SEQ ID NO: 135028 - protein, 9 aa, West Nile virus
KILPQIIKE

SEQ ID NO: 135029 - protein, 9 aa, West Nile virus
ILPQIIREA

SEQ ID NO: 135030 - protein, 9 aa, West Nile virus
LPQIIREAI

SEQ ID NO: 135031 - protein, 9 aa, West Nile virus
PQIIREAIN

SEQ ID NO: 135032 - protein, 9 aa, West Nile virus
QIIKEAINK

SEQ ID NO: 135033 - protein, 9 aa, West Nile virus
IIKEAINKR

SEQ ID NO: 135034 - protein, 9 aa, West Nile virus
IKEAINKRL

SEQ ID NO: 135035 - protein, 9 aa, West Nile virus
KEAINKRLR

SEQ ID NO: 135036 - protein, 9 aa, West Nile virus
EAINKRLRT

SEQ ID NO: 135037 - protein, 9 aa, West Nile virus
AINKRLRTA

SEQ ID NO: 135038 - protein, 9 aa, West Nile virus
NKRLRTAVL

SEQ ID NO: 135039 - protein, 9 aa, West Nile virus
KRLRTAVLA

SEQ ID NO: 135040 - protein, 9 aa, West Nile virus
RLRTAILAP

SEQ ID NO: 135041 - protein, 9 aa, West Nile virus
LRTAILAPT

SEQ ID NO: 135042 - protein, 9 aa, West Nile virus
RTAILAPTR

SEQ ID NO: 135043 - protein, 9 aa, West Nile virus
TAILAPTRV

SEQ ID NO: 135044 - protein, 9 aa, West Nile virus
AILAPTRVV

SEQ ID NO: 135045 - protein, 9 aa, West Nile virus
ILAPTRVVA

SEQ ID NO: 135046 - protein, 9 aa, West Nile virus
LAPTRVVAS

SEQ ID NO: 135047 - protein, 9 aa, West Nile virus
APTRVVASE

SEQ ID NO: 135048 - protein, 9 aa, West Nile virus
PTRVVASEM

SEQ ID NO: 135049 - protein, 9 aa, West Nile virus
TRVVAAEMS

SEQ ID NO: 135050 - protein, 9 aa, West Nile virus
RVVAAEMSE

SEQ ID NO: 135051 - protein, 9 aa, West Nile virus
VVAAEMSEA

SEQ ID NO: 135052 - protein, 9 aa, West Nile virus
VAAEMSEAL

SEQ ID NO: 135053 - protein, 9 aa, West Nile virus
AAEMSEALR

SEQ ID NO: 135054 - protein, 9 aa, West Nile virus
AEMSEALRG

SEQ ID NO: 135055 - protein, 9 aa, West Nile virus
EMSEALRGL

SEQ ID NO: 135056 - protein, 9 aa, West Nile virus
MSEALRGLP

SEQ ID NO: 135057 - protein, 9 aa, West Nile virus
SEALRGLPI

SEQ ID NO: 135058 - protein, 9 aa, West Nile virus
IRYQTSAVH

SEQ ID NO: 135059 - protein, 9 aa, West Nile virus
RYQTSAVHR

SEQ ID NO: 135060 - protein, 9 aa, West Nile virus
YQTSAVHRE

SEQ ID NO: 135061 - protein, 9 aa, West Nile virus
QTSAVHREH

SEQ ID NO: 135062 - protein, 9 aa, West Nile virus
REHSGNEIV

SEQ ID NO: 135063 - protein, 9 aa, West Nile virus
EHSGNEIVD

SEQ ID NO: 135064 - protein, 9 aa, West Nile virus
HSGNEIVDV

SEQ ID NO: 135065 - protein, 9 aa, West Nile virus
SGNEIVDVM

SEQ ID NO: 135066 - protein, 9 aa, West Nile virus
RVPNYNLFI

SEQ ID NO: 135067 - protein, 9 aa, West Nile virus
VPNYNLFIM

SEQ ID NO: 135068 - protein, 9 aa, West Nile virus
PNYNLFIMD

SEQ ID NO: 135069 - protein, 9 aa, West Nile virus
NYNLFIMDE

SEQ ID NO: 135070 - protein, 9 aa, West Nile virus
YNLFIMDEA

SEQ ID NO: 135071 - protein, 9 aa, West Nile virus
NLFIMDEAH

SEQ ID NO: 135072 - protein, 9 aa, West Nile virus
LFIMDEAHF

SEQ ID NO: 135073 - protein, 9 aa, West Nile virus
FIMDEAHFT

SEQ ID NO: 135074 - protein, 9 aa, West Nile virus
IMDEAHFTD

SEQ ID NO: 135075 - protein, 9 aa, West Nile virus
SIAARGYIA

SEQ ID NO: 135076 - protein, 9 aa, West Nile virus
IAARGYIAT

SEQ ID NO: 135077 - protein, 9 aa, West Nile virus
AARGYIATK

SEQ ID NO: 135078 - protein, 9 aa, West Nile virus
ARGYIATKV

SEQ ID NO: 135079 - protein, 9 aa, West Nile virus
RGYIATKVE

SEQ ID NO: 135080 - protein, 9 aa, West Nile virus
GYIATKVEL

SEQ ID NO: 135081 - protein, 9 aa, West Nile virus
YIATKVELG

SEQ ID NO: 135082 - protein, 9 aa, West Nile virus
IATKVELGE

SEQ ID NO: 135083 - protein, 9 aa, West Nile virus
ATKVELGEA

SEQ ID NO: 135084 - protein, 9 aa, West Nile virus
TRVELGEAA

SEQ ID NO: 135085 - protein, 9 aa, West Nile virus
RVELGEAAA

SEQ ID NO: 135086 - protein, 9 aa, West Nile virus
MTATPPGTH

SEQ ID NO: 135087 - protein, 9 aa, West Nile virus
TATPPGTHD

SEQ ID NO: 135088 - protein, 9 aa, West Nile virus
ATPPGSSDP

SEQ ID NO: 135089 - protein, 9 aa, West Nile virus
TPPGSSDPF

SEQ ID NO: 135090 - protein, 9 aa, West Nile virus
PPGSSDPFP

SEQ ID NO: 135091 - protein, 9 aa, West Nile virus
PGTSDPFPK

SEQ ID NO: 135092 - protein, 9 aa, West Nile virus
GTHDPFPES

SEQ ID NO: 135093 - protein, 9 aa, West Nile virus
THDPFPESN

SEQ ID NO: 135094 - protein, 9 aa, West Nile virus
SDPFPESNA

SEQ ID NO: 135095 - protein, 9 aa, West Nile virus
DPFPESNAP

SEQ ID NO: 135096 - protein, 9 aa, West Nile virus
PFPESNAPI

SEQ ID NO: 135097 - protein, 9 aa, West Nile virus
DMQTEIPDR

SEQ ID NO: 135098 - protein, 9 aa, West Nile virus
MQTEIPDRA

SEQ ID NO: 135099 - protein, 9 aa, West Nile virus
EIPDRAWNT

SEQ ID NO: 135100 - protein, 9 aa, West Nile virus
IPDRAWNTG

SEQ ID NO: 135101 - protein, 9 aa, West Nile virus
PDRAWNTGY

SEQ ID NO: 135102 - protein, 9 aa, West Nile virus
DRAWNTGYE

SEQ ID NO: 135103 - protein, 9 aa, West Nile virus
RAWNTGYEW

SEQ ID NO: 135104 - protein, 9 aa, West Nile virus
AWNTGYEWI

SEQ ID NO: 135105 - protein, 9 aa, West Nile virus
WNTGYEWIT

SEQ ID NO: 135106 - protein, 9 aa, West Nile virus
NTGYEWITE

SEQ ID NO: 135107 - protein, 9 aa, West Nile virus
TGYEWITEY

SEQ ID NO: 135108 - protein, 9 aa, West Nile virus
GYEWITEYI

SEQ ID NO: 135109 - protein, 9 aa, West Nile virus
YEWITEYIG

SEQ ID NO: 135110 - protein, 9 aa, West Nile virus
EWITEYIGK

SEQ ID NO: 135111 - protein, 9 aa, West Nile virus
WITEYIGKT

SEQ ID NO: 135112 - protein, 9 aa, West Nile virus
ITEYIGKTV

SEQ ID NO: 135113 - protein, 9 aa, West Nile virus
TEYIGKTVW

SEQ ID NO: 135114 - protein, 9 aa, West Nile virus
EYIGKTVWF

SEQ ID NO: 135115 - protein, 9 aa, West Nile virus
YIGKTVWFV

SEQ ID NO: 135116 - protein, 9 aa, West Nile virus
IGKTVWFVP

SEQ ID NO: 135117 - protein, 9 aa, West Nile virus
TVWFVPSVR

SEQ ID NO: 135118 - protein, 9 aa, West Nile virus
VWFVPSVRM

SEQ ID NO: 135119 - protein, 9 aa, West Nile virus
WFVPSVRMG

SEQ ID NO: 135120 - protein, 9 aa, West Nile virus
FVPSVRMGN

SEQ ID NO: 135121 - protein, 9 aa, West Nile virus
VPSVRMGNE

SEQ ID NO: 135122 - protein, 9 aa, West Nile virus
PSVRMGNEM

SEQ ID NO: 135123 - protein, 9 aa, West Nile virus
SVRMGNEMA

SEQ ID NO: 135124 - protein, 9 aa, West Nile virus
VRMGNEMAQ

SEQ ID NO: 135125 - protein, 9 aa, West Nile virus
RMGNEMAQC

SEQ ID NO: 135126 - protein, 9 aa, West Nile virus
MGNEMAQCL

SEQ ID NO: 135127 - protein, 9 aa, West Nile virus
GNEMAQCLQ

SEQ ID NO: 135128 - protein, 9 aa, West Nile virus
NEMAQCLQR

SEQ ID NO: 135129 - protein, 9 aa, West Nile virus
EMAQCLQRA

SEQ ID NO: 135130 - protein, 9 aa, West Nile virus
MAQCLQRAG

SEQ ID NO: 135131 - protein, 9 aa, West Nile virus
AQCLQRAGK

SEQ ID NO: 135132 - protein, 9 aa, West Nile virus
QCLQRAGKK

SEQ ID NO: 135133 - protein, 9 aa, West Nile virus
CLQRAGKRV

SEQ ID NO: 135134 - protein, 9 aa, West Nile virus
LQRAGKKVI

SEQ ID NO: 135135 - protein, 9 aa, West Nile virus
QRAGKKVIQ

SEQ ID NO: 135136 - protein, 9 aa, West Nile virus
RAGKKVIQL

SEQ ID NO: 135137 - protein, 9 aa, West Nile virus
AGKKVIQLN

SEQ ID NO: 135138 - protein, 9 aa, West Nile virus
GKKVIQLNR

SEQ ID NO: 135139 - protein, 9 aa, West Nile virus
KKVIQLNRK

SEQ ID NO: 135140 - protein, 9 aa, West Nile virus
KVIQLNRKS

SEQ ID NO: 135141 - protein, 9 aa, West Nile virus
VIQLNRKSY

SEQ ID NO: 135142 - protein, 9 aa, West Nile virus
IQLNRKSYE

SEQ ID NO: 135143 - protein, 9 aa, West Nile virus
KNDDWDFVV

SEQ ID NO: 135144 - protein, 9 aa, West Nile virus
NDDWDFVVT

SEQ ID NO: 135145 - protein, 9 aa, West Nile virus
DDWDFVVTT

SEQ ID NO: 135146 - protein, 9 aa, West Nile virus
DWDFVVTTD

SEQ ID NO: 135147 - protein, 9 aa, West Nile virus
WDFVVTTDI

SEQ ID NO: 135148 - protein, 9 aa, West Nile virus
DFVVTTDIS

SEQ ID NO: 135149 - protein, 9 aa, West Nile virus
FVVTTDISE

SEQ ID NO: 135150 - protein, 9 aa, West Nile virus
VVTTDISEM

SEQ ID NO: 135151 - protein, 9 aa, West Nile virus
VTTDISEMG

SEQ ID NO: 135152 - protein, 9 aa, West Nile virus
ISEMGANFR

SEQ ID NO: 135153 - protein, 9 aa, West Nile virus
SEMGANFRA

SEQ ID NO: 135154 - protein, 9 aa, West Nile virus
EMGANFRAS

SEQ ID NO: 135155 - protein, 9 aa, West Nile virus
MGANFKANR

SEQ ID NO: 135156 - protein, 9 aa, West Nile virus
GANFRASRV

SEQ ID NO: 135157 - protein, 9 aa, West Nile virus
ANFRASRVI

SEQ ID NO: 135158 - protein, 9 aa, West Nile virus
NFRASRVID

SEQ ID NO: 135159 - protein, 9 aa, West Nile virus
FRASRVIDS

SEQ ID NO: 135160 - protein, 9 aa, West Nile virus
KANRVIDSR

SEQ ID NO: 135161 - protein, 9 aa, West Nile virus
ANRVIDSRK

SEQ ID NO: 135162 - protein, 9 aa, West Nile virus
NRVIDSRKS

SEQ ID NO: 135163 - protein, 9 aa, West Nile virus
SRKSVKPII

SEQ ID NO: 135164 - protein, 9 aa, West Nile virus
RKSVKPIII

SEQ ID NO: 135165 - protein, 9 aa, West Nile virus
KSVKPTIIE

SEQ ID NO: 135166 - protein, 9 aa, West Nile virus
SVKPTIIEE

SEQ ID NO: 135167 - protein, 9 aa, West Nile virus
VKPTIIEEG

SEQ ID NO: 135168 - protein, 9 aa, West Nile virus
KPTIIEEGD

SEQ ID NO: 135169 - protein, 9 aa, West Nile virus
IEEGDGRVI

SEQ ID NO: 135170 - protein, 9 aa, West Nile virus
EEGDGRVIL

SEQ ID NO: 135171 - protein, 9 aa, West Nile virus
EGDGRVILG

SEQ ID NO: 135172 - protein, 9 aa, West Nile virus
GDGRVILGE

SEQ ID NO: 135173 - protein, 9 aa, West Nile virus
DGRVILGEP

SEQ ID NO: 135174 - protein, 9 aa, West Nile virus
NRVVLGEPS

SEQ ID NO: 135175 - protein, 9 aa, West Nile virus
RVVLGEPSA

SEQ ID NO: 135176 - protein, 9 aa, West Nile virus
VILGEPSAI

SEQ ID NO: 135177 - protein, 9 aa, West Nile virus
ILGEPSAIT

SEQ ID NO: 135178 - protein, 9 aa, West Nile virus
LGEPSAITA

SEQ ID NO: 135179 - protein, 9 aa, West Nile virus
GEPSAITAA

SEQ ID NO: 135180 - protein, 9 aa, West Nile virus
EPSAITAAS

SEQ ID NO: 135181 - protein, 9 aa, West Nile virus
PSAITAASA

SEQ ID NO: 135182 - protein, 9 aa, West Nile virus
SAITAASAA

SEQ ID NO: 135183 - protein, 9 aa, West Nile virus
AITAASAAQ

SEQ ID NO: 135184 - protein, 9 aa, West Nile virus
ITAASAAQR

SEQ ID NO: 135185 - protein, 9 aa, West Nile virus
SAAQRRGRT

SEQ ID NO: 135186 - protein, 9 aa, West Nile virus
AAQRRGRTG

SEQ ID NO: 135187 - protein, 9 aa, West Nile virus
AQRRGRTGR

SEQ ID NO: 135188 - protein, 9 aa, West Nile virus
QRRGRTGRN

SEQ ID NO: 135189 - protein, 9 aa, West Nile virus
RRGRIGRNS

SEQ ID NO: 135190 - protein, 9 aa, West Nile virus
RGRIGRNSS

SEQ ID NO: 135191 - protein, 9 aa, West Nile virus
GRIGRNSSQ

SEQ ID NO: 135192 - protein, 9 aa, West Nile virus
RIGRNSSQV

SEQ ID NO: 135193 - protein, 9 aa, West Nile virus
IGRNSSQVG

SEQ ID NO: 135194 - protein, 9 aa, West Nile virus
GRNSSQVGD

SEQ ID NO: 135195 - protein, 9 aa, West Nile virus
RNSSQVGDE

SEQ ID NO: 135196 - protein, 9 aa, West Nile virus
NSSQVGDEY

SEQ ID NO: 135197 - protein, 9 aa, West Nile virus
SSQVGDEYC

SEQ ID NO: 135198 - protein, 9 aa, West Nile virus
SQAGDEYCY

SEQ ID NO: 135199 - protein, 9 aa, West Nile virus
HTNEDDSNC

SEQ ID NO: 135200 - protein, 9 aa, West Nile virus
TNEDDSNYA

SEQ ID NO: 135201 - protein, 9 aa, West Nile virus
NEDDSNYAH

SEQ ID NO: 135202 - protein, 9 aa, West Nile virus
EDDSNCAHW

SEQ ID NO: 135203 - protein, 9 aa, West Nile virus
DDSNLAHWT

SEQ ID NO: 135204 - protein, 9 aa, West Nile virus
DSNLAHWTE

SEQ ID NO: 135205 - protein, 9 aa, West Nile virus
SNYAHWTEA

SEQ ID NO: 135206 - protein, 9 aa, West Nile virus
NCAHWTEAR

SEQ ID NO: 135207 - protein, 9 aa, West Nile virus
YAHWTEARI

SEQ ID NO: 135208 - protein, 9 aa, West Nile virus
MPDNINMPN

SEQ ID NO: 135209 - protein, 9 aa, West Nile virus
PDNINMPNG

SEQ ID NO: 135210 - protein, 9 aa, West Nile virus
NINMPNGLV

SEQ ID NO: 135211 - protein, 9 aa, West Nile virus
INMPNGLVA

SEQ ID NO: 135212 - protein, 9 aa, West Nile virus
NMPNGLVAQ

SEQ ID NO: 135213 - protein, 9 aa, West Nile virus
MPNGLVAQL

SEQ ID NO: 135214 - protein, 9 aa, West Nile virus
PNGLVAQLY

SEQ ID NO: 135215 - protein, 9 aa, West Nile virus
NGLVAQLYQ

SEQ ID NO: 135216 - protein, 9 aa, West Nile virus
GLVAQLYQP

SEQ ID NO: 135217 - protein, 9 aa, West Nile virus
LVAQLYQPE

SEQ ID NO: 135218 - protein, 9 aa, West Nile virus
VAQLYQPER

SEQ ID NO: 135219 - protein, 9 aa, West Nile virus
AQLYQPERE

SEQ ID NO: 135220 - protein, 9 aa, West Nile virus
QLYQPEREK

SEQ ID NO: 135221 - protein, 9 aa, West Nile virus
LYQPEREKV

SEQ ID NO: 135222 - protein, 9 aa, West Nile virus
YQPEREKVH

SEQ ID NO: 135223 - protein, 9 aa, West Nile virus
QPEREKVHT

SEQ ID NO: 135224 - protein, 9 aa, West Nile virus
PEREKVHTM

SEQ ID NO: 135225 - protein, 9 aa, West Nile virus
EREKVYTME

SEQ ID NO: 135226 - protein, 9 aa, West Nile virus
REKVHTMDG

SEQ ID NO: 135227 - protein, 9 aa, West Nile virus
EKVCTMDGE

SEQ ID NO: 135228 - protein, 9 aa, West Nile virus
KVYTMEGEY

SEQ ID NO: 135229 - protein, 9 aa, West Nile virus
VYTMDGEYK

SEQ ID NO: 135230 - protein, 9 aa, West Nile virus
YTMDGEYKL

SEQ ID NO: 135231 - protein, 9 aa, West Nile virus
TMDGEYKLR

SEQ ID NO: 135232 - protein, 9 aa, West Nile virus
MDGEYKLRG

SEQ ID NO: 135233 - protein, 9 aa, West Nile virus
DGEYKLRGE

SEQ ID NO: 135234 - protein, 9 aa, West Nile virus
GEYKLRGEE

SEQ ID NO: 135235 - protein, 9 aa, West Nile virus
EYKLRGEER

SEQ ID NO: 135236 - protein, 9 aa, West Nile virus
YKLRGEERK

SEQ ID NO: 135237 - protein, 9 aa, West Nile virus
KLRGEERKN

SEQ ID NO: 135238 - protein, 9 aa, West Nile virus
EERKNFLEF

SEQ ID NO: 135239 - protein, 9 aa, West Nile virus
ERKNFLEFL

SEQ ID NO: 135240 - protein, 9 aa, West Nile virus
RKNFLEFLR

SEQ ID NO: 135241 - protein, 9 aa, West Nile virus
KNFLEFLRT

SEQ ID NO: 135242 - protein, 9 aa, West Nile virus
NFLEFLRTA

SEQ ID NO: 135243 - protein, 9 aa, West Nile virus
FLEFLRTAD

SEQ ID NO: 135244 - protein, 9 aa, West Nile virus
LEFLRTADL

SEQ ID NO: 135245 - protein, 9 aa, West Nile virus
EFLRTADLP

SEQ ID NO: 135246 - protein, 9 aa, West Nile virus
FLRTADLPV

SEQ ID NO: 135247 - protein, 9 aa, West Nile virus
DLPVWLAYQ

SEQ ID NO: 135248 - protein, 9 aa, West Nile virus
LPVWLAYQV

SEQ ID NO: 135249 - protein, 9 aa, West Nile virus
PVWLAYQVA

SEQ ID NO: 135250 - protein, 9 aa, West Nile virus
VWLAYQVAA

SEQ ID NO: 135251 - protein, 9 aa, West Nile virus
WLAYQVAAA

SEQ ID NO: 135252 - protein, 9 aa, West Nile virus
LAYQVAAAG

SEQ ID NO: 135253 - protein, 9 aa, West Nile virus
AYKVAAAGI

SEQ ID NO: 135254 - protein, 9 aa, West Nile virus
KVAAAGISY

SEQ ID NO: 135255 - protein, 9 aa, West Nile virus
VAAAGISYH

SEQ ID NO: 135256 - protein, 9 aa, West Nile virus
AAAGISYHD

SEQ ID NO: 135257 - protein, 9 aa, West Nile virus
AAGISYHDR

SEQ ID NO: 135258 - protein, 9 aa, West Nile virus
AGISYHDRK

SEQ ID NO: 135259 - protein, 9 aa, West Nile virus
GISYHDRKW

SEQ ID NO: 135260 - protein, 9 aa, West Nile virus
ISYHDRKWC

SEQ ID NO: 135261 - protein, 9 aa, West Nile virus
SYHDRKWCF

SEQ ID NO: 135262 - protein, 9 aa, West Nile virus
YHDRKWCFD

SEQ ID NO: 135263 - protein, 9 aa, West Nile virus
HDRKWCFDG

SEQ ID NO: 135264 - protein, 9 aa, West Nile virus
DRKWCFDGP

SEQ ID NO: 135265 - protein, 9 aa, West Nile virus
RKWCFDGPR

SEQ ID NO: 135266 - protein, 9 aa, West Nile virus
KWCFDGPRT

SEQ ID NO: 135267 - protein, 9 aa, West Nile virus
FDGPRTNTV

SEQ ID NO: 135268 - protein, 9 aa, West Nile virus
DGPRTNTVL

SEQ ID NO: 135269 - protein, 9 aa, West Nile virus
GPRTNTVLE

SEQ ID NO: 135270 - protein, 9 aa, West Nile virus
PRTNTVLEE

SEQ ID NO: 135271 - protein, 9 aa, West Nile virus
RTNTVLEEN

SEQ ID NO: 135272 - protein, 9 aa, West Nile virus
TNTVLEENT

SEQ ID NO: 135273 - protein, 9 aa, West Nile virus
NTVLEENTE

SEQ ID NO: 135274 - protein, 9 aa, West Nile virus
TVLEENTEV

SEQ ID NO: 135275 - protein, 9 aa, West Nile virus
VLEENTEVE

SEQ ID NO: 135276 - protein, 9 aa, West Nile virus
LEENTEVEI

SEQ ID NO: 135277 - protein, 9 aa, West Nile virus
EENTEVEIV

SEQ ID NO: 135278 - protein, 9 aa, West Nile virus
ENTEVEIVT

SEQ ID NO: 135279 - protein, 9 aa, West Nile virus
NTEVEIVTK

SEQ ID NO: 135280 - protein, 9 aa, West Nile virus
TEVEIVTKM

SEQ ID NO: 135281 - protein, 9 aa, West Nile virus
EVEIVTKMG

SEQ ID NO: 135282 - protein, 9 aa, West Nile virus
VEIVTKMGE

SEQ ID NO: 135283 - protein, 9 aa, West Nile virus
EIVTKMGER

SEQ ID NO: 135284 - protein, 9 aa, West Nile virus
IVTKMGERK

SEQ ID NO: 135285 - protein, 9 aa, West Nile virus
VTKMGERKI

SEQ ID NO: 135286 - protein, 9 aa, West Nile virus
TKMGERKIL

SEQ ID NO: 135287 - protein, 9 aa, West Nile virus
KMGERKILR

SEQ ID NO: 135288 - protein, 9 aa, West Nile virus
MGERKILRP

SEQ ID NO: 135289 - protein, 9 aa, West Nile virus
RKILRPRWA

SEQ ID NO: 135290 - protein, 9 aa, West Nile virus
KILRPRWAD

SEQ ID NO: 135291 - protein, 9 aa, West Nile virus
ILRPRWADA

SEQ ID NO: 135292 - protein, 9 aa, West Nile virus
LRPRWADAR

SEQ ID NO: 135293 - protein, 9 aa, West Nile virus
RPRWADARV

SEQ ID NO: 135294 - protein, 9 aa, West Nile virus
PRWADARVY

SEQ ID NO: 135295 - protein, 9 aa, West Nile virus
RWADARVYS

SEQ ID NO: 135296 - protein, 9 aa, West Nile virus
WADARVYSD

SEQ ID NO: 135297 - protein, 9 aa, West Nile virus
ADARVYSDH

SEQ ID NO: 135298 - protein, 9 aa, West Nile virus
YSDHQALKS

SEQ ID NO: 135299 - protein, 9 aa, West Nile virus
SDHQALKSF

SEQ ID NO: 135300 - protein, 9 aa, West Nile virus
DHQALKSFK

SEQ ID NO: 135301 - protein, 9 aa, West Nile virus
HQALKSFKD

SEQ ID NO: 135302 - protein, 9 aa, West Nile virus
QALKSFKDF

SEQ ID NO: 135303 - protein, 9 aa, West Nile virus
ALKSFKDFA

SEQ ID NO: 135304 - protein, 9 aa, West Nile virus
LKSFKDFAS

SEQ ID NO: 135305 - protein, 9 aa, West Nile virus
KSFKDFASG

SEQ ID NO: 135306 - protein, 9 aa, West Nile virus
SFKDFASGK

SEQ ID NO: 135307 - protein, 9 aa, West Nile virus
FKDFAAGRR

SEQ ID NO: 135308 - protein, 9 aa, West Nile virus
KDFAAGRRS

SEQ ID NO: 135309 - protein, 9 aa, West Nile virus
DFAAGRRSQ

SEQ ID NO: 135310 - protein, 9 aa, West Nile virus
FAAGRRSQI

SEQ ID NO: 135311 - protein, 9 aa, West Nile virus
AAGRRSQIG

SEQ ID NO: 135312 - protein, 9 aa, West Nile virus
AGRRSQIGL

SEQ ID NO: 135313 - protein, 9 aa, West Nile virus
GKRSQIGLV

SEQ ID NO: 135314 - protein, 9 aa, West Nile virus
KRSQIGLVE

SEQ ID NO: 135315 - protein, 9 aa, West Nile virus
RSQIGLVEV

SEQ ID NO: 135316 - protein, 9 aa, West Nile virus
SQIGLVEVL

SEQ ID NO: 135317 - protein, 9 aa, West Nile virus
QIGLVEVLG

SEQ ID NO: 135318 - protein, 9 aa, West Nile virus
IGLVEVLGR

SEQ ID NO: 135319 - protein, 9 aa, West Nile virus
GLVEVLGRM

SEQ ID NO: 135320 - protein, 9 aa, West Nile virus
LVEVLGRMP

SEQ ID NO: 135321 - protein, 9 aa, West Nile virus
VEVLGRMPE

SEQ ID NO: 135322 - protein, 9 aa, West Nile virus
EVLGRMPEH

SEQ ID NO: 135323 - protein, 9 aa, West Nile virus
VLGRMPEHF

SEQ ID NO: 135324 - protein, 9 aa, West Nile virus
LGRMPEHFM

SEQ ID NO: 135325 - protein, 9 aa, West Nile virus
GRMPEHFMG

SEQ ID NO: 135326 - protein, 9 aa, West Nile virus
RMPEHFMGK

SEQ ID NO: 135327 - protein, 9 aa, West Nile virus
MPEHFVGKT

SEQ ID NO: 135328 - protein, 9 aa, West Nile virus
PEHFVGKTW

SEQ ID NO: 135329 - protein, 9 aa, West Nile virus
EHFVGKTWE

SEQ ID NO: 135330 - protein, 9 aa, West Nile virus
HFVGKTWEA

SEQ ID NO: 135331 - protein, 9 aa, West Nile virus
FVGKTWEAL

SEQ ID NO: 135332 - protein, 9 aa, West Nile virus
VGKTWEALD

SEQ ID NO: 135333 - protein, 9 aa, West Nile virus
VKTWEALDT

SEQ ID NO: 135334 - protein, 9 aa, West Nile virus
MYVVATADK

SEQ ID NO: 135335 - protein, 9 aa, West Nile virus
YVVATAERG

SEQ ID NO: 135336 - protein, 9 aa, West Nile virus
VVATAERGG

SEQ ID NO: 135337 - protein, 9 aa, West Nile virus
VATAERGGR

SEQ ID NO: 135338 - protein, 9 aa, West Nile virus
ATADKGGRA

SEQ ID NO: 135339 - protein, 9 aa, West Nile virus
TAERGGRAH

SEQ ID NO: 135340 - protein, 9 aa, West Nile virus
AERGGRAHR

SEQ ID NO: 135341 - protein, 9 aa, West Nile virus
EKGGRAHRT

SEQ ID NO: 135342 - protein, 9 aa, West Nile virus
KGGRAHRTA

SEQ ID NO: 135343 - protein, 9 aa, West Nile virus
GGRAHRTAL

SEQ ID NO: 135344 - protein, 9 aa, West Nile virus
GRAHRTALE

SEQ ID NO: 135345 - protein, 9 aa, West Nile virus
RAHRTALEE

SEQ ID NO: 135346 - protein, 9 aa, West Nile virus
AHRTALEEL

SEQ ID NO: 135347 - protein, 9 aa, West Nile virus
HRTALEELP

SEQ ID NO: 135348 - protein, 9 aa, West Nile virus
RTALEELPD

SEQ ID NO: 135349 - protein, 9 aa, West Nile virus
TALEELPDA

SEQ ID NO: 135350 - protein, 9 aa, West Nile virus
LPDALQTIV

SEQ ID NO: 135351 - protein, 9 aa, West Nile virus
PDALQTIVL

SEQ ID NO: 135352 - protein, 9 aa, West Nile virus
DALQTIVLI

SEQ ID NO: 135353 - protein, 9 aa, West Nile virus
ALQTIALIT

SEQ ID NO: 135354 - protein, 9 aa, West Nile virus
LQTIALITL

SEQ ID NO: 135355 - protein, 9 aa, West Nile virus
QTIALITLL

SEQ ID NO: 135356 - protein, 9 aa, West Nile virus
TIALITLLS

SEQ ID NO: 135357 - protein, 9 aa, West Nile virus
IALITLLSV

SEQ ID NO: 135358 - protein, 9 aa, West Nile virus
ALITLLSVM

SEQ ID NO: 135359 - protein, 9 aa, West Nile virus
LITLLSVMT

SEQ ID NO: 135360 - protein, 9 aa, West Nile virus
LLSVMSLGV

SEQ ID NO: 135361 - protein, 9 aa, West Nile virus
LSVMSLGVF

SEQ ID NO: 135362 - protein, 9 aa, West Nile virus
VMSLGVFFL

SEQ ID NO: 135363 - protein, 9 aa, West Nile virus
MSLGVFFLL

SEQ ID NO: 135364 - protein, 9 aa, West Nile virus
SLGVFFLLM

SEQ ID NO: 135365 - protein, 9 aa, West Nile virus
LGVFFLLMQ

SEQ ID NO: 135366 - protein, 9 aa, West Nile virus
GVFCLLMQR

SEQ ID NO: 135367 - protein, 9 aa, West Nile virus
VFCLLMQRK

SEQ ID NO: 135368 - protein, 9 aa, West Nile virus
FCLLMQRKG

SEQ ID NO: 135369 - protein, 9 aa, West Nile virus
CLLMQRKGV

SEQ ID NO: 135370 - protein, 9 aa, West Nile virus
LLMQRKGVS

SEQ ID NO: 135371 - protein, 9 aa, West Nile virus
LMQRKGVSK

SEQ ID NO: 135372 - protein, 9 aa, West Nile virus
MQRKGVSKI

SEQ ID NO: 135373 - protein, 9 aa, West Nile virus
QRKGVSKIG

SEQ ID NO: 135374 - protein, 9 aa, West Nile virus
RKGVSKIGL

SEQ ID NO: 135375 - protein, 9 aa, West Nile virus
KGVSKIGLA

SEQ ID NO: 135376 - protein, 9 aa, West Nile virus
GVSKIGLAG

SEQ ID NO: 135377 - protein, 9 aa, West Nile virus
IGKIGLGGT

SEQ ID NO: 135378 - protein, 9 aa, West Nile virus
LGAATFFCW

SEQ ID NO: 135379 - protein, 9 aa, West Nile virus
GAATFFCWM

SEQ ID NO: 135380 - protein, 9 aa, West Nile virus
AATFFCWMA

SEQ ID NO: 135381 - protein, 9 aa, West Nile virus
ATFFCWMAD

SEQ ID NO: 135382 - protein, 9 aa, West Nile virus
TFFCWMADV

SEQ ID NO: 135383 - protein, 9 aa, West Nile virus
FFCWMAEVS

SEQ ID NO: 135384 - protein, 9 aa, West Nile virus
FCWMAEVSG

SEQ ID NO: 135385 - protein, 9 aa, West Nile virus
CWMAEVSGT

SEQ ID NO: 135386 - protein, 9 aa, West Nile virus
WMAEVSGTK

SEQ ID NO: 135387 - protein, 9 aa, West Nile virus
MAEVSGTKI

SEQ ID NO: 135388 - protein, 9 aa, West Nile virus
AEVSGTKIA

SEQ ID NO: 135389 - protein, 9 aa, West Nile virus
EVSGTKIAG

SEQ ID NO: 135390 - protein, 9 aa, West Nile virus
VSGTKIAGM

SEQ ID NO: 135391 - protein, 9 aa, West Nile virus
SGTKIAGML

SEQ ID NO: 135392 - protein, 9 aa, West Nile virus
GMLLLSLLM

SEQ ID NO: 135393 - protein, 9 aa, West Nile virus
MLLLSLLMM

SEQ ID NO: 135394 - protein, 9 aa, West Nile virus
LLLSLLMMI

SEQ ID NO: 135395 - protein, 9 aa, West Nile virus
LLSLLMMIV

SEQ ID NO: 135396 - protein, 9 aa, West Nile virus
LSLLMMIVL

SEQ ID NO: 135397 - protein, 9 aa, West Nile virus
SLLMMIVLI

SEQ ID NO: 135398 - protein, 9 aa, West Nile virus
LLMMIVLIP

SEQ ID NO: 135399 - protein, 9 aa, West Nile virus
LMMIVLIPE

SEQ ID NO: 135400 - protein, 9 aa, West Nile virus
MMIVLIPEP

SEQ ID NO: 135401 - protein, 9 aa, West Nile virus
SQTDNQLAM

SEQ ID NO: 135402 - protein, 9 aa, West Nile virus
QTDNQLAMF

SEQ ID NO: 135403 - protein, 9 aa, West Nile virus
TDNQLAMFL

SEQ ID NO: 135404 - protein, 9 aa, West Nile virus
DNQLAMFLI

SEQ ID NO: 135405 - protein, 9 aa, West Nile virus
NQLAMFLIC

SEQ ID NO: 135406 - protein, 9 aa, West Nile virus
QLAMFLICV

SEQ ID NO: 135407 - protein, 9 aa, West Nile virus
LAVFLICVL

SEQ ID NO: 135408 - protein, 9 aa, West Nile virus
AVFLICVLT

SEQ ID NO: 135409 - protein, 9 aa, West Nile virus
VFLICVLTL

SEQ ID NO: 135410 - protein, 9 aa, West Nile virus
FLICVLTLV

SEQ ID NO: 135411 - protein, 9 aa, West Nile virus
TLVGAVAAN

SEQ ID NO: 135412 - protein, 9 aa, West Nile virus
LVGAVAANE

SEQ ID NO: 135413 - protein, 9 aa, West Nile virus
VGAVAANEM

SEQ ID NO: 135414 - protein, 9 aa, West Nile virus
GAVAANEMG

SEQ ID NO: 135415 - protein, 9 aa, West Nile virus
TVAANEMGW

SEQ ID NO: 135416 - protein, 9 aa, West Nile virus
ANEMGWLDR

SEQ ID NO: 135417 - protein, 9 aa, West Nile virus
NEMGWLDRT

SEQ ID NO: 135418 - protein, 9 aa, West Nile virus
EMGWLDRTK

SEQ ID NO: 135419 - protein, 9 aa, West Nile virus
MGWLDKTKN

SEQ ID NO: 135420 - protein, 9 aa, West Nile virus
GWLDKTKND

SEQ ID NO: 135421 - protein, 9 aa, West Nile virus
WLDKTKNDI

SEQ ID NO: 135422 - protein, 9 aa, West Nile virus
ESFLLDLRP

SEQ ID NO: 135423 - protein, 9 aa, West Nile virus
SFLLDLRPA

SEQ ID NO: 135424 - protein, 9 aa, West Nile virus
FLLDLKPAT

SEQ ID NO: 135425 - protein, 9 aa, West Nile virus
LLDLKPATA

SEQ ID NO: 135426 - protein, 9 aa, West Nile virus
LDLKPATAW

SEQ ID NO: 135427 - protein, 9 aa, West Nile virus
DLKPATAWS

SEQ ID NO: 135428 - protein, 9 aa, West Nile virus
LKPATAWSL

SEQ ID NO: 135429 - protein, 9 aa, West Nile virus
KPATAWSLY

SEQ ID NO: 135430 - protein, 9 aa, West Nile virus
TAWSLYAVS

SEQ ID NO: 135431 - protein, 9 aa, West Nile virus
AWSLYAVST

SEQ ID NO: 135432 - protein, 9 aa, West Nile virus
WSLYAVSTA

SEQ ID NO: 135433 - protein, 9 aa, West Nile virus
SLYAVSTAV

SEQ ID NO: 135434 - protein, 9 aa, West Nile virus
LYAVSTAVM

SEQ ID NO: 135435 - protein, 9 aa, West Nile virus
YAVSTAVMT

SEQ ID NO: 135436 - protein, 9 aa, West Nile virus
AVSTAVMTP

SEQ ID NO: 135437 - protein, 9 aa, West Nile virus
VSTAVMTPL

SEQ ID NO: 135438 - protein, 9 aa, West Nile virus
STAVMTPLL

SEQ ID NO: 135439 - protein, 9 aa, West Nile virus
TAVMTPLLK

SEQ ID NO: 135440 - protein, 9 aa, West Nile virus
AVMTPLLKH

SEQ ID NO: 135441 - protein, 9 aa, West Nile virus
VMTPLLKHV

SEQ ID NO: 135442 - protein, 9 aa, West Nile virus
MTPLLKHVI

SEQ ID NO: 135443 - protein, 9 aa, West Nile virus
TPLLKHVIT

SEQ ID NO: 135444 - protein, 9 aa, West Nile virus
PLLKHVITS

SEQ ID NO: 135445 - protein, 9 aa, West Nile virus
LLKHVITSD

SEQ ID NO: 135446 - protein, 9 aa, West Nile virus
LKHVITSDY

SEQ ID NO: 135447 - protein, 9 aa, West Nile virus
KHVITSDYI

SEQ ID NO: 135448 - protein, 9 aa, West Nile virus
HVITSDYIN

SEQ ID NO: 135449 - protein, 9 aa, West Nile virus
VITSDYINT

SEQ ID NO: 135450 - protein, 9 aa, West Nile virus
TSINVQAST

SEQ ID NO: 135451 - protein, 9 aa, West Nile virus
SINVQASTL

SEQ ID NO: 135452 - protein, 9 aa, West Nile virus
INVQASALY

SEQ ID NO: 135453 - protein, 9 aa, West Nile virus
NVQASALYS

SEQ ID NO: 135454 - protein, 9 aa, West Nile virus
VQASALYSL

SEQ ID NO: 135455 - protein, 9 aa, West Nile virus
QASALFTLS

SEQ ID NO: 135456 - protein, 9 aa, West Nile virus
ASALFTLSR

SEQ ID NO: 135457 - protein, 9 aa, West Nile virus
SALFTLSRG

SEQ ID NO: 135458 - protein, 9 aa, West Nile virus
ALFTLSRGF

SEQ ID NO: 135459 - protein, 9 aa, West Nile virus
LFTLSRGFP

SEQ ID NO: 135460 - protein, 9 aa, West Nile virus
FTLSRGFPF

SEQ ID NO: 135461 - protein, 9 aa, West Nile virus
TLSRGFPFV

SEQ ID NO: 135462 - protein, 9 aa, West Nile virus
LSRGFPFVD

SEQ ID NO: 135463 - protein, 9 aa, West Nile virus
SRGFPFVDV

SEQ ID NO: 135464 - protein, 9 aa, West Nile virus
GFPFVDVGI

SEQ ID NO: 135465 - protein, 9 aa, West Nile virus
FPFVDVGIS

SEQ ID NO: 135466 - protein, 9 aa, West Nile virus
PFVDVGISA

SEQ ID NO: 135467 - protein, 9 aa, West Nile virus
FVDVGISSL

SEQ ID NO: 135468 - protein, 9 aa, West Nile virus
VDVGISSLL

SEQ ID NO: 135469 - protein, 9 aa, West Nile virus
DVGISSLLL

SEQ ID NO: 135470 - protein, 9 aa, West Nile virus
VGISALLLA

SEQ ID NO: 135471 - protein, 9 aa, West Nile virus
GVSALLLAV

SEQ ID NO: 135472 - protein, 9 aa, West Nile virus
VSALLLAVG

SEQ ID NO: 135473 - protein, 9 aa, West Nile virus
SALLLAVGC

SEQ ID NO: 135474 - protein, 9 aa, West Nile virus
ALLLAVGCW

SEQ ID NO: 135475 - protein, 9 aa, West Nile virus
LLLAVGCWG

SEQ ID NO: 135476 - protein, 9 aa, West Nile virus
LLAVGCWGQ

SEQ ID NO: 135477 - protein, 9 aa, West Nile virus
LAVGCWGQV

SEQ ID NO: 135478 - protein, 9 aa, West Nile virus
AVGCWGQVT

SEQ ID NO: 135479 - protein, 9 aa, West Nile virus
VGCWGQVTL

SEQ ID NO: 135480 - protein, 9 aa, West Nile virus
WGQVTLTVA

SEQ ID NO: 135481 - protein, 9 aa, West Nile virus
GQVTLTVAV

SEQ ID NO: 135482 - protein, 9 aa, West Nile virus
VTLTVTVTS

SEQ ID NO: 135483 - protein, 9 aa, West Nile virus
TLTVTVTSA

SEQ ID NO: 135484 - protein, 9 aa, West Nile virus
ALLFCHYAY

SEQ ID NO: 135485 - protein, 9 aa, West Nile virus
LLLCHYAYM

SEQ ID NO: 135486 - protein, 9 aa, West Nile virus
LLCHYAYMV

SEQ ID NO: 135487 - protein, 9 aa, West Nile virus
LCHYAYMVP

SEQ ID NO: 135488 - protein, 9 aa, West Nile virus
HYAYMIPGW

SEQ ID NO: 135489 - protein, 9 aa, West Nile virus
YAYMVPGGQ

SEQ ID NO: 135490 - protein, 9 aa, West Nile virus
AYMIPGWQA

SEQ ID NO: 135491 - protein, 9 aa, West Nile virus
YMVPGGQAE

SEQ ID NO: 135492 - protein, 9 aa, West Nile virus
MIPGWQAEA

SEQ ID NO: 135493 - protein, 9 aa, West Nile virus
IPGWQAEAM

SEQ ID NO: 135494 - protein, 9 aa, West Nile virus
GWQAEAMRA

SEQ ID NO: 135495 - protein, 9 aa, West Nile virus
WQAEAMRAA

SEQ ID NO: 135496 - protein, 9 aa, West Nile virus
QAEAMRAAQ

SEQ ID NO: 135497 - protein, 9 aa, West Nile virus
AEAMRAAQR

SEQ ID NO: 135498 - protein, 9 aa, West Nile virus
EAMRAAQRR

SEQ ID NO: 135499 - protein, 9 aa, West Nile virus
AMRAAQRRT

SEQ ID NO: 135500 - protein, 9 aa, West Nile virus
MRAAQRRTA

SEQ ID NO: 135501 - protein, 9 aa, West Nile virus
RAAQRRTAA

SEQ ID NO: 135502 - protein, 9 aa, West Nile virus
AAQRRTAAG

SEQ ID NO: 135503 - protein, 9 aa, West Nile virus
TAAGIMKNV

SEQ ID NO: 135504 - protein, 9 aa, West Nile virus
AAGIMKNVV

SEQ ID NO: 135505 - protein, 9 aa, West Nile virus
AGIMKNVVV

SEQ ID NO: 135506 - protein, 9 aa, West Nile virus
GIMKNAVID

SEQ ID NO: 135507 - protein, 9 aa, West Nile virus
IMKNAVIDG

SEQ ID NO: 135508 - protein, 9 aa, West Nile virus
MKNVVVDGI

SEQ ID NO: 135509 - protein, 9 aa, West Nile virus
KNAVIDGMV

SEQ ID NO: 135510 - protein, 9 aa, West Nile virus
NVVVDGIVA

SEQ ID NO: 135511 - protein, 9 aa, West Nile virus
AVIDGMVAT

SEQ ID NO: 135512 - protein, 9 aa, West Nile virus
VIDGMVATD

SEQ ID NO: 135513 - protein, 9 aa, West Nile virus
IDGMVATDV

SEQ ID NO: 135514 - protein, 9 aa, West Nile virus
DGMVATDVP

SEQ ID NO: 135515 - protein, 9 aa, West Nile virus
GMVATDVPE

SEQ ID NO: 135516 - protein, 9 aa, West Nile virus
MVATDVPEL

SEQ ID NO: 135517 - protein, 9 aa, West Nile virus
TDVPELERA

SEQ ID NO: 135518 - protein, 9 aa, West Nile virus
DVPELERAT

SEQ ID NO: 135519 - protein, 9 aa, West Nile virus
VPELERATP

SEQ ID NO: 135520 - protein, 9 aa, West Nile virus
PELERTTPV

SEQ ID NO: 135521 - protein, 9 aa, West Nile virus
ELERTTPVM

SEQ ID NO: 135522 - protein, 9 aa, West Nile virus
LERTTPVMQ

SEQ ID NO: 135523 - protein, 9 aa, West Nile virus
ERTTPVMQK

SEQ ID NO: 135524 - protein, 9 aa, West Nile virus
RTTPVMQKK

SEQ ID NO: 135525 - protein, 9 aa, West Nile virus
TTPVMQKKV

SEQ ID NO: 135526 - protein, 9 aa, West Nile virus
TPVMQKKVG

SEQ ID NO: 135527 - protein, 9 aa, West Nile virus
PVMQKKVGQ

SEQ ID NO: 135528 - protein, 9 aa, West Nile virus
VMQKKVGQI

SEQ ID NO: 135529 - protein, 9 aa, West Nile virus
MQKKVGQVM

SEQ ID NO: 135530 - protein, 9 aa, West Nile virus
QKKVGQVML

SEQ ID NO: 135531 - protein, 9 aa, West Nile virus
KKVGQVMLI

SEQ ID NO: 135532 - protein, 9 aa, West Nile virus
KVGQVMLIL

SEQ ID NO: 135533 - protein, 9 aa, West Nile virus
VGQVMLILV

SEQ ID NO: 135534 - protein, 9 aa, West Nile virus
GQVMLILVS

SEQ ID NO: 135535 - protein, 9 aa, West Nile virus
MLILVSMAA

SEQ ID NO: 135536 - protein, 9 aa, West Nile virus
LILVSMAAV

SEQ ID NO: 135537 - protein, 9 aa, West Nile virus
ILVSMAAVV

SEQ ID NO: 135538 - protein, 9 aa, West Nile virus
LVSMAAVVV

SEQ ID NO: 135539 - protein, 9 aa, West Nile virus
VSMAAVVVN

SEQ ID NO: 135540 - protein, 9 aa, West Nile virus
SMAAVVVNP

SEQ ID NO: 135541 - protein, 9 aa, West Nile virus
MAAVVVNPS

SEQ ID NO: 135542 - protein, 9 aa, West Nile virus
AALVVNPSV

SEQ ID NO: 135543 - protein, 9 aa, West Nile virus
AVVVNPSVR

SEQ ID NO: 135544 - protein, 9 aa, West Nile virus
VVVNPSVRT

SEQ ID NO: 135545 - protein, 9 aa, West Nile virus
VVNPSVRTV

SEQ ID NO: 135546 - protein, 9 aa, West Nile virus
VNPSVRTVR

SEQ ID NO: 135547 - protein, 9 aa, West Nile virus
NPSVRTVRE

SEQ ID NO: 135548 - protein, 9 aa, West Nile virus
PSVRTVREA

SEQ ID NO: 135549 - protein, 9 aa, West Nile virus
SVRTVREAG

SEQ ID NO: 135550 - protein, 9 aa, West Nile virus
VRTVREAGI

SEQ ID NO: 135551 - protein, 9 aa, West Nile virus
RTVREAGIL

SEQ ID NO: 135552 - protein, 9 aa, West Nile virus
TVREAGILT

SEQ ID NO: 135553 - protein, 9 aa, West Nile virus
VREAGILTT

SEQ ID NO: 135554 - protein, 9 aa, West Nile virus
REAGILTTA

SEQ ID NO: 135555 - protein, 9 aa, West Nile virus
EAGILTTAA

SEQ ID NO: 135556 - protein, 9 aa, West Nile virus
AGILTTAAA

SEQ ID NO: 135557 - protein, 9 aa, West Nile virus
GILTTAAAV

SEQ ID NO: 135558 - protein, 9 aa, West Nile virus
ILTTAAAVT

SEQ ID NO: 135559 - protein, 9 aa, West Nile virus
LTTAAAVTL

SEQ ID NO: 135560 - protein, 9 aa, West Nile virus
TTAAAVTLW

SEQ ID NO: 135561 - protein, 9 aa, West Nile virus
SAAAVTLWE

SEQ ID NO: 135562 - protein, 9 aa, West Nile virus
SASVTLWEN

SEQ ID NO: 135563 - protein, 9 aa, West Nile virus
AAVTLWEKG

SEQ ID NO: 135564 - protein, 9 aa, West Nile virus
AVTLWEKGA

SEQ ID NO: 135565 - protein, 9 aa, West Nile virus
VTLWENGAG

SEQ ID NO: 135566 - protein, 9 aa, West Nile virus
TLWENGAGS

SEQ ID NO: 135567 - protein, 9 aa, West Nile virus
LWENGAGSV

SEQ ID NO: 135568 - protein, 9 aa, West Nile virus
WENGAGSVW

SEQ ID NO: 135569 - protein, 9 aa, West Nile virus
ENGAGSVWN

SEQ ID NO: 135570 - protein, 9 aa, West Nile virus
NGAGSVWNA

SEQ ID NO: 135571 - protein, 9 aa, West Nile virus
GAGSVWNAT

SEQ ID NO: 135572 - protein, 9 aa, West Nile virus
AGSVWNATT

SEQ ID NO: 135573 - protein, 9 aa, West Nile virus
GSVWNATTA

SEQ ID NO: 135574 - protein, 9 aa, West Nile virus
TTAIGLCHV

SEQ ID NO: 135575 - protein, 9 aa, West Nile virus
TAIGLCHVM

SEQ ID NO: 135576 - protein, 9 aa, West Nile virus
AIGLCHVMR

SEQ ID NO: 135577 - protein, 9 aa, West Nile virus
IGLCHVMRG

SEQ ID NO: 135578 - protein, 9 aa, West Nile virus
GLCHVMRGG

SEQ ID NO: 135579 - protein, 9 aa, West Nile virus
LCHVMRGGW

SEQ ID NO: 135580 - protein, 9 aa, West Nile virus
CHVMRGGWL

SEQ ID NO: 135581 - protein, 9 aa, West Nile virus
HVMRGGWLS

SEQ ID NO: 135582 - protein, 9 aa, West Nile virus
VMRGGWLSC

SEQ ID NO: 135583 - protein, 9 aa, West Nile virus
MREGWLSCL

SEQ ID NO: 135584 - protein, 9 aa, West Nile virus
RGGWLSCFS

SEQ ID NO: 135585 - protein, 9 aa, West Nile virus
GGWLSCLSM

SEQ ID NO: 135586 - protein, 9 aa, West Nile virus
GWLSCLSMT

SEQ ID NO: 135587 - protein, 9 aa, West Nile virus
WLSCLSIMW

SEQ ID NO: 135588 - protein, 9 aa, West Nile virus
LSCLSMTWT

SEQ ID NO: 135589 - protein, 9 aa, West Nile virus
SCLSMTWTL

SEQ ID NO: 135590 - protein, 9 aa, West Nile virus
KNMDKPGLK

SEQ ID NO: 135591 - protein, 9 aa, West Nile virus
NMDKPGLKR

SEQ ID NO: 135592 - protein, 9 aa, West Nile virus
MDKPGLKRG

SEQ ID NO: 135593 - protein, 9 aa, West Nile virus
DKPGLKRGG

SEQ ID NO: 135594 - protein, 9 aa, West Nile virus
KPGIKRGGA

SEQ ID NO: 135595 - protein, 9 aa, West Nile virus
PGIKRGGAK

SEQ ID NO: 135596 - protein, 9 aa, West Nile virus
VLKRGGAKG

SEQ ID NO: 135597 - protein, 9 aa, West Nile virus
RTLGEVWKD

SEQ ID NO: 135598 - protein, 9 aa, West Nile virus
TLGEVWKDR

SEQ ID NO: 135599 - protein, 9 aa, West Nile virus
LGEVWKDRL

SEQ ID NO: 135600 - protein, 9 aa, West Nile virus
GEVWKDRLN

SEQ ID NO: 135601 - protein, 9 aa, West Nile virus
EVWKERLNH

SEQ ID NO: 135602 - protein, 9 aa, West Nile virus
VWKERLNHM

SEQ ID NO: 135603 - protein, 9 aa, West Nile virus
WKERLNHMT

SEQ ID NO: 135604 - protein, 9 aa, West Nile virus
LTKEEFTRY

SEQ ID NO: 135605 - protein, 9 aa, West Nile virus
TKEEFIRYR

SEQ ID NO: 135606 - protein, 9 aa, West Nile virus
KEEFIRYRK

SEQ ID NO: 135607 - protein, 9 aa, West Nile virus
EEFIRYRKE

SEQ ID NO: 135608 - protein, 9 aa, West Nile virus
EFIRYRKEA

SEQ ID NO: 135609 - protein, 9 aa, West Nile virus
FIRYRKEAI

SEQ ID NO: 135610 - protein, 9 aa, West Nile virus
TRYRKEAIT

SEQ ID NO: 135611 - protein, 9 aa, West Nile virus
RYRKEAITE

SEQ ID NO: 135612 - protein, 9 aa, West Nile virus
YRKEAITEV

SEQ ID NO: 135613 - protein, 9 aa, West Nile virus
RKEAITEVD

SEQ ID NO: 135614 - protein, 9 aa, West Nile virus
KEAITEVDR

SEQ ID NO: 135615 - protein, 9 aa, West Nile virus
EAITEVDRS

SEQ ID NO: 135616 - protein, 9 aa, West Nile virus
AITEVDRSA

SEQ ID NO: 135617 - protein, 9 aa, West Nile virus
ITEVDRSAA

SEQ ID NO: 135618 - protein, 9 aa, West Nile virus
TEVDRSAAK

SEQ ID NO: 135619 - protein, 9 aa, West Nile virus
ARREGNITG

SEQ ID NO: 135620 - protein, 9 aa, West Nile virus
RREGNITGG

SEQ ID NO: 135621 - protein, 9 aa, West Nile virus
REGNITGGH

SEQ ID NO: 135622 - protein, 9 aa, West Nile virus
EGNITGGHP

SEQ ID NO: 135623 - protein, 9 aa, West Nile virus
GNITGGHPV

SEQ ID NO: 135624 - protein, 9 aa, West Nile virus
NITGGHPVS

SEQ ID NO: 135625 - protein, 9 aa, West Nile virus
ITGGHPVSR

SEQ ID NO: 135626 - protein, 9 aa, West Nile virus
TGGHSVSRG

SEQ ID NO: 135627 - protein, 9 aa, West Nile virus
GGHSVSRGT

SEQ ID NO: 135628 - protein, 9 aa, West Nile virus
GHSVSRGTA

SEQ ID NO: 135629 - protein, 9 aa, West Nile virus
HSVSRGTAK

SEQ ID NO: 135630 - protein, 9 aa, West Nile virus
SVSRGTAKL

SEQ ID NO: 135631 - protein, 9 aa, West Nile virus
WLVERRFLD

SEQ ID NO: 135632 - protein, 9 aa, West Nile virus
LVERRFLDP

SEQ ID NO: 135633 - protein, 9 aa, West Nile virus
VERRFLDPI

SEQ ID NO: 135634 - protein, 9 aa, West Nile virus
ERRFLDPIG

SEQ ID NO: 135635 - protein, 9 aa, West Nile virus
RRFLDPIGK

SEQ ID NO: 135636 - protein, 9 aa, West Nile virus
RFLDPIGKV

SEQ ID NO: 135637 - protein, 9 aa, West Nile virus
FLEPVGKVV

SEQ ID NO: 135638 - protein, 9 aa, West Nile virus
LEPVGKVVD

SEQ ID NO: 135639 - protein, 9 aa, West Nile virus
EPVGKVVDL

SEQ ID NO: 135640 - protein, 9 aa, West Nile virus
PVGKVVDLG

SEQ ID NO: 135641 - protein, 9 aa, West Nile virus
VGKVVDLGC

SEQ ID NO: 135642 - protein, 9 aa, West Nile virus
GKVVDLGCG

SEQ ID NO: 135643 - protein, 9 aa, West Nile virus
KVVDLGCGR

SEQ ID NO: 135644 - protein, 9 aa, West Nile virus
VVDLGCGRG

SEQ ID NO: 135645 - protein, 9 aa, West Nile virus
VDLGCGRGG

SEQ ID NO: 135646 - protein, 9 aa, West Nile virus
TQKRVQEVK

SEQ ID NO: 135647 - protein, 9 aa, West Nile virus
QKRVQEVKG

SEQ ID NO: 135648 - protein, 9 aa, West Nile virus
KRVQEVKGY

SEQ ID NO: 135649 - protein, 9 aa, West Nile virus
RVQEVKGYT

SEQ ID NO: 135650 - protein, 9 aa, West Nile virus
VQEVKGYTK

SEQ ID NO: 135651 - protein, 9 aa, West Nile virus
QEVKGYTKG

SEQ ID NO: 135652 - protein, 9 aa, West Nile virus
EVKGYTKGG

SEQ ID NO: 135653 - protein, 9 aa, West Nile virus
VKGYTKGGP

SEQ ID NO: 135654 - protein, 9 aa, West Nile virus
KGYTKGGPG

SEQ ID NO: 135655 - protein, 9 aa, West Nile virus
LVQSYGWNT

SEQ ID NO: 135656 - protein, 9 aa, West Nile virus
VQSYGWNTV

SEQ ID NO: 135657 - protein, 9 aa, West Nile virus
QSYGWNTVT

SEQ ID NO: 135658 - protein, 9 aa, West Nile virus
SYGWNTVTM

SEQ ID NO: 135659 - protein, 9 aa, West Nile virus
YGWNTVTMK

SEQ ID NO: 135660 - protein, 9 aa, West Nile virus
GWNTVTMKS

SEQ ID NO: 135661 - protein, 9 aa, West Nile virus
WNTVTMKSG

SEQ ID NO: 135662 - protein, 9 aa, West Nile virus
NTVTMKSGV

SEQ ID NO: 135663 - protein, 9 aa, West Nile virus
TVTMKSGVD

SEQ ID NO: 135664 - protein, 9 aa, West Nile virus
TMKSGVDVY

SEQ ID NO: 135665 - protein, 9 aa, West Nile virus
MKSGVDVYY

SEQ ID NO: 135666 - protein, 9 aa, West Nile virus
KSGVDVYYR

SEQ ID NO: 135667 - protein, 9 aa, West Nile virus
SGVDVYYRA

SEQ ID NO: 135668 - protein, 9 aa, West Nile virus
GVDVYYRAS

SEQ ID NO: 135669 - protein, 9 aa, West Nile virus
VDVYYRASE

SEQ ID NO: 135670 - protein, 9 aa, West Nile virus
DVFYRPSEA

SEQ ID NO: 135671 - protein, 9 aa, West Nile virus
VFYRPSEAS

SEQ ID NO: 135672 - protein, 9 aa, West Nile virus
FYRPSEASD

SEQ ID NO: 135673 - protein, 9 aa, West Nile virus
YRPSEASDT

SEQ ID NO: 135674 - protein, 9 aa, West Nile virus
RPSEASDTL

SEQ ID NO: 135675 - protein, 9 aa, West Nile virus
PSEASDTLL

SEQ ID NO: 135676 - protein, 9 aa, West Nile virus
SEASDTLLC

SEQ ID NO: 135677 - protein, 9 aa, West Nile virus
EASDTLLCD

SEQ ID NO: 135678 - protein, 9 aa, West Nile virus
ASDTLLCDI

SEQ ID NO: 135679 - protein, 9 aa, West Nile virus
SDTLLCDIG

SEQ ID NO: 135680 - protein, 9 aa, West Nile virus
LLCDIGESA

SEQ ID NO: 135681 - protein, 9 aa, West Nile virus
LCDIGESAS

SEQ ID NO: 135682 - protein, 9 aa, West Nile virus
CDIGESASS

SEQ ID NO: 135683 - protein, 9 aa, West Nile virus
DIGESASSA

SEQ ID NO: 135684 - protein, 9 aa, West Nile virus
IGESASSAE

SEQ ID NO: 135685 - protein, 9 aa, West Nile virus
GESASSAEV

SEQ ID NO: 135686 - protein, 9 aa, West Nile virus
ESASSAEVE

SEQ ID NO: 135687 - protein, 9 aa, West Nile virus
SASSAEVEE

SEQ ID NO: 135688 - protein, 9 aa, West Nile virus
ASSAEVEEH

SEQ ID NO: 135689 - protein, 9 aa, West Nile virus
AEVEEHRTV

SEQ ID NO: 135690 - protein, 9 aa, West Nile virus
EVEEHRTVR

SEQ ID NO: 135691 - protein, 9 aa, West Nile virus
VEEHRTVRV

SEQ ID NO: 135692 - protein, 9 aa, West Nile virus
EEHRTVRVL

SEQ ID NO: 135693 - protein, 9 aa, West Nile virus
EHRTVRVLE

SEQ ID NO: 135694 - protein, 9 aa, West Nile virus
HRTVRVLEM

SEQ ID NO: 135695 - protein, 9 aa, West Nile virus
RTVRVLEMV

SEQ ID NO: 135696 - protein, 9 aa, West Nile virus
TVRVLEMVE

SEQ ID NO: 135697 - protein, 9 aa, West Nile virus
VRVLEMVED

SEQ ID NO: 135698 - protein, 9 aa, West Nile virus
EDWLHRGPK

SEQ ID NO: 135699 - protein, 9 aa, West Nile virus
DWLHRGPKE

SEQ ID NO: 135700 - protein, 9 aa, West Nile virus
WLHRGPKEF

SEQ ID NO: 135701 - protein, 9 aa, West Nile virus
LHRGPKEFC

SEQ ID NO: 135702 - protein, 9 aa, West Nile virus
HRGPKEFCI

SEQ ID NO: 135703 - protein, 9 aa, West Nile virus
RGPKEFCIK

SEQ ID NO: 135704 - protein, 9 aa, West Nile virus
GPKEFCIKV

SEQ ID NO: 135705 - protein, 9 aa, West Nile virus
PKEFCIKVL

SEQ ID NO: 135706 - protein, 9 aa, West Nile virus
KEFCIKVLC

SEQ ID NO: 135707 - protein, 9 aa, West Nile virus
EFCIKVLCP

SEQ ID NO: 135708 - protein, 9 aa, West Nile virus
FCIKVLCPY

SEQ ID NO: 135709 - protein, 9 aa, West Nile virus
CIKVLCPYM

SEQ ID NO: 135710 - protein, 9 aa, West Nile virus
IKVLCPYMP

SEQ ID NO: 135711 - protein, 9 aa, West Nile virus
LCPYMPRVI

SEQ ID NO: 135712 - protein, 9 aa, West Nile virus
CPYMPKVVE

SEQ ID NO: 135713 - protein, 9 aa, West Nile virus
PYMPKVVEK

SEQ ID NO: 135714 - protein, 9 aa, West Nile virus
YMPKVVEKM

SEQ ID NO: 135715 - protein, 9 aa, West Nile virus
MPRVIEKME

SEQ ID NO: 135716 - protein, 9 aa, West Nile virus
PKVIEKMET

SEQ ID NO: 135717 - protein, 9 aa, West Nile virus
KVIEKMETL

SEQ ID NO: 135718 - protein, 9 aa, West Nile virus
VIEKMETLQ

SEQ ID NO: 135719 - protein, 9 aa, West Nile virus
IEKMETLQR

SEQ ID NO: 135720 - protein, 9 aa, West Nile virus
EKMETLQRR

SEQ ID NO: 135721 - protein, 9 aa, West Nile virus
KMETLQRRY

SEQ ID NO: 135722 - protein, 9 aa, West Nile virus
METLQRRYG

SEQ ID NO: 135723 - protein, 9 aa, West Nile virus
ETLQRRYGG

SEQ ID NO: 135724 - protein, 9 aa, West Nile virus
TLQRRYGGG

SEQ ID NO: 135725 - protein, 9 aa, West Nile virus
QRRYGGGLI

SEQ ID NO: 135726 - protein, 9 aa, West Nile virus
RRYGGGLIR

SEQ ID NO: 135727 - protein, 9 aa, West Nile virus
RYGGGLIRN

SEQ ID NO: 135728 - protein, 9 aa, West Nile virus
YGGGLIRNP

SEQ ID NO: 135729 - protein, 9 aa, West Nile virus
GGGLIRNPL

SEQ ID NO: 135730 - protein, 9 aa, West Nile virus
GGLIRNPLS

SEQ ID NO: 135731 - protein, 9 aa, West Nile virus
GLIRNPLSR

SEQ ID NO: 135732 - protein, 9 aa, West Nile virus
LIRNPLSRN

SEQ ID NO: 135733 - protein, 9 aa, West Nile virus
IRNPLSRNS

SEQ ID NO: 135734 - protein, 9 aa, West Nile virus
THEMYWVSH

SEQ ID NO: 135735 - protein, 9 aa, West Nile virus
HEMYWVSHA

SEQ ID NO: 135736 - protein, 9 aa, West Nile virus
EMYWVSHAS

SEQ ID NO: 135737 - protein, 9 aa, West Nile virus
MYWVSHASG

SEQ ID NO: 135738 - protein, 9 aa, West Nile virus
YWVSHASGN

SEQ ID NO: 135739 - protein, 9 aa, West Nile virus
WVSHASGNI

SEQ ID NO: 135740 - protein, 9 aa, West Nile virus
VSHASGNIV

SEQ ID NO: 135741 - protein, 9 aa, West Nile virus
SHASGNIVH

SEQ ID NO: 135742 - protein, 9 aa, West Nile virus
NIVHSVNMT

SEQ ID NO: 135743 - protein, 9 aa, West Nile virus
IVHSVNMTS

SEQ ID NO: 135744 - protein, 9 aa, West Nile virus
VNSVSMTSQ

SEQ ID NO: 135745 - protein, 9 aa, West Nile virus
NSVSMTSQV

SEQ ID NO: 135746 - protein, 9 aa, West Nile virus
SVSMTSQVL

SEQ ID NO: 135747 - protein, 9 aa, West Nile virus
VSMTSQVLL

SEQ ID NO: 135748 - protein, 9 aa, West Nile virus
SMTSQVLLG

SEQ ID NO: 135749 - protein, 9 aa, West Nile virus
VLLGRMEKK

SEQ ID NO: 135750 - protein, 9 aa, West Nile virus
LLGRMEKKT

SEQ ID NO: 135751 - protein, 9 aa, West Nile virus
LGRMEKKTW

SEQ ID NO: 135752 - protein, 9 aa, West Nile virus
GRMEKKTWK

SEQ ID NO: 135753 - protein, 9 aa, West Nile virus
RMEKKTWKG

SEQ ID NO: 135754 - protein, 9 aa, West Nile virus
MEKKTWKGP

SEQ ID NO: 135755 - protein, 9 aa, West Nile virus
EKKTWKGPQ

SEQ ID NO: 135756 - protein, 9 aa, West Nile virus
KKTWKGPQF

SEQ ID NO: 135757 - protein, 9 aa, West Nile virus
KTWKGPQFE

SEQ ID NO: 135758 - protein, 9 aa, West Nile virus
TWKGPQFEE

SEQ ID NO: 135759 - protein, 9 aa, West Nile virus
WKGPQFEED

SEQ ID NO: 135760 - protein, 9 aa, West Nile virus
KGPQFEEDV

SEQ ID NO: 135761 - protein, 9 aa, West Nile virus
GPQFEEDVN

SEQ ID NO: 135762 - protein, 9 aa, West Nile virus
PQFEEDVNL

SEQ ID NO: 135763 - protein, 9 aa, West Nile virus
QFEEDVNLG

SEQ ID NO: 135764 - protein, 9 aa, West Nile virus
FEEDVNLGS

SEQ ID NO: 135765 - protein, 9 aa, West Nile virus
EEDANLGSG

SEQ ID NO: 135766 - protein, 9 aa, West Nile virus
EDANLGSGT

SEQ ID NO: 135767 - protein, 9 aa, West Nile virus
DANLGSGTR

SEQ ID NO: 135768 - protein, 9 aa, West Nile virus
ANLGSGTRA

SEQ ID NO: 135769 - protein, 9 aa, West Nile virus
RAVGRPLLN

SEQ ID NO: 135770 - protein, 9 aa, West Nile virus
AVGRPLLNS

SEQ ID NO: 135771 - protein, 9 aa, West Nile virus
VGRPLLNSD

SEQ ID NO: 135772 - protein, 9 aa, West Nile virus
GRPLLNSDT

SEQ ID NO: 135773 - protein, 9 aa, West Nile virus
KPLLNSDTG

SEQ ID NO: 135774 - protein, 9 aa, West Nile virus
PLLNSDTGK

SEQ ID NO: 135775 - protein, 9 aa, West Nile virus
LLNSDTGKI

SEQ ID NO: 135776 - protein, 9 aa, West Nile virus
LNSDTGKIR

SEQ ID NO: 135777 - protein, 9 aa, West Nile virus
SDTGKIRNR

SEQ ID NO: 135778 - protein, 9 aa, West Nile virus
NRIERLKKE

SEQ ID NO: 135779 - protein, 9 aa, West Nile virus
RIERLKKEY

SEQ ID NO: 135780 - protein, 9 aa, West Nile virus
IERLKKEYS

SEQ ID NO: 135781 - protein, 9 aa, West Nile virus
DANHPYRTW

SEQ ID NO: 135782 - protein, 9 aa, West Nile virus
ANHPYRTWN

SEQ ID NO: 135783 - protein, 9 aa, West Nile virus
TWNYHGSYE

SEQ ID NO: 135784 - protein, 9 aa, West Nile virus
WNYHGSYEV

SEQ ID NO: 135785 - protein, 9 aa, West Nile virus
NYHGSYDVR

SEQ ID NO: 135786 - protein, 9 aa, West Nile virus
YHGSYDVRP

SEQ ID NO: 135787 - protein, 9 aa, West Nile virus
HGSYDVRPT

SEQ ID NO: 135788 - protein, 9 aa, West Nile virus
GSYDVRPTG

SEQ ID NO: 135789 - protein, 9 aa, West Nile virus
SYDVRPTGS

SEQ ID NO: 135790 - protein, 9 aa, West Nile virus
YDVRPTGSA

SEQ ID NO: 135791 - protein, 9 aa, West Nile virus
DVRPTGSAS

SEQ ID NO: 135792 - protein, 9 aa, West Nile virus
VRPTGSASS

SEQ ID NO: 135793 - protein, 9 aa, West Nile virus
RPTGSASSL

SEQ ID NO: 135794 - protein, 9 aa, West Nile virus
LSKPWDVIT

SEQ ID NO: 135795 - protein, 9 aa, West Nile virus
SKPWDVITN

SEQ ID NO: 135796 - protein, 9 aa, West Nile virus
KPWDVITNV

SEQ ID NO: 135797 - protein, 9 aa, West Nile virus
PWDVITNVT

SEQ ID NO: 135798 - protein, 9 aa, West Nile virus
WDVITNVTT

SEQ ID NO: 135799 - protein, 9 aa, West Nile virus
DTIMNVTTM

SEQ ID NO: 135800 - protein, 9 aa, West Nile virus
TITSVTTMA

SEQ ID NO: 135801 - protein, 9 aa, West Nile virus
IMNVTTMAM

SEQ ID NO: 135802 - protein, 9 aa, West Nile virus
TSVTTMAMT

SEQ ID NO: 135803 - protein, 9 aa, West Nile virus
VDTKAPEPA

SEQ ID NO: 135804 - protein, 9 aa, West Nile virus
DTKAPEPAE

SEQ ID NO: 135805 - protein, 9 aa, West Nile virus
TKAPEPAEG

SEQ ID NO: 135806 - protein, 9 aa, West Nile virus
KAPEPAEGV

SEQ ID NO: 135807 - protein, 9 aa, West Nile virus
APEPAEGVK

SEQ ID NO: 135808 - protein, 9 aa, West Nile virus
VLKETTNWL

SEQ ID NO: 135809 - protein, 9 aa, West Nile virus
NETTNWLWT

SEQ ID NO: 135810 - protein, 9 aa, West Nile virus
ETTNWLWTF

SEQ ID NO: 135811 - protein, 9 aa, West Nile virus
TTNWLWTFL

SEQ ID NO: 135812 - protein, 9 aa, West Nile virus
TNWLWTFLA

SEQ ID NO: 135813 - protein, 9 aa, West Nile virus
NWLWTFLAR

SEQ ID NO: 135814 - protein, 9 aa, West Nile virus
RDKKPRMCS

SEQ ID NO: 135815 - protein, 9 aa, West Nile virus
DKKPRMCSR

SEQ ID NO: 135816 - protein, 9 aa, West Nile virus
KKPRMCSRE

SEQ ID NO: 135817 - protein, 9 aa, West Nile virus
KPRMCSREE

SEQ ID NO: 135818 - protein, 9 aa, West Nile virus
PRMCTREEF

SEQ ID NO: 135819 - protein, 9 aa, West Nile virus
RMCTREEFI

SEQ ID NO: 135820 - protein, 9 aa, West Nile virus
MCSREEFIG

SEQ ID NO: 135821 - protein, 9 aa, West Nile virus
CSREEFIGK

SEQ ID NO: 135822 - protein, 9 aa, West Nile virus
SREEFIGKV

SEQ ID NO: 135823 - protein, 9 aa, West Nile virus
REEFIGKVN

SEQ ID NO: 135824 - protein, 9 aa, West Nile virus
EEFIGKVNS

SEQ ID NO: 135825 - protein, 9 aa, West Nile virus
EFIGKVNSN

SEQ ID NO: 135826 - protein, 9 aa, West Nile virus
FIGKVNSNA

SEQ ID NO: 135827 - protein, 9 aa, West Nile virus
IGKVNSNAA

SEQ ID NO: 135828 - protein, 9 aa, West Nile virus
GKVNSNAAL

SEQ ID NO: 135829 - protein, 9 aa, West Nile virus
MFEEQNQWK

SEQ ID NO: 135830 - protein, 9 aa, West Nile virus
FEEQNQWKN

SEQ ID NO: 135831 - protein, 9 aa, West Nile virus
EEQNQWKNA

SEQ ID NO: 135832 - protein, 9 aa, West Nile virus
EQNQWKNAR

SEQ ID NO: 135833 - protein, 9 aa, West Nile virus
QNQWKNARE

SEQ ID NO: 135834 - protein, 9 aa, West Nile virus
NQWKNAREA

SEQ ID NO: 135835 - protein, 9 aa, West Nile virus
QWKNAREAV

SEQ ID NO: 135836 - protein, 9 aa, West Nile virus
WKNAREAVE

SEQ ID NO: 135837 - protein, 9 aa, West Nile virus
KNAREAVED

SEQ ID NO: 135838 - protein, 9 aa, West Nile virus
NAREAVEDP

SEQ ID NO: 135839 - protein, 9 aa, West Nile virus
ARAAVEDPK

SEQ ID NO: 135840 - protein, 9 aa, West Nile virus
REAVEDLKF

SEQ ID NO: 135841 - protein, 9 aa, West Nile virus
AAVEDPKFW

SEQ ID NO: 135842 - protein, 9 aa, West Nile virus
AVEDLKFWE

SEQ ID NO: 135843 - protein, 9 aa, West Nile virus
VEDLKFWEM

SEQ ID NO: 135844 - protein, 9 aa, West Nile virus
EDPKFWEIV

SEQ ID NO: 135845 - protein, 9 aa, West Nile virus
DLKFWEMVD

SEQ ID NO: 135846 - protein, 9 aa, West Nile virus
PKFWEMVDD

SEQ ID NO: 135847 - protein, 9 aa, West Nile virus
KFWEMVDDE

SEQ ID NO: 135848 - protein, 9 aa, West Nile virus
FWEMVDDER

SEQ ID NO: 135849 - protein, 9 aa, West Nile virus
WEMVDDERE

SEQ ID NO: 135850 - protein, 9 aa, West Nile virus
EMVDDEREA

SEQ ID NO: 135851 - protein, 9 aa, West Nile virus
MVDDEREAH

SEQ ID NO: 135852 - protein, 9 aa, West Nile virus
VDDEREAHL

SEQ ID NO: 135853 - protein, 9 aa, West Nile virus
DDEREAHLR

SEQ ID NO: 135854 - protein, 9 aa, West Nile virus
DEREAHLRG

SEQ ID NO: 135855 - protein, 9 aa, West Nile virus
EAHLRGECN

SEQ ID NO: 135856 - protein, 9 aa, West Nile virus
AHLRGECNT

SEQ ID NO: 135857 - protein, 9 aa, West Nile virus
HLRGECNTC

SEQ ID NO: 135858 - protein, 9 aa, West Nile virus
LRGECNTCI

SEQ ID NO: 135859 - protein, 9 aa, West Nile virus
RGECNTCIY

SEQ ID NO: 135860 - protein, 9 aa, West Nile virus
GECNTCIYN

SEQ ID NO: 135861 - protein, 9 aa, West Nile virus
ECNTCIYNM

SEQ ID NO: 135862 - protein, 9 aa, West Nile virus
CNTCIYNMM

SEQ ID NO: 135863 - protein, 9 aa, West Nile virus
NTCIYNMMG

SEQ ID NO: 135864 - protein, 9 aa, West Nile virus
KPGEFGKAR

SEQ ID NO: 135865 - protein, 9 aa, West Nile virus
PGDFGKAKG

SEQ ID NO: 135866 - protein, 9 aa, West Nile virus
GDFGKAKGS

SEQ ID NO: 135867 - protein, 9 aa, West Nile virus
EFGKARGSR

SEQ ID NO: 135868 - protein, 9 aa, West Nile virus
NEDHWLGRE

SEQ ID NO: 135869 - protein, 9 aa, West Nile virus
EDHWLGREN

SEQ ID NO: 135870 - protein, 9 aa, West Nile virus
DHWLGRENS

SEQ ID NO: 135871 - protein, 9 aa, West Nile virus
HWLGRENSG

SEQ ID NO: 135872 - protein, 9 aa, West Nile virus
WLGRENSGG

SEQ ID NO: 135873 - protein, 9 aa, West Nile virus
LGRENSGGG

SEQ ID NO: 135874 - protein, 9 aa, West Nile virus
GRENSGGGV

SEQ ID NO: 135875 - protein, 9 aa, West Nile virus
RENSGGGVE

SEQ ID NO: 135876 - protein, 9 aa, West Nile virus
ENSGGGVEG

SEQ ID NO: 135877 - protein, 9 aa, West Nile virus
LGLQKLGYV

SEQ ID NO: 135878 - protein, 9 aa, West Nile virus
GLQKLGYVL

SEQ ID NO: 135879 - protein, 9 aa, West Nile virus
LQKLGYILK

SEQ ID NO: 135880 - protein, 9 aa, West Nile virus
QKLGYILKE

SEQ ID NO: 135881 - protein, 9 aa, West Nile virus
KLGYILKEV

SEQ ID NO: 135882 - protein, 9 aa, West Nile virus
LGYILKEVG

SEQ ID NO: 135883 - protein, 9 aa, West Nile virus
GGKMYADDT

SEQ ID NO: 135884 - protein, 9 aa, West Nile virus
GKMYADDTA

SEQ ID NO: 135885 - protein, 9 aa, West Nile virus
KMYADDTAG

SEQ ID NO: 135886 - protein, 9 aa, West Nile virus
MYADDTAGW

SEQ ID NO: 135887 - protein, 9 aa, West Nile virus
AGWDTRITK

SEQ ID NO: 135888 - protein, 9 aa, West Nile virus
GWDTRITKA

SEQ ID NO: 135889 - protein, 9 aa, West Nile virus
WDTRITKAD

SEQ ID NO: 135890 - protein, 9 aa, West Nile virus
DTRITKADL

SEQ ID NO: 135891 - protein, 9 aa, West Nile virus
TRITKADLE

SEQ ID NO: 135892 - protein, 9 aa, West Nile virus
RITKADLEN

SEQ ID NO: 135893 - protein, 9 aa, West Nile virus
ITKADLENE

SEQ ID NO: 135894 - protein, 9 aa, West Nile virus
TKADLENEA

SEQ ID NO: 135895 - protein, 9 aa, West Nile virus
KADLENEAK

SEQ ID NO: 135896 - protein, 9 aa, West Nile virus
ENEAKVLEF

SEQ ID NO: 135897 - protein, 9 aa, West Nile virus
NEAKVLEFL

SEQ ID NO: 135898 - protein, 9 aa, West Nile virus
EAKVLEFLD

SEQ ID NO: 135899 - protein, 9 aa, West Nile virus
AKVLEFLDG

SEQ ID NO: 135900 - protein, 9 aa, West Nile virus
KVLEFLDGE

SEQ ID NO: 135901 - protein, 9 aa, West Nile virus
VLEFLDGEH

SEQ ID NO: 135902 - protein, 9 aa, West Nile virus
LEFLDGEHR

SEQ ID NO: 135903 - protein, 9 aa, West Nile virus
EFLDGEHRR

SEQ ID NO: 135904 - protein, 9 aa, West Nile virus
FLDGEHRRL

SEQ ID NO: 135905 - protein, 9 aa, West Nile virus
LDREHRRLA

SEQ ID NO: 135906 - protein, 9 aa, West Nile virus
EGEHRRLAR

SEQ ID NO: 135907 - protein, 9 aa, West Nile virus
GEHRRLARS

SEQ ID NO: 135908 - protein, 9 aa, West Nile virus
EHRRLARSI

SEQ ID NO: 135909 - protein, 9 aa, West Nile virus
HRRLARSII

SEQ ID NO: 135910 - protein, 9 aa, West Nile virus
RRLARSIIE

SEQ ID NO: 135911 - protein, 9 aa, West Nile virus
RLARSIIEL

SEQ ID NO: 135912 - protein, 9 aa, West Nile virus
LARSIIELT

SEQ ID NO: 135913 - protein, 9 aa, West Nile virus
ARSIIELTY

SEQ ID NO: 135914 - protein, 9 aa, West Nile virus
RSIIELTYR

SEQ ID NO: 135915 - protein, 9 aa, West Nile virus
SIIELTYRH

SEQ ID NO: 135916 - protein, 9 aa, West Nile virus
VIELTYRHK

SEQ ID NO: 135917 - protein, 9 aa, West Nile virus
IELTYCHKV

SEQ ID NO: 135918 - protein, 9 aa, West Nile virus
ELTYCHKVV

SEQ ID NO: 135919 - protein, 9 aa, West Nile virus
LTYCHKVVK

SEQ ID NO: 135920 - protein, 9 aa, West Nile virus
TYRYKVVKV

SEQ ID NO: 135921 - protein, 9 aa, West Nile virus
YRHKVVKGM

SEQ ID NO: 135922 - protein, 9 aa, West Nile virus
CHKVVKVMR

SEQ ID NO: 135923 - protein, 9 aa, West Nile virus
HKVVKGMRP

SEQ ID NO: 135924 - protein, 9 aa, West Nile virus
VVKVMRPAV

SEQ ID NO: 135925 - protein, 9 aa, West Nile virus
VKVMRPAVG

SEQ ID NO: 135926 - protein, 9 aa, West Nile virus
KVMRPAVGG

SEQ ID NO: 135927 - protein, 9 aa, West Nile virus
VMRPAADGK

SEQ ID NO: 135928 - protein, 9 aa, West Nile virus
MRPAADGKT

SEQ ID NO: 135929 - protein, 9 aa, West Nile virus
RPAADGKTV

SEQ ID NO: 135930 - protein, 9 aa, West Nile virus
PAADGKTVM

SEQ ID NO: 135931 - protein, 9 aa, West Nile virus
AADGKTVMD

SEQ ID NO: 135932 - protein, 9 aa, West Nile virus
ADGKTVMDV

SEQ ID NO: 135933 - protein, 9 aa, West Nile virus
DGKTVMDVI

SEQ ID NO: 135934 - protein, 9 aa, West Nile virus
GKTVMDVIS

SEQ ID NO: 135935 - protein, 9 aa, West Nile virus
KTVMDVISR

SEQ ID NO: 135936 - protein, 9 aa, West Nile virus
TVMDIISRE

SEQ ID NO: 135937 - protein, 9 aa, West Nile virus
VMDIISRED

SEQ ID NO: 135938 - protein, 9 aa, West Nile virus
MDIISREDQ

SEQ ID NO: 135939 - protein, 9 aa, West Nile virus
DIISREDQR

SEQ ID NO: 135940 - protein, 9 aa, West Nile virus
IISREDQRG

SEQ ID NO: 135941 - protein, 9 aa, West Nile virus
QVVTYALNP

SEQ ID NO: 135942 - protein, 9 aa, West Nile virus
VVTYALNPF

SEQ ID NO: 135943 - protein, 9 aa, West Nile virus
VTYALNPFS

SEQ ID NO: 135944 - protein, 9 aa, West Nile virus
TYALNPFSN

SEQ ID NO: 135945 - protein, 9 aa, West Nile virus
YALNPFTNL

SEQ ID NO: 135946 - protein, 9 aa, West Nile virus
ALNTFTNLS

SEQ ID NO: 135947 - protein, 9 aa, West Nile virus
LNTFTNLSV

SEQ ID NO: 135948 - protein, 9 aa, West Nile virus
NTFTNLSVQ

SEQ ID NO: 135949 - protein, 9 aa, West Nile virus
TFTNLSVQL

SEQ ID NO: 135950 - protein, 9 aa, West Nile virus
FTNLSVQLV

SEQ ID NO: 135951 - protein, 9 aa, West Nile virus
TNLSVQLVR

SEQ ID NO: 135952 - protein, 9 aa, West Nile virus
NLSVQLVRM

SEQ ID NO: 135953 - protein, 9 aa, West Nile virus
LSVQLVRMM

SEQ ID NO: 135954 - protein, 9 aa, West Nile virus
SVQLVRMME

SEQ ID NO: 135955 - protein, 9 aa, West Nile virus
FQLGRRREG

SEQ ID NO: 135956 - protein, 9 aa, West Nile virus
QLVRRREGE

SEQ ID NO: 135957 - protein, 9 aa, West Nile virus
LGRRREGEG

SEQ ID NO: 135958 - protein, 9 aa, West Nile virus
GRRREGEGV

SEQ ID NO: 135959 - protein, 9 aa, West Nile virus
RMMEGEGVV

SEQ ID NO: 135960 - protein, 9 aa, West Nile virus
MMEGEGVVG

SEQ ID NO: 135961 - protein, 9 aa, West Nile virus
MEGEGVVGP

SEQ ID NO: 135962 - protein, 9 aa, West Nile virus
EGEGVVGPD

SEQ ID NO: 135963 - protein, 9 aa, West Nile virus
GEGVVGPDD

SEQ ID NO: 135964 - protein, 9 aa, West Nile virus
EGVVGPDDV

SEQ ID NO: 135965 - protein, 9 aa, West Nile virus
GVVGPDDVE

SEQ ID NO: 135966 - protein, 9 aa, West Nile virus
KGKGVKVRV

SEQ ID NO: 135967 - protein, 9 aa, West Nile virus
GKGVKVRVW

SEQ ID NO: 135968 - protein, 9 aa, West Nile virus
KGVKVRVWL

SEQ ID NO: 135969 - protein, 9 aa, West Nile virus
GVKVRVWLF

SEQ ID NO: 135970 - protein, 9 aa, West Nile virus
VKVRVWLFE

SEQ ID NO: 135971 - protein, 9 aa, West Nile virus
KVRVWLFEN

SEQ ID NO: 135972 - protein, 9 aa, West Nile virus
VRVWLFENG

SEQ ID NO: 135973 - protein, 9 aa, West Nile virus
RVWLFENGE

SEQ ID NO: 135974 - protein, 9 aa, West Nile virus
VWLFENGEE

SEQ ID NO: 135975 - protein, 9 aa, West Nile virus
WLSENGEER

SEQ ID NO: 135976 - protein, 9 aa, West Nile virus
LSENGEERL

SEQ ID NO: 135977 - protein, 9 aa, West Nile virus
SENGEERLS

SEQ ID NO: 135978 - protein, 9 aa, West Nile virus
ENGEERLGR

SEQ ID NO: 135979 - protein, 9 aa, West Nile virus
NGKERLGRM

SEQ ID NO: 135980 - protein, 9 aa, West Nile virus
GEERLGRMA

SEQ ID NO: 135981 - protein, 9 aa, West Nile virus
KERLGRMAV

SEQ ID NO: 135982 - protein, 9 aa, West Nile virus
ERLGRMAVS

SEQ ID NO: 135983 - protein, 9 aa, West Nile virus
RLGRMAVSG

SEQ ID NO: 135984 - protein, 9 aa, West Nile virus
LGRMAVSGD

SEQ ID NO: 135985 - protein, 9 aa, West Nile virus
GRMAVSGDD

SEQ ID NO: 135986 - protein, 9 aa, West Nile virus
KPLDDRFAS

SEQ ID NO: 135987 - protein, 9 aa, West Nile virus
PLDDRFATA

SEQ ID NO: 135988 - protein, 9 aa, West Nile virus
LDDRFATAL

SEQ ID NO: 135989 - protein, 9 aa, West Nile virus
DDRFATALH

SEQ ID NO: 135990 - protein, 9 aa, West Nile virus
DRFATALHF

SEQ ID NO: 135991 - protein, 9 aa, West Nile virus
RFATALHFL

SEQ ID NO: 135992 - protein, 9 aa, West Nile virus
FATALHFLN

SEQ ID NO: 135993 - protein, 9 aa, West Nile virus
ATALHFLNA

SEQ ID NO: 135994 - protein, 9 aa, West Nile virus
TALHFLNAM

SEQ ID NO: 135995 - protein, 9 aa, West Nile virus
ALHFLNAMS

SEQ ID NO: 135996 - protein, 9 aa, West Nile virus
LHFLNAMSQ

SEQ ID NO: 135997 - protein, 9 aa, West Nile virus
HFLNAMPKV

SEQ ID NO: 135998 - protein, 9 aa, West Nile virus
FLNAMSQVR

SEQ ID NO: 135999 - protein, 9 aa, West Nile virus
LNAMSQVRK

SEQ ID NO: 136000 - protein, 9 aa, West Nile virus
NAMPKVRKD

SEQ ID NO: 136001 - protein, 9 aa, West Nile virus
DMSKVRKDI

SEQ ID NO: 136002 - protein, 9 aa, West Nile virus
MSQVRKDIQ

SEQ ID NO: 136003 - protein, 9 aa, West Nile virus
SQVRKDIQE

SEQ ID NO: 136004 - protein, 9 aa, West Nile virus
STGWYDWQK

SEQ ID NO: 136005 - protein, 9 aa, West Nile virus
VGWYDWQQV

SEQ ID NO: 136006 - protein, 9 aa, West Nile virus
GWYDWQQVQ

SEQ ID NO: 136007 - protein, 9 aa, West Nile virus
WYDWQQVQF

SEQ ID NO: 136008 - protein, 9 aa, West Nile virus
YDWQQVQFC

SEQ ID NO: 136009 - protein, 9 aa, West Nile virus
DWQQVQFCS

SEQ ID NO: 136010 - protein, 9 aa, West Nile virus
WQQVQFCSN

SEQ ID NO: 136011 - protein, 9 aa, West Nile virus
QQVQFCSNH

SEQ ID NO: 136012 - protein, 9 aa, West Nile virus
QVQFCSNHF

SEQ ID NO: 136013 - protein, 9 aa, West Nile virus
VQFCSNHFT

SEQ ID NO: 136014 - protein, 9 aa, West Nile virus
QFCSNHFTE

SEQ ID NO: 136015 - protein, 9 aa, West Nile virus
MKDGRTLVT

SEQ ID NO: 136016 - protein, 9 aa, West Nile virus
KDGRTLVTP

SEQ ID NO: 136017 - protein, 9 aa, West Nile virus
DGRTLVTPC

SEQ ID NO: 136018 - protein, 9 aa, West Nile virus
GRTLVTPCR

SEQ ID NO: 136019 - protein, 9 aa, West Nile virus
RTLVTPCRG

SEQ ID NO: 136020 - protein, 9 aa, West Nile virus
TLVTPCRGQ

SEQ ID NO: 136021 - protein, 9 aa, West Nile virus
LVTPCRGQD

SEQ ID NO: 136022 - protein, 9 aa, West Nile virus
VTPCRGQDE

SEQ ID NO: 136023 - protein, 9 aa, West Nile virus
TPCRGQDEL

SEQ ID NO: 136024 - protein, 9 aa, West Nile virus
PCRGQDELI

SEQ ID NO: 136025 - protein, 9 aa, West Nile virus
CRGQDELIG

SEQ ID NO: 136026 - protein, 9 aa, West Nile virus
RGQDELIGR

SEQ ID NO: 136027 - protein, 9 aa, West Nile virus
GQDELIGRA

SEQ ID NO: 136028 - protein, 9 aa, West Nile virus
QDELIGRAR

SEQ ID NO: 136029 - protein, 9 aa, West Nile virus
DELIGRARI

SEQ ID NO: 136030 - protein, 9 aa, West Nile virus
ELIGRARIS

SEQ ID NO: 136031 - protein, 9 aa, West Nile virus
LIGRARISP

SEQ ID NO: 136032 - protein, 9 aa, West Nile virus
IGRARISPG

SEQ ID NO: 136033 - protein, 9 aa, West Nile virus
AKSYAQMWQ

SEQ ID NO: 136034 - protein, 9 aa, West Nile virus
KSYAQMWQL

SEQ ID NO: 136035 - protein, 9 aa, West Nile virus
SYAQMWQLL

SEQ ID NO: 136036 - protein, 9 aa, West Nile virus
YAQMWQLLY

SEQ ID NO: 136037 - protein, 9 aa, West Nile virus
AQMWQLLYF

SEQ ID NO: 136038 - protein, 9 aa, West Nile virus
QMWQLLYFH

SEQ ID NO: 136039 - protein, 9 aa, West Nile virus
MWQLLYFHR

SEQ ID NO: 136040 - protein, 9 aa, West Nile virus
WQLLYFHRR

SEQ ID NO: 136041 - protein, 9 aa, West Nile virus
QLLYFHRRD

SEQ ID NO: 136042 - protein, 9 aa, West Nile virus
NAICSAVPA

SEQ ID NO: 136043 - protein, 9 aa, West Nile virus
AICSAVPVS

SEQ ID NO: 136044 - protein, 9 aa, West Nile virus
ICSAVPVSW

SEQ ID NO: 136045 - protein, 9 aa, West Nile virus
CSAVPVSWV

SEQ ID NO: 136046 - protein, 9 aa, West Nile virus
SAVPVSWVP

SEQ ID NO: 136047 - protein, 9 aa, West Nile virus
AVPVSWVPT

SEQ ID NO: 136048 - protein, 9 aa, West Nile virus
VPVSWVPTG

SEQ ID NO: 136049 - protein, 9 aa, West Nile virus
PVSWVPTGR

SEQ ID NO: 136050 - protein, 9 aa, West Nile virus
VSWVPTGRT

SEQ ID NO: 136051 - protein, 9 aa, West Nile virus
SWVPTGRTT

SEQ ID NO: 136052 - protein, 9 aa, West Nile virus
GRTTWSIHV

SEQ ID NO: 136053 - protein, 9 aa, West Nile virus
RTTWSIHAK

SEQ ID NO: 136054 - protein, 9 aa, West Nile virus
TTWSIHAKG

SEQ ID NO: 136055 - protein, 9 aa, West Nile virus
TWSIHAKGE

SEQ ID NO: 136056 - protein, 9 aa, West Nile virus
WSIHAKGEW

SEQ ID NO: 136057 - protein, 9 aa, West Nile virus
SIHAKGEWM

SEQ ID NO: 136058 - protein, 9 aa, West Nile virus
IHAKGEWMT

SEQ ID NO: 136059 - protein, 9 aa, West Nile virus
HAKGEWMTT

SEQ ID NO: 136060 - protein, 9 aa, West Nile virus
AKGEWMTTE

SEQ ID NO: 136061 - protein, 9 aa, West Nile virus
KGEWMTTED

SEQ ID NO: 136062 - protein, 9 aa, West Nile virus
GEWMTTADM

SEQ ID NO: 136063 - protein, 9 aa, West Nile virus
EWMTTADML

SEQ ID NO: 136064 - protein, 9 aa, West Nile virus
WMTTEDMLA

SEQ ID NO: 136065 - protein, 9 aa, West Nile virus
MTTEDMLAV

SEQ ID NO: 136066 - protein, 9 aa, West Nile virus
TTEDMLAVW

SEQ ID NO: 136067 - protein, 9 aa, West Nile virus
TEDMLAVWN

SEQ ID NO: 136068 - protein, 9 aa, West Nile virus
EDMLAVWNR

SEQ ID NO: 136069 - protein, 9 aa, West Nile virus
DMLAVWNRV

SEQ ID NO: 136070 - protein, 9 aa, West Nile virus
MLAVWNRVW

SEQ ID NO: 136071 - protein, 9 aa, West Nile virus
LAVWNRVWI

SEQ ID NO: 136072 - protein, 9 aa, West Nile virus
AVWNRVWIE

SEQ ID NO: 136073 - protein, 9 aa, West Nile virus
NRVWIEENK

SEQ ID NO: 136074 - protein, 9 aa, West Nile virus
KVWIEENEW

SEQ ID NO: 136075 - protein, 9 aa, West Nile virus
MEDKTPVER

SEQ ID NO: 136076 - protein, 9 aa, West Nile virus
EDKTPVERW

SEQ ID NO: 136077 - protein, 9 aa, West Nile virus
DKTPVERWS

SEQ ID NO: 136078 - protein, 9 aa, West Nile virus
KTPVERWSD

SEQ ID NO: 136079 - protein, 9 aa, West Nile virus
TPVERWSDV

SEQ ID NO: 136080 - protein, 9 aa, West Nile virus
PVERWSDVP

SEQ ID NO: 136081 - protein, 9 aa, West Nile virus
VERWSDVPY

SEQ ID NO: 136082 - protein, 9 aa, West Nile virus
ERWSDVPYS

SEQ ID NO: 136083 - protein, 9 aa, West Nile virus
RWSDVPYSG

SEQ ID NO: 136084 - protein, 9 aa, West Nile virus
WSDIPYSGK

SEQ ID NO: 136085 - protein, 9 aa, West Nile virus
SDIPYSGKR

SEQ ID NO: 136086 - protein, 9 aa, West Nile virus
DIPYSGKRE

SEQ ID NO: 136087 - protein, 9 aa, West Nile virus
IPYSGKRED

SEQ ID NO: 136088 - protein, 9 aa, West Nile virus
CGSLIGTRT

SEQ ID NO: 136089 - protein, 9 aa, West Nile virus
GSLIGTRTR

SEQ ID NO: 136090 - protein, 9 aa, West Nile virus
SLIGTRTRA

SEQ ID NO: 136091 - protein, 9 aa, West Nile virus
LIGTRTRAT

SEQ ID NO: 136092 - protein, 9 aa, West Nile virus
IGTRTRATW

SEQ ID NO: 136093 - protein, 9 aa, West Nile virus
GTRTRATWA

SEQ ID NO: 136094 - protein, 9 aa, West Nile virus
TRTRATWAE

SEQ ID NO: 136095 - protein, 9 aa, West Nile virus
RTRATWAEN

SEQ ID NO: 136096 - protein, 9 aa, West Nile virus
TRATWAENI

SEQ ID NO: 136097 - protein, 9 aa, West Nile virus
RATWAENIH

SEQ ID NO: 136098 - protein, 9 aa, West Nile virus
ATWAENIHV

SEQ ID NO: 136099 - protein, 9 aa, West Nile virus
TWAENIHVA

SEQ ID NO: 136100 - protein, 9 aa, West Nile virus
WAENIHVAI

SEQ ID NO: 136101 - protein, 9 aa, West Nile virus
AENIHVAIN

SEQ ID NO: 136102 - protein, 9 aa, West Nile virus
ENIHVAINQ

SEQ ID NO: 136103 - protein, 9 aa, West Nile virus
NIHVAINQV

SEQ ID NO: 136104 - protein, 9 aa, West Nile virus
IHVAINQVR

SEQ ID NO: 136105 - protein, 9 aa, West Nile virus
HVAINQVRS

SEQ ID NO: 136106 - protein, 9 aa, West Nile virus
VIGEEKYVD

SEQ ID NO: 136107 - protein, 9 aa, West Nile virus
IGEEKYVDY

SEQ ID NO: 136108 - protein, 9 aa, West Nile virus
GEEKYVDYM

SEQ ID NO: 136109 - protein, 9 aa, West Nile virus
EEKYVDYMS

SEQ ID NO: 136110 - protein, 9 aa, West Nile virus
EKYVDYMGS

SEQ ID NO: 136111 - protein, 9 aa, West Nile virus
KYVDYMGSL

SEQ ID NO: 136112 - protein, 9 aa, West Nile virus
YVDYMSSLR

SEQ ID NO: 136113 - protein, 9 aa, West Nile virus
VDYMSSLRR

SEQ ID NO: 136114 - protein, 9 aa, West Nile virus
DYMSSLRRY

SEQ ID NO: 136115 - protein, 9 aa, West Nile virus
YMSSLRRYE

SEQ ID NO: 136116 - protein, 9 aa, West Nile virus
MSSLRRYED

SEQ ID NO: 136117 - protein, 9 aa, West Nile virus
GKNRAVNMQ

SEQ ID NO: 136118 - protein, 9 aa, West Nile virus
KNRAVNMQK

SEQ ID NO: 136119 - protein, 9 aa, West Nile virus
NRAVNMQKR

SEQ ID NO: 136120 - protein, 9 aa, West Nile virus
AVNMQKRGM

SEQ ID NO: 136121 - protein, 9 aa, West Nile virus
VNMQKRGTP

SEQ ID NO: 136122 - protein, 9 aa, West Nile virus
NMQKRGMPR

SEQ ID NO: 136123 - protein, 9 aa, West Nile virus
KRGTPRVLS

SEQ ID NO: 136124 - protein, 9 aa, West Nile virus
RGTPRVLSL

SEQ ID NO: 136125 - protein, 9 aa, West Nile virus
PRVLSLTGL

SEQ ID NO: 136126 - protein, 9 aa, West Nile virus
RVLSLTGLK

SEQ ID NO: 136127 - protein, 9 aa, West Nile virus
VLSLTGLKR

SEQ ID NO: 136128 - protein, 9 aa, West Nile virus
MSLIGLKRA

SEQ ID NO: 136129 - protein, 9 aa, West Nile virus
SLIGLKRAV

SEQ ID NO: 136130 - protein, 9 aa, West Nile virus
LIGLKRAVL

SEQ ID NO: 136131 - protein, 9 aa, West Nile virus
IGLKRAVLS

SEQ ID NO: 136132 - protein, 9 aa, West Nile virus
AVLSLIDGK

SEQ ID NO: 136133 - protein, 9 aa, West Nile virus
VLSLIDGKG

SEQ ID NO: 136134 - protein, 9 aa, West Nile virus
SLIDGRGPT

SEQ ID NO: 136135 - protein, 9 aa, West Nile virus
LIDGRGPTR

SEQ ID NO: 136136 - protein, 9 aa, West Nile virus
IDGRGPTRF

SEQ ID NO: 136137 - protein, 9 aa, West Nile virus
DGRGPTRFV

SEQ ID NO: 136138 - protein, 9 aa, West Nile virus
GRGPTRFVL

SEQ ID NO: 136139 - protein, 9 aa, West Nile virus
RGPTRFVLA

SEQ ID NO: 136140 - protein, 9 aa, West Nile virus
IRFVLALLT

SEQ ID NO: 136141 - protein, 9 aa, West Nile virus
VLALLAFFK

SEQ ID NO: 136142 - protein, 9 aa, West Nile virus
LALLAFFKF

SEQ ID NO: 136143 - protein, 9 aa, West Nile virus
ALLAFFKFT

SEQ ID NO: 136144 - protein, 9 aa, West Nile virus
LLAFFKFTA

SEQ ID NO: 136145 - protein, 9 aa, West Nile virus
LAFFKFTAI

SEQ ID NO: 136146 - protein, 9 aa, West Nile virus
AFFKFTAIA

SEQ ID NO: 136147 - protein, 9 aa, West Nile virus
IAPTRAVLN

SEQ ID NO: 136148 - protein, 9 aa, West Nile virus
APTRAVLER

SEQ ID NO: 136149 - protein, 9 aa, West Nile virus
PTRAVLERW

SEQ ID NO: 136150 - protein, 9 aa, West Nile virus
TRAVLERWR

SEQ ID NO: 136151 - protein, 9 aa, West Nile virus
RAVLDRWRS

SEQ ID NO: 136152 - protein, 9 aa, West Nile virus
AVLDRWRSV

SEQ ID NO: 136153 - protein, 9 aa, West Nile virus
VLDRWRSVN

SEQ ID NO: 136154 - protein, 9 aa, West Nile virus
LDRWRSVNK

SEQ ID NO: 136155 - protein, 9 aa, West Nile virus
DRWRSVNKQ

SEQ ID NO: 136156 - protein, 9 aa, West Nile virus
RWRSVNKQT

SEQ ID NO: 136157 - protein, 9 aa, West Nile virus
WRSVNKQTA

SEQ ID NO: 136158 - protein, 9 aa, West Nile virus
RSVNKQTAM

SEQ ID NO: 136159 - protein, 9 aa, West Nile virus
SVNKQTAMK

SEQ ID NO: 136160 - protein, 9 aa, West Nile virus
TSFKKELGI

SEQ ID NO: 136161 - protein, 9 aa, West Nile virus
SFKRELGTL

SEQ ID NO: 136162 - protein, 9 aa, West Nile virus
FKKELGILT

SEQ ID NO: 136163 - protein, 9 aa, West Nile virus
KRELGTLTS

SEQ ID NO: 136164 - protein, 9 aa, West Nile virus
KELGTLTNA

SEQ ID NO: 136165 - protein, 9 aa, West Nile virus
ELGILTNAI

SEQ ID NO: 136166 - protein, 9 aa, West Nile virus
LGALTSAIN

SEQ ID NO: 136167 - protein, 9 aa, West Nile virus
GILTNAISR

SEQ ID NO: 136168 - protein, 9 aa, West Nile virus
ALTSAINRR

SEQ ID NO: 136169 - protein, 9 aa, West Nile virus
LTNAMNRRS

SEQ ID NO: 136170 - protein, 9 aa, West Nile virus
NRRSLKQKK

SEQ ID NO: 136171 - protein, 9 aa, West Nile virus
RRSLKQKKR

SEQ ID NO: 136172 - protein, 9 aa, West Nile virus
RSLKQKKRG

SEQ ID NO: 136173 - protein, 9 aa, West Nile virus
SLKQKKRGG

SEQ ID NO: 136174 - protein, 9 aa, West Nile virus
KQKKRGGVV

SEQ ID NO: 136175 - protein, 9 aa, West Nile virus
QKKRGGVVG

SEQ ID NO: 136176 - protein, 9 aa, West Nile virus
KKRGGNTGI

SEQ ID NO: 136177 - protein, 9 aa, West Nile virus
GAVVLSNFQ

SEQ ID NO: 136178 - protein, 9 aa, West Nile virus
AVVLSNFQG

SEQ ID NO: 136179 - protein, 9 aa, West Nile virus
VVLSNFQGK

SEQ ID NO: 136180 - protein, 9 aa, West Nile virus
VLSNFQGKL

SEQ ID NO: 136181 - protein, 9 aa, West Nile virus
LSNFQGKVI

SEQ ID NO: 136182 - protein, 9 aa, West Nile virus
SNFQGKVIM

SEQ ID NO: 136183 - protein, 9 aa, West Nile virus
NFQGKVIMT

SEQ ID NO: 136184 - protein, 9 aa, West Nile virus
FQGKVIMTV

SEQ ID NO: 136185 - protein, 9 aa, West Nile virus
QGKVIMTVN

SEQ ID NO: 136186 - protein, 9 aa, West Nile virus
GKVIMTVNA

SEQ ID NO: 136187 - protein, 9 aa, West Nile virus
KVIMTVNAT

SEQ ID NO: 136188 - protein, 9 aa, West Nile virus
LMMTINATD

SEQ ID NO: 136189 - protein, 9 aa, West Nile virus
IMTVNATDV

SEQ ID NO: 136190 - protein, 9 aa, West Nile virus
MTINATDTT

SEQ ID NO: 136191 - protein, 9 aa, West Nile virus
IITIPPAAG

SEQ ID NO: 136192 - protein, 9 aa, West Nile virus
ITIPIASGK

SEQ ID NO: 136193 - protein, 9 aa, West Nile virus
TIPTASGKN

SEQ ID NO: 136194 - protein, 9 aa, West Nile virus
IPIASGKNL

SEQ ID NO: 136195 - protein, 9 aa, West Nile virus
PIASGKNLC

SEQ ID NO: 136196 - protein, 9 aa, West Nile virus
TASGKNLCT

SEQ ID NO: 136197 - protein, 9 aa, West Nile virus
AAGKNLCTV

SEQ ID NO: 136198 - protein, 9 aa, West Nile virus
SGKNLCTVR

SEQ ID NO: 136199 - protein, 9 aa, West Nile virus
GKNLCTVRA

SEQ ID NO: 136200 - protein, 9 aa, West Nile virus
KNLCTVRAM

SEQ ID NO: 136201 - protein, 9 aa, West Nile virus
NLCTVRAMD

SEQ ID NO: 136202 - protein, 9 aa, West Nile virus
LCTVRAMDV

SEQ ID NO: 136203 - protein, 9 aa, West Nile virus
CTVRAMDVG

SEQ ID NO: 136204 - protein, 9 aa, West Nile virus
IVRAMDVGH

SEQ ID NO: 136205 - protein, 9 aa, West Nile virus
IRAMDVGFM

SEQ ID NO: 136206 - protein, 9 aa, West Nile virus
RAMDVGFMC

SEQ ID NO: 136207 - protein, 9 aa, West Nile virus
AMDVGFMCD

SEQ ID NO: 136208 - protein, 9 aa, West Nile virus
MDVGFMCDD

SEQ ID NO: 136209 - protein, 9 aa, West Nile virus
DVGFMCDDT

SEQ ID NO: 136210 - protein, 9 aa, West Nile virus
VGFMCDDTI

SEQ ID NO: 136211 - protein, 9 aa, West Nile virus
GFMCDDTIA

SEQ ID NO: 136212 - protein, 9 aa, West Nile virus
FMCDDTIAY

SEQ ID NO: 136213 - protein, 9 aa, West Nile virus
MCDDTIAYE

SEQ ID NO: 136214 - protein, 9 aa, West Nile virus
CDDTIAYEC

SEQ ID NO: 136215 - protein, 9 aa, West Nile virus
DDTIAYECP

SEQ ID NO: 136216 - protein, 9 aa, West Nile virus
DTITYECSV

SEQ ID NO: 136217 - protein, 9 aa, West Nile virus
TITYECSVL

SEQ ID NO: 136218 - protein, 9 aa, West Nile virus
IAYECPALM

SEQ ID NO: 136219 - protein, 9 aa, West Nile virus
AYECPALME

SEQ ID NO: 136220 - protein, 9 aa, West Nile virus
YECPALMEG

SEQ ID NO: 136221 - protein, 9 aa, West Nile virus
ECPALMEGN

SEQ ID NO: 136222 - protein, 9 aa, West Nile virus
CPALMEGND

SEQ ID NO: 136223 - protein, 9 aa, West Nile virus
PALMEGNDP

SEQ ID NO: 136224 - protein, 9 aa, West Nile virus
ALMEGNDPE

SEQ ID NO: 136225 - protein, 9 aa, West Nile virus
LMEGNDPED

SEQ ID NO: 136226 - protein, 9 aa, West Nile virus
MEGNDPEDI

SEQ ID NO: 136227 - protein, 9 aa, West Nile virus
DIDCWCTKA

SEQ ID NO: 136228 - protein, 9 aa, West Nile virus
IDCWCTKLA

SEQ ID NO: 136229 - protein, 9 aa, West Nile virus
DCWCTKLAV

SEQ ID NO: 136230 - protein, 9 aa, West Nile virus
AVFVRYGRC

SEQ ID NO: 136231 - protein, 9 aa, West Nile virus
YGRCTKTRQ

SEQ ID NO: 136232 - protein, 9 aa, West Nile virus
GRCTRTRHS

SEQ ID NO: 136233 - protein, 9 aa, West Nile virus
RCTKTRQSR

SEQ ID NO: 136234 - protein, 9 aa, West Nile virus
CTRTRHSRR

SEQ ID NO: 136235 - protein, 9 aa, West Nile virus
TRTRHSRRS

SEQ ID NO: 136236 - protein, 9 aa, West Nile virus
KTRHSRRSK

SEQ ID NO: 136237 - protein, 9 aa, West Nile virus
TRHSRRSKR

SEQ ID NO: 136238 - protein, 9 aa, West Nile virus
RQSRRSRRS

SEQ ID NO: 136239 - protein, 9 aa, West Nile virus
HSRRSKRSL

SEQ ID NO: 136240 - protein, 9 aa, West Nile virus
SRRSLTVQA

SEQ ID NO: 136241 - protein, 9 aa, West Nile virus
KRSLTVQTH

SEQ ID NO: 136242 - protein, 9 aa, West Nile virus
SLTVQTHGK

SEQ ID NO: 136243 - protein, 9 aa, West Nile virus
LTVQTHGKS

SEQ ID NO: 136244 - protein, 9 aa, West Nile virus
TVQAHGEST

SEQ ID NO: 136245 - protein, 9 aa, West Nile virus
VQAHGESTL

SEQ ID NO: 136246 - protein, 9 aa, West Nile virus
QTHGESTLS

SEQ ID NO: 136247 - protein, 9 aa, West Nile virus
THGESTLSN

SEQ ID NO: 136248 - protein, 9 aa, West Nile virus
HGESTLSNK

SEQ ID NO: 136249 - protein, 9 aa, West Nile virus
GESTLSNKK

SEQ ID NO: 136250 - protein, 9 aa, West Nile virus
ESTLSNKKG

SEQ ID NO: 136251 - protein, 9 aa, West Nile virus
STLSNKKGA

SEQ ID NO: 136252 - protein, 9 aa, West Nile virus
TLSNKKGAW

SEQ ID NO: 136253 - protein, 9 aa, West Nile virus
LSNRKGAWL

SEQ ID NO: 136254 - protein, 9 aa, West Nile virus
SNRKGAWLD

SEQ ID NO: 136255 - protein, 9 aa, West Nile virus
NRKGAWLDS

SEQ ID NO: 136256 - protein, 9 aa, West Nile virus
RKGAWLDST

SEQ ID NO: 136257 - protein, 9 aa, West Nile virus
AWLDSTKAS

SEQ ID NO: 136258 - protein, 9 aa, West Nile virus
WLDSTKASR

SEQ ID NO: 136259 - protein, 9 aa, West Nile virus
LDSTKASRY

SEQ ID NO: 136260 - protein, 9 aa, West Nile virus
NTTQRVVFM

SEQ ID NO: 136261 - protein, 9 aa, West Nile virus
TQRVVFMIL

SEQ ID NO: 136262 - protein, 9 aa, West Nile virus
QRVVFMILL

SEQ ID NO: 136263 - protein, 9 aa, West Nile virus
RVVFAVLLL

SEQ ID NO: 136264 - protein, 9 aa, West Nile virus
VVFAVLLLL

SEQ ID NO: 136265 - protein, 9 aa, West Nile virus
VFAVLLLLV

SEQ ID NO: 136266 - protein, 9 aa, West Nile virus
FMILLLLVA

SEQ ID NO: 136267 - protein, 9 aa, West Nile virus
MILLLLVAP

SEQ ID NO: 136268 - protein, 9 aa, West Nile virus
LGMSSRDFL

SEQ ID NO: 136269 - protein, 9 aa, West Nile virus
GMSSRDFLE

SEQ ID NO: 136270 - protein, 9 aa, West Nile virus
MSSRDFLEG

SEQ ID NO: 136271 - protein, 9 aa, West Nile virus
SSRDFLEGV

SEQ ID NO: 136272 - protein, 9 aa, West Nile virus
SRDFLEGVS

SEQ ID NO: 136273 - protein, 9 aa, West Nile virus
EGVSGATWM

SEQ ID NO: 136274 - protein, 9 aa, West Nile virus
GVSGATWMD

SEQ ID NO: 136275 - protein, 9 aa, West Nile virus
VSGATWMDL

SEQ ID NO: 136276 - protein, 9 aa, West Nile virus
GDSCVTITA

SEQ ID NO: 136277 - protein, 9 aa, West Nile virus
DSCVTITAK

SEQ ID NO: 136278 - protein, 9 aa, West Nile virus
SCVTLMSKD

SEQ ID NO: 136279 - protein, 9 aa, West Nile virus
CVTITAKDR

SEQ ID NO: 136280 - protein, 9 aa, West Nile virus
VTIMSKNKP

SEQ ID NO: 136281 - protein, 9 aa, West Nile virus
TIMSKNKPT

SEQ ID NO: 136282 - protein, 9 aa, West Nile virus
ITAKDRPTI

SEQ ID NO: 136283 - protein, 9 aa, West Nile virus
TAKDRPTID

SEQ ID NO: 136284 - protein, 9 aa, West Nile virus
PTIDVKMTN

SEQ ID NO: 136285 - protein, 9 aa, West Nile virus
TIDVKMMKM

SEQ ID NO: 136286 - protein, 9 aa, West Nile virus
IDVKMMNVE

SEQ ID NO: 136287 - protein, 9 aa, West Nile virus
DVKMTNMEA

SEQ ID NO: 136288 - protein, 9 aa, West Nile virus
EVRSYCYAA

SEQ ID NO: 136289 - protein, 9 aa, West Nile virus
ATEISSSAA

SEQ ID NO: 136290 - protein, 9 aa, West Nile virus
TEISSSAAC

SEQ ID NO: 136291 - protein, 9 aa, West Nile virus
EISSSAACP

SEQ ID NO: 136292 - protein, 9 aa, West Nile virus
ISSSAACPT

SEQ ID NO: 136293 - protein, 9 aa, West Nile virus
SSSAACPTM

SEQ ID NO: 136294 - protein, 9 aa, West Nile virus
SSAACPTMG

SEQ ID NO: 136295 - protein, 9 aa, West Nile virus
SAACPTMGE

SEQ ID NO: 136296 - protein, 9 aa, West Nile virus
PAMGEAHND

SEQ ID NO: 136297 - protein, 9 aa, West Nile virus
AMGEAHNDK

SEQ ID NO: 136298 - protein, 9 aa, West Nile virus
GEAHNEKRT

SEQ ID NO: 136299 - protein, 9 aa, West Nile virus
EAHNEKRTD

SEQ ID NO: 136300 - protein, 9 aa, West Nile virus
AHNEKRTDS

SEQ ID NO: 136301 - protein, 9 aa, West Nile virus
YVCRQGVVD

SEQ ID NO: 136302 - protein, 9 aa, West Nile virus
DTCAKFTCS

SEQ ID NO: 136303 - protein, 9 aa, West Nile virus
TCAKFTCSN

SEQ ID NO: 136304 - protein, 9 aa, West Nile virus
CAKFTCSNK

SEQ ID NO: 136305 - protein, 9 aa, West Nile virus
AKFTCSNKA

SEQ ID NO: 136306 - protein, 9 aa, West Nile virus
KFACTTKAT

SEQ ID NO: 136307 - protein, 9 aa, West Nile virus
FACTTKATG

SEQ ID NO: 136308 - protein, 9 aa, West Nile virus
ACTTKATGW

SEQ ID NO: 136309 - protein, 9 aa, West Nile virus
CTTKATGWI

SEQ ID NO: 136310 - protein, 9 aa, West Nile virus
TTKATGWII

SEQ ID NO: 136311 - protein, 9 aa, West Nile virus
TKATGWIIQ

SEQ ID NO: 136312 - protein, 9 aa, West Nile virus
KATGWIIQK

SEQ ID NO: 136313 - protein, 9 aa, West Nile virus
ATGWIIQKE

SEQ ID NO: 136314 - protein, 9 aa, West Nile virus
TGWIIQKEN

SEQ ID NO: 136315 - protein, 9 aa, West Nile virus
GLTIQRENV

SEQ ID NO: 136316 - protein, 9 aa, West Nile virus
LTIQRENVK

SEQ ID NO: 136317 - protein, 9 aa, West Nile virus
TIQRENVKY

SEQ ID NO: 136318 - protein, 9 aa, West Nile virus
IQRENVKYE

SEQ ID NO: 136319 - protein, 9 aa, West Nile virus
QRENVKYEV

SEQ ID NO: 136320 - protein, 9 aa, West Nile virus
ENVKYEVAV

SEQ ID NO: 136321 - protein, 9 aa, West Nile virus
BIKYEVAIF

SEQ ID NO: 136322 - protein, 9 aa, West Nile virus
GPTTVESHR

SEQ ID NO: 136323 - protein, 9 aa, West Nile virus
GATQAGRLS

SEQ ID NO: 136324 - protein, 9 aa, West Nile virus
AAQAGRFSI

SEQ ID NO: 136325 - protein, 9 aa, West Nile virus
AQAGRFSIT

SEQ ID NO: 136326 - protein, 9 aa, West Nile virus
QAGRLSITP

SEQ ID NO: 136327 - protein, 9 aa, West Nile virus
AGRFSVSPA

SEQ ID NO: 136328 - protein, 9 aa, West Nile virus
GRFSVSPAA

SEQ ID NO: 136329 - protein, 9 aa, West Nile virus
RFSVSPAAP

SEQ ID NO: 136330 - protein, 9 aa, West Nile virus
FSVSPAAPT

SEQ ID NO: 136331 - protein, 9 aa, West Nile virus
SVSPAAPTH

SEQ ID NO: 136332 - protein, 9 aa, West Nile virus
VSPAAPTHT

SEQ ID NO: 136333 - protein, 9 aa, West Nile virus
NLGDYGEVT

SEQ ID NO: 136334 - protein, 9 aa, West Nile virus
LGEYGEVTM

SEQ ID NO: 136335 - protein, 9 aa, West Nile virus
GEYGEVTMD

SEQ ID NO: 136336 - protein, 9 aa, West Nile virus
DYGEVTIDC

SEQ ID NO: 136337 - protein, 9 aa, West Nile virus
YGEVTMDCE

SEQ ID NO: 136338 - protein, 9 aa, West Nile virus
GEVTMDCEP

SEQ ID NO: 136339 - protein, 9 aa, West Nile virus
EVTMDCEPR

SEQ ID NO: 136340 - protein, 9 aa, West Nile virus
VTIDCEPRS

SEQ ID NO: 136341 - protein, 9 aa, West Nile virus
TMDCEPRSG

SEQ ID NO: 136342 - protein, 9 aa, West Nile virus
IDCEPRSGI

SEQ ID NO: 136343 - protein, 9 aa, West Nile virus
EPRSGVDVD

SEQ ID NO: 136344 - protein, 9 aa, West Nile virus
PRSGVDVDA

SEQ ID NO: 136345 - protein, 9 aa, West Nile virus
RSGVDVDAF

SEQ ID NO: 136346 - protein, 9 aa, West Nile virus
SGVDVDAFY

SEQ ID NO: 136347 - protein, 9 aa, West Nile virus
GVDVDAFYV

SEQ ID NO: 136348 - protein, 9 aa, West Nile virus
VDVDAFYVM

SEQ ID NO: 136349 - protein, 9 aa, West Nile virus
DVDAFYVMT

SEQ ID NO: 136350 - protein, 9 aa, West Nile virus
VDAFYVMTV

SEQ ID NO: 136351 - protein, 9 aa, West Nile virus
DAFYVMTVG

SEQ ID NO: 136352 - protein, 9 aa, West Nile virus
LNLPWSSAE

SEQ ID NO: 136353 - protein, 9 aa, West Nile virus
NLPWSSAES

SEQ ID NO: 136354 - protein, 9 aa, West Nile virus
LPWSSAESN

SEQ ID NO: 136355 - protein, 9 aa, West Nile virus
WRNRETLVE

SEQ ID NO: 136356 - protein, 9 aa, West Nile virus
RNRETLVEF

SEQ ID NO: 136357 - protein, 9 aa, West Nile virus
NRETLVEFE

SEQ ID NO: 136358 - protein, 9 aa, West Nile virus
RETLVEFEE

SEQ ID NO: 136359 - protein, 9 aa, West Nile virus
ETLVEFEEP

SEQ ID NO: 136360 - protein, 9 aa, West Nile virus
TLVEFEEPH

SEQ ID NO: 136361 - protein, 9 aa, West Nile virus
LVEFEEPHA

SEQ ID NO: 136362 - protein, 9 aa, West Nile virus
VEFEEPHAT

SEQ ID NO: 136363 - protein, 9 aa, West Nile virus
AHATKQSVV

SEQ ID NO: 136364 - protein, 9 aa, West Nile virus
ALAGAIPLE

SEQ ID NO: 136365 - protein, 9 aa, West Nile virus
LAGAIPVSF

SEQ ID NO: 136366 - protein, 9 aa, West Nile virus
AGTIPVEFS

SEQ ID NO: 136367 - protein, 9 aa, West Nile virus
GAIPLEFSS

SEQ ID NO: 136368 - protein, 9 aa, West Nile virus
AIPVSFTSN

SEQ ID NO: 136369 - protein, 9 aa, West Nile virus
IPLEFSSNT

SEQ ID NO: 136370 - protein, 9 aa, West Nile virus
PVSFTSNTV

SEQ ID NO: 136371 - protein, 9 aa, West Nile virus
LEFSSNTVK

SEQ ID NO: 136372 - protein, 9 aa, West Nile virus
SFTSNTVKL

SEQ ID NO: 136373 - protein, 9 aa, West Nile virus
FTSNTVKLT

SEQ ID NO: 136374 - protein, 9 aa, West Nile virus
SSNTVTLTS

SEQ ID NO: 136375 - protein, 9 aa, West Nile virus
CRVKMEKLK

SEQ ID NO: 136376 - protein, 9 aa, West Nile virus
RVKMEKLKL

SEQ ID NO: 136377 - protein, 9 aa, West Nile virus
VKMEKLKLK

SEQ ID NO: 136378 - protein, 9 aa, West Nile virus
KMEKLKLKG

SEQ ID NO: 136379 - protein, 9 aa, West Nile virus
YGVCSKAFR

SEQ ID NO: 136380 - protein, 9 aa, West Nile virus
GVCSKAFRF

SEQ ID NO: 136381 - protein, 9 aa, West Nile virus
NTPADTGHG

SEQ ID NO: 136382 - protein, 9 aa, West Nile virus
VLELQYTGK

SEQ ID NO: 136383 - protein, 9 aa, West Nile virus
LELQYTGKD

SEQ ID NO: 136384 - protein, 9 aa, West Nile virus
TGKDGPCKV

SEQ ID NO: 136385 - protein, 9 aa, West Nile virus
GKDGPCKVP

SEQ ID NO: 136386 - protein, 9 aa, West Nile virus
KDGPCKVPI

SEQ ID NO: 136387 - protein, 9 aa, West Nile virus
DGPCKIPIT

SEQ ID NO: 136388 - protein, 9 aa, West Nile virus
GPCKIPISS

SEQ ID NO: 136389 - protein, 9 aa, West Nile virus
PCKIPITSV

SEQ ID NO: 136390 - protein, 9 aa, West Nile virus
CKIPISSVA

SEQ ID NO: 136391 - protein, 9 aa, West Nile virus
KIPITSVAS

SEQ ID NO: 136392 - protein, 9 aa, West Nile virus
IPISSVASL

SEQ ID NO: 136393 - protein, 9 aa, West Nile virus
VTVNPFVAA

SEQ ID NO: 136394 - protein, 9 aa, West Nile virus
TVNPFVSVS

SEQ ID NO: 136395 - protein, 9 aa, West Nile virus
VNPFVSVST

SEQ ID NO: 136396 - protein, 9 aa, West Nile virus
NPFVSVSTA

SEQ ID NO: 136397 - protein, 9 aa, West Nile virus
TANAKILVE

SEQ ID NO: 136398 - protein, 9 aa, West Nile virus
ANAKILVEL

SEQ ID NO: 136399 - protein, 9 aa, West Nile virus
NAKILVELE

SEQ ID NO: 136400 - protein, 9 aa, West Nile virus
AKILVELEP

SEQ ID NO: 136401 - protein, 9 aa, West Nile virus
VGRGEHQIN

SEQ ID NO: 136402 - protein, 9 aa, West Nile virus
GRGEHQINH

SEQ ID NO: 136403 - protein, 9 aa, West Nile virus
RGEHQINHH

SEQ ID NO: 136404 - protein, 9 aa, West Nile virus
GEHQINHHW

SEQ ID NO: 136405 - protein, 9 aa, West Nile virus
EQQISHHWH

SEQ ID NO: 136406 - protein, 9 aa, West Nile virus
QQINHHWYK

SEQ ID NO: 136407 - protein, 9 aa, West Nile virus
QINHHWYKS

SEQ ID NO: 136408 - protein, 9 aa, West Nile virus
INHHWYKSG

SEQ ID NO: 136409 - protein, 9 aa, West Nile virus
NHHWYKSGS

SEQ ID NO: 136410 - protein, 9 aa, West Nile virus
SSIGKAFTA

SEQ ID NO: 136411 - protein, 9 aa, West Nile virus
SIGKAFTAT

SEQ ID NO: 136412 - protein, 9 aa, West Nile virus
IGKAFTATL

SEQ ID NO: 136413 - protein, 9 aa, West Nile virus
GKAFATTLQ

SEQ ID NO: 136414 - protein, 9 aa, West Nile virus
KAFATTLQG

SEQ ID NO: 136415 - protein, 9 aa, West Nile virus
AFATTLQGA

SEQ ID NO: 136416 - protein, 9 aa, West Nile virus
FATTLQGAQ

SEQ ID NO: 136417 - protein, 9 aa, West Nile virus
ATTLQGAQR

SEQ ID NO: 136418 - protein, 9 aa, West Nile virus
TTLQGAQRL

SEQ ID NO: 136419 - protein, 9 aa, West Nile virus
TLQGAQRLV

SEQ ID NO: 136420 - protein, 9 aa, West Nile virus
LQGAQRLVS

SEQ ID NO: 136421 - protein, 9 aa, West Nile virus
QGAQRLVSL

SEQ ID NO: 136422 - protein, 9 aa, West Nile virus
DFGSVGGIF

SEQ ID NO: 136423 - protein, 9 aa, West Nile virus
FGSVGGVFN

SEQ ID NO: 136424 - protein, 9 aa, West Nile virus
GSVGGVFNS

SEQ ID NO: 136425 - protein, 9 aa, West Nile virus
SVGGVFNSI

SEQ ID NO: 136426 - protein, 9 aa, West Nile virus
VGGVFNSIG

SEQ ID NO: 136427 - protein, 9 aa, West Nile virus
GGVLTSVGQ

SEQ ID NO: 136428 - protein, 9 aa, West Nile virus
GIFTSFGKA

SEQ ID NO: 136429 - protein, 9 aa, West Nile virus
VFNSIGKAV

SEQ ID NO: 136430 - protein, 9 aa, West Nile virus
FNSIGKAVH

SEQ ID NO: 136431 - protein, 9 aa, West Nile virus
NSIGKAVHQ

SEQ ID NO: 136432 - protein, 9 aa, West Nile virus
SIGKAVHQL

SEQ ID NO: 136433 - protein, 9 aa, West Nile virus
IGKAVHQLF

SEQ ID NO: 136434 - protein, 9 aa, West Nile virus
GKAVHQLFG

SEQ ID NO: 136435 - protein, 9 aa, West Nile virus
KAVHQLFGG

SEQ ID NO: 136436 - protein, 9 aa, West Nile virus
AVHQLFGGA

SEQ ID NO: 136437 - protein, 9 aa, West Nile virus
VHQLFGGAF

SEQ ID NO: 136438 - protein, 9 aa, West Nile virus
QVFGGAFRL

SEQ ID NO: 136439 - protein, 9 aa, West Nile virus
VFGGAFRLL

SEQ ID NO: 136440 - protein, 9 aa, West Nile virus
ALLVWMGIN

SEQ ID NO: 136441 - protein, 9 aa, West Nile virus
LLLWMGVNA

SEQ ID NO: 136442 - protein, 9 aa, West Nile virus
LLWMGISAR

SEQ ID NO: 136443 - protein, 9 aa, West Nile virus
LWMGVNARD

SEQ ID NO: 136444 - protein, 9 aa, West Nile virus
WMGINARDK

SEQ ID NO: 136445 - protein, 9 aa, West Nile virus
MGISARDRS

SEQ ID NO: 136446 - protein, 9 aa, West Nile virus
GVNARDRSI

SEQ ID NO: 136447 - protein, 9 aa, West Nile virus
ISARDRSIA

SEQ ID NO: 136448 - protein, 9 aa, West Nile virus
NSRDRSIAM

SEQ ID NO: 136449 - protein, 9 aa, West Nile virus
SRDRSIAMT

SEQ ID NO: 136450 - protein, 9 aa, West Nile virus
RDRSIALMF

SEQ ID NO: 136451 - protein, 9 aa, West Nile virus
DKSIALTFL

SEQ ID NO: 136452 - protein, 9 aa, West Nile virus
RSIALMFLA

SEQ ID NO: 136453 - protein, 9 aa, West Nile virus
SIALTFLAI

SEQ ID NO: 136454 - protein, 9 aa, West Nile virus
IALTFLAIG

SEQ ID NO: 136455 - protein, 9 aa, West Nile virus
ALTFLAIGG

SEQ ID NO: 136456 - protein, 9 aa, West Nile virus
LTFLAIGGV

SEQ ID NO: 136457 - protein, 9 aa, West Nile virus
TFLAVGGIL

SEQ ID NO: 136458 - protein, 9 aa, West Nile virus
FLAIGGVLL

SEQ ID NO: 136459 - protein, 9 aa, West Nile virus
LAVGGILLF

SEQ ID NO: 136460 - protein, 9 aa, West Nile virus
AIGGVLLFL

SEQ ID NO: 136461 - protein, 9 aa, West Nile virus
VGGILLFLS

SEQ ID NO: 136462 - protein, 9 aa, West Nile virus
GGVLLFLSI

SEQ ID NO: 136463 - protein, 9 aa, West Nile virus
GVLLFLSVS

SEQ ID NO: 136464 - protein, 9 aa, West Nile virus
VLLFLSVSV

SEQ ID NO: 136465 - protein, 9 aa, West Nile virus
LLFLSVSVH

SEQ ID NO: 136466 - protein, 9 aa, West Nile virus
LFLSANVHA

SEQ ID NO: 136467 - protein, 9 aa, West Nile virus
FLSANVHAD

SEQ ID NO: 136468 - protein, 9 aa, West Nile virus
LSVSVHADT

SEQ ID NO: 136469 - protein, 9 aa, West Nile virus
SVSVHADTG

SEQ ID NO: 136470 - protein, 9 aa, West Nile virus
VSVHADTGC

SEQ ID NO: 136471 - protein, 9 aa, West Nile virus
ADTGCAIDV

SEQ ID NO: 136472 - protein, 9 aa, West Nile virus
DTGCAIDLK

SEQ ID NO: 136473 - protein, 9 aa, West Nile virus
TGCAIDLKR

SEQ ID NO: 136474 - protein, 9 aa, West Nile virus
GCAIDLKRQ

SEQ ID NO: 136475 - protein, 9 aa, West Nile virus
CAIDLKRQE

SEQ ID NO: 136476 - protein, 9 aa, West Nile virus
AIDLKRQEL

SEQ ID NO: 136477 - protein, 9 aa, West Nile virus
IDLKRQELR

SEQ ID NO: 136478 - protein, 9 aa, West Nile virus
DLKRQELRC

SEQ ID NO: 136479 - protein, 9 aa, West Nile virus
LKRQELRCG

SEQ ID NO: 136480 - protein, 9 aa, West Nile virus
KRQELRCGS

SEQ ID NO: 136481 - protein, 9 aa, West Nile virus
VFIYNDVEA

SEQ ID NO: 136482 - protein, 9 aa, West Nile virus
FIHNDVEVW

SEQ ID NO: 136483 - protein, 9 aa, West Nile virus
NDVEAWIDR

SEQ ID NO: 136484 - protein, 9 aa, West Nile virus
DVEAWIDRY

SEQ ID NO: 136485 - protein, 9 aa, West Nile virus
VEAWIDRYK

SEQ ID NO: 136486 - protein, 9 aa, West Nile virus
DRYRYHPET

SEQ ID NO: 136487 - protein, 9 aa, West Nile virus
RYRYHPETP

SEQ ID NO: 136488 - protein, 9 aa, West Nile virus
YRYHPETPQ

SEQ ID NO: 136489 - protein, 9 aa, West Nile virus
RYHPETPQG

SEQ ID NO: 136490 - protein, 9 aa, West Nile virus
YHPETPQGL

SEQ ID NO: 136491 - protein, 9 aa, West Nile virus
ETPQGLARV

SEQ ID NO: 136492 - protein, 9 aa, West Nile virus
TPQGLARVI

SEQ ID NO: 136493 - protein, 9 aa, West Nile virus
PQGLARIIQ

SEQ ID NO: 136494 - protein, 9 aa, West Nile virus
QGLAKVIQK

SEQ ID NO: 136495 - protein, 9 aa, West Nile virus
GLARVIQKA

SEQ ID NO: 136496 - protein, 9 aa, West Nile virus
LARIIQKAH

SEQ ID NO: 136497 - protein, 9 aa, West Nile virus
EGVCGLRSA

SEQ ID NO: 136498 - protein, 9 aa, West Nile virus
GVCGLRSAS

SEQ ID NO: 136499 - protein, 9 aa, West Nile virus
ICGLRSVSR

SEQ ID NO: 136500 - protein, 9 aa, West Nile virus
CGLRSASRL

SEQ ID NO: 136501 - protein, 9 aa, West Nile virus
GLRSASRLE

SEQ ID NO: 136502 - protein, 9 aa, West Nile virus
IRSVSRLEH

SEQ ID NO: 136503 - protein, 9 aa, West Nile virus
RLEHQMWDS

SEQ ID NO: 136504 - protein, 9 aa, West Nile virus
LEHQMWEAI

SEQ ID NO: 136505 - protein, 9 aa, West Nile virus
EHQMWEAIK

SEQ ID NO: 136506 - protein, 9 aa, West Nile virus
HQMWEAIKD

SEQ ID NO: 136507 - protein, 9 aa, West Nile virus
QMWEAIKDE

SEQ ID NO: 136508 - protein, 9 aa, West Nile virus
MWEAIKDEL

SEQ ID NO: 136509 - protein, 9 aa, West Nile virus
WEAIKDELN

SEQ ID NO: 136510 - protein, 9 aa, West Nile virus
EAIKDELNT

SEQ ID NO: 136511 - protein, 9 aa, West Nile virus
AIKDELNTL

SEQ ID NO: 136512 - protein, 9 aa, West Nile virus
VKDELNTLF

SEQ ID NO: 136513 - protein, 9 aa, West Nile virus
NTLFRENGI

SEQ ID NO: 136514 - protein, 9 aa, West Nile virus
TLFRENGID

SEQ ID NO: 136515 - protein, 9 aa, West Nile virus
LLKENGVDF

SEQ ID NO: 136516 - protein, 9 aa, West Nile virus
LKENGVDFS

SEQ ID NO: 136517 - protein, 9 aa, West Nile virus
KENGIDLSI

SEQ ID NO: 136518 - protein, 9 aa, West Nile virus
ENGIDLSIV

SEQ ID NO: 136519 - protein, 9 aa, West Nile virus
NGIDLSIVV

SEQ ID NO: 136520 - protein, 9 aa, West Nile virus
GIDLSIVVE

SEQ ID NO: 136521 - protein, 9 aa, West Nile virus
IDLSIVVEK

SEQ ID NO: 136522 - protein, 9 aa, West Nile virus
DLTVVVEKQ

SEQ ID NO: 136523 - protein, 9 aa, West Nile virus
ATTENLEIG

SEQ ID NO: 136524 - protein, 9 aa, West Nile virus
TTENLEIGW

SEQ ID NO: 136525 - protein, 9 aa, West Nile virus
TENLEIGWK

SEQ ID NO: 136526 - protein, 9 aa, West Nile virus
ENLEIGWKA

SEQ ID NO: 136527 - protein, 9 aa, West Nile virus
NLEIGWKAW

SEQ ID NO: 136528 - protein, 9 aa, West Nile virus
KSILFAPEI

SEQ ID NO: 136529 - protein, 9 aa, West Nile virus
SIIFAPEIA

SEQ ID NO: 136530 - protein, 9 aa, West Nile virus
IIFAPEIAN

SEQ ID NO: 136531 - protein, 9 aa, West Nile virus
FAPEIANNT

SEQ ID NO: 136532 - protein, 9 aa, West Nile virus
APEIANNTF

SEQ ID NO: 136533 - protein, 9 aa, West Nile virus
PEIANNTFV

SEQ ID NO: 136534 - protein, 9 aa, West Nile virus
ELANHTFVI

SEQ ID NO: 136535 - protein, 9 aa, West Nile virus
LANHTFVID

SEQ ID NO: 136536 - protein, 9 aa, West Nile virus
ANHTFVIDG

SEQ ID NO: 136537 - protein, 9 aa, West Nile virus
NHTFVIDGP

SEQ ID NO: 136538 - protein, 9 aa, West Nile virus
HTFVIDGPE

SEQ ID NO: 136539 - protein, 9 aa, West Nile virus
TFVVDGSET

SEQ ID NO: 136540 - protein, 9 aa, West Nile virus
FVIDGPETK

SEQ ID NO: 136541 - protein, 9 aa, West Nile virus
VIDGPETKE

SEQ ID NO: 136542 - protein, 9 aa, West Nile virus
IDGPETKEC

SEQ ID NO: 136543 - protein, 9 aa, West Nile virus
DGSETRECP

SEQ ID NO: 136544 - protein, 9 aa, West Nile virus
GPETKECPS

SEQ ID NO: 136545 - protein, 9 aa, West Nile virus
DRAWNSLEV

SEQ ID NO: 136546 - protein, 9 aa, West Nile virus
GLMTTRMFL

SEQ ID NO: 136547 - protein, 9 aa, West Nile virus
LTSTRMFMK

SEQ ID NO: 136548 - protein, 9 aa, West Nile virus
IREVNTTEC

SEQ ID NO: 136549 - protein, 9 aa, West Nile virus
REGNTTECD

SEQ ID NO: 136550 - protein, 9 aa, West Nile virus
SNTTECDTK

SEQ ID NO: 136551 - protein, 9 aa, West Nile virus
NTTECDSKT

SEQ ID NO: 136552 - protein, 9 aa, West Nile virus
TTECDSKTI

SEQ ID NO: 136553 - protein, 9 aa, West Nile virus
TECDSKTIG

SEQ ID NO: 136554 - protein, 9 aa, West Nile virus
ECDSKTIGT

SEQ ID NO: 136555 - protein, 9 aa, West Nile virus
CDSKTIGTA

SEQ ID NO: 136556 - protein, 9 aa, West Nile virus
DSKTIGTAV

SEQ ID NO: 136557 - protein, 9 aa, West Nile virus
SKTIGTAVK

SEQ ID NO: 136558 - protein, 9 aa, West Nile virus
TAVKNNLAV

SEQ ID NO: 136559 - protein, 9 aa, West Nile virus
AVKNNLAVH

SEQ ID NO: 136560 - protein, 9 aa, West Nile virus
IKNNLAIHS

SEQ ID NO: 136561 - protein, 9 aa, West Nile virus
LSYWIESRF

SEQ ID NO: 136562 - protein, 9 aa, West Nile virus
SYWIESRFN

SEQ ID NO: 136563 - protein, 9 aa, West Nile virus
LNETWKLER

SEQ ID NO: 136564 - protein, 9 aa, West Nile virus
NHTWKLERA

SEQ ID NO: 136565 - protein, 9 aa, West Nile virus
HTWKLERAV

SEQ ID NO: 136566 - protein, 9 aa, West Nile virus
THTLWGEGI

SEQ ID NO: 136567 - protein, 9 aa, West Nile virus
HTLWGEGIL

SEQ ID NO: 136568 - protein, 9 aa, West Nile virus
TLWGEGILE

SEQ ID NO: 136569 - protein, 9 aa, West Nile virus
LWGEGILES

SEQ ID NO: 136570 - protein, 9 aa, West Nile virus
GVQESDLII

SEQ ID NO: 136571 - protein, 9 aa, West Nile virus
VQESDLIIP

SEQ ID NO: 136572 - protein, 9 aa, West Nile virus
ESELIIPVT

SEQ ID NO: 136573 - protein, 9 aa, West Nile virus
SELIIPITL

SEQ ID NO: 136574 - protein, 9 aa, West Nile virus
DLIIPATLA

SEQ ID NO: 136575 - protein, 9 aa, West Nile virus
IIPITLAGL

SEQ ID NO: 136576 - protein, 9 aa, West Nile virus
IPITLAGLR

SEQ ID NO: 136577 - protein, 9 aa, West Nile virus
PITLAGLRS

SEQ ID NO: 136578 - protein, 9 aa, West Nile virus
ITLAGLRSN

SEQ ID NO: 136579 - protein, 9 aa, West Nile virus
TLAGPRSNY

SEQ ID NO: 136580 - protein, 9 aa, West Nile virus
LAGPRSNYN

SEQ ID NO: 136581 - protein, 9 aa, West Nile virus
AGPRSNYNR

SEQ ID NO: 136582 - protein, 9 aa, West Nile virus
GPRSNYNRR

SEQ ID NO: 136583 - protein, 9 aa, West Nile virus
PRSNYNRRP

SEQ ID NO: 136584 - protein, 9 aa, West Nile virus
HNRRPGYKM

SEQ ID NO: 136585 - protein, 9 aa, West Nile virus
KRPGYKTQN

SEQ ID NO: 136586 - protein, 9 aa, West Nile virus
PWDEGRIEI

SEQ ID NO: 136587 - protein, 9 aa, West Nile virus
WDEGRIEID

SEQ ID NO: 136588 - protein, 9 aa, West Nile virus
DEGRIEIDF

SEQ ID NO: 136589 - protein, 9 aa, West Nile virus
EGRIEIDFD

SEQ ID NO: 136590 - protein, 9 aa, West Nile virus
GRIEIDFDY

SEQ ID NO: 136591 - protein, 9 aa, West Nile virus
RIEIDFDYC

SEQ ID NO: 136592 - protein, 9 aa, West Nile virus
IEIDFDYCP

SEQ ID NO: 136593 - protein, 9 aa, West Nile virus
CPGTTVTVS

SEQ ID NO: 136594 - protein, 9 aa, West Nile virus
CGHRGPAIR

SEQ ID NO: 136595 - protein, 9 aa, West Nile virus
GHRGPAIRT

SEQ ID NO: 136596 - protein, 9 aa, West Nile virus
HRGPAIRTT

SEQ ID NO: 136597 - protein, 9 aa, West Nile virus
RGPAIRTTT

SEQ ID NO: 136598 - protein, 9 aa, West Nile virus
GPAIRTTTE

SEQ ID NO: 136599 - protein, 9 aa, West Nile virus
PAIRTTTES

SEQ ID NO: 136600 - protein, 9 aa, West Nile virus
AIRTTTESG

SEQ ID NO: 136601 - protein, 9 aa, West Nile virus
IRTTTESGK

SEQ ID NO: 136602 - protein, 9 aa, West Nile virus
CTLPPLRYR

SEQ ID NO: 136603 - protein, 9 aa, West Nile virus
TLPPLRYRT

SEQ ID NO: 136604 - protein, 9 aa, West Nile virus
LPPLRYRTE

SEQ ID NO: 136605 - protein, 9 aa, West Nile virus
TESGCWYGM

SEQ ID NO: 136606 - protein, 9 aa, West Nile virus
ESGCWYGME

SEQ ID NO: 136607 - protein, 9 aa, West Nile virus
WYGMEIRPL

SEQ ID NO: 136608 - protein, 9 aa, West Nile virus
YGMEIRPLR

SEQ ID NO: 136609 - protein, 9 aa, West Nile virus
GMEIRPLRH

SEQ ID NO: 136610 - protein, 9 aa, West Nile virus
MEIRPLRHD

SEQ ID NO: 136611 - protein, 9 aa, West Nile virus
EIRPLRHDE

SEQ ID NO: 136612 - protein, 9 aa, West Nile virus
IRPLRHDEK

SEQ ID NO: 136613 - protein, 9 aa, West Nile virus
RPLRHDEKT

SEQ ID NO: 136614 - protein, 9 aa, West Nile virus
PLRHDEKTL

SEQ ID NO: 136615 - protein, 9 aa, West Nile virus
LRHDEKTLV

SEQ ID NO: 136616 - protein, 9 aa, West Nile virus
RHDGKTLVQ

SEQ ID NO: 136617 - protein, 9 aa, West Nile virus
DEKTLVQSK

SEQ ID NO: 136618 - protein, 9 aa, West Nile virus
EKTLVQSKV

SEQ ID NO: 136619 - protein, 9 aa, West Nile virus
KTLVQSKVT

SEQ ID NO: 136620 - protein, 9 aa, West Nile virus
TLVQSKVTA

SEQ ID NO: 136621 - protein, 9 aa, West Nile virus
LVQSKVTAY

SEQ ID NO: 136622 - protein, 9 aa, West Nile virus
VQSKVTAYN

SEQ ID NO: 136623 - protein, 9 aa, West Nile virus
QSKVTAYNA

SEQ ID NO: 136624 - protein, 9 aa, West Nile virus
SKVTAYNAD

SEQ ID NO: 136625 - protein, 9 aa, West Nile virus
KVTAYNADM

SEQ ID NO: 136626 - protein, 9 aa, West Nile virus
VNAHNADMI

SEQ ID NO: 136627 - protein, 9 aa, West Nile virus
SAYKSDMID

SEQ ID NO: 136628 - protein, 9 aa, West Nile virus
AYKSDMIDP

SEQ ID NO: 136629 - protein, 9 aa, West Nile virus
HNADMIDPF

SEQ ID NO: 136630 - protein, 9 aa, West Nile virus
FQLGLLVVV

SEQ ID NO: 136631 - protein, 9 aa, West Nile virus
QLGLLVVVL

SEQ ID NO: 136632 - protein, 9 aa, West Nile virus
LGLLVVFLV

SEQ ID NO: 136633 - protein, 9 aa, West Nile virus
GLLVVVLAT

SEQ ID NO: 136634 - protein, 9 aa, West Nile virus
LLVVFLATK

SEQ ID NO: 136635 - protein, 9 aa, West Nile virus
LVVVLATQE

SEQ ID NO: 136636 - protein, 9 aa, West Nile virus
VVFLVTQEV

SEQ ID NO: 136637 - protein, 9 aa, West Nile virus
VFLATKEVL

SEQ ID NO: 136638 - protein, 9 aa, West Nile virus
FLVTQEVLR

SEQ ID NO: 136639 - protein, 9 aa, West Nile virus
LATQEVLRR

SEQ ID NO: 136640 - protein, 9 aa, West Nile virus
ATKEVLRKR

SEQ ID NO: 136641 - protein, 9 aa, West Nile virus
KRWTAKISV

SEQ ID NO: 136642 - protein, 9 aa, West Nile virus
RWTAKISVP

SEQ ID NO: 136643 - protein, 9 aa, West Nile virus
WTAKISVPA

SEQ ID NO: 136644 - protein, 9 aa, West Nile virus
TAKISVPAI

SEQ ID NO: 136645 - protein, 9 aa, West Nile virus
PAIIIALLT

SEQ ID NO: 136646 - protein, 9 aa, West Nile virus
AIIIALLTL

SEQ ID NO: 136647 - protein, 9 aa, West Nile virus
IIIALLTLV

SEQ ID NO: 136648 - protein, 9 aa, West Nile virus
IIALLTLVF

SEQ ID NO: 136649 - protein, 9 aa, West Nile virus
IALLTLVFG

SEQ ID NO: 136650 - protein, 9 aa, West Nile virus
ALLVLVLGG

SEQ ID NO: 136651 - protein, 9 aa, West Nile virus
LLVLVLGGI

SEQ ID NO: 136652 - protein, 9 aa, West Nile virus
AVLVLGGIT

SEQ ID NO: 136653 - protein, 9 aa, West Nile virus
VLVLGGITY

SEQ ID NO: 136654 - protein, 9 aa, West Nile virus
LVLGGITYT

SEQ ID NO: 136655 - protein, 9 aa, West Nile virus
VLGGITYTD

SEQ ID NO: 136656 - protein, 9 aa, West Nile virus
LGGITYTDV

SEQ ID NO: 136657 - protein, 9 aa, West Nile virus
GGVTYTDVL

SEQ ID NO: 136658 - protein, 9 aa, West Nile virus
GITYIDVLR

SEQ ID NO: 136659 - protein, 9 aa, West Nile virus
ITYIDVLRY

SEQ ID NO: 136660 - protein, 9 aa, West Nile virus
TYIDVLRYV

SEQ ID NO: 136661 - protein, 9 aa, West Nile virus
YTDVLRYVN

SEQ ID NO: 136662 - protein, 9 aa, West Nile virus
IDVLRYVIL

SEQ ID NO: 136663 - protein, 9 aa, West Nile virus
DVLRYVNLV

SEQ ID NO: 136664 - protein, 9 aa, West Nile virus
VLRYVNLVG

SEQ ID NO: 136665 - protein, 9 aa, West Nile virus
LRYVILAGA

SEQ ID NO: 136666 - protein, 9 aa, West Nile virus
RYVILAGAA

SEQ ID NO: 136667 - protein, 9 aa, West Nile virus
YVNLVGAAF

SEQ ID NO: 136668 - protein, 9 aa, West Nile virus
VILAGAAFA

SEQ ID NO: 136669 - protein, 9 aa, West Nile virus
ILVGAAFME

SEQ ID NO: 136670 - protein, 9 aa, West Nile virus
LAGAAFAES

SEQ ID NO: 136671 - protein, 9 aa, West Nile virus
VGAAFMEAN

SEQ ID NO: 136672 - protein, 9 aa, West Nile virus
LALMATFRI

SEQ ID NO: 136673 - protein, 9 aa, West Nile virus
ALMATFRIQ

SEQ ID NO: 136674 - protein, 9 aa, West Nile virus
LMATFRIQP

SEQ ID NO: 136675 - protein, 9 aa, West Nile virus
MATFKVQPV

SEQ ID NO: 136676 - protein, 9 aa, West Nile virus
ATFKVQPVF

SEQ ID NO: 136677 - protein, 9 aa, West Nile virus
IQPAFMVAS

SEQ ID NO: 136678 - protein, 9 aa, West Nile virus
QPAFMVASF

SEQ ID NO: 136679 - protein, 9 aa, West Nile virus
PAFMVASFL

SEQ ID NO: 136680 - protein, 9 aa, West Nile virus
AFMVASFLK

SEQ ID NO: 136681 - protein, 9 aa, West Nile virus
FMVASFLKT

SEQ ID NO: 136682 - protein, 9 aa, West Nile virus
VASFLKAKW

SEQ ID NO: 136683 - protein, 9 aa, West Nile virus
ASFLKAKWT

SEQ ID NO: 136684 - protein, 9 aa, West Nile virus
SFLKAKWTN

SEQ ID NO: 136685 - protein, 9 aa, West Nile virus
KWTNQESIL

SEQ ID NO: 136686 - protein, 9 aa, West Nile virus
WTNHENILL

SEQ ID NO: 136687 - protein, 9 aa, West Nile virus
TNHENILLM

SEQ ID NO: 136688 - protein, 9 aa, West Nile virus
NHENILLML

SEQ ID NO: 136689 - protein, 9 aa, West Nile virus
HENILLMLA

SEQ ID NO: 136690 - protein, 9 aa, West Nile virus
NILLMLAAA

SEQ ID NO: 136691 - protein, 9 aa, West Nile virus
AVFFQMAYY

SEQ ID NO: 136692 - protein, 9 aa, West Nile virus
VFFQMAYYD

SEQ ID NO: 136693 - protein, 9 aa, West Nile virus
FFQMAYIDS

SEQ ID NO: 136694 - protein, 9 aa, West Nile virus
FQMAYYDAR

SEQ ID NO: 136695 - protein, 9 aa, West Nile virus
WEMPDVLNS

SEQ ID NO: 136696 - protein, 9 aa, West Nile virus
NIPDVLNSL

SEQ ID NO: 136697 - protein, 9 aa, West Nile virus
IPDVLNSLS

SEQ ID NO: 136698 - protein, 9 aa, West Nile virus
PDVLNSLAA

SEQ ID NO: 136699 - protein, 9 aa, West Nile virus
DVLNSLAAA

SEQ ID NO: 136700 - protein, 9 aa, West Nile virus
VLNSLAAAW

SEQ ID NO: 136701 - protein, 9 aa, West Nile virus
LNSLAAAWM

SEQ ID NO: 136702 - protein, 9 aa, West Nile virus
NSLAVAWMV

SEQ ID NO: 136703 - protein, 9 aa, West Nile virus
SLAIAWMIL

SEQ ID NO: 136704 - protein, 9 aa, West Nile virus
LAAAWMILR

SEQ ID NO: 136705 - protein, 9 aa, West Nile virus
AAAWMILRA

SEQ ID NO: 136706 - protein, 9 aa, West Nile virus
AAWMILRAI

SEQ ID NO: 136707 - protein, 9 aa, West Nile virus
AWMILRAIG

SEQ ID NO: 136708 - protein, 9 aa, West Nile virus
WMILRAIGF

SEQ ID NO: 136709 - protein, 9 aa, West Nile virus
MILRAIGFT

SEQ ID NO: 136710 - protein, 9 aa, West Nile virus
FTTTSNVAT

SEQ ID NO: 136711 - protein, 9 aa, West Nile virus
TTTSNVATP

SEQ ID NO: 136712 - protein, 9 aa, West Nile virus
TTSNVATPL

SEQ ID NO: 136713 - protein, 9 aa, West Nile virus
TSNVVVPLM

SEQ ID NO: 136714 - protein, 9 aa, West Nile virus
SNVVVPLMA

SEQ ID NO: 136715 - protein, 9 aa, West Nile virus
NVVVPLMAL

SEQ ID NO: 136716 - protein, 9 aa, West Nile virus
VVVPLMALL

SEQ ID NO: 136717 - protein, 9 aa, West Nile virus
VVPLMALLT

SEQ ID NO: 136718 - protein, 9 aa, West Nile virus
VPLMALLTP

SEQ ID NO: 136719 - protein, 9 aa, West Nile virus
PLLALLTPR

SEQ ID NO: 136720 - protein, 9 aa, West Nile virus
ALAFLTPGL

SEQ ID NO: 136721 - protein, 9 aa, West Nile virus
MALLTPGLR

SEQ ID NO: 136722 - protein, 9 aa, West Nile virus
ALLTPRLRC

SEQ ID NO: 136723 - protein, 9 aa, West Nile virus
FLTPGLKCL

SEQ ID NO: 136724 - protein, 9 aa, West Nile virus
LTPGLKCLH

SEQ ID NO: 136725 - protein, 9 aa, West Nile virus
TPGLKCLHL

SEQ ID NO: 136726 - protein, 9 aa, West Nile virus
PGLKCLHLD

SEQ ID NO: 136727 - protein, 9 aa, West Nile virus
GLKCLHLDI

SEQ ID NO: 136728 - protein, 9 aa, West Nile virus
LKCLHLDIY

SEQ ID NO: 136729 - protein, 9 aa, West Nile virus
KCLHLDIYR

SEQ ID NO: 136730 - protein, 9 aa, West Nile virus
CLNLDVSRI

SEQ ID NO: 136731 - protein, 9 aa, West Nile virus
LNLDVYRIV

SEQ ID NO: 136732 - protein, 9 aa, West Nile virus
NLDVYKILL

SEQ ID NO: 136733 - protein, 9 aa, West Nile virus
LDVSRILLL

SEQ ID NO: 136734 - protein, 9 aa, West Nile virus
DVYKILLLM

SEQ ID NO: 136735 - protein, 9 aa, West Nile virus
VYRIVLLMI

SEQ ID NO: 136736 - protein, 9 aa, West Nile virus
YRILLLMIG

SEQ ID NO: 136737 - protein, 9 aa, West Nile virus
KILLLMVGI

SEQ ID NO: 136738 - protein, 9 aa, West Nile virus
IVLLMIGIG

SEQ ID NO: 136739 - protein, 9 aa, West Nile virus
VLLMIGIGS

SEQ ID NO: 136740 - protein, 9 aa, West Nile virus
LLMIGIGSL

SEQ ID NO: 136741 - protein, 9 aa, West Nile virus
LMVGVGSLV

SEQ ID NO: 136742 - protein, 9 aa, West Nile virus
MVGVGSLVK

SEQ ID NO: 136743 - protein, 9 aa, West Nile virus
VGVGSLVKE

SEQ ID NO: 136744 - protein, 9 aa, West Nile virus
GVGSLVKER

SEQ ID NO: 136745 - protein, 9 aa, West Nile virus
VGSLVKERR

SEQ ID NO: 136746 - protein, 9 aa, West Nile virus
GSLVKERRS

SEQ ID NO: 136747 - protein, 9 aa, West Nile virus
ERRSAVAKK

SEQ ID NO: 136748 - protein, 9 aa, West Nile virus
RRSAVAKKK

SEQ ID NO: 136749 - protein, 9 aa, West Nile virus
RSAVAKKKG

SEQ ID NO: 136750 - protein, 9 aa, West Nile virus
SAVAKKKGA

SEQ ID NO: 136751 - protein, 9 aa, West Nile virus
AVAKKKGAS

SEQ ID NO: 136752 - protein, 9 aa, West Nile virus
VAKKKGASL

SEQ ID NO: 136753 - protein, 9 aa, West Nile virus
AKKKGASLI

SEQ ID NO: 136754 - protein, 9 aa, West Nile virus
KKKGASLIC

SEQ ID NO: 136755 - protein, 9 aa, West Nile virus
KKGASLICL

SEQ ID NO: 136756 - protein, 9 aa, West Nile virus
KGASLICLA

SEQ ID NO: 136757 - protein, 9 aa, West Nile virus
GASLICLAL

SEQ ID NO: 136758 - protein, 9 aa, West Nile virus
ASLICLALA

SEQ ID NO: 136759 - protein, 9 aa, West Nile virus
SLICLALAS

SEQ ID NO: 136760 - protein, 9 aa, West Nile virus
FSPITLAAG

SEQ ID NO: 136761 - protein, 9 aa, West Nile virus
SPITLAAGL

SEQ ID NO: 136762 - protein, 9 aa, West Nile virus
PLILVAGLL

SEQ ID NO: 136763 - protein, 9 aa, West Nile virus
LAAGLMACD

SEQ ID NO: 136764 - protein, 9 aa, West Nile virus
AAGLMACDP

SEQ ID NO: 136765 - protein, 9 aa, West Nile virus
AGLMACDPN

SEQ ID NO: 136766 - protein, 9 aa, West Nile virus
GLMACDPNR

SEQ ID NO: 136767 - protein, 9 aa, West Nile virus
LMACDPNRK

SEQ ID NO: 136768 - protein, 9 aa, West Nile virus
MACDPNRKR

SEQ ID NO: 136769 - protein, 9 aa, West Nile virus
GLAELDVDS

SEQ ID NO: 136770 - protein, 9 aa, West Nile virus
LAELDIDTM

SEQ ID NO: 136771 - protein, 9 aa, West Nile virus
AELDVDSMA

SEQ ID NO: 136772 - protein, 9 aa, West Nile virus
ELDMDSMAI

SEQ ID NO: 136773 - protein, 9 aa, West Nile virus
LDIDTMAIP

SEQ ID NO: 136774 - protein, 9 aa, West Nile virus
DIDSMAVPM

SEQ ID NO: 136775 - protein, 9 aa, West Nile virus
VDSMAIPMT

SEQ ID NO: 136776 - protein, 9 aa, West Nile virus
IAGLMFAAY

SEQ ID NO: 136777 - protein, 9 aa, West Nile virus
AGLMFAAYV

SEQ ID NO: 136778 - protein, 9 aa, West Nile virus
GLMFAAYVI

SEQ ID NO: 136779 - protein, 9 aa, West Nile virus
LMFAAYVIT

SEQ ID NO: 136780 - protein, 9 aa, West Nile virus
MFAAYVITG

SEQ ID NO: 136781 - protein, 9 aa, West Nile virus
FAAYVITGR

SEQ ID NO: 136782 - protein, 9 aa, West Nile virus
AAYVITGRS

SEQ ID NO: 136783 - protein, 9 aa, West Nile virus
WIERVADIS

SEQ ID NO: 136784 - protein, 9 aa, West Nile virus
IERVADISW

SEQ ID NO: 136785 - protein, 9 aa, West Nile virus
ERVADISWE

SEQ ID NO: 136786 - protein, 9 aa, West Nile virus
RTADISWEG

SEQ ID NO: 136787 - protein, 9 aa, West Nile virus
TADISWEGD

SEQ ID NO: 136788 - protein, 9 aa, West Nile virus
ADISWEGDA

SEQ ID NO: 136789 - protein, 9 aa, West Nile virus
DISWEGDAE

SEQ ID NO: 136790 - protein, 9 aa, West Nile virus
ISWEGDAEI

SEQ ID NO: 136791 - protein, 9 aa, West Nile virus
SWEGDAEIT

SEQ ID NO: 136792 - protein, 9 aa, West Nile virus
WENDAEITG

SEQ ID NO: 136793 - protein, 9 aa, West Nile virus
EGDAEITGS

SEQ ID NO: 136794 - protein, 9 aa, West Nile virus
GDAEITGSS

SEQ ID NO: 136795 - protein, 9 aa, West Nile virus
DVEITGSSE

SEQ ID NO: 136796 - protein, 9 aa, West Nile virus
VEITGSSER

SEQ ID NO: 136797 - protein, 9 aa, West Nile virus
GSSERVDVK

SEQ ID NO: 136798 - protein, 9 aa, West Nile virus
SSERVDVKL

SEQ ID NO: 136799 - protein, 9 aa, West Nile virus
DVRLDDDGD

SEQ ID NO: 136800 - protein, 9 aa, West Nile virus
VRLDDGENF

SEQ ID NO: 136801 - protein, 9 aa, West Nile virus
RLDDDGDFQ

SEQ ID NO: 136802 - protein, 9 aa, West Nile virus
DDGENFQLM

SEQ ID NO: 136803 - protein, 9 aa, West Nile virus
DDGNFQLMS

SEQ ID NO: 136804 - protein, 9 aa, West Nile virus
GENFQLMND

SEQ ID NO: 136805 - protein, 9 aa, West Nile virus
GDFQLMNDP

SEQ ID NO: 136806 - protein, 9 aa, West Nile virus
NFQLMSDPG

SEQ ID NO: 136807 - protein, 9 aa, West Nile virus
APWKLWMLR

SEQ ID NO: 136808 - protein, 9 aa, West Nile virus
PWKLWMLRM

SEQ ID NO: 136809 - protein, 9 aa, West Nile virus
WMLRMTCLA

SEQ ID NO: 136810 - protein, 9 aa, West Nile virus
MTCLAVSAY

SEQ ID NO: 136811 - protein, 9 aa, West Nile virus
TCLAVSAYT

SEQ ID NO: 136812 - protein, 9 aa, West Nile virus
PWAILPSIV

SEQ ID NO: 136813 - protein, 9 aa, West Nile virus
WAVLPSVVG

SEQ ID NO: 136814 - protein, 9 aa, West Nile virus
AILPSIVGF

SEQ ID NO: 136815 - protein, 9 aa, West Nile virus
VLPSVVGFW

SEQ ID NO: 136816 - protein, 9 aa, West Nile virus
PSIVGFWIT

SEQ ID NO: 136817 - protein, 9 aa, West Nile virus
SVVGFWISL

SEQ ID NO: 136818 - protein, 9 aa, West Nile virus
VVGFWISLQ

SEQ ID NO: 136819 - protein, 9 aa, West Nile virus
DTPSPREYR

SEQ ID NO: 136820 - protein, 9 aa, West Nile virus
EYRKGDTTT

SEQ ID NO: 136821 - protein, 9 aa, West Nile virus
YRKGDTTTG

SEQ ID NO: 136822 - protein, 9 aa, West Nile virus
RKGDTTTGV

SEQ ID NO: 136823 - protein, 9 aa, West Nile virus
LLGNYQAGV

SEQ ID NO: 136824 - protein, 9 aa, West Nile virus
YGGPWKLQC

SEQ ID NO: 136825 - protein, 9 aa, West Nile virus
GGPWKLQCK

SEQ ID NO: 136826 - protein, 9 aa, West Nile virus
GPWKLQCKW

SEQ ID NO: 136827 - protein, 9 aa, West Nile virus
PWKLQHRWN

SEQ ID NO: 136828 - protein, 9 aa, West Nile virus
WKLQCKWNG

SEQ ID NO: 136829 - protein, 9 aa, West Nile virus
KLQRKWNGL

SEQ ID NO: 136830 - protein, 9 aa, West Nile virus
LQRKWNGLD

SEQ ID NO: 136831 - protein, 9 aa, West Nile virus
QRKWNGLDE

SEQ ID NO: 136832 - protein, 9 aa, West Nile virus
RKWNGLDEV

SEQ ID NO: 136833 - protein, 9 aa, West Nile virus
KWNGLDEVQ

SEQ ID NO: 136834 - protein, 9 aa, West Nile virus
WNGLDEVQM

SEQ ID NO: 136835 - protein, 9 aa, West Nile virus
NGLDEVQMI

SEQ ID NO: 136836 - protein, 9 aa, West Nile virus
GLDEVQMIV

SEQ ID NO: 136837 - protein, 9 aa, West Nile virus
LDEVQMIVA

SEQ ID NO: 136838 - protein, 9 aa, West Nile virus
MIVVKPGES

SEQ ID NO: 136839 - protein, 9 aa, West Nile virus
IVVEPGKNA

SEQ ID NO: 136840 - protein, 9 aa, West Nile virus
VVEPGKNAK

SEQ ID NO: 136841 - protein, 9 aa, West Nile virus
VEPGKNAKN

SEQ ID NO: 136842 - protein, 9 aa, West Nile virus
EPGKNAKNV

SEQ ID NO: 136843 - protein, 9 aa, West Nile virus
PGKNAKNVQ

SEQ ID NO: 136844 - protein, 9 aa, West Nile virus
GKNAKNVQT

SEQ ID NO: 136845 - protein, 9 aa, West Nile virus
KNAKNVQTK

SEQ ID NO: 136846 - protein, 9 aa, West Nile virus
NAKNVQTKP

SEQ ID NO: 136847 - protein, 9 aa, West Nile virus
AKNVQTKPG

SEQ ID NO: 136848 - protein, 9 aa, West Nile virus
GSPIVDKNS

SEQ ID NO: 136849 - protein, 9 aa, West Nile virus
SPIVDKNSD

SEQ ID NO: 136850 - protein, 9 aa, West Nile virus
PIVDKNSDV

SEQ ID NO: 136851 - protein, 9 aa, West Nile virus
IVDKSGDVI

SEQ ID NO: 136852 - protein, 9 aa, West Nile virus
VDKSGDVIG

SEQ ID NO: 136853 - protein, 9 aa, West Nile virus
DKNSDVIGL

SEQ ID NO: 136854 - protein, 9 aa, West Nile virus
KNSDVIGLY

SEQ ID NO: 136855 - protein, 9 aa, West Nile virus
NGVIMPSGS

SEQ ID NO: 136856 - protein, 9 aa, West Nile virus
GVIMPSGSY

SEQ ID NO: 136857 - protein, 9 aa, West Nile virus
VIMPSGSYI

SEQ ID NO: 136858 - protein, 9 aa, West Nile virus
IMPSGSYIS

SEQ ID NO: 136859 - protein, 9 aa, West Nile virus
MPSGSYISA

SEQ ID NO: 136860 - protein, 9 aa, West Nile virus
PSGSYISAI

SEQ ID NO: 136861 - protein, 9 aa, West Nile virus
SGSYISAIV

SEQ ID NO: 136862 - protein, 9 aa, West Nile virus
QGERMDEPV

SEQ ID NO: 136863 - protein, 9 aa, West Nile virus
GERMDEPVP

SEQ ID NO: 136864 - protein, 9 aa, West Nile virus
ERMDEPVPA

SEQ ID NO: 136865 - protein, 9 aa, West Nile virus
RMDEPVPAG

SEQ ID NO: 136866 - protein, 9 aa, West Nile virus
MDEPVPAGF

SEQ ID NO: 136867 - protein, 9 aa, West Nile virus
GFESEMLRK

SEQ ID NO: 136868 - protein, 9 aa, West Nile virus
FESEMLRKK

SEQ ID NO: 136869 - protein, 9 aa, West Nile virus
DPEMLRKKQ

SEQ ID NO: 136870 - protein, 9 aa, West Nile virus
SEMLRKKQI

SEQ ID NO: 136871 - protein, 9 aa, West Nile virus
EMLRKKKIT

SEQ ID NO: 136872 - protein, 9 aa, West Nile virus
MLRKKKITV

SEQ ID NO: 136873 - protein, 9 aa, West Nile virus
LRKKKITVL

SEQ ID NO: 136874 - protein, 9 aa, West Nile virus
RKKQISVLD

SEQ ID NO: 136875 - protein, 9 aa, West Nile virus
RKILPQIIR

SEQ ID NO: 136876 - protein, 9 aa, West Nile virus
KILPQIIRE

SEQ ID NO: 136877 - protein, 9 aa, West Nile virus
PQIIKEAMN

SEQ ID NO: 136878 - protein, 9 aa, West Nile virus
QIIREAINR

SEQ ID NO: 136879 - protein, 9 aa, West Nile virus
IIREAINRR

SEQ ID NO: 136880 - protein, 9 aa, West Nile virus
IREAINRRL

SEQ ID NO: 136881 - protein, 9 aa, West Nile virus
REAINRRLR

SEQ ID NO: 136882 - protein, 9 aa, West Nile virus
EAMNRRLRT

SEQ ID NO: 136883 - protein, 9 aa, West Nile virus
AISKRLRTA

SEQ ID NO: 136884 - protein, 9 aa, West Nile virus
NKRLRTAIL

SEQ ID NO: 136885 - protein, 9 aa, West Nile virus
KRLRTAILA

SEQ ID NO: 136886 - protein, 9 aa, West Nile virus
TRVVASEMA

SEQ ID NO: 136887 - protein, 9 aa, West Nile virus
RVVASEMAE

SEQ ID NO: 136888 - protein, 9 aa, West Nile virus
VVASEMAEA

SEQ ID NO: 136889 - protein, 9 aa, West Nile virus
VASEMAEAL

SEQ ID NO: 136890 - protein, 9 aa, West Nile virus
ASEMAEALR

SEQ ID NO: 136891 - protein, 9 aa, West Nile virus
SEMAEALRG

SEQ ID NO: 136892 - protein, 9 aa, West Nile virus
IRYQTSAVT

SEQ ID NO: 136893 - protein, 9 aa, West Nile virus
RYQTSAVTR

SEQ ID NO: 136894 - protein, 9 aa, West Nile virus
YQTSAVTRE

SEQ ID NO: 136895 - protein, 9 aa, West Nile virus
QTSAVTREH

SEQ ID NO: 136896 - protein, 9 aa, West Nile virus
REHTGNEIV

SEQ ID NO: 136897 - protein, 9 aa, West Nile virus
EHTGNEIVD

SEQ ID NO: 136898 - protein, 9 aa, West Nile virus
HTGNEIVDV

SEQ ID NO: 136899 - protein, 9 aa, West Nile virus
TGNEIVDVM

SEQ ID NO: 136900 - protein, 9 aa, West Nile virus
AARGYISTR

SEQ ID NO: 136901 - protein, 9 aa, West Nile virus
ARGYISTRV

SEQ ID NO: 136902 - protein, 9 aa, West Nile virus
RGYISTRVE

SEQ ID NO: 136903 - protein, 9 aa, West Nile virus
GYISTRVEL

SEQ ID NO: 136904 - protein, 9 aa, West Nile virus
YISTRVELG

SEQ ID NO: 136905 - protein, 9 aa, West Nile virus
ISTRVELGE

SEQ ID NO: 136906 - protein, 9 aa, West Nile virus
STRVELGEA

SEQ ID NO: 136907 - protein, 9 aa, West Nile virus
PGTHDPFPE

SEQ ID NO: 136908 - protein, 9 aa, West Nile virus
GTSDPFPKS

SEQ ID NO: 136909 - protein, 9 aa, West Nile virus
TSDPFPKSN

SEQ ID NO: 136910 - protein, 9 aa, West Nile virus
HDPFPESNA

SEQ ID NO: 136911 - protein, 9 aa, West Nile virus
PFPESNAPV

SEQ ID NO: 136912 - protein, 9 aa, West Nile virus
DIQTEIPDR

SEQ ID NO: 136913 - protein, 9 aa, West Nile virus
IQTEIPDRA

SEQ ID NO: 136914 - protein, 9 aa, West Nile virus
GYEWITEYV

SEQ ID NO: 136915 - protein, 9 aa, West Nile virus
YEWITEYVG

SEQ ID NO: 136916 - protein, 9 aa, West Nile virus
EWITEYVGK

SEQ ID NO: 136917 - protein, 9 aa, West Nile virus
WITEYVGKT

SEQ ID NO: 136918 - protein, 9 aa, West Nile virus
ITEYVGKTV

SEQ ID NO: 136919 - protein, 9 aa, West Nile virus
TEYVGKTVW

SEQ ID NO: 136920 - protein, 9 aa, West Nile virus
EYVGKTVWF

SEQ ID NO: 136921 - protein, 9 aa, West Nile virus
YVGKTVWFV

SEQ ID NO: 136922 - protein, 9 aa, West Nile virus
VGKTVWFVP

SEQ ID NO: 136923 - protein, 9 aa, West Nile virus
LCLQRAGKR

SEQ ID NO: 136924 - protein, 9 aa, West Nile virus
LQRAGKRVI

SEQ ID NO: 136925 - protein, 9 aa, West Nile virus
QRAGKRVIQ

SEQ ID NO: 136926 - protein, 9 aa, West Nile virus
RAGKRVIQL

SEQ ID NO: 136927 - protein, 9 aa, West Nile virus
AGKRVIQLN

SEQ ID NO: 136928 - protein, 9 aa, West Nile virus
GKRVIQLNR

SEQ ID NO: 136929 - protein, 9 aa, West Nile virus
KRVIQLNRK

SEQ ID NO: 136930 - protein, 9 aa, West Nile virus
RVIQLNRKS

SEQ ID NO: 136931 - protein, 9 aa, West Nile virus
EMGANFKAN

SEQ ID NO: 136932 - protein, 9 aa, West Nile virus
MGANFRASR

SEQ ID NO: 136933 - protein, 9 aa, West Nile virus
GANFKANRV

SEQ ID NO: 136934 - protein, 9 aa, West Nile virus
ANFKANRVI

SEQ ID NO: 136935 - protein, 9 aa, West Nile virus
NFKANRVID

SEQ ID NO: 136936 - protein, 9 aa, West Nile virus
FKANRVIDS

SEQ ID NO: 136937 - protein, 9 aa, West Nile virus
RASRVIDSR

SEQ ID NO: 136938 - protein, 9 aa, West Nile virus
KSVKPIIIT

SEQ ID NO: 136939 - protein, 9 aa, West Nile virus
SVKPTIITD

SEQ ID NO: 136940 - protein, 9 aa, West Nile virus
VKPTIITDG

SEQ ID NO: 136941 - protein, 9 aa, West Nile virus
KPTIITDGE

SEQ ID NO: 136942 - protein, 9 aa, West Nile virus
ITDGENRVV

SEQ ID NO: 136943 - protein, 9 aa, West Nile virus
TDGENRVVL

SEQ ID NO: 136944 - protein, 9 aa, West Nile virus
DGENRVVLG

SEQ ID NO: 136945 - protein, 9 aa, West Nile virus
GENRVVLGE

SEQ ID NO: 136946 - protein, 9 aa, West Nile virus
ENRVVLGEP

SEQ ID NO: 136947 - protein, 9 aa, West Nile virus
GKVVLSEPS

SEQ ID NO: 136948 - protein, 9 aa, West Nile virus
VVLGEPSAI

SEQ ID NO: 136949 - protein, 9 aa, West Nile virus
VLGEPSAIT

SEQ ID NO: 136950 - protein, 9 aa, West Nile virus
RRGRTGRNP

SEQ ID NO: 136951 - protein, 9 aa, West Nile virus
RGRIGRNPT

SEQ ID NO: 136952 - protein, 9 aa, West Nile virus
GRVGRNPSQ

SEQ ID NO: 136953 - protein, 9 aa, West Nile virus
RVGRNPSQV

SEQ ID NO: 136954 - protein, 9 aa, West Nile virus
TGRNPSQAG

SEQ ID NO: 136955 - protein, 9 aa, West Nile virus
GRNPSQAGD

SEQ ID NO: 136956 - protein, 9 aa, West Nile virus
RNPTQVGDE

SEQ ID NO: 136957 - protein, 9 aa, West Nile virus
NPTQVGDEY

SEQ ID NO: 136958 - protein, 9 aa, West Nile virus
PSQAGDEYC

SEQ ID NO: 136959 - protein, 9 aa, West Nile virus
HTNEDDSNY

SEQ ID NO: 136960 - protein, 9 aa, West Nile virus
TNEDDSNCA

SEQ ID NO: 136961 - protein, 9 aa, West Nile virus
NEDDSNCAH

SEQ ID NO: 136962 - protein, 9 aa, West Nile virus
EDDSNYAHW

SEQ ID NO: 136963 - protein, 9 aa, West Nile virus
DDSNYAHWT

SEQ ID NO: 136964 - protein, 9 aa, West Nile virus
DSNYAHWTE

SEQ ID NO: 136965 - protein, 9 aa, West Nile virus
SNLAHWTEA

SEQ ID NO: 136966 - protein, 9 aa, West Nile virus
NYAHWTEAR

SEQ ID NO: 136967 - protein, 9 aa, West Nile virus
CAHWTEARI

SEQ ID NO: 136968 - protein, 9 aa, West Nile virus
MPNGLIAQL

SEQ ID NO: 136969 - protein, 9 aa, West Nile virus
PNGLIAQLY

SEQ ID NO: 136970 - protein, 9 aa, West Nile virus
NGLIAQLYQ

SEQ ID NO: 136971 - protein, 9 aa, West Nile virus
GLIAQLYQP

SEQ ID NO: 136972 - protein, 9 aa, West Nile virus
LIAQLYQPE

SEQ ID NO: 136973 - protein, 9 aa, West Nile virus
IAQLYQPER

SEQ ID NO: 136974 - protein, 9 aa, West Nile virus
EREKVCTMD

SEQ ID NO: 136975 - protein, 9 aa, West Nile virus
REKVYTMEG

SEQ ID NO: 136976 - protein, 9 aa, West Nile virus
EKVYTMEGE

SEQ ID NO: 136977 - protein, 9 aa, West Nile virus
KVCTMDGEY

SEQ ID NO: 136978 - protein, 9 aa, West Nile virus
VHTMDGEYR

SEQ ID NO: 136979 - protein, 9 aa, West Nile virus
YTMEGEYRL

SEQ ID NO: 136980 - protein, 9 aa, West Nile virus
LPVWLAHKV

SEQ ID NO: 136981 - protein, 9 aa, West Nile virus
PVWLAYKAA

SEQ ID NO: 136982 - protein, 9 aa, West Nile virus
VWLAYKAAA

SEQ ID NO: 136983 - protein, 9 aa, West Nile virus
WLAYKAAAA

SEQ ID NO: 136984 - protein, 9 aa, West Nile virus
LAYKVASAG

SEQ ID NO: 136985 - protein, 9 aa, West Nile virus
AYQVAAAGI

SEQ ID NO: 136986 - protein, 9 aa, West Nile virus
QVAAAGISY

SEQ ID NO: 136987 - protein, 9 aa, West Nile virus
VAAAGVPYH

SEQ ID NO: 136988 - protein, 9 aa, West Nile virus
AAAGVPYHD

SEQ ID NO: 136989 - protein, 9 aa, West Nile virus
AAGVPYHDR

SEQ ID NO: 136990 - protein, 9 aa, West Nile virus
AGVPYHDRR

SEQ ID NO: 136991 - protein, 9 aa, West Nile virus
GVPYHDRRW

SEQ ID NO: 136992 - protein, 9 aa, West Nile virus
ISYHDRRWC

SEQ ID NO: 136993 - protein, 9 aa, West Nile virus
PYHDRRWCF

SEQ ID NO: 136994 - protein, 9 aa, West Nile virus
PRTNTVLED

SEQ ID NO: 136995 - protein, 9 aa, West Nile virus
RTNMILEDN

SEQ ID NO: 136996 - protein, 9 aa, West Nile virus
TNMILEDNN

SEQ ID NO: 136997 - protein, 9 aa, West Nile virus
NTVLEDNNE

SEQ ID NO: 136998 - protein, 9 aa, West Nile virus
MILEDNNEV

SEQ ID NO: 136999 - protein, 9 aa, West Nile virus
RKILRPRWV

SEQ ID NO: 137000 - protein, 9 aa, West Nile virus
KILRPRWVD

SEQ ID NO: 137001 - protein, 9 aa, West Nile virus
ILRPRWVDA

SEQ ID NO: 137002 - protein, 9 aa, West Nile virus
LRPRWVDAR

SEQ ID NO: 137003 - protein, 9 aa, West Nile virus
RPRWVDARV

SEQ ID NO: 137004 - protein, 9 aa, West Nile virus
PRWVDARVY

SEQ ID NO: 137005 - protein, 9 aa, West Nile virus
RWVDARVYS

SEQ ID NO: 137006 - protein, 9 aa, West Nile virus
WVDARVYSD

SEQ ID NO: 137007 - protein, 9 aa, West Nile virus
VDARVYSDH

SEQ ID NO: 137008 - protein, 9 aa, West Nile virus
YSDHQALKL

SEQ ID NO: 137009 - protein, 9 aa, West Nile virus
SDHQALKLF

SEQ ID NO: 137010 - protein, 9 aa, West Nile virus
DHQALKLFK

SEQ ID NO: 137011 - protein, 9 aa, West Nile virus
HQALKLFKD

SEQ ID NO: 137012 - protein, 9 aa, West Nile virus
QALKLFKDF

SEQ ID NO: 137013 - protein, 9 aa, West Nile virus
ALKLFKDFA

SEQ ID NO: 137014 - protein, 9 aa, West Nile virus
LKLFKDFAA

SEQ ID NO: 137015 - protein, 9 aa, West Nile virus
KLFKDFAAG

SEQ ID NO: 137016 - protein, 9 aa, West Nile virus
LFKDFAAGR

SEQ ID NO: 137017 - protein, 9 aa, West Nile virus
FASGKRSQM

SEQ ID NO: 137018 - protein, 9 aa, West Nile virus
AAGKRSQIG

SEQ ID NO: 137019 - protein, 9 aa, West Nile virus
SGKRSQIGF

SEQ ID NO: 137020 - protein, 9 aa, West Nile virus
GRRSQIGLV

SEQ ID NO: 137021 - protein, 9 aa, West Nile virus
RRSQIGLVE

SEQ ID NO: 137022 - protein, 9 aa, West Nile virus
RSQIGFIEV

SEQ ID NO: 137023 - protein, 9 aa, West Nile virus
SQIGLVEVI

SEQ ID NO: 137024 - protein, 9 aa, West Nile virus
QIGLVEVIG

SEQ ID NO: 137025 - protein, 9 aa, West Nile virus
IGLVEVIGR

SEQ ID NO: 137026 - protein, 9 aa, West Nile virus
GLVEVIGRM

SEQ ID NO: 137027 - protein, 9 aa, West Nile virus
LVEVIGRMP

SEQ ID NO: 137028 - protein, 9 aa, West Nile virus
VEVIGRMPE

SEQ ID NO: 137029 - protein, 9 aa, West Nile virus
EVIGRMPEH

SEQ ID NO: 137030 - protein, 9 aa, West Nile virus
VIGRMPEHF

SEQ ID NO: 137031 - protein, 9 aa, West Nile virus
IGRMPEHFV

SEQ ID NO: 137032 - protein, 9 aa, West Nile virus
GRMPEHFVG

SEQ ID NO: 137033 - protein, 9 aa, West Nile virus
RMPEHFVGK

SEQ ID NO: 137034 - protein, 9 aa, West Nile virus
MPEHFMVKT

SEQ ID NO: 137035 - protein, 9 aa, West Nile virus
PEHFMVKTW

SEQ ID NO: 137036 - protein, 9 aa, West Nile virus
EHFMVKTWE

SEQ ID NO: 137037 - protein, 9 aa, West Nile virus
HFMVKTWEA

SEQ ID NO: 137038 - protein, 9 aa, West Nile virus
FMVKTWEAL

SEQ ID NO: 137039 - protein, 9 aa, West Nile virus
MVKTWEALD

SEQ ID NO: 137040 - protein, 9 aa, West Nile virus
VVATAEKGR

SEQ ID NO: 137041 - protein, 9 aa, West Nile virus
VATADKGGR

SEQ ID NO: 137042 - protein, 9 aa, West Nile virus
ATAEKGRRA

SEQ ID NO: 137043 - protein, 9 aa, West Nile virus
TADKGGRAH

SEQ ID NO: 137044 - protein, 9 aa, West Nile virus
ADKGGRAHR

SEQ ID NO: 137045 - protein, 9 aa, West Nile virus
ERGGRAHRS

SEQ ID NO: 137046 - protein, 9 aa, West Nile virus
KGGRAHSMA

SEQ ID NO: 137047 - protein, 9 aa, West Nile virus
GRRAHRMAL

SEQ ID NO: 137048 - protein, 9 aa, West Nile virus
GRAHRSALE

SEQ ID NO: 137049 - protein, 9 aa, West Nile virus
RAHSMALEE

SEQ ID NO: 137050 - protein, 9 aa, West Nile virus
AHRSALEEL

SEQ ID NO: 137051 - protein, 9 aa, West Nile virus
HRSALEELP

SEQ ID NO: 137052 - protein, 9 aa, West Nile virus
RSALEELPD

SEQ ID NO: 137053 - protein, 9 aa, West Nile virus
LPDALQTVA

SEQ ID NO: 137054 - protein, 9 aa, West Nile virus
PDALQTVAL

SEQ ID NO: 137055 - protein, 9 aa, West Nile virus
DALQTVALI

SEQ ID NO: 137056 - protein, 9 aa, West Nile virus
ALQTIVLIA

SEQ ID NO: 137057 - protein, 9 aa, West Nile virus
LQTIVLIAL

SEQ ID NO: 137058 - protein, 9 aa, West Nile virus
QTIVLIALL

SEQ ID NO: 137059 - protein, 9 aa, West Nile virus
TIVLIALLS

SEQ ID NO: 137060 - protein, 9 aa, West Nile virus
IVLIALLSV

SEQ ID NO: 137061 - protein, 9 aa, West Nile virus
VLIALLSVM

SEQ ID NO: 137062 - protein, 9 aa, West Nile virus
LIALLSVMS

SEQ ID NO: 137063 - protein, 9 aa, West Nile virus
LLSVMTLGV

SEQ ID NO: 137064 - protein, 9 aa, West Nile virus
LSVMTLGVF

SEQ ID NO: 137065 - protein, 9 aa, West Nile virus
VMTLGVFCL

SEQ ID NO: 137066 - protein, 9 aa, West Nile virus
MTLGVFCLL

SEQ ID NO: 137067 - protein, 9 aa, West Nile virus
TLGVFCLLM

SEQ ID NO: 137068 - protein, 9 aa, West Nile virus
LGVFCLLMQ

SEQ ID NO: 137069 - protein, 9 aa, West Nile virus
GIFFLLMQR

SEQ ID NO: 137070 - protein, 9 aa, West Nile virus
VFLLLMQRK

SEQ ID NO: 137071 - protein, 9 aa, West Nile virus
IGKIGLGGV

SEQ ID NO: 137072 - protein, 9 aa, West Nile virus
LGLATFFCW

SEQ ID NO: 137073 - protein, 9 aa, West Nile virus
GLATFFCWM

SEQ ID NO: 137074 - protein, 9 aa, West Nile virus
LATFFCWMA

SEQ ID NO: 137075 - protein, 9 aa, West Nile virus
ATLFCWMAE

SEQ ID NO: 137076 - protein, 9 aa, West Nile virus
TLFCWMAEV

SEQ ID NO: 137077 - protein, 9 aa, West Nile virus
FFCWMADVP

SEQ ID NO: 137078 - protein, 9 aa, West Nile virus
FCWMADVPG

SEQ ID NO: 137079 - protein, 9 aa, West Nile virus
CWMADVPGT

SEQ ID NO: 137080 - protein, 9 aa, West Nile virus
WMADVPGTK

SEQ ID NO: 137081 - protein, 9 aa, West Nile virus
MADVPGTKI

SEQ ID NO: 137082 - protein, 9 aa, West Nile virus
ADVPGTKIA

SEQ ID NO: 137083 - protein, 9 aa, West Nile virus
DVPGTKIAG

SEQ ID NO: 137084 - protein, 9 aa, West Nile virus
LAMFLICVM

SEQ ID NO: 137085 - protein, 9 aa, West Nile virus
AMFLICVMT

SEQ ID NO: 137086 - protein, 9 aa, West Nile virus
MFLICVMTL

SEQ ID NO: 137087 - protein, 9 aa, West Nile virus
FLICVMTPV

SEQ ID NO: 137088 - protein, 9 aa, West Nile virus
TLVGTVAAN

SEQ ID NO: 137089 - protein, 9 aa, West Nile virus
LVGTVAANE

SEQ ID NO: 137090 - protein, 9 aa, West Nile virus
VGTVAANEM

SEQ ID NO: 137091 - protein, 9 aa, West Nile virus
GTVAANEMG

SEQ ID NO: 137092 - protein, 9 aa, West Nile virus
MGWLDRTKS

SEQ ID NO: 137093 - protein, 9 aa, West Nile virus
GWLDRTKSD

SEQ ID NO: 137094 - protein, 9 aa, West Nile virus
WLDRTKSDI

SEQ ID NO: 137095 - protein, 9 aa, West Nile virus
ESFLLDLKP

SEQ ID NO: 137096 - protein, 9 aa, West Nile virus
SFLLDLKPA

SEQ ID NO: 137097 - protein, 9 aa, West Nile virus
LLLDLKPAT

SEQ ID NO: 137098 - protein, 9 aa, West Nile virus
TAWSLYAVA

SEQ ID NO: 137099 - protein, 9 aa, West Nile virus
AWSLYAIST

SEQ ID NO: 137100 - protein, 9 aa, West Nile virus
WSLYAISTA

SEQ ID NO: 137101 - protein, 9 aa, West Nile virus
SLYAVTTAF

SEQ ID NO: 137102 - protein, 9 aa, West Nile virus
LYAVTTAFL

SEQ ID NO: 137103 - protein, 9 aa, West Nile virus
YAVATAVLT

SEQ ID NO: 137104 - protein, 9 aa, West Nile virus
AISTAFMTP

SEQ ID NO: 137105 - protein, 9 aa, West Nile virus
ISTAFMTPL

SEQ ID NO: 137106 - protein, 9 aa, West Nile virus
ATAVLTPLL

SEQ ID NO: 137107 - protein, 9 aa, West Nile virus
TAFLTPLLK

SEQ ID NO: 137108 - protein, 9 aa, West Nile virus
AVLTPLIKH

SEQ ID NO: 137109 - protein, 9 aa, West Nile virus
FMTPLLKHL

SEQ ID NO: 137110 - protein, 9 aa, West Nile virus
LTPLIKHLI

SEQ ID NO: 137111 - protein, 9 aa, West Nile virus
INVQASTLF

SEQ ID NO: 137112 - protein, 9 aa, West Nile virus
NVQASTLFT

SEQ ID NO: 137113 - protein, 9 aa, West Nile virus
VQASTLFTL

SEQ ID NO: 137114 - protein, 9 aa, West Nile virus
QASALYSLA

SEQ ID NO: 137115 - protein, 9 aa, West Nile virus
ASALYSLAR

SEQ ID NO: 137116 - protein, 9 aa, West Nile virus
SALYSLARG

SEQ ID NO: 137117 - protein, 9 aa, West Nile virus
ALYSLARGF

SEQ ID NO: 137118 - protein, 9 aa, West Nile virus
LYSLARGFP

SEQ ID NO: 137119 - protein, 9 aa, West Nile virus
YSLARGFPF

SEQ ID NO: 137120 - protein, 9 aa, West Nile virus
SLARGFPFV

SEQ ID NO: 137121 - protein, 9 aa, West Nile virus
GISSLLLAV

SEQ ID NO: 137122 - protein, 9 aa, West Nile virus
ISALLLAAG

SEQ ID NO: 137123 - protein, 9 aa, West Nile virus
TLTVTVTAT

SEQ ID NO: 137124 - protein, 9 aa, West Nile virus
TLLLCHYAY

SEQ ID NO: 137125 - protein, 9 aa, West Nile virus
AGIMKNAVI

SEQ ID NO: 137126 - protein, 9 aa, West Nile virus
GIMKNVVVD

SEQ ID NO: 137127 - protein, 9 aa, West Nile virus
IMKNVVVDG

SEQ ID NO: 137128 - protein, 9 aa, West Nile virus
MKNAVIDGM

SEQ ID NO: 137129 - protein, 9 aa, West Nile virus
KNVVVDGIV

SEQ ID NO: 137130 - protein, 9 aa, West Nile virus
NAVIDGMVA

SEQ ID NO: 137131 - protein, 9 aa, West Nile virus
VVVDGIVAT

SEQ ID NO: 137132 - protein, 9 aa, West Nile virus
PELERATPI

SEQ ID NO: 137133 - protein, 9 aa, West Nile virus
ELERATPIM

SEQ ID NO: 137134 - protein, 9 aa, West Nile virus
LERATPIMQ

SEQ ID NO: 137135 - protein, 9 aa, West Nile virus
ERATPIMQK

SEQ ID NO: 137136 - protein, 9 aa, West Nile virus
RATPIMQKK

SEQ ID NO: 137137 - protein, 9 aa, West Nile virus
ATPIMQKKV

SEQ ID NO: 137138 - protein, 9 aa, West Nile virus
TPIMQKKIG

SEQ ID NO: 137139 - protein, 9 aa, West Nile virus
PMMQKKVGQ

SEQ ID NO: 137140 - protein, 9 aa, West Nile virus
IMQKKVGQV

SEQ ID NO: 137141 - protein, 9 aa, West Nile virus
MQKKVGQII

SEQ ID NO: 137142 - protein, 9 aa, West Nile virus
QKKVGQIIL

SEQ ID NO: 137143 - protein, 9 aa, West Nile virus
KKVGQIILI

SEQ ID NO: 137144 - protein, 9 aa, West Nile virus
KVGQIILIL

SEQ ID NO: 137145 - protein, 9 aa, West Nile virus
VGQIILILV

SEQ ID NO: 137146 - protein, 9 aa, West Nile virus
GQIILILVS

SEQ ID NO: 137147 - protein, 9 aa, West Nile virus
MLILVSTAA

SEQ ID NO: 137148 - protein, 9 aa, West Nile virus
LILVSTAAV

SEQ ID NO: 137149 - protein, 9 aa, West Nile virus
ILVSTAAVV

SEQ ID NO: 137150 - protein, 9 aa, West Nile virus
LVSTAAVVV

SEQ ID NO: 137151 - protein, 9 aa, West Nile virus
VSTAAVVVN

SEQ ID NO: 137152 - protein, 9 aa, West Nile virus
STAAVVVNP

SEQ ID NO: 137153 - protein, 9 aa, West Nile virus
TAAVVVNPS

SEQ ID NO: 137154 - protein, 9 aa, West Nile virus
ALVVNPSVK

SEQ ID NO: 137155 - protein, 9 aa, West Nile virus
LVVNPSVKT

SEQ ID NO: 137156 - protein, 9 aa, West Nile virus
TVREAGILV

SEQ ID NO: 137157 - protein, 9 aa, West Nile virus
VREAGILVT

SEQ ID NO: 137158 - protein, 9 aa, West Nile virus
REAGILVTA

SEQ ID NO: 137159 - protein, 9 aa, West Nile virus
EAGILVTAA

SEQ ID NO: 137160 - protein, 9 aa, West Nile virus
AGILVTAAA

SEQ ID NO: 137161 - protein, 9 aa, West Nile virus
GILVTAAAV

SEQ ID NO: 137162 - protein, 9 aa, West Nile virus
ILVTAAAVT

SEQ ID NO: 137163 - protein, 9 aa, West Nile virus
LVTAAAVTL

SEQ ID NO: 137164 - protein, 9 aa, West Nile virus
VTAAAVTLW

SEQ ID NO: 137165 - protein, 9 aa, West Nile virus
GGWLSCFSI

SEQ ID NO: 137166 - protein, 9 aa, West Nile virus
GWLSCLSIM

SEQ ID NO: 137167 - protein, 9 aa, West Nile virus
WLSCLSMTW

SEQ ID NO: 137168 - protein, 9 aa, West Nile virus
LSCLSIMWT

SEQ ID NO: 137169 - protein, 9 aa, West Nile virus
SCLSIMWTL

SEQ ID NO: 137170 - protein, 9 aa, West Nile virus
KNMGKPGLK

SEQ ID NO: 137171 - protein, 9 aa, West Nile virus
NMGKPGLKR

SEQ ID NO: 137172 - protein, 9 aa, West Nile virus
MGKPGLKRG

SEQ ID NO: 137173 - protein, 9 aa, West Nile virus
GKPGLKRGG

SEQ ID NO: 137174 - protein, 9 aa, West Nile virus
TLGEAWKER

SEQ ID NO: 137175 - protein, 9 aa, West Nile virus
LGEAWKERL

SEQ ID NO: 137176 - protein, 9 aa, West Nile virus
GEVWKEKLN

SEQ ID NO: 137177 - protein, 9 aa, West Nile virus
EVWKDRLNR

SEQ ID NO: 137178 - protein, 9 aa, West Nile virus
VWKDRLNRL

SEQ ID NO: 137179 - protein, 9 aa, West Nile virus
WKDRLNRLT

SEQ ID NO: 137180 - protein, 9 aa, West Nile virus
MTKEEFIRY

SEQ ID NO: 137181 - protein, 9 aa, West Nile virus
TKEEFARYR

SEQ ID NO: 137182 - protein, 9 aa, West Nile virus
KEEFTRYRR

SEQ ID NO: 137183 - protein, 9 aa, West Nile virus
EEFARYRKE

SEQ ID NO: 137184 - protein, 9 aa, West Nile virus
EFARYRKEA

SEQ ID NO: 137185 - protein, 9 aa, West Nile virus
FARYRKEAI

SEQ ID NO: 137186 - protein, 9 aa, West Nile virus
IRYRKEAIT

SEQ ID NO: 137187 - protein, 9 aa, West Nile virus
AITEVDRAP

SEQ ID NO: 137188 - protein, 9 aa, West Nile virus
IIEVDRSTA

SEQ ID NO: 137189 - protein, 9 aa, West Nile virus
IEVDRSAAR

SEQ ID NO: 137190 - protein, 9 aa, West Nile virus
ARKERNITG

SEQ ID NO: 137191 - protein, 9 aa, West Nile virus
RKERNITGG

SEQ ID NO: 137192 - protein, 9 aa, West Nile virus
KERNITGGH

SEQ ID NO: 137193 - protein, 9 aa, West Nile virus
ERNITGGHP

SEQ ID NO: 137194 - protein, 9 aa, West Nile virus
RNITGGHPV

SEQ ID NO: 137195 - protein, 9 aa, West Nile virus
NVTGGHSVS

SEQ ID NO: 137196 - protein, 9 aa, West Nile virus
VTGGHSVSR

SEQ ID NO: 137197 - protein, 9 aa, West Nile virus
GGYPVSRGT

SEQ ID NO: 137198 - protein, 9 aa, West Nile virus
GYPVSRGTA

SEQ ID NO: 137199 - protein, 9 aa, West Nile virus
YPVSRGTAK

SEQ ID NO: 137200 - protein, 9 aa, West Nile virus
VERRFLEPI

SEQ ID NO: 137201 - protein, 9 aa, West Nile virus
ERRFLEPIG

SEQ ID NO: 137202 - protein, 9 aa, West Nile virus
RRFLEPIGK

SEQ ID NO: 137203 - protein, 9 aa, West Nile virus
KFVEPVGRV

SEQ ID NO: 137204 - protein, 9 aa, West Nile virus
FLDPIGKVV

SEQ ID NO: 137205 - protein, 9 aa, West Nile virus
LDPIGKVVD

SEQ ID NO: 137206 - protein, 9 aa, West Nile virus
DPIGKVVDL

SEQ ID NO: 137207 - protein, 9 aa, West Nile virus
PIGKVVDLG

SEQ ID NO: 137208 - protein, 9 aa, West Nile virus
IGKVVDLGC

SEQ ID NO: 137209 - protein, 9 aa, West Nile virus
DVYYRASEA

SEQ ID NO: 137210 - protein, 9 aa, West Nile virus
VYYRASEAS

SEQ ID NO: 137211 - protein, 9 aa, West Nile virus
YYRASEASD

SEQ ID NO: 137212 - protein, 9 aa, West Nile virus
YRASEASDT

SEQ ID NO: 137213 - protein, 9 aa, West Nile virus
RASEASDTL

SEQ ID NO: 137214 - protein, 9 aa, West Nile virus
ASEASDTLL

SEQ ID NO: 137215 - protein, 9 aa, West Nile virus
SEVSDTLLC

SEQ ID NO: 137216 - protein, 9 aa, West Nile virus
ESCDTLLCD

SEQ ID NO: 137217 - protein, 9 aa, West Nile virus
VSDTLLCDI

SEQ ID NO: 137218 - protein, 9 aa, West Nile virus
AEVEEHRTL

SEQ ID NO: 137219 - protein, 9 aa, West Nile virus
EVEEHRTLR

SEQ ID NO: 137220 - protein, 9 aa, West Nile virus
VEEHRTLRV

SEQ ID NO: 137221 - protein, 9 aa, West Nile virus
EEHRTLRVL

SEQ ID NO: 137222 - protein, 9 aa, West Nile virus
EHRTLRVLE

SEQ ID NO: 137223 - protein, 9 aa, West Nile virus
HRTLRVLEM

SEQ ID NO: 137224 - protein, 9 aa, West Nile virus
RTLRVLEMV

SEQ ID NO: 137225 - protein, 9 aa, West Nile virus
TLRVLEMVE

SEQ ID NO: 137226 - protein, 9 aa, West Nile virus
LRVLEMVED

SEQ ID NO: 137227 - protein, 9 aa, West Nile virus
HRGPKEFCV

SEQ ID NO: 137228 - protein, 9 aa, West Nile virus
RGPKEFCVK

SEQ ID NO: 137229 - protein, 9 aa, West Nile virus
GPKEFCVKV

SEQ ID NO: 137230 - protein, 9 aa, West Nile virus
PKEFCVKVL

SEQ ID NO: 137231 - protein, 9 aa, West Nile virus
KEFCVKVLC

SEQ ID NO: 137232 - protein, 9 aa, West Nile virus
PKVIEKMEV

SEQ ID NO: 137233 - protein, 9 aa, West Nile virus
KVIEKMEVL

SEQ ID NO: 137234 - protein, 9 aa, West Nile virus
VIEKMEVLQ

SEQ ID NO: 137235 - protein, 9 aa, West Nile virus
IEKMEVLQR

SEQ ID NO: 137236 - protein, 9 aa, West Nile virus
EKMEVLQRR

SEQ ID NO: 137237 - protein, 9 aa, West Nile virus
KMEVLQRRY

SEQ ID NO: 137238 - protein, 9 aa, West Nile virus
MEVLQRRYG

SEQ ID NO: 137239 - protein, 9 aa, West Nile virus
EVLQRRYGG

SEQ ID NO: 137240 - protein, 9 aa, West Nile virus
VLQRRYGGG

SEQ ID NO: 137241 - protein, 9 aa, West Nile virus
MYWVSRASS

SEQ ID NO: 137242 - protein, 9 aa, West Nile virus
YWVSRASRN

SEQ ID NO: 137243 - protein, 9 aa, West Nile virus
WVSRASGNI

SEQ ID NO: 137244 - protein, 9 aa, West Nile virus
VSRASGNIV

SEQ ID NO: 137245 - protein, 9 aa, West Nile virus
SRASGNIVN

SEQ ID NO: 137246 - protein, 9 aa, West Nile virus
NIVNSVSMT

SEQ ID NO: 137247 - protein, 9 aa, West Nile virus
IVNSVSMTS

SEQ ID NO: 137248 - protein, 9 aa, West Nile virus
VHAVNMTSQ

SEQ ID NO: 137249 - protein, 9 aa, West Nile virus
HAVNMTSQV

SEQ ID NO: 137250 - protein, 9 aa, West Nile virus
AVNMTSQVL

SEQ ID NO: 137251 - protein, 9 aa, West Nile virus
MEKKTWKGA

SEQ ID NO: 137252 - protein, 9 aa, West Nile virus
EKKTWKGAH

SEQ ID NO: 137253 - protein, 9 aa, West Nile virus
KKTWKGPQY

SEQ ID NO: 137254 - protein, 9 aa, West Nile virus
KTWKGPQYE

SEQ ID NO: 137255 - protein, 9 aa, West Nile virus
TWKGAHYEE

SEQ ID NO: 137256 - protein, 9 aa, West Nile virus
WKGAHYEED

SEQ ID NO: 137257 - protein, 9 aa, West Nile virus
KGPQYEEDA

SEQ ID NO: 137258 - protein, 9 aa, West Nile virus
GPQYEEDAN

SEQ ID NO: 137259 - protein, 9 aa, West Nile virus
PQYEEDANL

SEQ ID NO: 137260 - protein, 9 aa, West Nile virus
QYEEDANLG

SEQ ID NO: 137261 - protein, 9 aa, West Nile virus
YEEDANLGS

SEQ ID NO: 137262 - protein, 9 aa, West Nile virus
KPLLNSDTR

SEQ ID NO: 137263 - protein, 9 aa, West Nile virus
PLLNSDTSR

SEQ ID NO: 137264 - protein, 9 aa, West Nile virus
LLNSDTSRI

SEQ ID NO: 137265 - protein, 9 aa, West Nile virus
LNSDTSRIK

SEQ ID NO: 137266 - protein, 9 aa, West Nile virus
SDTSRIKSR

SEQ ID NO: 137267 - protein, 9 aa, West Nile virus
SRIERLKKE

SEQ ID NO: 137268 - protein, 9 aa, West Nile virus
RIERLKREY

SEQ ID NO: 137269 - protein, 9 aa, West Nile virus
IEKLKKEYG

SEQ ID NO: 137270 - protein, 9 aa, West Nile virus
DDNHPYRTW

SEQ ID NO: 137271 - protein, 9 aa, West Nile virus
DNHPYRTWN

SEQ ID NO: 137272 - protein, 9 aa, West Nile virus
NYHGSYEVK

SEQ ID NO: 137273 - protein, 9 aa, West Nile virus
YHGSYEVKP

SEQ ID NO: 137274 - protein, 9 aa, West Nile virus
HGSYEVKPT

SEQ ID NO: 137275 - protein, 9 aa, West Nile virus
GSYEVKPTG

SEQ ID NO: 137276 - protein, 9 aa, West Nile virus
SYEVKPTGS

SEQ ID NO: 137277 - protein, 9 aa, West Nile virus
YEVKPTGSA

SEQ ID NO: 137278 - protein, 9 aa, West Nile virus
EVKPTGSAS

SEQ ID NO: 137279 - protein, 9 aa, West Nile virus
VNPLVSASS

SEQ ID NO: 137280 - protein, 9 aa, West Nile virus
NPLVSASSL

SEQ ID NO: 137281 - protein, 9 aa, West Nile virus
SKPWDTIMN

SEQ ID NO: 137282 - protein, 9 aa, West Nile virus
KPWDTITSV

SEQ ID NO: 137283 - protein, 9 aa, West Nile virus
PWDTITSVT

SEQ ID NO: 137284 - protein, 9 aa, West Nile virus
WDTIMNVTT

SEQ ID NO: 137285 - protein, 9 aa, West Nile virus
DTITSVTTM

SEQ ID NO: 137286 - protein, 9 aa, West Nile virus
VITNVTTMA

SEQ ID NO: 137287 - protein, 9 aa, West Nile virus
KAPEPPAGV

SEQ ID NO: 137288 - protein, 9 aa, West Nile virus
APEPPEGVR

SEQ ID NO: 137289 - protein, 9 aa, West Nile virus
KETTNWLWA

SEQ ID NO: 137290 - protein, 9 aa, West Nile virus
ETTNWLWSH

SEQ ID NO: 137291 - protein, 9 aa, West Nile virus
TTNWLWAYL

SEQ ID NO: 137292 - protein, 9 aa, West Nile virus
TNWLWAFLS

SEQ ID NO: 137293 - protein, 9 aa, West Nile virus
NWLWSHLER

SEQ ID NO: 137294 - protein, 9 aa, West Nile virus
RNKRPRMCT

SEQ ID NO: 137295 - protein, 9 aa, West Nile virus
NKRPRMCTR

SEQ ID NO: 137296 - protein, 9 aa, West Nile virus
KRPRMCTRE

SEQ ID NO: 137297 - protein, 9 aa, West Nile virus
RPRMCTREE

SEQ ID NO: 137298 - protein, 9 aa, West Nile virus
MCSREEFIK

SEQ ID NO: 137299 - protein, 9 aa, West Nile virus
CSREEFIKK

SEQ ID NO: 137300 - protein, 9 aa, West Nile virus
SREEFIKKV

SEQ ID NO: 137301 - protein, 9 aa, West Nile virus
REEFIKKVN

SEQ ID NO: 137302 - protein, 9 aa, West Nile virus
EEFISKVNS

SEQ ID NO: 137303 - protein, 9 aa, West Nile virus
EFIKKVNSN

SEQ ID NO: 137304 - protein, 9 aa, West Nile virus
FISKVNSNA

SEQ ID NO: 137305 - protein, 9 aa, West Nile virus
ISKVNSNAA

SEQ ID NO: 137306 - protein, 9 aa, West Nile virus
SKVNSNAAL

SEQ ID NO: 137307 - protein, 9 aa, West Nile virus
MFEEQNQWS

SEQ ID NO: 137308 - protein, 9 aa, West Nile virus
FEEQNQWKS

SEQ ID NO: 137309 - protein, 9 aa, West Nile virus
EEQNQWKSA

SEQ ID NO: 137310 - protein, 9 aa, West Nile virus
EQNQWKSAR

SEQ ID NO: 137311 - protein, 9 aa, West Nile virus
QNQWKSARE

SEQ ID NO: 137312 - protein, 9 aa, West Nile virus
NQWKSAREA

SEQ ID NO: 137313 - protein, 9 aa, West Nile virus
QWKSAREAV

SEQ ID NO: 137314 - protein, 9 aa, West Nile virus
WKSAREAVE

SEQ ID NO: 137315 - protein, 9 aa, West Nile virus
KSAREAVED

SEQ ID NO: 137316 - protein, 9 aa, West Nile virus
SAREAVEDL

SEQ ID NO: 137317 - protein, 9 aa, West Nile virus
AREAVEDLK

SEQ ID NO: 137318 - protein, 9 aa, West Nile virus
RAAVEDPKF

SEQ ID NO: 137319 - protein, 9 aa, West Nile virus
EAVEDLKFW

SEQ ID NO: 137320 - protein, 9 aa, West Nile virus
AVEDQKFWE

SEQ ID NO: 137321 - protein, 9 aa, West Nile virus
VEDPKFWEI

SEQ ID NO: 137322 - protein, 9 aa, West Nile virus
EDLKFWEMV

SEQ ID NO: 137323 - protein, 9 aa, West Nile virus
DPKFWEIVD

SEQ ID NO: 137324 - protein, 9 aa, West Nile virus
LKFWEMVDE

SEQ ID NO: 137325 - protein, 9 aa, West Nile virus
KFWEIVDEE

SEQ ID NO: 137326 - protein, 9 aa, West Nile virus
FWEIVDEER

SEQ ID NO: 137327 - protein, 9 aa, West Nile virus
WEIVDEERE

SEQ ID NO: 137328 - protein, 9 aa, West Nile virus
EIVDEEREA

SEQ ID NO: 137329 - protein, 9 aa, West Nile virus
IVDEEREAH

SEQ ID NO: 137330 - protein, 9 aa, West Nile virus
EAHLRGECY

SEQ ID NO: 137331 - protein, 9 aa, West Nile virus
AHLRGECYT

SEQ ID NO: 137332 - protein, 9 aa, West Nile virus
HLRGECYTC

SEQ ID NO: 137333 - protein, 9 aa, West Nile virus
LRGECYTCI

SEQ ID NO: 137334 - protein, 9 aa, West Nile virus
RGECYTCIY

SEQ ID NO: 137335 - protein, 9 aa, West Nile virus
GECYTCIYN

SEQ ID NO: 137336 - protein, 9 aa, West Nile virus
ECYTCIYNM

SEQ ID NO: 137337 - protein, 9 aa, West Nile virus
CYTCIYNMM

SEQ ID NO: 137338 - protein, 9 aa, West Nile virus
YTCIYNMMG

SEQ ID NO: 137339 - protein, 9 aa, West Nile virus
LQKLGYVLR

SEQ ID NO: 137340 - protein, 9 aa, West Nile virus
QKLGYVLRE

SEQ ID NO: 137341 - protein, 9 aa, West Nile virus
KLGYVLREV

SEQ ID NO: 137342 - protein, 9 aa, West Nile virus
LGYVLREVG

SEQ ID NO: 137343 - protein, 9 aa, West Nile virus
GGRIYADDT

SEQ ID NO: 137344 - protein, 9 aa, West Nile virus
GRIYADDTA

SEQ ID NO: 137345 - protein, 9 aa, West Nile virus
KVYADDTAG

SEQ ID NO: 137346 - protein, 9 aa, West Nile virus
VYADDTAGW

SEQ ID NO: 137347 - protein, 9 aa, West Nile virus
AGWDTPITK

SEQ ID NO: 137348 - protein, 9 aa, West Nile virus
GWDTPITKA

SEQ ID NO: 137349 - protein, 9 aa, West Nile virus
WDTRITMTD

SEQ ID NO: 137350 - protein, 9 aa, West Nile virus
DTRITMTDL

SEQ ID NO: 137351 - protein, 9 aa, West Nile virus
TPITKADLE

SEQ ID NO: 137352 - protein, 9 aa, West Nile virus
PITKADLEN

SEQ ID NO: 137353 - protein, 9 aa, West Nile virus
AKVLELLEG

SEQ ID NO: 137354 - protein, 9 aa, West Nile virus
KVLELLEGE

SEQ ID NO: 137355 - protein, 9 aa, West Nile virus
VLELLEGEH

SEQ ID NO: 137356 - protein, 9 aa, West Nile virus
LELLEGEHR

SEQ ID NO: 137357 - protein, 9 aa, West Nile virus
ELLDREHRR

SEQ ID NO: 137358 - protein, 9 aa, West Nile virus
LLDREHRRL

SEQ ID NO: 137359 - protein, 9 aa, West Nile virus
EHRRLARSV

SEQ ID NO: 137360 - protein, 9 aa, West Nile virus
HRRLARSVI

SEQ ID NO: 137361 - protein, 9 aa, West Nile virus
RRLARSVIE

SEQ ID NO: 137362 - protein, 9 aa, West Nile virus
RLARSVIEL

SEQ ID NO: 137363 - protein, 9 aa, West Nile virus
LARSVIELT

SEQ ID NO: 137364 - protein, 9 aa, West Nile virus
ARSVIELTY

SEQ ID NO: 137365 - protein, 9 aa, West Nile virus
RSVIELTYR

SEQ ID NO: 137366 - protein, 9 aa, West Nile virus
SVIELTYRH

SEQ ID NO: 137367 - protein, 9 aa, West Nile virus
IIQLTYRHK

SEQ ID NO: 137368 - protein, 9 aa, West Nile virus
IQLTYRHKV

SEQ ID NO: 137369 - protein, 9 aa, West Nile virus
QLTYRHKVV

SEQ ID NO: 137370 - protein, 9 aa, West Nile virus
TYCHKVVKV

SEQ ID NO: 137371 - protein, 9 aa, West Nile virus
YRYKVVKVM

SEQ ID NO: 137372 - protein, 9 aa, West Nile virus
RYKVVKVMR

SEQ ID NO: 137373 - protein, 9 aa, West Nile virus
VMRPAVGGK

SEQ ID NO: 137374 - protein, 9 aa, West Nile virus
MRPAVGGKT

SEQ ID NO: 137375 - protein, 9 aa, West Nile virus
RPAVGGKTV

SEQ ID NO: 137376 - protein, 9 aa, West Nile virus
PAVGGKTVM

SEQ ID NO: 137377 - protein, 9 aa, West Nile virus
AVGGKTVMD

SEQ ID NO: 137378 - protein, 9 aa, West Nile virus
VGGKTVMDI

SEQ ID NO: 137379 - protein, 9 aa, West Nile virus
GGKTVMDII

SEQ ID NO: 137380 - protein, 9 aa, West Nile virus
GKTVMDIIS

SEQ ID NO: 137381 - protein, 9 aa, West Nile virus
KTVMDIISR

SEQ ID NO: 137382 - protein, 9 aa, West Nile virus
ALNPFSNLA

SEQ ID NO: 137383 - protein, 9 aa, West Nile virus
LNPFSNLAV

SEQ ID NO: 137384 - protein, 9 aa, West Nile virus
NPFTNLAFQ

SEQ ID NO: 137385 - protein, 9 aa, West Nile virus
PFTNLAFQL

SEQ ID NO: 137386 - protein, 9 aa, West Nile virus
FTNLAFQLG

SEQ ID NO: 137387 - protein, 9 aa, West Nile virus
SNLAVQLVR

SEQ ID NO: 137388 - protein, 9 aa, West Nile virus
NLAVQLVRR

SEQ ID NO: 137389 - protein, 9 aa, West Nile virus
LAVQLVRRR

SEQ ID NO: 137390 - protein, 9 aa, West Nile virus
AVQLVRRRE

SEQ ID NO: 137391 - protein, 9 aa, West Nile virus
RRREGEGVI

SEQ ID NO: 137392 - protein, 9 aa, West Nile virus
RREGEGVIG

SEQ ID NO: 137393 - protein, 9 aa, West Nile virus
REGEGVIGP

SEQ ID NO: 137394 - protein, 9 aa, West Nile virus
EGEGVITPD

SEQ ID NO: 137395 - protein, 9 aa, West Nile virus
GEGVIGPYD

SEQ ID NO: 137396 - protein, 9 aa, West Nile virus
EGVIGPDDI

SEQ ID NO: 137397 - protein, 9 aa, West Nile virus
GVIGPYDVE

SEQ ID NO: 137398 - protein, 9 aa, West Nile virus
KRKGPKVRT

SEQ ID NO: 137399 - protein, 9 aa, West Nile virus
RKGPKVRTW

SEQ ID NO: 137400 - protein, 9 aa, West Nile virus
GPKVRTWLS

SEQ ID NO: 137401 - protein, 9 aa, West Nile virus
PKVRTWLSE

SEQ ID NO: 137402 - protein, 9 aa, West Nile virus
KVRTWLSEN

SEQ ID NO: 137403 - protein, 9 aa, West Nile virus
VRTWLSENG

SEQ ID NO: 137404 - protein, 9 aa, West Nile virus
RTWLSENGE

SEQ ID NO: 137405 - protein, 9 aa, West Nile virus
TWLSENGEE

SEQ ID NO: 137406 - protein, 9 aa, West Nile virus
FENGEERLG

SEQ ID NO: 137407 - protein, 9 aa, West Nile virus
NGEERLGRM

SEQ ID NO: 137408 - protein, 9 aa, West Nile virus
GKERLGRMA

SEQ ID NO: 137409 - protein, 9 aa, West Nile virus
EERLGRMAV

SEQ ID NO: 137410 - protein, 9 aa, West Nile virus
PLDDRFASS

SEQ ID NO: 137411 - protein, 9 aa, West Nile virus
LDDRFASSL

SEQ ID NO: 137412 - protein, 9 aa, West Nile virus
DDRFASSLH

SEQ ID NO: 137413 - protein, 9 aa, West Nile virus
DRFASSLHF

SEQ ID NO: 137414 - protein, 9 aa, West Nile virus
RFAISLHFL

SEQ ID NO: 137415 - protein, 9 aa, West Nile virus
FASSLHFLN

SEQ ID NO: 137416 - protein, 9 aa, West Nile virus
ATSLHFLND

SEQ ID NO: 137417 - protein, 9 aa, West Nile virus
TSLHFLNDM

SEQ ID NO: 137418 - protein, 9 aa, West Nile virus
SLHFLNAMP

SEQ ID NO: 137419 - protein, 9 aa, West Nile virus
LHFLNAMPK

SEQ ID NO: 137420 - protein, 9 aa, West Nile virus
HFLNAMSQV

SEQ ID NO: 137421 - protein, 9 aa, West Nile virus
FLNAMPKVR

SEQ ID NO: 137422 - protein, 9 aa, West Nile virus
LNDMSKVRK

SEQ ID NO: 137423 - protein, 9 aa, West Nile virus
NAMSQVRKD

SEQ ID NO: 137424 - protein, 9 aa, West Nile virus
AMSQVRKDI

SEQ ID NO: 137425 - protein, 9 aa, West Nile virus
AICSAVPAN

SEQ ID NO: 137426 - protein, 9 aa, West Nile virus
ICSAVPANW

SEQ ID NO: 137427 - protein, 9 aa, West Nile virus
CSAVPANWV

SEQ ID NO: 137428 - protein, 9 aa, West Nile virus
SAVPANWVP

SEQ ID NO: 137429 - protein, 9 aa, West Nile virus
AVPANWVPT

SEQ ID NO: 137430 - protein, 9 aa, West Nile virus
VPANWVPTG

SEQ ID NO: 137431 - protein, 9 aa, West Nile virus
PANWVPTGR

SEQ ID NO: 137432 - protein, 9 aa, West Nile virus
ANWVPTGRT

SEQ ID NO: 137433 - protein, 9 aa, West Nile virus
DWVPTGRTT

SEQ ID NO: 137434 - protein, 9 aa, West Nile virus
RTTWSIHAR

SEQ ID NO: 137435 - protein, 9 aa, West Nile virus
TTWSIHARG

SEQ ID NO: 137436 - protein, 9 aa, West Nile virus
TWSIHARGE

SEQ ID NO: 137437 - protein, 9 aa, West Nile virus
WSIHARGEW

SEQ ID NO: 137438 - protein, 9 aa, West Nile virus
SIHARGEWM

SEQ ID NO: 137439 - protein, 9 aa, West Nile virus
IHARGEWMT

SEQ ID NO: 137440 - protein, 9 aa, West Nile virus
HARGEWMTT

SEQ ID NO: 137441 - protein, 9 aa, West Nile virus
ARGEWMTTA

SEQ ID NO: 137442 - protein, 9 aa, West Nile virus
RGEWMTTAD

SEQ ID NO: 137443 - protein, 9 aa, West Nile virus
WMTTADMLG

SEQ ID NO: 137444 - protein, 9 aa, West Nile virus
MTTADMLGV

SEQ ID NO: 137445 - protein, 9 aa, West Nile virus
TTADMLGVW

SEQ ID NO: 137446 - protein, 9 aa, West Nile virus
TADMLGVWN

SEQ ID NO: 137447 - protein, 9 aa, West Nile virus
ADMLGVWNR

SEQ ID NO: 137448 - protein, 9 aa, West Nile virus
DMLGVWNRV

SEQ ID NO: 137449 - protein, 9 aa, West Nile virus
MLGVWNRVW

SEQ ID NO: 137450 - protein, 9 aa, West Nile virus
LGVWNRVWI

SEQ ID NO: 137451 - protein, 9 aa, West Nile virus
GVWNRVWIE

SEQ ID NO: 137452 - protein, 9 aa, West Nile virus
TPVERWSDI

SEQ ID NO: 137453 - protein, 9 aa, West Nile virus
PVERWSDIP

SEQ ID NO: 137454 - protein, 9 aa, West Nile virus
VERWSDIPY

SEQ ID NO: 137455 - protein, 9 aa, West Nile virus
ERWSDIPYS

SEQ ID NO: 137456 - protein, 9 aa, West Nile virus
RWSDIPYSG

SEQ ID NO: 137457 - protein, 9 aa, West Nile virus
CGSLIGTRS

SEQ ID NO: 137458 - protein, 9 aa, West Nile virus
GSLIGTRSR

SEQ ID NO: 137459 - protein, 9 aa, West Nile virus
SLIGTRSRA

SEQ ID NO: 137460 - protein, 9 aa, West Nile virus
LIGTRSRAT

SEQ ID NO: 137461 - protein, 9 aa, West Nile virus
IGTRSRATW

SEQ ID NO: 137462 - protein, 9 aa, West Nile virus
GTRSRATWA

SEQ ID NO: 137463 - protein, 9 aa, West Nile virus
TRSRATWAE

SEQ ID NO: 137464 - protein, 9 aa, West Nile virus
RSRATWAEN

SEQ ID NO: 137465 - protein, 9 aa, West Nile virus
SRATWAENI

SEQ ID NO: 137466 - protein, 9 aa, West Nile virus
IQVAINQVK

SEQ ID NO: 137467 - protein, 9 aa, West Nile virus
QVAINQVRS

SEQ ID NO: 137468 - protein, 9 aa, West Nile virus
IIGEEKYVD

SEQ ID NO: 137469 - protein, 9 aa, West Nile virus
EEKYVDYMG

SEQ ID NO: 137470 - protein, 9 aa, West Nile virus
YVDYMGSLK

SEQ ID NO: 137471 - protein, 9 aa, West Nile virus
VDYMGSLKR

SEQ ID NO: 137472 - protein, 9 aa, West Nile virus
DYMGSLKRY

SEQ ID NO: 137473 - protein, 9 aa, West Nile virus
YMGSLKRYE

SEQ ID NO: 137474 - protein, 9 aa, West Nile virus
MGSLKRYEE

SEQ ID NO: 137475 - protein, 9 aa, West Nile virus
AVNMLKRGK

SEQ ID NO: 137476 - protein, 9 aa, West Nile virus
VNMLKRGKP

SEQ ID NO: 137477 - protein, 9 aa, West Nile virus
NMLKRGTPR

SEQ ID NO: 137478 - protein, 9 aa, West Nile virus
KRGMPRVMS

SEQ ID NO: 137479 - protein, 9 aa, West Nile virus
RGKPRVLSL

SEQ ID NO: 137480 - protein, 9 aa, West Nile virus
PRGGSLMGL

SEQ ID NO: 137481 - protein, 9 aa, West Nile virus
RVMSLIGLK

SEQ ID NO: 137482 - protein, 9 aa, West Nile virus
GGSLMGLKR

SEQ ID NO: 137483 - protein, 9 aa, West Nile virus
SLIDGKGPT

SEQ ID NO: 137484 - protein, 9 aa, West Nile virus
LIDGKGPTR

SEQ ID NO: 137485 - protein, 9 aa, West Nile virus
IDGKGPVRF

SEQ ID NO: 137486 - protein, 9 aa, West Nile virus
DGKGPTRFV

SEQ ID NO: 137487 - protein, 9 aa, West Nile virus
GKGPTRFVL

SEQ ID NO: 137488 - protein, 9 aa, West Nile virus
KGPVRFVLA

SEQ ID NO: 137489 - protein, 9 aa, West Nile virus
VRFVLALLA

SEQ ID NO: 137490 - protein, 9 aa, West Nile virus
LAFFRFTAV

SEQ ID NO: 137491 - protein, 9 aa, West Nile virus
VFFRFTAIA

SEQ ID NO: 137492 - protein, 9 aa, West Nile virus
VAPTRAVLD

SEQ ID NO: 137493 - protein, 9 aa, West Nile virus
RAVLERWRG

SEQ ID NO: 137494 - protein, 9 aa, West Nile virus
AVLERWRGV

SEQ ID NO: 137495 - protein, 9 aa, West Nile virus
LLDRWRGVN

SEQ ID NO: 137496 - protein, 9 aa, West Nile virus
LNRWRGVNK

SEQ ID NO: 137497 - protein, 9 aa, West Nile virus
NRWRGVNKQ

SEQ ID NO: 137498 - protein, 9 aa, West Nile virus
KKELGILTN

SEQ ID NO: 137499 - protein, 9 aa, West Nile virus
RELGTLTSA

SEQ ID NO: 137500 - protein, 9 aa, West Nile virus
ELGALTSAI

SEQ ID NO: 137501 - protein, 9 aa, West Nile virus
LGTLTNAMN

SEQ ID NO: 137502 - protein, 9 aa, West Nile virus
GTLTNAMNR

SEQ ID NO: 137503 - protein, 9 aa, West Nile virus
ILTNAISRR

SEQ ID NO: 137504 - protein, 9 aa, West Nile virus
NRRSSKEKK

SEQ ID NO: 137505 - protein, 9 aa, West Nile virus
RRSSKEKKR

SEQ ID NO: 137506 - protein, 9 aa, West Nile virus
RSAKQKKRG

SEQ ID NO: 137507 - protein, 9 aa, West Nile virus
SSKEKKRGG

SEQ ID NO: 137508 - protein, 9 aa, West Nile virus
KKKKRGGSI

SEQ ID NO: 137509 - protein, 9 aa, West Nile virus
EKKRGGKTG

SEQ ID NO: 137510 - protein, 9 aa, West Nile virus
KKRGGSIGV

SEQ ID NO: 137511 - protein, 9 aa, West Nile virus
RAVTLSNFQ

SEQ ID NO: 137512 - protein, 9 aa, West Nile virus
AVTLSDFQG

SEQ ID NO: 137513 - protein, 9 aa, West Nile virus
FQGKLMMTV

SEQ ID NO: 137514 - protein, 9 aa, West Nile virus
QGKVMMTIN

SEQ ID NO: 137515 - protein, 9 aa, West Nile virus
GKLMMTVNA

SEQ ID NO: 137516 - protein, 9 aa, West Nile virus
KLMMTVNAT

SEQ ID NO: 137517 - protein, 9 aa, West Nile virus
LMMTINATE

SEQ ID NO: 137518 - protein, 9 aa, West Nile virus
MMTINATDT

SEQ ID NO: 137519 - protein, 9 aa, West Nile virus
MTINATETT

SEQ ID NO: 137520 - protein, 9 aa, West Nile virus
VITIPIASG

SEQ ID NO: 137521 - protein, 9 aa, West Nile virus
PAAGKNLCI

SEQ ID NO: 137522 - protein, 9 aa, West Nile virus
ASGKNLCTV

SEQ ID NO: 137523 - protein, 9 aa, West Nile virus
AGKNLCTVR

SEQ ID NO: 137524 - protein, 9 aa, West Nile virus
TVRAMDVGY

SEQ ID NO: 137525 - protein, 9 aa, West Nile virus
VRAMDVGHM

SEQ ID NO: 137526 - protein, 9 aa, West Nile virus
RAMDVGHMC

SEQ ID NO: 137527 - protein, 9 aa, West Nile virus
AMDVGHMCD

SEQ ID NO: 137528 - protein, 9 aa, West Nile virus
MDVGHMCDD

SEQ ID NO: 137529 - protein, 9 aa, West Nile virus
DVGHMCDDT

SEQ ID NO: 137530 - protein, 9 aa, West Nile virus
VGHMCDDTI

SEQ ID NO: 137531 - protein, 9 aa, West Nile virus
GHMCDDTIT

SEQ ID NO: 137532 - protein, 9 aa, West Nile virus
HMCDDTITY

SEQ ID NO: 137533 - protein, 9 aa, West Nile virus
ITYECSVLS

SEQ ID NO: 137534 - protein, 9 aa, West Nile virus
TYECPALAA

SEQ ID NO: 137535 - protein, 9 aa, West Nile virus
YECPALAAG

SEQ ID NO: 137536 - protein, 9 aa, West Nile virus
ECSVLSAGN

SEQ ID NO: 137537 - protein, 9 aa, West Nile virus
CPALAAGND

SEQ ID NO: 137538 - protein, 9 aa, West Nile virus
SVLSAGNDP

SEQ ID NO: 137539 - protein, 9 aa, West Nile virus
VDCWCTKSA

SEQ ID NO: 137540 - protein, 9 aa, West Nile virus
DCWCTKSPV

SEQ ID NO: 137541 - protein, 9 aa, West Nile virus
AMYVRYGRC

SEQ ID NO: 137542 - protein, 9 aa, West Nile virus
KTRQSRRSR

SEQ ID NO: 137543 - protein, 9 aa, West Nile virus
QTHGESTLV

SEQ ID NO: 137544 - protein, 9 aa, West Nile virus
THGKSTLAN

SEQ ID NO: 137545 - protein, 9 aa, West Nile virus
HGKSTLANK

SEQ ID NO: 137546 - protein, 9 aa, West Nile virus
GESTLVNKK

SEQ ID NO: 137547 - protein, 9 aa, West Nile virus
KSTLANKKG

SEQ ID NO: 137548 - protein, 9 aa, West Nile virus
LSNKKGAWM

SEQ ID NO: 137549 - protein, 9 aa, West Nile virus
SNKKGAWMD

SEQ ID NO: 137550 - protein, 9 aa, West Nile virus
NTMQRVVFI

SEQ ID NO: 137551 - protein, 9 aa, West Nile virus
MQRVVFAVL

SEQ ID NO: 137552 - protein, 9 aa, West Nile virus
QRVVFAVLL

SEQ ID NO: 137553 - protein, 9 aa, West Nile virus
RVVFMILLL

SEQ ID NO: 137554 - protein, 9 aa, West Nile virus
VVFMILLLL

SEQ ID NO: 137555 - protein, 9 aa, West Nile virus
VFMILLLLV

SEQ ID NO: 137556 - protein, 9 aa, West Nile virus
FAVLLLLVA

SEQ ID NO: 137557 - protein, 9 aa, West Nile virus
AVLLLLVAP

SEQ ID NO: 137558 - protein, 9 aa, West Nile virus
SCVTITAKD

SEQ ID NO: 137559 - protein, 9 aa, West Nile virus
CVTIMSKNK

SEQ ID NO: 137560 - protein, 9 aa, West Nile virus
VTLMSKDKP

SEQ ID NO: 137561 - protein, 9 aa, West Nile virus
TITAKDRPT

SEQ ID NO: 137562 - protein, 9 aa, West Nile virus
LMSKDKPTI

SEQ ID NO: 137563 - protein, 9 aa, West Nile virus
TIDVKMMNV

SEQ ID NO: 137564 - protein, 9 aa, West Nile virus
IDVKMTNME

SEQ ID NO: 137565 - protein, 9 aa, West Nile virus
DVKMMKMEA

SEQ ID NO: 137566 - protein, 9 aa, West Nile virus
EVRSYCHLA

SEQ ID NO: 137567 - protein, 9 aa, West Nile virus
VSELSTKAA

SEQ ID NO: 137568 - protein, 9 aa, West Nile virus
SELSTKAAC

SEQ ID NO: 137569 - protein, 9 aa, West Nile virus
ELSTKAACP

SEQ ID NO: 137570 - protein, 9 aa, West Nile virus
LSTKAACPA

SEQ ID NO: 137571 - protein, 9 aa, West Nile virus
STKAACPAM

SEQ ID NO: 137572 - protein, 9 aa, West Nile virus
PRAACPTMG

SEQ ID NO: 137573 - protein, 9 aa, West Nile virus
KAACPTMGD

SEQ ID NO: 137574 - protein, 9 aa, West Nile virus
AHNDKRADS

SEQ ID NO: 137575 - protein, 9 aa, West Nile virus
YFCKQGVVD

SEQ ID NO: 137576 - protein, 9 aa, West Nile virus
TCARFACST

SEQ ID NO: 137577 - protein, 9 aa, West Nile virus
CARFACSTK

SEQ ID NO: 137578 - protein, 9 aa, West Nile virus
AKFACTSKA

SEQ ID NO: 137579 - protein, 9 aa, West Nile virus
KFTCSNKAT

SEQ ID NO: 137580 - protein, 9 aa, West Nile virus
FTCSNKATG

SEQ ID NO: 137581 - protein, 9 aa, West Nile virus
TCSNKATGL

SEQ ID NO: 137582 - protein, 9 aa, West Nile virus
CSNKATGLT

SEQ ID NO: 137583 - protein, 9 aa, West Nile virus
SNKATGLTI

SEQ ID NO: 137584 - protein, 9 aa, West Nile virus
NKATGLTIQ

SEQ ID NO: 137585 - protein, 9 aa, West Nile virus
KATGLTIQR

SEQ ID NO: 137586 - protein, 9 aa, West Nile virus
ATGLTIQRE

SEQ ID NO: 137587 - protein, 9 aa, West Nile virus
TGLTIQREN

SEQ ID NO: 137588 - protein, 9 aa, West Nile virus
GAAQAGRFS

SEQ ID NO: 137589 - protein, 9 aa, West Nile virus
ATQAGRLSI

SEQ ID NO: 137590 - protein, 9 aa, West Nile virus
TQAGRLSIT

SEQ ID NO: 137591 - protein, 9 aa, West Nile virus
QAGRFSVTP

SEQ ID NO: 137592 - protein, 9 aa, West Nile virus
AGRLSITPA

SEQ ID NO: 137593 - protein, 9 aa, West Nile virus
GRLSITPAA

SEQ ID NO: 137594 - protein, 9 aa, West Nile virus
RLSITPAAP

SEQ ID NO: 137595 - protein, 9 aa, West Nile virus
LSITPAAPS

SEQ ID NO: 137596 - protein, 9 aa, West Nile virus
SITPAAPSH

SEQ ID NO: 137597 - protein, 9 aa, West Nile virus
ITPAAPSHT

SEQ ID NO: 137598 - protein, 9 aa, West Nile virus
KLGGYGEVT

SEQ ID NO: 137599 - protein, 9 aa, West Nile virus
LGGYGEVTV

SEQ ID NO: 137600 - protein, 9 aa, West Nile virus
GDYGEVTID

SEQ ID NO: 137601 - protein, 9 aa, West Nile virus
GYGEVTVDC

SEQ ID NO: 137602 - protein, 9 aa, West Nile virus
DTSAYYVMT

SEQ ID NO: 137603 - protein, 9 aa, West Nile virus
TSAYYVMTV

SEQ ID NO: 137604 - protein, 9 aa, West Nile virus
SAYYVMTVG

SEQ ID NO: 137605 - protein, 9 aa, West Nile virus
NLPWSSAGG

SEQ ID NO: 137606 - protein, 9 aa, West Nile virus
LPWSSAGGT

SEQ ID NO: 137607 - protein, 9 aa, West Nile virus
WRNRETFME

SEQ ID NO: 137608 - protein, 9 aa, West Nile virus
RNRETFMEF

SEQ ID NO: 137609 - protein, 9 aa, West Nile virus
NRETFMEFE

SEQ ID NO: 137610 - protein, 9 aa, West Nile virus
RGTLMEFEE

SEQ ID NO: 137611 - protein, 9 aa, West Nile virus
GTLMEFEEP

SEQ ID NO: 137612 - protein, 9 aa, West Nile virus
ALAGTIPVE

SEQ ID NO: 137613 - protein, 9 aa, West Nile virus
LAGTIPVEF

SEQ ID NO: 137614 - protein, 9 aa, West Nile virus
AGAIPLEFS

SEQ ID NO: 137615 - protein, 9 aa, West Nile virus
GTIPVEFSS

SEQ ID NO: 137616 - protein, 9 aa, West Nile virus
AIPLEFSSN

SEQ ID NO: 137617 - protein, 9 aa, West Nile virus
VSFTSNTVK

SEQ ID NO: 137618 - protein, 9 aa, West Nile virus
TVNPFVSMA

SEQ ID NO: 137619 - protein, 9 aa, West Nile virus
VNPFVSVAA

SEQ ID NO: 137620 - protein, 9 aa, West Nile virus
NPFVSMATA

SEQ ID NO: 137621 - protein, 9 aa, West Nile virus
AANAKVLIE

SEQ ID NO: 137622 - protein, 9 aa, West Nile virus
ADAKVLIEL

SEQ ID NO: 137623 - protein, 9 aa, West Nile virus
DAKVLIELE

SEQ ID NO: 137624 - protein, 9 aa, West Nile virus
EQQINHHWY

SEQ ID NO: 137625 - protein, 9 aa, West Nile virus
HQINHHWHK

SEQ ID NO: 137626 - protein, 9 aa, West Nile virus
NHHWHKSGI

SEQ ID NO: 137627 - protein, 9 aa, West Nile virus
GKAFTATLK

SEQ ID NO: 137628 - protein, 9 aa, West Nile virus
KAFTATLKG

SEQ ID NO: 137629 - protein, 9 aa, West Nile virus
AFTATLKGA

SEQ ID NO: 137630 - protein, 9 aa, West Nile virus
FTATLKGAQ

SEQ ID NO: 137631 - protein, 9 aa, West Nile virus
TATLKGAQR

SEQ ID NO: 137632 - protein, 9 aa, West Nile virus
ATLKGAQRL

SEQ ID NO: 137633 - protein, 9 aa, West Nile virus
FGSVGGIFT

SEQ ID NO: 137634 - protein, 9 aa, West Nile virus
GSVGGIFTS

SEQ ID NO: 137635 - protein, 9 aa, West Nile virus
SVGGIFTSF

SEQ ID NO: 137636 - protein, 9 aa, West Nile virus
VGGVLTSVG

SEQ ID NO: 137637 - protein, 9 aa, West Nile virus
VLTSVGQAI

SEQ ID NO: 137638 - protein, 9 aa, West Nile virus
LTSVGQAIH

SEQ ID NO: 137639 - protein, 9 aa, West Nile virus
TSVGQAIHQ

SEQ ID NO: 137640 - protein, 9 aa, West Nile virus
SFGKAVHQV

SEQ ID NO: 137641 - protein, 9 aa, West Nile virus
FGKAVHQVF

SEQ ID NO: 137642 - protein, 9 aa, West Nile virus
LLLWMGISA

SEQ ID NO: 137643 - protein, 9 aa, West Nile virus
LLWMGVNAR

SEQ ID NO: 137644 - protein, 9 aa, West Nile virus
VWMGINARD

SEQ ID NO: 137645 - protein, 9 aa, West Nile virus
WMGVNARDR

SEQ ID NO: 137646 - protein, 9 aa, West Nile virus
MGINARDKS

SEQ ID NO: 137647 - protein, 9 aa, West Nile virus
GINARDKSI

SEQ ID NO: 137648 - protein, 9 aa, West Nile virus
INARDKSIA

SEQ ID NO: 137649 - protein, 9 aa, West Nile virus
NSRDRSIAL

SEQ ID NO: 137650 - protein, 9 aa, West Nile virus
SRDRSIALT

SEQ ID NO: 137651 - protein, 9 aa, West Nile virus
LTFLAVGGI

SEQ ID NO: 137652 - protein, 9 aa, West Nile virus
GILLFLSAN

SEQ ID NO: 137653 - protein, 9 aa, West Nile virus
VLLFLSINV

SEQ ID NO: 137654 - protein, 9 aa, West Nile virus
DTGCAIDVG

SEQ ID NO: 137655 - protein, 9 aa, West Nile virus
TGCAINITR

SEQ ID NO: 137656 - protein, 9 aa, West Nile virus
GCAIDVSRQ

SEQ ID NO: 137657 - protein, 9 aa, West Nile virus
CAIDVGRQE

SEQ ID NO: 137658 - protein, 9 aa, West Nile virus
AIDVGRQEL

SEQ ID NO: 137659 - protein, 9 aa, West Nile virus
IDVSRQELR

SEQ ID NO: 137660 - protein, 9 aa, West Nile virus
NITRQELRC

SEQ ID NO: 137661 - protein, 9 aa, West Nile virus
VSRQELRCG

SEQ ID NO: 137662 - protein, 9 aa, West Nile virus
TRQELRCGS

SEQ ID NO: 137663 - protein, 9 aa, West Nile virus
NDVEAWTDR

SEQ ID NO: 137664 - protein, 9 aa, West Nile virus
DVEAWTDRY

SEQ ID NO: 137665 - protein, 9 aa, West Nile virus
VEAWTDRYK

SEQ ID NO: 137666 - protein, 9 aa, West Nile virus
DRYKYHPET

SEQ ID NO: 137667 - protein, 9 aa, West Nile virus
RYKYHPETP

SEQ ID NO: 137668 - protein, 9 aa, West Nile virus
YKYHPETPQ

SEQ ID NO: 137669 - protein, 9 aa, West Nile virus
KFHPETPQG

SEQ ID NO: 137670 - protein, 9 aa, West Nile virus
FHPETPQGL

SEQ ID NO: 137671 - protein, 9 aa, West Nile virus
PQGLARVIQ

SEQ ID NO: 137672 - protein, 9 aa, West Nile virus
QGLARVIQK

SEQ ID NO: 137673 - protein, 9 aa, West Nile virus
GLARIIQKA

SEQ ID NO: 137674 - protein, 9 aa, West Nile virus
LARVIQKAH

SEQ ID NO: 137675 - protein, 9 aa, West Nile virus
SGTCGIRSV

SEQ ID NO: 137676 - protein, 9 aa, West Nile virus
GTCGIRSVS

SEQ ID NO: 137677 - protein, 9 aa, West Nile virus
VCGLRSASR

SEQ ID NO: 137678 - protein, 9 aa, West Nile virus
LEHQMWESI

SEQ ID NO: 137679 - protein, 9 aa, West Nile virus
EHQMWESIK

SEQ ID NO: 137680 - protein, 9 aa, West Nile virus
HQMWESIKD

SEQ ID NO: 137681 - protein, 9 aa, West Nile virus
QMWESIKDE

SEQ ID NO: 137682 - protein, 9 aa, West Nile virus
MWESIKDEL

SEQ ID NO: 137683 - protein, 9 aa, West Nile virus
WESIKDELN

SEQ ID NO: 137684 - protein, 9 aa, West Nile virus
ESIKDELNT

SEQ ID NO: 137685 - protein, 9 aa, West Nile virus
SIKDELNTL

SEQ ID NO: 137686 - protein, 9 aa, West Nile virus
PLKENGVDL

SEQ ID NO: 137687 - protein, 9 aa, West Nile virus
FRENGIDLS

SEQ ID NO: 137688 - protein, 9 aa, West Nile virus
RENGIDLSM

SEQ ID NO: 137689 - protein, 9 aa, West Nile virus
ENGVDLTVV

SEQ ID NO: 137690 - protein, 9 aa, West Nile virus
NGVDLTVVV

SEQ ID NO: 137691 - protein, 9 aa, West Nile virus
GVDLTVVVE

SEQ ID NO: 137692 - protein, 9 aa, West Nile virus
VDLTVVVEK

SEQ ID NO: 137693 - protein, 9 aa, West Nile virus
DLSMVVEKQ

SEQ ID NO: 137694 - protein, 9 aa, West Nile virus
ATSEKLEIG

SEQ ID NO: 137695 - protein, 9 aa, West Nile virus
TTEKFEIGW

SEQ ID NO: 137696 - protein, 9 aa, West Nile virus
TEKFEIGWK

SEQ ID NO: 137697 - protein, 9 aa, West Nile virus
EKFEIGWKA

SEQ ID NO: 137698 - protein, 9 aa, West Nile virus
KSIIFAPEI

SEQ ID NO: 137699 - protein, 9 aa, West Nile virus
SILFAPEIA

SEQ ID NO: 137700 - protein, 9 aa, West Nile virus
IMFASELAN

SEQ ID NO: 137701 - protein, 9 aa, West Nile virus
FASELANHT

SEQ ID NO: 137702 - protein, 9 aa, West Nile virus
APELANSTF

SEQ ID NO: 137703 - protein, 9 aa, West Nile virus
PELANSTFV

SEQ ID NO: 137704 - protein, 9 aa, West Nile virus
EIANNTFVV

SEQ ID NO: 137705 - protein, 9 aa, West Nile virus
IANNTFVVD

SEQ ID NO: 137706 - protein, 9 aa, West Nile virus
ANSTFVVDG

SEQ ID NO: 137707 - protein, 9 aa, West Nile virus
NNTFVVDGS

SEQ ID NO: 137708 - protein, 9 aa, West Nile virus
NTFVVDGSE

SEQ ID NO: 137709 - protein, 9 aa, West Nile virus
FVVDGSETR

SEQ ID NO: 137710 - protein, 9 aa, West Nile virus
VVDGSETRE

SEQ ID NO: 137711 - protein, 9 aa, West Nile virus
VDGSETREC

SEQ ID NO: 137712 - protein, 9 aa, West Nile virus
GSETRECPT

SEQ ID NO: 137713 - protein, 9 aa, West Nile virus
SRAWNSMEV

SEQ ID NO: 137714 - protein, 9 aa, West Nile virus
LMTTRMFLK

SEQ ID NO: 137715 - protein, 9 aa, West Nile virus
VREGNTTEC

SEQ ID NO: 137716 - protein, 9 aa, West Nile virus
REVNTTECD

SEQ ID NO: 137717 - protein, 9 aa, West Nile virus
GNTTECDSK

SEQ ID NO: 137718 - protein, 9 aa, West Nile virus
DSKIIGTAI

SEQ ID NO: 137719 - protein, 9 aa, West Nile virus
SKIIGTAIK

SEQ ID NO: 137720 - protein, 9 aa, West Nile virus
LSYWIESGF

SEQ ID NO: 137721 - protein, 9 aa, West Nile virus
SYWIESGFN

SEQ ID NO: 137722 - protein, 9 aa, West Nile virus
FNETWKLER

SEQ ID NO: 137723 - protein, 9 aa, West Nile virus
THTLWGEGV

SEQ ID NO: 137724 - protein, 9 aa, West Nile virus
HTLWGEGVQ

SEQ ID NO: 137725 - protein, 9 aa, West Nile virus
TLWGEGVQE

SEQ ID NO: 137726 - protein, 9 aa, West Nile virus
LWGEGVQES

SEQ ID NO: 137727 - protein, 9 aa, West Nile virus
GVIESELII

SEQ ID NO: 137728 - protein, 9 aa, West Nile virus
VIESELIIP

SEQ ID NO: 137729 - protein, 9 aa, West Nile virus
ESELIIPIT

SEQ ID NO: 137730 - protein, 9 aa, West Nile virus
SDLIIPATL

SEQ ID NO: 137731 - protein, 9 aa, West Nile virus
ELIIPITLA

SEQ ID NO: 137732 - protein, 9 aa, West Nile virus
IPATLAGPR

SEQ ID NO: 137733 - protein, 9 aa, West Nile virus
PATLAGPRS

SEQ ID NO: 137734 - protein, 9 aa, West Nile virus
ATLAGPRSN

SEQ ID NO: 137735 - protein, 9 aa, West Nile virus
CEHRGPAAR

SEQ ID NO: 137736 - protein, 9 aa, West Nile virus
EHRGPAART

SEQ ID NO: 137737 - protein, 9 aa, West Nile virus
HRGPSARTT

SEQ ID NO: 137738 - protein, 9 aa, West Nile virus
RGASTRTTT

SEQ ID NO: 137739 - protein, 9 aa, West Nile virus
GPSARTTTE

SEQ ID NO: 137740 - protein, 9 aa, West Nile virus
ASTRTTTDS

SEQ ID NO: 137741 - protein, 9 aa, West Nile virus
STRTTTDSG

SEQ ID NO: 137742 - protein, 9 aa, West Nile virus
CTLPPLRFK

SEQ ID NO: 137743 - protein, 9 aa, West Nile virus
TLPPLRFKT

SEQ ID NO: 137744 - protein, 9 aa, West Nile virus
LPPLRFQTR

SEQ ID NO: 137745 - protein, 9 aa, West Nile virus
TDNGCWYGM

SEQ ID NO: 137746 - protein, 9 aa, West Nile virus
DNGCWYGME

SEQ ID NO: 137747 - protein, 9 aa, West Nile virus
YGMEIRPLK

SEQ ID NO: 137748 - protein, 9 aa, West Nile virus
GMEIRPQKH

SEQ ID NO: 137749 - protein, 9 aa, West Nile virus
MEIRPQKHD

SEQ ID NO: 137750 - protein, 9 aa, West Nile virus
EIRPQKHDE

SEQ ID NO: 137751 - protein, 9 aa, West Nile virus
IRPQRHDGK

SEQ ID NO: 137752 - protein, 9 aa, West Nile virus
RPQKHDERT

SEQ ID NO: 137753 - protein, 9 aa, West Nile virus
PQKHDERTL

SEQ ID NO: 137754 - protein, 9 aa, West Nile virus
LKHDEKTLV

SEQ ID NO: 137755 - protein, 9 aa, West Nile virus
DERTLVQSQ

SEQ ID NO: 137756 - protein, 9 aa, West Nile virus
GKTLVQSQV

SEQ ID NO: 137757 - protein, 9 aa, West Nile virus
RTLVQSQVN

SEQ ID NO: 137758 - protein, 9 aa, West Nile virus
LVQSRVNAH

SEQ ID NO: 137759 - protein, 9 aa, West Nile virus
VQSRVNAHN

SEQ ID NO: 137760 - protein, 9 aa, West Nile virus
QSRVNAHNA

SEQ ID NO: 137761 - protein, 9 aa, West Nile virus
SRVSAYKSD

SEQ ID NO: 137762 - protein, 9 aa, West Nile virus
RVSAYKSDM

SEQ ID NO: 137763 - protein, 9 aa, West Nile virus
VSAYKSDMI

SEQ ID NO: 137764 - protein, 9 aa, West Nile virus
NAHNADMID

SEQ ID NO: 137765 - protein, 9 aa, West Nile virus
LGLLIVFLA

SEQ ID NO: 137766 - protein, 9 aa, West Nile virus
GLLIVFLAT

SEQ ID NO: 137767 - protein, 9 aa, West Nile virus
LLIVFLATQ

SEQ ID NO: 137768 - protein, 9 aa, West Nile virus
LVVFLATKE

SEQ ID NO: 137769 - protein, 9 aa, West Nile virus
IVFLATQEV

SEQ ID NO: 137770 - protein, 9 aa, West Nile virus
KRWTAKISL

SEQ ID NO: 137771 - protein, 9 aa, West Nile virus
RWTAKISLP

SEQ ID NO: 137772 - protein, 9 aa, West Nile virus
WTAKISLPA

SEQ ID NO: 137773 - protein, 9 aa, West Nile virus
TAKISLPAI

SEQ ID NO: 137774 - protein, 9 aa, West Nile virus
PAIMIALLV

SEQ ID NO: 137775 - protein, 9 aa, West Nile virus
AILLALLVL

SEQ ID NO: 137776 - protein, 9 aa, West Nile virus
IMIALLVLV

SEQ ID NO: 137777 - protein, 9 aa, West Nile virus
MIALLVLVL

SEQ ID NO: 137778 - protein, 9 aa, West Nile virus
IALLVLVLG

SEQ ID NO: 137779 - protein, 9 aa, West Nile virus
LLVLVFGGV

SEQ ID NO: 137780 - protein, 9 aa, West Nile virus
LVLVFGGVT

SEQ ID NO: 137781 - protein, 9 aa, West Nile virus
LVFGGITYI

SEQ ID NO: 137782 - protein, 9 aa, West Nile virus
VFGGITYID

SEQ ID NO: 137783 - protein, 9 aa, West Nile virus
FGGITYADV

SEQ ID NO: 137784 - protein, 9 aa, West Nile virus
GGITYIDVL

SEQ ID NO: 137785 - protein, 9 aa, West Nile virus
GVTYTDVLR

SEQ ID NO: 137786 - protein, 9 aa, West Nile virus
VTYTDVLRY

SEQ ID NO: 137787 - protein, 9 aa, West Nile virus
TYADVLRYV

SEQ ID NO: 137788 - protein, 9 aa, West Nile virus
YADVLRYVI

SEQ ID NO: 137789 - protein, 9 aa, West Nile virus
ADVLRYVIL

SEQ ID NO: 137790 - protein, 9 aa, West Nile virus
DVLRYVILA

SEQ ID NO: 137791 - protein, 9 aa, West Nile virus
VLRYIILVG

SEQ ID NO: 137792 - protein, 9 aa, West Nile virus
LRYVNLVGA

SEQ ID NO: 137793 - protein, 9 aa, West Nile virus
MATFRIQPV

SEQ ID NO: 137794 - protein, 9 aa, West Nile virus
ATFRIQPVF

SEQ ID NO: 137795 - protein, 9 aa, West Nile virus
VQPVFMVAS

SEQ ID NO: 137796 - protein, 9 aa, West Nile virus
QPVFMVATF

SEQ ID NO: 137797 - protein, 9 aa, West Nile virus
PVFVVASFL

SEQ ID NO: 137798 - protein, 9 aa, West Nile virus
VFVVASFLK

SEQ ID NO: 137799 - protein, 9 aa, West Nile virus
FMVASFLRA

SEQ ID NO: 137800 - protein, 9 aa, West Nile virus
VASFLKAGW

SEQ ID NO: 137801 - protein, 9 aa, West Nile virus
ATFVKARWT

SEQ ID NO: 137802 - protein, 9 aa, West Nile virus
SFLRARWTN

SEQ ID NO: 137803 - protein, 9 aa, West Nile virus
RWTNHENIL

SEQ ID NO: 137804 - protein, 9 aa, West Nile virus
AAFFQMAYI

SEQ ID NO: 137805 - protein, 9 aa, West Nile virus
AFFQMAYID

SEQ ID NO: 137806 - protein, 9 aa, West Nile virus
FQMAYIDSQ

SEQ ID NO: 137807 - protein, 9 aa, West Nile virus
WNIPDVLNS

SEQ ID NO: 137808 - protein, 9 aa, West Nile virus
EMPDVLNSL

SEQ ID NO: 137809 - protein, 9 aa, West Nile virus
MPDVLNSLA

SEQ ID NO: 137810 - protein, 9 aa, West Nile virus
SDVLNSLAV

SEQ ID NO: 137811 - protein, 9 aa, West Nile virus
NSLAIAWMI

SEQ ID NO: 137812 - protein, 9 aa, West Nile virus
SLAAAWMIL

SEQ ID NO: 137813 - protein, 9 aa, West Nile virus
LAVAWMVLR

SEQ ID NO: 137814 - protein, 9 aa, West Nile virus
AVAWMVLRA

SEQ ID NO: 137815 - protein, 9 aa, West Nile virus
MILRAITFP

SEQ ID NO: 137816 - protein, 9 aa, West Nile virus
FPTTSNVVV

SEQ ID NO: 137817 - protein, 9 aa, West Nile virus
TSTSNVVVP

SEQ ID NO: 137818 - protein, 9 aa, West Nile virus
LALLTPRLR

SEQ ID NO: 137819 - protein, 9 aa, West Nile virus
RCLNLDVSR

SEQ ID NO: 137820 - protein, 9 aa, West Nile virus
LNLDVSRIL

SEQ ID NO: 137821 - protein, 9 aa, West Nile virus
NLDVYRIVL

SEQ ID NO: 137822 - protein, 9 aa, West Nile virus
LDVYKILLL

SEQ ID NO: 137823 - protein, 9 aa, West Nile virus
DVSRILLLM

SEQ ID NO: 137824 - protein, 9 aa, West Nile virus
VYKILLLMV

SEQ ID NO: 137825 - protein, 9 aa, West Nile virus
YKILLLMVG

SEQ ID NO: 137826 - protein, 9 aa, West Nile virus
RILLLMIGI

SEQ ID NO: 137827 - protein, 9 aa, West Nile virus
LMIGIGSLI

SEQ ID NO: 137828 - protein, 9 aa, West Nile virus
MIGIGSLIR

SEQ ID NO: 137829 - protein, 9 aa, West Nile virus
IGIGSLIKE

SEQ ID NO: 137830 - protein, 9 aa, West Nile virus
GIGSLIKEK

SEQ ID NO: 137831 - protein, 9 aa, West Nile virus
IGSLIKEKR

SEQ ID NO: 137832 - protein, 9 aa, West Nile virus
GSLIKERRS

SEQ ID NO: 137833 - protein, 9 aa, West Nile virus
EKRNAAAKK

SEQ ID NO: 137834 - protein, 9 aa, West Nile virus
RRSSAAKKK

SEQ ID NO: 137835 - protein, 9 aa, West Nile virus
RNAAAKKKG

SEQ ID NO: 137836 - protein, 9 aa, West Nile virus
NSAAKKKGA

SEQ ID NO: 137837 - protein, 9 aa, West Nile virus
PMILAAGLV

SEQ ID NO: 137838 - protein, 9 aa, West Nile virus
LVAGLLACD

SEQ ID NO: 137839 - protein, 9 aa, West Nile virus
VAGLLACDP

SEQ ID NO: 137840 - protein, 9 aa, West Nile virus
AGLLACDPN

SEQ ID NO: 137841 - protein, 9 aa, West Nile virus
GLLACDPNR

SEQ ID NO: 137842 - protein, 9 aa, West Nile virus
LLACDPNRK

SEQ ID NO: 137843 - protein, 9 aa, West Nile virus
LACDPNRKR

SEQ ID NO: 137844 - protein, 9 aa, West Nile virus
ELDVDSMAI

SEQ ID NO: 137845 - protein, 9 aa, West Nile virus
LDMDSMAIP

SEQ ID NO: 137846 - protein, 9 aa, West Nile virus
DIDTMAIPM

SEQ ID NO: 137847 - protein, 9 aa, West Nile virus
IDSMAVPMT

SEQ ID NO: 137848 - protein, 9 aa, West Nile virus
RTADISWEN

SEQ ID NO: 137849 - protein, 9 aa, West Nile virus
TADISWEND

SEQ ID NO: 137850 - protein, 9 aa, West Nile virus
ADISWENDA

SEQ ID NO: 137851 - protein, 9 aa, West Nile virus
DISWESDVE

SEQ ID NO: 137852 - protein, 9 aa, West Nile virus
ISWENDAEI

SEQ ID NO: 137853 - protein, 9 aa, West Nile virus
SWENDAEIT

SEQ ID NO: 137854 - protein, 9 aa, West Nile virus
WESDVEITG

SEQ ID NO: 137855 - protein, 9 aa, West Nile virus
ESDVEITGS

SEQ ID NO: 137856 - protein, 9 aa, West Nile virus
NDAEITGSS

SEQ ID NO: 137857 - protein, 9 aa, West Nile virus
DDGDFQLMN

SEQ ID NO: 137858 - protein, 9 aa, West Nile virus
DGDFQLMND

SEQ ID NO: 137859 - protein, 9 aa, West Nile virus
GNFQLMSDP

SEQ ID NO: 137860 - protein, 9 aa, West Nile virus
WILRMVCLA

SEQ ID NO: 137861 - protein, 9 aa, West Nile virus
MACLAVSAY

SEQ ID NO: 137862 - protein, 9 aa, West Nile virus
VCLAVSAYT

SEQ ID NO: 137863 - protein, 9 aa, West Nile virus
DTPSPKEYE

SEQ ID NO: 137864 - protein, 9 aa, West Nile virus
VYKKGDTTT

SEQ ID NO: 137865 - protein, 9 aa, West Nile virus
YRKGDTATG

SEQ ID NO: 137866 - protein, 9 aa, West Nile virus
RKGDTATGV

SEQ ID NO: 137867 - protein, 9 aa, West Nile virus
GGPWKLGHR

SEQ ID NO: 137868 - protein, 9 aa, West Nile virus
GPWKLQHRW

SEQ ID NO: 137869 - protein, 9 aa, West Nile virus
PWKLQCKWN

SEQ ID NO: 137870 - protein, 9 aa, West Nile virus
WKLQHRWNG

SEQ ID NO: 137871 - protein, 9 aa, West Nile virus
KLQHRWNGQ

SEQ ID NO: 137872 - protein, 9 aa, West Nile virus
LQCKWNGQD

SEQ ID NO: 137873 - protein, 9 aa, West Nile virus
GHRWNGMDE

SEQ ID NO: 137874 - protein, 9 aa, West Nile virus
HRWNGQDEV

SEQ ID NO: 137875 - protein, 9 aa, West Nile virus
RWNGMDEVQ

SEQ ID NO: 137876 - protein, 9 aa, West Nile virus
IVVKPGESV

SEQ ID NO: 137877 - protein, 9 aa, West Nile virus
VAEPGRKTR

SEQ ID NO: 137878 - protein, 9 aa, West Nile virus
AEPGRKTRN

SEQ ID NO: 137879 - protein, 9 aa, West Nile virus
KPGESVKNV

SEQ ID NO: 137880 - protein, 9 aa, West Nile virus
PGESVKNVQ

SEQ ID NO: 137881 - protein, 9 aa, West Nile virus
GESVKNVQT

SEQ ID NO: 137882 - protein, 9 aa, West Nile virus
ESVKNVQTK

SEQ ID NO: 137883 - protein, 9 aa, West Nile virus
KTRNVQTKP

SEQ ID NO: 137884 - protein, 9 aa, West Nile virus
QGERMEEPP

SEQ ID NO: 137885 - protein, 9 aa, West Nile virus
GERMEEPVP

SEQ ID NO: 137886 - protein, 9 aa, West Nile virus
ERMEEPVPS

SEQ ID NO: 137887 - protein, 9 aa, West Nile virus
RMDEPIPVG

SEQ ID NO: 137888 - protein, 9 aa, West Nile virus
MDEPIPVGF

SEQ ID NO: 137889 - protein, 9 aa, West Nile virus
GFEPETLKK

SEQ ID NO: 137890 - protein, 9 aa, West Nile virus
FEPETLKKK

SEQ ID NO: 137891 - protein, 9 aa, West Nile virus
ESEMLRKKQ

SEQ ID NO: 137892 - protein, 9 aa, West Nile virus
PEMLRKKKI

SEQ ID NO: 137893 - protein, 9 aa, West Nile virus
ETLKKKQIT

SEQ ID NO: 137894 - protein, 9 aa, West Nile virus
PQIIKEAID

SEQ ID NO: 137895 - protein, 9 aa, West Nile virus
QIIKEAMNR

SEQ ID NO: 137896 - protein, 9 aa, West Nile virus
IIKEAISKR

SEQ ID NO: 137897 - protein, 9 aa, West Nile virus
IKEAIDRRL

SEQ ID NO: 137898 - protein, 9 aa, West Nile virus
KEAIDRRLR

SEQ ID NO: 137899 - protein, 9 aa, West Nile virus
EAISKRLRT

SEQ ID NO: 137900 - protein, 9 aa, West Nile virus
AMNRRLRTA

SEQ ID NO: 137901 - protein, 9 aa, West Nile virus
NRRLRTAIL

SEQ ID NO: 137902 - protein, 9 aa, West Nile virus
RVVTAEMAE

SEQ ID NO: 137903 - protein, 9 aa, West Nile virus
VVTAEMAEA

SEQ ID NO: 137904 - protein, 9 aa, West Nile virus
VTAEMAEAL

SEQ ID NO: 137905 - protein, 9 aa, West Nile virus
AAEMADALR

SEQ ID NO: 137906 - protein, 9 aa, West Nile virus
IRYQTSAVA

SEQ ID NO: 137907 - protein, 9 aa, West Nile virus
RYQTSAVAR

SEQ ID NO: 137908 - protein, 9 aa, West Nile virus
YQTSAVARE

SEQ ID NO: 137909 - protein, 9 aa, West Nile virus
QTSAVAREH

SEQ ID NO: 137910 - protein, 9 aa, West Nile virus
AARGYIATR

SEQ ID NO: 137911 - protein, 9 aa, West Nile virus
ARGYIATRV

SEQ ID NO: 137912 - protein, 9 aa, West Nile virus
RGYIATRVE

SEQ ID NO: 137913 - protein, 9 aa, West Nile virus
ISTRVELGD

SEQ ID NO: 137914 - protein, 9 aa, West Nile virus
STRVELGDA

SEQ ID NO: 137915 - protein, 9 aa, West Nile virus
GYEWITEFV

SEQ ID NO: 137916 - protein, 9 aa, West Nile virus
YEWITEYAG

SEQ ID NO: 137917 - protein, 9 aa, West Nile virus
EWITEFVGK

SEQ ID NO: 137918 - protein, 9 aa, West Nile virus
WITEYAGKT

SEQ ID NO: 137919 - protein, 9 aa, West Nile virus
ITEYAGKTV

SEQ ID NO: 137920 - protein, 9 aa, West Nile virus
TEFVGKTVW

SEQ ID NO: 137921 - protein, 9 aa, West Nile virus
EFVGKTVWF

SEQ ID NO: 137922 - protein, 9 aa, West Nile virus
FVGKTVWFV

SEQ ID NO: 137923 - protein, 9 aa, West Nile virus
SVKPTSITE

SEQ ID NO: 137924 - protein, 9 aa, West Nile virus
VKPTSITEG

SEQ ID NO: 137925 - protein, 9 aa, West Nile virus
KPTSITEGE

SEQ ID NO: 137926 - protein, 9 aa, West Nile virus
ITDGESRVV

SEQ ID NO: 137927 - protein, 9 aa, West Nile virus
TEGEARVIL

SEQ ID NO: 137928 - protein, 9 aa, West Nile virus
DGESRVVLG

SEQ ID NO: 137929 - protein, 9 aa, West Nile virus
GESRVVLGE

SEQ ID NO: 137930 - protein, 9 aa, West Nile virus
ESRVVLGEP

SEQ ID NO: 137931 - protein, 9 aa, West Nile virus
ARVILGEPS

SEQ ID NO: 137932 - protein, 9 aa, West Nile virus
RGRVGRNPS

SEQ ID NO: 137933 - protein, 9 aa, West Nile virus
GRTGRNPSQ

SEQ ID NO: 137934 - protein, 9 aa, West Nile virus
RIGRNPTQV

SEQ ID NO: 137935 - protein, 9 aa, West Nile virus
IGRNPTQVG

SEQ ID NO: 137936 - protein, 9 aa, West Nile virus
HTNEDDSNL

SEQ ID NO: 137937 - protein, 9 aa, West Nile virus
TNEDDSNLA

SEQ ID NO: 137938 - protein, 9 aa, West Nile virus
NEDDSNLAH

SEQ ID NO: 137939 - protein, 9 aa, West Nile virus
EDDSNLAHW

SEQ ID NO: 137940 - protein, 9 aa, West Nile virus
DDSNCAHWT

SEQ ID NO: 137941 - protein, 9 aa, West Nile virus
DSNCAHWTE

SEQ ID NO: 137942 - protein, 9 aa, West Nile virus
SNCAHWTEA

SEQ ID NO: 137943 - protein, 9 aa, West Nile virus
NLAHWTEAR

SEQ ID NO: 137944 - protein, 9 aa, West Nile virus
LAHWTEARI

SEQ ID NO: 137945 - protein, 9 aa, West Nile virus
VYTMEGEYR

SEQ ID NO: 137946 - protein, 9 aa, West Nile virus
CTMDGEYRL

SEQ ID NO: 137947 - protein, 9 aa, West Nile virus
VWLAHKVAA

SEQ ID NO: 137948 - protein, 9 aa, West Nile virus
WLAYKVASA

SEQ ID NO: 137949 - protein, 9 aa, West Nile virus
LAHKVAAAG

SEQ ID NO: 137950 - protein, 9 aa, West Nile virus
AYKAAAAGV

SEQ ID NO: 137951 - protein, 9 aa, West Nile virus
KVAAAGVPY

SEQ ID NO: 137952 - protein, 9 aa, West Nile virus
AAAAGVSYH

SEQ ID NO: 137953 - protein, 9 aa, West Nile virus
AGISYHDRR

SEQ ID NO: 137954 - protein, 9 aa, West Nile virus
GISYHDRRW

SEQ ID NO: 137955 - protein, 9 aa, West Nile virus
VPYHDRRWC

SEQ ID NO: 137956 - protein, 9 aa, West Nile virus
RWIDARVYL

SEQ ID NO: 137957 - protein, 9 aa, West Nile virus
WIDARVYLD

SEQ ID NO: 137958 - protein, 9 aa, West Nile virus
IDARVYLDH

SEQ ID NO: 137959 - protein, 9 aa, West Nile virus
FAAGKRSQI

SEQ ID NO: 137960 - protein, 9 aa, West Nile virus
ASGKRSQMG

SEQ ID NO: 137961 - protein, 9 aa, West Nile virus
SGKRSQVGL

SEQ ID NO: 137962 - protein, 9 aa, West Nile virus
GKRSQIGFI

SEQ ID NO: 137963 - protein, 9 aa, West Nile virus
KRSQIGFIE

SEQ ID NO: 137964 - protein, 9 aa, West Nile virus
RSQMGLIEV

SEQ ID NO: 137965 - protein, 9 aa, West Nile virus
SQIGFIEVL

SEQ ID NO: 137966 - protein, 9 aa, West Nile virus
QIGFIEVLG

SEQ ID NO: 137967 - protein, 9 aa, West Nile virus
IGFIEVLGK

SEQ ID NO: 137968 - protein, 9 aa, West Nile virus
GFIEVLGKM

SEQ ID NO: 137969 - protein, 9 aa, West Nile virus
FIEVLGKMP

SEQ ID NO: 137970 - protein, 9 aa, West Nile virus
GRMPEHFMV

SEQ ID NO: 137971 - protein, 9 aa, West Nile virus
RMPEHFMVK

SEQ ID NO: 137972 - protein, 9 aa, West Nile virus
AEKGRRAHR

SEQ ID NO: 137973 - protein, 9 aa, West Nile virus
EKGRRAHRM

SEQ ID NO: 137974 - protein, 9 aa, West Nile virus
RGGRAHRSA

SEQ ID NO: 137975 - protein, 9 aa, West Nile virus
GGRAHSMAL

SEQ ID NO: 137976 - protein, 9 aa, West Nile virus
RRAHRMALE

SEQ ID NO: 137977 - protein, 9 aa, West Nile virus
ALQTIILIT

SEQ ID NO: 137978 - protein, 9 aa, West Nile virus
LQTVALIAL

SEQ ID NO: 137979 - protein, 9 aa, West Nile virus
QTVALIALL

SEQ ID NO: 137980 - protein, 9 aa, West Nile virus
TIILITLLS

SEQ ID NO: 137981 - protein, 9 aa, West Nile virus
VALIALLGV

SEQ ID NO: 137982 - protein, 9 aa, West Nile virus
ALIALLGVM

SEQ ID NO: 137983 - protein, 9 aa, West Nile virus
LITLLSVMS

SEQ ID NO: 137984 - protein, 9 aa, West Nile virus
LLSVMSMGV

SEQ ID NO: 137985 - protein, 9 aa, West Nile virus
LSVMTMGIF

SEQ ID NO: 137986 - protein, 9 aa, West Nile virus
VMTMGVFLL

SEQ ID NO: 137987 - protein, 9 aa, West Nile virus
MTMGIFFLL

SEQ ID NO: 137988 - protein, 9 aa, West Nile virus
TMGIFFLLM

SEQ ID NO: 137989 - protein, 9 aa, West Nile virus
MGIFFLLMQ

SEQ ID NO: 137990 - protein, 9 aa, West Nile virus
IGKIGLGGI

SEQ ID NO: 137991 - protein, 9 aa, West Nile virus
LGVATLFCW

SEQ ID NO: 137992 - protein, 9 aa, West Nile virus
GVATLFCWM

SEQ ID NO: 137993 - protein, 9 aa, West Nile virus
VATLFCWMA

SEQ ID NO: 137994 - protein, 9 aa, West Nile virus
LFCWMAEVP

SEQ ID NO: 137995 - protein, 9 aa, West Nile virus
VFLICVMTP

SEQ ID NO: 137996 - protein, 9 aa, West Nile virus
FMICVMTLV

SEQ ID NO: 137997 - protein, 9 aa, West Nile virus
TPVSAVAAN

SEQ ID NO: 137998 - protein, 9 aa, West Nile virus
PVSAVAANE

SEQ ID NO: 137999 - protein, 9 aa, West Nile virus
WLDKTKSDV

SEQ ID NO: 138000 - protein, 9 aa, West Nile virus
ENFLLDLRP

SEQ ID NO: 138001 - protein, 9 aa, West Nile virus
NFLLDLRPA

SEQ ID NO: 138002 - protein, 9 aa, West Nile virus
SLYAISTAF

SEQ ID NO: 138003 - protein, 9 aa, West Nile virus
LYAISTAFM

SEQ ID NO: 138004 - protein, 9 aa, West Nile virus
YAVTTAFLT

SEQ ID NO: 138005 - protein, 9 aa, West Nile virus
AVATAVLTP

SEQ ID NO: 138006 - protein, 9 aa, West Nile virus
VTTAFLTPL

SEQ ID NO: 138007 - protein, 9 aa, West Nile virus
STAFMTPLL

SEQ ID NO: 138008 - protein, 9 aa, West Nile virus
TAVLTPLIK

SEQ ID NO: 138009 - protein, 9 aa, West Nile virus
AFMTPLLKH

SEQ ID NO: 138010 - protein, 9 aa, West Nile virus
VLTPLLKHV

SEQ ID NO: 138011 - protein, 9 aa, West Nile virus
LTPLLKHVI

SEQ ID NO: 138012 - protein, 9 aa, West Nile virus
QASTLFTLA

SEQ ID NO: 138013 - protein, 9 aa, West Nile virus
ASTLFTLAR

SEQ ID NO: 138014 - protein, 9 aa, West Nile virus
STLFTLARG

SEQ ID NO: 138015 - protein, 9 aa, West Nile virus
TLFTLARGF

SEQ ID NO: 138016 - protein, 9 aa, West Nile virus
VLLFCHYAY

SEQ ID NO: 138017 - protein, 9 aa, West Nile virus
TTPIMQKKI

SEQ ID NO: 138018 - protein, 9 aa, West Nile virus
MMQKKVGQV

SEQ ID NO: 138019 - protein, 9 aa, West Nile virus
KIGQIMLIL

SEQ ID NO: 138020 - protein, 9 aa, West Nile virus
IGQIMLILV

SEQ ID NO: 138021 - protein, 9 aa, West Nile virus
ILILVSMAA

SEQ ID NO: 138022 - protein, 9 aa, West Nile virus
LILVSLAAL

SEQ ID NO: 138023 - protein, 9 aa, West Nile virus
ILVSLAALV

SEQ ID NO: 138024 - protein, 9 aa, West Nile virus
LVSLAALVV

SEQ ID NO: 138025 - protein, 9 aa, West Nile virus
VSLAALVVN

SEQ ID NO: 138026 - protein, 9 aa, West Nile virus
SLAALVVNP

SEQ ID NO: 138027 - protein, 9 aa, West Nile virus
LAALVVNPS

SEQ ID NO: 138028 - protein, 9 aa, West Nile virus
VREAGILTS

SEQ ID NO: 138029 - protein, 9 aa, West Nile virus
REAGILITS

SEQ ID NO: 138030 - protein, 9 aa, West Nile virus
EAGILTSAA

SEQ ID NO: 138031 - protein, 9 aa, West Nile virus
AGILITSAS

SEQ ID NO: 138032 - protein, 9 aa, West Nile virus
GILTSAAAV

SEQ ID NO: 138033 - protein, 9 aa, West Nile virus
ILTSAAAVT

SEQ ID NO: 138034 - protein, 9 aa, West Nile virus
LTSAAAVTL

SEQ ID NO: 138035 - protein, 9 aa, West Nile virus
TSAAAVTLW

SEQ ID NO: 138036 - protein, 9 aa, West Nile virus
GWLSCLSIA

SEQ ID NO: 138037 - protein, 9 aa, West Nile virus
WLSCLSIAW

SEQ ID NO: 138038 - protein, 9 aa, West Nile virus
LSCLSIAWT

SEQ ID NO: 138039 - protein, 9 aa, West Nile virus
SCLSIAWTL

SEQ ID NO: 138040 - protein, 9 aa, West Nile virus
KNMEKPGIK

SEQ ID NO: 138041 - protein, 9 aa, West Nile virus
NLEKPGLKR

SEQ ID NO: 138042 - protein, 9 aa, West Nile virus
MEKPGIKRG

SEQ ID NO: 138043 - protein, 9 aa, West Nile virus
EKPVLKRGG

SEQ ID NO: 138044 - protein, 9 aa, West Nile virus
EVWKERLNY

SEQ ID NO: 138045 - protein, 9 aa, West Nile virus
VWKEKLNQM

SEQ ID NO: 138046 - protein, 9 aa, West Nile virus
WKERLNYMT

SEQ ID NO: 138047 - protein, 9 aa, West Nile virus
MTREEFTRY

SEQ ID NO: 138048 - protein, 9 aa, West Nile virus
TREEFTRYR

SEQ ID NO: 138049 - protein, 9 aa, West Nile virus
KEEFSRYRK

SEQ ID NO: 138050 - protein, 9 aa, West Nile virus
EEFSRYRKE

SEQ ID NO: 138051 - protein, 9 aa, West Nile virus
EFSRYRKEA

SEQ ID NO: 138052 - protein, 9 aa, West Nile virus
FTRYRREAI

SEQ ID NO: 138053 - protein, 9 aa, West Nile virus
ARYRKEAIT

SEQ ID NO: 138054 - protein, 9 aa, West Nile virus
TEVDRAPAK

SEQ ID NO: 138055 - protein, 9 aa, West Nile virus
ARREGNVTG

SEQ ID NO: 138056 - protein, 9 aa, West Nile virus
RREGNVTGG

SEQ ID NO: 138057 - protein, 9 aa, West Nile virus
KEGNITGGH

SEQ ID NO: 138058 - protein, 9 aa, West Nile virus
EGNVTGGHS

SEQ ID NO: 138059 - protein, 9 aa, West Nile virus
GNVTGGHSV

SEQ ID NO: 138060 - protein, 9 aa, West Nile virus
FVEPVGRVI

SEQ ID NO: 138061 - protein, 9 aa, West Nile virus
VEPVGRVID

SEQ ID NO: 138062 - protein, 9 aa, West Nile virus
EPIGKVIDL

SEQ ID NO: 138063 - protein, 9 aa, West Nile virus
PVGRVIDLG

SEQ ID NO: 138064 - protein, 9 aa, West Nile virus
VGRVIDLGC

SEQ ID NO: 138065 - protein, 9 aa, West Nile virus
DVFYRPSES

SEQ ID NO: 138066 - protein, 9 aa, West Nile virus
VFYRPSEVS

SEQ ID NO: 138067 - protein, 9 aa, West Nile virus
FYRTSEASD

SEQ ID NO: 138068 - protein, 9 aa, West Nile virus
YRPSESCDT

SEQ ID NO: 138069 - protein, 9 aa, West Nile virus
RPSEVSDTL

SEQ ID NO: 138070 - protein, 9 aa, West Nile virus
TSEASDTLL

SEQ ID NO: 138071 - protein, 9 aa, West Nile virus
HRTMRVLEM

SEQ ID NO: 138072 - protein, 9 aa, West Nile virus
RTIRVLEIV

SEQ ID NO: 138073 - protein, 9 aa, West Nile virus
TIRVLEIVE

SEQ ID NO: 138074 - protein, 9 aa, West Nile virus
IRVLEIVED

SEQ ID NO: 138075 - protein, 9 aa, West Nile virus
PKVIEKMEI

SEQ ID NO: 138076 - protein, 9 aa, West Nile virus
KVIEKMEIL

SEQ ID NO: 138077 - protein, 9 aa, West Nile virus
VIEKMEILQ

SEQ ID NO: 138078 - protein, 9 aa, West Nile virus
IEKMEILQR

SEQ ID NO: 138079 - protein, 9 aa, West Nile virus
EKMEILQRR

SEQ ID NO: 138080 - protein, 9 aa, West Nile virus
KMEILQRRY

SEQ ID NO: 138081 - protein, 9 aa, West Nile virus
MEILQRRYG

SEQ ID NO: 138082 - protein, 9 aa, West Nile virus
EILQRRYGG

SEQ ID NO: 138083 - protein, 9 aa, West Nile virus
ILQRRYGGG

SEQ ID NO: 138084 - protein, 9 aa, West Nile virus
MYWVSQASG

SEQ ID NO: 138085 - protein, 9 aa, West Nile virus
YWVSRASSN

SEQ ID NO: 138086 - protein, 9 aa, West Nile virus
WVSRASSNV

SEQ ID NO: 138087 - protein, 9 aa, West Nile virus
VSRASRNVV

SEQ ID NO: 138088 - protein, 9 aa, West Nile virus
SQASGNIVH

SEQ ID NO: 138089 - protein, 9 aa, West Nile virus
NIVHAVNMT

SEQ ID NO: 138090 - protein, 9 aa, West Nile virus
IVHAVNMTS

SEQ ID NO: 138091 - protein, 9 aa, West Nile virus
KKTWKGAHY

SEQ ID NO: 138092 - protein, 9 aa, West Nile virus
KTWKGAHYE

SEQ ID NO: 138093 - protein, 9 aa, West Nile virus
KGAHYEEDV

SEQ ID NO: 138094 - protein, 9 aa, West Nile virus
GAHYEEDVN

SEQ ID NO: 138095 - protein, 9 aa, West Nile virus
AHYEEDVNL

SEQ ID NO: 138096 - protein, 9 aa, West Nile virus
HYEEDVNLG

SEQ ID NO: 138097 - protein, 9 aa, West Nile virus
RPLLNSDTS

SEQ ID NO: 138098 - protein, 9 aa, West Nile virus
PLLNSDTRK

SEQ ID NO: 138099 - protein, 9 aa, West Nile virus
LLSSDTSKI

SEQ ID NO: 138100 - protein, 9 aa, West Nile virus
LNSDTSKIN

SEQ ID NO: 138101 - protein, 9 aa, West Nile virus
SDTSKINNR

SEQ ID NO: 138102 - protein, 9 aa, West Nile virus
NRIERLKRE

SEQ ID NO: 138103 - protein, 9 aa, West Nile virus
RVERLKREY

SEQ ID NO: 138104 - protein, 9 aa, West Nile virus
IERLKREYS

SEQ ID NO: 138105 - protein, 9 aa, West Nile virus
DGNHPYRTW

SEQ ID NO: 138106 - protein, 9 aa, West Nile virus
GNHPYRTWN

SEQ ID NO: 138107 - protein, 9 aa, West Nile virus
NYHGSYEVN

SEQ ID NO: 138108 - protein, 9 aa, West Nile virus
YHGSYDVNP

SEQ ID NO: 138109 - protein, 9 aa, West Nile virus
HGSYEVNPL

SEQ ID NO: 138110 - protein, 9 aa, West Nile virus
GSYDVNPTG

SEQ ID NO: 138111 - protein, 9 aa, West Nile virus
SYDVNPTGS

SEQ ID NO: 138112 - protein, 9 aa, West Nile virus
YEVNPLVSA

SEQ ID NO: 138113 - protein, 9 aa, West Nile virus
EVNPLVSAS

SEQ ID NO: 138114 - protein, 9 aa, West Nile virus
APEPPAGVK

SEQ ID NO: 138115 - protein, 9 aa, West Nile virus
TNWLWAYLA

SEQ ID NO: 138116 - protein, 9 aa, West Nile virus
NWLWAYLAR

SEQ ID NO: 138117 - protein, 9 aa, West Nile virus
RGKRPRMCS

SEQ ID NO: 138118 - protein, 9 aa, West Nile virus
GKRPRMCSR

SEQ ID NO: 138119 - protein, 9 aa, West Nile virus
MCTREEFIS

SEQ ID NO: 138120 - protein, 9 aa, West Nile virus
CTREEFISK

SEQ ID NO: 138121 - protein, 9 aa, West Nile virus
TREEFISKV

SEQ ID NO: 138122 - protein, 9 aa, West Nile virus
REEFISKVN

SEQ ID NO: 138123 - protein, 9 aa, West Nile virus
EEFIKKVNS

SEQ ID NO: 138124 - protein, 9 aa, West Nile virus
EFISKVNSN

SEQ ID NO: 138125 - protein, 9 aa, West Nile virus
FIKKVNSNA

SEQ ID NO: 138126 - protein, 9 aa, West Nile virus
IKKVNSNAA

SEQ ID NO: 138127 - protein, 9 aa, West Nile virus
KKVNSNAAL

SEQ ID NO: 138128 - protein, 9 aa, West Nile virus
FEEQNQWSN

SEQ ID NO: 138129 - protein, 9 aa, West Nile virus
EEQNQWSNA

SEQ ID NO: 138130 - protein, 9 aa, West Nile virus
EQNQWSNAR

SEQ ID NO: 138131 - protein, 9 aa, West Nile virus
QNQWSNARE

SEQ ID NO: 138132 - protein, 9 aa, West Nile virus
NQWSNAREA

SEQ ID NO: 138133 - protein, 9 aa, West Nile virus
QWSNAREAV

SEQ ID NO: 138134 - protein, 9 aa, West Nile virus
WSNAREAVE

SEQ ID NO: 138135 - protein, 9 aa, West Nile virus
SNAREAVED

SEQ ID NO: 138136 - protein, 9 aa, West Nile virus
SARAAVEDP

SEQ ID NO: 138137 - protein, 9 aa, West Nile virus
AREAVEDQK

SEQ ID NO: 138138 - protein, 9 aa, West Nile virus
REAVEDSTF

SEQ ID NO: 138139 - protein, 9 aa, West Nile virus
EAVEDSTFW

SEQ ID NO: 138140 - protein, 9 aa, West Nile virus
VEDQKFWEM

SEQ ID NO: 138141 - protein, 9 aa, West Nile virus
EDQKFWEMV

SEQ ID NO: 138142 - protein, 9 aa, West Nile virus
DSTFWEMVD

SEQ ID NO: 138143 - protein, 9 aa, West Nile virus
PKFWEIVDE

SEQ ID NO: 138144 - protein, 9 aa, West Nile virus
GGKVYADDT

SEQ ID NO: 138145 - protein, 9 aa, West Nile virus
GKVYADDTA

SEQ ID NO: 138146 - protein, 9 aa, West Nile virus
RIYADDTAG

SEQ ID NO: 138147 - protein, 9 aa, West Nile virus
IFADDTAGW

SEQ ID NO: 138148 - protein, 9 aa, West Nile virus
RAIIELTYC

SEQ ID NO: 138149 - protein, 9 aa, West Nile virus
AIIELTYCH

SEQ ID NO: 138150 - protein, 9 aa, West Nile virus
IIELTYRYK

SEQ ID NO: 138151 - protein, 9 aa, West Nile virus
AADGKTVMS

SEQ ID NO: 138152 - protein, 9 aa, West Nile virus
ADRKTVMDV

SEQ ID NO: 138153 - protein, 9 aa, West Nile virus
DGKTVMDII

SEQ ID NO: 138154 - protein, 9 aa, West Nile virus
GKTVMSLIS

SEQ ID NO: 138155 - protein, 9 aa, West Nile virus
EGEGVIGPY

SEQ ID NO: 138156 - protein, 9 aa, West Nile virus
GEGVIGPED

SEQ ID NO: 138157 - protein, 9 aa, West Nile virus
EGVITPDDV

SEQ ID NO: 138158 - protein, 9 aa, West Nile virus
GVIGPEDVE

SEQ ID NO: 138159 - protein, 9 aa, West Nile virus
RGKGPKVRT

SEQ ID NO: 138160 - protein, 9 aa, West Nile virus
ASSLHFLNA

SEQ ID NO: 138161 - protein, 9 aa, West Nile virus
SSLHFLNAM

SEQ ID NO: 138162 - protein, 9 aa, West Nile virus
AICSAVPVD

SEQ ID NO: 138163 - protein, 9 aa, West Nile virus
ICSAVPVDW

SEQ ID NO: 138164 - protein, 9 aa, West Nile virus
CSAVPVDWV

SEQ ID NO: 138165 - protein, 9 aa, West Nile virus
SAVPVDWVP

SEQ ID NO: 138166 - protein, 9 aa, West Nile virus
AVPVDWVPT

SEQ ID NO: 138167 - protein, 9 aa, West Nile virus
VPVDWVPTG

SEQ ID NO: 138168 - protein, 9 aa, West Nile virus
PVDWVPTGR

SEQ ID NO: 138169 - protein, 9 aa, West Nile virus
VDWVPTGRT

SEQ ID NO: 138170 - protein, 9 aa, West Nile virus
RTTWSIHVG

SEQ ID NO: 138171 - protein, 9 aa, West Nile virus
TTWSIHVGG

SEQ ID NO: 138172 - protein, 9 aa, West Nile virus
TWSIHVGGE

SEQ ID NO: 138173 - protein, 9 aa, West Nile virus
WSIHVGGEW

SEQ ID NO: 138174 - protein, 9 aa, West Nile virus
SIHVGGEWM

SEQ ID NO: 138175 - protein, 9 aa, West Nile virus
IHVGGEWMT

SEQ ID NO: 138176 - protein, 9 aa, West Nile virus
HVGGEWMTT

SEQ ID NO: 138177 - protein, 9 aa, West Nile virus
ARGEWMTTE

SEQ ID NO: 138178 - protein, 9 aa, West Nile virus
RGEWMTTED

SEQ ID NO: 138179 - protein, 9 aa, West Nile virus
WMTTEDMLS

SEQ ID NO: 138180 - protein, 9 aa, West Nile virus
MTTEDMLSV

SEQ ID NO: 138181 - protein, 9 aa, West Nile virus
TTEDMLSVW

SEQ ID NO: 138182 - protein, 9 aa, West Nile virus
TEDMLSVWN

SEQ ID NO: 138183 - protein, 9 aa, West Nile virus
EDMLSVWNR

SEQ ID NO: 138184 - protein, 9 aa, West Nile virus
DMLSVWNRV

SEQ ID NO: 138185 - protein, 9 aa, West Nile virus
MLSVWNRVW

SEQ ID NO: 138186 - protein, 9 aa, West Nile virus
LSVWNRVWI

SEQ ID NO: 138187 - protein, 9 aa, West Nile virus
SVWNRVWIE

SEQ ID NO: 138188 - protein, 9 aa, West Nile virus
QVAIGQVRS

SEQ ID NO: 138189 - protein, 9 aa, West Nile virus
MSSLRRYEE

SEQ ID NO: 138190 - protein, 9 aa, West Nile virus
AVNMLKRGT

SEQ ID NO: 138191 - protein, 9 aa, West Nile virus
VNMLKRGTP

SEQ ID NO: 138192 - protein, 9 aa, West Nile virus
NMQKRGKPR

SEQ ID NO: 138193 - protein, 9 aa, West Nile virus
KRGKPRGGS

SEQ ID NO: 138194 - protein, 9 aa, West Nile virus
RGKPRGGSL

SEQ ID NO: 138195 - protein, 9 aa, West Nile virus
VLERWRGVN

SEQ ID NO: 138196 - protein, 9 aa, West Nile virus
KKELGTLTN

SEQ ID NO: 138197 - protein, 9 aa, West Nile virus
KELGILTNA

SEQ ID NO: 138198 - protein, 9 aa, West Nile virus
NRRSAKQKK

SEQ ID NO: 138199 - protein, 9 aa, West Nile virus
RRSEKKKKR

SEQ ID NO: 138200 - protein, 9 aa, West Nile virus
RSSKEKKRG

SEQ ID NO: 138201 - protein, 9 aa, West Nile virus
SAKQKKRGG

SEQ ID NO: 138202 - protein, 9 aa, West Nile virus
KEKKRGGKT

SEQ ID NO: 138203 - protein, 9 aa, West Nile virus
QKKRGGNTG

SEQ ID NO: 138204 - protein, 9 aa, West Nile virus
KKRGGKTGS

SEQ ID NO: 138205 - protein, 9 aa, West Nile virus
GAVTLSDFQ

SEQ ID NO: 138206 - protein, 9 aa, West Nile virus
LMMTVNATD

SEQ ID NO: 138207 - protein, 9 aa, West Nile virus
MMTINATET

SEQ ID NO: 138208 - protein, 9 aa, West Nile virus
MTVNATDVA

SEQ ID NO: 138209 - protein, 9 aa, West Nile virus
AITIPTAAG

SEQ ID NO: 138210 - protein, 9 aa, West Nile virus
TVRAMDVGF

SEQ ID NO: 138211 - protein, 9 aa, West Nile virus
VRAIDVGFL

SEQ ID NO: 138212 - protein, 9 aa, West Nile virus
GFMCDDTIT

SEQ ID NO: 138213 - protein, 9 aa, West Nile virus
FMCDDTITY

SEQ ID NO: 138214 - protein, 9 aa, West Nile virus
IDCWCTKAA

SEQ ID NO: 138215 - protein, 9 aa, West Nile virus
DCWCTKLAM

SEQ ID NO: 138216 - protein, 9 aa, West Nile virus
QAHGESTLA

SEQ ID NO: 138217 - protein, 9 aa, West Nile virus
THGESTLVN

SEQ ID NO: 138218 - protein, 9 aa, West Nile virus
VNKKGAWLD

SEQ ID NO: 138219 - protein, 9 aa, West Nile virus
MQRVVFIVL

SEQ ID NO: 138220 - protein, 9 aa, West Nile virus
QRVVFIVLL

SEQ ID NO: 138221 - protein, 9 aa, West Nile virus
RVVFIVLLL

SEQ ID NO: 138222 - protein, 9 aa, West Nile virus
VVFIVLLLL

SEQ ID NO: 138223 - protein, 9 aa, West Nile virus
VFIVLLLLV

SEQ ID NO: 138224 - protein, 9 aa, West Nile virus
FIVLLLLVA

SEQ ID NO: 138225 - protein, 9 aa, West Nile virus
IVLLLLVAP

SEQ ID NO: 138226 - protein, 9 aa, West Nile virus
GVRDYCYLA

SEQ ID NO: 138227 - protein, 9 aa, West Nile virus
VNDLSPRAA

SEQ ID NO: 138228 - protein, 9 aa, West Nile virus
SELSTRAAC

SEQ ID NO: 138229 - protein, 9 aa, West Nile virus
DLSPRAACP

SEQ ID NO: 138230 - protein, 9 aa, West Nile virus
KFACTSKAT

SEQ ID NO: 138231 - protein, 9 aa, West Nile virus
ATQAGRFSV

SEQ ID NO: 138232 - protein, 9 aa, West Nile virus
TQAGRFSVT

SEQ ID NO: 138233 - protein, 9 aa, West Nile virus
AGRFTVSPS

SEQ ID NO: 138234 - protein, 9 aa, West Nile virus
GRFTVSPSA

SEQ ID NO: 138235 - protein, 9 aa, West Nile virus
RFTVSPSAP

SEQ ID NO: 138236 - protein, 9 aa, West Nile virus
FTVSPSAPT

SEQ ID NO: 138237 - protein, 9 aa, West Nile virus
SVTPAAPSY

SEQ ID NO: 138238 - protein, 9 aa, West Nile virus
VSPSAPTYT

SEQ ID NO: 138239 - protein, 9 aa, West Nile virus
DTNAYYVMS

SEQ ID NO: 138240 - protein, 9 aa, West Nile virus
TGAYYVMSV

SEQ ID NO: 138241 - protein, 9 aa, West Nile virus
NAYYVMSVG

SEQ ID NO: 138242 - protein, 9 aa, West Nile virus
LPWSSAGGN

SEQ ID NO: 138243 - protein, 9 aa, West Nile virus
VNPFVAAAT

SEQ ID NO: 138244 - protein, 9 aa, West Nile virus
NPFVAAATA

SEQ ID NO: 138245 - protein, 9 aa, West Nile virus
TADAKVLIE

SEQ ID NO: 138246 - protein, 9 aa, West Nile virus
SARDRSIAL

SEQ ID NO: 138247 - protein, 9 aa, West Nile virus
ARDKSIALT

SEQ ID NO: 138248 - protein, 9 aa, West Nile virus
MTFLAVGGI

SEQ ID NO: 138249 - protein, 9 aa, West Nile virus
DTGCAIDVS

SEQ ID NO: 138250 - protein, 9 aa, West Nile virus
TGCAIDVSR

SEQ ID NO: 138251 - protein, 9 aa, West Nile virus
GCAIDVGRQ

SEQ ID NO: 138252 - protein, 9 aa, West Nile virus
CAINITRQE

SEQ ID NO: 138253 - protein, 9 aa, West Nile virus
AIDVSRQEL

SEQ ID NO: 138254 - protein, 9 aa, West Nile virus
IDVGRQELR

SEQ ID NO: 138255 - protein, 9 aa, West Nile virus
DVGRQELRC

SEQ ID NO: 138256 - protein, 9 aa, West Nile virus
ITRQELRCG

SEQ ID NO: 138257 - protein, 9 aa, West Nile virus
NDVKAWMDR

SEQ ID NO: 138258 - protein, 9 aa, West Nile virus
DVEVWMDRY

SEQ ID NO: 138259 - protein, 9 aa, West Nile virus
VEVWMDRYK

SEQ ID NO: 138260 - protein, 9 aa, West Nile virus
DRYKFHPET

SEQ ID NO: 138261 - protein, 9 aa, West Nile virus
RYKFHPETP

SEQ ID NO: 138262 - protein, 9 aa, West Nile virus
YKFHPETPQ

SEQ ID NO: 138263 - protein, 9 aa, West Nile virus
KYHPETPQG

SEQ ID NO: 138264 - protein, 9 aa, West Nile virus
LEHQMWDSV

SEQ ID NO: 138265 - protein, 9 aa, West Nile virus
EHQMWDSVK

SEQ ID NO: 138266 - protein, 9 aa, West Nile virus
HQMWDSVKD

SEQ ID NO: 138267 - protein, 9 aa, West Nile virus
QMWDSVKDE

SEQ ID NO: 138268 - protein, 9 aa, West Nile virus
MWDSVKDEL

SEQ ID NO: 138269 - protein, 9 aa, West Nile virus
WDSVKDELN

SEQ ID NO: 138270 - protein, 9 aa, West Nile virus
DSVKDELNT

SEQ ID NO: 138271 - protein, 9 aa, West Nile virus
KENGVDFSV

SEQ ID NO: 138272 - protein, 9 aa, West Nile virus
ENGVDFSVV

SEQ ID NO: 138273 - protein, 9 aa, West Nile virus
NGVDFSVVV

SEQ ID NO: 138274 - protein, 9 aa, West Nile virus
GVDFSVVVE

SEQ ID NO: 138275 - protein, 9 aa, West Nile virus
IDLSMVVEK

SEQ ID NO: 138276 - protein, 9 aa, West Nile virus
ATTDKLEIG

SEQ ID NO: 138277 - protein, 9 aa, West Nile virus
TTDKLEIGW

SEQ ID NO: 138278 - protein, 9 aa, West Nile virus
SEKLEIGWK

SEQ ID NO: 138279 - protein, 9 aa, West Nile virus
ELANHTFVV

SEQ ID NO: 138280 - protein, 9 aa, West Nile virus
LANSTFVVD

SEQ ID NO: 138281 - protein, 9 aa, West Nile virus
NSTFVVDGP

SEQ ID NO: 138282 - protein, 9 aa, West Nile virus
HTFVVDGPE

SEQ ID NO: 138283 - protein, 9 aa, West Nile virus
GPETEECPS

SEQ ID NO: 138284 - protein, 9 aa, West Nile virus
VRKSNTTEC

SEQ ID NO: 138285 - protein, 9 aa, West Nile virus
VNTTECDSK

SEQ ID NO: 138286 - protein, 9 aa, West Nile virus
LNHTWKLER

SEQ ID NO: 138287 - protein, 9 aa, West Nile virus
HTLWGDGVV

SEQ ID NO: 138288 - protein, 9 aa, West Nile virus
TLWGDGVVE

SEQ ID NO: 138289 - protein, 9 aa, West Nile virus
LWGDGVVES

SEQ ID NO: 138290 - protein, 9 aa, West Nile virus
GVVESDLII

SEQ ID NO: 138291 - protein, 9 aa, West Nile virus
VVESDLIIP

SEQ ID NO: 138292 - protein, 9 aa, West Nile virus
CGHRGPSAR

SEQ ID NO: 138293 - protein, 9 aa, West Nile virus
GHRGPSART

SEQ ID NO: 138294 - protein, 9 aa, West Nile virus
LPPLRYTTE

SEQ ID NO: 138295 - protein, 9 aa, West Nile virus
EIRPLKHDE

SEQ ID NO: 138296 - protein, 9 aa, West Nile virus
IRPQKHDER

SEQ ID NO: 138297 - protein, 9 aa, West Nile virus
RPQRHDGKT

SEQ ID NO: 138298 - protein, 9 aa, West Nile virus
PQRHDGKTL

SEQ ID NO: 138299 - protein, 9 aa, West Nile virus
QRHDGKTLV

SEQ ID NO: 138300 - protein, 9 aa, West Nile virus
SRVNAHNAD

SEQ ID NO: 138301 - protein, 9 aa, West Nile virus
RVNAHNADM

SEQ ID NO: 138302 - protein, 9 aa, West Nile virus
LLVVFLVTQ

SEQ ID NO: 138303 - protein, 9 aa, West Nile virus
LVVFLVTQE

SEQ ID NO: 138304 - protein, 9 aa, West Nile virus
RRWTAKISM

SEQ ID NO: 138305 - protein, 9 aa, West Nile virus
PAILLALLV

SEQ ID NO: 138306 - protein, 9 aa, West Nile virus
AILVALAVL

SEQ ID NO: 138307 - protein, 9 aa, West Nile virus
ILVALAVLV

SEQ ID NO: 138308 - protein, 9 aa, West Nile virus
LLALLVLVF

SEQ ID NO: 138309 - protein, 9 aa, West Nile virus
FGGVTYTDV

SEQ ID NO: 138310 - protein, 9 aa, West Nile virus
YTDVLRYII

SEQ ID NO: 138311 - protein, 9 aa, West Nile virus
TDVLRYIIL

SEQ ID NO: 138312 - protein, 9 aa, West Nile virus
IQPVFMVAT

SEQ ID NO: 138313 - protein, 9 aa, West Nile virus
VFMVATFVK

SEQ ID NO: 138314 - protein, 9 aa, West Nile virus
FVVASFLKA

SEQ ID NO: 138315 - protein, 9 aa, West Nile virus
VASFLRARW

SEQ ID NO: 138316 - protein, 9 aa, West Nile virus
ASFLRARWT

SEQ ID NO: 138317 - protein, 9 aa, West Nile virus
SFLKAGWTN

SEQ ID NO: 138318 - protein, 9 aa, West Nile virus
RWTNQENTL

SEQ ID NO: 138319 - protein, 9 aa, West Nile virus
AAFFQMAYH

SEQ ID NO: 138320 - protein, 9 aa, West Nile virus
AFFQMAYHD

SEQ ID NO: 138321 - protein, 9 aa, West Nile virus
WGIPDVLNS

SEQ ID NO: 138322 - protein, 9 aa, West Nile virus
GIPDVLNSL

SEQ ID NO: 138323 - protein, 9 aa, West Nile virus
ISDVLNSLA

SEQ ID NO: 138324 - protein, 9 aa, West Nile virus
VSRILLLMV

SEQ ID NO: 138325 - protein, 9 aa, West Nile virus
MIGIGSLIK

SEQ ID NO: 138326 - protein, 9 aa, West Nile virus
IGIGSLIRE

SEQ ID NO: 138327 - protein, 9 aa, West Nile virus
IGSLIKEKK

SEQ ID NO: 138328 - protein, 9 aa, West Nile virus
GSLIKEKKN

SEQ ID NO: 138329 - protein, 9 aa, West Nile virus
ERRSSAAKK

SEQ ID NO: 138330 - protein, 9 aa, West Nile virus
KKNSAAKKK

SEQ ID NO: 138331 - protein, 9 aa, West Nile virus
PITLAAGLM

SEQ ID NO: 138332 - protein, 9 aa, West Nile virus
LAAGLVACD

SEQ ID NO: 138333 - protein, 9 aa, West Nile virus
AAGLVACDP

SEQ ID NO: 138334 - protein, 9 aa, West Nile virus
AGLVACDPN

SEQ ID NO: 138335 - protein, 9 aa, West Nile virus
GLVACDPNR

SEQ ID NO: 138336 - protein, 9 aa, West Nile virus
LVACDPNRK

SEQ ID NO: 138337 - protein, 9 aa, West Nile virus
VACDPNRKR

SEQ ID NO: 138338 - protein, 9 aa, West Nile virus
RTANISWES

SEQ ID NO: 138339 - protein, 9 aa, West Nile virus
VADISWEND

SEQ ID NO: 138340 - protein, 9 aa, West Nile virus
ADISWESDV

SEQ ID NO: 138341 - protein, 9 aa, West Nile virus
DISWENDAE

SEQ ID NO: 138342 - protein, 9 aa, West Nile virus
ISWESDVEI

SEQ ID NO: 138343 - protein, 9 aa, West Nile virus
SWESDVEIT

SEQ ID NO: 138344 - protein, 9 aa, West Nile virus
ENDAEITGS

SEQ ID NO: 138345 - protein, 9 aa, West Nile virus
SDVEITGSS

SEQ ID NO: 138346 - protein, 9 aa, West Nile virus
WMLKMACLA

SEQ ID NO: 138347 - protein, 9 aa, West Nile virus
MFCLAISAY

SEQ ID NO: 138348 - protein, 9 aa, West Nile virus
ACLAVSAYT

SEQ ID NO: 138349 - protein, 9 aa, West Nile virus
DTPSPKVYK

SEQ ID NO: 138350 - protein, 9 aa, West Nile virus
EYRKGDTAT

SEQ ID NO: 138351 - protein, 9 aa, West Nile virus
KLGHRWNGM

SEQ ID NO: 138352 - protein, 9 aa, West Nile virus
LQHRWNGQD

SEQ ID NO: 138353 - protein, 9 aa, West Nile virus
QHRWNGQDE

SEQ ID NO: 138354 - protein, 9 aa, West Nile virus
HRWNGMDEV

SEQ ID NO: 138355 - protein, 9 aa, West Nile virus
ERMDEPIPV

SEQ ID NO: 138356 - protein, 9 aa, West Nile virus
RMEEPPPVG

SEQ ID NO: 138357 - protein, 9 aa, West Nile virus
MEEPVPSGF

SEQ ID NO: 138358 - protein, 9 aa, West Nile virus
EPEMLRKKK

SEQ ID NO: 138359 - protein, 9 aa, West Nile virus
QIIKEAIDR

SEQ ID NO: 138360 - protein, 9 aa, West Nile virus
IIKEAIDRR

SEQ ID NO: 138361 - protein, 9 aa, West Nile virus
IKEAISKRL

SEQ ID NO: 138362 - protein, 9 aa, West Nile virus
KEAMNRRLR

SEQ ID NO: 138363 - protein, 9 aa, West Nile virus
SKRLRTAIL

SEQ ID NO: 138364 - protein, 9 aa, West Nile virus
IRYHTSAVT

SEQ ID NO: 138365 - protein, 9 aa, West Nile virus
RYQTSAVNR

SEQ ID NO: 138366 - protein, 9 aa, West Nile virus
YHTSAVTRE

SEQ ID NO: 138367 - protein, 9 aa, West Nile virus
QTSAVNREH

SEQ ID NO: 138368 - protein, 9 aa, West Nile virus
ITDGEGKVV

SEQ ID NO: 138369 - protein, 9 aa, West Nile virus
TDGESRVVL

SEQ ID NO: 138370 - protein, 9 aa, West Nile virus
EGEARVILG

SEQ ID NO: 138371 - protein, 9 aa, West Nile virus
GEARVILGE

SEQ ID NO: 138372 - protein, 9 aa, West Nile virus
EGKVVLSEP

SEQ ID NO: 138373 - protein, 9 aa, West Nile virus
AYKVASAGI

SEQ ID NO: 138374 - protein, 9 aa, West Nile virus
KVASAGISY

SEQ ID NO: 138375 - protein, 9 aa, West Nile virus
AGKRSQIGL

SEQ ID NO: 138376 - protein, 9 aa, West Nile virus
GKRSQVGLI

SEQ ID NO: 138377 - protein, 9 aa, West Nile virus
KRSQMGLIE

SEQ ID NO: 138378 - protein, 9 aa, West Nile virus
SQVGLIEVL

SEQ ID NO: 138379 - protein, 9 aa, West Nile virus
QMGLIEVLG

SEQ ID NO: 138380 - protein, 9 aa, West Nile virus
MGLIEVLGK

SEQ ID NO: 138381 - protein, 9 aa, West Nile virus
DKGGRAHRM

SEQ ID NO: 138382 - protein, 9 aa, West Nile virus
LLGVMTMGV

SEQ ID NO: 138383 - protein, 9 aa, West Nile virus
LGVMTMGVF

SEQ ID NO: 138384 - protein, 9 aa, West Nile virus
VMTMGIFFL

SEQ ID NO: 138385 - protein, 9 aa, West Nile virus
MTMGVFLLL

SEQ ID NO: 138386 - protein, 9 aa, West Nile virus
TMGVFLLLM

SEQ ID NO: 138387 - protein, 9 aa, West Nile virus
VSKIGLAGV

SEQ ID NO: 138388 - protein, 9 aa, West Nile virus
LAVATFFCW

SEQ ID NO: 138389 - protein, 9 aa, West Nile virus
VFMICVMTL

SEQ ID NO: 138390 - protein, 9 aa, West Nile virus
GEFFLDLRP

SEQ ID NO: 138391 - protein, 9 aa, West Nile virus
EFFLDLRPA

SEQ ID NO: 138392 - protein, 9 aa, West Nile virus
TTAFLTPLL

SEQ ID NO: 138393 - protein, 9 aa, West Nile virus
FLTPLLKHL

SEQ ID NO: 138394 - protein, 9 aa, West Nile virus
MLIWVSLAA

SEQ ID NO: 138395 - protein, 9 aa, West Nile virus
LIWVSLAAV

SEQ ID NO: 138396 - protein, 9 aa, West Nile virus
ILVSVAAVV

SEQ ID NO: 138397 - protein, 9 aa, West Nile virus
LVSVAAVVV

SEQ ID NO: 138398 - protein, 9 aa, West Nile virus
KSMEKPVLK

SEQ ID NO: 138399 - protein, 9 aa, West Nile virus
NMEKPGIKR

SEQ ID NO: 138400 - protein, 9 aa, West Nile virus
LEKPGLKRG

SEQ ID NO: 138401 - protein, 9 aa, West Nile virus
EAWKERLNQ

SEQ ID NO: 138402 - protein, 9 aa, West Nile virus
VWKERLNYM

SEQ ID NO: 138403 - protein, 9 aa, West Nile virus
WKEKLNQMS

SEQ ID NO: 138404 - protein, 9 aa, West Nile virus
MTKEEFARY

SEQ ID NO: 138405 - protein, 9 aa, West Nile virus
KEEFARYRK

SEQ ID NO: 138406 - protein, 9 aa, West Nile virus
TRYRREAIT

SEQ ID NO: 138407 - protein, 9 aa, West Nile virus
IEVDRSTAK

SEQ ID NO: 138408 - protein, 9 aa, West Nile virus
REGNVTGGH

SEQ ID NO: 138409 - protein, 9 aa, West Nile virus
DVFYRPSEV

SEQ ID NO: 138410 - protein, 9 aa, West Nile virus
VFYRPSESC

SEQ ID NO: 138411 - protein, 9 aa, West Nile virus
FYRPSEVSD

SEQ ID NO: 138412 - protein, 9 aa, West Nile virus
YRPSEVSDT

SEQ ID NO: 138413 - protein, 9 aa, West Nile virus
RTSEASDTL

SEQ ID NO: 138414 - protein, 9 aa, West Nile virus
PSEVSDTLL

SEQ ID NO: 138415 - protein, 9 aa, West Nile virus
PRVIEKMET

SEQ ID NO: 138416 - protein, 9 aa, West Nile virus
RVIEKMETL

SEQ ID NO: 138417 - protein, 9 aa, West Nile virus
VEKMEVLQR

SEQ ID NO: 138418 - protein, 9 aa, West Nile virus
WVSQASGNI

SEQ ID NO: 138419 - protein, 9 aa, West Nile virus
VSRASSNVV

SEQ ID NO: 138420 - protein, 9 aa, West Nile virus
SRASRNVVH

SEQ ID NO: 138421 - protein, 9 aa, West Nile virus
KRTWKGPQF

SEQ ID NO: 138422 - protein, 9 aa, West Nile virus
KTWKGPHYE

SEQ ID NO: 138423 - protein, 9 aa, West Nile virus
GPHYEEDVN

SEQ ID NO: 138424 - protein, 9 aa, West Nile virus
PHYEEDVNL

SEQ ID NO: 138425 - protein, 9 aa, West Nile virus
LNSDTRKIK

SEQ ID NO: 138426 - protein, 9 aa, West Nile virus
SDTRKIKNR

SEQ ID NO: 138427 - protein, 9 aa, West Nile virus
NRIEKLKKE

SEQ ID NO: 138428 - protein, 9 aa, West Nile virus
IERLKKEYN

SEQ ID NO: 138429 - protein, 9 aa, West Nile virus
DSNHPYRTW

SEQ ID NO: 138430 - protein, 9 aa, West Nile virus
SNHPYRTWN

SEQ ID NO: 138431 - protein, 9 aa, West Nile virus
RDKRPRLCS

SEQ ID NO: 138432 - protein, 9 aa, West Nile virus
EKKPRMCSR

SEQ ID NO: 138433 - protein, 9 aa, West Nile virus
LCSREEFKR

SEQ ID NO: 138434 - protein, 9 aa, West Nile virus
CSREEFISK

SEQ ID NO: 138435 - protein, 9 aa, West Nile virus
SREEFISKV

SEQ ID NO: 138436 - protein, 9 aa, West Nile virus
QNQWRSARA

SEQ ID NO: 138437 - protein, 9 aa, West Nile virus
NQWRSARAA

SEQ ID NO: 138438 - protein, 9 aa, West Nile virus
QWRSARAAV

SEQ ID NO: 138439 - protein, 9 aa, West Nile virus
WRSARAAVE

SEQ ID NO: 138440 - protein, 9 aa, West Nile virus
RSARAAVED

SEQ ID NO: 138441 - protein, 9 aa, West Nile virus
SAREAVEDS

SEQ ID NO: 138442 - protein, 9 aa, West Nile virus
STFWEMVDE

SEQ ID NO: 138443 - protein, 9 aa, West Nile virus
GGKIFADDT

SEQ ID NO: 138444 - protein, 9 aa, West Nile virus
GKIFADDTA

SEQ ID NO: 138445 - protein, 9 aa, West Nile virus
KTYADDTAG

SEQ ID NO: 138446 - protein, 9 aa, West Nile virus
SIIQLTYRH

SEQ ID NO: 138447 - protein, 9 aa, West Nile virus
ADGKTVMSL

SEQ ID NO: 138448 - protein, 9 aa, West Nile virus
DRKTVMDVI

SEQ ID NO: 138449 - protein, 9 aa, West Nile virus
EGVIGPYDV

SEQ ID NO: 138450 - protein, 9 aa, West Nile virus
GVITPDDVE

SEQ ID NO: 138451 - protein, 9 aa, West Nile virus
VGGEWMTTE

SEQ ID NO: 138452 - protein, 9 aa, West Nile virus
GGEWMTTEG

SEQ ID NO: 138453 - protein, 9 aa, West Nile virus
EGMLEVWNR

SEQ ID NO: 138454 - protein, 9 aa, West Nile virus
DMLGVWNKV

SEQ ID NO: 138455 - protein, 10 aa, West Nile virus
MSKKPGGPGK

SEQ ID NO: 138456 - protein, 10 aa, West Nile virus
SKKPGGPGKS

SEQ ID NO: 138457 - protein, 10 aa, West Nile virus
KKPGGPGKSR

SEQ ID NO: 138458 - protein, 10 aa, West Nile virus
KPGGPGKSRA

SEQ ID NO: 138459 - protein, 10 aa, West Nile virus
PGGPGKSRAV

SEQ ID NO: 138460 - protein, 10 aa, West Nile virus
GGPGKSRAVN

SEQ ID NO: 138461 - protein, 10 aa, West Nile virus
GPGKSRAVNM

SEQ ID NO: 138462 - protein, 10 aa, West Nile virus
PGKSRAVNML

SEQ ID NO: 138463 - protein, 10 aa, West Nile virus
GKSRAVNMLK

SEQ ID NO: 138464 - protein, 10 aa, West Nile virus
KSRAVNMLKR

SEQ ID NO: 138465 - protein, 10 aa, West Nile virus
SRAVNMLKRG

SEQ ID NO: 138466 - protein, 10 aa, West Nile virus
RAVNMLKRGM

SEQ ID NO: 138467 - protein, 10 aa, West Nile virus
AVNMLKRGMP

SEQ ID NO: 138468 - protein, 10 aa, West Nile virus
VNMLKRGMPR

SEQ ID NO: 138469 - protein, 10 aa, West Nile virus
KRGMPRVLSL

SEQ ID NO: 138470 - protein, 10 aa, West Nile virus
PRVLSLIGLK

SEQ ID NO: 138471 - protein, 10 aa, West Nile virus
RVLSLIGLKR

SEQ ID NO: 138472 - protein, 10 aa, West Nile virus
VLSLIGLKRA

SEQ ID NO: 138473 - protein, 10 aa, West Nile virus
LSLIGLKRAM

SEQ ID NO: 138474 - protein, 10 aa, West Nile virus
SLIGLKRAML

SEQ ID NO: 138475 - protein, 10 aa, West Nile virus
LIGLKRAMLS

SEQ ID NO: 138476 - protein, 10 aa, West Nile virus
IGLKRAMLSL

SEQ ID NO: 138477 - protein, 10 aa, West Nile virus
GLKRAMLSLI

SEQ ID NO: 138478 - protein, 10 aa, West Nile virus
LKRAMLSLID

SEQ ID NO: 138479 - protein, 10 aa, West Nile virus
KRAMLSLIDG

SEQ ID NO: 138480 - protein, 10 aa, West Nile virus
RAMLSLIDGK

SEQ ID NO: 138481 - protein, 10 aa, West Nile virus
AMLSLIDGKG

SEQ ID NO: 138482 - protein, 10 aa, West Nile virus
MLSLIDGKGP

SEQ ID NO: 138483 - protein, 10 aa, West Nile virus
LSLIDGKGPI

SEQ ID NO: 138484 - protein, 10 aa, West Nile virus
SLIDGKGPIR

SEQ ID NO: 138485 - protein, 10 aa, West Nile virus
LIDGKGPIRF

SEQ ID NO: 138486 - protein, 10 aa, West Nile virus
IDGKGPIRFV

SEQ ID NO: 138487 - protein, 10 aa, West Nile virus
DGKGPIRFVL

SEQ ID NO: 138488 - protein, 10 aa, West Nile virus
GKGPIRFVLA

SEQ ID NO: 138489 - protein, 10 aa, West Nile virus
KGPIRFVLAL

SEQ ID NO: 138490 - protein, 10 aa, West Nile virus
GPIRFVLALL

SEQ ID NO: 138491 - protein, 10 aa, West Nile virus
PIRFVLALLA

SEQ ID NO: 138492 - protein, 10 aa, West Nile virus
IRFVLALLAF

SEQ ID NO: 138493 - protein, 10 aa, West Nile virus
RFVLALLAFF

SEQ ID NO: 138494 - protein, 10 aa, West Nile virus
FVLALLAFFR

SEQ ID NO: 138495 - protein, 10 aa, West Nile virus
VLALLAFFRF

SEQ ID NO: 138496 - protein, 10 aa, West Nile virus
LALLAFFRFT

SEQ ID NO: 138497 - protein, 10 aa, West Nile virus
ALLAFFRFTA

SEQ ID NO: 138498 - protein, 10 aa, West Nile virus
LLAFFRFTAI

SEQ ID NO: 138499 - protein, 10 aa, West Nile virus
LAFFRFTAIA

SEQ ID NO: 138500 - protein, 10 aa, West Nile virus
AFFRFTAIAP

SEQ ID NO: 138501 - protein, 10 aa, West Nile virus
FFRFTAIAPT

SEQ ID NO: 138502 - protein, 10 aa, West Nile virus
FRFTAIAPTR

SEQ ID NO: 138503 - protein, 10 aa, West Nile virus
RFTAIAPTRA

SEQ ID NO: 138504 - protein, 10 aa, West Nile virus
FTAIAPTRAV

SEQ ID NO: 138505 - protein, 10 aa, West Nile virus
TAIAPTRAVL

SEQ ID NO: 138506 - protein, 10 aa, West Nile virus
AIAPTRAVLD

SEQ ID NO: 138507 - protein, 10 aa, West Nile virus
IAPTRAVLDR

SEQ ID NO: 138508 - protein, 10 aa, West Nile virus
APTRAVLDRW

SEQ ID NO: 138509 - protein, 10 aa, West Nile virus
PTRAVLDRWR

SEQ ID NO: 138510 - protein, 10 aa, West Nile virus
TRAVLDRWRG

SEQ ID NO: 138511 - protein, 10 aa, West Nile virus
RAVLDRWRGV

SEQ ID NO: 138512 - protein, 10 aa, West Nile virus
AVLDRWRGVN

SEQ ID NO: 138513 - protein, 10 aa, West Nile virus
VLDRWRGVNK

SEQ ID NO: 138514 - protein, 10 aa, West Nile virus
LDRWRGVNKQ

SEQ ID NO: 138515 - protein, 10 aa, West Nile virus
DRWRGVNKQT

SEQ ID NO: 138516 - protein, 10 aa, West Nile virus
RWRGVNKQTA

SEQ ID NO: 138517 - protein, 10 aa, West Nile virus
WRGVNKQTAM

SEQ ID NO: 138518 - protein, 10 aa, West Nile virus
RGVNKQTAMK

SEQ ID NO: 138519 - protein, 10 aa, West Nile virus
GVNKQTAMKH

SEQ ID NO: 138520 - protein, 10 aa, West Nile virus
VNKQTAMKHL

SEQ ID NO: 138521 - protein, 10 aa, West Nile virus
NKQTAMKHLL

SEQ ID NO: 138522 - protein, 10 aa, West Nile virus
KQTAMKHLLS

SEQ ID NO: 138523 - protein, 10 aa, West Nile virus
QTAMKHLLSF

SEQ ID NO: 138524 - protein, 10 aa, West Nile virus
TAMKHLLSFK

SEQ ID NO: 138525 - protein, 10 aa, West Nile virus
AMKHLLSFKK

SEQ ID NO: 138526 - protein, 10 aa, West Nile virus
MKHLLSFKKE

SEQ ID NO: 138527 - protein, 10 aa, West Nile virus
KHLLSFKKEL

SEQ ID NO: 138528 - protein, 10 aa, West Nile virus
HLLSFKKELG

SEQ ID NO: 138529 - protein, 10 aa, West Nile virus
LLSFKKELGT

SEQ ID NO: 138530 - protein, 10 aa, West Nile virus
LSFKKELGTL

SEQ ID NO: 138531 - protein, 10 aa, West Nile virus
SFKKELGTLT

SEQ ID NO: 138532 - protein, 10 aa, West Nile virus
FKKELGTLTS

SEQ ID NO: 138533 - protein, 10 aa, West Nile virus
KKELGTLTSA

SEQ ID NO: 138534 - protein, 10 aa, West Nile virus
KELGTLTSAI

SEQ ID NO: 138535 - protein, 10 aa, West Nile virus
ELGTLTSAIN

SEQ ID NO: 138536 - protein, 10 aa, West Nile virus
LGTLTSAINR

SEQ ID NO: 138537 - protein, 10 aa, West Nile virus
GTLTSAINRR

SEQ ID NO: 138538 - protein, 10 aa, West Nile virus
TLTSAINRRS

SEQ ID NO: 138539 - protein, 10 aa, West Nile virus
NRRSSKQKKR

SEQ ID NO: 138540 - protein, 10 aa, West Nile virus
RRSSKQKKRG

SEQ ID NO: 138541 - protein, 10 aa, West Nile virus
RSSKQKKRGG

SEQ ID NO: 138542 - protein, 10 aa, West Nile virus
KQKKRGGKTG

SEQ ID NO: 138543 - protein, 10 aa, West Nile virus
GAVTLSNFQG

SEQ ID NO: 138544 - protein, 10 aa, West Nile virus
AVTLSNFQGK

SEQ ID NO: 138545 - protein, 10 aa, West Nile virus
VTLSNFQGKV

SEQ ID NO: 138546 - protein, 10 aa, West Nile virus
TLSNFQGKVM

SEQ ID NO: 138547 - protein, 10 aa, West Nile virus
LSNFQGKVMM

SEQ ID NO: 138548 - protein, 10 aa, West Nile virus
SNFQGKVMMT

SEQ ID NO: 138549 - protein, 10 aa, West Nile virus
NFQGKVMMTV

SEQ ID NO: 138550 - protein, 10 aa, West Nile virus
FQGKVMMTVN

SEQ ID NO: 138551 - protein, 10 aa, West Nile virus
QGKVMMTVNA

SEQ ID NO: 138552 - protein, 10 aa, West Nile virus
GKVMMTVNAT

SEQ ID NO: 138553 - protein, 10 aa, West Nile virus
KVMMTVNATD

SEQ ID NO: 138554 - protein, 10 aa, West Nile virus
VITIPTAAGK

SEQ ID NO: 138555 - protein, 10 aa, West Nile virus
ITIPTAAGKN

SEQ ID NO: 138556 - protein, 10 aa, West Nile virus
TIPTAAGKNL

SEQ ID NO: 138557 - protein, 10 aa, West Nile virus
IPTAAGKNLC

SEQ ID NO: 138558 - protein, 10 aa, West Nile virus
PTAAGKNLCI

SEQ ID NO: 138559 - protein, 10 aa, West Nile virus
TAAGKNLCIV

SEQ ID NO: 138560 - protein, 10 aa, West Nile virus
AAGKNLCIVR

SEQ ID NO: 138561 - protein, 10 aa, West Nile virus
AGKNLCIVRA

SEQ ID NO: 138562 - protein, 10 aa, West Nile virus
GKNLCIVRAM

SEQ ID NO: 138563 - protein, 10 aa, West Nile virus
KNLCIVRAMD

SEQ ID NO: 138564 - protein, 10 aa, West Nile virus
NLCIVRAMDV

SEQ ID NO: 138565 - protein, 10 aa, West Nile virus
LCIVRAMDVG

SEQ ID NO: 138566 - protein, 10 aa, West Nile virus
CIVRAMDVGY

SEQ ID NO: 138567 - protein, 10 aa, West Nile virus
VRAMDVGYMC

SEQ ID NO: 138568 - protein, 10 aa, West Nile virus
RAMDVGYMCD

SEQ ID NO: 138569 - protein, 10 aa, West Nile virus
AMDVGYMCDD

SEQ ID NO: 138570 - protein, 10 aa, West Nile virus
MDVGYMCDDT

SEQ ID NO: 138571 - protein, 10 aa, West Nile virus
DVGYMCDDTI

SEQ ID NO: 138572 - protein, 10 aa, West Nile virus
VGYMCDDTIT

SEQ ID NO: 138573 - protein, 10 aa, West Nile virus
GYMCDDTITY

SEQ ID NO: 138574 - protein, 10 aa, West Nile virus
YMCDDTITYE

SEQ ID NO: 138575 - protein, 10 aa, West Nile virus
MCDDTITYEC

SEQ ID NO: 138576 - protein, 10 aa, West Nile virus
CDDTITYECP

SEQ ID NO: 138577 - protein, 10 aa, West Nile virus
DDTITYECPV

SEQ ID NO: 138578 - protein, 10 aa, West Nile virus
DTITYECPVL

SEQ ID NO: 138579 - protein, 10 aa, West Nile virus
TITYECPVLS

SEQ ID NO: 138580 - protein, 10 aa, West Nile virus
ITYECPVLSA

SEQ ID NO: 138581 - protein, 10 aa, West Nile virus
TYECPVLSAG

SEQ ID NO: 138582 - protein, 10 aa, West Nile virus
YECPVLSAGN

SEQ ID NO: 138583 - protein, 10 aa, West Nile virus
ECPVLSAGND

SEQ ID NO: 138584 - protein, 10 aa, West Nile virus
CPVLSAGNDP

SEQ ID NO: 138585 - protein, 10 aa, West Nile virus
PVLSAGNDPE

SEQ ID NO: 138586 - protein, 10 aa, West Nile virus
VLSAGNDPED

SEQ ID NO: 138587 - protein, 10 aa, West Nile virus
LSAGNDPEDI

SEQ ID NO: 138588 - protein, 10 aa, West Nile virus
SAGNDPEDID

SEQ ID NO: 138589 - protein, 10 aa, West Nile virus
AGNDPEDIDC

SEQ ID NO: 138590 - protein, 10 aa, West Nile virus
GNDPEDIDCW

SEQ ID NO: 138591 - protein, 10 aa, West Nile virus
NDPEDIDCWC

SEQ ID NO: 138592 - protein, 10 aa, West Nile virus
DPEDIDCWCT

SEQ ID NO: 138593 - protein, 10 aa, West Nile virus
PEDIDCWCTK

SEQ ID NO: 138594 - protein, 10 aa, West Nile virus
EDIDCWCTKS

SEQ ID NO: 138595 - protein, 10 aa, West Nile virus
DIDCWCTKSA

SEQ ID NO: 138596 - protein, 10 aa, West Nile virus
AVYVRYGRCT

SEQ ID NO: 138597 - protein, 10 aa, West Nile virus
VYVRYGRCTK

SEQ ID NO: 138598 - protein, 10 aa, West Nile virus
YVRYGRCTKT

SEQ ID NO: 138599 - protein, 10 aa, West Nile virus
VRYGRCTKTR

SEQ ID NO: 138600 - protein, 10 aa, West Nile virus
RYGRCTKTRH

SEQ ID NO: 138601 - protein, 10 aa, West Nile virus
YGRCTKTRHS

SEQ ID NO: 138602 - protein, 10 aa, West Nile virus
GRCTKTRHSR

SEQ ID NO: 138603 - protein, 10 aa, West Nile virus
RCTKTRHSRR

SEQ ID NO: 138604 - protein, 10 aa, West Nile virus
CTKTRHSRRS

SEQ ID NO: 138605 - protein, 10 aa, West Nile virus
TKTRHSRRSR

SEQ ID NO: 138606 - protein, 10 aa, West Nile virus
KTRHSRRSRR

SEQ ID NO: 138607 - protein, 10 aa, West Nile virus
TRHSRRSRRS

SEQ ID NO: 138608 - protein, 10 aa, West Nile virus
RHSRRSRRSL

SEQ ID NO: 138609 - protein, 10 aa, West Nile virus
HSRRSRRSLT

SEQ ID NO: 138610 - protein, 10 aa, West Nile virus
SRRSRRSLTV

SEQ ID NO: 138611 - protein, 10 aa, West Nile virus
RRSRRSLTVQ

SEQ ID NO: 138612 - protein, 10 aa, West Nile virus
RSRRSLTVQT

SEQ ID NO: 138613 - protein, 10 aa, West Nile virus
SRRSLTVQTH

SEQ ID NO: 138614 - protein, 10 aa, West Nile virus
RRSLTVQTHG

SEQ ID NO: 138615 - protein, 10 aa, West Nile virus
RSLTVQTHGE

SEQ ID NO: 138616 - protein, 10 aa, West Nile virus
SLTVQTHGES

SEQ ID NO: 138617 - protein, 10 aa, West Nile virus
LTVQTHGEST

SEQ ID NO: 138618 - protein, 10 aa, West Nile virus
TVQTHGESTL

SEQ ID NO: 138619 - protein, 10 aa, West Nile virus
VQTHGESTLA

SEQ ID NO: 138620 - protein, 10 aa, West Nile virus
QTHGESTLAN

SEQ ID NO: 138621 - protein, 10 aa, West Nile virus
THGESTLANK

SEQ ID NO: 138622 - protein, 10 aa, West Nile virus
HGESTLANKK

SEQ ID NO: 138623 - protein, 10 aa, West Nile virus
GESTLANKKG

SEQ ID NO: 138624 - protein, 10 aa, West Nile virus
ESTLANKKGA

SEQ ID NO: 138625 - protein, 10 aa, West Nile virus
STLANKKGAW

SEQ ID NO: 138626 - protein, 10 aa, West Nile virus
TLANKKGAWM

SEQ ID NO: 138627 - protein, 10 aa, West Nile virus
LANKKGAWMD

SEQ ID NO: 138628 - protein, 10 aa, West Nile virus
ANKKGAWMDS

SEQ ID NO: 138629 - protein, 10 aa, West Nile virus
NKKGAWMDST

SEQ ID NO: 138630 - protein, 10 aa, West Nile virus
KKGAWMDSTK

SEQ ID NO: 138631 - protein, 10 aa, West Nile virus
KGAWMDSTKA

SEQ ID NO: 138632 - protein, 10 aa, West Nile virus
GAWMDSTKAT

SEQ ID NO: 138633 - protein, 10 aa, West Nile virus
AWMDSTKATR

SEQ ID NO: 138634 - protein, 10 aa, West Nile virus
WMDSTKATRY

SEQ ID NO: 138635 - protein, 10 aa, West Nile virus
MDSTKATRYL

SEQ ID NO: 138636 - protein, 10 aa, West Nile virus
DSTKATRYLV

SEQ ID NO: 138637 - protein, 10 aa, West Nile virus
STKATRYLVK

SEQ ID NO: 138638 - protein, 10 aa, West Nile virus
TKATRYLVKT

SEQ ID NO: 138639 - protein, 10 aa, West Nile virus
KATRYLVKTE

SEQ ID NO: 138640 - protein, 10 aa, West Nile virus
ATRYLVKTES

SEQ ID NO: 138641 - protein, 10 aa, West Nile virus
TRYLVKTESW

SEQ ID NO: 138642 - protein, 10 aa, West Nile virus
RYLVKTESWI

SEQ ID NO: 138643 - protein, 10 aa, West Nile virus
YLVKTESWIL

SEQ ID NO: 138644 - protein, 10 aa, West Nile virus
LVKTESWILR

SEQ ID NO: 138645 - protein, 10 aa, West Nile virus
VKTESWILRN

SEQ ID NO: 138646 - protein, 10 aa, West Nile virus
KTESWILRNP

SEQ ID NO: 138647 - protein, 10 aa, West Nile virus
TESWILRNPG

SEQ ID NO: 138648 - protein, 10 aa, West Nile virus
ESWILRNPGY

SEQ ID NO: 138649 - protein, 10 aa, West Nile virus
SWILRNPGYA

SEQ ID NO: 138650 - protein, 10 aa, West Nile virus
WILRNPGYAL

SEQ ID NO: 138651 - protein, 10 aa, West Nile virus
ILRNPGYALV

SEQ ID NO: 138652 - protein, 10 aa, West Nile virus
LRNPGYALVA

SEQ ID NO: 138653 - protein, 10 aa, West Nile virus
RNPGYALVAA

SEQ ID NO: 138654 - protein, 10 aa, West Nile virus
NPGYALVAAV

SEQ ID NO: 138655 - protein, 10 aa, West Nile virus
PGYALVAAVI

SEQ ID NO: 138656 - protein, 10 aa, West Nile virus
GYALVAAVIG

SEQ ID NO: 138657 - protein, 10 aa, West Nile virus
YALVAAVIGW

SEQ ID NO: 138658 - protein, 10 aa, West Nile virus
ALVAAVIGWM

SEQ ID NO: 138659 - protein, 10 aa, West Nile virus
LVAAVIGWML

SEQ ID NO: 138660 - protein, 10 aa, West Nile virus
VAAVIGWMLG

SEQ ID NO: 138661 - protein, 10 aa, West Nile virus
AAVIGWMLGS

SEQ ID NO: 138662 - protein, 10 aa, West Nile virus
AVIGWMLGSN

SEQ ID NO: 138663 - protein, 10 aa, West Nile virus
VIGWMLGSNT

SEQ ID NO: 138664 - protein, 10 aa, West Nile virus
IGWMLGSNTM

SEQ ID NO: 138665 - protein, 10 aa, West Nile virus
GWMLGSNTMQ

SEQ ID NO: 138666 - protein, 10 aa, West Nile virus
WMLGSNTMQR

SEQ ID NO: 138667 - protein, 10 aa, West Nile virus
MLGSNTMQRV

SEQ ID NO: 138668 - protein, 10 aa, West Nile virus
LGSNTMQRVV

SEQ ID NO: 138669 - protein, 10 aa, West Nile virus
GSNTMQRVVF

SEQ ID NO: 138670 - protein, 10 aa, West Nile virus
SNTMQRVVFV

SEQ ID NO: 138671 - protein, 10 aa, West Nile virus
MQRVVFVVLL

SEQ ID NO: 138672 - protein, 10 aa, West Nile virus
QRVVFVVLLL

SEQ ID NO: 138673 - protein, 10 aa, West Nile virus
RVVFVVLLLL

SEQ ID NO: 138674 - protein, 10 aa, West Nile virus
VVFVVLLLLV

SEQ ID NO: 138675 - protein, 10 aa, West Nile virus
VFVVLLLLVA

SEQ ID NO: 138676 - protein, 10 aa, West Nile virus
FVVLLLLVAP

SEQ ID NO: 138677 - protein, 10 aa, West Nile virus
VVLLLLVAPA

SEQ ID NO: 138678 - protein, 10 aa, West Nile virus
VLLLLVAPAY

SEQ ID NO: 138679 - protein, 10 aa, West Nile virus
LLLLVAPAYS

SEQ ID NO: 138680 - protein, 10 aa, West Nile virus
LLLVAPAYSF

SEQ ID NO: 138681 - protein, 10 aa, West Nile virus
LLVAPAYSFN

SEQ ID NO: 138682 - protein, 10 aa, West Nile virus
LVAPAYSFNC

SEQ ID NO: 138683 - protein, 10 aa, West Nile virus
VAPAYSFNCL

SEQ ID NO: 138684 - protein, 10 aa, West Nile virus
APAYSFNCLG

SEQ ID NO: 138685 - protein, 10 aa, West Nile virus
PAYSFNCLGM

SEQ ID NO: 138686 - protein, 10 aa, West Nile virus
AYSFNCLGMS

SEQ ID NO: 138687 - protein, 10 aa, West Nile virus
YSFNCLGMSN

SEQ ID NO: 138688 - protein, 10 aa, West Nile virus
SFNCLGMSNR

SEQ ID NO: 138689 - protein, 10 aa, West Nile virus
FNCLGMSNRD

SEQ ID NO: 138690 - protein, 10 aa, West Nile virus
NCLGMSNRDF

SEQ ID NO: 138691 - protein, 10 aa, West Nile virus
CLGMSNRDFL

SEQ ID NO: 138692 - protein, 10 aa, West Nile virus
LGMSNRDFLE

SEQ ID NO: 138693 - protein, 10 aa, West Nile virus
GMSNRDFLEG

SEQ ID NO: 138694 - protein, 10 aa, West Nile virus
MSNRDFLEGV

SEQ ID NO: 138695 - protein, 10 aa, West Nile virus
SNRDFLEGVS

SEQ ID NO: 138696 - protein, 10 aa, West Nile virus
NRDFLEGVSG

SEQ ID NO: 138697 - protein, 10 aa, West Nile virus
RDFLEGVSGA

SEQ ID NO: 138698 - protein, 10 aa, West Nile virus
DFLEGVSGAT

SEQ ID NO: 138699 - protein, 10 aa, West Nile virus
FLEGVSGATW

SEQ ID NO: 138700 - protein, 10 aa, West Nile virus
LEGVSGATWV

SEQ ID NO: 138701 - protein, 10 aa, West Nile virus
EGVSGATWVD

SEQ ID NO: 138702 - protein, 10 aa, West Nile virus
GVSGATWVDL

SEQ ID NO: 138703 - protein, 10 aa, West Nile virus
VSGATWVDLV

SEQ ID NO: 138704 - protein, 10 aa, West Nile virus
SGATWVDLVL

SEQ ID NO: 138705 - protein, 10 aa, West Nile virus
GATWVDLVLE

SEQ ID NO: 138706 - protein, 10 aa, West Nile virus
ATWVDLVLEG

SEQ ID NO: 138707 - protein, 10 aa, West Nile virus
TWVDLVLEGD

SEQ ID NO: 138708 - protein, 10 aa, West Nile virus
WVDLVLEGDS

SEQ ID NO: 138709 - protein, 10 aa, West Nile virus
VDLVLEGDSC

SEQ ID NO: 138710 - protein, 10 aa, West Nile virus
DLVLEGDSCV

SEQ ID NO: 138711 - protein, 10 aa, West Nile virus
LVLEGDSCVT

SEQ ID NO: 138712 - protein, 10 aa, West Nile virus
VLEGDSCVTI

SEQ ID NO: 138713 - protein, 10 aa, West Nile virus
LEGDSCVTIM

SEQ ID NO: 138714 - protein, 10 aa, West Nile virus
EGDSCVTIMS

SEQ ID NO: 138715 - protein, 10 aa, West Nile virus
GDSCVTIMSK

SEQ ID NO: 138716 - protein, 10 aa, West Nile virus
DSCVTIMSKD

SEQ ID NO: 138717 - protein, 10 aa, West Nile virus
SCVTIMSKDK

SEQ ID NO: 138718 - protein, 10 aa, West Nile virus
CVTIMSKDKP

SEQ ID NO: 138719 - protein, 10 aa, West Nile virus
VTIMSKDKPT

SEQ ID NO: 138720 - protein, 10 aa, West Nile virus
TIMSKDKPTI

SEQ ID NO: 138721 - protein, 10 aa, West Nile virus
IMSKDKPTID

SEQ ID NO: 138722 - protein, 10 aa, West Nile virus
MSKDKPTIDV

SEQ ID NO: 138723 - protein, 10 aa, West Nile virus
SKDKPTIDVK

SEQ ID NO: 138724 - protein, 10 aa, West Nile virus
KDKPTIDVKM

SEQ ID NO: 138725 - protein, 10 aa, West Nile virus
DKPTIDVKMM

SEQ ID NO: 138726 - protein, 10 aa, West Nile virus
KPTIDVKMMN

SEQ ID NO: 138727 - protein, 10 aa, West Nile virus
PTIDVKMMNM

SEQ ID NO: 138728 - protein, 10 aa, West Nile virus
TIDVKMMNME

SEQ ID NO: 138729 - protein, 10 aa, West Nile virus
IDVKMMNMEA

SEQ ID NO: 138730 - protein, 10 aa, West Nile virus
VSDLSTKAAC

SEQ ID NO: 138731 - protein, 10 aa, West Nile virus
SDLSTKAACP

SEQ ID NO: 138732 - protein, 10 aa, West Nile virus
LSTKAACPTM

SEQ ID NO: 138733 - protein, 10 aa, West Nile virus
STKAACPTMG

SEQ ID NO: 138734 - protein, 10 aa, West Nile virus
TKAACPTMGE

SEQ ID NO: 138735 - protein, 10 aa, West Nile virus
KAACPTMGEA

SEQ ID NO: 138736 - protein, 10 aa, West Nile virus
AACPTMGEAH

SEQ ID NO: 138737 - protein, 10 aa, West Nile virus
ACPTMGEAHN

SEQ ID NO: 138738 - protein, 10 aa, West Nile virus
CPTMGEAHND

SEQ ID NO: 138739 - protein, 10 aa, West Nile virus
PTMGEAHNDK

SEQ ID NO: 138740 - protein, 10 aa, West Nile virus
TMGEAHNDKR

SEQ ID NO: 138741 - protein, 10 aa, West Nile virus
MGEAHNDKRA

SEQ ID NO: 138742 - protein, 10 aa, West Nile virus
GEAHNDKRAD

SEQ ID NO: 138743 - protein, 10 aa, West Nile virus
EAHNDKRADP

SEQ ID NO: 138744 - protein, 10 aa, West Nile virus
FVCRQGVVDR

SEQ ID NO: 138745 - protein, 10 aa, West Nile virus
VCRQGVVDRG

SEQ ID NO: 138746 - protein, 10 aa, West Nile virus
CRQGVVDRGW

SEQ ID NO: 138747 - protein, 10 aa, West Nile virus
RQGVVDRGWG

SEQ ID NO: 138748 - protein, 10 aa, West Nile virus
QGVVDRGWGN

SEQ ID NO: 138749 - protein, 10 aa, West Nile virus
GVVDRGWGNG

SEQ ID NO: 138750 - protein, 10 aa, West Nile virus
VVDRGWGNGC

SEQ ID NO: 138751 - protein, 10 aa, West Nile virus
VDRGWGNGCG

SEQ ID NO: 138752 - protein, 10 aa, West Nile virus
DRGWGNGCGL

SEQ ID NO: 138753 - protein, 10 aa, West Nile virus
RGWGNGCGLF

SEQ ID NO: 138754 - protein, 10 aa, West Nile virus
GWGNGCGLFG

SEQ ID NO: 138755 - protein, 10 aa, West Nile virus
WGNGCGLFGK

SEQ ID NO: 138756 - protein, 10 aa, West Nile virus
GNGCGLFGKG

SEQ ID NO: 138757 - protein, 10 aa, West Nile virus
NGCGLFGKGS

SEQ ID NO: 138758 - protein, 10 aa, West Nile virus
GCGLFGKGSI

SEQ ID NO: 138759 - protein, 10 aa, West Nile virus
CGLFGKGSID

SEQ ID NO: 138760 - protein, 10 aa, West Nile virus
GLFGKGSIDT

SEQ ID NO: 138761 - protein, 10 aa, West Nile virus
LFGKGSIDTC

SEQ ID NO: 138762 - protein, 10 aa, West Nile virus
FGKGSIDTCA

SEQ ID NO: 138763 - protein, 10 aa, West Nile virus
GKGSIDTCAK

SEQ ID NO: 138764 - protein, 10 aa, West Nile virus
KGSIDTCAKF

SEQ ID NO: 138765 - protein, 10 aa, West Nile virus
GSIDTCAKFA

SEQ ID NO: 138766 - protein, 10 aa, West Nile virus
SIDTCAKFAC

SEQ ID NO: 138767 - protein, 10 aa, West Nile virus
IDTCAKFACS

SEQ ID NO: 138768 - protein, 10 aa, West Nile virus
DTCAKFACST

SEQ ID NO: 138769 - protein, 10 aa, West Nile virus
TCAKFACSTK

SEQ ID NO: 138770 - protein, 10 aa, West Nile virus
CAKFACSTKA

SEQ ID NO: 138771 - protein, 10 aa, West Nile virus
AKFACSTKAI

SEQ ID NO: 138772 - protein, 10 aa, West Nile virus
KFACSTKAIG

SEQ ID NO: 138773 - protein, 10 aa, West Nile virus
FACSTKAIGR

SEQ ID NO: 138774 - protein, 10 aa, West Nile virus
ACSTKAIGRT

SEQ ID NO: 138775 - protein, 10 aa, West Nile virus
CSTKAIGRTI

SEQ ID NO: 138776 - protein, 10 aa, West Nile virus
STKAIGRTIL

SEQ ID NO: 138777 - protein, 10 aa, West Nile virus
TKAIGRTILK

SEQ ID NO: 138778 - protein, 10 aa, West Nile virus
KAIGRTILKE

SEQ ID NO: 138779 - protein, 10 aa, West Nile virus
AIGRTILKEN

SEQ ID NO: 138780 - protein, 10 aa, West Nile virus
IGRTILKENI

SEQ ID NO: 138781 - protein, 10 aa, West Nile virus
GRTILKENIK

SEQ ID NO: 138782 - protein, 10 aa, West Nile virus
RTILKENIKY

SEQ ID NO: 138783 - protein, 10 aa, West Nile virus
TILKENIKYE

SEQ ID NO: 138784 - protein, 10 aa, West Nile virus
ILKENIKYEV

SEQ ID NO: 138785 - protein, 10 aa, West Nile virus
LKENIKYEVA

SEQ ID NO: 138786 - protein, 10 aa, West Nile virus
KENIKYEVAI

SEQ ID NO: 138787 - protein, 10 aa, West Nile virus
ENIKYEVAIF

SEQ ID NO: 138788 - protein, 10 aa, West Nile virus
NIKYEVAIFV

SEQ ID NO: 138789 - protein, 10 aa, West Nile virus
IKYEVAIFVH

SEQ ID NO: 138790 - protein, 10 aa, West Nile virus
KYEVAIFVHG

SEQ ID NO: 138791 - protein, 10 aa, West Nile virus
YEVAIFVHGP

SEQ ID NO: 138792 - protein, 10 aa, West Nile virus
EVAIFVHGPT

SEQ ID NO: 138793 - protein, 10 aa, West Nile virus
VAIFVHGPTT

SEQ ID NO: 138794 - protein, 10 aa, West Nile virus
AIFVHGPTTV

SEQ ID NO: 138795 - protein, 10 aa, West Nile virus
IFVHGPTTVE

SEQ ID NO: 138796 - protein, 10 aa, West Nile virus
FVHGPTTVES

SEQ ID NO: 138797 - protein, 10 aa, West Nile virus
VHGPTTVESH

SEQ ID NO: 138798 - protein, 10 aa, West Nile virus
HGPTTVESHG

SEQ ID NO: 138799 - protein, 10 aa, West Nile virus
GATQAGRFSI

SEQ ID NO: 138800 - protein, 10 aa, West Nile virus
ATQAGRFSIT

SEQ ID NO: 138801 - protein, 10 aa, West Nile virus
TQAGRFSITP

SEQ ID NO: 138802 - protein, 10 aa, West Nile virus
QAGRFSITPA

SEQ ID NO: 138803 - protein, 10 aa, West Nile virus
AGRFSITPAA

SEQ ID NO: 138804 - protein, 10 aa, West Nile virus
GRFSITPAAP

SEQ ID NO: 138805 - protein, 10 aa, West Nile virus
RFSITPAAPS

SEQ ID NO: 138806 - protein, 10 aa, West Nile virus
SITPAAPSYT

SEQ ID NO: 138807 - protein, 10 aa, West Nile virus
KLGEYGEVTV

SEQ ID NO: 138808 - protein, 10 aa, West Nile virus
LGEYGEVTVD

SEQ ID NO: 138809 - protein, 10 aa, West Nile virus
GEYGEVTVDC

SEQ ID NO: 138810 - protein, 10 aa, West Nile virus
EYGEVTVDCE

SEQ ID NO: 138811 - protein, 10 aa, West Nile virus
YGEVTVDCEP

SEQ ID NO: 138812 - protein, 10 aa, West Nile virus
GEVTVDCEPR

SEQ ID NO: 138813 - protein, 10 aa, West Nile virus
EVTVDCEPRS

SEQ ID NO: 138814 - protein, 10 aa, West Nile virus
VTVDCEPRSG

SEQ ID NO: 138815 - protein, 10 aa, West Nile virus
TVDCEPRSGI

SEQ ID NO: 138816 - protein, 10 aa, West Nile virus
VDCEPRSGID

SEQ ID NO: 138817 - protein, 10 aa, West Nile virus
DCEPRSGIDT

SEQ ID NO: 138818 - protein, 10 aa, West Nile virus
CEPRSGIDTN

SEQ ID NO: 138819 - protein, 10 aa, West Nile virus
EPRSGIDTNA

SEQ ID NO: 138820 - protein, 10 aa, West Nile virus
PRSGIDTNAY

SEQ ID NO: 138821 - protein, 10 aa, West Nile virus
RSGIDTNAYY

SEQ ID NO: 138822 - protein, 10 aa, West Nile virus
SGIDTNAYYV

SEQ ID NO: 138823 - protein, 10 aa, West Nile virus
GIDTNAYYVM

SEQ ID NO: 138824 - protein, 10 aa, West Nile virus
IDTNAYYVMT

SEQ ID NO: 138825 - protein, 10 aa, West Nile virus
DTNAYYVMTV

SEQ ID NO: 138826 - protein, 10 aa, West Nile virus
TNAYYVMTVG

SEQ ID NO: 138827 - protein, 10 aa, West Nile virus
KTFLVHREWF

SEQ ID NO: 138828 - protein, 10 aa, West Nile virus
TFLVHREWFM

SEQ ID NO: 138829 - protein, 10 aa, West Nile virus
FLVHREWFMD

SEQ ID NO: 138830 - protein, 10 aa, West Nile virus
LVHREWFMDL

SEQ ID NO: 138831 - protein, 10 aa, West Nile virus
VHREWFMDLN

SEQ ID NO: 138832 - protein, 10 aa, West Nile virus
HREWFMDLNL

SEQ ID NO: 138833 - protein, 10 aa, West Nile virus
REWFMDLNLP

SEQ ID NO: 138834 - protein, 10 aa, West Nile virus
EWFMDLNLPW

SEQ ID NO: 138835 - protein, 10 aa, West Nile virus
WFMDLNLPWS

SEQ ID NO: 138836 - protein, 10 aa, West Nile virus
FMDLNLPWSS

SEQ ID NO: 138837 - protein, 10 aa, West Nile virus
MDLNLPWSSA

SEQ ID NO: 138838 - protein, 10 aa, West Nile virus
DLNLPWSSAG

SEQ ID NO: 138839 - protein, 10 aa, West Nile virus
LNLPWSSAGS

SEQ ID NO: 138840 - protein, 10 aa, West Nile virus
NLPWSSAGST

SEQ ID NO: 138841 - protein, 10 aa, West Nile virus
WRNRETLMEF

SEQ ID NO: 138842 - protein, 10 aa, West Nile virus
RNRETLMEFE

SEQ ID NO: 138843 - protein, 10 aa, West Nile virus
NRETLMEFEE

SEQ ID NO: 138844 - protein, 10 aa, West Nile virus
RETLMEFEEP

SEQ ID NO: 138845 - protein, 10 aa, West Nile virus
ETLMEFEEPH

SEQ ID NO: 138846 - protein, 10 aa, West Nile virus
TLMEFEEPHA

SEQ ID NO: 138847 - protein, 10 aa, West Nile virus
LMEFEEPHAT

SEQ ID NO: 138848 - protein, 10 aa, West Nile virus
MEFEEPHATK

SEQ ID NO: 138849 - protein, 10 aa, West Nile virus
EFEEPHATKQ

SEQ ID NO: 138850 - protein, 10 aa, West Nile virus
FEEPHATKQS

SEQ ID NO: 138851 - protein, 10 aa, West Nile virus
EEPHATKQSV

SEQ ID NO: 138852 - protein, 10 aa, West Nile virus
EPHATKQSVI

SEQ ID NO: 138853 - protein, 10 aa, West Nile virus
PHATKQSVIA

SEQ ID NO: 138854 - protein, 10 aa, West Nile virus
HATKQSVIAL

SEQ ID NO: 138855 - protein, 10 aa, West Nile virus
ATKQSVIALG

SEQ ID NO: 138856 - protein, 10 aa, West Nile virus
TKQSVIALGS

SEQ ID NO: 138857 - protein, 10 aa, West Nile virus
KQSVIALGSQ

SEQ ID NO: 138858 - protein, 10 aa, West Nile virus
QSVIALGSQE

SEQ ID NO: 138859 - protein, 10 aa, West Nile virus
SVIALGSQEG

SEQ ID NO: 138860 - protein, 10 aa, West Nile virus
VIALGSQEGA

SEQ ID NO: 138861 - protein, 10 aa, West Nile virus
IALGSQEGAL

SEQ ID NO: 138862 - protein, 10 aa, West Nile virus
ALGSQEGALH

SEQ ID NO: 138863 - protein, 10 aa, West Nile virus
LGSQEGALHQ

SEQ ID NO: 138864 - protein, 10 aa, West Nile virus
GSQEGALHQA

SEQ ID NO: 138865 - protein, 10 aa, West Nile virus
SQEGALHQAL

SEQ ID NO: 138866 - protein, 10 aa, West Nile virus
QEGALHQALA

SEQ ID NO: 138867 - protein, 10 aa, West Nile virus
EGALHQALAG

SEQ ID NO: 138868 - protein, 10 aa, West Nile virus
GALHQALAGA

SEQ ID NO: 138869 - protein, 10 aa, West Nile virus
ALHQALAGAI

SEQ ID NO: 138870 - protein, 10 aa, West Nile virus
LHQALAGAIP

SEQ ID NO: 138871 - protein, 10 aa, West Nile virus
HQALAGAIPV

SEQ ID NO: 138872 - protein, 10 aa, West Nile virus
QALAGAIPVE

SEQ ID NO: 138873 - protein, 10 aa, West Nile virus
ALAGAIPVEF

SEQ ID NO: 138874 - protein, 10 aa, West Nile virus
LAGAIPVEFS

SEQ ID NO: 138875 - protein, 10 aa, West Nile virus
AGAIPVEFSS

SEQ ID NO: 138876 - protein, 10 aa, West Nile virus
GAIPVEFSSN

SEQ ID NO: 138877 - protein, 10 aa, West Nile virus
AIPVEFSSNT

SEQ ID NO: 138878 - protein, 10 aa, West Nile virus
IPVEFSSNTV

SEQ ID NO: 138879 - protein, 10 aa, West Nile virus
PVEFSSNTVK

SEQ ID NO: 138880 - protein, 10 aa, West Nile virus
VEFSSNTVKL

SEQ ID NO: 138881 - protein, 10 aa, West Nile virus
EFSSNTVKLT

SEQ ID NO: 138882 - protein, 10 aa, West Nile virus
FSSNTVKLTS

SEQ ID NO: 138883 - protein, 10 aa, West Nile virus
SSNTVKLTSG

SEQ ID NO: 138884 - protein, 10 aa, West Nile virus
SNTVKLTSGH

SEQ ID NO: 138885 - protein, 10 aa, West Nile virus
NTVKLTSGHL

SEQ ID NO: 138886 - protein, 10 aa, West Nile virus
TVKLTSGHLK

SEQ ID NO: 138887 - protein, 10 aa, West Nile virus
VKLTSGHLKC

SEQ ID NO: 138888 - protein, 10 aa, West Nile virus
KLTSGHLKCR

SEQ ID NO: 138889 - protein, 10 aa, West Nile virus
LTSGHLKCRV

SEQ ID NO: 138890 - protein, 10 aa, West Nile virus
TSGHLKCRVK

SEQ ID NO: 138891 - protein, 10 aa, West Nile virus
SGHLKCRVKM

SEQ ID NO: 138892 - protein, 10 aa, West Nile virus
GHLKCRVKME

SEQ ID NO: 138893 - protein, 10 aa, West Nile virus
HLKCRVKMEK

SEQ ID NO: 138894 - protein, 10 aa, West Nile virus
LKCRVKMEKL

SEQ ID NO: 138895 - protein, 10 aa, West Nile virus
KCRVKMEKLQ

SEQ ID NO: 138896 - protein, 10 aa, West Nile virus
CRVKMEKLQL

SEQ ID NO: 138897 - protein, 10 aa, West Nile virus
RVKMEKLQLK

SEQ ID NO: 138898 - protein, 10 aa, West Nile virus
VKMEKLQLKG

SEQ ID NO: 138899 - protein, 10 aa, West Nile virus
KMEKLQLKGT

SEQ ID NO: 138900 - protein, 10 aa, West Nile virus
MEKLQLKGTT

SEQ ID NO: 138901 - protein, 10 aa, West Nile virus
EKLQLKGTTY

SEQ ID NO: 138902 - protein, 10 aa, West Nile virus
KLQLKGTTYG

SEQ ID NO: 138903 - protein, 10 aa, West Nile virus
LQLKGTTYGV

SEQ ID NO: 138904 - protein, 10 aa, West Nile virus
QLKGTTYGVC

SEQ ID NO: 138905 - protein, 10 aa, West Nile virus
LKGTTYGVCS

SEQ ID NO: 138906 - protein, 10 aa, West Nile virus
KGTTYGVCSK

SEQ ID NO: 138907 - protein, 10 aa, West Nile virus
GTTYGVCSKA

SEQ ID NO: 138908 - protein, 10 aa, West Nile virus
TTYGVCSKAF

SEQ ID NO: 138909 - protein, 10 aa, West Nile virus
TYGVCSKAFK

SEQ ID NO: 138910 - protein, 10 aa, West Nile virus
YGVCSKAFKF

SEQ ID NO: 138911 - protein, 10 aa, West Nile virus
GTPADTGHGT

SEQ ID NO: 138912 - protein, 10 aa, West Nile virus
TPADTGHGTV

SEQ ID NO: 138913 - protein, 10 aa, West Nile virus
PADTGHGTVV

SEQ ID NO: 138914 - protein, 10 aa, West Nile virus
ADTGHGTVVL

SEQ ID NO: 138915 - protein, 10 aa, West Nile virus
DTGHGTVVLE

SEQ ID NO: 138916 - protein, 10 aa, West Nile virus
TGHGTVVLEL

SEQ ID NO: 138917 - protein, 10 aa, West Nile virus
GHGTVVLELQ

SEQ ID NO: 138918 - protein, 10 aa, West Nile virus
HGTVVLELQY

SEQ ID NO: 138919 - protein, 10 aa, West Nile virus
GTVVLELQYT

SEQ ID NO: 138920 - protein, 10 aa, West Nile virus
TVVLELQYTG

SEQ ID NO: 138921 - protein, 10 aa, West Nile virus
VVLELQYTGT

SEQ ID NO: 138922 - protein, 10 aa, West Nile virus
VLELQYTGTD

SEQ ID NO: 138923 - protein, 10 aa, West Nile virus
LELQYTGTDG

SEQ ID NO: 138924 - protein, 10 aa, West Nile virus
ELQYTGTDGP

SEQ ID NO: 138925 - protein, 10 aa, West Nile virus
LQYTGTDGPC

SEQ ID NO: 138926 - protein, 10 aa, West Nile virus
QYTGTDGPCK

SEQ ID NO: 138927 - protein, 10 aa, West Nile virus
YTGTDGPCKV

SEQ ID NO: 138928 - protein, 10 aa, West Nile virus
TGTDGPCKVP

SEQ ID NO: 138929 - protein, 10 aa, West Nile virus
GTDGPCKVPI

SEQ ID NO: 138930 - protein, 10 aa, West Nile virus
TDGPCKVPIS

SEQ ID NO: 138931 - protein, 10 aa, West Nile virus
DGPCKVPISS

SEQ ID NO: 138932 - protein, 10 aa, West Nile virus
GPCKVPISSV

SEQ ID NO: 138933 - protein, 10 aa, West Nile virus
PCKVPISSVA

SEQ ID NO: 138934 - protein, 10 aa, West Nile virus
CKVPISSVAS

SEQ ID NO: 138935 - protein, 10 aa, West Nile virus
KVPISSVASL

SEQ ID NO: 138936 - protein, 10 aa, West Nile virus
VPISSVASLN

SEQ ID NO: 138937 - protein, 10 aa, West Nile virus
PISSVASLND

SEQ ID NO: 138938 - protein, 10 aa, West Nile virus
ISSVASLNDL

SEQ ID NO: 138939 - protein, 10 aa, West Nile virus
SSVASLNDLT

SEQ ID NO: 138940 - protein, 10 aa, West Nile virus
SVASLNDLTP

SEQ ID NO: 138941 - protein, 10 aa, West Nile virus
VASLNDLTPV

SEQ ID NO: 138942 - protein, 10 aa, West Nile virus
ASLNDLTPVG

SEQ ID NO: 138943 - protein, 10 aa, West Nile virus
SLNDLTPVGR

SEQ ID NO: 138944 - protein, 10 aa, West Nile virus
LNDLTPVGRL

SEQ ID NO: 138945 - protein, 10 aa, West Nile virus
NDLTPVGRLV

SEQ ID NO: 138946 - protein, 10 aa, West Nile virus
DLTPVGRLVT

SEQ ID NO: 138947 - protein, 10 aa, West Nile virus
LTPVGRLVTV

SEQ ID NO: 138948 - protein, 10 aa, West Nile virus
TPVGRLVTVN

SEQ ID NO: 138949 - protein, 10 aa, West Nile virus
PVGRLVTVNP

SEQ ID NO: 138950 - protein, 10 aa, West Nile virus
VGRLVTVNPF

SEQ ID NO: 138951 - protein, 10 aa, West Nile virus
GRLVTVNPFV

SEQ ID NO: 138952 - protein, 10 aa, West Nile virus
RLVTVNPFVS

SEQ ID NO: 138953 - protein, 10 aa, West Nile virus
LVTVNPFVSV

SEQ ID NO: 138954 - protein, 10 aa, West Nile virus
VTVNPFVSVA

SEQ ID NO: 138955 - protein, 10 aa, West Nile virus
TVNPFVSVAT

SEQ ID NO: 138956 - protein, 10 aa, West Nile virus
VNPFVSVATA

SEQ ID NO: 138957 - protein, 10 aa, West Nile virus
TANAKVLIEL

SEQ ID NO: 138958 - protein, 10 aa, West Nile virus
ANAKVLIELE

SEQ ID NO: 138959 - protein, 10 aa, West Nile virus
NAKVLIELEP

SEQ ID NO: 138960 - protein, 10 aa, West Nile virus
AKVLIELEPP

SEQ ID NO: 138961 - protein, 10 aa, West Nile virus
KVLIELEPPF

SEQ ID NO: 138962 - protein, 10 aa, West Nile virus
VLIELEPPFG

SEQ ID NO: 138963 - protein, 10 aa, West Nile virus
LIELEPPFGD

SEQ ID NO: 138964 - protein, 10 aa, West Nile virus
IELEPPFGDS

SEQ ID NO: 138965 - protein, 10 aa, West Nile virus
ELEPPFGDSY

SEQ ID NO: 138966 - protein, 10 aa, West Nile virus
LEPPFGDSYI

SEQ ID NO: 138967 - protein, 10 aa, West Nile virus
EPPFGDSYIV

SEQ ID NO: 138968 - protein, 10 aa, West Nile virus
PPFGDSYIVV

SEQ ID NO: 138969 - protein, 10 aa, West Nile virus
PFGDSYIVVG

SEQ ID NO: 138970 - protein, 10 aa, West Nile virus
FGDSYIVVGR

SEQ ID NO: 138971 - protein, 10 aa, West Nile virus
GDSYIVVGRG

SEQ ID NO: 138972 - protein, 10 aa, West Nile virus
DSYIVVGRGE

SEQ ID NO: 138973 - protein, 10 aa, West Nile virus
SYIVVGRGEQ

SEQ ID NO: 138974 - protein, 10 aa, West Nile virus
YIVVGRGEQQ

SEQ ID NO: 138975 - protein, 10 aa, West Nile virus
IVVGRGEQQI

SEQ ID NO: 138976 - protein, 10 aa, West Nile virus
VVGRGEQQIN

SEQ ID NO: 138977 - protein, 10 aa, West Nile virus
VGRGEQQINH

SEQ ID NO: 138978 - protein, 10 aa, West Nile virus
GRGEQQINHH

SEQ ID NO: 138979 - protein, 10 aa, West Nile virus
RGEQQINHHW

SEQ ID NO: 138980 - protein, 10 aa, West Nile virus
GEQQINHHWH

SEQ ID NO: 138981 - protein, 10 aa, West Nile virus
EQQINHHWHK

SEQ ID NO: 138982 - protein, 10 aa, West Nile virus
QQINHHWHKS

SEQ ID NO: 138983 - protein, 10 aa, West Nile virus
QINHHWHKSG

SEQ ID NO: 138984 - protein, 10 aa, West Nile virus
INHHWHKSGS

SEQ ID NO: 138985 - protein, 10 aa, West Nile virus
NHHWHKSGSS

SEQ ID NO: 138986 - protein, 10 aa, West Nile virus
HHWHKSGSSI

SEQ ID NO: 138987 - protein, 10 aa, West Nile virus
HWHKSGSSIG

SEQ ID NO: 138988 - protein, 10 aa, West Nile virus
WHKSGSSIGK

SEQ ID NO: 138989 - protein, 10 aa, West Nile virus
HKSGSSIGKA

SEQ ID NO: 138990 - protein, 10 aa, West Nile virus
KSGSSIGKAF

SEQ ID NO: 138991 - protein, 10 aa, West Nile virus
SGSSIGKAFT

SEQ ID NO: 138992 - protein, 10 aa, West Nile virus
GSSIGKAFTT

SEQ ID NO: 138993 - protein, 10 aa, West Nile virus
SSIGKAFTTT

SEQ ID NO: 138994 - protein, 10 aa, West Nile virus
SIGKAFTTTL

SEQ ID NO: 138995 - protein, 10 aa, West Nile virus
IGKAFTTTLK

SEQ ID NO: 138996 - protein, 10 aa, West Nile virus
GKAFTTTLKG

SEQ ID NO: 138997 - protein, 10 aa, West Nile virus
KAFTTTLKGA

SEQ ID NO: 138998 - protein, 10 aa, West Nile virus
AFTTTLKGAQ

SEQ ID NO: 138999 - protein, 10 aa, West Nile virus
FTTTLKGAQR

SEQ ID NO: 139000 - protein, 10 aa, West Nile virus
TTTLKGAQRL

SEQ ID NO: 139001 - protein, 10 aa, West Nile virus
TTLKGAQRLA

SEQ ID NO: 139002 - protein, 10 aa, West Nile virus
TLKGAQRLAA

SEQ ID NO: 139003 - protein, 10 aa, West Nile virus
LKGAQRLAAL

SEQ ID NO: 139004 - protein, 10 aa, West Nile virus
KGAQRLAALG

SEQ ID NO: 139005 - protein, 10 aa, West Nile virus
GAQRLAALGD

SEQ ID NO: 139006 - protein, 10 aa, West Nile virus
AQRLAALGDT

SEQ ID NO: 139007 - protein, 10 aa, West Nile virus
QRLAALGDTA

SEQ ID NO: 139008 - protein, 10 aa, West Nile virus
RLAALGDTAW

SEQ ID NO: 139009 - protein, 10 aa, West Nile virus
LAALGDTAWD

SEQ ID NO: 139010 - protein, 10 aa, West Nile virus
AALGDTAWDF

SEQ ID NO: 139011 - protein, 10 aa, West Nile virus
ALGDTAWDFG

SEQ ID NO: 139012 - protein, 10 aa, West Nile virus
LGDTAWDFGS

SEQ ID NO: 139013 - protein, 10 aa, West Nile virus
GDTAWDFGSV

SEQ ID NO: 139014 - protein, 10 aa, West Nile virus
DTAWDFGSVG

SEQ ID NO: 139015 - protein, 10 aa, West Nile virus
TAWDFGSVGG

SEQ ID NO: 139016 - protein, 10 aa, West Nile virus
AWDFGSVGGV

SEQ ID NO: 139017 - protein, 10 aa, West Nile virus
WDFGSVGGVF

SEQ ID NO: 139018 - protein, 10 aa, West Nile virus
DFGSVGGVFT

SEQ ID NO: 139019 - protein, 10 aa, West Nile virus
FGSVGGVFTS

SEQ ID NO: 139020 - protein, 10 aa, West Nile virus
GSVGGVFTSV

SEQ ID NO: 139021 - protein, 10 aa, West Nile virus
SVGGVFTSVG

SEQ ID NO: 139022 - protein, 10 aa, West Nile virus
VGGVFTSVGK

SEQ ID NO: 139023 - protein, 10 aa, West Nile virus
GGVFTSVGKA

SEQ ID NO: 139024 - protein, 10 aa, West Nile virus
GVFTSVGKAV

SEQ ID NO: 139025 - protein, 10 aa, West Nile virus
VFTSVGKAVH

SEQ ID NO: 139026 - protein, 10 aa, West Nile virus
FTSVGKAVHQ

SEQ ID NO: 139027 - protein, 10 aa, West Nile virus
TSVGKAVHQV

SEQ ID NO: 139028 - protein, 10 aa, West Nile virus
SVGKAVHQVF

SEQ ID NO: 139029 - protein, 10 aa, West Nile virus
VGKAVHQVFG

SEQ ID NO: 139030 - protein, 10 aa, West Nile virus
GKAVHQVFGG

SEQ ID NO: 139031 - protein, 10 aa, West Nile virus
KAVHQVFGGA

SEQ ID NO: 139032 - protein, 10 aa, West Nile virus
AVHQVFGGAF

SEQ ID NO: 139033 - protein, 10 aa, West Nile virus
VHQVFGGAFR

SEQ ID NO: 139034 - protein, 10 aa, West Nile virus
HQVFGGAFRS

SEQ ID NO: 139035 - protein, 10 aa, West Nile virus
QVFGGAFRSL

SEQ ID NO: 139036 - protein, 10 aa, West Nile virus
VFGGAFRSLF

SEQ ID NO: 139037 - protein, 10 aa, West Nile virus
FGGAFRSLFG

SEQ ID NO: 139038 - protein, 10 aa, West Nile virus
GGAFRSLFGG

SEQ ID NO: 139039 - protein, 10 aa, West Nile virus
GAFRSLFGGM

SEQ ID NO: 139040 - protein, 10 aa, West Nile virus
AFRSLFGGMS

SEQ ID NO: 139041 - protein, 10 aa, West Nile virus
FRSLFGGMSW

SEQ ID NO: 139042 - protein, 10 aa, West Nile virus
RSLFGGMSWI

SEQ ID NO: 139043 - protein, 10 aa, West Nile virus
SLFGGMSWIT

SEQ ID NO: 139044 - protein, 10 aa, West Nile virus
LFGGMSWITQ

SEQ ID NO: 139045 - protein, 10 aa, West Nile virus
FGGMSWITQG

SEQ ID NO: 139046 - protein, 10 aa, West Nile virus
GGMSWITQGL

SEQ ID NO: 139047 - protein, 10 aa, West Nile virus
GMSWITQGLL

SEQ ID NO: 139048 - protein, 10 aa, West Nile virus
MSWITQGLLG

SEQ ID NO: 139049 - protein, 10 aa, West Nile virus
SWITQGLLGA

SEQ ID NO: 139050 - protein, 10 aa, West Nile virus
WITQGLLGAL

SEQ ID NO: 139051 - protein, 10 aa, West Nile virus
ITQGLLGALL

SEQ ID NO: 139052 - protein, 10 aa, West Nile virus
TQGLLGALLL

SEQ ID NO: 139053 - protein, 10 aa, West Nile virus
QGLLGALLLW

SEQ ID NO: 139054 - protein, 10 aa, West Nile virus
GLLGALLLWM

SEQ ID NO: 139055 - protein, 10 aa, West Nile virus
LLGALLLWMG

SEQ ID NO: 139056 - protein, 10 aa, West Nile virus
LGALLLWMGI

SEQ ID NO: 139057 - protein, 10 aa, West Nile virus
GALLLWMGIN

SEQ ID NO: 139058 - protein, 10 aa, West Nile virus
ALLLWMGINA

SEQ ID NO: 139059 - protein, 10 aa, West Nile virus
LLLWMGINAR

SEQ ID NO: 139060 - protein, 10 aa, West Nile virus
LLWMGINARD

SEQ ID NO: 139061 - protein, 10 aa, West Nile virus
LWMGINARDR

SEQ ID NO: 139062 - protein, 10 aa, West Nile virus
WMGINARDRS

SEQ ID NO: 139063 - protein, 10 aa, West Nile virus
MGINARDRSI

SEQ ID NO: 139064 - protein, 10 aa, West Nile virus
GINARDRSIA

SEQ ID NO: 139065 - protein, 10 aa, West Nile virus
ARDRSIALTF

SEQ ID NO: 139066 - protein, 10 aa, West Nile virus
RDRSIALTFL

SEQ ID NO: 139067 - protein, 10 aa, West Nile virus
DRSIALTFLA

SEQ ID NO: 139068 - protein, 10 aa, West Nile virus
RSIALTFLAV

SEQ ID NO: 139069 - protein, 10 aa, West Nile virus
SIALTFLAVG

SEQ ID NO: 139070 - protein, 10 aa, West Nile virus
IALTFLAVGG

SEQ ID NO: 139071 - protein, 10 aa, West Nile virus
ALTFLAVGGV

SEQ ID NO: 139072 - protein, 10 aa, West Nile virus
LTFLAVGGVL

SEQ ID NO: 139073 - protein, 10 aa, West Nile virus
TFLAVGGVLL

SEQ ID NO: 139074 - protein, 10 aa, West Nile virus
FLAVGGVLLF

SEQ ID NO: 139075 - protein, 10 aa, West Nile virus
LAVGGVLLFL

SEQ ID NO: 139076 - protein, 10 aa, West Nile virus
AVGGVLLFLS

SEQ ID NO: 139077 - protein, 10 aa, West Nile virus
VGGVLLFLSV

SEQ ID NO: 139078 - protein, 10 aa, West Nile virus
GGVLLFLSVN

SEQ ID NO: 139079 - protein, 10 aa, West Nile virus
GVLLFLSVNV

SEQ ID NO: 139080 - protein, 10 aa, West Nile virus
VLLFLSVNVH

SEQ ID NO: 139081 - protein, 10 aa, West Nile virus
LLFLSVNVHA

SEQ ID NO: 139082 - protein, 10 aa, West Nile virus
LFLSVNVHAD

SEQ ID NO: 139083 - protein, 10 aa, West Nile virus
FLSVNVHADT

SEQ ID NO: 139084 - protein, 10 aa, West Nile virus
LSVNVHADTG

SEQ ID NO: 139085 - protein, 10 aa, West Nile virus
SVNVHADTGC

SEQ ID NO: 139086 - protein, 10 aa, West Nile virus
VNVHADTGCA

SEQ ID NO: 139087 - protein, 10 aa, West Nile virus
NVHADTGCAI

SEQ ID NO: 139088 - protein, 10 aa, West Nile virus
VHADTGCAID

SEQ ID NO: 139089 - protein, 10 aa, West Nile virus
HADTGCAIDI

SEQ ID NO: 139090 - protein, 10 aa, West Nile virus
ADTGCAIDIS

SEQ ID NO: 139091 - protein, 10 aa, West Nile virus
DTGCAIDISR

SEQ ID NO: 139092 - protein, 10 aa, West Nile virus
TGCAIDISRQ

SEQ ID NO: 139093 - protein, 10 aa, West Nile virus
GCAIDISRQE

SEQ ID NO: 139094 - protein, 10 aa, West Nile virus
CAIDISRQEL

SEQ ID NO: 139095 - protein, 10 aa, West Nile virus
AIDISRQELR

SEQ ID NO: 139096 - protein, 10 aa, West Nile virus
IDISRQELRC

SEQ ID NO: 139097 - protein, 10 aa, West Nile virus
DISRQELRCG

SEQ ID NO: 139098 - protein, 10 aa, West Nile virus
SRQELRCGSG

SEQ ID NO: 139099 - protein, 10 aa, West Nile virus
RQELRCGSGV

SEQ ID NO: 139100 - protein, 10 aa, West Nile virus
QELRCGSGVF

SEQ ID NO: 139101 - protein, 10 aa, West Nile virus
ELRCGSGVFI

SEQ ID NO: 139102 - protein, 10 aa, West Nile virus
LRCGSGVFIH

SEQ ID NO: 139103 - protein, 10 aa, West Nile virus
RCGSGVFIHN

SEQ ID NO: 139104 - protein, 10 aa, West Nile virus
CGSGVFIHND

SEQ ID NO: 139105 - protein, 10 aa, West Nile virus
GSGVFIHNDV

SEQ ID NO: 139106 - protein, 10 aa, West Nile virus
SGVFIHNDVE

SEQ ID NO: 139107 - protein, 10 aa, West Nile virus
GVFIHNDVEA

SEQ ID NO: 139108 - protein, 10 aa, West Nile virus
VFIHNDVEAW

SEQ ID NO: 139109 - protein, 10 aa, West Nile virus
NDVEAWMDRY

SEQ ID NO: 139110 - protein, 10 aa, West Nile virus
DVEAWMDRYK

SEQ ID NO: 139111 - protein, 10 aa, West Nile virus
DRYKYYPETP

SEQ ID NO: 139112 - protein, 10 aa, West Nile virus
RYKYYPETPQ

SEQ ID NO: 139113 - protein, 10 aa, West Nile virus
YKYYPETPQG

SEQ ID NO: 139114 - protein, 10 aa, West Nile virus
KYYPETPQGL

SEQ ID NO: 139115 - protein, 10 aa, West Nile virus
YYPETPQGLA

SEQ ID NO: 139116 - protein, 10 aa, West Nile virus
YPETPQGLAK

SEQ ID NO: 139117 - protein, 10 aa, West Nile virus
PETPQGLAKI

SEQ ID NO: 139118 - protein, 10 aa, West Nile virus
ETPQGLAKII

SEQ ID NO: 139119 - protein, 10 aa, West Nile virus
TPQGLAKIIQ

SEQ ID NO: 139120 - protein, 10 aa, West Nile virus
PQGLAKIIQK

SEQ ID NO: 139121 - protein, 10 aa, West Nile virus
QGLAKIIQKA

SEQ ID NO: 139122 - protein, 10 aa, West Nile virus
GLAKIIQKAH

SEQ ID NO: 139123 - protein, 10 aa, West Nile virus
EGVCGLRSVS

SEQ ID NO: 139124 - protein, 10 aa, West Nile virus
GVCGLRSVSR

SEQ ID NO: 139125 - protein, 10 aa, West Nile virus
VCGLRSVSRL

SEQ ID NO: 139126 - protein, 10 aa, West Nile virus
CGLRSVSRLE

SEQ ID NO: 139127 - protein, 10 aa, West Nile virus
GLRSVSRLEH

SEQ ID NO: 139128 - protein, 10 aa, West Nile virus
LRSVSRLEHQ

SEQ ID NO: 139129 - protein, 10 aa, West Nile virus
RSVSRLEHQM

SEQ ID NO: 139130 - protein, 10 aa, West Nile virus
SVSRLEHQMW

SEQ ID NO: 139131 - protein, 10 aa, West Nile virus
VSRLEHQMWE

SEQ ID NO: 139132 - protein, 10 aa, West Nile virus
SRLEHQMWEA

SEQ ID NO: 139133 - protein, 10 aa, West Nile virus
RLEHQMWEAV

SEQ ID NO: 139134 - protein, 10 aa, West Nile virus
LEHQMWEAVK

SEQ ID NO: 139135 - protein, 10 aa, West Nile virus
EHQMWEAVKD

SEQ ID NO: 139136 - protein, 10 aa, West Nile virus
HQMWEAVKDE

SEQ ID NO: 139137 - protein, 10 aa, West Nile virus
QMWEAVKDEL

SEQ ID NO: 139138 - protein, 10 aa, West Nile virus
MWEAVKDELN

SEQ ID NO: 139139 - protein, 10 aa, West Nile virus
WEAVKDELNT

SEQ ID NO: 139140 - protein, 10 aa, West Nile virus
AVKDELNTLL

SEQ ID NO: 139141 - protein, 10 aa, West Nile virus
VKDELNTLLK

SEQ ID NO: 139142 - protein, 10 aa, West Nile virus
KDELNTLLKE

SEQ ID NO: 139143 - protein, 10 aa, West Nile virus
DELNTLLKEN

SEQ ID NO: 139144 - protein, 10 aa, West Nile virus
ELNTLLKENG

SEQ ID NO: 139145 - protein, 10 aa, West Nile virus
LNTLLKENGV

SEQ ID NO: 139146 - protein, 10 aa, West Nile virus
NTLLKENGVD

SEQ ID NO: 139147 - protein, 10 aa, West Nile virus
TLLKENGVDL

SEQ ID NO: 139148 - protein, 10 aa, West Nile virus
LLKENGVDLS

SEQ ID NO: 139149 - protein, 10 aa, West Nile virus
LKENGVDLSV

SEQ ID NO: 139150 - protein, 10 aa, West Nile virus
KENGVDLSVV

SEQ ID NO: 139151 - protein, 10 aa, West Nile virus
ENGVDLSVVV

SEQ ID NO: 139152 - protein, 10 aa, West Nile virus
NGVDLSVVVE

SEQ ID NO: 139153 - protein, 10 aa, West Nile virus
GVDLSVVVEK

SEQ ID NO: 139154 - protein, 10 aa, West Nile virus
VDLSVVVEKQ

SEQ ID NO: 139155 - protein, 10 aa, West Nile virus
ATTEKLEIGW

SEQ ID NO: 139156 - protein, 10 aa, West Nile virus
TTEKLEIGWK

SEQ ID NO: 139157 - protein, 10 aa, West Nile virus
TEKLEIGWKA

SEQ ID NO: 139158 - protein, 10 aa, West Nile virus
EKLEIGWKAW

SEQ ID NO: 139159 - protein, 10 aa, West Nile virus
KLEIGWKAWG

SEQ ID NO: 139160 - protein, 10 aa, West Nile virus
LEIGWKAWGK

SEQ ID NO: 139161 - protein, 10 aa, West Nile virus
EIGWKAWGKS

SEQ ID NO: 139162 - protein, 10 aa, West Nile virus
IGWKAWGKSI

SEQ ID NO: 139163 - protein, 10 aa, West Nile virus
GWKAWGKSIL

SEQ ID NO: 139164 - protein, 10 aa, West Nile virus
WKAWGKSILF

SEQ ID NO: 139165 - protein, 10 aa, West Nile virus
KAWGKSILFA

SEQ ID NO: 139166 - protein, 10 aa, West Nile virus
AWGKSILFAP

SEQ ID NO: 139167 - protein, 10 aa, West Nile virus
WGKSILFAPE

SEQ ID NO: 139168 - protein, 10 aa, West Nile virus
GKSILFAPEL

SEQ ID NO: 139169 - protein, 10 aa, West Nile virus
KSILFAPELA

SEQ ID NO: 139170 - protein, 10 aa, West Nile virus
SILFAPELAN

SEQ ID NO: 139171 - protein, 10 aa, West Nile virus
FAPELANNTF

SEQ ID NO: 139172 - protein, 10 aa, West Nile virus
APELANNTFV

SEQ ID NO: 139173 - protein, 10 aa, West Nile virus
PELANNTFVV

SEQ ID NO: 139174 - protein, 10 aa, West Nile virus
ELANNTFVVD

SEQ ID NO: 139175 - protein, 10 aa, West Nile virus
LANNTFVVDG

SEQ ID NO: 139176 - protein, 10 aa, West Nile virus
ANNTFVVDGP

SEQ ID NO: 139177 - protein, 10 aa, West Nile virus
NNTFVVDGPE

SEQ ID NO: 139178 - protein, 10 aa, West Nile virus
NTFVVDGPET

SEQ ID NO: 139179 - protein, 10 aa, West Nile virus
TFVVDGPETK

SEQ ID NO: 139180 - protein, 10 aa, West Nile virus
FVVDGPETKE

SEQ ID NO: 139181 - protein, 10 aa, West Nile virus
VVDGPETKEC

SEQ ID NO: 139182 - protein, 10 aa, West Nile virus
VDGPETKECP

SEQ ID NO: 139183 - protein, 10 aa, West Nile virus
DGPETKECPT

SEQ ID NO: 139184 - protein, 10 aa, West Nile virus
NRAWNSLEVE

SEQ ID NO: 139185 - protein, 10 aa, West Nile virus
RAWNSLEVED

SEQ ID NO: 139186 - protein, 10 aa, West Nile virus
AWNSLEVEDF

SEQ ID NO: 139187 - protein, 10 aa, West Nile virus
WNSLEVEDFG

SEQ ID NO: 139188 - protein, 10 aa, West Nile virus
NSLEVEDFGF

SEQ ID NO: 139189 - protein, 10 aa, West Nile virus
SLEVEDFGFG

SEQ ID NO: 139190 - protein, 10 aa, West Nile virus
LEVEDFGFGL

SEQ ID NO: 139191 - protein, 10 aa, West Nile virus
EVEDFGFGLT

SEQ ID NO: 139192 - protein, 10 aa, West Nile virus
VEDFGFGLTS

SEQ ID NO: 139193 - protein, 10 aa, West Nile virus
EDFGFGLTST

SEQ ID NO: 139194 - protein, 10 aa, West Nile virus
DFGFGLTSTR

SEQ ID NO: 139195 - protein, 10 aa, West Nile virus
FGFGLTSTRM

SEQ ID NO: 139196 - protein, 10 aa, West Nile virus
GFGLTSTRMF

SEQ ID NO: 139197 - protein, 10 aa, West Nile virus
FGLTSTRMFL

SEQ ID NO: 139198 - protein, 10 aa, West Nile virus
GLTSTRMFLK

SEQ ID NO: 139199 - protein, 10 aa, West Nile virus
VRESNTTECD

SEQ ID NO: 139200 - protein, 10 aa, West Nile virus
NTTECDSKII

SEQ ID NO: 139201 - protein, 10 aa, West Nile virus
TTECDSKIIG

SEQ ID NO: 139202 - protein, 10 aa, West Nile virus
TECDSKIIGT

SEQ ID NO: 139203 - protein, 10 aa, West Nile virus
ECDSKIIGTA

SEQ ID NO: 139204 - protein, 10 aa, West Nile virus
CDSKIIGTAV

SEQ ID NO: 139205 - protein, 10 aa, West Nile virus
DSKIIGTAVK

SEQ ID NO: 139206 - protein, 10 aa, West Nile virus
SKIIGTAVKN

SEQ ID NO: 139207 - protein, 10 aa, West Nile virus
KIIGTAVKNN

SEQ ID NO: 139208 - protein, 10 aa, West Nile virus
IIGTAVKNNL

SEQ ID NO: 139209 - protein, 10 aa, West Nile virus
IGTAVKNNLA

SEQ ID NO: 139210 - protein, 10 aa, West Nile virus
GTAVKNNLAI

SEQ ID NO: 139211 - protein, 10 aa, West Nile virus
TAVKNNLAIH

SEQ ID NO: 139212 - protein, 10 aa, West Nile virus
AVKNNLAIHS

SEQ ID NO: 139213 - protein, 10 aa, West Nile virus
VKNNLAIHSD

SEQ ID NO: 139214 - protein, 10 aa, West Nile virus
KNNLAIHSDL

SEQ ID NO: 139215 - protein, 10 aa, West Nile virus
NNLAIHSDLS

SEQ ID NO: 139216 - protein, 10 aa, West Nile virus
NLAIHSDLSY

SEQ ID NO: 139217 - protein, 10 aa, West Nile virus
LAIHSDLSYW

SEQ ID NO: 139218 - protein, 10 aa, West Nile virus
AIHSDLSYWI

SEQ ID NO: 139219 - protein, 10 aa, West Nile virus
IHSDLSYWIE

SEQ ID NO: 139220 - protein, 10 aa, West Nile virus
HSDLSYWIES

SEQ ID NO: 139221 - protein, 10 aa, West Nile virus
SDLSYWIESR

SEQ ID NO: 139222 - protein, 10 aa, West Nile virus
DLSYWIESRL

SEQ ID NO: 139223 - protein, 10 aa, West Nile virus
LSYWIESRLN

SEQ ID NO: 139224 - protein, 10 aa, West Nile virus
LNDTWKLERA

SEQ ID NO: 139225 - protein, 10 aa, West Nile virus
NDTWKLERAV

SEQ ID NO: 139226 - protein, 10 aa, West Nile virus
DTWKLERAVL

SEQ ID NO: 139227 - protein, 10 aa, West Nile virus
TWKLERAVLG

SEQ ID NO: 139228 - protein, 10 aa, West Nile virus
WKLERAVLGE

SEQ ID NO: 139229 - protein, 10 aa, West Nile virus
KLERAVLGEV

SEQ ID NO: 139230 - protein, 10 aa, West Nile virus
LERAVLGEVK

SEQ ID NO: 139231 - protein, 10 aa, West Nile virus
ERAVLGEVKS

SEQ ID NO: 139232 - protein, 10 aa, West Nile virus
RAVLGEVKSC

SEQ ID NO: 139233 - protein, 10 aa, West Nile virus
AVLGEVKSCT

SEQ ID NO: 139234 - protein, 10 aa, West Nile virus
VLGEVKSCTW

SEQ ID NO: 139235 - protein, 10 aa, West Nile virus
LGEVKSCTWP

SEQ ID NO: 139236 - protein, 10 aa, West Nile virus
GEVKSCTWPE

SEQ ID NO: 139237 - protein, 10 aa, West Nile virus
EVKSCTWPET

SEQ ID NO: 139238 - protein, 10 aa, West Nile virus
VKSCTWPETH

SEQ ID NO: 139239 - protein, 10 aa, West Nile virus
KSCTWPETHT

SEQ ID NO: 139240 - protein, 10 aa, West Nile virus
SCTWPETHTL

SEQ ID NO: 139241 - protein, 10 aa, West Nile virus
CTWPETHTLW

SEQ ID NO: 139242 - protein, 10 aa, West Nile virus
TWPETHTLWG

SEQ ID NO: 139243 - protein, 10 aa, West Nile virus
WPETHTLWGD

SEQ ID NO: 139244 - protein, 10 aa, West Nile virus
PETHTLWGDG

SEQ ID NO: 139245 - protein, 10 aa, West Nile virus
ETHTLWGDGI

SEQ ID NO: 139246 - protein, 10 aa, West Nile virus
THTLWGDGIL

SEQ ID NO: 139247 - protein, 10 aa, West Nile virus
HTLWGDGILE

SEQ ID NO: 139248 - protein, 10 aa, West Nile virus
TLWGDGILES

SEQ ID NO: 139249 - protein, 10 aa, West Nile virus
GILESDLIIP

SEQ ID NO: 139250 - protein, 10 aa, West Nile virus
ESDLIIPVTL

SEQ ID NO: 139251 - protein, 10 aa, West Nile virus
SDLIIPVTLA

SEQ ID NO: 139252 - protein, 10 aa, West Nile virus
DLIIPVTLAG

SEQ ID NO: 139253 - protein, 10 aa, West Nile virus
LIIPVTLAGP

SEQ ID NO: 139254 - protein, 10 aa, West Nile virus
IIPVTLAGPR

SEQ ID NO: 139255 - protein, 10 aa, West Nile virus
IPVTLAGPRS

SEQ ID NO: 139256 - protein, 10 aa, West Nile virus
PVTLAGPRSN

SEQ ID NO: 139257 - protein, 10 aa, West Nile virus
VTLAGPRSNH

SEQ ID NO: 139258 - protein, 10 aa, West Nile virus
TLAGPRSNHN

SEQ ID NO: 139259 - protein, 10 aa, West Nile virus
LAGPRSNHNR

SEQ ID NO: 139260 - protein, 10 aa, West Nile virus
AGPRSNHNRR

SEQ ID NO: 139261 - protein, 10 aa, West Nile virus
GPRSNHNRRP

SEQ ID NO: 139262 - protein, 10 aa, West Nile virus
PRSNHNRRPG

SEQ ID NO: 139263 - protein, 10 aa, West Nile virus
RSNHNRRPGY

SEQ ID NO: 139264 - protein, 10 aa, West Nile virus
SNHNRRPGYK

SEQ ID NO: 139265 - protein, 10 aa, West Nile virus
NHNRRPGYKT

SEQ ID NO: 139266 - protein, 10 aa, West Nile virus
HNRRPGYKTQ

SEQ ID NO: 139267 - protein, 10 aa, West Nile virus
NRRPGYKTQN

SEQ ID NO: 139268 - protein, 10 aa, West Nile virus
RRPGYKTQNQ

SEQ ID NO: 139269 - protein, 10 aa, West Nile virus
RPGYKTQNQG

SEQ ID NO: 139270 - protein, 10 aa, West Nile virus
PGYKTQNQGP

SEQ ID NO: 139271 - protein, 10 aa, West Nile virus
GYKTQNQGPW

SEQ ID NO: 139272 - protein, 10 aa, West Nile virus
YKTQNQGPWD

SEQ ID NO: 139273 - protein, 10 aa, West Nile virus
KTQNQGPWDE

SEQ ID NO: 139274 - protein, 10 aa, West Nile virus
TQNQGPWDEG

SEQ ID NO: 139275 - protein, 10 aa, West Nile virus
QNQGPWDEGR

SEQ ID NO: 139276 - protein, 10 aa, West Nile virus
NQGPWDEGRV

SEQ ID NO: 139277 - protein, 10 aa, West Nile virus
QGPWDEGRVE

SEQ ID NO: 139278 - protein, 10 aa, West Nile virus
GPWDEGRVEI

SEQ ID NO: 139279 - protein, 10 aa, West Nile virus
PWDEGRVEID

SEQ ID NO: 139280 - protein, 10 aa, West Nile virus
WDEGRVEIDF

SEQ ID NO: 139281 - protein, 10 aa, West Nile virus
DEGRVEIDFD

SEQ ID NO: 139282 - protein, 10 aa, West Nile virus
EGRVEIDFDY

SEQ ID NO: 139283 - protein, 10 aa, West Nile virus
GRVEIDFDYC

SEQ ID NO: 139284 - protein, 10 aa, West Nile virus
RVEIDFDYCP

SEQ ID NO: 139285 - protein, 10 aa, West Nile virus
VEIDFDYCPG

SEQ ID NO: 139286 - protein, 10 aa, West Nile virus
EIDFDYCPGT

SEQ ID NO: 139287 - protein, 10 aa, West Nile virus
IDFDYCPGTT

SEQ ID NO: 139288 - protein, 10 aa, West Nile virus
DFDYCPGTTV

SEQ ID NO: 139289 - protein, 10 aa, West Nile virus
FDYCPGTTVT

SEQ ID NO: 139290 - protein, 10 aa, West Nile virus
DYCPGTTVTL

SEQ ID NO: 139291 - protein, 10 aa, West Nile virus
YCPGTTVTLS

SEQ ID NO: 139292 - protein, 10 aa, West Nile virus
CGHRGPATRT

SEQ ID NO: 139293 - protein, 10 aa, West Nile virus
GHRGPATRTT

SEQ ID NO: 139294 - protein, 10 aa, West Nile virus
HRGPATRTTT

SEQ ID NO: 139295 - protein, 10 aa, West Nile virus
RGPATRTTTE

SEQ ID NO: 139296 - protein, 10 aa, West Nile virus
GPATRTTTES

SEQ ID NO: 139297 - protein, 10 aa, West Nile virus
PATRTTTESG

SEQ ID NO: 139298 - protein, 10 aa, West Nile virus
ATRTTTESGK

SEQ ID NO: 139299 - protein, 10 aa, West Nile virus
TRTTTESGKL

SEQ ID NO: 139300 - protein, 10 aa, West Nile virus
RTTTESGKLI

SEQ ID NO: 139301 - protein, 10 aa, West Nile virus
TTTESGKLIT

SEQ ID NO: 139302 - protein, 10 aa, West Nile virus
TTESGKLITD

SEQ ID NO: 139303 - protein, 10 aa, West Nile virus
TESGKLITDW

SEQ ID NO: 139304 - protein, 10 aa, West Nile virus
ESGKLITDWC

SEQ ID NO: 139305 - protein, 10 aa, West Nile virus
SGKLITDWCC

SEQ ID NO: 139306 - protein, 10 aa, West Nile virus
GKLITDWCCR

SEQ ID NO: 139307 - protein, 10 aa, West Nile virus
KLITDWCCRS

SEQ ID NO: 139308 - protein, 10 aa, West Nile virus
LITDWCCRSC

SEQ ID NO: 139309 - protein, 10 aa, West Nile virus
ITDWCCRSCT

SEQ ID NO: 139310 - protein, 10 aa, West Nile virus
TDWCCRSCTL

SEQ ID NO: 139311 - protein, 10 aa, West Nile virus
DWCCRSCTLP

SEQ ID NO: 139312 - protein, 10 aa, West Nile virus
WCCRSCTLPP

SEQ ID NO: 139313 - protein, 10 aa, West Nile virus
CCRSCTLPPL

SEQ ID NO: 139314 - protein, 10 aa, West Nile virus
CRSCTLPPLR

SEQ ID NO: 139315 - protein, 10 aa, West Nile virus
RSCTLPPLRY

SEQ ID NO: 139316 - protein, 10 aa, West Nile virus
SCTLPPLRYQ

SEQ ID NO: 139317 - protein, 10 aa, West Nile virus
CTLPPLRYQT

SEQ ID NO: 139318 - protein, 10 aa, West Nile virus
TLPPLRYQTD

SEQ ID NO: 139319 - protein, 10 aa, West Nile virus
TDSGCWYGME

SEQ ID NO: 139320 - protein, 10 aa, West Nile virus
DSGCWYGMEI

SEQ ID NO: 139321 - protein, 10 aa, West Nile virus
SGCWYGMEIR

SEQ ID NO: 139322 - protein, 10 aa, West Nile virus
GCWYGMEIRP

SEQ ID NO: 139323 - protein, 10 aa, West Nile virus
CWYGMEIRPQ

SEQ ID NO: 139324 - protein, 10 aa, West Nile virus
WYGMEIRPQR

SEQ ID NO: 139325 - protein, 10 aa, West Nile virus
YGMEIRPQRH

SEQ ID NO: 139326 - protein, 10 aa, West Nile virus
GMEIRPQRHD

SEQ ID NO: 139327 - protein, 10 aa, West Nile virus
MEIRPQRHDE

SEQ ID NO: 139328 - protein, 10 aa, West Nile virus
EIRPQRHDEK

SEQ ID NO: 139329 - protein, 10 aa, West Nile virus
IRPQRHDEKT

SEQ ID NO: 139330 - protein, 10 aa, West Nile virus
RPQRHDEKTL

SEQ ID NO: 139331 - protein, 10 aa, West Nile virus
PQRHDEKTLV

SEQ ID NO: 139332 - protein, 10 aa, West Nile virus
QRHDEKTLVQ

SEQ ID NO: 139333 - protein, 10 aa, West Nile virus
RHDEKTLVQS

SEQ ID NO: 139334 - protein, 10 aa, West Nile virus
HDEKTLVQSQ

SEQ ID NO: 139335 - protein, 10 aa, West Nile virus
DEKTLVQSQV

SEQ ID NO: 139336 - protein, 10 aa, West Nile virus
EKTLVQSQVN

SEQ ID NO: 139337 - protein, 10 aa, West Nile virus
KTLVQSQVNA

SEQ ID NO: 139338 - protein, 10 aa, West Nile virus
TLVQSQVNAY

SEQ ID NO: 139339 - protein, 10 aa, West Nile virus
LVQSQVNAYN

SEQ ID NO: 139340 - protein, 10 aa, West Nile virus
VQSQVNAYNA

SEQ ID NO: 139341 - protein, 10 aa, West Nile virus
QSQVNAYNAD

SEQ ID NO: 139342 - protein, 10 aa, West Nile virus
SQVNAYNADM

SEQ ID NO: 139343 - protein, 10 aa, West Nile virus
QVNAYNADMI

SEQ ID NO: 139344 - protein, 10 aa, West Nile virus
VNAYNADMID

SEQ ID NO: 139345 - protein, 10 aa, West Nile virus
NAYNADMIDP

SEQ ID NO: 139346 - protein, 10 aa, West Nile virus
AYNADMIDPF

SEQ ID NO: 139347 - protein, 10 aa, West Nile virus
YNADMIDPFQ

SEQ ID NO: 139348 - protein, 10 aa, West Nile virus
NADMIDPFQL

SEQ ID NO: 139349 - protein, 10 aa, West Nile virus
ADMIDPFQLG

SEQ ID NO: 139350 - protein, 10 aa, West Nile virus
DMIDPFQLGL

SEQ ID NO: 139351 - protein, 10 aa, West Nile virus
MIDPFQLGLL

SEQ ID NO: 139352 - protein, 10 aa, West Nile virus
IDPFQLGLLV

SEQ ID NO: 139353 - protein, 10 aa, West Nile virus
DPFQLGLLVV

SEQ ID NO: 139354 - protein, 10 aa, West Nile virus
PFQLGLLVVF

SEQ ID NO: 139355 - protein, 10 aa, West Nile virus
FQLGLLVVFL

SEQ ID NO: 139356 - protein, 10 aa, West Nile virus
QLGLLVVFLA

SEQ ID NO: 139357 - protein, 10 aa, West Nile virus
LGLLVVFLAT

SEQ ID NO: 139358 - protein, 10 aa, West Nile virus
GLLVVFLATQ

SEQ ID NO: 139359 - protein, 10 aa, West Nile virus
LLVVFLATQE

SEQ ID NO: 139360 - protein, 10 aa, West Nile virus
LVVFLATQEV

SEQ ID NO: 139361 - protein, 10 aa, West Nile virus
VVFLATQEVL

SEQ ID NO: 139362 - protein, 10 aa, West Nile virus
VFLATQEVLR

SEQ ID NO: 139363 - protein, 10 aa, West Nile virus
FLATQEVLRK

SEQ ID NO: 139364 - protein, 10 aa, West Nile virus
LATQEVLRKR

SEQ ID NO: 139365 - protein, 10 aa, West Nile virus
ATQEVLRKRW

SEQ ID NO: 139366 - protein, 10 aa, West Nile virus
TQEVLRKRWT

SEQ ID NO: 139367 - protein, 10 aa, West Nile virus
QEVLRKRWTA

SEQ ID NO: 139368 - protein, 10 aa, West Nile virus
EVLRKRWTAK

SEQ ID NO: 139369 - protein, 10 aa, West Nile virus
VLRKRWTAKI

SEQ ID NO: 139370 - protein, 10 aa, West Nile virus
LRKRWTAKIS

SEQ ID NO: 139371 - protein, 10 aa, West Nile virus
RKRWTAKISM

SEQ ID NO: 139372 - protein, 10 aa, West Nile virus
KRWTAKISMP

SEQ ID NO: 139373 - protein, 10 aa, West Nile virus
RWTAKISMPA

SEQ ID NO: 139374 - protein, 10 aa, West Nile virus
WTAKISMPAI

SEQ ID NO: 139375 - protein, 10 aa, West Nile virus
PAILIALLVL

SEQ ID NO: 139376 - protein, 10 aa, West Nile virus
AILIALLVLV

SEQ ID NO: 139377 - protein, 10 aa, West Nile virus
ILIALLVLVF

SEQ ID NO: 139378 - protein, 10 aa, West Nile virus
LIALLVLVFG

SEQ ID NO: 139379 - protein, 10 aa, West Nile virus
IALLVLVFGG

SEQ ID NO: 139380 - protein, 10 aa, West Nile virus
ALLVLVFGGI

SEQ ID NO: 139381 - protein, 10 aa, West Nile virus
LLVLVFGGIT

SEQ ID NO: 139382 - protein, 10 aa, West Nile virus
LVLVFGGITY

SEQ ID NO: 139383 - protein, 10 aa, West Nile virus
VLVFGGITYT

SEQ ID NO: 139384 - protein, 10 aa, West Nile virus
LVFGGITYTD

SEQ ID NO: 139385 - protein, 10 aa, West Nile virus
VFGGITYTDV

SEQ ID NO: 139386 - protein, 10 aa, West Nile virus
FGGITYTDVL

SEQ ID NO: 139387 - protein, 10 aa, West Nile virus
GGITYTDVLR

SEQ ID NO: 139388 - protein, 10 aa, West Nile virus
GITYTDVLRY

SEQ ID NO: 139389 - protein, 10 aa, West Nile virus
ITYTDVLRYV

SEQ ID NO: 139390 - protein, 10 aa, West Nile virus
TYTDVLRYVI

SEQ ID NO: 139391 - protein, 10 aa, West Nile virus
YTDVLRYVIL

SEQ ID NO: 139392 - protein, 10 aa, West Nile virus
DVLRYVILVG

SEQ ID NO: 139393 - protein, 10 aa, West Nile virus
VLRYVILVGA

SEQ ID NO: 139394 - protein, 10 aa, West Nile virus
LRYVILVGAA

SEQ ID NO: 139395 - protein, 10 aa, West Nile virus
RYVILVGAAF

SEQ ID NO: 139396 - protein, 10 aa, West Nile virus
YVILVGAAFA

SEQ ID NO: 139397 - protein, 10 aa, West Nile virus
VILVGAAFAE

SEQ ID NO: 139398 - protein, 10 aa, West Nile virus
ILVGAAFAES

SEQ ID NO: 139399 - protein, 10 aa, West Nile virus
LVGAAFAESN

SEQ ID NO: 139400 - protein, 10 aa, West Nile virus
VGAAFAESNS

SEQ ID NO: 139401 - protein, 10 aa, West Nile virus
GAAFAESNSG

SEQ ID NO: 139402 - protein, 10 aa, West Nile virus
AAFAESNSGG

SEQ ID NO: 139403 - protein, 10 aa, West Nile virus
AFAESNSGGD

SEQ ID NO: 139404 - protein, 10 aa, West Nile virus
FAESNSGGDV

SEQ ID NO: 139405 - protein, 10 aa, West Nile virus
AESNSGGDVV

SEQ ID NO: 139406 - protein, 10 aa, West Nile virus
ESNSGGDVVH

SEQ ID NO: 139407 - protein, 10 aa, West Nile virus
SNSGGDVVHL

SEQ ID NO: 139408 - protein, 10 aa, West Nile virus
NSGGDVVHLA

SEQ ID NO: 139409 - protein, 10 aa, West Nile virus
SGGDVVHLAL

SEQ ID NO: 139410 - protein, 10 aa, West Nile virus
GGDVVHLALM

SEQ ID NO: 139411 - protein, 10 aa, West Nile virus
GDVVHLALMA

SEQ ID NO: 139412 - protein, 10 aa, West Nile virus
DVVHLALMAT

SEQ ID NO: 139413 - protein, 10 aa, West Nile virus
VVHLALMATF

SEQ ID NO: 139414 - protein, 10 aa, West Nile virus
VHLALMATFK

SEQ ID NO: 139415 - protein, 10 aa, West Nile virus
HLALMATFKI

SEQ ID NO: 139416 - protein, 10 aa, West Nile virus
LALMATFKIQ

SEQ ID NO: 139417 - protein, 10 aa, West Nile virus
ALMATFKIQP

SEQ ID NO: 139418 - protein, 10 aa, West Nile virus
LMATFKIQPV

SEQ ID NO: 139419 - protein, 10 aa, West Nile virus
MATFKIQPVF

SEQ ID NO: 139420 - protein, 10 aa, West Nile virus
IQPVFMVASF

SEQ ID NO: 139421 - protein, 10 aa, West Nile virus
QPVFMVASFL

SEQ ID NO: 139422 - protein, 10 aa, West Nile virus
PVFMVASFLK

SEQ ID NO: 139423 - protein, 10 aa, West Nile virus
VFMVASFLKA

SEQ ID NO: 139424 - protein, 10 aa, West Nile virus
VASFLKARWT

SEQ ID NO: 139425 - protein, 10 aa, West Nile virus
ASFLKARWTN

SEQ ID NO: 139426 - protein, 10 aa, West Nile virus
RWTNQENILL

SEQ ID NO: 139427 - protein, 10 aa, West Nile virus
WTNQENILLM

SEQ ID NO: 139428 - protein, 10 aa, West Nile virus
TNQENILLML

SEQ ID NO: 139429 - protein, 10 aa, West Nile virus
NQENILLMLA

SEQ ID NO: 139430 - protein, 10 aa, West Nile virus
QENILLMLAA

SEQ ID NO: 139431 - protein, 10 aa, West Nile virus
ENILLMLAAV

SEQ ID NO: 139432 - protein, 10 aa, West Nile virus
NILLMLAAVF

SEQ ID NO: 139433 - protein, 10 aa, West Nile virus
ILLMLAAVFF

SEQ ID NO: 139434 - protein, 10 aa, West Nile virus
LLMLAAVFFQ

SEQ ID NO: 139435 - protein, 10 aa, West Nile virus
LMLAAVFFQM

SEQ ID NO: 139436 - protein, 10 aa, West Nile virus
MLAAVFFQMA

SEQ ID NO: 139437 - protein, 10 aa, West Nile virus
LAAVFFQMAY

SEQ ID NO: 139438 - protein, 10 aa, West Nile virus
AAVFFQMAYH

SEQ ID NO: 139439 - protein, 10 aa, West Nile virus
AVFFQMAYHD

SEQ ID NO: 139440 - protein, 10 aa, West Nile virus
VFFQMAYHDA

SEQ ID NO: 139441 - protein, 10 aa, West Nile virus
FFQMAYHDAR

SEQ ID NO: 139442 - protein, 10 aa, West Nile virus
WEIPDVLNSL

SEQ ID NO: 139443 - protein, 10 aa, West Nile virus
PDVLNSLAVA

SEQ ID NO: 139444 - protein, 10 aa, West Nile virus
DVLNSLAVAW

SEQ ID NO: 139445 - protein, 10 aa, West Nile virus
VLNSLAVAWM

SEQ ID NO: 139446 - protein, 10 aa, West Nile virus
LNSLAVAWMI

SEQ ID NO: 139447 - protein, 10 aa, West Nile virus
NSLAVAWMIL

SEQ ID NO: 139448 - protein, 10 aa, West Nile virus
SLAVAWMILR

SEQ ID NO: 139449 - protein, 10 aa, West Nile virus
LAVAWMILRA

SEQ ID NO: 139450 - protein, 10 aa, West Nile virus
AVAWMILRAI

SEQ ID NO: 139451 - protein, 10 aa, West Nile virus
VAWMILRAIT

SEQ ID NO: 139452 - protein, 10 aa, West Nile virus
AWMILRAITF

SEQ ID NO: 139453 - protein, 10 aa, West Nile virus
WMILRAITFT

SEQ ID NO: 139454 - protein, 10 aa, West Nile virus
FTTTSNVVVP

SEQ ID NO: 139455 - protein, 10 aa, West Nile virus
TTTSNVVVPL

SEQ ID NO: 139456 - protein, 10 aa, West Nile virus
TTSNVVVPLL

SEQ ID NO: 139457 - protein, 10 aa, West Nile virus
TSNVVVPLLA

SEQ ID NO: 139458 - protein, 10 aa, West Nile virus
SNVVVPLLAL

SEQ ID NO: 139459 - protein, 10 aa, West Nile virus
NVVVPLLALL

SEQ ID NO: 139460 - protein, 10 aa, West Nile virus
VVVPLLALLT

SEQ ID NO: 139461 - protein, 10 aa, West Nile virus
VVPLLALLTP

SEQ ID NO: 139462 - protein, 10 aa, West Nile virus
VPLLALLTPG

SEQ ID NO: 139463 - protein, 10 aa, West Nile virus
PLLALLTPGL

SEQ ID NO: 139464 - protein, 10 aa, West Nile virus
LLALLTPGLR

SEQ ID NO: 139465 - protein, 10 aa, West Nile virus
LALLTPGLRC

SEQ ID NO: 139466 - protein, 10 aa, West Nile virus
ALLTPGLRCL

SEQ ID NO: 139467 - protein, 10 aa, West Nile virus
LLTPGLRCLN

SEQ ID NO: 139468 - protein, 10 aa, West Nile virus
LTPGLRCLNL

SEQ ID NO: 139469 - protein, 10 aa, West Nile virus
TPGLRCLNLD

SEQ ID NO: 139470 - protein, 10 aa, West Nile virus
PGLRCLNLDV

SEQ ID NO: 139471 - protein, 10 aa, West Nile virus
GLRCLNLDVY

SEQ ID NO: 139472 - protein, 10 aa, West Nile virus
LRCLNLDVYR

SEQ ID NO: 139473 - protein, 10 aa, West Nile virus
RCLNLDVYRI

SEQ ID NO: 139474 - protein, 10 aa, West Nile virus
CLNLDVYRIL

SEQ ID NO: 139475 - protein, 10 aa, West Nile virus
LNLDVYRILL

SEQ ID NO: 139476 - protein, 10 aa, West Nile virus
NLDVYRILLL

SEQ ID NO: 139477 - protein, 10 aa, West Nile virus
LDVYRILLLM

SEQ ID NO: 139478 - protein, 10 aa, West Nile virus
DVYRILLLMV

SEQ ID NO: 139479 - protein, 10 aa, West Nile virus
VYRILLLMVG

SEQ ID NO: 139480 - protein, 10 aa, West Nile virus
YRILLLMVGI

SEQ ID NO: 139481 - protein, 10 aa, West Nile virus
RILLLMVGIG

SEQ ID NO: 139482 - protein, 10 aa, West Nile virus
ILLLMVGIGS

SEQ ID NO: 139483 - protein, 10 aa, West Nile virus
LLLMVGIGSL

SEQ ID NO: 139484 - protein, 10 aa, West Nile virus
LLMVGIGSLI

SEQ ID NO: 139485 - protein, 10 aa, West Nile virus
LMVGIGSLIR

SEQ ID NO: 139486 - protein, 10 aa, West Nile virus
MVGIGSLIRE

SEQ ID NO: 139487 - protein, 10 aa, West Nile virus
GIGSLIREKR

SEQ ID NO: 139488 - protein, 10 aa, West Nile virus
EKRSAAAKKK

SEQ ID NO: 139489 - protein, 10 aa, West Nile virus
KRSAAAKKKG

SEQ ID NO: 139490 - protein, 10 aa, West Nile virus
RSAAAKKKGA

SEQ ID NO: 139491 - protein, 10 aa, West Nile virus
SAAAKKKGAS

SEQ ID NO: 139492 - protein, 10 aa, West Nile virus
AAAKKKGASL

SEQ ID NO: 139493 - protein, 10 aa, West Nile virus
AAKKKGASLL

SEQ ID NO: 139494 - protein, 10 aa, West Nile virus
AKKKGASLLC

SEQ ID NO: 139495 - protein, 10 aa, West Nile virus
KKKGASLLCL

SEQ ID NO: 139496 - protein, 10 aa, West Nile virus
KKGASLLCLA

SEQ ID NO: 139497 - protein, 10 aa, West Nile virus
KGASLLCLAL

SEQ ID NO: 139498 - protein, 10 aa, West Nile virus
GASLLCLALA

SEQ ID NO: 139499 - protein, 10 aa, West Nile virus
ASLLCLALAS

SEQ ID NO: 139500 - protein, 10 aa, West Nile virus
SLLCLALAST

SEQ ID NO: 139501 - protein, 10 aa, West Nile virus
LLCLALASTG

SEQ ID NO: 139502 - protein, 10 aa, West Nile virus
FNPMILAAGL

SEQ ID NO: 139503 - protein, 10 aa, West Nile virus
NPMILAAGLI

SEQ ID NO: 139504 - protein, 10 aa, West Nile virus
LAAGLIACDP

SEQ ID NO: 139505 - protein, 10 aa, West Nile virus
AAGLIACDPN

SEQ ID NO: 139506 - protein, 10 aa, West Nile virus
AGLIACDPNR

SEQ ID NO: 139507 - protein, 10 aa, West Nile virus
GLIACDPNRK

SEQ ID NO: 139508 - protein, 10 aa, West Nile virus
LIACDPNRKR

SEQ ID NO: 139509 - protein, 10 aa, West Nile virus
IACDPNRKRG

SEQ ID NO: 139510 - protein, 10 aa, West Nile virus
ACDPNRKRGW

SEQ ID NO: 139511 - protein, 10 aa, West Nile virus
CDPNRKRGWP

SEQ ID NO: 139512 - protein, 10 aa, West Nile virus
DPNRKRGWPA

SEQ ID NO: 139513 - protein, 10 aa, West Nile virus
PNRKRGWPAT

SEQ ID NO: 139514 - protein, 10 aa, West Nile virus
NRKRGWPATE

SEQ ID NO: 139515 - protein, 10 aa, West Nile virus
RKRGWPATEV

SEQ ID NO: 139516 - protein, 10 aa, West Nile virus
KRGWPATEVM

SEQ ID NO: 139517 - protein, 10 aa, West Nile virus
RGWPATEVMT

SEQ ID NO: 139518 - protein, 10 aa, West Nile virus
GWPATEVMTA

SEQ ID NO: 139519 - protein, 10 aa, West Nile virus
WPATEVMTAV

SEQ ID NO: 139520 - protein, 10 aa, West Nile virus
PATEVMTAVG

SEQ ID NO: 139521 - protein, 10 aa, West Nile virus
ATEVMTAVGL

SEQ ID NO: 139522 - protein, 10 aa, West Nile virus
TEVMTAVGLM

SEQ ID NO: 139523 - protein, 10 aa, West Nile virus
EVMTAVGLMF

SEQ ID NO: 139524 - protein, 10 aa, West Nile virus
VMTAVGLMFA

SEQ ID NO: 139525 - protein, 10 aa, West Nile virus
MTAVGLMFAI

SEQ ID NO: 139526 - protein, 10 aa, West Nile virus
TAVGLMFAIV

SEQ ID NO: 139527 - protein, 10 aa, West Nile virus
AVGLMFAIVG

SEQ ID NO: 139528 - protein, 10 aa, West Nile virus
VGLMFAIVGG

SEQ ID NO: 139529 - protein, 10 aa, West Nile virus
GLMFAIVGGL

SEQ ID NO: 139530 - protein, 10 aa, West Nile virus
LMFAIVGGLA

SEQ ID NO: 139531 - protein, 10 aa, West Nile virus
MFAIVGGLAE

SEQ ID NO: 139532 - protein, 10 aa, West Nile virus
FAIVGGLAEL

SEQ ID NO: 139533 - protein, 10 aa, West Nile virus
AIVGGLAELD

SEQ ID NO: 139534 - protein, 10 aa, West Nile virus
IVGGLAELDI

SEQ ID NO: 139535 - protein, 10 aa, West Nile virus
VGGLAELDID

SEQ ID NO: 139536 - protein, 10 aa, West Nile virus
GGLAELDIDS

SEQ ID NO: 139537 - protein, 10 aa, West Nile virus
GLAELDIDSM

SEQ ID NO: 139538 - protein, 10 aa, West Nile virus
LAELDIDSMA

SEQ ID NO: 139539 - protein, 10 aa, West Nile virus
AELDIDSMAI

SEQ ID NO: 139540 - protein, 10 aa, West Nile virus
ELDIDSMAIP

SEQ ID NO: 139541 - protein, 10 aa, West Nile virus
LDIDSMAIPM

SEQ ID NO: 139542 - protein, 10 aa, West Nile virus
DIDSMAIPMT

SEQ ID NO: 139543 - protein, 10 aa, West Nile virus
IDSMAIPMTI

SEQ ID NO: 139544 - protein, 10 aa, West Nile virus
DSMAIPMTIA

SEQ ID NO: 139545 - protein, 10 aa, West Nile virus
SMAIPMTIAG

SEQ ID NO: 139546 - protein, 10 aa, West Nile virus
MAIPMTIAGL

SEQ ID NO: 139547 - protein, 10 aa, West Nile virus
AIPMTIAGLM

SEQ ID NO: 139548 - protein, 10 aa, West Nile virus
IPMTIAGLMF

SEQ ID NO: 139549 - protein, 10 aa, West Nile virus
PMTIAGLMFA

SEQ ID NO: 139550 - protein, 10 aa, West Nile virus
MTIAGLMFAA

SEQ ID NO: 139551 - protein, 10 aa, West Nile virus
TIAGLMFAAF

SEQ ID NO: 139552 - protein, 10 aa, West Nile virus
IAGLMFAAFV

SEQ ID NO: 139553 - protein, 10 aa, West Nile virus
AGLMFAAFVI

SEQ ID NO: 139554 - protein, 10 aa, West Nile virus
GLMFAAFVIS

SEQ ID NO: 139555 - protein, 10 aa, West Nile virus
LMFAAFVISG

SEQ ID NO: 139556 - protein, 10 aa, West Nile virus
MFAAFVISGK

SEQ ID NO: 139557 - protein, 10 aa, West Nile virus
FAAFVISGKS

SEQ ID NO: 139558 - protein, 10 aa, West Nile virus
AAFVISGKST

SEQ ID NO: 139559 - protein, 10 aa, West Nile virus
AFVISGKSTD

SEQ ID NO: 139560 - protein, 10 aa, West Nile virus
FVISGKSTDM

SEQ ID NO: 139561 - protein, 10 aa, West Nile virus
VISGKSTDMW

SEQ ID NO: 139562 - protein, 10 aa, West Nile virus
ISGKSTDMWI

SEQ ID NO: 139563 - protein, 10 aa, West Nile virus
SGKSTDMWIE

SEQ ID NO: 139564 - protein, 10 aa, West Nile virus
GKSTDMWIER

SEQ ID NO: 139565 - protein, 10 aa, West Nile virus
KSTDMWIERT

SEQ ID NO: 139566 - protein, 10 aa, West Nile virus
STDMWIERTA

SEQ ID NO: 139567 - protein, 10 aa, West Nile virus
TDMWIERTAD

SEQ ID NO: 139568 - protein, 10 aa, West Nile virus
DMWIERTADI

SEQ ID NO: 139569 - protein, 10 aa, West Nile virus
MWIERTADIS

SEQ ID NO: 139570 - protein, 10 aa, West Nile virus
WIERTADISW

SEQ ID NO: 139571 - protein, 10 aa, West Nile virus
IERTADISWE

SEQ ID NO: 139572 - protein, 10 aa, West Nile virus
ERTADISWES

SEQ ID NO: 139573 - protein, 10 aa, West Nile virus
RTADISWESD

SEQ ID NO: 139574 - protein, 10 aa, West Nile virus
ADISWESDAE

SEQ ID NO: 139575 - protein, 10 aa, West Nile virus
DISWESDAEI

SEQ ID NO: 139576 - protein, 10 aa, West Nile virus
ISWESDAEIT

SEQ ID NO: 139577 - protein, 10 aa, West Nile virus
SWESDAEITG

SEQ ID NO: 139578 - protein, 10 aa, West Nile virus
WESDAEITGS

SEQ ID NO: 139579 - protein, 10 aa, West Nile virus
ESDAEITGSS

SEQ ID NO: 139580 - protein, 10 aa, West Nile virus
SDAEITGSSE

SEQ ID NO: 139581 - protein, 10 aa, West Nile virus
DAEITGSSER

SEQ ID NO: 139582 - protein, 10 aa, West Nile virus
AEITGSSERV

SEQ ID NO: 139583 - protein, 10 aa, West Nile virus
EITGSSERVD

SEQ ID NO: 139584 - protein, 10 aa, West Nile virus
ITGSSERVDV

SEQ ID NO: 139585 - protein, 10 aa, West Nile virus
TGSSERVDVR

SEQ ID NO: 139586 - protein, 10 aa, West Nile virus
GSSERVDVRL

SEQ ID NO: 139587 - protein, 10 aa, West Nile virus
SSERVDVRLD

SEQ ID NO: 139588 - protein, 10 aa, West Nile virus
SERVDVRLDD

SEQ ID NO: 139589 - protein, 10 aa, West Nile virus
ERVDVRLDDD

SEQ ID NO: 139590 - protein, 10 aa, West Nile virus
RVDVRLDDDG

SEQ ID NO: 139591 - protein, 10 aa, West Nile virus
VDVRLDDDGN

SEQ ID NO: 139592 - protein, 10 aa, West Nile virus
DVRLDDDGNF

SEQ ID NO: 139593 - protein, 10 aa, West Nile virus
VRLDDDGNFQ

SEQ ID NO: 139594 - protein, 10 aa, West Nile virus
RLDDDGNFQL

SEQ ID NO: 139595 - protein, 10 aa, West Nile virus
LDDDGNFQLM

SEQ ID NO: 139596 - protein, 10 aa, West Nile virus
DDDGNFQLMN

SEQ ID NO: 139597 - protein, 10 aa, West Nile virus
DDGNFQLMND

SEQ ID NO: 139598 - protein, 10 aa, West Nile virus
DGNFQLMNDP

SEQ ID NO: 139599 - protein, 10 aa, West Nile virus
GNFQLMNDPG

SEQ ID NO: 139600 - protein, 10 aa, West Nile virus
NFQLMNDPGA

SEQ ID NO: 139601 - protein, 10 aa, West Nile virus
FQLMNDPGAP

SEQ ID NO: 139602 - protein, 10 aa, West Nile virus
QLMNDPGAPW

SEQ ID NO: 139603 - protein, 10 aa, West Nile virus
LMNDPGAPWK

SEQ ID NO: 139604 - protein, 10 aa, West Nile virus
MNDPGAPWKI

SEQ ID NO: 139605 - protein, 10 aa, West Nile virus
NDPGAPWKIW

SEQ ID NO: 139606 - protein, 10 aa, West Nile virus
DPGAPWKIWM

SEQ ID NO: 139607 - protein, 10 aa, West Nile virus
PGAPWKIWML

SEQ ID NO: 139608 - protein, 10 aa, West Nile virus
GAPWKIWMLR

SEQ ID NO: 139609 - protein, 10 aa, West Nile virus
APWKIWMLRM

SEQ ID NO: 139610 - protein, 10 aa, West Nile virus
MVCLAISAYT

SEQ ID NO: 139611 - protein, 10 aa, West Nile virus
VCLAISAYTP

SEQ ID NO: 139612 - protein, 10 aa, West Nile virus
CLAISAYTPW

SEQ ID NO: 139613 - protein, 10 aa, West Nile virus
LAISAYTPWA

SEQ ID NO: 139614 - protein, 10 aa, West Nile virus
AISAYTPWAI

SEQ ID NO: 139615 - protein, 10 aa, West Nile virus
ISAYTPWAIL

SEQ ID NO: 139616 - protein, 10 aa, West Nile virus
SAYTPWAILP

SEQ ID NO: 139617 - protein, 10 aa, West Nile virus
AYTPWAILPS

SEQ ID NO: 139618 - protein, 10 aa, West Nile virus
YTPWAILPSV

SEQ ID NO: 139619 - protein, 10 aa, West Nile virus
TPWAILPSVV

SEQ ID NO: 139620 - protein, 10 aa, West Nile virus
PWAILPSVVG

SEQ ID NO: 139621 - protein, 10 aa, West Nile virus
WAILPSVVGF

SEQ ID NO: 139622 - protein, 10 aa, West Nile virus
AILPSVVGFW

SEQ ID NO: 139623 - protein, 10 aa, West Nile virus
ILPSVVGFWI

SEQ ID NO: 139624 - protein, 10 aa, West Nile virus
LPSVVGFWIT

SEQ ID NO: 139625 - protein, 10 aa, West Nile virus
PSVVGFWITL

SEQ ID NO: 139626 - protein, 10 aa, West Nile virus
SVVGFWITLQ

SEQ ID NO: 139627 - protein, 10 aa, West Nile virus
VVGFWITLQY

SEQ ID NO: 139628 - protein, 10 aa, West Nile virus
VGFWITLQYT

SEQ ID NO: 139629 - protein, 10 aa, West Nile virus
GFWITLQYTK

SEQ ID NO: 139630 - protein, 10 aa, West Nile virus
FWITLQYTKR

SEQ ID NO: 139631 - protein, 10 aa, West Nile virus
WITLQYTKRG

SEQ ID NO: 139632 - protein, 10 aa, West Nile virus
ITLQYTKRGG

SEQ ID NO: 139633 - protein, 10 aa, West Nile virus
TLQYTKRGGV

SEQ ID NO: 139634 - protein, 10 aa, West Nile virus
LQYTKRGGVL

SEQ ID NO: 139635 - protein, 10 aa, West Nile virus
QYTKRGGVLW

SEQ ID NO: 139636 - protein, 10 aa, West Nile virus
YTKRGGVLWD

SEQ ID NO: 139637 - protein, 10 aa, West Nile virus
TKRGGVLWDT

SEQ ID NO: 139638 - protein, 10 aa, West Nile virus
KRGGVLWDTP

SEQ ID NO: 139639 - protein, 10 aa, West Nile virus
RGGVLWDTPS

SEQ ID NO: 139640 - protein, 10 aa, West Nile virus
GGVLWDTPSP

SEQ ID NO: 139641 - protein, 10 aa, West Nile virus
GVLWDTPSPK

SEQ ID NO: 139642 - protein, 10 aa, West Nile virus
VLWDTPSPKE

SEQ ID NO: 139643 - protein, 10 aa, West Nile virus
LWDTPSPKEY

SEQ ID NO: 139644 - protein, 10 aa, West Nile virus
WDTPSPKEYK

SEQ ID NO: 139645 - protein, 10 aa, West Nile virus
EYKKGDTTTG

SEQ ID NO: 139646 - protein, 10 aa, West Nile virus
YKKGDTTTGV

SEQ ID NO: 139647 - protein, 10 aa, West Nile virus
KKGDTTTGVY

SEQ ID NO: 139648 - protein, 10 aa, West Nile virus
KGDTTTGVYR

SEQ ID NO: 139649 - protein, 10 aa, West Nile virus
GDTTTGVYRI

SEQ ID NO: 139650 - protein, 10 aa, West Nile virus
DTTTGVYRIM

SEQ ID NO: 139651 - protein, 10 aa, West Nile virus
TTTGVYRIMT

SEQ ID NO: 139652 - protein, 10 aa, West Nile virus
TTGVYRIMTR

SEQ ID NO: 139653 - protein, 10 aa, West Nile virus
TGVYRIMTRG

SEQ ID NO: 139654 - protein, 10 aa, West Nile virus
GVYRIMTRGL

SEQ ID NO: 139655 - protein, 10 aa, West Nile virus
VYRIMTRGLL

SEQ ID NO: 139656 - protein, 10 aa, West Nile virus
YRIMTRGLLG

SEQ ID NO: 139657 - protein, 10 aa, West Nile virus
RIMTRGLLGS

SEQ ID NO: 139658 - protein, 10 aa, West Nile virus
IMTRGLLGSY

SEQ ID NO: 139659 - protein, 10 aa, West Nile virus
MTRGLLGSYQ

SEQ ID NO: 139660 - protein, 10 aa, West Nile virus
TRGLLGSYQA

SEQ ID NO: 139661 - protein, 10 aa, West Nile virus
RGLLGSYQAG

SEQ ID NO: 139662 - protein, 10 aa, West Nile virus
GLLGSYQAGA

SEQ ID NO: 139663 - protein, 10 aa, West Nile virus
LLGSYQAGAG

SEQ ID NO: 139664 - protein, 10 aa, West Nile virus
LGSYQAGAGV

SEQ ID NO: 139665 - protein, 10 aa, West Nile virus
GSYQAGAGVM

SEQ ID NO: 139666 - protein, 10 aa, West Nile virus
SYQAGAGVMV

SEQ ID NO: 139667 - protein, 10 aa, West Nile virus
YQAGAGVMVE

SEQ ID NO: 139668 - protein, 10 aa, West Nile virus
QAGAGVMVEG

SEQ ID NO: 139669 - protein, 10 aa, West Nile virus
AGAGVMVEGV

SEQ ID NO: 139670 - protein, 10 aa, West Nile virus
GAGVMVEGVF

SEQ ID NO: 139671 - protein, 10 aa, West Nile virus
AGVMVEGVFH

SEQ ID NO: 139672 - protein, 10 aa, West Nile virus
GVMVEGVFHT

SEQ ID NO: 139673 - protein, 10 aa, West Nile virus
VMVEGVFHTL

SEQ ID NO: 139674 - protein, 10 aa, West Nile virus
MVEGVFHTLW

SEQ ID NO: 139675 - protein, 10 aa, West Nile virus
VEGVFHTLWH

SEQ ID NO: 139676 - protein, 10 aa, West Nile virus
EGVFHTLWHT

SEQ ID NO: 139677 - protein, 10 aa, West Nile virus
GVFHTLWHTT

SEQ ID NO: 139678 - protein, 10 aa, West Nile virus
VFHTLWHTTK

SEQ ID NO: 139679 - protein, 10 aa, West Nile virus
FHTLWHTTKG

SEQ ID NO: 139680 - protein, 10 aa, West Nile virus
HTLWHTTKGA

SEQ ID NO: 139681 - protein, 10 aa, West Nile virus
TLWHTTKGAA

SEQ ID NO: 139682 - protein, 10 aa, West Nile virus
LWHTTKGAAL

SEQ ID NO: 139683 - protein, 10 aa, West Nile virus
WHTTKGAALM

SEQ ID NO: 139684 - protein, 10 aa, West Nile virus
HTTKGAALMS

SEQ ID NO: 139685 - protein, 10 aa, West Nile virus
TTKGAALMSG

SEQ ID NO: 139686 - protein, 10 aa, West Nile virus
TKGAALMSGE

SEQ ID NO: 139687 - protein, 10 aa, West Nile virus
KGAALMSGEG

SEQ ID NO: 139688 - protein, 10 aa, West Nile virus
GAALMSGEGR

SEQ ID NO: 139689 - protein, 10 aa, West Nile virus
AALMSGEGRL

SEQ ID NO: 139690 - protein, 10 aa, West Nile virus
ALMSGEGRLD

SEQ ID NO: 139691 - protein, 10 aa, West Nile virus
LMSGEGRLDP

SEQ ID NO: 139692 - protein, 10 aa, West Nile virus
MSGEGRLDPY

SEQ ID NO: 139693 - protein, 10 aa, West Nile virus
SGEGRLDPYW

SEQ ID NO: 139694 - protein, 10 aa, West Nile virus
GEGRLDPYWG

SEQ ID NO: 139695 - protein, 10 aa, West Nile virus
EGRLDPYWGS

SEQ ID NO: 139696 - protein, 10 aa, West Nile virus
GRLDPYWGSV

SEQ ID NO: 139697 - protein, 10 aa, West Nile virus
RLDPYWGSVK

SEQ ID NO: 139698 - protein, 10 aa, West Nile virus
LDPYWGSVKE

SEQ ID NO: 139699 - protein, 10 aa, West Nile virus
DPYWGSVKED

SEQ ID NO: 139700 - protein, 10 aa, West Nile virus
PYWGSVKEDR

SEQ ID NO: 139701 - protein, 10 aa, West Nile virus
YWGSVKEDRL

SEQ ID NO: 139702 - protein, 10 aa, West Nile virus
WGSVKEDRLC

SEQ ID NO: 139703 - protein, 10 aa, West Nile virus
GSVKEDRLCY

SEQ ID NO: 139704 - protein, 10 aa, West Nile virus
SVKEDRLCYG

SEQ ID NO: 139705 - protein, 10 aa, West Nile virus
VKEDRLCYGG

SEQ ID NO: 139706 - protein, 10 aa, West Nile virus
KEDRLCYGGP

SEQ ID NO: 139707 - protein, 10 aa, West Nile virus
EDRLCYGGPW

SEQ ID NO: 139708 - protein, 10 aa, West Nile virus
DRLCYGGPWK

SEQ ID NO: 139709 - protein, 10 aa, West Nile virus
RLCYGGPWKL

SEQ ID NO: 139710 - protein, 10 aa, West Nile virus
LCYGGPWKLQ

SEQ ID NO: 139711 - protein, 10 aa, West Nile virus
CYGGPWKLQH

SEQ ID NO: 139712 - protein, 10 aa, West Nile virus
YGGPWKLQHK

SEQ ID NO: 139713 - protein, 10 aa, West Nile virus
GGPWKLQHKW

SEQ ID NO: 139714 - protein, 10 aa, West Nile virus
GPWKLQHKWN

SEQ ID NO: 139715 - protein, 10 aa, West Nile virus
PWKLQHKWNG

SEQ ID NO: 139716 - protein, 10 aa, West Nile virus
WKLQHKWNGQ

SEQ ID NO: 139717 - protein, 10 aa, West Nile virus
KLQHKWNGQD

SEQ ID NO: 139718 - protein, 10 aa, West Nile virus
LQHKWNGQDE

SEQ ID NO: 139719 - protein, 10 aa, West Nile virus
QHKWNGQDEV

SEQ ID NO: 139720 - protein, 10 aa, West Nile virus
HKWNGQDEVQ

SEQ ID NO: 139721 - protein, 10 aa, West Nile virus
KWNGQDEVQM

SEQ ID NO: 139722 - protein, 10 aa, West Nile virus
WNGQDEVQMI

SEQ ID NO: 139723 - protein, 10 aa, West Nile virus
NGQDEVQMIV

SEQ ID NO: 139724 - protein, 10 aa, West Nile virus
GQDEVQMIVV

SEQ ID NO: 139725 - protein, 10 aa, West Nile virus
QDEVQMIVVE

SEQ ID NO: 139726 - protein, 10 aa, West Nile virus
DEVQMIVVEP

SEQ ID NO: 139727 - protein, 10 aa, West Nile virus
EVQMIVVEPG

SEQ ID NO: 139728 - protein, 10 aa, West Nile virus
VQMIVVEPGK

SEQ ID NO: 139729 - protein, 10 aa, West Nile virus
QMIVVEPGKN

SEQ ID NO: 139730 - protein, 10 aa, West Nile virus
MIVVEPGKNV

SEQ ID NO: 139731 - protein, 10 aa, West Nile virus
IVVEPGKNVK

SEQ ID NO: 139732 - protein, 10 aa, West Nile virus
VVEPGKNVKN

SEQ ID NO: 139733 - protein, 10 aa, West Nile virus
VEPGKNVKNV

SEQ ID NO: 139734 - protein, 10 aa, West Nile virus
EPGKNVKNVQ

SEQ ID NO: 139735 - protein, 10 aa, West Nile virus
PGKNVKNVQT

SEQ ID NO: 139736 - protein, 10 aa, West Nile virus
GKNVKNVQTK

SEQ ID NO: 139737 - protein, 10 aa, West Nile virus
KNVKNVQTKP

SEQ ID NO: 139738 - protein, 10 aa, West Nile virus
NVKNVQTKPG

SEQ ID NO: 139739 - protein, 10 aa, West Nile virus
VKNVQTKPGV

SEQ ID NO: 139740 - protein, 10 aa, West Nile virus
KNVQTKPGVF

SEQ ID NO: 139741 - protein, 10 aa, West Nile virus
NVQTKPGVFK

SEQ ID NO: 139742 - protein, 10 aa, West Nile virus
VQTKPGVFKT

SEQ ID NO: 139743 - protein, 10 aa, West Nile virus
QTKPGVFKTP

SEQ ID NO: 139744 - protein, 10 aa, West Nile virus
TKPGVFKTPE

SEQ ID NO: 139745 - protein, 10 aa, West Nile virus
KPGVFKTPEG

SEQ ID NO: 139746 - protein, 10 aa, West Nile virus
PGVFKTPEGE

SEQ ID NO: 139747 - protein, 10 aa, West Nile virus
GVFKTPEGEI

SEQ ID NO: 139748 - protein, 10 aa, West Nile virus
VFKTPEGEIG

SEQ ID NO: 139749 - protein, 10 aa, West Nile virus
FKTPEGEIGA

SEQ ID NO: 139750 - protein, 10 aa, West Nile virus
KTPEGEIGAV

SEQ ID NO: 139751 - protein, 10 aa, West Nile virus
TPEGEIGAVT

SEQ ID NO: 139752 - protein, 10 aa, West Nile virus
PEGEIGAVTL

SEQ ID NO: 139753 - protein, 10 aa, West Nile virus
EGEIGAVTLD

SEQ ID NO: 139754 - protein, 10 aa, West Nile virus
GEIGAVTLDF

SEQ ID NO: 139755 - protein, 10 aa, West Nile virus
EIGAVTLDFP

SEQ ID NO: 139756 - protein, 10 aa, West Nile virus
IGAVTLDFPT

SEQ ID NO: 139757 - protein, 10 aa, West Nile virus
GAVTLDFPTG

SEQ ID NO: 139758 - protein, 10 aa, West Nile virus
AVTLDFPTGT

SEQ ID NO: 139759 - protein, 10 aa, West Nile virus
VTLDFPTGTS

SEQ ID NO: 139760 - protein, 10 aa, West Nile virus
TLDFPTGTSG

SEQ ID NO: 139761 - protein, 10 aa, West Nile virus
LDFPTGTSGS

SEQ ID NO: 139762 - protein, 10 aa, West Nile virus
DFPTGTSGSP

SEQ ID NO: 139763 - protein, 10 aa, West Nile virus
FPTGTSGSPI

SEQ ID NO: 139764 - protein, 10 aa, West Nile virus
PTGTSGSPIV

SEQ ID NO: 139765 - protein, 10 aa, West Nile virus
TGTSGSPIVD

SEQ ID NO: 139766 - protein, 10 aa, West Nile virus
GTSGSPIVDK

SEQ ID NO: 139767 - protein, 10 aa, West Nile virus
TSGSPIVDKN

SEQ ID NO: 139768 - protein, 10 aa, West Nile virus
SGSPIVDKNG

SEQ ID NO: 139769 - protein, 10 aa, West Nile virus
GSPIVDKNGD

SEQ ID NO: 139770 - protein, 10 aa, West Nile virus
SPIVDKNGDV

SEQ ID NO: 139771 - protein, 10 aa, West Nile virus
PIVDKNGDVI

SEQ ID NO: 139772 - protein, 10 aa, West Nile virus
IVDKNGDVIG

SEQ ID NO: 139773 - protein, 10 aa, West Nile virus
VDKNGDVIGL

SEQ ID NO: 139774 - protein, 10 aa, West Nile virus
DKNGDVIGLY

SEQ ID NO: 139775 - protein, 10 aa, West Nile virus
KNGDVIGLYG

SEQ ID NO: 139776 - protein, 10 aa, West Nile virus
NGDVIGLYGN

SEQ ID NO: 139777 - protein, 10 aa, West Nile virus
GDVIGLYGNG

SEQ ID NO: 139778 - protein, 10 aa, West Nile virus
DVIGLYGNGV

SEQ ID NO: 139779 - protein, 10 aa, West Nile virus
VIGLYGNGVI

SEQ ID NO: 139780 - protein, 10 aa, West Nile virus
IGLYGNGVIM

SEQ ID NO: 139781 - protein, 10 aa, West Nile virus
GLYGNGVIMP

SEQ ID NO: 139782 - protein, 10 aa, West Nile virus
LYGNGVIMPN

SEQ ID NO: 139783 - protein, 10 aa, West Nile virus
YGNGVIMPNG

SEQ ID NO: 139784 - protein, 10 aa, West Nile virus
GNGVIMPNGS

SEQ ID NO: 139785 - protein, 10 aa, West Nile virus
NGVIMPNGSY

SEQ ID NO: 139786 - protein, 10 aa, West Nile virus
GVIMPNGSYI

SEQ ID NO: 139787 - protein, 10 aa, West Nile virus
VIMPNGSYIS

SEQ ID NO: 139788 - protein, 10 aa, West Nile virus
IMPNGSYISA

SEQ ID NO: 139789 - protein, 10 aa, West Nile virus
MPNGSYISAI

SEQ ID NO: 139790 - protein, 10 aa, West Nile virus
PNGSYISAIV

SEQ ID NO: 139791 - protein, 10 aa, West Nile virus
NGSYISAIVQ

SEQ ID NO: 139792 - protein, 10 aa, West Nile virus
GSYISAIVQG

SEQ ID NO: 139793 - protein, 10 aa, West Nile virus
SYISAIVQGE

SEQ ID NO: 139794 - protein, 10 aa, West Nile virus
YISAIVQGER

SEQ ID NO: 139795 - protein, 10 aa, West Nile virus
ISAIVQGERM

SEQ ID NO: 139796 - protein, 10 aa, West Nile virus
SAIVQGERMD

SEQ ID NO: 139797 - protein, 10 aa, West Nile virus
AIVQGERMDE

SEQ ID NO: 139798 - protein, 10 aa, West Nile virus
IVQGERMDEP

SEQ ID NO: 139799 - protein, 10 aa, West Nile virus
VQGERMDEPI

SEQ ID NO: 139800 - protein, 10 aa, West Nile virus
QGERMDEPIP

SEQ ID NO: 139801 - protein, 10 aa, West Nile virus
GERMDEPIPA

SEQ ID NO: 139802 - protein, 10 aa, West Nile virus
ERMDEPIPAG

SEQ ID NO: 139803 - protein, 10 aa, West Nile virus
RMDEPIPAGF

SEQ ID NO: 139804 - protein, 10 aa, West Nile virus
GFEPEMLRKK

SEQ ID NO: 139805 - protein, 10 aa, West Nile virus
FEPEMLRKKQ

SEQ ID NO: 139806 - protein, 10 aa, West Nile virus
EPEMLRKKQI

SEQ ID NO: 139807 - protein, 10 aa, West Nile virus
PEMLRKKQIT

SEQ ID NO: 139808 - protein, 10 aa, West Nile virus
EMLRKKQITV

SEQ ID NO: 139809 - protein, 10 aa, West Nile virus
MLRKKQITVL

SEQ ID NO: 139810 - protein, 10 aa, West Nile virus
LRKKQITVLD

SEQ ID NO: 139811 - protein, 10 aa, West Nile virus
RKKQITVLDL

SEQ ID NO: 139812 - protein, 10 aa, West Nile virus
KKQITVLDLH

SEQ ID NO: 139813 - protein, 10 aa, West Nile virus
KQITVLDLHP

SEQ ID NO: 139814 - protein, 10 aa, West Nile virus
QITVLDLHPG

SEQ ID NO: 139815 - protein, 10 aa, West Nile virus
ITVLDLHPGA

SEQ ID NO: 139816 - protein, 10 aa, West Nile virus
TVLDLHPGAG

SEQ ID NO: 139817 - protein, 10 aa, West Nile virus
VLDLHPGAGK

SEQ ID NO: 139818 - protein, 10 aa, West Nile virus
LDLHPGAGKT

SEQ ID NO: 139819 - protein, 10 aa, West Nile virus
DLHPGAGKTR

SEQ ID NO: 139820 - protein, 10 aa, West Nile virus
LHPGAGKTRR

SEQ ID NO: 139821 - protein, 10 aa, West Nile virus
HPGAGKTRRI

SEQ ID NO: 139822 - protein, 10 aa, West Nile virus
PGAGKTRRIL

SEQ ID NO: 139823 - protein, 10 aa, West Nile virus
GAGKTRRILP

SEQ ID NO: 139824 - protein, 10 aa, West Nile virus
AGKTRRILPQ

SEQ ID NO: 139825 - protein, 10 aa, West Nile virus
GKTRRILPQI

SEQ ID NO: 139826 - protein, 10 aa, West Nile virus
KTRRILPQII

SEQ ID NO: 139827 - protein, 10 aa, West Nile virus
TRRILPQIIK

SEQ ID NO: 139828 - protein, 10 aa, West Nile virus
RRILPQIIKE

SEQ ID NO: 139829 - protein, 10 aa, West Nile virus
RILPQIIKEA

SEQ ID NO: 139830 - protein, 10 aa, West Nile virus
ILPQIIKEAI

SEQ ID NO: 139831 - protein, 10 aa, West Nile virus
LPQIIKEAIN

SEQ ID NO: 139832 - protein, 10 aa, West Nile virus
PQIIKEAINR

SEQ ID NO: 139833 - protein, 10 aa, West Nile virus
QIIKEAINRR

SEQ ID NO: 139834 - protein, 10 aa, West Nile virus
IIKEAINRRL

SEQ ID NO: 139835 - protein, 10 aa, West Nile virus
IKEAINRRLR

SEQ ID NO: 139836 - protein, 10 aa, West Nile virus
KEAINRRLRT

SEQ ID NO: 139837 - protein, 10 aa, West Nile virus
EAINRRLRTA

SEQ ID NO: 139838 - protein, 10 aa, West Nile virus
NRRLRTAVLA

SEQ ID NO: 139839 - protein, 10 aa, West Nile virus
RRLRTAVLAP

SEQ ID NO: 139840 - protein, 10 aa, West Nile virus
RLRTAVLAPT

SEQ ID NO: 139841 - protein, 10 aa, West Nile virus
LRTAVLAPTR

SEQ ID NO: 139842 - protein, 10 aa, West Nile virus
RTAVLAPTRV

SEQ ID NO: 139843 - protein, 10 aa, West Nile virus
TAVLAPTRVV

SEQ ID NO: 139844 - protein, 10 aa, West Nile virus
AVLAPTRVVA

SEQ ID NO: 139845 - protein, 10 aa, West Nile virus
VLAPTRVVAA

SEQ ID NO: 139846 - protein, 10 aa, West Nile virus
LAPTRVVAAE

SEQ ID NO: 139847 - protein, 10 aa, West Nile virus
APTRVVAAEM

SEQ ID NO: 139848 - protein, 10 aa, West Nile virus
PTRVVAAEMA

SEQ ID NO: 139849 - protein, 10 aa, West Nile virus
TRVVAAEMAE

SEQ ID NO: 139850 - protein, 10 aa, West Nile virus
RVVAAEMAEA

SEQ ID NO: 139851 - protein, 10 aa, West Nile virus
VVAAEMAEAL

SEQ ID NO: 139852 - protein, 10 aa, West Nile virus
VAAEMAEALR

SEQ ID NO: 139853 - protein, 10 aa, West Nile virus
AAEMAEALRG

SEQ ID NO: 139854 - protein, 10 aa, West Nile virus
AEMAEALRGL

SEQ ID NO: 139855 - protein, 10 aa, West Nile virus
EMAEALRGLP

SEQ ID NO: 139856 - protein, 10 aa, West Nile virus
MAEALRGLPI

SEQ ID NO: 139857 - protein, 10 aa, West Nile virus
AEALRGLPIR

SEQ ID NO: 139858 - protein, 10 aa, West Nile virus
EALRGLPIRY

SEQ ID NO: 139859 - protein, 10 aa, West Nile virus
ALRGLPIRYQ

SEQ ID NO: 139860 - protein, 10 aa, West Nile virus
LRGLPIRYQT

SEQ ID NO: 139861 - protein, 10 aa, West Nile virus
RGLPIRYQTS

SEQ ID NO: 139862 - protein, 10 aa, West Nile virus
GLPIRYQTSA

SEQ ID NO: 139863 - protein, 10 aa, West Nile virus
LPIRYQTSAV

SEQ ID NO: 139864 - protein, 10 aa, West Nile virus
PIRYQTSAVP

SEQ ID NO: 139865 - protein, 10 aa, West Nile virus
IRYQTSAVPR

SEQ ID NO: 139866 - protein, 10 aa, West Nile virus
RYQTSAVPRE

SEQ ID NO: 139867 - protein, 10 aa, West Nile virus
YQTSAVPREH

SEQ ID NO: 139868 - protein, 10 aa, West Nile virus
REHNGNEIVD

SEQ ID NO: 139869 - protein, 10 aa, West Nile virus
EHNGNEIVDV

SEQ ID NO: 139870 - protein, 10 aa, West Nile virus
HNGNEIVDVM

SEQ ID NO: 139871 - protein, 10 aa, West Nile virus
NGNEIVDVMC

SEQ ID NO: 139872 - protein, 10 aa, West Nile virus
GNEIVDVMCH

SEQ ID NO: 139873 - protein, 10 aa, West Nile virus
NEIVDVMCHA

SEQ ID NO: 139874 - protein, 10 aa, West Nile virus
EIVDVMCHAT

SEQ ID NO: 139875 - protein, 10 aa, West Nile virus
IVDVMCHATL

SEQ ID NO: 139876 - protein, 10 aa, West Nile virus
VDVMCHATLT

SEQ ID NO: 139877 - protein, 10 aa, West Nile virus
DVMCHATLTH

SEQ ID NO: 139878 - protein, 10 aa, West Nile virus
VMCHATLTHR

SEQ ID NO: 139879 - protein, 10 aa, West Nile virus
MCHATLTHRL

SEQ ID NO: 139880 - protein, 10 aa, West Nile virus
CHATLTHRLM

SEQ ID NO: 139881 - protein, 10 aa, West Nile virus
HATLTHRLMS

SEQ ID NO: 139882 - protein, 10 aa, West Nile virus
ATLTHRLMSP

SEQ ID NO: 139883 - protein, 10 aa, West Nile virus
TLTHRLMSPH

SEQ ID NO: 139884 - protein, 10 aa, West Nile virus
LTHRLMSPHR

SEQ ID NO: 139885 - protein, 10 aa, West Nile virus
THRLMSPHRV

SEQ ID NO: 139886 - protein, 10 aa, West Nile virus
HRLMSPHRVP

SEQ ID NO: 139887 - protein, 10 aa, West Nile virus
RLMSPHRVPN

SEQ ID NO: 139888 - protein, 10 aa, West Nile virus
LMSPHRVPNY

SEQ ID NO: 139889 - protein, 10 aa, West Nile virus
MSPHRVPNYN

SEQ ID NO: 139890 - protein, 10 aa, West Nile virus
SPHRVPNYNL

SEQ ID NO: 139891 - protein, 10 aa, West Nile virus
PHRVPNYNLF

SEQ ID NO: 139892 - protein, 10 aa, West Nile virus
HRVPNYNLFV

SEQ ID NO: 139893 - protein, 10 aa, West Nile virus
RVPNYNLFVM

SEQ ID NO: 139894 - protein, 10 aa, West Nile virus
VPNYNLFVMD

SEQ ID NO: 139895 - protein, 10 aa, West Nile virus
PNYNLFVMDE

SEQ ID NO: 139896 - protein, 10 aa, West Nile virus
NYNLFVMDEA

SEQ ID NO: 139897 - protein, 10 aa, West Nile virus
YNLFVMDEAH

SEQ ID NO: 139898 - protein, 10 aa, West Nile virus
NLFVMDEAHF

SEQ ID NO: 139899 - protein, 10 aa, West Nile virus
LFVMDEAHFT

SEQ ID NO: 139900 - protein, 10 aa, West Nile virus
FVMDEAHFTD

SEQ ID NO: 139901 - protein, 10 aa, West Nile virus
VMDEAHFTDP

SEQ ID NO: 139902 - protein, 10 aa, West Nile virus
MDEAHFTDPA

SEQ ID NO: 139903 - protein, 10 aa, West Nile virus
DEAHFTDPAS

SEQ ID NO: 139904 - protein, 10 aa, West Nile virus
EAHFTDPASI

SEQ ID NO: 139905 - protein, 10 aa, West Nile virus
AHFTDPASIA

SEQ ID NO: 139906 - protein, 10 aa, West Nile virus
HFTDPASIAA

SEQ ID NO: 139907 - protein, 10 aa, West Nile virus
FTDPASIAAR

SEQ ID NO: 139908 - protein, 10 aa, West Nile virus
TDPASIAARG

SEQ ID NO: 139909 - protein, 10 aa, West Nile virus
DPASIAARGY

SEQ ID NO: 139910 - protein, 10 aa, West Nile virus
PASIAARGYI

SEQ ID NO: 139911 - protein, 10 aa, West Nile virus
ASIAARGYIS

SEQ ID NO: 139912 - protein, 10 aa, West Nile virus
SIAARGYIST

SEQ ID NO: 139913 - protein, 10 aa, West Nile virus
IAARGYISTK

SEQ ID NO: 139914 - protein, 10 aa, West Nile virus
AARGYISTKV

SEQ ID NO: 139915 - protein, 10 aa, West Nile virus
ARGYISTKVE

SEQ ID NO: 139916 - protein, 10 aa, West Nile virus
RGYISTKVEL

SEQ ID NO: 139917 - protein, 10 aa, West Nile virus
GYISTKVELG

SEQ ID NO: 139918 - protein, 10 aa, West Nile virus
YISTKVELGE

SEQ ID NO: 139919 - protein, 10 aa, West Nile virus
ISTKVELGEA

SEQ ID NO: 139920 - protein, 10 aa, West Nile virus
STKVELGEAA

SEQ ID NO: 139921 - protein, 10 aa, West Nile virus
TKVELGEAAA

SEQ ID NO: 139922 - protein, 10 aa, West Nile virus
KVELGEAAAI

SEQ ID NO: 139923 - protein, 10 aa, West Nile virus
VELGEAAAIF

SEQ ID NO: 139924 - protein, 10 aa, West Nile virus
ELGEAAAIFM

SEQ ID NO: 139925 - protein, 10 aa, West Nile virus
LGEAAAIFMT

SEQ ID NO: 139926 - protein, 10 aa, West Nile virus
GEAAAIFMTA

SEQ ID NO: 139927 - protein, 10 aa, West Nile virus
EAAAIFMTAT

SEQ ID NO: 139928 - protein, 10 aa, West Nile virus
AAAIFMTATP

SEQ ID NO: 139929 - protein, 10 aa, West Nile virus
AAIFMTATPP

SEQ ID NO: 139930 - protein, 10 aa, West Nile virus
AIFMTATPPG

SEQ ID NO: 139931 - protein, 10 aa, West Nile virus
IFMTATPPGT

SEQ ID NO: 139932 - protein, 10 aa, West Nile virus
FMTATPPGTS

SEQ ID NO: 139933 - protein, 10 aa, West Nile virus
MTATPPGTSD

SEQ ID NO: 139934 - protein, 10 aa, West Nile virus
TATPPGTSDP

SEQ ID NO: 139935 - protein, 10 aa, West Nile virus
ATPPGTSDPF

SEQ ID NO: 139936 - protein, 10 aa, West Nile virus
TPPGTSDPFP

SEQ ID NO: 139937 - protein, 10 aa, West Nile virus
PPGTSDPFPE

SEQ ID NO: 139938 - protein, 10 aa, West Nile virus
PGTSDPFPES

SEQ ID NO: 139939 - protein, 10 aa, West Nile virus
GTSDPFPESN

SEQ ID NO: 139940 - protein, 10 aa, West Nile virus
TSDPFPESNS

SEQ ID NO: 139941 - protein, 10 aa, West Nile virus
SDPFPESNSP

SEQ ID NO: 139942 - protein, 10 aa, West Nile virus
DPFPESNSPI

SEQ ID NO: 139943 - protein, 10 aa, West Nile virus
DLQTEIPDRA

SEQ ID NO: 139944 - protein, 10 aa, West Nile virus
LQTEIPDRAW

SEQ ID NO: 139945 - protein, 10 aa, West Nile virus
QTEIPDRAWN

SEQ ID NO: 139946 - protein, 10 aa, West Nile virus
TEIPDRAWNS

SEQ ID NO: 139947 - protein, 10 aa, West Nile virus
EIPDRAWNSG

SEQ ID NO: 139948 - protein, 10 aa, West Nile virus
IPDRAWNSGY

SEQ ID NO: 139949 - protein, 10 aa, West Nile virus
PDRAWNSGYE

SEQ ID NO: 139950 - protein, 10 aa, West Nile virus
DRAWNSGYEW

SEQ ID NO: 139951 - protein, 10 aa, West Nile virus
RAWNSGYEWI

SEQ ID NO: 139952 - protein, 10 aa, West Nile virus
AWNSGYEWIT

SEQ ID NO: 139953 - protein, 10 aa, West Nile virus
WNSGYEWITE

SEQ ID NO: 139954 - protein, 10 aa, West Nile virus
NSGYEWITEY

SEQ ID NO: 139955 - protein, 10 aa, West Nile virus
SGYEWITEYT

SEQ ID NO: 139956 - protein, 10 aa, West Nile virus
GYEWITEYTG

SEQ ID NO: 139957 - protein, 10 aa, West Nile virus
YEWITEYTGK

SEQ ID NO: 139958 - protein, 10 aa, West Nile virus
EWITEYTGKT

SEQ ID NO: 139959 - protein, 10 aa, West Nile virus
WITEYTGKTV

SEQ ID NO: 139960 - protein, 10 aa, West Nile virus
ITEYTGKTVW

SEQ ID NO: 139961 - protein, 10 aa, West Nile virus
TEYTGKTVWF

SEQ ID NO: 139962 - protein, 10 aa, West Nile virus
EYTGKTVWFV

SEQ ID NO: 139963 - protein, 10 aa, West Nile virus
YTGKTVWFVP

SEQ ID NO: 139964 - protein, 10 aa, West Nile virus
TGKTVWFVPS

SEQ ID NO: 139965 - protein, 10 aa, West Nile virus
GKTVWFVPSV

SEQ ID NO: 139966 - protein, 10 aa, West Nile virus
KTVWFVPSVK

SEQ ID NO: 139967 - protein, 10 aa, West Nile virus
TVWFVPSVKM

SEQ ID NO: 139968 - protein, 10 aa, West Nile virus
VWFVPSVKMG

SEQ ID NO: 139969 - protein, 10 aa, West Nile virus
WFVPSVKMGN

SEQ ID NO: 139970 - protein, 10 aa, West Nile virus
FVPSVKMGNE

SEQ ID NO: 139971 - protein, 10 aa, West Nile virus
VPSVKMGNEI

SEQ ID NO: 139972 - protein, 10 aa, West Nile virus
PSVKMGNEIA

SEQ ID NO: 139973 - protein, 10 aa, West Nile virus
SVKMGNEIAL

SEQ ID NO: 139974 - protein, 10 aa, West Nile virus
VKMGNEIALC

SEQ ID NO: 139975 - protein, 10 aa, West Nile virus
KMGNEIALCL

SEQ ID NO: 139976 - protein, 10 aa, West Nile virus
MGNEIALCLQ

SEQ ID NO: 139977 - protein, 10 aa, West Nile virus
GNEIALCLQR

SEQ ID NO: 139978 - protein, 10 aa, West Nile virus
NEIALCLQRA

SEQ ID NO: 139979 - protein, 10 aa, West Nile virus
EIALCLQRAG

SEQ ID NO: 139980 - protein, 10 aa, West Nile virus
IALCLQRAGK

SEQ ID NO: 139981 - protein, 10 aa, West Nile virus
ALCLQRAGKK

SEQ ID NO: 139982 - protein, 10 aa, West Nile virus
LCLQRAGKKV

SEQ ID NO: 139983 - protein, 10 aa, West Nile virus
CLQRAGKKVV

SEQ ID NO: 139984 - protein, 10 aa, West Nile virus
LQRAGKKVVQ

SEQ ID NO: 139985 - protein, 10 aa, West Nile virus
QRAGKKVVQL

SEQ ID NO: 139986 - protein, 10 aa, West Nile virus
RAGKKVVQLN

SEQ ID NO: 139987 - protein, 10 aa, West Nile virus
AGKKVVQLNR

SEQ ID NO: 139988 - protein, 10 aa, West Nile virus
GKKVVQLNRK

SEQ ID NO: 139989 - protein, 10 aa, West Nile virus
KKVVQLNRKS

SEQ ID NO: 139990 - protein, 10 aa, West Nile virus
KVVQLNRKSY

SEQ ID NO: 139991 - protein, 10 aa, West Nile virus
VVQLNRKSYE

SEQ ID NO: 139992 - protein, 10 aa, West Nile virus
VQLNRKSYET

SEQ ID NO: 139993 - protein, 10 aa, West Nile virus
QLNRKSYETE

SEQ ID NO: 139994 - protein, 10 aa, West Nile virus
LNRKSYETEY

SEQ ID NO: 139995 - protein, 10 aa, West Nile virus
NRKSYETEYP

SEQ ID NO: 139996 - protein, 10 aa, West Nile virus
RKSYETEYPK

SEQ ID NO: 139997 - protein, 10 aa, West Nile virus
KSYETEYPKC

SEQ ID NO: 139998 - protein, 10 aa, West Nile virus
SYETEYPKCK

SEQ ID NO: 139999 - protein, 10 aa, West Nile virus
YETEYPKCKN

SEQ ID NO: 140000 - protein, 10 aa, West Nile virus
ETEYPKCKND

SEQ ID NO: 140001 - protein, 10 aa, West Nile virus
TEYPKCKNDD

SEQ ID NO: 140002 - protein, 10 aa, West Nile virus
EYPKCKNDDW

SEQ ID NO: 140003 - protein, 10 aa, West Nile virus
YPKCKNDDWD

SEQ ID NO: 140004 - protein, 10 aa, West Nile virus
PKCKNDDWDF

SEQ ID NO: 140005 - protein, 10 aa, West Nile virus
KCKNDDWDFV

SEQ ID NO: 140006 - protein, 10 aa, West Nile virus
CKNDDWDFVI

SEQ ID NO: 140007 - protein, 10 aa, West Nile virus
KNDDWDFVIT

SEQ ID NO: 140008 - protein, 10 aa, West Nile virus
NDDWDFVITT

SEQ ID NO: 140009 - protein, 10 aa, West Nile virus
DDWDFVITTD

SEQ ID NO: 140010 - protein, 10 aa, West Nile virus
DWDFVITTDI

SEQ ID NO: 140011 - protein, 10 aa, West Nile virus
WDFVITTDIS

SEQ ID NO: 140012 - protein, 10 aa, West Nile virus
DFVITTDISE

SEQ ID NO: 140013 - protein, 10 aa, West Nile virus
FVITTDISEM

SEQ ID NO: 140014 - protein, 10 aa, West Nile virus
VITTDISEMG

SEQ ID NO: 140015 - protein, 10 aa, West Nile virus
ITTDISEMGA

SEQ ID NO: 140016 - protein, 10 aa, West Nile virus
TTDISEMGAN

SEQ ID NO: 140017 - protein, 10 aa, West Nile virus
TDISEMGANF

SEQ ID NO: 140018 - protein, 10 aa, West Nile virus
DISEMGANFK

SEQ ID NO: 140019 - protein, 10 aa, West Nile virus
ISEMGANFKA

SEQ ID NO: 140020 - protein, 10 aa, West Nile virus
SEMGANFKAS

SEQ ID NO: 140021 - protein, 10 aa, West Nile virus
EMGANFKASR

SEQ ID NO: 140022 - protein, 10 aa, West Nile virus
MGANFKASRV

SEQ ID NO: 140023 - protein, 10 aa, West Nile virus
GANFKASRVI

SEQ ID NO: 140024 - protein, 10 aa, West Nile virus
ANFKASRVID

SEQ ID NO: 140025 - protein, 10 aa, West Nile virus
NFKASRVIDS

SEQ ID NO: 140026 - protein, 10 aa, West Nile virus
FKASRVIDSR

SEQ ID NO: 140027 - protein, 10 aa, West Nile virus
KASRVIDSRK

SEQ ID NO: 140028 - protein, 10 aa, West Nile virus
ASRVIDSRKS

SEQ ID NO: 140029 - protein, 10 aa, West Nile virus
SRVIDSRKSV

SEQ ID NO: 140030 - protein, 10 aa, West Nile virus
RVIDSRKSVK

SEQ ID NO: 140031 - protein, 10 aa, West Nile virus
VIDSRKSVKP

SEQ ID NO: 140032 - protein, 10 aa, West Nile virus
IDSRKSVKPT

SEQ ID NO: 140033 - protein, 10 aa, West Nile virus
DSRKSVKPTI

SEQ ID NO: 140034 - protein, 10 aa, West Nile virus
SRKSVKPTII

SEQ ID NO: 140035 - protein, 10 aa, West Nile virus
RKSVKPTIIT

SEQ ID NO: 140036 - protein, 10 aa, West Nile virus
KSVKPTIITE

SEQ ID NO: 140037 - protein, 10 aa, West Nile virus
SVKPTIITEG

SEQ ID NO: 140038 - protein, 10 aa, West Nile virus
VKPTIITEGE

SEQ ID NO: 140039 - protein, 10 aa, West Nile virus
ITEGEGRVIL

SEQ ID NO: 140040 - protein, 10 aa, West Nile virus
TEGEGRVILG

SEQ ID NO: 140041 - protein, 10 aa, West Nile virus
EGEGRVILGE

SEQ ID NO: 140042 - protein, 10 aa, West Nile virus
GEGRVILGEP

SEQ ID NO: 140043 - protein, 10 aa, West Nile virus
EGRVILGEPS

SEQ ID NO: 140044 - protein, 10 aa, West Nile virus
GRVILGEPSA

SEQ ID NO: 140045 - protein, 10 aa, West Nile virus
RVILGEPSAV

SEQ ID NO: 140046 - protein, 10 aa, West Nile virus
VILGEPSAVT

SEQ ID NO: 140047 - protein, 10 aa, West Nile virus
ILGEPSAVTA

SEQ ID NO: 140048 - protein, 10 aa, West Nile virus
LGEPSAVTAA

SEQ ID NO: 140049 - protein, 10 aa, West Nile virus
GEPSAVTAAS

SEQ ID NO: 140050 - protein, 10 aa, West Nile virus
EPSAVTAASA

SEQ ID NO: 140051 - protein, 10 aa, West Nile virus
PSAVTAASAA

SEQ ID NO: 140052 - protein, 10 aa, West Nile virus
SAVTAASAAQ

SEQ ID NO: 140053 - protein, 10 aa, West Nile virus
AVTAASAAQR

SEQ ID NO: 140054 - protein, 10 aa, West Nile virus
VTAASAAQRR

SEQ ID NO: 140055 - protein, 10 aa, West Nile virus
TAASAAQRRG

SEQ ID NO: 140056 - protein, 10 aa, West Nile virus
AASAAQRRGR

SEQ ID NO: 140057 - protein, 10 aa, West Nile virus
ASAAQRRGRI

SEQ ID NO: 140058 - protein, 10 aa, West Nile virus
SAAQRRGRIG

SEQ ID NO: 140059 - protein, 10 aa, West Nile virus
AAQRRGRIGR

SEQ ID NO: 140060 - protein, 10 aa, West Nile virus
AQRRGRIGRN

SEQ ID NO: 140061 - protein, 10 aa, West Nile virus
QRRGRIGRNP

SEQ ID NO: 140062 - protein, 10 aa, West Nile virus
RRGRIGRNPS

SEQ ID NO: 140063 - protein, 10 aa, West Nile virus
RGRIGRNPSQ

SEQ ID NO: 140064 - protein, 10 aa, West Nile virus
GRIGRNPSQV

SEQ ID NO: 140065 - protein, 10 aa, West Nile virus
RIGRNPSQVG

SEQ ID NO: 140066 - protein, 10 aa, West Nile virus
IGRNPSQVGD

SEQ ID NO: 140067 - protein, 10 aa, West Nile virus
GRNPSQVGDE

SEQ ID NO: 140068 - protein, 10 aa, West Nile virus
RNPSQVGDEY

SEQ ID NO: 140069 - protein, 10 aa, West Nile virus
NPSQVGDEYC

SEQ ID NO: 140070 - protein, 10 aa, West Nile virus
PSQVGDEYCY

SEQ ID NO: 140071 - protein, 10 aa, West Nile virus
SQVGDEYCYG

SEQ ID NO: 140072 - protein, 10 aa, West Nile virus
QVGDEYCYGG

SEQ ID NO: 140073 - protein, 10 aa, West Nile virus
VGDEYCYGGH

SEQ ID NO: 140074 - protein, 10 aa, West Nile virus
GDEYCYGGHT

SEQ ID NO: 140075 - protein, 10 aa, West Nile virus
DEYCYGGHTN

SEQ ID NO: 140076 - protein, 10 aa, West Nile virus
EYCYGGHTNE

SEQ ID NO: 140077 - protein, 10 aa, West Nile virus
YCYGGHTNED

SEQ ID NO: 140078 - protein, 10 aa, West Nile virus
CYGGHTNEDD

SEQ ID NO: 140079 - protein, 10 aa, West Nile virus
YGGHTNEDDS

SEQ ID NO: 140080 - protein, 10 aa, West Nile virus
GGHTNEDDSN

SEQ ID NO: 140081 - protein, 10 aa, West Nile virus
GHTNEDDSNF

SEQ ID NO: 140082 - protein, 10 aa, West Nile virus
HTNEDDSNFA

SEQ ID NO: 140083 - protein, 10 aa, West Nile virus
TNEDDSNFAH

SEQ ID NO: 140084 - protein, 10 aa, West Nile virus
NEDDSNFAHW

SEQ ID NO: 140085 - protein, 10 aa, West Nile virus
EDDSNFAHWT

SEQ ID NO: 140086 - protein, 10 aa, West Nile virus
DDSNFAHWTE

SEQ ID NO: 140087 - protein, 10 aa, West Nile virus
DSNFAHWTEA

SEQ ID NO: 140088 - protein, 10 aa, West Nile virus
SNFAHWTEAR

SEQ ID NO: 140089 - protein, 10 aa, West Nile virus
NFAHWTEARI

SEQ ID NO: 140090 - protein, 10 aa, West Nile virus
FAHWTEARIM

SEQ ID NO: 140091 - protein, 10 aa, West Nile virus
AHWTEARIML

SEQ ID NO: 140092 - protein, 10 aa, West Nile virus
HWTEARIMLD

SEQ ID NO: 140093 - protein, 10 aa, West Nile virus
WTEARIMLDN

SEQ ID NO: 140094 - protein, 10 aa, West Nile virus
TEARIMLDNI

SEQ ID NO: 140095 - protein, 10 aa, West Nile virus
EARIMLDNIN

SEQ ID NO: 140096 - protein, 10 aa, West Nile virus
ARIMLDNINM

SEQ ID NO: 140097 - protein, 10 aa, West Nile virus
RIMLDNINMP

SEQ ID NO: 140098 - protein, 10 aa, West Nile virus
IMLDNINMPN

SEQ ID NO: 140099 - protein, 10 aa, West Nile virus
MLDNINMPNG

SEQ ID NO: 140100 - protein, 10 aa, West Nile virus
LDNINMPNGL

SEQ ID NO: 140101 - protein, 10 aa, West Nile virus
DNINMPNGLI

SEQ ID NO: 140102 - protein, 10 aa, West Nile virus
NINMPNGLIA

SEQ ID NO: 140103 - protein, 10 aa, West Nile virus
INMPNGLIAQ

SEQ ID NO: 140104 - protein, 10 aa, West Nile virus
NMPNGLIAQF

SEQ ID NO: 140105 - protein, 10 aa, West Nile virus
MPNGLIAQFY

SEQ ID NO: 140106 - protein, 10 aa, West Nile virus
PNGLIAQFYQ

SEQ ID NO: 140107 - protein, 10 aa, West Nile virus
NGLIAQFYQP

SEQ ID NO: 140108 - protein, 10 aa, West Nile virus
GLIAQFYQPE

SEQ ID NO: 140109 - protein, 10 aa, West Nile virus
LIAQFYQPER

SEQ ID NO: 140110 - protein, 10 aa, West Nile virus
IAQFYQPERE

SEQ ID NO: 140111 - protein, 10 aa, West Nile virus
AQFYQPEREK

SEQ ID NO: 140112 - protein, 10 aa, West Nile virus
QFYQPEREKV

SEQ ID NO: 140113 - protein, 10 aa, West Nile virus
FYQPEREKVY

SEQ ID NO: 140114 - protein, 10 aa, West Nile virus
YQPEREKVYT

SEQ ID NO: 140115 - protein, 10 aa, West Nile virus
QPEREKVYTM

SEQ ID NO: 140116 - protein, 10 aa, West Nile virus
PEREKVYTMD

SEQ ID NO: 140117 - protein, 10 aa, West Nile virus
EREKVYTMDG

SEQ ID NO: 140118 - protein, 10 aa, West Nile virus
REKVYTMDGE

SEQ ID NO: 140119 - protein, 10 aa, West Nile virus
EKVYTMDGEY

SEQ ID NO: 140120 - protein, 10 aa, West Nile virus
KVYTMDGEYR

SEQ ID NO: 140121 - protein, 10 aa, West Nile virus
VYTMDGEYRL

SEQ ID NO: 140122 - protein, 10 aa, West Nile virus
YTMDGEYRLR

SEQ ID NO: 140123 - protein, 10 aa, West Nile virus
TMDGEYRLRG

SEQ ID NO: 140124 - protein, 10 aa, West Nile virus
MDGEYRLRGE

SEQ ID NO: 140125 - protein, 10 aa, West Nile virus
DGEYRLRGEE

SEQ ID NO: 140126 - protein, 10 aa, West Nile virus
GEYRLRGEER

SEQ ID NO: 140127 - protein, 10 aa, West Nile virus
EYRLRGEERK

SEQ ID NO: 140128 - protein, 10 aa, West Nile virus
YRLRGEERKN

SEQ ID NO: 140129 - protein, 10 aa, West Nile virus
RLRGEERKNF

SEQ ID NO: 140130 - protein, 10 aa, West Nile virus
LRGEERKNFL

SEQ ID NO: 140131 - protein, 10 aa, West Nile virus
RGEERKNFLE

SEQ ID NO: 140132 - protein, 10 aa, West Nile virus
GEERKNFLEL

SEQ ID NO: 140133 - protein, 10 aa, West Nile virus
EERKNFLELL

SEQ ID NO: 140134 - protein, 10 aa, West Nile virus
ERKNFLELLR

SEQ ID NO: 140135 - protein, 10 aa, West Nile virus
RKNFLELLRT

SEQ ID NO: 140136 - protein, 10 aa, West Nile virus
KNFLELLRTA

SEQ ID NO: 140137 - protein, 10 aa, West Nile virus
NFLELLRTAD

SEQ ID NO: 140138 - protein, 10 aa, West Nile virus
FLELLRTADL

SEQ ID NO: 140139 - protein, 10 aa, West Nile virus
LELLRTADLP

SEQ ID NO: 140140 - protein, 10 aa, West Nile virus
ELLRTADLPV

SEQ ID NO: 140141 - protein, 10 aa, West Nile virus
LLRTADLPVW

SEQ ID NO: 140142 - protein, 10 aa, West Nile virus
LRTADLPVWL

SEQ ID NO: 140143 - protein, 10 aa, West Nile virus
RTADLPVWLA

SEQ ID NO: 140144 - protein, 10 aa, West Nile virus
TADLPVWLAY

SEQ ID NO: 140145 - protein, 10 aa, West Nile virus
ADLPVWLAYK

SEQ ID NO: 140146 - protein, 10 aa, West Nile virus
DLPVWLAYKV

SEQ ID NO: 140147 - protein, 10 aa, West Nile virus
LPVWLAYKVA

SEQ ID NO: 140148 - protein, 10 aa, West Nile virus
PVWLAYKVAA

SEQ ID NO: 140149 - protein, 10 aa, West Nile virus
VWLAYKVAAA

SEQ ID NO: 140150 - protein, 10 aa, West Nile virus
WLAYKVAAAG

SEQ ID NO: 140151 - protein, 10 aa, West Nile virus
LAYKVAAAGV

SEQ ID NO: 140152 - protein, 10 aa, West Nile virus
KVAAAGVSYH

SEQ ID NO: 140153 - protein, 10 aa, West Nile virus
VAAAGVSYHD

SEQ ID NO: 140154 - protein, 10 aa, West Nile virus
AAAGVSYHDR

SEQ ID NO: 140155 - protein, 10 aa, West Nile virus
AAGVSYHDRR

SEQ ID NO: 140156 - protein, 10 aa, West Nile virus
AGVSYHDRRW

SEQ ID NO: 140157 - protein, 10 aa, West Nile virus
GVSYHDRRWC

SEQ ID NO: 140158 - protein, 10 aa, West Nile virus
VSYHDRRWCF

SEQ ID NO: 140159 - protein, 10 aa, West Nile virus
SYHDRRWCFD

SEQ ID NO: 140160 - protein, 10 aa, West Nile virus
YHDRRWCFDG

SEQ ID NO: 140161 - protein, 10 aa, West Nile virus
HDRRWCFDGP

SEQ ID NO: 140162 - protein, 10 aa, West Nile virus
DRRWCFDGPR

SEQ ID NO: 140163 - protein, 10 aa, West Nile virus
RRWCFDGPRT

SEQ ID NO: 140164 - protein, 10 aa, West Nile virus
RWCFDGPRTN

SEQ ID NO: 140165 - protein, 10 aa, West Nile virus
WCFDGPRTNT

SEQ ID NO: 140166 - protein, 10 aa, West Nile virus
CFDGPRTNTI

SEQ ID NO: 140167 - protein, 10 aa, West Nile virus
FDGPRTNTIL

SEQ ID NO: 140168 - protein, 10 aa, West Nile virus
DGPRTNTILE

SEQ ID NO: 140169 - protein, 10 aa, West Nile virus
GPRTNTILED

SEQ ID NO: 140170 - protein, 10 aa, West Nile virus
PRTNTILEDN

SEQ ID NO: 140171 - protein, 10 aa, West Nile virus
RTNTILEDNN

SEQ ID NO: 140172 - protein, 10 aa, West Nile virus
TNTILEDNNE

SEQ ID NO: 140173 - protein, 10 aa, West Nile virus
NTILEDNNEV

SEQ ID NO: 140174 - protein, 10 aa, West Nile virus
TILEDNNEVE

SEQ ID NO: 140175 - protein, 10 aa, West Nile virus
ILEDNNEVEV

SEQ ID NO: 140176 - protein, 10 aa, West Nile virus
LEDNNEVEVI

SEQ ID NO: 140177 - protein, 10 aa, West Nile virus
EDNNEVEVIT

SEQ ID NO: 140178 - protein, 10 aa, West Nile virus
DNNEVEVITK

SEQ ID NO: 140179 - protein, 10 aa, West Nile virus
NNEVEVITKL

SEQ ID NO: 140180 - protein, 10 aa, West Nile virus
NEVEVITKLG

SEQ ID NO: 140181 - protein, 10 aa, West Nile virus
EVEVITKLGE

SEQ ID NO: 140182 - protein, 10 aa, West Nile virus
VEVITKLGER

SEQ ID NO: 140183 - protein, 10 aa, West Nile virus
EVITKLGERK

SEQ ID NO: 140184 - protein, 10 aa, West Nile virus
VITKLGERKI

SEQ ID NO: 140185 - protein, 10 aa, West Nile virus
ITKLGERKIL

SEQ ID NO: 140186 - protein, 10 aa, West Nile virus
TKLGERKILR

SEQ ID NO: 140187 - protein, 10 aa, West Nile virus
KLGERKILRP

SEQ ID NO: 140188 - protein, 10 aa, West Nile virus
LGERKILRPR

SEQ ID NO: 140189 - protein, 10 aa, West Nile virus
GERKILRPRW

SEQ ID NO: 140190 - protein, 10 aa, West Nile virus
ERKILRPRWI

SEQ ID NO: 140191 - protein, 10 aa, West Nile virus
RKILRPRWID

SEQ ID NO: 140192 - protein, 10 aa, West Nile virus
KILRPRWIDA

SEQ ID NO: 140193 - protein, 10 aa, West Nile virus
ILRPRWIDAR

SEQ ID NO: 140194 - protein, 10 aa, West Nile virus
LRPRWIDARV

SEQ ID NO: 140195 - protein, 10 aa, West Nile virus
RPRWIDARVY

SEQ ID NO: 140196 - protein, 10 aa, West Nile virus
PRWIDARVYS

SEQ ID NO: 140197 - protein, 10 aa, West Nile virus
RWIDARVYSD

SEQ ID NO: 140198 - protein, 10 aa, West Nile virus
WIDARVYSDH

SEQ ID NO: 140199 - protein, 10 aa, West Nile virus
IDARVYSDHQ

SEQ ID NO: 140200 - protein, 10 aa, West Nile virus
DARVYSDHQA

SEQ ID NO: 140201 - protein, 10 aa, West Nile virus
ARVYSDHQAL

SEQ ID NO: 140202 - protein, 10 aa, West Nile virus
RVYSDHQALK

SEQ ID NO: 140203 - protein, 10 aa, West Nile virus
VYSDHQALKA

SEQ ID NO: 140204 - protein, 10 aa, West Nile virus
YSDHQALKAF

SEQ ID NO: 140205 - protein, 10 aa, West Nile virus
SDHQALKAFK

SEQ ID NO: 140206 - protein, 10 aa, West Nile virus
DHQALKAFKD

SEQ ID NO: 140207 - protein, 10 aa, West Nile virus
HQALKAFKDF

SEQ ID NO: 140208 - protein, 10 aa, West Nile virus
QALKAFKDFA

SEQ ID NO: 140209 - protein, 10 aa, West Nile virus
ALKAFKDFAS

SEQ ID NO: 140210 - protein, 10 aa, West Nile virus
LKAFKDFASG

SEQ ID NO: 140211 - protein, 10 aa, West Nile virus
KAFKDFASGK

SEQ ID NO: 140212 - protein, 10 aa, West Nile virus
AFKDFASGKR

SEQ ID NO: 140213 - protein, 10 aa, West Nile virus
FKDFASGKRS

SEQ ID NO: 140214 - protein, 10 aa, West Nile virus
KDFASGKRSQ

SEQ ID NO: 140215 - protein, 10 aa, West Nile virus
DFASGKRSQI

SEQ ID NO: 140216 - protein, 10 aa, West Nile virus
FASGKRSQIG

SEQ ID NO: 140217 - protein, 10 aa, West Nile virus
ASGKRSQIGL

SEQ ID NO: 140218 - protein, 10 aa, West Nile virus
GKRSQIGLIE

SEQ ID NO: 140219 - protein, 10 aa, West Nile virus
KRSQIGLIEV

SEQ ID NO: 140220 - protein, 10 aa, West Nile virus
RSQIGLIEVL

SEQ ID NO: 140221 - protein, 10 aa, West Nile virus
SQIGLIEVLG

SEQ ID NO: 140222 - protein, 10 aa, West Nile virus
QIGLIEVLGK

SEQ ID NO: 140223 - protein, 10 aa, West Nile virus
IGLIEVLGKM

SEQ ID NO: 140224 - protein, 10 aa, West Nile virus
GLIEVLGKMP

SEQ ID NO: 140225 - protein, 10 aa, West Nile virus
LIEVLGKMPE

SEQ ID NO: 140226 - protein, 10 aa, West Nile virus
IEVLGKMPEH

SEQ ID NO: 140227 - protein, 10 aa, West Nile virus
EVLGKMPEHF

SEQ ID NO: 140228 - protein, 10 aa, West Nile virus
VLGKMPEHFM

SEQ ID NO: 140229 - protein, 10 aa, West Nile virus
LGKMPEHFMG

SEQ ID NO: 140230 - protein, 10 aa, West Nile virus
GKMPEHFMGK

SEQ ID NO: 140231 - protein, 10 aa, West Nile virus
KMPEHFMGKT

SEQ ID NO: 140232 - protein, 10 aa, West Nile virus
MPEHFMGKTW

SEQ ID NO: 140233 - protein, 10 aa, West Nile virus
PEHFMGKTWE

SEQ ID NO: 140234 - protein, 10 aa, West Nile virus
EHFMGKTWEA

SEQ ID NO: 140235 - protein, 10 aa, West Nile virus
HFMGKTWEAL

SEQ ID NO: 140236 - protein, 10 aa, West Nile virus
FMGKTWEALD

SEQ ID NO: 140237 - protein, 10 aa, West Nile virus
MGKTWEALDT

SEQ ID NO: 140238 - protein, 10 aa, West Nile virus
GKTWEALDTM

SEQ ID NO: 140239 - protein, 10 aa, West Nile virus
KTWEALDTMY

SEQ ID NO: 140240 - protein, 10 aa, West Nile virus
TWEALDTMYV

SEQ ID NO: 140241 - protein, 10 aa, West Nile virus
WEALDTMYVV

SEQ ID NO: 140242 - protein, 10 aa, West Nile virus
EALDTMYVVA

SEQ ID NO: 140243 - protein, 10 aa, West Nile virus
ALDTMYVVAT

SEQ ID NO: 140244 - protein, 10 aa, West Nile virus
LDTMYVVATA

SEQ ID NO: 140245 - protein, 10 aa, West Nile virus
DTMYVVATAE

SEQ ID NO: 140246 - protein, 10 aa, West Nile virus
TMYVVATAEK

SEQ ID NO: 140247 - protein, 10 aa, West Nile virus
MYVVATAEKG

SEQ ID NO: 140248 - protein, 10 aa, West Nile virus
YVVATAEKGG

SEQ ID NO: 140249 - protein, 10 aa, West Nile virus
VVATAEKGGR

SEQ ID NO: 140250 - protein, 10 aa, West Nile virus
VATAEKGGRA

SEQ ID NO: 140251 - protein, 10 aa, West Nile virus
ATAEKGGRAH

SEQ ID NO: 140252 - protein, 10 aa, West Nile virus
TAEKGGRAHR

SEQ ID NO: 140253 - protein, 10 aa, West Nile virus
AEKGGRAHRM

SEQ ID NO: 140254 - protein, 10 aa, West Nile virus
EKGGRAHRMA

SEQ ID NO: 140255 - protein, 10 aa, West Nile virus
KGGRAHRMAL

SEQ ID NO: 140256 - protein, 10 aa, West Nile virus
GGRAHRMALE

SEQ ID NO: 140257 - protein, 10 aa, West Nile virus
GRAHRMALEE

SEQ ID NO: 140258 - protein, 10 aa, West Nile virus
RAHRMALEEL

SEQ ID NO: 140259 - protein, 10 aa, West Nile virus
AHRMALEELP

SEQ ID NO: 140260 - protein, 10 aa, West Nile virus
HRMALEELPD

SEQ ID NO: 140261 - protein, 10 aa, West Nile virus
RMALEELPDA

SEQ ID NO: 140262 - protein, 10 aa, West Nile virus
MALEELPDAL

SEQ ID NO: 140263 - protein, 10 aa, West Nile virus
ALEELPDALQ

SEQ ID NO: 140264 - protein, 10 aa, West Nile virus
LEELPDALQT

SEQ ID NO: 140265 - protein, 10 aa, West Nile virus
EELPDALQTI

SEQ ID NO: 140266 - protein, 10 aa, West Nile virus
ELPDALQTIA

SEQ ID NO: 140267 - protein, 10 aa, West Nile virus
LPDALQTIAL

SEQ ID NO: 140268 - protein, 10 aa, West Nile virus
PDALQTIALI

SEQ ID NO: 140269 - protein, 10 aa, West Nile virus
DALQTIALIA

SEQ ID NO: 140270 - protein, 10 aa, West Nile virus
ALQTIALIAL

SEQ ID NO: 140271 - protein, 10 aa, West Nile virus
LQTIALIALL

SEQ ID NO: 140272 - protein, 10 aa, West Nile virus
QTIALIALLS

SEQ ID NO: 140273 - protein, 10 aa, West Nile virus
TIALIALLSV

SEQ ID NO: 140274 - protein, 10 aa, West Nile virus
IALIALLSVM

SEQ ID NO: 140275 - protein, 10 aa, West Nile virus
LLSVMTMGVF

SEQ ID NO: 140276 - protein, 10 aa, West Nile virus
VMTMGVFFLL

SEQ ID NO: 140277 - protein, 10 aa, West Nile virus
MTMGVFFLLM

SEQ ID NO: 140278 - protein, 10 aa, West Nile virus
TMGVFFLLMQ

SEQ ID NO: 140279 - protein, 10 aa, West Nile virus
MGVFFLLMQR

SEQ ID NO: 140280 - protein, 10 aa, West Nile virus
GVFFLLMQRK

SEQ ID NO: 140281 - protein, 10 aa, West Nile virus
VFFLLMQRKG

SEQ ID NO: 140282 - protein, 10 aa, West Nile virus
FFLLMQRKGI

SEQ ID NO: 140283 - protein, 10 aa, West Nile virus
FLLMQRKGIG

SEQ ID NO: 140284 - protein, 10 aa, West Nile virus
LLMQRKGIGK

SEQ ID NO: 140285 - protein, 10 aa, West Nile virus
LMQRKGIGKI

SEQ ID NO: 140286 - protein, 10 aa, West Nile virus
MQRKGIGKIG

SEQ ID NO: 140287 - protein, 10 aa, West Nile virus
QRKGIGKIGL

SEQ ID NO: 140288 - protein, 10 aa, West Nile virus
RKGIGKIGLG

SEQ ID NO: 140289 - protein, 10 aa, West Nile virus
KGIGKIGLGG

SEQ ID NO: 140290 - protein, 10 aa, West Nile virus
GIGKIGLGGA

SEQ ID NO: 140291 - protein, 10 aa, West Nile virus
LGVATFFCWM

SEQ ID NO: 140292 - protein, 10 aa, West Nile virus
GVATFFCWMA

SEQ ID NO: 140293 - protein, 10 aa, West Nile virus
VATFFCWMAE

SEQ ID NO: 140294 - protein, 10 aa, West Nile virus
ATFFCWMAEV

SEQ ID NO: 140295 - protein, 10 aa, West Nile virus
TFFCWMAEVP

SEQ ID NO: 140296 - protein, 10 aa, West Nile virus
FFCWMAEVPG

SEQ ID NO: 140297 - protein, 10 aa, West Nile virus
FCWMAEVPGT

SEQ ID NO: 140298 - protein, 10 aa, West Nile virus
CWMAEVPGTK

SEQ ID NO: 140299 - protein, 10 aa, West Nile virus
WMAEVPGTKI

SEQ ID NO: 140300 - protein, 10 aa, West Nile virus
MAEVPGTKIA

SEQ ID NO: 140301 - protein, 10 aa, West Nile virus
AEVPGTKIAG

SEQ ID NO: 140302 - protein, 10 aa, West Nile virus
EVPGTKIAGM

SEQ ID NO: 140303 - protein, 10 aa, West Nile virus
VPGTKIAGML

SEQ ID NO: 140304 - protein, 10 aa, West Nile virus
PGTKIAGMLL

SEQ ID NO: 140305 - protein, 10 aa, West Nile virus
GTKIAGMLLL

SEQ ID NO: 140306 - protein, 10 aa, West Nile virus
TKIAGMLLLS

SEQ ID NO: 140307 - protein, 10 aa, West Nile virus
KIAGMLLLSL

SEQ ID NO: 140308 - protein, 10 aa, West Nile virus
IAGMLLLSLL

SEQ ID NO: 140309 - protein, 10 aa, West Nile virus
AGMLLLSLLL

SEQ ID NO: 140310 - protein, 10 aa, West Nile virus
GMLLLSLLLM

SEQ ID NO: 140311 - protein, 10 aa, West Nile virus
MLLLSLLLMI

SEQ ID NO: 140312 - protein, 10 aa, West Nile virus
LLLSLLLMIV

SEQ ID NO: 140313 - protein, 10 aa, West Nile virus
LLSLLLMIVL

SEQ ID NO: 140314 - protein, 10 aa, West Nile virus
LSLLLMIVLI

SEQ ID NO: 140315 - protein, 10 aa, West Nile virus
SLLLMIVLIP

SEQ ID NO: 140316 - protein, 10 aa, West Nile virus
LLLMIVLIPE

SEQ ID NO: 140317 - protein, 10 aa, West Nile virus
LLMIVLIPEP

SEQ ID NO: 140318 - protein, 10 aa, West Nile virus
LMIVLIPEPE

SEQ ID NO: 140319 - protein, 10 aa, West Nile virus
MIVLIPEPEK

SEQ ID NO: 140320 - protein, 10 aa, West Nile virus
IVLIPEPEKQ

SEQ ID NO: 140321 - protein, 10 aa, West Nile virus
VLIPEPEKQR

SEQ ID NO: 140322 - protein, 10 aa, West Nile virus
LIPEPEKQRS

SEQ ID NO: 140323 - protein, 10 aa, West Nile virus
IPEPEKQRSQ

SEQ ID NO: 140324 - protein, 10 aa, West Nile virus
PEPEKQRSQT

SEQ ID NO: 140325 - protein, 10 aa, West Nile virus
EPEKQRSQTD

SEQ ID NO: 140326 - protein, 10 aa, West Nile virus
PEKQRSQTDN

SEQ ID NO: 140327 - protein, 10 aa, West Nile virus
EKQRSQTDNQ

SEQ ID NO: 140328 - protein, 10 aa, West Nile virus
KQRSQTDNQL

SEQ ID NO: 140329 - protein, 10 aa, West Nile virus
QRSQTDNQLA

SEQ ID NO: 140330 - protein, 10 aa, West Nile virus
RSQTDNQLAV

SEQ ID NO: 140331 - protein, 10 aa, West Nile virus
SQTDNQLAVF

SEQ ID NO: 140332 - protein, 10 aa, West Nile virus
QTDNQLAVFL

SEQ ID NO: 140333 - protein, 10 aa, West Nile virus
TDNQLAVFLI

SEQ ID NO: 140334 - protein, 10 aa, West Nile virus
DNQLAVFLIC

SEQ ID NO: 140335 - protein, 10 aa, West Nile virus
NQLAVFLICV

SEQ ID NO: 140336 - protein, 10 aa, West Nile virus
QLAVFLICVM

SEQ ID NO: 140337 - protein, 10 aa, West Nile virus
LAVFLICVMT

SEQ ID NO: 140338 - protein, 10 aa, West Nile virus
AVFLICVMTL

SEQ ID NO: 140339 - protein, 10 aa, West Nile virus
VFLICVMTLV

SEQ ID NO: 140340 - protein, 10 aa, West Nile virus
TLVSAVAANE

SEQ ID NO: 140341 - protein, 10 aa, West Nile virus
LVSAVAANEM

SEQ ID NO: 140342 - protein, 10 aa, West Nile virus
VSAVAANEMG

SEQ ID NO: 140343 - protein, 10 aa, West Nile virus
SAVAANEMGW

SEQ ID NO: 140344 - protein, 10 aa, West Nile virus
AVAANEMGWL

SEQ ID NO: 140345 - protein, 10 aa, West Nile virus
VAANEMGWLD

SEQ ID NO: 140346 - protein, 10 aa, West Nile virus
AANEMGWLDK

SEQ ID NO: 140347 - protein, 10 aa, West Nile virus
ANEMGWLDKT

SEQ ID NO: 140348 - protein, 10 aa, West Nile virus
NEMGWLDKTK

SEQ ID NO: 140349 - protein, 10 aa, West Nile virus
EMGWLDKTKS

SEQ ID NO: 140350 - protein, 10 aa, West Nile virus
MGWLDKTKSD

SEQ ID NO: 140351 - protein, 10 aa, West Nile virus
GWLDKTKSDI

SEQ ID NO: 140352 - protein, 10 aa, West Nile virus
GEFLLDLRPA

SEQ ID NO: 140353 - protein, 10 aa, West Nile virus
EFLLDLRPAT

SEQ ID NO: 140354 - protein, 10 aa, West Nile virus
FLLDLRPATA

SEQ ID NO: 140355 - protein, 10 aa, West Nile virus
LLDLRPATAW

SEQ ID NO: 140356 - protein, 10 aa, West Nile virus
LDLRPATAWS

SEQ ID NO: 140357 - protein, 10 aa, West Nile virus
DLRPATAWSL

SEQ ID NO: 140358 - protein, 10 aa, West Nile virus
LRPATAWSLY

SEQ ID NO: 140359 - protein, 10 aa, West Nile virus
RPATAWSLYA

SEQ ID NO: 140360 - protein, 10 aa, West Nile virus
PATAWSLYAV

SEQ ID NO: 140361 - protein, 10 aa, West Nile virus
ATAWSLYAVT

SEQ ID NO: 140362 - protein, 10 aa, West Nile virus
TAWSLYAVTT

SEQ ID NO: 140363 - protein, 10 aa, West Nile virus
AWSLYAVTTA

SEQ ID NO: 140364 - protein, 10 aa, West Nile virus
WSLYAVTTAV

SEQ ID NO: 140365 - protein, 10 aa, West Nile virus
SLYAVTTAVL

SEQ ID NO: 140366 - protein, 10 aa, West Nile virus
LYAVTTAVLT

SEQ ID NO: 140367 - protein, 10 aa, West Nile virus
YAVTTAVLTP

SEQ ID NO: 140368 - protein, 10 aa, West Nile virus
AVTTAVLTPL

SEQ ID NO: 140369 - protein, 10 aa, West Nile virus
VTTAVLTPLL

SEQ ID NO: 140370 - protein, 10 aa, West Nile virus
TTAVLTPLLK

SEQ ID NO: 140371 - protein, 10 aa, West Nile virus
TAVLTPLLKH

SEQ ID NO: 140372 - protein, 10 aa, West Nile virus
AVLTPLLKHL

SEQ ID NO: 140373 - protein, 10 aa, West Nile virus
VLTPLLKHLI

SEQ ID NO: 140374 - protein, 10 aa, West Nile virus
LTPLLKHLIT

SEQ ID NO: 140375 - protein, 10 aa, West Nile virus
TPLLKHLITS

SEQ ID NO: 140376 - protein, 10 aa, West Nile virus
PLLKHLITSD

SEQ ID NO: 140377 - protein, 10 aa, West Nile virus
LLKHLITSDY

SEQ ID NO: 140378 - protein, 10 aa, West Nile virus
LKHLITSDYI

SEQ ID NO: 140379 - protein, 10 aa, West Nile virus
KHLITSDYIN

SEQ ID NO: 140380 - protein, 10 aa, West Nile virus
HLITSDYINT

SEQ ID NO: 140381 - protein, 10 aa, West Nile virus
LITSDYINTS

SEQ ID NO: 140382 - protein, 10 aa, West Nile virus
ITSDYINTSL

SEQ ID NO: 140383 - protein, 10 aa, West Nile virus
TSDYINTSLT

SEQ ID NO: 140384 - protein, 10 aa, West Nile virus
SDYINTSLTS

SEQ ID NO: 140385 - protein, 10 aa, West Nile virus
DYINTSLTSI

SEQ ID NO: 140386 - protein, 10 aa, West Nile virus
YINTSLTSIN

SEQ ID NO: 140387 - protein, 10 aa, West Nile virus
INTSLTSINV

SEQ ID NO: 140388 - protein, 10 aa, West Nile virus
NTSLTSINVQ

SEQ ID NO: 140389 - protein, 10 aa, West Nile virus
TSLTSINVQA

SEQ ID NO: 140390 - protein, 10 aa, West Nile virus
SLTSINVQAS

SEQ ID NO: 140391 - protein, 10 aa, West Nile virus
LTSINVQASA

SEQ ID NO: 140392 - protein, 10 aa, West Nile virus
TSINVQASAL

SEQ ID NO: 140393 - protein, 10 aa, West Nile virus
SINVQASALF

SEQ ID NO: 140394 - protein, 10 aa, West Nile virus
INVQASALFT

SEQ ID NO: 140395 - protein, 10 aa, West Nile virus
NVQASALFTL

SEQ ID NO: 140396 - protein, 10 aa, West Nile virus
VQASALFTLA

SEQ ID NO: 140397 - protein, 10 aa, West Nile virus
QASALFTLAR

SEQ ID NO: 140398 - protein, 10 aa, West Nile virus
ASALFTLARG

SEQ ID NO: 140399 - protein, 10 aa, West Nile virus
SALFTLARGF

SEQ ID NO: 140400 - protein, 10 aa, West Nile virus
ALFTLARGFP

SEQ ID NO: 140401 - protein, 10 aa, West Nile virus
LFTLARGFPF

SEQ ID NO: 140402 - protein, 10 aa, West Nile virus
FTLARGFPFV

SEQ ID NO: 140403 - protein, 10 aa, West Nile virus
TLARGFPFVD

SEQ ID NO: 140404 - protein, 10 aa, West Nile virus
LARGFPFVDV

SEQ ID NO: 140405 - protein, 10 aa, West Nile virus
ARGFPFVDVG

SEQ ID NO: 140406 - protein, 10 aa, West Nile virus
RGFPFVDVGV

SEQ ID NO: 140407 - protein, 10 aa, West Nile virus
GFPFVDVGVS

SEQ ID NO: 140408 - protein, 10 aa, West Nile virus
FPFVDVGVSA

SEQ ID NO: 140409 - protein, 10 aa, West Nile virus
PFVDVGVSAL

SEQ ID NO: 140410 - protein, 10 aa, West Nile virus
FVDVGVSALL

SEQ ID NO: 140411 - protein, 10 aa, West Nile virus
VDVGVSALLL

SEQ ID NO: 140412 - protein, 10 aa, West Nile virus
DVGVSALLLA

SEQ ID NO: 140413 - protein, 10 aa, West Nile virus
VGVSALLLAA

SEQ ID NO: 140414 - protein, 10 aa, West Nile virus
GVSALLLAAG

SEQ ID NO: 140415 - protein, 10 aa, West Nile virus
VSALLLAAGC

SEQ ID NO: 140416 - protein, 10 aa, West Nile virus
SALLLAAGCW

SEQ ID NO: 140417 - protein, 10 aa, West Nile virus
ALLLAAGCWG

SEQ ID NO: 140418 - protein, 10 aa, West Nile virus
LLLAAGCWGQ

SEQ ID NO: 140419 - protein, 10 aa, West Nile virus
LLAAGCWGQV

SEQ ID NO: 140420 - protein, 10 aa, West Nile virus
LAAGCWGQVT

SEQ ID NO: 140421 - protein, 10 aa, West Nile virus
AAGCWGQVTL

SEQ ID NO: 140422 - protein, 10 aa, West Nile virus
AGCWGQVTLT

SEQ ID NO: 140423 - protein, 10 aa, West Nile virus
GCWGQVTLTV

SEQ ID NO: 140424 - protein, 10 aa, West Nile virus
CWGQVTLTVT

SEQ ID NO: 140425 - protein, 10 aa, West Nile virus
WGQVTLTVTV

SEQ ID NO: 140426 - protein, 10 aa, West Nile virus
GQVTLTVTVT

SEQ ID NO: 140427 - protein, 10 aa, West Nile virus
QVTLTVTVTA

SEQ ID NO: 140428 - protein, 10 aa, West Nile virus
VTLTVTVTAA

SEQ ID NO: 140429 - protein, 10 aa, West Nile virus
TLLFCHYAYM

SEQ ID NO: 140430 - protein, 10 aa, West Nile virus
LLFCHYAYMV

SEQ ID NO: 140431 - protein, 10 aa, West Nile virus
LFCHYAYMVP

SEQ ID NO: 140432 - protein, 10 aa, West Nile virus
FCHYAYMVPG

SEQ ID NO: 140433 - protein, 10 aa, West Nile virus
CHYAYMVPGW

SEQ ID NO: 140434 - protein, 10 aa, West Nile virus
HYAYMVPGWQ

SEQ ID NO: 140435 - protein, 10 aa, West Nile virus
YAYMVPGWQA

SEQ ID NO: 140436 - protein, 10 aa, West Nile virus
AYMVPGWQAE

SEQ ID NO: 140437 - protein, 10 aa, West Nile virus
YMVPGWQAEA

SEQ ID NO: 140438 - protein, 10 aa, West Nile virus
MVPGWQAEAM

SEQ ID NO: 140439 - protein, 10 aa, West Nile virus
VPGWQAEAMR

SEQ ID NO: 140440 - protein, 10 aa, West Nile virus
PGWQAEAMRS

SEQ ID NO: 140441 - protein, 10 aa, West Nile virus
GWQAEAMRSA

SEQ ID NO: 140442 - protein, 10 aa, West Nile virus
WQAEAMRSAQ

SEQ ID NO: 140443 - protein, 10 aa, West Nile virus
QAEAMRSAQR

SEQ ID NO: 140444 - protein, 10 aa, West Nile virus
AEAMRSAQRR

SEQ ID NO: 140445 - protein, 10 aa, West Nile virus
EAMRSAQRRT

SEQ ID NO: 140446 - protein, 10 aa, West Nile virus
AMRSAQRRTA

SEQ ID NO: 140447 - protein, 10 aa, West Nile virus
MRSAQRRTAA

SEQ ID NO: 140448 - protein, 10 aa, West Nile virus
RSAQRRTAAG

SEQ ID NO: 140449 - protein, 10 aa, West Nile virus
SAQRRTAAGI

SEQ ID NO: 140450 - protein, 10 aa, West Nile virus
AQRRTAAGIM

SEQ ID NO: 140451 - protein, 10 aa, West Nile virus
QRRTAAGIMK

SEQ ID NO: 140452 - protein, 10 aa, West Nile virus
RRTAAGIMKN

SEQ ID NO: 140453 - protein, 10 aa, West Nile virus
RTAAGIMKNA

SEQ ID NO: 140454 - protein, 10 aa, West Nile virus
TAAGIMKNAV

SEQ ID NO: 140455 - protein, 10 aa, West Nile virus
AAGIMKNAVV

SEQ ID NO: 140456 - protein, 10 aa, West Nile virus
AGIMKNAVVD

SEQ ID NO: 140457 - protein, 10 aa, West Nile virus
GIMKNAVVDG

SEQ ID NO: 140458 - protein, 10 aa, West Nile virus
IMKNAVVDGI

SEQ ID NO: 140459 - protein, 10 aa, West Nile virus
MKNAVVDGIV

SEQ ID NO: 140460 - protein, 10 aa, West Nile virus
KNAVVDGIVA

SEQ ID NO: 140461 - protein, 10 aa, West Nile virus
NAVVDGIVAT

SEQ ID NO: 140462 - protein, 10 aa, West Nile virus
AVVDGIVATD

SEQ ID NO: 140463 - protein, 10 aa, West Nile virus
VVDGIVATDV

SEQ ID NO: 140464 - protein, 10 aa, West Nile virus
VDGIVATDVP

SEQ ID NO: 140465 - protein, 10 aa, West Nile virus
DGIVATDVPE

SEQ ID NO: 140466 - protein, 10 aa, West Nile virus
GIVATDVPEL

SEQ ID NO: 140467 - protein, 10 aa, West Nile virus
IVATDVPELE

SEQ ID NO: 140468 - protein, 10 aa, West Nile virus
VATDVPELER

SEQ ID NO: 140469 - protein, 10 aa, West Nile virus
ATDVPELERT

SEQ ID NO: 140470 - protein, 10 aa, West Nile virus
TDVPELERTT

SEQ ID NO: 140471 - protein, 10 aa, West Nile virus
DVPELERTTP

SEQ ID NO: 140472 - protein, 10 aa, West Nile virus
VPELERTTPI

SEQ ID NO: 140473 - protein, 10 aa, West Nile virus
PELERTTPIM

SEQ ID NO: 140474 - protein, 10 aa, West Nile virus
ELERTTPIMQ

SEQ ID NO: 140475 - protein, 10 aa, West Nile virus
LERTTPIMQK

SEQ ID NO: 140476 - protein, 10 aa, West Nile virus
ERTTPIMQKK

SEQ ID NO: 140477 - protein, 10 aa, West Nile virus
RTTPIMQKKV

SEQ ID NO: 140478 - protein, 10 aa, West Nile virus
TTPIMQKKVG

SEQ ID NO: 140479 - protein, 10 aa, West Nile virus
TPIMQKKVGQ

SEQ ID NO: 140480 - protein, 10 aa, West Nile virus
PIMQKKVGQI

SEQ ID NO: 140481 - protein, 10 aa, West Nile virus
IMQKKVGQIM

SEQ ID NO: 140482 - protein, 10 aa, West Nile virus
MQKKVGQIML

SEQ ID NO: 140483 - protein, 10 aa, West Nile virus
QKKVGQIMLI

SEQ ID NO: 140484 - protein, 10 aa, West Nile virus
KKVGQIMLIL

SEQ ID NO: 140485 - protein, 10 aa, West Nile virus
KVGQIMLILV

SEQ ID NO: 140486 - protein, 10 aa, West Nile virus
VGQIMLILVS

SEQ ID NO: 140487 - protein, 10 aa, West Nile virus
LILVSLAAVV

SEQ ID NO: 140488 - protein, 10 aa, West Nile virus
ILVSLAAVVV

SEQ ID NO: 140489 - protein, 10 aa, West Nile virus
LVSLAAVVVN

SEQ ID NO: 140490 - protein, 10 aa, West Nile virus
VSLAAVVVNP

SEQ ID NO: 140491 - protein, 10 aa, West Nile virus
SLAAVVVNPS

SEQ ID NO: 140492 - protein, 10 aa, West Nile virus
LAAVVVNPSV

SEQ ID NO: 140493 - protein, 10 aa, West Nile virus
AAVVVNPSVK

SEQ ID NO: 140494 - protein, 10 aa, West Nile virus
AVVVNPSVKT

SEQ ID NO: 140495 - protein, 10 aa, West Nile virus
VVVNPSVKTV

SEQ ID NO: 140496 - protein, 10 aa, West Nile virus
VVNPSVKTVR

SEQ ID NO: 140497 - protein, 10 aa, West Nile virus
VNPSVKTVRE

SEQ ID NO: 140498 - protein, 10 aa, West Nile virus
NPSVKTVREA

SEQ ID NO: 140499 - protein, 10 aa, West Nile virus
PSVKTVREAG

SEQ ID NO: 140500 - protein, 10 aa, West Nile virus
SVKTVREAGI

SEQ ID NO: 140501 - protein, 10 aa, West Nile virus
VKTVREAGIL

SEQ ID NO: 140502 - protein, 10 aa, West Nile virus
TVREAGILIT

SEQ ID NO: 140503 - protein, 10 aa, West Nile virus
VREAGILITA

SEQ ID NO: 140504 - protein, 10 aa, West Nile virus
REAGILITAA

SEQ ID NO: 140505 - protein, 10 aa, West Nile virus
EAGILITAAA

SEQ ID NO: 140506 - protein, 10 aa, West Nile virus
AGILITAAAV

SEQ ID NO: 140507 - protein, 10 aa, West Nile virus
GILITAAAVT

SEQ ID NO: 140508 - protein, 10 aa, West Nile virus
ILITAAAVTL

SEQ ID NO: 140509 - protein, 10 aa, West Nile virus
LITAAAVTLW

SEQ ID NO: 140510 - protein, 10 aa, West Nile virus
ITAAAVTLWE

SEQ ID NO: 140511 - protein, 10 aa, West Nile virus
TAAAVTLWEN

SEQ ID NO: 140512 - protein, 10 aa, West Nile virus
AAAVTLWENG

SEQ ID NO: 140513 - protein, 10 aa, West Nile virus
AAVTLWENGA

SEQ ID NO: 140514 - protein, 10 aa, West Nile virus
AVTLWENGAS

SEQ ID NO: 140515 - protein, 10 aa, West Nile virus
VTLWENGASS

SEQ ID NO: 140516 - protein, 10 aa, West Nile virus
TLWENGASSV

SEQ ID NO: 140517 - protein, 10 aa, West Nile virus
LWENGASSVW

SEQ ID NO: 140518 - protein, 10 aa, West Nile virus
WENGASSVWN

SEQ ID NO: 140519 - protein, 10 aa, West Nile virus
ENGASSVWNA

SEQ ID NO: 140520 - protein, 10 aa, West Nile virus
NGASSVWNAT

SEQ ID NO: 140521 - protein, 10 aa, West Nile virus
GASSVWNATT

SEQ ID NO: 140522 - protein, 10 aa, West Nile virus
ASSVWNATTA

SEQ ID NO: 140523 - protein, 10 aa, West Nile virus
SSVWNATTAI

SEQ ID NO: 140524 - protein, 10 aa, West Nile virus
SVWNATTAIG

SEQ ID NO: 140525 - protein, 10 aa, West Nile virus
VWNATTAIGL

SEQ ID NO: 140526 - protein, 10 aa, West Nile virus
WNATTAIGLC

SEQ ID NO: 140527 - protein, 10 aa, West Nile virus
NATTAIGLCH

SEQ ID NO: 140528 - protein, 10 aa, West Nile virus
ATTAIGLCHI

SEQ ID NO: 140529 - protein, 10 aa, West Nile virus
TTAIGLCHIM

SEQ ID NO: 140530 - protein, 10 aa, West Nile virus
TAIGLCHIMR

SEQ ID NO: 140531 - protein, 10 aa, West Nile virus
AIGLCHIMRG

SEQ ID NO: 140532 - protein, 10 aa, West Nile virus
IGLCHIMRGG

SEQ ID NO: 140533 - protein, 10 aa, West Nile virus
GLCHIMRGGW

SEQ ID NO: 140534 - protein, 10 aa, West Nile virus
LCHIMRGGWL

SEQ ID NO: 140535 - protein, 10 aa, West Nile virus
CHIMRGGWLS

SEQ ID NO: 140536 - protein, 10 aa, West Nile virus
HIMRGGWLSC

SEQ ID NO: 140537 - protein, 10 aa, West Nile virus
IMRGGWLSCL

SEQ ID NO: 140538 - protein, 10 aa, West Nile virus
MRGGWLSCLS

SEQ ID NO: 140539 - protein, 10 aa, West Nile virus
RGGWLSCLSI

SEQ ID NO: 140540 - protein, 10 aa, West Nile virus
GGWLSCLSIT

SEQ ID NO: 140541 - protein, 10 aa, West Nile virus
GWLSCLSITW

SEQ ID NO: 140542 - protein, 10 aa, West Nile virus
WLSCLSITWT

SEQ ID NO: 140543 - protein, 10 aa, West Nile virus
LSCLSITWTL

SEQ ID NO: 140544 - protein, 10 aa, West Nile virus
KNMEKPGLKR

SEQ ID NO: 140545 - protein, 10 aa, West Nile virus
NMEKPGLKRG

SEQ ID NO: 140546 - protein, 10 aa, West Nile virus
MEKPGLKRGG

SEQ ID NO: 140547 - protein, 10 aa, West Nile virus
EKPGLKRGGA

SEQ ID NO: 140548 - protein, 10 aa, West Nile virus
KPGLKRGGAK

SEQ ID NO: 140549 - protein, 10 aa, West Nile virus
PGLKRGGAKG

SEQ ID NO: 140550 - protein, 10 aa, West Nile virus
GLKRGGAKGR

SEQ ID NO: 140551 - protein, 10 aa, West Nile virus
LKRGGAKGRT

SEQ ID NO: 140552 - protein, 10 aa, West Nile virus
KRGGAKGRTL

SEQ ID NO: 140553 - protein, 10 aa, West Nile virus
RGGAKGRTLG

SEQ ID NO: 140554 - protein, 10 aa, West Nile virus
GGAKGRTLGE

SEQ ID NO: 140555 - protein, 10 aa, West Nile virus
GAKGRTLGEV

SEQ ID NO: 140556 - protein, 10 aa, West Nile virus
AKGRTLGEVW

SEQ ID NO: 140557 - protein, 10 aa, West Nile virus
KGRTLGEVWK

SEQ ID NO: 140558 - protein, 10 aa, West Nile virus
GRTLGEVWKE

SEQ ID NO: 140559 - protein, 10 aa, West Nile virus
RTLGEVWKER

SEQ ID NO: 140560 - protein, 10 aa, West Nile virus
TLGEVWKERL

SEQ ID NO: 140561 - protein, 10 aa, West Nile virus
LGEVWKERLN

SEQ ID NO: 140562 - protein, 10 aa, West Nile virus
GEVWKERLNQ

SEQ ID NO: 140563 - protein, 10 aa, West Nile virus
EVWKERLNQM

SEQ ID NO: 140564 - protein, 10 aa, West Nile virus
VWKERLNQMT

SEQ ID NO: 140565 - protein, 10 aa, West Nile virus
MTKEEFTRYR

SEQ ID NO: 140566 - protein, 10 aa, West Nile virus
TKEEFTRYRK

SEQ ID NO: 140567 - protein, 10 aa, West Nile virus
KEEFTRYRKE

SEQ ID NO: 140568 - protein, 10 aa, West Nile virus
EEFTRYRKEA

SEQ ID NO: 140569 - protein, 10 aa, West Nile virus
EFTRYRKEAI

SEQ ID NO: 140570 - protein, 10 aa, West Nile virus
FTRYRKEAII

SEQ ID NO: 140571 - protein, 10 aa, West Nile virus
TRYRKEAIIE

SEQ ID NO: 140572 - protein, 10 aa, West Nile virus
RYRKEAIIEV

SEQ ID NO: 140573 - protein, 10 aa, West Nile virus
YRKEAIIEVD

SEQ ID NO: 140574 - protein, 10 aa, West Nile virus
RKEAIIEVDR

SEQ ID NO: 140575 - protein, 10 aa, West Nile virus
KEAIIEVDRS

SEQ ID NO: 140576 - protein, 10 aa, West Nile virus
EAIIEVDRSA

SEQ ID NO: 140577 - protein, 10 aa, West Nile virus
AIIEVDRSAA

SEQ ID NO: 140578 - protein, 10 aa, West Nile virus
IIEVDRSAAK

SEQ ID NO: 140579 - protein, 10 aa, West Nile virus
ARKEGNVTGG

SEQ ID NO: 140580 - protein, 10 aa, West Nile virus
RKEGNVTGGH

SEQ ID NO: 140581 - protein, 10 aa, West Nile virus
EGNVTGGHPV

SEQ ID NO: 140582 - protein, 10 aa, West Nile virus
GNVTGGHPVS

SEQ ID NO: 140583 - protein, 10 aa, West Nile virus
NVTGGHPVSR

SEQ ID NO: 140584 - protein, 10 aa, West Nile virus
VTGGHPVSRG

SEQ ID NO: 140585 - protein, 10 aa, West Nile virus
TGGHPVSRGT

SEQ ID NO: 140586 - protein, 10 aa, West Nile virus
GGHPVSRGTA

SEQ ID NO: 140587 - protein, 10 aa, West Nile virus
GHPVSRGTAK

SEQ ID NO: 140588 - protein, 10 aa, West Nile virus
HPVSRGTAKL

SEQ ID NO: 140589 - protein, 10 aa, West Nile virus
PVSRGTAKLR

SEQ ID NO: 140590 - protein, 10 aa, West Nile virus
VSRGTAKLRW

SEQ ID NO: 140591 - protein, 10 aa, West Nile virus
SRGTAKLRWL

SEQ ID NO: 140592 - protein, 10 aa, West Nile virus
RGTAKLRWLV

SEQ ID NO: 140593 - protein, 10 aa, West Nile virus
GTAKLRWLVE

SEQ ID NO: 140594 - protein, 10 aa, West Nile virus
TAKLRWLVER

SEQ ID NO: 140595 - protein, 10 aa, West Nile virus
AKLRWLVERR

SEQ ID NO: 140596 - protein, 10 aa, West Nile virus
KLRWLVERRF

SEQ ID NO: 140597 - protein, 10 aa, West Nile virus
LRWLVERRFL

SEQ ID NO: 140598 - protein, 10 aa, West Nile virus
RWLVERRFLE

SEQ ID NO: 140599 - protein, 10 aa, West Nile virus
WLVERRFLEP

SEQ ID NO: 140600 - protein, 10 aa, West Nile virus
LVERRFLEPV

SEQ ID NO: 140601 - protein, 10 aa, West Nile virus
VERRFLEPVG

SEQ ID NO: 140602 - protein, 10 aa, West Nile virus
ERRFLEPVGK

SEQ ID NO: 140603 - protein, 10 aa, West Nile virus
RRFLEPVGKV

SEQ ID NO: 140604 - protein, 10 aa, West Nile virus
RFLEPVGKVI

SEQ ID NO: 140605 - protein, 10 aa, West Nile virus
FLEPVGKVID

SEQ ID NO: 140606 - protein, 10 aa, West Nile virus
LEPVGKVIDL

SEQ ID NO: 140607 - protein, 10 aa, West Nile virus
EPVGKVIDLG

SEQ ID NO: 140608 - protein, 10 aa, West Nile virus
PVGKVIDLGC

SEQ ID NO: 140609 - protein, 10 aa, West Nile virus
VGKVIDLGCG

SEQ ID NO: 140610 - protein, 10 aa, West Nile virus
GKVIDLGCGR

SEQ ID NO: 140611 - protein, 10 aa, West Nile virus
KVIDLGCGRG

SEQ ID NO: 140612 - protein, 10 aa, West Nile virus
VIDLGCGRGG

SEQ ID NO: 140613 - protein, 10 aa, West Nile virus
IDLGCGRGGW

SEQ ID NO: 140614 - protein, 10 aa, West Nile virus
DLGCGRGGWC

SEQ ID NO: 140615 - protein, 10 aa, West Nile virus
LGCGRGGWCY

SEQ ID NO: 140616 - protein, 10 aa, West Nile virus
GCGRGGWCYY

SEQ ID NO: 140617 - protein, 10 aa, West Nile virus
CGRGGWCYYM

SEQ ID NO: 140618 - protein, 10 aa, West Nile virus
GRGGWCYYMA

SEQ ID NO: 140619 - protein, 10 aa, West Nile virus
RGGWCYYMAT

SEQ ID NO: 140620 - protein, 10 aa, West Nile virus
GGWCYYMATQ

SEQ ID NO: 140621 - protein, 10 aa, West Nile virus
GWCYYMATQK

SEQ ID NO: 140622 - protein, 10 aa, West Nile virus
WCYYMATQKR

SEQ ID NO: 140623 - protein, 10 aa, West Nile virus
CYYMATQKRV

SEQ ID NO: 140624 - protein, 10 aa, West Nile virus
YYMATQKRVQ

SEQ ID NO: 140625 - protein, 10 aa, West Nile virus
YMATQKRVQE

SEQ ID NO: 140626 - protein, 10 aa, West Nile virus
MATQKRVQEV

SEQ ID NO: 140627 - protein, 10 aa, West Nile virus
ATQKRVQEVR

SEQ ID NO: 140628 - protein, 10 aa, West Nile virus
TQKRVQEVRG

SEQ ID NO: 140629 - protein, 10 aa, West Nile virus
QKRVQEVRGY

SEQ ID NO: 140630 - protein, 10 aa, West Nile virus
KRVQEVRGYT

SEQ ID NO: 140631 - protein, 10 aa, West Nile virus
RVQEVRGYTK

SEQ ID NO: 140632 - protein, 10 aa, West Nile virus
VQEVRGYTKG

SEQ ID NO: 140633 - protein, 10 aa, West Nile virus
QEVRGYTKGG

SEQ ID NO: 140634 - protein, 10 aa, West Nile virus
EVRGYTKGGP

SEQ ID NO: 140635 - protein, 10 aa, West Nile virus
VRGYTKGGPG

SEQ ID NO: 140636 - protein, 10 aa, West Nile virus
RGYTKGGPGH

SEQ ID NO: 140637 - protein, 10 aa, West Nile virus
GYTKGGPGHE

SEQ ID NO: 140638 - protein, 10 aa, West Nile virus
YTKGGPGHEE

SEQ ID NO: 140639 - protein, 10 aa, West Nile virus
TKGGPGHEEP

SEQ ID NO: 140640 - protein, 10 aa, West Nile virus
KGGPGHEEPQ

SEQ ID NO: 140641 - protein, 10 aa, West Nile virus
GGPGHEEPQL

SEQ ID NO: 140642 - protein, 10 aa, West Nile virus
GPGHEEPQLV

SEQ ID NO: 140643 - protein, 10 aa, West Nile virus
PGHEEPQLVQ

SEQ ID NO: 140644 - protein, 10 aa, West Nile virus
GHEEPQLVQS

SEQ ID NO: 140645 - protein, 10 aa, West Nile virus
HEEPQLVQSY

SEQ ID NO: 140646 - protein, 10 aa, West Nile virus
EEPQLVQSYG

SEQ ID NO: 140647 - protein, 10 aa, West Nile virus
EPQLVQSYGW

SEQ ID NO: 140648 - protein, 10 aa, West Nile virus
PQLVQSYGWN

SEQ ID NO: 140649 - protein, 10 aa, West Nile virus
QLVQSYGWNI

SEQ ID NO: 140650 - protein, 10 aa, West Nile virus
LVQSYGWNIV

SEQ ID NO: 140651 - protein, 10 aa, West Nile virus
VQSYGWNIVT

SEQ ID NO: 140652 - protein, 10 aa, West Nile virus
QSYGWNIVTM

SEQ ID NO: 140653 - protein, 10 aa, West Nile virus
SYGWNIVTMK

SEQ ID NO: 140654 - protein, 10 aa, West Nile virus
YGWNIVTMKS

SEQ ID NO: 140655 - protein, 10 aa, West Nile virus
GWNIVTMKSG

SEQ ID NO: 140656 - protein, 10 aa, West Nile virus
WNIVTMKSGV

SEQ ID NO: 140657 - protein, 10 aa, West Nile virus
NIVTMKSGVD

SEQ ID NO: 140658 - protein, 10 aa, West Nile virus
IVTMKSGVDV

SEQ ID NO: 140659 - protein, 10 aa, West Nile virus
VTMKSGVDVF

SEQ ID NO: 140660 - protein, 10 aa, West Nile virus
TMKSGVDVFY

SEQ ID NO: 140661 - protein, 10 aa, West Nile virus
MKSGVDVFYR

SEQ ID NO: 140662 - protein, 10 aa, West Nile virus
KSGVDVFYRP

SEQ ID NO: 140663 - protein, 10 aa, West Nile virus
SGVDVFYRPS

SEQ ID NO: 140664 - protein, 10 aa, West Nile virus
GVDVFYRPSE

SEQ ID NO: 140665 - protein, 10 aa, West Nile virus
VDVFYRPSEC

SEQ ID NO: 140666 - protein, 10 aa, West Nile virus
DVFYRPSECC

SEQ ID NO: 140667 - protein, 10 aa, West Nile virus
VFYRPSECCD

SEQ ID NO: 140668 - protein, 10 aa, West Nile virus
FYRPSECCDT

SEQ ID NO: 140669 - protein, 10 aa, West Nile virus
YRPSECCDTL

SEQ ID NO: 140670 - protein, 10 aa, West Nile virus
RPSECCDTLL

SEQ ID NO: 140671 - protein, 10 aa, West Nile virus
PSECCDTLLC

SEQ ID NO: 140672 - protein, 10 aa, West Nile virus
SECCDTLLCD

SEQ ID NO: 140673 - protein, 10 aa, West Nile virus
ECCDTLLCDI

SEQ ID NO: 140674 - protein, 10 aa, West Nile virus
CCDTLLCDIG

SEQ ID NO: 140675 - protein, 10 aa, West Nile virus
CDTLLCDIGE

SEQ ID NO: 140676 - protein, 10 aa, West Nile virus
DTLLCDIGES

SEQ ID NO: 140677 - protein, 10 aa, West Nile virus
TLLCDIGESS

SEQ ID NO: 140678 - protein, 10 aa, West Nile virus
LLCDIGESSS

SEQ ID NO: 140679 - protein, 10 aa, West Nile virus
LCDIGESSSS

SEQ ID NO: 140680 - protein, 10 aa, West Nile virus
CDIGESSSSA

SEQ ID NO: 140681 - protein, 10 aa, West Nile virus
DIGESSSSAE

SEQ ID NO: 140682 - protein, 10 aa, West Nile virus
IGESSSSAEV

SEQ ID NO: 140683 - protein, 10 aa, West Nile virus
GESSSSAEVE

SEQ ID NO: 140684 - protein, 10 aa, West Nile virus
ESSSSAEVEE

SEQ ID NO: 140685 - protein, 10 aa, West Nile virus
SSSSAEVEEH

SEQ ID NO: 140686 - protein, 10 aa, West Nile virus
SSSAEVEEHR

SEQ ID NO: 140687 - protein, 10 aa, West Nile virus
SSAEVEEHRT

SEQ ID NO: 140688 - protein, 10 aa, West Nile virus
SAEVEEHRTI

SEQ ID NO: 140689 - protein, 10 aa, West Nile virus
AEVEEHRTIR

SEQ ID NO: 140690 - protein, 10 aa, West Nile virus
EVEEHRTIRV

SEQ ID NO: 140691 - protein, 10 aa, West Nile virus
VEEHRTIRVL

SEQ ID NO: 140692 - protein, 10 aa, West Nile virus
EEHRTIRVLE

SEQ ID NO: 140693 - protein, 10 aa, West Nile virus
EHRTIRVLEM

SEQ ID NO: 140694 - protein, 10 aa, West Nile virus
HRTIRVLEMV

SEQ ID NO: 140695 - protein, 10 aa, West Nile virus
RTIRVLEMVE

SEQ ID NO: 140696 - protein, 10 aa, West Nile virus
TIRVLEMVED

SEQ ID NO: 140697 - protein, 10 aa, West Nile virus
IRVLEMVEDW

SEQ ID NO: 140698 - protein, 10 aa, West Nile virus
RVLEMVEDWL

SEQ ID NO: 140699 - protein, 10 aa, West Nile virus
VLEMVEDWLH

SEQ ID NO: 140700 - protein, 10 aa, West Nile virus
LEMVEDWLHR

SEQ ID NO: 140701 - protein, 10 aa, West Nile virus
EMVEDWLHRG

SEQ ID NO: 140702 - protein, 10 aa, West Nile virus
MVEDWLHRGP

SEQ ID NO: 140703 - protein, 10 aa, West Nile virus
VEDWLHRGPR

SEQ ID NO: 140704 - protein, 10 aa, West Nile virus
EDWLHRGPRE

SEQ ID NO: 140705 - protein, 10 aa, West Nile virus
DWLHRGPREF

SEQ ID NO: 140706 - protein, 10 aa, West Nile virus
WLHRGPREFC

SEQ ID NO: 140707 - protein, 10 aa, West Nile virus
LHRGPREFCV

SEQ ID NO: 140708 - protein, 10 aa, West Nile virus
HRGPREFCVK

SEQ ID NO: 140709 - protein, 10 aa, West Nile virus
RGPREFCVKV

SEQ ID NO: 140710 - protein, 10 aa, West Nile virus
GPREFCVKVL

SEQ ID NO: 140711 - protein, 10 aa, West Nile virus
PREFCVKVLC

SEQ ID NO: 140712 - protein, 10 aa, West Nile virus
REFCVKVLCP

SEQ ID NO: 140713 - protein, 10 aa, West Nile virus
EFCVKVLCPY

SEQ ID NO: 140714 - protein, 10 aa, West Nile virus
FCVKVLCPYM

SEQ ID NO: 140715 - protein, 10 aa, West Nile virus
CVKVLCPYMP

SEQ ID NO: 140716 - protein, 10 aa, West Nile virus
VKVLCPYMPK

SEQ ID NO: 140717 - protein, 10 aa, West Nile virus
KVLCPYMPKV

SEQ ID NO: 140718 - protein, 10 aa, West Nile virus
VLCPYMPKVI

SEQ ID NO: 140719 - protein, 10 aa, West Nile virus
LCPYMPKVIE

SEQ ID NO: 140720 - protein, 10 aa, West Nile virus
CPYMPKVIEK

SEQ ID NO: 140721 - protein, 10 aa, West Nile virus
PYMPKVIEKM

SEQ ID NO: 140722 - protein, 10 aa, West Nile virus
YMPKVIEKME

SEQ ID NO: 140723 - protein, 10 aa, West Nile virus
MPKVIEKMEL

SEQ ID NO: 140724 - protein, 10 aa, West Nile virus
PKVIEKMELL

SEQ ID NO: 140725 - protein, 10 aa, West Nile virus
KVIEKMELLQ

SEQ ID NO: 140726 - protein, 10 aa, West Nile virus
VIEKMELLQR

SEQ ID NO: 140727 - protein, 10 aa, West Nile virus
IEKMELLQRR

SEQ ID NO: 140728 - protein, 10 aa, West Nile virus
EKMELLQRRY

SEQ ID NO: 140729 - protein, 10 aa, West Nile virus
KMELLQRRYG

SEQ ID NO: 140730 - protein, 10 aa, West Nile virus
MELLQRRYGG

SEQ ID NO: 140731 - protein, 10 aa, West Nile virus
ELLQRRYGGG

SEQ ID NO: 140732 - protein, 10 aa, West Nile virus
LLQRRYGGGL

SEQ ID NO: 140733 - protein, 10 aa, West Nile virus
LQRRYGGGLV

SEQ ID NO: 140734 - protein, 10 aa, West Nile virus
QRRYGGGLVR

SEQ ID NO: 140735 - protein, 10 aa, West Nile virus
RRYGGGLVRN

SEQ ID NO: 140736 - protein, 10 aa, West Nile virus
RYGGGLVRNP

SEQ ID NO: 140737 - protein, 10 aa, West Nile virus
YGGGLVRNPL

SEQ ID NO: 140738 - protein, 10 aa, West Nile virus
GGGLVRNPLS

SEQ ID NO: 140739 - protein, 10 aa, West Nile virus
GGLVRNPLSR

SEQ ID NO: 140740 - protein, 10 aa, West Nile virus
GLVRNPLSRN

SEQ ID NO: 140741 - protein, 10 aa, West Nile virus
LVRNPLSRNS

SEQ ID NO: 140742 - protein, 10 aa, West Nile virus
VRNPLSRNST

SEQ ID NO: 140743 - protein, 10 aa, West Nile virus
RNPLSRNSTH

SEQ ID NO: 140744 - protein, 10 aa, West Nile virus
NPLSRNSTHE

SEQ ID NO: 140745 - protein, 10 aa, West Nile virus
PLSRNSTHEM

SEQ ID NO: 140746 - protein, 10 aa, West Nile virus
LSRNSTHEMY

SEQ ID NO: 140747 - protein, 10 aa, West Nile virus
SRNSTHEMYW

SEQ ID NO: 140748 - protein, 10 aa, West Nile virus
RNSTHEMYWV

SEQ ID NO: 140749 - protein, 10 aa, West Nile virus
NSTHEMYWVS

SEQ ID NO: 140750 - protein, 10 aa, West Nile virus
STHEMYWVSR

SEQ ID NO: 140751 - protein, 10 aa, West Nile virus
THEMYWVSRA

SEQ ID NO: 140752 - protein, 10 aa, West Nile virus
HEMYWVSRAS

SEQ ID NO: 140753 - protein, 10 aa, West Nile virus
EMYWVSRASG

SEQ ID NO: 140754 - protein, 10 aa, West Nile virus
MYWVSRASGN

SEQ ID NO: 140755 - protein, 10 aa, West Nile virus
YWVSRASGNV

SEQ ID NO: 140756 - protein, 10 aa, West Nile virus
WVSRASGNVV

SEQ ID NO: 140757 - protein, 10 aa, West Nile virus
VSRASGNVVH

SEQ ID NO: 140758 - protein, 10 aa, West Nile virus
NVVHSVNMTS

SEQ ID NO: 140759 - protein, 10 aa, West Nile virus
VVHSVNMTSQ

SEQ ID NO: 140760 - protein, 10 aa, West Nile virus
VHSVNMTSQV

SEQ ID NO: 140761 - protein, 10 aa, West Nile virus
HSVNMTSQVL

SEQ ID NO: 140762 - protein, 10 aa, West Nile virus
SVNMTSQVLL

SEQ ID NO: 140763 - protein, 10 aa, West Nile virus
VNMTSQVLLG

SEQ ID NO: 140764 - protein, 10 aa, West Nile virus
NMTSQVLLGR

SEQ ID NO: 140765 - protein, 10 aa, West Nile virus
MTSQVLLGRM

SEQ ID NO: 140766 - protein, 10 aa, West Nile virus
TSQVLLGRME

SEQ ID NO: 140767 - protein, 10 aa, West Nile virus
SQVLLGRMEK

SEQ ID NO: 140768 - protein, 10 aa, West Nile virus
QVLLGRMEKR

SEQ ID NO: 140769 - protein, 10 aa, West Nile virus
VLLGRMEKRT

SEQ ID NO: 140770 - protein, 10 aa, West Nile virus
LLGRMEKRTW

SEQ ID NO: 140771 - protein, 10 aa, West Nile virus
LGRMEKRTWK

SEQ ID NO: 140772 - protein, 10 aa, West Nile virus
GRMEKRTWKG

SEQ ID NO: 140773 - protein, 10 aa, West Nile virus
RMEKRTWKGP

SEQ ID NO: 140774 - protein, 10 aa, West Nile virus
MEKRTWKGPQ

SEQ ID NO: 140775 - protein, 10 aa, West Nile virus
EKRTWKGPQY

SEQ ID NO: 140776 - protein, 10 aa, West Nile virus
KRTWKGPQYE

SEQ ID NO: 140777 - protein, 10 aa, West Nile virus
RTWKGPQYEE

SEQ ID NO: 140778 - protein, 10 aa, West Nile virus
TWKGPQYEED

SEQ ID NO: 140779 - protein, 10 aa, West Nile virus
WKGPQYEEDV

SEQ ID NO: 140780 - protein, 10 aa, West Nile virus
KGPQYEEDVN

SEQ ID NO: 140781 - protein, 10 aa, West Nile virus
GPQYEEDVNL

SEQ ID NO: 140782 - protein, 10 aa, West Nile virus
PQYEEDVNLG

SEQ ID NO: 140783 - protein, 10 aa, West Nile virus
QYEEDVNLGS

SEQ ID NO: 140784 - protein, 10 aa, West Nile virus
YEEDVNLGSG

SEQ ID NO: 140785 - protein, 10 aa, West Nile virus
EEDVNLGSGT

SEQ ID NO: 140786 - protein, 10 aa, West Nile virus
EDVNLGSGTR

SEQ ID NO: 140787 - protein, 10 aa, West Nile virus
DVNLGSGTRA

SEQ ID NO: 140788 - protein, 10 aa, West Nile virus
VNLGSGTRAV

SEQ ID NO: 140789 - protein, 10 aa, West Nile virus
NLGSGTRAVG

SEQ ID NO: 140790 - protein, 10 aa, West Nile virus
LGSGTRAVGK

SEQ ID NO: 140791 - protein, 10 aa, West Nile virus
GSGTRAVGKP

SEQ ID NO: 140792 - protein, 10 aa, West Nile virus
SGTRAVGKPL

SEQ ID NO: 140793 - protein, 10 aa, West Nile virus
GTRAVGKPLL

SEQ ID NO: 140794 - protein, 10 aa, West Nile virus
TRAVGKPLLN

SEQ ID NO: 140795 - protein, 10 aa, West Nile virus
RAVGKPLLNS

SEQ ID NO: 140796 - protein, 10 aa, West Nile virus
AVGKPLLNSD

SEQ ID NO: 140797 - protein, 10 aa, West Nile virus
VGKPLLNSDT

SEQ ID NO: 140798 - protein, 10 aa, West Nile virus
GKPLLNSDTS

SEQ ID NO: 140799 - protein, 10 aa, West Nile virus
KPLLNSDTSK

SEQ ID NO: 140800 - protein, 10 aa, West Nile virus
PLLNSDTSKI

SEQ ID NO: 140801 - protein, 10 aa, West Nile virus
LLNSDTSKIK

SEQ ID NO: 140802 - protein, 10 aa, West Nile virus
NRIERLRREY

SEQ ID NO: 140803 - protein, 10 aa, West Nile virus
RIERLRREYS

SEQ ID NO: 140804 - protein, 10 aa, West Nile virus
DENHPYRTWN

SEQ ID NO: 140805 - protein, 10 aa, West Nile virus
ENHPYRTWNY

SEQ ID NO: 140806 - protein, 10 aa, West Nile virus
NHPYRTWNYH

SEQ ID NO: 140807 - protein, 10 aa, West Nile virus
HPYRTWNYHG

SEQ ID NO: 140808 - protein, 10 aa, West Nile virus
PYRTWNYHGS

SEQ ID NO: 140809 - protein, 10 aa, West Nile virus
YRTWNYHGSY

SEQ ID NO: 140810 - protein, 10 aa, West Nile virus
RTWNYHGSYD

SEQ ID NO: 140811 - protein, 10 aa, West Nile virus
TWNYHGSYDV

SEQ ID NO: 140812 - protein, 10 aa, West Nile virus
WNYHGSYDVK

SEQ ID NO: 140813 - protein, 10 aa, West Nile virus
NYHGSYDVKP

SEQ ID NO: 140814 - protein, 10 aa, West Nile virus
YHGSYDVKPT

SEQ ID NO: 140815 - protein, 10 aa, West Nile virus
HGSYDVKPTG

SEQ ID NO: 140816 - protein, 10 aa, West Nile virus
GSYDVKPTGS

SEQ ID NO: 140817 - protein, 10 aa, West Nile virus
SYDVKPTGSA

SEQ ID NO: 140818 - protein, 10 aa, West Nile virus
YDVKPTGSAS

SEQ ID NO: 140819 - protein, 10 aa, West Nile virus
DVKPTGSASS

SEQ ID NO: 140820 - protein, 10 aa, West Nile virus
VKPTGSASSL

SEQ ID NO: 140821 - protein, 10 aa, West Nile virus
KPTGSASSLV

SEQ ID NO: 140822 - protein, 10 aa, West Nile virus
PTGSASSLVN

SEQ ID NO: 140823 - protein, 10 aa, West Nile virus
TGSASSLVNG

SEQ ID NO: 140824 - protein, 10 aa, West Nile virus
GSASSLVNGV

SEQ ID NO: 140825 - protein, 10 aa, West Nile virus
SASSLVNGVV

SEQ ID NO: 140826 - protein, 10 aa, West Nile virus
ASSLVNGVVR

SEQ ID NO: 140827 - protein, 10 aa, West Nile virus
SSLVNGVVRL

SEQ ID NO: 140828 - protein, 10 aa, West Nile virus
SLVNGVVRLL

SEQ ID NO: 140829 - protein, 10 aa, West Nile virus
LVNGVVRLLS

SEQ ID NO: 140830 - protein, 10 aa, West Nile virus
VNGVVRLLSK

SEQ ID NO: 140831 - protein, 10 aa, West Nile virus
NGVVRLLSKP

SEQ ID NO: 140832 - protein, 10 aa, West Nile virus
GVVRLLSKPW

SEQ ID NO: 140833 - protein, 10 aa, West Nile virus
VVRLLSKPWD

SEQ ID NO: 140834 - protein, 10 aa, West Nile virus
VRLLSKPWDT

SEQ ID NO: 140835 - protein, 10 aa, West Nile virus
RLLSKPWDTI

SEQ ID NO: 140836 - protein, 10 aa, West Nile virus
LLSKPWDTIT

SEQ ID NO: 140837 - protein, 10 aa, West Nile virus
LSKPWDTITN

SEQ ID NO: 140838 - protein, 10 aa, West Nile virus
SKPWDTITNV

SEQ ID NO: 140839 - protein, 10 aa, West Nile virus
KPWDTITNVT

SEQ ID NO: 140840 - protein, 10 aa, West Nile virus
PWDTITNVTT

SEQ ID NO: 140841 - protein, 10 aa, West Nile virus
WDTITNVTTM

SEQ ID NO: 140842 - protein, 10 aa, West Nile virus
DTITNVTTMA

SEQ ID NO: 140843 - protein, 10 aa, West Nile virus
TITNVTTMAM

SEQ ID NO: 140844 - protein, 10 aa, West Nile virus
ITNVTTMAMT

SEQ ID NO: 140845 - protein, 10 aa, West Nile virus
TNVTTMAMTD

SEQ ID NO: 140846 - protein, 10 aa, West Nile virus
NVTTMAMTDT

SEQ ID NO: 140847 - protein, 10 aa, West Nile virus
VTTMAMTDTT

SEQ ID NO: 140848 - protein, 10 aa, West Nile virus
TTMAMTDTTP

SEQ ID NO: 140849 - protein, 10 aa, West Nile virus
TMAMTDTTPF

SEQ ID NO: 140850 - protein, 10 aa, West Nile virus
MAMTDTTPFG

SEQ ID NO: 140851 - protein, 10 aa, West Nile virus
AMTDTTPFGQ

SEQ ID NO: 140852 - protein, 10 aa, West Nile virus
MTDTTPFGQQ

SEQ ID NO: 140853 - protein, 10 aa, West Nile virus
TDTTPFGQQR

SEQ ID NO: 140854 - protein, 10 aa, West Nile virus
DTTPFGQQRV

SEQ ID NO: 140855 - protein, 10 aa, West Nile virus
TTPFGQQRVF

SEQ ID NO: 140856 - protein, 10 aa, West Nile virus
TPFGQQRVFK

SEQ ID NO: 140857 - protein, 10 aa, West Nile virus
PFGQQRVFKE

SEQ ID NO: 140858 - protein, 10 aa, West Nile virus
FGQQRVFKEK

SEQ ID NO: 140859 - protein, 10 aa, West Nile virus
GQQRVFKEKV

SEQ ID NO: 140860 - protein, 10 aa, West Nile virus
QQRVFKEKVD

SEQ ID NO: 140861 - protein, 10 aa, West Nile virus
QRVFKEKVDT

SEQ ID NO: 140862 - protein, 10 aa, West Nile virus
RVFKEKVDTK

SEQ ID NO: 140863 - protein, 10 aa, West Nile virus
VFKEKVDTKA

SEQ ID NO: 140864 - protein, 10 aa, West Nile virus
FKEKVDTKAP

SEQ ID NO: 140865 - protein, 10 aa, West Nile virus
KEKVDTKAPE

SEQ ID NO: 140866 - protein, 10 aa, West Nile virus
EKVDTKAPEP

SEQ ID NO: 140867 - protein, 10 aa, West Nile virus
KVDTKAPEPP

SEQ ID NO: 140868 - protein, 10 aa, West Nile virus
VDTKAPEPPE

SEQ ID NO: 140869 - protein, 10 aa, West Nile virus
DTKAPEPPEG

SEQ ID NO: 140870 - protein, 10 aa, West Nile virus
TKAPEPPEGV

SEQ ID NO: 140871 - protein, 10 aa, West Nile virus
KAPEPPEGVK

SEQ ID NO: 140872 - protein, 10 aa, West Nile virus
VLNETTNWLW

SEQ ID NO: 140873 - protein, 10 aa, West Nile virus
LNETTNWLWA

SEQ ID NO: 140874 - protein, 10 aa, West Nile virus
NETTNWLWAF

SEQ ID NO: 140875 - protein, 10 aa, West Nile virus
ETTNWLWAFL

SEQ ID NO: 140876 - protein, 10 aa, West Nile virus
TTNWLWAFLA

SEQ ID NO: 140877 - protein, 10 aa, West Nile virus
TNWLWAFLAR

SEQ ID NO: 140878 - protein, 10 aa, West Nile virus
REKRPRMCSR

SEQ ID NO: 140879 - protein, 10 aa, West Nile virus
EKRPRMCSRE

SEQ ID NO: 140880 - protein, 10 aa, West Nile virus
KRPRMCSREE

SEQ ID NO: 140881 - protein, 10 aa, West Nile virus
RPRMCSREEF

SEQ ID NO: 140882 - protein, 10 aa, West Nile virus
PRMCSREEFI

SEQ ID NO: 140883 - protein, 10 aa, West Nile virus
RMCSREEFIR

SEQ ID NO: 140884 - protein, 10 aa, West Nile virus
MCSREEFIRK

SEQ ID NO: 140885 - protein, 10 aa, West Nile virus
CSREEFIRKV

SEQ ID NO: 140886 - protein, 10 aa, West Nile virus
SREEFIRKVN

SEQ ID NO: 140887 - protein, 10 aa, West Nile virus
REEFIRKVNS

SEQ ID NO: 140888 - protein, 10 aa, West Nile virus
EEFIRKVNSN

SEQ ID NO: 140889 - protein, 10 aa, West Nile virus
EFIRKVNSNA

SEQ ID NO: 140890 - protein, 10 aa, West Nile virus
FIRKVNSNAA

SEQ ID NO: 140891 - protein, 10 aa, West Nile virus
IRKVNSNAAL

SEQ ID NO: 140892 - protein, 10 aa, West Nile virus
RKVNSNAALG

SEQ ID NO: 140893 - protein, 10 aa, West Nile virus
KVNSNAALGA

SEQ ID NO: 140894 - protein, 10 aa, West Nile virus
VNSNAALGAM

SEQ ID NO: 140895 - protein, 10 aa, West Nile virus
NSNAALGAMF

SEQ ID NO: 140896 - protein, 10 aa, West Nile virus
SNAALGAMFE

SEQ ID NO: 140897 - protein, 10 aa, West Nile virus
NAALGAMFEE

SEQ ID NO: 140898 - protein, 10 aa, West Nile virus
AALGAMFEEQ

SEQ ID NO: 140899 - protein, 10 aa, West Nile virus
ALGAMFEEQN

SEQ ID NO: 140900 - protein, 10 aa, West Nile virus
LGAMFEEQNQ

SEQ ID NO: 140901 - protein, 10 aa, West Nile virus
GAMFEEQNQW

SEQ ID NO: 140902 - protein, 10 aa, West Nile virus
AMFEEQNQWR

SEQ ID NO: 140903 - protein, 10 aa, West Nile virus
MFEEQNQWRS

SEQ ID NO: 140904 - protein, 10 aa, West Nile virus
FEEQNQWRSA

SEQ ID NO: 140905 - protein, 10 aa, West Nile virus
EEQNQWRSAR

SEQ ID NO: 140906 - protein, 10 aa, West Nile virus
EQNQWRSARE

SEQ ID NO: 140907 - protein, 10 aa, West Nile virus
QNQWRSAREA

SEQ ID NO: 140908 - protein, 10 aa, West Nile virus
NQWRSAREAV

SEQ ID NO: 140909 - protein, 10 aa, West Nile virus
QWRSAREAVE

SEQ ID NO: 140910 - protein, 10 aa, West Nile virus
WRSAREAVED

SEQ ID NO: 140911 - protein, 10 aa, West Nile virus
SAREAVEDPK

SEQ ID NO: 140912 - protein, 10 aa, West Nile virus
AREAVEDPKF

SEQ ID NO: 140913 - protein, 10 aa, West Nile virus
REAVEDPKFW

SEQ ID NO: 140914 - protein, 10 aa, West Nile virus
EAVEDPKFWE

SEQ ID NO: 140915 - protein, 10 aa, West Nile virus
AVEDPKFWEM

SEQ ID NO: 140916 - protein, 10 aa, West Nile virus
VEDPKFWEMV

SEQ ID NO: 140917 - protein, 10 aa, West Nile virus
EDPKFWEMVD

SEQ ID NO: 140918 - protein, 10 aa, West Nile virus
DPKFWEMVDE

SEQ ID NO: 140919 - protein, 10 aa, West Nile virus
PKFWEMVDEE

SEQ ID NO: 140920 - protein, 10 aa, West Nile virus
KFWEMVDEER

SEQ ID NO: 140921 - protein, 10 aa, West Nile virus
FWEMVDEERE

SEQ ID NO: 140922 - protein, 10 aa, West Nile virus
WEMVDEEREA

SEQ ID NO: 140923 - protein, 10 aa, West Nile virus
EMVDEEREAH

SEQ ID NO: 140924 - protein, 10 aa, West Nile virus
MVDEEREAHL

SEQ ID NO: 140925 - protein, 10 aa, West Nile virus
VDEEREAHLR

SEQ ID NO: 140926 - protein, 10 aa, West Nile virus
DEEREAHLRG

SEQ ID NO: 140927 - protein, 10 aa, West Nile virus
EEREAHLRGE

SEQ ID NO: 140928 - protein, 10 aa, West Nile virus
EREAHLRGEC

SEQ ID NO: 140929 - protein, 10 aa, West Nile virus
REAHLRGECH

SEQ ID NO: 140930 - protein, 10 aa, West Nile virus
EAHLRGECHT

SEQ ID NO: 140931 - protein, 10 aa, West Nile virus
AHLRGECHTC

SEQ ID NO: 140932 - protein, 10 aa, West Nile virus
HLRGECHTCI

SEQ ID NO: 140933 - protein, 10 aa, West Nile virus
LRGECHTCIY

SEQ ID NO: 140934 - protein, 10 aa, West Nile virus
RGECHTCIYN

SEQ ID NO: 140935 - protein, 10 aa, West Nile virus
GECHTCIYNM

SEQ ID NO: 140936 - protein, 10 aa, West Nile virus
ECHTCIYNMM

SEQ ID NO: 140937 - protein, 10 aa, West Nile virus
CHTCIYNMMG

SEQ ID NO: 140938 - protein, 10 aa, West Nile virus
HTCIYNMMGK

SEQ ID NO: 140939 - protein, 10 aa, West Nile virus
TCIYNMMGKR

SEQ ID NO: 140940 - protein, 10 aa, West Nile virus
CIYNMMGKRE

SEQ ID NO: 140941 - protein, 10 aa, West Nile virus
IYNMMGKREK

SEQ ID NO: 140942 - protein, 10 aa, West Nile virus
YNMMGKREKK

SEQ ID NO: 140943 - protein, 10 aa, West Nile virus
NMMGKREKKP

SEQ ID NO: 140944 - protein, 10 aa, West Nile virus
MMGKREKKPG

SEQ ID NO: 140945 - protein, 10 aa, West Nile virus
MGKREKKPGE

SEQ ID NO: 140946 - protein, 10 aa, West Nile virus
GKREKKPGEF

SEQ ID NO: 140947 - protein, 10 aa, West Nile virus
KREKKPGEFG

SEQ ID NO: 140948 - protein, 10 aa, West Nile virus
REKKPGEFGK

SEQ ID NO: 140949 - protein, 10 aa, West Nile virus
EKKPGEFGKA

SEQ ID NO: 140950 - protein, 10 aa, West Nile virus
KKPGEFGKAK

SEQ ID NO: 140951 - protein, 10 aa, West Nile virus
KPGEFGKAKG

SEQ ID NO: 140952 - protein, 10 aa, West Nile virus
PGEFGKAKGS

SEQ ID NO: 140953 - protein, 10 aa, West Nile virus
GEFGKAKGSR

SEQ ID NO: 140954 - protein, 10 aa, West Nile virus
EFGKAKGSRA

SEQ ID NO: 140955 - protein, 10 aa, West Nile virus
FGKAKGSRAI

SEQ ID NO: 140956 - protein, 10 aa, West Nile virus
GKAKGSRAIW

SEQ ID NO: 140957 - protein, 10 aa, West Nile virus
KAKGSRAIWF

SEQ ID NO: 140958 - protein, 10 aa, West Nile virus
AKGSRAIWFM

SEQ ID NO: 140959 - protein, 10 aa, West Nile virus
KGSRAIWFMW

SEQ ID NO: 140960 - protein, 10 aa, West Nile virus
GSRAIWFMWL

SEQ ID NO: 140961 - protein, 10 aa, West Nile virus
SRAIWFMWLG

SEQ ID NO: 140962 - protein, 10 aa, West Nile virus
RAIWFMWLGA

SEQ ID NO: 140963 - protein, 10 aa, West Nile virus
AIWFMWLGAR

SEQ ID NO: 140964 - protein, 10 aa, West Nile virus
IWFMWLGARF

SEQ ID NO: 140965 - protein, 10 aa, West Nile virus
WFMWLGARFL

SEQ ID NO: 140966 - protein, 10 aa, West Nile virus
FMWLGARFLE

SEQ ID NO: 140967 - protein, 10 aa, West Nile virus
MWLGARFLEF

SEQ ID NO: 140968 - protein, 10 aa, West Nile virus
WLGARFLEFE

SEQ ID NO: 140969 - protein, 10 aa, West Nile virus
LGARFLEFEA

SEQ ID NO: 140970 - protein, 10 aa, West Nile virus
GARFLEFEAL

SEQ ID NO: 140971 - protein, 10 aa, West Nile virus
ARFLEFEALG

SEQ ID NO: 140972 - protein, 10 aa, West Nile virus
RFLEFEALGF

SEQ ID NO: 140973 - protein, 10 aa, West Nile virus
FLEFEALGFL

SEQ ID NO: 140974 - protein, 10 aa, West Nile virus
LEFEALGFLN

SEQ ID NO: 140975 - protein, 10 aa, West Nile virus
EFEALGFLNE

SEQ ID NO: 140976 - protein, 10 aa, West Nile virus
FEALGFLNED

SEQ ID NO: 140977 - protein, 10 aa, West Nile virus
EALGFLNEDH

SEQ ID NO: 140978 - protein, 10 aa, West Nile virus
ALGFLNEDHW

SEQ ID NO: 140979 - protein, 10 aa, West Nile virus
LGFLNEDHWL

SEQ ID NO: 140980 - protein, 10 aa, West Nile virus
GFLNEDHWLG

SEQ ID NO: 140981 - protein, 10 aa, West Nile virus
FLNEDHWLGR

SEQ ID NO: 140982 - protein, 10 aa, West Nile virus
LNEDHWLGRK

SEQ ID NO: 140983 - protein, 10 aa, West Nile virus
NEDHWLGRKN

SEQ ID NO: 140984 - protein, 10 aa, West Nile virus
EDHWLGRKNS

SEQ ID NO: 140985 - protein, 10 aa, West Nile virus
DHWLGRKNSG

SEQ ID NO: 140986 - protein, 10 aa, West Nile virus
HWLGRKNSGG

SEQ ID NO: 140987 - protein, 10 aa, West Nile virus
WLGRKNSGGG

SEQ ID NO: 140988 - protein, 10 aa, West Nile virus
LGRKNSGGGV

SEQ ID NO: 140989 - protein, 10 aa, West Nile virus
GRKNSGGGVE

SEQ ID NO: 140990 - protein, 10 aa, West Nile virus
RKNSGGGVEG

SEQ ID NO: 140991 - protein, 10 aa, West Nile virus
KNSGGGVEGL

SEQ ID NO: 140992 - protein, 10 aa, West Nile virus
NSGGGVEGLG

SEQ ID NO: 140993 - protein, 10 aa, West Nile virus
SGGGVEGLGL

SEQ ID NO: 140994 - protein, 10 aa, West Nile virus
GGGVEGLGLQ

SEQ ID NO: 140995 - protein, 10 aa, West Nile virus
GGVEGLGLQK

SEQ ID NO: 140996 - protein, 10 aa, West Nile virus
GVEGLGLQKL

SEQ ID NO: 140997 - protein, 10 aa, West Nile virus
VEGLGLQKLG

SEQ ID NO: 140998 - protein, 10 aa, West Nile virus
EGLGLQKLGY

SEQ ID NO: 140999 - protein, 10 aa, West Nile virus
GLGLQKLGYI

SEQ ID NO: 141000 - protein, 10 aa, West Nile virus
LGLQKLGYIL

SEQ ID NO: 141001 - protein, 10 aa, West Nile virus
GLQKLGYILR

SEQ ID NO: 141002 - protein, 10 aa, West Nile virus
LQKLGYILRE

SEQ ID NO: 141003 - protein, 10 aa, West Nile virus
QKLGYILREV

SEQ ID NO: 141004 - protein, 10 aa, West Nile virus
KLGYILREVG

SEQ ID NO: 141005 - protein, 10 aa, West Nile virus
GGKIYADDTA

SEQ ID NO: 141006 - protein, 10 aa, West Nile virus
GKIYADDTAG

SEQ ID NO: 141007 - protein, 10 aa, West Nile virus
KIYADDTAGW

SEQ ID NO: 141008 - protein, 10 aa, West Nile virus
IYADDTAGWD

SEQ ID NO: 141009 - protein, 10 aa, West Nile virus
YADDTAGWDT

SEQ ID NO: 141010 - protein, 10 aa, West Nile virus
ADDTAGWDTR

SEQ ID NO: 141011 - protein, 10 aa, West Nile virus
DDTAGWDTRI

SEQ ID NO: 141012 - protein, 10 aa, West Nile virus
DTAGWDTRIT

SEQ ID NO: 141013 - protein, 10 aa, West Nile virus
TAGWDTRITR

SEQ ID NO: 141014 - protein, 10 aa, West Nile virus
AGWDTRITRA

SEQ ID NO: 141015 - protein, 10 aa, West Nile virus
GWDTRITRAD

SEQ ID NO: 141016 - protein, 10 aa, West Nile virus
WDTRITRADL

SEQ ID NO: 141017 - protein, 10 aa, West Nile virus
DTRITRADLE

SEQ ID NO: 141018 - protein, 10 aa, West Nile virus
TRITRADLEN

SEQ ID NO: 141019 - protein, 10 aa, West Nile virus
RITRADLENE

SEQ ID NO: 141020 - protein, 10 aa, West Nile virus
ITRADLENEA

SEQ ID NO: 141021 - protein, 10 aa, West Nile virus
TRADLENEAK

SEQ ID NO: 141022 - protein, 10 aa, West Nile virus
RADLENEAKV

SEQ ID NO: 141023 - protein, 10 aa, West Nile virus
ADLENEAKVL

SEQ ID NO: 141024 - protein, 10 aa, West Nile virus
DLENEAKVLE

SEQ ID NO: 141025 - protein, 10 aa, West Nile virus
LENEAKVLEL

SEQ ID NO: 141026 - protein, 10 aa, West Nile virus
ENEAKVLELL

SEQ ID NO: 141027 - protein, 10 aa, West Nile virus
NEAKVLELLD

SEQ ID NO: 141028 - protein, 10 aa, West Nile virus
EAKVLELLDG

SEQ ID NO: 141029 - protein, 10 aa, West Nile virus
AKVLELLDGE

SEQ ID NO: 141030 - protein, 10 aa, West Nile virus
KVLELLDGEH

SEQ ID NO: 141031 - protein, 10 aa, West Nile virus
VLELLDGEHR

SEQ ID NO: 141032 - protein, 10 aa, West Nile virus
LELLDGEHRR

SEQ ID NO: 141033 - protein, 10 aa, West Nile virus
ELLDGEHRRL

SEQ ID NO: 141034 - protein, 10 aa, West Nile virus
LLDGEHRRLA

SEQ ID NO: 141035 - protein, 10 aa, West Nile virus
LDGEHRRLAR

SEQ ID NO: 141036 - protein, 10 aa, West Nile virus
DGEHRRLARA

SEQ ID NO: 141037 - protein, 10 aa, West Nile virus
GEHRRLARAI

SEQ ID NO: 141038 - protein, 10 aa, West Nile virus
EHRRLARAII

SEQ ID NO: 141039 - protein, 10 aa, West Nile virus
HRRLARAIIE

SEQ ID NO: 141040 - protein, 10 aa, West Nile virus
RRLARAIIEL

SEQ ID NO: 141041 - protein, 10 aa, West Nile virus
RLARAIIELT

SEQ ID NO: 141042 - protein, 10 aa, West Nile virus
LARAIIELTY

SEQ ID NO: 141043 - protein, 10 aa, West Nile virus
ARAIIELTYR

SEQ ID NO: 141044 - protein, 10 aa, West Nile virus
RAIIELTYRH

SEQ ID NO: 141045 - protein, 10 aa, West Nile virus
AIIELTYRHK

SEQ ID NO: 141046 - protein, 10 aa, West Nile virus
IIELTYRHKV

SEQ ID NO: 141047 - protein, 10 aa, West Nile virus
IELTYRHKVV

SEQ ID NO: 141048 - protein, 10 aa, West Nile virus
ELTYRHKVVK

SEQ ID NO: 141049 - protein, 10 aa, West Nile virus
LTYRHKVVKV

SEQ ID NO: 141050 - protein, 10 aa, West Nile virus
TYRHKVVKVM

SEQ ID NO: 141051 - protein, 10 aa, West Nile virus
YRHKVVKVMR

SEQ ID NO: 141052 - protein, 10 aa, West Nile virus
RHKVVKVMRP

SEQ ID NO: 141053 - protein, 10 aa, West Nile virus
HKVVKVMRPA

SEQ ID NO: 141054 - protein, 10 aa, West Nile virus
KVVKVMRPAA

SEQ ID NO: 141055 - protein, 10 aa, West Nile virus
VVKVMRPAAD

SEQ ID NO: 141056 - protein, 10 aa, West Nile virus
VKVMRPAADG

SEQ ID NO: 141057 - protein, 10 aa, West Nile virus
KVMRPAADGR

SEQ ID NO: 141058 - protein, 10 aa, West Nile virus
VMRPAADGRT

SEQ ID NO: 141059 - protein, 10 aa, West Nile virus
MRPAADGRTV

SEQ ID NO: 141060 - protein, 10 aa, West Nile virus
RPAADGRTVM

SEQ ID NO: 141061 - protein, 10 aa, West Nile virus
PAADGRTVMD

SEQ ID NO: 141062 - protein, 10 aa, West Nile virus
AADGRTVMDV

SEQ ID NO: 141063 - protein, 10 aa, West Nile virus
ADGRTVMDVI

SEQ ID NO: 141064 - protein, 10 aa, West Nile virus
DGRTVMDVIS

SEQ ID NO: 141065 - protein, 10 aa, West Nile virus
GRTVMDVISR

SEQ ID NO: 141066 - protein, 10 aa, West Nile virus
RTVMDVISRE

SEQ ID NO: 141067 - protein, 10 aa, West Nile virus
TVMDVISRED

SEQ ID NO: 141068 - protein, 10 aa, West Nile virus
VMDVISREDQ

SEQ ID NO: 141069 - protein, 10 aa, West Nile virus
MDVISREDQR

SEQ ID NO: 141070 - protein, 10 aa, West Nile virus
DVISREDQRG

SEQ ID NO: 141071 - protein, 10 aa, West Nile virus
VISREDQRGS

SEQ ID NO: 141072 - protein, 10 aa, West Nile virus
ISREDQRGSG

SEQ ID NO: 141073 - protein, 10 aa, West Nile virus
SREDQRGSGQ

SEQ ID NO: 141074 - protein, 10 aa, West Nile virus
REDQRGSGQV

SEQ ID NO: 141075 - protein, 10 aa, West Nile virus
EDQRGSGQVV

SEQ ID NO: 141076 - protein, 10 aa, West Nile virus
DQRGSGQVVT

SEQ ID NO: 141077 - protein, 10 aa, West Nile virus
QRGSGQVVTY

SEQ ID NO: 141078 - protein, 10 aa, West Nile virus
RGSGQVVTYA

SEQ ID NO: 141079 - protein, 10 aa, West Nile virus
GSGQVVTYAL

SEQ ID NO: 141080 - protein, 10 aa, West Nile virus
SGQVVTYALN

SEQ ID NO: 141081 - protein, 10 aa, West Nile virus
GQVVTYALNT

SEQ ID NO: 141082 - protein, 10 aa, West Nile virus
QVVTYALNTF

SEQ ID NO: 141083 - protein, 10 aa, West Nile virus
VVTYALNTFT

SEQ ID NO: 141084 - protein, 10 aa, West Nile virus
VTYALNTFTN

SEQ ID NO: 141085 - protein, 10 aa, West Nile virus
TYALNTFTNL

SEQ ID NO: 141086 - protein, 10 aa, West Nile virus
YALNTFTNLA

SEQ ID NO: 141087 - protein, 10 aa, West Nile virus
ALNTFTNLAV

SEQ ID NO: 141088 - protein, 10 aa, West Nile virus
LNTFTNLAVQ

SEQ ID NO: 141089 - protein, 10 aa, West Nile virus
NTFTNLAVQL

SEQ ID NO: 141090 - protein, 10 aa, West Nile virus
TFTNLAVQLV

SEQ ID NO: 141091 - protein, 10 aa, West Nile virus
FTNLAVQLVR

SEQ ID NO: 141092 - protein, 10 aa, West Nile virus
TNLAVQLVRM

SEQ ID NO: 141093 - protein, 10 aa, West Nile virus
NLAVQLVRMM

SEQ ID NO: 141094 - protein, 10 aa, West Nile virus
LAVQLVRMME

SEQ ID NO: 141095 - protein, 10 aa, West Nile virus
AVQLVRMMEG

SEQ ID NO: 141096 - protein, 10 aa, West Nile virus
VQLVRMMEGE

SEQ ID NO: 141097 - protein, 10 aa, West Nile virus
QLVRMMEGEG

SEQ ID NO: 141098 - protein, 10 aa, West Nile virus
LVRMMEGEGV

SEQ ID NO: 141099 - protein, 10 aa, West Nile virus
VRMMEGEGVI

SEQ ID NO: 141100 - protein, 10 aa, West Nile virus
RMMEGEGVIG

SEQ ID NO: 141101 - protein, 10 aa, West Nile virus
MMEGEGVIGP

SEQ ID NO: 141102 - protein, 10 aa, West Nile virus
MEGEGVIGPD

SEQ ID NO: 141103 - protein, 10 aa, West Nile virus
EGEGVIGPDD

SEQ ID NO: 141104 - protein, 10 aa, West Nile virus
GEGVIGPDDV

SEQ ID NO: 141105 - protein, 10 aa, West Nile virus
EGVIGPDDVE

SEQ ID NO: 141106 - protein, 10 aa, West Nile virus
KGKGPKVRTW

SEQ ID NO: 141107 - protein, 10 aa, West Nile virus
GKGPKVRTWL

SEQ ID NO: 141108 - protein, 10 aa, West Nile virus
KGPKVRTWLF

SEQ ID NO: 141109 - protein, 10 aa, West Nile virus
GPKVRTWLFE

SEQ ID NO: 141110 - protein, 10 aa, West Nile virus
PKVRTWLFEN

SEQ ID NO: 141111 - protein, 10 aa, West Nile virus
KVRTWLFENG

SEQ ID NO: 141112 - protein, 10 aa, West Nile virus
VRTWLFENGE

SEQ ID NO: 141113 - protein, 10 aa, West Nile virus
RTWLFENGEE

SEQ ID NO: 141114 - protein, 10 aa, West Nile virus
TWLFENGEER

SEQ ID NO: 141115 - protein, 10 aa, West Nile virus
WLFENGEERL

SEQ ID NO: 141116 - protein, 10 aa, West Nile virus
LFENGEERLS

SEQ ID NO: 141117 - protein, 10 aa, West Nile virus
FENGEERLSR

SEQ ID NO: 141118 - protein, 10 aa, West Nile virus
ENGEERLSRM

SEQ ID NO: 141119 - protein, 10 aa, West Nile virus
NGEERLSRMA

SEQ ID NO: 141120 - protein, 10 aa, West Nile virus
GEERLSRMAV

SEQ ID NO: 141121 - protein, 10 aa, West Nile virus
EERLSRMAVS

SEQ ID NO: 141122 - protein, 10 aa, West Nile virus
ERLSRMAVSG

SEQ ID NO: 141123 - protein, 10 aa, West Nile virus
RLSRMAVSGD

SEQ ID NO: 141124 - protein, 10 aa, West Nile virus
LSRMAVSGDD

SEQ ID NO: 141125 - protein, 10 aa, West Nile virus
SRMAVSGDDC

SEQ ID NO: 141126 - protein, 10 aa, West Nile virus
RMAVSGDDCV

SEQ ID NO: 141127 - protein, 10 aa, West Nile virus
MAVSGDDCVV

SEQ ID NO: 141128 - protein, 10 aa, West Nile virus
AVSGDDCVVK

SEQ ID NO: 141129 - protein, 10 aa, West Nile virus
VSGDDCVVKP

SEQ ID NO: 141130 - protein, 10 aa, West Nile virus
SGDDCVVKPL

SEQ ID NO: 141131 - protein, 10 aa, West Nile virus
GDDCVVKPLD

SEQ ID NO: 141132 - protein, 10 aa, West Nile virus
DDCVVKPLDD

SEQ ID NO: 141133 - protein, 10 aa, West Nile virus
DCVVKPLDDR

SEQ ID NO: 141134 - protein, 10 aa, West Nile virus
CVVKPLDDRF

SEQ ID NO: 141135 - protein, 10 aa, West Nile virus
VVKPLDDRFA

SEQ ID NO: 141136 - protein, 10 aa, West Nile virus
VKPLDDRFAT

SEQ ID NO: 141137 - protein, 10 aa, West Nile virus
KPLDDRFATS

SEQ ID NO: 141138 - protein, 10 aa, West Nile virus
PLDDRFATSL

SEQ ID NO: 141139 - protein, 10 aa, West Nile virus
LDDRFATSLH

SEQ ID NO: 141140 - protein, 10 aa, West Nile virus
DDRFATSLHF

SEQ ID NO: 141141 - protein, 10 aa, West Nile virus
DRFATSLHFL

SEQ ID NO: 141142 - protein, 10 aa, West Nile virus
RFATSLHFLN

SEQ ID NO: 141143 - protein, 10 aa, West Nile virus
FATSLHFLNA

SEQ ID NO: 141144 - protein, 10 aa, West Nile virus
ATSLHFLNAM

SEQ ID NO: 141145 - protein, 10 aa, West Nile virus
TSLHFLNAMS

SEQ ID NO: 141146 - protein, 10 aa, West Nile virus
SLHFLNAMSK

SEQ ID NO: 141147 - protein, 10 aa, West Nile virus
LHFLNAMSKV

SEQ ID NO: 141148 - protein, 10 aa, West Nile virus
HFLNAMSKVR

SEQ ID NO: 141149 - protein, 10 aa, West Nile virus
FLNAMSKVRK

SEQ ID NO: 141150 - protein, 10 aa, West Nile virus
LNAMSKVRKD

SEQ ID NO: 141151 - protein, 10 aa, West Nile virus
NAMSKVRKDI

SEQ ID NO: 141152 - protein, 10 aa, West Nile virus
AMSKVRKDIQ

SEQ ID NO: 141153 - protein, 10 aa, West Nile virus
MSKVRKDIQE

SEQ ID NO: 141154 - protein, 10 aa, West Nile virus
SKVRKDIQEW

SEQ ID NO: 141155 - protein, 10 aa, West Nile virus
KVRKDIQEWK

SEQ ID NO: 141156 - protein, 10 aa, West Nile virus
VRKDIQEWKP

SEQ ID NO: 141157 - protein, 10 aa, West Nile virus
RKDIQEWKPS

SEQ ID NO: 141158 - protein, 10 aa, West Nile virus
KDIQEWKPST

SEQ ID NO: 141159 - protein, 10 aa, West Nile virus
DIQEWKPSTG

SEQ ID NO: 141160 - protein, 10 aa, West Nile virus
IQEWKPSTGW

SEQ ID NO: 141161 - protein, 10 aa, West Nile virus
QEWKPSTGWY

SEQ ID NO: 141162 - protein, 10 aa, West Nile virus
EWKPSTGWYD

SEQ ID NO: 141163 - protein, 10 aa, West Nile virus
WKPSTGWYDW

SEQ ID NO: 141164 - protein, 10 aa, West Nile virus
KPSTGWYDWQ

SEQ ID NO: 141165 - protein, 10 aa, West Nile virus
PSTGWYDWQQ

SEQ ID NO: 141166 - protein, 10 aa, West Nile virus
STGWYDWQQV

SEQ ID NO: 141167 - protein, 10 aa, West Nile virus
TGWYDWQQVP

SEQ ID NO: 141168 - protein, 10 aa, West Nile virus
GWYDWQQVPF

SEQ ID NO: 141169 - protein, 10 aa, West Nile virus
WYDWQQVPFC

SEQ ID NO: 141170 - protein, 10 aa, West Nile virus
YDWQQVPFCS

SEQ ID NO: 141171 - protein, 10 aa, West Nile virus
DWQQVPFCSN

SEQ ID NO: 141172 - protein, 10 aa, West Nile virus
WQQVPFCSNH

SEQ ID NO: 141173 - protein, 10 aa, West Nile virus
QQVPFCSNHF

SEQ ID NO: 141174 - protein, 10 aa, West Nile virus
QVPFCSNHFT

SEQ ID NO: 141175 - protein, 10 aa, West Nile virus
VPFCSNHFTE

SEQ ID NO: 141176 - protein, 10 aa, West Nile virus
PFCSNHFTEL

SEQ ID NO: 141177 - protein, 10 aa, West Nile virus
FCSNHFTELI

SEQ ID NO: 141178 - protein, 10 aa, West Nile virus
CSNHFTELIM

SEQ ID NO: 141179 - protein, 10 aa, West Nile virus
SNHFTELIMK

SEQ ID NO: 141180 - protein, 10 aa, West Nile virus
NHFTELIMKD

SEQ ID NO: 141181 - protein, 10 aa, West Nile virus
HFTELIMKDG

SEQ ID NO: 141182 - protein, 10 aa, West Nile virus
FTELIMKDGR

SEQ ID NO: 141183 - protein, 10 aa, West Nile virus
TELIMKDGRT

SEQ ID NO: 141184 - protein, 10 aa, West Nile virus
ELIMKDGRTL

SEQ ID NO: 141185 - protein, 10 aa, West Nile virus
LIMKDGRTLV

SEQ ID NO: 141186 - protein, 10 aa, West Nile virus
IMKDGRTLVV

SEQ ID NO: 141187 - protein, 10 aa, West Nile virus
MKDGRTLVVP

SEQ ID NO: 141188 - protein, 10 aa, West Nile virus
KDGRTLVVPC

SEQ ID NO: 141189 - protein, 10 aa, West Nile virus
DGRTLVVPCR

SEQ ID NO: 141190 - protein, 10 aa, West Nile virus
GRTLVVPCRG

SEQ ID NO: 141191 - protein, 10 aa, West Nile virus
RTLVVPCRGQ

SEQ ID NO: 141192 - protein, 10 aa, West Nile virus
TLVVPCRGQD

SEQ ID NO: 141193 - protein, 10 aa, West Nile virus
LVVPCRGQDE

SEQ ID NO: 141194 - protein, 10 aa, West Nile virus
VVPCRGQDEL

SEQ ID NO: 141195 - protein, 10 aa, West Nile virus
VPCRGQDELV

SEQ ID NO: 141196 - protein, 10 aa, West Nile virus
PCRGQDELVG

SEQ ID NO: 141197 - protein, 10 aa, West Nile virus
CRGQDELVGR

SEQ ID NO: 141198 - protein, 10 aa, West Nile virus
RGQDELVGRA

SEQ ID NO: 141199 - protein, 10 aa, West Nile virus
GQDELVGRAR

SEQ ID NO: 141200 - protein, 10 aa, West Nile virus
QDELVGRARI

SEQ ID NO: 141201 - protein, 10 aa, West Nile virus
DELVGRARIS

SEQ ID NO: 141202 - protein, 10 aa, West Nile virus
ELVGRARISP

SEQ ID NO: 141203 - protein, 10 aa, West Nile virus
LVGRARISPG

SEQ ID NO: 141204 - protein, 10 aa, West Nile virus
VGRARISPGA

SEQ ID NO: 141205 - protein, 10 aa, West Nile virus
GRARISPGAG

SEQ ID NO: 141206 - protein, 10 aa, West Nile virus
RARISPGAGW

SEQ ID NO: 141207 - protein, 10 aa, West Nile virus
ARISPGAGWN

SEQ ID NO: 141208 - protein, 10 aa, West Nile virus
RISPGAGWNV

SEQ ID NO: 141209 - protein, 10 aa, West Nile virus
ISPGAGWNVR

SEQ ID NO: 141210 - protein, 10 aa, West Nile virus
SPGAGWNVRD

SEQ ID NO: 141211 - protein, 10 aa, West Nile virus
PGAGWNVRDT

SEQ ID NO: 141212 - protein, 10 aa, West Nile virus
GAGWNVRDTA

SEQ ID NO: 141213 - protein, 10 aa, West Nile virus
AGWNVRDTAC

SEQ ID NO: 141214 - protein, 10 aa, West Nile virus
GWNVRDTACL

SEQ ID NO: 141215 - protein, 10 aa, West Nile virus
WNVRDTACLA

SEQ ID NO: 141216 - protein, 10 aa, West Nile virus
NVRDTACLAK

SEQ ID NO: 141217 - protein, 10 aa, West Nile virus
VRDTACLAKS

SEQ ID NO: 141218 - protein, 10 aa, West Nile virus
RDTACLAKSY

SEQ ID NO: 141219 - protein, 10 aa, West Nile virus
DTACLAKSYA

SEQ ID NO: 141220 - protein, 10 aa, West Nile virus
TACLAKSYAQ

SEQ ID NO: 141221 - protein, 10 aa, West Nile virus
ACLAKSYAQM

SEQ ID NO: 141222 - protein, 10 aa, West Nile virus
CLAKSYAQMW

SEQ ID NO: 141223 - protein, 10 aa, West Nile virus
LAKSYAQMWL

SEQ ID NO: 141224 - protein, 10 aa, West Nile virus
AKSYAQMWLL

SEQ ID NO: 141225 - protein, 10 aa, West Nile virus
KSYAQMWLLL

SEQ ID NO: 141226 - protein, 10 aa, West Nile virus
SYAQMWLLLY

SEQ ID NO: 141227 - protein, 10 aa, West Nile virus
YAQMWLLLYF

SEQ ID NO: 141228 - protein, 10 aa, West Nile virus
AQMWLLLYFH

SEQ ID NO: 141229 - protein, 10 aa, West Nile virus
QMWLLLYFHR

SEQ ID NO: 141230 - protein, 10 aa, West Nile virus
MWLLLYFHRR

SEQ ID NO: 141231 - protein, 10 aa, West Nile virus
WLLLYFHRRD

SEQ ID NO: 141232 - protein, 10 aa, West Nile virus
LLLYFHRRDL

SEQ ID NO: 141233 - protein, 10 aa, West Nile virus
LLYFHRRDLR

SEQ ID NO: 141234 - protein, 10 aa, West Nile virus
LYFHRRDLRL

SEQ ID NO: 141235 - protein, 10 aa, West Nile virus
YFHRRDLRLM

SEQ ID NO: 141236 - protein, 10 aa, West Nile virus
FHRRDLRLMA

SEQ ID NO: 141237 - protein, 10 aa, West Nile virus
HRRDLRLMAN

SEQ ID NO: 141238 - protein, 10 aa, West Nile virus
RRDLRLMANA

SEQ ID NO: 141239 - protein, 10 aa, West Nile virus
RDLRLMANAI

SEQ ID NO: 141240 - protein, 10 aa, West Nile virus
DLRLMANAIC

SEQ ID NO: 141241 - protein, 10 aa, West Nile virus
LRLMANAICS

SEQ ID NO: 141242 - protein, 10 aa, West Nile virus
RLMANAICSA

SEQ ID NO: 141243 - protein, 10 aa, West Nile virus
LMANAICSAV

SEQ ID NO: 141244 - protein, 10 aa, West Nile virus
MANAICSAVP

SEQ ID NO: 141245 - protein, 10 aa, West Nile virus
ANAICSAVPV

SEQ ID NO: 141246 - protein, 10 aa, West Nile virus
NAICSAVPVN

SEQ ID NO: 141247 - protein, 10 aa, West Nile virus
AICSAVPVNW

SEQ ID NO: 141248 - protein, 10 aa, West Nile virus
ICSAVPVNWV

SEQ ID NO: 141249 - protein, 10 aa, West Nile virus
CSAVPVNWVP

SEQ ID NO: 141250 - protein, 10 aa, West Nile virus
SAVPVNWVPT

SEQ ID NO: 141251 - protein, 10 aa, West Nile virus
AVPVNWVPTG

SEQ ID NO: 141252 - protein, 10 aa, West Nile virus
VPVNWVPTGR

SEQ ID NO: 141253 - protein, 10 aa, West Nile virus
PVNWVPTGRT

SEQ ID NO: 141254 - protein, 10 aa, West Nile virus
VNWVPTGRTT

SEQ ID NO: 141255 - protein, 10 aa, West Nile virus
NWVPTGRTTW

SEQ ID NO: 141256 - protein, 10 aa, West Nile virus
WVPTGRTTWS

SEQ ID NO: 141257 - protein, 10 aa, West Nile virus
VPTGRTTWSI

SEQ ID NO: 141258 - protein, 10 aa, West Nile virus
PTGRTTWSIH

SEQ ID NO: 141259 - protein, 10 aa, West Nile virus
TGRTTWSIHA

SEQ ID NO: 141260 - protein, 10 aa, West Nile virus
GRTTWSIHAG

SEQ ID NO: 141261 - protein, 10 aa, West Nile virus
RTTWSIHAGG

SEQ ID NO: 141262 - protein, 10 aa, West Nile virus
TTWSIHAGGE

SEQ ID NO: 141263 - protein, 10 aa, West Nile virus
TWSIHAGGEW

SEQ ID NO: 141264 - protein, 10 aa, West Nile virus
WSIHAGGEWM

SEQ ID NO: 141265 - protein, 10 aa, West Nile virus
SIHAGGEWMT

SEQ ID NO: 141266 - protein, 10 aa, West Nile virus
IHAGGEWMTT

SEQ ID NO: 141267 - protein, 10 aa, West Nile virus
HAGGEWMTTE

SEQ ID NO: 141268 - protein, 10 aa, West Nile virus
GGEWMTTEDM

SEQ ID NO: 141269 - protein, 10 aa, West Nile virus
GEWMTTEDML

SEQ ID NO: 141270 - protein, 10 aa, West Nile virus
EWMTTEDMLE

SEQ ID NO: 141271 - protein, 10 aa, West Nile virus
WMTTEDMLEV

SEQ ID NO: 141272 - protein, 10 aa, West Nile virus
MTTEDMLEVW

SEQ ID NO: 141273 - protein, 10 aa, West Nile virus
TTEDMLEVWN

SEQ ID NO: 141274 - protein, 10 aa, West Nile virus
TEDMLEVWNR

SEQ ID NO: 141275 - protein, 10 aa, West Nile virus
EDMLEVWNRV

SEQ ID NO: 141276 - protein, 10 aa, West Nile virus
DMLEVWNRVW

SEQ ID NO: 141277 - protein, 10 aa, West Nile virus
MLEVWNRVWI

SEQ ID NO: 141278 - protein, 10 aa, West Nile virus
LEVWNRVWIE

SEQ ID NO: 141279 - protein, 10 aa, West Nile virus
EVWNRVWIEE

SEQ ID NO: 141280 - protein, 10 aa, West Nile virus
VWNRVWIEEN

SEQ ID NO: 141281 - protein, 10 aa, West Nile virus
WNRVWIEENE

SEQ ID NO: 141282 - protein, 10 aa, West Nile virus
NRVWIEENEW

SEQ ID NO: 141283 - protein, 10 aa, West Nile virus
RVWIEENEWM

SEQ ID NO: 141284 - protein, 10 aa, West Nile virus
VWIEENEWME

SEQ ID NO: 141285 - protein, 10 aa, West Nile virus
WIEENEWMED

SEQ ID NO: 141286 - protein, 10 aa, West Nile virus
IEENEWMEDK

SEQ ID NO: 141287 - protein, 10 aa, West Nile virus
EENEWMEDKT

SEQ ID NO: 141288 - protein, 10 aa, West Nile virus
ENEWMEDKTP

SEQ ID NO: 141289 - protein, 10 aa, West Nile virus
NEWMEDKTPV

SEQ ID NO: 141290 - protein, 10 aa, West Nile virus
EWMEDKTPVE

SEQ ID NO: 141291 - protein, 10 aa, West Nile virus
WMEDKTPVEK

SEQ ID NO: 141292 - protein, 10 aa, West Nile virus
MEDKTPVEKW

SEQ ID NO: 141293 - protein, 10 aa, West Nile virus
EDKTPVEKWS

SEQ ID NO: 141294 - protein, 10 aa, West Nile virus
DKTPVEKWSD

SEQ ID NO: 141295 - protein, 10 aa, West Nile virus
KTPVEKWSDV

SEQ ID NO: 141296 - protein, 10 aa, West Nile virus
TPVEKWSDVP

SEQ ID NO: 141297 - protein, 10 aa, West Nile virus
PVEKWSDVPY

SEQ ID NO: 141298 - protein, 10 aa, West Nile virus
VEKWSDVPYS

SEQ ID NO: 141299 - protein, 10 aa, West Nile virus
EKWSDVPYSG

SEQ ID NO: 141300 - protein, 10 aa, West Nile virus
KWSDVPYSGK

SEQ ID NO: 141301 - protein, 10 aa, West Nile virus
WSDVPYSGKR

SEQ ID NO: 141302 - protein, 10 aa, West Nile virus
SDVPYSGKRE

SEQ ID NO: 141303 - protein, 10 aa, West Nile virus
DVPYSGKRED

SEQ ID NO: 141304 - protein, 10 aa, West Nile virus
VPYSGKREDI

SEQ ID NO: 141305 - protein, 10 aa, West Nile virus
PYSGKREDIW

SEQ ID NO: 141306 - protein, 10 aa, West Nile virus
YSGKREDIWC

SEQ ID NO: 141307 - protein, 10 aa, West Nile virus
SGKREDIWCG

SEQ ID NO: 141308 - protein, 10 aa, West Nile virus
GKREDIWCGS

SEQ ID NO: 141309 - protein, 10 aa, West Nile virus
KREDIWCGSL

SEQ ID NO: 141310 - protein, 10 aa, West Nile virus
REDIWCGSLI

SEQ ID NO: 141311 - protein, 10 aa, West Nile virus
EDIWCGSLIG

SEQ ID NO: 141312 - protein, 10 aa, West Nile virus
DIWCGSLIGT

SEQ ID NO: 141313 - protein, 10 aa, West Nile virus
IWCGSLIGTR

SEQ ID NO: 141314 - protein, 10 aa, West Nile virus
WCGSLIGTRA

SEQ ID NO: 141315 - protein, 10 aa, West Nile virus
CGSLIGTRAR

SEQ ID NO: 141316 - protein, 10 aa, West Nile virus
GSLIGTRARA

SEQ ID NO: 141317 - protein, 10 aa, West Nile virus
SLIGTRARAT

SEQ ID NO: 141318 - protein, 10 aa, West Nile virus
LIGTRARATW

SEQ ID NO: 141319 - protein, 10 aa, West Nile virus
IGTRARATWA

SEQ ID NO: 141320 - protein, 10 aa, West Nile virus
GTRARATWAE

SEQ ID NO: 141321 - protein, 10 aa, West Nile virus
TRARATWAEN

SEQ ID NO: 141322 - protein, 10 aa, West Nile virus
RARATWAENI

SEQ ID NO: 141323 - protein, 10 aa, West Nile virus
ARATWAENIQ

SEQ ID NO: 141324 - protein, 10 aa, West Nile virus
RATWAENIQV

SEQ ID NO: 141325 - protein, 10 aa, West Nile virus
ATWAENIQVA

SEQ ID NO: 141326 - protein, 10 aa, West Nile virus
TWAENIQVAI

SEQ ID NO: 141327 - protein, 10 aa, West Nile virus
WAENIQVAIN

SEQ ID NO: 141328 - protein, 10 aa, West Nile virus
AENIQVAINQ

SEQ ID NO: 141329 - protein, 10 aa, West Nile virus
ENIQVAINQV

SEQ ID NO: 141330 - protein, 10 aa, West Nile virus
NIQVAINQVR

SEQ ID NO: 141331 - protein, 10 aa, West Nile virus
IQVAINQVRA

SEQ ID NO: 141332 - protein, 10 aa, West Nile virus
IIGDEKYVDY

SEQ ID NO: 141333 - protein, 10 aa, West Nile virus
IGDEKYVDYM

SEQ ID NO: 141334 - protein, 10 aa, West Nile virus
GDEKYVDYMS

SEQ ID NO: 141335 - protein, 10 aa, West Nile virus
DEKYVDYMSS

SEQ ID NO: 141336 - protein, 10 aa, West Nile virus
EKYVDYMSSL

SEQ ID NO: 141337 - protein, 10 aa, West Nile virus
KYVDYMSSLK

SEQ ID NO: 141338 - protein, 10 aa, West Nile virus
YVDYMSSLKR

SEQ ID NO: 141339 - protein, 10 aa, West Nile virus
VDYMSSLKRY

SEQ ID NO: 141340 - protein, 10 aa, West Nile virus
DYMSSLKRYE

SEQ ID NO: 141341 - protein, 10 aa, West Nile virus
YMSSLKRYED

SEQ ID NO: 141342 - protein, 10 aa, West Nile virus
SKKPGGPGKN

SEQ ID NO: 141343 - protein, 10 aa, West Nile virus
KKPGGPGKNR

SEQ ID NO: 141344 - protein, 10 aa, West Nile virus
KPGGPGKNRA

SEQ ID NO: 141345 - protein, 10 aa, West Nile virus
PGGPGKNRAV

SEQ ID NO: 141346 - protein, 10 aa, West Nile virus
GGPGKNRAVN

SEQ ID NO: 141347 - protein, 10 aa, West Nile virus
GPGKNRAVNM

SEQ ID NO: 141348 - protein, 10 aa, West Nile virus
PGKNRAVNML

SEQ ID NO: 141349 - protein, 10 aa, West Nile virus
GKNRAVNMLK

SEQ ID NO: 141350 - protein, 10 aa, West Nile virus
KNRAVNMLKR

SEQ ID NO: 141351 - protein, 10 aa, West Nile virus
NRAVNMLKRG

SEQ ID NO: 141352 - protein, 10 aa, West Nile virus
RAVNMQKRGM

SEQ ID NO: 141353 - protein, 10 aa, West Nile virus
AVNMQKRGTP

SEQ ID NO: 141354 - protein, 10 aa, West Nile virus
VNMQKRGTPR

SEQ ID NO: 141355 - protein, 10 aa, West Nile virus
KRGMPRGLSL

SEQ ID NO: 141356 - protein, 10 aa, West Nile virus
PRGLSLIGLK

SEQ ID NO: 141357 - protein, 10 aa, West Nile virus
RGLSLIGLKR

SEQ ID NO: 141358 - protein, 10 aa, West Nile virus
GLSLIGLKRA

SEQ ID NO: 141359 - protein, 10 aa, West Nile virus
LSLTGLKRAM

SEQ ID NO: 141360 - protein, 10 aa, West Nile virus
SLTGLKRAML

SEQ ID NO: 141361 - protein, 10 aa, West Nile virus
LTGLKRAMLS

SEQ ID NO: 141362 - protein, 10 aa, West Nile virus
TGLKRAMLSL

SEQ ID NO: 141363 - protein, 10 aa, West Nile virus
GLKRAVLSLI

SEQ ID NO: 141364 - protein, 10 aa, West Nile virus
LKRAVLSLID

SEQ ID NO: 141365 - protein, 10 aa, West Nile virus
KRAVLSLIDG

SEQ ID NO: 141366 - protein, 10 aa, West Nile virus
RAMLSLIDGR

SEQ ID NO: 141367 - protein, 10 aa, West Nile virus
AMLSLIDGRG

SEQ ID NO: 141368 - protein, 10 aa, West Nile virus
MLSLIDGRGP

SEQ ID NO: 141369 - protein, 10 aa, West Nile virus
LSLIDGRGPI

SEQ ID NO: 141370 - protein, 10 aa, West Nile virus
SLIDGRGPIR

SEQ ID NO: 141371 - protein, 10 aa, West Nile virus
LIDGRGPIRF

SEQ ID NO: 141372 - protein, 10 aa, West Nile virus
IDGRGPIRFV

SEQ ID NO: 141373 - protein, 10 aa, West Nile virus
DGRGPIRFVL

SEQ ID NO: 141374 - protein, 10 aa, West Nile virus
GRGPIRFVLA

SEQ ID NO: 141375 - protein, 10 aa, West Nile virus
RGPIRFVLAL

SEQ ID NO: 141376 - protein, 10 aa, West Nile virus
GPTRFVLALL

SEQ ID NO: 141377 - protein, 10 aa, West Nile virus
PTRFVLALLA

SEQ ID NO: 141378 - protein, 10 aa, West Nile virus
TRFVLALLAF

SEQ ID NO: 141379 - protein, 10 aa, West Nile virus
RFVLALLTFF

SEQ ID NO: 141380 - protein, 10 aa, West Nile virus
FVLALLTFFR

SEQ ID NO: 141381 - protein, 10 aa, West Nile virus
VLALLTFFRF

SEQ ID NO: 141382 - protein, 10 aa, West Nile virus
LALLTFFRFT

SEQ ID NO: 141383 - protein, 10 aa, West Nile virus
ALLTFFRFTA

SEQ ID NO: 141384 - protein, 10 aa, West Nile virus
LLTFFRFTAI

SEQ ID NO: 141385 - protein, 10 aa, West Nile virus
LTFFRFTAIA

SEQ ID NO: 141386 - protein, 10 aa, West Nile virus
TFFRFTAIAP

SEQ ID NO: 141387 - protein, 10 aa, West Nile virus
FFKFTAIAPT

SEQ ID NO: 141388 - protein, 10 aa, West Nile virus
FKFTAIAPTR

SEQ ID NO: 141389 - protein, 10 aa, West Nile virus
KFTAIAPTRA

SEQ ID NO: 141390 - protein, 10 aa, West Nile virus
FTAIAPTRAL

SEQ ID NO: 141391 - protein, 10 aa, West Nile virus
TAIAPTRALL

SEQ ID NO: 141392 - protein, 10 aa, West Nile virus
AIAPTRALLD

SEQ ID NO: 141393 - protein, 10 aa, West Nile virus
IAPTRALLDR

SEQ ID NO: 141394 - protein, 10 aa, West Nile virus
APTRALLDRW

SEQ ID NO: 141395 - protein, 10 aa, West Nile virus
PTRALLDRWR

SEQ ID NO: 141396 - protein, 10 aa, West Nile virus
TRALLDRWRG

SEQ ID NO: 141397 - protein, 10 aa, West Nile virus
RALLDRWRGV

SEQ ID NO: 141398 - protein, 10 aa, West Nile virus
ALLDRWRGVR

SEQ ID NO: 141399 - protein, 10 aa, West Nile virus
LLDRWRGVRK

SEQ ID NO: 141400 - protein, 10 aa, West Nile virus
LDRWRGVRKQ

SEQ ID NO: 141401 - protein, 10 aa, West Nile virus
DRWRGVRKQT

SEQ ID NO: 141402 - protein, 10 aa, West Nile virus
RWRGVRKQTA

SEQ ID NO: 141403 - protein, 10 aa, West Nile virus
WRGVRKQTAM

SEQ ID NO: 141404 - protein, 10 aa, West Nile virus
RGVRKQTAMK

SEQ ID NO: 141405 - protein, 10 aa, West Nile virus
GVRKQTAMKH

SEQ ID NO: 141406 - protein, 10 aa, West Nile virus
VRKQTAMKHL

SEQ ID NO: 141407 - protein, 10 aa, West Nile virus
RKQTAMKHLL

SEQ ID NO: 141408 - protein, 10 aa, West Nile virus
AMKHLTSFKK

SEQ ID NO: 141409 - protein, 10 aa, West Nile virus
MKHLLSFKRE

SEQ ID NO: 141410 - protein, 10 aa, West Nile virus
KHLTSFKKEL

SEQ ID NO: 141411 - protein, 10 aa, West Nile virus
HLLSFKRELG

SEQ ID NO: 141412 - protein, 10 aa, West Nile virus
LLSFKKELGA

SEQ ID NO: 141413 - protein, 10 aa, West Nile virus
LSFKKELGAL

SEQ ID NO: 141414 - protein, 10 aa, West Nile virus
SFKKELGALT

SEQ ID NO: 141415 - protein, 10 aa, West Nile virus
FKKELGALTN

SEQ ID NO: 141416 - protein, 10 aa, West Nile virus
KKELGALTNA

SEQ ID NO: 141417 - protein, 10 aa, West Nile virus
KELGALTNAM

SEQ ID NO: 141418 - protein, 10 aa, West Nile virus
ELGALTNAMN

SEQ ID NO: 141419 - protein, 10 aa, West Nile virus
LGALTNAMNK

SEQ ID NO: 141420 - protein, 10 aa, West Nile virus
GALTNAMNKR

SEQ ID NO: 141421 - protein, 10 aa, West Nile virus
ALTNAMNKRS

SEQ ID NO: 141422 - protein, 10 aa, West Nile virus
NRRSTKQKKR

SEQ ID NO: 141423 - protein, 10 aa, West Nile virus
RRSTKQKKRG

SEQ ID NO: 141424 - protein, 10 aa, West Nile virus
RSTKQKKRGG

SEQ ID NO: 141425 - protein, 10 aa, West Nile virus
KQKKRGGTAG

SEQ ID NO: 141426 - protein, 10 aa, West Nile virus
SALTLSNFQG

SEQ ID NO: 141427 - protein, 10 aa, West Nile virus
ALTLSNFQGK

SEQ ID NO: 141428 - protein, 10 aa, West Nile virus
LTLSNFQGKL

SEQ ID NO: 141429 - protein, 10 aa, West Nile virus
TLSNFQGKLM

SEQ ID NO: 141430 - protein, 10 aa, West Nile virus
LSNFQGKLMM

SEQ ID NO: 141431 - protein, 10 aa, West Nile virus
SNFQGKLMMT

SEQ ID NO: 141432 - protein, 10 aa, West Nile virus
NFQGKLMMTI

SEQ ID NO: 141433 - protein, 10 aa, West Nile virus
FQGKLMMTIN

SEQ ID NO: 141434 - protein, 10 aa, West Nile virus
QGKLMMTINA

SEQ ID NO: 141435 - protein, 10 aa, West Nile virus
GKLMMTINAT

SEQ ID NO: 141436 - protein, 10 aa, West Nile virus
KVIMTVNATD

SEQ ID NO: 141437 - protein, 10 aa, West Nile virus
IITIPTAAGK

SEQ ID NO: 141438 - protein, 10 aa, West Nile virus
ITIPPAAGKN

SEQ ID NO: 141439 - protein, 10 aa, West Nile virus
TIPPAAGKNL

SEQ ID NO: 141440 - protein, 10 aa, West Nile virus
IPIASGKNLC

SEQ ID NO: 141441 - protein, 10 aa, West Nile virus
PTAAGKNLCT

SEQ ID NO: 141442 - protein, 10 aa, West Nile virus
TAAGKNLCTI

SEQ ID NO: 141443 - protein, 10 aa, West Nile virus
AAGKNLCTIR

SEQ ID NO: 141444 - protein, 10 aa, West Nile virus
AGKNLCTIRA

SEQ ID NO: 141445 - protein, 10 aa, West Nile virus
GKNLCTIRAM

SEQ ID NO: 141446 - protein, 10 aa, West Nile virus
KNLCTIRAMD

SEQ ID NO: 141447 - protein, 10 aa, West Nile virus
NLCTIRAMDV

SEQ ID NO: 141448 - protein, 10 aa, West Nile virus
LCTIRAMDVG

SEQ ID NO: 141449 - protein, 10 aa, West Nile virus
CTIRAMDVGF

SEQ ID NO: 141450 - protein, 10 aa, West Nile virus
VRAMDVGYLC

SEQ ID NO: 141451 - protein, 10 aa, West Nile virus
RAMDVGYLCE

SEQ ID NO: 141452 - protein, 10 aa, West Nile virus
AMDVGYLCED

SEQ ID NO: 141453 - protein, 10 aa, West Nile virus
MDVGYLCEDT

SEQ ID NO: 141454 - protein, 10 aa, West Nile virus
DVGYLCEDTI

SEQ ID NO: 141455 - protein, 10 aa, West Nile virus
VGYLCEDTIT

SEQ ID NO: 141456 - protein, 10 aa, West Nile virus
GYLCEDTITY

SEQ ID NO: 141457 - protein, 10 aa, West Nile virus
YLCEDTITYE

SEQ ID NO: 141458 - protein, 10 aa, West Nile virus
LCEDTITYEC

SEQ ID NO: 141459 - protein, 10 aa, West Nile virus
CEDTITYECP

SEQ ID NO: 141460 - protein, 10 aa, West Nile virus
EDTITYECPV

SEQ ID NO: 141461 - protein, 10 aa, West Nile virus
DTIAYECPAL

SEQ ID NO: 141462 - protein, 10 aa, West Nile virus
TITYECPVLA

SEQ ID NO: 141463 - protein, 10 aa, West Nile virus
ITYECPVLAA

SEQ ID NO: 141464 - protein, 10 aa, West Nile virus
TYECPVLAAG

SEQ ID NO: 141465 - protein, 10 aa, West Nile virus
YECPVLAAGN

SEQ ID NO: 141466 - protein, 10 aa, West Nile virus
ECPVLAAGND

SEQ ID NO: 141467 - protein, 10 aa, West Nile virus
CPVLAAGNDP

SEQ ID NO: 141468 - protein, 10 aa, West Nile virus
PVLAAGNDPE

SEQ ID NO: 141469 - protein, 10 aa, West Nile virus
VLAAGNDPED

SEQ ID NO: 141470 - protein, 10 aa, West Nile virus
LAAGNDPEDI

SEQ ID NO: 141471 - protein, 10 aa, West Nile virus
AAGNDPEDID

SEQ ID NO: 141472 - protein, 10 aa, West Nile virus
EGNDPEDIDC

SEQ ID NO: 141473 - protein, 10 aa, West Nile virus
EDIDCWCTKL

SEQ ID NO: 141474 - protein, 10 aa, West Nile virus
DIDCWCTKSS

SEQ ID NO: 141475 - protein, 10 aa, West Nile virus
SVYVRYGRCT

SEQ ID NO: 141476 - protein, 10 aa, West Nile virus
VFVRYGRCTR

SEQ ID NO: 141477 - protein, 10 aa, West Nile virus
FVRYGRCTRT

SEQ ID NO: 141478 - protein, 10 aa, West Nile virus
VRYGRCTRTR

SEQ ID NO: 141479 - protein, 10 aa, West Nile virus
RYGRCTRTRN

SEQ ID NO: 141480 - protein, 10 aa, West Nile virus
YGRCTRTRNS

SEQ ID NO: 141481 - protein, 10 aa, West Nile virus
GRCTRTRNSR

SEQ ID NO: 141482 - protein, 10 aa, West Nile virus
RCTRTRNSRR

SEQ ID NO: 141483 - protein, 10 aa, West Nile virus
CTRTRNSRRS

SEQ ID NO: 141484 - protein, 10 aa, West Nile virus
TRTRNSRRSR

SEQ ID NO: 141485 - protein, 10 aa, West Nile virus
RTRNSRRSRR

SEQ ID NO: 141486 - protein, 10 aa, West Nile virus
TRNSRRSRRS

SEQ ID NO: 141487 - protein, 10 aa, West Nile virus
RNSRRSRRSL

SEQ ID NO: 141488 - protein, 10 aa, West Nile virus
NSRRSRRSLN

SEQ ID NO: 141489 - protein, 10 aa, West Nile virus
SRRSRRSLNV

SEQ ID NO: 141490 - protein, 10 aa, West Nile virus
RRSRRSLNVQ

SEQ ID NO: 141491 - protein, 10 aa, West Nile virus
RSRRSLNVQV

SEQ ID NO: 141492 - protein, 10 aa, West Nile virus
SRRSLNVQVH

SEQ ID NO: 141493 - protein, 10 aa, West Nile virus
RRSLNVQVHG

SEQ ID NO: 141494 - protein, 10 aa, West Nile virus
RSLNVQVHGE

SEQ ID NO: 141495 - protein, 10 aa, West Nile virus
SLNVQVHGES

SEQ ID NO: 141496 - protein, 10 aa, West Nile virus
LNVQVHGESS

SEQ ID NO: 141497 - protein, 10 aa, West Nile virus
NVQVHGESSL

SEQ ID NO: 141498 - protein, 10 aa, West Nile virus
VQVHGESSLS

SEQ ID NO: 141499 - protein, 10 aa, West Nile virus
QVHGESSLSN

SEQ ID NO: 141500 - protein, 10 aa, West Nile virus
VHGESSLSNR

SEQ ID NO: 141501 - protein, 10 aa, West Nile virus
HGESSLSNRK

SEQ ID NO: 141502 - protein, 10 aa, West Nile virus
GESSLSNRKG

SEQ ID NO: 141503 - protein, 10 aa, West Nile virus
ESSLSNRKGA

SEQ ID NO: 141504 - protein, 10 aa, West Nile virus
SSLSNRKGAW

SEQ ID NO: 141505 - protein, 10 aa, West Nile virus
TLANKKGAWL

SEQ ID NO: 141506 - protein, 10 aa, West Nile virus
LANKKGAWLD

SEQ ID NO: 141507 - protein, 10 aa, West Nile virus
ANKKGAWLDS

SEQ ID NO: 141508 - protein, 10 aa, West Nile virus
NKKGAWLDST

SEQ ID NO: 141509 - protein, 10 aa, West Nile virus
KKGAWLDSTK

SEQ ID NO: 141510 - protein, 10 aa, West Nile virus
KGAWLDSTKA

SEQ ID NO: 141511 - protein, 10 aa, West Nile virus
GAWLDSTKAT

SEQ ID NO: 141512 - protein, 10 aa, West Nile virus
AWLDSTKATR

SEQ ID NO: 141513 - protein, 10 aa, West Nile virus
WLDSTKATRY

SEQ ID NO: 141514 - protein, 10 aa, West Nile virus
LDSTKATRYL

SEQ ID NO: 141515 - protein, 10 aa, West Nile virus
DSTKASRYLM

SEQ ID NO: 141516 - protein, 10 aa, West Nile virus
STKASRYLMK

SEQ ID NO: 141517 - protein, 10 aa, West Nile virus
TKASRYLMKA

SEQ ID NO: 141518 - protein, 10 aa, West Nile virus
KASRYLMKAE

SEQ ID NO: 141519 - protein, 10 aa, West Nile virus
ASRYLMKAES

SEQ ID NO: 141520 - protein, 10 aa, West Nile virus
SRYLMKAESW

SEQ ID NO: 141521 - protein, 10 aa, West Nile virus
RYLMKAESWI

SEQ ID NO: 141522 - protein, 10 aa, West Nile virus
YLMKAESWIL

SEQ ID NO: 141523 - protein, 10 aa, West Nile virus
LMKAESWILR

SEQ ID NO: 141524 - protein, 10 aa, West Nile virus
MKAESWILRN

SEQ ID NO: 141525 - protein, 10 aa, West Nile virus
KAESWILRNP

SEQ ID NO: 141526 - protein, 10 aa, West Nile virus
AESWILRNPG

SEQ ID NO: 141527 - protein, 10 aa, West Nile virus
PGYALVAAVT

SEQ ID NO: 141528 - protein, 10 aa, West Nile virus
GYALVAVVIG

SEQ ID NO: 141529 - protein, 10 aa, West Nile virus
YALVAAVTGW

SEQ ID NO: 141530 - protein, 10 aa, West Nile virus
ALVAAVTGWM

SEQ ID NO: 141531 - protein, 10 aa, West Nile virus
LVAAVTGWML

SEQ ID NO: 141532 - protein, 10 aa, West Nile virus
VAVVIGWMLG

SEQ ID NO: 141533 - protein, 10 aa, West Nile virus
AVVIGWMLGS

SEQ ID NO: 141534 - protein, 10 aa, West Nile virus
VVIGWMLGSN

SEQ ID NO: 141535 - protein, 10 aa, West Nile virus
VIGWMLGSNN

SEQ ID NO: 141536 - protein, 10 aa, West Nile virus
IGWMLGSNTT

SEQ ID NO: 141537 - protein, 10 aa, West Nile virus
GWMLGSNTTQ

SEQ ID NO: 141538 - protein, 10 aa, West Nile virus
WMLGSNTTQR

SEQ ID NO: 141539 - protein, 10 aa, West Nile virus
MLGSNTTQRV

SEQ ID NO: 141540 - protein, 10 aa, West Nile virus
LGSNTTQRVV

SEQ ID NO: 141541 - protein, 10 aa, West Nile virus
GSNTTQRVVF

SEQ ID NO: 141542 - protein, 10 aa, West Nile virus
SNTMQRVVFA

SEQ ID NO: 141543 - protein, 10 aa, West Nile virus
MQRVVFAILL

SEQ ID NO: 141544 - protein, 10 aa, West Nile virus
QRVVFAILLL

SEQ ID NO: 141545 - protein, 10 aa, West Nile virus
RVVFAILLLL

SEQ ID NO: 141546 - protein, 10 aa, West Nile virus
VVFAILLLLV

SEQ ID NO: 141547 - protein, 10 aa, West Nile virus
VFAILLLLVA

SEQ ID NO: 141548 - protein, 10 aa, West Nile virus
FAILLLLVAP

SEQ ID NO: 141549 - protein, 10 aa, West Nile virus
AILLLLVAPA

SEQ ID NO: 141550 - protein, 10 aa, West Nile virus
ILLLLVAPAY

SEQ ID NO: 141551 - protein, 10 aa, West Nile virus
YSFNCLGMSS

SEQ ID NO: 141552 - protein, 10 aa, West Nile virus
SFNCLGMSSR

SEQ ID NO: 141553 - protein, 10 aa, West Nile virus
FNCLGMSSRD

SEQ ID NO: 141554 - protein, 10 aa, West Nile virus
NCLGMSSRDF

SEQ ID NO: 141555 - protein, 10 aa, West Nile virus
CLGMSNRDFI

SEQ ID NO: 141556 - protein, 10 aa, West Nile virus
LGMSNRDFIE

SEQ ID NO: 141557 - protein, 10 aa, West Nile virus
GMSNRDFIEG

SEQ ID NO: 141558 - protein, 10 aa, West Nile virus
MSNRDFIEGA

SEQ ID NO: 141559 - protein, 10 aa, West Nile virus
SNRDFIEGAS

SEQ ID NO: 141560 - protein, 10 aa, West Nile virus
NRDFIEGASG

SEQ ID NO: 141561 - protein, 10 aa, West Nile virus
RDFIEGASGA

SEQ ID NO: 141562 - protein, 10 aa, West Nile virus
DFIEGASGAT

SEQ ID NO: 141563 - protein, 10 aa, West Nile virus
FIEGASGATW

SEQ ID NO: 141564 - protein, 10 aa, West Nile virus
IEGASGATWV

SEQ ID NO: 141565 - protein, 10 aa, West Nile virus
EGASGATWVD

SEQ ID NO: 141566 - protein, 10 aa, West Nile virus
GASGATWVDL

SEQ ID NO: 141567 - protein, 10 aa, West Nile virus
ASGATWVDLV

SEQ ID NO: 141568 - protein, 10 aa, West Nile virus
SGATWMDLVL

SEQ ID NO: 141569 - protein, 10 aa, West Nile virus
GATWMDLVLE

SEQ ID NO: 141570 - protein, 10 aa, West Nile virus
ATWMDLVLEG

SEQ ID NO: 141571 - protein, 10 aa, West Nile virus
TWMDLVLEGD

SEQ ID NO: 141572 - protein, 10 aa, West Nile virus
WMDLVLEGDS

SEQ ID NO: 141573 - protein, 10 aa, West Nile virus
MDLVLEGDSC

SEQ ID NO: 141574 - protein, 10 aa, West Nile virus
LEGDSCVTIT

SEQ ID NO: 141575 - protein, 10 aa, West Nile virus
EGDSCVTIMA

SEQ ID NO: 141576 - protein, 10 aa, West Nile virus
GDSCVTIMAK

SEQ ID NO: 141577 - protein, 10 aa, West Nile virus
DSCVTIMAKD

SEQ ID NO: 141578 - protein, 10 aa, West Nile virus
SCVTIMAKDR

SEQ ID NO: 141579 - protein, 10 aa, West Nile virus
CVTIMAKDRP

SEQ ID NO: 141580 - protein, 10 aa, West Nile virus
VTIMAKDRPT

SEQ ID NO: 141581 - protein, 10 aa, West Nile virus
TIMAKDRPTI

SEQ ID NO: 141582 - protein, 10 aa, West Nile virus
IMAKDRPTID

SEQ ID NO: 141583 - protein, 10 aa, West Nile virus
MAKDRPTIDV

SEQ ID NO: 141584 - protein, 10 aa, West Nile virus
AKDRPTIDVK

SEQ ID NO: 141585 - protein, 10 aa, West Nile virus
KDRPTIDVKM

SEQ ID NO: 141586 - protein, 10 aa, West Nile virus
DRPTIDVKMV

SEQ ID NO: 141587 - protein, 10 aa, West Nile virus
RPTIDVKMVT

SEQ ID NO: 141588 - protein, 10 aa, West Nile virus
PTIDVKMVTM

SEQ ID NO: 141589 - protein, 10 aa, West Nile virus
TIDVKMVTMG

SEQ ID NO: 141590 - protein, 10 aa, West Nile virus
IDVKMVTMGA

SEQ ID NO: 141591 - protein, 10 aa, West Nile virus
VSDLSTRAAC

SEQ ID NO: 141592 - protein, 10 aa, West Nile virus
SDLSTRAACP

SEQ ID NO: 141593 - protein, 10 aa, West Nile virus
LSTRAACPTM

SEQ ID NO: 141594 - protein, 10 aa, West Nile virus
STRAACPTMG

SEQ ID NO: 141595 - protein, 10 aa, West Nile virus
TRAACPTMGE

SEQ ID NO: 141596 - protein, 10 aa, West Nile virus
RAACPTMGEA

SEQ ID NO: 141597 - protein, 10 aa, West Nile virus
AACPAMGEAH

SEQ ID NO: 141598 - protein, 10 aa, West Nile virus
ACPTMGDAHN

SEQ ID NO: 141599 - protein, 10 aa, West Nile virus
CPTMGEAHNE

SEQ ID NO: 141600 - protein, 10 aa, West Nile virus
PTMGEAHNEK

SEQ ID NO: 141601 - protein, 10 aa, West Nile virus
TMGEAHNEKR

SEQ ID NO: 141602 - protein, 10 aa, West Nile virus
MGEAHNEKRA

SEQ ID NO: 141603 - protein, 10 aa, West Nile virus
GEAHNEKRAD

SEQ ID NO: 141604 - protein, 10 aa, West Nile virus
EAHNEKRADP

SEQ ID NO: 141605 - protein, 10 aa, West Nile virus
FVCKQGVVDR

SEQ ID NO: 141606 - protein, 10 aa, West Nile virus
VCKQGVVDRG

SEQ ID NO: 141607 - protein, 10 aa, West Nile virus
CKQGVVDRGW

SEQ ID NO: 141608 - protein, 10 aa, West Nile virus
KQGVVDRGWG

SEQ ID NO: 141609 - protein, 10 aa, West Nile virus
GSIDTCAKFT

SEQ ID NO: 141610 - protein, 10 aa, West Nile virus
SIDTCAKFTC

SEQ ID NO: 141611 - protein, 10 aa, West Nile virus
IDTCAKFACT

SEQ ID NO: 141612 - protein, 10 aa, West Nile virus
DTCAKFACTT

SEQ ID NO: 141613 - protein, 10 aa, West Nile virus
TCAKFACTTK

SEQ ID NO: 141614 - protein, 10 aa, West Nile virus
CAKFACTTKA

SEQ ID NO: 141615 - protein, 10 aa, West Nile virus
AKFACSTKAT

SEQ ID NO: 141616 - protein, 10 aa, West Nile virus
KFACSTKATG

SEQ ID NO: 141617 - protein, 10 aa, West Nile virus
FACSTKATGR

SEQ ID NO: 141618 - protein, 10 aa, West Nile virus
ACSTKATGRT

SEQ ID NO: 141619 - protein, 10 aa, West Nile virus
CSTKATGRTI

SEQ ID NO: 141620 - protein, 10 aa, West Nile virus
STKATGRTIL

SEQ ID NO: 141621 - protein, 10 aa, West Nile virus
TKATGRTILK

SEQ ID NO: 141622 - protein, 10 aa, West Nile virus
KATGRTILKE

SEQ ID NO: 141623 - protein, 10 aa, West Nile virus
ATGRTILKEN

SEQ ID NO: 141624 - protein, 10 aa, West Nile virus
TGRTILKENI

SEQ ID NO: 141625 - protein, 10 aa, West Nile virus
GWIIQKENIK

SEQ ID NO: 141626 - protein, 10 aa, West Nile virus
WIIQKENIKY

SEQ ID NO: 141627 - protein, 10 aa, West Nile virus
IIQKENIKYE

SEQ ID NO: 141628 - protein, 10 aa, West Nile virus
IQKENIKYEV

SEQ ID NO: 141629 - protein, 10 aa, West Nile virus
QKENIKYEVA

SEQ ID NO: 141630 - protein, 10 aa, West Nile virus
RENVKYEVAA

SEQ ID NO: 141631 - protein, 10 aa, West Nile virus
ENVKYEVAAF

SEQ ID NO: 141632 - protein, 10 aa, West Nile virus
NVKYEVAAFV

SEQ ID NO: 141633 - protein, 10 aa, West Nile virus
VKYEVAAFVH

SEQ ID NO: 141634 - protein, 10 aa, West Nile virus
KYEVAAFVHG

SEQ ID NO: 141635 - protein, 10 aa, West Nile virus
YEVAAFVHGP

SEQ ID NO: 141636 - protein, 10 aa, West Nile virus
EVAAFVHGPT

SEQ ID NO: 141637 - protein, 10 aa, West Nile virus
VAAFVHGPTT

SEQ ID NO: 141638 - protein, 10 aa, West Nile virus
AAFVHGPTTV

SEQ ID NO: 141639 - protein, 10 aa, West Nile virus
AFVHGPTTVD

SEQ ID NO: 141640 - protein, 10 aa, West Nile virus
FVHGPTTVDT

SEQ ID NO: 141641 - protein, 10 aa, West Nile virus
VHGPTTVDTH

SEQ ID NO: 141642 - protein, 10 aa, West Nile virus
HGPTTVDTHS

SEQ ID NO: 141643 - protein, 10 aa, West Nile virus
AAVQAGRFSV

SEQ ID NO: 141644 - protein, 10 aa, West Nile virus
AVQAGRFSVS

SEQ ID NO: 141645 - protein, 10 aa, West Nile virus
VQAGRFSVSP

SEQ ID NO: 141646 - protein, 10 aa, West Nile virus
QAGRFSITPS

SEQ ID NO: 141647 - protein, 10 aa, West Nile virus
AGRFSITPSA

SEQ ID NO: 141648 - protein, 10 aa, West Nile virus
GRFSITPSAP

SEQ ID NO: 141649 - protein, 10 aa, West Nile virus
RFSITPSAPS

SEQ ID NO: 141650 - protein, 10 aa, West Nile virus
SITPSAPSYT

SEQ ID NO: 141651 - protein, 10 aa, West Nile virus
TLGDYGEVTF

SEQ ID NO: 141652 - protein, 10 aa, West Nile virus
LGDYGEVTFD

SEQ ID NO: 141653 - protein, 10 aa, West Nile virus
GDYGEVTFDC

SEQ ID NO: 141654 - protein, 10 aa, West Nile virus
DYGEVTFDCE

SEQ ID NO: 141655 - protein, 10 aa, West Nile virus
YGEVTFDCEP

SEQ ID NO: 141656 - protein, 10 aa, West Nile virus
GEVTFDCEPR

SEQ ID NO: 141657 - protein, 10 aa, West Nile virus
EVTFDCEPRS

SEQ ID NO: 141658 - protein, 10 aa, West Nile virus
VTFDCEPRSG

SEQ ID NO: 141659 - protein, 10 aa, West Nile virus
TFDCEPRSGV

SEQ ID NO: 141660 - protein, 10 aa, West Nile virus
FDCEPRSGVD

SEQ ID NO: 141661 - protein, 10 aa, West Nile virus
DCEPRSGVDV

SEQ ID NO: 141662 - protein, 10 aa, West Nile virus
CEPRSGIDTS

SEQ ID NO: 141663 - protein, 10 aa, West Nile virus
EPRSGIDTSA

SEQ ID NO: 141664 - protein, 10 aa, West Nile virus
PRSGIDTSAY

SEQ ID NO: 141665 - protein, 10 aa, West Nile virus
RSGIDTSAYY

SEQ ID NO: 141666 - protein, 10 aa, West Nile virus
SGIDTSAYYV

SEQ ID NO: 141667 - protein, 10 aa, West Nile virus
GIDTSAYYVM

SEQ ID NO: 141668 - protein, 10 aa, West Nile virus
IDTSAYYVMS

SEQ ID NO: 141669 - protein, 10 aa, West Nile virus
DTSAYYVMSV

SEQ ID NO: 141670 - protein, 10 aa, West Nile virus
TSAYYVMSVG

SEQ ID NO: 141671 - protein, 10 aa, West Nile virus
KSFLVHREWF

SEQ ID NO: 141672 - protein, 10 aa, West Nile virus
SFLVHREWFM

SEQ ID NO: 141673 - protein, 10 aa, West Nile virus
HREWFMDLNM

SEQ ID NO: 141674 - protein, 10 aa, West Nile virus
REWFMDLNMP

SEQ ID NO: 141675 - protein, 10 aa, West Nile virus
EWFMDLNMPW

SEQ ID NO: 141676 - protein, 10 aa, West Nile virus
WFTDLNLPWS

SEQ ID NO: 141677 - protein, 10 aa, West Nile virus
FTDLNLPWSS

SEQ ID NO: 141678 - protein, 10 aa, West Nile virus
MDLNLPWSSP

SEQ ID NO: 141679 - protein, 10 aa, West Nile virus
DLNLPWSSPG

SEQ ID NO: 141680 - protein, 10 aa, West Nile virus
LNLPWSSPGN

SEQ ID NO: 141681 - protein, 10 aa, West Nile virus
NLPWSSPGNT

SEQ ID NO: 141682 - protein, 10 aa, West Nile virus
WRNREALVEF

SEQ ID NO: 141683 - protein, 10 aa, West Nile virus
RNREALVEFE

SEQ ID NO: 141684 - protein, 10 aa, West Nile virus
NREALVEFEE

SEQ ID NO: 141685 - protein, 10 aa, West Nile virus
REALVEFEEA

SEQ ID NO: 141686 - protein, 10 aa, West Nile virus
EALVEFEEAH

SEQ ID NO: 141687 - protein, 10 aa, West Nile virus
ALVEFEEAHA

SEQ ID NO: 141688 - protein, 10 aa, West Nile virus
LVEFEEAHAT

SEQ ID NO: 141689 - protein, 10 aa, West Nile virus
VEFEEAHATK

SEQ ID NO: 141690 - protein, 10 aa, West Nile virus
EFEEAHATKQ

SEQ ID NO: 141691 - protein, 10 aa, West Nile virus
FEEAHATKQS

SEQ ID NO: 141692 - protein, 10 aa, West Nile virus
EEAHATKQSV

SEQ ID NO: 141693 - protein, 10 aa, West Nile virus
EPHATKQSVV

SEQ ID NO: 141694 - protein, 10 aa, West Nile virus
PHATKQSVVA

SEQ ID NO: 141695 - protein, 10 aa, West Nile virus
HATKQSVVAL

SEQ ID NO: 141696 - protein, 10 aa, West Nile virus
ATKQSVVALG

SEQ ID NO: 141697 - protein, 10 aa, West Nile virus
TKQSVVALGS

SEQ ID NO: 141698 - protein, 10 aa, West Nile virus
KQSVVALGSQ

SEQ ID NO: 141699 - protein, 10 aa, West Nile virus
QSVVALGSQE

SEQ ID NO: 141700 - protein, 10 aa, West Nile virus
SVVALGSQEG

SEQ ID NO: 141701 - protein, 10 aa, West Nile virus
VVALGSQEGA

SEQ ID NO: 141702 - protein, 10 aa, West Nile virus
VALGSQEGAL

SEQ ID NO: 141703 - protein, 10 aa, West Nile virus
GALHQALAGT

SEQ ID NO: 141704 - protein, 10 aa, West Nile virus
ALQQALAGAI

SEQ ID NO: 141705 - protein, 10 aa, West Nile virus
LQQALAGAIP

SEQ ID NO: 141706 - protein, 10 aa, West Nile virus
HQALAGTIPV

SEQ ID NO: 141707 - protein, 10 aa, West Nile virus
QALAGAIPVD

SEQ ID NO: 141708 - protein, 10 aa, West Nile virus
ALAGAIPVDY

SEQ ID NO: 141709 - protein, 10 aa, West Nile virus
LAGAIPVDYK

SEQ ID NO: 141710 - protein, 10 aa, West Nile virus
AGAIPVDYKN

SEQ ID NO: 141711 - protein, 10 aa, West Nile virus
GAIPVDYKNS

SEQ ID NO: 141712 - protein, 10 aa, West Nile virus
AIPVDYKNSV

SEQ ID NO: 141713 - protein, 10 aa, West Nile virus
IPVDYKNSVV

SEQ ID NO: 141714 - protein, 10 aa, West Nile virus
PVDYKNSVVK

SEQ ID NO: 141715 - protein, 10 aa, West Nile virus
VDYKNSVVKL

SEQ ID NO: 141716 - protein, 10 aa, West Nile virus
DYKNSVVKLS

SEQ ID NO: 141717 - protein, 10 aa, West Nile virus
YKNSVVKLSS

SEQ ID NO: 141718 - protein, 10 aa, West Nile virus
KNSVVKLSSG

SEQ ID NO: 141719 - protein, 10 aa, West Nile virus
NSVVKLSSGH

SEQ ID NO: 141720 - protein, 10 aa, West Nile virus
SVVKLSSGHL

SEQ ID NO: 141721 - protein, 10 aa, West Nile virus
VVKLSSGHLK

SEQ ID NO: 141722 - protein, 10 aa, West Nile virus
VKLSSGHLKC

SEQ ID NO: 141723 - protein, 10 aa, West Nile virus
KLSSGHLKCR

SEQ ID NO: 141724 - protein, 10 aa, West Nile virus
LSSGHLKCRV

SEQ ID NO: 141725 - protein, 10 aa, West Nile virus
TSGHLKCRVR

SEQ ID NO: 141726 - protein, 10 aa, West Nile virus
SGHLKCRVRM

SEQ ID NO: 141727 - protein, 10 aa, West Nile virus
GHLKCRVRME

SEQ ID NO: 141728 - protein, 10 aa, West Nile virus
HLKCRVRMEK

SEQ ID NO: 141729 - protein, 10 aa, West Nile virus
LKCRVRMEKL

SEQ ID NO: 141730 - protein, 10 aa, West Nile virus
KCRVRMEKLQ

SEQ ID NO: 141731 - protein, 10 aa, West Nile virus
CRVRMEKLQL

SEQ ID NO: 141732 - protein, 10 aa, West Nile virus
RVRMEKLQLK

SEQ ID NO: 141733 - protein, 10 aa, West Nile virus
VRMEKLQLKG

SEQ ID NO: 141734 - protein, 10 aa, West Nile virus
RMEKLQLKGT

SEQ ID NO: 141735 - protein, 10 aa, West Nile virus
MEKLKLKGTT

SEQ ID NO: 141736 - protein, 10 aa, West Nile virus
EKLKLKGTTY

SEQ ID NO: 141737 - protein, 10 aa, West Nile virus
KLKLKGTTYG

SEQ ID NO: 141738 - protein, 10 aa, West Nile virus
LKLKGTTYGV

SEQ ID NO: 141739 - protein, 10 aa, West Nile virus
KLKGTTYGVC

SEQ ID NO: 141740 - protein, 10 aa, West Nile virus
LKGTTYGVCA

SEQ ID NO: 141741 - protein, 10 aa, West Nile virus
KGTTYGVCAK

SEQ ID NO: 141742 - protein, 10 aa, West Nile virus
GTTYGVCAKA

SEQ ID NO: 141743 - protein, 10 aa, West Nile virus
TTYGVCAKAF

SEQ ID NO: 141744 - protein, 10 aa, West Nile virus
TYGVCAKAFR

SEQ ID NO: 141745 - protein, 10 aa, West Nile virus
YGVCAKAFRF

SEQ ID NO: 141746 - protein, 10 aa, West Nile virus
RTPADTGHGT

SEQ ID NO: 141747 - protein, 10 aa, West Nile virus
ADTGHGTVVM

SEQ ID NO: 141748 - protein, 10 aa, West Nile virus
DTGHGTVVME

SEQ ID NO: 141749 - protein, 10 aa, West Nile virus
TGHGTVVMEL

SEQ ID NO: 141750 - protein, 10 aa, West Nile virus
GHGTVVMELQ

SEQ ID NO: 141751 - protein, 10 aa, West Nile virus
HGTVVMELQY

SEQ ID NO: 141752 - protein, 10 aa, West Nile virus
GTVVMELQYT

SEQ ID NO: 141753 - protein, 10 aa, West Nile virus
TVVMELQYTG

SEQ ID NO: 141754 - protein, 10 aa, West Nile virus
VVMELQYTGT

SEQ ID NO: 141755 - protein, 10 aa, West Nile virus
VMELQYTGTD

SEQ ID NO: 141756 - protein, 10 aa, West Nile virus
MELQYTGTDG

SEQ ID NO: 141757 - protein, 10 aa, West Nile virus
ELQYTGKDGP

SEQ ID NO: 141758 - protein, 10 aa, West Nile virus
LQYTGKDGPC

SEQ ID NO: 141759 - protein, 10 aa, West Nile virus
QYTGKDGPCK

SEQ ID NO: 141760 - protein, 10 aa, West Nile virus
YTGTDGPCKI

SEQ ID NO: 141761 - protein, 10 aa, West Nile virus
TGTDGPCKIP

SEQ ID NO: 141762 - protein, 10 aa, West Nile virus
GTDGPCKIPI

SEQ ID NO: 141763 - protein, 10 aa, West Nile virus
TDGPCKIPIT

SEQ ID NO: 141764 - protein, 10 aa, West Nile virus
DGPCKIPISS

SEQ ID NO: 141765 - protein, 10 aa, West Nile virus
GPCKIPISSV

SEQ ID NO: 141766 - protein, 10 aa, West Nile virus
PCKIPISSVA

SEQ ID NO: 141767 - protein, 10 aa, West Nile virus
CKIPISSVAS

SEQ ID NO: 141768 - protein, 10 aa, West Nile virus
KIPITSVASL

SEQ ID NO: 141769 - protein, 10 aa, West Nile virus
IPITSVASLN

SEQ ID NO: 141770 - protein, 10 aa, West Nile virus
PITSVASLND

SEQ ID NO: 141771 - protein, 10 aa, West Nile virus
ITSVASLNDL

SEQ ID NO: 141772 - protein, 10 aa, West Nile virus
TSVASLNDLT

SEQ ID NO: 141773 - protein, 10 aa, West Nile virus
VGRLVTVNPY

SEQ ID NO: 141774 - protein, 10 aa, West Nile virus
GRLVTVNPYV

SEQ ID NO: 141775 - protein, 10 aa, West Nile virus
RLVTVNPYVS

SEQ ID NO: 141776 - protein, 10 aa, West Nile virus
LVTVNPYVSV

SEQ ID NO: 141777 - protein, 10 aa, West Nile virus
VTVNPYVSVA

SEQ ID NO: 141778 - protein, 10 aa, West Nile virus
TVNPYVSVAT

SEQ ID NO: 141779 - protein, 10 aa, West Nile virus
VNPYVSVATA

SEQ ID NO: 141780 - protein, 10 aa, West Nile virus
TANSKVLIEL

SEQ ID NO: 141781 - protein, 10 aa, West Nile virus
ANSKVLIELE

SEQ ID NO: 141782 - protein, 10 aa, West Nile virus
NSKVLIELEP

SEQ ID NO: 141783 - protein, 10 aa, West Nile virus
SKVLIELEPP

SEQ ID NO: 141784 - protein, 10 aa, West Nile virus
KILVELEPPF

SEQ ID NO: 141785 - protein, 10 aa, West Nile virus
ILVELEPPFG

SEQ ID NO: 141786 - protein, 10 aa, West Nile virus
LVELEPPFGD

SEQ ID NO: 141787 - protein, 10 aa, West Nile virus
VELEPPFGDS

SEQ ID NO: 141788 - protein, 10 aa, West Nile virus
PPFGDSYIVI

SEQ ID NO: 141789 - protein, 10 aa, West Nile virus
PFGDSYIVIG

SEQ ID NO: 141790 - protein, 10 aa, West Nile virus
FGDSYIVIGK

SEQ ID NO: 141791 - protein, 10 aa, West Nile virus
GDSYIVIGKG

SEQ ID NO: 141792 - protein, 10 aa, West Nile virus
DSYIVIGKGD

SEQ ID NO: 141793 - protein, 10 aa, West Nile virus
SYIVIGKGDQ

SEQ ID NO: 141794 - protein, 10 aa, West Nile virus
YIVIGKGDQQ

SEQ ID NO: 141795 - protein, 10 aa, West Nile virus
IVIGKGDQQV

SEQ ID NO: 141796 - protein, 10 aa, West Nile virus
VIGKGDQQVT

SEQ ID NO: 141797 - protein, 10 aa, West Nile virus
IGKGDQQVTH

SEQ ID NO: 141798 - protein, 10 aa, West Nile virus
GKGDQQVTHH

SEQ ID NO: 141799 - protein, 10 aa, West Nile virus
KGDQQVTHHW

SEQ ID NO: 141800 - protein, 10 aa, West Nile virus
GDQQVTHHWH

SEQ ID NO: 141801 - protein, 10 aa, West Nile virus
DQQVTHHWHK

SEQ ID NO: 141802 - protein, 10 aa, West Nile virus
QQVTHHWHKS

SEQ ID NO: 141803 - protein, 10 aa, West Nile virus
QVTHHWHKSG

SEQ ID NO: 141804 - protein, 10 aa, West Nile virus
VTHHWHKSGS

SEQ ID NO: 141805 - protein, 10 aa, West Nile virus
THHWHKSGSS

SEQ ID NO: 141806 - protein, 10 aa, West Nile virus
HHWYKSGSSI

SEQ ID NO: 141807 - protein, 10 aa, West Nile virus
HWYKSGSSIG

SEQ ID NO: 141808 - protein, 10 aa, West Nile virus
WHKSGISIGK

SEQ ID NO: 141809 - protein, 10 aa, West Nile virus
HKSGISIGKA

SEQ ID NO: 141810 - protein, 10 aa, West Nile virus
SGSSIGKAFA

SEQ ID NO: 141811 - protein, 10 aa, West Nile virus
GSSIGKAFAT

SEQ ID NO: 141812 - protein, 10 aa, West Nile virus
SSIGKAFATT

SEQ ID NO: 141813 - protein, 10 aa, West Nile virus
SIGKAFATTL

SEQ ID NO: 141814 - protein, 10 aa, West Nile virus
IGKAFTTTLR

SEQ ID NO: 141815 - protein, 10 aa, West Nile virus
GKAFTTTLRG

SEQ ID NO: 141816 - protein, 10 aa, West Nile virus
KAFTTTLRGA

SEQ ID NO: 141817 - protein, 10 aa, West Nile virus
AFTTTLRGAQ

SEQ ID NO: 141818 - protein, 10 aa, West Nile virus
FTTTLRGAQR

SEQ ID NO: 141819 - protein, 10 aa, West Nile virus
TTTLRGAQRL

SEQ ID NO: 141820 - protein, 10 aa, West Nile virus
TTLRGAQRLA

SEQ ID NO: 141821 - protein, 10 aa, West Nile virus
TLRGAQRLAA

SEQ ID NO: 141822 - protein, 10 aa, West Nile virus
LRGAQRLAAL

SEQ ID NO: 141823 - protein, 10 aa, West Nile virus
RGAQRLAALG

SEQ ID NO: 141824 - protein, 10 aa, West Nile virus
GAQRLVSLGD

SEQ ID NO: 141825 - protein, 10 aa, West Nile virus
AQRLVSLGDT

SEQ ID NO: 141826 - protein, 10 aa, West Nile virus
QRLVSLGDTA

SEQ ID NO: 141827 - protein, 10 aa, West Nile virus
RLVSLGDTAW

SEQ ID NO: 141828 - protein, 10 aa, West Nile virus
LVSLGDTAWD

SEQ ID NO: 141829 - protein, 10 aa, West Nile virus
VSLGDTAWDF

SEQ ID NO: 141830 - protein, 10 aa, West Nile virus
SLGDTAWDFG

SEQ ID NO: 141831 - protein, 10 aa, West Nile virus
GDTAWDFGSI

SEQ ID NO: 141832 - protein, 10 aa, West Nile virus
DTAWDFGSIG

SEQ ID NO: 141833 - protein, 10 aa, West Nile virus
TAWDFGSIGG

SEQ ID NO: 141834 - protein, 10 aa, West Nile virus
AWDFGSIGGV

SEQ ID NO: 141835 - protein, 10 aa, West Nile virus
WDFGSIGGVF

SEQ ID NO: 141836 - protein, 10 aa, West Nile virus
DFGSIGGVFT

SEQ ID NO: 141837 - protein, 10 aa, West Nile virus
FGSIGGVFTS

SEQ ID NO: 141838 - protein, 10 aa, West Nile virus
GSIGGVFTSV

SEQ ID NO: 141839 - protein, 10 aa, West Nile virus
SIGGVFTSVG

SEQ ID NO: 141840 - protein, 10 aa, West Nile virus
IGGVFTSVGK

SEQ ID NO: 141841 - protein, 10 aa, West Nile virus
GGVFNSIGKA

SEQ ID NO: 141842 - protein, 10 aa, West Nile virus
GVFTSVGKAI

SEQ ID NO: 141843 - protein, 10 aa, West Nile virus
VFTSVGKAIH

SEQ ID NO: 141844 - protein, 10 aa, West Nile virus
FTSVGKAIHQ

SEQ ID NO: 141845 - protein, 10 aa, West Nile virus
TSVGKAIHQV

SEQ ID NO: 141846 - protein, 10 aa, West Nile virus
SVGKAIHQVF

SEQ ID NO: 141847 - protein, 10 aa, West Nile virus
VGKAIHQVFG

SEQ ID NO: 141848 - protein, 10 aa, West Nile virus
GKAIHQVFGG

SEQ ID NO: 141849 - protein, 10 aa, West Nile virus
KAIHQVFGGA

SEQ ID NO: 141850 - protein, 10 aa, West Nile virus
AIHQVFGGAF

SEQ ID NO: 141851 - protein, 10 aa, West Nile virus
IHQVFGGAFR

SEQ ID NO: 141852 - protein, 10 aa, West Nile virus
HQLFGGAFRS

SEQ ID NO: 141853 - protein, 10 aa, West Nile virus
QLFGGAFRSL

SEQ ID NO: 141854 - protein, 10 aa, West Nile virus
LFGGAFRSLF

SEQ ID NO: 141855 - protein, 10 aa, West Nile virus
FGGAFRLLFG

SEQ ID NO: 141856 - protein, 10 aa, West Nile virus
GGAFRLLFGG

SEQ ID NO: 141857 - protein, 10 aa, West Nile virus
GAFRLLFGGM

SEQ ID NO: 141858 - protein, 10 aa, West Nile virus
AFRLLFGGMS

SEQ ID NO: 141859 - protein, 10 aa, West Nile virus
FRLLFGGMSW

SEQ ID NO: 141860 - protein, 10 aa, West Nile virus
RLLFGGMSWI

SEQ ID NO: 141861 - protein, 10 aa, West Nile virus
LLFGGMSWIT

SEQ ID NO: 141862 - protein, 10 aa, West Nile virus
LGALLLWMGV

SEQ ID NO: 141863 - protein, 10 aa, West Nile virus
GALLLWMGVN

SEQ ID NO: 141864 - protein, 10 aa, West Nile virus
ALLLWMGINS

SEQ ID NO: 141865 - protein, 10 aa, West Nile virus
LLLWMGINSR

SEQ ID NO: 141866 - protein, 10 aa, West Nile virus
LLWMGINSRD

SEQ ID NO: 141867 - protein, 10 aa, West Nile virus
LWMGINSRDR

SEQ ID NO: 141868 - protein, 10 aa, West Nile virus
WMGINSRDRS

SEQ ID NO: 141869 - protein, 10 aa, West Nile virus
MGINSRDRSI

SEQ ID NO: 141870 - protein, 10 aa, West Nile virus
GINSRDRSIA

SEQ ID NO: 141871 - protein, 10 aa, West Nile virus
ARDRSIAMTF

SEQ ID NO: 141872 - protein, 10 aa, West Nile virus
RDRSIAMTFL

SEQ ID NO: 141873 - protein, 10 aa, West Nile virus
DRSIAMTFLA

SEQ ID NO: 141874 - protein, 10 aa, West Nile virus
RSIAMTFLAV

SEQ ID NO: 141875 - protein, 10 aa, West Nile virus
SIAMTFLAVG

SEQ ID NO: 141876 - protein, 10 aa, West Nile virus
IAMTFLAVGG

SEQ ID NO: 141877 - protein, 10 aa, West Nile virus
AMTFLAVGGV

SEQ ID NO: 141878 - protein, 10 aa, West Nile virus
MTFLAVGGVL

SEQ ID NO: 141879 - protein, 10 aa, West Nile virus
TFLAVGGILL

SEQ ID NO: 141880 - protein, 10 aa, West Nile virus
FLAVGGILLF

SEQ ID NO: 141881 - protein, 10 aa, West Nile virus
LAIGGVLLFL

SEQ ID NO: 141882 - protein, 10 aa, West Nile virus
AIGGVLLFLS

SEQ ID NO: 141883 - protein, 10 aa, West Nile virus
VGGILLFLSA

SEQ ID NO: 141884 - protein, 10 aa, West Nile virus
GGILLFLSAN

SEQ ID NO: 141885 - protein, 10 aa, West Nile virus
GILLFLSVNV

SEQ ID NO: 141886 - protein, 10 aa, West Nile virus
VLLFLSVSVH

SEQ ID NO: 141887 - protein, 10 aa, West Nile virus
LLFLSANVHA

SEQ ID NO: 141888 - protein, 10 aa, West Nile virus
LFLSINVHAD

SEQ ID NO: 141889 - protein, 10 aa, West Nile virus
FLSVSVHADT

SEQ ID NO: 141890 - protein, 10 aa, West Nile virus
LSVSVHADTG

SEQ ID NO: 141891 - protein, 10 aa, West Nile virus
SANVHADTGC

SEQ ID NO: 141892 - protein, 10 aa, West Nile virus
VSVHADTGCA

SEQ ID NO: 141893 - protein, 10 aa, West Nile virus
HADTGCAIDL

SEQ ID NO: 141894 - protein, 10 aa, West Nile virus
ADTGCAIDIG

SEQ ID NO: 141895 - protein, 10 aa, West Nile virus
DTGCAIDIGR

SEQ ID NO: 141896 - protein, 10 aa, West Nile virus
TGCAIDIGRQ

SEQ ID NO: 141897 - protein, 10 aa, West Nile virus
GCAIDIGRQE

SEQ ID NO: 141898 - protein, 10 aa, West Nile virus
CAIDIGRQEL

SEQ ID NO: 141899 - protein, 10 aa, West Nile virus
AIDIGRQELR

SEQ ID NO: 141900 - protein, 10 aa, West Nile virus
IDIGRQELRC

SEQ ID NO: 141901 - protein, 10 aa, West Nile virus
DIGRQELRCG

SEQ ID NO: 141902 - protein, 10 aa, West Nile virus
GRQELRCGSG

SEQ ID NO: 141903 - protein, 10 aa, West Nile virus
LRCGNGVFIH

SEQ ID NO: 141904 - protein, 10 aa, West Nile virus
RCGSGVFIYN

SEQ ID NO: 141905 - protein, 10 aa, West Nile virus
CGSGVFIYND

SEQ ID NO: 141906 - protein, 10 aa, West Nile virus
GSGVFIYNDV

SEQ ID NO: 141907 - protein, 10 aa, West Nile virus
NGVFIHNDVE

SEQ ID NO: 141908 - protein, 10 aa, West Nile virus
GVFIHNDVEV

SEQ ID NO: 141909 - protein, 10 aa, West Nile virus
VFIYNDVEAW

SEQ ID NO: 141910 - protein, 10 aa, West Nile virus
NDVEAWVDRY

SEQ ID NO: 141911 - protein, 10 aa, West Nile virus
DVEAWVDRYR

SEQ ID NO: 141912 - protein, 10 aa, West Nile virus
DRYKFYPETP

SEQ ID NO: 141913 - protein, 10 aa, West Nile virus
RYKFYPETPQ

SEQ ID NO: 141914 - protein, 10 aa, West Nile virus
YKFYPETPQG

SEQ ID NO: 141915 - protein, 10 aa, West Nile virus
KFYPETPQGL

SEQ ID NO: 141916 - protein, 10 aa, West Nile virus
FYPETPQGLA

SEQ ID NO: 141917 - protein, 10 aa, West Nile virus
HPETPQGLAK

SEQ ID NO: 141918 - protein, 10 aa, West Nile virus
PETPQGLAKV

SEQ ID NO: 141919 - protein, 10 aa, West Nile virus
ETPQGLAKVI

SEQ ID NO: 141920 - protein, 10 aa, West Nile virus
TPQGLAKIIH

SEQ ID NO: 141921 - protein, 10 aa, West Nile virus
PQGLAKIIHN

SEQ ID NO: 141922 - protein, 10 aa, West Nile virus
QGLAKIIHNA

SEQ ID NO: 141923 - protein, 10 aa, West Nile virus
GLAKIIHNAH

SEQ ID NO: 141924 - protein, 10 aa, West Nile virus
EGVCGVRSVS

SEQ ID NO: 141925 - protein, 10 aa, West Nile virus
GVCGVRSVSR

SEQ ID NO: 141926 - protein, 10 aa, West Nile virus
VCGVRSVSRL

SEQ ID NO: 141927 - protein, 10 aa, West Nile virus
CGVRSVSRLE

SEQ ID NO: 141928 - protein, 10 aa, West Nile virus
GVRSVSRLEH

SEQ ID NO: 141929 - protein, 10 aa, West Nile virus
VRSVSRLEHQ

SEQ ID NO: 141930 - protein, 10 aa, West Nile virus
VSRLEHQMWD

SEQ ID NO: 141931 - protein, 10 aa, West Nile virus
SRLEHQMWES

SEQ ID NO: 141932 - protein, 10 aa, West Nile virus
RLEHQMWESV

SEQ ID NO: 141933 - protein, 10 aa, West Nile virus
LEHQMWESVK

SEQ ID NO: 141934 - protein, 10 aa, West Nile virus
EHQMWESVKD

SEQ ID NO: 141935 - protein, 10 aa, West Nile virus
HQMWESVKDE

SEQ ID NO: 141936 - protein, 10 aa, West Nile virus
QMWESVKDEL

SEQ ID NO: 141937 - protein, 10 aa, West Nile virus
MWESVKDELN

SEQ ID NO: 141938 - protein, 10 aa, West Nile virus
WESVKDELNT

SEQ ID NO: 141939 - protein, 10 aa, West Nile virus
SVKDELNTLL

SEQ ID NO: 141940 - protein, 10 aa, West Nile virus
IKDELNTLLK

SEQ ID NO: 141941 - protein, 10 aa, West Nile virus
KDELNTLFRE

SEQ ID NO: 141942 - protein, 10 aa, West Nile virus
DELNTLFREN

SEQ ID NO: 141943 - protein, 10 aa, West Nile virus
ELNTLFRENG

SEQ ID NO: 141944 - protein, 10 aa, West Nile virus
LNTLLKENGI

SEQ ID NO: 141945 - protein, 10 aa, West Nile virus
NTLLKENGID

SEQ ID NO: 141946 - protein, 10 aa, West Nile virus
TLLKENGIDL

SEQ ID NO: 141947 - protein, 10 aa, West Nile virus
LLKENGIDLS

SEQ ID NO: 141948 - protein, 10 aa, West Nile virus
LKENGVDLSI

SEQ ID NO: 141949 - protein, 10 aa, West Nile virus
KENGVDLSIV

SEQ ID NO: 141950 - protein, 10 aa, West Nile virus
ENGVDLSIVV

SEQ ID NO: 141951 - protein, 10 aa, West Nile virus
NGVDLSIVVE

SEQ ID NO: 141952 - protein, 10 aa, West Nile virus
GVDLSIVVEK

SEQ ID NO: 141953 - protein, 10 aa, West Nile virus
VDLSIVVEKQ

SEQ ID NO: 141954 - protein, 10 aa, West Nile virus
ATTEKLEMGW

SEQ ID NO: 141955 - protein, 10 aa, West Nile virus
TTEKLEMGWK

SEQ ID NO: 141956 - protein, 10 aa, West Nile virus
TEKLEMGWKA

SEQ ID NO: 141957 - protein, 10 aa, West Nile virus
EKLEMGWKAW

SEQ ID NO: 141958 - protein, 10 aa, West Nile virus
KLEMGWKAWG

SEQ ID NO: 141959 - protein, 10 aa, West Nile virus
LEMGWKAWGK

SEQ ID NO: 141960 - protein, 10 aa, West Nile virus
EMGWKAWGKS

SEQ ID NO: 141961 - protein, 10 aa, West Nile virus
MGWKAWGKSI

SEQ ID NO: 141962 - protein, 10 aa, West Nile virus
GWKAWGKSII

SEQ ID NO: 141963 - protein, 10 aa, West Nile virus
WKAWGKSIIF

SEQ ID NO: 141964 - protein, 10 aa, West Nile virus
KAWGKSIIFA

SEQ ID NO: 141965 - protein, 10 aa, West Nile virus
AWGKSIIFAP

SEQ ID NO: 141966 - protein, 10 aa, West Nile virus
WGKSIIFAPE

SEQ ID NO: 141967 - protein, 10 aa, West Nile virus
GKSIIFAPEL

SEQ ID NO: 141968 - protein, 10 aa, West Nile virus
KSIIFAPELA

SEQ ID NO: 141969 - protein, 10 aa, West Nile virus
SIIFAPELAN

SEQ ID NO: 141970 - protein, 10 aa, West Nile virus
FAPELANHTF

SEQ ID NO: 141971 - protein, 10 aa, West Nile virus
APELANHTFV

SEQ ID NO: 141972 - protein, 10 aa, West Nile virus
PELANNTFVI

SEQ ID NO: 141973 - protein, 10 aa, West Nile virus
ELANNTFVID

SEQ ID NO: 141974 - protein, 10 aa, West Nile virus
LANNTFVIDG

SEQ ID NO: 141975 - protein, 10 aa, West Nile virus
ANNTFVIDGP

SEQ ID NO: 141976 - protein, 10 aa, West Nile virus
NNTFVIDGPE

SEQ ID NO: 141977 - protein, 10 aa, West Nile virus
NTFVIDGPET

SEQ ID NO: 141978 - protein, 10 aa, West Nile virus
TFVIDGPETE

SEQ ID NO: 141979 - protein, 10 aa, West Nile virus
FVIDGPETEE

SEQ ID NO: 141980 - protein, 10 aa, West Nile virus
VIDGPETEEC

SEQ ID NO: 141981 - protein, 10 aa, West Nile virus
IDGPETEECP

SEQ ID NO: 141982 - protein, 10 aa, West Nile virus
DGPETEECPT

SEQ ID NO: 141983 - protein, 10 aa, West Nile virus
NRAWNSMEVE

SEQ ID NO: 141984 - protein, 10 aa, West Nile virus
RAWNSMEVED

SEQ ID NO: 141985 - protein, 10 aa, West Nile virus
AWNSMEVEDF

SEQ ID NO: 141986 - protein, 10 aa, West Nile virus
WNSMEVEDFG

SEQ ID NO: 141987 - protein, 10 aa, West Nile virus
NSMEVEDFGF

SEQ ID NO: 141988 - protein, 10 aa, West Nile virus
SMEVEDFGFG

SEQ ID NO: 141989 - protein, 10 aa, West Nile virus
MEVEDFGFGL

SEQ ID NO: 141990 - protein, 10 aa, West Nile virus
FGFGLTSTRI

SEQ ID NO: 141991 - protein, 10 aa, West Nile virus
GFGLTSTRIF

SEQ ID NO: 141992 - protein, 10 aa, West Nile virus
FGLTSTRMFM

SEQ ID NO: 141993 - protein, 10 aa, West Nile virus
GLTSTRMFLR

SEQ ID NO: 141994 - protein, 10 aa, West Nile virus
IRETNTTECD

SEQ ID NO: 141995 - protein, 10 aa, West Nile virus
NTTECDTKII

SEQ ID NO: 141996 - protein, 10 aa, West Nile virus
TTECDTKIIG

SEQ ID NO: 141997 - protein, 10 aa, West Nile virus
TECDTKIIGT

SEQ ID NO: 141998 - protein, 10 aa, West Nile virus
ECDTKIIGTA

SEQ ID NO: 141999 - protein, 10 aa, West Nile virus
CDTKIIGTAV

SEQ ID NO: 142000 - protein, 10 aa, West Nile virus
DTKIIGTAVK

SEQ ID NO: 142001 - protein, 10 aa, West Nile virus
TKIIGTAVKN

SEQ ID NO: 142002 - protein, 10 aa, West Nile virus
KTIGTAVKNN

SEQ ID NO: 142003 - protein, 10 aa, West Nile virus
IIGTAVKNNM

SEQ ID NO: 142004 - protein, 10 aa, West Nile virus
IGTAVKNNMA

SEQ ID NO: 142005 - protein, 10 aa, West Nile virus
GTAVKNNMAV

SEQ ID NO: 142006 - protein, 10 aa, West Nile virus
TAVKNNMAVH

SEQ ID NO: 142007 - protein, 10 aa, West Nile virus
AVKNNMAVHS

SEQ ID NO: 142008 - protein, 10 aa, West Nile virus
VKNNMAVHSD

SEQ ID NO: 142009 - protein, 10 aa, West Nile virus
KNNMAVHSDL

SEQ ID NO: 142010 - protein, 10 aa, West Nile virus
NNMAVHSDLS

SEQ ID NO: 142011 - protein, 10 aa, West Nile virus
NMAVHSDLSY

SEQ ID NO: 142012 - protein, 10 aa, West Nile virus
MAVHSDLSYW

SEQ ID NO: 142013 - protein, 10 aa, West Nile virus
AVHSDLSYWI

SEQ ID NO: 142014 - protein, 10 aa, West Nile virus
VHSDLSYWIE

SEQ ID NO: 142015 - protein, 10 aa, West Nile virus
SDLSYWIESG

SEQ ID NO: 142016 - protein, 10 aa, West Nile virus
DLSYWIESGL

SEQ ID NO: 142017 - protein, 10 aa, West Nile virus
LSYWIESGLN

SEQ ID NO: 142018 - protein, 10 aa, West Nile virus
FNDTWKLERA

SEQ ID NO: 142019 - protein, 10 aa, West Nile virus
NETWKLERAV

SEQ ID NO: 142020 - protein, 10 aa, West Nile virus
ETWKLERAVL

SEQ ID NO: 142021 - protein, 10 aa, West Nile virus
WPETHTLWGE

SEQ ID NO: 142022 - protein, 10 aa, West Nile virus
PETHTLWGEG

SEQ ID NO: 142023 - protein, 10 aa, West Nile virus
ETHTLWGDGV

SEQ ID NO: 142024 - protein, 10 aa, West Nile virus
THTLWGDGVL

SEQ ID NO: 142025 - protein, 10 aa, West Nile virus
HTLWGDGVLE

SEQ ID NO: 142026 - protein, 10 aa, West Nile virus
TLWGDGVLES

SEQ ID NO: 142027 - protein, 10 aa, West Nile virus
GVLESDLIIP

SEQ ID NO: 142028 - protein, 10 aa, West Nile virus
ESDLIIPITL

SEQ ID NO: 142029 - protein, 10 aa, West Nile virus
SDLIIPITLA

SEQ ID NO: 142030 - protein, 10 aa, West Nile virus
DLIIPITLAG

SEQ ID NO: 142031 - protein, 10 aa, West Nile virus
LIIPITLAGP

SEQ ID NO: 142032 - protein, 10 aa, West Nile virus
IIPITLAGPR

SEQ ID NO: 142033 - protein, 10 aa, West Nile virus
IPITLAGPRS

SEQ ID NO: 142034 - protein, 10 aa, West Nile virus
PITLAGPRSN

SEQ ID NO: 142035 - protein, 10 aa, West Nile virus
ITLAGPRSNH

SEQ ID NO: 142036 - protein, 10 aa, West Nile virus
TLAGLRSNHN

SEQ ID NO: 142037 - protein, 10 aa, West Nile virus
LAGLRSNHNR

SEQ ID NO: 142038 - protein, 10 aa, West Nile virus
AGLRSNHNRR

SEQ ID NO: 142039 - protein, 10 aa, West Nile virus
GLRSNHNRRP

SEQ ID NO: 142040 - protein, 10 aa, West Nile virus
LRSNHNRRPG

SEQ ID NO: 142041 - protein, 10 aa, West Nile virus
KSNHNKRPGY

SEQ ID NO: 142042 - protein, 10 aa, West Nile virus
SNYNRRPGYK

SEQ ID NO: 142043 - protein, 10 aa, West Nile virus
NYNRRPGYKT

SEQ ID NO: 142044 - protein, 10 aa, West Nile virus
HNKRPGYKTQ

SEQ ID NO: 142045 - protein, 10 aa, West Nile virus
NRRPGYKTQS

SEQ ID NO: 142046 - protein, 10 aa, West Nile virus
RRPGYKTQSQ

SEQ ID NO: 142047 - protein, 10 aa, West Nile virus
RPGYKTQSQG

SEQ ID NO: 142048 - protein, 10 aa, West Nile virus
PGYKTQSQGP

SEQ ID NO: 142049 - protein, 10 aa, West Nile virus
GYKTQSQGPW

SEQ ID NO: 142050 - protein, 10 aa, West Nile virus
YKTQSQGPWD

SEQ ID NO: 142051 - protein, 10 aa, West Nile virus
KTQSQGPWDE

SEQ ID NO: 142052 - protein, 10 aa, West Nile virus
TQSQGPWDEG

SEQ ID NO: 142053 - protein, 10 aa, West Nile virus
QSQGPWDEGR

SEQ ID NO: 142054 - protein, 10 aa, West Nile virus
SQGPWDEGRV

SEQ ID NO: 142055 - protein, 10 aa, West Nile virus
QGPWDEGRIE

SEQ ID NO: 142056 - protein, 10 aa, West Nile virus
GPWDEGRVEL

SEQ ID NO: 142057 - protein, 10 aa, West Nile virus
PWDEGRVELD

SEQ ID NO: 142058 - protein, 10 aa, West Nile virus
WDEGRVELDF

SEQ ID NO: 142059 - protein, 10 aa, West Nile virus
DEGRVELDFD

SEQ ID NO: 142060 - protein, 10 aa, West Nile virus
EGRVELDFDY

SEQ ID NO: 142061 - protein, 10 aa, West Nile virus
GRVELDFDYC

SEQ ID NO: 142062 - protein, 10 aa, West Nile virus
RVELDFDYCP

SEQ ID NO: 142063 - protein, 10 aa, West Nile virus
VELDFDYCPG

SEQ ID NO: 142064 - protein, 10 aa, West Nile virus
ELDFDYCPGT

SEQ ID NO: 142065 - protein, 10 aa, West Nile virus
LDFDYCPGTT

SEQ ID NO: 142066 - protein, 10 aa, West Nile virus
DYCPGTTVTI

SEQ ID NO: 142067 - protein, 10 aa, West Nile virus
YCPGTTVTIS

SEQ ID NO: 142068 - protein, 10 aa, West Nile virus
CGHRGPAART

SEQ ID NO: 142069 - protein, 10 aa, West Nile virus
GHRGPAARTT

SEQ ID NO: 142070 - protein, 10 aa, West Nile virus
HRGPAARTTT

SEQ ID NO: 142071 - protein, 10 aa, West Nile virus
RGPAARTTTE

SEQ ID NO: 142072 - protein, 10 aa, West Nile virus
GPAARTTTES

SEQ ID NO: 142073 - protein, 10 aa, West Nile virus
PAARTTTESG

SEQ ID NO: 142074 - protein, 10 aa, West Nile virus
AARTTTESGK

SEQ ID NO: 142075 - protein, 10 aa, West Nile virus
ARTTTESGKL

SEQ ID NO: 142076 - protein, 10 aa, West Nile virus
TTTESGKLIS

SEQ ID NO: 142077 - protein, 10 aa, West Nile virus
TTESGKLISD

SEQ ID NO: 142078 - protein, 10 aa, West Nile virus
TESGKLISDW

SEQ ID NO: 142079 - protein, 10 aa, West Nile virus
ESGKLISDWC

SEQ ID NO: 142080 - protein, 10 aa, West Nile virus
SGKLISDWCC

SEQ ID NO: 142081 - protein, 10 aa, West Nile virus
GKLISDWCCR

SEQ ID NO: 142082 - protein, 10 aa, West Nile virus
KLISDWCCRS

SEQ ID NO: 142083 - protein, 10 aa, West Nile virus
LISDWCCRSC

SEQ ID NO: 142084 - protein, 10 aa, West Nile virus
ISDWCCRSCT

SEQ ID NO: 142085 - protein, 10 aa, West Nile virus
SDWCCRSCTL

SEQ ID NO: 142086 - protein, 10 aa, West Nile virus
RSCTLPPLRF

SEQ ID NO: 142087 - protein, 10 aa, West Nile virus
SCTLPPLRFQ

SEQ ID NO: 142088 - protein, 10 aa, West Nile virus
CTLPPLRFQT

SEQ ID NO: 142089 - protein, 10 aa, West Nile virus
TLPPLRFQTE

SEQ ID NO: 142090 - protein, 10 aa, West Nile virus
TENGCWYGME

SEQ ID NO: 142091 - protein, 10 aa, West Nile virus
ENGCWYGMEI

SEQ ID NO: 142092 - protein, 10 aa, West Nile virus
NGCWYGMEIR

SEQ ID NO: 142093 - protein, 10 aa, West Nile virus
CWYGMEIRPT

SEQ ID NO: 142094 - protein, 10 aa, West Nile virus
WYGMEIRPTR

SEQ ID NO: 142095 - protein, 10 aa, West Nile virus
YGMEIRPTRH

SEQ ID NO: 142096 - protein, 10 aa, West Nile virus
GMEIRPTRHD

SEQ ID NO: 142097 - protein, 10 aa, West Nile virus
MEIRPTRHDE

SEQ ID NO: 142098 - protein, 10 aa, West Nile virus
EIRPTRHDEK

SEQ ID NO: 142099 - protein, 10 aa, West Nile virus
IRPTRHDEKT

SEQ ID NO: 142100 - protein, 10 aa, West Nile virus
RPTRHDEKTL

SEQ ID NO: 142101 - protein, 10 aa, West Nile virus
PTRHDEKTLV

SEQ ID NO: 142102 - protein, 10 aa, West Nile virus
TRHDEKTLVQ

SEQ ID NO: 142103 - protein, 10 aa, West Nile virus
KHDEKTLVQS

SEQ ID NO: 142104 - protein, 10 aa, West Nile virus
HDEKTLVQSR

SEQ ID NO: 142105 - protein, 10 aa, West Nile virus
DEKTLVQSRV

SEQ ID NO: 142106 - protein, 10 aa, West Nile virus
EKTLVQSRVN

SEQ ID NO: 142107 - protein, 10 aa, West Nile virus
KTLVQSRVNA

SEQ ID NO: 142108 - protein, 10 aa, West Nile virus
TLVQSRVNAY

SEQ ID NO: 142109 - protein, 10 aa, West Nile virus
LVQSRVNAYN

SEQ ID NO: 142110 - protein, 10 aa, West Nile virus
VQSRVNAYNA

SEQ ID NO: 142111 - protein, 10 aa, West Nile virus
QSRVNAYNAD

SEQ ID NO: 142112 - protein, 10 aa, West Nile virus
SRVNAYNADM

SEQ ID NO: 142113 - protein, 10 aa, West Nile virus
RVNAYNADMI

SEQ ID NO: 142114 - protein, 10 aa, West Nile virus
VTAYNADMID

SEQ ID NO: 142115 - protein, 10 aa, West Nile virus
TAYNADMIDP

SEQ ID NO: 142116 - protein, 10 aa, West Nile virus
AYNAEMIDPF

SEQ ID NO: 142117 - protein, 10 aa, West Nile virus
YNAEMIDPFQ

SEQ ID NO: 142118 - protein, 10 aa, West Nile virus
KSDMIDPFQL

SEQ ID NO: 142119 - protein, 10 aa, West Nile virus
SDMIDPFQLG

SEQ ID NO: 142120 - protein, 10 aa, West Nile virus
MIDPFQLGLM

SEQ ID NO: 142121 - protein, 10 aa, West Nile virus
IDPFQLGLMV

SEQ ID NO: 142122 - protein, 10 aa, West Nile virus
DPFQLGLMVV

SEQ ID NO: 142123 - protein, 10 aa, West Nile virus
PFQLGLMVVF

SEQ ID NO: 142124 - protein, 10 aa, West Nile virus
FQLGLMVVFL

SEQ ID NO: 142125 - protein, 10 aa, West Nile virus
QLGLMVVFLA

SEQ ID NO: 142126 - protein, 10 aa, West Nile virus
LGLMVVFLAT

SEQ ID NO: 142127 - protein, 10 aa, West Nile virus
GLMVVFLATQ

SEQ ID NO: 142128 - protein, 10 aa, West Nile virus
LMVVFLATQE

SEQ ID NO: 142129 - protein, 10 aa, West Nile virus
MVVFLATQEV

SEQ ID NO: 142130 - protein, 10 aa, West Nile virus
VVFLATKEVL

SEQ ID NO: 142131 - protein, 10 aa, West Nile virus
VFLATKEVLR

SEQ ID NO: 142132 - protein, 10 aa, West Nile virus
FLATQEVLRR

SEQ ID NO: 142133 - protein, 10 aa, West Nile virus
LVTQEVLRKR

SEQ ID NO: 142134 - protein, 10 aa, West Nile virus
ATKEVLRKRW

SEQ ID NO: 142135 - protein, 10 aa, West Nile virus
TQEVLRRRWT

SEQ ID NO: 142136 - protein, 10 aa, West Nile virus
QEVLRRRWTA

SEQ ID NO: 142137 - protein, 10 aa, West Nile virus
RKRWTAKISI

SEQ ID NO: 142138 - protein, 10 aa, West Nile virus
KRWTAKISIP

SEQ ID NO: 142139 - protein, 10 aa, West Nile virus
RWTAKISIPA

SEQ ID NO: 142140 - protein, 10 aa, West Nile virus
WTAKISIPAI

SEQ ID NO: 142141 - protein, 10 aa, West Nile virus
PAIMLALLVL

SEQ ID NO: 142142 - protein, 10 aa, West Nile virus
AIMLALLVLV

SEQ ID NO: 142143 - protein, 10 aa, West Nile virus
IMLALLVLVF

SEQ ID NO: 142144 - protein, 10 aa, West Nile virus
MLALLVLVFG

SEQ ID NO: 142145 - protein, 10 aa, West Nile virus
LALLVLVFGG

SEQ ID NO: 142146 - protein, 10 aa, West Nile virus
ALLTLVFGGV

SEQ ID NO: 142147 - protein, 10 aa, West Nile virus
LLTLVFGGVT

SEQ ID NO: 142148 - protein, 10 aa, West Nile virus
LTLVFGGVTY

SEQ ID NO: 142149 - protein, 10 aa, West Nile virus
TLVFGGVTYT

SEQ ID NO: 142150 - protein, 10 aa, West Nile virus
LVFGGVTYTD

SEQ ID NO: 142151 - protein, 10 aa, West Nile virus
VFGGVTYTDL

SEQ ID NO: 142152 - protein, 10 aa, West Nile virus
FGGVTYTDLI

SEQ ID NO: 142153 - protein, 10 aa, West Nile virus
GGVTYTDLIR

SEQ ID NO: 142154 - protein, 10 aa, West Nile virus
GVTYTDLIRY

SEQ ID NO: 142155 - protein, 10 aa, West Nile virus
VTYTDLIRYV

SEQ ID NO: 142156 - protein, 10 aa, West Nile virus
TYTDLIRYVI

SEQ ID NO: 142157 - protein, 10 aa, West Nile virus
YTDLIRYVIL

SEQ ID NO: 142158 - protein, 10 aa, West Nile virus
DLIRYVILVG

SEQ ID NO: 142159 - protein, 10 aa, West Nile virus
LIRYVILVGA

SEQ ID NO: 142160 - protein, 10 aa, West Nile virus
IRYVILVGAA

SEQ ID NO: 142161 - protein, 10 aa, West Nile virus
RYVNLVGAAF

SEQ ID NO: 142162 - protein, 10 aa, West Nile virus
YVNLVGAAFA

SEQ ID NO: 142163 - protein, 10 aa, West Nile virus
VILAGAAFAE

SEQ ID NO: 142164 - protein, 10 aa, West Nile virus
ILVGAAFAEA

SEQ ID NO: 142165 - protein, 10 aa, West Nile virus
LVGAAFAEAN

SEQ ID NO: 142166 - protein, 10 aa, West Nile virus
VGAAFAEANS

SEQ ID NO: 142167 - protein, 10 aa, West Nile virus
GAAFAEANSG

SEQ ID NO: 142168 - protein, 10 aa, West Nile virus
AAFAEANSGG

SEQ ID NO: 142169 - protein, 10 aa, West Nile virus
AFAEANSGGD

SEQ ID NO: 142170 - protein, 10 aa, West Nile virus
FAEANSGGDV

SEQ ID NO: 142171 - protein, 10 aa, West Nile virus
AEANSGGDVV

SEQ ID NO: 142172 - protein, 10 aa, West Nile virus
EANSGGDVVH

SEQ ID NO: 142173 - protein, 10 aa, West Nile virus
ANSGGDVVHL

SEQ ID NO: 142174 - protein, 10 aa, West Nile virus
VHLALMATFR

SEQ ID NO: 142175 - protein, 10 aa, West Nile virus
HLALMATFKV

SEQ ID NO: 142176 - protein, 10 aa, West Nile virus
LALMATFKVQ

SEQ ID NO: 142177 - protein, 10 aa, West Nile virus
ALMATFKVQP

SEQ ID NO: 142178 - protein, 10 aa, West Nile virus
LMATFKIQPA

SEQ ID NO: 142179 - protein, 10 aa, West Nile virus
MATFKIQPAF

SEQ ID NO: 142180 - protein, 10 aa, West Nile virus
IQPVFLVASF

SEQ ID NO: 142181 - protein, 10 aa, West Nile virus
QPVFLVASFL

SEQ ID NO: 142182 - protein, 10 aa, West Nile virus
PVFLVASFLK

SEQ ID NO: 142183 - protein, 10 aa, West Nile virus
VFLVASFLKA

SEQ ID NO: 142184 - protein, 10 aa, West Nile virus
VASFLKTRWT

SEQ ID NO: 142185 - protein, 10 aa, West Nile virus
ASFLKTRWTN

SEQ ID NO: 142186 - protein, 10 aa, West Nile virus
RWTNQESILL

SEQ ID NO: 142187 - protein, 10 aa, West Nile virus
WTNQESILLM

SEQ ID NO: 142188 - protein, 10 aa, West Nile virus
TNQESILLML

SEQ ID NO: 142189 - protein, 10 aa, West Nile virus
NQESILLMLA

SEQ ID NO: 142190 - protein, 10 aa, West Nile virus
QESILLMLAA

SEQ ID NO: 142191 - protein, 10 aa, West Nile virus
ESILLMLAAA

SEQ ID NO: 142192 - protein, 10 aa, West Nile virus
SILLMLAAAF

SEQ ID NO: 142193 - protein, 10 aa, West Nile virus
ILLMLAAAFF

SEQ ID NO: 142194 - protein, 10 aa, West Nile virus
LLMLAAAFFQ

SEQ ID NO: 142195 - protein, 10 aa, West Nile virus
LMLAAAFFQM

SEQ ID NO: 142196 - protein, 10 aa, West Nile virus
MLAAAFFQMA

SEQ ID NO: 142197 - protein, 10 aa, West Nile virus
LAAAFFQMAY

SEQ ID NO: 142198 - protein, 10 aa, West Nile virus
AAAFFQMAYY

SEQ ID NO: 142199 - protein, 10 aa, West Nile virus
AAFFQMAYYD

SEQ ID NO: 142200 - protein, 10 aa, West Nile virus
AFFQMAYYDA

SEQ ID NO: 142201 - protein, 10 aa, West Nile virus
FFQMAYYDAK

SEQ ID NO: 142202 - protein, 10 aa, West Nile virus
WEVPDVLNSL

SEQ ID NO: 142203 - protein, 10 aa, West Nile virus
PDVLNSLSVA

SEQ ID NO: 142204 - protein, 10 aa, West Nile virus
DVLNSLSVAW

SEQ ID NO: 142205 - protein, 10 aa, West Nile virus
VLNSLSVAWM

SEQ ID NO: 142206 - protein, 10 aa, West Nile virus
LNSLSVAWMI

SEQ ID NO: 142207 - protein, 10 aa, West Nile virus
NSLSVAWMIL

SEQ ID NO: 142208 - protein, 10 aa, West Nile virus
SLSVAWMILR

SEQ ID NO: 142209 - protein, 10 aa, West Nile virus
LSVAWMILRA

SEQ ID NO: 142210 - protein, 10 aa, West Nile virus
SVAWMILRAI

SEQ ID NO: 142211 - protein, 10 aa, West Nile virus
VAWMILRAIS

SEQ ID NO: 142212 - protein, 10 aa, West Nile virus
AWMILRAISF

SEQ ID NO: 142213 - protein, 10 aa, West Nile virus
WMILRAISFT

SEQ ID NO: 142214 - protein, 10 aa, West Nile virus
FTNTSNVVVP

SEQ ID NO: 142215 - protein, 10 aa, West Nile virus
TNTSNVVVPL

SEQ ID NO: 142216 - protein, 10 aa, West Nile virus
NTSNVVVPLL

SEQ ID NO: 142217 - protein, 10 aa, West Nile virus
TSNVATPLLA

SEQ ID NO: 142218 - protein, 10 aa, West Nile virus
SNVATPLLAL

SEQ ID NO: 142219 - protein, 10 aa, West Nile virus
NVATPLLALL

SEQ ID NO: 142220 - protein, 10 aa, West Nile virus
VATPLLALLT

SEQ ID NO: 142221 - protein, 10 aa, West Nile virus
ATPLLALLTP

SEQ ID NO: 142222 - protein, 10 aa, West Nile virus
TPLLALLTPG

SEQ ID NO: 142223 - protein, 10 aa, West Nile virus
PLMALLTPGL

SEQ ID NO: 142224 - protein, 10 aa, West Nile virus
LLALLTPGLK

SEQ ID NO: 142225 - protein, 10 aa, West Nile virus
LALLTPGLKC

SEQ ID NO: 142226 - protein, 10 aa, West Nile virus
ALLTPGLKCL

SEQ ID NO: 142227 - protein, 10 aa, West Nile virus
LLTPGLKCLN

SEQ ID NO: 142228 - protein, 10 aa, West Nile virus
LTPGLKCLNL

SEQ ID NO: 142229 - protein, 10 aa, West Nile virus
TPGLKCLNLD

SEQ ID NO: 142230 - protein, 10 aa, West Nile virus
PGLKCLNLDV

SEQ ID NO: 142231 - protein, 10 aa, West Nile virus
GLKCLNLDVY

SEQ ID NO: 142232 - protein, 10 aa, West Nile virus
LKCLNLDVYR

SEQ ID NO: 142233 - protein, 10 aa, West Nile virus
KCLNLDVYRI

SEQ ID NO: 142234 - protein, 10 aa, West Nile virus
CLHLDIYRIL

SEQ ID NO: 142235 - protein, 10 aa, West Nile virus
LHLDIYRILL

SEQ ID NO: 142236 - protein, 10 aa, West Nile virus
HLDIYRILLL

SEQ ID NO: 142237 - protein, 10 aa, West Nile virus
LDIYRILLLM

SEQ ID NO: 142238 - protein, 10 aa, West Nile virus
DIYRILLLMV

SEQ ID NO: 142239 - protein, 10 aa, West Nile virus
IYRILLLMVG

SEQ ID NO: 142240 - protein, 10 aa, West Nile virus
YRILLLMVGV

SEQ ID NO: 142241 - protein, 10 aa, West Nile virus
RILLLMVGVG

SEQ ID NO: 142242 - protein, 10 aa, West Nile virus
ILLLMVGVGS

SEQ ID NO: 142243 - protein, 10 aa, West Nile virus
LLLMVGVGSL

SEQ ID NO: 142244 - protein, 10 aa, West Nile virus
LLMVGVGSLI

SEQ ID NO: 142245 - protein, 10 aa, West Nile virus
LMVGVGSLIK

SEQ ID NO: 142246 - protein, 10 aa, West Nile virus
MVGVGSLIKE

SEQ ID NO: 142247 - protein, 10 aa, West Nile virus
GVGSLIKEKR

SEQ ID NO: 142248 - protein, 10 aa, West Nile virus
EKRSSAAKKK

SEQ ID NO: 142249 - protein, 10 aa, West Nile virus
KRSSAAKKKG

SEQ ID NO: 142250 - protein, 10 aa, West Nile virus
RSSAAKKKGA

SEQ ID NO: 142251 - protein, 10 aa, West Nile virus
SSAAKKKGAC

SEQ ID NO: 142252 - protein, 10 aa, West Nile virus
SAAKKKGACL

SEQ ID NO: 142253 - protein, 10 aa, West Nile virus
AAKKKGACLI

SEQ ID NO: 142254 - protein, 10 aa, West Nile virus
AKKKGACLIC

SEQ ID NO: 142255 - protein, 10 aa, West Nile virus
KKKGACLICL

SEQ ID NO: 142256 - protein, 10 aa, West Nile virus
KKGACLICLA

SEQ ID NO: 142257 - protein, 10 aa, West Nile virus
KGACLICLAL

SEQ ID NO: 142258 - protein, 10 aa, West Nile virus
GACLICLALA

SEQ ID NO: 142259 - protein, 10 aa, West Nile virus
ACLICLALAS

SEQ ID NO: 142260 - protein, 10 aa, West Nile virus
CLICLALAST

SEQ ID NO: 142261 - protein, 10 aa, West Nile virus
LICLALASTG

SEQ ID NO: 142262 - protein, 10 aa, West Nile virus
FNPLILVAGL

SEQ ID NO: 142263 - protein, 10 aa, West Nile virus
NPMILAAGLM

SEQ ID NO: 142264 - protein, 10 aa, West Nile virus
LAAGLITCDP

SEQ ID NO: 142265 - protein, 10 aa, West Nile virus
AAGLITCDPN

SEQ ID NO: 142266 - protein, 10 aa, West Nile virus
AGLITCDPNR

SEQ ID NO: 142267 - protein, 10 aa, West Nile virus
GLITCDPNRK

SEQ ID NO: 142268 - protein, 10 aa, West Nile virus
LITCDPNRKR

SEQ ID NO: 142269 - protein, 10 aa, West Nile virus
ITCDPNRKRG

SEQ ID NO: 142270 - protein, 10 aa, West Nile virus
TCDPNRKRGW

SEQ ID NO: 142271 - protein, 10 aa, West Nile virus
IVGGLAELDM

SEQ ID NO: 142272 - protein, 10 aa, West Nile virus
VGGLAELDVD

SEQ ID NO: 142273 - protein, 10 aa, West Nile virus
GGLAELDMDS

SEQ ID NO: 142274 - protein, 10 aa, West Nile virus
GLAELDIDTM

SEQ ID NO: 142275 - protein, 10 aa, West Nile virus
LAELDVDSMA

SEQ ID NO: 142276 - protein, 10 aa, West Nile virus
AELDMDSMAI

SEQ ID NO: 142277 - protein, 10 aa, West Nile virus
ELDIDTMAIP

SEQ ID NO: 142278 - protein, 10 aa, West Nile virus
LDMDSMAIPM

SEQ ID NO: 142279 - protein, 10 aa, West Nile virus
DVDSMAIPMT

SEQ ID NO: 142280 - protein, 10 aa, West Nile virus
IDSMAVPMTI

SEQ ID NO: 142281 - protein, 10 aa, West Nile virus
DSMAVPMTIA

SEQ ID NO: 142282 - protein, 10 aa, West Nile virus
SMAVPMTIAG

SEQ ID NO: 142283 - protein, 10 aa, West Nile virus
PMTIAGLMFV

SEQ ID NO: 142284 - protein, 10 aa, West Nile virus
MTIAGLMFVA

SEQ ID NO: 142285 - protein, 10 aa, West Nile virus
TIAGLMFVAF

SEQ ID NO: 142286 - protein, 10 aa, West Nile virus
IAGLMFVAFV

SEQ ID NO: 142287 - protein, 10 aa, West Nile virus
AGLMFVAFVI

SEQ ID NO: 142288 - protein, 10 aa, West Nile virus
GLMFVAFVIS

SEQ ID NO: 142289 - protein, 10 aa, West Nile virus
LMFVAFVISG

SEQ ID NO: 142290 - protein, 10 aa, West Nile virus
MFVAFVISGK

SEQ ID NO: 142291 - protein, 10 aa, West Nile virus
FVAFVISGKS

SEQ ID NO: 142292 - protein, 10 aa, West Nile virus
VAFVISGKST

SEQ ID NO: 142293 - protein, 10 aa, West Nile virus
AYVITGRSTD

SEQ ID NO: 142294 - protein, 10 aa, West Nile virus
YVITGRSTDM

SEQ ID NO: 142295 - protein, 10 aa, West Nile virus
VITGRSTDMW

SEQ ID NO: 142296 - protein, 10 aa, West Nile virus
ITGRSTDMWI

SEQ ID NO: 142297 - protein, 10 aa, West Nile virus
TGRSTDMWIE

SEQ ID NO: 142298 - protein, 10 aa, West Nile virus
GRSTDMWIER

SEQ ID NO: 142299 - protein, 10 aa, West Nile virus
RSTDMWIERT

SEQ ID NO: 142300 - protein, 10 aa, West Nile virus
TDMWIERTAN

SEQ ID NO: 142301 - protein, 10 aa, West Nile virus
DMWIERTANI

SEQ ID NO: 142302 - protein, 10 aa, West Nile virus
MWIERTADIT

SEQ ID NO: 142303 - protein, 10 aa, West Nile virus
WIERTADITW

SEQ ID NO: 142304 - protein, 10 aa, West Nile virus
IERTADITWE

SEQ ID NO: 142305 - protein, 10 aa, West Nile virus
ERTADITWES

SEQ ID NO: 142306 - protein, 10 aa, West Nile virus
RTADITWESD

SEQ ID NO: 142307 - protein, 10 aa, West Nile virus
ADITWESDAE

SEQ ID NO: 142308 - protein, 10 aa, West Nile virus
DITWESDAEI

SEQ ID NO: 142309 - protein, 10 aa, West Nile virus
ITWESDAEIT

SEQ ID NO: 142310 - protein, 10 aa, West Nile virus
TWESDAEITG

SEQ ID NO: 142311 - protein, 10 aa, West Nile virus
WESDAEITGT

SEQ ID NO: 142312 - protein, 10 aa, West Nile virus
ESDAEITGTS

SEQ ID NO: 142313 - protein, 10 aa, West Nile virus
SDAEITGTSD

SEQ ID NO: 142314 - protein, 10 aa, West Nile virus
DAEITGTSDR

SEQ ID NO: 142315 - protein, 10 aa, West Nile virus
AEITGTSDRV

SEQ ID NO: 142316 - protein, 10 aa, West Nile virus
EITGTSDRVD

SEQ ID NO: 142317 - protein, 10 aa, West Nile virus
ITGTSDRVDV

SEQ ID NO: 142318 - protein, 10 aa, West Nile virus
TGTSDRVDVK

SEQ ID NO: 142319 - protein, 10 aa, West Nile virus
GTSDRVDVKL

SEQ ID NO: 142320 - protein, 10 aa, West Nile virus
TSDRVDVKLD

SEQ ID NO: 142321 - protein, 10 aa, West Nile virus
SDRVDVKLDD

SEQ ID NO: 142322 - protein, 10 aa, West Nile virus
DRVDVKLDDD

SEQ ID NO: 142323 - protein, 10 aa, West Nile virus
RVDVKLDDDG

SEQ ID NO: 142324 - protein, 10 aa, West Nile virus
VDVKLDDDGN

SEQ ID NO: 142325 - protein, 10 aa, West Nile virus
DVKLDDDGNF

SEQ ID NO: 142326 - protein, 10 aa, West Nile virus
VKLDDDGNFQ

SEQ ID NO: 142327 - protein, 10 aa, West Nile virus
KLDDDGNFQL

SEQ ID NO: 142328 - protein, 10 aa, West Nile virus
LDDDGNFQLI

SEQ ID NO: 142329 - protein, 10 aa, West Nile virus
DDDGNFQLIN

SEQ ID NO: 142330 - protein, 10 aa, West Nile virus
DDGNFQLIND

SEQ ID NO: 142331 - protein, 10 aa, West Nile virus
DGNFQLINDP

SEQ ID NO: 142332 - protein, 10 aa, West Nile virus
GNFQLINDPG

SEQ ID NO: 142333 - protein, 10 aa, West Nile virus
NFQLINDPGA

SEQ ID NO: 142334 - protein, 10 aa, West Nile virus
FQLINDPGAP

SEQ ID NO: 142335 - protein, 10 aa, West Nile virus
QLINDPGAPW

SEQ ID NO: 142336 - protein, 10 aa, West Nile virus
LINDPGAPWK

SEQ ID NO: 142337 - protein, 10 aa, West Nile virus
INDPGAPWKI

SEQ ID NO: 142338 - protein, 10 aa, West Nile virus
SDPGAPWKIW

SEQ ID NO: 142339 - protein, 10 aa, West Nile virus
DPGAPWKIWI

SEQ ID NO: 142340 - protein, 10 aa, West Nile virus
PGAPWKIWIL

SEQ ID NO: 142341 - protein, 10 aa, West Nile virus
GAPWKIWILR

SEQ ID NO: 142342 - protein, 10 aa, West Nile virus
APWKIWILRM

SEQ ID NO: 142343 - protein, 10 aa, West Nile virus
MACLAISAYT

SEQ ID NO: 142344 - protein, 10 aa, West Nile virus
ACLAISAYTP

SEQ ID NO: 142345 - protein, 10 aa, West Nile virus
CLAVSAYTPW

SEQ ID NO: 142346 - protein, 10 aa, West Nile virus
LAVSAYTPWA

SEQ ID NO: 142347 - protein, 10 aa, West Nile virus
AVSAYTPWAI

SEQ ID NO: 142348 - protein, 10 aa, West Nile virus
VSAYTPWAIL

SEQ ID NO: 142349 - protein, 10 aa, West Nile virus
YTPWAVLPSV

SEQ ID NO: 142350 - protein, 10 aa, West Nile virus
TPWAILPSVI

SEQ ID NO: 142351 - protein, 10 aa, West Nile virus
PWAILPSVIG

SEQ ID NO: 142352 - protein, 10 aa, West Nile virus
WAILPSVIGF

SEQ ID NO: 142353 - protein, 10 aa, West Nile virus
AILPSVIGFW

SEQ ID NO: 142354 - protein, 10 aa, West Nile virus
ILPSVIGFWI

SEQ ID NO: 142355 - protein, 10 aa, West Nile virus
LPSVIGFWIT

SEQ ID NO: 142356 - protein, 10 aa, West Nile virus
PSVIGFWITL

SEQ ID NO: 142357 - protein, 10 aa, West Nile virus
SVIGFWITLQ

SEQ ID NO: 142358 - protein, 10 aa, West Nile virus
VIGFWITLQY

SEQ ID NO: 142359 - protein, 10 aa, West Nile virus
IGFWITLQYT

SEQ ID NO: 142360 - protein, 10 aa, West Nile virus
GVLWDTPSPR

SEQ ID NO: 142361 - protein, 10 aa, West Nile virus
VLWDTPSPRE

SEQ ID NO: 142362 - protein, 10 aa, West Nile virus
LWDTPSPREY

SEQ ID NO: 142363 - protein, 10 aa, West Nile virus
WDTPSPREYK

SEQ ID NO: 142364 - protein, 10 aa, West Nile virus
EYKRGDTTTG

SEQ ID NO: 142365 - protein, 10 aa, West Nile virus
YKRGDTTTGV

SEQ ID NO: 142366 - protein, 10 aa, West Nile virus
KRGDTTTGVY

SEQ ID NO: 142367 - protein, 10 aa, West Nile virus
RGDTTTGVYR

SEQ ID NO: 142368 - protein, 10 aa, West Nile virus
GVYRIMTRGI

SEQ ID NO: 142369 - protein, 10 aa, West Nile virus
VYRIMTRGIL

SEQ ID NO: 142370 - protein, 10 aa, West Nile virus
YRIMTRGILG

SEQ ID NO: 142371 - protein, 10 aa, West Nile virus
RIMTRGILGS

SEQ ID NO: 142372 - protein, 10 aa, West Nile virus
IMTRGILGSY

SEQ ID NO: 142373 - protein, 10 aa, West Nile virus
MTRGILGSYQ

SEQ ID NO: 142374 - protein, 10 aa, West Nile virus
TRGILGSYQA

SEQ ID NO: 142375 - protein, 10 aa, West Nile virus
RGILGSYQAG

SEQ ID NO: 142376 - protein, 10 aa, West Nile virus
GILGSYQAGV

SEQ ID NO: 142377 - protein, 10 aa, West Nile virus
ILGSYQAGVG

SEQ ID NO: 142378 - protein, 10 aa, West Nile virus
LGSYQAGVGV

SEQ ID NO: 142379 - protein, 10 aa, West Nile virus
GSYQAGVGVM

SEQ ID NO: 142380 - protein, 10 aa, West Nile virus
SYQAGVGVMV

SEQ ID NO: 142381 - protein, 10 aa, West Nile virus
YQAGVGVMVE

SEQ ID NO: 142382 - protein, 10 aa, West Nile virus
QAGVGVMVEG

SEQ ID NO: 142383 - protein, 10 aa, West Nile virus
AGVGVMVEGV

SEQ ID NO: 142384 - protein, 10 aa, West Nile virus
GVGVMVEGVF

SEQ ID NO: 142385 - protein, 10 aa, West Nile virus
VGVMVEGVFH

SEQ ID NO: 142386 - protein, 10 aa, West Nile virus
TKGAALMSGT

SEQ ID NO: 142387 - protein, 10 aa, West Nile virus
KGAALMSGTG

SEQ ID NO: 142388 - protein, 10 aa, West Nile virus
GAALMSGTGR

SEQ ID NO: 142389 - protein, 10 aa, West Nile virus
AALMSGTGRL

SEQ ID NO: 142390 - protein, 10 aa, West Nile virus
ALMSGTGRLD

SEQ ID NO: 142391 - protein, 10 aa, West Nile virus
LMSGTGRLDP

SEQ ID NO: 142392 - protein, 10 aa, West Nile virus
MSGTGRLDPY

SEQ ID NO: 142393 - protein, 10 aa, West Nile virus
SGTGRLDPYW

SEQ ID NO: 142394 - protein, 10 aa, West Nile virus
GTGRLDPYWG

SEQ ID NO: 142395 - protein, 10 aa, West Nile virus
TGRLDPYWGS

SEQ ID NO: 142396 - protein, 10 aa, West Nile virus
RLDPYWGSVR

SEQ ID NO: 142397 - protein, 10 aa, West Nile virus
LDPYWGSVRE

SEQ ID NO: 142398 - protein, 10 aa, West Nile virus
DPYWGSVRED

SEQ ID NO: 142399 - protein, 10 aa, West Nile virus
PYWGSVREDR

SEQ ID NO: 142400 - protein, 10 aa, West Nile virus
YWGSVREDRL

SEQ ID NO: 142401 - protein, 10 aa, West Nile virus
WGSVREDRLC

SEQ ID NO: 142402 - protein, 10 aa, West Nile virus
GSVREDRLCY

SEQ ID NO: 142403 - protein, 10 aa, West Nile virus
SVREDRLCYG

SEQ ID NO: 142404 - protein, 10 aa, West Nile virus
VREDRLCYGG

SEQ ID NO: 142405 - protein, 10 aa, West Nile virus
REDRLCYGGP

SEQ ID NO: 142406 - protein, 10 aa, West Nile virus
CYGGPWKLQR

SEQ ID NO: 142407 - protein, 10 aa, West Nile virus
YGGPWKLQRK

SEQ ID NO: 142408 - protein, 10 aa, West Nile virus
GGPWKLQRKW

SEQ ID NO: 142409 - protein, 10 aa, West Nile virus
GPWKLQRKWN

SEQ ID NO: 142410 - protein, 10 aa, West Nile virus
PWKLQRKWNG

SEQ ID NO: 142411 - protein, 10 aa, West Nile virus
WKLQHKWNGH

SEQ ID NO: 142412 - protein, 10 aa, West Nile virus
KLQHKWNGHD

SEQ ID NO: 142413 - protein, 10 aa, West Nile virus
LQHKWNGHDE

SEQ ID NO: 142414 - protein, 10 aa, West Nile virus
QHKWNGHDEV

SEQ ID NO: 142415 - protein, 10 aa, West Nile virus
HKWNGHDEVQ

SEQ ID NO: 142416 - protein, 10 aa, West Nile virus
KWNGHDEVQM

SEQ ID NO: 142417 - protein, 10 aa, West Nile virus
WNGHDEVQMI

SEQ ID NO: 142418 - protein, 10 aa, West Nile virus
NGHDEVQMIV

SEQ ID NO: 142419 - protein, 10 aa, West Nile virus
GHDEVQMIVV

SEQ ID NO: 142420 - protein, 10 aa, West Nile virus
HDEVQMIVVE

SEQ ID NO: 142421 - protein, 10 aa, West Nile virus
DEVQMIVAEP

SEQ ID NO: 142422 - protein, 10 aa, West Nile virus
EVQMIVAEPG

SEQ ID NO: 142423 - protein, 10 aa, West Nile virus
VQMIVAEPGR

SEQ ID NO: 142424 - protein, 10 aa, West Nile virus
QMIVAEPGRN

SEQ ID NO: 142425 - protein, 10 aa, West Nile virus
MIVAEPGRNT

SEQ ID NO: 142426 - protein, 10 aa, West Nile virus
IVAEPGRNTR

SEQ ID NO: 142427 - protein, 10 aa, West Nile virus
VAEPGRNTRN

SEQ ID NO: 142428 - protein, 10 aa, West Nile virus
AEPGRNTRNV

SEQ ID NO: 142429 - protein, 10 aa, West Nile virus
EPGRNTRNVQ

SEQ ID NO: 142430 - protein, 10 aa, West Nile virus
PGRNTRNVQT

SEQ ID NO: 142431 - protein, 10 aa, West Nile virus
GRNTRNVQTK

SEQ ID NO: 142432 - protein, 10 aa, West Nile virus
RNTRNVQTKP

SEQ ID NO: 142433 - protein, 10 aa, West Nile virus
NTRNVQTKPG

SEQ ID NO: 142434 - protein, 10 aa, West Nile virus
TRNVQTKPGV

SEQ ID NO: 142435 - protein, 10 aa, West Nile virus
RNVQTKPGVF

SEQ ID NO: 142436 - protein, 10 aa, West Nile virus
TKPGVFKTPD

SEQ ID NO: 142437 - protein, 10 aa, West Nile virus
KPGVFKTPDG

SEQ ID NO: 142438 - protein, 10 aa, West Nile virus
PGVFKTPDGE

SEQ ID NO: 142439 - protein, 10 aa, West Nile virus
GVFKTPDGEI

SEQ ID NO: 142440 - protein, 10 aa, West Nile virus
VFKTPDGEIG

SEQ ID NO: 142441 - protein, 10 aa, West Nile virus
FKTPDGEIGA

SEQ ID NO: 142442 - protein, 10 aa, West Nile virus
KTPDGEIGAV

SEQ ID NO: 142443 - protein, 10 aa, West Nile virus
TPDGEIGAVT

SEQ ID NO: 142444 - protein, 10 aa, West Nile virus
PDGEIGAVTL

SEQ ID NO: 142445 - protein, 10 aa, West Nile virus
DGEIGAVTLD

SEQ ID NO: 142446 - protein, 10 aa, West Nile virus
GEIGAVTLDY

SEQ ID NO: 142447 - protein, 10 aa, West Nile virus
EIGAVTLDYP

SEQ ID NO: 142448 - protein, 10 aa, West Nile virus
IGAVTLDYPT

SEQ ID NO: 142449 - protein, 10 aa, West Nile virus
GAVTLDYPTG

SEQ ID NO: 142450 - protein, 10 aa, West Nile virus
AVTLDYPTGT

SEQ ID NO: 142451 - protein, 10 aa, West Nile virus
VTLDYPTGTS

SEQ ID NO: 142452 - protein, 10 aa, West Nile virus
TLDYPTGTSG

SEQ ID NO: 142453 - protein, 10 aa, West Nile virus
LDYPTGTSGS

SEQ ID NO: 142454 - protein, 10 aa, West Nile virus
DYPTGTSGSP

SEQ ID NO: 142455 - protein, 10 aa, West Nile virus
YPTGTSGSPI

SEQ ID NO: 142456 - protein, 10 aa, West Nile virus
GTSGSPIVDR

SEQ ID NO: 142457 - protein, 10 aa, West Nile virus
TSGSPIVDRN

SEQ ID NO: 142458 - protein, 10 aa, West Nile virus
SGSPIVDRNG

SEQ ID NO: 142459 - protein, 10 aa, West Nile virus
GSPIVDRNGD

SEQ ID NO: 142460 - protein, 10 aa, West Nile virus
SPIVDRNGDV

SEQ ID NO: 142461 - protein, 10 aa, West Nile virus
PIVDRNGDVI

SEQ ID NO: 142462 - protein, 10 aa, West Nile virus
IVDRNGDVIG

SEQ ID NO: 142463 - protein, 10 aa, West Nile virus
VDRNGDVIGL

SEQ ID NO: 142464 - protein, 10 aa, West Nile virus
DRNGDVIGLY

SEQ ID NO: 142465 - protein, 10 aa, West Nile virus
RNGDVIGLYG

SEQ ID NO: 142466 - protein, 10 aa, West Nile virus
SGDVIGLYGN

SEQ ID NO: 142467 - protein, 10 aa, West Nile virus
LYGNGVIMPS

SEQ ID NO: 142468 - protein, 10 aa, West Nile virus
YGNGVIMPSG

SEQ ID NO: 142469 - protein, 10 aa, West Nile virus
GNGVIMPNGA

SEQ ID NO: 142470 - protein, 10 aa, West Nile virus
NGVIMPNGAY

SEQ ID NO: 142471 - protein, 10 aa, West Nile virus
GVIMPNGAYI

SEQ ID NO: 142472 - protein, 10 aa, West Nile virus
VIMPNGAYIS

SEQ ID NO: 142473 - protein, 10 aa, West Nile virus
IMPNGAYISA

SEQ ID NO: 142474 - protein, 10 aa, West Nile virus
MPNGAYISAI

SEQ ID NO: 142475 - protein, 10 aa, West Nile virus
PNGAYISAIV

SEQ ID NO: 142476 - protein, 10 aa, West Nile virus
NGAYISAIVQ

SEQ ID NO: 142477 - protein, 10 aa, West Nile virus
GAYISAIVQG

SEQ ID NO: 142478 - protein, 10 aa, West Nile virus
AYISAIVQGE

SEQ ID NO: 142479 - protein, 10 aa, West Nile virus
SAIVQGERME

SEQ ID NO: 142480 - protein, 10 aa, West Nile virus
AIVQGERMEE

SEQ ID NO: 142481 - protein, 10 aa, West Nile virus
IVQGERMEEP

SEQ ID NO: 142482 - protein, 10 aa, West Nile virus
VQGERMEEPA

SEQ ID NO: 142483 - protein, 10 aa, West Nile virus
QGERMEEPAP

SEQ ID NO: 142484 - protein, 10 aa, West Nile virus
GERMEEPAPA

SEQ ID NO: 142485 - protein, 10 aa, West Nile virus
ERMEEPAPAG

SEQ ID NO: 142486 - protein, 10 aa, West Nile virus
RMEEPAPAGF

SEQ ID NO: 142487 - protein, 10 aa, West Nile virus
GFEPDMLRKK

SEQ ID NO: 142488 - protein, 10 aa, West Nile virus
FEPDMLRKKQ

SEQ ID NO: 142489 - protein, 10 aa, West Nile virus
EPDMLRKKQI

SEQ ID NO: 142490 - protein, 10 aa, West Nile virus
PDMLRKKQIT

SEQ ID NO: 142491 - protein, 10 aa, West Nile virus
DMLRKKQITV

SEQ ID NO: 142492 - protein, 10 aa, West Nile virus
TLKKKQITVL

SEQ ID NO: 142493 - protein, 10 aa, West Nile virus
LKKKQITVLD

SEQ ID NO: 142494 - protein, 10 aa, West Nile virus
RKKKITVLDL

SEQ ID NO: 142495 - protein, 10 aa, West Nile virus
KKQISVLDLH

SEQ ID NO: 142496 - protein, 10 aa, West Nile virus
KKITVLDLHP

SEQ ID NO: 142497 - protein, 10 aa, West Nile virus
QITVLDLHPD

SEQ ID NO: 142498 - protein, 10 aa, West Nile virus
ISVLDLHPGA

SEQ ID NO: 142499 - protein, 10 aa, West Nile virus
SVLDLHPGAG

SEQ ID NO: 142500 - protein, 10 aa, West Nile virus
LHPGAGKTRK

SEQ ID NO: 142501 - protein, 10 aa, West Nile virus
HPGAGKTRKI

SEQ ID NO: 142502 - protein, 10 aa, West Nile virus
PGAGKTRKIL

SEQ ID NO: 142503 - protein, 10 aa, West Nile virus
GAGKTRKILP

SEQ ID NO: 142504 - protein, 10 aa, West Nile virus
AGKTRKILPQ

SEQ ID NO: 142505 - protein, 10 aa, West Nile virus
GKTRKILPQI

SEQ ID NO: 142506 - protein, 10 aa, West Nile virus
KTRKILPQII

SEQ ID NO: 142507 - protein, 10 aa, West Nile virus
TRKILPQIIK

SEQ ID NO: 142508 - protein, 10 aa, West Nile virus
RKILPQIIKE

SEQ ID NO: 142509 - protein, 10 aa, West Nile virus
KILPQIIKEA

SEQ ID NO: 142510 - protein, 10 aa, West Nile virus
ILPQIIREAI

SEQ ID NO: 142511 - protein, 10 aa, West Nile virus
LPQIIREAIN

SEQ ID NO: 142512 - protein, 10 aa, West Nile virus
PQIIKEAINK

SEQ ID NO: 142513 - protein, 10 aa, West Nile virus
QIIKEAINKR

SEQ ID NO: 142514 - protein, 10 aa, West Nile virus
IIKEAINKRL

SEQ ID NO: 142515 - protein, 10 aa, West Nile virus
IKEAINKRLR

SEQ ID NO: 142516 - protein, 10 aa, West Nile virus
KEAINKRLRT

SEQ ID NO: 142517 - protein, 10 aa, West Nile virus
EAINKRLRTA

SEQ ID NO: 142518 - protein, 10 aa, West Nile virus
NKRLRTAVLA

SEQ ID NO: 142519 - protein, 10 aa, West Nile virus
KRLRTAVLAP

SEQ ID NO: 142520 - protein, 10 aa, West Nile virus
RLRTAILAPT

SEQ ID NO: 142521 - protein, 10 aa, West Nile virus
LRTAILAPTR

SEQ ID NO: 142522 - protein, 10 aa, West Nile virus
RTAILAPTRV

SEQ ID NO: 142523 - protein, 10 aa, West Nile virus
TAILAPTRVV

SEQ ID NO: 142524 - protein, 10 aa, West Nile virus
AILAPTRVVA

SEQ ID NO: 142525 - protein, 10 aa, West Nile virus
ILAPTRVVAS

SEQ ID NO: 142526 - protein, 10 aa, West Nile virus
LAPTRVVASE

SEQ ID NO: 142527 - protein, 10 aa, West Nile virus
APTRVVASEM

SEQ ID NO: 142528 - protein, 10 aa, West Nile virus
PTRVVAAEMS

SEQ ID NO: 142529 - protein, 10 aa, West Nile virus
TRVVAAEMSE

SEQ ID NO: 142530 - protein, 10 aa, West Nile virus
RVVAAEMSEA

SEQ ID NO: 142531 - protein, 10 aa, West Nile virus
VVAAEMSEAL

SEQ ID NO: 142532 - protein, 10 aa, West Nile virus
VAAEMSEALR

SEQ ID NO: 142533 - protein, 10 aa, West Nile virus
AAEMSEALRG

SEQ ID NO: 142534 - protein, 10 aa, West Nile virus
AEMSEALRGL

SEQ ID NO: 142535 - protein, 10 aa, West Nile virus
EMSEALRGLP

SEQ ID NO: 142536 - protein, 10 aa, West Nile virus
MSEALRGLPI

SEQ ID NO: 142537 - protein, 10 aa, West Nile virus
SEALRGLPIR

SEQ ID NO: 142538 - protein, 10 aa, West Nile virus
PIRYQTSAVH

SEQ ID NO: 142539 - protein, 10 aa, West Nile virus
IRYQTSAVHR

SEQ ID NO: 142540 - protein, 10 aa, West Nile virus
RYQTSAVHRE

SEQ ID NO: 142541 - protein, 10 aa, West Nile virus
YQTSAVHREH

SEQ ID NO: 142542 - protein, 10 aa, West Nile virus
REHSGNEIVD

SEQ ID NO: 142543 - protein, 10 aa, West Nile virus
EHSGNEIVDV

SEQ ID NO: 142544 - protein, 10 aa, West Nile virus
HSGNEIVDVM

SEQ ID NO: 142545 - protein, 10 aa, West Nile virus
SGNEIVDVMC

SEQ ID NO: 142546 - protein, 10 aa, West Nile virus
HRVPNYNLFI

SEQ ID NO: 142547 - protein, 10 aa, West Nile virus
RVPNYNLFIM

SEQ ID NO: 142548 - protein, 10 aa, West Nile virus
VPNYNLFIMD

SEQ ID NO: 142549 - protein, 10 aa, West Nile virus
PNYNLFIMDE

SEQ ID NO: 142550 - protein, 10 aa, West Nile virus
NYNLFIMDEA

SEQ ID NO: 142551 - protein, 10 aa, West Nile virus
YNLFIMDEAH

SEQ ID NO: 142552 - protein, 10 aa, West Nile virus
NLFIMDEAHF

SEQ ID NO: 142553 - protein, 10 aa, West Nile virus
LFIMDEAHFT

SEQ ID NO: 142554 - protein, 10 aa, West Nile virus
FIMDEAHFTD

SEQ ID NO: 142555 - protein, 10 aa, West Nile virus
IMDEAHFTDP

SEQ ID NO: 142556 - protein, 10 aa, West Nile virus
ASIAARGYIA

SEQ ID NO: 142557 - protein, 10 aa, West Nile virus
SIAARGYIAT

SEQ ID NO: 142558 - protein, 10 aa, West Nile virus
IAARGYIATK

SEQ ID NO: 142559 - protein, 10 aa, West Nile virus
AARGYIATKV

SEQ ID NO: 142560 - protein, 10 aa, West Nile virus
ARGYIATKVE

SEQ ID NO: 142561 - protein, 10 aa, West Nile virus
RGYIATKVEL

SEQ ID NO: 142562 - protein, 10 aa, West Nile virus
GYIATKVELG

SEQ ID NO: 142563 - protein, 10 aa, West Nile virus
YIATKVELGE

SEQ ID NO: 142564 - protein, 10 aa, West Nile virus
IATKVELGEA

SEQ ID NO: 142565 - protein, 10 aa, West Nile virus
ATKVELGEAA

SEQ ID NO: 142566 - protein, 10 aa, West Nile virus
TRVELGEAAA

SEQ ID NO: 142567 - protein, 10 aa, West Nile virus
RVELGEAAAI

SEQ ID NO: 142568 - protein, 10 aa, West Nile virus
FMTATPPGTH

SEQ ID NO: 142569 - protein, 10 aa, West Nile virus
MTATPPGTHD

SEQ ID NO: 142570 - protein, 10 aa, West Nile virus
TATPPGTHDP

SEQ ID NO: 142571 - protein, 10 aa, West Nile virus
ATPPGTHDPF

SEQ ID NO: 142572 - protein, 10 aa, West Nile virus
TPPGTHDPFP

SEQ ID NO: 142573 - protein, 10 aa, West Nile virus
PPGTHDPFPE

SEQ ID NO: 142574 - protein, 10 aa, West Nile virus
PGSSDPFPES

SEQ ID NO: 142575 - protein, 10 aa, West Nile virus
GTHDPFPESN

SEQ ID NO: 142576 - protein, 10 aa, West Nile virus
TSDPFPESNA

SEQ ID NO: 142577 - protein, 10 aa, West Nile virus
SDPFPESNAP

SEQ ID NO: 142578 - protein, 10 aa, West Nile virus
DPFPESNAPI

SEQ ID NO: 142579 - protein, 10 aa, West Nile virus
DMQTEIPDRA

SEQ ID NO: 142580 - protein, 10 aa, West Nile virus
MQTEIPDRAW

SEQ ID NO: 142581 - protein, 10 aa, West Nile virus
TEIPDRAWNT

SEQ ID NO: 142582 - protein, 10 aa, West Nile virus
EIPDRAWNTG

SEQ ID NO: 142583 - protein, 10 aa, West Nile virus
IPDRAWNTGY

SEQ ID NO: 142584 - protein, 10 aa, West Nile virus
PDRAWNTGYE

SEQ ID NO: 142585 - protein, 10 aa, West Nile virus
DRAWNTGYEW

SEQ ID NO: 142586 - protein, 10 aa, West Nile virus
RAWNTGYEWI

SEQ ID NO: 142587 - protein, 10 aa, West Nile virus
AWNTGYEWIT

SEQ ID NO: 142588 - protein, 10 aa, West Nile virus
WNTGYEWITE

SEQ ID NO: 142589 - protein, 10 aa, West Nile virus
NTGYEWITEY

SEQ ID NO: 142590 - protein, 10 aa, West Nile virus
SGYEWITEYI

SEQ ID NO: 142591 - protein, 10 aa, West Nile virus
GYEWITEYIG

SEQ ID NO: 142592 - protein, 10 aa, West Nile virus
YEWITEYIGK

SEQ ID NO: 142593 - protein, 10 aa, West Nile virus
EWITEYIGKT

SEQ ID NO: 142594 - protein, 10 aa, West Nile virus
WITEYIGKTV

SEQ ID NO: 142595 - protein, 10 aa, West Nile virus
ITEYIGKTVW

SEQ ID NO: 142596 - protein, 10 aa, West Nile virus
TEYIGKTVWF

SEQ ID NO: 142597 - protein, 10 aa, West Nile virus
EYIGKTVWFV

SEQ ID NO: 142598 - protein, 10 aa, West Nile virus
YIGKTVWFVP

SEQ ID NO: 142599 - protein, 10 aa, West Nile virus
IGKTVWFVPS

SEQ ID NO: 142600 - protein, 10 aa, West Nile virus
KTVWFVPSVR

SEQ ID NO: 142601 - protein, 10 aa, West Nile virus
TVWFVPSVRM

SEQ ID NO: 142602 - protein, 10 aa, West Nile virus
VWFVPSVRMG

SEQ ID NO: 142603 - protein, 10 aa, West Nile virus
WFVPSVRMGN

SEQ ID NO: 142604 - protein, 10 aa, West Nile virus
FVPSVRMGNE

SEQ ID NO: 142605 - protein, 10 aa, West Nile virus
VPSVRMGNEM

SEQ ID NO: 142606 - protein, 10 aa, West Nile virus
PSVRMGNEMA

SEQ ID NO: 142607 - protein, 10 aa, West Nile virus
SVRMGNEMAQ

SEQ ID NO: 142608 - protein, 10 aa, West Nile virus
VRMGNEMAQC

SEQ ID NO: 142609 - protein, 10 aa, West Nile virus
RMGNEMAQCL

SEQ ID NO: 142610 - protein, 10 aa, West Nile virus
MGNEMAQCLQ

SEQ ID NO: 142611 - protein, 10 aa, West Nile virus
GNEMAQCLQR

SEQ ID NO: 142612 - protein, 10 aa, West Nile virus
NEMAQCLQRA

SEQ ID NO: 142613 - protein, 10 aa, West Nile virus
EMAQCLQRAG

SEQ ID NO: 142614 - protein, 10 aa, West Nile virus
MAQCLQRAGK

SEQ ID NO: 142615 - protein, 10 aa, West Nile virus
AQCLQRAGKK

SEQ ID NO: 142616 - protein, 10 aa, West Nile virus
QCLQRAGKKV

SEQ ID NO: 142617 - protein, 10 aa, West Nile virus
CLQRAGKKVI

SEQ ID NO: 142618 - protein, 10 aa, West Nile virus
LQRAGKKVIQ

SEQ ID NO: 142619 - protein, 10 aa, West Nile virus
QRAGKKVIQL

SEQ ID NO: 142620 - protein, 10 aa, West Nile virus
RAGKKVIQLN

SEQ ID NO: 142621 - protein, 10 aa, West Nile virus
AGKKVIQLNR

SEQ ID NO: 142622 - protein, 10 aa, West Nile virus
GKKVIQLNRK

SEQ ID NO: 142623 - protein, 10 aa, West Nile virus
KKVIQLNRKS

SEQ ID NO: 142624 - protein, 10 aa, West Nile virus
KVIQLNRKSY

SEQ ID NO: 142625 - protein, 10 aa, West Nile virus
VIQLNRKSYE

SEQ ID NO: 142626 - protein, 10 aa, West Nile virus
IQLNRKSYET

SEQ ID NO: 142627 - protein, 10 aa, West Nile virus
CKNDDWDFVV

SEQ ID NO: 142628 - protein, 10 aa, West Nile virus
KNDDWDFVVT

SEQ ID NO: 142629 - protein, 10 aa, West Nile virus
NDDWDFVVTT

SEQ ID NO: 142630 - protein, 10 aa, West Nile virus
DDWDFVVTTD

SEQ ID NO: 142631 - protein, 10 aa, West Nile virus
DWDFVVTTDI

SEQ ID NO: 142632 - protein, 10 aa, West Nile virus
WDFVVTTDIS

SEQ ID NO: 142633 - protein, 10 aa, West Nile virus
DFVVTTDISE

SEQ ID NO: 142634 - protein, 10 aa, West Nile virus
FVVTTDISEM

SEQ ID NO: 142635 - protein, 10 aa, West Nile virus
VVTTDISEMG

SEQ ID NO: 142636 - protein, 10 aa, West Nile virus
VTTDISEMGA

SEQ ID NO: 142637 - protein, 10 aa, West Nile virus
DISEMGANFR

SEQ ID NO: 142638 - protein, 10 aa, West Nile virus
ISEMGANFRA

SEQ ID NO: 142639 - protein, 10 aa, West Nile virus
SEMGANFKAN

SEQ ID NO: 142640 - protein, 10 aa, West Nile virus
EMGANFRASR

SEQ ID NO: 142641 - protein, 10 aa, West Nile virus
MGANFRASRV

SEQ ID NO: 142642 - protein, 10 aa, West Nile virus
GANFKANRVI

SEQ ID NO: 142643 - protein, 10 aa, West Nile virus
ANFRASRVID

SEQ ID NO: 142644 - protein, 10 aa, West Nile virus
NFRASRVIDS

SEQ ID NO: 142645 - protein, 10 aa, West Nile virus
FKANRVIDSR

SEQ ID NO: 142646 - protein, 10 aa, West Nile virus
RASRVIDSRK

SEQ ID NO: 142647 - protein, 10 aa, West Nile virus
ANRVIDSRKS

SEQ ID NO: 142648 - protein, 10 aa, West Nile virus
NRVIDSRKSV

SEQ ID NO: 142649 - protein, 10 aa, West Nile virus
DSRKSVKPII

SEQ ID NO: 142650 - protein, 10 aa, West Nile virus
SRKSVKPTSI

SEQ ID NO: 142651 - protein, 10 aa, West Nile virus
RKSVKPTIIE

SEQ ID NO: 142652 - protein, 10 aa, West Nile virus
KSVKPTIIEE

SEQ ID NO: 142653 - protein, 10 aa, West Nile virus
SVKPTIIEEG

SEQ ID NO: 142654 - protein, 10 aa, West Nile virus
VKPTIIEEGD

SEQ ID NO: 142655 - protein, 10 aa, West Nile virus
IEEGDGRVIL

SEQ ID NO: 142656 - protein, 10 aa, West Nile virus
EEGDGRVILG

SEQ ID NO: 142657 - protein, 10 aa, West Nile virus
EGDGRVILGE

SEQ ID NO: 142658 - protein, 10 aa, West Nile virus
GDGRVILGEP

SEQ ID NO: 142659 - protein, 10 aa, West Nile virus
DGRVILGEPS

SEQ ID NO: 142660 - protein, 10 aa, West Nile virus
NRVVLGEPSA

SEQ ID NO: 142661 - protein, 10 aa, West Nile virus
RVILGEPSAI

SEQ ID NO: 142662 - protein, 10 aa, West Nile virus
VILGEPSAIT

SEQ ID NO: 142663 - protein, 10 aa, West Nile virus
ILGEPSAITA

SEQ ID NO: 142664 - protein, 10 aa, West Nile virus
LGEPSAITAA

SEQ ID NO: 142665 - protein, 10 aa, West Nile virus
GEPSAITAAS

SEQ ID NO: 142666 - protein, 10 aa, West Nile virus
EPSAITAASA

SEQ ID NO: 142667 - protein, 10 aa, West Nile virus
PSAITAASAA

SEQ ID NO: 142668 - protein, 10 aa, West Nile virus
SAITAASAAQ

SEQ ID NO: 142669 - protein, 10 aa, West Nile virus
AITAASAAQR

SEQ ID NO: 142670 - protein, 10 aa, West Nile virus
ITAASAAQRR

SEQ ID NO: 142671 - protein, 10 aa, West Nile virus
ASAAQRRGRT

SEQ ID NO: 142672 - protein, 10 aa, West Nile virus
SAAQRRGRTG

SEQ ID NO: 142673 - protein, 10 aa, West Nile virus
AAQRRGRTGR

SEQ ID NO: 142674 - protein, 10 aa, West Nile virus
AQRRGRTGRN

SEQ ID NO: 142675 - protein, 10 aa, West Nile virus
QRRGRIGRNS

SEQ ID NO: 142676 - protein, 10 aa, West Nile virus
RRGRIGRNSS

SEQ ID NO: 142677 - protein, 10 aa, West Nile virus
RGRIGRNSSQ

SEQ ID NO: 142678 - protein, 10 aa, West Nile virus
GRIGRNSSQV

SEQ ID NO: 142679 - protein, 10 aa, West Nile virus
RIGRNSSQVG

SEQ ID NO: 142680 - protein, 10 aa, West Nile virus
IGRNSSQVGD

SEQ ID NO: 142681 - protein, 10 aa, West Nile virus
GRNSSQVGDE

SEQ ID NO: 142682 - protein, 10 aa, West Nile virus
RNSSQVGDEY

SEQ ID NO: 142683 - protein, 10 aa, West Nile virus
NSSQVGDEYC

SEQ ID NO: 142684 - protein, 10 aa, West Nile virus
SSQVGDEYCY

SEQ ID NO: 142685 - protein, 10 aa, West Nile virus
SQAGDEYCYG

SEQ ID NO: 142686 - protein, 10 aa, West Nile virus
GHTNEDDSNC

SEQ ID NO: 142687 - protein, 10 aa, West Nile virus
HTNEDDSNCA

SEQ ID NO: 142688 - protein, 10 aa, West Nile virus
TNEDDSNLAH

SEQ ID NO: 142689 - protein, 10 aa, West Nile virus
NEDDSNYAHW

SEQ ID NO: 142690 - protein, 10 aa, West Nile virus
EDDSNLAHWT

SEQ ID NO: 142691 - protein, 10 aa, West Nile virus
DDSNYAHWTE

SEQ ID NO: 142692 - protein, 10 aa, West Nile virus
DSNYAHWTEA

SEQ ID NO: 142693 - protein, 10 aa, West Nile virus
SNLAHWTEAR

SEQ ID NO: 142694 - protein, 10 aa, West Nile virus
NLAHWTEARI

SEQ ID NO: 142695 - protein, 10 aa, West Nile virus
LAHWTEARIM

SEQ ID NO: 142696 - protein, 10 aa, West Nile virus
IMLDNINMPS

SEQ ID NO: 142697 - protein, 10 aa, West Nile virus
MPDNINMPNG

SEQ ID NO: 142698 - protein, 10 aa, West Nile virus
PDNINMPNGL

SEQ ID NO: 142699 - protein, 10 aa, West Nile virus
DNINMPNGLV

SEQ ID NO: 142700 - protein, 10 aa, West Nile virus
NINMPNGLVA

SEQ ID NO: 142701 - protein, 10 aa, West Nile virus
INMPNGLVAQ

SEQ ID NO: 142702 - protein, 10 aa, West Nile virus
NMPNGLVAQL

SEQ ID NO: 142703 - protein, 10 aa, West Nile virus
MPNGLVAQLY

SEQ ID NO: 142704 - protein, 10 aa, West Nile virus
PNGLVAQLYQ

SEQ ID NO: 142705 - protein, 10 aa, West Nile virus
NGLVAQLYQP

SEQ ID NO: 142706 - protein, 10 aa, West Nile virus
GLVAQLYQPE

SEQ ID NO: 142707 - protein, 10 aa, West Nile virus
LVAQLYQPER

SEQ ID NO: 142708 - protein, 10 aa, West Nile virus
VAQLYQPERE

SEQ ID NO: 142709 - protein, 10 aa, West Nile virus
AQLYQPEREK

SEQ ID NO: 142710 - protein, 10 aa, West Nile virus
QLYQPEREKV

SEQ ID NO: 142711 - protein, 10 aa, West Nile virus
LYQPEREKVY

SEQ ID NO: 142712 - protein, 10 aa, West Nile virus
YQPEREKVCT

SEQ ID NO: 142713 - protein, 10 aa, West Nile virus
QPEREKVCTM

SEQ ID NO: 142714 - protein, 10 aa, West Nile virus
PEREKVHTMD

SEQ ID NO: 142715 - protein, 10 aa, West Nile virus
EREKVHTMDG

SEQ ID NO: 142716 - protein, 10 aa, West Nile virus
REKVHTMDGE

SEQ ID NO: 142717 - protein, 10 aa, West Nile virus
EKVYTMEGEY

SEQ ID NO: 142718 - protein, 10 aa, West Nile virus
KVYTMDGEYK

SEQ ID NO: 142719 - protein, 10 aa, West Nile virus
VYTMDGEYKL

SEQ ID NO: 142720 - protein, 10 aa, West Nile virus
YTMDGEYKLR

SEQ ID NO: 142721 - protein, 10 aa, West Nile virus
TMDGEYKLRG

SEQ ID NO: 142722 - protein, 10 aa, West Nile virus
MDGEYKLRGE

SEQ ID NO: 142723 - protein, 10 aa, West Nile virus
DGEYKLRGEE

SEQ ID NO: 142724 - protein, 10 aa, West Nile virus
GEYKLRGEER

SEQ ID NO: 142725 - protein, 10 aa, West Nile virus
EYKLRGEERK

SEQ ID NO: 142726 - protein, 10 aa, West Nile virus
YKLRGEERKN

SEQ ID NO: 142727 - protein, 10 aa, West Nile virus
KLRGEERKNF

SEQ ID NO: 142728 - protein, 10 aa, West Nile virus
GEERKNFLEF

SEQ ID NO: 142729 - protein, 10 aa, West Nile virus
EERKNFLEFL

SEQ ID NO: 142730 - protein, 10 aa, West Nile virus
ERKNFLEFLR

SEQ ID NO: 142731 - protein, 10 aa, West Nile virus
RKNFLEFLRT

SEQ ID NO: 142732 - protein, 10 aa, West Nile virus
KNFLEFLRTA

SEQ ID NO: 142733 - protein, 10 aa, West Nile virus
NFLEFLRTAD

SEQ ID NO: 142734 - protein, 10 aa, West Nile virus
FLEFLRTADL

SEQ ID NO: 142735 - protein, 10 aa, West Nile virus
LEFLRTADLP

SEQ ID NO: 142736 - protein, 10 aa, West Nile virus
EFLRTADLPV

SEQ ID NO: 142737 - protein, 10 aa, West Nile virus
FLRTADLPVW

SEQ ID NO: 142738 - protein, 10 aa, West Nile virus
ADLPVWLAYQ

SEQ ID NO: 142739 - protein, 10 aa, West Nile virus
DLPVWLAYQV

SEQ ID NO: 142740 - protein, 10 aa, West Nile virus
LPVWLAYQVA

SEQ ID NO: 142741 - protein, 10 aa, West Nile virus
PVWLAYQVAA

SEQ ID NO: 142742 - protein, 10 aa, West Nile virus
VWLAYQVAAA

SEQ ID NO: 142743 - protein, 10 aa, West Nile virus
WLAYQVAAAG

SEQ ID NO: 142744 - protein, 10 aa, West Nile virus
LAYKVAAAGI

SEQ ID NO: 142745 - protein, 10 aa, West Nile virus
KVAAAGISYH

SEQ ID NO: 142746 - protein, 10 aa, West Nile virus
VAAAGISYHD

SEQ ID NO: 142747 - protein, 10 aa, West Nile virus
AAAGISYHDR

SEQ ID NO: 142748 - protein, 10 aa, West Nile virus
AAGISYHDRK

SEQ ID NO: 142749 - protein, 10 aa, West Nile virus
AGISYHDRKW

SEQ ID NO: 142750 - protein, 10 aa, West Nile virus
GISYHDRKWC

SEQ ID NO: 142751 - protein, 10 aa, West Nile virus
ISYHDRKWCF

SEQ ID NO: 142752 - protein, 10 aa, West Nile virus
SYHDRKWCFD

SEQ ID NO: 142753 - protein, 10 aa, West Nile virus
YHDRKWCFDG

SEQ ID NO: 142754 - protein, 10 aa, West Nile virus
HDRKWCFDGP

SEQ ID NO: 142755 - protein, 10 aa, West Nile virus
DRKWCFDGPR

SEQ ID NO: 142756 - protein, 10 aa, West Nile virus
RKWCFDGPRT

SEQ ID NO: 142757 - protein, 10 aa, West Nile virus
KWCFDGPRTN

SEQ ID NO: 142758 - protein, 10 aa, West Nile virus
CFDGPRTNTV

SEQ ID NO: 142759 - protein, 10 aa, West Nile virus
FDGPRTNTVL

SEQ ID NO: 142760 - protein, 10 aa, West Nile virus
DGPRTNTVLE

SEQ ID NO: 142761 - protein, 10 aa, West Nile virus
GPRTNTVLEE

SEQ ID NO: 142762 - protein, 10 aa, West Nile virus
PRTNTVLEEN

SEQ ID NO: 142763 - protein, 10 aa, West Nile virus
RTNTVLEENT

SEQ ID NO: 142764 - protein, 10 aa, West Nile virus
TNTVLEENTE

SEQ ID NO: 142765 - protein, 10 aa, West Nile virus
NTVLEENTEV

SEQ ID NO: 142766 - protein, 10 aa, West Nile virus
TVLEENTEVE

SEQ ID NO: 142767 - protein, 10 aa, West Nile virus
VLEENTEVEI

SEQ ID NO: 142768 - protein, 10 aa, West Nile virus
LEENTEVEIV

SEQ ID NO: 142769 - protein, 10 aa, West Nile virus
EENTEVEIVT

SEQ ID NO: 142770 - protein, 10 aa, West Nile virus
ENTEVEIVTK

SEQ ID NO: 142771 - protein, 10 aa, West Nile virus
NTEVEIVTKM

SEQ ID NO: 142772 - protein, 10 aa, West Nile virus
TEVEIVTKMG

SEQ ID NO: 142773 - protein, 10 aa, West Nile virus
EVEIVTKMGE

SEQ ID NO: 142774 - protein, 10 aa, West Nile virus
VEIVTKMGER

SEQ ID NO: 142775 - protein, 10 aa, West Nile virus
EIVTKMGERK

SEQ ID NO: 142776 - protein, 10 aa, West Nile virus
IVTKMGERKI

SEQ ID NO: 142777 - protein, 10 aa, West Nile virus
VTKMGERKIL

SEQ ID NO: 142778 - protein, 10 aa, West Nile virus
TKMGERKILR

SEQ ID NO: 142779 - protein, 10 aa, West Nile virus
KMGERKILRP

SEQ ID NO: 142780 - protein, 10 aa, West Nile virus
MGERKILRPR

SEQ ID NO: 142781 - protein, 10 aa, West Nile virus
ERKILRPRWA

SEQ ID NO: 142782 - protein, 10 aa, West Nile virus
RKILRPRWAD

SEQ ID NO: 142783 - protein, 10 aa, West Nile virus
KILRPRWADA

SEQ ID NO: 142784 - protein, 10 aa, West Nile virus
ILRPRWADAR

SEQ ID NO: 142785 - protein, 10 aa, West Nile virus
LRPRWADARV

SEQ ID NO: 142786 - protein, 10 aa, West Nile virus
RPRWADARVY

SEQ ID NO: 142787 - protein, 10 aa, West Nile virus
PRWADARVYS

SEQ ID NO: 142788 - protein, 10 aa, West Nile virus
RWADARVYSD

SEQ ID NO: 142789 - protein, 10 aa, West Nile virus
WADARVYSDH

SEQ ID NO: 142790 - protein, 10 aa, West Nile virus
ADARVYSDHQ

SEQ ID NO: 142791 - protein, 10 aa, West Nile virus
VYSDHQALKS

SEQ ID NO: 142792 - protein, 10 aa, West Nile virus
YSDHQALKSF

SEQ ID NO: 142793 - protein, 10 aa, West Nile virus
SDHQALKSFK

SEQ ID NO: 142794 - protein, 10 aa, West Nile virus
DHQALKSFKD

SEQ ID NO: 142795 - protein, 10 aa, West Nile virus
HQALKSFKDF

SEQ ID NO: 142796 - protein, 10 aa, West Nile virus
QALKSFKDFA

SEQ ID NO: 142797 - protein, 10 aa, West Nile virus
ALKSFKDFAS

SEQ ID NO: 142798 - protein, 10 aa, West Nile virus
LKSFKDFASG

SEQ ID NO: 142799 - protein, 10 aa, West Nile virus
KSFKDFASGK

SEQ ID NO: 142800 - protein, 10 aa, West Nile virus
SFKDFASGKR

SEQ ID NO: 142801 - protein, 10 aa, West Nile virus
FKDFAAGRRS

SEQ ID NO: 142802 - protein, 10 aa, West Nile virus
KDFAAGRRSQ

SEQ ID NO: 142803 - protein, 10 aa, West Nile virus
DFAAGRRSQI

SEQ ID NO: 142804 - protein, 10 aa, West Nile virus
FAAGRRSQIG

SEQ ID NO: 142805 - protein, 10 aa, West Nile virus
AAGRRSQIGL

SEQ ID NO: 142806 - protein, 10 aa, West Nile virus
GKRSQIGLVE

SEQ ID NO: 142807 - protein, 10 aa, West Nile virus
KRSQIGLVEV

SEQ ID NO: 142808 - protein, 10 aa, West Nile virus
RSQIGLVEVL

SEQ ID NO: 142809 - protein, 10 aa, West Nile virus
SQIGLVEVLG

SEQ ID NO: 142810 - protein, 10 aa, West Nile virus
QIGLVEVLGR

SEQ ID NO: 142811 - protein, 10 aa, West Nile virus
IGLVEVLGRM

SEQ ID NO: 142812 - protein, 10 aa, West Nile virus
GLVEVLGRMP

SEQ ID NO: 142813 - protein, 10 aa, West Nile virus
LVEVLGRMPE

SEQ ID NO: 142814 - protein, 10 aa, West Nile virus
VEVLGRMPEH

SEQ ID NO: 142815 - protein, 10 aa, West Nile virus
EVLGRMPEHF

SEQ ID NO: 142816 - protein, 10 aa, West Nile virus
VLGRMPEHFM

SEQ ID NO: 142817 - protein, 10 aa, West Nile virus
LGRMPEHFMG

SEQ ID NO: 142818 - protein, 10 aa, West Nile virus
GRMPEHFMGK

SEQ ID NO: 142819 - protein, 10 aa, West Nile virus
RMPEHFMGKT

SEQ ID NO: 142820 - protein, 10 aa, West Nile virus
MPEHFVGKTW

SEQ ID NO: 142821 - protein, 10 aa, West Nile virus
PEHFVGKTWE

SEQ ID NO: 142822 - protein, 10 aa, West Nile virus
EHFVGKTWEA

SEQ ID NO: 142823 - protein, 10 aa, West Nile virus
HFVGKTWEAL

SEQ ID NO: 142824 - protein, 10 aa, West Nile virus
FVGKTWEALD

SEQ ID NO: 142825 - protein, 10 aa, West Nile virus
VGKTWEALDT

SEQ ID NO: 142826 - protein, 10 aa, West Nile virus
VKTWEALDTM

SEQ ID NO: 142827 - protein, 10 aa, West Nile virus
TMYVVATADK

SEQ ID NO: 142828 - protein, 10 aa, West Nile virus
MYVVATAERG

SEQ ID NO: 142829 - protein, 10 aa, West Nile virus
YVVATADKGG

SEQ ID NO: 142830 - protein, 10 aa, West Nile virus
VVATAEKGRR

SEQ ID NO: 142831 - protein, 10 aa, West Nile virus
VATADKGGRA

SEQ ID NO: 142832 - protein, 10 aa, West Nile virus
ATAEKGRRAH

SEQ ID NO: 142833 - protein, 10 aa, West Nile virus
TAEKGGRAHS

SEQ ID NO: 142834 - protein, 10 aa, West Nile virus
AEKGGRAHRT

SEQ ID NO: 142835 - protein, 10 aa, West Nile virus
EKGGRAHRTA

SEQ ID NO: 142836 - protein, 10 aa, West Nile virus
KGGRAHRTAL

SEQ ID NO: 142837 - protein, 10 aa, West Nile virus
GGRAHRTALE

SEQ ID NO: 142838 - protein, 10 aa, West Nile virus
GRAHRTALEE

SEQ ID NO: 142839 - protein, 10 aa, West Nile virus
RAHRTALEEL

SEQ ID NO: 142840 - protein, 10 aa, West Nile virus
AHRTALEELP

SEQ ID NO: 142841 - protein, 10 aa, West Nile virus
HRTALEELPD

SEQ ID NO: 142842 - protein, 10 aa, West Nile virus
RTALEELPDA

SEQ ID NO: 142843 - protein, 10 aa, West Nile virus
TALEELPDAL

SEQ ID NO: 142844 - protein, 10 aa, West Nile virus
ELPDALQTIV

SEQ ID NO: 142845 - protein, 10 aa, West Nile virus
LPDALQTIVL

SEQ ID NO: 142846 - protein, 10 aa, West Nile virus
PDALQTIVLI

SEQ ID NO: 142847 - protein, 10 aa, West Nile virus
DALQTIALIT

SEQ ID NO: 142848 - protein, 10 aa, West Nile virus
ALQTIALITL

SEQ ID NO: 142849 - protein, 10 aa, West Nile virus
LQTIALITLL

SEQ ID NO: 142850 - protein, 10 aa, West Nile virus
QTIALITLLS

SEQ ID NO: 142851 - protein, 10 aa, West Nile virus
TIALITLLSV

SEQ ID NO: 142852 - protein, 10 aa, West Nile virus
IALITLLSVM

SEQ ID NO: 142853 - protein, 10 aa, West Nile virus
LLSVMSLGVF

SEQ ID NO: 142854 - protein, 10 aa, West Nile virus
VMSLGVFFLL

SEQ ID NO: 142855 - protein, 10 aa, West Nile virus
MSLGVFFLLM

SEQ ID NO: 142856 - protein, 10 aa, West Nile virus
SLGVFFLLMQ

SEQ ID NO: 142857 - protein, 10 aa, West Nile virus
LGVFFLLMQR

SEQ ID NO: 142858 - protein, 10 aa, West Nile virus
GVFCLLMQRK

SEQ ID NO: 142859 - protein, 10 aa, West Nile virus
VFCLLMQRKG

SEQ ID NO: 142860 - protein, 10 aa, West Nile virus
FCLLMQRKGV

SEQ ID NO: 142861 - protein, 10 aa, West Nile virus
CLLMQRKGVS

SEQ ID NO: 142862 - protein, 10 aa, West Nile virus
LLMQRKGVSK

SEQ ID NO: 142863 - protein, 10 aa, West Nile virus
LMQRKGVSKI

SEQ ID NO: 142864 - protein, 10 aa, West Nile virus
MQRKGVSKIG

SEQ ID NO: 142865 - protein, 10 aa, West Nile virus
QRKGVSKIGL

SEQ ID NO: 142866 - protein, 10 aa, West Nile virus
RKGVSKIGLA

SEQ ID NO: 142867 - protein, 10 aa, West Nile virus
KGVSKIGLAG

SEQ ID NO: 142868 - protein, 10 aa, West Nile virus
GIGKIGLGGT

SEQ ID NO: 142869 - protein, 10 aa, West Nile virus
LGAATFFCWM

SEQ ID NO: 142870 - protein, 10 aa, West Nile virus
GAATFFCWMA

SEQ ID NO: 142871 - protein, 10 aa, West Nile virus
AATFFCWMAE

SEQ ID NO: 142872 - protein, 10 aa, West Nile virus
ATLFCWMAEV

SEQ ID NO: 142873 - protein, 10 aa, West Nile virus
TFFCWMAEVS

SEQ ID NO: 142874 - protein, 10 aa, West Nile virus
FFCWMAEVSG

SEQ ID NO: 142875 - protein, 10 aa, West Nile virus
FCWMAEVSGT

SEQ ID NO: 142876 - protein, 10 aa, West Nile virus
CWMAEVSGTK

SEQ ID NO: 142877 - protein, 10 aa, West Nile virus
WMAEVSGTKI

SEQ ID NO: 142878 - protein, 10 aa, West Nile virus
MAEVSGTKIA

SEQ ID NO: 142879 - protein, 10 aa, West Nile virus
AEVSGTKIAG

SEQ ID NO: 142880 - protein, 10 aa, West Nile virus
EVSGTKIAGM

SEQ ID NO: 142881 - protein, 10 aa, West Nile virus
VSGTKIAGML

SEQ ID NO: 142882 - protein, 10 aa, West Nile virus
SGTKIAGMLL

SEQ ID NO: 142883 - protein, 10 aa, West Nile virus
AGMLLLSLLM

SEQ ID NO: 142884 - protein, 10 aa, West Nile virus
GMLLLSLLMM

SEQ ID NO: 142885 - protein, 10 aa, West Nile virus
MLLLSLLMMI

SEQ ID NO: 142886 - protein, 10 aa, West Nile virus
LLLSLLMMIV

SEQ ID NO: 142887 - protein, 10 aa, West Nile virus
LLSLLMMIVL

SEQ ID NO: 142888 - protein, 10 aa, West Nile virus
LSLLMMIVLI

SEQ ID NO: 142889 - protein, 10 aa, West Nile virus
SLLMMIVLIP

SEQ ID NO: 142890 - protein, 10 aa, West Nile virus
LLMMIVLIPE

SEQ ID NO: 142891 - protein, 10 aa, West Nile virus
LMMIVLIPEP

SEQ ID NO: 142892 - protein, 10 aa, West Nile virus
MMIVLIPEPE

SEQ ID NO: 142893 - protein, 10 aa, West Nile virus
RSQTDNQLAM

SEQ ID NO: 142894 - protein, 10 aa, West Nile virus
SQTDNQLAMF

SEQ ID NO: 142895 - protein, 10 aa, West Nile virus
QTDNQLAMFL

SEQ ID NO: 142896 - protein, 10 aa, West Nile virus
TDNQLAMFLI

SEQ ID NO: 142897 - protein, 10 aa, West Nile virus
DNQLAMFLIC

SEQ ID NO: 142898 - protein, 10 aa, West Nile virus
NQLAMFLICV

SEQ ID NO: 142899 - protein, 10 aa, West Nile virus
QLAVFLICVL

SEQ ID NO: 142900 - protein, 10 aa, West Nile virus
LAVFLICVLT

SEQ ID NO: 142901 - protein, 10 aa, West Nile virus
AVFLICVLTL

SEQ ID NO: 142902 - protein, 10 aa, West Nile virus
VFLICVLTLV

SEQ ID NO: 142903 - protein, 10 aa, West Nile virus
TLVGAVAANE

SEQ ID NO: 142904 - protein, 10 aa, West Nile virus
LVGAVAANEM

SEQ ID NO: 142905 - protein, 10 aa, West Nile virus
VGAVAANEMG

SEQ ID NO: 142906 - protein, 10 aa, West Nile virus
GAVAANEMGW

SEQ ID NO: 142907 - protein, 10 aa, West Nile virus
TVAANEMGWL

SEQ ID NO: 142908 - protein, 10 aa, West Nile virus
AANEMGWLDR

SEQ ID NO: 142909 - protein, 10 aa, West Nile virus
ANEMGWLDRT

SEQ ID NO: 142910 - protein, 10 aa, West Nile virus
NEMGWLDRTK

SEQ ID NO: 142911 - protein, 10 aa, West Nile virus
EMGWLDKTKN

SEQ ID NO: 142912 - protein, 10 aa, West Nile virus
MGWLDKTKND

SEQ ID NO: 142913 - protein, 10 aa, West Nile virus
GWLDKTKNDI

SEQ ID NO: 142914 - protein, 10 aa, West Nile virus
ESFLLDLRPA

SEQ ID NO: 142915 - protein, 10 aa, West Nile virus
SFLLDLRPAT

SEQ ID NO: 142916 - protein, 10 aa, West Nile virus
FLLDLKPATA

SEQ ID NO: 142917 - protein, 10 aa, West Nile virus
LLDLKPATAW

SEQ ID NO: 142918 - protein, 10 aa, West Nile virus
LDLKPATAWS

SEQ ID NO: 142919 - protein, 10 aa, West Nile virus
DLKPATAWSL

SEQ ID NO: 142920 - protein, 10 aa, West Nile virus
LKPATAWSLY

SEQ ID NO: 142921 - protein, 10 aa, West Nile virus
KPATAWSLYA

SEQ ID NO: 142922 - protein, 10 aa, West Nile virus
ATAWSLYAVS

SEQ ID NO: 142923 - protein, 10 aa, West Nile virus
TAWSLYAVST

SEQ ID NO: 142924 - protein, 10 aa, West Nile virus
AWSLYAVSTA

SEQ ID NO: 142925 - protein, 10 aa, West Nile virus
WSLYAVSTAV

SEQ ID NO: 142926 - protein, 10 aa, West Nile virus
SLYAVSTAVM

SEQ ID NO: 142927 - protein, 10 aa, West Nile virus
LYAVSTAVMT

SEQ ID NO: 142928 - protein, 10 aa, West Nile virus
YAVSTAVMTP

SEQ ID NO: 142929 - protein, 10 aa, West Nile virus
AVSTAVMTPL

SEQ ID NO: 142930 - protein, 10 aa, West Nile virus
VSTAVMTPLL

SEQ ID NO: 142931 - protein, 10 aa, West Nile virus
STAVMTPLLK

SEQ ID NO: 142932 - protein, 10 aa, West Nile virus
TAVMTPLLKH

SEQ ID NO: 142933 - protein, 10 aa, West Nile virus
AVMTPLLKHV

SEQ ID NO: 142934 - protein, 10 aa, West Nile virus
VMTPLLKHVI

SEQ ID NO: 142935 - protein, 10 aa, West Nile virus
MTPLLKHVIT

SEQ ID NO: 142936 - protein, 10 aa, West Nile virus
TPLLKHVITS

SEQ ID NO: 142937 - protein, 10 aa, West Nile virus
PLLKHVITSD

SEQ ID NO: 142938 - protein, 10 aa, West Nile virus
LLKHVITSDY

SEQ ID NO: 142939 - protein, 10 aa, West Nile virus
LKHVITSDYI

SEQ ID NO: 142940 - protein, 10 aa, West Nile virus
KHVITSDYIN

SEQ ID NO: 142941 - protein, 10 aa, West Nile virus
HVITSDYINT

SEQ ID NO: 142942 - protein, 10 aa, West Nile virus
VITSDYINTS

SEQ ID NO: 142943 - protein, 10 aa, West Nile virus
LTSINVQAST

SEQ ID NO: 142944 - protein, 10 aa, West Nile virus
TSINVQASTL

SEQ ID NO: 142945 - protein, 10 aa, West Nile virus
SINVQASALY

SEQ ID NO: 142946 - protein, 10 aa, West Nile virus
INVQASALYS

SEQ ID NO: 142947 - protein, 10 aa, West Nile virus
NVQASALYSL

SEQ ID NO: 142948 - protein, 10 aa, West Nile virus
VQASALFTLS

SEQ ID NO: 142949 - protein, 10 aa, West Nile virus
QASALFTLSR

SEQ ID NO: 142950 - protein, 10 aa, West Nile virus
ASALFTLSRG

SEQ ID NO: 142951 - protein, 10 aa, West Nile virus
SALFTLSRGF

SEQ ID NO: 142952 - protein, 10 aa, West Nile virus
ALFTLSRGFP

SEQ ID NO: 142953 - protein, 10 aa, West Nile virus
LFTLSRGFPF

SEQ ID NO: 142954 - protein, 10 aa, West Nile virus
FTLSRGFPFV

SEQ ID NO: 142955 - protein, 10 aa, West Nile virus
TLSRGFPFVD

SEQ ID NO: 142956 - protein, 10 aa, West Nile virus
LSRGFPFVDV

SEQ ID NO: 142957 - protein, 10 aa, West Nile virus
SRGFPFVDVG

SEQ ID NO: 142958 - protein, 10 aa, West Nile virus
RGFPFVDVGI

SEQ ID NO: 142959 - protein, 10 aa, West Nile virus
GFPFVDVGIS

SEQ ID NO: 142960 - protein, 10 aa, West Nile virus
FPFVDVGISA

SEQ ID NO: 142961 - protein, 10 aa, West Nile virus
PFVDVGISSL

SEQ ID NO: 142962 - protein, 10 aa, West Nile virus
FVDVGISALL

SEQ ID NO: 142963 - protein, 10 aa, West Nile virus
VDVGISALLL

SEQ ID NO: 142964 - protein, 10 aa, West Nile virus
DVGISALLLA

SEQ ID NO: 142965 - protein, 10 aa, West Nile virus
VGVSALLLAV

SEQ ID NO: 142966 - protein, 10 aa, West Nile virus
GVSALLLAVG

SEQ ID NO: 142967 - protein, 10 aa, West Nile virus
VSALLLAVGC

SEQ ID NO: 142968 - protein, 10 aa, West Nile virus
SALLLAVGCW

SEQ ID NO: 142969 - protein, 10 aa, West Nile virus
ALLLAVGCWG

SEQ ID NO: 142970 - protein, 10 aa, West Nile virus
LLLAVGCWGQ

SEQ ID NO: 142971 - protein, 10 aa, West Nile virus
LLAVGCWGQV

SEQ ID NO: 142972 - protein, 10 aa, West Nile virus
LAVGCWGQVT

SEQ ID NO: 142973 - protein, 10 aa, West Nile virus
AVGCWGQVTL

SEQ ID NO: 142974 - protein, 10 aa, West Nile virus
VGCWGQVTLT

SEQ ID NO: 142975 - protein, 10 aa, West Nile virus
CWGQVTLTVA

SEQ ID NO: 142976 - protein, 10 aa, West Nile virus
WEQVTLTVTV

SEQ ID NO: 142977 - protein, 10 aa, West Nile virus
GQVTLTVAVT

SEQ ID NO: 142978 - protein, 10 aa, West Nile virus
QVTLTVTVTS

SEQ ID NO: 142979 - protein, 10 aa, West Nile virus
VTLTVTVTSA

SEQ ID NO: 142980 - protein, 10 aa, West Nile virus
ALLFCHYAYM

SEQ ID NO: 142981 - protein, 10 aa, West Nile virus
LLLCHYAYMV

SEQ ID NO: 142982 - protein, 10 aa, West Nile virus
LLCHYAYMVP

SEQ ID NO: 142983 - protein, 10 aa, West Nile virus
LCHYAYMVPG

SEQ ID NO: 142984 - protein, 10 aa, West Nile virus
CHYAYMIPGW

SEQ ID NO: 142985 - protein, 10 aa, West Nile virus
HYAYMVPGGQ

SEQ ID NO: 142986 - protein, 10 aa, West Nile virus
YAYMIPGWQA

SEQ ID NO: 142987 - protein, 10 aa, West Nile virus
AYMVPGGQAE

SEQ ID NO: 142988 - protein, 10 aa, West Nile virus
YMIPGWQAEA

SEQ ID NO: 142989 - protein, 10 aa, West Nile virus
MIPGWQAEAM

SEQ ID NO: 142990 - protein, 10 aa, West Nile virus
IPGWQAEAMR

SEQ ID NO: 142991 - protein, 10 aa, West Nile virus
PGWQAEAMRA

SEQ ID NO: 142992 - protein, 10 aa, West Nile virus
GWQAEAMRAA

SEQ ID NO: 142993 - protein, 10 aa, West Nile virus
WQAEAMRAAQ

SEQ ID NO: 142994 - protein, 10 aa, West Nile virus
QAEAMRAAQR

SEQ ID NO: 142995 - protein, 10 aa, West Nile virus
AEAMRAAQRR

SEQ ID NO: 142996 - protein, 10 aa, West Nile virus
EAMRAAQRRT

SEQ ID NO: 142997 - protein, 10 aa, West Nile virus
AMRAAQRRTA

SEQ ID NO: 142998 - protein, 10 aa, West Nile virus
MRAAQRRTAA

SEQ ID NO: 142999 - protein, 10 aa, West Nile virus
RAAQRRTAAG

SEQ ID NO: 143000 - protein, 10 aa, West Nile virus
AAQRRTAAGI

SEQ ID NO: 143001 - protein, 10 aa, West Nile virus
RTAAGIMKNV

SEQ ID NO: 143002 - protein, 10 aa, West Nile virus
TAAGIMKNVV

SEQ ID NO: 143003 - protein, 10 aa, West Nile virus
AAGIMKNVVV

SEQ ID NO: 143004 - protein, 10 aa, West Nile virus
AGIMKNVVVD

SEQ ID NO: 143005 - protein, 10 aa, West Nile virus
GIMKNVVVDG

SEQ ID NO: 143006 - protein, 10 aa, West Nile virus
IMKNAVIDGM

SEQ ID NO: 143007 - protein, 10 aa, West Nile virus
MKNVVVDGIV

SEQ ID NO: 143008 - protein, 10 aa, West Nile virus
KNVVVDGIVA

SEQ ID NO: 143009 - protein, 10 aa, West Nile virus
NVVVDGIVAT

SEQ ID NO: 143010 - protein, 10 aa, West Nile virus
VVVDGIVATD

SEQ ID NO: 143011 - protein, 10 aa, West Nile virus
VIDGMVATDV

SEQ ID NO: 143012 - protein, 10 aa, West Nile virus
IDGMVATDVP

SEQ ID NO: 143013 - protein, 10 aa, West Nile virus
DGMVATDVPE

SEQ ID NO: 143014 - protein, 10 aa, West Nile virus
GMVATDVPEL

SEQ ID NO: 143015 - protein, 10 aa, West Nile virus
MVATDVPELE

SEQ ID NO: 143016 - protein, 10 aa, West Nile virus
ATDVPELERA

SEQ ID NO: 143017 - protein, 10 aa, West Nile virus
TDVPELERAT

SEQ ID NO: 143018 - protein, 10 aa, West Nile virus
DVPELERATP

SEQ ID NO: 143019 - protein, 10 aa, West Nile virus
VPELERTTPV

SEQ ID NO: 143020 - protein, 10 aa, West Nile virus
PELERTTPVM

SEQ ID NO: 143021 - protein, 10 aa, West Nile virus
ELERTTPVMQ

SEQ ID NO: 143022 - protein, 10 aa, West Nile virus
LERTTPVMQK

SEQ ID NO: 143023 - protein, 10 aa, West Nile virus
ERTTPVMQKK

SEQ ID NO: 143024 - protein, 10 aa, West Nile virus
RTTPVMQKKV

SEQ ID NO: 143025 - protein, 10 aa, West Nile virus
TTPVMQKKVG

SEQ ID NO: 143026 - protein, 10 aa, West Nile virus
TPVMQKKVGQ

SEQ ID NO: 143027 - protein, 10 aa, West Nile virus
PVMQKKVGQI

SEQ ID NO: 143028 - protein, 10 aa, West Nile virus
VMQKKVGQIM

SEQ ID NO: 143029 - protein, 10 aa, West Nile virus
MQKKVGQVML

SEQ ID NO: 143030 - protein, 10 aa, West Nile virus
QKKVGQVMLI

SEQ ID NO: 143031 - protein, 10 aa, West Nile virus
KKVGQVMLIL

SEQ ID NO: 143032 - protein, 10 aa, West Nile virus
KVGQVMLILV

SEQ ID NO: 143033 - protein, 10 aa, West Nile virus
VGQVMLILVS

SEQ ID NO: 143034 - protein, 10 aa, West Nile virus
LILVSMAAVV

SEQ ID NO: 143035 - protein, 10 aa, West Nile virus
ILVSMAAVVV

SEQ ID NO: 143036 - protein, 10 aa, West Nile virus
LVSMAAVVVN

SEQ ID NO: 143037 - protein, 10 aa, West Nile virus
VSMAAVVVNP

SEQ ID NO: 143038 - protein, 10 aa, West Nile virus
SMAAVVVNPS

SEQ ID NO: 143039 - protein, 10 aa, West Nile virus
MAAVVVNPSV

SEQ ID NO: 143040 - protein, 10 aa, West Nile virus
AAVVVNPSVR

SEQ ID NO: 143041 - protein, 10 aa, West Nile virus
AVVVNPSVRT

SEQ ID NO: 143042 - protein, 10 aa, West Nile virus
VVVNPSVRTV

SEQ ID NO: 143043 - protein, 10 aa, West Nile virus
VVNPSVRTVR

SEQ ID NO: 143044 - protein, 10 aa, West Nile virus
VNPSVRTVRE

SEQ ID NO: 143045 - protein, 10 aa, West Nile virus
NPSVRTVREA

SEQ ID NO: 143046 - protein, 10 aa, West Nile virus
PSVRTVREAG

SEQ ID NO: 143047 - protein, 10 aa, West Nile virus
SVRTVREAGI

SEQ ID NO: 143048 - protein, 10 aa, West Nile virus
VRTVREAGIL

SEQ ID NO: 143049 - protein, 10 aa, West Nile virus
TVREAGILTT

SEQ ID NO: 143050 - protein, 10 aa, West Nile virus
VREAGILTTA

SEQ ID NO: 143051 - protein, 10 aa, West Nile virus
REAGILTTAA

SEQ ID NO: 143052 - protein, 10 aa, West Nile virus
EAGILTTAAA

SEQ ID NO: 143053 - protein, 10 aa, West Nile virus
AGILTTAAAV

SEQ ID NO: 143054 - protein, 10 aa, West Nile virus
GILTTAAAVT

SEQ ID NO: 143055 - protein, 10 aa, West Nile virus
ILTTAAAVTL

SEQ ID NO: 143056 - protein, 10 aa, West Nile virus
LTTAAAVTLW

SEQ ID NO: 143057 - protein, 10 aa, West Nile virus
TTAAAVTLWE

SEQ ID NO: 143058 - protein, 10 aa, West Nile virus
TAAAVTLWEK

SEQ ID NO: 143059 - protein, 10 aa, West Nile virus
AAAVTLWEKG

SEQ ID NO: 143060 - protein, 10 aa, West Nile virus
AAVTLWEKGA

SEQ ID NO: 143061 - protein, 10 aa, West Nile virus
AVTLWENGAG

SEQ ID NO: 143062 - protein, 10 aa, West Nile virus
VTLWENGAGS

SEQ ID NO: 143063 - protein, 10 aa, West Nile virus
TLWENGAGSV

SEQ ID NO: 143064 - protein, 10 aa, West Nile virus
LWENGAGSVW

SEQ ID NO: 143065 - protein, 10 aa, West Nile virus
WENGAGSVWN

SEQ ID NO: 143066 - protein, 10 aa, West Nile virus
ENGAGSVWNA

SEQ ID NO: 143067 - protein, 10 aa, West Nile virus
NGAGSVWNAT

SEQ ID NO: 143068 - protein, 10 aa, West Nile virus
GAGSVWNATT

SEQ ID NO: 143069 - protein, 10 aa, West Nile virus
AGSVWNATTA

SEQ ID NO: 143070 - protein, 10 aa, West Nile virus
GSVWNATTAI

SEQ ID NO: 143071 - protein, 10 aa, West Nile virus
ATTAIGLCHV

SEQ ID NO: 143072 - protein, 10 aa, West Nile virus
TTAIGLCHVM

SEQ ID NO: 143073 - protein, 10 aa, West Nile virus
TAIGLCHVMR

SEQ ID NO: 143074 - protein, 10 aa, West Nile virus
AIGLCHVMRG

SEQ ID NO: 143075 - protein, 10 aa, West Nile virus
IGLCHVMRGG

SEQ ID NO: 143076 - protein, 10 aa, West Nile virus
GLCHVMRGGW

SEQ ID NO: 143077 - protein, 10 aa, West Nile virus
LCHVMRGGWL

SEQ ID NO: 143078 - protein, 10 aa, West Nile virus
CHVMRGGWLS

SEQ ID NO: 143079 - protein, 10 aa, West Nile virus
HVMRGGWLSC

SEQ ID NO: 143080 - protein, 10 aa, West Nile virus
VMRGGWLSCL

SEQ ID NO: 143081 - protein, 10 aa, West Nile virus
MRGGWLSCFS

SEQ ID NO: 143082 - protein, 10 aa, West Nile virus
RGGWLSCLSM

SEQ ID NO: 143083 - protein, 10 aa, West Nile virus
GGWLSCLSIM

SEQ ID NO: 143084 - protein, 10 aa, West Nile virus
GWLSCLSIMW

SEQ ID NO: 143085 - protein, 10 aa, West Nile virus
WLSCLSMTWT

SEQ ID NO: 143086 - protein, 10 aa, West Nile virus
LSCLSMTWTL

SEQ ID NO: 143087 - protein, 10 aa, West Nile virus
KNMDKPGLKR

SEQ ID NO: 143088 - protein, 10 aa, West Nile virus
NMDKPGLKRG

SEQ ID NO: 143089 - protein, 10 aa, West Nile virus
MDKPGLKRGG

SEQ ID NO: 143090 - protein, 10 aa, West Nile virus
DKPGLKRGGA

SEQ ID NO: 143091 - protein, 10 aa, West Nile virus
KPGIKRGGAK

SEQ ID NO: 143092 - protein, 10 aa, West Nile virus
PGIKRGGAKG

SEQ ID NO: 143093 - protein, 10 aa, West Nile virus
VLKRGGAKGR

SEQ ID NO: 143094 - protein, 10 aa, West Nile virus
GRTLGEVWKD

SEQ ID NO: 143095 - protein, 10 aa, West Nile virus
RTLGEVWKDR

SEQ ID NO: 143096 - protein, 10 aa, West Nile virus
TLGEVWKDRL

SEQ ID NO: 143097 - protein, 10 aa, West Nile virus
LGEVWKDRLN

SEQ ID NO: 143098 - protein, 10 aa, West Nile virus
GEVWKERLNH

SEQ ID NO: 143099 - protein, 10 aa, West Nile virus
EVWKERLNHM

SEQ ID NO: 143100 - protein, 10 aa, West Nile virus
VWKERLNHMT

SEQ ID NO: 143101 - protein, 10 aa, West Nile virus
LTKEEFTRYR

SEQ ID NO: 143102 - protein, 10 aa, West Nile virus
TKEEFIRYRK

SEQ ID NO: 143103 - protein, 10 aa, West Nile virus
KEEFIRYRKE

SEQ ID NO: 143104 - protein, 10 aa, West Nile virus
EEFIRYRKEA

SEQ ID NO: 143105 - protein, 10 aa, West Nile virus
EFIRYRKEAI

SEQ ID NO: 143106 - protein, 10 aa, West Nile virus
FTRYRKEAIT

SEQ ID NO: 143107 - protein, 10 aa, West Nile virus
TRYRKEAITE

SEQ ID NO: 143108 - protein, 10 aa, West Nile virus
RYRKEAITEV

SEQ ID NO: 143109 - protein, 10 aa, West Nile virus
YRKEAITEVD

SEQ ID NO: 143110 - protein, 10 aa, West Nile virus
RKEAITEVDR

SEQ ID NO: 143111 - protein, 10 aa, West Nile virus
KEAITEVDRS

SEQ ID NO: 143112 - protein, 10 aa, West Nile virus
EAITEVDRSA

SEQ ID NO: 143113 - protein, 10 aa, West Nile virus
AITEVDRSAA

SEQ ID NO: 143114 - protein, 10 aa, West Nile virus
ITEVDRSAAK

SEQ ID NO: 143115 - protein, 10 aa, West Nile virus
ARREGNITGG

SEQ ID NO: 143116 - protein, 10 aa, West Nile virus
RREGNITGGH

SEQ ID NO: 143117 - protein, 10 aa, West Nile virus
EGNITGGHPV

SEQ ID NO: 143118 - protein, 10 aa, West Nile virus
GNITGGHPVS

SEQ ID NO: 143119 - protein, 10 aa, West Nile virus
NITGGHPVSR

SEQ ID NO: 143120 - protein, 10 aa, West Nile virus
ITGGHPVSRG

SEQ ID NO: 143121 - protein, 10 aa, West Nile virus
TGGHSVSRGT

SEQ ID NO: 143122 - protein, 10 aa, West Nile virus
GGHSVSRGTA

SEQ ID NO: 143123 - protein, 10 aa, West Nile virus
GHSVSRGTAK

SEQ ID NO: 143124 - protein, 10 aa, West Nile virus
HSVSRGTAKL

SEQ ID NO: 143125 - protein, 10 aa, West Nile virus
SVSRGTAKLR

SEQ ID NO: 143126 - protein, 10 aa, West Nile virus
RWLVERRFLD

SEQ ID NO: 143127 - protein, 10 aa, West Nile virus
WLVERRFLDP

SEQ ID NO: 143128 - protein, 10 aa, West Nile virus
LVERRFLDPI

SEQ ID NO: 143129 - protein, 10 aa, West Nile virus
VERRFLDPIG

SEQ ID NO: 143130 - protein, 10 aa, West Nile virus
ERRFLDPIGK

SEQ ID NO: 143131 - protein, 10 aa, West Nile virus
RRFLDPIGKV

SEQ ID NO: 143132 - protein, 10 aa, West Nile virus
RFLEPVGKVV

SEQ ID NO: 143133 - protein, 10 aa, West Nile virus
FLEPVGKVVD

SEQ ID NO: 143134 - protein, 10 aa, West Nile virus
LEPVGKVVDL

SEQ ID NO: 143135 - protein, 10 aa, West Nile virus
EPVGKVVDLG

SEQ ID NO: 143136 - protein, 10 aa, West Nile virus
PVGKVVDLGC

SEQ ID NO: 143137 - protein, 10 aa, West Nile virus
VGKVVDLGCG

SEQ ID NO: 143138 - protein, 10 aa, West Nile virus
GKVVDLGCGR

SEQ ID NO: 143139 - protein, 10 aa, West Nile virus
KVVDLGCGRG

SEQ ID NO: 143140 - protein, 10 aa, West Nile virus
VVDLGCGRGG

SEQ ID NO: 143141 - protein, 10 aa, West Nile virus
VDLGCGRGGW

SEQ ID NO: 143142 - protein, 10 aa, West Nile virus
ATQKRVQEVK

SEQ ID NO: 143143 - protein, 10 aa, West Nile virus
TQKRVQEVKG

SEQ ID NO: 143144 - protein, 10 aa, West Nile virus
QKRVQEVKGY

SEQ ID NO: 143145 - protein, 10 aa, West Nile virus
KRVQEVKGYT

SEQ ID NO: 143146 - protein, 10 aa, West Nile virus
RVQEVKGYTK

SEQ ID NO: 143147 - protein, 10 aa, West Nile virus
VQEVKGYTKG

SEQ ID NO: 143148 - protein, 10 aa, West Nile virus
QEVKGYTKGG

SEQ ID NO: 143149 - protein, 10 aa, West Nile virus
EVKGYTKGGP

SEQ ID NO: 143150 - protein, 10 aa, West Nile virus
VKGYTKGGPG

SEQ ID NO: 143151 - protein, 10 aa, West Nile virus
KGYTKGGPGH

SEQ ID NO: 143152 - protein, 10 aa, West Nile virus
QLVQSYGWNT

SEQ ID NO: 143153 - protein, 10 aa, West Nile virus
LVQSYGWNTV

SEQ ID NO: 143154 - protein, 10 aa, West Nile virus
VQSYGWNTVT

SEQ ID NO: 143155 - protein, 10 aa, West Nile virus
QSYGWNTVTM

SEQ ID NO: 143156 - protein, 10 aa, West Nile virus
SYGWNTVTMK

SEQ ID NO: 143157 - protein, 10 aa, West Nile virus
YGWNTVTMKS

SEQ ID NO: 143158 - protein, 10 aa, West Nile virus
GWNTVTMKSG

SEQ ID NO: 143159 - protein, 10 aa, West Nile virus
WNTVTMKSGV

SEQ ID NO: 143160 - protein, 10 aa, West Nile virus
NTVTMKSGVD

SEQ ID NO: 143161 - protein, 10 aa, West Nile virus
TVTMKSGVDV

SEQ ID NO: 143162 - protein, 10 aa, West Nile virus
VTMKSGVDVY

SEQ ID NO: 143163 - protein, 10 aa, West Nile virus
TMKSGVDVYY

SEQ ID NO: 143164 - protein, 10 aa, West Nile virus
MKSGVDVYYR

SEQ ID NO: 143165 - protein, 10 aa, West Nile virus
KSGVDVYYRA

SEQ ID NO: 143166 - protein, 10 aa, West Nile virus
SGVDVYYRAS

SEQ ID NO: 143167 - protein, 10 aa, West Nile virus
GVDVYYRASE

SEQ ID NO: 143168 - protein, 10 aa, West Nile virus
VDVFYRPSEA

SEQ ID NO: 143169 - protein, 10 aa, West Nile virus
DVFYRPSEAS

SEQ ID NO: 143170 - protein, 10 aa, West Nile virus
VFYRPSEASD

SEQ ID NO: 143171 - protein, 10 aa, West Nile virus
FYRPSEASDT

SEQ ID NO: 143172 - protein, 10 aa, West Nile virus
YRPSEASDTL

SEQ ID NO: 143173 - protein, 10 aa, West Nile virus
RPSEASDTLL

SEQ ID NO: 143174 - protein, 10 aa, West Nile virus
PSEASDTLLC

SEQ ID NO: 143175 - protein, 10 aa, West Nile virus
SEASDTLLCD

SEQ ID NO: 143176 - protein, 10 aa, West Nile virus
EASDTLLCDI

SEQ ID NO: 143177 - protein, 10 aa, West Nile virus
ASDTLLCDIG

SEQ ID NO: 143178 - protein, 10 aa, West Nile virus
SDTLLCDIGE

SEQ ID NO: 143179 - protein, 10 aa, West Nile virus
TLLCDIGESA

SEQ ID NO: 143180 - protein, 10 aa, West Nile virus
LLCDIGESAS

SEQ ID NO: 143181 - protein, 10 aa, West Nile virus
LCDIGESASS

SEQ ID NO: 143182 - protein, 10 aa, West Nile virus
CDIGESASSA

SEQ ID NO: 143183 - protein, 10 aa, West Nile virus
DIGESASSAE

SEQ ID NO: 143184 - protein, 10 aa, West Nile virus
IGESASSAEV

SEQ ID NO: 143185 - protein, 10 aa, West Nile virus
GESASSAEVE

SEQ ID NO: 143186 - protein, 10 aa, West Nile virus
ESASSAEVEE

SEQ ID NO: 143187 - protein, 10 aa, West Nile virus
SASSAEVEEH

SEQ ID NO: 143188 - protein, 10 aa, West Nile virus
ASSAEVEEHR

SEQ ID NO: 143189 - protein, 10 aa, West Nile virus
SAEVEEHRTV

SEQ ID NO: 143190 - protein, 10 aa, West Nile virus
AEVEEHRTVR

SEQ ID NO: 143191 - protein, 10 aa, West Nile virus
EVEEHRTVRV

SEQ ID NO: 143192 - protein, 10 aa, West Nile virus
VEEHRTVRVL

SEQ ID NO: 143193 - protein, 10 aa, West Nile virus
EEHRTVRVLE

SEQ ID NO: 143194 - protein, 10 aa, West Nile virus
EHRTVRVLEM

SEQ ID NO: 143195 - protein, 10 aa, West Nile virus
HRTVRVLEMV

SEQ ID NO: 143196 - protein, 10 aa, West Nile virus
RTVRVLEMVE

SEQ ID NO: 143197 - protein, 10 aa, West Nile virus
TVRVLEMVED

SEQ ID NO: 143198 - protein, 10 aa, West Nile virus
VRVLEMVEDW

SEQ ID NO: 143199 - protein, 10 aa, West Nile virus
VEDWLHRGPK

SEQ ID NO: 143200 - protein, 10 aa, West Nile virus
EDWLHRGPKE

SEQ ID NO: 143201 - protein, 10 aa, West Nile virus
DWLHRGPKEF

SEQ ID NO: 143202 - protein, 10 aa, West Nile virus
WLHRGPKEFC

SEQ ID NO: 143203 - protein, 10 aa, West Nile virus
LHRGPKEFCI

SEQ ID NO: 143204 - protein, 10 aa, West Nile virus
HRGPKEFCIK

SEQ ID NO: 143205 - protein, 10 aa, West Nile virus
RGPKEFCIKV

SEQ ID NO: 143206 - protein, 10 aa, West Nile virus
GPKEFCIKVL

SEQ ID NO: 143207 - protein, 10 aa, West Nile virus
PKEFCIKVLC

SEQ ID NO: 143208 - protein, 10 aa, West Nile virus
KEFCIKVLCP

SEQ ID NO: 143209 - protein, 10 aa, West Nile virus
EFCIKVLCPY

SEQ ID NO: 143210 - protein, 10 aa, West Nile virus
FCIKVLCPYM

SEQ ID NO: 143211 - protein, 10 aa, West Nile virus
CIKVLCPYMP

SEQ ID NO: 143212 - protein, 10 aa, West Nile virus
IKVLCPYMPK

SEQ ID NO: 143213 - protein, 10 aa, West Nile virus
VLCPYMPRVI

SEQ ID NO: 143214 - protein, 10 aa, West Nile virus
LCPYMPKVVE

SEQ ID NO: 143215 - protein, 10 aa, West Nile virus
CPYMPRVIEK

SEQ ID NO: 143216 - protein, 10 aa, West Nile virus
PYMPRVIEKM

SEQ ID NO: 143217 - protein, 10 aa, West Nile virus
YMPRVIEKME

SEQ ID NO: 143218 - protein, 10 aa, West Nile virus
MPKVIEKMET

SEQ ID NO: 143219 - protein, 10 aa, West Nile virus
PKVIEKMETL

SEQ ID NO: 143220 - protein, 10 aa, West Nile virus
KVIEKMETLQ

SEQ ID NO: 143221 - protein, 10 aa, West Nile virus
VIEKMETLQR

SEQ ID NO: 143222 - protein, 10 aa, West Nile virus
IEKMETLQRR

SEQ ID NO: 143223 - protein, 10 aa, West Nile virus
EKMETLQRRY

SEQ ID NO: 143224 - protein, 10 aa, West Nile virus
KMETLQRRYG

SEQ ID NO: 143225 - protein, 10 aa, West Nile virus
METLQRRYGG

SEQ ID NO: 143226 - protein, 10 aa, West Nile virus
ETLQRRYGGG

SEQ ID NO: 143227 - protein, 10 aa, West Nile virus
TLQRRYGGGL

SEQ ID NO: 143228 - protein, 10 aa, West Nile virus
LQRRYGGGLI

SEQ ID NO: 143229 - protein, 10 aa, West Nile virus
QRRYGGGLIR

SEQ ID NO: 143230 - protein, 10 aa, West Nile virus
RRYGGGLIRN

SEQ ID NO: 143231 - protein, 10 aa, West Nile virus
RYGGGLIRNP

SEQ ID NO: 143232 - protein, 10 aa, West Nile virus
YGGGLIRNPL

SEQ ID NO: 143233 - protein, 10 aa, West Nile virus
GGGLIRNPLS

SEQ ID NO: 143234 - protein, 10 aa, West Nile virus
GGLIRNPLSR

SEQ ID NO: 143235 - protein, 10 aa, West Nile virus
GLIRNPLSRN

SEQ ID NO: 143236 - protein, 10 aa, West Nile virus
LIRNPLSRNS

SEQ ID NO: 143237 - protein, 10 aa, West Nile virus
IRNPLSRNST

SEQ ID NO: 143238 - protein, 10 aa, West Nile virus
STHEMYWVSH

SEQ ID NO: 143239 - protein, 10 aa, West Nile virus
THEMYWVSHA

SEQ ID NO: 143240 - protein, 10 aa, West Nile virus
HEMYWVSHAS

SEQ ID NO: 143241 - protein, 10 aa, West Nile virus
EMYWVSHASG

SEQ ID NO: 143242 - protein, 10 aa, West Nile virus
MYWVSHASGN

SEQ ID NO: 143243 - protein, 10 aa, West Nile virus
YWVSHASGNI

SEQ ID NO: 143244 - protein, 10 aa, West Nile virus
WVSHASGNIV

SEQ ID NO: 143245 - protein, 10 aa, West Nile virus
VSHASGNIVH

SEQ ID NO: 143246 - protein, 10 aa, West Nile virus
NIVHSVNMTS

SEQ ID NO: 143247 - protein, 10 aa, West Nile virus
IVHSVNMTSQ

SEQ ID NO: 143248 - protein, 10 aa, West Nile virus
VNSVSMTSQV

SEQ ID NO: 143249 - protein, 10 aa, West Nile virus
NSVSMTSQVL

SEQ ID NO: 143250 - protein, 10 aa, West Nile virus
SVSMTSQVLL

SEQ ID NO: 143251 - protein, 10 aa, West Nile virus
VSMTSQVLLG

SEQ ID NO: 143252 - protein, 10 aa, West Nile virus
SMTSQVLLGR

SEQ ID NO: 143253 - protein, 10 aa, West Nile virus
QVLLGRMEKK

SEQ ID NO: 143254 - protein, 10 aa, West Nile virus
VLLGRMEKKT

SEQ ID NO: 143255 - protein, 10 aa, West Nile virus
LLGRMEKKTW

SEQ ID NO: 143256 - protein, 10 aa, West Nile virus
LGRMEKKTWK

SEQ ID NO: 143257 - protein, 10 aa, West Nile virus
GRMEKKTWKG

SEQ ID NO: 143258 - protein, 10 aa, West Nile virus
RMEKKTWKGP

SEQ ID NO: 143259 - protein, 10 aa, West Nile virus
MEKKTWKGPQ

SEQ ID NO: 143260 - protein, 10 aa, West Nile virus
EKKTWKGPQF

SEQ ID NO: 143261 - protein, 10 aa, West Nile virus
KKTWKGPQFE

SEQ ID NO: 143262 - protein, 10 aa, West Nile virus
KTWKGPQFEE

SEQ ID NO: 143263 - protein, 10 aa, West Nile virus
TWKGPQFEED

SEQ ID NO: 143264 - protein, 10 aa, West Nile virus
WKGPQFEEDV

SEQ ID NO: 143265 - protein, 10 aa, West Nile virus
KGPQFEEDVN

SEQ ID NO: 143266 - protein, 10 aa, West Nile virus
GPQFEEDVNL

SEQ ID NO: 143267 - protein, 10 aa, West Nile virus
PQFEEDVNLG

SEQ ID NO: 143268 - protein, 10 aa, West Nile virus
QFEEDVNLGS

SEQ ID NO: 143269 - protein, 10 aa, West Nile virus
FEEDVNLGSG

SEQ ID NO: 143270 - protein, 10 aa, West Nile virus
EEDANLGSGT

SEQ ID NO: 143271 - protein, 10 aa, West Nile virus
EDANLGSGTR

SEQ ID NO: 143272 - protein, 10 aa, West Nile virus
DANLGSGTRA

SEQ ID NO: 143273 - protein, 10 aa, West Nile virus
ANLGSGTRAV

SEQ ID NO: 143274 - protein, 10 aa, West Nile virus
TRAVGRPLLN

SEQ ID NO: 143275 - protein, 10 aa, West Nile virus
RAVGKPLLSS

SEQ ID NO: 143276 - protein, 10 aa, West Nile virus
AVGRPLLNSD

SEQ ID NO: 143277 - protein, 10 aa, West Nile virus
VGKPLLSSDT

SEQ ID NO: 143278 - protein, 10 aa, West Nile virus
GKPLLNSDTG

SEQ ID NO: 143279 - protein, 10 aa, West Nile virus
KPLLNSDTGK

SEQ ID NO: 143280 - protein, 10 aa, West Nile virus
PLLNSDTGKI

SEQ ID NO: 143281 - protein, 10 aa, West Nile virus
LLNSDTGKIR

SEQ ID NO: 143282 - protein, 10 aa, West Nile virus
NRIERLKKEY

SEQ ID NO: 143283 - protein, 10 aa, West Nile virus
RIERLKKEYS

SEQ ID NO: 143284 - protein, 10 aa, West Nile virus
DANHPYRTWN

SEQ ID NO: 143285 - protein, 10 aa, West Nile virus
ANHPYRTWNY

SEQ ID NO: 143286 - protein, 10 aa, West Nile virus
RTWNYHGSYE

SEQ ID NO: 143287 - protein, 10 aa, West Nile virus
TWNYHGSYEV

SEQ ID NO: 143288 - protein, 10 aa, West Nile virus
WNYHGSYDVR

SEQ ID NO: 143289 - protein, 10 aa, West Nile virus
NYHGSYDVRP

SEQ ID NO: 143290 - protein, 10 aa, West Nile virus
YHGSYDVRPT

SEQ ID NO: 143291 - protein, 10 aa, West Nile virus
HGSYDVRPTG

SEQ ID NO: 143292 - protein, 10 aa, West Nile virus
GSYDVRPTGS

SEQ ID NO: 143293 - protein, 10 aa, West Nile virus
SYDVRPTGSA

SEQ ID NO: 143294 - protein, 10 aa, West Nile virus
YDVRPTGSAS

SEQ ID NO: 143295 - protein, 10 aa, West Nile virus
DVRPTGSASS

SEQ ID NO: 143296 - protein, 10 aa, West Nile virus
VRPTGSASSL

SEQ ID NO: 143297 - protein, 10 aa, West Nile virus
RPTGSASSLV

SEQ ID NO: 143298 - protein, 10 aa, West Nile virus
LLSKPWDVIT

SEQ ID NO: 143299 - protein, 10 aa, West Nile virus
LSKPWDTITS

SEQ ID NO: 143300 - protein, 10 aa, West Nile virus
SKPWDTITSV

SEQ ID NO: 143301 - protein, 10 aa, West Nile virus
KPWDVITNVT

SEQ ID NO: 143302 - protein, 10 aa, West Nile virus
PWDTITSVTT

SEQ ID NO: 143303 - protein, 10 aa, West Nile virus
WDTITSVTTM

SEQ ID NO: 143304 - protein, 10 aa, West Nile virus
DVITNVTTMA

SEQ ID NO: 143305 - protein, 10 aa, West Nile virus
TITSVTTMAM

SEQ ID NO: 143306 - protein, 10 aa, West Nile virus
IMNVTTMAMT

SEQ ID NO: 143307 - protein, 10 aa, West Nile virus
TSVTTMAMTD

SEQ ID NO: 143308 - protein, 10 aa, West Nile virus
KVDTKAPEPA

SEQ ID NO: 143309 - protein, 10 aa, West Nile virus
VDTKAPEPAE

SEQ ID NO: 143310 - protein, 10 aa, West Nile virus
DTKAPEPAEG

SEQ ID NO: 143311 - protein, 10 aa, West Nile virus
TKAPEPAEGV

SEQ ID NO: 143312 - protein, 10 aa, West Nile virus
KAPEPAEGVK

SEQ ID NO: 143313 - protein, 10 aa, West Nile virus
VLKETTNWLW

SEQ ID NO: 143314 - protein, 10 aa, West Nile virus
LNETTNWLWT

SEQ ID NO: 143315 - protein, 10 aa, West Nile virus
NETTNWLWTF

SEQ ID NO: 143316 - protein, 10 aa, West Nile virus
ETTNWLWTFL

SEQ ID NO: 143317 - protein, 10 aa, West Nile virus
TTNWLWTFLA

SEQ ID NO: 143318 - protein, 10 aa, West Nile virus
TNWLWTFLAR

SEQ ID NO: 143319 - protein, 10 aa, West Nile virus
RDKKPRMCSR

SEQ ID NO: 143320 - protein, 10 aa, West Nile virus
DKKPRMCSRE

SEQ ID NO: 143321 - protein, 10 aa, West Nile virus
KKPRMCSREE

SEQ ID NO: 143322 - protein, 10 aa, West Nile virus
KPRMCSREEF

SEQ ID NO: 143323 - protein, 10 aa, West Nile virus
PRMCTREEFI

SEQ ID NO: 143324 - protein, 10 aa, West Nile virus
RMCSREEFIG

SEQ ID NO: 143325 - protein, 10 aa, West Nile virus
MCSREEFIGK

SEQ ID NO: 143326 - protein, 10 aa, West Nile virus
CSREEFIGKV

SEQ ID NO: 143327 - protein, 10 aa, West Nile virus
SREEFIGKVN

SEQ ID NO: 143328 - protein, 10 aa, West Nile virus
REEFIGKVNS

SEQ ID NO: 143329 - protein, 10 aa, West Nile virus
EEFIGKVNSN

SEQ ID NO: 143330 - protein, 10 aa, West Nile virus
EFIGKVNSNA

SEQ ID NO: 143331 - protein, 10 aa, West Nile virus
FIGKVNSNAA

SEQ ID NO: 143332 - protein, 10 aa, West Nile virus
IGKVNSNAAL

SEQ ID NO: 143333 - protein, 10 aa, West Nile virus
GKVNSNAALG

SEQ ID NO: 143334 - protein, 10 aa, West Nile virus
AMFEEQNQWK

SEQ ID NO: 143335 - protein, 10 aa, West Nile virus
MFEEQNQWKN

SEQ ID NO: 143336 - protein, 10 aa, West Nile virus
FEEQNQWKNA

SEQ ID NO: 143337 - protein, 10 aa, West Nile virus
EEQNQWKNAR

SEQ ID NO: 143338 - protein, 10 aa, West Nile virus
EQNQWKNARE

SEQ ID NO: 143339 - protein, 10 aa, West Nile virus
QNQWKNAREA

SEQ ID NO: 143340 - protein, 10 aa, West Nile virus
NQWKNAREAV

SEQ ID NO: 143341 - protein, 10 aa, West Nile virus
QWKNAREAVE

SEQ ID NO: 143342 - protein, 10 aa, West Nile virus
WKNAREAVED

SEQ ID NO: 143343 - protein, 10 aa, West Nile virus
NAREAVEDPK

SEQ ID NO: 143344 - protein, 10 aa, West Nile virus
ARAAVEDPKF

SEQ ID NO: 143345 - protein, 10 aa, West Nile virus
REAVEDLKFW

SEQ ID NO: 143346 - protein, 10 aa, West Nile virus
EAVEDLKFWE

SEQ ID NO: 143347 - protein, 10 aa, West Nile virus
AVEDPKFWEI

SEQ ID NO: 143348 - protein, 10 aa, West Nile virus
VEDPKFWEIV

SEQ ID NO: 143349 - protein, 10 aa, West Nile virus
EDPKFWEIVD

SEQ ID NO: 143350 - protein, 10 aa, West Nile virus
DPKFWEMVDD

SEQ ID NO: 143351 - protein, 10 aa, West Nile virus
PKFWEMVDDE

SEQ ID NO: 143352 - protein, 10 aa, West Nile virus
KFWEMVDDER

SEQ ID NO: 143353 - protein, 10 aa, West Nile virus
FWEMVDDERE

SEQ ID NO: 143354 - protein, 10 aa, West Nile virus
WEMVDDEREA

SEQ ID NO: 143355 - protein, 10 aa, West Nile virus
EMVDDEREAH

SEQ ID NO: 143356 - protein, 10 aa, West Nile virus
MVDDEREAHL

SEQ ID NO: 143357 - protein, 10 aa, West Nile virus
VDDEREAHLR

SEQ ID NO: 143358 - protein, 10 aa, West Nile virus
DDEREAHLRG

SEQ ID NO: 143359 - protein, 10 aa, West Nile virus
DEREAHLRGE

SEQ ID NO: 143360 - protein, 10 aa, West Nile virus
REAHLRGECN

SEQ ID NO: 143361 - protein, 10 aa, West Nile virus
EAHLRGECNT

SEQ ID NO: 143362 - protein, 10 aa, West Nile virus
AHLRGECNTC

SEQ ID NO: 143363 - protein, 10 aa, West Nile virus
HLRGECNTCI

SEQ ID NO: 143364 - protein, 10 aa, West Nile virus
LRGECNTCIY

SEQ ID NO: 143365 - protein, 10 aa, West Nile virus
RGECNTCIYN

SEQ ID NO: 143366 - protein, 10 aa, West Nile virus
GECNTCIYNM

SEQ ID NO: 143367 - protein, 10 aa, West Nile virus
ECNTCIYNMM

SEQ ID NO: 143368 - protein, 10 aa, West Nile virus
CNTCIYNMMG

SEQ ID NO: 143369 - protein, 10 aa, West Nile virus
NTCIYNMMGK

SEQ ID NO: 143370 - protein, 10 aa, West Nile virus
KRPGDFGKAK

SEQ ID NO: 143371 - protein, 10 aa, West Nile virus
KPGEFGKARG

SEQ ID NO: 143372 - protein, 10 aa, West Nile virus
PGEFGKARGS

SEQ ID NO: 143373 - protein, 10 aa, West Nile virus
GEFGKARGSR

SEQ ID NO: 143374 - protein, 10 aa, West Nile virus
DFGKAKGSRA

SEQ ID NO: 143375 - protein, 10 aa, West Nile virus
LNEDHWLGRE

SEQ ID NO: 143376 - protein, 10 aa, West Nile virus
NEDHWLGREN

SEQ ID NO: 143377 - protein, 10 aa, West Nile virus
EDHWLGRENS

SEQ ID NO: 143378 - protein, 10 aa, West Nile virus
DHWLGRENSG

SEQ ID NO: 143379 - protein, 10 aa, West Nile virus
HWLGRENSGG

SEQ ID NO: 143380 - protein, 10 aa, West Nile virus
WLGRENSGGG

SEQ ID NO: 143381 - protein, 10 aa, West Nile virus
LGRENSGGGV

SEQ ID NO: 143382 - protein, 10 aa, West Nile virus
GRENSGGGVE

SEQ ID NO: 143383 - protein, 10 aa, West Nile virus
RENSGGGVEG

SEQ ID NO: 143384 - protein, 10 aa, West Nile virus
ENSGGGVEGL

SEQ ID NO: 143385 - protein, 10 aa, West Nile virus
GLGLQKLGYV

SEQ ID NO: 143386 - protein, 10 aa, West Nile virus
LGLQKLGYVL

SEQ ID NO: 143387 - protein, 10 aa, West Nile virus
GLQKLGYILK

SEQ ID NO: 143388 - protein, 10 aa, West Nile virus
LQKLGYILKE

SEQ ID NO: 143389 - protein, 10 aa, West Nile virus
QKLGYILKEV

SEQ ID NO: 143390 - protein, 10 aa, West Nile virus
KLGYILKEVG

SEQ ID NO: 143391 - protein, 10 aa, West Nile virus
GGKMYADDTA

SEQ ID NO: 143392 - protein, 10 aa, West Nile virus
GKMYADDTAG

SEQ ID NO: 143393 - protein, 10 aa, West Nile virus
KMYADDTAGW

SEQ ID NO: 143394 - protein, 10 aa, West Nile virus
MYADDTAGWD

SEQ ID NO: 143395 - protein, 10 aa, West Nile virus
TAGWDTRITK

SEQ ID NO: 143396 - protein, 10 aa, West Nile virus
AGWDTRITKA

SEQ ID NO: 143397 - protein, 10 aa, West Nile virus
GWDTRITKAD

SEQ ID NO: 143398 - protein, 10 aa, West Nile virus
WDTRITKADL

SEQ ID NO: 143399 - protein, 10 aa, West Nile virus
DTRITKADLE

SEQ ID NO: 143400 - protein, 10 aa, West Nile virus
TRITKADLEN

SEQ ID NO: 143401 - protein, 10 aa, West Nile virus
RITKADLENE

SEQ ID NO: 143402 - protein, 10 aa, West Nile virus
ITKADLENEA

SEQ ID NO: 143403 - protein, 10 aa, West Nile virus
TKADLENEAK

SEQ ID NO: 143404 - protein, 10 aa, West Nile virus
KADLENEAKV

SEQ ID NO: 143405 - protein, 10 aa, West Nile virus
LENEAKVLEF

SEQ ID NO: 143406 - protein, 10 aa, West Nile virus
ENEAKVLEFL

SEQ ID NO: 143407 - protein, 10 aa, West Nile virus
NEAKVLEFLD

SEQ ID NO: 143408 - protein, 10 aa, West Nile virus
EAKVLEFLDG

SEQ ID NO: 143409 - protein, 10 aa, West Nile virus
AKVLEFLDGE

SEQ ID NO: 143410 - protein, 10 aa, West Nile virus
KVLEFLDGEH

SEQ ID NO: 143411 - protein, 10 aa, West Nile virus
VLEFLDGEHR

SEQ ID NO: 143412 - protein, 10 aa, West Nile virus
LEFLDGEHRR

SEQ ID NO: 143413 - protein, 10 aa, West Nile virus
EFLDGEHRRL

SEQ ID NO: 143414 - protein, 10 aa, West Nile virus
FLDGEHRRLA

SEQ ID NO: 143415 - protein, 10 aa, West Nile virus
LEGEHRRLAR

SEQ ID NO: 143416 - protein, 10 aa, West Nile virus
DGEHRRLARS

SEQ ID NO: 143417 - protein, 10 aa, West Nile virus
GEHRRLARSI

SEQ ID NO: 143418 - protein, 10 aa, West Nile virus
EHRRLARSII

SEQ ID NO: 143419 - protein, 10 aa, West Nile virus
HRRLARSIIE

SEQ ID NO: 143420 - protein, 10 aa, West Nile virus
RRLARSIIEL

SEQ ID NO: 143421 - protein, 10 aa, West Nile virus
RLARSIIELT

SEQ ID NO: 143422 - protein, 10 aa, West Nile virus
LARSIIELTY

SEQ ID NO: 143423 - protein, 10 aa, West Nile virus
ARSIIELTYR

SEQ ID NO: 143424 - protein, 10 aa, West Nile virus
RSIIELTYRH

SEQ ID NO: 143425 - protein, 10 aa, West Nile virus
SIIELTYRHK

SEQ ID NO: 143426 - protein, 10 aa, West Nile virus
VIELTYRHKV

SEQ ID NO: 143427 - protein, 10 aa, West Nile virus
IELTYRYKVV

SEQ ID NO: 143428 - protein, 10 aa, West Nile virus
QLTYRHKVVK

SEQ ID NO: 143429 - protein, 10 aa, West Nile virus
LTYRHKVVKG

SEQ ID NO: 143430 - protein, 10 aa, West Nile virus
TYRYKVVKVM

SEQ ID NO: 143431 - protein, 10 aa, West Nile virus
YRHKVVKGMR

SEQ ID NO: 143432 - protein, 10 aa, West Nile virus
CHKVVKVMRP

SEQ ID NO: 143433 - protein, 10 aa, West Nile virus
YKVVKVMRPA

SEQ ID NO: 143434 - protein, 10 aa, West Nile virus
KVVKVMRPAV

SEQ ID NO: 143435 - protein, 10 aa, West Nile virus
VVKVMRPAVG

SEQ ID NO: 143436 - protein, 10 aa, West Nile virus
VKVMRPAVGG

SEQ ID NO: 143437 - protein, 10 aa, West Nile virus
KVMRPAADGK

SEQ ID NO: 143438 - protein, 10 aa, West Nile virus
VMRPAADGKT

SEQ ID NO: 143439 - protein, 10 aa, West Nile virus
MRPAADGKTV

SEQ ID NO: 143440 - protein, 10 aa, West Nile virus
RPAADGKTVM

SEQ ID NO: 143441 - protein, 10 aa, West Nile virus
PAADGKTVMD

SEQ ID NO: 143442 - protein, 10 aa, West Nile virus
AADGKTVMDV

SEQ ID NO: 143443 - protein, 10 aa, West Nile virus
ADGKTVMDVI

SEQ ID NO: 143444 - protein, 10 aa, West Nile virus
DGKTVMDVIS

SEQ ID NO: 143445 - protein, 10 aa, West Nile virus
GKTVMDVISR

SEQ ID NO: 143446 - protein, 10 aa, West Nile virus
KTVMDVISRE

SEQ ID NO: 143447 - protein, 10 aa, West Nile virus
TVMDIISRED

SEQ ID NO: 143448 - protein, 10 aa, West Nile virus
VMDIISREDQ

SEQ ID NO: 143449 - protein, 10 aa, West Nile virus
MDIISREDQR

SEQ ID NO: 143450 - protein, 10 aa, West Nile virus
DIISREDQRG

SEQ ID NO: 143451 - protein, 10 aa, West Nile virus
IISREDQRGS

SEQ ID NO: 143452 - protein, 10 aa, West Nile virus
GQVVTYALNP

SEQ ID NO: 143453 - protein, 10 aa, West Nile virus
QVVTYALNPF

SEQ ID NO: 143454 - protein, 10 aa, West Nile virus
VVTYALNPFS

SEQ ID NO: 143455 - protein, 10 aa, West Nile virus
VTYALNPFTN

SEQ ID NO: 143456 - protein, 10 aa, West Nile virus
TYALNPFTNL

SEQ ID NO: 143457 - protein, 10 aa, West Nile virus
YALNTFTNLS

SEQ ID NO: 143458 - protein, 10 aa, West Nile virus
ALNTFTNLSV

SEQ ID NO: 143459 - protein, 10 aa, West Nile virus
LNTFTNLSVQ

SEQ ID NO: 143460 - protein, 10 aa, West Nile virus
NTFTNLSVQL

SEQ ID NO: 143461 - protein, 10 aa, West Nile virus
TFTNLSVQLV

SEQ ID NO: 143462 - protein, 10 aa, West Nile virus
FTNLSVQLVR

SEQ ID NO: 143463 - protein, 10 aa, West Nile virus
TNLSVQLVRM

SEQ ID NO: 143464 - protein, 10 aa, West Nile virus
NLSVQLVRMM

SEQ ID NO: 143465 - protein, 10 aa, West Nile virus
LSVQLVRMME

SEQ ID NO: 143466 - protein, 10 aa, West Nile virus
SVQLVRMMEG

SEQ ID NO: 143467 - protein, 10 aa, West Nile virus
FQLGRRREGE

SEQ ID NO: 143468 - protein, 10 aa, West Nile virus
QLVRRREGEG

SEQ ID NO: 143469 - protein, 10 aa, West Nile virus
LGRRREGEGV

SEQ ID NO: 143470 - protein, 10 aa, West Nile virus
VRMMEGEGVV

SEQ ID NO: 143471 - protein, 10 aa, West Nile virus
RMMEGEGVVG

SEQ ID NO: 143472 - protein, 10 aa, West Nile virus
MMEGEGVVGP

SEQ ID NO: 143473 - protein, 10 aa, West Nile virus
MEGEGVVGPD

SEQ ID NO: 143474 - protein, 10 aa, West Nile virus
EGEGVVGPDD

SEQ ID NO: 143475 - protein, 10 aa, West Nile virus
GEGVVGPDDV

SEQ ID NO: 143476 - protein, 10 aa, West Nile virus
EGVVGPDDVE

SEQ ID NO: 143477 - protein, 10 aa, West Nile virus
KGKGVKVRVW

SEQ ID NO: 143478 - protein, 10 aa, West Nile virus
GKGVKVRVWL

SEQ ID NO: 143479 - protein, 10 aa, West Nile virus
KGVKVRVWLF

SEQ ID NO: 143480 - protein, 10 aa, West Nile virus
GVKVRVWLFE

SEQ ID NO: 143481 - protein, 10 aa, West Nile virus
VKVRVWLFEN

SEQ ID NO: 143482 - protein, 10 aa, West Nile virus
KVRVWLFENG

SEQ ID NO: 143483 - protein, 10 aa, West Nile virus
VRVWLFENGE

SEQ ID NO: 143484 - protein, 10 aa, West Nile virus
RVWLFENGEE

SEQ ID NO: 143485 - protein, 10 aa, West Nile virus
VWLFENGEER

SEQ ID NO: 143486 - protein, 10 aa, West Nile virus
WLSENGEERL

SEQ ID NO: 143487 - protein, 10 aa, West Nile virus
LSENGEERLS

SEQ ID NO: 143488 - protein, 10 aa, West Nile virus
SENGEERLSR

SEQ ID NO: 143489 - protein, 10 aa, West Nile virus
ENGKERLGRM

SEQ ID NO: 143490 - protein, 10 aa, West Nile virus
NGKERLGRMA

SEQ ID NO: 143491 - protein, 10 aa, West Nile virus
GEERLGRMAV

SEQ ID NO: 143492 - protein, 10 aa, West Nile virus
KERLGRMAVS

SEQ ID NO: 143493 - protein, 10 aa, West Nile virus
ERLGRMAVSG

SEQ ID NO: 143494 - protein, 10 aa, West Nile virus
RLGRMAVSGD

SEQ ID NO: 143495 - protein, 10 aa, West Nile virus
LGRMAVSGDD

SEQ ID NO: 143496 - protein, 10 aa, West Nile virus
GRMAVSGDDC

SEQ ID NO: 143497 - protein, 10 aa, West Nile virus
VKPLDDRFAS

SEQ ID NO: 143498 - protein, 10 aa, West Nile virus
KPLDDRFATA

SEQ ID NO: 143499 - protein, 10 aa, West Nile virus
PLDDRFATAL

SEQ ID NO: 143500 - protein, 10 aa, West Nile virus
LDDRFATALH

SEQ ID NO: 143501 - protein, 10 aa, West Nile virus
DDRFATALHF

SEQ ID NO: 143502 - protein, 10 aa, West Nile virus
DRFATALHFL

SEQ ID NO: 143503 - protein, 10 aa, West Nile virus
RFATALHFLN

SEQ ID NO: 143504 - protein, 10 aa, West Nile virus
FATALHFLNA

SEQ ID NO: 143505 - protein, 10 aa, West Nile virus
ATALHFLNAM

SEQ ID NO: 143506 - protein, 10 aa, West Nile virus
TALHFLNAMS

SEQ ID NO: 143507 - protein, 10 aa, West Nile virus
ALHFLNAMSK

SEQ ID NO: 143508 - protein, 10 aa, West Nile virus
LHFLNDMSKV

SEQ ID NO: 143509 - protein, 10 aa, West Nile virus
HFLNAMPKVR

SEQ ID NO: 143510 - protein, 10 aa, West Nile virus
FLNDMSKVRK

SEQ ID NO: 143511 - protein, 10 aa, West Nile virus
LNAMSQVRKD

SEQ ID NO: 143512 - protein, 10 aa, West Nile virus
NDMSKVRKDI

SEQ ID NO: 143513 - protein, 10 aa, West Nile virus
AMPKVRKDIQ

SEQ ID NO: 143514 - protein, 10 aa, West Nile virus
MPKVRKDIQE

SEQ ID NO: 143515 - protein, 10 aa, West Nile virus
PKVRKDIQEW

SEQ ID NO: 143516 - protein, 10 aa, West Nile virus
PSTGWYDWQK

SEQ ID NO: 143517 - protein, 10 aa, West Nile virus
SVGWYDWQQV

SEQ ID NO: 143518 - protein, 10 aa, West Nile virus
TGWYDWQQVQ

SEQ ID NO: 143519 - protein, 10 aa, West Nile virus
GWYDWQQVQF

SEQ ID NO: 143520 - protein, 10 aa, West Nile virus
WYDWQQVQFC

SEQ ID NO: 143521 - protein, 10 aa, West Nile virus
YDWQQVQFCS

SEQ ID NO: 143522 - protein, 10 aa, West Nile virus
DWQQVQFCSN

SEQ ID NO: 143523 - protein, 10 aa, West Nile virus
WQQVQFCSNH

SEQ ID NO: 143524 - protein, 10 aa, West Nile virus
QQVQFCSNHF

SEQ ID NO: 143525 - protein, 10 aa, West Nile virus
QVQFCSNHFT

SEQ ID NO: 143526 - protein, 10 aa, West Nile virus
VQFCSNHFTE

SEQ ID NO: 143527 - protein, 10 aa, West Nile virus
QFCSNHFTEL

SEQ ID NO: 143528 - protein, 10 aa, West Nile virus
IMKDGRTLVT

SEQ ID NO: 143529 - protein, 10 aa, West Nile virus
MKDGRTLVTP

SEQ ID NO: 143530 - protein, 10 aa, West Nile virus
KDGRTLVTPC

SEQ ID NO: 143531 - protein, 10 aa, West Nile virus
DGRTLVTPCR

SEQ ID NO: 143532 - protein, 10 aa, West Nile virus
GRTLVTPCRG

SEQ ID NO: 143533 - protein, 10 aa, West Nile virus
RTLVTPCRGQ

SEQ ID NO: 143534 - protein, 10 aa, West Nile virus
TLVTPCRGQD

SEQ ID NO: 143535 - protein, 10 aa, West Nile virus
LVTPCRGQDE

SEQ ID NO: 143536 - protein, 10 aa, West Nile virus
VTPCRGQDEL

SEQ ID NO: 143537 - protein, 10 aa, West Nile virus
VPCRGQDELI

SEQ ID NO: 143538 - protein, 10 aa, West Nile virus
PCRGQDELIG

SEQ ID NO: 143539 - protein, 10 aa, West Nile virus
CRGQDELIGR

SEQ ID NO: 143540 - protein, 10 aa, West Nile virus
RGQDELIGRA

SEQ ID NO: 143541 - protein, 10 aa, West Nile virus
GQDELIGRAR

SEQ ID NO: 143542 - protein, 10 aa, West Nile virus
QDELIGRARI

SEQ ID NO: 143543 - protein, 10 aa, West Nile virus
DELIGRARIS

SEQ ID NO: 143544 - protein, 10 aa, West Nile virus
ELIGRARISP

SEQ ID NO: 143545 - protein, 10 aa, West Nile virus
LIGRARISPG

SEQ ID NO: 143546 - protein, 10 aa, West Nile virus
IGRARISPGA

SEQ ID NO: 143547 - protein, 10 aa, West Nile virus
LAKSYAQMWQ

SEQ ID NO: 143548 - protein, 10 aa, West Nile virus
AKSYAQMWQL

SEQ ID NO: 143549 - protein, 10 aa, West Nile virus
KSYAQMWQLL

SEQ ID NO: 143550 - protein, 10 aa, West Nile virus
SYAQMWQLLY

SEQ ID NO: 143551 - protein, 10 aa, West Nile virus
YAQMWQLLYF

SEQ ID NO: 143552 - protein, 10 aa, West Nile virus
AQMWQLLYFH

SEQ ID NO: 143553 - protein, 10 aa, West Nile virus
QMWQLLYFHR

SEQ ID NO: 143554 - protein, 10 aa, West Nile virus
MWQLLYFHRR

SEQ ID NO: 143555 - protein, 10 aa, West Nile virus
WQLLYFHRRD

SEQ ID NO: 143556 - protein, 10 aa, West Nile virus
QLLYFHRRDL

SEQ ID NO: 143557 - protein, 10 aa, West Nile virus
ANAICSAVPA

SEQ ID NO: 143558 - protein, 10 aa, West Nile virus
NAICSAVPVS

SEQ ID NO: 143559 - protein, 10 aa, West Nile virus
AICSAVPVSW

SEQ ID NO: 143560 - protein, 10 aa, West Nile virus
ICSAVPVSWV

SEQ ID NO: 143561 - protein, 10 aa, West Nile virus
CSAVPVSWVP

SEQ ID NO: 143562 - protein, 10 aa, West Nile virus
SAVPVSWVPT

SEQ ID NO: 143563 - protein, 10 aa, West Nile virus
AVPVSWVPTG

SEQ ID NO: 143564 - protein, 10 aa, West Nile virus
VPVSWVPTGR

SEQ ID NO: 143565 - protein, 10 aa, West Nile virus
PVSWVPTGRT

SEQ ID NO: 143566 - protein, 10 aa, West Nile virus
VSWVPTGRTT

SEQ ID NO: 143567 - protein, 10 aa, West Nile virus
SWVPTGRTTW

SEQ ID NO: 143568 - protein, 10 aa, West Nile virus
TGRTTWSIHV

SEQ ID NO: 143569 - protein, 10 aa, West Nile virus
GRTTWSIHAK

SEQ ID NO: 143570 - protein, 10 aa, West Nile virus
RTTWSIHAKG

SEQ ID NO: 143571 - protein, 10 aa, West Nile virus
TTWSIHAKGE

SEQ ID NO: 143572 - protein, 10 aa, West Nile virus
TWSIHAKGEW

SEQ ID NO: 143573 - protein, 10 aa, West Nile virus
WSIHAKGEWM

SEQ ID NO: 143574 - protein, 10 aa, West Nile virus
SIHAKGEWMT

SEQ ID NO: 143575 - protein, 10 aa, West Nile virus
IHAKGEWMTT

SEQ ID NO: 143576 - protein, 10 aa, West Nile virus
HAKGEWMTTE

SEQ ID NO: 143577 - protein, 10 aa, West Nile virus
KGEWMTTEDM

SEQ ID NO: 143578 - protein, 10 aa, West Nile virus
GEWMTTADML

SEQ ID NO: 143579 - protein, 10 aa, West Nile virus
EWMTTEDMLA

SEQ ID NO: 143580 - protein, 10 aa, West Nile virus
WMTTEDMLAV

SEQ ID NO: 143581 - protein, 10 aa, West Nile virus
MTTEDMLAVW

SEQ ID NO: 143582 - protein, 10 aa, West Nile virus
TTEDMLAVWN

SEQ ID NO: 143583 - protein, 10 aa, West Nile virus
TEDMLAVWNR

SEQ ID NO: 143584 - protein, 10 aa, West Nile virus
EDMLAVWNRV

SEQ ID NO: 143585 - protein, 10 aa, West Nile virus
DMLAVWNRVW

SEQ ID NO: 143586 - protein, 10 aa, West Nile virus
MLAVWNRVWI

SEQ ID NO: 143587 - protein, 10 aa, West Nile virus
LAVWNRVWIE

SEQ ID NO: 143588 - protein, 10 aa, West Nile virus
AVWNRVWIEE

SEQ ID NO: 143589 - protein, 10 aa, West Nile virus
WNKVWIEENE

SEQ ID NO: 143590 - protein, 10 aa, West Nile virus
NKVWIEENEW

SEQ ID NO: 143591 - protein, 10 aa, West Nile virus
KVWIEENEWM

SEQ ID NO: 143592 - protein, 10 aa, West Nile virus
WMEDKTPVER

SEQ ID NO: 143593 - protein, 10 aa, West Nile virus
MEDKTPVERW

SEQ ID NO: 143594 - protein, 10 aa, West Nile virus
EDKTPVERWS

SEQ ID NO: 143595 - protein, 10 aa, West Nile virus
DKTPVERWSD

SEQ ID NO: 143596 - protein, 10 aa, West Nile virus
KTPVERWSDV

SEQ ID NO: 143597 - protein, 10 aa, West Nile virus
TPVERWSDVP

SEQ ID NO: 143598 - protein, 10 aa, West Nile virus
PVERWSDVPY

SEQ ID NO: 143599 - protein, 10 aa, West Nile virus
VERWSDVPYS

SEQ ID NO: 143600 - protein, 10 aa, West Nile virus
ERWSDVPYSG

SEQ ID NO: 143601 - protein, 10 aa, West Nile virus
RWSDVPYSGK

SEQ ID NO: 143602 - protein, 10 aa, West Nile virus
WSDIPYSGKR

SEQ ID NO: 143603 - protein, 10 aa, West Nile virus
SDIPYSGKRE

SEQ ID NO: 143604 - protein, 10 aa, West Nile virus
DIPYSGKRED

SEQ ID NO: 143605 - protein, 10 aa, West Nile virus
IPYSGKREDI

SEQ ID NO: 143606 - protein, 10 aa, West Nile virus
WCGSLIGTRT

SEQ ID NO: 143607 - protein, 10 aa, West Nile virus
CGSLIGTRTR

SEQ ID NO: 143608 - protein, 10 aa, West Nile virus
GSLIGTRTRA

SEQ ID NO: 143609 - protein, 10 aa, West Nile virus
SLIGTRTRAT

SEQ ID NO: 143610 - protein, 10 aa, West Nile virus
LIGTRTRATW

SEQ ID NO: 143611 - protein, 10 aa, West Nile virus
IGTRTRATWA

SEQ ID NO: 143612 - protein, 10 aa, West Nile virus
GTRTRATWAE

SEQ ID NO: 143613 - protein, 10 aa, West Nile virus
TRTRATWAEN

SEQ ID NO: 143614 - protein, 10 aa, West Nile virus
RTRATWAENI

SEQ ID NO: 143615 - protein, 10 aa, West Nile virus
TRATWAENIH

SEQ ID NO: 143616 - protein, 10 aa, West Nile virus
RATWAENIHV

SEQ ID NO: 143617 - protein, 10 aa, West Nile virus
ATWAENIHVA

SEQ ID NO: 143618 - protein, 10 aa, West Nile virus
TWAENIHVAI

SEQ ID NO: 143619 - protein, 10 aa, West Nile virus
WAENIHVAIN

SEQ ID NO: 143620 - protein, 10 aa, West Nile virus
AENIHVAINQ

SEQ ID NO: 143621 - protein, 10 aa, West Nile virus
ENIHVAINQV

SEQ ID NO: 143622 - protein, 10 aa, West Nile virus
NIHVAINQVR

SEQ ID NO: 143623 - protein, 10 aa, West Nile virus
IHVAINQVRS

SEQ ID NO: 143624 - protein, 10 aa, West Nile virus
VIGEEKYVDY

SEQ ID NO: 143625 - protein, 10 aa, West Nile virus
IGEEKYVDYM

SEQ ID NO: 143626 - protein, 10 aa, West Nile virus
GEEKYVDYMS

SEQ ID NO: 143627 - protein, 10 aa, West Nile virus
EEKYVDYMSS

SEQ ID NO: 143628 - protein, 10 aa, West Nile virus
EKYVDYMGSL

SEQ ID NO: 143629 - protein, 10 aa, West Nile virus
KYVDYMSSLR

SEQ ID NO: 143630 - protein, 10 aa, West Nile virus
YVDYMSSLRR

SEQ ID NO: 143631 - protein, 10 aa, West Nile virus
VDYMSSLRRY

SEQ ID NO: 143632 - protein, 10 aa, West Nile virus
DYMSSLRRYE

SEQ ID NO: 143633 - protein, 10 aa, West Nile virus
YMSSLRRYED

SEQ ID NO: 143634 - protein, 10 aa, West Nile virus
PGKNRAVNMQ

SEQ ID NO: 143635 - protein, 10 aa, West Nile virus
GKNRAVNMQK

SEQ ID NO: 143636 - protein, 10 aa, West Nile virus
KNRAVNMQKR

SEQ ID NO: 143637 - protein, 10 aa, West Nile virus
NRAVNMQKRG

SEQ ID NO: 143638 - protein, 10 aa, West Nile virus
RAVNMQKRGT

SEQ ID NO: 143639 - protein, 10 aa, West Nile virus
AVNMQKRGMP

SEQ ID NO: 143640 - protein, 10 aa, West Nile virus
VNMQKRGMPR

SEQ ID NO: 143641 - protein, 10 aa, West Nile virus
KRGTPRVLSL

SEQ ID NO: 143642 - protein, 10 aa, West Nile virus
PRVLSLTGLK

SEQ ID NO: 143643 - protein, 10 aa, West Nile virus
RVLSLTGLKR

SEQ ID NO: 143644 - protein, 10 aa, West Nile virus
VLSLTGLKRA

SEQ ID NO: 143645 - protein, 10 aa, West Nile virus
LSLIGLKRAV

SEQ ID NO: 143646 - protein, 10 aa, West Nile virus
SLIGLKRAVL

SEQ ID NO: 143647 - protein, 10 aa, West Nile virus
LIGLKRAVLS

SEQ ID NO: 143648 - protein, 10 aa, West Nile virus
IGLKRAVLSL

SEQ ID NO: 143649 - protein, 10 aa, West Nile virus
RAVLSLIDGK

SEQ ID NO: 143650 - protein, 10 aa, West Nile virus
AVLSLIDGKG

SEQ ID NO: 143651 - protein, 10 aa, West Nile virus
VLSLIDGKGP

SEQ ID NO: 143652 - protein, 10 aa, West Nile virus
LSLIDGRGPT

SEQ ID NO: 143653 - protein, 10 aa, West Nile virus
SLIDGRGPTR

SEQ ID NO: 143654 - protein, 10 aa, West Nile virus
LIDGRGPTRF

SEQ ID NO: 143655 - protein, 10 aa, West Nile virus
IDGRGPTRFV

SEQ ID NO: 143656 - protein, 10 aa, West Nile virus
DGRGPTRFVL

SEQ ID NO: 143657 - protein, 10 aa, West Nile virus
GRGPTRFVLA

SEQ ID NO: 143658 - protein, 10 aa, West Nile virus
RGPTRFVLAL

SEQ ID NO: 143659 - protein, 10 aa, West Nile virus
PIRFVLALLT

SEQ ID NO: 143660 - protein, 10 aa, West Nile virus
IRFVLALLTF

SEQ ID NO: 143661 - protein, 10 aa, West Nile virus
FVLALLAFFK

SEQ ID NO: 143662 - protein, 10 aa, West Nile virus
VLALLAFFKF

SEQ ID NO: 143663 - protein, 10 aa, West Nile virus
LALLAFFKFT

SEQ ID NO: 143664 - protein, 10 aa, West Nile virus
ALLAFFKFTA

SEQ ID NO: 143665 - protein, 10 aa, West Nile virus
LLAFFKFTAI

SEQ ID NO: 143666 - protein, 10 aa, West Nile virus
LAFFKFTAIA

SEQ ID NO: 143667 - protein, 10 aa, West Nile virus
AFFKFTAIAP

SEQ ID NO: 143668 - protein, 10 aa, West Nile virus
AVAPTRAVLD

SEQ ID NO: 143669 - protein, 10 aa, West Nile virus
IAPTRAVLER

SEQ ID NO: 143670 - protein, 10 aa, West Nile virus
APTRAVLNRW

SEQ ID NO: 143671 - protein, 10 aa, West Nile virus
PTRAVLNRWR

SEQ ID NO: 143672 - protein, 10 aa, West Nile virus
TRAVLDRWRS

SEQ ID NO: 143673 - protein, 10 aa, West Nile virus
RAVLDRWRSV

SEQ ID NO: 143674 - protein, 10 aa, West Nile virus
AVLDRWRSVN

SEQ ID NO: 143675 - protein, 10 aa, West Nile virus
VLDRWRSVNK

SEQ ID NO: 143676 - protein, 10 aa, West Nile virus
LDRWRSVNKQ

SEQ ID NO: 143677 - protein, 10 aa, West Nile virus
DRWRSVNKQT

SEQ ID NO: 143678 - protein, 10 aa, West Nile virus
RWRSVNKQTA

SEQ ID NO: 143679 - protein, 10 aa, West Nile virus
WRSVNKQTAM

SEQ ID NO: 143680 - protein, 10 aa, West Nile virus
RSVNKQTAMK

SEQ ID NO: 143681 - protein, 10 aa, West Nile virus
SVNKQTAMKH

SEQ ID NO: 143682 - protein, 10 aa, West Nile virus
LLSFKRELGT

SEQ ID NO: 143683 - protein, 10 aa, West Nile virus
LSFKRELGTL

SEQ ID NO: 143684 - protein, 10 aa, West Nile virus
SFKRELGTLT

SEQ ID NO: 143685 - protein, 10 aa, West Nile virus
FKKELGALTS

SEQ ID NO: 143686 - protein, 10 aa, West Nile virus
KRELGTLTSA

SEQ ID NO: 143687 - protein, 10 aa, West Nile virus
RELGTLTSAI

SEQ ID NO: 143688 - protein, 10 aa, West Nile virus
ELGALTSAIN

SEQ ID NO: 143689 - protein, 10 aa, West Nile virus
LGALTSAINR

SEQ ID NO: 143690 - protein, 10 aa, West Nile virus
GILTNAISRR

SEQ ID NO: 143691 - protein, 10 aa, West Nile virus
ILTNAISRRS

SEQ ID NO: 143692 - protein, 10 aa, West Nile virus
NRRSLKQKKR

SEQ ID NO: 143693 - protein, 10 aa, West Nile virus
RRSLKQKKRG

SEQ ID NO: 143694 - protein, 10 aa, West Nile virus
RSLKQKKRGG

SEQ ID NO: 143695 - protein, 10 aa, West Nile virus
KQKKRGGNTG

SEQ ID NO: 143696 - protein, 10 aa, West Nile virus
GAVVLSNFQG

SEQ ID NO: 143697 - protein, 10 aa, West Nile virus
AVVLSNFQGK

SEQ ID NO: 143698 - protein, 10 aa, West Nile virus
VTLSDFQGKV

SEQ ID NO: 143699 - protein, 10 aa, West Nile virus
TLSNFQGKVI

SEQ ID NO: 143700 - protein, 10 aa, West Nile virus
LSNFQGKVIM

SEQ ID NO: 143701 - protein, 10 aa, West Nile virus
SNFQGKVIMT

SEQ ID NO: 143702 - protein, 10 aa, West Nile virus
NFQGKVIMTV

SEQ ID NO: 143703 - protein, 10 aa, West Nile virus
FQGKVIMTVN

SEQ ID NO: 143704 - protein, 10 aa, West Nile virus
QGKVIMTVNA

SEQ ID NO: 143705 - protein, 10 aa, West Nile virus
GKVIMTVNAT

SEQ ID NO: 143706 - protein, 10 aa, West Nile virus
KLMMTINATD

SEQ ID NO: 143707 - protein, 10 aa, West Nile virus
AITIPTAAGK

SEQ ID NO: 143708 - protein, 10 aa, West Nile virus
ITIPIASGKN

SEQ ID NO: 143709 - protein, 10 aa, West Nile virus
TIPIASGKNL

SEQ ID NO: 143710 - protein, 10 aa, West Nile virus
IPTASGKNLC

SEQ ID NO: 143711 - protein, 10 aa, West Nile virus
PTASGKNLCT

SEQ ID NO: 143712 - protein, 10 aa, West Nile virus
TAAGKNLCTV

SEQ ID NO: 143713 - protein, 10 aa, West Nile virus
ASGKNLCTVR

SEQ ID NO: 143714 - protein, 10 aa, West Nile virus
SGKNLCTVRA

SEQ ID NO: 143715 - protein, 10 aa, West Nile virus
GKNLCTVRAM

SEQ ID NO: 143716 - protein, 10 aa, West Nile virus
KNLCTVRAMD

SEQ ID NO: 143717 - protein, 10 aa, West Nile virus
NLCTVRAMDV

SEQ ID NO: 143718 - protein, 10 aa, West Nile virus
LCTVRAMDVG

SEQ ID NO: 143719 - protein, 10 aa, West Nile virus
CIVRAMDVGH

SEQ ID NO: 143720 - protein, 10 aa, West Nile virus
IRAMDVGFMC

SEQ ID NO: 143721 - protein, 10 aa, West Nile virus
RAMDVGFMCD

SEQ ID NO: 143722 - protein, 10 aa, West Nile virus
AMDVGFMCDD

SEQ ID NO: 143723 - protein, 10 aa, West Nile virus
MDVGFMCDDT

SEQ ID NO: 143724 - protein, 10 aa, West Nile virus
DVGFMCDDTI

SEQ ID NO: 143725 - protein, 10 aa, West Nile virus
VGFMCDDTIA

SEQ ID NO: 143726 - protein, 10 aa, West Nile virus
GFMCDDTIAY

SEQ ID NO: 143727 - protein, 10 aa, West Nile virus
FMCDDTIAYE

SEQ ID NO: 143728 - protein, 10 aa, West Nile virus
MCDDTIAYEC

SEQ ID NO: 143729 - protein, 10 aa, West Nile virus
CDDTIAYECP

SEQ ID NO: 143730 - protein, 10 aa, West Nile virus
DDTIAYECPA

SEQ ID NO: 143731 - protein, 10 aa, West Nile virus
DTITYECPAL

SEQ ID NO: 143732 - protein, 10 aa, West Nile virus
TIAYECPALM

SEQ ID NO: 143733 - protein, 10 aa, West Nile virus
IAYECPALME

SEQ ID NO: 143734 - protein, 10 aa, West Nile virus
AYECPALMEG

SEQ ID NO: 143735 - protein, 10 aa, West Nile virus
YECPALMEGN

SEQ ID NO: 143736 - protein, 10 aa, West Nile virus
ECPALMEGND

SEQ ID NO: 143737 - protein, 10 aa, West Nile virus
CPALMEGNDP

SEQ ID NO: 143738 - protein, 10 aa, West Nile virus
PALMEGNDPE

SEQ ID NO: 143739 - protein, 10 aa, West Nile virus
ALMEGNDPED

SEQ ID NO: 143740 - protein, 10 aa, West Nile virus
LMEGNDPEDI

SEQ ID NO: 143741 - protein, 10 aa, West Nile virus
MEGNDPEDID

SEQ ID NO: 143742 - protein, 10 aa, West Nile virus
EDVDCWCTKS

SEQ ID NO: 143743 - protein, 10 aa, West Nile virus
DIDCWCTKLA

SEQ ID NO: 143744 - protein, 10 aa, West Nile virus
AVFVRYGRCT

SEQ ID NO: 143745 - protein, 10 aa, West Nile virus
MYVRYGRCTK

SEQ ID NO: 143746 - protein, 10 aa, West Nile virus
RYGRCTRTRH

SEQ ID NO: 143747 - protein, 10 aa, West Nile virus
YGRCTRTRHS

SEQ ID NO: 143748 - protein, 10 aa, West Nile virus
GRCTRTRHSR

SEQ ID NO: 143749 - protein, 10 aa, West Nile virus
RCTRTRHSRR

SEQ ID NO: 143750 - protein, 10 aa, West Nile virus
CTKTRQSRRS

SEQ ID NO: 143751 - protein, 10 aa, West Nile virus
TKTRQSRRSR

SEQ ID NO: 143752 - protein, 10 aa, West Nile virus
KTRQSRRSRR

SEQ ID NO: 143753 - protein, 10 aa, West Nile virus
TRQSRRSRRS

SEQ ID NO: 143754 - protein, 10 aa, West Nile virus
RQSRRSRRSL

SEQ ID NO: 143755 - protein, 10 aa, West Nile virus
QSRRSRRSLT

SEQ ID NO: 143756 - protein, 10 aa, West Nile virus
RSKRSLTVQT

SEQ ID NO: 143757 - protein, 10 aa, West Nile virus
SRRSLTVQAH

SEQ ID NO: 143758 - protein, 10 aa, West Nile virus
KRSLTVQTHG

SEQ ID NO: 143759 - protein, 10 aa, West Nile virus
RSLTVQAHGE

SEQ ID NO: 143760 - protein, 10 aa, West Nile virus
SLTVQAHGES

SEQ ID NO: 143761 - protein, 10 aa, West Nile virus
LTVQAHGEST

SEQ ID NO: 143762 - protein, 10 aa, West Nile virus
TVQTHGKSTL

SEQ ID NO: 143763 - protein, 10 aa, West Nile virus
VQTHGESTLS

SEQ ID NO: 143764 - protein, 10 aa, West Nile virus
QTHGESTLSN

SEQ ID NO: 143765 - protein, 10 aa, West Nile virus
THGESTLSNK

SEQ ID NO: 143766 - protein, 10 aa, West Nile virus
HGESTLSNKK

SEQ ID NO: 143767 - protein, 10 aa, West Nile virus
GESTLSNKKG

SEQ ID NO: 143768 - protein, 10 aa, West Nile virus
ESTLSNKKGA

SEQ ID NO: 143769 - protein, 10 aa, West Nile virus
STLSNKKGAW

SEQ ID NO: 143770 - protein, 10 aa, West Nile virus
SLSNRKGAWL

SEQ ID NO: 143771 - protein, 10 aa, West Nile virus
LSNRKGAWLD

SEQ ID NO: 143772 - protein, 10 aa, West Nile virus
SNRKGAWLDS

SEQ ID NO: 143773 - protein, 10 aa, West Nile virus
NRKGAWLDST

SEQ ID NO: 143774 - protein, 10 aa, West Nile virus
RKGAWLDSTK

SEQ ID NO: 143775 - protein, 10 aa, West Nile virus
GAWLDSTKAS

SEQ ID NO: 143776 - protein, 10 aa, West Nile virus
AWLDSTKASR

SEQ ID NO: 143777 - protein, 10 aa, West Nile virus
WLDSTKASRY

SEQ ID NO: 143778 - protein, 10 aa, West Nile virus
LDSTKASRYL

SEQ ID NO: 143779 - protein, 10 aa, West Nile virus
TGWMLGSNTM

SEQ ID NO: 143780 - protein, 10 aa, West Nile virus
SNTTQRVVFM

SEQ ID NO: 143781 - protein, 10 aa, West Nile virus
MQRVVFAVLL

SEQ ID NO: 143782 - protein, 10 aa, West Nile virus
QRVVFMILLL

SEQ ID NO: 143783 - protein, 10 aa, West Nile virus
RVVFMILLLL

SEQ ID NO: 143784 - protein, 10 aa, West Nile virus
VVFAVLLLLV

SEQ ID NO: 143785 - protein, 10 aa, West Nile virus
VFAVLLLLVA

SEQ ID NO: 143786 - protein, 10 aa, West Nile virus
FAVLLLLVAP

SEQ ID NO: 143787 - protein, 10 aa, West Nile virus
AVLLLLVAPA

SEQ ID NO: 143788 - protein, 10 aa, West Nile virus
CLGMSSRDFL

SEQ ID NO: 143789 - protein, 10 aa, West Nile virus
LGMSSRDFLE

SEQ ID NO: 143790 - protein, 10 aa, West Nile virus
GMSSRDFLEG

SEQ ID NO: 143791 - protein, 10 aa, West Nile virus
MSSRDFLEGV

SEQ ID NO: 143792 - protein, 10 aa, West Nile virus
SSRDFLEGVS

SEQ ID NO: 143793 - protein, 10 aa, West Nile virus
SRDFLEGVSG

SEQ ID NO: 143794 - protein, 10 aa, West Nile virus
LEGVSGATWM

SEQ ID NO: 143795 - protein, 10 aa, West Nile virus
EGVSGATWMD

SEQ ID NO: 143796 - protein, 10 aa, West Nile virus
GVSGATWMDL

SEQ ID NO: 143797 - protein, 10 aa, West Nile virus
VSGATWMDLV

SEQ ID NO: 143798 - protein, 10 aa, West Nile virus
EGDSCVTLMS

SEQ ID NO: 143799 - protein, 10 aa, West Nile virus
GDSCVTITAK

SEQ ID NO: 143800 - protein, 10 aa, West Nile virus
DSCVTITAKD

SEQ ID NO: 143801 - protein, 10 aa, West Nile virus
SCVTLMSKDK

SEQ ID NO: 143802 - protein, 10 aa, West Nile virus
CVTITAKDRP

SEQ ID NO: 143803 - protein, 10 aa, West Nile virus
VTITAKDRPT

SEQ ID NO: 143804 - protein, 10 aa, West Nile virus
TITAKDRPTI

SEQ ID NO: 143805 - protein, 10 aa, West Nile virus
IMSKNKPTID

SEQ ID NO: 143806 - protein, 10 aa, West Nile virus
MSKNKPTIDV

SEQ ID NO: 143807 - protein, 10 aa, West Nile virus
DKPTIDVKMT

SEQ ID NO: 143808 - protein, 10 aa, West Nile virus
KPTIDVKMMK

SEQ ID NO: 143809 - protein, 10 aa, West Nile virus
PTIDVKMTNM

SEQ ID NO: 143810 - protein, 10 aa, West Nile virus
TIDVKMMNVE

SEQ ID NO: 143811 - protein, 10 aa, West Nile virus
IDVKMTNMEA

SEQ ID NO: 143812 - protein, 10 aa, West Nile virus
ATEISSSAAC

SEQ ID NO: 143813 - protein, 10 aa, West Nile virus
TEISSSAACP

SEQ ID NO: 143814 - protein, 10 aa, West Nile virus
ISSSAACPTM

SEQ ID NO: 143815 - protein, 10 aa, West Nile virus
SSSAACPTMG

SEQ ID NO: 143816 - protein, 10 aa, West Nile virus
SSAACPTMGE

SEQ ID NO: 143817 - protein, 10 aa, West Nile virus
SAACPTMGEA

SEQ ID NO: 143818 - protein, 10 aa, West Nile virus
CPAMGEAHND

SEQ ID NO: 143819 - protein, 10 aa, West Nile virus
PAMGEAHNDK

SEQ ID NO: 143820 - protein, 10 aa, West Nile virus
TMGDAHNDKR

SEQ ID NO: 143821 - protein, 10 aa, West Nile virus
MGEAHNEKRT

SEQ ID NO: 143822 - protein, 10 aa, West Nile virus
GEAHNEKRTD

SEQ ID NO: 143823 - protein, 10 aa, West Nile virus
EAHNEKRTDS

SEQ ID NO: 143824 - protein, 10 aa, West Nile virus
YVCRQGVVDR

SEQ ID NO: 143825 - protein, 10 aa, West Nile virus
IDTCAKFTCS

SEQ ID NO: 143826 - protein, 10 aa, West Nile virus
DTCAKFTCSN

SEQ ID NO: 143827 - protein, 10 aa, West Nile virus
TCAKFTCSNK

SEQ ID NO: 143828 - protein, 10 aa, West Nile virus
CAKFTCSNKA

SEQ ID NO: 143829 - protein, 10 aa, West Nile virus
AKFACTTKAT

SEQ ID NO: 143830 - protein, 10 aa, West Nile virus
KFACTTKATG

SEQ ID NO: 143831 - protein, 10 aa, West Nile virus
FACTTKATGW

SEQ ID NO: 143832 - protein, 10 aa, West Nile virus
ACTTKATGWI

SEQ ID NO: 143833 - protein, 10 aa, West Nile virus
CTTKATGWII

SEQ ID NO: 143834 - protein, 10 aa, West Nile virus
TTKATGWIIQ

SEQ ID NO: 143835 - protein, 10 aa, West Nile virus
TKATGWIIQK

SEQ ID NO: 143836 - protein, 10 aa, West Nile virus
KATGWIIQKE

SEQ ID NO: 143837 - protein, 10 aa, West Nile virus
ATGWIIQKEN

SEQ ID NO: 143838 - protein, 10 aa, West Nile virus
TGWIIQKENI

SEQ ID NO: 143839 - protein, 10 aa, West Nile virus
GLTIQRENVK

SEQ ID NO: 143840 - protein, 10 aa, West Nile virus
LTIQRENVKY

SEQ ID NO: 143841 - protein, 10 aa, West Nile virus
TIQRENVKYE

SEQ ID NO: 143842 - protein, 10 aa, West Nile virus
IQRENVKYEV

SEQ ID NO: 143843 - protein, 10 aa, West Nile virus
QRENVKYEVA

SEQ ID NO: 143844 - protein, 10 aa, West Nile virus
KEBIKYEVAI

SEQ ID NO: 143845 - protein, 10 aa, West Nile virus
EBIKYEVAIF

SEQ ID NO: 143846 - protein, 10 aa, West Nile virus
BIKYEVAIFV

SEQ ID NO: 143847 - protein, 10 aa, West Nile virus
VSVHGPTTVD

SEQ ID NO: 143848 - protein, 10 aa, West Nile virus
FVHGPTTVDS

SEQ ID NO: 143849 - protein, 10 aa, West Nile virus
HGPTTVESHR

SEQ ID NO: 143850 - protein, 10 aa, West Nile virus
GAAQAGRFSI

SEQ ID NO: 143851 - protein, 10 aa, West Nile virus
AAQAGRFSIT

SEQ ID NO: 143852 - protein, 10 aa, West Nile virus
AQAGRFSITP

SEQ ID NO: 143853 - protein, 10 aa, West Nile virus
QAGRFSVSPA

SEQ ID NO: 143854 - protein, 10 aa, West Nile virus
AGRFSVSPAA

SEQ ID NO: 143855 - protein, 10 aa, West Nile virus
GRFSVSPAAP

SEQ ID NO: 143856 - protein, 10 aa, West Nile virus
RFSVSPAAPT

SEQ ID NO: 143857 - protein, 10 aa, West Nile virus
SVSPAAPTHT

SEQ ID NO: 143858 - protein, 10 aa, West Nile virus
NLGDYGEVTF

SEQ ID NO: 143859 - protein, 10 aa, West Nile virus
LGDYGEVTID

SEQ ID NO: 143860 - protein, 10 aa, West Nile virus
GDYGEVTIDC

SEQ ID NO: 143861 - protein, 10 aa, West Nile virus
DYGEVTIDCE

SEQ ID NO: 143862 - protein, 10 aa, West Nile virus
YGEVTIDCEP

SEQ ID NO: 143863 - protein, 10 aa, West Nile virus
GEVTMDCEPR

SEQ ID NO: 143864 - protein, 10 aa, West Nile virus
EVTIDCEPRS

SEQ ID NO: 143865 - protein, 10 aa, West Nile virus
VTIDCEPRSG

SEQ ID NO: 143866 - protein, 10 aa, West Nile virus
TIDCEPRSGI

SEQ ID NO: 143867 - protein, 10 aa, West Nile virus
IDCEPRSGID

SEQ ID NO: 143868 - protein, 10 aa, West Nile virus
CEPRSGVDVD

SEQ ID NO: 143869 - protein, 10 aa, West Nile virus
EPRSGVDVDA

SEQ ID NO: 143870 - protein, 10 aa, West Nile virus
PRSGVDVDAF

SEQ ID NO: 143871 - protein, 10 aa, West Nile virus
RSGVDVDAFY

SEQ ID NO: 143872 - protein, 10 aa, West Nile virus
SGVDVDAFYV

SEQ ID NO: 143873 - protein, 10 aa, West Nile virus
GVDVDAFYVM

SEQ ID NO: 143874 - protein, 10 aa, West Nile virus
VDVDAFYVMT

SEQ ID NO: 143875 - protein, 10 aa, West Nile virus
DVDAFYVMTV

SEQ ID NO: 143876 - protein, 10 aa, West Nile virus
VDAFYVMTVG

SEQ ID NO: 143877 - protein, 10 aa, West Nile virus
TDLNLPWSSA

SEQ ID NO: 143878 - protein, 10 aa, West Nile virus
DLNLPWSSAE

SEQ ID NO: 143879 - protein, 10 aa, West Nile virus
LNLPWSSAES

SEQ ID NO: 143880 - protein, 10 aa, West Nile virus
NLPWSSAESN

SEQ ID NO: 143881 - protein, 10 aa, West Nile virus
WRNRETLVEF

SEQ ID NO: 143882 - protein, 10 aa, West Nile virus
RNRETLVEFE

SEQ ID NO: 143883 - protein, 10 aa, West Nile virus
NRETLVEFEE

SEQ ID NO: 143884 - protein, 10 aa, West Nile virus
RETLVEFEEP

SEQ ID NO: 143885 - protein, 10 aa, West Nile virus
ETLVEFEEPH

SEQ ID NO: 143886 - protein, 10 aa, West Nile virus
TLVEFEEPHA

SEQ ID NO: 143887 - protein, 10 aa, West Nile virus
LVEFEEPHAT

SEQ ID NO: 143888 - protein, 10 aa, West Nile virus
VEFEEPHATK

SEQ ID NO: 143889 - protein, 10 aa, West Nile virus
EAHATKQSVV

SEQ ID NO: 143890 - protein, 10 aa, West Nile virus
AHATKQSVVA

SEQ ID NO: 143891 - protein, 10 aa, West Nile virus
QQALAGAIPV

SEQ ID NO: 143892 - protein, 10 aa, West Nile virus
QALAGAIPLE

SEQ ID NO: 143893 - protein, 10 aa, West Nile virus
ALAGTIPVEF

SEQ ID NO: 143894 - protein, 10 aa, West Nile virus
LAGAIPVSFT

SEQ ID NO: 143895 - protein, 10 aa, West Nile virus
AGAIPVSFTS

SEQ ID NO: 143896 - protein, 10 aa, West Nile virus
GAIPVSFTSN

SEQ ID NO: 143897 - protein, 10 aa, West Nile virus
TIPVEFSSNT

SEQ ID NO: 143898 - protein, 10 aa, West Nile virus
IPLEFSSNTV

SEQ ID NO: 143899 - protein, 10 aa, West Nile virus
PVSFTSNTVK

SEQ ID NO: 143900 - protein, 10 aa, West Nile virus
VEFSSNTVTL

SEQ ID NO: 143901 - protein, 10 aa, West Nile virus
EFSSNTVTLT

SEQ ID NO: 143902 - protein, 10 aa, West Nile virus
FTSNTVKLTS

SEQ ID NO: 143903 - protein, 10 aa, West Nile virus
TSNTVKLTSG

SEQ ID NO: 143904 - protein, 10 aa, West Nile virus
SSGHLKCRVK

SEQ ID NO: 143905 - protein, 10 aa, West Nile virus
KCRVKMEKLK

SEQ ID NO: 143906 - protein, 10 aa, West Nile virus
CRVKMEKLKL

SEQ ID NO: 143907 - protein, 10 aa, West Nile virus
RVKMEKLKLK

SEQ ID NO: 143908 - protein, 10 aa, West Nile virus
VKMEKLKLKG

SEQ ID NO: 143909 - protein, 10 aa, West Nile virus
KMEKLKLKGT

SEQ ID NO: 143910 - protein, 10 aa, West Nile virus
TYGVCSKAFR

SEQ ID NO: 143911 - protein, 10 aa, West Nile virus
YGVCSKAFRF

SEQ ID NO: 143912 - protein, 10 aa, West Nile virus
NTPADTGHGT

SEQ ID NO: 143913 - protein, 10 aa, West Nile virus
VVLELQYTGK

SEQ ID NO: 143914 - protein, 10 aa, West Nile virus
VLELQYTGKD

SEQ ID NO: 143915 - protein, 10 aa, West Nile virus
LELQYTGKDG

SEQ ID NO: 143916 - protein, 10 aa, West Nile virus
YTGKDGPCKV

SEQ ID NO: 143917 - protein, 10 aa, West Nile virus
TGKDGPCKVP

SEQ ID NO: 143918 - protein, 10 aa, West Nile virus
GKDGPCKVPI

SEQ ID NO: 143919 - protein, 10 aa, West Nile virus
TDGPCKIPIS

SEQ ID NO: 143920 - protein, 10 aa, West Nile virus
DGPCKIPITS

SEQ ID NO: 143921 - protein, 10 aa, West Nile virus
GPCKIPITSV

SEQ ID NO: 143922 - protein, 10 aa, West Nile virus
PCKIPITSVA

SEQ ID NO: 143923 - protein, 10 aa, West Nile virus
CKIPITSVAS

SEQ ID NO: 143924 - protein, 10 aa, West Nile virus
KIPISSVASL

SEQ ID NO: 143925 - protein, 10 aa, West Nile virus
IPISSVASLN

SEQ ID NO: 143926 - protein, 10 aa, West Nile virus
LVTVNPFVAA

SEQ ID NO: 143927 - protein, 10 aa, West Nile virus
VTVNPFVSVS

SEQ ID NO: 143928 - protein, 10 aa, West Nile virus
TVNPFVSVST

SEQ ID NO: 143929 - protein, 10 aa, West Nile virus
VNPFVSVSTA

SEQ ID NO: 143930 - protein, 10 aa, West Nile virus
TANAKILVEL

SEQ ID NO: 143931 - protein, 10 aa, West Nile virus
ANAKILVELE

SEQ ID NO: 143932 - protein, 10 aa, West Nile virus
NAKILVELEP

SEQ ID NO: 143933 - protein, 10 aa, West Nile virus
AKILVELEPP

SEQ ID NO: 143934 - protein, 10 aa, West Nile virus
VVGRGEHQIN

SEQ ID NO: 143935 - protein, 10 aa, West Nile virus
VGRGEHQINH

SEQ ID NO: 143936 - protein, 10 aa, West Nile virus
GRGEQQISHH

SEQ ID NO: 143937 - protein, 10 aa, West Nile virus
RGEHQINHHW

SEQ ID NO: 143938 - protein, 10 aa, West Nile virus
GEQQISHHWH

SEQ ID NO: 143939 - protein, 10 aa, West Nile virus
EQQINHHWYK

SEQ ID NO: 143940 - protein, 10 aa, West Nile virus
HQINHHWHKS

SEQ ID NO: 143941 - protein, 10 aa, West Nile virus
QISHHWHKSG

SEQ ID NO: 143942 - protein, 10 aa, West Nile virus
INHHWYKSGS

SEQ ID NO: 143943 - protein, 10 aa, West Nile virus
NHHWYKSGSS

SEQ ID NO: 143944 - protein, 10 aa, West Nile virus
GSSIGKAFTA

SEQ ID NO: 143945 - protein, 10 aa, West Nile virus
SSIGKAFTAT

SEQ ID NO: 143946 - protein, 10 aa, West Nile virus
SIGKAFTATL

SEQ ID NO: 143947 - protein, 10 aa, West Nile virus
IGKAFATTLQ

SEQ ID NO: 143948 - protein, 10 aa, West Nile virus
GKAFATTLQG

SEQ ID NO: 143949 - protein, 10 aa, West Nile virus
KAFATTLQGA

SEQ ID NO: 143950 - protein, 10 aa, West Nile virus
AFATTLQGAQ

SEQ ID NO: 143951 - protein, 10 aa, West Nile virus
FATTLQGAQR

SEQ ID NO: 143952 - protein, 10 aa, West Nile virus
ATTLQGAQRL

SEQ ID NO: 143953 - protein, 10 aa, West Nile virus
TTLQGAQRLV

SEQ ID NO: 143954 - protein, 10 aa, West Nile virus
TLQGAQRLVS

SEQ ID NO: 143955 - protein, 10 aa, West Nile virus
LQGAQRLVSL

SEQ ID NO: 143956 - protein, 10 aa, West Nile virus
QGAQRLVSLG

SEQ ID NO: 143957 - protein, 10 aa, West Nile virus
WDFGSVGGVL

SEQ ID NO: 143958 - protein, 10 aa, West Nile virus
DFGSVGGVFN

SEQ ID NO: 143959 - protein, 10 aa, West Nile virus
FGSVGGVFNS

SEQ ID NO: 143960 - protein, 10 aa, West Nile virus
GSVGGVFNSI

SEQ ID NO: 143961 - protein, 10 aa, West Nile virus
SVGGVFNSIG

SEQ ID NO: 143962 - protein, 10 aa, West Nile virus
VGGVFNSIGK

SEQ ID NO: 143963 - protein, 10 aa, West Nile virus
GGIFTSFGKA

SEQ ID NO: 143964 - protein, 10 aa, West Nile virus
GVFNSIGKAV

SEQ ID NO: 143965 - protein, 10 aa, West Nile virus
VFNSIGKAVH

SEQ ID NO: 143966 - protein, 10 aa, West Nile virus
FNSIGKAVHQ

SEQ ID NO: 143967 - protein, 10 aa, West Nile virus
NSIGKAVHQL

SEQ ID NO: 143968 - protein, 10 aa, West Nile virus
SIGKAVHQLF

SEQ ID NO: 143969 - protein, 10 aa, West Nile virus
IGKAVHQLFG

SEQ ID NO: 143970 - protein, 10 aa, West Nile virus
GKAVHQLFGG

SEQ ID NO: 143971 - protein, 10 aa, West Nile virus
KAVHQLFGGA

SEQ ID NO: 143972 - protein, 10 aa, West Nile virus
AVHQLFGGAF

SEQ ID NO: 143973 - protein, 10 aa, West Nile virus
VHQLFGGAFR

SEQ ID NO: 143974 - protein, 10 aa, West Nile virus
HQVFGGAFRL

SEQ ID NO: 143975 - protein, 10 aa, West Nile virus
QVFGGAFRLL

SEQ ID NO: 143976 - protein, 10 aa, West Nile virus
VFGGAFRLLF

SEQ ID NO: 143977 - protein, 10 aa, West Nile virus
GALLLWMGIS

SEQ ID NO: 143978 - protein, 10 aa, West Nile virus
ALLVWMGINA

SEQ ID NO: 143979 - protein, 10 aa, West Nile virus
LLLWMGVNAR

SEQ ID NO: 143980 - protein, 10 aa, West Nile virus
LVWMGINARD

SEQ ID NO: 143981 - protein, 10 aa, West Nile virus
LWMGISARDR

SEQ ID NO: 143982 - protein, 10 aa, West Nile virus
WMGINARDKS

SEQ ID NO: 143983 - protein, 10 aa, West Nile virus
MGVNARDRSI

SEQ ID NO: 143984 - protein, 10 aa, West Nile virus
GISARDRSIA

SEQ ID NO: 143985 - protein, 10 aa, West Nile virus
SRDRSIAMTF

SEQ ID NO: 143986 - protein, 10 aa, West Nile virus
RDKSIALTFL

SEQ ID NO: 143987 - protein, 10 aa, West Nile virus
DKSIALTFLA

SEQ ID NO: 143988 - protein, 10 aa, West Nile virus
RSIALTFLAI

SEQ ID NO: 143989 - protein, 10 aa, West Nile virus
SIALTFLAIG

SEQ ID NO: 143990 - protein, 10 aa, West Nile virus
IALTFLAIGG

SEQ ID NO: 143991 - protein, 10 aa, West Nile virus
ALTFLAIGGV

SEQ ID NO: 143992 - protein, 10 aa, West Nile virus
LTFLAIGGVL

SEQ ID NO: 143993 - protein, 10 aa, West Nile virus
TFLAIGGVLL

SEQ ID NO: 143994 - protein, 10 aa, West Nile virus
FLAIGGVLLF

SEQ ID NO: 143995 - protein, 10 aa, West Nile virus
LAVGGILLFL

SEQ ID NO: 143996 - protein, 10 aa, West Nile virus
AVGGILLFLS

SEQ ID NO: 143997 - protein, 10 aa, West Nile virus
IGGVLLFLSI

SEQ ID NO: 143998 - protein, 10 aa, West Nile virus
GGVLLFLSIN

SEQ ID NO: 143999 - protein, 10 aa, West Nile virus
GVLLFLSINV

SEQ ID NO: 144000 - protein, 10 aa, West Nile virus
ILLFLSVNVH

SEQ ID NO: 144001 - protein, 10 aa, West Nile virus
LLFLSVSVHA

SEQ ID NO: 144002 - protein, 10 aa, West Nile virus
LFLSANVHAD

SEQ ID NO: 144003 - protein, 10 aa, West Nile virus
FLSANVHADT

SEQ ID NO: 144004 - protein, 10 aa, West Nile virus
LSINVHADTG

SEQ ID NO: 144005 - protein, 10 aa, West Nile virus
SINVHADTGC

SEQ ID NO: 144006 - protein, 10 aa, West Nile virus
ANVHADTGCA

SEQ ID NO: 144007 - protein, 10 aa, West Nile virus
HADTGCAIDV

SEQ ID NO: 144008 - protein, 10 aa, West Nile virus
ADTGCAIDLK

SEQ ID NO: 144009 - protein, 10 aa, West Nile virus
DTGCAIDLKR

SEQ ID NO: 144010 - protein, 10 aa, West Nile virus
TGCAIDLKRQ

SEQ ID NO: 144011 - protein, 10 aa, West Nile virus
GCAIDLKRQE

SEQ ID NO: 144012 - protein, 10 aa, West Nile virus
CAIDLKRQEL

SEQ ID NO: 144013 - protein, 10 aa, West Nile virus
AIDLKRQELR

SEQ ID NO: 144014 - protein, 10 aa, West Nile virus
IDLKRQELRC

SEQ ID NO: 144015 - protein, 10 aa, West Nile virus
DLKRQELRCG

SEQ ID NO: 144016 - protein, 10 aa, West Nile virus
KRQELRCGSG

SEQ ID NO: 144017 - protein, 10 aa, West Nile virus
SGVFIYNDVE

SEQ ID NO: 144018 - protein, 10 aa, West Nile virus
GVFIHNDVKA

SEQ ID NO: 144019 - protein, 10 aa, West Nile virus
VFIHNDVKAW

SEQ ID NO: 144020 - protein, 10 aa, West Nile virus
NDVEAWIDRY

SEQ ID NO: 144021 - protein, 10 aa, West Nile virus
DVEAWIDRYK

SEQ ID NO: 144022 - protein, 10 aa, West Nile virus
DRYRYHPETP

SEQ ID NO: 144023 - protein, 10 aa, West Nile virus
RYRYHPETPQ

SEQ ID NO: 144024 - protein, 10 aa, West Nile virus
YRYHPETPQG

SEQ ID NO: 144025 - protein, 10 aa, West Nile virus
RYHPETPQGL

SEQ ID NO: 144026 - protein, 10 aa, West Nile virus
YHPETPQGLA

SEQ ID NO: 144027 - protein, 10 aa, West Nile virus
YLETPQGLAK

SEQ ID NO: 144028 - protein, 10 aa, West Nile virus
PETPQGLARI

SEQ ID NO: 144029 - protein, 10 aa, West Nile virus
ETPQGLARVI

SEQ ID NO: 144030 - protein, 10 aa, West Nile virus
TPQGLAKVIQ

SEQ ID NO: 144031 - protein, 10 aa, West Nile virus
PQGLARVIQK

SEQ ID NO: 144032 - protein, 10 aa, West Nile virus
QGLAKVIQKA

SEQ ID NO: 144033 - protein, 10 aa, West Nile virus
GLARIIQKAH

SEQ ID NO: 144034 - protein, 10 aa, West Nile virus
SGTCGIRSVS

SEQ ID NO: 144035 - protein, 10 aa, West Nile virus
GTCGIRSVSR

SEQ ID NO: 144036 - protein, 10 aa, West Nile virus
TCGIRSVSRL

SEQ ID NO: 144037 - protein, 10 aa, West Nile virus
CGLRSASRLE

SEQ ID NO: 144038 - protein, 10 aa, West Nile virus
GIRSVSRLEH

SEQ ID NO: 144039 - protein, 10 aa, West Nile virus
IRSVSRLEHQ

SEQ ID NO: 144040 - protein, 10 aa, West Nile virus
VSRLEHQMWG

SEQ ID NO: 144041 - protein, 10 aa, West Nile virus
SRLEHQMWDS

SEQ ID NO: 144042 - protein, 10 aa, West Nile virus
RLEHQMWEAI

SEQ ID NO: 144043 - protein, 10 aa, West Nile virus
LEHQMWEAIK

SEQ ID NO: 144044 - protein, 10 aa, West Nile virus
EHQMWEAIKD

SEQ ID NO: 144045 - protein, 10 aa, West Nile virus
HQMWEAIKDE

SEQ ID NO: 144046 - protein, 10 aa, West Nile virus
QMWEAIKDEL

SEQ ID NO: 144047 - protein, 10 aa, West Nile virus
MWEAIKDELN

SEQ ID NO: 144048 - protein, 10 aa, West Nile virus
WEAIKDELNT

SEQ ID NO: 144049 - protein, 10 aa, West Nile virus
AIKDELNTLL

SEQ ID NO: 144050 - protein, 10 aa, West Nile virus
VKDELNTPLK

SEQ ID NO: 144051 - protein, 10 aa, West Nile virus
LNTLFRENGI

SEQ ID NO: 144052 - protein, 10 aa, West Nile virus
NTLFRENGID

SEQ ID NO: 144053 - protein, 10 aa, West Nile virus
TPLKENGVDL

SEQ ID NO: 144054 - protein, 10 aa, West Nile virus
LLKENGVDLT

SEQ ID NO: 144055 - protein, 10 aa, West Nile virus
LKENGIDLSI

SEQ ID NO: 144056 - protein, 10 aa, West Nile virus
KENGIDLSIV

SEQ ID NO: 144057 - protein, 10 aa, West Nile virus
ENGIDLSIVV

SEQ ID NO: 144058 - protein, 10 aa, West Nile virus
NGIDLSIVVE

SEQ ID NO: 144059 - protein, 10 aa, West Nile virus
GIDLSIVVEK

SEQ ID NO: 144060 - protein, 10 aa, West Nile virus
IDLSIVVEKQ

SEQ ID NO: 144061 - protein, 10 aa, West Nile virus
ATTENLEIGW

SEQ ID NO: 144062 - protein, 10 aa, West Nile virus
TTENLEIGWK

SEQ ID NO: 144063 - protein, 10 aa, West Nile virus
TENLEIGWKA

SEQ ID NO: 144064 - protein, 10 aa, West Nile virus
ENLEIGWKAW

SEQ ID NO: 144065 - protein, 10 aa, West Nile virus
NLEIGWKAWG

SEQ ID NO: 144066 - protein, 10 aa, West Nile virus
GKSIMFASEL

SEQ ID NO: 144067 - protein, 10 aa, West Nile virus
KSILFAPEIA

SEQ ID NO: 144068 - protein, 10 aa, West Nile virus
SILFAPEIAN

SEQ ID NO: 144069 - protein, 10 aa, West Nile virus
FAPEIANNTF

SEQ ID NO: 144070 - protein, 10 aa, West Nile virus
APEIANNTFV

SEQ ID NO: 144071 - protein, 10 aa, West Nile virus
PELANHTFVI

SEQ ID NO: 144072 - protein, 10 aa, West Nile virus
ELANHTFVID

SEQ ID NO: 144073 - protein, 10 aa, West Nile virus
LANHTFVIDG

SEQ ID NO: 144074 - protein, 10 aa, West Nile virus
ANHTFVIDGP

SEQ ID NO: 144075 - protein, 10 aa, West Nile virus
NHTFVIDGPE

SEQ ID NO: 144076 - protein, 10 aa, West Nile virus
HTFVIDGPET

SEQ ID NO: 144077 - protein, 10 aa, West Nile virus
TFVIDGPETK

SEQ ID NO: 144078 - protein, 10 aa, West Nile virus
FVIDGPETKE

SEQ ID NO: 144079 - protein, 10 aa, West Nile virus
VIDGPETKEC

SEQ ID NO: 144080 - protein, 10 aa, West Nile virus
IDGPETKECP

SEQ ID NO: 144081 - protein, 10 aa, West Nile virus
DGPETKECPS

SEQ ID NO: 144082 - protein, 10 aa, West Nile virus
DRAWNSLEVE

SEQ ID NO: 144083 - protein, 10 aa, West Nile virus
FGLTSTRIFL

SEQ ID NO: 144084 - protein, 10 aa, West Nile virus
GLTSTRMFMK

SEQ ID NO: 144085 - protein, 10 aa, West Nile virus
VREGNTTECD

SEQ ID NO: 144086 - protein, 10 aa, West Nile virus
NTTECDSKTI

SEQ ID NO: 144087 - protein, 10 aa, West Nile virus
TTECDSKTIG

SEQ ID NO: 144088 - protein, 10 aa, West Nile virus
TECDSKTIGT

SEQ ID NO: 144089 - protein, 10 aa, West Nile virus
ECDSKTIGTA

SEQ ID NO: 144090 - protein, 10 aa, West Nile virus
CDSKTIGTAV

SEQ ID NO: 144091 - protein, 10 aa, West Nile virus
DSKTIGTAVK

SEQ ID NO: 144092 - protein, 10 aa, West Nile virus
SKTIGTAVKN

SEQ ID NO: 144093 - protein, 10 aa, West Nile virus
TIGTAVKNNL

SEQ ID NO: 144094 - protein, 10 aa, West Nile virus
GTAIKNNLAI

SEQ ID NO: 144095 - protein, 10 aa, West Nile virus
TAVKNNLAVH

SEQ ID NO: 144096 - protein, 10 aa, West Nile virus
AIKNNLAIHS

SEQ ID NO: 144097 - protein, 10 aa, West Nile virus
VKNNLAVHSD

SEQ ID NO: 144098 - protein, 10 aa, West Nile virus
DLSYWIESRF

SEQ ID NO: 144099 - protein, 10 aa, West Nile virus
LSYWIESRFN

SEQ ID NO: 144100 - protein, 10 aa, West Nile virus
LNETWKLERA

SEQ ID NO: 144101 - protein, 10 aa, West Nile virus
NHTWKLERAV

SEQ ID NO: 144102 - protein, 10 aa, West Nile virus
HTWKLERAVL

SEQ ID NO: 144103 - protein, 10 aa, West Nile virus
ETHTLWGEGI

SEQ ID NO: 144104 - protein, 10 aa, West Nile virus
THTLWGEGIL

SEQ ID NO: 144105 - protein, 10 aa, West Nile virus
HTLWGEGILE

SEQ ID NO: 144106 - protein, 10 aa, West Nile virus
TLWGEGILES

SEQ ID NO: 144107 - protein, 10 aa, West Nile virus
GVQESDLIIP

SEQ ID NO: 144108 - protein, 10 aa, West Nile virus
ESDLIIPATL

SEQ ID NO: 144109 - protein, 10 aa, West Nile virus
SDLIIPATLA

SEQ ID NO: 144110 - protein, 10 aa, West Nile virus
ELIIPVTLAG

SEQ ID NO: 144111 - protein, 10 aa, West Nile virus
LIIPITLAGL

SEQ ID NO: 144112 - protein, 10 aa, West Nile virus
IIPITLAGLR

SEQ ID NO: 144113 - protein, 10 aa, West Nile virus
IPITLAGLRS

SEQ ID NO: 144114 - protein, 10 aa, West Nile virus
PITLAGLRSN

SEQ ID NO: 144115 - protein, 10 aa, West Nile virus
ITLAGLRSNH

SEQ ID NO: 144116 - protein, 10 aa, West Nile virus
TLAGPRSNYN

SEQ ID NO: 144117 - protein, 10 aa, West Nile virus
LAGPRSNYNR

SEQ ID NO: 144118 - protein, 10 aa, West Nile virus
AGPRSNYNRR

SEQ ID NO: 144119 - protein, 10 aa, West Nile virus
GPRSNYNRRP

SEQ ID NO: 144120 - protein, 10 aa, West Nile virus
PRSNYNRRPG

SEQ ID NO: 144121 - protein, 10 aa, West Nile virus
NHNKRPGYKT

SEQ ID NO: 144122 - protein, 10 aa, West Nile virus
YNRRPGYKTQ

SEQ ID NO: 144123 - protein, 10 aa, West Nile virus
NKRPGYKTQN

SEQ ID NO: 144124 - protein, 10 aa, West Nile virus
RRPGYKMQNQ

SEQ ID NO: 144125 - protein, 10 aa, West Nile virus
NQGPWDEGRI

SEQ ID NO: 144126 - protein, 10 aa, West Nile virus
GPWDEGRIEI

SEQ ID NO: 144127 - protein, 10 aa, West Nile virus
PWDEGRIEID

SEQ ID NO: 144128 - protein, 10 aa, West Nile virus
WDEGRIEIDF

SEQ ID NO: 144129 - protein, 10 aa, West Nile virus
DEGRIEIDFD

SEQ ID NO: 144130 - protein, 10 aa, West Nile virus
EGRIEIDFDY

SEQ ID NO: 144131 - protein, 10 aa, West Nile virus
GRIEIDFDYC

SEQ ID NO: 144132 - protein, 10 aa, West Nile virus
RIEIDFDYCP

SEQ ID NO: 144133 - protein, 10 aa, West Nile virus
IEIDFDYCPG

SEQ ID NO: 144134 - protein, 10 aa, West Nile virus
YCPGTTVTVS

SEQ ID NO: 144135 - protein, 10 aa, West Nile virus
CGHRGPAIRT

SEQ ID NO: 144136 - protein, 10 aa, West Nile virus
GHRGPAIRTT

SEQ ID NO: 144137 - protein, 10 aa, West Nile virus
HRGPAIRTTT

SEQ ID NO: 144138 - protein, 10 aa, West Nile virus
RGPAIRTTTE

SEQ ID NO: 144139 - protein, 10 aa, West Nile virus
GPAIRTTTES

SEQ ID NO: 144140 - protein, 10 aa, West Nile virus
PAIRTTTESG

SEQ ID NO: 144141 - protein, 10 aa, West Nile virus
AIRTTTESGK

SEQ ID NO: 144142 - protein, 10 aa, West Nile virus
IRTTTESGKL

SEQ ID NO: 144143 - protein, 10 aa, West Nile virus
ESGKLITDWW

SEQ ID NO: 144144 - protein, 10 aa, West Nile virus
SCTLPPLRYR

SEQ ID NO: 144145 - protein, 10 aa, West Nile virus
CTLPPLRYRT

SEQ ID NO: 144146 - protein, 10 aa, West Nile virus
TLPPLRYRTE

SEQ ID NO: 144147 - protein, 10 aa, West Nile virus
TESGCWYGME

SEQ ID NO: 144148 - protein, 10 aa, West Nile virus
ESGCWYGMEI

SEQ ID NO: 144149 - protein, 10 aa, West Nile virus
CWYGMEIRPL

SEQ ID NO: 144150 - protein, 10 aa, West Nile virus
WYGMEIRPLR

SEQ ID NO: 144151 - protein, 10 aa, West Nile virus
YGMEIRPLRH

SEQ ID NO: 144152 - protein, 10 aa, West Nile virus
GMEIRPLRHD

SEQ ID NO: 144153 - protein, 10 aa, West Nile virus
MEIRPLRHDE

SEQ ID NO: 144154 - protein, 10 aa, West Nile virus
EIRPLRHDEK

SEQ ID NO: 144155 - protein, 10 aa, West Nile virus
IRPLRHDEKT

SEQ ID NO: 144156 - protein, 10 aa, West Nile virus
RPLRHDEKTL

SEQ ID NO: 144157 - protein, 10 aa, West Nile virus
PLRHDEKTLV

SEQ ID NO: 144158 - protein, 10 aa, West Nile virus
LRHDEKTLVQ

SEQ ID NO: 144159 - protein, 10 aa, West Nile virus
RHDGKTLVQS

SEQ ID NO: 144160 - protein, 10 aa, West Nile virus
HDEKTLVQSK

SEQ ID NO: 144161 - protein, 10 aa, West Nile virus
DEKTLVQSKV

SEQ ID NO: 144162 - protein, 10 aa, West Nile virus
EKTLVQSKVT

SEQ ID NO: 144163 - protein, 10 aa, West Nile virus
KTLVQSKVTA

SEQ ID NO: 144164 - protein, 10 aa, West Nile virus
TLVQSKVTAY

SEQ ID NO: 144165 - protein, 10 aa, West Nile virus
LVQSKVTAYN

SEQ ID NO: 144166 - protein, 10 aa, West Nile virus
VQSKVTAYNA

SEQ ID NO: 144167 - protein, 10 aa, West Nile virus
QSKVTAYNAD

SEQ ID NO: 144168 - protein, 10 aa, West Nile virus
SKVTAYNADM

SEQ ID NO: 144169 - protein, 10 aa, West Nile virus
KVTAYNADMI

SEQ ID NO: 144170 - protein, 10 aa, West Nile virus
VNAYNAEMID

SEQ ID NO: 144171 - protein, 10 aa, West Nile virus
NAHNADMIDP

SEQ ID NO: 144172 - protein, 10 aa, West Nile virus
AYKSDMIDPF

SEQ ID NO: 144173 - protein, 10 aa, West Nile virus
YKSDMIDPFQ

SEQ ID NO: 144174 - protein, 10 aa, West Nile virus
PFQLGLLVVV

SEQ ID NO: 144175 - protein, 10 aa, West Nile virus
FQLGLLVVVL

SEQ ID NO: 144176 - protein, 10 aa, West Nile virus
QLGLLVVFLV

SEQ ID NO: 144177 - protein, 10 aa, West Nile virus
LGLLVVVLAT

SEQ ID NO: 144178 - protein, 10 aa, West Nile virus
GLLVVFLATK

SEQ ID NO: 144179 - protein, 10 aa, West Nile virus
LLVVFLATKE

SEQ ID NO: 144180 - protein, 10 aa, West Nile virus
LVVVLATQEV

SEQ ID NO: 144181 - protein, 10 aa, West Nile virus
VVVLATQEVL

SEQ ID NO: 144182 - protein, 10 aa, West Nile virus
VFLVTQEVLR

SEQ ID NO: 144183 - protein, 10 aa, West Nile virus
FLVTQEVLRK

SEQ ID NO: 144184 - protein, 10 aa, West Nile virus
LATQEVLRRR

SEQ ID NO: 144185 - protein, 10 aa, West Nile virus
VTQEVLRKRW

SEQ ID NO: 144186 - protein, 10 aa, West Nile virus
RKRWTAKISV

SEQ ID NO: 144187 - protein, 10 aa, West Nile virus
KRWTAKISVP

SEQ ID NO: 144188 - protein, 10 aa, West Nile virus
RWTAKISVPA

SEQ ID NO: 144189 - protein, 10 aa, West Nile virus
WTAKISVPAI

SEQ ID NO: 144190 - protein, 10 aa, West Nile virus
PAIIIALLTL

SEQ ID NO: 144191 - protein, 10 aa, West Nile virus
AIIIALLTLV

SEQ ID NO: 144192 - protein, 10 aa, West Nile virus
IIIALLTLVF

SEQ ID NO: 144193 - protein, 10 aa, West Nile virus
IIALLTLVFG

SEQ ID NO: 144194 - protein, 10 aa, West Nile virus
IALLTLVFGG

SEQ ID NO: 144195 - protein, 10 aa, West Nile virus
ALAVLVLGGI

SEQ ID NO: 144196 - protein, 10 aa, West Nile virus
LAVLVLGGIT

SEQ ID NO: 144197 - protein, 10 aa, West Nile virus
LVLVLGGITY

SEQ ID NO: 144198 - protein, 10 aa, West Nile virus
VLVLGGITYT

SEQ ID NO: 144199 - protein, 10 aa, West Nile virus
LVLGGITYTD

SEQ ID NO: 144200 - protein, 10 aa, West Nile virus
VLGGITYTDV

SEQ ID NO: 144201 - protein, 10 aa, West Nile virus
LGGITYTDVL

SEQ ID NO: 144202 - protein, 10 aa, West Nile virus
GGITYADVLR

SEQ ID NO: 144203 - protein, 10 aa, West Nile virus
GITYIDVLRY

SEQ ID NO: 144204 - protein, 10 aa, West Nile virus
ITYTDVLRYI

SEQ ID NO: 144205 - protein, 10 aa, West Nile virus
TYTDVLRYII

SEQ ID NO: 144206 - protein, 10 aa, West Nile virus
YADVLRYVIL

SEQ ID NO: 144207 - protein, 10 aa, West Nile virus
DVLRYVNLVG

SEQ ID NO: 144208 - protein, 10 aa, West Nile virus
VLRYVILAGA

SEQ ID NO: 144209 - protein, 10 aa, West Nile virus
LRYVILAGAA

SEQ ID NO: 144210 - protein, 10 aa, West Nile virus
RYVILAGAAF

SEQ ID NO: 144211 - protein, 10 aa, West Nile virus
YVILAGAAFA

SEQ ID NO: 144212 - protein, 10 aa, West Nile virus
IILVGAAFME

SEQ ID NO: 144213 - protein, 10 aa, West Nile virus
NLVGAAFAES

SEQ ID NO: 144214 - protein, 10 aa, West Nile virus
LAGAAFAESN

SEQ ID NO: 144215 - protein, 10 aa, West Nile virus
VGAAFMEANS

SEQ ID NO: 144216 - protein, 10 aa, West Nile virus
HLALMATFRI

SEQ ID NO: 144217 - protein, 10 aa, West Nile virus
LALMATFRIQ

SEQ ID NO: 144218 - protein, 10 aa, West Nile virus
ALMATFRIQP

SEQ ID NO: 144219 - protein, 10 aa, West Nile virus
LMATFKVQPV

SEQ ID NO: 144220 - protein, 10 aa, West Nile virus
MATFKVQPVF

SEQ ID NO: 144221 - protein, 10 aa, West Nile virus
IQPAFMVASF

SEQ ID NO: 144222 - protein, 10 aa, West Nile virus
QPAFMVASFL

SEQ ID NO: 144223 - protein, 10 aa, West Nile virus
PAFMVASFLK

SEQ ID NO: 144224 - protein, 10 aa, West Nile virus
AFMVASFLKT

SEQ ID NO: 144225 - protein, 10 aa, West Nile virus
VASFLKAKWT

SEQ ID NO: 144226 - protein, 10 aa, West Nile virus
ASFLKAKWTN

SEQ ID NO: 144227 - protein, 10 aa, West Nile virus
KWTNQESILL

SEQ ID NO: 144228 - protein, 10 aa, West Nile virus
WTNHENILLM

SEQ ID NO: 144229 - protein, 10 aa, West Nile virus
TNHENILLML

SEQ ID NO: 144230 - protein, 10 aa, West Nile virus
NHENILLMLA

SEQ ID NO: 144231 - protein, 10 aa, West Nile virus
HENILLMLAA

SEQ ID NO: 144232 - protein, 10 aa, West Nile virus
ENILLMLAAA

SEQ ID NO: 144233 - protein, 10 aa, West Nile virus
NILLMLAAAF

SEQ ID NO: 144234 - protein, 10 aa, West Nile virus
AAVFFQMAYY

SEQ ID NO: 144235 - protein, 10 aa, West Nile virus
AVFFQMAYYD

SEQ ID NO: 144236 - protein, 10 aa, West Nile virus
VFFQMAYYDA

SEQ ID NO: 144237 - protein, 10 aa, West Nile virus
FFQMAYYDAR

SEQ ID NO: 144238 - protein, 10 aa, West Nile virus
WEMPDVLNSL

SEQ ID NO: 144239 - protein, 10 aa, West Nile virus
SDVLNSLAVA

SEQ ID NO: 144240 - protein, 10 aa, West Nile virus
DVLNSLAAAW

SEQ ID NO: 144241 - protein, 10 aa, West Nile virus
VLNSLAAAWM

SEQ ID NO: 144242 - protein, 10 aa, West Nile virus
LNSLAIAWMI

SEQ ID NO: 144243 - protein, 10 aa, West Nile virus
NSLAAAWMIL

SEQ ID NO: 144244 - protein, 10 aa, West Nile virus
SLAIAWMILR

SEQ ID NO: 144245 - protein, 10 aa, West Nile virus
LAVAWMVLRA

SEQ ID NO: 144246 - protein, 10 aa, West Nile virus
AIAWMILRAI

SEQ ID NO: 144247 - protein, 10 aa, West Nile virus
VAWMILRAIG

SEQ ID NO: 144248 - protein, 10 aa, West Nile virus
AWMILRAIGF

SEQ ID NO: 144249 - protein, 10 aa, West Nile virus
WMILRAIGFT

SEQ ID NO: 144250 - protein, 10 aa, West Nile virus
FTTTSNVATP

SEQ ID NO: 144251 - protein, 10 aa, West Nile virus
TTTSNVATPL

SEQ ID NO: 144252 - protein, 10 aa, West Nile virus
TTSNVATPLL

SEQ ID NO: 144253 - protein, 10 aa, West Nile virus
TSNVVVPLMA

SEQ ID NO: 144254 - protein, 10 aa, West Nile virus
SNVVVPLMAL

SEQ ID NO: 144255 - protein, 10 aa, West Nile virus
NVVVPLMALL

SEQ ID NO: 144256 - protein, 10 aa, West Nile virus
VVVPLMALLT

SEQ ID NO: 144257 - protein, 10 aa, West Nile virus
VVPLMALLTP

SEQ ID NO: 144258 - protein, 10 aa, West Nile virus
VPLMALLTPG

SEQ ID NO: 144259 - protein, 10 aa, West Nile virus
PALAFLTPGL

SEQ ID NO: 144260 - protein, 10 aa, West Nile virus
LMALLTPGLR

SEQ ID NO: 144261 - protein, 10 aa, West Nile virus
MALLTPGLRC

SEQ ID NO: 144262 - protein, 10 aa, West Nile virus
AFLTPGLKCL

SEQ ID NO: 144263 - protein, 10 aa, West Nile virus
LLTPGLKCLH

SEQ ID NO: 144264 - protein, 10 aa, West Nile virus
LTPGLKCLHL

SEQ ID NO: 144265 - protein, 10 aa, West Nile virus
TPGLKCLHLD

SEQ ID NO: 144266 - protein, 10 aa, West Nile virus
PGLKCLHLDI

SEQ ID NO: 144267 - protein, 10 aa, West Nile virus
GLKCLHLDIY

SEQ ID NO: 144268 - protein, 10 aa, West Nile virus
LKCLHLDIYR

SEQ ID NO: 144269 - protein, 10 aa, West Nile virus
KCLHLDIYRI

SEQ ID NO: 144270 - protein, 10 aa, West Nile virus
CLNLDVYKIL

SEQ ID NO: 144271 - protein, 10 aa, West Nile virus
LNLDVSRILL

SEQ ID NO: 144272 - protein, 10 aa, West Nile virus
NLDVYKILLL

SEQ ID NO: 144273 - protein, 10 aa, West Nile virus
LDVSRILLLM

SEQ ID NO: 144274 - protein, 10 aa, West Nile virus
DVYKILLLMV

SEQ ID NO: 144275 - protein, 10 aa, West Nile virus
VYRIVLLMIG

SEQ ID NO: 144276 - protein, 10 aa, West Nile virus
SRILLLMVGI

SEQ ID NO: 144277 - protein, 10 aa, West Nile virus
RIVLLMIGIG

SEQ ID NO: 144278 - protein, 10 aa, West Nile virus
IVLLMIGIGS

SEQ ID NO: 144279 - protein, 10 aa, West Nile virus
LLLMIGIGSL

SEQ ID NO: 144280 - protein, 10 aa, West Nile virus
LLMVGVGSLV

SEQ ID NO: 144281 - protein, 10 aa, West Nile virus
LMVGVGSLVK

SEQ ID NO: 144282 - protein, 10 aa, West Nile virus
MVGVGSLVKE

SEQ ID NO: 144283 - protein, 10 aa, West Nile virus
GVGSLVKERR

SEQ ID NO: 144284 - protein, 10 aa, West Nile virus
ERRSAVAKKK

SEQ ID NO: 144285 - protein, 10 aa, West Nile virus
RRSAVAKKKG

SEQ ID NO: 144286 - protein, 10 aa, West Nile virus
RSAVAKKKGA

SEQ ID NO: 144287 - protein, 10 aa, West Nile virus
SAVAKKKGAS

SEQ ID NO: 144288 - protein, 10 aa, West Nile virus
AVAKKKGASL

SEQ ID NO: 144289 - protein, 10 aa, West Nile virus
VAKKKGASLI

SEQ ID NO: 144290 - protein, 10 aa, West Nile virus
AKKKGASLIC

SEQ ID NO: 144291 - protein, 10 aa, West Nile virus
KKKGASLICL

SEQ ID NO: 144292 - protein, 10 aa, West Nile virus
KKGASLICLA

SEQ ID NO: 144293 - protein, 10 aa, West Nile virus
KGASLICLAL

SEQ ID NO: 144294 - protein, 10 aa, West Nile virus
GASLICLALA

SEQ ID NO: 144295 - protein, 10 aa, West Nile virus
ASLICLALAS

SEQ ID NO: 144296 - protein, 10 aa, West Nile virus
SLICLALAST

SEQ ID NO: 144297 - protein, 10 aa, West Nile virus
FSPLVLAAGL

SEQ ID NO: 144298 - protein, 10 aa, West Nile virus
NPLILVAGLL

SEQ ID NO: 144299 - protein, 10 aa, West Nile virus
LAAGLMACDP

SEQ ID NO: 144300 - protein, 10 aa, West Nile virus
AAGLMACDPN

SEQ ID NO: 144301 - protein, 10 aa, West Nile virus
AGLMACDPNR

SEQ ID NO: 144302 - protein, 10 aa, West Nile virus
GLMACDPNRK

SEQ ID NO: 144303 - protein, 10 aa, West Nile virus
LMACDPNRKR

SEQ ID NO: 144304 - protein, 10 aa, West Nile virus
MACDPNRKRG

SEQ ID NO: 144305 - protein, 10 aa, West Nile virus
GGLAELDIDT

SEQ ID NO: 144306 - protein, 10 aa, West Nile virus
GLAELDVDSM

SEQ ID NO: 144307 - protein, 10 aa, West Nile virus
LAELDIDTMA

SEQ ID NO: 144308 - protein, 10 aa, West Nile virus
AELDVDSMAI

SEQ ID NO: 144309 - protein, 10 aa, West Nile virus
ELDIDSMAVP

SEQ ID NO: 144310 - protein, 10 aa, West Nile virus
LDVDSMAIPM

SEQ ID NO: 144311 - protein, 10 aa, West Nile virus
DIDSMAVPMT

SEQ ID NO: 144312 - protein, 10 aa, West Nile virus
MDSMAIPMTI

SEQ ID NO: 144313 - protein, 10 aa, West Nile virus
TIAGLMFAAY

SEQ ID NO: 144314 - protein, 10 aa, West Nile virus
IAGLMFAAYV

SEQ ID NO: 144315 - protein, 10 aa, West Nile virus
AGLMFAAYVI

SEQ ID NO: 144316 - protein, 10 aa, West Nile virus
GLMFAAYVIT

SEQ ID NO: 144317 - protein, 10 aa, West Nile virus
LMFAAYVITG

SEQ ID NO: 144318 - protein, 10 aa, West Nile virus
MFAAYVITGR

SEQ ID NO: 144319 - protein, 10 aa, West Nile virus
FAAYVITGRS

SEQ ID NO: 144320 - protein, 10 aa, West Nile virus
AAYVITGRST

SEQ ID NO: 144321 - protein, 10 aa, West Nile virus
MWIERVADIS

SEQ ID NO: 144322 - protein, 10 aa, West Nile virus
WIERVADISW

SEQ ID NO: 144323 - protein, 10 aa, West Nile virus
IERVADISWE

SEQ ID NO: 144324 - protein, 10 aa, West Nile virus
ERTADISWEG

SEQ ID NO: 144325 - protein, 10 aa, West Nile virus
RTADISWEGD

SEQ ID NO: 144326 - protein, 10 aa, West Nile virus
ADISWEGDAE

SEQ ID NO: 144327 - protein, 10 aa, West Nile virus
DISWEGDAEI

SEQ ID NO: 144328 - protein, 10 aa, West Nile virus
ISWEGDAEIT

SEQ ID NO: 144329 - protein, 10 aa, West Nile virus
SWEGDAEITG

SEQ ID NO: 144330 - protein, 10 aa, West Nile virus
WEGDAEITGS

SEQ ID NO: 144331 - protein, 10 aa, West Nile virus
EGDAEITGSS

SEQ ID NO: 144332 - protein, 10 aa, West Nile virus
GDAEITGSSE

SEQ ID NO: 144333 - protein, 10 aa, West Nile virus
DVEITGSSER

SEQ ID NO: 144334 - protein, 10 aa, West Nile virus
VEITGSSERV

SEQ ID NO: 144335 - protein, 10 aa, West Nile virus
TGSSERVDVK

SEQ ID NO: 144336 - protein, 10 aa, West Nile virus
GSSERVDVKL

SEQ ID NO: 144337 - protein, 10 aa, West Nile virus
SSDRVDVKLD

SEQ ID NO: 144338 - protein, 10 aa, West Nile virus
ERVDVKLDDD

SEQ ID NO: 144339 - protein, 10 aa, West Nile virus
VDVRLDDGEN

SEQ ID NO: 144340 - protein, 10 aa, West Nile virus
DVRLDDGENF

SEQ ID NO: 144341 - protein, 10 aa, West Nile virus
VRLDDDGDFQ

SEQ ID NO: 144342 - protein, 10 aa, West Nile virus
RLDDGENFQL

SEQ ID NO: 144343 - protein, 10 aa, West Nile virus
LDDGENFQLM

SEQ ID NO: 144344 - protein, 10 aa, West Nile virus
DDDGNFQLMS

SEQ ID NO: 144345 - protein, 10 aa, West Nile virus
DDGDFQLMND

SEQ ID NO: 144346 - protein, 10 aa, West Nile virus
DGDFQLMNDP

SEQ ID NO: 144347 - protein, 10 aa, West Nile virus
ENFQLMNDPG

SEQ ID NO: 144348 - protein, 10 aa, West Nile virus
DFQLMNDPGA

SEQ ID NO: 144349 - protein, 10 aa, West Nile virus
MSDPGAPWKI

SEQ ID NO: 144350 - protein, 10 aa, West Nile virus
GAPWKLWMLR

SEQ ID NO: 144351 - protein, 10 aa, West Nile virus
APWKLWMLRM

SEQ ID NO: 144352 - protein, 10 aa, West Nile virus
MTCLAVSAYT

SEQ ID NO: 144353 - protein, 10 aa, West Nile virus
TCLAVSAYTP

SEQ ID NO: 144354 - protein, 10 aa, West Nile virus
TPWAVLPSVV

SEQ ID NO: 144355 - protein, 10 aa, West Nile virus
PWAVLPSVVG

SEQ ID NO: 144356 - protein, 10 aa, West Nile virus
WAVLPSVVGF

SEQ ID NO: 144357 - protein, 10 aa, West Nile virus
AVLPSVVGFW

SEQ ID NO: 144358 - protein, 10 aa, West Nile virus
VLPSVVGFWI

SEQ ID NO: 144359 - protein, 10 aa, West Nile virus
LPSIVGFWIT

SEQ ID NO: 144360 - protein, 10 aa, West Nile virus
PSVVGFWISL

SEQ ID NO: 144361 - protein, 10 aa, West Nile virus
SIVGFWITLQ

SEQ ID NO: 144362 - protein, 10 aa, West Nile virus
VVGFWISLQY

SEQ ID NO: 144363 - protein, 10 aa, West Nile virus
WDTPSPREYR

SEQ ID NO: 144364 - protein, 10 aa, West Nile virus
EYRKGDTTTG

SEQ ID NO: 144365 - protein, 10 aa, West Nile virus
YRKGDTTTGV

SEQ ID NO: 144366 - protein, 10 aa, West Nile virus
RKGDTTTGVY

SEQ ID NO: 144367 - protein, 10 aa, West Nile virus
GLLGNYQAGV

SEQ ID NO: 144368 - protein, 10 aa, West Nile virus
LLGNYQAGVG

SEQ ID NO: 144369 - protein, 10 aa, West Nile virus
CYGGPWKLQC

SEQ ID NO: 144370 - protein, 10 aa, West Nile virus
YGGPWKLGHR

SEQ ID NO: 144371 - protein, 10 aa, West Nile virus
GGPWKLGHRW

SEQ ID NO: 144372 - protein, 10 aa, West Nile virus
GPWKLQCKWN

SEQ ID NO: 144373 - protein, 10 aa, West Nile virus
PWKLQHRWNG

SEQ ID NO: 144374 - protein, 10 aa, West Nile virus
WKLQRKWNGL

SEQ ID NO: 144375 - protein, 10 aa, West Nile virus
KLQRKWNGLD

SEQ ID NO: 144376 - protein, 10 aa, West Nile virus
LQRKWNGLDE

SEQ ID NO: 144377 - protein, 10 aa, West Nile virus
QRKWNGLDEV

SEQ ID NO: 144378 - protein, 10 aa, West Nile virus
RKWNGLDEVQ

SEQ ID NO: 144379 - protein, 10 aa, West Nile virus
KWNGLDEVQM

SEQ ID NO: 144380 - protein, 10 aa, West Nile virus
WNGLDEVQMI

SEQ ID NO: 144381 - protein, 10 aa, West Nile virus
NGLDEVQMIV

SEQ ID NO: 144382 - protein, 10 aa, West Nile virus
GLDEVQMIVA

SEQ ID NO: 144383 - protein, 10 aa, West Nile virus
LDEVQMIVAE

SEQ ID NO: 144384 - protein, 10 aa, West Nile virus
QMIVVKPGES

SEQ ID NO: 144385 - protein, 10 aa, West Nile virus
MIVVEPGKNA

SEQ ID NO: 144386 - protein, 10 aa, West Nile virus
IVVEPGKNAK

SEQ ID NO: 144387 - protein, 10 aa, West Nile virus
VVEPGKNAKN

SEQ ID NO: 144388 - protein, 10 aa, West Nile virus
VEPGKNAKNV

SEQ ID NO: 144389 - protein, 10 aa, West Nile virus
EPGKNAKNVQ

SEQ ID NO: 144390 - protein, 10 aa, West Nile virus
PGKNAKNVQT

SEQ ID NO: 144391 - protein, 10 aa, West Nile virus
GKNAKNVQTK

SEQ ID NO: 144392 - protein, 10 aa, West Nile virus
KNAKNVQTKP

SEQ ID NO: 144393 - protein, 10 aa, West Nile virus
NAKNVQTKPG

SEQ ID NO: 144394 - protein, 10 aa, West Nile virus
AKNVQTKPGV

SEQ ID NO: 144395 - protein, 10 aa, West Nile virus
SGSPIVDKNS

SEQ ID NO: 144396 - protein, 10 aa, West Nile virus
GSPIVDKNSD

SEQ ID NO: 144397 - protein, 10 aa, West Nile virus
SPIVDKNSDV

SEQ ID NO: 144398 - protein, 10 aa, West Nile virus
PIVDKNSDVI

SEQ ID NO: 144399 - protein, 10 aa, West Nile virus
IVDKNSDVIG

SEQ ID NO: 144400 - protein, 10 aa, West Nile virus
VDKNSDVIGL

SEQ ID NO: 144401 - protein, 10 aa, West Nile virus
DKSGDVIGLY

SEQ ID NO: 144402 - protein, 10 aa, West Nile virus
KSGDVIGLYG

SEQ ID NO: 144403 - protein, 10 aa, West Nile virus
GNGVIMPSGS

SEQ ID NO: 144404 - protein, 10 aa, West Nile virus
NGVIMPSGSY

SEQ ID NO: 144405 - protein, 10 aa, West Nile virus
GVIMPSGSYI

SEQ ID NO: 144406 - protein, 10 aa, West Nile virus
VIMPSGSYIS

SEQ ID NO: 144407 - protein, 10 aa, West Nile virus
IMPSGSYISA

SEQ ID NO: 144408 - protein, 10 aa, West Nile virus
MPSGSYISAI

SEQ ID NO: 144409 - protein, 10 aa, West Nile virus
PSGSYISAIV

SEQ ID NO: 144410 - protein, 10 aa, West Nile virus
SGSYISAIVQ

SEQ ID NO: 144411 - protein, 10 aa, West Nile virus
VQGERMDEPV

SEQ ID NO: 144412 - protein, 10 aa, West Nile virus
QGERMDEPVP

SEQ ID NO: 144413 - protein, 10 aa, West Nile virus
GERMDEPVPA

SEQ ID NO: 144414 - protein, 10 aa, West Nile virus
ERMDEPVPAG

SEQ ID NO: 144415 - protein, 10 aa, West Nile virus
RMDEPVPAGF

SEQ ID NO: 144416 - protein, 10 aa, West Nile virus
GFEPETLKKK

SEQ ID NO: 144417 - protein, 10 aa, West Nile virus
FDPEMLRKKQ

SEQ ID NO: 144418 - protein, 10 aa, West Nile virus
ESEMLRKKQI

SEQ ID NO: 144419 - protein, 10 aa, West Nile virus
PDMLRKKQIS

SEQ ID NO: 144420 - protein, 10 aa, West Nile virus
DMLRKKQISV

SEQ ID NO: 144421 - protein, 10 aa, West Nile virus
MLRKKKITVL

SEQ ID NO: 144422 - protein, 10 aa, West Nile virus
LRKKKITVLD

SEQ ID NO: 144423 - protein, 10 aa, West Nile virus
RKKQISVLDL

SEQ ID NO: 144424 - protein, 10 aa, West Nile virus
KITVLDLHPG

SEQ ID NO: 144425 - protein, 10 aa, West Nile virus
TRKILPQIIR

SEQ ID NO: 144426 - protein, 10 aa, West Nile virus
RKILPQIIRE

SEQ ID NO: 144427 - protein, 10 aa, West Nile virus
KILPQIIREA

SEQ ID NO: 144428 - protein, 10 aa, West Nile virus
LPQIIKEAMN

SEQ ID NO: 144429 - protein, 10 aa, West Nile virus
PQIIREAINR

SEQ ID NO: 144430 - protein, 10 aa, West Nile virus
QIIREAINRR

SEQ ID NO: 144431 - protein, 10 aa, West Nile virus
IIREAINRRL

SEQ ID NO: 144432 - protein, 10 aa, West Nile virus
IREAINRRLR

SEQ ID NO: 144433 - protein, 10 aa, West Nile virus
REAINRRLRT

SEQ ID NO: 144434 - protein, 10 aa, West Nile virus
EAIDRRLRTA

SEQ ID NO: 144435 - protein, 10 aa, West Nile virus
NKRLRTAILA

SEQ ID NO: 144436 - protein, 10 aa, West Nile virus
KRLRTAILAP

SEQ ID NO: 144437 - protein, 10 aa, West Nile virus
ILAPTRVVAA

SEQ ID NO: 144438 - protein, 10 aa, West Nile virus
PTRVVASEMA

SEQ ID NO: 144439 - protein, 10 aa, West Nile virus
TRVVASEMAE

SEQ ID NO: 144440 - protein, 10 aa, West Nile virus
RVVASEMAEA

SEQ ID NO: 144441 - protein, 10 aa, West Nile virus
VVASEMAEAL

SEQ ID NO: 144442 - protein, 10 aa, West Nile virus
VASEMAEALR

SEQ ID NO: 144443 - protein, 10 aa, West Nile virus
ASEMAEALRG

SEQ ID NO: 144444 - protein, 10 aa, West Nile virus
SEMAEALRGL

SEQ ID NO: 144445 - protein, 10 aa, West Nile virus
PIRYQTSAVT

SEQ ID NO: 144446 - protein, 10 aa, West Nile virus
IRYQTSAVTR

SEQ ID NO: 144447 - protein, 10 aa, West Nile virus
RYQTSAVTRE

SEQ ID NO: 144448 - protein, 10 aa, West Nile virus
YQTSAVTREH

SEQ ID NO: 144449 - protein, 10 aa, West Nile virus
REHTGNEIVD

SEQ ID NO: 144450 - protein, 10 aa, West Nile virus
EHTGNEIVDV

SEQ ID NO: 144451 - protein, 10 aa, West Nile virus
HTGNEIVDVM

SEQ ID NO: 144452 - protein, 10 aa, West Nile virus
TGNEIVDVMC

SEQ ID NO: 144453 - protein, 10 aa, West Nile virus
IAARGYISTR

SEQ ID NO: 144454 - protein, 10 aa, West Nile virus
AARGYISTRV

SEQ ID NO: 144455 - protein, 10 aa, West Nile virus
ARGYISTRVE

SEQ ID NO: 144456 - protein, 10 aa, West Nile virus
RGYISTRVEL

SEQ ID NO: 144457 - protein, 10 aa, West Nile virus
GYISTRVELG

SEQ ID NO: 144458 - protein, 10 aa, West Nile virus
YISTRVELGE

SEQ ID NO: 144459 - protein, 10 aa, West Nile virus
ISTRVELGEA

SEQ ID NO: 144460 - protein, 10 aa, West Nile virus
STRVELGEAA

SEQ ID NO: 144461 - protein, 10 aa, West Nile virus
PPGTSDPFPK

SEQ ID NO: 144462 - protein, 10 aa, West Nile virus
PGTSDPFPKS

SEQ ID NO: 144463 - protein, 10 aa, West Nile virus
GTSDPFPKSN

SEQ ID NO: 144464 - protein, 10 aa, West Nile virus
TSDPFPKSNS

SEQ ID NO: 144465 - protein, 10 aa, West Nile virus
HDPFPESNAP

SEQ ID NO: 144466 - protein, 10 aa, West Nile virus
DPFPESNAPV

SEQ ID NO: 144467 - protein, 10 aa, West Nile virus
DIQTEIPDRA

SEQ ID NO: 144468 - protein, 10 aa, West Nile virus
IQTEIPDRAW

SEQ ID NO: 144469 - protein, 10 aa, West Nile virus
TGYEWITEYV

SEQ ID NO: 144470 - protein, 10 aa, West Nile virus
GYEWITEYVG

SEQ ID NO: 144471 - protein, 10 aa, West Nile virus
YEWITEYVGK

SEQ ID NO: 144472 - protein, 10 aa, West Nile virus
EWITEYVGKT

SEQ ID NO: 144473 - protein, 10 aa, West Nile virus
WITEYVGKTV

SEQ ID NO: 144474 - protein, 10 aa, West Nile virus
ITEYVGKTVW

SEQ ID NO: 144475 - protein, 10 aa, West Nile virus
TEYVGKTVWF

SEQ ID NO: 144476 - protein, 10 aa, West Nile virus
EYVGKTVWFV

SEQ ID NO: 144477 - protein, 10 aa, West Nile virus
YVGKTVWFVP

SEQ ID NO: 144478 - protein, 10 aa, West Nile virus
VGKTVWFVPS

SEQ ID NO: 144479 - protein, 10 aa, West Nile virus
AQCLQRAGKR

SEQ ID NO: 144480 - protein, 10 aa, West Nile virus
LCLQRAGKRV

SEQ ID NO: 144481 - protein, 10 aa, West Nile virus
CLQRAGKRVI

SEQ ID NO: 144482 - protein, 10 aa, West Nile virus
LQRAGKRVIQ

SEQ ID NO: 144483 - protein, 10 aa, West Nile virus
QRAGKRVIQL

SEQ ID NO: 144484 - protein, 10 aa, West Nile virus
RAGKRVIQLN

SEQ ID NO: 144485 - protein, 10 aa, West Nile virus
AGKRVIQLNR

SEQ ID NO: 144486 - protein, 10 aa, West Nile virus
GKRVIQLNRK

SEQ ID NO: 144487 - protein, 10 aa, West Nile virus
KRVIQLNRKS

SEQ ID NO: 144488 - protein, 10 aa, West Nile virus
RVIQLNRKSY

SEQ ID NO: 144489 - protein, 10 aa, West Nile virus
SEMGANFRAS

SEQ ID NO: 144490 - protein, 10 aa, West Nile virus
EMGANFKANR

SEQ ID NO: 144491 - protein, 10 aa, West Nile virus
MGANFKANRV

SEQ ID NO: 144492 - protein, 10 aa, West Nile virus
GANFRASRVI

SEQ ID NO: 144493 - protein, 10 aa, West Nile virus
ANFKANRVID

SEQ ID NO: 144494 - protein, 10 aa, West Nile virus
NFKANRVIDS

SEQ ID NO: 144495 - protein, 10 aa, West Nile virus
FRASRVIDSR

SEQ ID NO: 144496 - protein, 10 aa, West Nile virus
KANRVIDSRK

SEQ ID NO: 144497 - protein, 10 aa, West Nile virus
RKSVKPIIIT

SEQ ID NO: 144498 - protein, 10 aa, West Nile virus
KSVKPTIITD

SEQ ID NO: 144499 - protein, 10 aa, West Nile virus
SVKPTIITDG

SEQ ID NO: 144500 - protein, 10 aa, West Nile virus
VKPTIITDGE

SEQ ID NO: 144501 - protein, 10 aa, West Nile virus
ITDGENRVVL

SEQ ID NO: 144502 - protein, 10 aa, West Nile virus
TDGENRVVLG

SEQ ID NO: 144503 - protein, 10 aa, West Nile virus
DGENRVVLGE

SEQ ID NO: 144504 - protein, 10 aa, West Nile virus
GENRVVLGEP

SEQ ID NO: 144505 - protein, 10 aa, West Nile virus
ENRVVLGEPS

SEQ ID NO: 144506 - protein, 10 aa, West Nile virus
SRVVLGEPSA

SEQ ID NO: 144507 - protein, 10 aa, West Nile virus
RVVLGEPSAI

SEQ ID NO: 144508 - protein, 10 aa, West Nile virus
VVLGEPSAIT

SEQ ID NO: 144509 - protein, 10 aa, West Nile virus
VLGEPSAITA

SEQ ID NO: 144510 - protein, 10 aa, West Nile virus
QRRGRVGRNP

SEQ ID NO: 144511 - protein, 10 aa, West Nile virus
RRGRIGRNPT

SEQ ID NO: 144512 - protein, 10 aa, West Nile virus
RGRIGRNPTQ

SEQ ID NO: 144513 - protein, 10 aa, West Nile virus
GRTGRNPSQA

SEQ ID NO: 144514 - protein, 10 aa, West Nile virus
RTGRNPSQAG

SEQ ID NO: 144515 - protein, 10 aa, West Nile virus
IGRNPTQVGD

SEQ ID NO: 144516 - protein, 10 aa, West Nile virus
GRNPSQAGDE

SEQ ID NO: 144517 - protein, 10 aa, West Nile virus
RNPTQVGDEY

SEQ ID NO: 144518 - protein, 10 aa, West Nile virus
NPSQAGDEYC

SEQ ID NO: 144519 - protein, 10 aa, West Nile virus
PSQAGDEYCY

SEQ ID NO: 144520 - protein, 10 aa, West Nile virus
GHTNEDDSNY

SEQ ID NO: 144521 - protein, 10 aa, West Nile virus
HTNEDDSNYA

SEQ ID NO: 144522 - protein, 10 aa, West Nile virus
TNEDDSNYAH

SEQ ID NO: 144523 - protein, 10 aa, West Nile virus
NEDDSNCAHW

SEQ ID NO: 144524 - protein, 10 aa, West Nile virus
EDDSNYAHWT

SEQ ID NO: 144525 - protein, 10 aa, West Nile virus
DDSNCAHWTE

SEQ ID NO: 144526 - protein, 10 aa, West Nile virus
DSNLAHWTEA

SEQ ID NO: 144527 - protein, 10 aa, West Nile virus
SNCAHWTEAR

SEQ ID NO: 144528 - protein, 10 aa, West Nile virus
NCAHWTEARI

SEQ ID NO: 144529 - protein, 10 aa, West Nile virus
CAHWTEARIM

SEQ ID NO: 144530 - protein, 10 aa, West Nile virus
NMPNGLIAQL

SEQ ID NO: 144531 - protein, 10 aa, West Nile virus
MPNGLIAQLY

SEQ ID NO: 144532 - protein, 10 aa, West Nile virus
PNGLIAQLYQ

SEQ ID NO: 144533 - protein, 10 aa, West Nile virus
NGLIAQLYQP

SEQ ID NO: 144534 - protein, 10 aa, West Nile virus
GLIAQLYQPE

SEQ ID NO: 144535 - protein, 10 aa, West Nile virus
LIAQLYQPER

SEQ ID NO: 144536 - protein, 10 aa, West Nile virus
IAQLYQPERE

SEQ ID NO: 144537 - protein, 10 aa, West Nile virus
FYQPEREKVH

SEQ ID NO: 144538 - protein, 10 aa, West Nile virus
PEREKVYTME

SEQ ID NO: 144539 - protein, 10 aa, West Nile virus
EREKVCTMDG

SEQ ID NO: 144540 - protein, 10 aa, West Nile virus
REKVCTMDGE

SEQ ID NO: 144541 - protein, 10 aa, West Nile virus
EKVHTMDGEY

SEQ ID NO: 144542 - protein, 10 aa, West Nile virus
KVCTMDGEYR

SEQ ID NO: 144543 - protein, 10 aa, West Nile virus
VYTMEGEYRL

SEQ ID NO: 144544 - protein, 10 aa, West Nile virus
CTMDGEYRLR

SEQ ID NO: 144545 - protein, 10 aa, West Nile virus
DLPVWLAYKA

SEQ ID NO: 144546 - protein, 10 aa, West Nile virus
LPVWLAHKVA

SEQ ID NO: 144547 - protein, 10 aa, West Nile virus
PVWLAYKVAS

SEQ ID NO: 144548 - protein, 10 aa, West Nile virus
VWLAHKVAAA

SEQ ID NO: 144549 - protein, 10 aa, West Nile virus
WLAHKVAAAG

SEQ ID NO: 144550 - protein, 10 aa, West Nile virus
LAYQVAAAGI

SEQ ID NO: 144551 - protein, 10 aa, West Nile virus
QVAAAGISYH

SEQ ID NO: 144552 - protein, 10 aa, West Nile virus
VAAAGVPYHD

SEQ ID NO: 144553 - protein, 10 aa, West Nile virus
AAAGVPYHDR

SEQ ID NO: 144554 - protein, 10 aa, West Nile virus
AAGISYHDRR

SEQ ID NO: 144555 - protein, 10 aa, West Nile virus
AGVPYHDRRW

SEQ ID NO: 144556 - protein, 10 aa, West Nile virus
GVPYHDRRWC

SEQ ID NO: 144557 - protein, 10 aa, West Nile virus
VPYHDRRWCF

SEQ ID NO: 144558 - protein, 10 aa, West Nile virus
PYHDRRWCFD

SEQ ID NO: 144559 - protein, 10 aa, West Nile virus
GPRTNTVLED

SEQ ID NO: 144560 - protein, 10 aa, West Nile virus
PRTNMILEDN

SEQ ID NO: 144561 - protein, 10 aa, West Nile virus
RTNTVLEDNN

SEQ ID NO: 144562 - protein, 10 aa, West Nile virus
TNTVLEDNNE

SEQ ID NO: 144563 - protein, 10 aa, West Nile virus
NMILEDNNEV

SEQ ID NO: 144564 - protein, 10 aa, West Nile virus
TVLEDNNEVE

SEQ ID NO: 144565 - protein, 10 aa, West Nile virus
VGERKILRPR

SEQ ID NO: 144566 - protein, 10 aa, West Nile virus
ERKILRPRWV

SEQ ID NO: 144567 - protein, 10 aa, West Nile virus
RKILRPRWVD

SEQ ID NO: 144568 - protein, 10 aa, West Nile virus
KILRPRWVDA

SEQ ID NO: 144569 - protein, 10 aa, West Nile virus
ILRPRWVDAR

SEQ ID NO: 144570 - protein, 10 aa, West Nile virus
LRPRWVDARV

SEQ ID NO: 144571 - protein, 10 aa, West Nile virus
RPRWVDARVY

SEQ ID NO: 144572 - protein, 10 aa, West Nile virus
PRWVDARVYS

SEQ ID NO: 144573 - protein, 10 aa, West Nile virus
RWVDARVYSD

SEQ ID NO: 144574 - protein, 10 aa, West Nile virus
WVDARVYSDH

SEQ ID NO: 144575 - protein, 10 aa, West Nile virus
VDARVYSDHQ

SEQ ID NO: 144576 - protein, 10 aa, West Nile virus
VYSDHQALKL

SEQ ID NO: 144577 - protein, 10 aa, West Nile virus
YSDHQALKLF

SEQ ID NO: 144578 - protein, 10 aa, West Nile virus
SDHQALKLFK

SEQ ID NO: 144579 - protein, 10 aa, West Nile virus
DHQALKLFKD

SEQ ID NO: 144580 - protein, 10 aa, West Nile virus
HQALKLFKDF

SEQ ID NO: 144581 - protein, 10 aa, West Nile virus
QALKLFKDFA

SEQ ID NO: 144582 - protein, 10 aa, West Nile virus
ALKLFKDFAA

SEQ ID NO: 144583 - protein, 10 aa, West Nile virus
LKLFKDFAAG

SEQ ID NO: 144584 - protein, 10 aa, West Nile virus
KLFKDFAAGR

SEQ ID NO: 144585 - protein, 10 aa, West Nile virus
LFKDFAAGRR

SEQ ID NO: 144586 - protein, 10 aa, West Nile virus
DFASGKRSQM

SEQ ID NO: 144587 - protein, 10 aa, West Nile virus
FASGKRSQMG

SEQ ID NO: 144588 - protein, 10 aa, West Nile virus
ASGKRSQIGF

SEQ ID NO: 144589 - protein, 10 aa, West Nile virus
GRRSQIGLVE

SEQ ID NO: 144590 - protein, 10 aa, West Nile virus
RRSQIGLVEV

SEQ ID NO: 144591 - protein, 10 aa, West Nile virus
RSQIGLVEVI

SEQ ID NO: 144592 - protein, 10 aa, West Nile virus
SQIGLVEVIG

SEQ ID NO: 144593 - protein, 10 aa, West Nile virus
QIGLVEVIGR

SEQ ID NO: 144594 - protein, 10 aa, West Nile virus
IGLVEVIGRM

SEQ ID NO: 144595 - protein, 10 aa, West Nile virus
GLVEVIGRMP

SEQ ID NO: 144596 - protein, 10 aa, West Nile virus
LVEVIGRMPE

SEQ ID NO: 144597 - protein, 10 aa, West Nile virus
VEVIGRMPEH

SEQ ID NO: 144598 - protein, 10 aa, West Nile virus
EVIGRMPEHF

SEQ ID NO: 144599 - protein, 10 aa, West Nile virus
VIGRMPEHFV

SEQ ID NO: 144600 - protein, 10 aa, West Nile virus
IGRMPEHFVG

SEQ ID NO: 144601 - protein, 10 aa, West Nile virus
GRMPEHFVGK

SEQ ID NO: 144602 - protein, 10 aa, West Nile virus
RMPEHFVGKT

SEQ ID NO: 144603 - protein, 10 aa, West Nile virus
MPEHFMVKTW

SEQ ID NO: 144604 - protein, 10 aa, West Nile virus
PEHFMVKTWE

SEQ ID NO: 144605 - protein, 10 aa, West Nile virus
EHFMVKTWEA

SEQ ID NO: 144606 - protein, 10 aa, West Nile virus
HFMVKTWEAL

SEQ ID NO: 144607 - protein, 10 aa, West Nile virus
FMVKTWEALD

SEQ ID NO: 144608 - protein, 10 aa, West Nile virus
MVKTWEALDT

SEQ ID NO: 144609 - protein, 10 aa, West Nile virus
YVVATAEKGR

SEQ ID NO: 144610 - protein, 10 aa, West Nile virus
VVATAERGGR

SEQ ID NO: 144611 - protein, 10 aa, West Nile virus
VATAERGGRA

SEQ ID NO: 144612 - protein, 10 aa, West Nile virus
ATAERGGRAH

SEQ ID NO: 144613 - protein, 10 aa, West Nile virus
TADKGGRAHR

SEQ ID NO: 144614 - protein, 10 aa, West Nile virus
ADKGGRAHRM

SEQ ID NO: 144615 - protein, 10 aa, West Nile virus
ERGGRAHRSA

SEQ ID NO: 144616 - protein, 10 aa, West Nile virus
KGGRAHSMAL

SEQ ID NO: 144617 - protein, 10 aa, West Nile virus
GGRAHRSALE

SEQ ID NO: 144618 - protein, 10 aa, West Nile virus
RRAHRMALEE

SEQ ID NO: 144619 - protein, 10 aa, West Nile virus
RAHRSALEEL

SEQ ID NO: 144620 - protein, 10 aa, West Nile virus
AHSMALEELP

SEQ ID NO: 144621 - protein, 10 aa, West Nile virus
HRSALEELPD

SEQ ID NO: 144622 - protein, 10 aa, West Nile virus
RSALEELPDA

SEQ ID NO: 144623 - protein, 10 aa, West Nile virus
ELPDALQTVA

SEQ ID NO: 144624 - protein, 10 aa, West Nile virus
LPDALQTVAL

SEQ ID NO: 144625 - protein, 10 aa, West Nile virus
PDALQTIILI

SEQ ID NO: 144626 - protein, 10 aa, West Nile virus
DALQTIVLIA

SEQ ID NO: 144627 - protein, 10 aa, West Nile virus
ALQTIVLIAL

SEQ ID NO: 144628 - protein, 10 aa, West Nile virus
LQTIVLIALL

SEQ ID NO: 144629 - protein, 10 aa, West Nile virus
QTIVLIALLS

SEQ ID NO: 144630 - protein, 10 aa, West Nile virus
TIVLIALLSV

SEQ ID NO: 144631 - protein, 10 aa, West Nile virus
IVLIALLSVM

SEQ ID NO: 144632 - protein, 10 aa, West Nile virus
LLSVMTLGVF

SEQ ID NO: 144633 - protein, 10 aa, West Nile virus
VMTLGVFCLL

SEQ ID NO: 144634 - protein, 10 aa, West Nile virus
MTLGVFCLLM

SEQ ID NO: 144635 - protein, 10 aa, West Nile virus
TLGVFCLLMQ

SEQ ID NO: 144636 - protein, 10 aa, West Nile virus
LGVFCLLMQR

SEQ ID NO: 144637 - protein, 10 aa, West Nile virus
GIFFLLMQRK

SEQ ID NO: 144638 - protein, 10 aa, West Nile virus
IFFLLMQRKG

SEQ ID NO: 144639 - protein, 10 aa, West Nile virus
GIGKIGLGGV

SEQ ID NO: 144640 - protein, 10 aa, West Nile virus
LGLATFFCWM

SEQ ID NO: 144641 - protein, 10 aa, West Nile virus
GLATFFCWMA

SEQ ID NO: 144642 - protein, 10 aa, West Nile virus
LATFFCWMAE

SEQ ID NO: 144643 - protein, 10 aa, West Nile virus
ATFFCWMADV

SEQ ID NO: 144644 - protein, 10 aa, West Nile virus
TLFCWMAEVP

SEQ ID NO: 144645 - protein, 10 aa, West Nile virus
LFCWMAEVPG

SEQ ID NO: 144646 - protein, 10 aa, West Nile virus
FCWMADVPGT

SEQ ID NO: 144647 - protein, 10 aa, West Nile virus
CWMADVPGTK

SEQ ID NO: 144648 - protein, 10 aa, West Nile virus
WMADVPGTKI

SEQ ID NO: 144649 - protein, 10 aa, West Nile virus
MADVPGTKIA

SEQ ID NO: 144650 - protein, 10 aa, West Nile virus
ADVPGTKIAG

SEQ ID NO: 144651 - protein, 10 aa, West Nile virus
DVPGTKIAGM

SEQ ID NO: 144652 - protein, 10 aa, West Nile virus
QLAMFLICVM

SEQ ID NO: 144653 - protein, 10 aa, West Nile virus
LAMFLICVMT

SEQ ID NO: 144654 - protein, 10 aa, West Nile virus
AMFLICVMTL

SEQ ID NO: 144655 - protein, 10 aa, West Nile virus
MFLICVMTLV

SEQ ID NO: 144656 - protein, 10 aa, West Nile virus
TLVGTVAANE

SEQ ID NO: 144657 - protein, 10 aa, West Nile virus
LVGTVAANEM

SEQ ID NO: 144658 - protein, 10 aa, West Nile virus
VGTVAANEMG

SEQ ID NO: 144659 - protein, 10 aa, West Nile virus
GTVAANEMGW

SEQ ID NO: 144660 - protein, 10 aa, West Nile virus
EMGWLDRTKS

SEQ ID NO: 144661 - protein, 10 aa, West Nile virus
MGWLDRTKSD

SEQ ID NO: 144662 - protein, 10 aa, West Nile virus
GWLDRTKSDI

SEQ ID NO: 144663 - protein, 10 aa, West Nile virus
ESFLLDLKPA

SEQ ID NO: 144664 - protein, 10 aa, West Nile virus
SFLLDLKPAT

SEQ ID NO: 144665 - protein, 10 aa, West Nile virus
FFLDLRPATA

SEQ ID NO: 144666 - protein, 10 aa, West Nile virus
ATAWSLYAVA

SEQ ID NO: 144667 - protein, 10 aa, West Nile virus
TAWSLYAIST

SEQ ID NO: 144668 - protein, 10 aa, West Nile virus
AWSLYAISTA

SEQ ID NO: 144669 - protein, 10 aa, West Nile virus
WSLYAISTAF

SEQ ID NO: 144670 - protein, 10 aa, West Nile virus
SLYAVATAVL

SEQ ID NO: 144671 - protein, 10 aa, West Nile virus
LYAVATAVLT

SEQ ID NO: 144672 - protein, 10 aa, West Nile virus
YAISTAFMTP

SEQ ID NO: 144673 - protein, 10 aa, West Nile virus
AVATAVLTPL

SEQ ID NO: 144674 - protein, 10 aa, West Nile virus
ISTAFMTPLL

SEQ ID NO: 144675 - protein, 10 aa, West Nile virus
TTAFLTPLLK

SEQ ID NO: 144676 - protein, 10 aa, West Nile virus
TAFMTPLLKH

SEQ ID NO: 144677 - protein, 10 aa, West Nile virus
AFMTPLLKHL

SEQ ID NO: 144678 - protein, 10 aa, West Nile virus
VLTPLIKHLI

SEQ ID NO: 144679 - protein, 10 aa, West Nile virus
LTPLLKHVIT

SEQ ID NO: 144680 - protein, 10 aa, West Nile virus
SINVQASTLF

SEQ ID NO: 144681 - protein, 10 aa, West Nile virus
INVQASTLFT

SEQ ID NO: 144682 - protein, 10 aa, West Nile virus
NVQASTLFTL

SEQ ID NO: 144683 - protein, 10 aa, West Nile virus
VQASALYSLA

SEQ ID NO: 144684 - protein, 10 aa, West Nile virus
QASALYSLAR

SEQ ID NO: 144685 - protein, 10 aa, West Nile virus
ASALYSLARG

SEQ ID NO: 144686 - protein, 10 aa, West Nile virus
SALYSLARGF

SEQ ID NO: 144687 - protein, 10 aa, West Nile virus
ALYSLARGFP

SEQ ID NO: 144688 - protein, 10 aa, West Nile virus
LYSLARGFPF

SEQ ID NO: 144689 - protein, 10 aa, West Nile virus
YSLARGFPFV

SEQ ID NO: 144690 - protein, 10 aa, West Nile virus
SLARGFPFVD

SEQ ID NO: 144691 - protein, 10 aa, West Nile virus
VGISSLLLAV

SEQ ID NO: 144692 - protein, 10 aa, West Nile virus
GISSLLLAVG

SEQ ID NO: 144693 - protein, 10 aa, West Nile virus
ISALLLAAGC

SEQ ID NO: 144694 - protein, 10 aa, West Nile virus
ALLLAAGCWE

SEQ ID NO: 144695 - protein, 10 aa, West Nile virus
VTLTVTVTAT

SEQ ID NO: 144696 - protein, 10 aa, West Nile virus
TLLLCHYAYM

SEQ ID NO: 144697 - protein, 10 aa, West Nile virus
AAGIMKNAVI

SEQ ID NO: 144698 - protein, 10 aa, West Nile virus
AGIMKNAVID

SEQ ID NO: 144699 - protein, 10 aa, West Nile virus
GIMKNAVIDG

SEQ ID NO: 144700 - protein, 10 aa, West Nile virus
IMKNVVVDGI

SEQ ID NO: 144701 - protein, 10 aa, West Nile virus
MKNAVIDGMV

SEQ ID NO: 144702 - protein, 10 aa, West Nile virus
KNAVIDGMVA

SEQ ID NO: 144703 - protein, 10 aa, West Nile virus
NAVIDGMVAT

SEQ ID NO: 144704 - protein, 10 aa, West Nile virus
AVIDGMVATD

SEQ ID NO: 144705 - protein, 10 aa, West Nile virus
VPELERATPI

SEQ ID NO: 144706 - protein, 10 aa, West Nile virus
PELERATPIM

SEQ ID NO: 144707 - protein, 10 aa, West Nile virus
ELERATPIMQ

SEQ ID NO: 144708 - protein, 10 aa, West Nile virus
LERATPIMQK

SEQ ID NO: 144709 - protein, 10 aa, West Nile virus
ERATPIMQKK

SEQ ID NO: 144710 - protein, 10 aa, West Nile virus
RATPIMQKKV

SEQ ID NO: 144711 - protein, 10 aa, West Nile virus
ATPIMQKKVG

SEQ ID NO: 144712 - protein, 10 aa, West Nile virus
TPIMQKKIGQ

SEQ ID NO: 144713 - protein, 10 aa, West Nile virus
PIMQKKVGQV

SEQ ID NO: 144714 - protein, 10 aa, West Nile virus
IMQKKVGQVM

SEQ ID NO: 144715 - protein, 10 aa, West Nile virus
MQKKVGQIIL

SEQ ID NO: 144716 - protein, 10 aa, West Nile virus
QKKVGQIILI

SEQ ID NO: 144717 - protein, 10 aa, West Nile virus
KKVGQIILIL

SEQ ID NO: 144718 - protein, 10 aa, West Nile virus
KVGQIILILV

SEQ ID NO: 144719 - protein, 10 aa, West Nile virus
VGQIILILVS

SEQ ID NO: 144720 - protein, 10 aa, West Nile virus
LILVSTAAVV

SEQ ID NO: 144721 - protein, 10 aa, West Nile virus
ILVSTAAVVV

SEQ ID NO: 144722 - protein, 10 aa, West Nile virus
LVSTAAVVVN

SEQ ID NO: 144723 - protein, 10 aa, West Nile virus
VSTAAVVVNP

SEQ ID NO: 144724 - protein, 10 aa, West Nile virus
STAAVVVNPS

SEQ ID NO: 144725 - protein, 10 aa, West Nile virus
TAAVVVNPSV

SEQ ID NO: 144726 - protein, 10 aa, West Nile virus
AALVVNPSVK

SEQ ID NO: 144727 - protein, 10 aa, West Nile virus
ALVVNPSVKT

SEQ ID NO: 144728 - protein, 10 aa, West Nile virus
LVVNPSVKTV

SEQ ID NO: 144729 - protein, 10 aa, West Nile virus
TVREAGILVT

SEQ ID NO: 144730 - protein, 10 aa, West Nile virus
VREAGILVTA

SEQ ID NO: 144731 - protein, 10 aa, West Nile virus
REAGILVTAA

SEQ ID NO: 144732 - protein, 10 aa, West Nile virus
EAGILVTAAA

SEQ ID NO: 144733 - protein, 10 aa, West Nile virus
AGILVTAAAV

SEQ ID NO: 144734 - protein, 10 aa, West Nile virus
GILVTAAAVT

SEQ ID NO: 144735 - protein, 10 aa, West Nile virus
ILVTAAAVTL

SEQ ID NO: 144736 - protein, 10 aa, West Nile virus
LVTAAAVTLW

SEQ ID NO: 144737 - protein, 10 aa, West Nile virus
VTAAAVTLWE

SEQ ID NO: 144738 - protein, 10 aa, West Nile virus
SAAAVTLWEN

SEQ ID NO: 144739 - protein, 10 aa, West Nile virus
SVTLWENGAS

SEQ ID NO: 144740 - protein, 10 aa, West Nile virus
VMRGGWLSCF

SEQ ID NO: 144741 - protein, 10 aa, West Nile virus
REGWLSCLSI

SEQ ID NO: 144742 - protein, 10 aa, West Nile virus
GGWLSCLSMT

SEQ ID NO: 144743 - protein, 10 aa, West Nile virus
GWLSCLSMTW

SEQ ID NO: 144744 - protein, 10 aa, West Nile virus
WLSCLSIMWT

SEQ ID NO: 144745 - protein, 10 aa, West Nile virus
LSCLSIMWTL

SEQ ID NO: 144746 - protein, 10 aa, West Nile virus
KNMGKPGLKR

SEQ ID NO: 144747 - protein, 10 aa, West Nile virus
NMGKPGLKRG

SEQ ID NO: 144748 - protein, 10 aa, West Nile virus
MGKPGLKRGG

SEQ ID NO: 144749 - protein, 10 aa, West Nile virus
GKPGLKRGGA

SEQ ID NO: 144750 - protein, 10 aa, West Nile virus
RTLGEVWKEK

SEQ ID NO: 144751 - protein, 10 aa, West Nile virus
TLGEVWKEKL

SEQ ID NO: 144752 - protein, 10 aa, West Nile virus
LGEAWKERLN

SEQ ID NO: 144753 - protein, 10 aa, West Nile virus
GEVWKDRLNR

SEQ ID NO: 144754 - protein, 10 aa, West Nile virus
EVWKDRLNRL

SEQ ID NO: 144755 - protein, 10 aa, West Nile virus
VWKDRLNRLT

SEQ ID NO: 144756 - protein, 10 aa, West Nile virus
MTKEEFIRYR

SEQ ID NO: 144757 - protein, 10 aa, West Nile virus
TKEEFARYRK

SEQ ID NO: 144758 - protein, 10 aa, West Nile virus
KEEFARYRKE

SEQ ID NO: 144759 - protein, 10 aa, West Nile virus
EEFSRYRKEA

SEQ ID NO: 144760 - protein, 10 aa, West Nile virus
EFSRYRKEAI

SEQ ID NO: 144761 - protein, 10 aa, West Nile virus
FIRYRKEAIT

SEQ ID NO: 144762 - protein, 10 aa, West Nile virus
IRYRKEAITE

SEQ ID NO: 144763 - protein, 10 aa, West Nile virus
KEAITEVDRA

SEQ ID NO: 144764 - protein, 10 aa, West Nile virus
EAIIEVDRST

SEQ ID NO: 144765 - protein, 10 aa, West Nile virus
AIIEVDRSTA

SEQ ID NO: 144766 - protein, 10 aa, West Nile virus
IIEVDRSAAR

SEQ ID NO: 144767 - protein, 10 aa, West Nile virus
ARKERNITGG

SEQ ID NO: 144768 - protein, 10 aa, West Nile virus
RKERNITGGH

SEQ ID NO: 144769 - protein, 10 aa, West Nile virus
ERNITGGHPV

SEQ ID NO: 144770 - protein, 10 aa, West Nile virus
RNITGGHPVS

SEQ ID NO: 144771 - protein, 10 aa, West Nile virus
NVTGGHSVSR

SEQ ID NO: 144772 - protein, 10 aa, West Nile virus
VTGGHSVSRG

SEQ ID NO: 144773 - protein, 10 aa, West Nile virus
TGGHPVSRGS

SEQ ID NO: 144774 - protein, 10 aa, West Nile virus
GGHPVSRGSA

SEQ ID NO: 144775 - protein, 10 aa, West Nile virus
GHPVSRGSAK

SEQ ID NO: 144776 - protein, 10 aa, West Nile virus
HPVSRGSAKL

SEQ ID NO: 144777 - protein, 10 aa, West Nile virus
LVERRFLEPI

SEQ ID NO: 144778 - protein, 10 aa, West Nile virus
VERRFLEPIG

SEQ ID NO: 144779 - protein, 10 aa, West Nile virus
ERKFVEPVGR

SEQ ID NO: 144780 - protein, 10 aa, West Nile virus
RRFLEPIGKV

SEQ ID NO: 144781 - protein, 10 aa, West Nile virus
RFLDPIGKVV

SEQ ID NO: 144782 - protein, 10 aa, West Nile virus
FLDPIGKVVD

SEQ ID NO: 144783 - protein, 10 aa, West Nile virus
LDPIGKVVDL

SEQ ID NO: 144784 - protein, 10 aa, West Nile virus
DPIGKVVDLG

SEQ ID NO: 144785 - protein, 10 aa, West Nile virus
PIGKVVDLGC

SEQ ID NO: 144786 - protein, 10 aa, West Nile virus
IGKVVDLGCG

SEQ ID NO: 144787 - protein, 10 aa, West Nile virus
VDVYYRASEA

SEQ ID NO: 144788 - protein, 10 aa, West Nile virus
DVYYRASEAS

SEQ ID NO: 144789 - protein, 10 aa, West Nile virus
VYYRASEASD

SEQ ID NO: 144790 - protein, 10 aa, West Nile virus
YYRASEASDT

SEQ ID NO: 144791 - protein, 10 aa, West Nile virus
YRASEASDTL

SEQ ID NO: 144792 - protein, 10 aa, West Nile virus
RASEASDTLL

SEQ ID NO: 144793 - protein, 10 aa, West Nile virus
ASEASDTLLC

SEQ ID NO: 144794 - protein, 10 aa, West Nile virus
SEVSDTLLCD

SEQ ID NO: 144795 - protein, 10 aa, West Nile virus
ESCDTLLCDI

SEQ ID NO: 144796 - protein, 10 aa, West Nile virus
SCDTLLCDIG

SEQ ID NO: 144797 - protein, 10 aa, West Nile virus
SAEVEEHRTL

SEQ ID NO: 144798 - protein, 10 aa, West Nile virus
AEVEEHRTLR

SEQ ID NO: 144799 - protein, 10 aa, West Nile virus
EVEEHRTLRV

SEQ ID NO: 144800 - protein, 10 aa, West Nile virus
VEEHRTLRVL

SEQ ID NO: 144801 - protein, 10 aa, West Nile virus
EEHRTLRVLE

SEQ ID NO: 144802 - protein, 10 aa, West Nile virus
EHRTLRVLEM

SEQ ID NO: 144803 - protein, 10 aa, West Nile virus
HRTLRVLEMV

SEQ ID NO: 144804 - protein, 10 aa, West Nile virus
RTLRVLEMVE

SEQ ID NO: 144805 - protein, 10 aa, West Nile virus
TLRVLEMVED

SEQ ID NO: 144806 - protein, 10 aa, West Nile virus
LRVLEMVEDW

SEQ ID NO: 144807 - protein, 10 aa, West Nile virus
LHRGPKEFCV

SEQ ID NO: 144808 - protein, 10 aa, West Nile virus
HRGPKEFCVK

SEQ ID NO: 144809 - protein, 10 aa, West Nile virus
RGPKEFCVKV

SEQ ID NO: 144810 - protein, 10 aa, West Nile virus
GPKEFCVKVL

SEQ ID NO: 144811 - protein, 10 aa, West Nile virus
PKEFCVKVLC

SEQ ID NO: 144812 - protein, 10 aa, West Nile virus
KEFCVKVLCP

SEQ ID NO: 144813 - protein, 10 aa, West Nile virus
MPKVIEKMEV

SEQ ID NO: 144814 - protein, 10 aa, West Nile virus
PKVIEKMEVL

SEQ ID NO: 144815 - protein, 10 aa, West Nile virus
KVIEKMEVLQ

SEQ ID NO: 144816 - protein, 10 aa, West Nile virus
VIEKMEVLQR

SEQ ID NO: 144817 - protein, 10 aa, West Nile virus
IEKMEVLQRR

SEQ ID NO: 144818 - protein, 10 aa, West Nile virus
EKMEVLQRRY

SEQ ID NO: 144819 - protein, 10 aa, West Nile virus
KMEVLQRRYG

SEQ ID NO: 144820 - protein, 10 aa, West Nile virus
MEVLQRRYGG

SEQ ID NO: 144821 - protein, 10 aa, West Nile virus
EVLQRRYGGG

SEQ ID NO: 144822 - protein, 10 aa, West Nile virus
VLQRRYGGGL

SEQ ID NO: 144823 - protein, 10 aa, West Nile virus
EMYWVSQASG

SEQ ID NO: 144824 - protein, 10 aa, West Nile virus
MYWVSQASGN

SEQ ID NO: 144825 - protein, 10 aa, West Nile virus
YWVSRASGNI

SEQ ID NO: 144826 - protein, 10 aa, West Nile virus
WVSRASGNIV

SEQ ID NO: 144827 - protein, 10 aa, West Nile virus
VSRASGNIVN

SEQ ID NO: 144828 - protein, 10 aa, West Nile virus
NIVNSVSMTS

SEQ ID NO: 144829 - protein, 10 aa, West Nile virus
IVNSVSMTSQ

SEQ ID NO: 144830 - protein, 10 aa, West Nile virus
VHAVNMTSQV

SEQ ID NO: 144831 - protein, 10 aa, West Nile virus
HAVNMTSQVL

SEQ ID NO: 144832 - protein, 10 aa, West Nile virus
AVNMTSQVLL

SEQ ID NO: 144833 - protein, 10 aa, West Nile virus
RMEKKTWKGA

SEQ ID NO: 144834 - protein, 10 aa, West Nile virus
MEKKTWKGAH

SEQ ID NO: 144835 - protein, 10 aa, West Nile virus
EKKTWKGPQY

SEQ ID NO: 144836 - protein, 10 aa, West Nile virus
KKTWKGPQYE

SEQ ID NO: 144837 - protein, 10 aa, West Nile virus
KTWKGPQYEE

SEQ ID NO: 144838 - protein, 10 aa, West Nile virus
TWKGAHYEED

SEQ ID NO: 144839 - protein, 10 aa, West Nile virus
WKGPQYEEDA

SEQ ID NO: 144840 - protein, 10 aa, West Nile virus
KGPQYEEDAN

SEQ ID NO: 144841 - protein, 10 aa, West Nile virus
GPQYEEDANL

SEQ ID NO: 144842 - protein, 10 aa, West Nile virus
PQYEEDANLG

SEQ ID NO: 144843 - protein, 10 aa, West Nile virus
HYEEDVNLGS

SEQ ID NO: 144844 - protein, 10 aa, West Nile virus
YEEDANLGSG

SEQ ID NO: 144845 - protein, 10 aa, West Nile virus
GKPLLSSDTS

SEQ ID NO: 144846 - protein, 10 aa, West Nile virus
KPLLNSDTSR

SEQ ID NO: 144847 - protein, 10 aa, West Nile virus
PLLNSDTRKI

SEQ ID NO: 144848 - protein, 10 aa, West Nile virus
LLNSDTSKIN

SEQ ID NO: 144849 - protein, 10 aa, West Nile virus
SRIERLKKEY

SEQ ID NO: 144850 - protein, 10 aa, West Nile virus
RIERLKREYS

SEQ ID NO: 144851 - protein, 10 aa, West Nile virus
DDNHPYRTWN

SEQ ID NO: 144852 - protein, 10 aa, West Nile virus
DNHPYRTWNY

SEQ ID NO: 144853 - protein, 10 aa, West Nile virus
WNYHGSYEVK

SEQ ID NO: 144854 - protein, 10 aa, West Nile virus
NYHGSYEVKP

SEQ ID NO: 144855 - protein, 10 aa, West Nile virus
YHGSYEVKPT

SEQ ID NO: 144856 - protein, 10 aa, West Nile virus
HGSYEVKPTG

SEQ ID NO: 144857 - protein, 10 aa, West Nile virus
GSYEVKPTGS

SEQ ID NO: 144858 - protein, 10 aa, West Nile virus
SYEVKPTGSA

SEQ ID NO: 144859 - protein, 10 aa, West Nile virus
YEVKPTGSAS

SEQ ID NO: 144860 - protein, 10 aa, West Nile virus
EVKPTGSASS

SEQ ID NO: 144861 - protein, 10 aa, West Nile virus
VNPTGSASSL

SEQ ID NO: 144862 - protein, 10 aa, West Nile virus
NPTGSASSLV

SEQ ID NO: 144863 - protein, 10 aa, West Nile virus
LSKPWDVITN

SEQ ID NO: 144864 - protein, 10 aa, West Nile virus
SKPWDTIMNV

SEQ ID NO: 144865 - protein, 10 aa, West Nile virus
KPWDTIMNVT

SEQ ID NO: 144866 - protein, 10 aa, West Nile virus
PWDVITNVTT

SEQ ID NO: 144867 - protein, 10 aa, West Nile virus
WDTIMNVTTM

SEQ ID NO: 144868 - protein, 10 aa, West Nile virus
DTIMNVTTMA

SEQ ID NO: 144869 - protein, 10 aa, West Nile virus
TIMNVTTMAM

SEQ ID NO: 144870 - protein, 10 aa, West Nile virus
TKAPEPPEGA

SEQ ID NO: 144871 - protein, 10 aa, West Nile virus
KAPEPPEGAK

SEQ ID NO: 144872 - protein, 10 aa, West Nile virus
LNETTNWLWS

SEQ ID NO: 144873 - protein, 10 aa, West Nile virus
NETTNWLWAY

SEQ ID NO: 144874 - protein, 10 aa, West Nile virus
ETTNWLWAYL

SEQ ID NO: 144875 - protein, 10 aa, West Nile virus
TTNWLWAYLA

SEQ ID NO: 144876 - protein, 10 aa, West Nile virus
TNWLWAYLAR

SEQ ID NO: 144877 - protein, 10 aa, West Nile virus
RNKRPRMCTR

SEQ ID NO: 144878 - protein, 10 aa, West Nile virus
NKRPRMCTRE

SEQ ID NO: 144879 - protein, 10 aa, West Nile virus
KRPRMCTREE

SEQ ID NO: 144880 - protein, 10 aa, West Nile virus
RPRMCTREEF

SEQ ID NO: 144881 - protein, 10 aa, West Nile virus
RMCSREEFIK

SEQ ID NO: 144882 - protein, 10 aa, West Nile virus
MCSREEFIKK

SEQ ID NO: 144883 - protein, 10 aa, West Nile virus
CSREEFIKKV

SEQ ID NO: 144884 - protein, 10 aa, West Nile virus
SREEFIKKVN

SEQ ID NO: 144885 - protein, 10 aa, West Nile virus
REEFISKVNS

SEQ ID NO: 144886 - protein, 10 aa, West Nile virus
EEFISKVNSN

SEQ ID NO: 144887 - protein, 10 aa, West Nile virus
EFIKKVNSNA

SEQ ID NO: 144888 - protein, 10 aa, West Nile virus
FISKVNSNAA

SEQ ID NO: 144889 - protein, 10 aa, West Nile virus
IKKVNSNAAL

SEQ ID NO: 144890 - protein, 10 aa, West Nile virus
SKVNSNAALG

SEQ ID NO: 144891 - protein, 10 aa, West Nile virus
AMFEEQNQWS

SEQ ID NO: 144892 - protein, 10 aa, West Nile virus
MFEEQNQWKS

SEQ ID NO: 144893 - protein, 10 aa, West Nile virus
FEEQNQWKSA

SEQ ID NO: 144894 - protein, 10 aa, West Nile virus
EEQNQWKSAR

SEQ ID NO: 144895 - protein, 10 aa, West Nile virus
EQNQWKSARE

SEQ ID NO: 144896 - protein, 10 aa, West Nile virus
QNQWKSAREA

SEQ ID NO: 144897 - protein, 10 aa, West Nile virus
NQWKSAREAV

SEQ ID NO: 144898 - protein, 10 aa, West Nile virus
QWKSAREAVE

SEQ ID NO: 144899 - protein, 10 aa, West Nile virus
WKSAREAVED

SEQ ID NO: 144900 - protein, 10 aa, West Nile virus
SARAAVEDPK

SEQ ID NO: 144901 - protein, 10 aa, West Nile virus
AREAVEDLKF

SEQ ID NO: 144902 - protein, 10 aa, West Nile virus
RAAVEDPKFW

SEQ ID NO: 144903 - protein, 10 aa, West Nile virus
AAVEDPKFWE

SEQ ID NO: 144904 - protein, 10 aa, West Nile virus
AVEDLKFWEM

SEQ ID NO: 144905 - protein, 10 aa, West Nile virus
VEDLKFWEMV

SEQ ID NO: 144906 - protein, 10 aa, West Nile virus
EDLKFWEMVD

SEQ ID NO: 144907 - protein, 10 aa, West Nile virus
DLKFWEMVDE

SEQ ID NO: 144908 - protein, 10 aa, West Nile virus
PKFWEIVDEE

SEQ ID NO: 144909 - protein, 10 aa, West Nile virus
KFWEIVDEER

SEQ ID NO: 144910 - protein, 10 aa, West Nile virus
FWEIVDEERE

SEQ ID NO: 144911 - protein, 10 aa, West Nile virus
WEIVDEEREA

SEQ ID NO: 144912 - protein, 10 aa, West Nile virus
EIVDEEREAH

SEQ ID NO: 144913 - protein, 10 aa, West Nile virus
IVDEEREAHL

SEQ ID NO: 144914 - protein, 10 aa, West Nile virus
REAHLRGECY

SEQ ID NO: 144915 - protein, 10 aa, West Nile virus
EAHLRGECYT

SEQ ID NO: 144916 - protein, 10 aa, West Nile virus
AHLRGECYTC

SEQ ID NO: 144917 - protein, 10 aa, West Nile virus
HLRGECYTCI

SEQ ID NO: 144918 - protein, 10 aa, West Nile virus
LRGECYTCIY

SEQ ID NO: 144919 - protein, 10 aa, West Nile virus
RGECYTCIYN

SEQ ID NO: 144920 - protein, 10 aa, West Nile virus
GECYTCIYNM

SEQ ID NO: 144921 - protein, 10 aa, West Nile virus
ECYTCIYNMM

SEQ ID NO: 144922 - protein, 10 aa, West Nile virus
CYTCIYNMMG

SEQ ID NO: 144923 - protein, 10 aa, West Nile virus
YTCIYNMMGK

SEQ ID NO: 144924 - protein, 10 aa, West Nile virus
GLQKLGYVLR

SEQ ID NO: 144925 - protein, 10 aa, West Nile virus
LQKLGYVLRE

SEQ ID NO: 144926 - protein, 10 aa, West Nile virus
QKLGYVLREV

SEQ ID NO: 144927 - protein, 10 aa, West Nile virus
KLGYVLREVG

SEQ ID NO: 144928 - protein, 10 aa, West Nile virus
GGKVYADDTA

SEQ ID NO: 144929 - protein, 10 aa, West Nile virus
GKVYADDTAG

SEQ ID NO: 144930 - protein, 10 aa, West Nile virus
KVYADDTAGW

SEQ ID NO: 144931 - protein, 10 aa, West Nile virus
VYADDTAGWD

SEQ ID NO: 144932 - protein, 10 aa, West Nile virus
TAGWDTRITM

SEQ ID NO: 144933 - protein, 10 aa, West Nile virus
AGWDTRITMT

SEQ ID NO: 144934 - protein, 10 aa, West Nile virus
GWDTPITKAD

SEQ ID NO: 144935 - protein, 10 aa, West Nile virus
WDTRITMTDL

SEQ ID NO: 144936 - protein, 10 aa, West Nile virus
DTPITKADLE

SEQ ID NO: 144937 - protein, 10 aa, West Nile virus
TPITKADLEN

SEQ ID NO: 144938 - protein, 10 aa, West Nile virus
RITMTDLENE

SEQ ID NO: 144939 - protein, 10 aa, West Nile virus
EAKVLELLEG

SEQ ID NO: 144940 - protein, 10 aa, West Nile virus
AKVLELLEGE

SEQ ID NO: 144941 - protein, 10 aa, West Nile virus
KVLELLDREH

SEQ ID NO: 144942 - protein, 10 aa, West Nile virus
VLELLEGEHR

SEQ ID NO: 144943 - protein, 10 aa, West Nile virus
LELLEGEHRR

SEQ ID NO: 144944 - protein, 10 aa, West Nile virus
ELLDREHRRL

SEQ ID NO: 144945 - protein, 10 aa, West Nile virus
LLDREHRRLA

SEQ ID NO: 144946 - protein, 10 aa, West Nile virus
EGEHRRLARA

SEQ ID NO: 144947 - protein, 10 aa, West Nile virus
GEHRRLARSV

SEQ ID NO: 144948 - protein, 10 aa, West Nile virus
EHRRLARSVI

SEQ ID NO: 144949 - protein, 10 aa, West Nile virus
HRRLARSVIE

SEQ ID NO: 144950 - protein, 10 aa, West Nile virus
RRLARSVIEL

SEQ ID NO: 144951 - protein, 10 aa, West Nile virus
RLARSVIELT

SEQ ID NO: 144952 - protein, 10 aa, West Nile virus
LARSVIELTY

SEQ ID NO: 144953 - protein, 10 aa, West Nile virus
ARSVIELTYR

SEQ ID NO: 144954 - protein, 10 aa, West Nile virus
RSVIELTYRH

SEQ ID NO: 144955 - protein, 10 aa, West Nile virus
SVIELTYRHK

SEQ ID NO: 144956 - protein, 10 aa, West Nile virus
IIELTYCHKV

SEQ ID NO: 144957 - protein, 10 aa, West Nile virus
IELTYCHKVV

SEQ ID NO: 144958 - protein, 10 aa, West Nile virus
ELTYCHKVVK

SEQ ID NO: 144959 - protein, 10 aa, West Nile virus
LTYCHKVVKV

SEQ ID NO: 144960 - protein, 10 aa, West Nile virus
TYCHKVVKVM

SEQ ID NO: 144961 - protein, 10 aa, West Nile virus
YCHKVVKVMR

SEQ ID NO: 144962 - protein, 10 aa, West Nile virus
RHKVVKGMRP

SEQ ID NO: 144963 - protein, 10 aa, West Nile virus
KVMRPAVGGK

SEQ ID NO: 144964 - protein, 10 aa, West Nile virus
VMRPAVGGKT

SEQ ID NO: 144965 - protein, 10 aa, West Nile virus
MRPAVGGKTV

SEQ ID NO: 144966 - protein, 10 aa, West Nile virus
RPAVGGKTVM

SEQ ID NO: 144967 - protein, 10 aa, West Nile virus
PAVGGKTVMD

SEQ ID NO: 144968 - protein, 10 aa, West Nile virus
AVGGKTVMDI

SEQ ID NO: 144969 - protein, 10 aa, West Nile virus
VGGKTVMDII

SEQ ID NO: 144970 - protein, 10 aa, West Nile virus
GGKTVMDIIS

SEQ ID NO: 144971 - protein, 10 aa, West Nile virus
GKTVMDIISR

SEQ ID NO: 144972 - protein, 10 aa, West Nile virus
KTVMDIISRE

SEQ ID NO: 144973 - protein, 10 aa, West Nile virus
VISREDQRGR

SEQ ID NO: 144974 - protein, 10 aa, West Nile virus
YALNPFSNLA

SEQ ID NO: 144975 - protein, 10 aa, West Nile virus
ALNPFSNLAV

SEQ ID NO: 144976 - protein, 10 aa, West Nile virus
LNPFTNLAFQ

SEQ ID NO: 144977 - protein, 10 aa, West Nile virus
NPFTNLAFQL

SEQ ID NO: 144978 - protein, 10 aa, West Nile virus
PFTNLAFQLG

SEQ ID NO: 144979 - protein, 10 aa, West Nile virus
FTNLAFQLGR

SEQ ID NO: 144980 - protein, 10 aa, West Nile virus
TNLAFQLGRR

SEQ ID NO: 144981 - protein, 10 aa, West Nile virus
NLAFQLGRRR

SEQ ID NO: 144982 - protein, 10 aa, West Nile virus
LAVQLVRRRE

SEQ ID NO: 144983 - protein, 10 aa, West Nile virus
AVQLVRRREG

SEQ ID NO: 144984 - protein, 10 aa, West Nile virus
VRRREGEGVI

SEQ ID NO: 144985 - protein, 10 aa, West Nile virus
RRREGEGVIG

SEQ ID NO: 144986 - protein, 10 aa, West Nile virus
RREGEGVIGP

SEQ ID NO: 144987 - protein, 10 aa, West Nile virus
REGEGVIGPY

SEQ ID NO: 144988 - protein, 10 aa, West Nile virus
EGEGVIGPED

SEQ ID NO: 144989 - protein, 10 aa, West Nile virus
GEGVIGPYDV

SEQ ID NO: 144990 - protein, 10 aa, West Nile virus
EGVIGPYDVE

SEQ ID NO: 144991 - protein, 10 aa, West Nile virus
KRKGPKVRTW

SEQ ID NO: 144992 - protein, 10 aa, West Nile virus
RKGPKVRTWL

SEQ ID NO: 144993 - protein, 10 aa, West Nile virus
KGPKVRTWLS

SEQ ID NO: 144994 - protein, 10 aa, West Nile virus
GPKVRTWLSE

SEQ ID NO: 144995 - protein, 10 aa, West Nile virus
PKVRTWLSEN

SEQ ID NO: 144996 - protein, 10 aa, West Nile virus
KVRTWLSENG

SEQ ID NO: 144997 - protein, 10 aa, West Nile virus
VRTWLSENGE

SEQ ID NO: 144998 - protein, 10 aa, West Nile virus
RTWLSENGEE

SEQ ID NO: 144999 - protein, 10 aa, West Nile virus
TWLSENGEER

SEQ ID NO: 145000 - protein, 10 aa, West Nile virus
LFENGEERLG

SEQ ID NO: 145001 - protein, 10 aa, West Nile virus
FENGEERLGR

SEQ ID NO: 145002 - protein, 10 aa, West Nile virus
ENGEERLGRM

SEQ ID NO: 145003 - protein, 10 aa, West Nile virus
NGEERLGRMA

SEQ ID NO: 145004 - protein, 10 aa, West Nile virus
GEERLSRTAV

SEQ ID NO: 145005 - protein, 10 aa, West Nile virus
EERLSRTAVS

SEQ ID NO: 145006 - protein, 10 aa, West Nile virus
KPLDDRFASS

SEQ ID NO: 145007 - protein, 10 aa, West Nile virus
PLDDRFAISL

SEQ ID NO: 145008 - protein, 10 aa, West Nile virus
LDDRFAISLH

SEQ ID NO: 145009 - protein, 10 aa, West Nile virus
DDRFASSLHF

SEQ ID NO: 145010 - protein, 10 aa, West Nile virus
DRFAISLHFL

SEQ ID NO: 145011 - protein, 10 aa, West Nile virus
RFASSLHFLN

SEQ ID NO: 145012 - protein, 10 aa, West Nile virus
FATSLHFLND

SEQ ID NO: 145013 - protein, 10 aa, West Nile virus
AISLHFLNAM

SEQ ID NO: 145014 - protein, 10 aa, West Nile virus
TSLHFLNDMS

SEQ ID NO: 145015 - protein, 10 aa, West Nile virus
SLHFLNDMSK

SEQ ID NO: 145016 - protein, 10 aa, West Nile virus
LHFLNAMPKV

SEQ ID NO: 145017 - protein, 10 aa, West Nile virus
HFLNAMSQVR

SEQ ID NO: 145018 - protein, 10 aa, West Nile virus
FLNAMSQVRK

SEQ ID NO: 145019 - protein, 10 aa, West Nile virus
LNDMSKVRKD

SEQ ID NO: 145020 - protein, 10 aa, West Nile virus
NAMSQVRKDI

SEQ ID NO: 145021 - protein, 10 aa, West Nile virus
DMSKVRKDIQ

SEQ ID NO: 145022 - protein, 10 aa, West Nile virus
VGWYDWQQVP

SEQ ID NO: 145023 - protein, 10 aa, West Nile virus
IMKDGRTLVA

SEQ ID NO: 145024 - protein, 10 aa, West Nile virus
TPCRGQDELV

SEQ ID NO: 145025 - protein, 10 aa, West Nile virus
NAICSAVPAN

SEQ ID NO: 145026 - protein, 10 aa, West Nile virus
AICSAVPANW

SEQ ID NO: 145027 - protein, 10 aa, West Nile virus
ICSAVPANWV

SEQ ID NO: 145028 - protein, 10 aa, West Nile virus
CSAVPANWVP

SEQ ID NO: 145029 - protein, 10 aa, West Nile virus
SAVPANWVPT

SEQ ID NO: 145030 - protein, 10 aa, West Nile virus
AVPANWVPTG

SEQ ID NO: 145031 - protein, 10 aa, West Nile virus
VPANWVPTGR

SEQ ID NO: 145032 - protein, 10 aa, West Nile virus
PANWVPTGRT

SEQ ID NO: 145033 - protein, 10 aa, West Nile virus
ANWVPTGRTT

SEQ ID NO: 145034 - protein, 10 aa, West Nile virus
DWVPTGRTTW

SEQ ID NO: 145035 - protein, 10 aa, West Nile virus
GRTTWSIHAR

SEQ ID NO: 145036 - protein, 10 aa, West Nile virus
RTTWSIHARG

SEQ ID NO: 145037 - protein, 10 aa, West Nile virus
TTWSIHARGE

SEQ ID NO: 145038 - protein, 10 aa, West Nile virus
TWSIHARGEW

SEQ ID NO: 145039 - protein, 10 aa, West Nile virus
WSIHARGEWM

SEQ ID NO: 145040 - protein, 10 aa, West Nile virus
SIHARGEWMT

SEQ ID NO: 145041 - protein, 10 aa, West Nile virus
IHARGEWMTT

SEQ ID NO: 145042 - protein, 10 aa, West Nile virus
HARGEWMTTA

SEQ ID NO: 145043 - protein, 10 aa, West Nile virus
RGEWMTTADM

SEQ ID NO: 145044 - protein, 10 aa, West Nile virus
EWMTTADMLG

SEQ ID NO: 145045 - protein, 10 aa, West Nile virus
WMTTADMLGV

SEQ ID NO: 145046 - protein, 10 aa, West Nile virus
MTTADMLGVW

SEQ ID NO: 145047 - protein, 10 aa, West Nile virus
TTADMLGVWN

SEQ ID NO: 145048 - protein, 10 aa, West Nile virus
TADMLGVWNR

SEQ ID NO: 145049 - protein, 10 aa, West Nile virus
ADMLGVWNRV

SEQ ID NO: 145050 - protein, 10 aa, West Nile virus
DMLGVWNRVW

SEQ ID NO: 145051 - protein, 10 aa, West Nile virus
MLGVWNRVWI

SEQ ID NO: 145052 - protein, 10 aa, West Nile virus
LGVWNRVWIE

SEQ ID NO: 145053 - protein, 10 aa, West Nile virus
GVWNRVWIEE

SEQ ID NO: 145054 - protein, 10 aa, West Nile virus
KTPVERWSDI

SEQ ID NO: 145055 - protein, 10 aa, West Nile virus
TPVERWSDIP

SEQ ID NO: 145056 - protein, 10 aa, West Nile virus
PVERWSDIPY

SEQ ID NO: 145057 - protein, 10 aa, West Nile virus
VERWSDIPYS

SEQ ID NO: 145058 - protein, 10 aa, West Nile virus
ERWSDIPYSG

SEQ ID NO: 145059 - protein, 10 aa, West Nile virus
RWSDIPYSGK

SEQ ID NO: 145060 - protein, 10 aa, West Nile virus
WCGSLIGTRS

SEQ ID NO: 145061 - protein, 10 aa, West Nile virus
CGSLIGTRSR

SEQ ID NO: 145062 - protein, 10 aa, West Nile virus
GSLIGTRSRA

SEQ ID NO: 145063 - protein, 10 aa, West Nile virus
SLIGTRSRAT

SEQ ID NO: 145064 - protein, 10 aa, West Nile virus
LIGTRSRATW

SEQ ID NO: 145065 - protein, 10 aa, West Nile virus
IGTRSRATWA

SEQ ID NO: 145066 - protein, 10 aa, West Nile virus
GTRSRATWAE

SEQ ID NO: 145067 - protein, 10 aa, West Nile virus
TRSRATWAEN

SEQ ID NO: 145068 - protein, 10 aa, West Nile virus
RSRATWAENI

SEQ ID NO: 145069 - protein, 10 aa, West Nile virus
TRATWAENIQ

SEQ ID NO: 145070 - protein, 10 aa, West Nile virus
NIQVAINQVK

SEQ ID NO: 145071 - protein, 10 aa, West Nile virus
IQVAINQVRS

SEQ ID NO: 145072 - protein, 10 aa, West Nile virus
IIGEEKYVDY

SEQ ID NO: 145073 - protein, 10 aa, West Nile virus
GEEKYVDYMG

SEQ ID NO: 145074 - protein, 10 aa, West Nile virus
EEKYVDYMGS

SEQ ID NO: 145075 - protein, 10 aa, West Nile virus
KYVDYMGSLK

SEQ ID NO: 145076 - protein, 10 aa, West Nile virus
YVDYMGSLKR

SEQ ID NO: 145077 - protein, 10 aa, West Nile virus
VDYMGSLKRY

SEQ ID NO: 145078 - protein, 10 aa, West Nile virus
DYMGSLKRYE

SEQ ID NO: 145079 - protein, 10 aa, West Nile virus
YMGSLKRYEE

SEQ ID NO: 145080 - protein, 10 aa, West Nile virus
RAVNMQKRGK

SEQ ID NO: 145081 - protein, 10 aa, West Nile virus
AVNMLKRGTP

SEQ ID NO: 145082 - protein, 10 aa, West Nile virus
VNMLKRGKPR

SEQ ID NO: 145083 - protein, 10 aa, West Nile virus
KRGKPRGGSL

SEQ ID NO: 145084 - protein, 10 aa, West Nile virus
PRVMSLIGLK

SEQ ID NO: 145085 - protein, 10 aa, West Nile virus
RGGSLMGLKR

SEQ ID NO: 145086 - protein, 10 aa, West Nile virus
GGSLMGLKRA

SEQ ID NO: 145087 - protein, 10 aa, West Nile virus
GSLMGLKRAI

SEQ ID NO: 145088 - protein, 10 aa, West Nile virus
LSLIDGKGPV

SEQ ID NO: 145089 - protein, 10 aa, West Nile virus
SLIDGKGPTR

SEQ ID NO: 145090 - protein, 10 aa, West Nile virus
LIDGKGPTRF

SEQ ID NO: 145091 - protein, 10 aa, West Nile virus
IDGKGPTRFV

SEQ ID NO: 145092 - protein, 10 aa, West Nile virus
DGKGPTRFVL

SEQ ID NO: 145093 - protein, 10 aa, West Nile virus
GKGPTRFVLA

SEQ ID NO: 145094 - protein, 10 aa, West Nile virus
KGPVRFVLAL

SEQ ID NO: 145095 - protein, 10 aa, West Nile virus
PVRFVLALLA

SEQ ID NO: 145096 - protein, 10 aa, West Nile virus
IRFVLALLVF

SEQ ID NO: 145097 - protein, 10 aa, West Nile virus
LLVFFRFTAI

SEQ ID NO: 145098 - protein, 10 aa, West Nile virus
LAFFRFTAVA

SEQ ID NO: 145099 - protein, 10 aa, West Nile virus
AFFRFTAVAP

SEQ ID NO: 145100 - protein, 10 aa, West Nile virus
AIAPTRAVLE

SEQ ID NO: 145101 - protein, 10 aa, West Nile virus
IAPTRAVLNR

SEQ ID NO: 145102 - protein, 10 aa, West Nile virus
TRAVLNRWRG

SEQ ID NO: 145103 - protein, 10 aa, West Nile virus
RAVLERWRGV

SEQ ID NO: 145104 - protein, 10 aa, West Nile virus
AVLERWRGVN

SEQ ID NO: 145105 - protein, 10 aa, West Nile virus
VLNRWRGVNK

SEQ ID NO: 145106 - protein, 10 aa, West Nile virus
LNRWRGVNKQ

SEQ ID NO: 145107 - protein, 10 aa, West Nile virus
ERWRGVNKQT

SEQ ID NO: 145108 - protein, 10 aa, West Nile virus
FKRELGTLTS

SEQ ID NO: 145109 - protein, 10 aa, West Nile virus
KKELGALTSA

SEQ ID NO: 145110 - protein, 10 aa, West Nile virus
KELGTLTNAM

SEQ ID NO: 145111 - protein, 10 aa, West Nile virus
ELGTLTNAMN

SEQ ID NO: 145112 - protein, 10 aa, West Nile virus
LGILTNAISR

SEQ ID NO: 145113 - protein, 10 aa, West Nile virus
GTLTNAMNRR

SEQ ID NO: 145114 - protein, 10 aa, West Nile virus
ALTSAINRRS

SEQ ID NO: 145115 - protein, 10 aa, West Nile virus
SRRSEKKKKR

SEQ ID NO: 145116 - protein, 10 aa, West Nile virus
RRSEKKKKRG

SEQ ID NO: 145117 - protein, 10 aa, West Nile virus
RSAKQKKRGG

SEQ ID NO: 145118 - protein, 10 aa, West Nile virus
KKKKRGGSIG

SEQ ID NO: 145119 - protein, 10 aa, West Nile virus
RAVTLSNFQG

SEQ ID NO: 145120 - protein, 10 aa, West Nile virus
AVTLSDFQGK

SEQ ID NO: 145121 - protein, 10 aa, West Nile virus
VLSNFQGKLM

SEQ ID NO: 145122 - protein, 10 aa, West Nile virus
NFQGKLMMTV

SEQ ID NO: 145123 - protein, 10 aa, West Nile virus
FQGKVMMTIN

SEQ ID NO: 145124 - protein, 10 aa, West Nile virus
QGKLMMTVNA

SEQ ID NO: 145125 - protein, 10 aa, West Nile virus
GKVMMTINAT

SEQ ID NO: 145126 - protein, 10 aa, West Nile virus
KLMMTINATE

SEQ ID NO: 145127 - protein, 10 aa, West Nile virus
IITIPTASGK

SEQ ID NO: 145128 - protein, 10 aa, West Nile virus
PPAAGKNLCI

SEQ ID NO: 145129 - protein, 10 aa, West Nile virus
TASGKNLCTV

SEQ ID NO: 145130 - protein, 10 aa, West Nile virus
AAGKNLCTVR

SEQ ID NO: 145131 - protein, 10 aa, West Nile virus
AGKNLCTVRA

SEQ ID NO: 145132 - protein, 10 aa, West Nile virus
CTVRAMDVGY

SEQ ID NO: 145133 - protein, 10 aa, West Nile virus
VRAMDVGHMC

SEQ ID NO: 145134 - protein, 10 aa, West Nile virus
RAMDVGHMCD

SEQ ID NO: 145135 - protein, 10 aa, West Nile virus
AMDVGHMCDD

SEQ ID NO: 145136 - protein, 10 aa, West Nile virus
MDVGHMCDDT

SEQ ID NO: 145137 - protein, 10 aa, West Nile virus
DVGHMCDDTI

SEQ ID NO: 145138 - protein, 10 aa, West Nile virus
VGHMCDDTIT

SEQ ID NO: 145139 - protein, 10 aa, West Nile virus
GHMCDDTITY

SEQ ID NO: 145140 - protein, 10 aa, West Nile virus
HMCDDTITYE

SEQ ID NO: 145141 - protein, 10 aa, West Nile virus
DDTITYECPA

SEQ ID NO: 145142 - protein, 10 aa, West Nile virus
TITYECSVLS

SEQ ID NO: 145143 - protein, 10 aa, West Nile virus
ITYECPALAA

SEQ ID NO: 145144 - protein, 10 aa, West Nile virus
TYECSVLSAG

SEQ ID NO: 145145 - protein, 10 aa, West Nile virus
YECSVLSAGN

SEQ ID NO: 145146 - protein, 10 aa, West Nile virus
ECPALAAGND

SEQ ID NO: 145147 - protein, 10 aa, West Nile virus
CPALAAGNDP

SEQ ID NO: 145148 - protein, 10 aa, West Nile virus
PALAAGNDPE

SEQ ID NO: 145149 - protein, 10 aa, West Nile virus
DIDCWCTKAA

SEQ ID NO: 145150 - protein, 10 aa, West Nile virus
AMYVRYGRCT

SEQ ID NO: 145151 - protein, 10 aa, West Nile virus
TRTRHSRRSR

SEQ ID NO: 145152 - protein, 10 aa, West Nile virus
KTRHSRRSKR

SEQ ID NO: 145153 - protein, 10 aa, West Nile virus
VQTHGKSTLA

SEQ ID NO: 145154 - protein, 10 aa, West Nile virus
QTHGKSTLAN

SEQ ID NO: 145155 - protein, 10 aa, West Nile virus
AHGESTLANK

SEQ ID NO: 145156 - protein, 10 aa, West Nile virus
HGESTLVNKK

SEQ ID NO: 145157 - protein, 10 aa, West Nile virus
GESTLVNKKG

SEQ ID NO: 145158 - protein, 10 aa, West Nile virus
ESTLVNKKGA

SEQ ID NO: 145159 - protein, 10 aa, West Nile virus
TLSNKKGAWM

SEQ ID NO: 145160 - protein, 10 aa, West Nile virus
LSNKKGAWMD

SEQ ID NO: 145161 - protein, 10 aa, West Nile virus
SNKKGAWMDS

SEQ ID NO: 145162 - protein, 10 aa, West Nile virus
SNTMQRVVFI

SEQ ID NO: 145163 - protein, 10 aa, West Nile virus
TQRVVFMILL

SEQ ID NO: 145164 - protein, 10 aa, West Nile virus
QRVVFAVLLL

SEQ ID NO: 145165 - protein, 10 aa, West Nile virus
RVVFAVLLLL

SEQ ID NO: 145166 - protein, 10 aa, West Nile virus
VVFMILLLLV

SEQ ID NO: 145167 - protein, 10 aa, West Nile virus
VFMILLLLVA

SEQ ID NO: 145168 - protein, 10 aa, West Nile virus
FMILLLLVAP

SEQ ID NO: 145169 - protein, 10 aa, West Nile virus
MILLLLVAPA

SEQ ID NO: 145170 - protein, 10 aa, West Nile virus
DSCVTIMSKN

SEQ ID NO: 145171 - protein, 10 aa, West Nile virus
SCVTIMSKNK

SEQ ID NO: 145172 - protein, 10 aa, West Nile virus
CVTIMSKNKP

SEQ ID NO: 145173 - protein, 10 aa, West Nile virus
VTIMSKNKPT

SEQ ID NO: 145174 - protein, 10 aa, West Nile virus
TIMSKNKPTI

SEQ ID NO: 145175 - protein, 10 aa, West Nile virus
LMSKDKPTID

SEQ ID NO: 145176 - protein, 10 aa, West Nile virus
PTIDVKMMNV

SEQ ID NO: 145177 - protein, 10 aa, West Nile virus
TIDVKMMKME

SEQ ID NO: 145178 - protein, 10 aa, West Nile virus
IDVKMMKMEA

SEQ ID NO: 145179 - protein, 10 aa, West Nile virus
VSELSTKAAC

SEQ ID NO: 145180 - protein, 10 aa, West Nile virus
SELSTKAACP

SEQ ID NO: 145181 - protein, 10 aa, West Nile virus
LSPRAACPTM

SEQ ID NO: 145182 - protein, 10 aa, West Nile virus
STKAACPAMG

SEQ ID NO: 145183 - protein, 10 aa, West Nile virus
PRAACPTMGE

SEQ ID NO: 145184 - protein, 10 aa, West Nile virus
KAACPTMGDA

SEQ ID NO: 145185 - protein, 10 aa, West Nile virus
EAHNDKRADS

SEQ ID NO: 145186 - protein, 10 aa, West Nile virus
YFCKQGVVDR

SEQ ID NO: 145187 - protein, 10 aa, West Nile virus
DTCAKFACTS

SEQ ID NO: 145188 - protein, 10 aa, West Nile virus
TCARFACSTK

SEQ ID NO: 145189 - protein, 10 aa, West Nile virus
CAKFACTSKA

SEQ ID NO: 145190 - protein, 10 aa, West Nile virus
AKFTCSNKAT

SEQ ID NO: 145191 - protein, 10 aa, West Nile virus
KFTCSNKATG

SEQ ID NO: 145192 - protein, 10 aa, West Nile virus
FTCSNKATGL

SEQ ID NO: 145193 - protein, 10 aa, West Nile virus
TCSNKATGLT

SEQ ID NO: 145194 - protein, 10 aa, West Nile virus
CSNKATGLTI

SEQ ID NO: 145195 - protein, 10 aa, West Nile virus
SNKATGLTIQ

SEQ ID NO: 145196 - protein, 10 aa, West Nile virus
NKATGLTIQR

SEQ ID NO: 145197 - protein, 10 aa, West Nile virus
KATGLTIQRE

SEQ ID NO: 145198 - protein, 10 aa, West Nile virus
ATGLTIQREN

SEQ ID NO: 145199 - protein, 10 aa, West Nile virus
TGLTIQRENV

SEQ ID NO: 145200 - protein, 10 aa, West Nile virus
GATQAGRLSI

SEQ ID NO: 145201 - protein, 10 aa, West Nile virus
ATQAGRLSIT

SEQ ID NO: 145202 - protein, 10 aa, West Nile virus
TQAGRLSITP

SEQ ID NO: 145203 - protein, 10 aa, West Nile virus
QAGRLSITPA

SEQ ID NO: 145204 - protein, 10 aa, West Nile virus
AGRLSITPAA

SEQ ID NO: 145205 - protein, 10 aa, West Nile virus
GRLSITPAAP

SEQ ID NO: 145206 - protein, 10 aa, West Nile virus
RLSITPAAPS

SEQ ID NO: 145207 - protein, 10 aa, West Nile virus
SITPAAPSHT

SEQ ID NO: 145208 - protein, 10 aa, West Nile virus
KLGEYGEVTM

SEQ ID NO: 145209 - protein, 10 aa, West Nile virus
LGGYGEVTVD

SEQ ID NO: 145210 - protein, 10 aa, West Nile virus
GEYGEVTMDC

SEQ ID NO: 145211 - protein, 10 aa, West Nile virus
EYGEVTMDCE

SEQ ID NO: 145212 - protein, 10 aa, West Nile virus
IDTSAYYVMT

SEQ ID NO: 145213 - protein, 10 aa, West Nile virus
DTSAYYVMTV

SEQ ID NO: 145214 - protein, 10 aa, West Nile virus
TSAYYVMTVG

SEQ ID NO: 145215 - protein, 10 aa, West Nile virus
LNLPWSSAGG

SEQ ID NO: 145216 - protein, 10 aa, West Nile virus
NLPWSSAGGT

SEQ ID NO: 145217 - protein, 10 aa, West Nile virus
WRNRETFMEF

SEQ ID NO: 145218 - protein, 10 aa, West Nile virus
RNRGTLMEFE

SEQ ID NO: 145219 - protein, 10 aa, West Nile virus
NRETFMEFEE

SEQ ID NO: 145220 - protein, 10 aa, West Nile virus
RETFMEFEEP

SEQ ID NO: 145221 - protein, 10 aa, West Nile virus
ETFMEFEEPH

SEQ ID NO: 145222 - protein, 10 aa, West Nile virus
QALAGTIPVE

SEQ ID NO: 145223 - protein, 10 aa, West Nile virus
ALAGAIPLEF

SEQ ID NO: 145224 - protein, 10 aa, West Nile virus
LAGAIPLEFS

SEQ ID NO: 145225 - protein, 10 aa, West Nile virus
AGTIPVEFSS

SEQ ID NO: 145226 - protein, 10 aa, West Nile virus
GAIPLEFSSN

SEQ ID NO: 145227 - protein, 10 aa, West Nile virus
AIPVSFTSNT

SEQ ID NO: 145228 - protein, 10 aa, West Nile virus
PVEFSSNTVT

SEQ ID NO: 145229 - protein, 10 aa, West Nile virus
VSFTSNTVKL

SEQ ID NO: 145230 - protein, 10 aa, West Nile virus
KDGPCKVPIS

SEQ ID NO: 145231 - protein, 10 aa, West Nile virus
VTVNPFVSMA

SEQ ID NO: 145232 - protein, 10 aa, West Nile virus
TVNPFVSVAA

SEQ ID NO: 145233 - protein, 10 aa, West Nile virus
VNPFVAAATA

SEQ ID NO: 145234 - protein, 10 aa, West Nile virus
TADAKVLIEL

SEQ ID NO: 145235 - protein, 10 aa, West Nile virus
ANAKVLVELE

SEQ ID NO: 145236 - protein, 10 aa, West Nile virus
DAKVLIELEP

SEQ ID NO: 145237 - protein, 10 aa, West Nile virus
GEQQINHHWY

SEQ ID NO: 145238 - protein, 10 aa, West Nile virus
EHQINHHWHK

SEQ ID NO: 145239 - protein, 10 aa, West Nile virus
QQINHHWYKS

SEQ ID NO: 145240 - protein, 10 aa, West Nile virus
ISHHWHKSGS

SEQ ID NO: 145241 - protein, 10 aa, West Nile virus
NHHWHKSGIS

SEQ ID NO: 145242 - protein, 10 aa, West Nile virus
IGKAFTATLK

SEQ ID NO: 145243 - protein, 10 aa, West Nile virus
GKAFTATLKG

SEQ ID NO: 145244 - protein, 10 aa, West Nile virus
KAFTATLKGA

SEQ ID NO: 145245 - protein, 10 aa, West Nile virus
AFTATLKGAQ

SEQ ID NO: 145246 - protein, 10 aa, West Nile virus
FTATLKGAQR

SEQ ID NO: 145247 - protein, 10 aa, West Nile virus
TATLKGAQRL

SEQ ID NO: 145248 - protein, 10 aa, West Nile virus
ATLKGAQRLA

SEQ ID NO: 145249 - protein, 10 aa, West Nile virus
DFGSVGGVLT

SEQ ID NO: 145250 - protein, 10 aa, West Nile virus
FGSVGGIFTS

SEQ ID NO: 145251 - protein, 10 aa, West Nile virus
GSVGGIFTSF

SEQ ID NO: 145252 - protein, 10 aa, West Nile virus
SVGGVLTSVG

SEQ ID NO: 145253 - protein, 10 aa, West Nile virus
VGGVLTSVGQ

SEQ ID NO: 145254 - protein, 10 aa, West Nile virus
GIFTSFGKAV

SEQ ID NO: 145255 - protein, 10 aa, West Nile virus
VLTSVGQAIH

SEQ ID NO: 145256 - protein, 10 aa, West Nile virus
LTSVGQAIHQ

SEQ ID NO: 145257 - protein, 10 aa, West Nile virus
TSFGKAVHQV

SEQ ID NO: 145258 - protein, 10 aa, West Nile virus
SFGKAVHQVF

SEQ ID NO: 145259 - protein, 10 aa, West Nile virus
FGKAVHQVFG

SEQ ID NO: 145260 - protein, 10 aa, West Nile virus
ALLLWMGVNA

SEQ ID NO: 145261 - protein, 10 aa, West Nile virus
LLLWMGISAR

SEQ ID NO: 145262 - protein, 10 aa, West Nile virus
LLWMGISARD

SEQ ID NO: 145263 - protein, 10 aa, West Nile virus
LWMGVNARDR

SEQ ID NO: 145264 - protein, 10 aa, West Nile virus
WMGISARDRS

SEQ ID NO: 145265 - protein, 10 aa, West Nile virus
MGINARDKSI

SEQ ID NO: 145266 - protein, 10 aa, West Nile virus
GINARDKSIA

SEQ ID NO: 145267 - protein, 10 aa, West Nile virus
SRDRSIALTF

SEQ ID NO: 145268 - protein, 10 aa, West Nile virus
RSIALMFLAV

SEQ ID NO: 145269 - protein, 10 aa, West Nile virus
ALMFLAVGGV

SEQ ID NO: 145270 - protein, 10 aa, West Nile virus
LTFLAVGGIL

SEQ ID NO: 145271 - protein, 10 aa, West Nile virus
VGGILLFLSV

SEQ ID NO: 145272 - protein, 10 aa, West Nile virus
GGVLLFLSVS

SEQ ID NO: 145273 - protein, 10 aa, West Nile virus
GILLFLSANV

SEQ ID NO: 145274 - protein, 10 aa, West Nile virus
VLLFLSINVH

SEQ ID NO: 145275 - protein, 10 aa, West Nile virus
ADTGCAINIT

SEQ ID NO: 145276 - protein, 10 aa, West Nile virus
DTGCAINITR

SEQ ID NO: 145277 - protein, 10 aa, West Nile virus
TGCAIDVGRQ

SEQ ID NO: 145278 - protein, 10 aa, West Nile virus
GCAIDVSRQE

SEQ ID NO: 145279 - protein, 10 aa, West Nile virus
CAIDVGRQEL

SEQ ID NO: 145280 - protein, 10 aa, West Nile virus
AIDVSRQELR

SEQ ID NO: 145281 - protein, 10 aa, West Nile virus
IDVGRQELRC

SEQ ID NO: 145282 - protein, 10 aa, West Nile virus
DVGRQELRCG

SEQ ID NO: 145283 - protein, 10 aa, West Nile virus
TRQELRCGSG

SEQ ID NO: 145284 - protein, 10 aa, West Nile virus
NDVEAWTDRY

SEQ ID NO: 145285 - protein, 10 aa, West Nile virus
DVEAWTDRYK

SEQ ID NO: 145286 - protein, 10 aa, West Nile virus
DRYKFHPETP

SEQ ID NO: 145287 - protein, 10 aa, West Nile virus
RYKFHPETPQ

SEQ ID NO: 145288 - protein, 10 aa, West Nile virus
YKFHPETPQG

SEQ ID NO: 145289 - protein, 10 aa, West Nile virus
KYHPETPQGL

SEQ ID NO: 145290 - protein, 10 aa, West Nile virus
FHPETPQGLA

SEQ ID NO: 145291 - protein, 10 aa, West Nile virus
YPETPQGLAR

SEQ ID NO: 145292 - protein, 10 aa, West Nile virus
LETPQGLAKI

SEQ ID NO: 145293 - protein, 10 aa, West Nile virus
TPQGLARIIQ

SEQ ID NO: 145294 - protein, 10 aa, West Nile virus
PQGLAKVIQK

SEQ ID NO: 145295 - protein, 10 aa, West Nile virus
QGLARVIQKA

SEQ ID NO: 145296 - protein, 10 aa, West Nile virus
GLAKVIQKAH

SEQ ID NO: 145297 - protein, 10 aa, West Nile virus
EGVCGLRSAS

SEQ ID NO: 145298 - protein, 10 aa, West Nile virus
GVCGLRSASR

SEQ ID NO: 145299 - protein, 10 aa, West Nile virus
VCGLRSASRL

SEQ ID NO: 145300 - protein, 10 aa, West Nile virus
RLEHQMWESI

SEQ ID NO: 145301 - protein, 10 aa, West Nile virus
LEHQMWESIK

SEQ ID NO: 145302 - protein, 10 aa, West Nile virus
EHQMWESIKD

SEQ ID NO: 145303 - protein, 10 aa, West Nile virus
HQMWESIKDE

SEQ ID NO: 145304 - protein, 10 aa, West Nile virus
QMWESIKDEL

SEQ ID NO: 145305 - protein, 10 aa, West Nile virus
MWESIKDELN

SEQ ID NO: 145306 - protein, 10 aa, West Nile virus
WESIKDELNT

SEQ ID NO: 145307 - protein, 10 aa, West Nile virus
SIKDELNTLL

SEQ ID NO: 145308 - protein, 10 aa, West Nile virus
TLFRENGIDL

SEQ ID NO: 145309 - protein, 10 aa, West Nile virus
LFRENGIDLS

SEQ ID NO: 145310 - protein, 10 aa, West Nile virus
LKENGVDLTV

SEQ ID NO: 145311 - protein, 10 aa, West Nile virus
KENGVDFSVV

SEQ ID NO: 145312 - protein, 10 aa, West Nile virus
ENGIDLSMVV

SEQ ID NO: 145313 - protein, 10 aa, West Nile virus
NGVDFSVVVE

SEQ ID NO: 145314 - protein, 10 aa, West Nile virus
GVDLTVVVEK

SEQ ID NO: 145315 - protein, 10 aa, West Nile virus
VDFSVVVEKQ

SEQ ID NO: 145316 - protein, 10 aa, West Nile virus
ATTDKLEIGW

SEQ ID NO: 145317 - protein, 10 aa, West Nile virus
TTDKLEIGWK

SEQ ID NO: 145318 - protein, 10 aa, West Nile virus
TDKLEIGWKA

SEQ ID NO: 145319 - protein, 10 aa, West Nile virus
EKFEIGWKAW

SEQ ID NO: 145320 - protein, 10 aa, West Nile virus
GKSILFAPEI

SEQ ID NO: 145321 - protein, 10 aa, West Nile virus
KSIIFAPEIA

SEQ ID NO: 145322 - protein, 10 aa, West Nile virus
SIIFAPEIAN

SEQ ID NO: 145323 - protein, 10 aa, West Nile virus
FAPELANSTF

SEQ ID NO: 145324 - protein, 10 aa, West Nile virus
APELANSTFV

SEQ ID NO: 145325 - protein, 10 aa, West Nile virus
PEIANNTFVV

SEQ ID NO: 145326 - protein, 10 aa, West Nile virus
EIANNTFVVD

SEQ ID NO: 145327 - protein, 10 aa, West Nile virus
IANNTFVVDG

SEQ ID NO: 145328 - protein, 10 aa, West Nile virus
ANNTFVVDGS

SEQ ID NO: 145329 - protein, 10 aa, West Nile virus
NNTFVVDGSE

SEQ ID NO: 145330 - protein, 10 aa, West Nile virus
NTFVVDGSET

SEQ ID NO: 145331 - protein, 10 aa, West Nile virus
TFVVDGSETR

SEQ ID NO: 145332 - protein, 10 aa, West Nile virus
FVVDGSETRE

SEQ ID NO: 145333 - protein, 10 aa, West Nile virus
VVDGSETREC

SEQ ID NO: 145334 - protein, 10 aa, West Nile virus
VDGSETRECP

SEQ ID NO: 145335 - protein, 10 aa, West Nile virus
DGSETRECPT

SEQ ID NO: 145336 - protein, 10 aa, West Nile virus
SRAWNSMEVE

SEQ ID NO: 145337 - protein, 10 aa, West Nile virus
GLTSTRIFLK

SEQ ID NO: 145338 - protein, 10 aa, West Nile virus
IREVNTTECD

SEQ ID NO: 145339 - protein, 10 aa, West Nile virus
CDSKIIGTAI

SEQ ID NO: 145340 - protein, 10 aa, West Nile virus
DSKIIGTAIK

SEQ ID NO: 145341 - protein, 10 aa, West Nile virus
SKIIGTAIKN

SEQ ID NO: 145342 - protein, 10 aa, West Nile virus
DLSYWIESGF

SEQ ID NO: 145343 - protein, 10 aa, West Nile virus
LSYWIESGFN

SEQ ID NO: 145344 - protein, 10 aa, West Nile virus
LNHTWKLERA

SEQ ID NO: 145345 - protein, 10 aa, West Nile virus
ETHTLWGEGV

SEQ ID NO: 145346 - protein, 10 aa, West Nile virus
THTLWGEGVQ

SEQ ID NO: 145347 - protein, 10 aa, West Nile virus
HTLWGEGVQE

SEQ ID NO: 145348 - protein, 10 aa, West Nile virus
TLWGEGVQES

SEQ ID NO: 145349 - protein, 10 aa, West Nile virus
GVIESELIIP

SEQ ID NO: 145350 - protein, 10 aa, West Nile virus
ESELIIPITL

SEQ ID NO: 145351 - protein, 10 aa, West Nile virus
SELIIPVTLA

SEQ ID NO: 145352 - protein, 10 aa, West Nile virus
ELIIPITLAG

SEQ ID NO: 145353 - protein, 10 aa, West Nile virus
IIPATLAGPR

SEQ ID NO: 145354 - protein, 10 aa, West Nile virus
IPVTLAGPKS

SEQ ID NO: 145355 - protein, 10 aa, West Nile virus
PATLAGPRSN

SEQ ID NO: 145356 - protein, 10 aa, West Nile virus
VTLAGPRSNY

SEQ ID NO: 145357 - protein, 10 aa, West Nile virus
CEHRGPAART

SEQ ID NO: 145358 - protein, 10 aa, West Nile virus
EHRGPAARTT

SEQ ID NO: 145359 - protein, 10 aa, West Nile virus
HRGASTRTTT

SEQ ID NO: 145360 - protein, 10 aa, West Nile virus
RGPSARTTTE

SEQ ID NO: 145361 - protein, 10 aa, West Nile virus
GPSARTTTES

SEQ ID NO: 145362 - protein, 10 aa, West Nile virus
ASTRTTTDSG

SEQ ID NO: 145363 - protein, 10 aa, West Nile virus
SARTTTESGK

SEQ ID NO: 145364 - protein, 10 aa, West Nile virus
SCTLPPLRFK

SEQ ID NO: 145365 - protein, 10 aa, West Nile virus
CTLPPLRYTT

SEQ ID NO: 145366 - protein, 10 aa, West Nile virus
TLPPLRFQTR

SEQ ID NO: 145367 - protein, 10 aa, West Nile virus
TDNGCWYGME

SEQ ID NO: 145368 - protein, 10 aa, West Nile virus
DNGCWYGMEI

SEQ ID NO: 145369 - protein, 10 aa, West Nile virus
WYGMEIRPLK

SEQ ID NO: 145370 - protein, 10 aa, West Nile virus
YGMEIRPLKH

SEQ ID NO: 145371 - protein, 10 aa, West Nile virus
GMEIRPLKHD

SEQ ID NO: 145372 - protein, 10 aa, West Nile virus
MEIRPQRHDG

SEQ ID NO: 145373 - protein, 10 aa, West Nile virus
EIRPQRHDGK

SEQ ID NO: 145374 - protein, 10 aa, West Nile virus
IRPQRHDGKT

SEQ ID NO: 145375 - protein, 10 aa, West Nile virus
RPQKHDERTL

SEQ ID NO: 145376 - protein, 10 aa, West Nile virus
PQKHDERTLV

SEQ ID NO: 145377 - protein, 10 aa, West Nile virus
LKHDEKTLVQ

SEQ ID NO: 145378 - protein, 10 aa, West Nile virus
HDERTLVQSQ

SEQ ID NO: 145379 - protein, 10 aa, West Nile virus
DGKTLVQSQV

SEQ ID NO: 145380 - protein, 10 aa, West Nile virus
EKTLVQSRVS

SEQ ID NO: 145381 - protein, 10 aa, West Nile virus
KTLVQSRVSA

SEQ ID NO: 145382 - protein, 10 aa, West Nile virus
TLVQSRVSAY

SEQ ID NO: 145383 - protein, 10 aa, West Nile virus
LVQSRVSAYK

SEQ ID NO: 145384 - protein, 10 aa, West Nile virus
VQSRVSAYKS

SEQ ID NO: 145385 - protein, 10 aa, West Nile virus
QSRVSAYKSD

SEQ ID NO: 145386 - protein, 10 aa, West Nile virus
SRVSAYKSDM

SEQ ID NO: 145387 - protein, 10 aa, West Nile virus
RVSAYKSDMI

SEQ ID NO: 145388 - protein, 10 aa, West Nile virus
VNAHNADMID

SEQ ID NO: 145389 - protein, 10 aa, West Nile virus
NAYNAEMIDP

SEQ ID NO: 145390 - protein, 10 aa, West Nile virus
QLGLLIVFLA

SEQ ID NO: 145391 - protein, 10 aa, West Nile virus
LGLLIVFLAT

SEQ ID NO: 145392 - protein, 10 aa, West Nile virus
GLLVVFLVTQ

SEQ ID NO: 145393 - protein, 10 aa, West Nile virus
LLVVVLATQE

SEQ ID NO: 145394 - protein, 10 aa, West Nile virus
LIVFLATQEV

SEQ ID NO: 145395 - protein, 10 aa, West Nile virus
VVFLVTQEVL

SEQ ID NO: 145396 - protein, 10 aa, West Nile virus
FLATKEVLRK

SEQ ID NO: 145397 - protein, 10 aa, West Nile virus
RKRWTAKISL

SEQ ID NO: 145398 - protein, 10 aa, West Nile virus
KRWTAKISLP

SEQ ID NO: 145399 - protein, 10 aa, West Nile virus
RWTAKISLPA

SEQ ID NO: 145400 - protein, 10 aa, West Nile virus
WTAKISLPAI

SEQ ID NO: 145401 - protein, 10 aa, West Nile virus
PAILVALAVL

SEQ ID NO: 145402 - protein, 10 aa, West Nile virus
AILLALLVLV

SEQ ID NO: 145403 - protein, 10 aa, West Nile virus
IMIALLVLVL

SEQ ID NO: 145404 - protein, 10 aa, West Nile virus
MIALLVLVLG

SEQ ID NO: 145405 - protein, 10 aa, West Nile virus
VALAVLVLGG

SEQ ID NO: 145406 - protein, 10 aa, West Nile virus
ALLVLVLGGI

SEQ ID NO: 145407 - protein, 10 aa, West Nile virus
LLVLVLGGIT

SEQ ID NO: 145408 - protein, 10 aa, West Nile virus
LVLVFGGVTY

SEQ ID NO: 145409 - protein, 10 aa, West Nile virus
VLVFGGITYA

SEQ ID NO: 145410 - protein, 10 aa, West Nile virus
LVFGGITYID

SEQ ID NO: 145411 - protein, 10 aa, West Nile virus
VFGGITYIDV

SEQ ID NO: 145412 - protein, 10 aa, West Nile virus
FGGVTYTDVL

SEQ ID NO: 145413 - protein, 10 aa, West Nile virus
GGVTYTDVLR

SEQ ID NO: 145414 - protein, 10 aa, West Nile virus
GITYADVLRY

SEQ ID NO: 145415 - protein, 10 aa, West Nile virus
VTYTDVLRYV

SEQ ID NO: 145416 - protein, 10 aa, West Nile virus
TYTDVLRYVN

SEQ ID NO: 145417 - protein, 10 aa, West Nile virus
YTDVLRYIIL

SEQ ID NO: 145418 - protein, 10 aa, West Nile virus
DVLRYVILAG

SEQ ID NO: 145419 - protein, 10 aa, West Nile virus
VLRYVNLVGA

SEQ ID NO: 145420 - protein, 10 aa, West Nile virus
LRYVNLVGAA

SEQ ID NO: 145421 - protein, 10 aa, West Nile virus
ILAGAAFAES

SEQ ID NO: 145422 - protein, 10 aa, West Nile virus
LMATFRIQPV

SEQ ID NO: 145423 - protein, 10 aa, West Nile virus
MATFRIQPVF

SEQ ID NO: 145424 - protein, 10 aa, West Nile virus
VQPVFMVASF

SEQ ID NO: 145425 - protein, 10 aa, West Nile virus
QPVFVVASFL

SEQ ID NO: 145426 - protein, 10 aa, West Nile virus
PVFMVATFVK

SEQ ID NO: 145427 - protein, 10 aa, West Nile virus
VFVVASFLKA

SEQ ID NO: 145428 - protein, 10 aa, West Nile virus
VATFVKARWT

SEQ ID NO: 145429 - protein, 10 aa, West Nile virus
ATFVKARWTN

SEQ ID NO: 145430 - protein, 10 aa, West Nile virus
RWTNHENILL

SEQ ID NO: 145431 - protein, 10 aa, West Nile virus
AAAFFQMAYI

SEQ ID NO: 145432 - protein, 10 aa, West Nile virus
AAFFQMAYID

SEQ ID NO: 145433 - protein, 10 aa, West Nile virus
AFFQMAYIDS

SEQ ID NO: 145434 - protein, 10 aa, West Nile virus
FFQMAYIDSQ

SEQ ID NO: 145435 - protein, 10 aa, West Nile virus
WNIPDVLNSL

SEQ ID NO: 145436 - protein, 10 aa, West Nile virus
PDVLNSLAIA

SEQ ID NO: 145437 - protein, 10 aa, West Nile virus
LNSLAAAWMI

SEQ ID NO: 145438 - protein, 10 aa, West Nile virus
NSLAVAWMVL

SEQ ID NO: 145439 - protein, 10 aa, West Nile virus
SLAAAWMILR

SEQ ID NO: 145440 - protein, 10 aa, West Nile virus
LAIAWMILRA

SEQ ID NO: 145441 - protein, 10 aa, West Nile virus
AVAWMVLRAI

SEQ ID NO: 145442 - protein, 10 aa, West Nile virus
VAWMVLRAIS

SEQ ID NO: 145443 - protein, 10 aa, West Nile virus
WMVLRAISFT

SEQ ID NO: 145444 - protein, 10 aa, West Nile virus
FPTTSNVVVP

SEQ ID NO: 145445 - protein, 10 aa, West Nile virus
TSTSNVVVPA

SEQ ID NO: 145446 - protein, 10 aa, West Nile virus
TTSNVVVPLM

SEQ ID NO: 145447 - protein, 10 aa, West Nile virus
VPLLALLTPR

SEQ ID NO: 145448 - protein, 10 aa, West Nile virus
LLALLTPRLR

SEQ ID NO: 145449 - protein, 10 aa, West Nile virus
LAFLTPGLKC

SEQ ID NO: 145450 - protein, 10 aa, West Nile virus
LLTPRLRCLN

SEQ ID NO: 145451 - protein, 10 aa, West Nile virus
GLRCLNLDVS

SEQ ID NO: 145452 - protein, 10 aa, West Nile virus
LRCLNLDVSR

SEQ ID NO: 145453 - protein, 10 aa, West Nile virus
RCLNLDVSRI

SEQ ID NO: 145454 - protein, 10 aa, West Nile virus
CLNLDVSRIL

SEQ ID NO: 145455 - protein, 10 aa, West Nile virus
LNLDVYKILL

SEQ ID NO: 145456 - protein, 10 aa, West Nile virus
NLDVYRIVLL

SEQ ID NO: 145457 - protein, 10 aa, West Nile virus
LDVYRIVLLM

SEQ ID NO: 145458 - protein, 10 aa, West Nile virus
DVYRILLLMI

SEQ ID NO: 145459 - protein, 10 aa, West Nile virus
VSRILLLMVG

SEQ ID NO: 145460 - protein, 10 aa, West Nile virus
YRIVLLMIGI

SEQ ID NO: 145461 - protein, 10 aa, West Nile virus
RILLLMIGIG

SEQ ID NO: 145462 - protein, 10 aa, West Nile virus
LLMIGIGSLI

SEQ ID NO: 145463 - protein, 10 aa, West Nile virus
LMIGIGSLIK

SEQ ID NO: 145464 - protein, 10 aa, West Nile virus
MIGIGSLIKE

SEQ ID NO: 145465 - protein, 10 aa, West Nile virus
GIGSLIKEKR

SEQ ID NO: 145466 - protein, 10 aa, West Nile virus
EKKNSAAKKK

SEQ ID NO: 145467 - protein, 10 aa, West Nile virus
KRNAAAKKKG

SEQ ID NO: 145468 - protein, 10 aa, West Nile virus
RNAAAKKKGA

SEQ ID NO: 145469 - protein, 10 aa, West Nile virus
NAAAKKKGAS

SEQ ID NO: 145470 - protein, 10 aa, West Nile virus
AAKKKGASLI

SEQ ID NO: 145471 - protein, 10 aa, West Nile virus
NPMILAAGLV

SEQ ID NO: 145472 - protein, 10 aa, West Nile virus
LVAGLLACDP

SEQ ID NO: 145473 - protein, 10 aa, West Nile virus
VAGLLACDPN

SEQ ID NO: 145474 - protein, 10 aa, West Nile virus
AGLLACDPNR

SEQ ID NO: 145475 - protein, 10 aa, West Nile virus
GLLACDPNRK

SEQ ID NO: 145476 - protein, 10 aa, West Nile virus
LLACDPNRKR

SEQ ID NO: 145477 - protein, 10 aa, West Nile virus
LACDPNRKRG

SEQ ID NO: 145478 - protein, 10 aa, West Nile virus
AELDIDSMAV

SEQ ID NO: 145479 - protein, 10 aa, West Nile virus
ELDMDSMAIP

SEQ ID NO: 145480 - protein, 10 aa, West Nile virus
LDIDSMAVPM

SEQ ID NO: 145481 - protein, 10 aa, West Nile virus
DMDSMAIPMT

SEQ ID NO: 145482 - protein, 10 aa, West Nile virus
VDSMAIPMTI

SEQ ID NO: 145483 - protein, 10 aa, West Nile virus
ERTADISWEN

SEQ ID NO: 145484 - protein, 10 aa, West Nile virus
RTANISWESD

SEQ ID NO: 145485 - protein, 10 aa, West Nile virus
ADISWESDVE

SEQ ID NO: 145486 - protein, 10 aa, West Nile virus
DISWESDVEI

SEQ ID NO: 145487 - protein, 10 aa, West Nile virus
ISWENDAEIT

SEQ ID NO: 145488 - protein, 10 aa, West Nile virus
SWESDVEITG

SEQ ID NO: 145489 - protein, 10 aa, West Nile virus
WESDVEITGS

SEQ ID NO: 145490 - protein, 10 aa, West Nile virus
ENDAEITGSS

SEQ ID NO: 145491 - protein, 10 aa, West Nile virus
SDVEITGSSE

SEQ ID NO: 145492 - protein, 10 aa, West Nile virus
DDDGDFQLMN

SEQ ID NO: 145493 - protein, 10 aa, West Nile virus
DGENFQLMND

SEQ ID NO: 145494 - protein, 10 aa, West Nile virus
GENFQLMNDP

SEQ ID NO: 145495 - protein, 10 aa, West Nile virus
GDFQLMNDPG

SEQ ID NO: 145496 - protein, 10 aa, West Nile virus
MFCLAISAYT

SEQ ID NO: 145497 - protein, 10 aa, West Nile virus
FCLAISAYTP

SEQ ID NO: 145498 - protein, 10 aa, West Nile virus
WDTPSPKEYR

SEQ ID NO: 145499 - protein, 10 aa, West Nile virus
EYRKGDTATG

SEQ ID NO: 145500 - protein, 10 aa, West Nile virus
YEKGDTTTGV

SEQ ID NO: 145501 - protein, 10 aa, West Nile virus
EKGDTTTGVY

SEQ ID NO: 145502 - protein, 10 aa, West Nile virus
YGGPWKLQCK

SEQ ID NO: 145503 - protein, 10 aa, West Nile virus
GGPWKLQHRW

SEQ ID NO: 145504 - protein, 10 aa, West Nile virus
GPWKLQHRWN

SEQ ID NO: 145505 - protein, 10 aa, West Nile virus
PWKLGHRWNG

SEQ ID NO: 145506 - protein, 10 aa, West Nile virus
WKLQHRWNGQ

SEQ ID NO: 145507 - protein, 10 aa, West Nile virus
KLGHRWNGMD

SEQ ID NO: 145508 - protein, 10 aa, West Nile virus
LGHRWNGMDE

SEQ ID NO: 145509 - protein, 10 aa, West Nile virus
QCKWNGQDEV

SEQ ID NO: 145510 - protein, 10 aa, West Nile virus
HRWNGMDEVQ

SEQ ID NO: 145511 - protein, 10 aa, West Nile virus
RWNGQDEVQM

SEQ ID NO: 145512 - protein, 10 aa, West Nile virus
MDEVQMIVVE

SEQ ID NO: 145513 - protein, 10 aa, West Nile virus
MIVVKPGESV

SEQ ID NO: 145514 - protein, 10 aa, West Nile virus
IVVKPGESVK

SEQ ID NO: 145515 - protein, 10 aa, West Nile virus
VVKPGESVKN

SEQ ID NO: 145516 - protein, 10 aa, West Nile virus
VKPGESVKNV

SEQ ID NO: 145517 - protein, 10 aa, West Nile virus
EPGRKTRNVQ

SEQ ID NO: 145518 - protein, 10 aa, West Nile virus
PGESVKNVQT

SEQ ID NO: 145519 - protein, 10 aa, West Nile virus
GESVKNVQTK

SEQ ID NO: 145520 - protein, 10 aa, West Nile virus
ESVKNVQTKP

SEQ ID NO: 145521 - protein, 10 aa, West Nile virus
SVKNVQTKPG

SEQ ID NO: 145522 - protein, 10 aa, West Nile virus
VQGERMEEPV

SEQ ID NO: 145523 - protein, 10 aa, West Nile virus
QGERMEEPVP

SEQ ID NO: 145524 - protein, 10 aa, West Nile virus
GERMDEPIPV

SEQ ID NO: 145525 - protein, 10 aa, West Nile virus
ERMEEPPPVG

SEQ ID NO: 145526 - protein, 10 aa, West Nile virus
RMDEPIPVGF

SEQ ID NO: 145527 - protein, 10 aa, West Nile virus
GFESEMLRKK

SEQ ID NO: 145528 - protein, 10 aa, West Nile virus
FEPETLKKKQ

SEQ ID NO: 145529 - protein, 10 aa, West Nile virus
EPETLKKKQI

SEQ ID NO: 145530 - protein, 10 aa, West Nile virus
SEMLRKKQIT

SEQ ID NO: 145531 - protein, 10 aa, West Nile virus
EMLRKKKITV

SEQ ID NO: 145532 - protein, 10 aa, West Nile virus
LPQIIKEAIS

SEQ ID NO: 145533 - protein, 10 aa, West Nile virus
PQIIKEAIDR

SEQ ID NO: 145534 - protein, 10 aa, West Nile virus
QIIKEAMNRR

SEQ ID NO: 145535 - protein, 10 aa, West Nile virus
IIKEAMNRRL

SEQ ID NO: 145536 - protein, 10 aa, West Nile virus
IKEAISKRLR

SEQ ID NO: 145537 - protein, 10 aa, West Nile virus
KEAISKRLRT

SEQ ID NO: 145538 - protein, 10 aa, West Nile virus
EAMNRRLRTA

SEQ ID NO: 145539 - protein, 10 aa, West Nile virus
DRRLRTAVLA

SEQ ID NO: 145540 - protein, 10 aa, West Nile virus
VLAPTRVVAS

SEQ ID NO: 145541 - protein, 10 aa, West Nile virus
TRVVAAEMAD

SEQ ID NO: 145542 - protein, 10 aa, West Nile virus
RVVAAEMADA

SEQ ID NO: 145543 - protein, 10 aa, West Nile virus
VVTAEMAEAL

SEQ ID NO: 145544 - protein, 10 aa, West Nile virus
VAAEMADALR

SEQ ID NO: 145545 - protein, 10 aa, West Nile virus
AAEMADALRG

SEQ ID NO: 145546 - protein, 10 aa, West Nile virus
PIRYQTSAVA

SEQ ID NO: 145547 - protein, 10 aa, West Nile virus
IRYQTSAVAR

SEQ ID NO: 145548 - protein, 10 aa, West Nile virus
RYQTSAVARE

SEQ ID NO: 145549 - protein, 10 aa, West Nile virus
YQTSAVAREH

SEQ ID NO: 145550 - protein, 10 aa, West Nile virus
IAARGYIATR

SEQ ID NO: 145551 - protein, 10 aa, West Nile virus
AARGYIATRV

SEQ ID NO: 145552 - protein, 10 aa, West Nile virus
AGGYIATKVE

SEQ ID NO: 145553 - protein, 10 aa, West Nile virus
RGYIATRVEL

SEQ ID NO: 145554 - protein, 10 aa, West Nile virus
YISTRVELGD

SEQ ID NO: 145555 - protein, 10 aa, West Nile virus
IATRVELGEA

SEQ ID NO: 145556 - protein, 10 aa, West Nile virus
STRVELGDAA

SEQ ID NO: 145557 - protein, 10 aa, West Nile virus
SSDPFPESNA

SEQ ID NO: 145558 - protein, 10 aa, West Nile virus
SGYEWITEYV

SEQ ID NO: 145559 - protein, 10 aa, West Nile virus
GYEWITEYAG

SEQ ID NO: 145560 - protein, 10 aa, West Nile virus
YEWITEFVGK

SEQ ID NO: 145561 - protein, 10 aa, West Nile virus
EWITEFVGKT

SEQ ID NO: 145562 - protein, 10 aa, West Nile virus
WITEFVGKTV

SEQ ID NO: 145563 - protein, 10 aa, West Nile virus
ITEYAGKTVW

SEQ ID NO: 145564 - protein, 10 aa, West Nile virus
TEFVGKTVWF

SEQ ID NO: 145565 - protein, 10 aa, West Nile virus
EYAGKTVWFV

SEQ ID NO: 145566 - protein, 10 aa, West Nile virus
YAGKTVWFVP

SEQ ID NO: 145567 - protein, 10 aa, West Nile virus
LCLQRAGKKI

SEQ ID NO: 145568 - protein, 10 aa, West Nile virus
KSVKPTSITE

SEQ ID NO: 145569 - protein, 10 aa, West Nile virus
SVKPIIITEG

SEQ ID NO: 145570 - protein, 10 aa, West Nile virus
VKPTSITEGE

SEQ ID NO: 145571 - protein, 10 aa, West Nile virus
ITDGEGKVVL

SEQ ID NO: 145572 - protein, 10 aa, West Nile virus
TDGEGKVVLS

SEQ ID NO: 145573 - protein, 10 aa, West Nile virus
EGEARVILGE

SEQ ID NO: 145574 - protein, 10 aa, West Nile virus
GEGKVVLSEP

SEQ ID NO: 145575 - protein, 10 aa, West Nile virus
ESRVVLGEPS

SEQ ID NO: 145576 - protein, 10 aa, West Nile virus
ARVILGEPSA

SEQ ID NO: 145577 - protein, 10 aa, West Nile virus
RRGRVGRNPS

SEQ ID NO: 145578 - protein, 10 aa, West Nile virus
RGRVGRNPSQ

SEQ ID NO: 145579 - protein, 10 aa, West Nile virus
GRVGRNPSQV

SEQ ID NO: 145580 - protein, 10 aa, West Nile virus
RIGRNPTQVG

SEQ ID NO: 145581 - protein, 10 aa, West Nile virus
TGRNPSQAGD

SEQ ID NO: 145582 - protein, 10 aa, West Nile virus
GHTNEDDSNL

SEQ ID NO: 145583 - protein, 10 aa, West Nile virus
HTNEDDSNLA

SEQ ID NO: 145584 - protein, 10 aa, West Nile virus
TNEDDSNCAH

SEQ ID NO: 145585 - protein, 10 aa, West Nile virus
NEDDSNLAHW

SEQ ID NO: 145586 - protein, 10 aa, West Nile virus
EDDSNCAHWT

SEQ ID NO: 145587 - protein, 10 aa, West Nile virus
DDSNLAHWTE

SEQ ID NO: 145588 - protein, 10 aa, West Nile virus
DSNCAHWTEA

SEQ ID NO: 145589 - protein, 10 aa, West Nile virus
SNYAHWTEAR

SEQ ID NO: 145590 - protein, 10 aa, West Nile virus
NYAHWTEARI

SEQ ID NO: 145591 - protein, 10 aa, West Nile virus
YAHWTEARIM

SEQ ID NO: 145592 - protein, 10 aa, West Nile virus
KVYTMEGEYR

SEQ ID NO: 145593 - protein, 10 aa, West Nile virus
VHTMDGEYRL

SEQ ID NO: 145594 - protein, 10 aa, West Nile virus
YTMEGEYRLR

SEQ ID NO: 145595 - protein, 10 aa, West Nile virus
PVWLAHKVAA

SEQ ID NO: 145596 - protein, 10 aa, West Nile virus
VWLAYKVASA

SEQ ID NO: 145597 - protein, 10 aa, West Nile virus
WLAYKVASAG

SEQ ID NO: 145598 - protein, 10 aa, West Nile virus
LAYKAAAAGV

SEQ ID NO: 145599 - protein, 10 aa, West Nile virus
KVAAAGVPYH

SEQ ID NO: 145600 - protein, 10 aa, West Nile virus
VASAGISYHD

SEQ ID NO: 145601 - protein, 10 aa, West Nile virus
AAGVPYHDRR

SEQ ID NO: 145602 - protein, 10 aa, West Nile virus
AGISYHDRRW

SEQ ID NO: 145603 - protein, 10 aa, West Nile virus
GISYHDRRWC

SEQ ID NO: 145604 - protein, 10 aa, West Nile virus
ISYHDRRWCF

SEQ ID NO: 145605 - protein, 10 aa, West Nile virus
PWWTDARVYS

SEQ ID NO: 145606 - protein, 10 aa, West Nile virus
RWIDARVYLD

SEQ ID NO: 145607 - protein, 10 aa, West Nile virus
WTDARVYSDH

SEQ ID NO: 145608 - protein, 10 aa, West Nile virus
TDARVYSDHQ

SEQ ID NO: 145609 - protein, 10 aa, West Nile virus
DFASGKRSQV

SEQ ID NO: 145610 - protein, 10 aa, West Nile virus
FAAGKRSQIG

SEQ ID NO: 145611 - protein, 10 aa, West Nile virus
ASGKRSQMGL

SEQ ID NO: 145612 - protein, 10 aa, West Nile virus
GKRSQIGFIE

SEQ ID NO: 145613 - protein, 10 aa, West Nile virus
KRSQIGFIEV

SEQ ID NO: 145614 - protein, 10 aa, West Nile virus
RSQIGFIEVL

SEQ ID NO: 145615 - protein, 10 aa, West Nile virus
SQIGFIEVLG

SEQ ID NO: 145616 - protein, 10 aa, West Nile virus
QIGFIEVLGK

SEQ ID NO: 145617 - protein, 10 aa, West Nile virus
IGFIEVLGKM

SEQ ID NO: 145618 - protein, 10 aa, West Nile virus
GFIEVLGKMP

SEQ ID NO: 145619 - protein, 10 aa, West Nile virus
FIEVLGKMPE

SEQ ID NO: 145620 - protein, 10 aa, West Nile virus
LGRMPEHFMV

SEQ ID NO: 145621 - protein, 10 aa, West Nile virus
GRMPEHFMVK

SEQ ID NO: 145622 - protein, 10 aa, West Nile virus
RMPEHFMVKT

SEQ ID NO: 145623 - protein, 10 aa, West Nile virus
TAEKGRRAHR

SEQ ID NO: 145624 - protein, 10 aa, West Nile virus
AERGGRAHRS

SEQ ID NO: 145625 - protein, 10 aa, West Nile virus
EKGGRAHSMA

SEQ ID NO: 145626 - protein, 10 aa, West Nile virus
KGRRAHRMAL

SEQ ID NO: 145627 - protein, 10 aa, West Nile virus
GRRAHRMALE

SEQ ID NO: 145628 - protein, 10 aa, West Nile virus
GRAHSMALEE

SEQ ID NO: 145629 - protein, 10 aa, West Nile virus
DALQTVALIA

SEQ ID NO: 145630 - protein, 10 aa, West Nile virus
ALQTIILITL

SEQ ID NO: 145631 - protein, 10 aa, West Nile virus
LQTVALIALL

SEQ ID NO: 145632 - protein, 10 aa, West Nile virus
QTIILITLLS

SEQ ID NO: 145633 - protein, 10 aa, West Nile virus
TVALIALLGV

SEQ ID NO: 145634 - protein, 10 aa, West Nile virus
VALIALLGVM

SEQ ID NO: 145635 - protein, 10 aa, West Nile virus
LLSVMTMGIF

SEQ ID NO: 145636 - protein, 10 aa, West Nile virus
VMTMGIFFLL

SEQ ID NO: 145637 - protein, 10 aa, West Nile virus
MTMGVFLLLM

SEQ ID NO: 145638 - protein, 10 aa, West Nile virus
TMGVFLLLMQ

SEQ ID NO: 145639 - protein, 10 aa, West Nile virus
MGIFFLLMQR

SEQ ID NO: 145640 - protein, 10 aa, West Nile virus
GIGKIGLGGI

SEQ ID NO: 145641 - protein, 10 aa, West Nile virus
LGVATLFCWM

SEQ ID NO: 145642 - protein, 10 aa, West Nile virus
GVATLFCWMA

SEQ ID NO: 145643 - protein, 10 aa, West Nile virus
AATFFCWMAD

SEQ ID NO: 145644 - protein, 10 aa, West Nile virus
TFFCWMADVP

SEQ ID NO: 145645 - protein, 10 aa, West Nile virus
FFCWMADVPG

SEQ ID NO: 145646 - protein, 10 aa, West Nile virus
AVFMICVMTL

SEQ ID NO: 145647 - protein, 10 aa, West Nile virus
VFMICVMTLV

SEQ ID NO: 145648 - protein, 10 aa, West Nile virus
TPVSAVAANE

SEQ ID NO: 145649 - protein, 10 aa, West Nile virus
FISAVAANEM

SEQ ID NO: 145650 - protein, 10 aa, West Nile virus
GWLDKTKNDM

SEQ ID NO: 145651 - protein, 10 aa, West Nile virus
ADLLLDLKPA

SEQ ID NO: 145652 - protein, 10 aa, West Nile virus
NFLLDLRPAT

SEQ ID NO: 145653 - protein, 10 aa, West Nile virus
WSLYAVATAV

SEQ ID NO: 145654 - protein, 10 aa, West Nile virus
SLYAVTTAFL

SEQ ID NO: 145655 - protein, 10 aa, West Nile virus
LYAISTAFMT

SEQ ID NO: 145656 - protein, 10 aa, West Nile virus
YAVTTAFLTP

SEQ ID NO: 145657 - protein, 10 aa, West Nile virus
AVTTAFLTPL

SEQ ID NO: 145658 - protein, 10 aa, West Nile virus
VTTAVLTPLI

SEQ ID NO: 145659 - protein, 10 aa, West Nile virus
STAFMTPLLK

SEQ ID NO: 145660 - protein, 10 aa, West Nile virus
TAFLTPLLKH

SEQ ID NO: 145661 - protein, 10 aa, West Nile virus
AVLTPLLKHV

SEQ ID NO: 145662 - protein, 10 aa, West Nile virus
VLTPLLKHVI

SEQ ID NO: 145663 - protein, 10 aa, West Nile virus
LTPLIKHLIT

SEQ ID NO: 145664 - protein, 10 aa, West Nile virus
VQASTLFTLA

SEQ ID NO: 145665 - protein, 10 aa, West Nile virus
QASTLFTLAR

SEQ ID NO: 145666 - protein, 10 aa, West Nile virus
ASTLFTLARG

SEQ ID NO: 145667 - protein, 10 aa, West Nile virus
STLFTLARGF

SEQ ID NO: 145668 - protein, 10 aa, West Nile virus
TLFTLARGFP

SEQ ID NO: 145669 - protein, 10 aa, West Nile virus
ILLFCHYAYM

SEQ ID NO: 145670 - protein, 10 aa, West Nile virus
RTTPIMQKKI

SEQ ID NO: 145671 - protein, 10 aa, West Nile virus
ATPMMQKKVG

SEQ ID NO: 145672 - protein, 10 aa, West Nile virus
PMMQKKVGQV

SEQ ID NO: 145673 - protein, 10 aa, West Nile virus
VMQKKVGQII

SEQ ID NO: 145674 - protein, 10 aa, West Nile virus
KKVGQIMLIW

SEQ ID NO: 145675 - protein, 10 aa, West Nile virus
KVGQIMLIWV

SEQ ID NO: 145676 - protein, 10 aa, West Nile virus
IGQIMLILVS

SEQ ID NO: 145677 - protein, 10 aa, West Nile virus
LILVSLAALV

SEQ ID NO: 145678 - protein, 10 aa, West Nile virus
ILVSLAALVV

SEQ ID NO: 145679 - protein, 10 aa, West Nile virus
LVSLAALVVN

SEQ ID NO: 145680 - protein, 10 aa, West Nile virus
VSLAALVVNP

SEQ ID NO: 145681 - protein, 10 aa, West Nile virus
SLAALVVNPS

SEQ ID NO: 145682 - protein, 10 aa, West Nile virus
LAALVVNPSV

SEQ ID NO: 145683 - protein, 10 aa, West Nile virus
TVREAGILTS

SEQ ID NO: 145684 - protein, 10 aa, West Nile virus
VREAGILTSA

SEQ ID NO: 145685 - protein, 10 aa, West Nile virus
REAGILITSA

SEQ ID NO: 145686 - protein, 10 aa, West Nile virus
EAGILTSAAA

SEQ ID NO: 145687 - protein, 10 aa, West Nile virus
AGILTSAAAV

SEQ ID NO: 145688 - protein, 10 aa, West Nile virus
GILTSAAAVT

SEQ ID NO: 145689 - protein, 10 aa, West Nile virus
ILITSASVTL

SEQ ID NO: 145690 - protein, 10 aa, West Nile virus
LITSASVTLW

SEQ ID NO: 145691 - protein, 10 aa, West Nile virus
ITSASVTLWE

SEQ ID NO: 145692 - protein, 10 aa, West Nile virus
GGWLSCLSIA

SEQ ID NO: 145693 - protein, 10 aa, West Nile virus
GWLSCLSIAW

SEQ ID NO: 145694 - protein, 10 aa, West Nile virus
WLSCLSIAWT

SEQ ID NO: 145695 - protein, 10 aa, West Nile virus
LSCLSIAWTL

SEQ ID NO: 145696 - protein, 10 aa, West Nile virus
KNMEKPGIKR

SEQ ID NO: 145697 - protein, 10 aa, West Nile virus
SMEKPVLKRG

SEQ ID NO: 145698 - protein, 10 aa, West Nile virus
MEKPVLKRGG

SEQ ID NO: 145699 - protein, 10 aa, West Nile virus
EKPVLKRGGA

SEQ ID NO: 145700 - protein, 10 aa, West Nile virus
GEVWKEKLNQ

SEQ ID NO: 145701 - protein, 10 aa, West Nile virus
EVWKERLNYM

SEQ ID NO: 145702 - protein, 10 aa, West Nile virus
VWKERLNYMT

SEQ ID NO: 145703 - protein, 10 aa, West Nile virus
MTKEEFARYR

SEQ ID NO: 145704 - protein, 10 aa, West Nile virus
TREEFTRYRK

SEQ ID NO: 145705 - protein, 10 aa, West Nile virus
KEEFTRYRRE

SEQ ID NO: 145706 - protein, 10 aa, West Nile virus
EEFTRYRREA

SEQ ID NO: 145707 - protein, 10 aa, West Nile virus
EFARYRKEAI

SEQ ID NO: 145708 - protein, 10 aa, West Nile virus
FARYRKEAIT

SEQ ID NO: 145709 - protein, 10 aa, West Nile virus
SRYRKEAIIE

SEQ ID NO: 145710 - protein, 10 aa, West Nile virus
IIEVDRSAAQ

SEQ ID NO: 145711 - protein, 10 aa, West Nile virus
ARREGNVTGG

SEQ ID NO: 145712 - protein, 10 aa, West Nile virus
RKEGNITGGH

SEQ ID NO: 145713 - protein, 10 aa, West Nile virus
EGNVTGGHSV

SEQ ID NO: 145714 - protein, 10 aa, West Nile virus
GNVTGGHSVS

SEQ ID NO: 145715 - protein, 10 aa, West Nile virus
RFLEPIGKVI

SEQ ID NO: 145716 - protein, 10 aa, West Nile virus
FLEPIGKVID

SEQ ID NO: 145717 - protein, 10 aa, West Nile virus
LEPIGKVIDL

SEQ ID NO: 145718 - protein, 10 aa, West Nile virus
EPVGRVIDLG

SEQ ID NO: 145719 - protein, 10 aa, West Nile virus
PVGRVIDLGC

SEQ ID NO: 145720 - protein, 10 aa, West Nile virus
IGKVIDLGCG

SEQ ID NO: 145721 - protein, 10 aa, West Nile virus
VDVFYRPSEV

SEQ ID NO: 145722 - protein, 10 aa, West Nile virus
DVFYRPSESC

SEQ ID NO: 145723 - protein, 10 aa, West Nile virus
VFYRPSEVSD

SEQ ID NO: 145724 - protein, 10 aa, West Nile virus
FYRTSEASDT

SEQ ID NO: 145725 - protein, 10 aa, West Nile virus
YRPSESCDTL

SEQ ID NO: 145726 - protein, 10 aa, West Nile virus
RTSEASDTLL

SEQ ID NO: 145727 - protein, 10 aa, West Nile virus
PSEVSDTLLC

SEQ ID NO: 145728 - protein, 10 aa, West Nile virus
EHRTIRVLEI

SEQ ID NO: 145729 - protein, 10 aa, West Nile virus
HRTMRVLEMV

SEQ ID NO: 145730 - protein, 10 aa, West Nile virus
RTMRVLEMVE

SEQ ID NO: 145731 - protein, 10 aa, West Nile virus
TIRVLEIVED

SEQ ID NO: 145732 - protein, 10 aa, West Nile virus
IRVLEIVEDW

SEQ ID NO: 145733 - protein, 10 aa, West Nile virus
MPKVIEKMEI

SEQ ID NO: 145734 - protein, 10 aa, West Nile virus
PKVIEKMEIL

SEQ ID NO: 145735 - protein, 10 aa, West Nile virus
KVIEKMEILQ

SEQ ID NO: 145736 - protein, 10 aa, West Nile virus
VIEKMEILQR

SEQ ID NO: 145737 - protein, 10 aa, West Nile virus
IEKMEILQRR

SEQ ID NO: 145738 - protein, 10 aa, West Nile virus
EKMEILQRRY

SEQ ID NO: 145739 - protein, 10 aa, West Nile virus
KMEILQRRYG

SEQ ID NO: 145740 - protein, 10 aa, West Nile virus
MEILQRRYGG

SEQ ID NO: 145741 - protein, 10 aa, West Nile virus
EILQRRYGGG

SEQ ID NO: 145742 - protein, 10 aa, West Nile virus
ILQRRYGGGL

SEQ ID NO: 145743 - protein, 10 aa, West Nile virus
EMYWVSRASR

SEQ ID NO: 145744 - protein, 10 aa, West Nile virus
MYWVSRASSN

SEQ ID NO: 145745 - protein, 10 aa, West Nile virus
YWVSRASRNV

SEQ ID NO: 145746 - protein, 10 aa, West Nile virus
WVSRASSNVV

SEQ ID NO: 145747 - protein, 10 aa, West Nile virus
VSRASRNVVH

SEQ ID NO: 145748 - protein, 10 aa, West Nile virus
NIVHAVNMTS

SEQ ID NO: 145749 - protein, 10 aa, West Nile virus
IVHAVNMTSQ

SEQ ID NO: 145750 - protein, 10 aa, West Nile virus
EKKTWKGAHY

SEQ ID NO: 145751 - protein, 10 aa, West Nile virus
KKTWKGAHYE

SEQ ID NO: 145752 - protein, 10 aa, West Nile virus
KTWKGAHYEE

SEQ ID NO: 145753 - protein, 10 aa, West Nile virus
WKGAHYEEDV

SEQ ID NO: 145754 - protein, 10 aa, West Nile virus
KGAHYEEDVN

SEQ ID NO: 145755 - protein, 10 aa, West Nile virus
GAHYEEDVNL

SEQ ID NO: 145756 - protein, 10 aa, West Nile virus
AHYEEDVNLG

SEQ ID NO: 145757 - protein, 10 aa, West Nile virus
QYEEDANLGS

SEQ ID NO: 145758 - protein, 10 aa, West Nile virus
GKPLLNSDTR

SEQ ID NO: 145759 - protein, 10 aa, West Nile virus
KPLLSSDTSK

SEQ ID NO: 145760 - protein, 10 aa, West Nile virus
PLLNSDTSRI

SEQ ID NO: 145761 - protein, 10 aa, West Nile virus
LLSSDTSKIK

SEQ ID NO: 145762 - protein, 10 aa, West Nile virus
NRIEKLKKEY

SEQ ID NO: 145763 - protein, 10 aa, West Nile virus
RIERLKKEYN

SEQ ID NO: 145764 - protein, 10 aa, West Nile virus
DGNHPYRTWN

SEQ ID NO: 145765 - protein, 10 aa, West Nile virus
GNHPYRTWNY

SEQ ID NO: 145766 - protein, 10 aa, West Nile virus
WNYHGSYEVN

SEQ ID NO: 145767 - protein, 10 aa, West Nile virus
NYHGSYEVNP

SEQ ID NO: 145768 - protein, 10 aa, West Nile virus
YHGSYEVNPL

SEQ ID NO: 145769 - protein, 10 aa, West Nile virus
HGSYEVNPLV

SEQ ID NO: 145770 - protein, 10 aa, West Nile virus
GSYDVNPTGS

SEQ ID NO: 145771 - protein, 10 aa, West Nile virus
SYDVNPTGSA

SEQ ID NO: 145772 - protein, 10 aa, West Nile virus
YEVNPLVSAS

SEQ ID NO: 145773 - protein, 10 aa, West Nile virus
DVNPTGSASS

SEQ ID NO: 145774 - protein, 10 aa, West Nile virus
KAPEPPEGVR

SEQ ID NO: 145775 - protein, 10 aa, West Nile virus
KETTNWLWAF

SEQ ID NO: 145776 - protein, 10 aa, West Nile virus
TTNWLWAFLS

SEQ ID NO: 145777 - protein, 10 aa, West Nile virus
TNWLWAFLSR

SEQ ID NO: 145778 - protein, 10 aa, West Nile virus
RGKRPRMCSR

SEQ ID NO: 145779 - protein, 10 aa, West Nile virus
GKRPRMCSRE

SEQ ID NO: 145780 - protein, 10 aa, West Nile virus
RMCTREEFIS

SEQ ID NO: 145781 - protein, 10 aa, West Nile virus
MCTREEFISK

SEQ ID NO: 145782 - protein, 10 aa, West Nile virus
CTREEFISKV

SEQ ID NO: 145783 - protein, 10 aa, West Nile virus
TREEFISKVN

SEQ ID NO: 145784 - protein, 10 aa, West Nile virus
REEFIKKVNS

SEQ ID NO: 145785 - protein, 10 aa, West Nile virus
EEFIKKVNSN

SEQ ID NO: 145786 - protein, 10 aa, West Nile virus
EFISKVNSNA

SEQ ID NO: 145787 - protein, 10 aa, West Nile virus
FIKKVNSNAA

SEQ ID NO: 145788 - protein, 10 aa, West Nile virus
ISKVNSNAAL

SEQ ID NO: 145789 - protein, 10 aa, West Nile virus
KKVNSNAALG

SEQ ID NO: 145790 - protein, 10 aa, West Nile virus
MFEEQNQWSN

SEQ ID NO: 145791 - protein, 10 aa, West Nile virus
FEEQNQWSNA

SEQ ID NO: 145792 - protein, 10 aa, West Nile virus
EEQNQWSNAR

SEQ ID NO: 145793 - protein, 10 aa, West Nile virus
EQNQWSNARE

SEQ ID NO: 145794 - protein, 10 aa, West Nile virus
QNQWSNAREA

SEQ ID NO: 145795 - protein, 10 aa, West Nile virus
NQWSNAREAV

SEQ ID NO: 145796 - protein, 10 aa, West Nile virus
QWSNAREAVE

SEQ ID NO: 145797 - protein, 10 aa, West Nile virus
WSNAREAVED

SEQ ID NO: 145798 - protein, 10 aa, West Nile virus
SAREAVEDLK

SEQ ID NO: 145799 - protein, 10 aa, West Nile virus
AREAVEDQKF

SEQ ID NO: 145800 - protein, 10 aa, West Nile virus
REAVEDSTFW

SEQ ID NO: 145801 - protein, 10 aa, West Nile virus
EAVEDSTFWE

SEQ ID NO: 145802 - protein, 10 aa, West Nile virus
AVEDSTFWEM

SEQ ID NO: 145803 - protein, 10 aa, West Nile virus
VEDQKFWEMV

SEQ ID NO: 145804 - protein, 10 aa, West Nile virus
EDQKFWEMVD

SEQ ID NO: 145805 - protein, 10 aa, West Nile virus
DPKFWEIVDE

SEQ ID NO: 145806 - protein, 10 aa, West Nile virus
LKFWEMVDEE

SEQ ID NO: 145807 - protein, 10 aa, West Nile virus
GGRIYADDTA

SEQ ID NO: 145808 - protein, 10 aa, West Nile virus
GRIYADDTAG

SEQ ID NO: 145809 - protein, 10 aa, West Nile virus
RIYADDTAGW

SEQ ID NO: 145810 - protein, 10 aa, West Nile virus
IFADDTAGWD

SEQ ID NO: 145811 - protein, 10 aa, West Nile virus
ARAIIELTYC

SEQ ID NO: 145812 - protein, 10 aa, West Nile virus
RAIIELTYCH

SEQ ID NO: 145813 - protein, 10 aa, West Nile virus
SIIQLTYRHK

SEQ ID NO: 145814 - protein, 10 aa, West Nile virus
IIELTYRYKV

SEQ ID NO: 145815 - protein, 10 aa, West Nile virus
PAADRKTVMD

SEQ ID NO: 145816 - protein, 10 aa, West Nile virus
AADGKTVMSL

SEQ ID NO: 145817 - protein, 10 aa, West Nile virus
ADRKTVMDVI

SEQ ID NO: 145818 - protein, 10 aa, West Nile virus
DRKTVMDVIS

SEQ ID NO: 145819 - protein, 10 aa, West Nile virus
RKTVMDVISR

SEQ ID NO: 145820 - protein, 10 aa, West Nile virus
MEGEGVITPD

SEQ ID NO: 145821 - protein, 10 aa, West Nile virus
EGEGVIGPYD

SEQ ID NO: 145822 - protein, 10 aa, West Nile virus
GEGVIGPDDI

SEQ ID NO: 145823 - protein, 10 aa, West Nile virus
EGVIGPEDVE

SEQ ID NO: 145824 - protein, 10 aa, West Nile virus
RGKGPKVRTW

SEQ ID NO: 145825 - protein, 10 aa, West Nile virus
FAISLHFLNA

SEQ ID NO: 145826 - protein, 10 aa, West Nile virus
ASSLHFLNAM

SEQ ID NO: 145827 - protein, 10 aa, West Nile virus
TSLHFLNAMP

SEQ ID NO: 145828 - protein, 10 aa, West Nile virus
SLHFLNAMPK

SEQ ID NO: 145829 - protein, 10 aa, West Nile virus
NAICSAVPVD

SEQ ID NO: 145830 - protein, 10 aa, West Nile virus
AICSAVPVDW

SEQ ID NO: 145831 - protein, 10 aa, West Nile virus
ICSAVPVDWV

SEQ ID NO: 145832 - protein, 10 aa, West Nile virus
CSAVPVDWVP

SEQ ID NO: 145833 - protein, 10 aa, West Nile virus
SAVPVDWVPT

SEQ ID NO: 145834 - protein, 10 aa, West Nile virus
AVPVDWVPTG

SEQ ID NO: 145835 - protein, 10 aa, West Nile virus
VPVDWVPTGR

SEQ ID NO: 145836 - protein, 10 aa, West Nile virus
PVDWVPTGRT

SEQ ID NO: 145837 - protein, 10 aa, West Nile virus
VDWVPTGRTT

SEQ ID NO: 145838 - protein, 10 aa, West Nile virus
GRTTWSIHVG

SEQ ID NO: 145839 - protein, 10 aa, West Nile virus
RTTWSIHVGG

SEQ ID NO: 145840 - protein, 10 aa, West Nile virus
TTWSIHVGGE

SEQ ID NO: 145841 - protein, 10 aa, West Nile virus
TWSIHVGGEW

SEQ ID NO: 145842 - protein, 10 aa, West Nile virus
WSIHVGGEWM

SEQ ID NO: 145843 - protein, 10 aa, West Nile virus
SIHVGGEWMT

SEQ ID NO: 145844 - protein, 10 aa, West Nile virus
IHVGGEWMTT

SEQ ID NO: 145845 - protein, 10 aa, West Nile virus
HARGEWMTTE

SEQ ID NO: 145846 - protein, 10 aa, West Nile virus
RGEWMTTEDM

SEQ ID NO: 145847 - protein, 10 aa, West Nile virus
EWMTTEDMLS

SEQ ID NO: 145848 - protein, 10 aa, West Nile virus
WMTTEDMLSV

SEQ ID NO: 145849 - protein, 10 aa, West Nile virus
MTTEDMLSVW

SEQ ID NO: 145850 - protein, 10 aa, West Nile virus
TTEDMLSVWN

SEQ ID NO: 145851 - protein, 10 aa, West Nile virus
TEDMLSVWNR

SEQ ID NO: 145852 - protein, 10 aa, West Nile virus
EDMLSVWNRV

SEQ ID NO: 145853 - protein, 10 aa, West Nile virus
DMLSVWNRVW

SEQ ID NO: 145854 - protein, 10 aa, West Nile virus
MLSVWNRVWI

SEQ ID NO: 145855 - protein, 10 aa, West Nile virus
LSVWNRVWIE

SEQ ID NO: 145856 - protein, 10 aa, West Nile virus
SVWNRVWIEE

SEQ ID NO: 145857 - protein, 10 aa, West Nile virus
SRATWAENIQ

SEQ ID NO: 145858 - protein, 10 aa, West Nile virus
IQVAINQVKA

SEQ ID NO: 145859 - protein, 10 aa, West Nile virus
YMSSLRRYEE

SEQ ID NO: 145860 - protein, 10 aa, West Nile virus
RAVNMLKRGK

SEQ ID NO: 145861 - protein, 10 aa, West Nile virus
AVNMLKRGKP

SEQ ID NO: 145862 - protein, 10 aa, West Nile virus
VNMLKRGTPR

SEQ ID NO: 145863 - protein, 10 aa, West Nile virus
KRGMPRVMSL

SEQ ID NO: 145864 - protein, 10 aa, West Nile virus
ALLDRWRGVN

SEQ ID NO: 145865 - protein, 10 aa, West Nile virus
VLERWRGVNK

SEQ ID NO: 145866 - protein, 10 aa, West Nile virus
FKKELGTLTN

SEQ ID NO: 145867 - protein, 10 aa, West Nile virus
KKELGILTNA

SEQ ID NO: 145868 - protein, 10 aa, West Nile virus
KELGALTSAI

SEQ ID NO: 145869 - protein, 10 aa, West Nile virus
NRRSSKEKKR

SEQ ID NO: 145870 - protein, 10 aa, West Nile virus
RRSSKEKKRG

SEQ ID NO: 145871 - protein, 10 aa, West Nile virus
RSEKKKKRGG

SEQ ID NO: 145872 - protein, 10 aa, West Nile virus
KQKKRGGVVG

SEQ ID NO: 145873 - protein, 10 aa, West Nile virus
GSVTLSNFQG

SEQ ID NO: 145874 - protein, 10 aa, West Nile virus
NFQGKVMMTI

SEQ ID NO: 145875 - protein, 10 aa, West Nile virus
KLMMTVNATD

SEQ ID NO: 145876 - protein, 10 aa, West Nile virus
IITIPPAAGK

SEQ ID NO: 145877 - protein, 10 aa, West Nile virus
IASGKNLCTV

SEQ ID NO: 145878 - protein, 10 aa, West Nile virus
CTVRAIDVGF

SEQ ID NO: 145879 - protein, 10 aa, West Nile virus
VRAIDVGFLC

SEQ ID NO: 145880 - protein, 10 aa, West Nile virus
VGFLCDDTIT

SEQ ID NO: 145881 - protein, 10 aa, West Nile virus
GFLCDDTITY

SEQ ID NO: 145882 - protein, 10 aa, West Nile virus
FMCDDTITYE

SEQ ID NO: 145883 - protein, 10 aa, West Nile virus
DIDCWCTKSP

SEQ ID NO: 145884 - protein, 10 aa, West Nile virus
VQAHGESTLA

SEQ ID NO: 145885 - protein, 10 aa, West Nile virus
QAHGESTLAN

SEQ ID NO: 145886 - protein, 10 aa, West Nile virus
THGESTLVNK

SEQ ID NO: 145887 - protein, 10 aa, West Nile virus
LANKKGAWMB

SEQ ID NO: 145888 - protein, 10 aa, West Nile virus
ANKKGAWMBS

SEQ ID NO: 145889 - protein, 10 aa, West Nile virus
MQRVVFIVLL

SEQ ID NO: 145890 - protein, 10 aa, West Nile virus
QRVVFIVLLL

SEQ ID NO: 145891 - protein, 10 aa, West Nile virus
RVVFIVLLLL

SEQ ID NO: 145892 - protein, 10 aa, West Nile virus
VVFIVLLLLV

SEQ ID NO: 145893 - protein, 10 aa, West Nile virus
VFIVLLLLVA

SEQ ID NO: 145894 - protein, 10 aa, West Nile virus
FIVLLLLVAP

SEQ ID NO: 145895 - protein, 10 aa, West Nile virus
IVLLLLVAPA

SEQ ID NO: 145896 - protein, 10 aa, West Nile virus
VNDLSPRAAC

SEQ ID NO: 145897 - protein, 10 aa, West Nile virus
NDLSPRAACP

SEQ ID NO: 145898 - protein, 10 aa, West Nile virus
TKAACPTMGD

SEQ ID NO: 145899 - protein, 10 aa, West Nile virus
DAHNDKRADP

SEQ ID NO: 145900 - protein, 10 aa, West Nile virus
ARFACSTKAT

SEQ ID NO: 145901 - protein, 10 aa, West Nile virus
RFACSTKATG

SEQ ID NO: 145902 - protein, 10 aa, West Nile virus
GATQAGRFSV

SEQ ID NO: 145903 - protein, 10 aa, West Nile virus
ATQAGRFTVS

SEQ ID NO: 145904 - protein, 10 aa, West Nile virus
TQAGRFSVTP

SEQ ID NO: 145905 - protein, 10 aa, West Nile virus
QAGRFSVTPA

SEQ ID NO: 145906 - protein, 10 aa, West Nile virus
AGRFSVTPAA

SEQ ID NO: 145907 - protein, 10 aa, West Nile virus
GRFTVSPSAP

SEQ ID NO: 145908 - protein, 10 aa, West Nile virus
RFSVTPAAPS

SEQ ID NO: 145909 - protein, 10 aa, West Nile virus
TVSPSAPTYT

SEQ ID NO: 145910 - protein, 10 aa, West Nile virus
KLGGYGEVTV

SEQ ID NO: 145911 - protein, 10 aa, West Nile virus
IDTGAYYVMS

SEQ ID NO: 145912 - protein, 10 aa, West Nile virus
DTNAYYVMSV

SEQ ID NO: 145913 - protein, 10 aa, West Nile virus
TGAYYVMSVG

SEQ ID NO: 145914 - protein, 10 aa, West Nile virus
NLPWSSAGGN

SEQ ID NO: 145915 - protein, 10 aa, West Nile virus
TVNPFVAAAT

SEQ ID NO: 145916 - protein, 10 aa, West Nile virus
VNPFVSVAAA

SEQ ID NO: 145917 - protein, 10 aa, West Nile virus
AANAKVLIEL

SEQ ID NO: 145918 - protein, 10 aa, West Nile virus
ARDRSIALMF

SEQ ID NO: 145919 - protein, 10 aa, West Nile virus
ALTFLAVGGI

SEQ ID NO: 145920 - protein, 10 aa, West Nile virus
MTFLAVGGIL

SEQ ID NO: 145921 - protein, 10 aa, West Nile virus
ADTGCAIDVG

SEQ ID NO: 145922 - protein, 10 aa, West Nile virus
DTGCAIDVGR

SEQ ID NO: 145923 - protein, 10 aa, West Nile virus
TGCAIDVSRQ

SEQ ID NO: 145924 - protein, 10 aa, West Nile virus
GCAIDVGRQE

SEQ ID NO: 145925 - protein, 10 aa, West Nile virus
CAINITRQEL

SEQ ID NO: 145926 - protein, 10 aa, West Nile virus
AIDVGRQELR

SEQ ID NO: 145927 - protein, 10 aa, West Nile virus
INITRQELRC

SEQ ID NO: 145928 - protein, 10 aa, West Nile virus
DVSRQELRCG

SEQ ID NO: 145929 - protein, 10 aa, West Nile virus
NDVKAWMDRY

SEQ ID NO: 145930 - protein, 10 aa, West Nile virus
DVKAWMDRYK

SEQ ID NO: 145931 - protein, 10 aa, West Nile virus
DRYKYHPETP

SEQ ID NO: 145932 - protein, 10 aa, West Nile virus
RYKYHPETPQ

SEQ ID NO: 145933 - protein, 10 aa, West Nile virus
YKYHPETPQG

SEQ ID NO: 145934 - protein, 10 aa, West Nile virus
KFHPETPQGL

SEQ ID NO: 145935 - protein, 10 aa, West Nile virus
RLEHQMWDSV

SEQ ID NO: 145936 - protein, 10 aa, West Nile virus
LEHQMWDSVK

SEQ ID NO: 145937 - protein, 10 aa, West Nile virus
EHQMWDSVKD

SEQ ID NO: 145938 - protein, 10 aa, West Nile virus
HQMWDSVKDE

SEQ ID NO: 145939 - protein, 10 aa, West Nile virus
QMWDSVKDEL

SEQ ID NO: 145940 - protein, 10 aa, West Nile virus
MWDSVKDELN

SEQ ID NO: 145941 - protein, 10 aa, West Nile virus
WDSVKDELNT

SEQ ID NO: 145942 - protein, 10 aa, West Nile virus
SVKDELNTLF

SEQ ID NO: 145943 - protein, 10 aa, West Nile virus
LLKENGVDFS

SEQ ID NO: 145944 - protein, 10 aa, West Nile virus
FRENGIDLSM

SEQ ID NO: 145945 - protein, 10 aa, West Nile virus
KENGVDLTVV

SEQ ID NO: 145946 - protein, 10 aa, West Nile virus
ENGVDFSVVV

SEQ ID NO: 145947 - protein, 10 aa, West Nile virus
NGIDLSMVVE

SEQ ID NO: 145948 - protein, 10 aa, West Nile virus
GIDLSMVVEK

SEQ ID NO: 145949 - protein, 10 aa, West Nile virus
IDLSMVVEKQ

SEQ ID NO: 145950 - protein, 10 aa, West Nile virus
ATTEKFEIGW

SEQ ID NO: 145951 - protein, 10 aa, West Nile virus
TSEKLEIGWK

SEQ ID NO: 145952 - protein, 10 aa, West Nile virus
TEKFEIGWKA

SEQ ID NO: 145953 - protein, 10 aa, West Nile virus
PELANSTFVV

SEQ ID NO: 145954 - protein, 10 aa, West Nile virus
ELANHTFVVD

SEQ ID NO: 145955 - protein, 10 aa, West Nile virus
LANHTFVVDG

SEQ ID NO: 145956 - protein, 10 aa, West Nile virus
ANHTFVVDGP

SEQ ID NO: 145957 - protein, 10 aa, West Nile virus
NHTFVVDGPE

SEQ ID NO: 145958 - protein, 10 aa, West Nile virus
HTFVVDGPET

SEQ ID NO: 145959 - protein, 10 aa, West Nile virus
VDGPETEECP

SEQ ID NO: 145960 - protein, 10 aa, West Nile virus
DGPETKECST

SEQ ID NO: 145961 - protein, 10 aa, West Nile virus
ARESNTTECD

SEQ ID NO: 145962 - protein, 10 aa, West Nile virus
FNETWKLERA

SEQ ID NO: 145963 - protein, 10 aa, West Nile virus
THTLWGDGVV

SEQ ID NO: 145964 - protein, 10 aa, West Nile virus
HTLWGDGVVE

SEQ ID NO: 145965 - protein, 10 aa, West Nile virus
TLWGDGVIES

SEQ ID NO: 145966 - protein, 10 aa, West Nile virus
GVLESELIIP

SEQ ID NO: 145967 - protein, 10 aa, West Nile virus
ATLAGPRSNH

SEQ ID NO: 145968 - protein, 10 aa, West Nile virus
CGHRGPSART

SEQ ID NO: 145969 - protein, 10 aa, West Nile virus
GHRGPSARTT

SEQ ID NO: 145970 - protein, 10 aa, West Nile virus
TLPPLRFKTE

SEQ ID NO: 145971 - protein, 10 aa, West Nile virus
MEIRPQKHDE

SEQ ID NO: 145972 - protein, 10 aa, West Nile virus
EIRPLKHDEK

SEQ ID NO: 145973 - protein, 10 aa, West Nile virus
IRPQKHDERT

SEQ ID NO: 145974 - protein, 10 aa, West Nile virus
RPLKHDEKTL

SEQ ID NO: 145975 - protein, 10 aa, West Nile virus
PLKHDEKTLV

SEQ ID NO: 145976 - protein, 10 aa, West Nile virus
QKHDERTLVQ

SEQ ID NO: 145977 - protein, 10 aa, West Nile virus
ERTLVQSQVN

SEQ ID NO: 145978 - protein, 10 aa, West Nile virus
QSQVNAYNAE

SEQ ID NO: 145979 - protein, 10 aa, West Nile virus
SRVNAHNADM

SEQ ID NO: 145980 - protein, 10 aa, West Nile virus
QVNAYNAEMI

SEQ ID NO: 145981 - protein, 10 aa, West Nile virus
GLLIVFLATQ

SEQ ID NO: 145982 - protein, 10 aa, West Nile virus
LLIVFLATQE

SEQ ID NO: 145983 - protein, 10 aa, West Nile virus
LVVFLATKEV

SEQ ID NO: 145984 - protein, 10 aa, West Nile virus
RKRWTAKISG

SEQ ID NO: 145985 - protein, 10 aa, West Nile virus
RRWTAKISMP

SEQ ID NO: 145986 - protein, 10 aa, West Nile virus
PAIMIALLVL

SEQ ID NO: 145987 - protein, 10 aa, West Nile virus
AIMIALLVLV

SEQ ID NO: 145988 - protein, 10 aa, West Nile virus
ILVALAVLVL

SEQ ID NO: 145989 - protein, 10 aa, West Nile virus
LVALAVLVLG

SEQ ID NO: 145990 - protein, 10 aa, West Nile virus
VLVFGGITYI

SEQ ID NO: 145991 - protein, 10 aa, West Nile virus
VFGGITYADV

SEQ ID NO: 145992 - protein, 10 aa, West Nile virus
FGGITYADVL

SEQ ID NO: 145993 - protein, 10 aa, West Nile virus
ITYADVLRYV

SEQ ID NO: 145994 - protein, 10 aa, West Nile virus
TYADVLRYVI

SEQ ID NO: 145995 - protein, 10 aa, West Nile virus
YIDVLRYVIL

SEQ ID NO: 145996 - protein, 10 aa, West Nile virus
IQPVFMVATF

SEQ ID NO: 145997 - protein, 10 aa, West Nile virus
PVFVVASFLK

SEQ ID NO: 145998 - protein, 10 aa, West Nile virus
VFMVATFVKA

SEQ ID NO: 145999 - protein, 10 aa, West Nile virus
VASFLKAGWT

SEQ ID NO: 146000 - protein, 10 aa, West Nile virus
ASFLRARWTN

SEQ ID NO: 146001 - protein, 10 aa, West Nile virus
GWTNQENILL

SEQ ID NO: 146002 - protein, 10 aa, West Nile virus
AAAFFQMAYH

SEQ ID NO: 146003 - protein, 10 aa, West Nile virus
AAFFQMAYHD

SEQ ID NO: 146004 - protein, 10 aa, West Nile virus
AFFQMAYHDA

SEQ ID NO: 146005 - protein, 10 aa, West Nile virus
WGIPDVLNSL

SEQ ID NO: 146006 - protein, 10 aa, West Nile virus
IAWMILRAIT

SEQ ID NO: 146007 - protein, 10 aa, West Nile virus
DVYRIVLLMI

SEQ ID NO: 146008 - protein, 10 aa, West Nile virus
VYRILLLMIG

SEQ ID NO: 146009 - protein, 10 aa, West Nile virus
YKILLLMVGI

SEQ ID NO: 146010 - protein, 10 aa, West Nile virus
LMVGIGSLIK

SEQ ID NO: 146011 - protein, 10 aa, West Nile virus
MVGIGSLIKE

SEQ ID NO: 146012 - protein, 10 aa, West Nile virus
GVGSLIKERR

SEQ ID NO: 146013 - protein, 10 aa, West Nile virus
EKRNAAAKKK

SEQ ID NO: 146014 - protein, 10 aa, West Nile virus
KKNSAAKKKG

SEQ ID NO: 146015 - protein, 10 aa, West Nile virus
SPLVLAAGLI

SEQ ID NO: 146016 - protein, 10 aa, West Nile virus
LAAGLVACDP

SEQ ID NO: 146017 - protein, 10 aa, West Nile virus
AAGLVACDPN

SEQ ID NO: 146018 - protein, 10 aa, West Nile virus
AGLVACDPNR

SEQ ID NO: 146019 - protein, 10 aa, West Nile virus
GLVACDPNRK

SEQ ID NO: 146020 - protein, 10 aa, West Nile virus
LVACDPNRKR

SEQ ID NO: 146021 - protein, 10 aa, West Nile virus
VACDPNRKRG

SEQ ID NO: 146022 - protein, 10 aa, West Nile virus
ERVADISWEN

SEQ ID NO: 146023 - protein, 10 aa, West Nile virus
RVADISWEND

SEQ ID NO: 146024 - protein, 10 aa, West Nile virus
ADISWENDAE

SEQ ID NO: 146025 - protein, 10 aa, West Nile virus
DISWENDAEI

SEQ ID NO: 146026 - protein, 10 aa, West Nile virus
ISWESDVEIT

SEQ ID NO: 146027 - protein, 10 aa, West Nile virus
SWENDAEITG

SEQ ID NO: 146028 - protein, 10 aa, West Nile virus
WENDAEITGS

SEQ ID NO: 146029 - protein, 10 aa, West Nile virus
ESDVEITGSS

SEQ ID NO: 146030 - protein, 10 aa, West Nile virus
NDAEITGSSE

SEQ ID NO: 146031 - protein, 10 aa, West Nile virus
MVCLAVSAYT

SEQ ID NO: 146032 - protein, 10 aa, West Nile virus
VCLAVSAYTP

SEQ ID NO: 146033 - protein, 10 aa, West Nile virus
WDTPSPKVYK

SEQ ID NO: 146034 - protein, 10 aa, West Nile virus
EYEKGDTTTG

SEQ ID NO: 146035 - protein, 10 aa, West Nile virus
WKLGHRWNGM

SEQ ID NO: 146036 - protein, 10 aa, West Nile virus
KLQCKWNGQD

SEQ ID NO: 146037 - protein, 10 aa, West Nile virus
LQCKWNGQDE

SEQ ID NO: 146038 - protein, 10 aa, West Nile virus
GHRWNGMDEV

SEQ ID NO: 146039 - protein, 10 aa, West Nile virus
HRWNGQDEVQ

SEQ ID NO: 146040 - protein, 10 aa, West Nile virus
GERMEEPPPV

SEQ ID NO: 146041 - protein, 10 aa, West Nile virus
ERMDEPIPVG

SEQ ID NO: 146042 - protein, 10 aa, West Nile virus
RMEEPVPSGF

SEQ ID NO: 146043 - protein, 10 aa, West Nile virus
FEPEMLRKKK

SEQ ID NO: 146044 - protein, 10 aa, West Nile virus
DPEMLRKKQI

SEQ ID NO: 146045 - protein, 10 aa, West Nile virus
PETLKKKQIT

SEQ ID NO: 146046 - protein, 10 aa, West Nile virus
PQIIKEAMNR

SEQ ID NO: 146047 - protein, 10 aa, West Nile virus
QIIKEAIDRR

SEQ ID NO: 146048 - protein, 10 aa, West Nile virus
IIKEAIDRRL

SEQ ID NO: 146049 - protein, 10 aa, West Nile virus
IKEAMNRRLR

SEQ ID NO: 146050 - protein, 10 aa, West Nile virus
KEAIDRRLRT

SEQ ID NO: 146051 - protein, 10 aa, West Nile virus
SKRLRTAILA

SEQ ID NO: 146052 - protein, 10 aa, West Nile virus
PIRYQTSAVN

SEQ ID NO: 146053 - protein, 10 aa, West Nile virus
IRYQTSAVNR

SEQ ID NO: 146054 - protein, 10 aa, West Nile virus
RYQTSAVNRE

SEQ ID NO: 146055 - protein, 10 aa, West Nile virus
YQTSAVNREH

SEQ ID NO: 146056 - protein, 10 aa, West Nile virus
SGYEWITEYA

SEQ ID NO: 146057 - protein, 10 aa, West Nile virus
ITEGEARVIL

SEQ ID NO: 146058 - protein, 10 aa, West Nile virus
TDGESRVVLG

SEQ ID NO: 146059 - protein, 10 aa, West Nile virus
DGEGKVVLSE

SEQ ID NO: 146060 - protein, 10 aa, West Nile virus
GESRVVLGEP

SEQ ID NO: 146061 - protein, 10 aa, West Nile virus
EARVILGEPS

SEQ ID NO: 146062 - protein, 10 aa, West Nile virus
LAHKVAAAGV

SEQ ID NO: 146063 - protein, 10 aa, West Nile virus
KAAAAGVSYH

SEQ ID NO: 146064 - protein, 10 aa, West Nile virus
AAGVSYHDRK

SEQ ID NO: 146065 - protein, 10 aa, West Nile virus
ASGKRSQVGL

SEQ ID NO: 146066 - protein, 10 aa, West Nile virus
GKRSQMGLIE

SEQ ID NO: 146067 - protein, 10 aa, West Nile virus
KRSQVGLIEV

SEQ ID NO: 146068 - protein, 10 aa, West Nile virus
RSQMGLIEVL

SEQ ID NO: 146069 - protein, 10 aa, West Nile virus
SQMGLIEVLG

SEQ ID NO: 146070 - protein, 10 aa, West Nile virus
QMGLIEVLGK

SEQ ID NO: 146071 - protein, 10 aa, West Nile virus
MGLIEVLGKM

SEQ ID NO: 146072 - protein, 10 aa, West Nile virus
AEKGRRAHRM

SEQ ID NO: 146073 - protein, 10 aa, West Nile virus
EKGRRAHRMA

SEQ ID NO: 146074 - protein, 10 aa, West Nile virus
LLGVMTMGVF

SEQ ID NO: 146075 - protein, 10 aa, West Nile virus
VMTMGVFLLL

SEQ ID NO: 146076 - protein, 10 aa, West Nile virus
MSMGVFFLLM

SEQ ID NO: 146077 - protein, 10 aa, West Nile virus
TMGIFFLLMQ

SEQ ID NO: 146078 - protein, 10 aa, West Nile virus
GVSKIGLAGV

SEQ ID NO: 146079 - protein, 10 aa, West Nile virus
LAVATFFCWM

SEQ ID NO: 146080 - protein, 10 aa, West Nile virus
VATLFCWMAE

SEQ ID NO: 146081 - protein, 10 aa, West Nile virus
AVFLICVLTF

SEQ ID NO: 146082 - protein, 10 aa, West Nile virus
VFLICVLTFI

SEQ ID NO: 146083 - protein, 10 aa, West Nile virus
ENFLLDLRPA

SEQ ID NO: 146084 - protein, 10 aa, West Nile virus
DLLLDLKPAT

SEQ ID NO: 146085 - protein, 10 aa, West Nile virus
VATAVLTPLL

SEQ ID NO: 146086 - protein, 10 aa, West Nile virus
ATAVLTPLLK

SEQ ID NO: 146087 - protein, 10 aa, West Nile virus
AVLTPLIKHL

SEQ ID NO: 146088 - protein, 10 aa, West Nile virus
FLTPLLKHLI

SEQ ID NO: 146089 - protein, 10 aa, West Nile virus
MMQKKVGQVM

SEQ ID NO: 146090 - protein, 10 aa, West Nile virus
LIWVSLAAVV

SEQ ID NO: 146091 - protein, 10 aa, West Nile virus
ILVSVAAVVV

SEQ ID NO: 146092 - protein, 10 aa, West Nile virus
LVSVAAVVVN

SEQ ID NO: 146093 - protein, 10 aa, West Nile virus
EGWLSCLSIT

SEQ ID NO: 146094 - protein, 10 aa, West Nile virus
KNLEKPGLKR

SEQ ID NO: 146095 - protein, 10 aa, West Nile virus
NLEKPGLKRG

SEQ ID NO: 146096 - protein, 10 aa, West Nile virus
LEKPGLKRGG

SEQ ID NO: 146097 - protein, 10 aa, West Nile virus
GEAWKERLNQ

SEQ ID NO: 146098 - protein, 10 aa, West Nile virus
EVWKEKLNQM

SEQ ID NO: 146099 - protein, 10 aa, West Nile virus
VWKEKLNQMS

SEQ ID NO: 146100 - protein, 10 aa, West Nile virus
MSKEEFSRYR

SEQ ID NO: 146101 - protein, 10 aa, West Nile virus
TKEEFTRYRR

SEQ ID NO: 146102 - protein, 10 aa, West Nile virus
REEFTRYRKE

SEQ ID NO: 146103 - protein, 10 aa, West Nile virus
FSRYRKEAII

SEQ ID NO: 146104 - protein, 10 aa, West Nile virus
ARYRKEAITE

SEQ ID NO: 146105 - protein, 10 aa, West Nile virus
IIEVDRSTAK

SEQ ID NO: 146106 - protein, 10 aa, West Nile virus
RKEGNVTGGY

SEQ ID NO: 146107 - protein, 10 aa, West Nile virus
VDVFYRTSEA

SEQ ID NO: 146108 - protein, 10 aa, West Nile virus
DVFYRPSEVS

SEQ ID NO: 146109 - protein, 10 aa, West Nile virus
VFYRPSESCD

SEQ ID NO: 146110 - protein, 10 aa, West Nile virus
FYRPSESCDT

SEQ ID NO: 146111 - protein, 10 aa, West Nile virus
YRPSEVSDTL

SEQ ID NO: 146112 - protein, 10 aa, West Nile virus
RPSEVSDTLL

SEQ ID NO: 146113 - protein, 10 aa, West Nile virus
PSESCDTLLC

SEQ ID NO: 146114 - protein, 10 aa, West Nile virus
MPKVVEKMEV

SEQ ID NO: 146115 - protein, 10 aa, West Nile virus
PKVVEKMEVL

SEQ ID NO: 146116 - protein, 10 aa, West Nile virus
KVVEKMEVLQ

SEQ ID NO: 146117 - protein, 10 aa, West Nile virus
VIEKMELLQL

SEQ ID NO: 146118 - protein, 10 aa, West Nile virus
VEKMEVLQRR

SEQ ID NO: 146119 - protein, 10 aa, West Nile virus
YWVSQASGNI

SEQ ID NO: 146120 - protein, 10 aa, West Nile virus
WVSRASRNVV

SEQ ID NO: 146121 - protein, 10 aa, West Nile virus
VSQASGNIVH

SEQ ID NO: 146122 - protein, 10 aa, West Nile virus
EKRTWKGPQF

SEQ ID NO: 146123 - protein, 10 aa, West Nile virus
KRTWKGPQFE

SEQ ID NO: 146124 - protein, 10 aa, West Nile virus
KTWKGPHYEE

SEQ ID NO: 146125 - protein, 10 aa, West Nile virus
KGPHYEEDVN

SEQ ID NO: 146126 - protein, 10 aa, West Nile virus
GPHYEEDVNL

SEQ ID NO: 146127 - protein, 10 aa, West Nile virus
PQYEEDVSLG

SEQ ID NO: 146128 - protein, 10 aa, West Nile virus
KPLLNSDTRK

SEQ ID NO: 146129 - protein, 10 aa, West Nile virus
LLNSDTRKIK

SEQ ID NO: 146130 - protein, 10 aa, West Nile virus
NRIERLKREY

SEQ ID NO: 146131 - protein, 10 aa, West Nile virus
RVERLKREYG

SEQ ID NO: 146132 - protein, 10 aa, West Nile virus
DSNHPYRTWN

SEQ ID NO: 146133 - protein, 10 aa, West Nile virus
VNHPYRTWNY

SEQ ID NO: 146134 - protein, 10 aa, West Nile virus
RDKRPRLCSR

SEQ ID NO: 146135 - protein, 10 aa, West Nile virus
EKKPRMCSRE

SEQ ID NO: 146136 - protein, 10 aa, West Nile virus
RMCSREEFIS

SEQ ID NO: 146137 - protein, 10 aa, West Nile virus
LCSREEFKRK

SEQ ID NO: 146138 - protein, 10 aa, West Nile virus
CSREEFKRKV

SEQ ID NO: 146139 - protein, 10 aa, West Nile virus
SREEFKRKVN

SEQ ID NO: 146140 - protein, 10 aa, West Nile virus
EQNQWRSARA

SEQ ID NO: 146141 - protein, 10 aa, West Nile virus
QNQWRSARAA

SEQ ID NO: 146142 - protein, 10 aa, West Nile virus
NQWRSARAAV

SEQ ID NO: 146143 - protein, 10 aa, West Nile virus
QWRSARAAVE

SEQ ID NO: 146144 - protein, 10 aa, West Nile virus
WRSARAAVED

SEQ ID NO: 146145 - protein, 10 aa, West Nile virus
SAREAVEDST

SEQ ID NO: 146146 - protein, 10 aa, West Nile virus
DSTFWEMVDE

SEQ ID NO: 146147 - protein, 10 aa, West Nile virus
STFWEMVDEE

SEQ ID NO: 146148 - protein, 10 aa, West Nile virus
GGKTYADDTA

SEQ ID NO: 146149 - protein, 10 aa, West Nile virus
GKTYADDTAG

SEQ ID NO: 146150 - protein, 10 aa, West Nile virus
KTYADDTAGW

SEQ ID NO: 146151 - protein, 10 aa, West Nile virus
RSIIQLTYRH

SEQ ID NO: 146152 - protein, 10 aa, West Nile virus
AIIELTYCHK

SEQ ID NO: 146153 - protein, 10 aa, West Nile virus
AADRKTVMDV

SEQ ID NO: 146154 - protein, 10 aa, West Nile virus
ADGKTVMDII

SEQ ID NO: 146155 - protein, 10 aa, West Nile virus
DGKTVMDIIS

SEQ ID NO: 146156 - protein, 10 aa, West Nile virus
MEGEGVIGPE

SEQ ID NO: 146157 - protein, 10 aa, West Nile virus
GEGVITPDDV

SEQ ID NO: 146158 - protein, 10 aa, West Nile virus
EGVITPDDVE

SEQ ID NO: 146159 - protein, 10 aa, West Nile virus
ISLHFLNAMS

SEQ ID NO: 146160 - protein, 10 aa, West Nile virus
HVGGEWMTTE

SEQ ID NO: 146161 - protein, 10 aa, West Nile virus
GGEWMTTEGM

SEQ ID NO: 146162 - protein, 10 aa, West Nile virus
TADMLGVWNK

SEQ ID NO: 146163 - protein, 10 aa, West Nile virus
EGMLEVWNRV

SEQ ID NO: 146164 - protein, 10 aa, West Nile virus
DMLGVWNKVW

SEQ ID NO: 146165 - protein, 11 aa, West Nile virus
MSKKPGGPGKS

SEQ ID NO: 146166 - protein, 11 aa, West Nile virus
SKKPGGPGKSR

SEQ ID NO: 146167 - protein, 11 aa, West Nile virus
KKPGGPGKSRA

SEQ ID NO: 146168 - protein, 11 aa, West Nile virus
KPGGPGKSRAV

SEQ ID NO: 146169 - protein, 11 aa, West Nile virus
PGGPGKSRAVN

SEQ ID NO: 146170 - protein, 11 aa, West Nile virus
GGPGKSRAVNM

SEQ ID NO: 146171 - protein, 11 aa, West Nile virus
GPGKSRAVNML

SEQ ID NO: 146172 - protein, 11 aa, West Nile virus
PGKSRAVNMLK

SEQ ID NO: 146173 - protein, 11 aa, West Nile virus
GKSRAVNMLKR

SEQ ID NO: 146174 - protein, 11 aa, West Nile virus
KSRAVNMLKRG

SEQ ID NO: 146175 - protein, 11 aa, West Nile virus
RAVNMLKRGMP

SEQ ID NO: 146176 - protein, 11 aa, West Nile virus
AVNMLKRGMPR

SEQ ID NO: 146177 - protein, 11 aa, West Nile virus
PRVLSLIGLKR

SEQ ID NO: 146178 - protein, 11 aa, West Nile virus
RVLSLIGLKRA

SEQ ID NO: 146179 - protein, 11 aa, West Nile virus
VLSLIGLKRAM

SEQ ID NO: 146180 - protein, 11 aa, West Nile virus
LSLIGLKRAML

SEQ ID NO: 146181 - protein, 11 aa, West Nile virus
SLIGLKRAMLS

SEQ ID NO: 146182 - protein, 11 aa, West Nile virus
LIGLKRAMLSL

SEQ ID NO: 146183 - protein, 11 aa, West Nile virus
IGLKRAMLSLI

SEQ ID NO: 146184 - protein, 11 aa, West Nile virus
GLKRAMLSLID

SEQ ID NO: 146185 - protein, 11 aa, West Nile virus
LKRAMLSLIDG

SEQ ID NO: 146186 - protein, 11 aa, West Nile virus
KRAMLSLIDGK

SEQ ID NO: 146187 - protein, 11 aa, West Nile virus
RAMLSLIDGKG

SEQ ID NO: 146188 - protein, 11 aa, West Nile virus
AMLSLIDGKGP

SEQ ID NO: 146189 - protein, 11 aa, West Nile virus
LSLIDGKGPIR

SEQ ID NO: 146190 - protein, 11 aa, West Nile virus
SLIDGKGPIRF

SEQ ID NO: 146191 - protein, 11 aa, West Nile virus
LIDGKGPIRFV

SEQ ID NO: 146192 - protein, 11 aa, West Nile virus
IDGKGPIRFVL

SEQ ID NO: 146193 - protein, 11 aa, West Nile virus
DGKGPIRFVLA

SEQ ID NO: 146194 - protein, 11 aa, West Nile virus
GKGPIRFVLAL

SEQ ID NO: 146195 - protein, 11 aa, West Nile virus
KGPIRFVLALL

SEQ ID NO: 146196 - protein, 11 aa, West Nile virus
GPIRFVLALLA

SEQ ID NO: 146197 - protein, 11 aa, West Nile virus
PIRFVLALLAF

SEQ ID NO: 146198 - protein, 11 aa, West Nile virus
IRFVLALLAFF

SEQ ID NO: 146199 - protein, 11 aa, West Nile virus
RFVLALLAFFR

SEQ ID NO: 146200 - protein, 11 aa, West Nile virus
FVLALLAFFRF

SEQ ID NO: 146201 - protein, 11 aa, West Nile virus
VLALLAFFRFT

SEQ ID NO: 146202 - protein, 11 aa, West Nile virus
LALLAFFRFTA

SEQ ID NO: 146203 - protein, 11 aa, West Nile virus
ALLAFFRFTAI

SEQ ID NO: 146204 - protein, 11 aa, West Nile virus
LLAFFRFTAIA

SEQ ID NO: 146205 - protein, 11 aa, West Nile virus
LAFFRFTAIAP

SEQ ID NO: 146206 - protein, 11 aa, West Nile virus
AFFRFTAIAPT

SEQ ID NO: 146207 - protein, 11 aa, West Nile virus
FFRFTAIAPTR

SEQ ID NO: 146208 - protein, 11 aa, West Nile virus
FRFTAIAPTRA

SEQ ID NO: 146209 - protein, 11 aa, West Nile virus
RFTAIAPTRAV

SEQ ID NO: 146210 - protein, 11 aa, West Nile virus
FTAIAPTRAVL

SEQ ID NO: 146211 - protein, 11 aa, West Nile virus
TAIAPTRAVLD

SEQ ID NO: 146212 - protein, 11 aa, West Nile virus
AIAPTRAVLDR

SEQ ID NO: 146213 - protein, 11 aa, West Nile virus
IAPTRAVLDRW

SEQ ID NO: 146214 - protein, 11 aa, West Nile virus
APTRAVLDRWR

SEQ ID NO: 146215 - protein, 11 aa, West Nile virus
PTRAVLDRWRG

SEQ ID NO: 146216 - protein, 11 aa, West Nile virus
TRAVLDRWRGV

SEQ ID NO: 146217 - protein, 11 aa, West Nile virus
RAVLDRWRGVN

SEQ ID NO: 146218 - protein, 11 aa, West Nile virus
AVLDRWRGVNK

SEQ ID NO: 146219 - protein, 11 aa, West Nile virus
VLDRWRGVNKQ

SEQ ID NO: 146220 - protein, 11 aa, West Nile virus
LDRWRGVNKQT

SEQ ID NO: 146221 - protein, 11 aa, West Nile virus
DRWRGVNKQTA

SEQ ID NO: 146222 - protein, 11 aa, West Nile virus
RWRGVNKQTAM

SEQ ID NO: 146223 - protein, 11 aa, West Nile virus
WRGVNKQTAMK

SEQ ID NO: 146224 - protein, 11 aa, West Nile virus
RGVNKQTAMKH

SEQ ID NO: 146225 - protein, 11 aa, West Nile virus
GVNKQTAMKHL

SEQ ID NO: 146226 - protein, 11 aa, West Nile virus
VNKQTAMKHLL

SEQ ID NO: 146227 - protein, 11 aa, West Nile virus
NKQTAMKHLLS

SEQ ID NO: 146228 - protein, 11 aa, West Nile virus
KQTAMKHLLSF

SEQ ID NO: 146229 - protein, 11 aa, West Nile virus
QTAMKHLLSFK

SEQ ID NO: 146230 - protein, 11 aa, West Nile virus
TAMKHLLSFKK

SEQ ID NO: 146231 - protein, 11 aa, West Nile virus
AMKHLLSFKKE

SEQ ID NO: 146232 - protein, 11 aa, West Nile virus
MKHLLSFKKEL

SEQ ID NO: 146233 - protein, 11 aa, West Nile virus
KHLLSFKKELG

SEQ ID NO: 146234 - protein, 11 aa, West Nile virus
HLLSFKKELGT

SEQ ID NO: 146235 - protein, 11 aa, West Nile virus
LLSFKKELGTL

SEQ ID NO: 146236 - protein, 11 aa, West Nile virus
LSFKKELGTLT

SEQ ID NO: 146237 - protein, 11 aa, West Nile virus
SFKKELGTLTS

SEQ ID NO: 146238 - protein, 11 aa, West Nile virus
FKKELGTLTSA

SEQ ID NO: 146239 - protein, 11 aa, West Nile virus
KKELGTLTSAI

SEQ ID NO: 146240 - protein, 11 aa, West Nile virus
KELGTLTSAIN

SEQ ID NO: 146241 - protein, 11 aa, West Nile virus
ELGTLTSAINR

SEQ ID NO: 146242 - protein, 11 aa, West Nile virus
LGTLTSAINRR

SEQ ID NO: 146243 - protein, 11 aa, West Nile virus
GTLTSAINRRS

SEQ ID NO: 146244 - protein, 11 aa, West Nile virus
NRRSSKQKKRG

SEQ ID NO: 146245 - protein, 11 aa, West Nile virus
RRSSKQKKRGG

SEQ ID NO: 146246 - protein, 11 aa, West Nile virus
GAVTLSNFQGK

SEQ ID NO: 146247 - protein, 11 aa, West Nile virus
AVTLSNFQGKV

SEQ ID NO: 146248 - protein, 11 aa, West Nile virus
VTLSNFQGKVM

SEQ ID NO: 146249 - protein, 11 aa, West Nile virus
TLSNFQGKVMM

SEQ ID NO: 146250 - protein, 11 aa, West Nile virus
LSNFQGKVMMT

SEQ ID NO: 146251 - protein, 11 aa, West Nile virus
SNFQGKVMMTV

SEQ ID NO: 146252 - protein, 11 aa, West Nile virus
NFQGKVMMTVN

SEQ ID NO: 146253 - protein, 11 aa, West Nile virus
FQGKVMMTVNA

SEQ ID NO: 146254 - protein, 11 aa, West Nile virus
QGKVMMTVNAT

SEQ ID NO: 146255 - protein, 11 aa, West Nile virus
GKVMMTVNATD

SEQ ID NO: 146256 - protein, 11 aa, West Nile virus
VITIPTAAGKN

SEQ ID NO: 146257 - protein, 11 aa, West Nile virus
ITIPTAAGKNL

SEQ ID NO: 146258 - protein, 11 aa, West Nile virus
TIPTAAGKNLC

SEQ ID NO: 146259 - protein, 11 aa, West Nile virus
IPTAAGKNLCI

SEQ ID NO: 146260 - protein, 11 aa, West Nile virus
PTAAGKNLCIV

SEQ ID NO: 146261 - protein, 11 aa, West Nile virus
TAAGKNLCIVR

SEQ ID NO: 146262 - protein, 11 aa, West Nile virus
AAGKNLCIVRA

SEQ ID NO: 146263 - protein, 11 aa, West Nile virus
AGKNLCIVRAM

SEQ ID NO: 146264 - protein, 11 aa, West Nile virus
GKNLCIVRAMD

SEQ ID NO: 146265 - protein, 11 aa, West Nile virus
KNLCIVRAMDV

SEQ ID NO: 146266 - protein, 11 aa, West Nile virus
NLCIVRAMDVG

SEQ ID NO: 146267 - protein, 11 aa, West Nile virus
LCIVRAMDVGY

SEQ ID NO: 146268 - protein, 11 aa, West Nile virus
VRAMDVGYMCD

SEQ ID NO: 146269 - protein, 11 aa, West Nile virus
RAMDVGYMCDD

SEQ ID NO: 146270 - protein, 11 aa, West Nile virus
AMDVGYMCDDT

SEQ ID NO: 146271 - protein, 11 aa, West Nile virus
MDVGYMCDDTI

SEQ ID NO: 146272 - protein, 11 aa, West Nile virus
DVGYMCDDTIT

SEQ ID NO: 146273 - protein, 11 aa, West Nile virus
VGYMCDDTITY

SEQ ID NO: 146274 - protein, 11 aa, West Nile virus
GYMCDDTITYE

SEQ ID NO: 146275 - protein, 11 aa, West Nile virus
YMCDDTITYEC

SEQ ID NO: 146276 - protein, 11 aa, West Nile virus
MCDDTITYECP

SEQ ID NO: 146277 - protein, 11 aa, West Nile virus
CDDTITYECPV

SEQ ID NO: 146278 - protein, 11 aa, West Nile virus
DDTITYECPVL

SEQ ID NO: 146279 - protein, 11 aa, West Nile virus
DTITYECPVLS

SEQ ID NO: 146280 - protein, 11 aa, West Nile virus
TITYECPVLSA

SEQ ID NO: 146281 - protein, 11 aa, West Nile virus
ITYECPVLSAG

SEQ ID NO: 146282 - protein, 11 aa, West Nile virus
TYECPVLSAGN

SEQ ID NO: 146283 - protein, 11 aa, West Nile virus
YECPVLSAGND

SEQ ID NO: 146284 - protein, 11 aa, West Nile virus
ECPVLSAGNDP

SEQ ID NO: 146285 - protein, 11 aa, West Nile virus
CPVLSAGNDPE

SEQ ID NO: 146286 - protein, 11 aa, West Nile virus
PVLSAGNDPED

SEQ ID NO: 146287 - protein, 11 aa, West Nile virus
VLSAGNDPEDI

SEQ ID NO: 146288 - protein, 11 aa, West Nile virus
LSAGNDPEDID

SEQ ID NO: 146289 - protein, 11 aa, West Nile virus
SAGNDPEDIDC

SEQ ID NO: 146290 - protein, 11 aa, West Nile virus
AGNDPEDIDCW

SEQ ID NO: 146291 - protein, 11 aa, West Nile virus
GNDPEDIDCWC

SEQ ID NO: 146292 - protein, 11 aa, West Nile virus
NDPEDIDCWCT

SEQ ID NO: 146293 - protein, 11 aa, West Nile virus
DPEDIDCWCTK

SEQ ID NO: 146294 - protein, 11 aa, West Nile virus
PEDIDCWCTKS

SEQ ID NO: 146295 - protein, 11 aa, West Nile virus
EDIDCWCTKSA

SEQ ID NO: 146296 - protein, 11 aa, West Nile virus
AVYVRYGRCTK

SEQ ID NO: 146297 - protein, 11 aa, West Nile virus
VYVRYGRCTKT

SEQ ID NO: 146298 - protein, 11 aa, West Nile virus
YVRYGRCTKTR

SEQ ID NO: 146299 - protein, 11 aa, West Nile virus
VRYGRCTKTRH

SEQ ID NO: 146300 - protein, 11 aa, West Nile virus
RYGRCTKTRHS

SEQ ID NO: 146301 - protein, 11 aa, West Nile virus
YGRCTKTRHSR

SEQ ID NO: 146302 - protein, 11 aa, West Nile virus
GRCTKTRHSRR

SEQ ID NO: 146303 - protein, 11 aa, West Nile virus
RCTKTRHSRRS

SEQ ID NO: 146304 - protein, 11 aa, West Nile virus
CTKTRHSRRSR

SEQ ID NO: 146305 - protein, 11 aa, West Nile virus
TKTRHSRRSRR

SEQ ID NO: 146306 - protein, 11 aa, West Nile virus
KTRHSRRSRRS

SEQ ID NO: 146307 - protein, 11 aa, West Nile virus
TRHSRRSRRSL

SEQ ID NO: 146308 - protein, 11 aa, West Nile virus
RHSRRSRRSLT

SEQ ID NO: 146309 - protein, 11 aa, West Nile virus
HSRRSRRSLTV

SEQ ID NO: 146310 - protein, 11 aa, West Nile virus
SRRSRRSLTVQ

SEQ ID NO: 146311 - protein, 11 aa, West Nile virus
RRSRRSLTVQT

SEQ ID NO: 146312 - protein, 11 aa, West Nile virus
RSRRSLTVQTH

SEQ ID NO: 146313 - protein, 11 aa, West Nile virus
SRRSLTVQTHG

SEQ ID NO: 146314 - protein, 11 aa, West Nile virus
RRSLTVQTHGE

SEQ ID NO: 146315 - protein, 11 aa, West Nile virus
RSLTVQTHGES

SEQ ID NO: 146316 - protein, 11 aa, West Nile virus
SLTVQTHGEST

SEQ ID NO: 146317 - protein, 11 aa, West Nile virus
LTVQTHGESTL

SEQ ID NO: 146318 - protein, 11 aa, West Nile virus
TVQTHGESTLA

SEQ ID NO: 146319 - protein, 11 aa, West Nile virus
VQTHGESTLAN

SEQ ID NO: 146320 - protein, 11 aa, West Nile virus
QTHGESTLANK

SEQ ID NO: 146321 - protein, 11 aa, West Nile virus
THGESTLANKK

SEQ ID NO: 146322 - protein, 11 aa, West Nile virus
HGESTLANKKG

SEQ ID NO: 146323 - protein, 11 aa, West Nile virus
GESTLANKKGA

SEQ ID NO: 146324 - protein, 11 aa, West Nile virus
ESTLANKKGAW

SEQ ID NO: 146325 - protein, 11 aa, West Nile virus
STLANKKGAWM

SEQ ID NO: 146326 - protein, 11 aa, West Nile virus
TLANKKGAWMD

SEQ ID NO: 146327 - protein, 11 aa, West Nile virus
LANKKGAWMDS

SEQ ID NO: 146328 - protein, 11 aa, West Nile virus
ANKKGAWMDST

SEQ ID NO: 146329 - protein, 11 aa, West Nile virus
NKKGAWMDSTK

SEQ ID NO: 146330 - protein, 11 aa, West Nile virus
KKGAWMDSTKA

SEQ ID NO: 146331 - protein, 11 aa, West Nile virus
KGAWMDSTKAT

SEQ ID NO: 146332 - protein, 11 aa, West Nile virus
GAWMDSTKATR

SEQ ID NO: 146333 - protein, 11 aa, West Nile virus
AWMDSTKATRY

SEQ ID NO: 146334 - protein, 11 aa, West Nile virus
WMDSTKATRYL

SEQ ID NO: 146335 - protein, 11 aa, West Nile virus
MDSTKATRYLV

SEQ ID NO: 146336 - protein, 11 aa, West Nile virus
DSTKATRYLVK

SEQ ID NO: 146337 - protein, 11 aa, West Nile virus
STKATRYLVKT

SEQ ID NO: 146338 - protein, 11 aa, West Nile virus
TKATRYLVKTE

SEQ ID NO: 146339 - protein, 11 aa, West Nile virus
KATRYLVKTES

SEQ ID NO: 146340 - protein, 11 aa, West Nile virus
ATRYLVKTESW

SEQ ID NO: 146341 - protein, 11 aa, West Nile virus
TRYLVKTESWI

SEQ ID NO: 146342 - protein, 11 aa, West Nile virus
RYLVKTESWIL

SEQ ID NO: 146343 - protein, 11 aa, West Nile virus
YLVKTESWILR

SEQ ID NO: 146344 - protein, 11 aa, West Nile virus
LVKTESWILRN

SEQ ID NO: 146345 - protein, 11 aa, West Nile virus
VKTESWILRNP

SEQ ID NO: 146346 - protein, 11 aa, West Nile virus
KTESWILRNPG

SEQ ID NO: 146347 - protein, 11 aa, West Nile virus
TESWILRNPGY

SEQ ID NO: 146348 - protein, 11 aa, West Nile virus
ESWILRNPGYA

SEQ ID NO: 146349 - protein, 11 aa, West Nile virus
SWILRNPGYAL

SEQ ID NO: 146350 - protein, 11 aa, West Nile virus
WILRNPGYALV

SEQ ID NO: 146351 - protein, 11 aa, West Nile virus
ILRNPGYALVA

SEQ ID NO: 146352 - protein, 11 aa, West Nile virus
LRNPGYALVAA

SEQ ID NO: 146353 - protein, 11 aa, West Nile virus
RNPGYALVAAV

SEQ ID NO: 146354 - protein, 11 aa, West Nile virus
NPGYALVAAVI

SEQ ID NO: 146355 - protein, 11 aa, West Nile virus
PGYALVAAVIG

SEQ ID NO: 146356 - protein, 11 aa, West Nile virus
GYALVAAVIGW

SEQ ID NO: 146357 - protein, 11 aa, West Nile virus
YALVAAVIGWM

SEQ ID NO: 146358 - protein, 11 aa, West Nile virus
ALVAAVIGWML

SEQ ID NO: 146359 - protein, 11 aa, West Nile virus
LVAAVIGWMLG

SEQ ID NO: 146360 - protein, 11 aa, West Nile virus
VAAVIGWMLGS

SEQ ID NO: 146361 - protein, 11 aa, West Nile virus
AAVIGWMLGSN

SEQ ID NO: 146362 - protein, 11 aa, West Nile virus
AVIGWMLGSNT

SEQ ID NO: 146363 - protein, 11 aa, West Nile virus
VIGWMLGSNTM

SEQ ID NO: 146364 - protein, 11 aa, West Nile virus
IGWMLGSNTMQ

SEQ ID NO: 146365 - protein, 11 aa, West Nile virus
GWMLGSNTMQR

SEQ ID NO: 146366 - protein, 11 aa, West Nile virus
WMLGSNTMQRV

SEQ ID NO: 146367 - protein, 11 aa, West Nile virus
MLGSNTMQRVV

SEQ ID NO: 146368 - protein, 11 aa, West Nile virus
LGSNTMQRVVF

SEQ ID NO: 146369 - protein, 11 aa, West Nile virus
GSNTMQRVVFV

SEQ ID NO: 146370 - protein, 11 aa, West Nile virus
MQRVVFVVLLL

SEQ ID NO: 146371 - protein, 11 aa, West Nile virus
QRVVFVVLLLL

SEQ ID NO: 146372 - protein, 11 aa, West Nile virus
RVVFVVLLLLV

SEQ ID NO: 146373 - protein, 11 aa, West Nile virus
VVFVVLLLLVA

SEQ ID NO: 146374 - protein, 11 aa, West Nile virus
VFVVLLLLVAP

SEQ ID NO: 146375 - protein, 11 aa, West Nile virus
FVVLLLLVAPA

SEQ ID NO: 146376 - protein, 11 aa, West Nile virus
VVLLLLVAPAY

SEQ ID NO: 146377 - protein, 11 aa, West Nile virus
VLLLLVAPAYS

SEQ ID NO: 146378 - protein, 11 aa, West Nile virus
LLLLVAPAYSF

SEQ ID NO: 146379 - protein, 11 aa, West Nile virus
LLLVAPAYSFN

SEQ ID NO: 146380 - protein, 11 aa, West Nile virus
LLVAPAYSFNC

SEQ ID NO: 146381 - protein, 11 aa, West Nile virus
LVAPAYSFNCL

SEQ ID NO: 146382 - protein, 11 aa, West Nile virus
VAPAYSFNCLG

SEQ ID NO: 146383 - protein, 11 aa, West Nile virus
APAYSFNCLGM

SEQ ID NO: 146384 - protein, 11 aa, West Nile virus
PAYSFNCLGMS

SEQ ID NO: 146385 - protein, 11 aa, West Nile virus
AYSFNCLGMSN

SEQ ID NO: 146386 - protein, 11 aa, West Nile virus
YSFNCLGMSNR

SEQ ID NO: 146387 - protein, 11 aa, West Nile virus
SFNCLGMSNRD

SEQ ID NO: 146388 - protein, 11 aa, West Nile virus
FNCLGMSNRDF

SEQ ID NO: 146389 - protein, 11 aa, West Nile virus
NCLGMSNRDFL

SEQ ID NO: 146390 - protein, 11 aa, West Nile virus
CLGMSNRDFLE

SEQ ID NO: 146391 - protein, 11 aa, West Nile virus
LGMSNRDFLEG

SEQ ID NO: 146392 - protein, 11 aa, West Nile virus
GMSNRDFLEGV

SEQ ID NO: 146393 - protein, 11 aa, West Nile virus
MSNRDFLEGVS

SEQ ID NO: 146394 - protein, 11 aa, West Nile virus
SNRDFLEGVSG

SEQ ID NO: 146395 - protein, 11 aa, West Nile virus
NRDFLEGVSGA

SEQ ID NO: 146396 - protein, 11 aa, West Nile virus
RDFLEGVSGAT

SEQ ID NO: 146397 - protein, 11 aa, West Nile virus
DFLEGVSGATW

SEQ ID NO: 146398 - protein, 11 aa, West Nile virus
FLEGVSGATWV

SEQ ID NO: 146399 - protein, 11 aa, West Nile virus
LEGVSGATWVD

SEQ ID NO: 146400 - protein, 11 aa, West Nile virus
EGVSGATWVDL

SEQ ID NO: 146401 - protein, 11 aa, West Nile virus
GVSGATWVDLV

SEQ ID NO: 146402 - protein, 11 aa, West Nile virus
VSGATWVDLVL

SEQ ID NO: 146403 - protein, 11 aa, West Nile virus
SGATWVDLVLE

SEQ ID NO: 146404 - protein, 11 aa, West Nile virus
GATWVDLVLEG

SEQ ID NO: 146405 - protein, 11 aa, West Nile virus
ATWVDLVLEGD

SEQ ID NO: 146406 - protein, 11 aa, West Nile virus
TWVDLVLEGDS

SEQ ID NO: 146407 - protein, 11 aa, West Nile virus
WVDLVLEGDSC

SEQ ID NO: 146408 - protein, 11 aa, West Nile virus
VDLVLEGDSCV

SEQ ID NO: 146409 - protein, 11 aa, West Nile virus
DLVLEGDSCVT

SEQ ID NO: 146410 - protein, 11 aa, West Nile virus
LVLEGDSCVTI

SEQ ID NO: 146411 - protein, 11 aa, West Nile virus
VLEGDSCVTIM

SEQ ID NO: 146412 - protein, 11 aa, West Nile virus
LEGDSCVTIMS

SEQ ID NO: 146413 - protein, 11 aa, West Nile virus
EGDSCVTIMSK

SEQ ID NO: 146414 - protein, 11 aa, West Nile virus
GDSCVTIMSKD

SEQ ID NO: 146415 - protein, 11 aa, West Nile virus
DSCVTIMSKDK

SEQ ID NO: 146416 - protein, 11 aa, West Nile virus
SCVTIMSKDKP

SEQ ID NO: 146417 - protein, 11 aa, West Nile virus
CVTIMSKDKPT

SEQ ID NO: 146418 - protein, 11 aa, West Nile virus
VTIMSKDKPTI

SEQ ID NO: 146419 - protein, 11 aa, West Nile virus
TIMSKDKPTID

SEQ ID NO: 146420 - protein, 11 aa, West Nile virus
IMSKDKPTIDV

SEQ ID NO: 146421 - protein, 11 aa, West Nile virus
MSKDKPTIDVK

SEQ ID NO: 146422 - protein, 11 aa, West Nile virus
SKDKPTIDVKM

SEQ ID NO: 146423 - protein, 11 aa, West Nile virus
KDKPTIDVKMM

SEQ ID NO: 146424 - protein, 11 aa, West Nile virus
DKPTIDVKMMN

SEQ ID NO: 146425 - protein, 11 aa, West Nile virus
KPTIDVKMMNM

SEQ ID NO: 146426 - protein, 11 aa, West Nile virus
PTIDVKMMNME

SEQ ID NO: 146427 - protein, 11 aa, West Nile virus
TIDVKMMNMEA

SEQ ID NO: 146428 - protein, 11 aa, West Nile virus
VSDLSTKAACP

SEQ ID NO: 146429 - protein, 11 aa, West Nile virus
LSTKAACPTMG

SEQ ID NO: 146430 - protein, 11 aa, West Nile virus
STKAACPTMGE

SEQ ID NO: 146431 - protein, 11 aa, West Nile virus
TKAACPTMGEA

SEQ ID NO: 146432 - protein, 11 aa, West Nile virus
KAACPTMGEAH

SEQ ID NO: 146433 - protein, 11 aa, West Nile virus
AACPTMGEAHN

SEQ ID NO: 146434 - protein, 11 aa, West Nile virus
ACPTMGEAHND

SEQ ID NO: 146435 - protein, 11 aa, West Nile virus
CPTMGEAHNDK

SEQ ID NO: 146436 - protein, 11 aa, West Nile virus
PTMGEAHNDKR

SEQ ID NO: 146437 - protein, 11 aa, West Nile virus
TMGEAHNDKRA

SEQ ID NO: 146438 - protein, 11 aa, West Nile virus
MGEAHNDKRAD

SEQ ID NO: 146439 - protein, 11 aa, West Nile virus
GEAHNDKRADP

SEQ ID NO: 146440 - protein, 11 aa, West Nile virus
FVCRQGVVDRG

SEQ ID NO: 146441 - protein, 11 aa, West Nile virus
VCRQGVVDRGW

SEQ ID NO: 146442 - protein, 11 aa, West Nile virus
CRQGVVDRGWG

SEQ ID NO: 146443 - protein, 11 aa, West Nile virus
RQGVVDRGWGN

SEQ ID NO: 146444 - protein, 11 aa, West Nile virus
QGVVDRGWGNG

SEQ ID NO: 146445 - protein, 11 aa, West Nile virus
GVVDRGWGNGC

SEQ ID NO: 146446 - protein, 11 aa, West Nile virus
VVDRGWGNGCG

SEQ ID NO: 146447 - protein, 11 aa, West Nile virus
VDRGWGNGCGL

SEQ ID NO: 146448 - protein, 11 aa, West Nile virus
DRGWGNGCGLF

SEQ ID NO: 146449 - protein, 11 aa, West Nile virus
RGWGNGCGLFG

SEQ ID NO: 146450 - protein, 11 aa, West Nile virus
GWGNGCGLFGK

SEQ ID NO: 146451 - protein, 11 aa, West Nile virus
WGNGCGLFGKG

SEQ ID NO: 146452 - protein, 11 aa, West Nile virus
GNGCGLFGKGS

SEQ ID NO: 146453 - protein, 11 aa, West Nile virus
NGCGLFGKGSI

SEQ ID NO: 146454 - protein, 11 aa, West Nile virus
GCGLFGKGSID

SEQ ID NO: 146455 - protein, 11 aa, West Nile virus
CGLFGKGSIDT

SEQ ID NO: 146456 - protein, 11 aa, West Nile virus
GLFGKGSIDTC

SEQ ID NO: 146457 - protein, 11 aa, West Nile virus
LFGKGSIDTCA

SEQ ID NO: 146458 - protein, 11 aa, West Nile virus
FGKGSIDTCAK

SEQ ID NO: 146459 - protein, 11 aa, West Nile virus
GKGSIDTCAKF

SEQ ID NO: 146460 - protein, 11 aa, West Nile virus
KGSIDTCAKFA

SEQ ID NO: 146461 - protein, 11 aa, West Nile virus
GSIDTCAKFAC

SEQ ID NO: 146462 - protein, 11 aa, West Nile virus
SIDTCAKFACS

SEQ ID NO: 146463 - protein, 11 aa, West Nile virus
IDTCAKFACST

SEQ ID NO: 146464 - protein, 11 aa, West Nile virus
DTCAKFACSTK

SEQ ID NO: 146465 - protein, 11 aa, West Nile virus
TCAKFACSTKA

SEQ ID NO: 146466 - protein, 11 aa, West Nile virus
CAKFACSTKAI

SEQ ID NO: 146467 - protein, 11 aa, West Nile virus
AKFACSTKAIG

SEQ ID NO: 146468 - protein, 11 aa, West Nile virus
KFACSTKAIGR

SEQ ID NO: 146469 - protein, 11 aa, West Nile virus
FACSTKAIGRT

SEQ ID NO: 146470 - protein, 11 aa, West Nile virus
ACSTKAIGRTI

SEQ ID NO: 146471 - protein, 11 aa, West Nile virus
CSTKAIGRTIL

SEQ ID NO: 146472 - protein, 11 aa, West Nile virus
STKAIGRTILK

SEQ ID NO: 146473 - protein, 11 aa, West Nile virus
TKAIGRTILKE

SEQ ID NO: 146474 - protein, 11 aa, West Nile virus
KAIGRTILKEN

SEQ ID NO: 146475 - protein, 11 aa, West Nile virus
AIGRTILKENI

SEQ ID NO: 146476 - protein, 11 aa, West Nile virus
IGRTILKENIK

SEQ ID NO: 146477 - protein, 11 aa, West Nile virus
GRTILKENIKY

SEQ ID NO: 146478 - protein, 11 aa, West Nile virus
RTILKENIKYE

SEQ ID NO: 146479 - protein, 11 aa, West Nile virus
TILKENIKYEV

SEQ ID NO: 146480 - protein, 11 aa, West Nile virus
ILKENIKYEVA

SEQ ID NO: 146481 - protein, 11 aa, West Nile virus
LKENIKYEVAI

SEQ ID NO: 146482 - protein, 11 aa, West Nile virus
KENIKYEVAIF

SEQ ID NO: 146483 - protein, 11 aa, West Nile virus
ENIKYEVAIFV

SEQ ID NO: 146484 - protein, 11 aa, West Nile virus
NIKYEVAIFVH

SEQ ID NO: 146485 - protein, 11 aa, West Nile virus
IKYEVAIFVHG

SEQ ID NO: 146486 - protein, 11 aa, West Nile virus
KYEVAIFVHGP

SEQ ID NO: 146487 - protein, 11 aa, West Nile virus
YEVAIFVHGPT

SEQ ID NO: 146488 - protein, 11 aa, West Nile virus
EVAIFVHGPTT

SEQ ID NO: 146489 - protein, 11 aa, West Nile virus
VAIFVHGPTTV

SEQ ID NO: 146490 - protein, 11 aa, West Nile virus
AIFVHGPTTVE

SEQ ID NO: 146491 - protein, 11 aa, West Nile virus
IFVHGPTTVES

SEQ ID NO: 146492 - protein, 11 aa, West Nile virus
FVHGPTTVESH

SEQ ID NO: 146493 - protein, 11 aa, West Nile virus
VHGPTTVESHG

SEQ ID NO: 146494 - protein, 11 aa, West Nile virus
GATQAGRFSIT

SEQ ID NO: 146495 - protein, 11 aa, West Nile virus
ATQAGRFSITP

SEQ ID NO: 146496 - protein, 11 aa, West Nile virus
QAGRFSITPAA

SEQ ID NO: 146497 - protein, 11 aa, West Nile virus
AGRFSITPAAP

SEQ ID NO: 146498 - protein, 11 aa, West Nile virus
GRFSITPAAPS

SEQ ID NO: 146499 - protein, 11 aa, West Nile virus
KLGEYGEVTVD

SEQ ID NO: 146500 - protein, 11 aa, West Nile virus
LGEYGEVTVDC

SEQ ID NO: 146501 - protein, 11 aa, West Nile virus
GEYGEVTVDCE

SEQ ID NO: 146502 - protein, 11 aa, West Nile virus
EYGEVTVDCEP

SEQ ID NO: 146503 - protein, 11 aa, West Nile virus
YGEVTVDCEPR

SEQ ID NO: 146504 - protein, 11 aa, West Nile virus
GEVTVDCEPRS

SEQ ID NO: 146505 - protein, 11 aa, West Nile virus
EVTVDCEPRSG

SEQ ID NO: 146506 - protein, 11 aa, West Nile virus
VTVDCEPRSGI

SEQ ID NO: 146507 - protein, 11 aa, West Nile virus
TVDCEPRSGID

SEQ ID NO: 146508 - protein, 11 aa, West Nile virus
VDCEPRSGIDT

SEQ ID NO: 146509 - protein, 11 aa, West Nile virus
DCEPRSGIDTN

SEQ ID NO: 146510 - protein, 11 aa, West Nile virus
CEPRSGIDTNA

SEQ ID NO: 146511 - protein, 11 aa, West Nile virus
EPRSGIDTNAY

SEQ ID NO: 146512 - protein, 11 aa, West Nile virus
PRSGIDTNAYY

SEQ ID NO: 146513 - protein, 11 aa, West Nile virus
RSGIDTNAYYV

SEQ ID NO: 146514 - protein, 11 aa, West Nile virus
SGIDTNAYYVM

SEQ ID NO: 146515 - protein, 11 aa, West Nile virus
GIDTNAYYVMT

SEQ ID NO: 146516 - protein, 11 aa, West Nile virus
IDTNAYYVMTV

SEQ ID NO: 146517 - protein, 11 aa, West Nile virus
DTNAYYVMTVG

SEQ ID NO: 146518 - protein, 11 aa, West Nile virus
KTFLVHREWFM

SEQ ID NO: 146519 - protein, 11 aa, West Nile virus
TFLVHREWFMD

SEQ ID NO: 146520 - protein, 11 aa, West Nile virus
FLVHREWFMDL

SEQ ID NO: 146521 - protein, 11 aa, West Nile virus
LVHREWFMDLN

SEQ ID NO: 146522 - protein, 11 aa, West Nile virus
VHREWFMDLNL

SEQ ID NO: 146523 - protein, 11 aa, West Nile virus
HREWFMDLNLP

SEQ ID NO: 146524 - protein, 11 aa, West Nile virus
REWFMDLNLPW

SEQ ID NO: 146525 - protein, 11 aa, West Nile virus
EWFMDLNLPWS

SEQ ID NO: 146526 - protein, 11 aa, West Nile virus
WFMDLNLPWSS

SEQ ID NO: 146527 - protein, 11 aa, West Nile virus
FMDLNLPWSSA

SEQ ID NO: 146528 - protein, 11 aa, West Nile virus
MDLNLPWSSAG

SEQ ID NO: 146529 - protein, 11 aa, West Nile virus
DLNLPWSSAGS

SEQ ID NO: 146530 - protein, 11 aa, West Nile virus
LNLPWSSAGST

SEQ ID NO: 146531 - protein, 11 aa, West Nile virus
WRNRETLMEFE

SEQ ID NO: 146532 - protein, 11 aa, West Nile virus
RNRETLMEFEE

SEQ ID NO: 146533 - protein, 11 aa, West Nile virus
NRETLMEFEEP

SEQ ID NO: 146534 - protein, 11 aa, West Nile virus
RETLMEFEEPH

SEQ ID NO: 146535 - protein, 11 aa, West Nile virus
ETLMEFEEPHA

SEQ ID NO: 146536 - protein, 11 aa, West Nile virus
TLMEFEEPHAT

SEQ ID NO: 146537 - protein, 11 aa, West Nile virus
LMEFEEPHATK

SEQ ID NO: 146538 - protein, 11 aa, West Nile virus
MEFEEPHATKQ

SEQ ID NO: 146539 - protein, 11 aa, West Nile virus
EFEEPHATKQS

SEQ ID NO: 146540 - protein, 11 aa, West Nile virus
FEEPHATKQSV

SEQ ID NO: 146541 - protein, 11 aa, West Nile virus
EEPHATKQSVI

SEQ ID NO: 146542 - protein, 11 aa, West Nile virus
EPHATKQSVIA

SEQ ID NO: 146543 - protein, 11 aa, West Nile virus
PHATKQSVIAL

SEQ ID NO: 146544 - protein, 11 aa, West Nile virus
HATKQSVIALG

SEQ ID NO: 146545 - protein, 11 aa, West Nile virus
ATKQSVIALGS

SEQ ID NO: 146546 - protein, 11 aa, West Nile virus
TKQSVIALGSQ

SEQ ID NO: 146547 - protein, 11 aa, West Nile virus
KQSVIALGSQE

SEQ ID NO: 146548 - protein, 11 aa, West Nile virus
QSVIALGSQEG

SEQ ID NO: 146549 - protein, 11 aa, West Nile virus
SVIALGSQEGA

SEQ ID NO: 146550 - protein, 11 aa, West Nile virus
VIALGSQEGAL

SEQ ID NO: 146551 - protein, 11 aa, West Nile virus
IALGSQEGALH

SEQ ID NO: 146552 - protein, 11 aa, West Nile virus
ALGSQEGALHQ

SEQ ID NO: 146553 - protein, 11 aa, West Nile virus
LGSQEGALHQA

SEQ ID NO: 146554 - protein, 11 aa, West Nile virus
GSQEGALHQAL

SEQ ID NO: 146555 - protein, 11 aa, West Nile virus
SQEGALHQALA

SEQ ID NO: 146556 - protein, 11 aa, West Nile virus
QEGALHQALAG

SEQ ID NO: 146557 - protein, 11 aa, West Nile virus
EGALHQALAGA

SEQ ID NO: 146558 - protein, 11 aa, West Nile virus
GALHQALAGAI

SEQ ID NO: 146559 - protein, 11 aa, West Nile virus
ALHQALAGAIP

SEQ ID NO: 146560 - protein, 11 aa, West Nile virus
LHQALAGAIPV

SEQ ID NO: 146561 - protein, 11 aa, West Nile virus
HQALAGAIPVE

SEQ ID NO: 146562 - protein, 11 aa, West Nile virus
QALAGAIPVEF

SEQ ID NO: 146563 - protein, 11 aa, West Nile virus
ALAGAIPVEFS

SEQ ID NO: 146564 - protein, 11 aa, West Nile virus
LAGAIPVEFSS

SEQ ID NO: 146565 - protein, 11 aa, West Nile virus
AGAIPVEFSSN

SEQ ID NO: 146566 - protein, 11 aa, West Nile virus
GAIPVEFSSNT

SEQ ID NO: 146567 - protein, 11 aa, West Nile virus
AIPVEFSSNTV

SEQ ID NO: 146568 - protein, 11 aa, West Nile virus
IPVEFSSNTVK

SEQ ID NO: 146569 - protein, 11 aa, West Nile virus
PVEFSSNTVKL

SEQ ID NO: 146570 - protein, 11 aa, West Nile virus
VEFSSNTVKLT

SEQ ID NO: 146571 - protein, 11 aa, West Nile virus
EFSSNTVKLTS

SEQ ID NO: 146572 - protein, 11 aa, West Nile virus
FSSNTVKLTSG

SEQ ID NO: 146573 - protein, 11 aa, West Nile virus
SSNTVKLTSGH

SEQ ID NO: 146574 - protein, 11 aa, West Nile virus
SNTVKLTSGHL

SEQ ID NO: 146575 - protein, 11 aa, West Nile virus
NTVKLTSGHLK

SEQ ID NO: 146576 - protein, 11 aa, West Nile virus
TVKLTSGHLKC

SEQ ID NO: 146577 - protein, 11 aa, West Nile virus
VKLTSGHLKCR

SEQ ID NO: 146578 - protein, 11 aa, West Nile virus
KLTSGHLKCRV

SEQ ID NO: 146579 - protein, 11 aa, West Nile virus
LTSGHLKCRVK

SEQ ID NO: 146580 - protein, 11 aa, West Nile virus
TSGHLKCRVKM

SEQ ID NO: 146581 - protein, 11 aa, West Nile virus
SGHLKCRVKME

SEQ ID NO: 146582 - protein, 11 aa, West Nile virus
GHLKCRVKMEK

SEQ ID NO: 146583 - protein, 11 aa, West Nile virus
HLKCRVKMEKL

SEQ ID NO: 146584 - protein, 11 aa, West Nile virus
LKCRVKMEKLQ

SEQ ID NO: 146585 - protein, 11 aa, West Nile virus
KCRVKMEKLQL

SEQ ID NO: 146586 - protein, 11 aa, West Nile virus
CRVKMEKLQLK

SEQ ID NO: 146587 - protein, 11 aa, West Nile virus
RVKMEKLQLKG

SEQ ID NO: 146588 - protein, 11 aa, West Nile virus
VKMEKLQLKGT

SEQ ID NO: 146589 - protein, 11 aa, West Nile virus
KMEKLQLKGTT

SEQ ID NO: 146590 - protein, 11 aa, West Nile virus
MEKLQLKGTTY

SEQ ID NO: 146591 - protein, 11 aa, West Nile virus
EKLQLKGTTYG

SEQ ID NO: 146592 - protein, 11 aa, West Nile virus
KLQLKGTTYGV

SEQ ID NO: 146593 - protein, 11 aa, West Nile virus
LQLKGTTYGVC

SEQ ID NO: 146594 - protein, 11 aa, West Nile virus
QLKGTTYGVCS

SEQ ID NO: 146595 - protein, 11 aa, West Nile virus
LKGTTYGVCSK

SEQ ID NO: 146596 - protein, 11 aa, West Nile virus
KGTTYGVCSKA

SEQ ID NO: 146597 - protein, 11 aa, West Nile virus
GTTYGVCSKAF

SEQ ID NO: 146598 - protein, 11 aa, West Nile virus
TTYGVCSKAFK

SEQ ID NO: 146599 - protein, 11 aa, West Nile virus
TYGVCSKAFKF

SEQ ID NO: 146600 - protein, 11 aa, West Nile virus
GTPADTGHGTV

SEQ ID NO: 146601 - protein, 11 aa, West Nile virus
TPADTGHGTVV

SEQ ID NO: 146602 - protein, 11 aa, West Nile virus
PADTGHGTVVL

SEQ ID NO: 146603 - protein, 11 aa, West Nile virus
ADTGHGTVVLE

SEQ ID NO: 146604 - protein, 11 aa, West Nile virus
DTGHGTVVLEL

SEQ ID NO: 146605 - protein, 11 aa, West Nile virus
TGHGTVVLELQ

SEQ ID NO: 146606 - protein, 11 aa, West Nile virus
GHGTVVLELQY

SEQ ID NO: 146607 - protein, 11 aa, West Nile virus
HGTVVLELQYT

SEQ ID NO: 146608 - protein, 11 aa, West Nile virus
GTVVLELQYTG

SEQ ID NO: 146609 - protein, 11 aa, West Nile virus
TVVLELQYTGT

SEQ ID NO: 146610 - protein, 11 aa, West Nile virus
VVLELQYTGTD

SEQ ID NO: 146611 - protein, 11 aa, West Nile virus
VLELQYTGTDG

SEQ ID NO: 146612 - protein, 11 aa, West Nile virus
LELQYTGTDGP

SEQ ID NO: 146613 - protein, 11 aa, West Nile virus
ELQYTGTDGPC

SEQ ID NO: 146614 - protein, 11 aa, West Nile virus
LQYTGTDGPCK

SEQ ID NO: 146615 - protein, 11 aa, West Nile virus
QYTGTDGPCKV

SEQ ID NO: 146616 - protein, 11 aa, West Nile virus
YTGTDGPCKVP

SEQ ID NO: 146617 - protein, 11 aa, West Nile virus
TGTDGPCKVPI

SEQ ID NO: 146618 - protein, 11 aa, West Nile virus
GTDGPCKVPIS

SEQ ID NO: 146619 - protein, 11 aa, West Nile virus
TDGPCKVPISS

SEQ ID NO: 146620 - protein, 11 aa, West Nile virus
DGPCKVPISSV

SEQ ID NO: 146621 - protein, 11 aa, West Nile virus
GPCKVPISSVA

SEQ ID NO: 146622 - protein, 11 aa, West Nile virus
PCKVPISSVAS

SEQ ID NO: 146623 - protein, 11 aa, West Nile virus
CKVPISSVASL

SEQ ID NO: 146624 - protein, 11 aa, West Nile virus
KVPISSVASLN

SEQ ID NO: 146625 - protein, 11 aa, West Nile virus
VPISSVASLND

SEQ ID NO: 146626 - protein, 11 aa, West Nile virus
PISSVASLNDL

SEQ ID NO: 146627 - protein, 11 aa, West Nile virus
ISSVASLNDLT

SEQ ID NO: 146628 - protein, 11 aa, West Nile virus
SSVASLNDLTP

SEQ ID NO: 146629 - protein, 11 aa, West Nile virus
SVASLNDLTPV

SEQ ID NO: 146630 - protein, 11 aa, West Nile virus
VASLNDLTPVG

SEQ ID NO: 146631 - protein, 11 aa, West Nile virus
ASLNDLTPVGR

SEQ ID NO: 146632 - protein, 11 aa, West Nile virus
SLNDLTPVGRL

SEQ ID NO: 146633 - protein, 11 aa, West Nile virus
LNDLTPVGRLV

SEQ ID NO: 146634 - protein, 11 aa, West Nile virus
NDLTPVGRLVT

SEQ ID NO: 146635 - protein, 11 aa, West Nile virus
DLTPVGRLVTV

SEQ ID NO: 146636 - protein, 11 aa, West Nile virus
LTPVGRLVTVN

SEQ ID NO: 146637 - protein, 11 aa, West Nile virus
TPVGRLVTVNP

SEQ ID NO: 146638 - protein, 11 aa, West Nile virus
PVGRLVTVNPF

SEQ ID NO: 146639 - protein, 11 aa, West Nile virus
VGRLVTVNPFV

SEQ ID NO: 146640 - protein, 11 aa, West Nile virus
GRLVTVNPFVS

SEQ ID NO: 146641 - protein, 11 aa, West Nile virus
RLVTVNPFVSV

SEQ ID NO: 146642 - protein, 11 aa, West Nile virus
LVTVNPFVSVA

SEQ ID NO: 146643 - protein, 11 aa, West Nile virus
VTVNPFVSVAT

SEQ ID NO: 146644 - protein, 11 aa, West Nile virus
TVNPFVSVATA

SEQ ID NO: 146645 - protein, 11 aa, West Nile virus
TANAKVLIELE

SEQ ID NO: 146646 - protein, 11 aa, West Nile virus
ANAKVLIELEP

SEQ ID NO: 146647 - protein, 11 aa, West Nile virus
NAKVLIELEPP

SEQ ID NO: 146648 - protein, 11 aa, West Nile virus
AKVLIELEPPF

SEQ ID NO: 146649 - protein, 11 aa, West Nile virus
KVLIELEPPFG

SEQ ID NO: 146650 - protein, 11 aa, West Nile virus
VLIELEPPFGD

SEQ ID NO: 146651 - protein, 11 aa, West Nile virus
LIELEPPFGDS

SEQ ID NO: 146652 - protein, 11 aa, West Nile virus
IELEPPFGDSY

SEQ ID NO: 146653 - protein, 11 aa, West Nile virus
ELEPPFGDSYI

SEQ ID NO: 146654 - protein, 11 aa, West Nile virus
LEPPFGDSYIV

SEQ ID NO: 146655 - protein, 11 aa, West Nile virus
EPPFGDSYIVV

SEQ ID NO: 146656 - protein, 11 aa, West Nile virus
PPFGDSYIVVG

SEQ ID NO: 146657 - protein, 11 aa, West Nile virus
PFGDSYIVVGR

SEQ ID NO: 146658 - protein, 11 aa, West Nile virus
FGDSYIVVGRG

SEQ ID NO: 146659 - protein, 11 aa, West Nile virus
GDSYIVVGRGE

SEQ ID NO: 146660 - protein, 11 aa, West Nile virus
DSYIVVGRGEQ

SEQ ID NO: 146661 - protein, 11 aa, West Nile virus
SYIVVGRGEQQ

SEQ ID NO: 146662 - protein, 11 aa, West Nile virus
YIVVGRGEQQI

SEQ ID NO: 146663 - protein, 11 aa, West Nile virus
IVVGRGEQQIN

SEQ ID NO: 146664 - protein, 11 aa, West Nile virus
VVGRGEQQINH

SEQ ID NO: 146665 - protein, 11 aa, West Nile virus
VGRGEQQINHH

SEQ ID NO: 146666 - protein, 11 aa, West Nile virus
GRGEQQINHHW

SEQ ID NO: 146667 - protein, 11 aa, West Nile virus
RGEQQINHHWH

SEQ ID NO: 146668 - protein, 11 aa, West Nile virus
GEQQINHHWHK

SEQ ID NO: 146669 - protein, 11 aa, West Nile virus
EQQINHHWHKS

SEQ ID NO: 146670 - protein, 11 aa, West Nile virus
QQINHHWHKSG

SEQ ID NO: 146671 - protein, 11 aa, West Nile virus
QINHHWHKSGS

SEQ ID NO: 146672 - protein, 11 aa, West Nile virus
INHHWHKSGSS

SEQ ID NO: 146673 - protein, 11 aa, West Nile virus
NHHWHKSGSSI

SEQ ID NO: 146674 - protein, 11 aa, West Nile virus
HHWHKSGSSIG

SEQ ID NO: 146675 - protein, 11 aa, West Nile virus
HWHKSGSSIGK

SEQ ID NO: 146676 - protein, 11 aa, West Nile virus
WHKSGSSIGKA

SEQ ID NO: 146677 - protein, 11 aa, West Nile virus
HKSGSSIGKAF

SEQ ID NO: 146678 - protein, 11 aa, West Nile virus
KSGSSIGKAFT

SEQ ID NO: 146679 - protein, 11 aa, West Nile virus
SGSSIGKAFTT

SEQ ID NO: 146680 - protein, 11 aa, West Nile virus
GSSIGKAFTTT

SEQ ID NO: 146681 - protein, 11 aa, West Nile virus
SSIGKAFTTTL

SEQ ID NO: 146682 - protein, 11 aa, West Nile virus
SIGKAFTTTLK

SEQ ID NO: 146683 - protein, 11 aa, West Nile virus
IGKAFTTTLKG

SEQ ID NO: 146684 - protein, 11 aa, West Nile virus
GKAFTTTLKGA

SEQ ID NO: 146685 - protein, 11 aa, West Nile virus
KAFTTTLKGAQ

SEQ ID NO: 146686 - protein, 11 aa, West Nile virus
AFTTTLKGAQR

SEQ ID NO: 146687 - protein, 11 aa, West Nile virus
FTTTLKGAQRL

SEQ ID NO: 146688 - protein, 11 aa, West Nile virus
TTTLKGAQRLA

SEQ ID NO: 146689 - protein, 11 aa, West Nile virus
TTLKGAQRLAA

SEQ ID NO: 146690 - protein, 11 aa, West Nile virus
TLKGAQRLAAL

SEQ ID NO: 146691 - protein, 11 aa, West Nile virus
LKGAQRLAALG

SEQ ID NO: 146692 - protein, 11 aa, West Nile virus
KGAQRLAALGD

SEQ ID NO: 146693 - protein, 11 aa, West Nile virus
GAQRLAALGDT

SEQ ID NO: 146694 - protein, 11 aa, West Nile virus
AQRLAALGDTA

SEQ ID NO: 146695 - protein, 11 aa, West Nile virus
QRLAALGDTAW

SEQ ID NO: 146696 - protein, 11 aa, West Nile virus
RLAALGDTAWD

SEQ ID NO: 146697 - protein, 11 aa, West Nile virus
LAALGDTAWDF

SEQ ID NO: 146698 - protein, 11 aa, West Nile virus
AALGDTAWDFG

SEQ ID NO: 146699 - protein, 11 aa, West Nile virus
ALGDTAWDFGS

SEQ ID NO: 146700 - protein, 11 aa, West Nile virus
LGDTAWDFGSV

SEQ ID NO: 146701 - protein, 11 aa, West Nile virus
GDTAWDFGSVG

SEQ ID NO: 146702 - protein, 11 aa, West Nile virus
DTAWDFGSVGG

SEQ ID NO: 146703 - protein, 11 aa, West Nile virus
TAWDFGSVGGV

SEQ ID NO: 146704 - protein, 11 aa, West Nile virus
AWDFGSVGGVF

SEQ ID NO: 146705 - protein, 11 aa, West Nile virus
WDFGSVGGVFT

SEQ ID NO: 146706 - protein, 11 aa, West Nile virus
DFGSVGGVFTS

SEQ ID NO: 146707 - protein, 11 aa, West Nile virus
FGSVGGVFTSV

SEQ ID NO: 146708 - protein, 11 aa, West Nile virus
GSVGGVFTSVG

SEQ ID NO: 146709 - protein, 11 aa, West Nile virus
SVGGVFTSVGK

SEQ ID NO: 146710 - protein, 11 aa, West Nile virus
VGGVFTSVGKA

SEQ ID NO: 146711 - protein, 11 aa, West Nile virus
GGVFTSVGKAV

SEQ ID NO: 146712 - protein, 11 aa, West Nile virus
GVFTSVGKAVH

SEQ ID NO: 146713 - protein, 11 aa, West Nile virus
VFTSVGKAVHQ

SEQ ID NO: 146714 - protein, 11 aa, West Nile virus
FTSVGKAVHQV

SEQ ID NO: 146715 - protein, 11 aa, West Nile virus
TSVGKAVHQVF

SEQ ID NO: 146716 - protein, 11 aa, West Nile virus
SVGKAVHQVFG

SEQ ID NO: 146717 - protein, 11 aa, West Nile virus
VGKAVHQVFGG

SEQ ID NO: 146718 - protein, 11 aa, West Nile virus
GKAVHQVFGGA

SEQ ID NO: 146719 - protein, 11 aa, West Nile virus
KAVHQVFGGAF

SEQ ID NO: 146720 - protein, 11 aa, West Nile virus
AVHQVFGGAFR

SEQ ID NO: 146721 - protein, 11 aa, West Nile virus
VHQVFGGAFRS

SEQ ID NO: 146722 - protein, 11 aa, West Nile virus
HQVFGGAFRSL

SEQ ID NO: 146723 - protein, 11 aa, West Nile virus
QVFGGAFRSLF

SEQ ID NO: 146724 - protein, 11 aa, West Nile virus
VFGGAFRSLFG

SEQ ID NO: 146725 - protein, 11 aa, West Nile virus
FGGAFRSLFGG

SEQ ID NO: 146726 - protein, 11 aa, West Nile virus
GGAFRSLFGGM

SEQ ID NO: 146727 - protein, 11 aa, West Nile virus
GAFRSLFGGMS

SEQ ID NO: 146728 - protein, 11 aa, West Nile virus
AFRSLFGGMSW

SEQ ID NO: 146729 - protein, 11 aa, West Nile virus
FRSLFGGMSWI

SEQ ID NO: 146730 - protein, 11 aa, West Nile virus
RSLFGGMSWIT

SEQ ID NO: 146731 - protein, 11 aa, West Nile virus
SLFGGMSWITQ

SEQ ID NO: 146732 - protein, 11 aa, West Nile virus
LFGGMSWITQG

SEQ ID NO: 146733 - protein, 11 aa, West Nile virus
FGGMSWITQGL

SEQ ID NO: 146734 - protein, 11 aa, West Nile virus
GGMSWITQGLL

SEQ ID NO: 146735 - protein, 11 aa, West Nile virus
GMSWITQGLLG

SEQ ID NO: 146736 - protein, 11 aa, West Nile virus
MSWITQGLLGA

SEQ ID NO: 146737 - protein, 11 aa, West Nile virus
SWITQGLLGAL

SEQ ID NO: 146738 - protein, 11 aa, West Nile virus
WITQGLLGALL

SEQ ID NO: 146739 - protein, 11 aa, West Nile virus
ITQGLLGALLL

SEQ ID NO: 146740 - protein, 11 aa, West Nile virus
TQGLLGALLLW

SEQ ID NO: 146741 - protein, 11 aa, West Nile virus
QGLLGALLLWM

SEQ ID NO: 146742 - protein, 11 aa, West Nile virus
GLLGALLLWMG

SEQ ID NO: 146743 - protein, 11 aa, West Nile virus
LLGALLLWMGI

SEQ ID NO: 146744 - protein, 11 aa, West Nile virus
LGALLLWMGIN

SEQ ID NO: 146745 - protein, 11 aa, West Nile virus
GALLLWMGINA

SEQ ID NO: 146746 - protein, 11 aa, West Nile virus
ALLLWMGINAR

SEQ ID NO: 146747 - protein, 11 aa, West Nile virus
LLLWMGINARD

SEQ ID NO: 146748 - protein, 11 aa, West Nile virus
LLWMGINARDR

SEQ ID NO: 146749 - protein, 11 aa, West Nile virus
LWMGINARDRS

SEQ ID NO: 146750 - protein, 11 aa, West Nile virus
WMGINARDRSI

SEQ ID NO: 146751 - protein, 11 aa, West Nile virus
MGINARDRSIA

SEQ ID NO: 146752 - protein, 11 aa, West Nile virus
ARDRSIALTFL

SEQ ID NO: 146753 - protein, 11 aa, West Nile virus
RDRSIALTFLA

SEQ ID NO: 146754 - protein, 11 aa, West Nile virus
DRSIALTFLAV

SEQ ID NO: 146755 - protein, 11 aa, West Nile virus
RSIALTFLAVG

SEQ ID NO: 146756 - protein, 11 aa, West Nile virus
SIALTFLAVGG

SEQ ID NO: 146757 - protein, 11 aa, West Nile virus
IALTFLAVGGV

SEQ ID NO: 146758 - protein, 11 aa, West Nile virus
ALTFLAVGGVL

SEQ ID NO: 146759 - protein, 11 aa, West Nile virus
LTFLAVGGVLL

SEQ ID NO: 146760 - protein, 11 aa, West Nile virus
TFLAVGGVLLF

SEQ ID NO: 146761 - protein, 11 aa, West Nile virus
FLAVGGVLLFL

SEQ ID NO: 146762 - protein, 11 aa, West Nile virus
LAVGGVLLFLS

SEQ ID NO: 146763 - protein, 11 aa, West Nile virus
AVGGVLLFLSV

SEQ ID NO: 146764 - protein, 11 aa, West Nile virus
VGGVLLFLSVN

SEQ ID NO: 146765 - protein, 11 aa, West Nile virus
GGVLLFLSVNV

SEQ ID NO: 146766 - protein, 11 aa, West Nile virus
GVLLFLSVNVH

SEQ ID NO: 146767 - protein, 11 aa, West Nile virus
VLLFLSVNVHA

SEQ ID NO: 146768 - protein, 11 aa, West Nile virus
LLFLSVNVHAD

SEQ ID NO: 146769 - protein, 11 aa, West Nile virus
LFLSVNVHADT

SEQ ID NO: 146770 - protein, 11 aa, West Nile virus
FLSVNVHADTG

SEQ ID NO: 146771 - protein, 11 aa, West Nile virus
LSVNVHADTGC

SEQ ID NO: 146772 - protein, 11 aa, West Nile virus
SVNVHADTGCA

SEQ ID NO: 146773 - protein, 11 aa, West Nile virus
VNVHADTGCAI

SEQ ID NO: 146774 - protein, 11 aa, West Nile virus
NVHADTGCAID

SEQ ID NO: 146775 - protein, 11 aa, West Nile virus
VHADTGCAIDI

SEQ ID NO: 146776 - protein, 11 aa, West Nile virus
HADTGCAIDIS

SEQ ID NO: 146777 - protein, 11 aa, West Nile virus
ADTGCAIDISR

SEQ ID NO: 146778 - protein, 11 aa, West Nile virus
DTGCAIDISRQ

SEQ ID NO: 146779 - protein, 11 aa, West Nile virus
TGCAIDISRQE

SEQ ID NO: 146780 - protein, 11 aa, West Nile virus
GCAIDISRQEL

SEQ ID NO: 146781 - protein, 11 aa, West Nile virus
CAIDISRQELR

SEQ ID NO: 146782 - protein, 11 aa, West Nile virus
AIDISRQELRC

SEQ ID NO: 146783 - protein, 11 aa, West Nile virus
IDISRQELRCG

SEQ ID NO: 146784 - protein, 11 aa, West Nile virus
SRQELRCGSGV

SEQ ID NO: 146785 - protein, 11 aa, West Nile virus
RQELRCGSGVF

SEQ ID NO: 146786 - protein, 11 aa, West Nile virus
QELRCGSGVFI

SEQ ID NO: 146787 - protein, 11 aa, West Nile virus
ELRCGSGVFIH

SEQ ID NO: 146788 - protein, 11 aa, West Nile virus
LRCGSGVFIHN

SEQ ID NO: 146789 - protein, 11 aa, West Nile virus
RCGSGVFIHND

SEQ ID NO: 146790 - protein, 11 aa, West Nile virus
CGSGVFIHNDV

SEQ ID NO: 146791 - protein, 11 aa, West Nile virus
GSGVFIHNDVE

SEQ ID NO: 146792 - protein, 11 aa, West Nile virus
SGVFIHNDVEA

SEQ ID NO: 146793 - protein, 11 aa, West Nile virus
GVFIHNDVEAW

SEQ ID NO: 146794 - protein, 11 aa, West Nile virus
NDVEAWMDRYK

SEQ ID NO: 146795 - protein, 11 aa, West Nile virus
DRYKYYPETPQ

SEQ ID NO: 146796 - protein, 11 aa, West Nile virus
RYKYYPETPQG

SEQ ID NO: 146797 - protein, 11 aa, West Nile virus
YKYYPETPQGL

SEQ ID NO: 146798 - protein, 11 aa, West Nile virus
KYYPETPQGLA

SEQ ID NO: 146799 - protein, 11 aa, West Nile virus
YPETPQGLAKI

SEQ ID NO: 146800 - protein, 11 aa, West Nile virus
PETPQGLAKII

SEQ ID NO: 146801 - protein, 11 aa, West Nile virus
ETPQGLAKIIQ

SEQ ID NO: 146802 - protein, 11 aa, West Nile virus
TPQGLAKIIQK

SEQ ID NO: 146803 - protein, 11 aa, West Nile virus
PQGLAKIIQKA

SEQ ID NO: 146804 - protein, 11 aa, West Nile virus
QGLAKIIQKAH

SEQ ID NO: 146805 - protein, 11 aa, West Nile virus
EGVCGLRSVSR

SEQ ID NO: 146806 - protein, 11 aa, West Nile virus
GVCGLRSVSRL

SEQ ID NO: 146807 - protein, 11 aa, West Nile virus
VCGLRSVSRLE

SEQ ID NO: 146808 - protein, 11 aa, West Nile virus
CGLRSVSRLEH

SEQ ID NO: 146809 - protein, 11 aa, West Nile virus
GLRSVSRLEHQ

SEQ ID NO: 146810 - protein, 11 aa, West Nile virus
LRSVSRLEHQM

SEQ ID NO: 146811 - protein, 11 aa, West Nile virus
RSVSRLEHQMW

SEQ ID NO: 146812 - protein, 11 aa, West Nile virus
SVSRLEHQMWE

SEQ ID NO: 146813 - protein, 11 aa, West Nile virus
VSRLEHQMWEA

SEQ ID NO: 146814 - protein, 11 aa, West Nile virus
SRLEHQMWEAV

SEQ ID NO: 146815 - protein, 11 aa, West Nile virus
RLEHQMWEAVK

SEQ ID NO: 146816 - protein, 11 aa, West Nile virus
LEHQMWEAVKD

SEQ ID NO: 146817 - protein, 11 aa, West Nile virus
EHQMWEAVKDE

SEQ ID NO: 146818 - protein, 11 aa, West Nile virus
HQMWEAVKDEL

SEQ ID NO: 146819 - protein, 11 aa, West Nile virus
QMWEAVKDELN

SEQ ID NO: 146820 - protein, 11 aa, West Nile virus
MWEAVKDELNT

SEQ ID NO: 146821 - protein, 11 aa, West Nile virus
AVKDELNTLLK

SEQ ID NO: 146822 - protein, 11 aa, West Nile virus
VKDELNTLLKE

SEQ ID NO: 146823 - protein, 11 aa, West Nile virus
KDELNTLLKEN

SEQ ID NO: 146824 - protein, 11 aa, West Nile virus
DELNTLLKENG

SEQ ID NO: 146825 - protein, 11 aa, West Nile virus
ELNTLLKENGV

SEQ ID NO: 146826 - protein, 11 aa, West Nile virus
LNTLLKENGVD

SEQ ID NO: 146827 - protein, 11 aa, West Nile virus
NTLLKENGVDL

SEQ ID NO: 146828 - protein, 11 aa, West Nile virus
TLLKENGVDLS

SEQ ID NO: 146829 - protein, 11 aa, West Nile virus
LKENGVDLSVV

SEQ ID NO: 146830 - protein, 11 aa, West Nile virus
KENGVDLSVVV

SEQ ID NO: 146831 - protein, 11 aa, West Nile virus
ENGVDLSVVVE

SEQ ID NO: 146832 - protein, 11 aa, West Nile virus
NGVDLSVVVEK

SEQ ID NO: 146833 - protein, 11 aa, West Nile virus
GVDLSVVVEKQ

SEQ ID NO: 146834 - protein, 11 aa, West Nile virus
ATTEKLEIGWK

SEQ ID NO: 146835 - protein, 11 aa, West Nile virus
TTEKLEIGWKA

SEQ ID NO: 146836 - protein, 11 aa, West Nile virus
TEKLEIGWKAW

SEQ ID NO: 146837 - protein, 11 aa, West Nile virus
EKLEIGWKAWG

SEQ ID NO: 146838 - protein, 11 aa, West Nile virus
KLEIGWKAWGK

SEQ ID NO: 146839 - protein, 11 aa, West Nile virus
LEIGWKAWGKS

SEQ ID NO: 146840 - protein, 11 aa, West Nile virus
EIGWKAWGKSI

SEQ ID NO: 146841 - protein, 11 aa, West Nile virus
IGWKAWGKSIL

SEQ ID NO: 146842 - protein, 11 aa, West Nile virus
GWKAWGKSILF

SEQ ID NO: 146843 - protein, 11 aa, West Nile virus
WKAWGKSILFA

SEQ ID NO: 146844 - protein, 11 aa, West Nile virus
KAWGKSILFAP

SEQ ID NO: 146845 - protein, 11 aa, West Nile virus
AWGKSILFAPE

SEQ ID NO: 146846 - protein, 11 aa, West Nile virus
WGKSILFAPEL

SEQ ID NO: 146847 - protein, 11 aa, West Nile virus
GKSILFAPELA

SEQ ID NO: 146848 - protein, 11 aa, West Nile virus
KSILFAPELAN

SEQ ID NO: 146849 - protein, 11 aa, West Nile virus
FAPELANNTFV

SEQ ID NO: 146850 - protein, 11 aa, West Nile virus
APELANNTFVV

SEQ ID NO: 146851 - protein, 11 aa, West Nile virus
PELANNTFVVD

SEQ ID NO: 146852 - protein, 11 aa, West Nile virus
ELANNTFVVDG

SEQ ID NO: 146853 - protein, 11 aa, West Nile virus
ANNTFVVDGPE

SEQ ID NO: 146854 - protein, 11 aa, West Nile virus
NNTFVVDGPET

SEQ ID NO: 146855 - protein, 11 aa, West Nile virus
TFVVDGPETKE

SEQ ID NO: 146856 - protein, 11 aa, West Nile virus
FVVDGPETKEC

SEQ ID NO: 146857 - protein, 11 aa, West Nile virus
VVDGPETKECP

SEQ ID NO: 146858 - protein, 11 aa, West Nile virus
NRAWNSLEVED

SEQ ID NO: 146859 - protein, 11 aa, West Nile virus
RAWNSLEVEDF

SEQ ID NO: 146860 - protein, 11 aa, West Nile virus
AWNSLEVEDFG

SEQ ID NO: 146861 - protein, 11 aa, West Nile virus
WNSLEVEDFGF

SEQ ID NO: 146862 - protein, 11 aa, West Nile virus
NSLEVEDFGFG

SEQ ID NO: 146863 - protein, 11 aa, West Nile virus
SLEVEDFGFGL

SEQ ID NO: 146864 - protein, 11 aa, West Nile virus
LEVEDFGFGLT

SEQ ID NO: 146865 - protein, 11 aa, West Nile virus
EVEDFGFGLTS

SEQ ID NO: 146866 - protein, 11 aa, West Nile virus
VEDFGFGLTST

SEQ ID NO: 146867 - protein, 11 aa, West Nile virus
EDFGFGLTSTR

SEQ ID NO: 146868 - protein, 11 aa, West Nile virus
DFGFGLTSTRM

SEQ ID NO: 146869 - protein, 11 aa, West Nile virus
FGFGLTSTRMF

SEQ ID NO: 146870 - protein, 11 aa, West Nile virus
GFGLTSTRMFL

SEQ ID NO: 146871 - protein, 11 aa, West Nile virus
FGLTSTRMFLK

SEQ ID NO: 146872 - protein, 11 aa, West Nile virus
NTTECDSKIIG

SEQ ID NO: 146873 - protein, 11 aa, West Nile virus
TTECDSKIIGT

SEQ ID NO: 146874 - protein, 11 aa, West Nile virus
TECDSKIIGTA

SEQ ID NO: 146875 - protein, 11 aa, West Nile virus
ECDSKIIGTAV

SEQ ID NO: 146876 - protein, 11 aa, West Nile virus
CDSKIIGTAVK

SEQ ID NO: 146877 - protein, 11 aa, West Nile virus
DSKIIGTAVKN

SEQ ID NO: 146878 - protein, 11 aa, West Nile virus
SKIIGTAVKNN

SEQ ID NO: 146879 - protein, 11 aa, West Nile virus
KIIGTAVKNNL

SEQ ID NO: 146880 - protein, 11 aa, West Nile virus
IIGTAVKNNLA

SEQ ID NO: 146881 - protein, 11 aa, West Nile virus
IGTAVKNNLAI

SEQ ID NO: 146882 - protein, 11 aa, West Nile virus
GTAVKNNLAIH

SEQ ID NO: 146883 - protein, 11 aa, West Nile virus
TAVKNNLAIHS

SEQ ID NO: 146884 - protein, 11 aa, West Nile virus
AVKNNLAIHSD

SEQ ID NO: 146885 - protein, 11 aa, West Nile virus
VKNNLAIHSDL

SEQ ID NO: 146886 - protein, 11 aa, West Nile virus
KNNLAIHSDLS

SEQ ID NO: 146887 - protein, 11 aa, West Nile virus
NNLAIHSDLSY

SEQ ID NO: 146888 - protein, 11 aa, West Nile virus
NLAIHSDLSYW

SEQ ID NO: 146889 - protein, 11 aa, West Nile virus
LAIHSDLSYWI

SEQ ID NO: 146890 - protein, 11 aa, West Nile virus
AIHSDLSYWIE

SEQ ID NO: 146891 - protein, 11 aa, West Nile virus
IHSDLSYWIES

SEQ ID NO: 146892 - protein, 11 aa, West Nile virus
HSDLSYWIESR

SEQ ID NO: 146893 - protein, 11 aa, West Nile virus
SDLSYWIESRL

SEQ ID NO: 146894 - protein, 11 aa, West Nile virus
DLSYWIESRLN

SEQ ID NO: 146895 - protein, 11 aa, West Nile virus
LNDTWKLERAV

SEQ ID NO: 146896 - protein, 11 aa, West Nile virus
NDTWKLERAVL

SEQ ID NO: 146897 - protein, 11 aa, West Nile virus
DTWKLERAVLG

SEQ ID NO: 146898 - protein, 11 aa, West Nile virus
TWKLERAVLGE

SEQ ID NO: 146899 - protein, 11 aa, West Nile virus
WKLERAVLGEV

SEQ ID NO: 146900 - protein, 11 aa, West Nile virus
KLERAVLGEVK

SEQ ID NO: 146901 - protein, 11 aa, West Nile virus
LERAVLGEVKS

SEQ ID NO: 146902 - protein, 11 aa, West Nile virus
ERAVLGEVKSC

SEQ ID NO: 146903 - protein, 11 aa, West Nile virus
RAVLGEVKSCT

SEQ ID NO: 146904 - protein, 11 aa, West Nile virus
AVLGEVKSCTW

SEQ ID NO: 146905 - protein, 11 aa, West Nile virus
VLGEVKSCTWP

SEQ ID NO: 146906 - protein, 11 aa, West Nile virus
LGEVKSCTWPE

SEQ ID NO: 146907 - protein, 11 aa, West Nile virus
GEVKSCTWPET

SEQ ID NO: 146908 - protein, 11 aa, West Nile virus
EVKSCTWPETH

SEQ ID NO: 146909 - protein, 11 aa, West Nile virus
VKSCTWPETHT

SEQ ID NO: 146910 - protein, 11 aa, West Nile virus
KSCTWPETHTL

SEQ ID NO: 146911 - protein, 11 aa, West Nile virus
SCTWPETHTLW

SEQ ID NO: 146912 - protein, 11 aa, West Nile virus
CTWPETHTLWG

SEQ ID NO: 146913 - protein, 11 aa, West Nile virus
TWPETHTLWGD

SEQ ID NO: 146914 - protein, 11 aa, West Nile virus
WPETHTLWGDG

SEQ ID NO: 146915 - protein, 11 aa, West Nile virus
PETHTLWGDGI

SEQ ID NO: 146916 - protein, 11 aa, West Nile virus
ETHTLWGDGIL

SEQ ID NO: 146917 - protein, 11 aa, West Nile virus
THTLWGDGILE

SEQ ID NO: 146918 - protein, 11 aa, West Nile virus
HTLWGDGILES

SEQ ID NO: 146919 - protein, 11 aa, West Nile virus
ESDLIIPVTLA

SEQ ID NO: 146920 - protein, 11 aa, West Nile virus
SDLIIPVTLAG

SEQ ID NO: 146921 - protein, 11 aa, West Nile virus
DLIIPVTLAGP

SEQ ID NO: 146922 - protein, 11 aa, West Nile virus
LIIPVTLAGPR

SEQ ID NO: 146923 - protein, 11 aa, West Nile virus
IIPVTLAGPRS

SEQ ID NO: 146924 - protein, 11 aa, West Nile virus
IPVTLAGPRSN

SEQ ID NO: 146925 - protein, 11 aa, West Nile virus
PVTLAGPRSNH

SEQ ID NO: 146926 - protein, 11 aa, West Nile virus
VTLAGPRSNHN

SEQ ID NO: 146927 - protein, 11 aa, West Nile virus
TLAGPRSNHNR

SEQ ID NO: 146928 - protein, 11 aa, West Nile virus
LAGPRSNHNRR

SEQ ID NO: 146929 - protein, 11 aa, West Nile virus
AGPRSNHNRRP

SEQ ID NO: 146930 - protein, 11 aa, West Nile virus
GPRSNHNRRPG

SEQ ID NO: 146931 - protein, 11 aa, West Nile virus
PRSNHNRRPGY

SEQ ID NO: 146932 - protein, 11 aa, West Nile virus
RSNHNRRPGYK

SEQ ID NO: 146933 - protein, 11 aa, West Nile virus
SNHNRRPGYKT

SEQ ID NO: 146934 - protein, 11 aa, West Nile virus
NHNRRPGYKTQ

SEQ ID NO: 146935 - protein, 11 aa, West Nile virus
HNRRPGYKTQN

SEQ ID NO: 146936 - protein, 11 aa, West Nile virus
NRRPGYKTQNQ

SEQ ID NO: 146937 - protein, 11 aa, West Nile virus
RRPGYKTQNQG

SEQ ID NO: 146938 - protein, 11 aa, West Nile virus
RPGYKTQNQGP

SEQ ID NO: 146939 - protein, 11 aa, West Nile virus
PGYKTQNQGPW

SEQ ID NO: 146940 - protein, 11 aa, West Nile virus
GYKTQNQGPWD

SEQ ID NO: 146941 - protein, 11 aa, West Nile virus
YKTQNQGPWDE

SEQ ID NO: 146942 - protein, 11 aa, West Nile virus
KTQNQGPWDEG

SEQ ID NO: 146943 - protein, 11 aa, West Nile virus
TQNQGPWDEGR

SEQ ID NO: 146944 - protein, 11 aa, West Nile virus
QNQGPWDEGRV

SEQ ID NO: 146945 - protein, 11 aa, West Nile virus
NQGPWDEGRVE

SEQ ID NO: 146946 - protein, 11 aa, West Nile virus
QGPWDEGRVEI

SEQ ID NO: 146947 - protein, 11 aa, West Nile virus
GPWDEGRVEID

SEQ ID NO: 146948 - protein, 11 aa, West Nile virus
PWDEGRVEIDF

SEQ ID NO: 146949 - protein, 11 aa, West Nile virus
WDEGRVEIDFD

SEQ ID NO: 146950 - protein, 11 aa, West Nile virus
DEGRVEIDFDY

SEQ ID NO: 146951 - protein, 11 aa, West Nile virus
EGRVEIDFDYC

SEQ ID NO: 146952 - protein, 11 aa, West Nile virus
GRVEIDFDYCP

SEQ ID NO: 146953 - protein, 11 aa, West Nile virus
RVEIDFDYCPG

SEQ ID NO: 146954 - protein, 11 aa, West Nile virus
VEIDFDYCPGT

SEQ ID NO: 146955 - protein, 11 aa, West Nile virus
EIDFDYCPGTT

SEQ ID NO: 146956 - protein, 11 aa, West Nile virus
IDFDYCPGTTV

SEQ ID NO: 146957 - protein, 11 aa, West Nile virus
DFDYCPGTTVT

SEQ ID NO: 146958 - protein, 11 aa, West Nile virus
FDYCPGTTVTL

SEQ ID NO: 146959 - protein, 11 aa, West Nile virus
DYCPGTTVTLS

SEQ ID NO: 146960 - protein, 11 aa, West Nile virus
CGHRGPATRTT

SEQ ID NO: 146961 - protein, 11 aa, West Nile virus
GHRGPATRTTT

SEQ ID NO: 146962 - protein, 11 aa, West Nile virus
HRGPATRTTTE

SEQ ID NO: 146963 - protein, 11 aa, West Nile virus
RGPATRTTTES

SEQ ID NO: 146964 - protein, 11 aa, West Nile virus
GPATRTTTESG

SEQ ID NO: 146965 - protein, 11 aa, West Nile virus
PATRTTTESGK

SEQ ID NO: 146966 - protein, 11 aa, West Nile virus
ATRTTTESGKL

SEQ ID NO: 146967 - protein, 11 aa, West Nile virus
TRTTTESGKLI

SEQ ID NO: 146968 - protein, 11 aa, West Nile virus
RTTTESGKLIT

SEQ ID NO: 146969 - protein, 11 aa, West Nile virus
TTTESGKLITD

SEQ ID NO: 146970 - protein, 11 aa, West Nile virus
TTESGKLITDW

SEQ ID NO: 146971 - protein, 11 aa, West Nile virus
TESGKLITDWC

SEQ ID NO: 146972 - protein, 11 aa, West Nile virus
ESGKLITDWCC

SEQ ID NO: 146973 - protein, 11 aa, West Nile virus
SGKLITDWCCR

SEQ ID NO: 146974 - protein, 11 aa, West Nile virus
GKLITDWCCRS

SEQ ID NO: 146975 - protein, 11 aa, West Nile virus
KLITDWCCRSC

SEQ ID NO: 146976 - protein, 11 aa, West Nile virus
LITDWCCRSCT

SEQ ID NO: 146977 - protein, 11 aa, West Nile virus
ITDWCCRSCTL

SEQ ID NO: 146978 - protein, 11 aa, West Nile virus
TDWCCRSCTLP

SEQ ID NO: 146979 - protein, 11 aa, West Nile virus
DWCCRSCTLPP

SEQ ID NO: 146980 - protein, 11 aa, West Nile virus
WCCRSCTLPPL

SEQ ID NO: 146981 - protein, 11 aa, West Nile virus
CCRSCTLPPLR

SEQ ID NO: 146982 - protein, 11 aa, West Nile virus
CRSCTLPPLRY

SEQ ID NO: 146983 - protein, 11 aa, West Nile virus
RSCTLPPLRYQ

SEQ ID NO: 146984 - protein, 11 aa, West Nile virus
SCTLPPLRYQT

SEQ ID NO: 146985 - protein, 11 aa, West Nile virus
CTLPPLRYQTD

SEQ ID NO: 146986 - protein, 11 aa, West Nile virus
TDSGCWYGMEI

SEQ ID NO: 146987 - protein, 11 aa, West Nile virus
DSGCWYGMEIR

SEQ ID NO: 146988 - protein, 11 aa, West Nile virus
SGCWYGMEIRP

SEQ ID NO: 146989 - protein, 11 aa, West Nile virus
GCWYGMEIRPQ

SEQ ID NO: 146990 - protein, 11 aa, West Nile virus
CWYGMEIRPQR

SEQ ID NO: 146991 - protein, 11 aa, West Nile virus
WYGMEIRPQRH

SEQ ID NO: 146992 - protein, 11 aa, West Nile virus
YGMEIRPQRHD

SEQ ID NO: 146993 - protein, 11 aa, West Nile virus
GMEIRPQRHDE

SEQ ID NO: 146994 - protein, 11 aa, West Nile virus
MEIRPQRHDEK

SEQ ID NO: 146995 - protein, 11 aa, West Nile virus
EIRPQRHDEKT

SEQ ID NO: 146996 - protein, 11 aa, West Nile virus
IRPQRHDEKTL

SEQ ID NO: 146997 - protein, 11 aa, West Nile virus
RPQRHDEKTLV

SEQ ID NO: 146998 - protein, 11 aa, West Nile virus
PQRHDEKTLVQ

SEQ ID NO: 146999 - protein, 11 aa, West Nile virus
QRHDEKTLVQS

SEQ ID NO: 147000 - protein, 11 aa, West Nile virus
RHDEKTLVQSQ

SEQ ID NO: 147001 - protein, 11 aa, West Nile virus
HDEKTLVQSQV

SEQ ID NO: 147002 - protein, 11 aa, West Nile virus
DEKTLVQSQVN

SEQ ID NO: 147003 - protein, 11 aa, West Nile virus
EKTLVQSQVNA

SEQ ID NO: 147004 - protein, 11 aa, West Nile virus
KTLVQSQVNAY

SEQ ID NO: 147005 - protein, 11 aa, West Nile virus
TLVQSQVNAYN

SEQ ID NO: 147006 - protein, 11 aa, West Nile virus
LVQSQVNAYNA

SEQ ID NO: 147007 - protein, 11 aa, West Nile virus
VQSQVNAYNAD

SEQ ID NO: 147008 - protein, 11 aa, West Nile virus
QSQVNAYNADM

SEQ ID NO: 147009 - protein, 11 aa, West Nile virus
SQVNAYNADMI

SEQ ID NO: 147010 - protein, 11 aa, West Nile virus
QVNAYNADMID

SEQ ID NO: 147011 - protein, 11 aa, West Nile virus
VNAYNADMIDP

SEQ ID NO: 147012 - protein, 11 aa, West Nile virus
NAYNADMIDPF

SEQ ID NO: 147013 - protein, 11 aa, West Nile virus
AYNADMIDPFQ

SEQ ID NO: 147014 - protein, 11 aa, West Nile virus
YNADMIDPFQL

SEQ ID NO: 147015 - protein, 11 aa, West Nile virus
NADMIDPFQLG

SEQ ID NO: 147016 - protein, 11 aa, West Nile virus
ADMIDPFQLGL

SEQ ID NO: 147017 - protein, 11 aa, West Nile virus
DMIDPFQLGLL

SEQ ID NO: 147018 - protein, 11 aa, West Nile virus
MIDPFQLGLLV

SEQ ID NO: 147019 - protein, 11 aa, West Nile virus
IDPFQLGLLVV

SEQ ID NO: 147020 - protein, 11 aa, West Nile virus
DPFQLGLLVVF

SEQ ID NO: 147021 - protein, 11 aa, West Nile virus
PFQLGLLVVFL

SEQ ID NO: 147022 - protein, 11 aa, West Nile virus
FQLGLLVVFLA

SEQ ID NO: 147023 - protein, 11 aa, West Nile virus
QLGLLVVFLAT

SEQ ID NO: 147024 - protein, 11 aa, West Nile virus
LGLLVVFLATQ

SEQ ID NO: 147025 - protein, 11 aa, West Nile virus
GLLVVFLATQE

SEQ ID NO: 147026 - protein, 11 aa, West Nile virus
LLVVFLATQEV

SEQ ID NO: 147027 - protein, 11 aa, West Nile virus
LVVFLATQEVL

SEQ ID NO: 147028 - protein, 11 aa, West Nile virus
VVFLATQEVLR

SEQ ID NO: 147029 - protein, 11 aa, West Nile virus
VFLATQEVLRK

SEQ ID NO: 147030 - protein, 11 aa, West Nile virus
FLATQEVLRKR

SEQ ID NO: 147031 - protein, 11 aa, West Nile virus
LATQEVLRKRW

SEQ ID NO: 147032 - protein, 11 aa, West Nile virus
ATQEVLRKRWT

SEQ ID NO: 147033 - protein, 11 aa, West Nile virus
TQEVLRKRWTA

SEQ ID NO: 147034 - protein, 11 aa, West Nile virus
QEVLRKRWTAK

SEQ ID NO: 147035 - protein, 11 aa, West Nile virus
EVLRKRWTAKI

SEQ ID NO: 147036 - protein, 11 aa, West Nile virus
VLRKRWTAKIS

SEQ ID NO: 147037 - protein, 11 aa, West Nile virus
LRKRWTAKISM

SEQ ID NO: 147038 - protein, 11 aa, West Nile virus
RKRWTAKISMP

SEQ ID NO: 147039 - protein, 11 aa, West Nile virus
KRWTAKISMPA

SEQ ID NO: 147040 - protein, 11 aa, West Nile virus
RWTAKISMPAI

SEQ ID NO: 147041 - protein, 11 aa, West Nile virus
PAILIALLVLV

SEQ ID NO: 147042 - protein, 11 aa, West Nile virus
AILIALLVLVF

SEQ ID NO: 147043 - protein, 11 aa, West Nile virus
ILIALLVLVFG

SEQ ID NO: 147044 - protein, 11 aa, West Nile virus
LIALLVLVFGG

SEQ ID NO: 147045 - protein, 11 aa, West Nile virus
IALLVLVFGGI

SEQ ID NO: 147046 - protein, 11 aa, West Nile virus
ALLVLVFGGIT

SEQ ID NO: 147047 - protein, 11 aa, West Nile virus
LLVLVFGGITY

SEQ ID NO: 147048 - protein, 11 aa, West Nile virus
VLVFGGITYTD

SEQ ID NO: 147049 - protein, 11 aa, West Nile virus
LVFGGITYTDV

SEQ ID NO: 147050 - protein, 11 aa, West Nile virus
VFGGITYTDVL

SEQ ID NO: 147051 - protein, 11 aa, West Nile virus
FGGITYTDVLR

SEQ ID NO: 147052 - protein, 11 aa, West Nile virus
GGITYTDVLRY

SEQ ID NO: 147053 - protein, 11 aa, West Nile virus
GITYTDVLRYV

SEQ ID NO: 147054 - protein, 11 aa, West Nile virus
TYTDVLRYVIL

SEQ ID NO: 147055 - protein, 11 aa, West Nile virus
DVLRYVILVGA

SEQ ID NO: 147056 - protein, 11 aa, West Nile virus
VLRYVILVGAA

SEQ ID NO: 147057 - protein, 11 aa, West Nile virus
LRYVILVGAAF

SEQ ID NO: 147058 - protein, 11 aa, West Nile virus
RYVILVGAAFA

SEQ ID NO: 147059 - protein, 11 aa, West Nile virus
YVILVGAAFAE

SEQ ID NO: 147060 - protein, 11 aa, West Nile virus
VILVGAAFAES

SEQ ID NO: 147061 - protein, 11 aa, West Nile virus
ILVGAAFAESN

SEQ ID NO: 147062 - protein, 11 aa, West Nile virus
LVGAAFAESNS

SEQ ID NO: 147063 - protein, 11 aa, West Nile virus
VGAAFAESNSG

SEQ ID NO: 147064 - protein, 11 aa, West Nile virus
GAAFAESNSGG

SEQ ID NO: 147065 - protein, 11 aa, West Nile virus
AAFAESNSGGD

SEQ ID NO: 147066 - protein, 11 aa, West Nile virus
AFAESNSGGDV

SEQ ID NO: 147067 - protein, 11 aa, West Nile virus
FAESNSGGDVV

SEQ ID NO: 147068 - protein, 11 aa, West Nile virus
AESNSGGDVVH

SEQ ID NO: 147069 - protein, 11 aa, West Nile virus
ESNSGGDVVHL

SEQ ID NO: 147070 - protein, 11 aa, West Nile virus
SNSGGDVVHLA

SEQ ID NO: 147071 - protein, 11 aa, West Nile virus
NSGGDVVHLAL

SEQ ID NO: 147072 - protein, 11 aa, West Nile virus
SGGDVVHLALM

SEQ ID NO: 147073 - protein, 11 aa, West Nile virus
GGDVVHLALMA

SEQ ID NO: 147074 - protein, 11 aa, West Nile virus
GDVVHLALMAT

SEQ ID NO: 147075 - protein, 11 aa, West Nile virus
DVVHLALMATF

SEQ ID NO: 147076 - protein, 11 aa, West Nile virus
VVHLALMATFK

SEQ ID NO: 147077 - protein, 11 aa, West Nile virus
VHLALMATFKI

SEQ ID NO: 147078 - protein, 11 aa, West Nile virus
HLALMATFKIQ

SEQ ID NO: 147079 - protein, 11 aa, West Nile virus
LALMATFKIQP

SEQ ID NO: 147080 - protein, 11 aa, West Nile virus
ALMATFKIQPV

SEQ ID NO: 147081 - protein, 11 aa, West Nile virus
LMATFKIQPVF

SEQ ID NO: 147082 - protein, 11 aa, West Nile virus
IQPVFMVASFL

SEQ ID NO: 147083 - protein, 11 aa, West Nile virus
QPVFMVASFLK

SEQ ID NO: 147084 - protein, 11 aa, West Nile virus
PVFMVASFLKA

SEQ ID NO: 147085 - protein, 11 aa, West Nile virus
VASFLKARWTN

SEQ ID NO: 147086 - protein, 11 aa, West Nile virus
RWTNQENILLM

SEQ ID NO: 147087 - protein, 11 aa, West Nile virus
WTNQENILLML

SEQ ID NO: 147088 - protein, 11 aa, West Nile virus
TNQENILLMLA

SEQ ID NO: 147089 - protein, 11 aa, West Nile virus
NQENILLMLAA

SEQ ID NO: 147090 - protein, 11 aa, West Nile virus
QENILLMLAAV

SEQ ID NO: 147091 - protein, 11 aa, West Nile virus
ENILLMLAAVF

SEQ ID NO: 147092 - protein, 11 aa, West Nile virus
NILLMLAAVFF

SEQ ID NO: 147093 - protein, 11 aa, West Nile virus
ILLMLAAVFFQ

SEQ ID NO: 147094 - protein, 11 aa, West Nile virus
LLMLAAVFFQM

SEQ ID NO: 147095 - protein, 11 aa, West Nile virus
LMLAAVFFQMA

SEQ ID NO: 147096 - protein, 11 aa, West Nile virus
MLAAVFFQMAY

SEQ ID NO: 147097 - protein, 11 aa, West Nile virus
LAAVFFQMAYH

SEQ ID NO: 147098 - protein, 11 aa, West Nile virus
AAVFFQMAYHD

SEQ ID NO: 147099 - protein, 11 aa, West Nile virus
AVFFQMAYHDA

SEQ ID NO: 147100 - protein, 11 aa, West Nile virus
PDVLNSLAVAW

SEQ ID NO: 147101 - protein, 11 aa, West Nile virus
DVLNSLAVAWM

SEQ ID NO: 147102 - protein, 11 aa, West Nile virus
VLNSLAVAWMI

SEQ ID NO: 147103 - protein, 11 aa, West Nile virus
LNSLAVAWMIL

SEQ ID NO: 147104 - protein, 11 aa, West Nile virus
NSLAVAWMILR

SEQ ID NO: 147105 - protein, 11 aa, West Nile virus
SLAVAWMILRA

SEQ ID NO: 147106 - protein, 11 aa, West Nile virus
LAVAWMILRAI

SEQ ID NO: 147107 - protein, 11 aa, West Nile virus
AVAWMILRAIT

SEQ ID NO: 147108 - protein, 11 aa, West Nile virus
VAWMILRAITF

SEQ ID NO: 147109 - protein, 11 aa, West Nile virus
AWMILRAITFT

SEQ ID NO: 147110 - protein, 11 aa, West Nile virus
FTTTSNVVVPL

SEQ ID NO: 147111 - protein, 11 aa, West Nile virus
TTTSNVVVPLL

SEQ ID NO: 147112 - protein, 11 aa, West Nile virus
TTSNVVVPLLA

SEQ ID NO: 147113 - protein, 11 aa, West Nile virus
TSNVVVPLLAL

SEQ ID NO: 147114 - protein, 11 aa, West Nile virus
SNVVVPLLALL

SEQ ID NO: 147115 - protein, 11 aa, West Nile virus
NVVVPLLALLT

SEQ ID NO: 147116 - protein, 11 aa, West Nile virus
VVVPLLALLTP

SEQ ID NO: 147117 - protein, 11 aa, West Nile virus
VVPLLALLTPG

SEQ ID NO: 147118 - protein, 11 aa, West Nile virus
VPLLALLTPGL

SEQ ID NO: 147119 - protein, 11 aa, West Nile virus
PLLALLTPGLR

SEQ ID NO: 147120 - protein, 11 aa, West Nile virus
LLALLTPGLRC

SEQ ID NO: 147121 - protein, 11 aa, West Nile virus
LALLTPGLRCL

SEQ ID NO: 147122 - protein, 11 aa, West Nile virus
ALLTPGLRCLN

SEQ ID NO: 147123 - protein, 11 aa, West Nile virus
LLTPGLRCLNL

SEQ ID NO: 147124 - protein, 11 aa, West Nile virus
LTPGLRCLNLD

SEQ ID NO: 147125 - protein, 11 aa, West Nile virus
TPGLRCLNLDV

SEQ ID NO: 147126 - protein, 11 aa, West Nile virus
PGLRCLNLDVY

SEQ ID NO: 147127 - protein, 11 aa, West Nile virus
GLRCLNLDVYR

SEQ ID NO: 147128 - protein, 11 aa, West Nile virus
LRCLNLDVYRI

SEQ ID NO: 147129 - protein, 11 aa, West Nile virus
RCLNLDVYRIL

SEQ ID NO: 147130 - protein, 11 aa, West Nile virus
CLNLDVYRILL

SEQ ID NO: 147131 - protein, 11 aa, West Nile virus
LNLDVYRILLL

SEQ ID NO: 147132 - protein, 11 aa, West Nile virus
NLDVYRILLLM

SEQ ID NO: 147133 - protein, 11 aa, West Nile virus
LDVYRILLLMV

SEQ ID NO: 147134 - protein, 11 aa, West Nile virus
DVYRILLLMVG

SEQ ID NO: 147135 - protein, 11 aa, West Nile virus
YRILLLMVGIG

SEQ ID NO: 147136 - protein, 11 aa, West Nile virus
RILLLMVGIGS

SEQ ID NO: 147137 - protein, 11 aa, West Nile virus
ILLLMVGIGSL

SEQ ID NO: 147138 - protein, 11 aa, West Nile virus
LLLMVGIGSLI

SEQ ID NO: 147139 - protein, 11 aa, West Nile virus
LLMVGIGSLIR

SEQ ID NO: 147140 - protein, 11 aa, West Nile virus
LMVGIGSLIRE

SEQ ID NO: 147141 - protein, 11 aa, West Nile virus
EKRSAAAKKKG

SEQ ID NO: 147142 - protein, 11 aa, West Nile virus
KRSAAAKKKGA

SEQ ID NO: 147143 - protein, 11 aa, West Nile virus
RSAAAKKKGAS

SEQ ID NO: 147144 - protein, 11 aa, West Nile virus
SAAAKKKGASL

SEQ ID NO: 147145 - protein, 11 aa, West Nile virus
AAAKKKGASLL

SEQ ID NO: 147146 - protein, 11 aa, West Nile virus
AAKKKGASLLC

SEQ ID NO: 147147 - protein, 11 aa, West Nile virus
AKKKGASLLCL

SEQ ID NO: 147148 - protein, 11 aa, West Nile virus
KKKGASLLCLA

SEQ ID NO: 147149 - protein, 11 aa, West Nile virus
KKGASLLCLAL

SEQ ID NO: 147150 - protein, 11 aa, West Nile virus
KGASLLCLALA

SEQ ID NO: 147151 - protein, 11 aa, West Nile virus
GASLLCLALAS

SEQ ID NO: 147152 - protein, 11 aa, West Nile virus
ASLLCLALAST

SEQ ID NO: 147153 - protein, 11 aa, West Nile virus
SLLCLALASTG

SEQ ID NO: 147154 - protein, 11 aa, West Nile virus
FNPMILAAGLI

SEQ ID NO: 147155 - protein, 11 aa, West Nile virus
LAAGLIACDPN

SEQ ID NO: 147156 - protein, 11 aa, West Nile virus
AAGLIACDPNR

SEQ ID NO: 147157 - protein, 11 aa, West Nile virus
AGLIACDPNRK

SEQ ID NO: 147158 - protein, 11 aa, West Nile virus
GLIACDPNRKR

SEQ ID NO: 147159 - protein, 11 aa, West Nile virus
LIACDPNRKRG

SEQ ID NO: 147160 - protein, 11 aa, West Nile virus
IACDPNRKRGW

SEQ ID NO: 147161 - protein, 11 aa, West Nile virus
ACDPNRKRGWP

SEQ ID NO: 147162 - protein, 11 aa, West Nile virus
CDPNRKRGWPA

SEQ ID NO: 147163 - protein, 11 aa, West Nile virus
DPNRKRGWPAT

SEQ ID NO: 147164 - protein, 11 aa, West Nile virus
PNRKRGWPATE

SEQ ID NO: 147165 - protein, 11 aa, West Nile virus
NRKRGWPATEV

SEQ ID NO: 147166 - protein, 11 aa, West Nile virus
RKRGWPATEVM

SEQ ID NO: 147167 - protein, 11 aa, West Nile virus
KRGWPATEVMT

SEQ ID NO: 147168 - protein, 11 aa, West Nile virus
RGWPATEVMTA

SEQ ID NO: 147169 - protein, 11 aa, West Nile virus
GWPATEVMTAV

SEQ ID NO: 147170 - protein, 11 aa, West Nile virus
WPATEVMTAVG

SEQ ID NO: 147171 - protein, 11 aa, West Nile virus
PATEVMTAVGL

SEQ ID NO: 147172 - protein, 11 aa, West Nile virus
ATEVMTAVGLM

SEQ ID NO: 147173 - protein, 11 aa, West Nile virus
TEVMTAVGLMF

SEQ ID NO: 147174 - protein, 11 aa, West Nile virus
EVMTAVGLMFA

SEQ ID NO: 147175 - protein, 11 aa, West Nile virus
VMTAVGLMFAI

SEQ ID NO: 147176 - protein, 11 aa, West Nile virus
MTAVGLMFAIV

SEQ ID NO: 147177 - protein, 11 aa, West Nile virus
TAVGLMFAIVG

SEQ ID NO: 147178 - protein, 11 aa, West Nile virus
AVGLMFAIVGG

SEQ ID NO: 147179 - protein, 11 aa, West Nile virus
VGLMFAIVGGL

SEQ ID NO: 147180 - protein, 11 aa, West Nile virus
GLMFAIVGGLA

SEQ ID NO: 147181 - protein, 11 aa, West Nile virus
LMFAIVGGLAE

SEQ ID NO: 147182 - protein, 11 aa, West Nile virus
MFAIVGGLAEL

SEQ ID NO: 147183 - protein, 11 aa, West Nile virus
FAIVGGLAELD

SEQ ID NO: 147184 - protein, 11 aa, West Nile virus
AIVGGLAELDI

SEQ ID NO: 147185 - protein, 11 aa, West Nile virus
IVGGLAELDID

SEQ ID NO: 147186 - protein, 11 aa, West Nile virus
VGGLAELDIDS

SEQ ID NO: 147187 - protein, 11 aa, West Nile virus
GGLAELDIDSM

SEQ ID NO: 147188 - protein, 11 aa, West Nile virus
GLAELDIDSMA

SEQ ID NO: 147189 - protein, 11 aa, West Nile virus
LAELDIDSMAI

SEQ ID NO: 147190 - protein, 11 aa, West Nile virus
AELDIDSMAIP

SEQ ID NO: 147191 - protein, 11 aa, West Nile virus
ELDIDSMAIPM

SEQ ID NO: 147192 - protein, 11 aa, West Nile virus
LDIDSMAIPMT

SEQ ID NO: 147193 - protein, 11 aa, West Nile virus
DIDSMAIPMTI

SEQ ID NO: 147194 - protein, 11 aa, West Nile virus
IDSMAIPMTIA

SEQ ID NO: 147195 - protein, 11 aa, West Nile virus
DSMAIPMTIAG

SEQ ID NO: 147196 - protein, 11 aa, West Nile virus
SMAIPMTIAGL

SEQ ID NO: 147197 - protein, 11 aa, West Nile virus
MAIPMTIAGLM

SEQ ID NO: 147198 - protein, 11 aa, West Nile virus
AIPMTIAGLMF

SEQ ID NO: 147199 - protein, 11 aa, West Nile virus
IPMTIAGLMFA

SEQ ID NO: 147200 - protein, 11 aa, West Nile virus
PMTIAGLMFAA

SEQ ID NO: 147201 - protein, 11 aa, West Nile virus
MTIAGLMFAAF

SEQ ID NO: 147202 - protein, 11 aa, West Nile virus
TIAGLMFAAFV

SEQ ID NO: 147203 - protein, 11 aa, West Nile virus
IAGLMFAAFVI

SEQ ID NO: 147204 - protein, 11 aa, West Nile virus
AGLMFAAFVIS

SEQ ID NO: 147205 - protein, 11 aa, West Nile virus
GLMFAAFVISG

SEQ ID NO: 147206 - protein, 11 aa, West Nile virus
LMFAAFVISGK

SEQ ID NO: 147207 - protein, 11 aa, West Nile virus
MFAAFVISGKS

SEQ ID NO: 147208 - protein, 11 aa, West Nile virus
FAAFVISGKST

SEQ ID NO: 147209 - protein, 11 aa, West Nile virus
AAFVISGKSTD

SEQ ID NO: 147210 - protein, 11 aa, West Nile virus
AFVISGKSTDM

SEQ ID NO: 147211 - protein, 11 aa, West Nile virus
FVISGKSTDMW

SEQ ID NO: 147212 - protein, 11 aa, West Nile virus
VISGKSTDMWI

SEQ ID NO: 147213 - protein, 11 aa, West Nile virus
ISGKSTDMWIE

SEQ ID NO: 147214 - protein, 11 aa, West Nile virus
SGKSTDMWIER

SEQ ID NO: 147215 - protein, 11 aa, West Nile virus
GKSTDMWIERT

SEQ ID NO: 147216 - protein, 11 aa, West Nile virus
KSTDMWIERTA

SEQ ID NO: 147217 - protein, 11 aa, West Nile virus
STDMWIERTAD

SEQ ID NO: 147218 - protein, 11 aa, West Nile virus
TDMWIERTADI

SEQ ID NO: 147219 - protein, 11 aa, West Nile virus
DMWIERTADIS

SEQ ID NO: 147220 - protein, 11 aa, West Nile virus
MWIERTADISW

SEQ ID NO: 147221 - protein, 11 aa, West Nile virus
WIERTADISWE

SEQ ID NO: 147222 - protein, 11 aa, West Nile virus
IERTADISWES

SEQ ID NO: 147223 - protein, 11 aa, West Nile virus
ERTADISWESD

SEQ ID NO: 147224 - protein, 11 aa, West Nile virus
ADISWESDAEI

SEQ ID NO: 147225 - protein, 11 aa, West Nile virus
DISWESDAEIT

SEQ ID NO: 147226 - protein, 11 aa, West Nile virus
ISWESDAEITG

SEQ ID NO: 147227 - protein, 11 aa, West Nile virus
WESDAEITGSS

SEQ ID NO: 147228 - protein, 11 aa, West Nile virus
ESDAEITGSSE

SEQ ID NO: 147229 - protein, 11 aa, West Nile virus
SDAEITGSSER

SEQ ID NO: 147230 - protein, 11 aa, West Nile virus
DAEITGSSERV

SEQ ID NO: 147231 - protein, 11 aa, West Nile virus
AEITGSSERVD

SEQ ID NO: 147232 - protein, 11 aa, West Nile virus
EITGSSERVDV

SEQ ID NO: 147233 - protein, 11 aa, West Nile virus
ITGSSERVDVR

SEQ ID NO: 147234 - protein, 11 aa, West Nile virus
TGSSERVDVRL

SEQ ID NO: 147235 - protein, 11 aa, West Nile virus
GSSERVDVRLD

SEQ ID NO: 147236 - protein, 11 aa, West Nile virus
SSERVDVRLDD

SEQ ID NO: 147237 - protein, 11 aa, West Nile virus
SERVDVRLDDD

SEQ ID NO: 147238 - protein, 11 aa, West Nile virus
ERVDVRLDDDG

SEQ ID NO: 147239 - protein, 11 aa, West Nile virus
RVDVRLDDDGN

SEQ ID NO: 147240 - protein, 11 aa, West Nile virus
VDVRLDDDGNF

SEQ ID NO: 147241 - protein, 11 aa, West Nile virus
DVRLDDDGNFQ

SEQ ID NO: 147242 - protein, 11 aa, West Nile virus
VRLDDDGNFQL

SEQ ID NO: 147243 - protein, 11 aa, West Nile virus
RLDDDGNFQLM

SEQ ID NO: 147244 - protein, 11 aa, West Nile virus
LDDDGNFQLMN

SEQ ID NO: 147245 - protein, 11 aa, West Nile virus
DDDGNFQLMND

SEQ ID NO: 147246 - protein, 11 aa, West Nile virus
DDGNFQLMNDP

SEQ ID NO: 147247 - protein, 11 aa, West Nile virus
DGNFQLMNDPG

SEQ ID NO: 147248 - protein, 11 aa, West Nile virus
GNFQLMNDPGA

SEQ ID NO: 147249 - protein, 11 aa, West Nile virus
NFQLMNDPGAP

SEQ ID NO: 147250 - protein, 11 aa, West Nile virus
FQLMNDPGAPW

SEQ ID NO: 147251 - protein, 11 aa, West Nile virus
QLMNDPGAPWK

SEQ ID NO: 147252 - protein, 11 aa, West Nile virus
LMNDPGAPWKI

SEQ ID NO: 147253 - protein, 11 aa, West Nile virus
MNDPGAPWKIW

SEQ ID NO: 147254 - protein, 11 aa, West Nile virus
NDPGAPWKIWM

SEQ ID NO: 147255 - protein, 11 aa, West Nile virus
DPGAPWKIWML

SEQ ID NO: 147256 - protein, 11 aa, West Nile virus
PGAPWKIWMLR

SEQ ID NO: 147257 - protein, 11 aa, West Nile virus
GAPWKIWMLRM

SEQ ID NO: 147258 - protein, 11 aa, West Nile virus
MVCLAISAYTP

SEQ ID NO: 147259 - protein, 11 aa, West Nile virus
VCLAISAYTPW

SEQ ID NO: 147260 - protein, 11 aa, West Nile virus
CLAISAYTPWA

SEQ ID NO: 147261 - protein, 11 aa, West Nile virus
LAISAYTPWAI

SEQ ID NO: 147262 - protein, 11 aa, West Nile virus
AISAYTPWAIL

SEQ ID NO: 147263 - protein, 11 aa, West Nile virus
ISAYTPWAILP

SEQ ID NO: 147264 - protein, 11 aa, West Nile virus
SAYTPWAILPS

SEQ ID NO: 147265 - protein, 11 aa, West Nile virus
AYTPWAILPSV

SEQ ID NO: 147266 - protein, 11 aa, West Nile virus
YTPWAILPSVV

SEQ ID NO: 147267 - protein, 11 aa, West Nile virus
TPWAILPSVVG

SEQ ID NO: 147268 - protein, 11 aa, West Nile virus
PWAILPSVVGF

SEQ ID NO: 147269 - protein, 11 aa, West Nile virus
WAILPSVVGFW

SEQ ID NO: 147270 - protein, 11 aa, West Nile virus
AILPSVVGFWI

SEQ ID NO: 147271 - protein, 11 aa, West Nile virus
ILPSVVGFWIT

SEQ ID NO: 147272 - protein, 11 aa, West Nile virus
LPSVVGFWITL

SEQ ID NO: 147273 - protein, 11 aa, West Nile virus
PSVVGFWITLQ

SEQ ID NO: 147274 - protein, 11 aa, West Nile virus
SVVGFWITLQY

SEQ ID NO: 147275 - protein, 11 aa, West Nile virus
VVGFWITLQYT

SEQ ID NO: 147276 - protein, 11 aa, West Nile virus
VGFWITLQYTK

SEQ ID NO: 147277 - protein, 11 aa, West Nile virus
GFWITLQYTKR

SEQ ID NO: 147278 - protein, 11 aa, West Nile virus
FWITLQYTKRG

SEQ ID NO: 147279 - protein, 11 aa, West Nile virus
WITLQYTKRGG

SEQ ID NO: 147280 - protein, 11 aa, West Nile virus
ITLQYTKRGGV

SEQ ID NO: 147281 - protein, 11 aa, West Nile virus
TLQYTKRGGVL

SEQ ID NO: 147282 - protein, 11 aa, West Nile virus
LQYTKRGGVLW

SEQ ID NO: 147283 - protein, 11 aa, West Nile virus
QYTKRGGVLWD

SEQ ID NO: 147284 - protein, 11 aa, West Nile virus
YTKRGGVLWDT

SEQ ID NO: 147285 - protein, 11 aa, West Nile virus
TKRGGVLWDTP

SEQ ID NO: 147286 - protein, 11 aa, West Nile virus
KRGGVLWDTPS

SEQ ID NO: 147287 - protein, 11 aa, West Nile virus
RGGVLWDTPSP

SEQ ID NO: 147288 - protein, 11 aa, West Nile virus
GGVLWDTPSPK

SEQ ID NO: 147289 - protein, 11 aa, West Nile virus
GVLWDTPSPKE

SEQ ID NO: 147290 - protein, 11 aa, West Nile virus
VLWDTPSPKEY

SEQ ID NO: 147291 - protein, 11 aa, West Nile virus
LWDTPSPKEYK

SEQ ID NO: 147292 - protein, 11 aa, West Nile virus
EYKKGDTTTGV

SEQ ID NO: 147293 - protein, 11 aa, West Nile virus
YKKGDTTTGVY

SEQ ID NO: 147294 - protein, 11 aa, West Nile virus
KKGDTTTGVYR

SEQ ID NO: 147295 - protein, 11 aa, West Nile virus
KGDTTTGVYRI

SEQ ID NO: 147296 - protein, 11 aa, West Nile virus
GDTTTGVYRIM

SEQ ID NO: 147297 - protein, 11 aa, West Nile virus
DTTTGVYRIMT

SEQ ID NO: 147298 - protein, 11 aa, West Nile virus
TTTGVYRIMTR

SEQ ID NO: 147299 - protein, 11 aa, West Nile virus
TTGVYRIMTRG

SEQ ID NO: 147300 - protein, 11 aa, West Nile virus
TGVYRIMTRGL

SEQ ID NO: 147301 - protein, 11 aa, West Nile virus
GVYRIMTRGLL

SEQ ID NO: 147302 - protein, 11 aa, West Nile virus
VYRIMTRGLLG

SEQ ID NO: 147303 - protein, 11 aa, West Nile virus
YRIMTRGLLGS

SEQ ID NO: 147304 - protein, 11 aa, West Nile virus
RIMTRGLLGSY

SEQ ID NO: 147305 - protein, 11 aa, West Nile virus
IMTRGLLGSYQ

SEQ ID NO: 147306 - protein, 11 aa, West Nile virus
MTRGLLGSYQA

SEQ ID NO: 147307 - protein, 11 aa, West Nile virus
TRGLLGSYQAG

SEQ ID NO: 147308 - protein, 11 aa, West Nile virus
RGLLGSYQAGA

SEQ ID NO: 147309 - protein, 11 aa, West Nile virus
GLLGSYQAGAG

SEQ ID NO: 147310 - protein, 11 aa, West Nile virus
LLGSYQAGAGV

SEQ ID NO: 147311 - protein, 11 aa, West Nile virus
LGSYQAGAGVM

SEQ ID NO: 147312 - protein, 11 aa, West Nile virus
GSYQAGAGVMV

SEQ ID NO: 147313 - protein, 11 aa, West Nile virus
SYQAGAGVMVE

SEQ ID NO: 147314 - protein, 11 aa, West Nile virus
YQAGAGVMVEG

SEQ ID NO: 147315 - protein, 11 aa, West Nile virus
QAGAGVMVEGV

SEQ ID NO: 147316 - protein, 11 aa, West Nile virus
AGAGVMVEGVF

SEQ ID NO: 147317 - protein, 11 aa, West Nile virus
GAGVMVEGVFH

SEQ ID NO: 147318 - protein, 11 aa, West Nile virus
AGVMVEGVFHT

SEQ ID NO: 147319 - protein, 11 aa, West Nile virus
GVMVEGVFHTL

SEQ ID NO: 147320 - protein, 11 aa, West Nile virus
VMVEGVFHTLW

SEQ ID NO: 147321 - protein, 11 aa, West Nile virus
MVEGVFHTLWH

SEQ ID NO: 147322 - protein, 11 aa, West Nile virus
VEGVFHTLWHT

SEQ ID NO: 147323 - protein, 11 aa, West Nile virus
EGVFHTLWHTT

SEQ ID NO: 147324 - protein, 11 aa, West Nile virus
GVFHTLWHTTK

SEQ ID NO: 147325 - protein, 11 aa, West Nile virus
VFHTLWHTTKG

SEQ ID NO: 147326 - protein, 11 aa, West Nile virus
FHTLWHTTKGA

SEQ ID NO: 147327 - protein, 11 aa, West Nile virus
HTLWHTTKGAA

SEQ ID NO: 147328 - protein, 11 aa, West Nile virus
TLWHTTKGAAL

SEQ ID NO: 147329 - protein, 11 aa, West Nile virus
LWHTTKGAALM

SEQ ID NO: 147330 - protein, 11 aa, West Nile virus
WHTTKGAALMS

SEQ ID NO: 147331 - protein, 11 aa, West Nile virus
HTTKGAALMSG

SEQ ID NO: 147332 - protein, 11 aa, West Nile virus
TTKGAALMSGE

SEQ ID NO: 147333 - protein, 11 aa, West Nile virus
TKGAALMSGEG

SEQ ID NO: 147334 - protein, 11 aa, West Nile virus
KGAALMSGEGR

SEQ ID NO: 147335 - protein, 11 aa, West Nile virus
GAALMSGEGRL

SEQ ID NO: 147336 - protein, 11 aa, West Nile virus
AALMSGEGRLD

SEQ ID NO: 147337 - protein, 11 aa, West Nile virus
ALMSGEGRLDP

SEQ ID NO: 147338 - protein, 11 aa, West Nile virus
LMSGEGRLDPY

SEQ ID NO: 147339 - protein, 11 aa, West Nile virus
MSGEGRLDPYW

SEQ ID NO: 147340 - protein, 11 aa, West Nile virus
SGEGRLDPYWG

SEQ ID NO: 147341 - protein, 11 aa, West Nile virus
GEGRLDPYWGS

SEQ ID NO: 147342 - protein, 11 aa, West Nile virus
EGRLDPYWGSV

SEQ ID NO: 147343 - protein, 11 aa, West Nile virus
GRLDPYWGSVK

SEQ ID NO: 147344 - protein, 11 aa, West Nile virus
RLDPYWGSVKE

SEQ ID NO: 147345 - protein, 11 aa, West Nile virus
LDPYWGSVKED

SEQ ID NO: 147346 - protein, 11 aa, West Nile virus
DPYWGSVKEDR

SEQ ID NO: 147347 - protein, 11 aa, West Nile virus
PYWGSVKEDRL

SEQ ID NO: 147348 - protein, 11 aa, West Nile virus
YWGSVKEDRLC

SEQ ID NO: 147349 - protein, 11 aa, West Nile virus
WGSVKEDRLCY

SEQ ID NO: 147350 - protein, 11 aa, West Nile virus
GSVKEDRLCYG

SEQ ID NO: 147351 - protein, 11 aa, West Nile virus
SVKEDRLCYGG

SEQ ID NO: 147352 - protein, 11 aa, West Nile virus
VKEDRLCYGGP

SEQ ID NO: 147353 - protein, 11 aa, West Nile virus
KEDRLCYGGPW

SEQ ID NO: 147354 - protein, 11 aa, West Nile virus
EDRLCYGGPWK

SEQ ID NO: 147355 - protein, 11 aa, West Nile virus
DRLCYGGPWKL

SEQ ID NO: 147356 - protein, 11 aa, West Nile virus
RLCYGGPWKLQ

SEQ ID NO: 147357 - protein, 11 aa, West Nile virus
LCYGGPWKLQH

SEQ ID NO: 147358 - protein, 11 aa, West Nile virus
CYGGPWKLQHK

SEQ ID NO: 147359 - protein, 11 aa, West Nile virus
YGGPWKLQHKW

SEQ ID NO: 147360 - protein, 11 aa, West Nile virus
GGPWKLQHKWN

SEQ ID NO: 147361 - protein, 11 aa, West Nile virus
GPWKLQHKWNG

SEQ ID NO: 147362 - protein, 11 aa, West Nile virus
PWKLQHKWNGQ

SEQ ID NO: 147363 - protein, 11 aa, West Nile virus
WKLQHKWNGQD

SEQ ID NO: 147364 - protein, 11 aa, West Nile virus
KLQHKWNGQDE

SEQ ID NO: 147365 - protein, 11 aa, West Nile virus
LQHKWNGQDEV

SEQ ID NO: 147366 - protein, 11 aa, West Nile virus
QHKWNGQDEVQ

SEQ ID NO: 147367 - protein, 11 aa, West Nile virus
HKWNGQDEVQM

SEQ ID NO: 147368 - protein, 11 aa, West Nile virus
KWNGQDEVQMI

SEQ ID NO: 147369 - protein, 11 aa, West Nile virus
WNGQDEVQMIV

SEQ ID NO: 147370 - protein, 11 aa, West Nile virus
NGQDEVQMIVV

SEQ ID NO: 147371 - protein, 11 aa, West Nile virus
GQDEVQMIVVE

SEQ ID NO: 147372 - protein, 11 aa, West Nile virus
QDEVQMIVVEP

SEQ ID NO: 147373 - protein, 11 aa, West Nile virus
DEVQMIVVEPG

SEQ ID NO: 147374 - protein, 11 aa, West Nile virus
EVQMIVVEPGK

SEQ ID NO: 147375 - protein, 11 aa, West Nile virus
VQMIVVEPGKN

SEQ ID NO: 147376 - protein, 11 aa, West Nile virus
QMIVVEPGKNV

SEQ ID NO: 147377 - protein, 11 aa, West Nile virus
MIVVEPGKNVK

SEQ ID NO: 147378 - protein, 11 aa, West Nile virus
IVVEPGKNVKN

SEQ ID NO: 147379 - protein, 11 aa, West Nile virus
VVEPGKNVKNV

SEQ ID NO: 147380 - protein, 11 aa, West Nile virus
VEPGKNVKNVQ

SEQ ID NO: 147381 - protein, 11 aa, West Nile virus
EPGKNVKNVQT

SEQ ID NO: 147382 - protein, 11 aa, West Nile virus
PGKNVKNVQTK

SEQ ID NO: 147383 - protein, 11 aa, West Nile virus
GKNVKNVQTKP

SEQ ID NO: 147384 - protein, 11 aa, West Nile virus
KNVKNVQTKPG

SEQ ID NO: 147385 - protein, 11 aa, West Nile virus
NVKNVQTKPGV

SEQ ID NO: 147386 - protein, 11 aa, West Nile virus
VKNVQTKPGVF

SEQ ID NO: 147387 - protein, 11 aa, West Nile virus
KNVQTKPGVFK

SEQ ID NO: 147388 - protein, 11 aa, West Nile virus
NVQTKPGVFKT

SEQ ID NO: 147389 - protein, 11 aa, West Nile virus
VQTKPGVFKTP

SEQ ID NO: 147390 - protein, 11 aa, West Nile virus
QTKPGVFKTPE

SEQ ID NO: 147391 - protein, 11 aa, West Nile virus
TKPGVFKTPEG

SEQ ID NO: 147392 - protein, 11 aa, West Nile virus
KPGVFKTPEGE

SEQ ID NO: 147393 - protein, 11 aa, West Nile virus
PGVFKTPEGEI

SEQ ID NO: 147394 - protein, 11 aa, West Nile virus
GVFKTPEGEIG

SEQ ID NO: 147395 - protein, 11 aa, West Nile virus
VFKTPEGEIGA

SEQ ID NO: 147396 - protein, 11 aa, West Nile virus
FKTPEGEIGAV

SEQ ID NO: 147397 - protein, 11 aa, West Nile virus
KTPEGEIGAVT

SEQ ID NO: 147398 - protein, 11 aa, West Nile virus
TPEGEIGAVTL

SEQ ID NO: 147399 - protein, 11 aa, West Nile virus
PEGEIGAVTLD

SEQ ID NO: 147400 - protein, 11 aa, West Nile virus
EGEIGAVTLDF

SEQ ID NO: 147401 - protein, 11 aa, West Nile virus
GEIGAVTLDFP

SEQ ID NO: 147402 - protein, 11 aa, West Nile virus
EIGAVTLDFPT

SEQ ID NO: 147403 - protein, 11 aa, West Nile virus
IGAVTLDFPTG

SEQ ID NO: 147404 - protein, 11 aa, West Nile virus
GAVTLDFPTGT

SEQ ID NO: 147405 - protein, 11 aa, West Nile virus
AVTLDFPTGTS

SEQ ID NO: 147406 - protein, 11 aa, West Nile virus
VTLDFPTGTSG

SEQ ID NO: 147407 - protein, 11 aa, West Nile virus
TLDFPTGTSGS

SEQ ID NO: 147408 - protein, 11 aa, West Nile virus
LDFPTGTSGSP

SEQ ID NO: 147409 - protein, 11 aa, West Nile virus
DFPTGTSGSPI

SEQ ID NO: 147410 - protein, 11 aa, West Nile virus
FPTGTSGSPIV

SEQ ID NO: 147411 - protein, 11 aa, West Nile virus
PTGTSGSPIVD

SEQ ID NO: 147412 - protein, 11 aa, West Nile virus
TGTSGSPIVDK

SEQ ID NO: 147413 - protein, 11 aa, West Nile virus
GTSGSPIVDKN

SEQ ID NO: 147414 - protein, 11 aa, West Nile virus
TSGSPIVDKNG

SEQ ID NO: 147415 - protein, 11 aa, West Nile virus
SGSPIVDKNGD

SEQ ID NO: 147416 - protein, 11 aa, West Nile virus
GSPIVDKNGDV

SEQ ID NO: 147417 - protein, 11 aa, West Nile virus
SPIVDKNGDVI

SEQ ID NO: 147418 - protein, 11 aa, West Nile virus
PIVDKNGDVIG

SEQ ID NO: 147419 - protein, 11 aa, West Nile virus
IVDKNGDVIGL

SEQ ID NO: 147420 - protein, 11 aa, West Nile virus
VDKNGDVIGLY

SEQ ID NO: 147421 - protein, 11 aa, West Nile virus
DKNGDVIGLYG

SEQ ID NO: 147422 - protein, 11 aa, West Nile virus
KNGDVIGLYGN

SEQ ID NO: 147423 - protein, 11 aa, West Nile virus
NGDVIGLYGNG

SEQ ID NO: 147424 - protein, 11 aa, West Nile virus
GDVIGLYGNGV

SEQ ID NO: 147425 - protein, 11 aa, West Nile virus
DVIGLYGNGVI

SEQ ID NO: 147426 - protein, 11 aa, West Nile virus
VIGLYGNGVIM

SEQ ID NO: 147427 - protein, 11 aa, West Nile virus
IGLYGNGVIMP

SEQ ID NO: 147428 - protein, 11 aa, West Nile virus
GLYGNGVIMPN

SEQ ID NO: 147429 - protein, 11 aa, West Nile virus
LYGNGVIMPNG

SEQ ID NO: 147430 - protein, 11 aa, West Nile virus
YGNGVIMPNGS

SEQ ID NO: 147431 - protein, 11 aa, West Nile virus
GNGVIMPNGSY

SEQ ID NO: 147432 - protein, 11 aa, West Nile virus
NGVIMPNGSYI

SEQ ID NO: 147433 - protein, 11 aa, West Nile virus
GVIMPNGSYIS

SEQ ID NO: 147434 - protein, 11 aa, West Nile virus
VIMPNGSYISA

SEQ ID NO: 147435 - protein, 11 aa, West Nile virus
IMPNGSYISAI

SEQ ID NO: 147436 - protein, 11 aa, West Nile virus
MPNGSYISAIV

SEQ ID NO: 147437 - protein, 11 aa, West Nile virus
PNGSYISAIVQ

SEQ ID NO: 147438 - protein, 11 aa, West Nile virus
NGSYISAIVQG

SEQ ID NO: 147439 - protein, 11 aa, West Nile virus
GSYISAIVQGE

SEQ ID NO: 147440 - protein, 11 aa, West Nile virus
SYISAIVQGER

SEQ ID NO: 147441 - protein, 11 aa, West Nile virus
YISAIVQGERM

SEQ ID NO: 147442 - protein, 11 aa, West Nile virus
ISAIVQGERMD

SEQ ID NO: 147443 - protein, 11 aa, West Nile virus
SAIVQGERMDE

SEQ ID NO: 147444 - protein, 11 aa, West Nile virus
AIVQGERMDEP

SEQ ID NO: 147445 - protein, 11 aa, West Nile virus
IVQGERMDEPI

SEQ ID NO: 147446 - protein, 11 aa, West Nile virus
VQGERMDEPIP

SEQ ID NO: 147447 - protein, 11 aa, West Nile virus
QGERMDEPIPA

SEQ ID NO: 147448 - protein, 11 aa, West Nile virus
GERMDEPIPAG

SEQ ID NO: 147449 - protein, 11 aa, West Nile virus
ERMDEPIPAGF

SEQ ID NO: 147450 - protein, 11 aa, West Nile virus
GFEPEMLRKKQ

SEQ ID NO: 147451 - protein, 11 aa, West Nile virus
FEPEMLRKKQI

SEQ ID NO: 147452 - protein, 11 aa, West Nile virus
PEMLRKKQITV

SEQ ID NO: 147453 - protein, 11 aa, West Nile virus
EMLRKKQITVL

SEQ ID NO: 147454 - protein, 11 aa, West Nile virus
MLRKKQITVLD

SEQ ID NO: 147455 - protein, 11 aa, West Nile virus
LRKKQITVLDL

SEQ ID NO: 147456 - protein, 11 aa, West Nile virus
RKKQITVLDLH

SEQ ID NO: 147457 - protein, 11 aa, West Nile virus
KKQITVLDLHP

SEQ ID NO: 147458 - protein, 11 aa, West Nile virus
KQITVLDLHPG

SEQ ID NO: 147459 - protein, 11 aa, West Nile virus
QITVLDLHPGA

SEQ ID NO: 147460 - protein, 11 aa, West Nile virus
ITVLDLHPGAG

SEQ ID NO: 147461 - protein, 11 aa, West Nile virus
TVLDLHPGAGK

SEQ ID NO: 147462 - protein, 11 aa, West Nile virus
VLDLHPGAGKT

SEQ ID NO: 147463 - protein, 11 aa, West Nile virus
LDLHPGAGKTR

SEQ ID NO: 147464 - protein, 11 aa, West Nile virus
DLHPGAGKTRR

SEQ ID NO: 147465 - protein, 11 aa, West Nile virus
LHPGAGKTRRI

SEQ ID NO: 147466 - protein, 11 aa, West Nile virus
HPGAGKTRRIL

SEQ ID NO: 147467 - protein, 11 aa, West Nile virus
PGAGKTRRILP

SEQ ID NO: 147468 - protein, 11 aa, West Nile virus
GAGKTRRILPQ

SEQ ID NO: 147469 - protein, 11 aa, West Nile virus
AGKTRRILPQI

SEQ ID NO: 147470 - protein, 11 aa, West Nile virus
GKTRRILPQII

SEQ ID NO: 147471 - protein, 11 aa, West Nile virus
KTRRILPQIIK

SEQ ID NO: 147472 - protein, 11 aa, West Nile virus
TRRILPQIIKE

SEQ ID NO: 147473 - protein, 11 aa, West Nile virus
RRILPQIIKEA

SEQ ID NO: 147474 - protein, 11 aa, West Nile virus
RILPQIIKEAI

SEQ ID NO: 147475 - protein, 11 aa, West Nile virus
ILPQIIKEAIN

SEQ ID NO: 147476 - protein, 11 aa, West Nile virus
LPQIIKEAINR

SEQ ID NO: 147477 - protein, 11 aa, West Nile virus
PQIIKEAINRR

SEQ ID NO: 147478 - protein, 11 aa, West Nile virus
QIIKEAINRRL

SEQ ID NO: 147479 - protein, 11 aa, West Nile virus
IIKEAINRRLR

SEQ ID NO: 147480 - protein, 11 aa, West Nile virus
IKEAINRRLRT

SEQ ID NO: 147481 - protein, 11 aa, West Nile virus
KEAINRRLRTA

SEQ ID NO: 147482 - protein, 11 aa, West Nile virus
NRRLRTAVLAP

SEQ ID NO: 147483 - protein, 11 aa, West Nile virus
RRLRTAVLAPT

SEQ ID NO: 147484 - protein, 11 aa, West Nile virus
RLRTAVLAPTR

SEQ ID NO: 147485 - protein, 11 aa, West Nile virus
LRTAVLAPTRV

SEQ ID NO: 147486 - protein, 11 aa, West Nile virus
RTAVLAPTRVV

SEQ ID NO: 147487 - protein, 11 aa, West Nile virus
TAVLAPTRVVA

SEQ ID NO: 147488 - protein, 11 aa, West Nile virus
AVLAPTRVVAA

SEQ ID NO: 147489 - protein, 11 aa, West Nile virus
VLAPTRVVAAE

SEQ ID NO: 147490 - protein, 11 aa, West Nile virus
LAPTRVVAAEM

SEQ ID NO: 147491 - protein, 11 aa, West Nile virus
APTRVVAAEMA

SEQ ID NO: 147492 - protein, 11 aa, West Nile virus
PTRVVAAEMAE

SEQ ID NO: 147493 - protein, 11 aa, West Nile virus
TRVVAAEMAEA

SEQ ID NO: 147494 - protein, 11 aa, West Nile virus
RVVAAEMAEAL

SEQ ID NO: 147495 - protein, 11 aa, West Nile virus
VVAAEMAEALR

SEQ ID NO: 147496 - protein, 11 aa, West Nile virus
VAAEMAEALRG

SEQ ID NO: 147497 - protein, 11 aa, West Nile virus
AAEMAEALRGL

SEQ ID NO: 147498 - protein, 11 aa, West Nile virus
AEMAEALRGLP

SEQ ID NO: 147499 - protein, 11 aa, West Nile virus
EMAEALRGLPI

SEQ ID NO: 147500 - protein, 11 aa, West Nile virus
MAEALRGLPIR

SEQ ID NO: 147501 - protein, 11 aa, West Nile virus
AEALRGLPIRY

SEQ ID NO: 147502 - protein, 11 aa, West Nile virus
EALRGLPIRYQ

SEQ ID NO: 147503 - protein, 11 aa, West Nile virus
ALRGLPIRYQT

SEQ ID NO: 147504 - protein, 11 aa, West Nile virus
LRGLPIRYQTS

SEQ ID NO: 147505 - protein, 11 aa, West Nile virus
RGLPIRYQTSA

SEQ ID NO: 147506 - protein, 11 aa, West Nile virus
GLPIRYQTSAV

SEQ ID NO: 147507 - protein, 11 aa, West Nile virus
LPIRYQTSAVP

SEQ ID NO: 147508 - protein, 11 aa, West Nile virus
PIRYQTSAVPR

SEQ ID NO: 147509 - protein, 11 aa, West Nile virus
IRYQTSAVPRE

SEQ ID NO: 147510 - protein, 11 aa, West Nile virus
RYQTSAVPREH

SEQ ID NO: 147511 - protein, 11 aa, West Nile virus
REHNGNEIVDV

SEQ ID NO: 147512 - protein, 11 aa, West Nile virus
EHNGNEIVDVM

SEQ ID NO: 147513 - protein, 11 aa, West Nile virus
HNGNEIVDVMC

SEQ ID NO: 147514 - protein, 11 aa, West Nile virus
NGNEIVDVMCH

SEQ ID NO: 147515 - protein, 11 aa, West Nile virus
GNEIVDVMCHA

SEQ ID NO: 147516 - protein, 11 aa, West Nile virus
NEIVDVMCHAT

SEQ ID NO: 147517 - protein, 11 aa, West Nile virus
EIVDVMCHATL

SEQ ID NO: 147518 - protein, 11 aa, West Nile virus
IVDVMCHATLT

SEQ ID NO: 147519 - protein, 11 aa, West Nile virus
VDVMCHATLTH

SEQ ID NO: 147520 - protein, 11 aa, West Nile virus
DVMCHATLTHR

SEQ ID NO: 147521 - protein, 11 aa, West Nile virus
VMCHATLTHRL

SEQ ID NO: 147522 - protein, 11 aa, West Nile virus
MCHATLTHRLM

SEQ ID NO: 147523 - protein, 11 aa, West Nile virus
CHATLTHRLMS

SEQ ID NO: 147524 - protein, 11 aa, West Nile virus
HATLTHRLMSP

SEQ ID NO: 147525 - protein, 11 aa, West Nile virus
ATLTHRLMSPH

SEQ ID NO: 147526 - protein, 11 aa, West Nile virus
TLTHRLMSPHR

SEQ ID NO: 147527 - protein, 11 aa, West Nile virus
LTHRLMSPHRV

SEQ ID NO: 147528 - protein, 11 aa, West Nile virus
THRLMSPHRVP

SEQ ID NO: 147529 - protein, 11 aa, West Nile virus
HRLMSPHRVPN

SEQ ID NO: 147530 - protein, 11 aa, West Nile virus
RLMSPHRVPNY

SEQ ID NO: 147531 - protein, 11 aa, West Nile virus
LMSPHRVPNYN

SEQ ID NO: 147532 - protein, 11 aa, West Nile virus
MSPHRVPNYNL

SEQ ID NO: 147533 - protein, 11 aa, West Nile virus
SPHRVPNYNLF

SEQ ID NO: 147534 - protein, 11 aa, West Nile virus
PHRVPNYNLFV

SEQ ID NO: 147535 - protein, 11 aa, West Nile virus
HRVPNYNLFVM

SEQ ID NO: 147536 - protein, 11 aa, West Nile virus
RVPNYNLFVMD

SEQ ID NO: 147537 - protein, 11 aa, West Nile virus
VPNYNLFVMDE

SEQ ID NO: 147538 - protein, 11 aa, West Nile virus
PNYNLFVMDEA

SEQ ID NO: 147539 - protein, 11 aa, West Nile virus
NYNLFVMDEAH

SEQ ID NO: 147540 - protein, 11 aa, West Nile virus
YNLFVMDEAHF

SEQ ID NO: 147541 - protein, 11 aa, West Nile virus
NLFVMDEAHFT

SEQ ID NO: 147542 - protein, 11 aa, West Nile virus
LFVMDEAHFTD

SEQ ID NO: 147543 - protein, 11 aa, West Nile virus
FVMDEAHFTDP

SEQ ID NO: 147544 - protein, 11 aa, West Nile virus
VMDEAHFTDPA

SEQ ID NO: 147545 - protein, 11 aa, West Nile virus
MDEAHFTDPAS

SEQ ID NO: 147546 - protein, 11 aa, West Nile virus
DEAHFTDPASI

SEQ ID NO: 147547 - protein, 11 aa, West Nile virus
EAHFTDPASIA

SEQ ID NO: 147548 - protein, 11 aa, West Nile virus
AHFTDPASIAA

SEQ ID NO: 147549 - protein, 11 aa, West Nile virus
HFTDPASIAAR

SEQ ID NO: 147550 - protein, 11 aa, West Nile virus
FTDPASIAARG

SEQ ID NO: 147551 - protein, 11 aa, West Nile virus
TDPASIAARGY

SEQ ID NO: 147552 - protein, 11 aa, West Nile virus
DPASIAARGYI

SEQ ID NO: 147553 - protein, 11 aa, West Nile virus
PASIAARGYIS

SEQ ID NO: 147554 - protein, 11 aa, West Nile virus
ASIAARGYIST

SEQ ID NO: 147555 - protein, 11 aa, West Nile virus
SIAARGYISTK

SEQ ID NO: 147556 - protein, 11 aa, West Nile virus
IAARGYISTKV

SEQ ID NO: 147557 - protein, 11 aa, West Nile virus
AARGYISTKVE

SEQ ID NO: 147558 - protein, 11 aa, West Nile virus
ARGYISTKVEL

SEQ ID NO: 147559 - protein, 11 aa, West Nile virus
RGYISTKVELG

SEQ ID NO: 147560 - protein, 11 aa, West Nile virus
GYISTKVELGE

SEQ ID NO: 147561 - protein, 11 aa, West Nile virus
YISTKVELGEA

SEQ ID NO: 147562 - protein, 11 aa, West Nile virus
ISTKVELGEAA

SEQ ID NO: 147563 - protein, 11 aa, West Nile virus
STKVELGEAAA

SEQ ID NO: 147564 - protein, 11 aa, West Nile virus
TKVELGEAAAI

SEQ ID NO: 147565 - protein, 11 aa, West Nile virus
KVELGEAAAIF

SEQ ID NO: 147566 - protein, 11 aa, West Nile virus
VELGEAAAIFM

SEQ ID NO: 147567 - protein, 11 aa, West Nile virus
ELGEAAAIFMT

SEQ ID NO: 147568 - protein, 11 aa, West Nile virus
LGEAAAIFMTA

SEQ ID NO: 147569 - protein, 11 aa, West Nile virus
GEAAAIFMTAT

SEQ ID NO: 147570 - protein, 11 aa, West Nile virus
EAAAIFMTATP

SEQ ID NO: 147571 - protein, 11 aa, West Nile virus
AAAIFMTATPP

SEQ ID NO: 147572 - protein, 11 aa, West Nile virus
AAIFMTATPPG

SEQ ID NO: 147573 - protein, 11 aa, West Nile virus
AIFMTATPPGT

SEQ ID NO: 147574 - protein, 11 aa, West Nile virus
IFMTATPPGTS

SEQ ID NO: 147575 - protein, 11 aa, West Nile virus
FMTATPPGTSD

SEQ ID NO: 147576 - protein, 11 aa, West Nile virus
MTATPPGTSDP

SEQ ID NO: 147577 - protein, 11 aa, West Nile virus
TATPPGTSDPF

SEQ ID NO: 147578 - protein, 11 aa, West Nile virus
ATPPGTSDPFP

SEQ ID NO: 147579 - protein, 11 aa, West Nile virus
TPPGTSDPFPE

SEQ ID NO: 147580 - protein, 11 aa, West Nile virus
PPGTSDPFPES

SEQ ID NO: 147581 - protein, 11 aa, West Nile virus
PGTSDPFPESN

SEQ ID NO: 147582 - protein, 11 aa, West Nile virus
GTSDPFPESNS

SEQ ID NO: 147583 - protein, 11 aa, West Nile virus
TSDPFPESNSP

SEQ ID NO: 147584 - protein, 11 aa, West Nile virus
SDPFPESNSPI

SEQ ID NO: 147585 - protein, 11 aa, West Nile virus
DLQTEIPDRAW

SEQ ID NO: 147586 - protein, 11 aa, West Nile virus
LQTEIPDRAWN

SEQ ID NO: 147587 - protein, 11 aa, West Nile virus
QTEIPDRAWNS

SEQ ID NO: 147588 - protein, 11 aa, West Nile virus
TEIPDRAWNSG

SEQ ID NO: 147589 - protein, 11 aa, West Nile virus
EIPDRAWNSGY

SEQ ID NO: 147590 - protein, 11 aa, West Nile virus
IPDRAWNSGYE

SEQ ID NO: 147591 - protein, 11 aa, West Nile virus
PDRAWNSGYEW

SEQ ID NO: 147592 - protein, 11 aa, West Nile virus
DRAWNSGYEWI

SEQ ID NO: 147593 - protein, 11 aa, West Nile virus
RAWNSGYEWIT

SEQ ID NO: 147594 - protein, 11 aa, West Nile virus
AWNSGYEWITE

SEQ ID NO: 147595 - protein, 11 aa, West Nile virus
WNSGYEWITEY

SEQ ID NO: 147596 - protein, 11 aa, West Nile virus
NSGYEWITEYT

SEQ ID NO: 147597 - protein, 11 aa, West Nile virus
SGYEWITEYTG

SEQ ID NO: 147598 - protein, 11 aa, West Nile virus
GYEWITEYTGK

SEQ ID NO: 147599 - protein, 11 aa, West Nile virus
YEWITEYTGKT

SEQ ID NO: 147600 - protein, 11 aa, West Nile virus
EWITEYTGKTV

SEQ ID NO: 147601 - protein, 11 aa, West Nile virus
WITEYTGKTVW

SEQ ID NO: 147602 - protein, 11 aa, West Nile virus
ITEYTGKTVWF

SEQ ID NO: 147603 - protein, 11 aa, West Nile virus
TEYTGKTVWFV

SEQ ID NO: 147604 - protein, 11 aa, West Nile virus
EYTGKTVWFVP

SEQ ID NO: 147605 - protein, 11 aa, West Nile virus
YTGKTVWFVPS

SEQ ID NO: 147606 - protein, 11 aa, West Nile virus
TGKTVWFVPSV

SEQ ID NO: 147607 - protein, 11 aa, West Nile virus
GKTVWFVPSVK

SEQ ID NO: 147608 - protein, 11 aa, West Nile virus
KTVWFVPSVKM

SEQ ID NO: 147609 - protein, 11 aa, West Nile virus
TVWFVPSVKMG

SEQ ID NO: 147610 - protein, 11 aa, West Nile virus
VWFVPSVKMGN

SEQ ID NO: 147611 - protein, 11 aa, West Nile virus
WFVPSVKMGNE

SEQ ID NO: 147612 - protein, 11 aa, West Nile virus
FVPSVKMGNEI

SEQ ID NO: 147613 - protein, 11 aa, West Nile virus
VPSVKMGNEIA

SEQ ID NO: 147614 - protein, 11 aa, West Nile virus
PSVKMGNEIAL

SEQ ID NO: 147615 - protein, 11 aa, West Nile virus
SVKMGNEIALC

SEQ ID NO: 147616 - protein, 11 aa, West Nile virus
VKMGNEIALCL

SEQ ID NO: 147617 - protein, 11 aa, West Nile virus
KMGNEIALCLQ

SEQ ID NO: 147618 - protein, 11 aa, West Nile virus
MGNEIALCLQR

SEQ ID NO: 147619 - protein, 11 aa, West Nile virus
GNEIALCLQRA

SEQ ID NO: 147620 - protein, 11 aa, West Nile virus
NEIALCLQRAG

SEQ ID NO: 147621 - protein, 11 aa, West Nile virus
EIALCLQRAGK

SEQ ID NO: 147622 - protein, 11 aa, West Nile virus
IALCLQRAGKK

SEQ ID NO: 147623 - protein, 11 aa, West Nile virus
ALCLQRAGKKV

SEQ ID NO: 147624 - protein, 11 aa, West Nile virus
LCLQRAGKKVV

SEQ ID NO: 147625 - protein, 11 aa, West Nile virus
CLQRAGKKVVQ

SEQ ID NO: 147626 - protein, 11 aa, West Nile virus
LQRAGKKVVQL

SEQ ID NO: 147627 - protein, 11 aa, West Nile virus
QRAGKKVVQLN

SEQ ID NO: 147628 - protein, 11 aa, West Nile virus
RAGKKVVQLNR

SEQ ID NO: 147629 - protein, 11 aa, West Nile virus
AGKKVVQLNRK

SEQ ID NO: 147630 - protein, 11 aa, West Nile virus
GKKVVQLNRKS

SEQ ID NO: 147631 - protein, 11 aa, West Nile virus
KKVVQLNRKSY

SEQ ID NO: 147632 - protein, 11 aa, West Nile virus
KVVQLNRKSYE

SEQ ID NO: 147633 - protein, 11 aa, West Nile virus
VVQLNRKSYET

SEQ ID NO: 147634 - protein, 11 aa, West Nile virus
VQLNRKSYETE

SEQ ID NO: 147635 - protein, 11 aa, West Nile virus
QLNRKSYETEY

SEQ ID NO: 147636 - protein, 11 aa, West Nile virus
LNRKSYETEYP

SEQ ID NO: 147637 - protein, 11 aa, West Nile virus
NRKSYETEYPK

SEQ ID NO: 147638 - protein, 11 aa, West Nile virus
RKSYETEYPKC

SEQ ID NO: 147639 - protein, 11 aa, West Nile virus
KSYETEYPKCK

SEQ ID NO: 147640 - protein, 11 aa, West Nile virus
SYETEYPKCKN

SEQ ID NO: 147641 - protein, 11 aa, West Nile virus
YETEYPKCKND

SEQ ID NO: 147642 - protein, 11 aa, West Nile virus
ETEYPKCKNDD

SEQ ID NO: 147643 - protein, 11 aa, West Nile virus
TEYPKCKNDDW

SEQ ID NO: 147644 - protein, 11 aa, West Nile virus
EYPKCKNDDWD

SEQ ID NO: 147645 - protein, 11 aa, West Nile virus
YPKCKNDDWDF

SEQ ID NO: 147646 - protein, 11 aa, West Nile virus
PKCKNDDWDFV

SEQ ID NO: 147647 - protein, 11 aa, West Nile virus
KCKNDDWDFVI

SEQ ID NO: 147648 - protein, 11 aa, West Nile virus
CKNDDWDFVIT

SEQ ID NO: 147649 - protein, 11 aa, West Nile virus
KNDDWDFVITT

SEQ ID NO: 147650 - protein, 11 aa, West Nile virus
NDDWDFVITTD

SEQ ID NO: 147651 - protein, 11 aa, West Nile virus
DDWDFVITTDI

SEQ ID NO: 147652 - protein, 11 aa, West Nile virus
DWDFVITTDIS

SEQ ID NO: 147653 - protein, 11 aa, West Nile virus
WDFVITTDISE

SEQ ID NO: 147654 - protein, 11 aa, West Nile virus
DFVITTDISEM

SEQ ID NO: 147655 - protein, 11 aa, West Nile virus
FVITTDISEMG

SEQ ID NO: 147656 - protein, 11 aa, West Nile virus
VITTDISEMGA

SEQ ID NO: 147657 - protein, 11 aa, West Nile virus
ITTDISEMGAN

SEQ ID NO: 147658 - protein, 11 aa, West Nile virus
TTDISEMGANF

SEQ ID NO: 147659 - protein, 11 aa, West Nile virus
TDISEMGANFK

SEQ ID NO: 147660 - protein, 11 aa, West Nile virus
DISEMGANFKA

SEQ ID NO: 147661 - protein, 11 aa, West Nile virus
ISEMGANFKAS

SEQ ID NO: 147662 - protein, 11 aa, West Nile virus
SEMGANFKASR

SEQ ID NO: 147663 - protein, 11 aa, West Nile virus
EMGANFKASRV

SEQ ID NO: 147664 - protein, 11 aa, West Nile virus
MGANFKASRVI

SEQ ID NO: 147665 - protein, 11 aa, West Nile virus
GANFKASRVID

SEQ ID NO: 147666 - protein, 11 aa, West Nile virus
ANFKASRVIDS

SEQ ID NO: 147667 - protein, 11 aa, West Nile virus
NFKASRVIDSR

SEQ ID NO: 147668 - protein, 11 aa, West Nile virus
FKASRVIDSRK

SEQ ID NO: 147669 - protein, 11 aa, West Nile virus
KASRVIDSRKS

SEQ ID NO: 147670 - protein, 11 aa, West Nile virus
ASRVIDSRKSV

SEQ ID NO: 147671 - protein, 11 aa, West Nile virus
SRVIDSRKSVK

SEQ ID NO: 147672 - protein, 11 aa, West Nile virus
RVIDSRKSVKP

SEQ ID NO: 147673 - protein, 11 aa, West Nile virus
VIDSRKSVKPT

SEQ ID NO: 147674 - protein, 11 aa, West Nile virus
IDSRKSVKPTI

SEQ ID NO: 147675 - protein, 11 aa, West Nile virus
DSRKSVKPTII

SEQ ID NO: 147676 - protein, 11 aa, West Nile virus
SRKSVKPTIIT

SEQ ID NO: 147677 - protein, 11 aa, West Nile virus
RKSVKPTIITE

SEQ ID NO: 147678 - protein, 11 aa, West Nile virus
KSVKPTIITEG

SEQ ID NO: 147679 - protein, 11 aa, West Nile virus
SVKPTIITEGE

SEQ ID NO: 147680 - protein, 11 aa, West Nile virus
ITEGEGRVILG

SEQ ID NO: 147681 - protein, 11 aa, West Nile virus
TEGEGRVILGE

SEQ ID NO: 147682 - protein, 11 aa, West Nile virus
EGEGRVILGEP

SEQ ID NO: 147683 - protein, 11 aa, West Nile virus
GEGRVILGEPS

SEQ ID NO: 147684 - protein, 11 aa, West Nile virus
EGRVILGEPSA

SEQ ID NO: 147685 - protein, 11 aa, West Nile virus
GRVILGEPSAV

SEQ ID NO: 147686 - protein, 11 aa, West Nile virus
RVILGEPSAVT

SEQ ID NO: 147687 - protein, 11 aa, West Nile virus
VILGEPSAVTA

SEQ ID NO: 147688 - protein, 11 aa, West Nile virus
ILGEPSAVTAA

SEQ ID NO: 147689 - protein, 11 aa, West Nile virus
LGEPSAVTAAS

SEQ ID NO: 147690 - protein, 11 aa, West Nile virus
GEPSAVTAASA

SEQ ID NO: 147691 - protein, 11 aa, West Nile virus
EPSAVTAASAA

SEQ ID NO: 147692 - protein, 11 aa, West Nile virus
PSAVTAASAAQ

SEQ ID NO: 147693 - protein, 11 aa, West Nile virus
SAVTAASAAQR

SEQ ID NO: 147694 - protein, 11 aa, West Nile virus
AVTAASAAQRR

SEQ ID NO: 147695 - protein, 11 aa, West Nile virus
VTAASAAQRRG

SEQ ID NO: 147696 - protein, 11 aa, West Nile virus
TAASAAQRRGR

SEQ ID NO: 147697 - protein, 11 aa, West Nile virus
AASAAQRRGRI

SEQ ID NO: 147698 - protein, 11 aa, West Nile virus
ASAAQRRGRIG

SEQ ID NO: 147699 - protein, 11 aa, West Nile virus
SAAQRRGRIGR

SEQ ID NO: 147700 - protein, 11 aa, West Nile virus
AAQRRGRIGRN

SEQ ID NO: 147701 - protein, 11 aa, West Nile virus
AQRRGRIGRNP

SEQ ID NO: 147702 - protein, 11 aa, West Nile virus
QRRGRIGRNPS

SEQ ID NO: 147703 - protein, 11 aa, West Nile virus
RRGRIGRNPSQ

SEQ ID NO: 147704 - protein, 11 aa, West Nile virus
RGRIGRNPSQV

SEQ ID NO: 147705 - protein, 11 aa, West Nile virus
GRIGRNPSQVG

SEQ ID NO: 147706 - protein, 11 aa, West Nile virus
RIGRNPSQVGD

SEQ ID NO: 147707 - protein, 11 aa, West Nile virus
IGRNPSQVGDE

SEQ ID NO: 147708 - protein, 11 aa, West Nile virus
GRNPSQVGDEY

SEQ ID NO: 147709 - protein, 11 aa, West Nile virus
RNPSQVGDEYC

SEQ ID NO: 147710 - protein, 11 aa, West Nile virus
NPSQVGDEYCY

SEQ ID NO: 147711 - protein, 11 aa, West Nile virus
PSQVGDEYCYG

SEQ ID NO: 147712 - protein, 11 aa, West Nile virus
SQVGDEYCYGG

SEQ ID NO: 147713 - protein, 11 aa, West Nile virus
QVGDEYCYGGH

SEQ ID NO: 147714 - protein, 11 aa, West Nile virus
VGDEYCYGGHT

SEQ ID NO: 147715 - protein, 11 aa, West Nile virus
GDEYCYGGHTN

SEQ ID NO: 147716 - protein, 11 aa, West Nile virus
DEYCYGGHTNE

SEQ ID NO: 147717 - protein, 11 aa, West Nile virus
EYCYGGHTNED

SEQ ID NO: 147718 - protein, 11 aa, West Nile virus
YCYGGHTNEDD

SEQ ID NO: 147719 - protein, 11 aa, West Nile virus
CYGGHTNEDDS

SEQ ID NO: 147720 - protein, 11 aa, West Nile virus
YGGHTNEDDSN

SEQ ID NO: 147721 - protein, 11 aa, West Nile virus
GGHTNEDDSNF

SEQ ID NO: 147722 - protein, 11 aa, West Nile virus
GHTNEDDSNFA

SEQ ID NO: 147723 - protein, 11 aa, West Nile virus
HTNEDDSNFAH

SEQ ID NO: 147724 - protein, 11 aa, West Nile virus
TNEDDSNFAHW

SEQ ID NO: 147725 - protein, 11 aa, West Nile virus
NEDDSNFAHWT

SEQ ID NO: 147726 - protein, 11 aa, West Nile virus
EDDSNFAHWTE

SEQ ID NO: 147727 - protein, 11 aa, West Nile virus
DDSNFAHWTEA

SEQ ID NO: 147728 - protein, 11 aa, West Nile virus
DSNFAHWTEAR

SEQ ID NO: 147729 - protein, 11 aa, West Nile virus
SNFAHWTEARI

SEQ ID NO: 147730 - protein, 11 aa, West Nile virus
NFAHWTEARIM

SEQ ID NO: 147731 - protein, 11 aa, West Nile virus
FAHWTEARIML

SEQ ID NO: 147732 - protein, 11 aa, West Nile virus
AHWTEARIMLD

SEQ ID NO: 147733 - protein, 11 aa, West Nile virus
HWTEARIMLDN

SEQ ID NO: 147734 - protein, 11 aa, West Nile virus
WTEARIMLDNI

SEQ ID NO: 147735 - protein, 11 aa, West Nile virus
TEARIMLDNIN

SEQ ID NO: 147736 - protein, 11 aa, West Nile virus
EARIMLDNINM

SEQ ID NO: 147737 - protein, 11 aa, West Nile virus
ARIMLDNINMP

SEQ ID NO: 147738 - protein, 11 aa, West Nile virus
RIMLDNINMPN

SEQ ID NO: 147739 - protein, 11 aa, West Nile virus
IMLDNINMPNG

SEQ ID NO: 147740 - protein, 11 aa, West Nile virus
MLDNINMPNGL

SEQ ID NO: 147741 - protein, 11 aa, West Nile virus
LDNINMPNGLI

SEQ ID NO: 147742 - protein, 11 aa, West Nile virus
DNINMPNGLIA

SEQ ID NO: 147743 - protein, 11 aa, West Nile virus
NINMPNGLIAQ

SEQ ID NO: 147744 - protein, 11 aa, West Nile virus
INMPNGLIAQF

SEQ ID NO: 147745 - protein, 11 aa, West Nile virus
NMPNGLIAQFY

SEQ ID NO: 147746 - protein, 11 aa, West Nile virus
MPNGLIAQFYQ

SEQ ID NO: 147747 - protein, 11 aa, West Nile virus
PNGLIAQFYQP

SEQ ID NO: 147748 - protein, 11 aa, West Nile virus
NGLIAQFYQPE

SEQ ID NO: 147749 - protein, 11 aa, West Nile virus
GLIAQFYQPER

SEQ ID NO: 147750 - protein, 11 aa, West Nile virus
LIAQFYQPERE

SEQ ID NO: 147751 - protein, 11 aa, West Nile virus
IAQFYQPEREK

SEQ ID NO: 147752 - protein, 11 aa, West Nile virus
AQFYQPEREKV

SEQ ID NO: 147753 - protein, 11 aa, West Nile virus
QFYQPEREKVY

SEQ ID NO: 147754 - protein, 11 aa, West Nile virus
FYQPEREKVYT

SEQ ID NO: 147755 - protein, 11 aa, West Nile virus
YQPEREKVYTM

SEQ ID NO: 147756 - protein, 11 aa, West Nile virus
QPEREKVYTMD

SEQ ID NO: 147757 - protein, 11 aa, West Nile virus
PEREKVYTMDG

SEQ ID NO: 147758 - protein, 11 aa, West Nile virus
EREKVYTMDGE

SEQ ID NO: 147759 - protein, 11 aa, West Nile virus
REKVYTMDGEY

SEQ ID NO: 147760 - protein, 11 aa, West Nile virus
EKVYTMDGEYR

SEQ ID NO: 147761 - protein, 11 aa, West Nile virus
KVYTMDGEYRL

SEQ ID NO: 147762 - protein, 11 aa, West Nile virus
VYTMDGEYRLR

SEQ ID NO: 147763 - protein, 11 aa, West Nile virus
YTMDGEYRLRG

SEQ ID NO: 147764 - protein, 11 aa, West Nile virus
TMDGEYRLRGE

SEQ ID NO: 147765 - protein, 11 aa, West Nile virus
MDGEYRLRGEE

SEQ ID NO: 147766 - protein, 11 aa, West Nile virus
DGEYRLRGEER

SEQ ID NO: 147767 - protein, 11 aa, West Nile virus
GEYRLRGEERK

SEQ ID NO: 147768 - protein, 11 aa, West Nile virus
EYRLRGEERKN

SEQ ID NO: 147769 - protein, 11 aa, West Nile virus
YRLRGEERKNF

SEQ ID NO: 147770 - protein, 11 aa, West Nile virus
RLRGEERKNFL

SEQ ID NO: 147771 - protein, 11 aa, West Nile virus
LRGEERKNFLE

SEQ ID NO: 147772 - protein, 11 aa, West Nile virus
RGEERKNFLEL

SEQ ID NO: 147773 - protein, 11 aa, West Nile virus
GEERKNFLELL

SEQ ID NO: 147774 - protein, 11 aa, West Nile virus
EERKNFLELLR

SEQ ID NO: 147775 - protein, 11 aa, West Nile virus
ERKNFLELLRT

SEQ ID NO: 147776 - protein, 11 aa, West Nile virus
RKNFLELLRTA

SEQ ID NO: 147777 - protein, 11 aa, West Nile virus
KNFLELLRTAD

SEQ ID NO: 147778 - protein, 11 aa, West Nile virus
NFLELLRTADL

SEQ ID NO: 147779 - protein, 11 aa, West Nile virus
FLELLRTADLP

SEQ ID NO: 147780 - protein, 11 aa, West Nile virus
LELLRTADLPV

SEQ ID NO: 147781 - protein, 11 aa, West Nile virus
ELLRTADLPVW

SEQ ID NO: 147782 - protein, 11 aa, West Nile virus
LLRTADLPVWL

SEQ ID NO: 147783 - protein, 11 aa, West Nile virus
LRTADLPVWLA

SEQ ID NO: 147784 - protein, 11 aa, West Nile virus
RTADLPVWLAY

SEQ ID NO: 147785 - protein, 11 aa, West Nile virus
TADLPVWLAYK

SEQ ID NO: 147786 - protein, 11 aa, West Nile virus
ADLPVWLAYKV

SEQ ID NO: 147787 - protein, 11 aa, West Nile virus
DLPVWLAYKVA

SEQ ID NO: 147788 - protein, 11 aa, West Nile virus
LPVWLAYKVAA

SEQ ID NO: 147789 - protein, 11 aa, West Nile virus
PVWLAYKVAAA

SEQ ID NO: 147790 - protein, 11 aa, West Nile virus
VWLAYKVAAAG

SEQ ID NO: 147791 - protein, 11 aa, West Nile virus
WLAYKVAAAGV

SEQ ID NO: 147792 - protein, 11 aa, West Nile virus
KVAAAGVSYHD

SEQ ID NO: 147793 - protein, 11 aa, West Nile virus
VAAAGVSYHDR

SEQ ID NO: 147794 - protein, 11 aa, West Nile virus
AAAGVSYHDRR

SEQ ID NO: 147795 - protein, 11 aa, West Nile virus
AAGVSYHDRRW

SEQ ID NO: 147796 - protein, 11 aa, West Nile virus
AGVSYHDRRWC

SEQ ID NO: 147797 - protein, 11 aa, West Nile virus
GVSYHDRRWCF

SEQ ID NO: 147798 - protein, 11 aa, West Nile virus
VSYHDRRWCFD

SEQ ID NO: 147799 - protein, 11 aa, West Nile virus
SYHDRRWCFDG

SEQ ID NO: 147800 - protein, 11 aa, West Nile virus
YHDRRWCFDGP

SEQ ID NO: 147801 - protein, 11 aa, West Nile virus
HDRRWCFDGPR

SEQ ID NO: 147802 - protein, 11 aa, West Nile virus
DRRWCFDGPRT

SEQ ID NO: 147803 - protein, 11 aa, West Nile virus
RRWCFDGPRTN

SEQ ID NO: 147804 - protein, 11 aa, West Nile virus
RWCFDGPRTNT

SEQ ID NO: 147805 - protein, 11 aa, West Nile virus
WCFDGPRTNTI

SEQ ID NO: 147806 - protein, 11 aa, West Nile virus
CFDGPRTNTIL

SEQ ID NO: 147807 - protein, 11 aa, West Nile virus
FDGPRTNTILE

SEQ ID NO: 147808 - protein, 11 aa, West Nile virus
DGPRTNTILED

SEQ ID NO: 147809 - protein, 11 aa, West Nile virus
GPRTNTILEDN

SEQ ID NO: 147810 - protein, 11 aa, West Nile virus
PRTNTILEDNN

SEQ ID NO: 147811 - protein, 11 aa, West Nile virus
RTNTILEDNNE

SEQ ID NO: 147812 - protein, 11 aa, West Nile virus
TNTILEDNNEV

SEQ ID NO: 147813 - protein, 11 aa, West Nile virus
NTILEDNNEVE

SEQ ID NO: 147814 - protein, 11 aa, West Nile virus
TILEDNNEVEV

SEQ ID NO: 147815 - protein, 11 aa, West Nile virus
ILEDNNEVEVI

SEQ ID NO: 147816 - protein, 11 aa, West Nile virus
LEDNNEVEVIT

SEQ ID NO: 147817 - protein, 11 aa, West Nile virus
EDNNEVEVITK

SEQ ID NO: 147818 - protein, 11 aa, West Nile virus
DNNEVEVITKL

SEQ ID NO: 147819 - protein, 11 aa, West Nile virus
NNEVEVITKLG

SEQ ID NO: 147820 - protein, 11 aa, West Nile virus
NEVEVITKLGE

SEQ ID NO: 147821 - protein, 11 aa, West Nile virus
EVEVITKLGER

SEQ ID NO: 147822 - protein, 11 aa, West Nile virus
VEVITKLGERK

SEQ ID NO: 147823 - protein, 11 aa, West Nile virus
EVITKLGERKI

SEQ ID NO: 147824 - protein, 11 aa, West Nile virus
VITKLGERKIL

SEQ ID NO: 147825 - protein, 11 aa, West Nile virus
ITKLGERKILR

SEQ ID NO: 147826 - protein, 11 aa, West Nile virus
TKLGERKILRP

SEQ ID NO: 147827 - protein, 11 aa, West Nile virus
KLGERKILRPR

SEQ ID NO: 147828 - protein, 11 aa, West Nile virus
LGERKILRPRW

SEQ ID NO: 147829 - protein, 11 aa, West Nile virus
GERKILRPRWI

SEQ ID NO: 147830 - protein, 11 aa, West Nile virus
ERKILRPRWID

SEQ ID NO: 147831 - protein, 11 aa, West Nile virus
RKILRPRWIDA

SEQ ID NO: 147832 - protein, 11 aa, West Nile virus
KILRPRWIDAR

SEQ ID NO: 147833 - protein, 11 aa, West Nile virus
ILRPRWIDARV

SEQ ID NO: 147834 - protein, 11 aa, West Nile virus
LRPRWIDARVY

SEQ ID NO: 147835 - protein, 11 aa, West Nile virus
RPRWIDARVYS

SEQ ID NO: 147836 - protein, 11 aa, West Nile virus
PRWIDARVYSD

SEQ ID NO: 147837 - protein, 11 aa, West Nile virus
RWIDARVYSDH

SEQ ID NO: 147838 - protein, 11 aa, West Nile virus
WIDARVYSDHQ

SEQ ID NO: 147839 - protein, 11 aa, West Nile virus
IDARVYSDHQA

SEQ ID NO: 147840 - protein, 11 aa, West Nile virus
DARVYSDHQAL

SEQ ID NO: 147841 - protein, 11 aa, West Nile virus
ARVYSDHQALK

SEQ ID NO: 147842 - protein, 11 aa, West Nile virus
RVYSDHQALKA

SEQ ID NO: 147843 - protein, 11 aa, West Nile virus
VYSDHQALKAF

SEQ ID NO: 147844 - protein, 11 aa, West Nile virus
YSDHQALKAFK

SEQ ID NO: 147845 - protein, 11 aa, West Nile virus
SDHQALKAFKD

SEQ ID NO: 147846 - protein, 11 aa, West Nile virus
DHQALKAFKDF

SEQ ID NO: 147847 - protein, 11 aa, West Nile virus
HQALKAFKDFA

SEQ ID NO: 147848 - protein, 11 aa, West Nile virus
QALKAFKDFAS

SEQ ID NO: 147849 - protein, 11 aa, West Nile virus
ALKAFKDFASG

SEQ ID NO: 147850 - protein, 11 aa, West Nile virus
LKAFKDFASGK

SEQ ID NO: 147851 - protein, 11 aa, West Nile virus
KAFKDFASGKR

SEQ ID NO: 147852 - protein, 11 aa, West Nile virus
AFKDFASGKRS

SEQ ID NO: 147853 - protein, 11 aa, West Nile virus
FKDFASGKRSQ

SEQ ID NO: 147854 - protein, 11 aa, West Nile virus
KDFASGKRSQI

SEQ ID NO: 147855 - protein, 11 aa, West Nile virus
DFASGKRSQIG

SEQ ID NO: 147856 - protein, 11 aa, West Nile virus
FASGKRSQIGL

SEQ ID NO: 147857 - protein, 11 aa, West Nile virus
GKRSQIGLIEV

SEQ ID NO: 147858 - protein, 11 aa, West Nile virus
KRSQIGLIEVL

SEQ ID NO: 147859 - protein, 11 aa, West Nile virus
RSQIGLIEVLG

SEQ ID NO: 147860 - protein, 11 aa, West Nile virus
SQIGLIEVLGK

SEQ ID NO: 147861 - protein, 11 aa, West Nile virus
QIGLIEVLGKM

SEQ ID NO: 147862 - protein, 11 aa, West Nile virus
IGLIEVLGKMP

SEQ ID NO: 147863 - protein, 11 aa, West Nile virus
GLIEVLGKMPE

SEQ ID NO: 147864 - protein, 11 aa, West Nile virus
LIEVLGKMPEH

SEQ ID NO: 147865 - protein, 11 aa, West Nile virus
IEVLGKMPEHF

SEQ ID NO: 147866 - protein, 11 aa, West Nile virus
EVLGKMPEHFM

SEQ ID NO: 147867 - protein, 11 aa, West Nile virus
VLGKMPEHFMG

SEQ ID NO: 147868 - protein, 11 aa, West Nile virus
LGKMPEHFMGK

SEQ ID NO: 147869 - protein, 11 aa, West Nile virus
GKMPEHFMGKT

SEQ ID NO: 147870 - protein, 11 aa, West Nile virus
KMPEHFMGKTW

SEQ ID NO: 147871 - protein, 11 aa, West Nile virus
MPEHFMGKTWE

SEQ ID NO: 147872 - protein, 11 aa, West Nile virus
PEHFMGKTWEA

SEQ ID NO: 147873 - protein, 11 aa, West Nile virus
EHFMGKTWEAL

SEQ ID NO: 147874 - protein, 11 aa, West Nile virus
HFMGKTWEALD

SEQ ID NO: 147875 - protein, 11 aa, West Nile virus
FMGKTWEALDT

SEQ ID NO: 147876 - protein, 11 aa, West Nile virus
MGKTWEALDTM

SEQ ID NO: 147877 - protein, 11 aa, West Nile virus
GKTWEALDTMY

SEQ ID NO: 147878 - protein, 11 aa, West Nile virus
KTWEALDTMYV

SEQ ID NO: 147879 - protein, 11 aa, West Nile virus
TWEALDTMYVV

SEQ ID NO: 147880 - protein, 11 aa, West Nile virus
WEALDTMYVVA

SEQ ID NO: 147881 - protein, 11 aa, West Nile virus
EALDTMYVVAT

SEQ ID NO: 147882 - protein, 11 aa, West Nile virus
ALDTMYVVATA

SEQ ID NO: 147883 - protein, 11 aa, West Nile virus
LDTMYVVATAE

SEQ ID NO: 147884 - protein, 11 aa, West Nile virus
DTMYVVATAEK

SEQ ID NO: 147885 - protein, 11 aa, West Nile virus
TMYVVATAEKG

SEQ ID NO: 147886 - protein, 11 aa, West Nile virus
MYVVATAEKGG

SEQ ID NO: 147887 - protein, 11 aa, West Nile virus
YVVATAEKGGR

SEQ ID NO: 147888 - protein, 11 aa, West Nile virus
VVATAEKGGRA

SEQ ID NO: 147889 - protein, 11 aa, West Nile virus
VATAEKGGRAH

SEQ ID NO: 147890 - protein, 11 aa, West Nile virus
ATAEKGGRAHR

SEQ ID NO: 147891 - protein, 11 aa, West Nile virus
TAEKGGRAHRM

SEQ ID NO: 147892 - protein, 11 aa, West Nile virus
AEKGGRAHRMA

SEQ ID NO: 147893 - protein, 11 aa, West Nile virus
EKGGRAHRMAL

SEQ ID NO: 147894 - protein, 11 aa, West Nile virus
KGGRAHRMALE

SEQ ID NO: 147895 - protein, 11 aa, West Nile virus
GGRAHRMALEE

SEQ ID NO: 147896 - protein, 11 aa, West Nile virus
GRAHRMALEEL

SEQ ID NO: 147897 - protein, 11 aa, West Nile virus
RAHRMALEELP

SEQ ID NO: 147898 - protein, 11 aa, West Nile virus
AHRMALEELPD

SEQ ID NO: 147899 - protein, 11 aa, West Nile virus
HRMALEELPDA

SEQ ID NO: 147900 - protein, 11 aa, West Nile virus
RMALEELPDAL

SEQ ID NO: 147901 - protein, 11 aa, West Nile virus
MALEELPDALQ

SEQ ID NO: 147902 - protein, 11 aa, West Nile virus
ALEELPDALQT

SEQ ID NO: 147903 - protein, 11 aa, West Nile virus
LEELPDALQTI

SEQ ID NO: 147904 - protein, 11 aa, West Nile virus
EELPDALQTIA

SEQ ID NO: 147905 - protein, 11 aa, West Nile virus
ELPDALQTIAL

SEQ ID NO: 147906 - protein, 11 aa, West Nile virus
LPDALQTIALI

SEQ ID NO: 147907 - protein, 11 aa, West Nile virus
PDALQTIALIA

SEQ ID NO: 147908 - protein, 11 aa, West Nile virus
DALQTIALIAL

SEQ ID NO: 147909 - protein, 11 aa, West Nile virus
ALQTIALIALL

SEQ ID NO: 147910 - protein, 11 aa, West Nile virus
LQTIALIALLS

SEQ ID NO: 147911 - protein, 11 aa, West Nile virus
QTIALIALLSV

SEQ ID NO: 147912 - protein, 11 aa, West Nile virus
TIALIALLSVM

SEQ ID NO: 147913 - protein, 11 aa, West Nile virus
VMTMGVFFLLM

SEQ ID NO: 147914 - protein, 11 aa, West Nile virus
MTMGVFFLLMQ

SEQ ID NO: 147915 - protein, 11 aa, West Nile virus
TMGVFFLLMQR

SEQ ID NO: 147916 - protein, 11 aa, West Nile virus
MGVFFLLMQRK

SEQ ID NO: 147917 - protein, 11 aa, West Nile virus
GVFFLLMQRKG

SEQ ID NO: 147918 - protein, 11 aa, West Nile virus
VFFLLMQRKGI

SEQ ID NO: 147919 - protein, 11 aa, West Nile virus
FFLLMQRKGIG

SEQ ID NO: 147920 - protein, 11 aa, West Nile virus
FLLMQRKGIGK

SEQ ID NO: 147921 - protein, 11 aa, West Nile virus
LLMQRKGIGKI

SEQ ID NO: 147922 - protein, 11 aa, West Nile virus
LMQRKGIGKIG

SEQ ID NO: 147923 - protein, 11 aa, West Nile virus
MQRKGIGKIGL

SEQ ID NO: 147924 - protein, 11 aa, West Nile virus
QRKGIGKIGLG

SEQ ID NO: 147925 - protein, 11 aa, West Nile virus
RKGIGKIGLGG

SEQ ID NO: 147926 - protein, 11 aa, West Nile virus
KGIGKIGLGGA

SEQ ID NO: 147927 - protein, 11 aa, West Nile virus
LGVATFFCWMA

SEQ ID NO: 147928 - protein, 11 aa, West Nile virus
GVATFFCWMAE

SEQ ID NO: 147929 - protein, 11 aa, West Nile virus
VATFFCWMAEV

SEQ ID NO: 147930 - protein, 11 aa, West Nile virus
ATFFCWMAEVP

SEQ ID NO: 147931 - protein, 11 aa, West Nile virus
TFFCWMAEVPG

SEQ ID NO: 147932 - protein, 11 aa, West Nile virus
FFCWMAEVPGT

SEQ ID NO: 147933 - protein, 11 aa, West Nile virus
FCWMAEVPGTK

SEQ ID NO: 147934 - protein, 11 aa, West Nile virus
CWMAEVPGTKI

SEQ ID NO: 147935 - protein, 11 aa, West Nile virus
WMAEVPGTKIA

SEQ ID NO: 147936 - protein, 11 aa, West Nile virus
MAEVPGTKIAG

SEQ ID NO: 147937 - protein, 11 aa, West Nile virus
AEVPGTKIAGM

SEQ ID NO: 147938 - protein, 11 aa, West Nile virus
EVPGTKIAGML

SEQ ID NO: 147939 - protein, 11 aa, West Nile virus
VPGTKIAGMLL

SEQ ID NO: 147940 - protein, 11 aa, West Nile virus
PGTKIAGMLLL

SEQ ID NO: 147941 - protein, 11 aa, West Nile virus
GTKIAGMLLLS

SEQ ID NO: 147942 - protein, 11 aa, West Nile virus
TKIAGMLLLSL

SEQ ID NO: 147943 - protein, 11 aa, West Nile virus
KIAGMLLLSLL

SEQ ID NO: 147944 - protein, 11 aa, West Nile virus
IAGMLLLSLLL

SEQ ID NO: 147945 - protein, 11 aa, West Nile virus
AGMLLLSLLLM

SEQ ID NO: 147946 - protein, 11 aa, West Nile virus
GMLLLSLLLMI

SEQ ID NO: 147947 - protein, 11 aa, West Nile virus
MLLLSLLLMIV

SEQ ID NO: 147948 - protein, 11 aa, West Nile virus
LLLSLLLMIVL

SEQ ID NO: 147949 - protein, 11 aa, West Nile virus
LLSLLLMIVLI

SEQ ID NO: 147950 - protein, 11 aa, West Nile virus
LSLLLMIVLIP

SEQ ID NO: 147951 - protein, 11 aa, West Nile virus
SLLLMIVLIPE

SEQ ID NO: 147952 - protein, 11 aa, West Nile virus
LLLMIVLIPEP

SEQ ID NO: 147953 - protein, 11 aa, West Nile virus
LLMIVLIPEPE

SEQ ID NO: 147954 - protein, 11 aa, West Nile virus
LMIVLIPEPEK

SEQ ID NO: 147955 - protein, 11 aa, West Nile virus
MIVLIPEPEKQ

SEQ ID NO: 147956 - protein, 11 aa, West Nile virus
IVLIPEPEKQR

SEQ ID NO: 147957 - protein, 11 aa, West Nile virus
VLIPEPEKQRS

SEQ ID NO: 147958 - protein, 11 aa, West Nile virus
LIPEPEKQRSQ

SEQ ID NO: 147959 - protein, 11 aa, West Nile virus
IPEPEKQRSQT

SEQ ID NO: 147960 - protein, 11 aa, West Nile virus
PEPEKQRSQTD

SEQ ID NO: 147961 - protein, 11 aa, West Nile virus
EPEKQRSQTDN

SEQ ID NO: 147962 - protein, 11 aa, West Nile virus
PEKQRSQTDNQ

SEQ ID NO: 147963 - protein, 11 aa, West Nile virus
EKQRSQTDNQL

SEQ ID NO: 147964 - protein, 11 aa, West Nile virus
KQRSQTDNQLA

SEQ ID NO: 147965 - protein, 11 aa, West Nile virus
QRSQTDNQLAV

SEQ ID NO: 147966 - protein, 11 aa, West Nile virus
RSQTDNQLAVF

SEQ ID NO: 147967 - protein, 11 aa, West Nile virus
SQTDNQLAVFL

SEQ ID NO: 147968 - protein, 11 aa, West Nile virus
QTDNQLAVFLI

SEQ ID NO: 147969 - protein, 11 aa, West Nile virus
TDNQLAVFLIC

SEQ ID NO: 147970 - protein, 11 aa, West Nile virus
DNQLAVFLICV

SEQ ID NO: 147971 - protein, 11 aa, West Nile virus
NQLAVFLICVM

SEQ ID NO: 147972 - protein, 11 aa, West Nile virus
QLAVFLICVMT

SEQ ID NO: 147973 - protein, 11 aa, West Nile virus
LAVFLICVMTL

SEQ ID NO: 147974 - protein, 11 aa, West Nile virus
AVFLICVMTLV

SEQ ID NO: 147975 - protein, 11 aa, West Nile virus
TLVSAVAANEM

SEQ ID NO: 147976 - protein, 11 aa, West Nile virus
LVSAVAANEMG

SEQ ID NO: 147977 - protein, 11 aa, West Nile virus
VSAVAANEMGW

SEQ ID NO: 147978 - protein, 11 aa, West Nile virus
SAVAANEMGWL

SEQ ID NO: 147979 - protein, 11 aa, West Nile virus
AVAANEMGWLD

SEQ ID NO: 147980 - protein, 11 aa, West Nile virus
VAANEMGWLDK

SEQ ID NO: 147981 - protein, 11 aa, West Nile virus
AANEMGWLDKT

SEQ ID NO: 147982 - protein, 11 aa, West Nile virus
ANEMGWLDKTK

SEQ ID NO: 147983 - protein, 11 aa, West Nile virus
NEMGWLDKTKS

SEQ ID NO: 147984 - protein, 11 aa, West Nile virus
EMGWLDKTKSD

SEQ ID NO: 147985 - protein, 11 aa, West Nile virus
MGWLDKTKSDI

SEQ ID NO: 147986 - protein, 11 aa, West Nile virus
GEFLLDLRPAT

SEQ ID NO: 147987 - protein, 11 aa, West Nile virus
EFLLDLRPATA

SEQ ID NO: 147988 - protein, 11 aa, West Nile virus
FLLDLRPATAW

SEQ ID NO: 147989 - protein, 11 aa, West Nile virus
LLDLRPATAWS

SEQ ID NO: 147990 - protein, 11 aa, West Nile virus
LDLRPATAWSL

SEQ ID NO: 147991 - protein, 11 aa, West Nile virus
DLRPATAWSLY

SEQ ID NO: 147992 - protein, 11 aa, West Nile virus
LRPATAWSLYA

SEQ ID NO: 147993 - protein, 11 aa, West Nile virus
RPATAWSLYAV

SEQ ID NO: 147994 - protein, 11 aa, West Nile virus
PATAWSLYAVT

SEQ ID NO: 147995 - protein, 11 aa, West Nile virus
ATAWSLYAVTT

SEQ ID NO: 147996 - protein, 11 aa, West Nile virus
TAWSLYAVTTA

SEQ ID NO: 147997 - protein, 11 aa, West Nile virus
AWSLYAVTTAV

SEQ ID NO: 147998 - protein, 11 aa, West Nile virus
WSLYAVTTAVL

SEQ ID NO: 147999 - protein, 11 aa, West Nile virus
SLYAVTTAVLT

SEQ ID NO: 148000 - protein, 11 aa, West Nile virus
LYAVTTAVLTP

SEQ ID NO: 148001 - protein, 11 aa, West Nile virus
YAVTTAVLTPL

SEQ ID NO: 148002 - protein, 11 aa, West Nile virus
AVTTAVLTPLL

SEQ ID NO: 148003 - protein, 11 aa, West Nile virus
VTTAVLTPLLK

SEQ ID NO: 148004 - protein, 11 aa, West Nile virus
TTAVLTPLLKH

SEQ ID NO: 148005 - protein, 11 aa, West Nile virus
TAVLTPLLKHL

SEQ ID NO: 148006 - protein, 11 aa, West Nile virus
AVLTPLLKHLI

SEQ ID NO: 148007 - protein, 11 aa, West Nile virus
VLTPLLKHLIT

SEQ ID NO: 148008 - protein, 11 aa, West Nile virus
LTPLLKHLITS

SEQ ID NO: 148009 - protein, 11 aa, West Nile virus
TPLLKHLITSD

SEQ ID NO: 148010 - protein, 11 aa, West Nile virus
PLLKHLITSDY

SEQ ID NO: 148011 - protein, 11 aa, West Nile virus
LLKHLITSDYI

SEQ ID NO: 148012 - protein, 11 aa, West Nile virus
LKHLITSDYIN

SEQ ID NO: 148013 - protein, 11 aa, West Nile virus
KHLITSDYINT

SEQ ID NO: 148014 - protein, 11 aa, West Nile virus
HLITSDYINTS

SEQ ID NO: 148015 - protein, 11 aa, West Nile virus
LITSDYINTSL

SEQ ID NO: 148016 - protein, 11 aa, West Nile virus
ITSDYINTSLT

SEQ ID NO: 148017 - protein, 11 aa, West Nile virus
TSDYINTSLTS

SEQ ID NO: 148018 - protein, 11 aa, West Nile virus
SDYINTSLTSI

SEQ ID NO: 148019 - protein, 11 aa, West Nile virus
DYINTSLTSIN

SEQ ID NO: 148020 - protein, 11 aa, West Nile virus
YINTSLTSINV

SEQ ID NO: 148021 - protein, 11 aa, West Nile virus
INTSLTSINVQ

SEQ ID NO: 148022 - protein, 11 aa, West Nile virus
NTSLTSINVQA

SEQ ID NO: 148023 - protein, 11 aa, West Nile virus
TSLTSINVQAS

SEQ ID NO: 148024 - protein, 11 aa, West Nile virus
SLTSINVQASA

SEQ ID NO: 148025 - protein, 11 aa, West Nile virus
LTSINVQASAL

SEQ ID NO: 148026 - protein, 11 aa, West Nile virus
TSINVQASALF

SEQ ID NO: 148027 - protein, 11 aa, West Nile virus
SINVQASALFT

SEQ ID NO: 148028 - protein, 11 aa, West Nile virus
INVQASALFTL

SEQ ID NO: 148029 - protein, 11 aa, West Nile virus
NVQASALFTLA

SEQ ID NO: 148030 - protein, 11 aa, West Nile virus
VQASALFTLAR

SEQ ID NO: 148031 - protein, 11 aa, West Nile virus
QASALFTLARG

SEQ ID NO: 148032 - protein, 11 aa, West Nile virus
ASALFTLARGF

SEQ ID NO: 148033 - protein, 11 aa, West Nile virus
SALFTLARGFP

SEQ ID NO: 148034 - protein, 11 aa, West Nile virus
ALFTLARGFPF

SEQ ID NO: 148035 - protein, 11 aa, West Nile virus
LFTLARGFPFV

SEQ ID NO: 148036 - protein, 11 aa, West Nile virus
FTLARGFPFVD

SEQ ID NO: 148037 - protein, 11 aa, West Nile virus
TLARGFPFVDV

SEQ ID NO: 148038 - protein, 11 aa, West Nile virus
LARGFPFVDVG

SEQ ID NO: 148039 - protein, 11 aa, West Nile virus
ARGFPFVDVGV

SEQ ID NO: 148040 - protein, 11 aa, West Nile virus
RGFPFVDVGVS

SEQ ID NO: 148041 - protein, 11 aa, West Nile virus
GFPFVDVGVSA

SEQ ID NO: 148042 - protein, 11 aa, West Nile virus
FPFVDVGVSAL

SEQ ID NO: 148043 - protein, 11 aa, West Nile virus
PFVDVGVSALL

SEQ ID NO: 148044 - protein, 11 aa, West Nile virus
FVDVGVSALLL

SEQ ID NO: 148045 - protein, 11 aa, West Nile virus
VDVGVSALLLA

SEQ ID NO: 148046 - protein, 11 aa, West Nile virus
DVGVSALLLAA

SEQ ID NO: 148047 - protein, 11 aa, West Nile virus
VGVSALLLAAG

SEQ ID NO: 148048 - protein, 11 aa, West Nile virus
GVSALLLAAGC

SEQ ID NO: 148049 - protein, 11 aa, West Nile virus
VSALLLAAGCW

SEQ ID NO: 148050 - protein, 11 aa, West Nile virus
SALLLAAGCWG

SEQ ID NO: 148051 - protein, 11 aa, West Nile virus
ALLLAAGCWGQ

SEQ ID NO: 148052 - protein, 11 aa, West Nile virus
LLLAAGCWGQV

SEQ ID NO: 148053 - protein, 11 aa, West Nile virus
LLAAGCWGQVT

SEQ ID NO: 148054 - protein, 11 aa, West Nile virus
LAAGCWGQVTL

SEQ ID NO: 148055 - protein, 11 aa, West Nile virus
AAGCWGQVTLT

SEQ ID NO: 148056 - protein, 11 aa, West Nile virus
AGCWGQVTLTV

SEQ ID NO: 148057 - protein, 11 aa, West Nile virus
GCWGQVTLTVT

SEQ ID NO: 148058 - protein, 11 aa, West Nile virus
CWGQVTLTVTV

SEQ ID NO: 148059 - protein, 11 aa, West Nile virus
WGQVTLTVTVT

SEQ ID NO: 148060 - protein, 11 aa, West Nile virus
GQVTLTVTVTA

SEQ ID NO: 148061 - protein, 11 aa, West Nile virus
QVTLTVTVTAA

SEQ ID NO: 148062 - protein, 11 aa, West Nile virus
TLLFCHYAYMV

SEQ ID NO: 148063 - protein, 11 aa, West Nile virus
LLFCHYAYMVP

SEQ ID NO: 148064 - protein, 11 aa, West Nile virus
LFCHYAYMVPG

SEQ ID NO: 148065 - protein, 11 aa, West Nile virus
FCHYAYMVPGW

SEQ ID NO: 148066 - protein, 11 aa, West Nile virus
CHYAYMVPGWQ

SEQ ID NO: 148067 - protein, 11 aa, West Nile virus
HYAYMVPGWQA

SEQ ID NO: 148068 - protein, 11 aa, West Nile virus
YAYMVPGWQAE

SEQ ID NO: 148069 - protein, 11 aa, West Nile virus
AYMVPGWQAEA

SEQ ID NO: 148070 - protein, 11 aa, West Nile virus
YMVPGWQAEAM

SEQ ID NO: 148071 - protein, 11 aa, West Nile virus
MVPGWQAEAMR

SEQ ID NO: 148072 - protein, 11 aa, West Nile virus
VPGWQAEAMRS

SEQ ID NO: 148073 - protein, 11 aa, West Nile virus
PGWQAEAMRSA

SEQ ID NO: 148074 - protein, 11 aa, West Nile virus
GWQAEAMRSAQ

SEQ ID NO: 148075 - protein, 11 aa, West Nile virus
WQAEAMRSAQR

SEQ ID NO: 148076 - protein, 11 aa, West Nile virus
QAEAMRSAQRR

SEQ ID NO: 148077 - protein, 11 aa, West Nile virus
AEAMRSAQRRT

SEQ ID NO: 148078 - protein, 11 aa, West Nile virus
EAMRSAQRRTA

SEQ ID NO: 148079 - protein, 11 aa, West Nile virus
AMRSAQRRTAA

SEQ ID NO: 148080 - protein, 11 aa, West Nile virus
MRSAQRRTAAG

SEQ ID NO: 148081 - protein, 11 aa, West Nile virus
RSAQRRTAAGI

SEQ ID NO: 148082 - protein, 11 aa, West Nile virus
SAQRRTAAGIM

SEQ ID NO: 148083 - protein, 11 aa, West Nile virus
AQRRTAAGIMK

SEQ ID NO: 148084 - protein, 11 aa, West Nile virus
QRRTAAGIMKN

SEQ ID NO: 148085 - protein, 11 aa, West Nile virus
RRTAAGIMKNA

SEQ ID NO: 148086 - protein, 11 aa, West Nile virus
RTAAGIMKNAV

SEQ ID NO: 148087 - protein, 11 aa, West Nile virus
TAAGIMKNAVV

SEQ ID NO: 148088 - protein, 11 aa, West Nile virus
AAGIMKNAVVD

SEQ ID NO: 148089 - protein, 11 aa, West Nile virus
AGIMKNAVVDG

SEQ ID NO: 148090 - protein, 11 aa, West Nile virus
GIMKNAVVDGI

SEQ ID NO: 148091 - protein, 11 aa, West Nile virus
IMKNAVVDGIV

SEQ ID NO: 148092 - protein, 11 aa, West Nile virus
MKNAVVDGIVA

SEQ ID NO: 148093 - protein, 11 aa, West Nile virus
KNAVVDGIVAT

SEQ ID NO: 148094 - protein, 11 aa, West Nile virus
NAVVDGIVATD

SEQ ID NO: 148095 - protein, 11 aa, West Nile virus
AVVDGIVATDV

SEQ ID NO: 148096 - protein, 11 aa, West Nile virus
VVDGIVATDVP

SEQ ID NO: 148097 - protein, 11 aa, West Nile virus
VDGIVATDVPE

SEQ ID NO: 148098 - protein, 11 aa, West Nile virus
DGIVATDVPEL

SEQ ID NO: 148099 - protein, 11 aa, West Nile virus
GIVATDVPELE

SEQ ID NO: 148100 - protein, 11 aa, West Nile virus
IVATDVPELER

SEQ ID NO: 148101 - protein, 11 aa, West Nile virus
VATDVPELERT

SEQ ID NO: 148102 - protein, 11 aa, West Nile virus
ATDVPELERTT

SEQ ID NO: 148103 - protein, 11 aa, West Nile virus
TDVPELERTTP

SEQ ID NO: 148104 - protein, 11 aa, West Nile virus
DVPELERTTPI

SEQ ID NO: 148105 - protein, 11 aa, West Nile virus
VPELERTTPIM

SEQ ID NO: 148106 - protein, 11 aa, West Nile virus
PELERTTPIMQ

SEQ ID NO: 148107 - protein, 11 aa, West Nile virus
ELERTTPIMQK

SEQ ID NO: 148108 - protein, 11 aa, West Nile virus
LERTTPIMQKK

SEQ ID NO: 148109 - protein, 11 aa, West Nile virus
ERTTPIMQKKV

SEQ ID NO: 148110 - protein, 11 aa, West Nile virus
RTTPIMQKKVG

SEQ ID NO: 148111 - protein, 11 aa, West Nile virus
TTPIMQKKVGQ

SEQ ID NO: 148112 - protein, 11 aa, West Nile virus
TPIMQKKVGQI

SEQ ID NO: 148113 - protein, 11 aa, West Nile virus
PIMQKKVGQIM

SEQ ID NO: 148114 - protein, 11 aa, West Nile virus
IMQKKVGQIML

SEQ ID NO: 148115 - protein, 11 aa, West Nile virus
MQKKVGQIMLI

SEQ ID NO: 148116 - protein, 11 aa, West Nile virus
QKKVGQIMLIL

SEQ ID NO: 148117 - protein, 11 aa, West Nile virus
KKVGQIMLILV

SEQ ID NO: 148118 - protein, 11 aa, West Nile virus
KVGQIMLILVS

SEQ ID NO: 148119 - protein, 11 aa, West Nile virus
LILVSLAAVVV

SEQ ID NO: 148120 - protein, 11 aa, West Nile virus
ILVSLAAVVVN

SEQ ID NO: 148121 - protein, 11 aa, West Nile virus
LVSLAAVVVNP

SEQ ID NO: 148122 - protein, 11 aa, West Nile virus
VSLAAVVVNPS

SEQ ID NO: 148123 - protein, 11 aa, West Nile virus
SLAAVVVNPSV

SEQ ID NO: 148124 - protein, 11 aa, West Nile virus
AAVVVNPSVKT

SEQ ID NO: 148125 - protein, 11 aa, West Nile virus
AVVVNPSVKTV

SEQ ID NO: 148126 - protein, 11 aa, West Nile virus
VVVNPSVKTVR

SEQ ID NO: 148127 - protein, 11 aa, West Nile virus
VVNPSVKTVRE

SEQ ID NO: 148128 - protein, 11 aa, West Nile virus
VNPSVKTVREA

SEQ ID NO: 148129 - protein, 11 aa, West Nile virus
NPSVKTVREAG

SEQ ID NO: 148130 - protein, 11 aa, West Nile virus
PSVKTVREAGI

SEQ ID NO: 148131 - protein, 11 aa, West Nile virus
SVKTVREAGIL

SEQ ID NO: 148132 - protein, 11 aa, West Nile virus
TVREAGILITA

SEQ ID NO: 148133 - protein, 11 aa, West Nile virus
VREAGILITAA

SEQ ID NO: 148134 - protein, 11 aa, West Nile virus
REAGILITAAA

SEQ ID NO: 148135 - protein, 11 aa, West Nile virus
EAGILITAAAV

SEQ ID NO: 148136 - protein, 11 aa, West Nile virus
AGILITAAAVT

SEQ ID NO: 148137 - protein, 11 aa, West Nile virus
GILITAAAVTL

SEQ ID NO: 148138 - protein, 11 aa, West Nile virus
ILITAAAVTLW

SEQ ID NO: 148139 - protein, 11 aa, West Nile virus
LITAAAVTLWE

SEQ ID NO: 148140 - protein, 11 aa, West Nile virus
ITAAAVTLWEN

SEQ ID NO: 148141 - protein, 11 aa, West Nile virus
TAAAVTLWENG

SEQ ID NO: 148142 - protein, 11 aa, West Nile virus
AAAVTLWENGA

SEQ ID NO: 148143 - protein, 11 aa, West Nile virus
AAVTLWENGAS

SEQ ID NO: 148144 - protein, 11 aa, West Nile virus
AVTLWENGASS

SEQ ID NO: 148145 - protein, 11 aa, West Nile virus
VTLWENGASSV

SEQ ID NO: 148146 - protein, 11 aa, West Nile virus
TLWENGASSVW

SEQ ID NO: 148147 - protein, 11 aa, West Nile virus
LWENGASSVWN

SEQ ID NO: 148148 - protein, 11 aa, West Nile virus
WENGASSVWNA

SEQ ID NO: 148149 - protein, 11 aa, West Nile virus
ENGASSVWNAT

SEQ ID NO: 148150 - protein, 11 aa, West Nile virus
NGASSVWNATT

SEQ ID NO: 148151 - protein, 11 aa, West Nile virus
GASSVWNATTA

SEQ ID NO: 148152 - protein, 11 aa, West Nile virus
ASSVWNATTAI

SEQ ID NO: 148153 - protein, 11 aa, West Nile virus
SSVWNATTAIG

SEQ ID NO: 148154 - protein, 11 aa, West Nile virus
SVWNATTAIGL

SEQ ID NO: 148155 - protein, 11 aa, West Nile virus
VWNATTAIGLC

SEQ ID NO: 148156 - protein, 11 aa, West Nile virus
WNATTAIGLCH

SEQ ID NO: 148157 - protein, 11 aa, West Nile virus
NATTAIGLCHI

SEQ ID NO: 148158 - protein, 11 aa, West Nile virus
ATTAIGLCHIM

SEQ ID NO: 148159 - protein, 11 aa, West Nile virus
TTAIGLCHIMR

SEQ ID NO: 148160 - protein, 11 aa, West Nile virus
TAIGLCHIMRG

SEQ ID NO: 148161 - protein, 11 aa, West Nile virus
AIGLCHIMRGG

SEQ ID NO: 148162 - protein, 11 aa, West Nile virus
IGLCHIMRGGW

SEQ ID NO: 148163 - protein, 11 aa, West Nile virus
GLCHIMRGGWL

SEQ ID NO: 148164 - protein, 11 aa, West Nile virus
LCHIMRGGWLS

SEQ ID NO: 148165 - protein, 11 aa, West Nile virus
CHIMRGGWLSC

SEQ ID NO: 148166 - protein, 11 aa, West Nile virus
HIMRGGWLSCL

SEQ ID NO: 148167 - protein, 11 aa, West Nile virus
IMRGGWLSCLS

SEQ ID NO: 148168 - protein, 11 aa, West Nile virus
MRGGWLSCLSI

SEQ ID NO: 148169 - protein, 11 aa, West Nile virus
RGGWLSCLSIT

SEQ ID NO: 148170 - protein, 11 aa, West Nile virus
GGWLSCLSITW

SEQ ID NO: 148171 - protein, 11 aa, West Nile virus
GWLSCLSITWT

SEQ ID NO: 148172 - protein, 11 aa, West Nile virus
WLSCLSITWTL

SEQ ID NO: 148173 - protein, 11 aa, West Nile virus
KNMEKPGLKRG

SEQ ID NO: 148174 - protein, 11 aa, West Nile virus
NMEKPGLKRGG

SEQ ID NO: 148175 - protein, 11 aa, West Nile virus
MEKPGLKRGGA

SEQ ID NO: 148176 - protein, 11 aa, West Nile virus
EKPGLKRGGAK

SEQ ID NO: 148177 - protein, 11 aa, West Nile virus
KPGLKRGGAKG

SEQ ID NO: 148178 - protein, 11 aa, West Nile virus
PGLKRGGAKGR

SEQ ID NO: 148179 - protein, 11 aa, West Nile virus
GLKRGGAKGRT

SEQ ID NO: 148180 - protein, 11 aa, West Nile virus
LKRGGAKGRTL

SEQ ID NO: 148181 - protein, 11 aa, West Nile virus
KRGGAKGRTLG

SEQ ID NO: 148182 - protein, 11 aa, West Nile virus
RGGAKGRTLGE

SEQ ID NO: 148183 - protein, 11 aa, West Nile virus
GGAKGRTLGEV

SEQ ID NO: 148184 - protein, 11 aa, West Nile virus
GAKGRTLGEVW

SEQ ID NO: 148185 - protein, 11 aa, West Nile virus
AKGRTLGEVWK

SEQ ID NO: 148186 - protein, 11 aa, West Nile virus
KGRTLGEVWKE

SEQ ID NO: 148187 - protein, 11 aa, West Nile virus
GRTLGEVWKER

SEQ ID NO: 148188 - protein, 11 aa, West Nile virus
RTLGEVWKERL

SEQ ID NO: 148189 - protein, 11 aa, West Nile virus
TLGEVWKERLN

SEQ ID NO: 148190 - protein, 11 aa, West Nile virus
LGEVWKERLNQ

SEQ ID NO: 148191 - protein, 11 aa, West Nile virus
GEVWKERLNQM

SEQ ID NO: 148192 - protein, 11 aa, West Nile virus
EVWKERLNQMT

SEQ ID NO: 148193 - protein, 11 aa, West Nile virus
TKEEFTRYRKE

SEQ ID NO: 148194 - protein, 11 aa, West Nile virus
KEEFTRYRKEA

SEQ ID NO: 148195 - protein, 11 aa, West Nile virus
EEFTRYRKEAI

SEQ ID NO: 148196 - protein, 11 aa, West Nile virus
EFTRYRKEAII

SEQ ID NO: 148197 - protein, 11 aa, West Nile virus
FTRYRKEAIIE

SEQ ID NO: 148198 - protein, 11 aa, West Nile virus
TRYRKEAIIEV

SEQ ID NO: 148199 - protein, 11 aa, West Nile virus
RYRKEAIIEVD

SEQ ID NO: 148200 - protein, 11 aa, West Nile virus
YRKEAIIEVDR

SEQ ID NO: 148201 - protein, 11 aa, West Nile virus
RKEAIIEVDRS

SEQ ID NO: 148202 - protein, 11 aa, West Nile virus
KEAIIEVDRSA

SEQ ID NO: 148203 - protein, 11 aa, West Nile virus
EAIIEVDRSAA

SEQ ID NO: 148204 - protein, 11 aa, West Nile virus
AIIEVDRSAAK

SEQ ID NO: 148205 - protein, 11 aa, West Nile virus
ARKEGNVTGGH

SEQ ID NO: 148206 - protein, 11 aa, West Nile virus
EGNVTGGHPVS

SEQ ID NO: 148207 - protein, 11 aa, West Nile virus
GNVTGGHPVSR

SEQ ID NO: 148208 - protein, 11 aa, West Nile virus
NVTGGHPVSRG

SEQ ID NO: 148209 - protein, 11 aa, West Nile virus
VTGGHPVSRGT

SEQ ID NO: 148210 - protein, 11 aa, West Nile virus
TGGHPVSRGTA

SEQ ID NO: 148211 - protein, 11 aa, West Nile virus
GGHPVSRGTAK

SEQ ID NO: 148212 - protein, 11 aa, West Nile virus
GHPVSRGTAKL

SEQ ID NO: 148213 - protein, 11 aa, West Nile virus
HPVSRGTAKLR

SEQ ID NO: 148214 - protein, 11 aa, West Nile virus
PVSRGTAKLRW

SEQ ID NO: 148215 - protein, 11 aa, West Nile virus
VSRGTAKLRWL

SEQ ID NO: 148216 - protein, 11 aa, West Nile virus
SRGTAKLRWLV

SEQ ID NO: 148217 - protein, 11 aa, West Nile virus
RGTAKLRWLVE

SEQ ID NO: 148218 - protein, 11 aa, West Nile virus
GTAKLRWLVER

SEQ ID NO: 148219 - protein, 11 aa, West Nile virus
TAKLRWLVERR

SEQ ID NO: 148220 - protein, 11 aa, West Nile virus
AKLRWLVERRF

SEQ ID NO: 148221 - protein, 11 aa, West Nile virus
KLRWLVERRFL

SEQ ID NO: 148222 - protein, 11 aa, West Nile virus
LRWLVERRFLE

SEQ ID NO: 148223 - protein, 11 aa, West Nile virus
RWLVERRFLEP

SEQ ID NO: 148224 - protein, 11 aa, West Nile virus
WLVERRFLEPV

SEQ ID NO: 148225 - protein, 11 aa, West Nile virus
LVERRFLEPVG

SEQ ID NO: 148226 - protein, 11 aa, West Nile virus
VERRFLEPVGK

SEQ ID NO: 148227 - protein, 11 aa, West Nile virus
ERRFLEPVGKV

SEQ ID NO: 148228 - protein, 11 aa, West Nile virus
RRFLEPVGKVI

SEQ ID NO: 148229 - protein, 11 aa, West Nile virus
RFLEPVGKVID

SEQ ID NO: 148230 - protein, 11 aa, West Nile virus
FLEPVGKVIDL

SEQ ID NO: 148231 - protein, 11 aa, West Nile virus
LEPVGKVIDLG

SEQ ID NO: 148232 - protein, 11 aa, West Nile virus
EPVGKVIDLGC

SEQ ID NO: 148233 - protein, 11 aa, West Nile virus
PVGKVIDLGCG

SEQ ID NO: 148234 - protein, 11 aa, West Nile virus
VGKVIDLGCGR

SEQ ID NO: 148235 - protein, 11 aa, West Nile virus
GKVIDLGCGRG

SEQ ID NO: 148236 - protein, 11 aa, West Nile virus
KVIDLGCGRGG

SEQ ID NO: 148237 - protein, 11 aa, West Nile virus
VIDLGCGRGGW

SEQ ID NO: 148238 - protein, 11 aa, West Nile virus
IDLGCGRGGWC

SEQ ID NO: 148239 - protein, 11 aa, West Nile virus
DLGCGRGGWCY

SEQ ID NO: 148240 - protein, 11 aa, West Nile virus
LGCGRGGWCYY

SEQ ID NO: 148241 - protein, 11 aa, West Nile virus
GCGRGGWCYYM

SEQ ID NO: 148242 - protein, 11 aa, West Nile virus
CGRGGWCYYMA

SEQ ID NO: 148243 - protein, 11 aa, West Nile virus
GRGGWCYYMAT

SEQ ID NO: 148244 - protein, 11 aa, West Nile virus
RGGWCYYMATQ

SEQ ID NO: 148245 - protein, 11 aa, West Nile virus
GGWCYYMATQK

SEQ ID NO: 148246 - protein, 11 aa, West Nile virus
GWCYYMATQKR

SEQ ID NO: 148247 - protein, 11 aa, West Nile virus
WCYYMATQKRV

SEQ ID NO: 148248 - protein, 11 aa, West Nile virus
CYYMATQKRVQ

SEQ ID NO: 148249 - protein, 11 aa, West Nile virus
YYMATQKRVQE

SEQ ID NO: 148250 - protein, 11 aa, West Nile virus
YMATQKRVQEV

SEQ ID NO: 148251 - protein, 11 aa, West Nile virus
MATQKRVQEVR

SEQ ID NO: 148252 - protein, 11 aa, West Nile virus
ATQKRVQEVRG

SEQ ID NO: 148253 - protein, 11 aa, West Nile virus
TQKRVQEVRGY

SEQ ID NO: 148254 - protein, 11 aa, West Nile virus
QKRVQEVRGYT

SEQ ID NO: 148255 - protein, 11 aa, West Nile virus
KRVQEVRGYTK

SEQ ID NO: 148256 - protein, 11 aa, West Nile virus
RVQEVRGYTKG

SEQ ID NO: 148257 - protein, 11 aa, West Nile virus
VQEVRGYTKGG

SEQ ID NO: 148258 - protein, 11 aa, West Nile virus
QEVRGYTKGGP

SEQ ID NO: 148259 - protein, 11 aa, West Nile virus
EVRGYTKGGPG

SEQ ID NO: 148260 - protein, 11 aa, West Nile virus
VRGYTKGGPGH

SEQ ID NO: 148261 - protein, 11 aa, West Nile virus
RGYTKGGPGHE

SEQ ID NO: 148262 - protein, 11 aa, West Nile virus
GYTKGGPGHEE

SEQ ID NO: 148263 - protein, 11 aa, West Nile virus
YTKGGPGHEEP

SEQ ID NO: 148264 - protein, 11 aa, West Nile virus
TKGGPGHEEPQ

SEQ ID NO: 148265 - protein, 11 aa, West Nile virus
KGGPGHEEPQL

SEQ ID NO: 148266 - protein, 11 aa, West Nile virus
GGPGHEEPQLV

SEQ ID NO: 148267 - protein, 11 aa, West Nile virus
GPGHEEPQLVQ

SEQ ID NO: 148268 - protein, 11 aa, West Nile virus
PGHEEPQLVQS

SEQ ID NO: 148269 - protein, 11 aa, West Nile virus
GHEEPQLVQSY

SEQ ID NO: 148270 - protein, 11 aa, West Nile virus
HEEPQLVQSYG

SEQ ID NO: 148271 - protein, 11 aa, West Nile virus
EEPQLVQSYGW

SEQ ID NO: 148272 - protein, 11 aa, West Nile virus
EPQLVQSYGWN

SEQ ID NO: 148273 - protein, 11 aa, West Nile virus
PQLVQSYGWNI

SEQ ID NO: 148274 - protein, 11 aa, West Nile virus
QLVQSYGWNIV

SEQ ID NO: 148275 - protein, 11 aa, West Nile virus
LVQSYGWNIVT

SEQ ID NO: 148276 - protein, 11 aa, West Nile virus
VQSYGWNIVTM

SEQ ID NO: 148277 - protein, 11 aa, West Nile virus
QSYGWNIVTMK

SEQ ID NO: 148278 - protein, 11 aa, West Nile virus
SYGWNIVTMKS

SEQ ID NO: 148279 - protein, 11 aa, West Nile virus
YGWNIVTMKSG

SEQ ID NO: 148280 - protein, 11 aa, West Nile virus
GWNIVTMKSGV

SEQ ID NO: 148281 - protein, 11 aa, West Nile virus
WNIVTMKSGVD

SEQ ID NO: 148282 - protein, 11 aa, West Nile virus
NIVTMKSGVDV

SEQ ID NO: 148283 - protein, 11 aa, West Nile virus
IVTMKSGVDVF

SEQ ID NO: 148284 - protein, 11 aa, West Nile virus
VTMKSGVDVFY

SEQ ID NO: 148285 - protein, 11 aa, West Nile virus
TMKSGVDVFYR

SEQ ID NO: 148286 - protein, 11 aa, West Nile virus
MKSGVDVFYRP

SEQ ID NO: 148287 - protein, 11 aa, West Nile virus
KSGVDVFYRPS

SEQ ID NO: 148288 - protein, 11 aa, West Nile virus
SGVDVFYRPSE

SEQ ID NO: 148289 - protein, 11 aa, West Nile virus
GVDVFYRPSEC

SEQ ID NO: 148290 - protein, 11 aa, West Nile virus
VDVFYRPSECC

SEQ ID NO: 148291 - protein, 11 aa, West Nile virus
DVFYRPSECCD

SEQ ID NO: 148292 - protein, 11 aa, West Nile virus
VFYRPSECCDT

SEQ ID NO: 148293 - protein, 11 aa, West Nile virus
FYRPSECCDTL

SEQ ID NO: 148294 - protein, 11 aa, West Nile virus
YRPSECCDTLL

SEQ ID NO: 148295 - protein, 11 aa, West Nile virus
RPSECCDTLLC

SEQ ID NO: 148296 - protein, 11 aa, West Nile virus
PSECCDTLLCD

SEQ ID NO: 148297 - protein, 11 aa, West Nile virus
SECCDTLLCDI

SEQ ID NO: 148298 - protein, 11 aa, West Nile virus
ECCDTLLCDIG

SEQ ID NO: 148299 - protein, 11 aa, West Nile virus
CCDTLLCDIGE

SEQ ID NO: 148300 - protein, 11 aa, West Nile virus
CDTLLCDIGES

SEQ ID NO: 148301 - protein, 11 aa, West Nile virus
DTLLCDIGESS

SEQ ID NO: 148302 - protein, 11 aa, West Nile virus
TLLCDIGESSS

SEQ ID NO: 148303 - protein, 11 aa, West Nile virus
LLCDIGESSSS

SEQ ID NO: 148304 - protein, 11 aa, West Nile virus
LCDIGESSSSA

SEQ ID NO: 148305 - protein, 11 aa, West Nile virus
CDIGESSSSAE

SEQ ID NO: 148306 - protein, 11 aa, West Nile virus
DIGESSSSAEV

SEQ ID NO: 148307 - protein, 11 aa, West Nile virus
IGESSSSAEVE

SEQ ID NO: 148308 - protein, 11 aa, West Nile virus
GESSSSAEVEE

SEQ ID NO: 148309 - protein, 11 aa, West Nile virus
ESSSSAEVEEH

SEQ ID NO: 148310 - protein, 11 aa, West Nile virus
SSSSAEVEEHR

SEQ ID NO: 148311 - protein, 11 aa, West Nile virus
SSSAEVEEHRT

SEQ ID NO: 148312 - protein, 11 aa, West Nile virus
SSAEVEEHRTI

SEQ ID NO: 148313 - protein, 11 aa, West Nile virus
SAEVEEHRTIR

SEQ ID NO: 148314 - protein, 11 aa, West Nile virus
AEVEEHRTIRV

SEQ ID NO: 148315 - protein, 11 aa, West Nile virus
EVEEHRTIRVL

SEQ ID NO: 148316 - protein, 11 aa, West Nile virus
VEEHRTIRVLE

SEQ ID NO: 148317 - protein, 11 aa, West Nile virus
EEHRTIRVLEM

SEQ ID NO: 148318 - protein, 11 aa, West Nile virus
EHRTIRVLEMV

SEQ ID NO: 148319 - protein, 11 aa, West Nile virus
HRTIRVLEMVE

SEQ ID NO: 148320 - protein, 11 aa, West Nile virus
RTIRVLEMVED

SEQ ID NO: 148321 - protein, 11 aa, West Nile virus
TIRVLEMVEDW

SEQ ID NO: 148322 - protein, 11 aa, West Nile virus
IRVLEMVEDWL

SEQ ID NO: 148323 - protein, 11 aa, West Nile virus
RVLEMVEDWLH

SEQ ID NO: 148324 - protein, 11 aa, West Nile virus
VLEMVEDWLHR

SEQ ID NO: 148325 - protein, 11 aa, West Nile virus
LEMVEDWLHRG

SEQ ID NO: 148326 - protein, 11 aa, West Nile virus
EMVEDWLHRGP

SEQ ID NO: 148327 - protein, 11 aa, West Nile virus
MVEDWLHRGPR

SEQ ID NO: 148328 - protein, 11 aa, West Nile virus
VEDWLHRGPRE

SEQ ID NO: 148329 - protein, 11 aa, West Nile virus
EDWLHRGPREF

SEQ ID NO: 148330 - protein, 11 aa, West Nile virus
DWLHRGPREFC

SEQ ID NO: 148331 - protein, 11 aa, West Nile virus
WLHRGPREFCV

SEQ ID NO: 148332 - protein, 11 aa, West Nile virus
LHRGPREFCVK

SEQ ID NO: 148333 - protein, 11 aa, West Nile virus
HRGPREFCVKV

SEQ ID NO: 148334 - protein, 11 aa, West Nile virus
RGPREFCVKVL

SEQ ID NO: 148335 - protein, 11 aa, West Nile virus
GPREFCVKVLC

SEQ ID NO: 148336 - protein, 11 aa, West Nile virus
PREFCVKVLCP

SEQ ID NO: 148337 - protein, 11 aa, West Nile virus
REFCVKVLCPY

SEQ ID NO: 148338 - protein, 11 aa, West Nile virus
EFCVKVLCPYM

SEQ ID NO: 148339 - protein, 11 aa, West Nile virus
FCVKVLCPYMP

SEQ ID NO: 148340 - protein, 11 aa, West Nile virus
CVKVLCPYMPK

SEQ ID NO: 148341 - protein, 11 aa, West Nile virus
VKVLCPYMPKV

SEQ ID NO: 148342 - protein, 11 aa, West Nile virus
KVLCPYMPKVI

SEQ ID NO: 148343 - protein, 11 aa, West Nile virus
VLCPYMPKVIE

SEQ ID NO: 148344 - protein, 11 aa, West Nile virus
LCPYMPKVIEK

SEQ ID NO: 148345 - protein, 11 aa, West Nile virus
CPYMPKVIEKM

SEQ ID NO: 148346 - protein, 11 aa, West Nile virus
PYMPKVIEKME

SEQ ID NO: 148347 - protein, 11 aa, West Nile virus
YMPKVIEKMEL

SEQ ID NO: 148348 - protein, 11 aa, West Nile virus
MPKVIEKMELL

SEQ ID NO: 148349 - protein, 11 aa, West Nile virus
PKVIEKMELLQ

SEQ ID NO: 148350 - protein, 11 aa, West Nile virus
VIEKMELLQRR

SEQ ID NO: 148351 - protein, 11 aa, West Nile virus
IEKMELLQRRY

SEQ ID NO: 148352 - protein, 11 aa, West Nile virus
EKMELLQRRYG

SEQ ID NO: 148353 - protein, 11 aa, West Nile virus
KMELLQRRYGG

SEQ ID NO: 148354 - protein, 11 aa, West Nile virus
MELLQRRYGGG

SEQ ID NO: 148355 - protein, 11 aa, West Nile virus
ELLQRRYGGGL

SEQ ID NO: 148356 - protein, 11 aa, West Nile virus
LQRRYGGGLVR

SEQ ID NO: 148357 - protein, 11 aa, West Nile virus
QRRYGGGLVRN

SEQ ID NO: 148358 - protein, 11 aa, West Nile virus
RRYGGGLVRNP

SEQ ID NO: 148359 - protein, 11 aa, West Nile virus
RYGGGLVRNPL

SEQ ID NO: 148360 - protein, 11 aa, West Nile virus
YGGGLVRNPLS

SEQ ID NO: 148361 - protein, 11 aa, West Nile virus
GGGLVRNPLSR

SEQ ID NO: 148362 - protein, 11 aa, West Nile virus
GGLVRNPLSRN

SEQ ID NO: 148363 - protein, 11 aa, West Nile virus
GLVRNPLSRNS

SEQ ID NO: 148364 - protein, 11 aa, West Nile virus
LVRNPLSRNST

SEQ ID NO: 148365 - protein, 11 aa, West Nile virus
VRNPLSRNSTH

SEQ ID NO: 148366 - protein, 11 aa, West Nile virus
RNPLSRNSTHE

SEQ ID NO: 148367 - protein, 11 aa, West Nile virus
NPLSRNSTHEM

SEQ ID NO: 148368 - protein, 11 aa, West Nile virus
PLSRNSTHEMY

SEQ ID NO: 148369 - protein, 11 aa, West Nile virus
LSRNSTHEMYW

SEQ ID NO: 148370 - protein, 11 aa, West Nile virus
SRNSTHEMYWV

SEQ ID NO: 148371 - protein, 11 aa, West Nile virus
RNSTHEMYWVS

SEQ ID NO: 148372 - protein, 11 aa, West Nile virus
NSTHEMYWVSR

SEQ ID NO: 148373 - protein, 11 aa, West Nile virus
STHEMYWVSRA

SEQ ID NO: 148374 - protein, 11 aa, West Nile virus
THEMYWVSRAS

SEQ ID NO: 148375 - protein, 11 aa, West Nile virus
HEMYWVSRASG

SEQ ID NO: 148376 - protein, 11 aa, West Nile virus
EMYWVSRASGN

SEQ ID NO: 148377 - protein, 11 aa, West Nile virus
MYWVSRASGNV

SEQ ID NO: 148378 - protein, 11 aa, West Nile virus
YWVSRASGNVV

SEQ ID NO: 148379 - protein, 11 aa, West Nile virus
WVSRASGNVVH

SEQ ID NO: 148380 - protein, 11 aa, West Nile virus
NVVHSVNMTSQ

SEQ ID NO: 148381 - protein, 11 aa, West Nile virus
VVHSVNMTSQV

SEQ ID NO: 148382 - protein, 11 aa, West Nile virus
VHSVNMTSQVL

SEQ ID NO: 148383 - protein, 11 aa, West Nile virus
HSVNMTSQVLL

SEQ ID NO: 148384 - protein, 11 aa, West Nile virus
SVNMTSQVLLG

SEQ ID NO: 148385 - protein, 11 aa, West Nile virus
VNMTSQVLLGR

SEQ ID NO: 148386 - protein, 11 aa, West Nile virus
NMTSQVLLGRM

SEQ ID NO: 148387 - protein, 11 aa, West Nile virus
MTSQVLLGRME

SEQ ID NO: 148388 - protein, 11 aa, West Nile virus
TSQVLLGRMEK

SEQ ID NO: 148389 - protein, 11 aa, West Nile virus
SQVLLGRMEKR

SEQ ID NO: 148390 - protein, 11 aa, West Nile virus
QVLLGRMEKRT

SEQ ID NO: 148391 - protein, 11 aa, West Nile virus
VLLGRMEKRTW

SEQ ID NO: 148392 - protein, 11 aa, West Nile virus
LLGRMEKRTWK

SEQ ID NO: 148393 - protein, 11 aa, West Nile virus
LGRMEKRTWKG

SEQ ID NO: 148394 - protein, 11 aa, West Nile virus
GRMEKRTWKGP

SEQ ID NO: 148395 - protein, 11 aa, West Nile virus
RMEKRTWKGPQ

SEQ ID NO: 148396 - protein, 11 aa, West Nile virus
MEKRTWKGPQY

SEQ ID NO: 148397 - protein, 11 aa, West Nile virus
EKRTWKGPQYE

SEQ ID NO: 148398 - protein, 11 aa, West Nile virus
KRTWKGPQYEE

SEQ ID NO: 148399 - protein, 11 aa, West Nile virus
RTWKGPQYEED

SEQ ID NO: 148400 - protein, 11 aa, West Nile virus
TWKGPQYEEDV

SEQ ID NO: 148401 - protein, 11 aa, West Nile virus
WKGPQYEEDVN

SEQ ID NO: 148402 - protein, 11 aa, West Nile virus
KGPQYEEDVNL

SEQ ID NO: 148403 - protein, 11 aa, West Nile virus
GPQYEEDVNLG

SEQ ID NO: 148404 - protein, 11 aa, West Nile virus
PQYEEDVNLGS

SEQ ID NO: 148405 - protein, 11 aa, West Nile virus
QYEEDVNLGSG

SEQ ID NO: 148406 - protein, 11 aa, West Nile virus
YEEDVNLGSGT

SEQ ID NO: 148407 - protein, 11 aa, West Nile virus
EEDVNLGSGTR

SEQ ID NO: 148408 - protein, 11 aa, West Nile virus
EDVNLGSGTRA

SEQ ID NO: 148409 - protein, 11 aa, West Nile virus
DVNLGSGTRAV

SEQ ID NO: 148410 - protein, 11 aa, West Nile virus
VNLGSGTRAVG

SEQ ID NO: 148411 - protein, 11 aa, West Nile virus
NLGSGTRAVGK

SEQ ID NO: 148412 - protein, 11 aa, West Nile virus
LGSGTRAVGKP

SEQ ID NO: 148413 - protein, 11 aa, West Nile virus
GSGTRAVGKPL

SEQ ID NO: 148414 - protein, 11 aa, West Nile virus
SGTRAVGKPLL

SEQ ID NO: 148415 - protein, 11 aa, West Nile virus
GTRAVGKPLLN

SEQ ID NO: 148416 - protein, 11 aa, West Nile virus
TRAVGKPLLNS

SEQ ID NO: 148417 - protein, 11 aa, West Nile virus
RAVGKPLLNSD

SEQ ID NO: 148418 - protein, 11 aa, West Nile virus
AVGKPLLNSDT

SEQ ID NO: 148419 - protein, 11 aa, West Nile virus
VGKPLLNSDTS

SEQ ID NO: 148420 - protein, 11 aa, West Nile virus
GKPLLNSDTSK

SEQ ID NO: 148421 - protein, 11 aa, West Nile virus
KPLLNSDTSKI

SEQ ID NO: 148422 - protein, 11 aa, West Nile virus
PLLNSDTSKIK

SEQ ID NO: 148423 - protein, 11 aa, West Nile virus
DENHPYRTWNY

SEQ ID NO: 148424 - protein, 11 aa, West Nile virus
ENHPYRTWNYH

SEQ ID NO: 148425 - protein, 11 aa, West Nile virus
NHPYRTWNYHG

SEQ ID NO: 148426 - protein, 11 aa, West Nile virus
HPYRTWNYHGS

SEQ ID NO: 148427 - protein, 11 aa, West Nile virus
PYRTWNYHGSY

SEQ ID NO: 148428 - protein, 11 aa, West Nile virus
YRTWNYHGSYD

SEQ ID NO: 148429 - protein, 11 aa, West Nile virus
RTWNYHGSYDV

SEQ ID NO: 148430 - protein, 11 aa, West Nile virus
TWNYHGSYDVK

SEQ ID NO: 148431 - protein, 11 aa, West Nile virus
WNYHGSYDVKP

SEQ ID NO: 148432 - protein, 11 aa, West Nile virus
NYHGSYDVKPT

SEQ ID NO: 148433 - protein, 11 aa, West Nile virus
YHGSYDVKPTG

SEQ ID NO: 148434 - protein, 11 aa, West Nile virus
HGSYDVKPTGS

SEQ ID NO: 148435 - protein, 11 aa, West Nile virus
GSYDVKPTGSA

SEQ ID NO: 148436 - protein, 11 aa, West Nile virus
SYDVKPTGSAS

SEQ ID NO: 148437 - protein, 11 aa, West Nile virus
YDVKPTGSASS

SEQ ID NO: 148438 - protein, 11 aa, West Nile virus
DVKPTGSASSL

SEQ ID NO: 148439 - protein, 11 aa, West Nile virus
VKPTGSASSLV

SEQ ID NO: 148440 - protein, 11 aa, West Nile virus
KPTGSASSLVN

SEQ ID NO: 148441 - protein, 11 aa, West Nile virus
PTGSASSLVNG

SEQ ID NO: 148442 - protein, 11 aa, West Nile virus
TGSASSLVNGV

SEQ ID NO: 148443 - protein, 11 aa, West Nile virus
GSASSLVNGVV

SEQ ID NO: 148444 - protein, 11 aa, West Nile virus
SASSLVNGVVR

SEQ ID NO: 148445 - protein, 11 aa, West Nile virus
ASSLVNGVVRL

SEQ ID NO: 148446 - protein, 11 aa, West Nile virus
SSLVNGVVRLL

SEQ ID NO: 148447 - protein, 11 aa, West Nile virus
SLVNGVVRLLS

SEQ ID NO: 148448 - protein, 11 aa, West Nile virus
LVNGVVRLLSK

SEQ ID NO: 148449 - protein, 11 aa, West Nile virus
VNGVVRLLSKP

SEQ ID NO: 148450 - protein, 11 aa, West Nile virus
NGVVRLLSKPW

SEQ ID NO: 148451 - protein, 11 aa, West Nile virus
GVVRLLSKPWD

SEQ ID NO: 148452 - protein, 11 aa, West Nile virus
VVRLLSKPWDT

SEQ ID NO: 148453 - protein, 11 aa, West Nile virus
VRLLSKPWDTI

SEQ ID NO: 148454 - protein, 11 aa, West Nile virus
RLLSKPWDTIT

SEQ ID NO: 148455 - protein, 11 aa, West Nile virus
LLSKPWDTITN

SEQ ID NO: 148456 - protein, 11 aa, West Nile virus
LSKPWDTITNV

SEQ ID NO: 148457 - protein, 11 aa, West Nile virus
SKPWDTITNVT

SEQ ID NO: 148458 - protein, 11 aa, West Nile virus
KPWDTITNVTT

SEQ ID NO: 148459 - protein, 11 aa, West Nile virus
PWDTITNVTTM

SEQ ID NO: 148460 - protein, 11 aa, West Nile virus
WDTITNVTTMA

SEQ ID NO: 148461 - protein, 11 aa, West Nile virus
DTITNVTTMAM

SEQ ID NO: 148462 - protein, 11 aa, West Nile virus
TITNVTTMAMT

SEQ ID NO: 148463 - protein, 11 aa, West Nile virus
ITNVTTMAMTD

SEQ ID NO: 148464 - protein, 11 aa, West Nile virus
TNVTTMAMTDT

SEQ ID NO: 148465 - protein, 11 aa, West Nile virus
NVTTMAMTDTT

SEQ ID NO: 148466 - protein, 11 aa, West Nile virus
VTTMAMTDTTP

SEQ ID NO: 148467 - protein, 11 aa, West Nile virus
TTMAMTDTTPF

SEQ ID NO: 148468 - protein, 11 aa, West Nile virus
TMAMTDTTPFG

SEQ ID NO: 148469 - protein, 11 aa, West Nile virus
MAMTDTTPFGQ

SEQ ID NO: 148470 - protein, 11 aa, West Nile virus
AMTDTTPFGQQ

SEQ ID NO: 148471 - protein, 11 aa, West Nile virus
MTDTTPFGQQR

SEQ ID NO: 148472 - protein, 11 aa, West Nile virus
TDTTPFGQQRV

SEQ ID NO: 148473 - protein, 11 aa, West Nile virus
DTTPFGQQRVF

SEQ ID NO: 148474 - protein, 11 aa, West Nile virus
TTPFGQQRVFK

SEQ ID NO: 148475 - protein, 11 aa, West Nile virus
TPFGQQRVFKE

SEQ ID NO: 148476 - protein, 11 aa, West Nile virus
PFGQQRVFKEK

SEQ ID NO: 148477 - protein, 11 aa, West Nile virus
FGQQRVFKEKV

SEQ ID NO: 148478 - protein, 11 aa, West Nile virus
GQQRVFKEKVD

SEQ ID NO: 148479 - protein, 11 aa, West Nile virus
QQRVFKEKVDT

SEQ ID NO: 148480 - protein, 11 aa, West Nile virus
QRVFKEKVDTK

SEQ ID NO: 148481 - protein, 11 aa, West Nile virus
RVFKEKVDTKA

SEQ ID NO: 148482 - protein, 11 aa, West Nile virus
VFKEKVDTKAP

SEQ ID NO: 148483 - protein, 11 aa, West Nile virus
FKEKVDTKAPE

SEQ ID NO: 148484 - protein, 11 aa, West Nile virus
KEKVDTKAPEP

SEQ ID NO: 148485 - protein, 11 aa, West Nile virus
EKVDTKAPEPP

SEQ ID NO: 148486 - protein, 11 aa, West Nile virus
KVDTKAPEPPE

SEQ ID NO: 148487 - protein, 11 aa, West Nile virus
VDTKAPEPPEG

SEQ ID NO: 148488 - protein, 11 aa, West Nile virus
DTKAPEPPEGV

SEQ ID NO: 148489 - protein, 11 aa, West Nile virus
TKAPEPPEGVK

SEQ ID NO: 148490 - protein, 11 aa, West Nile virus
VLNETTNWLWA

SEQ ID NO: 148491 - protein, 11 aa, West Nile virus
LNETTNWLWAF

SEQ ID NO: 148492 - protein, 11 aa, West Nile virus
NETTNWLWAFL

SEQ ID NO: 148493 - protein, 11 aa, West Nile virus
ETTNWLWAFLA

SEQ ID NO: 148494 - protein, 11 aa, West Nile virus
TTNWLWAFLAR

SEQ ID NO: 148495 - protein, 11 aa, West Nile virus
REKRPRMCSRE

SEQ ID NO: 148496 - protein, 11 aa, West Nile virus
EKRPRMCSREE

SEQ ID NO: 148497 - protein, 11 aa, West Nile virus
KRPRMCSREEF

SEQ ID NO: 148498 - protein, 11 aa, West Nile virus
RPRMCSREEFI

SEQ ID NO: 148499 - protein, 11 aa, West Nile virus
PRMCSREEFIR

SEQ ID NO: 148500 - protein, 11 aa, West Nile virus
RMCSREEFIRK

SEQ ID NO: 148501 - protein, 11 aa, West Nile virus
MCSREEFIRKV

SEQ ID NO: 148502 - protein, 11 aa, West Nile virus
CSREEFIRKVN

SEQ ID NO: 148503 - protein, 11 aa, West Nile virus
SREEFIRKVNS

SEQ ID NO: 148504 - protein, 11 aa, West Nile virus
REEFIRKVNSN

SEQ ID NO: 148505 - protein, 11 aa, West Nile virus
EEFIRKVNSNA

SEQ ID NO: 148506 - protein, 11 aa, West Nile virus
EFIRKVNSNAA

SEQ ID NO: 148507 - protein, 11 aa, West Nile virus
FIRKVNSNAAL

SEQ ID NO: 148508 - protein, 11 aa, West Nile virus
IRKVNSNAALG

SEQ ID NO: 148509 - protein, 11 aa, West Nile virus
RKVNSNAALGA

SEQ ID NO: 148510 - protein, 11 aa, West Nile virus
KVNSNAALGAM

SEQ ID NO: 148511 - protein, 11 aa, West Nile virus
VNSNAALGAMF

SEQ ID NO: 148512 - protein, 11 aa, West Nile virus
NSNAALGAMFE

SEQ ID NO: 148513 - protein, 11 aa, West Nile virus
SNAALGAMFEE

SEQ ID NO: 148514 - protein, 11 aa, West Nile virus
NAALGAMFEEQ

SEQ ID NO: 148515 - protein, 11 aa, West Nile virus
AALGAMFEEQN

SEQ ID NO: 148516 - protein, 11 aa, West Nile virus
ALGAMFEEQNQ

SEQ ID NO: 148517 - protein, 11 aa, West Nile virus
LGAMFEEQNQW

SEQ ID NO: 148518 - protein, 11 aa, West Nile virus
GAMFEEQNQWR

SEQ ID NO: 148519 - protein, 11 aa, West Nile virus
AMFEEQNQWRS

SEQ ID NO: 148520 - protein, 11 aa, West Nile virus
MFEEQNQWRSA

SEQ ID NO: 148521 - protein, 11 aa, West Nile virus
FEEQNQWRSAR

SEQ ID NO: 148522 - protein, 11 aa, West Nile virus
EEQNQWRSARE

SEQ ID NO: 148523 - protein, 11 aa, West Nile virus
EQNQWRSAREA

SEQ ID NO: 148524 - protein, 11 aa, West Nile virus
QNQWRSAREAV

SEQ ID NO: 148525 - protein, 11 aa, West Nile virus
NQWRSAREAVE

SEQ ID NO: 148526 - protein, 11 aa, West Nile virus
QWRSAREAVED

SEQ ID NO: 148527 - protein, 11 aa, West Nile virus
SAREAVEDPKF

SEQ ID NO: 148528 - protein, 11 aa, West Nile virus
AREAVEDPKFW

SEQ ID NO: 148529 - protein, 11 aa, West Nile virus
REAVEDPKFWE

SEQ ID NO: 148530 - protein, 11 aa, West Nile virus
EAVEDPKFWEM

SEQ ID NO: 148531 - protein, 11 aa, West Nile virus
AVEDPKFWEMV

SEQ ID NO: 148532 - protein, 11 aa, West Nile virus
VEDPKFWEMVD

SEQ ID NO: 148533 - protein, 11 aa, West Nile virus
EDPKFWEMVDE

SEQ ID NO: 148534 - protein, 11 aa, West Nile virus
DPKFWEMVDEE

SEQ ID NO: 148535 - protein, 11 aa, West Nile virus
PKFWEMVDEER

SEQ ID NO: 148536 - protein, 11 aa, West Nile virus
KFWEMVDEERE

SEQ ID NO: 148537 - protein, 11 aa, West Nile virus
FWEMVDEEREA

SEQ ID NO: 148538 - protein, 11 aa, West Nile virus
WEMVDEEREAH

SEQ ID NO: 148539 - protein, 11 aa, West Nile virus
EMVDEEREAHL

SEQ ID NO: 148540 - protein, 11 aa, West Nile virus
MVDEEREAHLR

SEQ ID NO: 148541 - protein, 11 aa, West Nile virus
VDEEREAHLRG

SEQ ID NO: 148542 - protein, 11 aa, West Nile virus
DEEREAHLRGE

SEQ ID NO: 148543 - protein, 11 aa, West Nile virus
EEREAHLRGEC

SEQ ID NO: 148544 - protein, 11 aa, West Nile virus
EREAHLRGECH

SEQ ID NO: 148545 - protein, 11 aa, West Nile virus
REAHLRGECHT

SEQ ID NO: 148546 - protein, 11 aa, West Nile virus
EAHLRGECHTC

SEQ ID NO: 148547 - protein, 11 aa, West Nile virus
AHLRGECHTCI

SEQ ID NO: 148548 - protein, 11 aa, West Nile virus
HLRGECHTCIY

SEQ ID NO: 148549 - protein, 11 aa, West Nile virus
LRGECHTCIYN

SEQ ID NO: 148550 - protein, 11 aa, West Nile virus
RGECHTCIYNM

SEQ ID NO: 148551 - protein, 11 aa, West Nile virus
GECHTCIYNMM

SEQ ID NO: 148552 - protein, 11 aa, West Nile virus
ECHTCIYNMMG

SEQ ID NO: 148553 - protein, 11 aa, West Nile virus
CHTCIYNMMGK

SEQ ID NO: 148554 - protein, 11 aa, West Nile virus
HTCIYNMMGKR

SEQ ID NO: 148555 - protein, 11 aa, West Nile virus
TCIYNMMGKRE

SEQ ID NO: 148556 - protein, 11 aa, West Nile virus
CIYNMMGKREK

SEQ ID NO: 148557 - protein, 11 aa, West Nile virus
IYNMMGKREKK

SEQ ID NO: 148558 - protein, 11 aa, West Nile virus
YNMMGKREKKP

SEQ ID NO: 148559 - protein, 11 aa, West Nile virus
NMMGKREKKPG

SEQ ID NO: 148560 - protein, 11 aa, West Nile virus
MMGKREKKPGE

SEQ ID NO: 148561 - protein, 11 aa, West Nile virus
MGKREKKPGEF

SEQ ID NO: 148562 - protein, 11 aa, West Nile virus
GKREKKPGEFG

SEQ ID NO: 148563 - protein, 11 aa, West Nile virus
KREKKPGEFGK

SEQ ID NO: 148564 - protein, 11 aa, West Nile virus
REKKPGEFGKA

SEQ ID NO: 148565 - protein, 11 aa, West Nile virus
EKKPGEFGKAK

SEQ ID NO: 148566 - protein, 11 aa, West Nile virus
KKPGEFGKAKG

SEQ ID NO: 148567 - protein, 11 aa, West Nile virus
KPGEFGKAKGS

SEQ ID NO: 148568 - protein, 11 aa, West Nile virus
PGEFGKAKGSR

SEQ ID NO: 148569 - protein, 11 aa, West Nile virus
GEFGKAKGSRA

SEQ ID NO: 148570 - protein, 11 aa, West Nile virus
EFGKAKGSRAI

SEQ ID NO: 148571 - protein, 11 aa, West Nile virus
FGKAKGSRAIW

SEQ ID NO: 148572 - protein, 11 aa, West Nile virus
GKAKGSRAIWF

SEQ ID NO: 148573 - protein, 11 aa, West Nile virus
KAKGSRAIWFM

SEQ ID NO: 148574 - protein, 11 aa, West Nile virus
AKGSRAIWFMW

SEQ ID NO: 148575 - protein, 11 aa, West Nile virus
KGSRAIWFMWL

SEQ ID NO: 148576 - protein, 11 aa, West Nile virus
GSRAIWFMWLG

SEQ ID NO: 148577 - protein, 11 aa, West Nile virus
SRAIWFMWLGA

SEQ ID NO: 148578 - protein, 11 aa, West Nile virus
RAIWFMWLGAR

SEQ ID NO: 148579 - protein, 11 aa, West Nile virus
AIWFMWLGARF

SEQ ID NO: 148580 - protein, 11 aa, West Nile virus
IWFMWLGARFL

SEQ ID NO: 148581 - protein, 11 aa, West Nile virus
WFMWLGARFLE

SEQ ID NO: 148582 - protein, 11 aa, West Nile virus
FMWLGARFLEF

SEQ ID NO: 148583 - protein, 11 aa, West Nile virus
MWLGARFLEFE

SEQ ID NO: 148584 - protein, 11 aa, West Nile virus
WLGARFLEFEA

SEQ ID NO: 148585 - protein, 11 aa, West Nile virus
LGARFLEFEAL

SEQ ID NO: 148586 - protein, 11 aa, West Nile virus
GARFLEFEALG

SEQ ID NO: 148587 - protein, 11 aa, West Nile virus
ARFLEFEALGF

SEQ ID NO: 148588 - protein, 11 aa, West Nile virus
RFLEFEALGFL

SEQ ID NO: 148589 - protein, 11 aa, West Nile virus
FLEFEALGFLN

SEQ ID NO: 148590 - protein, 11 aa, West Nile virus
LEFEALGFLNE

SEQ ID NO: 148591 - protein, 11 aa, West Nile virus
EFEALGFLNED

SEQ ID NO: 148592 - protein, 11 aa, West Nile virus
FEALGFLNEDH

SEQ ID NO: 148593 - protein, 11 aa, West Nile virus
EALGFLNEDHW

SEQ ID NO: 148594 - protein, 11 aa, West Nile virus
ALGFLNEDHWL

SEQ ID NO: 148595 - protein, 11 aa, West Nile virus
LGFLNEDHWLG

SEQ ID NO: 148596 - protein, 11 aa, West Nile virus
GFLNEDHWLGR

SEQ ID NO: 148597 - protein, 11 aa, West Nile virus
FLNEDHWLGRK

SEQ ID NO: 148598 - protein, 11 aa, West Nile virus
LNEDHWLGRKN

SEQ ID NO: 148599 - protein, 11 aa, West Nile virus
NEDHWLGRKNS

SEQ ID NO: 148600 - protein, 11 aa, West Nile virus
EDHWLGRKNSG

SEQ ID NO: 148601 - protein, 11 aa, West Nile virus
DHWLGRKNSGG

SEQ ID NO: 148602 - protein, 11 aa, West Nile virus
HWLGRKNSGGG

SEQ ID NO: 148603 - protein, 11 aa, West Nile virus
WLGRKNSGGGV

SEQ ID NO: 148604 - protein, 11 aa, West Nile virus
LGRKNSGGGVE

SEQ ID NO: 148605 - protein, 11 aa, West Nile virus
GRKNSGGGVEG

SEQ ID NO: 148606 - protein, 11 aa, West Nile virus
RKNSGGGVEGL

SEQ ID NO: 148607 - protein, 11 aa, West Nile virus
KNSGGGVEGLG

SEQ ID NO: 148608 - protein, 11 aa, West Nile virus
NSGGGVEGLGL

SEQ ID NO: 148609 - protein, 11 aa, West Nile virus
SGGGVEGLGLQ

SEQ ID NO: 148610 - protein, 11 aa, West Nile virus
GGGVEGLGLQK

SEQ ID NO: 148611 - protein, 11 aa, West Nile virus
GGVEGLGLQKL

SEQ ID NO: 148612 - protein, 11 aa, West Nile virus
GVEGLGLQKLG

SEQ ID NO: 148613 - protein, 11 aa, West Nile virus
VEGLGLQKLGY

SEQ ID NO: 148614 - protein, 11 aa, West Nile virus
EGLGLQKLGYI

SEQ ID NO: 148615 - protein, 11 aa, West Nile virus
GLGLQKLGYIL

SEQ ID NO: 148616 - protein, 11 aa, West Nile virus
LGLQKLGYILR

SEQ ID NO: 148617 - protein, 11 aa, West Nile virus
GLQKLGYILRE

SEQ ID NO: 148618 - protein, 11 aa, West Nile virus
LQKLGYILREV

SEQ ID NO: 148619 - protein, 11 aa, West Nile virus
QKLGYILREVG

SEQ ID NO: 148620 - protein, 11 aa, West Nile virus
GGKIYADDTAG

SEQ ID NO: 148621 - protein, 11 aa, West Nile virus
GKIYADDTAGW

SEQ ID NO: 148622 - protein, 11 aa, West Nile virus
KIYADDTAGWD

SEQ ID NO: 148623 - protein, 11 aa, West Nile virus
IYADDTAGWDT

SEQ ID NO: 148624 - protein, 11 aa, West Nile virus
YADDTAGWDTR

SEQ ID NO: 148625 - protein, 11 aa, West Nile virus
ADDTAGWDTRI

SEQ ID NO: 148626 - protein, 11 aa, West Nile virus
DDTAGWDTRIT

SEQ ID NO: 148627 - protein, 11 aa, West Nile virus
DTAGWDTRITR

SEQ ID NO: 148628 - protein, 11 aa, West Nile virus
TAGWDTRITRA

SEQ ID NO: 148629 - protein, 11 aa, West Nile virus
AGWDTRITRAD

SEQ ID NO: 148630 - protein, 11 aa, West Nile virus
GWDTRITRADL

SEQ ID NO: 148631 - protein, 11 aa, West Nile virus
WDTRITRADLE

SEQ ID NO: 148632 - protein, 11 aa, West Nile virus
DTRITRADLEN

SEQ ID NO: 148633 - protein, 11 aa, West Nile virus
TRITRADLENE

SEQ ID NO: 148634 - protein, 11 aa, West Nile virus
RITRADLENEA

SEQ ID NO: 148635 - protein, 11 aa, West Nile virus
ITRADLENEAK

SEQ ID NO: 148636 - protein, 11 aa, West Nile virus
TRADLENEAKV

SEQ ID NO: 148637 - protein, 11 aa, West Nile virus
RADLENEAKVL

SEQ ID NO: 148638 - protein, 11 aa, West Nile virus
ADLENEAKVLE

SEQ ID NO: 148639 - protein, 11 aa, West Nile virus
DLENEAKVLEL

SEQ ID NO: 148640 - protein, 11 aa, West Nile virus
LENEAKVLELL

SEQ ID NO: 148641 - protein, 11 aa, West Nile virus
ENEAKVLELLD

SEQ ID NO: 148642 - protein, 11 aa, West Nile virus
NEAKVLELLDG

SEQ ID NO: 148643 - protein, 11 aa, West Nile virus
EAKVLELLDGE

SEQ ID NO: 148644 - protein, 11 aa, West Nile virus
AKVLELLDGEH

SEQ ID NO: 148645 - protein, 11 aa, West Nile virus
KVLELLDGEHR

SEQ ID NO: 148646 - protein, 11 aa, West Nile virus
VLELLDGEHRR

SEQ ID NO: 148647 - protein, 11 aa, West Nile virus
LELLDGEHRRL

SEQ ID NO: 148648 - protein, 11 aa, West Nile virus
ELLDGEHRRLA

SEQ ID NO: 148649 - protein, 11 aa, West Nile virus
LLDGEHRRLAR

SEQ ID NO: 148650 - protein, 11 aa, West Nile virus
LDGEHRRLARA

SEQ ID NO: 148651 - protein, 11 aa, West Nile virus
DGEHRRLARAI

SEQ ID NO: 148652 - protein, 11 aa, West Nile virus
GEHRRLARAII

SEQ ID NO: 148653 - protein, 11 aa, West Nile virus
EHRRLARAIIE

SEQ ID NO: 148654 - protein, 11 aa, West Nile virus
HRRLARAIIEL

SEQ ID NO: 148655 - protein, 11 aa, West Nile virus
RRLARAIIELT

SEQ ID NO: 148656 - protein, 11 aa, West Nile virus
RLARAIIELTY

SEQ ID NO: 148657 - protein, 11 aa, West Nile virus
LARAIIELTYR

SEQ ID NO: 148658 - protein, 11 aa, West Nile virus
ARAIIELTYRH

SEQ ID NO: 148659 - protein, 11 aa, West Nile virus
RAIIELTYRHK

SEQ ID NO: 148660 - protein, 11 aa, West Nile virus
AIIELTYRHKV

SEQ ID NO: 148661 - protein, 11 aa, West Nile virus
IIELTYRHKVV

SEQ ID NO: 148662 - protein, 11 aa, West Nile virus
IELTYRHKVVK

SEQ ID NO: 148663 - protein, 11 aa, West Nile virus
ELTYRHKVVKV

SEQ ID NO: 148664 - protein, 11 aa, West Nile virus
LTYRHKVVKVM

SEQ ID NO: 148665 - protein, 11 aa, West Nile virus
TYRHKVVKVMR

SEQ ID NO: 148666 - protein, 11 aa, West Nile virus
YRHKVVKVMRP

SEQ ID NO: 148667 - protein, 11 aa, West Nile virus
RHKVVKVMRPA

SEQ ID NO: 148668 - protein, 11 aa, West Nile virus
HKVVKVMRPAA

SEQ ID NO: 148669 - protein, 11 aa, West Nile virus
KVVKVMRPAAD

SEQ ID NO: 148670 - protein, 11 aa, West Nile virus
VVKVMRPAADG

SEQ ID NO: 148671 - protein, 11 aa, West Nile virus
VKVMRPAADGR

SEQ ID NO: 148672 - protein, 11 aa, West Nile virus
KVMRPAADGRT

SEQ ID NO: 148673 - protein, 11 aa, West Nile virus
VMRPAADGRTV

SEQ ID NO: 148674 - protein, 11 aa, West Nile virus
MRPAADGRTVM

SEQ ID NO: 148675 - protein, 11 aa, West Nile virus
RPAADGRTVMD

SEQ ID NO: 148676 - protein, 11 aa, West Nile virus
PAADGRTVMDV

SEQ ID NO: 148677 - protein, 11 aa, West Nile virus
AADGRTVMDVI

SEQ ID NO: 148678 - protein, 11 aa, West Nile virus
ADGRTVMDVIS

SEQ ID NO: 148679 - protein, 11 aa, West Nile virus
DGRTVMDVISR

SEQ ID NO: 148680 - protein, 11 aa, West Nile virus
GRTVMDVISRE

SEQ ID NO: 148681 - protein, 11 aa, West Nile virus
RTVMDVISRED

SEQ ID NO: 148682 - protein, 11 aa, West Nile virus
TVMDVISREDQ

SEQ ID NO: 148683 - protein, 11 aa, West Nile virus
VMDVISREDQR

SEQ ID NO: 148684 - protein, 11 aa, West Nile virus
MDVISREDQRG

SEQ ID NO: 148685 - protein, 11 aa, West Nile virus
DVISREDQRGS

SEQ ID NO: 148686 - protein, 11 aa, West Nile virus
VISREDQRGSG

SEQ ID NO: 148687 - protein, 11 aa, West Nile virus
ISREDQRGSGQ

SEQ ID NO: 148688 - protein, 11 aa, West Nile virus
SREDQRGSGQV

SEQ ID NO: 148689 - protein, 11 aa, West Nile virus
REDQRGSGQVV

SEQ ID NO: 148690 - protein, 11 aa, West Nile virus
EDQRGSGQVVT

SEQ ID NO: 148691 - protein, 11 aa, West Nile virus
DQRGSGQVVTY

SEQ ID NO: 148692 - protein, 11 aa, West Nile virus
QRGSGQVVTYA

SEQ ID NO: 148693 - protein, 11 aa, West Nile virus
RGSGQVVTYAL

SEQ ID NO: 148694 - protein, 11 aa, West Nile virus
GSGQVVTYALN

SEQ ID NO: 148695 - protein, 11 aa, West Nile virus
SGQVVTYALNT

SEQ ID NO: 148696 - protein, 11 aa, West Nile virus
GQVVTYALNTF

SEQ ID NO: 148697 - protein, 11 aa, West Nile virus
QVVTYALNTFT

SEQ ID NO: 148698 - protein, 11 aa, West Nile virus
VVTYALNTFTN

SEQ ID NO: 148699 - protein, 11 aa, West Nile virus
VTYALNTFTNL

SEQ ID NO: 148700 - protein, 11 aa, West Nile virus
TYALNTFTNLA

SEQ ID NO: 148701 - protein, 11 aa, West Nile virus
YALNTFTNLAV

SEQ ID NO: 148702 - protein, 11 aa, West Nile virus
ALNTFTNLAVQ

SEQ ID NO: 148703 - protein, 11 aa, West Nile virus
LNTFTNLAVQL

SEQ ID NO: 148704 - protein, 11 aa, West Nile virus
NTFTNLAVQLV

SEQ ID NO: 148705 - protein, 11 aa, West Nile virus
TFTNLAVQLVR

SEQ ID NO: 148706 - protein, 11 aa, West Nile virus
FTNLAVQLVRM

SEQ ID NO: 148707 - protein, 11 aa, West Nile virus
TNLAVQLVRMM

SEQ ID NO: 148708 - protein, 11 aa, West Nile virus
NLAVQLVRMME

SEQ ID NO: 148709 - protein, 11 aa, West Nile virus
LAVQLVRMMEG

SEQ ID NO: 148710 - protein, 11 aa, West Nile virus
AVQLVRMMEGE

SEQ ID NO: 148711 - protein, 11 aa, West Nile virus
VQLVRMMEGEG

SEQ ID NO: 148712 - protein, 11 aa, West Nile virus
QLVRMMEGEGV

SEQ ID NO: 148713 - protein, 11 aa, West Nile virus
LVRMMEGEGVI

SEQ ID NO: 148714 - protein, 11 aa, West Nile virus
VRMMEGEGVIG

SEQ ID NO: 148715 - protein, 11 aa, West Nile virus
RMMEGEGVIGP

SEQ ID NO: 148716 - protein, 11 aa, West Nile virus
MMEGEGVIGPD

SEQ ID NO: 148717 - protein, 11 aa, West Nile virus
MEGEGVIGPDD

SEQ ID NO: 148718 - protein, 11 aa, West Nile virus
EGEGVIGPDDV

SEQ ID NO: 148719 - protein, 11 aa, West Nile virus
GEGVIGPDDVE

SEQ ID NO: 148720 - protein, 11 aa, West Nile virus
KGKGPKVRTWL

SEQ ID NO: 148721 - protein, 11 aa, West Nile virus
GKGPKVRTWLF

SEQ ID NO: 148722 - protein, 11 aa, West Nile virus
KGPKVRTWLFE

SEQ ID NO: 148723 - protein, 11 aa, West Nile virus
GPKVRTWLFEN

SEQ ID NO: 148724 - protein, 11 aa, West Nile virus
PKVRTWLFENG

SEQ ID NO: 148725 - protein, 11 aa, West Nile virus
KVRTWLFENGE

SEQ ID NO: 148726 - protein, 11 aa, West Nile virus
VRTWLFENGEE

SEQ ID NO: 148727 - protein, 11 aa, West Nile virus
RTWLFENGEER

SEQ ID NO: 148728 - protein, 11 aa, West Nile virus
TWLFENGEERL

SEQ ID NO: 148729 - protein, 11 aa, West Nile virus
WLFENGEERLS

SEQ ID NO: 148730 - protein, 11 aa, West Nile virus
LFENGEERLSR

SEQ ID NO: 148731 - protein, 11 aa, West Nile virus
FENGEERLSRM

SEQ ID NO: 148732 - protein, 11 aa, West Nile virus
ENGEERLSRMA

SEQ ID NO: 148733 - protein, 11 aa, West Nile virus
NGEERLSRMAV

SEQ ID NO: 148734 - protein, 11 aa, West Nile virus
GEERLSRMAVS

SEQ ID NO: 148735 - protein, 11 aa, West Nile virus
EERLSRMAVSG

SEQ ID NO: 148736 - protein, 11 aa, West Nile virus
ERLSRMAVSGD

SEQ ID NO: 148737 - protein, 11 aa, West Nile virus
RLSRMAVSGDD

SEQ ID NO: 148738 - protein, 11 aa, West Nile virus
LSRMAVSGDDC

SEQ ID NO: 148739 - protein, 11 aa, West Nile virus
SRMAVSGDDCV

SEQ ID NO: 148740 - protein, 11 aa, West Nile virus
RMAVSGDDCVV

SEQ ID NO: 148741 - protein, 11 aa, West Nile virus
MAVSGDDCVVK

SEQ ID NO: 148742 - protein, 11 aa, West Nile virus
AVSGDDCVVKP

SEQ ID NO: 148743 - protein, 11 aa, West Nile virus
VSGDDCVVKPL

SEQ ID NO: 148744 - protein, 11 aa, West Nile virus
SGDDCVVKPLD

SEQ ID NO: 148745 - protein, 11 aa, West Nile virus
GDDCVVKPLDD

SEQ ID NO: 148746 - protein, 11 aa, West Nile virus
DDCVVKPLDDR

SEQ ID NO: 148747 - protein, 11 aa, West Nile virus
DCVVKPLDDRF

SEQ ID NO: 148748 - protein, 11 aa, West Nile virus
CVVKPLDDRFA

SEQ ID NO: 148749 - protein, 11 aa, West Nile virus
VVKPLDDRFAT

SEQ ID NO: 148750 - protein, 11 aa, West Nile virus
VKPLDDRFATS

SEQ ID NO: 148751 - protein, 11 aa, West Nile virus
KPLDDRFATSL

SEQ ID NO: 148752 - protein, 11 aa, West Nile virus
PLDDRFATSLH

SEQ ID NO: 148753 - protein, 11 aa, West Nile virus
LDDRFATSLHF

SEQ ID NO: 148754 - protein, 11 aa, West Nile virus
DDRFATSLHFL

SEQ ID NO: 148755 - protein, 11 aa, West Nile virus
DRFATSLHFLN

SEQ ID NO: 148756 - protein, 11 aa, West Nile virus
RFATSLHFLNA

SEQ ID NO: 148757 - protein, 11 aa, West Nile virus
FATSLHFLNAM

SEQ ID NO: 148758 - protein, 11 aa, West Nile virus
ATSLHFLNAMS

SEQ ID NO: 148759 - protein, 11 aa, West Nile virus
SLHFLNAMSKV

SEQ ID NO: 148760 - protein, 11 aa, West Nile virus
LHFLNAMSKVR

SEQ ID NO: 148761 - protein, 11 aa, West Nile virus
HFLNAMSKVRK

SEQ ID NO: 148762 - protein, 11 aa, West Nile virus
FLNAMSKVRKD

SEQ ID NO: 148763 - protein, 11 aa, West Nile virus
LNAMSKVRKDI

SEQ ID NO: 148764 - protein, 11 aa, West Nile virus
NAMSKVRKDIQ

SEQ ID NO: 148765 - protein, 11 aa, West Nile virus
AMSKVRKDIQE

SEQ ID NO: 148766 - protein, 11 aa, West Nile virus
MSKVRKDIQEW

SEQ ID NO: 148767 - protein, 11 aa, West Nile virus
SKVRKDIQEWK

SEQ ID NO: 148768 - protein, 11 aa, West Nile virus
KVRKDIQEWKP

SEQ ID NO: 148769 - protein, 11 aa, West Nile virus
VRKDIQEWKPS

SEQ ID NO: 148770 - protein, 11 aa, West Nile virus
RKDIQEWKPST

SEQ ID NO: 148771 - protein, 11 aa, West Nile virus
KDIQEWKPSTG

SEQ ID NO: 148772 - protein, 11 aa, West Nile virus
DIQEWKPSTGW

SEQ ID NO: 148773 - protein, 11 aa, West Nile virus
IQEWKPSTGWY

SEQ ID NO: 148774 - protein, 11 aa, West Nile virus
QEWKPSTGWYD

SEQ ID NO: 148775 - protein, 11 aa, West Nile virus
EWKPSTGWYDW

SEQ ID NO: 148776 - protein, 11 aa, West Nile virus
WKPSTGWYDWQ

SEQ ID NO: 148777 - protein, 11 aa, West Nile virus
KPSTGWYDWQQ

SEQ ID NO: 148778 - protein, 11 aa, West Nile virus
PSTGWYDWQQV

SEQ ID NO: 148779 - protein, 11 aa, West Nile virus
STGWYDWQQVP

SEQ ID NO: 148780 - protein, 11 aa, West Nile virus
TGWYDWQQVPF

SEQ ID NO: 148781 - protein, 11 aa, West Nile virus
GWYDWQQVPFC

SEQ ID NO: 148782 - protein, 11 aa, West Nile virus
WYDWQQVPFCS

SEQ ID NO: 148783 - protein, 11 aa, West Nile virus
YDWQQVPFCSN

SEQ ID NO: 148784 - protein, 11 aa, West Nile virus
DWQQVPFCSNH

SEQ ID NO: 148785 - protein, 11 aa, West Nile virus
WQQVPFCSNHF

SEQ ID NO: 148786 - protein, 11 aa, West Nile virus
QQVPFCSNHFT

SEQ ID NO: 148787 - protein, 11 aa, West Nile virus
QVPFCSNHFTE

SEQ ID NO: 148788 - protein, 11 aa, West Nile virus
VPFCSNHFTEL

SEQ ID NO: 148789 - protein, 11 aa, West Nile virus
PFCSNHFTELI

SEQ ID NO: 148790 - protein, 11 aa, West Nile virus
FCSNHFTELIM

SEQ ID NO: 148791 - protein, 11 aa, West Nile virus
CSNHFTELIMK

SEQ ID NO: 148792 - protein, 11 aa, West Nile virus
SNHFTELIMKD

SEQ ID NO: 148793 - protein, 11 aa, West Nile virus
NHFTELIMKDG

SEQ ID NO: 148794 - protein, 11 aa, West Nile virus
HFTELIMKDGR

SEQ ID NO: 148795 - protein, 11 aa, West Nile virus
FTELIMKDGRT

SEQ ID NO: 148796 - protein, 11 aa, West Nile virus
TELIMKDGRTL

SEQ ID NO: 148797 - protein, 11 aa, West Nile virus
ELIMKDGRTLV

SEQ ID NO: 148798 - protein, 11 aa, West Nile virus
LIMKDGRTLVV

SEQ ID NO: 148799 - protein, 11 aa, West Nile virus
IMKDGRTLVVP

SEQ ID NO: 148800 - protein, 11 aa, West Nile virus
MKDGRTLVVPC

SEQ ID NO: 148801 - protein, 11 aa, West Nile virus
KDGRTLVVPCR

SEQ ID NO: 148802 - protein, 11 aa, West Nile virus
DGRTLVVPCRG

SEQ ID NO: 148803 - protein, 11 aa, West Nile virus
GRTLVVPCRGQ

SEQ ID NO: 148804 - protein, 11 aa, West Nile virus
RTLVVPCRGQD

SEQ ID NO: 148805 - protein, 11 aa, West Nile virus
TLVVPCRGQDE

SEQ ID NO: 148806 - protein, 11 aa, West Nile virus
LVVPCRGQDEL

SEQ ID NO: 148807 - protein, 11 aa, West Nile virus
VVPCRGQDELV

SEQ ID NO: 148808 - protein, 11 aa, West Nile virus
VPCRGQDELVG

SEQ ID NO: 148809 - protein, 11 aa, West Nile virus
PCRGQDELVGR

SEQ ID NO: 148810 - protein, 11 aa, West Nile virus
CRGQDELVGRA

SEQ ID NO: 148811 - protein, 11 aa, West Nile virus
RGQDELVGRAR

SEQ ID NO: 148812 - protein, 11 aa, West Nile virus
GQDELVGRARI

SEQ ID NO: 148813 - protein, 11 aa, West Nile virus
QDELVGRARIS

SEQ ID NO: 148814 - protein, 11 aa, West Nile virus
DELVGRARISP

SEQ ID NO: 148815 - protein, 11 aa, West Nile virus
ELVGRARISPG

SEQ ID NO: 148816 - protein, 11 aa, West Nile virus
LVGRARISPGA

SEQ ID NO: 148817 - protein, 11 aa, West Nile virus
VGRARISPGAG

SEQ ID NO: 148818 - protein, 11 aa, West Nile virus
GRARISPGAGW

SEQ ID NO: 148819 - protein, 11 aa, West Nile virus
RARISPGAGWN

SEQ ID NO: 148820 - protein, 11 aa, West Nile virus
ARISPGAGWNV

SEQ ID NO: 148821 - protein, 11 aa, West Nile virus
RISPGAGWNVR

SEQ ID NO: 148822 - protein, 11 aa, West Nile virus
ISPGAGWNVRD

SEQ ID NO: 148823 - protein, 11 aa, West Nile virus
SPGAGWNVRDT

SEQ ID NO: 148824 - protein, 11 aa, West Nile virus
PGAGWNVRDTA

SEQ ID NO: 148825 - protein, 11 aa, West Nile virus
GAGWNVRDTAC

SEQ ID NO: 148826 - protein, 11 aa, West Nile virus
AGWNVRDTACL

SEQ ID NO: 148827 - protein, 11 aa, West Nile virus
GWNVRDTACLA

SEQ ID NO: 148828 - protein, 11 aa, West Nile virus
WNVRDTACLAK

SEQ ID NO: 148829 - protein, 11 aa, West Nile virus
NVRDTACLAKS

SEQ ID NO: 148830 - protein, 11 aa, West Nile virus
VRDTACLAKSY

SEQ ID NO: 148831 - protein, 11 aa, West Nile virus
RDTACLAKSYA

SEQ ID NO: 148832 - protein, 11 aa, West Nile virus
DTACLAKSYAQ

SEQ ID NO: 148833 - protein, 11 aa, West Nile virus
TACLAKSYAQM

SEQ ID NO: 148834 - protein, 11 aa, West Nile virus
ACLAKSYAQMW

SEQ ID NO: 148835 - protein, 11 aa, West Nile virus
CLAKSYAQMWL

SEQ ID NO: 148836 - protein, 11 aa, West Nile virus
LAKSYAQMWLL

SEQ ID NO: 148837 - protein, 11 aa, West Nile virus
AKSYAQMWLLL

SEQ ID NO: 148838 - protein, 11 aa, West Nile virus
KSYAQMWLLLY

SEQ ID NO: 148839 - protein, 11 aa, West Nile virus
SYAQMWLLLYF

SEQ ID NO: 148840 - protein, 11 aa, West Nile virus
YAQMWLLLYFH

SEQ ID NO: 148841 - protein, 11 aa, West Nile virus
AQMWLLLYFHR

SEQ ID NO: 148842 - protein, 11 aa, West Nile virus
QMWLLLYFHRR

SEQ ID NO: 148843 - protein, 11 aa, West Nile virus
MWLLLYFHRRD

SEQ ID NO: 148844 - protein, 11 aa, West Nile virus
WLLLYFHRRDL

SEQ ID NO: 148845 - protein, 11 aa, West Nile virus
LLLYFHRRDLR

SEQ ID NO: 148846 - protein, 11 aa, West Nile virus
LLYFHRRDLRL

SEQ ID NO: 148847 - protein, 11 aa, West Nile virus
LYFHRRDLRLM

SEQ ID NO: 148848 - protein, 11 aa, West Nile virus
YFHRRDLRLMA

SEQ ID NO: 148849 - protein, 11 aa, West Nile virus
FHRRDLRLMAN

SEQ ID NO: 148850 - protein, 11 aa, West Nile virus
HRRDLRLMANA

SEQ ID NO: 148851 - protein, 11 aa, West Nile virus
RRDLRLMANAI

SEQ ID NO: 148852 - protein, 11 aa, West Nile virus
RDLRLMANAIC

SEQ ID NO: 148853 - protein, 11 aa, West Nile virus
DLRLMANAICS

SEQ ID NO: 148854 - protein, 11 aa, West Nile virus
LRLMANAICSA

SEQ ID NO: 148855 - protein, 11 aa, West Nile virus
RLMANAICSAV

SEQ ID NO: 148856 - protein, 11 aa, West Nile virus
LMANAICSAVP

SEQ ID NO: 148857 - protein, 11 aa, West Nile virus
MANAICSAVPV

SEQ ID NO: 148858 - protein, 11 aa, West Nile virus
ANAICSAVPVN

SEQ ID NO: 148859 - protein, 11 aa, West Nile virus
NAICSAVPVNW

SEQ ID NO: 148860 - protein, 11 aa, West Nile virus
AICSAVPVNWV

SEQ ID NO: 148861 - protein, 11 aa, West Nile virus
ICSAVPVNWVP

SEQ ID NO: 148862 - protein, 11 aa, West Nile virus
CSAVPVNWVPT

SEQ ID NO: 148863 - protein, 11 aa, West Nile virus
SAVPVNWVPTG

SEQ ID NO: 148864 - protein, 11 aa, West Nile virus
AVPVNWVPTGR

SEQ ID NO: 148865 - protein, 11 aa, West Nile virus
VPVNWVPTGRT

SEQ ID NO: 148866 - protein, 11 aa, West Nile virus
PVNWVPTGRTT

SEQ ID NO: 148867 - protein, 11 aa, West Nile virus
VNWVPTGRTTW

SEQ ID NO: 148868 - protein, 11 aa, West Nile virus
NWVPTGRTTWS

SEQ ID NO: 148869 - protein, 11 aa, West Nile virus
WVPTGRTTWSI

SEQ ID NO: 148870 - protein, 11 aa, West Nile virus
VPTGRTTWSIH

SEQ ID NO: 148871 - protein, 11 aa, West Nile virus
PTGRTTWSIHA

SEQ ID NO: 148872 - protein, 11 aa, West Nile virus
TGRTTWSIHAG

SEQ ID NO: 148873 - protein, 11 aa, West Nile virus
GRTTWSIHAGG

SEQ ID NO: 148874 - protein, 11 aa, West Nile virus
RTTWSIHAGGE

SEQ ID NO: 148875 - protein, 11 aa, West Nile virus
TTWSIHAGGEW

SEQ ID NO: 148876 - protein, 11 aa, West Nile virus
TWSIHAGGEWM

SEQ ID NO: 148877 - protein, 11 aa, West Nile virus
WSIHAGGEWMT

SEQ ID NO: 148878 - protein, 11 aa, West Nile virus
SIHAGGEWMTT

SEQ ID NO: 148879 - protein, 11 aa, West Nile virus
GGEWMTTEDML

SEQ ID NO: 148880 - protein, 11 aa, West Nile virus
GEWMTTEDMLE

SEQ ID NO: 148881 - protein, 11 aa, West Nile virus
EWMTTEDMLEV

SEQ ID NO: 148882 - protein, 11 aa, West Nile virus
WMTTEDMLEVW

SEQ ID NO: 148883 - protein, 11 aa, West Nile virus
MTTEDMLEVWN

SEQ ID NO: 148884 - protein, 11 aa, West Nile virus
TTEDMLEVWNR

SEQ ID NO: 148885 - protein, 11 aa, West Nile virus
TEDMLEVWNRV

SEQ ID NO: 148886 - protein, 11 aa, West Nile virus
EDMLEVWNRVW

SEQ ID NO: 148887 - protein, 11 aa, West Nile virus
DMLEVWNRVWI

SEQ ID NO: 148888 - protein, 11 aa, West Nile virus
MLEVWNRVWIE

SEQ ID NO: 148889 - protein, 11 aa, West Nile virus
LEVWNRVWIEE

SEQ ID NO: 148890 - protein, 11 aa, West Nile virus
EVWNRVWIEEN

SEQ ID NO: 148891 - protein, 11 aa, West Nile virus
VWNRVWIEENE

SEQ ID NO: 148892 - protein, 11 aa, West Nile virus
WNRVWIEENEW

SEQ ID NO: 148893 - protein, 11 aa, West Nile virus
NRVWIEENEWM

SEQ ID NO: 148894 - protein, 11 aa, West Nile virus
RVWIEENEWME

SEQ ID NO: 148895 - protein, 11 aa, West Nile virus
VWIEENEWMED

SEQ ID NO: 148896 - protein, 11 aa, West Nile virus
WIEENEWMEDK

SEQ ID NO: 148897 - protein, 11 aa, West Nile virus
IEENEWMEDKT

SEQ ID NO: 148898 - protein, 11 aa, West Nile virus
EENEWMEDKTP

SEQ ID NO: 148899 - protein, 11 aa, West Nile virus
ENEWMEDKTPV

SEQ ID NO: 148900 - protein, 11 aa, West Nile virus
NEWMEDKTPVE

SEQ ID NO: 148901 - protein, 11 aa, West Nile virus
EWMEDKTPVEK

SEQ ID NO: 148902 - protein, 11 aa, West Nile virus
WMEDKTPVEKW

SEQ ID NO: 148903 - protein, 11 aa, West Nile virus
MEDKTPVEKWS

SEQ ID NO: 148904 - protein, 11 aa, West Nile virus
EDKTPVEKWSD

SEQ ID NO: 148905 - protein, 11 aa, West Nile virus
DKTPVEKWSDV

SEQ ID NO: 148906 - protein, 11 aa, West Nile virus
KTPVEKWSDVP

SEQ ID NO: 148907 - protein, 11 aa, West Nile virus
TPVEKWSDVPY

SEQ ID NO: 148908 - protein, 11 aa, West Nile virus
PVEKWSDVPYS

SEQ ID NO: 148909 - protein, 11 aa, West Nile virus
VEKWSDVPYSG

SEQ ID NO: 148910 - protein, 11 aa, West Nile virus
EKWSDVPYSGK

SEQ ID NO: 148911 - protein, 11 aa, West Nile virus
KWSDVPYSGKR

SEQ ID NO: 148912 - protein, 11 aa, West Nile virus
WSDVPYSGKRE

SEQ ID NO: 148913 - protein, 11 aa, West Nile virus
SDVPYSGKRED

SEQ ID NO: 148914 - protein, 11 aa, West Nile virus
DVPYSGKREDI

SEQ ID NO: 148915 - protein, 11 aa, West Nile virus
VPYSGKREDIW

SEQ ID NO: 148916 - protein, 11 aa, West Nile virus
PYSGKREDIWC

SEQ ID NO: 148917 - protein, 11 aa, West Nile virus
YSGKREDIWCG

SEQ ID NO: 148918 - protein, 11 aa, West Nile virus
SGKREDIWCGS

SEQ ID NO: 148919 - protein, 11 aa, West Nile virus
GKREDIWCGSL

SEQ ID NO: 148920 - protein, 11 aa, West Nile virus
KREDIWCGSLI

SEQ ID NO: 148921 - protein, 11 aa, West Nile virus
REDIWCGSLIG

SEQ ID NO: 148922 - protein, 11 aa, West Nile virus
EDIWCGSLIGT

SEQ ID NO: 148923 - protein, 11 aa, West Nile virus
DIWCGSLIGTR

SEQ ID NO: 148924 - protein, 11 aa, West Nile virus
IWCGSLIGTRA

SEQ ID NO: 148925 - protein, 11 aa, West Nile virus
WCGSLIGTRAR

SEQ ID NO: 148926 - protein, 11 aa, West Nile virus
CGSLIGTRARA

SEQ ID NO: 148927 - protein, 11 aa, West Nile virus
GSLIGTRARAT

SEQ ID NO: 148928 - protein, 11 aa, West Nile virus
SLIGTRARATW

SEQ ID NO: 148929 - protein, 11 aa, West Nile virus
LIGTRARATWA

SEQ ID NO: 148930 - protein, 11 aa, West Nile virus
IGTRARATWAE

SEQ ID NO: 148931 - protein, 11 aa, West Nile virus
GTRARATWAEN

SEQ ID NO: 148932 - protein, 11 aa, West Nile virus
TRARATWAENI

SEQ ID NO: 148933 - protein, 11 aa, West Nile virus
RARATWAENIQ

SEQ ID NO: 148934 - protein, 11 aa, West Nile virus
ARATWAENIQV

SEQ ID NO: 148935 - protein, 11 aa, West Nile virus
RATWAENIQVA

SEQ ID NO: 148936 - protein, 11 aa, West Nile virus
ATWAENIQVAI

SEQ ID NO: 148937 - protein, 11 aa, West Nile virus
TWAENIQVAIN

SEQ ID NO: 148938 - protein, 11 aa, West Nile virus
WAENIQVAINQ

SEQ ID NO: 148939 - protein, 11 aa, West Nile virus
AENIQVAINQV

SEQ ID NO: 148940 - protein, 11 aa, West Nile virus
ENIQVAINQVR

SEQ ID NO: 148941 - protein, 11 aa, West Nile virus
NIQVAINQVRA

SEQ ID NO: 148942 - protein, 11 aa, West Nile virus
IIGDEKYVDYM

SEQ ID NO: 148943 - protein, 11 aa, West Nile virus
IGDEKYVDYMS

SEQ ID NO: 148944 - protein, 11 aa, West Nile virus
GDEKYVDYMSS

SEQ ID NO: 148945 - protein, 11 aa, West Nile virus
DEKYVDYMSSL

SEQ ID NO: 148946 - protein, 11 aa, West Nile virus
EKYVDYMSSLK

SEQ ID NO: 148947 - protein, 11 aa, West Nile virus
KYVDYMSSLKR

SEQ ID NO: 148948 - protein, 11 aa, West Nile virus
YVDYMSSLKRY

SEQ ID NO: 148949 - protein, 11 aa, West Nile virus
VDYMSSLKRYE

SEQ ID NO: 148950 - protein, 11 aa, West Nile virus
DYMSSLKRYED

SEQ ID NO: 148951 - protein, 11 aa, West Nile virus
MSKKPGGPGKN

SEQ ID NO: 148952 - protein, 11 aa, West Nile virus
SKKPGGPGKNR

SEQ ID NO: 148953 - protein, 11 aa, West Nile virus
KKPGGPGKNRA

SEQ ID NO: 148954 - protein, 11 aa, West Nile virus
KPGGPGKNRAV

SEQ ID NO: 148955 - protein, 11 aa, West Nile virus
PGGPGKNRAVN

SEQ ID NO: 148956 - protein, 11 aa, West Nile virus
GGPGKNRAVNM

SEQ ID NO: 148957 - protein, 11 aa, West Nile virus
GPGKNRAVNML

SEQ ID NO: 148958 - protein, 11 aa, West Nile virus
PGKNRAVNMLK

SEQ ID NO: 148959 - protein, 11 aa, West Nile virus
GKNRAVNMLKR

SEQ ID NO: 148960 - protein, 11 aa, West Nile virus
KNRAVNMLKRG

SEQ ID NO: 148961 - protein, 11 aa, West Nile virus
RAVNMQKRGTP

SEQ ID NO: 148962 - protein, 11 aa, West Nile virus
AVNMQKRGMPR

SEQ ID NO: 148963 - protein, 11 aa, West Nile virus
PRGLSLIGLKR

SEQ ID NO: 148964 - protein, 11 aa, West Nile virus
RGLSLIGLKRA

SEQ ID NO: 148965 - protein, 11 aa, West Nile virus
GLSLIGLKRAM

SEQ ID NO: 148966 - protein, 11 aa, West Nile virus
LSLTGLKRAML

SEQ ID NO: 148967 - protein, 11 aa, West Nile virus
SLTGLKRAMLS

SEQ ID NO: 148968 - protein, 11 aa, West Nile virus
LTGLKRAMLSL

SEQ ID NO: 148969 - protein, 11 aa, West Nile virus
TGLKRAMLSLI

SEQ ID NO: 148970 - protein, 11 aa, West Nile virus
GLKRAVLSLID

SEQ ID NO: 148971 - protein, 11 aa, West Nile virus
LKRAVLSLIDG

SEQ ID NO: 148972 - protein, 11 aa, West Nile virus
KRAMLSLIDGR

SEQ ID NO: 148973 - protein, 11 aa, West Nile virus
RAMLSLIDGRG

SEQ ID NO: 148974 - protein, 11 aa, West Nile virus
AMLSLIDGRGP

SEQ ID NO: 148975 - protein, 11 aa, West Nile virus
LSLIDGRGPIR

SEQ ID NO: 148976 - protein, 11 aa, West Nile virus
SLIDGRGPIRF

SEQ ID NO: 148977 - protein, 11 aa, West Nile virus
LIDGRGPIRFV

SEQ ID NO: 148978 - protein, 11 aa, West Nile virus
IDGRGPIRFVL

SEQ ID NO: 148979 - protein, 11 aa, West Nile virus
DGRGPIRFVLA

SEQ ID NO: 148980 - protein, 11 aa, West Nile virus
GRGPIRFVLAL

SEQ ID NO: 148981 - protein, 11 aa, West Nile virus
RGPIRFVLALL

SEQ ID NO: 148982 - protein, 11 aa, West Nile virus
GPIRFVLALLT

SEQ ID NO: 148983 - protein, 11 aa, West Nile virus
PTRFVLALLAF

SEQ ID NO: 148984 - protein, 11 aa, West Nile virus
IRFVLALLTFF

SEQ ID NO: 148985 - protein, 11 aa, West Nile virus
RFVLALLTFFR

SEQ ID NO: 148986 - protein, 11 aa, West Nile virus
FVLALLTFFRF

SEQ ID NO: 148987 - protein, 11 aa, West Nile virus
VLALLTFFRFT

SEQ ID NO: 148988 - protein, 11 aa, West Nile virus
LALLTFFRFTA

SEQ ID NO: 148989 - protein, 11 aa, West Nile virus
ALLTFFRFTAI

SEQ ID NO: 148990 - protein, 11 aa, West Nile virus
LLTFFRFTAIA

SEQ ID NO: 148991 - protein, 11 aa, West Nile virus
LTFFRFTAIAP

SEQ ID NO: 148992 - protein, 11 aa, West Nile virus
TFFRFTAIAPT

SEQ ID NO: 148993 - protein, 11 aa, West Nile virus
FFKFTAIAPTR

SEQ ID NO: 148994 - protein, 11 aa, West Nile virus
FKFTAIAPTRA

SEQ ID NO: 148995 - protein, 11 aa, West Nile virus
RFTAIAPTRAL

SEQ ID NO: 148996 - protein, 11 aa, West Nile virus
FTAIAPTRALL

SEQ ID NO: 148997 - protein, 11 aa, West Nile virus
TAIAPTRALLD

SEQ ID NO: 148998 - protein, 11 aa, West Nile virus
AIAPTRALLDR

SEQ ID NO: 148999 - protein, 11 aa, West Nile virus
IAPTRALLDRW

SEQ ID NO: 149000 - protein, 11 aa, West Nile virus
APTRALLDRWR

SEQ ID NO: 149001 - protein, 11 aa, West Nile virus
PTRALLDRWRG

SEQ ID NO: 149002 - protein, 11 aa, West Nile virus
TRALLDRWRGV

SEQ ID NO: 149003 - protein, 11 aa, West Nile virus
RALLDRWRGVR

SEQ ID NO: 149004 - protein, 11 aa, West Nile virus
ALLDRWRGVRK

SEQ ID NO: 149005 - protein, 11 aa, West Nile virus
LLDRWRGVRKQ

SEQ ID NO: 149006 - protein, 11 aa, West Nile virus
LDRWRGVRKQT

SEQ ID NO: 149007 - protein, 11 aa, West Nile virus
DRWRGVRKQTA

SEQ ID NO: 149008 - protein, 11 aa, West Nile virus
RWRGVRKQTAM

SEQ ID NO: 149009 - protein, 11 aa, West Nile virus
WRGVRKQTAMK

SEQ ID NO: 149010 - protein, 11 aa, West Nile virus
RGVRKQTAMKH

SEQ ID NO: 149011 - protein, 11 aa, West Nile virus
GVRKQTAMKHL

SEQ ID NO: 149012 - protein, 11 aa, West Nile virus
VRKQTAMKHLL

SEQ ID NO: 149013 - protein, 11 aa, West Nile virus
RKQTAMKHLLS

SEQ ID NO: 149014 - protein, 11 aa, West Nile virus
TAMKHLTSFKK

SEQ ID NO: 149015 - protein, 11 aa, West Nile virus
AMKHLTSFKKE

SEQ ID NO: 149016 - protein, 11 aa, West Nile virus
MKHLLSFKREL

SEQ ID NO: 149017 - protein, 11 aa, West Nile virus
KHLLSFKRELG

SEQ ID NO: 149018 - protein, 11 aa, West Nile virus
HLLSFKKELGA

SEQ ID NO: 149019 - protein, 11 aa, West Nile virus
LLSFKKELGAL

SEQ ID NO: 149020 - protein, 11 aa, West Nile virus
LSFKKELGALT

SEQ ID NO: 149021 - protein, 11 aa, West Nile virus
SFKKELGALTN

SEQ ID NO: 149022 - protein, 11 aa, West Nile virus
FKKELGALTNA

SEQ ID NO: 149023 - protein, 11 aa, West Nile virus
KKELGALTNAM

SEQ ID NO: 149024 - protein, 11 aa, West Nile virus
KELGALTNAMN

SEQ ID NO: 149025 - protein, 11 aa, West Nile virus
ELGALTNAMNK

SEQ ID NO: 149026 - protein, 11 aa, West Nile virus
LGALTNAMNKR

SEQ ID NO: 149027 - protein, 11 aa, West Nile virus
GALTNAMNKRS

SEQ ID NO: 149028 - protein, 11 aa, West Nile virus
NRRSTKQKKRG

SEQ ID NO: 149029 - protein, 11 aa, West Nile virus
RRSTKQKKRGG

SEQ ID NO: 149030 - protein, 11 aa, West Nile virus
SALTLSNFQGK

SEQ ID NO: 149031 - protein, 11 aa, West Nile virus
ALTLSNFQGKL

SEQ ID NO: 149032 - protein, 11 aa, West Nile virus
LTLSNFQGKLM

SEQ ID NO: 149033 - protein, 11 aa, West Nile virus
TLSNFQGKLMM

SEQ ID NO: 149034 - protein, 11 aa, West Nile virus
LSNFQGKLMMT

SEQ ID NO: 149035 - protein, 11 aa, West Nile virus
SNFQGKLMMTI

SEQ ID NO: 149036 - protein, 11 aa, West Nile virus
NFQGKLMMTIN

SEQ ID NO: 149037 - protein, 11 aa, West Nile virus
FQGKLMMTINA

SEQ ID NO: 149038 - protein, 11 aa, West Nile virus
QGKLMMTINAT

SEQ ID NO: 149039 - protein, 11 aa, West Nile virus
GKVIMTVNATD

SEQ ID NO: 149040 - protein, 11 aa, West Nile virus
IITIPTAAGKN

SEQ ID NO: 149041 - protein, 11 aa, West Nile virus
ITIPIASGKNL

SEQ ID NO: 149042 - protein, 11 aa, West Nile virus
TIPIASGKNLC

SEQ ID NO: 149043 - protein, 11 aa, West Nile virus
IPTAAGKNLCT

SEQ ID NO: 149044 - protein, 11 aa, West Nile virus
PTAAGKNLCTI

SEQ ID NO: 149045 - protein, 11 aa, West Nile virus
TAAGKNLCTIR

SEQ ID NO: 149046 - protein, 11 aa, West Nile virus
AAGKNLCTIRA

SEQ ID NO: 149047 - protein, 11 aa, West Nile virus
AGKNLCTIRAM

SEQ ID NO: 149048 - protein, 11 aa, West Nile virus
GKNLCTIRAMD

SEQ ID NO: 149049 - protein, 11 aa, West Nile virus
KNLCTIRAMDV

SEQ ID NO: 149050 - protein, 11 aa, West Nile virus
NLCTIRAMDVG

SEQ ID NO: 149051 - protein, 11 aa, West Nile virus
LCTIRAMDVGF

SEQ ID NO: 149052 - protein, 11 aa, West Nile virus
VRAMDVGYLCE

SEQ ID NO: 149053 - protein, 11 aa, West Nile virus
RAMDVGYLCED

SEQ ID NO: 149054 - protein, 11 aa, West Nile virus
AMDVGYLCEDT

SEQ ID NO: 149055 - protein, 11 aa, West Nile virus
MDVGYLCEDTI

SEQ ID NO: 149056 - protein, 11 aa, West Nile virus
DVGYLCEDTIT

SEQ ID NO: 149057 - protein, 11 aa, West Nile virus
VGYLCEDTITY

SEQ ID NO: 149058 - protein, 11 aa, West Nile virus
GYLCEDTITYE

SEQ ID NO: 149059 - protein, 11 aa, West Nile virus
YLCEDTITYEC

SEQ ID NO: 149060 - protein, 11 aa, West Nile virus
LCEDTITYECP

SEQ ID NO: 149061 - protein, 11 aa, West Nile virus
CEDTITYECPV

SEQ ID NO: 149062 - protein, 11 aa, West Nile virus
EDTITYECPVL

SEQ ID NO: 149063 - protein, 11 aa, West Nile virus
DTITYECPVLA

SEQ ID NO: 149064 - protein, 11 aa, West Nile virus
TITYECPVLAA

SEQ ID NO: 149065 - protein, 11 aa, West Nile virus
ITYECPVLAAG

SEQ ID NO: 149066 - protein, 11 aa, West Nile virus
TYECPVLAAGN

SEQ ID NO: 149067 - protein, 11 aa, West Nile virus
YECPVLAAGND

SEQ ID NO: 149068 - protein, 11 aa, West Nile virus
ECPVLAAGNDP

SEQ ID NO: 149069 - protein, 11 aa, West Nile virus
CPVLAAGNDPE

SEQ ID NO: 149070 - protein, 11 aa, West Nile virus
PVLAAGNDPED

SEQ ID NO: 149071 - protein, 11 aa, West Nile virus
VLAAGNDPEDI

SEQ ID NO: 149072 - protein, 11 aa, West Nile virus
LAAGNDPEDID

SEQ ID NO: 149073 - protein, 11 aa, West Nile virus
AAGNDPEDIDC

SEQ ID NO: 149074 - protein, 11 aa, West Nile virus
EGNDPEDIDCW

SEQ ID NO: 149075 - protein, 11 aa, West Nile virus
PEDIDCWCTKL

SEQ ID NO: 149076 - protein, 11 aa, West Nile virus
EDIDCWCTKSS

SEQ ID NO: 149077 - protein, 11 aa, West Nile virus
SVYVRYGRCTK

SEQ ID NO: 149078 - protein, 11 aa, West Nile virus
VFVRYGRCTRT

SEQ ID NO: 149079 - protein, 11 aa, West Nile virus
FVRYGRCTRTR

SEQ ID NO: 149080 - protein, 11 aa, West Nile virus
VRYGRCTRTRN

SEQ ID NO: 149081 - protein, 11 aa, West Nile virus
RYGRCTRTRNS

SEQ ID NO: 149082 - protein, 11 aa, West Nile virus
YGRCTRTRNSR

SEQ ID NO: 149083 - protein, 11 aa, West Nile virus
GRCTRTRNSRR

SEQ ID NO: 149084 - protein, 11 aa, West Nile virus
RCTRTRNSRRS

SEQ ID NO: 149085 - protein, 11 aa, West Nile virus
CTRTRNSRRSR

SEQ ID NO: 149086 - protein, 11 aa, West Nile virus
TRTRNSRRSRR

SEQ ID NO: 149087 - protein, 11 aa, West Nile virus
RTRNSRRSRRS

SEQ ID NO: 149088 - protein, 11 aa, West Nile virus
TRNSRRSRRSL

SEQ ID NO: 149089 - protein, 11 aa, West Nile virus
RNSRRSRRSLN

SEQ ID NO: 149090 - protein, 11 aa, West Nile virus
NSRRSRRSLNV

SEQ ID NO: 149091 - protein, 11 aa, West Nile virus
SRRSRRSLNVQ

SEQ ID NO: 149092 - protein, 11 aa, West Nile virus
RRSRRSLNVQV

SEQ ID NO: 149093 - protein, 11 aa, West Nile virus
RSRRSLNVQVH

SEQ ID NO: 149094 - protein, 11 aa, West Nile virus
SRRSLNVQVHG

SEQ ID NO: 149095 - protein, 11 aa, West Nile virus
RRSLNVQVHGE

SEQ ID NO: 149096 - protein, 11 aa, West Nile virus
RSLNVQVHGES

SEQ ID NO: 149097 - protein, 11 aa, West Nile virus
SLNVQVHGESS

SEQ ID NO: 149098 - protein, 11 aa, West Nile virus
LNVQVHGESSL

SEQ ID NO: 149099 - protein, 11 aa, West Nile virus
NVQVHGESSLS

SEQ ID NO: 149100 - protein, 11 aa, West Nile virus
VQVHGESSLSN

SEQ ID NO: 149101 - protein, 11 aa, West Nile virus
QVHGESSLSNR

SEQ ID NO: 149102 - protein, 11 aa, West Nile virus
VHGESSLSNRK

SEQ ID NO: 149103 - protein, 11 aa, West Nile virus
HGESSLSNRKG

SEQ ID NO: 149104 - protein, 11 aa, West Nile virus
GESSLSNRKGA

SEQ ID NO: 149105 - protein, 11 aa, West Nile virus
ESSLSNRKGAW

SEQ ID NO: 149106 - protein, 11 aa, West Nile virus
STLANKKGAWL

SEQ ID NO: 149107 - protein, 11 aa, West Nile virus
TLANKKGAWLD

SEQ ID NO: 149108 - protein, 11 aa, West Nile virus
LANKKGAWLDS

SEQ ID NO: 149109 - protein, 11 aa, West Nile virus
ANKKGAWLDST

SEQ ID NO: 149110 - protein, 11 aa, West Nile virus
NKKGAWLDSTK

SEQ ID NO: 149111 - protein, 11 aa, West Nile virus
KKGAWLDSTKA

SEQ ID NO: 149112 - protein, 11 aa, West Nile virus
KGAWLDSTKAT

SEQ ID NO: 149113 - protein, 11 aa, West Nile virus
GAWLDSTKATR

SEQ ID NO: 149114 - protein, 11 aa, West Nile virus
AWLDSTKATRY

SEQ ID NO: 149115 - protein, 11 aa, West Nile virus
WLDSTKATRYL

SEQ ID NO: 149116 - protein, 11 aa, West Nile virus
LDSTKATRYLV

SEQ ID NO: 149117 - protein, 11 aa, West Nile virus
DSTKASRYLMK

SEQ ID NO: 149118 - protein, 11 aa, West Nile virus
STKASRYLMKA

SEQ ID NO: 149119 - protein, 11 aa, West Nile virus
TKASRYLMKAE

SEQ ID NO: 149120 - protein, 11 aa, West Nile virus
KASRYLMKAES

SEQ ID NO: 149121 - protein, 11 aa, West Nile virus
ASRYLMKAESW

SEQ ID NO: 149122 - protein, 11 aa, West Nile virus
SRYLMKAESWI

SEQ ID NO: 149123 - protein, 11 aa, West Nile virus
RYLMKAESWIL

SEQ ID NO: 149124 - protein, 11 aa, West Nile virus
YLMKAESWILR

SEQ ID NO: 149125 - protein, 11 aa, West Nile virus
LMKAESWILRN

SEQ ID NO: 149126 - protein, 11 aa, West Nile virus
MKAESWILRNP

SEQ ID NO: 149127 - protein, 11 aa, West Nile virus
KAESWILRNPG

SEQ ID NO: 149128 - protein, 11 aa, West Nile virus
AESWILRNPGY

SEQ ID NO: 149129 - protein, 11 aa, West Nile virus
NPGYALVAVVI

SEQ ID NO: 149130 - protein, 11 aa, West Nile virus
PGYALVAVVIG

SEQ ID NO: 149131 - protein, 11 aa, West Nile virus
GYALVAAVTGW

SEQ ID NO: 149132 - protein, 11 aa, West Nile virus
YALVAAVTGWM

SEQ ID NO: 149133 - protein, 11 aa, West Nile virus
ALVAVVIGWML

SEQ ID NO: 149134 - protein, 11 aa, West Nile virus
LVAVVIGWMLG

SEQ ID NO: 149135 - protein, 11 aa, West Nile virus
VAAVTGWMLGS

SEQ ID NO: 149136 - protein, 11 aa, West Nile virus
AAVTGWMLGSN

SEQ ID NO: 149137 - protein, 11 aa, West Nile virus
VVIGWMLGSNN

SEQ ID NO: 149138 - protein, 11 aa, West Nile virus
VIGWMLGSNTT

SEQ ID NO: 149139 - protein, 11 aa, West Nile virus
IGWMLGSNTTQ

SEQ ID NO: 149140 - protein, 11 aa, West Nile virus
GWMLGSNTTQR

SEQ ID NO: 149141 - protein, 11 aa, West Nile virus
WMLGSNTTQRV

SEQ ID NO: 149142 - protein, 11 aa, West Nile virus
MLGSNTTQRVV

SEQ ID NO: 149143 - protein, 11 aa, West Nile virus
LGSNTTQRVVF

SEQ ID NO: 149144 - protein, 11 aa, West Nile virus
GSNTMQRVVFA

SEQ ID NO: 149145 - protein, 11 aa, West Nile virus
MQRVVFAILLL

SEQ ID NO: 149146 - protein, 11 aa, West Nile virus
QRVVFAILLLL

SEQ ID NO: 149147 - protein, 11 aa, West Nile virus
RVVFAILLLLV

SEQ ID NO: 149148 - protein, 11 aa, West Nile virus
VVFAILLLLVA

SEQ ID NO: 149149 - protein, 11 aa, West Nile virus
VFAILLLLVAP

SEQ ID NO: 149150 - protein, 11 aa, West Nile virus
FAILLLLVAPA

SEQ ID NO: 149151 - protein, 11 aa, West Nile virus
AILLLLVAPAY

SEQ ID NO: 149152 - protein, 11 aa, West Nile virus
ILLLLVAPAYS

SEQ ID NO: 149153 - protein, 11 aa, West Nile virus
AYSFNCLGMSS

SEQ ID NO: 149154 - protein, 11 aa, West Nile virus
YSFNCLGMSSR

SEQ ID NO: 149155 - protein, 11 aa, West Nile virus
SFNCLGMSSRD

SEQ ID NO: 149156 - protein, 11 aa, West Nile virus
FNCLGMSSRDF

SEQ ID NO: 149157 - protein, 11 aa, West Nile virus
NCLGMSNRDFI

SEQ ID NO: 149158 - protein, 11 aa, West Nile virus
CLGMSNRDFIE

SEQ ID NO: 149159 - protein, 11 aa, West Nile virus
LGMSNRDFIEG

SEQ ID NO: 149160 - protein, 11 aa, West Nile virus
GMSNRDFIEGA

SEQ ID NO: 149161 - protein, 11 aa, West Nile virus
MSNRDFIEGAS

SEQ ID NO: 149162 - protein, 11 aa, West Nile virus
SNRDFIEGASG

SEQ ID NO: 149163 - protein, 11 aa, West Nile virus
NRDFIEGASGA

SEQ ID NO: 149164 - protein, 11 aa, West Nile virus
RDFIEGASGAT

SEQ ID NO: 149165 - protein, 11 aa, West Nile virus
DFIEGASGATW

SEQ ID NO: 149166 - protein, 11 aa, West Nile virus
FIEGASGATWV

SEQ ID NO: 149167 - protein, 11 aa, West Nile virus
IEGASGATWVD

SEQ ID NO: 149168 - protein, 11 aa, West Nile virus
EGASGATWVDL

SEQ ID NO: 149169 - protein, 11 aa, West Nile virus
GASGATWVDLV

SEQ ID NO: 149170 - protein, 11 aa, West Nile virus
ASGATWVDLVL

SEQ ID NO: 149171 - protein, 11 aa, West Nile virus
SGATWMDLVLE

SEQ ID NO: 149172 - protein, 11 aa, West Nile virus
GATWMDLVLEG

SEQ ID NO: 149173 - protein, 11 aa, West Nile virus
ATWMDLVLEGD

SEQ ID NO: 149174 - protein, 11 aa, West Nile virus
TWMDLVLEGDS

SEQ ID NO: 149175 - protein, 11 aa, West Nile virus
WMDLVLEGDSC

SEQ ID NO: 149176 - protein, 11 aa, West Nile virus
MDLVLEGDSCV

SEQ ID NO: 149177 - protein, 11 aa, West Nile virus
VLEGDSCVTIT

SEQ ID NO: 149178 - protein, 11 aa, West Nile virus
LEGDSCVTIMA

SEQ ID NO: 149179 - protein, 11 aa, West Nile virus
EGDSCVTIMAK

SEQ ID NO: 149180 - protein, 11 aa, West Nile virus
GDSCVTIMAKD

SEQ ID NO: 149181 - protein, 11 aa, West Nile virus
DSCVTIMAKDR

SEQ ID NO: 149182 - protein, 11 aa, West Nile virus
SCVTIMAKDRP

SEQ ID NO: 149183 - protein, 11 aa, West Nile virus
CVTIMAKDRPT

SEQ ID NO: 149184 - protein, 11 aa, West Nile virus
VTIMAKDRPTI

SEQ ID NO: 149185 - protein, 11 aa, West Nile virus
TIMAKDRPTID

SEQ ID NO: 149186 - protein, 11 aa, West Nile virus
IMAKDRPTIDV

SEQ ID NO: 149187 - protein, 11 aa, West Nile virus
MAKDRPTIDVK

SEQ ID NO: 149188 - protein, 11 aa, West Nile virus
AKDRPTIDVKM

SEQ ID NO: 149189 - protein, 11 aa, West Nile virus
KDRPTIDVKMV

SEQ ID NO: 149190 - protein, 11 aa, West Nile virus
DRPTIDVKMVT

SEQ ID NO: 149191 - protein, 11 aa, West Nile virus
RPTIDVKMVTM

SEQ ID NO: 149192 - protein, 11 aa, West Nile virus
PTIDVKMVTMG

SEQ ID NO: 149193 - protein, 11 aa, West Nile virus
TIDVKMVTMGA

SEQ ID NO: 149194 - protein, 11 aa, West Nile virus
VSDLSTRAACP

SEQ ID NO: 149195 - protein, 11 aa, West Nile virus
LSTRAACPTMG

SEQ ID NO: 149196 - protein, 11 aa, West Nile virus
STRAACPTMGE

SEQ ID NO: 149197 - protein, 11 aa, West Nile virus
TRAACPTMGEA

SEQ ID NO: 149198 - protein, 11 aa, West Nile virus
RAACPTMGEAH

SEQ ID NO: 149199 - protein, 11 aa, West Nile virus
AACPTMGDAHN

SEQ ID NO: 149200 - protein, 11 aa, West Nile virus
ACPTMGEAHNE

SEQ ID NO: 149201 - protein, 11 aa, West Nile virus
CPTMGEAHNEK

SEQ ID NO: 149202 - protein, 11 aa, West Nile virus
PTMGEAHNEKR

SEQ ID NO: 149203 - protein, 11 aa, West Nile virus
TMGEAHNEKRA

SEQ ID NO: 149204 - protein, 11 aa, West Nile virus
MGEAHNEKRAD

SEQ ID NO: 149205 - protein, 11 aa, West Nile virus
GEAHNEKRADP

SEQ ID NO: 149206 - protein, 11 aa, West Nile virus
FVCKQGVVDRG

SEQ ID NO: 149207 - protein, 11 aa, West Nile virus
VCKQGVVDRGW

SEQ ID NO: 149208 - protein, 11 aa, West Nile virus
CKQGVVDRGWG

SEQ ID NO: 149209 - protein, 11 aa, West Nile virus
KQGVVDRGWGN

SEQ ID NO: 149210 - protein, 11 aa, West Nile virus
KGSIDTCAKFT

SEQ ID NO: 149211 - protein, 11 aa, West Nile virus
GSIDTCAKFTC

SEQ ID NO: 149212 - protein, 11 aa, West Nile virus
SIDTCAKFACT

SEQ ID NO: 149213 - protein, 11 aa, West Nile virus
IDTCAKFACTT

SEQ ID NO: 149214 - protein, 11 aa, West Nile virus
DTCAKFACTTK

SEQ ID NO: 149215 - protein, 11 aa, West Nile virus
TCAKFACTTKA

SEQ ID NO: 149216 - protein, 11 aa, West Nile virus
CAKFACSTKAT

SEQ ID NO: 149217 - protein, 11 aa, West Nile virus
AKFACSTKATG

SEQ ID NO: 149218 - protein, 11 aa, West Nile virus
KFACSTKATGR

SEQ ID NO: 149219 - protein, 11 aa, West Nile virus
FACSTKATGRT

SEQ ID NO: 149220 - protein, 11 aa, West Nile virus
ACSTKATGRTI

SEQ ID NO: 149221 - protein, 11 aa, West Nile virus
CSTKATGRTIL

SEQ ID NO: 149222 - protein, 11 aa, West Nile virus
STKATGRTILK

SEQ ID NO: 149223 - protein, 11 aa, West Nile virus
TKATGRTILKE

SEQ ID NO: 149224 - protein, 11 aa, West Nile virus
KATGRTILKEN

SEQ ID NO: 149225 - protein, 11 aa, West Nile virus
ATGRTILKENI

SEQ ID NO: 149226 - protein, 11 aa, West Nile virus
TGRTILKENIK

SEQ ID NO: 149227 - protein, 11 aa, West Nile virus
GWIIQKENIKY

SEQ ID NO: 149228 - protein, 11 aa, West Nile virus
WIIQKENIKYE

SEQ ID NO: 149229 - protein, 11 aa, West Nile virus
IIQKENIKYEV

SEQ ID NO: 149230 - protein, 11 aa, West Nile virus
IQKENIKYEVA

SEQ ID NO: 149231 - protein, 11 aa, West Nile virus
QKENIKYEVAI

SEQ ID NO: 149232 - protein, 11 aa, West Nile virus
RENVKYEVAAF

SEQ ID NO: 149233 - protein, 11 aa, West Nile virus
ENVKYEVAAFV

SEQ ID NO: 149234 - protein, 11 aa, West Nile virus
NVKYEVAAFVH

SEQ ID NO: 149235 - protein, 11 aa, West Nile virus
VKYEVAAFVHG

SEQ ID NO: 149236 - protein, 11 aa, West Nile virus
KYEVAAFVHGP

SEQ ID NO: 149237 - protein, 11 aa, West Nile virus
YEVAAFVHGPT

SEQ ID NO: 149238 - protein, 11 aa, West Nile virus
EVAAFVHGPTT

SEQ ID NO: 149239 - protein, 11 aa, West Nile virus
VAAFVHGPTTV

SEQ ID NO: 149240 - protein, 11 aa, West Nile virus
AAFVHGPTTVD

SEQ ID NO: 149241 - protein, 11 aa, West Nile virus
AFVHGPTTVDT

SEQ ID NO: 149242 - protein, 11 aa, West Nile virus
FVHGPTTVDTH

SEQ ID NO: 149243 - protein, 11 aa, West Nile virus
VHGPTTVDTHS

SEQ ID NO: 149244 - protein, 11 aa, West Nile virus
AAVQAGRFSVS

SEQ ID NO: 149245 - protein, 11 aa, West Nile virus
AVQAGRFSVSP

SEQ ID NO: 149246 - protein, 11 aa, West Nile virus
QAGRFSITPSA

SEQ ID NO: 149247 - protein, 11 aa, West Nile virus
AGRFSITPSAP

SEQ ID NO: 149248 - protein, 11 aa, West Nile virus
GRFSITPSAPS

SEQ ID NO: 149249 - protein, 11 aa, West Nile virus
TLGDYGEVTFD

SEQ ID NO: 149250 - protein, 11 aa, West Nile virus
LGDYGEVTFDC

SEQ ID NO: 149251 - protein, 11 aa, West Nile virus
GDYGEVTFDCE

SEQ ID NO: 149252 - protein, 11 aa, West Nile virus
DYGEVTFDCEP

SEQ ID NO: 149253 - protein, 11 aa, West Nile virus
YGEVTFDCEPR

SEQ ID NO: 149254 - protein, 11 aa, West Nile virus
GEVTFDCEPRS

SEQ ID NO: 149255 - protein, 11 aa, West Nile virus
EVTFDCEPRSG

SEQ ID NO: 149256 - protein, 11 aa, West Nile virus
VTFDCEPRSGV

SEQ ID NO: 149257 - protein, 11 aa, West Nile virus
TFDCEPRSGVD

SEQ ID NO: 149258 - protein, 11 aa, West Nile virus
FDCEPRSGVDV

SEQ ID NO: 149259 - protein, 11 aa, West Nile virus
DCEPRSGIDTS

SEQ ID NO: 149260 - protein, 11 aa, West Nile virus
CEPRSGIDTSA

SEQ ID NO: 149261 - protein, 11 aa, West Nile virus
EPRSGIDTSAY

SEQ ID NO: 149262 - protein, 11 aa, West Nile virus
PRSGIDTSAYY

SEQ ID NO: 149263 - protein, 11 aa, West Nile virus
RSGIDTSAYYV

SEQ ID NO: 149264 - protein, 11 aa, West Nile virus
SGIDTSAYYVM

SEQ ID NO: 149265 - protein, 11 aa, West Nile virus
GIDTSAYYVMS

SEQ ID NO: 149266 - protein, 11 aa, West Nile virus
IDTSAYYVMSV

SEQ ID NO: 149267 - protein, 11 aa, West Nile virus
DTSAYYVMSVG

SEQ ID NO: 149268 - protein, 11 aa, West Nile virus
KSFLVHREWFM

SEQ ID NO: 149269 - protein, 11 aa, West Nile virus
SFLVHREWFMD

SEQ ID NO: 149270 - protein, 11 aa, West Nile virus
VHREWFMDLNM

SEQ ID NO: 149271 - protein, 11 aa, West Nile virus
HREWFTDLNLP

SEQ ID NO: 149272 - protein, 11 aa, West Nile virus
REWFTDLNLPW

SEQ ID NO: 149273 - protein, 11 aa, West Nile virus
EWFMDLNMPWS

SEQ ID NO: 149274 - protein, 11 aa, West Nile virus
WFTDLNLPWSS

SEQ ID NO: 149275 - protein, 11 aa, West Nile virus
FMDLNLPWSSP

SEQ ID NO: 149276 - protein, 11 aa, West Nile virus
MDLNLPWSSPG

SEQ ID NO: 149277 - protein, 11 aa, West Nile virus
DLNLPWSSPGN

SEQ ID NO: 149278 - protein, 11 aa, West Nile virus
LNLPWSSPGNT

SEQ ID NO: 149279 - protein, 11 aa, West Nile virus
WRNREALVEFE

SEQ ID NO: 149280 - protein, 11 aa, West Nile virus
RNREALVEFEE

SEQ ID NO: 149281 - protein, 11 aa, West Nile virus
NREALVEFEEA

SEQ ID NO: 149282 - protein, 11 aa, West Nile virus
REALVEFEEAH

SEQ ID NO: 149283 - protein, 11 aa, West Nile virus
EALVEFEEAHA

SEQ ID NO: 149284 - protein, 11 aa, West Nile virus
ALVEFEEAHAT

SEQ ID NO: 149285 - protein, 11 aa, West Nile virus
LVEFEEAHATK

SEQ ID NO: 149286 - protein, 11 aa, West Nile virus
VEFEEAHATKQ

SEQ ID NO: 149287 - protein, 11 aa, West Nile virus
EFEEAHATKQS

SEQ ID NO: 149288 - protein, 11 aa, West Nile virus
FEEAHATKQSV

SEQ ID NO: 149289 - protein, 11 aa, West Nile virus
EEPHATKQSVV

SEQ ID NO: 149290 - protein, 11 aa, West Nile virus
EPHATKQSVVA

SEQ ID NO: 149291 - protein, 11 aa, West Nile virus
PHATKQSVVAL

SEQ ID NO: 149292 - protein, 11 aa, West Nile virus
HATKQSVVALG

SEQ ID NO: 149293 - protein, 11 aa, West Nile virus
ATKQSVVALGS

SEQ ID NO: 149294 - protein, 11 aa, West Nile virus
TKQSVVALGSQ

SEQ ID NO: 149295 - protein, 11 aa, West Nile virus
KQSVVALGSQE

SEQ ID NO: 149296 - protein, 11 aa, West Nile virus
QSVVALGSQEG

SEQ ID NO: 149297 - protein, 11 aa, West Nile virus
SVVALGSQEGA

SEQ ID NO: 149298 - protein, 11 aa, West Nile virus
VVALGSQEGAL

SEQ ID NO: 149299 - protein, 11 aa, West Nile virus
VALGSQEGALH

SEQ ID NO: 149300 - protein, 11 aa, West Nile virus
EGALQQALAGA

SEQ ID NO: 149301 - protein, 11 aa, West Nile virus
GALHQALAGTI

SEQ ID NO: 149302 - protein, 11 aa, West Nile virus
ALHQALAGTIP

SEQ ID NO: 149303 - protein, 11 aa, West Nile virus
LHQALAGAIPL

SEQ ID NO: 149304 - protein, 11 aa, West Nile virus
HQALAGAIPVD

SEQ ID NO: 149305 - protein, 11 aa, West Nile virus
QALAGAIPVDY

SEQ ID NO: 149306 - protein, 11 aa, West Nile virus
ALAGAIPVDYK

SEQ ID NO: 149307 - protein, 11 aa, West Nile virus
LAGAIPVDYKN

SEQ ID NO: 149308 - protein, 11 aa, West Nile virus
AGAIPVDYKNS

SEQ ID NO: 149309 - protein, 11 aa, West Nile virus
GAIPVDYKNSV

SEQ ID NO: 149310 - protein, 11 aa, West Nile virus
AIPVDYKNSVV

SEQ ID NO: 149311 - protein, 11 aa, West Nile virus
IPVDYKNSVVK

SEQ ID NO: 149312 - protein, 11 aa, West Nile virus
PVDYKNSVVKL

SEQ ID NO: 149313 - protein, 11 aa, West Nile virus
VDYKNSVVKLS

SEQ ID NO: 149314 - protein, 11 aa, West Nile virus
DYKNSVVKLSS

SEQ ID NO: 149315 - protein, 11 aa, West Nile virus
YKNSVVKLSSG

SEQ ID NO: 149316 - protein, 11 aa, West Nile virus
KNSVVKLSSGH

SEQ ID NO: 149317 - protein, 11 aa, West Nile virus
NSVVKLSSGHL

SEQ ID NO: 149318 - protein, 11 aa, West Nile virus
SVVKLSSGHLK

SEQ ID NO: 149319 - protein, 11 aa, West Nile virus
VVKLSSGHLKC

SEQ ID NO: 149320 - protein, 11 aa, West Nile virus
VKLSSGHLKCR

SEQ ID NO: 149321 - protein, 11 aa, West Nile virus
KLSSGHLKCRV

SEQ ID NO: 149322 - protein, 11 aa, West Nile virus
LTSGHLKCRVR

SEQ ID NO: 149323 - protein, 11 aa, West Nile virus
TSGHLKCRVRM

SEQ ID NO: 149324 - protein, 11 aa, West Nile virus
SGHLKCRVRME

SEQ ID NO: 149325 - protein, 11 aa, West Nile virus
GHLKCRVRMEK

SEQ ID NO: 149326 - protein, 11 aa, West Nile virus
HLKCRVRMEKL

SEQ ID NO: 149327 - protein, 11 aa, West Nile virus
LKCRVRMEKLQ

SEQ ID NO: 149328 - protein, 11 aa, West Nile virus
KCRVRMEKLQL

SEQ ID NO: 149329 - protein, 11 aa, West Nile virus
CRVRMEKLQLK

SEQ ID NO: 149330 - protein, 11 aa, West Nile virus
RVRMEKLQLKG

SEQ ID NO: 149331 - protein, 11 aa, West Nile virus
VRMEKLQLKGT

SEQ ID NO: 149332 - protein, 11 aa, West Nile virus
RMEKLQLKGTT

SEQ ID NO: 149333 - protein, 11 aa, West Nile virus
MEKLKLKGTTY

SEQ ID NO: 149334 - protein, 11 aa, West Nile virus
EKLKLKGTTYG

SEQ ID NO: 149335 - protein, 11 aa, West Nile virus
KLKLKGTTYGV

SEQ ID NO: 149336 - protein, 11 aa, West Nile virus
LKLKGTTYGVC

SEQ ID NO: 149337 - protein, 11 aa, West Nile virus
KLKGTTYGVCA

SEQ ID NO: 149338 - protein, 11 aa, West Nile virus
LKGTTYGVCAK

SEQ ID NO: 149339 - protein, 11 aa, West Nile virus
KGTTYGVCAKA

SEQ ID NO: 149340 - protein, 11 aa, West Nile virus
GTTYGVCAKAF

SEQ ID NO: 149341 - protein, 11 aa, West Nile virus
TTYGVCAKAFR

SEQ ID NO: 149342 - protein, 11 aa, West Nile virus
TYGVCAKAFRF

SEQ ID NO: 149343 - protein, 11 aa, West Nile virus
RTPADTGHGTV

SEQ ID NO: 149344 - protein, 11 aa, West Nile virus
PADTGHGTVVM

SEQ ID NO: 149345 - protein, 11 aa, West Nile virus
ADTGHGTVVME

SEQ ID NO: 149346 - protein, 11 aa, West Nile virus
DTGHGTVVMEL

SEQ ID NO: 149347 - protein, 11 aa, West Nile virus
TGHGTVVMELQ

SEQ ID NO: 149348 - protein, 11 aa, West Nile virus
GHGTVVMELQY

SEQ ID NO: 149349 - protein, 11 aa, West Nile virus
HGTVVMELQYT

SEQ ID NO: 149350 - protein, 11 aa, West Nile virus
GTVVMELQYTG

SEQ ID NO: 149351 - protein, 11 aa, West Nile virus
TVVMELQYTGT

SEQ ID NO: 149352 - protein, 11 aa, West Nile virus
VVMELQYTGTD

SEQ ID NO: 149353 - protein, 11 aa, West Nile virus
VMELQYTGTDG

SEQ ID NO: 149354 - protein, 11 aa, West Nile virus
MELQYTGTDGP

SEQ ID NO: 149355 - protein, 11 aa, West Nile virus
ELQYTGKDGPC

SEQ ID NO: 149356 - protein, 11 aa, West Nile virus
LQYTGKDGPCK

SEQ ID NO: 149357 - protein, 11 aa, West Nile virus
QYTGTDGPCKI

SEQ ID NO: 149358 - protein, 11 aa, West Nile virus
YTGTDGPCKIP

SEQ ID NO: 149359 - protein, 11 aa, West Nile virus
TGTDGPCKIPI

SEQ ID NO: 149360 - protein, 11 aa, West Nile virus
GTDGPCKIPIS

SEQ ID NO: 149361 - protein, 11 aa, West Nile virus
TDGPCKIPISS

SEQ ID NO: 149362 - protein, 11 aa, West Nile virus
DGPCKIPITSV

SEQ ID NO: 149363 - protein, 11 aa, West Nile virus
GPCKIPISSVA

SEQ ID NO: 149364 - protein, 11 aa, West Nile virus
PCKIPISSVAS

SEQ ID NO: 149365 - protein, 11 aa, West Nile virus
CKIPITSVASL

SEQ ID NO: 149366 - protein, 11 aa, West Nile virus
KIPITSVASLN

SEQ ID NO: 149367 - protein, 11 aa, West Nile virus
IPITSVASLND

SEQ ID NO: 149368 - protein, 11 aa, West Nile virus
PITSVASLNDL

SEQ ID NO: 149369 - protein, 11 aa, West Nile virus
ITSVASLNDLT

SEQ ID NO: 149370 - protein, 11 aa, West Nile virus
TSVASLNDLTP

SEQ ID NO: 149371 - protein, 11 aa, West Nile virus
PVGRLVTVNPY

SEQ ID NO: 149372 - protein, 11 aa, West Nile virus
VGRLVTVNPYV

SEQ ID NO: 149373 - protein, 11 aa, West Nile virus
GRLVTVNPYVS

SEQ ID NO: 149374 - protein, 11 aa, West Nile virus
RLVTVNPYVSV

SEQ ID NO: 149375 - protein, 11 aa, West Nile virus
LVTVNPYVSVA

SEQ ID NO: 149376 - protein, 11 aa, West Nile virus
VTVNPYVSVAT

SEQ ID NO: 149377 - protein, 11 aa, West Nile virus
TVNPYVSVATA

SEQ ID NO: 149378 - protein, 11 aa, West Nile virus
TANSKVLIELE

SEQ ID NO: 149379 - protein, 11 aa, West Nile virus
ANSKVLIELEP

SEQ ID NO: 149380 - protein, 11 aa, West Nile virus
NSKVLIELEPP

SEQ ID NO: 149381 - protein, 11 aa, West Nile virus
SKVLIELEPPF

SEQ ID NO: 149382 - protein, 11 aa, West Nile virus
KILVELEPPFG

SEQ ID NO: 149383 - protein, 11 aa, West Nile virus
ILVELEPPFGD

SEQ ID NO: 149384 - protein, 11 aa, West Nile virus
LVELEPPFGDS

SEQ ID NO: 149385 - protein, 11 aa, West Nile virus
VELEPPFGDSY

SEQ ID NO: 149386 - protein, 11 aa, West Nile virus
EPPFGDSYIVI

SEQ ID NO: 149387 - protein, 11 aa, West Nile virus
PPFGDSYIVIG

SEQ ID NO: 149388 - protein, 11 aa, West Nile virus
PFGDSYIVIGK

SEQ ID NO: 149389 - protein, 11 aa, West Nile virus
FGDSYIVIGKG

SEQ ID NO: 149390 - protein, 11 aa, West Nile virus
GDSYIVIGKGD

SEQ ID NO: 149391 - protein, 11 aa, West Nile virus
DSYIVIGKGDQ

SEQ ID NO: 149392 - protein, 11 aa, West Nile virus
SYIVIGKGDQQ

SEQ ID NO: 149393 - protein, 11 aa, West Nile virus
YIVIGKGDQQV

SEQ ID NO: 149394 - protein, 11 aa, West Nile virus
IVIGKGDQQVT

SEQ ID NO: 149395 - protein, 11 aa, West Nile virus
VIGKGDQQVTH

SEQ ID NO: 149396 - protein, 11 aa, West Nile virus
IGKGDQQVTHH

SEQ ID NO: 149397 - protein, 11 aa, West Nile virus
GKGDQQVTHHW

SEQ ID NO: 149398 - protein, 11 aa, West Nile virus
KGDQQVTHHWH

SEQ ID NO: 149399 - protein, 11 aa, West Nile virus
GDQQVTHHWHK

SEQ ID NO: 149400 - protein, 11 aa, West Nile virus
DQQVTHHWHKS

SEQ ID NO: 149401 - protein, 11 aa, West Nile virus
QQVTHHWHKSG

SEQ ID NO: 149402 - protein, 11 aa, West Nile virus
QVTHHWHKSGS

SEQ ID NO: 149403 - protein, 11 aa, West Nile virus
VTHHWHKSGSS

SEQ ID NO: 149404 - protein, 11 aa, West Nile virus
THHWHKSGSSI

SEQ ID NO: 149405 - protein, 11 aa, West Nile virus
HHWHKSGISIG

SEQ ID NO: 149406 - protein, 11 aa, West Nile virus
HWYKSGSSIGK

SEQ ID NO: 149407 - protein, 11 aa, West Nile virus
WYKSGSSIGKA

SEQ ID NO: 149408 - protein, 11 aa, West Nile virus
HKSGISIGKAF

SEQ ID NO: 149409 - protein, 11 aa, West Nile virus
KSGSSIGKAFA

SEQ ID NO: 149410 - protein, 11 aa, West Nile virus
SGSSIGKAFAT

SEQ ID NO: 149411 - protein, 11 aa, West Nile virus
GSSIGKAFATT

SEQ ID NO: 149412 - protein, 11 aa, West Nile virus
SSIGKAFATTL

SEQ ID NO: 149413 - protein, 11 aa, West Nile virus
SIGKAFTTTLR

SEQ ID NO: 149414 - protein, 11 aa, West Nile virus
IGKAFTTTLRG

SEQ ID NO: 149415 - protein, 11 aa, West Nile virus
GKAFTTTLRGA

SEQ ID NO: 149416 - protein, 11 aa, West Nile virus
KAFTTTLRGAQ

SEQ ID NO: 149417 - protein, 11 aa, West Nile virus
AFTTTLRGAQR

SEQ ID NO: 149418 - protein, 11 aa, West Nile virus
FTTTLRGAQRL

SEQ ID NO: 149419 - protein, 11 aa, West Nile virus
TTTLRGAQRLA

SEQ ID NO: 149420 - protein, 11 aa, West Nile virus
TTLRGAQRLAA

SEQ ID NO: 149421 - protein, 11 aa, West Nile virus
TLRGAQRLAAL

SEQ ID NO: 149422 - protein, 11 aa, West Nile virus
LRGAQRLAALG

SEQ ID NO: 149423 - protein, 11 aa, West Nile virus
RGAQRLAALGD

SEQ ID NO: 149424 - protein, 11 aa, West Nile virus
GAQRLVSLGDT

SEQ ID NO: 149425 - protein, 11 aa, West Nile virus
AQRLVSLGDTA

SEQ ID NO: 149426 - protein, 11 aa, West Nile virus
QRLVSLGDTAW

SEQ ID NO: 149427 - protein, 11 aa, West Nile virus
RLVSLGDTAWD

SEQ ID NO: 149428 - protein, 11 aa, West Nile virus
LVSLGDTAWDF

SEQ ID NO: 149429 - protein, 11 aa, West Nile virus
VSLGDTAWDFG

SEQ ID NO: 149430 - protein, 11 aa, West Nile virus
SLGDTAWDFGS

SEQ ID NO: 149431 - protein, 11 aa, West Nile virus
LGDTAWDFGSI

SEQ ID NO: 149432 - protein, 11 aa, West Nile virus
GDTAWDFGSIG

SEQ ID NO: 149433 - protein, 11 aa, West Nile virus
DTAWDFGSIGG

SEQ ID NO: 149434 - protein, 11 aa, West Nile virus
TAWDFGSIGGV

SEQ ID NO: 149435 - protein, 11 aa, West Nile virus
AWDFGSIGGVF

SEQ ID NO: 149436 - protein, 11 aa, West Nile virus
WDFGSIGGVFT

SEQ ID NO: 149437 - protein, 11 aa, West Nile virus
DFGSIGGVFTS

SEQ ID NO: 149438 - protein, 11 aa, West Nile virus
FGSIGGVFTSV

SEQ ID NO: 149439 - protein, 11 aa, West Nile virus
GSIGGVFTSVG

SEQ ID NO: 149440 - protein, 11 aa, West Nile virus
SIGGVFTSVGK

SEQ ID NO: 149441 - protein, 11 aa, West Nile virus
IGGVFTSVGKA

SEQ ID NO: 149442 - protein, 11 aa, West Nile virus
GGVFTSVGKAI

SEQ ID NO: 149443 - protein, 11 aa, West Nile virus
GVFTSVGKAIH

SEQ ID NO: 149444 - protein, 11 aa, West Nile virus
VFTSVGKAIHQ

SEQ ID NO: 149445 - protein, 11 aa, West Nile virus
FTSVGKAIHQV

SEQ ID NO: 149446 - protein, 11 aa, West Nile virus
TSVGKAIHQVF

SEQ ID NO: 149447 - protein, 11 aa, West Nile virus
SVGKAIHQVFG

SEQ ID NO: 149448 - protein, 11 aa, West Nile virus
VGKAIHQVFGG

SEQ ID NO: 149449 - protein, 11 aa, West Nile virus
GKAIHQVFGGA

SEQ ID NO: 149450 - protein, 11 aa, West Nile virus
KAIHQVFGGAF

SEQ ID NO: 149451 - protein, 11 aa, West Nile virus
AIHQVFGGAFR

SEQ ID NO: 149452 - protein, 11 aa, West Nile virus
IHQVFGGAFRS

SEQ ID NO: 149453 - protein, 11 aa, West Nile virus
HQLFGGAFRSL

SEQ ID NO: 149454 - protein, 11 aa, West Nile virus
QLFGGAFRSLF

SEQ ID NO: 149455 - protein, 11 aa, West Nile virus
LFGGAFRSLFG

SEQ ID NO: 149456 - protein, 11 aa, West Nile virus
FGGAFRLLFGG

SEQ ID NO: 149457 - protein, 11 aa, West Nile virus
GGAFRLLFGGM

SEQ ID NO: 149458 - protein, 11 aa, West Nile virus
GAFRLLFGGMS

SEQ ID NO: 149459 - protein, 11 aa, West Nile virus
AFRLLFGGMSW

SEQ ID NO: 149460 - protein, 11 aa, West Nile virus
FRLLFGGMSWI

SEQ ID NO: 149461 - protein, 11 aa, West Nile virus
RLLFGGMSWIT

SEQ ID NO: 149462 - protein, 11 aa, West Nile virus
LLFGGMSWITQ

SEQ ID NO: 149463 - protein, 11 aa, West Nile virus
LMGALLVWMGI

SEQ ID NO: 149464 - protein, 11 aa, West Nile virus
MGALLVWMGIN

SEQ ID NO: 149465 - protein, 11 aa, West Nile virus
GALLLWMGINS

SEQ ID NO: 149466 - protein, 11 aa, West Nile virus
ALLLWMGINSR

SEQ ID NO: 149467 - protein, 11 aa, West Nile virus
LLLWMGINSRD

SEQ ID NO: 149468 - protein, 11 aa, West Nile virus
LLWMGINSRDR

SEQ ID NO: 149469 - protein, 11 aa, West Nile virus
LWMGINSRDRS

SEQ ID NO: 149470 - protein, 11 aa, West Nile virus
WMGINSRDRSI

SEQ ID NO: 149471 - protein, 11 aa, West Nile virus
MGINSRDRSIA

SEQ ID NO: 149472 - protein, 11 aa, West Nile virus
ARDRSIAMTFL

SEQ ID NO: 149473 - protein, 11 aa, West Nile virus
RDRSIAMTFLA

SEQ ID NO: 149474 - protein, 11 aa, West Nile virus
DRSIAMTFLAV

SEQ ID NO: 149475 - protein, 11 aa, West Nile virus
RSIAMTFLAVG

SEQ ID NO: 149476 - protein, 11 aa, West Nile virus
SIAMTFLAVGG

SEQ ID NO: 149477 - protein, 11 aa, West Nile virus
IAMTFLAVGGV

SEQ ID NO: 149478 - protein, 11 aa, West Nile virus
AMTFLAVGGVL

SEQ ID NO: 149479 - protein, 11 aa, West Nile virus
MTFLAVGGVLL

SEQ ID NO: 149480 - protein, 11 aa, West Nile virus
TFLAVGGILLF

SEQ ID NO: 149481 - protein, 11 aa, West Nile virus
FLAIGGVLLFL

SEQ ID NO: 149482 - protein, 11 aa, West Nile virus
LAIGGVLLFLS

SEQ ID NO: 149483 - protein, 11 aa, West Nile virus
AVGGILLFLSA

SEQ ID NO: 149484 - protein, 11 aa, West Nile virus
VGGVLLFLSVS

SEQ ID NO: 149485 - protein, 11 aa, West Nile virus
GGVLLFLSVSV

SEQ ID NO: 149486 - protein, 11 aa, West Nile virus
GVLLFLSVSVH

SEQ ID NO: 149487 - protein, 11 aa, West Nile virus
VLLFLSINVHA

SEQ ID NO: 149488 - protein, 11 aa, West Nile virus
LLFLSINVHAD

SEQ ID NO: 149489 - protein, 11 aa, West Nile virus
LFLSANVHADT

SEQ ID NO: 149490 - protein, 11 aa, West Nile virus
FLSVSVHADTG

SEQ ID NO: 149491 - protein, 11 aa, West Nile virus
LSVSVHADTGC

SEQ ID NO: 149492 - protein, 11 aa, West Nile virus
SANVHADTGCA

SEQ ID NO: 149493 - protein, 11 aa, West Nile virus
INVHADTGCAI

SEQ ID NO: 149494 - protein, 11 aa, West Nile virus
NVHADTGCAIN

SEQ ID NO: 149495 - protein, 11 aa, West Nile virus
VHADTGCAIDL

SEQ ID NO: 149496 - protein, 11 aa, West Nile virus
HADTGCAIDIG

SEQ ID NO: 149497 - protein, 11 aa, West Nile virus
ADTGCAIDIGR

SEQ ID NO: 149498 - protein, 11 aa, West Nile virus
DTGCAIDIGRQ

SEQ ID NO: 149499 - protein, 11 aa, West Nile virus
TGCAIDIGRQE

SEQ ID NO: 149500 - protein, 11 aa, West Nile virus
GCAIDIGRQEL

SEQ ID NO: 149501 - protein, 11 aa, West Nile virus
CAIDIGRQELR

SEQ ID NO: 149502 - protein, 11 aa, West Nile virus
AIDIGRQELRC

SEQ ID NO: 149503 - protein, 11 aa, West Nile virus
IDIGRQELRCG

SEQ ID NO: 149504 - protein, 11 aa, West Nile virus
GRQELRCGSGV

SEQ ID NO: 149505 - protein, 11 aa, West Nile virus
ELRCGNGVFIH

SEQ ID NO: 149506 - protein, 11 aa, West Nile virus
LRCGNGVFIHN

SEQ ID NO: 149507 - protein, 11 aa, West Nile virus
RCGNGVFIHND

SEQ ID NO: 149508 - protein, 11 aa, West Nile virus
CGSGVFIYNDV

SEQ ID NO: 149509 - protein, 11 aa, West Nile virus
GSGVFIHNDVK

SEQ ID NO: 149510 - protein, 11 aa, West Nile virus
NGVFIHNDVEA

SEQ ID NO: 149511 - protein, 11 aa, West Nile virus
GVFIHNDVKAW

SEQ ID NO: 149512 - protein, 11 aa, West Nile virus
NDVEAWVDRYR

SEQ ID NO: 149513 - protein, 11 aa, West Nile virus
DRYKFYPETPQ

SEQ ID NO: 149514 - protein, 11 aa, West Nile virus
RYKFYPETPQG

SEQ ID NO: 149515 - protein, 11 aa, West Nile virus
YKFYPETPQGL

SEQ ID NO: 149516 - protein, 11 aa, West Nile virus
KFYPETPQGLA

SEQ ID NO: 149517 - protein, 11 aa, West Nile virus
HPETPQGLAKI

SEQ ID NO: 149518 - protein, 11 aa, West Nile virus
PETPQGLARII

SEQ ID NO: 149519 - protein, 11 aa, West Nile virus
ETPQGLAKIIH

SEQ ID NO: 149520 - protein, 11 aa, West Nile virus
TPQGLAKIIHN

SEQ ID NO: 149521 - protein, 11 aa, West Nile virus
PQGLAKIIHNA

SEQ ID NO: 149522 - protein, 11 aa, West Nile virus
QGLAKIIHNAH

SEQ ID NO: 149523 - protein, 11 aa, West Nile virus
EGVCGVRSVSR

SEQ ID NO: 149524 - protein, 11 aa, West Nile virus
GVCGVRSVSRL

SEQ ID NO: 149525 - protein, 11 aa, West Nile virus
VCGVRSVSRLE

SEQ ID NO: 149526 - protein, 11 aa, West Nile virus
CGVRSVSRLEH

SEQ ID NO: 149527 - protein, 11 aa, West Nile virus
GVRSVSRLEHQ

SEQ ID NO: 149528 - protein, 11 aa, West Nile virus
VRSVSRLEHQM

SEQ ID NO: 149529 - protein, 11 aa, West Nile virus
SVSRLEHQMWD

SEQ ID NO: 149530 - protein, 11 aa, West Nile virus
VSRLEHQMWES

SEQ ID NO: 149531 - protein, 11 aa, West Nile virus
SRLEHQMWESV

SEQ ID NO: 149532 - protein, 11 aa, West Nile virus
RLEHQMWESVK

SEQ ID NO: 149533 - protein, 11 aa, West Nile virus
LEHQMWESVKD

SEQ ID NO: 149534 - protein, 11 aa, West Nile virus
EHQMWESVKDE

SEQ ID NO: 149535 - protein, 11 aa, West Nile virus
HQMWESVKDEL

SEQ ID NO: 149536 - protein, 11 aa, West Nile virus
QMWESVKDELN

SEQ ID NO: 149537 - protein, 11 aa, West Nile virus
MWESVKDELNT

SEQ ID NO: 149538 - protein, 11 aa, West Nile virus
SVKDELNTLLK

SEQ ID NO: 149539 - protein, 11 aa, West Nile virus
IKDELNTLLKE

SEQ ID NO: 149540 - protein, 11 aa, West Nile virus
KDELNTLFREN

SEQ ID NO: 149541 - protein, 11 aa, West Nile virus
DELNTPLKENG

SEQ ID NO: 149542 - protein, 11 aa, West Nile virus
ELNTLLKENGI

SEQ ID NO: 149543 - protein, 11 aa, West Nile virus
LNTLLKENGID

SEQ ID NO: 149544 - protein, 11 aa, West Nile virus
NTLLKENGIDL

SEQ ID NO: 149545 - protein, 11 aa, West Nile virus
TLLKENGIDLS

SEQ ID NO: 149546 - protein, 11 aa, West Nile virus
LKENGVDLSIV

SEQ ID NO: 149547 - protein, 11 aa, West Nile virus
KENGVDLSIVV

SEQ ID NO: 149548 - protein, 11 aa, West Nile virus
ENGVDLSIVVE

SEQ ID NO: 149549 - protein, 11 aa, West Nile virus
NGVDLSIVVEK

SEQ ID NO: 149550 - protein, 11 aa, West Nile virus
GVDLSIVVEKQ

SEQ ID NO: 149551 - protein, 11 aa, West Nile virus
ATTEKLEMGWK

SEQ ID NO: 149552 - protein, 11 aa, West Nile virus
TTEKLEMGWKA

SEQ ID NO: 149553 - protein, 11 aa, West Nile virus
TEKLEMGWKAW

SEQ ID NO: 149554 - protein, 11 aa, West Nile virus
EKLEMGWKAWG

SEQ ID NO: 149555 - protein, 11 aa, West Nile virus
KLEMGWKAWGK

SEQ ID NO: 149556 - protein, 11 aa, West Nile virus
LEMGWKAWGKS

SEQ ID NO: 149557 - protein, 11 aa, West Nile virus
EMGWKAWGKSI

SEQ ID NO: 149558 - protein, 11 aa, West Nile virus
MGWKAWGKSII

SEQ ID NO: 149559 - protein, 11 aa, West Nile virus
GWKAWGKSIIF

SEQ ID NO: 149560 - protein, 11 aa, West Nile virus
WKAWGKSIIFA

SEQ ID NO: 149561 - protein, 11 aa, West Nile virus
KAWGKSIIFAP

SEQ ID NO: 149562 - protein, 11 aa, West Nile virus
AWGKSIIFAPE

SEQ ID NO: 149563 - protein, 11 aa, West Nile virus
WGKSIIFAPEL

SEQ ID NO: 149564 - protein, 11 aa, West Nile virus
GKSIIFAPELA

SEQ ID NO: 149565 - protein, 11 aa, West Nile virus
KSIIFAPELAN

SEQ ID NO: 149566 - protein, 11 aa, West Nile virus
FAPELANHTFV

SEQ ID NO: 149567 - protein, 11 aa, West Nile virus
APELANNTFVI

SEQ ID NO: 149568 - protein, 11 aa, West Nile virus
PELANNTFVID

SEQ ID NO: 149569 - protein, 11 aa, West Nile virus
ELANNTFVIDG

SEQ ID NO: 149570 - protein, 11 aa, West Nile virus
ANNTFVIDGPE

SEQ ID NO: 149571 - protein, 11 aa, West Nile virus
NNTFVIDGPET

SEQ ID NO: 149572 - protein, 11 aa, West Nile virus
TFVIDGPETEE

SEQ ID NO: 149573 - protein, 11 aa, West Nile virus
FVIDGPETEEC

SEQ ID NO: 149574 - protein, 11 aa, West Nile virus
VIDGPETEECP

SEQ ID NO: 149575 - protein, 11 aa, West Nile virus
NRAWNSMEVED

SEQ ID NO: 149576 - protein, 11 aa, West Nile virus
RAWNSMEVEDF

SEQ ID NO: 149577 - protein, 11 aa, West Nile virus
AWNSMEVEDFG

SEQ ID NO: 149578 - protein, 11 aa, West Nile virus
WNSMEVEDFGF

SEQ ID NO: 149579 - protein, 11 aa, West Nile virus
NSMEVEDFGFG

SEQ ID NO: 149580 - protein, 11 aa, West Nile virus
SMEVEDFGFGL

SEQ ID NO: 149581 - protein, 11 aa, West Nile virus
MEVEDFGFGLT

SEQ ID NO: 149582 - protein, 11 aa, West Nile virus
DFGFGLTSTRI

SEQ ID NO: 149583 - protein, 11 aa, West Nile virus
FGFGLTSTRIF

SEQ ID NO: 149584 - protein, 11 aa, West Nile virus
GFGLTSTRMFM

SEQ ID NO: 149585 - protein, 11 aa, West Nile virus
FGLTSTRMFLR

SEQ ID NO: 149586 - protein, 11 aa, West Nile virus
NTTECDTKIIG

SEQ ID NO: 149587 - protein, 11 aa, West Nile virus
TTECDTKIIGT

SEQ ID NO: 149588 - protein, 11 aa, West Nile virus
TECDTKIIGTA

SEQ ID NO: 149589 - protein, 11 aa, West Nile virus
ECDTKIIGTAV

SEQ ID NO: 149590 - protein, 11 aa, West Nile virus
CDTKIIGTAVK

SEQ ID NO: 149591 - protein, 11 aa, West Nile virus
DTKIIGTAVKN

SEQ ID NO: 149592 - protein, 11 aa, West Nile virus
TKIIGTAVKNN

SEQ ID NO: 149593 - protein, 11 aa, West Nile virus
KIIGTAVKNNM

SEQ ID NO: 149594 - protein, 11 aa, West Nile virus
IIGTAVKNNMA

SEQ ID NO: 149595 - protein, 11 aa, West Nile virus
IGTAVKNNMAV

SEQ ID NO: 149596 - protein, 11 aa, West Nile virus
GTAVKNNMAVH

SEQ ID NO: 149597 - protein, 11 aa, West Nile virus
TAVKNNMAVHS

SEQ ID NO: 149598 - protein, 11 aa, West Nile virus
AVKNNMAVHSD

SEQ ID NO: 149599 - protein, 11 aa, West Nile virus
VKNNMAVHSDL

SEQ ID NO: 149600 - protein, 11 aa, West Nile virus
KNNMAVHSDLS

SEQ ID NO: 149601 - protein, 11 aa, West Nile virus
NNMAVHSDLSY

SEQ ID NO: 149602 - protein, 11 aa, West Nile virus
NMAVHSDLSYW

SEQ ID NO: 149603 - protein, 11 aa, West Nile virus
MAVHSDLSYWI

SEQ ID NO: 149604 - protein, 11 aa, West Nile virus
AVHSDLSYWIE

SEQ ID NO: 149605 - protein, 11 aa, West Nile virus
VHSDLSYWIES

SEQ ID NO: 149606 - protein, 11 aa, West Nile virus
HSDLSYWIESG

SEQ ID NO: 149607 - protein, 11 aa, West Nile virus
SDLSYWIESGL

SEQ ID NO: 149608 - protein, 11 aa, West Nile virus
DLSYWIESGLN

SEQ ID NO: 149609 - protein, 11 aa, West Nile virus
FNDTWKLERAV

SEQ ID NO: 149610 - protein, 11 aa, West Nile virus
NETWKLERAVL

SEQ ID NO: 149611 - protein, 11 aa, West Nile virus
ETWKLERAVLG

SEQ ID NO: 149612 - protein, 11 aa, West Nile virus
TWPETHTLWGE

SEQ ID NO: 149613 - protein, 11 aa, West Nile virus
WPETHTLWGEG

SEQ ID NO: 149614 - protein, 11 aa, West Nile virus
PETHTLWGDGV

SEQ ID NO: 149615 - protein, 11 aa, West Nile virus
ETHTLWGDGVL

SEQ ID NO: 149616 - protein, 11 aa, West Nile virus
THTLWGDGVLE

SEQ ID NO: 149617 - protein, 11 aa, West Nile virus
HTLWGDGVLES

SEQ ID NO: 149618 - protein, 11 aa, West Nile virus
ESDLIIPITLA

SEQ ID NO: 149619 - protein, 11 aa, West Nile virus
SDLIIPITLAG

SEQ ID NO: 149620 - protein, 11 aa, West Nile virus
DLIIPITLAGP

SEQ ID NO: 149621 - protein, 11 aa, West Nile virus
LIIPITLAGPR

SEQ ID NO: 149622 - protein, 11 aa, West Nile virus
IIPITLAGPRS

SEQ ID NO: 149623 - protein, 11 aa, West Nile virus
IPITLAGPRSN

SEQ ID NO: 149624 - protein, 11 aa, West Nile virus
PITLAGPRSNH

SEQ ID NO: 149625 - protein, 11 aa, West Nile virus
ITLAGPRSNHN

SEQ ID NO: 149626 - protein, 11 aa, West Nile virus
TLAGLRSNHNR

SEQ ID NO: 149627 - protein, 11 aa, West Nile virus
LAGLRSNHNRR

SEQ ID NO: 149628 - protein, 11 aa, West Nile virus
AGLRSNHNRRP

SEQ ID NO: 149629 - protein, 11 aa, West Nile virus
GLRSNHNRRPG

SEQ ID NO: 149630 - protein, 11 aa, West Nile virus
LRSNHNRRPGY

SEQ ID NO: 149631 - protein, 11 aa, West Nile virus
KSNHNKRPGYK

SEQ ID NO: 149632 - protein, 11 aa, West Nile virus
SNHNRRPGYKM

SEQ ID NO: 149633 - protein, 11 aa, West Nile virus
NHNKRPGYKTQ

SEQ ID NO: 149634 - protein, 11 aa, West Nile virus
HNRRPGYKTQS

SEQ ID NO: 149635 - protein, 11 aa, West Nile virus
NRRPGYKTQSQ

SEQ ID NO: 149636 - protein, 11 aa, West Nile virus
RRPGYKTQSQG

SEQ ID NO: 149637 - protein, 11 aa, West Nile virus
RPGYKTQSQGP

SEQ ID NO: 149638 - protein, 11 aa, West Nile virus
PGYKTQSQGPW

SEQ ID NO: 149639 - protein, 11 aa, West Nile virus
GYKTQSQGPWD

SEQ ID NO: 149640 - protein, 11 aa, West Nile virus
YKTQSQGPWDE

SEQ ID NO: 149641 - protein, 11 aa, West Nile virus
KTQSQGPWDEG

SEQ ID NO: 149642 - protein, 11 aa, West Nile virus
TQSQGPWDEGR

SEQ ID NO: 149643 - protein, 11 aa, West Nile virus
QSQGPWDEGRV

SEQ ID NO: 149644 - protein, 11 aa, West Nile virus
SQGPWDEGRVE

SEQ ID NO: 149645 - protein, 11 aa, West Nile virus
QGPWDEGRVEL

SEQ ID NO: 149646 - protein, 11 aa, West Nile virus
GPWDEGRVELD

SEQ ID NO: 149647 - protein, 11 aa, West Nile virus
PWDEGRVELDF

SEQ ID NO: 149648 - protein, 11 aa, West Nile virus
WDEGRVELDFD

SEQ ID NO: 149649 - protein, 11 aa, West Nile virus
DEGRVELDFDY

SEQ ID NO: 149650 - protein, 11 aa, West Nile virus
EGRVELDFDYC

SEQ ID NO: 149651 - protein, 11 aa, West Nile virus
GRVELDFDYCP

SEQ ID NO: 149652 - protein, 11 aa, West Nile virus
RVELDFDYCPG

SEQ ID NO: 149653 - protein, 11 aa, West Nile virus
VELDFDYCPGT

SEQ ID NO: 149654 - protein, 11 aa, West Nile virus
ELDFDYCPGTT

SEQ ID NO: 149655 - protein, 11 aa, West Nile virus
LDFDYCPGTTV

SEQ ID NO: 149656 - protein, 11 aa, West Nile virus
FDYCPGTTVTI

SEQ ID NO: 149657 - protein, 11 aa, West Nile virus
DYCPGTTVTIS

SEQ ID NO: 149658 - protein, 11 aa, West Nile virus
CGHRGPAARTT

SEQ ID NO: 149659 - protein, 11 aa, West Nile virus
GHRGPAARTTT

SEQ ID NO: 149660 - protein, 11 aa, West Nile virus
HRGPAARTTTE

SEQ ID NO: 149661 - protein, 11 aa, West Nile virus
RGPAARTTTES

SEQ ID NO: 149662 - protein, 11 aa, West Nile virus
GPAARTTTESG

SEQ ID NO: 149663 - protein, 11 aa, West Nile virus
PAARTTTESGK

SEQ ID NO: 149664 - protein, 11 aa, West Nile virus
AARTTTESGKL

SEQ ID NO: 149665 - protein, 11 aa, West Nile virus
ARTTTESGKLI

SEQ ID NO: 149666 - protein, 11 aa, West Nile virus
RTTTESGKLIS

SEQ ID NO: 149667 - protein, 11 aa, West Nile virus
TTTESGKLISD

SEQ ID NO: 149668 - protein, 11 aa, West Nile virus
TTESGKLISDW

SEQ ID NO: 149669 - protein, 11 aa, West Nile virus
TESGKLISDWC

SEQ ID NO: 149670 - protein, 11 aa, West Nile virus
ESGKLISDWCC

SEQ ID NO: 149671 - protein, 11 aa, West Nile virus
SGKLISDWCCR

SEQ ID NO: 149672 - protein, 11 aa, West Nile virus
GKLISDWCCRS

SEQ ID NO: 149673 - protein, 11 aa, West Nile virus
KLISDWCCRSC

SEQ ID NO: 149674 - protein, 11 aa, West Nile virus
LISDWCCRSCT

SEQ ID NO: 149675 - protein, 11 aa, West Nile virus
ISDWCCRSCTL

SEQ ID NO: 149676 - protein, 11 aa, West Nile virus
SDWCCRSCTLP

SEQ ID NO: 149677 - protein, 11 aa, West Nile virus
CRSCTLPPLRF

SEQ ID NO: 149678 - protein, 11 aa, West Nile virus
RSCTLPPLRFQ

SEQ ID NO: 149679 - protein, 11 aa, West Nile virus
SCTLPPLRFQT

SEQ ID NO: 149680 - protein, 11 aa, West Nile virus
CTLPPLRFQTE

SEQ ID NO: 149681 - protein, 11 aa, West Nile virus
TENGCWYGMEI

SEQ ID NO: 149682 - protein, 11 aa, West Nile virus
ENGCWYGMEIR

SEQ ID NO: 149683 - protein, 11 aa, West Nile virus
NGCWYGMEIRP

SEQ ID NO: 149684 - protein, 11 aa, West Nile virus
GCWYGMEIRPT

SEQ ID NO: 149685 - protein, 11 aa, West Nile virus
CWYGMEIRPTR

SEQ ID NO: 149686 - protein, 11 aa, West Nile virus
WYGMEIRPTRH

SEQ ID NO: 149687 - protein, 11 aa, West Nile virus
YGMEIRPTRHD

SEQ ID NO: 149688 - protein, 11 aa, West Nile virus
GMEIRPTRHDE

SEQ ID NO: 149689 - protein, 11 aa, West Nile virus
MEIRPTRHDEK

SEQ ID NO: 149690 - protein, 11 aa, West Nile virus
EIRPTRHDEKT

SEQ ID NO: 149691 - protein, 11 aa, West Nile virus
IRPTRHDEKTL

SEQ ID NO: 149692 - protein, 11 aa, West Nile virus
RPTRHDEKTLV

SEQ ID NO: 149693 - protein, 11 aa, West Nile virus
PTRHDEKTLVQ

SEQ ID NO: 149694 - protein, 11 aa, West Nile virus
TRHDEKTLVQS

SEQ ID NO: 149695 - protein, 11 aa, West Nile virus
RHDEKTLVQSR

SEQ ID NO: 149696 - protein, 11 aa, West Nile virus
HDEKTLVQSRV

SEQ ID NO: 149697 - protein, 11 aa, West Nile virus
DEKTLVQSRVN

SEQ ID NO: 149698 - protein, 11 aa, West Nile virus
EKTLVQSRVNA

SEQ ID NO: 149699 - protein, 11 aa, West Nile virus
KTLVQSRVNAY

SEQ ID NO: 149700 - protein, 11 aa, West Nile virus
TLVQSRVNAYN

SEQ ID NO: 149701 - protein, 11 aa, West Nile virus
LVQSRVNAYNA

SEQ ID NO: 149702 - protein, 11 aa, West Nile virus
VQSRVNAYNAD

SEQ ID NO: 149703 - protein, 11 aa, West Nile virus
QSRVNAYNADM

SEQ ID NO: 149704 - protein, 11 aa, West Nile virus
SRVNAYNADMI

SEQ ID NO: 149705 - protein, 11 aa, West Nile virus
RVNAYNADMID

SEQ ID NO: 149706 - protein, 11 aa, West Nile virus
VTAYNADMIDP

SEQ ID NO: 149707 - protein, 11 aa, West Nile virus
TAYNADMIDPF

SEQ ID NO: 149708 - protein, 11 aa, West Nile virus
AYNAEMIDPFQ

SEQ ID NO: 149709 - protein, 11 aa, West Nile virus
HNADMIDPFQL

SEQ ID NO: 149710 - protein, 11 aa, West Nile virus
NAEMIDPFQLG

SEQ ID NO: 149711 - protein, 11 aa, West Nile virus
AEMIDPFQLGL

SEQ ID NO: 149712 - protein, 11 aa, West Nile virus
DMIDPFQLGLM

SEQ ID NO: 149713 - protein, 11 aa, West Nile virus
MIDPFQLGLMV

SEQ ID NO: 149714 - protein, 11 aa, West Nile virus
IDPFQLGLMVV

SEQ ID NO: 149715 - protein, 11 aa, West Nile virus
DPFQLGLMVVF

SEQ ID NO: 149716 - protein, 11 aa, West Nile virus
PFQLGLMVVFL

SEQ ID NO: 149717 - protein, 11 aa, West Nile virus
FQLGLMVVFLA

SEQ ID NO: 149718 - protein, 11 aa, West Nile virus
QLGLMVVFLAT

SEQ ID NO: 149719 - protein, 11 aa, West Nile virus
LGLMVVFLATQ

SEQ ID NO: 149720 - protein, 11 aa, West Nile virus
GLMVVFLATQE

SEQ ID NO: 149721 - protein, 11 aa, West Nile virus
LMVVFLATQEV

SEQ ID NO: 149722 - protein, 11 aa, West Nile virus
MVVFLATQEVL

SEQ ID NO: 149723 - protein, 11 aa, West Nile virus
VVVLATQEVLR

SEQ ID NO: 149724 - protein, 11 aa, West Nile virus
VFLATQEVLRR

SEQ ID NO: 149725 - protein, 11 aa, West Nile virus
FLVTQEVLRKR

SEQ ID NO: 149726 - protein, 11 aa, West Nile virus
LVTQEVLRKRW

SEQ ID NO: 149727 - protein, 11 aa, West Nile virus
ATKEVLRKRWT

SEQ ID NO: 149728 - protein, 11 aa, West Nile virus
TKEVLRKRWTA

SEQ ID NO: 149729 - protein, 11 aa, West Nile virus
KEVLRKRWTAK

SEQ ID NO: 149730 - protein, 11 aa, West Nile virus
LRKRWTAKISI

SEQ ID NO: 149731 - protein, 11 aa, West Nile virus
RKRWTAKISIP

SEQ ID NO: 149732 - protein, 11 aa, West Nile virus
KRWTAKISIPA

SEQ ID NO: 149733 - protein, 11 aa, West Nile virus
RWTAKISIPAI

SEQ ID NO: 149734 - protein, 11 aa, West Nile virus
PAIMLALLVLV

SEQ ID NO: 149735 - protein, 11 aa, West Nile virus
AIMLALLVLVF

SEQ ID NO: 149736 - protein, 11 aa, West Nile virus
IMLALLVLVFG

SEQ ID NO: 149737 - protein, 11 aa, West Nile virus
MLALLVLVFGG

SEQ ID NO: 149738 - protein, 11 aa, West Nile virus
LALLVLVFGGI

SEQ ID NO: 149739 - protein, 11 aa, West Nile virus
ALLTLVFGGVT

SEQ ID NO: 149740 - protein, 11 aa, West Nile virus
LLTLVFGGVTY

SEQ ID NO: 149741 - protein, 11 aa, West Nile virus
TLVFGGVTYTD

SEQ ID NO: 149742 - protein, 11 aa, West Nile virus
LVFGGVTYTDL

SEQ ID NO: 149743 - protein, 11 aa, West Nile virus
VFGGVTYTDLI

SEQ ID NO: 149744 - protein, 11 aa, West Nile virus
FGGVTYTDLIR

SEQ ID NO: 149745 - protein, 11 aa, West Nile virus
GGVTYTDLIRY

SEQ ID NO: 149746 - protein, 11 aa, West Nile virus
GVTYTDLIRYV

SEQ ID NO: 149747 - protein, 11 aa, West Nile virus
TYTDLIRYVIL

SEQ ID NO: 149748 - protein, 11 aa, West Nile virus
DLIRYVILVGA

SEQ ID NO: 149749 - protein, 11 aa, West Nile virus
LIRYVILVGAA

SEQ ID NO: 149750 - protein, 11 aa, West Nile virus
IRYVILVGAAF

SEQ ID NO: 149751 - protein, 11 aa, West Nile virus
RYVILAGAAFA

SEQ ID NO: 149752 - protein, 11 aa, West Nile virus
YVNLVGAAFAE

SEQ ID NO: 149753 - protein, 11 aa, West Nile virus
VILVGAAFAEA

SEQ ID NO: 149754 - protein, 11 aa, West Nile virus
ILVGAAFAEAN

SEQ ID NO: 149755 - protein, 11 aa, West Nile virus
LVGAAFAEANS

SEQ ID NO: 149756 - protein, 11 aa, West Nile virus
VGAAFAEANSG

SEQ ID NO: 149757 - protein, 11 aa, West Nile virus
GAAFAEANSGG

SEQ ID NO: 149758 - protein, 11 aa, West Nile virus
AAFAEANSGGD

SEQ ID NO: 149759 - protein, 11 aa, West Nile virus
AFAEANSGGDV

SEQ ID NO: 149760 - protein, 11 aa, West Nile virus
FAEANSGGDVV

SEQ ID NO: 149761 - protein, 11 aa, West Nile virus
AEANSGGDVVH

SEQ ID NO: 149762 - protein, 11 aa, West Nile virus
EANSGGDVVHL

SEQ ID NO: 149763 - protein, 11 aa, West Nile virus
ANSGGDVVHLA

SEQ ID NO: 149764 - protein, 11 aa, West Nile virus
VVHLALMATFR

SEQ ID NO: 149765 - protein, 11 aa, West Nile virus
VHLALMATFKV

SEQ ID NO: 149766 - protein, 11 aa, West Nile virus
HLALMATFKVQ

SEQ ID NO: 149767 - protein, 11 aa, West Nile virus
LALMATFKVQP

SEQ ID NO: 149768 - protein, 11 aa, West Nile virus
ALMATFKIQPA

SEQ ID NO: 149769 - protein, 11 aa, West Nile virus
LMATFKIQPAF

SEQ ID NO: 149770 - protein, 11 aa, West Nile virus
IQPVFLVASFL

SEQ ID NO: 149771 - protein, 11 aa, West Nile virus
QPVFLVASFLK

SEQ ID NO: 149772 - protein, 11 aa, West Nile virus
PVFLVASFLKA

SEQ ID NO: 149773 - protein, 11 aa, West Nile virus
VASFLKTRWTN

SEQ ID NO: 149774 - protein, 11 aa, West Nile virus
RWTNQESILLM

SEQ ID NO: 149775 - protein, 11 aa, West Nile virus
WTNQESILLML

SEQ ID NO: 149776 - protein, 11 aa, West Nile virus
TNQESILLMLA

SEQ ID NO: 149777 - protein, 11 aa, West Nile virus
NQESILLMLAA

SEQ ID NO: 149778 - protein, 11 aa, West Nile virus
QESILLMLAAA

SEQ ID NO: 149779 - protein, 11 aa, West Nile virus
ESILLMLAAAF

SEQ ID NO: 149780 - protein, 11 aa, West Nile virus
SILLMLAAAFF

SEQ ID NO: 149781 - protein, 11 aa, West Nile virus
ILLMLAAAFFQ

SEQ ID NO: 149782 - protein, 11 aa, West Nile virus
LLMLAAAFFQM

SEQ ID NO: 149783 - protein, 11 aa, West Nile virus
LMLAAAFFQMA

SEQ ID NO: 149784 - protein, 11 aa, West Nile virus
MLAAAFFQMAY

SEQ ID NO: 149785 - protein, 11 aa, West Nile virus
LAAAFFQMAYY

SEQ ID NO: 149786 - protein, 11 aa, West Nile virus
AAAFFQMAYYD

SEQ ID NO: 149787 - protein, 11 aa, West Nile virus
AAFFQMAYYDA

SEQ ID NO: 149788 - protein, 11 aa, West Nile virus
PDVLNSLSVAW

SEQ ID NO: 149789 - protein, 11 aa, West Nile virus
DVLNSLSVAWM

SEQ ID NO: 149790 - protein, 11 aa, West Nile virus
VLNSLSVAWMI

SEQ ID NO: 149791 - protein, 11 aa, West Nile virus
LNSLSVAWMIL

SEQ ID NO: 149792 - protein, 11 aa, West Nile virus
NSLSVAWMILR

SEQ ID NO: 149793 - protein, 11 aa, West Nile virus
SLSVAWMILRA

SEQ ID NO: 149794 - protein, 11 aa, West Nile virus
LSVAWMILRAI

SEQ ID NO: 149795 - protein, 11 aa, West Nile virus
SVAWMILRAIS

SEQ ID NO: 149796 - protein, 11 aa, West Nile virus
VAWMILRAISF

SEQ ID NO: 149797 - protein, 11 aa, West Nile virus
AWMILRAISFT

SEQ ID NO: 149798 - protein, 11 aa, West Nile virus
FTNTSNVVVPL

SEQ ID NO: 149799 - protein, 11 aa, West Nile virus
TNTSNVVVPLL

SEQ ID NO: 149800 - protein, 11 aa, West Nile virus
NTSNVVVPLLA

SEQ ID NO: 149801 - protein, 11 aa, West Nile virus
TSNVATPLLAL

SEQ ID NO: 149802 - protein, 11 aa, West Nile virus
SNVATPLLALL

SEQ ID NO: 149803 - protein, 11 aa, West Nile virus
NVATPLLALLT

SEQ ID NO: 149804 - protein, 11 aa, West Nile virus
VATPLLALLTP

SEQ ID NO: 149805 - protein, 11 aa, West Nile virus
ATPLLALLTPG

SEQ ID NO: 149806 - protein, 11 aa, West Nile virus
TPLLALLTPGL

SEQ ID NO: 149807 - protein, 11 aa, West Nile virus
PLLALLTPGLK

SEQ ID NO: 149808 - protein, 11 aa, West Nile virus
LLALLTPGLKC

SEQ ID NO: 149809 - protein, 11 aa, West Nile virus
LALLTPGLKCL

SEQ ID NO: 149810 - protein, 11 aa, West Nile virus
ALLTPGLKCLN

SEQ ID NO: 149811 - protein, 11 aa, West Nile virus
LLTPGLKCLNL

SEQ ID NO: 149812 - protein, 11 aa, West Nile virus
LTPGLKCLNLD

SEQ ID NO: 149813 - protein, 11 aa, West Nile virus
TPGLKCLNLDV

SEQ ID NO: 149814 - protein, 11 aa, West Nile virus
PGLKCLNLDVY

SEQ ID NO: 149815 - protein, 11 aa, West Nile virus
GLKCLNLDVYR

SEQ ID NO: 149816 - protein, 11 aa, West Nile virus
LKCLNLDVYRI

SEQ ID NO: 149817 - protein, 11 aa, West Nile virus
KCLNLDVYRIL

SEQ ID NO: 149818 - protein, 11 aa, West Nile virus
CLHLDIYRILL

SEQ ID NO: 149819 - protein, 11 aa, West Nile virus
LHLDIYRILLL

SEQ ID NO: 149820 - protein, 11 aa, West Nile virus
HLDIYRILLLM

SEQ ID NO: 149821 - protein, 11 aa, West Nile virus
LDIYRILLLMV

SEQ ID NO: 149822 - protein, 11 aa, West Nile virus
DIYRILLLMVG

SEQ ID NO: 149823 - protein, 11 aa, West Nile virus
YRILLLMVGVG

SEQ ID NO: 149824 - protein, 11 aa, West Nile virus
RILLLMVGVGS

SEQ ID NO: 149825 - protein, 11 aa, West Nile virus
ILLLMVGVGSL

SEQ ID NO: 149826 - protein, 11 aa, West Nile virus
LLLMVGVGSLI

SEQ ID NO: 149827 - protein, 11 aa, West Nile virus
LLMVGVGSLIK

SEQ ID NO: 149828 - protein, 11 aa, West Nile virus
LMVGVGSLIKE

SEQ ID NO: 149829 - protein, 11 aa, West Nile virus
EKRSSAAKKKG

SEQ ID NO: 149830 - protein, 11 aa, West Nile virus
KRSSAAKKKGA

SEQ ID NO: 149831 - protein, 11 aa, West Nile virus
RSSAAKKKGAC

SEQ ID NO: 149832 - protein, 11 aa, West Nile virus
SSAAKKKGACL

SEQ ID NO: 149833 - protein, 11 aa, West Nile virus
SAAKKKGACLI

SEQ ID NO: 149834 - protein, 11 aa, West Nile virus
AAKKKGACLIC

SEQ ID NO: 149835 - protein, 11 aa, West Nile virus
AKKKGACLICL

SEQ ID NO: 149836 - protein, 11 aa, West Nile virus
KKKGACLICLA

SEQ ID NO: 149837 - protein, 11 aa, West Nile virus
KKGACLICLAL

SEQ ID NO: 149838 - protein, 11 aa, West Nile virus
KGACLICLALA

SEQ ID NO: 149839 - protein, 11 aa, West Nile virus
GACLICLALAS

SEQ ID NO: 149840 - protein, 11 aa, West Nile virus
ACLICLALAST

SEQ ID NO: 149841 - protein, 11 aa, West Nile virus
CLICLALASTG

SEQ ID NO: 149842 - protein, 11 aa, West Nile virus
FNPMILAAGLM

SEQ ID NO: 149843 - protein, 11 aa, West Nile virus
LAAGLITCDPN

SEQ ID NO: 149844 - protein, 11 aa, West Nile virus
AAGLITCDPNR

SEQ ID NO: 149845 - protein, 11 aa, West Nile virus
AGLITCDPNRK

SEQ ID NO: 149846 - protein, 11 aa, West Nile virus
GLITCDPNRKR

SEQ ID NO: 149847 - protein, 11 aa, West Nile virus
LITCDPNRKRG

SEQ ID NO: 149848 - protein, 11 aa, West Nile virus
ITCDPNRKRGW

SEQ ID NO: 149849 - protein, 11 aa, West Nile virus
TCDPNRKRGWP

SEQ ID NO: 149850 - protein, 11 aa, West Nile virus
AIVGGLAELDV

SEQ ID NO: 149851 - protein, 11 aa, West Nile virus
IVGGLAELDVD

SEQ ID NO: 149852 - protein, 11 aa, West Nile virus
VGGLAELDIDT

SEQ ID NO: 149853 - protein, 11 aa, West Nile virus
GGLAELDMDSM

SEQ ID NO: 149854 - protein, 11 aa, West Nile virus
GLAELDIDTMA

SEQ ID NO: 149855 - protein, 11 aa, West Nile virus
LAELDVDSMAI

SEQ ID NO: 149856 - protein, 11 aa, West Nile virus
AELDMDSMAIP

SEQ ID NO: 149857 - protein, 11 aa, West Nile virus
ELDVDSMAIPM

SEQ ID NO: 149858 - protein, 11 aa, West Nile virus
LDMDSMAIPMT

SEQ ID NO: 149859 - protein, 11 aa, West Nile virus
DIDSMAVPMTI

SEQ ID NO: 149860 - protein, 11 aa, West Nile virus
IDSMAVPMTIA

SEQ ID NO: 149861 - protein, 11 aa, West Nile virus
DSMAVPMTIAG

SEQ ID NO: 149862 - protein, 11 aa, West Nile virus
SMAVPMTIAGL

SEQ ID NO: 149863 - protein, 11 aa, West Nile virus
IPMTIAGLMFV

SEQ ID NO: 149864 - protein, 11 aa, West Nile virus
PMTIAGLMFVA

SEQ ID NO: 149865 - protein, 11 aa, West Nile virus
MTIAGLMFVAF

SEQ ID NO: 149866 - protein, 11 aa, West Nile virus
TIAGLMFVAFV

SEQ ID NO: 149867 - protein, 11 aa, West Nile virus
IAGLMFVAFVI

SEQ ID NO: 149868 - protein, 11 aa, West Nile virus
AGLMFVAFVIS

SEQ ID NO: 149869 - protein, 11 aa, West Nile virus
GLMFVAFVISG

SEQ ID NO: 149870 - protein, 11 aa, West Nile virus
LMFVAFVISGK

SEQ ID NO: 149871 - protein, 11 aa, West Nile virus
MFVAFVISGKS

SEQ ID NO: 149872 - protein, 11 aa, West Nile virus
FVAFVISGKST

SEQ ID NO: 149873 - protein, 11 aa, West Nile virus
VAFVISGKSTD

SEQ ID NO: 149874 - protein, 11 aa, West Nile virus
AYVITGRSTDM

SEQ ID NO: 149875 - protein, 11 aa, West Nile virus
YVITGRSTDMW

SEQ ID NO: 149876 - protein, 11 aa, West Nile virus
VITGRSTDMWI

SEQ ID NO: 149877 - protein, 11 aa, West Nile virus
ITGRSTDMWIE

SEQ ID NO: 149878 - protein, 11 aa, West Nile virus
TGRSTDMWIER

SEQ ID NO: 149879 - protein, 11 aa, West Nile virus
GRSTDMWIERT

SEQ ID NO: 149880 - protein, 11 aa, West Nile virus
RSTDMWIERTA

SEQ ID NO: 149881 - protein, 11 aa, West Nile virus
STDMWIERVAD

SEQ ID NO: 149882 - protein, 11 aa, West Nile virus
TDMWIERTANI

SEQ ID NO: 149883 - protein, 11 aa, West Nile virus
DMWIERTADIT

SEQ ID NO: 149884 - protein, 11 aa, West Nile virus
MWIERTADITW

SEQ ID NO: 149885 - protein, 11 aa, West Nile virus
WIERTADITWE

SEQ ID NO: 149886 - protein, 11 aa, West Nile virus
IERTADITWES

SEQ ID NO: 149887 - protein, 11 aa, West Nile virus
ERTADITWESD

SEQ ID NO: 149888 - protein, 11 aa, West Nile virus
ADITWESDAEI

SEQ ID NO: 149889 - protein, 11 aa, West Nile virus
DITWESDAEIT

SEQ ID NO: 149890 - protein, 11 aa, West Nile virus
ITWESDAEITG

SEQ ID NO: 149891 - protein, 11 aa, West Nile virus
WESDAEITGTS

SEQ ID NO: 149892 - protein, 11 aa, West Nile virus
ESDAEITGTSD

SEQ ID NO: 149893 - protein, 11 aa, West Nile virus
SDAEITGTSDR

SEQ ID NO: 149894 - protein, 11 aa, West Nile virus
DAEITGTSDRV

SEQ ID NO: 149895 - protein, 11 aa, West Nile virus
AEITGTSDRVD

SEQ ID NO: 149896 - protein, 11 aa, West Nile virus
EITGTSDRVDV

SEQ ID NO: 149897 - protein, 11 aa, West Nile virus
ITGTSDRVDVK

SEQ ID NO: 149898 - protein, 11 aa, West Nile virus
TGTSDRVDVKL

SEQ ID NO: 149899 - protein, 11 aa, West Nile virus
GTSDRVDVKLD

SEQ ID NO: 149900 - protein, 11 aa, West Nile virus
TSDRVDVKLDD

SEQ ID NO: 149901 - protein, 11 aa, West Nile virus
SDRVDVKLDDD

SEQ ID NO: 149902 - protein, 11 aa, West Nile virus
DRVDVKLDDDG

SEQ ID NO: 149903 - protein, 11 aa, West Nile virus
RVDVKLDDDGN

SEQ ID NO: 149904 - protein, 11 aa, West Nile virus
VDVKLDDDGNF

SEQ ID NO: 149905 - protein, 11 aa, West Nile virus
DVKLDDDGNFQ

SEQ ID NO: 149906 - protein, 11 aa, West Nile virus
VKLDDDGNFQL

SEQ ID NO: 149907 - protein, 11 aa, West Nile virus
KLDDDGNFQLM

SEQ ID NO: 149908 - protein, 11 aa, West Nile virus
LDDDGNFQLIN

SEQ ID NO: 149909 - protein, 11 aa, West Nile virus
DDDGNFQLIND

SEQ ID NO: 149910 - protein, 11 aa, West Nile virus
DDGNFQLINDP

SEQ ID NO: 149911 - protein, 11 aa, West Nile virus
DGNFQLINDPG

SEQ ID NO: 149912 - protein, 11 aa, West Nile virus
GNFQLINDPGA

SEQ ID NO: 149913 - protein, 11 aa, West Nile virus
NFQLINDPGAP

SEQ ID NO: 149914 - protein, 11 aa, West Nile virus
FQLINDPGAPW

SEQ ID NO: 149915 - protein, 11 aa, West Nile virus
QLINDPGAPWK

SEQ ID NO: 149916 - protein, 11 aa, West Nile virus
LINDPGAPWKI

SEQ ID NO: 149917 - protein, 11 aa, West Nile virus
INDPGAPWKIW

SEQ ID NO: 149918 - protein, 11 aa, West Nile virus
NDPGAPWKIWI

SEQ ID NO: 149919 - protein, 11 aa, West Nile virus
DPGAPWKIWIL

SEQ ID NO: 149920 - protein, 11 aa, West Nile virus
PGAPWKIWILR

SEQ ID NO: 149921 - protein, 11 aa, West Nile virus
GAPWKIWILRM

SEQ ID NO: 149922 - protein, 11 aa, West Nile virus
MACLAISAYTP

SEQ ID NO: 149923 - protein, 11 aa, West Nile virus
ACLAISAYTPW

SEQ ID NO: 149924 - protein, 11 aa, West Nile virus
CLAVSAYTPWA

SEQ ID NO: 149925 - protein, 11 aa, West Nile virus
LAVSAYTPWAI

SEQ ID NO: 149926 - protein, 11 aa, West Nile virus
AVSAYTPWAIL

SEQ ID NO: 149927 - protein, 11 aa, West Nile virus
VSAYTPWAILP

SEQ ID NO: 149928 - protein, 11 aa, West Nile virus
AYTPWAVLPSV

SEQ ID NO: 149929 - protein, 11 aa, West Nile virus
YTPWAILPSVI

SEQ ID NO: 149930 - protein, 11 aa, West Nile virus
TPWAILPSVIG

SEQ ID NO: 149931 - protein, 11 aa, West Nile virus
PWAILPSVIGF

SEQ ID NO: 149932 - protein, 11 aa, West Nile virus
WAILPSVIGFW

SEQ ID NO: 149933 - protein, 11 aa, West Nile virus
AILPSVIGFWI

SEQ ID NO: 149934 - protein, 11 aa, West Nile virus
ILPSVIGFWIT

SEQ ID NO: 149935 - protein, 11 aa, West Nile virus
LPSVIGFWITL

SEQ ID NO: 149936 - protein, 11 aa, West Nile virus
PSVIGFWITLQ

SEQ ID NO: 149937 - protein, 11 aa, West Nile virus
SVIGFWITLQY

SEQ ID NO: 149938 - protein, 11 aa, West Nile virus
VIGFWITLQYT

SEQ ID NO: 149939 - protein, 11 aa, West Nile virus
IGFWITLQYTK

SEQ ID NO: 149940 - protein, 11 aa, West Nile virus
GGVLWDTPSPR

SEQ ID NO: 149941 - protein, 11 aa, West Nile virus
GVLWDTPSPRE

SEQ ID NO: 149942 - protein, 11 aa, West Nile virus
VLWDTPSPREY

SEQ ID NO: 149943 - protein, 11 aa, West Nile virus
LWDTPSPREYK

SEQ ID NO: 149944 - protein, 11 aa, West Nile virus
EYKRGDTTTGV

SEQ ID NO: 149945 - protein, 11 aa, West Nile virus
YKRGDTTTGVY

SEQ ID NO: 149946 - protein, 11 aa, West Nile virus
KRGDTTTGVYR

SEQ ID NO: 149947 - protein, 11 aa, West Nile virus
RGDTTTGVYRI

SEQ ID NO: 149948 - protein, 11 aa, West Nile virus
TGVYRIMTRGI

SEQ ID NO: 149949 - protein, 11 aa, West Nile virus
GVYRIMTRGIL

SEQ ID NO: 149950 - protein, 11 aa, West Nile virus
VYRIMTRGILG

SEQ ID NO: 149951 - protein, 11 aa, West Nile virus
YRIMTRGILGS

SEQ ID NO: 149952 - protein, 11 aa, West Nile virus
RIMTRGILGSY

SEQ ID NO: 149953 - protein, 11 aa, West Nile virus
IMTRGILGSYQ

SEQ ID NO: 149954 - protein, 11 aa, West Nile virus
MTRGILGSYQA

SEQ ID NO: 149955 - protein, 11 aa, West Nile virus
TRGILGSYQAG

SEQ ID NO: 149956 - protein, 11 aa, West Nile virus
RGILGSYQAGV

SEQ ID NO: 149957 - protein, 11 aa, West Nile virus
GILGSYQAGVG

SEQ ID NO: 149958 - protein, 11 aa, West Nile virus
ILGSYQAGVGV

SEQ ID NO: 149959 - protein, 11 aa, West Nile virus
LGSYQAGVGVM

SEQ ID NO: 149960 - protein, 11 aa, West Nile virus
GSYQAGVGVMV

SEQ ID NO: 149961 - protein, 11 aa, West Nile virus
SYQAGVGVMVE

SEQ ID NO: 149962 - protein, 11 aa, West Nile virus
YQAGVGVMVEG

SEQ ID NO: 149963 - protein, 11 aa, West Nile virus
QAGVGVMVEGV

SEQ ID NO: 149964 - protein, 11 aa, West Nile virus
AGVGVMVEGVF

SEQ ID NO: 149965 - protein, 11 aa, West Nile virus
GVGVMVEGVFH

SEQ ID NO: 149966 - protein, 11 aa, West Nile virus
VGVMVEGVFHT

SEQ ID NO: 149967 - protein, 11 aa, West Nile virus
TTKGAALMSGT

SEQ ID NO: 149968 - protein, 11 aa, West Nile virus
TKGAALMSGTG

SEQ ID NO: 149969 - protein, 11 aa, West Nile virus
KGAALMSGTGR

SEQ ID NO: 149970 - protein, 11 aa, West Nile virus
GAALMSGTGRL

SEQ ID NO: 149971 - protein, 11 aa, West Nile virus
AALMSGTGRLD

SEQ ID NO: 149972 - protein, 11 aa, West Nile virus
ALMSGTGRLDP

SEQ ID NO: 149973 - protein, 11 aa, West Nile virus
LMSGTGRLDPY

SEQ ID NO: 149974 - protein, 11 aa, West Nile virus
MSGTGRLDPYW

SEQ ID NO: 149975 - protein, 11 aa, West Nile virus
SGTGRLDPYWG

SEQ ID NO: 149976 - protein, 11 aa, West Nile virus
GTGRLDPYWGS

SEQ ID NO: 149977 - protein, 11 aa, West Nile virus
TGRLDPYWGSV

SEQ ID NO: 149978 - protein, 11 aa, West Nile virus
GRLDPYWGSVR

SEQ ID NO: 149979 - protein, 11 aa, West Nile virus
RLDPYWGSVRE

SEQ ID NO: 149980 - protein, 11 aa, West Nile virus
LDPYWGSVRED

SEQ ID NO: 149981 - protein, 11 aa, West Nile virus
DPYWGSVREDR

SEQ ID NO: 149982 - protein, 11 aa, West Nile virus
PYWGSVREDRL

SEQ ID NO: 149983 - protein, 11 aa, West Nile virus
YWGSVREDRLC

SEQ ID NO: 149984 - protein, 11 aa, West Nile virus
WGSVREDRLCY

SEQ ID NO: 149985 - protein, 11 aa, West Nile virus
GSVREDRLCYG

SEQ ID NO: 149986 - protein, 11 aa, West Nile virus
SVREDRLCYGG

SEQ ID NO: 149987 - protein, 11 aa, West Nile virus
VREDRLCYGGP

SEQ ID NO: 149988 - protein, 11 aa, West Nile virus
REDRLCYGGPW

SEQ ID NO: 149989 - protein, 11 aa, West Nile virus
LCYGGPWKLQR

SEQ ID NO: 149990 - protein, 11 aa, West Nile virus
CYGGPWKLQRK

SEQ ID NO: 149991 - protein, 11 aa, West Nile virus
YGGPWKLQRKW

SEQ ID NO: 149992 - protein, 11 aa, West Nile virus
GGPWKLQRKWN

SEQ ID NO: 149993 - protein, 11 aa, West Nile virus
GPWKLQRKWNG

SEQ ID NO: 149994 - protein, 11 aa, West Nile virus
PWKLQHKWNGH

SEQ ID NO: 149995 - protein, 11 aa, West Nile virus
WKLQHKWNGHD

SEQ ID NO: 149996 - protein, 11 aa, West Nile virus
KLQHKWNGHDE

SEQ ID NO: 149997 - protein, 11 aa, West Nile virus
LQHKWNGHDEV

SEQ ID NO: 149998 - protein, 11 aa, West Nile virus
QHKWNGHDEVQ

SEQ ID NO: 149999 - protein, 11 aa, West Nile virus
HKWNGHDEVQM

SEQ ID NO: 150000 - protein, 11 aa, West Nile virus
KWNGHDEVQMI

SEQ ID NO: 150001 - protein, 11 aa, West Nile virus
WNGHDEVQMIV

SEQ ID NO: 150002 - protein, 11 aa, West Nile virus
NGHDEVQMIVV

SEQ ID NO: 150003 - protein, 11 aa, West Nile virus
GHDEVQMIVVE

SEQ ID NO: 150004 - protein, 11 aa, West Nile virus
HDEVQMIVVEP

SEQ ID NO: 150005 - protein, 11 aa, West Nile virus
DEVQMIVAEPG

SEQ ID NO: 150006 - protein, 11 aa, West Nile virus
EVQMIVAEPGR

SEQ ID NO: 150007 - protein, 11 aa, West Nile virus
VQMIVAEPGRN

SEQ ID NO: 150008 - protein, 11 aa, West Nile virus
QMIVAEPGRNT

SEQ ID NO: 150009 - protein, 11 aa, West Nile virus
MIVAEPGRNTR

SEQ ID NO: 150010 - protein, 11 aa, West Nile virus
IVAEPGRNTRN

SEQ ID NO: 150011 - protein, 11 aa, West Nile virus
VAEPGRNTRNV

SEQ ID NO: 150012 - protein, 11 aa, West Nile virus
AEPGRNTRNVQ

SEQ ID NO: 150013 - protein, 11 aa, West Nile virus
EPGRNTRNVQT

SEQ ID NO: 150014 - protein, 11 aa, West Nile virus
PGRNTRNVQTK

SEQ ID NO: 150015 - protein, 11 aa, West Nile virus
GRNTRNVQTKP

SEQ ID NO: 150016 - protein, 11 aa, West Nile virus
RNTRNVQTKPG

SEQ ID NO: 150017 - protein, 11 aa, West Nile virus
NTRNVQTKPGV

SEQ ID NO: 150018 - protein, 11 aa, West Nile virus
TRNVQTKPGVF

SEQ ID NO: 150019 - protein, 11 aa, West Nile virus
RNVQTKPGVFK

SEQ ID NO: 150020 - protein, 11 aa, West Nile virus
QTKPGVFKTPD

SEQ ID NO: 150021 - protein, 11 aa, West Nile virus
TKPGVFKTPDG

SEQ ID NO: 150022 - protein, 11 aa, West Nile virus
KPGVFKTPDGE

SEQ ID NO: 150023 - protein, 11 aa, West Nile virus
PGVFKTPDGEI

SEQ ID NO: 150024 - protein, 11 aa, West Nile virus
GVFKTPDGEIG

SEQ ID NO: 150025 - protein, 11 aa, West Nile virus
VFKTPDGEIGA

SEQ ID NO: 150026 - protein, 11 aa, West Nile virus
FKTPDGEIGAV

SEQ ID NO: 150027 - protein, 11 aa, West Nile virus
KTPDGEIGAVT

SEQ ID NO: 150028 - protein, 11 aa, West Nile virus
TPDGEIGAVTL

SEQ ID NO: 150029 - protein, 11 aa, West Nile virus
PDGEIGAVTLD

SEQ ID NO: 150030 - protein, 11 aa, West Nile virus
EGEIGAVTLDY

SEQ ID NO: 150031 - protein, 11 aa, West Nile virus
GEIGAVTLDYP

SEQ ID NO: 150032 - protein, 11 aa, West Nile virus
EIGAVTLDYPT

SEQ ID NO: 150033 - protein, 11 aa, West Nile virus
IGAVTLDYPTG

SEQ ID NO: 150034 - protein, 11 aa, West Nile virus
GAVTLDYPTGT

SEQ ID NO: 150035 - protein, 11 aa, West Nile virus
AVTLDYPTGTS

SEQ ID NO: 150036 - protein, 11 aa, West Nile virus
VTLDYPTGTSG

SEQ ID NO: 150037 - protein, 11 aa, West Nile virus
TLDYPTGTSGS

SEQ ID NO: 150038 - protein, 11 aa, West Nile virus
LDYPTGTSGSP

SEQ ID NO: 150039 - protein, 11 aa, West Nile virus
DYPTGTSGSPI

SEQ ID NO: 150040 - protein, 11 aa, West Nile virus
YPTGTSGSPIV

SEQ ID NO: 150041 - protein, 11 aa, West Nile virus
TGTSGSPIVDR

SEQ ID NO: 150042 - protein, 11 aa, West Nile virus
GTSGSPIVDRN

SEQ ID NO: 150043 - protein, 11 aa, West Nile virus
TSGSPIVDRNG

SEQ ID NO: 150044 - protein, 11 aa, West Nile virus
SGSPIVDRNGD

SEQ ID NO: 150045 - protein, 11 aa, West Nile virus
GSPIVDRNGDV

SEQ ID NO: 150046 - protein, 11 aa, West Nile virus
SPIVDRNGDVI

SEQ ID NO: 150047 - protein, 11 aa, West Nile virus
PIVDRNGDVIG

SEQ ID NO: 150048 - protein, 11 aa, West Nile virus
IVDRNGDVIGL

SEQ ID NO: 150049 - protein, 11 aa, West Nile virus
VDRNGDVIGLY

SEQ ID NO: 150050 - protein, 11 aa, West Nile virus
DRNGDVIGLYG

SEQ ID NO: 150051 - protein, 11 aa, West Nile virus
RNGDVIGLYGN

SEQ ID NO: 150052 - protein, 11 aa, West Nile virus
SGDVIGLYGNG

SEQ ID NO: 150053 - protein, 11 aa, West Nile virus
GLYGNGVIMPS

SEQ ID NO: 150054 - protein, 11 aa, West Nile virus
LYGNGVIMPSG

SEQ ID NO: 150055 - protein, 11 aa, West Nile virus
YGNGVIMPNGA

SEQ ID NO: 150056 - protein, 11 aa, West Nile virus
GNGVIMPNGAY

SEQ ID NO: 150057 - protein, 11 aa, West Nile virus
NGVIMPNGAYI

SEQ ID NO: 150058 - protein, 11 aa, West Nile virus
GVIMPNGAYIS

SEQ ID NO: 150059 - protein, 11 aa, West Nile virus
VIMPNGAYISA

SEQ ID NO: 150060 - protein, 11 aa, West Nile virus
IMPNGAYISAI

SEQ ID NO: 150061 - protein, 11 aa, West Nile virus
MPNGAYISAIV

SEQ ID NO: 150062 - protein, 11 aa, West Nile virus
PNGAYISAIVQ

SEQ ID NO: 150063 - protein, 11 aa, West Nile virus
NGAYISAIVQG

SEQ ID NO: 150064 - protein, 11 aa, West Nile virus
GAYISAIVQGE

SEQ ID NO: 150065 - protein, 11 aa, West Nile virus
AYISAIVQGER

SEQ ID NO: 150066 - protein, 11 aa, West Nile virus
ISAIVQGERME

SEQ ID NO: 150067 - protein, 11 aa, West Nile virus
SAIVQGERMEE

SEQ ID NO: 150068 - protein, 11 aa, West Nile virus
AIVQGERMEEP

SEQ ID NO: 150069 - protein, 11 aa, West Nile virus
IVQGERMEEPA

SEQ ID NO: 150070 - protein, 11 aa, West Nile virus
VQGERMEEPAP

SEQ ID NO: 150071 - protein, 11 aa, West Nile virus
QGERMEEPAPA

SEQ ID NO: 150072 - protein, 11 aa, West Nile virus
GERMEEPAPAG

SEQ ID NO: 150073 - protein, 11 aa, West Nile virus
ERMEEPAPAGF

SEQ ID NO: 150074 - protein, 11 aa, West Nile virus
GFEPDMLRKKQ

SEQ ID NO: 150075 - protein, 11 aa, West Nile virus
FEPDMLRKKQI

SEQ ID NO: 150076 - protein, 11 aa, West Nile virus
PDMLRKKQITV

SEQ ID NO: 150077 - protein, 11 aa, West Nile virus
DMLRKKQITVL

SEQ ID NO: 150078 - protein, 11 aa, West Nile virus
MLRKKQISVLD

SEQ ID NO: 150079 - protein, 11 aa, West Nile virus
LRKKKITVLDL

SEQ ID NO: 150080 - protein, 11 aa, West Nile virus
KKKQITVLDLH

SEQ ID NO: 150081 - protein, 11 aa, West Nile virus
KKQISVLDLHP

SEQ ID NO: 150082 - protein, 11 aa, West Nile virus
KQISVLDLHPG

SEQ ID NO: 150083 - protein, 11 aa, West Nile virus
QITVLDLHPDA

SEQ ID NO: 150084 - protein, 11 aa, West Nile virus
ISVLDLHPGAG

SEQ ID NO: 150085 - protein, 11 aa, West Nile virus
TVLDLHPDAGK

SEQ ID NO: 150086 - protein, 11 aa, West Nile virus
DLHPGAGKTRK

SEQ ID NO: 150087 - protein, 11 aa, West Nile virus
LHPGAGKTRKI

SEQ ID NO: 150088 - protein, 11 aa, West Nile virus
HPGAGKTRKIL

SEQ ID NO: 150089 - protein, 11 aa, West Nile virus
PGAGKTRKILP

SEQ ID NO: 150090 - protein, 11 aa, West Nile virus
GAGKTRKILPQ

SEQ ID NO: 150091 - protein, 11 aa, West Nile virus
AGKTRKILPQI

SEQ ID NO: 150092 - protein, 11 aa, West Nile virus
GKTRKILPQII

SEQ ID NO: 150093 - protein, 11 aa, West Nile virus
KTRKILPQIIK

SEQ ID NO: 150094 - protein, 11 aa, West Nile virus
TRKILPQIIKE

SEQ ID NO: 150095 - protein, 11 aa, West Nile virus
RKILPQIIKEA

SEQ ID NO: 150096 - protein, 11 aa, West Nile virus
KILPQIIKEAI

SEQ ID NO: 150097 - protein, 11 aa, West Nile virus
ILPQIIREAIN

SEQ ID NO: 150098 - protein, 11 aa, West Nile virus
LPQIIKEAINK

SEQ ID NO: 150099 - protein, 11 aa, West Nile virus
PQIIKEAINKR

SEQ ID NO: 150100 - protein, 11 aa, West Nile virus
QIIKEAINKRL

SEQ ID NO: 150101 - protein, 11 aa, West Nile virus
IIKEAINKRLR

SEQ ID NO: 150102 - protein, 11 aa, West Nile virus
IKEAINKRLRT

SEQ ID NO: 150103 - protein, 11 aa, West Nile virus
KEAINKRLRTA

SEQ ID NO: 150104 - protein, 11 aa, West Nile virus
NKRLRTAVLAP

SEQ ID NO: 150105 - protein, 11 aa, West Nile virus
KRLRTAVLAPT

SEQ ID NO: 150106 - protein, 11 aa, West Nile virus
RLRTAILAPTR

SEQ ID NO: 150107 - protein, 11 aa, West Nile virus
LRTAILAPTRV

SEQ ID NO: 150108 - protein, 11 aa, West Nile virus
RTAILAPTRVV

SEQ ID NO: 150109 - protein, 11 aa, West Nile virus
TAILAPTRVVA

SEQ ID NO: 150110 - protein, 11 aa, West Nile virus
AILAPTRVVAS

SEQ ID NO: 150111 - protein, 11 aa, West Nile virus
ILAPTRVVASE

SEQ ID NO: 150112 - protein, 11 aa, West Nile virus
LAPTRVVASEM

SEQ ID NO: 150113 - protein, 11 aa, West Nile virus
APTRVVAAEMS

SEQ ID NO: 150114 - protein, 11 aa, West Nile virus
PTRVVAAEMSE

SEQ ID NO: 150115 - protein, 11 aa, West Nile virus
TRVVAAEMSEA

SEQ ID NO: 150116 - protein, 11 aa, West Nile virus
RVVAAEMSEAL

SEQ ID NO: 150117 - protein, 11 aa, West Nile virus
VVAAEMSEALR

SEQ ID NO: 150118 - protein, 11 aa, West Nile virus
VAAEMSEALRG

SEQ ID NO: 150119 - protein, 11 aa, West Nile virus
AAEMSEALRGL

SEQ ID NO: 150120 - protein, 11 aa, West Nile virus
AEMSEALRGLP

SEQ ID NO: 150121 - protein, 11 aa, West Nile virus
EMSEALRGLPI

SEQ ID NO: 150122 - protein, 11 aa, West Nile virus
MSEALRGLPIR

SEQ ID NO: 150123 - protein, 11 aa, West Nile virus
SEALRGLPIRY

SEQ ID NO: 150124 - protein, 11 aa, West Nile virus
DALRGLPIRYQ

SEQ ID NO: 150125 - protein, 11 aa, West Nile virus
LPIRYQTSAVH

SEQ ID NO: 150126 - protein, 11 aa, West Nile virus
PIRYQTSAVHR

SEQ ID NO: 150127 - protein, 11 aa, West Nile virus
IRYQTSAVHRE

SEQ ID NO: 150128 - protein, 11 aa, West Nile virus
RYQTSAVHREH

SEQ ID NO: 150129 - protein, 11 aa, West Nile virus
REHSGNEIVDV

SEQ ID NO: 150130 - protein, 11 aa, West Nile virus
EHSGNEIVDVM

SEQ ID NO: 150131 - protein, 11 aa, West Nile virus
HSGNEIVDVMC

SEQ ID NO: 150132 - protein, 11 aa, West Nile virus
SGNEIVDVMCH

SEQ ID NO: 150133 - protein, 11 aa, West Nile virus
PHRVPNYNLFI

SEQ ID NO: 150134 - protein, 11 aa, West Nile virus
HRVPNYNLFIM

SEQ ID NO: 150135 - protein, 11 aa, West Nile virus
RVPNYNLFIMD

SEQ ID NO: 150136 - protein, 11 aa, West Nile virus
VPNYNLFIMDE

SEQ ID NO: 150137 - protein, 11 aa, West Nile virus
PNYNLFIMDEA

SEQ ID NO: 150138 - protein, 11 aa, West Nile virus
NYNLFIMDEAH

SEQ ID NO: 150139 - protein, 11 aa, West Nile virus
YNLFIMDEAHF

SEQ ID NO: 150140 - protein, 11 aa, West Nile virus
NLFIMDEAHFT

SEQ ID NO: 150141 - protein, 11 aa, West Nile virus
LFIMDEAHFTD

SEQ ID NO: 150142 - protein, 11 aa, West Nile virus
FIMDEAHFTDP

SEQ ID NO: 150143 - protein, 11 aa, West Nile virus
IMDEAHFTDPA

SEQ ID NO: 150144 - protein, 11 aa, West Nile virus
PASIAARGYIA

SEQ ID NO: 150145 - protein, 11 aa, West Nile virus
ASIAARGYIAT

SEQ ID NO: 150146 - protein, 11 aa, West Nile virus
SIAARGYIATK

SEQ ID NO: 150147 - protein, 11 aa, West Nile virus
IAARGYIATKV

SEQ ID NO: 150148 - protein, 11 aa, West Nile virus
AARGYIATKVE

SEQ ID NO: 150149 - protein, 11 aa, West Nile virus
ARGYIATKVEL

SEQ ID NO: 150150 - protein, 11 aa, West Nile virus
RGYIATKVELG

SEQ ID NO: 150151 - protein, 11 aa, West Nile virus
GYIATKVELGE

SEQ ID NO: 150152 - protein, 11 aa, West Nile virus
YIATKVELGEA

SEQ ID NO: 150153 - protein, 11 aa, West Nile virus
IATKVELGEAA

SEQ ID NO: 150154 - protein, 11 aa, West Nile virus
ATKVELGEAAA

SEQ ID NO: 150155 - protein, 11 aa, West Nile virus
TRVELGEAAAI

SEQ ID NO: 150156 - protein, 11 aa, West Nile virus
RVELGEAAAIF

SEQ ID NO: 150157 - protein, 11 aa, West Nile virus
IFMTATPPGSS

SEQ ID NO: 150158 - protein, 11 aa, West Nile virus
FMTATPPGSSD

SEQ ID NO: 150159 - protein, 11 aa, West Nile virus
MTATPPGTHDP

SEQ ID NO: 150160 - protein, 11 aa, West Nile virus
TATPPGTHDPF

SEQ ID NO: 150161 - protein, 11 aa, West Nile virus
ATPPGTHDPFP

SEQ ID NO: 150162 - protein, 11 aa, West Nile virus
TPPGTHDPFPE

SEQ ID NO: 150163 - protein, 11 aa, West Nile virus
PPGSSDPFPES

SEQ ID NO: 150164 - protein, 11 aa, West Nile virus
PGTSDPFPKSN

SEQ ID NO: 150165 - protein, 11 aa, West Nile virus
GTSDPFPESNA

SEQ ID NO: 150166 - protein, 11 aa, West Nile virus
TSDPFPESNAP

SEQ ID NO: 150167 - protein, 11 aa, West Nile virus
SDPFPESNAPI

SEQ ID NO: 150168 - protein, 11 aa, West Nile virus
DMQTEIPDRAW

SEQ ID NO: 150169 - protein, 11 aa, West Nile virus
MQTEIPDRAWN

SEQ ID NO: 150170 - protein, 11 aa, West Nile virus
QTEIPDRAWNT

SEQ ID NO: 150171 - protein, 11 aa, West Nile virus
TEIPDRAWNTG

SEQ ID NO: 150172 - protein, 11 aa, West Nile virus
EIPDRAWNTGY

SEQ ID NO: 150173 - protein, 11 aa, West Nile virus
IPDRAWNTGYE

SEQ ID NO: 150174 - protein, 11 aa, West Nile virus
PDRAWNTGYEW

SEQ ID NO: 150175 - protein, 11 aa, West Nile virus
DRAWNTGYEWI

SEQ ID NO: 150176 - protein, 11 aa, West Nile virus
RAWNTGYEWIT

SEQ ID NO: 150177 - protein, 11 aa, West Nile virus
AWNTGYEWITE

SEQ ID NO: 150178 - protein, 11 aa, West Nile virus
WNTGYEWITEY

SEQ ID NO: 150179 - protein, 11 aa, West Nile virus
NSGYEWITEYI

SEQ ID NO: 150180 - protein, 11 aa, West Nile virus
SGYEWITEYIG

SEQ ID NO: 150181 - protein, 11 aa, West Nile virus
GYEWITEYIGK

SEQ ID NO: 150182 - protein, 11 aa, West Nile virus
YEWITEYIGKT

SEQ ID NO: 150183 - protein, 11 aa, West Nile virus
EWITEYIGKTV

SEQ ID NO: 150184 - protein, 11 aa, West Nile virus
WITEYIGKTVW

SEQ ID NO: 150185 - protein, 11 aa, West Nile virus
ITEYIGKTVWF

SEQ ID NO: 150186 - protein, 11 aa, West Nile virus
TEYIGKTVWFV

SEQ ID NO: 150187 - protein, 11 aa, West Nile virus
EYIGKTVWFVP

SEQ ID NO: 150188 - protein, 11 aa, West Nile virus
YIGKTVWFVPS

SEQ ID NO: 150189 - protein, 11 aa, West Nile virus
IGKTVWFVPSV

SEQ ID NO: 150190 - protein, 11 aa, West Nile virus
GKTVWFVPSVR

SEQ ID NO: 150191 - protein, 11 aa, West Nile virus
KTVWFVPSVRM

SEQ ID NO: 150192 - protein, 11 aa, West Nile virus
TVWFVPSVRMG

SEQ ID NO: 150193 - protein, 11 aa, West Nile virus
VWFVPSVRMGN

SEQ ID NO: 150194 - protein, 11 aa, West Nile virus
WFVPSVRMGNE

SEQ ID NO: 150195 - protein, 11 aa, West Nile virus
FVPSVRMGNEM

SEQ ID NO: 150196 - protein, 11 aa, West Nile virus
VPSVRMGNEMA

SEQ ID NO: 150197 - protein, 11 aa, West Nile virus
PSVRMGNEMAQ

SEQ ID NO: 150198 - protein, 11 aa, West Nile virus
SVRMGNEMAQC

SEQ ID NO: 150199 - protein, 11 aa, West Nile virus
VRMGNEMAQCL

SEQ ID NO: 150200 - protein, 11 aa, West Nile virus
RMGNEMAQCLQ

SEQ ID NO: 150201 - protein, 11 aa, West Nile virus
MGNEMAQCLQR

SEQ ID NO: 150202 - protein, 11 aa, West Nile virus
GNEMAQCLQRA

SEQ ID NO: 150203 - protein, 11 aa, West Nile virus
NEMAQCLQRAG

SEQ ID NO: 150204 - protein, 11 aa, West Nile virus
EMAQCLQRAGK

SEQ ID NO: 150205 - protein, 11 aa, West Nile virus
MAQCLQRAGKK

SEQ ID NO: 150206 - protein, 11 aa, West Nile virus
AQCLQRAGKKV

SEQ ID NO: 150207 - protein, 11 aa, West Nile virus
LCLQRAGKKVI

SEQ ID NO: 150208 - protein, 11 aa, West Nile virus
CLQRAGKKVIQ

SEQ ID NO: 150209 - protein, 11 aa, West Nile virus
LQRAGKKVIQL

SEQ ID NO: 150210 - protein, 11 aa, West Nile virus
QRAGKKVIQLN

SEQ ID NO: 150211 - protein, 11 aa, West Nile virus
RAGKKVIQLNR

SEQ ID NO: 150212 - protein, 11 aa, West Nile virus
AGKKVIQLNRK

SEQ ID NO: 150213 - protein, 11 aa, West Nile virus
GKKVIQLNRKS

SEQ ID NO: 150214 - protein, 11 aa, West Nile virus
KKVIQLNRKSY

SEQ ID NO: 150215 - protein, 11 aa, West Nile virus
KVIQLNRKSYE

SEQ ID NO: 150216 - protein, 11 aa, West Nile virus
VIQLNRKSYET

SEQ ID NO: 150217 - protein, 11 aa, West Nile virus
IQLNRKSYETE

SEQ ID NO: 150218 - protein, 11 aa, West Nile virus
KCKNDDWDFVV

SEQ ID NO: 150219 - protein, 11 aa, West Nile virus
CKNDDWDFVVT

SEQ ID NO: 150220 - protein, 11 aa, West Nile virus
KNDDWDFVVTT

SEQ ID NO: 150221 - protein, 11 aa, West Nile virus
NDDWDFVVTTD

SEQ ID NO: 150222 - protein, 11 aa, West Nile virus
DDWDFVVTTDI

SEQ ID NO: 150223 - protein, 11 aa, West Nile virus
DWDFVVTTDIS

SEQ ID NO: 150224 - protein, 11 aa, West Nile virus
WDFVVTTDISE

SEQ ID NO: 150225 - protein, 11 aa, West Nile virus
DFVVTTDISEM

SEQ ID NO: 150226 - protein, 11 aa, West Nile virus
FVVTTDISEMG

SEQ ID NO: 150227 - protein, 11 aa, West Nile virus
VVTTDISEMGA

SEQ ID NO: 150228 - protein, 11 aa, West Nile virus
VTTDISEMGAN

SEQ ID NO: 150229 - protein, 11 aa, West Nile virus
TDISEMGANFR

SEQ ID NO: 150230 - protein, 11 aa, West Nile virus
DISEMGANFRA

SEQ ID NO: 150231 - protein, 11 aa, West Nile virus
ISEMGANFKAN

SEQ ID NO: 150232 - protein, 11 aa, West Nile virus
SEMGANFRASR

SEQ ID NO: 150233 - protein, 11 aa, West Nile virus
EMGANFKANRV

SEQ ID NO: 150234 - protein, 11 aa, West Nile virus
MGANFRASRVI

SEQ ID NO: 150235 - protein, 11 aa, West Nile virus
GANFRASRVID

SEQ ID NO: 150236 - protein, 11 aa, West Nile virus
ANFKANRVIDS

SEQ ID NO: 150237 - protein, 11 aa, West Nile virus
NFRASRVIDSR

SEQ ID NO: 150238 - protein, 11 aa, West Nile virus
FRASRVIDSRK

SEQ ID NO: 150239 - protein, 11 aa, West Nile virus
KANRVIDSRKS

SEQ ID NO: 150240 - protein, 11 aa, West Nile virus
ANRVIDSRKSV

SEQ ID NO: 150241 - protein, 11 aa, West Nile virus
NRVIDSRKSVK

SEQ ID NO: 150242 - protein, 11 aa, West Nile virus
IDSRKSVKPTS

SEQ ID NO: 150243 - protein, 11 aa, West Nile virus
DSRKSVKPIII

SEQ ID NO: 150244 - protein, 11 aa, West Nile virus
SRKSVKPTIIE

SEQ ID NO: 150245 - protein, 11 aa, West Nile virus
RKSVKPTIIEE

SEQ ID NO: 150246 - protein, 11 aa, West Nile virus
KSVKPTIIEEG

SEQ ID NO: 150247 - protein, 11 aa, West Nile virus
SVKPTIIEEGD

SEQ ID NO: 150248 - protein, 11 aa, West Nile virus
IEEGDGRVILG

SEQ ID NO: 150249 - protein, 11 aa, West Nile virus
EEGDGRVILGE

SEQ ID NO: 150250 - protein, 11 aa, West Nile virus
EGDGRVILGEP

SEQ ID NO: 150251 - protein, 11 aa, West Nile virus
GDGRVILGEPS

SEQ ID NO: 150252 - protein, 11 aa, West Nile virus
DGRVILGEPSA

SEQ ID NO: 150253 - protein, 11 aa, West Nile virus
GRVILGEPSAI

SEQ ID NO: 150254 - protein, 11 aa, West Nile virus
RVILGEPSAIT

SEQ ID NO: 150255 - protein, 11 aa, West Nile virus
VILGEPSAITA

SEQ ID NO: 150256 - protein, 11 aa, West Nile virus
ILGEPSAITAA

SEQ ID NO: 150257 - protein, 11 aa, West Nile virus
LGEPSAITAAS

SEQ ID NO: 150258 - protein, 11 aa, West Nile virus
GEPSAITAASA

SEQ ID NO: 150259 - protein, 11 aa, West Nile virus
EPSAITAASAA

SEQ ID NO: 150260 - protein, 11 aa, West Nile virus
PSAITAASAAQ

SEQ ID NO: 150261 - protein, 11 aa, West Nile virus
SAITAASAAQR

SEQ ID NO: 150262 - protein, 11 aa, West Nile virus
AITAASAAQRR

SEQ ID NO: 150263 - protein, 11 aa, West Nile virus
ITAASAAQRRG

SEQ ID NO: 150264 - protein, 11 aa, West Nile virus
AASAAQRRGRV

SEQ ID NO: 150265 - protein, 11 aa, West Nile virus
ASAAQRRGRVG

SEQ ID NO: 150266 - protein, 11 aa, West Nile virus
SAAQRRGRTGR

SEQ ID NO: 150267 - protein, 11 aa, West Nile virus
AAQRRGRVGRN

SEQ ID NO: 150268 - protein, 11 aa, West Nile virus
AQRRGRIGRNS

SEQ ID NO: 150269 - protein, 11 aa, West Nile virus
QRRGRIGRNSS

SEQ ID NO: 150270 - protein, 11 aa, West Nile virus
RRGRIGRNSSQ

SEQ ID NO: 150271 - protein, 11 aa, West Nile virus
RGRIGRNSSQV

SEQ ID NO: 150272 - protein, 11 aa, West Nile virus
GRIGRNSSQVG

SEQ ID NO: 150273 - protein, 11 aa, West Nile virus
RIGRNSSQVGD

SEQ ID NO: 150274 - protein, 11 aa, West Nile virus
IGRNSSQVGDE

SEQ ID NO: 150275 - protein, 11 aa, West Nile virus
GRNSSQVGDEY

SEQ ID NO: 150276 - protein, 11 aa, West Nile virus
RNSSQVGDEYC

SEQ ID NO: 150277 - protein, 11 aa, West Nile virus
NSSQVGDEYCY

SEQ ID NO: 150278 - protein, 11 aa, West Nile virus
SSQVGDEYCYG

SEQ ID NO: 150279 - protein, 11 aa, West Nile virus
SQAGDEYCYGG

SEQ ID NO: 150280 - protein, 11 aa, West Nile virus
GGHTNEDDSNC

SEQ ID NO: 150281 - protein, 11 aa, West Nile virus
GHTNEDDSNYA

SEQ ID NO: 150282 - protein, 11 aa, West Nile virus
HTNEDDSNYAH

SEQ ID NO: 150283 - protein, 11 aa, West Nile virus
TNEDDSNYAHW

SEQ ID NO: 150284 - protein, 11 aa, West Nile virus
NEDDSNCAHWT

SEQ ID NO: 150285 - protein, 11 aa, West Nile virus
EDDSNLAHWTE

SEQ ID NO: 150286 - protein, 11 aa, West Nile virus
DDSNCAHWTEA

SEQ ID NO: 150287 - protein, 11 aa, West Nile virus
DSNYAHWTEAR

SEQ ID NO: 150288 - protein, 11 aa, West Nile virus
SNYAHWTEARI

SEQ ID NO: 150289 - protein, 11 aa, West Nile virus
NYAHWTEARIM

SEQ ID NO: 150290 - protein, 11 aa, West Nile virus
CAHWTEARIML

SEQ ID NO: 150291 - protein, 11 aa, West Nile virus
RIMLDNINMPS

SEQ ID NO: 150292 - protein, 11 aa, West Nile virus
IMLDNINMPSG

SEQ ID NO: 150293 - protein, 11 aa, West Nile virus
MLDNINMPSGL

SEQ ID NO: 150294 - protein, 11 aa, West Nile virus
LDNINMPNGLV

SEQ ID NO: 150295 - protein, 11 aa, West Nile virus
DNINMPNGLVA

SEQ ID NO: 150296 - protein, 11 aa, West Nile virus
NINMPNGLVAQ

SEQ ID NO: 150297 - protein, 11 aa, West Nile virus
INMPNGLVAQL

SEQ ID NO: 150298 - protein, 11 aa, West Nile virus
NMPNGLVAQLY

SEQ ID NO: 150299 - protein, 11 aa, West Nile virus
MPNGLVAQLYQ

SEQ ID NO: 150300 - protein, 11 aa, West Nile virus
PNGLVAQLYQP

SEQ ID NO: 150301 - protein, 11 aa, West Nile virus
NGLVAQLYQPE

SEQ ID NO: 150302 - protein, 11 aa, West Nile virus
GLVAQLYQPER

SEQ ID NO: 150303 - protein, 11 aa, West Nile virus
LVAQLYQPERE

SEQ ID NO: 150304 - protein, 11 aa, West Nile virus
VAQLYQPEREK

SEQ ID NO: 150305 - protein, 11 aa, West Nile virus
AQLYQPEREKV

SEQ ID NO: 150306 - protein, 11 aa, West Nile virus
QLYQPEREKVY

SEQ ID NO: 150307 - protein, 11 aa, West Nile virus
LYQPEREKVYT

SEQ ID NO: 150308 - protein, 11 aa, West Nile virus
YQPEREKVHTM

SEQ ID NO: 150309 - protein, 11 aa, West Nile virus
QPEREKVHTMD

SEQ ID NO: 150310 - protein, 11 aa, West Nile virus
PEREKVCTMDG

SEQ ID NO: 150311 - protein, 11 aa, West Nile virus
EREKVCTMDGE

SEQ ID NO: 150312 - protein, 11 aa, West Nile virus
REKVCTMDGEY

SEQ ID NO: 150313 - protein, 11 aa, West Nile virus
EKVYTMDGEYK

SEQ ID NO: 150314 - protein, 11 aa, West Nile virus
KVYTMDGEYKL

SEQ ID NO: 150315 - protein, 11 aa, West Nile virus
VYTMDGEYKLR

SEQ ID NO: 150316 - protein, 11 aa, West Nile virus
YTMDGEYKLRG

SEQ ID NO: 150317 - protein, 11 aa, West Nile virus
TMDGEYKLRGE

SEQ ID NO: 150318 - protein, 11 aa, West Nile virus
MDGEYKLRGEE

SEQ ID NO: 150319 - protein, 11 aa, West Nile virus
DGEYKLRGEER

SEQ ID NO: 150320 - protein, 11 aa, West Nile virus
GEYKLRGEERK

SEQ ID NO: 150321 - protein, 11 aa, West Nile virus
EYKLRGEERKN

SEQ ID NO: 150322 - protein, 11 aa, West Nile virus
YKLRGEERKNF

SEQ ID NO: 150323 - protein, 11 aa, West Nile virus
KLRGEERKNFL

SEQ ID NO: 150324 - protein, 11 aa, West Nile virus
RGEERKNFLEF

SEQ ID NO: 150325 - protein, 11 aa, West Nile virus
GEERKNFLEFL

SEQ ID NO: 150326 - protein, 11 aa, West Nile virus
EERKNFLEFLR

SEQ ID NO: 150327 - protein, 11 aa, West Nile virus
ERKNFLEFLRT

SEQ ID NO: 150328 - protein, 11 aa, West Nile virus
RKNFLEFLRTA

SEQ ID NO: 150329 - protein, 11 aa, West Nile virus
KNFLEFLRTAD

SEQ ID NO: 150330 - protein, 11 aa, West Nile virus
NFLEFLRTADL

SEQ ID NO: 150331 - protein, 11 aa, West Nile virus
FLEFLRTADLP

SEQ ID NO: 150332 - protein, 11 aa, West Nile virus
LEFLRTADLPV

SEQ ID NO: 150333 - protein, 11 aa, West Nile virus
EFLRTADLPVW

SEQ ID NO: 150334 - protein, 11 aa, West Nile virus
FLRTADLPVWL

SEQ ID NO: 150335 - protein, 11 aa, West Nile virus
KTADLPVWLAY

SEQ ID NO: 150336 - protein, 11 aa, West Nile virus
TADLPVWLAYQ

SEQ ID NO: 150337 - protein, 11 aa, West Nile virus
ADLPVWLAYQV

SEQ ID NO: 150338 - protein, 11 aa, West Nile virus
DLPVWLAYQVA

SEQ ID NO: 150339 - protein, 11 aa, West Nile virus
LPVWLAYQVAA

SEQ ID NO: 150340 - protein, 11 aa, West Nile virus
PVWLAYQVAAA

SEQ ID NO: 150341 - protein, 11 aa, West Nile virus
VWLAYQVAAAG

SEQ ID NO: 150342 - protein, 11 aa, West Nile virus
WLAYKVAAAGI

SEQ ID NO: 150343 - protein, 11 aa, West Nile virus
KVAAAGISYHD

SEQ ID NO: 150344 - protein, 11 aa, West Nile virus
VAAAGISYHDR

SEQ ID NO: 150345 - protein, 11 aa, West Nile virus
AAAGISYHDRK

SEQ ID NO: 150346 - protein, 11 aa, West Nile virus
AAGISYHDRKW

SEQ ID NO: 150347 - protein, 11 aa, West Nile virus
AGISYHDRKWC

SEQ ID NO: 150348 - protein, 11 aa, West Nile virus
GISYHDRKWCF

SEQ ID NO: 150349 - protein, 11 aa, West Nile virus
ISYHDRKWCFD

SEQ ID NO: 150350 - protein, 11 aa, West Nile virus
SYHDRKWCFDG

SEQ ID NO: 150351 - protein, 11 aa, West Nile virus
YHDRKWCFDGP

SEQ ID NO: 150352 - protein, 11 aa, West Nile virus
HDRKWCFDGPR

SEQ ID NO: 150353 - protein, 11 aa, West Nile virus
DRKWCFDGPRT

SEQ ID NO: 150354 - protein, 11 aa, West Nile virus
RKWCFDGPRTN

SEQ ID NO: 150355 - protein, 11 aa, West Nile virus
KWCFDGPRTNT

SEQ ID NO: 150356 - protein, 11 aa, West Nile virus
WCFDGPRTNTV

SEQ ID NO: 150357 - protein, 11 aa, West Nile virus
CFDGPRTNTVL

SEQ ID NO: 150358 - protein, 11 aa, West Nile virus
FDGPRTNTVLE

SEQ ID NO: 150359 - protein, 11 aa, West Nile virus
DGPRTNTVLEE

SEQ ID NO: 150360 - protein, 11 aa, West Nile virus
GPRTNTVLEEN

SEQ ID NO: 150361 - protein, 11 aa, West Nile virus
PRTNTVLEENT

SEQ ID NO: 150362 - protein, 11 aa, West Nile virus
RTNTVLEENTE

SEQ ID NO: 150363 - protein, 11 aa, West Nile virus
TNTVLEENTEV

SEQ ID NO: 150364 - protein, 11 aa, West Nile virus
NTVLEENTEVE

SEQ ID NO: 150365 - protein, 11 aa, West Nile virus
TVLEENTEVEI

SEQ ID NO: 150366 - protein, 11 aa, West Nile virus
VLEENTEVEIV

SEQ ID NO: 150367 - protein, 11 aa, West Nile virus
LEENTEVEIVT

SEQ ID NO: 150368 - protein, 11 aa, West Nile virus
EENTEVEIVTK

SEQ ID NO: 150369 - protein, 11 aa, West Nile virus
ENTEVEIVTKM

SEQ ID NO: 150370 - protein, 11 aa, West Nile virus
NTEVEIVTKMG

SEQ ID NO: 150371 - protein, 11 aa, West Nile virus
TEVEIVTKMGE

SEQ ID NO: 150372 - protein, 11 aa, West Nile virus
EVEIVTKMGER

SEQ ID NO: 150373 - protein, 11 aa, West Nile virus
VEIVTKMGERK

SEQ ID NO: 150374 - protein, 11 aa, West Nile virus
EIVTKMGERKI

SEQ ID NO: 150375 - protein, 11 aa, West Nile virus
IVTKMGERKIL

SEQ ID NO: 150376 - protein, 11 aa, West Nile virus
VTKMGERKILR

SEQ ID NO: 150377 - protein, 11 aa, West Nile virus
TKMGERKILRP

SEQ ID NO: 150378 - protein, 11 aa, West Nile virus
KMGERKILRPR

SEQ ID NO: 150379 - protein, 11 aa, West Nile virus
MGERKILRPRW

SEQ ID NO: 150380 - protein, 11 aa, West Nile virus
GERKILRPRWA

SEQ ID NO: 150381 - protein, 11 aa, West Nile virus
ERKILRPRWAD

SEQ ID NO: 150382 - protein, 11 aa, West Nile virus
RKILRPRWADA

SEQ ID NO: 150383 - protein, 11 aa, West Nile virus
KILRPRWADAR

SEQ ID NO: 150384 - protein, 11 aa, West Nile virus
ILRPRWADARV

SEQ ID NO: 150385 - protein, 11 aa, West Nile virus
LRPRWADARVY

SEQ ID NO: 150386 - protein, 11 aa, West Nile virus
RPRWADARVYS

SEQ ID NO: 150387 - protein, 11 aa, West Nile virus
PRWADARVYSD

SEQ ID NO: 150388 - protein, 11 aa, West Nile virus
RWADARVYSDH

SEQ ID NO: 150389 - protein, 11 aa, West Nile virus
WADARVYSDHQ

SEQ ID NO: 150390 - protein, 11 aa, West Nile virus
ADARVYSDHQA

SEQ ID NO: 150391 - protein, 11 aa, West Nile virus
RVYSDHQALKS

SEQ ID NO: 150392 - protein, 11 aa, West Nile virus
VYSDHQALKSF

SEQ ID NO: 150393 - protein, 11 aa, West Nile virus
YSDHQALKSFK

SEQ ID NO: 150394 - protein, 11 aa, West Nile virus
SDHQALKSFKD

SEQ ID NO: 150395 - protein, 11 aa, West Nile virus
DHQALKSFKDF

SEQ ID NO: 150396 - protein, 11 aa, West Nile virus
HQALKSFKDFA

SEQ ID NO: 150397 - protein, 11 aa, West Nile virus
QALKSFKDFAS

SEQ ID NO: 150398 - protein, 11 aa, West Nile virus
ALKSFKDFASG

SEQ ID NO: 150399 - protein, 11 aa, West Nile virus
LKSFKDFASGK

SEQ ID NO: 150400 - protein, 11 aa, West Nile virus
KSFKDFASGKR

SEQ ID NO: 150401 - protein, 11 aa, West Nile virus
SFKDFASGKRS

SEQ ID NO: 150402 - protein, 11 aa, West Nile virus
FKDFAAGRRSQ

SEQ ID NO: 150403 - protein, 11 aa, West Nile virus
KDFAAGRRSQI

SEQ ID NO: 150404 - protein, 11 aa, West Nile virus
DFAAGRRSQIG

SEQ ID NO: 150405 - protein, 11 aa, West Nile virus
FAAGRRSQIGL

SEQ ID NO: 150406 - protein, 11 aa, West Nile virus
GKRSQIGLVEV

SEQ ID NO: 150407 - protein, 11 aa, West Nile virus
KRSQIGLVEVL

SEQ ID NO: 150408 - protein, 11 aa, West Nile virus
RSQIGLVEVLG

SEQ ID NO: 150409 - protein, 11 aa, West Nile virus
SQIGLVEVLGR

SEQ ID NO: 150410 - protein, 11 aa, West Nile virus
QIGLVEVLGRM

SEQ ID NO: 150411 - protein, 11 aa, West Nile virus
IGLVEVLGRMP

SEQ ID NO: 150412 - protein, 11 aa, West Nile virus
GLVEVLGRMPE

SEQ ID NO: 150413 - protein, 11 aa, West Nile virus
LVEVLGRMPEH

SEQ ID NO: 150414 - protein, 11 aa, West Nile virus
VEVLGRMPEHF

SEQ ID NO: 150415 - protein, 11 aa, West Nile virus
EVLGRMPEHFM

SEQ ID NO: 150416 - protein, 11 aa, West Nile virus
VLGRMPEHFMG

SEQ ID NO: 150417 - protein, 11 aa, West Nile virus
LGRMPEHFMGK

SEQ ID NO: 150418 - protein, 11 aa, West Nile virus
GRMPEHFMGKT

SEQ ID NO: 150419 - protein, 11 aa, West Nile virus
RMPEHFMGKTW

SEQ ID NO: 150420 - protein, 11 aa, West Nile virus
MPEHFVGKTWE

SEQ ID NO: 150421 - protein, 11 aa, West Nile virus
PEHFVGKTWEA

SEQ ID NO: 150422 - protein, 11 aa, West Nile virus
EHFVGKTWEAL

SEQ ID NO: 150423 - protein, 11 aa, West Nile virus
HFVGKTWEALD

SEQ ID NO: 150424 - protein, 11 aa, West Nile virus
FVGKTWEALDT

SEQ ID NO: 150425 - protein, 11 aa, West Nile virus
VGKTWEALDTM

SEQ ID NO: 150426 - protein, 11 aa, West Nile virus
VKTWEALDTMY

SEQ ID NO: 150427 - protein, 11 aa, West Nile virus
DTMYVVATAER

SEQ ID NO: 150428 - protein, 11 aa, West Nile virus
TMYVVATAERG

SEQ ID NO: 150429 - protein, 11 aa, West Nile virus
MYVVATAERGG

SEQ ID NO: 150430 - protein, 11 aa, West Nile virus
YVVATAEKGRR

SEQ ID NO: 150431 - protein, 11 aa, West Nile virus
VVATAERGGRA

SEQ ID NO: 150432 - protein, 11 aa, West Nile virus
VATAERGGRAH

SEQ ID NO: 150433 - protein, 11 aa, West Nile virus
ATAEKGRRAHR

SEQ ID NO: 150434 - protein, 11 aa, West Nile virus
TAEKGGRAHRT

SEQ ID NO: 150435 - protein, 11 aa, West Nile virus
AEKGGRAHRTA

SEQ ID NO: 150436 - protein, 11 aa, West Nile virus
EKGGRAHRTAL

SEQ ID NO: 150437 - protein, 11 aa, West Nile virus
KGGRAHRTALE

SEQ ID NO: 150438 - protein, 11 aa, West Nile virus
GGRAHRTALEE

SEQ ID NO: 150439 - protein, 11 aa, West Nile virus
GRAHRTALEEL

SEQ ID NO: 150440 - protein, 11 aa, West Nile virus
RAHRTALEELP

SEQ ID NO: 150441 - protein, 11 aa, West Nile virus
AHRTALEELPD

SEQ ID NO: 150442 - protein, 11 aa, West Nile virus
HRTALEELPDA

SEQ ID NO: 150443 - protein, 11 aa, West Nile virus
RTALEELPDAL

SEQ ID NO: 150444 - protein, 11 aa, West Nile virus
TALEELPDALQ

SEQ ID NO: 150445 - protein, 11 aa, West Nile virus
EELPDALQTIV

SEQ ID NO: 150446 - protein, 11 aa, West Nile virus
ELPDALQTIVL

SEQ ID NO: 150447 - protein, 11 aa, West Nile virus
LPDALQTIVLI

SEQ ID NO: 150448 - protein, 11 aa, West Nile virus
PDALQTIALIT

SEQ ID NO: 150449 - protein, 11 aa, West Nile virus
DALQTIALITL

SEQ ID NO: 150450 - protein, 11 aa, West Nile virus
ALQTIALITLL

SEQ ID NO: 150451 - protein, 11 aa, West Nile virus
LQTIALITLLS

SEQ ID NO: 150452 - protein, 11 aa, West Nile virus
QTIALITLLSV

SEQ ID NO: 150453 - protein, 11 aa, West Nile virus
TIALITLLSVM

SEQ ID NO: 150454 - protein, 11 aa, West Nile virus
VMSLGVFFLLM

SEQ ID NO: 150455 - protein, 11 aa, West Nile virus
MSLGVFFLLMQ

SEQ ID NO: 150456 - protein, 11 aa, West Nile virus
SLGVFFLLMQR

SEQ ID NO: 150457 - protein, 11 aa, West Nile virus
LGVFFLLMQRK

SEQ ID NO: 150458 - protein, 11 aa, West Nile virus
GVFCLLMQRKG

SEQ ID NO: 150459 - protein, 11 aa, West Nile virus
VFCLLMQRKGV

SEQ ID NO: 150460 - protein, 11 aa, West Nile virus
FCLLMQRKGVS

SEQ ID NO: 150461 - protein, 11 aa, West Nile virus
CLLMQRKGVSK

SEQ ID NO: 150462 - protein, 11 aa, West Nile virus
LLMQRKGVSKI

SEQ ID NO: 150463 - protein, 11 aa, West Nile virus
LMQRKGVSKIG

SEQ ID NO: 150464 - protein, 11 aa, West Nile virus
MQRKGVSKIGL

SEQ ID NO: 150465 - protein, 11 aa, West Nile virus
QRKGVSKIGLA

SEQ ID NO: 150466 - protein, 11 aa, West Nile virus
RKGVSKIGLAG

SEQ ID NO: 150467 - protein, 11 aa, West Nile virus
KGIGKIGLGGT

SEQ ID NO: 150468 - protein, 11 aa, West Nile virus
LGAATFFCWMA

SEQ ID NO: 150469 - protein, 11 aa, West Nile virus
GAATFFCWMAE

SEQ ID NO: 150470 - protein, 11 aa, West Nile virus
AATFFCWMAEV

SEQ ID NO: 150471 - protein, 11 aa, West Nile virus
ATFFCWMAEVS

SEQ ID NO: 150472 - protein, 11 aa, West Nile virus
TFFCWMAEVSG

SEQ ID NO: 150473 - protein, 11 aa, West Nile virus
FFCWMAEVSGT

SEQ ID NO: 150474 - protein, 11 aa, West Nile virus
FCWMAEVSGTK

SEQ ID NO: 150475 - protein, 11 aa, West Nile virus
CWMAEVSGTKI

SEQ ID NO: 150476 - protein, 11 aa, West Nile virus
WMAEVSGTKIA

SEQ ID NO: 150477 - protein, 11 aa, West Nile virus
MAEVSGTKIAG

SEQ ID NO: 150478 - protein, 11 aa, West Nile virus
AEVSGTKIAGM

SEQ ID NO: 150479 - protein, 11 aa, West Nile virus
EVSGTKIAGML

SEQ ID NO: 150480 - protein, 11 aa, West Nile virus
VSGTKIAGMLL

SEQ ID NO: 150481 - protein, 11 aa, West Nile virus
SGTKIAGMLLL

SEQ ID NO: 150482 - protein, 11 aa, West Nile virus
IAGMLLLSLLM

SEQ ID NO: 150483 - protein, 11 aa, West Nile virus
AGMLLLSLLMM

SEQ ID NO: 150484 - protein, 11 aa, West Nile virus
GMLLLSLLMMI

SEQ ID NO: 150485 - protein, 11 aa, West Nile virus
MLLLSLLMMIV

SEQ ID NO: 150486 - protein, 11 aa, West Nile virus
LLLSLLMMIVL

SEQ ID NO: 150487 - protein, 11 aa, West Nile virus
LLSLLMMIVLI

SEQ ID NO: 150488 - protein, 11 aa, West Nile virus
LSLLMMIVLIP

SEQ ID NO: 150489 - protein, 11 aa, West Nile virus
SLLMMIVLIPE

SEQ ID NO: 150490 - protein, 11 aa, West Nile virus
LLMMIVLIPEP

SEQ ID NO: 150491 - protein, 11 aa, West Nile virus
LMMIVLIPEPE

SEQ ID NO: 150492 - protein, 11 aa, West Nile virus
MMIVLIPEPEK

SEQ ID NO: 150493 - protein, 11 aa, West Nile virus
QRSQTDNQLAM

SEQ ID NO: 150494 - protein, 11 aa, West Nile virus
RSQTDNQLAMF

SEQ ID NO: 150495 - protein, 11 aa, West Nile virus
SQTDNQLAMFL

SEQ ID NO: 150496 - protein, 11 aa, West Nile virus
QTDNQLAMFLI

SEQ ID NO: 150497 - protein, 11 aa, West Nile virus
TDNQLAMFLIC

SEQ ID NO: 150498 - protein, 11 aa, West Nile virus
DNQLAMFLICV

SEQ ID NO: 150499 - protein, 11 aa, West Nile virus
NQLAVFLICVL

SEQ ID NO: 150500 - protein, 11 aa, West Nile virus
QLAVFLICVLT

SEQ ID NO: 150501 - protein, 11 aa, West Nile virus
LAVFLICVLTL

SEQ ID NO: 150502 - protein, 11 aa, West Nile virus
AVFLICVLTLV

SEQ ID NO: 150503 - protein, 11 aa, West Nile virus
TLVGAVAANEM

SEQ ID NO: 150504 - protein, 11 aa, West Nile virus
LVGAVAANEMG

SEQ ID NO: 150505 - protein, 11 aa, West Nile virus
VGAVAANEMGW

SEQ ID NO: 150506 - protein, 11 aa, West Nile virus
GAVAANEMGWL

SEQ ID NO: 150507 - protein, 11 aa, West Nile virus
TVAANEMGWLD

SEQ ID NO: 150508 - protein, 11 aa, West Nile virus
VAANEMGWLDR

SEQ ID NO: 150509 - protein, 11 aa, West Nile virus
AANEMGWLDRT

SEQ ID NO: 150510 - protein, 11 aa, West Nile virus
ANEMGWLDRTK

SEQ ID NO: 150511 - protein, 11 aa, West Nile virus
NEMGWLDKTKN

SEQ ID NO: 150512 - protein, 11 aa, West Nile virus
EMGWLDKTKND

SEQ ID NO: 150513 - protein, 11 aa, West Nile virus
MGWLDKTKNDI

SEQ ID NO: 150514 - protein, 11 aa, West Nile virus
ESFLLDLRPAT

SEQ ID NO: 150515 - protein, 11 aa, West Nile virus
SFLLDLRPATA

SEQ ID NO: 150516 - protein, 11 aa, West Nile virus
FLLDLKPATAW

SEQ ID NO: 150517 - protein, 11 aa, West Nile virus
LLDLKPATAWS

SEQ ID NO: 150518 - protein, 11 aa, West Nile virus
LDLKPATAWSL

SEQ ID NO: 150519 - protein, 11 aa, West Nile virus
DLKPATAWSLY

SEQ ID NO: 150520 - protein, 11 aa, West Nile virus
LKPATAWSLYA

SEQ ID NO: 150521 - protein, 11 aa, West Nile virus
KPATAWSLYAV

SEQ ID NO: 150522 - protein, 11 aa, West Nile virus
PATAWSLYAVS

SEQ ID NO: 150523 - protein, 11 aa, West Nile virus
ATAWSLYAVST

SEQ ID NO: 150524 - protein, 11 aa, West Nile virus
TAWSLYAVSTA

SEQ ID NO: 150525 - protein, 11 aa, West Nile virus
AWSLYAVSTAV

SEQ ID NO: 150526 - protein, 11 aa, West Nile virus
WSLYAVSTAVM

SEQ ID NO: 150527 - protein, 11 aa, West Nile virus
SLYAVSTAVMT

SEQ ID NO: 150528 - protein, 11 aa, West Nile virus
LYAVSTAVMTP

SEQ ID NO: 150529 - protein, 11 aa, West Nile virus
YAVSTAVMTPL

SEQ ID NO: 150530 - protein, 11 aa, West Nile virus
AVSTAVMTPLL

SEQ ID NO: 150531 - protein, 11 aa, West Nile virus
VSTAVMTPLLK

SEQ ID NO: 150532 - protein, 11 aa, West Nile virus
STAVMTPLLKH

SEQ ID NO: 150533 - protein, 11 aa, West Nile virus
TAVMTPLLKHV

SEQ ID NO: 150534 - protein, 11 aa, West Nile virus
AVMTPLLKHVI

SEQ ID NO: 150535 - protein, 11 aa, West Nile virus
VMTPLLKHVIT

SEQ ID NO: 150536 - protein, 11 aa, West Nile virus
MTPLLKHVITS

SEQ ID NO: 150537 - protein, 11 aa, West Nile virus
TPLLKHVITSD

SEQ ID NO: 150538 - protein, 11 aa, West Nile virus
PLLKHVITSDY

SEQ ID NO: 150539 - protein, 11 aa, West Nile virus
LLKHVITSDYI

SEQ ID NO: 150540 - protein, 11 aa, West Nile virus
LKHVITSDYIN

SEQ ID NO: 150541 - protein, 11 aa, West Nile virus
KHVITSDYINT

SEQ ID NO: 150542 - protein, 11 aa, West Nile virus
HVITSDYINTS

SEQ ID NO: 150543 - protein, 11 aa, West Nile virus
VITSDYINTSL

SEQ ID NO: 150544 - protein, 11 aa, West Nile virus
SLTSINVQAST

SEQ ID NO: 150545 - protein, 11 aa, West Nile virus
LTSINVQASTL

SEQ ID NO: 150546 - protein, 11 aa, West Nile virus
TSINVQASALY

SEQ ID NO: 150547 - protein, 11 aa, West Nile virus
SINVQASALYS

SEQ ID NO: 150548 - protein, 11 aa, West Nile virus
INVQASALYSL

SEQ ID NO: 150549 - protein, 11 aa, West Nile virus
NVQASALFTLS

SEQ ID NO: 150550 - protein, 11 aa, West Nile virus
VQASALFTLSR

SEQ ID NO: 150551 - protein, 11 aa, West Nile virus
QASALFTLSRG

SEQ ID NO: 150552 - protein, 11 aa, West Nile virus
ASALFTLSRGF

SEQ ID NO: 150553 - protein, 11 aa, West Nile virus
SALFTLSRGFP

SEQ ID NO: 150554 - protein, 11 aa, West Nile virus
ALFTLSRGFPF

SEQ ID NO: 150555 - protein, 11 aa, West Nile virus
LFTLSRGFPFV

SEQ ID NO: 150556 - protein, 11 aa, West Nile virus
FTLSRGFPFVD

SEQ ID NO: 150557 - protein, 11 aa, West Nile virus
TLSRGFPFVDV

SEQ ID NO: 150558 - protein, 11 aa, West Nile virus
LSRGFPFVDVG

SEQ ID NO: 150559 - protein, 11 aa, West Nile virus
SRGFPFVDVGV

SEQ ID NO: 150560 - protein, 11 aa, West Nile virus
RGFPFVDVGIS

SEQ ID NO: 150561 - protein, 11 aa, West Nile virus
GFPFVDVGISA

SEQ ID NO: 150562 - protein, 11 aa, West Nile virus
FPFVDVGISSL

SEQ ID NO: 150563 - protein, 11 aa, West Nile virus
PFVDVGISSLL

SEQ ID NO: 150564 - protein, 11 aa, West Nile virus
FVDVGISALLL

SEQ ID NO: 150565 - protein, 11 aa, West Nile virus
VDVGISALLLA

SEQ ID NO: 150566 - protein, 11 aa, West Nile virus
DVGVSALLLAV

SEQ ID NO: 150567 - protein, 11 aa, West Nile virus
VGVSALLLAVG

SEQ ID NO: 150568 - protein, 11 aa, West Nile virus
GVSALLLAVGC

SEQ ID NO: 150569 - protein, 11 aa, West Nile virus
VSALLLAVGCW

SEQ ID NO: 150570 - protein, 11 aa, West Nile virus
SALLLAVGCWG

SEQ ID NO: 150571 - protein, 11 aa, West Nile virus
ALLLAVGCWGQ

SEQ ID NO: 150572 - protein, 11 aa, West Nile virus
LLLAVGCWGQV

SEQ ID NO: 150573 - protein, 11 aa, West Nile virus
LLAVGCWGQVT

SEQ ID NO: 150574 - protein, 11 aa, West Nile virus
LAVGCWGQVTL

SEQ ID NO: 150575 - protein, 11 aa, West Nile virus
AVGCWGQVTLT

SEQ ID NO: 150576 - protein, 11 aa, West Nile virus
VGCWGQVTLTV

SEQ ID NO: 150577 - protein, 11 aa, West Nile virus
GCWGQVTLTVA

SEQ ID NO: 150578 - protein, 11 aa, West Nile virus
CWEQVTLTVTV

SEQ ID NO: 150579 - protein, 11 aa, West Nile virus
WGQVTLTVAVT

SEQ ID NO: 150580 - protein, 11 aa, West Nile virus
GQVTLTVTVTS

SEQ ID NO: 150581 - protein, 11 aa, West Nile virus
QVTLTVTVTAT

SEQ ID NO: 150582 - protein, 11 aa, West Nile virus
ALLFCHYAYMV

SEQ ID NO: 150583 - protein, 11 aa, West Nile virus
LLLCHYAYMVP

SEQ ID NO: 150584 - protein, 11 aa, West Nile virus
LLCHYAYMVPG

SEQ ID NO: 150585 - protein, 11 aa, West Nile virus
LCHYAYMVPGW

SEQ ID NO: 150586 - protein, 11 aa, West Nile virus
CHYAYMIPGWQ

SEQ ID NO: 150587 - protein, 11 aa, West Nile virus
HYAYMVPGGQA

SEQ ID NO: 150588 - protein, 11 aa, West Nile virus
YAYMIPGWQAE

SEQ ID NO: 150589 - protein, 11 aa, West Nile virus
AYMVPGGQAEA

SEQ ID NO: 150590 - protein, 11 aa, West Nile virus
YMVPGGQAEAM

SEQ ID NO: 150591 - protein, 11 aa, West Nile virus
MIPGWQAEAMR

SEQ ID NO: 150592 - protein, 11 aa, West Nile virus
VPGWQAEAMRA

SEQ ID NO: 150593 - protein, 11 aa, West Nile virus
PGWQAEAMRAA

SEQ ID NO: 150594 - protein, 11 aa, West Nile virus
GWQAEAMRAAQ

SEQ ID NO: 150595 - protein, 11 aa, West Nile virus
WQAEAMRAAQR

SEQ ID NO: 150596 - protein, 11 aa, West Nile virus
QAEAMRAAQRR

SEQ ID NO: 150597 - protein, 11 aa, West Nile virus
AEAMRAAQRRT

SEQ ID NO: 150598 - protein, 11 aa, West Nile virus
EAMRAAQRRTA

SEQ ID NO: 150599 - protein, 11 aa, West Nile virus
AMRAAQRRTAA

SEQ ID NO: 150600 - protein, 11 aa, West Nile virus
MRAAQRRTAAG

SEQ ID NO: 150601 - protein, 11 aa, West Nile virus
RAAQRRTAAGI

SEQ ID NO: 150602 - protein, 11 aa, West Nile virus
AAQRRTAAGIM

SEQ ID NO: 150603 - protein, 11 aa, West Nile virus
RRTAAGIMKNV

SEQ ID NO: 150604 - protein, 11 aa, West Nile virus
RTAAGIMKNVV

SEQ ID NO: 150605 - protein, 11 aa, West Nile virus
TAAGIMKNVVV

SEQ ID NO: 150606 - protein, 11 aa, West Nile virus
AAGIMKNVVVD

SEQ ID NO: 150607 - protein, 11 aa, West Nile virus
AGIMKNAVIDG

SEQ ID NO: 150608 - protein, 11 aa, West Nile virus
GIMKNAVIDGM

SEQ ID NO: 150609 - protein, 11 aa, West Nile virus
IMKNVVVDGIV

SEQ ID NO: 150610 - protein, 11 aa, West Nile virus
MKNAVIDGMVA

SEQ ID NO: 150611 - protein, 11 aa, West Nile virus
KNAVIDGMVAT

SEQ ID NO: 150612 - protein, 11 aa, West Nile virus
NAVIDGMVATD

SEQ ID NO: 150613 - protein, 11 aa, West Nile virus
VVVDGIVATDV

SEQ ID NO: 150614 - protein, 11 aa, West Nile virus
VIDGMVATDVP

SEQ ID NO: 150615 - protein, 11 aa, West Nile virus
IDGMVATDVPE

SEQ ID NO: 150616 - protein, 11 aa, West Nile virus
DGMVATDVPEL

SEQ ID NO: 150617 - protein, 11 aa, West Nile virus
GMVATDVPELE

SEQ ID NO: 150618 - protein, 11 aa, West Nile virus
MVATDVPELER

SEQ ID NO: 150619 - protein, 11 aa, West Nile virus
VATDVPELERA

SEQ ID NO: 150620 - protein, 11 aa, West Nile virus
ATDVPELERAT

SEQ ID NO: 150621 - protein, 11 aa, West Nile virus
TDVPELERATP

SEQ ID NO: 150622 - protein, 11 aa, West Nile virus
DVPELERTTPV

SEQ ID NO: 150623 - protein, 11 aa, West Nile virus
VPELERTTPVM

SEQ ID NO: 150624 - protein, 11 aa, West Nile virus
PELERTTPVMQ

SEQ ID NO: 150625 - protein, 11 aa, West Nile virus
ELERTTPVMQK

SEQ ID NO: 150626 - protein, 11 aa, West Nile virus
LERTTPVMQKK

SEQ ID NO: 150627 - protein, 11 aa, West Nile virus
ERTTPVMQKKV

SEQ ID NO: 150628 - protein, 11 aa, West Nile virus
RTTPVMQKKVG

SEQ ID NO: 150629 - protein, 11 aa, West Nile virus
TTPVMQKKVGQ

SEQ ID NO: 150630 - protein, 11 aa, West Nile virus
TPVMQKKVGQI

SEQ ID NO: 150631 - protein, 11 aa, West Nile virus
PVMQKKVGQIM

SEQ ID NO: 150632 - protein, 11 aa, West Nile virus
VMQKKVGQIML

SEQ ID NO: 150633 - protein, 11 aa, West Nile virus
MQKKVGQVMLI

SEQ ID NO: 150634 - protein, 11 aa, West Nile virus
QKKVGQVMLIL

SEQ ID NO: 150635 - protein, 11 aa, West Nile virus
KKVGQVMLILV

SEQ ID NO: 150636 - protein, 11 aa, West Nile virus
KVGQVMLILVS

SEQ ID NO: 150637 - protein, 11 aa, West Nile virus
LILVSMAAVVV

SEQ ID NO: 150638 - protein, 11 aa, West Nile virus
ILVSMAAVVVN

SEQ ID NO: 150639 - protein, 11 aa, West Nile virus
LVSMAAVVVNP

SEQ ID NO: 150640 - protein, 11 aa, West Nile virus
VSMAAVVVNPS

SEQ ID NO: 150641 - protein, 11 aa, West Nile virus
SMAAVVVNPSV

SEQ ID NO: 150642 - protein, 11 aa, West Nile virus
AAVVVNPSVRT

SEQ ID NO: 150643 - protein, 11 aa, West Nile virus
AVVVNPSVRTV

SEQ ID NO: 150644 - protein, 11 aa, West Nile virus
VVVNPSVRTVR

SEQ ID NO: 150645 - protein, 11 aa, West Nile virus
VVNPSVRTVRE

SEQ ID NO: 150646 - protein, 11 aa, West Nile virus
VNPSVRTVREA

SEQ ID NO: 150647 - protein, 11 aa, West Nile virus
NPSVRTVREAG

SEQ ID NO: 150648 - protein, 11 aa, West Nile virus
PSVRTVREAGI

SEQ ID NO: 150649 - protein, 11 aa, West Nile virus
SVRTVREAGIL

SEQ ID NO: 150650 - protein, 11 aa, West Nile virus
TVREAGILTTA

SEQ ID NO: 150651 - protein, 11 aa, West Nile virus
VREAGILTTAA

SEQ ID NO: 150652 - protein, 11 aa, West Nile virus
REAGILTTAAA

SEQ ID NO: 150653 - protein, 11 aa, West Nile virus
EAGILTTAAAV

SEQ ID NO: 150654 - protein, 11 aa, West Nile virus
AGILTTAAAVT

SEQ ID NO: 150655 - protein, 11 aa, West Nile virus
GILTTAAAVTL

SEQ ID NO: 150656 - protein, 11 aa, West Nile virus
ILTTAAAVTLW

SEQ ID NO: 150657 - protein, 11 aa, West Nile virus
LTTAAAVTLWE

SEQ ID NO: 150658 - protein, 11 aa, West Nile virus
TTAAAVTLWEN

SEQ ID NO: 150659 - protein, 11 aa, West Nile virus
TAAAVTLWEKG

SEQ ID NO: 150660 - protein, 11 aa, West Nile virus
AAAVTLWEKGA

SEQ ID NO: 150661 - protein, 11 aa, West Nile virus
AAVTLWENGAG

SEQ ID NO: 150662 - protein, 11 aa, West Nile virus
AVTLWENGAGS

SEQ ID NO: 150663 - protein, 11 aa, West Nile virus
VTLWENGAGSV

SEQ ID NO: 150664 - protein, 11 aa, West Nile virus
TLWENGAGSVW

SEQ ID NO: 150665 - protein, 11 aa, West Nile virus
LWENGAGSVWN

SEQ ID NO: 150666 - protein, 11 aa, West Nile virus
WENGAGSVWNA

SEQ ID NO: 150667 - protein, 11 aa, West Nile virus
ENGAGSVWNAT

SEQ ID NO: 150668 - protein, 11 aa, West Nile virus
NGAGSVWNATT

SEQ ID NO: 150669 - protein, 11 aa, West Nile virus
GAGSVWNATTA

SEQ ID NO: 150670 - protein, 11 aa, West Nile virus
AGSVWNATTAI

SEQ ID NO: 150671 - protein, 11 aa, West Nile virus
GSVWNATTAIG

SEQ ID NO: 150672 - protein, 11 aa, West Nile virus
NATTAIGLCHV

SEQ ID NO: 150673 - protein, 11 aa, West Nile virus
ATTAIGLCHVM

SEQ ID NO: 150674 - protein, 11 aa, West Nile virus
TTAIGLCHVMR

SEQ ID NO: 150675 - protein, 11 aa, West Nile virus
TAIGLCHVMRG

SEQ ID NO: 150676 - protein, 11 aa, West Nile virus
AIGLCHVMRGG

SEQ ID NO: 150677 - protein, 11 aa, West Nile virus
IGLCHVMRGGW

SEQ ID NO: 150678 - protein, 11 aa, West Nile virus
GLCHVMRGGWL

SEQ ID NO: 150679 - protein, 11 aa, West Nile virus
LCHVMRGGWLS

SEQ ID NO: 150680 - protein, 11 aa, West Nile virus
CHVMRGGWLSC

SEQ ID NO: 150681 - protein, 11 aa, West Nile virus
HVMRGGWLSCL

SEQ ID NO: 150682 - protein, 11 aa, West Nile virus
VMRGGWLSCLS

SEQ ID NO: 150683 - protein, 11 aa, West Nile virus
MRGGWLSCLSM

SEQ ID NO: 150684 - protein, 11 aa, West Nile virus
RGGWLSCLSMT

SEQ ID NO: 150685 - protein, 11 aa, West Nile virus
GGWLSCLSIMW

SEQ ID NO: 150686 - protein, 11 aa, West Nile virus
GWLSCLSMTWT

SEQ ID NO: 150687 - protein, 11 aa, West Nile virus
WLSCLSMTWTL

SEQ ID NO: 150688 - protein, 11 aa, West Nile virus
KNMDKPGLKRG

SEQ ID NO: 150689 - protein, 11 aa, West Nile virus
NMDKPGLKRGG

SEQ ID NO: 150690 - protein, 11 aa, West Nile virus
MDKPGLKRGGA

SEQ ID NO: 150691 - protein, 11 aa, West Nile virus
DKPGLKRGGAK

SEQ ID NO: 150692 - protein, 11 aa, West Nile virus
KPVLKRGGAKG

SEQ ID NO: 150693 - protein, 11 aa, West Nile virus
PVLKRGGAKGR

SEQ ID NO: 150694 - protein, 11 aa, West Nile virus
VLKRGGAKGRT

SEQ ID NO: 150695 - protein, 11 aa, West Nile virus
KGRTLGEVWKD

SEQ ID NO: 150696 - protein, 11 aa, West Nile virus
GRTLGEVWKDR

SEQ ID NO: 150697 - protein, 11 aa, West Nile virus
RTLGEVWKDRL

SEQ ID NO: 150698 - protein, 11 aa, West Nile virus
TLGEVWKDRLN

SEQ ID NO: 150699 - protein, 11 aa, West Nile virus
LGEVWKERLNH

SEQ ID NO: 150700 - protein, 11 aa, West Nile virus
GEVWKERLNHM

SEQ ID NO: 150701 - protein, 11 aa, West Nile virus
EVWKERLNHMT

SEQ ID NO: 150702 - protein, 11 aa, West Nile virus
TKEEFIRYRKE

SEQ ID NO: 150703 - protein, 11 aa, West Nile virus
KEEFIRYRKEA

SEQ ID NO: 150704 - protein, 11 aa, West Nile virus
EEFIRYRKEAI

SEQ ID NO: 150705 - protein, 11 aa, West Nile virus
EFTRYRKEAIT

SEQ ID NO: 150706 - protein, 11 aa, West Nile virus
FTRYRKEAITE

SEQ ID NO: 150707 - protein, 11 aa, West Nile virus
TRYRKEAITEV

SEQ ID NO: 150708 - protein, 11 aa, West Nile virus
RYRKEAITEVD

SEQ ID NO: 150709 - protein, 11 aa, West Nile virus
YRKEAITEVDR

SEQ ID NO: 150710 - protein, 11 aa, West Nile virus
RKEAITEVDRS

SEQ ID NO: 150711 - protein, 11 aa, West Nile virus
KEAITEVDRSA

SEQ ID NO: 150712 - protein, 11 aa, West Nile virus
EAITEVDRSAA

SEQ ID NO: 150713 - protein, 11 aa, West Nile virus
AITEVDRSAAK

SEQ ID NO: 150714 - protein, 11 aa, West Nile virus
ARREGNITGGH

SEQ ID NO: 150715 - protein, 11 aa, West Nile virus
EGNITGGHPVS

SEQ ID NO: 150716 - protein, 11 aa, West Nile virus
GNITGGHPVSR

SEQ ID NO: 150717 - protein, 11 aa, West Nile virus
NITGGHPVSRG

SEQ ID NO: 150718 - protein, 11 aa, West Nile virus
ITGGHPVSRGT

SEQ ID NO: 150719 - protein, 11 aa, West Nile virus
TGGHSVSRGTA

SEQ ID NO: 150720 - protein, 11 aa, West Nile virus
GGHSVSRGTAK

SEQ ID NO: 150721 - protein, 11 aa, West Nile virus
GHSVSRGTAKL

SEQ ID NO: 150722 - protein, 11 aa, West Nile virus
HSVSRGTAKLR

SEQ ID NO: 150723 - protein, 11 aa, West Nile virus
SVSRGTAKLRW

SEQ ID NO: 150724 - protein, 11 aa, West Nile virus
LRWLVERRFLD

SEQ ID NO: 150725 - protein, 11 aa, West Nile virus
RWLVERRFLDP

SEQ ID NO: 150726 - protein, 11 aa, West Nile virus
WLVERRFLDPI

SEQ ID NO: 150727 - protein, 11 aa, West Nile virus
LVERRFLDPIG

SEQ ID NO: 150728 - protein, 11 aa, West Nile virus
VERRFLDPIGK

SEQ ID NO: 150729 - protein, 11 aa, West Nile virus
ERRFLDPIGKV

SEQ ID NO: 150730 - protein, 11 aa, West Nile virus
RRFLEPVGKVV

SEQ ID NO: 150731 - protein, 11 aa, West Nile virus
RFLEPVGKVVD

SEQ ID NO: 150732 - protein, 11 aa, West Nile virus
FLEPVGKVVDL

SEQ ID NO: 150733 - protein, 11 aa, West Nile virus
LEPVGKVVDLG

SEQ ID NO: 150734 - protein, 11 aa, West Nile virus
EPVGKVVDLGC

SEQ ID NO: 150735 - protein, 11 aa, West Nile virus
PVGKVVDLGCG

SEQ ID NO: 150736 - protein, 11 aa, West Nile virus
VGKVVDLGCGR

SEQ ID NO: 150737 - protein, 11 aa, West Nile virus
GKVVDLGCGRG

SEQ ID NO: 150738 - protein, 11 aa, West Nile virus
KVVDLGCGRGG

SEQ ID NO: 150739 - protein, 11 aa, West Nile virus
VVDLGCGRGGW

SEQ ID NO: 150740 - protein, 11 aa, West Nile virus
VDLGCGRGGWC

SEQ ID NO: 150741 - protein, 11 aa, West Nile virus
MATQKRVQEVK

SEQ ID NO: 150742 - protein, 11 aa, West Nile virus
ATQKRVQEVKG

SEQ ID NO: 150743 - protein, 11 aa, West Nile virus
TQKRVQEVKGY

SEQ ID NO: 150744 - protein, 11 aa, West Nile virus
QKRVQEVKGYT

SEQ ID NO: 150745 - protein, 11 aa, West Nile virus
KRVQEVKGYTK

SEQ ID NO: 150746 - protein, 11 aa, West Nile virus
RVQEVKGYTKG

SEQ ID NO: 150747 - protein, 11 aa, West Nile virus
VQEVKGYTKGG

SEQ ID NO: 150748 - protein, 11 aa, West Nile virus
QEVKGYTKGGP

SEQ ID NO: 150749 - protein, 11 aa, West Nile virus
EVKGYTKGGPG

SEQ ID NO: 150750 - protein, 11 aa, West Nile virus
VKGYTKGGPGH

SEQ ID NO: 150751 - protein, 11 aa, West Nile virus
KGYTKGGPGHE

SEQ ID NO: 150752 - protein, 11 aa, West Nile virus
PQLVQSYGWNT

SEQ ID NO: 150753 - protein, 11 aa, West Nile virus
QLVQSYGWNTV

SEQ ID NO: 150754 - protein, 11 aa, West Nile virus
LVQSYGWNTVT

SEQ ID NO: 150755 - protein, 11 aa, West Nile virus
VQSYGWNTVTM

SEQ ID NO: 150756 - protein, 11 aa, West Nile virus
QSYGWNTVTMK

SEQ ID NO: 150757 - protein, 11 aa, West Nile virus
SYGWNTVTMKS

SEQ ID NO: 150758 - protein, 11 aa, West Nile virus
YGWNTVTMKSG

SEQ ID NO: 150759 - protein, 11 aa, West Nile virus
GWNTVTMKSGV

SEQ ID NO: 150760 - protein, 11 aa, West Nile virus
WNTVTMKSGVD

SEQ ID NO: 150761 - protein, 11 aa, West Nile virus
NTVTMKSGVDV

SEQ ID NO: 150762 - protein, 11 aa, West Nile virus
TVTMKSGVDVY

SEQ ID NO: 150763 - protein, 11 aa, West Nile virus
VTMKSGVDVYY

SEQ ID NO: 150764 - protein, 11 aa, West Nile virus
TMKSGVDVYYR

SEQ ID NO: 150765 - protein, 11 aa, West Nile virus
MKSGVDVYYRA

SEQ ID NO: 150766 - protein, 11 aa, West Nile virus
KSGVDVYYRAS

SEQ ID NO: 150767 - protein, 11 aa, West Nile virus
SGVDVYYRASE

SEQ ID NO: 150768 - protein, 11 aa, West Nile virus
GVDVFYRPSEA

SEQ ID NO: 150769 - protein, 11 aa, West Nile virus
VDVFYRPSEAS

SEQ ID NO: 150770 - protein, 11 aa, West Nile virus
DVFYRPSEASD

SEQ ID NO: 150771 - protein, 11 aa, West Nile virus
VFYRPSEASDT

SEQ ID NO: 150772 - protein, 11 aa, West Nile virus
FYRPSEASDTL

SEQ ID NO: 150773 - protein, 11 aa, West Nile virus
YRPSEASDTLL

SEQ ID NO: 150774 - protein, 11 aa, West Nile virus
RPSEASDTLLC

SEQ ID NO: 150775 - protein, 11 aa, West Nile virus
PSEASDTLLCD

SEQ ID NO: 150776 - protein, 11 aa, West Nile virus
SEASDTLLCDI

SEQ ID NO: 150777 - protein, 11 aa, West Nile virus
EASDTLLCDIG

SEQ ID NO: 150778 - protein, 11 aa, West Nile virus
ASDTLLCDIGE

SEQ ID NO: 150779 - protein, 11 aa, West Nile virus
SDTLLCDIGES

SEQ ID NO: 150780 - protein, 11 aa, West Nile virus
DTLLCDIGESA

SEQ ID NO: 150781 - protein, 11 aa, West Nile virus
TLLCDIGESAS

SEQ ID NO: 150782 - protein, 11 aa, West Nile virus
LLCDIGESASS

SEQ ID NO: 150783 - protein, 11 aa, West Nile virus
LCDIGESASSA

SEQ ID NO: 150784 - protein, 11 aa, West Nile virus
CDIGESASSAE

SEQ ID NO: 150785 - protein, 11 aa, West Nile virus
DIGESASSAEV

SEQ ID NO: 150786 - protein, 11 aa, West Nile virus
IGESASSAEVE

SEQ ID NO: 150787 - protein, 11 aa, West Nile virus
GESASSAEVEE

SEQ ID NO: 150788 - protein, 11 aa, West Nile virus
ESASSAEVEEH

SEQ ID NO: 150789 - protein, 11 aa, West Nile virus
SASSAEVEEHR

SEQ ID NO: 150790 - protein, 11 aa, West Nile virus
ASSAEVEEHRT

SEQ ID NO: 150791 - protein, 11 aa, West Nile virus
SSAEVEEHRTV

SEQ ID NO: 150792 - protein, 11 aa, West Nile virus
SAEVEEHRTVR

SEQ ID NO: 150793 - protein, 11 aa, West Nile virus
AEVEEHRTVRV

SEQ ID NO: 150794 - protein, 11 aa, West Nile virus
EVEEHRTVRVL

SEQ ID NO: 150795 - protein, 11 aa, West Nile virus
VEEHRTVRVLE

SEQ ID NO: 150796 - protein, 11 aa, West Nile virus
EEHRTVRVLEM

SEQ ID NO: 150797 - protein, 11 aa, West Nile virus
EHRTVRVLEMV

SEQ ID NO: 150798 - protein, 11 aa, West Nile virus
HRTVRVLEMVE

SEQ ID NO: 150799 - protein, 11 aa, West Nile virus
RTVRVLEMVED

SEQ ID NO: 150800 - protein, 11 aa, West Nile virus
TVRVLEMVEDW

SEQ ID NO: 150801 - protein, 11 aa, West Nile virus
VRVLEMVEDWL

SEQ ID NO: 150802 - protein, 11 aa, West Nile virus
MVEDWLHRGPK

SEQ ID NO: 150803 - protein, 11 aa, West Nile virus
VEDWLHRGPKE

SEQ ID NO: 150804 - protein, 11 aa, West Nile virus
EDWLHRGPKEF

SEQ ID NO: 150805 - protein, 11 aa, West Nile virus
DWLHRGPKEFC

SEQ ID NO: 150806 - protein, 11 aa, West Nile virus
WLHRGPKEFCI

SEQ ID NO: 150807 - protein, 11 aa, West Nile virus
LHRGPKEFCIK

SEQ ID NO: 150808 - protein, 11 aa, West Nile virus
HRGPKEFCIKV

SEQ ID NO: 150809 - protein, 11 aa, West Nile virus
RGPKEFCIKVL

SEQ ID NO: 150810 - protein, 11 aa, West Nile virus
GPKEFCIKVLC

SEQ ID NO: 150811 - protein, 11 aa, West Nile virus
PKEFCIKVLCP

SEQ ID NO: 150812 - protein, 11 aa, West Nile virus
KEFCIKVLCPY

SEQ ID NO: 150813 - protein, 11 aa, West Nile virus
EFCIKVLCPYM

SEQ ID NO: 150814 - protein, 11 aa, West Nile virus
FCIKVLCPYMP

SEQ ID NO: 150815 - protein, 11 aa, West Nile virus
CIKVLCPYMPK

SEQ ID NO: 150816 - protein, 11 aa, West Nile virus
IKVLCPYMPKV

SEQ ID NO: 150817 - protein, 11 aa, West Nile virus
KVLCPYMPKVV

SEQ ID NO: 150818 - protein, 11 aa, West Nile virus
VLCPYMPRVIE

SEQ ID NO: 150819 - protein, 11 aa, West Nile virus
LCPYMPKVVEK

SEQ ID NO: 150820 - protein, 11 aa, West Nile virus
CPYMPRVIEKM

SEQ ID NO: 150821 - protein, 11 aa, West Nile virus
PYMPRVIEKME

SEQ ID NO: 150822 - protein, 11 aa, West Nile virus
YMPKVIEKMET

SEQ ID NO: 150823 - protein, 11 aa, West Nile virus
MPKVIEKMETL

SEQ ID NO: 150824 - protein, 11 aa, West Nile virus
PKVIEKMETLQ

SEQ ID NO: 150825 - protein, 11 aa, West Nile virus
VIEKMETLQRR

SEQ ID NO: 150826 - protein, 11 aa, West Nile virus
IEKMETLQRRY

SEQ ID NO: 150827 - protein, 11 aa, West Nile virus
EKMETLQRRYG

SEQ ID NO: 150828 - protein, 11 aa, West Nile virus
KMETLQRRYGG

SEQ ID NO: 150829 - protein, 11 aa, West Nile virus
METLQRRYGGG

SEQ ID NO: 150830 - protein, 11 aa, West Nile virus
ETLQRRYGGGL

SEQ ID NO: 150831 - protein, 11 aa, West Nile virus
LQRRYGGGLIR

SEQ ID NO: 150832 - protein, 11 aa, West Nile virus
QRRYGGGLIRN

SEQ ID NO: 150833 - protein, 11 aa, West Nile virus
RRYGGGLIRNP

SEQ ID NO: 150834 - protein, 11 aa, West Nile virus
RYGGGLIRNPL

SEQ ID NO: 150835 - protein, 11 aa, West Nile virus
YGGGLIRNPLS

SEQ ID NO: 150836 - protein, 11 aa, West Nile virus
GGGLIRNPLSR

SEQ ID NO: 150837 - protein, 11 aa, West Nile virus
GGLIRNPLSRN

SEQ ID NO: 150838 - protein, 11 aa, West Nile virus
GLIRNPLSRNS

SEQ ID NO: 150839 - protein, 11 aa, West Nile virus
LIRNPLSRNST

SEQ ID NO: 150840 - protein, 11 aa, West Nile virus
IRNPLSRNSTH

SEQ ID NO: 150841 - protein, 11 aa, West Nile virus
NSTHEMYWVSH

SEQ ID NO: 150842 - protein, 11 aa, West Nile virus
STHEMYWVSHA

SEQ ID NO: 150843 - protein, 11 aa, West Nile virus
THEMYWVSHAS

SEQ ID NO: 150844 - protein, 11 aa, West Nile virus
HEMYWVSHASG

SEQ ID NO: 150845 - protein, 11 aa, West Nile virus
EMYWVSHASGN

SEQ ID NO: 150846 - protein, 11 aa, West Nile virus
MYWVSHASGNI

SEQ ID NO: 150847 - protein, 11 aa, West Nile virus
YWVSHASGNIV

SEQ ID NO: 150848 - protein, 11 aa, West Nile virus
WVSHASGNIVH

SEQ ID NO: 150849 - protein, 11 aa, West Nile virus
NIVHSVNMTSQ

SEQ ID NO: 150850 - protein, 11 aa, West Nile virus
IVHSVNMTSQV

SEQ ID NO: 150851 - protein, 11 aa, West Nile virus
VNSVSMTSQVL

SEQ ID NO: 150852 - protein, 11 aa, West Nile virus
NSVSMTSQVLL

SEQ ID NO: 150853 - protein, 11 aa, West Nile virus
SVSMTSQVLLG

SEQ ID NO: 150854 - protein, 11 aa, West Nile virus
VSMTSQVLLGR

SEQ ID NO: 150855 - protein, 11 aa, West Nile virus
SMTSQVLLGRM

SEQ ID NO: 150856 - protein, 11 aa, West Nile virus
SQVLLGRMEKK

SEQ ID NO: 150857 - protein, 11 aa, West Nile virus
QVLLGRMEKKT

SEQ ID NO: 150858 - protein, 11 aa, West Nile virus
VLLGRMEKKTW

SEQ ID NO: 150859 - protein, 11 aa, West Nile virus
LLGRMEKKTWK

SEQ ID NO: 150860 - protein, 11 aa, West Nile virus
LGRMEKKTWKG

SEQ ID NO: 150861 - protein, 11 aa, West Nile virus
GRMEKKTWKGP

SEQ ID NO: 150862 - protein, 11 aa, West Nile virus
RMEKKTWKGPQ

SEQ ID NO: 150863 - protein, 11 aa, West Nile virus
MEKKTWKGPQF

SEQ ID NO: 150864 - protein, 11 aa, West Nile virus
EKKTWKGPQFE

SEQ ID NO: 150865 - protein, 11 aa, West Nile virus
KKTWKGPQFEE

SEQ ID NO: 150866 - protein, 11 aa, West Nile virus
KTWKGPQFEED

SEQ ID NO: 150867 - protein, 11 aa, West Nile virus
TWKGPQFEEDV

SEQ ID NO: 150868 - protein, 11 aa, West Nile virus
WKGPQFEEDVN

SEQ ID NO: 150869 - protein, 11 aa, West Nile virus
KGPQFEEDVNL

SEQ ID NO: 150870 - protein, 11 aa, West Nile virus
GPQFEEDVNLG

SEQ ID NO: 150871 - protein, 11 aa, West Nile virus
PQFEEDVNLGS

SEQ ID NO: 150872 - protein, 11 aa, West Nile virus
QFEEDVNLGSG

SEQ ID NO: 150873 - protein, 11 aa, West Nile virus
FEEDVNLGSGT

SEQ ID NO: 150874 - protein, 11 aa, West Nile virus
EEDANLGSGTR

SEQ ID NO: 150875 - protein, 11 aa, West Nile virus
EDANLGSGTRA

SEQ ID NO: 150876 - protein, 11 aa, West Nile virus
DANLGSGTRAV

SEQ ID NO: 150877 - protein, 11 aa, West Nile virus
ANLGSGTRAVG

SEQ ID NO: 150878 - protein, 11 aa, West Nile virus
SLGSGTRAVGK

SEQ ID NO: 150879 - protein, 11 aa, West Nile virus
GTRAVGKPLLS

SEQ ID NO: 150880 - protein, 11 aa, West Nile virus
TRAVGRPLLNS

SEQ ID NO: 150881 - protein, 11 aa, West Nile virus
RAVGKPLLSSD

SEQ ID NO: 150882 - protein, 11 aa, West Nile virus
AVGKPLLSSDT

SEQ ID NO: 150883 - protein, 11 aa, West Nile virus
VGKPLLNSDTG

SEQ ID NO: 150884 - protein, 11 aa, West Nile virus
GKPLLNSDTGK

SEQ ID NO: 150885 - protein, 11 aa, West Nile virus
KPLLNSDTGKI

SEQ ID NO: 150886 - protein, 11 aa, West Nile virus
PLLNSDTGKIR

SEQ ID NO: 150887 - protein, 11 aa, West Nile virus
DANHPYRTWNY

SEQ ID NO: 150888 - protein, 11 aa, West Nile virus
ANHPYRTWNYH

SEQ ID NO: 150889 - protein, 11 aa, West Nile virus
YRTWNYHGSYE

SEQ ID NO: 150890 - protein, 11 aa, West Nile virus
RTWNYHGSYEV

SEQ ID NO: 150891 - protein, 11 aa, West Nile virus
TWNYHGSYDVR

SEQ ID NO: 150892 - protein, 11 aa, West Nile virus
WNYHGSYDVRP

SEQ ID NO: 150893 - protein, 11 aa, West Nile virus
NYHGSYDVRPT

SEQ ID NO: 150894 - protein, 11 aa, West Nile virus
YHGSYDVRPTG

SEQ ID NO: 150895 - protein, 11 aa, West Nile virus
HGSYDVRPTGS

SEQ ID NO: 150896 - protein, 11 aa, West Nile virus
GSYDVRPTGSA

SEQ ID NO: 150897 - protein, 11 aa, West Nile virus
SYDVRPTGSAS

SEQ ID NO: 150898 - protein, 11 aa, West Nile virus
YDVRPTGSASS

SEQ ID NO: 150899 - protein, 11 aa, West Nile virus
DVRPTGSASSL

SEQ ID NO: 150900 - protein, 11 aa, West Nile virus
VRPTGSASSLV

SEQ ID NO: 150901 - protein, 11 aa, West Nile virus
RPTGSASSLVN

SEQ ID NO: 150902 - protein, 11 aa, West Nile virus
RLLSKPWDVIT

SEQ ID NO: 150903 - protein, 11 aa, West Nile virus
LLSKPWDTITS

SEQ ID NO: 150904 - protein, 11 aa, West Nile virus
LSKPWDVITNV

SEQ ID NO: 150905 - protein, 11 aa, West Nile virus
SKPWDTITSVT

SEQ ID NO: 150906 - protein, 11 aa, West Nile virus
KPWDVITNVTT

SEQ ID NO: 150907 - protein, 11 aa, West Nile virus
PWDTIMNVTTM

SEQ ID NO: 150908 - protein, 11 aa, West Nile virus
WDVITNVTTMA

SEQ ID NO: 150909 - protein, 11 aa, West Nile virus
DTITSVTTMAM

SEQ ID NO: 150910 - protein, 11 aa, West Nile virus
TITSVTTMAMT

SEQ ID NO: 150911 - protein, 11 aa, West Nile virus
IMNVTTMAMTD

SEQ ID NO: 150912 - protein, 11 aa, West Nile virus
TSVTTMAMTDT

SEQ ID NO: 150913 - protein, 11 aa, West Nile virus
EKVDTKAPEPA

SEQ ID NO: 150914 - protein, 11 aa, West Nile virus
KVDTKAPEPAE

SEQ ID NO: 150915 - protein, 11 aa, West Nile virus
VDTKAPEPAEG

SEQ ID NO: 150916 - protein, 11 aa, West Nile virus
DTKAPEPAEGV

SEQ ID NO: 150917 - protein, 11 aa, West Nile virus
TKAPEPAEGVK

SEQ ID NO: 150918 - protein, 11 aa, West Nile virus
VLNETTNWLWT

SEQ ID NO: 150919 - protein, 11 aa, West Nile virus
LNETTNWLWTF

SEQ ID NO: 150920 - protein, 11 aa, West Nile virus
NETTNWLWTFL

SEQ ID NO: 150921 - protein, 11 aa, West Nile virus
ETTNWLWTFLA

SEQ ID NO: 150922 - protein, 11 aa, West Nile virus
TTNWLWTFLAR

SEQ ID NO: 150923 - protein, 11 aa, West Nile virus
RDKKPRMCSRE

SEQ ID NO: 150924 - protein, 11 aa, West Nile virus
DKKPRMCSREE

SEQ ID NO: 150925 - protein, 11 aa, West Nile virus
KKPRMCSREEF

SEQ ID NO: 150926 - protein, 11 aa, West Nile virus
KPRMCSREEFI

SEQ ID NO: 150927 - protein, 11 aa, West Nile virus
PRMCSREEFIG

SEQ ID NO: 150928 - protein, 11 aa, West Nile virus
RMCSREEFIGK

SEQ ID NO: 150929 - protein, 11 aa, West Nile virus
MCSREEFIGKV

SEQ ID NO: 150930 - protein, 11 aa, West Nile virus
CSREEFIGKVN

SEQ ID NO: 150931 - protein, 11 aa, West Nile virus
SREEFIGKVNS

SEQ ID NO: 150932 - protein, 11 aa, West Nile virus
REEFIGKVNSN

SEQ ID NO: 150933 - protein, 11 aa, West Nile virus
EEFIGKVNSNA

SEQ ID NO: 150934 - protein, 11 aa, West Nile virus
EFIGKVNSNAA

SEQ ID NO: 150935 - protein, 11 aa, West Nile virus
FIGKVNSNAAL

SEQ ID NO: 150936 - protein, 11 aa, West Nile virus
IGKVNSNAALG

SEQ ID NO: 150937 - protein, 11 aa, West Nile virus
GKVNSNAALGA

SEQ ID NO: 150938 - protein, 11 aa, West Nile virus
GAMFEEQNQWK

SEQ ID NO: 150939 - protein, 11 aa, West Nile virus
AMFEEQNQWKN

SEQ ID NO: 150940 - protein, 11 aa, West Nile virus
MFEEQNQWKNA

SEQ ID NO: 150941 - protein, 11 aa, West Nile virus
FEEQNQWKNAR

SEQ ID NO: 150942 - protein, 11 aa, West Nile virus
EEQNQWKNARE

SEQ ID NO: 150943 - protein, 11 aa, West Nile virus
EQNQWKNAREA

SEQ ID NO: 150944 - protein, 11 aa, West Nile virus
QNQWKNAREAV

SEQ ID NO: 150945 - protein, 11 aa, West Nile virus
NQWKNAREAVE

SEQ ID NO: 150946 - protein, 11 aa, West Nile virus
QWKNAREAVED

SEQ ID NO: 150947 - protein, 11 aa, West Nile virus
NAREAVEDPKF

SEQ ID NO: 150948 - protein, 11 aa, West Nile virus
ARAAVEDPKFW

SEQ ID NO: 150949 - protein, 11 aa, West Nile virus
RAAVEDPKFWE

SEQ ID NO: 150950 - protein, 11 aa, West Nile virus
AAVEDPKFWEI

SEQ ID NO: 150951 - protein, 11 aa, West Nile virus
AVEDPKFWEIV

SEQ ID NO: 150952 - protein, 11 aa, West Nile virus
VEDLKFWEMVD

SEQ ID NO: 150953 - protein, 11 aa, West Nile virus
EDPKFWEMVDD

SEQ ID NO: 150954 - protein, 11 aa, West Nile virus
DPKFWEMVDDE

SEQ ID NO: 150955 - protein, 11 aa, West Nile virus
PKFWEMVDDER

SEQ ID NO: 150956 - protein, 11 aa, West Nile virus
KFWEMVDDERE

SEQ ID NO: 150957 - protein, 11 aa, West Nile virus
FWEMVDDEREA

SEQ ID NO: 150958 - protein, 11 aa, West Nile virus
WEMVDDEREAH

SEQ ID NO: 150959 - protein, 11 aa, West Nile virus
EMVDDEREAHL

SEQ ID NO: 150960 - protein, 11 aa, West Nile virus
MVDDEREAHLR

SEQ ID NO: 150961 - protein, 11 aa, West Nile virus
VDDEREAHLRG

SEQ ID NO: 150962 - protein, 11 aa, West Nile virus
DDEREAHLRGE

SEQ ID NO: 150963 - protein, 11 aa, West Nile virus
DEREAHLRGEC

SEQ ID NO: 150964 - protein, 11 aa, West Nile virus
EREAHLRGECN

SEQ ID NO: 150965 - protein, 11 aa, West Nile virus
REAHLRGECNT

SEQ ID NO: 150966 - protein, 11 aa, West Nile virus
EAHLRGECNTC

SEQ ID NO: 150967 - protein, 11 aa, West Nile virus
AHLRGECNTCI

SEQ ID NO: 150968 - protein, 11 aa, West Nile virus
HLRGECNTCIY

SEQ ID NO: 150969 - protein, 11 aa, West Nile virus
LRGECNTCIYN

SEQ ID NO: 150970 - protein, 11 aa, West Nile virus
RGECNTCIYNM

SEQ ID NO: 150971 - protein, 11 aa, West Nile virus
GECNTCIYNMM

SEQ ID NO: 150972 - protein, 11 aa, West Nile virus
ECNTCIYNMMG

SEQ ID NO: 150973 - protein, 11 aa, West Nile virus
CNTCIYNMMGK

SEQ ID NO: 150974 - protein, 11 aa, West Nile virus
NTCIYNMMGKR

SEQ ID NO: 150975 - protein, 11 aa, West Nile virus
EKKPGEFGKAR

SEQ ID NO: 150976 - protein, 11 aa, West Nile virus
KRPGDFGKAKG

SEQ ID NO: 150977 - protein, 11 aa, West Nile virus
KPGEFGKARGS

SEQ ID NO: 150978 - protein, 11 aa, West Nile virus
PGEFGKARGSR

SEQ ID NO: 150979 - protein, 11 aa, West Nile virus
GEFGKARGSRA

SEQ ID NO: 150980 - protein, 11 aa, West Nile virus
EFGKARGSRAI

SEQ ID NO: 150981 - protein, 11 aa, West Nile virus
FLNEDHWLGRE

SEQ ID NO: 150982 - protein, 11 aa, West Nile virus
LNEDHWLGREN

SEQ ID NO: 150983 - protein, 11 aa, West Nile virus
NEDHWLGRENS

SEQ ID NO: 150984 - protein, 11 aa, West Nile virus
EDHWLGRENSG

SEQ ID NO: 150985 - protein, 11 aa, West Nile virus
DHWLGRENSGG

SEQ ID NO: 150986 - protein, 11 aa, West Nile virus
HWLGRENSGGG

SEQ ID NO: 150987 - protein, 11 aa, West Nile virus
WLGRENSGGGV

SEQ ID NO: 150988 - protein, 11 aa, West Nile virus
LGRENSGGGVE

SEQ ID NO: 150989 - protein, 11 aa, West Nile virus
GRENSGGGVEG

SEQ ID NO: 150990 - protein, 11 aa, West Nile virus
RENSGGGVEGL

SEQ ID NO: 150991 - protein, 11 aa, West Nile virus
ENSGGGVEGLG

SEQ ID NO: 150992 - protein, 11 aa, West Nile virus
EGLGLQKLGYV

SEQ ID NO: 150993 - protein, 11 aa, West Nile virus
GLGLQKLGYVL

SEQ ID NO: 150994 - protein, 11 aa, West Nile virus
LGLQKLGYILK

SEQ ID NO: 150995 - protein, 11 aa, West Nile virus
GLQKLGYILKE

SEQ ID NO: 150996 - protein, 11 aa, West Nile virus
LQKLGYILKEV

SEQ ID NO: 150997 - protein, 11 aa, West Nile virus
QKLGYILKEVG

SEQ ID NO: 150998 - protein, 11 aa, West Nile virus
GGKMYADDTAG

SEQ ID NO: 150999 - protein, 11 aa, West Nile virus
GKMYADDTAGW

SEQ ID NO: 151000 - protein, 11 aa, West Nile virus
KMYADDTAGWD

SEQ ID NO: 151001 - protein, 11 aa, West Nile virus
MYADDTAGWDT

SEQ ID NO: 151002 - protein, 11 aa, West Nile virus
DTAGWDTRITK

SEQ ID NO: 151003 - protein, 11 aa, West Nile virus
TAGWDTRITKA

SEQ ID NO: 151004 - protein, 11 aa, West Nile virus
AGWDTRITKAD

SEQ ID NO: 151005 - protein, 11 aa, West Nile virus
GWDTRITKADL

SEQ ID NO: 151006 - protein, 11 aa, West Nile virus
WDTRITKADLE

SEQ ID NO: 151007 - protein, 11 aa, West Nile virus
DTRITKADLEN

SEQ ID NO: 151008 - protein, 11 aa, West Nile virus
TRITKADLENE

SEQ ID NO: 151009 - protein, 11 aa, West Nile virus
RITKADLENEA

SEQ ID NO: 151010 - protein, 11 aa, West Nile virus
ITKADLENEAK

SEQ ID NO: 151011 - protein, 11 aa, West Nile virus
TKADLENEAKV

SEQ ID NO: 151012 - protein, 11 aa, West Nile virus
KADLENEAKVL

SEQ ID NO: 151013 - protein, 11 aa, West Nile virus
DLENEAKVLEF

SEQ ID NO: 151014 - protein, 11 aa, West Nile virus
LENEAKVLEFL

SEQ ID NO: 151015 - protein, 11 aa, West Nile virus
ENEAKVLEFLD

SEQ ID NO: 151016 - protein, 11 aa, West Nile virus
NEAKVLEFLDG

SEQ ID NO: 151017 - protein, 11 aa, West Nile virus
EAKVLEFLDGE

SEQ ID NO: 151018 - protein, 11 aa, West Nile virus
AKVLEFLDGEH

SEQ ID NO: 151019 - protein, 11 aa, West Nile virus
KVLEFLDGEHR

SEQ ID NO: 151020 - protein, 11 aa, West Nile virus
VLEFLDGEHRR

SEQ ID NO: 151021 - protein, 11 aa, West Nile virus
LEFLDGEHRRL

SEQ ID NO: 151022 - protein, 11 aa, West Nile virus
EFLDGEHRRLA

SEQ ID NO: 151023 - protein, 11 aa, West Nile virus
FLDGEHRRLAR

SEQ ID NO: 151024 - protein, 11 aa, West Nile virus
LDGEHRRLARS

SEQ ID NO: 151025 - protein, 11 aa, West Nile virus
DGEHRRLARSI

SEQ ID NO: 151026 - protein, 11 aa, West Nile virus
GEHRRLARSII

SEQ ID NO: 151027 - protein, 11 aa, West Nile virus
EHRRLARSIIE

SEQ ID NO: 151028 - protein, 11 aa, West Nile virus
HRRLARSIIEL

SEQ ID NO: 151029 - protein, 11 aa, West Nile virus
RRLARSIIELT

SEQ ID NO: 151030 - protein, 11 aa, West Nile virus
RLARSIIELTY

SEQ ID NO: 151031 - protein, 11 aa, West Nile virus
LARSIIELTYR

SEQ ID NO: 151032 - protein, 11 aa, West Nile virus
ARSIIELTYRH

SEQ ID NO: 151033 - protein, 11 aa, West Nile virus
RSIIELTYRHK

SEQ ID NO: 151034 - protein, 11 aa, West Nile virus
SIIELTYRHKV

SEQ ID NO: 151035 - protein, 11 aa, West Nile virus
VIELTYRHKVV

SEQ ID NO: 151036 - protein, 11 aa, West Nile virus
IELTYCHKVVK

SEQ ID NO: 151037 - protein, 11 aa, West Nile virus
ELTYRYKVVKV

SEQ ID NO: 151038 - protein, 11 aa, West Nile virus
LTYCHKVVKVM

SEQ ID NO: 151039 - protein, 11 aa, West Nile virus
TYCHKVVKVMR

SEQ ID NO: 151040 - protein, 11 aa, West Nile virus
YCHKVVKVMRP

SEQ ID NO: 151041 - protein, 11 aa, West Nile virus
CHKVVKVMRPA

SEQ ID NO: 151042 - protein, 11 aa, West Nile virus
HKVVKVMRPAV

SEQ ID NO: 151043 - protein, 11 aa, West Nile virus
KVVKVMRPAVG

SEQ ID NO: 151044 - protein, 11 aa, West Nile virus
VVKVMRPAVGG

SEQ ID NO: 151045 - protein, 11 aa, West Nile virus
VKVMRPAADGK

SEQ ID NO: 151046 - protein, 11 aa, West Nile virus
KVMRPAADGKT

SEQ ID NO: 151047 - protein, 11 aa, West Nile virus
VMRPAADGKTV

SEQ ID NO: 151048 - protein, 11 aa, West Nile virus
MRPAADGKTVM

SEQ ID NO: 151049 - protein, 11 aa, West Nile virus
RPAADGKTVMD

SEQ ID NO: 151050 - protein, 11 aa, West Nile virus
PAADGKTVMDV

SEQ ID NO: 151051 - protein, 11 aa, West Nile virus
AADGKTVMDVI

SEQ ID NO: 151052 - protein, 11 aa, West Nile virus
ADGKTVMDVIS

SEQ ID NO: 151053 - protein, 11 aa, West Nile virus
DGKTVMDVISR

SEQ ID NO: 151054 - protein, 11 aa, West Nile virus
GKTVMDVISRE

SEQ ID NO: 151055 - protein, 11 aa, West Nile virus
KTVMDVISRED

SEQ ID NO: 151056 - protein, 11 aa, West Nile virus
TVMDIISREDQ

SEQ ID NO: 151057 - protein, 11 aa, West Nile virus
VMDIISREDQR

SEQ ID NO: 151058 - protein, 11 aa, West Nile virus
MDIISREDQRG

SEQ ID NO: 151059 - protein, 11 aa, West Nile virus
DIISREDQRGS

SEQ ID NO: 151060 - protein, 11 aa, West Nile virus
IISREDQRGSG

SEQ ID NO: 151061 - protein, 11 aa, West Nile virus
SGQVVTYALNP

SEQ ID NO: 151062 - protein, 11 aa, West Nile virus
GQVVTYALNPF

SEQ ID NO: 151063 - protein, 11 aa, West Nile virus
QVVTYALNPFS

SEQ ID NO: 151064 - protein, 11 aa, West Nile virus
VVTYALNPFTN

SEQ ID NO: 151065 - protein, 11 aa, West Nile virus
VTYALNPFTNL

SEQ ID NO: 151066 - protein, 11 aa, West Nile virus
TYALNTFTNLS

SEQ ID NO: 151067 - protein, 11 aa, West Nile virus
YALNTFTNLSV

SEQ ID NO: 151068 - protein, 11 aa, West Nile virus
ALNTFTNLSVQ

SEQ ID NO: 151069 - protein, 11 aa, West Nile virus
LNTFTNLSVQL

SEQ ID NO: 151070 - protein, 11 aa, West Nile virus
NTFTNLSVQLV

SEQ ID NO: 151071 - protein, 11 aa, West Nile virus
TFTNLSVQLVR

SEQ ID NO: 151072 - protein, 11 aa, West Nile virus
FTNLSVQLVRM

SEQ ID NO: 151073 - protein, 11 aa, West Nile virus
TNLSVQLVRMM

SEQ ID NO: 151074 - protein, 11 aa, West Nile virus
NLSVQLVRMME

SEQ ID NO: 151075 - protein, 11 aa, West Nile virus
LSVQLVRMMEG

SEQ ID NO: 151076 - protein, 11 aa, West Nile virus
SVQLVRMMEGE

SEQ ID NO: 151077 - protein, 11 aa, West Nile virus
FQLGRRREGEG

SEQ ID NO: 151078 - protein, 11 aa, West Nile virus
QLVRRREGEGV

SEQ ID NO: 151079 - protein, 11 aa, West Nile virus
LVRMMEGEGVV

SEQ ID NO: 151080 - protein, 11 aa, West Nile virus
VRMMEGEGVVG

SEQ ID NO: 151081 - protein, 11 aa, West Nile virus
RMMEGEGVVGP

SEQ ID NO: 151082 - protein, 11 aa, West Nile virus
MMEGEGVVGPD

SEQ ID NO: 151083 - protein, 11 aa, West Nile virus
MEGEGVVGPDD

SEQ ID NO: 151084 - protein, 11 aa, West Nile virus
EGEGVVGPDDV

SEQ ID NO: 151085 - protein, 11 aa, West Nile virus
GEGVVGPDDVE

SEQ ID NO: 151086 - protein, 11 aa, West Nile virus
KGKGVKVRVWL
